United States Patent 7,314,750 (ADDRESSABLE OLIGONUCLEOTIDE ARRAY OF THE RAT GENOME) - sequence listing, part 7

SEQ ID NO: 227447 - DNA, 25 bp, Rattus norvegicus
cagaaagctacatcatcgccggtgc

SEQ ID NO: 227448 - DNA, 25 bp, Rattus norvegicus
cagaaagctccgagcatgcagccct

SEQ ID NO: 227449 - DNA, 25 bp, Rattus norvegicus
cagaaagctccgtgcatgcagccct

SEQ ID NO: 227450 - DNA, 25 bp, Rattus norvegicus
cagaaagctggtcttcccactgcag

SEQ ID NO: 227451 - DNA, 25 bp, Rattus norvegicus
cagaaagctggtgttcccactgcag

SEQ ID NO: 227452 - DNA, 25 bp, Rattus norvegicus
cagaaagcttgcactgttcttacag

SEQ ID NO: 227453 - DNA, 25 bp, Rattus norvegicus
cagaaagcttgctctgttcttacag

SEQ ID NO: 227454 - DNA, 25 bp, Rattus norvegicus
cagaaaggcagtaccggtttggtgt

SEQ ID NO: 227455 - DNA, 25 bp, Rattus norvegicus
cagaaaggcagttccggtttggtgt

SEQ ID NO: 227456 - DNA, 25 bp, Rattus norvegicus
cagaaagggatgaaggccttctcca

SEQ ID NO: 227457 - DNA, 25 bp, Rattus norvegicus
cagaaagggatgtaggccttctcca

SEQ ID NO: 227458 - DNA, 25 bp, Rattus norvegicus
cagaaagtctgtcctcactgtcttc

SEQ ID NO: 227459 - DNA, 25 bp, Rattus norvegicus
cagaaagtctgtgctcactgtcttc

SEQ ID NO: 227460 - DNA, 25 bp, Rattus norvegicus
cagaaagtgcagactgtcggtcaga

SEQ ID NO: 227461 - DNA, 25 bp, Rattus norvegicus
cagaaagtgcagtctgtcggtcaga

SEQ ID NO: 227462 - DNA, 25 bp, Rattus norvegicus
cagaaagtggtgctcagttgtagaa

SEQ ID NO: 227463 - DNA, 25 bp, Rattus norvegicus
cagaaagtggtggtcagttgtagaa

SEQ ID NO: 227464 - DNA, 25 bp, Rattus norvegicus
cagaaagtgttcatggcccaggctc

SEQ ID NO: 227465 - DNA, 25 bp, Rattus norvegicus
cagaaagtgttcttggcccaggctc

SEQ ID NO: 227466 - DNA, 25 bp, Rattus norvegicus
cagaaagttagtctccctcgagcag

SEQ ID NO: 227467 - DNA, 25 bp, Rattus norvegicus
cagaaagttagtgtccctcgagcag

SEQ ID NO: 227468 - DNA, 25 bp, Rattus norvegicus
cagaaagttcctatgtttcctcctt

SEQ ID NO: 227469 - DNA, 25 bp, Rattus norvegicus
cagaaagttcctcctggagtgcaaa

SEQ ID NO: 227470 - DNA, 25 bp, Rattus norvegicus
cagaaagttcctgctggagtgcaaa

SEQ ID NO: 227471 - DNA, 25 bp, Rattus norvegicus
cagaaagttcctttgtttcctcctt

SEQ ID NO: 227472 - DNA, 25 bp, Rattus norvegicus
cagaaagtttccactaatatacgcc

SEQ ID NO: 227473 - DNA, 25 bp, Rattus norvegicus
cagaaagtttcctctaatatacgcc

SEQ ID NO: 227474 - DNA, 25 bp, Rattus norvegicus
cagaaatatgacaactgcaccaagc

SEQ ID NO: 227475 - DNA, 25 bp, Rattus norvegicus
cagaaatatgactactgcaccaagc

SEQ ID NO: 227476 - DNA, 25 bp, Rattus norvegicus
cagaaatatttgcttgacttcaaca

SEQ ID NO: 227477 - DNA, 25 bp, Rattus norvegicus
cagaaatatttggttgacttcaaca

SEQ ID NO: 227478 - DNA, 25 bp, Rattus norvegicus
cagaaatcccttacttatcccagca

SEQ ID NO: 227479 - DNA, 25 bp, Rattus norvegicus
cagaaatccctttcttatcccagca

SEQ ID NO: 227480 - DNA, 25 bp, Rattus norvegicus
cagaaatctgaaacctgtgggaatt

SEQ ID NO: 227481 - DNA, 25 bp, Rattus norvegicus
cagaaatctgaatcctgtgggaatt

SEQ ID NO: 227482 - DNA, 25 bp, Rattus norvegicus
cagaaatctgggagtgccacgggct

SEQ ID NO: 227483 - DNA, 25 bp, Rattus norvegicus
cagaaatctgggtgtgccacgggct

SEQ ID NO: 227484 - DNA, 25 bp, Rattus norvegicus
cagaaatcttgtctcaaggtcctag

SEQ ID NO: 227485 - DNA, 25 bp, Rattus norvegicus
cagaaatcttgtgtcaaggtcctag

SEQ ID NO: 227486 - DNA, 25 bp, Rattus norvegicus
cagaaatctttcaaactccctttct

SEQ ID NO: 227487 - DNA, 25 bp, Rattus norvegicus
cagaaatctttctaactccctttct

SEQ ID NO: 227488 - DNA, 25 bp, Rattus norvegicus
cagaaatgaccccaggatccctcta

SEQ ID NO: 227489 - DNA, 25 bp, Rattus norvegicus
cagaaatgacccgaggatccctcta

SEQ ID NO: 227490 - DNA, 25 bp, Rattus norvegicus
cagaaatgcatcagggagtcgccac

SEQ ID NO: 227491 - DNA, 25 bp, Rattus norvegicus
cagaaatgcatctgggagtcgccac

SEQ ID NO: 227492 - DNA, 25 bp, Rattus norvegicus
cagaaatgtcttaagcaccgcggat

SEQ ID NO: 227493 - DNA, 25 bp, Rattus norvegicus
cagaaatgtctttagcaccgcggat

SEQ ID NO: 227494 - DNA, 25 bp, Rattus norvegicus
cagaaatgttacatttgttccaata

SEQ ID NO: 227495 - DNA, 25 bp, Rattus norvegicus
cagaaatgttacttttgttccaata

SEQ ID NO: 227496 - DNA, 25 bp, Rattus norvegicus
cagaaattcacgaccaatggtcaaa

SEQ ID NO: 227497 - DNA, 25 bp, Rattus norvegicus
cagaaattcacgtccaatggtcaaa

SEQ ID NO: 227498 - DNA, 25 bp, Rattus norvegicus
cagaaattctctcagattccccatt

SEQ ID NO: 227499 - DNA, 25 bp, Rattus norvegicus
cagaaattctctgagattccccatt

SEQ ID NO: 227500 - DNA, 25 bp, Rattus norvegicus
cagaaattcttgagcatactatgta

SEQ ID NO: 227501 - DNA, 25 bp, Rattus norvegicus
cagaaattcttgtgcatactatgta

SEQ ID NO: 227502 - DNA, 25 bp, Rattus norvegicus
cagaacacatttacctcctgttaga

SEQ ID NO: 227503 - DNA, 25 bp, Rattus norvegicus
cagaacacattttcctcctgttaga

SEQ ID NO: 227504 - DNA, 25 bp, Rattus norvegicus
cagaacaccccgagatgagaggaga

SEQ ID NO: 227505 - DNA, 25 bp, Rattus norvegicus
cagaacaccccgtgatgagaggaga

SEQ ID NO: 227506 - DNA, 25 bp, Rattus norvegicus
cagaacacccttcttgcccttaaag

SEQ ID NO: 227507 - DNA, 25 bp, Rattus norvegicus
cagaacacccttgttgcccttaaag

SEQ ID NO: 227508 - DNA, 25 bp, Rattus norvegicus
cagaacacggcaattggcacctttt

SEQ ID NO: 227509 - DNA, 25 bp, Rattus norvegicus
cagaacacggcatttggcacctttt

SEQ ID NO: 227510 - DNA, 25 bp, Rattus norvegicus
cagaacactctaacagccttaatgg

SEQ ID NO: 227511 - DNA, 25 bp, Rattus norvegicus
cagaacactctatcagccttaatgg

SEQ ID NO: 227512 - DNA, 25 bp, Rattus norvegicus
cagaacactgttccgtctcagggat

SEQ ID NO: 227513 - DNA, 25 bp, Rattus norvegicus
cagaacactgttgcgtctcagggat

SEQ ID NO: 227514 - DNA, 25 bp, Rattus norvegicus
cagaacagacctcggtgctagccag

SEQ ID NO: 227515 - DNA, 25 bp, Rattus norvegicus
cagaacagacctgggtgctagccag

SEQ ID NO: 227516 - DNA, 25 bp, Rattus norvegicus
cagaacagcgagagggatcgaggcg

SEQ ID NO: 227517 - DNA, 25 bp, Rattus norvegicus
cagaacagcgagtgggatcgaggcg

SEQ ID NO: 227518 - DNA, 25 bp, Rattus norvegicus
cagaacagcgctatcaatatgaagt

SEQ ID NO: 227519 - DNA, 25 bp, Rattus norvegicus
cagaacagcgctttcaatatgaagt

SEQ ID NO: 227520 - DNA, 25 bp, Rattus norvegicus
cagaacagctgtatcgtttggagat

SEQ ID NO: 227521 - DNA, 25 bp, Rattus norvegicus
cagaacagctgtttcgtttggagat

SEQ ID NO: 227522 - DNA, 25 bp, Rattus norvegicus
cagaacagggcgcagctcgactttg

SEQ ID NO: 227523 - DNA, 25 bp, Rattus norvegicus
cagaacagggcggagctcgactttg

SEQ ID NO: 227524 - DNA, 25 bp, Rattus norvegicus
cagaacaggtgacgctcccgggatt

SEQ ID NO: 227525 - DNA, 25 bp, Rattus norvegicus
cagaacaggtgaggctcccgggatt

SEQ ID NO: 227526 - DNA, 25 bp, Rattus norvegicus
cagaacagtacacctttgggtccct

SEQ ID NO: 227527 - DNA, 25 bp, Rattus norvegicus
cagaacagtacagctttgggtccct

SEQ ID NO: 227528 - DNA, 25 bp, Rattus norvegicus
cagaacatcatcaccaggagagaaa

SEQ ID NO: 227529 - DNA, 25 bp, Rattus norvegicus
cagaacatcatctccaggagagaaa

SEQ ID NO: 227530 - DNA, 25 bp, Rattus norvegicus
cagaacatccgtatgctgataagtg

SEQ ID NO: 227531 - DNA, 25 bp, Rattus norvegicus
cagaacatccgtttgctgataagtg

SEQ ID NO: 227532 - DNA, 25 bp, Rattus norvegicus
cagaacatctgtaccttgtttgtat

SEQ ID NO: 227533 - DNA, 25 bp, Rattus norvegicus
cagaacatctgttccttgtttgtat

SEQ ID NO: 227534 - DNA, 25 bp, Rattus norvegicus
cagaacatttaactaaacttcggat

SEQ ID NO: 227535 - DNA, 25 bp, Rattus norvegicus
cagaacatttaagtaaacttcggat

SEQ ID NO: 227536 - DNA, 25 bp, Rattus norvegicus
cagaacatttctaaggactccgagc

SEQ ID NO: 227537 - DNA, 25 bp, Rattus norvegicus
cagaacatttcttaggactccgagc

SEQ ID NO: 227538 - DNA, 25 bp, Rattus norvegicus
cagaaccaacaaattcccttcattt

SEQ ID NO: 227539 - DNA, 25 bp, Rattus norvegicus
cagaaccaacaatttcccttcattt

SEQ ID NO: 227540 - DNA, 25 bp, Rattus norvegicus
cagaaccacataccctttcttgctt

SEQ ID NO: 227541 - DNA, 25 bp, Rattus norvegicus
cagaaccacatagcctttcttgctt

SEQ ID NO: 227542 - DNA, 25 bp, Rattus norvegicus
cagaaccaggttcttgcgcgtctat

SEQ ID NO: 227543 - DNA, 25 bp, Rattus norvegicus
cagaaccaggttgttgcgcgtctat

SEQ ID NO: 227544 - DNA, 25 bp, Rattus norvegicus
cagaaccgagttactaaggctacct

SEQ ID NO: 227545 - DNA, 25 bp, Rattus norvegicus
cagaaccgagtttctaaggctacct

SEQ ID NO: 227546 - DNA, 25 bp, Rattus norvegicus
cagaaccgttttcttgttgtatccg

SEQ ID NO: 227547 - DNA, 25 bp, Rattus norvegicus
cagaaccgttttgttgttgtatccg

SEQ ID NO: 227548 - DNA, 25 bp, Rattus norvegicus
cagaacctcgtgaccttagagtcaa

SEQ ID NO: 227549 - DNA, 25 bp, Rattus norvegicus
cagaacctcgtgtccttagagtcaa

SEQ ID NO: 227550 - DNA, 25 bp, Rattus norvegicus
cagaacctgggcaagcacctttact

SEQ ID NO: 227551 - DNA, 25 bp, Rattus norvegicus
cagaacctgggctagcacctttact

SEQ ID NO: 227552 - DNA, 25 bp, Rattus norvegicus
cagaaccttcttaggcttagaggga

SEQ ID NO: 227553 - DNA, 25 bp, Rattus norvegicus
cagaaccttctttggcttagaggga

SEQ ID NO: 227554 - DNA, 25 bp, Rattus norvegicus
cagaaccttggcattggaaataaat

SEQ ID NO: 227555 - DNA, 25 bp, Rattus norvegicus
cagaaccttggctttggaaataaat

SEQ ID NO: 227556 - DNA, 25 bp, Rattus norvegicus
cagaacgatcaaaggccaagtggca

SEQ ID NO: 227557 - DNA, 25 bp, Rattus norvegicus
cagaacgatcaatggccaagtggca

SEQ ID NO: 227558 - DNA, 25 bp, Rattus norvegicus
cagaacggctcgctgcgcctggtac

SEQ ID NO: 227559 - DNA, 25 bp, Rattus norvegicus
cagaacggctcggtgcgcctggtac

SEQ ID NO: 227560 - DNA, 25 bp, Rattus norvegicus
cagaacgggttgaatggcttgcatc

SEQ ID NO: 227561 - DNA, 25 bp, Rattus norvegicus
cagaacgggttgtatggcttgcatc

SEQ ID NO: 227562 - DNA, 25 bp, Rattus norvegicus
cagaacgtgactcaagtgccttgga

SEQ ID NO: 227563 - DNA, 25 bp, Rattus norvegicus
cagaacgtgactgaagtgccttgga

SEQ ID NO: 227564 - DNA, 25 bp, Rattus norvegicus
cagaactacaggaactgttgtgtat

SEQ ID NO: 227565 - DNA, 25 bp, Rattus norvegicus
cagaactacaggtactgttgtgtat

SEQ ID NO: 227566 - DNA, 25 bp, Rattus norvegicus
cagaactagggcagcccaccaggat

SEQ ID NO: 227567 - DNA, 25 bp, Rattus norvegicus
cagaactagggctgcccaccaggat

SEQ ID NO: 227568 - DNA, 25 bp, Rattus norvegicus
cagaactcacatacaagtcctgtca

SEQ ID NO: 227569 - DNA, 25 bp, Rattus norvegicus
cagaactcacattcaagtcctgtca

SEQ ID NO: 227570 - DNA, 25 bp, Rattus norvegicus
cagaactcagtcaggccaacaggct

SEQ ID NO: 227571 - DNA, 25 bp, Rattus norvegicus
cagaactcagtctggccaacaggct

SEQ ID NO: 227572 - DNA, 25 bp, Rattus norvegicus
cagaactccccgatagcctgaaaga

SEQ ID NO: 227573 - DNA, 25 bp, Rattus norvegicus
cagaactccccgttagcctgaaaga

SEQ ID NO: 227574 - DNA, 25 bp, Rattus norvegicus
cagaactgccctcggcttaggtaaa

SEQ ID NO: 227575 - DNA, 25 bp, Rattus norvegicus
cagaactgccctgggcttaggtaaa

SEQ ID NO: 227576 - DNA, 25 bp, Rattus norvegicus
cagaactgcggtctggctgcagtct

SEQ ID NO: 227577 - DNA, 25 bp, Rattus norvegicus
cagaactgcggtgtggctgcagtct

SEQ ID NO: 227578 - DNA, 25 bp, Rattus norvegicus
cagaactgctgcacttactcatgtg

SEQ ID NO: 227579 - DNA, 25 bp, Rattus norvegicus
cagaactgctgctcttactcatgtg

SEQ ID NO: 227580 - DNA, 25 bp, Rattus norvegicus
cagaactgtggaagcagcccaggtt

SEQ ID NO: 227581 - DNA, 25 bp, Rattus norvegicus
cagaactgtggaagggccccagcat

SEQ ID NO: 227582 - DNA, 25 bp, Rattus norvegicus
cagaactgtggatgcagcccaggtt

SEQ ID NO: 227583 - DNA, 25 bp, Rattus norvegicus
cagaactgtggatgggccccagcat

SEQ ID NO: 227584 - DNA, 25 bp, Rattus norvegicus
cagaacttacctagatttgatattt

SEQ ID NO: 227585 - DNA, 25 bp, Rattus norvegicus
cagaacttaccttgatttgatattt

SEQ ID NO: 227586 - DNA, 25 bp, Rattus norvegicus
cagaacttatataagagcgtcagat

SEQ ID NO: 227587 - DNA, 25 bp, Rattus norvegicus
cagaacttatattagagcgtcagat

SEQ ID NO: 227588 - DNA, 25 bp, Rattus norvegicus
cagaacttcactcgtctgtgagagc

SEQ ID NO: 227589 - DNA, 25 bp, Rattus norvegicus
cagaacttcactggtctgtgagagc

SEQ ID NO: 227590 - DNA, 25 bp, Rattus norvegicus
cagaacttcctcagcaccaaaatag

SEQ ID NO: 227591 - DNA, 25 bp, Rattus norvegicus
cagaacttcctctgcaccaaaatag

SEQ ID NO: 227592 - DNA, 25 bp, Rattus norvegicus
cagaacttctgcattcatggtgaat

SEQ ID NO: 227593 - DNA, 25 bp, Rattus norvegicus
cagaacttctgctttcatggtgaat

SEQ ID NO: 227594 - DNA, 25 bp, Rattus norvegicus
cagaacttgataattggtgggacca

SEQ ID NO: 227595 - DNA, 25 bp, Rattus norvegicus
cagaacttgatatttggtgggacca

SEQ ID NO: 227596 - DNA, 25 bp, Rattus norvegicus
cagaacttgattcccacctacagtg

SEQ ID NO: 227597 - DNA, 25 bp, Rattus norvegicus
cagaacttgattgccacctacagtg

SEQ ID NO: 227598 - DNA, 25 bp, Rattus norvegicus
cagaacttgtgtaatgacaggtgat

SEQ ID NO: 227599 - DNA, 25 bp, Rattus norvegicus
cagaacttgtgttatgacaggtgat

SEQ ID NO: 227600 - DNA, 25 bp, Rattus norvegicus
cagaagaaacttccgcaggttggta

SEQ ID NO: 227601 - DNA, 25 bp, Rattus norvegicus
cagaagaaacttgcgcaggttggta

SEQ ID NO: 227602 - DNA, 25 bp, Rattus norvegicus
cagaagaaataccattcatgcatag

SEQ ID NO: 227603 - DNA, 25 bp, Rattus norvegicus
cagaagaaatacgattcatgcatag

SEQ ID NO: 227604 - DNA, 25 bp, Rattus norvegicus
cagaagaaccccaaaagctgtgttt

SEQ ID NO: 227605 - DNA, 25 bp, Rattus norvegicus
cagaagaacccctaaagctgtgttt

SEQ ID NO: 227606 - DNA, 25 bp, Rattus norvegicus
cagaagaagcaactcgaaagcggga

SEQ ID NO: 227607 - DNA, 25 bp, Rattus norvegicus
cagaagaagcaagtcgaaagcggga

SEQ ID NO: 227608 - DNA, 25 bp, Rattus norvegicus
cagaagaaggtgacagatctcatta

SEQ ID NO: 227609 - DNA, 25 bp, Rattus norvegicus
cagaagaaggtgtcagatctcatta

SEQ ID NO: 227610 - DNA, 25 bp, Rattus norvegicus
cagaagaattttcccaggacccact

SEQ ID NO: 227611 - DNA, 25 bp, Rattus norvegicus
cagaagaattttgccaggacccact

SEQ ID NO: 227612 - DNA, 25 bp, Rattus norvegicus
cagaagacacaaatcctgctcctag

SEQ ID NO: 227613 - DNA, 25 bp, Rattus norvegicus
cagaagacacaattcctgctcctag

SEQ ID NO: 227614 - DNA, 25 bp, Rattus norvegicus
cagaagacaggccaacgcttcctga

SEQ ID NO: 227615 - DNA, 25 bp, Rattus norvegicus
cagaagacaggcgaacgcttcctga

SEQ ID NO: 227616 - DNA, 25 bp, Rattus norvegicus
cagaagaccagaactttttctttcc

SEQ ID NO: 227617 - DNA, 25 bp, Rattus norvegicus
cagaagaccagatctttttctttcc

SEQ ID NO: 227618 - DNA, 25 bp, Rattus norvegicus
cagaagacctctatgactagataga

SEQ ID NO: 227619 - DNA, 25 bp, Rattus norvegicus
cagaagacctctttgactagataga

SEQ ID NO: 227620 - DNA, 25 bp, Rattus norvegicus
cagaagacgcgcacgagttggtcac

SEQ ID NO: 227621 - DNA, 25 bp, Rattus norvegicus
cagaagacgcgctcgagttggtcac

SEQ ID NO: 227622 - DNA, 25 bp, Rattus norvegicus
cagaagacgcggagccctccgtttc

SEQ ID NO: 227623 - DNA, 25 bp, Rattus norvegicus
cagaagacgcggtgccctccgtttc

SEQ ID NO: 227624 - DNA, 25 bp, Rattus norvegicus
cagaagacgggcagagtgatgccaa

SEQ ID NO: 227625 - DNA, 25 bp, Rattus norvegicus
cagaagacgggctgagtgatgccaa

SEQ ID NO: 227626 - DNA, 25 bp, Rattus norvegicus
cagaagactgtcaatgctcggagaa

SEQ ID NO: 227627 - DNA, 25 bp, Rattus norvegicus
cagaagactgtctatgctcggagaa

SEQ ID NO: 227628 - DNA, 25 bp, Rattus norvegicus
cagaagactgttagcccctgctgga

SEQ ID NO: 227629 - DNA, 25 bp, Rattus norvegicus
cagaagactgtttgcccctgctgga

SEQ ID NO: 227630 - DNA, 25 bp, Rattus norvegicus
cagaagagcggtcccctcctgactt

SEQ ID NO: 227631 - DNA, 25 bp, Rattus norvegicus
cagaagagcggtgccctcctgactt

SEQ ID NO: 227632 - DNA, 25 bp, Rattus norvegicus
cagaagaggaagatcgtttgttgaa

SEQ ID NO: 227633 - DNA, 25 bp, Rattus norvegicus
cagaagaggaagttcgtttgttgaa

SEQ ID NO: 227634 - DNA, 25 bp, Rattus norvegicus
cagaagaggaggagccttttggcct

SEQ ID NO: 227635 - DNA, 25 bp, Rattus norvegicus
cagaagaggaggtgccttttggcct

SEQ ID NO: 227636 - DNA, 25 bp, Rattus norvegicus
cagaagatctggctttgtagaacaa

SEQ ID NO: 227637 - DNA, 25 bp, Rattus norvegicus
cagaagatctgggtttgtagaacaa

SEQ ID NO: 227638 - DNA, 25 bp, Rattus norvegicus
cagaagatgatgactttggcaattt

SEQ ID NO: 227639 - DNA, 25 bp, Rattus norvegicus
cagaagatgatgtctttggcaattt

SEQ ID NO: 227640 - DNA, 25 bp, Rattus norvegicus
cagaagatggtgactgttcctctgg

SEQ ID NO: 227641 - DNA, 25 bp, Rattus norvegicus
cagaagatggtgtctgttcctctgg

SEQ ID NO: 227642 - DNA, 25 bp, Rattus norvegicus
cagaagcaaagtaccccgcagaatt

SEQ ID NO: 227643 - DNA, 25 bp, Rattus norvegicus
cagaagcaaagttccccgcagaatt

SEQ ID NO: 227644 - DNA, 25 bp, Rattus norvegicus
cagaagcagctactccttgaaggac

SEQ ID NO: 227645 - DNA, 25 bp, Rattus norvegicus
cagaagcagctagtccttgaaggac

SEQ ID NO: 227646 - DNA, 25 bp, Rattus norvegicus
cagaagcagcttatgtcacatgagt

SEQ ID NO: 227647 - DNA, 25 bp, Rattus norvegicus
cagaagcagcttttgtcacatgagt

SEQ ID NO: 227648 - DNA, 25 bp, Rattus norvegicus
cagaagcaggatccagcgtctaatt

SEQ ID NO: 227649 - DNA, 25 bp, Rattus norvegicus
cagaagcaggatgcagcgtctaatt

SEQ ID NO: 227650 - DNA, 25 bp, Rattus norvegicus
cagaagcatcccaggcccagagtca

SEQ ID NO: 227651 - DNA, 25 bp, Rattus norvegicus
cagaagcatccctggcccagagtca

SEQ ID NO: 227652 - DNA, 25 bp, Rattus norvegicus
cagaagccctgccttgttggtaaca

SEQ ID NO: 227653 - DNA, 25 bp, Rattus norvegicus
cagaagccctgcgttgttggtaaca

SEQ ID NO: 227654 - DNA, 25 bp, Rattus norvegicus
cagaagcctcatctaggacttgctg

SEQ ID NO: 227655 - DNA, 25 bp, Rattus norvegicus
cagaagcctcatgtaggacttgctg

SEQ ID NO: 227656 - DNA, 25 bp, Rattus norvegicus
cagaagcctcttcaggtcaagaaat

SEQ ID NO: 227657 - DNA, 25 bp, Rattus norvegicus
cagaagcctcttgaggtcaagaaat

SEQ ID NO: 227658 - DNA, 25 bp, Rattus norvegicus
cagaagcctgatcggccgtgtttac

SEQ ID NO: 227659 - DNA, 25 bp, Rattus norvegicus
cagaagcctgatgggccgtgtttac

SEQ ID NO: 227660 - DNA, 25 bp, Rattus norvegicus
cagaagcctgtgaacatgtccagca

SEQ ID NO: 227661 - DNA, 25 bp, Rattus norvegicus
cagaagcctgtgtacatgtccagca

SEQ ID NO: 227662 - DNA, 25 bp, Rattus norvegicus
cagaagcggagcattttcctaagtt

SEQ ID NO: 227663 - DNA, 25 bp, Rattus norvegicus
cagaagcggagctttttcctaagtt

SEQ ID NO: 227664 - DNA, 25 bp, Rattus norvegicus
cagaagcgggttctactttggataa

SEQ ID NO: 227665 - DNA, 25 bp, Rattus norvegicus
cagaagcgggttgtactttggataa

SEQ ID NO: 227666 - DNA, 25 bp, Rattus norvegicus
cagaagctacagatacttgtggaaa

SEQ ID NO: 227667 - DNA, 25 bp, Rattus norvegicus
cagaagctacagttacttgtggaaa

SEQ ID NO: 227668 - DNA, 25 bp, Rattus norvegicus
cagaagctatggaaacggaaccctc

SEQ ID NO: 227669 - DNA, 25 bp, Rattus norvegicus
cagaagctatggtaacggaaccctc

SEQ ID NO: 227670 - DNA, 25 bp, Rattus norvegicus
cagaagctctggattggacgaaaca

SEQ ID NO: 227671 - DNA, 25 bp, Rattus norvegicus
cagaagctctggtttggacgaaaca

SEQ ID NO: 227672 - DNA, 25 bp, Rattus norvegicus
cagaagctgaaaacggcctccatag

SEQ ID NO: 227673 - DNA, 25 bp, Rattus norvegicus
cagaagctgaaatcggcctccatag

SEQ ID NO: 227674 - DNA, 25 bp, Rattus norvegicus
cagaagctgaagatgcaaggcaaaa

SEQ ID NO: 227675 - DNA, 25 bp, Rattus norvegicus
cagaagctgaagttgcaaggcaaaa

SEQ ID NO: 227676 - DNA, 25 bp, Rattus norvegicus
cagaagctggagacacctgtggcca

SEQ ID NO: 227677 - DNA, 25 bp, Rattus norvegicus
cagaagctggagtcacctgtggcca

SEQ ID NO: 227678 - DNA, 25 bp, Rattus norvegicus
cagaagctggtaatataggacctat

SEQ ID NO: 227679 - DNA, 25 bp, Rattus norvegicus
cagaagctggtattataggacctat

SEQ ID NO: 227680 - DNA, 25 bp, Rattus norvegicus
cagaagcttccgaggtgtctaccac

SEQ ID NO: 227681 - DNA, 25 bp, Rattus norvegicus
cagaagcttccgtggtgtctaccac

SEQ ID NO: 227682 - DNA, 25 bp, Rattus norvegicus
cagaagctttaacgtcttttctgaa

SEQ ID NO: 227683 - DNA, 25 bp, Rattus norvegicus
cagaagctttaaggtcttttctgaa

SEQ ID NO: 227684 - DNA, 25 bp, Rattus norvegicus
cagaagctttgccaccagaagaagt

SEQ ID NO: 227685 - DNA, 25 bp, Rattus norvegicus
cagaagctttgcgaccagaagaagt

SEQ ID NO: 227686 - DNA, 25 bp, Rattus norvegicus
cagaagctttggatttgggcagata

SEQ ID NO: 227687 - DNA, 25 bp, Rattus norvegicus
cagaagctttggttttgggcagata

SEQ ID NO: 227688 - DNA, 25 bp, Rattus norvegicus
cagaaggaagagatgctagcactaa

SEQ ID NO: 227689 - DNA, 25 bp, Rattus norvegicus
cagaaggaagagttgctagcactaa

SEQ ID NO: 227690 - DNA, 25 bp, Rattus norvegicus
cagaaggacactaattggacactat

SEQ ID NO: 227691 - DNA, 25 bp, Rattus norvegicus
cagaaggacacttattggacactat

SEQ ID NO: 227692 - DNA, 25 bp, Rattus norvegicus
cagaaggacagacacagcggataag

SEQ ID NO: 227693 - DNA, 25 bp, Rattus norvegicus
cagaaggacagagacagcggataag

SEQ ID NO: 227694 - DNA, 25 bp, Rattus norvegicus
cagaaggacccgcagcacagagagc

SEQ ID NO: 227695 - DNA, 25 bp, Rattus norvegicus
cagaaggacccggagcacagagagc

SEQ ID NO: 227696 - DNA, 25 bp, Rattus norvegicus
cagaaggaccctcagatggtgtata

SEQ ID NO: 227697 - DNA, 25 bp, Rattus norvegicus
cagaaggaccctgagatggtgtata

SEQ ID NO: 227698 - DNA, 25 bp, Rattus norvegicus
cagaaggactgacccactaccgtgg

SEQ ID NO: 227699 - DNA, 25 bp, Rattus norvegicus
cagaaggactgagccactaccgtgg

SEQ ID NO: 227700 - DNA, 25 bp, Rattus norvegicus
cagaaggactttcgccaggtaaaca

SEQ ID NO: 227701 - DNA, 25 bp, Rattus norvegicus
cagaaggactttggccaggtaaaca

SEQ ID NO: 227702 - DNA, 25 bp, Rattus norvegicus
cagaaggagacaccgctgcctaatt

SEQ ID NO: 227703 - DNA, 25 bp, Rattus norvegicus
cagaaggagacagcgctgcctaatt

SEQ ID NO: 227704 - DNA, 25 bp, Rattus norvegicus
cagaaggagcttcttctctgacctc

SEQ ID NO: 227705 - DNA, 25 bp, Rattus norvegicus
cagaaggagcttgttctctgacctc

SEQ ID NO: 227706 - DNA, 25 bp, Rattus norvegicus
cagaaggagtagatcatgtgggcca

SEQ ID NO: 227707 - DNA, 25 bp, Rattus norvegicus
cagaaggagtagttcatgtgggcca

SEQ ID NO: 227708 - DNA, 25 bp, Rattus norvegicus
cagaaggcagaacgctggactgttt

SEQ ID NO: 227709 - DNA, 25 bp, Rattus norvegicus
cagaaggcagaaggctggactgttt

SEQ ID NO: 227710 - DNA, 25 bp, Rattus norvegicus
cagaaggcatctacaggttcctgaa

SEQ ID NO: 227711 - DNA, 25 bp, Rattus norvegicus
cagaaggcatcttcaggttcctgaa

SEQ ID NO: 227712 - DNA, 25 bp, Rattus norvegicus
cagaaggccgcaattatgcgagcaa

SEQ ID NO: 227713 - DNA, 25 bp, Rattus norvegicus
cagaaggccgcatttatgcgagcaa

SEQ ID NO: 227714 - DNA, 25 bp, Rattus norvegicus
cagaaggcgagcacacggcatgtaa

SEQ ID NO: 227715 - DNA, 25 bp, Rattus norvegicus
cagaaggcgagctcacggcatgtaa

SEQ ID NO: 227716 - DNA, 25 bp, Rattus norvegicus
cagaaggcgcagactccagtttggg

SEQ ID NO: 227717 - DNA, 25 bp, Rattus norvegicus
cagaaggcgcagtctccagtttggg

SEQ ID NO: 227718 - DNA, 25 bp, Rattus norvegicus
cagaaggcgccaagttggagcagat

SEQ ID NO: 227719 - DNA, 25 bp, Rattus norvegicus
cagaaggcgccatgttggagcagat

SEQ ID NO: 227720 - DNA, 25 bp, Rattus norvegicus
cagaagggagccatgccggctgtca

SEQ ID NO: 227721 - DNA, 25 bp, Rattus norvegicus
cagaagggagccttgccggctgtca

SEQ ID NO: 227722 - DNA, 25 bp, Rattus norvegicus
cagaagggaggcaccggacagcttc

SEQ ID NO: 227723 - DNA, 25 bp, Rattus norvegicus
cagaagggaggctccggacagcttc

SEQ ID NO: 227724 - DNA, 25 bp, Rattus norvegicus
cagaagggctctcctgagtgagaca

SEQ ID NO: 227725 - DNA, 25 bp, Rattus norvegicus
cagaagggctctgctgagtgagaca

SEQ ID NO: 227726 - DNA, 25 bp, Rattus norvegicus
cagaaggtgggtatttctctgggct

SEQ ID NO: 227727 - DNA, 25 bp, Rattus norvegicus
cagaaggtgggtttttctctgggct

SEQ ID NO: 227728 - DNA, 25 bp, Rattus norvegicus
cagaaggtgtgtccgaacttggccc

SEQ ID NO: 227729 - DNA, 25 bp, Rattus norvegicus
cagaaggtgtgtgcgaacttggccc

SEQ ID NO: 227730 - DNA, 25 bp, Rattus norvegicus
cagaaggttcctccgcatttcgtag

SEQ ID NO: 227731 - DNA, 25 bp, Rattus norvegicus
cagaaggttcctgcgcatttcgtag

SEQ ID NO: 227732 - DNA, 25 bp, Rattus norvegicus
cagaaggttgacattgggcgaccaa

SEQ ID NO: 227733 - DNA, 25 bp, Rattus norvegicus
cagaaggttgactttgggcgaccaa

SEQ ID NO: 227734 - DNA, 25 bp, Rattus norvegicus
cagaagtaatgtactcttggtggca

SEQ ID NO: 227735 - DNA, 25 bp, Rattus norvegicus
cagaagtaatgttctcttggtggca

SEQ ID NO: 227736 - DNA, 25 bp, Rattus norvegicus
cagaagtacttgctgttagtcgctt

SEQ ID NO: 227737 - DNA, 25 bp, Rattus norvegicus
cagaagtacttggtgttagtcgctt

SEQ ID NO: 227738 - DNA, 25 bp, Rattus norvegicus
cagaagtagcatacccgtgtacaaa

SEQ ID NO: 227739 - DNA, 25 bp, Rattus norvegicus
cagaagtagcattcccgtgtacaaa

SEQ ID NO: 227740 - DNA, 25 bp, Rattus norvegicus
cagaagtcagtaagccacccagtta

SEQ ID NO: 227741 - DNA, 25 bp, Rattus norvegicus
cagaagtcagtatgccacccagtta

SEQ ID NO: 227742 - DNA, 25 bp, Rattus norvegicus
cagaagtcatccactctgctcaaga

SEQ ID NO: 227743 - DNA, 25 bp, Rattus norvegicus
cagaagtcatccagtggaactagat

SEQ ID NO: 227744 - DNA, 25 bp, Rattus norvegicus
cagaagtcatcctctctgctcaaga

SEQ ID NO: 227745 - DNA, 25 bp, Rattus norvegicus
cagaagtcatcctgtggaactagat

SEQ ID NO: 227746 - DNA, 25 bp, Rattus norvegicus
cagaagtccaaacggctaccatcac

SEQ ID NO: 227747 - DNA, 25 bp, Rattus norvegicus
cagaagtccaaagggctaccatcac

SEQ ID NO: 227748 - DNA, 25 bp, Rattus norvegicus
cagaagtccaccagggtgcttgata

SEQ ID NO: 227749 - DNA, 25 bp, Rattus norvegicus
cagaagtccacctgggtgcttgata

SEQ ID NO: 227750 - DNA, 25 bp, Rattus norvegicus
cagaagtcctatagaagccctgccc

SEQ ID NO: 227751 - DNA, 25 bp, Rattus norvegicus
cagaagtcctattgaagccctgccc

SEQ ID NO: 227752 - DNA, 25 bp, Rattus norvegicus
cagaagtccttaattgtcagtttta

SEQ ID NO: 227753 - DNA, 25 bp, Rattus norvegicus
cagaagtccttatttgtcagtttta

SEQ ID NO: 227754 - DNA, 25 bp, Rattus norvegicus
cagaagtcttggcagccttccaggg

SEQ ID NO: 227755 - DNA, 25 bp, Rattus norvegicus
cagaagtcttgggagccttccaggg

SEQ ID NO: 227756 - DNA, 25 bp, Rattus norvegicus
cagaagtgaagaactagagctgccg

SEQ ID NO: 227757 - DNA, 25 bp, Rattus norvegicus
cagaagtgaagatctagagctgccg

SEQ ID NO: 227758 - DNA, 25 bp, Rattus norvegicus
cagaagtgacagctctgctgggcct

SEQ ID NO: 227759 - DNA, 25 bp, Rattus norvegicus
cagaagtgacaggtctgctgggcct

SEQ ID NO: 227760 - DNA, 25 bp, Rattus norvegicus
cagaagtgcgcgcaactcggacaaa

SEQ ID NO: 227761 - DNA, 25 bp, Rattus norvegicus
cagaagtgcgcggaactcggacaaa

SEQ ID NO: 227762 - DNA, 25 bp, Rattus norvegicus
cagaagtggcacaatcatccttaaa

SEQ ID NO: 227763 - DNA, 25 bp, Rattus norvegicus
cagaagtggcactatcatccttaaa

SEQ ID NO: 227764 - DNA, 25 bp, Rattus norvegicus
cagaagtggcagacttcattgtgga

SEQ ID NO: 227765 - DNA, 25 bp, Rattus norvegicus
cagaagtggcagtcttcattgtgga

SEQ ID NO: 227766 - DNA, 25 bp, Rattus norvegicus
cagaagtgtgctcgccatgcctcag

SEQ ID NO: 227767 - DNA, 25 bp, Rattus norvegicus
cagaagtgtgctggccatgcctcag

SEQ ID NO: 227768 - DNA, 25 bp, Rattus norvegicus
cagaagtgtgtcactctgcgggcag

SEQ ID NO: 227769 - DNA, 25 bp, Rattus norvegicus
cagaagtgtgtctctctgcgggcag

SEQ ID NO: 227770 - DNA, 25 bp, Rattus norvegicus
cagaagtgttcacatcttaatgatc

SEQ ID NO: 227771 - DNA, 25 bp, Rattus norvegicus
cagaagtgttcagatcttaatgatc

SEQ ID NO: 227772 - DNA, 25 bp, Rattus norvegicus
cagaagtgttccagcatctgaactt

SEQ ID NO: 227773 - DNA, 25 bp, Rattus norvegicus
cagaagtgttcctgcatctgaactt

SEQ ID NO: 227774 - DNA, 25 bp, Rattus norvegicus
cagaagttaaaaaggctgccgtgcg

SEQ ID NO: 227775 - DNA, 25 bp, Rattus norvegicus
cagaagttaaaatggctgccgtgcg

SEQ ID NO: 227776 - DNA, 25 bp, Rattus norvegicus
cagaagttccctatgaaactgccaa

SEQ ID NO: 227777 - DNA, 25 bp, Rattus norvegicus
cagaagttccctttgaaactgccaa

SEQ ID NO: 227778 - DNA, 25 bp, Rattus norvegicus
cagaagttccggaaccagttcctgt

SEQ ID NO: 227779 - DNA, 25 bp, Rattus norvegicus
cagaagttccggtaccagttcctgt

SEQ ID NO: 227780 - DNA, 25 bp, Rattus norvegicus
cagaagttccttcggactcccttga

SEQ ID NO: 227781 - DNA, 25 bp, Rattus norvegicus
cagaagttccttgggactcccttga

SEQ ID NO: 227782 - DNA, 25 bp, Rattus norvegicus
cagaagttctgcagtaggttccctc

SEQ ID NO: 227783 - DNA, 25 bp, Rattus norvegicus
cagaagttctgctgtaggttccctc

SEQ ID NO: 227784 - DNA, 25 bp, Rattus norvegicus
cagaagttctgtccccaagccaggg

SEQ ID NO: 227785 - DNA, 25 bp, Rattus norvegicus
cagaagttctgtgcccaagccaggg

SEQ ID NO: 227786 - DNA, 25 bp, Rattus norvegicus
cagaagttggatcaggtttcgccct

SEQ ID NO: 227787 - DNA, 25 bp, Rattus norvegicus
cagaagttggatgaggtttcgccct

SEQ ID NO: 227788 - DNA, 25 bp, Rattus norvegicus
cagaataaaggcctgttcctctcct

SEQ ID NO: 227789 - DNA, 25 bp, Rattus norvegicus
cagaataaaggcgtgttcctctcct

SEQ ID NO: 227790 - DNA, 25 bp, Rattus norvegicus
cagaataagatgctaccccttttca

SEQ ID NO: 227791 - DNA, 25 bp, Rattus norvegicus
cagaataagatggtaccccttttca

SEQ ID NO: 227792 - DNA, 25 bp, Rattus norvegicus
cagaatacatcgactaccttagagg

SEQ ID NO: 227793 - DNA, 25 bp, Rattus norvegicus
cagaatacatcgtctaccttagagg

SEQ ID NO: 227794 - DNA, 25 bp, Rattus norvegicus
cagaatactgacatccgggcagtta

SEQ ID NO: 227795 - DNA, 25 bp, Rattus norvegicus
cagaatactgacttccgggcagtta

SEQ ID NO: 227796 - DNA, 25 bp, Rattus norvegicus
cagaatagaggtcccaaagccttct

SEQ ID NO: 227797 - DNA, 25 bp, Rattus norvegicus
cagaatagaggtgccaaagccttct

SEQ ID NO: 227798 - DNA, 25 bp, Rattus norvegicus
cagaatagtactataatgtgcaggt

SEQ ID NO: 227799 - DNA, 25 bp, Rattus norvegicus
cagaatagtactttaatgtgcaggt

SEQ ID NO: 227800 - DNA, 25 bp, Rattus norvegicus
cagaatagtgagagccgaggtccat

SEQ ID NO: 227801 - DNA, 25 bp, Rattus norvegicus
cagaatagtgagtgccgaggtccat

SEQ ID NO: 227802 - DNA, 25 bp, Rattus norvegicus
cagaatatcttcacccttgttataa

SEQ ID NO: 227803 - DNA, 25 bp, Rattus norvegicus
cagaatatcttctcccttgttataa

SEQ ID NO: 227804 - DNA, 25 bp, Rattus norvegicus
cagaatatctttcagctcactgctc

SEQ ID NO: 227805 - DNA, 25 bp, Rattus norvegicus
cagaatatctttgagctcactgctc

SEQ ID NO: 227806 - DNA, 25 bp, Rattus norvegicus
cagaatatggttaacttctgccacc

SEQ ID NO: 227807 - DNA, 25 bp, Rattus norvegicus
cagaatatggtttacttctgccacc

SEQ ID NO: 227808 - DNA, 25 bp, Rattus norvegicus
cagaatatttatacccatgggcttt

SEQ ID NO: 227809 - DNA, 25 bp, Rattus norvegicus
cagaatatttattcccatgggcttt

SEQ ID NO: 227810 - DNA, 25 bp, Rattus norvegicus
cagaatattttgctaactgtccaat

SEQ ID NO: 227811 - DNA, 25 bp, Rattus norvegicus
cagaatattttggtaactgtccaat

SEQ ID NO: 227812 - DNA, 25 bp, Rattus norvegicus
cagaatcacttcagtcccttcagtg

SEQ ID NO: 227813 - DNA, 25 bp, Rattus norvegicus
cagaatcacttctgtcccttcagtg

SEQ ID NO: 227814 - DNA, 25 bp, Rattus norvegicus
cagaatccaccaagatcagccagtg

SEQ ID NO: 227815 - DNA, 25 bp, Rattus norvegicus
cagaatccaccatgatcagccagtg

SEQ ID NO: 227816 - DNA, 25 bp, Rattus norvegicus
cagaatccccatcagtgttagcaat

SEQ ID NO: 227817 - DNA, 25 bp, Rattus norvegicus
cagaatccccatgagtgttagcaat

SEQ ID NO: 227818 - DNA, 25 bp, Rattus norvegicus
cagaatcctgccagcacttggctct

SEQ ID NO: 227819 - DNA, 25 bp, Rattus norvegicus
cagaatcctgcctgcacttggctct

SEQ ID NO: 227820 - DNA, 25 bp, Rattus norvegicus
cagaatcgcttgctgcgtcttgtgt

SEQ ID NO: 227821 - DNA, 25 bp, Rattus norvegicus
cagaatcgcttggtgcgtcttgtgt

SEQ ID NO: 227822 - DNA, 25 bp, Rattus norvegicus
cagaatctctgtctgaacccatgac

SEQ ID NO: 227823 - DNA, 25 bp, Rattus norvegicus
cagaatctctgtgtgaacccatgac

SEQ ID NO: 227824 - DNA, 25 bp, Rattus norvegicus
cagaatctggctcccagtgttttgt

SEQ ID NO: 227825 - DNA, 25 bp, Rattus norvegicus
cagaatctggctgccagtgttttgt

SEQ ID NO: 227826 - DNA, 25 bp, Rattus norvegicus
cagaatctgtccctctgtacagctg

SEQ ID NO: 227827 - DNA, 25 bp, Rattus norvegicus
cagaatctgtccgtctgtacagctg

SEQ ID NO: 227828 - DNA, 25 bp, Rattus norvegicus
cagaatcttaacagttgcccaggct

SEQ ID NO: 227829 - DNA, 25 bp, Rattus norvegicus
cagaatcttaactgttgcccaggct

SEQ ID NO: 227830 - DNA, 25 bp, Rattus norvegicus
cagaatgacaagataacccagttaa

SEQ ID NO: 227831 - DNA, 25 bp, Rattus norvegicus
cagaatgacaagttaacccagttaa

SEQ ID NO: 227832 - DNA, 25 bp, Rattus norvegicus
cagaatgagaaaccggagtggcccc

SEQ ID NO: 227833 - DNA, 25 bp, Rattus norvegicus
cagaatgagaaagcggagtggcccc

SEQ ID NO: 227834 - DNA, 25 bp, Rattus norvegicus
cagaatgcaggtattattctgcccc

SEQ ID NO: 227835 - DNA, 25 bp, Rattus norvegicus
cagaatgcaggttttattctgcccc

SEQ ID NO: 227836 - DNA, 25 bp, Rattus norvegicus
cagaatgcccagatggtggctggcc

SEQ ID NO: 227837 - DNA, 25 bp, Rattus norvegicus
cagaatgcccagttggtggctggcc

SEQ ID NO: 227838 - DNA, 25 bp, Rattus norvegicus
cagaatggcttgatgctggaattta

SEQ ID NO: 227839 - DNA, 25 bp, Rattus norvegicus
cagaatggcttgttgctggaattta

SEQ ID NO: 227840 - DNA, 25 bp, Rattus norvegicus
cagaatgggtgcagatggagctaca

SEQ ID NO: 227841 - DNA, 25 bp, Rattus norvegicus
cagaatgggtgctgatggagctaca

SEQ ID NO: 227842 - DNA, 25 bp, Rattus norvegicus
cagaatggtctgatggcatataact

SEQ ID NO: 227843 - DNA, 25 bp, Rattus norvegicus
cagaatggtctgttggcatataact

SEQ ID NO: 227844 - DNA, 25 bp, Rattus norvegicus
cagaatggtgtgacgctgactacct

SEQ ID NO: 227845 - DNA, 25 bp, Rattus norvegicus
cagaatggtgtgtcgctgactacct

SEQ ID NO: 227846 - DNA, 25 bp, Rattus norvegicus
cagaatggtttgacacccttcccta

SEQ ID NO: 227847 - DNA, 25 bp, Rattus norvegicus
cagaatggtttgtcacccttcccta

SEQ ID NO: 227848 - DNA, 25 bp, Rattus norvegicus
cagaatgtccttatctcaggaggga

SEQ ID NO: 227849 - DNA, 25 bp, Rattus norvegicus
cagaatgtccttttctcaggaggga

SEQ ID NO: 227850 - DNA, 25 bp, Rattus norvegicus
cagaatgtgactcgttggatctcat

SEQ ID NO: 227851 - DNA, 25 bp, Rattus norvegicus
cagaatgtgactctgagcttcaggg

SEQ ID NO: 227852 - DNA, 25 bp, Rattus norvegicus
cagaatgtgactggttggatctcat

SEQ ID NO: 227853 - DNA, 25 bp, Rattus norvegicus
cagaatgtgactgtgagcttcaggg

SEQ ID NO: 227854 - DNA, 25 bp, Rattus norvegicus
cagaatgtggagacagttacttcaa

SEQ ID NO: 227855 - DNA, 25 bp, Rattus norvegicus
cagaatgtggagtcagttacttcaa

SEQ ID NO: 227856 - DNA, 25 bp, Rattus norvegicus
cagaatgtgtgtcattgtgggactc

SEQ ID NO: 227857 - DNA, 25 bp, Rattus norvegicus
cagaatgtgtgtgattgtgggactc

SEQ ID NO: 227858 - DNA, 25 bp, Rattus norvegicus
cagaatgttctcaacttcgactagt

SEQ ID NO: 227859 - DNA, 25 bp, Rattus norvegicus
cagaatgttctctacttcgactagt

SEQ ID NO: 227860 - DNA, 25 bp, Rattus norvegicus
cagaatgttcttagcttggtcaagg

SEQ ID NO: 227861 - DNA, 25 bp, Rattus norvegicus
cagaatgttctttgcttggtcaagg

SEQ ID NO: 227862 - DNA, 25 bp, Rattus norvegicus
cagaattcagataccatgtgataat

SEQ ID NO: 227863 - DNA, 25 bp, Rattus norvegicus
cagaattcagattccatgtgataat

SEQ ID NO: 227864 - DNA, 25 bp, Rattus norvegicus
cagaattccaggctcatctgatctc

SEQ ID NO: 227865 - DNA, 25 bp, Rattus norvegicus
cagaattccagggtcatctgatctc

SEQ ID NO: 227866 - DNA, 25 bp, Rattus norvegicus
cagaattccatgaggcaacttgtaa

SEQ ID NO: 227867 - DNA, 25 bp, Rattus norvegicus
cagaattccatgtggcaacttgtaa

SEQ ID NO: 227868 - DNA, 25 bp, Rattus norvegicus
cagaattctggtaggcctgtgtatt

SEQ ID NO: 227869 - DNA, 25 bp, Rattus norvegicus
cagaattctggttggcctgtgtatt

SEQ ID NO: 227870 - DNA, 25 bp, Rattus norvegicus
cagaattctgttcatctcggctaat

SEQ ID NO: 227871 - DNA, 25 bp, Rattus norvegicus
cagaattctgttgatctcggctaat

SEQ ID NO: 227872 - DNA, 25 bp, Rattus norvegicus
cagaattcttgtcggctgctacata

SEQ ID NO: 227873 - DNA, 25 bp, Rattus norvegicus
cagaattcttgtgggctgctacata

SEQ ID NO: 227874 - DNA, 25 bp, Rattus norvegicus
cagaattgcaggcacagttaccact

SEQ ID NO: 227875 - DNA, 25 bp, Rattus norvegicus
cagaattgcagggacagttaccact

SEQ ID NO: 227876 - DNA, 25 bp, Rattus norvegicus
cagaattgtgagatgtgaccatgga

SEQ ID NO: 227877 - DNA, 25 bp, Rattus norvegicus
cagaattgtgagttgtgaccatgga

SEQ ID NO: 227878 - DNA, 25 bp, Rattus norvegicus
cagaatttcaaccaggcggccgggc

SEQ ID NO: 227879 - DNA, 25 bp, Rattus norvegicus
cagaatttcaacgaggcggccgggc

SEQ ID NO: 227880 - DNA, 25 bp, Rattus norvegicus
cagaatttcagaattttgtacccta

SEQ ID NO: 227881 - DNA, 25 bp, Rattus norvegicus
cagaatttcagatttttgtacccta

SEQ ID NO: 227882 - DNA, 25 bp, Rattus norvegicus
cagaatttctccaccttttgtttgt

SEQ ID NO: 227883 - DNA, 25 bp, Rattus norvegicus
cagaatttctcctccttttgtttgt

SEQ ID NO: 227884 - DNA, 25 bp, Rattus norvegicus
cagaatttctggcagagtagccggt

SEQ ID NO: 227885 - DNA, 25 bp, Rattus norvegicus
cagaatttctgggagagtagccggt

SEQ ID NO: 227886 - DNA, 25 bp, Rattus norvegicus
cagaatttgggcctcagacttgagg

SEQ ID NO: 227887 - DNA, 25 bp, Rattus norvegicus
cagaatttgggcgtcagacttgagg

SEQ ID NO: 227888 - DNA, 25 bp, Rattus norvegicus
cagaattttagtagtgtggccttga

SEQ ID NO: 227889 - DNA, 25 bp, Rattus norvegicus
cagaattttagttgtgtggccttga

SEQ ID NO: 227890 - DNA, 25 bp, Rattus norvegicus
cagaattttcttaggttgccgacaa

SEQ ID NO: 227891 - DNA, 25 bp, Rattus norvegicus
cagaattttctttggttgccgacaa

SEQ ID NO: 227892 - DNA, 25 bp, Rattus norvegicus
cagaatttttgtagaggcactcagg

SEQ ID NO: 227893 - DNA, 25 bp, Rattus norvegicus
cagaatttttgttgaggcactcagg

SEQ ID NO: 227894 - DNA, 25 bp, Rattus norvegicus
cagacaaagccccagatggcgaagc

SEQ ID NO: 227895 - DNA, 25 bp, Rattus norvegicus
cagacaaagcccgagatggcgaagc

SEQ ID NO: 227896 - DNA, 25 bp, Rattus norvegicus
cagacaaatgtgctgcaggcaggct

SEQ ID NO: 227897 - DNA, 25 bp, Rattus norvegicus
cagacaaatgtggtgcaggcaggct

SEQ ID NO: 227898 - DNA, 25 bp, Rattus norvegicus
cagacaacggaaccgtgccttactt

SEQ ID NO: 227899 - DNA, 25 bp, Rattus norvegicus
cagacaacggaagcgtgccttactt

SEQ ID NO: 227900 - DNA, 25 bp, Rattus norvegicus
cagacaacgggcctgcttttgtctc

SEQ ID NO: 227901 - DNA, 25 bp, Rattus norvegicus
cagacaacgggcgtgcttttgtctc

SEQ ID NO: 227902 - DNA, 25 bp, Rattus norvegicus
cagacaactcagatttcctactaga

SEQ ID NO: 227903 - DNA, 25 bp, Rattus norvegicus
cagacaactcagttttcctactaga

SEQ ID NO: 227904 - DNA, 25 bp, Rattus norvegicus
cagacaactgtgctgctagggccag

SEQ ID NO: 227905 - DNA, 25 bp, Rattus norvegicus
cagacaactgtggtgctagggccag

SEQ ID NO: 227906 - DNA, 25 bp, Rattus norvegicus
cagacaagacagaggtgttgcctaa

SEQ ID NO: 227907 - DNA, 25 bp, Rattus norvegicus
cagacaagacagtggtgttgcctaa

SEQ ID NO: 227908 - DNA, 25 bp, Rattus norvegicus
cagacaagagtcacggcctaggtgg

SEQ ID NO: 227909 - DNA, 25 bp, Rattus norvegicus
cagacaagagtctcggcctaggtgg

SEQ ID NO: 227910 - DNA, 25 bp, Rattus norvegicus
cagacaagggcacgagatctcagct

SEQ ID NO: 227911 - DNA, 25 bp, Rattus norvegicus
cagacaagggcaggagatctcagct

SEQ ID NO: 227912 - DNA, 25 bp, Rattus norvegicus
cagacaatctgtacaagcggacgga

SEQ ID NO: 227913 - DNA, 25 bp, Rattus norvegicus
cagacaatctgttcaagcggacgga

SEQ ID NO: 227914 - DNA, 25 bp, Rattus norvegicus
cagacaatgactagcttcctatctc

SEQ ID NO: 227915 - DNA, 25 bp, Rattus norvegicus
cagacaatgacttgcttcctatctc

SEQ ID NO: 227916 - DNA, 25 bp, Rattus norvegicus
cagacacaagctcctacaaccaggg

SEQ ID NO: 227917 - DNA, 25 bp, Rattus norvegicus
cagacacaagctgctacaaccaggg

SEQ ID NO: 227918 - DNA, 25 bp, Rattus norvegicus
cagacacacctactgtgtttgctct

SEQ ID NO: 227919 - DNA, 25 bp, Rattus norvegicus
cagacacacctagtgtgtttgctct

SEQ ID NO: 227920 - DNA, 25 bp, Rattus norvegicus
cagacacagaggcaggtagaccttt

SEQ ID NO: 227921 - DNA, 25 bp, Rattus norvegicus
cagacacagagggaggtagaccttt

SEQ ID NO: 227922 - DNA, 25 bp, Rattus norvegicus
cagacacatcttcaggtaggagccc

SEQ ID NO: 227923 - DNA, 25 bp, Rattus norvegicus
cagacacatcttgaggtaggagccc

SEQ ID NO: 227924 - DNA, 25 bp, Rattus norvegicus
cagacaccatccagacaactgttaa

SEQ ID NO: 227925 - DNA, 25 bp, Rattus norvegicus
cagacaccatcctgacaactgttaa

SEQ ID NO: 227926 - DNA, 25 bp, Rattus norvegicus
cagacaccgtttacctagtgggtga

SEQ ID NO: 227927 - DNA, 25 bp, Rattus norvegicus
cagacaccgttttcctagtgggtga

SEQ ID NO: 227928 - DNA, 25 bp, Rattus norvegicus
cagacacgaggtactttatggcgaa

SEQ ID NO: 227929 - DNA, 25 bp, Rattus norvegicus
cagacacgaggttctttatggcgaa

SEQ ID NO: 227930 - DNA, 25 bp, Rattus norvegicus
cagacacgtcatcggccatgtggat

SEQ ID NO: 227931 - DNA, 25 bp, Rattus norvegicus
cagacacgtcatgggccatgtggat

SEQ ID NO: 227932 - DNA, 25 bp, Rattus norvegicus
cagacactatttatccattgtggat

SEQ ID NO: 227933 - DNA, 25 bp, Rattus norvegicus
cagacactatttttccattgtggat

SEQ ID NO: 227934 - DNA, 25 bp, Rattus norvegicus
cagacactccctatgtatgtggtga

SEQ ID NO: 227935 - DNA, 25 bp, Rattus norvegicus
cagacactccctttgtatgtggtga

SEQ ID NO: 227936 - DNA, 25 bp, Rattus norvegicus
cagacacttagcactttttattaca

SEQ ID NO: 227937 - DNA, 25 bp, Rattus norvegicus
cagacacttagctctttttattaca

SEQ ID NO: 227938 - DNA, 25 bp, Rattus norvegicus
cagacacttccgagggaacgagaaa

SEQ ID NO: 227939 - DNA, 25 bp, Rattus norvegicus
cagacacttccgtgggaacgagaaa

SEQ ID NO: 227940 - DNA, 25 bp, Rattus norvegicus
cagacacttcctctgaagccaataa

SEQ ID NO: 227941 - DNA, 25 bp, Rattus norvegicus
cagacacttcctgtgaagccaataa

SEQ ID NO: 227942 - DNA, 25 bp, Rattus norvegicus
cagacacttctgagttcttctacct

SEQ ID NO: 227943 - DNA, 25 bp, Rattus norvegicus
cagacacttctgtgttcttctacct

SEQ ID NO: 227944 - DNA, 25 bp, Rattus norvegicus
cagacacttgtgaacccagatcata

SEQ ID NO: 227945 - DNA, 25 bp, Rattus norvegicus
cagacacttgtgtacccagatcata

SEQ ID NO: 227946 - DNA, 25 bp, Rattus norvegicus
cagacactttatctaactcaatggt

SEQ ID NO: 227947 - DNA, 25 bp, Rattus norvegicus
cagacactttatgtaactcaatggt

SEQ ID NO: 227948 - DNA, 25 bp, Rattus norvegicus
cagacagaactgcaaggcccctatt

SEQ ID NO: 227949 - DNA, 25 bp, Rattus norvegicus
cagacagaactggaaggcccctatt

SEQ ID NO: 227950 - DNA, 25 bp, Rattus norvegicus
cagacagaagggacaagtggctaga

SEQ ID NO: 227951 - DNA, 25 bp, Rattus norvegicus
cagacagaagggtcaagtggctaga

SEQ ID NO: 227952 - DNA, 25 bp, Rattus norvegicus
cagacagacattctaccagttctct

SEQ ID NO: 227953 - DNA, 25 bp, Rattus norvegicus
cagacagacattgtaccagttctct

SEQ ID NO: 227954 - DNA, 25 bp, Rattus norvegicus
cagacagagacgcagaaagcacccc

SEQ ID NO: 227955 - DNA, 25 bp, Rattus norvegicus
cagacagagacggagaaagcacccc

SEQ ID NO: 227956 - DNA, 25 bp, Rattus norvegicus
cagacagatctaaaagccattgctt

SEQ ID NO: 227957 - DNA, 25 bp, Rattus norvegicus
cagacagatctataagccattgctt

SEQ ID NO: 227958 - DNA, 25 bp, Rattus norvegicus
cagacagatcttattggtaacccaa

SEQ ID NO: 227959 - DNA, 25 bp, Rattus norvegicus
cagacagatctttttggtaacccaa

SEQ ID NO: 227960 - DNA, 25 bp, Rattus norvegicus
cagacagatgtcaaacccttcttgc

SEQ ID NO: 227961 - DNA, 25 bp, Rattus norvegicus
cagacagatgtctaacccttcttgc

SEQ ID NO: 227962 - DNA, 25 bp, Rattus norvegicus
cagacagccagacagccgtcacagg

SEQ ID NO: 227963 - DNA, 25 bp, Rattus norvegicus
cagacagccagagagccgtcacagg

SEQ ID NO: 227964 - DNA, 25 bp, Rattus norvegicus
cagacagcctcccttttctagaagt

SEQ ID NO: 227965 - DNA, 25 bp, Rattus norvegicus
cagacagcctccgttttctagaagt

SEQ ID NO: 227966 - DNA, 25 bp, Rattus norvegicus
cagacagcgatgaggatctgcctgg

SEQ ID NO: 227967 - DNA, 25 bp, Rattus norvegicus
cagacagcgatgtggatctgcctgg

SEQ ID NO: 227968 - DNA, 25 bp, Rattus norvegicus
cagacagctctgcttattagttcag

SEQ ID NO: 227969 - DNA, 25 bp, Rattus norvegicus
cagacagctctggttattagttcag

SEQ ID NO: 227970 - DNA, 25 bp, Rattus norvegicus
cagacagctgggactttcaagcaaa

SEQ ID NO: 227971 - DNA, 25 bp, Rattus norvegicus
cagacagctgggtctttcaagcaaa

SEQ ID NO: 227972 - DNA, 25 bp, Rattus norvegicus
cagacagctgttatcccaatggact

SEQ ID NO: 227973 - DNA, 25 bp, Rattus norvegicus
cagacagctgttttcccaatggact

SEQ ID NO: 227974 - DNA, 25 bp, Rattus norvegicus
cagacagcttctattctgctggaga

SEQ ID NO: 227975 - DNA, 25 bp, Rattus norvegicus
cagacagcttcttttctgctggaga

SEQ ID NO: 227976 - DNA, 25 bp, Rattus norvegicus
cagacaggacctctggactgcagtc

SEQ ID NO: 227977 - DNA, 25 bp, Rattus norvegicus
cagacaggacctgtggactgcagtc

SEQ ID NO: 227978 - DNA, 25 bp, Rattus norvegicus
cagacaggatccagactcctgggtc

SEQ ID NO: 227979 - DNA, 25 bp, Rattus norvegicus
cagacaggatcctgactcctgggtc

SEQ ID NO: 227980 - DNA, 25 bp, Rattus norvegicus
cagacaggatctaaggaactggcag

SEQ ID NO: 227981 - DNA, 25 bp, Rattus norvegicus
cagacaggatcttaggaactggcag

SEQ ID NO: 227982 - DNA, 25 bp, Rattus norvegicus
cagacaggccgaccccagatttgga

SEQ ID NO: 227983 - DNA, 25 bp, Rattus norvegicus
cagacaggccgagcccagatttgga

SEQ ID NO: 227984 - DNA, 25 bp, Rattus norvegicus
cagacagggcgcagtgtttaagcaa

SEQ ID NO: 227985 - DNA, 25 bp, Rattus norvegicus
cagacagggcgctgtgtttaagcaa

SEQ ID NO: 227986 - DNA, 25 bp, Rattus norvegicus
cagacaggtcttagcctctccagtg

SEQ ID NO: 227987 - DNA, 25 bp, Rattus norvegicus
cagacaggtctttgcctctccagtg

SEQ ID NO: 227988 - DNA, 25 bp, Rattus norvegicus
cagacagtcctgcagttggcagctg

SEQ ID NO: 227989 - DNA, 25 bp, Rattus norvegicus
cagacagtcctggagttggcagctg

SEQ ID NO: 227990 - DNA, 25 bp, Rattus norvegicus
cagacagtgaatctgctggcgcaga

SEQ ID NO: 227991 - DNA, 25 bp, Rattus norvegicus
cagacagtgaatgtgctggcgcaga

SEQ ID NO: 227992 - DNA, 25 bp, Rattus norvegicus
cagacagttccacaggctggactcc

SEQ ID NO: 227993 - DNA, 25 bp, Rattus norvegicus
cagacagttccagaggctggactcc

SEQ ID NO: 227994 - DNA, 25 bp, Rattus norvegicus
cagacagttgtaattgctccgccat

SEQ ID NO: 227995 - DNA, 25 bp, Rattus norvegicus
cagacagttgtatttgctccgccat

SEQ ID NO: 227996 - DNA, 25 bp, Rattus norvegicus
cagacatacaccaaaatgcaggcaa

SEQ ID NO: 227997 - DNA, 25 bp, Rattus norvegicus
cagacatacacctaaatgcaggcaa

SEQ ID NO: 227998 - DNA, 25 bp, Rattus norvegicus
cagacatatcttaggttcaattgat

SEQ ID NO: 227999 - DNA, 25 bp, Rattus norvegicus
cagacatatctttggttcaattgat

SEQ ID NO: 228000 - DNA, 25 bp, Rattus norvegicus
cagacatcaagcctgtgaaaccaat

SEQ ID NO: 228001 - DNA, 25 bp, Rattus norvegicus
cagacatcaagcgtgtgaaaccaat

SEQ ID NO: 228002 - DNA, 25 bp, Rattus norvegicus
cagacatcaccaccgtagccaggag

SEQ ID NO: 228003 - DNA, 25 bp, Rattus norvegicus
cagacatcaccagcgtagccaggag

SEQ ID NO: 228004 - DNA, 25 bp, Rattus norvegicus
cagacatgaattctgcattttgcct

SEQ ID NO: 228005 - DNA, 25 bp, Rattus norvegicus
cagacatgaattgtgcattttgcct

SEQ ID NO: 228006 - DNA, 25 bp, Rattus norvegicus
cagacatgatgacttggaccttata

SEQ ID NO: 228007 - DNA, 25 bp, Rattus norvegicus
cagacatgatgagttggaccttata

SEQ ID NO: 228008 - DNA, 25 bp, Rattus norvegicus
cagacatgatggacgcgaggcagaa

SEQ ID NO: 228009 - DNA, 25 bp, Rattus norvegicus
cagacatgatggtcgcgaggcagaa

SEQ ID NO: 228010 - DNA, 25 bp, Rattus norvegicus
cagacatgccagatgaggtcaacat

SEQ ID NO: 228011 - DNA, 25 bp, Rattus norvegicus
cagacatgccagttgaggtcaacat

SEQ ID NO: 228012 - DNA, 25 bp, Rattus norvegicus
cagacatggttaaagatccagacat

SEQ ID NO: 228013 - DNA, 25 bp, Rattus norvegicus
cagacatggttatagatccagacat

SEQ ID NO: 228014 - DNA, 25 bp, Rattus norvegicus
cagacatgttgtaattgcctgtgaa

SEQ ID NO: 228015 - DNA, 25 bp, Rattus norvegicus
cagacatgttgttattgcctgtgaa

SEQ ID NO: 228016 - DNA, 25 bp, Rattus norvegicus
cagacattcagcacgtgttctcagt

SEQ ID NO: 228017 - DNA, 25 bp, Rattus norvegicus
cagacattcagctcgtgttctcagt

SEQ ID NO: 228018 - DNA, 25 bp, Rattus norvegicus
cagacatttctcaagatcttgactt

SEQ ID NO: 228019 - DNA, 25 bp, Rattus norvegicus
cagacatttctctagatcttgactt

SEQ ID NO: 228020 - DNA, 25 bp, Rattus norvegicus
cagacatttgttcctgtgcgaccag

SEQ ID NO: 228021 - DNA, 25 bp, Rattus norvegicus
cagacatttgttgctgtgcgaccag

SEQ ID NO: 228022 - DNA, 25 bp, Rattus norvegicus
cagacatttttaacctgtaggcttt

SEQ ID NO: 228023 - DNA, 25 bp, Rattus norvegicus
cagacatttttatcctgtaggcttt

SEQ ID NO: 228024 - DNA, 25 bp, Rattus norvegicus
cagaccaatttccctcatatatcga

SEQ ID NO: 228025 - DNA, 25 bp, Rattus norvegicus
cagaccaatttcgctcatatatcga

SEQ ID NO: 228026 - DNA, 25 bp, Rattus norvegicus
cagaccacaataacaaataagcggg

SEQ ID NO: 228027 - DNA, 25 bp, Rattus norvegicus
cagaccacaatatcaaataagcggg

SEQ ID NO: 228028 - DNA, 25 bp, Rattus norvegicus
cagaccacaatgatccttttctttt

SEQ ID NO: 228029 - DNA, 25 bp, Rattus norvegicus
cagaccacaatgttccttttctttt

SEQ ID NO: 228030 - DNA, 25 bp, Rattus norvegicus
cagaccacagaaatagcaactaagg

SEQ ID NO: 228031 - DNA, 25 bp, Rattus norvegicus
cagaccacagaattagcaactaagg

SEQ ID NO: 228032 - DNA, 25 bp, Rattus norvegicus
cagaccaccccgctggattttgaaa

SEQ ID NO: 228033 - DNA, 25 bp, Rattus norvegicus
cagaccaccccggtggattttgaaa

SEQ ID NO: 228034 - DNA, 25 bp, Rattus norvegicus
cagaccactggcagtttccatagaa

SEQ ID NO: 228035 - DNA, 25 bp, Rattus norvegicus
cagaccactggctgtttccatagaa

SEQ ID NO: 228036 - DNA, 25 bp, Rattus norvegicus
cagaccagacccaaaaggacctaag

SEQ ID NO: 228037 - DNA, 25 bp, Rattus norvegicus
cagaccagaccctaaaggacctaag

SEQ ID NO: 228038 - DNA, 25 bp, Rattus norvegicus
cagaccagagggaaaccctagcctt

SEQ ID NO: 228039 - DNA, 25 bp, Rattus norvegicus
cagaccagagggtaaccctagcctt

SEQ ID NO: 228040 - DNA, 25 bp, Rattus norvegicus
cagaccagagtcagacctctctcag

SEQ ID NO: 228041 - DNA, 25 bp, Rattus norvegicus
cagaccagagtctgacctctctcag

SEQ ID NO: 228042 - DNA, 25 bp, Rattus norvegicus
cagaccagcgcgacctgagagggca

SEQ ID NO: 228043 - DNA, 25 bp, Rattus norvegicus
cagaccagcgcgtcctgagagggca

SEQ ID NO: 228044 - DNA, 25 bp, Rattus norvegicus
cagaccagcttacgctacgaggtga

SEQ ID NO: 228045 - DNA, 25 bp, Rattus norvegicus
cagaccagcttaggctacgaggtga

SEQ ID NO: 228046 - DNA, 25 bp, Rattus norvegicus
cagaccaggctcaaaggccacaaag

SEQ ID NO: 228047 - DNA, 25 bp, Rattus norvegicus
cagaccaggctctaaggccacaaag

SEQ ID NO: 228048 - DNA, 25 bp, Rattus norvegicus
cagaccagtgaaacggcccagagag

SEQ ID NO: 228049 - DNA, 25 bp, Rattus norvegicus
cagaccagtgaatcggcccagagag

SEQ ID NO: 228050 - DNA, 25 bp, Rattus norvegicus
cagaccatatgtatcaggtttctat

SEQ ID NO: 228051 - DNA, 25 bp, Rattus norvegicus
cagaccatatgtttcaggtttctat

SEQ ID NO: 228052 - DNA, 25 bp, Rattus norvegicus
cagaccatcacaccttgcaatatat

SEQ ID NO: 228053 - DNA, 25 bp, Rattus norvegicus
cagaccatcacagcttgcaatatat

SEQ ID NO: 228054 - DNA, 25 bp, Rattus norvegicus
cagaccatgacaatcagctgcagca

SEQ ID NO: 228055 - DNA, 25 bp, Rattus norvegicus
cagaccatgacattcagctgcagca

SEQ ID NO: 228056 - DNA, 25 bp, Rattus norvegicus
cagaccatggccaggtgaagcagag

SEQ ID NO: 228057 - DNA, 25 bp, Rattus norvegicus
cagaccatggcctggtgaagcagag

SEQ ID NO: 228058 - DNA, 25 bp, Rattus norvegicus
cagacccaataacctacgccttaag

SEQ ID NO: 228059 - DNA, 25 bp, Rattus norvegicus
cagacccaataagctacgccttaag

SEQ ID NO: 228060 - DNA, 25 bp, Rattus norvegicus
cagacccaattacaaagcttttcaa

SEQ ID NO: 228061 - DNA, 25 bp, Rattus norvegicus
cagacccaattagaaagcttttcaa

SEQ ID NO: 228062 - DNA, 25 bp, Rattus norvegicus
cagacccagatgatttgtgaacgta

SEQ ID NO: 228063 - DNA, 25 bp, Rattus norvegicus
cagacccagatgttttgtgaacgta

SEQ ID NO: 228064 - DNA, 25 bp, Rattus norvegicus
cagacccagcagagaatggtaggaa

SEQ ID NO: 228065 - DNA, 25 bp, Rattus norvegicus
cagacccagcagtgaatggtaggaa

SEQ ID NO: 228066 - DNA, 25 bp, Rattus norvegicus
cagacccagtatcgcctcattgatt

SEQ ID NO: 228067 - DNA, 25 bp, Rattus norvegicus
cagacccagtatggcctcattgatt

SEQ ID NO: 228068 - DNA, 25 bp, Rattus norvegicus
cagacccatggaaacgagatgccag

SEQ ID NO: 228069 - DNA, 25 bp, Rattus norvegicus
cagacccatggatacgagatgccag

SEQ ID NO: 228070 - DNA, 25 bp, Rattus norvegicus
cagaccccagagcagtattagcgag

SEQ ID NO: 228071 - DNA, 25 bp, Rattus norvegicus
cagaccccagaggagtattagcgag

SEQ ID NO: 228072 - DNA, 25 bp, Rattus norvegicus
cagaccccaggaccttgtgatagag

SEQ ID NO: 228073 - DNA, 25 bp, Rattus norvegicus
cagaccccaggagcttgtgatagag

SEQ ID NO: 228074 - DNA, 25 bp, Rattus norvegicus
cagaccccgaacacgtgttgttaag

SEQ ID NO: 228075 - DNA, 25 bp, Rattus norvegicus
cagaccccgaactcgtgttgttaag

SEQ ID NO: 228076 - DNA, 25 bp, Rattus norvegicus
cagaccccgggacgtgcttttacag

SEQ ID NO: 228077 - DNA, 25 bp, Rattus norvegicus
cagaccccgggaggtgcttttacag

SEQ ID NO: 228078 - DNA, 25 bp, Rattus norvegicus
cagaccccttctagctttagtaaag

SEQ ID NO: 228079 - DNA, 25 bp, Rattus norvegicus
cagaccccttcttgctttagtaaag

SEQ ID NO: 228080 - DNA, 25 bp, Rattus norvegicus
cagacccgcaacacagttatcaatt

SEQ ID NO: 228081 - DNA, 25 bp, Rattus norvegicus
cagacccgcaactcagttatcaatt

SEQ ID NO: 228082 - DNA, 25 bp, Rattus norvegicus
cagaccctaaagagctgcccgggac

SEQ ID NO: 228083 - DNA, 25 bp, Rattus norvegicus
cagaccctaaagtgctgcccgggac

SEQ ID NO: 228084 - DNA, 25 bp, Rattus norvegicus
cagaccctaggaacacttcctgaaa

SEQ ID NO: 228085 - DNA, 25 bp, Rattus norvegicus
cagaccctaggatcacttcctgaaa

SEQ ID NO: 228086 - DNA, 25 bp, Rattus norvegicus
cagaccctcaccacaaaagtcggtt

SEQ ID NO: 228087 - DNA, 25 bp, Rattus norvegicus
cagaccctcacctcaaaagtcggtt

SEQ ID NO: 228088 - DNA, 25 bp, Rattus norvegicus
cagaccctccgtagaattcagagaa

SEQ ID NO: 228089 - DNA, 25 bp, Rattus norvegicus
cagaccctccgttgaattcagagaa

SEQ ID NO: 228090 - DNA, 25 bp, Rattus norvegicus
cagaccctgcttacactggatgtaa

SEQ ID NO: 228091 - DNA, 25 bp, Rattus norvegicus
cagaccctgctttcactggatgtaa

SEQ ID NO: 228092 - DNA, 25 bp, Rattus norvegicus
cagaccctgggcagcgcactcattg

SEQ ID NO: 228093 - DNA, 25 bp, Rattus norvegicus
cagaccctgggctgcgcactcattg

SEQ ID NO: 228094 - DNA, 25 bp, Rattus norvegicus
cagaccctgtgacactggttgttta

SEQ ID NO: 228095 - DNA, 25 bp, Rattus norvegicus
cagaccctgtgagactggttgttta

SEQ ID NO: 228096 - DNA, 25 bp, Rattus norvegicus
cagaccgagcatccacaaacaagaa

SEQ ID NO: 228097 - DNA, 25 bp, Rattus norvegicus
cagaccgagcatgcacaaacaagaa

SEQ ID NO: 228098 - DNA, 25 bp, Rattus norvegicus
cagaccgggacgcaagctgtaccaa

SEQ ID NO: 228099 - DNA, 25 bp, Rattus norvegicus
cagaccgggacggaagctgtaccaa

SEQ ID NO: 228100 - DNA, 25 bp, Rattus norvegicus
cagaccggttttcctggctggagtc

SEQ ID NO: 228101 - DNA, 25 bp, Rattus norvegicus
cagaccggttttgctggctggagtc

SEQ ID NO: 228102 - DNA, 25 bp, Rattus norvegicus
cagaccgtacatctttgagggacta

SEQ ID NO: 228103 - DNA, 25 bp, Rattus norvegicus
cagaccgtacatgtttgagggacta

SEQ ID NO: 228104 - DNA, 25 bp, Rattus norvegicus
cagaccgtgatgatgactacttgag

SEQ ID NO: 228105 - DNA, 25 bp, Rattus norvegicus
cagaccgtgatgttgactacttgag

SEQ ID NO: 228106 - DNA, 25 bp, Rattus norvegicus
cagaccgtgcttactattgtacaga

SEQ ID NO: 228107 - DNA, 25 bp, Rattus norvegicus
cagaccgtgctttctattgtacaga

SEQ ID NO: 228108 - DNA, 25 bp, Rattus norvegicus
cagacctaaagaaattggaaaccag

SEQ ID NO: 228109 - DNA, 25 bp, Rattus norvegicus
cagacctaaagatattggaaaccag

SEQ ID NO: 228110 - DNA, 25 bp, Rattus norvegicus
cagacctacaggacatatcaatgaa

SEQ ID NO: 228111 - DNA, 25 bp, Rattus norvegicus
cagacctacaggtcatatcaatgaa

SEQ ID NO: 228112 - DNA, 25 bp, Rattus norvegicus
cagacctacagtagagcagcaaggt

SEQ ID NO: 228113 - DNA, 25 bp, Rattus norvegicus
cagacctacagttgagcagcaaggt

SEQ ID NO: 228114 - DNA, 25 bp, Rattus norvegicus
cagacctagccacatatcgagaaag

SEQ ID NO: 228115 - DNA, 25 bp, Rattus norvegicus
cagacctagccagatatcgagaaag

SEQ ID NO: 228116 - DNA, 25 bp, Rattus norvegicus
cagacctagccgatgtgtttttgtt

SEQ ID NO: 228117 - DNA, 25 bp, Rattus norvegicus
cagacctagccgttgtgtttttgtt

SEQ ID NO: 228118 - DNA, 25 bp, Rattus norvegicus
cagacctcaagaattccatttcctt

SEQ ID NO: 228119 - DNA, 25 bp, Rattus norvegicus
cagacctcaagatttccatttcctt

SEQ ID NO: 228120 - DNA, 25 bp, Rattus norvegicus
cagacctccttgattatggctttca

SEQ ID NO: 228121 - DNA, 25 bp, Rattus norvegicus
cagacctccttgtttatggctttca

SEQ ID NO: 228122 - DNA, 25 bp, Rattus norvegicus
cagacctctgagattgaggcagctt

SEQ ID NO: 228123 - DNA, 25 bp, Rattus norvegicus
cagacctctgagtttgaggcagctt

SEQ ID NO: 228124 - DNA, 25 bp, Rattus norvegicus
cagacctctgcaagtatatttgata

SEQ ID NO: 228125 - DNA, 25 bp, Rattus norvegicus
cagacctctgcatgtatatttgata

SEQ ID NO: 228126 - DNA, 25 bp, Rattus norvegicus
cagacctctggaatttattgcatga

SEQ ID NO: 228127 - DNA, 25 bp, Rattus norvegicus
cagacctctggattttattgcatga

SEQ ID NO: 228128 - DNA, 25 bp, Rattus norvegicus
cagacctgactgacttgcatagtaa

SEQ ID NO: 228129 - DNA, 25 bp, Rattus norvegicus
cagacctgactgtcttgcatagtaa

SEQ ID NO: 228130 - DNA, 25 bp, Rattus norvegicus
cagacctgtagaagtttggccaaat

SEQ ID NO: 228131 - DNA, 25 bp, Rattus norvegicus
cagacctgtagatgtttggccaaat

SEQ ID NO: 228132 - DNA, 25 bp, Rattus norvegicus
cagacctgtgagcagtgttgttaca

SEQ ID NO: 228133 - DNA, 25 bp, Rattus norvegicus
cagacctgtgaggagtgttgttaca

SEQ ID NO: 228134 - DNA, 25 bp, Rattus norvegicus
cagacctgtggaaaaggcttcaccc

SEQ ID NO: 228135 - DNA, 25 bp, Rattus norvegicus
cagacctgtggataaggcttcaccc

SEQ ID NO: 228136 - DNA, 25 bp, Rattus norvegicus
cagaccttaaaccaaacccaagcat

SEQ ID NO: 228137 - DNA, 25 bp, Rattus norvegicus
cagaccttaaacgaaacccaagcat

SEQ ID NO: 228138 - DNA, 25 bp, Rattus norvegicus
cagaccttccgacaatatggccaga

SEQ ID NO: 228139 - DNA, 25 bp, Rattus norvegicus
cagaccttccgagaatatggccaga

SEQ ID NO: 228140 - DNA, 25 bp, Rattus norvegicus
cagaccttccggaagatcatccgaa

SEQ ID NO: 228141 - DNA, 25 bp, Rattus norvegicus
cagaccttccggtagatcatccgaa

SEQ ID NO: 228142 - DNA, 25 bp, Rattus norvegicus
cagaccttgctgaaatggctcctcc

SEQ ID NO: 228143 - DNA, 25 bp, Rattus norvegicus
cagaccttgctgtaatggctcctcc

SEQ ID NO: 228144 - DNA, 25 bp, Rattus norvegicus
cagacctttccccattgagttttat

SEQ ID NO: 228145 - DNA, 25 bp, Rattus norvegicus
cagacctttcccgattgagttttat

SEQ ID NO: 228146 - DNA, 25 bp, Rattus norvegicus
cagacctttctgaggctttttggta

SEQ ID NO: 228147 - DNA, 25 bp, Rattus norvegicus
cagacctttctgtggctttttggta

SEQ ID NO: 228148 - DNA, 25 bp, Rattus norvegicus
cagacctttgttaactgctctgtgg

SEQ ID NO: 228149 - DNA, 25 bp, Rattus norvegicus
cagacctttgtttactgctctgtgg

SEQ ID NO: 228150 - DNA, 25 bp, Rattus norvegicus
cagacgacgttgaatgcaccagggt

SEQ ID NO: 228151 - DNA, 25 bp, Rattus norvegicus
cagacgacgttgtatgcaccagggt

SEQ ID NO: 228152 - DNA, 25 bp, Rattus norvegicus
cagacgactgcacatgttgataaca

SEQ ID NO: 228153 - DNA, 25 bp, Rattus norvegicus
cagacgactgcagatgttgataaca

SEQ ID NO: 228154 - DNA, 25 bp, Rattus norvegicus
cagacgagactgcatctttcagaat

SEQ ID NO: 228155 - DNA, 25 bp, Rattus norvegicus
cagacgagactggatctttcagaat

SEQ ID NO: 228156 - DNA, 25 bp, Rattus norvegicus
cagacgagctgtccctgtggttaga

SEQ ID NO: 228157 - DNA, 25 bp, Rattus norvegicus
cagacgagctgtgcctgtggttaga

SEQ ID NO: 228158 - DNA, 25 bp, Rattus norvegicus
cagacgaggagtacgctgtgcgcaa

SEQ ID NO: 228159 - DNA, 25 bp, Rattus norvegicus
cagacgaggagttcgctgtgcgcaa

SEQ ID NO: 228160 - DNA, 25 bp, Rattus norvegicus
cagacgagttcgatgcttttgtttt

SEQ ID NO: 228161 - DNA, 25 bp, Rattus norvegicus
cagacgagttcgttgcttttgtttt

SEQ ID NO: 228162 - DNA, 25 bp, Rattus norvegicus
cagacgcatcgcaggtggatgtcaa

SEQ ID NO: 228163 - DNA, 25 bp, Rattus norvegicus
cagacgcatcgctggtggatgtcaa

SEQ ID NO: 228164 - DNA, 25 bp, Rattus norvegicus
cagacgccacagcacgtgaggtcaa

SEQ ID NO: 228165 - DNA, 25 bp, Rattus norvegicus
cagacgccacaggacgtgaggtcaa

SEQ ID NO: 228166 - DNA, 25 bp, Rattus norvegicus
cagacgccattgctggaccagctga

SEQ ID NO: 228167 - DNA, 25 bp, Rattus norvegicus
cagacgccattggtggaccagctga

SEQ ID NO: 228168 - DNA, 25 bp, Rattus norvegicus
cagacggagctgcttcatcatgttc

SEQ ID NO: 228169 - DNA, 25 bp, Rattus norvegicus
cagacggagctggttcatcatgttc

SEQ ID NO: 228170 - DNA, 25 bp, Rattus norvegicus
cagacggatcctcagttcgaggtca

SEQ ID NO: 228171 - DNA, 25 bp, Rattus norvegicus
cagacggatcctgagttcgaggtca

SEQ ID NO: 228172 - DNA, 25 bp, Rattus norvegicus
cagacggccagcctcttggatgtga

SEQ ID NO: 228173 - DNA, 25 bp, Rattus norvegicus
cagacggccagcgtcttggatgtga

SEQ ID NO: 228174 - DNA, 25 bp, Rattus norvegicus
cagacggcgactaccagacagaggt

SEQ ID NO: 228175 - DNA, 25 bp, Rattus norvegicus
cagacggcgacttccagacagaggt

SEQ ID NO: 228176 - DNA, 25 bp, Rattus norvegicus
cagacggcgctgatgatgcagagct

SEQ ID NO: 228177 - DNA, 25 bp, Rattus norvegicus
cagacggcgctgttgatgcagagct

SEQ ID NO: 228178 - DNA, 25 bp, Rattus norvegicus
cagacgggcgccaccagggaaatgt

SEQ ID NO: 228179 - DNA, 25 bp, Rattus norvegicus
cagacgggcgcctccagggaaatgt

SEQ ID NO: 228180 - DNA, 25 bp, Rattus norvegicus
cagacgggtgtcagaggtattttca

SEQ ID NO: 228181 - DNA, 25 bp, Rattus norvegicus
cagacgggtgtctgaggtattttca

SEQ ID NO: 228182 - DNA, 25 bp, Rattus norvegicus
cagacggtaccccacagttgacggt

SEQ ID NO: 228183 - DNA, 25 bp, Rattus norvegicus
cagacggtacccgacagttgacggt

SEQ ID NO: 228184 - DNA, 25 bp, Rattus norvegicus
cagacggtttttagctatttgaata

SEQ ID NO: 228185 - DNA, 25 bp, Rattus norvegicus
cagacggttttttgctatttgaata

SEQ ID NO: 228186 - DNA, 25 bp, Rattus norvegicus
cagacgtaactaatgtataaatgta

SEQ ID NO: 228187 - DNA, 25 bp, Rattus norvegicus
cagacgtaactattgtataaatgta

SEQ ID NO: 228188 - DNA, 25 bp, Rattus norvegicus
cagacgtacggaaagtcaagggtat

SEQ ID NO: 228189 - DNA, 25 bp, Rattus norvegicus
cagacgtacggatagtcaagggtat

SEQ ID NO: 228190 - DNA, 25 bp, Rattus norvegicus
cagacgtcacatcagaacccagagg

SEQ ID NO: 228191 - DNA, 25 bp, Rattus norvegicus
cagacgtcacatgagaacccagagg

SEQ ID NO: 228192 - DNA, 25 bp, Rattus norvegicus
cagacgtcatctcctgtcctgctaa

SEQ ID NO: 228193 - DNA, 25 bp, Rattus norvegicus
cagacgtcatctgctgtcctgctaa

SEQ ID NO: 228194 - DNA, 25 bp, Rattus norvegicus
cagacgtcgtcaagatggctcagta

SEQ ID NO: 228195 - DNA, 25 bp, Rattus norvegicus
cagacgtcgtcatgatggctcagta

SEQ ID NO: 228196 - DNA, 25 bp, Rattus norvegicus
cagacgtgctaaccctattcaatgt

SEQ ID NO: 228197 - DNA, 25 bp, Rattus norvegicus
cagacgtgctaagcctattcaatgt

SEQ ID NO: 228198 - DNA, 25 bp, Rattus norvegicus
cagacgttcctgattttatgtgtga

SEQ ID NO: 228199 - DNA, 25 bp, Rattus norvegicus
cagacgttcctgtttttatgtgtga

SEQ ID NO: 228200 - DNA, 25 bp, Rattus norvegicus
cagacgttgtgccaggagctttcaa

SEQ ID NO: 228201 - DNA, 25 bp, Rattus norvegicus
cagacgttgtgcgaggagctttcaa

SEQ ID NO: 228202 - DNA, 25 bp, Rattus norvegicus
cagactaacctcaggagagtcgttt

SEQ ID NO: 228203 - DNA, 25 bp, Rattus norvegicus
cagactaacctctggagagtcgttt

SEQ ID NO: 228204 - DNA, 25 bp, Rattus norvegicus
cagactaatcttaaccacggtgcta

SEQ ID NO: 228205 - DNA, 25 bp, Rattus norvegicus
cagactaatctttaccacggtgcta

SEQ ID NO: 228206 - DNA, 25 bp, Rattus norvegicus
cagactacgctgcaatggatgatgt

SEQ ID NO: 228207 - DNA, 25 bp, Rattus norvegicus
cagactacgctggaatggatgatgt

SEQ ID NO: 228208 - DNA, 25 bp, Rattus norvegicus
cagactatagggaccagtgggtatc

SEQ ID NO: 228209 - DNA, 25 bp, Rattus norvegicus
cagactatagggtccagtgggtatc

SEQ ID NO: 228210 - DNA, 25 bp, Rattus norvegicus
cagactatctacctttttgttccta

SEQ ID NO: 228211 - DNA, 25 bp, Rattus norvegicus
cagactatctacgtttttgttccta

SEQ ID NO: 228212 - DNA, 25 bp, Rattus norvegicus
cagactatgctgacgatgacgatgg

SEQ ID NO: 228213 - DNA, 25 bp, Rattus norvegicus
cagactatgctgtcgatgacgatgg

SEQ ID NO: 228214 - DNA, 25 bp, Rattus norvegicus
cagactatgtatatggctactgcca

SEQ ID NO: 228215 - DNA, 25 bp, Rattus norvegicus
cagactatgtatttggctactgcca

SEQ ID NO: 228216 - DNA, 25 bp, Rattus norvegicus
cagactattcttacacagcttgctc

SEQ ID NO: 228217 - DNA, 25 bp, Rattus norvegicus
cagactattctttcacagcttgctc

SEQ ID NO: 228218 - DNA, 25 bp, Rattus norvegicus
cagactatttctcgagagctgcaga

SEQ ID NO: 228219 - DNA, 25 bp, Rattus norvegicus
cagactatttctggagagctgcaga

SEQ ID NO: 228220 - DNA, 25 bp, Rattus norvegicus
cagactcacagcactacgtatcaaa

SEQ ID NO: 228221 - DNA, 25 bp, Rattus norvegicus
cagactcacagctctacgtatcaaa

SEQ ID NO: 228222 - DNA, 25 bp, Rattus norvegicus
cagactcactttcttcaactggctg

SEQ ID NO: 228223 - DNA, 25 bp, Rattus norvegicus
cagactcactttgttcaactggctg

SEQ ID NO: 228224 - DNA, 25 bp, Rattus norvegicus
cagactcagcatcaagcacttccgt

SEQ ID NO: 228225 - DNA, 25 bp, Rattus norvegicus
cagactcagcatgaagcacttccgt

SEQ ID NO: 228226 - DNA, 25 bp, Rattus norvegicus
cagactcaggacatcagggttggta

SEQ ID NO: 228227 - DNA, 25 bp, Rattus norvegicus
cagactcaggacttcagggttggta

SEQ ID NO: 228228 - DNA, 25 bp, Rattus norvegicus
cagactcagggtatagctacttgct

SEQ ID NO: 228229 - DNA, 25 bp, Rattus norvegicus
cagactcagggtttagctacttgct

SEQ ID NO: 228230 - DNA, 25 bp, Rattus norvegicus
cagactcatcgcagacagcctgtgt

SEQ ID NO: 228231 - DNA, 25 bp, Rattus norvegicus
cagactcatcgctgacagcctgtgt

SEQ ID NO: 228232 - DNA, 25 bp, Rattus norvegicus
cagactcattgtaattcaccgtttt

SEQ ID NO: 228233 - DNA, 25 bp, Rattus norvegicus
cagactcattgttattcaccgtttt

SEQ ID NO: 228234 - DNA, 25 bp, Rattus norvegicus
cagactccaagacggctgagccttc

SEQ ID NO: 228235 - DNA, 25 bp, Rattus norvegicus
cagactccaagagggctgagccttc

SEQ ID NO: 228236 - DNA, 25 bp, Rattus norvegicus
cagactccacaaccagtgctggtgg

SEQ ID NO: 228237 - DNA, 25 bp, Rattus norvegicus
cagactccacaagcagtgctggtgg

SEQ ID NO: 228238 - DNA, 25 bp, Rattus norvegicus
cagactcccatacgcgtgcaggcgg

SEQ ID NO: 228239 - DNA, 25 bp, Rattus norvegicus
cagactcccataggcgtgcaggcgg

SEQ ID NO: 228240 - DNA, 25 bp, Rattus norvegicus
cagactccgaagaccccttggaggt

SEQ ID NO: 228241 - DNA, 25 bp, Rattus norvegicus
cagactccgaagtccccttggaggt

SEQ ID NO: 228242 - DNA, 25 bp, Rattus norvegicus
cagactcctcagacgtgggaactat

SEQ ID NO: 228243 - DNA, 25 bp, Rattus norvegicus
cagactcctcagtcgtgggaactat

SEQ ID NO: 228244 - DNA, 25 bp, Rattus norvegicus
cagactcctgctatgttgtttagtt

SEQ ID NO: 228245 - DNA, 25 bp, Rattus norvegicus
cagactcctgctttgttgtttagtt

SEQ ID NO: 228246 - DNA, 25 bp, Rattus norvegicus
cagactcctggcaaattcctccatg

SEQ ID NO: 228247 - DNA, 25 bp, Rattus norvegicus
cagactcctggctaattcctccatg

SEQ ID NO: 228248 - DNA, 25 bp, Rattus norvegicus
cagactcgggctaagggccaggcca

SEQ ID NO: 228249 - DNA, 25 bp, Rattus norvegicus
cagactcgggcttagggccaggcca

SEQ ID NO: 228250 - DNA, 25 bp, Rattus norvegicus
cagactcgtggcatctaagttttgt

SEQ ID NO: 228251 - DNA, 25 bp, Rattus norvegicus
cagactcgtggcttctaagttttgt

SEQ ID NO: 228252 - DNA, 25 bp, Rattus norvegicus
cagactctagatatgccatgcaggg

SEQ ID NO: 228253 - DNA, 25 bp, Rattus norvegicus
cagactctagatttgccatgcaggg

SEQ ID NO: 228254 - DNA, 25 bp, Rattus norvegicus
cagactctcaccaatcaggtcaaga

SEQ ID NO: 228255 - DNA, 25 bp, Rattus norvegicus
cagactctcacctatcaggtcaaga

SEQ ID NO: 228256 - DNA, 25 bp, Rattus norvegicus
cagactctcatgcagttggttgtaa

SEQ ID NO: 228257 - DNA, 25 bp, Rattus norvegicus
cagactctcatggagttggttgtaa

SEQ ID NO: 228258 - DNA, 25 bp, Rattus norvegicus
cagactctccatcctgaatgacagc

SEQ ID NO: 228259 - DNA, 25 bp, Rattus norvegicus
cagactctccatgctgaatgacagc

SEQ ID NO: 228260 - DNA, 25 bp, Rattus norvegicus
cagactctccttctactatattttt

SEQ ID NO: 228261 - DNA, 25 bp, Rattus norvegicus
cagactctccttgtactatattttt

SEQ ID NO: 228262 - DNA, 25 bp, Rattus norvegicus
cagactctctgtcgatcttaggtaa

SEQ ID NO: 228263 - DNA, 25 bp, Rattus norvegicus
cagactctctgtggatcttaggtaa

SEQ ID NO: 228264 - DNA, 25 bp, Rattus norvegicus
cagactctgcacacggaagcaggca

SEQ ID NO: 228265 - DNA, 25 bp, Rattus norvegicus
cagactctgcactcggaagcaggca

SEQ ID NO: 228266 - DNA, 25 bp, Rattus norvegicus
cagactctgctgacatgaaggtgaa

SEQ ID NO: 228267 - DNA, 25 bp, Rattus norvegicus
cagactctgctgtcatgaaggtgaa

SEQ ID NO: 228268 - DNA, 25 bp, Rattus norvegicus
cagactctggagatgcgcgtgctag

SEQ ID NO: 228269 - DNA, 25 bp, Rattus norvegicus
cagactctggagttgcgcgtgctag

SEQ ID NO: 228270 - DNA, 25 bp, Rattus norvegicus
cagactctgggcctagcagctagga

SEQ ID NO: 228271 - DNA, 25 bp, Rattus norvegicus
cagactctgggcgtagcagctagga

SEQ ID NO: 228272 - DNA, 25 bp, Rattus norvegicus
cagactctgtgaccaagggagtgct

SEQ ID NO: 228273 - DNA, 25 bp, Rattus norvegicus
cagactctgtgagcaagggagtgct

SEQ ID NO: 228274 - DNA, 25 bp, Rattus norvegicus
cagactcttcctcatcagtaaacta

SEQ ID NO: 228275 - DNA, 25 bp, Rattus norvegicus
cagactcttcctgatcagtaaacta

SEQ ID NO: 228276 - DNA, 25 bp, Rattus norvegicus
cagactcttctgcacacgtgtacaa

SEQ ID NO: 228277 - DNA, 25 bp, Rattus norvegicus
cagactcttctggacacgtgtacaa

SEQ ID NO: 228278 - DNA, 25 bp, Rattus norvegicus
cagactgaaggtccgcgttaccggc

SEQ ID NO: 228279 - DNA, 25 bp, Rattus norvegicus
cagactgaaggtgcgcgttaccggc

SEQ ID NO: 228280 - DNA, 25 bp, Rattus norvegicus
cagactgacagcagcacattcggca

SEQ ID NO: 228281 - DNA, 25 bp, Rattus norvegicus
cagactgacagctgcacattcggca

SEQ ID NO: 228282 - DNA, 25 bp, Rattus norvegicus
cagactgagacacctggcttgggct

SEQ ID NO: 228283 - DNA, 25 bp, Rattus norvegicus
cagactgagacagctggcttgggct

SEQ ID NO: 228284 - DNA, 25 bp, Rattus norvegicus
cagactgagctgcactatgtgagga

SEQ ID NO: 228285 - DNA, 25 bp, Rattus norvegicus
cagactgagctggactatgtgagga

SEQ ID NO: 228286 - DNA, 25 bp, Rattus norvegicus
cagactgaggtgacctggtcatgtg

SEQ ID NO: 228287 - DNA, 25 bp, Rattus norvegicus
cagactgaggtgtcctggtcatgtg

SEQ ID NO: 228288 - DNA, 25 bp, Rattus norvegicus
cagactgcccctacgagtctaaacc

SEQ ID NO: 228289 - DNA, 25 bp, Rattus norvegicus
cagactgccccttcgagtctaaacc

SEQ ID NO: 228290 - DNA, 25 bp, Rattus norvegicus
cagactgcctgtaccaaaatccaaa

SEQ ID NO: 228291 - DNA, 25 bp, Rattus norvegicus
cagactgcctgttccaaaatccaaa

SEQ ID NO: 228292 - DNA, 25 bp, Rattus norvegicus
cagactgcgctcagaggacaggtgc

SEQ ID NO: 228293 - DNA, 25 bp, Rattus norvegicus
cagactgcgctctgaggacaggtgc

SEQ ID NO: 228294 - DNA, 25 bp, Rattus norvegicus
cagactggacctaagagcattttag

SEQ ID NO: 228295 - DNA, 25 bp, Rattus norvegicus
cagactggaccttagagcattttag

SEQ ID NO: 228296 - DNA, 25 bp, Rattus norvegicus
cagactggcagtagcctggaccaga

SEQ ID NO: 228297 - DNA, 25 bp, Rattus norvegicus
cagactggcagttgcctggaccaga

SEQ ID NO: 228298 - DNA, 25 bp, Rattus norvegicus
cagactgggcaacggctacaagctt

SEQ ID NO: 228299 - DNA, 25 bp, Rattus norvegicus
cagactgggcaagggctacaagctt

SEQ ID NO: 228300 - DNA, 25 bp, Rattus norvegicus
cagactggtcatatcttaatagcaa

SEQ ID NO: 228301 - DNA, 25 bp, Rattus norvegicus
cagactggtcatatgcggatggccg

SEQ ID NO: 228302 - DNA, 25 bp, Rattus norvegicus
cagactggtcatttcttaatagcaa

SEQ ID NO: 228303 - DNA, 25 bp, Rattus norvegicus
cagactggtcatttgcggatggccg

SEQ ID NO: 228304 - DNA, 25 bp, Rattus norvegicus
cagactgtagtgagtgctggctgca

SEQ ID NO: 228305 - DNA, 25 bp, Rattus norvegicus
cagactgtagtgtgtgctggctgca

SEQ ID NO: 228306 - DNA, 25 bp, Rattus norvegicus
cagactgtatttatcctattggttt

SEQ ID NO: 228307 - DNA, 25 bp, Rattus norvegicus
cagactgtatttttcctattggttt

SEQ ID NO: 228308 - DNA, 25 bp, Rattus norvegicus
cagactgtcaatatgggccctgagt

SEQ ID NO: 228309 - DNA, 25 bp, Rattus norvegicus
cagactgtcaatttgggccctgagt

SEQ ID NO: 228310 - DNA, 25 bp, Rattus norvegicus
cagactgtgacccttgtattagaaa

SEQ ID NO: 228311 - DNA, 25 bp, Rattus norvegicus
cagactgtgaccgttgtattagaaa

SEQ ID NO: 228312 - DNA, 25 bp, Rattus norvegicus
cagactgtgataaaggtgcattttc

SEQ ID NO: 228313 - DNA, 25 bp, Rattus norvegicus
cagactgtgatataggtgcattttc

SEQ ID NO: 228314 - DNA, 25 bp, Rattus norvegicus
cagactgtgcacagtttgtttaaaa

SEQ ID NO: 228315 - DNA, 25 bp, Rattus norvegicus
cagactgtgcactgtttgtttaaaa

SEQ ID NO: 228316 - DNA, 25 bp, Rattus norvegicus
cagactgtgccaccctttgtggttg

SEQ ID NO: 228317 - DNA, 25 bp, Rattus norvegicus
cagactgtgccagcctttgtggttg

SEQ ID NO: 228318 - DNA, 25 bp, Rattus norvegicus
cagactgttactatgttggccctat

SEQ ID NO: 228319 - DNA, 25 bp, Rattus norvegicus
cagactgttactttgttggccctat

SEQ ID NO: 228320 - DNA, 25 bp, Rattus norvegicus
cagactgttgatcctaatgtacttg

SEQ ID NO: 228321 - DNA, 25 bp, Rattus norvegicus
cagactgttgatgctaatgtacttg

SEQ ID NO: 228322 - DNA, 25 bp, Rattus norvegicus
cagactgtttctattggcttagacc

SEQ ID NO: 228323 - DNA, 25 bp, Rattus norvegicus
cagactgtttcttttggcttagacc

SEQ ID NO: 228324 - DNA, 25 bp, Rattus norvegicus
cagactgttttgagctgagcatggc

SEQ ID NO: 228325 - DNA, 25 bp, Rattus norvegicus
cagactgttttgtgctgagcatggc

SEQ ID NO: 228326 - DNA, 25 bp, Rattus norvegicus
cagacttacagcaggatgccaggct

SEQ ID NO: 228327 - DNA, 25 bp, Rattus norvegicus
cagacttacagctggatgccaggct

SEQ ID NO: 228328 - DNA, 25 bp, Rattus norvegicus
cagacttacattactgcttcagtgt

SEQ ID NO: 228329 - DNA, 25 bp, Rattus norvegicus
cagacttacatttctgcttcagtgt

SEQ ID NO: 228330 - DNA, 25 bp, Rattus norvegicus
cagacttcaaagagattggcctatt

SEQ ID NO: 228331 - DNA, 25 bp, Rattus norvegicus
cagacttcaaagtgattggcctatt

SEQ ID NO: 228332 - DNA, 25 bp, Rattus norvegicus
cagacttccgtgactgtaacaggga

SEQ ID NO: 228333 - DNA, 25 bp, Rattus norvegicus
cagacttccgtgtctgtaacaggga

SEQ ID NO: 228334 - DNA, 25 bp, Rattus norvegicus
cagacttcgagcatcctgtaaggac

SEQ ID NO: 228335 - DNA, 25 bp, Rattus norvegicus
cagacttcgagcttcctgtaaggac

SEQ ID NO: 228336 - DNA, 25 bp, Rattus norvegicus
cagacttctcctagcctcaaataaa

SEQ ID NO: 228337 - DNA, 25 bp, Rattus norvegicus
cagacttctcctcggtggattttca

SEQ ID NO: 228338 - DNA, 25 bp, Rattus norvegicus
cagacttctcctgggtggattttca

SEQ ID NO: 228339 - DNA, 25 bp, Rattus norvegicus
cagacttctccttgcctcaaataaa

SEQ ID NO: 228340 - DNA, 25 bp, Rattus norvegicus
cagacttctctacttcagagtaaga

SEQ ID NO: 228341 - DNA, 25 bp, Rattus norvegicus
cagacttctctagttcagagtaaga

SEQ ID NO: 228342 - DNA, 25 bp, Rattus norvegicus
cagacttctgagctgtgttctgctg

SEQ ID NO: 228343 - DNA, 25 bp, Rattus norvegicus
cagacttctgaggtgtgttctgctg

SEQ ID NO: 228344 - DNA, 25 bp, Rattus norvegicus
cagacttctgtgagcttttatactt

SEQ ID NO: 228345 - DNA, 25 bp, Rattus norvegicus
cagacttctgtgtgcttttatactt

SEQ ID NO: 228346 - DNA, 25 bp, Rattus norvegicus
cagacttgaaataagctccgtcccc

SEQ ID NO: 228347 - DNA, 25 bp, Rattus norvegicus
cagacttgaaattagctccgtcccc

SEQ ID NO: 228348 - DNA, 25 bp, Rattus norvegicus
cagacttgacctccggcgctgggct

SEQ ID NO: 228349 - DNA, 25 bp, Rattus norvegicus
cagacttgacctgcggcgctgggct

SEQ ID NO: 228350 - DNA, 25 bp, Rattus norvegicus
cagacttgagcaacttttccttcag

SEQ ID NO: 228351 - DNA, 25 bp, Rattus norvegicus
cagacttgagcatcttttccttcag

SEQ ID NO: 228352 - DNA, 25 bp, Rattus norvegicus
cagacttgagtcaccatgtatgtgg

SEQ ID NO: 228353 - DNA, 25 bp, Rattus norvegicus
cagacttgagtcacttttaccctaa

SEQ ID NO: 228354 - DNA, 25 bp, Rattus norvegicus
cagacttgagtctccatgtatgtgg

SEQ ID NO: 228355 - DNA, 25 bp, Rattus norvegicus
cagacttgagtctcttttaccctaa

SEQ ID NO: 228356 - DNA, 25 bp, Rattus norvegicus
cagacttgccagctggccagtatga

SEQ ID NO: 228357 - DNA, 25 bp, Rattus norvegicus
cagacttgccaggtggccagtatga

SEQ ID NO: 228358 - DNA, 25 bp, Rattus norvegicus
cagacttgcgagacatggcctttat

SEQ ID NO: 228359 - DNA, 25 bp, Rattus norvegicus
cagacttgcgagtcatggcctttat

SEQ ID NO: 228360 - DNA, 25 bp, Rattus norvegicus
cagacttggaaaacgatgtgttcgg

SEQ ID NO: 228361 - DNA, 25 bp, Rattus norvegicus
cagacttggaaatcgatgtgttcgg

SEQ ID NO: 228362 - DNA, 25 bp, Rattus norvegicus
cagacttggcggcagggaactttac

SEQ ID NO: 228363 - DNA, 25 bp, Rattus norvegicus
cagacttggcgggagggaactttac

SEQ ID NO: 228364 - DNA, 25 bp, Rattus norvegicus
cagacttgggagctttcggaacctt

SEQ ID NO: 228365 - DNA, 25 bp, Rattus norvegicus
cagacttgggaggtttcggaacctt

SEQ ID NO: 228366 - DNA, 25 bp, Rattus norvegicus
cagacttgggttaacacgtcacttc

SEQ ID NO: 228367 - DNA, 25 bp, Rattus norvegicus
cagacttgggtttacacgtcacttc

SEQ ID NO: 228368 - DNA, 25 bp, Rattus norvegicus
cagacttggtatacctactgtggga

SEQ ID NO: 228369 - DNA, 25 bp, Rattus norvegicus
cagacttggtattcctactgtggga

SEQ ID NO: 228370 - DNA, 25 bp, Rattus norvegicus
cagacttggtgtattgcttgctatg

SEQ ID NO: 228371 - DNA, 25 bp, Rattus norvegicus
cagacttggtgttttgcttgctatg

SEQ ID NO: 228372 - DNA, 25 bp, Rattus norvegicus
cagactttctccactgaccttttta

SEQ ID NO: 228373 - DNA, 25 bp, Rattus norvegicus
cagactttctcctctgaccttttta

SEQ ID NO: 228374 - DNA, 25 bp, Rattus norvegicus
cagactttgcagacccagaggtaat

SEQ ID NO: 228375 - DNA, 25 bp, Rattus norvegicus
cagactttgcagaggttggaccgaa

SEQ ID NO: 228376 - DNA, 25 bp, Rattus norvegicus
cagactttgcagtcccagaggtaat

SEQ ID NO: 228377 - DNA, 25 bp, Rattus norvegicus
cagactttgcagtggttggaccgaa

SEQ ID NO: 228378 - DNA, 25 bp, Rattus norvegicus
cagactttgcttatcacacttttaa

SEQ ID NO: 228379 - DNA, 25 bp, Rattus norvegicus
cagactttgcttttcacacttttaa

SEQ ID NO: 228380 - DNA, 25 bp, Rattus norvegicus
cagactttggccacgcgagagtaat

SEQ ID NO: 228381 - DNA, 25 bp, Rattus norvegicus
cagactttggcctcgcgagagtaat

SEQ ID NO: 228382 - DNA, 25 bp, Rattus norvegicus
cagactttgtctcctaatttaaaat

SEQ ID NO: 228383 - DNA, 25 bp, Rattus norvegicus
cagactttgtctgctaatttaaaat

SEQ ID NO: 228384 - DNA, 25 bp, Rattus norvegicus
cagactttttctcaaagggctccgc

SEQ ID NO: 228385 - DNA, 25 bp, Rattus norvegicus
cagactttttctgaaagggctccgc

SEQ ID NO: 228386 - DNA, 25 bp, Rattus norvegicus
cagagaaagctaaacccatctcctg

SEQ ID NO: 228387 - DNA, 25 bp, Rattus norvegicus
cagagaaagctatacccatctcctg

SEQ ID NO: 228388 - DNA, 25 bp, Rattus norvegicus
cagagaaatcttcttaacagcagaa

SEQ ID NO: 228389 - DNA, 25 bp, Rattus norvegicus
cagagaaatcttgttaacagcagaa

SEQ ID NO: 228390 - DNA, 25 bp, Rattus norvegicus
cagagaaatggtcgcttttggctcc

SEQ ID NO: 228391 - DNA, 25 bp, Rattus norvegicus
cagagaaatggtggcttttggctcc

SEQ ID NO: 228392 - DNA, 25 bp, Rattus norvegicus
cagagaacaagcaccttcctttaaa

SEQ ID NO: 228393 - DNA, 25 bp, Rattus norvegicus
cagagaacaagctccttcctttaaa

SEQ ID NO: 228394 - DNA, 25 bp, Rattus norvegicus
cagagaacagcacgcttcttctgag

SEQ ID NO: 228395 - DNA, 25 bp, Rattus norvegicus
cagagaacagcaggcttcttctgag

SEQ ID NO: 228396 - DNA, 25 bp, Rattus norvegicus
cagagaacctgtccgtggttcccag

SEQ ID NO: 228397 - DNA, 25 bp, Rattus norvegicus
cagagaacctgtgcgtggttcccag

SEQ ID NO: 228398 - DNA, 25 bp, Rattus norvegicus
cagagaacgggaagccccaggcctg

SEQ ID NO: 228399 - DNA, 25 bp, Rattus norvegicus
cagagaacgggatgccccaggcctg

SEQ ID NO: 228400 - DNA, 25 bp, Rattus norvegicus
cagagaactcggaacatgtgtatgt

SEQ ID NO: 228401 - DNA, 25 bp, Rattus norvegicus
cagagaactcggtacatgtgtatgt

SEQ ID NO: 228402 - DNA, 25 bp, Rattus norvegicus
cagagaagaccaacgcgaagcggct

SEQ ID NO: 228403 - DNA, 25 bp, Rattus norvegicus
cagagaagaccatcgcgaagcggct

SEQ ID NO: 228404 - DNA, 25 bp, Rattus norvegicus
cagagaagacccagtttacaacttt

SEQ ID NO: 228405 - DNA, 25 bp, Rattus norvegicus
cagagaagaccctgtttacaacttt

SEQ ID NO: 228406 - DNA, 25 bp, Rattus norvegicus
cagagaagactgagccaggagaatt

SEQ ID NO: 228407 - DNA, 25 bp, Rattus norvegicus
cagagaagactgtgccaggagaatt

SEQ ID NO: 228408 - DNA, 25 bp, Rattus norvegicus
cagagaagcagaccggcactcctgg

SEQ ID NO: 228409 - DNA, 25 bp, Rattus norvegicus
cagagaagcagagcggcactcctgg

SEQ ID NO: 228410 - DNA, 25 bp, Rattus norvegicus
cagagaaggcttcctcggtgagcta

SEQ ID NO: 228411 - DNA, 25 bp, Rattus norvegicus
cagagaaggcttgctcggtgagcta

SEQ ID NO: 228412 - DNA, 25 bp, Rattus norvegicus
cagagaagtgctcggcagtgcttcc

SEQ ID NO: 228413 - DNA, 25 bp, Rattus norvegicus
cagagaagtgctgggcagtgcttcc

SEQ ID NO: 228414 - DNA, 25 bp, Rattus norvegicus
cagagaatccaaaccaaccaaccaa

SEQ ID NO: 228415 - DNA, 25 bp, Rattus norvegicus
cagagaatccaatccaaccaaccaa

SEQ ID NO: 228416 - DNA, 25 bp, Rattus norvegicus
cagagaatcgggatcctgagaggcc

SEQ ID NO: 228417 - DNA, 25 bp, Rattus norvegicus
cagagaatcgggttcctgagaggcc

SEQ ID NO: 228418 - DNA, 25 bp, Rattus norvegicus
cagagaatctctccttcaggcaggt

SEQ ID NO: 228419 - DNA, 25 bp, Rattus norvegicus
cagagaatctctgcttcaggcaggt

SEQ ID NO: 228420 - DNA, 25 bp, Rattus norvegicus
cagagaatggagacctgcgcccaga

SEQ ID NO: 228421 - DNA, 25 bp, Rattus norvegicus
cagagaatggagtcctgcgcccaga

SEQ ID NO: 228422 - DNA, 25 bp, Rattus norvegicus
cagagaatgtgaatgcggccgtgat

SEQ ID NO: 228423 - DNA, 25 bp, Rattus norvegicus
cagagaatgtgattgcggccgtgat

SEQ ID NO: 228424 - DNA, 25 bp, Rattus norvegicus
cagagacaatttcttgtttcccaac

SEQ ID NO: 228425 - DNA, 25 bp, Rattus norvegicus
cagagacaatttgttgtttcccaac

SEQ ID NO: 228426 - DNA, 25 bp, Rattus norvegicus
cagagacactgcataattcccttgt

SEQ ID NO: 228427 - DNA, 25 bp, Rattus norvegicus
cagagacactgcttaattcccttgt

SEQ ID NO: 228428 - DNA, 25 bp, Rattus norvegicus
cagagacagcaacggcttggcatca

SEQ ID NO: 228429 - DNA, 25 bp, Rattus norvegicus
cagagacagcaagggcttggcatca

SEQ ID NO: 228430 - DNA, 25 bp, Rattus norvegicus
cagagacagcagcttcttgaggaag

SEQ ID NO: 228431 - DNA, 25 bp, Rattus norvegicus
cagagacagcaggttcttgaggaag

SEQ ID NO: 228432 - DNA, 25 bp, Rattus norvegicus
cagagacagggacagacattacctc

SEQ ID NO: 228433 - DNA, 25 bp, Rattus norvegicus
cagagacagggagagacattacctc

SEQ ID NO: 228434 - DNA, 25 bp, Rattus norvegicus
cagagacagtagctcctcaggagtt

SEQ ID NO: 228435 - DNA, 25 bp, Rattus norvegicus
cagagacagtaggtcctcaggagtt

SEQ ID NO: 228436 - DNA, 25 bp, Rattus norvegicus
cagagacagttactgtgccttgcga

SEQ ID NO: 228437 - DNA, 25 bp, Rattus norvegicus
cagagacagttagtgtgccttgcga

SEQ ID NO: 228438 - DNA, 25 bp, Rattus norvegicus
cagagacatgagctcatctgcttac

SEQ ID NO: 228439 - DNA, 25 bp, Rattus norvegicus
cagagacatgaggtcatctgcttac

SEQ ID NO: 228440 - DNA, 25 bp, Rattus norvegicus
cagagaccatcacatcctcactggt

SEQ ID NO: 228441 - DNA, 25 bp, Rattus norvegicus
cagagaccatcagatcctcactggt

SEQ ID NO: 228442 - DNA, 25 bp, Rattus norvegicus
cagagacccatgctggtggacatat

SEQ ID NO: 228443 - DNA, 25 bp, Rattus norvegicus
cagagacccatggtggtggacatat

SEQ ID NO: 228444 - DNA, 25 bp, Rattus norvegicus
cagagacccctgaagtacctagtta

SEQ ID NO: 228445 - DNA, 25 bp, Rattus norvegicus
cagagacccctgtagtacctagtta

SEQ ID NO: 228446 - DNA, 25 bp, Rattus norvegicus
cagagacccgtgactgcgagttcgg

SEQ ID NO: 228447 - DNA, 25 bp, Rattus norvegicus
cagagacccgtgtctgcgagttcgg

SEQ ID NO: 228448 - DNA, 25 bp, Rattus norvegicus
cagagaccggtcagtacatctgcat

SEQ ID NO: 228449 - DNA, 25 bp, Rattus norvegicus
cagagaccggtctgtacatctgcat

SEQ ID NO: 228450 - DNA, 25 bp, Rattus norvegicus
cagagacctcagatgtgtggaataa

SEQ ID NO: 228451 - DNA, 25 bp, Rattus norvegicus
cagagacctcagttgtgtggaataa

SEQ ID NO: 228452 - DNA, 25 bp, Rattus norvegicus
cagagacctccgcattcaccttggg

SEQ ID NO: 228453 - DNA, 25 bp, Rattus norvegicus
cagagacctccggattcaccttggg

SEQ ID NO: 228454 - DNA, 25 bp, Rattus norvegicus
cagagacctcttccgctataggtaa

SEQ ID NO: 228455 - DNA, 25 bp, Rattus norvegicus
cagagacctcttgcgctataggtaa

SEQ ID NO: 228456 - DNA, 25 bp, Rattus norvegicus
cagagaccttacatgtttacacagt

SEQ ID NO: 228457 - DNA, 25 bp, Rattus norvegicus
cagagaccttacttgtttacacagt

SEQ ID NO: 228458 - DNA, 25 bp, Rattus norvegicus
cagagacgttccattctttcgttta

SEQ ID NO: 228459 - DNA, 25 bp, Rattus norvegicus
cagagacgttcctttctttcgttta

SEQ ID NO: 228460 - DNA, 25 bp, Rattus norvegicus
cagagactactaagccagccggagt

SEQ ID NO: 228461 - DNA, 25 bp, Rattus norvegicus
cagagactactatgccagccggagt

SEQ ID NO: 228462 - DNA, 25 bp, Rattus norvegicus
cagagactactgaacggactttgaa

SEQ ID NO: 228463 - DNA, 25 bp, Rattus norvegicus
cagagactactgtacggactttgaa

SEQ ID NO: 228464 - DNA, 25 bp, Rattus norvegicus
cagagactacttaggattcattgat

SEQ ID NO: 228465 - DNA, 25 bp, Rattus norvegicus
cagagactactttggattcattgat

SEQ ID NO: 228466 - DNA, 25 bp, Rattus norvegicus
cagagactccggctactgtgggaat

SEQ ID NO: 228467 - DNA, 25 bp, Rattus norvegicus
cagagactccgggtactgtgggaat

SEQ ID NO: 228468 - DNA, 25 bp, Rattus norvegicus
cagagactcgggactgtttcgtgag

SEQ ID NO: 228469 - DNA, 25 bp, Rattus norvegicus
cagagactcgggtctgtttcgtgag

SEQ ID NO: 228470 - DNA, 25 bp, Rattus norvegicus
cagagactcgttatattgtgcttac

SEQ ID NO: 228471 - DNA, 25 bp, Rattus norvegicus
cagagactcgttttattgtgcttac

SEQ ID NO: 228472 - DNA, 25 bp, Rattus norvegicus
cagagactctttcttccggaagaga

SEQ ID NO: 228473 - DNA, 25 bp, Rattus norvegicus
cagagactctttgttccggaagaga

SEQ ID NO: 228474 - DNA, 25 bp, Rattus norvegicus
cagagactgcgaccagccgcgtgct

SEQ ID NO: 228475 - DNA, 25 bp, Rattus norvegicus
cagagactgcgagcagccgcgtgct

SEQ ID NO: 228476 - DNA, 25 bp, Rattus norvegicus
cagagactgctgctgaattagttca

SEQ ID NO: 228477 - DNA, 25 bp, Rattus norvegicus
cagagactgctggtgaattagttca

SEQ ID NO: 228478 - DNA, 25 bp, Rattus norvegicus
cagagactggtaatgatggcttttt

SEQ ID NO: 228479 - DNA, 25 bp, Rattus norvegicus
cagagactggtattgatggcttttt

SEQ ID NO: 228480 - DNA, 25 bp, Rattus norvegicus
cagagactgtagaccctataaggaa

SEQ ID NO: 228481 - DNA, 25 bp, Rattus norvegicus
cagagactgtagtccctataaggaa

SEQ ID NO: 228482 - DNA, 25 bp, Rattus norvegicus
cagagactgtttacctcagcgtaat

SEQ ID NO: 228483 - DNA, 25 bp, Rattus norvegicus
cagagactgttttcctcagcgtaat

SEQ ID NO: 228484 - DNA, 25 bp, Rattus norvegicus
cagagacttcttatgctcagagtga

SEQ ID NO: 228485 - DNA, 25 bp, Rattus norvegicus
cagagacttcttttgctcagagtga

SEQ ID NO: 228486 - DNA, 25 bp, Rattus norvegicus
cagagacttgagcttgaccatggaa

SEQ ID NO: 228487 - DNA, 25 bp, Rattus norvegicus
cagagacttgaggttgaccatggaa

SEQ ID NO: 228488 - DNA, 25 bp, Rattus norvegicus
cagagacttggaagagcttaggact

SEQ ID NO: 228489 - DNA, 25 bp, Rattus norvegicus
cagagacttggacagctgcagtgat

SEQ ID NO: 228490 - DNA, 25 bp, Rattus norvegicus
cagagacttggagagctgcagtgat

SEQ ID NO: 228491 - DNA, 25 bp, Rattus norvegicus
cagagacttggatgagcttaggact

SEQ ID NO: 228492 - DNA, 25 bp, Rattus norvegicus
cagagagaaaccagcaattccactc

SEQ ID NO: 228493 - DNA, 25 bp, Rattus norvegicus
cagagagaaacctgcaattccactc

SEQ ID NO: 228494 - DNA, 25 bp, Rattus norvegicus
cagagagaatgcaggatcccctgga

SEQ ID NO: 228495 - DNA, 25 bp, Rattus norvegicus
cagagagaatgctggatcccctgga

SEQ ID NO: 228496 - DNA, 25 bp, Rattus norvegicus
cagagagacactagggtccctggca

SEQ ID NO: 228497 - DNA, 25 bp, Rattus norvegicus
cagagagacacttgggtccctggca

SEQ ID NO: 228498 - DNA, 25 bp, Rattus norvegicus
cagagagagaatcaccgtgaacccc

SEQ ID NO: 228499 - DNA, 25 bp, Rattus norvegicus
cagagagagaatgaccgtgaacccc

SEQ ID NO: 228500 - DNA, 25 bp, Rattus norvegicus
cagagagaggccatcggctccgaga

SEQ ID NO: 228501 - DNA, 25 bp, Rattus norvegicus
cagagagaggccttcggctccgaga

SEQ ID NO: 228502 - DNA, 25 bp, Rattus norvegicus
cagagagagtggactgcccacagcc

SEQ ID NO: 228503 - DNA, 25 bp, Rattus norvegicus
cagagagagtggtctgcccacagcc

SEQ ID NO: 228504 - DNA, 25 bp, Rattus norvegicus
cagagagcacctccaagcaggtggt

SEQ ID NO: 228505 - DNA, 25 bp, Rattus norvegicus
cagagagcacctgcaagcaggtggt

SEQ ID NO: 228506 - DNA, 25 bp, Rattus norvegicus
cagagagccgtcacagggagcgtat

SEQ ID NO: 228507 - DNA, 25 bp, Rattus norvegicus
cagagagccgtctcagggagcgtat

SEQ ID NO: 228508 - DNA, 25 bp, Rattus norvegicus
cagagagccttcacattggctcagt

SEQ ID NO: 228509 - DNA, 25 bp, Rattus norvegicus
cagagagccttctcattggctcagt

SEQ ID NO: 228510 - DNA, 25 bp, Rattus norvegicus
cagagagcgcgcaggcgctaggaca

SEQ ID NO: 228511 - DNA, 25 bp, Rattus norvegicus
cagagagcgcgctggcgctaggaca

SEQ ID NO: 228512 - DNA, 25 bp, Rattus norvegicus
cagagagctgttatcagatagtgac

SEQ ID NO: 228513 - DNA, 25 bp, Rattus norvegicus
cagagagctgttttcagatagtgac

SEQ ID NO: 228514 - DNA, 25 bp, Rattus norvegicus
cagagagcttgcatagcgtgcacaa

SEQ ID NO: 228515 - DNA, 25 bp, Rattus norvegicus
cagagagcttgcttagcgtgcacaa

SEQ ID NO: 228516 - DNA, 25 bp, Rattus norvegicus
cagagaggaaccaactgcccgggtt

SEQ ID NO: 228517 - DNA, 25 bp, Rattus norvegicus
cagagaggaacctactgcccgggtt

SEQ ID NO: 228518 - DNA, 25 bp, Rattus norvegicus
cagagaggagtaacgcggagcccat

SEQ ID NO: 228519 - DNA, 25 bp, Rattus norvegicus
cagagaggagtatcgcggagcccat

SEQ ID NO: 228520 - DNA, 25 bp, Rattus norvegicus
cagagagggagaagcccctccccaa

SEQ ID NO: 228521 - DNA, 25 bp, Rattus norvegicus
cagagagggagatgcccctccccaa

SEQ ID NO: 228522 - DNA, 25 bp, Rattus norvegicus
cagagagggctaataaggctttaca

SEQ ID NO: 228523 - DNA, 25 bp, Rattus norvegicus
cagagagggctattaaggctttaca

SEQ ID NO: 228524 - DNA, 25 bp, Rattus norvegicus
cagagaggtgaaagctggtgctcaa

SEQ ID NO: 228525 - DNA, 25 bp, Rattus norvegicus
cagagaggtgaatgctggtgctcaa

SEQ ID NO: 228526 - DNA, 25 bp, Rattus norvegicus
cagagaggttatatcttctgcccct

SEQ ID NO: 228527 - DNA, 25 bp, Rattus norvegicus
cagagaggttatttcttctgcccct

SEQ ID NO: 228528 - DNA, 25 bp, Rattus norvegicus
cagagagtaaggctctcaagccctt

SEQ ID NO: 228529 - DNA, 25 bp, Rattus norvegicus
cagagagtaagggtctcaagccctt

SEQ ID NO: 228530 - DNA, 25 bp, Rattus norvegicus
cagagagtactgatgctcctcgctg

SEQ ID NO: 228531 - DNA, 25 bp, Rattus norvegicus
cagagagtactgttgctcctcgctg

SEQ ID NO: 228532 - DNA, 25 bp, Rattus norvegicus
cagagagtccctaagaaccctatat

SEQ ID NO: 228533 - DNA, 25 bp, Rattus norvegicus
cagagagtcccttagaaccctatat

SEQ ID NO: 228534 - DNA, 25 bp, Rattus norvegicus
cagagagtctccatgagctcagaat

SEQ ID NO: 228535 - DNA, 25 bp, Rattus norvegicus
cagagagtctccttgagctcagaat

SEQ ID NO: 228536 - DNA, 25 bp, Rattus norvegicus
cagagagtggatcggctctttccct

SEQ ID NO: 228537 - DNA, 25 bp, Rattus norvegicus
cagagagtggatgggctctttccct

SEQ ID NO: 228538 - DNA, 25 bp, Rattus norvegicus
cagagagtggttatctcctgtctgt

SEQ ID NO: 228539 - DNA, 25 bp, Rattus norvegicus
cagagagtggttttctcctgtctgt

SEQ ID NO: 228540 - DNA, 25 bp, Rattus norvegicus
cagagagttcaacgcgaagactgta

SEQ ID NO: 228541 - DNA, 25 bp, Rattus norvegicus
cagagagttcaaggcgaagactgta

SEQ ID NO: 228542 - DNA, 25 bp, Rattus norvegicus
cagagagttcatatggagagaccca

SEQ ID NO: 228543 - DNA, 25 bp, Rattus norvegicus
cagagagttcatttggagagaccca

SEQ ID NO: 228544 - DNA, 25 bp, Rattus norvegicus
cagagataaatcagccatggcctaa

SEQ ID NO: 228545 - DNA, 25 bp, Rattus norvegicus
cagagataaatctgccatggcctaa

SEQ ID NO: 228546 - DNA, 25 bp, Rattus norvegicus
cagagatacggaacgcacaggagct

SEQ ID NO: 228547 - DNA, 25 bp, Rattus norvegicus
cagagatacggatcgcacaggagct

SEQ ID NO: 228548 - DNA, 25 bp, Rattus norvegicus
cagagatagctgataacgagtcgta

SEQ ID NO: 228549 - DNA, 25 bp, Rattus norvegicus
cagagatagctgttaacgagtcgta

SEQ ID NO: 228550 - DNA, 25 bp, Rattus norvegicus
cagagatcacgtagcagatggtgca

SEQ ID NO: 228551 - DNA, 25 bp, Rattus norvegicus
cagagatcacgttgcagatggtgca

SEQ ID NO: 228552 - DNA, 25 bp, Rattus norvegicus
cagagatcagctccaacttggcagt

SEQ ID NO: 228553 - DNA, 25 bp, Rattus norvegicus
cagagatcagctgcaacttggcagt

SEQ ID NO: 228554 - DNA, 25 bp, Rattus norvegicus
cagagatccctcagtttggcaatgg

SEQ ID NO: 228555 - DNA, 25 bp, Rattus norvegicus
cagagatccctctgtttggcaatgg

SEQ ID NO: 228556 - DNA, 25 bp, Rattus norvegicus
cagagatcgtgtccaagcctagtat

SEQ ID NO: 228557 - DNA, 25 bp, Rattus norvegicus
cagagatcgtgtgcaagcctagtat

SEQ ID NO: 228558 - DNA, 25 bp, Rattus norvegicus
cagagatctgtactcctcattaaga

SEQ ID NO: 228559 - DNA, 25 bp, Rattus norvegicus
cagagatctgtagtcctcattaaga

SEQ ID NO: 228560 - DNA, 25 bp, Rattus norvegicus
cagagatctgtccatcttagccaag

SEQ ID NO: 228561 - DNA, 25 bp, Rattus norvegicus
cagagatctgtcgatcttagccaag

SEQ ID NO: 228562 - DNA, 25 bp, Rattus norvegicus
cagagatgaaccctggcccaggtta

SEQ ID NO: 228563 - DNA, 25 bp, Rattus norvegicus
cagagatgaaccgtggcccaggtta

SEQ ID NO: 228564 - DNA, 25 bp, Rattus norvegicus
cagagatgccaaagttagttagtgt

SEQ ID NO: 228565 - DNA, 25 bp, Rattus norvegicus
cagagatgccaatgttagttagtgt

SEQ ID NO: 228566 - DNA, 25 bp, Rattus norvegicus
cagagatgctgcagcccccggagga

SEQ ID NO: 228567 - DNA, 25 bp, Rattus norvegicus
cagagatgctgctgcccccggagga

SEQ ID NO: 228568 - DNA, 25 bp, Rattus norvegicus
cagagatgcttcatgatgctgaatc

SEQ ID NO: 228569 - DNA, 25 bp, Rattus norvegicus
cagagatgcttcttgatgctgaatc

SEQ ID NO: 228570 - DNA, 25 bp, Rattus norvegicus
cagagatggcttccctaagtacttc

SEQ ID NO: 228571 - DNA, 25 bp, Rattus norvegicus
cagagatggcttgcctaagtacttc

SEQ ID NO: 228572 - DNA, 25 bp, Rattus norvegicus
cagagatgttgcacaccggtggatt

SEQ ID NO: 228573 - DNA, 25 bp, Rattus norvegicus
cagagatgttgctcaccggtggatt

SEQ ID NO: 228574 - DNA, 25 bp, Rattus norvegicus
cagagattggcgattaatgtctaaa

SEQ ID NO: 228575 - DNA, 25 bp, Rattus norvegicus
cagagattggcgtttaatgtctaaa

SEQ ID NO: 228576 - DNA, 25 bp, Rattus norvegicus
cagagattgtttaggtgtcgtttta

SEQ ID NO: 228577 - DNA, 25 bp, Rattus norvegicus
cagagattgttttggtgtcgtttta

SEQ ID NO: 228578 - DNA, 25 bp, Rattus norvegicus
cagagatttcacatgctatccaaag

SEQ ID NO: 228579 - DNA, 25 bp, Rattus norvegicus
cagagatttcacttgctatccaaag

SEQ ID NO: 228580 - DNA, 25 bp, Rattus norvegicus
cagagatttcataggttgcgtcaaa

SEQ ID NO: 228581 - DNA, 25 bp, Rattus norvegicus
cagagatttcattggttgcgtcaaa

SEQ ID NO: 228582 - DNA, 25 bp, Rattus norvegicus
cagagcaagaagagtttttatggtt

SEQ ID NO: 228583 - DNA, 25 bp, Rattus norvegicus
cagagcaagaagtgtttttatggtt

SEQ ID NO: 228584 - DNA, 25 bp, Rattus norvegicus
cagagcaagactcccctggccagta

SEQ ID NO: 228585 - DNA, 25 bp, Rattus norvegicus
cagagcaagactgccctggccagta

SEQ ID NO: 228586 - DNA, 25 bp, Rattus norvegicus
cagagcaagtgactactagtagcaa

SEQ ID NO: 228587 - DNA, 25 bp, Rattus norvegicus
cagagcaagtgagtactagtagcaa

SEQ ID NO: 228588 - DNA, 25 bp, Rattus norvegicus
cagagcaatcagactggagttgcaa

SEQ ID NO: 228589 - DNA, 25 bp, Rattus norvegicus
cagagcaatcagtctggagttgcaa

SEQ ID NO: 228590 - DNA, 25 bp, Rattus norvegicus
cagagcacctgtatgagaccatttc

SEQ ID NO: 228591 - DNA, 25 bp, Rattus norvegicus
cagagcacctgtttgagaccatttc

SEQ ID NO: 228592 - DNA, 25 bp, Rattus norvegicus
cagagcactcccaattgcatcaaaa

SEQ ID NO: 228593 - DNA, 25 bp, Rattus norvegicus
cagagcactccctattgcatcaaaa

SEQ ID NO: 228594 - DNA, 25 bp, Rattus norvegicus
cagagcagagtgaggcggcggcggc

SEQ ID NO: 228595 - DNA, 25 bp, Rattus norvegicus
cagagcagagtgtggcggcggcggc

SEQ ID NO: 228596 - DNA, 25 bp, Rattus norvegicus
cagagcagcaacaccaaccagatgg

SEQ ID NO: 228597 - DNA, 25 bp, Rattus norvegicus
cagagcagcaactccaaccagatgg

SEQ ID NO: 228598 - DNA, 25 bp, Rattus norvegicus
cagagcagccgaacaatttgtattt

SEQ ID NO: 228599 - DNA, 25 bp, Rattus norvegicus
cagagcagccgatcaatttgtattt

SEQ ID NO: 228600 - DNA, 25 bp, Rattus norvegicus
cagagcagcctactgaggagaagct

SEQ ID NO: 228601 - DNA, 25 bp, Rattus norvegicus
cagagcagcctagtgaggagaagct

SEQ ID NO: 228602 - DNA, 25 bp, Rattus norvegicus
cagagcagcctgaagcctgtggttt

SEQ ID NO: 228603 - DNA, 25 bp, Rattus norvegicus
cagagcagcctgtagcctgtggttt

SEQ ID NO: 228604 - DNA, 25 bp, Rattus norvegicus
cagagcagctggctcatactagtga

SEQ ID NO: 228605 - DNA, 25 bp, Rattus norvegicus
cagagcagctgggtcatactagtga

SEQ ID NO: 228606 - DNA, 25 bp, Rattus norvegicus
cagagcaggcacagcggaacctgga

SEQ ID NO: 228607 - DNA, 25 bp, Rattus norvegicus
cagagcaggcactgcggaacctgga

SEQ ID NO: 228608 - DNA, 25 bp, Rattus norvegicus
cagagcaggcgaaaccttaggactg

SEQ ID NO: 228609 - DNA, 25 bp, Rattus norvegicus
cagagcaggcgataccttaggactg

SEQ ID NO: 228610 - DNA, 25 bp, Rattus norvegicus
cagagcaggctaaccacatttgctt

SEQ ID NO: 228611 - DNA, 25 bp, Rattus norvegicus
cagagcaggctatccacatttgctt

SEQ ID NO: 228612 - DNA, 25 bp, Rattus norvegicus
cagagcaggctgatcaagaactcaa

SEQ ID NO: 228613 - DNA, 25 bp, Rattus norvegicus
cagagcaggctgttcaagaactcaa

SEQ ID NO: 228614 - DNA, 25 bp, Rattus norvegicus
cagagcagggacagttcacgctggt

SEQ ID NO: 228615 - DNA, 25 bp, Rattus norvegicus
cagagcagggactgttcacgctggt

SEQ ID NO: 228616 - DNA, 25 bp, Rattus norvegicus
cagagcagggttctcaggctgacca

SEQ ID NO: 228617 - DNA, 25 bp, Rattus norvegicus
cagagcagggttgtcaggctgacca

SEQ ID NO: 228618 - DNA, 25 bp, Rattus norvegicus
cagagcaggtaacacattggctgtc

SEQ ID NO: 228619 - DNA, 25 bp, Rattus norvegicus
cagagcaggtaagacattggctgtc

SEQ ID NO: 228620 - DNA, 25 bp, Rattus norvegicus
cagagcagtcttccgtaacttttga

SEQ ID NO: 228621 - DNA, 25 bp, Rattus norvegicus
cagagcagtcttgcgtaacttttga

SEQ ID NO: 228622 - DNA, 25 bp, Rattus norvegicus
cagagcagttgtattccagttattt

SEQ ID NO: 228623 - DNA, 25 bp, Rattus norvegicus
cagagcagttgttttccagttattt

SEQ ID NO: 228624 - DNA, 25 bp, Rattus norvegicus
cagagcatatttaacaggacttcat

SEQ ID NO: 228625 - DNA, 25 bp, Rattus norvegicus
cagagcatattttacaggacttcat

SEQ ID NO: 228626 - DNA, 25 bp, Rattus norvegicus
cagagcatgcgcattaacccagagc

SEQ ID NO: 228627 - DNA, 25 bp, Rattus norvegicus
cagagcatgcgctttaacccagagc

SEQ ID NO: 228628 - DNA, 25 bp, Rattus norvegicus
cagagcatgcgtataaagtccttaa

SEQ ID NO: 228629 - DNA, 25 bp, Rattus norvegicus
cagagcatgcgtttaaagtccttaa

SEQ ID NO: 228630 - DNA, 25 bp, Rattus norvegicus
cagagcatggccactggctttttta

SEQ ID NO: 228631 - DNA, 25 bp, Rattus norvegicus
cagagcatggcctctggctttttta

SEQ ID NO: 228632 - DNA, 25 bp, Rattus norvegicus
cagagccacatgaggaaggcttctt

SEQ ID NO: 228633 - DNA, 25 bp, Rattus norvegicus
cagagccacatgtggaaggcttctt

SEQ ID NO: 228634 - DNA, 25 bp, Rattus norvegicus
cagagccacattcaggtcacattgt

SEQ ID NO: 228635 - DNA, 25 bp, Rattus norvegicus
cagagccacattgaggtcacattgt

SEQ ID NO: 228636 - DNA, 25 bp, Rattus norvegicus
cagagccactggatttgatccacag

SEQ ID NO: 228637 - DNA, 25 bp, Rattus norvegicus
cagagccactggctacttttgtgtt

SEQ ID NO: 228638 - DNA, 25 bp, Rattus norvegicus
cagagccactgggtacttttgtgtt

SEQ ID NO: 228639 - DNA, 25 bp, Rattus norvegicus
cagagccactggttttgatccacag

SEQ ID NO: 228640 - DNA, 25 bp, Rattus norvegicus
cagagccagcacctgtagtcagaga

SEQ ID NO: 228641 - DNA, 25 bp, Rattus norvegicus
cagagccagcacgtgtagtcagaga

SEQ ID NO: 228642 - DNA, 25 bp, Rattus norvegicus
cagagccagctgcttcgatccagag

SEQ ID NO: 228643 - DNA, 25 bp, Rattus norvegicus
cagagccagctggttcgatccagag

SEQ ID NO: 228644 - DNA, 25 bp, Rattus norvegicus
cagagccaggcccagatgagaagaa

SEQ ID NO: 228645 - DNA, 25 bp, Rattus norvegicus
cagagccaggccgagatgagaagaa

SEQ ID NO: 228646 - DNA, 25 bp, Rattus norvegicus
cagagccagggaatcgactcgggat

SEQ ID NO: 228647 - DNA, 25 bp, Rattus norvegicus
cagagccagggattcgactcgggat

SEQ ID NO: 228648 - DNA, 25 bp, Rattus norvegicus
cagagccagggcaagtgtatttaat

SEQ ID NO: 228649 - DNA, 25 bp, Rattus norvegicus
cagagccagggctagtgtatttaat

SEQ ID NO: 228650 - DNA, 25 bp, Rattus norvegicus
cagagccagggtctccttatacttt

SEQ ID NO: 228651 - DNA, 25 bp, Rattus norvegicus
cagagccagggtgtccttatacttt

SEQ ID NO: 228652 - DNA, 25 bp, Rattus norvegicus
cagagccaggtcctactttgtttta

SEQ ID NO: 228653 - DNA, 25 bp, Rattus norvegicus
cagagccaggtcgtactttgtttta

SEQ ID NO: 228654 - DNA, 25 bp, Rattus norvegicus
cagagccagtcaatgcctgcccagg

SEQ ID NO: 228655 - DNA, 25 bp, Rattus norvegicus
cagagccagtcattgcctgcccagg

SEQ ID NO: 228656 - DNA, 25 bp, Rattus norvegicus
cagagccatagtcggtcagtccaga

SEQ ID NO: 228657 - DNA, 25 bp, Rattus norvegicus
cagagccatagtgggtcagtccaga

SEQ ID NO: 228658 - DNA, 25 bp, Rattus norvegicus
cagagccatgcacatcttggacaga

SEQ ID NO: 228659 - DNA, 25 bp, Rattus norvegicus
cagagccatgcagatcttggacaga

SEQ ID NO: 228660 - DNA, 25 bp, Rattus norvegicus
cagagccattcacggttttatttca

SEQ ID NO: 228661 - DNA, 25 bp, Rattus norvegicus
cagagccattcagggttttatttca

SEQ ID NO: 228662 - DNA, 25 bp, Rattus norvegicus
cagagccattgtcaccagcgagtta

SEQ ID NO: 228663 - DNA, 25 bp, Rattus norvegicus
cagagccattgtgaccagcgagtta

SEQ ID NO: 228664 - DNA, 25 bp, Rattus norvegicus
cagagcccaagtaagtgcatgtgtc

SEQ ID NO: 228665 - DNA, 25 bp, Rattus norvegicus
cagagcccaagttagtgcatgtgtc

SEQ ID NO: 228666 - DNA, 25 bp, Rattus norvegicus
cagagcccacttcagggtttctcaa

SEQ ID NO: 228667 - DNA, 25 bp, Rattus norvegicus
cagagcccacttgagggtttctcaa

SEQ ID NO: 228668 - DNA, 25 bp, Rattus norvegicus
cagagcccaggtcatcatggcaaaa

SEQ ID NO: 228669 - DNA, 25 bp, Rattus norvegicus
cagagcccaggtgatcatggcaaaa

SEQ ID NO: 228670 - DNA, 25 bp, Rattus norvegicus
cagagcccggccattgtgtgtgcag

SEQ ID NO: 228671 - DNA, 25 bp, Rattus norvegicus
cagagcccggcctttgtgtgtgcag

SEQ ID NO: 228672 - DNA, 25 bp, Rattus norvegicus
cagagcccgtgcagccgctggagtt

SEQ ID NO: 228673 - DNA, 25 bp, Rattus norvegicus
cagagcccgtgctgccgctggagtt

SEQ ID NO: 228674 - DNA, 25 bp, Rattus norvegicus
cagagccctactatcaaccaaattg

SEQ ID NO: 228675 - DNA, 25 bp, Rattus norvegicus
cagagccctactttcaaccaaattg

SEQ ID NO: 228676 - DNA, 25 bp, Rattus norvegicus
cagagccctgctatcattgattctg

SEQ ID NO: 228677 - DNA, 25 bp, Rattus norvegicus
cagagccctgctttcattgattctg

SEQ ID NO: 228678 - DNA, 25 bp, Rattus norvegicus
cagagccctgggaagtttaacatat

SEQ ID NO: 228679 - DNA, 25 bp, Rattus norvegicus
cagagccctgggatggagattaact

SEQ ID NO: 228680 - DNA, 25 bp, Rattus norvegicus
cagagccctgggtagtttaacatat

SEQ ID NO: 228681 - DNA, 25 bp, Rattus norvegicus
cagagccctgggttggagattaact

SEQ ID NO: 228682 - DNA, 25 bp, Rattus norvegicus
cagagcccttctccggagtttcttt

SEQ ID NO: 228683 - DNA, 25 bp, Rattus norvegicus
cagagcccttctgcggagtttcttt

SEQ ID NO: 228684 - DNA, 25 bp, Rattus norvegicus
cagagcccttgacggccagtgtgct

SEQ ID NO: 228685 - DNA, 25 bp, Rattus norvegicus
cagagcccttgagggccagtgtgct

SEQ ID NO: 228686 - DNA, 25 bp, Rattus norvegicus
cagagcccttggatttatgtatata

SEQ ID NO: 228687 - DNA, 25 bp, Rattus norvegicus
cagagcccttggttttatgtatata

SEQ ID NO: 228688 - DNA, 25 bp, Rattus norvegicus
cagagccgagggaaatgtcacagat

SEQ ID NO: 228689 - DNA, 25 bp, Rattus norvegicus
cagagccgagggtaatgtcacagat

SEQ ID NO: 228690 - DNA, 25 bp, Rattus norvegicus
cagagccgtgctcccatcttgggtt

SEQ ID NO: 228691 - DNA, 25 bp, Rattus norvegicus
cagagccgtgctgccatcttgggtt

SEQ ID NO: 228692 - DNA, 25 bp, Rattus norvegicus
cagagcctagtgacagttccaagta

SEQ ID NO: 228693 - DNA, 25 bp, Rattus norvegicus
cagagcctagtgtcagttccaagta

SEQ ID NO: 228694 - DNA, 25 bp, Rattus norvegicus
cagagcctcagcacaaaggcatcgt

SEQ ID NO: 228695 - DNA, 25 bp, Rattus norvegicus
cagagcctcagctcaaaggcatcgt

SEQ ID NO: 228696 - DNA, 25 bp, Rattus norvegicus
cagagcctctttactcggagacaga

SEQ ID NO: 228697 - DNA, 25 bp, Rattus norvegicus
cagagcctcttttctcggagacaga

SEQ ID NO: 228698 - DNA, 25 bp, Rattus norvegicus
cagagcctgaacatgtagcacatcc

SEQ ID NO: 228699 - DNA, 25 bp, Rattus norvegicus
cagagcctgaacttgtagcacatcc

SEQ ID NO: 228700 - DNA, 25 bp, Rattus norvegicus
cagagcctgagaccagctgaagcct

SEQ ID NO: 228701 - DNA, 25 bp, Rattus norvegicus
cagagcctgagagcagctgaagcct

SEQ ID NO: 228702 - DNA, 25 bp, Rattus norvegicus
cagagcctgcccatgagcttcaagg

SEQ ID NO: 228703 - DNA, 25 bp, Rattus norvegicus
cagagcctgcccttgagcttcaagg

SEQ ID NO: 228704 - DNA, 25 bp, Rattus norvegicus
cagagcctggataacttttggacat

SEQ ID NO: 228705 - DNA, 25 bp, Rattus norvegicus
cagagcctggattacttttggacat

SEQ ID NO: 228706 - DNA, 25 bp, Rattus norvegicus
cagagcctttgtagttcagtgttgt

SEQ ID NO: 228707 - DNA, 25 bp, Rattus norvegicus
cagagcctttgttgttcagtgttgt

SEQ ID NO: 228708 - DNA, 25 bp, Rattus norvegicus
cagagcgaagtcaccctgctgagaa

SEQ ID NO: 228709 - DNA, 25 bp, Rattus norvegicus
cagagcgaagtctccctgctgagaa

SEQ ID NO: 228710 - DNA, 25 bp, Rattus norvegicus
cagagcgacctaaccctgtgtgagg

SEQ ID NO: 228711 - DNA, 25 bp, Rattus norvegicus
cagagcgacctatccctgtgtgagg

SEQ ID NO: 228712 - DNA, 25 bp, Rattus norvegicus
cagagcgactcgcttaagggaaagc

SEQ ID NO: 228713 - DNA, 25 bp, Rattus norvegicus
cagagcgactcggttaagggaaagc

SEQ ID NO: 228714 - DNA, 25 bp, Rattus norvegicus
cagagcgatcccactgagctgtgga

SEQ ID NO: 228715 - DNA, 25 bp, Rattus norvegicus
cagagcgatccctctgagctgtgga

SEQ ID NO: 228716 - DNA, 25 bp, Rattus norvegicus
cagagcgatctcagtgttccttaag

SEQ ID NO: 228717 - DNA, 25 bp, Rattus norvegicus
cagagcgatctctgtgttccttaag

SEQ ID NO: 228718 - DNA, 25 bp, Rattus norvegicus
cagagcgcaagcatccaggtgtcag

SEQ ID NO: 228719 - DNA, 25 bp, Rattus norvegicus
cagagcgcaagcttccaggtgtcag

SEQ ID NO: 228720 - DNA, 25 bp, Rattus norvegicus
cagagcgcaccgatccaagggaaga

SEQ ID NO: 228721 - DNA, 25 bp, Rattus norvegicus
cagagcgcaccgttccaagggaaga

SEQ ID NO: 228722 - DNA, 25 bp, Rattus norvegicus
cagagcgcagtcagactccagagga

SEQ ID NO: 228723 - DNA, 25 bp, Rattus norvegicus
cagagcgcagtctgactccagagga

SEQ ID NO: 228724 - DNA, 25 bp, Rattus norvegicus
cagagcgccacacgtttttggtgtg

SEQ ID NO: 228725 - DNA, 25 bp, Rattus norvegicus
cagagcgccacaggtttttggtgtg

SEQ ID NO: 228726 - DNA, 25 bp, Rattus norvegicus
cagagcgctacacgatgcattcagt

SEQ ID NO: 228727 - DNA, 25 bp, Rattus norvegicus
cagagcgctacaggatgcattcagt

SEQ ID NO: 228728 - DNA, 25 bp, Rattus norvegicus
cagagcgctggcagaaactggaatc

SEQ ID NO: 228729 - DNA, 25 bp, Rattus norvegicus
cagagcgctggctgaaactggaatc

SEQ ID NO: 228730 - DNA, 25 bp, Rattus norvegicus
cagagcgcttatacgcagctggccg

SEQ ID NO: 228731 - DNA, 25 bp, Rattus norvegicus
cagagcgcttattcgcagctggccg

SEQ ID NO: 228732 - DNA, 25 bp, Rattus norvegicus
cagagcggactacgctgcaacagct

SEQ ID NO: 228733 - DNA, 25 bp, Rattus norvegicus
cagagcggactaggctgcaacagct

SEQ ID NO: 228734 - DNA, 25 bp, Rattus norvegicus
cagagcggactcaaggccctggagt

SEQ ID NO: 228735 - DNA, 25 bp, Rattus norvegicus
cagagcggactctaggccctggagt

SEQ ID NO: 228736 - DNA, 25 bp, Rattus norvegicus
cagagcgggaacaacgtggcgtcta

SEQ ID NO: 228737 - DNA, 25 bp, Rattus norvegicus
cagagcgggaactacgtggcgtcta

SEQ ID NO: 228738 - DNA, 25 bp, Rattus norvegicus
cagagcgtctgtcgcctatctccgt

SEQ ID NO: 228739 - DNA, 25 bp, Rattus norvegicus
cagagcgtctgtggcctatctccgt

SEQ ID NO: 228740 - DNA, 25 bp, Rattus norvegicus
cagagctaatgtatgtcctaaattt

SEQ ID NO: 228741 - DNA, 25 bp, Rattus norvegicus
cagagctaatgtttgtcctaaattt

SEQ ID NO: 228742 - DNA, 25 bp, Rattus norvegicus
cagagctagattagtatgcctttaa

SEQ ID NO: 228743 - DNA, 25 bp, Rattus norvegicus
cagagctagatttgtatgcctttaa

SEQ ID NO: 228744 - DNA, 25 bp, Rattus norvegicus
cagagctcaacacctgttttgttat

SEQ ID NO: 228745 - DNA, 25 bp, Rattus norvegicus
cagagctcaacagctgttttgttat

SEQ ID NO: 228746 - DNA, 25 bp, Rattus norvegicus
cagagctcaagactattctccttaa

SEQ ID NO: 228747 - DNA, 25 bp, Rattus norvegicus
cagagctcaagagtattctccttaa

SEQ ID NO: 228748 - DNA, 25 bp, Rattus norvegicus
cagagctcactgactatgaccgagg

SEQ ID NO: 228749 - DNA, 25 bp, Rattus norvegicus
cagagctcactgtctatgaccgagg

SEQ ID NO: 228750 - DNA, 25 bp, Rattus norvegicus
cagagctcagctatgtgggaaacca

SEQ ID NO: 228751 - DNA, 25 bp, Rattus norvegicus
cagagctcagctttgtgggaaacca

SEQ ID NO: 228752 - DNA, 25 bp, Rattus norvegicus
cagagctcaggcagggcttggatca

SEQ ID NO: 228753 - DNA, 25 bp, Rattus norvegicus
cagagctcaggctgggcttggatca

SEQ ID NO: 228754 - DNA, 25 bp, Rattus norvegicus
cagagctcccataccaaaggatgag

SEQ ID NO: 228755 - DNA, 25 bp, Rattus norvegicus
cagagctcccattccaaaggatgag

SEQ ID NO: 228756 - DNA, 25 bp, Rattus norvegicus
cagagctccctcatatgaagttaaa

SEQ ID NO: 228757 - DNA, 25 bp, Rattus norvegicus
cagagctccctcttatgaagttaaa

SEQ ID NO: 228758 - DNA, 25 bp, Rattus norvegicus
cagagctcccttctgtggcaagatg

SEQ ID NO: 228759 - DNA, 25 bp, Rattus norvegicus
cagagctcccttgtgtggcaagatg

SEQ ID NO: 228760 - DNA, 25 bp, Rattus norvegicus
cagagctctctgaagttttccttag

SEQ ID NO: 228761 - DNA, 25 bp, Rattus norvegicus
cagagctctctgcaagggtcttgaa

SEQ ID NO: 228762 - DNA, 25 bp, Rattus norvegicus
cagagctctctggaagggtcttgaa

SEQ ID NO: 228763 - DNA, 25 bp, Rattus norvegicus
cagagctctctgtagttttccttag

SEQ ID NO: 228764 - DNA, 25 bp, Rattus norvegicus
cagagctcttctacagacactgatt

SEQ ID NO: 228765 - DNA, 25 bp, Rattus norvegicus
cagagctcttcttcagacactgatt

SEQ ID NO: 228766 - DNA, 25 bp, Rattus norvegicus
cagagctgagcacattgctttccag

SEQ ID NO: 228767 - DNA, 25 bp, Rattus norvegicus
cagagctgagcagattgctttccag

SEQ ID NO: 228768 - DNA, 25 bp, Rattus norvegicus
cagagctgatgcaatccgttcaaag

SEQ ID NO: 228769 - DNA, 25 bp, Rattus norvegicus
cagagctgatgctatccgttcaaag

SEQ ID NO: 228770 - DNA, 25 bp, Rattus norvegicus
cagagctgcactatgtatgatgtaa

SEQ ID NO: 228771 - DNA, 25 bp, Rattus norvegicus
cagagctgcactttgtatgatgtaa

SEQ ID NO: 228772 - DNA, 25 bp, Rattus norvegicus
cagagctgccagatactgcaggcaa

SEQ ID NO: 228773 - DNA, 25 bp, Rattus norvegicus
cagagctgccagttactgcaggcaa

SEQ ID NO: 228774 - DNA, 25 bp, Rattus norvegicus
cagagctgcctactgccttggagag

SEQ ID NO: 228775 - DNA, 25 bp, Rattus norvegicus
cagagctgcctagtgccttggagag

SEQ ID NO: 228776 - DNA, 25 bp, Rattus norvegicus
cagagctgtatgcaattcttatgat

SEQ ID NO: 228777 - DNA, 25 bp, Rattus norvegicus
cagagctgtatggaattcttatgat

SEQ ID NO: 228778 - DNA, 25 bp, Rattus norvegicus
cagagctgtgacacagttgcgtcat

SEQ ID NO: 228779 - DNA, 25 bp, Rattus norvegicus
cagagctgtgactcagttgcgtcat

SEQ ID NO: 228780 - DNA, 25 bp, Rattus norvegicus
cagagctgtttgaccctatgatttt

SEQ ID NO: 228781 - DNA, 25 bp, Rattus norvegicus
cagagctgtttgtccctatgatttt

SEQ ID NO: 228782 - DNA, 25 bp, Rattus norvegicus
cagagcttcatccatgctgggttat

SEQ ID NO: 228783 - DNA, 25 bp, Rattus norvegicus
cagagcttcatcgatgctgggttat

SEQ ID NO: 228784 - DNA, 25 bp, Rattus norvegicus
cagagcttccaccaagacacttgaa

SEQ ID NO: 228785 - DNA, 25 bp, Rattus norvegicus
cagagcttccacgaagacacttgaa

SEQ ID NO: 228786 - DNA, 25 bp, Rattus norvegicus
cagagcttcccgatgtaagaggaca

SEQ ID NO: 228787 - DNA, 25 bp, Rattus norvegicus
cagagcttcccgttgtaagaggaca

SEQ ID NO: 228788 - DNA, 25 bp, Rattus norvegicus
cagagcttctgacatcttgggctga

SEQ ID NO: 228789 - DNA, 25 bp, Rattus norvegicus
cagagcttctgagatcttgggctga

SEQ ID NO: 228790 - DNA, 25 bp, Rattus norvegicus
cagagcttgcccatggtcgtgggaa

SEQ ID NO: 228791 - DNA, 25 bp, Rattus norvegicus
cagagcttgcccttggtcgtgggaa

SEQ ID NO: 228792 - DNA, 25 bp, Rattus norvegicus
cagagctttattaacttcttccacc

SEQ ID NO: 228793 - DNA, 25 bp, Rattus norvegicus
cagagctttatttacttcttccacc

SEQ ID NO: 228794 - DNA, 25 bp, Rattus norvegicus
cagagctttcataccagttccaagc

SEQ ID NO: 228795 - DNA, 25 bp, Rattus norvegicus
cagagctttcattccagttccaagc

SEQ ID NO: 228796 - DNA, 25 bp, Rattus norvegicus
cagagctttctcagagcagaagcaa

SEQ ID NO: 228797 - DNA, 25 bp, Rattus norvegicus
cagagctttctctgagcagaagcaa

SEQ ID NO: 228798 - DNA, 25 bp, Rattus norvegicus
cagagctttgaacccttgtcggaga

SEQ ID NO: 228799 - DNA, 25 bp, Rattus norvegicus
cagagctttgaagccttgtcggaga

SEQ ID NO: 228800 - DNA, 25 bp, Rattus norvegicus
cagagcttttatcacccatggtgga

SEQ ID NO: 228801 - DNA, 25 bp, Rattus norvegicus
cagagcttttatgacccatggtgga

SEQ ID NO: 228802 - DNA, 25 bp, Rattus norvegicus
cagaggaaatatatctctatctctc

SEQ ID NO: 228803 - DNA, 25 bp, Rattus norvegicus
cagaggaaatatttctctatctctc

SEQ ID NO: 228804 - DNA, 25 bp, Rattus norvegicus
cagaggaagggaccgctgttcacaa

SEQ ID NO: 228805 - DNA, 25 bp, Rattus norvegicus
cagaggaagggagcgctgttcacaa

SEQ ID NO: 228806 - DNA, 25 bp, Rattus norvegicus
cagaggaatggtcagcgcccagttc

SEQ ID NO: 228807 - DNA, 25 bp, Rattus norvegicus
cagaggaatggtgagcgcccagttc

SEQ ID NO: 228808 - DNA, 25 bp, Rattus norvegicus
cagaggacaaacattcttttgttct

SEQ ID NO: 228809 - DNA, 25 bp, Rattus norvegicus
cagaggacaaactttcttttgttct

SEQ ID NO: 228810 - DNA, 25 bp, Rattus norvegicus
cagaggacccttacgacagactttt

SEQ ID NO: 228811 - DNA, 25 bp, Rattus norvegicus
cagaggaccctttcgacagactttt

SEQ ID NO: 228812 - DNA, 25 bp, Rattus norvegicus
cagaggacctctctgagcctgcatt

SEQ ID NO: 228813 - DNA, 25 bp, Rattus norvegicus
cagaggacctctgtgagcctgcatt

SEQ ID NO: 228814 - DNA, 25 bp, Rattus norvegicus
cagaggacctgtattaaatgaccac

SEQ ID NO: 228815 - DNA, 25 bp, Rattus norvegicus
cagaggacctgttttaaatgaccac

SEQ ID NO: 228816 - DNA, 25 bp, Rattus norvegicus
cagaggacgcctagtgtgtgcgtgt

SEQ ID NO: 228817 - DNA, 25 bp, Rattus norvegicus
cagaggacgccttgtgtgtgcgtgt

SEQ ID NO: 228818 - DNA, 25 bp, Rattus norvegicus
cagaggactagcagactttgccaag

SEQ ID NO: 228819 - DNA, 25 bp, Rattus norvegicus
cagaggactagctgactttgccaag

SEQ ID NO: 228820 - DNA, 25 bp, Rattus norvegicus
cagaggactatcagccaagtggcca

SEQ ID NO: 228821 - DNA, 25 bp, Rattus norvegicus
cagaggactatctgccaagtggcca

SEQ ID NO: 228822 - DNA, 25 bp, Rattus norvegicus
cagaggactcgtagtttattcataa

SEQ ID NO: 228823 - DNA, 25 bp, Rattus norvegicus
cagaggactcgttgtttattcataa

SEQ ID NO: 228824 - DNA, 25 bp, Rattus norvegicus
cagaggactgggataggctccagat

SEQ ID NO: 228825 - DNA, 25 bp, Rattus norvegicus
cagaggactgggttaggctccagat

SEQ ID NO: 228826 - DNA, 25 bp, Rattus norvegicus
cagaggacttcgaccaggagctatt

SEQ ID NO: 228827 - DNA, 25 bp, Rattus norvegicus
cagaggacttcgtccaggagctatt

SEQ ID NO: 228828 - DNA, 25 bp, Rattus norvegicus
cagaggagacaaaagcccaaggttt

SEQ ID NO: 228829 - DNA, 25 bp, Rattus norvegicus
cagaggagacaatagcccaaggttt

SEQ ID NO: 228830 - DNA, 25 bp, Rattus norvegicus
cagaggagcagcagggtccttacct

SEQ ID NO: 228831 - DNA, 25 bp, Rattus norvegicus
cagaggagcagctgggtccttacct

SEQ ID NO: 228832 - DNA, 25 bp, Rattus norvegicus
cagaggagcataacttccttcagaa

SEQ ID NO: 228833 - DNA, 25 bp, Rattus norvegicus
cagaggagcatatcttccttcagaa

SEQ ID NO: 228834 - DNA, 25 bp, Rattus norvegicus
cagaggagcctgctgaaggagggca

SEQ ID NO: 228835 - DNA, 25 bp, Rattus norvegicus
cagaggagcctggtgaaggagggca

SEQ ID NO: 228836 - DNA, 25 bp, Rattus norvegicus
cagaggagctgaacctggctccaaa

SEQ ID NO: 228837 - DNA, 25 bp, Rattus norvegicus
cagaggagctgatcctggctccaaa

SEQ ID NO: 228838 - DNA, 25 bp, Rattus norvegicus
cagaggagctgcatgaagaccagtt

SEQ ID NO: 228839 - DNA, 25 bp, Rattus norvegicus
cagaggagctgcttgaagaccagtt

SEQ ID NO: 228840 - DNA, 25 bp, Rattus norvegicus
cagaggagctggctagacacctgca

SEQ ID NO: 228841 - DNA, 25 bp, Rattus norvegicus
cagaggagctgggtagacacctgca

SEQ ID NO: 228842 - DNA, 25 bp, Rattus norvegicus
cagaggaggcccagctccccggaag

SEQ ID NO: 228843 - DNA, 25 bp, Rattus norvegicus
cagaggaggccctgctccccggaag

SEQ ID NO: 228844 - DNA, 25 bp, Rattus norvegicus
cagaggagtctcatttcactggtga

SEQ ID NO: 228845 - DNA, 25 bp, Rattus norvegicus
cagaggagtctcttttcactggtga

SEQ ID NO: 228846 - DNA, 25 bp, Rattus norvegicus
cagaggatccgacagttttgtaatt

SEQ ID NO: 228847 - DNA, 25 bp, Rattus norvegicus
cagaggatccgagagttttgtaatt

SEQ ID NO: 228848 - DNA, 25 bp, Rattus norvegicus
cagaggatctgtcagagggctcaca

SEQ ID NO: 228849 - DNA, 25 bp, Rattus norvegicus
cagaggatctgtgagagggctcaca

SEQ ID NO: 228850 - DNA, 25 bp, Rattus norvegicus
cagaggatgatgagatacgcatgat

SEQ ID NO: 228851 - DNA, 25 bp, Rattus norvegicus
cagaggatgatgtgatacgcatgat

SEQ ID NO: 228852 - DNA, 25 bp, Rattus norvegicus
cagaggatgcttcgacctgaagttg

SEQ ID NO: 228853 - DNA, 25 bp, Rattus norvegicus
cagaggatgcttggacctgaagttg

SEQ ID NO: 228854 - DNA, 25 bp, Rattus norvegicus
cagaggattcgaccctgcagtgaca

SEQ ID NO: 228855 - DNA, 25 bp, Rattus norvegicus
cagaggattcgagcctgcagtgaca

SEQ ID NO: 228856 - DNA, 25 bp, Rattus norvegicus
cagaggattgacctgttttgcagca

SEQ ID NO: 228857 - DNA, 25 bp, Rattus norvegicus
cagaggattgacgtgttttgcagca

SEQ ID NO: 228858 - DNA, 25 bp, Rattus norvegicus
cagaggcacaggctggacatccaga

SEQ ID NO: 228859 - DNA, 25 bp, Rattus norvegicus
cagaggcacagggtggacatccaga

SEQ ID NO: 228860 - DNA, 25 bp, Rattus norvegicus
cagaggcacattcctatccgtcttt

SEQ ID NO: 228861 - DNA, 25 bp, Rattus norvegicus
cagaggcacattgctatccgtcttt

SEQ ID NO: 228862 - DNA, 25 bp, Rattus norvegicus
cagaggcacggaatggacccacgga

SEQ ID NO: 228863 - DNA, 25 bp, Rattus norvegicus
cagaggcacggattggacccacgga

SEQ ID NO: 228864 - DNA, 25 bp, Rattus norvegicus
cagaggcactctcggcgcacaagag

SEQ ID NO: 228865 - DNA, 25 bp, Rattus norvegicus
cagaggcactctgggcgcacaagag

SEQ ID NO: 228866 - DNA, 25 bp, Rattus norvegicus
cagaggcagaccatggagctggatt

SEQ ID NO: 228867 - DNA, 25 bp, Rattus norvegicus
cagaggcagaccttggagctggatt

SEQ ID NO: 228868 - DNA, 25 bp, Rattus norvegicus
cagaggcaggaaaacacagaacaat

SEQ ID NO: 228869 - DNA, 25 bp, Rattus norvegicus
cagaggcaggaatacacagaacaat

SEQ ID NO: 228870 - DNA, 25 bp, Rattus norvegicus
cagaggcaggatacagatccaggca

SEQ ID NO: 228871 - DNA, 25 bp, Rattus norvegicus
cagaggcaggattcagatccaggca

SEQ ID NO: 228872 - DNA, 25 bp, Rattus norvegicus
cagaggcatccactgaaccgagagt

SEQ ID NO: 228873 - DNA, 25 bp, Rattus norvegicus
cagaggcatccagtgaaccgagagt

SEQ ID NO: 228874 - DNA, 25 bp, Rattus norvegicus
cagaggccagatcgtagagttcact

SEQ ID NO: 228875 - DNA, 25 bp, Rattus norvegicus
cagaggccagatcgtggagatcaca

SEQ ID NO: 228876 - DNA, 25 bp, Rattus norvegicus
cagaggccagatggtagagttcact

SEQ ID NO: 228877 - DNA, 25 bp, Rattus norvegicus
cagaggccagatggtggagatcaca

SEQ ID NO: 228878 - DNA, 25 bp, Rattus norvegicus
cagaggccctgacacatacataaca

SEQ ID NO: 228879 - DNA, 25 bp, Rattus norvegicus
cagaggccctgacctgtggtaacct

SEQ ID NO: 228880 - DNA, 25 bp, Rattus norvegicus
cagaggccctgagacatacataaca

SEQ ID NO: 228881 - DNA, 25 bp, Rattus norvegicus
cagaggccctgagctgtggtaacct

SEQ ID NO: 228882 - DNA, 25 bp, Rattus norvegicus
cagaggccgggcagcatcaggtgtg

SEQ ID NO: 228883 - DNA, 25 bp, Rattus norvegicus
cagaggccgggctgcatcaggtgtg

SEQ ID NO: 228884 - DNA, 25 bp, Rattus norvegicus
cagaggcctatactgaaaccagatt

SEQ ID NO: 228885 - DNA, 25 bp, Rattus norvegicus
cagaggcctatagtgaaaccagatt

SEQ ID NO: 228886 - DNA, 25 bp, Rattus norvegicus
cagaggcctccccagtgtcggcagt

SEQ ID NO: 228887 - DNA, 25 bp, Rattus norvegicus
cagaggcctcccgagtgtcggcagt

SEQ ID NO: 228888 - DNA, 25 bp, Rattus norvegicus
cagaggcctctgagatttttctgag

SEQ ID NO: 228889 - DNA, 25 bp, Rattus norvegicus
cagaggcctctgtgatttttctgag

SEQ ID NO: 228890 - DNA, 25 bp, Rattus norvegicus
cagaggcctgccacagtgggccaca

SEQ ID NO: 228891 - DNA, 25 bp, Rattus norvegicus
cagaggcctgcctcagtgggccaca

SEQ ID NO: 228892 - DNA, 25 bp, Rattus norvegicus
cagaggcctgtgaccatttaaatca

SEQ ID NO: 228893 - DNA, 25 bp, Rattus norvegicus
cagaggcctgtgtccatttaaatca

SEQ ID NO: 228894 - DNA, 25 bp, Rattus norvegicus
cagaggcctgttcgcaaagtgagat

SEQ ID NO: 228895 - DNA, 25 bp, Rattus norvegicus
cagaggcctgttggcaaagtgagat

SEQ ID NO: 228896 - DNA, 25 bp, Rattus norvegicus
cagaggccttaaccccgtggagaag

SEQ ID NO: 228897 - DNA, 25 bp, Rattus norvegicus
cagaggccttaagcccgtggagaag

SEQ ID NO: 228898 - DNA, 25 bp, Rattus norvegicus
cagaggccttggacatgttcacaac

SEQ ID NO: 228899 - DNA, 25 bp, Rattus norvegicus
cagaggccttggtcatgttcacaac

SEQ ID NO: 228900 - DNA, 25 bp, Rattus norvegicus
cagaggcggccaatgtgtctgtagt

SEQ ID NO: 228901 - DNA, 25 bp, Rattus norvegicus
cagaggcggccattgtgtctgtagt

SEQ ID NO: 228902 - DNA, 25 bp, Rattus norvegicus
cagaggcgggtgagagtcctctctt

SEQ ID NO: 228903 - DNA, 25 bp, Rattus norvegicus
cagaggcgggtgtgagtcctctctt

SEQ ID NO: 228904 - DNA, 25 bp, Rattus norvegicus
cagaggcgtcgtcatctattgtgat

SEQ ID NO: 228905 - DNA, 25 bp, Rattus norvegicus
cagaggcgtcgtgatctattgtgat

SEQ ID NO: 228906 - DNA, 25 bp, Rattus norvegicus
cagaggctacgcagactatgtcttt

SEQ ID NO: 228907 - DNA, 25 bp, Rattus norvegicus
cagaggctacgctgactatgtcttt

SEQ ID NO: 228908 - DNA, 25 bp, Rattus norvegicus
cagaggctactgaattttggtggaa

SEQ ID NO: 228909 - DNA, 25 bp, Rattus norvegicus
cagaggctactgtattttggtggaa

SEQ ID NO: 228910 - DNA, 25 bp, Rattus norvegicus
cagaggctatgaagcccccttttag

SEQ ID NO: 228911 - DNA, 25 bp, Rattus norvegicus
cagaggctatgatgcccccttttag

SEQ ID NO: 228912 - DNA, 25 bp, Rattus norvegicus
cagaggctccaaaatgaaggcatta

SEQ ID NO: 228913 - DNA, 25 bp, Rattus norvegicus
cagaggctccaatatgaaggcatta

SEQ ID NO: 228914 - DNA, 25 bp, Rattus norvegicus
cagaggctgaagatatggtagtaaa

SEQ ID NO: 228915 - DNA, 25 bp, Rattus norvegicus
cagaggctgaagttatggtagtaaa

SEQ ID NO: 228916 - DNA, 25 bp, Rattus norvegicus
cagaggctgcctatcaaatgacaac

SEQ ID NO: 228917 - DNA, 25 bp, Rattus norvegicus
cagaggctgcctttcaaatgacaac

SEQ ID NO: 228918 - DNA, 25 bp, Rattus norvegicus
cagaggctgcgtcctacctgcaggt

SEQ ID NO: 228919 - DNA, 25 bp, Rattus norvegicus
cagaggctgcgtgctacctgcaggt

SEQ ID NO: 228920 - DNA, 25 bp, Rattus norvegicus
cagaggctggacatatgcacggaga

SEQ ID NO: 228921 - DNA, 25 bp, Rattus norvegicus
cagaggctggacttatgcacggaga

SEQ ID NO: 228922 - DNA, 25 bp, Rattus norvegicus
cagaggctggctcctttggctgaca

SEQ ID NO: 228923 - DNA, 25 bp, Rattus norvegicus
cagaggctggctgctttggctgaca

SEQ ID NO: 228924 - DNA, 25 bp, Rattus norvegicus
cagaggctgttgagtttatttcata

SEQ ID NO: 228925 - DNA, 25 bp, Rattus norvegicus
cagaggctgttgtgtttatttcata

SEQ ID NO: 228926 - DNA, 25 bp, Rattus norvegicus
cagaggcttcagatgagcccctgga

SEQ ID NO: 228927 - DNA, 25 bp, Rattus norvegicus
cagaggcttcagttgagcccctgga

SEQ ID NO: 228928 - DNA, 25 bp, Rattus norvegicus
cagaggcttccacgcttcattatcc

SEQ ID NO: 228929 - DNA, 25 bp, Rattus norvegicus
cagaggcttccaggcttcattatcc

SEQ ID NO: 228930 - DNA, 25 bp, Rattus norvegicus
cagaggcttcctatcaatatatatt

SEQ ID NO: 228931 - DNA, 25 bp, Rattus norvegicus
cagaggcttcctttcaatatatatt

SEQ ID NO: 228932 - DNA, 25 bp, Rattus norvegicus
cagaggcttgagcacccagagccca

SEQ ID NO: 228933 - DNA, 25 bp, Rattus norvegicus
cagaggcttgaggacccagagccca

SEQ ID NO: 228934 - DNA, 25 bp, Rattus norvegicus
cagaggctttcccatgtgtgtggct

SEQ ID NO: 228935 - DNA, 25 bp, Rattus norvegicus
cagaggctttccgatgtgtgtggct

SEQ ID NO: 228936 - DNA, 25 bp, Rattus norvegicus
cagaggcttttacgtgcaatggctt

SEQ ID NO: 228937 - DNA, 25 bp, Rattus norvegicus
cagaggcttttaggtgcaatggctt

SEQ ID NO: 228938 - DNA, 25 bp, Rattus norvegicus
cagagggaacttaaatgtgcatatc

SEQ ID NO: 228939 - DNA, 25 bp, Rattus norvegicus
cagagggaactttaatgtgcatatc

SEQ ID NO: 228940 - DNA, 25 bp, Rattus norvegicus
cagagggaccccagcacgtaggtaa

SEQ ID NO: 228941 - DNA, 25 bp, Rattus norvegicus
cagagggacccctgcacgtaggtaa

SEQ ID NO: 228942 - DNA, 25 bp, Rattus norvegicus
cagagggacctcaactcttccagag

SEQ ID NO: 228943 - DNA, 25 bp, Rattus norvegicus
cagagggacctctactcttccagag

SEQ ID NO: 228944 - DNA, 25 bp, Rattus norvegicus
cagagggaggctcccctgccatctt

SEQ ID NO: 228945 - DNA, 25 bp, Rattus norvegicus
cagagggaggctgccctgccatctt

SEQ ID NO: 228946 - DNA, 25 bp, Rattus norvegicus
cagagggatcgtcgcttggcttccc

SEQ ID NO: 228947 - DNA, 25 bp, Rattus norvegicus
cagagggatcgtggcttggcttccc

SEQ ID NO: 228948 - DNA, 25 bp, Rattus norvegicus
cagagggcacttactcggcagagta

SEQ ID NO: 228949 - DNA, 25 bp, Rattus norvegicus
cagagggcactttctcggcagagta

SEQ ID NO: 228950 - DNA, 25 bp, Rattus norvegicus
cagagggcagatccccagaggctac

SEQ ID NO: 228951 - DNA, 25 bp, Rattus norvegicus
cagagggcagatgcccagaggctac

SEQ ID NO: 228952 - DNA, 25 bp, Rattus norvegicus
cagagggccatcactgacatttttt

SEQ ID NO: 228953 - DNA, 25 bp, Rattus norvegicus
cagagggccatctctgacatttttt

SEQ ID NO: 228954 - DNA, 25 bp, Rattus norvegicus
cagagggccatgagtcttacaagat

SEQ ID NO: 228955 - DNA, 25 bp, Rattus norvegicus
cagagggccatgtgtcttacaagat

SEQ ID NO: 228956 - DNA, 25 bp, Rattus norvegicus
cagagggcccttcgaagagtttaca

SEQ ID NO: 228957 - DNA, 25 bp, Rattus norvegicus
cagagggcccttggaagagtttaca

SEQ ID NO: 228958 - DNA, 25 bp, Rattus norvegicus
cagagggcctttccgaatccttatg

SEQ ID NO: 228959 - DNA, 25 bp, Rattus norvegicus
cagagggcctttgcgaatccttatg

SEQ ID NO: 228960 - DNA, 25 bp, Rattus norvegicus
cagagggcgggaaggtttccactac

SEQ ID NO: 228961 - DNA, 25 bp, Rattus norvegicus
cagagggcgggatggtttccactac

SEQ ID NO: 228962 - DNA, 25 bp, Rattus norvegicus
cagagggctactagccaggatcttt

SEQ ID NO: 228963 - DNA, 25 bp, Rattus norvegicus
cagagggctacttgccaggatcttt

SEQ ID NO: 228964 - DNA, 25 bp, Rattus norvegicus
cagagggtacctacacagtgaccat

SEQ ID NO: 228965 - DNA, 25 bp, Rattus norvegicus
cagagggtaccttcacagtgaccat

SEQ ID NO: 228966 - DNA, 25 bp, Rattus norvegicus
cagagggtggagaccatgagtcctt

SEQ ID NO: 228967 - DNA, 25 bp, Rattus norvegicus
cagagggtggagtccatgagtcctt

SEQ ID NO: 228968 - DNA, 25 bp, Rattus norvegicus
cagagggtggccagttttgctttaa

SEQ ID NO: 228969 - DNA, 25 bp, Rattus norvegicus
cagagggtggcctgttttgctttaa

SEQ ID NO: 228970 - DNA, 25 bp, Rattus norvegicus
cagagggttaccatactgagtatct

SEQ ID NO: 228971 - DNA, 25 bp, Rattus norvegicus
cagagggttaccttactgagtatct

SEQ ID NO: 228972 - DNA, 25 bp, Rattus norvegicus
cagaggtaaatgctcctgcagagta

SEQ ID NO: 228973 - DNA, 25 bp, Rattus norvegicus
cagaggtaaatggtcctgcagagta

SEQ ID NO: 228974 - DNA, 25 bp, Rattus norvegicus
cagaggtagctacacgattcagaac

SEQ ID NO: 228975 - DNA, 25 bp, Rattus norvegicus
cagaggtagctagacgattcagaac

SEQ ID NO: 228976 - DNA, 25 bp, Rattus norvegicus
cagaggtagcttacaggatgccagt

SEQ ID NO: 228977 - DNA, 25 bp, Rattus norvegicus
cagaggtagctttcaggatgccagt

SEQ ID NO: 228978 - DNA, 25 bp, Rattus norvegicus
cagaggtcacctaagtttattgttt

SEQ ID NO: 228979 - DNA, 25 bp, Rattus norvegicus
cagaggtcaccttagtttattgttt

SEQ ID NO: 228980 - DNA, 25 bp, Rattus norvegicus
cagaggtcactgctgaccacattcc

SEQ ID NO: 228981 - DNA, 25 bp, Rattus norvegicus
cagaggtcactggtgaccacattcc

SEQ ID NO: 228982 - DNA, 25 bp, Rattus norvegicus
cagaggtcagggatcagttagtact

SEQ ID NO: 228983 - DNA, 25 bp, Rattus norvegicus
cagaggtcagggttcagttagtact

SEQ ID NO: 228984 - DNA, 25 bp, Rattus norvegicus
cagaggtccaacaggcttagcctta

SEQ ID NO: 228985 - DNA, 25 bp, Rattus norvegicus
cagaggtccaactggcttagcctta

SEQ ID NO: 228986 - DNA, 25 bp, Rattus norvegicus
cagaggtccaggctcccgctatcag

SEQ ID NO: 228987 - DNA, 25 bp, Rattus norvegicus
cagaggtccagggtcccgctatcag

SEQ ID NO: 228988 - DNA, 25 bp, Rattus norvegicus
cagaggtcctgcatgctgtgatcat

SEQ ID NO: 228989 - DNA, 25 bp, Rattus norvegicus
cagaggtcctgcttgctgtgatcat

SEQ ID NO: 228990 - DNA, 25 bp, Rattus norvegicus
cagaggtctcgactccacggagtat

SEQ ID NO: 228991 - DNA, 25 bp, Rattus norvegicus
cagaggtctcgagtccacggagtat

SEQ ID NO: 228992 - DNA, 25 bp, Rattus norvegicus
cagaggtctttcacaggagccttat

SEQ ID NO: 228993 - DNA, 25 bp, Rattus norvegicus
cagaggtctttctcaggagccttat

SEQ ID NO: 228994 - DNA, 25 bp, Rattus norvegicus
cagaggtggagtcccgctatgccac

SEQ ID NO: 228995 - DNA, 25 bp, Rattus norvegicus
cagaggtggagtgccgctatgccac

SEQ ID NO: 228996 - DNA, 25 bp, Rattus norvegicus
cagaggtggcaacagggtcttccct

SEQ ID NO: 228997 - DNA, 25 bp, Rattus norvegicus
cagaggtggcaagagggtcttccct

SEQ ID NO: 228998 - DNA, 25 bp, Rattus norvegicus
cagaggtggcctatcctgattattt

SEQ ID NO: 228999 - DNA, 25 bp, Rattus norvegicus
cagaggtggcctttcctgattattt

SEQ ID NO: 229000 - DNA, 25 bp, Rattus norvegicus
cagaggtgggccagtcatctcggat

SEQ ID NO: 229001 - DNA, 25 bp, Rattus norvegicus
cagaggtgggcctgtcatctcggat

SEQ ID NO: 229002 - DNA, 25 bp, Rattus norvegicus
cagaggtgtttaatggtgtccccat

SEQ ID NO: 229003 - DNA, 25 bp, Rattus norvegicus
cagaggtgtttattggtgtccccat

SEQ ID NO: 229004 - DNA, 25 bp, Rattus norvegicus
cagaggttaaaaacgacgctcctaa

SEQ ID NO: 229005 - DNA, 25 bp, Rattus norvegicus
cagaggttaaaatcgacgctcctaa

SEQ ID NO: 229006 - DNA, 25 bp, Rattus norvegicus
cagaggttagaaccatccagggtta

SEQ ID NO: 229007 - DNA, 25 bp, Rattus norvegicus
cagaggttagaagcatccagggtta

SEQ ID NO: 229008 - DNA, 25 bp, Rattus norvegicus
cagaggttgcttaaatagccatcgt

SEQ ID NO: 229009 - DNA, 25 bp, Rattus norvegicus
cagaggttgctttaatagccatcgt

SEQ ID NO: 229010 - DNA, 25 bp, Rattus norvegicus
cagaggttgggacctggcttcccct

SEQ ID NO: 229011 - DNA, 25 bp, Rattus norvegicus
cagaggttgggagctggcttcccct

SEQ ID NO: 229012 - DNA, 25 bp, Rattus norvegicus
cagaggtttctaaataaagccaaag

SEQ ID NO: 229013 - DNA, 25 bp, Rattus norvegicus
cagaggtttctatataaagccaaag

SEQ ID NO: 229014 - DNA, 25 bp, Rattus norvegicus
cagaggtttgaaagcccagtgaccc

SEQ ID NO: 229015 - DNA, 25 bp, Rattus norvegicus
cagaggtttgaatgcccagtgaccc

SEQ ID NO: 229016 - DNA, 25 bp, Rattus norvegicus
cagagtacaataatttcccgtgaaa

SEQ ID NO: 229017 - DNA, 25 bp, Rattus norvegicus
cagagtacaatattttcccgtgaaa

SEQ ID NO: 229018 - DNA, 25 bp, Rattus norvegicus
cagagtacttagagggtctccctga

SEQ ID NO: 229019 - DNA, 25 bp, Rattus norvegicus
cagagtacttagtgggtctccctga

SEQ ID NO: 229020 - DNA, 25 bp, Rattus norvegicus
cagagtagcttcatgcctgctgact

SEQ ID NO: 229021 - DNA, 25 bp, Rattus norvegicus
cagagtagcttcattgtgtcatgag

SEQ ID NO: 229022 - DNA, 25 bp, Rattus norvegicus
cagagtagcttcttgcctgctgact

SEQ ID NO: 229023 - DNA, 25 bp, Rattus norvegicus
cagagtagcttctttgtgtcatgag

SEQ ID NO: 229024 - DNA, 25 bp, Rattus norvegicus
cagagtaggtgacccaacggcgcat

SEQ ID NO: 229025 - DNA, 25 bp, Rattus norvegicus
cagagtaggtgagccaacggcgcat

SEQ ID NO: 229026 - DNA, 25 bp, Rattus norvegicus
cagagtatatttcccttcagataac

SEQ ID NO: 229027 - DNA, 25 bp, Rattus norvegicus
cagagtatatttgccttcagataac

SEQ ID NO: 229028 - DNA, 25 bp, Rattus norvegicus
cagagtatcacaccgcttccagcgg

SEQ ID NO: 229029 - DNA, 25 bp, Rattus norvegicus
cagagtatcacagcgcttccagcgg

SEQ ID NO: 229030 - DNA, 25 bp, Rattus norvegicus
cagagtatctccagggcctgagaat

SEQ ID NO: 229031 - DNA, 25 bp, Rattus norvegicus
cagagtatctcctgggcctgagaat

SEQ ID NO: 229032 - DNA, 25 bp, Rattus norvegicus
cagagtcacaggcaccgagcatggc

SEQ ID NO: 229033 - DNA, 25 bp, Rattus norvegicus
cagagtcacagggaccgagcatggc

SEQ ID NO: 229034 - DNA, 25 bp, Rattus norvegicus
cagagtcactgaccctgcagggaca

SEQ ID NO: 229035 - DNA, 25 bp, Rattus norvegicus
cagagtcactgagcctgcagggaca

SEQ ID NO: 229036 - DNA, 25 bp, Rattus norvegicus
cagagtcagcagatgtggtaaattt

SEQ ID NO: 229037 - DNA, 25 bp, Rattus norvegicus
cagagtcagcagttgtggtaaattt

SEQ ID NO: 229038 - DNA, 25 bp, Rattus norvegicus
cagagtcatgacagtttaccaaaaa

SEQ ID NO: 229039 - DNA, 25 bp, Rattus norvegicus
cagagtcatgactgtttaccaaaaa

SEQ ID NO: 229040 - DNA, 25 bp, Rattus norvegicus
cagagtccactgaaattccccttga

SEQ ID NO: 229041 - DNA, 25 bp, Rattus norvegicus
cagagtccactgtaattccccttga

SEQ ID NO: 229042 - DNA, 25 bp, Rattus norvegicus
cagagtccatggattgtcccaacta

SEQ ID NO: 229043 - DNA, 25 bp, Rattus norvegicus
cagagtccatggtttgtcccaacta

SEQ ID NO: 229044 - DNA, 25 bp, Rattus norvegicus
cagagtccccggcttaagggctgca

SEQ ID NO: 229045 - DNA, 25 bp, Rattus norvegicus
cagagtccccgggttaagggctgca

SEQ ID NO: 229046 - DNA, 25 bp, Rattus norvegicus
cagagtcccgttcccgagagatgga

SEQ ID NO: 229047 - DNA, 25 bp, Rattus norvegicus
cagagtcccgttgccgagagatgga

SEQ ID NO: 229048 - DNA, 25 bp, Rattus norvegicus
cagagtccctacaaagaatgcatta

SEQ ID NO: 229049 - DNA, 25 bp, Rattus norvegicus
cagagtccctactaagaatgcatta

SEQ ID NO: 229050 - DNA, 25 bp, Rattus norvegicus
cagagtccgctgcattactaataaa

SEQ ID NO: 229051 - DNA, 25 bp, Rattus norvegicus
cagagtccgctggattactaataaa

SEQ ID NO: 229052 - DNA, 25 bp, Rattus norvegicus
cagagtcctcctcgctgggacagag

SEQ ID NO: 229053 - DNA, 25 bp, Rattus norvegicus
cagagtcctcctggctgggacagag

SEQ ID NO: 229054 - DNA, 25 bp, Rattus norvegicus
cagagtcctgccacatggtggtgta

SEQ ID NO: 229055 - DNA, 25 bp, Rattus norvegicus
cagagtcctgccctaatttacatgt

SEQ ID NO: 229056 - DNA, 25 bp, Rattus norvegicus
cagagtcctgccgtaatttacatgt

SEQ ID NO: 229057 - DNA, 25 bp, Rattus norvegicus
cagagtcctgcctcatggtggtgta

SEQ ID NO: 229058 - DNA, 25 bp, Rattus norvegicus
cagagtcctttccatgaacacaact

SEQ ID NO: 229059 - DNA, 25 bp, Rattus norvegicus
cagagtcctttcgatgaacacaact

SEQ ID NO: 229060 - DNA, 25 bp, Rattus norvegicus
cagagtcgcggtcgttcttgtgata

SEQ ID NO: 229061 - DNA, 25 bp, Rattus norvegicus
cagagtcgcggtggttcttgtgata

SEQ ID NO: 229062 - DNA, 25 bp, Rattus norvegicus
cagagtcggtgcacacctggcagga

SEQ ID NO: 229063 - DNA, 25 bp, Rattus norvegicus
cagagtcggtgctcacctggcagga

SEQ ID NO: 229064 - DNA, 25 bp, Rattus norvegicus
cagagtctatgtaggaggtgatata

SEQ ID NO: 229065 - DNA, 25 bp, Rattus norvegicus
cagagtctatgttggaggtgatata

SEQ ID NO: 229066 - DNA, 25 bp, Rattus norvegicus
cagagtctccaaacctaacaagtca

SEQ ID NO: 229067 - DNA, 25 bp, Rattus norvegicus
cagagtctccaatcctaacaagtca

SEQ ID NO: 229068 - DNA, 25 bp, Rattus norvegicus
cagagtctccagaattgaggacata

SEQ ID NO: 229069 - DNA, 25 bp, Rattus norvegicus
cagagtctccagtattgaggacata

SEQ ID NO: 229070 - DNA, 25 bp, Rattus norvegicus
cagagtctctcacccaggtcttatc

SEQ ID NO: 229071 - DNA, 25 bp, Rattus norvegicus
cagagtctctcagccaggtcttatc

SEQ ID NO: 229072 - DNA, 25 bp, Rattus norvegicus
cagagtctggaacggtggctgggat

SEQ ID NO: 229073 - DNA, 25 bp, Rattus norvegicus
cagagtctggaagggtggctgggat

SEQ ID NO: 229074 - DNA, 25 bp, Rattus norvegicus
cagagtctggacatacaagctaggt

SEQ ID NO: 229075 - DNA, 25 bp, Rattus norvegicus
cagagtctggacttacaagctaggt

SEQ ID NO: 229076 - DNA, 25 bp, Rattus norvegicus
cagagtctgtgtattattgggccca

SEQ ID NO: 229077 - DNA, 25 bp, Rattus norvegicus
cagagtctgtgttttattgggccca

SEQ ID NO: 229078 - DNA, 25 bp, Rattus norvegicus
cagagtcttctgacatttcattttt

SEQ ID NO: 229079 - DNA, 25 bp, Rattus norvegicus
cagagtcttctgtcatttcattttt

SEQ ID NO: 229080 - DNA, 25 bp, Rattus norvegicus
cagagtcttgtcagcttggtggttc

SEQ ID NO: 229081 - DNA, 25 bp, Rattus norvegicus
cagagtcttgtctgcttggtggttc

SEQ ID NO: 229082 - DNA, 25 bp, Rattus norvegicus
cagagtgaaccgagtacgttgtaca

SEQ ID NO: 229083 - DNA, 25 bp, Rattus norvegicus
cagagtgaaccgtgtacgttgtaca

SEQ ID NO: 229084 - DNA, 25 bp, Rattus norvegicus
cagagtgacctcaggttcagttctc

SEQ ID NO: 229085 - DNA, 25 bp, Rattus norvegicus
cagagtgacctctggttcagttctc

SEQ ID NO: 229086 - DNA, 25 bp, Rattus norvegicus
cagagtgaggaacccagccccttgg

SEQ ID NO: 229087 - DNA, 25 bp, Rattus norvegicus
cagagtgaggaagccagccccttgg

SEQ ID NO: 229088 - DNA, 25 bp, Rattus norvegicus
cagagtgcagccctttcaagtagaa

SEQ ID NO: 229089 - DNA, 25 bp, Rattus norvegicus
cagagtgcagccgtttcaagtagaa

SEQ ID NO: 229090 - DNA, 25 bp, Rattus norvegicus
cagagtgccctcaactctagtagac

SEQ ID NO: 229091 - DNA, 25 bp, Rattus norvegicus
cagagtgccctctactctagtagac

SEQ ID NO: 229092 - DNA, 25 bp, Rattus norvegicus
cagagtgcgcctccttttgagtaag

SEQ ID NO: 229093 - DNA, 25 bp, Rattus norvegicus
cagagtgcgcctgcttttgagtaag

SEQ ID NO: 229094 - DNA, 25 bp, Rattus norvegicus
cagagtggactcaccccatggtggg

SEQ ID NO: 229095 - DNA, 25 bp, Rattus norvegicus
cagagtggactctccccatggtggg

SEQ ID NO: 229096 - DNA, 25 bp, Rattus norvegicus
cagagtggacttcatggcttttgtt

SEQ ID NO: 229097 - DNA, 25 bp, Rattus norvegicus
cagagtggacttgatggcttttgtt

SEQ ID NO: 229098 - DNA, 25 bp, Rattus norvegicus
cagagtggagctcacttgagtctat

SEQ ID NO: 229099 - DNA, 25 bp, Rattus norvegicus
cagagtggagctgacttgagtctat

SEQ ID NO: 229100 - DNA, 25 bp, Rattus norvegicus
cagagtggatgaacctgcttcaggg

SEQ ID NO: 229101 - DNA, 25 bp, Rattus norvegicus
cagagtggatgatcctgcttcaggg

SEQ ID NO: 229102 - DNA, 25 bp, Rattus norvegicus
cagagtggccttcggcacatgccaa

SEQ ID NO: 229103 - DNA, 25 bp, Rattus norvegicus
cagagtggccttgggcacatgccaa

SEQ ID NO: 229104 - DNA, 25 bp, Rattus norvegicus
cagagtggctatcgcgggcaaacaa

SEQ ID NO: 229105 - DNA, 25 bp, Rattus norvegicus
cagagtggctatggcgggcaaacaa

SEQ ID NO: 229106 - DNA, 25 bp, Rattus norvegicus
cagagtgggatactatcggtgttcc

SEQ ID NO: 229107 - DNA, 25 bp, Rattus norvegicus
cagagtgggatagtatcggtgttcc

SEQ ID NO: 229108 - DNA, 25 bp, Rattus norvegicus
cagagtgtcaccagctgggagtgat

SEQ ID NO: 229109 - DNA, 25 bp, Rattus norvegicus
cagagtgtcacctgctgggagtgat

SEQ ID NO: 229110 - DNA, 25 bp, Rattus norvegicus
cagagtgtcaggagagtgtatatgc

SEQ ID NO: 229111 - DNA, 25 bp, Rattus norvegicus
cagagtgtcaggtgagtgtatatgc

SEQ ID NO: 229112 - DNA, 25 bp, Rattus norvegicus
cagagtgtccacacggaagatggtg

SEQ ID NO: 229113 - DNA, 25 bp, Rattus norvegicus
cagagtgtccactcggaagatggtg

SEQ ID NO: 229114 - DNA, 25 bp, Rattus norvegicus
cagagtgtcccaaagcttagatgct

SEQ ID NO: 229115 - DNA, 25 bp, Rattus norvegicus
cagagtgtcccaccgacgatgagga

SEQ ID NO: 229116 - DNA, 25 bp, Rattus norvegicus
cagagtgtcccagcgacgatgagga

SEQ ID NO: 229117 - DNA, 25 bp, Rattus norvegicus
cagagtgtcccatagcttagatgct

SEQ ID NO: 229118 - DNA, 25 bp, Rattus norvegicus
cagagtgtccgtagccatttatcct

SEQ ID NO: 229119 - DNA, 25 bp, Rattus norvegicus
cagagtgtccgttgccatttatcct

SEQ ID NO: 229120 - DNA, 25 bp, Rattus norvegicus
cagagtgtctcaagccagggcccag

SEQ ID NO: 229121 - DNA, 25 bp, Rattus norvegicus
cagagtgtctcatgccagggcccag

SEQ ID NO: 229122 - DNA, 25 bp, Rattus norvegicus
cagagtgtggtgagcagtttcctgc

SEQ ID NO: 229123 - DNA, 25 bp, Rattus norvegicus
cagagtgtggtgtgcagtttcctgc

SEQ ID NO: 229124 - DNA, 25 bp, Rattus norvegicus
cagagtgtgtcgaaggtagccagta

SEQ ID NO: 229125 - DNA, 25 bp, Rattus norvegicus
cagagtgtgtcgtaggtagccagta

SEQ ID NO: 229126 - DNA, 25 bp, Rattus norvegicus
cagagtgtgttcacatgacatacca

SEQ ID NO: 229127 - DNA, 25 bp, Rattus norvegicus
cagagtgtgttctcatgacatacca

SEQ ID NO: 229128 - DNA, 25 bp, Rattus norvegicus
cagagtgtttgtatgaatcccacgt

SEQ ID NO: 229129 - DNA, 25 bp, Rattus norvegicus
cagagtgtttgtttgaatcccacgt

SEQ ID NO: 229130 - DNA, 25 bp, Rattus norvegicus
cagagttaataacccctttgtgtgt

SEQ ID NO: 229131 - DNA, 25 bp, Rattus norvegicus
cagagttaataagccctttgtgtgt

SEQ ID NO: 229132 - DNA, 25 bp, Rattus norvegicus
cagagttagcctcggttgttccaca

SEQ ID NO: 229133 - DNA, 25 bp, Rattus norvegicus
cagagttagcctgggttgttccaca

SEQ ID NO: 229134 - DNA, 25 bp, Rattus norvegicus
cagagttcacttatgctagaggcaa

SEQ ID NO: 229135 - DNA, 25 bp, Rattus norvegicus
cagagttcacttttgctagaggcaa

SEQ ID NO: 229136 - DNA, 25 bp, Rattus norvegicus
cagagttcagaaaccataccgtaga

SEQ ID NO: 229137 - DNA, 25 bp, Rattus norvegicus
cagagttcagaatccataccgtaga

SEQ ID NO: 229138 - DNA, 25 bp, Rattus norvegicus
cagagttcagtgctggatgccttca

SEQ ID NO: 229139 - DNA, 25 bp, Rattus norvegicus
cagagttcagtggtggatgccttca

SEQ ID NO: 229140 - DNA, 25 bp, Rattus norvegicus
cagagttcataccatgcataccttt

SEQ ID NO: 229141 - DNA, 25 bp, Rattus norvegicus
cagagttcatacgatgcataccttt

SEQ ID NO: 229142 - DNA, 25 bp, Rattus norvegicus
cagagttcattgaatgtgtgggttt

SEQ ID NO: 229143 - DNA, 25 bp, Rattus norvegicus
cagagttcattgtatgtgtgggttt

SEQ ID NO: 229144 - DNA, 25 bp, Rattus norvegicus
cagagttccagcagtttcctcagaa

SEQ ID NO: 229145 - DNA, 25 bp, Rattus norvegicus
cagagttccagctgtttcctcagaa

SEQ ID NO: 229146 - DNA, 25 bp, Rattus norvegicus
cagagttcctggagttacgtggttc

SEQ ID NO: 229147 - DNA, 25 bp, Rattus norvegicus
cagagttcctggtgttacgtggttc

SEQ ID NO: 229148 - DNA, 25 bp, Rattus norvegicus
cagagttctaccctctaaaggcgga

SEQ ID NO: 229149 - DNA, 25 bp, Rattus norvegicus
cagagttctaccgtctaaaggcgga

SEQ ID NO: 229150 - DNA, 25 bp, Rattus norvegicus
cagagttctgaccaccaggaagcta

SEQ ID NO: 229151 - DNA, 25 bp, Rattus norvegicus
cagagttctgacgaccaggaagcta

SEQ ID NO: 229152 - DNA, 25 bp, Rattus norvegicus
cagagttgctggacggtggctctca

SEQ ID NO: 229153 - DNA, 25 bp, Rattus norvegicus
cagagttgctggtcggtggctctca

SEQ ID NO: 229154 - DNA, 25 bp, Rattus norvegicus
cagagttggagacccgccagtctta

SEQ ID NO: 229155 - DNA, 25 bp, Rattus norvegicus
cagagttggagagccgccagtctta

SEQ ID NO: 229156 - DNA, 25 bp, Rattus norvegicus
cagagttgggccacgtaggaaactg

SEQ ID NO: 229157 - DNA, 25 bp, Rattus norvegicus
cagagttgggcctcgtaggaaactg

SEQ ID NO: 229158 - DNA, 25 bp, Rattus norvegicus
cagagttggtgtatggagcccagcc

SEQ ID NO: 229159 - DNA, 25 bp, Rattus norvegicus
cagagttggtgtttggagcccagcc

SEQ ID NO: 229160 - DNA, 25 bp, Rattus norvegicus
cagagttgtcgtccttttactgtgt

SEQ ID NO: 229161 - DNA, 25 bp, Rattus norvegicus
cagagttgtcgtgcttttactgtgt

SEQ ID NO: 229162 - DNA, 25 bp, Rattus norvegicus
cagagtttactgaggccagggctag

SEQ ID NO: 229163 - DNA, 25 bp, Rattus norvegicus
cagagtttactgtggccagggctag

SEQ ID NO: 229164 - DNA, 25 bp, Rattus norvegicus
cagagtttagcaattcccttcctta

SEQ ID NO: 229165 - DNA, 25 bp, Rattus norvegicus
cagagtttagcatttcccttcctta

SEQ ID NO: 229166 - DNA, 25 bp, Rattus norvegicus
cagagtttcaaaaccccttgactaa

SEQ ID NO: 229167 - DNA, 25 bp, Rattus norvegicus
cagagtttcaaatccccttgactaa

SEQ ID NO: 229168 - DNA, 25 bp, Rattus norvegicus
cagagtttctgtatgcgaatatgag

SEQ ID NO: 229169 - DNA, 25 bp, Rattus norvegicus
cagagtttctgtttgcgaatatgag

SEQ ID NO: 229170 - DNA, 25 bp, Rattus norvegicus
cagagtttgactaactgacttgtgt

SEQ ID NO: 229171 - DNA, 25 bp, Rattus norvegicus
cagagtttgacttactgacttgtgt

SEQ ID NO: 229172 - DNA, 25 bp, Rattus norvegicus
cagagtttgcgtacatttgcttttc

SEQ ID NO: 229173 - DNA, 25 bp, Rattus norvegicus
cagagtttgcgttcatttgcttttc

SEQ ID NO: 229174 - DNA, 25 bp, Rattus norvegicus
cagagtttggcaatataggtttgtt

SEQ ID NO: 229175 - DNA, 25 bp, Rattus norvegicus
cagagtttggcattataggtttgtt

SEQ ID NO: 229176 - DNA, 25 bp, Rattus norvegicus
cagagtttggctattctggaagaat

SEQ ID NO: 229177 - DNA, 25 bp, Rattus norvegicus
cagagtttggcttttctggaagaat

SEQ ID NO: 229178 - DNA, 25 bp, Rattus norvegicus
cagagtttggtcatcctggtgaaaa

SEQ ID NO: 229179 - DNA, 25 bp, Rattus norvegicus
cagagtttggtcttcctggtgaaaa

SEQ ID NO: 229180 - DNA, 25 bp, Rattus norvegicus
cagagtttgtcaacgggttcgtaca

SEQ ID NO: 229181 - DNA, 25 bp, Rattus norvegicus
cagagtttgtcatcgggttcgtaca

SEQ ID NO: 229182 - DNA, 25 bp, Rattus norvegicus
cagagttttcatacctaggctattt

SEQ ID NO: 229183 - DNA, 25 bp, Rattus norvegicus
cagagttttcattcctaggctattt

SEQ ID NO: 229184 - DNA, 25 bp, Rattus norvegicus
cagagttttctaaaggctcgtggaa

SEQ ID NO: 229185 - DNA, 25 bp, Rattus norvegicus
cagagttttctataggctcgtggaa

SEQ ID NO: 229186 - DNA, 25 bp, Rattus norvegicus
cagagtttttcaccccagggcacat

SEQ ID NO: 229187 - DNA, 25 bp, Rattus norvegicus
cagagtttttcagcccagggcacat

SEQ ID NO: 229188 - DNA, 25 bp, Rattus norvegicus
cagagtttttctatgcaggagcgac

SEQ ID NO: 229189 - DNA, 25 bp, Rattus norvegicus
cagagtttttctttgcaggagcgac

SEQ ID NO: 229190 - DNA, 25 bp, Rattus norvegicus
cagataacctgaactaccaagtggc

SEQ ID NO: 229191 - DNA, 25 bp, Rattus norvegicus
cagataacctgatctaccaagtggc

SEQ ID NO: 229192 - DNA, 25 bp, Rattus norvegicus
cagataactctaacttgggtcaagc

SEQ ID NO: 229193 - DNA, 25 bp, Rattus norvegicus
cagataactctatcttgggtcaagc

SEQ ID NO: 229194 - DNA, 25 bp, Rattus norvegicus
cagataagcccgctatccctgtttt

SEQ ID NO: 229195 - DNA, 25 bp, Rattus norvegicus
cagataagcccggtatccctgtttt

SEQ ID NO: 229196 - DNA, 25 bp, Rattus norvegicus
cagataatccttagactgtcagtct

SEQ ID NO: 229197 - DNA, 25 bp, Rattus norvegicus
cagataatcctttgactgtcagtct

SEQ ID NO: 229198 - DNA, 25 bp, Rattus norvegicus
cagataattcatcactattgctgca

SEQ ID NO: 229199 - DNA, 25 bp, Rattus norvegicus
cagataattcatgactattgctgca

SEQ ID NO: 229200 - DNA, 25 bp, Rattus norvegicus
cagatacactgaacccgaagaaaga

SEQ ID NO: 229201 - DNA, 25 bp, Rattus norvegicus
cagatacactgatcccgaagaaaga

SEQ ID NO: 229202 - DNA, 25 bp, Rattus norvegicus
cagataccaggccagttgcttggaa

SEQ ID NO: 229203 - DNA, 25 bp, Rattus norvegicus
cagataccaggcgagttgcttggaa

SEQ ID NO: 229204 - DNA, 25 bp, Rattus norvegicus
cagataccctttccttggaaccaag

SEQ ID NO: 229205 - DNA, 25 bp, Rattus norvegicus
cagataccctttgcttggaaccaag

SEQ ID NO: 229206 - DNA, 25 bp, Rattus norvegicus
cagatacctcctagcttttgggtat

SEQ ID NO: 229207 - DNA, 25 bp, Rattus norvegicus
cagatacctccttgcttttgggtat

SEQ ID NO: 229208 - DNA, 25 bp, Rattus norvegicus
cagatactctgtacactcatggtgc

SEQ ID NO: 229209 - DNA, 25 bp, Rattus norvegicus
cagatactctgttcactcatggtgc

SEQ ID NO: 229210 - DNA, 25 bp, Rattus norvegicus
cagatacttggactgaaattggtaa

SEQ ID NO: 229211 - DNA, 25 bp, Rattus norvegicus
cagatacttggagtgaaattggtaa

SEQ ID NO: 229212 - DNA, 25 bp, Rattus norvegicus
cagatagaatgcactccaccttatt

SEQ ID NO: 229213 - DNA, 25 bp, Rattus norvegicus
cagatagaatgctctccaccttatt

SEQ ID NO: 229214 - DNA, 25 bp, Rattus norvegicus
cagatagagactccccggatgacta

SEQ ID NO: 229215 - DNA, 25 bp, Rattus norvegicus
cagatagagactgcccggatgacta

SEQ ID NO: 229216 - DNA, 25 bp, Rattus norvegicus
cagatagctctaagggactcccgtg

SEQ ID NO: 229217 - DNA, 25 bp, Rattus norvegicus
cagatagctctatgggactcccgtg

SEQ ID NO: 229218 - DNA, 25 bp, Rattus norvegicus
cagataggaaagcatgtgctgctct

SEQ ID NO: 229219 - DNA, 25 bp, Rattus norvegicus
cagataggaaaggatgtgctgctct

SEQ ID NO: 229220 - DNA, 25 bp, Rattus norvegicus
cagatagggcagctgcacaggatat

SEQ ID NO: 229221 - DNA, 25 bp, Rattus norvegicus
cagatagggcaggtgcacaggatat

SEQ ID NO: 229222 - DNA, 25 bp, Rattus norvegicus
cagatagggtctctggctaggcacc

SEQ ID NO: 229223 - DNA, 25 bp, Rattus norvegicus
cagatagggtctgtggctaggcacc

SEQ ID NO: 229224 - DNA, 25 bp, Rattus norvegicus
cagatagtttcaattcacctgtaaa

SEQ ID NO: 229225 - DNA, 25 bp, Rattus norvegicus
cagatagtttcatttcacctgtaaa

SEQ ID NO: 229226 - DNA, 25 bp, Rattus norvegicus
cagatatacgttcgaaactgtagaa

SEQ ID NO: 229227 - DNA, 25 bp, Rattus norvegicus
cagatatacgttggaaactgtagaa

SEQ ID NO: 229228 - DNA, 25 bp, Rattus norvegicus
cagatatcttggcacaccccagtgt

SEQ ID NO: 229229 - DNA, 25 bp, Rattus norvegicus
cagatatcttgggacaccccagtgt

SEQ ID NO: 229230 - DNA, 25 bp, Rattus norvegicus
cagatatgacaacggctcaggaaga

SEQ ID NO: 229231 - DNA, 25 bp, Rattus norvegicus
cagatatgacaagggctcaggaaga

SEQ ID NO: 229232 - DNA, 25 bp, Rattus norvegicus
cagatatgcataatccctccagatg

SEQ ID NO: 229233 - DNA, 25 bp, Rattus norvegicus
cagatatgcatattccctccagatg

SEQ ID NO: 229234 - DNA, 25 bp, Rattus norvegicus
cagatatggtttagcctgagtcaaa

SEQ ID NO: 229235 - DNA, 25 bp, Rattus norvegicus
cagatatggttttgcctgagtcaaa

SEQ ID NO: 229236 - DNA, 25 bp, Rattus norvegicus
cagatatgtgccactgtttccaact

SEQ ID NO: 229237 - DNA, 25 bp, Rattus norvegicus
cagatatgtgcctctgtttccaact

SEQ ID NO: 229238 - DNA, 25 bp, Rattus norvegicus
cagatattaccaccatgccagacat

SEQ ID NO: 229239 - DNA, 25 bp, Rattus norvegicus
cagatattaccagcatgccagacat

SEQ ID NO: 229240 - DNA, 25 bp, Rattus norvegicus
cagatattatgcacacccacttcag

SEQ ID NO: 229241 - DNA, 25 bp, Rattus norvegicus
cagatattatgctcacccacttcag

SEQ ID NO: 229242 - DNA, 25 bp, Rattus norvegicus
cagatattattgaattgcctgtaaa

SEQ ID NO: 229243 - DNA, 25 bp, Rattus norvegicus
cagatattattgtattgcctgtaaa

SEQ ID NO: 229244 - DNA, 25 bp, Rattus norvegicus
cagatattgcgcacattttgcagat

SEQ ID NO: 229245 - DNA, 25 bp, Rattus norvegicus
cagatattgcgctcattttgcagat

SEQ ID NO: 229246 - DNA, 25 bp, Rattus norvegicus
cagatatttattatgctttccaaac

SEQ ID NO: 229247 - DNA, 25 bp, Rattus norvegicus
cagatatttattttgctttccaaac

SEQ ID NO: 229248 - DNA, 25 bp, Rattus norvegicus
cagatatttgaacctgaccgtcttt

SEQ ID NO: 229249 - DNA, 25 bp, Rattus norvegicus
cagatatttgaagctgaccgtcttt

SEQ ID NO: 229250 - DNA, 25 bp, Rattus norvegicus
cagatcaaaagcagtgtcagacaca

SEQ ID NO: 229251 - DNA, 25 bp, Rattus norvegicus
cagatcaaaagctgtgtcagacaca

SEQ ID NO: 229252 - DNA, 25 bp, Rattus norvegicus
cagatcacagtgagtcattccatga

SEQ ID NO: 229253 - DNA, 25 bp, Rattus norvegicus
cagatcacagtgtgtcattccatga

SEQ ID NO: 229254 - DNA, 25 bp, Rattus norvegicus
cagatcaccaaacgaccagaaatca

SEQ ID NO: 229255 - DNA, 25 bp, Rattus norvegicus
cagatcaccaaaggaccagaaatca

SEQ ID NO: 229256 - DNA, 25 bp, Rattus norvegicus
cagatcaccaggaaagatgacaact

SEQ ID NO: 229257 - DNA, 25 bp, Rattus norvegicus
cagatcaccaggtaagatgacaact

SEQ ID NO: 229258 - DNA, 25 bp, Rattus norvegicus
cagatcacccacattccagaggcat

SEQ ID NO: 229259 - DNA, 25 bp, Rattus norvegicus
cagatcacccactttccagaggcat

SEQ ID NO: 229260 - DNA, 25 bp, Rattus norvegicus
cagatcaggtgtacagggtggttca

SEQ ID NO: 229261 - DNA, 25 bp, Rattus norvegicus
cagatcaggtgttcagggtggttca

SEQ ID NO: 229262 - DNA, 25 bp, Rattus norvegicus
cagatcatccctacggcggaggaga

SEQ ID NO: 229263 - DNA, 25 bp, Rattus norvegicus
cagatcatcccttcggcggaggaga

SEQ ID NO: 229264 - DNA, 25 bp, Rattus norvegicus
cagatccacctgactatgacatggg

SEQ ID NO: 229265 - DNA, 25 bp, Rattus norvegicus
cagatccacctgtctatgacatggg

SEQ ID NO: 229266 - DNA, 25 bp, Rattus norvegicus
cagatccactttcttaggtttaatc

SEQ ID NO: 229267 - DNA, 25 bp, Rattus norvegicus
cagatccactttgttaggtttaatc

SEQ ID NO: 229268 - DNA, 25 bp, Rattus norvegicus
cagatcccagatccgggagaccctg

SEQ ID NO: 229269 - DNA, 25 bp, Rattus norvegicus
cagatcccagatgcgggagaccctg

SEQ ID NO: 229270 - DNA, 25 bp, Rattus norvegicus
cagatcccaggacacaggtgtttta

SEQ ID NO: 229271 - DNA, 25 bp, Rattus norvegicus
cagatcccaggagacaggtgtttta

SEQ ID NO: 229272 - DNA, 25 bp, Rattus norvegicus
cagatccccaatcacaggttcacgt

SEQ ID NO: 229273 - DNA, 25 bp, Rattus norvegicus
cagatccccaatgacaggttcacgt

SEQ ID NO: 229274 - DNA, 25 bp, Rattus norvegicus
cagatcccctggagtcagaataaag

SEQ ID NO: 229275 - DNA, 25 bp, Rattus norvegicus
cagatcccctggtgtcagaataaag

SEQ ID NO: 229276 - DNA, 25 bp, Rattus norvegicus
cagatcccggtgcttgtgattctag

SEQ ID NO: 229277 - DNA, 25 bp, Rattus norvegicus
cagatcccggtggttgtgattctag

SEQ ID NO: 229278 - DNA, 25 bp, Rattus norvegicus
cagatcccgtgtattgtgtcaatgc

SEQ ID NO: 229279 - DNA, 25 bp, Rattus norvegicus
cagatcccgtgttttgtgtcaatgc

SEQ ID NO: 229280 - DNA, 25 bp, Rattus norvegicus
cagatccctctgctcagtcattcat

SEQ ID NO: 229281 - DNA, 25 bp, Rattus norvegicus
cagatccctctggtcagtcattcat

SEQ ID NO: 229282 - DNA, 25 bp, Rattus norvegicus
cagatccgccagacctgtgaggaga

SEQ ID NO: 229283 - DNA, 25 bp, Rattus norvegicus
cagatccgccagtcctgtgaggaga

SEQ ID NO: 229284 - DNA, 25 bp, Rattus norvegicus
cagatccgctggaactagagctagg

SEQ ID NO: 229285 - DNA, 25 bp, Rattus norvegicus
cagatccgctggtactagagctagg

SEQ ID NO: 229286 - DNA, 25 bp, Rattus norvegicus
cagatcctagagagactgcggttag

SEQ ID NO: 229287 - DNA, 25 bp, Rattus norvegicus
cagatcctagagtgactgcggttag

SEQ ID NO: 229288 - DNA, 25 bp, Rattus norvegicus
cagatcctcaggacaagcactggct

SEQ ID NO: 229289 - DNA, 25 bp, Rattus norvegicus
cagatcctcaggtcaagcactggct

SEQ ID NO: 229290 - DNA, 25 bp, Rattus norvegicus
cagatcctcctcatctattttttgt

SEQ ID NO: 229291 - DNA, 25 bp, Rattus norvegicus
cagatcctcctcttctattttttgt

SEQ ID NO: 229292 - DNA, 25 bp, Rattus norvegicus
cagatcctgaaccttaattgaacca

SEQ ID NO: 229293 - DNA, 25 bp, Rattus norvegicus
cagatcctgaacgttaattgaacca

SEQ ID NO: 229294 - DNA, 25 bp, Rattus norvegicus
cagatcctgctgctatttgtgaagt

SEQ ID NO: 229295 - DNA, 25 bp, Rattus norvegicus
cagatcctgctggtatttgtgaagt

SEQ ID NO: 229296 - DNA, 25 bp, Rattus norvegicus
cagatcctgtggactgtgagctcca

SEQ ID NO: 229297 - DNA, 25 bp, Rattus norvegicus
cagatcctgtggtctgtgagctcca

SEQ ID NO: 229298 - DNA, 25 bp, Rattus norvegicus
cagatccttaacatacctatggtac

SEQ ID NO: 229299 - DNA, 25 bp, Rattus norvegicus
cagatccttaacttacctatggtac

SEQ ID NO: 229300 - DNA, 25 bp, Rattus norvegicus
cagatcctttctctgcttaagtggt

SEQ ID NO: 229301 - DNA, 25 bp, Rattus norvegicus
cagatcctttctgtgcttaagtggt

SEQ ID NO: 229302 - DNA, 25 bp, Rattus norvegicus
cagatcgagtggatccgtgcaggca

SEQ ID NO: 229303 - DNA, 25 bp, Rattus norvegicus
cagatcgagtggttccgtgcaggca

SEQ ID NO: 229304 - DNA, 25 bp, Rattus norvegicus
cagatcgctgtactgccttggacct

SEQ ID NO: 229305 - DNA, 25 bp, Rattus norvegicus
cagatcgctgtagtgccttggacct

SEQ ID NO: 229306 - DNA, 25 bp, Rattus norvegicus
cagatcggcttgcatacgtcgtact

SEQ ID NO: 229307 - DNA, 25 bp, Rattus norvegicus
cagatcggcttggatacgtcgtact

SEQ ID NO: 229308 - DNA, 25 bp, Rattus norvegicus
cagatcgtctcaatgcttctcaggg

SEQ ID NO: 229309 - DNA, 25 bp, Rattus norvegicus
cagatcgtctcattgcttctcaggg

SEQ ID NO: 229310 - DNA, 25 bp, Rattus norvegicus
cagatcgttgtgctttgttagggac

SEQ ID NO: 229311 - DNA, 25 bp, Rattus norvegicus
cagatcgttgtggtttgttagggac

SEQ ID NO: 229312 - DNA, 25 bp, Rattus norvegicus
cagatctaaatgatggctctcacca

SEQ ID NO: 229313 - DNA, 25 bp, Rattus norvegicus
cagatctaaatgttggctctcacca

SEQ ID NO: 229314 - DNA, 25 bp, Rattus norvegicus
cagatctatctacctcttctatgag

SEQ ID NO: 229315 - DNA, 25 bp, Rattus norvegicus
cagatctatctagctcttctatgag

SEQ ID NO: 229316 - DNA, 25 bp, Rattus norvegicus
cagatctattgtagtgagcccttca

SEQ ID NO: 229317 - DNA, 25 bp, Rattus norvegicus
cagatctattgttgtgagcccttca

SEQ ID NO: 229318 - DNA, 25 bp, Rattus norvegicus
cagatctcagtcacactaggtggga

SEQ ID NO: 229319 - DNA, 25 bp, Rattus norvegicus
cagatctcagtctcactaggtggga

SEQ ID NO: 229320 - DNA, 25 bp, Rattus norvegicus
cagatctctcaactgtggcctggat

SEQ ID NO: 229321 - DNA, 25 bp, Rattus norvegicus
cagatctctcaagtgtggcctggat

SEQ ID NO: 229322 - DNA, 25 bp, Rattus norvegicus
cagatctctgagcaaccctgccaag

SEQ ID NO: 229323 - DNA, 25 bp, Rattus norvegicus
cagatctctgaggaaccctgccaag

SEQ ID NO: 229324 - DNA, 25 bp, Rattus norvegicus
cagatctcttgtctgtaaatgcttc

SEQ ID NO: 229325 - DNA, 25 bp, Rattus norvegicus
cagatctcttgtgtgtaaatgcttc

SEQ ID NO: 229326 - DNA, 25 bp, Rattus norvegicus
cagatctgaaatcggctccttgtca

SEQ ID NO: 229327 - DNA, 25 bp, Rattus norvegicus
cagatctgaaatgggctccttgtca

SEQ ID NO: 229328 - DNA, 25 bp, Rattus norvegicus
cagatctgcagcatcttagctttta

SEQ ID NO: 229329 - DNA, 25 bp, Rattus norvegicus
cagatctgcagcttcttagctttta

SEQ ID NO: 229330 - DNA, 25 bp, Rattus norvegicus
cagatctgcttcacagctcggtgat

SEQ ID NO: 229331 - DNA, 25 bp, Rattus norvegicus
cagatctgcttctcagctcggtgat

SEQ ID NO: 229332 - DNA, 25 bp, Rattus norvegicus
cagatctggaggagcttgtggccct

SEQ ID NO: 229333 - DNA, 25 bp, Rattus norvegicus
cagatctggaggtgcttgtggccct

SEQ ID NO: 229334 - DNA, 25 bp, Rattus norvegicus
cagatctggcccagtggctagaaga

SEQ ID NO: 229335 - DNA, 25 bp, Rattus norvegicus
cagatctggccctgtggctagaaga

SEQ ID NO: 229336 - DNA, 25 bp, Rattus norvegicus
cagatctggccgctggatcagcagt

SEQ ID NO: 229337 - DNA, 25 bp, Rattus norvegicus
cagatctggccggtggatcagcagt

SEQ ID NO: 229338 - DNA, 25 bp, Rattus norvegicus
cagatcttacttctttgacaacccc

SEQ ID NO: 229339 - DNA, 25 bp, Rattus norvegicus
cagatcttacttgtttgacaacccc

SEQ ID NO: 229340 - DNA, 25 bp, Rattus norvegicus
cagatcttattcattggccttgaaa

SEQ ID NO: 229341 - DNA, 25 bp, Rattus norvegicus
cagatcttattctttggccttgaaa

SEQ ID NO: 229342 - DNA, 25 bp, Rattus norvegicus
cagatcttcaggagtcttccatgaa

SEQ ID NO: 229343 - DNA, 25 bp, Rattus norvegicus
cagatcttcaggtgtcttccatgaa

SEQ ID NO: 229344 - DNA, 25 bp, Rattus norvegicus
cagatcttctgacctattccaagac

SEQ ID NO: 229345 - DNA, 25 bp, Rattus norvegicus
cagatcttctgagctattccaagac

SEQ ID NO: 229346 - DNA, 25 bp, Rattus norvegicus
cagatcttctgtctcattcgataca

SEQ ID NO: 229347 - DNA, 25 bp, Rattus norvegicus
cagatcttctgtgtcattcgataca

SEQ ID NO: 229348 - DNA, 25 bp, Rattus norvegicus
cagatcttcttaaaggacggtacat

SEQ ID NO: 229349 - DNA, 25 bp, Rattus norvegicus
cagatcttcttataggacggtacat

SEQ ID NO: 229350 - DNA, 25 bp, Rattus norvegicus
cagatcttggatccctgggtttatc

SEQ ID NO: 229351 - DNA, 25 bp, Rattus norvegicus
cagatcttggatgcctgggtttatc

SEQ ID NO: 229352 - DNA, 25 bp, Rattus norvegicus
cagatcttgtctaaccccaatggaa

SEQ ID NO: 229353 - DNA, 25 bp, Rattus norvegicus
cagatcttgtcttaccccaatggaa

SEQ ID NO: 229354 - DNA, 25 bp, Rattus norvegicus
cagatcttttgtctttttctcctct

SEQ ID NO: 229355 - DNA, 25 bp, Rattus norvegicus
cagatcttttgtgtttttctcctct

SEQ ID NO: 229356 - DNA, 25 bp, Rattus norvegicus
cagatgaaacaaaaccaccactgta

SEQ ID NO: 229357 - DNA, 25 bp, Rattus norvegicus
cagatgaaacaataccaccactgta

SEQ ID NO: 229358 - DNA, 25 bp, Rattus norvegicus
cagatgaagctgaacccctagaggt

SEQ ID NO: 229359 - DNA, 25 bp, Rattus norvegicus
cagatgaagctgtacccctagaggt

SEQ ID NO: 229360 - DNA, 25 bp, Rattus norvegicus
cagatgaaggcacttgctgtggtac

SEQ ID NO: 229361 - DNA, 25 bp, Rattus norvegicus
cagatgaaggcagttgctgtggtac

SEQ ID NO: 229362 - DNA, 25 bp, Rattus norvegicus
cagatgacacccatgctggaactgt

SEQ ID NO: 229363 - DNA, 25 bp, Rattus norvegicus
cagatgacacccttgctggaactgt

SEQ ID NO: 229364 - DNA, 25 bp, Rattus norvegicus
cagatgacacctcctgttttgtagt

SEQ ID NO: 229365 - DNA, 25 bp, Rattus norvegicus
cagatgacacctgctgttttgtagt

SEQ ID NO: 229366 - DNA, 25 bp, Rattus norvegicus
cagatgacatcacacaacggcaggg

SEQ ID NO: 229367 - DNA, 25 bp, Rattus norvegicus
cagatgacatcagacaacggcaggg

SEQ ID NO: 229368 - DNA, 25 bp, Rattus norvegicus
cagatgagccctcgccagagggacc

SEQ ID NO: 229369 - DNA, 25 bp, Rattus norvegicus
cagatgagccctggccagagggacc

SEQ ID NO: 229370 - DNA, 25 bp, Rattus norvegicus
cagatgaggcggacctggaagacct

SEQ ID NO: 229371 - DNA, 25 bp, Rattus norvegicus
cagatgaggcggtcctggaagacct

SEQ ID NO: 229372 - DNA, 25 bp, Rattus norvegicus
cagatgatccagcagattcagcaga

SEQ ID NO: 229373 - DNA, 25 bp, Rattus norvegicus
cagatgatccaggagattcagcaga

SEQ ID NO: 229374 - DNA, 25 bp, Rattus norvegicus
cagatgcaccatctcaggtcgggaa

SEQ ID NO: 229375 - DNA, 25 bp, Rattus norvegicus
cagatgcaccatgtcaggtcgggaa

SEQ ID NO: 229376 - DNA, 25 bp, Rattus norvegicus
cagatgcaccccaactgtctgtttt

SEQ ID NO: 229377 - DNA, 25 bp, Rattus norvegicus
cagatgcacccctactgtctgtttt

SEQ ID NO: 229378 - DNA, 25 bp, Rattus norvegicus
cagatgcagcccactgagtgatcat

SEQ ID NO: 229379 - DNA, 25 bp, Rattus norvegicus
cagatgcagccctctgagtgatcat

SEQ ID NO: 229380 - DNA, 25 bp, Rattus norvegicus
cagatgcagggaccggcgccaccta

SEQ ID NO: 229381 - DNA, 25 bp, Rattus norvegicus
cagatgcagggagcggcgccaccta

SEQ ID NO: 229382 - DNA, 25 bp, Rattus norvegicus
cagatgcatgaacaagggaagccac

SEQ ID NO: 229383 - DNA, 25 bp, Rattus norvegicus
cagatgcatgaagaagggaagccac

SEQ ID NO: 229384 - DNA, 25 bp, Rattus norvegicus
cagatgcatggcacacggtgaatga

SEQ ID NO: 229385 - DNA, 25 bp, Rattus norvegicus
cagatgcatggctcacggtgaatga

SEQ ID NO: 229386 - DNA, 25 bp, Rattus norvegicus
cagatgccagccctaagtgggtgct

SEQ ID NO: 229387 - DNA, 25 bp, Rattus norvegicus
cagatgccagccgtaagtgggtgct

SEQ ID NO: 229388 - DNA, 25 bp, Rattus norvegicus
cagatgcctctcatccggaagaaga

SEQ ID NO: 229389 - DNA, 25 bp, Rattus norvegicus
cagatgcctctcttccggaagaaga

SEQ ID NO: 229390 - DNA, 25 bp, Rattus norvegicus
cagatgcctcttcggatccagaacc

SEQ ID NO: 229391 - DNA, 25 bp, Rattus norvegicus
cagatgcctcttgggatccagaacc

SEQ ID NO: 229392 - DNA, 25 bp, Rattus norvegicus
cagatgcggtgacctcccattggaa

SEQ ID NO: 229393 - DNA, 25 bp, Rattus norvegicus
cagatgcggtgagctcccattggaa

SEQ ID NO: 229394 - DNA, 25 bp, Rattus norvegicus
cagatgctccgacgatcttcaagga

SEQ ID NO: 229395 - DNA, 25 bp, Rattus norvegicus
cagatgctccgaggatcttcaagga

SEQ ID NO: 229396 - DNA, 25 bp, Rattus norvegicus
cagatgctcctaaagtggccacaat

SEQ ID NO: 229397 - DNA, 25 bp, Rattus norvegicus
cagatgctcctatagtggccacaat

SEQ ID NO: 229398 - DNA, 25 bp, Rattus norvegicus
cagatgctcctgctgtgtgacaggt

SEQ ID NO: 229399 - DNA, 25 bp, Rattus norvegicus
cagatgctcctggtgtgtgacaggt

SEQ ID NO: 229400 - DNA, 25 bp, Rattus norvegicus
cagatgctgattcgctagagtcttc

SEQ ID NO: 229401 - DNA, 25 bp, Rattus norvegicus
cagatgctgattggctagagtcttc

SEQ ID NO: 229402 - DNA, 25 bp, Rattus norvegicus
cagatgctgcagagacttcggctat

SEQ ID NO: 229403 - DNA, 25 bp, Rattus norvegicus
cagatgctgcagtgacttcggctat

SEQ ID NO: 229404 - DNA, 25 bp, Rattus norvegicus
cagatgctgccccagacctattctt

SEQ ID NO: 229405 - DNA, 25 bp, Rattus norvegicus
cagatgctgcccgagacctattctt

SEQ ID NO: 229406 - DNA, 25 bp, Rattus norvegicus
cagatgctggcgatgcaccagatca

SEQ ID NO: 229407 - DNA, 25 bp, Rattus norvegicus
cagatgctggcgttgcaccagatca

SEQ ID NO: 229408 - DNA, 25 bp, Rattus norvegicus
cagatgcttatcatttgtacacacc

SEQ ID NO: 229409 - DNA, 25 bp, Rattus norvegicus
cagatgcttatcttttgtacacacc

SEQ ID NO: 229410 - DNA, 25 bp, Rattus norvegicus
cagatggacagaacagcactgagca

SEQ ID NO: 229411 - DNA, 25 bp, Rattus norvegicus
cagatggacagatcagcactgagca

SEQ ID NO: 229412 - DNA, 25 bp, Rattus norvegicus
cagatggacctaccttgggatttta

SEQ ID NO: 229413 - DNA, 25 bp, Rattus norvegicus
cagatggacctagcttgggatttta

SEQ ID NO: 229414 - DNA, 25 bp, Rattus norvegicus
cagatggacctgctggtgtttcgtt

SEQ ID NO: 229415 - DNA, 25 bp, Rattus norvegicus
cagatggacctggtggtgtttcgtt

SEQ ID NO: 229416 - DNA, 25 bp, Rattus norvegicus
cagatggacgggagcccttccccta

SEQ ID NO: 229417 - DNA, 25 bp, Rattus norvegicus
cagatggacgggtgcccttccccta

SEQ ID NO: 229418 - DNA, 25 bp, Rattus norvegicus
cagatggagcatccctgactggtcc

SEQ ID NO: 229419 - DNA, 25 bp, Rattus norvegicus
cagatggagcatgcctgactggtcc

SEQ ID NO: 229420 - DNA, 25 bp, Rattus norvegicus
cagatggagggcatgccgctgtatt

SEQ ID NO: 229421 - DNA, 25 bp, Rattus norvegicus
cagatggagggcttgccgctgtatt

SEQ ID NO: 229422 - DNA, 25 bp, Rattus norvegicus
cagatggcacaaatgtccgagtaca

SEQ ID NO: 229423 - DNA, 25 bp, Rattus norvegicus
cagatggcacaattgtccgagtaca

SEQ ID NO: 229424 - DNA, 25 bp, Rattus norvegicus
cagatggcagccagtcagttgtgga

SEQ ID NO: 229425 - DNA, 25 bp, Rattus norvegicus
cagatggcagcctgtcagttgtgga

SEQ ID NO: 229426 - DNA, 25 bp, Rattus norvegicus
cagatggcaggacaacttgttggac

SEQ ID NO: 229427 - DNA, 25 bp, Rattus norvegicus
cagatggcaggagaacttgttggac

SEQ ID NO: 229428 - DNA, 25 bp, Rattus norvegicus
cagatggccccacatgcaaagttct

SEQ ID NO: 229429 - DNA, 25 bp, Rattus norvegicus
cagatggccccagatgcaaagttct

SEQ ID NO: 229430 - DNA, 25 bp, Rattus norvegicus
cagatggcctctcggacatgctgga

SEQ ID NO: 229431 - DNA, 25 bp, Rattus norvegicus
cagatggcctctgggacatgctgga

SEQ ID NO: 229432 - DNA, 25 bp, Rattus norvegicus
cagatggcctgacagatgactccca

SEQ ID NO: 229433 - DNA, 25 bp, Rattus norvegicus
cagatggcctgagagatgactccca

SEQ ID NO: 229434 - DNA, 25 bp, Rattus norvegicus
cagatggctatgagctcgaaggcaa

SEQ ID NO: 229435 - DNA, 25 bp, Rattus norvegicus
cagatggctatgtgctcgaaggcaa

SEQ ID NO: 229436 - DNA, 25 bp, Rattus norvegicus
cagatggctggacaggtaacactgt

SEQ ID NO: 229437 - DNA, 25 bp, Rattus norvegicus
cagatggctggagaggtaacactgt

SEQ ID NO: 229438 - DNA, 25 bp, Rattus norvegicus
cagatggcttaactgctaggcttta

SEQ ID NO: 229439 - DNA, 25 bp, Rattus norvegicus
cagatggcttaagtgctaggcttta

SEQ ID NO: 229440 - DNA, 25 bp, Rattus norvegicus
cagatgggagccatggcgtgtcccc

SEQ ID NO: 229441 - DNA, 25 bp, Rattus norvegicus
cagatgggagccttggcgtgtcccc

SEQ ID NO: 229442 - DNA, 25 bp, Rattus norvegicus
cagatgggcatcagtcgaccgagca

SEQ ID NO: 229443 - DNA, 25 bp, Rattus norvegicus
cagatgggcatctgtcgaccgagca

SEQ ID NO: 229444 - DNA, 25 bp, Rattus norvegicus
cagatggtcaagagcgggagcactt

SEQ ID NO: 229445 - DNA, 25 bp, Rattus norvegicus
cagatggtcaagtgcgggagcactt

SEQ ID NO: 229446 - DNA, 25 bp, Rattus norvegicus
cagatggtcccaattgtaaacccaa

SEQ ID NO: 229447 - DNA, 25 bp, Rattus norvegicus
cagatggtcccatttgtaaacccaa

SEQ ID NO: 229448 - DNA, 25 bp, Rattus norvegicus
cagatggtggctactggctgtccca

SEQ ID NO: 229449 - DNA, 25 bp, Rattus norvegicus
cagatggtggcttctggctgtccca

SEQ ID NO: 229450 - DNA, 25 bp, Rattus norvegicus
cagatggtgtctcggctgacctgcc

SEQ ID NO: 229451 - DNA, 25 bp, Rattus norvegicus
cagatggtgtctgggctgacctgcc

SEQ ID NO: 229452 - DNA, 25 bp, Rattus norvegicus
cagatggtgttaaagatttgagtgc

SEQ ID NO: 229453 - DNA, 25 bp, Rattus norvegicus
cagatggtgttatagatttgagtgc

SEQ ID NO: 229454 - DNA, 25 bp, Rattus norvegicus
cagatggttcttctggtgtctccta

SEQ ID NO: 229455 - DNA, 25 bp, Rattus norvegicus
cagatggttcttgtggtgtctccta

SEQ ID NO: 229456 - DNA, 25 bp, Rattus norvegicus
cagatgtacaccattaaattatgga

SEQ ID NO: 229457 - DNA, 25 bp, Rattus norvegicus
cagatgtacacctttaaattatgga

SEQ ID NO: 229458 - DNA, 25 bp, Rattus norvegicus
cagatgtatgatatcaagacccgat

SEQ ID NO: 229459 - DNA, 25 bp, Rattus norvegicus
cagatgtatgatttcaagacccgat

SEQ ID NO: 229460 - DNA, 25 bp, Rattus norvegicus
cagatgtattggagggacttctata

SEQ ID NO: 229461 - DNA, 25 bp, Rattus norvegicus
cagatgtattggtgggacttctata

SEQ ID NO: 229462 - DNA, 25 bp, Rattus norvegicus
cagatgtcagtgcaacagatcgcat

SEQ ID NO: 229463 - DNA, 25 bp, Rattus norvegicus
cagatgtcagtggaacagatcgcat

SEQ ID NO: 229464 - DNA, 25 bp, Rattus norvegicus
cagatgtccatcctcccgattttgc

SEQ ID NO: 229465 - DNA, 25 bp, Rattus norvegicus
cagatgtccatcgtcccgattttgc

SEQ ID NO: 229466 - DNA, 25 bp, Rattus norvegicus
cagatgtccgttagctgaggctagg

SEQ ID NO: 229467 - DNA, 25 bp, Rattus norvegicus
cagatgtccgtttgctgaggctagg

SEQ ID NO: 229468 - DNA, 25 bp, Rattus norvegicus
cagatgtcctgaacgatgctatatt

SEQ ID NO: 229469 - DNA, 25 bp, Rattus norvegicus
cagatgtcctgatcgatgctatatt

SEQ ID NO: 229470 - DNA, 25 bp, Rattus norvegicus
cagatgtctattccggagcttcaac

SEQ ID NO: 229471 - DNA, 25 bp, Rattus norvegicus
cagatgtctattgcggagcttcaac

SEQ ID NO: 229472 - DNA, 25 bp, Rattus norvegicus
cagatgtctccacgcccatatggga

SEQ ID NO: 229473 - DNA, 25 bp, Rattus norvegicus
cagatgtctccaggcccatatggga

SEQ ID NO: 229474 - DNA, 25 bp, Rattus norvegicus
cagatgtgcacacaaatcctaagtt

SEQ ID NO: 229475 - DNA, 25 bp, Rattus norvegicus
cagatgtgcacagaaatcctaagtt

SEQ ID NO: 229476 - DNA, 25 bp, Rattus norvegicus
cagatgtgccaaacggctttcacgt

SEQ ID NO: 229477 - DNA, 25 bp, Rattus norvegicus
cagatgtgccaatcggctttcacgt

SEQ ID NO: 229478 - DNA, 25 bp, Rattus norvegicus
cagatgtgctatacttatgtttcaa

SEQ ID NO: 229479 - DNA, 25 bp, Rattus norvegicus
cagatgtgctattcttatgtttcaa

SEQ ID NO: 229480 - DNA, 25 bp, Rattus norvegicus
cagatgtggactcctctagcgagtg

SEQ ID NO: 229481 - DNA, 25 bp, Rattus norvegicus
cagatgtggactgctctagcgagtg

SEQ ID NO: 229482 - DNA, 25 bp, Rattus norvegicus
cagatgtggagtctgtgtctgcccc

SEQ ID NO: 229483 - DNA, 25 bp, Rattus norvegicus
cagatgtggagtgtgtgtctgcccc

SEQ ID NO: 229484 - DNA, 25 bp, Rattus norvegicus
cagatgtggctgctggttactccta

SEQ ID NO: 229485 - DNA, 25 bp, Rattus norvegicus
cagatgtggctggtggttactccta

SEQ ID NO: 229486 - DNA, 25 bp, Rattus norvegicus
cagatgtgtattatgggctgaccca

SEQ ID NO: 229487 - DNA, 25 bp, Rattus norvegicus
cagatgtgtattttgggctgaccca

SEQ ID NO: 229488 - DNA, 25 bp, Rattus norvegicus
cagatgttacagatgctgctgcaga

SEQ ID NO: 229489 - DNA, 25 bp, Rattus norvegicus
cagatgttacagttgctgctgcaga

SEQ ID NO: 229490 - DNA, 25 bp, Rattus norvegicus
cagatgttagtgacctgctttcaca

SEQ ID NO: 229491 - DNA, 25 bp, Rattus norvegicus
cagatgttagtgtcctgctttcaca

SEQ ID NO: 229492 - DNA, 25 bp, Rattus norvegicus
cagatgttcagtagggaggccccga

SEQ ID NO: 229493 - DNA, 25 bp, Rattus norvegicus
cagatgttcagttgggaggccccga

SEQ ID NO: 229494 - DNA, 25 bp, Rattus norvegicus
cagatgttcatccagcttgtcaggg

SEQ ID NO: 229495 - DNA, 25 bp, Rattus norvegicus
cagatgttcatcgagcttgtcaggg

SEQ ID NO: 229496 - DNA, 25 bp, Rattus norvegicus
cagatgtttcttacagttgcttgct

SEQ ID NO: 229497 - DNA, 25 bp, Rattus norvegicus
cagatgtttctttcagttgcttgct

SEQ ID NO: 229498 - DNA, 25 bp, Rattus norvegicus
cagatgttttggacagcctgtgaaa

SEQ ID NO: 229499 - DNA, 25 bp, Rattus norvegicus
cagatgttttggtcagcctgtgaaa

SEQ ID NO: 229500 - DNA, 25 bp, Rattus norvegicus
cagattaaaacacttctgtggctgc

SEQ ID NO: 229501 - DNA, 25 bp, Rattus norvegicus
cagattaaaacagttctgtggctgc

SEQ ID NO: 229502 - DNA, 25 bp, Rattus norvegicus
cagattacaggtcgccagagtggaa

SEQ ID NO: 229503 - DNA, 25 bp, Rattus norvegicus
cagattacaggtggccagagtggaa

SEQ ID NO: 229504 - DNA, 25 bp, Rattus norvegicus
cagattacctgtcccaaagacattc

SEQ ID NO: 229505 - DNA, 25 bp, Rattus norvegicus
cagattacctgtgccaaagacattc

SEQ ID NO: 229506 - DNA, 25 bp, Rattus norvegicus
cagattatagttatcctttgggtcg

SEQ ID NO: 229507 - DNA, 25 bp, Rattus norvegicus
cagattatagttttcctttgggtcg

SEQ ID NO: 229508 - DNA, 25 bp, Rattus norvegicus
cagattatgctgcaaatgacgccat

SEQ ID NO: 229509 - DNA, 25 bp, Rattus norvegicus
cagattatgctggaaatgacgccat

SEQ ID NO: 229510 - DNA, 25 bp, Rattus norvegicus
cagattatggtcatttgattatcaa

SEQ ID NO: 229511 - DNA, 25 bp, Rattus norvegicus
cagattatggtcttttgattatcaa

SEQ ID NO: 229512 - DNA, 25 bp, Rattus norvegicus
cagattatgtaacacttgggctaaa

SEQ ID NO: 229513 - DNA, 25 bp, Rattus norvegicus
cagattatgtaagacttgggctaaa

SEQ ID NO: 229514 - DNA, 25 bp, Rattus norvegicus
cagattcaagtcagtgccgtgcaaa

SEQ ID NO: 229515 - DNA, 25 bp, Rattus norvegicus
cagattcaagtctgtgccgtgcaaa

SEQ ID NO: 229516 - DNA, 25 bp, Rattus norvegicus
cagattcacttcctgtggatttcaa

SEQ ID NO: 229517 - DNA, 25 bp, Rattus norvegicus
cagattcacttcgtgtggatttcaa

SEQ ID NO: 229518 - DNA, 25 bp, Rattus norvegicus
cagattcatttccagttaactgaca

SEQ ID NO: 229519 - DNA, 25 bp, Rattus norvegicus
cagattcatttcgagttaactgaca

SEQ ID NO: 229520 - DNA, 25 bp, Rattus norvegicus
cagattcattttaccttattaagtt

SEQ ID NO: 229521 - DNA, 25 bp, Rattus norvegicus
cagattcatttttccttattaagtt

SEQ ID NO: 229522 - DNA, 25 bp, Rattus norvegicus
cagattcccctcatgttactaataa

SEQ ID NO: 229523 - DNA, 25 bp, Rattus norvegicus
cagattcccctcttgttactaataa

SEQ ID NO: 229524 - DNA, 25 bp, Rattus norvegicus
cagattcctgacatgaactcctgac

SEQ ID NO: 229525 - DNA, 25 bp, Rattus norvegicus
cagattcctgacttgaactcctgac

SEQ ID NO: 229526 - DNA, 25 bp, Rattus norvegicus
cagattcctggtctttccccaagtt

SEQ ID NO: 229527 - DNA, 25 bp, Rattus norvegicus
cagattcctggtgtttccccaagtt

SEQ ID NO: 229528 - DNA, 25 bp, Rattus norvegicus
cagattctggaactcccgtcttttt

SEQ ID NO: 229529 - DNA, 25 bp, Rattus norvegicus
cagattctggaagtcccgtcttttt

SEQ ID NO: 229530 - DNA, 25 bp, Rattus norvegicus
cagattctgggcagttctggtgcag

SEQ ID NO: 229531 - DNA, 25 bp, Rattus norvegicus
cagattctgggctgttctggtgcag

SEQ ID NO: 229532 - DNA, 25 bp, Rattus norvegicus
cagattcttctacgaacagaccctt

SEQ ID NO: 229533 - DNA, 25 bp, Rattus norvegicus
cagattcttctaggaacagaccctt

SEQ ID NO: 229534 - DNA, 25 bp, Rattus norvegicus
cagattcttgggaacttttgaacca

SEQ ID NO: 229535 - DNA, 25 bp, Rattus norvegicus
cagattcttgggtacttttgaacca

SEQ ID NO: 229536 - DNA, 25 bp, Rattus norvegicus
cagattgcctttacttgggtggtaa

SEQ ID NO: 229537 - DNA, 25 bp, Rattus norvegicus
cagattgccttttcttgggtggtaa

SEQ ID NO: 229538 - DNA, 25 bp, Rattus norvegicus
cagattgctcctatactgctttaaa

SEQ ID NO: 229539 - DNA, 25 bp, Rattus norvegicus
cagattgctcctttactgctttaaa

SEQ ID NO: 229540 - DNA, 25 bp, Rattus norvegicus
cagattgctcttatcagtgacgttc

SEQ ID NO: 229541 - DNA, 25 bp, Rattus norvegicus
cagattgctcttttcagtgacgttc

SEQ ID NO: 229542 - DNA, 25 bp, Rattus norvegicus
cagattgctgttcttggagtcgtga

SEQ ID NO: 229543 - DNA, 25 bp, Rattus norvegicus
cagattgctgttgttggagtcgtga

SEQ ID NO: 229544 - DNA, 25 bp, Rattus norvegicus
cagattgcttgtactctaaaggagg

SEQ ID NO: 229545 - DNA, 25 bp, Rattus norvegicus
cagattgcttgttctctaaaggagg

SEQ ID NO: 229546 - DNA, 25 bp, Rattus norvegicus
cagattgtatctacagactccaggg

SEQ ID NO: 229547 - DNA, 25 bp, Rattus norvegicus
cagattgtatctcttagtccctagc

SEQ ID NO: 229548 - DNA, 25 bp, Rattus norvegicus
cagattgtatctgttagtccctagc

SEQ ID NO: 229549 - DNA, 25 bp, Rattus norvegicus
cagattgtatcttcagactccaggg

SEQ ID NO: 229550 - DNA, 25 bp, Rattus norvegicus
cagattgtgcccattgtgacgtaat

SEQ ID NO: 229551 - DNA, 25 bp, Rattus norvegicus
cagattgtgccctttgtgacgtaat

SEQ ID NO: 229552 - DNA, 25 bp, Rattus norvegicus
cagattgtggtacctcagcgaggcc

SEQ ID NO: 229553 - DNA, 25 bp, Rattus norvegicus
cagattgtggtagctcagcgaggcc

SEQ ID NO: 229554 - DNA, 25 bp, Rattus norvegicus
cagatttaagccctgtgtttactat

SEQ ID NO: 229555 - DNA, 25 bp, Rattus norvegicus
cagatttaagccgtgtgtttactat

SEQ ID NO: 229556 - DNA, 25 bp, Rattus norvegicus
cagatttaggccatacatgtatgta

SEQ ID NO: 229557 - DNA, 25 bp, Rattus norvegicus
cagatttaggccttacatgtatgta

SEQ ID NO: 229558 - DNA, 25 bp, Rattus norvegicus
cagatttcctgtctgatgtgttaag

SEQ ID NO: 229559 - DNA, 25 bp, Rattus norvegicus
cagatttcctgtgtgatgtgttaag

SEQ ID NO: 229560 - DNA, 25 bp, Rattus norvegicus
cagatttcgagaacttttggcagaa

SEQ ID NO: 229561 - DNA, 25 bp, Rattus norvegicus
cagatttcgagatcttttggcagaa

SEQ ID NO: 229562 - DNA, 25 bp, Rattus norvegicus
cagatttctaacagctggtcagagc

SEQ ID NO: 229563 - DNA, 25 bp, Rattus norvegicus
cagatttctaactgctggtcagagc

SEQ ID NO: 229564 - DNA, 25 bp, Rattus norvegicus
cagatttctatgcaggcaaaccact

SEQ ID NO: 229565 - DNA, 25 bp, Rattus norvegicus
cagatttctatggaggcaaaccact

SEQ ID NO: 229566 - DNA, 25 bp, Rattus norvegicus
cagatttcttctaacattccttcag

SEQ ID NO: 229567 - DNA, 25 bp, Rattus norvegicus
cagatttcttcttacattccttcag

SEQ ID NO: 229568 - DNA, 25 bp, Rattus norvegicus
cagatttgcctacaaaatacctttc

SEQ ID NO: 229569 - DNA, 25 bp, Rattus norvegicus
cagatttgcctagaaaatacctttc

SEQ ID NO: 229570 - DNA, 25 bp, Rattus norvegicus
cagatttgccttatacccgatattt

SEQ ID NO: 229571 - DNA, 25 bp, Rattus norvegicus
cagatttgccttttacccgatattt

SEQ ID NO: 229572 - DNA, 25 bp, Rattus norvegicus
cagatttgtctgataccggctttga

SEQ ID NO: 229573 - DNA, 25 bp, Rattus norvegicus
cagatttgtctgttaccggctttga

SEQ ID NO: 229574 - DNA, 25 bp, Rattus norvegicus
cagatttgttcaatgcactaaagga

SEQ ID NO: 229575 - DNA, 25 bp, Rattus norvegicus
cagatttgttcattgcactaaagga

SEQ ID NO: 229576 - DNA, 25 bp, Rattus norvegicus
cagattttacatatttgcagaccaa

SEQ ID NO: 229577 - DNA, 25 bp, Rattus norvegicus
cagattttacatttttgcagaccaa

SEQ ID NO: 229578 - DNA, 25 bp, Rattus norvegicus
cagattttcactagacctttggtcc

SEQ ID NO: 229579 - DNA, 25 bp, Rattus norvegicus
cagattttcacttgacctttggtcc

SEQ ID NO: 229580 - DNA, 25 bp, Rattus norvegicus
cagattttgctgagaccgggagcat

SEQ ID NO: 229581 - DNA, 25 bp, Rattus norvegicus
cagattttgctgctcattgtttatg

SEQ ID NO: 229582 - DNA, 25 bp, Rattus norvegicus
cagattttgctggtcattgtttatg

SEQ ID NO: 229583 - DNA, 25 bp, Rattus norvegicus
cagattttgctgtgaccgggagcat

SEQ ID NO: 229584 - DNA, 25 bp, Rattus norvegicus
cagattttggaaaagtgtgtgtgcc

SEQ ID NO: 229585 - DNA, 25 bp, Rattus norvegicus
cagattttggaatagtgtgtgtgcc

SEQ ID NO: 229586 - DNA, 25 bp, Rattus norvegicus
cagattttggtgcagttgcttaaga

SEQ ID NO: 229587 - DNA, 25 bp, Rattus norvegicus
cagattttggtggagttgcttaaga

SEQ ID NO: 229588 - DNA, 25 bp, Rattus norvegicus
cagatttttaccaggctgcctttta

SEQ ID NO: 229589 - DNA, 25 bp, Rattus norvegicus
cagatttttaccaggtggtttcaca

SEQ ID NO: 229590 - DNA, 25 bp, Rattus norvegicus
cagatttttacctggctgcctttta

SEQ ID NO: 229591 - DNA, 25 bp, Rattus norvegicus
cagatttttacctggtggtttcaca

SEQ ID NO: 229592 - DNA, 25 bp, Rattus norvegicus
cagatttttctgagtaagccctaaa

SEQ ID NO: 229593 - DNA, 25 bp, Rattus norvegicus
cagatttttctgtgtaagccctaaa

SEQ ID NO: 229594 - DNA, 25 bp, Rattus norvegicus
cagatttttcttccagggtggtttt

SEQ ID NO: 229595 - DNA, 25 bp, Rattus norvegicus
cagatttttcttgcagggtggtttt

SEQ ID NO: 229596 - DNA, 25 bp, Rattus norvegicus
cagatttttgacaaacctgacaaaa

SEQ ID NO: 229597 - DNA, 25 bp, Rattus norvegicus
cagatttttgactaacctgacaaaa

SEQ ID NO: 229598 - DNA, 25 bp, Rattus norvegicus
cagatttttgcacatcggtgggcct

SEQ ID NO: 229599 - DNA, 25 bp, Rattus norvegicus
cagatttttgcagatcggtgggcct

SEQ ID NO: 229600 - DNA, 25 bp, Rattus norvegicus
cagcaaaaatccaagctagcccttt

SEQ ID NO: 229601 - DNA, 25 bp, Rattus norvegicus
cagcaaaaatcctagctagcccttt

SEQ ID NO: 229602 - DNA, 25 bp, Rattus norvegicus
cagcaaaacttgacctgggccatga

SEQ ID NO: 229603 - DNA, 25 bp, Rattus norvegicus
cagcaaaacttgtcctgggccatga

SEQ ID NO: 229604 - DNA, 25 bp, Rattus norvegicus
cagcaaaagtataaatgggcttctt

SEQ ID NO: 229605 - DNA, 25 bp, Rattus norvegicus
cagcaaaagtattaatgggcttctt

SEQ ID NO: 229606 - DNA, 25 bp, Rattus norvegicus
cagcaaaatatgcaggatggaaatt

SEQ ID NO: 229607 - DNA, 25 bp, Rattus norvegicus
cagcaaaatatggaggatggaaatt

SEQ ID NO: 229608 - DNA, 25 bp, Rattus norvegicus
cagcaaaccgctcacttccagatag

SEQ ID NO: 229609 - DNA, 25 bp, Rattus norvegicus
cagcaaaccgctgacttccagatag

SEQ ID NO: 229610 - DNA, 25 bp, Rattus norvegicus
cagcaaacctgcacatcagatctta

SEQ ID NO: 229611 - DNA, 25 bp, Rattus norvegicus
cagcaaacctgctcatcagatctta

SEQ ID NO: 229612 - DNA, 25 bp, Rattus norvegicus
cagcaaagagaccacagattagttt

SEQ ID NO: 229613 - DNA, 25 bp, Rattus norvegicus
cagcaaagagacgacagattagttt

SEQ ID NO: 229614 - DNA, 25 bp, Rattus norvegicus
cagcaaagccaacagctccgggcgt

SEQ ID NO: 229615 - DNA, 25 bp, Rattus norvegicus
cagcaaagccaagagctccgggcgt

SEQ ID NO: 229616 - DNA, 25 bp, Rattus norvegicus
cagcaaagctgacgttactgtttaa

SEQ ID NO: 229617 - DNA, 25 bp, Rattus norvegicus
cagcaaagctgaggttactgtttaa

SEQ ID NO: 229618 - DNA, 25 bp, Rattus norvegicus
cagcaaagggcacgtgcatgtgact

SEQ ID NO: 229619 - DNA, 25 bp, Rattus norvegicus
cagcaaagggcaggtgcatgtgact

SEQ ID NO: 229620 - DNA, 25 bp, Rattus norvegicus
cagcaaagggttacattggcatcaa

SEQ ID NO: 229621 - DNA, 25 bp, Rattus norvegicus
cagcaaagggtttcattggcatcaa

SEQ ID NO: 229622 - DNA, 25 bp, Rattus norvegicus
cagcaaattctcagtctaatagttg

SEQ ID NO: 229623 - DNA, 25 bp, Rattus norvegicus
cagcaaattctctgtctaatagttg

SEQ ID NO: 229624 - DNA, 25 bp, Rattus norvegicus
cagcaacactttctaggcacaccag

SEQ ID NO: 229625 - DNA, 25 bp, Rattus norvegicus
cagcaacactttgtaggcacaccag

SEQ ID NO: 229626 - DNA, 25 bp, Rattus norvegicus
cagcaacagaatatccttggcggat

SEQ ID NO: 229627 - DNA, 25 bp, Rattus norvegicus
cagcaacagaatttccttggcggat

SEQ ID NO: 229628 - DNA, 25 bp, Rattus norvegicus
cagcaacagactcctgtttcagcct

SEQ ID NO: 229629 - DNA, 25 bp, Rattus norvegicus
cagcaacagactgctgtttcagcct

SEQ ID NO: 229630 - DNA, 25 bp, Rattus norvegicus
cagcaacagagaagacccgtggagt

SEQ ID NO: 229631 - DNA, 25 bp, Rattus norvegicus
cagcaacagagatgacccgtggagt

SEQ ID NO: 229632 - DNA, 25 bp, Rattus norvegicus
cagcaacattagaaagtacacttta

SEQ ID NO: 229633 - DNA, 25 bp, Rattus norvegicus
cagcaacattagtaagtacacttta

SEQ ID NO: 229634 - DNA, 25 bp, Rattus norvegicus
cagcaacattcaccccaatggaatt

SEQ ID NO: 229635 - DNA, 25 bp, Rattus norvegicus
cagcaacattcagcccaatggaatt

SEQ ID NO: 229636 - DNA, 25 bp, Rattus norvegicus
cagcaactacagaggcttccattgt

SEQ ID NO: 229637 - DNA, 25 bp, Rattus norvegicus
cagcaactacagtggcttccattgt

SEQ ID NO: 229638 - DNA, 25 bp, Rattus norvegicus
cagcaactcttcaactcttttaatg

SEQ ID NO: 229639 - DNA, 25 bp, Rattus norvegicus
cagcaactcttctactcttttaatg

SEQ ID NO: 229640 - DNA, 25 bp, Rattus norvegicus
cagcaactgtgtcggtgcagctagc

SEQ ID NO: 229641 - DNA, 25 bp, Rattus norvegicus
cagcaactgtgtgggtgcagctagc

SEQ ID NO: 229642 - DNA, 25 bp, Rattus norvegicus
cagcaacttaatacctttgtccctt

SEQ ID NO: 229643 - DNA, 25 bp, Rattus norvegicus
cagcaacttaattcctttgtccctt

SEQ ID NO: 229644 - DNA, 25 bp, Rattus norvegicus
cagcaagaaattaggcttcacagtt

SEQ ID NO: 229645 - DNA, 25 bp, Rattus norvegicus
cagcaagaaatttggcttcacagtt

SEQ ID NO: 229646 - DNA, 25 bp, Rattus norvegicus
cagcaagacgtaaagggaccttcct

SEQ ID NO: 229647 - DNA, 25 bp, Rattus norvegicus
cagcaagacgtatagggaccttcct

SEQ ID NO: 229648 - DNA, 25 bp, Rattus norvegicus
cagcaagaggacagacaagggcaga

SEQ ID NO: 229649 - DNA, 25 bp, Rattus norvegicus
cagcaagaggactgacaagggcaga

SEQ ID NO: 229650 - DNA, 25 bp, Rattus norvegicus
cagcaagatctacattttaaatcac

SEQ ID NO: 229651 - DNA, 25 bp, Rattus norvegicus
cagcaagatctagattttaaatcac

SEQ ID NO: 229652 - DNA, 25 bp, Rattus norvegicus
cagcaagcaggtactgaagccacag

SEQ ID NO: 229653 - DNA, 25 bp, Rattus norvegicus
cagcaagcaggttctgaagccacag

SEQ ID NO: 229654 - DNA, 25 bp, Rattus norvegicus
cagcaagcgagacccagcatcctgg

SEQ ID NO: 229655 - DNA, 25 bp, Rattus norvegicus
cagcaagcgagagccagcatcctgg

SEQ ID NO: 229656 - DNA, 25 bp, Rattus norvegicus
cagcaagctattctttgtccccaaa

SEQ ID NO: 229657 - DNA, 25 bp, Rattus norvegicus
cagcaagctattgtttgtccccaaa

SEQ ID NO: 229658 - DNA, 25 bp, Rattus norvegicus
cagcaagctggcacggcaagggcaa

SEQ ID NO: 229659 - DNA, 25 bp, Rattus norvegicus
cagcaagctggcagcggccaaagct

SEQ ID NO: 229660 - DNA, 25 bp, Rattus norvegicus
cagcaagctggctcggcaagggcaa

SEQ ID NO: 229661 - DNA, 25 bp, Rattus norvegicus
cagcaagctggctgcggccaaagct

SEQ ID NO: 229662 - DNA, 25 bp, Rattus norvegicus
cagcaaggaggtctctgactaaccc

SEQ ID NO: 229663 - DNA, 25 bp, Rattus norvegicus
cagcaaggaggtgtctgactaaccc

SEQ ID NO: 229664 - DNA, 25 bp, Rattus norvegicus
cagcaaggttaacggcatcgcggtt

SEQ ID NO: 229665 - DNA, 25 bp, Rattus norvegicus
cagcaaggttaagggcatcgcggtt

SEQ ID NO: 229666 - DNA, 25 bp, Rattus norvegicus
cagcaaggttggaccttcgtaacaa

SEQ ID NO: 229667 - DNA, 25 bp, Rattus norvegicus
cagcaaggttggtccttcgtaacaa

SEQ ID NO: 229668 - DNA, 25 bp, Rattus norvegicus
cagcaagtacagaacagagccagag

SEQ ID NO: 229669 - DNA, 25 bp, Rattus norvegicus
cagcaagtacagtacagagccagag

SEQ ID NO: 229670 - DNA, 25 bp, Rattus norvegicus
cagcaagtattgacagtgccagcca

SEQ ID NO: 229671 - DNA, 25 bp, Rattus norvegicus
cagcaagtattgtcagtgccagcca

SEQ ID NO: 229672 - DNA, 25 bp, Rattus norvegicus
cagcaagtggtgcagcctctggcac

SEQ ID NO: 229673 - DNA, 25 bp, Rattus norvegicus
cagcaagtggtggagcctctggcac

SEQ ID NO: 229674 - DNA, 25 bp, Rattus norvegicus
cagcaagttcagagacacacacaag

SEQ ID NO: 229675 - DNA, 25 bp, Rattus norvegicus
cagcaagttcagtgacacacacaag

SEQ ID NO: 229676 - DNA, 25 bp, Rattus norvegicus
cagcaagttcttcgatgaccctatg

SEQ ID NO: 229677 - DNA, 25 bp, Rattus norvegicus
cagcaagttcttggatgaccctatg

SEQ ID NO: 229678 - DNA, 25 bp, Rattus norvegicus
cagcaataatgtccccagcgccggg

SEQ ID NO: 229679 - DNA, 25 bp, Rattus norvegicus
cagcaataatgtgcccagcgccggg

SEQ ID NO: 229680 - DNA, 25 bp, Rattus norvegicus
cagcaatccatgactgtcaatgtaa

SEQ ID NO: 229681 - DNA, 25 bp, Rattus norvegicus
cagcaatccatgtctgtcaatgtaa

SEQ ID NO: 229682 - DNA, 25 bp, Rattus norvegicus
cagcaatcgcagaggcctgggcccg

SEQ ID NO: 229683 - DNA, 25 bp, Rattus norvegicus
cagcaatcgcagtggcctgggcccg

SEQ ID NO: 229684 - DNA, 25 bp, Rattus norvegicus
cagcaatgagagctctgccagttcc

SEQ ID NO: 229685 - DNA, 25 bp, Rattus norvegicus
cagcaatgagaggtctgccagttcc

SEQ ID NO: 229686 - DNA, 25 bp, Rattus norvegicus
cagcaatgcactatggtttcctatt

SEQ ID NO: 229687 - DNA, 25 bp, Rattus norvegicus
cagcaatgcactttggtttcctatt

SEQ ID NO: 229688 - DNA, 25 bp, Rattus norvegicus
cagcaatgctctcggtggacacaaa

SEQ ID NO: 229689 - DNA, 25 bp, Rattus norvegicus
cagcaatgctctgggtggacacaaa

SEQ ID NO: 229690 - DNA, 25 bp, Rattus norvegicus
cagcaatggaaaccctaaccaagaa

SEQ ID NO: 229691 - DNA, 25 bp, Rattus norvegicus
cagcaatggaaagcctaaccaagaa

SEQ ID NO: 229692 - DNA, 25 bp, Rattus norvegicus
cagcaatggctgctcagttcagaag

SEQ ID NO: 229693 - DNA, 25 bp, Rattus norvegicus
cagcaatggctggtcagttcagaag

SEQ ID NO: 229694 - DNA, 25 bp, Rattus norvegicus
cagcaatgggtgaccttcctgactc

SEQ ID NO: 229695 - DNA, 25 bp, Rattus norvegicus
cagcaatgggtgtccttcctgactc

SEQ ID NO: 229696 - DNA, 25 bp, Rattus norvegicus
cagcaatgttggataccgttgtatt

SEQ ID NO: 229697 - DNA, 25 bp, Rattus norvegicus
cagcaatgttggttaccgttgtatt

SEQ ID NO: 229698 - DNA, 25 bp, Rattus norvegicus
cagcacaagggtcggatccttcctt

SEQ ID NO: 229699 - DNA, 25 bp, Rattus norvegicus
cagcacaagggtgggatccttcctt

SEQ ID NO: 229700 - DNA, 25 bp, Rattus norvegicus
cagcacacagctatctggaggagtg

SEQ ID NO: 229701 - DNA, 25 bp, Rattus norvegicus
cagcacacagctttctggaggagtg

SEQ ID NO: 229702 - DNA, 25 bp, Rattus norvegicus
cagcacaccacactcacagattttg

SEQ ID NO: 229703 - DNA, 25 bp, Rattus norvegicus
cagcacaccacagtcacagattttg

SEQ ID NO: 229704 - DNA, 25 bp, Rattus norvegicus
cagcacacctgcattagacgctaat

SEQ ID NO: 229705 - DNA, 25 bp, Rattus norvegicus
cagcacacctgctttagacgctaat

SEQ ID NO: 229706 - DNA, 25 bp, Rattus norvegicus
cagcacacgcttagtctgcagttag

SEQ ID NO: 229707 - DNA, 25 bp, Rattus norvegicus
cagcacacgctttgtctgcagttag

SEQ ID NO: 229708 - DNA, 25 bp, Rattus norvegicus
cagcacactgtgaaactggctcagt

SEQ ID NO: 229709 - DNA, 25 bp, Rattus norvegicus
cagcacactgtgtaactggctcagt

SEQ ID NO: 229710 - DNA, 25 bp, Rattus norvegicus
cagcacagagctcggatcctcaact

SEQ ID NO: 229711 - DNA, 25 bp, Rattus norvegicus
cagcacagagctgggatcctcaact

SEQ ID NO: 229712 - DNA, 25 bp, Rattus norvegicus
cagcacagccccattgaatagacaa

SEQ ID NO: 229713 - DNA, 25 bp, Rattus norvegicus
cagcacagcccctttgaatagacaa

SEQ ID NO: 229714 - DNA, 25 bp, Rattus norvegicus
cagcacagcctcctaacattaaaga

SEQ ID NO: 229715 - DNA, 25 bp, Rattus norvegicus
cagcacagcctcgtaacattaaaga

SEQ ID NO: 229716 - DNA, 25 bp, Rattus norvegicus
cagcacagcctgaatgcggaccaaa

SEQ ID NO: 229717 - DNA, 25 bp, Rattus norvegicus
cagcacagcctgtatgcggaccaaa

SEQ ID NO: 229718 - DNA, 25 bp, Rattus norvegicus
cagcacagccttagagctcttggaa

SEQ ID NO: 229719 - DNA, 25 bp, Rattus norvegicus
cagcacagcctttgagctcttggaa

SEQ ID NO: 229720 - DNA, 25 bp, Rattus norvegicus
cagcacagctgtcaccggagaggat

SEQ ID NO: 229721 - DNA, 25 bp, Rattus norvegicus
cagcacagctgtgaccggagaggat

SEQ ID NO: 229722 - DNA, 25 bp, Rattus norvegicus
cagcacaggctgaccgtaagcagta

SEQ ID NO: 229723 - DNA, 25 bp, Rattus norvegicus
cagcacaggctgtccgtaagcagta

SEQ ID NO: 229724 - DNA, 25 bp, Rattus norvegicus
cagcacagtagcatttatcaattta

SEQ ID NO: 229725 - DNA, 25 bp, Rattus norvegicus
cagcacagtagcttttatcaattta

SEQ ID NO: 229726 - DNA, 25 bp, Rattus norvegicus
cagcacagtctcattctgagcagaa

SEQ ID NO: 229727 - DNA, 25 bp, Rattus norvegicus
cagcacagtctccataatgaacatt

SEQ ID NO: 229728 - DNA, 25 bp, Rattus norvegicus
cagcacagtctcgataatgaacatt

SEQ ID NO: 229729 - DNA, 25 bp, Rattus norvegicus
cagcacagtctctttctgagcagaa

SEQ ID NO: 229730 - DNA, 25 bp, Rattus norvegicus
cagcacagtctgcagatgtctctaa

SEQ ID NO: 229731 - DNA, 25 bp, Rattus norvegicus
cagcacagtctggagatgtctctaa

SEQ ID NO: 229732 - DNA, 25 bp, Rattus norvegicus
cagcacagtggcaagggtgttctca

SEQ ID NO: 229733 - DNA, 25 bp, Rattus norvegicus
cagcacagtggctagggtgttctca

SEQ ID NO: 229734 - DNA, 25 bp, Rattus norvegicus
cagcacagtgtgagggagacttctg

SEQ ID NO: 229735 - DNA, 25 bp, Rattus norvegicus
cagcacagtgtgtgggagacttctg

SEQ ID NO: 229736 - DNA, 25 bp, Rattus norvegicus
cagcacatagagaagttttcccaca

SEQ ID NO: 229737 - DNA, 25 bp, Rattus norvegicus
cagcacatagagtagttttcccaca

SEQ ID NO: 229738 - DNA, 25 bp, Rattus norvegicus
cagcacatcctactttggcattatt

SEQ ID NO: 229739 - DNA, 25 bp, Rattus norvegicus
cagcacatcctagtttggcattatt

SEQ ID NO: 229740 - DNA, 25 bp, Rattus norvegicus
cagcaccactgcaatgagcgcatag

SEQ ID NO: 229741 - DNA, 25 bp, Rattus norvegicus
cagcaccactgctatgagcgcatag

SEQ ID NO: 229742 - DNA, 25 bp, Rattus norvegicus
cagcaccactggacctcaaagagga

SEQ ID NO: 229743 - DNA, 25 bp, Rattus norvegicus
cagcaccactggtcctcaaagagga

SEQ ID NO: 229744 - DNA, 25 bp, Rattus norvegicus
cagcaccagcacagggagtggcaga

SEQ ID NO: 229745 - DNA, 25 bp, Rattus norvegicus
cagcaccagcactgggagtggcaga

SEQ ID NO: 229746 - DNA, 25 bp, Rattus norvegicus
cagcaccagcatacacataggcata

SEQ ID NO: 229747 - DNA, 25 bp, Rattus norvegicus
cagcaccagcattcacataggcata

SEQ ID NO: 229748 - DNA, 25 bp, Rattus norvegicus
cagcaccagcttcggcaactgattg

SEQ ID NO: 229749 - DNA, 25 bp, Rattus norvegicus
cagcaccagcttgggcaactgattg

SEQ ID NO: 229750 - DNA, 25 bp, Rattus norvegicus
cagcaccaggtcatgagctgacggg

SEQ ID NO: 229751 - DNA, 25 bp, Rattus norvegicus
cagcaccaggtcttgagctgacggg

SEQ ID NO: 229752 - DNA, 25 bp, Rattus norvegicus
cagcacccagggactggctaggata

SEQ ID NO: 229753 - DNA, 25 bp, Rattus norvegicus
cagcacccagggtctggctaggata

SEQ ID NO: 229754 - DNA, 25 bp, Rattus norvegicus
cagcacccctgactcagagctgtga

SEQ ID NO: 229755 - DNA, 25 bp, Rattus norvegicus
cagcacccctgagtcagagctgtga

SEQ ID NO: 229756 - DNA, 25 bp, Rattus norvegicus
cagcacccgaggctctcaaaaatgg

SEQ ID NO: 229757 - DNA, 25 bp, Rattus norvegicus
cagcacccgagggtctcaaaaatgg

SEQ ID NO: 229758 - DNA, 25 bp, Rattus norvegicus
cagcaccctgatcctcatgggaaat

SEQ ID NO: 229759 - DNA, 25 bp, Rattus norvegicus
cagcaccctgatgctcatgggaaat

SEQ ID NO: 229760 - DNA, 25 bp, Rattus norvegicus
cagcaccctggtatgtaaatagcaa

SEQ ID NO: 229761 - DNA, 25 bp, Rattus norvegicus
cagcaccctggtttgtaaatagcaa

SEQ ID NO: 229762 - DNA, 25 bp, Rattus norvegicus
cagcaccgcacacgtacgaggcggt

SEQ ID NO: 229763 - DNA, 25 bp, Rattus norvegicus
cagcaccgcacaggtacgaggcggt

SEQ ID NO: 229764 - DNA, 25 bp, Rattus norvegicus
cagcaccgttaaacccttgccgagg

SEQ ID NO: 229765 - DNA, 25 bp, Rattus norvegicus
cagcaccgttaatcccttgccgagg

SEQ ID NO: 229766 - DNA, 25 bp, Rattus norvegicus
cagcacctatgtaggagaattttca

SEQ ID NO: 229767 - DNA, 25 bp, Rattus norvegicus
cagcacctatgttggagaattttca

SEQ ID NO: 229768 - DNA, 25 bp, Rattus norvegicus
cagcacctgtggagcatagccctct

SEQ ID NO: 229769 - DNA, 25 bp, Rattus norvegicus
cagcacctgtggtgcatagccctct

SEQ ID NO: 229770 - DNA, 25 bp, Rattus norvegicus
cagcaccttcatagggttgaccata

SEQ ID NO: 229771 - DNA, 25 bp, Rattus norvegicus
cagcaccttcattgggttgaccata

SEQ ID NO: 229772 - DNA, 25 bp, Rattus norvegicus
cagcaccttcctcgtggcttagtta

SEQ ID NO: 229773 - DNA, 25 bp, Rattus norvegicus
cagcaccttcctggtggcttagtta

SEQ ID NO: 229774 - DNA, 25 bp, Rattus norvegicus
cagcaccttcttcatttccatgaag

SEQ ID NO: 229775 - DNA, 25 bp, Rattus norvegicus
cagcaccttcttgatttccatgaag

SEQ ID NO: 229776 - DNA, 25 bp, Rattus norvegicus
cagcaccttgctagaagatgacttt

SEQ ID NO: 229777 - DNA, 25 bp, Rattus norvegicus
cagcaccttgcttgaagatgacttt

SEQ ID NO: 229778 - DNA, 25 bp, Rattus norvegicus
cagcacctttcacggaagcctttga

SEQ ID NO: 229779 - DNA, 25 bp, Rattus norvegicus
cagcacctttcagggaagcctttga

SEQ ID NO: 229780 - DNA, 25 bp, Rattus norvegicus
cagcacctttgcatttgttgatgca

SEQ ID NO: 229781 - DNA, 25 bp, Rattus norvegicus
cagcacctttgcttttgttgatgca

SEQ ID NO: 229782 - DNA, 25 bp, Rattus norvegicus
cagcacctttggacctggaacaaaa

SEQ ID NO: 229783 - DNA, 25 bp, Rattus norvegicus
cagcacctttggtcctggaacaaaa

SEQ ID NO: 229784 - DNA, 25 bp, Rattus norvegicus
cagcacgaagacacagaagacgata

SEQ ID NO: 229785 - DNA, 25 bp, Rattus norvegicus
cagcacgaagactcagaagacgata

SEQ ID NO: 229786 - DNA, 25 bp, Rattus norvegicus
cagcacgagatgacccaggataata

SEQ ID NO: 229787 - DNA, 25 bp, Rattus norvegicus
cagcacgagatgtcccaggataata

SEQ ID NO: 229788 - DNA, 25 bp, Rattus norvegicus
cagcacgagcagaaacttcatggta

SEQ ID NO: 229789 - DNA, 25 bp, Rattus norvegicus
cagcacgagcagtaacttcatggta

SEQ ID NO: 229790 - DNA, 25 bp, Rattus norvegicus
cagcacgagctgatcggtttgcgat

SEQ ID NO: 229791 - DNA, 25 bp, Rattus norvegicus
cagcacgagctgttcggtttgcgat

SEQ ID NO: 229792 - DNA, 25 bp, Rattus norvegicus
cagcacgctctgcagcatgaagcaa

SEQ ID NO: 229793 - DNA, 25 bp, Rattus norvegicus
cagcacgctctggagcatgaagcaa

SEQ ID NO: 229794 - DNA, 25 bp, Rattus norvegicus
cagcacgctgcgcaacttgttcaag

SEQ ID NO: 229795 - DNA, 25 bp, Rattus norvegicus
cagcacgctgcggaacttgttcaag

SEQ ID NO: 229796 - DNA, 25 bp, Rattus norvegicus
cagcacgctgggattgtggcatctg

SEQ ID NO: 229797 - DNA, 25 bp, Rattus norvegicus
cagcacgctgggtttgtggcatctg

SEQ ID NO: 229798 - DNA, 25 bp, Rattus norvegicus
cagcacggtctccacaataatattc

SEQ ID NO: 229799 - DNA, 25 bp, Rattus norvegicus
cagcacggtctcgacaataatattc

SEQ ID NO: 229800 - DNA, 25 bp, Rattus norvegicus
cagcacgtggcaatgttacagttat

SEQ ID NO: 229801 - DNA, 25 bp, Rattus norvegicus
cagcacgtggcattgttacagttat

SEQ ID NO: 229802 - DNA, 25 bp, Rattus norvegicus
cagcacgttgctctcgattaagacc

SEQ ID NO: 229803 - DNA, 25 bp, Rattus norvegicus
cagcacgttgctgtcgattaagacc

SEQ ID NO: 229804 - DNA, 25 bp, Rattus norvegicus
cagcactagggacgcggatctctga

SEQ ID NO: 229805 - DNA, 25 bp, Rattus norvegicus
cagcactagggaggcggatctctga

SEQ ID NO: 229806 - DNA, 25 bp, Rattus norvegicus
cagcactcaagaagccaaggtaggt

SEQ ID NO: 229807 - DNA, 25 bp, Rattus norvegicus
cagcactcaagatgccaaggtaggt

SEQ ID NO: 229808 - DNA, 25 bp, Rattus norvegicus
cagcactcccgtcaagcttgaagga

SEQ ID NO: 229809 - DNA, 25 bp, Rattus norvegicus
cagcactcccgtgaagcttgaagga

SEQ ID NO: 229810 - DNA, 25 bp, Rattus norvegicus
cagcactcgagacagctggtggaca

SEQ ID NO: 229811 - DNA, 25 bp, Rattus norvegicus
cagcactcgagagagctggtggaca

SEQ ID NO: 229812 - DNA, 25 bp, Rattus norvegicus
cagcactgactgaaaggcatgttta

SEQ ID NO: 229813 - DNA, 25 bp, Rattus norvegicus
cagcactgactgctctaccaagagt

SEQ ID NO: 229814 - DNA, 25 bp, Rattus norvegicus
cagcactgactggtctaccaagagt

SEQ ID NO: 229815 - DNA, 25 bp, Rattus norvegicus
cagcactgactgtaaggcatgttta

SEQ ID NO: 229816 - DNA, 25 bp, Rattus norvegicus
cagcactgattgataatttcctcgt

SEQ ID NO: 229817 - DNA, 25 bp, Rattus norvegicus
cagcactgattgttaatttcctcgt

SEQ ID NO: 229818 - DNA, 25 bp, Rattus norvegicus
cagcactgcagccatcagccaaagg

SEQ ID NO: 229819 - DNA, 25 bp, Rattus norvegicus
cagcactgcagcgatcagccaaagg

SEQ ID NO: 229820 - DNA, 25 bp, Rattus norvegicus
cagcactgcaggcaggtcactgact

SEQ ID NO: 229821 - DNA, 25 bp, Rattus norvegicus
cagcactgcagggaggtcactgact

SEQ ID NO: 229822 - DNA, 25 bp, Rattus norvegicus
cagcactgcatgacactggtgtggt

SEQ ID NO: 229823 - DNA, 25 bp, Rattus norvegicus
cagcactgcatgtcactggtgtggt

SEQ ID NO: 229824 - DNA, 25 bp, Rattus norvegicus
cagcactgctgactccatggagtag

SEQ ID NO: 229825 - DNA, 25 bp, Rattus norvegicus
cagcactgctgagtccatggagtag

SEQ ID NO: 229826 - DNA, 25 bp, Rattus norvegicus
cagcactggacaaatcatggaaaca

SEQ ID NO: 229827 - DNA, 25 bp, Rattus norvegicus
cagcactggacatatcatggaaaca

SEQ ID NO: 229828 - DNA, 25 bp, Rattus norvegicus
cagcactgggcactgctcagggaca

SEQ ID NO: 229829 - DNA, 25 bp, Rattus norvegicus
cagcactgggcagtgctcagggaca

SEQ ID NO: 229830 - DNA, 25 bp, Rattus norvegicus
cagcactggtacaggtgtcgggaac

SEQ ID NO: 229831 - DNA, 25 bp, Rattus norvegicus
cagcactggtactggtgtcgggaac

SEQ ID NO: 229832 - DNA, 25 bp, Rattus norvegicus
cagcactgtattacctgacaagccc

SEQ ID NO: 229833 - DNA, 25 bp, Rattus norvegicus
cagcactgtatttcctgacaagccc

SEQ ID NO: 229834 - DNA, 25 bp, Rattus norvegicus
cagcacttagctctctactggtaag

SEQ ID NO: 229835 - DNA, 25 bp, Rattus norvegicus
cagcacttagctgtctactggtaag

SEQ ID NO: 229836 - DNA, 25 bp, Rattus norvegicus
cagcacttattcaggactgcatttt

SEQ ID NO: 229837 - DNA, 25 bp, Rattus norvegicus
cagcacttattctggactgcatttt

SEQ ID NO: 229838 - DNA, 25 bp, Rattus norvegicus
cagcacttcctgacgtgaggtgttc

SEQ ID NO: 229839 - DNA, 25 bp, Rattus norvegicus
cagcacttcctgtcgtgaggtgttc

SEQ ID NO: 229840 - DNA, 25 bp, Rattus norvegicus
cagcacttgctcattttggatgatg

SEQ ID NO: 229841 - DNA, 25 bp, Rattus norvegicus
cagcacttgctctttttggatgatg

SEQ ID NO: 229842 - DNA, 25 bp, Rattus norvegicus
cagcacttggatcgactagcatagt

SEQ ID NO: 229843 - DNA, 25 bp, Rattus norvegicus
cagcacttggatggactagcatagt

SEQ ID NO: 229844 - DNA, 25 bp, Rattus norvegicus
cagcacttgggacgacagatcagga

SEQ ID NO: 229845 - DNA, 25 bp, Rattus norvegicus
cagcacttgggaggacagatcagga

SEQ ID NO: 229846 - DNA, 25 bp, Rattus norvegicus
cagcactttctcacaggtatctata

SEQ ID NO: 229847 - DNA, 25 bp, Rattus norvegicus
cagcactttctctcaggtatctata

SEQ ID NO: 229848 - DNA, 25 bp, Rattus norvegicus
cagcactttgtgatctatgaaccag

SEQ ID NO: 229849 - DNA, 25 bp, Rattus norvegicus
cagcactttgtgttctatgaaccag

SEQ ID NO: 229850 - DNA, 25 bp, Rattus norvegicus
cagcagaaactccaacatgacacag

SEQ ID NO: 229851 - DNA, 25 bp, Rattus norvegicus
cagcagaaactcgaacatgacacag

SEQ ID NO: 229852 - DNA, 25 bp, Rattus norvegicus
cagcagaagagacctggcttggcct

SEQ ID NO: 229853 - DNA, 25 bp, Rattus norvegicus
cagcagaagagagctggcttggcct

SEQ ID NO: 229854 - DNA, 25 bp, Rattus norvegicus
cagcagaagcggaatgtaccagtga

SEQ ID NO: 229855 - DNA, 25 bp, Rattus norvegicus
cagcagaagcggtatgtaccagtga

SEQ ID NO: 229856 - DNA, 25 bp, Rattus norvegicus
cagcagaagctgcagttcgatcact

SEQ ID NO: 229857 - DNA, 25 bp, Rattus norvegicus
cagcagaagctggagttcgatcact

SEQ ID NO: 229858 - DNA, 25 bp, Rattus norvegicus
cagcagaaggtcagtgtcagcaaca

SEQ ID NO: 229859 - DNA, 25 bp, Rattus norvegicus
cagcagaaggtctgtgtcagcaaca

SEQ ID NO: 229860 - DNA, 25 bp, Rattus norvegicus
cagcagaattatccggcttccggtt

SEQ ID NO: 229861 - DNA, 25 bp, Rattus norvegicus
cagcagaattatgcggcttccggtt

SEQ ID NO: 229862 - DNA, 25 bp, Rattus norvegicus
cagcagacactcaacgcagaagcga

SEQ ID NO: 229863 - DNA, 25 bp, Rattus norvegicus
cagcagacactctacgcagaagcga

SEQ ID NO: 229864 - DNA, 25 bp, Rattus norvegicus
cagcagaccaggaacctgagtggag

SEQ ID NO: 229865 - DNA, 25 bp, Rattus norvegicus
cagcagaccaggtacctgagtggag

SEQ ID NO: 229866 - DNA, 25 bp, Rattus norvegicus
cagcagaccccaatgtcaatgtggc

SEQ ID NO: 229867 - DNA, 25 bp, Rattus norvegicus
cagcagaccccacatgtacatgaca

SEQ ID NO: 229868 - DNA, 25 bp, Rattus norvegicus
cagcagaccccagatgtacatgaca

SEQ ID NO: 229869 - DNA, 25 bp, Rattus norvegicus
cagcagaccccattgtcaatgtggc

SEQ ID NO: 229870 - DNA, 25 bp, Rattus norvegicus
cagcagacttgcctccaatggagtg

SEQ ID NO: 229871 - DNA, 25 bp, Rattus norvegicus
cagcagacttgcgtccaatggagtg

SEQ ID NO: 229872 - DNA, 25 bp, Rattus norvegicus
cagcagagactcatgaaggttcctg

SEQ ID NO: 229873 - DNA, 25 bp, Rattus norvegicus
cagcagagactcttgaaggttcctg

SEQ ID NO: 229874 - DNA, 25 bp, Rattus norvegicus
cagcagagggcaaacaggacagaac

SEQ ID NO: 229875 - DNA, 25 bp, Rattus norvegicus
cagcagagggcatacaggacagaac

SEQ ID NO: 229876 - DNA, 25 bp, Rattus norvegicus
cagcagataaaacaactcgccacca

SEQ ID NO: 229877 - DNA, 25 bp, Rattus norvegicus
cagcagataaaagaactcgccacca

SEQ ID NO: 229878 - DNA, 25 bp, Rattus norvegicus
cagcagatctacacggatggttccg

SEQ ID NO: 229879 - DNA, 25 bp, Rattus norvegicus
cagcagatctactcggatggttccg

SEQ ID NO: 229880 - DNA, 25 bp, Rattus norvegicus
cagcagatggctcagaaagatttgg

SEQ ID NO: 229881 - DNA, 25 bp, Rattus norvegicus
cagcagatggctgagaaagatttgg

SEQ ID NO: 229882 - DNA, 25 bp, Rattus norvegicus
cagcagatgggaccacctggacttg

SEQ ID NO: 229883 - DNA, 25 bp, Rattus norvegicus
cagcagatgggagcacctggacttg

SEQ ID NO: 229884 - DNA, 25 bp, Rattus norvegicus
cagcagatgggcaggtttggacctc

SEQ ID NO: 229885 - DNA, 25 bp, Rattus norvegicus
cagcagatgggctggtttggacctc

SEQ ID NO: 229886 - DNA, 25 bp, Rattus norvegicus
cagcagattggaaggagacacagat

SEQ ID NO: 229887 - DNA, 25 bp, Rattus norvegicus
cagcagattggatggagacacagat

SEQ ID NO: 229888 - DNA, 25 bp, Rattus norvegicus
cagcagcaccatcagcaggaggaca

SEQ ID NO: 229889 - DNA, 25 bp, Rattus norvegicus
cagcagcaccatgagcaggaggaca

SEQ ID NO: 229890 - DNA, 25 bp, Rattus norvegicus
cagcagcaccttcacagttgtttaa

SEQ ID NO: 229891 - DNA, 25 bp, Rattus norvegicus
cagcagcaccttgacagttgtttaa

SEQ ID NO: 229892 - DNA, 25 bp, Rattus norvegicus
cagcagcagcatccagagcaggaag

SEQ ID NO: 229893 - DNA, 25 bp, Rattus norvegicus
cagcagcagcatgcagagcaggaag

SEQ ID NO: 229894 - DNA, 25 bp, Rattus norvegicus
cagcagcagcccatggtagcaccag

SEQ ID NO: 229895 - DNA, 25 bp, Rattus norvegicus
cagcagcagcccttggtagcaccag

SEQ ID NO: 229896 - DNA, 25 bp, Rattus norvegicus
cagcagcagctgatgagactctacg

SEQ ID NO: 229897 - DNA, 25 bp, Rattus norvegicus
cagcagcagctgttgagactctacg

SEQ ID NO: 229898 - DNA, 25 bp, Rattus norvegicus
cagcagcaggacacttagcagcagt

SEQ ID NO: 229899 - DNA, 25 bp, Rattus norvegicus
cagcagcaggactcttagcagcagt

SEQ ID NO: 229900 - DNA, 25 bp, Rattus norvegicus
cagcagcaggctcgttaccgagtac

SEQ ID NO: 229901 - DNA, 25 bp, Rattus norvegicus
cagcagcaggctggttaccgagtac

SEQ ID NO: 229902 - DNA, 25 bp, Rattus norvegicus
cagcagcaggttcgttgactcgtga

SEQ ID NO: 229903 - DNA, 25 bp, Rattus norvegicus
cagcagcaggttggttgactcgtga

SEQ ID NO: 229904 - DNA, 25 bp, Rattus norvegicus
cagcagcagtctctactcaagtaca

SEQ ID NO: 229905 - DNA, 25 bp, Rattus norvegicus
cagcagcagtctgtactcaagtaca

SEQ ID NO: 229906 - DNA, 25 bp, Rattus norvegicus
cagcagcagtgacctctttatctgg

SEQ ID NO: 229907 - DNA, 25 bp, Rattus norvegicus
cagcagcagtgagctctttatctgg

SEQ ID NO: 229908 - DNA, 25 bp, Rattus norvegicus
cagcagcagtggcatacttcaaaag

SEQ ID NO: 229909 - DNA, 25 bp, Rattus norvegicus
cagcagcagtgggatacttcaaaag

SEQ ID NO: 229910 - DNA, 25 bp, Rattus norvegicus
cagcagcagtttactttattccttc

SEQ ID NO: 229911 - DNA, 25 bp, Rattus norvegicus
cagcagcagttttctttattccttc

SEQ ID NO: 229912 - DNA, 25 bp, Rattus norvegicus
cagcagcatagcatcttgacagaaa

SEQ ID NO: 229913 - DNA, 25 bp, Rattus norvegicus
cagcagcatagcttcttgacagaaa

SEQ ID NO: 229914 - DNA, 25 bp, Rattus norvegicus
cagcagcatttcagtgatggcccac

SEQ ID NO: 229915 - DNA, 25 bp, Rattus norvegicus
cagcagcatttctgtgatggcccac

SEQ ID NO: 229916 - DNA, 25 bp, Rattus norvegicus
cagcagccaggaccacttgttgctg

SEQ ID NO: 229917 - DNA, 25 bp, Rattus norvegicus
cagcagccaggagcacttgttgctg

SEQ ID NO: 229918 - DNA, 25 bp, Rattus norvegicus
cagcagccgcgcatgatggcgtaga

SEQ ID NO: 229919 - DNA, 25 bp, Rattus norvegicus
cagcagccgcgcttgatggcgtaga

SEQ ID NO: 229920 - DNA, 25 bp, Rattus norvegicus
cagcagccgctgaactcaggatggt

SEQ ID NO: 229921 - DNA, 25 bp, Rattus norvegicus
cagcagccgctgacatgtaaatgga

SEQ ID NO: 229922 - DNA, 25 bp, Rattus norvegicus
cagcagccgctgtactcaggatggt

SEQ ID NO: 229923 - DNA, 25 bp, Rattus norvegicus
cagcagccgctgtcatgtaaatgga

SEQ ID NO: 229924 - DNA, 25 bp, Rattus norvegicus
cagcagcctagtaggggacgcagaa

SEQ ID NO: 229925 - DNA, 25 bp, Rattus norvegicus
cagcagcctagttggggacgcagaa

SEQ ID NO: 229926 - DNA, 25 bp, Rattus norvegicus
cagcagcctcgcaagggccgcgagc

SEQ ID NO: 229927 - DNA, 25 bp, Rattus norvegicus
cagcagcctcgctagggccgcgagc

SEQ ID NO: 229928 - DNA, 25 bp, Rattus norvegicus
cagcagcctcttactggagaacaca

SEQ ID NO: 229929 - DNA, 25 bp, Rattus norvegicus
cagcagcctctttctggagaacaca

SEQ ID NO: 229930 - DNA, 25 bp, Rattus norvegicus
cagcagcctgcacctggattacgca

SEQ ID NO: 229931 - DNA, 25 bp, Rattus norvegicus
cagcagcctgcagctggattacgca

SEQ ID NO: 229932 - DNA, 25 bp, Rattus norvegicus
cagcagcctgtccagcgggagcagc

SEQ ID NO: 229933 - DNA, 25 bp, Rattus norvegicus
cagcagcctgtcgagcgggagcagc

SEQ ID NO: 229934 - DNA, 25 bp, Rattus norvegicus
cagcagcgagtaaggttggacaccg

SEQ ID NO: 229935 - DNA, 25 bp, Rattus norvegicus
cagcagcgagtaagttgtccgaaat

SEQ ID NO: 229936 - DNA, 25 bp, Rattus norvegicus
cagcagcgagtatggttggacaccg

SEQ ID NO: 229937 - DNA, 25 bp, Rattus norvegicus
cagcagcgagtatgttgtccgaaat

SEQ ID NO: 229938 - DNA, 25 bp, Rattus norvegicus
cagcagcgccaccatggcgcggaaa

SEQ ID NO: 229939 - DNA, 25 bp, Rattus norvegicus
cagcagcgccacgatggcgcggaaa

SEQ ID NO: 229940 - DNA, 25 bp, Rattus norvegicus
cagcagcggcttatggaccagtggc

SEQ ID NO: 229941 - DNA, 25 bp, Rattus norvegicus
cagcagcggcttttggaccagtggc

SEQ ID NO: 229942 - DNA, 25 bp, Rattus norvegicus
cagcagcgggtcagtcacccggagc

SEQ ID NO: 229943 - DNA, 25 bp, Rattus norvegicus
cagcagcgggtctgtcacccggagc

SEQ ID NO: 229944 - DNA, 25 bp, Rattus norvegicus
cagcagcggtcaactggccagagaa

SEQ ID NO: 229945 - DNA, 25 bp, Rattus norvegicus
cagcagcggtcatctggccagagaa

SEQ ID NO: 229946 - DNA, 25 bp, Rattus norvegicus
cagcagcggtgaagtccaggtgaca

SEQ ID NO: 229947 - DNA, 25 bp, Rattus norvegicus
cagcagcggtgatgtccaggtgaca

SEQ ID NO: 229948 - DNA, 25 bp, Rattus norvegicus
cagcagctacaacagttgcgattct

SEQ ID NO: 229949 - DNA, 25 bp, Rattus norvegicus
cagcagctacaagagttgcgattct

SEQ ID NO: 229950 - DNA, 25 bp, Rattus norvegicus
cagcagctatcacactcaagtctta

SEQ ID NO: 229951 - DNA, 25 bp, Rattus norvegicus
cagcagctatcagactcaagtctta

SEQ ID NO: 229952 - DNA, 25 bp, Rattus norvegicus
cagcagctcattctcttgactaggg

SEQ ID NO: 229953 - DNA, 25 bp, Rattus norvegicus
cagcagctcattgtcttgactaggg

SEQ ID NO: 229954 - DNA, 25 bp, Rattus norvegicus
cagcagctccgaagaagagggtgca

SEQ ID NO: 229955 - DNA, 25 bp, Rattus norvegicus
cagcagctccgatgaagagggtgca

SEQ ID NO: 229956 - DNA, 25 bp, Rattus norvegicus
cagcagctgagtaggtcgatggaca

SEQ ID NO: 229957 - DNA, 25 bp, Rattus norvegicus
cagcagctgagttggtcgatggaca

SEQ ID NO: 229958 - DNA, 25 bp, Rattus norvegicus
cagcagctgattcgctcgcggagtc

SEQ ID NO: 229959 - DNA, 25 bp, Rattus norvegicus
cagcagctgattggctcgcggagtc

SEQ ID NO: 229960 - DNA, 25 bp, Rattus norvegicus
cagcagctgcaccaggaatttcaaa

SEQ ID NO: 229961 - DNA, 25 bp, Rattus norvegicus
cagcagctgcacgaggaatttcaaa

SEQ ID NO: 229962 - DNA, 25 bp, Rattus norvegicus
cagcagctgcatacaaggaccgagt

SEQ ID NO: 229963 - DNA, 25 bp, Rattus norvegicus
cagcagctgcattcaaggaccgagt

SEQ ID NO: 229964 - DNA, 25 bp, Rattus norvegicus
cagcagctgctgcaacaggccaaga

SEQ ID NO: 229965 - DNA, 25 bp, Rattus norvegicus
cagcagctgctggaacaggccaaga

SEQ ID NO: 229966 - DNA, 25 bp, Rattus norvegicus
cagcagctgtgaatggaggccgcct

SEQ ID NO: 229967 - DNA, 25 bp, Rattus norvegicus
cagcagctgtgattggaggccgcct

SEQ ID NO: 229968 - DNA, 25 bp, Rattus norvegicus
cagcagctgtgtacactgaggccta

SEQ ID NO: 229969 - DNA, 25 bp, Rattus norvegicus
cagcagctgtgttcactgaggccta

SEQ ID NO: 229970 - DNA, 25 bp, Rattus norvegicus
cagcagctgttccagtctgaatggg

SEQ ID NO: 229971 - DNA, 25 bp, Rattus norvegicus
cagcagctgttcgagtctgaatggg

SEQ ID NO: 229972 - DNA, 25 bp, Rattus norvegicus
cagcagcttatgctgttgcctgtag

SEQ ID NO: 229973 - DNA, 25 bp, Rattus norvegicus
cagcagcttatggtgttgcctgtag

SEQ ID NO: 229974 - DNA, 25 bp, Rattus norvegicus
cagcagcttcaaatctgggtagaca

SEQ ID NO: 229975 - DNA, 25 bp, Rattus norvegicus
cagcagcttcaattctgggtagaca

SEQ ID NO: 229976 - DNA, 25 bp, Rattus norvegicus
cagcagcttcatatcgtcttcttca

SEQ ID NO: 229977 - DNA, 25 bp, Rattus norvegicus
cagcagcttcatttcgtcttcttca

SEQ ID NO: 229978 - DNA, 25 bp, Rattus norvegicus
cagcagcttctgcagagaggcatga

SEQ ID NO: 229979 - DNA, 25 bp, Rattus norvegicus
cagcagcttctggagagaggcatga

SEQ ID NO: 229980 - DNA, 25 bp, Rattus norvegicus
cagcagcttgttagtgttgacgcca

SEQ ID NO: 229981 - DNA, 25 bp, Rattus norvegicus
cagcagcttgtttgtgttgacgcca

SEQ ID NO: 229982 - DNA, 25 bp, Rattus norvegicus
cagcagctttgaaggtcccagttca

SEQ ID NO: 229983 - DNA, 25 bp, Rattus norvegicus
cagcagctttgatggtcccagttca

SEQ ID NO: 229984 - DNA, 25 bp, Rattus norvegicus
cagcagctttttacaacgttccaaa

SEQ ID NO: 229985 - DNA, 25 bp, Rattus norvegicus
cagcagctttttctggtccttaaca

SEQ ID NO: 229986 - DNA, 25 bp, Rattus norvegicus
cagcagctttttgtggtccttaaca

SEQ ID NO: 229987 - DNA, 25 bp, Rattus norvegicus
cagcagcttttttcaacgttccaaa

SEQ ID NO: 229988 - DNA, 25 bp, Rattus norvegicus
cagcaggacaaccagaacttcttta

SEQ ID NO: 229989 - DNA, 25 bp, Rattus norvegicus
cagcaggacaacgagaacttcttta

SEQ ID NO: 229990 - DNA, 25 bp, Rattus norvegicus
cagcaggactgccacaagttcaagg

SEQ ID NO: 229991 - DNA, 25 bp, Rattus norvegicus
cagcaggactgcgacaagttcaagg

SEQ ID NO: 229992 - DNA, 25 bp, Rattus norvegicus
cagcaggaggacatgttttggaaac

SEQ ID NO: 229993 - DNA, 25 bp, Rattus norvegicus
cagcaggaggacttgttttggaaac

SEQ ID NO: 229994 - DNA, 25 bp, Rattus norvegicus
cagcaggagtcccagtgcagagtcc

SEQ ID NO: 229995 - DNA, 25 bp, Rattus norvegicus
cagcaggagtccgagtgcagagtcc

SEQ ID NO: 229996 - DNA, 25 bp, Rattus norvegicus
cagcaggatcgaagtgtaacacatt

SEQ ID NO: 229997 - DNA, 25 bp, Rattus norvegicus
cagcaggatcgatgtgtaacacatt

SEQ ID NO: 229998 - DNA, 25 bp, Rattus norvegicus
cagcaggcagatctttagtgcgaaa

SEQ ID NO: 229999 - DNA, 25 bp, Rattus norvegicus
cagcaggcagatgtttagtgcgaaa

SEQ ID NO: 230000 - DNA, 25 bp, Rattus norvegicus
cagcaggcagcacttcgacgaagaa

SEQ ID NO: 230001 - DNA, 25 bp, Rattus norvegicus
cagcaggcagcagttcgacgaagaa

SEQ ID NO: 230002 - DNA, 25 bp, Rattus norvegicus
cagcaggctcaaaggcagggacaat

SEQ ID NO: 230003 - DNA, 25 bp, Rattus norvegicus
cagcaggctcaatggcagggacaat

SEQ ID NO: 230004 - DNA, 25 bp, Rattus norvegicus
cagcaggctctacgacatgtatata

SEQ ID NO: 230005 - DNA, 25 bp, Rattus norvegicus
cagcaggctctaggacatgtatata

SEQ ID NO: 230006 - DNA, 25 bp, Rattus norvegicus
cagcaggctgctagtttgtgtcttg

SEQ ID NO: 230007 - DNA, 25 bp, Rattus norvegicus
cagcaggctgcttgtttgtgtcttg

SEQ ID NO: 230008 - DNA, 25 bp, Rattus norvegicus
cagcaggctgtgctctaaagtaaac

SEQ ID NO: 230009 - DNA, 25 bp, Rattus norvegicus
cagcaggctgtggtctaaagtaaac

SEQ ID NO: 230010 - DNA, 25 bp, Rattus norvegicus
cagcaggctttcattgccaatggag

SEQ ID NO: 230011 - DNA, 25 bp, Rattus norvegicus
cagcaggctttctttgccaatggag

SEQ ID NO: 230012 - DNA, 25 bp, Rattus norvegicus
cagcagggacatacgggatcacaga

SEQ ID NO: 230013 - DNA, 25 bp, Rattus norvegicus
cagcagggacattcgggatcacaga

SEQ ID NO: 230014 - DNA, 25 bp, Rattus norvegicus
cagcagggtctccacctaaccagag

SEQ ID NO: 230015 - DNA, 25 bp, Rattus norvegicus
cagcagggtctcgacctaaccagag

SEQ ID NO: 230016 - DNA, 25 bp, Rattus norvegicus
cagcagggtttgacttggtttttag

SEQ ID NO: 230017 - DNA, 25 bp, Rattus norvegicus
cagcagggtttgtcttggtttttag

SEQ ID NO: 230018 - DNA, 25 bp, Rattus norvegicus
cagcaggtaagcatgtttgccgcaa

SEQ ID NO: 230019 - DNA, 25 bp, Rattus norvegicus
cagcaggtaagcttgtttgccgcaa

SEQ ID NO: 230020 - DNA, 25 bp, Rattus norvegicus
cagcaggtatacagctctggcccaa

SEQ ID NO: 230021 - DNA, 25 bp, Rattus norvegicus
cagcaggtatactgctctggcccaa

SEQ ID NO: 230022 - DNA, 25 bp, Rattus norvegicus
cagcaggtcaagcttgccatggcaa

SEQ ID NO: 230023 - DNA, 25 bp, Rattus norvegicus
cagcaggtcaaggttgccatggcaa

SEQ ID NO: 230024 - DNA, 25 bp, Rattus norvegicus
cagcaggtctagactactgtaccag

SEQ ID NO: 230025 - DNA, 25 bp, Rattus norvegicus
cagcaggtctagtctactgtaccag

SEQ ID NO: 230026 - DNA, 25 bp, Rattus norvegicus
cagcaggtctgccagtgttttcaga

SEQ ID NO: 230027 - DNA, 25 bp, Rattus norvegicus
cagcaggtctgcgagtgttttcaga

SEQ ID NO: 230028 - DNA, 25 bp, Rattus norvegicus
cagcaggtgcctatgttctgggtta

SEQ ID NO: 230029 - DNA, 25 bp, Rattus norvegicus
cagcaggtgcctttgttctgggtta

SEQ ID NO: 230030 - DNA, 25 bp, Rattus norvegicus
cagcaggtgctccaaaagtagtgaa

SEQ ID NO: 230031 - DNA, 25 bp, Rattus norvegicus
cagcaggtgctcgaaaagtagtgaa

SEQ ID NO: 230032 - DNA, 25 bp, Rattus norvegicus
cagcaggttgagactggtggcctct

SEQ ID NO: 230033 - DNA, 25 bp, Rattus norvegicus
cagcaggttgagtctggtggcctct

SEQ ID NO: 230034 - DNA, 25 bp, Rattus norvegicus
cagcaggttgctcttctcaaggaga

SEQ ID NO: 230035 - DNA, 25 bp, Rattus norvegicus
cagcaggttgctgttctcaaggaga

SEQ ID NO: 230036 - DNA, 25 bp, Rattus norvegicus
cagcaggtttttcccttggaaaatc

SEQ ID NO: 230037 - DNA, 25 bp, Rattus norvegicus
cagcaggtttttgccttggaaaatc

SEQ ID NO: 230038 - DNA, 25 bp, Rattus norvegicus
cagcagtagtaaaacgtctccgaga

SEQ ID NO: 230039 - DNA, 25 bp, Rattus norvegicus
cagcagtagtaatacgtctccgaga

SEQ ID NO: 230040 - DNA, 25 bp, Rattus norvegicus
cagcagtcaagtactccacctttgg

SEQ ID NO: 230041 - DNA, 25 bp, Rattus norvegicus
cagcagtcaagttctccacctttgg

SEQ ID NO: 230042 - DNA, 25 bp, Rattus norvegicus
cagcagtcctgcagtgaaggcctta

SEQ ID NO: 230043 - DNA, 25 bp, Rattus norvegicus
cagcagtcctgctgtgaaggcctta

SEQ ID NO: 230044 - DNA, 25 bp, Rattus norvegicus
cagcagtcctttattctaattccac

SEQ ID NO: 230045 - DNA, 25 bp, Rattus norvegicus
cagcagtccttttttctaattccac

SEQ ID NO: 230046 - DNA, 25 bp, Rattus norvegicus
cagcagtcgcgtcgcttaagtgtca

SEQ ID NO: 230047 - DNA, 25 bp, Rattus norvegicus
cagcagtcgcgtggcttaagtgtca

SEQ ID NO: 230048 - DNA, 25 bp, Rattus norvegicus
cagcagtgagggacccggccatgct

SEQ ID NO: 230049 - DNA, 25 bp, Rattus norvegicus
cagcagtgagggtcccggccatgct

SEQ ID NO: 230050 - DNA, 25 bp, Rattus norvegicus
cagcagtgcatgaggaaccagccat

SEQ ID NO: 230051 - DNA, 25 bp, Rattus norvegicus
cagcagtgcatgtggaaccagccat

SEQ ID NO: 230052 - DNA, 25 bp, Rattus norvegicus
cagcagtggccgcatcctgtatgga

SEQ ID NO: 230053 - DNA, 25 bp, Rattus norvegicus
cagcagtggccggatcctgtatgga

SEQ ID NO: 230054 - DNA, 25 bp, Rattus norvegicus
cagcagtggctgcacacagtgtctt

SEQ ID NO: 230055 - DNA, 25 bp, Rattus norvegicus
cagcagtggctggacacagtgtctt

SEQ ID NO: 230056 - DNA, 25 bp, Rattus norvegicus
cagcagtggcttcttcgaaatgtca

SEQ ID NO: 230057 - DNA, 25 bp, Rattus norvegicus
cagcagtggcttgttcgaaatgtca

SEQ ID NO: 230058 - DNA, 25 bp, Rattus norvegicus
cagcagtgtgccaaaagcaggtcat

SEQ ID NO: 230059 - DNA, 25 bp, Rattus norvegicus
cagcagtgtgcctaaagcaggtcat

SEQ ID NO: 230060 - DNA, 25 bp, Rattus norvegicus
cagcagtgttccagagagttgcaca

SEQ ID NO: 230061 - DNA, 25 bp, Rattus norvegicus
cagcagtgttcctgagagttgcaca

SEQ ID NO: 230062 - DNA, 25 bp, Rattus norvegicus
cagcagtgttggatggtctcacagc

SEQ ID NO: 230063 - DNA, 25 bp, Rattus norvegicus
cagcagtgttggttggtctcacagc

SEQ ID NO: 230064 - DNA, 25 bp, Rattus norvegicus
cagcagttaggcaagcctggctgtc

SEQ ID NO: 230065 - DNA, 25 bp, Rattus norvegicus
cagcagttaggctagcctggctgtc

SEQ ID NO: 230066 - DNA, 25 bp, Rattus norvegicus
cagcagttgcccaggttatggagaa

SEQ ID NO: 230067 - DNA, 25 bp, Rattus norvegicus
cagcagttgccctggttatggagaa

SEQ ID NO: 230068 - DNA, 25 bp, Rattus norvegicus
cagcagttgctaacccagtatcact

SEQ ID NO: 230069 - DNA, 25 bp, Rattus norvegicus
cagcagttgctatcccagtatcact

SEQ ID NO: 230070 - DNA, 25 bp, Rattus norvegicus
cagcagttgctcctaatccttatta

SEQ ID NO: 230071 - DNA, 25 bp, Rattus norvegicus
cagcagttgctcgtaatccttatta

SEQ ID NO: 230072 - DNA, 25 bp, Rattus norvegicus
cagcagttgtggaaaatttggacta

SEQ ID NO: 230073 - DNA, 25 bp, Rattus norvegicus
cagcagttgtggtaaatttggacta

SEQ ID NO: 230074 - DNA, 25 bp, Rattus norvegicus
cagcagtttctcagtaaggcaaaaa

SEQ ID NO: 230075 - DNA, 25 bp, Rattus norvegicus
cagcagtttctctgtaaggcaaaaa

SEQ ID NO: 230076 - DNA, 25 bp, Rattus norvegicus
cagcagttttatattgacccaggag

SEQ ID NO: 230077 - DNA, 25 bp, Rattus norvegicus
cagcagttttattttgacccaggag

SEQ ID NO: 230078 - DNA, 25 bp, Rattus norvegicus
cagcataccgagatgacttatttca

SEQ ID NO: 230079 - DNA, 25 bp, Rattus norvegicus
cagcataccgagttgacttatttca

SEQ ID NO: 230080 - DNA, 25 bp, Rattus norvegicus
cagcatatggctcgacgaataaatt

SEQ ID NO: 230081 - DNA, 25 bp, Rattus norvegicus
cagcatatggctggacgaataaatt

SEQ ID NO: 230082 - DNA, 25 bp, Rattus norvegicus
cagcatattcatcgccccgttggag

SEQ ID NO: 230083 - DNA, 25 bp, Rattus norvegicus
cagcatattcatggccccgttggag

SEQ ID NO: 230084 - DNA, 25 bp, Rattus norvegicus
cagcatcacatacagttccactttt

SEQ ID NO: 230085 - DNA, 25 bp, Rattus norvegicus
cagcatcacatagagttccactttt

SEQ ID NO: 230086 - DNA, 25 bp, Rattus norvegicus
cagcatcacggcctcagaatatatt

SEQ ID NO: 230087 - DNA, 25 bp, Rattus norvegicus
cagcatcacggcgtcagaatatatt

SEQ ID NO: 230088 - DNA, 25 bp, Rattus norvegicus
cagcatcactgacactggagtcaat

SEQ ID NO: 230089 - DNA, 25 bp, Rattus norvegicus
cagcatcactgagactggagtcaat

SEQ ID NO: 230090 - DNA, 25 bp, Rattus norvegicus
cagcatcagccgctgcatagtggat

SEQ ID NO: 230091 - DNA, 25 bp, Rattus norvegicus
cagcatcagccggtgcatagtggat

SEQ ID NO: 230092 - DNA, 25 bp, Rattus norvegicus
cagcatcaggtccagttttcagcaa

SEQ ID NO: 230093 - DNA, 25 bp, Rattus norvegicus
cagcatcaggtcgagttttcagcaa

SEQ ID NO: 230094 - DNA, 25 bp, Rattus norvegicus
cagcatcagtgaccataagcctgtc

SEQ ID NO: 230095 - DNA, 25 bp, Rattus norvegicus
cagcatcagtgagcataagcctgtc

SEQ ID NO: 230096 - DNA, 25 bp, Rattus norvegicus
cagcatcagtgcagcctgacacagt

SEQ ID NO: 230097 - DNA, 25 bp, Rattus norvegicus
cagcatcagtgctgcctgacacagt

SEQ ID NO: 230098 - DNA, 25 bp, Rattus norvegicus
cagcatccagttatatcctgaatgt

SEQ ID NO: 230099 - DNA, 25 bp, Rattus norvegicus
cagcatccagttttatcctgaatgt

SEQ ID NO: 230100 - DNA, 25 bp, Rattus norvegicus
cagcatcctaatagattctgtctta

SEQ ID NO: 230101 - DNA, 25 bp, Rattus norvegicus
cagcatcctaattgattctgtctta

SEQ ID NO: 230102 - DNA, 25 bp, Rattus norvegicus
cagcatccttccagtgactgtggca

SEQ ID NO: 230103 - DNA, 25 bp, Rattus norvegicus
cagcatccttcctgtgactgtggca

SEQ ID NO: 230104 - DNA, 25 bp, Rattus norvegicus
cagcatccttgcctgaaatgtgaat

SEQ ID NO: 230105 - DNA, 25 bp, Rattus norvegicus
cagcatccttgcgtgaaatgtgaat

SEQ ID NO: 230106 - DNA, 25 bp, Rattus norvegicus
cagcatcgtcagaagttgtaccctc

SEQ ID NO: 230107 - DNA, 25 bp, Rattus norvegicus
cagcatcgtcagtagttgtaccctc

SEQ ID NO: 230108 - DNA, 25 bp, Rattus norvegicus
cagcatctattgatactgtcattag

SEQ ID NO: 230109 - DNA, 25 bp, Rattus norvegicus
cagcatctattgttactgtcattag

SEQ ID NO: 230110 - DNA, 25 bp, Rattus norvegicus
cagcatctcacaccagcagagtctg

SEQ ID NO: 230111 - DNA, 25 bp, Rattus norvegicus
cagcatctcacagcagcagagtctg

SEQ ID NO: 230112 - DNA, 25 bp, Rattus norvegicus
cagcatctctccatggcataggata

SEQ ID NO: 230113 - DNA, 25 bp, Rattus norvegicus
cagcatctctccttggcataggata

SEQ ID NO: 230114 - DNA, 25 bp, Rattus norvegicus
cagcatctgaaaatcctccgaggag

SEQ ID NO: 230115 - DNA, 25 bp, Rattus norvegicus
cagcatctgaaattcctccgaggag

SEQ ID NO: 230116 - DNA, 25 bp, Rattus norvegicus
cagcatctgcaacagcggttgcttt

SEQ ID NO: 230117 - DNA, 25 bp, Rattus norvegicus
cagcatctgcaagagcggttgcttt

SEQ ID NO: 230118 - DNA, 25 bp, Rattus norvegicus
cagcatctgcatagggtgtcatgtg

SEQ ID NO: 230119 - DNA, 25 bp, Rattus norvegicus
cagcatctgcatcagtttcctctaa

SEQ ID NO: 230120 - DNA, 25 bp, Rattus norvegicus
cagcatctgcatgagtttcctctaa

SEQ ID NO: 230121 - DNA, 25 bp, Rattus norvegicus
cagcatctgcattgggtgtcatgtg

SEQ ID NO: 230122 - DNA, 25 bp, Rattus norvegicus
cagcatctggctctgtttcaggata

SEQ ID NO: 230123 - DNA, 25 bp, Rattus norvegicus
cagcatctggctgtgtttcaggata

SEQ ID NO: 230124 - DNA, 25 bp, Rattus norvegicus
cagcatctgtatctatcccttcaat

SEQ ID NO: 230125 - DNA, 25 bp, Rattus norvegicus
cagcatctgtatgtatcccttcaat

SEQ ID NO: 230126 - DNA, 25 bp, Rattus norvegicus
cagcatctgtgcctcttcagaaagt

SEQ ID NO: 230127 - DNA, 25 bp, Rattus norvegicus
cagcatctgtgcgtcttcagaaagt

SEQ ID NO: 230128 - DNA, 25 bp, Rattus norvegicus
cagcatctgtgtattgtgtgagcct

SEQ ID NO: 230129 - DNA, 25 bp, Rattus norvegicus
cagcatctgtgttttgtgtgagcct

SEQ ID NO: 230130 - DNA, 25 bp, Rattus norvegicus
cagcatcttacgctggtttggtgag

SEQ ID NO: 230131 - DNA, 25 bp, Rattus norvegicus
cagcatcttacggtggtttggtgag

SEQ ID NO: 230132 - DNA, 25 bp, Rattus norvegicus
cagcatcttgatcggcatttccaat

SEQ ID NO: 230133 - DNA, 25 bp, Rattus norvegicus
cagcatcttgatgggcatttccaat

SEQ ID NO: 230134 - DNA, 25 bp, Rattus norvegicus
cagcatctttctccctgaagttcga

SEQ ID NO: 230135 - DNA, 25 bp, Rattus norvegicus
cagcatctttctctctatgtggata

SEQ ID NO: 230136 - DNA, 25 bp, Rattus norvegicus
cagcatctttctgcctgaagttcga

SEQ ID NO: 230137 - DNA, 25 bp, Rattus norvegicus
cagcatctttctgtctatgtggata

SEQ ID NO: 230138 - DNA, 25 bp, Rattus norvegicus
cagcatcttttccaagtccgttctt

SEQ ID NO: 230139 - DNA, 25 bp, Rattus norvegicus
cagcatcttttcgaagtccgttctt

SEQ ID NO: 230140 - DNA, 25 bp, Rattus norvegicus
cagcatgacagcacggctcggaagg

SEQ ID NO: 230141 - DNA, 25 bp, Rattus norvegicus
cagcatgacagctcggctcggaagg

SEQ ID NO: 230142 - DNA, 25 bp, Rattus norvegicus
cagcatgaggtgcactatctggtgt

SEQ ID NO: 230143 - DNA, 25 bp, Rattus norvegicus
cagcatgaggtggactatctggtgt

SEQ ID NO: 230144 - DNA, 25 bp, Rattus norvegicus
cagcatgccgctaatgtcttggtta

SEQ ID NO: 230145 - DNA, 25 bp, Rattus norvegicus
cagcatgccgcttatgtcttggtta

SEQ ID NO: 230146 - DNA, 25 bp, Rattus norvegicus
cagcatgcctccatagagttctgag

SEQ ID NO: 230147 - DNA, 25 bp, Rattus norvegicus
cagcatgcctccttagagttctgag

SEQ ID NO: 230148 - DNA, 25 bp, Rattus norvegicus
cagcatgcctgaagctgcctgccta

SEQ ID NO: 230149 - DNA, 25 bp, Rattus norvegicus
cagcatgcctgatgctgcctgccta

SEQ ID NO: 230150 - DNA, 25 bp, Rattus norvegicus
cagcatgctgctcctagtcgggaca

SEQ ID NO: 230151 - DNA, 25 bp, Rattus norvegicus
cagcatgctgctgctagtcgggaca

SEQ ID NO: 230152 - DNA, 25 bp, Rattus norvegicus
cagcatggagtgacacccaatccca

SEQ ID NO: 230153 - DNA, 25 bp, Rattus norvegicus
cagcatggagtgtcacccaatccca

SEQ ID NO: 230154 - DNA, 25 bp, Rattus norvegicus
cagcatggcactccagtgtctcatg

SEQ ID NO: 230155 - DNA, 25 bp, Rattus norvegicus
cagcatggcactgcagtgtctcatg

SEQ ID NO: 230156 - DNA, 25 bp, Rattus norvegicus
cagcatggcattacctctgtgatgg

SEQ ID NO: 230157 - DNA, 25 bp, Rattus norvegicus
cagcatggcatttcctctgtgatgg

SEQ ID NO: 230158 - DNA, 25 bp, Rattus norvegicus
cagcatgggcagagtcaggaaataa

SEQ ID NO: 230159 - DNA, 25 bp, Rattus norvegicus
cagcatgggcagtgtcaggaaataa

SEQ ID NO: 230160 - DNA, 25 bp, Rattus norvegicus
cagcatgtaaatactctggtcttta

SEQ ID NO: 230161 - DNA, 25 bp, Rattus norvegicus
cagcatgtaaattctctggtcttta

SEQ ID NO: 230162 - DNA, 25 bp, Rattus norvegicus
cagcatgtagacagggacacacaag

SEQ ID NO: 230163 - DNA, 25 bp, Rattus norvegicus
cagcatgtagactgggacacacaag

SEQ ID NO: 230164 - DNA, 25 bp, Rattus norvegicus
cagcatgtcagaaagcccggctatg

SEQ ID NO: 230165 - DNA, 25 bp, Rattus norvegicus
cagcatgtcagatagcccggctatg

SEQ ID NO: 230166 - DNA, 25 bp, Rattus norvegicus
cagcatgtctcgcatactaaccgtt

SEQ ID NO: 230167 - DNA, 25 bp, Rattus norvegicus
cagcatgtctcggatactaaccgtt

SEQ ID NO: 230168 - DNA, 25 bp, Rattus norvegicus
cagcatgtggatatcctgtgagcat

SEQ ID NO: 230169 - DNA, 25 bp, Rattus norvegicus
cagcatgtggatttcctgtgagcat

SEQ ID NO: 230170 - DNA, 25 bp, Rattus norvegicus
cagcatgtgtgtctttgtcttctaa

SEQ ID NO: 230171 - DNA, 25 bp, Rattus norvegicus
cagcatgtgtgtgtttgtcttctaa

SEQ ID NO: 230172 - DNA, 25 bp, Rattus norvegicus
cagcatgttggacggcaccactgat

SEQ ID NO: 230173 - DNA, 25 bp, Rattus norvegicus
cagcatgttggagggcaccactgat

SEQ ID NO: 230174 - DNA, 25 bp, Rattus norvegicus
cagcatgttggcattcggagcggaa

SEQ ID NO: 230175 - DNA, 25 bp, Rattus norvegicus
cagcatgttggctttcggagcggaa

SEQ ID NO: 230176 - DNA, 25 bp, Rattus norvegicus
cagcatgtttgcattgggcatcggg

SEQ ID NO: 230177 - DNA, 25 bp, Rattus norvegicus
cagcatgtttgctttgggcatcggg

SEQ ID NO: 230178 - DNA, 25 bp, Rattus norvegicus
cagcattacctcagctctaaactag

SEQ ID NO: 230179 - DNA, 25 bp, Rattus norvegicus
cagcattacctctgctctaaactag

SEQ ID NO: 230180 - DNA, 25 bp, Rattus norvegicus
cagcattacttcaccttgttttaga

SEQ ID NO: 230181 - DNA, 25 bp, Rattus norvegicus
cagcattacttctccttgttttaga

SEQ ID NO: 230182 - DNA, 25 bp, Rattus norvegicus
cagcattagtctcgctcagtatcta

SEQ ID NO: 230183 - DNA, 25 bp, Rattus norvegicus
cagcattagtctggctcagtatcta

SEQ ID NO: 230184 - DNA, 25 bp, Rattus norvegicus
cagcattcacatattggttcacaat

SEQ ID NO: 230185 - DNA, 25 bp, Rattus norvegicus
cagcattcacattttggttcacaat

SEQ ID NO: 230186 - DNA, 25 bp, Rattus norvegicus
cagcattcagacctgcttcctggca

SEQ ID NO: 230187 - DNA, 25 bp, Rattus norvegicus
cagcattcagacgtgcttcctggca

SEQ ID NO: 230188 - DNA, 25 bp, Rattus norvegicus
cagcattcaggcatctgaggtttct

SEQ ID NO: 230189 - DNA, 25 bp, Rattus norvegicus
cagcattcaggcttctgaggtttct

SEQ ID NO: 230190 - DNA, 25 bp, Rattus norvegicus
cagcattccttcctatcatcttatg

SEQ ID NO: 230191 - DNA, 25 bp, Rattus norvegicus
cagcattccttcgtatcatcttatg

SEQ ID NO: 230192 - DNA, 25 bp, Rattus norvegicus
cagcattcgtttacccaccaaaata

SEQ ID NO: 230193 - DNA, 25 bp, Rattus norvegicus
cagcattcgttttcccaccaaaata

SEQ ID NO: 230194 - DNA, 25 bp, Rattus norvegicus
cagcattctcctactcagtgttaag

SEQ ID NO: 230195 - DNA, 25 bp, Rattus norvegicus
cagcattctccttctcagtgttaag

SEQ ID NO: 230196 - DNA, 25 bp, Rattus norvegicus
cagcattctgcaccgtttcagttta

SEQ ID NO: 230197 - DNA, 25 bp, Rattus norvegicus
cagcattctgcagcgtttcagttta

SEQ ID NO: 230198 - DNA, 25 bp, Rattus norvegicus
cagcattctggaagcggaggctaga

SEQ ID NO: 230199 - DNA, 25 bp, Rattus norvegicus
cagcattctggatgcggaggctaga

SEQ ID NO: 230200 - DNA, 25 bp, Rattus norvegicus
cagcattgaattcctgtcttaacaa

SEQ ID NO: 230201 - DNA, 25 bp, Rattus norvegicus
cagcattgaattgctgtcttaacaa

SEQ ID NO: 230202 - DNA, 25 bp, Rattus norvegicus
cagcattgagctatttctttctttg

SEQ ID NO: 230203 - DNA, 25 bp, Rattus norvegicus
cagcattgagctttttctttctttg

SEQ ID NO: 230204 - DNA, 25 bp, Rattus norvegicus
cagcattgatttagagcccgggttc

SEQ ID NO: 230205 - DNA, 25 bp, Rattus norvegicus
cagcattgattttgagcccgggttc

SEQ ID NO: 230206 - DNA, 25 bp, Rattus norvegicus
cagcattgcaaaaaaggactttact

SEQ ID NO: 230207 - DNA, 25 bp, Rattus norvegicus
cagcattgcaaataaggactttact

SEQ ID NO: 230208 - DNA, 25 bp, Rattus norvegicus
cagcattggcagactcattgggatt

SEQ ID NO: 230209 - DNA, 25 bp, Rattus norvegicus
cagcattggcagtctcattgggatt

SEQ ID NO: 230210 - DNA, 25 bp, Rattus norvegicus
cagcattgtacgaggattctaggga

SEQ ID NO: 230211 - DNA, 25 bp, Rattus norvegicus
cagcattgtacgtggattctaggga

SEQ ID NO: 230212 - DNA, 25 bp, Rattus norvegicus
cagcattgtcagagtaacggcctac

SEQ ID NO: 230213 - DNA, 25 bp, Rattus norvegicus
cagcattgtcagtgtaacggcctac

SEQ ID NO: 230214 - DNA, 25 bp, Rattus norvegicus
cagcattgttgcacaggaaattggt

SEQ ID NO: 230215 - DNA, 25 bp, Rattus norvegicus
cagcattgttgctcaggaaattggt

SEQ ID NO: 230216 - DNA, 25 bp, Rattus norvegicus
cagcatttacagacacggccgagga

SEQ ID NO: 230217 - DNA, 25 bp, Rattus norvegicus
cagcatttacagtcacggccgagga

SEQ ID NO: 230218 - DNA, 25 bp, Rattus norvegicus
cagcatttagtaatggtttgtgttg

SEQ ID NO: 230219 - DNA, 25 bp, Rattus norvegicus
cagcatttagtattggtttgtgttg

SEQ ID NO: 230220 - DNA, 25 bp, Rattus norvegicus
cagcatttgaatctcctcttgacaa

SEQ ID NO: 230221 - DNA, 25 bp, Rattus norvegicus
cagcatttgaatgtcctcttgacaa

SEQ ID NO: 230222 - DNA, 25 bp, Rattus norvegicus
cagcatttggccacgttgttggttt

SEQ ID NO: 230223 - DNA, 25 bp, Rattus norvegicus
cagcatttggcctcgttgttggttt

SEQ ID NO: 230224 - DNA, 25 bp, Rattus norvegicus
cagcatttggttctgcctgtaaaac

SEQ ID NO: 230225 - DNA, 25 bp, Rattus norvegicus
cagcatttggttgtgcctgtaaaac

SEQ ID NO: 230226 - DNA, 25 bp, Rattus norvegicus
cagcatttgtccattgaatcctggg

SEQ ID NO: 230227 - DNA, 25 bp, Rattus norvegicus
cagcatttgtcctttgaatcctggg

SEQ ID NO: 230228 - DNA, 25 bp, Rattus norvegicus
cagcattttgagaacttggatccca

SEQ ID NO: 230229 - DNA, 25 bp, Rattus norvegicus
cagcattttgagtacttggatccca

SEQ ID NO: 230230 - DNA, 25 bp, Rattus norvegicus
cagcattttgctataaccttccgga

SEQ ID NO: 230231 - DNA, 25 bp, Rattus norvegicus
cagcattttgctttaaccttccgga

SEQ ID NO: 230232 - DNA, 25 bp, Rattus norvegicus
cagccaaactccaattcacattaat

SEQ ID NO: 230233 - DNA, 25 bp, Rattus norvegicus
cagccaaactcctattcacattaat

SEQ ID NO: 230234 - DNA, 25 bp, Rattus norvegicus
cagccaacacggatcggaaagcttt

SEQ ID NO: 230235 - DNA, 25 bp, Rattus norvegicus
cagccaacacggttcggaaagcttt

SEQ ID NO: 230236 - DNA, 25 bp, Rattus norvegicus
cagccaacggaaacttgtgggttag

SEQ ID NO: 230237 - DNA, 25 bp, Rattus norvegicus
cagccaacggaatcttgtgggttag

SEQ ID NO: 230238 - DNA, 25 bp, Rattus norvegicus
cagccaactgatcctatataatttt

SEQ ID NO: 230239 - DNA, 25 bp, Rattus norvegicus
cagccaactgatgctatataatttt

SEQ ID NO: 230240 - DNA, 25 bp, Rattus norvegicus
cagccaacttccatcagatgactat

SEQ ID NO: 230241 - DNA, 25 bp, Rattus norvegicus
cagccaacttccttcagatgactat

SEQ ID NO: 230242 - DNA, 25 bp, Rattus norvegicus
cagccaagcatgagagcagagctgg

SEQ ID NO: 230243 - DNA, 25 bp, Rattus norvegicus
cagccaagcatgtgagcagagctgg

SEQ ID NO: 230244 - DNA, 25 bp, Rattus norvegicus
cagccaagtatcatgaattcatcgc

SEQ ID NO: 230245 - DNA, 25 bp, Rattus norvegicus
cagccaagtatcttgaattcatcgc

SEQ ID NO: 230246 - DNA, 25 bp, Rattus norvegicus
cagccaatctctcactatgcaagat

SEQ ID NO: 230247 - DNA, 25 bp, Rattus norvegicus
cagccaatctctgactatgcaagat

SEQ ID NO: 230248 - DNA, 25 bp, Rattus norvegicus
cagccacaaaccattgaaggctaaa

SEQ ID NO: 230249 - DNA, 25 bp, Rattus norvegicus
cagccacaaacctttgaaggctaaa

SEQ ID NO: 230250 - DNA, 25 bp, Rattus norvegicus
cagccacaatgtctacagcaccaaa

SEQ ID NO: 230251 - DNA, 25 bp, Rattus norvegicus
cagccacaatgtgtacagcaccaaa

SEQ ID NO: 230252 - DNA, 25 bp, Rattus norvegicus
cagccacacggtcgcctctgtgtta

SEQ ID NO: 230253 - DNA, 25 bp, Rattus norvegicus
cagccacacggtggcctctgtgtta

SEQ ID NO: 230254 - DNA, 25 bp, Rattus norvegicus
cagccacatggcatttccttctttt

SEQ ID NO: 230255 - DNA, 25 bp, Rattus norvegicus
cagccacatggcttttccttctttt

SEQ ID NO: 230256 - DNA, 25 bp, Rattus norvegicus
cagccacattctccttggattcgag

SEQ ID NO: 230257 - DNA, 25 bp, Rattus norvegicus
cagccacattctgcttggattcgag

SEQ ID NO: 230258 - DNA, 25 bp, Rattus norvegicus
cagccacattttcatgtcattcgca

SEQ ID NO: 230259 - DNA, 25 bp, Rattus norvegicus
cagccacattttgatgtcattcgca

SEQ ID NO: 230260 - DNA, 25 bp, Rattus norvegicus
cagccaccacttcagtgtgatttgg

SEQ ID NO: 230261 - DNA, 25 bp, Rattus norvegicus
cagccaccacttgagtgtgatttgg

SEQ ID NO: 230262 - DNA, 25 bp, Rattus norvegicus
cagccaccggcacatttaagagata

SEQ ID NO: 230263 - DNA, 25 bp, Rattus norvegicus
cagccaccggcagatttaagagata

SEQ ID NO: 230264 - DNA, 25 bp, Rattus norvegicus
cagccacctggaccgagtcgtttag

SEQ ID NO: 230265 - DNA, 25 bp, Rattus norvegicus
cagccacctggagcgagtcgtttag

SEQ ID NO: 230266 - DNA, 25 bp, Rattus norvegicus
cagccacctttgctttagaatccta

SEQ ID NO: 230267 - DNA, 25 bp, Rattus norvegicus
cagccacctttggtttagaatccta

SEQ ID NO: 230268 - DNA, 25 bp, Rattus norvegicus
cagccacgggaccaagtgcttcttg

SEQ ID NO: 230269 - DNA, 25 bp, Rattus norvegicus
cagccacgggacgaagtgcttcttg

SEQ ID NO: 230270 - DNA, 25 bp, Rattus norvegicus
cagccacgggatacctggagatgct

SEQ ID NO: 230271 - DNA, 25 bp, Rattus norvegicus
cagccacgggattcctggagatgct

SEQ ID NO: 230272 - DNA, 25 bp, Rattus norvegicus
cagccactattaagtcaccactgtg

SEQ ID NO: 230273 - DNA, 25 bp, Rattus norvegicus
cagccactattatgtcaccactgtg

SEQ ID NO: 230274 - DNA, 25 bp, Rattus norvegicus
cagccactctctagaacagcagaat

SEQ ID NO: 230275 - DNA, 25 bp, Rattus norvegicus
cagccactctcttgaacagcagaat

SEQ ID NO: 230276 - DNA, 25 bp, Rattus norvegicus
cagccactctgcatttgattgacat

SEQ ID NO: 230277 - DNA, 25 bp, Rattus norvegicus
cagccactctgcttttgattgacat

SEQ ID NO: 230278 - DNA, 25 bp, Rattus norvegicus
cagccactctttcaggagaacctga

SEQ ID NO: 230279 - DNA, 25 bp, Rattus norvegicus
cagccactctttgaggagaacctga

SEQ ID NO: 230280 - DNA, 25 bp, Rattus norvegicus
cagccactgcagacacttgttggta

SEQ ID NO: 230281 - DNA, 25 bp, Rattus norvegicus
cagccactgcagtcacttgttggta

SEQ ID NO: 230282 - DNA, 25 bp, Rattus norvegicus
cagccactgggcattcagaaacgta

SEQ ID NO: 230283 - DNA, 25 bp, Rattus norvegicus
cagccactgggctttcagaaacgta

SEQ ID NO: 230284 - DNA, 25 bp, Rattus norvegicus
cagccactggttcgtggaacctggt

SEQ ID NO: 230285 - DNA, 25 bp, Rattus norvegicus
cagccactggttggtggaacctggt

SEQ ID NO: 230286 - DNA, 25 bp, Rattus norvegicus
cagccactgtgaatacaacatcgat

SEQ ID NO: 230287 - DNA, 25 bp, Rattus norvegicus
cagccactgtgattacaacatcgat

SEQ ID NO: 230288 - DNA, 25 bp, Rattus norvegicus
cagccacttaaacctgttcactttc

SEQ ID NO: 230289 - DNA, 25 bp, Rattus norvegicus
cagccacttaaagctgttcactttc

SEQ ID NO: 230290 - DNA, 25 bp, Rattus norvegicus
cagccacttcatctaggacttaata

SEQ ID NO: 230291 - DNA, 25 bp, Rattus norvegicus
cagccacttcatgtaggacttaata

SEQ ID NO: 230292 - DNA, 25 bp, Rattus norvegicus
cagccacttgtgaatgtgcccaaag

SEQ ID NO: 230293 - DNA, 25 bp, Rattus norvegicus
cagccacttgtgtatgtgcccaaag

SEQ ID NO: 230294 - DNA, 25 bp, Rattus norvegicus
cagccagaatggatgcagacagtag

SEQ ID NO: 230295 - DNA, 25 bp, Rattus norvegicus
cagccagaatggttgcagacagtag

SEQ ID NO: 230296 - DNA, 25 bp, Rattus norvegicus
cagccagaccacctgaaacctaggg

SEQ ID NO: 230297 - DNA, 25 bp, Rattus norvegicus
cagccagaccacgtgaaacctaggg

SEQ ID NO: 230298 - DNA, 25 bp, Rattus norvegicus
cagccagactgtctacggagatcct

SEQ ID NO: 230299 - DNA, 25 bp, Rattus norvegicus
cagccagactgtgtacggagatcct

SEQ ID NO: 230300 - DNA, 25 bp, Rattus norvegicus
cagccagagtcaccagttgtggtaa

SEQ ID NO: 230301 - DNA, 25 bp, Rattus norvegicus
cagccagagtcagcagttgtggtaa

SEQ ID NO: 230302 - DNA, 25 bp, Rattus norvegicus
cagccagatctactattgcttcaat

SEQ ID NO: 230303 - DNA, 25 bp, Rattus norvegicus
cagccagatctagtattgcttcaat

SEQ ID NO: 230304 - DNA, 25 bp, Rattus norvegicus
cagccagcactgacaatcgagaatc

SEQ ID NO: 230305 - DNA, 25 bp, Rattus norvegicus
cagccagcactgtcaatcgagaatc

SEQ ID NO: 230306 - DNA, 25 bp, Rattus norvegicus
cagccagcagatcactcggaggaca

SEQ ID NO: 230307 - DNA, 25 bp, Rattus norvegicus
cagccagcagatgactcggaggaca

SEQ ID NO: 230308 - DNA, 25 bp, Rattus norvegicus
cagccagcagctattttcttcagaa

SEQ ID NO: 230309 - DNA, 25 bp, Rattus norvegicus
cagccagcagcttttttcttcagaa

SEQ ID NO: 230310 - DNA, 25 bp, Rattus norvegicus
cagccagcataccaagtcctgggta

SEQ ID NO: 230311 - DNA, 25 bp, Rattus norvegicus
cagccagcatacgaagtcctgggta

SEQ ID NO: 230312 - DNA, 25 bp, Rattus norvegicus
cagccagcatccctttctttaaaaa

SEQ ID NO: 230313 - DNA, 25 bp, Rattus norvegicus
cagccagcatccgtttctttaaaaa

SEQ ID NO: 230314 - DNA, 25 bp, Rattus norvegicus
cagccagccagactccagagagagt

SEQ ID NO: 230315 - DNA, 25 bp, Rattus norvegicus
cagccagccagagtccagagagagt

SEQ ID NO: 230316 - DNA, 25 bp, Rattus norvegicus
cagccagccccaacttcgagggtgg

SEQ ID NO: 230317 - DNA, 25 bp, Rattus norvegicus
cagccagccccatcttcgagggtgg

SEQ ID NO: 230318 - DNA, 25 bp, Rattus norvegicus
cagccagccgggagaccttgaataa

SEQ ID NO: 230319 - DNA, 25 bp, Rattus norvegicus
cagccagccgggtgaccttgaataa

SEQ ID NO: 230320 - DNA, 25 bp, Rattus norvegicus
cagccagcctagagaaaaccagaga

SEQ ID NO: 230321 - DNA, 25 bp, Rattus norvegicus
cagccagcctagtgaaaaccagaga

SEQ ID NO: 230322 - DNA, 25 bp, Rattus norvegicus
cagccagcgaggagtgtgcttgcaa

SEQ ID NO: 230323 - DNA, 25 bp, Rattus norvegicus
cagccagcgaggtgtgtgcttgcaa

SEQ ID NO: 230324 - DNA, 25 bp, Rattus norvegicus
cagccagctatcctatcgtgaattg

SEQ ID NO: 230325 - DNA, 25 bp, Rattus norvegicus
cagccagctatcgtatcgtgaattg

SEQ ID NO: 230326 - DNA, 25 bp, Rattus norvegicus
cagccagctattccctgacatgtgt

SEQ ID NO: 230327 - DNA, 25 bp, Rattus norvegicus
cagccagctattgcctgacatgtgt

SEQ ID NO: 230328 - DNA, 25 bp, Rattus norvegicus
cagccagctcaactgcctgaaggaa

SEQ ID NO: 230329 - DNA, 25 bp, Rattus norvegicus
cagccagctcaagtgcctgaaggaa

SEQ ID NO: 230330 - DNA, 25 bp, Rattus norvegicus
cagccagctgatcctctgaacaaag

SEQ ID NO: 230331 - DNA, 25 bp, Rattus norvegicus
cagccagctgatgctctgaacaaag

SEQ ID NO: 230332 - DNA, 25 bp, Rattus norvegicus
cagccagcttaacctacagttcaag

SEQ ID NO: 230333 - DNA, 25 bp, Rattus norvegicus
cagccagcttaagctacagttcaag

SEQ ID NO: 230334 - DNA, 25 bp, Rattus norvegicus
cagccagctttcatttgtcttatca

SEQ ID NO: 230335 - DNA, 25 bp, Rattus norvegicus
cagccagctttcttttgtcttatca

SEQ ID NO: 230336 - DNA, 25 bp, Rattus norvegicus
cagccaggaaaaacctctctaaaaa

SEQ ID NO: 230337 - DNA, 25 bp, Rattus norvegicus
cagccaggaaaatcctctctaaaaa

SEQ ID NO: 230338 - DNA, 25 bp, Rattus norvegicus
cagccaggaatgctattccctgact

SEQ ID NO: 230339 - DNA, 25 bp, Rattus norvegicus
cagccaggaatggtattccctgact

SEQ ID NO: 230340 - DNA, 25 bp, Rattus norvegicus
cagccaggaggcatggcacttggcc

SEQ ID NO: 230341 - DNA, 25 bp, Rattus norvegicus
cagccaggaggcttggcacttggcc

SEQ ID NO: 230342 - DNA, 25 bp, Rattus norvegicus
cagccaggatctctcatcgagttga

SEQ ID NO: 230343 - DNA, 25 bp, Rattus norvegicus
cagccaggatctgtcatcgagttga

SEQ ID NO: 230344 - DNA, 25 bp, Rattus norvegicus
cagccaggctcgctggaagtgtaaa

SEQ ID NO: 230345 - DNA, 25 bp, Rattus norvegicus
cagccaggctcggtggaagtgtaaa

SEQ ID NO: 230346 - DNA, 25 bp, Rattus norvegicus
cagccaggcttacacccagaaaggg

SEQ ID NO: 230347 - DNA, 25 bp, Rattus norvegicus
cagccaggcttagacccagaaaggg

SEQ ID NO: 230348 - DNA, 25 bp, Rattus norvegicus
cagccagggccaagacaagcagcat

SEQ ID NO: 230349 - DNA, 25 bp, Rattus norvegicus
cagccagggccatgacaagcagcat

SEQ ID NO: 230350 - DNA, 25 bp, Rattus norvegicus
cagccagggcctccatctaaagtaa

SEQ ID NO: 230351 - DNA, 25 bp, Rattus norvegicus
cagccagggcctgcatctaaagtaa

SEQ ID NO: 230352 - DNA, 25 bp, Rattus norvegicus
cagccagggctgactcttgaaattg

SEQ ID NO: 230353 - DNA, 25 bp, Rattus norvegicus
cagccagggctgtctcttgaaattg

SEQ ID NO: 230354 - DNA, 25 bp, Rattus norvegicus
cagccaggtggtcgaactttcctcc

SEQ ID NO: 230355 - DNA, 25 bp, Rattus norvegicus
cagccaggtggtggaactttcctcc

SEQ ID NO: 230356 - DNA, 25 bp, Rattus norvegicus
cagccagtcagtctgttttgcatac

SEQ ID NO: 230357 - DNA, 25 bp, Rattus norvegicus
cagccagtcagtgtgttttgcatac

SEQ ID NO: 230358 - DNA, 25 bp, Rattus norvegicus
cagccagtccctaaaacttctaaga

SEQ ID NO: 230359 - DNA, 25 bp, Rattus norvegicus
cagccagtcccttaaacttctaaga

SEQ ID NO: 230360 - DNA, 25 bp, Rattus norvegicus
cagccagtctgcaaaatgagtttca

SEQ ID NO: 230361 - DNA, 25 bp, Rattus norvegicus
cagccagtctgctaaatgagtttca

SEQ ID NO: 230362 - DNA, 25 bp, Rattus norvegicus
cagccagtgccaagaatgctgaagg

SEQ ID NO: 230363 - DNA, 25 bp, Rattus norvegicus
cagccagtgccatgaatgctgaagg

SEQ ID NO: 230364 - DNA, 25 bp, Rattus norvegicus
cagccagtgctcatacatgcagaac

SEQ ID NO: 230365 - DNA, 25 bp, Rattus norvegicus
cagccagtgctcttacatgcagaac

SEQ ID NO: 230366 - DNA, 25 bp, Rattus norvegicus
cagccagtgggcaaatctgtgctct

SEQ ID NO: 230367 - DNA, 25 bp, Rattus norvegicus
cagccagtgggctaatctgtgctct

SEQ ID NO: 230368 - DNA, 25 bp, Rattus norvegicus
cagccagtgtgtagtcattatgcca

SEQ ID NO: 230369 - DNA, 25 bp, Rattus norvegicus
cagccagtgtgttgtcattatgcca

SEQ ID NO: 230370 - DNA, 25 bp, Rattus norvegicus
cagccagtttatctctatcactttc

SEQ ID NO: 230371 - DNA, 25 bp, Rattus norvegicus
cagccagtttatgtctatcactttc

SEQ ID NO: 230372 - DNA, 25 bp, Rattus norvegicus
cagccagttttgatgcaatctgctt

SEQ ID NO: 230373 - DNA, 25 bp, Rattus norvegicus
cagccagttttgttgcaatctgctt

SEQ ID NO: 230374 - DNA, 25 bp, Rattus norvegicus
cagccatactgtagacactctgatg

SEQ ID NO: 230375 - DNA, 25 bp, Rattus norvegicus
cagccatactgttgacactctgatg

SEQ ID NO: 230376 - DNA, 25 bp, Rattus norvegicus
cagccatagctccataccgaaggat

SEQ ID NO: 230377 - DNA, 25 bp, Rattus norvegicus
cagccatagctcgataccgaaggat

SEQ ID NO: 230378 - DNA, 25 bp, Rattus norvegicus
cagccatagctgacttcatagggat

SEQ ID NO: 230379 - DNA, 25 bp, Rattus norvegicus
cagccatagctgtcttcatagggat

SEQ ID NO: 230380 - DNA, 25 bp, Rattus norvegicus
cagccatatgaacttggaggaccta

SEQ ID NO: 230381 - DNA, 25 bp, Rattus norvegicus
cagccatatgaagttggaggaccta

SEQ ID NO: 230382 - DNA, 25 bp, Rattus norvegicus
cagccatcaggcacaacagttgtct

SEQ ID NO: 230383 - DNA, 25 bp, Rattus norvegicus
cagccatcaggctcaacagttgtct

SEQ ID NO: 230384 - DNA, 25 bp, Rattus norvegicus
cagccatccatgaattctctctggg

SEQ ID NO: 230385 - DNA, 25 bp, Rattus norvegicus
cagccatccatgtattctctctggg

SEQ ID NO: 230386 - DNA, 25 bp, Rattus norvegicus
cagccatgacagcagctcaggcaca

SEQ ID NO: 230387 - DNA, 25 bp, Rattus norvegicus
cagccatgacaggagctcaggcaca

SEQ ID NO: 230388 - DNA, 25 bp, Rattus norvegicus
cagccatgaccgactacttgttatg

SEQ ID NO: 230389 - DNA, 25 bp, Rattus norvegicus
cagccatgaccgtctacttgttatg

SEQ ID NO: 230390 - DNA, 25 bp, Rattus norvegicus
cagccatgatgcacagtgaccgact

SEQ ID NO: 230391 - DNA, 25 bp, Rattus norvegicus
cagccatgatgctcagtgaccgact

SEQ ID NO: 230392 - DNA, 25 bp, Rattus norvegicus
cagccatgctccagtcacaaaggaa

SEQ ID NO: 230393 - DNA, 25 bp, Rattus norvegicus
cagccatgctcctgtcacaaaggaa

SEQ ID NO: 230394 - DNA, 25 bp, Rattus norvegicus
cagccatgctggatctttgtcaaac

SEQ ID NO: 230395 - DNA, 25 bp, Rattus norvegicus
cagccatgctggttctttgtcaaac

SEQ ID NO: 230396 - DNA, 25 bp, Rattus norvegicus
cagccatgcttacgttgcctggaaa

SEQ ID NO: 230397 - DNA, 25 bp, Rattus norvegicus
cagccatgcttaggttgcctggaaa

SEQ ID NO: 230398 - DNA, 25 bp, Rattus norvegicus
cagccatggagacggaccgctacat

SEQ ID NO: 230399 - DNA, 25 bp, Rattus norvegicus
cagccatggagagggaccgctacat

SEQ ID NO: 230400 - DNA, 25 bp, Rattus norvegicus
cagccatggcttccgaggattacat

SEQ ID NO: 230401 - DNA, 25 bp, Rattus norvegicus
cagccatggcttgcgaggattacat

SEQ ID NO: 230402 - DNA, 25 bp, Rattus norvegicus
cagccatggggaagtcagctttcat

SEQ ID NO: 230403 - DNA, 25 bp, Rattus norvegicus
cagccatggggatgtcagctttcat

SEQ ID NO: 230404 - DNA, 25 bp, Rattus norvegicus
cagccattggctacaggcaagttag

SEQ ID NO: 230405 - DNA, 25 bp, Rattus norvegicus
cagccattggctcatgatgcatgct

SEQ ID NO: 230406 - DNA, 25 bp, Rattus norvegicus
cagccattggctgatgatgcatgct

SEQ ID NO: 230407 - DNA, 25 bp, Rattus norvegicus
cagccattggcttcaggcaagttag

SEQ ID NO: 230408 - DNA, 25 bp, Rattus norvegicus
cagccattgtacagggtgactcact

SEQ ID NO: 230409 - DNA, 25 bp, Rattus norvegicus
cagccattgtactgggtgactcact

SEQ ID NO: 230410 - DNA, 25 bp, Rattus norvegicus
cagccatttctcaaacagtatcctt

SEQ ID NO: 230411 - DNA, 25 bp, Rattus norvegicus
cagccatttctctaacagtatcctt

SEQ ID NO: 230412 - DNA, 25 bp, Rattus norvegicus
cagccatttggtctctgaaacttca

SEQ ID NO: 230413 - DNA, 25 bp, Rattus norvegicus
cagccatttggtgtctgaaacttca

SEQ ID NO: 230414 - DNA, 25 bp, Rattus norvegicus
cagccatttgtaaactagtgtcagt

SEQ ID NO: 230415 - DNA, 25 bp, Rattus norvegicus
cagccatttgtatactagtgtcagt

SEQ ID NO: 230416 - DNA, 25 bp, Rattus norvegicus
cagccattttgtaccattatataaa

SEQ ID NO: 230417 - DNA, 25 bp, Rattus norvegicus
cagccattttgtacgtgtgactcat

SEQ ID NO: 230418 - DNA, 25 bp, Rattus norvegicus
cagccattttgttccattatataaa

SEQ ID NO: 230419 - DNA, 25 bp, Rattus norvegicus
cagccattttgttcgtgtgactcat

SEQ ID NO: 230420 - DNA, 25 bp, Rattus norvegicus
cagcccaagctacatcttcaagagt

SEQ ID NO: 230421 - DNA, 25 bp, Rattus norvegicus
cagcccaagctagatcttcaagagt

SEQ ID NO: 230422 - DNA, 25 bp, Rattus norvegicus
cagcccaaggctccgagggtcccat

SEQ ID NO: 230423 - DNA, 25 bp, Rattus norvegicus
cagcccaaggctgcgagggtcccat

SEQ ID NO: 230424 - DNA, 25 bp, Rattus norvegicus
cagcccacagggaggccggcgctat

SEQ ID NO: 230425 - DNA, 25 bp, Rattus norvegicus
cagcccacagggtggccggcgctat

SEQ ID NO: 230426 - DNA, 25 bp, Rattus norvegicus
cagcccaccatgagctcaataggag

SEQ ID NO: 230427 - DNA, 25 bp, Rattus norvegicus
cagcccaccatgtgctcaataggag

SEQ ID NO: 230428 - DNA, 25 bp, Rattus norvegicus
cagcccaccctgaagtgtacataaa

SEQ ID NO: 230429 - DNA, 25 bp, Rattus norvegicus
cagcccaccctgtagtgtacataaa

SEQ ID NO: 230430 - DNA, 25 bp, Rattus norvegicus
cagcccacgctgatggaagaggaag

SEQ ID NO: 230431 - DNA, 25 bp, Rattus norvegicus
cagcccacgctgttggaagaggaag

SEQ ID NO: 230432 - DNA, 25 bp, Rattus norvegicus
cagcccacgcttaggaatgcttggc

SEQ ID NO: 230433 - DNA, 25 bp, Rattus norvegicus
cagcccacgctttggaatgcttggc

SEQ ID NO: 230434 - DNA, 25 bp, Rattus norvegicus
cagcccacggtgcatgacagtggca

SEQ ID NO: 230435 - DNA, 25 bp, Rattus norvegicus
cagcccacggtggatgacagtggca

SEQ ID NO: 230436 - DNA, 25 bp, Rattus norvegicus
cagcccactgagcaatgccaggtga

SEQ ID NO: 230437 - DNA, 25 bp, Rattus norvegicus
cagcccactgaggaatgccaggtga

SEQ ID NO: 230438 - DNA, 25 bp, Rattus norvegicus
cagcccactgccatgcaagaaagag

SEQ ID NO: 230439 - DNA, 25 bp, Rattus norvegicus
cagcccactgccttgcaagaaagag

SEQ ID NO: 230440 - DNA, 25 bp, Rattus norvegicus
cagcccacttagaacctgtgaacaa

SEQ ID NO: 230441 - DNA, 25 bp, Rattus norvegicus
cagcccacttagtacctgtgaacaa

SEQ ID NO: 230442 - DNA, 25 bp, Rattus norvegicus
cagcccagacttcttcggaagggtt

SEQ ID NO: 230443 - DNA, 25 bp, Rattus norvegicus
cagcccagacttgttcggaagggtt

SEQ ID NO: 230444 - DNA, 25 bp, Rattus norvegicus
cagcccagaggcaacaacctaagga

SEQ ID NO: 230445 - DNA, 25 bp, Rattus norvegicus
cagcccagaggctacaacctaagga

SEQ ID NO: 230446 - DNA, 25 bp, Rattus norvegicus
cagcccagcctgaagtgtaattcta

SEQ ID NO: 230447 - DNA, 25 bp, Rattus norvegicus
cagcccagcctgtagtgtaattcta

SEQ ID NO: 230448 - DNA, 25 bp, Rattus norvegicus
cagcccagctggaaatgtctactct

SEQ ID NO: 230449 - DNA, 25 bp, Rattus norvegicus
cagcccagctggtaatgtctactct

SEQ ID NO: 230450 - DNA, 25 bp, Rattus norvegicus
cagcccagctgtagtgagaccagct

SEQ ID NO: 230451 - DNA, 25 bp, Rattus norvegicus
cagcccagctgttgtgagaccagct

SEQ ID NO: 230452 - DNA, 25 bp, Rattus norvegicus
cagcccaggagaaccagtcacagaa

SEQ ID NO: 230453 - DNA, 25 bp, Rattus norvegicus
cagcccaggagatccagtcacagaa

SEQ ID NO: 230454 - DNA, 25 bp, Rattus norvegicus
cagcccaggctgcattgtatagtta

SEQ ID NO: 230455 - DNA, 25 bp, Rattus norvegicus
cagcccaggctggattgtatagtta

SEQ ID NO: 230456 - DNA, 25 bp, Rattus norvegicus
cagcccagggagactttatatagga

SEQ ID NO: 230457 - DNA, 25 bp, Rattus norvegicus
cagcccagggagtctttatatagga

SEQ ID NO: 230458 - DNA, 25 bp, Rattus norvegicus
cagcccagtatgatccttttgtaaa

SEQ ID NO: 230459 - DNA, 25 bp, Rattus norvegicus
cagcccagtatgttccttttgtaaa

SEQ ID NO: 230460 - DNA, 25 bp, Rattus norvegicus
cagcccagtcctagagtggcaggaa

SEQ ID NO: 230461 - DNA, 25 bp, Rattus norvegicus
cagcccagtcctattagtctcaaaa

SEQ ID NO: 230462 - DNA, 25 bp, Rattus norvegicus
cagcccagtccttgagtggcaggaa

SEQ ID NO: 230463 - DNA, 25 bp, Rattus norvegicus
cagcccagtccttttagtctcaaaa

SEQ ID NO: 230464 - DNA, 25 bp, Rattus norvegicus
cagcccagtgtccttatgattagaa

SEQ ID NO: 230465 - DNA, 25 bp, Rattus norvegicus
cagcccagtgtcgttatgattagaa

SEQ ID NO: 230466 - DNA, 25 bp, Rattus norvegicus
cagcccataacactcattcaatatc

SEQ ID NO: 230467 - DNA, 25 bp, Rattus norvegicus
cagcccataacagtcattcaatatc

SEQ ID NO: 230468 - DNA, 25 bp, Rattus norvegicus
cagcccatagagcagccgagagctc

SEQ ID NO: 230469 - DNA, 25 bp, Rattus norvegicus
cagcccatagaggagccgagagctc

SEQ ID NO: 230470 - DNA, 25 bp, Rattus norvegicus
cagcccatagccagaacgtcgaggt

SEQ ID NO: 230471 - DNA, 25 bp, Rattus norvegicus
cagcccatagcctgaacgtcgaggt

SEQ ID NO: 230472 - DNA, 25 bp, Rattus norvegicus
cagcccatagctataccttgataga

SEQ ID NO: 230473 - DNA, 25 bp, Rattus norvegicus
cagcccatagctttaccttgataga

SEQ ID NO: 230474 - DNA, 25 bp, Rattus norvegicus
cagcccataggccactgtgataatt

SEQ ID NO: 230475 - DNA, 25 bp, Rattus norvegicus
cagcccataggcgactgtgataatt

SEQ ID NO: 230476 - DNA, 25 bp, Rattus norvegicus
cagcccatccctaaatgtggcttta

SEQ ID NO: 230477 - DNA, 25 bp, Rattus norvegicus
cagcccatcccttaatgtggcttta

SEQ ID NO: 230478 - DNA, 25 bp, Rattus norvegicus
cagcccatcgggagcgactaggaat

SEQ ID NO: 230479 - DNA, 25 bp, Rattus norvegicus
cagcccatcgggtgcgactaggaat

SEQ ID NO: 230480 - DNA, 25 bp, Rattus norvegicus
cagcccatcttcatagtgtttgtga

SEQ ID NO: 230481 - DNA, 25 bp, Rattus norvegicus
cagcccatcttcttagtgtttgtga

SEQ ID NO: 230482 - DNA, 25 bp, Rattus norvegicus
cagcccatggctctttgacgagagc

SEQ ID NO: 230483 - DNA, 25 bp, Rattus norvegicus
cagcccatggctgtttgacgagagc

SEQ ID NO: 230484 - DNA, 25 bp, Rattus norvegicus
cagcccattggccttatgtgtgtgt

SEQ ID NO: 230485 - DNA, 25 bp, Rattus norvegicus
cagcccattggcgttatgtgtgtgt

SEQ ID NO: 230486 - DNA, 25 bp, Rattus norvegicus
cagccccacctcagagacattgttt

SEQ ID NO: 230487 - DNA, 25 bp, Rattus norvegicus
cagccccacctctgagacattgttt

SEQ ID NO: 230488 - DNA, 25 bp, Rattus norvegicus
cagccccaggagaatgtgtaaagtt

SEQ ID NO: 230489 - DNA, 25 bp, Rattus norvegicus
cagccccaggagtatgtgtaaagtt

SEQ ID NO: 230490 - DNA, 25 bp, Rattus norvegicus
cagccccagggaacttgttatactg

SEQ ID NO: 230491 - DNA, 25 bp, Rattus norvegicus
cagccccagggatcttgttatactg

SEQ ID NO: 230492 - DNA, 25 bp, Rattus norvegicus
cagccccaggtcagtacagttttaa

SEQ ID NO: 230493 - DNA, 25 bp, Rattus norvegicus
cagccccaggtctgtacagttttaa

SEQ ID NO: 230494 - DNA, 25 bp, Rattus norvegicus
cagccccatatccagtggatcaaac

SEQ ID NO: 230495 - DNA, 25 bp, Rattus norvegicus
cagccccatatcgagtggatcaaac

SEQ ID NO: 230496 - DNA, 25 bp, Rattus norvegicus
cagccccatcctatctgataagaag

SEQ ID NO: 230497 - DNA, 25 bp, Rattus norvegicus
cagccccatcctttctgataagaag

SEQ ID NO: 230498 - DNA, 25 bp, Rattus norvegicus
cagccccatctcatcgtatggttaa

SEQ ID NO: 230499 - DNA, 25 bp, Rattus norvegicus
cagccccatctcttcgtatggttaa

SEQ ID NO: 230500 - DNA, 25 bp, Rattus norvegicus
cagccccatctgagctgactgtggg

SEQ ID NO: 230501 - DNA, 25 bp, Rattus norvegicus
cagccccatctgtgctgactgtggg

SEQ ID NO: 230502 - DNA, 25 bp, Rattus norvegicus
cagccccgagtgcttaacacctgga

SEQ ID NO: 230503 - DNA, 25 bp, Rattus norvegicus
cagccccgagtggttaacacctgga

SEQ ID NO: 230504 - DNA, 25 bp, Rattus norvegicus
cagccccggtggagaacagcccggt

SEQ ID NO: 230505 - DNA, 25 bp, Rattus norvegicus
cagccccggtggtgaacagcccggt

SEQ ID NO: 230506 - DNA, 25 bp, Rattus norvegicus
cagcccctagatcccaaggatgtca

SEQ ID NO: 230507 - DNA, 25 bp, Rattus norvegicus
cagcccctagatgccaaggatgtca

SEQ ID NO: 230508 - DNA, 25 bp, Rattus norvegicus
cagcccctctggagtaagttaatcc

SEQ ID NO: 230509 - DNA, 25 bp, Rattus norvegicus
cagcccctctggtgtaagttaatcc

SEQ ID NO: 230510 - DNA, 25 bp, Rattus norvegicus
cagcccctggataattattgtgcaa

SEQ ID NO: 230511 - DNA, 25 bp, Rattus norvegicus
cagcccctggattattattgtgcaa

SEQ ID NO: 230512 - DNA, 25 bp, Rattus norvegicus
cagcccctgtgtattttgaagcatt

SEQ ID NO: 230513 - DNA, 25 bp, Rattus norvegicus
cagcccctgtgttttttgaagcatt

SEQ ID NO: 230514 - DNA, 25 bp, Rattus norvegicus
cagccccttagacgcctgggttgga

SEQ ID NO: 230515 - DNA, 25 bp, Rattus norvegicus
cagccccttagaggcctgggttgga

SEQ ID NO: 230516 - DNA, 25 bp, Rattus norvegicus
cagccccttcttcgaaatactgtgg

SEQ ID NO: 230517 - DNA, 25 bp, Rattus norvegicus
cagccccttcttggaaatactgtgg

SEQ ID NO: 230518 - DNA, 25 bp, Rattus norvegicus
cagccccttgtgacttttgaaatag

SEQ ID NO: 230519 - DNA, 25 bp, Rattus norvegicus
cagccccttgtgtcttttgaaatag

SEQ ID NO: 230520 - DNA, 25 bp, Rattus norvegicus
cagcccgaaagtatgcttgtccttt

SEQ ID NO: 230521 - DNA, 25 bp, Rattus norvegicus
cagcccgaaagtttgcttgtccttt

SEQ ID NO: 230522 - DNA, 25 bp, Rattus norvegicus
cagcccgagttcctagtgaagtgtt

SEQ ID NO: 230523 - DNA, 25 bp, Rattus norvegicus
cagcccgagttcgtagtgaagtgtt

SEQ ID NO: 230524 - DNA, 25 bp, Rattus norvegicus
cagcccgatgtgatggatgctctca

SEQ ID NO: 230525 - DNA, 25 bp, Rattus norvegicus
cagcccgatgtgttggatgctctca

SEQ ID NO: 230526 - DNA, 25 bp, Rattus norvegicus
cagcccgcagatctttgtgttttga

SEQ ID NO: 230527 - DNA, 25 bp, Rattus norvegicus
cagcccgcagatgtttgtgttttga

SEQ ID NO: 230528 - DNA, 25 bp, Rattus norvegicus
cagcccggctgtcgaaggcacgttt

SEQ ID NO: 230529 - DNA, 25 bp, Rattus norvegicus
cagcccggctgtggaaggcacgttt

SEQ ID NO: 230530 - DNA, 25 bp, Rattus norvegicus
cagcccgtgctaacatgaaatgcat

SEQ ID NO: 230531 - DNA, 25 bp, Rattus norvegicus
cagcccgtgctatcatgaaatgcat

SEQ ID NO: 230532 - DNA, 25 bp, Rattus norvegicus
cagcccgtgctgaatcagctgtaaa

SEQ ID NO: 230533 - DNA, 25 bp, Rattus norvegicus
cagcccgtgctgtatcagctgtaaa

SEQ ID NO: 230534 - DNA, 25 bp, Rattus norvegicus
cagccctacggaagacagcatggat

SEQ ID NO: 230535 - DNA, 25 bp, Rattus norvegicus
cagccctacggatgacagcatggat

SEQ ID NO: 230536 - DNA, 25 bp, Rattus norvegicus
cagccctactgtacctggaggagct

SEQ ID NO: 230537 - DNA, 25 bp, Rattus norvegicus
cagccctactgttcctggaggagct

SEQ ID NO: 230538 - DNA, 25 bp, Rattus norvegicus
cagccctaggctcgttgtttttaca

SEQ ID NO: 230539 - DNA, 25 bp, Rattus norvegicus
cagccctaggctggttgtttttaca

SEQ ID NO: 230540 - DNA, 25 bp, Rattus norvegicus
cagccctagggcatgagcagagcaa

SEQ ID NO: 230541 - DNA, 25 bp, Rattus norvegicus
cagccctagggcttgagcagagcaa

SEQ ID NO: 230542 - DNA, 25 bp, Rattus norvegicus
cagccctaggttcctcagtcttttt

SEQ ID NO: 230543 - DNA, 25 bp, Rattus norvegicus
cagccctaggttgctcagtcttttt

SEQ ID NO: 230544 - DNA, 25 bp, Rattus norvegicus
cagccctcaaggaggtttacattta

SEQ ID NO: 230545 - DNA, 25 bp, Rattus norvegicus
cagccctcaaggtggtttacattta

SEQ ID NO: 230546 - DNA, 25 bp, Rattus norvegicus
cagccctcacgactcactgaagaga

SEQ ID NO: 230547 - DNA, 25 bp, Rattus norvegicus
cagccctcacgagtcactgaagaga

SEQ ID NO: 230548 - DNA, 25 bp, Rattus norvegicus
cagccctcagagcaaggtttggaca

SEQ ID NO: 230549 - DNA, 25 bp, Rattus norvegicus
cagccctcagaggaaggtttggaca

SEQ ID NO: 230550 - DNA, 25 bp, Rattus norvegicus
cagccctcatctctctatggaggat

SEQ ID NO: 230551 - DNA, 25 bp, Rattus norvegicus
cagccctcatctgtctatggaggat

SEQ ID NO: 230552 - DNA, 25 bp, Rattus norvegicus
cagccctcatttaatcgtacattta

SEQ ID NO: 230553 - DNA, 25 bp, Rattus norvegicus
cagccctcattttatcgtacattta

SEQ ID NO: 230554 - DNA, 25 bp, Rattus norvegicus
cagccctcgtgtcatacattttcag

SEQ ID NO: 230555 - DNA, 25 bp, Rattus norvegicus
cagccctcgtgtgatacattttcag

SEQ ID NO: 230556 - DNA, 25 bp, Rattus norvegicus
cagccctgacacatctcattgagaa

SEQ ID NO: 230557 - DNA, 25 bp, Rattus norvegicus
cagccctgacacttctcattgagaa

SEQ ID NO: 230558 - DNA, 25 bp, Rattus norvegicus
cagccctgagagacttttttcccct

SEQ ID NO: 230559 - DNA, 25 bp, Rattus norvegicus
cagccctgagagtcttttttcccct

SEQ ID NO: 230560 - DNA, 25 bp, Rattus norvegicus
cagccctgatctcgtacattattag

SEQ ID NO: 230561 - DNA, 25 bp, Rattus norvegicus
cagccctgatctggtacattattag

SEQ ID NO: 230562 - DNA, 25 bp, Rattus norvegicus
cagccctgcactaataagcgcgcgg

SEQ ID NO: 230563 - DNA, 25 bp, Rattus norvegicus
cagccctgcacttataagcgcgcgg

SEQ ID NO: 230564 - DNA, 25 bp, Rattus norvegicus
cagccctgccaactgtgttttattg

SEQ ID NO: 230565 - DNA, 25 bp, Rattus norvegicus
cagccctgccaagtgtgttttattg

SEQ ID NO: 230566 - DNA, 25 bp, Rattus norvegicus
cagccctgctatcctggagtggtaa

SEQ ID NO: 230567 - DNA, 25 bp, Rattus norvegicus
cagccctgctatgctggagtggtaa

SEQ ID NO: 230568 - DNA, 25 bp, Rattus norvegicus
cagccctggaagctactgcgataat

SEQ ID NO: 230569 - DNA, 25 bp, Rattus norvegicus
cagccctggaaggtactgcgataat

SEQ ID NO: 230570 - DNA, 25 bp, Rattus norvegicus
cagccctggaggatctggagacatc

SEQ ID NO: 230571 - DNA, 25 bp, Rattus norvegicus
cagccctggaggttctggagacatc

SEQ ID NO: 230572 - DNA, 25 bp, Rattus norvegicus
cagccctggcttactatagcatgag

SEQ ID NO: 230573 - DNA, 25 bp, Rattus norvegicus
cagccctggcttatgagagtgtggt

SEQ ID NO: 230574 - DNA, 25 bp, Rattus norvegicus
cagccctggctttctatagcatgag

SEQ ID NO: 230575 - DNA, 25 bp, Rattus norvegicus
cagccctggcttttgagagtgtggt

SEQ ID NO: 230576 - DNA, 25 bp, Rattus norvegicus
cagccctggtccatttgctaccaga

SEQ ID NO: 230577 - DNA, 25 bp, Rattus norvegicus
cagccctggtccttttgctaccaga

SEQ ID NO: 230578 - DNA, 25 bp, Rattus norvegicus
cagcccttaggtccctatgtttggt

SEQ ID NO: 230579 - DNA, 25 bp, Rattus norvegicus
cagcccttaggtgcctatgtttggt

SEQ ID NO: 230580 - DNA, 25 bp, Rattus norvegicus
cagcccttcactccaggataacaga

SEQ ID NO: 230581 - DNA, 25 bp, Rattus norvegicus
cagcccttcactgcaggataacaga

SEQ ID NO: 230582 - DNA, 25 bp, Rattus norvegicus
cagcccttcctcaggatgaggatgt

SEQ ID NO: 230583 - DNA, 25 bp, Rattus norvegicus
cagcccttcctctggatgaggatgt

SEQ ID NO: 230584 - DNA, 25 bp, Rattus norvegicus
cagcccttcgtgcttctgaacaaga

SEQ ID NO: 230585 - DNA, 25 bp, Rattus norvegicus
cagcccttcgtggttctgaacaaga

SEQ ID NO: 230586 - DNA, 25 bp, Rattus norvegicus
cagcccttgaggcaatgtgcaaaga

SEQ ID NO: 230587 - DNA, 25 bp, Rattus norvegicus
cagcccttgagggaatgtgcaaaga

SEQ ID NO: 230588 - DNA, 25 bp, Rattus norvegicus
cagcccttgctaatttagggtcaag

SEQ ID NO: 230589 - DNA, 25 bp, Rattus norvegicus
cagcccttgctattttagggtcaag

SEQ ID NO: 230590 - DNA, 25 bp, Rattus norvegicus
cagcccttgcttaggaacctgaggt

SEQ ID NO: 230591 - DNA, 25 bp, Rattus norvegicus
cagcccttgcttcacaacagtgtgg

SEQ ID NO: 230592 - DNA, 25 bp, Rattus norvegicus
cagcccttgcttgacaacagtgtgg

SEQ ID NO: 230593 - DNA, 25 bp, Rattus norvegicus
cagcccttgctttggaacctgaggt

SEQ ID NO: 230594 - DNA, 25 bp, Rattus norvegicus
cagcccttggtgaaactagtgagtc

SEQ ID NO: 230595 - DNA, 25 bp, Rattus norvegicus
cagcccttggtgtaactagtgagtc

SEQ ID NO: 230596 - DNA, 25 bp, Rattus norvegicus
cagcccttgttactacaaaactcaa

SEQ ID NO: 230597 - DNA, 25 bp, Rattus norvegicus
cagcccttgttagtacaaaactcaa

SEQ ID NO: 230598 - DNA, 25 bp, Rattus norvegicus
cagccgaaagctccccattaaggga

SEQ ID NO: 230599 - DNA, 25 bp, Rattus norvegicus
cagccgaaagctgcccattaaggga

SEQ ID NO: 230600 - DNA, 25 bp, Rattus norvegicus
cagccgaaaggaagtctcaacgaat

SEQ ID NO: 230601 - DNA, 25 bp, Rattus norvegicus
cagccgaaaggatgtctcaacgaat

SEQ ID NO: 230602 - DNA, 25 bp, Rattus norvegicus
cagccgaagcccagcaggaacgtga

SEQ ID NO: 230603 - DNA, 25 bp, Rattus norvegicus
cagccgaagccctgcaggaacgtga

SEQ ID NO: 230604 - DNA, 25 bp, Rattus norvegicus
cagccgacacacagagtggtattct

SEQ ID NO: 230605 - DNA, 25 bp, Rattus norvegicus
cagccgacacactgagtggtattct

SEQ ID NO: 230606 - DNA, 25 bp, Rattus norvegicus
cagccgagacagcactgctcttagg

SEQ ID NO: 230607 - DNA, 25 bp, Rattus norvegicus
cagccgagacaggactgctcttagg

SEQ ID NO: 230608 - DNA, 25 bp, Rattus norvegicus
cagccgaggcagcttctgagtgact

SEQ ID NO: 230609 - DNA, 25 bp, Rattus norvegicus
cagccgaggcaggttctgagtgact

SEQ ID NO: 230610 - DNA, 25 bp, Rattus norvegicus
cagccgagggccagactgtcttgaa

SEQ ID NO: 230611 - DNA, 25 bp, Rattus norvegicus
cagccgagggcctgactgtcttgaa

SEQ ID NO: 230612 - DNA, 25 bp, Rattus norvegicus
cagccgcaggctaagcactagggta

SEQ ID NO: 230613 - DNA, 25 bp, Rattus norvegicus
cagccgcaggcttagcactagggta

SEQ ID NO: 230614 - DNA, 25 bp, Rattus norvegicus
cagccgcatggtcgtgtcgatattt

SEQ ID NO: 230615 - DNA, 25 bp, Rattus norvegicus
cagccgcatggtggtgtcgatattt

SEQ ID NO: 230616 - DNA, 25 bp, Rattus norvegicus
cagccgccacgaagcagatttttgt

SEQ ID NO: 230617 - DNA, 25 bp, Rattus norvegicus
cagccgccacgatgcagatttttgt

SEQ ID NO: 230618 - DNA, 25 bp, Rattus norvegicus
cagccgccttcgagtgtcccgagtg

SEQ ID NO: 230619 - DNA, 25 bp, Rattus norvegicus
cagccgccttcgtgtgtcccgagtg

SEQ ID NO: 230620 - DNA, 25 bp, Rattus norvegicus
cagccgcctttccttaggtgttggg

SEQ ID NO: 230621 - DNA, 25 bp, Rattus norvegicus
cagccgcctttcgttaggtgttggg

SEQ ID NO: 230622 - DNA, 25 bp, Rattus norvegicus
cagccgcgccatacaggtggtgaga

SEQ ID NO: 230623 - DNA, 25 bp, Rattus norvegicus
cagccgcgccattcaggtggtgaga

SEQ ID NO: 230624 - DNA, 25 bp, Rattus norvegicus
cagccgctgcagacacgaggagaac

SEQ ID NO: 230625 - DNA, 25 bp, Rattus norvegicus
cagccgctgcagtcacgaggagaac

SEQ ID NO: 230626 - DNA, 25 bp, Rattus norvegicus
cagccgctgccaagtgtgcatgaga

SEQ ID NO: 230627 - DNA, 25 bp, Rattus norvegicus
cagccgctgccatgtgtgcatgaga

SEQ ID NO: 230628 - DNA, 25 bp, Rattus norvegicus
cagccgctgtcgagagttctgcagg

SEQ ID NO: 230629 - DNA, 25 bp, Rattus norvegicus
cagccgctgtcgtgagttctgcagg

SEQ ID NO: 230630 - DNA, 25 bp, Rattus norvegicus
cagccggagcggaacacaagcaagg

SEQ ID NO: 230631 - DNA, 25 bp, Rattus norvegicus
cagccggagcggtacacaagcaagg

SEQ ID NO: 230632 - DNA, 25 bp, Rattus norvegicus
cagccggataccctgtctaaaacaa

SEQ ID NO: 230633 - DNA, 25 bp, Rattus norvegicus
cagccggataccgtgtctaaaacaa

SEQ ID NO: 230634 - DNA, 25 bp, Rattus norvegicus
cagccggcaggcattttgtgttgag

SEQ ID NO: 230635 - DNA, 25 bp, Rattus norvegicus
cagccggcaggctttttgtgttgag

SEQ ID NO: 230636 - DNA, 25 bp, Rattus norvegicus
cagccggccgtgacaaattctagta

SEQ ID NO: 230637 - DNA, 25 bp, Rattus norvegicus
cagccggccgtgtcaaattctagta

SEQ ID NO: 230638 - DNA, 25 bp, Rattus norvegicus
cagccggcttggaatccatgtgttt

SEQ ID NO: 230639 - DNA, 25 bp, Rattus norvegicus
cagccggcttggtatccatgtgttt

SEQ ID NO: 230640 - DNA, 25 bp, Rattus norvegicus
cagccgggagttagttctctgagca

SEQ ID NO: 230641 - DNA, 25 bp, Rattus norvegicus
cagccgggagtttgttctctgagca

SEQ ID NO: 230642 - DNA, 25 bp, Rattus norvegicus
cagccggtcccgagagagtagcaga

SEQ ID NO: 230643 - DNA, 25 bp, Rattus norvegicus
cagccggtcccgtgagagtagcaga

SEQ ID NO: 230644 - DNA, 25 bp, Rattus norvegicus
cagccggtgtggaagcatatgttgc

SEQ ID NO: 230645 - DNA, 25 bp, Rattus norvegicus
cagccggtgtggtagcatatgttgc

SEQ ID NO: 230646 - DNA, 25 bp, Rattus norvegicus
cagccgtaaaatctaggtgtctagt

SEQ ID NO: 230647 - DNA, 25 bp, Rattus norvegicus
cagccgtaaaatgtaggtgtctagt

SEQ ID NO: 230648 - DNA, 25 bp, Rattus norvegicus
cagccgtagttgaaatggttcttct

SEQ ID NO: 230649 - DNA, 25 bp, Rattus norvegicus
cagccgtagttgtaatggttcttct

SEQ ID NO: 230650 - DNA, 25 bp, Rattus norvegicus
cagccgtcccctacaagtggtggag

SEQ ID NO: 230651 - DNA, 25 bp, Rattus norvegicus
cagccgtccccttcaagtggtggag

SEQ ID NO: 230652 - DNA, 25 bp, Rattus norvegicus
cagccgtcgcggagagataccaaga

SEQ ID NO: 230653 - DNA, 25 bp, Rattus norvegicus
cagccgtcgcggtgagataccaaga

SEQ ID NO: 230654 - DNA, 25 bp, Rattus norvegicus
cagccgtctgtactacaccagattc

SEQ ID NO: 230655 - DNA, 25 bp, Rattus norvegicus
cagccgtctgtagtacaccagattc

SEQ ID NO: 230656 - DNA, 25 bp, Rattus norvegicus
cagccgtgcctaagttaatcgctag

SEQ ID NO: 230657 - DNA, 25 bp, Rattus norvegicus
cagccgtgcctatgttaatcgctag

SEQ ID NO: 230658 - DNA, 25 bp, Rattus norvegicus
cagccgtggcggattcagtagaagt

SEQ ID NO: 230659 - DNA, 25 bp, Rattus norvegicus
cagccgtggcggtttcagtagaagt

SEQ ID NO: 230660 - DNA, 25 bp, Rattus norvegicus
cagccgttaaaactgcttgctactt

SEQ ID NO: 230661 - DNA, 25 bp, Rattus norvegicus
cagccgttaaaagtgcttgctactt

SEQ ID NO: 230662 - DNA, 25 bp, Rattus norvegicus
cagccgttccacaaaacttggttct

SEQ ID NO: 230663 - DNA, 25 bp, Rattus norvegicus
cagccgttccactaaacttggttct

SEQ ID NO: 230664 - DNA, 25 bp, Rattus norvegicus
cagccgttgacaagcgcgtagcctc

SEQ ID NO: 230665 - DNA, 25 bp, Rattus norvegicus
cagccgttgacatgcgcgtagcctc

SEQ ID NO: 230666 - DNA, 25 bp, Rattus norvegicus
cagccgtttcatccgggttcagaac

SEQ ID NO: 230667 - DNA, 25 bp, Rattus norvegicus
cagccgtttcatgcgggttcagaac

SEQ ID NO: 230668 - DNA, 25 bp, Rattus norvegicus
cagcctaaggatacagggtagctct

SEQ ID NO: 230669 - DNA, 25 bp, Rattus norvegicus
cagcctaaggattcagggtagctct

SEQ ID NO: 230670 - DNA, 25 bp, Rattus norvegicus
cagcctacgattcctaccttaaaag

SEQ ID NO: 230671 - DNA, 25 bp, Rattus norvegicus
cagcctacgattgctaccttaaaag

SEQ ID NO: 230672 - DNA, 25 bp, Rattus norvegicus
cagcctactggtccttgtggcggta

SEQ ID NO: 230673 - DNA, 25 bp, Rattus norvegicus
cagcctactggtgcttgtggcggta

SEQ ID NO: 230674 - DNA, 25 bp, Rattus norvegicus
cagcctagaatgctggtcgcctaga

SEQ ID NO: 230675 - DNA, 25 bp, Rattus norvegicus
cagcctagaatggtggtcgcctaga

SEQ ID NO: 230676 - DNA, 25 bp, Rattus norvegicus
cagcctagaggcatccaatcttgga

SEQ ID NO: 230677 - DNA, 25 bp, Rattus norvegicus
cagcctagaggcttccaatcttgga

SEQ ID NO: 230678 - DNA, 25 bp, Rattus norvegicus
cagcctagcatgagtgtagtttttt

SEQ ID NO: 230679 - DNA, 25 bp, Rattus norvegicus
cagcctagcatgtgtgtagtttttt

SEQ ID NO: 230680 - DNA, 25 bp, Rattus norvegicus
cagcctagccagatagcagctattt

SEQ ID NO: 230681 - DNA, 25 bp, Rattus norvegicus
cagcctagccagttagcagctattt

SEQ ID NO: 230682 - DNA, 25 bp, Rattus norvegicus
cagcctaggaggcttgtttcccaga

SEQ ID NO: 230683 - DNA, 25 bp, Rattus norvegicus
cagcctaggagggttgtttcccaga

SEQ ID NO: 230684 - DNA, 25 bp, Rattus norvegicus
cagcctatactaaacctttcttcac

SEQ ID NO: 230685 - DNA, 25 bp, Rattus norvegicus
cagcctatactatacctttcttcac

SEQ ID NO: 230686 - DNA, 25 bp, Rattus norvegicus
cagcctatagctccggagacctcag

SEQ ID NO: 230687 - DNA, 25 bp, Rattus norvegicus
cagcctatagctgcggagacctcag

SEQ ID NO: 230688 - DNA, 25 bp, Rattus norvegicus
cagcctatgctcagcaattctgcat

SEQ ID NO: 230689 - DNA, 25 bp, Rattus norvegicus
cagcctatgctctgcaattctgcat

SEQ ID NO: 230690 - DNA, 25 bp, Rattus norvegicus
cagcctatggaaatcatcctctctg

SEQ ID NO: 230691 - DNA, 25 bp, Rattus norvegicus
cagcctatggaattcatcctctctg

SEQ ID NO: 230692 - DNA, 25 bp, Rattus norvegicus
cagcctatggatcgcctattttata

SEQ ID NO: 230693 - DNA, 25 bp, Rattus norvegicus
cagcctatggatggcctattttata

SEQ ID NO: 230694 - DNA, 25 bp, Rattus norvegicus
cagcctatgtttatatcgattgaat

SEQ ID NO: 230695 - DNA, 25 bp, Rattus norvegicus
cagcctatgtttttatcgattgaat

SEQ ID NO: 230696 - DNA, 25 bp, Rattus norvegicus
cagcctattcccctttgagaaagaa

SEQ ID NO: 230697 - DNA, 25 bp, Rattus norvegicus
cagcctattcccgtttgagaaagaa

SEQ ID NO: 230698 - DNA, 25 bp, Rattus norvegicus
cagcctcaaacacttcaaaccggaa

SEQ ID NO: 230699 - DNA, 25 bp, Rattus norvegicus
cagcctcaaacagttcaaaccggaa

SEQ ID NO: 230700 - DNA, 25 bp, Rattus norvegicus
cagcctcaaagtcctgtccagggaa

SEQ ID NO: 230701 - DNA, 25 bp, Rattus norvegicus
cagcctcaaagtgctgtccagggaa

SEQ ID NO: 230702 - DNA, 25 bp, Rattus norvegicus
cagcctcaagatcctttccaaaggg

SEQ ID NO: 230703 - DNA, 25 bp, Rattus norvegicus
cagcctcaagatgctttccaaaggg

SEQ ID NO: 230704 - DNA, 25 bp, Rattus norvegicus
cagcctcagagaacttgtttccttc

SEQ ID NO: 230705 - DNA, 25 bp, Rattus norvegicus
cagcctcagagatcttgtttccttc

SEQ ID NO: 230706 - DNA, 25 bp, Rattus norvegicus
cagcctcagcggacatggttaaacc

SEQ ID NO: 230707 - DNA, 25 bp, Rattus norvegicus
cagcctcagcggtcatggttaaacc

SEQ ID NO: 230708 - DNA, 25 bp, Rattus norvegicus
cagcctcagctgattaagtgttttt

SEQ ID NO: 230709 - DNA, 25 bp, Rattus norvegicus
cagcctcagctgtttaagtgttttt

SEQ ID NO: 230710 - DNA, 25 bp, Rattus norvegicus
cagcctcagcttagcccagatgaat

SEQ ID NO: 230711 - DNA, 25 bp, Rattus norvegicus
cagcctcagctttgcccagatgaat

SEQ ID NO: 230712 - DNA, 25 bp, Rattus norvegicus
cagcctcaggatcagagctatctgt

SEQ ID NO: 230713 - DNA, 25 bp, Rattus norvegicus
cagcctcaggatgagagctatctgt

SEQ ID NO: 230714 - DNA, 25 bp, Rattus norvegicus
cagcctcaggcaactgttgcattga

SEQ ID NO: 230715 - DNA, 25 bp, Rattus norvegicus
cagcctcaggcatctgttgcattga

SEQ ID NO: 230716 - DNA, 25 bp, Rattus norvegicus
cagcctcaggctaatggttctactt

SEQ ID NO: 230717 - DNA, 25 bp, Rattus norvegicus
cagcctcaggcttatggttctactt

SEQ ID NO: 230718 - DNA, 25 bp, Rattus norvegicus
cagcctcagttcacaactttcagga

SEQ ID NO: 230719 - DNA, 25 bp, Rattus norvegicus
cagcctcagttctcaactttcagga

SEQ ID NO: 230720 - DNA, 25 bp, Rattus norvegicus
cagcctcatgcacctgtgagcagga

SEQ ID NO: 230721 - DNA, 25 bp, Rattus norvegicus
cagcctcatgcagctgtgagcagga

SEQ ID NO: 230722 - DNA, 25 bp, Rattus norvegicus
cagcctccaagccaaggcaaaagga

SEQ ID NO: 230723 - DNA, 25 bp, Rattus norvegicus
cagcctccaagcgaaggcaaaagga

SEQ ID NO: 230724 - DNA, 25 bp, Rattus norvegicus
cagcctccacaaactctgttttagt

SEQ ID NO: 230725 - DNA, 25 bp, Rattus norvegicus
cagcctccacaatctctgttttagt

SEQ ID NO: 230726 - DNA, 25 bp, Rattus norvegicus
cagcctcccaaaagtatcttttaaa

SEQ ID NO: 230727 - DNA, 25 bp, Rattus norvegicus
cagcctcccaaatgtatcttttaaa

SEQ ID NO: 230728 - DNA, 25 bp, Rattus norvegicus
cagcctccggtgatcggattgtttt

SEQ ID NO: 230729 - DNA, 25 bp, Rattus norvegicus
cagcctccggtgttcggattgtttt

SEQ ID NO: 230730 - DNA, 25 bp, Rattus norvegicus
cagcctcctctgagtactttggaca

SEQ ID NO: 230731 - DNA, 25 bp, Rattus norvegicus
cagcctcctctgtgtactttggaca

SEQ ID NO: 230732 - DNA, 25 bp, Rattus norvegicus
cagcctcgaaatccagcacaaagta

SEQ ID NO: 230733 - DNA, 25 bp, Rattus norvegicus
cagcctcgaaatgcagcacaaagta

SEQ ID NO: 230734 - DNA, 25 bp, Rattus norvegicus
cagcctcgccctcggttgatatgga

SEQ ID NO: 230735 - DNA, 25 bp, Rattus norvegicus
cagcctcgccctgggttgatatgga

SEQ ID NO: 230736 - DNA, 25 bp, Rattus norvegicus
cagcctcggaacagttggtacagaa

SEQ ID NO: 230737 - DNA, 25 bp, Rattus norvegicus
cagcctcggaactgttggtacagaa

SEQ ID NO: 230738 - DNA, 25 bp, Rattus norvegicus
cagcctcggatgctcttcaagttaa

SEQ ID NO: 230739 - DNA, 25 bp, Rattus norvegicus
cagcctcggatggtcttcaagttaa

SEQ ID NO: 230740 - DNA, 25 bp, Rattus norvegicus
cagcctctaattagcacacctgaaa

SEQ ID NO: 230741 - DNA, 25 bp, Rattus norvegicus
cagcctctaatttgcacacctgaaa

SEQ ID NO: 230742 - DNA, 25 bp, Rattus norvegicus
cagcctctcaatctatgtctgtaga

SEQ ID NO: 230743 - DNA, 25 bp, Rattus norvegicus
cagcctctcaatgtatgtctgtaga

SEQ ID NO: 230744 - DNA, 25 bp, Rattus norvegicus
cagcctctcagcatttggagcaaag

SEQ ID NO: 230745 - DNA, 25 bp, Rattus norvegicus
cagcctctcagcttttggagcaaag

SEQ ID NO: 230746 - DNA, 25 bp, Rattus norvegicus
cagcctctctgtcttaatagcacaa

SEQ ID NO: 230747 - DNA, 25 bp, Rattus norvegicus
cagcctctctgtgttaatagcacaa

SEQ ID NO: 230748 - DNA, 25 bp, Rattus norvegicus
cagcctctgacccaggaaatacaaa

SEQ ID NO: 230749 - DNA, 25 bp, Rattus norvegicus
cagcctctgaccgaggaaatacaaa

SEQ ID NO: 230750 - DNA, 25 bp, Rattus norvegicus
cagcctctgctcattaacctaagga

SEQ ID NO: 230751 - DNA, 25 bp, Rattus norvegicus
cagcctctgctctttaacctaagga

SEQ ID NO: 230752 - DNA, 25 bp, Rattus norvegicus
cagcctctgctgagactagaactgg

SEQ ID NO: 230753 - DNA, 25 bp, Rattus norvegicus
cagcctctgctgctggcatgtcaga

SEQ ID NO: 230754 - DNA, 25 bp, Rattus norvegicus
cagcctctgctggtggcatgtcaga

SEQ ID NO: 230755 - DNA, 25 bp, Rattus norvegicus
cagcctctgctgtgactagaactgg

SEQ ID NO: 230756 - DNA, 25 bp, Rattus norvegicus
cagcctctggagacaccgagatgaa

SEQ ID NO: 230757 - DNA, 25 bp, Rattus norvegicus
cagcctctggagtcaccgagatgaa

SEQ ID NO: 230758 - DNA, 25 bp, Rattus norvegicus
cagcctctggctagagaacttacta

SEQ ID NO: 230759 - DNA, 25 bp, Rattus norvegicus
cagcctctggcttgagaacttacta

SEQ ID NO: 230760 - DNA, 25 bp, Rattus norvegicus
cagcctctgtttcactacattttag

SEQ ID NO: 230761 - DNA, 25 bp, Rattus norvegicus
cagcctctgtttgactacattttag

SEQ ID NO: 230762 - DNA, 25 bp, Rattus norvegicus
cagcctcttggaagtgatcccagct

SEQ ID NO: 230763 - DNA, 25 bp, Rattus norvegicus
cagcctcttggatgtgatcccagct

SEQ ID NO: 230764 - DNA, 25 bp, Rattus norvegicus
cagcctcttgtcatgcagatgtaga

SEQ ID NO: 230765 - DNA, 25 bp, Rattus norvegicus
cagcctcttgtcttgcagatgtaga

SEQ ID NO: 230766 - DNA, 25 bp, Rattus norvegicus
cagcctctttagacgctaagcgtta

SEQ ID NO: 230767 - DNA, 25 bp, Rattus norvegicus
cagcctctttagtcgctaagcgtta

SEQ ID NO: 230768 - DNA, 25 bp, Rattus norvegicus
cagcctgaagtgctccaagtgtcaa

SEQ ID NO: 230769 - DNA, 25 bp, Rattus norvegicus
cagcctgaagtggtccaagtgtcaa

SEQ ID NO: 230770 - DNA, 25 bp, Rattus norvegicus
cagcctgaatagatgcctagaccca

SEQ ID NO: 230771 - DNA, 25 bp, Rattus norvegicus
cagcctgaatagttgcctagaccca

SEQ ID NO: 230772 - DNA, 25 bp, Rattus norvegicus
cagcctgaatttccccacaagtggg

SEQ ID NO: 230773 - DNA, 25 bp, Rattus norvegicus
cagcctgaatttgcccacaagtggg

SEQ ID NO: 230774 - DNA, 25 bp, Rattus norvegicus
cagcctgacctccaatttagagctt

SEQ ID NO: 230775 - DNA, 25 bp, Rattus norvegicus
cagcctgacctcgaatttagagctt

SEQ ID NO: 230776 - DNA, 25 bp, Rattus norvegicus
cagcctgacctgagggtatgtagga

SEQ ID NO: 230777 - DNA, 25 bp, Rattus norvegicus
cagcctgacctgtgggtatgtagga

SEQ ID NO: 230778 - DNA, 25 bp, Rattus norvegicus
cagcctgactttaatgccctaattt

SEQ ID NO: 230779 - DNA, 25 bp, Rattus norvegicus
cagcctgacttttatgccctaattt

SEQ ID NO: 230780 - DNA, 25 bp, Rattus norvegicus
cagcctgagcatcggcaatgctttc

SEQ ID NO: 230781 - DNA, 25 bp, Rattus norvegicus
cagcctgagcatgggcaatgctttc

SEQ ID NO: 230782 - DNA, 25 bp, Rattus norvegicus
cagcctgagcgtctaatcccatggg

SEQ ID NO: 230783 - DNA, 25 bp, Rattus norvegicus
cagcctgagcgtgtaatcccatggg

SEQ ID NO: 230784 - DNA, 25 bp, Rattus norvegicus
cagcctgagtgtcgcttcagcacaa

SEQ ID NO: 230785 - DNA, 25 bp, Rattus norvegicus
cagcctgagtgtggcttcagcacaa

SEQ ID NO: 230786 - DNA, 25 bp, Rattus norvegicus
cagcctgatctgcacgatgggttcc

SEQ ID NO: 230787 - DNA, 25 bp, Rattus norvegicus
cagcctgatctggacgatgggttcc

SEQ ID NO: 230788 - DNA, 25 bp, Rattus norvegicus
cagcctgatgggagtcagctacatg

SEQ ID NO: 230789 - DNA, 25 bp, Rattus norvegicus
cagcctgatgggtgtcagctacatg

SEQ ID NO: 230790 - DNA, 25 bp, Rattus norvegicus
cagcctgattgaagacgtagatgcc

SEQ ID NO: 230791 - DNA, 25 bp, Rattus norvegicus
cagcctgattgatgacgtagatgcc

SEQ ID NO: 230792 - DNA, 25 bp, Rattus norvegicus
cagcctgcaattcggataccctgtt

SEQ ID NO: 230793 - DNA, 25 bp, Rattus norvegicus
cagcctgcaattgggataccctgtt

SEQ ID NO: 230794 - DNA, 25 bp, Rattus norvegicus
cagcctgcacctcaacagttatgtg

SEQ ID NO: 230795 - DNA, 25 bp, Rattus norvegicus
cagcctgcacctcccggaaaaggat

SEQ ID NO: 230796 - DNA, 25 bp, Rattus norvegicus
cagcctgcacctgaacagttatgtg

SEQ ID NO: 230797 - DNA, 25 bp, Rattus norvegicus
cagcctgcacctgccggaaaaggat

SEQ ID NO: 230798 - DNA, 25 bp, Rattus norvegicus
cagcctgcactgagtgagcatgaat

SEQ ID NO: 230799 - DNA, 25 bp, Rattus norvegicus
cagcctgcactgtgtgagcatgaat

SEQ ID NO: 230800 - DNA, 25 bp, Rattus norvegicus
cagcctgcacttcctgtagatggag

SEQ ID NO: 230801 - DNA, 25 bp, Rattus norvegicus
cagcctgcacttgctgtagatggag

SEQ ID NO: 230802 - DNA, 25 bp, Rattus norvegicus
cagcctgcagacattacccttttgt

SEQ ID NO: 230803 - DNA, 25 bp, Rattus norvegicus
cagcctgcagactttacccttttgt

SEQ ID NO: 230804 - DNA, 25 bp, Rattus norvegicus
cagcctgccgcaaggtggatgttca

SEQ ID NO: 230805 - DNA, 25 bp, Rattus norvegicus
cagcctgccgcatggtggatgttca

SEQ ID NO: 230806 - DNA, 25 bp, Rattus norvegicus
cagcctgccgctcaaaacatgaaag

SEQ ID NO: 230807 - DNA, 25 bp, Rattus norvegicus
cagcctgccgctgaaaacatgaaag

SEQ ID NO: 230808 - DNA, 25 bp, Rattus norvegicus
cagcctgccggtcccatgatggaca

SEQ ID NO: 230809 - DNA, 25 bp, Rattus norvegicus
cagcctgccggtgccatgatggaca

SEQ ID NO: 230810 - DNA, 25 bp, Rattus norvegicus
cagcctgcctgtagtaatgtgttga

SEQ ID NO: 230811 - DNA, 25 bp, Rattus norvegicus
cagcctgcctgttgtaatgtgttga

SEQ ID NO: 230812 - DNA, 25 bp, Rattus norvegicus
cagcctgccttcactggaagcgcaa

SEQ ID NO: 230813 - DNA, 25 bp, Rattus norvegicus
cagcctgccttctctggaagcgcaa

SEQ ID NO: 230814 - DNA, 25 bp, Rattus norvegicus
cagcctgctctgaagagtgagacca

SEQ ID NO: 230815 - DNA, 25 bp, Rattus norvegicus
cagcctgctctgagagagccagtgt

SEQ ID NO: 230816 - DNA, 25 bp, Rattus norvegicus
cagcctgctctgagatattgtcaca

SEQ ID NO: 230817 - DNA, 25 bp, Rattus norvegicus
cagcctgctctgtagagtgagacca

SEQ ID NO: 230818 - DNA, 25 bp, Rattus norvegicus
cagcctgctctgtgagagccagtgt

SEQ ID NO: 230819 - DNA, 25 bp, Rattus norvegicus
cagcctgctctgtgatattgtcaca

SEQ ID NO: 230820 - DNA, 25 bp, Rattus norvegicus
cagcctgctgacagctgagtgtgga

SEQ ID NO: 230821 - DNA, 25 bp, Rattus norvegicus
cagcctgctgactgctgagtgtgga

SEQ ID NO: 230822 - DNA, 25 bp, Rattus norvegicus
cagcctgctgccataaatctttaaa

SEQ ID NO: 230823 - DNA, 25 bp, Rattus norvegicus
cagcctgctgccttaaatctttaaa

SEQ ID NO: 230824 - DNA, 25 bp, Rattus norvegicus
cagcctgctgtcaaggatgtgacct

SEQ ID NO: 230825 - DNA, 25 bp, Rattus norvegicus
cagcctgctgtctaggatgtgacct

SEQ ID NO: 230826 - DNA, 25 bp, Rattus norvegicus
cagcctggagagatcatcactacgt

SEQ ID NO: 230827 - DNA, 25 bp, Rattus norvegicus
cagcctggagagttcatcactacgt

SEQ ID NO: 230828 - DNA, 25 bp, Rattus norvegicus
cagcctggagccctagctataaata

SEQ ID NO: 230829 - DNA, 25 bp, Rattus norvegicus
cagcctggagccgtagctataaata

SEQ ID NO: 230830 - DNA, 25 bp, Rattus norvegicus
cagcctggcattagggatggaagtt

SEQ ID NO: 230831 - DNA, 25 bp, Rattus norvegicus
cagcctggcatttgggatggaagtt

SEQ ID NO: 230832 - DNA, 25 bp, Rattus norvegicus
cagcctggccaaccttagtctagag

SEQ ID NO: 230833 - DNA, 25 bp, Rattus norvegicus
cagcctggccaagcttagtctagag

SEQ ID NO: 230834 - DNA, 25 bp, Rattus norvegicus
cagcctggccagctattttctctga

SEQ ID NO: 230835 - DNA, 25 bp, Rattus norvegicus
cagcctggccaggtattttctctga

SEQ ID NO: 230836 - DNA, 25 bp, Rattus norvegicus
cagcctggctagatccagtaagtca

SEQ ID NO: 230837 - DNA, 25 bp, Rattus norvegicus
cagcctggctagttccagtaagtca

SEQ ID NO: 230838 - DNA, 25 bp, Rattus norvegicus
cagcctggcttcagtggcaatcact

SEQ ID NO: 230839 - DNA, 25 bp, Rattus norvegicus
cagcctggcttctgtggcaatcact

SEQ ID NO: 230840 - DNA, 25 bp, Rattus norvegicus
cagcctgggcagctgggtggcacag

SEQ ID NO: 230841 - DNA, 25 bp, Rattus norvegicus
cagcctgggcaggtgggtggcacag

SEQ ID NO: 230842 - DNA, 25 bp, Rattus norvegicus
cagcctgggctactttgttgtaaga

SEQ ID NO: 230843 - DNA, 25 bp, Rattus norvegicus
cagcctgggctagtttgttgtaaga

SEQ ID NO: 230844 - DNA, 25 bp, Rattus norvegicus
cagcctgggctcaggcagttggtat

SEQ ID NO: 230845 - DNA, 25 bp, Rattus norvegicus
cagcctgggctctggcagttggtat

SEQ ID NO: 230846 - DNA, 25 bp, Rattus norvegicus
cagcctgggctgaatactatagaca

SEQ ID NO: 230847 - DNA, 25 bp, Rattus norvegicus
cagcctgggctgtatactatagaca

SEQ ID NO: 230848 - DNA, 25 bp, Rattus norvegicus
cagcctgggcttacttttgtggagt

SEQ ID NO: 230849 - DNA, 25 bp, Rattus norvegicus
cagcctgggctttcttttgtggagt

SEQ ID NO: 230850 - DNA, 25 bp, Rattus norvegicus
cagcctggtactcggttaggagcca

SEQ ID NO: 230851 - DNA, 25 bp, Rattus norvegicus
cagcctggtactgggttaggagcca

SEQ ID NO: 230852 - DNA, 25 bp, Rattus norvegicus
cagcctggtgatactgagtgggtaa

SEQ ID NO: 230853 - DNA, 25 bp, Rattus norvegicus
cagcctggtgattctgagtgggtaa

SEQ ID NO: 230854 - DNA, 25 bp, Rattus norvegicus
cagcctggtgggacttcgggaacaa

SEQ ID NO: 230855 - DNA, 25 bp, Rattus norvegicus
cagcctggtgggtcttcgggaacaa

SEQ ID NO: 230856 - DNA, 25 bp, Rattus norvegicus
cagcctggttttaacatagatctag

SEQ ID NO: 230857 - DNA, 25 bp, Rattus norvegicus
cagcctggtttttacatagatctag

SEQ ID NO: 230858 - DNA, 25 bp, Rattus norvegicus
cagcctgtacaacttgctcatagcc

SEQ ID NO: 230859 - DNA, 25 bp, Rattus norvegicus
cagcctgtacaagttgctcatagcc

SEQ ID NO: 230860 - DNA, 25 bp, Rattus norvegicus
cagcctgtaccaccccagtaaatat

SEQ ID NO: 230861 - DNA, 25 bp, Rattus norvegicus
cagcctgtaccagcccagtaaatat

SEQ ID NO: 230862 - DNA, 25 bp, Rattus norvegicus
cagcctgtactgcagagtgggcatc

SEQ ID NO: 230863 - DNA, 25 bp, Rattus norvegicus
cagcctgtactggagagtgggcatc

SEQ ID NO: 230864 - DNA, 25 bp, Rattus norvegicus
cagcctgtatttctgcgagcagtgg

SEQ ID NO: 230865 - DNA, 25 bp, Rattus norvegicus
cagcctgtatttgtgcgagcagtgg

SEQ ID NO: 230866 - DNA, 25 bp, Rattus norvegicus
cagcctgtcactacatatctttcat

SEQ ID NO: 230867 - DNA, 25 bp, Rattus norvegicus
cagcctgtcacttcatatctttcat

SEQ ID NO: 230868 - DNA, 25 bp, Rattus norvegicus
cagcctgtcagtccagaatccaaat

SEQ ID NO: 230869 - DNA, 25 bp, Rattus norvegicus
cagcctgtcagtgcagaatccaaat

SEQ ID NO: 230870 - DNA, 25 bp, Rattus norvegicus
cagcctgtcataacccttatatcaa

SEQ ID NO: 230871 - DNA, 25 bp, Rattus norvegicus
cagcctgtcatatcccttatatcaa

SEQ ID NO: 230872 - DNA, 25 bp, Rattus norvegicus
cagcctgtcctgaaaatattgccaa

SEQ ID NO: 230873 - DNA, 25 bp, Rattus norvegicus
cagcctgtcctgtaaatattgccaa

SEQ ID NO: 230874 - DNA, 25 bp, Rattus norvegicus
cagcctgtctacatagggaggtcca

SEQ ID NO: 230875 - DNA, 25 bp, Rattus norvegicus
cagcctgtctacttagggaggtcca

SEQ ID NO: 230876 - DNA, 25 bp, Rattus norvegicus
cagcctgtcttgcagagcacgggac

SEQ ID NO: 230877 - DNA, 25 bp, Rattus norvegicus
cagcctgtcttggagagcacgggac

SEQ ID NO: 230878 - DNA, 25 bp, Rattus norvegicus
cagcctgtgagtatctgggacactt

SEQ ID NO: 230879 - DNA, 25 bp, Rattus norvegicus
cagcctgtgagtttctgggacactt

SEQ ID NO: 230880 - DNA, 25 bp, Rattus norvegicus
cagcctgtggccatccctaagtggg

SEQ ID NO: 230881 - DNA, 25 bp, Rattus norvegicus
cagcctgtggccttccctaagtggg

SEQ ID NO: 230882 - DNA, 25 bp, Rattus norvegicus
cagcctgtggtcctcttaactaata

SEQ ID NO: 230883 - DNA, 25 bp, Rattus norvegicus
cagcctgtggtcgtcttaactaata

SEQ ID NO: 230884 - DNA, 25 bp, Rattus norvegicus
cagcctgtgtagattcccggtggga

SEQ ID NO: 230885 - DNA, 25 bp, Rattus norvegicus
cagcctgtgtagtttcccggtggga

SEQ ID NO: 230886 - DNA, 25 bp, Rattus norvegicus
cagcctgtgtgtatgtggagtttcc

SEQ ID NO: 230887 - DNA, 25 bp, Rattus norvegicus
cagcctgtgtgtctccagagggcaa

SEQ ID NO: 230888 - DNA, 25 bp, Rattus norvegicus
cagcctgtgtgtgtccagagggcaa

SEQ ID NO: 230889 - DNA, 25 bp, Rattus norvegicus
cagcctgtgtgtttgtggagtttcc

SEQ ID NO: 230890 - DNA, 25 bp, Rattus norvegicus
cagcctgtgtttatataaaagctag

SEQ ID NO: 230891 - DNA, 25 bp, Rattus norvegicus
cagcctgtgtttttataaaagctag

SEQ ID NO: 230892 - DNA, 25 bp, Rattus norvegicus
cagcctgttctgctatgttttgagc

SEQ ID NO: 230893 - DNA, 25 bp, Rattus norvegicus
cagcctgttctggtatgttttgagc

SEQ ID NO: 230894 - DNA, 25 bp, Rattus norvegicus
cagcctgtttagacctttaccaaag

SEQ ID NO: 230895 - DNA, 25 bp, Rattus norvegicus
cagcctgtttagtcctttaccaaag

SEQ ID NO: 230896 - DNA, 25 bp, Rattus norvegicus
cagcctgtttctattgatggaggac

SEQ ID NO: 230897 - DNA, 25 bp, Rattus norvegicus
cagcctgtttcttttgatggaggac

SEQ ID NO: 230898 - DNA, 25 bp, Rattus norvegicus
cagccttaagagagtttgtgtaacc

SEQ ID NO: 230899 - DNA, 25 bp, Rattus norvegicus
cagccttaagagtgtttgtgtaacc

SEQ ID NO: 230900 - DNA, 25 bp, Rattus norvegicus
cagccttaatagactcctcttacat

SEQ ID NO: 230901 - DNA, 25 bp, Rattus norvegicus
cagccttaatagtctcctcttacat

SEQ ID NO: 230902 - DNA, 25 bp, Rattus norvegicus
cagccttacatgcagaacaccaagt

SEQ ID NO: 230903 - DNA, 25 bp, Rattus norvegicus
cagccttacatggagaacaccaagt

SEQ ID NO: 230904 - DNA, 25 bp, Rattus norvegicus
cagccttacctgaggctagcacgac

SEQ ID NO: 230905 - DNA, 25 bp, Rattus norvegicus
cagccttacctgtggctagcacgac

SEQ ID NO: 230906 - DNA, 25 bp, Rattus norvegicus
cagccttattgtagaacttgccagc

SEQ ID NO: 230907 - DNA, 25 bp, Rattus norvegicus
cagccttattgtcactgcattcata

SEQ ID NO: 230908 - DNA, 25 bp, Rattus norvegicus
cagccttattgtgactgcattcata

SEQ ID NO: 230909 - DNA, 25 bp, Rattus norvegicus
cagccttattgttgaacttgccagc

SEQ ID NO: 230910 - DNA, 25 bp, Rattus norvegicus
cagccttcaattacattctcgagtt

SEQ ID NO: 230911 - DNA, 25 bp, Rattus norvegicus
cagccttcaatttcattctcgagtt

SEQ ID NO: 230912 - DNA, 25 bp, Rattus norvegicus
cagccttcatacagagtgtcgacat

SEQ ID NO: 230913 - DNA, 25 bp, Rattus norvegicus
cagccttcatactgagtgtcgacat

SEQ ID NO: 230914 - DNA, 25 bp, Rattus norvegicus
cagccttccacccgaagagaaagca

SEQ ID NO: 230915 - DNA, 25 bp, Rattus norvegicus
cagccttccaccggaagagaaagca

SEQ ID NO: 230916 - DNA, 25 bp, Rattus norvegicus
cagccttccagtacaatacttcaaa

SEQ ID NO: 230917 - DNA, 25 bp, Rattus norvegicus
cagccttccagttcaatacttcaaa

SEQ ID NO: 230918 - DNA, 25 bp, Rattus norvegicus
cagccttccgttctacgaacagtga

SEQ ID NO: 230919 - DNA, 25 bp, Rattus norvegicus
cagccttccgttgtacgaacagtga

SEQ ID NO: 230920 - DNA, 25 bp, Rattus norvegicus
cagccttcctccatgaagaatagca

SEQ ID NO: 230921 - DNA, 25 bp, Rattus norvegicus
cagccttcctccttgaagaatagca

SEQ ID NO: 230922 - DNA, 25 bp, Rattus norvegicus
cagccttcctgcaagaatctcataa

SEQ ID NO: 230923 - DNA, 25 bp, Rattus norvegicus
cagccttcctgctagaatctcataa

SEQ ID NO: 230924 - DNA, 25 bp, Rattus norvegicus
cagccttccttgctctttcttctta

SEQ ID NO: 230925 - DNA, 25 bp, Rattus norvegicus
cagccttccttggtctttcttctta

SEQ ID NO: 230926 - DNA, 25 bp, Rattus norvegicus
cagccttcctttatcggtatggagt

SEQ ID NO: 230927 - DNA, 25 bp, Rattus norvegicus
cagccttcctttttcggtatggagt

SEQ ID NO: 230928 - DNA, 25 bp, Rattus norvegicus
cagccttcgcctataacaactgaat

SEQ ID NO: 230929 - DNA, 25 bp, Rattus norvegicus
cagccttcgcctttaacaactgaat

SEQ ID NO: 230930 - DNA, 25 bp, Rattus norvegicus
cagccttcggacacaacttgttgat

SEQ ID NO: 230931 - DNA, 25 bp, Rattus norvegicus
cagccttcggactcaacttgttgat

SEQ ID NO: 230932 - DNA, 25 bp, Rattus norvegicus
cagccttctagcacaaacacttttt

SEQ ID NO: 230933 - DNA, 25 bp, Rattus norvegicus
cagccttctagctcaaacacttttt

SEQ ID NO: 230934 - DNA, 25 bp, Rattus norvegicus
cagccttctcacaggtggttcctca

SEQ ID NO: 230935 - DNA, 25 bp, Rattus norvegicus
cagccttctcactggtggttcctca

SEQ ID NO: 230936 - DNA, 25 bp, Rattus norvegicus
cagccttctctgcagggtatttggg

SEQ ID NO: 230937 - DNA, 25 bp, Rattus norvegicus
cagccttctctggagggtatttggg

SEQ ID NO: 230938 - DNA, 25 bp, Rattus norvegicus
cagccttctgatattttgctactgt

SEQ ID NO: 230939 - DNA, 25 bp, Rattus norvegicus
cagccttctgattttttgctactgt

SEQ ID NO: 230940 - DNA, 25 bp, Rattus norvegicus
cagccttcttcacagttgtgaccag

SEQ ID NO: 230941 - DNA, 25 bp, Rattus norvegicus
cagccttcttcagagttgtgaccag

SEQ ID NO: 230942 - DNA, 25 bp, Rattus norvegicus
cagccttgaaggaggcatgagcaaa

SEQ ID NO: 230943 - DNA, 25 bp, Rattus norvegicus
cagccttgaaggtggcatgagcaaa

SEQ ID NO: 230944 - DNA, 25 bp, Rattus norvegicus
cagccttgagagcacgccttaaaaa

SEQ ID NO: 230945 - DNA, 25 bp, Rattus norvegicus
cagccttgagaggacgccttaaaaa

SEQ ID NO: 230946 - DNA, 25 bp, Rattus norvegicus
cagccttgagcaataactgccaggt

SEQ ID NO: 230947 - DNA, 25 bp, Rattus norvegicus
cagccttgagcattaactgccaggt

SEQ ID NO: 230948 - DNA, 25 bp, Rattus norvegicus
cagccttgcttgattttaccagtat

SEQ ID NO: 230949 - DNA, 25 bp, Rattus norvegicus
cagccttgcttgtttttaccagtat

SEQ ID NO: 230950 - DNA, 25 bp, Rattus norvegicus
cagccttggaccacaggtggctgaa

SEQ ID NO: 230951 - DNA, 25 bp, Rattus norvegicus
cagccttggacctcaggtggctgaa

SEQ ID NO: 230952 - DNA, 25 bp, Rattus norvegicus
cagccttggagcctcagctgcagag

SEQ ID NO: 230953 - DNA, 25 bp, Rattus norvegicus
cagccttggagcgtcagctgcagag

SEQ ID NO: 230954 - DNA, 25 bp, Rattus norvegicus
cagccttggcttagaaatccagctt

SEQ ID NO: 230955 - DNA, 25 bp, Rattus norvegicus
cagccttggctttgaaatccagctt

SEQ ID NO: 230956 - DNA, 25 bp, Rattus norvegicus
cagccttgggatacactactctggg

SEQ ID NO: 230957 - DNA, 25 bp, Rattus norvegicus
cagccttgggattcactactctggg

SEQ ID NO: 230958 - DNA, 25 bp, Rattus norvegicus
cagccttgggctaaactacgttgtt

SEQ ID NO: 230959 - DNA, 25 bp, Rattus norvegicus
cagccttgggcttaactacgttgtt

SEQ ID NO: 230960 - DNA, 25 bp, Rattus norvegicus
cagccttgtggcatgaagtctttta

SEQ ID NO: 230961 - DNA, 25 bp, Rattus norvegicus
cagccttgtggcttgaagtctttta

SEQ ID NO: 230962 - DNA, 25 bp, Rattus norvegicus
cagccttgtggtattaatgcctgct

SEQ ID NO: 230963 - DNA, 25 bp, Rattus norvegicus
cagccttgtggttttaatgcctgct

SEQ ID NO: 230964 - DNA, 25 bp, Rattus norvegicus
cagcctttactcatttatcacatac

SEQ ID NO: 230965 - DNA, 25 bp, Rattus norvegicus
cagcctttactcttttatcacatac

SEQ ID NO: 230966 - DNA, 25 bp, Rattus norvegicus
cagcctttatgtcccagattcttaa

SEQ ID NO: 230967 - DNA, 25 bp, Rattus norvegicus
cagcctttatgtcctagattattag

SEQ ID NO: 230968 - DNA, 25 bp, Rattus norvegicus
cagcctttatgtgccagattcttaa

SEQ ID NO: 230969 - DNA, 25 bp, Rattus norvegicus
cagcctttatgtgctagattattag

SEQ ID NO: 230970 - DNA, 25 bp, Rattus norvegicus
cagcctttcaggagcatggttttac

SEQ ID NO: 230971 - DNA, 25 bp, Rattus norvegicus
cagcctttcaggtgcatggttttac

SEQ ID NO: 230972 - DNA, 25 bp, Rattus norvegicus
cagcctttcatcatccacaattgag

SEQ ID NO: 230973 - DNA, 25 bp, Rattus norvegicus
cagcctttcatcttccacaattgag

SEQ ID NO: 230974 - DNA, 25 bp, Rattus norvegicus
cagcctttccctcatacagcataat

SEQ ID NO: 230975 - DNA, 25 bp, Rattus norvegicus
cagcctttccctgatacagcataat

SEQ ID NO: 230976 - DNA, 25 bp, Rattus norvegicus
cagcctttccgacctaacagtgtaa

SEQ ID NO: 230977 - DNA, 25 bp, Rattus norvegicus
cagcctttccgagctaacagtgtaa

SEQ ID NO: 230978 - DNA, 25 bp, Rattus norvegicus
cagcctttcctcatttttaatgtat

SEQ ID NO: 230979 - DNA, 25 bp, Rattus norvegicus
cagcctttcctcttttttaatgtat

SEQ ID NO: 230980 - DNA, 25 bp, Rattus norvegicus
cagcctttcgaactctcttgataag

SEQ ID NO: 230981 - DNA, 25 bp, Rattus norvegicus
cagcctttcgaagtctcttgataag

SEQ ID NO: 230982 - DNA, 25 bp, Rattus norvegicus
cagcctttctgcataattcccagtc

SEQ ID NO: 230983 - DNA, 25 bp, Rattus norvegicus
cagcctttctgcttaattcccagtc

SEQ ID NO: 230984 - DNA, 25 bp, Rattus norvegicus
cagcctttgaggcagactttcactt

SEQ ID NO: 230985 - DNA, 25 bp, Rattus norvegicus
cagcctttgagggagactttcactt

SEQ ID NO: 230986 - DNA, 25 bp, Rattus norvegicus
cagcctttgccactatgtattccta

SEQ ID NO: 230987 - DNA, 25 bp, Rattus norvegicus
cagcctttgccagtatgtattccta

SEQ ID NO: 230988 - DNA, 25 bp, Rattus norvegicus
cagcctttgttcatggatgccttta

SEQ ID NO: 230989 - DNA, 25 bp, Rattus norvegicus
cagcctttgttcttggatgccttta

SEQ ID NO: 230990 - DNA, 25 bp, Rattus norvegicus
cagccttttccaccacagagggtta

SEQ ID NO: 230991 - DNA, 25 bp, Rattus norvegicus
cagccttttccagcacagagggtta

SEQ ID NO: 230992 - DNA, 25 bp, Rattus norvegicus
cagccttttgctctgtaatgctttt

SEQ ID NO: 230993 - DNA, 25 bp, Rattus norvegicus
cagccttttgctgtgtaatgctttt

SEQ ID NO: 230994 - DNA, 25 bp, Rattus norvegicus
cagcctttttaccagtgtggccaaa

SEQ ID NO: 230995 - DNA, 25 bp, Rattus norvegicus
cagcctttttacgagtgtggccaaa

SEQ ID NO: 230996 - DNA, 25 bp, Rattus norvegicus
cagcgaagtacaatccgttcacggg

SEQ ID NO: 230997 - DNA, 25 bp, Rattus norvegicus
cagcgaagtacattccgttcacggg

SEQ ID NO: 230998 - DNA, 25 bp, Rattus norvegicus
cagcgaagtggccagaaccaccttg

SEQ ID NO: 230999 - DNA, 25 bp, Rattus norvegicus
cagcgaagtggcgagaaccaccttg

SEQ ID NO: 231000 - DNA, 25 bp, Rattus norvegicus
cagcgaatctagctcctctgacagt

SEQ ID NO: 231001 - DNA, 25 bp, Rattus norvegicus
cagcgaatctaggtcctctgacagt

SEQ ID NO: 231002 - DNA, 25 bp, Rattus norvegicus
cagcgaatgccacccaattgaacat

SEQ ID NO: 231003 - DNA, 25 bp, Rattus norvegicus
cagcgaatgccagccaattgaacat

SEQ ID NO: 231004 - DNA, 25 bp, Rattus norvegicus
cagcgaccaggacattgacttcaag

SEQ ID NO: 231005 - DNA, 25 bp, Rattus norvegicus
cagcgaccaggagattgacttcaag

SEQ ID NO: 231006 - DNA, 25 bp, Rattus norvegicus
cagcgacgacgcctgcgcaaagagc

SEQ ID NO: 231007 - DNA, 25 bp, Rattus norvegicus
cagcgacgacgcgtgcgcaaagagc

SEQ ID NO: 231008 - DNA, 25 bp, Rattus norvegicus
cagcgacgtcacacagggcaacagt

SEQ ID NO: 231009 - DNA, 25 bp, Rattus norvegicus
cagcgacgtcactcagggcaacagt

SEQ ID NO: 231010 - DNA, 25 bp, Rattus norvegicus
cagcgactgcatcgcctcaatggga

SEQ ID NO: 231011 - DNA, 25 bp, Rattus norvegicus
cagcgactgcatggcctcaatggga

SEQ ID NO: 231012 - DNA, 25 bp, Rattus norvegicus
cagcgacttcctcaagatcaacgta

SEQ ID NO: 231013 - DNA, 25 bp, Rattus norvegicus
cagcgacttcctgaagatcaacgta

SEQ ID NO: 231014 - DNA, 25 bp, Rattus norvegicus
cagcgactttgtatacattcccgaa

SEQ ID NO: 231015 - DNA, 25 bp, Rattus norvegicus
cagcgactttgtttacattcccgaa

SEQ ID NO: 231016 - DNA, 25 bp, Rattus norvegicus
cagcgagaaaacatacctgcttccc

SEQ ID NO: 231017 - DNA, 25 bp, Rattus norvegicus
cagcgagaaaacttacctgcttccc

SEQ ID NO: 231018 - DNA, 25 bp, Rattus norvegicus
cagcgagaccagcaagtattcctta

SEQ ID NO: 231019 - DNA, 25 bp, Rattus norvegicus
cagcgagaccaggaagtattcctta

SEQ ID NO: 231020 - DNA, 25 bp, Rattus norvegicus
cagcgagatctgcacggttcagaat

SEQ ID NO: 231021 - DNA, 25 bp, Rattus norvegicus
cagcgagatctggacggttcagaat

SEQ ID NO: 231022 - DNA, 25 bp, Rattus norvegicus
cagcgagcagctccgaagcttcagc

SEQ ID NO: 231023 - DNA, 25 bp, Rattus norvegicus
cagcgagcagctgcgaagcttcagc

SEQ ID NO: 231024 - DNA, 25 bp, Rattus norvegicus
cagcgagcaggacccacgtcggtca

SEQ ID NO: 231025 - DNA, 25 bp, Rattus norvegicus
cagcgagcaggagccacgtcggtca

SEQ ID NO: 231026 - DNA, 25 bp, Rattus norvegicus
cagcgagcctcgactacacgaagag

SEQ ID NO: 231027 - DNA, 25 bp, Rattus norvegicus
cagcgagcctcgtctacacgaagag

SEQ ID NO: 231028 - DNA, 25 bp, Rattus norvegicus
cagcgagctgtacctctgagctcaa

SEQ ID NO: 231029 - DNA, 25 bp, Rattus norvegicus
cagcgagctgtagctctgagctcaa

SEQ ID NO: 231030 - DNA, 25 bp, Rattus norvegicus
cagcgaggccagaactcaccagaaa

SEQ ID NO: 231031 - DNA, 25 bp, Rattus norvegicus
cagcgaggccagtactcaccagaaa

SEQ ID NO: 231032 - DNA, 25 bp, Rattus norvegicus
cagcgaggctggacgtctgaatgca

SEQ ID NO: 231033 - DNA, 25 bp, Rattus norvegicus
cagcgaggctggtcgtctgaatgca

SEQ ID NO: 231034 - DNA, 25 bp, Rattus norvegicus
cagcgaggcttgatttctccagaat

SEQ ID NO: 231035 - DNA, 25 bp, Rattus norvegicus
cagcgaggcttgttttctccagaat

SEQ ID NO: 231036 - DNA, 25 bp, Rattus norvegicus
cagcgaggtcctcttttggagttag

SEQ ID NO: 231037 - DNA, 25 bp, Rattus norvegicus
cagcgaggtcctgttttggagttag

SEQ ID NO: 231038 - DNA, 25 bp, Rattus norvegicus
cagcgagtctctcgaaaatggagag

SEQ ID NO: 231039 - DNA, 25 bp, Rattus norvegicus
cagcgagtctctggaaaatggagag

SEQ ID NO: 231040 - DNA, 25 bp, Rattus norvegicus
cagcgagtggacaagattttcagca

SEQ ID NO: 231041 - DNA, 25 bp, Rattus norvegicus
cagcgagtggactagattttcagca

SEQ ID NO: 231042 - DNA, 25 bp, Rattus norvegicus
cagcgataatccacctttacaacaa

SEQ ID NO: 231043 - DNA, 25 bp, Rattus norvegicus
cagcgataatcctcctttacaacaa

SEQ ID NO: 231044 - DNA, 25 bp, Rattus norvegicus
cagcgataatctcaagtgcaaacat

SEQ ID NO: 231045 - DNA, 25 bp, Rattus norvegicus
cagcgataatctgaagtgcaaacat

SEQ ID NO: 231046 - DNA, 25 bp, Rattus norvegicus
cagcgatgctgccttctgtttgctt

SEQ ID NO: 231047 - DNA, 25 bp, Rattus norvegicus
cagcgatgctgcgttctgtttgctt

SEQ ID NO: 231048 - DNA, 25 bp, Rattus norvegicus
cagcgatgggtcaccaggcaagtcc

SEQ ID NO: 231049 - DNA, 25 bp, Rattus norvegicus
cagcgatgggtctccaggcaagtcc

SEQ ID NO: 231050 - DNA, 25 bp, Rattus norvegicus
cagcgattcagtattctggacccat

SEQ ID NO: 231051 - DNA, 25 bp, Rattus norvegicus
cagcgattcagttttctggacccat

SEQ ID NO: 231052 - DNA, 25 bp, Rattus norvegicus
cagcgattgcaactggcctggccgc

SEQ ID NO: 231053 - DNA, 25 bp, Rattus norvegicus
cagcgattgcaagtggcctggccgc

SEQ ID NO: 231054 - DNA, 25 bp, Rattus norvegicus
cagcgattgtccagtgggagccatg

SEQ ID NO: 231055 - DNA, 25 bp, Rattus norvegicus
cagcgattgtcctgtgggagccatg

SEQ ID NO: 231056 - DNA, 25 bp, Rattus norvegicus
cagcgatttacaccgattaacaccc

SEQ ID NO: 231057 - DNA, 25 bp, Rattus norvegicus
cagcgatttacagcgattaacaccc

SEQ ID NO: 231058 - DNA, 25 bp, Rattus norvegicus
cagcgatttcgaccgagttcgggat

SEQ ID NO: 231059 - DNA, 25 bp, Rattus norvegicus
cagcgatttcgagcgagttcgggat

SEQ ID NO: 231060 - DNA, 25 bp, Rattus norvegicus
cagcgattttctatatgatcttaat

SEQ ID NO: 231061 - DNA, 25 bp, Rattus norvegicus
cagcgattttctttatgatcttaat

SEQ ID NO: 231062 - DNA, 25 bp, Rattus norvegicus
cagcgcaactgtcaggatgtgatcc

SEQ ID NO: 231063 - DNA, 25 bp, Rattus norvegicus
cagcgcaactgtgaggatgtgatcc

SEQ ID NO: 231064 - DNA, 25 bp, Rattus norvegicus
cagcgcaccgagacacgggccgagt

SEQ ID NO: 231065 - DNA, 25 bp, Rattus norvegicus
cagcgcaccgagtcacgggccgagt

SEQ ID NO: 231066 - DNA, 25 bp, Rattus norvegicus
cagcgcaggagaacgtcgtcgtgat

SEQ ID NO: 231067 - DNA, 25 bp, Rattus norvegicus
cagcgcaggagatcgtcgtcgtgat

SEQ ID NO: 231068 - DNA, 25 bp, Rattus norvegicus
cagcgcaggcggacatcagtgtctc

SEQ ID NO: 231069 - DNA, 25 bp, Rattus norvegicus
cagcgcaggcggtcatcagtgtctc

SEQ ID NO: 231070 - DNA, 25 bp, Rattus norvegicus
cagcgcaggtgtcgcagtctgttac

SEQ ID NO: 231071 - DNA, 25 bp, Rattus norvegicus
cagcgcaggtgtggcagtctgttac

SEQ ID NO: 231072 - DNA, 25 bp, Rattus norvegicus
cagcgcattccaagctctgagtttg

SEQ ID NO: 231073 - DNA, 25 bp, Rattus norvegicus
cagcgcattccatgctctgagtttg

SEQ ID NO: 231074 - DNA, 25 bp, Rattus norvegicus
cagcgccacaagctgaagtcccagg

SEQ ID NO: 231075 - DNA, 25 bp, Rattus norvegicus
cagcgccacaaggtgaagtcccagg

SEQ ID NO: 231076 - DNA, 25 bp, Rattus norvegicus
cagcgccacctgatgcaaagggtat

SEQ ID NO: 231077 - DNA, 25 bp, Rattus norvegicus
cagcgccacctgttgcaaagggtat

SEQ ID NO: 231078 - DNA, 25 bp, Rattus norvegicus
cagcgcccatgtcaggtgactcaca

SEQ ID NO: 231079 - DNA, 25 bp, Rattus norvegicus
cagcgcccatgtgaggtgactcaca

SEQ ID NO: 231080 - DNA, 25 bp, Rattus norvegicus
cagcgccgagggaataaatcatcaa

SEQ ID NO: 231081 - DNA, 25 bp, Rattus norvegicus
cagcgccgagggtataaatcatcaa

SEQ ID NO: 231082 - DNA, 25 bp, Rattus norvegicus
cagcgccgccttatcaaattttgtt

SEQ ID NO: 231083 - DNA, 25 bp, Rattus norvegicus
cagcgccgccttttcaaattttgtt

SEQ ID NO: 231084 - DNA, 25 bp, Rattus norvegicus
cagcgccgggccagcgtttcgcttt

SEQ ID NO: 231085 - DNA, 25 bp, Rattus norvegicus
cagcgccgggcctgcgtttcgcttt

SEQ ID NO: 231086 - DNA, 25 bp, Rattus norvegicus
cagcgcctgcagagaagatgtccca

SEQ ID NO: 231087 - DNA, 25 bp, Rattus norvegicus
cagcgcctgcagtgaagatgtccca

SEQ ID NO: 231088 - DNA, 25 bp, Rattus norvegicus
cagcgcctgtttattcctactttaa

SEQ ID NO: 231089 - DNA, 25 bp, Rattus norvegicus
cagcgcctgttttttcctactttaa

SEQ ID NO: 231090 - DNA, 25 bp, Rattus norvegicus
cagcgcgctggcagttttaactggg

SEQ ID NO: 231091 - DNA, 25 bp, Rattus norvegicus
cagcgcgctggctgttttaactggg

SEQ ID NO: 231092 - DNA, 25 bp, Rattus norvegicus
cagcgcgggccgatcctcttgtctg

SEQ ID NO: 231093 - DNA, 25 bp, Rattus norvegicus
cagcgcgggccgttcctcttgtctg

SEQ ID NO: 231094 - DNA, 25 bp, Rattus norvegicus
cagcgctcagaacacgtagaacgga

SEQ ID NO: 231095 - DNA, 25 bp, Rattus norvegicus
cagcgctcagaagacgtagaacgga

SEQ ID NO: 231096 - DNA, 25 bp, Rattus norvegicus
cagcgctcagctctgtggcatgaac

SEQ ID NO: 231097 - DNA, 25 bp, Rattus norvegicus
cagcgctcagctgtgtggcatgaac

SEQ ID NO: 231098 - DNA, 25 bp, Rattus norvegicus
cagcgctcagggaccttggatatat

SEQ ID NO: 231099 - DNA, 25 bp, Rattus norvegicus
cagcgctcagggtccttggatatat

SEQ ID NO: 231100 - DNA, 25 bp, Rattus norvegicus
cagcgctgctagctacatgctcttt

SEQ ID NO: 231101 - DNA, 25 bp, Rattus norvegicus
cagcgctgctaggtacatgctcttt

SEQ ID NO: 231102 - DNA, 25 bp, Rattus norvegicus
cagcgcttcctgcttatgcaaatca

SEQ ID NO: 231103 - DNA, 25 bp, Rattus norvegicus
cagcgcttcctggttatgcaaatca

SEQ ID NO: 231104 - DNA, 25 bp, Rattus norvegicus
cagcgcttcgaacgttttctggaac

SEQ ID NO: 231105 - DNA, 25 bp, Rattus norvegicus
cagcgcttcgaaggttttctggaac

SEQ ID NO: 231106 - DNA, 25 bp, Rattus norvegicus
cagcgcttctccataacctgggcaa

SEQ ID NO: 231107 - DNA, 25 bp, Rattus norvegicus
cagcgcttctccttaacctgggcaa

SEQ ID NO: 231108 - DNA, 25 bp, Rattus norvegicus
cagcgctttcaaaatgaagtggatt

SEQ ID NO: 231109 - DNA, 25 bp, Rattus norvegicus
cagcgctttcaatatgaagtggatt

SEQ ID NO: 231110 - DNA, 25 bp, Rattus norvegicus
cagcggaaacacaagcggattctat

SEQ ID NO: 231111 - DNA, 25 bp, Rattus norvegicus
cagcggaaacactagcggattctat

SEQ ID NO: 231112 - DNA, 25 bp, Rattus norvegicus
cagcggaatcccatgtaatttcagt

SEQ ID NO: 231113 - DNA, 25 bp, Rattus norvegicus
cagcggaatcccttgtaatttcagt

SEQ ID NO: 231114 - DNA, 25 bp, Rattus norvegicus
cagcggagaggaagagcagttctta

SEQ ID NO: 231115 - DNA, 25 bp, Rattus norvegicus
cagcggagaggatgagcagttctta

SEQ ID NO: 231116 - DNA, 25 bp, Rattus norvegicus
cagcggatacacaggcctcacaagc

SEQ ID NO: 231117 - DNA, 25 bp, Rattus norvegicus
cagcggatacactggcctcacaagc

SEQ ID NO: 231118 - DNA, 25 bp, Rattus norvegicus
cagcggatggctctttgtacattta

SEQ ID NO: 231119 - DNA, 25 bp, Rattus norvegicus
cagcggatggctgtttgtacattta

SEQ ID NO: 231120 - DNA, 25 bp, Rattus norvegicus
cagcggatggtcacaggatgttaaa

SEQ ID NO: 231121 - DNA, 25 bp, Rattus norvegicus
cagcggatggtctcaggatgttaaa

SEQ ID NO: 231122 - DNA, 25 bp, Rattus norvegicus
cagcggcaccgtatatccagacagc

SEQ ID NO: 231123 - DNA, 25 bp, Rattus norvegicus
cagcggcaccgtttatccagacagc

SEQ ID NO: 231124 - DNA, 25 bp, Rattus norvegicus
cagcggcagctcagattttggaaaa

SEQ ID NO: 231125 - DNA, 25 bp, Rattus norvegicus
cagcggcagctctgattttggaaaa

SEQ ID NO: 231126 - DNA, 25 bp, Rattus norvegicus
cagcggcatttgctcgggcagccgc

SEQ ID NO: 231127 - DNA, 25 bp, Rattus norvegicus
cagcggcatttggtcgggcagccgc

SEQ ID NO: 231128 - DNA, 25 bp, Rattus norvegicus
cagcggccacttcttgcgggagaac

SEQ ID NO: 231129 - DNA, 25 bp, Rattus norvegicus
cagcggccacttgttgcgggagaac

SEQ ID NO: 231130 - DNA, 25 bp, Rattus norvegicus
cagcggccagtcaagactcttgtga

SEQ ID NO: 231131 - DNA, 25 bp, Rattus norvegicus
cagcggccagtctagactcttgtga

SEQ ID NO: 231132 - DNA, 25 bp, Rattus norvegicus
cagcggccatgtccagattggttta

SEQ ID NO: 231133 - DNA, 25 bp, Rattus norvegicus
cagcggccatgtgcagattggttta

SEQ ID NO: 231134 - DNA, 25 bp, Rattus norvegicus
cagcggcgcaataccactaaatgac

SEQ ID NO: 231135 - DNA, 25 bp, Rattus norvegicus
cagcggcgcaattccactaaatgac

SEQ ID NO: 231136 - DNA, 25 bp, Rattus norvegicus
cagcggcgccagagctcgcagtcag

SEQ ID NO: 231137 - DNA, 25 bp, Rattus norvegicus
cagcggcgccagtgctcgcagtcag

SEQ ID NO: 231138 - DNA, 25 bp, Rattus norvegicus
cagcggcggccgacgcggcttcgga

SEQ ID NO: 231139 - DNA, 25 bp, Rattus norvegicus
cagcggcggccgtcgcggcttcgga

SEQ ID NO: 231140 - DNA, 25 bp, Rattus norvegicus
cagcggcggcggcttgtcctcgagg

SEQ ID NO: 231141 - DNA, 25 bp, Rattus norvegicus
cagcggcggcgggttgtcctcgagg

SEQ ID NO: 231142 - DNA, 25 bp, Rattus norvegicus
cagcggcgggcccatttgtgcggcc

SEQ ID NO: 231143 - DNA, 25 bp, Rattus norvegicus
cagcggcgggccgatttgtgcggcc

SEQ ID NO: 231144 - DNA, 25 bp, Rattus norvegicus
cagcggctgcctctacagtaagaac

SEQ ID NO: 231145 - DNA, 25 bp, Rattus norvegicus
cagcggctgcctgtacagtaagaac

SEQ ID NO: 231146 - DNA, 25 bp, Rattus norvegicus
cagcggctgcttctcttgatgaggt

SEQ ID NO: 231147 - DNA, 25 bp, Rattus norvegicus
cagcggctgcttgtcttgatgaggt

SEQ ID NO: 231148 - DNA, 25 bp, Rattus norvegicus
cagcgggaaaatcgcggcgggctct

SEQ ID NO: 231149 - DNA, 25 bp, Rattus norvegicus
cagcgggaaaatggcggcgggctct

SEQ ID NO: 231150 - DNA, 25 bp, Rattus norvegicus
cagcgggaacacctatgcctacggg

SEQ ID NO: 231151 - DNA, 25 bp, Rattus norvegicus
cagcgggaacacgtatgcctacggg

SEQ ID NO: 231152 - DNA, 25 bp, Rattus norvegicus
cagcgggacgcgctcatttaagaag

SEQ ID NO: 231153 - DNA, 25 bp, Rattus norvegicus
cagcgggacgcggtcatttaagaag

SEQ ID NO: 231154 - DNA, 25 bp, Rattus norvegicus
cagcgggatccaccttacaatagaa

SEQ ID NO: 231155 - DNA, 25 bp, Rattus norvegicus
cagcgggatccagcttacaatagaa

SEQ ID NO: 231156 - DNA, 25 bp, Rattus norvegicus
cagcgggcactgacggttactcgca

SEQ ID NO: 231157 - DNA, 25 bp, Rattus norvegicus
cagcgggcactgtcggttactcgca

SEQ ID NO: 231158 - DNA, 25 bp, Rattus norvegicus
cagcgggcttttccttttgttctcc

SEQ ID NO: 231159 - DNA, 25 bp, Rattus norvegicus
cagcgggcttttgcttttgttctcc

SEQ ID NO: 231160 - DNA, 25 bp, Rattus norvegicus
cagcgggtatggcatcctatgtgcc

SEQ ID NO: 231161 - DNA, 25 bp, Rattus norvegicus
cagcgggtatgggatcctatgtgcc

SEQ ID NO: 231162 - DNA, 25 bp, Rattus norvegicus
cagcgggtccaacacaaagccggga

SEQ ID NO: 231163 - DNA, 25 bp, Rattus norvegicus
cagcgggtccaagacaaagccggga

SEQ ID NO: 231164 - DNA, 25 bp, Rattus norvegicus
cagcgggtgaacagctaccttggat

SEQ ID NO: 231165 - DNA, 25 bp, Rattus norvegicus
cagcgggtgaactgctaccttggat

SEQ ID NO: 231166 - DNA, 25 bp, Rattus norvegicus
cagcgggtggcaagaggcctttcct

SEQ ID NO: 231167 - DNA, 25 bp, Rattus norvegicus
cagcgggtggcatgaggcctttcct

SEQ ID NO: 231168 - DNA, 25 bp, Rattus norvegicus
cagcggtactacattgagggcatca

SEQ ID NO: 231169 - DNA, 25 bp, Rattus norvegicus
cagcggtactactttgagggcatca

SEQ ID NO: 231170 - DNA, 25 bp, Rattus norvegicus
cagcggtctagtattgagtctttcc

SEQ ID NO: 231171 - DNA, 25 bp, Rattus norvegicus
cagcggtctagttttgagtctttcc

SEQ ID NO: 231172 - DNA, 25 bp, Rattus norvegicus
cagcggtctctgctgtgcagaatta

SEQ ID NO: 231173 - DNA, 25 bp, Rattus norvegicus
cagcggtctctggtgtgcagaatta

SEQ ID NO: 231174 - DNA, 25 bp, Rattus norvegicus
cagcggtgctgccattgtaattcca

SEQ ID NO: 231175 - DNA, 25 bp, Rattus norvegicus
cagcggtgctgcgattgtaattcca

SEQ ID NO: 231176 - DNA, 25 bp, Rattus norvegicus
cagcggtggcacatggaagtcccat

SEQ ID NO: 231177 - DNA, 25 bp, Rattus norvegicus
cagcggtggcacttggaagtcccat

SEQ ID NO: 231178 - DNA, 25 bp, Rattus norvegicus
cagcggtgtcatctgctctgaaaca

SEQ ID NO: 231179 - DNA, 25 bp, Rattus norvegicus
cagcggtgtcatgtgctctgaaaca

SEQ ID NO: 231180 - DNA, 25 bp, Rattus norvegicus
cagcggttgctacgatacatcgtca

SEQ ID NO: 231181 - DNA, 25 bp, Rattus norvegicus
cagcggttgctaggatacatcgtca

SEQ ID NO: 231182 - DNA, 25 bp, Rattus norvegicus
cagcggttgctgactgtgtattcag

SEQ ID NO: 231183 - DNA, 25 bp, Rattus norvegicus
cagcggttgctgtctgtgtattcag

SEQ ID NO: 231184 - DNA, 25 bp, Rattus norvegicus
cagcgtagcaccacctttgagaagt

SEQ ID NO: 231185 - DNA, 25 bp, Rattus norvegicus
cagcgtagcacctcctttgagaagt

SEQ ID NO: 231186 - DNA, 25 bp, Rattus norvegicus
cagcgtatagctcttgtttgtcggc

SEQ ID NO: 231187 - DNA, 25 bp, Rattus norvegicus
cagcgtatagctgttgtttgtcggc

SEQ ID NO: 231188 - DNA, 25 bp, Rattus norvegicus
cagcgtattccaaaactcagccaaa

SEQ ID NO: 231189 - DNA, 25 bp, Rattus norvegicus
cagcgtattccataactcagccaaa

SEQ ID NO: 231190 - DNA, 25 bp, Rattus norvegicus
cagcgtattgcgatgaccggcatta

SEQ ID NO: 231191 - DNA, 25 bp, Rattus norvegicus
cagcgtattgcgttgaccggcatta

SEQ ID NO: 231192 - DNA, 25 bp, Rattus norvegicus
cagcgtcacctgatactttatagtt

SEQ ID NO: 231193 - DNA, 25 bp, Rattus norvegicus
cagcgtcacctgttactttatagtt

SEQ ID NO: 231194 - DNA, 25 bp, Rattus norvegicus
cagcgtcaggctcgacaatggacaa

SEQ ID NO: 231195 - DNA, 25 bp, Rattus norvegicus
cagcgtcaggctggacaatggacaa

SEQ ID NO: 231196 - DNA, 25 bp, Rattus norvegicus
cagcgtcatctacaaatccatttca

SEQ ID NO: 231197 - DNA, 25 bp, Rattus norvegicus
cagcgtcatctagaaatccatttca

SEQ ID NO: 231198 - DNA, 25 bp, Rattus norvegicus
cagcgtccaccacaacacagttatg

SEQ ID NO: 231199 - DNA, 25 bp, Rattus norvegicus
cagcgtccaccagaacacagttatg

SEQ ID NO: 231200 - DNA, 25 bp, Rattus norvegicus
cagcgtccagctactgcaaagaggg

SEQ ID NO: 231201 - DNA, 25 bp, Rattus norvegicus
cagcgtccagcttctgcaaagaggg

SEQ ID NO: 231202 - DNA, 25 bp, Rattus norvegicus
cagcgtcccgaacgcctcgaagtgg

SEQ ID NO: 231203 - DNA, 25 bp, Rattus norvegicus
cagcgtcccgaaggcctcgaagtgg

SEQ ID NO: 231204 - DNA, 25 bp, Rattus norvegicus
cagcgtcccgctcggagaagagaca

SEQ ID NO: 231205 - DNA, 25 bp, Rattus norvegicus
cagcgtcccgctgggagaagagaca

SEQ ID NO: 231206 - DNA, 25 bp, Rattus norvegicus
cagcgtcctggacaagttcttcttc

SEQ ID NO: 231207 - DNA, 25 bp, Rattus norvegicus
cagcgtcctggagaagttcttcttc

SEQ ID NO: 231208 - DNA, 25 bp, Rattus norvegicus
cagcgtcctttcctgttccgtttgg

SEQ ID NO: 231209 - DNA, 25 bp, Rattus norvegicus
cagcgtcctttcgtgttccgtttgg

SEQ ID NO: 231210 - DNA, 25 bp, Rattus norvegicus
cagcgtcgctggaccaggaattctg

SEQ ID NO: 231211 - DNA, 25 bp, Rattus norvegicus
cagcgtcgctggtccaggaattctg

SEQ ID NO: 231212 - DNA, 25 bp, Rattus norvegicus
cagcgtcttcagaaccatctgatga

SEQ ID NO: 231213 - DNA, 25 bp, Rattus norvegicus
cagcgtcttcagtaccatctgatga

SEQ ID NO: 231214 - DNA, 25 bp, Rattus norvegicus
cagcgtgaagctcagtgcgtcgcct

SEQ ID NO: 231215 - DNA, 25 bp, Rattus norvegicus
cagcgtgaagctgagtgcgtcgcct

SEQ ID NO: 231216 - DNA, 25 bp, Rattus norvegicus
cagcgtgaggtcattcttgagtata

SEQ ID NO: 231217 - DNA, 25 bp, Rattus norvegicus
cagcgtgaggtctttcttgagtata

SEQ ID NO: 231218 - DNA, 25 bp, Rattus norvegicus
cagcgtgcacaaagtcgagatggat

SEQ ID NO: 231219 - DNA, 25 bp, Rattus norvegicus
cagcgtgcacaatgtcgagatggat

SEQ ID NO: 231220 - DNA, 25 bp, Rattus norvegicus
cagcgtgcagcaagacagactacat

SEQ ID NO: 231221 - DNA, 25 bp, Rattus norvegicus
cagcgtgcagcatgacagactacat

SEQ ID NO: 231222 - DNA, 25 bp, Rattus norvegicus
cagcgtgcagtaactgtgaactgat

SEQ ID NO: 231223 - DNA, 25 bp, Rattus norvegicus
cagcgtgcagtatctgtgaactgat

SEQ ID NO: 231224 - DNA, 25 bp, Rattus norvegicus
cagcgtgcctttcatttctttgtaa

SEQ ID NO: 231225 - DNA, 25 bp, Rattus norvegicus
cagcgtgcctttgatttctttgtaa

SEQ ID NO: 231226 - DNA, 25 bp, Rattus norvegicus
cagcgtgcgttcaccaggaatgtga

SEQ ID NO: 231227 - DNA, 25 bp, Rattus norvegicus
cagcgtgcgttctccaggaatgtga

SEQ ID NO: 231228 - DNA, 25 bp, Rattus norvegicus
cagcgtggagctccagcccttggat

SEQ ID NO: 231229 - DNA, 25 bp, Rattus norvegicus
cagcgtggagctgcagcccttggat

SEQ ID NO: 231230 - DNA, 25 bp, Rattus norvegicus
cagcgtggtctaaagtttcctcaaa

SEQ ID NO: 231231 - DNA, 25 bp, Rattus norvegicus
cagcgtggtctatagtttcctcaaa

SEQ ID NO: 231232 - DNA, 25 bp, Rattus norvegicus
cagcgtgtacgccaagagcaagtca

SEQ ID NO: 231233 - DNA, 25 bp, Rattus norvegicus
cagcgtgtacgcgaagagcaagtca

SEQ ID NO: 231234 - DNA, 25 bp, Rattus norvegicus
cagcgtgtctgtagtagtagctcta

SEQ ID NO: 231235 - DNA, 25 bp, Rattus norvegicus
cagcgtgtctgttgtagtagctcta

SEQ ID NO: 231236 - DNA, 25 bp, Rattus norvegicus
cagcgttactgcctgtgtatagtat

SEQ ID NO: 231237 - DNA, 25 bp, Rattus norvegicus
cagcgttactgcgtgtgtatagtat

SEQ ID NO: 231238 - DNA, 25 bp, Rattus norvegicus
cagcgttatcgtatgccatggcatg

SEQ ID NO: 231239 - DNA, 25 bp, Rattus norvegicus
cagcgttatcgtttgccatggcatg

SEQ ID NO: 231240 - DNA, 25 bp, Rattus norvegicus
cagcgttcactactggtgactctta

SEQ ID NO: 231241 - DNA, 25 bp, Rattus norvegicus
cagcgttcactagtggtgactctta

SEQ ID NO: 231242 - DNA, 25 bp, Rattus norvegicus
cagcgttcagcacattacgtctttt

SEQ ID NO: 231243 - DNA, 25 bp, Rattus norvegicus
cagcgttcagcagattacgtctttt

SEQ ID NO: 231244 - DNA, 25 bp, Rattus norvegicus
cagcgttcgctgaatcttgagttaa

SEQ ID NO: 231245 - DNA, 25 bp, Rattus norvegicus
cagcgttcgctgtatcttgagttaa

SEQ ID NO: 231246 - DNA, 25 bp, Rattus norvegicus
cagcgttggccgcagtaaccaatga

SEQ ID NO: 231247 - DNA, 25 bp, Rattus norvegicus
cagcgttggccggagtaaccaatga

SEQ ID NO: 231248 - DNA, 25 bp, Rattus norvegicus
cagcgtttatctattgcctacaaat

SEQ ID NO: 231249 - DNA, 25 bp, Rattus norvegicus
cagcgtttatcttttgcctacaaat

SEQ ID NO: 231250 - DNA, 25 bp, Rattus norvegicus
cagcgttttcagcttggtgcttagc

SEQ ID NO: 231251 - DNA, 25 bp, Rattus norvegicus
cagcgttttcaggttggtgcttagc

SEQ ID NO: 231252 - DNA, 25 bp, Rattus norvegicus
cagctaaagcccaatacttgagagg

SEQ ID NO: 231253 - DNA, 25 bp, Rattus norvegicus
cagctaaagccctatacttgagagg

SEQ ID NO: 231254 - DNA, 25 bp, Rattus norvegicus
cagctaaagggaccagcccatagag

SEQ ID NO: 231255 - DNA, 25 bp, Rattus norvegicus
cagctaaagggagcagcccatagag

SEQ ID NO: 231256 - DNA, 25 bp, Rattus norvegicus
cagctaacctttatgctgggttggg

SEQ ID NO: 231257 - DNA, 25 bp, Rattus norvegicus
cagctaacctttttgctgggttggg

SEQ ID NO: 231258 - DNA, 25 bp, Rattus norvegicus
cagctaacgagcaggaggccttctc

SEQ ID NO: 231259 - DNA, 25 bp, Rattus norvegicus
cagctaacgagctggaggccttctc

SEQ ID NO: 231260 - DNA, 25 bp, Rattus norvegicus
cagctaactagcctgggtaccattg

SEQ ID NO: 231261 - DNA, 25 bp, Rattus norvegicus
cagctaactagcgtgggtaccattg

SEQ ID NO: 231262 - DNA, 25 bp, Rattus norvegicus
cagctaagggaacagtcatggagaa

SEQ ID NO: 231263 - DNA, 25 bp, Rattus norvegicus
cagctaagggaagagtcatggagaa

SEQ ID NO: 231264 - DNA, 25 bp, Rattus norvegicus
cagctaattctgatggtggttcctc

SEQ ID NO: 231265 - DNA, 25 bp, Rattus norvegicus
cagctaattctgttggtggttcctc

SEQ ID NO: 231266 - DNA, 25 bp, Rattus norvegicus
cagctacagtgtataaatcttttaa

SEQ ID NO: 231267 - DNA, 25 bp, Rattus norvegicus
cagctacagtgtttaaatcttttaa

SEQ ID NO: 231268 - DNA, 25 bp, Rattus norvegicus
cagctacatcttactcacaacagtg

SEQ ID NO: 231269 - DNA, 25 bp, Rattus norvegicus
cagctacatctttctcacaacagtg

SEQ ID NO: 231270 - DNA, 25 bp, Rattus norvegicus
cagctaccacacatcaagagaaaac

SEQ ID NO: 231271 - DNA, 25 bp, Rattus norvegicus
cagctaccacacttcaagagaaaac

SEQ ID NO: 231272 - DNA, 25 bp, Rattus norvegicus
cagctaccagtcatctacttggtta

SEQ ID NO: 231273 - DNA, 25 bp, Rattus norvegicus
cagctaccagtcttctacttggtta

SEQ ID NO: 231274 - DNA, 25 bp, Rattus norvegicus
cagctacccaagctcagacagggaa

SEQ ID NO: 231275 - DNA, 25 bp, Rattus norvegicus
cagctacccaaggtcagacagggaa

SEQ ID NO: 231276 - DNA, 25 bp, Rattus norvegicus
cagctacctagtcatccaattttac

SEQ ID NO: 231277 - DNA, 25 bp, Rattus norvegicus
cagctacctagtgatccaattttac

SEQ ID NO: 231278 - DNA, 25 bp, Rattus norvegicus
cagctacgtgttatagccttcgagt

SEQ ID NO: 231279 - DNA, 25 bp, Rattus norvegicus
cagctacgtgttttagccttcgagt

SEQ ID NO: 231280 - DNA, 25 bp, Rattus norvegicus
cagctactagtgcatgggtctttgg

SEQ ID NO: 231281 - DNA, 25 bp, Rattus norvegicus
cagctactagtggatgggtctttgg

SEQ ID NO: 231282 - DNA, 25 bp, Rattus norvegicus
cagctactccctcttgagtacatta

SEQ ID NO: 231283 - DNA, 25 bp, Rattus norvegicus
cagctactccctgttgagtacatta

SEQ ID NO: 231284 - DNA, 25 bp, Rattus norvegicus
cagctacttggcctcctatttatag

SEQ ID NO: 231285 - DNA, 25 bp, Rattus norvegicus
cagctacttggcgtcctatttatag

SEQ ID NO: 231286 - DNA, 25 bp, Rattus norvegicus
cagctagaagcacggtttcctctct

SEQ ID NO: 231287 - DNA, 25 bp, Rattus norvegicus
cagctagaagcagggtttcctctct

SEQ ID NO: 231288 - DNA, 25 bp, Rattus norvegicus
cagctagaatgccttttgatgaatc

SEQ ID NO: 231289 - DNA, 25 bp, Rattus norvegicus
cagctagaatgcgttttgatgaatc

SEQ ID NO: 231290 - DNA, 25 bp, Rattus norvegicus
cagctagcatctcaccttggaacta

SEQ ID NO: 231291 - DNA, 25 bp, Rattus norvegicus
cagctagcatctgaccttggaacta

SEQ ID NO: 231292 - DNA, 25 bp, Rattus norvegicus
cagctagctctccagatggtcacta

SEQ ID NO: 231293 - DNA, 25 bp, Rattus norvegicus
cagctagctctcgagatggtcacta

SEQ ID NO: 231294 - DNA, 25 bp, Rattus norvegicus
cagctagctgaaagtctctcttgta

SEQ ID NO: 231295 - DNA, 25 bp, Rattus norvegicus
cagctagctgaatgtctctcttgta

SEQ ID NO: 231296 - DNA, 25 bp, Rattus norvegicus
cagctagggtttctgaattctttac

SEQ ID NO: 231297 - DNA, 25 bp, Rattus norvegicus
cagctagggtttgtgaattctttac

SEQ ID NO: 231298 - DNA, 25 bp, Rattus norvegicus
cagctaggtcaactccagtcggagg

SEQ ID NO: 231299 - DNA, 25 bp, Rattus norvegicus
cagctaggtcaagtccagtcggagg

SEQ ID NO: 231300 - DNA, 25 bp, Rattus norvegicus
cagctaggtgtcaggcctgggaaca

SEQ ID NO: 231301 - DNA, 25 bp, Rattus norvegicus
cagctaggtgtctggcctgggaaca

SEQ ID NO: 231302 - DNA, 25 bp, Rattus norvegicus
cagctagtggtgagttcccattctc

SEQ ID NO: 231303 - DNA, 25 bp, Rattus norvegicus
cagctagtggtgtgttcccattctc

SEQ ID NO: 231304 - DNA, 25 bp, Rattus norvegicus
cagctatctgctaattttgggtact

SEQ ID NO: 231305 - DNA, 25 bp, Rattus norvegicus
cagctatctgcttattttgggtact

SEQ ID NO: 231306 - DNA, 25 bp, Rattus norvegicus
cagctatgcccgactgcagtagaat

SEQ ID NO: 231307 - DNA, 25 bp, Rattus norvegicus
cagctatgcccgtctgcagtagaat

SEQ ID NO: 231308 - DNA, 25 bp, Rattus norvegicus
cagctatgcctgcatggtggtccga

SEQ ID NO: 231309 - DNA, 25 bp, Rattus norvegicus
cagctatgcctggatggtggtccga

SEQ ID NO: 231310 - DNA, 25 bp, Rattus norvegicus
cagctatgtgatatgaagtatccgt

SEQ ID NO: 231311 - DNA, 25 bp, Rattus norvegicus
cagctatgtgatttgaagtatccgt

SEQ ID NO: 231312 - DNA, 25 bp, Rattus norvegicus
cagctattgtctatgtttcccttta

SEQ ID NO: 231313 - DNA, 25 bp, Rattus norvegicus
cagctattgtctttgtttcccttta

SEQ ID NO: 231314 - DNA, 25 bp, Rattus norvegicus
cagctatttgtaacactccagggtt

SEQ ID NO: 231315 - DNA, 25 bp, Rattus norvegicus
cagctatttgtatcactccagggtt

SEQ ID NO: 231316 - DNA, 25 bp, Rattus norvegicus
cagctcaccaagctatgggatggtt

SEQ ID NO: 231317 - DNA, 25 bp, Rattus norvegicus
cagctcaccaaggtatgggatggtt

SEQ ID NO: 231318 - DNA, 25 bp, Rattus norvegicus
cagctcacctgtagatttggagaca

SEQ ID NO: 231319 - DNA, 25 bp, Rattus norvegicus
cagctcacctgttgatttggagaca

SEQ ID NO: 231320 - DNA, 25 bp, Rattus norvegicus
cagctcactgccaaattagagatga

SEQ ID NO: 231321 - DNA, 25 bp, Rattus norvegicus
cagctcactgcctaattagagatga

SEQ ID NO: 231322 - DNA, 25 bp, Rattus norvegicus
cagctcactgtacagcgactgctta

SEQ ID NO: 231323 - DNA, 25 bp, Rattus norvegicus
cagctcactgtagagcgactgctta

SEQ ID NO: 231324 - DNA, 25 bp, Rattus norvegicus
cagctcacttctatgtcagtgtttt

SEQ ID NO: 231325 - DNA, 25 bp, Rattus norvegicus
cagctcacttctttgtcagtgtttt

SEQ ID NO: 231326 - DNA, 25 bp, Rattus norvegicus
cagctcagagtgaaggtagagatct

SEQ ID NO: 231327 - DNA, 25 bp, Rattus norvegicus
cagctcagagtgagggtgttctgct

SEQ ID NO: 231328 - DNA, 25 bp, Rattus norvegicus
cagctcagagtgtaggtagagatct

SEQ ID NO: 231329 - DNA, 25 bp, Rattus norvegicus
cagctcagagtgtgggtgttctgct

SEQ ID NO: 231330 - DNA, 25 bp, Rattus norvegicus
cagctcagatgtccaggaaagactt

SEQ ID NO: 231331 - DNA, 25 bp, Rattus norvegicus
cagctcagatgtgcaggaaagactt

SEQ ID NO: 231332 - DNA, 25 bp, Rattus norvegicus
cagctcagcatcatgacaacagata

SEQ ID NO: 231333 - DNA, 25 bp, Rattus norvegicus
cagctcagcatcttgacaacagata

SEQ ID NO: 231334 - DNA, 25 bp, Rattus norvegicus
cagctcagctccaacatttgttaac

SEQ ID NO: 231335 - DNA, 25 bp, Rattus norvegicus
cagctcagctcctacatttgttaac

SEQ ID NO: 231336 - DNA, 25 bp, Rattus norvegicus
cagctcagctgcaccaataaagcaa

SEQ ID NO: 231337 - DNA, 25 bp, Rattus norvegicus
cagctcagctgctccaataaagcaa

SEQ ID NO: 231338 - DNA, 25 bp, Rattus norvegicus
cagctcagctggaaggatgtctgcc

SEQ ID NO: 231339 - DNA, 25 bp, Rattus norvegicus
cagctcagctggattctttgaacac

SEQ ID NO: 231340 - DNA, 25 bp, Rattus norvegicus
cagctcagctggtaggatgtctgcc

SEQ ID NO: 231341 - DNA, 25 bp, Rattus norvegicus
cagctcagctggtttctttgaacac

SEQ ID NO: 231342 - DNA, 25 bp, Rattus norvegicus
cagctcagtgggaagcctgggaaca

SEQ ID NO: 231343 - DNA, 25 bp, Rattus norvegicus
cagctcagtgggtagcctgggaaca

SEQ ID NO: 231344 - DNA, 25 bp, Rattus norvegicus
cagctcagtggtaggtggcaattct

SEQ ID NO: 231345 - DNA, 25 bp, Rattus norvegicus
cagctcagtggttggtggcaattct

SEQ ID NO: 231346 - DNA, 25 bp, Rattus norvegicus
cagctcagtgtcacatcgcaaatgt

SEQ ID NO: 231347 - DNA, 25 bp, Rattus norvegicus
cagctcagtgtctcatcgcaaatgt

SEQ ID NO: 231348 - DNA, 25 bp, Rattus norvegicus
cagctcagtgtgattacagtgcaga

SEQ ID NO: 231349 - DNA, 25 bp, Rattus norvegicus
cagctcagtgtgtttacagtgcaga

SEQ ID NO: 231350 - DNA, 25 bp, Rattus norvegicus
cagctcatcggacagttctatgtcc

SEQ ID NO: 231351 - DNA, 25 bp, Rattus norvegicus
cagctcatcggagagttctatgtcc

SEQ ID NO: 231352 - DNA, 25 bp, Rattus norvegicus
cagctcatctacattgtactcgcaa

SEQ ID NO: 231353 - DNA, 25 bp, Rattus norvegicus
cagctcatctactttgtactcgcaa

SEQ ID NO: 231354 - DNA, 25 bp, Rattus norvegicus
cagctcatgattctatgtcacccac

SEQ ID NO: 231355 - DNA, 25 bp, Rattus norvegicus
cagctcatgattgtatgtcacccac

SEQ ID NO: 231356 - DNA, 25 bp, Rattus norvegicus
cagctcatgtatcgtctgcctgaca

SEQ ID NO: 231357 - DNA, 25 bp, Rattus norvegicus
cagctcatgtatggtctgcctgaca

SEQ ID NO: 231358 - DNA, 25 bp, Rattus norvegicus
cagctcattgctatcctaagtttaa

SEQ ID NO: 231359 - DNA, 25 bp, Rattus norvegicus
cagctcattgctttcctaagtttaa

SEQ ID NO: 231360 - DNA, 25 bp, Rattus norvegicus
cagctcattttgatcacctggaggg

SEQ ID NO: 231361 - DNA, 25 bp, Rattus norvegicus
cagctcattttgttcacctggaggg

SEQ ID NO: 231362 - DNA, 25 bp, Rattus norvegicus
cagctccaagagctttttcgacttt

SEQ ID NO: 231363 - DNA, 25 bp, Rattus norvegicus
cagctccaagaggtttttcgacttt

SEQ ID NO: 231364 - DNA, 25 bp, Rattus norvegicus
cagctccaagggagttccatgggca

SEQ ID NO: 231365 - DNA, 25 bp, Rattus norvegicus
cagctccaagggtgttccatgggca

SEQ ID NO: 231366 - DNA, 25 bp, Rattus norvegicus
cagctccaagtgagcccacagagct

SEQ ID NO: 231367 - DNA, 25 bp, Rattus norvegicus
cagctccaagtgtgcccacagagct

SEQ ID NO: 231368 - DNA, 25 bp, Rattus norvegicus
cagctccactctcgcttcagagagg

SEQ ID NO: 231369 - DNA, 25 bp, Rattus norvegicus
cagctccactctggcttcagagagg

SEQ ID NO: 231370 - DNA, 25 bp, Rattus norvegicus
cagctccagagtccaggtccaaatt

SEQ ID NO: 231371 - DNA, 25 bp, Rattus norvegicus
cagctccagagtgcaggtccaaatt

SEQ ID NO: 231372 - DNA, 25 bp, Rattus norvegicus
cagctccagcttacatggcttttta

SEQ ID NO: 231373 - DNA, 25 bp, Rattus norvegicus
cagctccagctttcatggcttttta

SEQ ID NO: 231374 - DNA, 25 bp, Rattus norvegicus
cagctccaggaacgtttccctctag

SEQ ID NO: 231375 - DNA, 25 bp, Rattus norvegicus
cagctccaggaaggtttccctctag

SEQ ID NO: 231376 - DNA, 25 bp, Rattus norvegicus
cagctccagtctatagatcaactct

SEQ ID NO: 231377 - DNA, 25 bp, Rattus norvegicus
cagctccagtctttagatcaactct

SEQ ID NO: 231378 - DNA, 25 bp, Rattus norvegicus
cagctccataggaagagggtggcat

SEQ ID NO: 231379 - DNA, 25 bp, Rattus norvegicus
cagctccataggtagagggtggcat

SEQ ID NO: 231380 - DNA, 25 bp, Rattus norvegicus
cagctccatgacctaaccaatcttt

SEQ ID NO: 231381 - DNA, 25 bp, Rattus norvegicus
cagctccatgacgtaaccaatcttt

SEQ ID NO: 231382 - DNA, 25 bp, Rattus norvegicus
cagctccatgcaagctcttgtaata

SEQ ID NO: 231383 - DNA, 25 bp, Rattus norvegicus
cagctccatgcatgctcttgtaata

SEQ ID NO: 231384 - DNA, 25 bp, Rattus norvegicus
cagctccatggcaactgaggcatgt

SEQ ID NO: 231385 - DNA, 25 bp, Rattus norvegicus
cagctccatggctactgaggcatgt

SEQ ID NO: 231386 - DNA, 25 bp, Rattus norvegicus
cagctccattccaaactgcaggatt

SEQ ID NO: 231387 - DNA, 25 bp, Rattus norvegicus
cagctccattcctaactgcaggatt

SEQ ID NO: 231388 - DNA, 25 bp, Rattus norvegicus
cagctcccagacactacatgggcag

SEQ ID NO: 231389 - DNA, 25 bp, Rattus norvegicus
cagctcccagactctacatgggcag

SEQ ID NO: 231390 - DNA, 25 bp, Rattus norvegicus
cagctcccatcaccagatgatcttt

SEQ ID NO: 231391 - DNA, 25 bp, Rattus norvegicus
cagctcccatcagcagatgatcttt

SEQ ID NO: 231392 - DNA, 25 bp, Rattus norvegicus
cagctcccctcacttaatttattaa

SEQ ID NO: 231393 - DNA, 25 bp, Rattus norvegicus
cagctcccctcagttaatttattaa

SEQ ID NO: 231394 - DNA, 25 bp, Rattus norvegicus
cagctccctgaaccgcatggatcaa

SEQ ID NO: 231395 - DNA, 25 bp, Rattus norvegicus
cagctccctgaagcgcatggatcaa

SEQ ID NO: 231396 - DNA, 25 bp, Rattus norvegicus
cagctccggactccaaagggtacgg

SEQ ID NO: 231397 - DNA, 25 bp, Rattus norvegicus
cagctccggactgcaaagggtacgg

SEQ ID NO: 231398 - DNA, 25 bp, Rattus norvegicus
cagctccggcctcagttgcagcagg

SEQ ID NO: 231399 - DNA, 25 bp, Rattus norvegicus
cagctccggcctgagttgcagcagg

SEQ ID NO: 231400 - DNA, 25 bp, Rattus norvegicus
cagctccggcggaagtgcagagtac

SEQ ID NO: 231401 - DNA, 25 bp, Rattus norvegicus
cagctccggcggtagtgcagagtac

SEQ ID NO: 231402 - DNA, 25 bp, Rattus norvegicus
cagctcctatagctgggaacccttt

SEQ ID NO: 231403 - DNA, 25 bp, Rattus norvegicus
cagctcctataggtgggaacccttt

SEQ ID NO: 231404 - DNA, 25 bp, Rattus norvegicus
cagctcctcaacacacaagattgtt

SEQ ID NO: 231405 - DNA, 25 bp, Rattus norvegicus
cagctcctcaactcacaagattgtt

SEQ ID NO: 231406 - DNA, 25 bp, Rattus norvegicus
cagctcctcgagctggaatcctgca

SEQ ID NO: 231407 - DNA, 25 bp, Rattus norvegicus
cagctcctcgaggtggaatcctgca

SEQ ID NO: 231408 - DNA, 25 bp, Rattus norvegicus
cagctcctcgttagatagcattctt

SEQ ID NO: 231409 - DNA, 25 bp, Rattus norvegicus
cagctcctcgtttgatagcattctt

SEQ ID NO: 231410 - DNA, 25 bp, Rattus norvegicus
cagctcctgcctcagttggagtttg

SEQ ID NO: 231411 - DNA, 25 bp, Rattus norvegicus
cagctcctgcctgagttggagtttg

SEQ ID NO: 231412 - DNA, 25 bp, Rattus norvegicus
cagctcctgcgaaggctgcaagggc

SEQ ID NO: 231413 - DNA, 25 bp, Rattus norvegicus
cagctcctgcgatggctgcaagggc

SEQ ID NO: 231414 - DNA, 25 bp, Rattus norvegicus
cagctcctgttcactagcagaagaa

SEQ ID NO: 231415 - DNA, 25 bp, Rattus norvegicus
cagctcctgttctctagcagaagaa

SEQ ID NO: 231416 - DNA, 25 bp, Rattus norvegicus
cagctccttactctcctgaaaggag

SEQ ID NO: 231417 - DNA, 25 bp, Rattus norvegicus
cagctccttactgtcctgaaaggag

SEQ ID NO: 231418 - DNA, 25 bp, Rattus norvegicus
cagctccttgcgcaagcacatgaag

SEQ ID NO: 231419 - DNA, 25 bp, Rattus norvegicus
cagctccttgcggaagcacatgaag

SEQ ID NO: 231420 - DNA, 25 bp, Rattus norvegicus
cagctcgaactcacagtggttctaa

SEQ ID NO: 231421 - DNA, 25 bp, Rattus norvegicus
cagctcgaactctcagtggttctaa

SEQ ID NO: 231422 - DNA, 25 bp, Rattus norvegicus
cagctcgactgccaacaatgaagaa

SEQ ID NO: 231423 - DNA, 25 bp, Rattus norvegicus
cagctcgactgcgaacaatgaagaa

SEQ ID NO: 231424 - DNA, 25 bp, Rattus norvegicus
cagctcgactttagtcccctaggga

SEQ ID NO: 231425 - DNA, 25 bp, Rattus norvegicus
cagctcgacttttgtcccctaggga

SEQ ID NO: 231426 - DNA, 25 bp, Rattus norvegicus
cagctcgcccatcattttaattaaa

SEQ ID NO: 231427 - DNA, 25 bp, Rattus norvegicus
cagctcgcccatgattttaattaaa

SEQ ID NO: 231428 - DNA, 25 bp, Rattus norvegicus
cagctcgccgcgactggagagtccg

SEQ ID NO: 231429 - DNA, 25 bp, Rattus norvegicus
cagctcgccgcgtctggagagtccg

SEQ ID NO: 231430 - DNA, 25 bp, Rattus norvegicus
cagctcggctgaaggcttacttgat

SEQ ID NO: 231431 - DNA, 25 bp, Rattus norvegicus
cagctcggctgatggcttacttgat

SEQ ID NO: 231432 - DNA, 25 bp, Rattus norvegicus
cagctcgggtgccacagggaacaat

SEQ ID NO: 231433 - DNA, 25 bp, Rattus norvegicus
cagctcgggtgcgacagggaacaat

SEQ ID NO: 231434 - DNA, 25 bp, Rattus norvegicus
cagctcggtgggaaagtacttgtgt

SEQ ID NO: 231435 - DNA, 25 bp, Rattus norvegicus
cagctcggtgggtaagtacttgtgt

SEQ ID NO: 231436 - DNA, 25 bp, Rattus norvegicus
cagctcggttcacttgtatcacaaa

SEQ ID NO: 231437 - DNA, 25 bp, Rattus norvegicus
cagctcggttcagttgtatcacaaa

SEQ ID NO: 231438 - DNA, 25 bp, Rattus norvegicus
cagctcgtatttcgaaggccctcac

SEQ ID NO: 231439 - DNA, 25 bp, Rattus norvegicus
cagctcgtatttggaaggccctcac

SEQ ID NO: 231440 - DNA, 25 bp, Rattus norvegicus
cagctctaacacaatgccattatct

SEQ ID NO: 231441 - DNA, 25 bp, Rattus norvegicus
cagctctaacactatgccattatct

SEQ ID NO: 231442 - DNA, 25 bp, Rattus norvegicus
cagctctcacaccttttctaataaa

SEQ ID NO: 231443 - DNA, 25 bp, Rattus norvegicus
cagctctcacacgttttctaataaa

SEQ ID NO: 231444 - DNA, 25 bp, Rattus norvegicus
cagctctcatctaccgacggatata

SEQ ID NO: 231445 - DNA, 25 bp, Rattus norvegicus
cagctctcatcttccgacggatata

SEQ ID NO: 231446 - DNA, 25 bp, Rattus norvegicus
cagctctccataatgtcactcaaga

SEQ ID NO: 231447 - DNA, 25 bp, Rattus norvegicus
cagctctccatattgtcactcaaga

SEQ ID NO: 231448 - DNA, 25 bp, Rattus norvegicus
cagctctccatgctgtcgaatggga

SEQ ID NO: 231449 - DNA, 25 bp, Rattus norvegicus
cagctctccatggtgtcgaatggga

SEQ ID NO: 231450 - DNA, 25 bp, Rattus norvegicus
cagctctccggaaaggttcatcgaa

SEQ ID NO: 231451 - DNA, 25 bp, Rattus norvegicus
cagctctccggataggttcatcgaa

SEQ ID NO: 231452 - DNA, 25 bp, Rattus norvegicus
cagctctctcttagaggctctcaaa

SEQ ID NO: 231453 - DNA, 25 bp, Rattus norvegicus
cagctctctctttgaggctctcaaa

SEQ ID NO: 231454 - DNA, 25 bp, Rattus norvegicus
cagctctctgagagacctccgcaag

SEQ ID NO: 231455 - DNA, 25 bp, Rattus norvegicus
cagctctctgagtgacctccgcaag

SEQ ID NO: 231456 - DNA, 25 bp, Rattus norvegicus
cagctctctggtatctgatgaagac

SEQ ID NO: 231457 - DNA, 25 bp, Rattus norvegicus
cagctctctggtttctgatgaagac

SEQ ID NO: 231458 - DNA, 25 bp, Rattus norvegicus
cagctctgaaatacattgttttgcc

SEQ ID NO: 231459 - DNA, 25 bp, Rattus norvegicus
cagctctgaaattcattgttttgcc

SEQ ID NO: 231460 - DNA, 25 bp, Rattus norvegicus
cagctctgacgcatctgaacatgag

SEQ ID NO: 231461 - DNA, 25 bp, Rattus norvegicus
cagctctgacgcttctgaacatgag

SEQ ID NO: 231462 - DNA, 25 bp, Rattus norvegicus
cagctctgactcctgtgaaactaga

SEQ ID NO: 231463 - DNA, 25 bp, Rattus norvegicus
cagctctgactcgtgtgaaactaga

SEQ ID NO: 231464 - DNA, 25 bp, Rattus norvegicus
cagctctgcgagctcttcataatgt

SEQ ID NO: 231465 - DNA, 25 bp, Rattus norvegicus
cagctctgcgaggtcttcataatgt

SEQ ID NO: 231466 - DNA, 25 bp, Rattus norvegicus
cagctctgctggaactggaaggcaa

SEQ ID NO: 231467 - DNA, 25 bp, Rattus norvegicus
cagctctgctggtactggaaggcaa

SEQ ID NO: 231468 - DNA, 25 bp, Rattus norvegicus
cagctctggagtacttgcactcgag

SEQ ID NO: 231469 - DNA, 25 bp, Rattus norvegicus
cagctctggagttcttgcactcgag

SEQ ID NO: 231470 - DNA, 25 bp, Rattus norvegicus
cagctctggctacgagtcgtccaca

SEQ ID NO: 231471 - DNA, 25 bp, Rattus norvegicus
cagctctggctaggagtcgtccaca

SEQ ID NO: 231472 - DNA, 25 bp, Rattus norvegicus
cagctctggtagacggttctggaat

SEQ ID NO: 231473 - DNA, 25 bp, Rattus norvegicus
cagctctggtagtcggttctggaat

SEQ ID NO: 231474 - DNA, 25 bp, Rattus norvegicus
cagctctgtcagaacgtccaatgga

SEQ ID NO: 231475 - DNA, 25 bp, Rattus norvegicus
cagctctgtcagtacgtccaatgga

SEQ ID NO: 231476 - DNA, 25 bp, Rattus norvegicus
cagctctgtgaacccttggacggaa

SEQ ID NO: 231477 - DNA, 25 bp, Rattus norvegicus
cagctctgtgaagccttggacggaa

SEQ ID NO: 231478 - DNA, 25 bp, Rattus norvegicus
cagctctgtgcccatgaactttaag

SEQ ID NO: 231479 - DNA, 25 bp, Rattus norvegicus
cagctctgtgccgatgaactttaag

SEQ ID NO: 231480 - DNA, 25 bp, Rattus norvegicus
cagctcttagaaccctgcacagaag

SEQ ID NO: 231481 - DNA, 25 bp, Rattus norvegicus
cagctcttagaagcctgcacagaag

SEQ ID NO: 231482 - DNA, 25 bp, Rattus norvegicus
cagctcttcatgcatgtttccagaa

SEQ ID NO: 231483 - DNA, 25 bp, Rattus norvegicus
cagctcttcatggatgtttccagaa

SEQ ID NO: 231484 - DNA, 25 bp, Rattus norvegicus
cagctcttccatcaaggtttcagat

SEQ ID NO: 231485 - DNA, 25 bp, Rattus norvegicus
cagctcttccatgaaggtttcagat

SEQ ID NO: 231486 - DNA, 25 bp, Rattus norvegicus
cagctcttcttgatgttctagttag

SEQ ID NO: 231487 - DNA, 25 bp, Rattus norvegicus
cagctcttcttgttgttctagttag

SEQ ID NO: 231488 - DNA, 25 bp, Rattus norvegicus
cagctcttgacaactgtgttcacaa

SEQ ID NO: 231489 - DNA, 25 bp, Rattus norvegicus
cagctcttgacatctgtgttcacaa

SEQ ID NO: 231490 - DNA, 25 bp, Rattus norvegicus
cagctcttgagcagctgctgttgaa

SEQ ID NO: 231491 - DNA, 25 bp, Rattus norvegicus
cagctcttgagctgctgctgttgaa

SEQ ID NO: 231492 - DNA, 25 bp, Rattus norvegicus
cagctcttgaggcactggccaagga

SEQ ID NO: 231493 - DNA, 25 bp, Rattus norvegicus
cagctcttgagggactggccaagga

SEQ ID NO: 231494 - DNA, 25 bp, Rattus norvegicus
cagctcttgatcaccctaaacaaag

SEQ ID NO: 231495 - DNA, 25 bp, Rattus norvegicus
cagctcttgatctccctaaacaaag

SEQ ID NO: 231496 - DNA, 25 bp, Rattus norvegicus
cagctcttgtcccatgccggacagg

SEQ ID NO: 231497 - DNA, 25 bp, Rattus norvegicus
cagctcttgtccgatgccggacagg

SEQ ID NO: 231498 - DNA, 25 bp, Rattus norvegicus
cagctctttatcacagtactcagga

SEQ ID NO: 231499 - DNA, 25 bp, Rattus norvegicus
cagctctttatctcagtactcagga

SEQ ID NO: 231500 - DNA, 25 bp, Rattus norvegicus
cagctctttcctatcacaagttgga

SEQ ID NO: 231501 - DNA, 25 bp, Rattus norvegicus
cagctctttcctttcacaagttgga

SEQ ID NO: 231502 - DNA, 25 bp, Rattus norvegicus
cagctctttggaagaccttcaggga

SEQ ID NO: 231503 - DNA, 25 bp, Rattus norvegicus
cagctctttggatgaccttcaggga

SEQ ID NO: 231504 - DNA, 25 bp, Rattus norvegicus
cagctcttttctatgtcggtcgagg

SEQ ID NO: 231505 - DNA, 25 bp, Rattus norvegicus
cagctcttttctttgtcggtcgagg

SEQ ID NO: 231506 - DNA, 25 bp, Rattus norvegicus
cagctgaagacaaatttgcccacat

SEQ ID NO: 231507 - DNA, 25 bp, Rattus norvegicus
cagctgaagacatatttgcccacat

SEQ ID NO: 231508 - DNA, 25 bp, Rattus norvegicus
cagctgaagagcacctagtcatcct

SEQ ID NO: 231509 - DNA, 25 bp, Rattus norvegicus
cagctgaagagctcctagtcatcct

SEQ ID NO: 231510 - DNA, 25 bp, Rattus norvegicus
cagctgaagcctcctgtgcagacag

SEQ ID NO: 231511 - DNA, 25 bp, Rattus norvegicus
cagctgaagcctgctgtgcagacag

SEQ ID NO: 231512 - DNA, 25 bp, Rattus norvegicus
cagctgaagcgacccagcagagctg

SEQ ID NO: 231513 - DNA, 25 bp, Rattus norvegicus
cagctgaagcgagccagcagagctg

SEQ ID NO: 231514 - DNA, 25 bp, Rattus norvegicus
cagctgaagcttaggttacccgtag

SEQ ID NO: 231515 - DNA, 25 bp, Rattus norvegicus
cagctgaagctttggttacccgtag

SEQ ID NO: 231516 - DNA, 25 bp, Rattus norvegicus
cagctgaatcagagtcccagttatt

SEQ ID NO: 231517 - DNA, 25 bp, Rattus norvegicus
cagctgaatcagtgtcccagttatt

SEQ ID NO: 231518 - DNA, 25 bp, Rattus norvegicus
cagctgaattcccaagatttactgg

SEQ ID NO: 231519 - DNA, 25 bp, Rattus norvegicus
cagctgaattccgaagatttactgg

SEQ ID NO: 231520 - DNA, 25 bp, Rattus norvegicus
cagctgaattggcatggtctgcatc

SEQ ID NO: 231521 - DNA, 25 bp, Rattus norvegicus
cagctgaattgggatggtctgcatc

SEQ ID NO: 231522 - DNA, 25 bp, Rattus norvegicus
cagctgacaagcacaatgtatcgtt

SEQ ID NO: 231523 - DNA, 25 bp, Rattus norvegicus
cagctgacaagctcaatgtatcgtt

SEQ ID NO: 231524 - DNA, 25 bp, Rattus norvegicus
cagctgacactgatttgcaaatttg

SEQ ID NO: 231525 - DNA, 25 bp, Rattus norvegicus
cagctgacactgttttgcaaatttg

SEQ ID NO: 231526 - DNA, 25 bp, Rattus norvegicus
cagctgacagggatttaggtcctat

SEQ ID NO: 231527 - DNA, 25 bp, Rattus norvegicus
cagctgacagggttttaggtcctat

SEQ ID NO: 231528 - DNA, 25 bp, Rattus norvegicus
cagctgacatcaaagacctaggttt

SEQ ID NO: 231529 - DNA, 25 bp, Rattus norvegicus
cagctgacatcatagacctaggttt

SEQ ID NO: 231530 - DNA, 25 bp, Rattus norvegicus
cagctgacatctacctgagcctgta

SEQ ID NO: 231531 - DNA, 25 bp, Rattus norvegicus
cagctgacatcttcctgagcctgta

SEQ ID NO: 231532 - DNA, 25 bp, Rattus norvegicus
cagctgaccaggatcaaggtttttg

SEQ ID NO: 231533 - DNA, 25 bp, Rattus norvegicus
cagctgaccaggttcaaggtttttg

SEQ ID NO: 231534 - DNA, 25 bp, Rattus norvegicus
cagctgaccgttagcctggagagta

SEQ ID NO: 231535 - DNA, 25 bp, Rattus norvegicus
cagctgaccgtttgcctggagagta

SEQ ID NO: 231536 - DNA, 25 bp, Rattus norvegicus
cagctgacctatcttttgttggaca

SEQ ID NO: 231537 - DNA, 25 bp, Rattus norvegicus
cagctgacctatgttttgttggaca

SEQ ID NO: 231538 - DNA, 25 bp, Rattus norvegicus
cagctgacgtggcagttcattcgta

SEQ ID NO: 231539 - DNA, 25 bp, Rattus norvegicus
cagctgacgtgggagttcattcgta

SEQ ID NO: 231540 - DNA, 25 bp, Rattus norvegicus
cagctgactgctacttgagaggtta

SEQ ID NO: 231541 - DNA, 25 bp, Rattus norvegicus
cagctgactgcttcttgagaggtta

SEQ ID NO: 231542 - DNA, 25 bp, Rattus norvegicus
cagctgactgggagtttggttttct

SEQ ID NO: 231543 - DNA, 25 bp, Rattus norvegicus
cagctgactgggtgtttggttttct

SEQ ID NO: 231544 - DNA, 25 bp, Rattus norvegicus
cagctgagatcgactccctgtggga

SEQ ID NO: 231545 - DNA, 25 bp, Rattus norvegicus
cagctgagatcgtctccctgtggga

SEQ ID NO: 231546 - DNA, 25 bp, Rattus norvegicus
cagctgatagttatctgccagatct

SEQ ID NO: 231547 - DNA, 25 bp, Rattus norvegicus
cagctgatagttttctgccagatct

SEQ ID NO: 231548 - DNA, 25 bp, Rattus norvegicus
cagctgatatttccacatgactctc

SEQ ID NO: 231549 - DNA, 25 bp, Rattus norvegicus
cagctgatatttgcacatgactctc

SEQ ID NO: 231550 - DNA, 25 bp, Rattus norvegicus
cagctgatcctccacatggaatttc

SEQ ID NO: 231551 - DNA, 25 bp, Rattus norvegicus
cagctgatcctcgacatggaatttc

SEQ ID NO: 231552 - DNA, 25 bp, Rattus norvegicus
cagctgatgctgaaccgtcatggga

SEQ ID NO: 231553 - DNA, 25 bp, Rattus norvegicus
cagctgatgctgtaccgtcatggga

SEQ ID NO: 231554 - DNA, 25 bp, Rattus norvegicus
cagctgatgcttcagtctaaaatca

SEQ ID NO: 231555 - DNA, 25 bp, Rattus norvegicus
cagctgatgcttgagtctaaaatca

SEQ ID NO: 231556 - DNA, 25 bp, Rattus norvegicus
cagctgatgtatcgttggtggctca

SEQ ID NO: 231557 - DNA, 25 bp, Rattus norvegicus
cagctgatgtatggttggtggctca

SEQ ID NO: 231558 - DNA, 25 bp, Rattus norvegicus
cagctgcaagcaagggctgcttcat

SEQ ID NO: 231559 - DNA, 25 bp, Rattus norvegicus
cagctgcaagcatgggctgcttcat

SEQ ID NO: 231560 - DNA, 25 bp, Rattus norvegicus
cagctgcaatctccctccaagtgta

SEQ ID NO: 231561 - DNA, 25 bp, Rattus norvegicus
cagctgcaatctgcctccaagtgta

SEQ ID NO: 231562 - DNA, 25 bp, Rattus norvegicus
cagctgcacctgaaaaccaagtaag

SEQ ID NO: 231563 - DNA, 25 bp, Rattus norvegicus
cagctgcacctgtaaaccaagtaag

SEQ ID NO: 231564 - DNA, 25 bp, Rattus norvegicus
cagctgcaggccattctacccgagg

SEQ ID NO: 231565 - DNA, 25 bp, Rattus norvegicus
cagctgcaggcctttctacccgagg

SEQ ID NO: 231566 - DNA, 25 bp, Rattus norvegicus
cagctgcagtttcgtcttaaataaa

SEQ ID NO: 231567 - DNA, 25 bp, Rattus norvegicus
cagctgcagtttggtcttaaataaa

SEQ ID NO: 231568 - DNA, 25 bp, Rattus norvegicus
cagctgcatgcaagggatttcaaca

SEQ ID NO: 231569 - DNA, 25 bp, Rattus norvegicus
cagctgcatgcatgggatttcaaca

SEQ ID NO: 231570 - DNA, 25 bp, Rattus norvegicus
cagctgcccctgaatgatgctaact

SEQ ID NO: 231571 - DNA, 25 bp, Rattus norvegicus
cagctgcccctgtatgatgctaact

SEQ ID NO: 231572 - DNA, 25 bp, Rattus norvegicus
cagctgcccgcactctgtgcgagga

SEQ ID NO: 231573 - DNA, 25 bp, Rattus norvegicus
cagctgcccgcagtctgtgcgagga

SEQ ID NO: 231574 - DNA, 25 bp, Rattus norvegicus
cagctgccctgcagatacttacctg

SEQ ID NO: 231575 - DNA, 25 bp, Rattus norvegicus
cagctgccctgctgatacttacctg

SEQ ID NO: 231576 - DNA, 25 bp, Rattus norvegicus
cagctgccctggaatgtggaacaga

SEQ ID NO: 231577 - DNA, 25 bp, Rattus norvegicus
cagctgccctggaattatatgacat

SEQ ID NO: 231578 - DNA, 25 bp, Rattus norvegicus
cagctgccctggcacgtgtgacgta

SEQ ID NO: 231579 - DNA, 25 bp, Rattus norvegicus
cagctgccctgggacgtgtgacgta

SEQ ID NO: 231580 - DNA, 25 bp, Rattus norvegicus
cagctgccctggtatgtggaacaga

SEQ ID NO: 231581 - DNA, 25 bp, Rattus norvegicus
cagctgccctggtattatatgacat

SEQ ID NO: 231582 - DNA, 25 bp, Rattus norvegicus
cagctgccctgtatcagttgatgtt

SEQ ID NO: 231583 - DNA, 25 bp, Rattus norvegicus
cagctgccctgtttcagttgatgtt

SEQ ID NO: 231584 - DNA, 25 bp, Rattus norvegicus
cagctgccgcaccatcctgaagaag

SEQ ID NO: 231585 - DNA, 25 bp, Rattus norvegicus
cagctgccgcacgatcctgaagaag

SEQ ID NO: 231586 - DNA, 25 bp, Rattus norvegicus
cagctgccggacaatacctgtgagt

SEQ ID NO: 231587 - DNA, 25 bp, Rattus norvegicus
cagctgccggactatacctgtgagt

SEQ ID NO: 231588 - DNA, 25 bp, Rattus norvegicus
cagctgccgttgagccccatagcga

SEQ ID NO: 231589 - DNA, 25 bp, Rattus norvegicus
cagctgccgttgtgccccatagcga

SEQ ID NO: 231590 - DNA, 25 bp, Rattus norvegicus
cagctgcctctaactggttacagtg

SEQ ID NO: 231591 - DNA, 25 bp, Rattus norvegicus
cagctgcctctatctggttacagtg

SEQ ID NO: 231592 - DNA, 25 bp, Rattus norvegicus
cagctgcctctgctaggatcaaagg

SEQ ID NO: 231593 - DNA, 25 bp, Rattus norvegicus
cagctgcctctggtaggatcaaagg

SEQ ID NO: 231594 - DNA, 25 bp, Rattus norvegicus
cagctgcctgttaaaactgctcaac

SEQ ID NO: 231595 - DNA, 25 bp, Rattus norvegicus
cagctgcctgtttaaactgctcaac

SEQ ID NO: 231596 - DNA, 25 bp, Rattus norvegicus
cagctgccttcaatttgtgtgacca

SEQ ID NO: 231597 - DNA, 25 bp, Rattus norvegicus
cagctgccttcattttgtgtgacca

SEQ ID NO: 231598 - DNA, 25 bp, Rattus norvegicus
cagctgcggcggagtacagagaaat

SEQ ID NO: 231599 - DNA, 25 bp, Rattus norvegicus
cagctgcggcggtgtacagagaaat

SEQ ID NO: 231600 - DNA, 25 bp, Rattus norvegicus
cagctgctcagtccagtaaatccat

SEQ ID NO: 231601 - DNA, 25 bp, Rattus norvegicus
cagctgctcagtgcagtaaatccat

SEQ ID NO: 231602 - DNA, 25 bp, Rattus norvegicus
cagctgctcatgctctttgacaaat

SEQ ID NO: 231603 - DNA, 25 bp, Rattus norvegicus
cagctgctcatggtctttgacaaat

SEQ ID NO: 231604 - DNA, 25 bp, Rattus norvegicus
cagctgctccaacgcggtagtgctg

SEQ ID NO: 231605 - DNA, 25 bp, Rattus norvegicus
cagctgctccaaggcggtagtgctg

SEQ ID NO: 231606 - DNA, 25 bp, Rattus norvegicus
cagctgctccacaatgtccatggga

SEQ ID NO: 231607 - DNA, 25 bp, Rattus norvegicus
cagctgctccactatgtccatggga

SEQ ID NO: 231608 - DNA, 25 bp, Rattus norvegicus
cagctgctctaacacttttcacata

SEQ ID NO: 231609 - DNA, 25 bp, Rattus norvegicus
cagctgctctaacatctgaggactt

SEQ ID NO: 231610 - DNA, 25 bp, Rattus norvegicus
cagctgctctaagacttttcacata

SEQ ID NO: 231611 - DNA, 25 bp, Rattus norvegicus
cagctgctctaagatctgaggactt

SEQ ID NO: 231612 - DNA, 25 bp, Rattus norvegicus
cagctgctggagacatataggtcat

SEQ ID NO: 231613 - DNA, 25 bp, Rattus norvegicus
cagctgctggagtcatataggtcat

SEQ ID NO: 231614 - DNA, 25 bp, Rattus norvegicus
cagctgctggcaccgcaaaccagga

SEQ ID NO: 231615 - DNA, 25 bp, Rattus norvegicus
cagctgctggcagcgcaaaccagga

SEQ ID NO: 231616 - DNA, 25 bp, Rattus norvegicus
cagctgctgggtatctgcggtccag

SEQ ID NO: 231617 - DNA, 25 bp, Rattus norvegicus
cagctgctgggtttctgcggtccag

SEQ ID NO: 231618 - DNA, 25 bp, Rattus norvegicus
cagctgctggtgatgacttggaata

SEQ ID NO: 231619 - DNA, 25 bp, Rattus norvegicus
cagctgctggtgatgttgtaattag

SEQ ID NO: 231620 - DNA, 25 bp, Rattus norvegicus
cagctgctggtgttgacttggaata

SEQ ID NO: 231621 - DNA, 25 bp, Rattus norvegicus
cagctgctggtgttgttgtaattag

SEQ ID NO: 231622 - DNA, 25 bp, Rattus norvegicus
cagctgctgtaaacccaatactggg

SEQ ID NO: 231623 - DNA, 25 bp, Rattus norvegicus
cagctgctgtaatcccaatactggg

SEQ ID NO: 231624 - DNA, 25 bp, Rattus norvegicus
cagctgctgtccaaaacttgtctga

SEQ ID NO: 231625 - DNA, 25 bp, Rattus norvegicus
cagctgctgtcctaaacttgtctga

SEQ ID NO: 231626 - DNA, 25 bp, Rattus norvegicus
cagctgcttgctcatatttgcatag

SEQ ID NO: 231627 - DNA, 25 bp, Rattus norvegicus
cagctgcttgctgatatttgcatag

SEQ ID NO: 231628 - DNA, 25 bp, Rattus norvegicus
cagctgctttgacaccgtgtacgat

SEQ ID NO: 231629 - DNA, 25 bp, Rattus norvegicus
cagctgctttgagaccgtgtacgat

SEQ ID NO: 231630 - DNA, 25 bp, Rattus norvegicus
cagctggaagctatacccgatttaa

SEQ ID NO: 231631 - DNA, 25 bp, Rattus norvegicus
cagctggaagctttacccgatttaa

SEQ ID NO: 231632 - DNA, 25 bp, Rattus norvegicus
cagctggagcacagatggcagattt

SEQ ID NO: 231633 - DNA, 25 bp, Rattus norvegicus
cagctggagcactgatggcagattt

SEQ ID NO: 231634 - DNA, 25 bp, Rattus norvegicus
cagctggaggagatgtgcagggagc

SEQ ID NO: 231635 - DNA, 25 bp, Rattus norvegicus
cagctggaggagttgtgcagggagc

SEQ ID NO: 231636 - DNA, 25 bp, Rattus norvegicus
cagctggatgctaaaaatttgatca

SEQ ID NO: 231637 - DNA, 25 bp, Rattus norvegicus
cagctggatgcttaaaatttgatca

SEQ ID NO: 231638 - DNA, 25 bp, Rattus norvegicus
cagctggatttccatgactacctca

SEQ ID NO: 231639 - DNA, 25 bp, Rattus norvegicus
cagctggatttcgatgactacctca

SEQ ID NO: 231640 - DNA, 25 bp, Rattus norvegicus
cagctggcacggcaagtgaagtcaa

SEQ ID NO: 231641 - DNA, 25 bp, Rattus norvegicus
cagctggcacgggaagtgaagtcaa

SEQ ID NO: 231642 - DNA, 25 bp, Rattus norvegicus
cagctggcacttcgtgcattcggaa

SEQ ID NO: 231643 - DNA, 25 bp, Rattus norvegicus
cagctggcacttggtgcattcggaa

SEQ ID NO: 231644 - DNA, 25 bp, Rattus norvegicus
cagctggcccagaatcggatcaaaa

SEQ ID NO: 231645 - DNA, 25 bp, Rattus norvegicus
cagctggcccagtatcggatcaaaa

SEQ ID NO: 231646 - DNA, 25 bp, Rattus norvegicus
cagctggccccgcaaatgcaaatga

SEQ ID NO: 231647 - DNA, 25 bp, Rattus norvegicus
cagctggccccggaaatgcaaatga

SEQ ID NO: 231648 - DNA, 25 bp, Rattus norvegicus
cagctggcctctcgcacaaggatct

SEQ ID NO: 231649 - DNA, 25 bp, Rattus norvegicus
cagctggcctctggcacaaggatct

SEQ ID NO: 231650 - DNA, 25 bp, Rattus norvegicus
cagctggccttgcagatgatcaaac

SEQ ID NO: 231651 - DNA, 25 bp, Rattus norvegicus
cagctggccttggagatgatcaaac

SEQ ID NO: 231652 - DNA, 25 bp, Rattus norvegicus
cagctggcgcagcactacatctctt

SEQ ID NO: 231653 - DNA, 25 bp, Rattus norvegicus
cagctggcgcaggactacatctctt

SEQ ID NO: 231654 - DNA, 25 bp, Rattus norvegicus
cagctggctcagacttggcaagttt

SEQ ID NO: 231655 - DNA, 25 bp, Rattus norvegicus
cagctggctcagcagacaggtttgt

SEQ ID NO: 231656 - DNA, 25 bp, Rattus norvegicus
cagctggctcaggagacaggtttgt

SEQ ID NO: 231657 - DNA, 25 bp, Rattus norvegicus
cagctggctcagtcttggcaagttt

SEQ ID NO: 231658 - DNA, 25 bp, Rattus norvegicus
cagctgggtcacactcagcgatgag

SEQ ID NO: 231659 - DNA, 25 bp, Rattus norvegicus
cagctgggtcactctcagcgatgag

SEQ ID NO: 231660 - DNA, 25 bp, Rattus norvegicus
cagctgggtctcactaggtttgacg

SEQ ID NO: 231661 - DNA, 25 bp, Rattus norvegicus
cagctgggtctctctaggtttgacg

SEQ ID NO: 231662 - DNA, 25 bp, Rattus norvegicus
cagctggtagagagcatacctagca

SEQ ID NO: 231663 - DNA, 25 bp, Rattus norvegicus
cagctggtagagtgcatacctagca

SEQ ID NO: 231664 - DNA, 25 bp, Rattus norvegicus
cagctggtctggatggctctggatt

SEQ ID NO: 231665 - DNA, 25 bp, Rattus norvegicus
cagctggtctggttggctctggatt

SEQ ID NO: 231666 - DNA, 25 bp, Rattus norvegicus
cagctggtgcggcacctggaattct

SEQ ID NO: 231667 - DNA, 25 bp, Rattus norvegicus
cagctggtgcgggacctggaattct

SEQ ID NO: 231668 - DNA, 25 bp, Rattus norvegicus
cagctggttcatcccttccactaga

SEQ ID NO: 231669 - DNA, 25 bp, Rattus norvegicus
cagctggttcatgccttccactaga

SEQ ID NO: 231670 - DNA, 25 bp, Rattus norvegicus
cagctggttctccttttgtaatatt

SEQ ID NO: 231671 - DNA, 25 bp, Rattus norvegicus
cagctggttctcgttttgtaatatt

SEQ ID NO: 231672 - DNA, 25 bp, Rattus norvegicus
cagctggttctgaagtttctttacg

SEQ ID NO: 231673 - DNA, 25 bp, Rattus norvegicus
cagctggttctgtagtttctttacg

SEQ ID NO: 231674 - DNA, 25 bp, Rattus norvegicus
cagctggtttgtctcttatttaatg

SEQ ID NO: 231675 - DNA, 25 bp, Rattus norvegicus
cagctggtttgtgtcttatttaatg

SEQ ID NO: 231676 - DNA, 25 bp, Rattus norvegicus
cagctgtaccttctaagcagtcaaa

SEQ ID NO: 231677 - DNA, 25 bp, Rattus norvegicus
cagctgtaccttgtaagcagtcaaa

SEQ ID NO: 231678 - DNA, 25 bp, Rattus norvegicus
cagctgtagatcaagtatgtgccta

SEQ ID NO: 231679 - DNA, 25 bp, Rattus norvegicus
cagctgtagatctagtatgtgccta

SEQ ID NO: 231680 - DNA, 25 bp, Rattus norvegicus
cagctgtatctgagtgcggtcacac

SEQ ID NO: 231681 - DNA, 25 bp, Rattus norvegicus
cagctgtatctgtgtgcggtcacac

SEQ ID NO: 231682 - DNA, 25 bp, Rattus norvegicus
cagctgtcaattaatcctgtgaata

SEQ ID NO: 231683 - DNA, 25 bp, Rattus norvegicus
cagctgtcaatttatcctgtgaata

SEQ ID NO: 231684 - DNA, 25 bp, Rattus norvegicus
cagctgtcacaccactcaacgagag

SEQ ID NO: 231685 - DNA, 25 bp, Rattus norvegicus
cagctgtcacacgactcaacgagag

SEQ ID NO: 231686 - DNA, 25 bp, Rattus norvegicus
cagctgtcacccataagagcatgat

SEQ ID NO: 231687 - DNA, 25 bp, Rattus norvegicus
cagctgtcacccttaagagcatgat

SEQ ID NO: 231688 - DNA, 25 bp, Rattus norvegicus
cagctgtcagctcatggctactaac

SEQ ID NO: 231689 - DNA, 25 bp, Rattus norvegicus
cagctgtcagctgatggctactaac

SEQ ID NO: 231690 - DNA, 25 bp, Rattus norvegicus
cagctgtcatggaaacttctgttga

SEQ ID NO: 231691 - DNA, 25 bp, Rattus norvegicus
cagctgtcatggtaacttctgttga

SEQ ID NO: 231692 - DNA, 25 bp, Rattus norvegicus
cagctgtccagtcttggtgattcca

SEQ ID NO: 231693 - DNA, 25 bp, Rattus norvegicus
cagctgtccagtgttggtgattcca

SEQ ID NO: 231694 - DNA, 25 bp, Rattus norvegicus
cagctgtctgagctcttcaaaggta

SEQ ID NO: 231695 - DNA, 25 bp, Rattus norvegicus
cagctgtctgaggtcttcaaaggta

SEQ ID NO: 231696 - DNA, 25 bp, Rattus norvegicus
cagctgtctgatcgtgggctttgat

SEQ ID NO: 231697 - DNA, 25 bp, Rattus norvegicus
cagctgtctgatggtgggctttgat

SEQ ID NO: 231698 - DNA, 25 bp, Rattus norvegicus
cagctgtctttcatgtgcagataaa

SEQ ID NO: 231699 - DNA, 25 bp, Rattus norvegicus
cagctgtctttcattataatgagag

SEQ ID NO: 231700 - DNA, 25 bp, Rattus norvegicus
cagctgtctttcttgtgcagataaa

SEQ ID NO: 231701 - DNA, 25 bp, Rattus norvegicus
cagctgtctttctttataatgagag

SEQ ID NO: 231702 - DNA, 25 bp, Rattus norvegicus
cagctgtgaaacatctgtccacctt

SEQ ID NO: 231703 - DNA, 25 bp, Rattus norvegicus
cagctgtgaaacttctgtccacctt

SEQ ID NO: 231704 - DNA, 25 bp, Rattus norvegicus
cagctgtgatggcttctttccaatg

SEQ ID NO: 231705 - DNA, 25 bp, Rattus norvegicus
cagctgtgatgggttctttccaatg

SEQ ID NO: 231706 - DNA, 25 bp, Rattus norvegicus
cagctgtgcacactttgggttgttc

SEQ ID NO: 231707 - DNA, 25 bp, Rattus norvegicus
cagctgtgcacagtttgggttgttc

SEQ ID NO: 231708 - DNA, 25 bp, Rattus norvegicus
cagctgtggcccaacggagaagaca

SEQ ID NO: 231709 - DNA, 25 bp, Rattus norvegicus
cagctgtggccctacggagaagaca

SEQ ID NO: 231710 - DNA, 25 bp, Rattus norvegicus
cagctgtggcttagagagacgtcta

SEQ ID NO: 231711 - DNA, 25 bp, Rattus norvegicus
cagctgtggctttgagagacgtcta

SEQ ID NO: 231712 - DNA, 25 bp, Rattus norvegicus
cagctgtggtcaccggtcctaagta

SEQ ID NO: 231713 - DNA, 25 bp, Rattus norvegicus
cagctgtggtcagcggtcctaagta

SEQ ID NO: 231714 - DNA, 25 bp, Rattus norvegicus
cagctgtgtgcgatggtgtgtttct

SEQ ID NO: 231715 - DNA, 25 bp, Rattus norvegicus
cagctgtgtgcgttggtgtgtttct

SEQ ID NO: 231716 - DNA, 25 bp, Rattus norvegicus
cagctgtgtgctagtatcccaggat

SEQ ID NO: 231717 - DNA, 25 bp, Rattus norvegicus
cagctgtgtgcttgtatcccaggat

SEQ ID NO: 231718 - DNA, 25 bp, Rattus norvegicus
cagctgtgtggtcggtgttcccaac

SEQ ID NO: 231719 - DNA, 25 bp, Rattus norvegicus
cagctgtgtggtgggtgttcccaac

SEQ ID NO: 231720 - DNA, 25 bp, Rattus norvegicus
cagctgttaagactccttgttgctt

SEQ ID NO: 231721 - DNA, 25 bp, Rattus norvegicus
cagctgttaagagtccttgttgctt

SEQ ID NO: 231722 - DNA, 25 bp, Rattus norvegicus
cagctgttatctctcgtggttttca

SEQ ID NO: 231723 - DNA, 25 bp, Rattus norvegicus
cagctgttatctgtcgtggttttca

SEQ ID NO: 231724 - DNA, 25 bp, Rattus norvegicus
cagctgttctcacggtcgctttttt

SEQ ID NO: 231725 - DNA, 25 bp, Rattus norvegicus
cagctgttctcagggtcgctttttt

SEQ ID NO: 231726 - DNA, 25 bp, Rattus norvegicus
cagctgttggttcgtgtgcgaaatc

SEQ ID NO: 231727 - DNA, 25 bp, Rattus norvegicus
cagctgttggttggtgtgcgaaatc

SEQ ID NO: 231728 - DNA, 25 bp, Rattus norvegicus
cagctgttgtgacttttctgtgaca

SEQ ID NO: 231729 - DNA, 25 bp, Rattus norvegicus
cagctgttgtgagttttctgtgaca

SEQ ID NO: 231730 - DNA, 25 bp, Rattus norvegicus
cagctgttgtggatagatggcctat

SEQ ID NO: 231731 - DNA, 25 bp, Rattus norvegicus
cagctgttgtggttagatggcctat

SEQ ID NO: 231732 - DNA, 25 bp, Rattus norvegicus
cagctgtttcagacttagtggaggc

SEQ ID NO: 231733 - DNA, 25 bp, Rattus norvegicus
cagctgtttcagtcttagtggaggc

SEQ ID NO: 231734 - DNA, 25 bp, Rattus norvegicus
cagctgtttcttacatagatcattt

SEQ ID NO: 231735 - DNA, 25 bp, Rattus norvegicus
cagctgtttctttcatagatcattt

SEQ ID NO: 231736 - DNA, 25 bp, Rattus norvegicus
cagctgtttgggatctctgcagttc

SEQ ID NO: 231737 - DNA, 25 bp, Rattus norvegicus
cagctgtttgggttctctgcagttc

SEQ ID NO: 231738 - DNA, 25 bp, Rattus norvegicus
cagctgtttgtcagcctgtttgaag

SEQ ID NO: 231739 - DNA, 25 bp, Rattus norvegicus
cagctgtttgtctgcctgtttgaag

SEQ ID NO: 231740 - DNA, 25 bp, Rattus norvegicus
cagcttaaaataagctttggtcagt

SEQ ID NO: 231741 - DNA, 25 bp, Rattus norvegicus
cagcttaaaatatgctttggtcagt

SEQ ID NO: 231742 - DNA, 25 bp, Rattus norvegicus
cagcttactgcaacaatccaagttt

SEQ ID NO: 231743 - DNA, 25 bp, Rattus norvegicus
cagcttactgcatcaatccaagttt

SEQ ID NO: 231744 - DNA, 25 bp, Rattus norvegicus
cagcttacttggatgacctgcgcag

SEQ ID NO: 231745 - DNA, 25 bp, Rattus norvegicus
cagcttacttggttgacctgcgcag

SEQ ID NO: 231746 - DNA, 25 bp, Rattus norvegicus
cagcttagcagcagtaacgccattt

SEQ ID NO: 231747 - DNA, 25 bp, Rattus norvegicus
cagcttagcagctgtaacgccattt

SEQ ID NO: 231748 - DNA, 25 bp, Rattus norvegicus
cagcttaggctacatggagagatct

SEQ ID NO: 231749 - DNA, 25 bp, Rattus norvegicus
cagcttaggctagatggagagatct

SEQ ID NO: 231750 - DNA, 25 bp, Rattus norvegicus
cagcttataaaaaggaactgcgata

SEQ ID NO: 231751 - DNA, 25 bp, Rattus norvegicus
cagcttataaaatggaactgcgata

SEQ ID NO: 231752 - DNA, 25 bp, Rattus norvegicus
cagcttatcttgctctccatgacaa

SEQ ID NO: 231753 - DNA, 25 bp, Rattus norvegicus
cagcttatcttggtctccatgacaa

SEQ ID NO: 231754 - DNA, 25 bp, Rattus norvegicus
cagcttatgaatccttgcgtgtaac

SEQ ID NO: 231755 - DNA, 25 bp, Rattus norvegicus
cagcttatgaatgcttgcgtgtaac

SEQ ID NO: 231756 - DNA, 25 bp, Rattus norvegicus
cagcttattcacagcttggcttgta

SEQ ID NO: 231757 - DNA, 25 bp, Rattus norvegicus
cagcttattcactgcttggcttgta

SEQ ID NO: 231758 - DNA, 25 bp, Rattus norvegicus
cagcttcaagctagttttctcttaa

SEQ ID NO: 231759 - DNA, 25 bp, Rattus norvegicus
cagcttcaagcttgttttctcttaa

SEQ ID NO: 231760 - DNA, 25 bp, Rattus norvegicus
cagcttcacggcaggtgaggttgca

SEQ ID NO: 231761 - DNA, 25 bp, Rattus norvegicus
cagcttcacggctggtgaggttgca

SEQ ID NO: 231762 - DNA, 25 bp, Rattus norvegicus
cagcttcagttgatctaggaccttt

SEQ ID NO: 231763 - DNA, 25 bp, Rattus norvegicus
cagcttcagttgttctaggaccttt

SEQ ID NO: 231764 - DNA, 25 bp, Rattus norvegicus
cagcttcatataaccccagggacag

SEQ ID NO: 231765 - DNA, 25 bp, Rattus norvegicus
cagcttcatatatccccagggacag

SEQ ID NO: 231766 - DNA, 25 bp, Rattus norvegicus
cagcttcatttgagctctcttcata

SEQ ID NO: 231767 - DNA, 25 bp, Rattus norvegicus
cagcttcatttgtgctctcttcata

SEQ ID NO: 231768 - DNA, 25 bp, Rattus norvegicus
cagcttccccaaaaaaccagatgtt

SEQ ID NO: 231769 - DNA, 25 bp, Rattus norvegicus
cagcttccccaataaaccagatgtt

SEQ ID NO: 231770 - DNA, 25 bp, Rattus norvegicus
cagcttcctaatctgtttgtgtcca

SEQ ID NO: 231771 - DNA, 25 bp, Rattus norvegicus
cagcttcctaatgtgtttgtgtcca

SEQ ID NO: 231772 - DNA, 25 bp, Rattus norvegicus
cagcttcctcccatgttttgtttat

SEQ ID NO: 231773 - DNA, 25 bp, Rattus norvegicus
cagcttcctcccttgttttgtttat

SEQ ID NO: 231774 - DNA, 25 bp, Rattus norvegicus
cagcttccttggctatgtgaggtaa

SEQ ID NO: 231775 - DNA, 25 bp, Rattus norvegicus
cagcttccttgggtatgtgaggtaa

SEQ ID NO: 231776 - DNA, 25 bp, Rattus norvegicus
cagcttccttttcatgtgttgataa

SEQ ID NO: 231777 - DNA, 25 bp, Rattus norvegicus
cagcttccttttcggttgcagtcat

SEQ ID NO: 231778 - DNA, 25 bp, Rattus norvegicus
cagcttccttttgatgtgttgataa

SEQ ID NO: 231779 - DNA, 25 bp, Rattus norvegicus
cagcttccttttgggttgcagtcat

SEQ ID NO: 231780 - DNA, 25 bp, Rattus norvegicus
cagcttcgtgttcccctaattaggg

SEQ ID NO: 231781 - DNA, 25 bp, Rattus norvegicus
cagcttcgtgttgccctaattaggg

SEQ ID NO: 231782 - DNA, 25 bp, Rattus norvegicus
cagcttcgtttcaagtgttacccag

SEQ ID NO: 231783 - DNA, 25 bp, Rattus norvegicus
cagcttcgtttctagtgttacccag

SEQ ID NO: 231784 - DNA, 25 bp, Rattus norvegicus
cagcttctccttagcagccatgttt

SEQ ID NO: 231785 - DNA, 25 bp, Rattus norvegicus
cagcttctccttcctgggtaggagg

SEQ ID NO: 231786 - DNA, 25 bp, Rattus norvegicus
cagcttctccttgctgggtaggagg

SEQ ID NO: 231787 - DNA, 25 bp, Rattus norvegicus
cagcttctcctttgcagccatgttt

SEQ ID NO: 231788 - DNA, 25 bp, Rattus norvegicus
cagcttctcgtacctcagattttat

SEQ ID NO: 231789 - DNA, 25 bp, Rattus norvegicus
cagcttctcgtagctcagattttat

SEQ ID NO: 231790 - DNA, 25 bp, Rattus norvegicus
cagcttctctgtccctgcaaagaga

SEQ ID NO: 231791 - DNA, 25 bp, Rattus norvegicus
cagcttctctgtgcctgcaaagaga

SEQ ID NO: 231792 - DNA, 25 bp, Rattus norvegicus
cagcttctgctgcatctcctggttg

SEQ ID NO: 231793 - DNA, 25 bp, Rattus norvegicus
cagcttctgctggatctcctggttg

SEQ ID NO: 231794 - DNA, 25 bp, Rattus norvegicus
cagcttctggcaaacacaccattac

SEQ ID NO: 231795 - DNA, 25 bp, Rattus norvegicus
cagcttctggcatacacaccattac

SEQ ID NO: 231796 - DNA, 25 bp, Rattus norvegicus
cagcttcttcatcagggacatcatc

SEQ ID NO: 231797 - DNA, 25 bp, Rattus norvegicus
cagcttcttcatgagggacatcatc

SEQ ID NO: 231798 - DNA, 25 bp, Rattus norvegicus
cagcttcttggtaacattccctagt

SEQ ID NO: 231799 - DNA, 25 bp, Rattus norvegicus
cagcttcttggttacattccctagt

SEQ ID NO: 231800 - DNA, 25 bp, Rattus norvegicus
cagcttctttggagcagcgtcacaa

SEQ ID NO: 231801 - DNA, 25 bp, Rattus norvegicus
cagcttctttggtgcagcgtcacaa

SEQ ID NO: 231802 - DNA, 25 bp, Rattus norvegicus
cagcttgaaggaaccgttggcgccg

SEQ ID NO: 231803 - DNA, 25 bp, Rattus norvegicus
cagcttgaaggacctgggctgctct

SEQ ID NO: 231804 - DNA, 25 bp, Rattus norvegicus
cagcttgaaggagctgggctgctct

SEQ ID NO: 231805 - DNA, 25 bp, Rattus norvegicus
cagcttgaaggatccgttggcgccg

SEQ ID NO: 231806 - DNA, 25 bp, Rattus norvegicus
cagcttgacctaaacagagagtttc

SEQ ID NO: 231807 - DNA, 25 bp, Rattus norvegicus
cagcttgacctatacagagagtttc

SEQ ID NO: 231808 - DNA, 25 bp, Rattus norvegicus
cagcttgagcaacaaaccggcacag

SEQ ID NO: 231809 - DNA, 25 bp, Rattus norvegicus
cagcttgagcaagaaaccggcacag

SEQ ID NO: 231810 - DNA, 25 bp, Rattus norvegicus
cagcttgaggatactgaggcgtctc

SEQ ID NO: 231811 - DNA, 25 bp, Rattus norvegicus
cagcttgaggattctgaggcgtctc

SEQ ID NO: 231812 - DNA, 25 bp, Rattus norvegicus
cagcttgatttcactgtatcttgca

SEQ ID NO: 231813 - DNA, 25 bp, Rattus norvegicus
cagcttgatttctctgtatcttgca

SEQ ID NO: 231814 - DNA, 25 bp, Rattus norvegicus
cagcttgccaggatccttaactata

SEQ ID NO: 231815 - DNA, 25 bp, Rattus norvegicus
cagcttgccaggttccttaactata

SEQ ID NO: 231816 - DNA, 25 bp, Rattus norvegicus
cagcttgccctgcaagtgatcgtga

SEQ ID NO: 231817 - DNA, 25 bp, Rattus norvegicus
cagcttgccctggaagtgatcgtga

SEQ ID NO: 231818 - DNA, 25 bp, Rattus norvegicus
cagcttgctgaaaagtgtggcagta

SEQ ID NO: 231819 - DNA, 25 bp, Rattus norvegicus
cagcttgctgaatagtgtggcagta

SEQ ID NO: 231820 - DNA, 25 bp, Rattus norvegicus
cagcttgctggccagagaccagtca

SEQ ID NO: 231821 - DNA, 25 bp, Rattus norvegicus
cagcttgctggcgagagaccagtca

SEQ ID NO: 231822 - DNA, 25 bp, Rattus norvegicus
cagcttgcttttctgtgtcatgaag

SEQ ID NO: 231823 - DNA, 25 bp, Rattus norvegicus
cagcttgcttttgtgtgtcatgaag

SEQ ID NO: 231824 - DNA, 25 bp, Rattus norvegicus
cagcttggagctcgcagtacctatg

SEQ ID NO: 231825 - DNA, 25 bp, Rattus norvegicus
cagcttggagctggcagtacctatg

SEQ ID NO: 231826 - DNA, 25 bp, Rattus norvegicus
cagcttggcgcgatctagaggattc

SEQ ID NO: 231827 - DNA, 25 bp, Rattus norvegicus
cagcttggcgcgttctagaggattc

SEQ ID NO: 231828 - DNA, 25 bp, Rattus norvegicus
cagcttgtagagactccatgggcca

SEQ ID NO: 231829 - DNA, 25 bp, Rattus norvegicus
cagcttgtagagtctccatgggcca

SEQ ID NO: 231830 - DNA, 25 bp, Rattus norvegicus
cagcttgtagctagggccttgaaca

SEQ ID NO: 231831 - DNA, 25 bp, Rattus norvegicus
cagcttgtagcttgggccttgaaca

SEQ ID NO: 231832 - DNA, 25 bp, Rattus norvegicus
cagcttgtatgtcgaaggccctcat

SEQ ID NO: 231833 - DNA, 25 bp, Rattus norvegicus
cagcttgtatgtggaaggccctcat

SEQ ID NO: 231834 - DNA, 25 bp, Rattus norvegicus
cagcttgtcaggaccagcctggaca

SEQ ID NO: 231835 - DNA, 25 bp, Rattus norvegicus
cagcttgtcaggtccagcctggaca

SEQ ID NO: 231836 - DNA, 25 bp, Rattus norvegicus
cagcttgtcagtcattggccttttg

SEQ ID NO: 231837 - DNA, 25 bp, Rattus norvegicus
cagcttgtcagtgattggccttttg

SEQ ID NO: 231838 - DNA, 25 bp, Rattus norvegicus
cagcttgtgaaacacccaaatttca

SEQ ID NO: 231839 - DNA, 25 bp, Rattus norvegicus
cagcttgtgaaagacccaaatttca

SEQ ID NO: 231840 - DNA, 25 bp, Rattus norvegicus
cagcttgtgagtctactgagtaaca

SEQ ID NO: 231841 - DNA, 25 bp, Rattus norvegicus
cagcttgtgagtgtactgagtaaca

SEQ ID NO: 231842 - DNA, 25 bp, Rattus norvegicus
cagcttgtgcatcgaactttccaaa

SEQ ID NO: 231843 - DNA, 25 bp, Rattus norvegicus
cagcttgtgcatggaactttccaaa

SEQ ID NO: 231844 - DNA, 25 bp, Rattus norvegicus
cagcttgtgtgccatgtggttcaga

SEQ ID NO: 231845 - DNA, 25 bp, Rattus norvegicus
cagcttgtgtgcgatgtggttcaga

SEQ ID NO: 231846 - DNA, 25 bp, Rattus norvegicus
cagcttgttcgaaaattaggcaggg

SEQ ID NO: 231847 - DNA, 25 bp, Rattus norvegicus
cagcttgttcgataattaggcaggg

SEQ ID NO: 231848 - DNA, 25 bp, Rattus norvegicus
cagcttgttgcactttttcatacta

SEQ ID NO: 231849 - DNA, 25 bp, Rattus norvegicus
cagcttgttgcagtttttcatacta

SEQ ID NO: 231850 - DNA, 25 bp, Rattus norvegicus
cagctttactcgagttccctaggaa

SEQ ID NO: 231851 - DNA, 25 bp, Rattus norvegicus
cagctttactcgtgttccctaggaa

SEQ ID NO: 231852 - DNA, 25 bp, Rattus norvegicus
cagctttagactccgggctgttcat

SEQ ID NO: 231853 - DNA, 25 bp, Rattus norvegicus
cagctttagactgcgggctgttcat

SEQ ID NO: 231854 - DNA, 25 bp, Rattus norvegicus
cagctttagattcctcctttttgtt

SEQ ID NO: 231855 - DNA, 25 bp, Rattus norvegicus
cagctttagattgctcctttttgtt

SEQ ID NO: 231856 - DNA, 25 bp, Rattus norvegicus
cagctttatttaagttcgtacccct

SEQ ID NO: 231857 - DNA, 25 bp, Rattus norvegicus
cagctttatttatgttcgtacccct

SEQ ID NO: 231858 - DNA, 25 bp, Rattus norvegicus
cagctttcactgaggcaattagcag

SEQ ID NO: 231859 - DNA, 25 bp, Rattus norvegicus
cagctttcactgtggcaattagcag

SEQ ID NO: 231860 - DNA, 25 bp, Rattus norvegicus
cagctttccatgacaaatgtcgcat

SEQ ID NO: 231861 - DNA, 25 bp, Rattus norvegicus
cagctttccatgtcaaatgtcgcat

SEQ ID NO: 231862 - DNA, 25 bp, Rattus norvegicus
cagctttcctgcactttttacataa

SEQ ID NO: 231863 - DNA, 25 bp, Rattus norvegicus
cagctttcctgctctttttacataa

SEQ ID NO: 231864 - DNA, 25 bp, Rattus norvegicus
cagctttcgcgacatggtgtacaga

SEQ ID NO: 231865 - DNA, 25 bp, Rattus norvegicus
cagctttcgcgagatggtgtacaga

SEQ ID NO: 231866 - DNA, 25 bp, Rattus norvegicus
cagctttctctgcagttctatgtga

SEQ ID NO: 231867 - DNA, 25 bp, Rattus norvegicus
cagctttctctggagttctatgtga

SEQ ID NO: 231868 - DNA, 25 bp, Rattus norvegicus
cagctttctgctcggtctgggagac

SEQ ID NO: 231869 - DNA, 25 bp, Rattus norvegicus
cagctttctgctgggtctgggagac

SEQ ID NO: 231870 - DNA, 25 bp, Rattus norvegicus
cagctttctgggatgctggcacaga

SEQ ID NO: 231871 - DNA, 25 bp, Rattus norvegicus
cagctttctgggttgctggcacaga

SEQ ID NO: 231872 - DNA, 25 bp, Rattus norvegicus
cagctttctgtaagtggatctcggc

SEQ ID NO: 231873 - DNA, 25 bp, Rattus norvegicus
cagctttctgtatgtggatctcggc

SEQ ID NO: 231874 - DNA, 25 bp, Rattus norvegicus
cagctttgaaccctgaaactgcttg

SEQ ID NO: 231875 - DNA, 25 bp, Rattus norvegicus
cagctttgaaccgtgaaactgcttg

SEQ ID NO: 231876 - DNA, 25 bp, Rattus norvegicus
cagctttgccacatccagtgtgaca

SEQ ID NO: 231877 - DNA, 25 bp, Rattus norvegicus
cagctttgccacttccagtgtgaca

SEQ ID NO: 231878 - DNA, 25 bp, Rattus norvegicus
cagctttgccatcgtcttgaatgag

SEQ ID NO: 231879 - DNA, 25 bp, Rattus norvegicus
cagctttgccatggtcttgaatgag

SEQ ID NO: 231880 - DNA, 25 bp, Rattus norvegicus
cagctttgctggcacacaagcatat

SEQ ID NO: 231881 - DNA, 25 bp, Rattus norvegicus
cagctttgctgggacacaagcatat

SEQ ID NO: 231882 - DNA, 25 bp, Rattus norvegicus
cagctttgtttgaacttttttccag

SEQ ID NO: 231883 - DNA, 25 bp, Rattus norvegicus
cagctttgtttgtacttttttccag

SEQ ID NO: 231884 - DNA, 25 bp, Rattus norvegicus
cagcttttactaccaggctctgagt

SEQ ID NO: 231885 - DNA, 25 bp, Rattus norvegicus
cagcttttactagcaggctctgagt

SEQ ID NO: 231886 - DNA, 25 bp, Rattus norvegicus
cagcttttatataccacagtacagt

SEQ ID NO: 231887 - DNA, 25 bp, Rattus norvegicus
cagcttttatattccacagtacagt

SEQ ID NO: 231888 - DNA, 25 bp, Rattus norvegicus
cagcttttccttacagtgactggtg

SEQ ID NO: 231889 - DNA, 25 bp, Rattus norvegicus
cagcttttcctttcagtgactggtg

SEQ ID NO: 231890 - DNA, 25 bp, Rattus norvegicus
cagcttttggttctaggacatctaa

SEQ ID NO: 231891 - DNA, 25 bp, Rattus norvegicus
cagcttttggttgtaggacatctaa

SEQ ID NO: 231892 - DNA, 25 bp, Rattus norvegicus
cagcttttgtttactttgggcatgt

SEQ ID NO: 231893 - DNA, 25 bp, Rattus norvegicus
cagcttttgttttctttgggcatgt

SEQ ID NO: 231894 - DNA, 25 bp, Rattus norvegicus
cagctttttaatagcctggccacac

SEQ ID NO: 231895 - DNA, 25 bp, Rattus norvegicus
cagctttttaattgcctggccacac

SEQ ID NO: 231896 - DNA, 25 bp, Rattus norvegicus
cagctttttcctctgagagtttcac

SEQ ID NO: 231897 - DNA, 25 bp, Rattus norvegicus
cagctttttcctgtgagagtttcac

SEQ ID NO: 231898 - DNA, 25 bp, Rattus norvegicus
caggaaaaattgaacctggtacatt

SEQ ID NO: 231899 - DNA, 25 bp, Rattus norvegicus
caggaaaaattgtacctggtacatt

SEQ ID NO: 231900 - DNA, 25 bp, Rattus norvegicus
caggaaaaccagcagcgccccggag

SEQ ID NO: 231901 - DNA, 25 bp, Rattus norvegicus
caggaaaaccaggagcgccccggag

SEQ ID NO: 231902 - DNA, 25 bp, Rattus norvegicus
caggaaaaccccagctggacttgtt

SEQ ID NO: 231903 - DNA, 25 bp, Rattus norvegicus
caggaaaacccctgctggacttgtt

SEQ ID NO: 231904 - DNA, 25 bp, Rattus norvegicus
caggaaaagcgaaactccggaggcg

SEQ ID NO: 231905 - DNA, 25 bp, Rattus norvegicus
caggaaaagcgatactccggaggcg

SEQ ID NO: 231906 - DNA, 25 bp, Rattus norvegicus
caggaaaaggttctcgtggcctctt

SEQ ID NO: 231907 - DNA, 25 bp, Rattus norvegicus
caggaaaaggttgtcgtggcctctt

SEQ ID NO: 231908 - DNA, 25 bp, Rattus norvegicus
caggaaaatcctcagaacttcccca

SEQ ID NO: 231909 - DNA, 25 bp, Rattus norvegicus
caggaaaatcctgagaacttcccca

SEQ ID NO: 231910 - DNA, 25 bp, Rattus norvegicus
caggaaaatgtgatgtccgtattaa

SEQ ID NO: 231911 - DNA, 25 bp, Rattus norvegicus
caggaaaatgtgttgtccgtattaa

SEQ ID NO: 231912 - DNA, 25 bp, Rattus norvegicus
caggaaaatgttcctcttcccgaca

SEQ ID NO: 231913 - DNA, 25 bp, Rattus norvegicus
caggaaaatgttgctcttcccgaca

SEQ ID NO: 231914 - DNA, 25 bp, Rattus norvegicus
caggaaacagttacctgcagtttta

SEQ ID NO: 231915 - DNA, 25 bp, Rattus norvegicus
caggaaacagtttcctgcagtttta

SEQ ID NO: 231916 - DNA, 25 bp, Rattus norvegicus
caggaaaccgctcgctgaatcttca

SEQ ID NO: 231917 - DNA, 25 bp, Rattus norvegicus
caggaaaccgctggctgaatcttca

SEQ ID NO: 231918 - DNA, 25 bp, Rattus norvegicus
caggaaactgttctgtttgttgttg

SEQ ID NO: 231919 - DNA, 25 bp, Rattus norvegicus
caggaaactgttgtgtttgttgttg

SEQ ID NO: 231920 - DNA, 25 bp, Rattus norvegicus
caggaaagccctcgaaacgcaccgg

SEQ ID NO: 231921 - DNA, 25 bp, Rattus norvegicus
caggaaagccctggaaacgcaccgg

SEQ ID NO: 231922 - DNA, 25 bp, Rattus norvegicus
caggaaaggctgatgttgtgtctcc

SEQ ID NO: 231923 - DNA, 25 bp, Rattus norvegicus
caggaaaggctgttgttgtgtctcc

SEQ ID NO: 231924 - DNA, 25 bp, Rattus norvegicus
caggaaatagtgctagacaccttta

SEQ ID NO: 231925 - DNA, 25 bp, Rattus norvegicus
caggaaatagtggtagacaccttta

SEQ ID NO: 231926 - DNA, 25 bp, Rattus norvegicus
caggaaatcctaaccataaattttg

SEQ ID NO: 231927 - DNA, 25 bp, Rattus norvegicus
caggaaatcctatccataaattttg

SEQ ID NO: 231928 - DNA, 25 bp, Rattus norvegicus
caggaaatgcctctggagttctaca

SEQ ID NO: 231929 - DNA, 25 bp, Rattus norvegicus
caggaaatgcctgtggagttctaca

SEQ ID NO: 231930 - DNA, 25 bp, Rattus norvegicus
caggaaatggctatctgcagaatta

SEQ ID NO: 231931 - DNA, 25 bp, Rattus norvegicus
caggaaatggctttctgcagaatta

SEQ ID NO: 231932 - DNA, 25 bp, Rattus norvegicus
caggaaattcctaggcctgtaatta

SEQ ID NO: 231933 - DNA, 25 bp, Rattus norvegicus
caggaaattccttggcctgtaatta

SEQ ID NO: 231934 - DNA, 25 bp, Rattus norvegicus
caggaacaacagactcctgcttggg

SEQ ID NO: 231935 - DNA, 25 bp, Rattus norvegicus
caggaacaacagtctcctgcttggg

SEQ ID NO: 231936 - DNA, 25 bp, Rattus norvegicus
caggaacaagccctatgtctcatgg

SEQ ID NO: 231937 - DNA, 25 bp, Rattus norvegicus
caggaacaagccgtatgtctcatgg

SEQ ID NO: 231938 - DNA, 25 bp, Rattus norvegicus
caggaacagagtcagcgccttggtt

SEQ ID NO: 231939 - DNA, 25 bp, Rattus norvegicus
caggaacagagtgagcgccttggtt

SEQ ID NO: 231940 - DNA, 25 bp, Rattus norvegicus
caggaacaggtgagcgcttttcaaa

SEQ ID NO: 231941 - DNA, 25 bp, Rattus norvegicus
caggaacaggtgtgcgcttttcaaa

SEQ ID NO: 231942 - DNA, 25 bp, Rattus norvegicus
caggaacatatgagagctgtgcatt

SEQ ID NO: 231943 - DNA, 25 bp, Rattus norvegicus
caggaacatatgtgagctgtgcatt

SEQ ID NO: 231944 - DNA, 25 bp, Rattus norvegicus
caggaacccggccatggaagccatg

SEQ ID NO: 231945 - DNA, 25 bp, Rattus norvegicus
caggaacccggcgatggaagccatg

SEQ ID NO: 231946 - DNA, 25 bp, Rattus norvegicus
caggaacctttccttgattctttgg

SEQ ID NO: 231947 - DNA, 25 bp, Rattus norvegicus
caggaacctttcgttgattctttgg

SEQ ID NO: 231948 - DNA, 25 bp, Rattus norvegicus
caggaacgtaggctcttcaggaatt

SEQ ID NO: 231949 - DNA, 25 bp, Rattus norvegicus
caggaacgtagggtcttcaggaatt

SEQ ID NO: 231950 - DNA, 25 bp, Rattus norvegicus
caggaactaagcacccgctgggaga

SEQ ID NO: 231951 - DNA, 25 bp, Rattus norvegicus
caggaactaagctcccgctgggaga

SEQ ID NO: 231952 - DNA, 25 bp, Rattus norvegicus
caggaactgaatatctgactgttaa

SEQ ID NO: 231953 - DNA, 25 bp, Rattus norvegicus
caggaactgaatttctgactgttaa

SEQ ID NO: 231954 - DNA, 25 bp, Rattus norvegicus
caggaactgaccatgtgctccactg

SEQ ID NO: 231955 - DNA, 25 bp, Rattus norvegicus
caggaactgaccttgtgctccactg

SEQ ID NO: 231956 - DNA, 25 bp, Rattus norvegicus
caggaactgaggagcttacttgtat

SEQ ID NO: 231957 - DNA, 25 bp, Rattus norvegicus
caggaactgaggtgcttacttgtat

SEQ ID NO: 231958 - DNA, 25 bp, Rattus norvegicus
caggaactggttctcaatgtgggtc

SEQ ID NO: 231959 - DNA, 25 bp, Rattus norvegicus
caggaactggttgtcaatgtgggtc

SEQ ID NO: 231960 - DNA, 25 bp, Rattus norvegicus
caggaacttcctccgctagctgggc

SEQ ID NO: 231961 - DNA, 25 bp, Rattus norvegicus
caggaacttcctgcgctagctgggc

SEQ ID NO: 231962 - DNA, 25 bp, Rattus norvegicus
caggaacttgggaaatgtccccagg

SEQ ID NO: 231963 - DNA, 25 bp, Rattus norvegicus
caggaacttgggtaatgtccccagg

SEQ ID NO: 231964 - DNA, 25 bp, Rattus norvegicus
caggaagaaaccatgccaacctcaa

SEQ ID NO: 231965 - DNA, 25 bp, Rattus norvegicus
caggaagaaaccttgccaacctcaa

SEQ ID NO: 231966 - DNA, 25 bp, Rattus norvegicus
caggaagaattaaaccctcatctcc

SEQ ID NO: 231967 - DNA, 25 bp, Rattus norvegicus
caggaagaattataccctcatctcc

SEQ ID NO: 231968 - DNA, 25 bp, Rattus norvegicus
caggaagaattcacccagggcatct

SEQ ID NO: 231969 - DNA, 25 bp, Rattus norvegicus
caggaagaattctcccagggcatct

SEQ ID NO: 231970 - DNA, 25 bp, Rattus norvegicus
caggaagacatgagccttctgcccc

SEQ ID NO: 231971 - DNA, 25 bp, Rattus norvegicus
caggaagacatgtgccttctgcccc

SEQ ID NO: 231972 - DNA, 25 bp, Rattus norvegicus
caggaagacattatgaggtattgac

SEQ ID NO: 231973 - DNA, 25 bp, Rattus norvegicus
caggaagacattttgaggtattgac

SEQ ID NO: 231974 - DNA, 25 bp, Rattus norvegicus
caggaagaccccagtgccttttgac

SEQ ID NO: 231975 - DNA, 25 bp, Rattus norvegicus
caggaagacccctgtgccttttgac

SEQ ID NO: 231976 - DNA, 25 bp, Rattus norvegicus
caggaagacttccagctgctgtgcc

SEQ ID NO: 231977 - DNA, 25 bp, Rattus norvegicus
caggaagacttcgagctgctgtgcc

SEQ ID NO: 231978 - DNA, 25 bp, Rattus norvegicus
caggaagagccgcacacttacagtt

SEQ ID NO: 231979 - DNA, 25 bp, Rattus norvegicus
caggaagagccggacacttacagtt

SEQ ID NO: 231980 - DNA, 25 bp, Rattus norvegicus
caggaagaggaaagtgccagccaat

SEQ ID NO: 231981 - DNA, 25 bp, Rattus norvegicus
caggaagaggaatgtgccagccaat

SEQ ID NO: 231982 - DNA, 25 bp, Rattus norvegicus
caggaagatctcagacttactttgg

SEQ ID NO: 231983 - DNA, 25 bp, Rattus norvegicus
caggaagatctctgacttactttgg

SEQ ID NO: 231984 - DNA, 25 bp, Rattus norvegicus
caggaagcacatcgtgttcttgggt

SEQ ID NO: 231985 - DNA, 25 bp, Rattus norvegicus
caggaagcacatggtgttcttgggt

SEQ ID NO: 231986 - DNA, 25 bp, Rattus norvegicus
caggaagccacaagccactgaagct

SEQ ID NO: 231987 - DNA, 25 bp, Rattus norvegicus
caggaagccacatgccactgaagct

SEQ ID NO: 231988 - DNA, 25 bp, Rattus norvegicus
caggaagccggaagtcgctgccgcc

SEQ ID NO: 231989 - DNA, 25 bp, Rattus norvegicus
caggaagccggatgtcgctgccgcc

SEQ ID NO: 231990 - DNA, 25 bp, Rattus norvegicus
caggaagccgttatcaactccagac

SEQ ID NO: 231991 - DNA, 25 bp, Rattus norvegicus
caggaagccgttttcaactccagac

SEQ ID NO: 231992 - DNA, 25 bp, Rattus norvegicus
caggaagcctgaccccactgagtca

SEQ ID NO: 231993 - DNA, 25 bp, Rattus norvegicus
caggaagcctgagcccactgagtca

SEQ ID NO: 231994 - DNA, 25 bp, Rattus norvegicus
caggaagctcttctagactgctata

SEQ ID NO: 231995 - DNA, 25 bp, Rattus norvegicus
caggaagctcttcttgtttggaact

SEQ ID NO: 231996 - DNA, 25 bp, Rattus norvegicus
caggaagctcttgtagactgctata

SEQ ID NO: 231997 - DNA, 25 bp, Rattus norvegicus
caggaagctcttgttgtttggaact

SEQ ID NO: 231998 - DNA, 25 bp, Rattus norvegicus
caggaagctgccagagtcctctgaa

SEQ ID NO: 231999 - DNA, 25 bp, Rattus norvegicus
caggaagctgcctgagtcctctgaa

SEQ ID NO: 232000 - DNA, 25 bp, Rattus norvegicus
caggaagctgttatcctgtcccatg

SEQ ID NO: 232001 - DNA, 25 bp, Rattus norvegicus
caggaagctgttttcctgtcccatg

SEQ ID NO: 232002 - DNA, 25 bp, Rattus norvegicus
caggaaggaagaaccccatttccaa

SEQ ID NO: 232003 - DNA, 25 bp, Rattus norvegicus
caggaaggaagatccccatttccaa

SEQ ID NO: 232004 - DNA, 25 bp, Rattus norvegicus
caggaaggaattagtcagtctctat

SEQ ID NO: 232005 - DNA, 25 bp, Rattus norvegicus
caggaaggaatttgtcagtctctat

SEQ ID NO: 232006 - DNA, 25 bp, Rattus norvegicus
caggaaggacagctgttttggcttc

SEQ ID NO: 232007 - DNA, 25 bp, Rattus norvegicus
caggaaggacaggtgttttggcttc

SEQ ID NO: 232008 - DNA, 25 bp, Rattus norvegicus
caggaaggccagaagtgtgaagaca

SEQ ID NO: 232009 - DNA, 25 bp, Rattus norvegicus
caggaaggccagtagtgtgaagaca

SEQ ID NO: 232010 - DNA, 25 bp, Rattus norvegicus
caggaaggcctacgtgaacatgtca

SEQ ID NO: 232011 - DNA, 25 bp, Rattus norvegicus
caggaaggcctaggtgaacatgtca

SEQ ID NO: 232012 - DNA, 25 bp, Rattus norvegicus
caggaaggctctcggtaattcccct

SEQ ID NO: 232013 - DNA, 25 bp, Rattus norvegicus
caggaaggctctgggtaattcccct

SEQ ID NO: 232014 - DNA, 25 bp, Rattus norvegicus
caggaagggacccagtgcggcccca

SEQ ID NO: 232015 - DNA, 25 bp, Rattus norvegicus
caggaagggaccgagtgcggcccca

SEQ ID NO: 232016 - DNA, 25 bp, Rattus norvegicus
caggaagggagcacaatttggaata

SEQ ID NO: 232017 - DNA, 25 bp, Rattus norvegicus
caggaagggagctcaatttggaata

SEQ ID NO: 232018 - DNA, 25 bp, Rattus norvegicus
caggaaggtcttaccactcggtgaa

SEQ ID NO: 232019 - DNA, 25 bp, Rattus norvegicus
caggaaggtctttccactcggtgaa

SEQ ID NO: 232020 - DNA, 25 bp, Rattus norvegicus
caggaaggtgggaccccagaatcct

SEQ ID NO: 232021 - DNA, 25 bp, Rattus norvegicus
caggaaggtgggtccccagaatcct

SEQ ID NO: 232022 - DNA, 25 bp, Rattus norvegicus
caggaagtaaatcagcagctcacaa

SEQ ID NO: 232023 - DNA, 25 bp, Rattus norvegicus
caggaagtaaatgagcagctcacaa

SEQ ID NO: 232024 - DNA, 25 bp, Rattus norvegicus
caggaagtctaacaacaagcttgta

SEQ ID NO: 232025 - DNA, 25 bp, Rattus norvegicus
caggaagtctaagaacaagcttgta

SEQ ID NO: 232026 - DNA, 25 bp, Rattus norvegicus
caggaagtgcctcgctactcatcca

SEQ ID NO: 232027 - DNA, 25 bp, Rattus norvegicus
caggaagtgcctggctactcatcca

SEQ ID NO: 232028 - DNA, 25 bp, Rattus norvegicus
caggaagtggctatggcaggataaa

SEQ ID NO: 232029 - DNA, 25 bp, Rattus norvegicus
caggaagtggctttggcaggataaa

SEQ ID NO: 232030 - DNA, 25 bp, Rattus norvegicus
caggaagtgtgtaggcagcctcttg

SEQ ID NO: 232031 - DNA, 25 bp, Rattus norvegicus
caggaagtgtgttggcagcctcttg

SEQ ID NO: 232032 - DNA, 25 bp, Rattus norvegicus
caggaagttcctcgttttgacaatg

SEQ ID NO: 232033 - DNA, 25 bp, Rattus norvegicus
caggaagttcctggttttgacaatg

SEQ ID NO: 232034 - DNA, 25 bp, Rattus norvegicus
caggaagttctccgaacagtctttt

SEQ ID NO: 232035 - DNA, 25 bp, Rattus norvegicus
caggaagttctcggaacagtctttt

SEQ ID NO: 232036 - DNA, 25 bp, Rattus norvegicus
caggaagttctgatggcacactgat

SEQ ID NO: 232037 - DNA, 25 bp, Rattus norvegicus
caggaagttctgttggcacactgat

SEQ ID NO: 232038 - DNA, 25 bp, Rattus norvegicus
caggaagttttcatctcccctaact

SEQ ID NO: 232039 - DNA, 25 bp, Rattus norvegicus
caggaagttttcttctcccctaact

SEQ ID NO: 232040 - DNA, 25 bp, Rattus norvegicus
caggaataaaagatcttgtcccaaa

SEQ ID NO: 232041 - DNA, 25 bp, Rattus norvegicus
caggaataaaagttcttgtcccaaa

SEQ ID NO: 232042 - DNA, 25 bp, Rattus norvegicus
caggaatactttcgctctagctccc

SEQ ID NO: 232043 - DNA, 25 bp, Rattus norvegicus
caggaatactttggctctagctccc

SEQ ID NO: 232044 - DNA, 25 bp, Rattus norvegicus
caggaatataagatgcttctgcaca

SEQ ID NO: 232045 - DNA, 25 bp, Rattus norvegicus
caggaatataagttgcttctgcaca

SEQ ID NO: 232046 - DNA, 25 bp, Rattus norvegicus
caggaatatctgaccatgagcggca

SEQ ID NO: 232047 - DNA, 25 bp, Rattus norvegicus
caggaatatctgtccatgagcggca

SEQ ID NO: 232048 - DNA, 25 bp, Rattus norvegicus
caggaatcaggaacaccagtggctt

SEQ ID NO: 232049 - DNA, 25 bp, Rattus norvegicus
caggaatcaggatcaccagtggctt

SEQ ID NO: 232050 - DNA, 25 bp, Rattus norvegicus
caggaatcatcaccggtggcacaaa

SEQ ID NO: 232051 - DNA, 25 bp, Rattus norvegicus
caggaatcatcagcggtggcacaaa

SEQ ID NO: 232052 - DNA, 25 bp, Rattus norvegicus
caggaatccattagctatgttaagc

SEQ ID NO: 232053 - DNA, 25 bp, Rattus norvegicus
caggaatccatttgctatgttaagc

SEQ ID NO: 232054 - DNA, 25 bp, Rattus norvegicus
caggaatcctgcagggaggctgcaa

SEQ ID NO: 232055 - DNA, 25 bp, Rattus norvegicus
caggaatcctgctgggaggctgcaa

SEQ ID NO: 232056 - DNA, 25 bp, Rattus norvegicus
caggaatccttaccggctttatccg

SEQ ID NO: 232057 - DNA, 25 bp, Rattus norvegicus
caggaatccttagcggctttatccg

SEQ ID NO: 232058 - DNA, 25 bp, Rattus norvegicus
caggaatcgggaagcacaacgcgga

SEQ ID NO: 232059 - DNA, 25 bp, Rattus norvegicus
caggaatcgggatgcacaacgcgga

SEQ ID NO: 232060 - DNA, 25 bp, Rattus norvegicus
caggaatctcttcgcttcaatcatg

SEQ ID NO: 232061 - DNA, 25 bp, Rattus norvegicus
caggaatctcttggcttcaatcatg

SEQ ID NO: 232062 - DNA, 25 bp, Rattus norvegicus
caggaatgcctgcactcaacgaaat

SEQ ID NO: 232063 - DNA, 25 bp, Rattus norvegicus
caggaatgcctggactcaacgaaat

SEQ ID NO: 232064 - DNA, 25 bp, Rattus norvegicus
caggaattccacctgtggcttttta

SEQ ID NO: 232065 - DNA, 25 bp, Rattus norvegicus
caggaattccacgtgtggcttttta

SEQ ID NO: 232066 - DNA, 25 bp, Rattus norvegicus
caggaattctctactctactataat

SEQ ID NO: 232067 - DNA, 25 bp, Rattus norvegicus
caggaattctcttctctactataat

SEQ ID NO: 232068 - DNA, 25 bp, Rattus norvegicus
caggaattgcaccagcccagatcat

SEQ ID NO: 232069 - DNA, 25 bp, Rattus norvegicus
caggaattgcacgagcccagatcat

SEQ ID NO: 232070 - DNA, 25 bp, Rattus norvegicus
caggaattgtgtctgttggccatca

SEQ ID NO: 232071 - DNA, 25 bp, Rattus norvegicus
caggaattgtgtgtgttggccatca

SEQ ID NO: 232072 - DNA, 25 bp, Rattus norvegicus
caggaatttgccaccaaccctgata

SEQ ID NO: 232073 - DNA, 25 bp, Rattus norvegicus
caggaatttgcctccaaccctgata

SEQ ID NO: 232074 - DNA, 25 bp, Rattus norvegicus
caggaatttggtcttgcccggttca

SEQ ID NO: 232075 - DNA, 25 bp, Rattus norvegicus
caggaatttggtgttgcccggttca

SEQ ID NO: 232076 - DNA, 25 bp, Rattus norvegicus
caggacaacttgcaggattcggttt

SEQ ID NO: 232077 - DNA, 25 bp, Rattus norvegicus
caggacaacttggaggattcggttt

SEQ ID NO: 232078 - DNA, 25 bp, Rattus norvegicus
caggacaagcacagccatttggcta

SEQ ID NO: 232079 - DNA, 25 bp, Rattus norvegicus
caggacaagcactgccatttggcta

SEQ ID NO: 232080 - DNA, 25 bp, Rattus norvegicus
caggacaatgtcatcgtgctaccgt

SEQ ID NO: 232081 - DNA, 25 bp, Rattus norvegicus
caggacaatgtcttcgtgctaccgt

SEQ ID NO: 232082 - DNA, 25 bp, Rattus norvegicus
caggacacacacaggagtcagaccc

SEQ ID NO: 232083 - DNA, 25 bp, Rattus norvegicus
caggacacacactggagtcagaccc

SEQ ID NO: 232084 - DNA, 25 bp, Rattus norvegicus
caggacacactgacgtagatttgct

SEQ ID NO: 232085 - DNA, 25 bp, Rattus norvegicus
caggacacactgtcgtagatttgct

SEQ ID NO: 232086 - DNA, 25 bp, Rattus norvegicus
caggacacaggccagctcaggtgat

SEQ ID NO: 232087 - DNA, 25 bp, Rattus norvegicus
caggacacaggcgagctcaggtgat

SEQ ID NO: 232088 - DNA, 25 bp, Rattus norvegicus
caggacacctcgataaatttgccag

SEQ ID NO: 232089 - DNA, 25 bp, Rattus norvegicus
caggacacctcgttaaatttgccag

SEQ ID NO: 232090 - DNA, 25 bp, Rattus norvegicus
caggacactgctagatcaccactgt

SEQ ID NO: 232091 - DNA, 25 bp, Rattus norvegicus
caggacactgcttgatcaccactgt

SEQ ID NO: 232092 - DNA, 25 bp, Rattus norvegicus
caggacagagaaacgagccgctttt

SEQ ID NO: 232093 - DNA, 25 bp, Rattus norvegicus
caggacagagaatcgagccgctttt

SEQ ID NO: 232094 - DNA, 25 bp, Rattus norvegicus
caggacagccctagaggtccctttc

SEQ ID NO: 232095 - DNA, 25 bp, Rattus norvegicus
caggacagcccttgaggtccctttc

SEQ ID NO: 232096 - DNA, 25 bp, Rattus norvegicus
caggacagggtcacagcatgtttaa

SEQ ID NO: 232097 - DNA, 25 bp, Rattus norvegicus
caggacagggtctcagcatgtttaa

SEQ ID NO: 232098 - DNA, 25 bp, Rattus norvegicus
caggacagtgatatccaagctgagt

SEQ ID NO: 232099 - DNA, 25 bp, Rattus norvegicus
caggacagtgatttccaagctgagt

SEQ ID NO: 232100 - DNA, 25 bp, Rattus norvegicus
caggacagtggcatcatttagggtt

SEQ ID NO: 232101 - DNA, 25 bp, Rattus norvegicus
caggacagtggcttcatttagggtt

SEQ ID NO: 232102 - DNA, 25 bp, Rattus norvegicus
caggacagttggaaaagcgtcttta

SEQ ID NO: 232103 - DNA, 25 bp, Rattus norvegicus
caggacagttggtaaagcgtcttta

SEQ ID NO: 232104 - DNA, 25 bp, Rattus norvegicus
caggacatcaagacggagaacggta

SEQ ID NO: 232105 - DNA, 25 bp, Rattus norvegicus
caggacatcaagtcggagaacggta

SEQ ID NO: 232106 - DNA, 25 bp, Rattus norvegicus
caggacatcattcccatcttgggta

SEQ ID NO: 232107 - DNA, 25 bp, Rattus norvegicus
caggacatcattcgccgtttcaagt

SEQ ID NO: 232108 - DNA, 25 bp, Rattus norvegicus
caggacatcattgccatcttgggta

SEQ ID NO: 232109 - DNA, 25 bp, Rattus norvegicus
caggacatcattggccgtttcaagt

SEQ ID NO: 232110 - DNA, 25 bp, Rattus norvegicus
caggacatccaactgtttgccatgg

SEQ ID NO: 232111 - DNA, 25 bp, Rattus norvegicus
caggacatccaagtgtttgccatgg

SEQ ID NO: 232112 - DNA, 25 bp, Rattus norvegicus
caggacatcctcagaactcagcagt

SEQ ID NO: 232113 - DNA, 25 bp, Rattus norvegicus
caggacatcctctgaactcagcagt

SEQ ID NO: 232114 - DNA, 25 bp, Rattus norvegicus
caggacatgcaactgctgtggtatc

SEQ ID NO: 232115 - DNA, 25 bp, Rattus norvegicus
caggacatgcaagtgctgtggtatc

SEQ ID NO: 232116 - DNA, 25 bp, Rattus norvegicus
caggacattcctagcttggacagca

SEQ ID NO: 232117 - DNA, 25 bp, Rattus norvegicus
caggacattccttgcttggacagca

SEQ ID NO: 232118 - DNA, 25 bp, Rattus norvegicus
caggacattgatatggagtgtggct

SEQ ID NO: 232119 - DNA, 25 bp, Rattus norvegicus
caggacattgatttggagtgtggct

SEQ ID NO: 232120 - DNA, 25 bp, Rattus norvegicus
caggaccaggtcagtgggaaccgtc

SEQ ID NO: 232121 - DNA, 25 bp, Rattus norvegicus
caggaccaggtctgtgggaaccgtc

SEQ ID NO: 232122 - DNA, 25 bp, Rattus norvegicus
caggaccatcctcttgctcatgagc

SEQ ID NO: 232123 - DNA, 25 bp, Rattus norvegicus
caggaccatcctgttgctcatgagc

SEQ ID NO: 232124 - DNA, 25 bp, Rattus norvegicus
caggacccacagaacctaagttact

SEQ ID NO: 232125 - DNA, 25 bp, Rattus norvegicus
caggacccacagtacctaagttact

SEQ ID NO: 232126 - DNA, 25 bp, Rattus norvegicus
caggacccacatatgctttgaacta

SEQ ID NO: 232127 - DNA, 25 bp, Rattus norvegicus
caggacccacatttgctttgaacta

SEQ ID NO: 232128 - DNA, 25 bp, Rattus norvegicus
caggacccaggtagcttagtcaagt

SEQ ID NO: 232129 - DNA, 25 bp, Rattus norvegicus
caggacccaggttgcttagtcaagt

SEQ ID NO: 232130 - DNA, 25 bp, Rattus norvegicus
caggacccggatctaccatcggaag

SEQ ID NO: 232131 - DNA, 25 bp, Rattus norvegicus
caggacccggatgtaccatcggaag

SEQ ID NO: 232132 - DNA, 25 bp, Rattus norvegicus
caggaccctggacttgagagaagac

SEQ ID NO: 232133 - DNA, 25 bp, Rattus norvegicus
caggaccctggagttgagagaagac

SEQ ID NO: 232134 - DNA, 25 bp, Rattus norvegicus
caggaccgcgcaccatacaaagaat

SEQ ID NO: 232135 - DNA, 25 bp, Rattus norvegicus
caggaccgcgcagcatacaaagaat

SEQ ID NO: 232136 - DNA, 25 bp, Rattus norvegicus
caggaccgtgctaggcttggtgaca

SEQ ID NO: 232137 - DNA, 25 bp, Rattus norvegicus
caggaccgtgcttggcttggtgaca

SEQ ID NO: 232138 - DNA, 25 bp, Rattus norvegicus
caggacctagacaagcagcagcgca

SEQ ID NO: 232139 - DNA, 25 bp, Rattus norvegicus
caggacctagactagcagcagcgca

SEQ ID NO: 232140 - DNA, 25 bp, Rattus norvegicus
caggacctagttctatttcttttca

SEQ ID NO: 232141 - DNA, 25 bp, Rattus norvegicus
caggacctagttgtatttcttttca

SEQ ID NO: 232142 - DNA, 25 bp, Rattus norvegicus
caggacctatgcatggctttggctt

SEQ ID NO: 232143 - DNA, 25 bp, Rattus norvegicus
caggacctatgcttggctttggctt

SEQ ID NO: 232144 - DNA, 25 bp, Rattus norvegicus
caggacctcaaaaggctctgtcagc

SEQ ID NO: 232145 - DNA, 25 bp, Rattus norvegicus
caggacctcaaatggctctgtcagc

SEQ ID NO: 232146 - DNA, 25 bp, Rattus norvegicus
caggacctcacccattatgggaaac

SEQ ID NO: 232147 - DNA, 25 bp, Rattus norvegicus
caggacctcaccgattatgggaaac

SEQ ID NO: 232148 - DNA, 25 bp, Rattus norvegicus
caggacctctcacaacacagtggag

SEQ ID NO: 232149 - DNA, 25 bp, Rattus norvegicus
caggacctctcagaacacagtggag

SEQ ID NO: 232150 - DNA, 25 bp, Rattus norvegicus
caggacctgaacaggctgcagcaag

SEQ ID NO: 232151 - DNA, 25 bp, Rattus norvegicus
caggacctgaactggctgcagcaag

SEQ ID NO: 232152 - DNA, 25 bp, Rattus norvegicus
caggacctgagaaattgggatttag

SEQ ID NO: 232153 - DNA, 25 bp, Rattus norvegicus
caggacctgagatattgggatttag

SEQ ID NO: 232154 - DNA, 25 bp, Rattus norvegicus
caggacctgctgaacggctttgtgg

SEQ ID NO: 232155 - DNA, 25 bp, Rattus norvegicus
caggacctgctgcagaagatttaca

SEQ ID NO: 232156 - DNA, 25 bp, Rattus norvegicus
caggacctgctggagaagatttaca

SEQ ID NO: 232157 - DNA, 25 bp, Rattus norvegicus
caggacctgctgtacggctttgtgg

SEQ ID NO: 232158 - DNA, 25 bp, Rattus norvegicus
caggacctgggaccccacaaggaga

SEQ ID NO: 232159 - DNA, 25 bp, Rattus norvegicus
caggacctgggagcccacaaggaga

SEQ ID NO: 232160 - DNA, 25 bp, Rattus norvegicus
caggacctggtaagccaaactcgat

SEQ ID NO: 232161 - DNA, 25 bp, Rattus norvegicus
caggacctggtatgccaaactcgat

SEQ ID NO: 232162 - DNA, 25 bp, Rattus norvegicus
caggacctggtcctgcaggaagcaa

SEQ ID NO: 232163 - DNA, 25 bp, Rattus norvegicus
caggacctggtcgtgcaggaagcaa

SEQ ID NO: 232164 - DNA, 25 bp, Rattus norvegicus
caggacctggttctttcatttggag

SEQ ID NO: 232165 - DNA, 25 bp, Rattus norvegicus
caggacctggttgtttcatttggag

SEQ ID NO: 232166 - DNA, 25 bp, Rattus norvegicus
caggaccttctcaaggcatctaatt

SEQ ID NO: 232167 - DNA, 25 bp, Rattus norvegicus
caggaccttctctaggcatctaatt

SEQ ID NO: 232168 - DNA, 25 bp, Rattus norvegicus
caggaccttgctcgcagctatggca

SEQ ID NO: 232169 - DNA, 25 bp, Rattus norvegicus
caggaccttgctggcagctatggca

SEQ ID NO: 232170 - DNA, 25 bp, Rattus norvegicus
caggaccttgtacagagcttcggat

SEQ ID NO: 232171 - DNA, 25 bp, Rattus norvegicus
caggaccttgtagagagcttcggat

SEQ ID NO: 232172 - DNA, 25 bp, Rattus norvegicus
caggacgacattcaggtgacccagt

SEQ ID NO: 232173 - DNA, 25 bp, Rattus norvegicus
caggacgacattgaggtgacccagt

SEQ ID NO: 232174 - DNA, 25 bp, Rattus norvegicus
caggacgacgccaccaaagaaagat

SEQ ID NO: 232175 - DNA, 25 bp, Rattus norvegicus
caggacgacgcctccaaagaaagat

SEQ ID NO: 232176 - DNA, 25 bp, Rattus norvegicus
caggacgagctgatgattttcatga

SEQ ID NO: 232177 - DNA, 25 bp, Rattus norvegicus
caggacgagctgttgattttcatga

SEQ ID NO: 232178 - DNA, 25 bp, Rattus norvegicus
caggacgagtttcccagtttcccac

SEQ ID NO: 232179 - DNA, 25 bp, Rattus norvegicus
caggacgagtttgccagtttcccac

SEQ ID NO: 232180 - DNA, 25 bp, Rattus norvegicus
caggacgcagttactggatccaaag

SEQ ID NO: 232181 - DNA, 25 bp, Rattus norvegicus
caggacgcagtttctggatccaaag

SEQ ID NO: 232182 - DNA, 25 bp, Rattus norvegicus
caggacggacttcgcttttggacac

SEQ ID NO: 232183 - DNA, 25 bp, Rattus norvegicus
caggacggacttggcttttggacac

SEQ ID NO: 232184 - DNA, 25 bp, Rattus norvegicus
caggacggagcaccgagccggagct

SEQ ID NO: 232185 - DNA, 25 bp, Rattus norvegicus
caggacggagcagcgagccggagct

SEQ ID NO: 232186 - DNA, 25 bp, Rattus norvegicus
caggacgggcaccagaattccagta

SEQ ID NO: 232187 - DNA, 25 bp, Rattus norvegicus
caggacgggcacgagaattccagta

SEQ ID NO: 232188 - DNA, 25 bp, Rattus norvegicus
caggacgtagtgctggtcactgaca

SEQ ID NO: 232189 - DNA, 25 bp, Rattus norvegicus
caggacgtagtggtggtcactgaca

SEQ ID NO: 232190 - DNA, 25 bp, Rattus norvegicus
caggacgtgccaccaagtggtttta

SEQ ID NO: 232191 - DNA, 25 bp, Rattus norvegicus
caggacgtgccagcaagtggtttta

SEQ ID NO: 232192 - DNA, 25 bp, Rattus norvegicus
caggactaccaccagaccatgtatt

SEQ ID NO: 232193 - DNA, 25 bp, Rattus norvegicus
caggactaccacgagaccatgtatt

SEQ ID NO: 232194 - DNA, 25 bp, Rattus norvegicus
caggactatgtcaaataaaaagcaa

SEQ ID NO: 232195 - DNA, 25 bp, Rattus norvegicus
caggactatgtctaataaaaagcaa

SEQ ID NO: 232196 - DNA, 25 bp, Rattus norvegicus
caggactccaagcagccagtgcggg

SEQ ID NO: 232197 - DNA, 25 bp, Rattus norvegicus
caggactccaaggagccagtgcggg

SEQ ID NO: 232198 - DNA, 25 bp, Rattus norvegicus
caggactccatgctaattcacagaa

SEQ ID NO: 232199 - DNA, 25 bp, Rattus norvegicus
caggactccatggtaattcacagaa

SEQ ID NO: 232200 - DNA, 25 bp, Rattus norvegicus
caggactcgttacaaggcttggcaa

SEQ ID NO: 232201 - DNA, 25 bp, Rattus norvegicus
caggactcgttagaaggcttggcaa

SEQ ID NO: 232202 - DNA, 25 bp, Rattus norvegicus
caggactctgccactgtggaaggag

SEQ ID NO: 232203 - DNA, 25 bp, Rattus norvegicus
caggactctgcctctgtggaaggag

SEQ ID NO: 232204 - DNA, 25 bp, Rattus norvegicus
caggactgggagctggcacaccctt

SEQ ID NO: 232205 - DNA, 25 bp, Rattus norvegicus
caggactgggaggtggcacaccctt

SEQ ID NO: 232206 - DNA, 25 bp, Rattus norvegicus
caggactgggtgactcggtgctcta

SEQ ID NO: 232207 - DNA, 25 bp, Rattus norvegicus
caggactgggtgtctcggtgctcta

SEQ ID NO: 232208 - DNA, 25 bp, Rattus norvegicus
caggactggtctccgtagcccatgg

SEQ ID NO: 232209 - DNA, 25 bp, Rattus norvegicus
caggactggtctgcgtagcccatgg

SEQ ID NO: 232210 - DNA, 25 bp, Rattus norvegicus
caggactgtcgaagggctcagtgct

SEQ ID NO: 232211 - DNA, 25 bp, Rattus norvegicus
caggactgtcgatgggctcagtgct

SEQ ID NO: 232212 - DNA, 25 bp, Rattus norvegicus
caggacttagtacctgagatactgc

SEQ ID NO: 232213 - DNA, 25 bp, Rattus norvegicus
caggacttagtagctgagatactgc

SEQ ID NO: 232214 - DNA, 25 bp, Rattus norvegicus
caggacttcctacggttctacgtgg

SEQ ID NO: 232215 - DNA, 25 bp, Rattus norvegicus
caggacttcctagggttctacgtgg

SEQ ID NO: 232216 - DNA, 25 bp, Rattus norvegicus
caggacttcctgcatttgggatttc

SEQ ID NO: 232217 - DNA, 25 bp, Rattus norvegicus
caggacttcctggatttgggatttc

SEQ ID NO: 232218 - DNA, 25 bp, Rattus norvegicus
caggacttgagcagccagggacata

SEQ ID NO: 232219 - DNA, 25 bp, Rattus norvegicus
caggacttgagctgccagggacata

SEQ ID NO: 232220 - DNA, 25 bp, Rattus norvegicus
caggacttgcccctagagcatttaa

SEQ ID NO: 232221 - DNA, 25 bp, Rattus norvegicus
caggacttgcccgtagagcatttaa

SEQ ID NO: 232222 - DNA, 25 bp, Rattus norvegicus
caggacttgctgattcagtggcttg

SEQ ID NO: 232223 - DNA, 25 bp, Rattus norvegicus
caggacttgctgtttcagtggcttg

SEQ ID NO: 232224 - DNA, 25 bp, Rattus norvegicus
caggacttgggtattgtggctgact

SEQ ID NO: 232225 - DNA, 25 bp, Rattus norvegicus
caggacttgggttttgtggctgact

SEQ ID NO: 232226 - DNA, 25 bp, Rattus norvegicus
caggacttggtgcagccgccctaga

SEQ ID NO: 232227 - DNA, 25 bp, Rattus norvegicus
caggacttggtggagccgccctaga

SEQ ID NO: 232228 - DNA, 25 bp, Rattus norvegicus
caggacttgtggctgcgccgacata

SEQ ID NO: 232229 - DNA, 25 bp, Rattus norvegicus
caggacttgtgggtgcgccgacata

SEQ ID NO: 232230 - DNA, 25 bp, Rattus norvegicus
caggactttccgattccacaattag

SEQ ID NO: 232231 - DNA, 25 bp, Rattus norvegicus
caggactttccgtttccacaattag

SEQ ID NO: 232232 - DNA, 25 bp, Rattus norvegicus
caggactttctgatttacacccagt

SEQ ID NO: 232233 - DNA, 25 bp, Rattus norvegicus
caggactttctgttttacacccagt

SEQ ID NO: 232234 - DNA, 25 bp, Rattus norvegicus
caggactttggcagggactgatcaa

SEQ ID NO: 232235 - DNA, 25 bp, Rattus norvegicus
caggactttggctgggactgatcaa

SEQ ID NO: 232236 - DNA, 25 bp, Rattus norvegicus
caggagaaaagacggccttgttact

SEQ ID NO: 232237 - DNA, 25 bp, Rattus norvegicus
caggagaaaagagggccttgttact

SEQ ID NO: 232238 - DNA, 25 bp, Rattus norvegicus
caggagaaacccctgtcagtcgttc

SEQ ID NO: 232239 - DNA, 25 bp, Rattus norvegicus
caggagaaacccgtgtcagtcgttc

SEQ ID NO: 232240 - DNA, 25 bp, Rattus norvegicus
caggagaacttcacggtcagtgacc

SEQ ID NO: 232241 - DNA, 25 bp, Rattus norvegicus
caggagaacttctcggtcagtgacc

SEQ ID NO: 232242 - DNA, 25 bp, Rattus norvegicus
caggagaagtttccgcccacaaggc

SEQ ID NO: 232243 - DNA, 25 bp, Rattus norvegicus
caggagaagtttgcgcccacaaggc

SEQ ID NO: 232244 - DNA, 25 bp, Rattus norvegicus
caggagaatgtaattccctctgcat

SEQ ID NO: 232245 - DNA, 25 bp, Rattus norvegicus
caggagaatgtatttccctctgcat

SEQ ID NO: 232246 - DNA, 25 bp, Rattus norvegicus
caggagacagcacggctcactccag

SEQ ID NO: 232247 - DNA, 25 bp, Rattus norvegicus
caggagacagcagggctcactccag

SEQ ID NO: 232248 - DNA, 25 bp, Rattus norvegicus
caggagacatacagttgccaacaca

SEQ ID NO: 232249 - DNA, 25 bp, Rattus norvegicus
caggagacatactgttgccaacaca

SEQ ID NO: 232250 - DNA, 25 bp, Rattus norvegicus
caggagacatttacatgcttatgga

SEQ ID NO: 232251 - DNA, 25 bp, Rattus norvegicus
caggagacattttcatgcttatgga

SEQ ID NO: 232252 - DNA, 25 bp, Rattus norvegicus
caggagacccggctgtcagtcaatc

SEQ ID NO: 232253 - DNA, 25 bp, Rattus norvegicus
caggagacccgggtgtcagtcaatc

SEQ ID NO: 232254 - DNA, 25 bp, Rattus norvegicus
caggagaccgttatgagtgcaacag

SEQ ID NO: 232255 - DNA, 25 bp, Rattus norvegicus
caggagaccgttttgagtgcaacag

SEQ ID NO: 232256 - DNA, 25 bp, Rattus norvegicus
caggagacgatgaccgcgtgattct

SEQ ID NO: 232257 - DNA, 25 bp, Rattus norvegicus
caggagacgatgtccgcgtgattct

SEQ ID NO: 232258 - DNA, 25 bp, Rattus norvegicus
caggagacgcccacaggagctgaat

SEQ ID NO: 232259 - DNA, 25 bp, Rattus norvegicus
caggagacgccctcaggagctgaat

SEQ ID NO: 232260 - DNA, 25 bp, Rattus norvegicus
caggagacttggctctatggcatgt

SEQ ID NO: 232261 - DNA, 25 bp, Rattus norvegicus
caggagacttgggtctatggcatgt

SEQ ID NO: 232262 - DNA, 25 bp, Rattus norvegicus
caggagactttgagctgccttcaga

SEQ ID NO: 232263 - DNA, 25 bp, Rattus norvegicus
caggagactttgtgctgccttcaga

SEQ ID NO: 232264 - DNA, 25 bp, Rattus norvegicus
caggagagcccaagattgcggtaga

SEQ ID NO: 232265 - DNA, 25 bp, Rattus norvegicus
caggagagcccatgattgcggtaga

SEQ ID NO: 232266 - DNA, 25 bp, Rattus norvegicus
caggagagctatctggactttggcc

SEQ ID NO: 232267 - DNA, 25 bp, Rattus norvegicus
caggagagctatgtggactttggcc

SEQ ID NO: 232268 - DNA, 25 bp, Rattus norvegicus
caggagaggatgagcccctgctaaa

SEQ ID NO: 232269 - DNA, 25 bp, Rattus norvegicus
caggagaggatgtgcccctgctaaa

SEQ ID NO: 232270 - DNA, 25 bp, Rattus norvegicus
caggagagtcacaggtcttatgttg

SEQ ID NO: 232271 - DNA, 25 bp, Rattus norvegicus
caggagagtcactggtcttatgttg

SEQ ID NO: 232272 - DNA, 25 bp, Rattus norvegicus
caggagagtgctccttctctgcact

SEQ ID NO: 232273 - DNA, 25 bp, Rattus norvegicus
caggagagtgctgcttctctgcact

SEQ ID NO: 232274 - DNA, 25 bp, Rattus norvegicus
caggagatacctacagccattaacc

SEQ ID NO: 232275 - DNA, 25 bp, Rattus norvegicus
caggagataccttcagccattaacc

SEQ ID NO: 232276 - DNA, 25 bp, Rattus norvegicus
caggagatatgcatcccagccatat

SEQ ID NO: 232277 - DNA, 25 bp, Rattus norvegicus
caggagatatgcttcccagccatat

SEQ ID NO: 232278 - DNA, 25 bp, Rattus norvegicus
caggagatccaacaggcactggtat

SEQ ID NO: 232279 - DNA, 25 bp, Rattus norvegicus
caggagatccaagaggcactggtat

SEQ ID NO: 232280 - DNA, 25 bp, Rattus norvegicus
caggagatccctaaatgctatttaa

SEQ ID NO: 232281 - DNA, 25 bp, Rattus norvegicus
caggagatccctcaaggacacttct

SEQ ID NO: 232282 - DNA, 25 bp, Rattus norvegicus
caggagatccctgaaggacacttct

SEQ ID NO: 232283 - DNA, 25 bp, Rattus norvegicus
caggagatcccttaatgctatttaa

SEQ ID NO: 232284 - DNA, 25 bp, Rattus norvegicus
caggagatggccaatgcttccctca

SEQ ID NO: 232285 - DNA, 25 bp, Rattus norvegicus
caggagatggcctatgcttccctca

SEQ ID NO: 232286 - DNA, 25 bp, Rattus norvegicus
caggagatgggcctcaaaaagtctt

SEQ ID NO: 232287 - DNA, 25 bp, Rattus norvegicus
caggagatgggcgtcaaaaagtctt

SEQ ID NO: 232288 - DNA, 25 bp, Rattus norvegicus
caggagatggtcaggttttggtttt

SEQ ID NO: 232289 - DNA, 25 bp, Rattus norvegicus
caggagatggtctggttttggtttt

SEQ ID NO: 232290 - DNA, 25 bp, Rattus norvegicus
caggagcacgcgacttttaagagga

SEQ ID NO: 232291 - DNA, 25 bp, Rattus norvegicus
caggagcacgcgtcttttaagagga

SEQ ID NO: 232292 - DNA, 25 bp, Rattus norvegicus
caggagcagtggattgccatgcagt

SEQ ID NO: 232293 - DNA, 25 bp, Rattus norvegicus
caggagcagtggtttgccatgcagt

SEQ ID NO: 232294 - DNA, 25 bp, Rattus norvegicus
caggagcatctgacagcgtttgttt

SEQ ID NO: 232295 - DNA, 25 bp, Rattus norvegicus
caggagcatctgatctttaatatac

SEQ ID NO: 232296 - DNA, 25 bp, Rattus norvegicus
caggagcatctgtcagcgtttgttt

SEQ ID NO: 232297 - DNA, 25 bp, Rattus norvegicus
caggagcatctgttctttaatatac

SEQ ID NO: 232298 - DNA, 25 bp, Rattus norvegicus
caggagccaaaaccgactgtgcact

SEQ ID NO: 232299 - DNA, 25 bp, Rattus norvegicus
caggagccaaaagcgactgtgcact

SEQ ID NO: 232300 - DNA, 25 bp, Rattus norvegicus
caggagccaaggatgggtgccctta

SEQ ID NO: 232301 - DNA, 25 bp, Rattus norvegicus
caggagccaaggttgggtgccctta

SEQ ID NO: 232302 - DNA, 25 bp, Rattus norvegicus
caggagccaatcaaacctcttgaaa

SEQ ID NO: 232303 - DNA, 25 bp, Rattus norvegicus
caggagccaatctaacctcttgaaa

SEQ ID NO: 232304 - DNA, 25 bp, Rattus norvegicus
caggagccagctctttagcccctag

SEQ ID NO: 232305 - DNA, 25 bp, Rattus norvegicus
caggagccagctgtttagcccctag

SEQ ID NO: 232306 - DNA, 25 bp, Rattus norvegicus
caggagccagtcagaccttgaaatt

SEQ ID NO: 232307 - DNA, 25 bp, Rattus norvegicus
caggagccagtctgaccttgaaatt

SEQ ID NO: 232308 - DNA, 25 bp, Rattus norvegicus
caggagccagtgaatataagtatga

SEQ ID NO: 232309 - DNA, 25 bp, Rattus norvegicus
caggagccagtgtatataagtatga

SEQ ID NO: 232310 - DNA, 25 bp, Rattus norvegicus
caggagcccatgcatgaccgtgtat

SEQ ID NO: 232311 - DNA, 25 bp, Rattus norvegicus
caggagcccatggatgaccgtgtat

SEQ ID NO: 232312 - DNA, 25 bp, Rattus norvegicus
caggagccccagatatcagtgtgtc

SEQ ID NO: 232313 - DNA, 25 bp, Rattus norvegicus
caggagccccagttatcagtgtgtc

SEQ ID NO: 232314 - DNA, 25 bp, Rattus norvegicus
caggagcccctgaaagactttacag

SEQ ID NO: 232315 - DNA, 25 bp, Rattus norvegicus
caggagcccctgtaagactttacag

SEQ ID NO: 232316 - DNA, 25 bp, Rattus norvegicus
caggagcccttccaagcacagtggg

SEQ ID NO: 232317 - DNA, 25 bp, Rattus norvegicus
caggagcccttcgaagcacagtggg

SEQ ID NO: 232318 - DNA, 25 bp, Rattus norvegicus
caggagccgtggaccaggcccagca

SEQ ID NO: 232319 - DNA, 25 bp, Rattus norvegicus
caggagccgtggtccaggcccagca

SEQ ID NO: 232320 - DNA, 25 bp, Rattus norvegicus
caggagcctgttatggtttcttctc

SEQ ID NO: 232321 - DNA, 25 bp, Rattus norvegicus
caggagcctgttttggtttcttctc

SEQ ID NO: 232322 - DNA, 25 bp, Rattus norvegicus
caggagcggctgcacaacaagacaa

SEQ ID NO: 232323 - DNA, 25 bp, Rattus norvegicus
caggagcggctggacaacaagacaa

SEQ ID NO: 232324 - DNA, 25 bp, Rattus norvegicus
caggagctctttccagcattatgtc

SEQ ID NO: 232325 - DNA, 25 bp, Rattus norvegicus
caggagctctttgcagcattatgtc

SEQ ID NO: 232326 - DNA, 25 bp, Rattus norvegicus
caggagctgcacactctagcacagg

SEQ ID NO: 232327 - DNA, 25 bp, Rattus norvegicus
caggagctgcactctctagcacagg

SEQ ID NO: 232328 - DNA, 25 bp, Rattus norvegicus
caggagctgcagacgagtttagaat

SEQ ID NO: 232329 - DNA, 25 bp, Rattus norvegicus
caggagctgcagtcgagtttagaat

SEQ ID NO: 232330 - DNA, 25 bp, Rattus norvegicus
caggagctgccgattccttatgcat

SEQ ID NO: 232331 - DNA, 25 bp, Rattus norvegicus
caggagctgccgtttccttatgcat

SEQ ID NO: 232332 - DNA, 25 bp, Rattus norvegicus
caggagctggcaaagtcaccaagtc

SEQ ID NO: 232333 - DNA, 25 bp, Rattus norvegicus
caggagctggcatagtcaccaagtc

SEQ ID NO: 232334 - DNA, 25 bp, Rattus norvegicus
caggagctgtggctggtcacctggg

SEQ ID NO: 232335 - DNA, 25 bp, Rattus norvegicus
caggagctgtgggtggtcacctggg

SEQ ID NO: 232336 - DNA, 25 bp, Rattus norvegicus
caggagctgtgtatcgtggtttacc

SEQ ID NO: 232337 - DNA, 25 bp, Rattus norvegicus
caggagctgtgtttcgtggtttacc

SEQ ID NO: 232338 - DNA, 25 bp, Rattus norvegicus
caggagcttgagctagcttgtcaca

SEQ ID NO: 232339 - DNA, 25 bp, Rattus norvegicus
caggagcttgaggtagcttgtcaca

SEQ ID NO: 232340 - DNA, 25 bp, Rattus norvegicus
caggagcttgtgattgagaggcttt

SEQ ID NO: 232341 - DNA, 25 bp, Rattus norvegicus
caggagcttgtgtttgagaggcttt

SEQ ID NO: 232342 - DNA, 25 bp, Rattus norvegicus
caggagctttgtcaccagtgcattg

SEQ ID NO: 232343 - DNA, 25 bp, Rattus norvegicus
caggagctttgtgaccagtgcattg

SEQ ID NO: 232344 - DNA, 25 bp, Rattus norvegicus
caggaggaccacacgttcaaggcct

SEQ ID NO: 232345 - DNA, 25 bp, Rattus norvegicus
caggaggaccactcgttcaaggcct

SEQ ID NO: 232346 - DNA, 25 bp, Rattus norvegicus
caggaggacccacaacccgaggacg

SEQ ID NO: 232347 - DNA, 25 bp, Rattus norvegicus
caggaggacccagaacccgaggacg

SEQ ID NO: 232348 - DNA, 25 bp, Rattus norvegicus
caggaggacctgctggaacccagat

SEQ ID NO: 232349 - DNA, 25 bp, Rattus norvegicus
caggaggacctggtggaacccagat

SEQ ID NO: 232350 - DNA, 25 bp, Rattus norvegicus
caggaggacgagattcgccagcagt

SEQ ID NO: 232351 - DNA, 25 bp, Rattus norvegicus
caggaggacgagtttcgccagcagt

SEQ ID NO: 232352 - DNA, 25 bp, Rattus norvegicus
caggaggactgaaccatctgccagg

SEQ ID NO: 232353 - DNA, 25 bp, Rattus norvegicus
caggaggactgatccatctgccagg

SEQ ID NO: 232354 - DNA, 25 bp, Rattus norvegicus
caggaggactgcaatgaggccagcc

SEQ ID NO: 232355 - DNA, 25 bp, Rattus norvegicus
caggaggactgctatgaggccagcc

SEQ ID NO: 232356 - DNA, 25 bp, Rattus norvegicus
caggaggacttgatctatttatgtt

SEQ ID NO: 232357 - DNA, 25 bp, Rattus norvegicus
caggaggacttgttctatttatgtt

SEQ ID NO: 232358 - DNA, 25 bp, Rattus norvegicus
caggaggagagtctgacccagaggt

SEQ ID NO: 232359 - DNA, 25 bp, Rattus norvegicus
caggaggagagtgtgacccagaggt

SEQ ID NO: 232360 - DNA, 25 bp, Rattus norvegicus
caggaggagctcactgctgtgctgc

SEQ ID NO: 232361 - DNA, 25 bp, Rattus norvegicus
caggaggagctctctgctgtgctgc

SEQ ID NO: 232362 - DNA, 25 bp, Rattus norvegicus
caggaggagcttcggttgtttccct

SEQ ID NO: 232363 - DNA, 25 bp, Rattus norvegicus
caggaggagcttgggttgtttccct

SEQ ID NO: 232364 - DNA, 25 bp, Rattus norvegicus
caggaggatactacagcccaatgct

SEQ ID NO: 232365 - DNA, 25 bp, Rattus norvegicus
caggaggatacttcagcccaatgct

SEQ ID NO: 232366 - DNA, 25 bp, Rattus norvegicus
caggaggattgaccctgtttcaaaa

SEQ ID NO: 232367 - DNA, 25 bp, Rattus norvegicus
caggaggattgagcctgtttcaaaa

SEQ ID NO: 232368 - DNA, 25 bp, Rattus norvegicus
caggaggcacctctgttattagatg

SEQ ID NO: 232369 - DNA, 25 bp, Rattus norvegicus
caggaggcacctgtgttattagatg

SEQ ID NO: 232370 - DNA, 25 bp, Rattus norvegicus
caggaggcagccctggtgtcccctt

SEQ ID NO: 232371 - DNA, 25 bp, Rattus norvegicus
caggaggcagccgtggtgtcccctt

SEQ ID NO: 232372 - DNA, 25 bp, Rattus norvegicus
caggaggcagcgattcatcttgacc

SEQ ID NO: 232373 - DNA, 25 bp, Rattus norvegicus
caggaggcagcgtttcatcttgacc

SEQ ID NO: 232374 - DNA, 25 bp, Rattus norvegicus
caggaggcatttattctaggcttga

SEQ ID NO: 232375 - DNA, 25 bp, Rattus norvegicus
caggaggcattttttctaggcttga

SEQ ID NO: 232376 - DNA, 25 bp, Rattus norvegicus
caggaggccctgcaagattttcaga

SEQ ID NO: 232377 - DNA, 25 bp, Rattus norvegicus
caggaggccctggaagattttcaga

SEQ ID NO: 232378 - DNA, 25 bp, Rattus norvegicus
caggaggccgaccaagtgaagttac

SEQ ID NO: 232379 - DNA, 25 bp, Rattus norvegicus
caggaggccgacgaagtgaagttac

SEQ ID NO: 232380 - DNA, 25 bp, Rattus norvegicus
caggaggccggaacctgtcagtttt

SEQ ID NO: 232381 - DNA, 25 bp, Rattus norvegicus
caggaggccggatcctgtcagtttt

SEQ ID NO: 232382 - DNA, 25 bp, Rattus norvegicus
caggaggccttcctggacatttttt

SEQ ID NO: 232383 - DNA, 25 bp, Rattus norvegicus
caggaggccttcgtggacatttttt

SEQ ID NO: 232384 - DNA, 25 bp, Rattus norvegicus
caggaggcgtccatagatttctcac

SEQ ID NO: 232385 - DNA, 25 bp, Rattus norvegicus
caggaggcgtccttagatttctcac

SEQ ID NO: 232386 - DNA, 25 bp, Rattus norvegicus
caggaggctctccatgataggcaga

SEQ ID NO: 232387 - DNA, 25 bp, Rattus norvegicus
caggaggctctcgatgataggcaga

SEQ ID NO: 232388 - DNA, 25 bp, Rattus norvegicus
caggaggctgccagcttggcagtca

SEQ ID NO: 232389 - DNA, 25 bp, Rattus norvegicus
caggaggctgcctgcttggcagtca

SEQ ID NO: 232390 - DNA, 25 bp, Rattus norvegicus
caggagggacccatcagcaactctt

SEQ ID NO: 232391 - DNA, 25 bp, Rattus norvegicus
caggagggacccttcagcaactctt

SEQ ID NO: 232392 - DNA, 25 bp, Rattus norvegicus
caggagggaggaacgcttcatgcat

SEQ ID NO: 232393 - DNA, 25 bp, Rattus norvegicus
caggagggaggatcgcttcatgcat

SEQ ID NO: 232394 - DNA, 25 bp, Rattus norvegicus
caggagggcacacgcttacgcttca

SEQ ID NO: 232395 - DNA, 25 bp, Rattus norvegicus
caggagggcacaggcttacgcttca

SEQ ID NO: 232396 - DNA, 25 bp, Rattus norvegicus
caggagggccaaagcaacagccttt

SEQ ID NO: 232397 - DNA, 25 bp, Rattus norvegicus
caggagggccaatgcaacagccttt

SEQ ID NO: 232398 - DNA, 25 bp, Rattus norvegicus
caggagggctctagcaggtttttgt

SEQ ID NO: 232399 - DNA, 25 bp, Rattus norvegicus
caggagggctcttgcaggtttttgt

SEQ ID NO: 232400 - DNA, 25 bp, Rattus norvegicus
caggaggtcagcatttaggcgtctg

SEQ ID NO: 232401 - DNA, 25 bp, Rattus norvegicus
caggaggtcagcttttaggcgtctg

SEQ ID NO: 232402 - DNA, 25 bp, Rattus norvegicus
caggaggtgagaatccctccctgtt

SEQ ID NO: 232403 - DNA, 25 bp, Rattus norvegicus
caggaggtgagattccctccctgtt

SEQ ID NO: 232404 - DNA, 25 bp, Rattus norvegicus
caggaggttctaattacagccagga

SEQ ID NO: 232405 - DNA, 25 bp, Rattus norvegicus
caggaggttctatttacagccagga

SEQ ID NO: 232406 - DNA, 25 bp, Rattus norvegicus
caggaggttctgaggttccaggcca

SEQ ID NO: 232407 - DNA, 25 bp, Rattus norvegicus
caggaggttctgtggttccaggcca

SEQ ID NO: 232408 - DNA, 25 bp, Rattus norvegicus
caggaggttcttcggtctggtatcc

SEQ ID NO: 232409 - DNA, 25 bp, Rattus norvegicus
caggaggttcttgggtctggtatcc

SEQ ID NO: 232410 - DNA, 25 bp, Rattus norvegicus
caggagtacgtcactgatccgaagt

SEQ ID NO: 232411 - DNA, 25 bp, Rattus norvegicus
caggagtacgtctctgatccgaagt

SEQ ID NO: 232412 - DNA, 25 bp, Rattus norvegicus
caggagtatgaccaagctggcccct

SEQ ID NO: 232413 - DNA, 25 bp, Rattus norvegicus
caggagtatgacgaagctggcccct

SEQ ID NO: 232414 - DNA, 25 bp, Rattus norvegicus
caggagtatgctcctggcacttacg

SEQ ID NO: 232415 - DNA, 25 bp, Rattus norvegicus
caggagtatgctgctggcacttacg

SEQ ID NO: 232416 - DNA, 25 bp, Rattus norvegicus
caggagtcacggactgtgtgttccc

SEQ ID NO: 232417 - DNA, 25 bp, Rattus norvegicus
caggagtcacggtctgtgtgttccc

SEQ ID NO: 232418 - DNA, 25 bp, Rattus norvegicus
caggagtcattgaaagttccacaga

SEQ ID NO: 232419 - DNA, 25 bp, Rattus norvegicus
caggagtcattgtaagttccacaga

SEQ ID NO: 232420 - DNA, 25 bp, Rattus norvegicus
caggagtccagcaggcactcgagaa

SEQ ID NO: 232421 - DNA, 25 bp, Rattus norvegicus
caggagtccagctggcactcgagaa

SEQ ID NO: 232422 - DNA, 25 bp, Rattus norvegicus
caggagtcctggcaaatcttccgta

SEQ ID NO: 232423 - DNA, 25 bp, Rattus norvegicus
caggagtcctgggaaatcttccgta

SEQ ID NO: 232424 - DNA, 25 bp, Rattus norvegicus
caggagtctcctcaagtgcaagcag

SEQ ID NO: 232425 - DNA, 25 bp, Rattus norvegicus
caggagtctcctgaagtgcaagcag

SEQ ID NO: 232426 - DNA, 25 bp, Rattus norvegicus
caggagtctgtccatctttgttgtc

SEQ ID NO: 232427 - DNA, 25 bp, Rattus norvegicus
caggagtctgtcgatctttgttgtc

SEQ ID NO: 232428 - DNA, 25 bp, Rattus norvegicus
caggagtgatctatggtgggcctca

SEQ ID NO: 232429 - DNA, 25 bp, Rattus norvegicus
caggagtgatctttggtgggcctca

SEQ ID NO: 232430 - DNA, 25 bp, Rattus norvegicus
caggagtgtcacattgggttcagta

SEQ ID NO: 232431 - DNA, 25 bp, Rattus norvegicus
caggagtgtcactttgggttcagta

SEQ ID NO: 232432 - DNA, 25 bp, Rattus norvegicus
caggagttaacgatgataatcactt

SEQ ID NO: 232433 - DNA, 25 bp, Rattus norvegicus
caggagttaacgttgataatcactt

SEQ ID NO: 232434 - DNA, 25 bp, Rattus norvegicus
caggagttccttctgtcactaatta

SEQ ID NO: 232435 - DNA, 25 bp, Rattus norvegicus
caggagttccttgtgtcactaatta

SEQ ID NO: 232436 - DNA, 25 bp, Rattus norvegicus
caggagttgctgaattcccattcag

SEQ ID NO: 232437 - DNA, 25 bp, Rattus norvegicus
caggagttgctgtattcccattcag

SEQ ID NO: 232438 - DNA, 25 bp, Rattus norvegicus
caggagtttctgcagagtttcagat

SEQ ID NO: 232439 - DNA, 25 bp, Rattus norvegicus
caggagtttctggagagtttcagat

SEQ ID NO: 232440 - DNA, 25 bp, Rattus norvegicus
caggataaagctattcccatttgga

SEQ ID NO: 232441 - DNA, 25 bp, Rattus norvegicus
caggataaagcttttcccatttgga

SEQ ID NO: 232442 - DNA, 25 bp, Rattus norvegicus
caggataacctgaatgcgctattgg

SEQ ID NO: 232443 - DNA, 25 bp, Rattus norvegicus
caggataacctgtatgcgctattgg

SEQ ID NO: 232444 - DNA, 25 bp, Rattus norvegicus
caggataaccttaacttcccatctt

SEQ ID NO: 232445 - DNA, 25 bp, Rattus norvegicus
caggataacctttacttcccatctt

SEQ ID NO: 232446 - DNA, 25 bp, Rattus norvegicus
caggatacacttactccactatttg

SEQ ID NO: 232447 - DNA, 25 bp, Rattus norvegicus
caggatacactttctccactatttg

SEQ ID NO: 232448 - DNA, 25 bp, Rattus norvegicus
caggatagacctactgatgatgaat

SEQ ID NO: 232449 - DNA, 25 bp, Rattus norvegicus
caggatagaccttctgatgatgaat

SEQ ID NO: 232450 - DNA, 25 bp, Rattus norvegicus
caggatagcctgacccaaatttatt

SEQ ID NO: 232451 - DNA, 25 bp, Rattus norvegicus
caggatagcctgtcccaaatttatt

SEQ ID NO: 232452 - DNA, 25 bp, Rattus norvegicus
caggatagcgggagacggtccggct

SEQ ID NO: 232453 - DNA, 25 bp, Rattus norvegicus
caggatagcgggtgacggtccggct

SEQ ID NO: 232454 - DNA, 25 bp, Rattus norvegicus
caggataggattaactgttactggg

SEQ ID NO: 232455 - DNA, 25 bp, Rattus norvegicus
caggataggatttactgttactggg

SEQ ID NO: 232456 - DNA, 25 bp, Rattus norvegicus
caggataggtataaactcagaactt

SEQ ID NO: 232457 - DNA, 25 bp, Rattus norvegicus
caggataggtattaactcagaactt

SEQ ID NO: 232458 - DNA, 25 bp, Rattus norvegicus
caggatataggtacagtttcttaaa

SEQ ID NO: 232459 - DNA, 25 bp, Rattus norvegicus
caggatataggttcagtttcttaaa

SEQ ID NO: 232460 - DNA, 25 bp, Rattus norvegicus
caggatatcatcaaccaggtccata

SEQ ID NO: 232461 - DNA, 25 bp, Rattus norvegicus
caggatatcatctaccaggtccata

SEQ ID NO: 232462 - DNA, 25 bp, Rattus norvegicus
caggatatccctataagttacttgg

SEQ ID NO: 232463 - DNA, 25 bp, Rattus norvegicus
caggatatccctttaagttacttgg

SEQ ID NO: 232464 - DNA, 25 bp, Rattus norvegicus
caggatatctcaagtgtgggaccga

SEQ ID NO: 232465 - DNA, 25 bp, Rattus norvegicus
caggatatctcatgtgtgggaccga

SEQ ID NO: 232466 - DNA, 25 bp, Rattus norvegicus
caggatcactgcaggtttgaatgac

SEQ ID NO: 232467 - DNA, 25 bp, Rattus norvegicus
caggatcactgctggtttgaatgac

SEQ ID NO: 232468 - DNA, 25 bp, Rattus norvegicus
caggatcactggctgttctgacaag

SEQ ID NO: 232469 - DNA, 25 bp, Rattus norvegicus
caggatcactgggtgttctgacaag

SEQ ID NO: 232470 - DNA, 25 bp, Rattus norvegicus
caggatcagactctacgagagggaa

SEQ ID NO: 232471 - DNA, 25 bp, Rattus norvegicus
caggatcagactgtacgagagggaa

SEQ ID NO: 232472 - DNA, 25 bp, Rattus norvegicus
caggatcagcttccacagcatcaag

SEQ ID NO: 232473 - DNA, 25 bp, Rattus norvegicus
caggatcagcttgcacagcatcaag

SEQ ID NO: 232474 - DNA, 25 bp, Rattus norvegicus
caggatcagtttatgccagtgcaat

SEQ ID NO: 232475 - DNA, 25 bp, Rattus norvegicus
caggatcagtttttgccagtgcaat

SEQ ID NO: 232476 - DNA, 25 bp, Rattus norvegicus
caggatccacctcgagcatgacgtc

SEQ ID NO: 232477 - DNA, 25 bp, Rattus norvegicus
caggatccacctctttgatcagaaa

SEQ ID NO: 232478 - DNA, 25 bp, Rattus norvegicus
caggatccacctggagcatgacgtc

SEQ ID NO: 232479 - DNA, 25 bp, Rattus norvegicus
caggatccacctgtttgatcagaaa

SEQ ID NO: 232480 - DNA, 25 bp, Rattus norvegicus
caggatcccgataaatttgactatt

SEQ ID NO: 232481 - DNA, 25 bp, Rattus norvegicus
caggatcccgattaatttgactatt

SEQ ID NO: 232482 - DNA, 25 bp, Rattus norvegicus
caggatccttggcactgttcaggaa

SEQ ID NO: 232483 - DNA, 25 bp, Rattus norvegicus
caggatccttgggactgttcaggaa

SEQ ID NO: 232484 - DNA, 25 bp, Rattus norvegicus
caggatcgcaggcagaggccatatt

SEQ ID NO: 232485 - DNA, 25 bp, Rattus norvegicus
caggatcgcagggagaggccatatt

SEQ ID NO: 232486 - DNA, 25 bp, Rattus norvegicus
caggatcggagcatggcagcagcca

SEQ ID NO: 232487 - DNA, 25 bp, Rattus norvegicus
caggatcggagcttggcagcagcca

SEQ ID NO: 232488 - DNA, 25 bp, Rattus norvegicus
caggatcgtattcctgtgtagccca

SEQ ID NO: 232489 - DNA, 25 bp, Rattus norvegicus
caggatcgtattgctgtgtagccca

SEQ ID NO: 232490 - DNA, 25 bp, Rattus norvegicus
caggatctagctcgcggctatactt

SEQ ID NO: 232491 - DNA, 25 bp, Rattus norvegicus
caggatctagctggcggctatactt

SEQ ID NO: 232492 - DNA, 25 bp, Rattus norvegicus
caggatctattaccctggcttctgc

SEQ ID NO: 232493 - DNA, 25 bp, Rattus norvegicus
caggatctattagcctggcttctgc

SEQ ID NO: 232494 - DNA, 25 bp, Rattus norvegicus
caggatctgacccacagggactgtg

SEQ ID NO: 232495 - DNA, 25 bp, Rattus norvegicus
caggatctgaccgacagggactgtg

SEQ ID NO: 232496 - DNA, 25 bp, Rattus norvegicus
caggatctgcccatattgtgaagtt

SEQ ID NO: 232497 - DNA, 25 bp, Rattus norvegicus
caggatctgcccttattgtgaagtt

SEQ ID NO: 232498 - DNA, 25 bp, Rattus norvegicus
caggatctggaaacacctggtagat

SEQ ID NO: 232499 - DNA, 25 bp, Rattus norvegicus
caggatctggaatcacctggtagat

SEQ ID NO: 232500 - DNA, 25 bp, Rattus norvegicus
caggatctggacagcaagtgttctt

SEQ ID NO: 232501 - DNA, 25 bp, Rattus norvegicus
caggatctggactgcaagtgttctt

SEQ ID NO: 232502 - DNA, 25 bp, Rattus norvegicus
caggatcttcaaagccctgtggaac

SEQ ID NO: 232503 - DNA, 25 bp, Rattus norvegicus
caggatcttcaatgccctgtggaac

SEQ ID NO: 232504 - DNA, 25 bp, Rattus norvegicus
caggatgaaccacagcacgacagcg

SEQ ID NO: 232505 - DNA, 25 bp, Rattus norvegicus
caggatgaaccagagcacgacagcg

SEQ ID NO: 232506 - DNA, 25 bp, Rattus norvegicus
caggatgaagccctcagtcttgaga

SEQ ID NO: 232507 - DNA, 25 bp, Rattus norvegicus
caggatgaagccgtcagtcttgaga

SEQ ID NO: 232508 - DNA, 25 bp, Rattus norvegicus
caggatgaccgtatcttccaaaaga

SEQ ID NO: 232509 - DNA, 25 bp, Rattus norvegicus
caggatgaccgtttcttccaaaaga

SEQ ID NO: 232510 - DNA, 25 bp, Rattus norvegicus
caggatgaggcactgcagtgcaaaa

SEQ ID NO: 232511 - DNA, 25 bp, Rattus norvegicus
caggatgaggcagtgcagtgcaaaa

SEQ ID NO: 232512 - DNA, 25 bp, Rattus norvegicus
caggatgagtccattggtggccctc

SEQ ID NO: 232513 - DNA, 25 bp, Rattus norvegicus
caggatgagtcctttggtggccctc

SEQ ID NO: 232514 - DNA, 25 bp, Rattus norvegicus
caggatgcagtaaggcaccgccagg

SEQ ID NO: 232515 - DNA, 25 bp, Rattus norvegicus
caggatgcagtatggcaccgccagg

SEQ ID NO: 232516 - DNA, 25 bp, Rattus norvegicus
caggatgccctgcagacagtgtctc

SEQ ID NO: 232517 - DNA, 25 bp, Rattus norvegicus
caggatgccctggagacagtgtctc

SEQ ID NO: 232518 - DNA, 25 bp, Rattus norvegicus
caggatgccgggacatcggtttgca

SEQ ID NO: 232519 - DNA, 25 bp, Rattus norvegicus
caggatgccgggtcatcggtttgca

SEQ ID NO: 232520 - DNA, 25 bp, Rattus norvegicus
caggatgctgacactttgaaaatgg

SEQ ID NO: 232521 - DNA, 25 bp, Rattus norvegicus
caggatgctgactctttgaaaatgg

SEQ ID NO: 232522 - DNA, 25 bp, Rattus norvegicus
caggatgctgccaagtgtctctctc

SEQ ID NO: 232523 - DNA, 25 bp, Rattus norvegicus
caggatgctgcctagtgtctctctc

SEQ ID NO: 232524 - DNA, 25 bp, Rattus norvegicus
caggatgcttaccttgttctgcaag

SEQ ID NO: 232525 - DNA, 25 bp, Rattus norvegicus
caggatgcttacgttgttctgcaag

SEQ ID NO: 232526 - DNA, 25 bp, Rattus norvegicus
caggatgcttcccacgatttggaga

SEQ ID NO: 232527 - DNA, 25 bp, Rattus norvegicus
caggatgcttccgacgatttggaga

SEQ ID NO: 232528 - DNA, 25 bp, Rattus norvegicus
caggatggacagaatacttcacact

SEQ ID NO: 232529 - DNA, 25 bp, Rattus norvegicus
caggatggacagtatacttcacact

SEQ ID NO: 232530 - DNA, 25 bp, Rattus norvegicus
caggatggacgtcgtgcacctccag

SEQ ID NO: 232531 - DNA, 25 bp, Rattus norvegicus
caggatggacgtggtgcacctccag

SEQ ID NO: 232532 - DNA, 25 bp, Rattus norvegicus
caggatggatatctggcttgcttat

SEQ ID NO: 232533 - DNA, 25 bp, Rattus norvegicus
caggatggatatgtggcttgcttat

SEQ ID NO: 232534 - DNA, 25 bp, Rattus norvegicus
caggatggcattaatctgctttgat

SEQ ID NO: 232535 - DNA, 25 bp, Rattus norvegicus
caggatggcatttatctgctttgat

SEQ ID NO: 232536 - DNA, 25 bp, Rattus norvegicus
caggatgggagaaatgtctttccac

SEQ ID NO: 232537 - DNA, 25 bp, Rattus norvegicus
caggatgggagatatgtctttccac

SEQ ID NO: 232538 - DNA, 25 bp, Rattus norvegicus
caggatgggcgactcagatgattct

SEQ ID NO: 232539 - DNA, 25 bp, Rattus norvegicus
caggatgggcgagtcagatgattct

SEQ ID NO: 232540 - DNA, 25 bp, Rattus norvegicus
caggatggtgttaccaaccttgaag

SEQ ID NO: 232541 - DNA, 25 bp, Rattus norvegicus
caggatggtgtttccaaccttgaag

SEQ ID NO: 232542 - DNA, 25 bp, Rattus norvegicus
caggatgtcagacaagtgcttgacc

SEQ ID NO: 232543 - DNA, 25 bp, Rattus norvegicus
caggatgtcagagaagtgcttgacc

SEQ ID NO: 232544 - DNA, 25 bp, Rattus norvegicus
caggatgtcaggactacagagaaac

SEQ ID NO: 232545 - DNA, 25 bp, Rattus norvegicus
caggatgtcaggtctacagagaaac

SEQ ID NO: 232546 - DNA, 25 bp, Rattus norvegicus
caggatgtccttcagatgtttcctc

SEQ ID NO: 232547 - DNA, 25 bp, Rattus norvegicus
caggatgtccttgagatgtttcctc

SEQ ID NO: 232548 - DNA, 25 bp, Rattus norvegicus
caggatgttacacccttgtcaacaa

SEQ ID NO: 232549 - DNA, 25 bp, Rattus norvegicus
caggatgttacagccttgtcaacaa

SEQ ID NO: 232550 - DNA, 25 bp, Rattus norvegicus
caggatgttcctcatagctttttat

SEQ ID NO: 232551 - DNA, 25 bp, Rattus norvegicus
caggatgttcctgatagctttttat

SEQ ID NO: 232552 - DNA, 25 bp, Rattus norvegicus
caggatgttctcactgattatcaga

SEQ ID NO: 232553 - DNA, 25 bp, Rattus norvegicus
caggatgttctctctgattatcaga

SEQ ID NO: 232554 - DNA, 25 bp, Rattus norvegicus
caggattactgccttttgtgggtat

SEQ ID NO: 232555 - DNA, 25 bp, Rattus norvegicus
caggattactgcgttttgtgggtat

SEQ ID NO: 232556 - DNA, 25 bp, Rattus norvegicus
caggattcactgcttggactgagaa

SEQ ID NO: 232557 - DNA, 25 bp, Rattus norvegicus
caggattcactggttggactgagaa

SEQ ID NO: 232558 - DNA, 25 bp, Rattus norvegicus
caggattcaggcctgcgatggacct

SEQ ID NO: 232559 - DNA, 25 bp, Rattus norvegicus
caggattcaggcgtgcgatggacct

SEQ ID NO: 232560 - DNA, 25 bp, Rattus norvegicus
caggattcgagcctcccggagacat

SEQ ID NO: 232561 - DNA, 25 bp, Rattus norvegicus
caggattcgagcgtcccggagacat

SEQ ID NO: 232562 - DNA, 25 bp, Rattus norvegicus
caggattctcacagattatttttgt

SEQ ID NO: 232563 - DNA, 25 bp, Rattus norvegicus
caggattctcactgattatttttgt

SEQ ID NO: 232564 - DNA, 25 bp, Rattus norvegicus
caggattcttccctcacagacgaga

SEQ ID NO: 232565 - DNA, 25 bp, Rattus norvegicus
caggattcttccgtcacagacgaga

SEQ ID NO: 232566 - DNA, 25 bp, Rattus norvegicus
caggattcttgcactgagtgccccg

SEQ ID NO: 232567 - DNA, 25 bp, Rattus norvegicus
caggattcttgctctgagtgccccg

SEQ ID NO: 232568 - DNA, 25 bp, Rattus norvegicus
caggattgagtaagagccgggcacc

SEQ ID NO: 232569 - DNA, 25 bp, Rattus norvegicus
caggattgagtatgagccgggcacc

SEQ ID NO: 232570 - DNA, 25 bp, Rattus norvegicus
caggattgtctcatgcccagggtag

SEQ ID NO: 232571 - DNA, 25 bp, Rattus norvegicus
caggattgtctcttgcccagggtag

SEQ ID NO: 232572 - DNA, 25 bp, Rattus norvegicus
caggatttcatcacacttctcagaa

SEQ ID NO: 232573 - DNA, 25 bp, Rattus norvegicus
caggatttcatctcacttctcagaa

SEQ ID NO: 232574 - DNA, 25 bp, Rattus norvegicus
caggatttgaaacccttcctcgggt

SEQ ID NO: 232575 - DNA, 25 bp, Rattus norvegicus
caggatttgaaagccttcctcgggt

SEQ ID NO: 232576 - DNA, 25 bp, Rattus norvegicus
caggatttgctgactcaggactgga

SEQ ID NO: 232577 - DNA, 25 bp, Rattus norvegicus
caggatttgctgtctcaggactgga

SEQ ID NO: 232578 - DNA, 25 bp, Rattus norvegicus
caggattttgtgatgggagctcata

SEQ ID NO: 232579 - DNA, 25 bp, Rattus norvegicus
caggattttgtgttgggagctcata

SEQ ID NO: 232580 - DNA, 25 bp, Rattus norvegicus
caggcaaacctgagagcatcttgaa

SEQ ID NO: 232581 - DNA, 25 bp, Rattus norvegicus
caggcaaacctgtgagcatcttgaa

SEQ ID NO: 232582 - DNA, 25 bp, Rattus norvegicus
caggcaaagcctatctaccagagag

SEQ ID NO: 232583 - DNA, 25 bp, Rattus norvegicus
caggcaaagcctttctaccagagag

SEQ ID NO: 232584 - DNA, 25 bp, Rattus norvegicus
caggcaaatctcagtgaatttcagg

SEQ ID NO: 232585 - DNA, 25 bp, Rattus norvegicus
caggcaaatctctgtgaatttcagg

SEQ ID NO: 232586 - DNA, 25 bp, Rattus norvegicus
caggcaaatgtcaggaactcccgaa

SEQ ID NO: 232587 - DNA, 25 bp, Rattus norvegicus
caggcaaatgtctggaactcccgaa

SEQ ID NO: 232588 - DNA, 25 bp, Rattus norvegicus
caggcaacagttagggttgacccaa

SEQ ID NO: 232589 - DNA, 25 bp, Rattus norvegicus
caggcaacagtttgggttgacccaa

SEQ ID NO: 232590 - DNA, 25 bp, Rattus norvegicus
caggcaaccaaccattgaccgaaac

SEQ ID NO: 232591 - DNA, 25 bp, Rattus norvegicus
caggcaaccaacgattgaccgaaac

SEQ ID NO: 232592 - DNA, 25 bp, Rattus norvegicus
caggcaacctggaaatgacaatttt

SEQ ID NO: 232593 - DNA, 25 bp, Rattus norvegicus
caggcaacctggtaatgacaatttt

SEQ ID NO: 232594 - DNA, 25 bp, Rattus norvegicus
caggcaacttttcatctgctctcat

SEQ ID NO: 232595 - DNA, 25 bp, Rattus norvegicus
caggcaacttttgatctgctctcat

SEQ ID NO: 232596 - DNA, 25 bp, Rattus norvegicus
caggcaagccaaattgtaagtgaca

SEQ ID NO: 232597 - DNA, 25 bp, Rattus norvegicus
caggcaagccaatttgtaagtgaca

SEQ ID NO: 232598 - DNA, 25 bp, Rattus norvegicus
caggcaagctcccaagttgcgacat

SEQ ID NO: 232599 - DNA, 25 bp, Rattus norvegicus
caggcaagctccgaagttgcgacat

SEQ ID NO: 232600 - DNA, 25 bp, Rattus norvegicus
caggcaaggactaatgggcatattc

SEQ ID NO: 232601 - DNA, 25 bp, Rattus norvegicus
caggcaaggacttatgggcatattc

SEQ ID NO: 232602 - DNA, 25 bp, Rattus norvegicus
caggcaaggctgagttctagaagct

SEQ ID NO: 232603 - DNA, 25 bp, Rattus norvegicus
caggcaaggctgtgttctagaagct

SEQ ID NO: 232604 - DNA, 25 bp, Rattus norvegicus
caggcaagtgtcaccattttgaaca

SEQ ID NO: 232605 - DNA, 25 bp, Rattus norvegicus
caggcaagtgtctccattttgaaca

SEQ ID NO: 232606 - DNA, 25 bp, Rattus norvegicus
caggcaagttctctttgtgtgtgtc

SEQ ID NO: 232607 - DNA, 25 bp, Rattus norvegicus
caggcaagttctgtttgtgtgtgtc

SEQ ID NO: 232608 - DNA, 25 bp, Rattus norvegicus
caggcaatagctccatgggcttcct

SEQ ID NO: 232609 - DNA, 25 bp, Rattus norvegicus
caggcaatagctgcatgggcttcct

SEQ ID NO: 232610 - DNA, 25 bp, Rattus norvegicus
caggcaatgggacctactgagccat

SEQ ID NO: 232611 - DNA, 25 bp, Rattus norvegicus
caggcaatgggagctactgagccat

SEQ ID NO: 232612 - DNA, 25 bp, Rattus norvegicus
caggcacaaacaaggcactcaacat

SEQ ID NO: 232613 - DNA, 25 bp, Rattus norvegicus
caggcacaaacatggcactcaacat

SEQ ID NO: 232614 - DNA, 25 bp, Rattus norvegicus
caggcacaagttacaacgctgttcc

SEQ ID NO: 232615 - DNA, 25 bp, Rattus norvegicus
caggcacaagtttcaacgctgttcc

SEQ ID NO: 232616 - DNA, 25 bp, Rattus norvegicus
caggcacactttccccagatgtttt

SEQ ID NO: 232617 - DNA, 25 bp, Rattus norvegicus
caggcacactttgcccagatgtttt

SEQ ID NO: 232618 - DNA, 25 bp, Rattus norvegicus
caggcacaggagatggtcctcatgt

SEQ ID NO: 232619 - DNA, 25 bp, Rattus norvegicus
caggcacaggagttggtcctcatgt

SEQ ID NO: 232620 - DNA, 25 bp, Rattus norvegicus
caggcacagggaccccatttgctgg

SEQ ID NO: 232621 - DNA, 25 bp, Rattus norvegicus
caggcacagggagcccatttgctgg

SEQ ID NO: 232622 - DNA, 25 bp, Rattus norvegicus
caggcacatcctatttgcaagtgga

SEQ ID NO: 232623 - DNA, 25 bp, Rattus norvegicus
caggcacatcctttttgcaagtgga

SEQ ID NO: 232624 - DNA, 25 bp, Rattus norvegicus
caggcacatgcaaacttgggaacaa

SEQ ID NO: 232625 - DNA, 25 bp, Rattus norvegicus
caggcacatgcatacttgggaacaa

SEQ ID NO: 232626 - DNA, 25 bp, Rattus norvegicus
caggcacatggtcgtttccttttta

SEQ ID NO: 232627 - DNA, 25 bp, Rattus norvegicus
caggcacatggtggtttccttttta

SEQ ID NO: 232628 - DNA, 25 bp, Rattus norvegicus
caggcacattatacacacagcttaa

SEQ ID NO: 232629 - DNA, 25 bp, Rattus norvegicus
caggcacattattcacacagcttaa

SEQ ID NO: 232630 - DNA, 25 bp, Rattus norvegicus
caggcaccaaggacaatgtgaccat

SEQ ID NO: 232631 - DNA, 25 bp, Rattus norvegicus
caggcaccaaggtcaatgtgaccat

SEQ ID NO: 232632 - DNA, 25 bp, Rattus norvegicus
caggcaccaatcaagaccaagcatg

SEQ ID NO: 232633 - DNA, 25 bp, Rattus norvegicus
caggcaccaatctagaccaagcatg

SEQ ID NO: 232634 - DNA, 25 bp, Rattus norvegicus
caggcaccatctatcatctttttaa

SEQ ID NO: 232635 - DNA, 25 bp, Rattus norvegicus
caggcaccatctttcatctttttaa

SEQ ID NO: 232636 - DNA, 25 bp, Rattus norvegicus
caggcacctcggaacaaaaccattt

SEQ ID NO: 232637 - DNA, 25 bp, Rattus norvegicus
caggcacctcggtacaaaaccattt

SEQ ID NO: 232638 - DNA, 25 bp, Rattus norvegicus
caggcactaaaccaccatcttaaga

SEQ ID NO: 232639 - DNA, 25 bp, Rattus norvegicus
caggcactaaacgaccatcttaaga

SEQ ID NO: 232640 - DNA, 25 bp, Rattus norvegicus
caggcactagagcaagggccacagt

SEQ ID NO: 232641 - DNA, 25 bp, Rattus norvegicus
caggcactagaggaagggccacagt

SEQ ID NO: 232642 - DNA, 25 bp, Rattus norvegicus
caggcactcgagaattttccttggg

SEQ ID NO: 232643 - DNA, 25 bp, Rattus norvegicus
caggcactcgagtattttccttggg

SEQ ID NO: 232644 - DNA, 25 bp, Rattus norvegicus
caggcactgacacgctggtgctttt

SEQ ID NO: 232645 - DNA, 25 bp, Rattus norvegicus
caggcactgacaggctggtgctttt

SEQ ID NO: 232646 - DNA, 25 bp, Rattus norvegicus
caggcactgctgacctaattccggg

SEQ ID NO: 232647 - DNA, 25 bp, Rattus norvegicus
caggcactgctgtcctaattccggg

SEQ ID NO: 232648 - DNA, 25 bp, Rattus norvegicus
caggcactgtccctgaaggacacaa

SEQ ID NO: 232649 - DNA, 25 bp, Rattus norvegicus
caggcactgtccgtgaaggacacaa

SEQ ID NO: 232650 - DNA, 25 bp, Rattus norvegicus
caggcacttcttacctttgggttgc

SEQ ID NO: 232651 - DNA, 25 bp, Rattus norvegicus
caggcacttctttcctttgggttgc

SEQ ID NO: 232652 - DNA, 25 bp, Rattus norvegicus
caggcacttggtaccttgaacgagt

SEQ ID NO: 232653 - DNA, 25 bp, Rattus norvegicus
caggcacttggttccttgaacgagt

SEQ ID NO: 232654 - DNA, 25 bp, Rattus norvegicus
caggcactttggaaaacacgcggat

SEQ ID NO: 232655 - DNA, 25 bp, Rattus norvegicus
caggcactttggtaaacacgcggat

SEQ ID NO: 232656 - DNA, 25 bp, Rattus norvegicus
caggcagaacaaacaccaaacactt

SEQ ID NO: 232657 - DNA, 25 bp, Rattus norvegicus
caggcagaacaatcaccaaacactt

SEQ ID NO: 232658 - DNA, 25 bp, Rattus norvegicus
caggcagacgttcttcagatccatg

SEQ ID NO: 232659 - DNA, 25 bp, Rattus norvegicus
caggcagacgttgttcagatccatg

SEQ ID NO: 232660 - DNA, 25 bp, Rattus norvegicus
caggcagactgccaggctacagaaa

SEQ ID NO: 232661 - DNA, 25 bp, Rattus norvegicus
caggcagactgcgaggctacagaaa

SEQ ID NO: 232662 - DNA, 25 bp, Rattus norvegicus
caggcagataccaacagtctcttaa

SEQ ID NO: 232663 - DNA, 25 bp, Rattus norvegicus
caggcagatacctacagtctcttaa

SEQ ID NO: 232664 - DNA, 25 bp, Rattus norvegicus
caggcagatcctagtttgagttttg

SEQ ID NO: 232665 - DNA, 25 bp, Rattus norvegicus
caggcagatccttgtttgagttttg

SEQ ID NO: 232666 - DNA, 25 bp, Rattus norvegicus
caggcagatgtccaaagctcttttc

SEQ ID NO: 232667 - DNA, 25 bp, Rattus norvegicus
caggcagatgtcgaaagctcttttc

SEQ ID NO: 232668 - DNA, 25 bp, Rattus norvegicus
caggcagattacatgagttccagca

SEQ ID NO: 232669 - DNA, 25 bp, Rattus norvegicus
caggcagattacttgagttccagca

SEQ ID NO: 232670 - DNA, 25 bp, Rattus norvegicus
caggcagcaaagatgtctgttacat

SEQ ID NO: 232671 - DNA, 25 bp, Rattus norvegicus
caggcagcaaagttgtctgttacat

SEQ ID NO: 232672 - DNA, 25 bp, Rattus norvegicus
caggcagcaagaatacagactcggg

SEQ ID NO: 232673 - DNA, 25 bp, Rattus norvegicus
caggcagcaagattacagactcggg

SEQ ID NO: 232674 - DNA, 25 bp, Rattus norvegicus
caggcagcacacatggagtggcttt

SEQ ID NO: 232675 - DNA, 25 bp, Rattus norvegicus
caggcagcacacttggagtggcttt

SEQ ID NO: 232676 - DNA, 25 bp, Rattus norvegicus
caggcagcaccgcacagaaatgttt

SEQ ID NO: 232677 - DNA, 25 bp, Rattus norvegicus
caggcagcaccggacagaaatgttt

SEQ ID NO: 232678 - DNA, 25 bp, Rattus norvegicus
caggcagcagctcggctccgattcg

SEQ ID NO: 232679 - DNA, 25 bp, Rattus norvegicus
caggcagcagctgggctccgattcg

SEQ ID NO: 232680 - DNA, 25 bp, Rattus norvegicus
caggcagcctctactcttctaagaa

SEQ ID NO: 232681 - DNA, 25 bp, Rattus norvegicus
caggcagcctcttctcttctaagaa

SEQ ID NO: 232682 - DNA, 25 bp, Rattus norvegicus
caggcagcctgccttagacttgcag

SEQ ID NO: 232683 - DNA, 25 bp, Rattus norvegicus
caggcagcctgcgttagacttgcag

SEQ ID NO: 232684 - DNA, 25 bp, Rattus norvegicus
caggcagctctgctctagggaacta

SEQ ID NO: 232685 - DNA, 25 bp, Rattus norvegicus
caggcagctctggtctagggaacta

SEQ ID NO: 232686 - DNA, 25 bp, Rattus norvegicus
caggcaggacagcatgtggctggac

SEQ ID NO: 232687 - DNA, 25 bp, Rattus norvegicus
caggcaggacaggatgtggctggac

SEQ ID NO: 232688 - DNA, 25 bp, Rattus norvegicus
caggcaggagcacctgggccaattc

SEQ ID NO: 232689 - DNA, 25 bp, Rattus norvegicus
caggcaggagcagctgggccaattc

SEQ ID NO: 232690 - DNA, 25 bp, Rattus norvegicus
caggcaggcatgagtcagagccctt

SEQ ID NO: 232691 - DNA, 25 bp, Rattus norvegicus
caggcaggcatgtgtcagagccctt

SEQ ID NO: 232692 - DNA, 25 bp, Rattus norvegicus
caggcaggctcccatcctaaaggaa

SEQ ID NO: 232693 - DNA, 25 bp, Rattus norvegicus
caggcaggctccgatcctaaaggaa

SEQ ID NO: 232694 - DNA, 25 bp, Rattus norvegicus
caggcaggttagcaccctggtgtta

SEQ ID NO: 232695 - DNA, 25 bp, Rattus norvegicus
caggcaggttaggaccctggtgtta

SEQ ID NO: 232696 - DNA, 25 bp, Rattus norvegicus
caggcagtacagcagatcaagtcac

SEQ ID NO: 232697 - DNA, 25 bp, Rattus norvegicus
caggcagtacaggagatcaagtcac

SEQ ID NO: 232698 - DNA, 25 bp, Rattus norvegicus
caggcagtactgatcatgtgtttct

SEQ ID NO: 232699 - DNA, 25 bp, Rattus norvegicus
caggcagtactgttcatgtgtttct

SEQ ID NO: 232700 - DNA, 25 bp, Rattus norvegicus
caggcagtcatgatggatggtcccc

SEQ ID NO: 232701 - DNA, 25 bp, Rattus norvegicus
caggcagtcatgttggatggtcccc

SEQ ID NO: 232702 - DNA, 25 bp, Rattus norvegicus
caggcagtgagtctgcgccgccatt

SEQ ID NO: 232703 - DNA, 25 bp, Rattus norvegicus
caggcagtgagtgtgcgccgccatt

SEQ ID NO: 232704 - DNA, 25 bp, Rattus norvegicus
caggcagtgcctatgattggaaatg

SEQ ID NO: 232705 - DNA, 25 bp, Rattus norvegicus
caggcagtgcctttgattggaaatg

SEQ ID NO: 232706 - DNA, 25 bp, Rattus norvegicus
caggcagtggttataatggaggctt

SEQ ID NO: 232707 - DNA, 25 bp, Rattus norvegicus
caggcagtggttttaatggaggctt

SEQ ID NO: 232708 - DNA, 25 bp, Rattus norvegicus
caggcagtgtccaattgcatatcaa

SEQ ID NO: 232709 - DNA, 25 bp, Rattus norvegicus
caggcagtgtcctattgcatatcaa

SEQ ID NO: 232710 - DNA, 25 bp, Rattus norvegicus
caggcagttctgaggcaaagatgga

SEQ ID NO: 232711 - DNA, 25 bp, Rattus norvegicus
caggcagttctgtggcaaagatgga

SEQ ID NO: 232712 - DNA, 25 bp, Rattus norvegicus
caggcagttgggacacgggaaccat

SEQ ID NO: 232713 - DNA, 25 bp, Rattus norvegicus
caggcagttgggtcacgggaaccat

SEQ ID NO: 232714 - DNA, 25 bp, Rattus norvegicus
caggcatacattatgacaggtgtct

SEQ ID NO: 232715 - DNA, 25 bp, Rattus norvegicus
caggcatacattttgacaggtgtct

SEQ ID NO: 232716 - DNA, 25 bp, Rattus norvegicus
caggcatccactaacatcaactgat

SEQ ID NO: 232717 - DNA, 25 bp, Rattus norvegicus
caggcatccacttacatcaactgat

SEQ ID NO: 232718 - DNA, 25 bp, Rattus norvegicus
caggcatcctgtcaactaagaagaa

SEQ ID NO: 232719 - DNA, 25 bp, Rattus norvegicus
caggcatcctgtgaactaagaagaa

SEQ ID NO: 232720 - DNA, 25 bp, Rattus norvegicus
caggcatcggctactgcagttaggg

SEQ ID NO: 232721 - DNA, 25 bp, Rattus norvegicus
caggcatcggcttctgcagttaggg

SEQ ID NO: 232722 - DNA, 25 bp, Rattus norvegicus
caggcatcgggtacactgtcagtga

SEQ ID NO: 232723 - DNA, 25 bp, Rattus norvegicus
caggcatcgggttcactgtcagtga

SEQ ID NO: 232724 - DNA, 25 bp, Rattus norvegicus
caggcatctgtaatgtacatgcatg

SEQ ID NO: 232725 - DNA, 25 bp, Rattus norvegicus
caggcatctgtattgtacatgcatg

SEQ ID NO: 232726 - DNA, 25 bp, Rattus norvegicus
caggcatcttgcaaacagtctttga

SEQ ID NO: 232727 - DNA, 25 bp, Rattus norvegicus
caggcatcttgctaacagtctttga

SEQ ID NO: 232728 - DNA, 25 bp, Rattus norvegicus
caggcatgcacacggcaggttccaa

SEQ ID NO: 232729 - DNA, 25 bp, Rattus norvegicus
caggcatgcacagggcaggttccaa

SEQ ID NO: 232730 - DNA, 25 bp, Rattus norvegicus
caggcatgcaggaacctaacctctg

SEQ ID NO: 232731 - DNA, 25 bp, Rattus norvegicus
caggcatgcaggtacctaacctctg

SEQ ID NO: 232732 - DNA, 25 bp, Rattus norvegicus
caggcatgcctgaagtgcacataca

SEQ ID NO: 232733 - DNA, 25 bp, Rattus norvegicus
caggcatgcctgtagtgcacataca

SEQ ID NO: 232734 - DNA, 25 bp, Rattus norvegicus
caggcatgctctcagactactcctg

SEQ ID NO: 232735 - DNA, 25 bp, Rattus norvegicus
caggcatgctctgagactactcctg

SEQ ID NO: 232736 - DNA, 25 bp, Rattus norvegicus
caggcatgctgcaccagtcgtgttg

SEQ ID NO: 232737 - DNA, 25 bp, Rattus norvegicus
caggcatgctgctccagtcgtgttg

SEQ ID NO: 232738 - DNA, 25 bp, Rattus norvegicus
caggcatggtctccaggtttcaggt

SEQ ID NO: 232739 - DNA, 25 bp, Rattus norvegicus
caggcatggtctgcaggtttcaggt

SEQ ID NO: 232740 - DNA, 25 bp, Rattus norvegicus
caggcatggtggcatccctagtaat

SEQ ID NO: 232741 - DNA, 25 bp, Rattus norvegicus
caggcatggtgggatccctagtaat

SEQ ID NO: 232742 - DNA, 25 bp, Rattus norvegicus
caggcattatgcaccgtaacgcaga

SEQ ID NO: 232743 - DNA, 25 bp, Rattus norvegicus
caggcattatgctccgtaacgcaga

SEQ ID NO: 232744 - DNA, 25 bp, Rattus norvegicus
caggcattccctatgtaacttaggt

SEQ ID NO: 232745 - DNA, 25 bp, Rattus norvegicus
caggcattccctttgtaacttaggt

SEQ ID NO: 232746 - DNA, 25 bp, Rattus norvegicus
caggcattcctcagatcacacaaga

SEQ ID NO: 232747 - DNA, 25 bp, Rattus norvegicus
caggcattcctctgatcacacaaga

SEQ ID NO: 232748 - DNA, 25 bp, Rattus norvegicus
caggcattcgtgaggctcttgtcag

SEQ ID NO: 232749 - DNA, 25 bp, Rattus norvegicus
caggcattcgtgtggctcttgtcag

SEQ ID NO: 232750 - DNA, 25 bp, Rattus norvegicus
caggcattctagactctgtgctaac

SEQ ID NO: 232751 - DNA, 25 bp, Rattus norvegicus
caggcattctagtctctgtgctaac

SEQ ID NO: 232752 - DNA, 25 bp, Rattus norvegicus
caggcattctgtattgtccaccagt

SEQ ID NO: 232753 - DNA, 25 bp, Rattus norvegicus
caggcattctgttttgtccaccagt

SEQ ID NO: 232754 - DNA, 25 bp, Rattus norvegicus
caggcatttctgcatgtgagccact

SEQ ID NO: 232755 - DNA, 25 bp, Rattus norvegicus
caggcatttctggatgtgagccact

SEQ ID NO: 232756 - DNA, 25 bp, Rattus norvegicus
caggccaaatacctggaccagatgg

SEQ ID NO: 232757 - DNA, 25 bp, Rattus norvegicus
caggccaaatacgtggaccagatgg

SEQ ID NO: 232758 - DNA, 25 bp, Rattus norvegicus
caggccaacatgatttctgtgaaaa

SEQ ID NO: 232759 - DNA, 25 bp, Rattus norvegicus
caggccaacatgttttctgtgaaaa

SEQ ID NO: 232760 - DNA, 25 bp, Rattus norvegicus
caggccaaccatcccttagttaagt

SEQ ID NO: 232761 - DNA, 25 bp, Rattus norvegicus
caggccaaccatgccttagttaagt

SEQ ID NO: 232762 - DNA, 25 bp, Rattus norvegicus
caggccaagggccataggctttgtt

SEQ ID NO: 232763 - DNA, 25 bp, Rattus norvegicus
caggccaagggcgataggctttgtt

SEQ ID NO: 232764 - DNA, 25 bp, Rattus norvegicus
caggccacaggcatcttcaagaaag

SEQ ID NO: 232765 - DNA, 25 bp, Rattus norvegicus
caggccacaggcttcttcaagaaag

SEQ ID NO: 232766 - DNA, 25 bp, Rattus norvegicus
caggccacattgcagctgtacaagt

SEQ ID NO: 232767 - DNA, 25 bp, Rattus norvegicus
caggccacattggagctgtacaagt

SEQ ID NO: 232768 - DNA, 25 bp, Rattus norvegicus
caggccacccttcacaatgtgatgg

SEQ ID NO: 232769 - DNA, 25 bp, Rattus norvegicus
caggccacccttgacaatgtgatgg

SEQ ID NO: 232770 - DNA, 25 bp, Rattus norvegicus
caggccacctcaaaatctaggtctt

SEQ ID NO: 232771 - DNA, 25 bp, Rattus norvegicus
caggccacctcataatctaggtctt

SEQ ID NO: 232772 - DNA, 25 bp, Rattus norvegicus
caggccactggaattgttgaacatc

SEQ ID NO: 232773 - DNA, 25 bp, Rattus norvegicus
caggccactggatttgttgaacatc

SEQ ID NO: 232774 - DNA, 25 bp, Rattus norvegicus
caggccacttgcacgtgcagcagcg

SEQ ID NO: 232775 - DNA, 25 bp, Rattus norvegicus
caggccacttgctcgtgcagcagcg

SEQ ID NO: 232776 - DNA, 25 bp, Rattus norvegicus
caggccagaaaacgaaccccaaatg

SEQ ID NO: 232777 - DNA, 25 bp, Rattus norvegicus
caggccagaaaaggaaccccaaatg

SEQ ID NO: 232778 - DNA, 25 bp, Rattus norvegicus
caggccagagacaccactgaaattt

SEQ ID NO: 232779 - DNA, 25 bp, Rattus norvegicus
caggccagagactccactgaaattt

SEQ ID NO: 232780 - DNA, 25 bp, Rattus norvegicus
caggccagagtcacccaggtaccgg

SEQ ID NO: 232781 - DNA, 25 bp, Rattus norvegicus
caggccagagtctcccaggtaccgg

SEQ ID NO: 232782 - DNA, 25 bp, Rattus norvegicus
caggccagcactcagtcatttgaga

SEQ ID NO: 232783 - DNA, 25 bp, Rattus norvegicus
caggccagcactgagtcatttgaga

SEQ ID NO: 232784 - DNA, 25 bp, Rattus norvegicus
caggccagccaacgtatcatgcagc

SEQ ID NO: 232785 - DNA, 25 bp, Rattus norvegicus
caggccagccaaggtatcatgcagc

SEQ ID NO: 232786 - DNA, 25 bp, Rattus norvegicus
caggccagccagatatggacagtat

SEQ ID NO: 232787 - DNA, 25 bp, Rattus norvegicus
caggccagccagttatggacagtat

SEQ ID NO: 232788 - DNA, 25 bp, Rattus norvegicus
caggccagctgtcgcagtgaacatt

SEQ ID NO: 232789 - DNA, 25 bp, Rattus norvegicus
caggccagctgtggcagtgaacatt

SEQ ID NO: 232790 - DNA, 25 bp, Rattus norvegicus
caggccaggagacaccgctgtacat

SEQ ID NO: 232791 - DNA, 25 bp, Rattus norvegicus
caggccaggagagaccgctgtacat

SEQ ID NO: 232792 - DNA, 25 bp, Rattus norvegicus
caggccagggatatgtacgggaact

SEQ ID NO: 232793 - DNA, 25 bp, Rattus norvegicus
caggccagggatttgtacgggaact

SEQ ID NO: 232794 - DNA, 25 bp, Rattus norvegicus
caggccagtcgacgctatgttgtaa

SEQ ID NO: 232795 - DNA, 25 bp, Rattus norvegicus
caggccagtcgaggctatgttgtaa

SEQ ID NO: 232796 - DNA, 25 bp, Rattus norvegicus
caggccataggacccggtgcctaac

SEQ ID NO: 232797 - DNA, 25 bp, Rattus norvegicus
caggccataggagccggtgcctaac

SEQ ID NO: 232798 - DNA, 25 bp, Rattus norvegicus
caggccattactatagcacccagat

SEQ ID NO: 232799 - DNA, 25 bp, Rattus norvegicus
caggccattactttagcacccagat

SEQ ID NO: 232800 - DNA, 25 bp, Rattus norvegicus
caggccattcctatttattgtgcat

SEQ ID NO: 232801 - DNA, 25 bp, Rattus norvegicus
caggccattcctttttattgtgcat

SEQ ID NO: 232802 - DNA, 25 bp, Rattus norvegicus
caggccattggcaattgattgtgtt

SEQ ID NO: 232803 - DNA, 25 bp, Rattus norvegicus
caggccattggctattgattgtgtt

SEQ ID NO: 232804 - DNA, 25 bp, Rattus norvegicus
caggccattgtgactgttggacgtt

SEQ ID NO: 232805 - DNA, 25 bp, Rattus norvegicus
caggccattgtgtctgttggacgtt

SEQ ID NO: 232806 - DNA, 25 bp, Rattus norvegicus
caggcccaaggaaaacagcatatta

SEQ ID NO: 232807 - DNA, 25 bp, Rattus norvegicus
caggcccaaggataacagcatatta

SEQ ID NO: 232808 - DNA, 25 bp, Rattus norvegicus
caggcccacatcaggctttaaattc

SEQ ID NO: 232809 - DNA, 25 bp, Rattus norvegicus
caggcccacatctggctttaaattc

SEQ ID NO: 232810 - DNA, 25 bp, Rattus norvegicus
caggcccagattcagtcacatgctc

SEQ ID NO: 232811 - DNA, 25 bp, Rattus norvegicus
caggcccagattgagtcacatgctc

SEQ ID NO: 232812 - DNA, 25 bp, Rattus norvegicus
caggcccagctgctgatggtgatca

SEQ ID NO: 232813 - DNA, 25 bp, Rattus norvegicus
caggcccagctggtgatggtgatca

SEQ ID NO: 232814 - DNA, 25 bp, Rattus norvegicus
caggcccaggtcacagttcttattc

SEQ ID NO: 232815 - DNA, 25 bp, Rattus norvegicus
caggcccaggtctcagttcttattc

SEQ ID NO: 232816 - DNA, 25 bp, Rattus norvegicus
caggcccatatgatgtttacagatt

SEQ ID NO: 232817 - DNA, 25 bp, Rattus norvegicus
caggcccatatgttgtttacagatt

SEQ ID NO: 232818 - DNA, 25 bp, Rattus norvegicus
caggcccattgacggatctcagctg

SEQ ID NO: 232819 - DNA, 25 bp, Rattus norvegicus
caggcccattgagggatctcagctg

SEQ ID NO: 232820 - DNA, 25 bp, Rattus norvegicus
caggccccaaggagggtttactgag

SEQ ID NO: 232821 - DNA, 25 bp, Rattus norvegicus
caggccccaaggtgggtttactgag

SEQ ID NO: 232822 - DNA, 25 bp, Rattus norvegicus
caggccccagaacgcccagtaaaat

SEQ ID NO: 232823 - DNA, 25 bp, Rattus norvegicus
caggccccagaaggcccagtaaaat

SEQ ID NO: 232824 - DNA, 25 bp, Rattus norvegicus
caggccccagagagtcagaggtgac

SEQ ID NO: 232825 - DNA, 25 bp, Rattus norvegicus
caggccccagagtgtcagaggtgac

SEQ ID NO: 232826 - DNA, 25 bp, Rattus norvegicus
caggccccaggaattttacacataa

SEQ ID NO: 232827 - DNA, 25 bp, Rattus norvegicus
caggccccaggatttttacacataa

SEQ ID NO: 232828 - DNA, 25 bp, Rattus norvegicus
caggccccagtccagattaatgtgt

SEQ ID NO: 232829 - DNA, 25 bp, Rattus norvegicus
caggccccagtcgagattaatgtgt

SEQ ID NO: 232830 - DNA, 25 bp, Rattus norvegicus
caggccccgtgcacatatcacatga

SEQ ID NO: 232831 - DNA, 25 bp, Rattus norvegicus
caggccccgtgctcatatcacatga

SEQ ID NO: 232832 - DNA, 25 bp, Rattus norvegicus
caggcccctgatattcatggatagt

SEQ ID NO: 232833 - DNA, 25 bp, Rattus norvegicus
caggcccctgattttcatggatagt

SEQ ID NO: 232834 - DNA, 25 bp, Rattus norvegicus
caggcccctggcaacccagtgttgg

SEQ ID NO: 232835 - DNA, 25 bp, Rattus norvegicus
caggcccctggctacccagtgttgg

SEQ ID NO: 232836 - DNA, 25 bp, Rattus norvegicus
caggccccttgtcgcattcaaatgc

SEQ ID NO: 232837 - DNA, 25 bp, Rattus norvegicus
caggccccttgtggcattcaaatgc

SEQ ID NO: 232838 - DNA, 25 bp, Rattus norvegicus
caggccctccagaaagatactactt

SEQ ID NO: 232839 - DNA, 25 bp, Rattus norvegicus
caggccctccagtaagatactactt

SEQ ID NO: 232840 - DNA, 25 bp, Rattus norvegicus
caggccctgagtattgtgaccaaag

SEQ ID NO: 232841 - DNA, 25 bp, Rattus norvegicus
caggccctgagttttgtgaccaaag

SEQ ID NO: 232842 - DNA, 25 bp, Rattus norvegicus
caggccctgggcaaatgtagacatg

SEQ ID NO: 232843 - DNA, 25 bp, Rattus norvegicus
caggccctgggctaatgtagacatg

SEQ ID NO: 232844 - DNA, 25 bp, Rattus norvegicus
caggccctggtgagctctgggatat

SEQ ID NO: 232845 - DNA, 25 bp, Rattus norvegicus
caggccctggtgtgctctgggatat

SEQ ID NO: 232846 - DNA, 25 bp, Rattus norvegicus
caggccctgtaactggcttctcatt

SEQ ID NO: 232847 - DNA, 25 bp, Rattus norvegicus
caggccctgtaagtggcttctcatt

SEQ ID NO: 232848 - DNA, 25 bp, Rattus norvegicus
caggccctgtgacattgcactcatg

SEQ ID NO: 232849 - DNA, 25 bp, Rattus norvegicus
caggccctgtgagattgcactcatg

SEQ ID NO: 232850 - DNA, 25 bp, Rattus norvegicus
caggccctgtttccccagtatgaaa

SEQ ID NO: 232851 - DNA, 25 bp, Rattus norvegicus
caggccctgtttgcccagtatgaaa

SEQ ID NO: 232852 - DNA, 25 bp, Rattus norvegicus
caggccctttaaagagtcgacttct

SEQ ID NO: 232853 - DNA, 25 bp, Rattus norvegicus
caggccctttaatgagtcgacttct

SEQ ID NO: 232854 - DNA, 25 bp, Rattus norvegicus
caggccgacacacacatttttcatc

SEQ ID NO: 232855 - DNA, 25 bp, Rattus norvegicus
caggccgacacagacatttttcatc

SEQ ID NO: 232856 - DNA, 25 bp, Rattus norvegicus
caggccgagagcattaccaattttc

SEQ ID NO: 232857 - DNA, 25 bp, Rattus norvegicus
caggccgagagctttaccaattttc

SEQ ID NO: 232858 - DNA, 25 bp, Rattus norvegicus
caggccgagggtctttactttgtga

SEQ ID NO: 232859 - DNA, 25 bp, Rattus norvegicus
caggccgagggtgtttactttgtga

SEQ ID NO: 232860 - DNA, 25 bp, Rattus norvegicus
caggccgatagcaatgactttgagg

SEQ ID NO: 232861 - DNA, 25 bp, Rattus norvegicus
caggccgatagctatgactttgagg

SEQ ID NO: 232862 - DNA, 25 bp, Rattus norvegicus
caggccgccagaaggacgtgttcat

SEQ ID NO: 232863 - DNA, 25 bp, Rattus norvegicus
caggccgccagatggacgtgttcat

SEQ ID NO: 232864 - DNA, 25 bp, Rattus norvegicus
caggccgcctgtccagtgatgaagc

SEQ ID NO: 232865 - DNA, 25 bp, Rattus norvegicus
caggccgcctgtgcagtgatgaagc

SEQ ID NO: 232866 - DNA, 25 bp, Rattus norvegicus
caggccggaatgaaagagctccttt

SEQ ID NO: 232867 - DNA, 25 bp, Rattus norvegicus
caggccggaatgtaagagctccttt

SEQ ID NO: 232868 - DNA, 25 bp, Rattus norvegicus
caggccggcatcactagatcagcca

SEQ ID NO: 232869 - DNA, 25 bp, Rattus norvegicus
caggccggcatctctagatcagcca

SEQ ID NO: 232870 - DNA, 25 bp, Rattus norvegicus
caggccgggcagattttagatgctc

SEQ ID NO: 232871 - DNA, 25 bp, Rattus norvegicus
caggccgggcagtttttagatgctc

SEQ ID NO: 232872 - DNA, 25 bp, Rattus norvegicus
caggccgggcctacagcatgttggc

SEQ ID NO: 232873 - DNA, 25 bp, Rattus norvegicus
caggccgggccttcagcatgttggc

SEQ ID NO: 232874 - DNA, 25 bp, Rattus norvegicus
caggccgtggacagttttatctgta

SEQ ID NO: 232875 - DNA, 25 bp, Rattus norvegicus
caggccgtggactgttttatctgta

SEQ ID NO: 232876 - DNA, 25 bp, Rattus norvegicus
caggcctaaaggctggtaggttctt

SEQ ID NO: 232877 - DNA, 25 bp, Rattus norvegicus
caggcctaaagggtggtaggttctt

SEQ ID NO: 232878 - DNA, 25 bp, Rattus norvegicus
caggcctaacccaatgatttattca

SEQ ID NO: 232879 - DNA, 25 bp, Rattus norvegicus
caggcctaaccctatgatttattca

SEQ ID NO: 232880 - DNA, 25 bp, Rattus norvegicus
caggcctacaagagacacacagtgc

SEQ ID NO: 232881 - DNA, 25 bp, Rattus norvegicus
caggcctacaagtgacacacagtgc

SEQ ID NO: 232882 - DNA, 25 bp, Rattus norvegicus
caggcctacagtatccatggttgaa

SEQ ID NO: 232883 - DNA, 25 bp, Rattus norvegicus
caggcctacagtttccatggttgaa

SEQ ID NO: 232884 - DNA, 25 bp, Rattus norvegicus
caggcctaccttaagttcttggatc

SEQ ID NO: 232885 - DNA, 25 bp, Rattus norvegicus
caggcctacctttagttcttggatc

SEQ ID NO: 232886 - DNA, 25 bp, Rattus norvegicus
caggcctacgggaccgtgtgccgct

SEQ ID NO: 232887 - DNA, 25 bp, Rattus norvegicus
caggcctacgggtccgtgtgccgct

SEQ ID NO: 232888 - DNA, 25 bp, Rattus norvegicus
caggcctagggcagtgactctaatc

SEQ ID NO: 232889 - DNA, 25 bp, Rattus norvegicus
caggcctagggctgtgactctaatc

SEQ ID NO: 232890 - DNA, 25 bp, Rattus norvegicus
caggcctcaatactgccagggataa

SEQ ID NO: 232891 - DNA, 25 bp, Rattus norvegicus
caggcctcaatagtgccagggataa

SEQ ID NO: 232892 - DNA, 25 bp, Rattus norvegicus
caggcctcaattatccactgtaatt

SEQ ID NO: 232893 - DNA, 25 bp, Rattus norvegicus
caggcctcaattttccactgtaatt

SEQ ID NO: 232894 - DNA, 25 bp, Rattus norvegicus
caggcctcagacagactgtgatgtt

SEQ ID NO: 232895 - DNA, 25 bp, Rattus norvegicus
caggcctcagactgactgtgatgtt

SEQ ID NO: 232896 - DNA, 25 bp, Rattus norvegicus
caggcctcagctacttcggaagagt

SEQ ID NO: 232897 - DNA, 25 bp, Rattus norvegicus
caggcctcagcttcttcggaagagt

SEQ ID NO: 232898 - DNA, 25 bp, Rattus norvegicus
caggcctcagggacaagtatgtctt

SEQ ID NO: 232899 - DNA, 25 bp, Rattus norvegicus
caggcctcagggtcaagtatgtctt

SEQ ID NO: 232900 - DNA, 25 bp, Rattus norvegicus
caggcctcccagatgtgtagagtat

SEQ ID NO: 232901 - DNA, 25 bp, Rattus norvegicus
caggcctcccagttgtgtagagtat

SEQ ID NO: 232902 - DNA, 25 bp, Rattus norvegicus
caggcctcccatcttgaagacattt

SEQ ID NO: 232903 - DNA, 25 bp, Rattus norvegicus
caggcctcccatgttgaagacattt

SEQ ID NO: 232904 - DNA, 25 bp, Rattus norvegicus
caggcctccctgatgtgagtaggtc

SEQ ID NO: 232905 - DNA, 25 bp, Rattus norvegicus
caggcctccctgttgtgagtaggtc

SEQ ID NO: 232906 - DNA, 25 bp, Rattus norvegicus
caggcctcctaaccaagttcttgct

SEQ ID NO: 232907 - DNA, 25 bp, Rattus norvegicus
caggcctcctaagcaagttcttgct

SEQ ID NO: 232908 - DNA, 25 bp, Rattus norvegicus
caggcctctcatctcaggaaggagt

SEQ ID NO: 232909 - DNA, 25 bp, Rattus norvegicus
caggcctctcatgtcaggaaggagt

SEQ ID NO: 232910 - DNA, 25 bp, Rattus norvegicus
caggcctctctgctgagagtcagaa

SEQ ID NO: 232911 - DNA, 25 bp, Rattus norvegicus
caggcctctctgctgggcattttat

SEQ ID NO: 232912 - DNA, 25 bp, Rattus norvegicus
caggcctctctggtgagagtcagaa

SEQ ID NO: 232913 - DNA, 25 bp, Rattus norvegicus
caggcctctctggtgggcattttat

SEQ ID NO: 232914 - DNA, 25 bp, Rattus norvegicus
caggcctctgctcgagactgagaag

SEQ ID NO: 232915 - DNA, 25 bp, Rattus norvegicus
caggcctctgctggagactgagaag

SEQ ID NO: 232916 - DNA, 25 bp, Rattus norvegicus
caggcctctgtcattgttagtgtac

SEQ ID NO: 232917 - DNA, 25 bp, Rattus norvegicus
caggcctctgtctttgttagtgtac

SEQ ID NO: 232918 - DNA, 25 bp, Rattus norvegicus
caggcctcttggacggacaggtcat

SEQ ID NO: 232919 - DNA, 25 bp, Rattus norvegicus
caggcctcttggtcggacaggtcat

SEQ ID NO: 232920 - DNA, 25 bp, Rattus norvegicus
caggcctgactgagcacatgctgag

SEQ ID NO: 232921 - DNA, 25 bp, Rattus norvegicus
caggcctgactgtgcacatgctgag

SEQ ID NO: 232922 - DNA, 25 bp, Rattus norvegicus
caggcctgaggaaaccgagcttttt

SEQ ID NO: 232923 - DNA, 25 bp, Rattus norvegicus
caggcctgaggataccgagcttttt

SEQ ID NO: 232924 - DNA, 25 bp, Rattus norvegicus
caggcctgaggcaacaatttcccga

SEQ ID NO: 232925 - DNA, 25 bp, Rattus norvegicus
caggcctgaggctacaatttcccga

SEQ ID NO: 232926 - DNA, 25 bp, Rattus norvegicus
caggcctgataccaacgtgctgcgg

SEQ ID NO: 232927 - DNA, 25 bp, Rattus norvegicus
caggcctgatacgaacgtgctgcgg

SEQ ID NO: 232928 - DNA, 25 bp, Rattus norvegicus
caggcctgcggtctgcaagctttcg

SEQ ID NO: 232929 - DNA, 25 bp, Rattus norvegicus
caggcctgcggtgtgcaagctttcg

SEQ ID NO: 232930 - DNA, 25 bp, Rattus norvegicus
caggcctgctgcaagactggagaac

SEQ ID NO: 232931 - DNA, 25 bp, Rattus norvegicus
caggcctgctgctagactggagaac

SEQ ID NO: 232932 - DNA, 25 bp, Rattus norvegicus
caggcctggcttataagtgcagatg

SEQ ID NO: 232933 - DNA, 25 bp, Rattus norvegicus
caggcctggcttttaagtgcagatg

SEQ ID NO: 232934 - DNA, 25 bp, Rattus norvegicus
caggcctgtatcatggcagttggaa

SEQ ID NO: 232935 - DNA, 25 bp, Rattus norvegicus
caggcctgtatcttggcagttggaa

SEQ ID NO: 232936 - DNA, 25 bp, Rattus norvegicus
caggcctgtcaacccagattgggat

SEQ ID NO: 232937 - DNA, 25 bp, Rattus norvegicus
caggcctgtcaagccagattgggat

SEQ ID NO: 232938 - DNA, 25 bp, Rattus norvegicus
caggccttactacaaccatttgtca

SEQ ID NO: 232939 - DNA, 25 bp, Rattus norvegicus
caggccttactagaaccatttgtca

SEQ ID NO: 232940 - DNA, 25 bp, Rattus norvegicus
caggccttattccggtgctatgagt

SEQ ID NO: 232941 - DNA, 25 bp, Rattus norvegicus
caggccttattcgggtgctatgagt

SEQ ID NO: 232942 - DNA, 25 bp, Rattus norvegicus
caggccttcagtactcatgtgttta

SEQ ID NO: 232943 - DNA, 25 bp, Rattus norvegicus
caggccttcagttctcatgtgttta

SEQ ID NO: 232944 - DNA, 25 bp, Rattus norvegicus
caggccttccatctggatggccatt

SEQ ID NO: 232945 - DNA, 25 bp, Rattus norvegicus
caggccttccatgtggatggccatt

SEQ ID NO: 232946 - DNA, 25 bp, Rattus norvegicus
caggccttccgaaaatgcgcggctt

SEQ ID NO: 232947 - DNA, 25 bp, Rattus norvegicus
caggccttccgataatgcgcggctt

SEQ ID NO: 232948 - DNA, 25 bp, Rattus norvegicus
caggccttcctaactagcagaggca

SEQ ID NO: 232949 - DNA, 25 bp, Rattus norvegicus
caggccttcctatctagcagaggca

SEQ ID NO: 232950 - DNA, 25 bp, Rattus norvegicus
caggccttctggaaaccgtgggtga

SEQ ID NO: 232951 - DNA, 25 bp, Rattus norvegicus
caggccttctggtaaccgtgggtga

SEQ ID NO: 232952 - DNA, 25 bp, Rattus norvegicus
caggccttgatgaaaatactatatt

SEQ ID NO: 232953 - DNA, 25 bp, Rattus norvegicus
caggccttgatgtaaatactatatt

SEQ ID NO: 232954 - DNA, 25 bp, Rattus norvegicus
caggccttgttaaaaataagctgca

SEQ ID NO: 232955 - DNA, 25 bp, Rattus norvegicus
caggccttgttataaataagctgca

SEQ ID NO: 232956 - DNA, 25 bp, Rattus norvegicus
caggcctttggaaggtttggctaaa

SEQ ID NO: 232957 - DNA, 25 bp, Rattus norvegicus
caggcctttggatggtttggctaaa

SEQ ID NO: 232958 - DNA, 25 bp, Rattus norvegicus
caggcgaatcctacatggacatact

SEQ ID NO: 232959 - DNA, 25 bp, Rattus norvegicus
caggcgaatccttcatggacatact

SEQ ID NO: 232960 - DNA, 25 bp, Rattus norvegicus
caggcgactcagacactcgggaact

SEQ ID NO: 232961 - DNA, 25 bp, Rattus norvegicus
caggcgactcagtcactcgggaact

SEQ ID NO: 232962 - DNA, 25 bp, Rattus norvegicus
caggcgaggatgcacttgataatgt

SEQ ID NO: 232963 - DNA, 25 bp, Rattus norvegicus
caggcgaggatggacttgataatgt

SEQ ID NO: 232964 - DNA, 25 bp, Rattus norvegicus
caggcgagggagaccaacagcgacc

SEQ ID NO: 232965 - DNA, 25 bp, Rattus norvegicus
caggcgagggagtccaacagcgacc

SEQ ID NO: 232966 - DNA, 25 bp, Rattus norvegicus
caggcgatgatgatggctttctgac

SEQ ID NO: 232967 - DNA, 25 bp, Rattus norvegicus
caggcgatgatgttggctttctgac

SEQ ID NO: 232968 - DNA, 25 bp, Rattus norvegicus
caggcgatggtcagcgaacgctgcc

SEQ ID NO: 232969 - DNA, 25 bp, Rattus norvegicus
caggcgatggtctgcgaacgctgcc

SEQ ID NO: 232970 - DNA, 25 bp, Rattus norvegicus
caggcgcatttaccttgggatgtct

SEQ ID NO: 232971 - DNA, 25 bp, Rattus norvegicus
caggcgcatttagcttgggatgtct

SEQ ID NO: 232972 - DNA, 25 bp, Rattus norvegicus
caggcgccattgcagccatcgtgat

SEQ ID NO: 232973 - DNA, 25 bp, Rattus norvegicus
caggcgccattggagccatcgtgat

SEQ ID NO: 232974 - DNA, 25 bp, Rattus norvegicus
caggcgcctcttctcccgggagaaa

SEQ ID NO: 232975 - DNA, 25 bp, Rattus norvegicus
caggcgcctcttgtcccgggagaaa

SEQ ID NO: 232976 - DNA, 25 bp, Rattus norvegicus
caggcgcgagccagagacccccgcg

SEQ ID NO: 232977 - DNA, 25 bp, Rattus norvegicus
caggcgcgagcctgagacccccgcg

SEQ ID NO: 232978 - DNA, 25 bp, Rattus norvegicus
caggcgcgagctccctcatgttgca

SEQ ID NO: 232979 - DNA, 25 bp, Rattus norvegicus
caggcgcgagctgcctcatgttgca

SEQ ID NO: 232980 - DNA, 25 bp, Rattus norvegicus
caggcgctgactcggtttgctttat

SEQ ID NO: 232981 - DNA, 25 bp, Rattus norvegicus
caggcgctgactgggtttgctttat

SEQ ID NO: 232982 - DNA, 25 bp, Rattus norvegicus
caggcgctgattacccatatgcatg

SEQ ID NO: 232983 - DNA, 25 bp, Rattus norvegicus
caggcgctgatttcccatatgcatg

SEQ ID NO: 232984 - DNA, 25 bp, Rattus norvegicus
caggcgctggccaagttttagggca

SEQ ID NO: 232985 - DNA, 25 bp, Rattus norvegicus
caggcgctggcctagttttagggca

SEQ ID NO: 232986 - DNA, 25 bp, Rattus norvegicus
caggcgctgtgactactcggtaaag

SEQ ID NO: 232987 - DNA, 25 bp, Rattus norvegicus
caggcgctgtgagtactcggtaaag

SEQ ID NO: 232988 - DNA, 25 bp, Rattus norvegicus
caggcggaaactcggctggtcgttc

SEQ ID NO: 232989 - DNA, 25 bp, Rattus norvegicus
caggcggaaactgggctggtcgttc

SEQ ID NO: 232990 - DNA, 25 bp, Rattus norvegicus
caggcggaattgcagcagcacttac

SEQ ID NO: 232991 - DNA, 25 bp, Rattus norvegicus
caggcggaattggagcagcacttac

SEQ ID NO: 232992 - DNA, 25 bp, Rattus norvegicus
caggcggatcctagtatggttatca

SEQ ID NO: 232993 - DNA, 25 bp, Rattus norvegicus
caggcggatccttgtatggttatca

SEQ ID NO: 232994 - DNA, 25 bp, Rattus norvegicus
caggcggccctgcatacatagaaga

SEQ ID NO: 232995 - DNA, 25 bp, Rattus norvegicus
caggcggccctggatacatagaaga

SEQ ID NO: 232996 - DNA, 25 bp, Rattus norvegicus
caggcggcgcgtaattctttttaga

SEQ ID NO: 232997 - DNA, 25 bp, Rattus norvegicus
caggcggcgcgttattctttttaga

SEQ ID NO: 232998 - DNA, 25 bp, Rattus norvegicus
caggcgggacccacaggcatagaat

SEQ ID NO: 232999 - DNA, 25 bp, Rattus norvegicus
caggcgggaccctcaggcatagaat

SEQ ID NO: 233000 - DNA, 25 bp, Rattus norvegicus
caggcggtgcgtcacgtttttacgt

SEQ ID NO: 233001 - DNA, 25 bp, Rattus norvegicus
caggcggtgcgtgacgtttttacgt

SEQ ID NO: 233002 - DNA, 25 bp, Rattus norvegicus
caggcgtagccaaagtacttgtgtt

SEQ ID NO: 233003 - DNA, 25 bp, Rattus norvegicus
caggcgtagccatagtacttgtgtt

SEQ ID NO: 233004 - DNA, 25 bp, Rattus norvegicus
caggcgtatcctctggtcaaaagaa

SEQ ID NO: 233005 - DNA, 25 bp, Rattus norvegicus
caggcgtatcctgtggtcaaaagaa

SEQ ID NO: 233006 - DNA, 25 bp, Rattus norvegicus
caggcgtgtttaagcatgccctcac

SEQ ID NO: 233007 - DNA, 25 bp, Rattus norvegicus
caggcgtgtttatgcatgccctcac

SEQ ID NO: 233008 - DNA, 25 bp, Rattus norvegicus
caggcgtttggaagtgcttggctac

SEQ ID NO: 233009 - DNA, 25 bp, Rattus norvegicus
caggcgtttggatgtgcttggctac

SEQ ID NO: 233010 - DNA, 25 bp, Rattus norvegicus
caggctaagactatttaacctcaag

SEQ ID NO: 233011 - DNA, 25 bp, Rattus norvegicus
caggctaagactttttaacctcaag

SEQ ID NO: 233012 - DNA, 25 bp, Rattus norvegicus
caggctaagagtcagcttcactgcc

SEQ ID NO: 233013 - DNA, 25 bp, Rattus norvegicus
caggctaagagtgagcttcactgcc

SEQ ID NO: 233014 - DNA, 25 bp, Rattus norvegicus
caggctacagtcaatgcttggtact

SEQ ID NO: 233015 - DNA, 25 bp, Rattus norvegicus
caggctacagtctatgcttggtact

SEQ ID NO: 233016 - DNA, 25 bp, Rattus norvegicus
caggctacagtgagagaatgtgtct

SEQ ID NO: 233017 - DNA, 25 bp, Rattus norvegicus
caggctacagtgtgagaatgtgtct

SEQ ID NO: 233018 - DNA, 25 bp, Rattus norvegicus
caggctacctctacttgaaaaaaca

SEQ ID NO: 233019 - DNA, 25 bp, Rattus norvegicus
caggctacctcttcttgaaaaaaca

SEQ ID NO: 233020 - DNA, 25 bp, Rattus norvegicus
caggctacctgcagcgggagagcaa

SEQ ID NO: 233021 - DNA, 25 bp, Rattus norvegicus
caggctacctgctgcgggagagcaa

SEQ ID NO: 233022 - DNA, 25 bp, Rattus norvegicus
caggctacgatcaggtaccggcgga

SEQ ID NO: 233023 - DNA, 25 bp, Rattus norvegicus
caggctacgatctggtaccggcgga

SEQ ID NO: 233024 - DNA, 25 bp, Rattus norvegicus
caggctactacgacaggctgtgtga

SEQ ID NO: 233025 - DNA, 25 bp, Rattus norvegicus
caggctactacgtcaggctgtgtga

SEQ ID NO: 233026 - DNA, 25 bp, Rattus norvegicus
caggctactgggatggtgtccgata

SEQ ID NO: 233027 - DNA, 25 bp, Rattus norvegicus
caggctactgggttggtgtccgata

SEQ ID NO: 233028 - DNA, 25 bp, Rattus norvegicus
caggctactgtcaaattccacgtgg

SEQ ID NO: 233029 - DNA, 25 bp, Rattus norvegicus
caggctactgtctaattccacgtgg

SEQ ID NO: 233030 - DNA, 25 bp, Rattus norvegicus
caggctagaactcttgaattcagaa

SEQ ID NO: 233031 - DNA, 25 bp, Rattus norvegicus
caggctagaactgttgaattcagaa

SEQ ID NO: 233032 - DNA, 25 bp, Rattus norvegicus
caggctagaagcctgcgggcacaca

SEQ ID NO: 233033 - DNA, 25 bp, Rattus norvegicus
caggctagaagcgtgcgggcacaca

SEQ ID NO: 233034 - DNA, 25 bp, Rattus norvegicus
caggctagaccaacttcaggacaaa

SEQ ID NO: 233035 - DNA, 25 bp, Rattus norvegicus
caggctagaccatcttcaggacaaa

SEQ ID NO: 233036 - DNA, 25 bp, Rattus norvegicus
caggctagactgctccacagtaaat

SEQ ID NO: 233037 - DNA, 25 bp, Rattus norvegicus
caggctagactggtccacagtaaat

SEQ ID NO: 233038 - DNA, 25 bp, Rattus norvegicus
caggctagcctcaaagtcaataggt

SEQ ID NO: 233039 - DNA, 25 bp, Rattus norvegicus
caggctagcctcagaacttagagat

SEQ ID NO: 233040 - DNA, 25 bp, Rattus norvegicus
caggctagcctcatgtagtgagttc

SEQ ID NO: 233041 - DNA, 25 bp, Rattus norvegicus
caggctagcctctaagtcaataggt

SEQ ID NO: 233042 - DNA, 25 bp, Rattus norvegicus
caggctagcctctgaacttagagat

SEQ ID NO: 233043 - DNA, 25 bp, Rattus norvegicus
caggctagcctcttgtagtgagttc

SEQ ID NO: 233044 - DNA, 25 bp, Rattus norvegicus
caggctagctctcaactcattctac

SEQ ID NO: 233045 - DNA, 25 bp, Rattus norvegicus
caggctagctctgaactcattctac

SEQ ID NO: 233046 - DNA, 25 bp, Rattus norvegicus
caggctaggactctgcagccttgga

SEQ ID NO: 233047 - DNA, 25 bp, Rattus norvegicus
caggctaggactgtgcagccttgga

SEQ ID NO: 233048 - DNA, 25 bp, Rattus norvegicus
caggctagggagattcgggcacatt

SEQ ID NO: 233049 - DNA, 25 bp, Rattus norvegicus
caggctagggagtttcgggcacatt

SEQ ID NO: 233050 - DNA, 25 bp, Rattus norvegicus
caggctagtcatagggctctcaaaa

SEQ ID NO: 233051 - DNA, 25 bp, Rattus norvegicus
caggctagtcattgggctctcaaaa

SEQ ID NO: 233052 - DNA, 25 bp, Rattus norvegicus
caggctatatgaacattcacaccaa

SEQ ID NO: 233053 - DNA, 25 bp, Rattus norvegicus
caggctatatgatcattcacaccaa

SEQ ID NO: 233054 - DNA, 25 bp, Rattus norvegicus
caggctatcgatatatggttttcaa

SEQ ID NO: 233055 - DNA, 25 bp, Rattus norvegicus
caggctatcgatttatggttttcaa

SEQ ID NO: 233056 - DNA, 25 bp, Rattus norvegicus
caggctatgagccactactttgcat

SEQ ID NO: 233057 - DNA, 25 bp, Rattus norvegicus
caggctatgagcgactactttgcat

SEQ ID NO: 233058 - DNA, 25 bp, Rattus norvegicus
caggctcaaatcattgtcccacgtc

SEQ ID NO: 233059 - DNA, 25 bp, Rattus norvegicus
caggctcaaatctttgtcccacgtc

SEQ ID NO: 233060 - DNA, 25 bp, Rattus norvegicus
caggctcacactcggtttatgaagg

SEQ ID NO: 233061 - DNA, 25 bp, Rattus norvegicus
caggctcacactgggtttatgaagg

SEQ ID NO: 233062 - DNA, 25 bp, Rattus norvegicus
caggctcacgtgcagtctaactcag

SEQ ID NO: 233063 - DNA, 25 bp, Rattus norvegicus
caggctcacgtggagtctaactcag

SEQ ID NO: 233064 - DNA, 25 bp, Rattus norvegicus
caggctcactccaacattcagatga

SEQ ID NO: 233065 - DNA, 25 bp, Rattus norvegicus
caggctcactcctacattcagatga

SEQ ID NO: 233066 - DNA, 25 bp, Rattus norvegicus
caggctcagaatcatgggtctcccc

SEQ ID NO: 233067 - DNA, 25 bp, Rattus norvegicus
caggctcagaatgatgggtctcccc

SEQ ID NO: 233068 - DNA, 25 bp, Rattus norvegicus
caggctcagagaacgaacttgcttt

SEQ ID NO: 233069 - DNA, 25 bp, Rattus norvegicus
caggctcagagatcgaacttgcttt

SEQ ID NO: 233070 - DNA, 25 bp, Rattus norvegicus
caggctcagcaacacgggaaaggtg

SEQ ID NO: 233071 - DNA, 25 bp, Rattus norvegicus
caggctcagcaagacgggaaaggtg

SEQ ID NO: 233072 - DNA, 25 bp, Rattus norvegicus
caggctcatcctctaaatgtgcttg

SEQ ID NO: 233073 - DNA, 25 bp, Rattus norvegicus
caggctcatcctgtaaatgtgcttg

SEQ ID NO: 233074 - DNA, 25 bp, Rattus norvegicus
caggctccaggaccttgtggacaaa

SEQ ID NO: 233075 - DNA, 25 bp, Rattus norvegicus
caggctccaggagcttgtggacaaa

SEQ ID NO: 233076 - DNA, 25 bp, Rattus norvegicus
caggctccagggaaaagacctcaat

SEQ ID NO: 233077 - DNA, 25 bp, Rattus norvegicus
caggctccagggtaaagacctcaat

SEQ ID NO: 233078 - DNA, 25 bp, Rattus norvegicus
caggctccccttaagatgtgtatat

SEQ ID NO: 233079 - DNA, 25 bp, Rattus norvegicus
caggctcccctttagatgtgtatat

SEQ ID NO: 233080 - DNA, 25 bp, Rattus norvegicus
caggctccgagtctacacagaggta

SEQ ID NO: 233081 - DNA, 25 bp, Rattus norvegicus
caggctccgagtgtacacagaggta

SEQ ID NO: 233082 - DNA, 25 bp, Rattus norvegicus
caggctccgcgcagagacatttttc

SEQ ID NO: 233083 - DNA, 25 bp, Rattus norvegicus
caggctccgcgctgagacatttttc

SEQ ID NO: 233084 - DNA, 25 bp, Rattus norvegicus
caggctcctgcactagatgttaggt

SEQ ID NO: 233085 - DNA, 25 bp, Rattus norvegicus
caggctcctgcagtagatgttaggt

SEQ ID NO: 233086 - DNA, 25 bp, Rattus norvegicus
caggctcctggacacgcagaacttg

SEQ ID NO: 233087 - DNA, 25 bp, Rattus norvegicus
caggctcctggagacgcagaacttg

SEQ ID NO: 233088 - DNA, 25 bp, Rattus norvegicus
caggctcctgggacaacggtcaagg

SEQ ID NO: 233089 - DNA, 25 bp, Rattus norvegicus
caggctcctgggtcaacggtcaagg

SEQ ID NO: 233090 - DNA, 25 bp, Rattus norvegicus
caggctccttggctcatgaatgaac

SEQ ID NO: 233091 - DNA, 25 bp, Rattus norvegicus
caggctccttgggtcatgaatgaac

SEQ ID NO: 233092 - DNA, 25 bp, Rattus norvegicus
caggctcgccaacctggatgaagat

SEQ ID NO: 233093 - DNA, 25 bp, Rattus norvegicus
caggctcgccaagctggatgaagat

SEQ ID NO: 233094 - DNA, 25 bp, Rattus norvegicus
caggctcgctgtaggcttgcagttt

SEQ ID NO: 233095 - DNA, 25 bp, Rattus norvegicus
caggctcgctgttggcttgcagttt

SEQ ID NO: 233096 - DNA, 25 bp, Rattus norvegicus
caggctcgtgccactgaggaggaca

SEQ ID NO: 233097 - DNA, 25 bp, Rattus norvegicus
caggctcgtgcctctgaggaggaca

SEQ ID NO: 233098 - DNA, 25 bp, Rattus norvegicus
caggctcgttgtacctcttggaaaa

SEQ ID NO: 233099 - DNA, 25 bp, Rattus norvegicus
caggctcgttgttcctcttggaaaa

SEQ ID NO: 233100 - DNA, 25 bp, Rattus norvegicus
caggctctaattccactggcagtga

SEQ ID NO: 233101 - DNA, 25 bp, Rattus norvegicus
caggctctaattgcactggcagtga

SEQ ID NO: 233102 - DNA, 25 bp, Rattus norvegicus
caggctctacggattcaagatccat

SEQ ID NO: 233103 - DNA, 25 bp, Rattus norvegicus
caggctctacggtttcaagatccat

SEQ ID NO: 233104 - DNA, 25 bp, Rattus norvegicus
caggctctcctacacatgtaagcag

SEQ ID NO: 233105 - DNA, 25 bp, Rattus norvegicus
caggctctcctagacatgtaagcag

SEQ ID NO: 233106 - DNA, 25 bp, Rattus norvegicus
caggctctcctgaagggacgtttga

SEQ ID NO: 233107 - DNA, 25 bp, Rattus norvegicus
caggctctcctgtagggacgtttga

SEQ ID NO: 233108 - DNA, 25 bp, Rattus norvegicus
caggctctcttcaggtcatgagttc

SEQ ID NO: 233109 - DNA, 25 bp, Rattus norvegicus
caggctctcttctggtcatgagttc

SEQ ID NO: 233110 - DNA, 25 bp, Rattus norvegicus
caggctctgctgctatagccatcat

SEQ ID NO: 233111 - DNA, 25 bp, Rattus norvegicus
caggctctgctggtatagccatcat

SEQ ID NO: 233112 - DNA, 25 bp, Rattus norvegicus
caggctctggttagagtttggtaga

SEQ ID NO: 233113 - DNA, 25 bp, Rattus norvegicus
caggctctggtttgagtttggtaga

SEQ ID NO: 233114 - DNA, 25 bp, Rattus norvegicus
caggctctgtcccaaggaatgtgtt

SEQ ID NO: 233115 - DNA, 25 bp, Rattus norvegicus
caggctctgtccgaaggaatgtgtt

SEQ ID NO: 233116 - DNA, 25 bp, Rattus norvegicus
caggctctgtggctgccaggaactc

SEQ ID NO: 233117 - DNA, 25 bp, Rattus norvegicus
caggctctgtgggtgccaggaactc

SEQ ID NO: 233118 - DNA, 25 bp, Rattus norvegicus
caggctctttggcattgacttcaaa

SEQ ID NO: 233119 - DNA, 25 bp, Rattus norvegicus
caggctctttgggattgacttcaaa

SEQ ID NO: 233120 - DNA, 25 bp, Rattus norvegicus
caggctgaattcagctgatgctgca

SEQ ID NO: 233121 - DNA, 25 bp, Rattus norvegicus
caggctgaattctgctgatgctgca

SEQ ID NO: 233122 - DNA, 25 bp, Rattus norvegicus
caggctgacagtaacaaggcaccaa

SEQ ID NO: 233123 - DNA, 25 bp, Rattus norvegicus
caggctgacagttacaaggcaccaa

SEQ ID NO: 233124 - DNA, 25 bp, Rattus norvegicus
caggctgaccacactgggaagatag

SEQ ID NO: 233125 - DNA, 25 bp, Rattus norvegicus
caggctgaccactctgggaagatag

SEQ ID NO: 233126 - DNA, 25 bp, Rattus norvegicus
caggctgacctgaaaaactcccatt

SEQ ID NO: 233127 - DNA, 25 bp, Rattus norvegicus
caggctgacctgtaaaactcccatt

SEQ ID NO: 233128 - DNA, 25 bp, Rattus norvegicus
caggctgactaacacaccaggagca

SEQ ID NO: 233129 - DNA, 25 bp, Rattus norvegicus
caggctgactaagacaccaggagca

SEQ ID NO: 233130 - DNA, 25 bp, Rattus norvegicus
caggctgacttgctactcacagaca

SEQ ID NO: 233131 - DNA, 25 bp, Rattus norvegicus
caggctgacttggtactcacagaca

SEQ ID NO: 233132 - DNA, 25 bp, Rattus norvegicus
caggctgagacacttgagttgtgat

SEQ ID NO: 233133 - DNA, 25 bp, Rattus norvegicus
caggctgagacagttgagttgtgat

SEQ ID NO: 233134 - DNA, 25 bp, Rattus norvegicus
caggctgagctgaatagtgggaccc

SEQ ID NO: 233135 - DNA, 25 bp, Rattus norvegicus
caggctgagctgtatagtgggaccc

SEQ ID NO: 233136 - DNA, 25 bp, Rattus norvegicus
caggctgagtagaccctgtcagata

SEQ ID NO: 233137 - DNA, 25 bp, Rattus norvegicus
caggctgagtagtccctgtcagata

SEQ ID NO: 233138 - DNA, 25 bp, Rattus norvegicus
caggctgatcctctgttcttagaag

SEQ ID NO: 233139 - DNA, 25 bp, Rattus norvegicus
caggctgatcctgtgttcttagaag

SEQ ID NO: 233140 - DNA, 25 bp, Rattus norvegicus
caggctgatcgcagacaaccagtgg

SEQ ID NO: 233141 - DNA, 25 bp, Rattus norvegicus
caggctgatcgctgacaaccagtgg

SEQ ID NO: 233142 - DNA, 25 bp, Rattus norvegicus
caggctgatgtaatgctgagggcaa

SEQ ID NO: 233143 - DNA, 25 bp, Rattus norvegicus
caggctgatgtattgctgagggcaa

SEQ ID NO: 233144 - DNA, 25 bp, Rattus norvegicus
caggctgcacagattgaataccgat

SEQ ID NO: 233145 - DNA, 25 bp, Rattus norvegicus
caggctgcacagtttgaataccgat

SEQ ID NO: 233146 - DNA, 25 bp, Rattus norvegicus
caggctgcagaaaatgtggctaccc

SEQ ID NO: 233147 - DNA, 25 bp, Rattus norvegicus
caggctgcagaatatgtggctaccc

SEQ ID NO: 233148 - DNA, 25 bp, Rattus norvegicus
caggctgcagatctagttctcacgt

SEQ ID NO: 233149 - DNA, 25 bp, Rattus norvegicus
caggctgcagatgtagttctcacgt

SEQ ID NO: 233150 - DNA, 25 bp, Rattus norvegicus
caggctgcagttagttacgtaggac

SEQ ID NO: 233151 - DNA, 25 bp, Rattus norvegicus
caggctgcagtttgttacgtaggac

SEQ ID NO: 233152 - DNA, 25 bp, Rattus norvegicus
caggctgcatctactcggtgaggtt

SEQ ID NO: 233153 - DNA, 25 bp, Rattus norvegicus
caggctgcatcttctcggtgaggtt

SEQ ID NO: 233154 - DNA, 25 bp, Rattus norvegicus
caggctgcccagctgtaccaggaga

SEQ ID NO: 233155 - DNA, 25 bp, Rattus norvegicus
caggctgcccaggtgtaccaggaga

SEQ ID NO: 233156 - DNA, 25 bp, Rattus norvegicus
caggctgcctcaaggttttggccag

SEQ ID NO: 233157 - DNA, 25 bp, Rattus norvegicus
caggctgcctcatggttttggccag

SEQ ID NO: 233158 - DNA, 25 bp, Rattus norvegicus
caggctgcctgccagaaaaggtgta

SEQ ID NO: 233159 - DNA, 25 bp, Rattus norvegicus
caggctgcctgcgagaaaaggtgta

SEQ ID NO: 233160 - DNA, 25 bp, Rattus norvegicus
caggctgctctgattgttggtgtaa

SEQ ID NO: 233161 - DNA, 25 bp, Rattus norvegicus
caggctgctctgtttgttggtgtaa

SEQ ID NO: 233162 - DNA, 25 bp, Rattus norvegicus
caggctgctgggatctcaggcagaa

SEQ ID NO: 233163 - DNA, 25 bp, Rattus norvegicus
caggctgctgggttctcaggcagaa

SEQ ID NO: 233164 - DNA, 25 bp, Rattus norvegicus
caggctgctgttcctcttggcgtag

SEQ ID NO: 233165 - DNA, 25 bp, Rattus norvegicus
caggctgctgttgctcttggcgtag

SEQ ID NO: 233166 - DNA, 25 bp, Rattus norvegicus
caggctggacctccatacagtgttc

SEQ ID NO: 233167 - DNA, 25 bp, Rattus norvegicus
caggctggacctgcatacagtgttc

SEQ ID NO: 233168 - DNA, 25 bp, Rattus norvegicus
caggctggagacatggtgcagccaa

SEQ ID NO: 233169 - DNA, 25 bp, Rattus norvegicus
caggctggagacttggtgcagccaa

SEQ ID NO: 233170 - DNA, 25 bp, Rattus norvegicus
caggctggagatcgccctgcctcag

SEQ ID NO: 233171 - DNA, 25 bp, Rattus norvegicus
caggctggagatggccctgcctcag

SEQ ID NO: 233172 - DNA, 25 bp, Rattus norvegicus
caggctggagcacaggtaccactca

SEQ ID NO: 233173 - DNA, 25 bp, Rattus norvegicus
caggctggagcagaggtaccactca

SEQ ID NO: 233174 - DNA, 25 bp, Rattus norvegicus
caggctggcagaaaactgagtttca

SEQ ID NO: 233175 - DNA, 25 bp, Rattus norvegicus
caggctggcagataactgagtttca

SEQ ID NO: 233176 - DNA, 25 bp, Rattus norvegicus
caggctggccagacattcacagaga

SEQ ID NO: 233177 - DNA, 25 bp, Rattus norvegicus
caggctggccagtcattcacagaga

SEQ ID NO: 233178 - DNA, 25 bp, Rattus norvegicus
caggctggccctcgcagaaagtaaa

SEQ ID NO: 233179 - DNA, 25 bp, Rattus norvegicus
caggctggccctggcagaaagtaaa

SEQ ID NO: 233180 - DNA, 25 bp, Rattus norvegicus
caggctgggaagacaactcctctag

SEQ ID NO: 233181 - DNA, 25 bp, Rattus norvegicus
caggctgggaagtcaactcctctag

SEQ ID NO: 233182 - DNA, 25 bp, Rattus norvegicus
caggctgggactaatgcttggctgt

SEQ ID NO: 233183 - DNA, 25 bp, Rattus norvegicus
caggctgggacttatgcttggctgt

SEQ ID NO: 233184 - DNA, 25 bp, Rattus norvegicus
caggctgggtgaattccaggaccct

SEQ ID NO: 233185 - DNA, 25 bp, Rattus norvegicus
caggctgggtgatttccaggaccct

SEQ ID NO: 233186 - DNA, 25 bp, Rattus norvegicus
caggctggtcctcttaccaaagaat

SEQ ID NO: 233187 - DNA, 25 bp, Rattus norvegicus
caggctggtcctgttaccaaagaat

SEQ ID NO: 233188 - DNA, 25 bp, Rattus norvegicus
caggctggtctgcactatatactga

SEQ ID NO: 233189 - DNA, 25 bp, Rattus norvegicus
caggctggtctggactatatactga

SEQ ID NO: 233190 - DNA, 25 bp, Rattus norvegicus
caggctgtcacacttctggcaaaca

SEQ ID NO: 233191 - DNA, 25 bp, Rattus norvegicus
caggctgtcacagttctggcaaaca

SEQ ID NO: 233192 - DNA, 25 bp, Rattus norvegicus
caggctgtccccataatgctgtgtg

SEQ ID NO: 233193 - DNA, 25 bp, Rattus norvegicus
caggctgtccccttaatgctgtgtg

SEQ ID NO: 233194 - DNA, 25 bp, Rattus norvegicus
caggctgtccggagactgacaagca

SEQ ID NO: 233195 - DNA, 25 bp, Rattus norvegicus
caggctgtccggtgactgacaagca

SEQ ID NO: 233196 - DNA, 25 bp, Rattus norvegicus
caggctgtcctgcaaatcgctcagt

SEQ ID NO: 233197 - DNA, 25 bp, Rattus norvegicus
caggctgtcctggaaatcgctcagt

SEQ ID NO: 233198 - DNA, 25 bp, Rattus norvegicus
caggctgtgacccatcgggagccat

SEQ ID NO: 233199 - DNA, 25 bp, Rattus norvegicus
caggctgtgaccgatcgggagccat

SEQ ID NO: 233200 - DNA, 25 bp, Rattus norvegicus
caggctgtgagcaatatcttgagtt

SEQ ID NO: 233201 - DNA, 25 bp, Rattus norvegicus
caggctgtgagctatatcttgagtt

SEQ ID NO: 233202 - DNA, 25 bp, Rattus norvegicus
caggctgtggatccagttcaacatt

SEQ ID NO: 233203 - DNA, 25 bp, Rattus norvegicus
caggctgtggatgcagttcaacatt

SEQ ID NO: 233204 - DNA, 25 bp, Rattus norvegicus
caggctgtggtcaagcttggtcatc

SEQ ID NO: 233205 - DNA, 25 bp, Rattus norvegicus
caggctgtggtcattgtttttgatt

SEQ ID NO: 233206 - DNA, 25 bp, Rattus norvegicus
caggctgtggtctagcttggtcatc

SEQ ID NO: 233207 - DNA, 25 bp, Rattus norvegicus
caggctgtggtctttgtttttgatt

SEQ ID NO: 233208 - DNA, 25 bp, Rattus norvegicus
caggctgtgtccctcaagatacaaa

SEQ ID NO: 233209 - DNA, 25 bp, Rattus norvegicus
caggctgtgtccgtcaagatacaaa

SEQ ID NO: 233210 - DNA, 25 bp, Rattus norvegicus
caggctgtgtttcaagggttccctt

SEQ ID NO: 233211 - DNA, 25 bp, Rattus norvegicus
caggctgtgtttgaagggttccctt

SEQ ID NO: 233212 - DNA, 25 bp, Rattus norvegicus
caggctgttaatatccttgacaata

SEQ ID NO: 233213 - DNA, 25 bp, Rattus norvegicus
caggctgttaatttccttgacaata

SEQ ID NO: 233214 - DNA, 25 bp, Rattus norvegicus
caggctgttctgaccttttagttta

SEQ ID NO: 233215 - DNA, 25 bp, Rattus norvegicus
caggctgttctgtccttttagttta

SEQ ID NO: 233216 - DNA, 25 bp, Rattus norvegicus
caggctgtttctcaggcgttcttcc

SEQ ID NO: 233217 - DNA, 25 bp, Rattus norvegicus
caggctgtttctgaggcgttcttcc

SEQ ID NO: 233218 - DNA, 25 bp, Rattus norvegicus
caggcttacgccaaaatttccactt

SEQ ID NO: 233219 - DNA, 25 bp, Rattus norvegicus
caggcttacgcctaaatttccactt

SEQ ID NO: 233220 - DNA, 25 bp, Rattus norvegicus
caggcttagctcctctgaagggaaa

SEQ ID NO: 233221 - DNA, 25 bp, Rattus norvegicus
caggcttagctcgtctgaagggaaa

SEQ ID NO: 233222 - DNA, 25 bp, Rattus norvegicus
caggcttatcctcagcaaagaaact

SEQ ID NO: 233223 - DNA, 25 bp, Rattus norvegicus
caggcttatcctctacttgttaact

SEQ ID NO: 233224 - DNA, 25 bp, Rattus norvegicus
caggcttatcctgagcaaagaaact

SEQ ID NO: 233225 - DNA, 25 bp, Rattus norvegicus
caggcttatcctgtacttgttaact

SEQ ID NO: 233226 - DNA, 25 bp, Rattus norvegicus
caggcttcacaacgctcagcggaca

SEQ ID NO: 233227 - DNA, 25 bp, Rattus norvegicus
caggcttcacaaggctcagcggaca

SEQ ID NO: 233228 - DNA, 25 bp, Rattus norvegicus
caggcttcagtgagcattttgttta

SEQ ID NO: 233229 - DNA, 25 bp, Rattus norvegicus
caggcttcagtgtgcattttgttta

SEQ ID NO: 233230 - DNA, 25 bp, Rattus norvegicus
caggcttccagcactgagtctcaac

SEQ ID NO: 233231 - DNA, 25 bp, Rattus norvegicus
caggcttccagctctgagtctcaac

SEQ ID NO: 233232 - DNA, 25 bp, Rattus norvegicus
caggcttccagtatgcttgggagta

SEQ ID NO: 233233 - DNA, 25 bp, Rattus norvegicus
caggcttccagtttgcttgggagta

SEQ ID NO: 233234 - DNA, 25 bp, Rattus norvegicus
caggcttccccacagtgatttaaat

SEQ ID NO: 233235 - DNA, 25 bp, Rattus norvegicus
caggcttccccagagtgatttaaat

SEQ ID NO: 233236 - DNA, 25 bp, Rattus norvegicus
caggcttcccttattatttcttgag

SEQ ID NO: 233237 - DNA, 25 bp, Rattus norvegicus
caggcttccctttttatttcttgag

SEQ ID NO: 233238 - DNA, 25 bp, Rattus norvegicus
caggcttccggtcggcagacaagtt

SEQ ID NO: 233239 - DNA, 25 bp, Rattus norvegicus
caggcttccggtgggcagacaagtt

SEQ ID NO: 233240 - DNA, 25 bp, Rattus norvegicus
caggcttcctctcgttaacaaagat

SEQ ID NO: 233241 - DNA, 25 bp, Rattus norvegicus
caggcttcctctggttaacaaagat

SEQ ID NO: 233242 - DNA, 25 bp, Rattus norvegicus
caggcttcctgaatgttaaccacgg

SEQ ID NO: 233243 - DNA, 25 bp, Rattus norvegicus
caggcttcctgattgttaaccacgg

SEQ ID NO: 233244 - DNA, 25 bp, Rattus norvegicus
caggcttccttcatggtattcgttc

SEQ ID NO: 233245 - DNA, 25 bp, Rattus norvegicus
caggcttccttcttggtattcgttc

SEQ ID NO: 233246 - DNA, 25 bp, Rattus norvegicus
caggcttcgcttaggtgcttcagct

SEQ ID NO: 233247 - DNA, 25 bp, Rattus norvegicus
caggcttcgctttggtgcttcagct

SEQ ID NO: 233248 - DNA, 25 bp, Rattus norvegicus
caggcttcgtctctgaaagtgtgga

SEQ ID NO: 233249 - DNA, 25 bp, Rattus norvegicus
caggcttcgtctgtgaaagtgtgga

SEQ ID NO: 233250 - DNA, 25 bp, Rattus norvegicus
caggcttctgtacagtggccctaaa

SEQ ID NO: 233251 - DNA, 25 bp, Rattus norvegicus
caggcttctgtagagtggccctaaa

SEQ ID NO: 233252 - DNA, 25 bp, Rattus norvegicus
caggcttcttctcacattggtaatt

SEQ ID NO: 233253 - DNA, 25 bp, Rattus norvegicus
caggcttcttctgacattggtaatt

SEQ ID NO: 233254 - DNA, 25 bp, Rattus norvegicus
caggcttgacgcaggaatccttcag

SEQ ID NO: 233255 - DNA, 25 bp, Rattus norvegicus
caggcttgacgctggaatccttcag

SEQ ID NO: 233256 - DNA, 25 bp, Rattus norvegicus
caggcttgagttactttattagctc

SEQ ID NO: 233257 - DNA, 25 bp, Rattus norvegicus
caggcttgagtttctttattagctc

SEQ ID NO: 233258 - DNA, 25 bp, Rattus norvegicus
caggcttgcaataggtttgggtatt

SEQ ID NO: 233259 - DNA, 25 bp, Rattus norvegicus
caggcttgcaattggtttgggtatt

SEQ ID NO: 233260 - DNA, 25 bp, Rattus norvegicus
caggcttgcattccttagccaagaa

SEQ ID NO: 233261 - DNA, 25 bp, Rattus norvegicus
caggcttgcattgcttagccaagaa

SEQ ID NO: 233262 - DNA, 25 bp, Rattus norvegicus
caggcttgcttcctcatggttcgag

SEQ ID NO: 233263 - DNA, 25 bp, Rattus norvegicus
caggcttgcttcgtcatggttcgag

SEQ ID NO: 233264 - DNA, 25 bp, Rattus norvegicus
caggcttgggataatgaaaatgttg

SEQ ID NO: 233265 - DNA, 25 bp, Rattus norvegicus
caggcttgggattatgaaaatgttg

SEQ ID NO: 233266 - DNA, 25 bp, Rattus norvegicus
caggcttgtgtcagatgggagatca

SEQ ID NO: 233267 - DNA, 25 bp, Rattus norvegicus
caggcttgtgtctgatgggagatca

SEQ ID NO: 233268 - DNA, 25 bp, Rattus norvegicus
caggctttccttactcaggatggta

SEQ ID NO: 233269 - DNA, 25 bp, Rattus norvegicus
caggctttcctttctcaggatggta

SEQ ID NO: 233270 - DNA, 25 bp, Rattus norvegicus
caggctttctctctgctaagtgtat

SEQ ID NO: 233271 - DNA, 25 bp, Rattus norvegicus
caggctttctctgtgctaagtgtat

SEQ ID NO: 233272 - DNA, 25 bp, Rattus norvegicus
caggctttgacacccaaattctggg

SEQ ID NO: 233273 - DNA, 25 bp, Rattus norvegicus
caggctttgacagccaaattctggg

SEQ ID NO: 233274 - DNA, 25 bp, Rattus norvegicus
caggctttgctaagtaattggtact

SEQ ID NO: 233275 - DNA, 25 bp, Rattus norvegicus
caggctttgctatgtaattggtact

SEQ ID NO: 233276 - DNA, 25 bp, Rattus norvegicus
caggctttgtaactcttgcttaaat

SEQ ID NO: 233277 - DNA, 25 bp, Rattus norvegicus
caggctttgtaagtcttgcttaaat

SEQ ID NO: 233278 - DNA, 25 bp, Rattus norvegicus
caggcttttaatatcttagcgctaa

SEQ ID NO: 233279 - DNA, 25 bp, Rattus norvegicus
caggcttttaatttcttagcgctaa

SEQ ID NO: 233280 - DNA, 25 bp, Rattus norvegicus
caggcttttacccacatgttgctgg

SEQ ID NO: 233281 - DNA, 25 bp, Rattus norvegicus
caggcttttaccgacatgttgctgg

SEQ ID NO: 233282 - DNA, 25 bp, Rattus norvegicus
caggcttttcctcgtgtctctgctg

SEQ ID NO: 233283 - DNA, 25 bp, Rattus norvegicus
caggcttttcctggtgtctctgctg

SEQ ID NO: 233284 - DNA, 25 bp, Rattus norvegicus
caggcttttgagatcctctgtgtca

SEQ ID NO: 233285 - DNA, 25 bp, Rattus norvegicus
caggcttttgagttcctctgtgtca

SEQ ID NO: 233286 - DNA, 25 bp, Rattus norvegicus
caggcttttgctatgattccagctt

SEQ ID NO: 233287 - DNA, 25 bp, Rattus norvegicus
caggcttttgctttgattccagctt

SEQ ID NO: 233288 - DNA, 25 bp, Rattus norvegicus
cagggaaacccgaactttgatgaag

SEQ ID NO: 233289 - DNA, 25 bp, Rattus norvegicus
cagggaaacccgtactttgatgaag

SEQ ID NO: 233290 - DNA, 25 bp, Rattus norvegicus
cagggaaatccaccaggctctagtt

SEQ ID NO: 233291 - DNA, 25 bp, Rattus norvegicus
cagggaaatccagcaggctctagtt

SEQ ID NO: 233292 - DNA, 25 bp, Rattus norvegicus
cagggaacccctctaggaatgtgga

SEQ ID NO: 233293 - DNA, 25 bp, Rattus norvegicus
cagggaacccctgtaggaatgtgga

SEQ ID NO: 233294 - DNA, 25 bp, Rattus norvegicus
cagggaacccttaagatttgttgca

SEQ ID NO: 233295 - DNA, 25 bp, Rattus norvegicus
cagggaaccctttagatttgttgca

SEQ ID NO: 233296 - DNA, 25 bp, Rattus norvegicus
cagggaactagtcctccgaattcta

SEQ ID NO: 233297 - DNA, 25 bp, Rattus norvegicus
cagggaactagtgctccgaattcta

SEQ ID NO: 233298 - DNA, 25 bp, Rattus norvegicus
cagggaactgatctgttgttgccat

SEQ ID NO: 233299 - DNA, 25 bp, Rattus norvegicus
cagggaactgatgtgttgttgccat

SEQ ID NO: 233300 - DNA, 25 bp, Rattus norvegicus
cagggaactggcagttttgcccttt

SEQ ID NO: 233301 - DNA, 25 bp, Rattus norvegicus
cagggaactggctgttttgcccttt

SEQ ID NO: 233302 - DNA, 25 bp, Rattus norvegicus
cagggaacttttactaccacaggag

SEQ ID NO: 233303 - DNA, 25 bp, Rattus norvegicus
cagggaactttttctaccacaggag

SEQ ID NO: 233304 - DNA, 25 bp, Rattus norvegicus
cagggaagccatagccaggaaacaa

SEQ ID NO: 233305 - DNA, 25 bp, Rattus norvegicus
cagggaagccattgccaggaaacaa

SEQ ID NO: 233306 - DNA, 25 bp, Rattus norvegicus
cagggaagcgatctcgaagtccgat

SEQ ID NO: 233307 - DNA, 25 bp, Rattus norvegicus
cagggaagcgatgtcgaagtccgat

SEQ ID NO: 233308 - DNA, 25 bp, Rattus norvegicus
cagggaagctctcttgggataccac

SEQ ID NO: 233309 - DNA, 25 bp, Rattus norvegicus
cagggaagctctgttgggataccac

SEQ ID NO: 233310 - DNA, 25 bp, Rattus norvegicus
cagggaataaatccattcagccttt

SEQ ID NO: 233311 - DNA, 25 bp, Rattus norvegicus
cagggaataaatgcattcagccttt

SEQ ID NO: 233312 - DNA, 25 bp, Rattus norvegicus
cagggaatctgacacctacttctgc

SEQ ID NO: 233313 - DNA, 25 bp, Rattus norvegicus
cagggaatctgagacctacttctgc

SEQ ID NO: 233314 - DNA, 25 bp, Rattus norvegicus
cagggaatgacccatgtgactcttt

SEQ ID NO: 233315 - DNA, 25 bp, Rattus norvegicus
cagggaatgaccgatgtgactcttt

SEQ ID NO: 233316 - DNA, 25 bp, Rattus norvegicus
cagggaatgagtattctgggccagt

SEQ ID NO: 233317 - DNA, 25 bp, Rattus norvegicus
cagggaatgagtccagagccccata

SEQ ID NO: 233318 - DNA, 25 bp, Rattus norvegicus
cagggaatgagtgcagagccccata

SEQ ID NO: 233319 - DNA, 25 bp, Rattus norvegicus
cagggaatgagttttctgggccagt

SEQ ID NO: 233320 - DNA, 25 bp, Rattus norvegicus
cagggaatttcccagccgtttgagt

SEQ ID NO: 233321 - DNA, 25 bp, Rattus norvegicus
cagggaatttccgagccgtttgagt

SEQ ID NO: 233322 - DNA, 25 bp, Rattus norvegicus
cagggacaatcaatctctaggcgtt

SEQ ID NO: 233323 - DNA, 25 bp, Rattus norvegicus
cagggacaatcattctctaggcgtt

SEQ ID NO: 233324 - DNA, 25 bp, Rattus norvegicus
cagggacacagacggacaccccgga

SEQ ID NO: 233325 - DNA, 25 bp, Rattus norvegicus
cagggacacagagggacaccccgga

SEQ ID NO: 233326 - DNA, 25 bp, Rattus norvegicus
cagggacacccacacagcaagtggt

SEQ ID NO: 233327 - DNA, 25 bp, Rattus norvegicus
cagggacacccagacagcaagtggt

SEQ ID NO: 233328 - DNA, 25 bp, Rattus norvegicus
cagggacagcatccattcggactct

SEQ ID NO: 233329 - DNA, 25 bp, Rattus norvegicus
cagggacagcatgcattcggactct

SEQ ID NO: 233330 - DNA, 25 bp, Rattus norvegicus
cagggacatgagatccattccaggg

SEQ ID NO: 233331 - DNA, 25 bp, Rattus norvegicus
cagggacatgagttccattccaggg

SEQ ID NO: 233332 - DNA, 25 bp, Rattus norvegicus
cagggaccagaaagccttatgggaa

SEQ ID NO: 233333 - DNA, 25 bp, Rattus norvegicus
cagggaccagaatgccttatgggaa

SEQ ID NO: 233334 - DNA, 25 bp, Rattus norvegicus
cagggacccaagagtctctgcctac

SEQ ID NO: 233335 - DNA, 25 bp, Rattus norvegicus
cagggacccaagtgtctctgcctac

SEQ ID NO: 233336 - DNA, 25 bp, Rattus norvegicus
cagggacccaggagttaggaactat

SEQ ID NO: 233337 - DNA, 25 bp, Rattus norvegicus
cagggacccaggtgttaggaactat

SEQ ID NO: 233338 - DNA, 25 bp, Rattus norvegicus
cagggacccgagcagagcttctaca

SEQ ID NO: 233339 - DNA, 25 bp, Rattus norvegicus
cagggacccgaggagagcttctaca

SEQ ID NO: 233340 - DNA, 25 bp, Rattus norvegicus
cagggacccgtgagctaacagagct

SEQ ID NO: 233341 - DNA, 25 bp, Rattus norvegicus
cagggacccgtgtgctaacagagct

SEQ ID NO: 233342 - DNA, 25 bp, Rattus norvegicus
cagggacctcgcaaagctttgtggt

SEQ ID NO: 233343 - DNA, 25 bp, Rattus norvegicus
cagggacctcgctaagctttgtggt

SEQ ID NO: 233344 - DNA, 25 bp, Rattus norvegicus
cagggacctctgcaaatagctcgca

SEQ ID NO: 233345 - DNA, 25 bp, Rattus norvegicus
cagggacctctggaaatagctcgca

SEQ ID NO: 233346 - DNA, 25 bp, Rattus norvegicus
cagggacctgagaaagcacatggca

SEQ ID NO: 233347 - DNA, 25 bp, Rattus norvegicus
cagggacctgagctacatgcaggtt

SEQ ID NO: 233348 - DNA, 25 bp, Rattus norvegicus
cagggacctgaggtacatgcaggtt

SEQ ID NO: 233349 - DNA, 25 bp, Rattus norvegicus
cagggacctgagtaagcacatggca

SEQ ID NO: 233350 - DNA, 25 bp, Rattus norvegicus
cagggaccttgcactggaggacaaa

SEQ ID NO: 233351 - DNA, 25 bp, Rattus norvegicus
cagggaccttgctctggaggacaaa

SEQ ID NO: 233352 - DNA, 25 bp, Rattus norvegicus
cagggacgagaccatgtggcccaaa

SEQ ID NO: 233353 - DNA, 25 bp, Rattus norvegicus
cagggacgagacgatgtggcccaaa

SEQ ID NO: 233354 - DNA, 25 bp, Rattus norvegicus
cagggacgccagcaactcaaagcaa

SEQ ID NO: 233355 - DNA, 25 bp, Rattus norvegicus
cagggacgccaggaactcaaagcaa

SEQ ID NO: 233356 - DNA, 25 bp, Rattus norvegicus
cagggactctaaaatctcagggaca

SEQ ID NO: 233357 - DNA, 25 bp, Rattus norvegicus
cagggactctaatatctcagggaca

SEQ ID NO: 233358 - DNA, 25 bp, Rattus norvegicus
cagggactgactcctgatagttctt

SEQ ID NO: 233359 - DNA, 25 bp, Rattus norvegicus
cagggactgactgctgatagttctt

SEQ ID NO: 233360 - DNA, 25 bp, Rattus norvegicus
cagggactggtaagggccctacaga

SEQ ID NO: 233361 - DNA, 25 bp, Rattus norvegicus
cagggactggtatgggccctacaga

SEQ ID NO: 233362 - DNA, 25 bp, Rattus norvegicus
cagggactgtccctattactttatt

SEQ ID NO: 233363 - DNA, 25 bp, Rattus norvegicus
cagggactgtccgtattactttatt

SEQ ID NO: 233364 - DNA, 25 bp, Rattus norvegicus
cagggacttaggattatctcgttat

SEQ ID NO: 233365 - DNA, 25 bp, Rattus norvegicus
cagggacttaggtttatctcgttat

SEQ ID NO: 233366 - DNA, 25 bp, Rattus norvegicus
cagggactttccactcagattacat

SEQ ID NO: 233367 - DNA, 25 bp, Rattus norvegicus
cagggactttcctctcagattacat

SEQ ID NO: 233368 - DNA, 25 bp, Rattus norvegicus
cagggagaacccaggaaagagaaat

SEQ ID NO: 233369 - DNA, 25 bp, Rattus norvegicus
cagggagaaccctggaaagagaaat

SEQ ID NO: 233370 - DNA, 25 bp, Rattus norvegicus
cagggagacctgagctcgaccaagt

SEQ ID NO: 233371 - DNA, 25 bp, Rattus norvegicus
cagggagacctgtgctcgaccaagt

SEQ ID NO: 233372 - DNA, 25 bp, Rattus norvegicus
cagggagagacacgtcaggccccac

SEQ ID NO: 233373 - DNA, 25 bp, Rattus norvegicus
cagggagagacaggtcaggccccac

SEQ ID NO: 233374 - DNA, 25 bp, Rattus norvegicus
cagggagagcgcacactgtgtgcac

SEQ ID NO: 233375 - DNA, 25 bp, Rattus norvegicus
cagggagagcgctcactgtgtgcac

SEQ ID NO: 233376 - DNA, 25 bp, Rattus norvegicus
cagggagagtcaccctgcagtccac

SEQ ID NO: 233377 - DNA, 25 bp, Rattus norvegicus
cagggagagtcagcctgcagtccac

SEQ ID NO: 233378 - DNA, 25 bp, Rattus norvegicus
cagggagatcaacccggatgccaaa

SEQ ID NO: 233379 - DNA, 25 bp, Rattus norvegicus
cagggagatcaagccggatgccaaa

SEQ ID NO: 233380 - DNA, 25 bp, Rattus norvegicus
cagggagatcatcaagcctagacta

SEQ ID NO: 233381 - DNA, 25 bp, Rattus norvegicus
cagggagatcatgaagcctagacta

SEQ ID NO: 233382 - DNA, 25 bp, Rattus norvegicus
cagggagcaatgacttgactggtaa

SEQ ID NO: 233383 - DNA, 25 bp, Rattus norvegicus
cagggagcaatgtcttgactggtaa

SEQ ID NO: 233384 - DNA, 25 bp, Rattus norvegicus
cagggagcagaacttgacacttaat

SEQ ID NO: 233385 - DNA, 25 bp, Rattus norvegicus
cagggagcagaagttgacacttaat

SEQ ID NO: 233386 - DNA, 25 bp, Rattus norvegicus
cagggagcagagacagtgttagaac

SEQ ID NO: 233387 - DNA, 25 bp, Rattus norvegicus
cagggagcagagtcagtgttagaac

SEQ ID NO: 233388 - DNA, 25 bp, Rattus norvegicus
cagggagcaggaccaccgtgccaca

SEQ ID NO: 233389 - DNA, 25 bp, Rattus norvegicus
cagggagcaggagcaccgtgccaca

SEQ ID NO: 233390 - DNA, 25 bp, Rattus norvegicus
cagggagccctgctgattattgagc

SEQ ID NO: 233391 - DNA, 25 bp, Rattus norvegicus
cagggagccctggtgattattgagc

SEQ ID NO: 233392 - DNA, 25 bp, Rattus norvegicus
cagggagcctctaccatcagcggga

SEQ ID NO: 233393 - DNA, 25 bp, Rattus norvegicus
cagggagcctcttccatcagcggga

SEQ ID NO: 233394 - DNA, 25 bp, Rattus norvegicus
cagggagccttgaagctgttgctga

SEQ ID NO: 233395 - DNA, 25 bp, Rattus norvegicus
cagggagccttgagcccaaagtcct

SEQ ID NO: 233396 - DNA, 25 bp, Rattus norvegicus
cagggagccttgtagctgttgctga

SEQ ID NO: 233397 - DNA, 25 bp, Rattus norvegicus
cagggagccttgtgcccaaagtcct

SEQ ID NO: 233398 - DNA, 25 bp, Rattus norvegicus
cagggagctacgaccccagggctgt

SEQ ID NO: 233399 - DNA, 25 bp, Rattus norvegicus
cagggagctacgtccccagggctgt

SEQ ID NO: 233400 - DNA, 25 bp, Rattus norvegicus
cagggagctgtgaattcctttccac

SEQ ID NO: 233401 - DNA, 25 bp, Rattus norvegicus
cagggagctgtgtattcctttccac

SEQ ID NO: 233402 - DNA, 25 bp, Rattus norvegicus
cagggagctgttagtctagtgacca

SEQ ID NO: 233403 - DNA, 25 bp, Rattus norvegicus
cagggagctgtttgtctagtgacca

SEQ ID NO: 233404 - DNA, 25 bp, Rattus norvegicus
cagggaggacggctacctttaccag

SEQ ID NO: 233405 - DNA, 25 bp, Rattus norvegicus
cagggaggacgggtacctttaccag

SEQ ID NO: 233406 - DNA, 25 bp, Rattus norvegicus
cagggaggcagtaggtgttcacaat

SEQ ID NO: 233407 - DNA, 25 bp, Rattus norvegicus
cagggaggcagttggtgttcacaat

SEQ ID NO: 233408 - DNA, 25 bp, Rattus norvegicus
cagggaggcttcaggtagtgctctt

SEQ ID NO: 233409 - DNA, 25 bp, Rattus norvegicus
cagggaggcttctggtagtgctctt

SEQ ID NO: 233410 - DNA, 25 bp, Rattus norvegicus
cagggagtatggacttctcagttac

SEQ ID NO: 233411 - DNA, 25 bp, Rattus norvegicus
cagggagtatggtcttctcagttac

SEQ ID NO: 233412 - DNA, 25 bp, Rattus norvegicus
cagggagtccacactgtcagcaggg

SEQ ID NO: 233413 - DNA, 25 bp, Rattus norvegicus
cagggagtccactctgtcagcaggg

SEQ ID NO: 233414 - DNA, 25 bp, Rattus norvegicus
cagggagtcttgcttatgcacagtt

SEQ ID NO: 233415 - DNA, 25 bp, Rattus norvegicus
cagggagtcttggttatgcacagtt

SEQ ID NO: 233416 - DNA, 25 bp, Rattus norvegicus
cagggagtgactctgctcattctcc

SEQ ID NO: 233417 - DNA, 25 bp, Rattus norvegicus
cagggagtgactgtgctcattctcc

SEQ ID NO: 233418 - DNA, 25 bp, Rattus norvegicus
cagggagtgctaagccagtttcaat

SEQ ID NO: 233419 - DNA, 25 bp, Rattus norvegicus
cagggagtgctatgccagtttcaat

SEQ ID NO: 233420 - DNA, 25 bp, Rattus norvegicus
cagggagtgttgattctttggcttt

SEQ ID NO: 233421 - DNA, 25 bp, Rattus norvegicus
cagggagtgttgtttctttggcttt

SEQ ID NO: 233422 - DNA, 25 bp, Rattus norvegicus
cagggagtgtttctgcagatgaact

SEQ ID NO: 233423 - DNA, 25 bp, Rattus norvegicus
cagggagtgtttgtgcagatgaact

SEQ ID NO: 233424 - DNA, 25 bp, Rattus norvegicus
cagggatacctcagatacatcatta

SEQ ID NO: 233425 - DNA, 25 bp, Rattus norvegicus
cagggatacctctgatacatcatta

SEQ ID NO: 233426 - DNA, 25 bp, Rattus norvegicus
cagggatcgtgacgacattgtcatt

SEQ ID NO: 233427 - DNA, 25 bp, Rattus norvegicus
cagggatcgtgaggacattgtcatt

SEQ ID NO: 233428 - DNA, 25 bp, Rattus norvegicus
cagggatgacatctccaagaaatgg

SEQ ID NO: 233429 - DNA, 25 bp, Rattus norvegicus
cagggatgacatgtccaagaaatgg

SEQ ID NO: 233430 - DNA, 25 bp, Rattus norvegicus
cagggatgactgagccatttgttga

SEQ ID NO: 233431 - DNA, 25 bp, Rattus norvegicus
cagggatgactgtgccatttgttga

SEQ ID NO: 233432 - DNA, 25 bp, Rattus norvegicus
cagggatgattacggagccgcccca

SEQ ID NO: 233433 - DNA, 25 bp, Rattus norvegicus
cagggatgattagggagccgcccca

SEQ ID NO: 233434 - DNA, 25 bp, Rattus norvegicus
cagggatgcggtacacgctttagtt

SEQ ID NO: 233435 - DNA, 25 bp, Rattus norvegicus
cagggatgcggttcacgctttagtt

SEQ ID NO: 233436 - DNA, 25 bp, Rattus norvegicus
cagggatgctggcagccaaccgtcc

SEQ ID NO: 233437 - DNA, 25 bp, Rattus norvegicus
cagggatgctgggagccaaccgtcc

SEQ ID NO: 233438 - DNA, 25 bp, Rattus norvegicus
cagggatggacactttatgttaagc

SEQ ID NO: 233439 - DNA, 25 bp, Rattus norvegicus
cagggatggacagtttatgttaagc

SEQ ID NO: 233440 - DNA, 25 bp, Rattus norvegicus
cagggatggcctatgcgcactatgc

SEQ ID NO: 233441 - DNA, 25 bp, Rattus norvegicus
cagggatggcctttgcgcactatgc

SEQ ID NO: 233442 - DNA, 25 bp, Rattus norvegicus
cagggattcatacaggcagtttttt

SEQ ID NO: 233443 - DNA, 25 bp, Rattus norvegicus
cagggattcatagaggcagtttttt

SEQ ID NO: 233444 - DNA, 25 bp, Rattus norvegicus
cagggattcatcagtgcttgtaaat

SEQ ID NO: 233445 - DNA, 25 bp, Rattus norvegicus
cagggattcatctgtgcttgtaaat

SEQ ID NO: 233446 - DNA, 25 bp, Rattus norvegicus
cagggattctccattaaattcctaa

SEQ ID NO: 233447 - DNA, 25 bp, Rattus norvegicus
cagggattctcctttaaattcctaa

SEQ ID NO: 233448 - DNA, 25 bp, Rattus norvegicus
cagggattctgaactgctggtagat

SEQ ID NO: 233449 - DNA, 25 bp, Rattus norvegicus
cagggattctgatctgctggtagat

SEQ ID NO: 233450 - DNA, 25 bp, Rattus norvegicus
cagggattcttgaatgcatttttaa

SEQ ID NO: 233451 - DNA, 25 bp, Rattus norvegicus
cagggattcttgtatgcatttttaa

SEQ ID NO: 233452 - DNA, 25 bp, Rattus norvegicus
cagggatttcacagatcatcttgtg

SEQ ID NO: 233453 - DNA, 25 bp, Rattus norvegicus
cagggatttcactgatcatcttgtg

SEQ ID NO: 233454 - DNA, 25 bp, Rattus norvegicus
cagggatttgctacttttgtgccat

SEQ ID NO: 233455 - DNA, 25 bp, Rattus norvegicus
cagggatttgcttcttttgtgccat

SEQ ID NO: 233456 - DNA, 25 bp, Rattus norvegicus
cagggatttgttacttggcctccta

SEQ ID NO: 233457 - DNA, 25 bp, Rattus norvegicus
cagggatttgtttcttggcctccta

SEQ ID NO: 233458 - DNA, 25 bp, Rattus norvegicus
cagggatttttaagcaaagctctta

SEQ ID NO: 233459 - DNA, 25 bp, Rattus norvegicus
cagggatttttatgcaaagctctta

SEQ ID NO: 233460 - DNA, 25 bp, Rattus norvegicus
cagggcaatattattcttgtggcaa

SEQ ID NO: 233461 - DNA, 25 bp, Rattus norvegicus
cagggcaatatttttcttgtggcaa

SEQ ID NO: 233462 - DNA, 25 bp, Rattus norvegicus
cagggcacacggctggcgagaagag

SEQ ID NO: 233463 - DNA, 25 bp, Rattus norvegicus
cagggcacacgggtggcgagaagag

SEQ ID NO: 233464 - DNA, 25 bp, Rattus norvegicus
cagggcacagttctctagggctgca

SEQ ID NO: 233465 - DNA, 25 bp, Rattus norvegicus
cagggcacagttgtctagggctgca

SEQ ID NO: 233466 - DNA, 25 bp, Rattus norvegicus
cagggcaccctgagtgaaaaccaat

SEQ ID NO: 233467 - DNA, 25 bp, Rattus norvegicus
cagggcaccctgtgtgaaaaccaat

SEQ ID NO: 233468 - DNA, 25 bp, Rattus norvegicus
cagggcactcgaaatctttggctaa

SEQ ID NO: 233469 - DNA, 25 bp, Rattus norvegicus
cagggcactcgatatctttggctaa

SEQ ID NO: 233470 - DNA, 25 bp, Rattus norvegicus
cagggcactgcgctctgacagactg

SEQ ID NO: 233471 - DNA, 25 bp, Rattus norvegicus
cagggcactgcggtctgacagactg

SEQ ID NO: 233472 - DNA, 25 bp, Rattus norvegicus
cagggcacttcacggttcgcagaga

SEQ ID NO: 233473 - DNA, 25 bp, Rattus norvegicus
cagggcacttcagggttcgcagaga

SEQ ID NO: 233474 - DNA, 25 bp, Rattus norvegicus
cagggcagagctccattgcggcttt

SEQ ID NO: 233475 - DNA, 25 bp, Rattus norvegicus
cagggcagagctgcattgcggcttt

SEQ ID NO: 233476 - DNA, 25 bp, Rattus norvegicus
cagggcagagggactcccagttaaa

SEQ ID NO: 233477 - DNA, 25 bp, Rattus norvegicus
cagggcagagggtctcccagttaaa

SEQ ID NO: 233478 - DNA, 25 bp, Rattus norvegicus
cagggcagagtcctcattgctgagt

SEQ ID NO: 233479 - DNA, 25 bp, Rattus norvegicus
cagggcagagtcgtcattgctgagt

SEQ ID NO: 233480 - DNA, 25 bp, Rattus norvegicus
cagggcagcaaaacttgtactattt

SEQ ID NO: 233481 - DNA, 25 bp, Rattus norvegicus
cagggcagcaaatcttgtactattt

SEQ ID NO: 233482 - DNA, 25 bp, Rattus norvegicus
cagggcagcaggctcttgattcatt

SEQ ID NO: 233483 - DNA, 25 bp, Rattus norvegicus
cagggcagcagggtcttgattcatt

SEQ ID NO: 233484 - DNA, 25 bp, Rattus norvegicus
cagggcagccatcgcttcataataa

SEQ ID NO: 233485 - DNA, 25 bp, Rattus norvegicus
cagggcagccatggcttcataataa

SEQ ID NO: 233486 - DNA, 25 bp, Rattus norvegicus
cagggcagccccaggatgggcttcc

SEQ ID NO: 233487 - DNA, 25 bp, Rattus norvegicus
cagggcagcccctggatgggcttcc

SEQ ID NO: 233488 - DNA, 25 bp, Rattus norvegicus
cagggcagccttctccaggtagaaa

SEQ ID NO: 233489 - DNA, 25 bp, Rattus norvegicus
cagggcagccttgtccaggtagaaa

SEQ ID NO: 233490 - DNA, 25 bp, Rattus norvegicus
cagggcagctccacccgggaagtca

SEQ ID NO: 233491 - DNA, 25 bp, Rattus norvegicus
cagggcagctcctcccgggaagtca

SEQ ID NO: 233492 - DNA, 25 bp, Rattus norvegicus
cagggcagtgagagggcacacagca

SEQ ID NO: 233493 - DNA, 25 bp, Rattus norvegicus
cagggcagtgagtgggcacacagca

SEQ ID NO: 233494 - DNA, 25 bp, Rattus norvegicus
cagggcataatgatgtccactatct

SEQ ID NO: 233495 - DNA, 25 bp, Rattus norvegicus
cagggcataatgttgtccactatct

SEQ ID NO: 233496 - DNA, 25 bp, Rattus norvegicus
cagggcatcgataactagagtcaca

SEQ ID NO: 233497 - DNA, 25 bp, Rattus norvegicus
cagggcatcgattactagagtcaca

SEQ ID NO: 233498 - DNA, 25 bp, Rattus norvegicus
cagggcatgggaaggatcgttccat

SEQ ID NO: 233499 - DNA, 25 bp, Rattus norvegicus
cagggcatgggatggatcgttccat

SEQ ID NO: 233500 - DNA, 25 bp, Rattus norvegicus
cagggcatggtcactgtcattggaa

SEQ ID NO: 233501 - DNA, 25 bp, Rattus norvegicus
cagggcatggtctctgtcattggaa

SEQ ID NO: 233502 - DNA, 25 bp, Rattus norvegicus
cagggcatgtggatatctcatcctt

SEQ ID NO: 233503 - DNA, 25 bp, Rattus norvegicus
cagggcatgtggttatctcatcctt

SEQ ID NO: 233504 - DNA, 25 bp, Rattus norvegicus
cagggcattctgatgcatcgtgcaa

SEQ ID NO: 233505 - DNA, 25 bp, Rattus norvegicus
cagggcattctgttgcatcgtgcaa

SEQ ID NO: 233506 - DNA, 25 bp, Rattus norvegicus
cagggccaacagacttcacatgaca

SEQ ID NO: 233507 - DNA, 25 bp, Rattus norvegicus
cagggccaacagtcttcacatgaca

SEQ ID NO: 233508 - DNA, 25 bp, Rattus norvegicus
cagggccaacgccattagcattata

SEQ ID NO: 233509 - DNA, 25 bp, Rattus norvegicus
cagggccaacgcgattagcattata

SEQ ID NO: 233510 - DNA, 25 bp, Rattus norvegicus
cagggccaagaccagtttcaggatt

SEQ ID NO: 233511 - DNA, 25 bp, Rattus norvegicus
cagggccaagacgagtttcaggatt

SEQ ID NO: 233512 - DNA, 25 bp, Rattus norvegicus
cagggccacattactctatggaggg

SEQ ID NO: 233513 - DNA, 25 bp, Rattus norvegicus
cagggccacatttctctatggaggg

SEQ ID NO: 233514 - DNA, 25 bp, Rattus norvegicus
cagggccaccagagagctggtaaga

SEQ ID NO: 233515 - DNA, 25 bp, Rattus norvegicus
cagggccaccagtgagctggtaaga

SEQ ID NO: 233516 - DNA, 25 bp, Rattus norvegicus
cagggccactgtcggcaacctgaat

SEQ ID NO: 233517 - DNA, 25 bp, Rattus norvegicus
cagggccactgtgggcaacctgaat

SEQ ID NO: 233518 - DNA, 25 bp, Rattus norvegicus
cagggccaggagatatgttttgatt

SEQ ID NO: 233519 - DNA, 25 bp, Rattus norvegicus
cagggccaggagttatgttttgatt

SEQ ID NO: 233520 - DNA, 25 bp, Rattus norvegicus
cagggccatttacatagagacacat

SEQ ID NO: 233521 - DNA, 25 bp, Rattus norvegicus
cagggccatttagatagagacacat

SEQ ID NO: 233522 - DNA, 25 bp, Rattus norvegicus
cagggccatttgatccctttagaga

SEQ ID NO: 233523 - DNA, 25 bp, Rattus norvegicus
cagggccatttgttccctttagaga

SEQ ID NO: 233524 - DNA, 25 bp, Rattus norvegicus
cagggccattttcatatcgtgttct

SEQ ID NO: 233525 - DNA, 25 bp, Rattus norvegicus
cagggccattttgatatcgtgttct

SEQ ID NO: 233526 - DNA, 25 bp, Rattus norvegicus
cagggcccatccagggaagtgtata

SEQ ID NO: 233527 - DNA, 25 bp, Rattus norvegicus
cagggcccatcctgggaagtgtata

SEQ ID NO: 233528 - DNA, 25 bp, Rattus norvegicus
cagggcccatgaacctttacagagt

SEQ ID NO: 233529 - DNA, 25 bp, Rattus norvegicus
cagggcccatgatcctttacagagt

SEQ ID NO: 233530 - DNA, 25 bp, Rattus norvegicus
cagggcccatgtacagtgctagaga

SEQ ID NO: 233531 - DNA, 25 bp, Rattus norvegicus
cagggcccatgttcagtgctagaga

SEQ ID NO: 233532 - DNA, 25 bp, Rattus norvegicus
cagggcccgcagactgatgagtgtt

SEQ ID NO: 233533 - DNA, 25 bp, Rattus norvegicus
cagggcccgcagtctgatgagtgtt

SEQ ID NO: 233534 - DNA, 25 bp, Rattus norvegicus
cagggccctaccattggaggtgata

SEQ ID NO: 233535 - DNA, 25 bp, Rattus norvegicus
cagggccctacctttggaggtgata

SEQ ID NO: 233536 - DNA, 25 bp, Rattus norvegicus
cagggccctcggaaactgagcgaga

SEQ ID NO: 233537 - DNA, 25 bp, Rattus norvegicus
cagggccctcggtaactgagcgaga

SEQ ID NO: 233538 - DNA, 25 bp, Rattus norvegicus
cagggccctgacagaattcttcaga

SEQ ID NO: 233539 - DNA, 25 bp, Rattus norvegicus
cagggccctgactgaattcttcaga

SEQ ID NO: 233540 - DNA, 25 bp, Rattus norvegicus
cagggccctgagctctctgagcagt

SEQ ID NO: 233541 - DNA, 25 bp, Rattus norvegicus
cagggccctgaggtctctgagcagt

SEQ ID NO: 233542 - DNA, 25 bp, Rattus norvegicus
cagggccctgggcacatttcccaag

SEQ ID NO: 233543 - DNA, 25 bp, Rattus norvegicus
cagggccctggggacatttcccaag

SEQ ID NO: 233544 - DNA, 25 bp, Rattus norvegicus
cagggcctcctgaagttcaaaaaat

SEQ ID NO: 233545 - DNA, 25 bp, Rattus norvegicus
cagggcctcctgtagttcaaaaaat

SEQ ID NO: 233546 - DNA, 25 bp, Rattus norvegicus
cagggcctctgcacaagttggatgt

SEQ ID NO: 233547 - DNA, 25 bp, Rattus norvegicus
cagggcctctgctcaagttggatgt

SEQ ID NO: 233548 - DNA, 25 bp, Rattus norvegicus
cagggcctcttcagatgcctcttcg

SEQ ID NO: 233549 - DNA, 25 bp, Rattus norvegicus
cagggcctcttctgatgcctcttcg

SEQ ID NO: 233550 - DNA, 25 bp, Rattus norvegicus
cagggcctgagtcttttgtatgcac

SEQ ID NO: 233551 - DNA, 25 bp, Rattus norvegicus
cagggcctgagtgttttgtatgcac

SEQ ID NO: 233552 - DNA, 25 bp, Rattus norvegicus
cagggcctgcagacattaaccatga

SEQ ID NO: 233553 - DNA, 25 bp, Rattus norvegicus
cagggcctgcagagttgcctaagga

SEQ ID NO: 233554 - DNA, 25 bp, Rattus norvegicus
cagggcctgcagtcattaaccatga

SEQ ID NO: 233555 - DNA, 25 bp, Rattus norvegicus
cagggcctgcagtgttgcctaagga

SEQ ID NO: 233556 - DNA, 25 bp, Rattus norvegicus
cagggcctgcctacgttcaacagat

SEQ ID NO: 233557 - DNA, 25 bp, Rattus norvegicus
cagggcctgccttcgttcaacagat

SEQ ID NO: 233558 - DNA, 25 bp, Rattus norvegicus
cagggcctggtgagaaatgtcttct

SEQ ID NO: 233559 - DNA, 25 bp, Rattus norvegicus
cagggcctggtgtgaaatgtcttct

SEQ ID NO: 233560 - DNA, 25 bp, Rattus norvegicus
cagggcctgtgaaggcagctacgca

SEQ ID NO: 233561 - DNA, 25 bp, Rattus norvegicus
cagggcctgtgatggcagctacgca

SEQ ID NO: 233562 - DNA, 25 bp, Rattus norvegicus
cagggcctgtgtactggtgttcaga

SEQ ID NO: 233563 - DNA, 25 bp, Rattus norvegicus
cagggcctgtgttctggtgttcaga

SEQ ID NO: 233564 - DNA, 25 bp, Rattus norvegicus
cagggccttcctcgactatgtaaga

SEQ ID NO: 233565 - DNA, 25 bp, Rattus norvegicus
cagggccttcctggactatgtaaga

SEQ ID NO: 233566 - DNA, 25 bp, Rattus norvegicus
cagggccttctaagcaagcctcaag

SEQ ID NO: 233567 - DNA, 25 bp, Rattus norvegicus
cagggccttctatgcaagcctcaag

SEQ ID NO: 233568 - DNA, 25 bp, Rattus norvegicus
cagggccttgccaggtgagttgtca

SEQ ID NO: 233569 - DNA, 25 bp, Rattus norvegicus
cagggccttgcctggtgagttgtca

SEQ ID NO: 233570 - DNA, 25 bp, Rattus norvegicus
cagggcgaagccacagggacctaga

SEQ ID NO: 233571 - DNA, 25 bp, Rattus norvegicus
cagggcgaagcctcagggacctaga

SEQ ID NO: 233572 - DNA, 25 bp, Rattus norvegicus
cagggcgaattacattttttctgtt

SEQ ID NO: 233573 - DNA, 25 bp, Rattus norvegicus
cagggcgaattagattttttctgtt

SEQ ID NO: 233574 - DNA, 25 bp, Rattus norvegicus
cagggcgcgtaactctcactttcct

SEQ ID NO: 233575 - DNA, 25 bp, Rattus norvegicus
cagggcgcgtaagtctcactttcct

SEQ ID NO: 233576 - DNA, 25 bp, Rattus norvegicus
cagggcggtcagctagaaatagtca

SEQ ID NO: 233577 - DNA, 25 bp, Rattus norvegicus
cagggcggtcaggtagaaatagtca

SEQ ID NO: 233578 - DNA, 25 bp, Rattus norvegicus
cagggcgtgctaacaggataccagt

SEQ ID NO: 233579 - DNA, 25 bp, Rattus norvegicus
cagggcgtgctatcaggataccagt

SEQ ID NO: 233580 - DNA, 25 bp, Rattus norvegicus
cagggctaaaggacactcgagtact

SEQ ID NO: 233581 - DNA, 25 bp, Rattus norvegicus
cagggctaaaggtcactcgagtact

SEQ ID NO: 233582 - DNA, 25 bp, Rattus norvegicus
cagggctaagccagggaagaccttc

SEQ ID NO: 233583 - DNA, 25 bp, Rattus norvegicus
cagggctaagcctgggaagaccttc

SEQ ID NO: 233584 - DNA, 25 bp, Rattus norvegicus
cagggctacaggctggacacagatt

SEQ ID NO: 233585 - DNA, 25 bp, Rattus norvegicus
cagggctacagggtggacacagatt

SEQ ID NO: 233586 - DNA, 25 bp, Rattus norvegicus
cagggctacatacaggaaacctcat

SEQ ID NO: 233587 - DNA, 25 bp, Rattus norvegicus
cagggctacatagaggaaacctcat

SEQ ID NO: 233588 - DNA, 25 bp, Rattus norvegicus
cagggctacctgaattttgctaaaa

SEQ ID NO: 233589 - DNA, 25 bp, Rattus norvegicus
cagggctacctgactttttaatttg

SEQ ID NO: 233590 - DNA, 25 bp, Rattus norvegicus
cagggctacctgtattttgctaaaa

SEQ ID NO: 233591 - DNA, 25 bp, Rattus norvegicus
cagggctacctgtctttttaatttg

SEQ ID NO: 233592 - DNA, 25 bp, Rattus norvegicus
cagggctaccttcgcgaacttgcgc

SEQ ID NO: 233593 - DNA, 25 bp, Rattus norvegicus
cagggctaccttggcgaacttgcgc

SEQ ID NO: 233594 - DNA, 25 bp, Rattus norvegicus
cagggctagcggacctctgggcctt

SEQ ID NO: 233595 - DNA, 25 bp, Rattus norvegicus
cagggctagcggtcctctgggcctt

SEQ ID NO: 233596 - DNA, 25 bp, Rattus norvegicus
cagggctatttcaccaatgtacaat

SEQ ID NO: 233597 - DNA, 25 bp, Rattus norvegicus
cagggctatttctccaatgtacaat

SEQ ID NO: 233598 - DNA, 25 bp, Rattus norvegicus
cagggctcagagaccgatgggaaat

SEQ ID NO: 233599 - DNA, 25 bp, Rattus norvegicus
cagggctcagagtccgatgggaaat

SEQ ID NO: 233600 - DNA, 25 bp, Rattus norvegicus
cagggctcagtgatcaggctgtaca

SEQ ID NO: 233601 - DNA, 25 bp, Rattus norvegicus
cagggctcagtgttcaggctgtaca

SEQ ID NO: 233602 - DNA, 25 bp, Rattus norvegicus
cagggctcattcatgattctcaacc

SEQ ID NO: 233603 - DNA, 25 bp, Rattus norvegicus
cagggctcattcttgattctcaacc

SEQ ID NO: 233604 - DNA, 25 bp, Rattus norvegicus
cagggctcatttagcctcttattag

SEQ ID NO: 233605 - DNA, 25 bp, Rattus norvegicus
cagggctcattttgcctcttattag

SEQ ID NO: 233606 - DNA, 25 bp, Rattus norvegicus
cagggctcgctcatggagcagatca

SEQ ID NO: 233607 - DNA, 25 bp, Rattus norvegicus
cagggctcgctcttggagcagatca

SEQ ID NO: 233608 - DNA, 25 bp, Rattus norvegicus
cagggctctgaacgctgcttctcta

SEQ ID NO: 233609 - DNA, 25 bp, Rattus norvegicus
cagggctctgaaggctgcttctcta

SEQ ID NO: 233610 - DNA, 25 bp, Rattus norvegicus
cagggctctgctcaggaaacacagt

SEQ ID NO: 233611 - DNA, 25 bp, Rattus norvegicus
cagggctctgctgaggaaacacagt

SEQ ID NO: 233612 - DNA, 25 bp, Rattus norvegicus
cagggctctggacggaatcatttct

SEQ ID NO: 233613 - DNA, 25 bp, Rattus norvegicus
cagggctctggagggaatcatttct

SEQ ID NO: 233614 - DNA, 25 bp, Rattus norvegicus
cagggctctggcactactttgaaga

SEQ ID NO: 233615 - DNA, 25 bp, Rattus norvegicus
cagggctctggctctactttgaaga

SEQ ID NO: 233616 - DNA, 25 bp, Rattus norvegicus
cagggctctttgcttgatgtaaatc

SEQ ID NO: 233617 - DNA, 25 bp, Rattus norvegicus
cagggctctttggttgatgtaaatc

SEQ ID NO: 233618 - DNA, 25 bp, Rattus norvegicus
cagggctgaacaacctcatcgacat

SEQ ID NO: 233619 - DNA, 25 bp, Rattus norvegicus
cagggctgaacatcctcatcgacat

SEQ ID NO: 233620 - DNA, 25 bp, Rattus norvegicus
cagggctgagaacctgaggctttca

SEQ ID NO: 233621 - DNA, 25 bp, Rattus norvegicus
cagggctgagaagctgaggctttca

SEQ ID NO: 233622 - DNA, 25 bp, Rattus norvegicus
cagggctgatgtatacctagttcaa

SEQ ID NO: 233623 - DNA, 25 bp, Rattus norvegicus
cagggctgatgtttacctagttcaa

SEQ ID NO: 233624 - DNA, 25 bp, Rattus norvegicus
cagggctgctctattacttgaataa

SEQ ID NO: 233625 - DNA, 25 bp, Rattus norvegicus
cagggctgctcttttacttgaataa

SEQ ID NO: 233626 - DNA, 25 bp, Rattus norvegicus
cagggctgctttcgacaaggctact

SEQ ID NO: 233627 - DNA, 25 bp, Rattus norvegicus
cagggctgctttggacaaggctact

SEQ ID NO: 233628 - DNA, 25 bp, Rattus norvegicus
cagggctggaataccgccacaaaga

SEQ ID NO: 233629 - DNA, 25 bp, Rattus norvegicus
cagggctggaattccgccacaaaga

SEQ ID NO: 233630 - DNA, 25 bp, Rattus norvegicus
cagggctggcccactaaggaagtca

SEQ ID NO: 233631 - DNA, 25 bp, Rattus norvegicus
cagggctggccctctaaggaagtca

SEQ ID NO: 233632 - DNA, 25 bp, Rattus norvegicus
cagggctgggctccggctgcctctg

SEQ ID NO: 233633 - DNA, 25 bp, Rattus norvegicus
cagggctgggctgcggctgcctctg

SEQ ID NO: 233634 - DNA, 25 bp, Rattus norvegicus
cagggctggttcagttcatatccaa

SEQ ID NO: 233635 - DNA, 25 bp, Rattus norvegicus
cagggctggttcatcgggctcatgt

SEQ ID NO: 233636 - DNA, 25 bp, Rattus norvegicus
cagggctggttctgttcatatccaa

SEQ ID NO: 233637 - DNA, 25 bp, Rattus norvegicus
cagggctggttcttcgggctcatgt

SEQ ID NO: 233638 - DNA, 25 bp, Rattus norvegicus
cagggctggttgattctgtagcctt

SEQ ID NO: 233639 - DNA, 25 bp, Rattus norvegicus
cagggctggttgtttctgtagcctt

SEQ ID NO: 233640 - DNA, 25 bp, Rattus norvegicus
cagggctggtttctgagtttccgtc

SEQ ID NO: 233641 - DNA, 25 bp, Rattus norvegicus
cagggctggtttctgccttcagacc

SEQ ID NO: 233642 - DNA, 25 bp, Rattus norvegicus
cagggctggtttgtgagtttccgtc

SEQ ID NO: 233643 - DNA, 25 bp, Rattus norvegicus
cagggctggtttgtgccttcagacc

SEQ ID NO: 233644 - DNA, 25 bp, Rattus norvegicus
cagggctgtcgcaactggatcagaa

SEQ ID NO: 233645 - DNA, 25 bp, Rattus norvegicus
cagggctgtcgctactggatcagaa

SEQ ID NO: 233646 - DNA, 25 bp, Rattus norvegicus
cagggctgtggtcccatcctagaca

SEQ ID NO: 233647 - DNA, 25 bp, Rattus norvegicus
cagggctgtggtgccatcctagaca

SEQ ID NO: 233648 - DNA, 25 bp, Rattus norvegicus
cagggcttatgtatcagtttgtttc

SEQ ID NO: 233649 - DNA, 25 bp, Rattus norvegicus
cagggcttatgtttcagtttgtttc

SEQ ID NO: 233650 - DNA, 25 bp, Rattus norvegicus
cagggcttccatctctcatcgtggg

SEQ ID NO: 233651 - DNA, 25 bp, Rattus norvegicus
cagggcttccatgtctcatcgtggg

SEQ ID NO: 233652 - DNA, 25 bp, Rattus norvegicus
cagggcttcctcaaaaaagttcaag

SEQ ID NO: 233653 - DNA, 25 bp, Rattus norvegicus
cagggcttcctctaaaaagttcaag

SEQ ID NO: 233654 - DNA, 25 bp, Rattus norvegicus
cagggcttcgcccaggcatgcttag

SEQ ID NO: 233655 - DNA, 25 bp, Rattus norvegicus
cagggcttcgccgaggcatgcttag

SEQ ID NO: 233656 - DNA, 25 bp, Rattus norvegicus
cagggcttcttgcatcgctgtcata

SEQ ID NO: 233657 - DNA, 25 bp, Rattus norvegicus
cagggcttcttggatcgctgtcata

SEQ ID NO: 233658 - DNA, 25 bp, Rattus norvegicus
cagggcttgaccatcattactgtca

SEQ ID NO: 233659 - DNA, 25 bp, Rattus norvegicus
cagggcttgaccttcattactgtca

SEQ ID NO: 233660 - DNA, 25 bp, Rattus norvegicus
cagggcttgggcagatgcaaacatc

SEQ ID NO: 233661 - DNA, 25 bp, Rattus norvegicus
cagggcttgggctgatgcaaacatc

SEQ ID NO: 233662 - DNA, 25 bp, Rattus norvegicus
cagggcttgtgaaaagtcgctccaa

SEQ ID NO: 233663 - DNA, 25 bp, Rattus norvegicus
cagggcttgtgataagtcgctccaa

SEQ ID NO: 233664 - DNA, 25 bp, Rattus norvegicus
cagggcttgtttatatattcattga

SEQ ID NO: 233665 - DNA, 25 bp, Rattus norvegicus
cagggcttgtttttatattcattga

SEQ ID NO: 233666 - DNA, 25 bp, Rattus norvegicus
cagggctttgtgagtactagggaaa

SEQ ID NO: 233667 - DNA, 25 bp, Rattus norvegicus
cagggctttgtgtgtactagggaaa

SEQ ID NO: 233668 - DNA, 25 bp, Rattus norvegicus
cagggcttttctccacagtactgag

SEQ ID NO: 233669 - DNA, 25 bp, Rattus norvegicus
cagggcttttctcccaactcttaga

SEQ ID NO: 233670 - DNA, 25 bp, Rattus norvegicus
cagggcttttctgcacagtactgag

SEQ ID NO: 233671 - DNA, 25 bp, Rattus norvegicus
cagggcttttctgccaactcttaga

SEQ ID NO: 233672 - DNA, 25 bp, Rattus norvegicus
caggggatttctaatgccatcaaac

SEQ ID NO: 233673 - DNA, 25 bp, Rattus norvegicus
caggggatttcttatgccatcaaac

SEQ ID NO: 233674 - DNA, 25 bp, Rattus norvegicus
cagggggaccttcagtgccacaaat

SEQ ID NO: 233675 - DNA, 25 bp, Rattus norvegicus
cagggggaccttgagtgccacaaat

SEQ ID NO: 233676 - DNA, 25 bp, Rattus norvegicus
cagggtaaagccactggagacacaa

SEQ ID NO: 233677 - DNA, 25 bp, Rattus norvegicus
cagggtaaagcctctggagacacaa

SEQ ID NO: 233678 - DNA, 25 bp, Rattus norvegicus
cagggtaacttcacaggccagaatt

SEQ ID NO: 233679 - DNA, 25 bp, Rattus norvegicus
cagggtaacttctcaggccagaatt

SEQ ID NO: 233680 - DNA, 25 bp, Rattus norvegicus
cagggtaagagacaccaataccttt

SEQ ID NO: 233681 - DNA, 25 bp, Rattus norvegicus
cagggtaagagagaccaataccttt

SEQ ID NO: 233682 - DNA, 25 bp, Rattus norvegicus
cagggtacagataggcttttggcat

SEQ ID NO: 233683 - DNA, 25 bp, Rattus norvegicus
cagggtacagattggcttttggcat

SEQ ID NO: 233684 - DNA, 25 bp, Rattus norvegicus
cagggtacagcccactaaaaaggag

SEQ ID NO: 233685 - DNA, 25 bp, Rattus norvegicus
cagggtacagccgactaaaaaggag

SEQ ID NO: 233686 - DNA, 25 bp, Rattus norvegicus
cagggtacagtcatctaggtggtta

SEQ ID NO: 233687 - DNA, 25 bp, Rattus norvegicus
cagggtacagtcattggtggccaag

SEQ ID NO: 233688 - DNA, 25 bp, Rattus norvegicus
cagggtacagtcttctaggtggtta

SEQ ID NO: 233689 - DNA, 25 bp, Rattus norvegicus
cagggtacagtctttggtggccaag

SEQ ID NO: 233690 - DNA, 25 bp, Rattus norvegicus
cagggtacgcccaaatgactcagaa

SEQ ID NO: 233691 - DNA, 25 bp, Rattus norvegicus
cagggtacgccctaatgactcagaa

SEQ ID NO: 233692 - DNA, 25 bp, Rattus norvegicus
cagggtactgaacccgacagcatct

SEQ ID NO: 233693 - DNA, 25 bp, Rattus norvegicus
cagggtactgaagccgacagcatct

SEQ ID NO: 233694 - DNA, 25 bp, Rattus norvegicus
cagggtactggacacaacacatcaa

SEQ ID NO: 233695 - DNA, 25 bp, Rattus norvegicus
cagggtactggagacaacacatcaa

SEQ ID NO: 233696 - DNA, 25 bp, Rattus norvegicus
cagggtagacggctgcagaacttct

SEQ ID NO: 233697 - DNA, 25 bp, Rattus norvegicus
cagggtagacgggtgcagaacttct

SEQ ID NO: 233698 - DNA, 25 bp, Rattus norvegicus
cagggtagcctcaacattactgtgt

SEQ ID NO: 233699 - DNA, 25 bp, Rattus norvegicus
cagggtagcctctacattactgtgt

SEQ ID NO: 233700 - DNA, 25 bp, Rattus norvegicus
cagggtagggagagtctccacctga

SEQ ID NO: 233701 - DNA, 25 bp, Rattus norvegicus
cagggtagggagtgtctccacctga

SEQ ID NO: 233702 - DNA, 25 bp, Rattus norvegicus
cagggtatcaccaggcagggtataa

SEQ ID NO: 233703 - DNA, 25 bp, Rattus norvegicus
cagggtatcacctggcagggtataa

SEQ ID NO: 233704 - DNA, 25 bp, Rattus norvegicus
cagggtatcctgcattttttgaatt

SEQ ID NO: 233705 - DNA, 25 bp, Rattus norvegicus
cagggtatcctggattttttgaatt

SEQ ID NO: 233706 - DNA, 25 bp, Rattus norvegicus
cagggtatccttaggtggcttctgt

SEQ ID NO: 233707 - DNA, 25 bp, Rattus norvegicus
cagggtatcctttggtggcttctgt

SEQ ID NO: 233708 - DNA, 25 bp, Rattus norvegicus
cagggtatgcacacccgtggatgca

SEQ ID NO: 233709 - DNA, 25 bp, Rattus norvegicus
cagggtatgcactcccgtggatgca

SEQ ID NO: 233710 - DNA, 25 bp, Rattus norvegicus
cagggtatgtccagaaaatggtttt

SEQ ID NO: 233711 - DNA, 25 bp, Rattus norvegicus
cagggtatgtcctgaaaatggtttt

SEQ ID NO: 233712 - DNA, 25 bp, Rattus norvegicus
cagggtcaacggcacagtgtcccta

SEQ ID NO: 233713 - DNA, 25 bp, Rattus norvegicus
cagggtcaacgggacagtgtcccta

SEQ ID NO: 233714 - DNA, 25 bp, Rattus norvegicus
cagggtcaactgagtttttcttatt

SEQ ID NO: 233715 - DNA, 25 bp, Rattus norvegicus
cagggtcaactgtgtttttcttatt

SEQ ID NO: 233716 - DNA, 25 bp, Rattus norvegicus
cagggtcaatgtaaagtatatcaaa

SEQ ID NO: 233717 - DNA, 25 bp, Rattus norvegicus
cagggtcaatgttaagtatatcaaa

SEQ ID NO: 233718 - DNA, 25 bp, Rattus norvegicus
cagggtcacaggcagatttacaaca

SEQ ID NO: 233719 - DNA, 25 bp, Rattus norvegicus
cagggtcacagggagatttacaaca

SEQ ID NO: 233720 - DNA, 25 bp, Rattus norvegicus
cagggtcactcgcaacttattttga

SEQ ID NO: 233721 - DNA, 25 bp, Rattus norvegicus
cagggtcactcggaacttattttga

SEQ ID NO: 233722 - DNA, 25 bp, Rattus norvegicus
cagggtcaggatctgtgtacctcca

SEQ ID NO: 233723 - DNA, 25 bp, Rattus norvegicus
cagggtcaggatgtgtgtacctcca

SEQ ID NO: 233724 - DNA, 25 bp, Rattus norvegicus
cagggtcagggacacacagcaccat

SEQ ID NO: 233725 - DNA, 25 bp, Rattus norvegicus
cagggtcagggagacacagcaccat

SEQ ID NO: 233726 - DNA, 25 bp, Rattus norvegicus
cagggtcaggtgatgctgtcccaca

SEQ ID NO: 233727 - DNA, 25 bp, Rattus norvegicus
cagggtcaggtgttgctgtcccaca

SEQ ID NO: 233728 - DNA, 25 bp, Rattus norvegicus
cagggtccagcgacgggcctcaacg

SEQ ID NO: 233729 - DNA, 25 bp, Rattus norvegicus
cagggtccagcgtcgggcctcaacg

SEQ ID NO: 233730 - DNA, 25 bp, Rattus norvegicus
cagggtccatgacatcccagcagtc

SEQ ID NO: 233731 - DNA, 25 bp, Rattus norvegicus
cagggtccatgagatcccagcagtc

SEQ ID NO: 233732 - DNA, 25 bp, Rattus norvegicus
cagggtccccagcacttgttacaaa

SEQ ID NO: 233733 - DNA, 25 bp, Rattus norvegicus
cagggtccccaggacttgttacaaa

SEQ ID NO: 233734 - DNA, 25 bp, Rattus norvegicus
cagggtccccatctttgaacagaag

SEQ ID NO: 233735 - DNA, 25 bp, Rattus norvegicus
cagggtccccatgtttgaacagaag

SEQ ID NO: 233736 - DNA, 25 bp, Rattus norvegicus
cagggtcccgagaggctcttaagtc

SEQ ID NO: 233737 - DNA, 25 bp, Rattus norvegicus
cagggtcccgagtggctcttaagtc

SEQ ID NO: 233738 - DNA, 25 bp, Rattus norvegicus
cagggtcccttcagaaagtccagct

SEQ ID NO: 233739 - DNA, 25 bp, Rattus norvegicus
cagggtcccttctgaaagtccagct

SEQ ID NO: 233740 - DNA, 25 bp, Rattus norvegicus
cagggtccgtccacattattattga

SEQ ID NO: 233741 - DNA, 25 bp, Rattus norvegicus
cagggtccgtcctcattattattga

SEQ ID NO: 233742 - DNA, 25 bp, Rattus norvegicus
cagggtcctcttcgcttagacagtg

SEQ ID NO: 233743 - DNA, 25 bp, Rattus norvegicus
cagggtcctcttggcttagacagtg

SEQ ID NO: 233744 - DNA, 25 bp, Rattus norvegicus
cagggtcctggaatgagtttatgaa

SEQ ID NO: 233745 - DNA, 25 bp, Rattus norvegicus
cagggtcctggattgagtttatgaa

SEQ ID NO: 233746 - DNA, 25 bp, Rattus norvegicus
cagggtccttgtcagtcacatcctg

SEQ ID NO: 233747 - DNA, 25 bp, Rattus norvegicus
cagggtccttgtgagtcacatcctg

SEQ ID NO: 233748 - DNA, 25 bp, Rattus norvegicus
cagggtcgagctcatggcagacctt

SEQ ID NO: 233749 - DNA, 25 bp, Rattus norvegicus
cagggtcgagctgatggcagacctt

SEQ ID NO: 233750 - DNA, 25 bp, Rattus norvegicus
cagggtcggtccatgcgaagctagt

SEQ ID NO: 233751 - DNA, 25 bp, Rattus norvegicus
cagggtcggtccttgcgaagctagt

SEQ ID NO: 233752 - DNA, 25 bp, Rattus norvegicus
cagggtcgtgggacatactgtgcac

SEQ ID NO: 233753 - DNA, 25 bp, Rattus norvegicus
cagggtcgtgggtcatactgtgcac

SEQ ID NO: 233754 - DNA, 25 bp, Rattus norvegicus
cagggtctcaaaattgtgtttctca

SEQ ID NO: 233755 - DNA, 25 bp, Rattus norvegicus
cagggtctcaaatttgtgtttctca

SEQ ID NO: 233756 - DNA, 25 bp, Rattus norvegicus
cagggtctcatcatgcacgtgggag

SEQ ID NO: 233757 - DNA, 25 bp, Rattus norvegicus
cagggtctcatcttgcacgtgggag

SEQ ID NO: 233758 - DNA, 25 bp, Rattus norvegicus
cagggtctcattactccaaggagga

SEQ ID NO: 233759 - DNA, 25 bp, Rattus norvegicus
cagggtctcatttctccaaggagga

SEQ ID NO: 233760 - DNA, 25 bp, Rattus norvegicus
cagggtctcctgagattggaagaat

SEQ ID NO: 233761 - DNA, 25 bp, Rattus norvegicus
cagggtctcctgtgattggaagaat

SEQ ID NO: 233762 - DNA, 25 bp, Rattus norvegicus
cagggtctcttcagtgtagtaatcc

SEQ ID NO: 233763 - DNA, 25 bp, Rattus norvegicus
cagggtctcttctgtgtagtaatcc

SEQ ID NO: 233764 - DNA, 25 bp, Rattus norvegicus
cagggtctcttgaaacctttgtgac

SEQ ID NO: 233765 - DNA, 25 bp, Rattus norvegicus
cagggtctcttgtaacctttgtgac

SEQ ID NO: 233766 - DNA, 25 bp, Rattus norvegicus
cagggtctgatacggctttgttcac

SEQ ID NO: 233767 - DNA, 25 bp, Rattus norvegicus
cagggtctgatagggctttgttcac

SEQ ID NO: 233768 - DNA, 25 bp, Rattus norvegicus
cagggtctggccacactagagacaa

SEQ ID NO: 233769 - DNA, 25 bp, Rattus norvegicus
cagggtctggcctcactagagacaa

SEQ ID NO: 233770 - DNA, 25 bp, Rattus norvegicus
cagggtctgtcaccacaaacaggaa

SEQ ID NO: 233771 - DNA, 25 bp, Rattus norvegicus
cagggtctgtcagcacaaacaggaa

SEQ ID NO: 233772 - DNA, 25 bp, Rattus norvegicus
cagggtcttaccatatagctctagg

SEQ ID NO: 233773 - DNA, 25 bp, Rattus norvegicus
cagggtcttaccttatagctctagg

SEQ ID NO: 233774 - DNA, 25 bp, Rattus norvegicus
cagggtcttcctcaggagttgccaa

SEQ ID NO: 233775 - DNA, 25 bp, Rattus norvegicus
cagggtcttcctgaggagttgccaa

SEQ ID NO: 233776 - DNA, 25 bp, Rattus norvegicus
cagggtcttctgagacctcaccgaa

SEQ ID NO: 233777 - DNA, 25 bp, Rattus norvegicus
cagggtcttctgtgacctcaccgaa

SEQ ID NO: 233778 - DNA, 25 bp, Rattus norvegicus
cagggtctttctctccgtgaacaaa

SEQ ID NO: 233779 - DNA, 25 bp, Rattus norvegicus
cagggtctttctgtccgtgaacaaa

SEQ ID NO: 233780 - DNA, 25 bp, Rattus norvegicus
cagggtctttttccatagagcccta

SEQ ID NO: 233781 - DNA, 25 bp, Rattus norvegicus
cagggtctttttgcatagagcccta

SEQ ID NO: 233782 - DNA, 25 bp, Rattus norvegicus
cagggtgaacttactgaccccgaga

SEQ ID NO: 233783 - DNA, 25 bp, Rattus norvegicus
cagggtgaactttctgaccccgaga

SEQ ID NO: 233784 - DNA, 25 bp, Rattus norvegicus
cagggtgaatgacgaggcaatctcc

SEQ ID NO: 233785 - DNA, 25 bp, Rattus norvegicus
cagggtgaatgaggaggcaatctcc

SEQ ID NO: 233786 - DNA, 25 bp, Rattus norvegicus
cagggtgaatgtatgcgctctttgt

SEQ ID NO: 233787 - DNA, 25 bp, Rattus norvegicus
cagggtgaatgtttgcgctctttgt

SEQ ID NO: 233788 - DNA, 25 bp, Rattus norvegicus
cagggtgacacaattctgtaatggt

SEQ ID NO: 233789 - DNA, 25 bp, Rattus norvegicus
cagggtgacacatttctgtaatggt

SEQ ID NO: 233790 - DNA, 25 bp, Rattus norvegicus
cagggtgactacaggcctttacaaa

SEQ ID NO: 233791 - DNA, 25 bp, Rattus norvegicus
cagggtgactactggcctttacaaa

SEQ ID NO: 233792 - DNA, 25 bp, Rattus norvegicus
cagggtgccagtacagccacatggg

SEQ ID NO: 233793 - DNA, 25 bp, Rattus norvegicus
cagggtgccagttcagccacatggg

SEQ ID NO: 233794 - DNA, 25 bp, Rattus norvegicus
cagggtgcgcgcatacgcctgtgtt

SEQ ID NO: 233795 - DNA, 25 bp, Rattus norvegicus
cagggtgcgcgcttacgcctgtgtt

SEQ ID NO: 233796 - DNA, 25 bp, Rattus norvegicus
cagggtgcggttatatgaaggctca

SEQ ID NO: 233797 - DNA, 25 bp, Rattus norvegicus
cagggtgcggttttatgaaggctca

SEQ ID NO: 233798 - DNA, 25 bp, Rattus norvegicus
cagggtgctcttagggactggatct

SEQ ID NO: 233799 - DNA, 25 bp, Rattus norvegicus
cagggtgctctttgggactggatct

SEQ ID NO: 233800 - DNA, 25 bp, Rattus norvegicus
cagggtgctgggatcagtttcttta

SEQ ID NO: 233801 - DNA, 25 bp, Rattus norvegicus
cagggtgctgggttcagtttcttta

SEQ ID NO: 233802 - DNA, 25 bp, Rattus norvegicus
cagggtggaactactctggcagctg

SEQ ID NO: 233803 - DNA, 25 bp, Rattus norvegicus
cagggtggaacttctctggcagctg

SEQ ID NO: 233804 - DNA, 25 bp, Rattus norvegicus
cagggtggacctagataaaattcct

SEQ ID NO: 233805 - DNA, 25 bp, Rattus norvegicus
cagggtggaccttgataaaattcct

SEQ ID NO: 233806 - DNA, 25 bp, Rattus norvegicus
cagggtggattgattacgacatgtc

SEQ ID NO: 233807 - DNA, 25 bp, Rattus norvegicus
cagggtggattgtttacgacatgtc

SEQ ID NO: 233808 - DNA, 25 bp, Rattus norvegicus
cagggtggtagcactggaactgtaa

SEQ ID NO: 233809 - DNA, 25 bp, Rattus norvegicus
cagggtggtagctctggaactgtaa

SEQ ID NO: 233810 - DNA, 25 bp, Rattus norvegicus
cagggtggtgatcacctgtgacctt

SEQ ID NO: 233811 - DNA, 25 bp, Rattus norvegicus
cagggtggtgatgacctgtgacctt

SEQ ID NO: 233812 - DNA, 25 bp, Rattus norvegicus
cagggtggttatagaaaccttctca

SEQ ID NO: 233813 - DNA, 25 bp, Rattus norvegicus
cagggtggttattgaaaccttctca

SEQ ID NO: 233814 - DNA, 25 bp, Rattus norvegicus
cagggtgtacctattagccatagtt

SEQ ID NO: 233815 - DNA, 25 bp, Rattus norvegicus
cagggtgtaccttttagccatagtt

SEQ ID NO: 233816 - DNA, 25 bp, Rattus norvegicus
cagggtgtacgccaacatgttcaag

SEQ ID NO: 233817 - DNA, 25 bp, Rattus norvegicus
cagggtgtacgcgaacatgttcaag

SEQ ID NO: 233818 - DNA, 25 bp, Rattus norvegicus
cagggtgtccagctgccgttgcaca

SEQ ID NO: 233819 - DNA, 25 bp, Rattus norvegicus
cagggtgtccaggtgccgttgcaca

SEQ ID NO: 233820 - DNA, 25 bp, Rattus norvegicus
cagggtgtccgaagtcttcttgtgg

SEQ ID NO: 233821 - DNA, 25 bp, Rattus norvegicus
cagggtgtccgatgtcttcttgtgg

SEQ ID NO: 233822 - DNA, 25 bp, Rattus norvegicus
cagggtgtgaatcagtgtcgtccaa

SEQ ID NO: 233823 - DNA, 25 bp, Rattus norvegicus
cagggtgtgaatgagtgtcgtccaa

SEQ ID NO: 233824 - DNA, 25 bp, Rattus norvegicus
cagggtgttcttacttcacattttt

SEQ ID NO: 233825 - DNA, 25 bp, Rattus norvegicus
cagggtgttctttcttcacattttt

SEQ ID NO: 233826 - DNA, 25 bp, Rattus norvegicus
cagggtgttggtacttctgagctac

SEQ ID NO: 233827 - DNA, 25 bp, Rattus norvegicus
cagggtgttggttcttctgagctac

SEQ ID NO: 233828 - DNA, 25 bp, Rattus norvegicus
cagggtgtttctatatgttcagtca

SEQ ID NO: 233829 - DNA, 25 bp, Rattus norvegicus
cagggtgtttctttatgttcagtca

SEQ ID NO: 233830 - DNA, 25 bp, Rattus norvegicus
cagggttacagaccacttttatgga

SEQ ID NO: 233831 - DNA, 25 bp, Rattus norvegicus
cagggttacagagcacttttatgga

SEQ ID NO: 233832 - DNA, 25 bp, Rattus norvegicus
cagggttagagtacacagtgtcagt

SEQ ID NO: 233833 - DNA, 25 bp, Rattus norvegicus
cagggttagagttcacagtgtcagt

SEQ ID NO: 233834 - DNA, 25 bp, Rattus norvegicus
cagggttatagcaggcagccggtat

SEQ ID NO: 233835 - DNA, 25 bp, Rattus norvegicus
cagggttatagctggcagccggtat

SEQ ID NO: 233836 - DNA, 25 bp, Rattus norvegicus
cagggttatgacctatattgggcag

SEQ ID NO: 233837 - DNA, 25 bp, Rattus norvegicus
cagggttatgacgtatattgggcag

SEQ ID NO: 233838 - DNA, 25 bp, Rattus norvegicus
cagggttattctccgtggtgtctca

SEQ ID NO: 233839 - DNA, 25 bp, Rattus norvegicus
cagggttattctgcgtggtgtctca

SEQ ID NO: 233840 - DNA, 25 bp, Rattus norvegicus
cagggttcaaggcagtacagtcaaa

SEQ ID NO: 233841 - DNA, 25 bp, Rattus norvegicus
cagggttcaagggagtacagtcaaa

SEQ ID NO: 233842 - DNA, 25 bp, Rattus norvegicus
cagggttcacataggccaagtcatc

SEQ ID NO: 233843 - DNA, 25 bp, Rattus norvegicus
cagggttcacattggccaagtcatc

SEQ ID NO: 233844 - DNA, 25 bp, Rattus norvegicus
cagggttcacgcagcagatggacag

SEQ ID NO: 233845 - DNA, 25 bp, Rattus norvegicus
cagggttcacgctgcagatggacag

SEQ ID NO: 233846 - DNA, 25 bp, Rattus norvegicus
cagggttcattgactgccacattaa

SEQ ID NO: 233847 - DNA, 25 bp, Rattus norvegicus
cagggttcattgtctgccacattaa

SEQ ID NO: 233848 - DNA, 25 bp, Rattus norvegicus
cagggttccctgaagctttagttgc

SEQ ID NO: 233849 - DNA, 25 bp, Rattus norvegicus
cagggttccctgacacttagtgaga

SEQ ID NO: 233850 - DNA, 25 bp, Rattus norvegicus
cagggttccctgtagctttagttgc

SEQ ID NO: 233851 - DNA, 25 bp, Rattus norvegicus
cagggttccctgtcacttagtgaga

SEQ ID NO: 233852 - DNA, 25 bp, Rattus norvegicus
cagggttcctgtcattgatcccaaa

SEQ ID NO: 233853 - DNA, 25 bp, Rattus norvegicus
cagggttcctgtgattgatcccaaa

SEQ ID NO: 233854 - DNA, 25 bp, Rattus norvegicus
cagggttgaattcagcctcaggctt

SEQ ID NO: 233855 - DNA, 25 bp, Rattus norvegicus
cagggttgaattgagcctcaggctt

SEQ ID NO: 233856 - DNA, 25 bp, Rattus norvegicus
cagggttgagttctcttgcaggtcc

SEQ ID NO: 233857 - DNA, 25 bp, Rattus norvegicus
cagggttgagttgtcttgcaggtcc

SEQ ID NO: 233858 - DNA, 25 bp, Rattus norvegicus
cagggtttaagtaactattgcgcaa

SEQ ID NO: 233859 - DNA, 25 bp, Rattus norvegicus
cagggtttaagttactattgcgcaa

SEQ ID NO: 233860 - DNA, 25 bp, Rattus norvegicus
cagggtttcagcctttaagctagag

SEQ ID NO: 233861 - DNA, 25 bp, Rattus norvegicus
cagggtttcagcgtttaagctagag

SEQ ID NO: 233862 - DNA, 25 bp, Rattus norvegicus
cagggtttccgcacagtttgagggc

SEQ ID NO: 233863 - DNA, 25 bp, Rattus norvegicus
cagggtttccgctcagtttgagggc

SEQ ID NO: 233864 - DNA, 25 bp, Rattus norvegicus
cagggtttccttagagctagtcggc

SEQ ID NO: 233865 - DNA, 25 bp, Rattus norvegicus
cagggtttcctttgagctagtcggc

SEQ ID NO: 233866 - DNA, 25 bp, Rattus norvegicus
cagggtttctagatctgtttcactc

SEQ ID NO: 233867 - DNA, 25 bp, Rattus norvegicus
cagggtttctagttctgtttcactc

SEQ ID NO: 233868 - DNA, 25 bp, Rattus norvegicus
cagggtttcttaaccttcaaagatg

SEQ ID NO: 233869 - DNA, 25 bp, Rattus norvegicus
cagggtttcttatccttcaaagatg

SEQ ID NO: 233870 - DNA, 25 bp, Rattus norvegicus
cagggtttgaaaacaccgtcggatt

SEQ ID NO: 233871 - DNA, 25 bp, Rattus norvegicus
cagggtttgaaatcaccgtcggatt

SEQ ID NO: 233872 - DNA, 25 bp, Rattus norvegicus
cagggtttgctaccactgggcatca

SEQ ID NO: 233873 - DNA, 25 bp, Rattus norvegicus
cagggtttgctagcactgggcatca

SEQ ID NO: 233874 - DNA, 25 bp, Rattus norvegicus
cagggtttggccatgtcgccttttg

SEQ ID NO: 233875 - DNA, 25 bp, Rattus norvegicus
cagggtttggccttgtcgccttttg

SEQ ID NO: 233876 - DNA, 25 bp, Rattus norvegicus
cagggttttctgactcttggatact

SEQ ID NO: 233877 - DNA, 25 bp, Rattus norvegicus
cagggttttctgtctcttggatact

SEQ ID NO: 233878 - DNA, 25 bp, Rattus norvegicus
caggtaaaatatccgtgcacacaaa

SEQ ID NO: 233879 - DNA, 25 bp, Rattus norvegicus
caggtaaaatatgcgtgcacacaaa

SEQ ID NO: 233880 - DNA, 25 bp, Rattus norvegicus
caggtaaagacgattgcttcatttc

SEQ ID NO: 233881 - DNA, 25 bp, Rattus norvegicus
caggtaaagacgtttgcttcatttc

SEQ ID NO: 233882 - DNA, 25 bp, Rattus norvegicus
caggtaaagcgtcattccccaccaa

SEQ ID NO: 233883 - DNA, 25 bp, Rattus norvegicus
caggtaaagcgtgattccccaccaa

SEQ ID NO: 233884 - DNA, 25 bp, Rattus norvegicus
caggtaaatcaacgtactgtgagaa

SEQ ID NO: 233885 - DNA, 25 bp, Rattus norvegicus
caggtaaatcaaggtactgtgagaa

SEQ ID NO: 233886 - DNA, 25 bp, Rattus norvegicus
caggtaacagtgactaaggacaaaa

SEQ ID NO: 233887 - DNA, 25 bp, Rattus norvegicus
caggtaacagtgtctaaggacaaaa

SEQ ID NO: 233888 - DNA, 25 bp, Rattus norvegicus
caggtaacccgcagttagtcgcggc

SEQ ID NO: 233889 - DNA, 25 bp, Rattus norvegicus
caggtaacccgctgttagtcgcggc

SEQ ID NO: 233890 - DNA, 25 bp, Rattus norvegicus
caggtaacgtcaatagtcggtcatt

SEQ ID NO: 233891 - DNA, 25 bp, Rattus norvegicus
caggtaacgtcattagtcggtcatt

SEQ ID NO: 233892 - DNA, 25 bp, Rattus norvegicus
caggtaacgtctcccattcatgttt

SEQ ID NO: 233893 - DNA, 25 bp, Rattus norvegicus
caggtaacgtctgccattcatgttt

SEQ ID NO: 233894 - DNA, 25 bp, Rattus norvegicus
caggtaatccatctagtagaagtca

SEQ ID NO: 233895 - DNA, 25 bp, Rattus norvegicus
caggtaatccatgtagtagaagtca

SEQ ID NO: 233896 - DNA, 25 bp, Rattus norvegicus
caggtaatgaatctttggccagata

SEQ ID NO: 233897 - DNA, 25 bp, Rattus norvegicus
caggtaatgaatgtttggccagata

SEQ ID NO: 233898 - DNA, 25 bp, Rattus norvegicus
caggtacagccgaaggtgtttctct

SEQ ID NO: 233899 - DNA, 25 bp, Rattus norvegicus
caggtacagccgtaggtgtttctct

SEQ ID NO: 233900 - DNA, 25 bp, Rattus norvegicus
caggtacagggcaagcttctcatcc

SEQ ID NO: 233901 - DNA, 25 bp, Rattus norvegicus
caggtacagggctagcttctcatcc

SEQ ID NO: 233902 - DNA, 25 bp, Rattus norvegicus
caggtacatgtgctcttttaatata

SEQ ID NO: 233903 - DNA, 25 bp, Rattus norvegicus
caggtacatgtggtcttttaatata

SEQ ID NO: 233904 - DNA, 25 bp, Rattus norvegicus
caggtacccctgacatcaaggacaa

SEQ ID NO: 233905 - DNA, 25 bp, Rattus norvegicus
caggtacccctgtcatcaaggacaa

SEQ ID NO: 233906 - DNA, 25 bp, Rattus norvegicus
caggtaccccttcgaacacagaata

SEQ ID NO: 233907 - DNA, 25 bp, Rattus norvegicus
caggtaccccttggaacacagaata

SEQ ID NO: 233908 - DNA, 25 bp, Rattus norvegicus
caggtaccgtggcttgactcgcgac

SEQ ID NO: 233909 - DNA, 25 bp, Rattus norvegicus
caggtaccgtgggttgactcgcgac

SEQ ID NO: 233910 - DNA, 25 bp, Rattus norvegicus
caggtacctcttagtgtgtttaata

SEQ ID NO: 233911 - DNA, 25 bp, Rattus norvegicus
caggtacctctttgtgtgtttaata

SEQ ID NO: 233912 - DNA, 25 bp, Rattus norvegicus
caggtacctggccacagcatttgaa

SEQ ID NO: 233913 - DNA, 25 bp, Rattus norvegicus
caggtacctggcgacagcatttgaa

SEQ ID NO: 233914 - DNA, 25 bp, Rattus norvegicus
caggtacgtgttcccgcaagccagg

SEQ ID NO: 233915 - DNA, 25 bp, Rattus norvegicus
caggtacgtgttgccgcaagccagg

SEQ ID NO: 233916 - DNA, 25 bp, Rattus norvegicus
caggtactctcaccctgttctttag

SEQ ID NO: 233917 - DNA, 25 bp, Rattus norvegicus
caggtactctcagcctgttctttag

SEQ ID NO: 233918 - DNA, 25 bp, Rattus norvegicus
caggtactggagcttggaatttccc

SEQ ID NO: 233919 - DNA, 25 bp, Rattus norvegicus
caggtactggaggttggaatttccc

SEQ ID NO: 233920 - DNA, 25 bp, Rattus norvegicus
caggtagaaatcagccccactcagg

SEQ ID NO: 233921 - DNA, 25 bp, Rattus norvegicus
caggtagaaatctgccccactcagg

SEQ ID NO: 233922 - DNA, 25 bp, Rattus norvegicus
caggtagcagagctctccttgatgc

SEQ ID NO: 233923 - DNA, 25 bp, Rattus norvegicus
caggtagcagaggtctccttgatgc

SEQ ID NO: 233924 - DNA, 25 bp, Rattus norvegicus
caggtagccgccaggccggttcggg

SEQ ID NO: 233925 - DNA, 25 bp, Rattus norvegicus
caggtagccgcctggccggttcggg

SEQ ID NO: 233926 - DNA, 25 bp, Rattus norvegicus
caggtaggtattcgctccactgtaa

SEQ ID NO: 233927 - DNA, 25 bp, Rattus norvegicus
caggtaggtattggctccactgtaa

SEQ ID NO: 233928 - DNA, 25 bp, Rattus norvegicus
caggtaggtcaccagatgggccata

SEQ ID NO: 233929 - DNA, 25 bp, Rattus norvegicus
caggtaggtcacgagatgggccata

SEQ ID NO: 233930 - DNA, 25 bp, Rattus norvegicus
caggtagtctttctgtgcatgcagt

SEQ ID NO: 233931 - DNA, 25 bp, Rattus norvegicus
caggtagtctttgtgtgcatgcagt

SEQ ID NO: 233932 - DNA, 25 bp, Rattus norvegicus
caggtagtgacgcaacccgcaggct

SEQ ID NO: 233933 - DNA, 25 bp, Rattus norvegicus
caggtagtgacggaacccgcaggct

SEQ ID NO: 233934 - DNA, 25 bp, Rattus norvegicus
caggtagtgcagcaccttctcagct

SEQ ID NO: 233935 - DNA, 25 bp, Rattus norvegicus
caggtagtgcaggaccttctcagct

SEQ ID NO: 233936 - DNA, 25 bp, Rattus norvegicus
caggtatacaccacaggactgcttt

SEQ ID NO: 233937 - DNA, 25 bp, Rattus norvegicus
caggtatacacctcaggactgcttt

SEQ ID NO: 233938 - DNA, 25 bp, Rattus norvegicus
caggtatacttcattgtggccagtc

SEQ ID NO: 233939 - DNA, 25 bp, Rattus norvegicus
caggtatacttctttgtggccagtc

SEQ ID NO: 233940 - DNA, 25 bp, Rattus norvegicus
caggtatcgatcacactggtcaggt

SEQ ID NO: 233941 - DNA, 25 bp, Rattus norvegicus
caggtatcgatctcactggtcaggt

SEQ ID NO: 233942 - DNA, 25 bp, Rattus norvegicus
caggtatgaattaggccaggctctc

SEQ ID NO: 233943 - DNA, 25 bp, Rattus norvegicus
caggtatgaatttggccaggctctc

SEQ ID NO: 233944 - DNA, 25 bp, Rattus norvegicus
caggtatgagccaccaagcctttct

SEQ ID NO: 233945 - DNA, 25 bp, Rattus norvegicus
caggtatgagcctccaagcctttct

SEQ ID NO: 233946 - DNA, 25 bp, Rattus norvegicus
caggtatgcatgaaattcacagaca

SEQ ID NO: 233947 - DNA, 25 bp, Rattus norvegicus
caggtatgcatgtaattcacagaca

SEQ ID NO: 233948 - DNA, 25 bp, Rattus norvegicus
caggtatgtcacaggctggttcagc

SEQ ID NO: 233949 - DNA, 25 bp, Rattus norvegicus
caggtatgtcactggctggttcagc

SEQ ID NO: 233950 - DNA, 25 bp, Rattus norvegicus
caggtattactcattgtctgttaaa

SEQ ID NO: 233951 - DNA, 25 bp, Rattus norvegicus
caggtattactctttgtctgttaaa

SEQ ID NO: 233952 - DNA, 25 bp, Rattus norvegicus
caggtattctggcttgtgttccact

SEQ ID NO: 233953 - DNA, 25 bp, Rattus norvegicus
caggtattctgggttgtgttccact

SEQ ID NO: 233954 - DNA, 25 bp, Rattus norvegicus
caggtattgatcagcttttcagtta

SEQ ID NO: 233955 - DNA, 25 bp, Rattus norvegicus
caggtattgatctgcttttcagtta

SEQ ID NO: 233956 - DNA, 25 bp, Rattus norvegicus
caggtattttcaaggcttttgcttt

SEQ ID NO: 233957 - DNA, 25 bp, Rattus norvegicus
caggtattttcatggcttttgcttt

SEQ ID NO: 233958 - DNA, 25 bp, Rattus norvegicus
caggtattttgtcaaggcttttaag

SEQ ID NO: 233959 - DNA, 25 bp, Rattus norvegicus
caggtattttgtgaaggcttttaag

SEQ ID NO: 233960 - DNA, 25 bp, Rattus norvegicus
caggtcacacccactgtagaaagtt

SEQ ID NO: 233961 - DNA, 25 bp, Rattus norvegicus
caggtcacaccctctgtagaaagtt

SEQ ID NO: 233962 - DNA, 25 bp, Rattus norvegicus
caggtcacagatattgggttcgcca

SEQ ID NO: 233963 - DNA, 25 bp, Rattus norvegicus
caggtcacagattttgggttcgcca

SEQ ID NO: 233964 - DNA, 25 bp, Rattus norvegicus
caggtcaccgtgattgcacatgtgt

SEQ ID NO: 233965 - DNA, 25 bp, Rattus norvegicus
caggtcaccgtgtttgcacatgtgt

SEQ ID NO: 233966 - DNA, 25 bp, Rattus norvegicus
caggtcacgctcaatgtctttgaaa

SEQ ID NO: 233967 - DNA, 25 bp, Rattus norvegicus
caggtcacgctctatgtctttgaaa

SEQ ID NO: 233968 - DNA, 25 bp, Rattus norvegicus
caggtcacttgcatccttgatagga

SEQ ID NO: 233969 - DNA, 25 bp, Rattus norvegicus
caggtcacttgcttccttgatagga

SEQ ID NO: 233970 - DNA, 25 bp, Rattus norvegicus
caggtcagtagaaccttcaggtcta

SEQ ID NO: 233971 - DNA, 25 bp, Rattus norvegicus
caggtcagtagatccttcaggtcta

SEQ ID NO: 233972 - DNA, 25 bp, Rattus norvegicus
caggtcatggcaccgttgttcacaa

SEQ ID NO: 233973 - DNA, 25 bp, Rattus norvegicus
caggtcatggcagcgttgttcacaa

SEQ ID NO: 233974 - DNA, 25 bp, Rattus norvegicus
caggtcattggaacttgtctgtaat

SEQ ID NO: 233975 - DNA, 25 bp, Rattus norvegicus
caggtcattggatcttgtctgtaat

SEQ ID NO: 233976 - DNA, 25 bp, Rattus norvegicus
caggtccacaacagtatccagaagg

SEQ ID NO: 233977 - DNA, 25 bp, Rattus norvegicus
caggtccacaactgtatccagaagg

SEQ ID NO: 233978 - DNA, 25 bp, Rattus norvegicus
caggtccaccagacgggtcttagag

SEQ ID NO: 233979 - DNA, 25 bp, Rattus norvegicus
caggtccaccagtcgggtcttagag

SEQ ID NO: 233980 - DNA, 25 bp, Rattus norvegicus
caggtccattccagatgccaagagt

SEQ ID NO: 233981 - DNA, 25 bp, Rattus norvegicus
caggtccattcctgatgccaagagt

SEQ ID NO: 233982 - DNA, 25 bp, Rattus norvegicus
caggtcccaagtctcgggttccgcg

SEQ ID NO: 233983 - DNA, 25 bp, Rattus norvegicus
caggtcccaagtgtcgggttccgcg

SEQ ID NO: 233984 - DNA, 25 bp, Rattus norvegicus
caggtcccagaaaccacgcgggtcg

SEQ ID NO: 233985 - DNA, 25 bp, Rattus norvegicus
caggtcccagaatccacgcgggtcg

SEQ ID NO: 233986 - DNA, 25 bp, Rattus norvegicus
caggtccccacgatgagatcatgtc

SEQ ID NO: 233987 - DNA, 25 bp, Rattus norvegicus
caggtccccacgttgagatcatgtc

SEQ ID NO: 233988 - DNA, 25 bp, Rattus norvegicus
caggtccccagtcctgaggctatgg

SEQ ID NO: 233989 - DNA, 25 bp, Rattus norvegicus
caggtccccagtgctgaggctatgg

SEQ ID NO: 233990 - DNA, 25 bp, Rattus norvegicus
caggtccccgtcagggagccttctg

SEQ ID NO: 233991 - DNA, 25 bp, Rattus norvegicus
caggtccccgtctgggagccttctg

SEQ ID NO: 233992 - DNA, 25 bp, Rattus norvegicus
caggtccctcaaccctaaatgtgga

SEQ ID NO: 233993 - DNA, 25 bp, Rattus norvegicus
caggtccctcaagcctaaatgtgga

SEQ ID NO: 233994 - DNA, 25 bp, Rattus norvegicus
caggtccctctgagagcttcttgaa

SEQ ID NO: 233995 - DNA, 25 bp, Rattus norvegicus
caggtccctctgtgagcttcttgaa

SEQ ID NO: 233996 - DNA, 25 bp, Rattus norvegicus
caggtccctggcacaggagtccagt

SEQ ID NO: 233997 - DNA, 25 bp, Rattus norvegicus
caggtccctggctcaggagtccagt

SEQ ID NO: 233998 - DNA, 25 bp, Rattus norvegicus
caggtccctggtcatggagcgtcaa

SEQ ID NO: 233999 - DNA, 25 bp, Rattus norvegicus
caggtccctggtgatggagcgtcaa

SEQ ID NO: 234000 - DNA, 25 bp, Rattus norvegicus
caggtccctgttccaatttcatttg

SEQ ID NO: 234001 - DNA, 25 bp, Rattus norvegicus
caggtccctgttgcaatttcatttg

SEQ ID NO: 234002 - DNA, 25 bp, Rattus norvegicus
caggtccgatctatgctggagatat

SEQ ID NO: 234003 - DNA, 25 bp, Rattus norvegicus
caggtccgatctttgctggagatat

SEQ ID NO: 234004 - DNA, 25 bp, Rattus norvegicus
caggtccggattaggaattggaagc

SEQ ID NO: 234005 - DNA, 25 bp, Rattus norvegicus
caggtccggatttggaattggaagc

SEQ ID NO: 234006 - DNA, 25 bp, Rattus norvegicus
caggtcctgccccaataaagcgtct

SEQ ID NO: 234007 - DNA, 25 bp, Rattus norvegicus
caggtcctgcccgaataaagcgtct

SEQ ID NO: 234008 - DNA, 25 bp, Rattus norvegicus
caggtcctgctgaagttcttagtga

SEQ ID NO: 234009 - DNA, 25 bp, Rattus norvegicus
caggtcctgctgtagttcttagtga

SEQ ID NO: 234010 - DNA, 25 bp, Rattus norvegicus
caggtcctgcttcagaaacactcaa

SEQ ID NO: 234011 - DNA, 25 bp, Rattus norvegicus
caggtcctgcttgagaaacactcaa

SEQ ID NO: 234012 - DNA, 25 bp, Rattus norvegicus
caggtcctggtgaatgctatcatca

SEQ ID NO: 234013 - DNA, 25 bp, Rattus norvegicus
caggtcctggtgtatgctatcatca

SEQ ID NO: 234014 - DNA, 25 bp, Rattus norvegicus
caggtccttctcaagtttgactgta

SEQ ID NO: 234015 - DNA, 25 bp, Rattus norvegicus
caggtccttctctagtttgactgta

SEQ ID NO: 234016 - DNA, 25 bp, Rattus norvegicus
caggtcctttggcatccggagaaat

SEQ ID NO: 234017 - DNA, 25 bp, Rattus norvegicus
caggtcctttgggatccggagaaat

SEQ ID NO: 234018 - DNA, 25 bp, Rattus norvegicus
caggtcgaacggatgcagatgatca

SEQ ID NO: 234019 - DNA, 25 bp, Rattus norvegicus
caggtcgaacggttgcagatgatca

SEQ ID NO: 234020 - DNA, 25 bp, Rattus norvegicus
caggtcgagggtctttctagaattt

SEQ ID NO: 234021 - DNA, 25 bp, Rattus norvegicus
caggtcgagggtgtttctagaattt

SEQ ID NO: 234022 - DNA, 25 bp, Rattus norvegicus
caggtcgaggtcacggaggcattct

SEQ ID NO: 234023 - DNA, 25 bp, Rattus norvegicus
caggtcgaggtctcggaggcattct

SEQ ID NO: 234024 - DNA, 25 bp, Rattus norvegicus
caggtcggtcggctggtggctgcct

SEQ ID NO: 234025 - DNA, 25 bp, Rattus norvegicus
caggtcggtcgggtggtggctgcct

SEQ ID NO: 234026 - DNA, 25 bp, Rattus norvegicus
caggtcggttttcgatgcaggttct

SEQ ID NO: 234027 - DNA, 25 bp, Rattus norvegicus
caggtcggttttggatgcaggttct

SEQ ID NO: 234028 - DNA, 25 bp, Rattus norvegicus
caggtcgtcgtgataaccaggaaca

SEQ ID NO: 234029 - DNA, 25 bp, Rattus norvegicus
caggtcgtcgtgttaaccaggaaca

SEQ ID NO: 234030 - DNA, 25 bp, Rattus norvegicus
caggtcgtgactccttagagtttaa

SEQ ID NO: 234031 - DNA, 25 bp, Rattus norvegicus
caggtcgtgactgcttagagtttaa

SEQ ID NO: 234032 - DNA, 25 bp, Rattus norvegicus
caggtctaacctctaagttgtgtat

SEQ ID NO: 234033 - DNA, 25 bp, Rattus norvegicus
caggtctaacctgtaagttgtgtat

SEQ ID NO: 234034 - DNA, 25 bp, Rattus norvegicus
caggtctaagaactgctacgtggta

SEQ ID NO: 234035 - DNA, 25 bp, Rattus norvegicus
caggtctaagaagtgctacgtggta

SEQ ID NO: 234036 - DNA, 25 bp, Rattus norvegicus
caggtctacattaggagttccaagc

SEQ ID NO: 234037 - DNA, 25 bp, Rattus norvegicus
caggtctacatttggagttccaagc

SEQ ID NO: 234038 - DNA, 25 bp, Rattus norvegicus
caggtctaccgtcagttccagaatc

SEQ ID NO: 234039 - DNA, 25 bp, Rattus norvegicus
caggtctaccgtgagttccagaatc

SEQ ID NO: 234040 - DNA, 25 bp, Rattus norvegicus
caggtctacctacagcaatcttagc

SEQ ID NO: 234041 - DNA, 25 bp, Rattus norvegicus
caggtctacctagagcaatcttagc

SEQ ID NO: 234042 - DNA, 25 bp, Rattus norvegicus
caggtctaggcaatcagttccaaga

SEQ ID NO: 234043 - DNA, 25 bp, Rattus norvegicus
caggtctaggcattcagttccaaga

SEQ ID NO: 234044 - DNA, 25 bp, Rattus norvegicus
caggtctatcatatggtttgacaga

SEQ ID NO: 234045 - DNA, 25 bp, Rattus norvegicus
caggtctatcatttggtttgacaga

SEQ ID NO: 234046 - DNA, 25 bp, Rattus norvegicus
caggtctcaagtactcagtgctcag

SEQ ID NO: 234047 - DNA, 25 bp, Rattus norvegicus
caggtctcaagttctcagtgctcag

SEQ ID NO: 234048 - DNA, 25 bp, Rattus norvegicus
caggtctcagccattggttttcaaa

SEQ ID NO: 234049 - DNA, 25 bp, Rattus norvegicus
caggtctcagcctttggttttcaaa

SEQ ID NO: 234050 - DNA, 25 bp, Rattus norvegicus
caggtctccatcacggaaactaatc

SEQ ID NO: 234051 - DNA, 25 bp, Rattus norvegicus
caggtctccatctcggaaactaatc

SEQ ID NO: 234052 - DNA, 25 bp, Rattus norvegicus
caggtctccctactcatcaattatg

SEQ ID NO: 234053 - DNA, 25 bp, Rattus norvegicus
caggtctccctagtcatcaattatg

SEQ ID NO: 234054 - DNA, 25 bp, Rattus norvegicus
caggtctcccttaagtactgtggaa

SEQ ID NO: 234055 - DNA, 25 bp, Rattus norvegicus
caggtctccctttagtactgtggaa

SEQ ID NO: 234056 - DNA, 25 bp, Rattus norvegicus
caggtctcctagactgatagctggg

SEQ ID NO: 234057 - DNA, 25 bp, Rattus norvegicus
caggtctcctagtctgatagctggg

SEQ ID NO: 234058 - DNA, 25 bp, Rattus norvegicus
caggtctccttgacatcatttcaaa

SEQ ID NO: 234059 - DNA, 25 bp, Rattus norvegicus
caggtctccttgtcatcatttcaaa

SEQ ID NO: 234060 - DNA, 25 bp, Rattus norvegicus
caggtctcggcgcacagctgcatcg

SEQ ID NO: 234061 - DNA, 25 bp, Rattus norvegicus
caggtctcggcggacagctgcatcg

SEQ ID NO: 234062 - DNA, 25 bp, Rattus norvegicus
caggtctctcccatgtgttttatac

SEQ ID NO: 234063 - DNA, 25 bp, Rattus norvegicus
caggtctctcccttgtgttttatac

SEQ ID NO: 234064 - DNA, 25 bp, Rattus norvegicus
caggtctctgcactgtatataaaac

SEQ ID NO: 234065 - DNA, 25 bp, Rattus norvegicus
caggtctctgcagtgtatataaaac

SEQ ID NO: 234066 - DNA, 25 bp, Rattus norvegicus
caggtctctggaacattatgggtaa

SEQ ID NO: 234067 - DNA, 25 bp, Rattus norvegicus
caggtctctggatcattatgggtaa

SEQ ID NO: 234068 - DNA, 25 bp, Rattus norvegicus
caggtctctttgacgagggaggctt

SEQ ID NO: 234069 - DNA, 25 bp, Rattus norvegicus
caggtctctttgtcgagggaggctt

SEQ ID NO: 234070 - DNA, 25 bp, Rattus norvegicus
caggtctgacagctagaagatgctt

SEQ ID NO: 234071 - DNA, 25 bp, Rattus norvegicus
caggtctgacaggtagaagatgctt

SEQ ID NO: 234072 - DNA, 25 bp, Rattus norvegicus
caggtctgacctaggcagtggattt

SEQ ID NO: 234073 - DNA, 25 bp, Rattus norvegicus
caggtctgaccttggcagtggattt

SEQ ID NO: 234074 - DNA, 25 bp, Rattus norvegicus
caggtctgagaaatacccattttta

SEQ ID NO: 234075 - DNA, 25 bp, Rattus norvegicus
caggtctgagaattacccattttta

SEQ ID NO: 234076 - DNA, 25 bp, Rattus norvegicus
caggtctgccatcttttcaggtgac

SEQ ID NO: 234077 - DNA, 25 bp, Rattus norvegicus
caggtctgccatgttttcaggtgac

SEQ ID NO: 234078 - DNA, 25 bp, Rattus norvegicus
caggtctgggctaccttttggagag

SEQ ID NO: 234079 - DNA, 25 bp, Rattus norvegicus
caggtctgggcttccttttggagag

SEQ ID NO: 234080 - DNA, 25 bp, Rattus norvegicus
caggtctggtggaagcaatgtttac

SEQ ID NO: 234081 - DNA, 25 bp, Rattus norvegicus
caggtctggtggtagcaatgtttac

SEQ ID NO: 234082 - DNA, 25 bp, Rattus norvegicus
caggtctgtaaaatggcgggtcccg

SEQ ID NO: 234083 - DNA, 25 bp, Rattus norvegicus
caggtctgtaaattggcgggtcccg

SEQ ID NO: 234084 - DNA, 25 bp, Rattus norvegicus
caggtcttcataaaccctaaggtgt

SEQ ID NO: 234085 - DNA, 25 bp, Rattus norvegicus
caggtcttcatataccctaaggtgt

SEQ ID NO: 234086 - DNA, 25 bp, Rattus norvegicus
caggtcttcctgaagtggtctccaa

SEQ ID NO: 234087 - DNA, 25 bp, Rattus norvegicus
caggtcttcctgctgctatagcaga

SEQ ID NO: 234088 - DNA, 25 bp, Rattus norvegicus
caggtcttcctggtgctatagcaga

SEQ ID NO: 234089 - DNA, 25 bp, Rattus norvegicus
caggtcttcctgtagtggtctccaa

SEQ ID NO: 234090 - DNA, 25 bp, Rattus norvegicus
caggtcttctgacgtgactgctact

SEQ ID NO: 234091 - DNA, 25 bp, Rattus norvegicus
caggtcttctgaggtgactgctact

SEQ ID NO: 234092 - DNA, 25 bp, Rattus norvegicus
caggtcttcttacagctctgcaagg

SEQ ID NO: 234093 - DNA, 25 bp, Rattus norvegicus
caggtcttcttagagctctgcaagg

SEQ ID NO: 234094 - DNA, 25 bp, Rattus norvegicus
caggtcttgcatcgtgggtcagttc

SEQ ID NO: 234095 - DNA, 25 bp, Rattus norvegicus
caggtcttgcatggtgggtcagttc

SEQ ID NO: 234096 - DNA, 25 bp, Rattus norvegicus
caggtcttggctacaatctgttcaa

SEQ ID NO: 234097 - DNA, 25 bp, Rattus norvegicus
caggtcttggctccacaccattgtg

SEQ ID NO: 234098 - DNA, 25 bp, Rattus norvegicus
caggtcttggctgcacaccattgtg

SEQ ID NO: 234099 - DNA, 25 bp, Rattus norvegicus
caggtcttggcttcaatctgttcaa

SEQ ID NO: 234100 - DNA, 25 bp, Rattus norvegicus
caggtctttctgatcttccaggaat

SEQ ID NO: 234101 - DNA, 25 bp, Rattus norvegicus
caggtctttctgttcttccaggaat

SEQ ID NO: 234102 - DNA, 25 bp, Rattus norvegicus
caggtctttggtacctgatcggttt

SEQ ID NO: 234103 - DNA, 25 bp, Rattus norvegicus
caggtctttggttcctgatcggttt

SEQ ID NO: 234104 - DNA, 25 bp, Rattus norvegicus
caggtctttgtgatggaatatcttc

SEQ ID NO: 234105 - DNA, 25 bp, Rattus norvegicus
caggtctttgtgttggaatatcttc

SEQ ID NO: 234106 - DNA, 25 bp, Rattus norvegicus
caggtgaaccgcagggcttgtgaaa

SEQ ID NO: 234107 - DNA, 25 bp, Rattus norvegicus
caggtgaaccgctgggcttgtgaaa

SEQ ID NO: 234108 - DNA, 25 bp, Rattus norvegicus
caggtgaacgaaaccccagcagggt

SEQ ID NO: 234109 - DNA, 25 bp, Rattus norvegicus
caggtgaacgaatccccagcagggt

SEQ ID NO: 234110 - DNA, 25 bp, Rattus norvegicus
caggtgaagccaccacttgatgcgg

SEQ ID NO: 234111 - DNA, 25 bp, Rattus norvegicus
caggtgaagccagcacttgatgcgg

SEQ ID NO: 234112 - DNA, 25 bp, Rattus norvegicus
caggtgacaggactgcacagcgcac

SEQ ID NO: 234113 - DNA, 25 bp, Rattus norvegicus
caggtgacaggagtgcacagcgcac

SEQ ID NO: 234114 - DNA, 25 bp, Rattus norvegicus
caggtgaccagtccatgaggtgtta

SEQ ID NO: 234115 - DNA, 25 bp, Rattus norvegicus
caggtgaccagtgcatgaggtgtta

SEQ ID NO: 234116 - DNA, 25 bp, Rattus norvegicus
caggtgacccctcgaggtatagaca

SEQ ID NO: 234117 - DNA, 25 bp, Rattus norvegicus
caggtgacccctggaggtatagaca

SEQ ID NO: 234118 - DNA, 25 bp, Rattus norvegicus
caggtgaccggccagaaacccaagc

SEQ ID NO: 234119 - DNA, 25 bp, Rattus norvegicus
caggtgaccggcgagaaacccaagc

SEQ ID NO: 234120 - DNA, 25 bp, Rattus norvegicus
caggtgactcttacttgggatttct

SEQ ID NO: 234121 - DNA, 25 bp, Rattus norvegicus
caggtgactcttaggatcaagggca

SEQ ID NO: 234122 - DNA, 25 bp, Rattus norvegicus
caggtgactctttcttgggatttct

SEQ ID NO: 234123 - DNA, 25 bp, Rattus norvegicus
caggtgactctttggatcaagggca

SEQ ID NO: 234124 - DNA, 25 bp, Rattus norvegicus
caggtgagccagagcctgtgtagaa

SEQ ID NO: 234125 - DNA, 25 bp, Rattus norvegicus
caggtgagccagagtgcaagctgca

SEQ ID NO: 234126 - DNA, 25 bp, Rattus norvegicus
caggtgagccagtgcctgtgtagaa

SEQ ID NO: 234127 - DNA, 25 bp, Rattus norvegicus
caggtgagccagtgtgcaagctgca

SEQ ID NO: 234128 - DNA, 25 bp, Rattus norvegicus
caggtgatagcaacttctccccttt

SEQ ID NO: 234129 - DNA, 25 bp, Rattus norvegicus
caggtgatagcatcttctccccttt

SEQ ID NO: 234130 - DNA, 25 bp, Rattus norvegicus
caggtgatccatcgtgaggtcttaa

SEQ ID NO: 234131 - DNA, 25 bp, Rattus norvegicus
caggtgatccatggtgaggtcttaa

SEQ ID NO: 234132 - DNA, 25 bp, Rattus norvegicus
caggtgatcctgatcatactttgga

SEQ ID NO: 234133 - DNA, 25 bp, Rattus norvegicus
caggtgatcctgttcatactttgga

SEQ ID NO: 234134 - DNA, 25 bp, Rattus norvegicus
caggtgatgcgacccaggagccaaa

SEQ ID NO: 234135 - DNA, 25 bp, Rattus norvegicus
caggtgatgcgagccaggagccaaa

SEQ ID NO: 234136 - DNA, 25 bp, Rattus norvegicus
caggtgattctgaccttcataggtc

SEQ ID NO: 234137 - DNA, 25 bp, Rattus norvegicus
caggtgattctgtccttcataggtc

SEQ ID NO: 234138 - DNA, 25 bp, Rattus norvegicus
caggtgcaagaacaaaccctctttt

SEQ ID NO: 234139 - DNA, 25 bp, Rattus norvegicus
caggtgcaagaagaaaccctctttt

SEQ ID NO: 234140 - DNA, 25 bp, Rattus norvegicus
caggtgcagccacatctcacaaagt

SEQ ID NO: 234141 - DNA, 25 bp, Rattus norvegicus
caggtgcagccagatctcacaaagt

SEQ ID NO: 234142 - DNA, 25 bp, Rattus norvegicus
caggtgcagggtcacattcttctaa

SEQ ID NO: 234143 - DNA, 25 bp, Rattus norvegicus
caggtgcagggtgacattcttctaa

SEQ ID NO: 234144 - DNA, 25 bp, Rattus norvegicus
caggtgcatgtgactgccagtgaca

SEQ ID NO: 234145 - DNA, 25 bp, Rattus norvegicus
caggtgcatgtgtctgccagtgaca

SEQ ID NO: 234146 - DNA, 25 bp, Rattus norvegicus
caggtgcattgtctgtcagaatttt

SEQ ID NO: 234147 - DNA, 25 bp, Rattus norvegicus
caggtgcattgtgtgtcagaatttt

SEQ ID NO: 234148 - DNA, 25 bp, Rattus norvegicus
caggtgccaggaatgttgttctgga

SEQ ID NO: 234149 - DNA, 25 bp, Rattus norvegicus
caggtgccaggattgttgttctgga

SEQ ID NO: 234150 - DNA, 25 bp, Rattus norvegicus
caggtgccatttctctcaaggtttc

SEQ ID NO: 234151 - DNA, 25 bp, Rattus norvegicus
caggtgccatttgtctcaaggtttc

SEQ ID NO: 234152 - DNA, 25 bp, Rattus norvegicus
caggtgcctaggacttcgaggccaa

SEQ ID NO: 234153 - DNA, 25 bp, Rattus norvegicus
caggtgcctaggtcttcgaggccaa

SEQ ID NO: 234154 - DNA, 25 bp, Rattus norvegicus
caggtgcctcatccacggtaaaata

SEQ ID NO: 234155 - DNA, 25 bp, Rattus norvegicus
caggtgcctcatgcacggtaaaata

SEQ ID NO: 234156 - DNA, 25 bp, Rattus norvegicus
caggtgcctgacactgccatgtggg

SEQ ID NO: 234157 - DNA, 25 bp, Rattus norvegicus
caggtgcctgactctgccatgtggg

SEQ ID NO: 234158 - DNA, 25 bp, Rattus norvegicus
caggtgcgatttaggatcttgtaaa

SEQ ID NO: 234159 - DNA, 25 bp, Rattus norvegicus
caggtgcgattttggatcttgtaaa

SEQ ID NO: 234160 - DNA, 25 bp, Rattus norvegicus
caggtgctaagtatcagtgctaaat

SEQ ID NO: 234161 - DNA, 25 bp, Rattus norvegicus
caggtgctaagtttcagtgctaaat

SEQ ID NO: 234162 - DNA, 25 bp, Rattus norvegicus
caggtgctattgctaggcttcagga

SEQ ID NO: 234163 - DNA, 25 bp, Rattus norvegicus
caggtgctattggtaggcttcagga

SEQ ID NO: 234164 - DNA, 25 bp, Rattus norvegicus
caggtgctggagacgtgcactgcaa

SEQ ID NO: 234165 - DNA, 25 bp, Rattus norvegicus
caggtgctggagacttttgtgtgtc

SEQ ID NO: 234166 - DNA, 25 bp, Rattus norvegicus
caggtgctggagtcgtgcactgcaa

SEQ ID NO: 234167 - DNA, 25 bp, Rattus norvegicus
caggtgctggagtcttttgtgtgtc

SEQ ID NO: 234168 - DNA, 25 bp, Rattus norvegicus
caggtgctgggtacaaaggtttgca

SEQ ID NO: 234169 - DNA, 25 bp, Rattus norvegicus
caggtgctgggttcaaaggtttgca

SEQ ID NO: 234170 - DNA, 25 bp, Rattus norvegicus
caggtgctgtaacactactgttgtt

SEQ ID NO: 234171 - DNA, 25 bp, Rattus norvegicus
caggtgctgtaagactactgttgtt

SEQ ID NO: 234172 - DNA, 25 bp, Rattus norvegicus
caggtgctttatacattaagagcta

SEQ ID NO: 234173 - DNA, 25 bp, Rattus norvegicus
caggtgctttattcattaagagcta

SEQ ID NO: 234174 - DNA, 25 bp, Rattus norvegicus
caggtgctttttactcaagtgggaa

SEQ ID NO: 234175 - DNA, 25 bp, Rattus norvegicus
caggtgcttttttctcaagtgggaa

SEQ ID NO: 234176 - DNA, 25 bp, Rattus norvegicus
caggtggaacacaatgcagagcttt

SEQ ID NO: 234177 - DNA, 25 bp, Rattus norvegicus
caggtggaacactatgcagagcttt

SEQ ID NO: 234178 - DNA, 25 bp, Rattus norvegicus
caggtggaaccaaccaggctcagga

SEQ ID NO: 234179 - DNA, 25 bp, Rattus norvegicus
caggtggaaccatccaggctcagga

SEQ ID NO: 234180 - DNA, 25 bp, Rattus norvegicus
caggtggagtgaactgtcgtcccca

SEQ ID NO: 234181 - DNA, 25 bp, Rattus norvegicus
caggtggagtgatctgtcgtcccca

SEQ ID NO: 234182 - DNA, 25 bp, Rattus norvegicus
caggtggatacacaactcccattcc

SEQ ID NO: 234183 - DNA, 25 bp, Rattus norvegicus
caggtggatacagaactcccattcc

SEQ ID NO: 234184 - DNA, 25 bp, Rattus norvegicus
caggtggatctactttgtgtcaagt

SEQ ID NO: 234185 - DNA, 25 bp, Rattus norvegicus
caggtggatctagtttgtgtcaagt

SEQ ID NO: 234186 - DNA, 25 bp, Rattus norvegicus
caggtggcagcacacgtgtcatgca

SEQ ID NO: 234187 - DNA, 25 bp, Rattus norvegicus
caggtggcagcagacgtgtcatgca

SEQ ID NO: 234188 - DNA, 25 bp, Rattus norvegicus
caggtggcagtgcagactcttctag

SEQ ID NO: 234189 - DNA, 25 bp, Rattus norvegicus
caggtggcagtggagactcttctag

SEQ ID NO: 234190 - DNA, 25 bp, Rattus norvegicus
caggtggccattaggagtctcagca

SEQ ID NO: 234191 - DNA, 25 bp, Rattus norvegicus
caggtggccatttggagtctcagca

SEQ ID NO: 234192 - DNA, 25 bp, Rattus norvegicus
caggtggcccacacagaaattattg

SEQ ID NO: 234193 - DNA, 25 bp, Rattus norvegicus
caggtggcccactcagaaattattg

SEQ ID NO: 234194 - DNA, 25 bp, Rattus norvegicus
caggtggcctgcagaagtcagttga

SEQ ID NO: 234195 - DNA, 25 bp, Rattus norvegicus
caggtggcctgctgaagtcagttga

SEQ ID NO: 234196 - DNA, 25 bp, Rattus norvegicus
caggtggctggactgtcctagtttt

SEQ ID NO: 234197 - DNA, 25 bp, Rattus norvegicus
caggtggctggagtgtcctagtttt

SEQ ID NO: 234198 - DNA, 25 bp, Rattus norvegicus
caggtgggagaaactgccgcagttt

SEQ ID NO: 234199 - DNA, 25 bp, Rattus norvegicus
caggtgggagaatctgccgcagttt

SEQ ID NO: 234200 - DNA, 25 bp, Rattus norvegicus
caggtgggcctgaagcatcttttat

SEQ ID NO: 234201 - DNA, 25 bp, Rattus norvegicus
caggtgggcctgtagcatcttttat

SEQ ID NO: 234202 - DNA, 25 bp, Rattus norvegicus
caggtggtctctctgaggtcaagac

SEQ ID NO: 234203 - DNA, 25 bp, Rattus norvegicus
caggtggtctctgtgaggtcaagac

SEQ ID NO: 234204 - DNA, 25 bp, Rattus norvegicus
caggtggtgtgaatcttaacagcaa

SEQ ID NO: 234205 - DNA, 25 bp, Rattus norvegicus
caggtggtgtgattcttaacagcaa

SEQ ID NO: 234206 - DNA, 25 bp, Rattus norvegicus
caggtgtaaggtattctgtgcaaaa

SEQ ID NO: 234207 - DNA, 25 bp, Rattus norvegicus
caggtgtaaggttttctgtgcaaaa

SEQ ID NO: 234208 - DNA, 25 bp, Rattus norvegicus
caggtgtaatagaccaggctgtgaa

SEQ ID NO: 234209 - DNA, 25 bp, Rattus norvegicus
caggtgtaatagtccaggctgtgaa

SEQ ID NO: 234210 - DNA, 25 bp, Rattus norvegicus
caggtgtaggctccagttttatttt

SEQ ID NO: 234211 - DNA, 25 bp, Rattus norvegicus
caggtgtaggctgcagttttatttt

SEQ ID NO: 234212 - DNA, 25 bp, Rattus norvegicus
caggtgtcagatatcaggttcatgt

SEQ ID NO: 234213 - DNA, 25 bp, Rattus norvegicus
caggtgtcagatttcaggttcatgt

SEQ ID NO: 234214 - DNA, 25 bp, Rattus norvegicus
caggtgtcagcgcagctgtaaatag

SEQ ID NO: 234215 - DNA, 25 bp, Rattus norvegicus
caggtgtcagcggagctgtaaatag

SEQ ID NO: 234216 - DNA, 25 bp, Rattus norvegicus
caggtgtcccggcaaacggatgcaa

SEQ ID NO: 234217 - DNA, 25 bp, Rattus norvegicus
caggtgtcccgggaaacggatgcaa

SEQ ID NO: 234218 - DNA, 25 bp, Rattus norvegicus
caggtgtctgttccctctggcacat

SEQ ID NO: 234219 - DNA, 25 bp, Rattus norvegicus
caggtgtctgttgcctctggcacat

SEQ ID NO: 234220 - DNA, 25 bp, Rattus norvegicus
caggtgtgaacaatgctcagccctc

SEQ ID NO: 234221 - DNA, 25 bp, Rattus norvegicus
caggtgtgaacattgctcagccctc

SEQ ID NO: 234222 - DNA, 25 bp, Rattus norvegicus
caggtgtgacttaatggttgacttt

SEQ ID NO: 234223 - DNA, 25 bp, Rattus norvegicus
caggtgtgactttatggttgacttt

SEQ ID NO: 234224 - DNA, 25 bp, Rattus norvegicus
caggtgtgattgctttttgctcata

SEQ ID NO: 234225 - DNA, 25 bp, Rattus norvegicus
caggtgtgattggtttttgctcata

SEQ ID NO: 234226 - DNA, 25 bp, Rattus norvegicus
caggtgtgctccatcctctggtctc

SEQ ID NO: 234227 - DNA, 25 bp, Rattus norvegicus
caggtgtgctccttcctctggtctc

SEQ ID NO: 234228 - DNA, 25 bp, Rattus norvegicus
caggtgtgggctacctgtaagacct

SEQ ID NO: 234229 - DNA, 25 bp, Rattus norvegicus
caggtgtgggcttcctgtaagacct

SEQ ID NO: 234230 - DNA, 25 bp, Rattus norvegicus
caggtgtggtagctactgcctttaa

SEQ ID NO: 234231 - DNA, 25 bp, Rattus norvegicus
caggtgtggtaggtactgcctttaa

SEQ ID NO: 234232 - DNA, 25 bp, Rattus norvegicus
caggtgtggtgcctcactcatgtaa

SEQ ID NO: 234233 - DNA, 25 bp, Rattus norvegicus
caggtgtggtgcgtcactcatgtaa

SEQ ID NO: 234234 - DNA, 25 bp, Rattus norvegicus
caggtgtgtccacccagatcaagaa

SEQ ID NO: 234235 - DNA, 25 bp, Rattus norvegicus
caggtgtgtccagccagatcaagaa

SEQ ID NO: 234236 - DNA, 25 bp, Rattus norvegicus
caggtgttacttagtgttttgtgca

SEQ ID NO: 234237 - DNA, 25 bp, Rattus norvegicus
caggtgttactttgtgttttgtgca

SEQ ID NO: 234238 - DNA, 25 bp, Rattus norvegicus
caggtgttagagatctggtcaacca

SEQ ID NO: 234239 - DNA, 25 bp, Rattus norvegicus
caggtgttagagttctggtcaacca

SEQ ID NO: 234240 - DNA, 25 bp, Rattus norvegicus
caggtgttcctaccagagtgtgata

SEQ ID NO: 234241 - DNA, 25 bp, Rattus norvegicus
caggtgttcctagcagagtgtgata

SEQ ID NO: 234242 - DNA, 25 bp, Rattus norvegicus
caggtgttctccatggatgcttgga

SEQ ID NO: 234243 - DNA, 25 bp, Rattus norvegicus
caggtgttctccttggatgcttgga

SEQ ID NO: 234244 - DNA, 25 bp, Rattus norvegicus
caggtgttcttccatggcgtacaag

SEQ ID NO: 234245 - DNA, 25 bp, Rattus norvegicus
caggtgttcttcgatggcgtacaag

SEQ ID NO: 234246 - DNA, 25 bp, Rattus norvegicus
caggtgtttatcactgctggaattt

SEQ ID NO: 234247 - DNA, 25 bp, Rattus norvegicus
caggtgtttatctctgctggaattt

SEQ ID NO: 234248 - DNA, 25 bp, Rattus norvegicus
caggtgtttcggacttgcaattagc

SEQ ID NO: 234249 - DNA, 25 bp, Rattus norvegicus
caggtgtttcggtcttgcaattagc

SEQ ID NO: 234250 - DNA, 25 bp, Rattus norvegicus
caggtgtttcgtagttctatgctaa

SEQ ID NO: 234251 - DNA, 25 bp, Rattus norvegicus
caggtgtttcgttgttctatgctaa

SEQ ID NO: 234252 - DNA, 25 bp, Rattus norvegicus
caggtgtttgacatgtaactggcac

SEQ ID NO: 234253 - DNA, 25 bp, Rattus norvegicus
caggtgtttgacttgtaactggcac

SEQ ID NO: 234254 - DNA, 25 bp, Rattus norvegicus
caggtgtttgtgatttggctctctc

SEQ ID NO: 234255 - DNA, 25 bp, Rattus norvegicus
caggtgtttgtgttttggctctctc

SEQ ID NO: 234256 - DNA, 25 bp, Rattus norvegicus
caggttaaattgatcagcaaactca

SEQ ID NO: 234257 - DNA, 25 bp, Rattus norvegicus
caggttaaattgttcagcaaactca

SEQ ID NO: 234258 - DNA, 25 bp, Rattus norvegicus
caggttaccccaactaccagcagta

SEQ ID NO: 234259 - DNA, 25 bp, Rattus norvegicus
caggttaccccatctaccagcagta

SEQ ID NO: 234260 - DNA, 25 bp, Rattus norvegicus
caggttaccctgcactaagtggcca

SEQ ID NO: 234261 - DNA, 25 bp, Rattus norvegicus
caggttaccctggactaagtggcca

SEQ ID NO: 234262 - DNA, 25 bp, Rattus norvegicus
caggttacgacacgcctgcaggtgc

SEQ ID NO: 234263 - DNA, 25 bp, Rattus norvegicus
caggttacgacaggcctgcaggtgc

SEQ ID NO: 234264 - DNA, 25 bp, Rattus norvegicus
caggttactgacctttacttggcgg

SEQ ID NO: 234265 - DNA, 25 bp, Rattus norvegicus
caggttactgacgtttacttggcgg

SEQ ID NO: 234266 - DNA, 25 bp, Rattus norvegicus
caggttactgttatgccttattgct

SEQ ID NO: 234267 - DNA, 25 bp, Rattus norvegicus
caggttactgttttgccttattgct

SEQ ID NO: 234268 - DNA, 25 bp, Rattus norvegicus
caggttagaagtcctctggaggctt

SEQ ID NO: 234269 - DNA, 25 bp, Rattus norvegicus
caggttagaagtgctctggaggctt

SEQ ID NO: 234270 - DNA, 25 bp, Rattus norvegicus
caggttagccaccattagcatctat

SEQ ID NO: 234271 - DNA, 25 bp, Rattus norvegicus
caggttagccacgattagcatctat

SEQ ID NO: 234272 - DNA, 25 bp, Rattus norvegicus
caggttagctacacaaagggcttct

SEQ ID NO: 234273 - DNA, 25 bp, Rattus norvegicus
caggttagctactcaaagggcttct

SEQ ID NO: 234274 - DNA, 25 bp, Rattus norvegicus
caggttagtaacattgtgcactctt

SEQ ID NO: 234275 - DNA, 25 bp, Rattus norvegicus
caggttagtaactttgtgcactctt

SEQ ID NO: 234276 - DNA, 25 bp, Rattus norvegicus
caggttatacagcacattgccctaa

SEQ ID NO: 234277 - DNA, 25 bp, Rattus norvegicus
caggttatacaggacattgccctaa

SEQ ID NO: 234278 - DNA, 25 bp, Rattus norvegicus
caggttatgaaaatgtcccagtgac

SEQ ID NO: 234279 - DNA, 25 bp, Rattus norvegicus
caggttatgaaattgtcccagtgac

SEQ ID NO: 234280 - DNA, 25 bp, Rattus norvegicus
caggttatgatcagctggccatgtt

SEQ ID NO: 234281 - DNA, 25 bp, Rattus norvegicus
caggttatgatctgctggccatgtt

SEQ ID NO: 234282 - DNA, 25 bp, Rattus norvegicus
caggttatttggatgttagtggtgc

SEQ ID NO: 234283 - DNA, 25 bp, Rattus norvegicus
caggttatttggttgttagtggtgc

SEQ ID NO: 234284 - DNA, 25 bp, Rattus norvegicus
caggttcagagactttgggcctaga

SEQ ID NO: 234285 - DNA, 25 bp, Rattus norvegicus
caggttcagagagtttgggcctaga

SEQ ID NO: 234286 - DNA, 25 bp, Rattus norvegicus
caggttcaggttaatccgcagatac

SEQ ID NO: 234287 - DNA, 25 bp, Rattus norvegicus
caggttcaggtttatccgcagatac

SEQ ID NO: 234288 - DNA, 25 bp, Rattus norvegicus
caggttcatccaattatcttggcag

SEQ ID NO: 234289 - DNA, 25 bp, Rattus norvegicus
caggttcatccatttatcttggcag

SEQ ID NO: 234290 - DNA, 25 bp, Rattus norvegicus
caggttccactgcatctgaacgttg

SEQ ID NO: 234291 - DNA, 25 bp, Rattus norvegicus
caggttccactggatctgaacgttg

SEQ ID NO: 234292 - DNA, 25 bp, Rattus norvegicus
caggttcccagcactgtgagatgat

SEQ ID NO: 234293 - DNA, 25 bp, Rattus norvegicus
caggttcccagctctgtgagatgat

SEQ ID NO: 234294 - DNA, 25 bp, Rattus norvegicus
caggttccccgtcctgctgtgagga

SEQ ID NO: 234295 - DNA, 25 bp, Rattus norvegicus
caggttccccgtgctgctgtgagga

SEQ ID NO: 234296 - DNA, 25 bp, Rattus norvegicus
caggttcctgctatgcttgggttcc

SEQ ID NO: 234297 - DNA, 25 bp, Rattus norvegicus
caggttcctgctttgcttgggttcc

SEQ ID NO: 234298 - DNA, 25 bp, Rattus norvegicus
caggttcctgtgattcgattggtgt

SEQ ID NO: 234299 - DNA, 25 bp, Rattus norvegicus
caggttcctgtgtttcgattggtgt

SEQ ID NO: 234300 - DNA, 25 bp, Rattus norvegicus
caggttctgatcctgcgctcgcgcg

SEQ ID NO: 234301 - DNA, 25 bp, Rattus norvegicus
caggttctgatcgtgcgctcgcgcg

SEQ ID NO: 234302 - DNA, 25 bp, Rattus norvegicus
caggttctgctgagccaggcttgta

SEQ ID NO: 234303 - DNA, 25 bp, Rattus norvegicus
caggttctgctgtgccaggcttgta

SEQ ID NO: 234304 - DNA, 25 bp, Rattus norvegicus
caggttcttcacctccattttataa

SEQ ID NO: 234305 - DNA, 25 bp, Rattus norvegicus
caggttcttcacgtccattttataa

SEQ ID NO: 234306 - DNA, 25 bp, Rattus norvegicus
caggttgacaataaactggcatttt

SEQ ID NO: 234307 - DNA, 25 bp, Rattus norvegicus
caggttgacaattaactggcatttt

SEQ ID NO: 234308 - DNA, 25 bp, Rattus norvegicus
caggttgatcatacagatgttttct

SEQ ID NO: 234309 - DNA, 25 bp, Rattus norvegicus
caggttgatcattcagatgttttct

SEQ ID NO: 234310 - DNA, 25 bp, Rattus norvegicus
caggttgcacttctagggcttgttg

SEQ ID NO: 234311 - DNA, 25 bp, Rattus norvegicus
caggttgcacttgtagggcttgttg

SEQ ID NO: 234312 - DNA, 25 bp, Rattus norvegicus
caggttgcctttactcctgagaaat

SEQ ID NO: 234313 - DNA, 25 bp, Rattus norvegicus
caggttgccttttctcctgagaaat

SEQ ID NO: 234314 - DNA, 25 bp, Rattus norvegicus
caggttgctctcaagggcttcggag

SEQ ID NO: 234315 - DNA, 25 bp, Rattus norvegicus
caggttgctctctagggcttcggag

SEQ ID NO: 234316 - DNA, 25 bp, Rattus norvegicus
caggttgctgtgaaaagtcacactt

SEQ ID NO: 234317 - DNA, 25 bp, Rattus norvegicus
caggttgctgtgtaaagtcacactt

SEQ ID NO: 234318 - DNA, 25 bp, Rattus norvegicus
caggttgcttctccgtattctggag

SEQ ID NO: 234319 - DNA, 25 bp, Rattus norvegicus
caggttgcttctgcgtattctggag

SEQ ID NO: 234320 - DNA, 25 bp, Rattus norvegicus
caggttggagggaaactcgttgatc

SEQ ID NO: 234321 - DNA, 25 bp, Rattus norvegicus
caggttggagggtaactcgttgatc

SEQ ID NO: 234322 - DNA, 25 bp, Rattus norvegicus
caggttgggaacacatggtgtgtca

SEQ ID NO: 234323 - DNA, 25 bp, Rattus norvegicus
caggttgggaactcatggtgtgtca

SEQ ID NO: 234324 - DNA, 25 bp, Rattus norvegicus
caggttggtgatcttgtttggtcca

SEQ ID NO: 234325 - DNA, 25 bp, Rattus norvegicus
caggttggtgatgttgtttggtcca

SEQ ID NO: 234326 - DNA, 25 bp, Rattus norvegicus
caggttgtccgtctttctattatga

SEQ ID NO: 234327 - DNA, 25 bp, Rattus norvegicus
caggttgtccgtgtttctattatga

SEQ ID NO: 234328 - DNA, 25 bp, Rattus norvegicus
caggttgtctacatttggaaatgca

SEQ ID NO: 234329 - DNA, 25 bp, Rattus norvegicus
caggttgtctacttttggaaatgca

SEQ ID NO: 234330 - DNA, 25 bp, Rattus norvegicus
caggttgtgcaaagaactggcaggc

SEQ ID NO: 234331 - DNA, 25 bp, Rattus norvegicus
caggttgtgcaatgaactggcaggc

SEQ ID NO: 234332 - DNA, 25 bp, Rattus norvegicus
caggtttcagagaggttccagcaac

SEQ ID NO: 234333 - DNA, 25 bp, Rattus norvegicus
caggtttcagagtggttccagcaac

SEQ ID NO: 234334 - DNA, 25 bp, Rattus norvegicus
caggtttcagtcatcccaaggtatc

SEQ ID NO: 234335 - DNA, 25 bp, Rattus norvegicus
caggtttcagtcttcccaaggtatc

SEQ ID NO: 234336 - DNA, 25 bp, Rattus norvegicus
caggtttcatggaactctagttctt

SEQ ID NO: 234337 - DNA, 25 bp, Rattus norvegicus
caggtttcatggtactctagttctt

SEQ ID NO: 234338 - DNA, 25 bp, Rattus norvegicus
caggtttcctggaaaggtcactcga

SEQ ID NO: 234339 - DNA, 25 bp, Rattus norvegicus
caggtttcctggtaaggtcactcga

SEQ ID NO: 234340 - DNA, 25 bp, Rattus norvegicus
caggtttcctttcacctctgaataa

SEQ ID NO: 234341 - DNA, 25 bp, Rattus norvegicus
caggtttcctttgacctctgaataa

SEQ ID NO: 234342 - DNA, 25 bp, Rattus norvegicus
caggtttctgctcttaggctcttaa

SEQ ID NO: 234343 - DNA, 25 bp, Rattus norvegicus
caggtttctgctgttaggctcttaa

SEQ ID NO: 234344 - DNA, 25 bp, Rattus norvegicus
caggtttctttgaggtagtctcggt

SEQ ID NO: 234345 - DNA, 25 bp, Rattus norvegicus
caggtttctttgtggtagtctcggt

SEQ ID NO: 234346 - DNA, 25 bp, Rattus norvegicus
caggtttgacacaagcagcttccca

SEQ ID NO: 234347 - DNA, 25 bp, Rattus norvegicus
caggtttgacactagcagcttccca

SEQ ID NO: 234348 - DNA, 25 bp, Rattus norvegicus
caggtttgaggtcgacttcagcccc

SEQ ID NO: 234349 - DNA, 25 bp, Rattus norvegicus
caggtttgaggtggacttcagcccc

SEQ ID NO: 234350 - DNA, 25 bp, Rattus norvegicus
caggtttggcatctttaaggacttc

SEQ ID NO: 234351 - DNA, 25 bp, Rattus norvegicus
caggtttggcatgtttaaggacttc

SEQ ID NO: 234352 - DNA, 25 bp, Rattus norvegicus
caggtttgggtgactgcgtattcca

SEQ ID NO: 234353 - DNA, 25 bp, Rattus norvegicus
caggtttgggtgtctgcgtattcca

SEQ ID NO: 234354 - DNA, 25 bp, Rattus norvegicus
caggtttggtggaggctttcagaac

SEQ ID NO: 234355 - DNA, 25 bp, Rattus norvegicus
caggtttggtggtggctttcagaac

SEQ ID NO: 234356 - DNA, 25 bp, Rattus norvegicus
caggtttgtgaaatttatgatgcta

SEQ ID NO: 234357 - DNA, 25 bp, Rattus norvegicus
caggtttgtgaattttatgatgcta

SEQ ID NO: 234358 - DNA, 25 bp, Rattus norvegicus
caggttttactaagcaattctagct

SEQ ID NO: 234359 - DNA, 25 bp, Rattus norvegicus
caggttttactatgcaattctagct

SEQ ID NO: 234360 - DNA, 25 bp, Rattus norvegicus
caggttttacttcgcaattctatat

SEQ ID NO: 234361 - DNA, 25 bp, Rattus norvegicus
caggttttacttggcaattctatat

SEQ ID NO: 234362 - DNA, 25 bp, Rattus norvegicus
caggttttagtgacaaacgggcacg

SEQ ID NO: 234363 - DNA, 25 bp, Rattus norvegicus
caggttttagtgtcaaacgggcacg

SEQ ID NO: 234364 - DNA, 25 bp, Rattus norvegicus
caggttttatcacactttcatggag

SEQ ID NO: 234365 - DNA, 25 bp, Rattus norvegicus
caggttttatcagactttcatggag

SEQ ID NO: 234366 - DNA, 25 bp, Rattus norvegicus
caggttttgcagatagaaatttctc

SEQ ID NO: 234367 - DNA, 25 bp, Rattus norvegicus
caggttttgcagttagaaatttctc

SEQ ID NO: 234368 - DNA, 25 bp, Rattus norvegicus
caggttttgcttatccatgaggacg

SEQ ID NO: 234369 - DNA, 25 bp, Rattus norvegicus
caggttttgcttttccatgaggacg

SEQ ID NO: 234370 - DNA, 25 bp, Rattus norvegicus
caggttttgttccattgtgttgcgt

SEQ ID NO: 234371 - DNA, 25 bp, Rattus norvegicus
caggttttgttcgattgtgttgcgt

SEQ ID NO: 234372 - DNA, 25 bp, Rattus norvegicus
caggtttttctccttggttgtgcag

SEQ ID NO: 234373 - DNA, 25 bp, Rattus norvegicus
caggtttttctcgttggttgtgcag

SEQ ID NO: 234374 - DNA, 25 bp, Rattus norvegicus
caggtttttgccatgaagaatcagt

SEQ ID NO: 234375 - DNA, 25 bp, Rattus norvegicus
caggtttttgccttgaagaatcagt

SEQ ID NO: 234376 - DNA, 25 bp, Rattus norvegicus
cagtaaaacttcctgtccttgttga

SEQ ID NO: 234377 - DNA, 25 bp, Rattus norvegicus
cagtaaaacttcgtgtccttgttga

SEQ ID NO: 234378 - DNA, 25 bp, Rattus norvegicus
cagtaaaatccacaagcgctcagag

SEQ ID NO: 234379 - DNA, 25 bp, Rattus norvegicus
cagtaaaatccagaagcgctcagag

SEQ ID NO: 234380 - DNA, 25 bp, Rattus norvegicus
cagtaaaatgtgctcccgtgtggtc

SEQ ID NO: 234381 - DNA, 25 bp, Rattus norvegicus
cagtaaaatgtggtcccgtgtggtc

SEQ ID NO: 234382 - DNA, 25 bp, Rattus norvegicus
cagtaaacatcacgccttccttggc

SEQ ID NO: 234383 - DNA, 25 bp, Rattus norvegicus
cagtaaacatcaggccttccttggc

SEQ ID NO: 234384 - DNA, 25 bp, Rattus norvegicus
cagtaaacccaacacacagtaaagt

SEQ ID NO: 234385 - DNA, 25 bp, Rattus norvegicus
cagtaaacccaagacacagtaaagt

SEQ ID NO: 234386 - DNA, 25 bp, Rattus norvegicus
cagtaaaggcgccatcttggttccc

SEQ ID NO: 234387 - DNA, 25 bp, Rattus norvegicus
cagtaaaggcgcgatcttggttccc

SEQ ID NO: 234388 - DNA, 25 bp, Rattus norvegicus
cagtaaatgccactacggtttccca

SEQ ID NO: 234389 - DNA, 25 bp, Rattus norvegicus
cagtaaatgccagtacggtttccca

SEQ ID NO: 234390 - DNA, 25 bp, Rattus norvegicus
cagtaacactttaattcctgacctt

SEQ ID NO: 234391 - DNA, 25 bp, Rattus norvegicus
cagtaacacttttattcctgacctt

SEQ ID NO: 234392 - DNA, 25 bp, Rattus norvegicus
cagtaacagcttagtgtgccgggct

SEQ ID NO: 234393 - DNA, 25 bp, Rattus norvegicus
cagtaacagctttgtgtgccgggct

SEQ ID NO: 234394 - DNA, 25 bp, Rattus norvegicus
cagtaacagtgacggcttggcttga

SEQ ID NO: 234395 - DNA, 25 bp, Rattus norvegicus
cagtaacagtgagggcttggcttga

SEQ ID NO: 234396 - DNA, 25 bp, Rattus norvegicus
cagtaacatcttagtctttttcatg

SEQ ID NO: 234397 - DNA, 25 bp, Rattus norvegicus
cagtaacatctttgtctttttcatg

SEQ ID NO: 234398 - DNA, 25 bp, Rattus norvegicus
cagtaaccagggacgaccgcggcta

SEQ ID NO: 234399 - DNA, 25 bp, Rattus norvegicus
cagtaaccagggtcgaccgcggcta

SEQ ID NO: 234400 - DNA, 25 bp, Rattus norvegicus
cagtaacctgacctgagctggacct

SEQ ID NO: 234401 - DNA, 25 bp, Rattus norvegicus
cagtaacctgacgtgagctggacct

SEQ ID NO: 234402 - DNA, 25 bp, Rattus norvegicus
cagtaacgggaactcgccaactccg

SEQ ID NO: 234403 - DNA, 25 bp, Rattus norvegicus
cagtaacgggaagtcgccaactccg

SEQ ID NO: 234404 - DNA, 25 bp, Rattus norvegicus
cagtaactcagcacagtccaatggg

SEQ ID NO: 234405 - DNA, 25 bp, Rattus norvegicus
cagtaactcagctcagtccaatggg

SEQ ID NO: 234406 - DNA, 25 bp, Rattus norvegicus
cagtaactcgataattttctctctc

SEQ ID NO: 234407 - DNA, 25 bp, Rattus norvegicus
cagtaactcgattattttctctctc

SEQ ID NO: 234408 - DNA, 25 bp, Rattus norvegicus
cagtaactggttacacgggtattcg

SEQ ID NO: 234409 - DNA, 25 bp, Rattus norvegicus
cagtaactggtttcacgggtattcg

SEQ ID NO: 234410 - DNA, 25 bp, Rattus norvegicus
cagtaactgtttctctttttgtggt

SEQ ID NO: 234411 - DNA, 25 bp, Rattus norvegicus
cagtaactgtttgtctttttgtggt

SEQ ID NO: 234412 - DNA, 25 bp, Rattus norvegicus
cagtaacttcagctttttgactcaa

SEQ ID NO: 234413 - DNA, 25 bp, Rattus norvegicus
cagtaacttcaggtttttgactcaa

SEQ ID NO: 234414 - DNA, 25 bp, Rattus norvegicus
cagtaagcagcaattcaccatggct

SEQ ID NO: 234415 - DNA, 25 bp, Rattus norvegicus
cagtaagcagcatttcaccatggct

SEQ ID NO: 234416 - DNA, 25 bp, Rattus norvegicus
cagtaagccatgacccctgtctggg

SEQ ID NO: 234417 - DNA, 25 bp, Rattus norvegicus
cagtaagccatgtcccctgtctggg

SEQ ID NO: 234418 - DNA, 25 bp, Rattus norvegicus
cagtaaggcactcggatattgtccc

SEQ ID NO: 234419 - DNA, 25 bp, Rattus norvegicus
cagtaaggcactgggatattgtccc

SEQ ID NO: 234420 - DNA, 25 bp, Rattus norvegicus
cagtaagtcataccatggtcccatt

SEQ ID NO: 234421 - DNA, 25 bp, Rattus norvegicus
cagtaagtcatagcatggtcccatt

SEQ ID NO: 234422 - DNA, 25 bp, Rattus norvegicus
cagtaagtcccgcttccagcgattt

SEQ ID NO: 234423 - DNA, 25 bp, Rattus norvegicus
cagtaagtcccggttccagcgattt

SEQ ID NO: 234424 - DNA, 25 bp, Rattus norvegicus
cagtaagtgcttccctgctgtggga

SEQ ID NO: 234425 - DNA, 25 bp, Rattus norvegicus
cagtaagtgcttgcctgctgtggga

SEQ ID NO: 234426 - DNA, 25 bp, Rattus norvegicus
cagtaagtggctactctgtgataca

SEQ ID NO: 234427 - DNA, 25 bp, Rattus norvegicus
cagtaagtggcttctctgtgataca

SEQ ID NO: 234428 - DNA, 25 bp, Rattus norvegicus
cagtaatactgaccctacccatgtg

SEQ ID NO: 234429 - DNA, 25 bp, Rattus norvegicus
cagtaatactgagcctacccatgtg

SEQ ID NO: 234430 - DNA, 25 bp, Rattus norvegicus
cagtaatatttcaaataaccatcta

SEQ ID NO: 234431 - DNA, 25 bp, Rattus norvegicus
cagtaatatttctaataaccatcta

SEQ ID NO: 234432 - DNA, 25 bp, Rattus norvegicus
cagtaatcttgtattggtcttctcc

SEQ ID NO: 234433 - DNA, 25 bp, Rattus norvegicus
cagtaatcttgttttggtcttctcc

SEQ ID NO: 234434 - DNA, 25 bp, Rattus norvegicus
cagtaatgagctcatctcctacaac

SEQ ID NO: 234435 - DNA, 25 bp, Rattus norvegicus
cagtaatgagctgatctcctacaac

SEQ ID NO: 234436 - DNA, 25 bp, Rattus norvegicus
cagtaattctctcttcagagattaa

SEQ ID NO: 234437 - DNA, 25 bp, Rattus norvegicus
cagtaattctctgttcagagattaa

SEQ ID NO: 234438 - DNA, 25 bp, Rattus norvegicus
cagtaattggatcccacctttacca

SEQ ID NO: 234439 - DNA, 25 bp, Rattus norvegicus
cagtaattggatgccacctttacca

SEQ ID NO: 234440 - DNA, 25 bp, Rattus norvegicus
cagtaatttctgaattgctagacat

SEQ ID NO: 234441 - DNA, 25 bp, Rattus norvegicus
cagtaatttctgtattgctagacat

SEQ ID NO: 234442 - DNA, 25 bp, Rattus norvegicus
cagtacaaaaagagcaaccctgtgc

SEQ ID NO: 234443 - DNA, 25 bp, Rattus norvegicus
cagtacaaaaagtgcaaccctgtgc

SEQ ID NO: 234444 - DNA, 25 bp, Rattus norvegicus
cagtacaacctcattttctattata

SEQ ID NO: 234445 - DNA, 25 bp, Rattus norvegicus
cagtacaacctctttttctattata

SEQ ID NO: 234446 - DNA, 25 bp, Rattus norvegicus
cagtacagatccagcacagggtgct

SEQ ID NO: 234447 - DNA, 25 bp, Rattus norvegicus
cagtacagatcctgcacagggtgct

SEQ ID NO: 234448 - DNA, 25 bp, Rattus norvegicus
cagtacagccgtcttggagggaact

SEQ ID NO: 234449 - DNA, 25 bp, Rattus norvegicus
cagtacagccgtgttggagggaact

SEQ ID NO: 234450 - DNA, 25 bp, Rattus norvegicus
cagtacaggctgaaggaggcttctg

SEQ ID NO: 234451 - DNA, 25 bp, Rattus norvegicus
cagtacaggctgtaggaggcttctg

SEQ ID NO: 234452 - DNA, 25 bp, Rattus norvegicus
cagtacatactcattttgtgtgtgt

SEQ ID NO: 234453 - DNA, 25 bp, Rattus norvegicus
cagtacatactctttttgtgtgtgt

SEQ ID NO: 234454 - DNA, 25 bp, Rattus norvegicus
cagtacatctctcttctcatgaaga

SEQ ID NO: 234455 - DNA, 25 bp, Rattus norvegicus
cagtacatctctgttctcatgaaga

SEQ ID NO: 234456 - DNA, 25 bp, Rattus norvegicus
cagtacatgggcattgatttatttt

SEQ ID NO: 234457 - DNA, 25 bp, Rattus norvegicus
cagtacatgggctttgatttatttt

SEQ ID NO: 234458 - DNA, 25 bp, Rattus norvegicus
cagtacattttgcaagcttgaaacc

SEQ ID NO: 234459 - DNA, 25 bp, Rattus norvegicus
cagtacattttggaagcttgaaacc

SEQ ID NO: 234460 - DNA, 25 bp, Rattus norvegicus
cagtacatttttaggtttctcagat

SEQ ID NO: 234461 - DNA, 25 bp, Rattus norvegicus
cagtacattttttggtttctcagat

SEQ ID NO: 234462 - DNA, 25 bp, Rattus norvegicus
cagtaccacctcatttcaagactag

SEQ ID NO: 234463 - DNA, 25 bp, Rattus norvegicus
cagtaccacctcttttcaagactag

SEQ ID NO: 234464 - DNA, 25 bp, Rattus norvegicus
cagtaccagtcacaattctccatga

SEQ ID NO: 234465 - DNA, 25 bp, Rattus norvegicus
cagtaccagtcagaattctccatga

SEQ ID NO: 234466 - DNA, 25 bp, Rattus norvegicus
cagtaccctactctgtaagcaacct

SEQ ID NO: 234467 - DNA, 25 bp, Rattus norvegicus
cagtaccctactgtgtaagcaacct

SEQ ID NO: 234468 - DNA, 25 bp, Rattus norvegicus
cagtaccctagtattatattgcgct

SEQ ID NO: 234469 - DNA, 25 bp, Rattus norvegicus
cagtaccctagttttatattgcgct

SEQ ID NO: 234470 - DNA, 25 bp, Rattus norvegicus
cagtacccttgcctttaaagctgta

SEQ ID NO: 234471 - DNA, 25 bp, Rattus norvegicus
cagtacccttgcgtttaaagctgta

SEQ ID NO: 234472 - DNA, 25 bp, Rattus norvegicus
cagtacctcatacgctgctttggga

SEQ ID NO: 234473 - DNA, 25 bp, Rattus norvegicus
cagtacctcataggctgctttggga

SEQ ID NO: 234474 - DNA, 25 bp, Rattus norvegicus
cagtacctctgtccgtcgggtagca

SEQ ID NO: 234475 - DNA, 25 bp, Rattus norvegicus
cagtacctctgtgcgtcgggtagca

SEQ ID NO: 234476 - DNA, 25 bp, Rattus norvegicus
cagtacctgctgcagtcagactgaa

SEQ ID NO: 234477 - DNA, 25 bp, Rattus norvegicus
cagtacctgctggagtcagactgaa

SEQ ID NO: 234478 - DNA, 25 bp, Rattus norvegicus
cagtacctgtttctcatctttaacc

SEQ ID NO: 234479 - DNA, 25 bp, Rattus norvegicus
cagtacctgtttgtcatctttaacc

SEQ ID NO: 234480 - DNA, 25 bp, Rattus norvegicus
cagtacctttcaagctcactcagga

SEQ ID NO: 234481 - DNA, 25 bp, Rattus norvegicus
cagtacctttcatgctcactcagga

SEQ ID NO: 234482 - DNA, 25 bp, Rattus norvegicus
cagtacgacgggaaagttgacatct

SEQ ID NO: 234483 - DNA, 25 bp, Rattus norvegicus
cagtacgacgggtaagttgacatct

SEQ ID NO: 234484 - DNA, 25 bp, Rattus norvegicus
cagtactattttctgcttttggttt

SEQ ID NO: 234485 - DNA, 25 bp, Rattus norvegicus
cagtactattttgtgcttttggttt

SEQ ID NO: 234486 - DNA, 25 bp, Rattus norvegicus
cagtactgaatgaggccgcggattt

SEQ ID NO: 234487 - DNA, 25 bp, Rattus norvegicus
cagtactgaatgtggccgcggattt

SEQ ID NO: 234488 - DNA, 25 bp, Rattus norvegicus
cagtactgcagacgtagccaggcca

SEQ ID NO: 234489 - DNA, 25 bp, Rattus norvegicus
cagtactgcagaggtagccaggcca

SEQ ID NO: 234490 - DNA, 25 bp, Rattus norvegicus
cagtactgcctgcaaacttaccttc

SEQ ID NO: 234491 - DNA, 25 bp, Rattus norvegicus
cagtactgcctggaaacttaccttc

SEQ ID NO: 234492 - DNA, 25 bp, Rattus norvegicus
cagtactgttcgagtgttctgtgta

SEQ ID NO: 234493 - DNA, 25 bp, Rattus norvegicus
cagtactgttcgtgtgttctgtgta

SEQ ID NO: 234494 - DNA, 25 bp, Rattus norvegicus
cagtacttctgtattcctttacaag

SEQ ID NO: 234495 - DNA, 25 bp, Rattus norvegicus
cagtacttctgttttcctttacaag

SEQ ID NO: 234496 - DNA, 25 bp, Rattus norvegicus
cagtacttgctgacactggcggagc

SEQ ID NO: 234497 - DNA, 25 bp, Rattus norvegicus
cagtacttgctgtcactggcggagc

SEQ ID NO: 234498 - DNA, 25 bp, Rattus norvegicus
cagtactttattatggttgggcgat

SEQ ID NO: 234499 - DNA, 25 bp, Rattus norvegicus
cagtactttattttggttgggcgat

SEQ ID NO: 234500 - DNA, 25 bp, Rattus norvegicus
cagtactttgtacatagtgggcatt

SEQ ID NO: 234501 - DNA, 25 bp, Rattus norvegicus
cagtactttgtagatagtgggcatt

SEQ ID NO: 234502 - DNA, 25 bp, Rattus norvegicus
cagtagaaggagctgcggcagcggc

SEQ ID NO: 234503 - DNA, 25 bp, Rattus norvegicus
cagtagaaggaggtgcggcagcggc

SEQ ID NO: 234504 - DNA, 25 bp, Rattus norvegicus
cagtagaattgtaacctgaacattt

SEQ ID NO: 234505 - DNA, 25 bp, Rattus norvegicus
cagtagaattgttacctgaacattt

SEQ ID NO: 234506 - DNA, 25 bp, Rattus norvegicus
cagtagacacttatggttctttctt

SEQ ID NO: 234507 - DNA, 25 bp, Rattus norvegicus
cagtagacacttttggttctttctt

SEQ ID NO: 234508 - DNA, 25 bp, Rattus norvegicus
cagtagactccacattcataataga

SEQ ID NO: 234509 - DNA, 25 bp, Rattus norvegicus
cagtagactccagattcataataga

SEQ ID NO: 234510 - DNA, 25 bp, Rattus norvegicus
cagtagagtgagcagctgccctgct

SEQ ID NO: 234511 - DNA, 25 bp, Rattus norvegicus
cagtagagtgaggagctgccctgct

SEQ ID NO: 234512 - DNA, 25 bp, Rattus norvegicus
cagtagcagaccctcagtatacaga

SEQ ID NO: 234513 - DNA, 25 bp, Rattus norvegicus
cagtagcagaccgtcagtatacaga

SEQ ID NO: 234514 - DNA, 25 bp, Rattus norvegicus
cagtagcagatgccgttcaaaaggt

SEQ ID NO: 234515 - DNA, 25 bp, Rattus norvegicus
cagtagcagatggcgttcaaaaggt

SEQ ID NO: 234516 - DNA, 25 bp, Rattus norvegicus
cagtagcagtatatcctggtcatta

SEQ ID NO: 234517 - DNA, 25 bp, Rattus norvegicus
cagtagcagtatttcctggtcatta

SEQ ID NO: 234518 - DNA, 25 bp, Rattus norvegicus
cagtagcagtgtccctcctttaatg

SEQ ID NO: 234519 - DNA, 25 bp, Rattus norvegicus
cagtagcagtgtgcctcctttaatg

SEQ ID NO: 234520 - DNA, 25 bp, Rattus norvegicus
cagtagccactgaaaagagccttag

SEQ ID NO: 234521 - DNA, 25 bp, Rattus norvegicus
cagtagccactgtaaagagccttag

SEQ ID NO: 234522 - DNA, 25 bp, Rattus norvegicus
cagtagccttatcctgtgggtggaa

SEQ ID NO: 234523 - DNA, 25 bp, Rattus norvegicus
cagtagccttatgctgtgggtggaa

SEQ ID NO: 234524 - DNA, 25 bp, Rattus norvegicus
cagtagctctacatgtgaatttgta

SEQ ID NO: 234525 - DNA, 25 bp, Rattus norvegicus
cagtagctctacttgtgaatttgta

SEQ ID NO: 234526 - DNA, 25 bp, Rattus norvegicus
cagtagctgagcacaaggcccggaa

SEQ ID NO: 234527 - DNA, 25 bp, Rattus norvegicus
cagtagctgagctcaaggcccggaa

SEQ ID NO: 234528 - DNA, 25 bp, Rattus norvegicus
cagtagctgatgacctgagctctat

SEQ ID NO: 234529 - DNA, 25 bp, Rattus norvegicus
cagtagctgatgtcctgagctctat

SEQ ID NO: 234530 - DNA, 25 bp, Rattus norvegicus
cagtagctgcagagcggagccacta

SEQ ID NO: 234531 - DNA, 25 bp, Rattus norvegicus
cagtagctgcagtgcggagccacta

SEQ ID NO: 234532 - DNA, 25 bp, Rattus norvegicus
cagtagcttccgagttgctgagtta

SEQ ID NO: 234533 - DNA, 25 bp, Rattus norvegicus
cagtagcttccgtgttgctgagtta

SEQ ID NO: 234534 - DNA, 25 bp, Rattus norvegicus
cagtagcttgtgactgggcactcaa

SEQ ID NO: 234535 - DNA, 25 bp, Rattus norvegicus
cagtagcttgtgtctgggcactcaa

SEQ ID NO: 234536 - DNA, 25 bp, Rattus norvegicus
cagtaggagaggctgcacctagccc

SEQ ID NO: 234537 - DNA, 25 bp, Rattus norvegicus
cagtaggagagggtgcacctagccc

SEQ ID NO: 234538 - DNA, 25 bp, Rattus norvegicus
cagtaggcacgtatgcttggtacct

SEQ ID NO: 234539 - DNA, 25 bp, Rattus norvegicus
cagtaggcacgtttgcttggtacct

SEQ ID NO: 234540 - DNA, 25 bp, Rattus norvegicus
cagtaggccagcacgtcccggaagg

SEQ ID NO: 234541 - DNA, 25 bp, Rattus norvegicus
cagtaggccagctcgtcccggaagg

SEQ ID NO: 234542 - DNA, 25 bp, Rattus norvegicus
cagtaggctttgagatttcgagtta

SEQ ID NO: 234543 - DNA, 25 bp, Rattus norvegicus
cagtaggctttgtgatttcgagtta

SEQ ID NO: 234544 - DNA, 25 bp, Rattus norvegicus
cagtagggctatctggtctacccca

SEQ ID NO: 234545 - DNA, 25 bp, Rattus norvegicus
cagtagggctatgtggtctacccca

SEQ ID NO: 234546 - DNA, 25 bp, Rattus norvegicus
cagtaggtctttatcccgatttcgc

SEQ ID NO: 234547 - DNA, 25 bp, Rattus norvegicus
cagtaggtctttttcccgatttcgc

SEQ ID NO: 234548 - DNA, 25 bp, Rattus norvegicus
cagtaggtggcactagtaccccggc

SEQ ID NO: 234549 - DNA, 25 bp, Rattus norvegicus
cagtaggtggcagtagtaccccggc

SEQ ID NO: 234550 - DNA, 25 bp, Rattus norvegicus
cagtaggttcttcgtgtttcccata

SEQ ID NO: 234551 - DNA, 25 bp, Rattus norvegicus
cagtaggttcttggtgtttcccata

SEQ ID NO: 234552 - DNA, 25 bp, Rattus norvegicus
cagtaggttgcgctgtaagtgtcat

SEQ ID NO: 234553 - DNA, 25 bp, Rattus norvegicus
cagtaggttgcggtgtaagtgtcat

SEQ ID NO: 234554 - DNA, 25 bp, Rattus norvegicus
cagtagtagcctccagttttccagg

SEQ ID NO: 234555 - DNA, 25 bp, Rattus norvegicus
cagtagtagcctgcagttttccagg

SEQ ID NO: 234556 - DNA, 25 bp, Rattus norvegicus
cagtagtcacctactgtgtaggaga

SEQ ID NO: 234557 - DNA, 25 bp, Rattus norvegicus
cagtagtcaccttctgtgtaggaga

SEQ ID NO: 234558 - DNA, 25 bp, Rattus norvegicus
cagtagtcctaccttaacggatcct

SEQ ID NO: 234559 - DNA, 25 bp, Rattus norvegicus
cagtagtcctacgttaacggatcct

SEQ ID NO: 234560 - DNA, 25 bp, Rattus norvegicus
cagtagtctcttcgctggatggcaa

SEQ ID NO: 234561 - DNA, 25 bp, Rattus norvegicus
cagtagtctcttggctggatggcaa

SEQ ID NO: 234562 - DNA, 25 bp, Rattus norvegicus
cagtagtgacctctgactttgtaag

SEQ ID NO: 234563 - DNA, 25 bp, Rattus norvegicus
cagtagtgacctgtgactttgtaag

SEQ ID NO: 234564 - DNA, 25 bp, Rattus norvegicus
cagtagtgggcccttaactgaataa

SEQ ID NO: 234565 - DNA, 25 bp, Rattus norvegicus
cagtagtgggccgttaactgaataa

SEQ ID NO: 234566 - DNA, 25 bp, Rattus norvegicus
cagtagttcagtacacctcgtaagg

SEQ ID NO: 234567 - DNA, 25 bp, Rattus norvegicus
cagtagttcagttcacctcgtaagg

SEQ ID NO: 234568 - DNA, 25 bp, Rattus norvegicus
cagtagttctctcttgggcacggaa

SEQ ID NO: 234569 - DNA, 25 bp, Rattus norvegicus
cagtagttctctgttgggcacggaa

SEQ ID NO: 234570 - DNA, 25 bp, Rattus norvegicus
cagtagttgctgactatttgttaat

SEQ ID NO: 234571 - DNA, 25 bp, Rattus norvegicus
cagtagttgctgtctatttgttaat

SEQ ID NO: 234572 - DNA, 25 bp, Rattus norvegicus
cagtagttgtttatgccccagtaga

SEQ ID NO: 234573 - DNA, 25 bp, Rattus norvegicus
cagtagttgtttttgccccagtaga

SEQ ID NO: 234574 - DNA, 25 bp, Rattus norvegicus
cagtagtttattatttgccacggag

SEQ ID NO: 234575 - DNA, 25 bp, Rattus norvegicus
cagtagtttattttttgccacggag

SEQ ID NO: 234576 - DNA, 25 bp, Rattus norvegicus
cagtataaaggtatttagctgcaaa

SEQ ID NO: 234577 - DNA, 25 bp, Rattus norvegicus
cagtataaaggtttttagctgcaaa

SEQ ID NO: 234578 - DNA, 25 bp, Rattus norvegicus
cagtataaccacaccccagtctttt

SEQ ID NO: 234579 - DNA, 25 bp, Rattus norvegicus
cagtataaccactccccagtctttt

SEQ ID NO: 234580 - DNA, 25 bp, Rattus norvegicus
cagtatacacttcctggtttctatt

SEQ ID NO: 234581 - DNA, 25 bp, Rattus norvegicus
cagtatacacttgctggtttctatt

SEQ ID NO: 234582 - DNA, 25 bp, Rattus norvegicus
cagtatacgcgactgcatttcttat

SEQ ID NO: 234583 - DNA, 25 bp, Rattus norvegicus
cagtatacgcgagtgcatttcttat

SEQ ID NO: 234584 - DNA, 25 bp, Rattus norvegicus
cagtatagtctgaagccatgttgta

SEQ ID NO: 234585 - DNA, 25 bp, Rattus norvegicus
cagtatagtctgtagccatgttgta

SEQ ID NO: 234586 - DNA, 25 bp, Rattus norvegicus
cagtatattgctattttccttgtta

SEQ ID NO: 234587 - DNA, 25 bp, Rattus norvegicus
cagtatattgcttttttccttgtta

SEQ ID NO: 234588 - DNA, 25 bp, Rattus norvegicus
cagtatcaagttacgttttgcatta

SEQ ID NO: 234589 - DNA, 25 bp, Rattus norvegicus
cagtatcaagtttcgttttgcatta

SEQ ID NO: 234590 - DNA, 25 bp, Rattus norvegicus
cagtatcattcccactcttatagag

SEQ ID NO: 234591 - DNA, 25 bp, Rattus norvegicus
cagtatcattccgactcttatagag

SEQ ID NO: 234592 - DNA, 25 bp, Rattus norvegicus
cagtatccagctatggtcctgcatt

SEQ ID NO: 234593 - DNA, 25 bp, Rattus norvegicus
cagtatccagctttggtcctgcatt

SEQ ID NO: 234594 - DNA, 25 bp, Rattus norvegicus
cagtatcccgaaacctgaactacag

SEQ ID NO: 234595 - DNA, 25 bp, Rattus norvegicus
cagtatcccgaatcctgaactacag

SEQ ID NO: 234596 - DNA, 25 bp, Rattus norvegicus
cagtatcccgtcaccaggaaacctg

SEQ ID NO: 234597 - DNA, 25 bp, Rattus norvegicus
cagtatcccgtctccaggaaacctg

SEQ ID NO: 234598 - DNA, 25 bp, Rattus norvegicus
cagtatcccgtgagtcttgggacaa

SEQ ID NO: 234599 - DNA, 25 bp, Rattus norvegicus
cagtatcccgtgtgtcttgggacaa

SEQ ID NO: 234600 - DNA, 25 bp, Rattus norvegicus
cagtatcctagaagtttcccaacac

SEQ ID NO: 234601 - DNA, 25 bp, Rattus norvegicus
cagtatcctagatgtttcccaacac

SEQ ID NO: 234602 - DNA, 25 bp, Rattus norvegicus
cagtatcctcaaactttttgtggtg

SEQ ID NO: 234603 - DNA, 25 bp, Rattus norvegicus
cagtatcctcaatctttttgtggtg

SEQ ID NO: 234604 - DNA, 25 bp, Rattus norvegicus
cagtatcctgctcgcctccggagtg

SEQ ID NO: 234605 - DNA, 25 bp, Rattus norvegicus
cagtatcctgctggcctccggagtg

SEQ ID NO: 234606 - DNA, 25 bp, Rattus norvegicus
cagtatcgggctctatcgggctata

SEQ ID NO: 234607 - DNA, 25 bp, Rattus norvegicus
cagtatcgggctgtatcgggctata

SEQ ID NO: 234608 - DNA, 25 bp, Rattus norvegicus
cagtatctccccattttgggcttct

SEQ ID NO: 234609 - DNA, 25 bp, Rattus norvegicus
cagtatctcccctttttgggcttct

SEQ ID NO: 234610 - DNA, 25 bp, Rattus norvegicus
cagtatcttattcaggttcctgcaa

SEQ ID NO: 234611 - DNA, 25 bp, Rattus norvegicus
cagtatcttattgaggttcctgcaa

SEQ ID NO: 234612 - DNA, 25 bp, Rattus norvegicus
cagtatgctcggcttgccatggcaa

SEQ ID NO: 234613 - DNA, 25 bp, Rattus norvegicus
cagtatgctcgggttgccatggcaa

SEQ ID NO: 234614 - DNA, 25 bp, Rattus norvegicus
cagtatggctgcactctgtgaggac

SEQ ID NO: 234615 - DNA, 25 bp, Rattus norvegicus
cagtatggctgctctctgtgaggac

SEQ ID NO: 234616 - DNA, 25 bp, Rattus norvegicus
cagtatgggactccagccttggctg

SEQ ID NO: 234617 - DNA, 25 bp, Rattus norvegicus
cagtatgggactgcagccttggctg

SEQ ID NO: 234618 - DNA, 25 bp, Rattus norvegicus
cagtatgtcttcactttgaggccag

SEQ ID NO: 234619 - DNA, 25 bp, Rattus norvegicus
cagtatgtcttctctttgaggccag

SEQ ID NO: 234620 - DNA, 25 bp, Rattus norvegicus
cagtatgtgcttacttgtgttcaag

SEQ ID NO: 234621 - DNA, 25 bp, Rattus norvegicus
cagtatgtgctttcttgtgttcaag

SEQ ID NO: 234622 - DNA, 25 bp, Rattus norvegicus
cagtatgtttctacttgaatttgga

SEQ ID NO: 234623 - DNA, 25 bp, Rattus norvegicus
cagtatgtttcttcttgaatttgga

SEQ ID NO: 234624 - DNA, 25 bp, Rattus norvegicus
cagtattactatcacaccaacagcc

SEQ ID NO: 234625 - DNA, 25 bp, Rattus norvegicus
cagtattactatgacaccaacagcc

SEQ ID NO: 234626 - DNA, 25 bp, Rattus norvegicus
cagtattagcccctgccattatggg

SEQ ID NO: 234627 - DNA, 25 bp, Rattus norvegicus
cagtattagcccgtgccattatggg

SEQ ID NO: 234628 - DNA, 25 bp, Rattus norvegicus
cagtattagcctcgcccagtatcta

SEQ ID NO: 234629 - DNA, 25 bp, Rattus norvegicus
cagtattagcctggcccagtatcta

SEQ ID NO: 234630 - DNA, 25 bp, Rattus norvegicus
cagtattatcagatgctgtgctgga

SEQ ID NO: 234631 - DNA, 25 bp, Rattus norvegicus
cagtattatcagttgctgtgctgga

SEQ ID NO: 234632 - DNA, 25 bp, Rattus norvegicus
cagtattcccttagtgatgttgtca

SEQ ID NO: 234633 - DNA, 25 bp, Rattus norvegicus
cagtattccctttgtgatgttgtca

SEQ ID NO: 234634 - DNA, 25 bp, Rattus norvegicus
cagtattctctgaggccaagtgttt

SEQ ID NO: 234635 - DNA, 25 bp, Rattus norvegicus
cagtattctctgtggccaagtgttt

SEQ ID NO: 234636 - DNA, 25 bp, Rattus norvegicus
cagtattctgctattgtgtttttta

SEQ ID NO: 234637 - DNA, 25 bp, Rattus norvegicus
cagtattctgcttttgtgtttttta

SEQ ID NO: 234638 - DNA, 25 bp, Rattus norvegicus
cagtattgctgtcgatgctggccat

SEQ ID NO: 234639 - DNA, 25 bp, Rattus norvegicus
cagtattgctgtggatgctggccat

SEQ ID NO: 234640 - DNA, 25 bp, Rattus norvegicus
cagtattgtcaaaggtgtgtgtatg

SEQ ID NO: 234641 - DNA, 25 bp, Rattus norvegicus
cagtattgtcaatggtgtgtgtatg

SEQ ID NO: 234642 - DNA, 25 bp, Rattus norvegicus
cagtattgtctgacttccgtgtgaa

SEQ ID NO: 234643 - DNA, 25 bp, Rattus norvegicus
cagtattgtctgtcttccgtgtgaa

SEQ ID NO: 234644 - DNA, 25 bp, Rattus norvegicus
cagtatttagaacccaaccatgatt

SEQ ID NO: 234645 - DNA, 25 bp, Rattus norvegicus
cagtatttagaagccaaccatgatt

SEQ ID NO: 234646 - DNA, 25 bp, Rattus norvegicus
cagtatttcacaatctgttgtcaaa

SEQ ID NO: 234647 - DNA, 25 bp, Rattus norvegicus
cagtatttcacattctgttgtcaaa

SEQ ID NO: 234648 - DNA, 25 bp, Rattus norvegicus
cagtatttcagtctatgtgccgtgt

SEQ ID NO: 234649 - DNA, 25 bp, Rattus norvegicus
cagtatttcagtgtatgtgccgtgt

SEQ ID NO: 234650 - DNA, 25 bp, Rattus norvegicus
cagtatttccctcttcgttgtgttt

SEQ ID NO: 234651 - DNA, 25 bp, Rattus norvegicus
cagtatttccctgttcgttgtgttt

SEQ ID NO: 234652 - DNA, 25 bp, Rattus norvegicus
cagtatttgcaaaaccgagagggtc

SEQ ID NO: 234653 - DNA, 25 bp, Rattus norvegicus
cagtatttgcaataccgagagggtc

SEQ ID NO: 234654 - DNA, 25 bp, Rattus norvegicus
cagtatttgcttcgccttagtcttg

SEQ ID NO: 234655 - DNA, 25 bp, Rattus norvegicus
cagtatttgcttggccttagtcttg

SEQ ID NO: 234656 - DNA, 25 bp, Rattus norvegicus
cagtatttgtacattttactacagt

SEQ ID NO: 234657 - DNA, 25 bp, Rattus norvegicus
cagtatttgtactttttactacagt

SEQ ID NO: 234658 - DNA, 25 bp, Rattus norvegicus
cagtatttgtccagccgagttttgt

SEQ ID NO: 234659 - DNA, 25 bp, Rattus norvegicus
cagtatttgtcctgccgagttttgt

SEQ ID NO: 234660 - DNA, 25 bp, Rattus norvegicus
cagtatttgtggagatggcagctaa

SEQ ID NO: 234661 - DNA, 25 bp, Rattus norvegicus
cagtatttgtggtgatggcagctaa

SEQ ID NO: 234662 - DNA, 25 bp, Rattus norvegicus
cagtattttctgagtttccttatta

SEQ ID NO: 234663 - DNA, 25 bp, Rattus norvegicus
cagtattttctgtgtttccttatta

SEQ ID NO: 234664 - DNA, 25 bp, Rattus norvegicus
cagtatttttatccccgtgtatttt

SEQ ID NO: 234665 - DNA, 25 bp, Rattus norvegicus
cagtatttttatgcccgtgtatttt

SEQ ID NO: 234666 - DNA, 25 bp, Rattus norvegicus
cagtcaaaaagtctgttgcacatgc

SEQ ID NO: 234667 - DNA, 25 bp, Rattus norvegicus
cagtcaaaaagtgtgttgcacatgc

SEQ ID NO: 234668 - DNA, 25 bp, Rattus norvegicus
cagtcaaacggaacagtgccagcct

SEQ ID NO: 234669 - DNA, 25 bp, Rattus norvegicus
cagtcaaacggatcagtgccagcct

SEQ ID NO: 234670 - DNA, 25 bp, Rattus norvegicus
cagtcaacaattacacttgtagcat

SEQ ID NO: 234671 - DNA, 25 bp, Rattus norvegicus
cagtcaacaatttcacttgtagcat

SEQ ID NO: 234672 - DNA, 25 bp, Rattus norvegicus
cagtcaacgtctcctcatctgatct

SEQ ID NO: 234673 - DNA, 25 bp, Rattus norvegicus
cagtcaacgtctgctcatctgatct

SEQ ID NO: 234674 - DNA, 25 bp, Rattus norvegicus
cagtcaactgccatctttcttatta

SEQ ID NO: 234675 - DNA, 25 bp, Rattus norvegicus
cagtcaactgccttctttcttatta

SEQ ID NO: 234676 - DNA, 25 bp, Rattus norvegicus
cagtcaagcctgaaacgtcggttca

SEQ ID NO: 234677 - DNA, 25 bp, Rattus norvegicus
cagtcaagcctgtaacgtcggttca

SEQ ID NO: 234678 - DNA, 25 bp, Rattus norvegicus
cagtcaaggtgtctactagcagcta

SEQ ID NO: 234679 - DNA, 25 bp, Rattus norvegicus
cagtcaaggtgtgtactagcagcta

SEQ ID NO: 234680 - DNA, 25 bp, Rattus norvegicus
cagtcaagttttctttcccacctcg

SEQ ID NO: 234681 - DNA, 25 bp, Rattus norvegicus
cagtcaagttttgtttcccacctcg

SEQ ID NO: 234682 - DNA, 25 bp, Rattus norvegicus
cagtcaatttggcaatttagtgtaa

SEQ ID NO: 234683 - DNA, 25 bp, Rattus norvegicus
cagtcaatttgggaatttagtgtaa

SEQ ID NO: 234684 - DNA, 25 bp, Rattus norvegicus
cagtcacagattcccctcaacgaga

SEQ ID NO: 234685 - DNA, 25 bp, Rattus norvegicus
cagtcacagattgccctcaacgaga

SEQ ID NO: 234686 - DNA, 25 bp, Rattus norvegicus
cagtcacagctgaccctagtgtcag

SEQ ID NO: 234687 - DNA, 25 bp, Rattus norvegicus
cagtcacagctgtccctagtgtcag

SEQ ID NO: 234688 - DNA, 25 bp, Rattus norvegicus
cagtcacaggaaacgttgctcacat

SEQ ID NO: 234689 - DNA, 25 bp, Rattus norvegicus
cagtcacaggaatcgttgctcacat

SEQ ID NO: 234690 - DNA, 25 bp, Rattus norvegicus
cagtcacaggacattttcttttgta

SEQ ID NO: 234691 - DNA, 25 bp, Rattus norvegicus
cagtcacaggactttttcttttgta

SEQ ID NO: 234692 - DNA, 25 bp, Rattus norvegicus
cagtcacatacacagacggccgagt

SEQ ID NO: 234693 - DNA, 25 bp, Rattus norvegicus
cagtcacatacagagacggccgagt

SEQ ID NO: 234694 - DNA, 25 bp, Rattus norvegicus
cagtcaccagggaagaaaggctttc

SEQ ID NO: 234695 - DNA, 25 bp, Rattus norvegicus
cagtcaccagggtagaaaggctttc

SEQ ID NO: 234696 - DNA, 25 bp, Rattus norvegicus
cagtcacccttaaactctcaagagt

SEQ ID NO: 234697 - DNA, 25 bp, Rattus norvegicus
cagtcacccttatactctcaagagt

SEQ ID NO: 234698 - DNA, 25 bp, Rattus norvegicus
cagtcaccggctcttacataacgtg

SEQ ID NO: 234699 - DNA, 25 bp, Rattus norvegicus
cagtcaccggctgttacataacgtg

SEQ ID NO: 234700 - DNA, 25 bp, Rattus norvegicus
cagtcacctgtgaatcttgcatgat

SEQ ID NO: 234701 - DNA, 25 bp, Rattus norvegicus
cagtcacctgtgtatcttgcatgat

SEQ ID NO: 234702 - DNA, 25 bp, Rattus norvegicus
cagtcacgaaccagcaggaccctag

SEQ ID NO: 234703 - DNA, 25 bp, Rattus norvegicus
cagtcacgaacctgcaggaccctag

SEQ ID NO: 234704 - DNA, 25 bp, Rattus norvegicus
cagtcacgggagcatcagagcttct

SEQ ID NO: 234705 - DNA, 25 bp, Rattus norvegicus
cagtcacgggaggatcagagcttct

SEQ ID NO: 234706 - DNA, 25 bp, Rattus norvegicus
cagtcacggtagagggcgcccatgt

SEQ ID NO: 234707 - DNA, 25 bp, Rattus norvegicus
cagtcacggtagtgggcgcccatgt

SEQ ID NO: 234708 - DNA, 25 bp, Rattus norvegicus
cagtcactaactcgaagccctttga

SEQ ID NO: 234709 - DNA, 25 bp, Rattus norvegicus
cagtcactaactggaagccctttga

SEQ ID NO: 234710 - DNA, 25 bp, Rattus norvegicus
cagtcactctgcatattgacccaga

SEQ ID NO: 234711 - DNA, 25 bp, Rattus norvegicus
cagtcactctgcttattgacccaga

SEQ ID NO: 234712 - DNA, 25 bp, Rattus norvegicus
cagtcactcttcaatcaaagcatgt

SEQ ID NO: 234713 - DNA, 25 bp, Rattus norvegicus
cagtcactcttctatcaaagcatgt

SEQ ID NO: 234714 - DNA, 25 bp, Rattus norvegicus
cagtcactgactcgtgggtttgtaa

SEQ ID NO: 234715 - DNA, 25 bp, Rattus norvegicus
cagtcactgactggtgggtttgtaa

SEQ ID NO: 234716 - DNA, 25 bp, Rattus norvegicus
cagtcactgatcacagttcttttta

SEQ ID NO: 234717 - DNA, 25 bp, Rattus norvegicus
cagtcactgatctcagttcttttta

SEQ ID NO: 234718 - DNA, 25 bp, Rattus norvegicus
cagtcactgggtcacttttggatgc

SEQ ID NO: 234719 - DNA, 25 bp, Rattus norvegicus
cagtcactgggtgacttttggatgc

SEQ ID NO: 234720 - DNA, 25 bp, Rattus norvegicus
cagtcactggtaatttttggattca

SEQ ID NO: 234721 - DNA, 25 bp, Rattus norvegicus
cagtcactggtattttttggattca

SEQ ID NO: 234722 - DNA, 25 bp, Rattus norvegicus
cagtcactgttcagggcagctggga

SEQ ID NO: 234723 - DNA, 25 bp, Rattus norvegicus
cagtcactgttctgggcagctggga

SEQ ID NO: 234724 - DNA, 25 bp, Rattus norvegicus
cagtcacttatcagctgtcaaggct

SEQ ID NO: 234725 - DNA, 25 bp, Rattus norvegicus
cagtcacttatctgctgtcaaggct

SEQ ID NO: 234726 - DNA, 25 bp, Rattus norvegicus
cagtcacttatgacctgaggttctt

SEQ ID NO: 234727 - DNA, 25 bp, Rattus norvegicus
cagtcacttatgtcctgaggttctt

SEQ ID NO: 234728 - DNA, 25 bp, Rattus norvegicus
cagtcagaaggtcaggtgcctgcac

SEQ ID NO: 234729 - DNA, 25 bp, Rattus norvegicus
cagtcagaaggtgaggtgcctgcac

SEQ ID NO: 234730 - DNA, 25 bp, Rattus norvegicus
cagtcagaccttcaaattccaggat

SEQ ID NO: 234731 - DNA, 25 bp, Rattus norvegicus
cagtcagaccttgaaattccaggat

SEQ ID NO: 234732 - DNA, 25 bp, Rattus norvegicus
cagtcagacggtatttagctatttg

SEQ ID NO: 234733 - DNA, 25 bp, Rattus norvegicus
cagtcagacggtttttagctatttg

SEQ ID NO: 234734 - DNA, 25 bp, Rattus norvegicus
cagtcagactgtcggcgttccagaa

SEQ ID NO: 234735 - DNA, 25 bp, Rattus norvegicus
cagtcagactgtgggcgttccagaa

SEQ ID NO: 234736 - DNA, 25 bp, Rattus norvegicus
cagtcagatccgaccacagcacagt

SEQ ID NO: 234737 - DNA, 25 bp, Rattus norvegicus
cagtcagatccgtccacagcacagt

SEQ ID NO: 234738 - DNA, 25 bp, Rattus norvegicus
cagtcagcctcaccaagtggaacaa

SEQ ID NO: 234739 - DNA, 25 bp, Rattus norvegicus
cagtcagcctcagcaagtggaacaa

SEQ ID NO: 234740 - DNA, 25 bp, Rattus norvegicus
cagtcagctgcaaggttacttgctt

SEQ ID NO: 234741 - DNA, 25 bp, Rattus norvegicus
cagtcagctgcatggttacttgctt

SEQ ID NO: 234742 - DNA, 25 bp, Rattus norvegicus
cagtcagctggtatctacttggtgt

SEQ ID NO: 234743 - DNA, 25 bp, Rattus norvegicus
cagtcagctggtttctacttggtgt

SEQ ID NO: 234744 - DNA, 25 bp, Rattus norvegicus
cagtcaggagcacacagcactcatg

SEQ ID NO: 234745 - DNA, 25 bp, Rattus norvegicus
cagtcaggagcagacagcactcatg

SEQ ID NO: 234746 - DNA, 25 bp, Rattus norvegicus
cagtcaggaggcatttcaagaggga

SEQ ID NO: 234747 - DNA, 25 bp, Rattus norvegicus
cagtcaggaggcttttcaagaggga

SEQ ID NO: 234748 - DNA, 25 bp, Rattus norvegicus
cagtcaggccagagtctgcagctat

SEQ ID NO: 234749 - DNA, 25 bp, Rattus norvegicus
cagtcaggccagtgtctgcagctat

SEQ ID NO: 234750 - DNA, 25 bp, Rattus norvegicus
cagtcaggctgcagggtcaaggtca

SEQ ID NO: 234751 - DNA, 25 bp, Rattus norvegicus
cagtcaggctgctgggtcaaggtca

SEQ ID NO: 234752 - DNA, 25 bp, Rattus norvegicus
cagtcagggagcaggccatgagtca

SEQ ID NO: 234753 - DNA, 25 bp, Rattus norvegicus
cagtcagggagctggccatgagtca

SEQ ID NO: 234754 - DNA, 25 bp, Rattus norvegicus
cagtcaggtctgaggctggacacaa

SEQ ID NO: 234755 - DNA, 25 bp, Rattus norvegicus
cagtcaggtctgtggctggacacaa

SEQ ID NO: 234756 - DNA, 25 bp, Rattus norvegicus
cagtcaggtggcagacagtcacctt

SEQ ID NO: 234757 - DNA, 25 bp, Rattus norvegicus
cagtcaggtggctgacagtcacctt

SEQ ID NO: 234758 - DNA, 25 bp, Rattus norvegicus
cagtcagtccacaagctgtgttcat

SEQ ID NO: 234759 - DNA, 25 bp, Rattus norvegicus
cagtcagtccactagctgtgttcat

SEQ ID NO: 234760 - DNA, 25 bp, Rattus norvegicus
cagtcagtcctgctccaaagaaaac

SEQ ID NO: 234761 - DNA, 25 bp, Rattus norvegicus
cagtcagtcctggtccaaagaaaac

SEQ ID NO: 234762 - DNA, 25 bp, Rattus norvegicus
cagtcagtctcacatgttggttctt

SEQ ID NO: 234763 - DNA, 25 bp, Rattus norvegicus
cagtcagtctcagatgttggttctt

SEQ ID NO: 234764 - DNA, 25 bp, Rattus norvegicus
cagtcagtctgtccgttggtctata

SEQ ID NO: 234765 - DNA, 25 bp, Rattus norvegicus
cagtcagtctgtgcgttggtctata

SEQ ID NO: 234766 - DNA, 25 bp, Rattus norvegicus
cagtcagtggacagctacatcattg

SEQ ID NO: 234767 - DNA, 25 bp, Rattus norvegicus
cagtcagtggactgctacatcattg

SEQ ID NO: 234768 - DNA, 25 bp, Rattus norvegicus
cagtcagtggccaatgatcctacta

SEQ ID NO: 234769 - DNA, 25 bp, Rattus norvegicus
cagtcagtggcctatgatcctacta

SEQ ID NO: 234770 - DNA, 25 bp, Rattus norvegicus
cagtcagtgtcaactcccaggtgaa

SEQ ID NO: 234771 - DNA, 25 bp, Rattus norvegicus
cagtcagtgtcatctcccaggtgaa

SEQ ID NO: 234772 - DNA, 25 bp, Rattus norvegicus
cagtcagtgtttctggtctagatta

SEQ ID NO: 234773 - DNA, 25 bp, Rattus norvegicus
cagtcagtgtttgtggtctagatta

SEQ ID NO: 234774 - DNA, 25 bp, Rattus norvegicus
cagtcagttgccattttcagtgcag

SEQ ID NO: 234775 - DNA, 25 bp, Rattus norvegicus
cagtcagttgcctttttcagtgcag

SEQ ID NO: 234776 - DNA, 25 bp, Rattus norvegicus
cagtcagttttacatgcccagtttt

SEQ ID NO: 234777 - DNA, 25 bp, Rattus norvegicus
cagtcagttttagatgcccagtttt

SEQ ID NO: 234778 - DNA, 25 bp, Rattus norvegicus
cagtcatagacacaggtggccttgc

SEQ ID NO: 234779 - DNA, 25 bp, Rattus norvegicus
cagtcatagacagaggtggccttgc

SEQ ID NO: 234780 - DNA, 25 bp, Rattus norvegicus
cagtcatccatcctggtgagagcct

SEQ ID NO: 234781 - DNA, 25 bp, Rattus norvegicus
cagtcatccatcgtggtgagagcct

SEQ ID NO: 234782 - DNA, 25 bp, Rattus norvegicus
cagtcatctgccagattttgttcaa

SEQ ID NO: 234783 - DNA, 25 bp, Rattus norvegicus
cagtcatctgcctgattttgttcaa

SEQ ID NO: 234784 - DNA, 25 bp, Rattus norvegicus
cagtcatcttgtctttgtgttgatc

SEQ ID NO: 234785 - DNA, 25 bp, Rattus norvegicus
cagtcatcttgtgtttgtgttgatc

SEQ ID NO: 234786 - DNA, 25 bp, Rattus norvegicus
cagtcatgacttcatattcaggtaa

SEQ ID NO: 234787 - DNA, 25 bp, Rattus norvegicus
cagtcatgacttgatattcaggtaa

SEQ ID NO: 234788 - DNA, 25 bp, Rattus norvegicus
cagtcatgagagagggaatgctcct

SEQ ID NO: 234789 - DNA, 25 bp, Rattus norvegicus
cagtcatgagagtgggaatgctcct

SEQ ID NO: 234790 - DNA, 25 bp, Rattus norvegicus
cagtcatgatgacagcccgtggaga

SEQ ID NO: 234791 - DNA, 25 bp, Rattus norvegicus
cagtcatgatgagagcccgtggaga

SEQ ID NO: 234792 - DNA, 25 bp, Rattus norvegicus
cagtcatggctaccagaatcgtcac

SEQ ID NO: 234793 - DNA, 25 bp, Rattus norvegicus
cagtcatggctagcagaatcgtcac

SEQ ID NO: 234794 - DNA, 25 bp, Rattus norvegicus
cagtcatggtggacaacgttgtcaa

SEQ ID NO: 234795 - DNA, 25 bp, Rattus norvegicus
cagtcatggtggtcaacgttgtcaa

SEQ ID NO: 234796 - DNA, 25 bp, Rattus norvegicus
cagtcatgtctcatggcctcaagaa

SEQ ID NO: 234797 - DNA, 25 bp, Rattus norvegicus
cagtcatgtctcttggcctcaagaa

SEQ ID NO: 234798 - DNA, 25 bp, Rattus norvegicus
cagtcattaaggacaaactcctccc

SEQ ID NO: 234799 - DNA, 25 bp, Rattus norvegicus
cagtcattaaggtcaaactcctccc

SEQ ID NO: 234800 - DNA, 25 bp, Rattus norvegicus
cagtcattagacattttcagttcaa

SEQ ID NO: 234801 - DNA, 25 bp, Rattus norvegicus
cagtcattagactttttcagttcaa

SEQ ID NO: 234802 - DNA, 25 bp, Rattus norvegicus
cagtcattcaaccattattcaccaa

SEQ ID NO: 234803 - DNA, 25 bp, Rattus norvegicus
cagtcattcaacgattattcaccaa

SEQ ID NO: 234804 - DNA, 25 bp, Rattus norvegicus
cagtcattcataatggattagaacc

SEQ ID NO: 234805 - DNA, 25 bp, Rattus norvegicus
cagtcattcatattggattagaacc

SEQ ID NO: 234806 - DNA, 25 bp, Rattus norvegicus
cagtcattccgcacctaaaatcaaa

SEQ ID NO: 234807 - DNA, 25 bp, Rattus norvegicus
cagtcattccgctcctaaaatcaaa

SEQ ID NO: 234808 - DNA, 25 bp, Rattus norvegicus
cagtcattgcagcaggtagttgtta

SEQ ID NO: 234809 - DNA, 25 bp, Rattus norvegicus
cagtcattgcaggaggtagttgtta

SEQ ID NO: 234810 - DNA, 25 bp, Rattus norvegicus
cagtcattgtggagtcctgagtgca

SEQ ID NO: 234811 - DNA, 25 bp, Rattus norvegicus
cagtcattgtggtgtcctgagtgca

SEQ ID NO: 234812 - DNA, 25 bp, Rattus norvegicus
cagtcatttggcagatggcttctta

SEQ ID NO: 234813 - DNA, 25 bp, Rattus norvegicus
cagtcatttggctgatggcttctta

SEQ ID NO: 234814 - DNA, 25 bp, Rattus norvegicus
cagtccaaactgctagaaagagaat

SEQ ID NO: 234815 - DNA, 25 bp, Rattus norvegicus
cagtccaaactggtagaaagagaat

SEQ ID NO: 234816 - DNA, 25 bp, Rattus norvegicus
cagtccaacatcactgaggtacctt

SEQ ID NO: 234817 - DNA, 25 bp, Rattus norvegicus
cagtccaacatctctgaggtacctt

SEQ ID NO: 234818 - DNA, 25 bp, Rattus norvegicus
cagtccaacttaattttctctaggg

SEQ ID NO: 234819 - DNA, 25 bp, Rattus norvegicus
cagtccaacttatttttctctaggg

SEQ ID NO: 234820 - DNA, 25 bp, Rattus norvegicus
cagtccaccaacctaaagcttattt

SEQ ID NO: 234821 - DNA, 25 bp, Rattus norvegicus
cagtccaccaacgtaaagcttattt

SEQ ID NO: 234822 - DNA, 25 bp, Rattus norvegicus
cagtccaccggcaacaatttcatgt

SEQ ID NO: 234823 - DNA, 25 bp, Rattus norvegicus
cagtccaccggctacaatttcatgt

SEQ ID NO: 234824 - DNA, 25 bp, Rattus norvegicus
cagtccacgtgtacctttgttacca

SEQ ID NO: 234825 - DNA, 25 bp, Rattus norvegicus
cagtccacgtgttcctttgttacca

SEQ ID NO: 234826 - DNA, 25 bp, Rattus norvegicus
cagtccactccacctgggaaaggaa

SEQ ID NO: 234827 - DNA, 25 bp, Rattus norvegicus
cagtccactccagctgggaaaggaa

SEQ ID NO: 234828 - DNA, 25 bp, Rattus norvegicus
cagtccactgcaaccactaagaatg

SEQ ID NO: 234829 - DNA, 25 bp, Rattus norvegicus
cagtccactgcatccactaagaatg

SEQ ID NO: 234830 - DNA, 25 bp, Rattus norvegicus
cagtccacttgtagatatcctcagg

SEQ ID NO: 234831 - DNA, 25 bp, Rattus norvegicus
cagtccacttgttgatatcctcagg

SEQ ID NO: 234832 - DNA, 25 bp, Rattus norvegicus
cagtccactttcacttcacgatagg

SEQ ID NO: 234833 - DNA, 25 bp, Rattus norvegicus
cagtccactttctcttcacgatagg

SEQ ID NO: 234834 - DNA, 25 bp, Rattus norvegicus
cagtccagactgaaggctcttgttc

SEQ ID NO: 234835 - DNA, 25 bp, Rattus norvegicus
cagtccagactgtaggctcttgttc

SEQ ID NO: 234836 - DNA, 25 bp, Rattus norvegicus
cagtccagagatatgaaagggcccc

SEQ ID NO: 234837 - DNA, 25 bp, Rattus norvegicus
cagtccagagatttgaaagggcccc

SEQ ID NO: 234838 - DNA, 25 bp, Rattus norvegicus
cagtccagcttgaccttacttgtac

SEQ ID NO: 234839 - DNA, 25 bp, Rattus norvegicus
cagtccagcttgtccttacttgtac

SEQ ID NO: 234840 - DNA, 25 bp, Rattus norvegicus
cagtccagggagctgttaggtcttt

SEQ ID NO: 234841 - DNA, 25 bp, Rattus norvegicus
cagtccagggaggtgttaggtcttt

SEQ ID NO: 234842 - DNA, 25 bp, Rattus norvegicus
cagtccataagaccaaatagttgtt

SEQ ID NO: 234843 - DNA, 25 bp, Rattus norvegicus
cagtccataagagcaaatagttgtt

SEQ ID NO: 234844 - DNA, 25 bp, Rattus norvegicus
cagtccatcctacaggtacaggcga

SEQ ID NO: 234845 - DNA, 25 bp, Rattus norvegicus
cagtccatcctagaggtacaggcga

SEQ ID NO: 234846 - DNA, 25 bp, Rattus norvegicus
cagtccatctgtacacccaatgtga

SEQ ID NO: 234847 - DNA, 25 bp, Rattus norvegicus
cagtccatctgttcacccaatgtga

SEQ ID NO: 234848 - DNA, 25 bp, Rattus norvegicus
cagtccatggtcattgccttgttga

SEQ ID NO: 234849 - DNA, 25 bp, Rattus norvegicus
cagtccatggtctttgccttgttga

SEQ ID NO: 234850 - DNA, 25 bp, Rattus norvegicus
cagtccatgttgatttgccagtgta

SEQ ID NO: 234851 - DNA, 25 bp, Rattus norvegicus
cagtccatgttgttttgccagtgta

SEQ ID NO: 234852 - DNA, 25 bp, Rattus norvegicus
cagtccattgacatttaatacgttg

SEQ ID NO: 234853 - DNA, 25 bp, Rattus norvegicus
cagtccattgacttttaatacgttg

SEQ ID NO: 234854 - DNA, 25 bp, Rattus norvegicus
cagtccattggcatcttagcacaga

SEQ ID NO: 234855 - DNA, 25 bp, Rattus norvegicus
cagtccattggcttcttagcacaga

SEQ ID NO: 234856 - DNA, 25 bp, Rattus norvegicus
cagtcccaactaatatttctatttt

SEQ ID NO: 234857 - DNA, 25 bp, Rattus norvegicus
cagtcccaactattatttctatttt

SEQ ID NO: 234858 - DNA, 25 bp, Rattus norvegicus
cagtcccaagggatccaaatccttt

SEQ ID NO: 234859 - DNA, 25 bp, Rattus norvegicus
cagtcccaagggttccaaatccttt

SEQ ID NO: 234860 - DNA, 25 bp, Rattus norvegicus
cagtcccagcttacttgaaaccaag

SEQ ID NO: 234861 - DNA, 25 bp, Rattus norvegicus
cagtcccagctttcttgaaaccaag

SEQ ID NO: 234862 - DNA, 25 bp, Rattus norvegicus
cagtcccagttcaggtatgctgtga

SEQ ID NO: 234863 - DNA, 25 bp, Rattus norvegicus
cagtcccagttctggtatgctgtga

SEQ ID NO: 234864 - DNA, 25 bp, Rattus norvegicus
cagtcccatggtcaatagtaaggtt

SEQ ID NO: 234865 - DNA, 25 bp, Rattus norvegicus
cagtcccatggtgaatagtaaggtt

SEQ ID NO: 234866 - DNA, 25 bp, Rattus norvegicus
cagtccccagtcaagcgtagatgaa

SEQ ID NO: 234867 - DNA, 25 bp, Rattus norvegicus
cagtccccagtctagcgtagatgaa

SEQ ID NO: 234868 - DNA, 25 bp, Rattus norvegicus
cagtccccatatatattggacacta

SEQ ID NO: 234869 - DNA, 25 bp, Rattus norvegicus
cagtccccatatttattggacacta

SEQ ID NO: 234870 - DNA, 25 bp, Rattus norvegicus
cagtccccatctatctttaccttga

SEQ ID NO: 234871 - DNA, 25 bp, Rattus norvegicus
cagtccccatctttctttaccttga

SEQ ID NO: 234872 - DNA, 25 bp, Rattus norvegicus
cagtccccggatctgaatgggctca

SEQ ID NO: 234873 - DNA, 25 bp, Rattus norvegicus
cagtccccggatgtgaatgggctca

SEQ ID NO: 234874 - DNA, 25 bp, Rattus norvegicus
cagtcccctcacatttagagactta

SEQ ID NO: 234875 - DNA, 25 bp, Rattus norvegicus
cagtcccctcacttttagagactta

SEQ ID NO: 234876 - DNA, 25 bp, Rattus norvegicus
cagtcccctgagagagttagtccaa

SEQ ID NO: 234877 - DNA, 25 bp, Rattus norvegicus
cagtcccctgagtgagttagtccaa

SEQ ID NO: 234878 - DNA, 25 bp, Rattus norvegicus
cagtccccttaactgtatgcagaga

SEQ ID NO: 234879 - DNA, 25 bp, Rattus norvegicus
cagtccccttaagtgtatgcagaga

SEQ ID NO: 234880 - DNA, 25 bp, Rattus norvegicus
cagtcccggttgatgtatgcaattt

SEQ ID NO: 234881 - DNA, 25 bp, Rattus norvegicus
cagtcccggttgttgtatgcaattt

SEQ ID NO: 234882 - DNA, 25 bp, Rattus norvegicus
cagtccctacctagcaaagtgtttt

SEQ ID NO: 234883 - DNA, 25 bp, Rattus norvegicus
cagtccctaccttgcaaagtgtttt

SEQ ID NO: 234884 - DNA, 25 bp, Rattus norvegicus
cagtccctgcttacaggctgaagaa

SEQ ID NO: 234885 - DNA, 25 bp, Rattus norvegicus
cagtccctgctttcaggctgaagaa

SEQ ID NO: 234886 - DNA, 25 bp, Rattus norvegicus
cagtccctgggaaattatgatcata

SEQ ID NO: 234887 - DNA, 25 bp, Rattus norvegicus
cagtccctgggaaccacacggtgga

SEQ ID NO: 234888 - DNA, 25 bp, Rattus norvegicus
cagtccctgggaagggttgatacca

SEQ ID NO: 234889 - DNA, 25 bp, Rattus norvegicus
cagtccctgggatattatgatcata

SEQ ID NO: 234890 - DNA, 25 bp, Rattus norvegicus
cagtccctgggatccacacggtgga

SEQ ID NO: 234891 - DNA, 25 bp, Rattus norvegicus
cagtccctgggatgggttgatacca

SEQ ID NO: 234892 - DNA, 25 bp, Rattus norvegicus
cagtccctgggtatgagtcacagca

SEQ ID NO: 234893 - DNA, 25 bp, Rattus norvegicus
cagtccctgggtttgagtcacagca

SEQ ID NO: 234894 - DNA, 25 bp, Rattus norvegicus
cagtccctttttcgaagcctgagga

SEQ ID NO: 234895 - DNA, 25 bp, Rattus norvegicus
cagtccctttttggaagcctgagga

SEQ ID NO: 234896 - DNA, 25 bp, Rattus norvegicus
cagtccgatcagaacagtggtccag

SEQ ID NO: 234897 - DNA, 25 bp, Rattus norvegicus
cagtccgatcagtacagtggtccag

SEQ ID NO: 234898 - DNA, 25 bp, Rattus norvegicus
cagtccgtgacaatgtttgcagcaa

SEQ ID NO: 234899 - DNA, 25 bp, Rattus norvegicus
cagtccgtgacattgtttgcagcaa

SEQ ID NO: 234900 - DNA, 25 bp, Rattus norvegicus
cagtccgtgcgtacacaggccaggt

SEQ ID NO: 234901 - DNA, 25 bp, Rattus norvegicus
cagtccgtgcgttcacaggccaggt

SEQ ID NO: 234902 - DNA, 25 bp, Rattus norvegicus
cagtccgtgtgtatagtgccatcta

SEQ ID NO: 234903 - DNA, 25 bp, Rattus norvegicus
cagtccgtgtgtttagtgccatcta

SEQ ID NO: 234904 - DNA, 25 bp, Rattus norvegicus
cagtccgttccactttgtactaaag

SEQ ID NO: 234905 - DNA, 25 bp, Rattus norvegicus
cagtccgttccagtttgtactaaag

SEQ ID NO: 234906 - DNA, 25 bp, Rattus norvegicus
cagtccgtttagaactccttagtat

SEQ ID NO: 234907 - DNA, 25 bp, Rattus norvegicus
cagtccgtttagtactccttagtat

SEQ ID NO: 234908 - DNA, 25 bp, Rattus norvegicus
cagtcctaaaatagggcttgcggtt

SEQ ID NO: 234909 - DNA, 25 bp, Rattus norvegicus
cagtcctaaaattgggcttgcggtt

SEQ ID NO: 234910 - DNA, 25 bp, Rattus norvegicus
cagtcctactgtctgtgaatagaaa

SEQ ID NO: 234911 - DNA, 25 bp, Rattus norvegicus
cagtcctactgtgtgtgaatagaaa

SEQ ID NO: 234912 - DNA, 25 bp, Rattus norvegicus
cagtcctcagctacgtagtaagttg

SEQ ID NO: 234913 - DNA, 25 bp, Rattus norvegicus
cagtcctcagcttcgtagtaagttg

SEQ ID NO: 234914 - DNA, 25 bp, Rattus norvegicus
cagtcctcgctactcagaaggcaga

SEQ ID NO: 234915 - DNA, 25 bp, Rattus norvegicus
cagtcctcgctagtcagaaggcaga

SEQ ID NO: 234916 - DNA, 25 bp, Rattus norvegicus
cagtcctctgtaaagccaagtgcca

SEQ ID NO: 234917 - DNA, 25 bp, Rattus norvegicus
cagtcctctgtatagccaagtgcca

SEQ ID NO: 234918 - DNA, 25 bp, Rattus norvegicus
cagtcctctttaccaacagtgcaaa

SEQ ID NO: 234919 - DNA, 25 bp, Rattus norvegicus
cagtcctctttagcaacagtgcaaa

SEQ ID NO: 234920 - DNA, 25 bp, Rattus norvegicus
cagtcctgaggaaagatgggccatg

SEQ ID NO: 234921 - DNA, 25 bp, Rattus norvegicus
cagtcctgaggatagatgggccatg

SEQ ID NO: 234922 - DNA, 25 bp, Rattus norvegicus
cagtcctgatgaagtttgccttgca

SEQ ID NO: 234923 - DNA, 25 bp, Rattus norvegicus
cagtcctgatgatgtttgccttgca

SEQ ID NO: 234924 - DNA, 25 bp, Rattus norvegicus
cagtcctgcagcaagctgagagtcc

SEQ ID NO: 234925 - DNA, 25 bp, Rattus norvegicus
cagtcctgcagctagctgagagtcc

SEQ ID NO: 234926 - DNA, 25 bp, Rattus norvegicus
cagtcctggattcggatggctgctc

SEQ ID NO: 234927 - DNA, 25 bp, Rattus norvegicus
cagtcctggattgggatggctgctc

SEQ ID NO: 234928 - DNA, 25 bp, Rattus norvegicus
cagtcctggtctcccagggttatgt

SEQ ID NO: 234929 - DNA, 25 bp, Rattus norvegicus
cagtcctggtctgccagggttatgt

SEQ ID NO: 234930 - DNA, 25 bp, Rattus norvegicus
cagtcctggttgcagcacagctgaa

SEQ ID NO: 234931 - DNA, 25 bp, Rattus norvegicus
cagtcctggttggagcacagctgaa

SEQ ID NO: 234932 - DNA, 25 bp, Rattus norvegicus
cagtcctgtattagaactctgttca

SEQ ID NO: 234933 - DNA, 25 bp, Rattus norvegicus
cagtcctgtatttgaactctgttca

SEQ ID NO: 234934 - DNA, 25 bp, Rattus norvegicus
cagtcctgtgcaaaccgtgggtcta

SEQ ID NO: 234935 - DNA, 25 bp, Rattus norvegicus
cagtcctgtgcataccgtgggtcta

SEQ ID NO: 234936 - DNA, 25 bp, Rattus norvegicus
cagtcctgttcaacctagcttttga

SEQ ID NO: 234937 - DNA, 25 bp, Rattus norvegicus
cagtcctgttcatcctagcttttga

SEQ ID NO: 234938 - DNA, 25 bp, Rattus norvegicus
cagtccttaagtagatttggtggca

SEQ ID NO: 234939 - DNA, 25 bp, Rattus norvegicus
cagtccttaagttgatttggtggca

SEQ ID NO: 234940 - DNA, 25 bp, Rattus norvegicus
cagtccttacttaggttgctttatc

SEQ ID NO: 234941 - DNA, 25 bp, Rattus norvegicus
cagtccttactttggttgctttatc

SEQ ID NO: 234942 - DNA, 25 bp, Rattus norvegicus
cagtccttaggcaggtcaatgggaa

SEQ ID NO: 234943 - DNA, 25 bp, Rattus norvegicus
cagtccttaggctggtcaatgggaa

SEQ ID NO: 234944 - DNA, 25 bp, Rattus norvegicus
cagtccttatcaatggtatgccccg

SEQ ID NO: 234945 - DNA, 25 bp, Rattus norvegicus
cagtccttatcattggtatgccccg

SEQ ID NO: 234946 - DNA, 25 bp, Rattus norvegicus
cagtccttgagtaagcaaccccgtt

SEQ ID NO: 234947 - DNA, 25 bp, Rattus norvegicus
cagtccttgagttagcaaccccgtt

SEQ ID NO: 234948 - DNA, 25 bp, Rattus norvegicus
cagtcctttgctcccattgtagaag

SEQ ID NO: 234949 - DNA, 25 bp, Rattus norvegicus
cagtcctttgctgccattgtagaag

SEQ ID NO: 234950 - DNA, 25 bp, Rattus norvegicus
cagtcgaaaagcaaacccggagaga

SEQ ID NO: 234951 - DNA, 25 bp, Rattus norvegicus
cagtcgaaaagctaacccggagaga

SEQ ID NO: 234952 - DNA, 25 bp, Rattus norvegicus
cagtcgaccattactctggagtgtt

SEQ ID NO: 234953 - DNA, 25 bp, Rattus norvegicus
cagtcgaccatttctctggagtgtt

SEQ ID NO: 234954 - DNA, 25 bp, Rattus norvegicus
cagtcgagagtacagttcttcccgc

SEQ ID NO: 234955 - DNA, 25 bp, Rattus norvegicus
cagtcgagagtagagttcttcccgc

SEQ ID NO: 234956 - DNA, 25 bp, Rattus norvegicus
cagtcgaggctaagttgtaagagcc

SEQ ID NO: 234957 - DNA, 25 bp, Rattus norvegicus
cagtcgaggctatgttgtaagagcc

SEQ ID NO: 234958 - DNA, 25 bp, Rattus norvegicus
cagtcgaggcttcacgaggtggcca

SEQ ID NO: 234959 - DNA, 25 bp, Rattus norvegicus
cagtcgaggcttgacgaggtggcca

SEQ ID NO: 234960 - DNA, 25 bp, Rattus norvegicus
cagtcgagtgttacccaatgtggtt

SEQ ID NO: 234961 - DNA, 25 bp, Rattus norvegicus
cagtcgagtgtttcccaatgtggtt

SEQ ID NO: 234962 - DNA, 25 bp, Rattus norvegicus
cagtcgcatggtctggctagatcgc

SEQ ID NO: 234963 - DNA, 25 bp, Rattus norvegicus
cagtcgcatggtgtggctagatcgc

SEQ ID NO: 234964 - DNA, 25 bp, Rattus norvegicus
cagtcgccatgtatgagtcattgaa

SEQ ID NO: 234965 - DNA, 25 bp, Rattus norvegicus
cagtcgccatgtttgagtcattgaa

SEQ ID NO: 234966 - DNA, 25 bp, Rattus norvegicus
cagtcgccatttacagctgtctgaa

SEQ ID NO: 234967 - DNA, 25 bp, Rattus norvegicus
cagtcgccattttcagctgtctgaa

SEQ ID NO: 234968 - DNA, 25 bp, Rattus norvegicus
cagtcgctcgttcgctggaaaacca

SEQ ID NO: 234969 - DNA, 25 bp, Rattus norvegicus
cagtcgctcgttggctggaaaacca

SEQ ID NO: 234970 - DNA, 25 bp, Rattus norvegicus
cagtcgctggctcagcctgaggaca

SEQ ID NO: 234971 - DNA, 25 bp, Rattus norvegicus
cagtcgctggctgagcctgaggaca

SEQ ID NO: 234972 - DNA, 25 bp, Rattus norvegicus
cagtcggcagccagagctcaacgtg

SEQ ID NO: 234973 - DNA, 25 bp, Rattus norvegicus
cagtcggcagcctgagctcaacgtg

SEQ ID NO: 234974 - DNA, 25 bp, Rattus norvegicus
cagtcggcaggcagaacagagttca

SEQ ID NO: 234975 - DNA, 25 bp, Rattus norvegicus
cagtcggcaggctgaacagagttca

SEQ ID NO: 234976 - DNA, 25 bp, Rattus norvegicus
cagtcggccaccacaggctgagcag

SEQ ID NO: 234977 - DNA, 25 bp, Rattus norvegicus
cagtcggccacctcaggctgagcag

SEQ ID NO: 234978 - DNA, 25 bp, Rattus norvegicus
cagtcgggaaccagcagtgtccgga

SEQ ID NO: 234979 - DNA, 25 bp, Rattus norvegicus
cagtcgggaacctgcagtgtccgga

SEQ ID NO: 234980 - DNA, 25 bp, Rattus norvegicus
cagtcggttattctcggtgcatagc

SEQ ID NO: 234981 - DNA, 25 bp, Rattus norvegicus
cagtcggttattgtcggtgcatagc

SEQ ID NO: 234982 - DNA, 25 bp, Rattus norvegicus
cagtcgtaagacatggcttccagtg

SEQ ID NO: 234983 - DNA, 25 bp, Rattus norvegicus
cagtcgtaagacttggcttccagtg

SEQ ID NO: 234984 - DNA, 25 bp, Rattus norvegicus
cagtcgtctctcagttcttgaggta

SEQ ID NO: 234985 - DNA, 25 bp, Rattus norvegicus
cagtcgtctctctgttcttgaggta

SEQ ID NO: 234986 - DNA, 25 bp, Rattus norvegicus
cagtcgtggtgaacttccatcgctc

SEQ ID NO: 234987 - DNA, 25 bp, Rattus norvegicus
cagtcgtggtgatcttccatcgctc

SEQ ID NO: 234988 - DNA, 25 bp, Rattus norvegicus
cagtcgtggtgcaggtgcaactaga

SEQ ID NO: 234989 - DNA, 25 bp, Rattus norvegicus
cagtcgtggtgctggtgcaactaga

SEQ ID NO: 234990 - DNA, 25 bp, Rattus norvegicus
cagtcgtggttaccctgtacagaga

SEQ ID NO: 234991 - DNA, 25 bp, Rattus norvegicus
cagtcgtggttagcctgtacagaga

SEQ ID NO: 234992 - DNA, 25 bp, Rattus norvegicus
cagtcgtgtgagcagcactaacaac

SEQ ID NO: 234993 - DNA, 25 bp, Rattus norvegicus
cagtcgtgtgaggagcactaacaac

SEQ ID NO: 234994 - DNA, 25 bp, Rattus norvegicus
cagtcgtgttggacggttgtctcca

SEQ ID NO: 234995 - DNA, 25 bp, Rattus norvegicus
cagtcgtgttggtcggttgtctcca

SEQ ID NO: 234996 - DNA, 25 bp, Rattus norvegicus
cagtctaagtgcagtggtgtgttaa

SEQ ID NO: 234997 - DNA, 25 bp, Rattus norvegicus
cagtctaagtgctgtggtgtgttaa

SEQ ID NO: 234998 - DNA, 25 bp, Rattus norvegicus
cagtctacagcactaaccagggcct

SEQ ID NO: 234999 - DNA, 25 bp, Rattus norvegicus
cagtctacagcagtaaccagggcct

SEQ ID NO: 235000 - DNA, 25 bp, Rattus norvegicus
cagtctaccaccagttactaaatgt

SEQ ID NO: 235001 - DNA, 25 bp, Rattus norvegicus
cagtctaccacctgttactaaatgt

SEQ ID NO: 235002 - DNA, 25 bp, Rattus norvegicus
cagtctagagccatggtgattccat

SEQ ID NO: 235003 - DNA, 25 bp, Rattus norvegicus
cagtctagagccttggtgattccat

SEQ ID NO: 235004 - DNA, 25 bp, Rattus norvegicus
cagtctagcgggaggcggcaggcct

SEQ ID NO: 235005 - DNA, 25 bp, Rattus norvegicus
cagtctagcgggtggcggcaggcct

SEQ ID NO: 235006 - DNA, 25 bp, Rattus norvegicus
cagtctagtagtcggaattgggcat

SEQ ID NO: 235007 - DNA, 25 bp, Rattus norvegicus
cagtctagtagtgggaattgggcat

SEQ ID NO: 235008 - DNA, 25 bp, Rattus norvegicus
cagtctagttttctgcctcaagaga

SEQ ID NO: 235009 - DNA, 25 bp, Rattus norvegicus
cagtctagttttgtgcctcaagaga

SEQ ID NO: 235010 - DNA, 25 bp, Rattus norvegicus
cagtctataccaactgttcttgtgg

SEQ ID NO: 235011 - DNA, 25 bp, Rattus norvegicus
cagtctataccatctgttcttgtgg

SEQ ID NO: 235012 - DNA, 25 bp, Rattus norvegicus
cagtctatagacaacagtggctttt

SEQ ID NO: 235013 - DNA, 25 bp, Rattus norvegicus
cagtctatagactacagtggctttt

SEQ ID NO: 235014 - DNA, 25 bp, Rattus norvegicus
cagtctatgaacactcagggcttta

SEQ ID NO: 235015 - DNA, 25 bp, Rattus norvegicus
cagtctatgaactctcagggcttta

SEQ ID NO: 235016 - DNA, 25 bp, Rattus norvegicus
cagtctcaaaggctcagttctcaga

SEQ ID NO: 235017 - DNA, 25 bp, Rattus norvegicus
cagtctcaaagggtcagttctcaga

SEQ ID NO: 235018 - DNA, 25 bp, Rattus norvegicus
cagtctcacaagaggctaatcttct

SEQ ID NO: 235019 - DNA, 25 bp, Rattus norvegicus
cagtctcacaagtggctaatcttct

SEQ ID NO: 235020 - DNA, 25 bp, Rattus norvegicus
cagtctcacggtactctattggaaa

SEQ ID NO: 235021 - DNA, 25 bp, Rattus norvegicus
cagtctcacggttctctattggaaa

SEQ ID NO: 235022 - DNA, 25 bp, Rattus norvegicus
cagtctcagccacttagttcatcta

SEQ ID NO: 235023 - DNA, 25 bp, Rattus norvegicus
cagtctcagccagttagttcatcta

SEQ ID NO: 235024 - DNA, 25 bp, Rattus norvegicus
cagtctcatctcaggccatccatag

SEQ ID NO: 235025 - DNA, 25 bp, Rattus norvegicus
cagtctcatctctggccatccatag

SEQ ID NO: 235026 - DNA, 25 bp, Rattus norvegicus
cagtctcatctgatcttttgaagga

SEQ ID NO: 235027 - DNA, 25 bp, Rattus norvegicus
cagtctcatctgttcttttgaagga

SEQ ID NO: 235028 - DNA, 25 bp, Rattus norvegicus
cagtctccagtaagaggtggccatt

SEQ ID NO: 235029 - DNA, 25 bp, Rattus norvegicus
cagtctccagtatgaggtggccatt

SEQ ID NO: 235030 - DNA, 25 bp, Rattus norvegicus
cagtctccccatctctaagaaggat

SEQ ID NO: 235031 - DNA, 25 bp, Rattus norvegicus
cagtctccccatgtctaagaaggat

SEQ ID NO: 235032 - DNA, 25 bp, Rattus norvegicus
cagtctccctctagtttgaaaagaa

SEQ ID NO: 235033 - DNA, 25 bp, Rattus norvegicus
cagtctccctcttgtttgaaaagaa

SEQ ID NO: 235034 - DNA, 25 bp, Rattus norvegicus
cagtctcctgatccctgtcaataaa

SEQ ID NO: 235035 - DNA, 25 bp, Rattus norvegicus
cagtctcctgatgcctgtcaataaa

SEQ ID NO: 235036 - DNA, 25 bp, Rattus norvegicus
cagtctcctgggattggtagctatg

SEQ ID NO: 235037 - DNA, 25 bp, Rattus norvegicus
cagtctcctgggtttggtagctatg

SEQ ID NO: 235038 - DNA, 25 bp, Rattus norvegicus
cagtctcctgtacaaatcacctttc

SEQ ID NO: 235039 - DNA, 25 bp, Rattus norvegicus
cagtctcctgtagaaatcacctttc

SEQ ID NO: 235040 - DNA, 25 bp, Rattus norvegicus
cagtctccttgaaccttagtcagca

SEQ ID NO: 235041 - DNA, 25 bp, Rattus norvegicus
cagtctccttgatccttagtcagca

SEQ ID NO: 235042 - DNA, 25 bp, Rattus norvegicus
cagtctccttgcagtgcatgaacag

SEQ ID NO: 235043 - DNA, 25 bp, Rattus norvegicus
cagtctccttgctgtgcatgaacag

SEQ ID NO: 235044 - DNA, 25 bp, Rattus norvegicus
cagtctccttgtatcagcgttttga

SEQ ID NO: 235045 - DNA, 25 bp, Rattus norvegicus
cagtctccttgtttcagcgttttga

SEQ ID NO: 235046 - DNA, 25 bp, Rattus norvegicus
cagtctcgtgctccatctgaatcaa

SEQ ID NO: 235047 - DNA, 25 bp, Rattus norvegicus
cagtctcgtgctgcatctgaatcaa

SEQ ID NO: 235048 - DNA, 25 bp, Rattus norvegicus
cagtctctaccaaagtgcagttcat

SEQ ID NO: 235049 - DNA, 25 bp, Rattus norvegicus
cagtctctaccatagtgcagttcat

SEQ ID NO: 235050 - DNA, 25 bp, Rattus norvegicus
cagtctctagggaacaggcgtggaa

SEQ ID NO: 235051 - DNA, 25 bp, Rattus norvegicus
cagtctctagggtacaggcgtggaa

SEQ ID NO: 235052 - DNA, 25 bp, Rattus norvegicus
cagtctctagtgagctcctttgaag

SEQ ID NO: 235053 - DNA, 25 bp, Rattus norvegicus
cagtctctagtgtgctcctttgaag

SEQ ID NO: 235054 - DNA, 25 bp, Rattus norvegicus
cagtctctctcaatgttctagtttt

SEQ ID NO: 235055 - DNA, 25 bp, Rattus norvegicus
cagtctctctcattgttctagtttt

SEQ ID NO: 235056 - DNA, 25 bp, Rattus norvegicus
cagtctctggagatcaatgtcttct

SEQ ID NO: 235057 - DNA, 25 bp, Rattus norvegicus
cagtctctggagttcaatgtcttct

SEQ ID NO: 235058 - DNA, 25 bp, Rattus norvegicus
cagtctctggtgacgtgcaatgcgg

SEQ ID NO: 235059 - DNA, 25 bp, Rattus norvegicus
cagtctctggtgtcgtgcaatgcgg

SEQ ID NO: 235060 - DNA, 25 bp, Rattus norvegicus
cagtctctgtggctttagccttagg

SEQ ID NO: 235061 - DNA, 25 bp, Rattus norvegicus
cagtctctgtgggtttagccttagg

SEQ ID NO: 235062 - DNA, 25 bp, Rattus norvegicus
cagtctcttctgcatgttaccaaat

SEQ ID NO: 235063 - DNA, 25 bp, Rattus norvegicus
cagtctcttctggatgttaccaaat

SEQ ID NO: 235064 - DNA, 25 bp, Rattus norvegicus
cagtctcttggaccagtctgagcac

SEQ ID NO: 235065 - DNA, 25 bp, Rattus norvegicus
cagtctcttggagcagtctgagcac

SEQ ID NO: 235066 - DNA, 25 bp, Rattus norvegicus
cagtctgagggacagccatggccat

SEQ ID NO: 235067 - DNA, 25 bp, Rattus norvegicus
cagtctgagggagagccatggccat

SEQ ID NO: 235068 - DNA, 25 bp, Rattus norvegicus
cagtctgagtataccgacatccgga

SEQ ID NO: 235069 - DNA, 25 bp, Rattus norvegicus
cagtctgagtattccgacatccgga

SEQ ID NO: 235070 - DNA, 25 bp, Rattus norvegicus
cagtctgatgttaagaaaattccta

SEQ ID NO: 235071 - DNA, 25 bp, Rattus norvegicus
cagtctgatgtttagaaaattccta

SEQ ID NO: 235072 - DNA, 25 bp, Rattus norvegicus
cagtctgcaccgacctagactaaaa

SEQ ID NO: 235073 - DNA, 25 bp, Rattus norvegicus
cagtctgcaccgtcctagactaaaa

SEQ ID NO: 235074 - DNA, 25 bp, Rattus norvegicus
cagtctgccagacgccttggcacag

SEQ ID NO: 235075 - DNA, 25 bp, Rattus norvegicus
cagtctgccagaggccttggcacag

SEQ ID NO: 235076 - DNA, 25 bp, Rattus norvegicus
cagtctgccttcaataatgtaccta

SEQ ID NO: 235077 - DNA, 25 bp, Rattus norvegicus
cagtctgccttctataatgtaccta

SEQ ID NO: 235078 - DNA, 25 bp, Rattus norvegicus
cagtctgcggtccactgatgaggaa

SEQ ID NO: 235079 - DNA, 25 bp, Rattus norvegicus
cagtctgcggtcgactgatgaggaa

SEQ ID NO: 235080 - DNA, 25 bp, Rattus norvegicus
cagtctgctgttcatggtttggcca

SEQ ID NO: 235081 - DNA, 25 bp, Rattus norvegicus
cagtctgctgttgatggtttggcca

SEQ ID NO: 235082 - DNA, 25 bp, Rattus norvegicus
cagtctggcatgaacctcgagtggt

SEQ ID NO: 235083 - DNA, 25 bp, Rattus norvegicus
cagtctggcatgtacctcgagtggt

SEQ ID NO: 235084 - DNA, 25 bp, Rattus norvegicus
cagtctggccttcaaatcctcctgt

SEQ ID NO: 235085 - DNA, 25 bp, Rattus norvegicus
cagtctggccttgaaatcctcctgt

SEQ ID NO: 235086 - DNA, 25 bp, Rattus norvegicus
cagtctgggagaacccgaccttgga

SEQ ID NO: 235087 - DNA, 25 bp, Rattus norvegicus
cagtctgggagatcccgaccttgga

SEQ ID NO: 235088 - DNA, 25 bp, Rattus norvegicus
cagtctgggcacacaaagggtctct

SEQ ID NO: 235089 - DNA, 25 bp, Rattus norvegicus
cagtctgggcactcaaagggtctct

SEQ ID NO: 235090 - DNA, 25 bp, Rattus norvegicus
cagtctgggcttatgagggtaatat

SEQ ID NO: 235091 - DNA, 25 bp, Rattus norvegicus
cagtctgggcttttgagggtaatat

SEQ ID NO: 235092 - DNA, 25 bp, Rattus norvegicus
cagtctgggttcagagctggattct

SEQ ID NO: 235093 - DNA, 25 bp, Rattus norvegicus
cagtctgggttctgagctggattct

SEQ ID NO: 235094 - DNA, 25 bp, Rattus norvegicus
cagtctggtcacacttaagcttcaa

SEQ ID NO: 235095 - DNA, 25 bp, Rattus norvegicus
cagtctggtcactcttaagcttcaa

SEQ ID NO: 235096 - DNA, 25 bp, Rattus norvegicus
cagtctgtaattacggaatgatcta

SEQ ID NO: 235097 - DNA, 25 bp, Rattus norvegicus
cagtctgtaatttcggaatgatcta

SEQ ID NO: 235098 - DNA, 25 bp, Rattus norvegicus
cagtctgtacagctaattctctaaa

SEQ ID NO: 235099 - DNA, 25 bp, Rattus norvegicus
cagtctgtacaggtaattctctaaa

SEQ ID NO: 235100 - DNA, 25 bp, Rattus norvegicus
cagtctgtagctccatgcattgtat

SEQ ID NO: 235101 - DNA, 25 bp, Rattus norvegicus
cagtctgtagctgcatgcattgtat

SEQ ID NO: 235102 - DNA, 25 bp, Rattus norvegicus
cagtctgtatcgcatcctcactgca

SEQ ID NO: 235103 - DNA, 25 bp, Rattus norvegicus
cagtctgtatcggatcctcactgca

SEQ ID NO: 235104 - DNA, 25 bp, Rattus norvegicus
cagtctgtcagtctagaggctctac

SEQ ID NO: 235105 - DNA, 25 bp, Rattus norvegicus
cagtctgtcagtgtagaggctctac

SEQ ID NO: 235106 - DNA, 25 bp, Rattus norvegicus
cagtctgtccagacactgggtggca

SEQ ID NO: 235107 - DNA, 25 bp, Rattus norvegicus
cagtctgtccagtcactgggtggca

SEQ ID NO: 235108 - DNA, 25 bp, Rattus norvegicus
cagtctgtcctcatggtaccatgat

SEQ ID NO: 235109 - DNA, 25 bp, Rattus norvegicus
cagtctgtcctcttggtaccatgat

SEQ ID NO: 235110 - DNA, 25 bp, Rattus norvegicus
cagtctgtcttcaatggtctttctt

SEQ ID NO: 235111 - DNA, 25 bp, Rattus norvegicus
cagtctgtcttctatggtctttctt

SEQ ID NO: 235112 - DNA, 25 bp, Rattus norvegicus
cagtctgtctttatgcatggagtta

SEQ ID NO: 235113 - DNA, 25 bp, Rattus norvegicus
cagtctgtctttatgtagagtttac

SEQ ID NO: 235114 - DNA, 25 bp, Rattus norvegicus
cagtctgtctttttgcatggagtta

SEQ ID NO: 235115 - DNA, 25 bp, Rattus norvegicus
cagtctgtctttttgtagagtttac

SEQ ID NO: 235116 - DNA, 25 bp, Rattus norvegicus
cagtctgtgaccctgtcgaatgaca

SEQ ID NO: 235117 - DNA, 25 bp, Rattus norvegicus
cagtctgtgaccgtgtcgaatgaca

SEQ ID NO: 235118 - DNA, 25 bp, Rattus norvegicus
cagtctgtgtgtaaccgtggtggtt

SEQ ID NO: 235119 - DNA, 25 bp, Rattus norvegicus
cagtctgtgtgttaccgtggtggtt

SEQ ID NO: 235120 - DNA, 25 bp, Rattus norvegicus
cagtctgtgttaagaccttaatcag

SEQ ID NO: 235121 - DNA, 25 bp, Rattus norvegicus
cagtctgtgttatgaccttaatcag

SEQ ID NO: 235122 - DNA, 25 bp, Rattus norvegicus
cagtctgttacactgacttgtgttt

SEQ ID NO: 235123 - DNA, 25 bp, Rattus norvegicus
cagtctgttacagtgacttgtgttt

SEQ ID NO: 235124 - DNA, 25 bp, Rattus norvegicus
cagtctgtttttaatgaatccattt

SEQ ID NO: 235125 - DNA, 25 bp, Rattus norvegicus
cagtctgttttttatgaatccattt

SEQ ID NO: 235126 - DNA, 25 bp, Rattus norvegicus
cagtcttaacagctgatcctagtaa

SEQ ID NO: 235127 - DNA, 25 bp, Rattus norvegicus
cagtcttaacaggtgatcctagtaa

SEQ ID NO: 235128 - DNA, 25 bp, Rattus norvegicus
cagtcttactctccatttttgtttg

SEQ ID NO: 235129 - DNA, 25 bp, Rattus norvegicus
cagtcttactctgcatttttgtttg

SEQ ID NO: 235130 - DNA, 25 bp, Rattus norvegicus
cagtcttactgcacatccataatta

SEQ ID NO: 235131 - DNA, 25 bp, Rattus norvegicus
cagtcttactgctcatccataatta

SEQ ID NO: 235132 - DNA, 25 bp, Rattus norvegicus
cagtcttcaaccatggctatgtggt

SEQ ID NO: 235133 - DNA, 25 bp, Rattus norvegicus
cagtcttcaaccttggctatgtggt

SEQ ID NO: 235134 - DNA, 25 bp, Rattus norvegicus
cagtcttcagtaaccataggcccag

SEQ ID NO: 235135 - DNA, 25 bp, Rattus norvegicus
cagtcttcagtatccataggcccag

SEQ ID NO: 235136 - DNA, 25 bp, Rattus norvegicus
cagtcttcccaccaatcttaattat

SEQ ID NO: 235137 - DNA, 25 bp, Rattus norvegicus
cagtcttcccacgaatcttaattat

SEQ ID NO: 235138 - DNA, 25 bp, Rattus norvegicus
cagtcttccctgattatttggtgca

SEQ ID NO: 235139 - DNA, 25 bp, Rattus norvegicus
cagtcttccctgtttatttggtgca

SEQ ID NO: 235140 - DNA, 25 bp, Rattus norvegicus
cagtcttcccttacttcagggaatt

SEQ ID NO: 235141 - DNA, 25 bp, Rattus norvegicus
cagtcttccctttcttcagggaatt

SEQ ID NO: 235142 - DNA, 25 bp, Rattus norvegicus
cagtcttccgtgatgggctttgcca

SEQ ID NO: 235143 - DNA, 25 bp, Rattus norvegicus
cagtcttccgtgttgggctttgcca

SEQ ID NO: 235144 - DNA, 25 bp, Rattus norvegicus
cagtcttcctcaatcagtaatacca

SEQ ID NO: 235145 - DNA, 25 bp, Rattus norvegicus
cagtcttcctcattcagtaatacca

SEQ ID NO: 235146 - DNA, 25 bp, Rattus norvegicus
cagtcttcgatgctgaggtttttca

SEQ ID NO: 235147 - DNA, 25 bp, Rattus norvegicus
cagtcttcgatggtgaggtttttca

SEQ ID NO: 235148 - DNA, 25 bp, Rattus norvegicus
cagtcttcgggaccaggttttgcac

SEQ ID NO: 235149 - DNA, 25 bp, Rattus norvegicus
cagtcttcgggagcaggttttgcac

SEQ ID NO: 235150 - DNA, 25 bp, Rattus norvegicus
cagtcttctcacagtcttggtaatg

SEQ ID NO: 235151 - DNA, 25 bp, Rattus norvegicus
cagtcttctcactgtcttggtaatg

SEQ ID NO: 235152 - DNA, 25 bp, Rattus norvegicus
cagtcttctcttatctatagcatgg

SEQ ID NO: 235153 - DNA, 25 bp, Rattus norvegicus
cagtcttctcttttctatagcatgg

SEQ ID NO: 235154 - DNA, 25 bp, Rattus norvegicus
cagtcttctgtcaacttcctgtgct

SEQ ID NO: 235155 - DNA, 25 bp, Rattus norvegicus
cagtcttctgtctacttcctgtgct

SEQ ID NO: 235156 - DNA, 25 bp, Rattus norvegicus
cagtcttcttagaaacctgaacaat

SEQ ID NO: 235157 - DNA, 25 bp, Rattus norvegicus
cagtcttcttagtaacctgaacaat

SEQ ID NO: 235158 - DNA, 25 bp, Rattus norvegicus
cagtcttgaaaacacccgctatttg

SEQ ID NO: 235159 - DNA, 25 bp, Rattus norvegicus
cagtcttgaaaagacccgctatttg

SEQ ID NO: 235160 - DNA, 25 bp, Rattus norvegicus
cagtcttgatcccactacaaagcat

SEQ ID NO: 235161 - DNA, 25 bp, Rattus norvegicus
cagtcttgatccgactacaaagcat

SEQ ID NO: 235162 - DNA, 25 bp, Rattus norvegicus
cagtcttgatttacttgtgatttgt

SEQ ID NO: 235163 - DNA, 25 bp, Rattus norvegicus
cagtcttgattttcttgtgatttgt

SEQ ID NO: 235164 - DNA, 25 bp, Rattus norvegicus
cagtcttggcatactgtacctaatg

SEQ ID NO: 235165 - DNA, 25 bp, Rattus norvegicus
cagtcttggcattctgtacctaatg

SEQ ID NO: 235166 - DNA, 25 bp, Rattus norvegicus
cagtcttggctacgtagtgaattca

SEQ ID NO: 235167 - DNA, 25 bp, Rattus norvegicus
cagtcttggctaggtagtgaattca

SEQ ID NO: 235168 - DNA, 25 bp, Rattus norvegicus
cagtcttgggaaacccctgatactt

SEQ ID NO: 235169 - DNA, 25 bp, Rattus norvegicus
cagtcttgggaatcccctgatactt

SEQ ID NO: 235170 - DNA, 25 bp, Rattus norvegicus
cagtcttgtatgagccttgatccaa

SEQ ID NO: 235171 - DNA, 25 bp, Rattus norvegicus
cagtcttgtatgtgccttgatccaa

SEQ ID NO: 235172 - DNA, 25 bp, Rattus norvegicus
cagtcttgtcagcacagtcttcaaa

SEQ ID NO: 235173 - DNA, 25 bp, Rattus norvegicus
cagtcttgtcaggacagtcttcaaa

SEQ ID NO: 235174 - DNA, 25 bp, Rattus norvegicus
cagtcttgtcttatcaaagtgctaa

SEQ ID NO: 235175 - DNA, 25 bp, Rattus norvegicus
cagtcttgtcttttcaaagtgctaa

SEQ ID NO: 235176 - DNA, 25 bp, Rattus norvegicus
cagtcttgttcccagatctcaaatt

SEQ ID NO: 235177 - DNA, 25 bp, Rattus norvegicus
cagtcttgttccgagatctcaaatt

SEQ ID NO: 235178 - DNA, 25 bp, Rattus norvegicus
cagtcttgtttcagtgttgtaactt

SEQ ID NO: 235179 - DNA, 25 bp, Rattus norvegicus
cagtcttgtttctgtgttgtaactt

SEQ ID NO: 235180 - DNA, 25 bp, Rattus norvegicus
cagtctttaaagcaacgtcgtacat

SEQ ID NO: 235181 - DNA, 25 bp, Rattus norvegicus
cagtctttaaaggaacgtcgtacat

SEQ ID NO: 235182 - DNA, 25 bp, Rattus norvegicus
cagtctttagtcacagagcctggag

SEQ ID NO: 235183 - DNA, 25 bp, Rattus norvegicus
cagtctttagtctcagagcctggag

SEQ ID NO: 235184 - DNA, 25 bp, Rattus norvegicus
cagtctttcaaaattcctacttgta

SEQ ID NO: 235185 - DNA, 25 bp, Rattus norvegicus
cagtctttcaaatttcctacttgta

SEQ ID NO: 235186 - DNA, 25 bp, Rattus norvegicus
cagtctttcctgagctagagcggca

SEQ ID NO: 235187 - DNA, 25 bp, Rattus norvegicus
cagtctttcctgtgctagagcggca

SEQ ID NO: 235188 - DNA, 25 bp, Rattus norvegicus
cagtctttcttgagacatctgtcag

SEQ ID NO: 235189 - DNA, 25 bp, Rattus norvegicus
cagtctttcttgtgacatctgtcag

SEQ ID NO: 235190 - DNA, 25 bp, Rattus norvegicus
cagtctttgagcatgggtttaccac

SEQ ID NO: 235191 - DNA, 25 bp, Rattus norvegicus
cagtctttgagcttgggtttaccac

SEQ ID NO: 235192 - DNA, 25 bp, Rattus norvegicus
cagtctttgatgagtctatgcccag

SEQ ID NO: 235193 - DNA, 25 bp, Rattus norvegicus
cagtctttgatgtgtctatgcccag

SEQ ID NO: 235194 - DNA, 25 bp, Rattus norvegicus
cagtctttgattattgcttgtttac

SEQ ID NO: 235195 - DNA, 25 bp, Rattus norvegicus
cagtctttgatttttgcttgtttac

SEQ ID NO: 235196 - DNA, 25 bp, Rattus norvegicus
cagtctttgctcactgttgacctag

SEQ ID NO: 235197 - DNA, 25 bp, Rattus norvegicus
cagtctttgctctctgttgacctag

SEQ ID NO: 235198 - DNA, 25 bp, Rattus norvegicus
cagtctttgcttcggtttgttattt

SEQ ID NO: 235199 - DNA, 25 bp, Rattus norvegicus
cagtctttgcttgggtttgttattt

SEQ ID NO: 235200 - DNA, 25 bp, Rattus norvegicus
cagtcttttattcagcagtggccat

SEQ ID NO: 235201 - DNA, 25 bp, Rattus norvegicus
cagtcttttattgagcagtggccat

SEQ ID NO: 235202 - DNA, 25 bp, Rattus norvegicus
cagtcttttctaactgaggtcccct

SEQ ID NO: 235203 - DNA, 25 bp, Rattus norvegicus
cagtcttttctatctgaggtcccct

SEQ ID NO: 235204 - DNA, 25 bp, Rattus norvegicus
cagtctttttccactccttcactgc

SEQ ID NO: 235205 - DNA, 25 bp, Rattus norvegicus
cagtctttttcctctccttcactgc

SEQ ID NO: 235206 - DNA, 25 bp, Rattus norvegicus
cagtgaaaacgactcggccgtgttc

SEQ ID NO: 235207 - DNA, 25 bp, Rattus norvegicus
cagtgaaaacgagtcggccgtgttc

SEQ ID NO: 235208 - DNA, 25 bp, Rattus norvegicus
cagtgaaacaccattgggcttattt

SEQ ID NO: 235209 - DNA, 25 bp, Rattus norvegicus
cagtgaaacacctttgggcttattt

SEQ ID NO: 235210 - DNA, 25 bp, Rattus norvegicus
cagtgaaacctgaccattgtgatgg

SEQ ID NO: 235211 - DNA, 25 bp, Rattus norvegicus
cagtgaaacctgtccattgtgatgg

SEQ ID NO: 235212 - DNA, 25 bp, Rattus norvegicus
cagtgaaagtgccaaccaggtcttt

SEQ ID NO: 235213 - DNA, 25 bp, Rattus norvegicus
cagtgaaagtgcgaaccaggtcttt

SEQ ID NO: 235214 - DNA, 25 bp, Rattus norvegicus
cagtgaaatgagacttcccgcttac

SEQ ID NO: 235215 - DNA, 25 bp, Rattus norvegicus
cagtgaaatgagtcttcccgcttac

SEQ ID NO: 235216 - DNA, 25 bp, Rattus norvegicus
cagtgaaattctactcttgtcaagt

SEQ ID NO: 235217 - DNA, 25 bp, Rattus norvegicus
cagtgaaattcttctcttgtcaagt

SEQ ID NO: 235218 - DNA, 25 bp, Rattus norvegicus
cagtgaacaaacacaggtcgttggt

SEQ ID NO: 235219 - DNA, 25 bp, Rattus norvegicus
cagtgaacaaactcaggtcgttggt

SEQ ID NO: 235220 - DNA, 25 bp, Rattus norvegicus
cagtgaacataaacctaagtccttg

SEQ ID NO: 235221 - DNA, 25 bp, Rattus norvegicus
cagtgaacataatcctaagtccttg

SEQ ID NO: 235222 - DNA, 25 bp, Rattus norvegicus
cagtgaacccaaccaagagcagctt

SEQ ID NO: 235223 - DNA, 25 bp, Rattus norvegicus
cagtgaacccaagcaagagcagctt

SEQ ID NO: 235224 - DNA, 25 bp, Rattus norvegicus
cagtgaaccttgagcccatgtgtgt

SEQ ID NO: 235225 - DNA, 25 bp, Rattus norvegicus
cagtgaaccttgtgcccatgtgtgt

SEQ ID NO: 235226 - DNA, 25 bp, Rattus norvegicus
cagtgaactcctagtttgacaggtt

SEQ ID NO: 235227 - DNA, 25 bp, Rattus norvegicus
cagtgaactccttgtttgacaggtt

SEQ ID NO: 235228 - DNA, 25 bp, Rattus norvegicus
cagtgaagaattcccaccagtgctc

SEQ ID NO: 235229 - DNA, 25 bp, Rattus norvegicus
cagtgaagaattgccaccagtgctc

SEQ ID NO: 235230 - DNA, 25 bp, Rattus norvegicus
cagtgaaggagaaagcgagtcctaa

SEQ ID NO: 235231 - DNA, 25 bp, Rattus norvegicus
cagtgaaggagatagcgagtcctaa

SEQ ID NO: 235232 - DNA, 25 bp, Rattus norvegicus
cagtgaaggttgacaggcatcggct

SEQ ID NO: 235233 - DNA, 25 bp, Rattus norvegicus
cagtgaaggttgtcaggcatcggct

SEQ ID NO: 235234 - DNA, 25 bp, Rattus norvegicus
cagtgaatctgtcttctgtctctgt

SEQ ID NO: 235235 - DNA, 25 bp, Rattus norvegicus
cagtgaatctgtgttctgtctctgt

SEQ ID NO: 235236 - DNA, 25 bp, Rattus norvegicus
cagtgaatgtttctaacggcaagtc

SEQ ID NO: 235237 - DNA, 25 bp, Rattus norvegicus
cagtgaatgtttgtaacggcaagtc

SEQ ID NO: 235238 - DNA, 25 bp, Rattus norvegicus
cagtgaattaagcttctcccttaat

SEQ ID NO: 235239 - DNA, 25 bp, Rattus norvegicus
cagtgaattaaggttctcccttaat

SEQ ID NO: 235240 - DNA, 25 bp, Rattus norvegicus
cagtgacaacctaaatttccctaat

SEQ ID NO: 235241 - DNA, 25 bp, Rattus norvegicus
cagtgacaaccttaatttccctaat

SEQ ID NO: 235242 - DNA, 25 bp, Rattus norvegicus
cagtgacaagctactaatgccctca

SEQ ID NO: 235243 - DNA, 25 bp, Rattus norvegicus
cagtgacaagcttctaatgccctca

SEQ ID NO: 235244 - DNA, 25 bp, Rattus norvegicus
cagtgacaaggcctttgactttaaa

SEQ ID NO: 235245 - DNA, 25 bp, Rattus norvegicus
cagtgacaaggcgtttgactttaaa

SEQ ID NO: 235246 - DNA, 25 bp, Rattus norvegicus
cagtgacaccgtattcttagaagct

SEQ ID NO: 235247 - DNA, 25 bp, Rattus norvegicus
cagtgacaccgttttcttagaagct

SEQ ID NO: 235248 - DNA, 25 bp, Rattus norvegicus
cagtgacactggaactactcttgca

SEQ ID NO: 235249 - DNA, 25 bp, Rattus norvegicus
cagtgacactggtactactcttgca

SEQ ID NO: 235250 - DNA, 25 bp, Rattus norvegicus
cagtgacagcagagttcctttaaca

SEQ ID NO: 235251 - DNA, 25 bp, Rattus norvegicus
cagtgacagcagtgttcctttaaca

SEQ ID NO: 235252 - DNA, 25 bp, Rattus norvegicus
cagtgacagcttcatcctgattgaa

SEQ ID NO: 235253 - DNA, 25 bp, Rattus norvegicus
cagtgacagcttgatcctgattgaa

SEQ ID NO: 235254 - DNA, 25 bp, Rattus norvegicus
cagtgacatcagaatcctccaggag

SEQ ID NO: 235255 - DNA, 25 bp, Rattus norvegicus
cagtgacatcagtatcctccaggag

SEQ ID NO: 235256 - DNA, 25 bp, Rattus norvegicus
cagtgacatcatccttaccaaataa

SEQ ID NO: 235257 - DNA, 25 bp, Rattus norvegicus
cagtgacatcatgcttaccaaataa

SEQ ID NO: 235258 - DNA, 25 bp, Rattus norvegicus
cagtgacattaccatagagctttac

SEQ ID NO: 235259 - DNA, 25 bp, Rattus norvegicus
cagtgacattacgatagagctttac

SEQ ID NO: 235260 - DNA, 25 bp, Rattus norvegicus
cagtgaccactgaacctgtgcttca

SEQ ID NO: 235261 - DNA, 25 bp, Rattus norvegicus
cagtgaccactgtacctgtgcttca

SEQ ID NO: 235262 - DNA, 25 bp, Rattus norvegicus
cagtgaccacttaccagttgagttt

SEQ ID NO: 235263 - DNA, 25 bp, Rattus norvegicus
cagtgaccactttccagttgagttt

SEQ ID NO: 235264 - DNA, 25 bp, Rattus norvegicus
cagtgaccccaactacagagtgtgt

SEQ ID NO: 235265 - DNA, 25 bp, Rattus norvegicus
cagtgaccccaagtacagagtgtgt

SEQ ID NO: 235266 - DNA, 25 bp, Rattus norvegicus
cagtgaccctttccctaggatgaac

SEQ ID NO: 235267 - DNA, 25 bp, Rattus norvegicus
cagtgaccctttgcctaggatgaac

SEQ ID NO: 235268 - DNA, 25 bp, Rattus norvegicus
cagtgacctcctcagtgacacggaa

SEQ ID NO: 235269 - DNA, 25 bp, Rattus norvegicus
cagtgacctcctgagtgacacggaa

SEQ ID NO: 235270 - DNA, 25 bp, Rattus norvegicus
cagtgacctgtgatgttaatccatt

SEQ ID NO: 235271 - DNA, 25 bp, Rattus norvegicus
cagtgacctgtgttgttaatccatt

SEQ ID NO: 235272 - DNA, 25 bp, Rattus norvegicus
cagtgaccttttcttttatctttgt

SEQ ID NO: 235273 - DNA, 25 bp, Rattus norvegicus
cagtgaccttttgttttatctttgt

SEQ ID NO: 235274 - DNA, 25 bp, Rattus norvegicus
cagtgacgaccccaacagtggtgga

SEQ ID NO: 235275 - DNA, 25 bp, Rattus norvegicus
cagtgacgacccgaacagtggtgga

SEQ ID NO: 235276 - DNA, 25 bp, Rattus norvegicus
cagtgacgaggaaggtgagtcttct

SEQ ID NO: 235277 - DNA, 25 bp, Rattus norvegicus
cagtgacgaggatggtgagtcttct

SEQ ID NO: 235278 - DNA, 25 bp, Rattus norvegicus
cagtgacgcagaactggtgcccaag

SEQ ID NO: 235279 - DNA, 25 bp, Rattus norvegicus
cagtgacgcagatctggtgcccaag

SEQ ID NO: 235280 - DNA, 25 bp, Rattus norvegicus
cagtgacgggcaacttcccttctac

SEQ ID NO: 235281 - DNA, 25 bp, Rattus norvegicus
cagtgacgggcatcttcccttctac

SEQ ID NO: 235282 - DNA, 25 bp, Rattus norvegicus
cagtgacgtactccagcgagacttg

SEQ ID NO: 235283 - DNA, 25 bp, Rattus norvegicus
cagtgacgtactgcagcgagacttg

SEQ ID NO: 235284 - DNA, 25 bp, Rattus norvegicus
cagtgactctacctttgttctagaa

SEQ ID NO: 235285 - DNA, 25 bp, Rattus norvegicus
cagtgactctacgtttgttctagaa

SEQ ID NO: 235286 - DNA, 25 bp, Rattus norvegicus
cagtgactgcttccgtttgtgaccc

SEQ ID NO: 235287 - DNA, 25 bp, Rattus norvegicus
cagtgactgcttgcgtttgtgaccc

SEQ ID NO: 235288 - DNA, 25 bp, Rattus norvegicus
cagtgactggtaacatcatgaaaac

SEQ ID NO: 235289 - DNA, 25 bp, Rattus norvegicus
cagtgactggtatcatcatgaaaac

SEQ ID NO: 235290 - DNA, 25 bp, Rattus norvegicus
cagtgactgtgtatctgatgtcgta

SEQ ID NO: 235291 - DNA, 25 bp, Rattus norvegicus
cagtgactgtgtttctgatgtcgta

SEQ ID NO: 235292 - DNA, 25 bp, Rattus norvegicus
cagtgacttcggcatgtctcgagaa

SEQ ID NO: 235293 - DNA, 25 bp, Rattus norvegicus
cagtgacttcgggatgtctcgagaa

SEQ ID NO: 235294 - DNA, 25 bp, Rattus norvegicus
cagtgacttgatctttttaatgttc

SEQ ID NO: 235295 - DNA, 25 bp, Rattus norvegicus
cagtgacttgatgtttttaatgttc

SEQ ID NO: 235296 - DNA, 25 bp, Rattus norvegicus
cagtgacttgttccgcacgtgtagt

SEQ ID NO: 235297 - DNA, 25 bp, Rattus norvegicus
cagtgacttgttgcgcacgtgtagt

SEQ ID NO: 235298 - DNA, 25 bp, Rattus norvegicus
cagtgagactcccaaggctcttgct

SEQ ID NO: 235299 - DNA, 25 bp, Rattus norvegicus
cagtgagactccgaaggctcttgct

SEQ ID NO: 235300 - DNA, 25 bp, Rattus norvegicus
cagtgagactgcaccgtcagcagtt

SEQ ID NO: 235301 - DNA, 25 bp, Rattus norvegicus
cagtgagactgcattcctatggtat

SEQ ID NO: 235302 - DNA, 25 bp, Rattus norvegicus
cagtgagactgctccgtcagcagtt

SEQ ID NO: 235303 - DNA, 25 bp, Rattus norvegicus
cagtgagactgctttcctatggtat

SEQ ID NO: 235304 - DNA, 25 bp, Rattus norvegicus
cagtgagaggtcagctgtctgttca

SEQ ID NO: 235305 - DNA, 25 bp, Rattus norvegicus
cagtgagaggtctgctgtctgttca

SEQ ID NO: 235306 - DNA, 25 bp, Rattus norvegicus
cagtgagatagcacttgactcccta

SEQ ID NO: 235307 - DNA, 25 bp, Rattus norvegicus
cagtgagatagctcttgactcccta

SEQ ID NO: 235308 - DNA, 25 bp, Rattus norvegicus
cagtgagattgtcatgtcatcccca

SEQ ID NO: 235309 - DNA, 25 bp, Rattus norvegicus
cagtgagattgtgatgtcatcccca

SEQ ID NO: 235310 - DNA, 25 bp, Rattus norvegicus
cagtgagcacgacgccagtgtccaa

SEQ ID NO: 235311 - DNA, 25 bp, Rattus norvegicus
cagtgagcacgaggccagtgtccaa

SEQ ID NO: 235312 - DNA, 25 bp, Rattus norvegicus
cagtgagcccaaagatgtcttcttc

SEQ ID NO: 235313 - DNA, 25 bp, Rattus norvegicus
cagtgagcccaatgatgtcttcttc

SEQ ID NO: 235314 - DNA, 25 bp, Rattus norvegicus
cagtgagccgtaatcttcacagtca

SEQ ID NO: 235315 - DNA, 25 bp, Rattus norvegicus
cagtgagccgtattcttcacagtca

SEQ ID NO: 235316 - DNA, 25 bp, Rattus norvegicus
cagtgagcctggcacttgctgtaga

SEQ ID NO: 235317 - DNA, 25 bp, Rattus norvegicus
cagtgagcctgggacttgctgtaga

SEQ ID NO: 235318 - DNA, 25 bp, Rattus norvegicus
cagtgagctcagaccagatggccaa

SEQ ID NO: 235319 - DNA, 25 bp, Rattus norvegicus
cagtgagctcagtccagatggccaa

SEQ ID NO: 235320 - DNA, 25 bp, Rattus norvegicus
cagtgagctccaagacagtcaggca

SEQ ID NO: 235321 - DNA, 25 bp, Rattus norvegicus
cagtgagctccatgacagtcaggca

SEQ ID NO: 235322 - DNA, 25 bp, Rattus norvegicus
cagtgagctttccactccagagaaa

SEQ ID NO: 235323 - DNA, 25 bp, Rattus norvegicus
cagtgagctttcgactccagagaaa

SEQ ID NO: 235324 - DNA, 25 bp, Rattus norvegicus
cagtgaggagcacttttcccacgca

SEQ ID NO: 235325 - DNA, 25 bp, Rattus norvegicus
cagtgaggagcagttttcccacgca

SEQ ID NO: 235326 - DNA, 25 bp, Rattus norvegicus
cagtgaggaggtaccgtttcccgat

SEQ ID NO: 235327 - DNA, 25 bp, Rattus norvegicus
cagtgaggaggttccgtttcccgat

SEQ ID NO: 235328 - DNA, 25 bp, Rattus norvegicus
cagtgaggcctgatgggtgatactt

SEQ ID NO: 235329 - DNA, 25 bp, Rattus norvegicus
cagtgaggcctgttgggtgatactt

SEQ ID NO: 235330 - DNA, 25 bp, Rattus norvegicus
cagtgaggtcctagtaacgtttgtt

SEQ ID NO: 235331 - DNA, 25 bp, Rattus norvegicus
cagtgaggtccttgtaacgtttgtt

SEQ ID NO: 235332 - DNA, 25 bp, Rattus norvegicus
cagtgaggtcttcctacagtctata

SEQ ID NO: 235333 - DNA, 25 bp, Rattus norvegicus
cagtgaggtcttgctacagtctata

SEQ ID NO: 235334 - DNA, 25 bp, Rattus norvegicus
cagtgaggtggccatcttgtgattt

SEQ ID NO: 235335 - DNA, 25 bp, Rattus norvegicus
cagtgaggtggcgatcttgtgattt

SEQ ID NO: 235336 - DNA, 25 bp, Rattus norvegicus
cagtgagtacagagctgggtctaca

SEQ ID NO: 235337 - DNA, 25 bp, Rattus norvegicus
cagtgagtacagtgctgggtctaca

SEQ ID NO: 235338 - DNA, 25 bp, Rattus norvegicus
cagtgagtccagaagcggagttaca

SEQ ID NO: 235339 - DNA, 25 bp, Rattus norvegicus
cagtgagtccagtagcggagttaca

SEQ ID NO: 235340 - DNA, 25 bp, Rattus norvegicus
cagtgagtctcaacacaacagtgaa

SEQ ID NO: 235341 - DNA, 25 bp, Rattus norvegicus
cagtgagtctcatcacaacagtgaa

SEQ ID NO: 235342 - DNA, 25 bp, Rattus norvegicus
cagtgagtctgacggccctgtctaa

SEQ ID NO: 235343 - DNA, 25 bp, Rattus norvegicus
cagtgagtctgagggccctgtctaa

SEQ ID NO: 235344 - DNA, 25 bp, Rattus norvegicus
cagtgagtgatgatttcagtgtgaa

SEQ ID NO: 235345 - DNA, 25 bp, Rattus norvegicus
cagtgagtgatgttttcagtgtgaa

SEQ ID NO: 235346 - DNA, 25 bp, Rattus norvegicus
cagtgagtgcctcgcaagcctgtga

SEQ ID NO: 235347 - DNA, 25 bp, Rattus norvegicus
cagtgagtgcctggcaagcctgtga

SEQ ID NO: 235348 - DNA, 25 bp, Rattus norvegicus
cagtgagttcatagccagagtttaa

SEQ ID NO: 235349 - DNA, 25 bp, Rattus norvegicus
cagtgagttcattgccagagtttaa

SEQ ID NO: 235350 - DNA, 25 bp, Rattus norvegicus
cagtgagttctacagatccacctgc

SEQ ID NO: 235351 - DNA, 25 bp, Rattus norvegicus
cagtgagttctagagatccacctgc

SEQ ID NO: 235352 - DNA, 25 bp, Rattus norvegicus
cagtgagtttcaatgcccacacggt

SEQ ID NO: 235353 - DNA, 25 bp, Rattus norvegicus
cagtgagtttcattgcccacacggt

SEQ ID NO: 235354 - DNA, 25 bp, Rattus norvegicus
cagtgataacccaaaagaaactctt

SEQ ID NO: 235355 - DNA, 25 bp, Rattus norvegicus
cagtgataaccctaaagaaactctt

SEQ ID NO: 235356 - DNA, 25 bp, Rattus norvegicus
cagtgataactcacttgtcttgtaa

SEQ ID NO: 235357 - DNA, 25 bp, Rattus norvegicus
cagtgataactctcttgtcttgtaa

SEQ ID NO: 235358 - DNA, 25 bp, Rattus norvegicus
cagtgatcacggctgaacctttaag

SEQ ID NO: 235359 - DNA, 25 bp, Rattus norvegicus
cagtgatcacgggtgaacctttaag

SEQ ID NO: 235360 - DNA, 25 bp, Rattus norvegicus
cagtgatcactgatgctttaggctc

SEQ ID NO: 235361 - DNA, 25 bp, Rattus norvegicus
cagtgatcactgttgctttaggctc

SEQ ID NO: 235362 - DNA, 25 bp, Rattus norvegicus
cagtgatcatgaatttgcgcctgag

SEQ ID NO: 235363 - DNA, 25 bp, Rattus norvegicus
cagtgatcatgattttgcgcctgag

SEQ ID NO: 235364 - DNA, 25 bp, Rattus norvegicus
cagtgatccattataacaaccctaa

SEQ ID NO: 235365 - DNA, 25 bp, Rattus norvegicus
cagtgatccattttaacaaccctaa

SEQ ID NO: 235366 - DNA, 25 bp, Rattus norvegicus
cagtgatcctgacttgttctgcctc

SEQ ID NO: 235367 - DNA, 25 bp, Rattus norvegicus
cagtgatcctgagttgttctgcctc

SEQ ID NO: 235368 - DNA, 25 bp, Rattus norvegicus
cagtgatcctggaagcctgccagga

SEQ ID NO: 235369 - DNA, 25 bp, Rattus norvegicus
cagtgatcctggtagcctgccagga

SEQ ID NO: 235370 - DNA, 25 bp, Rattus norvegicus
cagtgatctctccgcgtgtgacatg

SEQ ID NO: 235371 - DNA, 25 bp, Rattus norvegicus
cagtgatctctcggcgtgtgacatg

SEQ ID NO: 235372 - DNA, 25 bp, Rattus norvegicus
cagtgatcttctatggaggttccgt

SEQ ID NO: 235373 - DNA, 25 bp, Rattus norvegicus
cagtgatcttctttggaggttccgt

SEQ ID NO: 235374 - DNA, 25 bp, Rattus norvegicus
cagtgatcttgaccccttcctagtt

SEQ ID NO: 235375 - DNA, 25 bp, Rattus norvegicus
cagtgatcttgagcccttcctagtt

SEQ ID NO: 235376 - DNA, 25 bp, Rattus norvegicus
cagtgatgagatcccatgtggatgc

SEQ ID NO: 235377 - DNA, 25 bp, Rattus norvegicus
cagtgatgagatgccatgtggatgc

SEQ ID NO: 235378 - DNA, 25 bp, Rattus norvegicus
cagtgatgagttatcctttctgttc

SEQ ID NO: 235379 - DNA, 25 bp, Rattus norvegicus
cagtgatgagttttcctttctgttc

SEQ ID NO: 235380 - DNA, 25 bp, Rattus norvegicus
cagtgatgccagagtttaccagaga

SEQ ID NO: 235381 - DNA, 25 bp, Rattus norvegicus
cagtgatgccagtgtttaccagaga

SEQ ID NO: 235382 - DNA, 25 bp, Rattus norvegicus
cagtgatgccgtagaccttgaagga

SEQ ID NO: 235383 - DNA, 25 bp, Rattus norvegicus
cagtgatgccgttgaccttgaagga

SEQ ID NO: 235384 - DNA, 25 bp, Rattus norvegicus
cagtgatgctccatgaccagatgaa

SEQ ID NO: 235385 - DNA, 25 bp, Rattus norvegicus
cagtgatgctccttgaccagatgaa

SEQ ID NO: 235386 - DNA, 25 bp, Rattus norvegicus
cagtgatgctctcggttttcagtaa

SEQ ID NO: 235387 - DNA, 25 bp, Rattus norvegicus
cagtgatgctctgggttttcagtaa

SEQ ID NO: 235388 - DNA, 25 bp, Rattus norvegicus
cagtgatggctgattggtgtcgtct

SEQ ID NO: 235389 - DNA, 25 bp, Rattus norvegicus
cagtgatggctgcttcagaggacat

SEQ ID NO: 235390 - DNA, 25 bp, Rattus norvegicus
cagtgatggctggttcagaggacat

SEQ ID NO: 235391 - DNA, 25 bp, Rattus norvegicus
cagtgatggctgtttggtgtcgtct

SEQ ID NO: 235392 - DNA, 25 bp, Rattus norvegicus
cagtgatgggtaatgccccttagaa

SEQ ID NO: 235393 - DNA, 25 bp, Rattus norvegicus
cagtgatgggtattgccccttagaa

SEQ ID NO: 235394 - DNA, 25 bp, Rattus norvegicus
cagtgatgtgttacgtccccagtta

SEQ ID NO: 235395 - DNA, 25 bp, Rattus norvegicus
cagtgatgtgtttcgtccccagtta

SEQ ID NO: 235396 - DNA, 25 bp, Rattus norvegicus
cagtgatgttggagtggagctcccc

SEQ ID NO: 235397 - DNA, 25 bp, Rattus norvegicus
cagtgatgttggtgtggagctcccc

SEQ ID NO: 235398 - DNA, 25 bp, Rattus norvegicus
cagtgattatatctttttgcagaac

SEQ ID NO: 235399 - DNA, 25 bp, Rattus norvegicus
cagtgattatatgtttttgcagaac

SEQ ID NO: 235400 - DNA, 25 bp, Rattus norvegicus
cagtgattatgcagatatcctctga

SEQ ID NO: 235401 - DNA, 25 bp, Rattus norvegicus
cagtgattatgcctcttggatcaat

SEQ ID NO: 235402 - DNA, 25 bp, Rattus norvegicus
cagtgattatgcgtcttggatcaat

SEQ ID NO: 235403 - DNA, 25 bp, Rattus norvegicus
cagtgattatgctgatatcctctga

SEQ ID NO: 235404 - DNA, 25 bp, Rattus norvegicus
cagtgattccctattcaatgacatt

SEQ ID NO: 235405 - DNA, 25 bp, Rattus norvegicus
cagtgattcccttttcaatgacatt

SEQ ID NO: 235406 - DNA, 25 bp, Rattus norvegicus
cagtgattcctaaagcccgtatctc

SEQ ID NO: 235407 - DNA, 25 bp, Rattus norvegicus
cagtgattcctatagcccgtatctc

SEQ ID NO: 235408 - DNA, 25 bp, Rattus norvegicus
cagtgattctaaatggcagtataca

SEQ ID NO: 235409 - DNA, 25 bp, Rattus norvegicus
cagtgattctaattggcagtataca

SEQ ID NO: 235410 - DNA, 25 bp, Rattus norvegicus
cagtgatttctcaggctttagtaat

SEQ ID NO: 235411 - DNA, 25 bp, Rattus norvegicus
cagtgatttctctggctttagtaat

SEQ ID NO: 235412 - DNA, 25 bp, Rattus norvegicus
cagtgatttctgactttgactatac

SEQ ID NO: 235413 - DNA, 25 bp, Rattus norvegicus
cagtgatttctgtctttgactatac

SEQ ID NO: 235414 - DNA, 25 bp, Rattus norvegicus
cagtgattttgaactttagcttcaa

SEQ ID NO: 235415 - DNA, 25 bp, Rattus norvegicus
cagtgattttgatctttagcttcaa

SEQ ID NO: 235416 - DNA, 25 bp, Rattus norvegicus
cagtgcaaatctagcccctaatggg

SEQ ID NO: 235417 - DNA, 25 bp, Rattus norvegicus
cagtgcaaatcttgcccctaatggg

SEQ ID NO: 235418 - DNA, 25 bp, Rattus norvegicus
cagtgcaactgtcttaaacctacct

SEQ ID NO: 235419 - DNA, 25 bp, Rattus norvegicus
cagtgcaactgtgttaaacctacct

SEQ ID NO: 235420 - DNA, 25 bp, Rattus norvegicus
cagtgcaaggccatcttctgtagat

SEQ ID NO: 235421 - DNA, 25 bp, Rattus norvegicus
cagtgcaaggccttcttctgtagat

SEQ ID NO: 235422 - DNA, 25 bp, Rattus norvegicus
cagtgcacacaactgaacactcatc

SEQ ID NO: 235423 - DNA, 25 bp, Rattus norvegicus
cagtgcacacaagtgaacactcatc

SEQ ID NO: 235424 - DNA, 25 bp, Rattus norvegicus
cagtgcacactgattgtacataaaa

SEQ ID NO: 235425 - DNA, 25 bp, Rattus norvegicus
cagtgcacactgtttgtacataaaa

SEQ ID NO: 235426 - DNA, 25 bp, Rattus norvegicus
cagtgcacagttccacaggcgtggt

SEQ ID NO: 235427 - DNA, 25 bp, Rattus norvegicus
cagtgcacagttgcacaggcgtggt

SEQ ID NO: 235428 - DNA, 25 bp, Rattus norvegicus
cagtgcacataaaacttccctgtat

SEQ ID NO: 235429 - DNA, 25 bp, Rattus norvegicus
cagtgcacataatacttccctgtat

SEQ ID NO: 235430 - DNA, 25 bp, Rattus norvegicus
cagtgcacgctcactatgtatttaa

SEQ ID NO: 235431 - DNA, 25 bp, Rattus norvegicus
cagtgcacgctctctatgtatttaa

SEQ ID NO: 235432 - DNA, 25 bp, Rattus norvegicus
cagtgcactgttctgaagtctcttg

SEQ ID NO: 235433 - DNA, 25 bp, Rattus norvegicus
cagtgcactgttgtgaagtctcttg

SEQ ID NO: 235434 - DNA, 25 bp, Rattus norvegicus
cagtgcagatgaagtctgtgtgaca

SEQ ID NO: 235435 - DNA, 25 bp, Rattus norvegicus
cagtgcagatgatgtctgtgtgaca

SEQ ID NO: 235436 - DNA, 25 bp, Rattus norvegicus
cagtgcagatttagattccagcccc

SEQ ID NO: 235437 - DNA, 25 bp, Rattus norvegicus
cagtgcagattttgattccagcccc

SEQ ID NO: 235438 - DNA, 25 bp, Rattus norvegicus
cagtgcagcgctacctgggatggct

SEQ ID NO: 235439 - DNA, 25 bp, Rattus norvegicus
cagtgcagcgcttcctgggatggct

SEQ ID NO: 235440 - DNA, 25 bp, Rattus norvegicus
cagtgcagctagagtttatgtcaat

SEQ ID NO: 235441 - DNA, 25 bp, Rattus norvegicus
cagtgcagctagtgtttatgtcaat

SEQ ID NO: 235442 - DNA, 25 bp, Rattus norvegicus
cagtgcaggcgcacatggtgctgtc

SEQ ID NO: 235443 - DNA, 25 bp, Rattus norvegicus
cagtgcaggcgctcatggtgctgtc

SEQ ID NO: 235444 - DNA, 25 bp, Rattus norvegicus
cagtgcaggtgacatccattttcca

SEQ ID NO: 235445 - DNA, 25 bp, Rattus norvegicus
cagtgcaggtgagatccattttcca

SEQ ID NO: 235446 - DNA, 25 bp, Rattus norvegicus
cagtgcagtacaaatcttgagtgta

SEQ ID NO: 235447 - DNA, 25 bp, Rattus norvegicus
cagtgcagtacatatcttgagtgta

SEQ ID NO: 235448 - DNA, 25 bp, Rattus norvegicus
cagtgcagtctgatgagggcatcct

SEQ ID NO: 235449 - DNA, 25 bp, Rattus norvegicus
cagtgcagtctgttgagggcatcct

SEQ ID NO: 235450 - DNA, 25 bp, Rattus norvegicus
cagtgcagttctcgccaaggccaag

SEQ ID NO: 235451 - DNA, 25 bp, Rattus norvegicus
cagtgcagttctggccaaggccaag

SEQ ID NO: 235452 - DNA, 25 bp, Rattus norvegicus
cagtgcatggtgcttctgcttgcat

SEQ ID NO: 235453 - DNA, 25 bp, Rattus norvegicus
cagtgcatggtggttctgcttgcat

SEQ ID NO: 235454 - DNA, 25 bp, Rattus norvegicus
cagtgcattctgcatcttttatcaa

SEQ ID NO: 235455 - DNA, 25 bp, Rattus norvegicus
cagtgcattctggatcttttatcaa

SEQ ID NO: 235456 - DNA, 25 bp, Rattus norvegicus
cagtgcattgcactggaaaggatat

SEQ ID NO: 235457 - DNA, 25 bp, Rattus norvegicus
cagtgcattgcagtggaaaggatat

SEQ ID NO: 235458 - DNA, 25 bp, Rattus norvegicus
cagtgcattgtaattaggattagat

SEQ ID NO: 235459 - DNA, 25 bp, Rattus norvegicus
cagtgcattgtatttaggattagat

SEQ ID NO: 235460 - DNA, 25 bp, Rattus norvegicus
cagtgccaacctccaggctaatggg

SEQ ID NO: 235461 - DNA, 25 bp, Rattus norvegicus
cagtgccaacctgcaggctaatggg

SEQ ID NO: 235462 - DNA, 25 bp, Rattus norvegicus
cagtgccaactgaggagcttttgtt

SEQ ID NO: 235463 - DNA, 25 bp, Rattus norvegicus
cagtgccaactgtggagcttttgtt

SEQ ID NO: 235464 - DNA, 25 bp, Rattus norvegicus
cagtgccaagcaagtaatctccagt

SEQ ID NO: 235465 - DNA, 25 bp, Rattus norvegicus
cagtgccaagcatgtaatctccagt

SEQ ID NO: 235466 - DNA, 25 bp, Rattus norvegicus
cagtgccaccatccgattgtacagt

SEQ ID NO: 235467 - DNA, 25 bp, Rattus norvegicus
cagtgccaccatgcgattgtacagt

SEQ ID NO: 235468 - DNA, 25 bp, Rattus norvegicus
cagtgccacgtcatgagcgtcagag

SEQ ID NO: 235469 - DNA, 25 bp, Rattus norvegicus
cagtgccacgtcttgagcgtcagag

SEQ ID NO: 235470 - DNA, 25 bp, Rattus norvegicus
cagtgccactccaaatgttatttag

SEQ ID NO: 235471 - DNA, 25 bp, Rattus norvegicus
cagtgccactcctaatgttatttag

SEQ ID NO: 235472 - DNA, 25 bp, Rattus norvegicus
cagtgccagcatcttttagtaagaa

SEQ ID NO: 235473 - DNA, 25 bp, Rattus norvegicus
cagtgccagcatgttttagtaagaa

SEQ ID NO: 235474 - DNA, 25 bp, Rattus norvegicus
cagtgccagccaagttacctgaaat

SEQ ID NO: 235475 - DNA, 25 bp, Rattus norvegicus
cagtgccagccatgttacctgaaat

SEQ ID NO: 235476 - DNA, 25 bp, Rattus norvegicus
cagtgccaggccaacaggcgagcct

SEQ ID NO: 235477 - DNA, 25 bp, Rattus norvegicus
cagtgccaggcctacaggcgagcct

SEQ ID NO: 235478 - DNA, 25 bp, Rattus norvegicus
cagtgccagggacttgctgcagttt

SEQ ID NO: 235479 - DNA, 25 bp, Rattus norvegicus
cagtgccagggagttgctgcagttt

SEQ ID NO: 235480 - DNA, 25 bp, Rattus norvegicus
cagtgccagggcatgggttgaattc

SEQ ID NO: 235481 - DNA, 25 bp, Rattus norvegicus
cagtgccagggcttgggttgaattc

SEQ ID NO: 235482 - DNA, 25 bp, Rattus norvegicus
cagtgccaggttcgccaggttctga

SEQ ID NO: 235483 - DNA, 25 bp, Rattus norvegicus
cagtgccaggttggccaggttctga

SEQ ID NO: 235484 - DNA, 25 bp, Rattus norvegicus
cagtgccatactcttaccattctgg

SEQ ID NO: 235485 - DNA, 25 bp, Rattus norvegicus
cagtgccatactgttaccattctgg

SEQ ID NO: 235486 - DNA, 25 bp, Rattus norvegicus
cagtgccataggctacaattgggaa

SEQ ID NO: 235487 - DNA, 25 bp, Rattus norvegicus
cagtgccatagggtacaattgggaa

SEQ ID NO: 235488 - DNA, 25 bp, Rattus norvegicus
cagtgccatttactcagagatctct

SEQ ID NO: 235489 - DNA, 25 bp, Rattus norvegicus
cagtgccatttagtcagagatctct

SEQ ID NO: 235490 - DNA, 25 bp, Rattus norvegicus
cagtgcccacttcagtttgtagcaa

SEQ ID NO: 235491 - DNA, 25 bp, Rattus norvegicus
cagtgcccacttcctatattgataa

SEQ ID NO: 235492 - DNA, 25 bp, Rattus norvegicus
cagtgcccacttgagtttgtagcaa

SEQ ID NO: 235493 - DNA, 25 bp, Rattus norvegicus
cagtgcccacttgctatattgataa

SEQ ID NO: 235494 - DNA, 25 bp, Rattus norvegicus
cagtgcccaggaagaatgcccttgt

SEQ ID NO: 235495 - DNA, 25 bp, Rattus norvegicus
cagtgcccaggatgaatgcccttgt

SEQ ID NO: 235496 - DNA, 25 bp, Rattus norvegicus
cagtgccccagacgagtcagactac

SEQ ID NO: 235497 - DNA, 25 bp, Rattus norvegicus
cagtgccccagaggagtcagactac

SEQ ID NO: 235498 - DNA, 25 bp, Rattus norvegicus
cagtgcccgaatacttatcttttga

SEQ ID NO: 235499 - DNA, 25 bp, Rattus norvegicus
cagtgcccgaattcttatcttttga

SEQ ID NO: 235500 - DNA, 25 bp, Rattus norvegicus
cagtgcccttggacaaaggtgcttt

SEQ ID NO: 235501 - DNA, 25 bp, Rattus norvegicus
cagtgcccttggtcaaaggtgcttt

SEQ ID NO: 235502 - DNA, 25 bp, Rattus norvegicus
cagtgccctttgagtggatggccag

SEQ ID NO: 235503 - DNA, 25 bp, Rattus norvegicus
cagtgccctttgtgtggatggccag

SEQ ID NO: 235504 - DNA, 25 bp, Rattus norvegicus
cagtgccgatgacaagagagccctt

SEQ ID NO: 235505 - DNA, 25 bp, Rattus norvegicus
cagtgccgatgagaagagagccctt

SEQ ID NO: 235506 - DNA, 25 bp, Rattus norvegicus
cagtgcctctgaccctggtattaag

SEQ ID NO: 235507 - DNA, 25 bp, Rattus norvegicus
cagtgcctctgagcctggtattaag

SEQ ID NO: 235508 - DNA, 25 bp, Rattus norvegicus
cagtgcctctggaaacctaaccaaa

SEQ ID NO: 235509 - DNA, 25 bp, Rattus norvegicus
cagtgcctctggtaacctaaccaaa

SEQ ID NO: 235510 - DNA, 25 bp, Rattus norvegicus
cagtgcctgaggagaatttgaagat

SEQ ID NO: 235511 - DNA, 25 bp, Rattus norvegicus
cagtgcctgaggtgaatttgaagat

SEQ ID NO: 235512 - DNA, 25 bp, Rattus norvegicus
cagtgcctgctgattacacattgtg

SEQ ID NO: 235513 - DNA, 25 bp, Rattus norvegicus
cagtgcctgctgtttacacattgtg

SEQ ID NO: 235514 - DNA, 25 bp, Rattus norvegicus
cagtgcctgtctccctgtgcataga

SEQ ID NO: 235515 - DNA, 25 bp, Rattus norvegicus
cagtgcctgtctgcctgtgcataga

SEQ ID NO: 235516 - DNA, 25 bp, Rattus norvegicus
cagtgccttccaatgatgttatgtg

SEQ ID NO: 235517 - DNA, 25 bp, Rattus norvegicus
cagtgccttccattgatgttatgtg

SEQ ID NO: 235518 - DNA, 25 bp, Rattus norvegicus
cagtgccttctgatgtacatgaata

SEQ ID NO: 235519 - DNA, 25 bp, Rattus norvegicus
cagtgccttctgttgtacatgaata

SEQ ID NO: 235520 - DNA, 25 bp, Rattus norvegicus
cagtgccttgctacatgggaatcat

SEQ ID NO: 235521 - DNA, 25 bp, Rattus norvegicus
cagtgccttgcttcatgggaatcat

SEQ ID NO: 235522 - DNA, 25 bp, Rattus norvegicus
cagtgccttgggacagagctttatc

SEQ ID NO: 235523 - DNA, 25 bp, Rattus norvegicus
cagtgccttgggtcagagctttatc

SEQ ID NO: 235524 - DNA, 25 bp, Rattus norvegicus
cagtgcctttgcagctatggatcaa

SEQ ID NO: 235525 - DNA, 25 bp, Rattus norvegicus
cagtgcctttgctgctatggatcaa

SEQ ID NO: 235526 - DNA, 25 bp, Rattus norvegicus
cagtgcgaagtcattgccgttggcg

SEQ ID NO: 235527 - DNA, 25 bp, Rattus norvegicus
cagtgcgaagtctttgccgttggcg

SEQ ID NO: 235528 - DNA, 25 bp, Rattus norvegicus
cagtgcgacctgcagcaagtgcaat

SEQ ID NO: 235529 - DNA, 25 bp, Rattus norvegicus
cagtgcgacctggagcaagtgcaat

SEQ ID NO: 235530 - DNA, 25 bp, Rattus norvegicus
cagtgcgggttactgctcccagaga

SEQ ID NO: 235531 - DNA, 25 bp, Rattus norvegicus
cagtgcgggttagtgctcccagaga

SEQ ID NO: 235532 - DNA, 25 bp, Rattus norvegicus
cagtgcgtcctgctggttgacaaac

SEQ ID NO: 235533 - DNA, 25 bp, Rattus norvegicus
cagtgcgtcctggtggttgacaaac

SEQ ID NO: 235534 - DNA, 25 bp, Rattus norvegicus
cagtgcgtcttgaggagcgtgccct

SEQ ID NO: 235535 - DNA, 25 bp, Rattus norvegicus
cagtgcgtcttgtggagcgtgccct

SEQ ID NO: 235536 - DNA, 25 bp, Rattus norvegicus
cagtgctaacagctctggatatttt

SEQ ID NO: 235537 - DNA, 25 bp, Rattus norvegicus
cagtgctaacaggtctggatatttt

SEQ ID NO: 235538 - DNA, 25 bp, Rattus norvegicus
cagtgctaccatcggacagctgtat

SEQ ID NO: 235539 - DNA, 25 bp, Rattus norvegicus
cagtgctaccatgggacagctgtat

SEQ ID NO: 235540 - DNA, 25 bp, Rattus norvegicus
cagtgctacccacgctgaaaatgtg

SEQ ID NO: 235541 - DNA, 25 bp, Rattus norvegicus
cagtgctacccaggctgaaaatgtg

SEQ ID NO: 235542 - DNA, 25 bp, Rattus norvegicus
cagtgctactgtcttgagatttggt

SEQ ID NO: 235543 - DNA, 25 bp, Rattus norvegicus
cagtgctactgtgttgagatttggt

SEQ ID NO: 235544 - DNA, 25 bp, Rattus norvegicus
cagtgctagcaccaagtccttgaat

SEQ ID NO: 235545 - DNA, 25 bp, Rattus norvegicus
cagtgctagcacgaagtccttgaat

SEQ ID NO: 235546 - DNA, 25 bp, Rattus norvegicus
cagtgctagggacaccaagacagaa

SEQ ID NO: 235547 - DNA, 25 bp, Rattus norvegicus
cagtgctagggagaccaagacagaa

SEQ ID NO: 235548 - DNA, 25 bp, Rattus norvegicus
cagtgctcagggatgactcctttga

SEQ ID NO: 235549 - DNA, 25 bp, Rattus norvegicus
cagtgctcagggttgactcctttga

SEQ ID NO: 235550 - DNA, 25 bp, Rattus norvegicus
cagtgctcagtaattatttagtctt

SEQ ID NO: 235551 - DNA, 25 bp, Rattus norvegicus
cagtgctcagtatttatttagtctt

SEQ ID NO: 235552 - DNA, 25 bp, Rattus norvegicus
cagtgctccactctgtctttattat

SEQ ID NO: 235553 - DNA, 25 bp, Rattus norvegicus
cagtgctccactgtgtctttattat

SEQ ID NO: 235554 - DNA, 25 bp, Rattus norvegicus
cagtgctcgcagagtgttcagtttc

SEQ ID NO: 235555 - DNA, 25 bp, Rattus norvegicus
cagtgctcgcagtgtgttcagtttc

SEQ ID NO: 235556 - DNA, 25 bp, Rattus norvegicus
cagtgctctgatcccttttttataa

SEQ ID NO: 235557 - DNA, 25 bp, Rattus norvegicus
cagtgctctgatgccttttttataa

SEQ ID NO: 235558 - DNA, 25 bp, Rattus norvegicus
cagtgctctgcaaatttagtccatt

SEQ ID NO: 235559 - DNA, 25 bp, Rattus norvegicus
cagtgctctgcatatttagtccatt

SEQ ID NO: 235560 - DNA, 25 bp, Rattus norvegicus
cagtgctctggcaaatggcaaatga

SEQ ID NO: 235561 - DNA, 25 bp, Rattus norvegicus
cagtgctctggctaatggcaaatga

SEQ ID NO: 235562 - DNA, 25 bp, Rattus norvegicus
cagtgctctgtgatgtccacgtgat

SEQ ID NO: 235563 - DNA, 25 bp, Rattus norvegicus
cagtgctctgtgttgtccacgtgat

SEQ ID NO: 235564 - DNA, 25 bp, Rattus norvegicus
cagtgctgactgacctggcttggag

SEQ ID NO: 235565 - DNA, 25 bp, Rattus norvegicus
cagtgctgactgtcctggcttggag

SEQ ID NO: 235566 - DNA, 25 bp, Rattus norvegicus
cagtgctgagtaatatagtcctttc

SEQ ID NO: 235567 - DNA, 25 bp, Rattus norvegicus
cagtgctgagtattatagtcctttc

SEQ ID NO: 235568 - DNA, 25 bp, Rattus norvegicus
cagtgctgatgtcctctgtttatgg

SEQ ID NO: 235569 - DNA, 25 bp, Rattus norvegicus
cagtgctgatgtgctctgtttatgg

SEQ ID NO: 235570 - DNA, 25 bp, Rattus norvegicus
cagtgctgatttaatatccctgtca

SEQ ID NO: 235571 - DNA, 25 bp, Rattus norvegicus
cagtgctgattttatatccctgtca

SEQ ID NO: 235572 - DNA, 25 bp, Rattus norvegicus
cagtgctgcgctcgcattggcaaaa

SEQ ID NO: 235573 - DNA, 25 bp, Rattus norvegicus
cagtgctgcgctggcattggcaaaa

SEQ ID NO: 235574 - DNA, 25 bp, Rattus norvegicus
cagtgctgctctcaggattctacag

SEQ ID NO: 235575 - DNA, 25 bp, Rattus norvegicus
cagtgctgctctgaggattctacag

SEQ ID NO: 235576 - DNA, 25 bp, Rattus norvegicus
cagtgctggacacgtttctgaagac

SEQ ID NO: 235577 - DNA, 25 bp, Rattus norvegicus
cagtgctggacaggtttctgaagac

SEQ ID NO: 235578 - DNA, 25 bp, Rattus norvegicus
cagtgctggatacattgtgaggacc

SEQ ID NO: 235579 - DNA, 25 bp, Rattus norvegicus
cagtgctggatagattgtgaggacc

SEQ ID NO: 235580 - DNA, 25 bp, Rattus norvegicus
cagtgctgggagactgtgctgacca

SEQ ID NO: 235581 - DNA, 25 bp, Rattus norvegicus
cagtgctgggagtctgtgctgacca

SEQ ID NO: 235582 - DNA, 25 bp, Rattus norvegicus
cagtgctgtgctctctaaccatcca

SEQ ID NO: 235583 - DNA, 25 bp, Rattus norvegicus
cagtgctgtgctgtctaaccatcca

SEQ ID NO: 235584 - DNA, 25 bp, Rattus norvegicus
cagtgctgtgtcatttttgacttca

SEQ ID NO: 235585 - DNA, 25 bp, Rattus norvegicus
cagtgctgtgtcttttttgacttca

SEQ ID NO: 235586 - DNA, 25 bp, Rattus norvegicus
cagtgcttggagagctgacagccca

SEQ ID NO: 235587 - DNA, 25 bp, Rattus norvegicus
cagtgcttggagtgctgacagccca

SEQ ID NO: 235588 - DNA, 25 bp, Rattus norvegicus
cagtgctttttgaagctgtctgagt

SEQ ID NO: 235589 - DNA, 25 bp, Rattus norvegicus
cagtgctttttgtagctgtctgagt

SEQ ID NO: 235590 - DNA, 25 bp, Rattus norvegicus
cagtggaaccaaatttctgccctta

SEQ ID NO: 235591 - DNA, 25 bp, Rattus norvegicus
cagtggaaccaattttctgccctta

SEQ ID NO: 235592 - DNA, 25 bp, Rattus norvegicus
cagtggaacttcagacctcagcaaa

SEQ ID NO: 235593 - DNA, 25 bp, Rattus norvegicus
cagtggaacttctgacctcagcaaa

SEQ ID NO: 235594 - DNA, 25 bp, Rattus norvegicus
cagtggaagccaattacagctaaat

SEQ ID NO: 235595 - DNA, 25 bp, Rattus norvegicus
cagtggaagccatttacagctaaat

SEQ ID NO: 235596 - DNA, 25 bp, Rattus norvegicus
cagtggaagcctcccaatcacggcg

SEQ ID NO: 235597 - DNA, 25 bp, Rattus norvegicus
cagtggaagcctgccaatcacggcg

SEQ ID NO: 235598 - DNA, 25 bp, Rattus norvegicus
cagtggaagcgtcctgggtcctcaa

SEQ ID NO: 235599 - DNA, 25 bp, Rattus norvegicus
cagtggaagcgtgctgggtcctcaa

SEQ ID NO: 235600 - DNA, 25 bp, Rattus norvegicus
cagtggaaggtgctgtctcttcttt

SEQ ID NO: 235601 - DNA, 25 bp, Rattus norvegicus
cagtggaaggtggtgtctcttcttt

SEQ ID NO: 235602 - DNA, 25 bp, Rattus norvegicus
cagtggaagttcctcaaccctcgtt

SEQ ID NO: 235603 - DNA, 25 bp, Rattus norvegicus
cagtggaagttcgtcaaccctcgtt

SEQ ID NO: 235604 - DNA, 25 bp, Rattus norvegicus
cagtggaatggccagctgcttgtct

SEQ ID NO: 235605 - DNA, 25 bp, Rattus norvegicus
cagtggaatggcgagctgcttgtct

SEQ ID NO: 235606 - DNA, 25 bp, Rattus norvegicus
cagtggacacttctgtggagttgca

SEQ ID NO: 235607 - DNA, 25 bp, Rattus norvegicus
cagtggacacttgtgtggagttgca

SEQ ID NO: 235608 - DNA, 25 bp, Rattus norvegicus
cagtggacatttagctctctcggga

SEQ ID NO: 235609 - DNA, 25 bp, Rattus norvegicus
cagtggacattttgctctctcggga

SEQ ID NO: 235610 - DNA, 25 bp, Rattus norvegicus
cagtggactctgcagctacagttaa

SEQ ID NO: 235611 - DNA, 25 bp, Rattus norvegicus
cagtggactctggagctacagttaa

SEQ ID NO: 235612 - DNA, 25 bp, Rattus norvegicus
cagtggagcgctcgcataccctgac

SEQ ID NO: 235613 - DNA, 25 bp, Rattus norvegicus
cagtggagcgctggcataccctgac

SEQ ID NO: 235614 - DNA, 25 bp, Rattus norvegicus
cagtggagcggcagcagcagctcaa

SEQ ID NO: 235615 - DNA, 25 bp, Rattus norvegicus
cagtggagcggctgcagcagctcaa

SEQ ID NO: 235616 - DNA, 25 bp, Rattus norvegicus
cagtggagtcggagacagtgtcctc

SEQ ID NO: 235617 - DNA, 25 bp, Rattus norvegicus
cagtggagtcggtgacagtgtcctc

SEQ ID NO: 235618 - DNA, 25 bp, Rattus norvegicus
cagtggagtggacgcagcctcccac

SEQ ID NO: 235619 - DNA, 25 bp, Rattus norvegicus
cagtggagtggaggcagcctcccac

SEQ ID NO: 235620 - DNA, 25 bp, Rattus norvegicus
cagtggagtgtaaccatgcttccca

SEQ ID NO: 235621 - DNA, 25 bp, Rattus norvegicus
cagtggagtgtatccatgcttccca

SEQ ID NO: 235622 - DNA, 25 bp, Rattus norvegicus
cagtggagttctacggaggacatga

SEQ ID NO: 235623 - DNA, 25 bp, Rattus norvegicus
cagtggagttcttcggaggacatga

SEQ ID NO: 235624 - DNA, 25 bp, Rattus norvegicus
cagtggataaaacccctggttgacc

SEQ ID NO: 235625 - DNA, 25 bp, Rattus norvegicus
cagtggataaaagccctggttgacc

SEQ ID NO: 235626 - DNA, 25 bp, Rattus norvegicus
cagtggatcaccaacgagcagttaa

SEQ ID NO: 235627 - DNA, 25 bp, Rattus norvegicus
cagtggatcacctacgagcagttaa

SEQ ID NO: 235628 - DNA, 25 bp, Rattus norvegicus
cagtggatcttcagaactgcccttg

SEQ ID NO: 235629 - DNA, 25 bp, Rattus norvegicus
cagtggatcttctgaactgcccttg

SEQ ID NO: 235630 - DNA, 25 bp, Rattus norvegicus
cagtggatgttgacctgggcctccc

SEQ ID NO: 235631 - DNA, 25 bp, Rattus norvegicus
cagtggatgttgtcctgggcctccc

SEQ ID NO: 235632 - DNA, 25 bp, Rattus norvegicus
cagtggatttgtactttttgcctca

SEQ ID NO: 235633 - DNA, 25 bp, Rattus norvegicus
cagtggatttgttctttttgcctca

SEQ ID NO: 235634 - DNA, 25 bp, Rattus norvegicus
cagtggcaacctccggatggccgtt

SEQ ID NO: 235635 - DNA, 25 bp, Rattus norvegicus
cagtggcaacctgcggatggccgtt

SEQ ID NO: 235636 - DNA, 25 bp, Rattus norvegicus
cagtggcacatacgcatttcttagt

SEQ ID NO: 235637 - DNA, 25 bp, Rattus norvegicus
cagtggcacataggcatttcttagt

SEQ ID NO: 235638 - DNA, 25 bp, Rattus norvegicus
cagtggcactgcacttggagcggat

SEQ ID NO: 235639 - DNA, 25 bp, Rattus norvegicus
cagtggcactgctcttggagcggat

SEQ ID NO: 235640 - DNA, 25 bp, Rattus norvegicus
cagtggcagacaagctggtggccca

SEQ ID NO: 235641 - DNA, 25 bp, Rattus norvegicus
cagtggcagacatgctggtggccca

SEQ ID NO: 235642 - DNA, 25 bp, Rattus norvegicus
cagtggcagaggaagcccatgcttc

SEQ ID NO: 235643 - DNA, 25 bp, Rattus norvegicus
cagtggcagaggtagcccatgcttc

SEQ ID NO: 235644 - DNA, 25 bp, Rattus norvegicus
cagtggcagtttatcgagaccttta

SEQ ID NO: 235645 - DNA, 25 bp, Rattus norvegicus
cagtggcagtttttcgagaccttta

SEQ ID NO: 235646 - DNA, 25 bp, Rattus norvegicus
cagtggcatttgattattaagtctc

SEQ ID NO: 235647 - DNA, 25 bp, Rattus norvegicus
cagtggcatttgtttattaagtctc

SEQ ID NO: 235648 - DNA, 25 bp, Rattus norvegicus
cagtggccactgagatcatccagag

SEQ ID NO: 235649 - DNA, 25 bp, Rattus norvegicus
cagtggccactgtgatcatccagag

SEQ ID NO: 235650 - DNA, 25 bp, Rattus norvegicus
cagtggccagacctttgcagtgaaa

SEQ ID NO: 235651 - DNA, 25 bp, Rattus norvegicus
cagtggccagacgtttgcagtgaaa

SEQ ID NO: 235652 - DNA, 25 bp, Rattus norvegicus
cagtggccagagcatgcgtgcaata

SEQ ID NO: 235653 - DNA, 25 bp, Rattus norvegicus
cagtggccagaggatgcgtgcaata

SEQ ID NO: 235654 - DNA, 25 bp, Rattus norvegicus
cagtggccagccatgcatggataca

SEQ ID NO: 235655 - DNA, 25 bp, Rattus norvegicus
cagtggccagccttgcatggataca

SEQ ID NO: 235656 - DNA, 25 bp, Rattus norvegicus
cagtggccagtgaacatggtggact

SEQ ID NO: 235657 - DNA, 25 bp, Rattus norvegicus
cagtggccagtgtacatggtggact

SEQ ID NO: 235658 - DNA, 25 bp, Rattus norvegicus
cagtggccatatatgggcagttccc

SEQ ID NO: 235659 - DNA, 25 bp, Rattus norvegicus
cagtggccatatttgggcagttccc

SEQ ID NO: 235660 - DNA, 25 bp, Rattus norvegicus
cagtggcccaataccattgggatgg

SEQ ID NO: 235661 - DNA, 25 bp, Rattus norvegicus
cagtggcccaattccattgggatgg

SEQ ID NO: 235662 - DNA, 25 bp, Rattus norvegicus
cagtggcccacaaacggaaactttg

SEQ ID NO: 235663 - DNA, 25 bp, Rattus norvegicus
cagtggcccacatacggaaactttg

SEQ ID NO: 235664 - DNA, 25 bp, Rattus norvegicus
cagtggcccctaagcaggagattta

SEQ ID NO: 235665 - DNA, 25 bp, Rattus norvegicus
cagtggcccctatgcaggagattta

SEQ ID NO: 235666 - DNA, 25 bp, Rattus norvegicus
cagtggcccctcattgcatttggag

SEQ ID NO: 235667 - DNA, 25 bp, Rattus norvegicus
cagtggcccctctttgcatttggag

SEQ ID NO: 235668 - DNA, 25 bp, Rattus norvegicus
cagtggcctgagatgggtttagctt

SEQ ID NO: 235669 - DNA, 25 bp, Rattus norvegicus
cagtggcctgagttgggtttagctt

SEQ ID NO: 235670 - DNA, 25 bp, Rattus norvegicus
cagtggcctgatcgctgaagcacat

SEQ ID NO: 235671 - DNA, 25 bp, Rattus norvegicus
cagtggcctgatggctgaagcacat

SEQ ID NO: 235672 - DNA, 25 bp, Rattus norvegicus
cagtggcctggcatagctgagtgaa

SEQ ID NO: 235673 - DNA, 25 bp, Rattus norvegicus
cagtggcctggcttagctgagtgaa

SEQ ID NO: 235674 - DNA, 25 bp, Rattus norvegicus
cagtggcgattcagggacctgctcg

SEQ ID NO: 235675 - DNA, 25 bp, Rattus norvegicus
cagtggcgattctgggacctgctcg

SEQ ID NO: 235676 - DNA, 25 bp, Rattus norvegicus
cagtggcgtcagctctctgccttca

SEQ ID NO: 235677 - DNA, 25 bp, Rattus norvegicus
cagtggcgtcaggtctctgccttca

SEQ ID NO: 235678 - DNA, 25 bp, Rattus norvegicus
cagtggcgtttcatcagttagcaga

SEQ ID NO: 235679 - DNA, 25 bp, Rattus norvegicus
cagtggcgtttcttcagttagcaga

SEQ ID NO: 235680 - DNA, 25 bp, Rattus norvegicus
cagtggctacacagcccaggagtat

SEQ ID NO: 235681 - DNA, 25 bp, Rattus norvegicus
cagtggctacactgcccaggagtat

SEQ ID NO: 235682 - DNA, 25 bp, Rattus norvegicus
cagtggctaccgcaagttcccagaa

SEQ ID NO: 235683 - DNA, 25 bp, Rattus norvegicus
cagtggctaccggaagttcccagaa

SEQ ID NO: 235684 - DNA, 25 bp, Rattus norvegicus
cagtggctccagagcttctccaggc

SEQ ID NO: 235685 - DNA, 25 bp, Rattus norvegicus
cagtggctccagtgcttctccaggc

SEQ ID NO: 235686 - DNA, 25 bp, Rattus norvegicus
cagtggctcccaatttagaacctaa

SEQ ID NO: 235687 - DNA, 25 bp, Rattus norvegicus
cagtggctcccattttagaacctaa

SEQ ID NO: 235688 - DNA, 25 bp, Rattus norvegicus
cagtggctctcaccgttcaggaagc

SEQ ID NO: 235689 - DNA, 25 bp, Rattus norvegicus
cagtggctctcagcgttcaggaagc

SEQ ID NO: 235690 - DNA, 25 bp, Rattus norvegicus
cagtggctgaatcataccttaggtt

SEQ ID NO: 235691 - DNA, 25 bp, Rattus norvegicus
cagtggctgaatgataccttaggtt

SEQ ID NO: 235692 - DNA, 25 bp, Rattus norvegicus
cagtggctgactatttcctgtgact

SEQ ID NO: 235693 - DNA, 25 bp, Rattus norvegicus
cagtggctgactttttcctgtgact

SEQ ID NO: 235694 - DNA, 25 bp, Rattus norvegicus
cagtggctgcagcagccttgccact

SEQ ID NO: 235695 - DNA, 25 bp, Rattus norvegicus
cagtggctgcaggagccttgccact

SEQ ID NO: 235696 - DNA, 25 bp, Rattus norvegicus
cagtggctgctcacattgatgtgta

SEQ ID NO: 235697 - DNA, 25 bp, Rattus norvegicus
cagtggctgctctcattgatgtgta

SEQ ID NO: 235698 - DNA, 25 bp, Rattus norvegicus
cagtggctgctgaatatgcgtagaa

SEQ ID NO: 235699 - DNA, 25 bp, Rattus norvegicus
cagtggctgctgtatatgcgtagaa

SEQ ID NO: 235700 - DNA, 25 bp, Rattus norvegicus
cagtggctggtcaatgcgattacat

SEQ ID NO: 235701 - DNA, 25 bp, Rattus norvegicus
cagtggctggtctatgcgattacat

SEQ ID NO: 235702 - DNA, 25 bp, Rattus norvegicus
cagtggctgtagactactgagacac

SEQ ID NO: 235703 - DNA, 25 bp, Rattus norvegicus
cagtggctgtagagcatgtcacttt

SEQ ID NO: 235704 - DNA, 25 bp, Rattus norvegicus
cagtggctgtagtctactgagacac

SEQ ID NO: 235705 - DNA, 25 bp, Rattus norvegicus
cagtggctgtagtgcatgtcacttt

SEQ ID NO: 235706 - DNA, 25 bp, Rattus norvegicus
cagtggcttggcagtgtctgtgacc

SEQ ID NO: 235707 - DNA, 25 bp, Rattus norvegicus
cagtggcttggctgtgtctgtgacc

SEQ ID NO: 235708 - DNA, 25 bp, Rattus norvegicus
cagtgggaaagtatgacagcagaat

SEQ ID NO: 235709 - DNA, 25 bp, Rattus norvegicus
cagtgggaaagtttgacagcagaat

SEQ ID NO: 235710 - DNA, 25 bp, Rattus norvegicus
cagtgggaaataacgctcttatcta

SEQ ID NO: 235711 - DNA, 25 bp, Rattus norvegicus
cagtgggaaatatcgctcttatcta

SEQ ID NO: 235712 - DNA, 25 bp, Rattus norvegicus
cagtgggaaatgacacgcggctgca

SEQ ID NO: 235713 - DNA, 25 bp, Rattus norvegicus
cagtgggaaatgtcacgcggctgca

SEQ ID NO: 235714 - DNA, 25 bp, Rattus norvegicus
cagtgggaacttagtctctaaagaa

SEQ ID NO: 235715 - DNA, 25 bp, Rattus norvegicus
cagtgggaactttgtctctaaagaa

SEQ ID NO: 235716 - DNA, 25 bp, Rattus norvegicus
cagtgggaagccagtatcgggacat

SEQ ID NO: 235717 - DNA, 25 bp, Rattus norvegicus
cagtgggaagcctgtatcgggacat

SEQ ID NO: 235718 - DNA, 25 bp, Rattus norvegicus
cagtgggacactccattgctgggca

SEQ ID NO: 235719 - DNA, 25 bp, Rattus norvegicus
cagtgggacactgcattgctgggca

SEQ ID NO: 235720 - DNA, 25 bp, Rattus norvegicus
cagtgggacaggacgaggcctctct

SEQ ID NO: 235721 - DNA, 25 bp, Rattus norvegicus
cagtgggacaggtcgaggcctctct

SEQ ID NO: 235722 - DNA, 25 bp, Rattus norvegicus
cagtgggaccatcggctatgcatct

SEQ ID NO: 235723 - DNA, 25 bp, Rattus norvegicus
cagtgggaccatgggctatgcatct

SEQ ID NO: 235724 - DNA, 25 bp, Rattus norvegicus
cagtgggactcacccgcactctggg

SEQ ID NO: 235725 - DNA, 25 bp, Rattus norvegicus
cagtgggactcagccgcactctggg

SEQ ID NO: 235726 - DNA, 25 bp, Rattus norvegicus
cagtgggagctcatcgagttcaagg

SEQ ID NO: 235727 - DNA, 25 bp, Rattus norvegicus
cagtgggagctcttcgagttcaagg

SEQ ID NO: 235728 - DNA, 25 bp, Rattus norvegicus
cagtgggagtatacctgcggacttt

SEQ ID NO: 235729 - DNA, 25 bp, Rattus norvegicus
cagtgggagtattcctgcggacttt

SEQ ID NO: 235730 - DNA, 25 bp, Rattus norvegicus
cagtgggagtgacgctcagctcctt

SEQ ID NO: 235731 - DNA, 25 bp, Rattus norvegicus
cagtgggagtgaggctcagctcctt

SEQ ID NO: 235732 - DNA, 25 bp, Rattus norvegicus
cagtgggcactcagtgcattgctaa

SEQ ID NO: 235733 - DNA, 25 bp, Rattus norvegicus
cagtgggcactctgtgcattgctaa

SEQ ID NO: 235734 - DNA, 25 bp, Rattus norvegicus
cagtgggcagatcagacactgtccc

SEQ ID NO: 235735 - DNA, 25 bp, Rattus norvegicus
cagtgggcagatgagacactgtccc

SEQ ID NO: 235736 - DNA, 25 bp, Rattus norvegicus
cagtgggccaggcaaccagagcttc

SEQ ID NO: 235737 - DNA, 25 bp, Rattus norvegicus
cagtgggccagggaaccagagcttc

SEQ ID NO: 235738 - DNA, 25 bp, Rattus norvegicus
cagtgggcgtggaaagcttactctt

SEQ ID NO: 235739 - DNA, 25 bp, Rattus norvegicus
cagtgggcgtggtaagcttactctt

SEQ ID NO: 235740 - DNA, 25 bp, Rattus norvegicus
cagtgggctagcagtcaggtttttc

SEQ ID NO: 235741 - DNA, 25 bp, Rattus norvegicus
cagtgggctagctgtcaggtttttc

SEQ ID NO: 235742 - DNA, 25 bp, Rattus norvegicus
cagtgggctgtgagccacggtatct

SEQ ID NO: 235743 - DNA, 25 bp, Rattus norvegicus
cagtgggctgtgtgccacggtatct

SEQ ID NO: 235744 - DNA, 25 bp, Rattus norvegicus
cagtgggcttcccttttcatagttt

SEQ ID NO: 235745 - DNA, 25 bp, Rattus norvegicus
cagtgggcttccgttttcatagttt

SEQ ID NO: 235746 - DNA, 25 bp, Rattus norvegicus
cagtgggctttgaggatgctcctaa

SEQ ID NO: 235747 - DNA, 25 bp, Rattus norvegicus
cagtgggctttgtggatgctcctaa

SEQ ID NO: 235748 - DNA, 25 bp, Rattus norvegicus
cagtgggtacatcgttgctttccta

SEQ ID NO: 235749 - DNA, 25 bp, Rattus norvegicus
cagtgggtacatggttgctttccta

SEQ ID NO: 235750 - DNA, 25 bp, Rattus norvegicus
cagtgggtacctccgggacagctta

SEQ ID NO: 235751 - DNA, 25 bp, Rattus norvegicus
cagtgggtacctgcgggacagctta

SEQ ID NO: 235752 - DNA, 25 bp, Rattus norvegicus
cagtgggtcgtcctagtgcacacct

SEQ ID NO: 235753 - DNA, 25 bp, Rattus norvegicus
cagtgggtcgtcgtagtgcacacct

SEQ ID NO: 235754 - DNA, 25 bp, Rattus norvegicus
cagtgggtgcctaaggacaagaact

SEQ ID NO: 235755 - DNA, 25 bp, Rattus norvegicus
cagtgggtgccttaggacaagaact

SEQ ID NO: 235756 - DNA, 25 bp, Rattus norvegicus
cagtgggtttatagtgcttctcctt

SEQ ID NO: 235757 - DNA, 25 bp, Rattus norvegicus
cagtgggtttattgtgcttctcctt

SEQ ID NO: 235758 - DNA, 25 bp, Rattus norvegicus
cagtgggttttcacatcagtgttca

SEQ ID NO: 235759 - DNA, 25 bp, Rattus norvegicus
cagtgggttttctcatcagtgttca

SEQ ID NO: 235760 - DNA, 25 bp, Rattus norvegicus
cagtggtaaagcagcctcggcggta

SEQ ID NO: 235761 - DNA, 25 bp, Rattus norvegicus
cagtggtaaagctgcctcggcggta

SEQ ID NO: 235762 - DNA, 25 bp, Rattus norvegicus
cagtggtaacttatgtccaccttct

SEQ ID NO: 235763 - DNA, 25 bp, Rattus norvegicus
cagtggtaacttttgtccaccttct

SEQ ID NO: 235764 - DNA, 25 bp, Rattus norvegicus
cagtggtactttcctgacgtcagaa

SEQ ID NO: 235765 - DNA, 25 bp, Rattus norvegicus
cagtggtactttgctgacgtcagaa

SEQ ID NO: 235766 - DNA, 25 bp, Rattus norvegicus
cagtggtagcgtcatcctcaagatc

SEQ ID NO: 235767 - DNA, 25 bp, Rattus norvegicus
cagtggtagcgtgatcctcaagatc

SEQ ID NO: 235768 - DNA, 25 bp, Rattus norvegicus
cagtggtatataccgggcttgccta

SEQ ID NO: 235769 - DNA, 25 bp, Rattus norvegicus
cagtggtatatagcgggcttgccta

SEQ ID NO: 235770 - DNA, 25 bp, Rattus norvegicus
cagtggtcaagcacgggtcacaggc

SEQ ID NO: 235771 - DNA, 25 bp, Rattus norvegicus
cagtggtcaagctcgggtcacaggc

SEQ ID NO: 235772 - DNA, 25 bp, Rattus norvegicus
cagtggtcagatccctttcctataa

SEQ ID NO: 235773 - DNA, 25 bp, Rattus norvegicus
cagtggtcagatgcctttcctataa

SEQ ID NO: 235774 - DNA, 25 bp, Rattus norvegicus
cagtggtcatgtagccccttcgagg

SEQ ID NO: 235775 - DNA, 25 bp, Rattus norvegicus
cagtggtcatgttgccccttcgagg

SEQ ID NO: 235776 - DNA, 25 bp, Rattus norvegicus
cagtggtctgcgctattttcgtaag

SEQ ID NO: 235777 - DNA, 25 bp, Rattus norvegicus
cagtggtctgcggtattttcgtaag

SEQ ID NO: 235778 - DNA, 25 bp, Rattus norvegicus
cagtggtgacttatttaccggttca

SEQ ID NO: 235779 - DNA, 25 bp, Rattus norvegicus
cagtggtgacttttttaccggttca

SEQ ID NO: 235780 - DNA, 25 bp, Rattus norvegicus
cagtggtgagccctgttcattttta

SEQ ID NO: 235781 - DNA, 25 bp, Rattus norvegicus
cagtggtgagccgtgttcattttta

SEQ ID NO: 235782 - DNA, 25 bp, Rattus norvegicus
cagtggtgcctcatgtagcatgtat

SEQ ID NO: 235783 - DNA, 25 bp, Rattus norvegicus
cagtggtgcctcttgtagcatgtat

SEQ ID NO: 235784 - DNA, 25 bp, Rattus norvegicus
cagtggtgctggagataaacatgat

SEQ ID NO: 235785 - DNA, 25 bp, Rattus norvegicus
cagtggtgctggtgataaacatgat

SEQ ID NO: 235786 - DNA, 25 bp, Rattus norvegicus
cagtggtggaagctcacaggcctaa

SEQ ID NO: 235787 - DNA, 25 bp, Rattus norvegicus
cagtggtggaaggtcacaggcctaa

SEQ ID NO: 235788 - DNA, 25 bp, Rattus norvegicus
cagtggtggcatccaggaccagatt

SEQ ID NO: 235789 - DNA, 25 bp, Rattus norvegicus
cagtggtggcatgcaggaccagatt

SEQ ID NO: 235790 - DNA, 25 bp, Rattus norvegicus
cagtggtggccaccttggagacatt

SEQ ID NO: 235791 - DNA, 25 bp, Rattus norvegicus
cagtggtggccagcttggagacatt

SEQ ID NO: 235792 - DNA, 25 bp, Rattus norvegicus
cagtggtgggcacatccaagtgctt

SEQ ID NO: 235793 - DNA, 25 bp, Rattus norvegicus
cagtggtgggcagatccaagtgctt

SEQ ID NO: 235794 - DNA, 25 bp, Rattus norvegicus
cagtggtgtctgacacattttatca

SEQ ID NO: 235795 - DNA, 25 bp, Rattus norvegicus
cagtggtgtctgtcacattttatca

SEQ ID NO: 235796 - DNA, 25 bp, Rattus norvegicus
cagtggtgtgtcctcatttgttaca

SEQ ID NO: 235797 - DNA, 25 bp, Rattus norvegicus
cagtggtgtgtcgtcatttgttaca

SEQ ID NO: 235798 - DNA, 25 bp, Rattus norvegicus
cagtggtgttgcaagtgtcctctgt

SEQ ID NO: 235799 - DNA, 25 bp, Rattus norvegicus
cagtggtgttgctagtgtcctctgt

SEQ ID NO: 235800 - DNA, 25 bp, Rattus norvegicus
cagtggttaaaacactatctgctct

SEQ ID NO: 235801 - DNA, 25 bp, Rattus norvegicus
cagtggttaaaagactatctgctct

SEQ ID NO: 235802 - DNA, 25 bp, Rattus norvegicus
cagtggttagctaagtgtgcggaca

SEQ ID NO: 235803 - DNA, 25 bp, Rattus norvegicus
cagtggttagcttagtgtgcggaca

SEQ ID NO: 235804 - DNA, 25 bp, Rattus norvegicus
cagtggttaggaattctgtcaccga

SEQ ID NO: 235805 - DNA, 25 bp, Rattus norvegicus
cagtggttaggatttctgtcaccga

SEQ ID NO: 235806 - DNA, 25 bp, Rattus norvegicus
cagtggttcagtccatatcttaggt

SEQ ID NO: 235807 - DNA, 25 bp, Rattus norvegicus
cagtggttcagtgcatatcttaggt

SEQ ID NO: 235808 - DNA, 25 bp, Rattus norvegicus
cagtggttccctagcaatagttgtg

SEQ ID NO: 235809 - DNA, 25 bp, Rattus norvegicus
cagtggttcccttgcaatagttgtg

SEQ ID NO: 235810 - DNA, 25 bp, Rattus norvegicus
cagtggttccgacaatgtgggctct

SEQ ID NO: 235811 - DNA, 25 bp, Rattus norvegicus
cagtggttccgagaatgtgggctct

SEQ ID NO: 235812 - DNA, 25 bp, Rattus norvegicus
cagtggttccggatcacttggatag

SEQ ID NO: 235813 - DNA, 25 bp, Rattus norvegicus
cagtggttccggttcacttggatag

SEQ ID NO: 235814 - DNA, 25 bp, Rattus norvegicus
cagtggttctacaccaaagcatgaa

SEQ ID NO: 235815 - DNA, 25 bp, Rattus norvegicus
cagtggttctactccaaagcatgaa

SEQ ID NO: 235816 - DNA, 25 bp, Rattus norvegicus
cagtggttgagcatcgactgctctt

SEQ ID NO: 235817 - DNA, 25 bp, Rattus norvegicus
cagtggttgagcttcgactgctctt

SEQ ID NO: 235818 - DNA, 25 bp, Rattus norvegicus
cagtggtttactctactctgcaaac

SEQ ID NO: 235819 - DNA, 25 bp, Rattus norvegicus
cagtggtttactgtactctgcaaac

SEQ ID NO: 235820 - DNA, 25 bp, Rattus norvegicus
cagtggtttcctattgggagtctca

SEQ ID NO: 235821 - DNA, 25 bp, Rattus norvegicus
cagtggtttccttttgggagtctca

SEQ ID NO: 235822 - DNA, 25 bp, Rattus norvegicus
cagtggtttgagaccctgtatgttg

SEQ ID NO: 235823 - DNA, 25 bp, Rattus norvegicus
cagtggtttgagtccctgtatgttg

SEQ ID NO: 235824 - DNA, 25 bp, Rattus norvegicus
cagtggttttaacagcaggccccgg

SEQ ID NO: 235825 - DNA, 25 bp, Rattus norvegicus
cagtggttttaagagcaggccccgg

SEQ ID NO: 235826 - DNA, 25 bp, Rattus norvegicus
cagtggttttgtatataagcagagt

SEQ ID NO: 235827 - DNA, 25 bp, Rattus norvegicus
cagtggttttgtttataagcagagt

SEQ ID NO: 235828 - DNA, 25 bp, Rattus norvegicus
cagtgtaaagctaatttgtattcaa

SEQ ID NO: 235829 - DNA, 25 bp, Rattus norvegicus
cagtgtaaagcttatttgtattcaa

SEQ ID NO: 235830 - DNA, 25 bp, Rattus norvegicus
cagtgtacacttctgtacatactga

SEQ ID NO: 235831 - DNA, 25 bp, Rattus norvegicus
cagtgtacacttgtgtacatactga

SEQ ID NO: 235832 - DNA, 25 bp, Rattus norvegicus
cagtgtacagatatctatgcaggca

SEQ ID NO: 235833 - DNA, 25 bp, Rattus norvegicus
cagtgtacagatttctatgcaggca

SEQ ID NO: 235834 - DNA, 25 bp, Rattus norvegicus
cagtgtacatacactgtatcatgaa

SEQ ID NO: 235835 - DNA, 25 bp, Rattus norvegicus
cagtgtacatactctgtatcatgaa

SEQ ID NO: 235836 - DNA, 25 bp, Rattus norvegicus
cagtgtaccacacagatggcagcaa

SEQ ID NO: 235837 - DNA, 25 bp, Rattus norvegicus
cagtgtaccacagagatggcagcaa

SEQ ID NO: 235838 - DNA, 25 bp, Rattus norvegicus
cagtgtacggctcggcttagtcaca

SEQ ID NO: 235839 - DNA, 25 bp, Rattus norvegicus
cagtgtacggctgggcttagtcaca

SEQ ID NO: 235840 - DNA, 25 bp, Rattus norvegicus
cagtgtacttggcagcttttataaa

SEQ ID NO: 235841 - DNA, 25 bp, Rattus norvegicus
cagtgtacttgggagcttttataaa

SEQ ID NO: 235842 - DNA, 25 bp, Rattus norvegicus
cagtgtactttgaatcattgatgaa

SEQ ID NO: 235843 - DNA, 25 bp, Rattus norvegicus
cagtgtactttgtatcattgatgaa

SEQ ID NO: 235844 - DNA, 25 bp, Rattus norvegicus
cagtgtagacccagcgactatggat

SEQ ID NO: 235845 - DNA, 25 bp, Rattus norvegicus
cagtgtagaccctgcgactatggat

SEQ ID NO: 235846 - DNA, 25 bp, Rattus norvegicus
cagtgtagacttatgtttgtgccca

SEQ ID NO: 235847 - DNA, 25 bp, Rattus norvegicus
cagtgtagacttttgtttgtgccca

SEQ ID NO: 235848 - DNA, 25 bp, Rattus norvegicus
cagtgtagttaacggtggctctctc

SEQ ID NO: 235849 - DNA, 25 bp, Rattus norvegicus
cagtgtagttaagggtggctctctc

SEQ ID NO: 235850 - DNA, 25 bp, Rattus norvegicus
cagtgtagttgtatttctcctttca

SEQ ID NO: 235851 - DNA, 25 bp, Rattus norvegicus
cagtgtagttgtttttctcctttca

SEQ ID NO: 235852 - DNA, 25 bp, Rattus norvegicus
cagtgtatagatcccctaccctgac

SEQ ID NO: 235853 - DNA, 25 bp, Rattus norvegicus
cagtgtatagatgccctaccctgac

SEQ ID NO: 235854 - DNA, 25 bp, Rattus norvegicus
cagtgtatcaagagtggccaagctt

SEQ ID NO: 235855 - DNA, 25 bp, Rattus norvegicus
cagtgtatcaagtgtggccaagctt

SEQ ID NO: 235856 - DNA, 25 bp, Rattus norvegicus
cagtgtatccagcacaccgaggata

SEQ ID NO: 235857 - DNA, 25 bp, Rattus norvegicus
cagtgtatccaggacaccgaggata

SEQ ID NO: 235858 - DNA, 25 bp, Rattus norvegicus
cagtgtatgacgatggccccaccgg

SEQ ID NO: 235859 - DNA, 25 bp, Rattus norvegicus
cagtgtatgacgttggccccaccgg

SEQ ID NO: 235860 - DNA, 25 bp, Rattus norvegicus
cagtgtatgactacagcgctgccga

SEQ ID NO: 235861 - DNA, 25 bp, Rattus norvegicus
cagtgtatgacttcagcgctgccga

SEQ ID NO: 235862 - DNA, 25 bp, Rattus norvegicus
cagtgtatgggcagttgcttctcca

SEQ ID NO: 235863 - DNA, 25 bp, Rattus norvegicus
cagtgtatgggctgttgcttctcca

SEQ ID NO: 235864 - DNA, 25 bp, Rattus norvegicus
cagtgtattatgatcaatgtctaaa

SEQ ID NO: 235865 - DNA, 25 bp, Rattus norvegicus
cagtgtattatgttcaatgtctaaa

SEQ ID NO: 235866 - DNA, 25 bp, Rattus norvegicus
cagtgtcacccaatactatgtataa

SEQ ID NO: 235867 - DNA, 25 bp, Rattus norvegicus
cagtgtcacccattactatgtataa

SEQ ID NO: 235868 - DNA, 25 bp, Rattus norvegicus
cagtgtcaccttattatgttttatt

SEQ ID NO: 235869 - DNA, 25 bp, Rattus norvegicus
cagtgtcacctttttatgttttatt

SEQ ID NO: 235870 - DNA, 25 bp, Rattus norvegicus
cagtgtcacggtattttgtattatg

SEQ ID NO: 235871 - DNA, 25 bp, Rattus norvegicus
cagtgtcacggttttttgtattatg

SEQ ID NO: 235872 - DNA, 25 bp, Rattus norvegicus
cagtgtcactgcaggagattactcc

SEQ ID NO: 235873 - DNA, 25 bp, Rattus norvegicus
cagtgtcactgctggagattactcc

SEQ ID NO: 235874 - DNA, 25 bp, Rattus norvegicus
cagtgtcactgtcttgtcccatggg

SEQ ID NO: 235875 - DNA, 25 bp, Rattus norvegicus
cagtgtcactgtgttgtcccatggg

SEQ ID NO: 235876 - DNA, 25 bp, Rattus norvegicus
cagtgtcagaatatatggccctttt

SEQ ID NO: 235877 - DNA, 25 bp, Rattus norvegicus
cagtgtcagaatttatggccctttt

SEQ ID NO: 235878 - DNA, 25 bp, Rattus norvegicus
cagtgtcaggttatcctcctaggaa

SEQ ID NO: 235879 - DNA, 25 bp, Rattus norvegicus
cagtgtcaggttttcctcctaggaa

SEQ ID NO: 235880 - DNA, 25 bp, Rattus norvegicus
cagtgtcagtgccagtgtccagatg

SEQ ID NO: 235881 - DNA, 25 bp, Rattus norvegicus
cagtgtcagtgcgagtgtccagatg

SEQ ID NO: 235882 - DNA, 25 bp, Rattus norvegicus
cagtgtcatccaacagaagagctga

SEQ ID NO: 235883 - DNA, 25 bp, Rattus norvegicus
cagtgtcatccatcagaagagctga

SEQ ID NO: 235884 - DNA, 25 bp, Rattus norvegicus
cagtgtcatcccattcttgtagaat

SEQ ID NO: 235885 - DNA, 25 bp, Rattus norvegicus
cagtgtcatccctttcttgtagaat

SEQ ID NO: 235886 - DNA, 25 bp, Rattus norvegicus
cagtgtcatctgaaggtggctttta

SEQ ID NO: 235887 - DNA, 25 bp, Rattus norvegicus
cagtgtcatctgtaggtggctttta

SEQ ID NO: 235888 - DNA, 25 bp, Rattus norvegicus
cagtgtcatttcagcatttccgttt

SEQ ID NO: 235889 - DNA, 25 bp, Rattus norvegicus
cagtgtcatttctgcatttccgttt

SEQ ID NO: 235890 - DNA, 25 bp, Rattus norvegicus
cagtgtcattttcccttgtatgtct

SEQ ID NO: 235891 - DNA, 25 bp, Rattus norvegicus
cagtgtcattttgccttgtatgtct

SEQ ID NO: 235892 - DNA, 25 bp, Rattus norvegicus
cagtgtccaccacgctgtgcaggag

SEQ ID NO: 235893 - DNA, 25 bp, Rattus norvegicus
cagtgtccaccaggctgtgcaggag

SEQ ID NO: 235894 - DNA, 25 bp, Rattus norvegicus
cagtgtccagaacccgccatttaaa

SEQ ID NO: 235895 - DNA, 25 bp, Rattus norvegicus
cagtgtccagaagccgccatttaaa

SEQ ID NO: 235896 - DNA, 25 bp, Rattus norvegicus
cagtgtccaggcatttctcttagtg

SEQ ID NO: 235897 - DNA, 25 bp, Rattus norvegicus
cagtgtccaggcttttctcttagtg

SEQ ID NO: 235898 - DNA, 25 bp, Rattus norvegicus
cagtgtccattgagtgtcgcacaat

SEQ ID NO: 235899 - DNA, 25 bp, Rattus norvegicus
cagtgtccattgtgtgtcgcacaat

SEQ ID NO: 235900 - DNA, 25 bp, Rattus norvegicus
cagtgtcccaatccgggctgtggaa

SEQ ID NO: 235901 - DNA, 25 bp, Rattus norvegicus
cagtgtcccaatgcgggctgtggaa

SEQ ID NO: 235902 - DNA, 25 bp, Rattus norvegicus
cagtgtccccagcaagggagataaa

SEQ ID NO: 235903 - DNA, 25 bp, Rattus norvegicus
cagtgtccccaggaagggagataaa

SEQ ID NO: 235904 - DNA, 25 bp, Rattus norvegicus
cagtgtccgtgaattgggtatccaa

SEQ ID NO: 235905 - DNA, 25 bp, Rattus norvegicus
cagtgtccgtgatttgggtatccaa

SEQ ID NO: 235906 - DNA, 25 bp, Rattus norvegicus
cagtgtcctacactgagctttgatt

SEQ ID NO: 235907 - DNA, 25 bp, Rattus norvegicus
cagtgtcctacagtgagctttgatt

SEQ ID NO: 235908 - DNA, 25 bp, Rattus norvegicus
cagtgtcctaccaaactcagttgaa

SEQ ID NO: 235909 - DNA, 25 bp, Rattus norvegicus
cagtgtcctacctaactcagttgaa

SEQ ID NO: 235910 - DNA, 25 bp, Rattus norvegicus
cagtgtcctcttcaagacgggcttt

SEQ ID NO: 235911 - DNA, 25 bp, Rattus norvegicus
cagtgtcctcttgaagacgggcttt

SEQ ID NO: 235912 - DNA, 25 bp, Rattus norvegicus
cagtgtcctgtgagaatggtaccca

SEQ ID NO: 235913 - DNA, 25 bp, Rattus norvegicus
cagtgtcctgtgtgaatggtaccca

SEQ ID NO: 235914 - DNA, 25 bp, Rattus norvegicus
cagtgtccttatctgtttcccaaga

SEQ ID NO: 235915 - DNA, 25 bp, Rattus norvegicus
cagtgtccttatgtgtttcccaaga

SEQ ID NO: 235916 - DNA, 25 bp, Rattus norvegicus
cagtgtcgagttatagctcaggcga

SEQ ID NO: 235917 - DNA, 25 bp, Rattus norvegicus
cagtgtcgagttttagctcaggcga

SEQ ID NO: 235918 - DNA, 25 bp, Rattus norvegicus
cagtgtcgtccaagcacggagacat

SEQ ID NO: 235919 - DNA, 25 bp, Rattus norvegicus
cagtgtcgtccatgcacggagacat

SEQ ID NO: 235920 - DNA, 25 bp, Rattus norvegicus
cagtgtctaaggctgcagccgcgca

SEQ ID NO: 235921 - DNA, 25 bp, Rattus norvegicus
cagtgtctaagggtgcagccgcgca

SEQ ID NO: 235922 - DNA, 25 bp, Rattus norvegicus
cagtgtctagagagtcccggatggc

SEQ ID NO: 235923 - DNA, 25 bp, Rattus norvegicus
cagtgtctagagtgtcccggatggc

SEQ ID NO: 235924 - DNA, 25 bp, Rattus norvegicus
cagtgtctcatgactgtacaagatt

SEQ ID NO: 235925 - DNA, 25 bp, Rattus norvegicus
cagtgtctcatgtctgtacaagatt

SEQ ID NO: 235926 - DNA, 25 bp, Rattus norvegicus
cagtgtctctagaccaagtgtaagg

SEQ ID NO: 235927 - DNA, 25 bp, Rattus norvegicus
cagtgtctctagtccaagtgtaagg

SEQ ID NO: 235928 - DNA, 25 bp, Rattus norvegicus
cagtgtctgaccacgttctggaagg

SEQ ID NO: 235929 - DNA, 25 bp, Rattus norvegicus
cagtgtctgacctcgttctggaagg

SEQ ID NO: 235930 - DNA, 25 bp, Rattus norvegicus
cagtgtctgaggcttcaagtgccaa

SEQ ID NO: 235931 - DNA, 25 bp, Rattus norvegicus
cagtgtctgagggttcaagtgccaa

SEQ ID NO: 235932 - DNA, 25 bp, Rattus norvegicus
cagtgtctgctgatggacttctaat

SEQ ID NO: 235933 - DNA, 25 bp, Rattus norvegicus
cagtgtctgctgttggacttctaat

SEQ ID NO: 235934 - DNA, 25 bp, Rattus norvegicus
cagtgtctgggtctccgggaaactc

SEQ ID NO: 235935 - DNA, 25 bp, Rattus norvegicus
cagtgtctgggtgtccgggaaactc

SEQ ID NO: 235936 - DNA, 25 bp, Rattus norvegicus
cagtgtctgtcccagatgaatgttg

SEQ ID NO: 235937 - DNA, 25 bp, Rattus norvegicus
cagtgtctgtccgagatgaatgttg

SEQ ID NO: 235938 - DNA, 25 bp, Rattus norvegicus
cagtgtcttactctcgagttgcagg

SEQ ID NO: 235939 - DNA, 25 bp, Rattus norvegicus
cagtgtcttactgtcgagttgcagg

SEQ ID NO: 235940 - DNA, 25 bp, Rattus norvegicus
cagtgtcttctgctgcttaaagctt

SEQ ID NO: 235941 - DNA, 25 bp, Rattus norvegicus
cagtgtcttctggtgcttaaagctt

SEQ ID NO: 235942 - DNA, 25 bp, Rattus norvegicus
cagtgtcttgaaaaaattgctctat

SEQ ID NO: 235943 - DNA, 25 bp, Rattus norvegicus
cagtgtcttgaataaattgctctat

SEQ ID NO: 235944 - DNA, 25 bp, Rattus norvegicus
cagtgtcttgagacgtcttgcagaa

SEQ ID NO: 235945 - DNA, 25 bp, Rattus norvegicus
cagtgtcttgagtcgtcttgcagaa

SEQ ID NO: 235946 - DNA, 25 bp, Rattus norvegicus
cagtgtcttgatccagaggctctgc

SEQ ID NO: 235947 - DNA, 25 bp, Rattus norvegicus
cagtgtcttgatgcagaggctctgc

SEQ ID NO: 235948 - DNA, 25 bp, Rattus norvegicus
cagtgtctttccattgattgtctaa

SEQ ID NO: 235949 - DNA, 25 bp, Rattus norvegicus
cagtgtctttcctttgattgtctaa

SEQ ID NO: 235950 - DNA, 25 bp, Rattus norvegicus
cagtgtgacctcatagtgacaccaa

SEQ ID NO: 235951 - DNA, 25 bp, Rattus norvegicus
cagtgtgacctcttagtgacaccaa

SEQ ID NO: 235952 - DNA, 25 bp, Rattus norvegicus
cagtgtgaggaaacccattttgcta

SEQ ID NO: 235953 - DNA, 25 bp, Rattus norvegicus
cagtgtgaggaatcccattttgcta

SEQ ID NO: 235954 - DNA, 25 bp, Rattus norvegicus
cagtgtgagttacatcagttgtcaa

SEQ ID NO: 235955 - DNA, 25 bp, Rattus norvegicus
cagtgtgagttagatcagttgtcaa

SEQ ID NO: 235956 - DNA, 25 bp, Rattus norvegicus
cagtgtgcaaagatccccacagcgg

SEQ ID NO: 235957 - DNA, 25 bp, Rattus norvegicus
cagtgtgcaaagttccccacagcgg

SEQ ID NO: 235958 - DNA, 25 bp, Rattus norvegicus
cagtgtgcagatagggccctcgtct

SEQ ID NO: 235959 - DNA, 25 bp, Rattus norvegicus
cagtgtgcagattgggccctcgtct

SEQ ID NO: 235960 - DNA, 25 bp, Rattus norvegicus
cagtgtgcagctatctggtgccaac

SEQ ID NO: 235961 - DNA, 25 bp, Rattus norvegicus
cagtgtgcagctttctggtgccaac

SEQ ID NO: 235962 - DNA, 25 bp, Rattus norvegicus
cagtgtgcatctctctaccatgcaa

SEQ ID NO: 235963 - DNA, 25 bp, Rattus norvegicus
cagtgtgcatctgtctaccatgcaa

SEQ ID NO: 235964 - DNA, 25 bp, Rattus norvegicus
cagtgtgccacaattcacgcccgtg

SEQ ID NO: 235965 - DNA, 25 bp, Rattus norvegicus
cagtgtgccacatttcacgcccgtg

SEQ ID NO: 235966 - DNA, 25 bp, Rattus norvegicus
cagtgtgcctggatcaaatgctcga

SEQ ID NO: 235967 - DNA, 25 bp, Rattus norvegicus
cagtgtgcctggttcaaatgctcga

SEQ ID NO: 235968 - DNA, 25 bp, Rattus norvegicus
cagtgtgcgaagctctgacgtgact

SEQ ID NO: 235969 - DNA, 25 bp, Rattus norvegicus
cagtgtgcgaaggtctgacgtgact

SEQ ID NO: 235970 - DNA, 25 bp, Rattus norvegicus
cagtgtgctagcatttaggaagaac

SEQ ID NO: 235971 - DNA, 25 bp, Rattus norvegicus
cagtgtgctagcttttaggaagaac

SEQ ID NO: 235972 - DNA, 25 bp, Rattus norvegicus
cagtgtgctatcactgggtacaagt

SEQ ID NO: 235973 - DNA, 25 bp, Rattus norvegicus
cagtgtgctatctctgggtacaagt

SEQ ID NO: 235974 - DNA, 25 bp, Rattus norvegicus
cagtgtgctcagaactgctctggaa

SEQ ID NO: 235975 - DNA, 25 bp, Rattus norvegicus
cagtgtgctcagcacacagaggctt

SEQ ID NO: 235976 - DNA, 25 bp, Rattus norvegicus
cagtgtgctcaggacacagaggctt

SEQ ID NO: 235977 - DNA, 25 bp, Rattus norvegicus
cagtgtgctcagtactgctctggaa

SEQ ID NO: 235978 - DNA, 25 bp, Rattus norvegicus
cagtgtgctcccctaacagaggtgg

SEQ ID NO: 235979 - DNA, 25 bp, Rattus norvegicus
cagtgtgctcccgtaacagaggtgg

SEQ ID NO: 235980 - DNA, 25 bp, Rattus norvegicus
cagtgtgctctcagatggtagctgt

SEQ ID NO: 235981 - DNA, 25 bp, Rattus norvegicus
cagtgtgctctctgatggtagctgt

SEQ ID NO: 235982 - DNA, 25 bp, Rattus norvegicus
cagtgtgctctgaacacaggtacta

SEQ ID NO: 235983 - DNA, 25 bp, Rattus norvegicus
cagtgtgctctgctttagagccaaa

SEQ ID NO: 235984 - DNA, 25 bp, Rattus norvegicus
cagtgtgctctggtttagagccaaa

SEQ ID NO: 235985 - DNA, 25 bp, Rattus norvegicus
cagtgtgctctgtacacaggtacta

SEQ ID NO: 235986 - DNA, 25 bp, Rattus norvegicus
cagtgtgcttctagtctatttggga

SEQ ID NO: 235987 - DNA, 25 bp, Rattus norvegicus
cagtgtgcttcttgtctatttggga

SEQ ID NO: 235988 - DNA, 25 bp, Rattus norvegicus
cagtgtggagccctcagattgagac

SEQ ID NO: 235989 - DNA, 25 bp, Rattus norvegicus
cagtgtggagccgtcagattgagac

SEQ ID NO: 235990 - DNA, 25 bp, Rattus norvegicus
cagtgtggcactctaatataacccc

SEQ ID NO: 235991 - DNA, 25 bp, Rattus norvegicus
cagtgtggcactgtaatataacccc

SEQ ID NO: 235992 - DNA, 25 bp, Rattus norvegicus
cagtgtggcagcatatcatctcttg

SEQ ID NO: 235993 - DNA, 25 bp, Rattus norvegicus
cagtgtggcagcttatcatctcttg

SEQ ID NO: 235994 - DNA, 25 bp, Rattus norvegicus
cagtgtggctatctaatttttgtga

SEQ ID NO: 235995 - DNA, 25 bp, Rattus norvegicus
cagtgtggctatgtaatttttgtga

SEQ ID NO: 235996 - DNA, 25 bp, Rattus norvegicus
cagtgtggctccaggctcagcaggt

SEQ ID NO: 235997 - DNA, 25 bp, Rattus norvegicus
cagtgtggctcctggctcagcaggt

SEQ ID NO: 235998 - DNA, 25 bp, Rattus norvegicus
cagtgtggctctctccatggagact

SEQ ID NO: 235999 - DNA, 25 bp, Rattus norvegicus
cagtgtggctctgtccatggagact

SEQ ID NO: 236000 - DNA, 25 bp, Rattus norvegicus
cagtgtgggatccagtatctcatgt

SEQ ID NO: 236001 - DNA, 25 bp, Rattus norvegicus
cagtgtgggatcgagtatctcatgt

SEQ ID NO: 236002 - DNA, 25 bp, Rattus norvegicus
cagtgtgggtgcaagagttccagac

SEQ ID NO: 236003 - DNA, 25 bp, Rattus norvegicus
cagtgtgggtgctagagttccagac

SEQ ID NO: 236004 - DNA, 25 bp, Rattus norvegicus
cagtgtggtacacccaaccttgctc

SEQ ID NO: 236005 - DNA, 25 bp, Rattus norvegicus
cagtgtggtacagccaaccttgctc

SEQ ID NO: 236006 - DNA, 25 bp, Rattus norvegicus
cagtgtggtattacatggagcttta

SEQ ID NO: 236007 - DNA, 25 bp, Rattus norvegicus
cagtgtggtatttcatggagcttta

SEQ ID NO: 236008 - DNA, 25 bp, Rattus norvegicus
cagtgtggtcacatggattggccta

SEQ ID NO: 236009 - DNA, 25 bp, Rattus norvegicus
cagtgtggtcacttggattggccta

SEQ ID NO: 236010 - DNA, 25 bp, Rattus norvegicus
cagtgtggtctgagagtgcttctat

SEQ ID NO: 236011 - DNA, 25 bp, Rattus norvegicus
cagtgtggtctgtgagtgcttctat

SEQ ID NO: 236012 - DNA, 25 bp, Rattus norvegicus
cagtgtggtgcaaatggctgagcat

SEQ ID NO: 236013 - DNA, 25 bp, Rattus norvegicus
cagtgtggtgcatatggctgagcat

SEQ ID NO: 236014 - DNA, 25 bp, Rattus norvegicus
cagtgtggttcaatggccaggctga

SEQ ID NO: 236015 - DNA, 25 bp, Rattus norvegicus
cagtgtggttcattggccaggctga

SEQ ID NO: 236016 - DNA, 25 bp, Rattus norvegicus
cagtgtggtttccacctgattacga

SEQ ID NO: 236017 - DNA, 25 bp, Rattus norvegicus
cagtgtggtttcgacctgattacga

SEQ ID NO: 236018 - DNA, 25 bp, Rattus norvegicus
cagtgtgtaaggctggagcccctta

SEQ ID NO: 236019 - DNA, 25 bp, Rattus norvegicus
cagtgtgtaagggtggagcccctta

SEQ ID NO: 236020 - DNA, 25 bp, Rattus norvegicus
cagtgtgtattgatagcttcaggca

SEQ ID NO: 236021 - DNA, 25 bp, Rattus norvegicus
cagtgtgtattgttagcttcaggca

SEQ ID NO: 236022 - DNA, 25 bp, Rattus norvegicus
cagtgtgtcaacatgcttctgatgt

SEQ ID NO: 236023 - DNA, 25 bp, Rattus norvegicus
cagtgtgtcaacttgcttctgatgt

SEQ ID NO: 236024 - DNA, 25 bp, Rattus norvegicus
cagtgtgtccgtctgactttagaac

SEQ ID NO: 236025 - DNA, 25 bp, Rattus norvegicus
cagtgtgtccgtgtgactttagaac

SEQ ID NO: 236026 - DNA, 25 bp, Rattus norvegicus
cagtgtgtcctgagtgcaagcgctc

SEQ ID NO: 236027 - DNA, 25 bp, Rattus norvegicus
cagtgtgtcctgtgtgcaagcgctc

SEQ ID NO: 236028 - DNA, 25 bp, Rattus norvegicus
cagtgtgtgactcgtttcctttttt

SEQ ID NO: 236029 - DNA, 25 bp, Rattus norvegicus
cagtgtgtgactggtttcctttttt

SEQ ID NO: 236030 - DNA, 25 bp, Rattus norvegicus
cagtgtgtgctgagtgatatttttt

SEQ ID NO: 236031 - DNA, 25 bp, Rattus norvegicus
cagtgtgtgctgtgtgatatttttt

SEQ ID NO: 236032 - DNA, 25 bp, Rattus norvegicus
cagtgtgtggccagctctccagtgc

SEQ ID NO: 236033 - DNA, 25 bp, Rattus norvegicus
cagtgtgtggcctgctctccagtgc

SEQ ID NO: 236034 - DNA, 25 bp, Rattus norvegicus
cagtgtgttcaactccatggaggct

SEQ ID NO: 236035 - DNA, 25 bp, Rattus norvegicus
cagtgtgttcaagtccatggaggct

SEQ ID NO: 236036 - DNA, 25 bp, Rattus norvegicus
cagtgtgttgtcattttgagtttta

SEQ ID NO: 236037 - DNA, 25 bp, Rattus norvegicus
cagtgtgttgtctttttgagtttta

SEQ ID NO: 236038 - DNA, 25 bp, Rattus norvegicus
cagtgtgtttatcgccttttgtaaa

SEQ ID NO: 236039 - DNA, 25 bp, Rattus norvegicus
cagtgtgtttatggccttttgtaaa

SEQ ID NO: 236040 - DNA, 25 bp, Rattus norvegicus
cagtgttaaaatagccagtgtagtc

SEQ ID NO: 236041 - DNA, 25 bp, Rattus norvegicus
cagtgttaaaattgccagtgtagtc

SEQ ID NO: 236042 - DNA, 25 bp, Rattus norvegicus
cagtgttaacacacctgactaggat

SEQ ID NO: 236043 - DNA, 25 bp, Rattus norvegicus
cagtgttaacactcctgactaggat

SEQ ID NO: 236044 - DNA, 25 bp, Rattus norvegicus
cagtgttaagagagtccacgtgatt

SEQ ID NO: 236045 - DNA, 25 bp, Rattus norvegicus
cagtgttaagagtgtccacgtgatt

SEQ ID NO: 236046 - DNA, 25 bp, Rattus norvegicus
cagtgttacaataggtgccggttat

SEQ ID NO: 236047 - DNA, 25 bp, Rattus norvegicus
cagtgttacaatccaagctgcttac

SEQ ID NO: 236048 - DNA, 25 bp, Rattus norvegicus
cagtgttacaatgcaagctgcttac

SEQ ID NO: 236049 - DNA, 25 bp, Rattus norvegicus
cagtgttacaattggtgccggttat

SEQ ID NO: 236050 - DNA, 25 bp, Rattus norvegicus
cagtgttaccataagccttcttgaa

SEQ ID NO: 236051 - DNA, 25 bp, Rattus norvegicus
cagtgttaccattagccttcttgaa

SEQ ID NO: 236052 - DNA, 25 bp, Rattus norvegicus
cagtgttactgtctccgggctgtag

SEQ ID NO: 236053 - DNA, 25 bp, Rattus norvegicus
cagtgttactgtgtccgggctgtag

SEQ ID NO: 236054 - DNA, 25 bp, Rattus norvegicus
cagtgttagaggacctgcctggcaa

SEQ ID NO: 236055 - DNA, 25 bp, Rattus norvegicus
cagtgttagaggtcctgcctggcaa

SEQ ID NO: 236056 - DNA, 25 bp, Rattus norvegicus
cagtgttagctcctgtccatgagga

SEQ ID NO: 236057 - DNA, 25 bp, Rattus norvegicus
cagtgttagctcgtgtccatgagga

SEQ ID NO: 236058 - DNA, 25 bp, Rattus norvegicus
cagtgttagtgaagcccgtgggtaa

SEQ ID NO: 236059 - DNA, 25 bp, Rattus norvegicus
cagtgttagtgatgcccgtgggtaa

SEQ ID NO: 236060 - DNA, 25 bp, Rattus norvegicus
cagtgttagtggaagcgtgctctca

SEQ ID NO: 236061 - DNA, 25 bp, Rattus norvegicus
cagtgttagtggtagcgtgctctca

SEQ ID NO: 236062 - DNA, 25 bp, Rattus norvegicus
cagtgttatgtcatcctttctttaa

SEQ ID NO: 236063 - DNA, 25 bp, Rattus norvegicus
cagtgttatgtcttcctttctttaa

SEQ ID NO: 236064 - DNA, 25 bp, Rattus norvegicus
cagtgttcacctacaagcagacttg

SEQ ID NO: 236065 - DNA, 25 bp, Rattus norvegicus
cagtgttcaccttcaagcagacttg

SEQ ID NO: 236066 - DNA, 25 bp, Rattus norvegicus
cagtgttcacttcacagttcagctg

SEQ ID NO: 236067 - DNA, 25 bp, Rattus norvegicus
cagtgttcacttgacagttcagctg

SEQ ID NO: 236068 - DNA, 25 bp, Rattus norvegicus
cagtgttcagggatcctatttccta

SEQ ID NO: 236069 - DNA, 25 bp, Rattus norvegicus
cagtgttcagggttcctatttccta

SEQ ID NO: 236070 - DNA, 25 bp, Rattus norvegicus
cagtgttcagtgactaaacagccaa

SEQ ID NO: 236071 - DNA, 25 bp, Rattus norvegicus
cagtgttcagtgtctaaacagccaa

SEQ ID NO: 236072 - DNA, 25 bp, Rattus norvegicus
cagtgttcatacacccatgtacata

SEQ ID NO: 236073 - DNA, 25 bp, Rattus norvegicus
cagtgttcatactcccatgtacata

SEQ ID NO: 236074 - DNA, 25 bp, Rattus norvegicus
cagtgttcatatatatggccaggca

SEQ ID NO: 236075 - DNA, 25 bp, Rattus norvegicus
cagtgttcatatttatggccaggca

SEQ ID NO: 236076 - DNA, 25 bp, Rattus norvegicus
cagtgttcatcaactgaagttgagt

SEQ ID NO: 236077 - DNA, 25 bp, Rattus norvegicus
cagtgttcatcatctgaagttgagt

SEQ ID NO: 236078 - DNA, 25 bp, Rattus norvegicus
cagtgttcatgtaccattgcgtttg

SEQ ID NO: 236079 - DNA, 25 bp, Rattus norvegicus
cagtgttcatgttccattgcgtttg

SEQ ID NO: 236080 - DNA, 25 bp, Rattus norvegicus
cagtgttcccaacttctccattaaa

SEQ ID NO: 236081 - DNA, 25 bp, Rattus norvegicus
cagtgttcccaagttctccattaaa

SEQ ID NO: 236082 - DNA, 25 bp, Rattus norvegicus
cagtgttcgaagactcgggtgccta

SEQ ID NO: 236083 - DNA, 25 bp, Rattus norvegicus
cagtgttcgaagtctcgggtgccta

SEQ ID NO: 236084 - DNA, 25 bp, Rattus norvegicus
cagtgttcgtccagatttttgtagg

SEQ ID NO: 236085 - DNA, 25 bp, Rattus norvegicus
cagtgttcgtcctgatttttgtagg

SEQ ID NO: 236086 - DNA, 25 bp, Rattus norvegicus
cagtgttctgctcttctgtctgaca

SEQ ID NO: 236087 - DNA, 25 bp, Rattus norvegicus
cagtgttctgctgttctgtctgaca

SEQ ID NO: 236088 - DNA, 25 bp, Rattus norvegicus
cagtgttctgggatgatgcaagcta

SEQ ID NO: 236089 - DNA, 25 bp, Rattus norvegicus
cagtgttctgggttgatgcaagcta

SEQ ID NO: 236090 - DNA, 25 bp, Rattus norvegicus
cagtgttctggtacttggtctttaa

SEQ ID NO: 236091 - DNA, 25 bp, Rattus norvegicus
cagtgttctggtaggtaaggcctca

SEQ ID NO: 236092 - DNA, 25 bp, Rattus norvegicus
cagtgttctggttcttggtctttaa

SEQ ID NO: 236093 - DNA, 25 bp, Rattus norvegicus
cagtgttctggttggtaaggcctca

SEQ ID NO: 236094 - DNA, 25 bp, Rattus norvegicus
cagtgttctgtgacatggcaccgaa

SEQ ID NO: 236095 - DNA, 25 bp, Rattus norvegicus
cagtgttctgtgtcatggcaccgaa

SEQ ID NO: 236096 - DNA, 25 bp, Rattus norvegicus
cagtgttgacatacagttctcacca

SEQ ID NO: 236097 - DNA, 25 bp, Rattus norvegicus
cagtgttgacattcagttctcacca

SEQ ID NO: 236098 - DNA, 25 bp, Rattus norvegicus
cagtgttgagtacccttttgtttaa

SEQ ID NO: 236099 - DNA, 25 bp, Rattus norvegicus
cagtgttgagtagccttttgtttaa

SEQ ID NO: 236100 - DNA, 25 bp, Rattus norvegicus
cagtgttgattaacccaggtgcagg

SEQ ID NO: 236101 - DNA, 25 bp, Rattus norvegicus
cagtgttgattatcccaggtgcagg

SEQ ID NO: 236102 - DNA, 25 bp, Rattus norvegicus
cagtgttgctaaccgtggcattcac

SEQ ID NO: 236103 - DNA, 25 bp, Rattus norvegicus
cagtgttgctaagcgtggcattcac

SEQ ID NO: 236104 - DNA, 25 bp, Rattus norvegicus
cagtgttggacgattgctgtggcac

SEQ ID NO: 236105 - DNA, 25 bp, Rattus norvegicus
cagtgttggacgtttgctgtggcac

SEQ ID NO: 236106 - DNA, 25 bp, Rattus norvegicus
cagtgttggtatacacatccggtta

SEQ ID NO: 236107 - DNA, 25 bp, Rattus norvegicus
cagtgttggtattcacatccggtta

SEQ ID NO: 236108 - DNA, 25 bp, Rattus norvegicus
cagtgttggtcaccacacgtctgta

SEQ ID NO: 236109 - DNA, 25 bp, Rattus norvegicus
cagtgttggtcagcacacgtctgta

SEQ ID NO: 236110 - DNA, 25 bp, Rattus norvegicus
cagtgttggtccatctaggacgcct

SEQ ID NO: 236111 - DNA, 25 bp, Rattus norvegicus
cagtgttggtccttctaggacgcct

SEQ ID NO: 236112 - DNA, 25 bp, Rattus norvegicus
cagtgttggtgacttttccctgggt

SEQ ID NO: 236113 - DNA, 25 bp, Rattus norvegicus
cagtgttggtgagttttccctgggt

SEQ ID NO: 236114 - DNA, 25 bp, Rattus norvegicus
cagtgttgtagtaggttggcaagcc

SEQ ID NO: 236115 - DNA, 25 bp, Rattus norvegicus
cagtgttgtagttggttggcaagcc

SEQ ID NO: 236116 - DNA, 25 bp, Rattus norvegicus
cagtgttgtatgactttccctggtt

SEQ ID NO: 236117 - DNA, 25 bp, Rattus norvegicus
cagtgttgtatgaggactcccggga

SEQ ID NO: 236118 - DNA, 25 bp, Rattus norvegicus
cagtgttgtatgtctttccctggtt

SEQ ID NO: 236119 - DNA, 25 bp, Rattus norvegicus
cagtgttgtatgtggactcccggga

SEQ ID NO: 236120 - DNA, 25 bp, Rattus norvegicus
cagtgttgtattactcttgcctagt

SEQ ID NO: 236121 - DNA, 25 bp, Rattus norvegicus
cagtgttgtatttctcttgcctagt

SEQ ID NO: 236122 - DNA, 25 bp, Rattus norvegicus
cagtgtttacagcacgaggacagta

SEQ ID NO: 236123 - DNA, 25 bp, Rattus norvegicus
cagtgtttacaggacgaggacagta

SEQ ID NO: 236124 - DNA, 25 bp, Rattus norvegicus
cagtgtttacttcctgctgttgaca

SEQ ID NO: 236125 - DNA, 25 bp, Rattus norvegicus
cagtgtttacttgctgctgttgaca

SEQ ID NO: 236126 - DNA, 25 bp, Rattus norvegicus
cagtgtttcatgatgggagagcctc

SEQ ID NO: 236127 - DNA, 25 bp, Rattus norvegicus
cagtgtttcatgttgggagagcctc

SEQ ID NO: 236128 - DNA, 25 bp, Rattus norvegicus
cagtgtttccatccatatgattgta

SEQ ID NO: 236129 - DNA, 25 bp, Rattus norvegicus
cagtgtttccatgcatatgattgta

SEQ ID NO: 236130 - DNA, 25 bp, Rattus norvegicus
cagtgtttcctgagcacgtgtgtgt

SEQ ID NO: 236131 - DNA, 25 bp, Rattus norvegicus
cagtgtttcctgtgcacgtgtgtgt

SEQ ID NO: 236132 - DNA, 25 bp, Rattus norvegicus
cagtgtttcttcattgcctgtgtat

SEQ ID NO: 236133 - DNA, 25 bp, Rattus norvegicus
cagtgtttcttctttgcctgtgtat

SEQ ID NO: 236134 - DNA, 25 bp, Rattus norvegicus
cagtgtttgattccgttgggcctgt

SEQ ID NO: 236135 - DNA, 25 bp, Rattus norvegicus
cagtgtttgattgcgttgggcctgt

SEQ ID NO: 236136 - DNA, 25 bp, Rattus norvegicus
cagtgtttggtgacctttccgtatc

SEQ ID NO: 236137 - DNA, 25 bp, Rattus norvegicus
cagtgtttggtgtcctttccgtatc

SEQ ID NO: 236138 - DNA, 25 bp, Rattus norvegicus
cagtgtttgtgtcctatggtgttaa

SEQ ID NO: 236139 - DNA, 25 bp, Rattus norvegicus
cagtgtttgtgtgctatggtgttaa

SEQ ID NO: 236140 - DNA, 25 bp, Rattus norvegicus
cagtgtttgttcatggccagtgctt

SEQ ID NO: 236141 - DNA, 25 bp, Rattus norvegicus
cagtgtttgttcttggccagtgctt

SEQ ID NO: 236142 - DNA, 25 bp, Rattus norvegicus
cagtgttttccgagtgaacttccaa

SEQ ID NO: 236143 - DNA, 25 bp, Rattus norvegicus
cagtgttttccgtgtgaacttccaa

SEQ ID NO: 236144 - DNA, 25 bp, Rattus norvegicus
cagtgttttgccattccctgtgata

SEQ ID NO: 236145 - DNA, 25 bp, Rattus norvegicus
cagtgttttgcctttccctgtgata

SEQ ID NO: 236146 - DNA, 25 bp, Rattus norvegicus
cagttaacactcaatggcttgcttg

SEQ ID NO: 236147 - DNA, 25 bp, Rattus norvegicus
cagttaacactctatggcttgcttg

SEQ ID NO: 236148 - DNA, 25 bp, Rattus norvegicus
cagttaagactcctagcccctagtt

SEQ ID NO: 236149 - DNA, 25 bp, Rattus norvegicus
cagttaagactcgtagcccctagtt

SEQ ID NO: 236150 - DNA, 25 bp, Rattus norvegicus
cagttaagtgttcctggggctcaaa

SEQ ID NO: 236151 - DNA, 25 bp, Rattus norvegicus
cagttaagtgttgctggggctcaaa

SEQ ID NO: 236152 - DNA, 25 bp, Rattus norvegicus
cagttaatactgcagtccacagata

SEQ ID NO: 236153 - DNA, 25 bp, Rattus norvegicus
cagttaatactggagtccacagata

SEQ ID NO: 236154 - DNA, 25 bp, Rattus norvegicus
cagttaatgcgacttatggtggcca

SEQ ID NO: 236155 - DNA, 25 bp, Rattus norvegicus
cagttaatgcgagttatggtggcca

SEQ ID NO: 236156 - DNA, 25 bp, Rattus norvegicus
cagttacacattccctgccgaaggg

SEQ ID NO: 236157 - DNA, 25 bp, Rattus norvegicus
cagttacacattgcctgccgaaggg

SEQ ID NO: 236158 - DNA, 25 bp, Rattus norvegicus
cagttacagtgaagtgaagcactcc

SEQ ID NO: 236159 - DNA, 25 bp, Rattus norvegicus
cagttacagtgatgtgaagcactcc

SEQ ID NO: 236160 - DNA, 25 bp, Rattus norvegicus
cagttactaactctaggttcctctt

SEQ ID NO: 236161 - DNA, 25 bp, Rattus norvegicus
cagttactaactgtaggttcctctt

SEQ ID NO: 236162 - DNA, 25 bp, Rattus norvegicus
cagttactaagaacccactcagggc

SEQ ID NO: 236163 - DNA, 25 bp, Rattus norvegicus
cagttactaagatcccactcagggc

SEQ ID NO: 236164 - DNA, 25 bp, Rattus norvegicus
cagttactaagccatcccggcggat

SEQ ID NO: 236165 - DNA, 25 bp, Rattus norvegicus
cagttactaagcgatcccggcggat

SEQ ID NO: 236166 - DNA, 25 bp, Rattus norvegicus
cagttactacgtaccccaggttgag

SEQ ID NO: 236167 - DNA, 25 bp, Rattus norvegicus
cagttactacgttccccaggttgag

SEQ ID NO: 236168 - DNA, 25 bp, Rattus norvegicus
cagttactcactcccatttaaaatg

SEQ ID NO: 236169 - DNA, 25 bp, Rattus norvegicus
cagttactcactgccatttaaaatg

SEQ ID NO: 236170 - DNA, 25 bp, Rattus norvegicus
cagttactgatgaggatttcttcct

SEQ ID NO: 236171 - DNA, 25 bp, Rattus norvegicus
cagttactgatgtggatttcttcct

SEQ ID NO: 236172 - DNA, 25 bp, Rattus norvegicus
cagttactgtcaacagtggctggag

SEQ ID NO: 236173 - DNA, 25 bp, Rattus norvegicus
cagttactgtcatcagtggctggag

SEQ ID NO: 236174 - DNA, 25 bp, Rattus norvegicus
cagttacttaatcccacatatgcat

SEQ ID NO: 236175 - DNA, 25 bp, Rattus norvegicus
cagttacttaatgccacatatgcat

SEQ ID NO: 236176 - DNA, 25 bp, Rattus norvegicus
cagttagagcgcacgcaccggcaga

SEQ ID NO: 236177 - DNA, 25 bp, Rattus norvegicus
cagttagagcgctcgcaccggcaga

SEQ ID NO: 236178 - DNA, 25 bp, Rattus norvegicus
cagttagatttcatctgtcctgaca

SEQ ID NO: 236179 - DNA, 25 bp, Rattus norvegicus
cagttagatttcttctgtcctgaca

SEQ ID NO: 236180 - DNA, 25 bp, Rattus norvegicus
cagttagcactcctctcattataaa

SEQ ID NO: 236181 - DNA, 25 bp, Rattus norvegicus
cagttagcactcgtctcattataaa

SEQ ID NO: 236182 - DNA, 25 bp, Rattus norvegicus
cagttagccaacagcccaggagttt

SEQ ID NO: 236183 - DNA, 25 bp, Rattus norvegicus
cagttagccaactgcccaggagttt

SEQ ID NO: 236184 - DNA, 25 bp, Rattus norvegicus
cagttagcctccatgtgtggtgtgg

SEQ ID NO: 236185 - DNA, 25 bp, Rattus norvegicus
cagttagcctccttgtgtggtgtgg

SEQ ID NO: 236186 - DNA, 25 bp, Rattus norvegicus
cagttaggagacctagttttctcat

SEQ ID NO: 236187 - DNA, 25 bp, Rattus norvegicus
cagttaggagacgtagttttctcat

SEQ ID NO: 236188 - DNA, 25 bp, Rattus norvegicus
cagttaggatctatcccccctcaat

SEQ ID NO: 236189 - DNA, 25 bp, Rattus norvegicus
cagttaggatctttcccccctcaat

SEQ ID NO: 236190 - DNA, 25 bp, Rattus norvegicus
cagttaggtccacgacatcccttgg

SEQ ID NO: 236191 - DNA, 25 bp, Rattus norvegicus
cagttaggtccaggacatcccttgg

SEQ ID NO: 236192 - DNA, 25 bp, Rattus norvegicus
cagttaggtctcagtattcttacaa

SEQ ID NO: 236193 - DNA, 25 bp, Rattus norvegicus
cagttaggtctctgtattcttacaa

SEQ ID NO: 236194 - DNA, 25 bp, Rattus norvegicus
cagttagtgggcacatgccacagag

SEQ ID NO: 236195 - DNA, 25 bp, Rattus norvegicus
cagttagtgggctcatgccacagag

SEQ ID NO: 236196 - DNA, 25 bp, Rattus norvegicus
cagttagttaggactcacttgtttt

SEQ ID NO: 236197 - DNA, 25 bp, Rattus norvegicus
cagttagttaggtctcacttgtttt

SEQ ID NO: 236198 - DNA, 25 bp, Rattus norvegicus
cagttagttcaacatgtttctgtga

SEQ ID NO: 236199 - DNA, 25 bp, Rattus norvegicus
cagttagttcaagatgtttctgtga

SEQ ID NO: 236200 - DNA, 25 bp, Rattus norvegicus
cagttagttcttcccataggcatgg

SEQ ID NO: 236201 - DNA, 25 bp, Rattus norvegicus
cagttagttcttgccataggcatgg

SEQ ID NO: 236202 - DNA, 25 bp, Rattus norvegicus
cagttatatctaacgtatcccttcc

SEQ ID NO: 236203 - DNA, 25 bp, Rattus norvegicus
cagttatatctatcgtatcccttcc

SEQ ID NO: 236204 - DNA, 25 bp, Rattus norvegicus
cagttatatttacaaccaccagggt

SEQ ID NO: 236205 - DNA, 25 bp, Rattus norvegicus
cagttatatttagaaccaccagggt

SEQ ID NO: 236206 - DNA, 25 bp, Rattus norvegicus
cagttatggatcatgcctctacaaa

SEQ ID NO: 236207 - DNA, 25 bp, Rattus norvegicus
cagttatggatcttgcctctacaaa

SEQ ID NO: 236208 - DNA, 25 bp, Rattus norvegicus
cagttattacttaagctttaagagg

SEQ ID NO: 236209 - DNA, 25 bp, Rattus norvegicus
cagttattactttagctttaagagg

SEQ ID NO: 236210 - DNA, 25 bp, Rattus norvegicus
cagttattcactatctagctcagag

SEQ ID NO: 236211 - DNA, 25 bp, Rattus norvegicus
cagttattcactttctagctcagag

SEQ ID NO: 236212 - DNA, 25 bp, Rattus norvegicus
cagttatttatgagaggcttggtga

SEQ ID NO: 236213 - DNA, 25 bp, Rattus norvegicus
cagttatttatgtgaggcttggtga

SEQ ID NO: 236214 - DNA, 25 bp, Rattus norvegicus
cagttatttctcacagctgattcag

SEQ ID NO: 236215 - DNA, 25 bp, Rattus norvegicus
cagttatttctctcagctgattcag

SEQ ID NO: 236216 - DNA, 25 bp, Rattus norvegicus
cagttattttaacgcgcatgcccaa

SEQ ID NO: 236217 - DNA, 25 bp, Rattus norvegicus
cagttattttaaggcgcatgcccaa

SEQ ID NO: 236218 - DNA, 25 bp, Rattus norvegicus
cagttcaaactgcttcttctaggag

SEQ ID NO: 236219 - DNA, 25 bp, Rattus norvegicus
cagttcaaactggttcttctaggag

SEQ ID NO: 236220 - DNA, 25 bp, Rattus norvegicus
cagttcaaaggcagccccaaattgc

SEQ ID NO: 236221 - DNA, 25 bp, Rattus norvegicus
cagttcaaaggctgccccaaattgc

SEQ ID NO: 236222 - DNA, 25 bp, Rattus norvegicus
cagttcaacttcctccatgtgatca

SEQ ID NO: 236223 - DNA, 25 bp, Rattus norvegicus
cagttcaacttcgtccatgtgatca

SEQ ID NO: 236224 - DNA, 25 bp, Rattus norvegicus
cagttcaagctcagactcgccgtag

SEQ ID NO: 236225 - DNA, 25 bp, Rattus norvegicus
cagttcaagctctgactcgccgtag

SEQ ID NO: 236226 - DNA, 25 bp, Rattus norvegicus
cagttcaaggtcagcatccagtatt

SEQ ID NO: 236227 - DNA, 25 bp, Rattus norvegicus
cagttcaaggtctgcatccagtatt

SEQ ID NO: 236228 - DNA, 25 bp, Rattus norvegicus
cagttcacccaaacatgtctttcat

SEQ ID NO: 236229 - DNA, 25 bp, Rattus norvegicus
cagttcacccaatcatgtctttcat

SEQ ID NO: 236230 - DNA, 25 bp, Rattus norvegicus
cagttcaccctaagtttacacggga

SEQ ID NO: 236231 - DNA, 25 bp, Rattus norvegicus
cagttcaccctatgtttacacggga

SEQ ID NO: 236232 - DNA, 25 bp, Rattus norvegicus
cagttcacctccaaattctaatgtc

SEQ ID NO: 236233 - DNA, 25 bp, Rattus norvegicus
cagttcacctcctaattctaatgtc

SEQ ID NO: 236234 - DNA, 25 bp, Rattus norvegicus
cagttcactacaatggtgcaggtta

SEQ ID NO: 236235 - DNA, 25 bp, Rattus norvegicus
cagttcactacattggtgcaggtta

SEQ ID NO: 236236 - DNA, 25 bp, Rattus norvegicus
cagttcactgtgctttgcctgtgga

SEQ ID NO: 236237 - DNA, 25 bp, Rattus norvegicus
cagttcactgtggtttgcctgtgga

SEQ ID NO: 236238 - DNA, 25 bp, Rattus norvegicus
cagttcacttctcggaagccatgga

SEQ ID NO: 236239 - DNA, 25 bp, Rattus norvegicus
cagttcacttctgggaagccatgga

SEQ ID NO: 236240 - DNA, 25 bp, Rattus norvegicus
cagttcactttcatattgcttcata

SEQ ID NO: 236241 - DNA, 25 bp, Rattus norvegicus
cagttcactttcttattgcttcata

SEQ ID NO: 236242 - DNA, 25 bp, Rattus norvegicus
cagttcactttgattggaattcccc

SEQ ID NO: 236243 - DNA, 25 bp, Rattus norvegicus
cagttcactttgtttggaattcccc

SEQ ID NO: 236244 - DNA, 25 bp, Rattus norvegicus
cagttcagaataaagcccaggccaa

SEQ ID NO: 236245 - DNA, 25 bp, Rattus norvegicus
cagttcagaatatagcccaggccaa

SEQ ID NO: 236246 - DNA, 25 bp, Rattus norvegicus
cagttcagcaacctctacgtaagtt

SEQ ID NO: 236247 - DNA, 25 bp, Rattus norvegicus
cagttcagcaacgtctacgtaagtt

SEQ ID NO: 236248 - DNA, 25 bp, Rattus norvegicus
cagttcagggcactcgttcacctta

SEQ ID NO: 236249 - DNA, 25 bp, Rattus norvegicus
cagttcagggcagtcgttcacctta

SEQ ID NO: 236250 - DNA, 25 bp, Rattus norvegicus
cagttcagtctgcttgtttgtaaac

SEQ ID NO: 236251 - DNA, 25 bp, Rattus norvegicus
cagttcagtctggttgtttgtaaac

SEQ ID NO: 236252 - DNA, 25 bp, Rattus norvegicus
cagttcagtgacatgggcttccagc

SEQ ID NO: 236253 - DNA, 25 bp, Rattus norvegicus
cagttcagtgacttgggcttccagc

SEQ ID NO: 236254 - DNA, 25 bp, Rattus norvegicus
cagttcatatgcacagggctctcct

SEQ ID NO: 236255 - DNA, 25 bp, Rattus norvegicus
cagttcatatgctcagggctctcct

SEQ ID NO: 236256 - DNA, 25 bp, Rattus norvegicus
cagttcatgcgtagggtttgcagca

SEQ ID NO: 236257 - DNA, 25 bp, Rattus norvegicus
cagttcatgcgttgggtttgcagca

SEQ ID NO: 236258 - DNA, 25 bp, Rattus norvegicus
cagttcattcctctattgtaaattg

SEQ ID NO: 236259 - DNA, 25 bp, Rattus norvegicus
cagttcattcctgtattgtaaattg

SEQ ID NO: 236260 - DNA, 25 bp, Rattus norvegicus
cagttcattctgaggacaactccta

SEQ ID NO: 236261 - DNA, 25 bp, Rattus norvegicus
cagttcattctgtggacaactccta

SEQ ID NO: 236262 - DNA, 25 bp, Rattus norvegicus
cagttcattgtacagcatttgcttt

SEQ ID NO: 236263 - DNA, 25 bp, Rattus norvegicus
cagttcattgtagagcatttgcttt

SEQ ID NO: 236264 - DNA, 25 bp, Rattus norvegicus
cagttccaaatcacataggtcaatg

SEQ ID NO: 236265 - DNA, 25 bp, Rattus norvegicus
cagttccaaatctcataggtcaatg

SEQ ID NO: 236266 - DNA, 25 bp, Rattus norvegicus
cagttccactttagaagtgtcagtg

SEQ ID NO: 236267 - DNA, 25 bp, Rattus norvegicus
cagttccacttttgaagtgtcagtg

SEQ ID NO: 236268 - DNA, 25 bp, Rattus norvegicus
cagttccagggaagtggcctcatgc

SEQ ID NO: 236269 - DNA, 25 bp, Rattus norvegicus
cagttccagggatgtggcctcatgc

SEQ ID NO: 236270 - DNA, 25 bp, Rattus norvegicus
cagttcccagacatcctcccaaggt

SEQ ID NO: 236271 - DNA, 25 bp, Rattus norvegicus
cagttcccagacttcctcccaaggt

SEQ ID NO: 236272 - DNA, 25 bp, Rattus norvegicus
cagttcccagcgagcagcccattgt

SEQ ID NO: 236273 - DNA, 25 bp, Rattus norvegicus
cagttcccagcgtgcagcccattgt

SEQ ID NO: 236274 - DNA, 25 bp, Rattus norvegicus
cagttcccagtcactgttgtgaata

SEQ ID NO: 236275 - DNA, 25 bp, Rattus norvegicus
cagttcccagtctctgttgtgaata

SEQ ID NO: 236276 - DNA, 25 bp, Rattus norvegicus
cagttcccatgacagagtgttccac

SEQ ID NO: 236277 - DNA, 25 bp, Rattus norvegicus
cagttcccatgagagagtgttccac

SEQ ID NO: 236278 - DNA, 25 bp, Rattus norvegicus
cagttccccagaatgtaagagttca

SEQ ID NO: 236279 - DNA, 25 bp, Rattus norvegicus
cagttccccagattgtaagagttca

SEQ ID NO: 236280 - DNA, 25 bp, Rattus norvegicus
cagttcccctttacatgggctagaa

SEQ ID NO: 236281 - DNA, 25 bp, Rattus norvegicus
cagttcccctttatattctgtctgg

SEQ ID NO: 236282 - DNA, 25 bp, Rattus norvegicus
cagttccccttttcatgggctagaa

SEQ ID NO: 236283 - DNA, 25 bp, Rattus norvegicus
cagttcccctttttattctgtctgg

SEQ ID NO: 236284 - DNA, 25 bp, Rattus norvegicus
cagttcccggatctggatttcttaa

SEQ ID NO: 236285 - DNA, 25 bp, Rattus norvegicus
cagttcccggatgtggatttcttaa

SEQ ID NO: 236286 - DNA, 25 bp, Rattus norvegicus
cagttcccgggcaagaagttacaca

SEQ ID NO: 236287 - DNA, 25 bp, Rattus norvegicus
cagttcccgggctagaagttacaca

SEQ ID NO: 236288 - DNA, 25 bp, Rattus norvegicus
cagttcccgggtaaggcttccactg

SEQ ID NO: 236289 - DNA, 25 bp, Rattus norvegicus
cagttcccgggtcctgtctatggca

SEQ ID NO: 236290 - DNA, 25 bp, Rattus norvegicus
cagttcccgggtgctgtctatggca

SEQ ID NO: 236291 - DNA, 25 bp, Rattus norvegicus
cagttcccgggttaggcttccactg

SEQ ID NO: 236292 - DNA, 25 bp, Rattus norvegicus
cagttccctgggatatggatctaga

SEQ ID NO: 236293 - DNA, 25 bp, Rattus norvegicus
cagttccctgggttatggatctaga

SEQ ID NO: 236294 - DNA, 25 bp, Rattus norvegicus
cagttcctcctgaccctgttactaa

SEQ ID NO: 236295 - DNA, 25 bp, Rattus norvegicus
cagttcctcctgtccctgttactaa

SEQ ID NO: 236296 - DNA, 25 bp, Rattus norvegicus
cagttcctgaggatcttagtctctg

SEQ ID NO: 236297 - DNA, 25 bp, Rattus norvegicus
cagttcctgaggttcttagtctctg

SEQ ID NO: 236298 - DNA, 25 bp, Rattus norvegicus
cagttcctgattcccagtgaccatt

SEQ ID NO: 236299 - DNA, 25 bp, Rattus norvegicus
cagttcctgattgccagtgaccatt

SEQ ID NO: 236300 - DNA, 25 bp, Rattus norvegicus
cagttcctgcttacgtgttcagaag

SEQ ID NO: 236301 - DNA, 25 bp, Rattus norvegicus
cagttcctgctttcgtgttcagaag

SEQ ID NO: 236302 - DNA, 25 bp, Rattus norvegicus
cagttcctgttcagactttcttcag

SEQ ID NO: 236303 - DNA, 25 bp, Rattus norvegicus
cagttcctgttctgactttcttcag

SEQ ID NO: 236304 - DNA, 25 bp, Rattus norvegicus
cagttcgaactgacccttgaagaag

SEQ ID NO: 236305 - DNA, 25 bp, Rattus norvegicus
cagttcgaactgtcccttgaagaag

SEQ ID NO: 236306 - DNA, 25 bp, Rattus norvegicus
cagttcgcatctcgcagggatctca

SEQ ID NO: 236307 - DNA, 25 bp, Rattus norvegicus
cagttcgcatctggcagggatctca

SEQ ID NO: 236308 - DNA, 25 bp, Rattus norvegicus
cagttcgctgtgatttccttcggaa

SEQ ID NO: 236309 - DNA, 25 bp, Rattus norvegicus
cagttcgctgtgttttccttcggaa

SEQ ID NO: 236310 - DNA, 25 bp, Rattus norvegicus
cagttcgggttacacagcgagatct

SEQ ID NO: 236311 - DNA, 25 bp, Rattus norvegicus
cagttcgggttagacagcgagatct

SEQ ID NO: 236312 - DNA, 25 bp, Rattus norvegicus
cagttcggtgctatgggatcccaag

SEQ ID NO: 236313 - DNA, 25 bp, Rattus norvegicus
cagttcggtgctttgggatcccaag

SEQ ID NO: 236314 - DNA, 25 bp, Rattus norvegicus
cagttcggtggcaagcctttatttt

SEQ ID NO: 236315 - DNA, 25 bp, Rattus norvegicus
cagttcggtggctagcctttatttt

SEQ ID NO: 236316 - DNA, 25 bp, Rattus norvegicus
cagttcgtctggaagtggctggcta

SEQ ID NO: 236317 - DNA, 25 bp, Rattus norvegicus
cagttcgtctggtagtggctggcta

SEQ ID NO: 236318 - DNA, 25 bp, Rattus norvegicus
cagttcgtgactcgatctcaggcta

SEQ ID NO: 236319 - DNA, 25 bp, Rattus norvegicus
cagttcgtgactggatctcaggcta

SEQ ID NO: 236320 - DNA, 25 bp, Rattus norvegicus
cagttcgtttaaccccattagtaat

SEQ ID NO: 236321 - DNA, 25 bp, Rattus norvegicus
cagttcgtttaagcccattagtaat

SEQ ID NO: 236322 - DNA, 25 bp, Rattus norvegicus
cagttctaaccaattgtcacagtgt

SEQ ID NO: 236323 - DNA, 25 bp, Rattus norvegicus
cagttctaaccatttgtcacagtgt

SEQ ID NO: 236324 - DNA, 25 bp, Rattus norvegicus
cagttctaactcctgaaattacgta

SEQ ID NO: 236325 - DNA, 25 bp, Rattus norvegicus
cagttctaactcgtgaaattacgta

SEQ ID NO: 236326 - DNA, 25 bp, Rattus norvegicus
cagttctaagaacgcctggcctagg

SEQ ID NO: 236327 - DNA, 25 bp, Rattus norvegicus
cagttctaagaaggcctggcctagg

SEQ ID NO: 236328 - DNA, 25 bp, Rattus norvegicus
cagttctaccatacattcatgtatg

SEQ ID NO: 236329 - DNA, 25 bp, Rattus norvegicus
cagttctaccattcattcatgtatg

SEQ ID NO: 236330 - DNA, 25 bp, Rattus norvegicus
cagttctatgtcaattccatggttc

SEQ ID NO: 236331 - DNA, 25 bp, Rattus norvegicus
cagttctatgtctattccatggttc

SEQ ID NO: 236332 - DNA, 25 bp, Rattus norvegicus
cagttctcacagatgattgtggtca

SEQ ID NO: 236333 - DNA, 25 bp, Rattus norvegicus
cagttctcacagttgattgtggtca

SEQ ID NO: 236334 - DNA, 25 bp, Rattus norvegicus
cagttctcatgtctgcgattgttca

SEQ ID NO: 236335 - DNA, 25 bp, Rattus norvegicus
cagttctcatgtgtgcgattgttca

SEQ ID NO: 236336 - DNA, 25 bp, Rattus norvegicus
cagttctccaaaatacggtcctgaa

SEQ ID NO: 236337 - DNA, 25 bp, Rattus norvegicus
cagttctccaaattacggtcctgaa

SEQ ID NO: 236338 - DNA, 25 bp, Rattus norvegicus
cagttctcgtccactaagagctgtg

SEQ ID NO: 236339 - DNA, 25 bp, Rattus norvegicus
cagttctcgtcctctaagagctgtg

SEQ ID NO: 236340 - DNA, 25 bp, Rattus norvegicus
cagttctcttaaccctttctcttta

SEQ ID NO: 236341 - DNA, 25 bp, Rattus norvegicus
cagttctcttaagcctttctcttta

SEQ ID NO: 236342 - DNA, 25 bp, Rattus norvegicus
cagttctgaatgctgtcctcaaagt

SEQ ID NO: 236343 - DNA, 25 bp, Rattus norvegicus
cagttctgaatggtgtcctcaaagt

SEQ ID NO: 236344 - DNA, 25 bp, Rattus norvegicus
cagttctgactgatgatcgacttca

SEQ ID NO: 236345 - DNA, 25 bp, Rattus norvegicus
cagttctgactgttgatcgacttca

SEQ ID NO: 236346 - DNA, 25 bp, Rattus norvegicus
cagttctgagacaccttgcagcata

SEQ ID NO: 236347 - DNA, 25 bp, Rattus norvegicus
cagttctgagactccttgcagcata

SEQ ID NO: 236348 - DNA, 25 bp, Rattus norvegicus
cagttctgccagcacctgtgagaga

SEQ ID NO: 236349 - DNA, 25 bp, Rattus norvegicus
cagttctgccaggacctgtgagaga

SEQ ID NO: 236350 - DNA, 25 bp, Rattus norvegicus
cagttctgccctagttgcaagtgga

SEQ ID NO: 236351 - DNA, 25 bp, Rattus norvegicus
cagttctgcccttgttgcaagtgga

SEQ ID NO: 236352 - DNA, 25 bp, Rattus norvegicus
cagttctggcctagtgtgtggtaca

SEQ ID NO: 236353 - DNA, 25 bp, Rattus norvegicus
cagttctggccttgtgtgtggtaca

SEQ ID NO: 236354 - DNA, 25 bp, Rattus norvegicus
cagttctgggagcttctctttgcta

SEQ ID NO: 236355 - DNA, 25 bp, Rattus norvegicus
cagttctgggaggttctctttgcta

SEQ ID NO: 236356 - DNA, 25 bp, Rattus norvegicus
cagttctgggccctcgagtcttttc

SEQ ID NO: 236357 - DNA, 25 bp, Rattus norvegicus
cagttctgggccgtcgagtcttttc

SEQ ID NO: 236358 - DNA, 25 bp, Rattus norvegicus
cagttctgggtcagctctctcagag

SEQ ID NO: 236359 - DNA, 25 bp, Rattus norvegicus
cagttctgggtctgctctctcagag

SEQ ID NO: 236360 - DNA, 25 bp, Rattus norvegicus
cagttctggttcaaagcttgggtct

SEQ ID NO: 236361 - DNA, 25 bp, Rattus norvegicus
cagttctggttctaagcttgggtct

SEQ ID NO: 236362 - DNA, 25 bp, Rattus norvegicus
cagttctgtattactgggctttgcc

SEQ ID NO: 236363 - DNA, 25 bp, Rattus norvegicus
cagttctgtatttctgggctttgcc

SEQ ID NO: 236364 - DNA, 25 bp, Rattus norvegicus
cagttctgtctcaaccacaggaaaa

SEQ ID NO: 236365 - DNA, 25 bp, Rattus norvegicus
cagttctgtctctaccacaggaaaa

SEQ ID NO: 236366 - DNA, 25 bp, Rattus norvegicus
cagttctgtggtctcatgttagtta

SEQ ID NO: 236367 - DNA, 25 bp, Rattus norvegicus
cagttctgtggtgtcatgttagtta

SEQ ID NO: 236368 - DNA, 25 bp, Rattus norvegicus
cagttctgtgtcaacagtgtgtaat

SEQ ID NO: 236369 - DNA, 25 bp, Rattus norvegicus
cagttctgtgtctacagtgtgtaat

SEQ ID NO: 236370 - DNA, 25 bp, Rattus norvegicus
cagttctgttggcaatggcctcatg

SEQ ID NO: 236371 - DNA, 25 bp, Rattus norvegicus
cagttctgttgggaatggcctcatg

SEQ ID NO: 236372 - DNA, 25 bp, Rattus norvegicus
cagttcttactgcaggtggttgaca

SEQ ID NO: 236373 - DNA, 25 bp, Rattus norvegicus
cagttcttactggaggtggttgaca

SEQ ID NO: 236374 - DNA, 25 bp, Rattus norvegicus
cagttcttcaagcaggccggcattc

SEQ ID NO: 236375 - DNA, 25 bp, Rattus norvegicus
cagttcttcaaggaggccggcattc

SEQ ID NO: 236376 - DNA, 25 bp, Rattus norvegicus
cagttcttcacaacattcctaatgg

SEQ ID NO: 236377 - DNA, 25 bp, Rattus norvegicus
cagttcttcacatcattcctaatgg

SEQ ID NO: 236378 - DNA, 25 bp, Rattus norvegicus
cagttcttcataacggtagtgccaa

SEQ ID NO: 236379 - DNA, 25 bp, Rattus norvegicus
cagttcttcatatcggtagtgccaa

SEQ ID NO: 236380 - DNA, 25 bp, Rattus norvegicus
cagttcttctccagccgcatggaga

SEQ ID NO: 236381 - DNA, 25 bp, Rattus norvegicus
cagttcttctcctgccgcatggaga

SEQ ID NO: 236382 - DNA, 25 bp, Rattus norvegicus
cagttcttctggatgtctgctaagc

SEQ ID NO: 236383 - DNA, 25 bp, Rattus norvegicus
cagttcttctggttgtctgctaagc

SEQ ID NO: 236384 - DNA, 25 bp, Rattus norvegicus
cagttcttgcatagttggggaccga

SEQ ID NO: 236385 - DNA, 25 bp, Rattus norvegicus
cagttcttgcattgttggggaccga

SEQ ID NO: 236386 - DNA, 25 bp, Rattus norvegicus
cagttctttcttagttgcacgtgga

SEQ ID NO: 236387 - DNA, 25 bp, Rattus norvegicus
cagttctttctttgttgcacgtgga

SEQ ID NO: 236388 - DNA, 25 bp, Rattus norvegicus
cagttctttgagagcaccttaggtc

SEQ ID NO: 236389 - DNA, 25 bp, Rattus norvegicus
cagttctttgagtgcaccttaggtc

SEQ ID NO: 236390 - DNA, 25 bp, Rattus norvegicus
cagttctttgcactgtcgcctggag

SEQ ID NO: 236391 - DNA, 25 bp, Rattus norvegicus
cagttctttgcagtgtcgcctggag

SEQ ID NO: 236392 - DNA, 25 bp, Rattus norvegicus
cagttctttgtcagcccaggtgggc

SEQ ID NO: 236393 - DNA, 25 bp, Rattus norvegicus
cagttctttgtctgcccaggtgggc

SEQ ID NO: 236394 - DNA, 25 bp, Rattus norvegicus
cagttctttttgctgcgcttttcag

SEQ ID NO: 236395 - DNA, 25 bp, Rattus norvegicus
cagttctttttggtgcgcttttcag

SEQ ID NO: 236396 - DNA, 25 bp, Rattus norvegicus
cagttgaaactgaaggcccgctagg

SEQ ID NO: 236397 - DNA, 25 bp, Rattus norvegicus
cagttgaaactgtaggcccgctagg

SEQ ID NO: 236398 - DNA, 25 bp, Rattus norvegicus
cagttgaaagtaaagcccgctcctc

SEQ ID NO: 236399 - DNA, 25 bp, Rattus norvegicus
cagttgaaagtatagcccgctcctc

SEQ ID NO: 236400 - DNA, 25 bp, Rattus norvegicus
cagttgacttcgacttttcaaagaa

SEQ ID NO: 236401 - DNA, 25 bp, Rattus norvegicus
cagttgacttcgtcttttcaaagaa

SEQ ID NO: 236402 - DNA, 25 bp, Rattus norvegicus
cagttgatcactcaggttccggtgg

SEQ ID NO: 236403 - DNA, 25 bp, Rattus norvegicus
cagttgatcactgaggttccggtgg

SEQ ID NO: 236404 - DNA, 25 bp, Rattus norvegicus
cagttgcacagaagttcaaggtttc

SEQ ID NO: 236405 - DNA, 25 bp, Rattus norvegicus
cagttgcacagatgttcaaggtttc

SEQ ID NO: 236406 - DNA, 25 bp, Rattus norvegicus
cagttgcattctattgggaatttac

SEQ ID NO: 236407 - DNA, 25 bp, Rattus norvegicus
cagttgcattcttttgggaatttac

SEQ ID NO: 236408 - DNA, 25 bp, Rattus norvegicus
cagttgcatttccagttgtgtgact

SEQ ID NO: 236409 - DNA, 25 bp, Rattus norvegicus
cagttgcatttcgagttgtgtgact

SEQ ID NO: 236410 - DNA, 25 bp, Rattus norvegicus
cagttgcctggcaacattgctaaaa

SEQ ID NO: 236411 - DNA, 25 bp, Rattus norvegicus
cagttgcctggctacattgctaaaa

SEQ ID NO: 236412 - DNA, 25 bp, Rattus norvegicus
cagttgcgcttacgatcctgtatgt

SEQ ID NO: 236413 - DNA, 25 bp, Rattus norvegicus
cagttgcgcttaggatcctgtatgt

SEQ ID NO: 236414 - DNA, 25 bp, Rattus norvegicus
cagttgcttttgatgctagtttgta

SEQ ID NO: 236415 - DNA, 25 bp, Rattus norvegicus
cagttgcttttgttgctagtttgta

SEQ ID NO: 236416 - DNA, 25 bp, Rattus norvegicus
cagttggagaatcggtccctctaca

SEQ ID NO: 236417 - DNA, 25 bp, Rattus norvegicus
cagttggagaatgggtccctctaca

SEQ ID NO: 236418 - DNA, 25 bp, Rattus norvegicus
cagttggagccacttctagtagtct

SEQ ID NO: 236419 - DNA, 25 bp, Rattus norvegicus
cagttggagccagttctagtagtct

SEQ ID NO: 236420 - DNA, 25 bp, Rattus norvegicus
cagttggagttgagggttatgaccc

SEQ ID NO: 236421 - DNA, 25 bp, Rattus norvegicus
cagttggagttgtgggttatgaccc

SEQ ID NO: 236422 - DNA, 25 bp, Rattus norvegicus
cagttggattttacccccattgtgg

SEQ ID NO: 236423 - DNA, 25 bp, Rattus norvegicus
cagttggatttttcccccattgtgg

SEQ ID NO: 236424 - DNA, 25 bp, Rattus norvegicus
cagttggcagttccaggccagcgta

SEQ ID NO: 236425 - DNA, 25 bp, Rattus norvegicus
cagttggcagttgcaggccagcgta

SEQ ID NO: 236426 - DNA, 25 bp, Rattus norvegicus
cagttggcctagattccctgttcct

SEQ ID NO: 236427 - DNA, 25 bp, Rattus norvegicus
cagttggcctagctgggtagactat

SEQ ID NO: 236428 - DNA, 25 bp, Rattus norvegicus
cagttggcctaggtgggtagactat

SEQ ID NO: 236429 - DNA, 25 bp, Rattus norvegicus
cagttggcctagtttccctgttcct

SEQ ID NO: 236430 - DNA, 25 bp, Rattus norvegicus
cagttggcggccatccaggaaatgc

SEQ ID NO: 236431 - DNA, 25 bp, Rattus norvegicus
cagttggcggccttccaggaaatgc

SEQ ID NO: 236432 - DNA, 25 bp, Rattus norvegicus
cagttggctctgctccaaaggtgat

SEQ ID NO: 236433 - DNA, 25 bp, Rattus norvegicus
cagttggctctggtccaaaggtgat

SEQ ID NO: 236434 - DNA, 25 bp, Rattus norvegicus
cagttgggaactaggctcattgagc

SEQ ID NO: 236435 - DNA, 25 bp, Rattus norvegicus
cagttgggaacttggctcattgagc

SEQ ID NO: 236436 - DNA, 25 bp, Rattus norvegicus
cagttgggttgtctgaccgtctata

SEQ ID NO: 236437 - DNA, 25 bp, Rattus norvegicus
cagttgggttgtgtgaccgtctata

SEQ ID NO: 236438 - DNA, 25 bp, Rattus norvegicus
cagttgggtttcatgttgatcttac

SEQ ID NO: 236439 - DNA, 25 bp, Rattus norvegicus
cagttgggtttcttgttgatcttac

SEQ ID NO: 236440 - DNA, 25 bp, Rattus norvegicus
cagttggtaaaaaggcagcctagca

SEQ ID NO: 236441 - DNA, 25 bp, Rattus norvegicus
cagttggtaaaatggcagcctagca

SEQ ID NO: 236442 - DNA, 25 bp, Rattus norvegicus
cagttggtaccacatctttttagat

SEQ ID NO: 236443 - DNA, 25 bp, Rattus norvegicus
cagttggtaccagatctttttagat

SEQ ID NO: 236444 - DNA, 25 bp, Rattus norvegicus
cagttggtattcaggttgtgcagtt

SEQ ID NO: 236445 - DNA, 25 bp, Rattus norvegicus
cagttggtattctggttgtgcagtt

SEQ ID NO: 236446 - DNA, 25 bp, Rattus norvegicus
cagttggtcgtgatccttgtggaag

SEQ ID NO: 236447 - DNA, 25 bp, Rattus norvegicus
cagttggtcgtgttccttgtggaag

SEQ ID NO: 236448 - DNA, 25 bp, Rattus norvegicus
cagttggtctctcggagtcttgaaa

SEQ ID NO: 236449 - DNA, 25 bp, Rattus norvegicus
cagttggtctctgggagtcttgaaa

SEQ ID NO: 236450 - DNA, 25 bp, Rattus norvegicus
cagttggtgatcaacgctgcggaca

SEQ ID NO: 236451 - DNA, 25 bp, Rattus norvegicus
cagttggtgatctacgctgcggaca

SEQ ID NO: 236452 - DNA, 25 bp, Rattus norvegicus
cagttggtgtacatcggtcagtaga

SEQ ID NO: 236453 - DNA, 25 bp, Rattus norvegicus
cagttggtgtacttcggtcagtaga

SEQ ID NO: 236454 - DNA, 25 bp, Rattus norvegicus
cagttggttgaaacagtccctttct

SEQ ID NO: 236455 - DNA, 25 bp, Rattus norvegicus
cagttggttgaatcagtccctttct

SEQ ID NO: 236456 - DNA, 25 bp, Rattus norvegicus
cagttggtttctcaaagtgctttca

SEQ ID NO: 236457 - DNA, 25 bp, Rattus norvegicus
cagttggtttctgaaagtgctttca

SEQ ID NO: 236458 - DNA, 25 bp, Rattus norvegicus
cagttggtttttctagcactcctac

SEQ ID NO: 236459 - DNA, 25 bp, Rattus norvegicus
cagttggtttttgtagcactcctac

SEQ ID NO: 236460 - DNA, 25 bp, Rattus norvegicus
cagttgtactgaatacctgcaccta

SEQ ID NO: 236461 - DNA, 25 bp, Rattus norvegicus
cagttgtactgattacctgcaccta

SEQ ID NO: 236462 - DNA, 25 bp, Rattus norvegicus
cagttgtagcttatgattggtagaa

SEQ ID NO: 236463 - DNA, 25 bp, Rattus norvegicus
cagttgtagcttttgattggtagaa

SEQ ID NO: 236464 - DNA, 25 bp, Rattus norvegicus
cagttgtccttccatagtgtctcag

SEQ ID NO: 236465 - DNA, 25 bp, Rattus norvegicus
cagttgtccttcgatagtgtctcag

SEQ ID NO: 236466 - DNA, 25 bp, Rattus norvegicus
cagttgtctcttccgggactgtcta

SEQ ID NO: 236467 - DNA, 25 bp, Rattus norvegicus
cagttgtctcttgcgggactgtcta

SEQ ID NO: 236468 - DNA, 25 bp, Rattus norvegicus
cagttgtctggtattgattcgtcga

SEQ ID NO: 236469 - DNA, 25 bp, Rattus norvegicus
cagttgtctggttttgattcgtcga

SEQ ID NO: 236470 - DNA, 25 bp, Rattus norvegicus
cagttgtctgtgaaagtttgtctta

SEQ ID NO: 236471 - DNA, 25 bp, Rattus norvegicus
cagttgtctgtgtaagtttgtctta

SEQ ID NO: 236472 - DNA, 25 bp, Rattus norvegicus
cagttgtcttctacacacatcatgt

SEQ ID NO: 236473 - DNA, 25 bp, Rattus norvegicus
cagttgtcttcttcacacatcatgt

SEQ ID NO: 236474 - DNA, 25 bp, Rattus norvegicus
cagttgtgcgggaaccaaataaaca

SEQ ID NO: 236475 - DNA, 25 bp, Rattus norvegicus
cagttgtgcgggtaccaaataaaca

SEQ ID NO: 236476 - DNA, 25 bp, Rattus norvegicus
cagttgtgtgccaaactggaaaccc

SEQ ID NO: 236477 - DNA, 25 bp, Rattus norvegicus
cagttgtgtgcctaactggaaaccc

SEQ ID NO: 236478 - DNA, 25 bp, Rattus norvegicus
cagttgttaagacctccgactgctc

SEQ ID NO: 236479 - DNA, 25 bp, Rattus norvegicus
cagttgttaagagctccgactgctc

SEQ ID NO: 236480 - DNA, 25 bp, Rattus norvegicus
cagttgttcttgatcatggagtttg

SEQ ID NO: 236481 - DNA, 25 bp, Rattus norvegicus
cagttgttcttgttcatggagtttg

SEQ ID NO: 236482 - DNA, 25 bp, Rattus norvegicus
cagttgttctttaggttcctcacta

SEQ ID NO: 236483 - DNA, 25 bp, Rattus norvegicus
cagttgttcttttggttcctcacta

SEQ ID NO: 236484 - DNA, 25 bp, Rattus norvegicus
cagttgtttgaaccggtgacccatt

SEQ ID NO: 236485 - DNA, 25 bp, Rattus norvegicus
cagttgtttgaagcggtgacccatt

SEQ ID NO: 236486 - DNA, 25 bp, Rattus norvegicus
cagttgttttcaatctccttgtaat

SEQ ID NO: 236487 - DNA, 25 bp, Rattus norvegicus
cagttgttttcacataacgtcccct

SEQ ID NO: 236488 - DNA, 25 bp, Rattus norvegicus
cagttgttttcagataacgtcccct

SEQ ID NO: 236489 - DNA, 25 bp, Rattus norvegicus
cagttgttttcattctccttgtaat

SEQ ID NO: 236490 - DNA, 25 bp, Rattus norvegicus
cagttgttttccatcctttggttgc

SEQ ID NO: 236491 - DNA, 25 bp, Rattus norvegicus
cagttgttttccttcctttggttgc

SEQ ID NO: 236492 - DNA, 25 bp, Rattus norvegicus
cagttgtttttcacacctcattgtg

SEQ ID NO: 236493 - DNA, 25 bp, Rattus norvegicus
cagttgtttttctcacctcattgtg

SEQ ID NO: 236494 - DNA, 25 bp, Rattus norvegicus
cagtttaagaaaagagtccatccca

SEQ ID NO: 236495 - DNA, 25 bp, Rattus norvegicus
cagtttaagaaatgagtccatccca

SEQ ID NO: 236496 - DNA, 25 bp, Rattus norvegicus
cagtttaccctgagctgtccagctt

SEQ ID NO: 236497 - DNA, 25 bp, Rattus norvegicus
cagtttaccctgtgctgtccagctt

SEQ ID NO: 236498 - DNA, 25 bp, Rattus norvegicus
cagtttacctgtctccatatgtgtc

SEQ ID NO: 236499 - DNA, 25 bp, Rattus norvegicus
cagtttacctgtgtccatatgtgtc

SEQ ID NO: 236500 - DNA, 25 bp, Rattus norvegicus
cagtttactactagcctgggctgaa

SEQ ID NO: 236501 - DNA, 25 bp, Rattus norvegicus
cagtttactacttgcctgggctgaa

SEQ ID NO: 236502 - DNA, 25 bp, Rattus norvegicus
cagtttactccccaagcaggaaaag

SEQ ID NO: 236503 - DNA, 25 bp, Rattus norvegicus
cagtttactcccgaagcaggaaaag

SEQ ID NO: 236504 - DNA, 25 bp, Rattus norvegicus
cagtttagaaaacctctgggccagg

SEQ ID NO: 236505 - DNA, 25 bp, Rattus norvegicus
cagtttagaaaagctctgggccagg

SEQ ID NO: 236506 - DNA, 25 bp, Rattus norvegicus
cagtttatagttcttgtatgcgcat

SEQ ID NO: 236507 - DNA, 25 bp, Rattus norvegicus
cagtttatagttgttgtatgcgcat

SEQ ID NO: 236508 - DNA, 25 bp, Rattus norvegicus
cagtttatgatgctcgtgggtttct

SEQ ID NO: 236509 - DNA, 25 bp, Rattus norvegicus
cagtttatgatggtcgtgggtttct

SEQ ID NO: 236510 - DNA, 25 bp, Rattus norvegicus
cagtttatgtggactccggaattaa

SEQ ID NO: 236511 - DNA, 25 bp, Rattus norvegicus
cagtttatgtggtctccggaattaa

SEQ ID NO: 236512 - DNA, 25 bp, Rattus norvegicus
cagtttattcctctgtgagtggaca

SEQ ID NO: 236513 - DNA, 25 bp, Rattus norvegicus
cagtttattcctgtgtgagtggaca

SEQ ID NO: 236514 - DNA, 25 bp, Rattus norvegicus
cagtttcagaagacctgatgccctc

SEQ ID NO: 236515 - DNA, 25 bp, Rattus norvegicus
cagtttcagaagtcctgatgccctc

SEQ ID NO: 236516 - DNA, 25 bp, Rattus norvegicus
cagtttcagggtctcatgttgttct

SEQ ID NO: 236517 - DNA, 25 bp, Rattus norvegicus
cagtttcagggtgtcatgttgttct

SEQ ID NO: 236518 - DNA, 25 bp, Rattus norvegicus
cagtttccaggtatgtatgctgtag

SEQ ID NO: 236519 - DNA, 25 bp, Rattus norvegicus
cagtttccaggtttgtatgctgtag

SEQ ID NO: 236520 - DNA, 25 bp, Rattus norvegicus
cagtttccatacaaagatgcccgtg

SEQ ID NO: 236521 - DNA, 25 bp, Rattus norvegicus
cagtttccatactaagatgcccgtg

SEQ ID NO: 236522 - DNA, 25 bp, Rattus norvegicus
cagtttccattacttgtttggccaa

SEQ ID NO: 236523 - DNA, 25 bp, Rattus norvegicus
cagtttccattagttgtttggccaa

SEQ ID NO: 236524 - DNA, 25 bp, Rattus norvegicus
cagtttcccaaacgccacatggcag

SEQ ID NO: 236525 - DNA, 25 bp, Rattus norvegicus
cagtttcccaaaggccacatggcag

SEQ ID NO: 236526 - DNA, 25 bp, Rattus norvegicus
cagtttcccttgaaagcttactgta

SEQ ID NO: 236527 - DNA, 25 bp, Rattus norvegicus
cagtttcccttgtaagcttactgta

SEQ ID NO: 236528 - DNA, 25 bp, Rattus norvegicus
cagtttccgctgcttctatttgagt

SEQ ID NO: 236529 - DNA, 25 bp, Rattus norvegicus
cagtttccgctggttctatttgagt

SEQ ID NO: 236530 - DNA, 25 bp, Rattus norvegicus
cagtttcctgttaatcatcttcaaa

SEQ ID NO: 236531 - DNA, 25 bp, Rattus norvegicus
cagtttcctgtttatcatcttcaaa

SEQ ID NO: 236532 - DNA, 25 bp, Rattus norvegicus
cagtttccttttaggtccagttcat

SEQ ID NO: 236533 - DNA, 25 bp, Rattus norvegicus
cagtttcctttttggtccagttcat

SEQ ID NO: 236534 - DNA, 25 bp, Rattus norvegicus
cagtttcgacggcaagctggcctgc

SEQ ID NO: 236535 - DNA, 25 bp, Rattus norvegicus
cagtttcgacgggaagctggcctgc

SEQ ID NO: 236536 - DNA, 25 bp, Rattus norvegicus
cagtttcgtttgcagcagattcgca

SEQ ID NO: 236537 - DNA, 25 bp, Rattus norvegicus
cagtttcgtttggagcagattcgca

SEQ ID NO: 236538 - DNA, 25 bp, Rattus norvegicus
cagtttctaactctatgggaccaga

SEQ ID NO: 236539 - DNA, 25 bp, Rattus norvegicus
cagtttctaactgtatgggaccaga

SEQ ID NO: 236540 - DNA, 25 bp, Rattus norvegicus
cagtttctaatgactacgtgtatgt

SEQ ID NO: 236541 - DNA, 25 bp, Rattus norvegicus
cagtttctaatgtctacgtgtatgt

SEQ ID NO: 236542 - DNA, 25 bp, Rattus norvegicus
cagtttctggcaatatttttcctaa

SEQ ID NO: 236543 - DNA, 25 bp, Rattus norvegicus
cagtttctggcattatttttcctaa

SEQ ID NO: 236544 - DNA, 25 bp, Rattus norvegicus
cagtttctgtgaagggattatcccc

SEQ ID NO: 236545 - DNA, 25 bp, Rattus norvegicus
cagtttctgtgatgggattatcccc

SEQ ID NO: 236546 - DNA, 25 bp, Rattus norvegicus
cagtttcttcagaaccaggctatgt

SEQ ID NO: 236547 - DNA, 25 bp, Rattus norvegicus
cagtttcttcagtaccaggctatgt

SEQ ID NO: 236548 - DNA, 25 bp, Rattus norvegicus
cagtttgaactcatgtcccttttgt

SEQ ID NO: 236549 - DNA, 25 bp, Rattus norvegicus
cagtttgaactcttgtcccttttgt

SEQ ID NO: 236550 - DNA, 25 bp, Rattus norvegicus
cagtttgacggcatccatgtggtga

SEQ ID NO: 236551 - DNA, 25 bp, Rattus norvegicus
cagtttgacggcttccatgtggtga

SEQ ID NO: 236552 - DNA, 25 bp, Rattus norvegicus
cagtttgactctaataagacctgat

SEQ ID NO: 236553 - DNA, 25 bp, Rattus norvegicus
cagtttgactcttataagacctgat

SEQ ID NO: 236554 - DNA, 25 bp, Rattus norvegicus
cagtttgagaccctggacgtccaga

SEQ ID NO: 236555 - DNA, 25 bp, Rattus norvegicus
cagtttgagaccgtggacgtccaga

SEQ ID NO: 236556 - DNA, 25 bp, Rattus norvegicus
cagtttgaggaaatcggccgggcct

SEQ ID NO: 236557 - DNA, 25 bp, Rattus norvegicus
cagtttgaggaattcggccgggcct

SEQ ID NO: 236558 - DNA, 25 bp, Rattus norvegicus
cagtttgagtccagtccaatggagg

SEQ ID NO: 236559 - DNA, 25 bp, Rattus norvegicus
cagtttgagtcctgtccaatggagg

SEQ ID NO: 236560 - DNA, 25 bp, Rattus norvegicus
cagtttgatggtcacatgctccagt

SEQ ID NO: 236561 - DNA, 25 bp, Rattus norvegicus
cagtttgatggtgacatgctccagt

SEQ ID NO: 236562 - DNA, 25 bp, Rattus norvegicus
cagtttgcacagaatgtcttttcac

SEQ ID NO: 236563 - DNA, 25 bp, Rattus norvegicus
cagtttgcacagtatgtcttttcac

SEQ ID NO: 236564 - DNA, 25 bp, Rattus norvegicus
cagtttgcacctaagacgcttttta

SEQ ID NO: 236565 - DNA, 25 bp, Rattus norvegicus
cagtttgcaccttagacgcttttta

SEQ ID NO: 236566 - DNA, 25 bp, Rattus norvegicus
cagtttgccaagactctgtgttaaa

SEQ ID NO: 236567 - DNA, 25 bp, Rattus norvegicus
cagtttgccaagtctctgtgttaaa

SEQ ID NO: 236568 - DNA, 25 bp, Rattus norvegicus
cagtttgccaccctctatttaagtt

SEQ ID NO: 236569 - DNA, 25 bp, Rattus norvegicus
cagtttgccaccgtctatttaagtt

SEQ ID NO: 236570 - DNA, 25 bp, Rattus norvegicus
cagtttgccatcacattggttctgt

SEQ ID NO: 236571 - DNA, 25 bp, Rattus norvegicus
cagtttgccatctcattggttctgt

SEQ ID NO: 236572 - DNA, 25 bp, Rattus norvegicus
cagtttgcccaaagtgagacattta

SEQ ID NO: 236573 - DNA, 25 bp, Rattus norvegicus
cagtttgcccaatgtgagacattta

SEQ ID NO: 236574 - DNA, 25 bp, Rattus norvegicus
cagtttgccctcatcgattgataga

SEQ ID NO: 236575 - DNA, 25 bp, Rattus norvegicus
cagtttgccctcttcgattgataga

SEQ ID NO: 236576 - DNA, 25 bp, Rattus norvegicus
cagtttgctcaaatgggtcttctct

SEQ ID NO: 236577 - DNA, 25 bp, Rattus norvegicus
cagtttgctcaattgggtcttctct

SEQ ID NO: 236578 - DNA, 25 bp, Rattus norvegicus
cagtttgctcgtcgatttttggcta

SEQ ID NO: 236579 - DNA, 25 bp, Rattus norvegicus
cagtttgctcgtggatttttggcta

SEQ ID NO: 236580 - DNA, 25 bp, Rattus norvegicus
cagtttgctgagaggaaggatttca

SEQ ID NO: 236581 - DNA, 25 bp, Rattus norvegicus
cagtttgctgagtggaaggatttca

SEQ ID NO: 236582 - DNA, 25 bp, Rattus norvegicus
cagtttgctgggagaccggcagaca

SEQ ID NO: 236583 - DNA, 25 bp, Rattus norvegicus
cagtttgctgggtgaccggcagaca

SEQ ID NO: 236584 - DNA, 25 bp, Rattus norvegicus
cagtttgcttctcaggctagtggaa

SEQ ID NO: 236585 - DNA, 25 bp, Rattus norvegicus
cagtttgcttctgaggctagtggaa

SEQ ID NO: 236586 - DNA, 25 bp, Rattus norvegicus
cagtttggacatctttccccattaa

SEQ ID NO: 236587 - DNA, 25 bp, Rattus norvegicus
cagtttggacatgtttccccattaa

SEQ ID NO: 236588 - DNA, 25 bp, Rattus norvegicus
cagtttggcagtatccttgctgaaa

SEQ ID NO: 236589 - DNA, 25 bp, Rattus norvegicus
cagtttggcagtttccttgctgaaa

SEQ ID NO: 236590 - DNA, 25 bp, Rattus norvegicus
cagtttggccttaaagtcccaccag

SEQ ID NO: 236591 - DNA, 25 bp, Rattus norvegicus
cagtttggcctttaagtcccaccag

SEQ ID NO: 236592 - DNA, 25 bp, Rattus norvegicus
cagtttggctctatctatcgtgaag

SEQ ID NO: 236593 - DNA, 25 bp, Rattus norvegicus
cagtttggctctttctatcgtgaag

SEQ ID NO: 236594 - DNA, 25 bp, Rattus norvegicus
cagtttggcttgaagtgctctagga

SEQ ID NO: 236595 - DNA, 25 bp, Rattus norvegicus
cagtttggcttgtagtgctctagga

SEQ ID NO: 236596 - DNA, 25 bp, Rattus norvegicus
cagtttggtcttctccttttagata

SEQ ID NO: 236597 - DNA, 25 bp, Rattus norvegicus
cagtttggtcttgtccttttagata

SEQ ID NO: 236598 - DNA, 25 bp, Rattus norvegicus
cagtttggttgcctactctgttaaa

SEQ ID NO: 236599 - DNA, 25 bp, Rattus norvegicus
cagtttggttgcgtactctgttaaa

SEQ ID NO: 236600 - DNA, 25 bp, Rattus norvegicus
cagtttgtaggtacccttgtcgtga

SEQ ID NO: 236601 - DNA, 25 bp, Rattus norvegicus
cagtttgtaggttcccttgtcgtga

SEQ ID NO: 236602 - DNA, 25 bp, Rattus norvegicus
cagtttgtattcattgcagcccttc

SEQ ID NO: 236603 - DNA, 25 bp, Rattus norvegicus
cagtttgtattctttgcagcccttc

SEQ ID NO: 236604 - DNA, 25 bp, Rattus norvegicus
cagtttgtcatcacggcccaggagt

SEQ ID NO: 236605 - DNA, 25 bp, Rattus norvegicus
cagtttgtcatctcggcccaggagt

SEQ ID NO: 236606 - DNA, 25 bp, Rattus norvegicus
cagtttgtcattagcttccatgtga

SEQ ID NO: 236607 - DNA, 25 bp, Rattus norvegicus
cagtttgtcatttgcttccatgtga

SEQ ID NO: 236608 - DNA, 25 bp, Rattus norvegicus
cagtttgtctaactcctggctctta

SEQ ID NO: 236609 - DNA, 25 bp, Rattus norvegicus
cagtttgtctaagtcctggctctta

SEQ ID NO: 236610 - DNA, 25 bp, Rattus norvegicus
cagtttgtctggaacatgcctccga

SEQ ID NO: 236611 - DNA, 25 bp, Rattus norvegicus
cagtttgtctggtacatgcctccga

SEQ ID NO: 236612 - DNA, 25 bp, Rattus norvegicus
cagtttgtcttcagggctgctgcgg

SEQ ID NO: 236613 - DNA, 25 bp, Rattus norvegicus
cagtttgtcttctgggctgctgcgg

SEQ ID NO: 236614 - DNA, 25 bp, Rattus norvegicus
cagtttgtgactcgtagcccacgat

SEQ ID NO: 236615 - DNA, 25 bp, Rattus norvegicus
cagtttgtgactggtagcccacgat

SEQ ID NO: 236616 - DNA, 25 bp, Rattus norvegicus
cagtttgtgcatccggtctgagagc

SEQ ID NO: 236617 - DNA, 25 bp, Rattus norvegicus
cagtttgtgcatgcggtctgagagc

SEQ ID NO: 236618 - DNA, 25 bp, Rattus norvegicus
cagtttgtggttactatgcctgttt

SEQ ID NO: 236619 - DNA, 25 bp, Rattus norvegicus
cagtttgtggttcccatgtggcact

SEQ ID NO: 236620 - DNA, 25 bp, Rattus norvegicus
cagtttgtggttgccatgtggcact

SEQ ID NO: 236621 - DNA, 25 bp, Rattus norvegicus
cagtttgtggtttctatgcctgttt

SEQ ID NO: 236622 - DNA, 25 bp, Rattus norvegicus
cagtttgtgtctaacaagagatgtt

SEQ ID NO: 236623 - DNA, 25 bp, Rattus norvegicus
cagtttgtgtcttacaagagatgtt

SEQ ID NO: 236624 - DNA, 25 bp, Rattus norvegicus
cagtttgtgttgatcagagatgtct

SEQ ID NO: 236625 - DNA, 25 bp, Rattus norvegicus
cagtttgtgttgttcagagatgtct

SEQ ID NO: 236626 - DNA, 25 bp, Rattus norvegicus
cagtttgttcaactgccatcgccat

SEQ ID NO: 236627 - DNA, 25 bp, Rattus norvegicus
cagtttgttcaagtgccatcgccat

SEQ ID NO: 236628 - DNA, 25 bp, Rattus norvegicus
cagttttaaccactgaaagctcatg

SEQ ID NO: 236629 - DNA, 25 bp, Rattus norvegicus
cagttttaaccagtgaaagctcatg

SEQ ID NO: 236630 - DNA, 25 bp, Rattus norvegicus
cagttttacaaactgcatggtcatt

SEQ ID NO: 236631 - DNA, 25 bp, Rattus norvegicus
cagttttacaaagtgcatggtcatt

SEQ ID NO: 236632 - DNA, 25 bp, Rattus norvegicus
cagttttactgcatttgctaacaaa

SEQ ID NO: 236633 - DNA, 25 bp, Rattus norvegicus
cagttttactgcttttgctaacaaa

SEQ ID NO: 236634 - DNA, 25 bp, Rattus norvegicus
cagttttacttcaagcatgtggccc

SEQ ID NO: 236635 - DNA, 25 bp, Rattus norvegicus
cagttttacttctagcatgtggccc

SEQ ID NO: 236636 - DNA, 25 bp, Rattus norvegicus
cagttttactttacacacttccaag

SEQ ID NO: 236637 - DNA, 25 bp, Rattus norvegicus
cagttttacttttcacacttccaag

SEQ ID NO: 236638 - DNA, 25 bp, Rattus norvegicus
cagttttattaccatgctgtgcaaa

SEQ ID NO: 236639 - DNA, 25 bp, Rattus norvegicus
cagttttattacgatgctgtgcaaa

SEQ ID NO: 236640 - DNA, 25 bp, Rattus norvegicus
cagttttcaaacaatgcagtcagaa

SEQ ID NO: 236641 - DNA, 25 bp, Rattus norvegicus
cagttttcaaactatgcagtcagaa

SEQ ID NO: 236642 - DNA, 25 bp, Rattus norvegicus
cagttttcagagctcttcaagatct

SEQ ID NO: 236643 - DNA, 25 bp, Rattus norvegicus
cagttttcagaggtcttcaagatct

SEQ ID NO: 236644 - DNA, 25 bp, Rattus norvegicus
cagttttcatttagctgagctagaa

SEQ ID NO: 236645 - DNA, 25 bp, Rattus norvegicus
cagttttcattttgctgagctagaa

SEQ ID NO: 236646 - DNA, 25 bp, Rattus norvegicus
cagttttctaatcaatgtgctatca

SEQ ID NO: 236647 - DNA, 25 bp, Rattus norvegicus
cagttttctaatgaatgtgctatca

SEQ ID NO: 236648 - DNA, 25 bp, Rattus norvegicus
cagttttctacacccagcagaggga

SEQ ID NO: 236649 - DNA, 25 bp, Rattus norvegicus
cagttttctacagccagcagaggga

SEQ ID NO: 236650 - DNA, 25 bp, Rattus norvegicus
cagttttctgccctgtgcataaaaa

SEQ ID NO: 236651 - DNA, 25 bp, Rattus norvegicus
cagttttctgccgtgtgcataaaaa

SEQ ID NO: 236652 - DNA, 25 bp, Rattus norvegicus
cagttttctgtaaggatgtggctcc

SEQ ID NO: 236653 - DNA, 25 bp, Rattus norvegicus
cagttttctgtatggatgtggctcc

SEQ ID NO: 236654 - DNA, 25 bp, Rattus norvegicus
cagttttcttcaagagtgcagcccc

SEQ ID NO: 236655 - DNA, 25 bp, Rattus norvegicus
cagttttcttcatgagtgcagcccc

SEQ ID NO: 236656 - DNA, 25 bp, Rattus norvegicus
cagttttctttgaaacatgttttat

SEQ ID NO: 236657 - DNA, 25 bp, Rattus norvegicus
cagttttctttgtaacatgttttat

SEQ ID NO: 236658 - DNA, 25 bp, Rattus norvegicus
cagttttgaggtaatgcacactaaa

SEQ ID NO: 236659 - DNA, 25 bp, Rattus norvegicus
cagttttgaggttatgcacactaaa

SEQ ID NO: 236660 - DNA, 25 bp, Rattus norvegicus
cagttttgatccagtcacacttaca

SEQ ID NO: 236661 - DNA, 25 bp, Rattus norvegicus
cagttttgatcctgtcacacttaca

SEQ ID NO: 236662 - DNA, 25 bp, Rattus norvegicus
cagttttgatgaccccacttacaag

SEQ ID NO: 236663 - DNA, 25 bp, Rattus norvegicus
cagttttgatgagcccacttacaag

SEQ ID NO: 236664 - DNA, 25 bp, Rattus norvegicus
cagttttggagtatccctttgctga

SEQ ID NO: 236665 - DNA, 25 bp, Rattus norvegicus
cagttttggagtttccctttgctga

SEQ ID NO: 236666 - DNA, 25 bp, Rattus norvegicus
cagttttgtacgaatgcctgttaaa

SEQ ID NO: 236667 - DNA, 25 bp, Rattus norvegicus
cagttttgtacgtatgcctgttaaa

SEQ ID NO: 236668 - DNA, 25 bp, Rattus norvegicus
cagttttgtgtaccagggcaggcct

SEQ ID NO: 236669 - DNA, 25 bp, Rattus norvegicus
cagttttgtgtagcagggcaggcct

SEQ ID NO: 236670 - DNA, 25 bp, Rattus norvegicus
cagttttgtgtgctttcttagcata

SEQ ID NO: 236671 - DNA, 25 bp, Rattus norvegicus
cagttttgtgtggtttcttagcata

SEQ ID NO: 236672 - DNA, 25 bp, Rattus norvegicus
cagttttgttttcctcttgggaatg

SEQ ID NO: 236673 - DNA, 25 bp, Rattus norvegicus
cagttttgttttgctcttgggaatg

SEQ ID NO: 236674 - DNA, 25 bp, Rattus norvegicus
cagtttttatgactatcccatgagt

SEQ ID NO: 236675 - DNA, 25 bp, Rattus norvegicus
cagtttttatgagtatcccatgagt

SEQ ID NO: 236676 - DNA, 25 bp, Rattus norvegicus
cagtttttccagaacctgttgttga

SEQ ID NO: 236677 - DNA, 25 bp, Rattus norvegicus
cagtttttccagtacctgttgttga

SEQ ID NO: 236678 - DNA, 25 bp, Rattus norvegicus
cagtttttctatacggtgccatcca

SEQ ID NO: 236679 - DNA, 25 bp, Rattus norvegicus
cagtttttctattcggtgccatcca

SEQ ID NO: 236680 - DNA, 25 bp, Rattus norvegicus
cagtttttggtccttcatttcttct

SEQ ID NO: 236681 - DNA, 25 bp, Rattus norvegicus
cagtttttggtcgttcatttcttct

SEQ ID NO: 236682 - DNA, 25 bp, Rattus norvegicus
cataaaaacatcctggcacttctcc

SEQ ID NO: 236683 - DNA, 25 bp, Rattus norvegicus
cataaaaacatcgtggcacttctcc

SEQ ID NO: 236684 - DNA, 25 bp, Rattus norvegicus
cataaagcctttacaacctgtgcct

SEQ ID NO: 236685 - DNA, 25 bp, Rattus norvegicus
cataaagccttttcaacctgtgcct

SEQ ID NO: 236686 - DNA, 25 bp, Rattus norvegicus
cataaagcgggacaccagcctattc

SEQ ID NO: 236687 - DNA, 25 bp, Rattus norvegicus
cataaagcgggagaccagcctattc

SEQ ID NO: 236688 - DNA, 25 bp, Rattus norvegicus
cataaaggtctaaaagccaggattt

SEQ ID NO: 236689 - DNA, 25 bp, Rattus norvegicus
cataaaggtctataagccaggattt

SEQ ID NO: 236690 - DNA, 25 bp, Rattus norvegicus
cataaagtcctccttgaaactcgga

SEQ ID NO: 236691 - DNA, 25 bp, Rattus norvegicus
cataaagtcctcgttgaaactcgga

SEQ ID NO: 236692 - DNA, 25 bp, Rattus norvegicus
cataaagtcttcacactcttctggc

SEQ ID NO: 236693 - DNA, 25 bp, Rattus norvegicus
cataaagtcttctcactcttctggc

SEQ ID NO: 236694 - DNA, 25 bp, Rattus norvegicus
cataaagtgagcactgtgtcagtca

SEQ ID NO: 236695 - DNA, 25 bp, Rattus norvegicus
cataaagtgagctctgtgtcagtca

SEQ ID NO: 236696 - DNA, 25 bp, Rattus norvegicus
cataaagtgcttatgaggctaaata

SEQ ID NO: 236697 - DNA, 25 bp, Rattus norvegicus
cataaagtgcttttgaggctaaata

SEQ ID NO: 236698 - DNA, 25 bp, Rattus norvegicus
cataaagtggcgacccaggtgaagc

SEQ ID NO: 236699 - DNA, 25 bp, Rattus norvegicus
cataaagtggcgtcccaggtgaagc

SEQ ID NO: 236700 - DNA, 25 bp, Rattus norvegicus
cataaagttcctccttgtttgcgtt

SEQ ID NO: 236701 - DNA, 25 bp, Rattus norvegicus
cataaagttcctgcttgtttgcgtt

SEQ ID NO: 236702 - DNA, 25 bp, Rattus norvegicus
cataaatctccccacaaaaattcca

SEQ ID NO: 236703 - DNA, 25 bp, Rattus norvegicus
cataaatctcccgacaaaaattcca

SEQ ID NO: 236704 - DNA, 25 bp, Rattus norvegicus
cataaatttcttatcagtgaactga

SEQ ID NO: 236705 - DNA, 25 bp, Rattus norvegicus
cataaatttcttttcagtgaactga

SEQ ID NO: 236706 - DNA, 25 bp, Rattus norvegicus
cataacaccctactccggaatggta

SEQ ID NO: 236707 - DNA, 25 bp, Rattus norvegicus
cataacaccctagtccggaatggta

SEQ ID NO: 236708 - DNA, 25 bp, Rattus norvegicus
cataacactaagaccttctagccag

SEQ ID NO: 236709 - DNA, 25 bp, Rattus norvegicus
cataacactaagtccttctagccag

SEQ ID NO: 236710 - DNA, 25 bp, Rattus norvegicus
cataacactgcgcatctgtgatgat

SEQ ID NO: 236711 - DNA, 25 bp, Rattus norvegicus
cataacactgcggatctgtgatgat

SEQ ID NO: 236712 - DNA, 25 bp, Rattus norvegicus
cataacactgttacgctttctttaa

SEQ ID NO: 236713 - DNA, 25 bp, Rattus norvegicus
cataacactgtttcgctttctttaa

SEQ ID NO: 236714 - DNA, 25 bp, Rattus norvegicus
cataacacttctagtctttgagact

SEQ ID NO: 236715 - DNA, 25 bp, Rattus norvegicus
cataacacttcttgtctttgagact

SEQ ID NO: 236716 - DNA, 25 bp, Rattus norvegicus
cataaccacgttatacattgacatt

SEQ ID NO: 236717 - DNA, 25 bp, Rattus norvegicus
cataaccacgttttacattgacatt

SEQ ID NO: 236718 - DNA, 25 bp, Rattus norvegicus
cataaccagatcacttcatctgtcc

SEQ ID NO: 236719 - DNA, 25 bp, Rattus norvegicus
cataaccagatctcttcatctgtcc

SEQ ID NO: 236720 - DNA, 25 bp, Rattus norvegicus
cataaccatatgctgtgcttctgtg

SEQ ID NO: 236721 - DNA, 25 bp, Rattus norvegicus
cataaccatatggtgtgcttctgtg

SEQ ID NO: 236722 - DNA, 25 bp, Rattus norvegicus
cataaccgatggcagtctctcagtc

SEQ ID NO: 236723 - DNA, 25 bp, Rattus norvegicus
cataaccgatgggagtctctcagtc

SEQ ID NO: 236724 - DNA, 25 bp, Rattus norvegicus
cataaccttgccctggtatcagtac

SEQ ID NO: 236725 - DNA, 25 bp, Rattus norvegicus
cataaccttgccgtggtatcagtac

SEQ ID NO: 236726 - DNA, 25 bp, Rattus norvegicus
cataacggtccgaatctccccggag

SEQ ID NO: 236727 - DNA, 25 bp, Rattus norvegicus
cataacggtccgtatctccccggag

SEQ ID NO: 236728 - DNA, 25 bp, Rattus norvegicus
cataactcggctcctgttctgctgc

SEQ ID NO: 236729 - DNA, 25 bp, Rattus norvegicus
cataactcggctgctgttctgctgc

SEQ ID NO: 236730 - DNA, 25 bp, Rattus norvegicus
cataactcgtaaccatgtttagtaa

SEQ ID NO: 236731 - DNA, 25 bp, Rattus norvegicus
cataactcgtaagcatgtttagtaa

SEQ ID NO: 236732 - DNA, 25 bp, Rattus norvegicus
cataactgacaccatgagtaaaggt

SEQ ID NO: 236733 - DNA, 25 bp, Rattus norvegicus
cataactgacacgatgagtaaaggt

SEQ ID NO: 236734 - DNA, 25 bp, Rattus norvegicus
cataactgataccaggccctgctta

SEQ ID NO: 236735 - DNA, 25 bp, Rattus norvegicus
cataactgatacgaggccctgctta

SEQ ID NO: 236736 - DNA, 25 bp, Rattus norvegicus
cataacttaatgacaattggcgcag

SEQ ID NO: 236737 - DNA, 25 bp, Rattus norvegicus
cataacttaatgtcaattggcgcag

SEQ ID NO: 236738 - DNA, 25 bp, Rattus norvegicus
cataacttacaaatccgtagccccg

SEQ ID NO: 236739 - DNA, 25 bp, Rattus norvegicus
cataacttacaattccgtagccccg

SEQ ID NO: 236740 - DNA, 25 bp, Rattus norvegicus
cataacttagttatcaccttcgatt

SEQ ID NO: 236741 - DNA, 25 bp, Rattus norvegicus
cataacttagttttcaccttcgatt

SEQ ID NO: 236742 - DNA, 25 bp, Rattus norvegicus
cataagactggccttggttcaagta

SEQ ID NO: 236743 - DNA, 25 bp, Rattus norvegicus
cataagactggcgttggttcaagta

SEQ ID NO: 236744 - DNA, 25 bp, Rattus norvegicus
cataagacttccattctgtgtagaa

SEQ ID NO: 236745 - DNA, 25 bp, Rattus norvegicus
cataagacttcctttctgtgtagaa

SEQ ID NO: 236746 - DNA, 25 bp, Rattus norvegicus
cataagattctgcaggagtcgggtc

SEQ ID NO: 236747 - DNA, 25 bp, Rattus norvegicus
cataagattctggaggagtcgggtc

SEQ ID NO: 236748 - DNA, 25 bp, Rattus norvegicus
cataagcatagacagtccacgtggt

SEQ ID NO: 236749 - DNA, 25 bp, Rattus norvegicus
cataagcatagagagtccacgtggt

SEQ ID NO: 236750 - DNA, 25 bp, Rattus norvegicus
cataagcatgtaacgcctgaggccc

SEQ ID NO: 236751 - DNA, 25 bp, Rattus norvegicus
cataagcatgtatcgcctgaggccc

SEQ ID NO: 236752 - DNA, 25 bp, Rattus norvegicus
cataagctcagtcgtgtcccggtga

SEQ ID NO: 236753 - DNA, 25 bp, Rattus norvegicus
cataagctcagtggtgtcccggtga

SEQ ID NO: 236754 - DNA, 25 bp, Rattus norvegicus
cataagctcttgatctgggtgacag

SEQ ID NO: 236755 - DNA, 25 bp, Rattus norvegicus
cataagctcttgttctgggtgacag

SEQ ID NO: 236756 - DNA, 25 bp, Rattus norvegicus
cataagctggtgattgttggtaatc

SEQ ID NO: 236757 - DNA, 25 bp, Rattus norvegicus
cataagctggtgtttgttggtaatc

SEQ ID NO: 236758 - DNA, 25 bp, Rattus norvegicus
cataagctgtgcctgccttcccata

SEQ ID NO: 236759 - DNA, 25 bp, Rattus norvegicus
cataagctgtgcgtgccttcccata

SEQ ID NO: 236760 - DNA, 25 bp, Rattus norvegicus
cataagggcatgcattaccgggact

SEQ ID NO: 236761 - DNA, 25 bp, Rattus norvegicus
cataagggcatggattaccgggact

SEQ ID NO: 236762 - DNA, 25 bp, Rattus norvegicus
cataagggccacaaggagaggcaca

SEQ ID NO: 236763 - DNA, 25 bp, Rattus norvegicus
cataagggccactaggagaggcaca

SEQ ID NO: 236764 - DNA, 25 bp, Rattus norvegicus
cataaggtctcgcagtccagcacct

SEQ ID NO: 236765 - DNA, 25 bp, Rattus norvegicus
cataaggtctcggagtccagcacct

SEQ ID NO: 236766 - DNA, 25 bp, Rattus norvegicus
cataagtatcccctactctgtctgt

SEQ ID NO: 236767 - DNA, 25 bp, Rattus norvegicus
cataagtatcccgtactctgtctgt

SEQ ID NO: 236768 - DNA, 25 bp, Rattus norvegicus
cataagtcttgtactctttagctgt

SEQ ID NO: 236769 - DNA, 25 bp, Rattus norvegicus
cataagtcttgttctctttagctgt

SEQ ID NO: 236770 - DNA, 25 bp, Rattus norvegicus
cataataaggaaccctattggccca

SEQ ID NO: 236771 - DNA, 25 bp, Rattus norvegicus
cataataaggaagcctattggccca

SEQ ID NO: 236772 - DNA, 25 bp, Rattus norvegicus
cataatactgaaacctcacacggcc

SEQ ID NO: 236773 - DNA, 25 bp, Rattus norvegicus
cataatactgaatcctcacacggcc

SEQ ID NO: 236774 - DNA, 25 bp, Rattus norvegicus
cataatagtatgatgctttcctcac

SEQ ID NO: 236775 - DNA, 25 bp, Rattus norvegicus
cataatagtatgttgctttcctcac

SEQ ID NO: 236776 - DNA, 25 bp, Rattus norvegicus
cataatatgtttcaggtacctggcc

SEQ ID NO: 236777 - DNA, 25 bp, Rattus norvegicus
cataatatgtttgaggtacctggcc

SEQ ID NO: 236778 - DNA, 25 bp, Rattus norvegicus
cataatccacgtaactcacctttgc

SEQ ID NO: 236779 - DNA, 25 bp, Rattus norvegicus
cataatccacgttactcacctttgc

SEQ ID NO: 236780 - DNA, 25 bp, Rattus norvegicus
cataatccagagaggcttgccccga

SEQ ID NO: 236781 - DNA, 25 bp, Rattus norvegicus
cataatccagagtggcttgccccga

SEQ ID NO: 236782 - DNA, 25 bp, Rattus norvegicus
cataatcgaaacagtccgggctgca

SEQ ID NO: 236783 - DNA, 25 bp, Rattus norvegicus
cataatcgaaactgtccgggctgca

SEQ ID NO: 236784 - DNA, 25 bp, Rattus norvegicus
cataatctgtacatgactgttctgt

SEQ ID NO: 236785 - DNA, 25 bp, Rattus norvegicus
cataatctgtacttgactgttctgt

SEQ ID NO: 236786 - DNA, 25 bp, Rattus norvegicus
cataatctgtggaggtgttaggata

SEQ ID NO: 236787 - DNA, 25 bp, Rattus norvegicus
cataatctgtggtggtgttaggata

SEQ ID NO: 236788 - DNA, 25 bp, Rattus norvegicus
cataatctgtgtatccatggaggac

SEQ ID NO: 236789 - DNA, 25 bp, Rattus norvegicus
cataatctgtgtttccatggaggac

SEQ ID NO: 236790 - DNA, 25 bp, Rattus norvegicus
cataatcttgtacatgtgggactac

SEQ ID NO: 236791 - DNA, 25 bp, Rattus norvegicus
cataatcttgtagatgtgggactac

SEQ ID NO: 236792 - DNA, 25 bp, Rattus norvegicus
cataatgacatcactgagcctggct

SEQ ID NO: 236793 - DNA, 25 bp, Rattus norvegicus
cataatgacatctctgagcctggct

SEQ ID NO: 236794 - DNA, 25 bp, Rattus norvegicus
cataatgcctgcactgaggtcgaat

SEQ ID NO: 236795 - DNA, 25 bp, Rattus norvegicus
cataatgcctgctctgaggtcgaat

SEQ ID NO: 236796 - DNA, 25 bp, Rattus norvegicus
cataatggaggtacctttctggtcc

SEQ ID NO: 236797 - DNA, 25 bp, Rattus norvegicus
cataatggaggttcctttctggtcc

SEQ ID NO: 236798 - DNA, 25 bp, Rattus norvegicus
cataatggtgccactcaactccagc

SEQ ID NO: 236799 - DNA, 25 bp, Rattus norvegicus
cataatggtgcctctcaactccagc

SEQ ID NO: 236800 - DNA, 25 bp, Rattus norvegicus
cataatggttttctgtgctctcgag

SEQ ID NO: 236801 - DNA, 25 bp, Rattus norvegicus
cataatggttttgtgtgctctcgag

SEQ ID NO: 236802 - DNA, 25 bp, Rattus norvegicus
cataattatctgagtattcccctaa

SEQ ID NO: 236803 - DNA, 25 bp, Rattus norvegicus
cataattatctgtgtattcccctaa

SEQ ID NO: 236804 - DNA, 25 bp, Rattus norvegicus
cataattatgtcagctttcctcttg

SEQ ID NO: 236805 - DNA, 25 bp, Rattus norvegicus
cataattatgtctgctttcctcttg

SEQ ID NO: 236806 - DNA, 25 bp, Rattus norvegicus
cataattattgcagtgtccagccca

SEQ ID NO: 236807 - DNA, 25 bp, Rattus norvegicus
cataattattgctgtgtccagccca

SEQ ID NO: 236808 - DNA, 25 bp, Rattus norvegicus
cataattgatttactgatgcattta

SEQ ID NO: 236809 - DNA, 25 bp, Rattus norvegicus
cataattgattttctgatgcattta

SEQ ID NO: 236810 - DNA, 25 bp, Rattus norvegicus
cataatttatcaagccttgttagtt

SEQ ID NO: 236811 - DNA, 25 bp, Rattus norvegicus
cataatttatcatgccttgttagtt

SEQ ID NO: 236812 - DNA, 25 bp, Rattus norvegicus
cataatttctctctgttgcacacat

SEQ ID NO: 236813 - DNA, 25 bp, Rattus norvegicus
cataatttctctgtgttgcacacat

SEQ ID NO: 236814 - DNA, 25 bp, Rattus norvegicus
cataatttgtttacgcttagcttta

SEQ ID NO: 236815 - DNA, 25 bp, Rattus norvegicus
cataatttgttttcgcttagcttta

SEQ ID NO: 236816 - DNA, 25 bp, Rattus norvegicus
cataattttttcacctgctctttaa

SEQ ID NO: 236817 - DNA, 25 bp, Rattus norvegicus
cataattttttctcctgctctttaa

SEQ ID NO: 236818 - DNA, 25 bp, Rattus norvegicus
catacaactgagagtgccctggagt

SEQ ID NO: 236819 - DNA, 25 bp, Rattus norvegicus
catacaactgagtgtgccctggagt

SEQ ID NO: 236820 - DNA, 25 bp, Rattus norvegicus
catacaagagacaagccgaggaagc

SEQ ID NO: 236821 - DNA, 25 bp, Rattus norvegicus
catacaagagactagccgaggaagc

SEQ ID NO: 236822 - DNA, 25 bp, Rattus norvegicus
catacacacactaaggactcataag

SEQ ID NO: 236823 - DNA, 25 bp, Rattus norvegicus
catacacacacttaggactcataag

SEQ ID NO: 236824 - DNA, 25 bp, Rattus norvegicus
catacacagcttagtcttttgctct

SEQ ID NO: 236825 - DNA, 25 bp, Rattus norvegicus
catacacagctttgtcttttgctct

SEQ ID NO: 236826 - DNA, 25 bp, Rattus norvegicus
catacacatatgcagagttgatctt

SEQ ID NO: 236827 - DNA, 25 bp, Rattus norvegicus
catacacatatggagagttgatctt

SEQ ID NO: 236828 - DNA, 25 bp, Rattus norvegicus
catacacgatgcacacacaagaagt

SEQ ID NO: 236829 - DNA, 25 bp, Rattus norvegicus
catacacgatgctcacacaagaagt

SEQ ID NO: 236830 - DNA, 25 bp, Rattus norvegicus
catacacgggacagagcttgagctc

SEQ ID NO: 236831 - DNA, 25 bp, Rattus norvegicus
catacacgggactgagcttgagctc

SEQ ID NO: 236832 - DNA, 25 bp, Rattus norvegicus
catacacgtgatattactttctaaa

SEQ ID NO: 236833 - DNA, 25 bp, Rattus norvegicus
catacacgtgattttactttctaaa

SEQ ID NO: 236834 - DNA, 25 bp, Rattus norvegicus
catacactcatcagcattcccataa

SEQ ID NO: 236835 - DNA, 25 bp, Rattus norvegicus
catacactcatctgcattcccataa

SEQ ID NO: 236836 - DNA, 25 bp, Rattus norvegicus
catacacttttactaatcccaacac

SEQ ID NO: 236837 - DNA, 25 bp, Rattus norvegicus
catacacttttagtaatcccaacac

SEQ ID NO: 236838 - DNA, 25 bp, Rattus norvegicus
catacagacgacagctgatgctgca

SEQ ID NO: 236839 - DNA, 25 bp, Rattus norvegicus
catacagacgactgctgatgctgca

SEQ ID NO: 236840 - DNA, 25 bp, Rattus norvegicus
catacagattctaaatggacccaag

SEQ ID NO: 236841 - DNA, 25 bp, Rattus norvegicus
catacagattcttaatggacccaag

SEQ ID NO: 236842 - DNA, 25 bp, Rattus norvegicus
catacagcatggacctttaacctat

SEQ ID NO: 236843 - DNA, 25 bp, Rattus norvegicus
catacagcatggtcctttaacctat

SEQ ID NO: 236844 - DNA, 25 bp, Rattus norvegicus
catacagcatgtctgtgcacgcata

SEQ ID NO: 236845 - DNA, 25 bp, Rattus norvegicus
catacagcatgtgtgtgcacgcata

SEQ ID NO: 236846 - DNA, 25 bp, Rattus norvegicus
catacagccctgagtggaatcctaa

SEQ ID NO: 236847 - DNA, 25 bp, Rattus norvegicus
catacagccctgtgtggaatcctaa

SEQ ID NO: 236848 - DNA, 25 bp, Rattus norvegicus
catacagcctttacgtggacataag

SEQ ID NO: 236849 - DNA, 25 bp, Rattus norvegicus
catacagccttttcgtggacataag

SEQ ID NO: 236850 - DNA, 25 bp, Rattus norvegicus
catacagctgtgaagacttgccttt

SEQ ID NO: 236851 - DNA, 25 bp, Rattus norvegicus
catacagctgtgtagacttgccttt

SEQ ID NO: 236852 - DNA, 25 bp, Rattus norvegicus
catacagtatttattctccttcacc

SEQ ID NO: 236853 - DNA, 25 bp, Rattus norvegicus
catacagtattttttctccttcacc

SEQ ID NO: 236854 - DNA, 25 bp, Rattus norvegicus
catacagtggcccaattccattggg

SEQ ID NO: 236855 - DNA, 25 bp, Rattus norvegicus
catacagtggccgaattccattggg

SEQ ID NO: 236856 - DNA, 25 bp, Rattus norvegicus
catacatagggtccgctggtgcata

SEQ ID NO: 236857 - DNA, 25 bp, Rattus norvegicus
catacatagggtgcgctggtgcata

SEQ ID NO: 236858 - DNA, 25 bp, Rattus norvegicus
catacatggtgaactgggtttccaa

SEQ ID NO: 236859 - DNA, 25 bp, Rattus norvegicus
catacatggtgatctgggtttccaa

SEQ ID NO: 236860 - DNA, 25 bp, Rattus norvegicus
catacatgtaggcactcgtgtatac

SEQ ID NO: 236861 - DNA, 25 bp, Rattus norvegicus
catacatgtagggactcgtgtatac

SEQ ID NO: 236862 - DNA, 25 bp, Rattus norvegicus
catacatgtataactctctctgcca

SEQ ID NO: 236863 - DNA, 25 bp, Rattus norvegicus
catacatgtatatctctctctgcca

SEQ ID NO: 236864 - DNA, 25 bp, Rattus norvegicus
catacattactcagcctaggctaaa

SEQ ID NO: 236865 - DNA, 25 bp, Rattus norvegicus
catacattactctgcctaggctaaa

SEQ ID NO: 236866 - DNA, 25 bp, Rattus norvegicus
catacattccatcagggccctttca

SEQ ID NO: 236867 - DNA, 25 bp, Rattus norvegicus
catacattccatgagggccctttca

SEQ ID NO: 236868 - DNA, 25 bp, Rattus norvegicus
catacattgagtccccaggaagccc

SEQ ID NO: 236869 - DNA, 25 bp, Rattus norvegicus
catacattgagtgcccaggaagccc

SEQ ID NO: 236870 - DNA, 25 bp, Rattus norvegicus
catacattgggcacacctgtgggtt

SEQ ID NO: 236871 - DNA, 25 bp, Rattus norvegicus
catacattgggctcacctgtgggtt

SEQ ID NO: 236872 - DNA, 25 bp, Rattus norvegicus
catacatttttaatatcttccaaag

SEQ ID NO: 236873 - DNA, 25 bp, Rattus norvegicus
catacatttttattatcttccaaag

SEQ ID NO: 236874 - DNA, 25 bp, Rattus norvegicus
cataccactatgcatgtctgggagt

SEQ ID NO: 236875 - DNA, 25 bp, Rattus norvegicus
cataccactatggatgtctgggagt

SEQ ID NO: 236876 - DNA, 25 bp, Rattus norvegicus
cataccagatcgcagacgttttcat

SEQ ID NO: 236877 - DNA, 25 bp, Rattus norvegicus
cataccagatcggagacgttttcat

SEQ ID NO: 236878 - DNA, 25 bp, Rattus norvegicus
cataccagggtgcaggcatcctctt

SEQ ID NO: 236879 - DNA, 25 bp, Rattus norvegicus
cataccagggtggaggcatcctctt

SEQ ID NO: 236880 - DNA, 25 bp, Rattus norvegicus
cataccagtgttagttcggtctact

SEQ ID NO: 236881 - DNA, 25 bp, Rattus norvegicus
cataccagtgtttgttcggtctact

SEQ ID NO: 236882 - DNA, 25 bp, Rattus norvegicus
cataccatcatgatagactaccaaa

SEQ ID NO: 236883 - DNA, 25 bp, Rattus norvegicus
cataccatcatgttagactaccaaa

SEQ ID NO: 236884 - DNA, 25 bp, Rattus norvegicus
cataccatgtgcagagaggcgccaa

SEQ ID NO: 236885 - DNA, 25 bp, Rattus norvegicus
cataccatgtgctgagaggcgccaa

SEQ ID NO: 236886 - DNA, 25 bp, Rattus norvegicus
cataccattgccctagcatgatggg

SEQ ID NO: 236887 - DNA, 25 bp, Rattus norvegicus
cataccattgccgtagcatgatggg

SEQ ID NO: 236888 - DNA, 25 bp, Rattus norvegicus
cataccattggccaatgtcggtcat

SEQ ID NO: 236889 - DNA, 25 bp, Rattus norvegicus
cataccattggcgaatgtcggtcat

SEQ ID NO: 236890 - DNA, 25 bp, Rattus norvegicus
catacccagggcagcgtggaaacta

SEQ ID NO: 236891 - DNA, 25 bp, Rattus norvegicus
catacccagggctgcgtggaaacta

SEQ ID NO: 236892 - DNA, 25 bp, Rattus norvegicus
cataccccagctcatgctgaaggag

SEQ ID NO: 236893 - DNA, 25 bp, Rattus norvegicus
cataccccagctgatgctgaaggag

SEQ ID NO: 236894 - DNA, 25 bp, Rattus norvegicus
cataccccaggaacatccattttaa

SEQ ID NO: 236895 - DNA, 25 bp, Rattus norvegicus
cataccccaggatcatccattttaa

SEQ ID NO: 236896 - DNA, 25 bp, Rattus norvegicus
cataccccatgcaacttgttagagc

SEQ ID NO: 236897 - DNA, 25 bp, Rattus norvegicus
cataccccatgctacttgttagagc

SEQ ID NO: 236898 - DNA, 25 bp, Rattus norvegicus
catacccgaggacttcttaagtctt

SEQ ID NO: 236899 - DNA, 25 bp, Rattus norvegicus
catacccgaggagttcttaagtctt

SEQ ID NO: 236900 - DNA, 25 bp, Rattus norvegicus
catacccgtacgactgggagccaga

SEQ ID NO: 236901 - DNA, 25 bp, Rattus norvegicus
catacccgtacgtctgggagccaga

SEQ ID NO: 236902 - DNA, 25 bp, Rattus norvegicus
catacccgtgttccaagtgattcaa

SEQ ID NO: 236903 - DNA, 25 bp, Rattus norvegicus
catacccgtgttgcaagtgattcaa

SEQ ID NO: 236904 - DNA, 25 bp, Rattus norvegicus
cataccctgagtctgctgcataagc

SEQ ID NO: 236905 - DNA, 25 bp, Rattus norvegicus
cataccctgagtgtgctgcataagc

SEQ ID NO: 236906 - DNA, 25 bp, Rattus norvegicus
cataccctgcaaccagatctggata

SEQ ID NO: 236907 - DNA, 25 bp, Rattus norvegicus
cataccctgcaagcagatctggata

SEQ ID NO: 236908 - DNA, 25 bp, Rattus norvegicus
cataccctgtgtccggatgtaatgc

SEQ ID NO: 236909 - DNA, 25 bp, Rattus norvegicus
cataccctgtgtgcggatgtaatgc

SEQ ID NO: 236910 - DNA, 25 bp, Rattus norvegicus
cataccctgttcagacagctacagt

SEQ ID NO: 236911 - DNA, 25 bp, Rattus norvegicus
cataccctgttctgacagctacagt

SEQ ID NO: 236912 - DNA, 25 bp, Rattus norvegicus
catacccttgtcattcatactaact

SEQ ID NO: 236913 - DNA, 25 bp, Rattus norvegicus
catacccttgtctttcatactaact

SEQ ID NO: 236914 - DNA, 25 bp, Rattus norvegicus
cataccgctctgaaactggcaggtt

SEQ ID NO: 236915 - DNA, 25 bp, Rattus norvegicus
cataccgctctgtaactggcaggtt

SEQ ID NO: 236916 - DNA, 25 bp, Rattus norvegicus
cataccgctgtcctttctgtgacaa

SEQ ID NO: 236917 - DNA, 25 bp, Rattus norvegicus
cataccgctgtcgtttctgtgacaa

SEQ ID NO: 236918 - DNA, 25 bp, Rattus norvegicus
cataccgggagaagagtagacgcta

SEQ ID NO: 236919 - DNA, 25 bp, Rattus norvegicus
cataccgggagatgagtagacgcta

SEQ ID NO: 236920 - DNA, 25 bp, Rattus norvegicus
cataccgttactctccttctcatgg

SEQ ID NO: 236921 - DNA, 25 bp, Rattus norvegicus
cataccgttactgtccttctcatgg

SEQ ID NO: 236922 - DNA, 25 bp, Rattus norvegicus
catacctaatttacacaccagttct

SEQ ID NO: 236923 - DNA, 25 bp, Rattus norvegicus
catacctaattttcacaccagttct

SEQ ID NO: 236924 - DNA, 25 bp, Rattus norvegicus
catacctagtacagtgccttgcaca

SEQ ID NO: 236925 - DNA, 25 bp, Rattus norvegicus
catacctagtactgtgccttgcaca

SEQ ID NO: 236926 - DNA, 25 bp, Rattus norvegicus
catacctcctccagattgtttttct

SEQ ID NO: 236927 - DNA, 25 bp, Rattus norvegicus
catacctcctcctgattgtttttct

SEQ ID NO: 236928 - DNA, 25 bp, Rattus norvegicus
catacctgcccacggttgatgggca

SEQ ID NO: 236929 - DNA, 25 bp, Rattus norvegicus
catacctgcccagggttgatgggca

SEQ ID NO: 236930 - DNA, 25 bp, Rattus norvegicus
catacctggctaattttcttaacac

SEQ ID NO: 236931 - DNA, 25 bp, Rattus norvegicus
catacctggctatttttcttaacac

SEQ ID NO: 236932 - DNA, 25 bp, Rattus norvegicus
catacctggcttaacttgtttctaa

SEQ ID NO: 236933 - DNA, 25 bp, Rattus norvegicus
catacctggctttacttgtttctaa

SEQ ID NO: 236934 - DNA, 25 bp, Rattus norvegicus
catacctgtgaacccatccgtgaaa

SEQ ID NO: 236935 - DNA, 25 bp, Rattus norvegicus
catacctgtgaagccatccgtgaaa

SEQ ID NO: 236936 - DNA, 25 bp, Rattus norvegicus
catacctgtttgctttcataggaca

SEQ ID NO: 236937 - DNA, 25 bp, Rattus norvegicus
catacctgtttggtttcataggaca

SEQ ID NO: 236938 - DNA, 25 bp, Rattus norvegicus
cataccttagagatagcccgtgcat

SEQ ID NO: 236939 - DNA, 25 bp, Rattus norvegicus
cataccttagagttagcccgtgcat

SEQ ID NO: 236940 - DNA, 25 bp, Rattus norvegicus
cataccttagttctttatgtattta

SEQ ID NO: 236941 - DNA, 25 bp, Rattus norvegicus
cataccttagttgtttatgtattta

SEQ ID NO: 236942 - DNA, 25 bp, Rattus norvegicus
cataccttgcacatgaacggcttca

SEQ ID NO: 236943 - DNA, 25 bp, Rattus norvegicus
cataccttgcacttgaacggcttca

SEQ ID NO: 236944 - DNA, 25 bp, Rattus norvegicus
catacctttgctcccagacaaggat

SEQ ID NO: 236945 - DNA, 25 bp, Rattus norvegicus
catacctttgctgccagacaaggat

SEQ ID NO: 236946 - DNA, 25 bp, Rattus norvegicus
catacgcatctacgacctgggcctg

SEQ ID NO: 236947 - DNA, 25 bp, Rattus norvegicus
catacgcatctaggacctgggcctg

SEQ ID NO: 236948 - DNA, 25 bp, Rattus norvegicus
catacggaagcaaaccaccacgccc

SEQ ID NO: 236949 - DNA, 25 bp, Rattus norvegicus
catacggaagcataccaccacgccc

SEQ ID NO: 236950 - DNA, 25 bp, Rattus norvegicus
catacggcgactcgcagaggctgac

SEQ ID NO: 236951 - DNA, 25 bp, Rattus norvegicus
catacggcgactggcagaggctgac

SEQ ID NO: 236952 - DNA, 25 bp, Rattus norvegicus
catacggtgacaatttctctgggtg

SEQ ID NO: 236953 - DNA, 25 bp, Rattus norvegicus
catacggtgacattttctctgggtg

SEQ ID NO: 236954 - DNA, 25 bp, Rattus norvegicus
catacgtgagttaggaattccttaa

SEQ ID NO: 236955 - DNA, 25 bp, Rattus norvegicus
catacgtgagtttggaattccttaa

SEQ ID NO: 236956 - DNA, 25 bp, Rattus norvegicus
catacgtgcattccctttgtgcgtg

SEQ ID NO: 236957 - DNA, 25 bp, Rattus norvegicus
catacgtgcattgcctttgtgcgtg

SEQ ID NO: 236958 - DNA, 25 bp, Rattus norvegicus
catacgtgtgtgcaggttccagagt

SEQ ID NO: 236959 - DNA, 25 bp, Rattus norvegicus
catacgtgtgtggaggttccagagt

SEQ ID NO: 236960 - DNA, 25 bp, Rattus norvegicus
catactaacattactcctttggagg

SEQ ID NO: 236961 - DNA, 25 bp, Rattus norvegicus
catactaacatttctcctttggagg

SEQ ID NO: 236962 - DNA, 25 bp, Rattus norvegicus
catactacaccaacatctgtgccat

SEQ ID NO: 236963 - DNA, 25 bp, Rattus norvegicus
catactacaccatcatctgtgccat

SEQ ID NO: 236964 - DNA, 25 bp, Rattus norvegicus
catactactgtacttttcgggatca

SEQ ID NO: 236965 - DNA, 25 bp, Rattus norvegicus
catactactgtagttttcgggatca

SEQ ID NO: 236966 - DNA, 25 bp, Rattus norvegicus
catactcctctcatgtataccaaag

SEQ ID NO: 236967 - DNA, 25 bp, Rattus norvegicus
catactcctctcttgtataccaaag

SEQ ID NO: 236968 - DNA, 25 bp, Rattus norvegicus
catactcgactacattctgggctga

SEQ ID NO: 236969 - DNA, 25 bp, Rattus norvegicus
catactcgactagattctgggctga

SEQ ID NO: 236970 - DNA, 25 bp, Rattus norvegicus
catactctaaagctccgaggcccaa

SEQ ID NO: 236971 - DNA, 25 bp, Rattus norvegicus
catactctaaaggtccgaggcccaa

SEQ ID NO: 236972 - DNA, 25 bp, Rattus norvegicus
catactctaaggacacagctctggg

SEQ ID NO: 236973 - DNA, 25 bp, Rattus norvegicus
catactctaaggtcacagctctggg

SEQ ID NO: 236974 - DNA, 25 bp, Rattus norvegicus
catactctatgaagctgtcctctga

SEQ ID NO: 236975 - DNA, 25 bp, Rattus norvegicus
catactctatgatgctgtcctctga

SEQ ID NO: 236976 - DNA, 25 bp, Rattus norvegicus
catactctgcatactgtctgattaa

SEQ ID NO: 236977 - DNA, 25 bp, Rattus norvegicus
catactctgcattctgtctgattaa

SEQ ID NO: 236978 - DNA, 25 bp, Rattus norvegicus
catactctgtgaccaggcatgtctg

SEQ ID NO: 236979 - DNA, 25 bp, Rattus norvegicus
catactctgtgagcaggcatgtctg

SEQ ID NO: 236980 - DNA, 25 bp, Rattus norvegicus
catactctttgtcttgtgacaacag

SEQ ID NO: 236981 - DNA, 25 bp, Rattus norvegicus
catactctttgtgttgtgacaacag

SEQ ID NO: 236982 - DNA, 25 bp, Rattus norvegicus
catactgacttcctacaaattgtgt

SEQ ID NO: 236983 - DNA, 25 bp, Rattus norvegicus
catactgacttcgtacaaattgtgt

SEQ ID NO: 236984 - DNA, 25 bp, Rattus norvegicus
catactgcccaacaagtattgctga

SEQ ID NO: 236985 - DNA, 25 bp, Rattus norvegicus
catactgcccaagaagtattgctga

SEQ ID NO: 236986 - DNA, 25 bp, Rattus norvegicus
catactgcccttctcaaactaggag

SEQ ID NO: 236987 - DNA, 25 bp, Rattus norvegicus
catactgcccttgtcaaactaggag

SEQ ID NO: 236988 - DNA, 25 bp, Rattus norvegicus
catactggaactaaccaagaccggt

SEQ ID NO: 236989 - DNA, 25 bp, Rattus norvegicus
catactggaacttaccaagaccggt

SEQ ID NO: 236990 - DNA, 25 bp, Rattus norvegicus
catactggctgaatgtgttcttgag

SEQ ID NO: 236991 - DNA, 25 bp, Rattus norvegicus
catactggctgacggctaggaccat

SEQ ID NO: 236992 - DNA, 25 bp, Rattus norvegicus
catactggctgagggctaggaccat

SEQ ID NO: 236993 - DNA, 25 bp, Rattus norvegicus
catactggctgattgtgttcttgag

SEQ ID NO: 236994 - DNA, 25 bp, Rattus norvegicus
catactgggagcattgtagttccta

SEQ ID NO: 236995 - DNA, 25 bp, Rattus norvegicus
catactgggagctttgtagttccta

SEQ ID NO: 236996 - DNA, 25 bp, Rattus norvegicus
catactggtgggactatagctcgat

SEQ ID NO: 236997 - DNA, 25 bp, Rattus norvegicus
catactggtgggtctatagctcgat

SEQ ID NO: 236998 - DNA, 25 bp, Rattus norvegicus
catactggttctcctatggtataaa

SEQ ID NO: 236999 - DNA, 25 bp, Rattus norvegicus
catactggttctgctatggtataaa

SEQ ID NO: 237000 - DNA, 25 bp, Rattus norvegicus
catactgtatgcattctacctgtaa

SEQ ID NO: 237001 - DNA, 25 bp, Rattus norvegicus
catactgtatgctttctacctgtaa

SEQ ID NO: 237002 - DNA, 25 bp, Rattus norvegicus
catactgtcaccagcctgttatttt

SEQ ID NO: 237003 - DNA, 25 bp, Rattus norvegicus
catactgtcacctgcctgttatttt

SEQ ID NO: 237004 - DNA, 25 bp, Rattus norvegicus
catactgtcagtatttgtcttaata

SEQ ID NO: 237005 - DNA, 25 bp, Rattus norvegicus
catactgtcagtttttgtcttaata

SEQ ID NO: 237006 - DNA, 25 bp, Rattus norvegicus
catactgttcccaatgtggcataga

SEQ ID NO: 237007 - DNA, 25 bp, Rattus norvegicus
catactgttccctatgtggcataga

SEQ ID NO: 237008 - DNA, 25 bp, Rattus norvegicus
catactgttgtaactgtgccattca

SEQ ID NO: 237009 - DNA, 25 bp, Rattus norvegicus
catactgttgtatctgtgccattca

SEQ ID NO: 237010 - DNA, 25 bp, Rattus norvegicus
catactgtttggagtctgcgcgtgc

SEQ ID NO: 237011 - DNA, 25 bp, Rattus norvegicus
catactgtttggtgtctgcgcgtgc

SEQ ID NO: 237012 - DNA, 25 bp, Rattus norvegicus
catactgttttcatataacccgctt

SEQ ID NO: 237013 - DNA, 25 bp, Rattus norvegicus
catactgttttcttataacccgctt

SEQ ID NO: 237014 - DNA, 25 bp, Rattus norvegicus
catacttaaggcctgagtcctcagc

SEQ ID NO: 237015 - DNA, 25 bp, Rattus norvegicus
catacttaaggcgtgagtcctcagc

SEQ ID NO: 237016 - DNA, 25 bp, Rattus norvegicus
catacttcatgcaattccttaaccg

SEQ ID NO: 237017 - DNA, 25 bp, Rattus norvegicus
catacttcatgctattccttaaccg

SEQ ID NO: 237018 - DNA, 25 bp, Rattus norvegicus
catacttccattcccaggaggcttc

SEQ ID NO: 237019 - DNA, 25 bp, Rattus norvegicus
catacttccattgccaggaggcttc

SEQ ID NO: 237020 - DNA, 25 bp, Rattus norvegicus
catacttccgagaacttcgtattta

SEQ ID NO: 237021 - DNA, 25 bp, Rattus norvegicus
catacttccgagtacttcgtattta

SEQ ID NO: 237022 - DNA, 25 bp, Rattus norvegicus
catacttcctttctgaatgtcacca

SEQ ID NO: 237023 - DNA, 25 bp, Rattus norvegicus
catacttcctttgtgaatgtcacca

SEQ ID NO: 237024 - DNA, 25 bp, Rattus norvegicus
catacttcggtgactatttcggttg

SEQ ID NO: 237025 - DNA, 25 bp, Rattus norvegicus
catacttcggtgtctatttcggttg

SEQ ID NO: 237026 - DNA, 25 bp, Rattus norvegicus
catacttgactcacatgatgacgtg

SEQ ID NO: 237027 - DNA, 25 bp, Rattus norvegicus
catacttgactctcatgatgacgtg

SEQ ID NO: 237028 - DNA, 25 bp, Rattus norvegicus
catacttggcttatggcaagggtgg

SEQ ID NO: 237029 - DNA, 25 bp, Rattus norvegicus
catacttggcttttggcaagggtgg

SEQ ID NO: 237030 - DNA, 25 bp, Rattus norvegicus
catacttgggttattctgactcacg

SEQ ID NO: 237031 - DNA, 25 bp, Rattus norvegicus
catacttgggtttttctgactcacg

SEQ ID NO: 237032 - DNA, 25 bp, Rattus norvegicus
catacttgtaatattgctgctgtta

SEQ ID NO: 237033 - DNA, 25 bp, Rattus norvegicus
catacttgtaattttgctgctgtta

SEQ ID NO: 237034 - DNA, 25 bp, Rattus norvegicus
catacttgtaggaccaatacttgaa

SEQ ID NO: 237035 - DNA, 25 bp, Rattus norvegicus
catacttgtaggtccaatacttgaa

SEQ ID NO: 237036 - DNA, 25 bp, Rattus norvegicus
catacttgtttcacctatgatggga

SEQ ID NO: 237037 - DNA, 25 bp, Rattus norvegicus
catacttgtttctcctatgatggga

SEQ ID NO: 237038 - DNA, 25 bp, Rattus norvegicus
catacttgtttgatgttctgaatac

SEQ ID NO: 237039 - DNA, 25 bp, Rattus norvegicus
catacttgtttgttgttctgaatac

SEQ ID NO: 237040 - DNA, 25 bp, Rattus norvegicus
catacttttatactgatcctgtggg

SEQ ID NO: 237041 - DNA, 25 bp, Rattus norvegicus
catacttttatagtgatcctgtggg

SEQ ID NO: 237042 - DNA, 25 bp, Rattus norvegicus
catacttttgctatctttgttaagg

SEQ ID NO: 237043 - DNA, 25 bp, Rattus norvegicus
catacttttgctttctttgttaagg

SEQ ID NO: 237044 - DNA, 25 bp, Rattus norvegicus
catagaagtcgcacagttggcatat

SEQ ID NO: 237045 - DNA, 25 bp, Rattus norvegicus
catagaagtcgctcagttggcatat

SEQ ID NO: 237046 - DNA, 25 bp, Rattus norvegicus
catagaagttaaccgtgtttgtcca

SEQ ID NO: 237047 - DNA, 25 bp, Rattus norvegicus
catagaagttaagcgtgtttgtcca

SEQ ID NO: 237048 - DNA, 25 bp, Rattus norvegicus
catagaatttcgacagctgcctggt

SEQ ID NO: 237049 - DNA, 25 bp, Rattus norvegicus
catagaatttcgtcagctgcctggt

SEQ ID NO: 237050 - DNA, 25 bp, Rattus norvegicus
catagacacactatcttttctcttc

SEQ ID NO: 237051 - DNA, 25 bp, Rattus norvegicus
catagacacactttcttttctcttc

SEQ ID NO: 237052 - DNA, 25 bp, Rattus norvegicus
catagacactgaagggaccggaccc

SEQ ID NO: 237053 - DNA, 25 bp, Rattus norvegicus
catagacactgatgggaccggaccc

SEQ ID NO: 237054 - DNA, 25 bp, Rattus norvegicus
catagacaggagactccctggagcc

SEQ ID NO: 237055 - DNA, 25 bp, Rattus norvegicus
catagacaggagtctccctggagcc

SEQ ID NO: 237056 - DNA, 25 bp, Rattus norvegicus
catagaccagttaattgcatcaagt

SEQ ID NO: 237057 - DNA, 25 bp, Rattus norvegicus
catagaccagtttattgcatcaagt

SEQ ID NO: 237058 - DNA, 25 bp, Rattus norvegicus
catagaccgtctctttctgcctcag

SEQ ID NO: 237059 - DNA, 25 bp, Rattus norvegicus
catagaccgtctgtttctgcctcag

SEQ ID NO: 237060 - DNA, 25 bp, Rattus norvegicus
catagacctcatatccacttgggaa

SEQ ID NO: 237061 - DNA, 25 bp, Rattus norvegicus
catagacctcatttccacttgggaa

SEQ ID NO: 237062 - DNA, 25 bp, Rattus norvegicus
catagacctgttcttctcaacggaa

SEQ ID NO: 237063 - DNA, 25 bp, Rattus norvegicus
catagacctgttgttctcaacggaa

SEQ ID NO: 237064 - DNA, 25 bp, Rattus norvegicus
catagacttggacagccctggtgct

SEQ ID NO: 237065 - DNA, 25 bp, Rattus norvegicus
catagacttggagagccctggtgct

SEQ ID NO: 237066 - DNA, 25 bp, Rattus norvegicus
catagagaacgaaccaccttttgag

SEQ ID NO: 237067 - DNA, 25 bp, Rattus norvegicus
catagagaacgatccaccttttgag

SEQ ID NO: 237068 - DNA, 25 bp, Rattus norvegicus
catagagtagagcaagctgctgtga

SEQ ID NO: 237069 - DNA, 25 bp, Rattus norvegicus
catagagtagaggaagctgctgtga

SEQ ID NO: 237070 - DNA, 25 bp, Rattus norvegicus
catagagtaggcagggtttctgcca

SEQ ID NO: 237071 - DNA, 25 bp, Rattus norvegicus
catagagtaggctgggtttctgcca

SEQ ID NO: 237072 - DNA, 25 bp, Rattus norvegicus
catagatactatcttcaaaggctgt

SEQ ID NO: 237073 - DNA, 25 bp, Rattus norvegicus
catagatactatgttcaaaggctgt

SEQ ID NO: 237074 - DNA, 25 bp, Rattus norvegicus
catagatcattcatgtcttcctcaa

SEQ ID NO: 237075 - DNA, 25 bp, Rattus norvegicus
catagatcattcttgtcttcctcaa

SEQ ID NO: 237076 - DNA, 25 bp, Rattus norvegicus
catagatgatcaaatccagctgcta

SEQ ID NO: 237077 - DNA, 25 bp, Rattus norvegicus
catagatgatcatatccagctgcta

SEQ ID NO: 237078 - DNA, 25 bp, Rattus norvegicus
catagatggtgacgtcgctgtccgt

SEQ ID NO: 237079 - DNA, 25 bp, Rattus norvegicus
catagatggtgaggtcgctgtccgt

SEQ ID NO: 237080 - DNA, 25 bp, Rattus norvegicus
catagatgtaacattggccccgcag

SEQ ID NO: 237081 - DNA, 25 bp, Rattus norvegicus
catagatgtaactttggccccgcag

SEQ ID NO: 237082 - DNA, 25 bp, Rattus norvegicus
catagcaaagccatgtctcaacacc

SEQ ID NO: 237083 - DNA, 25 bp, Rattus norvegicus
catagcaaagccttgtctcaacacc

SEQ ID NO: 237084 - DNA, 25 bp, Rattus norvegicus
catagcaactctcaggatacccagg

SEQ ID NO: 237085 - DNA, 25 bp, Rattus norvegicus
catagcaactctgaggatacccagg

SEQ ID NO: 237086 - DNA, 25 bp, Rattus norvegicus
catagcaagaacagttgtgaagaca

SEQ ID NO: 237087 - DNA, 25 bp, Rattus norvegicus
catagcaagaactgttgtgaagaca

SEQ ID NO: 237088 - DNA, 25 bp, Rattus norvegicus
catagcacctgcctgttgattagat

SEQ ID NO: 237089 - DNA, 25 bp, Rattus norvegicus
catagcacctgcgtgttgattagat

SEQ ID NO: 237090 - DNA, 25 bp, Rattus norvegicus
catagcactaaaacagatggttcaa

SEQ ID NO: 237091 - DNA, 25 bp, Rattus norvegicus
catagcactaaatcagatggttcaa

SEQ ID NO: 237092 - DNA, 25 bp, Rattus norvegicus
catagcactgtacggctgtctttct

SEQ ID NO: 237093 - DNA, 25 bp, Rattus norvegicus
catagcactgtagggctgtctttct

SEQ ID NO: 237094 - DNA, 25 bp, Rattus norvegicus
catagcagacttccagtgcgtcctg

SEQ ID NO: 237095 - DNA, 25 bp, Rattus norvegicus
catagcagacttgcagtgcgtcctg

SEQ ID NO: 237096 - DNA, 25 bp, Rattus norvegicus
catagcattgggagtaaggacatca

SEQ ID NO: 237097 - DNA, 25 bp, Rattus norvegicus
catagcattgggtgtaaggacatca

SEQ ID NO: 237098 - DNA, 25 bp, Rattus norvegicus
catagccagcacattcctatagctt

SEQ ID NO: 237099 - DNA, 25 bp, Rattus norvegicus
catagccagcactttcctatagctt

SEQ ID NO: 237100 - DNA, 25 bp, Rattus norvegicus
catagccatagccacagggtttcct

SEQ ID NO: 237101 - DNA, 25 bp, Rattus norvegicus
catagccatagcgacagggtttcct

SEQ ID NO: 237102 - DNA, 25 bp, Rattus norvegicus
catagccatgctcagagagccacac

SEQ ID NO: 237103 - DNA, 25 bp, Rattus norvegicus
catagccatgctgagagagccacac

SEQ ID NO: 237104 - DNA, 25 bp, Rattus norvegicus
catagccattgaaaagtcttgcgga

SEQ ID NO: 237105 - DNA, 25 bp, Rattus norvegicus
catagccattgataagtcttgcgga

SEQ ID NO: 237106 - DNA, 25 bp, Rattus norvegicus
catagcccagctcactttaagaaat

SEQ ID NO: 237107 - DNA, 25 bp, Rattus norvegicus
catagcccagctgactttaagaaat

SEQ ID NO: 237108 - DNA, 25 bp, Rattus norvegicus
catagccctgggaaaccttgtttga

SEQ ID NO: 237109 - DNA, 25 bp, Rattus norvegicus
catagccctgggaaagacatcttca

SEQ ID NO: 237110 - DNA, 25 bp, Rattus norvegicus
catagccctgggtaaccttgtttga

SEQ ID NO: 237111 - DNA, 25 bp, Rattus norvegicus
catagccctgggtaagacatcttca

SEQ ID NO: 237112 - DNA, 25 bp, Rattus norvegicus
catagcctagccacatccaaataag

SEQ ID NO: 237113 - DNA, 25 bp, Rattus norvegicus
catagcctagcctcatccaaataag

SEQ ID NO: 237114 - DNA, 25 bp, Rattus norvegicus
catagcctatttatcatctgatttg

SEQ ID NO: 237115 - DNA, 25 bp, Rattus norvegicus
catagcctatttttcatctgatttg

SEQ ID NO: 237116 - DNA, 25 bp, Rattus norvegicus
catagcctttccatttgtagcattg

SEQ ID NO: 237117 - DNA, 25 bp, Rattus norvegicus
catagcctttccttttgtagcattg

SEQ ID NO: 237118 - DNA, 25 bp, Rattus norvegicus
catagcgtcctcagttttctaagaa

SEQ ID NO: 237119 - DNA, 25 bp, Rattus norvegicus
catagcgtcctctgttttctaagaa

SEQ ID NO: 237120 - DNA, 25 bp, Rattus norvegicus
catagctactggattgtgggttttc

SEQ ID NO: 237121 - DNA, 25 bp, Rattus norvegicus
catagctactggtttgtgggttttc

SEQ ID NO: 237122 - DNA, 25 bp, Rattus norvegicus
catagctctgttctctcttcttttt

SEQ ID NO: 237123 - DNA, 25 bp, Rattus norvegicus
catagctctgttgtctcttcttttt

SEQ ID NO: 237124 - DNA, 25 bp, Rattus norvegicus
catagctgctctaaccactgaacca

SEQ ID NO: 237125 - DNA, 25 bp, Rattus norvegicus
catagctgctcttaccactgaacca

SEQ ID NO: 237126 - DNA, 25 bp, Rattus norvegicus
catagctgtacaaataacccctttc

SEQ ID NO: 237127 - DNA, 25 bp, Rattus norvegicus
catagctgtacatataacccctttc

SEQ ID NO: 237128 - DNA, 25 bp, Rattus norvegicus
catagcttcccaaaactcagacttg

SEQ ID NO: 237129 - DNA, 25 bp, Rattus norvegicus
catagcttcccataactcagacttg

SEQ ID NO: 237130 - DNA, 25 bp, Rattus norvegicus
catagcttcctgagctcaagtgaga

SEQ ID NO: 237131 - DNA, 25 bp, Rattus norvegicus
catagcttcctgtgctcaagtgaga

SEQ ID NO: 237132 - DNA, 25 bp, Rattus norvegicus
catagcttctcccttcataaacaag

SEQ ID NO: 237133 - DNA, 25 bp, Rattus norvegicus
catagcttctccgttcataaacaag

SEQ ID NO: 237134 - DNA, 25 bp, Rattus norvegicus
catagcttgatgaatgctgcaggct

SEQ ID NO: 237135 - DNA, 25 bp, Rattus norvegicus
catagcttgatgtatgctgcaggct

SEQ ID NO: 237136 - DNA, 25 bp, Rattus norvegicus
catagctttaataccatccgtttcc

SEQ ID NO: 237137 - DNA, 25 bp, Rattus norvegicus
catagctttaattccatccgtttcc

SEQ ID NO: 237138 - DNA, 25 bp, Rattus norvegicus
catagctttgatcatctgcccacaa

SEQ ID NO: 237139 - DNA, 25 bp, Rattus norvegicus
catagctttgatgatctgcccacaa

SEQ ID NO: 237140 - DNA, 25 bp, Rattus norvegicus
catagcttttctatgcacacagtct

SEQ ID NO: 237141 - DNA, 25 bp, Rattus norvegicus
catagcttttctttgcacacagtct

SEQ ID NO: 237142 - DNA, 25 bp, Rattus norvegicus
cataggaactgcactgtgaacttgc

SEQ ID NO: 237143 - DNA, 25 bp, Rattus norvegicus
cataggaactgctctgtgaacttgc

SEQ ID NO: 237144 - DNA, 25 bp, Rattus norvegicus
cataggaatcacaaggagggctgga

SEQ ID NO: 237145 - DNA, 25 bp, Rattus norvegicus
cataggaatcactaggagggctgga

SEQ ID NO: 237146 - DNA, 25 bp, Rattus norvegicus
cataggaccgctcgtagagtttgga

SEQ ID NO: 237147 - DNA, 25 bp, Rattus norvegicus
cataggaccgctggtagagtttgga

SEQ ID NO: 237148 - DNA, 25 bp, Rattus norvegicus
cataggacttacagcctcaggcatg

SEQ ID NO: 237149 - DNA, 25 bp, Rattus norvegicus
cataggacttactgcctcaggcatg

SEQ ID NO: 237150 - DNA, 25 bp, Rattus norvegicus
cataggatgatcatggagctcgtag

SEQ ID NO: 237151 - DNA, 25 bp, Rattus norvegicus
cataggatgatcttggagctcgtag

SEQ ID NO: 237152 - DNA, 25 bp, Rattus norvegicus
cataggatttgaatgcactctgaat

SEQ ID NO: 237153 - DNA, 25 bp, Rattus norvegicus
cataggatttgattgcactctgaat

SEQ ID NO: 237154 - DNA, 25 bp, Rattus norvegicus
cataggcaagttacctcttgatgat

SEQ ID NO: 237155 - DNA, 25 bp, Rattus norvegicus
cataggcaagtttcctcttgatgat

SEQ ID NO: 237156 - DNA, 25 bp, Rattus norvegicus
cataggcaatgcatacacttgtata

SEQ ID NO: 237157 - DNA, 25 bp, Rattus norvegicus
cataggcaatgcttacacttgtata

SEQ ID NO: 237158 - DNA, 25 bp, Rattus norvegicus
cataggcagtgcatctcgtgtagaa

SEQ ID NO: 237159 - DNA, 25 bp, Rattus norvegicus
cataggcagtgcttctcgtgtagaa

SEQ ID NO: 237160 - DNA, 25 bp, Rattus norvegicus
cataggcagtggatcttaggcaggt

SEQ ID NO: 237161 - DNA, 25 bp, Rattus norvegicus
cataggcagtggttcttaggcaggt

SEQ ID NO: 237162 - DNA, 25 bp, Rattus norvegicus
cataggccaggtcagcatttggaat

SEQ ID NO: 237163 - DNA, 25 bp, Rattus norvegicus
cataggccaggtgagcatttggaat

SEQ ID NO: 237164 - DNA, 25 bp, Rattus norvegicus
cataggcctagtcggtgcatctgca

SEQ ID NO: 237165 - DNA, 25 bp, Rattus norvegicus
cataggcctagtgggtgcatctgca

SEQ ID NO: 237166 - DNA, 25 bp, Rattus norvegicus
cataggcctcctattacacattaag

SEQ ID NO: 237167 - DNA, 25 bp, Rattus norvegicus
cataggcctccttttacacattaag

SEQ ID NO: 237168 - DNA, 25 bp, Rattus norvegicus
cataggctctacagtagtgcatccc

SEQ ID NO: 237169 - DNA, 25 bp, Rattus norvegicus
cataggctctactgtagtgcatccc

SEQ ID NO: 237170 - DNA, 25 bp, Rattus norvegicus
cataggctgtgaccacaagggagca

SEQ ID NO: 237171 - DNA, 25 bp, Rattus norvegicus
cataggctgtgagcacaagggagca

SEQ ID NO: 237172 - DNA, 25 bp, Rattus norvegicus
cataggcttatcatgtacttgggag

SEQ ID NO: 237173 - DNA, 25 bp, Rattus norvegicus
cataggcttatcttgtacttgggag

SEQ ID NO: 237174 - DNA, 25 bp, Rattus norvegicus
cataggcttctcaggttttagtgtc

SEQ ID NO: 237175 - DNA, 25 bp, Rattus norvegicus
cataggcttctctggttttagtgtc

SEQ ID NO: 237176 - DNA, 25 bp, Rattus norvegicus
cataggcttctgaatgtgcaggcaa

SEQ ID NO: 237177 - DNA, 25 bp, Rattus norvegicus
cataggcttctgtatgtgcaggcaa

SEQ ID NO: 237178 - DNA, 25 bp, Rattus norvegicus
cataggctttatagtcatgttatca

SEQ ID NO: 237179 - DNA, 25 bp, Rattus norvegicus
cataggctttattgtcatgttatca

SEQ ID NO: 237180 - DNA, 25 bp, Rattus norvegicus
catagggcttgcctggcacatgtaa

SEQ ID NO: 237181 - DNA, 25 bp, Rattus norvegicus
catagggcttgcgtggcacatgtaa

SEQ ID NO: 237182 - DNA, 25 bp, Rattus norvegicus
catagggtgattagtatttgcttac

SEQ ID NO: 237183 - DNA, 25 bp, Rattus norvegicus
catagggtgatttgtatttgcttac

SEQ ID NO: 237184 - DNA, 25 bp, Rattus norvegicus
cataggtaacctatagattgggaaa

SEQ ID NO: 237185 - DNA, 25 bp, Rattus norvegicus
cataggtaacctttagattgggaaa

SEQ ID NO: 237186 - DNA, 25 bp, Rattus norvegicus
cataggtagctccaggaaccccaaa

SEQ ID NO: 237187 - DNA, 25 bp, Rattus norvegicus
cataggtagctcgaggaaccccaaa

SEQ ID NO: 237188 - DNA, 25 bp, Rattus norvegicus
cataggtatcatatagcagtcactg

SEQ ID NO: 237189 - DNA, 25 bp, Rattus norvegicus
cataggtatcatttagcagtcactg

SEQ ID NO: 237190 - DNA, 25 bp, Rattus norvegicus
cataggtattttagtgtctttcttt

SEQ ID NO: 237191 - DNA, 25 bp, Rattus norvegicus
cataggtatttttgtgtctttcttt

SEQ ID NO: 237192 - DNA, 25 bp, Rattus norvegicus
cataggtcagagatccaaggacaca

SEQ ID NO: 237193 - DNA, 25 bp, Rattus norvegicus
cataggtcagagttccaaggacaca

SEQ ID NO: 237194 - DNA, 25 bp, Rattus norvegicus
cataggtgcaggatggttttgatac

SEQ ID NO: 237195 - DNA, 25 bp, Rattus norvegicus
cataggtgcaggttggttttgatac

SEQ ID NO: 237196 - DNA, 25 bp, Rattus norvegicus
cataggtgtctaaaggtgtcaggaa

SEQ ID NO: 237197 - DNA, 25 bp, Rattus norvegicus
cataggtgtctataggtgtcaggaa

SEQ ID NO: 237198 - DNA, 25 bp, Rattus norvegicus
cataggttactactttggccacttc

SEQ ID NO: 237199 - DNA, 25 bp, Rattus norvegicus
cataggttactagtttggccacttc

SEQ ID NO: 237200 - DNA, 25 bp, Rattus norvegicus
cataggttatctcgccacttaatgg

SEQ ID NO: 237201 - DNA, 25 bp, Rattus norvegicus
cataggttatctggccacttaatgg

SEQ ID NO: 237202 - DNA, 25 bp, Rattus norvegicus
cataggttgagccagcctgttttat

SEQ ID NO: 237203 - DNA, 25 bp, Rattus norvegicus
cataggttgagcgagcctgttttat

SEQ ID NO: 237204 - DNA, 25 bp, Rattus norvegicus
cataggtttaagactaaactgggct

SEQ ID NO: 237205 - DNA, 25 bp, Rattus norvegicus
cataggtttaagtctaaactgggct

SEQ ID NO: 237206 - DNA, 25 bp, Rattus norvegicus
cataggttttgtcgtcgggcagact

SEQ ID NO: 237207 - DNA, 25 bp, Rattus norvegicus
cataggttttgtggtcgggcagact

SEQ ID NO: 237208 - DNA, 25 bp, Rattus norvegicus
catagtaagcaccaggacagcctgt

SEQ ID NO: 237209 - DNA, 25 bp, Rattus norvegicus
catagtaagcacgaggacagcctgt

SEQ ID NO: 237210 - DNA, 25 bp, Rattus norvegicus
catagtaatggcactgggtcccttt

SEQ ID NO: 237211 - DNA, 25 bp, Rattus norvegicus
catagtaatggctctgggtcccttt

SEQ ID NO: 237212 - DNA, 25 bp, Rattus norvegicus
catagtacctgtagggcattttggt

SEQ ID NO: 237213 - DNA, 25 bp, Rattus norvegicus
catagtacctgttgggcattttggt

SEQ ID NO: 237214 - DNA, 25 bp, Rattus norvegicus
catagtagagatccccaagaacctg

SEQ ID NO: 237215 - DNA, 25 bp, Rattus norvegicus
catagtagagatgcccaagaacctg

SEQ ID NO: 237216 - DNA, 25 bp, Rattus norvegicus
catagtatgtttaatttcctgaggg

SEQ ID NO: 237217 - DNA, 25 bp, Rattus norvegicus
catagtatgttttatttcctgaggg

SEQ ID NO: 237218 - DNA, 25 bp, Rattus norvegicus
catagtattacaaccatgactgttg

SEQ ID NO: 237219 - DNA, 25 bp, Rattus norvegicus
catagtattacatccatgactgttg

SEQ ID NO: 237220 - DNA, 25 bp, Rattus norvegicus
catagtcaagaacgaacacttaggt

SEQ ID NO: 237221 - DNA, 25 bp, Rattus norvegicus
catagtcaagaaggaacacttaggt

SEQ ID NO: 237222 - DNA, 25 bp, Rattus norvegicus
catagtcaagttcctttgtggcaaa

SEQ ID NO: 237223 - DNA, 25 bp, Rattus norvegicus
catagtcaagttgctttgtggcaaa

SEQ ID NO: 237224 - DNA, 25 bp, Rattus norvegicus
catagtcatgtgacagattagctta

SEQ ID NO: 237225 - DNA, 25 bp, Rattus norvegicus
catagtcatgtgtcagattagctta

SEQ ID NO: 237226 - DNA, 25 bp, Rattus norvegicus
catagtcatttaacctgatgctgaa

SEQ ID NO: 237227 - DNA, 25 bp, Rattus norvegicus
catagtcatttatcctgatgctgaa

SEQ ID NO: 237228 - DNA, 25 bp, Rattus norvegicus
catagtctagttcccagtacatggc

SEQ ID NO: 237229 - DNA, 25 bp, Rattus norvegicus
catagtctagttgccagtacatggc

SEQ ID NO: 237230 - DNA, 25 bp, Rattus norvegicus
catagtctccatacctacagatgta

SEQ ID NO: 237231 - DNA, 25 bp, Rattus norvegicus
catagtctccattcctacagatgta

SEQ ID NO: 237232 - DNA, 25 bp, Rattus norvegicus
catagtgaaacaccgccctttggta

SEQ ID NO: 237233 - DNA, 25 bp, Rattus norvegicus
catagtgaaacagcgccctttggta

SEQ ID NO: 237234 - DNA, 25 bp, Rattus norvegicus
catagtgaatctcgtggtggcgctt

SEQ ID NO: 237235 - DNA, 25 bp, Rattus norvegicus
catagtgaatctggtggtggcgctt

SEQ ID NO: 237236 - DNA, 25 bp, Rattus norvegicus
catagtgagatgctgtcttccccaa

SEQ ID NO: 237237 - DNA, 25 bp, Rattus norvegicus
catagtgagatggtgtcttccccaa

SEQ ID NO: 237238 - DNA, 25 bp, Rattus norvegicus
catagtgagcacattccagggccct

SEQ ID NO: 237239 - DNA, 25 bp, Rattus norvegicus
catagtgagcactttccagggccct

SEQ ID NO: 237240 - DNA, 25 bp, Rattus norvegicus
catagtgagtttaacaccggcctga

SEQ ID NO: 237241 - DNA, 25 bp, Rattus norvegicus
catagtgagttttacaccggcctga

SEQ ID NO: 237242 - DNA, 25 bp, Rattus norvegicus
catagtgcacttcgaaaaagctggt

SEQ ID NO: 237243 - DNA, 25 bp, Rattus norvegicus
catagtgcacttggaaaaagctggt

SEQ ID NO: 237244 - DNA, 25 bp, Rattus norvegicus
catagtgcatatctatagccctggc

SEQ ID NO: 237245 - DNA, 25 bp, Rattus norvegicus
catagtgcatatgtatagccctggc

SEQ ID NO: 237246 - DNA, 25 bp, Rattus norvegicus
catagtgcatggagtgtggtgcccc

SEQ ID NO: 237247 - DNA, 25 bp, Rattus norvegicus
catagtgcatggtgtgtggtgcccc

SEQ ID NO: 237248 - DNA, 25 bp, Rattus norvegicus
catagtgcctacatctgtccttttt

SEQ ID NO: 237249 - DNA, 25 bp, Rattus norvegicus
catagtgcctacttctgtccttttt

SEQ ID NO: 237250 - DNA, 25 bp, Rattus norvegicus
catagtgcttgtaaatagattcaga

SEQ ID NO: 237251 - DNA, 25 bp, Rattus norvegicus
catagtgcttgttaatagattcaga

SEQ ID NO: 237252 - DNA, 25 bp, Rattus norvegicus
catagtgctttgatttcacaccaaa

SEQ ID NO: 237253 - DNA, 25 bp, Rattus norvegicus
catagtgctttgttttcacaccaaa

SEQ ID NO: 237254 - DNA, 25 bp, Rattus norvegicus
catagtggccagagaggacctcaga

SEQ ID NO: 237255 - DNA, 25 bp, Rattus norvegicus
catagtggccagtgaggacctcaga

SEQ ID NO: 237256 - DNA, 25 bp, Rattus norvegicus
catagtgggaacattctccgtttct

SEQ ID NO: 237257 - DNA, 25 bp, Rattus norvegicus
catagtgggaactttctccgtttct

SEQ ID NO: 237258 - DNA, 25 bp, Rattus norvegicus
catagtgggtcgacttgtgtgtctg

SEQ ID NO: 237259 - DNA, 25 bp, Rattus norvegicus
catagtgggtcgtcttgtgtgtctg

SEQ ID NO: 237260 - DNA, 25 bp, Rattus norvegicus
catagtgggttgaggaatgcacctt

SEQ ID NO: 237261 - DNA, 25 bp, Rattus norvegicus
catagtgggttgtggaatgcacctt

SEQ ID NO: 237262 - DNA, 25 bp, Rattus norvegicus
catagtgtggatcactgcctaagtc

SEQ ID NO: 237263 - DNA, 25 bp, Rattus norvegicus
catagtgtggatgactgcctaagtc

SEQ ID NO: 237264 - DNA, 25 bp, Rattus norvegicus
catagtgtgggcctgtgctttgaca

SEQ ID NO: 237265 - DNA, 25 bp, Rattus norvegicus
catagtgtgggcgtgtgctttgaca

SEQ ID NO: 237266 - DNA, 25 bp, Rattus norvegicus
catagtgttcataacctgagctcat

SEQ ID NO: 237267 - DNA, 25 bp, Rattus norvegicus
catagtgttcattacctgagctcat

SEQ ID NO: 237268 - DNA, 25 bp, Rattus norvegicus
catagtgttttgattccgggacaag

SEQ ID NO: 237269 - DNA, 25 bp, Rattus norvegicus
catagtgttttgtttccgggacaag

SEQ ID NO: 237270 - DNA, 25 bp, Rattus norvegicus
catagttacatacggcttttcagaa

SEQ ID NO: 237271 - DNA, 25 bp, Rattus norvegicus
catagttacatagggcttttcagaa

SEQ ID NO: 237272 - DNA, 25 bp, Rattus norvegicus
catagttcagaaattagtgtctcca

SEQ ID NO: 237273 - DNA, 25 bp, Rattus norvegicus
catagttcagaatttagtgtctcca

SEQ ID NO: 237274 - DNA, 25 bp, Rattus norvegicus
catagttccttactttgtcctttca

SEQ ID NO: 237275 - DNA, 25 bp, Rattus norvegicus
catagttccttagtttgtcctttca

SEQ ID NO: 237276 - DNA, 25 bp, Rattus norvegicus
catagttctctcagcatttcctttt

SEQ ID NO: 237277 - DNA, 25 bp, Rattus norvegicus
catagttctctctgcatttcctttt

SEQ ID NO: 237278 - DNA, 25 bp, Rattus norvegicus
catagttctgtgctagccattgttt

SEQ ID NO: 237279 - DNA, 25 bp, Rattus norvegicus
catagttctgtggtagccattgttt

SEQ ID NO: 237280 - DNA, 25 bp, Rattus norvegicus
catagttcttcacgcaggtcacggt

SEQ ID NO: 237281 - DNA, 25 bp, Rattus norvegicus
catagttcttcaggcaggtcacggt

SEQ ID NO: 237282 - DNA, 25 bp, Rattus norvegicus
catagttctttgacaattccttaat

SEQ ID NO: 237283 - DNA, 25 bp, Rattus norvegicus
catagttctttgtcaattccttaat

SEQ ID NO: 237284 - DNA, 25 bp, Rattus norvegicus
catagttgtctgagccgaagtgtct

SEQ ID NO: 237285 - DNA, 25 bp, Rattus norvegicus
catagttgtctgtgccgaagtgtct

SEQ ID NO: 237286 - DNA, 25 bp, Rattus norvegicus
catagtttaatcaaaaggttggctt

SEQ ID NO: 237287 - DNA, 25 bp, Rattus norvegicus
catagtttaatctaaaggttggctt

SEQ ID NO: 237288 - DNA, 25 bp, Rattus norvegicus
catagttttatgacccattggatta

SEQ ID NO: 237289 - DNA, 25 bp, Rattus norvegicus
catagttttatgtcccattggatta

SEQ ID NO: 237290 - DNA, 25 bp, Rattus norvegicus
catagtttttccctccgaattcttg

SEQ ID NO: 237291 - DNA, 25 bp, Rattus norvegicus
catagtttttccgtccgaattcttg

SEQ ID NO: 237292 - DNA, 25 bp, Rattus norvegicus
catataacccggaatgcttttactt

SEQ ID NO: 237293 - DNA, 25 bp, Rattus norvegicus
catataacccggtatgcttttactt

SEQ ID NO: 237294 - DNA, 25 bp, Rattus norvegicus
catatacatagcagattccttccct

SEQ ID NO: 237295 - DNA, 25 bp, Rattus norvegicus
catatacatagctgattccttccct

SEQ ID NO: 237296 - DNA, 25 bp, Rattus norvegicus
catataccgctgctgcactgatatg

SEQ ID NO: 237297 - DNA, 25 bp, Rattus norvegicus
catataccgctggtgcactgatatg

SEQ ID NO: 237298 - DNA, 25 bp, Rattus norvegicus
catatactcactcttttcttacctg

SEQ ID NO: 237299 - DNA, 25 bp, Rattus norvegicus
catatactcactgttttcttacctg

SEQ ID NO: 237300 - DNA, 25 bp, Rattus norvegicus
catatagccccacattcaattcgtg

SEQ ID NO: 237301 - DNA, 25 bp, Rattus norvegicus
catatagccccagattcaattcgtg

SEQ ID NO: 237302 - DNA, 25 bp, Rattus norvegicus
catatagtgtgtctgcagtttgtac

SEQ ID NO: 237303 - DNA, 25 bp, Rattus norvegicus
catatagtgtgtgtgcagtttgtac

SEQ ID NO: 237304 - DNA, 25 bp, Rattus norvegicus
catatatctgtcagtggttgtataa

SEQ ID NO: 237305 - DNA, 25 bp, Rattus norvegicus
catatatctgtctgtggttgtataa

SEQ ID NO: 237306 - DNA, 25 bp, Rattus norvegicus
catatatctgtgatcttggagccga

SEQ ID NO: 237307 - DNA, 25 bp, Rattus norvegicus
catatatctgtgttcttggagccga

SEQ ID NO: 237308 - DNA, 25 bp, Rattus norvegicus
catatatgcctgagcatgtgtgcat

SEQ ID NO: 237309 - DNA, 25 bp, Rattus norvegicus
catatatgcctgtgcatgtgtgcat

SEQ ID NO: 237310 - DNA, 25 bp, Rattus norvegicus
catatatgtctgagcaccgtgtgca

SEQ ID NO: 237311 - DNA, 25 bp, Rattus norvegicus
catatatgtctgtgcaccgtgtgca

SEQ ID NO: 237312 - DNA, 25 bp, Rattus norvegicus
catatattcttaacgacccgtttga

SEQ ID NO: 237313 - DNA, 25 bp, Rattus norvegicus
catatattcttatcgacccgtttga

SEQ ID NO: 237314 - DNA, 25 bp, Rattus norvegicus
catatatttttgactctgtggccta

SEQ ID NO: 237315 - DNA, 25 bp, Rattus norvegicus
catatatttttgtctctgtggccta

SEQ ID NO: 237316 - DNA, 25 bp, Rattus norvegicus
catatcacacgtcgccttgtctaga

SEQ ID NO: 237317 - DNA, 25 bp, Rattus norvegicus
catatcacacgtggccttgtctaga

SEQ ID NO: 237318 - DNA, 25 bp, Rattus norvegicus
catatcatgccacctcctaaaaata

SEQ ID NO: 237319 - DNA, 25 bp, Rattus norvegicus
catatcatgccagctcctaaaaata

SEQ ID NO: 237320 - DNA, 25 bp, Rattus norvegicus
catatccaccacactgtgacattaa

SEQ ID NO: 237321 - DNA, 25 bp, Rattus norvegicus
catatccaccactctgtgacattaa

SEQ ID NO: 237322 - DNA, 25 bp, Rattus norvegicus
catatccatggtactctggctagaa

SEQ ID NO: 237323 - DNA, 25 bp, Rattus norvegicus
catatccatggttctctggctagaa

SEQ ID NO: 237324 - DNA, 25 bp, Rattus norvegicus
catatcctctagaggtggcaaccca

SEQ ID NO: 237325 - DNA, 25 bp, Rattus norvegicus
catatcctctagtggtggcaaccca

SEQ ID NO: 237326 - DNA, 25 bp, Rattus norvegicus
catatcctgccaatatgccgaaagg

SEQ ID NO: 237327 - DNA, 25 bp, Rattus norvegicus
catatcctgccattatgccgaaagg

SEQ ID NO: 237328 - DNA, 25 bp, Rattus norvegicus
catatcctgtgaaatgtgctgtcat

SEQ ID NO: 237329 - DNA, 25 bp, Rattus norvegicus
catatcctgtgatatgtgctgtcat

SEQ ID NO: 237330 - DNA, 25 bp, Rattus norvegicus
catatccttataatctacgccatta

SEQ ID NO: 237331 - DNA, 25 bp, Rattus norvegicus
catatccttatattctacgccatta

SEQ ID NO: 237332 - DNA, 25 bp, Rattus norvegicus
catatccttctgctgaggcatggga

SEQ ID NO: 237333 - DNA, 25 bp, Rattus norvegicus
catatccttctggtgaggcatggga

SEQ ID NO: 237334 - DNA, 25 bp, Rattus norvegicus
catatccttgatacgggtgtctgac

SEQ ID NO: 237335 - DNA, 25 bp, Rattus norvegicus
catatccttgattcgggtgtctgac

SEQ ID NO: 237336 - DNA, 25 bp, Rattus norvegicus
catatcctttatcaatgcttaccag

SEQ ID NO: 237337 - DNA, 25 bp, Rattus norvegicus
catatcctttatgaatgcttaccag

SEQ ID NO: 237338 - DNA, 25 bp, Rattus norvegicus
catatctagttgcatggtagccatc

SEQ ID NO: 237339 - DNA, 25 bp, Rattus norvegicus
catatctagttggatggtagccatc

SEQ ID NO: 237340 - DNA, 25 bp, Rattus norvegicus
catatctgggcccaagttatcaatt

SEQ ID NO: 237341 - DNA, 25 bp, Rattus norvegicus
catatctgggccgaagttatcaatt

SEQ ID NO: 237342 - DNA, 25 bp, Rattus norvegicus
catatcttcatcagggaccggcaca

SEQ ID NO: 237343 - DNA, 25 bp, Rattus norvegicus
catatcttcatctgggaccggcaca

SEQ ID NO: 237344 - DNA, 25 bp, Rattus norvegicus
catatcttgtacattcatagggcat

SEQ ID NO: 237345 - DNA, 25 bp, Rattus norvegicus
catatcttgtactttcatagggcat

SEQ ID NO: 237346 - DNA, 25 bp, Rattus norvegicus
catatcttgtttacctcgtcctaaa

SEQ ID NO: 237347 - DNA, 25 bp, Rattus norvegicus
catatcttgttttcctcgtcctaaa

SEQ ID NO: 237348 - DNA, 25 bp, Rattus norvegicus
catatctttctcatgaattctgttt

SEQ ID NO: 237349 - DNA, 25 bp, Rattus norvegicus
catatctttctcttgaattctgttt

SEQ ID NO: 237350 - DNA, 25 bp, Rattus norvegicus
catatgaacgttccagaggtggtaa

SEQ ID NO: 237351 - DNA, 25 bp, Rattus norvegicus
catatgaacgttgcagaggtggtaa

SEQ ID NO: 237352 - DNA, 25 bp, Rattus norvegicus
catatgacatttcaacatcctttaa

SEQ ID NO: 237353 - DNA, 25 bp, Rattus norvegicus
catatgacatttgaacatcctttaa

SEQ ID NO: 237354 - DNA, 25 bp, Rattus norvegicus
catatgaccttgatgcttggagcat

SEQ ID NO: 237355 - DNA, 25 bp, Rattus norvegicus
catatgaccttgttgcttggagcat

SEQ ID NO: 237356 - DNA, 25 bp, Rattus norvegicus
catatgaggtggactttgaagactt

SEQ ID NO: 237357 - DNA, 25 bp, Rattus norvegicus
catatgaggtggtctttgaagactt

SEQ ID NO: 237358 - DNA, 25 bp, Rattus norvegicus
catatgatacatatccctgccaatt

SEQ ID NO: 237359 - DNA, 25 bp, Rattus norvegicus
catatgatacatttccctgccaatt

SEQ ID NO: 237360 - DNA, 25 bp, Rattus norvegicus
catatgatgcttacttttgccttgt

SEQ ID NO: 237361 - DNA, 25 bp, Rattus norvegicus
catatgatgctttcttttgccttgt

SEQ ID NO: 237362 - DNA, 25 bp, Rattus norvegicus
catatgattgttacagtttgtgcag

SEQ ID NO: 237363 - DNA, 25 bp, Rattus norvegicus
catatgattgtttcagtttgtgcag

SEQ ID NO: 237364 - DNA, 25 bp, Rattus norvegicus
catatgatttgtacttctgctgaga

SEQ ID NO: 237365 - DNA, 25 bp, Rattus norvegicus
catatgatttgttcttctgctgaga

SEQ ID NO: 237366 - DNA, 25 bp, Rattus norvegicus
catatgcagtttctagtctcagtaa

SEQ ID NO: 237367 - DNA, 25 bp, Rattus norvegicus
catatgcagtttgtagtctcagtaa

SEQ ID NO: 237368 - DNA, 25 bp, Rattus norvegicus
catatgcatgtactagcctcaaatt

SEQ ID NO: 237369 - DNA, 25 bp, Rattus norvegicus
catatgcatgtagtagcctcaaatt

SEQ ID NO: 237370 - DNA, 25 bp, Rattus norvegicus
catatgcattgcctggctgttctgt

SEQ ID NO: 237371 - DNA, 25 bp, Rattus norvegicus
catatgcattgcgtggctgttctgt

SEQ ID NO: 237372 - DNA, 25 bp, Rattus norvegicus
catatgcattgtagtggtccaggaa

SEQ ID NO: 237373 - DNA, 25 bp, Rattus norvegicus
catatgcattgttgtggtccaggaa

SEQ ID NO: 237374 - DNA, 25 bp, Rattus norvegicus
catatgcccagtctgatctggagca

SEQ ID NO: 237375 - DNA, 25 bp, Rattus norvegicus
catatgcccagtgtgatctggagca

SEQ ID NO: 237376 - DNA, 25 bp, Rattus norvegicus
catatgcctgctaggctgtggcatt

SEQ ID NO: 237377 - DNA, 25 bp, Rattus norvegicus
catatgcctgcttggctgtggcatt

SEQ ID NO: 237378 - DNA, 25 bp, Rattus norvegicus
catatgcctggcagcagagtatttt

SEQ ID NO: 237379 - DNA, 25 bp, Rattus norvegicus
catatgcctggctgcagagtatttt

SEQ ID NO: 237380 - DNA, 25 bp, Rattus norvegicus
catatgcgtgctacttgtaactttt

SEQ ID NO: 237381 - DNA, 25 bp, Rattus norvegicus
catatgcgtgcttcttgtaactttt

SEQ ID NO: 237382 - DNA, 25 bp, Rattus norvegicus
catatgcttcctattaacttgcttt

SEQ ID NO: 237383 - DNA, 25 bp, Rattus norvegicus
catatgcttccttttaacttgcttt

SEQ ID NO: 237384 - DNA, 25 bp, Rattus norvegicus
catatggacattactctggcagtga

SEQ ID NO: 237385 - DNA, 25 bp, Rattus norvegicus
catatggacatttctctggcagtga

SEQ ID NO: 237386 - DNA, 25 bp, Rattus norvegicus
catatggagctgcaacttgtggttg

SEQ ID NO: 237387 - DNA, 25 bp, Rattus norvegicus
catatggagctggaacttgtggttg

SEQ ID NO: 237388 - DNA, 25 bp, Rattus norvegicus
catatggcggagaccctgggtgctc

SEQ ID NO: 237389 - DNA, 25 bp, Rattus norvegicus
catatggcggagtccctgggtgctc

SEQ ID NO: 237390 - DNA, 25 bp, Rattus norvegicus
catatggtggctcatagctgtttgt

SEQ ID NO: 237391 - DNA, 25 bp, Rattus norvegicus
catatggtggctgatagctgtttgt

SEQ ID NO: 237392 - DNA, 25 bp, Rattus norvegicus
catatggttgacatgctacagctgt

SEQ ID NO: 237393 - DNA, 25 bp, Rattus norvegicus
catatggttgacttgctacagctgt

SEQ ID NO: 237394 - DNA, 25 bp, Rattus norvegicus
catatgtagaataagcaggtggctc

SEQ ID NO: 237395 - DNA, 25 bp, Rattus norvegicus
catatgtagaattagcaggtggctc

SEQ ID NO: 237396 - DNA, 25 bp, Rattus norvegicus
catatgtatggtattgaggcattaa

SEQ ID NO: 237397 - DNA, 25 bp, Rattus norvegicus
catatgtatggttttgaggcattaa

SEQ ID NO: 237398 - DNA, 25 bp, Rattus norvegicus
catatgtcataaattgttgctgctc

SEQ ID NO: 237399 - DNA, 25 bp, Rattus norvegicus
catatgtcataatttgttgctgctc

SEQ ID NO: 237400 - DNA, 25 bp, Rattus norvegicus
catatgtccccacccaagtattatt

SEQ ID NO: 237401 - DNA, 25 bp, Rattus norvegicus
catatgtccccagccaagtattatt

SEQ ID NO: 237402 - DNA, 25 bp, Rattus norvegicus
catatgtgctatcgcatttgtgccc

SEQ ID NO: 237403 - DNA, 25 bp, Rattus norvegicus
catatgtgctatggcatttgtgccc

SEQ ID NO: 237404 - DNA, 25 bp, Rattus norvegicus
catatgtggaaaagcctacatctca

SEQ ID NO: 237405 - DNA, 25 bp, Rattus norvegicus
catatgtggaaatgcctacatctca

SEQ ID NO: 237406 - DNA, 25 bp, Rattus norvegicus
catatgtgtcctcgattaatagagt

SEQ ID NO: 237407 - DNA, 25 bp, Rattus norvegicus
catatgtgtcctggattaatagagt

SEQ ID NO: 237408 - DNA, 25 bp, Rattus norvegicus
catatgtgtgtaaaggtgtcaggca

SEQ ID NO: 237409 - DNA, 25 bp, Rattus norvegicus
catatgtgtgtataggtgtcaggca

SEQ ID NO: 237410 - DNA, 25 bp, Rattus norvegicus
catatgtgtgtgattgctgttaatt

SEQ ID NO: 237411 - DNA, 25 bp, Rattus norvegicus
catatgtgtgtgtttgctgttaatt

SEQ ID NO: 237412 - DNA, 25 bp, Rattus norvegicus
catatgtgttcgacctggtgagaga

SEQ ID NO: 237413 - DNA, 25 bp, Rattus norvegicus
catatgtgttcgtcctggtgagaga

SEQ ID NO: 237414 - DNA, 25 bp, Rattus norvegicus
catatgttacatagtcccaccagga

SEQ ID NO: 237415 - DNA, 25 bp, Rattus norvegicus
catatgttacattgtcccaccagga

SEQ ID NO: 237416 - DNA, 25 bp, Rattus norvegicus
catatgttccccacagacatgcata

SEQ ID NO: 237417 - DNA, 25 bp, Rattus norvegicus
catatgttcccctcagacatgcata

SEQ ID NO: 237418 - DNA, 25 bp, Rattus norvegicus
catattaaagtacaggcctgggcct

SEQ ID NO: 237419 - DNA, 25 bp, Rattus norvegicus
catattaaagtagaggcctgggcct

SEQ ID NO: 237420 - DNA, 25 bp, Rattus norvegicus
catattaactatccactgtcaggtg

SEQ ID NO: 237421 - DNA, 25 bp, Rattus norvegicus
catattaactatgcactgtcaggtg

SEQ ID NO: 237422 - DNA, 25 bp, Rattus norvegicus
catattacctggcttctctaggttt

SEQ ID NO: 237423 - DNA, 25 bp, Rattus norvegicus
catattacctgggttctctaggttt

SEQ ID NO: 237424 - DNA, 25 bp, Rattus norvegicus
catattagcactctttccttcattt

SEQ ID NO: 237425 - DNA, 25 bp, Rattus norvegicus
catattagcactgtttccttcattt

SEQ ID NO: 237426 - DNA, 25 bp, Rattus norvegicus
catattcagtagagtcagccttgct

SEQ ID NO: 237427 - DNA, 25 bp, Rattus norvegicus
catattcagtagtgtcagccttgct

SEQ ID NO: 237428 - DNA, 25 bp, Rattus norvegicus
catattcagtcaatgtgggagcgct

SEQ ID NO: 237429 - DNA, 25 bp, Rattus norvegicus
catattcagtcattgtgggagcgct

SEQ ID NO: 237430 - DNA, 25 bp, Rattus norvegicus
catattcatttgaatccaaggtgct

SEQ ID NO: 237431 - DNA, 25 bp, Rattus norvegicus
catattcatttgtatccaaggtgct

SEQ ID NO: 237432 - DNA, 25 bp, Rattus norvegicus
catattccaattatttcaggtgtga

SEQ ID NO: 237433 - DNA, 25 bp, Rattus norvegicus
catattccaattttttcaggtgtga

SEQ ID NO: 237434 - DNA, 25 bp, Rattus norvegicus
catattccagagatagggtgggcca

SEQ ID NO: 237435 - DNA, 25 bp, Rattus norvegicus
catattccagagttagggtgggcca

SEQ ID NO: 237436 - DNA, 25 bp, Rattus norvegicus
catattccctaaccgctggtttata

SEQ ID NO: 237437 - DNA, 25 bp, Rattus norvegicus
catattccctaagcgctggtttata

SEQ ID NO: 237438 - DNA, 25 bp, Rattus norvegicus
catattcgattcagactggacgtaa

SEQ ID NO: 237439 - DNA, 25 bp, Rattus norvegicus
catattcgattctgactggacgtaa

SEQ ID NO: 237440 - DNA, 25 bp, Rattus norvegicus
catattcggcaaccggatcatccta

SEQ ID NO: 237441 - DNA, 25 bp, Rattus norvegicus
catattcggcaagcggatcatccta

SEQ ID NO: 237442 - DNA, 25 bp, Rattus norvegicus
catattctacccagtttctactaag

SEQ ID NO: 237443 - DNA, 25 bp, Rattus norvegicus
catattctaccctgtttctactaag

SEQ ID NO: 237444 - DNA, 25 bp, Rattus norvegicus
catattctcacgctcattggcagaa

SEQ ID NO: 237445 - DNA, 25 bp, Rattus norvegicus
catattctcacggtcattggcagaa

SEQ ID NO: 237446 - DNA, 25 bp, Rattus norvegicus
catattctctgtcccatgttcattc

SEQ ID NO: 237447 - DNA, 25 bp, Rattus norvegicus
catattctctgtgccatgttcattc

SEQ ID NO: 237448 - DNA, 25 bp, Rattus norvegicus
catattcttggtatctctccactaa

SEQ ID NO: 237449 - DNA, 25 bp, Rattus norvegicus
catattcttggtttctctccactaa

SEQ ID NO: 237450 - DNA, 25 bp, Rattus norvegicus
catattgagcccatgtatgtgccac

SEQ ID NO: 237451 - DNA, 25 bp, Rattus norvegicus
catattgagcccttgtatgtgccac

SEQ ID NO: 237452 - DNA, 25 bp, Rattus norvegicus
catattgagtagagatcgtttgaac

SEQ ID NO: 237453 - DNA, 25 bp, Rattus norvegicus
catattgagtagtgatcgtttgaac

SEQ ID NO: 237454 - DNA, 25 bp, Rattus norvegicus
catattgcggtgaatgtgggatttt

SEQ ID NO: 237455 - DNA, 25 bp, Rattus norvegicus
catattgcggtgtatgtgggatttt

SEQ ID NO: 237456 - DNA, 25 bp, Rattus norvegicus
catattggaaggactctactggaca

SEQ ID NO: 237457 - DNA, 25 bp, Rattus norvegicus
catattggaaggtctctactggaca

SEQ ID NO: 237458 - DNA, 25 bp, Rattus norvegicus
catattgggactatctcttgagaca

SEQ ID NO: 237459 - DNA, 25 bp, Rattus norvegicus
catattgggactttctcttgagaca

SEQ ID NO: 237460 - DNA, 25 bp, Rattus norvegicus
catattgggtaaatcttctagtggt

SEQ ID NO: 237461 - DNA, 25 bp, Rattus norvegicus
catattgggtaattcttctagtggt

SEQ ID NO: 237462 - DNA, 25 bp, Rattus norvegicus
catattggtcatccctatagaggat

SEQ ID NO: 237463 - DNA, 25 bp, Rattus norvegicus
catattggtcatgcctatagaggat

SEQ ID NO: 237464 - DNA, 25 bp, Rattus norvegicus
catattgtaagactgggctccacct

SEQ ID NO: 237465 - DNA, 25 bp, Rattus norvegicus
catattgtaagagtgggctccacct

SEQ ID NO: 237466 - DNA, 25 bp, Rattus norvegicus
catattgtcaacctgtttgctggaa

SEQ ID NO: 237467 - DNA, 25 bp, Rattus norvegicus
catattgtcaacgtgtttgctggaa

SEQ ID NO: 237468 - DNA, 25 bp, Rattus norvegicus
catattgttcacattacttttacga

SEQ ID NO: 237469 - DNA, 25 bp, Rattus norvegicus
catattgttcactttacttttacga

SEQ ID NO: 237470 - DNA, 25 bp, Rattus norvegicus
catatttaaactcgccatcctcaca

SEQ ID NO: 237471 - DNA, 25 bp, Rattus norvegicus
catatttaaactggccatcctcaca

SEQ ID NO: 237472 - DNA, 25 bp, Rattus norvegicus
catatttattatacacttgctccag

SEQ ID NO: 237473 - DNA, 25 bp, Rattus norvegicus
catatttattattcacttgctccag

SEQ ID NO: 237474 - DNA, 25 bp, Rattus norvegicus
catatttattgcattcctcaggaaa

SEQ ID NO: 237475 - DNA, 25 bp, Rattus norvegicus
catatttattgctttcctcaggaaa

SEQ ID NO: 237476 - DNA, 25 bp, Rattus norvegicus
catatttgcatgagcttcctaccca

SEQ ID NO: 237477 - DNA, 25 bp, Rattus norvegicus
catatttgcatgtgcttcctaccca

SEQ ID NO: 237478 - DNA, 25 bp, Rattus norvegicus
catatttgctgtcatgttctcccat

SEQ ID NO: 237479 - DNA, 25 bp, Rattus norvegicus
catatttgctgtgatgttctcccat

SEQ ID NO: 237480 - DNA, 25 bp, Rattus norvegicus
catatttgttatctgtggtggacta

SEQ ID NO: 237481 - DNA, 25 bp, Rattus norvegicus
catatttgttatgtgtggtggacta

SEQ ID NO: 237482 - DNA, 25 bp, Rattus norvegicus
catattttctaaagccagaggcctt

SEQ ID NO: 237483 - DNA, 25 bp, Rattus norvegicus
catattttctaatgccagaggcctt

SEQ ID NO: 237484 - DNA, 25 bp, Rattus norvegicus
catattttctatagtgtgcctttca

SEQ ID NO: 237485 - DNA, 25 bp, Rattus norvegicus
catattttctattgtgtgcctttca

SEQ ID NO: 237486 - DNA, 25 bp, Rattus norvegicus
catatttttactacgtcttgacaac

SEQ ID NO: 237487 - DNA, 25 bp, Rattus norvegicus
catatttttacttcgtcttgacaac

SEQ ID NO: 237488 - DNA, 25 bp, Rattus norvegicus
catatttttcatccatggtcatcgg

SEQ ID NO: 237489 - DNA, 25 bp, Rattus norvegicus
catatttttcatgcatggtcatcgg

SEQ ID NO: 237490 - DNA, 25 bp, Rattus norvegicus
catcaaaacttgacctgtacccagg

SEQ ID NO: 237491 - DNA, 25 bp, Rattus norvegicus
catcaaaacttgtcctgtacccagg

SEQ ID NO: 237492 - DNA, 25 bp, Rattus norvegicus
catcaaaatcatcgtggccctcggt

SEQ ID NO: 237493 - DNA, 25 bp, Rattus norvegicus
catcaaaatcatggtggccctcggt

SEQ ID NO: 237494 - DNA, 25 bp, Rattus norvegicus
catcaaaatgatcgcagggaccctc

SEQ ID NO: 237495 - DNA, 25 bp, Rattus norvegicus
catcaaaatgatggcagggaccctc

SEQ ID NO: 237496 - DNA, 25 bp, Rattus norvegicus
catcaaacgttccttctcagtggga

SEQ ID NO: 237497 - DNA, 25 bp, Rattus norvegicus
catcaaacgttcgttctcagtggga

SEQ ID NO: 237498 - DNA, 25 bp, Rattus norvegicus
catcaaagttttatcctccttctag

SEQ ID NO: 237499 - DNA, 25 bp, Rattus norvegicus
catcaaagttttttcctccttctag

SEQ ID NO: 237500 - DNA, 25 bp, Rattus norvegicus
catcaaatgtgtctttccctaaacc

SEQ ID NO: 237501 - DNA, 25 bp, Rattus norvegicus
catcaaatgtgtgtttccctaaacc

SEQ ID NO: 237502 - DNA, 25 bp, Rattus norvegicus
catcaaattttgaggtgtcctccct

SEQ ID NO: 237503 - DNA, 25 bp, Rattus norvegicus
catcaaattttgtggtgtcctccct

SEQ ID NO: 237504 - DNA, 25 bp, Rattus norvegicus
catcaacagcatcaagtccagatta

SEQ ID NO: 237505 - DNA, 25 bp, Rattus norvegicus
catcaacagcatgaagtccagatta

SEQ ID NO: 237506 - DNA, 25 bp, Rattus norvegicus
catcaacctcatagtactgtcacag

SEQ ID NO: 237507 - DNA, 25 bp, Rattus norvegicus
catcaacctcattgtactgtcacag

SEQ ID NO: 237508 - DNA, 25 bp, Rattus norvegicus
catcaacgggatcccacatttcata

SEQ ID NO: 237509 - DNA, 25 bp, Rattus norvegicus
catcaacgggatgccacatttcata

SEQ ID NO: 237510 - DNA, 25 bp, Rattus norvegicus
catcaactagttaggccctttgggc

SEQ ID NO: 237511 - DNA, 25 bp, Rattus norvegicus
catcaactagtttggccctttgggc

SEQ ID NO: 237512 - DNA, 25 bp, Rattus norvegicus
catcaactttcaccacacaacgtat

SEQ ID NO: 237513 - DNA, 25 bp, Rattus norvegicus
catcaactttcagcacacaacgtat

SEQ ID NO: 237514 - DNA, 25 bp, Rattus norvegicus
catcaacttttaatccaggagggca

SEQ ID NO: 237515 - DNA, 25 bp, Rattus norvegicus
catcaacttttattccaggagggca

SEQ ID NO: 237516 - DNA, 25 bp, Rattus norvegicus
catcaagaaaccacggtgggcgtgg

SEQ ID NO: 237517 - DNA, 25 bp, Rattus norvegicus
catcaagaaacctcggtgggcgtgg

SEQ ID NO: 237518 - DNA, 25 bp, Rattus norvegicus
catcaagacgggatggattcccttt

SEQ ID NO: 237519 - DNA, 25 bp, Rattus norvegicus
catcaagacgggttggattcccttt

SEQ ID NO: 237520 - DNA, 25 bp, Rattus norvegicus
catcaagacgttccaggacctgggt

SEQ ID NO: 237521 - DNA, 25 bp, Rattus norvegicus
catcaagacgttgcaggacctgggt

SEQ ID NO: 237522 - DNA, 25 bp, Rattus norvegicus
catcaagagggtagccaaggagcta

SEQ ID NO: 237523 - DNA, 25 bp, Rattus norvegicus
catcaagagggttgccaaggagcta

SEQ ID NO: 237524 - DNA, 25 bp, Rattus norvegicus
catcaagagtggcagggtgtcctcc

SEQ ID NO: 237525 - DNA, 25 bp, Rattus norvegicus
catcaagagtgggagggtgtcctcc

SEQ ID NO: 237526 - DNA, 25 bp, Rattus norvegicus
catcaagcccacatcccagtgaaag

SEQ ID NO: 237527 - DNA, 25 bp, Rattus norvegicus
catcaagcccacttcccagtgaaag

SEQ ID NO: 237528 - DNA, 25 bp, Rattus norvegicus
catcaaggagatcggcctctgagca

SEQ ID NO: 237529 - DNA, 25 bp, Rattus norvegicus
catcaaggagatgggcctctgagca

SEQ ID NO: 237530 - DNA, 25 bp, Rattus norvegicus
catcaaggagtgacgactcctcaga

SEQ ID NO: 237531 - DNA, 25 bp, Rattus norvegicus
catcaaggagtgtcgactcctcaga

SEQ ID NO: 237532 - DNA, 25 bp, Rattus norvegicus
catcaaggctaaacgtggcgggcaa

SEQ ID NO: 237533 - DNA, 25 bp, Rattus norvegicus
catcaaggctaatcgtggcgggcaa

SEQ ID NO: 237534 - DNA, 25 bp, Rattus norvegicus
catcaagtctccaggcccaggtggc

SEQ ID NO: 237535 - DNA, 25 bp, Rattus norvegicus
catcaagtctcctggcccaggtggc

SEQ ID NO: 237536 - DNA, 25 bp, Rattus norvegicus
catcaagtgaagctggacctccaat

SEQ ID NO: 237537 - DNA, 25 bp, Rattus norvegicus
catcaagtgaaggtggacctccaat

SEQ ID NO: 237538 - DNA, 25 bp, Rattus norvegicus
catcaagttgatatcattggtgcat

SEQ ID NO: 237539 - DNA, 25 bp, Rattus norvegicus
catcaagttgatttcattggtgcat

SEQ ID NO: 237540 - DNA, 25 bp, Rattus norvegicus
catcaatccgagactgggatgtgga

SEQ ID NO: 237541 - DNA, 25 bp, Rattus norvegicus
catcaatccgagtctgggatgtgga

SEQ ID NO: 237542 - DNA, 25 bp, Rattus norvegicus
catcaatggcctcgagagctcactg

SEQ ID NO: 237543 - DNA, 25 bp, Rattus norvegicus
catcaatggcctggagagctcactg

SEQ ID NO: 237544 - DNA, 25 bp, Rattus norvegicus
catcaatgtcttagagggcaataag

SEQ ID NO: 237545 - DNA, 25 bp, Rattus norvegicus
catcaatgtctttgagggcaataag

SEQ ID NO: 237546 - DNA, 25 bp, Rattus norvegicus
catcaattcagcaagatcggcctac

SEQ ID NO: 237547 - DNA, 25 bp, Rattus norvegicus
catcaattcagctagatcggcctac

SEQ ID NO: 237548 - DNA, 25 bp, Rattus norvegicus
catcaatttgctatctggcccttaa

SEQ ID NO: 237549 - DNA, 25 bp, Rattus norvegicus
catcaatttgctttctggcccttaa

SEQ ID NO: 237550 - DNA, 25 bp, Rattus norvegicus
catcaatttgtcactgaagtttctt

SEQ ID NO: 237551 - DNA, 25 bp, Rattus norvegicus
catcaatttgtctctgaagtttctt

SEQ ID NO: 237552 - DNA, 25 bp, Rattus norvegicus
catcacaaagtcagcccatagtcta

SEQ ID NO: 237553 - DNA, 25 bp, Rattus norvegicus
catcacaaagtctgcccatagtcta

SEQ ID NO: 237554 - DNA, 25 bp, Rattus norvegicus
catcacacaggtaaaggagcagtct

SEQ ID NO: 237555 - DNA, 25 bp, Rattus norvegicus
catcacacaggttaaggagcagtct

SEQ ID NO: 237556 - DNA, 25 bp, Rattus norvegicus
catcacacctggactttctctttaa

SEQ ID NO: 237557 - DNA, 25 bp, Rattus norvegicus
catcacacctggatccaaaatgaat

SEQ ID NO: 237558 - DNA, 25 bp, Rattus norvegicus
catcacacctggtctttctctttaa

SEQ ID NO: 237559 - DNA, 25 bp, Rattus norvegicus
catcacacctggttccaaaatgaat

SEQ ID NO: 237560 - DNA, 25 bp, Rattus norvegicus
catcacactgtacatgccatgggtt

SEQ ID NO: 237561 - DNA, 25 bp, Rattus norvegicus
catcacactgtagatgccatgggtt

SEQ ID NO: 237562 - DNA, 25 bp, Rattus norvegicus
catcacacttggctatttactatta

SEQ ID NO: 237563 - DNA, 25 bp, Rattus norvegicus
catcacacttgggtatttactatta

SEQ ID NO: 237564 - DNA, 25 bp, Rattus norvegicus
catcacactttcatgttgctgcaga

SEQ ID NO: 237565 - DNA, 25 bp, Rattus norvegicus
catcacactttcttgttgctgcaga

SEQ ID NO: 237566 - DNA, 25 bp, Rattus norvegicus
catcacagagaaagcggtgtttgaa

SEQ ID NO: 237567 - DNA, 25 bp, Rattus norvegicus
catcacagagaatgcggtgtttgaa

SEQ ID NO: 237568 - DNA, 25 bp, Rattus norvegicus
catcacagcatcatttattctggca

SEQ ID NO: 237569 - DNA, 25 bp, Rattus norvegicus
catcacagcatcttttattctggca

SEQ ID NO: 237570 - DNA, 25 bp, Rattus norvegicus
catcacagtggcctgggtatgtgct

SEQ ID NO: 237571 - DNA, 25 bp, Rattus norvegicus
catcacagtggcgtgggtatgtgct

SEQ ID NO: 237572 - DNA, 25 bp, Rattus norvegicus
catcaccaagctccgggcggcaaga

SEQ ID NO: 237573 - DNA, 25 bp, Rattus norvegicus
catcaccaagctgcgggcggcaaga

SEQ ID NO: 237574 - DNA, 25 bp, Rattus norvegicus
catcaccagtggaccaaagggcact

SEQ ID NO: 237575 - DNA, 25 bp, Rattus norvegicus
catcaccagtggtccaaagggcact

SEQ ID NO: 237576 - DNA, 25 bp, Rattus norvegicus
catcacccaggcagtaatctttatt

SEQ ID NO: 237577 - DNA, 25 bp, Rattus norvegicus
catcacccaggcagtggaggtacaa

SEQ ID NO: 237578 - DNA, 25 bp, Rattus norvegicus
catcacccaggctgtaatctttatt

SEQ ID NO: 237579 - DNA, 25 bp, Rattus norvegicus
catcacccaggctgtggaggtacaa

SEQ ID NO: 237580 - DNA, 25 bp, Rattus norvegicus
catcacccctagatctgttttacta

SEQ ID NO: 237581 - DNA, 25 bp, Rattus norvegicus
catcacccctagttctgttttacta

SEQ ID NO: 237582 - DNA, 25 bp, Rattus norvegicus
catcaccctgtgaatcaatctttta

SEQ ID NO: 237583 - DNA, 25 bp, Rattus norvegicus
catcaccctgtgtatcaatctttta

SEQ ID NO: 237584 - DNA, 25 bp, Rattus norvegicus
catcaccgcctcattgaaagggaga

SEQ ID NO: 237585 - DNA, 25 bp, Rattus norvegicus
catcaccgcctctttgaaagggaga

SEQ ID NO: 237586 - DNA, 25 bp, Rattus norvegicus
catcaccgctttaatggatcacaaa

SEQ ID NO: 237587 - DNA, 25 bp, Rattus norvegicus
catcaccgcttttatggatcacaaa

SEQ ID NO: 237588 - DNA, 25 bp, Rattus norvegicus
catcaccgttttacagcacagctga

SEQ ID NO: 237589 - DNA, 25 bp, Rattus norvegicus
catcaccgtttttcagcacagctga

SEQ ID NO: 237590 - DNA, 25 bp, Rattus norvegicus
catcacctgggaccgtagtggacag

SEQ ID NO: 237591 - DNA, 25 bp, Rattus norvegicus
catcacctgggagcgtagtggacag

SEQ ID NO: 237592 - DNA, 25 bp, Rattus norvegicus
catcaccttattaagcagccagcat

SEQ ID NO: 237593 - DNA, 25 bp, Rattus norvegicus
catcaccttatttagcagccagcat

SEQ ID NO: 237594 - DNA, 25 bp, Rattus norvegicus
catcacctttcaaaattccctttgc

SEQ ID NO: 237595 - DNA, 25 bp, Rattus norvegicus
catcacctttcataattccctttgc

SEQ ID NO: 237596 - DNA, 25 bp, Rattus norvegicus
catcacctttgcagacaaatcacca

SEQ ID NO: 237597 - DNA, 25 bp, Rattus norvegicus
catcacctttgctgacaaatcacca

SEQ ID NO: 237598 - DNA, 25 bp, Rattus norvegicus
catcacctttttcgcctatgcagga

SEQ ID NO: 237599 - DNA, 25 bp, Rattus norvegicus
catcacctttttggcctatgcagga

SEQ ID NO: 237600 - DNA, 25 bp, Rattus norvegicus
catcacgaccagaattgcgaaggct

SEQ ID NO: 237601 - DNA, 25 bp, Rattus norvegicus
catcacgaccagtattgcgaaggct

SEQ ID NO: 237602 - DNA, 25 bp, Rattus norvegicus
catcactctgaaccttgtcatcaag

SEQ ID NO: 237603 - DNA, 25 bp, Rattus norvegicus
catcactctgaagcttgtcatcaag

SEQ ID NO: 237604 - DNA, 25 bp, Rattus norvegicus
catcactgccttctttgtactggag

SEQ ID NO: 237605 - DNA, 25 bp, Rattus norvegicus
catcactgccttgtttgtactggag

SEQ ID NO: 237606 - DNA, 25 bp, Rattus norvegicus
catcactgctgaacttgggagccat

SEQ ID NO: 237607 - DNA, 25 bp, Rattus norvegicus
catcactgctgatcttgggagccat

SEQ ID NO: 237608 - DNA, 25 bp, Rattus norvegicus
catcactgtcgtaaggcaaggcttt

SEQ ID NO: 237609 - DNA, 25 bp, Rattus norvegicus
catcactgtcgttaggcaaggcttt

SEQ ID NO: 237610 - DNA, 25 bp, Rattus norvegicus
catcactgtgttcatttcctgggat

SEQ ID NO: 237611 - DNA, 25 bp, Rattus norvegicus
catcactgtgttgatttcctgggat

SEQ ID NO: 237612 - DNA, 25 bp, Rattus norvegicus
catcactgttgtctggagttgtcca

SEQ ID NO: 237613 - DNA, 25 bp, Rattus norvegicus
catcactgttgtgtggagttgtcca

SEQ ID NO: 237614 - DNA, 25 bp, Rattus norvegicus
catcacttcttcagcaatgtgcttt

SEQ ID NO: 237615 - DNA, 25 bp, Rattus norvegicus
catcacttcttctgcaatgtgcttt

SEQ ID NO: 237616 - DNA, 25 bp, Rattus norvegicus
catcactttaccacgatcgtcatta

SEQ ID NO: 237617 - DNA, 25 bp, Rattus norvegicus
catcactttacctcgatcgtcatta

SEQ ID NO: 237618 - DNA, 25 bp, Rattus norvegicus
catcactttcgtatgtgtggacata

SEQ ID NO: 237619 - DNA, 25 bp, Rattus norvegicus
catcactttcgtttgtgtggacata

SEQ ID NO: 237620 - DNA, 25 bp, Rattus norvegicus
catcagaaatgtcctgctggctttt

SEQ ID NO: 237621 - DNA, 25 bp, Rattus norvegicus
catcagaaatgtgctgctggctttt

SEQ ID NO: 237622 - DNA, 25 bp, Rattus norvegicus
catcagaatctgacggccaaaagcg

SEQ ID NO: 237623 - DNA, 25 bp, Rattus norvegicus
catcagaatctgtcggccaaaagcg

SEQ ID NO: 237624 - DNA, 25 bp, Rattus norvegicus
catcagacagctaaccttgggaata

SEQ ID NO: 237625 - DNA, 25 bp, Rattus norvegicus
catcagacagcttaccttgggaata

SEQ ID NO: 237626 - DNA, 25 bp, Rattus norvegicus
catcagacccagcaggaggcattga

SEQ ID NO: 237627 - DNA, 25 bp, Rattus norvegicus
catcagacccaggaggaggcattga

SEQ ID NO: 237628 - DNA, 25 bp, Rattus norvegicus
catcagactcggaggatggtcctga

SEQ ID NO: 237629 - DNA, 25 bp, Rattus norvegicus
catcagactcggtggatggtcctga

SEQ ID NO: 237630 - DNA, 25 bp, Rattus norvegicus
catcagactctacatgttcatccta

SEQ ID NO: 237631 - DNA, 25 bp, Rattus norvegicus
catcagactctagatgttcatccta

SEQ ID NO: 237632 - DNA, 25 bp, Rattus norvegicus
catcagactcttcccagctatggtg

SEQ ID NO: 237633 - DNA, 25 bp, Rattus norvegicus
catcagactcttcctggcagggtat

SEQ ID NO: 237634 - DNA, 25 bp, Rattus norvegicus
catcagactcttgccagctatggtg

SEQ ID NO: 237635 - DNA, 25 bp, Rattus norvegicus
catcagactcttgctggcagggtat

SEQ ID NO: 237636 - DNA, 25 bp, Rattus norvegicus
catcagagcctgattacgagaccac

SEQ ID NO: 237637 - DNA, 25 bp, Rattus norvegicus
catcagagcctgtttacgagaccac

SEQ ID NO: 237638 - DNA, 25 bp, Rattus norvegicus
catcagagtgagagttgttgcccat

SEQ ID NO: 237639 - DNA, 25 bp, Rattus norvegicus
catcagagtgagtgttgttgcccat

SEQ ID NO: 237640 - DNA, 25 bp, Rattus norvegicus
catcagagtggcctgttcagtgaag

SEQ ID NO: 237641 - DNA, 25 bp, Rattus norvegicus
catcagagtggcgtgttcagtgaag

SEQ ID NO: 237642 - DNA, 25 bp, Rattus norvegicus
catcagatagacatgggtttgccac

SEQ ID NO: 237643 - DNA, 25 bp, Rattus norvegicus
catcagatagacttgggtttgccac

SEQ ID NO: 237644 - DNA, 25 bp, Rattus norvegicus
catcagatccccaaggagtagaggt

SEQ ID NO: 237645 - DNA, 25 bp, Rattus norvegicus
catcagatcccctaggagtagaggt

SEQ ID NO: 237646 - DNA, 25 bp, Rattus norvegicus
catcagatgttgacctctggctcaa

SEQ ID NO: 237647 - DNA, 25 bp, Rattus norvegicus
catcagatgttgtcctctggctcaa

SEQ ID NO: 237648 - DNA, 25 bp, Rattus norvegicus
catcagatttaaccggaagcttcag

SEQ ID NO: 237649 - DNA, 25 bp, Rattus norvegicus
catcagatttaagcggaagcttcag

SEQ ID NO: 237650 - DNA, 25 bp, Rattus norvegicus
catcagcaactgacacttgggcaag

SEQ ID NO: 237651 - DNA, 25 bp, Rattus norvegicus
catcagcaactgtcacttgggcaag

SEQ ID NO: 237652 - DNA, 25 bp, Rattus norvegicus
catcagcatcatctccacctaaaat

SEQ ID NO: 237653 - DNA, 25 bp, Rattus norvegicus
catcagcatcatgtccacctaaaat

SEQ ID NO: 237654 - DNA, 25 bp, Rattus norvegicus
catcagccatgcactctagttttga

SEQ ID NO: 237655 - DNA, 25 bp, Rattus norvegicus
catcagccatgctctctagttttga

SEQ ID NO: 237656 - DNA, 25 bp, Rattus norvegicus
catcagccccgacaccaggaaggaa

SEQ ID NO: 237657 - DNA, 25 bp, Rattus norvegicus
catcagccccgagaccaggaaggaa

SEQ ID NO: 237658 - DNA, 25 bp, Rattus norvegicus
catcagcctgataagtataaaattt

SEQ ID NO: 237659 - DNA, 25 bp, Rattus norvegicus
catcagcctgattagtataaaattt

SEQ ID NO: 237660 - DNA, 25 bp, Rattus norvegicus
catcagccttatcttcccaaagagc

SEQ ID NO: 237661 - DNA, 25 bp, Rattus norvegicus
catcagccttatgttcccaaagagc

SEQ ID NO: 237662 - DNA, 25 bp, Rattus norvegicus
catcagcgaggacctggaccacgct

SEQ ID NO: 237663 - DNA, 25 bp, Rattus norvegicus
catcagcgaggagctggaccacgct

SEQ ID NO: 237664 - DNA, 25 bp, Rattus norvegicus
catcagcgcgcaagagggcagaccg

SEQ ID NO: 237665 - DNA, 25 bp, Rattus norvegicus
catcagcgcgcatgagggcagaccg

SEQ ID NO: 237666 - DNA, 25 bp, Rattus norvegicus
catcagcgtggacgaatcggtcgac

SEQ ID NO: 237667 - DNA, 25 bp, Rattus norvegicus
catcagcgtggaggaatcggtcgac

SEQ ID NO: 237668 - DNA, 25 bp, Rattus norvegicus
catcagctagacatggccggtgcac

SEQ ID NO: 237669 - DNA, 25 bp, Rattus norvegicus
catcagctagacttggccggtgcac

SEQ ID NO: 237670 - DNA, 25 bp, Rattus norvegicus
catcagctgatgattccttttcaaa

SEQ ID NO: 237671 - DNA, 25 bp, Rattus norvegicus
catcagctgatgtttccttttcaaa

SEQ ID NO: 237672 - DNA, 25 bp, Rattus norvegicus
catcagcttcggcatcgaccaaatc

SEQ ID NO: 237673 - DNA, 25 bp, Rattus norvegicus
catcagcttcgggatcgaccaaatc

SEQ ID NO: 237674 - DNA, 25 bp, Rattus norvegicus
catcagcttgctcggcctcagtgag

SEQ ID NO: 237675 - DNA, 25 bp, Rattus norvegicus
catcagcttgctgggcctcagtgag

SEQ ID NO: 237676 - DNA, 25 bp, Rattus norvegicus
catcagctttctccctccaaaaaag

SEQ ID NO: 237677 - DNA, 25 bp, Rattus norvegicus
catcagctttctgcctccaaaaaag

SEQ ID NO: 237678 - DNA, 25 bp, Rattus norvegicus
catcaggaaggacctgtacgccaac

SEQ ID NO: 237679 - DNA, 25 bp, Rattus norvegicus
catcaggaaggagctgtacgccaac

SEQ ID NO: 237680 - DNA, 25 bp, Rattus norvegicus
catcaggacaaacatcttcaccact

SEQ ID NO: 237681 - DNA, 25 bp, Rattus norvegicus
catcaggacaaagatcttcaccact

SEQ ID NO: 237682 - DNA, 25 bp, Rattus norvegicus
catcaggattggcagccctgtggct

SEQ ID NO: 237683 - DNA, 25 bp, Rattus norvegicus
catcaggattgggagccctgtggct

SEQ ID NO: 237684 - DNA, 25 bp, Rattus norvegicus
catcaggattttaggctggtggcct

SEQ ID NO: 237685 - DNA, 25 bp, Rattus norvegicus
catcaggatttttggctggtggcct

SEQ ID NO: 237686 - DNA, 25 bp, Rattus norvegicus
catcaggcactaatctaatgtgtgt

SEQ ID NO: 237687 - DNA, 25 bp, Rattus norvegicus
catcaggcactattctaatgtgtgt

SEQ ID NO: 237688 - DNA, 25 bp, Rattus norvegicus
catcaggcaggtcccaatgcttgta

SEQ ID NO: 237689 - DNA, 25 bp, Rattus norvegicus
catcaggcaggtgccaatgcttgta

SEQ ID NO: 237690 - DNA, 25 bp, Rattus norvegicus
catcaggccactaaggaatccctaa

SEQ ID NO: 237691 - DNA, 25 bp, Rattus norvegicus
catcaggccacttaggaatccctaa

SEQ ID NO: 237692 - DNA, 25 bp, Rattus norvegicus
catcaggccctacagcgcaaaaaga

SEQ ID NO: 237693 - DNA, 25 bp, Rattus norvegicus
catcaggccctagagcgcaaaaaga

SEQ ID NO: 237694 - DNA, 25 bp, Rattus norvegicus
catcaggctgaaaagccagtggcct

SEQ ID NO: 237695 - DNA, 25 bp, Rattus norvegicus
catcaggctgaatagccagtggcct

SEQ ID NO: 237696 - DNA, 25 bp, Rattus norvegicus
catcaggcttagaattttttcgcaa

SEQ ID NO: 237697 - DNA, 25 bp, Rattus norvegicus
catcaggcttagtattttttcgcaa

SEQ ID NO: 237698 - DNA, 25 bp, Rattus norvegicus
catcagggtctgaatgtggctgcct

SEQ ID NO: 237699 - DNA, 25 bp, Rattus norvegicus
catcagggtctgtatgtggctgcct

SEQ ID NO: 237700 - DNA, 25 bp, Rattus norvegicus
catcaggtcatcagagggcaggtct

SEQ ID NO: 237701 - DNA, 25 bp, Rattus norvegicus
catcaggtcatctgagggcaggtct

SEQ ID NO: 237702 - DNA, 25 bp, Rattus norvegicus
catcaggtctagagatccacgtgct

SEQ ID NO: 237703 - DNA, 25 bp, Rattus norvegicus
catcaggtctagtgatccacgtgct

SEQ ID NO: 237704 - DNA, 25 bp, Rattus norvegicus
catcaggtggtgatacgaccccggg

SEQ ID NO: 237705 - DNA, 25 bp, Rattus norvegicus
catcaggtggtgttacgaccccggg

SEQ ID NO: 237706 - DNA, 25 bp, Rattus norvegicus
catcaggtgtgtactggcttcgcaa

SEQ ID NO: 237707 - DNA, 25 bp, Rattus norvegicus
catcaggtgtgttctggcttcgcaa

SEQ ID NO: 237708 - DNA, 25 bp, Rattus norvegicus
catcaggttgagagttttcttacta

SEQ ID NO: 237709 - DNA, 25 bp, Rattus norvegicus
catcaggttgagtgttttcttacta

SEQ ID NO: 237710 - DNA, 25 bp, Rattus norvegicus
catcagtatcagagacgttcccgac

SEQ ID NO: 237711 - DNA, 25 bp, Rattus norvegicus
catcagtatcagtgacgttcccgac

SEQ ID NO: 237712 - DNA, 25 bp, Rattus norvegicus
catcagtatgatatgcttcctataa

SEQ ID NO: 237713 - DNA, 25 bp, Rattus norvegicus
catcagtatgatttgcttcctataa

SEQ ID NO: 237714 - DNA, 25 bp, Rattus norvegicus
catcagtattcaccttagggcggtt

SEQ ID NO: 237715 - DNA, 25 bp, Rattus norvegicus
catcagtattcagcttagggcggtt

SEQ ID NO: 237716 - DNA, 25 bp, Rattus norvegicus
catcagtcgcaaagattcagctcgc

SEQ ID NO: 237717 - DNA, 25 bp, Rattus norvegicus
catcagtcgcaatgattcagctcgc

SEQ ID NO: 237718 - DNA, 25 bp, Rattus norvegicus
catcagtcttctacttagccttatg

SEQ ID NO: 237719 - DNA, 25 bp, Rattus norvegicus
catcagtcttcttcttagccttatg

SEQ ID NO: 237720 - DNA, 25 bp, Rattus norvegicus
catcagtcttgacggctgtccttaa

SEQ ID NO: 237721 - DNA, 25 bp, Rattus norvegicus
catcagtcttgagggctgtccttaa

SEQ ID NO: 237722 - DNA, 25 bp, Rattus norvegicus
catcagtgaccccacatattacaac

SEQ ID NO: 237723 - DNA, 25 bp, Rattus norvegicus
catcagtgacccgacatattacaac

SEQ ID NO: 237724 - DNA, 25 bp, Rattus norvegicus
catcagtgcagtaccttcaatgtgg

SEQ ID NO: 237725 - DNA, 25 bp, Rattus norvegicus
catcagtgcagttccttcaatgtgg

SEQ ID NO: 237726 - DNA, 25 bp, Rattus norvegicus
catcagtgtccgagttaagtttatt

SEQ ID NO: 237727 - DNA, 25 bp, Rattus norvegicus
catcagtgtccgtgttaagtttatt

SEQ ID NO: 237728 - DNA, 25 bp, Rattus norvegicus
catcagtgtgttacttagtgtccag

SEQ ID NO: 237729 - DNA, 25 bp, Rattus norvegicus
catcagtgtgttatgtgccaggttt

SEQ ID NO: 237730 - DNA, 25 bp, Rattus norvegicus
catcagtgtgtttcttagtgtccag

SEQ ID NO: 237731 - DNA, 25 bp, Rattus norvegicus
catcagtgtgttttgtgccaggttt

SEQ ID NO: 237732 - DNA, 25 bp, Rattus norvegicus
catcagtgttaacagcatcccagct

SEQ ID NO: 237733 - DNA, 25 bp, Rattus norvegicus
catcagtgttaagagcatcccagct

SEQ ID NO: 237734 - DNA, 25 bp, Rattus norvegicus
catcagttgctgaatgcagctcaaa

SEQ ID NO: 237735 - DNA, 25 bp, Rattus norvegicus
catcagttgctgtatgcagctcaaa

SEQ ID NO: 237736 - DNA, 25 bp, Rattus norvegicus
catcagtttgatcgtggcccagaaa

SEQ ID NO: 237737 - DNA, 25 bp, Rattus norvegicus
catcagtttgatggtggcccagaaa

SEQ ID NO: 237738 - DNA, 25 bp, Rattus norvegicus
catcataaaagcagctccttggctg

SEQ ID NO: 237739 - DNA, 25 bp, Rattus norvegicus
catcataaaagctgctccttggctg

SEQ ID NO: 237740 - DNA, 25 bp, Rattus norvegicus
catcataccaggaccttcctttatg

SEQ ID NO: 237741 - DNA, 25 bp, Rattus norvegicus
catcataccaggtccttcctttatg

SEQ ID NO: 237742 - DNA, 25 bp, Rattus norvegicus
catcatacccacagctaggacatat

SEQ ID NO: 237743 - DNA, 25 bp, Rattus norvegicus
catcatacccactgctaggacatat

SEQ ID NO: 237744 - DNA, 25 bp, Rattus norvegicus
catcatacttccatactcaatgcta

SEQ ID NO: 237745 - DNA, 25 bp, Rattus norvegicus
catcatacttccttactcaatgcta

SEQ ID NO: 237746 - DNA, 25 bp, Rattus norvegicus
catcatagatatcggtcctgtggat

SEQ ID NO: 237747 - DNA, 25 bp, Rattus norvegicus
catcatagatatgggtcctgtggat

SEQ ID NO: 237748 - DNA, 25 bp, Rattus norvegicus
catcatatctggacttggtctagta

SEQ ID NO: 237749 - DNA, 25 bp, Rattus norvegicus
catcatatctggtcttggtctagta

SEQ ID NO: 237750 - DNA, 25 bp, Rattus norvegicus
catcatattataactgtgctcacaa

SEQ ID NO: 237751 - DNA, 25 bp, Rattus norvegicus
catcatattatatctgtgctcacaa

SEQ ID NO: 237752 - DNA, 25 bp, Rattus norvegicus
catcatcaacctattcattttcatt

SEQ ID NO: 237753 - DNA, 25 bp, Rattus norvegicus
catcatcaaccttttcattttcatt

SEQ ID NO: 237754 - DNA, 25 bp, Rattus norvegicus
catcatcacatgcagtgccaacttt

SEQ ID NO: 237755 - DNA, 25 bp, Rattus norvegicus
catcatcacatggagtgccaacttt

SEQ ID NO: 237756 - DNA, 25 bp, Rattus norvegicus
catcatcagcttctttctgcttaga

SEQ ID NO: 237757 - DNA, 25 bp, Rattus norvegicus
catcatcagcttgtttctgcttaga

SEQ ID NO: 237758 - DNA, 25 bp, Rattus norvegicus
catcatcatgcacgatgtgtgaagg

SEQ ID NO: 237759 - DNA, 25 bp, Rattus norvegicus
catcatcatgcaggatgtgtgaagg

SEQ ID NO: 237760 - DNA, 25 bp, Rattus norvegicus
catcatccctcactttttcatgtta

SEQ ID NO: 237761 - DNA, 25 bp, Rattus norvegicus
catcatccctcagtttttcatgtta

SEQ ID NO: 237762 - DNA, 25 bp, Rattus norvegicus
catcatcgtggtcctggtggtgacc

SEQ ID NO: 237763 - DNA, 25 bp, Rattus norvegicus
catcatcgtggtgctggtggtgacc

SEQ ID NO: 237764 - DNA, 25 bp, Rattus norvegicus
catcatctatacatggttttctgta

SEQ ID NO: 237765 - DNA, 25 bp, Rattus norvegicus
catcatctatacttggttttctgta

SEQ ID NO: 237766 - DNA, 25 bp, Rattus norvegicus
catcatctctagagctagttgctgc

SEQ ID NO: 237767 - DNA, 25 bp, Rattus norvegicus
catcatctctagtgctagttgctgc

SEQ ID NO: 237768 - DNA, 25 bp, Rattus norvegicus
catcatctgataccaccatgcttaa

SEQ ID NO: 237769 - DNA, 25 bp, Rattus norvegicus
catcatctgatagcaccatgcttaa

SEQ ID NO: 237770 - DNA, 25 bp, Rattus norvegicus
catcatcttcccaggtaatcattgc

SEQ ID NO: 237771 - DNA, 25 bp, Rattus norvegicus
catcatcttccctggtaatcattgc

SEQ ID NO: 237772 - DNA, 25 bp, Rattus norvegicus
catcatcttcctacgtttactgaaa

SEQ ID NO: 237773 - DNA, 25 bp, Rattus norvegicus
catcatcttccttcgtttactgaaa

SEQ ID NO: 237774 - DNA, 25 bp, Rattus norvegicus
catcatgacgatcctgctcaagtgc

SEQ ID NO: 237775 - DNA, 25 bp, Rattus norvegicus
catcatgacgatgctgctcaagtgc

SEQ ID NO: 237776 - DNA, 25 bp, Rattus norvegicus
catcatgagaacacattgacgtcac

SEQ ID NO: 237777 - DNA, 25 bp, Rattus norvegicus
catcatgagaactcattgacgtcac

SEQ ID NO: 237778 - DNA, 25 bp, Rattus norvegicus
catcatgcagaaacagtctgtggct

SEQ ID NO: 237779 - DNA, 25 bp, Rattus norvegicus
catcatgcagaatcagtctgtggct

SEQ ID NO: 237780 - DNA, 25 bp, Rattus norvegicus
catcatgccgggagtgtggattcta

SEQ ID NO: 237781 - DNA, 25 bp, Rattus norvegicus
catcatgccgggtgtgtggattcta

SEQ ID NO: 237782 - DNA, 25 bp, Rattus norvegicus
catcatgcttccaccttacaaatat

SEQ ID NO: 237783 - DNA, 25 bp, Rattus norvegicus
catcatgcttcctccttacaaatat

SEQ ID NO: 237784 - DNA, 25 bp, Rattus norvegicus
catcatggatatatctaggagactc

SEQ ID NO: 237785 - DNA, 25 bp, Rattus norvegicus
catcatggatatttctaggagactc

SEQ ID NO: 237786 - DNA, 25 bp, Rattus norvegicus
catcatggcgtgactgatctacaga

SEQ ID NO: 237787 - DNA, 25 bp, Rattus norvegicus
catcatggcgtgtctgatctacaga

SEQ ID NO: 237788 - DNA, 25 bp, Rattus norvegicus
catcatggcttgagtgcatggacac

SEQ ID NO: 237789 - DNA, 25 bp, Rattus norvegicus
catcatggcttgtgtgcatggacac

SEQ ID NO: 237790 - DNA, 25 bp, Rattus norvegicus
catcatggctttctatgagagcagg

SEQ ID NO: 237791 - DNA, 25 bp, Rattus norvegicus
catcatggctttgtatgagagcagg

SEQ ID NO: 237792 - DNA, 25 bp, Rattus norvegicus
catcatgggctgcacactggacttc

SEQ ID NO: 237793 - DNA, 25 bp, Rattus norvegicus
catcatgggctggacactggacttc

SEQ ID NO: 237794 - DNA, 25 bp, Rattus norvegicus
catcatggggtcaggagcttccgga

SEQ ID NO: 237795 - DNA, 25 bp, Rattus norvegicus
catcatggggtctggagcttccgga

SEQ ID NO: 237796 - DNA, 25 bp, Rattus norvegicus
catcatggtgggaagactttgtttt

SEQ ID NO: 237797 - DNA, 25 bp, Rattus norvegicus
catcatggtgggtagactttgtttt

SEQ ID NO: 237798 - DNA, 25 bp, Rattus norvegicus
catcatggttccatatttgtgaagt

SEQ ID NO: 237799 - DNA, 25 bp, Rattus norvegicus
catcatggttccttatttgtgaagt

SEQ ID NO: 237800 - DNA, 25 bp, Rattus norvegicus
catcatgtcacgatacgggcggtat

SEQ ID NO: 237801 - DNA, 25 bp, Rattus norvegicus
catcatgtcacgttacgggcggtat

SEQ ID NO: 237802 - DNA, 25 bp, Rattus norvegicus
catcatgtccctctggaagccatta

SEQ ID NO: 237803 - DNA, 25 bp, Rattus norvegicus
catcatgtccctgtggaagccatta

SEQ ID NO: 237804 - DNA, 25 bp, Rattus norvegicus
catcatgtgagtcggcctgctttcc

SEQ ID NO: 237805 - DNA, 25 bp, Rattus norvegicus
catcatgtgagtgggcctgctttcc

SEQ ID NO: 237806 - DNA, 25 bp, Rattus norvegicus
catcattaaattatccctcctggtc

SEQ ID NO: 237807 - DNA, 25 bp, Rattus norvegicus
catcattaaattttccctcctggtc

SEQ ID NO: 237808 - DNA, 25 bp, Rattus norvegicus
catcattaatccagagcatgcccca

SEQ ID NO: 237809 - DNA, 25 bp, Rattus norvegicus
catcattaatcctgagcatgcccca

SEQ ID NO: 237810 - DNA, 25 bp, Rattus norvegicus
catcattgcccgcaatggccggtat

SEQ ID NO: 237811 - DNA, 25 bp, Rattus norvegicus
catcattgcccggaatggccggtat

SEQ ID NO: 237812 - DNA, 25 bp, Rattus norvegicus
catcattgccttaccatggttgtaa

SEQ ID NO: 237813 - DNA, 25 bp, Rattus norvegicus
catcattgcctttccatggttgtaa

SEQ ID NO: 237814 - DNA, 25 bp, Rattus norvegicus
catcattggagcaatggtggttgtt

SEQ ID NO: 237815 - DNA, 25 bp, Rattus norvegicus
catcattggagctatggtggttgtt

SEQ ID NO: 237816 - DNA, 25 bp, Rattus norvegicus
catcattgtgtcactgcattgcctt

SEQ ID NO: 237817 - DNA, 25 bp, Rattus norvegicus
catcattgtgtctctgcattgcctt

SEQ ID NO: 237818 - DNA, 25 bp, Rattus norvegicus
catcattgttttcttctggagagaa

SEQ ID NO: 237819 - DNA, 25 bp, Rattus norvegicus
catcattgttttgttctggagagaa

SEQ ID NO: 237820 - DNA, 25 bp, Rattus norvegicus
catcatttaatgagtttcctttata

SEQ ID NO: 237821 - DNA, 25 bp, Rattus norvegicus
catcatttaatgtgtttcctttata

SEQ ID NO: 237822 - DNA, 25 bp, Rattus norvegicus
catcatttcaaactctgtccagtct

SEQ ID NO: 237823 - DNA, 25 bp, Rattus norvegicus
catcatttcaaagtctgtccagtct

SEQ ID NO: 237824 - DNA, 25 bp, Rattus norvegicus
catcatttctgtaggctgggtgttg

SEQ ID NO: 237825 - DNA, 25 bp, Rattus norvegicus
catcatttctgttggctgggtgttg

SEQ ID NO: 237826 - DNA, 25 bp, Rattus norvegicus
catcattttaatcccaactcttcag

SEQ ID NO: 237827 - DNA, 25 bp, Rattus norvegicus
catcattttaatgccaactcttcag

SEQ ID NO: 237828 - DNA, 25 bp, Rattus norvegicus
catcattttcacctggatgtcccac

SEQ ID NO: 237829 - DNA, 25 bp, Rattus norvegicus
catcattttcacgtggatgtcccac

SEQ ID NO: 237830 - DNA, 25 bp, Rattus norvegicus
catccaaacccgacatgctagattt

SEQ ID NO: 237831 - DNA, 25 bp, Rattus norvegicus
catccaaacccgtcatgctagattt

SEQ ID NO: 237832 - DNA, 25 bp, Rattus norvegicus
catccaaactgtcatttccctagta

SEQ ID NO: 237833 - DNA, 25 bp, Rattus norvegicus
catccaaactgtgatttccctagta

SEQ ID NO: 237834 - DNA, 25 bp, Rattus norvegicus
catccaaagcgcagtgcctagggaa

SEQ ID NO: 237835 - DNA, 25 bp, Rattus norvegicus
catccaaagcgctgtgcctagggaa

SEQ ID NO: 237836 - DNA, 25 bp, Rattus norvegicus
catccaaccggaagtacccattaag

SEQ ID NO: 237837 - DNA, 25 bp, Rattus norvegicus
catccaaccggatgtacccattaag

SEQ ID NO: 237838 - DNA, 25 bp, Rattus norvegicus
catccaactggtatgttcttttgca

SEQ ID NO: 237839 - DNA, 25 bp, Rattus norvegicus
catccaactggtttgttcttttgca

SEQ ID NO: 237840 - DNA, 25 bp, Rattus norvegicus
catccaagagctcgccaagcaaaag

SEQ ID NO: 237841 - DNA, 25 bp, Rattus norvegicus
catccaagagctggccaagcaaaag

SEQ ID NO: 237842 - DNA, 25 bp, Rattus norvegicus
catccaagagggagcacggcgtaca

SEQ ID NO: 237843 - DNA, 25 bp, Rattus norvegicus
catccaagagggtgcacggcgtaca

SEQ ID NO: 237844 - DNA, 25 bp, Rattus norvegicus
catccaagcactcgccaggagggaa

SEQ ID NO: 237845 - DNA, 25 bp, Rattus norvegicus
catccaagcactggccaggagggaa

SEQ ID NO: 237846 - DNA, 25 bp, Rattus norvegicus
catccaagcgttacaccggtgtctc

SEQ ID NO: 237847 - DNA, 25 bp, Rattus norvegicus
catccaagcgtttcaccggtgtctc

SEQ ID NO: 237848 - DNA, 25 bp, Rattus norvegicus
catccaaggatgaagcaactgtgag

SEQ ID NO: 237849 - DNA, 25 bp, Rattus norvegicus
catccaaggatgtagcaactgtgag

SEQ ID NO: 237850 - DNA, 25 bp, Rattus norvegicus
catccaaggctacggcacttctggg

SEQ ID NO: 237851 - DNA, 25 bp, Rattus norvegicus
catccaaggctagggcacttctggg

SEQ ID NO: 237852 - DNA, 25 bp, Rattus norvegicus
catccaatagtgagtcaggtgaatt

SEQ ID NO: 237853 - DNA, 25 bp, Rattus norvegicus
catccaatagtgtgtcaggtgaatt

SEQ ID NO: 237854 - DNA, 25 bp, Rattus norvegicus
catccaatgaagctgtttgctgcta

SEQ ID NO: 237855 - DNA, 25 bp, Rattus norvegicus
catccaatgaaggtgtttgctgcta

SEQ ID NO: 237856 - DNA, 25 bp, Rattus norvegicus
catccacaaggcagctcacaattat

SEQ ID NO: 237857 - DNA, 25 bp, Rattus norvegicus
catccacaaggctgctcacaattat

SEQ ID NO: 237858 - DNA, 25 bp, Rattus norvegicus
catccacagctaagttcatctctaa

SEQ ID NO: 237859 - DNA, 25 bp, Rattus norvegicus
catccacagctatgttcatctctaa

SEQ ID NO: 237860 - DNA, 25 bp, Rattus norvegicus
catccacagtggaaccttttacagt

SEQ ID NO: 237861 - DNA, 25 bp, Rattus norvegicus
catccacagtggtaccttttacagt

SEQ ID NO: 237862 - DNA, 25 bp, Rattus norvegicus
catccacatggtcggttgcaaccac

SEQ ID NO: 237863 - DNA, 25 bp, Rattus norvegicus
catccacatggtgggttgcaaccac

SEQ ID NO: 237864 - DNA, 25 bp, Rattus norvegicus
catccaccaacaccaacatgggaat

SEQ ID NO: 237865 - DNA, 25 bp, Rattus norvegicus
catccaccaacagcaacatgggaat

SEQ ID NO: 237866 - DNA, 25 bp, Rattus norvegicus
catccaccatacatctttgttttta

SEQ ID NO: 237867 - DNA, 25 bp, Rattus norvegicus
catccaccatacttctttgttttta

SEQ ID NO: 237868 - DNA, 25 bp, Rattus norvegicus
catccaccattaccaaaatccttag

SEQ ID NO: 237869 - DNA, 25 bp, Rattus norvegicus
catccaccattagcaaaatccttag

SEQ ID NO: 237870 - DNA, 25 bp, Rattus norvegicus
catccacccatcagagaggcttctt

SEQ ID NO: 237871 - DNA, 25 bp, Rattus norvegicus
catccacccatctgagaggcttctt

SEQ ID NO: 237872 - DNA, 25 bp, Rattus norvegicus
catccacccgttactgtgagtatag

SEQ ID NO: 237873 - DNA, 25 bp, Rattus norvegicus
catccacccgtttctgtgagtatag

SEQ ID NO: 237874 - DNA, 25 bp, Rattus norvegicus
catccaccctataaaagcagtcctt

SEQ ID NO: 237875 - DNA, 25 bp, Rattus norvegicus
catccaccctattaaagcagtcctt

SEQ ID NO: 237876 - DNA, 25 bp, Rattus norvegicus
catccacctcataattatcaacctt

SEQ ID NO: 237877 - DNA, 25 bp, Rattus norvegicus
catccacctcattattatcaacctt

SEQ ID NO: 237878 - DNA, 25 bp, Rattus norvegicus
catccacctgtgaatttgtcatgct

SEQ ID NO: 237879 - DNA, 25 bp, Rattus norvegicus
catccacctgtgtatttgtcatgct

SEQ ID NO: 237880 - DNA, 25 bp, Rattus norvegicus
catccacgtggacatttgcttaaat

SEQ ID NO: 237881 - DNA, 25 bp, Rattus norvegicus
catccacgtggagatttgcttaaat

SEQ ID NO: 237882 - DNA, 25 bp, Rattus norvegicus
catccactacacagcacggtcagat

SEQ ID NO: 237883 - DNA, 25 bp, Rattus norvegicus
catccactacactgcacggtcagat

SEQ ID NO: 237884 - DNA, 25 bp, Rattus norvegicus
catccactggatactgctggtgtgt

SEQ ID NO: 237885 - DNA, 25 bp, Rattus norvegicus
catccactggattctgctggtgtgt

SEQ ID NO: 237886 - DNA, 25 bp, Rattus norvegicus
catccactggtgctgccaaggctgt

SEQ ID NO: 237887 - DNA, 25 bp, Rattus norvegicus
catccactggtggtgccaaggctgt

SEQ ID NO: 237888 - DNA, 25 bp, Rattus norvegicus
catccagagacaagagcaccatcac

SEQ ID NO: 237889 - DNA, 25 bp, Rattus norvegicus
catccagagacatgagcaccatcac

SEQ ID NO: 237890 - DNA, 25 bp, Rattus norvegicus
catccagagctgatatcctctcggg

SEQ ID NO: 237891 - DNA, 25 bp, Rattus norvegicus
catccagagctgttatcctctcggg

SEQ ID NO: 237892 - DNA, 25 bp, Rattus norvegicus
catccagagggcagtttggttcttt

SEQ ID NO: 237893 - DNA, 25 bp, Rattus norvegicus
catccagagggctgtttggttcttt

SEQ ID NO: 237894 - DNA, 25 bp, Rattus norvegicus
catccagagttcagcttgtcatcat

SEQ ID NO: 237895 - DNA, 25 bp, Rattus norvegicus
catccagagttctgcttgtcatcat

SEQ ID NO: 237896 - DNA, 25 bp, Rattus norvegicus
catccagatggtacgggcacagcgc

SEQ ID NO: 237897 - DNA, 25 bp, Rattus norvegicus
catccagatggttcgggcacagcgc

SEQ ID NO: 237898 - DNA, 25 bp, Rattus norvegicus
catccagcatgtcggaaggccatca

SEQ ID NO: 237899 - DNA, 25 bp, Rattus norvegicus
catccagcatgtgggaaggccatca

SEQ ID NO: 237900 - DNA, 25 bp, Rattus norvegicus
catccagctgaacaccattgcaaag

SEQ ID NO: 237901 - DNA, 25 bp, Rattus norvegicus
catccagctgaagaccattgcaaag

SEQ ID NO: 237902 - DNA, 25 bp, Rattus norvegicus
catccaggagtgctctgaaggcttt

SEQ ID NO: 237903 - DNA, 25 bp, Rattus norvegicus
catccaggagtggtctgaaggcttt

SEQ ID NO: 237904 - DNA, 25 bp, Rattus norvegicus
catccaggctgaaatggtgctggag

SEQ ID NO: 237905 - DNA, 25 bp, Rattus norvegicus
catccaggctgatatggtgctggag

SEQ ID NO: 237906 - DNA, 25 bp, Rattus norvegicus
catccaggtcctcaagatcgcacag

SEQ ID NO: 237907 - DNA, 25 bp, Rattus norvegicus
catccaggtcctgaagatcgcacag

SEQ ID NO: 237908 - DNA, 25 bp, Rattus norvegicus
catccaggtgacactgtgtgaggct

SEQ ID NO: 237909 - DNA, 25 bp, Rattus norvegicus
catccaggtgactctgtgtgaggct

SEQ ID NO: 237910 - DNA, 25 bp, Rattus norvegicus
catccaggtggcattagggtcctaa

SEQ ID NO: 237911 - DNA, 25 bp, Rattus norvegicus
catccaggtggctttagggtcctaa

SEQ ID NO: 237912 - DNA, 25 bp, Rattus norvegicus
catccaggtggtccaaatgcagtga

SEQ ID NO: 237913 - DNA, 25 bp, Rattus norvegicus
catccaggtggtgcaaatgcagtga

SEQ ID NO: 237914 - DNA, 25 bp, Rattus norvegicus
catccagtctagctggttggtgagc

SEQ ID NO: 237915 - DNA, 25 bp, Rattus norvegicus
catccagtctaggtggttggtgagc

SEQ ID NO: 237916 - DNA, 25 bp, Rattus norvegicus
catccagtcttcatctctatttatc

SEQ ID NO: 237917 - DNA, 25 bp, Rattus norvegicus
catccagtcttcttctctatttatc

SEQ ID NO: 237918 - DNA, 25 bp, Rattus norvegicus
catccagttagtattccaaggcctt

SEQ ID NO: 237919 - DNA, 25 bp, Rattus norvegicus
catccagttagtcgtaaacctttcg

SEQ ID NO: 237920 - DNA, 25 bp, Rattus norvegicus
catccagttagtggtaaacctttcg

SEQ ID NO: 237921 - DNA, 25 bp, Rattus norvegicus
catccagttagttttccaaggcctt

SEQ ID NO: 237922 - DNA, 25 bp, Rattus norvegicus
catccagttcatcagattctctcat

SEQ ID NO: 237923 - DNA, 25 bp, Rattus norvegicus
catccagttcatgagattctctcat

SEQ ID NO: 237924 - DNA, 25 bp, Rattus norvegicus
catccagttcctcatccatgttggg

SEQ ID NO: 237925 - DNA, 25 bp, Rattus norvegicus
catccagttcctgatccatgttggg

SEQ ID NO: 237926 - DNA, 25 bp, Rattus norvegicus
catccagttctacggctgtactgtc

SEQ ID NO: 237927 - DNA, 25 bp, Rattus norvegicus
catccagttctagggctgtactgtc

SEQ ID NO: 237928 - DNA, 25 bp, Rattus norvegicus
catccagttgataggcttgcctaac

SEQ ID NO: 237929 - DNA, 25 bp, Rattus norvegicus
catccagttgattggcttgcctaac

SEQ ID NO: 237930 - DNA, 25 bp, Rattus norvegicus
catccagttgggagtatagttttca

SEQ ID NO: 237931 - DNA, 25 bp, Rattus norvegicus
catccagttgggtgtatagttttca

SEQ ID NO: 237932 - DNA, 25 bp, Rattus norvegicus
catccagtttctcattcccaagaag

SEQ ID NO: 237933 - DNA, 25 bp, Rattus norvegicus
catccagtttctgattcccaagaag

SEQ ID NO: 237934 - DNA, 25 bp, Rattus norvegicus
catccataactgagtcttgaaaggt

SEQ ID NO: 237935 - DNA, 25 bp, Rattus norvegicus
catccataactgtgtcttgaaaggt

SEQ ID NO: 237936 - DNA, 25 bp, Rattus norvegicus
catccatagcggagaaacgccctat

SEQ ID NO: 237937 - DNA, 25 bp, Rattus norvegicus
catccatagcggtgaaacgccctat

SEQ ID NO: 237938 - DNA, 25 bp, Rattus norvegicus
catccatcagtgaggagtgggaaag

SEQ ID NO: 237939 - DNA, 25 bp, Rattus norvegicus
catccatcagtgtggagtgggaaag

SEQ ID NO: 237940 - DNA, 25 bp, Rattus norvegicus
catccatgcgctaggaaatgcttat

SEQ ID NO: 237941 - DNA, 25 bp, Rattus norvegicus
catccatgcgcttggaaatgcttat

SEQ ID NO: 237942 - DNA, 25 bp, Rattus norvegicus
catccatggcttctgattctagttc

SEQ ID NO: 237943 - DNA, 25 bp, Rattus norvegicus
catccatggcttgtgattctagttc

SEQ ID NO: 237944 - DNA, 25 bp, Rattus norvegicus
catccattcatccaggctttgagtt

SEQ ID NO: 237945 - DNA, 25 bp, Rattus norvegicus
catccattcatcgaggctttgagtt

SEQ ID NO: 237946 - DNA, 25 bp, Rattus norvegicus
catccatttcaaaacgtgtctcggg

SEQ ID NO: 237947 - DNA, 25 bp, Rattus norvegicus
catccatttcaatacgtgtctcggg

SEQ ID NO: 237948 - DNA, 25 bp, Rattus norvegicus
catcccaaaatgaggctgccatctt

SEQ ID NO: 237949 - DNA, 25 bp, Rattus norvegicus
catcccaaaatgtggctgccatctt

SEQ ID NO: 237950 - DNA, 25 bp, Rattus norvegicus
catcccaaatttcatcggtccatag

SEQ ID NO: 237951 - DNA, 25 bp, Rattus norvegicus
catcccaaatttgatcggtccatag

SEQ ID NO: 237952 - DNA, 25 bp, Rattus norvegicus
catcccacagtgctcctgagaagag

SEQ ID NO: 237953 - DNA, 25 bp, Rattus norvegicus
catcccacagtggtcctgagaagag

SEQ ID NO: 237954 - DNA, 25 bp, Rattus norvegicus
catcccaccactactgatttatgtt

SEQ ID NO: 237955 - DNA, 25 bp, Rattus norvegicus
catcccaccacttctgatttatgtt

SEQ ID NO: 237956 - DNA, 25 bp, Rattus norvegicus
catcccagatggaagccaatgtgtt

SEQ ID NO: 237957 - DNA, 25 bp, Rattus norvegicus
catcccagatggtagccaatgtgtt

SEQ ID NO: 237958 - DNA, 25 bp, Rattus norvegicus
catcccaggcctctgataggagctt

SEQ ID NO: 237959 - DNA, 25 bp, Rattus norvegicus
catcccaggcctgtgataggagctt

SEQ ID NO: 237960 - DNA, 25 bp, Rattus norvegicus
catcccagggatcagtttcacattt

SEQ ID NO: 237961 - DNA, 25 bp, Rattus norvegicus
catcccagggatgagtttcacattt

SEQ ID NO: 237962 - DNA, 25 bp, Rattus norvegicus
catcccaggtctccaaccagagatg

SEQ ID NO: 237963 - DNA, 25 bp, Rattus norvegicus
catcccaggtctgcaaccagagatg

SEQ ID NO: 237964 - DNA, 25 bp, Rattus norvegicus
catcccaggtttcactcttcaaaaa

SEQ ID NO: 237965 - DNA, 25 bp, Rattus norvegicus
catcccaggtttgactcttcaaaaa

SEQ ID NO: 237966 - DNA, 25 bp, Rattus norvegicus
catcccagtgatccatgaaccaagc

SEQ ID NO: 237967 - DNA, 25 bp, Rattus norvegicus
catcccagtgatgcatgaaccaagc

SEQ ID NO: 237968 - DNA, 25 bp, Rattus norvegicus
catcccagtgtgacgcttgtgttag

SEQ ID NO: 237969 - DNA, 25 bp, Rattus norvegicus
catcccagtgtgtcgcttgtgttag

SEQ ID NO: 237970 - DNA, 25 bp, Rattus norvegicus
catcccatacccatttttctaggtt

SEQ ID NO: 237971 - DNA, 25 bp, Rattus norvegicus
catcccatacccttttttctaggtt

SEQ ID NO: 237972 - DNA, 25 bp, Rattus norvegicus
catcccatagccctttagacattat

SEQ ID NO: 237973 - DNA, 25 bp, Rattus norvegicus
catcccatagccgtttagacattat

SEQ ID NO: 237974 - DNA, 25 bp, Rattus norvegicus
catcccatgaagcttctgttctcag

SEQ ID NO: 237975 - DNA, 25 bp, Rattus norvegicus
catcccatgaaggttctgttctcag

SEQ ID NO: 237976 - DNA, 25 bp, Rattus norvegicus
catccccaacctactcaaaagatta

SEQ ID NO: 237977 - DNA, 25 bp, Rattus norvegicus
catccccaaccttctcaaaagatta

SEQ ID NO: 237978 - DNA, 25 bp, Rattus norvegicus
catccccaaggaccgagtgattctt

SEQ ID NO: 237979 - DNA, 25 bp, Rattus norvegicus
catccccaaggagcgagtgattctt

SEQ ID NO: 237980 - DNA, 25 bp, Rattus norvegicus
catccccaagggaacagttgtgatt

SEQ ID NO: 237981 - DNA, 25 bp, Rattus norvegicus
catccccaagggtacagttgtgatt

SEQ ID NO: 237982 - DNA, 25 bp, Rattus norvegicus
catccccaagtgcagctgggtgtga

SEQ ID NO: 237983 - DNA, 25 bp, Rattus norvegicus
catccccaagtggagctgggtgtga

SEQ ID NO: 237984 - DNA, 25 bp, Rattus norvegicus
catccccatgggaactttattgttt

SEQ ID NO: 237985 - DNA, 25 bp, Rattus norvegicus
catccccatgggtactttattgttt

SEQ ID NO: 237986 - DNA, 25 bp, Rattus norvegicus
catccccatttgcactgtgaccaag

SEQ ID NO: 237987 - DNA, 25 bp, Rattus norvegicus
catccccatttggactgtgaccaag

SEQ ID NO: 237988 - DNA, 25 bp, Rattus norvegicus
catcccctcaccctaaatgtgatta

SEQ ID NO: 237989 - DNA, 25 bp, Rattus norvegicus
catcccctcaccgtaaatgtgatta

SEQ ID NO: 237990 - DNA, 25 bp, Rattus norvegicus
catcccctcagaaaatgcctttgaa

SEQ ID NO: 237991 - DNA, 25 bp, Rattus norvegicus
catcccctcagataatgcctttgaa

SEQ ID NO: 237992 - DNA, 25 bp, Rattus norvegicus
catcccctctcgagaatggttcaca

SEQ ID NO: 237993 - DNA, 25 bp, Rattus norvegicus
catcccctctcgtgaatggttcaca

SEQ ID NO: 237994 - DNA, 25 bp, Rattus norvegicus
catcccctctgacagtggtcaatgt

SEQ ID NO: 237995 - DNA, 25 bp, Rattus norvegicus
catcccctctgagagtggtcaatgt

SEQ ID NO: 237996 - DNA, 25 bp, Rattus norvegicus
catcccctgcaccaaggagaatcaa

SEQ ID NO: 237997 - DNA, 25 bp, Rattus norvegicus
catcccctgcacgaaggagaatcaa

SEQ ID NO: 237998 - DNA, 25 bp, Rattus norvegicus
catcccctggccagagaactaagag

SEQ ID NO: 237999 - DNA, 25 bp, Rattus norvegicus
catcccctggcctgagaactaagag

SEQ ID NO: 238000 - DNA, 25 bp, Rattus norvegicus
catcccctggctatggtatactata

SEQ ID NO: 238001 - DNA, 25 bp, Rattus norvegicus
catcccctggctttggtatactata

SEQ ID NO: 238002 - DNA, 25 bp, Rattus norvegicus
catccccttctgattattctgtaag

SEQ ID NO: 238003 - DNA, 25 bp, Rattus norvegicus
catccccttctgtttattctgtaag

SEQ ID NO: 238004 - DNA, 25 bp, Rattus norvegicus
catcccgagacaatgttgggcccaa

SEQ ID NO: 238005 - DNA, 25 bp, Rattus norvegicus
catcccgagacattgttgggcccaa

SEQ ID NO: 238006 - DNA, 25 bp, Rattus norvegicus
catcccgagtggattaacgtgtaca

SEQ ID NO: 238007 - DNA, 25 bp, Rattus norvegicus
catcccgagtggtttaacgtgtaca

SEQ ID NO: 238008 - DNA, 25 bp, Rattus norvegicus
catcccgcctttacttgtgataaat

SEQ ID NO: 238009 - DNA, 25 bp, Rattus norvegicus
catcccgccttttcttgtgataaat

SEQ ID NO: 238010 - DNA, 25 bp, Rattus norvegicus
catcccggacagagaacctttctca

SEQ ID NO: 238011 - DNA, 25 bp, Rattus norvegicus
catcccggacagtgaacctttctca

SEQ ID NO: 238012 - DNA, 25 bp, Rattus norvegicus
catcccggtggcaactataaattaa

SEQ ID NO: 238013 - DNA, 25 bp, Rattus norvegicus
catcccggtggctactataaattaa

SEQ ID NO: 238014 - DNA, 25 bp, Rattus norvegicus
catccctaaatcctgagggtgaaat

SEQ ID NO: 238015 - DNA, 25 bp, Rattus norvegicus
catccctaaatcgtgagggtgaaat

SEQ ID NO: 238016 - DNA, 25 bp, Rattus norvegicus
catccctaccctattttcggtgatt

SEQ ID NO: 238017 - DNA, 25 bp, Rattus norvegicus
catccctacccttttttcggtgatt

SEQ ID NO: 238018 - DNA, 25 bp, Rattus norvegicus
catccctacctcacttcataataaa

SEQ ID NO: 238019 - DNA, 25 bp, Rattus norvegicus
catccctacctctcttcataataaa

SEQ ID NO: 238020 - DNA, 25 bp, Rattus norvegicus
catccctagtaaacctgacacttag

SEQ ID NO: 238021 - DNA, 25 bp, Rattus norvegicus
catccctagtaatcctgacacttag

SEQ ID NO: 238022 - DNA, 25 bp, Rattus norvegicus
catccctattcacaacagtcttcaa

SEQ ID NO: 238023 - DNA, 25 bp, Rattus norvegicus
catccctattcagaacagtcttcaa

SEQ ID NO: 238024 - DNA, 25 bp, Rattus norvegicus
catccctcagagacatagccttgaa

SEQ ID NO: 238025 - DNA, 25 bp, Rattus norvegicus
catccctcagagtcatagccttgaa

SEQ ID NO: 238026 - DNA, 25 bp, Rattus norvegicus
catccctccttgatacttcagtgta

SEQ ID NO: 238027 - DNA, 25 bp, Rattus norvegicus
catccctccttgttacttcagtgta

SEQ ID NO: 238028 - DNA, 25 bp, Rattus norvegicus
catccctctagtactcttgagaagt

SEQ ID NO: 238029 - DNA, 25 bp, Rattus norvegicus
catccctctagttctcttgagaagt

SEQ ID NO: 238030 - DNA, 25 bp, Rattus norvegicus
catccctctggcagagtgggagagc

SEQ ID NO: 238031 - DNA, 25 bp, Rattus norvegicus
catccctctggctgagtgggagagc

SEQ ID NO: 238032 - DNA, 25 bp, Rattus norvegicus
catccctgatgcataccgacagata

SEQ ID NO: 238033 - DNA, 25 bp, Rattus norvegicus
catccctgatgcttaccgacagata

SEQ ID NO: 238034 - DNA, 25 bp, Rattus norvegicus
catccctgggagcaacagacctggc

SEQ ID NO: 238035 - DNA, 25 bp, Rattus norvegicus
catccctgggaggaacagacctggc

SEQ ID NO: 238036 - DNA, 25 bp, Rattus norvegicus
catccctgtacacccgatggaatgg

SEQ ID NO: 238037 - DNA, 25 bp, Rattus norvegicus
catccctgtacagccgatggaatgg

SEQ ID NO: 238038 - DNA, 25 bp, Rattus norvegicus
catcccttccaacgacgacatttat

SEQ ID NO: 238039 - DNA, 25 bp, Rattus norvegicus
catcccttccaaggacgacatttat

SEQ ID NO: 238040 - DNA, 25 bp, Rattus norvegicus
catcccttccacacagttaaaagga

SEQ ID NO: 238041 - DNA, 25 bp, Rattus norvegicus
catcccttccactcagttaaaagga

SEQ ID NO: 238042 - DNA, 25 bp, Rattus norvegicus
catcccttctgtagtcatagagcca

SEQ ID NO: 238043 - DNA, 25 bp, Rattus norvegicus
catcccttctgttgtcatagagcca

SEQ ID NO: 238044 - DNA, 25 bp, Rattus norvegicus
catcccttgactcctgttatgtgaa

SEQ ID NO: 238045 - DNA, 25 bp, Rattus norvegicus
catcccttgactgctgttatgtgaa

SEQ ID NO: 238046 - DNA, 25 bp, Rattus norvegicus
catcccttgtccattgagctacagg

SEQ ID NO: 238047 - DNA, 25 bp, Rattus norvegicus
catcccttgtcctttgagctacagg

SEQ ID NO: 238048 - DNA, 25 bp, Rattus norvegicus
catccctttgggaagctggacaata

SEQ ID NO: 238049 - DNA, 25 bp, Rattus norvegicus
catccctttgggtagctggacaata

SEQ ID NO: 238050 - DNA, 25 bp, Rattus norvegicus
catcccttttggatccattgttgta

SEQ ID NO: 238051 - DNA, 25 bp, Rattus norvegicus
catcccttttggttccattgttgta

SEQ ID NO: 238052 - DNA, 25 bp, Rattus norvegicus
catccctttttaatttgccctagat

SEQ ID NO: 238053 - DNA, 25 bp, Rattus norvegicus
catccctttttattttgccctagat

SEQ ID NO: 238054 - DNA, 25 bp, Rattus norvegicus
catccgaaatgtaacctggtcagtc

SEQ ID NO: 238055 - DNA, 25 bp, Rattus norvegicus
catccgaaatgttacctggtcagtc

SEQ ID NO: 238056 - DNA, 25 bp, Rattus norvegicus
catccgagatgaccagctctgaagc

SEQ ID NO: 238057 - DNA, 25 bp, Rattus norvegicus
catccgagatgagcagctctgaagc

SEQ ID NO: 238058 - DNA, 25 bp, Rattus norvegicus
catccgatactgaggctgttaaaat

SEQ ID NO: 238059 - DNA, 25 bp, Rattus norvegicus
catccgatactgtggctgttaaaat

SEQ ID NO: 238060 - DNA, 25 bp, Rattus norvegicus
catccgcaaggaattgtatgctaac

SEQ ID NO: 238061 - DNA, 25 bp, Rattus norvegicus
catccgcaaggatttgtatgctaac

SEQ ID NO: 238062 - DNA, 25 bp, Rattus norvegicus
catccgcaatagcagttccttagaa

SEQ ID NO: 238063 - DNA, 25 bp, Rattus norvegicus
catccgcaataggagttccttagaa

SEQ ID NO: 238064 - DNA, 25 bp, Rattus norvegicus
catccgctcggaaatggccttcgtc

SEQ ID NO: 238065 - DNA, 25 bp, Rattus norvegicus
catccgctcggatatggccttcgtc

SEQ ID NO: 238066 - DNA, 25 bp, Rattus norvegicus
catccgctgcatcgtcacagtagag

SEQ ID NO: 238067 - DNA, 25 bp, Rattus norvegicus
catccgctgcatggtcacagtagag

SEQ ID NO: 238068 - DNA, 25 bp, Rattus norvegicus
catccgcttgtcacgggaagagtgt

SEQ ID NO: 238069 - DNA, 25 bp, Rattus norvegicus
catccgcttgtctcgggaagagtgt

SEQ ID NO: 238070 - DNA, 25 bp, Rattus norvegicus
catccggagccgatctcaattgaaa

SEQ ID NO: 238071 - DNA, 25 bp, Rattus norvegicus
catccggagccgttctcaattgaaa

SEQ ID NO: 238072 - DNA, 25 bp, Rattus norvegicus
catccggagcgtcatcaagcagggt

SEQ ID NO: 238073 - DNA, 25 bp, Rattus norvegicus
catccggagcgtgatcaagcagggt

SEQ ID NO: 238074 - DNA, 25 bp, Rattus norvegicus
catccggcaagtattggtggcgtat

SEQ ID NO: 238075 - DNA, 25 bp, Rattus norvegicus
catccggcaagttttggtggcgtat

SEQ ID NO: 238076 - DNA, 25 bp, Rattus norvegicus
catccggcaggaaaggcggcccgaa

SEQ ID NO: 238077 - DNA, 25 bp, Rattus norvegicus
catccggcaggataggcggcccgaa

SEQ ID NO: 238078 - DNA, 25 bp, Rattus norvegicus
catccggcctagaactttacccttg

SEQ ID NO: 238079 - DNA, 25 bp, Rattus norvegicus
catccggcctagtactttacccttg

SEQ ID NO: 238080 - DNA, 25 bp, Rattus norvegicus
catccggcgatgagagtttgggatc

SEQ ID NO: 238081 - DNA, 25 bp, Rattus norvegicus
catccggcgatgtgagtttgggatc

SEQ ID NO: 238082 - DNA, 25 bp, Rattus norvegicus
catccggcttcactgggtagaattt

SEQ ID NO: 238083 - DNA, 25 bp, Rattus norvegicus
catccggcttcagtgggtagaattt

SEQ ID NO: 238084 - DNA, 25 bp, Rattus norvegicus
catccgggaacacggcaacatctac

SEQ ID NO: 238085 - DNA, 25 bp, Rattus norvegicus
catccgggaacagggcaacatctac

SEQ ID NO: 238086 - DNA, 25 bp, Rattus norvegicus
catccggttagcatttgttctttgt

SEQ ID NO: 238087 - DNA, 25 bp, Rattus norvegicus
catccggttagcttttgttctttgt

SEQ ID NO: 238088 - DNA, 25 bp, Rattus norvegicus
catccgtacccaattctagactaat

SEQ ID NO: 238089 - DNA, 25 bp, Rattus norvegicus
catccgtacccatttctagactaat

SEQ ID NO: 238090 - DNA, 25 bp, Rattus norvegicus
catccgtactgtcggtatccttgat

SEQ ID NO: 238091 - DNA, 25 bp, Rattus norvegicus
catccgtactgtgggtatccttgat

SEQ ID NO: 238092 - DNA, 25 bp, Rattus norvegicus
catccgtgatgcatctcatgttgga

SEQ ID NO: 238093 - DNA, 25 bp, Rattus norvegicus
catccgtgatgcttctcatgttgga

SEQ ID NO: 238094 - DNA, 25 bp, Rattus norvegicus
catccgtgtataaataatagaaccc

SEQ ID NO: 238095 - DNA, 25 bp, Rattus norvegicus
catccgtgtatatataatagaaccc

SEQ ID NO: 238096 - DNA, 25 bp, Rattus norvegicus
catccgttaaatactttgttctggt

SEQ ID NO: 238097 - DNA, 25 bp, Rattus norvegicus
catccgttaaattctttgttctggt

SEQ ID NO: 238098 - DNA, 25 bp, Rattus norvegicus
catccgttatgtcaaggctttgcag

SEQ ID NO: 238099 - DNA, 25 bp, Rattus norvegicus
catccgttatgtgaaggctttgcag

SEQ ID NO: 238100 - DNA, 25 bp, Rattus norvegicus
catccgtttcagagcattccagagc

SEQ ID NO: 238101 - DNA, 25 bp, Rattus norvegicus
catccgtttcagtgcattccagagc

SEQ ID NO: 238102 - DNA, 25 bp, Rattus norvegicus
catcctaacagacgttctccaaggg

SEQ ID NO: 238103 - DNA, 25 bp, Rattus norvegicus
catcctaacagaggttctccaaggg

SEQ ID NO: 238104 - DNA, 25 bp, Rattus norvegicus
catcctaacagcattgaattcctta

SEQ ID NO: 238105 - DNA, 25 bp, Rattus norvegicus
catcctaacagctttgaattcctta

SEQ ID NO: 238106 - DNA, 25 bp, Rattus norvegicus
catcctaaccccatggagcctgggt

SEQ ID NO: 238107 - DNA, 25 bp, Rattus norvegicus
catcctaaccccttggagcctgggt

SEQ ID NO: 238108 - DNA, 25 bp, Rattus norvegicus
catcctaactgccttaattccgagg

SEQ ID NO: 238109 - DNA, 25 bp, Rattus norvegicus
catcctaactgcgttaattccgagg

SEQ ID NO: 238110 - DNA, 25 bp, Rattus norvegicus
catcctaaggatcgtactggctttc

SEQ ID NO: 238111 - DNA, 25 bp, Rattus norvegicus
catcctaaggatggtactggctttc

SEQ ID NO: 238112 - DNA, 25 bp, Rattus norvegicus
catcctacttcaactagttagcaag

SEQ ID NO: 238113 - DNA, 25 bp, Rattus norvegicus
catcctacttcatctagttagcaag

SEQ ID NO: 238114 - DNA, 25 bp, Rattus norvegicus
catcctacttgaatgtgcctttgta

SEQ ID NO: 238115 - DNA, 25 bp, Rattus norvegicus
catcctacttgattgtgcctttgta

SEQ ID NO: 238116 - DNA, 25 bp, Rattus norvegicus
catcctagcctcagaatgggaaggt

SEQ ID NO: 238117 - DNA, 25 bp, Rattus norvegicus
catcctagcctctgaatgggaaggt

SEQ ID NO: 238118 - DNA, 25 bp, Rattus norvegicus
catcctagcctgattctatgggagg

SEQ ID NO: 238119 - DNA, 25 bp, Rattus norvegicus
catcctagcctgtttctatgggagg

SEQ ID NO: 238120 - DNA, 25 bp, Rattus norvegicus
catcctatgcaaaactgtgtggcca

SEQ ID NO: 238121 - DNA, 25 bp, Rattus norvegicus
catcctatgcaatactgtgtggcca

SEQ ID NO: 238122 - DNA, 25 bp, Rattus norvegicus
catcctcacattctcagcatattta

SEQ ID NO: 238123 - DNA, 25 bp, Rattus norvegicus
catcctcacattgtcagcatattta

SEQ ID NO: 238124 - DNA, 25 bp, Rattus norvegicus
catcctcaccctcttaaagtgggat

SEQ ID NO: 238125 - DNA, 25 bp, Rattus norvegicus
catcctcaccctgttaaagtgggat

SEQ ID NO: 238126 - DNA, 25 bp, Rattus norvegicus
catcctcactaacttgtctcttgta

SEQ ID NO: 238127 - DNA, 25 bp, Rattus norvegicus
catcctcactaagttgtctcttgta

SEQ ID NO: 238128 - DNA, 25 bp, Rattus norvegicus
catcctcactgtcgattttagagag

SEQ ID NO: 238129 - DNA, 25 bp, Rattus norvegicus
catcctcactgtggattttagagag

SEQ ID NO: 238130 - DNA, 25 bp, Rattus norvegicus
catcctcagagcagtggttccaaaa

SEQ ID NO: 238131 - DNA, 25 bp, Rattus norvegicus
catcctcagagctgtggttccaaaa

SEQ ID NO: 238132 - DNA, 25 bp, Rattus norvegicus
catcctcagctaccttgacatgaag

SEQ ID NO: 238133 - DNA, 25 bp, Rattus norvegicus
catcctcagctagcttgacatgaag

SEQ ID NO: 238134 - DNA, 25 bp, Rattus norvegicus
catcctcagcttcgtaacagttcaa

SEQ ID NO: 238135 - DNA, 25 bp, Rattus norvegicus
catcctcagcttggtaacagttcaa

SEQ ID NO: 238136 - DNA, 25 bp, Rattus norvegicus
catcctcaggtgcaatgctttcagg

SEQ ID NO: 238137 - DNA, 25 bp, Rattus norvegicus
catcctcaggtggaatgctttcagg

SEQ ID NO: 238138 - DNA, 25 bp, Rattus norvegicus
catcctcagtgtccccgggaattga

SEQ ID NO: 238139 - DNA, 25 bp, Rattus norvegicus
catcctcagtgtgcccgggaattga

SEQ ID NO: 238140 - DNA, 25 bp, Rattus norvegicus
catcctcataagcaggcatgtcagg

SEQ ID NO: 238141 - DNA, 25 bp, Rattus norvegicus
catcctcataaggaggcatgtcagg

SEQ ID NO: 238142 - DNA, 25 bp, Rattus norvegicus
catcctcatgagatagtattacagt

SEQ ID NO: 238143 - DNA, 25 bp, Rattus norvegicus
catcctcatgagttagtattacagt

SEQ ID NO: 238144 - DNA, 25 bp, Rattus norvegicus
catcctcatttccaactataatcca

SEQ ID NO: 238145 - DNA, 25 bp, Rattus norvegicus
catcctcatttcgaactataatcca

SEQ ID NO: 238146 - DNA, 25 bp, Rattus norvegicus
catcctccagagctcgagactgtag

SEQ ID NO: 238147 - DNA, 25 bp, Rattus norvegicus
catcctccagaggtcgagactgtag

SEQ ID NO: 238148 - DNA, 25 bp, Rattus norvegicus
catcctccagtgatggccggaagaa

SEQ ID NO: 238149 - DNA, 25 bp, Rattus norvegicus
catcctccagtgttggccggaagaa

SEQ ID NO: 238150 - DNA, 25 bp, Rattus norvegicus
catcctccatctctgacataaatgc

SEQ ID NO: 238151 - DNA, 25 bp, Rattus norvegicus
catcctccatctgtgacataaatgc

SEQ ID NO: 238152 - DNA, 25 bp, Rattus norvegicus
catcctccccaaacctgtatataga

SEQ ID NO: 238153 - DNA, 25 bp, Rattus norvegicus
catcctccccaatcctgtatataga

SEQ ID NO: 238154 - DNA, 25 bp, Rattus norvegicus
catcctcccttcaataatgcttgta

SEQ ID NO: 238155 - DNA, 25 bp, Rattus norvegicus
catcctcccttctataatgcttgta

SEQ ID NO: 238156 - DNA, 25 bp, Rattus norvegicus
catcctccggataaacaccattgag

SEQ ID NO: 238157 - DNA, 25 bp, Rattus norvegicus
catcctccggattaacaccattgag

SEQ ID NO: 238158 - DNA, 25 bp, Rattus norvegicus
catcctcctcttagtattattgtac

SEQ ID NO: 238159 - DNA, 25 bp, Rattus norvegicus
catcctcctctttgtattattgtac

SEQ ID NO: 238160 - DNA, 25 bp, Rattus norvegicus
catcctcctgagagtgatctccctg

SEQ ID NO: 238161 - DNA, 25 bp, Rattus norvegicus
catcctcctgagtgtgatctccctg

SEQ ID NO: 238162 - DNA, 25 bp, Rattus norvegicus
catcctcgcgcgacctcaggtctgt

SEQ ID NO: 238163 - DNA, 25 bp, Rattus norvegicus
catcctcgcgcgtcctcaggtctgt

SEQ ID NO: 238164 - DNA, 25 bp, Rattus norvegicus
catcctctacttatcttgctttctt

SEQ ID NO: 238165 - DNA, 25 bp, Rattus norvegicus
catcctctacttttcttgctttctt

SEQ ID NO: 238166 - DNA, 25 bp, Rattus norvegicus
catcctctaggtatgtagtgggctt

SEQ ID NO: 238167 - DNA, 25 bp, Rattus norvegicus
catcctctaggtttgtagtgggctt

SEQ ID NO: 238168 - DNA, 25 bp, Rattus norvegicus
catcctctcagaagctcttgagtta

SEQ ID NO: 238169 - DNA, 25 bp, Rattus norvegicus
catcctctcagatgctcttgagtta

SEQ ID NO: 238170 - DNA, 25 bp, Rattus norvegicus
catcctctgactagtattctttcta

SEQ ID NO: 238171 - DNA, 25 bp, Rattus norvegicus
catcctctgacttgtattctttcta

SEQ ID NO: 238172 - DNA, 25 bp, Rattus norvegicus
catcctctgtacaatgttcactcgt

SEQ ID NO: 238173 - DNA, 25 bp, Rattus norvegicus
catcctctgtactatgttcactcgt

SEQ ID NO: 238174 - DNA, 25 bp, Rattus norvegicus
catcctctgttgcattcccagtata

SEQ ID NO: 238175 - DNA, 25 bp, Rattus norvegicus
catcctctgttggattcccagtata

SEQ ID NO: 238176 - DNA, 25 bp, Rattus norvegicus
catcctcttcatcccattgataagt

SEQ ID NO: 238177 - DNA, 25 bp, Rattus norvegicus
catcctcttcatgccattgataagt

SEQ ID NO: 238178 - DNA, 25 bp, Rattus norvegicus
catcctgaactacagaaccctttat

SEQ ID NO: 238179 - DNA, 25 bp, Rattus norvegicus
catcctgaactagagaaccctttat

SEQ ID NO: 238180 - DNA, 25 bp, Rattus norvegicus
catcctgaactccatgcacaagtac

SEQ ID NO: 238181 - DNA, 25 bp, Rattus norvegicus
catcctgaactcgatgcacaagtac

SEQ ID NO: 238182 - DNA, 25 bp, Rattus norvegicus
catcctgacaggcaaccaagttagc

SEQ ID NO: 238183 - DNA, 25 bp, Rattus norvegicus
catcctgacagggaaccaagttagc

SEQ ID NO: 238184 - DNA, 25 bp, Rattus norvegicus
catcctgaccccacgtataaaagtt

SEQ ID NO: 238185 - DNA, 25 bp, Rattus norvegicus
catcctgacccctcgtataaaagtt

SEQ ID NO: 238186 - DNA, 25 bp, Rattus norvegicus
catcctgactgaacctcaatctgaa

SEQ ID NO: 238187 - DNA, 25 bp, Rattus norvegicus
catcctgactgatcctcaatctgaa

SEQ ID NO: 238188 - DNA, 25 bp, Rattus norvegicus
catcctgagactctgctgtgcggtg

SEQ ID NO: 238189 - DNA, 25 bp, Rattus norvegicus
catcctgagactgtgctgtgcggtg

SEQ ID NO: 238190 - DNA, 25 bp, Rattus norvegicus
catcctgagaggcttcattccgaga

SEQ ID NO: 238191 - DNA, 25 bp, Rattus norvegicus
catcctgagagggttcattccgaga

SEQ ID NO: 238192 - DNA, 25 bp, Rattus norvegicus
catcctgaggaccagcatgtcttaa

SEQ ID NO: 238193 - DNA, 25 bp, Rattus norvegicus
catcctgaggacgagcatgtcttaa

SEQ ID NO: 238194 - DNA, 25 bp, Rattus norvegicus
catcctgcagcaatcaggcctggct

SEQ ID NO: 238195 - DNA, 25 bp, Rattus norvegicus
catcctgcagcaccgctatgaaggg

SEQ ID NO: 238196 - DNA, 25 bp, Rattus norvegicus
catcctgcagcagcgctatgaaggg

SEQ ID NO: 238197 - DNA, 25 bp, Rattus norvegicus
catcctgcagcattcaggcctggct

SEQ ID NO: 238198 - DNA, 25 bp, Rattus norvegicus
catcctgcaggtcgtcacgagtcgg

SEQ ID NO: 238199 - DNA, 25 bp, Rattus norvegicus
catcctgcaggtggtcacgagtcgg

SEQ ID NO: 238200 - DNA, 25 bp, Rattus norvegicus
catcctgcatcacagactggtttgg

SEQ ID NO: 238201 - DNA, 25 bp, Rattus norvegicus
catcctgcatcagagactggtttgg

SEQ ID NO: 238202 - DNA, 25 bp, Rattus norvegicus
catcctgcccagagtgacgagaaag

SEQ ID NO: 238203 - DNA, 25 bp, Rattus norvegicus
catcctgcccagtgtgacgagaaag

SEQ ID NO: 238204 - DNA, 25 bp, Rattus norvegicus
catcctgcgctaattgacgaacgaa

SEQ ID NO: 238205 - DNA, 25 bp, Rattus norvegicus
catcctgcgctatttgacgaacgaa

SEQ ID NO: 238206 - DNA, 25 bp, Rattus norvegicus
catcctgcgcttcctttgaaaagag

SEQ ID NO: 238207 - DNA, 25 bp, Rattus norvegicus
catcctgcgcttgctttgaaaagag

SEQ ID NO: 238208 - DNA, 25 bp, Rattus norvegicus
catcctgctaggctccactggaaag

SEQ ID NO: 238209 - DNA, 25 bp, Rattus norvegicus
catcctgctagggtccactggaaag

SEQ ID NO: 238210 - DNA, 25 bp, Rattus norvegicus
catcctgctctcatagactgcaaga

SEQ ID NO: 238211 - DNA, 25 bp, Rattus norvegicus
catcctgctctcttagactgcaaga

SEQ ID NO: 238212 - DNA, 25 bp, Rattus norvegicus
catcctgcttgcattctgtataaaa

SEQ ID NO: 238213 - DNA, 25 bp, Rattus norvegicus
catcctgcttgctttctgtataaaa

SEQ ID NO: 238214 - DNA, 25 bp, Rattus norvegicus
catcctgctttgagaagtgtacacg

SEQ ID NO: 238215 - DNA, 25 bp, Rattus norvegicus
catcctgctttgtgaagtgtacacg

SEQ ID NO: 238216 - DNA, 25 bp, Rattus norvegicus
catcctggagaacggcacacgggca

SEQ ID NO: 238217 - DNA, 25 bp, Rattus norvegicus
catcctggagaagggcacacgggca

SEQ ID NO: 238218 - DNA, 25 bp, Rattus norvegicus
catcctgggaacacagattgtcctc

SEQ ID NO: 238219 - DNA, 25 bp, Rattus norvegicus
catcctgggaactcagattgtcctc

SEQ ID NO: 238220 - DNA, 25 bp, Rattus norvegicus
catcctgggatgatcattggcttga

SEQ ID NO: 238221 - DNA, 25 bp, Rattus norvegicus
catcctgggatgctgtgaactgtca

SEQ ID NO: 238222 - DNA, 25 bp, Rattus norvegicus
catcctgggatggtgtgaactgtca

SEQ ID NO: 238223 - DNA, 25 bp, Rattus norvegicus
catcctgggatgttcattggcttga

SEQ ID NO: 238224 - DNA, 25 bp, Rattus norvegicus
catcctgggtggaggtcgctgtact

SEQ ID NO: 238225 - DNA, 25 bp, Rattus norvegicus
catcctgggtggtggtcgctgtact

SEQ ID NO: 238226 - DNA, 25 bp, Rattus norvegicus
catcctggtttgactttcagagtaa

SEQ ID NO: 238227 - DNA, 25 bp, Rattus norvegicus
catcctggtttgtctttcagagtaa

SEQ ID NO: 238228 - DNA, 25 bp, Rattus norvegicus
catcctgtaccaactttaggcacaa

SEQ ID NO: 238229 - DNA, 25 bp, Rattus norvegicus
catcctgtaccatctttaggcacaa

SEQ ID NO: 238230 - DNA, 25 bp, Rattus norvegicus
catcctgtccccagaacagttaaaa

SEQ ID NO: 238231 - DNA, 25 bp, Rattus norvegicus
catcctgtcccctgaacagttaaaa

SEQ ID NO: 238232 - DNA, 25 bp, Rattus norvegicus
catcctgtctggacggttggtctca

SEQ ID NO: 238233 - DNA, 25 bp, Rattus norvegicus
catcctgtctggtcggttggtctca

SEQ ID NO: 238234 - DNA, 25 bp, Rattus norvegicus
catcctgtctgtatggcttcataaa

SEQ ID NO: 238235 - DNA, 25 bp, Rattus norvegicus
catcctgtctgtttggcttcataaa

SEQ ID NO: 238236 - DNA, 25 bp, Rattus norvegicus
catcctgtgcaaaatgccgtgtaga

SEQ ID NO: 238237 - DNA, 25 bp, Rattus norvegicus
catcctgtgcaatatgccgtgtaga

SEQ ID NO: 238238 - DNA, 25 bp, Rattus norvegicus
catcctgtgcctactttgtatatgg

SEQ ID NO: 238239 - DNA, 25 bp, Rattus norvegicus
catcctgtgccttctttgtatatgg

SEQ ID NO: 238240 - DNA, 25 bp, Rattus norvegicus
catcctgtggccatgtttcgagacc

SEQ ID NO: 238241 - DNA, 25 bp, Rattus norvegicus
catcctgtggccttgtttcgagacc

SEQ ID NO: 238242 - DNA, 25 bp, Rattus norvegicus
catcctgtgggaagggaccgtgttt

SEQ ID NO: 238243 - DNA, 25 bp, Rattus norvegicus
catcctgtgggatgggaccgtgttt

SEQ ID NO: 238244 - DNA, 25 bp, Rattus norvegicus
catcctgttcctatgtgacatgcag

SEQ ID NO: 238245 - DNA, 25 bp, Rattus norvegicus
catcctgttcctttgtgacatgcag

SEQ ID NO: 238246 - DNA, 25 bp, Rattus norvegicus
catccttacgccattgagacagggt

SEQ ID NO: 238247 - DNA, 25 bp, Rattus norvegicus
catccttacgcctttgagacagggt

SEQ ID NO: 238248 - DNA, 25 bp, Rattus norvegicus
catccttacttacactttcactaga

SEQ ID NO: 238249 - DNA, 25 bp, Rattus norvegicus
catccttacttagactttcactaga

SEQ ID NO: 238250 - DNA, 25 bp, Rattus norvegicus
catccttaggcaatcagggctttga

SEQ ID NO: 238251 - DNA, 25 bp, Rattus norvegicus
catccttaggcattcagggctttga

SEQ ID NO: 238252 - DNA, 25 bp, Rattus norvegicus
catccttcagatacttggtggcttt

SEQ ID NO: 238253 - DNA, 25 bp, Rattus norvegicus
catccttcagattcttggtggcttt

SEQ ID NO: 238254 - DNA, 25 bp, Rattus norvegicus
catccttcatcaatgtcatgttctc

SEQ ID NO: 238255 - DNA, 25 bp, Rattus norvegicus
catccttcatcattgtcatgttctc

SEQ ID NO: 238256 - DNA, 25 bp, Rattus norvegicus
catccttccattctgtagggctgaa

SEQ ID NO: 238257 - DNA, 25 bp, Rattus norvegicus
catccttccattgtgtagggctgaa

SEQ ID NO: 238258 - DNA, 25 bp, Rattus norvegicus
catccttcctttactgaactcttat

SEQ ID NO: 238259 - DNA, 25 bp, Rattus norvegicus
catccttccttttctgaactcttat

SEQ ID NO: 238260 - DNA, 25 bp, Rattus norvegicus
catccttcgcctactgataatttgg

SEQ ID NO: 238261 - DNA, 25 bp, Rattus norvegicus
catccttcgccttctgataatttgg

SEQ ID NO: 238262 - DNA, 25 bp, Rattus norvegicus
catccttctcagacttatcttgagg

SEQ ID NO: 238263 - DNA, 25 bp, Rattus norvegicus
catccttctcagtcttatcttgagg

SEQ ID NO: 238264 - DNA, 25 bp, Rattus norvegicus
catccttctgtaaaattcactctta

SEQ ID NO: 238265 - DNA, 25 bp, Rattus norvegicus
catccttctgtataattcactctta

SEQ ID NO: 238266 - DNA, 25 bp, Rattus norvegicus
catccttctgtgcactggacaagag

SEQ ID NO: 238267 - DNA, 25 bp, Rattus norvegicus
catccttctgtggactggacaagag

SEQ ID NO: 238268 - DNA, 25 bp, Rattus norvegicus
catccttctttaacctgactgtcaa

SEQ ID NO: 238269 - DNA, 25 bp, Rattus norvegicus
catccttctttatcctgactgtcaa

SEQ ID NO: 238270 - DNA, 25 bp, Rattus norvegicus
catccttgaggaattggtcttccca

SEQ ID NO: 238271 - DNA, 25 bp, Rattus norvegicus
catccttgaggatttggtcttccca

SEQ ID NO: 238272 - DNA, 25 bp, Rattus norvegicus
catccttgcctgaaatgtgaatgtg

SEQ ID NO: 238273 - DNA, 25 bp, Rattus norvegicus
catccttgcctgtaatgtgaatgtg

SEQ ID NO: 238274 - DNA, 25 bp, Rattus norvegicus
catccttggctcactgttctcaggg

SEQ ID NO: 238275 - DNA, 25 bp, Rattus norvegicus
catccttggctctctgttctcaggg

SEQ ID NO: 238276 - DNA, 25 bp, Rattus norvegicus
catcctttacccatctactattaag

SEQ ID NO: 238277 - DNA, 25 bp, Rattus norvegicus
catcctttacccttctactattaag

SEQ ID NO: 238278 - DNA, 25 bp, Rattus norvegicus
catcctttatggacttcccatttac

SEQ ID NO: 238279 - DNA, 25 bp, Rattus norvegicus
catcctttatggtcttcccatttac

SEQ ID NO: 238280 - DNA, 25 bp, Rattus norvegicus
catcctttgagcagtgggactcggg

SEQ ID NO: 238281 - DNA, 25 bp, Rattus norvegicus
catcctttgagctgtgggactcggg

SEQ ID NO: 238282 - DNA, 25 bp, Rattus norvegicus
catccttttcatcccgggagagaag

SEQ ID NO: 238283 - DNA, 25 bp, Rattus norvegicus
catccttttcatgccgggagagaag

SEQ ID NO: 238284 - DNA, 25 bp, Rattus norvegicus
catccttttggcaatacccgtgaat

SEQ ID NO: 238285 - DNA, 25 bp, Rattus norvegicus
catccttttggctatacccgtgaat

SEQ ID NO: 238286 - DNA, 25 bp, Rattus norvegicus
catccttttgtcacactcgttgaaa

SEQ ID NO: 238287 - DNA, 25 bp, Rattus norvegicus
catccttttgtctcactcgttgaaa

SEQ ID NO: 238288 - DNA, 25 bp, Rattus norvegicus
catcgaaagcagaaacgtcctcctc

SEQ ID NO: 238289 - DNA, 25 bp, Rattus norvegicus
catcgaaagcagtaacgtcctcctc

SEQ ID NO: 238290 - DNA, 25 bp, Rattus norvegicus
catcgaagacatcgtggccagcgtg

SEQ ID NO: 238291 - DNA, 25 bp, Rattus norvegicus
catcgaagacatggtggccagcgtg

SEQ ID NO: 238292 - DNA, 25 bp, Rattus norvegicus
catcgaagctaacgttatttgtgga

SEQ ID NO: 238293 - DNA, 25 bp, Rattus norvegicus
catcgaagctaaggttatttgtgga

SEQ ID NO: 238294 - DNA, 25 bp, Rattus norvegicus
catcgaatcagtcccatccattgct

SEQ ID NO: 238295 - DNA, 25 bp, Rattus norvegicus
catcgaatcagtgccatccattgct

SEQ ID NO: 238296 - DNA, 25 bp, Rattus norvegicus
catcgacagtctcttctcattaggg

SEQ ID NO: 238297 - DNA, 25 bp, Rattus norvegicus
catcgacagtctgttctcattaggg

SEQ ID NO: 238298 - DNA, 25 bp, Rattus norvegicus
catcgaccgctgagtggaggccttt

SEQ ID NO: 238299 - DNA, 25 bp, Rattus norvegicus
catcgaccgctgtgtggaggccttt

SEQ ID NO: 238300 - DNA, 25 bp, Rattus norvegicus
catcgagatcagatttgaggcgtct

SEQ ID NO: 238301 - DNA, 25 bp, Rattus norvegicus
catcgagatcagttttgaggcgtct

SEQ ID NO: 238302 - DNA, 25 bp, Rattus norvegicus
catcgagcagatatacccagtcaac

SEQ ID NO: 238303 - DNA, 25 bp, Rattus norvegicus
catcgagcagatttacccagtcaac

SEQ ID NO: 238304 - DNA, 25 bp, Rattus norvegicus
catcgaggagcacagctgggcacac

SEQ ID NO: 238305 - DNA, 25 bp, Rattus norvegicus
catcgaggagcagagctgggcacac

SEQ ID NO: 238306 - DNA, 25 bp, Rattus norvegicus
catcgaggcacaactgacccaggaa

SEQ ID NO: 238307 - DNA, 25 bp, Rattus norvegicus
catcgaggcacatctgacccaggaa

SEQ ID NO: 238308 - DNA, 25 bp, Rattus norvegicus
catcgagtctggatctagtgccttc

SEQ ID NO: 238309 - DNA, 25 bp, Rattus norvegicus
catcgagtctggttctagtgccttc

SEQ ID NO: 238310 - DNA, 25 bp, Rattus norvegicus
catcgatcgctgcagacggagtgaa

SEQ ID NO: 238311 - DNA, 25 bp, Rattus norvegicus
catcgatcgctggagacggagtgaa

SEQ ID NO: 238312 - DNA, 25 bp, Rattus norvegicus
catcgcagagctactcattgtggct

SEQ ID NO: 238313 - DNA, 25 bp, Rattus norvegicus
catcgcagagcttctcattgtggct

SEQ ID NO: 238314 - DNA, 25 bp, Rattus norvegicus
catcgcaggcccctttcttcttttt

SEQ ID NO: 238315 - DNA, 25 bp, Rattus norvegicus
catcgcaggcccgtttcttcttttt

SEQ ID NO: 238316 - DNA, 25 bp, Rattus norvegicus
catcgcaggcggaagcttgttcatc

SEQ ID NO: 238317 - DNA, 25 bp, Rattus norvegicus
catcgcaggcggtagcttgttcatc

SEQ ID NO: 238318 - DNA, 25 bp, Rattus norvegicus
catcgcattgtcaggtgtgcctggt

SEQ ID NO: 238319 - DNA, 25 bp, Rattus norvegicus
catcgcattgtctggtgtgcctggt

SEQ ID NO: 238320 - DNA, 25 bp, Rattus norvegicus
catcgccactcacagttgcaaagaa

SEQ ID NO: 238321 - DNA, 25 bp, Rattus norvegicus
catcgccactcagagttgcaaagaa

SEQ ID NO: 238322 - DNA, 25 bp, Rattus norvegicus
catcgccgacggagccatgatggag

SEQ ID NO: 238323 - DNA, 25 bp, Rattus norvegicus
catcgccgacggtgccatgatggag

SEQ ID NO: 238324 - DNA, 25 bp, Rattus norvegicus
catcgccgggcgacgacgaggagga

SEQ ID NO: 238325 - DNA, 25 bp, Rattus norvegicus
catcgccgggcgtcgacgaggagga

SEQ ID NO: 238326 - DNA, 25 bp, Rattus norvegicus
catcgcctatccaagggtcttgaag

SEQ ID NO: 238327 - DNA, 25 bp, Rattus norvegicus
catcgcctatcctagggtcttgaag

SEQ ID NO: 238328 - DNA, 25 bp, Rattus norvegicus
catcgcctggatcaggtttgacagt

SEQ ID NO: 238329 - DNA, 25 bp, Rattus norvegicus
catcgcctggatgaggtttgacagt

SEQ ID NO: 238330 - DNA, 25 bp, Rattus norvegicus
catcgcctggtaagatgctggcagt

SEQ ID NO: 238331 - DNA, 25 bp, Rattus norvegicus
catcgcctggtatgatgctggcagt

SEQ ID NO: 238332 - DNA, 25 bp, Rattus norvegicus
catcgcgccgtactacaggtgcaga

SEQ ID NO: 238333 - DNA, 25 bp, Rattus norvegicus
catcgcgccgtagtacaggtgcaga

SEQ ID NO: 238334 - DNA, 25 bp, Rattus norvegicus
catcgcggcgggagccagcttcctg

SEQ ID NO: 238335 - DNA, 25 bp, Rattus norvegicus
catcgcggcgggtgccagcttcctg

SEQ ID NO: 238336 - DNA, 25 bp, Rattus norvegicus
catcgcggctgcacggagaggtctc

SEQ ID NO: 238337 - DNA, 25 bp, Rattus norvegicus
catcgcggctgctcggagaggtctc

SEQ ID NO: 238338 - DNA, 25 bp, Rattus norvegicus
catcgcgtgtttcttttctgctgga

SEQ ID NO: 238339 - DNA, 25 bp, Rattus norvegicus
catcgcgtgtttgttttctgctgga

SEQ ID NO: 238340 - DNA, 25 bp, Rattus norvegicus
catcgctcattcactgtgcagattg

SEQ ID NO: 238341 - DNA, 25 bp, Rattus norvegicus
catcgctcattctctgtgcagattg

SEQ ID NO: 238342 - DNA, 25 bp, Rattus norvegicus
catcgctctcacagtcctggcaggg

SEQ ID NO: 238343 - DNA, 25 bp, Rattus norvegicus
catcgctctcactgtcctggcaggg

SEQ ID NO: 238344 - DNA, 25 bp, Rattus norvegicus
catcgctgacagcatgcagaaggag

SEQ ID NO: 238345 - DNA, 25 bp, Rattus norvegicus
catcgctgacaggatgcagaaggag

SEQ ID NO: 238346 - DNA, 25 bp, Rattus norvegicus
catcgctgatgtctacggcaagtga

SEQ ID NO: 238347 - DNA, 25 bp, Rattus norvegicus
catcgctgatgtgtacggcaagtga

SEQ ID NO: 238348 - DNA, 25 bp, Rattus norvegicus
catcgctgcagacgagccgggctct

SEQ ID NO: 238349 - DNA, 25 bp, Rattus norvegicus
catcgctgcagaggagccgggctct

SEQ ID NO: 238350 - DNA, 25 bp, Rattus norvegicus
catcgctggccaattccgaaaggag

SEQ ID NO: 238351 - DNA, 25 bp, Rattus norvegicus
catcgctggccatttccgaaaggag

SEQ ID NO: 238352 - DNA, 25 bp, Rattus norvegicus
catcgctttagtcggagggagacat

SEQ ID NO: 238353 - DNA, 25 bp, Rattus norvegicus
catcgctttagtgggagggagacat

SEQ ID NO: 238354 - DNA, 25 bp, Rattus norvegicus
catcggaagtcgcacgccggtgacc

SEQ ID NO: 238355 - DNA, 25 bp, Rattus norvegicus
catcggaagtcggacgccggtgacc

SEQ ID NO: 238356 - DNA, 25 bp, Rattus norvegicus
catcggatctctcggaagtggagct

SEQ ID NO: 238357 - DNA, 25 bp, Rattus norvegicus
catcggatctctgggaagtggagct

SEQ ID NO: 238358 - DNA, 25 bp, Rattus norvegicus
catcggatgctgattttctgcctga

SEQ ID NO: 238359 - DNA, 25 bp, Rattus norvegicus
catcggatgctgtttttctgcctga

SEQ ID NO: 238360 - DNA, 25 bp, Rattus norvegicus
catcggattttcaactgcttctcaa

SEQ ID NO: 238361 - DNA, 25 bp, Rattus norvegicus
catcggattttctactgcttctcaa

SEQ ID NO: 238362 - DNA, 25 bp, Rattus norvegicus
catcggctaagcagggtgtgagtaa

SEQ ID NO: 238363 - DNA, 25 bp, Rattus norvegicus
catcggctaagctgggtgtgagtaa

SEQ ID NO: 238364 - DNA, 25 bp, Rattus norvegicus
catcggcttgcgatttagtcttaat

SEQ ID NO: 238365 - DNA, 25 bp, Rattus norvegicus
catcggcttgcgttttagtcttaat

SEQ ID NO: 238366 - DNA, 25 bp, Rattus norvegicus
catcggcttggtctggttccagtgt

SEQ ID NO: 238367 - DNA, 25 bp, Rattus norvegicus
catcggcttggtgtggttccagtgt

SEQ ID NO: 238368 - DNA, 25 bp, Rattus norvegicus
catcgggaaccgcagggagctaaat

SEQ ID NO: 238369 - DNA, 25 bp, Rattus norvegicus
catcgggaaccggagggagctaaat

SEQ ID NO: 238370 - DNA, 25 bp, Rattus norvegicus
catcgggagggcactcaccaggaag

SEQ ID NO: 238371 - DNA, 25 bp, Rattus norvegicus
catcgggagggctctcaccaggaag

SEQ ID NO: 238372 - DNA, 25 bp, Rattus norvegicus
catcgggttcccataaagtcagtct

SEQ ID NO: 238373 - DNA, 25 bp, Rattus norvegicus
catcgggttcccttaaagtcagtct

SEQ ID NO: 238374 - DNA, 25 bp, Rattus norvegicus
catcgggttgataattttattgctt

SEQ ID NO: 238375 - DNA, 25 bp, Rattus norvegicus
catcgggttgattattttattgctt

SEQ ID NO: 238376 - DNA, 25 bp, Rattus norvegicus
catcggtaatgaaacagcctcctca

SEQ ID NO: 238377 - DNA, 25 bp, Rattus norvegicus
catcggtaatgatacagcctcctca

SEQ ID NO: 238378 - DNA, 25 bp, Rattus norvegicus
catcggtggcagagactcctacaat

SEQ ID NO: 238379 - DNA, 25 bp, Rattus norvegicus
catcggtggcagtgactcctacaat

SEQ ID NO: 238380 - DNA, 25 bp, Rattus norvegicus
catcggttatgtatgtcaggtcttc

SEQ ID NO: 238381 - DNA, 25 bp, Rattus norvegicus
catcggttatgtttgtcaggtcttc

SEQ ID NO: 238382 - DNA, 25 bp, Rattus norvegicus
catcgtacctgcagtttgctacatg

SEQ ID NO: 238383 - DNA, 25 bp, Rattus norvegicus
catcgtacctgctgtttgctacatg

SEQ ID NO: 238384 - DNA, 25 bp, Rattus norvegicus
catcgtactcctactcaaatgacaa

SEQ ID NO: 238385 - DNA, 25 bp, Rattus norvegicus
catcgtactccttctcaaatgacaa

SEQ ID NO: 238386 - DNA, 25 bp, Rattus norvegicus
catcgtactgtaagcgagagtccgc

SEQ ID NO: 238387 - DNA, 25 bp, Rattus norvegicus
catcgtactgtatgcgagagtccgc

SEQ ID NO: 238388 - DNA, 25 bp, Rattus norvegicus
catcgtagtagcatttcttgtgtgt

SEQ ID NO: 238389 - DNA, 25 bp, Rattus norvegicus
catcgtagtagcttttcttgtgtgt

SEQ ID NO: 238390 - DNA, 25 bp, Rattus norvegicus
catcgtcactagcttatcctctggg

SEQ ID NO: 238391 - DNA, 25 bp, Rattus norvegicus
catcgtcactaggttatcctctggg

SEQ ID NO: 238392 - DNA, 25 bp, Rattus norvegicus
catcgtcggctgatataggtcgtgg

SEQ ID NO: 238393 - DNA, 25 bp, Rattus norvegicus
catcgtcggctgttataggtcgtgg

SEQ ID NO: 238394 - DNA, 25 bp, Rattus norvegicus
catcgtcttccaaattctcacataa

SEQ ID NO: 238395 - DNA, 25 bp, Rattus norvegicus
catcgtcttccatattctcacataa

SEQ ID NO: 238396 - DNA, 25 bp, Rattus norvegicus
catcgtgaccgtcgttgtctctcac

SEQ ID NO: 238397 - DNA, 25 bp, Rattus norvegicus
catcgtgaccgtggttgtctctcac

SEQ ID NO: 238398 - DNA, 25 bp, Rattus norvegicus
catcgtgatgccagacttagtaaga

SEQ ID NO: 238399 - DNA, 25 bp, Rattus norvegicus
catcgtgatgcctgacttagtaaga

SEQ ID NO: 238400 - DNA, 25 bp, Rattus norvegicus
catcgtgatgctagagttctctttt

SEQ ID NO: 238401 - DNA, 25 bp, Rattus norvegicus
catcgtgatgcttgagttctctttt

SEQ ID NO: 238402 - DNA, 25 bp, Rattus norvegicus
catcgtgatggccattgccgggaac

SEQ ID NO: 238403 - DNA, 25 bp, Rattus norvegicus
catcgtgatggcgattgccgggaac

SEQ ID NO: 238404 - DNA, 25 bp, Rattus norvegicus
catcgtgcaccgcaaatgcttctag

SEQ ID NO: 238405 - DNA, 25 bp, Rattus norvegicus
catcgtgcaccgctacatgagcatc

SEQ ID NO: 238406 - DNA, 25 bp, Rattus norvegicus
catcgtgcaccggaaatgcttctag

SEQ ID NO: 238407 - DNA, 25 bp, Rattus norvegicus
catcgtgcaccggtacatgagcatc

SEQ ID NO: 238408 - DNA, 25 bp, Rattus norvegicus
catcgtgctagaccagcaggtgaga

SEQ ID NO: 238409 - DNA, 25 bp, Rattus norvegicus
catcgtgctagagcagcaggtgaga

SEQ ID NO: 238410 - DNA, 25 bp, Rattus norvegicus
catcgtgggccgccctaggcaccag

SEQ ID NO: 238411 - DNA, 25 bp, Rattus norvegicus
catcgtgggccggcctaggcaccag

SEQ ID NO: 238412 - DNA, 25 bp, Rattus norvegicus
catcgtgtcccacgaaagggcggcc

SEQ ID NO: 238413 - DNA, 25 bp, Rattus norvegicus
catcgtgtcccaggaaagggcggcc

SEQ ID NO: 238414 - DNA, 25 bp, Rattus norvegicus
catcgtgtcctactggctattctgt

SEQ ID NO: 238415 - DNA, 25 bp, Rattus norvegicus
catcgtgtcctagtggctattctgt

SEQ ID NO: 238416 - DNA, 25 bp, Rattus norvegicus
catcgtgtctgtctcctgtggaaaa

SEQ ID NO: 238417 - DNA, 25 bp, Rattus norvegicus
catcgtgtctgtgtcctgtggaaaa

SEQ ID NO: 238418 - DNA, 25 bp, Rattus norvegicus
catcgtgtgctgatgtttgtgtgca

SEQ ID NO: 238419 - DNA, 25 bp, Rattus norvegicus
catcgtgtgctgttgtttgtgtgca

SEQ ID NO: 238420 - DNA, 25 bp, Rattus norvegicus
catcgtgtgcttatgactgcttgat

SEQ ID NO: 238421 - DNA, 25 bp, Rattus norvegicus
catcgtgtgcttttgactgcttgat

SEQ ID NO: 238422 - DNA, 25 bp, Rattus norvegicus
catcgtgtgtaccttccaggagtat

SEQ ID NO: 238423 - DNA, 25 bp, Rattus norvegicus
catcgtgtgtacgttccaggagtat

SEQ ID NO: 238424 - DNA, 25 bp, Rattus norvegicus
catcgttaaactatgttggcggaga

SEQ ID NO: 238425 - DNA, 25 bp, Rattus norvegicus
catcgttaaactttgttggcggaga

SEQ ID NO: 238426 - DNA, 25 bp, Rattus norvegicus
catcgttagattctcagccatttat

SEQ ID NO: 238427 - DNA, 25 bp, Rattus norvegicus
catcgttagattgtcagccatttat

SEQ ID NO: 238428 - DNA, 25 bp, Rattus norvegicus
catcgttcgccaagtgcgcgctgaa

SEQ ID NO: 238429 - DNA, 25 bp, Rattus norvegicus
catcgttcgccatgtgcgcgctgaa

SEQ ID NO: 238430 - DNA, 25 bp, Rattus norvegicus
catcgttgcctacgttgagcagttt

SEQ ID NO: 238431 - DNA, 25 bp, Rattus norvegicus
catcgttgcctaggttgagcagttt

SEQ ID NO: 238432 - DNA, 25 bp, Rattus norvegicus
catcgttgcctccagtgaacatgta

SEQ ID NO: 238433 - DNA, 25 bp, Rattus norvegicus
catcgttgcctcgagtgaacatgta

SEQ ID NO: 238434 - DNA, 25 bp, Rattus norvegicus
catcgtttacgcactggtctccaag

SEQ ID NO: 238435 - DNA, 25 bp, Rattus norvegicus
catcgtttacgctctggtctccaag

SEQ ID NO: 238436 - DNA, 25 bp, Rattus norvegicus
catcgtttgggaacttgggaaagct

SEQ ID NO: 238437 - DNA, 25 bp, Rattus norvegicus
catcgtttgggatcttgggaaagct

SEQ ID NO: 238438 - DNA, 25 bp, Rattus norvegicus
catcgttttgtgaccatagtggtag

SEQ ID NO: 238439 - DNA, 25 bp, Rattus norvegicus
catcgttttgtgtccatagtggtag

SEQ ID NO: 238440 - DNA, 25 bp, Rattus norvegicus
catcgtttttgcactcctgggcgtg

SEQ ID NO: 238441 - DNA, 25 bp, Rattus norvegicus
catcgtttttgctctcctgggcgtg

SEQ ID NO: 238442 - DNA, 25 bp, Rattus norvegicus
catctaaaagtgatccagctctaaa

SEQ ID NO: 238443 - DNA, 25 bp, Rattus norvegicus
catctaaaagtgttccagctctaaa

SEQ ID NO: 238444 - DNA, 25 bp, Rattus norvegicus
catctaaacacaaaacaggactctt

SEQ ID NO: 238445 - DNA, 25 bp, Rattus norvegicus
catctaaacacataacaggactctt

SEQ ID NO: 238446 - DNA, 25 bp, Rattus norvegicus
catctaaaggctactggtcatgcaa

SEQ ID NO: 238447 - DNA, 25 bp, Rattus norvegicus
catctaaaggcttctggtcatgcaa

SEQ ID NO: 238448 - DNA, 25 bp, Rattus norvegicus
catctaattgagcaagtaacatcta

SEQ ID NO: 238449 - DNA, 25 bp, Rattus norvegicus
catctaattgaggaagtaacatcta

SEQ ID NO: 238450 - DNA, 25 bp, Rattus norvegicus
catctaatttgacagacgcaggatt

SEQ ID NO: 238451 - DNA, 25 bp, Rattus norvegicus
catctaatttgagagacgcaggatt

SEQ ID NO: 238452 - DNA, 25 bp, Rattus norvegicus
catctacaccatagagtctttccat

SEQ ID NO: 238453 - DNA, 25 bp, Rattus norvegicus
catctacaccattgagtctttccat

SEQ ID NO: 238454 - DNA, 25 bp, Rattus norvegicus
catctacagactctgctgccgctga

SEQ ID NO: 238455 - DNA, 25 bp, Rattus norvegicus
catctacagactgtgctgccgctga

SEQ ID NO: 238456 - DNA, 25 bp, Rattus norvegicus
catctacatttaaaaccgctttcct

SEQ ID NO: 238457 - DNA, 25 bp, Rattus norvegicus
catctacatttaaaaggtgctgaag

SEQ ID NO: 238458 - DNA, 25 bp, Rattus norvegicus
catctacatttataaccgctttcct

SEQ ID NO: 238459 - DNA, 25 bp, Rattus norvegicus
catctacatttataaggtgctgaag

SEQ ID NO: 238460 - DNA, 25 bp, Rattus norvegicus
catctaccaaggctgctgcagtgta

SEQ ID NO: 238461 - DNA, 25 bp, Rattus norvegicus
catctaccaagggtgctgcagtgta

SEQ ID NO: 238462 - DNA, 25 bp, Rattus norvegicus
catctaccgtctctgttgccgctga

SEQ ID NO: 238463 - DNA, 25 bp, Rattus norvegicus
catctaccgtctgtgttgccgctga

SEQ ID NO: 238464 - DNA, 25 bp, Rattus norvegicus
catctacctcatcctggacaaaaaa

SEQ ID NO: 238465 - DNA, 25 bp, Rattus norvegicus
catctacctcatctggctgtggaag

SEQ ID NO: 238466 - DNA, 25 bp, Rattus norvegicus
catctacctcatgctggacaaaaaa

SEQ ID NO: 238467 - DNA, 25 bp, Rattus norvegicus
catctacctcatgtggctgtggaag

SEQ ID NO: 238468 - DNA, 25 bp, Rattus norvegicus
catctacctgcgaggtggattttta

SEQ ID NO: 238469 - DNA, 25 bp, Rattus norvegicus
catctacctgcgtggtggattttta

SEQ ID NO: 238470 - DNA, 25 bp, Rattus norvegicus
catctacctggtactacttgacaga

SEQ ID NO: 238471 - DNA, 25 bp, Rattus norvegicus
catctacctggtcttcttactaata

SEQ ID NO: 238472 - DNA, 25 bp, Rattus norvegicus
catctacctggtgttcttactaata

SEQ ID NO: 238473 - DNA, 25 bp, Rattus norvegicus
catctacctggttctacttgacaga

SEQ ID NO: 238474 - DNA, 25 bp, Rattus norvegicus
catctaccttggcataaagcggaaa

SEQ ID NO: 238475 - DNA, 25 bp, Rattus norvegicus
catctaccttgggataaagcggaaa

SEQ ID NO: 238476 - DNA, 25 bp, Rattus norvegicus
catctacgcctgatatgttgtgaga

SEQ ID NO: 238477 - DNA, 25 bp, Rattus norvegicus
catctacgcctgttatgttgtgaga

SEQ ID NO: 238478 - DNA, 25 bp, Rattus norvegicus
catctacgtgacaacctttctgagg

SEQ ID NO: 238479 - DNA, 25 bp, Rattus norvegicus
catctacgtgactacctttctgagg

SEQ ID NO: 238480 - DNA, 25 bp, Rattus norvegicus
catctactttgtaaaatacccttga

SEQ ID NO: 238481 - DNA, 25 bp, Rattus norvegicus
catctactttgttaaatacccttga

SEQ ID NO: 238482 - DNA, 25 bp, Rattus norvegicus
catctagacatcctcaggaccgatt

SEQ ID NO: 238483 - DNA, 25 bp, Rattus norvegicus
catctagacatcgtcaggaccgatt

SEQ ID NO: 238484 - DNA, 25 bp, Rattus norvegicus
catctagatgctctccaagtggtca

SEQ ID NO: 238485 - DNA, 25 bp, Rattus norvegicus
catctagatgctgtccaagtggtca

SEQ ID NO: 238486 - DNA, 25 bp, Rattus norvegicus
catctagctctccttcacatttgaa

SEQ ID NO: 238487 - DNA, 25 bp, Rattus norvegicus
catctagctctcgttcacatttgaa

SEQ ID NO: 238488 - DNA, 25 bp, Rattus norvegicus
catctaggagcacggcaagtagtaa

SEQ ID NO: 238489 - DNA, 25 bp, Rattus norvegicus
catctaggagcagggcaagtagtaa

SEQ ID NO: 238490 - DNA, 25 bp, Rattus norvegicus
catctagggctgactgttaacgggt

SEQ ID NO: 238491 - DNA, 25 bp, Rattus norvegicus
catctagggctgtctgttaacgggt

SEQ ID NO: 238492 - DNA, 25 bp, Rattus norvegicus
catctagttgcccttggactttttt

SEQ ID NO: 238493 - DNA, 25 bp, Rattus norvegicus
catctagttgccgttggactttttt

SEQ ID NO: 238494 - DNA, 25 bp, Rattus norvegicus
catctataacagctctccttatgga

SEQ ID NO: 238495 - DNA, 25 bp, Rattus norvegicus
catctataacaggtctccttatgga

SEQ ID NO: 238496 - DNA, 25 bp, Rattus norvegicus
catctatatccacagcaagttgctc

SEQ ID NO: 238497 - DNA, 25 bp, Rattus norvegicus
catctatatccagagcaagttgctc

SEQ ID NO: 238498 - DNA, 25 bp, Rattus norvegicus
catctatctttccatttgctgtgtg

SEQ ID NO: 238499 - DNA, 25 bp, Rattus norvegicus
catctatctttcgatttgctgtgtg

SEQ ID NO: 238500 - DNA, 25 bp, Rattus norvegicus
catctatgagggatacgcgctccct

SEQ ID NO: 238501 - DNA, 25 bp, Rattus norvegicus
catctatgagggttacgcgctccct

SEQ ID NO: 238502 - DNA, 25 bp, Rattus norvegicus
catctcaaattcactgtctctacat

SEQ ID NO: 238503 - DNA, 25 bp, Rattus norvegicus
catctcaaattctctgtctctacat

SEQ ID NO: 238504 - DNA, 25 bp, Rattus norvegicus
catctcaactgactacaactcattg

SEQ ID NO: 238505 - DNA, 25 bp, Rattus norvegicus
catctcaactgagtacaactcattg

SEQ ID NO: 238506 - DNA, 25 bp, Rattus norvegicus
catctcaatgttcggtgctcggtca

SEQ ID NO: 238507 - DNA, 25 bp, Rattus norvegicus
catctcaatgttgggtgctcggtca

SEQ ID NO: 238508 - DNA, 25 bp, Rattus norvegicus
catctcaattcaacagcactgcaac

SEQ ID NO: 238509 - DNA, 25 bp, Rattus norvegicus
catctcaattcatcagcactgcaac

SEQ ID NO: 238510 - DNA, 25 bp, Rattus norvegicus
catctcacatcacaactcagtgttg

SEQ ID NO: 238511 - DNA, 25 bp, Rattus norvegicus
catctcacatcagaactcagtgttg

SEQ ID NO: 238512 - DNA, 25 bp, Rattus norvegicus
catctcacatctctcacggactaaa

SEQ ID NO: 238513 - DNA, 25 bp, Rattus norvegicus
catctcacatctgtcacggactaaa

SEQ ID NO: 238514 - DNA, 25 bp, Rattus norvegicus
catctcaccgtgaagtcctagaacc

SEQ ID NO: 238515 - DNA, 25 bp, Rattus norvegicus
catctcaccgtgtagtcctagaacc

SEQ ID NO: 238516 - DNA, 25 bp, Rattus norvegicus
catctcacctgcatgaagctgtata

SEQ ID NO: 238517 - DNA, 25 bp, Rattus norvegicus
catctcacctgcttgaagctgtata

SEQ ID NO: 238518 - DNA, 25 bp, Rattus norvegicus
catctcacgtccatttagcgattga

SEQ ID NO: 238519 - DNA, 25 bp, Rattus norvegicus
catctcacgtccttttagcgattga

SEQ ID NO: 238520 - DNA, 25 bp, Rattus norvegicus
catctcactacgaacgcattctata

SEQ ID NO: 238521 - DNA, 25 bp, Rattus norvegicus
catctcactacgtacgcattctata

SEQ ID NO: 238522 - DNA, 25 bp, Rattus norvegicus
catctcactcacagtgcttgctggg

SEQ ID NO: 238523 - DNA, 25 bp, Rattus norvegicus
catctcactcactgtgcttgctggg

SEQ ID NO: 238524 - DNA, 25 bp, Rattus norvegicus
catctcactccgacattttagcaag

SEQ ID NO: 238525 - DNA, 25 bp, Rattus norvegicus
catctcactccgtcattttagcaag

SEQ ID NO: 238526 - DNA, 25 bp, Rattus norvegicus
catctcagactgaacctaggcggac

SEQ ID NO: 238527 - DNA, 25 bp, Rattus norvegicus
catctcagactgtacctaggcggac

SEQ ID NO: 238528 - DNA, 25 bp, Rattus norvegicus
catctcagccctaagttggaaacag

SEQ ID NO: 238529 - DNA, 25 bp, Rattus norvegicus
catctcagcccttagttggaaacag

SEQ ID NO: 238530 - DNA, 25 bp, Rattus norvegicus
catctcagctatcggacttttttca

SEQ ID NO: 238531 - DNA, 25 bp, Rattus norvegicus
catctcagctatgggacttttttca

SEQ ID NO: 238532 - DNA, 25 bp, Rattus norvegicus
catctcaggcacatgggtgggacca

SEQ ID NO: 238533 - DNA, 25 bp, Rattus norvegicus
catctcaggcacttgggtgggacca

SEQ ID NO: 238534 - DNA, 25 bp, Rattus norvegicus
catctcagtgacaccaagggctgat

SEQ ID NO: 238535 - DNA, 25 bp, Rattus norvegicus
catctcagtgactccaagggctgat

SEQ ID NO: 238536 - DNA, 25 bp, Rattus norvegicus
catctcatcgtaaggttaaccgttc

SEQ ID NO: 238537 - DNA, 25 bp, Rattus norvegicus
catctcatcgtatggttaaccgttc

SEQ ID NO: 238538 - DNA, 25 bp, Rattus norvegicus
catctcatctgacggactgccatgg

SEQ ID NO: 238539 - DNA, 25 bp, Rattus norvegicus
catctcatctgagggactgccatgg

SEQ ID NO: 238540 - DNA, 25 bp, Rattus norvegicus
catctcattaggaccaaccctaaag

SEQ ID NO: 238541 - DNA, 25 bp, Rattus norvegicus
catctcattaggtccaaccctaaag

SEQ ID NO: 238542 - DNA, 25 bp, Rattus norvegicus
catctcattgtcaaacaagcccttt

SEQ ID NO: 238543 - DNA, 25 bp, Rattus norvegicus
catctcattgtctaacaagcccttt

SEQ ID NO: 238544 - DNA, 25 bp, Rattus norvegicus
catctccaaacgaggatccgcggct

SEQ ID NO: 238545 - DNA, 25 bp, Rattus norvegicus
catctccaaacgtggatccgcggct

SEQ ID NO: 238546 - DNA, 25 bp, Rattus norvegicus
catctccaaagtcaacctgaacttt

SEQ ID NO: 238547 - DNA, 25 bp, Rattus norvegicus
catctccaaagtgaacctgaacttt

SEQ ID NO: 238548 - DNA, 25 bp, Rattus norvegicus
catctccaacggatggctaccattt

SEQ ID NO: 238549 - DNA, 25 bp, Rattus norvegicus
catctccaacggttggctaccattt

SEQ ID NO: 238550 - DNA, 25 bp, Rattus norvegicus
catctccaagagaaggctgcgctga

SEQ ID NO: 238551 - DNA, 25 bp, Rattus norvegicus
catctccaagagtaggctgcgctga

SEQ ID NO: 238552 - DNA, 25 bp, Rattus norvegicus
catctccagagacgacgctatttgt

SEQ ID NO: 238553 - DNA, 25 bp, Rattus norvegicus
catctccagagaggacgctatttgt

SEQ ID NO: 238554 - DNA, 25 bp, Rattus norvegicus
catctccagatgagcccaggtgtga

SEQ ID NO: 238555 - DNA, 25 bp, Rattus norvegicus
catctccagatgtgcccaggtgtga

SEQ ID NO: 238556 - DNA, 25 bp, Rattus norvegicus
catctccagccccagttatatttaa

SEQ ID NO: 238557 - DNA, 25 bp, Rattus norvegicus
catctccagcccgagttatatttaa

SEQ ID NO: 238558 - DNA, 25 bp, Rattus norvegicus
catctccatgccaattcttttgttt

SEQ ID NO: 238559 - DNA, 25 bp, Rattus norvegicus
catctccatgcctattcttttgttt

SEQ ID NO: 238560 - DNA, 25 bp, Rattus norvegicus
catctccccaaactgcttttaaaag

SEQ ID NO: 238561 - DNA, 25 bp, Rattus norvegicus
catctccccaaagtgcttttaaaag

SEQ ID NO: 238562 - DNA, 25 bp, Rattus norvegicus
catctccccaggaaaagttcacgta

SEQ ID NO: 238563 - DNA, 25 bp, Rattus norvegicus
catctccccaggtaaagttcacgta

SEQ ID NO: 238564 - DNA, 25 bp, Rattus norvegicus
catctccctcgcattgaaaacaaat

SEQ ID NO: 238565 - DNA, 25 bp, Rattus norvegicus
catctccctcgctttgaaaacaaat

SEQ ID NO: 238566 - DNA, 25 bp, Rattus norvegicus
catctcctcggactacttgcagaag

SEQ ID NO: 238567 - DNA, 25 bp, Rattus norvegicus
catctcctcggagtacttgcagaag

SEQ ID NO: 238568 - DNA, 25 bp, Rattus norvegicus
catctcctcttaacatgctttttct

SEQ ID NO: 238569 - DNA, 25 bp, Rattus norvegicus
catctcctcttatcatgctttttct

SEQ ID NO: 238570 - DNA, 25 bp, Rattus norvegicus
catctcctgctgctattcacaatgg

SEQ ID NO: 238571 - DNA, 25 bp, Rattus norvegicus
catctcctgctggtattcacaatgg

SEQ ID NO: 238572 - DNA, 25 bp, Rattus norvegicus
catctcctgggaccaaggtggccaa

SEQ ID NO: 238573 - DNA, 25 bp, Rattus norvegicus
catctcctgggagcaaggtggccaa

SEQ ID NO: 238574 - DNA, 25 bp, Rattus norvegicus
catctccttggcaatagcttggatt

SEQ ID NO: 238575 - DNA, 25 bp, Rattus norvegicus
catctccttggctatagcttggatt

SEQ ID NO: 238576 - DNA, 25 bp, Rattus norvegicus
catctcctttatcacccaagggttt

SEQ ID NO: 238577 - DNA, 25 bp, Rattus norvegicus
catctcctttatgacccaagggttt

SEQ ID NO: 238578 - DNA, 25 bp, Rattus norvegicus
catctcctttccaaagtgccttatg

SEQ ID NO: 238579 - DNA, 25 bp, Rattus norvegicus
catctcctttcctaagtgccttatg

SEQ ID NO: 238580 - DNA, 25 bp, Rattus norvegicus
catctcgaaggtcgctgggttccga

SEQ ID NO: 238581 - DNA, 25 bp, Rattus norvegicus
catctcgaaggtggctgggttccga

SEQ ID NO: 238582 - DNA, 25 bp, Rattus norvegicus
catctcggggtgcttttctgttata

SEQ ID NO: 238583 - DNA, 25 bp, Rattus norvegicus
catctcggggtggttttctgttata

SEQ ID NO: 238584 - DNA, 25 bp, Rattus norvegicus
catctctaatgcctatctttctatc

SEQ ID NO: 238585 - DNA, 25 bp, Rattus norvegicus
catctctaatgcgtatctttctatc

SEQ ID NO: 238586 - DNA, 25 bp, Rattus norvegicus
catctctactgcctggcttacataa

SEQ ID NO: 238587 - DNA, 25 bp, Rattus norvegicus
catctctactgcgtggcttacataa

SEQ ID NO: 238588 - DNA, 25 bp, Rattus norvegicus
catctctattaaccactgagtacac

SEQ ID NO: 238589 - DNA, 25 bp, Rattus norvegicus
catctctattaagcactgagtacac

SEQ ID NO: 238590 - DNA, 25 bp, Rattus norvegicus
catctctcagagagttcccttaaaa

SEQ ID NO: 238591 - DNA, 25 bp, Rattus norvegicus
catctctcagagtgttcccttaaaa

SEQ ID NO: 238592 - DNA, 25 bp, Rattus norvegicus
catctctccaacaagctccaaaagt

SEQ ID NO: 238593 - DNA, 25 bp, Rattus norvegicus
catctctccaactagctccaaaagt

SEQ ID NO: 238594 - DNA, 25 bp, Rattus norvegicus
catctctccatccatttatcctgtt

SEQ ID NO: 238595 - DNA, 25 bp, Rattus norvegicus
catctctccatcgatttatcctgtt

SEQ ID NO: 238596 - DNA, 25 bp, Rattus norvegicus
catctctcctaacccaattgagtta

SEQ ID NO: 238597 - DNA, 25 bp, Rattus norvegicus
catctctcctaagccaattgagtta

SEQ ID NO: 238598 - DNA, 25 bp, Rattus norvegicus
catctctctggaaggattgctgaaa

SEQ ID NO: 238599 - DNA, 25 bp, Rattus norvegicus
catctctctggatggattgctgaaa

SEQ ID NO: 238600 - DNA, 25 bp, Rattus norvegicus
catctctctgtcagtgaactggaaa

SEQ ID NO: 238601 - DNA, 25 bp, Rattus norvegicus
catctctctgtctgtgaactggaaa

SEQ ID NO: 238602 - DNA, 25 bp, Rattus norvegicus
catctctgagagctatatcgcctgc

SEQ ID NO: 238603 - DNA, 25 bp, Rattus norvegicus
catctctgagaggtatatcgcctgc

SEQ ID NO: 238604 - DNA, 25 bp, Rattus norvegicus
catctctgcctacgctccgggtttt

SEQ ID NO: 238605 - DNA, 25 bp, Rattus norvegicus
catctctgcctaggctccgggtttt

SEQ ID NO: 238606 - DNA, 25 bp, Rattus norvegicus
catctctgtcataattttacccctc

SEQ ID NO: 238607 - DNA, 25 bp, Rattus norvegicus
catctctgtcattattttacccctc

SEQ ID NO: 238608 - DNA, 25 bp, Rattus norvegicus
catctctgtgccaaagaccaaagtc

SEQ ID NO: 238609 - DNA, 25 bp, Rattus norvegicus
catctctgtgcctaagaccaaagtc

SEQ ID NO: 238610 - DNA, 25 bp, Rattus norvegicus
catctctgtggcacagacatgactt

SEQ ID NO: 238611 - DNA, 25 bp, Rattus norvegicus
catctctgtggctcagacatgactt

SEQ ID NO: 238612 - DNA, 25 bp, Rattus norvegicus
catctctgttctaaaggccaaacct

SEQ ID NO: 238613 - DNA, 25 bp, Rattus norvegicus
catctctgttcttaaggccaaacct

SEQ ID NO: 238614 - DNA, 25 bp, Rattus norvegicus
catctcttcactagttgcatttgct

SEQ ID NO: 238615 - DNA, 25 bp, Rattus norvegicus
catctcttcacttgttgcatttgct

SEQ ID NO: 238616 - DNA, 25 bp, Rattus norvegicus
catctcttcagtacctacttagcac

SEQ ID NO: 238617 - DNA, 25 bp, Rattus norvegicus
catctcttcagttcctacttagcac

SEQ ID NO: 238618 - DNA, 25 bp, Rattus norvegicus
catctcttctttatactggcagcag

SEQ ID NO: 238619 - DNA, 25 bp, Rattus norvegicus
catctcttctttttactggcagcag

SEQ ID NO: 238620 - DNA, 25 bp, Rattus norvegicus
catctcttgttactgtagtgctggg

SEQ ID NO: 238621 - DNA, 25 bp, Rattus norvegicus
catctcttgttagtgtagtgctggg

SEQ ID NO: 238622 - DNA, 25 bp, Rattus norvegicus
catctcttgtttccctcagtgaata

SEQ ID NO: 238623 - DNA, 25 bp, Rattus norvegicus
catctcttgtttgcctcagtgaata

SEQ ID NO: 238624 - DNA, 25 bp, Rattus norvegicus
catctctttaccatcacatatggca

SEQ ID NO: 238625 - DNA, 25 bp, Rattus norvegicus
catctctttaccttcacatatggca

SEQ ID NO: 238626 - DNA, 25 bp, Rattus norvegicus
catctctttactcactaaccagtca

SEQ ID NO: 238627 - DNA, 25 bp, Rattus norvegicus
catctctttactgactaaccagtca

SEQ ID NO: 238628 - DNA, 25 bp, Rattus norvegicus
catctctttcaaaagcatcttaccc

SEQ ID NO: 238629 - DNA, 25 bp, Rattus norvegicus
catctctttcaatagcatcttaccc

SEQ ID NO: 238630 - DNA, 25 bp, Rattus norvegicus
catctctttgagactgttttccatt

SEQ ID NO: 238631 - DNA, 25 bp, Rattus norvegicus
catctctttgagtctgttttccatt

SEQ ID NO: 238632 - DNA, 25 bp, Rattus norvegicus
catctctttgccattgagtaaactt

SEQ ID NO: 238633 - DNA, 25 bp, Rattus norvegicus
catctctttgcctttgagtaaactt

SEQ ID NO: 238634 - DNA, 25 bp, Rattus norvegicus
catctcttttatacccttgttattc

SEQ ID NO: 238635 - DNA, 25 bp, Rattus norvegicus
catctcttttatcctcgcttatgaa

SEQ ID NO: 238636 - DNA, 25 bp, Rattus norvegicus
catctcttttatgctcgcttatgaa

SEQ ID NO: 238637 - DNA, 25 bp, Rattus norvegicus
catctcttttattcccttgttattc

SEQ ID NO: 238638 - DNA, 25 bp, Rattus norvegicus
catctcttttccacttctttattga

SEQ ID NO: 238639 - DNA, 25 bp, Rattus norvegicus
catctcttttcctcttctttattga

SEQ ID NO: 238640 - DNA, 25 bp, Rattus norvegicus
catctcttttctccctgactggtca

SEQ ID NO: 238641 - DNA, 25 bp, Rattus norvegicus
catctcttttctgcctgactggtca

SEQ ID NO: 238642 - DNA, 25 bp, Rattus norvegicus
catctgagaatgcagcagcctgtcc

SEQ ID NO: 238643 - DNA, 25 bp, Rattus norvegicus
catctgagaatggagcagcctgtcc

SEQ ID NO: 238644 - DNA, 25 bp, Rattus norvegicus
catctgagagagcttgttttccctt

SEQ ID NO: 238645 - DNA, 25 bp, Rattus norvegicus
catctgagagaggttgttttccctt

SEQ ID NO: 238646 - DNA, 25 bp, Rattus norvegicus
catctgatttacatttgggccattg

SEQ ID NO: 238647 - DNA, 25 bp, Rattus norvegicus
catctgatttacttttgggccattg

SEQ ID NO: 238648 - DNA, 25 bp, Rattus norvegicus
catctgcaatttactgagctattaa

SEQ ID NO: 238649 - DNA, 25 bp, Rattus norvegicus
catctgcaattttctgagctattaa

SEQ ID NO: 238650 - DNA, 25 bp, Rattus norvegicus
catctgcactggctttttactgtta

SEQ ID NO: 238651 - DNA, 25 bp, Rattus norvegicus
catctgcactgggtttttactgtta

SEQ ID NO: 238652 - DNA, 25 bp, Rattus norvegicus
catctgcagatcagatgggcatcag

SEQ ID NO: 238653 - DNA, 25 bp, Rattus norvegicus
catctgcagatctgatgggcatcag

SEQ ID NO: 238654 - DNA, 25 bp, Rattus norvegicus
catctgcagctcatgggtggcgaaa

SEQ ID NO: 238655 - DNA, 25 bp, Rattus norvegicus
catctgcagctcttgggtggcgaaa

SEQ ID NO: 238656 - DNA, 25 bp, Rattus norvegicus
catctgcattcgaggttggcatgtt

SEQ ID NO: 238657 - DNA, 25 bp, Rattus norvegicus
catctgcattcgtggttggcatgtt

SEQ ID NO: 238658 - DNA, 25 bp, Rattus norvegicus
catctgccaaaacggccttcttttc

SEQ ID NO: 238659 - DNA, 25 bp, Rattus norvegicus
catctgccaaaagggccttcttttc

SEQ ID NO: 238660 - DNA, 25 bp, Rattus norvegicus
catctgcccagcaggaagggtgttt

SEQ ID NO: 238661 - DNA, 25 bp, Rattus norvegicus
catctgcccagctggaagggtgttt

SEQ ID NO: 238662 - DNA, 25 bp, Rattus norvegicus
catctgcctacgaagaatgtgagga

SEQ ID NO: 238663 - DNA, 25 bp, Rattus norvegicus
catctgcctacgtagaatgtgagga

SEQ ID NO: 238664 - DNA, 25 bp, Rattus norvegicus
catctgccttctctgaagctgagag

SEQ ID NO: 238665 - DNA, 25 bp, Rattus norvegicus
catctgccttctgtgaagctgagag

SEQ ID NO: 238666 - DNA, 25 bp, Rattus norvegicus
catctgcgagaaccgcttcatgcgg

SEQ ID NO: 238667 - DNA, 25 bp, Rattus norvegicus
catctgcgagaagcgcttcatgcgg

SEQ ID NO: 238668 - DNA, 25 bp, Rattus norvegicus
catctgcgaggtacagttcagtcct

SEQ ID NO: 238669 - DNA, 25 bp, Rattus norvegicus
catctgcgaggttcagttcagtcct

SEQ ID NO: 238670 - DNA, 25 bp, Rattus norvegicus
catctgcggtgtactgacttggatt

SEQ ID NO: 238671 - DNA, 25 bp, Rattus norvegicus
catctgcggtgttctgacttggatt

SEQ ID NO: 238672 - DNA, 25 bp, Rattus norvegicus
catctgctcctcaaattcgaaactt

SEQ ID NO: 238673 - DNA, 25 bp, Rattus norvegicus
catctgctcctctaattcgaaactt

SEQ ID NO: 238674 - DNA, 25 bp, Rattus norvegicus
catctgctcctgagtatgtattttt

SEQ ID NO: 238675 - DNA, 25 bp, Rattus norvegicus
catctgctcctgtgtatgtattttt

SEQ ID NO: 238676 - DNA, 25 bp, Rattus norvegicus
catctgctggtgagtggacaagtat

SEQ ID NO: 238677 - DNA, 25 bp, Rattus norvegicus
catctgctggtgatcattttgttct

SEQ ID NO: 238678 - DNA, 25 bp, Rattus norvegicus
catctgctggtgtgtggacaagtat

SEQ ID NO: 238679 - DNA, 25 bp, Rattus norvegicus
catctgctggtgttcattttgttct

SEQ ID NO: 238680 - DNA, 25 bp, Rattus norvegicus
catctgctgttaaccttttctgtag

SEQ ID NO: 238681 - DNA, 25 bp, Rattus norvegicus
catctgctgttatccttttctgtag

SEQ ID NO: 238682 - DNA, 25 bp, Rattus norvegicus
catctgctgtttaaaacggcaacaa

SEQ ID NO: 238683 - DNA, 25 bp, Rattus norvegicus
catctgctgttttaaacggcaacaa

SEQ ID NO: 238684 - DNA, 25 bp, Rattus norvegicus
catctgcttaatcgccctggacaaa

SEQ ID NO: 238685 - DNA, 25 bp, Rattus norvegicus
catctgcttaatggccctggacaaa

SEQ ID NO: 238686 - DNA, 25 bp, Rattus norvegicus
catctgcttgatccggtttgctgtg

SEQ ID NO: 238687 - DNA, 25 bp, Rattus norvegicus
catctgcttgatgcggtttgctgtg

SEQ ID NO: 238688 - DNA, 25 bp, Rattus norvegicus
catctgcttggcaatcatcgtgaac

SEQ ID NO: 238689 - DNA, 25 bp, Rattus norvegicus
catctgcttggctatcatcgtgaac

SEQ ID NO: 238690 - DNA, 25 bp, Rattus norvegicus
catctgctttatccctagcggaaga

SEQ ID NO: 238691 - DNA, 25 bp, Rattus norvegicus
catctgctttatgcctagcggaaga

SEQ ID NO: 238692 - DNA, 25 bp, Rattus norvegicus
catctggaacaaatgcggcggtgga

SEQ ID NO: 238693 - DNA, 25 bp, Rattus norvegicus
catctggaacaattgcggcggtgga

SEQ ID NO: 238694 - DNA, 25 bp, Rattus norvegicus
catctggagcttactttgcctggaa

SEQ ID NO: 238695 - DNA, 25 bp, Rattus norvegicus
catctggagctttctttgcctggaa

SEQ ID NO: 238696 - DNA, 25 bp, Rattus norvegicus
catctggatcacatgtttacgtctc

SEQ ID NO: 238697 - DNA, 25 bp, Rattus norvegicus
catctggatcacttgtttacgtctc

SEQ ID NO: 238698 - DNA, 25 bp, Rattus norvegicus
catctggatgacatgcaagggcctt

SEQ ID NO: 238699 - DNA, 25 bp, Rattus norvegicus
catctggatgacttgcaagggcctt

SEQ ID NO: 238700 - DNA, 25 bp, Rattus norvegicus
catctggcagcaccttgaggtgtca

SEQ ID NO: 238701 - DNA, 25 bp, Rattus norvegicus
catctggcagcagcttgaggtgtca

SEQ ID NO: 238702 - DNA, 25 bp, Rattus norvegicus
catctggccagtcgtgattagcact

SEQ ID NO: 238703 - DNA, 25 bp, Rattus norvegicus
catctggccagtggtgattagcact

SEQ ID NO: 238704 - DNA, 25 bp, Rattus norvegicus
catctggcccttagccttgggtaaa

SEQ ID NO: 238705 - DNA, 25 bp, Rattus norvegicus
catctggccctttgccttgggtaaa

SEQ ID NO: 238706 - DNA, 25 bp, Rattus norvegicus
catctggctcaaagaatggtctaga

SEQ ID NO: 238707 - DNA, 25 bp, Rattus norvegicus
catctggctcaatgaatggtctaga

SEQ ID NO: 238708 - DNA, 25 bp, Rattus norvegicus
catctggctgttcggctcgaagcaa

SEQ ID NO: 238709 - DNA, 25 bp, Rattus norvegicus
catctggctgttgggctcgaagcaa

SEQ ID NO: 238710 - DNA, 25 bp, Rattus norvegicus
catctgggatctctcactgctgaca

SEQ ID NO: 238711 - DNA, 25 bp, Rattus norvegicus
catctgggatctgtcactgctgaca

SEQ ID NO: 238712 - DNA, 25 bp, Rattus norvegicus
catctgggatggctgaacttctacg

SEQ ID NO: 238713 - DNA, 25 bp, Rattus norvegicus
catctgggatgggtgaacttctacg

SEQ ID NO: 238714 - DNA, 25 bp, Rattus norvegicus
catctgggcattctgtgttgctgga

SEQ ID NO: 238715 - DNA, 25 bp, Rattus norvegicus
catctgggcattgtgtgttgctgga

SEQ ID NO: 238716 - DNA, 25 bp, Rattus norvegicus
catctgggttgcagcatttccgaaa

SEQ ID NO: 238717 - DNA, 25 bp, Rattus norvegicus
catctgggttgctgcatttccgaaa

SEQ ID NO: 238718 - DNA, 25 bp, Rattus norvegicus
catctggtcctccttggctgttggg

SEQ ID NO: 238719 - DNA, 25 bp, Rattus norvegicus
catctggtcctcgttggctgttggg

SEQ ID NO: 238720 - DNA, 25 bp, Rattus norvegicus
catctggtcctgacataatttcctt

SEQ ID NO: 238721 - DNA, 25 bp, Rattus norvegicus
catctggtcctgtcataatttcctt

SEQ ID NO: 238722 - DNA, 25 bp, Rattus norvegicus
catctggtgtgcatactgaaatctc

SEQ ID NO: 238723 - DNA, 25 bp, Rattus norvegicus
catctggtgtgcttactgaaatctc

SEQ ID NO: 238724 - DNA, 25 bp, Rattus norvegicus
catctggttctgaggtttgctaagg

SEQ ID NO: 238725 - DNA, 25 bp, Rattus norvegicus
catctggttctgtggtttgctaagg

SEQ ID NO: 238726 - DNA, 25 bp, Rattus norvegicus
catctggttcttacttcagggccat

SEQ ID NO: 238727 - DNA, 25 bp, Rattus norvegicus
catctggttctttcttcagggccat

SEQ ID NO: 238728 - DNA, 25 bp, Rattus norvegicus
catctggttggcattctcgccagtc

SEQ ID NO: 238729 - DNA, 25 bp, Rattus norvegicus
catctggttggctttctcgccagtc

SEQ ID NO: 238730 - DNA, 25 bp, Rattus norvegicus
catctgtacttacttctgttggtca

SEQ ID NO: 238731 - DNA, 25 bp, Rattus norvegicus
catctgtacttagttctgttggtca

SEQ ID NO: 238732 - DNA, 25 bp, Rattus norvegicus
catctgtatattagatcataaaggc

SEQ ID NO: 238733 - DNA, 25 bp, Rattus norvegicus
catctgtatatttgatcataaaggc

SEQ ID NO: 238734 - DNA, 25 bp, Rattus norvegicus
catctgtatcctcgcactgctgaag

SEQ ID NO: 238735 - DNA, 25 bp, Rattus norvegicus
catctgtatcctggcactgctgaag

SEQ ID NO: 238736 - DNA, 25 bp, Rattus norvegicus
catctgtcatggaatgtaatgcccc

SEQ ID NO: 238737 - DNA, 25 bp, Rattus norvegicus
catctgtcatggtatgtaatgcccc

SEQ ID NO: 238738 - DNA, 25 bp, Rattus norvegicus
catctgtcccgtagacgtgtatttt

SEQ ID NO: 238739 - DNA, 25 bp, Rattus norvegicus
catctgtcccgttgacgtgtatttt

SEQ ID NO: 238740 - DNA, 25 bp, Rattus norvegicus
catctgtctaatcgccagcgtgtgg

SEQ ID NO: 238741 - DNA, 25 bp, Rattus norvegicus
catctgtctaatggccagcgtgtgg

SEQ ID NO: 238742 - DNA, 25 bp, Rattus norvegicus
catctgtctcccagtggtctatatg

SEQ ID NO: 238743 - DNA, 25 bp, Rattus norvegicus
catctgtctccctgtggtctatatg

SEQ ID NO: 238744 - DNA, 25 bp, Rattus norvegicus
catctgtgaagtccttcctgctaca

SEQ ID NO: 238745 - DNA, 25 bp, Rattus norvegicus
catctgtgaagtgcttcctgctaca

SEQ ID NO: 238746 - DNA, 25 bp, Rattus norvegicus
catctgtgagatatcgcccttggtg

SEQ ID NO: 238747 - DNA, 25 bp, Rattus norvegicus
catctgtgagatttcgcccttggtg

SEQ ID NO: 238748 - DNA, 25 bp, Rattus norvegicus
catctgtgctgtccctagagaatga

SEQ ID NO: 238749 - DNA, 25 bp, Rattus norvegicus
catctgtgctgtgcctagagaatga

SEQ ID NO: 238750 - DNA, 25 bp, Rattus norvegicus
catctgtgctttccagaactgtgag

SEQ ID NO: 238751 - DNA, 25 bp, Rattus norvegicus
catctgtgctttgcagaactgtgag

SEQ ID NO: 238752 - DNA, 25 bp, Rattus norvegicus
catctgtgttttcccctctaaataa

SEQ ID NO: 238753 - DNA, 25 bp, Rattus norvegicus
catctgtgttttgccctctaaataa

SEQ ID NO: 238754 - DNA, 25 bp, Rattus norvegicus
catctgttggtccaggaagcatcta

SEQ ID NO: 238755 - DNA, 25 bp, Rattus norvegicus
catctgttggtcgaggaagcatcta

SEQ ID NO: 238756 - DNA, 25 bp, Rattus norvegicus
catctgtttcttaaggtttgagcgt

SEQ ID NO: 238757 - DNA, 25 bp, Rattus norvegicus
catctgtttctttaggtttgagcgt

SEQ ID NO: 238758 - DNA, 25 bp, Rattus norvegicus
catcttactatgaatctgtctactt

SEQ ID NO: 238759 - DNA, 25 bp, Rattus norvegicus
catcttactatgtatctgtctactt

SEQ ID NO: 238760 - DNA, 25 bp, Rattus norvegicus
catcttactgtaatctgttctttga

SEQ ID NO: 238761 - DNA, 25 bp, Rattus norvegicus
catcttactgtattctgttctttga

SEQ ID NO: 238762 - DNA, 25 bp, Rattus norvegicus
catcttagcatcacacacagcaggt

SEQ ID NO: 238763 - DNA, 25 bp, Rattus norvegicus
catcttagcatctcacacagcaggt

SEQ ID NO: 238764 - DNA, 25 bp, Rattus norvegicus
catcttatcaaaccaccttataggg

SEQ ID NO: 238765 - DNA, 25 bp, Rattus norvegicus
catcttatcaaagcaccttataggg

SEQ ID NO: 238766 - DNA, 25 bp, Rattus norvegicus
catcttatgcctaaaactcttctgt

SEQ ID NO: 238767 - DNA, 25 bp, Rattus norvegicus
catcttatgccttaaactcttctgt

SEQ ID NO: 238768 - DNA, 25 bp, Rattus norvegicus
catcttcaacagagctctcttcatt

SEQ ID NO: 238769 - DNA, 25 bp, Rattus norvegicus
catcttcaacagtgctctcttcatt

SEQ ID NO: 238770 - DNA, 25 bp, Rattus norvegicus
catcttcaactgaagattccatggc

SEQ ID NO: 238771 - DNA, 25 bp, Rattus norvegicus
catcttcaactgtagattccatggc

SEQ ID NO: 238772 - DNA, 25 bp, Rattus norvegicus
catcttcaaggcctttgctatgatt

SEQ ID NO: 238773 - DNA, 25 bp, Rattus norvegicus
catcttcaaggcgtttgctatgatt

SEQ ID NO: 238774 - DNA, 25 bp, Rattus norvegicus
catcttcacatccaggtccagcggg

SEQ ID NO: 238775 - DNA, 25 bp, Rattus norvegicus
catcttcacatcgaggtccagcggg

SEQ ID NO: 238776 - DNA, 25 bp, Rattus norvegicus
catcttcactcacttaagggagtat

SEQ ID NO: 238777 - DNA, 25 bp, Rattus norvegicus
catcttcactcagttaagggagtat

SEQ ID NO: 238778 - DNA, 25 bp, Rattus norvegicus
catcttcactgaatctgactggctt

SEQ ID NO: 238779 - DNA, 25 bp, Rattus norvegicus
catcttcactgattctgactggctt

SEQ ID NO: 238780 - DNA, 25 bp, Rattus norvegicus
catcttcaggaacccctgttcctaa

SEQ ID NO: 238781 - DNA, 25 bp, Rattus norvegicus
catcttcaggaagccctgttcctaa

SEQ ID NO: 238782 - DNA, 25 bp, Rattus norvegicus
catcttcaggatccatcaccagaaa

SEQ ID NO: 238783 - DNA, 25 bp, Rattus norvegicus
catcttcaggatgcatcaccagaaa

SEQ ID NO: 238784 - DNA, 25 bp, Rattus norvegicus
catcttcatcgtagtttgaaacagt

SEQ ID NO: 238785 - DNA, 25 bp, Rattus norvegicus
catcttcatcgttgtttgaaacagt

SEQ ID NO: 238786 - DNA, 25 bp, Rattus norvegicus
catcttcattgtactggctgcagga

SEQ ID NO: 238787 - DNA, 25 bp, Rattus norvegicus
catcttcattgttctggctgcagga

SEQ ID NO: 238788 - DNA, 25 bp, Rattus norvegicus
catcttccaggaaccgggcgatgag

SEQ ID NO: 238789 - DNA, 25 bp, Rattus norvegicus
catcttccaggaacttcatgattaa

SEQ ID NO: 238790 - DNA, 25 bp, Rattus norvegicus
catcttccaggatccgggcgatgag

SEQ ID NO: 238791 - DNA, 25 bp, Rattus norvegicus
catcttccaggatcttcatgattaa

SEQ ID NO: 238792 - DNA, 25 bp, Rattus norvegicus
catcttccagtaacacgtatccatt

SEQ ID NO: 238793 - DNA, 25 bp, Rattus norvegicus
catcttccagtatcacgtatccatt

SEQ ID NO: 238794 - DNA, 25 bp, Rattus norvegicus
catcttccagttatctgccagcctg

SEQ ID NO: 238795 - DNA, 25 bp, Rattus norvegicus
catcttccagttttctgccagcctg

SEQ ID NO: 238796 - DNA, 25 bp, Rattus norvegicus
catcttccccagaattcctaatgtt

SEQ ID NO: 238797 - DNA, 25 bp, Rattus norvegicus
catcttccccagtattcctaatgtt

SEQ ID NO: 238798 - DNA, 25 bp, Rattus norvegicus
catcttcctcttcgcgttgcagaga

SEQ ID NO: 238799 - DNA, 25 bp, Rattus norvegicus
catcttcctcttggcgttgcagaga

SEQ ID NO: 238800 - DNA, 25 bp, Rattus norvegicus
catcttcctggcattttattctaag

SEQ ID NO: 238801 - DNA, 25 bp, Rattus norvegicus
catcttcctggctttttattctaag

SEQ ID NO: 238802 - DNA, 25 bp, Rattus norvegicus
catcttcgaaccatacagttttaga

SEQ ID NO: 238803 - DNA, 25 bp, Rattus norvegicus
catcttcgaaccttacagttttaga

SEQ ID NO: 238804 - DNA, 25 bp, Rattus norvegicus
catcttcgaactcctctttgattta

SEQ ID NO: 238805 - DNA, 25 bp, Rattus norvegicus
catcttcgaactgctctttgattta

SEQ ID NO: 238806 - DNA, 25 bp, Rattus norvegicus
catcttcgggatcaatctggcaaca

SEQ ID NO: 238807 - DNA, 25 bp, Rattus norvegicus
catcttcgggatgaatctggcaaca

SEQ ID NO: 238808 - DNA, 25 bp, Rattus norvegicus
catcttcgtgtcagcaggtgtggtt

SEQ ID NO: 238809 - DNA, 25 bp, Rattus norvegicus
catcttcgtgtctgcaggtgtggtt

SEQ ID NO: 238810 - DNA, 25 bp, Rattus norvegicus
catcttctactgattcctctgaaaa

SEQ ID NO: 238811 - DNA, 25 bp, Rattus norvegicus
catcttctactgtttcctctgaaaa

SEQ ID NO: 238812 - DNA, 25 bp, Rattus norvegicus
catcttctatatcctgtacagggcc

SEQ ID NO: 238813 - DNA, 25 bp, Rattus norvegicus
catcttctatatgctgtacagggcc

SEQ ID NO: 238814 - DNA, 25 bp, Rattus norvegicus
catcttctccgtacaatgctgtgag

SEQ ID NO: 238815 - DNA, 25 bp, Rattus norvegicus
catcttctccgttcaatgctgtgag

SEQ ID NO: 238816 - DNA, 25 bp, Rattus norvegicus
catcttctgggacctttgtatctat

SEQ ID NO: 238817 - DNA, 25 bp, Rattus norvegicus
catcttctgggagctttgtatctat

SEQ ID NO: 238818 - DNA, 25 bp, Rattus norvegicus
catcttctgtgtacgggaggagcct

SEQ ID NO: 238819 - DNA, 25 bp, Rattus norvegicus
catcttctgtgttcgggaggagcct

SEQ ID NO: 238820 - DNA, 25 bp, Rattus norvegicus
catcttcttgtacggcttctggcca

SEQ ID NO: 238821 - DNA, 25 bp, Rattus norvegicus
catcttcttgtagggcttctggcca

SEQ ID NO: 238822 - DNA, 25 bp, Rattus norvegicus
catcttcttgtgcaaatgcccagga

SEQ ID NO: 238823 - DNA, 25 bp, Rattus norvegicus
catcttcttgtggaaatgcccagga

SEQ ID NO: 238824 - DNA, 25 bp, Rattus norvegicus
catcttgaacagctgctcacatgtt

SEQ ID NO: 238825 - DNA, 25 bp, Rattus norvegicus
catcttgaacaggtgctcacatgtt

SEQ ID NO: 238826 - DNA, 25 bp, Rattus norvegicus
catcttgaagatcccgcggagcggt

SEQ ID NO: 238827 - DNA, 25 bp, Rattus norvegicus
catcttgaagatgccgcggagcggt

SEQ ID NO: 238828 - DNA, 25 bp, Rattus norvegicus
catcttgaatcaaccagttctccag

SEQ ID NO: 238829 - DNA, 25 bp, Rattus norvegicus
catcttgaatcatccagttctccag

SEQ ID NO: 238830 - DNA, 25 bp, Rattus norvegicus
catcttgacaggaagttttaactct

SEQ ID NO: 238831 - DNA, 25 bp, Rattus norvegicus
catcttgacaggtagttttaactct

SEQ ID NO: 238832 - DNA, 25 bp, Rattus norvegicus
catcttgacctcagggaaccgccgt

SEQ ID NO: 238833 - DNA, 25 bp, Rattus norvegicus
catcttgacctctgggaaccgccgt

SEQ ID NO: 238834 - DNA, 25 bp, Rattus norvegicus
catcttgactttagtgtttgtgtta

SEQ ID NO: 238835 - DNA, 25 bp, Rattus norvegicus
catcttgacttttgtgtttgtgtta

SEQ ID NO: 238836 - DNA, 25 bp, Rattus norvegicus
catcttgattggaggcagtgctgac

SEQ ID NO: 238837 - DNA, 25 bp, Rattus norvegicus
catcttgattggtggcagtgctgac

SEQ ID NO: 238838 - DNA, 25 bp, Rattus norvegicus
catcttgcagcgatcagcacgccag

SEQ ID NO: 238839 - DNA, 25 bp, Rattus norvegicus
catcttgcagcgttcagcacgccag

SEQ ID NO: 238840 - DNA, 25 bp, Rattus norvegicus
catcttgcctgtatcacctgaatac

SEQ ID NO: 238841 - DNA, 25 bp, Rattus norvegicus
catcttgcctgtttcacctgaatac

SEQ ID NO: 238842 - DNA, 25 bp, Rattus norvegicus
catcttgctcaaaacaccctgttta

SEQ ID NO: 238843 - DNA, 25 bp, Rattus norvegicus
catcttgctcaatacaccctgttta

SEQ ID NO: 238844 - DNA, 25 bp, Rattus norvegicus
catcttggattcctctctgtagagt

SEQ ID NO: 238845 - DNA, 25 bp, Rattus norvegicus
catcttggattcgtctctgtagagt

SEQ ID NO: 238846 - DNA, 25 bp, Rattus norvegicus
catcttggccaacctggctgagaga

SEQ ID NO: 238847 - DNA, 25 bp, Rattus norvegicus
catcttggccaagctggctgagaga

SEQ ID NO: 238848 - DNA, 25 bp, Rattus norvegicus
catcttggcctaccttgtgtctgga

SEQ ID NO: 238849 - DNA, 25 bp, Rattus norvegicus
catcttggcctagcttgtgtctgga

SEQ ID NO: 238850 - DNA, 25 bp, Rattus norvegicus
catcttggttgcactgtacggaaat

SEQ ID NO: 238851 - DNA, 25 bp, Rattus norvegicus
catcttggttgctctgtacggaaat

SEQ ID NO: 238852 - DNA, 25 bp, Rattus norvegicus
catcttgtacttcaggatcttcttg

SEQ ID NO: 238853 - DNA, 25 bp, Rattus norvegicus
catcttgtacttgaggatcttcttg

SEQ ID NO: 238854 - DNA, 25 bp, Rattus norvegicus
catcttgtatataaccctgctcttg

SEQ ID NO: 238855 - DNA, 25 bp, Rattus norvegicus
catcttgtatattaccctgctcttg

SEQ ID NO: 238856 - DNA, 25 bp, Rattus norvegicus
catcttgtcttgctctgaatttttc

SEQ ID NO: 238857 - DNA, 25 bp, Rattus norvegicus
catcttgtcttggtctgaatttttc

SEQ ID NO: 238858 - DNA, 25 bp, Rattus norvegicus
catcttgtgcaaagtatccggttgt

SEQ ID NO: 238859 - DNA, 25 bp, Rattus norvegicus
catcttgtgcaatgtatccggttgt

SEQ ID NO: 238860 - DNA, 25 bp, Rattus norvegicus
catcttgtggctaccggttgatata

SEQ ID NO: 238861 - DNA, 25 bp, Rattus norvegicus
catcttgtggcttccggttgatata

SEQ ID NO: 238862 - DNA, 25 bp, Rattus norvegicus
catcttgttgctccctcgcgtttgt

SEQ ID NO: 238863 - DNA, 25 bp, Rattus norvegicus
catcttgttgctgcctcgcgtttgt

SEQ ID NO: 238864 - DNA, 25 bp, Rattus norvegicus
catcttgtttttaactcagcaactg

SEQ ID NO: 238865 - DNA, 25 bp, Rattus norvegicus
catcttgtttttaagctaacctcaa

SEQ ID NO: 238866 - DNA, 25 bp, Rattus norvegicus
catcttgttttttactcagcaactg

SEQ ID NO: 238867 - DNA, 25 bp, Rattus norvegicus
catcttgttttttagctaacctcaa

SEQ ID NO: 238868 - DNA, 25 bp, Rattus norvegicus
catctttaagatcggctgtacttct

SEQ ID NO: 238869 - DNA, 25 bp, Rattus norvegicus
catctttaagatgggctgtacttct

SEQ ID NO: 238870 - DNA, 25 bp, Rattus norvegicus
catctttacaacatggtggtcccaa

SEQ ID NO: 238871 - DNA, 25 bp, Rattus norvegicus
catctttacaacttggtggtcccaa

SEQ ID NO: 238872 - DNA, 25 bp, Rattus norvegicus
catctttcaagaacacccgtggaat

SEQ ID NO: 238873 - DNA, 25 bp, Rattus norvegicus
catctttcaagatcacccgtggaat

SEQ ID NO: 238874 - DNA, 25 bp, Rattus norvegicus
catctttcatttccatacacttcta

SEQ ID NO: 238875 - DNA, 25 bp, Rattus norvegicus
catctttcatttgcatacacttcta

SEQ ID NO: 238876 - DNA, 25 bp, Rattus norvegicus
catctttctcaaaacgtttcaccga

SEQ ID NO: 238877 - DNA, 25 bp, Rattus norvegicus
catctttctcaatacgtttcaccga

SEQ ID NO: 238878 - DNA, 25 bp, Rattus norvegicus
catctttctcttaccatctggttta

SEQ ID NO: 238879 - DNA, 25 bp, Rattus norvegicus
catctttctctttccatctggttta

SEQ ID NO: 238880 - DNA, 25 bp, Rattus norvegicus
catctttctgatagcgtgaccgtgt

SEQ ID NO: 238881 - DNA, 25 bp, Rattus norvegicus
catctttctgattgcgtgaccgtgt

SEQ ID NO: 238882 - DNA, 25 bp, Rattus norvegicus
catctttctgctccagcagggttca

SEQ ID NO: 238883 - DNA, 25 bp, Rattus norvegicus
catctttctgctgcagcagggttca

SEQ ID NO: 238884 - DNA, 25 bp, Rattus norvegicus
catctttctttgcttatcagtagtc

SEQ ID NO: 238885 - DNA, 25 bp, Rattus norvegicus
catctttctttggttatcagtagtc

SEQ ID NO: 238886 - DNA, 25 bp, Rattus norvegicus
catctttgagccaggttctccaggg

SEQ ID NO: 238887 - DNA, 25 bp, Rattus norvegicus
catctttgagcctggttctccaggg

SEQ ID NO: 238888 - DNA, 25 bp, Rattus norvegicus
catctttgatgtcttgttcctggca

SEQ ID NO: 238889 - DNA, 25 bp, Rattus norvegicus
catctttgatgtgttgttcctggca

SEQ ID NO: 238890 - DNA, 25 bp, Rattus norvegicus
catctttgcataccccatgcatcat

SEQ ID NO: 238891 - DNA, 25 bp, Rattus norvegicus
catctttgcatagcccatgcatcat

SEQ ID NO: 238892 - DNA, 25 bp, Rattus norvegicus
catctttgctccaaacccaagtttg

SEQ ID NO: 238893 - DNA, 25 bp, Rattus norvegicus
catctttgctcctaacccaagtttg

SEQ ID NO: 238894 - DNA, 25 bp, Rattus norvegicus
catctttgtagcacaagtgaagctt

SEQ ID NO: 238895 - DNA, 25 bp, Rattus norvegicus
catctttgtagctcaagtgaagctt

SEQ ID NO: 238896 - DNA, 25 bp, Rattus norvegicus
catctttgtccgaaggtttgcgtaa

SEQ ID NO: 238897 - DNA, 25 bp, Rattus norvegicus
catctttgtccgtaggtttgcgtaa

SEQ ID NO: 238898 - DNA, 25 bp, Rattus norvegicus
catctttgtgctacctgactgcaga

SEQ ID NO: 238899 - DNA, 25 bp, Rattus norvegicus
catctttgtgcttcctgactgcaga

SEQ ID NO: 238900 - DNA, 25 bp, Rattus norvegicus
catctttgtgtacacctgcatgcaa

SEQ ID NO: 238901 - DNA, 25 bp, Rattus norvegicus
catctttgtgtagacctgcatgcaa

SEQ ID NO: 238902 - DNA, 25 bp, Rattus norvegicus
catcttttctgtcgagtcaactggg

SEQ ID NO: 238903 - DNA, 25 bp, Rattus norvegicus
catcttttctgtggagtcaactggg

SEQ ID NO: 238904 - DNA, 25 bp, Rattus norvegicus
catcttttctttctggtagggccta

SEQ ID NO: 238905 - DNA, 25 bp, Rattus norvegicus
catcttttctttgtggtagggccta

SEQ ID NO: 238906 - DNA, 25 bp, Rattus norvegicus
catcttttggttcactgtgcattaa

SEQ ID NO: 238907 - DNA, 25 bp, Rattus norvegicus
catcttttggttgactgtgcattaa

SEQ ID NO: 238908 - DNA, 25 bp, Rattus norvegicus
catgaaaaccttctgtggtaccccg

SEQ ID NO: 238909 - DNA, 25 bp, Rattus norvegicus
catgaaaaccttgtgtggtaccccg

SEQ ID NO: 238910 - DNA, 25 bp, Rattus norvegicus
catgaaaccgtgctgtatagtcttg

SEQ ID NO: 238911 - DNA, 25 bp, Rattus norvegicus
catgaaaccgtggtgtatagtcttg

SEQ ID NO: 238912 - DNA, 25 bp, Rattus norvegicus
catgaaacctaactcctgggattaa

SEQ ID NO: 238913 - DNA, 25 bp, Rattus norvegicus
catgaaacctaagtcctgggattaa

SEQ ID NO: 238914 - DNA, 25 bp, Rattus norvegicus
catgaaagacgaactggcagactat

SEQ ID NO: 238915 - DNA, 25 bp, Rattus norvegicus
catgaaagacgatctggcagactat

SEQ ID NO: 238916 - DNA, 25 bp, Rattus norvegicus
catgaaagtcgtcggaggcctgtct

SEQ ID NO: 238917 - DNA, 25 bp, Rattus norvegicus
catgaaagtcgtgggaggcctgtct

SEQ ID NO: 238918 - DNA, 25 bp, Rattus norvegicus
catgaaagtggacagggacagctct

SEQ ID NO: 238919 - DNA, 25 bp, Rattus norvegicus
catgaaagtggagagggacagctct

SEQ ID NO: 238920 - DNA, 25 bp, Rattus norvegicus
catgaaatccttagcgggtgttaaa

SEQ ID NO: 238921 - DNA, 25 bp, Rattus norvegicus
catgaaatcctttgcgggtgttaaa

SEQ ID NO: 238922 - DNA, 25 bp, Rattus norvegicus
catgaaatggcacctgcagtggtcc

SEQ ID NO: 238923 - DNA, 25 bp, Rattus norvegicus
catgaaatggcagctgcagtggtcc

SEQ ID NO: 238924 - DNA, 25 bp, Rattus norvegicus
catgaacagcctatgccaatcgtgg

SEQ ID NO: 238925 - DNA, 25 bp, Rattus norvegicus
catgaacagcctttgccaatcgtgg

SEQ ID NO: 238926 - DNA, 25 bp, Rattus norvegicus
catgaaccctcacaagctgcacgtg

SEQ ID NO: 238927 - DNA, 25 bp, Rattus norvegicus
catgaaccctcagaagctgcacgtg

SEQ ID NO: 238928 - DNA, 25 bp, Rattus norvegicus
catgaaccggctccaggatgactat

SEQ ID NO: 238929 - DNA, 25 bp, Rattus norvegicus
catgaaccggctgcaggatgactat

SEQ ID NO: 238930 - DNA, 25 bp, Rattus norvegicus
catgaaccttgaatgctggcactat

SEQ ID NO: 238931 - DNA, 25 bp, Rattus norvegicus
catgaaccttgattgctggcactat

SEQ ID NO: 238932 - DNA, 25 bp, Rattus norvegicus
catgaactctagcttctgaatcctc

SEQ ID NO: 238933 - DNA, 25 bp, Rattus norvegicus
catgaactctaggttctgaatcctc

SEQ ID NO: 238934 - DNA, 25 bp, Rattus norvegicus
catgaactctgtctaagctgctttt

SEQ ID NO: 238935 - DNA, 25 bp, Rattus norvegicus
catgaactctgtgtaagctgctttt

SEQ ID NO: 238936 - DNA, 25 bp, Rattus norvegicus
catgaacttgggaaagccaccttac

SEQ ID NO: 238937 - DNA, 25 bp, Rattus norvegicus
catgaacttgggtaagccaccttac

SEQ ID NO: 238938 - DNA, 25 bp, Rattus norvegicus
catgaagacattctgtggtacacca

SEQ ID NO: 238939 - DNA, 25 bp, Rattus norvegicus
catgaagacattgtgtggtacacca

SEQ ID NO: 238940 - DNA, 25 bp, Rattus norvegicus
catgaagagaatcccagagctggtg

SEQ ID NO: 238941 - DNA, 25 bp, Rattus norvegicus
catgaagagaatgccagagctggtg

SEQ ID NO: 238942 - DNA, 25 bp, Rattus norvegicus
catgaagatgctcaggcttgaaggt

SEQ ID NO: 238943 - DNA, 25 bp, Rattus norvegicus
catgaagatgctgaggcttgaaggt

SEQ ID NO: 238944 - DNA, 25 bp, Rattus norvegicus
catgaagattatactcagattgctt

SEQ ID NO: 238945 - DNA, 25 bp, Rattus norvegicus
catgaagattattctcagattgctt

SEQ ID NO: 238946 - DNA, 25 bp, Rattus norvegicus
catgaagcaggaccccgcagtgtgc

SEQ ID NO: 238947 - DNA, 25 bp, Rattus norvegicus
catgaagcaggagcccgcagtgtgc

SEQ ID NO: 238948 - DNA, 25 bp, Rattus norvegicus
catgaagcccagagtccaatctcag

SEQ ID NO: 238949 - DNA, 25 bp, Rattus norvegicus
catgaagcccagtgtccaatctcag

SEQ ID NO: 238950 - DNA, 25 bp, Rattus norvegicus
catgaagccctaaggacgtcgtaat

SEQ ID NO: 238951 - DNA, 25 bp, Rattus norvegicus
catgaagccctatggacgtcgtaat

SEQ ID NO: 238952 - DNA, 25 bp, Rattus norvegicus
catgaagctgagaggccgagagatt

SEQ ID NO: 238953 - DNA, 25 bp, Rattus norvegicus
catgaagctgagtggccgagagatt

SEQ ID NO: 238954 - DNA, 25 bp, Rattus norvegicus
catgaaggccgtccacgagagctct

SEQ ID NO: 238955 - DNA, 25 bp, Rattus norvegicus
catgaaggccgtgcacgagagctct

SEQ ID NO: 238956 - DNA, 25 bp, Rattus norvegicus
catgaaggtcctagttgttctgctt

SEQ ID NO: 238957 - DNA, 25 bp, Rattus norvegicus
catgaaggtccttgttgttctgctt

SEQ ID NO: 238958 - DNA, 25 bp, Rattus norvegicus
catgaaggtctaatctttgcacttt

SEQ ID NO: 238959 - DNA, 25 bp, Rattus norvegicus
catgaaggtctattctttgcacttt

SEQ ID NO: 238960 - DNA, 25 bp, Rattus norvegicus
catgaaggtggtcactcccggagcc

SEQ ID NO: 238961 - DNA, 25 bp, Rattus norvegicus
catgaaggtggtgactcccggagcc

SEQ ID NO: 238962 - DNA, 25 bp, Rattus norvegicus
catgaaggtttaccgccttgaactt

SEQ ID NO: 238963 - DNA, 25 bp, Rattus norvegicus
catgaaggtttagcgccttgaactt

SEQ ID NO: 238964 - DNA, 25 bp, Rattus norvegicus
catgaagtacttccatggaatggag

SEQ ID NO: 238965 - DNA, 25 bp, Rattus norvegicus
catgaagtacttgcatggaatggag

SEQ ID NO: 238966 - DNA, 25 bp, Rattus norvegicus
catgaagtcatacagggcctggagc

SEQ ID NO: 238967 - DNA, 25 bp, Rattus norvegicus
catgaagtcatagagggcctggagc

SEQ ID NO: 238968 - DNA, 25 bp, Rattus norvegicus
catgaagtggagactggctgccttt

SEQ ID NO: 238969 - DNA, 25 bp, Rattus norvegicus
catgaagtggagtctggctgccttt

SEQ ID NO: 238970 - DNA, 25 bp, Rattus norvegicus
catgaagttcttcctcttgtagagc

SEQ ID NO: 238971 - DNA, 25 bp, Rattus norvegicus
catgaagttcttgctcttgtagagc

SEQ ID NO: 238972 - DNA, 25 bp, Rattus norvegicus
catgaagtttccaatctgtacagat

SEQ ID NO: 238973 - DNA, 25 bp, Rattus norvegicus
catgaagtttcctatctgtacagat

SEQ ID NO: 238974 - DNA, 25 bp, Rattus norvegicus
catgaatacgtgatagctgttagga

SEQ ID NO: 238975 - DNA, 25 bp, Rattus norvegicus
catgaatacgtgttagctgttagga

SEQ ID NO: 238976 - DNA, 25 bp, Rattus norvegicus
catgaatacgttagccagctggttt

SEQ ID NO: 238977 - DNA, 25 bp, Rattus norvegicus
catgaatacgtttgccagctggttt

SEQ ID NO: 238978 - DNA, 25 bp, Rattus norvegicus
catgaatatgagactacccaccttt

SEQ ID NO: 238979 - DNA, 25 bp, Rattus norvegicus
catgaatatgagtctacccaccttt

SEQ ID NO: 238980 - DNA, 25 bp, Rattus norvegicus
catgaatgaatgaagggcacctcct

SEQ ID NO: 238981 - DNA, 25 bp, Rattus norvegicus
catgaatgaatgtagggcacctcct

SEQ ID NO: 238982 - DNA, 25 bp, Rattus norvegicus
catgaatgagaccagcagccgttct

SEQ ID NO: 238983 - DNA, 25 bp, Rattus norvegicus
catgaatgagacgagcagccgttct

SEQ ID NO: 238984 - DNA, 25 bp, Rattus norvegicus
catgaatgcagtccccatggaggct

SEQ ID NO: 238985 - DNA, 25 bp, Rattus norvegicus
catgaatgcagtgcccatggaggct

SEQ ID NO: 238986 - DNA, 25 bp, Rattus norvegicus
catgaatgcatgctcagtttattaa

SEQ ID NO: 238987 - DNA, 25 bp, Rattus norvegicus
catgaatgcatggtcagtttattaa

SEQ ID NO: 238988 - DNA, 25 bp, Rattus norvegicus
catgaatgcttacttctgtctccac

SEQ ID NO: 238989 - DNA, 25 bp, Rattus norvegicus
catgaatgcttagttctgtctccac

SEQ ID NO: 238990 - DNA, 25 bp, Rattus norvegicus
catgaatgcttcaaggaggtgttct

SEQ ID NO: 238991 - DNA, 25 bp, Rattus norvegicus
catgaatgcttctaggaggtgttct

SEQ ID NO: 238992 - DNA, 25 bp, Rattus norvegicus
catgaatggcccaggagctgtgtgc

SEQ ID NO: 238993 - DNA, 25 bp, Rattus norvegicus
catgaatggccctggagctgtgtgc

SEQ ID NO: 238994 - DNA, 25 bp, Rattus norvegicus
catgaatgtctcaatgtagctgtga

SEQ ID NO: 238995 - DNA, 25 bp, Rattus norvegicus
catgaatgtctctatgtagctgtga

SEQ ID NO: 238996 - DNA, 25 bp, Rattus norvegicus
catgaatgttgcctgctgcttgaac

SEQ ID NO: 238997 - DNA, 25 bp, Rattus norvegicus
catgaatgttgcctttgagtaactg

SEQ ID NO: 238998 - DNA, 25 bp, Rattus norvegicus
catgaatgttgcgtgctgcttgaac

SEQ ID NO: 238999 - DNA, 25 bp, Rattus norvegicus
catgaatgttgcgtttgagtaactg

SEQ ID NO: 239000 - DNA, 25 bp, Rattus norvegicus
catgaatttctaattcacaagggta

SEQ ID NO: 239001 - DNA, 25 bp, Rattus norvegicus
catgaatttctatttcacaagggta

SEQ ID NO: 239002 - DNA, 25 bp, Rattus norvegicus
catgaattttcaatgttctgtcaac

SEQ ID NO: 239003 - DNA, 25 bp, Rattus norvegicus
catgaattttcattgttctgtcaac

SEQ ID NO: 239004 - DNA, 25 bp, Rattus norvegicus
catgacaacctgaagtctctcctgt

SEQ ID NO: 239005 - DNA, 25 bp, Rattus norvegicus
catgacaacctgtagtctctcctgt

SEQ ID NO: 239006 - DNA, 25 bp, Rattus norvegicus
catgacaatagcagcattactgcca

SEQ ID NO: 239007 - DNA, 25 bp, Rattus norvegicus
catgacaatagctgcattactgcca

SEQ ID NO: 239008 - DNA, 25 bp, Rattus norvegicus
catgacaatgtcaggaactcgtttt

SEQ ID NO: 239009 - DNA, 25 bp, Rattus norvegicus
catgacaatgtctggaactcgtttt

SEQ ID NO: 239010 - DNA, 25 bp, Rattus norvegicus
catgacacagaacaccccgggagat

SEQ ID NO: 239011 - DNA, 25 bp, Rattus norvegicus
catgacacagaagaccccgggagat

SEQ ID NO: 239012 - DNA, 25 bp, Rattus norvegicus
catgacactgaaagacggacaggaa

SEQ ID NO: 239013 - DNA, 25 bp, Rattus norvegicus
catgacactgaatgacggacaggaa

SEQ ID NO: 239014 - DNA, 25 bp, Rattus norvegicus
catgacagctggcaaactcgaagta

SEQ ID NO: 239015 - DNA, 25 bp, Rattus norvegicus
catgacagctgggaaactcgaagta

SEQ ID NO: 239016 - DNA, 25 bp, Rattus norvegicus
catgacaggtagatggcagaagtac

SEQ ID NO: 239017 - DNA, 25 bp, Rattus norvegicus
catgacaggtagttggcagaagtac

SEQ ID NO: 239018 - DNA, 25 bp, Rattus norvegicus
catgacatggacagctctttgttaa

SEQ ID NO: 239019 - DNA, 25 bp, Rattus norvegicus
catgacatggactgctctttgttaa

SEQ ID NO: 239020 - DNA, 25 bp, Rattus norvegicus
catgaccagaagcttgacgcaccaa

SEQ ID NO: 239021 - DNA, 25 bp, Rattus norvegicus
catgaccagaaggttgacgcaccaa

SEQ ID NO: 239022 - DNA, 25 bp, Rattus norvegicus
catgaccatgctcccgcctaatgag

SEQ ID NO: 239023 - DNA, 25 bp, Rattus norvegicus
catgaccatgctgccgcctaatgag

SEQ ID NO: 239024 - DNA, 25 bp, Rattus norvegicus
catgaccgttctacccagatgggaa

SEQ ID NO: 239025 - DNA, 25 bp, Rattus norvegicus
catgaccgttcttcccagatgggaa

SEQ ID NO: 239026 - DNA, 25 bp, Rattus norvegicus
catgacctgcatcagagaagcatcc

SEQ ID NO: 239027 - DNA, 25 bp, Rattus norvegicus
catgacctgcatgagagaagcatcc

SEQ ID NO: 239028 - DNA, 25 bp, Rattus norvegicus
catgacctttagagaacccgaccga

SEQ ID NO: 239029 - DNA, 25 bp, Rattus norvegicus
catgacctttagtgaacccgaccga

SEQ ID NO: 239030 - DNA, 25 bp, Rattus norvegicus
catgacgaccaccatgatcatcatt

SEQ ID NO: 239031 - DNA, 25 bp, Rattus norvegicus
catgacgaccacgatgatcatcatt

SEQ ID NO: 239032 - DNA, 25 bp, Rattus norvegicus
catgacgctggtccttgaccatgaa

SEQ ID NO: 239033 - DNA, 25 bp, Rattus norvegicus
catgacgctggtgcttgaccatgaa

SEQ ID NO: 239034 - DNA, 25 bp, Rattus norvegicus
catgacgtcatacctctgcggaggt

SEQ ID NO: 239035 - DNA, 25 bp, Rattus norvegicus
catgacgtcatagctctgcggaggt

SEQ ID NO: 239036 - DNA, 25 bp, Rattus norvegicus
catgacgttgtgatttgctgtcgtt

SEQ ID NO: 239037 - DNA, 25 bp, Rattus norvegicus
catgacgttgtgttttgctgtcgtt

SEQ ID NO: 239038 - DNA, 25 bp, Rattus norvegicus
catgacgtttctaccacttgtaatt

SEQ ID NO: 239039 - DNA, 25 bp, Rattus norvegicus
catgacgtttcttccacttgtaatt

SEQ ID NO: 239040 - DNA, 25 bp, Rattus norvegicus
catgactcatgcatcgttaaacctg

SEQ ID NO: 239041 - DNA, 25 bp, Rattus norvegicus
catgactcatgcttcgttaaacctg

SEQ ID NO: 239042 - DNA, 25 bp, Rattus norvegicus
catgactccttacctggagagttaa

SEQ ID NO: 239043 - DNA, 25 bp, Rattus norvegicus
catgactccttagctggagagttaa

SEQ ID NO: 239044 - DNA, 25 bp, Rattus norvegicus
catgactctcggagccggactgggc

SEQ ID NO: 239045 - DNA, 25 bp, Rattus norvegicus
catgactctcggtgccggactgggc

SEQ ID NO: 239046 - DNA, 25 bp, Rattus norvegicus
catgactcttggaatgggctattcc

SEQ ID NO: 239047 - DNA, 25 bp, Rattus norvegicus
catgactcttggtatgggctattcc

SEQ ID NO: 239048 - DNA, 25 bp, Rattus norvegicus
catgactgtaataccgtgtgcgtaa

SEQ ID NO: 239049 - DNA, 25 bp, Rattus norvegicus
catgactgtaattccgtgtgcgtaa

SEQ ID NO: 239050 - DNA, 25 bp, Rattus norvegicus
catgactgtagcatcttgcagacaa

SEQ ID NO: 239051 - DNA, 25 bp, Rattus norvegicus
catgactgtagcttcttgcagacaa

SEQ ID NO: 239052 - DNA, 25 bp, Rattus norvegicus
catgactgtggacgcctgagcaagc

SEQ ID NO: 239053 - DNA, 25 bp, Rattus norvegicus
catgactgtggaggcctgagcaagc

SEQ ID NO: 239054 - DNA, 25 bp, Rattus norvegicus
catgactgtggtatcttattgtgta

SEQ ID NO: 239055 - DNA, 25 bp, Rattus norvegicus
catgactgtggtttcttattgtgta

SEQ ID NO: 239056 - DNA, 25 bp, Rattus norvegicus
catgactgttaaaatcctgaaaaat

SEQ ID NO: 239057 - DNA, 25 bp, Rattus norvegicus
catgactgttaatatcctgaaaaat

SEQ ID NO: 239058 - DNA, 25 bp, Rattus norvegicus
catgactgttacaccaggtctaggg

SEQ ID NO: 239059 - DNA, 25 bp, Rattus norvegicus
catgactgttactccaggtctaggg

SEQ ID NO: 239060 - DNA, 25 bp, Rattus norvegicus
catgacttacatcgtggagccactg

SEQ ID NO: 239061 - DNA, 25 bp, Rattus norvegicus
catgacttacatggtggagccactg

SEQ ID NO: 239062 - DNA, 25 bp, Rattus norvegicus
catgacttctccaatttctgtattt

SEQ ID NO: 239063 - DNA, 25 bp, Rattus norvegicus
catgacttctcctatttctgtattt

SEQ ID NO: 239064 - DNA, 25 bp, Rattus norvegicus
catgacttggttaaacgatttatac

SEQ ID NO: 239065 - DNA, 25 bp, Rattus norvegicus
catgacttggtttaacgatttatac

SEQ ID NO: 239066 - DNA, 25 bp, Rattus norvegicus
catgactttcctatcctaattttca

SEQ ID NO: 239067 - DNA, 25 bp, Rattus norvegicus
catgactttcctttcctaattttca

SEQ ID NO: 239068 - DNA, 25 bp, Rattus norvegicus
catgactttggtctttggctgccga

SEQ ID NO: 239069 - DNA, 25 bp, Rattus norvegicus
catgactttggtgtttggctgccga

SEQ ID NO: 239070 - DNA, 25 bp, Rattus norvegicus
catgagaaaaaccgcacaggccttc

SEQ ID NO: 239071 - DNA, 25 bp, Rattus norvegicus
catgagaaaaacggcacaggccttc

SEQ ID NO: 239072 - DNA, 25 bp, Rattus norvegicus
catgagaagcttcgcggtccggttt

SEQ ID NO: 239073 - DNA, 25 bp, Rattus norvegicus
catgagaagcttggcggtccggttt

SEQ ID NO: 239074 - DNA, 25 bp, Rattus norvegicus
catgagaccagtcgaacagggcaga

SEQ ID NO: 239075 - DNA, 25 bp, Rattus norvegicus
catgagaccagtggaacagggcaga

SEQ ID NO: 239076 - DNA, 25 bp, Rattus norvegicus
catgagacctataagtcagtgccca

SEQ ID NO: 239077 - DNA, 25 bp, Rattus norvegicus
catgagacctattagtcagtgccca

SEQ ID NO: 239078 - DNA, 25 bp, Rattus norvegicus
catgagacggtgaagctgcttgcct

SEQ ID NO: 239079 - DNA, 25 bp, Rattus norvegicus
catgagacggtgtagctgcttgcct

SEQ ID NO: 239080 - DNA, 25 bp, Rattus norvegicus
catgagagcccaccacaggaggagt

SEQ ID NO: 239081 - DNA, 25 bp, Rattus norvegicus
catgagagcccagcacaggaggagt

SEQ ID NO: 239082 - DNA, 25 bp, Rattus norvegicus
catgagatatttagtagtctacttt

SEQ ID NO: 239083 - DNA, 25 bp, Rattus norvegicus
catgagatattttgtagtctacttt

SEQ ID NO: 239084 - DNA, 25 bp, Rattus norvegicus
catgagatgggcatgtggtcctgcc

SEQ ID NO: 239085 - DNA, 25 bp, Rattus norvegicus
catgagatgggcttgtggtcctgcc

SEQ ID NO: 239086 - DNA, 25 bp, Rattus norvegicus
catgagatgtttaagcctctcagcc

SEQ ID NO: 239087 - DNA, 25 bp, Rattus norvegicus
catgagatgttttagcctctcagcc

SEQ ID NO: 239088 - DNA, 25 bp, Rattus norvegicus
catgagcaccttctggattttgttt

SEQ ID NO: 239089 - DNA, 25 bp, Rattus norvegicus
catgagcaccttgtggattttgttt

SEQ ID NO: 239090 - DNA, 25 bp, Rattus norvegicus
catgagcagtgtagacggagagact

SEQ ID NO: 239091 - DNA, 25 bp, Rattus norvegicus
catgagcagtgttgacggagagact

SEQ ID NO: 239092 - DNA, 25 bp, Rattus norvegicus
catgagcctcagagtttggaaaagt

SEQ ID NO: 239093 - DNA, 25 bp, Rattus norvegicus
catgagcctcagtgtttggaaaagt

SEQ ID NO: 239094 - DNA, 25 bp, Rattus norvegicus
catgagccttttatacatttgtgaa

SEQ ID NO: 239095 - DNA, 25 bp, Rattus norvegicus
catgagccttttttacatttgtgaa

SEQ ID NO: 239096 - DNA, 25 bp, Rattus norvegicus
catgagcgggaacctagagaagcct

SEQ ID NO: 239097 - DNA, 25 bp, Rattus norvegicus
catgagcgggaagctagagaagcct

SEQ ID NO: 239098 - DNA, 25 bp, Rattus norvegicus
catgagcgtatgagccaatgtcaaa

SEQ ID NO: 239099 - DNA, 25 bp, Rattus norvegicus
catgagcgtatgtgccaatgtcaaa

SEQ ID NO: 239100 - DNA, 25 bp, Rattus norvegicus
catgagcgtgttcgccgatgccagt

SEQ ID NO: 239101 - DNA, 25 bp, Rattus norvegicus
catgagcgtgttggccgatgccagt

SEQ ID NO: 239102 - DNA, 25 bp, Rattus norvegicus
catgagctactgaatcatccttaag

SEQ ID NO: 239103 - DNA, 25 bp, Rattus norvegicus
catgagctactgtatcatccttaag

SEQ ID NO: 239104 - DNA, 25 bp, Rattus norvegicus
catgagctattactgcatttctgca

SEQ ID NO: 239105 - DNA, 25 bp, Rattus norvegicus
catgagctattagtgcatttctgca

SEQ ID NO: 239106 - DNA, 25 bp, Rattus norvegicus
catgagctcaggatagttgtcccct

SEQ ID NO: 239107 - DNA, 25 bp, Rattus norvegicus
catgagctcaggttagttgtcccct

SEQ ID NO: 239108 - DNA, 25 bp, Rattus norvegicus
catgagctccatccagctgtttgag

SEQ ID NO: 239109 - DNA, 25 bp, Rattus norvegicus
catgagctccatgcagctgtttgag

SEQ ID NO: 239110 - DNA, 25 bp, Rattus norvegicus
catgagctgattctgaagtatcgat

SEQ ID NO: 239111 - DNA, 25 bp, Rattus norvegicus
catgagctgattgtgaagtatcgat

SEQ ID NO: 239112 - DNA, 25 bp, Rattus norvegicus
catgagctgtttcacttattcgaag

SEQ ID NO: 239113 - DNA, 25 bp, Rattus norvegicus
catgagctgtttgacttattcgaag

SEQ ID NO: 239114 - DNA, 25 bp, Rattus norvegicus
catgagcttgcgcttggtgtgttaa

SEQ ID NO: 239115 - DNA, 25 bp, Rattus norvegicus
catgagcttgcggttggtgtgttaa

SEQ ID NO: 239116 - DNA, 25 bp, Rattus norvegicus
catgagcttgggatttgttagggtc

SEQ ID NO: 239117 - DNA, 25 bp, Rattus norvegicus
catgagcttgggttttgttagggtc

SEQ ID NO: 239118 - DNA, 25 bp, Rattus norvegicus
catgaggaagatccgcgccaatgcc

SEQ ID NO: 239119 - DNA, 25 bp, Rattus norvegicus
catgaggaagatgcgcgccaatgcc

SEQ ID NO: 239120 - DNA, 25 bp, Rattus norvegicus
catgaggatatcatcggtgcggtct

SEQ ID NO: 239121 - DNA, 25 bp, Rattus norvegicus
catgaggatatcttcggtgcggtct

SEQ ID NO: 239122 - DNA, 25 bp, Rattus norvegicus
catgaggatgtaccctttccagatc

SEQ ID NO: 239123 - DNA, 25 bp, Rattus norvegicus
catgaggatgtagcctttccagatc

SEQ ID NO: 239124 - DNA, 25 bp, Rattus norvegicus
catgaggcaattctgctggctgcgt

SEQ ID NO: 239125 - DNA, 25 bp, Rattus norvegicus
catgaggcaattgtgctggctgcgt

SEQ ID NO: 239126 - DNA, 25 bp, Rattus norvegicus
catgaggctgtgatgaagtgactta

SEQ ID NO: 239127 - DNA, 25 bp, Rattus norvegicus
catgaggctgtgttgaagtgactta

SEQ ID NO: 239128 - DNA, 25 bp, Rattus norvegicus
catgaggctttaccgaggcgagact

SEQ ID NO: 239129 - DNA, 25 bp, Rattus norvegicus
catgaggctttagcgaggcgagact

SEQ ID NO: 239130 - DNA, 25 bp, Rattus norvegicus
catgagggccaaagtctgtgtcctg

SEQ ID NO: 239131 - DNA, 25 bp, Rattus norvegicus
catgagggccaatgtctgtgtcctg

SEQ ID NO: 239132 - DNA, 25 bp, Rattus norvegicus
catgagggtgttctgaggatcaaat

SEQ ID NO: 239133 - DNA, 25 bp, Rattus norvegicus
catgagggtgttgtgaggatcaaat

SEQ ID NO: 239134 - DNA, 25 bp, Rattus norvegicus
catgaggtcccgaagatgcatctta

SEQ ID NO: 239135 - DNA, 25 bp, Rattus norvegicus
catgaggtcccgtagatgcatctta

SEQ ID NO: 239136 - DNA, 25 bp, Rattus norvegicus
catgaggtgaatattccttccttag

SEQ ID NO: 239137 - DNA, 25 bp, Rattus norvegicus
catgaggtgaattttccttccttag

SEQ ID NO: 239138 - DNA, 25 bp, Rattus norvegicus
catgaggtgcggaaggtcctctctt

SEQ ID NO: 239139 - DNA, 25 bp, Rattus norvegicus
catgaggtgcggtaggtcctctctt

SEQ ID NO: 239140 - DNA, 25 bp, Rattus norvegicus
catgagtaggttcagcagctccact

SEQ ID NO: 239141 - DNA, 25 bp, Rattus norvegicus
catgagtaggttgagcagctccact

SEQ ID NO: 239142 - DNA, 25 bp, Rattus norvegicus
catgagtatcatagctgtcctggtt

SEQ ID NO: 239143 - DNA, 25 bp, Rattus norvegicus
catgagtatcattgctgtcctggtt

SEQ ID NO: 239144 - DNA, 25 bp, Rattus norvegicus
catgagtattgtagacattttgcta

SEQ ID NO: 239145 - DNA, 25 bp, Rattus norvegicus
catgagtattgttgacattttgcta

SEQ ID NO: 239146 - DNA, 25 bp, Rattus norvegicus
catgagtcaacaagggcagactgta

SEQ ID NO: 239147 - DNA, 25 bp, Rattus norvegicus
catgagtcaacatgggcagactgta

SEQ ID NO: 239148 - DNA, 25 bp, Rattus norvegicus
catgagtcattaactggtcctgtat

SEQ ID NO: 239149 - DNA, 25 bp, Rattus norvegicus
catgagtcattatctggtcctgtat

SEQ ID NO: 239150 - DNA, 25 bp, Rattus norvegicus
catgagtgcatgactgtaaaactaa

SEQ ID NO: 239151 - DNA, 25 bp, Rattus norvegicus
catgagtgcatgtctgtaaaactaa

SEQ ID NO: 239152 - DNA, 25 bp, Rattus norvegicus
catgagtgcctgatttgacttccga

SEQ ID NO: 239153 - DNA, 25 bp, Rattus norvegicus
catgagtgcctgttttgacttccga

SEQ ID NO: 239154 - DNA, 25 bp, Rattus norvegicus
catgagtgctgcatgcgggtttcat

SEQ ID NO: 239155 - DNA, 25 bp, Rattus norvegicus
catgagtgctgcttgcgggtttcat

SEQ ID NO: 239156 - DNA, 25 bp, Rattus norvegicus
catgagtgtttcactgtcgaagact

SEQ ID NO: 239157 - DNA, 25 bp, Rattus norvegicus
catgagtgtttctctgtcgaagact

SEQ ID NO: 239158 - DNA, 25 bp, Rattus norvegicus
catgagttacacagatagcttttag

SEQ ID NO: 239159 - DNA, 25 bp, Rattus norvegicus
catgagttacactgatagcttttag

SEQ ID NO: 239160 - DNA, 25 bp, Rattus norvegicus
catgagttggtcaccagtttggcaa

SEQ ID NO: 239161 - DNA, 25 bp, Rattus norvegicus
catgagttggtctccagtttggcaa

SEQ ID NO: 239162 - DNA, 25 bp, Rattus norvegicus
catgagtttaaacccggcctggcct

SEQ ID NO: 239163 - DNA, 25 bp, Rattus norvegicus
catgagtttaaagccggcctggcct

SEQ ID NO: 239164 - DNA, 25 bp, Rattus norvegicus
catgataatgtgaatttctccgaat

SEQ ID NO: 239165 - DNA, 25 bp, Rattus norvegicus
catgataatgtgtatttctccgaat

SEQ ID NO: 239166 - DNA, 25 bp, Rattus norvegicus
catgataattgcacacagattttac

SEQ ID NO: 239167 - DNA, 25 bp, Rattus norvegicus
catgataattgctcacagattttac

SEQ ID NO: 239168 - DNA, 25 bp, Rattus norvegicus
catgatacacccactctggtaatag

SEQ ID NO: 239169 - DNA, 25 bp, Rattus norvegicus
catgatacaccctctctggtaatag

SEQ ID NO: 239170 - DNA, 25 bp, Rattus norvegicus
catgatatctccatggtgggtttct

SEQ ID NO: 239171 - DNA, 25 bp, Rattus norvegicus
catgatatctccttggtgggtttct

SEQ ID NO: 239172 - DNA, 25 bp, Rattus norvegicus
catgatattccccagaggcagtctg

SEQ ID NO: 239173 - DNA, 25 bp, Rattus norvegicus
catgatattcccgagaggcagtctg

SEQ ID NO: 239174 - DNA, 25 bp, Rattus norvegicus
catgatatttccacactccttttga

SEQ ID NO: 239175 - DNA, 25 bp, Rattus norvegicus
catgatatttcctcactccttttga

SEQ ID NO: 239176 - DNA, 25 bp, Rattus norvegicus
catgatcacttcacttgttacaagt

SEQ ID NO: 239177 - DNA, 25 bp, Rattus norvegicus
catgatcacttctcttgttacaagt

SEQ ID NO: 239178 - DNA, 25 bp, Rattus norvegicus
catgatcatggtccccatttgctac

SEQ ID NO: 239179 - DNA, 25 bp, Rattus norvegicus
catgatcatggtctgttgctaaagt

SEQ ID NO: 239180 - DNA, 25 bp, Rattus norvegicus
catgatcatggtgcccatttgctac

SEQ ID NO: 239181 - DNA, 25 bp, Rattus norvegicus
catgatcatggtgtgttgctaaagt

SEQ ID NO: 239182 - DNA, 25 bp, Rattus norvegicus
catgatcccaatccgctataatctg

SEQ ID NO: 239183 - DNA, 25 bp, Rattus norvegicus
catgatcccaatgcgctataatctg

SEQ ID NO: 239184 - DNA, 25 bp, Rattus norvegicus
catgatcccatgagccaaagttctg

SEQ ID NO: 239185 - DNA, 25 bp, Rattus norvegicus
catgatcccatgtgccaaagttctg

SEQ ID NO: 239186 - DNA, 25 bp, Rattus norvegicus
catgatcctcttcttcttctaataa

SEQ ID NO: 239187 - DNA, 25 bp, Rattus norvegicus
catgatcctcttgttcttctaataa

SEQ ID NO: 239188 - DNA, 25 bp, Rattus norvegicus
catgatcggacaaacctgcgggtat

SEQ ID NO: 239189 - DNA, 25 bp, Rattus norvegicus
catgatcggacatacctgcgggtat

SEQ ID NO: 239190 - DNA, 25 bp, Rattus norvegicus
catgatctccgtctagagcagctac

SEQ ID NO: 239191 - DNA, 25 bp, Rattus norvegicus
catgatctccgtgtagagcagctac

SEQ ID NO: 239192 - DNA, 25 bp, Rattus norvegicus
catgatctgtgtctctggctggtaa

SEQ ID NO: 239193 - DNA, 25 bp, Rattus norvegicus
catgatctgtgtgtctggctggtaa

SEQ ID NO: 239194 - DNA, 25 bp, Rattus norvegicus
catgatctttatcccgcatgagctg

SEQ ID NO: 239195 - DNA, 25 bp, Rattus norvegicus
catgatctttatgccgcatgagctg

SEQ ID NO: 239196 - DNA, 25 bp, Rattus norvegicus
catgatgaccatcgactaaccctct

SEQ ID NO: 239197 - DNA, 25 bp, Rattus norvegicus
catgatgaccatggactaaccctct

SEQ ID NO: 239198 - DNA, 25 bp, Rattus norvegicus
catgatgacgagagctttttctagc

SEQ ID NO: 239199 - DNA, 25 bp, Rattus norvegicus
catgatgacgagtgctttttctagc

SEQ ID NO: 239200 - DNA, 25 bp, Rattus norvegicus
catgatgactcgagacagtctgtga

SEQ ID NO: 239201 - DNA, 25 bp, Rattus norvegicus
catgatgactcgtgacagtctgtga

SEQ ID NO: 239202 - DNA, 25 bp, Rattus norvegicus
catgatgagtcaaatgctgtttgca

SEQ ID NO: 239203 - DNA, 25 bp, Rattus norvegicus
catgatgagtcatatgctgtttgca

SEQ ID NO: 239204 - DNA, 25 bp, Rattus norvegicus
catgatgattgaatggctgtttcca

SEQ ID NO: 239205 - DNA, 25 bp, Rattus norvegicus
catgatgattgattggctgtttcca

SEQ ID NO: 239206 - DNA, 25 bp, Rattus norvegicus
catgatgattttctagtctgacagt

SEQ ID NO: 239207 - DNA, 25 bp, Rattus norvegicus
catgatgattttgtagtctgacagt

SEQ ID NO: 239208 - DNA, 25 bp, Rattus norvegicus
catgatgcagagaggcggtaccttt

SEQ ID NO: 239209 - DNA, 25 bp, Rattus norvegicus
catgatgcagagtggcggtaccttt

SEQ ID NO: 239210 - DNA, 25 bp, Rattus norvegicus
catgatgcagccagttctgtggtga

SEQ ID NO: 239211 - DNA, 25 bp, Rattus norvegicus
catgatgcagcctgttctgtggtga

SEQ ID NO: 239212 - DNA, 25 bp, Rattus norvegicus
catgatgcatccatctctgttgtcg

SEQ ID NO: 239213 - DNA, 25 bp, Rattus norvegicus
catgatgcatccttctctgttgtcg

SEQ ID NO: 239214 - DNA, 25 bp, Rattus norvegicus
catgatgccctgatcctggatgtgg

SEQ ID NO: 239215 - DNA, 25 bp, Rattus norvegicus
catgatgccctgttcctggatgtgg

SEQ ID NO: 239216 - DNA, 25 bp, Rattus norvegicus
catgatgccgttcctacttgcaatc

SEQ ID NO: 239217 - DNA, 25 bp, Rattus norvegicus
catgatgccgttgctacttgcaatc

SEQ ID NO: 239218 - DNA, 25 bp, Rattus norvegicus
catgatgcggctccgaggctcggcg

SEQ ID NO: 239219 - DNA, 25 bp, Rattus norvegicus
catgatgcggctgcgaggctcggcg

SEQ ID NO: 239220 - DNA, 25 bp, Rattus norvegicus
catgatgctcagagcagtaccgttt

SEQ ID NO: 239221 - DNA, 25 bp, Rattus norvegicus
catgatgctcagtgcagtaccgttt

SEQ ID NO: 239222 - DNA, 25 bp, Rattus norvegicus
catgatgcttcgaattgccaggatt

SEQ ID NO: 239223 - DNA, 25 bp, Rattus norvegicus
catgatgcttcgtattgccaggatt

SEQ ID NO: 239224 - DNA, 25 bp, Rattus norvegicus
catgatggcccaagtctctgtacgg

SEQ ID NO: 239225 - DNA, 25 bp, Rattus norvegicus
catgatggcccatgtctctgtacgg

SEQ ID NO: 239226 - DNA, 25 bp, Rattus norvegicus
catgatgtaccacgccatgggcgtc

SEQ ID NO: 239227 - DNA, 25 bp, Rattus norvegicus
catgatgtaccaggccatgggcgtc

SEQ ID NO: 239228 - DNA, 25 bp, Rattus norvegicus
catgatgtcctgattgtaatagtag

SEQ ID NO: 239229 - DNA, 25 bp, Rattus norvegicus
catgatgtcctgtttgtaatagtag

SEQ ID NO: 239230 - DNA, 25 bp, Rattus norvegicus
catgatgtctccagaatttggttat

SEQ ID NO: 239231 - DNA, 25 bp, Rattus norvegicus
catgatgtctcctgaatttggttat

SEQ ID NO: 239232 - DNA, 25 bp, Rattus norvegicus
catgatgttcaacgctggcagcttt

SEQ ID NO: 239233 - DNA, 25 bp, Rattus norvegicus
catgatgttcaaggctggcagcttt

SEQ ID NO: 239234 - DNA, 25 bp, Rattus norvegicus
catgatgtttaaaaagccctttgga

SEQ ID NO: 239235 - DNA, 25 bp, Rattus norvegicus
catgatgtttaataagccctttgga

SEQ ID NO: 239236 - DNA, 25 bp, Rattus norvegicus
catgatgtttgcctccacttgagag

SEQ ID NO: 239237 - DNA, 25 bp, Rattus norvegicus
catgatgtttgcgtccacttgagag

SEQ ID NO: 239238 - DNA, 25 bp, Rattus norvegicus
catgattacagccagatgtggtggt

SEQ ID NO: 239239 - DNA, 25 bp, Rattus norvegicus
catgattacagcgagatgtggtggt

SEQ ID NO: 239240 - DNA, 25 bp, Rattus norvegicus
catgattactgtacggctaatggac

SEQ ID NO: 239241 - DNA, 25 bp, Rattus norvegicus
catgattactgttcggctaatggac

SEQ ID NO: 239242 - DNA, 25 bp, Rattus norvegicus
catgattcagtgagatcctgtgtta

SEQ ID NO: 239243 - DNA, 25 bp, Rattus norvegicus
catgattcagtgtgatcctgtgtta

SEQ ID NO: 239244 - DNA, 25 bp, Rattus norvegicus
catgattcccgccccgctgctggga

SEQ ID NO: 239245 - DNA, 25 bp, Rattus norvegicus
catgattcccgcgccgctgctggga

SEQ ID NO: 239246 - DNA, 25 bp, Rattus norvegicus
catgattcctgactacaacctgtat

SEQ ID NO: 239247 - DNA, 25 bp, Rattus norvegicus
catgattcctgagtacaacctgtat

SEQ ID NO: 239248 - DNA, 25 bp, Rattus norvegicus
catgattcggaaacggtcttttggg

SEQ ID NO: 239249 - DNA, 25 bp, Rattus norvegicus
catgattcggaatcggtcttttggg

SEQ ID NO: 239250 - DNA, 25 bp, Rattus norvegicus
catgattctgggagttggcaactcc

SEQ ID NO: 239251 - DNA, 25 bp, Rattus norvegicus
catgattctgggtgttggcaactcc

SEQ ID NO: 239252 - DNA, 25 bp, Rattus norvegicus
catgattgccctacacttacaagaa

SEQ ID NO: 239253 - DNA, 25 bp, Rattus norvegicus
catgattgcccttcacttacaagaa

SEQ ID NO: 239254 - DNA, 25 bp, Rattus norvegicus
catgattgtctgactcactgagcca

SEQ ID NO: 239255 - DNA, 25 bp, Rattus norvegicus
catgattgtctgtctcactgagcca

SEQ ID NO: 239256 - DNA, 25 bp, Rattus norvegicus
catgatttaagcctgctgggtttaa

SEQ ID NO: 239257 - DNA, 25 bp, Rattus norvegicus
catgatttaagcgtgctgggtttaa

SEQ ID NO: 239258 - DNA, 25 bp, Rattus norvegicus
catgatttccttcactatggacctt

SEQ ID NO: 239259 - DNA, 25 bp, Rattus norvegicus
catgatttccttgactatggacctt

SEQ ID NO: 239260 - DNA, 25 bp, Rattus norvegicus
catgatttctgaatgtttcctgtaa

SEQ ID NO: 239261 - DNA, 25 bp, Rattus norvegicus
catgatttctgattgtttcctgtaa

SEQ ID NO: 239262 - DNA, 25 bp, Rattus norvegicus
catgattttcaacgacaagctctaa

SEQ ID NO: 239263 - DNA, 25 bp, Rattus norvegicus
catgattttcaaggacaagctctaa

SEQ ID NO: 239264 - DNA, 25 bp, Rattus norvegicus
catgattttgcacagcctttggttt

SEQ ID NO: 239265 - DNA, 25 bp, Rattus norvegicus
catgattttgcagagcctttggttt

SEQ ID NO: 239266 - DNA, 25 bp, Rattus norvegicus
catgcaaagaggatgtgacccacaa

SEQ ID NO: 239267 - DNA, 25 bp, Rattus norvegicus
catgcaaagaggttgtgacccacaa

SEQ ID NO: 239268 - DNA, 25 bp, Rattus norvegicus
catgcaaagcatcgtggcacttgag

SEQ ID NO: 239269 - DNA, 25 bp, Rattus norvegicus
catgcaaagcatggtggcacttgag

SEQ ID NO: 239270 - DNA, 25 bp, Rattus norvegicus
catgcaaagcctccaggtagctggt

SEQ ID NO: 239271 - DNA, 25 bp, Rattus norvegicus
catgcaaagcctgcaggtagctggt

SEQ ID NO: 239272 - DNA, 25 bp, Rattus norvegicus
catgcaaagttgcactcggtttttt

SEQ ID NO: 239273 - DNA, 25 bp, Rattus norvegicus
catgcaaagttggactcggtttttt

SEQ ID NO: 239274 - DNA, 25 bp, Rattus norvegicus
catgcaaatcataacctgtctcctg

SEQ ID NO: 239275 - DNA, 25 bp, Rattus norvegicus
catgcaaatcattacctgtctcctg

SEQ ID NO: 239276 - DNA, 25 bp, Rattus norvegicus
catgcaacaccacccaatatattac

SEQ ID NO: 239277 - DNA, 25 bp, Rattus norvegicus
catgcaacaccagccaatatattac

SEQ ID NO: 239278 - DNA, 25 bp, Rattus norvegicus
catgcaactgcaaaacgtaccagga

SEQ ID NO: 239279 - DNA, 25 bp, Rattus norvegicus
catgcaactgcaattctcaagcacc

SEQ ID NO: 239280 - DNA, 25 bp, Rattus norvegicus
catgcaactgcataacgtaccagga

SEQ ID NO: 239281 - DNA, 25 bp, Rattus norvegicus
catgcaactgcatttctcaagcacc

SEQ ID NO: 239282 - DNA, 25 bp, Rattus norvegicus
catgcaagatgccaaagacctaatt

SEQ ID NO: 239283 - DNA, 25 bp, Rattus norvegicus
catgcaagatgcgaaagacctaatt

SEQ ID NO: 239284 - DNA, 25 bp, Rattus norvegicus
catgcaatattaacagttcgtggga

SEQ ID NO: 239285 - DNA, 25 bp, Rattus norvegicus
catgcaatattatcagttcgtggga

SEQ ID NO: 239286 - DNA, 25 bp, Rattus norvegicus
catgcaattttgagactaggtctta

SEQ ID NO: 239287 - DNA, 25 bp, Rattus norvegicus
catgcaattttgtgactaggtctta

SEQ ID NO: 239288 - DNA, 25 bp, Rattus norvegicus
catgcacaaattaggcctctggatt

SEQ ID NO: 239289 - DNA, 25 bp, Rattus norvegicus
catgcacaaatttggcctctggatt

SEQ ID NO: 239290 - DNA, 25 bp, Rattus norvegicus
catgcacaaggcctgtgtttgcttt

SEQ ID NO: 239291 - DNA, 25 bp, Rattus norvegicus
catgcacaaggcgtgtgtttgcttt

SEQ ID NO: 239292 - DNA, 25 bp, Rattus norvegicus
catgcacagggtcgctcaggatcac

SEQ ID NO: 239293 - DNA, 25 bp, Rattus norvegicus
catgcacagggtggctcaggatcac

SEQ ID NO: 239294 - DNA, 25 bp, Rattus norvegicus
catgcacatgatcatatgagacccc

SEQ ID NO: 239295 - DNA, 25 bp, Rattus norvegicus
catgcacatgatgatatgagacccc

SEQ ID NO: 239296 - DNA, 25 bp, Rattus norvegicus
catgcacatgccagttttgctggaa

SEQ ID NO: 239297 - DNA, 25 bp, Rattus norvegicus
catgcacatgcctgttttgctggaa

SEQ ID NO: 239298 - DNA, 25 bp, Rattus norvegicus
catgcaccaccaccttgagaaggaa

SEQ ID NO: 239299 - DNA, 25 bp, Rattus norvegicus
catgcaccaccagcttgagaaggaa

SEQ ID NO: 239300 - DNA, 25 bp, Rattus norvegicus
catgcaccaggcaatggctgaggta

SEQ ID NO: 239301 - DNA, 25 bp, Rattus norvegicus
catgcaccaggctatggctgaggta

SEQ ID NO: 239302 - DNA, 25 bp, Rattus norvegicus
catgcaccatggagggagacttata

SEQ ID NO: 239303 - DNA, 25 bp, Rattus norvegicus
catgcaccatggtgggagacttata

SEQ ID NO: 239304 - DNA, 25 bp, Rattus norvegicus
catgcacccctgatgggaagatcaa

SEQ ID NO: 239305 - DNA, 25 bp, Rattus norvegicus
catgcacccctgttgggaagatcaa

SEQ ID NO: 239306 - DNA, 25 bp, Rattus norvegicus
catgcacctcctcataaatgtatta

SEQ ID NO: 239307 - DNA, 25 bp, Rattus norvegicus
catgcacctcctgataaatgtatta

SEQ ID NO: 239308 - DNA, 25 bp, Rattus norvegicus
catgcacctggccagtctaagcttg

SEQ ID NO: 239309 - DNA, 25 bp, Rattus norvegicus
catgcacctggcgagtctaagcttg

SEQ ID NO: 239310 - DNA, 25 bp, Rattus norvegicus
catgcacctgttagtaaaagtcaac

SEQ ID NO: 239311 - DNA, 25 bp, Rattus norvegicus
catgcacctgtttgtaaaagtcaac

SEQ ID NO: 239312 - DNA, 25 bp, Rattus norvegicus
catgcaccttctaagtacttacaag

SEQ ID NO: 239313 - DNA, 25 bp, Rattus norvegicus
catgcaccttcttagtacttacaag

SEQ ID NO: 239314 - DNA, 25 bp, Rattus norvegicus
catgcacgctcacgcagtttctaac

SEQ ID NO: 239315 - DNA, 25 bp, Rattus norvegicus
catgcacgctcaggcagtttctaac

SEQ ID NO: 239316 - DNA, 25 bp, Rattus norvegicus
catgcactcgctaagttaaagtcaa

SEQ ID NO: 239317 - DNA, 25 bp, Rattus norvegicus
catgcactcgcttagttaaagtcaa

SEQ ID NO: 239318 - DNA, 25 bp, Rattus norvegicus
catgcactgcctatgggagtgggct

SEQ ID NO: 239319 - DNA, 25 bp, Rattus norvegicus
catgcactgcctttgggagtgggct

SEQ ID NO: 239320 - DNA, 25 bp, Rattus norvegicus
catgcactgctgaagatatactgga

SEQ ID NO: 239321 - DNA, 25 bp, Rattus norvegicus
catgcactgctgtagatatactgga

SEQ ID NO: 239322 - DNA, 25 bp, Rattus norvegicus
catgcactgtgccttcaagatgaaa

SEQ ID NO: 239323 - DNA, 25 bp, Rattus norvegicus
catgcactgtgcgttcaagatgaaa

SEQ ID NO: 239324 - DNA, 25 bp, Rattus norvegicus
catgcacttctcataggctgaggaa

SEQ ID NO: 239325 - DNA, 25 bp, Rattus norvegicus
catgcacttctcttaggctgaggaa

SEQ ID NO: 239326 - DNA, 25 bp, Rattus norvegicus
catgcacttgagctcaacctgcact

SEQ ID NO: 239327 - DNA, 25 bp, Rattus norvegicus
catgcacttgaggtcaacctgcact

SEQ ID NO: 239328 - DNA, 25 bp, Rattus norvegicus
catgcactttccacaaaccttaaaa

SEQ ID NO: 239329 - DNA, 25 bp, Rattus norvegicus
catgcactttcctcaaaccttaaaa

SEQ ID NO: 239330 - DNA, 25 bp, Rattus norvegicus
catgcagaagttccaagtcctttct

SEQ ID NO: 239331 - DNA, 25 bp, Rattus norvegicus
catgcagaagttgcaagtcctttct

SEQ ID NO: 239332 - DNA, 25 bp, Rattus norvegicus
catgcagacactagagggcccatta

SEQ ID NO: 239333 - DNA, 25 bp, Rattus norvegicus
catgcagacacttgagggcccatta

SEQ ID NO: 239334 - DNA, 25 bp, Rattus norvegicus
catgcagaggctcagcttgtgctta

SEQ ID NO: 239335 - DNA, 25 bp, Rattus norvegicus
catgcagaggctgagcttgtgctta

SEQ ID NO: 239336 - DNA, 25 bp, Rattus norvegicus
catgcagatatacagccgccagttg

SEQ ID NO: 239337 - DNA, 25 bp, Rattus norvegicus
catgcagatatagagccgccagttg

SEQ ID NO: 239338 - DNA, 25 bp, Rattus norvegicus
catgcagatgagagccctgggcaac

SEQ ID NO: 239339 - DNA, 25 bp, Rattus norvegicus
catgcagatgagtgccctgggcaac

SEQ ID NO: 239340 - DNA, 25 bp, Rattus norvegicus
catgcagcacatcgccaagaacgtc

SEQ ID NO: 239341 - DNA, 25 bp, Rattus norvegicus
catgcagcacatggccaagaacgtc

SEQ ID NO: 239342 - DNA, 25 bp, Rattus norvegicus
catgcagcagatctttgcccttgga

SEQ ID NO: 239343 - DNA, 25 bp, Rattus norvegicus
catgcagcagatgtttgcccttgga

SEQ ID NO: 239344 - DNA, 25 bp, Rattus norvegicus
catgcagcctgcattttcttacaag

SEQ ID NO: 239345 - DNA, 25 bp, Rattus norvegicus
catgcagcctgctttttcttacaag

SEQ ID NO: 239346 - DNA, 25 bp, Rattus norvegicus
catgcagctcggacggtagagcatt

SEQ ID NO: 239347 - DNA, 25 bp, Rattus norvegicus
catgcagctcggtcggtagagcatt

SEQ ID NO: 239348 - DNA, 25 bp, Rattus norvegicus
catgcaggacaaacaagccaaggat

SEQ ID NO: 239349 - DNA, 25 bp, Rattus norvegicus
catgcaggacaatcaagccaaggat

SEQ ID NO: 239350 - DNA, 25 bp, Rattus norvegicus
catgcaggaggcactgtgttttatc

SEQ ID NO: 239351 - DNA, 25 bp, Rattus norvegicus
catgcaggaggctctgtgttttatc

SEQ ID NO: 239352 - DNA, 25 bp, Rattus norvegicus
catgcaggctaaacattgtacacgt

SEQ ID NO: 239353 - DNA, 25 bp, Rattus norvegicus
catgcaggctaatcattgtacacgt

SEQ ID NO: 239354 - DNA, 25 bp, Rattus norvegicus
catgcaggctttcgggctatctgaa

SEQ ID NO: 239355 - DNA, 25 bp, Rattus norvegicus
catgcaggctttggggctatctgaa

SEQ ID NO: 239356 - DNA, 25 bp, Rattus norvegicus
catgcaggtagacctgcgtctggct

SEQ ID NO: 239357 - DNA, 25 bp, Rattus norvegicus
catgcaggtagagctgcgtctggct

SEQ ID NO: 239358 - DNA, 25 bp, Rattus norvegicus
catgcaggtgctcttctccggtgag

SEQ ID NO: 239359 - DNA, 25 bp, Rattus norvegicus
catgcaggtgctgttctccggtgag

SEQ ID NO: 239360 - DNA, 25 bp, Rattus norvegicus
catgcagtattcagtttccagcaag

SEQ ID NO: 239361 - DNA, 25 bp, Rattus norvegicus
catgcagtattctgtttccagcaag

SEQ ID NO: 239362 - DNA, 25 bp, Rattus norvegicus
catgcagtccatctccattcaggaa

SEQ ID NO: 239363 - DNA, 25 bp, Rattus norvegicus
catgcagtccatctgaaggtgctca

SEQ ID NO: 239364 - DNA, 25 bp, Rattus norvegicus
catgcagtccatgtccattcaggaa

SEQ ID NO: 239365 - DNA, 25 bp, Rattus norvegicus
catgcagtccatgtgaaggtgctca

SEQ ID NO: 239366 - DNA, 25 bp, Rattus norvegicus
catgcagtcgttccatcacctggaa

SEQ ID NO: 239367 - DNA, 25 bp, Rattus norvegicus
catgcagtcgttgcatcacctggaa

SEQ ID NO: 239368 - DNA, 25 bp, Rattus norvegicus
catgcagtgggtctttcttggaaaa

SEQ ID NO: 239369 - DNA, 25 bp, Rattus norvegicus
catgcagtgggtgtttcttggaaaa

SEQ ID NO: 239370 - DNA, 25 bp, Rattus norvegicus
catgcagtgtgcatggtatacccag

SEQ ID NO: 239371 - DNA, 25 bp, Rattus norvegicus
catgcagtgtgcttggtatacccag

SEQ ID NO: 239372 - DNA, 25 bp, Rattus norvegicus
catgcagtgtggctacctctgaatt

SEQ ID NO: 239373 - DNA, 25 bp, Rattus norvegicus
catgcagtgtgggtacctctgaatt

SEQ ID NO: 239374 - DNA, 25 bp, Rattus norvegicus
catgcagttgggatttagctgtact

SEQ ID NO: 239375 - DNA, 25 bp, Rattus norvegicus
catgcagttgggttttagctgtact

SEQ ID NO: 239376 - DNA, 25 bp, Rattus norvegicus
catgcatcgtgtagtgggcttaggc

SEQ ID NO: 239377 - DNA, 25 bp, Rattus norvegicus
catgcatcgtgttgtgggcttaggc

SEQ ID NO: 239378 - DNA, 25 bp, Rattus norvegicus
catgcatctcccaaatgacagaatt

SEQ ID NO: 239379 - DNA, 25 bp, Rattus norvegicus
catgcatctccctaatgacagaatt

SEQ ID NO: 239380 - DNA, 25 bp, Rattus norvegicus
catgcatggctgctttgtggtaatt

SEQ ID NO: 239381 - DNA, 25 bp, Rattus norvegicus
catgcatggctggtttgtggtaatt

SEQ ID NO: 239382 - DNA, 25 bp, Rattus norvegicus
catgcatgtttaagggtcaccttcc

SEQ ID NO: 239383 - DNA, 25 bp, Rattus norvegicus
catgcatgtttatgggtcaccttcc

SEQ ID NO: 239384 - DNA, 25 bp, Rattus norvegicus
catgcattgacaattctgcctgaat

SEQ ID NO: 239385 - DNA, 25 bp, Rattus norvegicus
catgcattgacatttctgcctgaat

SEQ ID NO: 239386 - DNA, 25 bp, Rattus norvegicus
catgcatttaaactctgccagaaaa

SEQ ID NO: 239387 - DNA, 25 bp, Rattus norvegicus
catgcatttaaagtctgccagaaaa

SEQ ID NO: 239388 - DNA, 25 bp, Rattus norvegicus
catgcatttaatcgacagtcacttt

SEQ ID NO: 239389 - DNA, 25 bp, Rattus norvegicus
catgcatttaatggacagtcacttt

SEQ ID NO: 239390 - DNA, 25 bp, Rattus norvegicus
catgccaacactcagcgggagcaaa

SEQ ID NO: 239391 - DNA, 25 bp, Rattus norvegicus
catgccaacactgagcgggagcaaa

SEQ ID NO: 239392 - DNA, 25 bp, Rattus norvegicus
catgccaaccatactcttttgagta

SEQ ID NO: 239393 - DNA, 25 bp, Rattus norvegicus
catgccaaccattctcttttgagta

SEQ ID NO: 239394 - DNA, 25 bp, Rattus norvegicus
catgccaagagcaagtggtgcccaa

SEQ ID NO: 239395 - DNA, 25 bp, Rattus norvegicus
catgccaagagctagtggtgcccaa

SEQ ID NO: 239396 - DNA, 25 bp, Rattus norvegicus
catgccaagctcagggcttgatctg

SEQ ID NO: 239397 - DNA, 25 bp, Rattus norvegicus
catgccaagctctgggcttgatctg

SEQ ID NO: 239398 - DNA, 25 bp, Rattus norvegicus
catgccaagtggaagtgaggctgtt

SEQ ID NO: 239399 - DNA, 25 bp, Rattus norvegicus
catgccaagtggtagtgaggctgtt

SEQ ID NO: 239400 - DNA, 25 bp, Rattus norvegicus
catgccaattttacgaaaaggtccg

SEQ ID NO: 239401 - DNA, 25 bp, Rattus norvegicus
catgccaatttttcgaaaaggtccg

SEQ ID NO: 239402 - DNA, 25 bp, Rattus norvegicus
catgccacacgcactattagtactg

SEQ ID NO: 239403 - DNA, 25 bp, Rattus norvegicus
catgccacacgctctattagtactg

SEQ ID NO: 239404 - DNA, 25 bp, Rattus norvegicus
catgccacaggacagatttctagtt

SEQ ID NO: 239405 - DNA, 25 bp, Rattus norvegicus
catgccacaggagagatttctagtt

SEQ ID NO: 239406 - DNA, 25 bp, Rattus norvegicus
catgccaccgttctgtaaatttaag

SEQ ID NO: 239407 - DNA, 25 bp, Rattus norvegicus
catgccaccgttgtgtaaatttaag

SEQ ID NO: 239408 - DNA, 25 bp, Rattus norvegicus
catgccactcatataattgtccttc

SEQ ID NO: 239409 - DNA, 25 bp, Rattus norvegicus
catgccactcatttaattgtccttc

SEQ ID NO: 239410 - DNA, 25 bp, Rattus norvegicus
catgccagggacactctgttcccat

SEQ ID NO: 239411 - DNA, 25 bp, Rattus norvegicus
catgccagggactctctgttcccat

SEQ ID NO: 239412 - DNA, 25 bp, Rattus norvegicus
catgccataatgctatctgttttct

SEQ ID NO: 239413 - DNA, 25 bp, Rattus norvegicus
catgccataatggtatctgttttct

SEQ ID NO: 239414 - DNA, 25 bp, Rattus norvegicus
catgccatcatacagagccttgtca

SEQ ID NO: 239415 - DNA, 25 bp, Rattus norvegicus
catgccatcatagagagccttgtca

SEQ ID NO: 239416 - DNA, 25 bp, Rattus norvegicus
catgccatccaacctgtcaaaactg

SEQ ID NO: 239417 - DNA, 25 bp, Rattus norvegicus
catgccatccaagctgtcaaaactg

SEQ ID NO: 239418 - DNA, 25 bp, Rattus norvegicus
catgccatgcagctacttgacagtg

SEQ ID NO: 239419 - DNA, 25 bp, Rattus norvegicus
catgccatgcaggtacttgacagtg

SEQ ID NO: 239420 - DNA, 25 bp, Rattus norvegicus
catgccatggtgactctcagaagga

SEQ ID NO: 239421 - DNA, 25 bp, Rattus norvegicus
catgccatggtgcaccagttaggaa

SEQ ID NO: 239422 - DNA, 25 bp, Rattus norvegicus
catgccatggtggaccagttaggaa

SEQ ID NO: 239423 - DNA, 25 bp, Rattus norvegicus
catgccatggtgtctctcagaagga

SEQ ID NO: 239424 - DNA, 25 bp, Rattus norvegicus
catgccatttctctttactctttga

SEQ ID NO: 239425 - DNA, 25 bp, Rattus norvegicus
catgccatttctgtttactctttga

SEQ ID NO: 239426 - DNA, 25 bp, Rattus norvegicus
catgccatttggagagggtttttct

SEQ ID NO: 239427 - DNA, 25 bp, Rattus norvegicus
catgccatttggtgagggtttttct

SEQ ID NO: 239428 - DNA, 25 bp, Rattus norvegicus
catgcccaactcaaaggaagctttt

SEQ ID NO: 239429 - DNA, 25 bp, Rattus norvegicus
catgcccaactctaaggaagctttt

SEQ ID NO: 239430 - DNA, 25 bp, Rattus norvegicus
catgcccacattacactttacaaat

SEQ ID NO: 239431 - DNA, 25 bp, Rattus norvegicus
catgcccacatttcactttacaaat

SEQ ID NO: 239432 - DNA, 25 bp, Rattus norvegicus
catgcccactctaacactttgataa

SEQ ID NO: 239433 - DNA, 25 bp, Rattus norvegicus
catgcccactcttacactttgataa

SEQ ID NO: 239434 - DNA, 25 bp, Rattus norvegicus
catgcccagaataccggttggtttt

SEQ ID NO: 239435 - DNA, 25 bp, Rattus norvegicus
catgcccagaattccggttggtttt

SEQ ID NO: 239436 - DNA, 25 bp, Rattus norvegicus
catgcccagaccagtcagtaggttt

SEQ ID NO: 239437 - DNA, 25 bp, Rattus norvegicus
catgcccagacctgtcagtaggttt

SEQ ID NO: 239438 - DNA, 25 bp, Rattus norvegicus
catgcccagctaccttgaagactct

SEQ ID NO: 239439 - DNA, 25 bp, Rattus norvegicus
catgcccagctagcttgaagactct

SEQ ID NO: 239440 - DNA, 25 bp, Rattus norvegicus
catgcccagcttatgtgtctaacaa

SEQ ID NO: 239441 - DNA, 25 bp, Rattus norvegicus
catgcccagcttcataatttttact

SEQ ID NO: 239442 - DNA, 25 bp, Rattus norvegicus
catgcccagcttgataatttttact

SEQ ID NO: 239443 - DNA, 25 bp, Rattus norvegicus
catgcccagcttttgtgtctaacaa

SEQ ID NO: 239444 - DNA, 25 bp, Rattus norvegicus
catgcccaggacaggtacaaggcaa

SEQ ID NO: 239445 - DNA, 25 bp, Rattus norvegicus
catgcccaggactggtacaaggcaa

SEQ ID NO: 239446 - DNA, 25 bp, Rattus norvegicus
catgcccagggccagtgaaaagtgc

SEQ ID NO: 239447 - DNA, 25 bp, Rattus norvegicus
catgcccagggcgagtgaaaagtgc

SEQ ID NO: 239448 - DNA, 25 bp, Rattus norvegicus
catgcccaggtactgtctgtttgga

SEQ ID NO: 239449 - DNA, 25 bp, Rattus norvegicus
catgcccaggtagtgtctgtttgga

SEQ ID NO: 239450 - DNA, 25 bp, Rattus norvegicus
catgcccagttccacagagtacgga

SEQ ID NO: 239451 - DNA, 25 bp, Rattus norvegicus
catgcccagttcgacagagtacgga

SEQ ID NO: 239452 - DNA, 25 bp, Rattus norvegicus
catgcccatcatcgaattccacggg

SEQ ID NO: 239453 - DNA, 25 bp, Rattus norvegicus
catgcccatcatggaattccacggg

SEQ ID NO: 239454 - DNA, 25 bp, Rattus norvegicus
catgcccatctgattctgagttgaa

SEQ ID NO: 239455 - DNA, 25 bp, Rattus norvegicus
catgcccatctgtttctgagttgaa

SEQ ID NO: 239456 - DNA, 25 bp, Rattus norvegicus
catgcccatgtgaatataatctata

SEQ ID NO: 239457 - DNA, 25 bp, Rattus norvegicus
catgcccatgtgtatataatctata

SEQ ID NO: 239458 - DNA, 25 bp, Rattus norvegicus
catgccccacagacgtaatactgaa

SEQ ID NO: 239459 - DNA, 25 bp, Rattus norvegicus
catgccccacagtcgtaatactgaa

SEQ ID NO: 239460 - DNA, 25 bp, Rattus norvegicus
catgccccacctagacataaattgt

SEQ ID NO: 239461 - DNA, 25 bp, Rattus norvegicus
catgccccaccttgacataaattgt

SEQ ID NO: 239462 - DNA, 25 bp, Rattus norvegicus
catgccccactgacgggttttctag

SEQ ID NO: 239463 - DNA, 25 bp, Rattus norvegicus
catgccccactgtcgggttttctag

SEQ ID NO: 239464 - DNA, 25 bp, Rattus norvegicus
catgccccagtcaatgaactatctt

SEQ ID NO: 239465 - DNA, 25 bp, Rattus norvegicus
catgccccagtctatgaactatctt

SEQ ID NO: 239466 - DNA, 25 bp, Rattus norvegicus
catgcccctcacaagtatgtgttat

SEQ ID NO: 239467 - DNA, 25 bp, Rattus norvegicus
catgcccctcactagtatgtgttat

SEQ ID NO: 239468 - DNA, 25 bp, Rattus norvegicus
catgcccctgttaggaaatggagac

SEQ ID NO: 239469 - DNA, 25 bp, Rattus norvegicus
catgcccctgtttggaaatggagac

SEQ ID NO: 239470 - DNA, 25 bp, Rattus norvegicus
catgccccttgcaggttagatgaca

SEQ ID NO: 239471 - DNA, 25 bp, Rattus norvegicus
catgccccttgctggttagatgaca

SEQ ID NO: 239472 - DNA, 25 bp, Rattus norvegicus
catgccctcagacccttagaagaaa

SEQ ID NO: 239473 - DNA, 25 bp, Rattus norvegicus
catgccctcagagccttagaagaaa

SEQ ID NO: 239474 - DNA, 25 bp, Rattus norvegicus
catgccctgggcagcggtgaagaac

SEQ ID NO: 239475 - DNA, 25 bp, Rattus norvegicus
catgccctgggctgcggtgaagaac

SEQ ID NO: 239476 - DNA, 25 bp, Rattus norvegicus
catgcccttaatctcagaaccattt

SEQ ID NO: 239477 - DNA, 25 bp, Rattus norvegicus
catgcccttaatgtcagaaccattt

SEQ ID NO: 239478 - DNA, 25 bp, Rattus norvegicus
catgcccttcacaaacatctgatgt

SEQ ID NO: 239479 - DNA, 25 bp, Rattus norvegicus
catgcccttcactaacatctgatgt

SEQ ID NO: 239480 - DNA, 25 bp, Rattus norvegicus
catgcccttttaaaattcacggatt

SEQ ID NO: 239481 - DNA, 25 bp, Rattus norvegicus
catgcccttttataattcacggatt

SEQ ID NO: 239482 - DNA, 25 bp, Rattus norvegicus
catgccgacttcattttgccagaaa

SEQ ID NO: 239483 - DNA, 25 bp, Rattus norvegicus
catgccgacttctttttgccagaaa

SEQ ID NO: 239484 - DNA, 25 bp, Rattus norvegicus
catgccgcccaaagacgacaagaag

SEQ ID NO: 239485 - DNA, 25 bp, Rattus norvegicus
catgccgcccaatgacgacaagaag

SEQ ID NO: 239486 - DNA, 25 bp, Rattus norvegicus
catgccgggagtagttgagaagaat

SEQ ID NO: 239487 - DNA, 25 bp, Rattus norvegicus
catgccgggagttgttgagaagaat

SEQ ID NO: 239488 - DNA, 25 bp, Rattus norvegicus
catgccgggtttcaccaacgtaggt

SEQ ID NO: 239489 - DNA, 25 bp, Rattus norvegicus
catgccgggtttgaccaacgtaggt

SEQ ID NO: 239490 - DNA, 25 bp, Rattus norvegicus
catgccgttgtgattcttttagagt

SEQ ID NO: 239491 - DNA, 25 bp, Rattus norvegicus
catgccgttgtgtttcttttagagt

SEQ ID NO: 239492 - DNA, 25 bp, Rattus norvegicus
catgccgtttggatgccagtgcatt

SEQ ID NO: 239493 - DNA, 25 bp, Rattus norvegicus
catgccgtttggttgccagtgcatt

SEQ ID NO: 239494 - DNA, 25 bp, Rattus norvegicus
catgcctaatgtatgcagtgccgag

SEQ ID NO: 239495 - DNA, 25 bp, Rattus norvegicus
catgcctaatgtttgcagtgccgag

SEQ ID NO: 239496 - DNA, 25 bp, Rattus norvegicus
catgcctacctgcaagagccgaaga

SEQ ID NO: 239497 - DNA, 25 bp, Rattus norvegicus
catgcctacctggaagagccgaaga

SEQ ID NO: 239498 - DNA, 25 bp, Rattus norvegicus
catgcctataatcctgacattaatg

SEQ ID NO: 239499 - DNA, 25 bp, Rattus norvegicus
catgcctataatgctgacattaatg

SEQ ID NO: 239500 - DNA, 25 bp, Rattus norvegicus
catgcctatgttcgtgttagctcac

SEQ ID NO: 239501 - DNA, 25 bp, Rattus norvegicus
catgcctatgttggtgttagctcac

SEQ ID NO: 239502 - DNA, 25 bp, Rattus norvegicus
catgcctcatgcagtccttaggaaa

SEQ ID NO: 239503 - DNA, 25 bp, Rattus norvegicus
catgcctcatgctgtccttaggaaa

SEQ ID NO: 239504 - DNA, 25 bp, Rattus norvegicus
catgcctccatccacatatgtagca

SEQ ID NO: 239505 - DNA, 25 bp, Rattus norvegicus
catgcctccatcgacatatgtagca

SEQ ID NO: 239506 - DNA, 25 bp, Rattus norvegicus
catgcctcctttaagactctttgat

SEQ ID NO: 239507 - DNA, 25 bp, Rattus norvegicus
catgcctccttttagactctttgat

SEQ ID NO: 239508 - DNA, 25 bp, Rattus norvegicus
catgcctcggtgactgatctttttt

SEQ ID NO: 239509 - DNA, 25 bp, Rattus norvegicus
catgcctcggtgtctgatctttttt

SEQ ID NO: 239510 - DNA, 25 bp, Rattus norvegicus
catgcctctgctattgtagttgtac

SEQ ID NO: 239511 - DNA, 25 bp, Rattus norvegicus
catgcctctgcttttgtagttgtac

SEQ ID NO: 239512 - DNA, 25 bp, Rattus norvegicus
catgcctcttttaccatcaaacaaa

SEQ ID NO: 239513 - DNA, 25 bp, Rattus norvegicus
catgcctctttttccatcaaacaaa

SEQ ID NO: 239514 - DNA, 25 bp, Rattus norvegicus
catgcctgaatgacctgttttgtta

SEQ ID NO: 239515 - DNA, 25 bp, Rattus norvegicus
catgcctgaatgtcctgttttgtta

SEQ ID NO: 239516 - DNA, 25 bp, Rattus norvegicus
catgcctgcgagagtgagacctggt

SEQ ID NO: 239517 - DNA, 25 bp, Rattus norvegicus
catgcctgcgagtgtgagacctggt

SEQ ID NO: 239518 - DNA, 25 bp, Rattus norvegicus
catgcctgctgcacgggctctaagc

SEQ ID NO: 239519 - DNA, 25 bp, Rattus norvegicus
catgcctgctgctcgggctctaagc

SEQ ID NO: 239520 - DNA, 25 bp, Rattus norvegicus
catgcctggctcagaaattgagtct

SEQ ID NO: 239521 - DNA, 25 bp, Rattus norvegicus
catgcctggctctgaaattgagtct

SEQ ID NO: 239522 - DNA, 25 bp, Rattus norvegicus
catgcctggcttaacgtgctgcgta

SEQ ID NO: 239523 - DNA, 25 bp, Rattus norvegicus
catgcctggcttctttgttgctggg

SEQ ID NO: 239524 - DNA, 25 bp, Rattus norvegicus
catgcctggcttgtttgttgctggg

SEQ ID NO: 239525 - DNA, 25 bp, Rattus norvegicus
catgcctggctttacgtgctgcgta

SEQ ID NO: 239526 - DNA, 25 bp, Rattus norvegicus
catgcctggttcatggtgctgggca

SEQ ID NO: 239527 - DNA, 25 bp, Rattus norvegicus
catgcctggttcttggtgctgggca

SEQ ID NO: 239528 - DNA, 25 bp, Rattus norvegicus
catgcctgtagtctgtgcttggagt

SEQ ID NO: 239529 - DNA, 25 bp, Rattus norvegicus
catgcctgtagtgtgtgcttggagt

SEQ ID NO: 239530 - DNA, 25 bp, Rattus norvegicus
catgcctgtatgactaacaagcttt

SEQ ID NO: 239531 - DNA, 25 bp, Rattus norvegicus
catgcctgtatgtctaacaagcttt

SEQ ID NO: 239532 - DNA, 25 bp, Rattus norvegicus
catgcctgtgagctaacgttgtcca

SEQ ID NO: 239533 - DNA, 25 bp, Rattus norvegicus
catgcctgtgaggtaacgttgtcca

SEQ ID NO: 239534 - DNA, 25 bp, Rattus norvegicus
catgccttaatcatggactgccagc

SEQ ID NO: 239535 - DNA, 25 bp, Rattus norvegicus
catgccttaatcttggactgccagc

SEQ ID NO: 239536 - DNA, 25 bp, Rattus norvegicus
catgccttcattcgccgttggtaag

SEQ ID NO: 239537 - DNA, 25 bp, Rattus norvegicus
catgccttcattggccgttggtaag

SEQ ID NO: 239538 - DNA, 25 bp, Rattus norvegicus
catgccttccgtatgttgattttta

SEQ ID NO: 239539 - DNA, 25 bp, Rattus norvegicus
catgccttccgtttgttgattttta

SEQ ID NO: 239540 - DNA, 25 bp, Rattus norvegicus
catgccttgctgactttttatagta

SEQ ID NO: 239541 - DNA, 25 bp, Rattus norvegicus
catgccttgctgtctttttatagta

SEQ ID NO: 239542 - DNA, 25 bp, Rattus norvegicus
catgccttggatactgagtgtctca

SEQ ID NO: 239543 - DNA, 25 bp, Rattus norvegicus
catgccttggattctgagtgtctca

SEQ ID NO: 239544 - DNA, 25 bp, Rattus norvegicus
catgcctttggcattgtgtagagta

SEQ ID NO: 239545 - DNA, 25 bp, Rattus norvegicus
catgcctttggctttgtgtagagta

SEQ ID NO: 239546 - DNA, 25 bp, Rattus norvegicus
catgcctttgggattgccttaattc

SEQ ID NO: 239547 - DNA, 25 bp, Rattus norvegicus
catgcctttgggtttgccttaattc

SEQ ID NO: 239548 - DNA, 25 bp, Rattus norvegicus
catgccttttccattagtggtggga

SEQ ID NO: 239549 - DNA, 25 bp, Rattus norvegicus
catgccttttcctttagtggtggga

SEQ ID NO: 239550 - DNA, 25 bp, Rattus norvegicus
catgcgcaagggagtgttcgagtca

SEQ ID NO: 239551 - DNA, 25 bp, Rattus norvegicus
catgcgcaagggtgtgttcgagtca

SEQ ID NO: 239552 - DNA, 25 bp, Rattus norvegicus
catgcgcaaggtcgttctcgaggct

SEQ ID NO: 239553 - DNA, 25 bp, Rattus norvegicus
catgcgcaaggtggttctcgaggct

SEQ ID NO: 239554 - DNA, 25 bp, Rattus norvegicus
catgcgcagtgcacgttagacaaga

SEQ ID NO: 239555 - DNA, 25 bp, Rattus norvegicus
catgcgcagtgctcgttagacaaga

SEQ ID NO: 239556 - DNA, 25 bp, Rattus norvegicus
catgcgcccgggatagccgggttcc

SEQ ID NO: 239557 - DNA, 25 bp, Rattus norvegicus
catgcgcccgggttagccgggttcc

SEQ ID NO: 239558 - DNA, 25 bp, Rattus norvegicus
catgcgccgtgtatctggtttgtat

SEQ ID NO: 239559 - DNA, 25 bp, Rattus norvegicus
catgcgccgtgtttctggtttgtat

SEQ ID NO: 239560 - DNA, 25 bp, Rattus norvegicus
catgcggattatccactcgccacag

SEQ ID NO: 239561 - DNA, 25 bp, Rattus norvegicus
catgcggattatgcactcgccacag

SEQ ID NO: 239562 - DNA, 25 bp, Rattus norvegicus
catgcggtggccattggcagtcagt

SEQ ID NO: 239563 - DNA, 25 bp, Rattus norvegicus
catgcggtggcctttggcagtcagt

SEQ ID NO: 239564 - DNA, 25 bp, Rattus norvegicus
catgcgtgcatccactgggtcaaat

SEQ ID NO: 239565 - DNA, 25 bp, Rattus norvegicus
catgcgtgcatcgactgggtcaaat

SEQ ID NO: 239566 - DNA, 25 bp, Rattus norvegicus
catgcgtgtggacttcaagtctgac

SEQ ID NO: 239567 - DNA, 25 bp, Rattus norvegicus
catgcgtgtggagttcaagtctgac

SEQ ID NO: 239568 - DNA, 25 bp, Rattus norvegicus
catgcgttcctcacagagtgacata

SEQ ID NO: 239569 - DNA, 25 bp, Rattus norvegicus
catgcgttcctctcagagtgacata

SEQ ID NO: 239570 - DNA, 25 bp, Rattus norvegicus
catgcgttcgctcaaaggcatcggt

SEQ ID NO: 239571 - DNA, 25 bp, Rattus norvegicus
catgcgttcgctgaaaggcatcggt

SEQ ID NO: 239572 - DNA, 25 bp, Rattus norvegicus
catgcgttggagagaacagcccgga

SEQ ID NO: 239573 - DNA, 25 bp, Rattus norvegicus
catgcgttggagtgaacagcccgga

SEQ ID NO: 239574 - DNA, 25 bp, Rattus norvegicus
catgcgttgtgcactactgtgtatc

SEQ ID NO: 239575 - DNA, 25 bp, Rattus norvegicus
catgcgttgtgctctactgtgtatc

SEQ ID NO: 239576 - DNA, 25 bp, Rattus norvegicus
catgctaactgaagtatagtgaaca

SEQ ID NO: 239577 - DNA, 25 bp, Rattus norvegicus
catgctaactgatgtatagtgaaca

SEQ ID NO: 239578 - DNA, 25 bp, Rattus norvegicus
catgctaatttcatacttggtgtgt

SEQ ID NO: 239579 - DNA, 25 bp, Rattus norvegicus
catgctaatttcttacttggtgtgt

SEQ ID NO: 239580 - DNA, 25 bp, Rattus norvegicus
catgctacagcccaggtgtcatcaa

SEQ ID NO: 239581 - DNA, 25 bp, Rattus norvegicus
catgctacagccgaggtgtcatcaa

SEQ ID NO: 239582 - DNA, 25 bp, Rattus norvegicus
catgctaccataactttcaggcttg

SEQ ID NO: 239583 - DNA, 25 bp, Rattus norvegicus
catgctaccatatctttcaggcttg

SEQ ID NO: 239584 - DNA, 25 bp, Rattus norvegicus
catgctacctttagtctgtattaaa

SEQ ID NO: 239585 - DNA, 25 bp, Rattus norvegicus
catgctaccttttgtctgtattaaa

SEQ ID NO: 239586 - DNA, 25 bp, Rattus norvegicus
catgctacttgcatatctttttgtc

SEQ ID NO: 239587 - DNA, 25 bp, Rattus norvegicus
catgctacttgcttatctttttgtc

SEQ ID NO: 239588 - DNA, 25 bp, Rattus norvegicus
catgctagaggcatggcaggttcta

SEQ ID NO: 239589 - DNA, 25 bp, Rattus norvegicus
catgctagaggcttggcaggttcta

SEQ ID NO: 239590 - DNA, 25 bp, Rattus norvegicus
catgctagatttatctcactgtgga

SEQ ID NO: 239591 - DNA, 25 bp, Rattus norvegicus
catgctagatttttctcactgtgga

SEQ ID NO: 239592 - DNA, 25 bp, Rattus norvegicus
catgctaggcaactgtgtggccact

SEQ ID NO: 239593 - DNA, 25 bp, Rattus norvegicus
catgctaggcaagtgtgtggccact

SEQ ID NO: 239594 - DNA, 25 bp, Rattus norvegicus
catgctaggcttaggagtgtttgag

SEQ ID NO: 239595 - DNA, 25 bp, Rattus norvegicus
catgctaggctttggagtgtttgag

SEQ ID NO: 239596 - DNA, 25 bp, Rattus norvegicus
catgctagtcaactggtgtaccact

SEQ ID NO: 239597 - DNA, 25 bp, Rattus norvegicus
catgctagtcaagtggtgtaccact

SEQ ID NO: 239598 - DNA, 25 bp, Rattus norvegicus
catgctagtcttagtgctggctcta

SEQ ID NO: 239599 - DNA, 25 bp, Rattus norvegicus
catgctagtctttgtgctggctcta

SEQ ID NO: 239600 - DNA, 25 bp, Rattus norvegicus
catgctatatacatgctatacacat

SEQ ID NO: 239601 - DNA, 25 bp, Rattus norvegicus
catgctatatacttgctatacacat

SEQ ID NO: 239602 - DNA, 25 bp, Rattus norvegicus
catgctatcgttagctttggtatta

SEQ ID NO: 239603 - DNA, 25 bp, Rattus norvegicus
catgctatcgtttgctttggtatta

SEQ ID NO: 239604 - DNA, 25 bp, Rattus norvegicus
catgctatcttcatcttcatcgttg

SEQ ID NO: 239605 - DNA, 25 bp, Rattus norvegicus
catgctatcttcttcttcatcgttg

SEQ ID NO: 239606 - DNA, 25 bp, Rattus norvegicus
catgctattgatctgttgactgtca

SEQ ID NO: 239607 - DNA, 25 bp, Rattus norvegicus
catgctattgatgtgttgactgtca

SEQ ID NO: 239608 - DNA, 25 bp, Rattus norvegicus
catgctcaaccaactgtgtgtgtgt

SEQ ID NO: 239609 - DNA, 25 bp, Rattus norvegicus
catgctcaaccatctgtgtgtgtgt

SEQ ID NO: 239610 - DNA, 25 bp, Rattus norvegicus
catgctcacaagctactgctctgta

SEQ ID NO: 239611 - DNA, 25 bp, Rattus norvegicus
catgctcacaaggtactgctctgta

SEQ ID NO: 239612 - DNA, 25 bp, Rattus norvegicus
catgctcacagtatgcgctcaagga

SEQ ID NO: 239613 - DNA, 25 bp, Rattus norvegicus
catgctcacagtttgcgctcaagga

SEQ ID NO: 239614 - DNA, 25 bp, Rattus norvegicus
catgctcagacaacggctatggtgt

SEQ ID NO: 239615 - DNA, 25 bp, Rattus norvegicus
catgctcagacatcggctatggtgt

SEQ ID NO: 239616 - DNA, 25 bp, Rattus norvegicus
catgctcagtgtattgtgtcttttc

SEQ ID NO: 239617 - DNA, 25 bp, Rattus norvegicus
catgctcagtgtattttattgtcct

SEQ ID NO: 239618 - DNA, 25 bp, Rattus norvegicus
catgctcagtgttttgtgtcttttc

SEQ ID NO: 239619 - DNA, 25 bp, Rattus norvegicus
catgctcagtgttttttattgtcct

SEQ ID NO: 239620 - DNA, 25 bp, Rattus norvegicus
catgctcatcctcaaatggtgtggg

SEQ ID NO: 239621 - DNA, 25 bp, Rattus norvegicus
catgctcatcctgaaatggtgtggg

SEQ ID NO: 239622 - DNA, 25 bp, Rattus norvegicus
catgctcatttacgaaggtgcccac

SEQ ID NO: 239623 - DNA, 25 bp, Rattus norvegicus
catgctcatttaggaaggtgcccac

SEQ ID NO: 239624 - DNA, 25 bp, Rattus norvegicus
catgctccctcaaggatccagttct

SEQ ID NO: 239625 - DNA, 25 bp, Rattus norvegicus
catgctccctcatggatccagttct

SEQ ID NO: 239626 - DNA, 25 bp, Rattus norvegicus
catgctccgtgtacttctgcgggag

SEQ ID NO: 239627 - DNA, 25 bp, Rattus norvegicus
catgctccgtgttcttctgcgggag

SEQ ID NO: 239628 - DNA, 25 bp, Rattus norvegicus
catgctccgtttagttcagttgtga

SEQ ID NO: 239629 - DNA, 25 bp, Rattus norvegicus
catgctccgttttgttcagttgtga

SEQ ID NO: 239630 - DNA, 25 bp, Rattus norvegicus
catgctcctatgctgatcttgtcaa

SEQ ID NO: 239631 - DNA, 25 bp, Rattus norvegicus
catgctcctatggtgatcttgtcaa

SEQ ID NO: 239632 - DNA, 25 bp, Rattus norvegicus
catgctcctgaacttggaacgcaaa

SEQ ID NO: 239633 - DNA, 25 bp, Rattus norvegicus
catgctcctgaagttggaacgcaaa

SEQ ID NO: 239634 - DNA, 25 bp, Rattus norvegicus
catgctcggatcagttcgttttgaa

SEQ ID NO: 239635 - DNA, 25 bp, Rattus norvegicus
catgctcggatctgttcgttttgaa

SEQ ID NO: 239636 - DNA, 25 bp, Rattus norvegicus
catgctcggtgtctttgatagtttc

SEQ ID NO: 239637 - DNA, 25 bp, Rattus norvegicus
catgctcggtgtgtttgatagtttc

SEQ ID NO: 239638 - DNA, 25 bp, Rattus norvegicus
catgctctactgcagccatcatgat

SEQ ID NO: 239639 - DNA, 25 bp, Rattus norvegicus
catgctctactggagccatcatgat

SEQ ID NO: 239640 - DNA, 25 bp, Rattus norvegicus
catgctctatacaaccctgattatt

SEQ ID NO: 239641 - DNA, 25 bp, Rattus norvegicus
catgctctatacagacagcagcttt

SEQ ID NO: 239642 - DNA, 25 bp, Rattus norvegicus
catgctctatactaccctgattatt

SEQ ID NO: 239643 - DNA, 25 bp, Rattus norvegicus
catgctctatactgacagcagcttt

SEQ ID NO: 239644 - DNA, 25 bp, Rattus norvegicus
catgctctatgtatgtgccttttaa

SEQ ID NO: 239645 - DNA, 25 bp, Rattus norvegicus
catgctctatgtttgtgccttttaa

SEQ ID NO: 239646 - DNA, 25 bp, Rattus norvegicus
catgctctcaggctgctacagaaaa

SEQ ID NO: 239647 - DNA, 25 bp, Rattus norvegicus
catgctctcagggtgctacagaaaa

SEQ ID NO: 239648 - DNA, 25 bp, Rattus norvegicus
catgctctcatgctgttcgacagta

SEQ ID NO: 239649 - DNA, 25 bp, Rattus norvegicus
catgctctcatggtgttcgacagta

SEQ ID NO: 239650 - DNA, 25 bp, Rattus norvegicus
catgctctgattcggccttggttaa

SEQ ID NO: 239651 - DNA, 25 bp, Rattus norvegicus
catgctctgattgggccttggttaa

SEQ ID NO: 239652 - DNA, 25 bp, Rattus norvegicus
catgctctgcatagatgggccattt

SEQ ID NO: 239653 - DNA, 25 bp, Rattus norvegicus
catgctctgcatccgtgctatgcgt

SEQ ID NO: 239654 - DNA, 25 bp, Rattus norvegicus
catgctctgcatgcgtgctatgcgt

SEQ ID NO: 239655 - DNA, 25 bp, Rattus norvegicus
catgctctgcattgatgggccattt

SEQ ID NO: 239656 - DNA, 25 bp, Rattus norvegicus
catgctctggagaatacgtcacttt

SEQ ID NO: 239657 - DNA, 25 bp, Rattus norvegicus
catgctctggagtatacgtcacttt

SEQ ID NO: 239658 - DNA, 25 bp, Rattus norvegicus
catgctctggccacacaatgataaa

SEQ ID NO: 239659 - DNA, 25 bp, Rattus norvegicus
catgctctggcctcacaatgataaa

SEQ ID NO: 239660 - DNA, 25 bp, Rattus norvegicus
catgctctgggtattgctccatggg

SEQ ID NO: 239661 - DNA, 25 bp, Rattus norvegicus
catgctctgggttttgctccatggg

SEQ ID NO: 239662 - DNA, 25 bp, Rattus norvegicus
catgctctgtgcaggatactttgac

SEQ ID NO: 239663 - DNA, 25 bp, Rattus norvegicus
catgctctgtgctggatactttgac

SEQ ID NO: 239664 - DNA, 25 bp, Rattus norvegicus
catgctctttccacgggttacagat

SEQ ID NO: 239665 - DNA, 25 bp, Rattus norvegicus
catgctctttcctcgggttacagat

SEQ ID NO: 239666 - DNA, 25 bp, Rattus norvegicus
catgctgaactccaggccagtggaa

SEQ ID NO: 239667 - DNA, 25 bp, Rattus norvegicus
catgctgaactcgaggccagtggaa

SEQ ID NO: 239668 - DNA, 25 bp, Rattus norvegicus
catgctgaaggactgaaccatgact

SEQ ID NO: 239669 - DNA, 25 bp, Rattus norvegicus
catgctgaaggagtgaaccatgact

SEQ ID NO: 239670 - DNA, 25 bp, Rattus norvegicus
catgctgaataaacgcctggagttg

SEQ ID NO: 239671 - DNA, 25 bp, Rattus norvegicus
catgctgaataatcgcctggagttg

SEQ ID NO: 239672 - DNA, 25 bp, Rattus norvegicus
catgctgacaggagagaggcgttac

SEQ ID NO: 239673 - DNA, 25 bp, Rattus norvegicus
catgctgacaggtgagaggcgttac

SEQ ID NO: 239674 - DNA, 25 bp, Rattus norvegicus
catgctgaggtcatttctgggtgaa

SEQ ID NO: 239675 - DNA, 25 bp, Rattus norvegicus
catgctgaggtcttttctgggtgaa

SEQ ID NO: 239676 - DNA, 25 bp, Rattus norvegicus
catgctgagtagagtttgctcctct

SEQ ID NO: 239677 - DNA, 25 bp, Rattus norvegicus
catgctgagtagtgtttgctcctct

SEQ ID NO: 239678 - DNA, 25 bp, Rattus norvegicus
catgctgatggacccaacagtctgg

SEQ ID NO: 239679 - DNA, 25 bp, Rattus norvegicus
catgctgatggagccaacagtctgg

SEQ ID NO: 239680 - DNA, 25 bp, Rattus norvegicus
catgctgatgtaagactgtccctgt

SEQ ID NO: 239681 - DNA, 25 bp, Rattus norvegicus
catgctgatgtatgactgtccctgt

SEQ ID NO: 239682 - DNA, 25 bp, Rattus norvegicus
catgctgattatctcaagttttaga

SEQ ID NO: 239683 - DNA, 25 bp, Rattus norvegicus
catgctgattatgtcaagttttaga

SEQ ID NO: 239684 - DNA, 25 bp, Rattus norvegicus
catgctgatttaagggttaccgact

SEQ ID NO: 239685 - DNA, 25 bp, Rattus norvegicus
catgctgatttatgggttaccgact

SEQ ID NO: 239686 - DNA, 25 bp, Rattus norvegicus
catgctgattttcggcatcaccaac

SEQ ID NO: 239687 - DNA, 25 bp, Rattus norvegicus
catgctgattttgggcatcaccaac

SEQ ID NO: 239688 - DNA, 25 bp, Rattus norvegicus
catgctgcacgcagtacaaaaggaa

SEQ ID NO: 239689 - DNA, 25 bp, Rattus norvegicus
catgctgcacgctgtacaaaaggaa

SEQ ID NO: 239690 - DNA, 25 bp, Rattus norvegicus
catgctgcagttatatattccagaa

SEQ ID NO: 239691 - DNA, 25 bp, Rattus norvegicus
catgctgcagttttatattccagaa

SEQ ID NO: 239692 - DNA, 25 bp, Rattus norvegicus
catgctgcatatatgtttggcttac

SEQ ID NO: 239693 - DNA, 25 bp, Rattus norvegicus
catgctgcatatttgtttggcttac

SEQ ID NO: 239694 - DNA, 25 bp, Rattus norvegicus
catgctgcattcagggtaccgagga

SEQ ID NO: 239695 - DNA, 25 bp, Rattus norvegicus
catgctgcattctgggtaccgagga

SEQ ID NO: 239696 - DNA, 25 bp, Rattus norvegicus
catgctgccaaaaacaggttgcccc

SEQ ID NO: 239697 - DNA, 25 bp, Rattus norvegicus
catgctgccaaatacaggttgcccc

SEQ ID NO: 239698 - DNA, 25 bp, Rattus norvegicus
catgctgccagtatcttttttggtt

SEQ ID NO: 239699 - DNA, 25 bp, Rattus norvegicus
catgctgccagtttcttttttggtt

SEQ ID NO: 239700 - DNA, 25 bp, Rattus norvegicus
catgctgccgcacgatgatcagtcc

SEQ ID NO: 239701 - DNA, 25 bp, Rattus norvegicus
catgctgccgcaggatgatcagtcc

SEQ ID NO: 239702 - DNA, 25 bp, Rattus norvegicus
catgctgcctctagttacaacacag

SEQ ID NO: 239703 - DNA, 25 bp, Rattus norvegicus
catgctgcctcttgttacaacacag

SEQ ID NO: 239704 - DNA, 25 bp, Rattus norvegicus
catgctgcgcatcaagtccgagaat

SEQ ID NO: 239705 - DNA, 25 bp, Rattus norvegicus
catgctgcgcatgaagtccgagaat

SEQ ID NO: 239706 - DNA, 25 bp, Rattus norvegicus
catgctgcggctagacgttatgatt

SEQ ID NO: 239707 - DNA, 25 bp, Rattus norvegicus
catgctgcggcttgacgttatgatt

SEQ ID NO: 239708 - DNA, 25 bp, Rattus norvegicus
catgctgcgtgtcaacagttataca

SEQ ID NO: 239709 - DNA, 25 bp, Rattus norvegicus
catgctgcgtgtgaacagttataca

SEQ ID NO: 239710 - DNA, 25 bp, Rattus norvegicus
catgctgctgctccgcctggagaaa

SEQ ID NO: 239711 - DNA, 25 bp, Rattus norvegicus
catgctgctgctgcgcctggagaaa

SEQ ID NO: 239712 - DNA, 25 bp, Rattus norvegicus
catgctgctggacccggagagattt

SEQ ID NO: 239713 - DNA, 25 bp, Rattus norvegicus
catgctgctggaccctgtggtgtac

SEQ ID NO: 239714 - DNA, 25 bp, Rattus norvegicus
catgctgctggagccggagagattt

SEQ ID NO: 239715 - DNA, 25 bp, Rattus norvegicus
catgctgctggagcctgtggtgtac

SEQ ID NO: 239716 - DNA, 25 bp, Rattus norvegicus
catgctggagacaggaccttgctta

SEQ ID NO: 239717 - DNA, 25 bp, Rattus norvegicus
catgctggagactggaccttgctta

SEQ ID NO: 239718 - DNA, 25 bp, Rattus norvegicus
catgctggcgttctgctggattgaa

SEQ ID NO: 239719 - DNA, 25 bp, Rattus norvegicus
catgctggcgttgtgctggattgaa

SEQ ID NO: 239720 - DNA, 25 bp, Rattus norvegicus
catgctgggatgcaccttttctata

SEQ ID NO: 239721 - DNA, 25 bp, Rattus norvegicus
catgctgggatggaccttttctata

SEQ ID NO: 239722 - DNA, 25 bp, Rattus norvegicus
catgctggggtgagacttttcagtg

SEQ ID NO: 239723 - DNA, 25 bp, Rattus norvegicus
catgctggggtgtgacttttcagtg

SEQ ID NO: 239724 - DNA, 25 bp, Rattus norvegicus
catgctggtaccacggagagctaat

SEQ ID NO: 239725 - DNA, 25 bp, Rattus norvegicus
catgctggtacctcggagagctaat

SEQ ID NO: 239726 - DNA, 25 bp, Rattus norvegicus
catgctggtcttagcttctaggaat

SEQ ID NO: 239727 - DNA, 25 bp, Rattus norvegicus
catgctggtctttgcttctaggaat

SEQ ID NO: 239728 - DNA, 25 bp, Rattus norvegicus
catgctggtgacctgtgctgtctca

SEQ ID NO: 239729 - DNA, 25 bp, Rattus norvegicus
catgctggtgacgtgtgctgtctca

SEQ ID NO: 239730 - DNA, 25 bp, Rattus norvegicus
catgctgtaccccaaggaggacaag

SEQ ID NO: 239731 - DNA, 25 bp, Rattus norvegicus
catgctgtacccgaaggaggacaag

SEQ ID NO: 239732 - DNA, 25 bp, Rattus norvegicus
catgctgtatggatgccacgtgaga

SEQ ID NO: 239733 - DNA, 25 bp, Rattus norvegicus
catgctgtatggttgccacgtgaga

SEQ ID NO: 239734 - DNA, 25 bp, Rattus norvegicus
catgctgtctgaaactgttggcaca

SEQ ID NO: 239735 - DNA, 25 bp, Rattus norvegicus
catgctgtctgatactgttggcaca

SEQ ID NO: 239736 - DNA, 25 bp, Rattus norvegicus
catgctgtgcatcccgctttctctg

SEQ ID NO: 239737 - DNA, 25 bp, Rattus norvegicus
catgctgtgcatgccgctttctctg

SEQ ID NO: 239738 - DNA, 25 bp, Rattus norvegicus
catgctgtgcttagtggttcttctt

SEQ ID NO: 239739 - DNA, 25 bp, Rattus norvegicus
catgctgtgctttgtggttcttctt

SEQ ID NO: 239740 - DNA, 25 bp, Rattus norvegicus
catgctgtggctccttgatgaatgt

SEQ ID NO: 239741 - DNA, 25 bp, Rattus norvegicus
catgctgtggctgcttgatgaatgt

SEQ ID NO: 239742 - DNA, 25 bp, Rattus norvegicus
catgctgtggtacgagatctctctc

SEQ ID NO: 239743 - DNA, 25 bp, Rattus norvegicus
catgctgtggtaggagatctctctc

SEQ ID NO: 239744 - DNA, 25 bp, Rattus norvegicus
catgctgtgtggatgtgaccttttg

SEQ ID NO: 239745 - DNA, 25 bp, Rattus norvegicus
catgctgtgtggttgtgaccttttg

SEQ ID NO: 239746 - DNA, 25 bp, Rattus norvegicus
catgctgtgtgtcctctgtataggt

SEQ ID NO: 239747 - DNA, 25 bp, Rattus norvegicus
catgctgtgtgtgctctgtataggt

SEQ ID NO: 239748 - DNA, 25 bp, Rattus norvegicus
catgctgttaagatgtcctactcca

SEQ ID NO: 239749 - DNA, 25 bp, Rattus norvegicus
catgctgttaagttgtcctactcca

SEQ ID NO: 239750 - DNA, 25 bp, Rattus norvegicus
catgcttaacacagacttgctactg

SEQ ID NO: 239751 - DNA, 25 bp, Rattus norvegicus
catgcttaacactgacttgctactg

SEQ ID NO: 239752 - DNA, 25 bp, Rattus norvegicus
catgcttaatgtctcttttgccaca

SEQ ID NO: 239753 - DNA, 25 bp, Rattus norvegicus
catgcttaatgtgtcttttgccaca

SEQ ID NO: 239754 - DNA, 25 bp, Rattus norvegicus
catgcttacagcagttaccctggaa

SEQ ID NO: 239755 - DNA, 25 bp, Rattus norvegicus
catgcttacagctgttaccctggaa

SEQ ID NO: 239756 - DNA, 25 bp, Rattus norvegicus
catgcttattgtctctgtgtcggct

SEQ ID NO: 239757 - DNA, 25 bp, Rattus norvegicus
catgcttattgtgtctgtgtcggct

SEQ ID NO: 239758 - DNA, 25 bp, Rattus norvegicus
catgcttcatacatacactaacgtt

SEQ ID NO: 239759 - DNA, 25 bp, Rattus norvegicus
catgcttcatacttacactaacgtt

SEQ ID NO: 239760 - DNA, 25 bp, Rattus norvegicus
catgcttcatgaacagcgcggcgcg

SEQ ID NO: 239761 - DNA, 25 bp, Rattus norvegicus
catgcttcatgatcagcgcggcgcg

SEQ ID NO: 239762 - DNA, 25 bp, Rattus norvegicus
catgcttcctttaagaacttttcag

SEQ ID NO: 239763 - DNA, 25 bp, Rattus norvegicus
catgcttccttttagaacttttcag

SEQ ID NO: 239764 - DNA, 25 bp, Rattus norvegicus
catgcttctctgacacaatgcacag

SEQ ID NO: 239765 - DNA, 25 bp, Rattus norvegicus
catgcttctctgtcacaatgcacag

SEQ ID NO: 239766 - DNA, 25 bp, Rattus norvegicus
catgcttctggcctggacacacaaa

SEQ ID NO: 239767 - DNA, 25 bp, Rattus norvegicus
catgcttctggcgtggacacacaaa

SEQ ID NO: 239768 - DNA, 25 bp, Rattus norvegicus
catgcttctgggatgagctccttaa

SEQ ID NO: 239769 - DNA, 25 bp, Rattus norvegicus
catgcttctgggttgagctccttaa

SEQ ID NO: 239770 - DNA, 25 bp, Rattus norvegicus
catgcttgatggatagcttgctctg

SEQ ID NO: 239771 - DNA, 25 bp, Rattus norvegicus
catgcttgatggttagcttgctctg

SEQ ID NO: 239772 - DNA, 25 bp, Rattus norvegicus
catgcttgcacccagaaattttcca

SEQ ID NO: 239773 - DNA, 25 bp, Rattus norvegicus
catgcttgcaccgagaaattttcca

SEQ ID NO: 239774 - DNA, 25 bp, Rattus norvegicus
catgcttgtgccatcatgtttgcat

SEQ ID NO: 239775 - DNA, 25 bp, Rattus norvegicus
catgcttgtgccttcatgtttgcat

SEQ ID NO: 239776 - DNA, 25 bp, Rattus norvegicus
catgcttgtgtgatgatggcttgac

SEQ ID NO: 239777 - DNA, 25 bp, Rattus norvegicus
catgcttgtgtgttgatggcttgac

SEQ ID NO: 239778 - DNA, 25 bp, Rattus norvegicus
catgctttatgcatatctgtatagt

SEQ ID NO: 239779 - DNA, 25 bp, Rattus norvegicus
catgctttatgcttatctgtatagt

SEQ ID NO: 239780 - DNA, 25 bp, Rattus norvegicus
catgctttcatccagtcatatggtt

SEQ ID NO: 239781 - DNA, 25 bp, Rattus norvegicus
catgctttcatcgagtcatatggtt

SEQ ID NO: 239782 - DNA, 25 bp, Rattus norvegicus
catgctttccttagtgtgggtttat

SEQ ID NO: 239783 - DNA, 25 bp, Rattus norvegicus
catgctttcctttgtgtgggtttat

SEQ ID NO: 239784 - DNA, 25 bp, Rattus norvegicus
catgctttcgaccatgagtggcaaa

SEQ ID NO: 239785 - DNA, 25 bp, Rattus norvegicus
catgctttcgacgatgagtggcaaa

SEQ ID NO: 239786 - DNA, 25 bp, Rattus norvegicus
catgctttgctgctactgaaatgag

SEQ ID NO: 239787 - DNA, 25 bp, Rattus norvegicus
catgctttgctggtactgaaatgag

SEQ ID NO: 239788 - DNA, 25 bp, Rattus norvegicus
catgcttttaatcccaggtctcagg

SEQ ID NO: 239789 - DNA, 25 bp, Rattus norvegicus
catgcttttaatgccaggtctcagg

SEQ ID NO: 239790 - DNA, 25 bp, Rattus norvegicus
catgcttttgttcaggtgacctgta

SEQ ID NO: 239791 - DNA, 25 bp, Rattus norvegicus
catgcttttgttgaggtgacctgta

SEQ ID NO: 239792 - DNA, 25 bp, Rattus norvegicus
catgctttttgcattgtatagagga

SEQ ID NO: 239793 - DNA, 25 bp, Rattus norvegicus
catgctttttgctttgtatagagga

SEQ ID NO: 239794 - DNA, 25 bp, Rattus norvegicus
catggaaacccaaaggccgtgtgtt

SEQ ID NO: 239795 - DNA, 25 bp, Rattus norvegicus
catggaaacccataggccgtgtgtt

SEQ ID NO: 239796 - DNA, 25 bp, Rattus norvegicus
catggaaacgctcctaatattttta

SEQ ID NO: 239797 - DNA, 25 bp, Rattus norvegicus
catggaaacgctgctaatattttta

SEQ ID NO: 239798 - DNA, 25 bp, Rattus norvegicus
catggaaacggcagatacagcttaa

SEQ ID NO: 239799 - DNA, 25 bp, Rattus norvegicus
catggaaacggctgatacagcttaa

SEQ ID NO: 239800 - DNA, 25 bp, Rattus norvegicus
catggaacaggcatctggtcttttt

SEQ ID NO: 239801 - DNA, 25 bp, Rattus norvegicus
catggaacaggcttctggtcttttt

SEQ ID NO: 239802 - DNA, 25 bp, Rattus norvegicus
catggaaccaccactgagtcagttt

SEQ ID NO: 239803 - DNA, 25 bp, Rattus norvegicus
catggaaccacctctgagtcagttt

SEQ ID NO: 239804 - DNA, 25 bp, Rattus norvegicus
catggaacccatctcctgtgaaata

SEQ ID NO: 239805 - DNA, 25 bp, Rattus norvegicus
catggaacccatgtcctgtgaaata

SEQ ID NO: 239806 - DNA, 25 bp, Rattus norvegicus
catggaacctgtattgtgtctcttc

SEQ ID NO: 239807 - DNA, 25 bp, Rattus norvegicus
catggaacctgttttgtgtctcttc

SEQ ID NO: 239808 - DNA, 25 bp, Rattus norvegicus
catggaagaaatcttcatggtctac

SEQ ID NO: 239809 - DNA, 25 bp, Rattus norvegicus
catggaagaaatgttcatggtctac

SEQ ID NO: 239810 - DNA, 25 bp, Rattus norvegicus
catggaagaactccctctcaatcac

SEQ ID NO: 239811 - DNA, 25 bp, Rattus norvegicus
catggaagaactgcctctcaatcac

SEQ ID NO: 239812 - DNA, 25 bp, Rattus norvegicus
catggaagacagacatgctgagcat

SEQ ID NO: 239813 - DNA, 25 bp, Rattus norvegicus
catggaagacagtcatgctgagcat

SEQ ID NO: 239814 - DNA, 25 bp, Rattus norvegicus
catggaaggcttactgcatttctcc

SEQ ID NO: 239815 - DNA, 25 bp, Rattus norvegicus
catggaaggctttctgcatttctcc

SEQ ID NO: 239816 - DNA, 25 bp, Rattus norvegicus
catggaatttccctctaactgtggc

SEQ ID NO: 239817 - DNA, 25 bp, Rattus norvegicus
catggaatttccgtctaactgtggc

SEQ ID NO: 239818 - DNA, 25 bp, Rattus norvegicus
catggaatttgcagtcctggcactg

SEQ ID NO: 239819 - DNA, 25 bp, Rattus norvegicus
catggaatttgctgtcctggcactg

SEQ ID NO: 239820 - DNA, 25 bp, Rattus norvegicus
catggacacagtaatcaagcctcgg

SEQ ID NO: 239821 - DNA, 25 bp, Rattus norvegicus
catggacacagttatcaagcctcgg

SEQ ID NO: 239822 - DNA, 25 bp, Rattus norvegicus
catggacagcagcaaggttgttcat

SEQ ID NO: 239823 - DNA, 25 bp, Rattus norvegicus
catggacagcaggaaggttgttcat

SEQ ID NO: 239824 - DNA, 25 bp, Rattus norvegicus
catggacatggtattagtatctggg

SEQ ID NO: 239825 - DNA, 25 bp, Rattus norvegicus
catggacatggttttagtatctggg

SEQ ID NO: 239826 - DNA, 25 bp, Rattus norvegicus
catggacatttgagtgatgcccagt

SEQ ID NO: 239827 - DNA, 25 bp, Rattus norvegicus
catggacatttgtgtgatgcccagt

SEQ ID NO: 239828 - DNA, 25 bp, Rattus norvegicus
catggacccactcaaagtcatcgta

SEQ ID NO: 239829 - DNA, 25 bp, Rattus norvegicus
catggacccactgaaagtcatcgta

SEQ ID NO: 239830 - DNA, 25 bp, Rattus norvegicus
catggaccggttaatattttgaagc

SEQ ID NO: 239831 - DNA, 25 bp, Rattus norvegicus
catggaccggtttatattttgaagc

SEQ ID NO: 239832 - DNA, 25 bp, Rattus norvegicus
catggacctggaccctagagagaaa

SEQ ID NO: 239833 - DNA, 25 bp, Rattus norvegicus
catggacctggagcctagagagaaa

SEQ ID NO: 239834 - DNA, 25 bp, Rattus norvegicus
catggaccttttagtgacctgttac

SEQ ID NO: 239835 - DNA, 25 bp, Rattus norvegicus
catggacctttttgtgacctgttac

SEQ ID NO: 239836 - DNA, 25 bp, Rattus norvegicus
catggacgctgtagggaataatcac

SEQ ID NO: 239837 - DNA, 25 bp, Rattus norvegicus
catggacgctgttgggaataatcac

SEQ ID NO: 239838 - DNA, 25 bp, Rattus norvegicus
catggacgtcgcagctatgaagcag

SEQ ID NO: 239839 - DNA, 25 bp, Rattus norvegicus
catggacgtcgctgctatgaagcag

SEQ ID NO: 239840 - DNA, 25 bp, Rattus norvegicus
catggactcatacattagaatgctt

SEQ ID NO: 239841 - DNA, 25 bp, Rattus norvegicus
catggactcatagattagaatgctt

SEQ ID NO: 239842 - DNA, 25 bp, Rattus norvegicus
catggactctgcagtgacctgggag

SEQ ID NO: 239843 - DNA, 25 bp, Rattus norvegicus
catggactctgctgtgacctgggag

SEQ ID NO: 239844 - DNA, 25 bp, Rattus norvegicus
catggactctttctgcttgacaatg

SEQ ID NO: 239845 - DNA, 25 bp, Rattus norvegicus
catggactctttgtgcttgacaatg

SEQ ID NO: 239846 - DNA, 25 bp, Rattus norvegicus
catggactgaatctgcttgttgatc

SEQ ID NO: 239847 - DNA, 25 bp, Rattus norvegicus
catggactgaatgtgcttgttgatc

SEQ ID NO: 239848 - DNA, 25 bp, Rattus norvegicus
catggacttagtccctgatgagctt

SEQ ID NO: 239849 - DNA, 25 bp, Rattus norvegicus
catggacttagtgcctgatgagctt

SEQ ID NO: 239850 - DNA, 25 bp, Rattus norvegicus
catggacttccgagcaaaatctttt

SEQ ID NO: 239851 - DNA, 25 bp, Rattus norvegicus
catggacttccgtgcaaaatctttt

SEQ ID NO: 239852 - DNA, 25 bp, Rattus norvegicus
catggacttctacgcccttctggag

SEQ ID NO: 239853 - DNA, 25 bp, Rattus norvegicus
catggacttctaggcccttctggag

SEQ ID NO: 239854 - DNA, 25 bp, Rattus norvegicus
catggacttgatcttgttagttcta

SEQ ID NO: 239855 - DNA, 25 bp, Rattus norvegicus
catggacttgatgttgttagttcta

SEQ ID NO: 239856 - DNA, 25 bp, Rattus norvegicus
catggagaaactccggctgctgctg

SEQ ID NO: 239857 - DNA, 25 bp, Rattus norvegicus
catggagaaactgcggctgctgctg

SEQ ID NO: 239858 - DNA, 25 bp, Rattus norvegicus
catggagaaagtacctgacttccct

SEQ ID NO: 239859 - DNA, 25 bp, Rattus norvegicus
catggagaaagttcctgacttccct

SEQ ID NO: 239860 - DNA, 25 bp, Rattus norvegicus
catggagaagatctttttcacagta

SEQ ID NO: 239861 - DNA, 25 bp, Rattus norvegicus
catggagaagatgtttttcacagta

SEQ ID NO: 239862 - DNA, 25 bp, Rattus norvegicus
catggagacatgaggcaaagacaaa

SEQ ID NO: 239863 - DNA, 25 bp, Rattus norvegicus
catggagacatgtggcaaagacaaa

SEQ ID NO: 239864 - DNA, 25 bp, Rattus norvegicus
catggagacttgctgttcttctgcc

SEQ ID NO: 239865 - DNA, 25 bp, Rattus norvegicus
catggagacttggtgttcttctgcc

SEQ ID NO: 239866 - DNA, 25 bp, Rattus norvegicus
catggagagcgaccccaggaccgtt

SEQ ID NO: 239867 - DNA, 25 bp, Rattus norvegicus
catggagagcgagcccaggaccgtt

SEQ ID NO: 239868 - DNA, 25 bp, Rattus norvegicus
catggagagctcagtatttttacct

SEQ ID NO: 239869 - DNA, 25 bp, Rattus norvegicus
catggagagctctgtatttttacct

SEQ ID NO: 239870 - DNA, 25 bp, Rattus norvegicus
catggagaggttagtctgggctact

SEQ ID NO: 239871 - DNA, 25 bp, Rattus norvegicus
catggagaggtttgtctgggctact

SEQ ID NO: 239872 - DNA, 25 bp, Rattus norvegicus
catggagagtctctcataaatattt

SEQ ID NO: 239873 - DNA, 25 bp, Rattus norvegicus
catggagagtctgtcataaatattt

SEQ ID NO: 239874 - DNA, 25 bp, Rattus norvegicus
catggagatcagaggccaactttct

SEQ ID NO: 239875 - DNA, 25 bp, Rattus norvegicus
catggagatcagtggccaactttct

SEQ ID NO: 239876 - DNA, 25 bp, Rattus norvegicus
catggagatgacatgccttaggttt

SEQ ID NO: 239877 - DNA, 25 bp, Rattus norvegicus
catggagatgacttgccttaggttt

SEQ ID NO: 239878 - DNA, 25 bp, Rattus norvegicus
catggagcctttagcctgtattgca

SEQ ID NO: 239879 - DNA, 25 bp, Rattus norvegicus
catggagccttttgcctgtattgca

SEQ ID NO: 239880 - DNA, 25 bp, Rattus norvegicus
catggagctaatcccagcgtgacta

SEQ ID NO: 239881 - DNA, 25 bp, Rattus norvegicus
catggagctaatgccagcgtgacta

SEQ ID NO: 239882 - DNA, 25 bp, Rattus norvegicus
catggagctcaaaaggactggtgtc

SEQ ID NO: 239883 - DNA, 25 bp, Rattus norvegicus
catggagctcaacggactctgtaag

SEQ ID NO: 239884 - DNA, 25 bp, Rattus norvegicus
catggagctcaagggactctgtaag

SEQ ID NO: 239885 - DNA, 25 bp, Rattus norvegicus
catggagctcaataggactggtgtc

SEQ ID NO: 239886 - DNA, 25 bp, Rattus norvegicus
catggaggacctcttgcaggccgca

SEQ ID NO: 239887 - DNA, 25 bp, Rattus norvegicus
catggaggacctgttgcaggccgca

SEQ ID NO: 239888 - DNA, 25 bp, Rattus norvegicus
catggaggagtgagtctgtcttgtc

SEQ ID NO: 239889 - DNA, 25 bp, Rattus norvegicus
catggaggagtgtgtctgtcttgtc

SEQ ID NO: 239890 - DNA, 25 bp, Rattus norvegicus
catggaggcctcatagtttttccct

SEQ ID NO: 239891 - DNA, 25 bp, Rattus norvegicus
catggaggcctcttagtttttccct

SEQ ID NO: 239892 - DNA, 25 bp, Rattus norvegicus
catggaggctggcaactactggttt

SEQ ID NO: 239893 - DNA, 25 bp, Rattus norvegicus
catggaggctgggaactactggttt

SEQ ID NO: 239894 - DNA, 25 bp, Rattus norvegicus
catggagggcctagtggacaccagt

SEQ ID NO: 239895 - DNA, 25 bp, Rattus norvegicus
catggagggccttgtggacaccagt

SEQ ID NO: 239896 - DNA, 25 bp, Rattus norvegicus
catggagtccttcaagcagacggat

SEQ ID NO: 239897 - DNA, 25 bp, Rattus norvegicus
catggagtccttgaagcagacggat

SEQ ID NO: 239898 - DNA, 25 bp, Rattus norvegicus
catggagtctcaaacctgcaggaat

SEQ ID NO: 239899 - DNA, 25 bp, Rattus norvegicus
catggagtctcatacctgcaggaat

SEQ ID NO: 239900 - DNA, 25 bp, Rattus norvegicus
catggagtctgacatctacgacacc

SEQ ID NO: 239901 - DNA, 25 bp, Rattus norvegicus
catggagtctgagatctacgacacc

SEQ ID NO: 239902 - DNA, 25 bp, Rattus norvegicus
catggagtctgcagtcctggcagca

SEQ ID NO: 239903 - DNA, 25 bp, Rattus norvegicus
catggagtctgctgtcctggcagca

SEQ ID NO: 239904 - DNA, 25 bp, Rattus norvegicus
catggagtgttgagaagcatacagt

SEQ ID NO: 239905 - DNA, 25 bp, Rattus norvegicus
catggagtgttgtgaagcatacagt

SEQ ID NO: 239906 - DNA, 25 bp, Rattus norvegicus
catggagttctaaggcttcagcact

SEQ ID NO: 239907 - DNA, 25 bp, Rattus norvegicus
catggagttctatggcttcagcact

SEQ ID NO: 239908 - DNA, 25 bp, Rattus norvegicus
catggatatgatatgccctcctgga

SEQ ID NO: 239909 - DNA, 25 bp, Rattus norvegicus
catggatatgatttgccctcctgga

SEQ ID NO: 239910 - DNA, 25 bp, Rattus norvegicus
catggatattggaacctgacgacaa

SEQ ID NO: 239911 - DNA, 25 bp, Rattus norvegicus
catggatattggtacctgacgacaa

SEQ ID NO: 239912 - DNA, 25 bp, Rattus norvegicus
catggatcaagcaaccgcctcagag

SEQ ID NO: 239913 - DNA, 25 bp, Rattus norvegicus
catggatcaagctaccgcctcagag

SEQ ID NO: 239914 - DNA, 25 bp, Rattus norvegicus
catggatcacaccacatcctctgta

SEQ ID NO: 239915 - DNA, 25 bp, Rattus norvegicus
catggatcacacgacatcctctgta

SEQ ID NO: 239916 - DNA, 25 bp, Rattus norvegicus
catggatgacttatgagattttctc

SEQ ID NO: 239917 - DNA, 25 bp, Rattus norvegicus
catggatgacttttgagattttctc

SEQ ID NO: 239918 - DNA, 25 bp, Rattus norvegicus
catggatgcatcacacattggctgt

SEQ ID NO: 239919 - DNA, 25 bp, Rattus norvegicus
catggatgcatctcacattggctgt

SEQ ID NO: 239920 - DNA, 25 bp, Rattus norvegicus
catggatgccttctggacggtctat

SEQ ID NO: 239921 - DNA, 25 bp, Rattus norvegicus
catggatgccttgtggacggtctat

SEQ ID NO: 239922 - DNA, 25 bp, Rattus norvegicus
catggatgcttaccctggactgcac

SEQ ID NO: 239923 - DNA, 25 bp, Rattus norvegicus
catggatgcttagcctggactgcac

SEQ ID NO: 239924 - DNA, 25 bp, Rattus norvegicus
catggatggagtatctactgtgtga

SEQ ID NO: 239925 - DNA, 25 bp, Rattus norvegicus
catggatggagtttctactgtgtga

SEQ ID NO: 239926 - DNA, 25 bp, Rattus norvegicus
catggatgtctgcagtgctcccagc

SEQ ID NO: 239927 - DNA, 25 bp, Rattus norvegicus
catggatgtctggagtgctcccagc

SEQ ID NO: 239928 - DNA, 25 bp, Rattus norvegicus
catggattcatgatagcggctgcag

SEQ ID NO: 239929 - DNA, 25 bp, Rattus norvegicus
catggattcatgttagcggctgcag

SEQ ID NO: 239930 - DNA, 25 bp, Rattus norvegicus
catggattctggatgtctctctgtg

SEQ ID NO: 239931 - DNA, 25 bp, Rattus norvegicus
catggattctggttgtctctctgtg

SEQ ID NO: 239932 - DNA, 25 bp, Rattus norvegicus
catggattctttctatctgacttag

SEQ ID NO: 239933 - DNA, 25 bp, Rattus norvegicus
catggattctttgtatctgacttag

SEQ ID NO: 239934 - DNA, 25 bp, Rattus norvegicus
catggattgagaaaccccctaagga

SEQ ID NO: 239935 - DNA, 25 bp, Rattus norvegicus
catggattgagataccccctaagga

SEQ ID NO: 239936 - DNA, 25 bp, Rattus norvegicus
catggattggcaagacttattttta

SEQ ID NO: 239937 - DNA, 25 bp, Rattus norvegicus
catggattggcatgacttattttta

SEQ ID NO: 239938 - DNA, 25 bp, Rattus norvegicus
catggattgtgcagggcagctctgt

SEQ ID NO: 239939 - DNA, 25 bp, Rattus norvegicus
catggattgtgctgggcagctctgt

SEQ ID NO: 239940 - DNA, 25 bp, Rattus norvegicus
catggatttgtgacgtacctcagct

SEQ ID NO: 239941 - DNA, 25 bp, Rattus norvegicus
catggatttgtgtcgtacctcagct

SEQ ID NO: 239942 - DNA, 25 bp, Rattus norvegicus
catggcaacctactaaactttctca

SEQ ID NO: 239943 - DNA, 25 bp, Rattus norvegicus
catggcaacctagtaaactttctca

SEQ ID NO: 239944 - DNA, 25 bp, Rattus norvegicus
catggcaacgctctggtcttagtac

SEQ ID NO: 239945 - DNA, 25 bp, Rattus norvegicus
catggcaacgctgtggtcttagtac

SEQ ID NO: 239946 - DNA, 25 bp, Rattus norvegicus
catggcacatgaacgggaggcccac

SEQ ID NO: 239947 - DNA, 25 bp, Rattus norvegicus
catggcacatgatcgggaggcccac

SEQ ID NO: 239948 - DNA, 25 bp, Rattus norvegicus
catggcaccagacctgtttcaggta

SEQ ID NO: 239949 - DNA, 25 bp, Rattus norvegicus
catggcaccagagctgtttcaggta

SEQ ID NO: 239950 - DNA, 25 bp, Rattus norvegicus
catggcactattcggtttcactaaa

SEQ ID NO: 239951 - DNA, 25 bp, Rattus norvegicus
catggcactattgggtttcactaaa

SEQ ID NO: 239952 - DNA, 25 bp, Rattus norvegicus
catggcactgccactgtaagtcagg

SEQ ID NO: 239953 - DNA, 25 bp, Rattus norvegicus
catggcactgcctctgtaagtcagg

SEQ ID NO: 239954 - DNA, 25 bp, Rattus norvegicus
catggcactggacgtagactttgac

SEQ ID NO: 239955 - DNA, 25 bp, Rattus norvegicus
catggcactggaggtagactttgac

SEQ ID NO: 239956 - DNA, 25 bp, Rattus norvegicus
catggcacttcactatggctcagag

SEQ ID NO: 239957 - DNA, 25 bp, Rattus norvegicus
catggcacttcagtatggctcagag

SEQ ID NO: 239958 - DNA, 25 bp, Rattus norvegicus
catggcacttgcagttgtaataaat

SEQ ID NO: 239959 - DNA, 25 bp, Rattus norvegicus
catggcacttgctgttgtaataaat

SEQ ID NO: 239960 - DNA, 25 bp, Rattus norvegicus
catggcagacatacctctggcaaat

SEQ ID NO: 239961 - DNA, 25 bp, Rattus norvegicus
catggcagacattcctctggcaaat

SEQ ID NO: 239962 - DNA, 25 bp, Rattus norvegicus
catggcagcttacacctataattcc

SEQ ID NO: 239963 - DNA, 25 bp, Rattus norvegicus
catggcagcttagacctataattcc

SEQ ID NO: 239964 - DNA, 25 bp, Rattus norvegicus
catggcatatggagtcccatttggg

SEQ ID NO: 239965 - DNA, 25 bp, Rattus norvegicus
catggcatatggtgtcccatttggg

SEQ ID NO: 239966 - DNA, 25 bp, Rattus norvegicus
catggcatctctcacagttgtaagt

SEQ ID NO: 239967 - DNA, 25 bp, Rattus norvegicus
catggcatctctgacagttgtaagt

SEQ ID NO: 239968 - DNA, 25 bp, Rattus norvegicus
catggcatggcccaggttcattaaa

SEQ ID NO: 239969 - DNA, 25 bp, Rattus norvegicus
catggcatggccgaggttcattaaa

SEQ ID NO: 239970 - DNA, 25 bp, Rattus norvegicus
catggcattgccatgaaatacttgc

SEQ ID NO: 239971 - DNA, 25 bp, Rattus norvegicus
catggcattgccttgaaatacttgc

SEQ ID NO: 239972 - DNA, 25 bp, Rattus norvegicus
catggcattgtaattcctatgattt

SEQ ID NO: 239973 - DNA, 25 bp, Rattus norvegicus
catggcattgtatttcctatgattt

SEQ ID NO: 239974 - DNA, 25 bp, Rattus norvegicus
catggccaatccacagcagccttgc

SEQ ID NO: 239975 - DNA, 25 bp, Rattus norvegicus
catggccaatcctcagcagccttgc

SEQ ID NO: 239976 - DNA, 25 bp, Rattus norvegicus
catggccactacctgcagaagagag

SEQ ID NO: 239977 - DNA, 25 bp, Rattus norvegicus
catggccactacgtgcagaagagag

SEQ ID NO: 239978 - DNA, 25 bp, Rattus norvegicus
catggccagtccatgggaggttttc

SEQ ID NO: 239979 - DNA, 25 bp, Rattus norvegicus
catggccagtccttgggaggttttc

SEQ ID NO: 239980 - DNA, 25 bp, Rattus norvegicus
catggccagtgacaggagacttctt

SEQ ID NO: 239981 - DNA, 25 bp, Rattus norvegicus
catggccagtgagaggagacttctt

SEQ ID NO: 239982 - DNA, 25 bp, Rattus norvegicus
catggccatactagactgtctactt

SEQ ID NO: 239983 - DNA, 25 bp, Rattus norvegicus
catggccatacttgactgtctactt

SEQ ID NO: 239984 - DNA, 25 bp, Rattus norvegicus
catggccatcttagagctgctggac

SEQ ID NO: 239985 - DNA, 25 bp, Rattus norvegicus
catggccatctttgagctgctggac

SEQ ID NO: 239986 - DNA, 25 bp, Rattus norvegicus
catggccatggcacagggcactgtg

SEQ ID NO: 239987 - DNA, 25 bp, Rattus norvegicus
catggccatggctcagggcactgtg

SEQ ID NO: 239988 - DNA, 25 bp, Rattus norvegicus
catggccatttgaatcactccgagg

SEQ ID NO: 239989 - DNA, 25 bp, Rattus norvegicus
catggccatttgtatcactccgagg

SEQ ID NO: 239990 - DNA, 25 bp, Rattus norvegicus
catggcccaaatcctgggtttttgg

SEQ ID NO: 239991 - DNA, 25 bp, Rattus norvegicus
catggcccaaatgctgggtttttgg

SEQ ID NO: 239992 - DNA, 25 bp, Rattus norvegicus
catggcccaatcctgtatttatttc

SEQ ID NO: 239993 - DNA, 25 bp, Rattus norvegicus
catggcccaatcgtgtatttatttc

SEQ ID NO: 239994 - DNA, 25 bp, Rattus norvegicus
catggcccgtcaccagatggatgtg

SEQ ID NO: 239995 - DNA, 25 bp, Rattus norvegicus
catggcccgtcagcagatggatgtg

SEQ ID NO: 239996 - DNA, 25 bp, Rattus norvegicus
catggccctcagaatggcgtgagca

SEQ ID NO: 239997 - DNA, 25 bp, Rattus norvegicus
catggccctcagtatggcgtgagca

SEQ ID NO: 239998 - DNA, 25 bp, Rattus norvegicus
catggccctgatctcagagttcttt

SEQ ID NO: 239999 - DNA, 25 bp, Rattus norvegicus
catggccctgatgtcagagttcttt

SEQ ID NO: 240000 - DNA, 25 bp, Rattus norvegicus
catggccctggacggtctggcacat

SEQ ID NO: 240001 - DNA, 25 bp, Rattus norvegicus
catggccctggagggtctggcacat

SEQ ID NO: 240002 - DNA, 25 bp, Rattus norvegicus
catggccctggcacggtccagtgga

SEQ ID NO: 240003 - DNA, 25 bp, Rattus norvegicus
catggccctggctcggtccagtgga

SEQ ID NO: 240004 - DNA, 25 bp, Rattus norvegicus
catggccctgggaaggatacacaga

SEQ ID NO: 240005 - DNA, 25 bp, Rattus norvegicus
catggccctgggtaggatacacaga

SEQ ID NO: 240006 - DNA, 25 bp, Rattus norvegicus
catggcccttagaaggcgacagagt

SEQ ID NO: 240007 - DNA, 25 bp, Rattus norvegicus
catggcccttagtaggcgacagagt

SEQ ID NO: 240008 - DNA, 25 bp, Rattus norvegicus
catggcccttttaattaagtctgta

SEQ ID NO: 240009 - DNA, 25 bp, Rattus norvegicus
catggccctttttattaagtctgta

SEQ ID NO: 240010 - DNA, 25 bp, Rattus norvegicus
catggccgccctccaggtaattgag

SEQ ID NO: 240011 - DNA, 25 bp, Rattus norvegicus
catggccgccctgcaggtaattgag

SEQ ID NO: 240012 - DNA, 25 bp, Rattus norvegicus
catggccgccgtcgtggaaaagatc

SEQ ID NO: 240013 - DNA, 25 bp, Rattus norvegicus
catggccgccgtggtggaaaagatc

SEQ ID NO: 240014 - DNA, 25 bp, Rattus norvegicus
catggccgggacactcgagatggct

SEQ ID NO: 240015 - DNA, 25 bp, Rattus norvegicus
catggccgggactctcgagatggct

SEQ ID NO: 240016 - DNA, 25 bp, Rattus norvegicus
catggccgttgcacaccagataaaa

SEQ ID NO: 240017 - DNA, 25 bp, Rattus norvegicus
catggccgttgctcaccagataaaa

SEQ ID NO: 240018 - DNA, 25 bp, Rattus norvegicus
catggcctacaaagacttcttctta

SEQ ID NO: 240019 - DNA, 25 bp, Rattus norvegicus
catggcctacaatgacttcttctta

SEQ ID NO: 240020 - DNA, 25 bp, Rattus norvegicus
catggcctcgcccatttgaaatgag

SEQ ID NO: 240021 - DNA, 25 bp, Rattus norvegicus
catggcctcgccgatttgaaatgag

SEQ ID NO: 240022 - DNA, 25 bp, Rattus norvegicus
catggcctctgcactgatttctatc

SEQ ID NO: 240023 - DNA, 25 bp, Rattus norvegicus
catggcctctgctctgatttctatc

SEQ ID NO: 240024 - DNA, 25 bp, Rattus norvegicus
catggcctgcagaatgcccaagctg

SEQ ID NO: 240025 - DNA, 25 bp, Rattus norvegicus
catggcctgcagtatgcccaagctg

SEQ ID NO: 240026 - DNA, 25 bp, Rattus norvegicus
catggccttagcacagactgtcatt

SEQ ID NO: 240027 - DNA, 25 bp, Rattus norvegicus
catggccttagctcagactgtcatt

SEQ ID NO: 240028 - DNA, 25 bp, Rattus norvegicus
catggccttgagacaggacagctta

SEQ ID NO: 240029 - DNA, 25 bp, Rattus norvegicus
catggccttgagtcaggacagctta

SEQ ID NO: 240030 - DNA, 25 bp, Rattus norvegicus
catggccttgcacggctacaccata

SEQ ID NO: 240031 - DNA, 25 bp, Rattus norvegicus
catggccttgcagggctacaccata

SEQ ID NO: 240032 - DNA, 25 bp, Rattus norvegicus
catggcctttgcagagggtattcca

SEQ ID NO: 240033 - DNA, 25 bp, Rattus norvegicus
catggcctttgctgagggtattcca

SEQ ID NO: 240034 - DNA, 25 bp, Rattus norvegicus
catggcctttggctgtagagtcttt

SEQ ID NO: 240035 - DNA, 25 bp, Rattus norvegicus
catggcctttgggtgtagagtcttt

SEQ ID NO: 240036 - DNA, 25 bp, Rattus norvegicus
catggcgccaggacagcaggctagc

SEQ ID NO: 240037 - DNA, 25 bp, Rattus norvegicus
catggcgccaggtcagcaggctagc

SEQ ID NO: 240038 - DNA, 25 bp, Rattus norvegicus
catggcgctgcacggatggtgcact

SEQ ID NO: 240039 - DNA, 25 bp, Rattus norvegicus
catggcgctgcagggatggtgcact

SEQ ID NO: 240040 - DNA, 25 bp, Rattus norvegicus
catggcggaaacacagttcagcagt

SEQ ID NO: 240041 - DNA, 25 bp, Rattus norvegicus
catggcggaaactcagttcagcagt

SEQ ID NO: 240042 - DNA, 25 bp, Rattus norvegicus
catggctaagccaaagttatgacat

SEQ ID NO: 240043 - DNA, 25 bp, Rattus norvegicus
catggctaagcctaagttatgacat

SEQ ID NO: 240044 - DNA, 25 bp, Rattus norvegicus
catggctaccacagtcttcaaagca

SEQ ID NO: 240045 - DNA, 25 bp, Rattus norvegicus
catggctaccactgtcttcaaagca

SEQ ID NO: 240046 - DNA, 25 bp, Rattus norvegicus
catggctattccactgcagcttaaa

SEQ ID NO: 240047 - DNA, 25 bp, Rattus norvegicus
catggctattcctctgcagcttaaa

SEQ ID NO: 240048 - DNA, 25 bp, Rattus norvegicus
catggctcagaaactacaggtcaaa

SEQ ID NO: 240049 - DNA, 25 bp, Rattus norvegicus
catggctcagaatctacaggtcaaa

SEQ ID NO: 240050 - DNA, 25 bp, Rattus norvegicus
catggctcagctcggtgtgacccag

SEQ ID NO: 240051 - DNA, 25 bp, Rattus norvegicus
catggctcagctgggtgtgacccag

SEQ ID NO: 240052 - DNA, 25 bp, Rattus norvegicus
catggctcagttcctctatcaaatc

SEQ ID NO: 240053 - DNA, 25 bp, Rattus norvegicus
catggctcagttgctctatcaaatc

SEQ ID NO: 240054 - DNA, 25 bp, Rattus norvegicus
catggctcatagctataaggattat

SEQ ID NO: 240055 - DNA, 25 bp, Rattus norvegicus
catggctcataggtataaggattat

SEQ ID NO: 240056 - DNA, 25 bp, Rattus norvegicus
catggctcattaccagagactgtga

SEQ ID NO: 240057 - DNA, 25 bp, Rattus norvegicus
catggctcattagcagagactgtga

SEQ ID NO: 240058 - DNA, 25 bp, Rattus norvegicus
catggctccagcaaacacaagggct

SEQ ID NO: 240059 - DNA, 25 bp, Rattus norvegicus
catggctccagctaacacaagggct

SEQ ID NO: 240060 - DNA, 25 bp, Rattus norvegicus
catggctctctgaaagcctaggtaa

SEQ ID NO: 240061 - DNA, 25 bp, Rattus norvegicus
catggctctctgtaagcctaggtaa

SEQ ID NO: 240062 - DNA, 25 bp, Rattus norvegicus
catggctctggtagttcctctgtga

SEQ ID NO: 240063 - DNA, 25 bp, Rattus norvegicus
catggctctggttgttcctctgtga

SEQ ID NO: 240064 - DNA, 25 bp, Rattus norvegicus
catggctgaaccactctttgattca

SEQ ID NO: 240065 - DNA, 25 bp, Rattus norvegicus
catggctgaacctctctttgattca

SEQ ID NO: 240066 - DNA, 25 bp, Rattus norvegicus
catggctgatagatgctttgtgcat

SEQ ID NO: 240067 - DNA, 25 bp, Rattus norvegicus
catggctgatagttgctttgtgcat

SEQ ID NO: 240068 - DNA, 25 bp, Rattus norvegicus
catggctgatggagctctctgtata

SEQ ID NO: 240069 - DNA, 25 bp, Rattus norvegicus
catggctgatggtgctctctgtata

SEQ ID NO: 240070 - DNA, 25 bp, Rattus norvegicus
catggctggcatcttcaactgcata

SEQ ID NO: 240071 - DNA, 25 bp, Rattus norvegicus
catggctggcatgttcaactgcata

SEQ ID NO: 240072 - DNA, 25 bp, Rattus norvegicus
catggctggcctatattcttttcct

SEQ ID NO: 240073 - DNA, 25 bp, Rattus norvegicus
catggctggcctttattcttttcct

SEQ ID NO: 240074 - DNA, 25 bp, Rattus norvegicus
catggctgggagctcagtaaactta

SEQ ID NO: 240075 - DNA, 25 bp, Rattus norvegicus
catggctgggaggtcagtaaactta

SEQ ID NO: 240076 - DNA, 25 bp, Rattus norvegicus
catggctggtaactattttgggcaa

SEQ ID NO: 240077 - DNA, 25 bp, Rattus norvegicus
catggctggtaagtattttgggcaa

SEQ ID NO: 240078 - DNA, 25 bp, Rattus norvegicus
catggctggtagagtctgtggatca

SEQ ID NO: 240079 - DNA, 25 bp, Rattus norvegicus
catggctggtagtgtctgtggatca

SEQ ID NO: 240080 - DNA, 25 bp, Rattus norvegicus
catggctgtgtacgatgctccagta

SEQ ID NO: 240081 - DNA, 25 bp, Rattus norvegicus
catggctgtgtaggatgctccagta

SEQ ID NO: 240082 - DNA, 25 bp, Rattus norvegicus
catggcttaaatcctgactctcaga

SEQ ID NO: 240083 - DNA, 25 bp, Rattus norvegicus
catggcttaaatgctgactctcaga

SEQ ID NO: 240084 - DNA, 25 bp, Rattus norvegicus
catggcttcattctggctagcgtag

SEQ ID NO: 240085 - DNA, 25 bp, Rattus norvegicus
catggcttcattgtggctagcgtag

SEQ ID NO: 240086 - DNA, 25 bp, Rattus norvegicus
catggcttccacctgcttgaggagc

SEQ ID NO: 240087 - DNA, 25 bp, Rattus norvegicus
catggcttccacgtgcttgaggagc

SEQ ID NO: 240088 - DNA, 25 bp, Rattus norvegicus
catggcttcctcagtgacaaactaa

SEQ ID NO: 240089 - DNA, 25 bp, Rattus norvegicus
catggcttcctctgtgacaaactaa

SEQ ID NO: 240090 - DNA, 25 bp, Rattus norvegicus
catggcttctttacctttactgaaa

SEQ ID NO: 240091 - DNA, 25 bp, Rattus norvegicus
catggcttcttttcctttactgaaa

SEQ ID NO: 240092 - DNA, 25 bp, Rattus norvegicus
catggctttctcacagtggtgatga

SEQ ID NO: 240093 - DNA, 25 bp, Rattus norvegicus
catggctttctctcagtggtgatga

SEQ ID NO: 240094 - DNA, 25 bp, Rattus norvegicus
catggctttctgaaggtttgctgta

SEQ ID NO: 240095 - DNA, 25 bp, Rattus norvegicus
catggctttctgtaggtttgctgta

SEQ ID NO: 240096 - DNA, 25 bp, Rattus norvegicus
catggctttgcccaatttctggttt

SEQ ID NO: 240097 - DNA, 25 bp, Rattus norvegicus
catggctttgccgaatttctggttt

SEQ ID NO: 240098 - DNA, 25 bp, Rattus norvegicus
catggctttgctatatatcttgata

SEQ ID NO: 240099 - DNA, 25 bp, Rattus norvegicus
catggctttgctttatatcttgata

SEQ ID NO: 240100 - DNA, 25 bp, Rattus norvegicus
catggctttggtacagggacaagtt

SEQ ID NO: 240101 - DNA, 25 bp, Rattus norvegicus
catggctttggttcagggacaagtt

SEQ ID NO: 240102 - DNA, 25 bp, Rattus norvegicus
catgggaacacaactgactatttgt

SEQ ID NO: 240103 - DNA, 25 bp, Rattus norvegicus
catgggaacacatctgactatttgt

SEQ ID NO: 240104 - DNA, 25 bp, Rattus norvegicus
catgggaatcgaagttacttctgtt

SEQ ID NO: 240105 - DNA, 25 bp, Rattus norvegicus
catgggaatcgatgttacttctgtt

SEQ ID NO: 240106 - DNA, 25 bp, Rattus norvegicus
catgggacaccacggtcggcgtttt

SEQ ID NO: 240107 - DNA, 25 bp, Rattus norvegicus
catgggacaccagggtcggcgtttt

SEQ ID NO: 240108 - DNA, 25 bp, Rattus norvegicus
catgggacatatcactggctagaaa

SEQ ID NO: 240109 - DNA, 25 bp, Rattus norvegicus
catgggacatatgactggctagaaa

SEQ ID NO: 240110 - DNA, 25 bp, Rattus norvegicus
catgggactgttatgtacctgcttc

SEQ ID NO: 240111 - DNA, 25 bp, Rattus norvegicus
catgggactgttttgtacctgcttc

SEQ ID NO: 240112 - DNA, 25 bp, Rattus norvegicus
catgggagaaccatgctgacctgca

SEQ ID NO: 240113 - DNA, 25 bp, Rattus norvegicus
catgggagaaccttgctgacctgca

SEQ ID NO: 240114 - DNA, 25 bp, Rattus norvegicus
catgggagcctaagtcattgccagt

SEQ ID NO: 240115 - DNA, 25 bp, Rattus norvegicus
catgggagcctatgtcattgccagt

SEQ ID NO: 240116 - DNA, 25 bp, Rattus norvegicus
catgggattccaccgcagtcaggcg

SEQ ID NO: 240117 - DNA, 25 bp, Rattus norvegicus
catgggattccagcgcagtcaggcg

SEQ ID NO: 240118 - DNA, 25 bp, Rattus norvegicus
catgggattcttaaactgtttgtac

SEQ ID NO: 240119 - DNA, 25 bp, Rattus norvegicus
catgggattctttaactgtttgtac

SEQ ID NO: 240120 - DNA, 25 bp, Rattus norvegicus
catgggattgtcactgttcctttct

SEQ ID NO: 240121 - DNA, 25 bp, Rattus norvegicus
catgggattgtctctgttcctttct

SEQ ID NO: 240122 - DNA, 25 bp, Rattus norvegicus
catgggatttaacacctagagagat

SEQ ID NO: 240123 - DNA, 25 bp, Rattus norvegicus
catgggatttaagacctagagagat

SEQ ID NO: 240124 - DNA, 25 bp, Rattus norvegicus
catgggcacagcaatggaactctct

SEQ ID NO: 240125 - DNA, 25 bp, Rattus norvegicus
catgggcacagctatggaactctct

SEQ ID NO: 240126 - DNA, 25 bp, Rattus norvegicus
catgggcaccatcaacagacagctg

SEQ ID NO: 240127 - DNA, 25 bp, Rattus norvegicus
catgggcaccatgaacagacagctg

SEQ ID NO: 240128 - DNA, 25 bp, Rattus norvegicus
catgggcagagcataggcactttct

SEQ ID NO: 240129 - DNA, 25 bp, Rattus norvegicus
catgggcagagcttaggcactttct

SEQ ID NO: 240130 - DNA, 25 bp, Rattus norvegicus
catgggcagattcacggacttagct

SEQ ID NO: 240131 - DNA, 25 bp, Rattus norvegicus
catgggcagattgacggacttagct

SEQ ID NO: 240132 - DNA, 25 bp, Rattus norvegicus
catgggcagccaccagtttcaggat

SEQ ID NO: 240133 - DNA, 25 bp, Rattus norvegicus
catgggcagccagcagtttcaggat

SEQ ID NO: 240134 - DNA, 25 bp, Rattus norvegicus
catgggcagctgacactttgtctgg

SEQ ID NO: 240135 - DNA, 25 bp, Rattus norvegicus
catgggcagctgtcactttgtctgg

SEQ ID NO: 240136 - DNA, 25 bp, Rattus norvegicus
catgggcagtctcatccagatgata

SEQ ID NO: 240137 - DNA, 25 bp, Rattus norvegicus
catgggcagtctgatccagatgata

SEQ ID NO: 240138 - DNA, 25 bp, Rattus norvegicus
catgggcatttaccgtctctgaaca

SEQ ID NO: 240139 - DNA, 25 bp, Rattus norvegicus
catgggcatttagcgtctctgaaca

SEQ ID NO: 240140 - DNA, 25 bp, Rattus norvegicus
catgggcatttcatgcgggtgcttt

SEQ ID NO: 240141 - DNA, 25 bp, Rattus norvegicus
catgggcatttcttgcgggtgcttt

SEQ ID NO: 240142 - DNA, 25 bp, Rattus norvegicus
catgggccatcaaagcaggcagctt

SEQ ID NO: 240143 - DNA, 25 bp, Rattus norvegicus
catgggccatcatagcaggcagctt

SEQ ID NO: 240144 - DNA, 25 bp, Rattus norvegicus
catgggccatgaccactcaatttta

SEQ ID NO: 240145 - DNA, 25 bp, Rattus norvegicus
catgggccatgagcactcaatttta

SEQ ID NO: 240146 - DNA, 25 bp, Rattus norvegicus
catgggccatgtccctggcattgaa

SEQ ID NO: 240147 - DNA, 25 bp, Rattus norvegicus
catgggccatgtgcctggcattgaa

SEQ ID NO: 240148 - DNA, 25 bp, Rattus norvegicus
catgggccgaaaccctgcagtgttc

SEQ ID NO: 240149 - DNA, 25 bp, Rattus norvegicus
catgggccgaaagcctgcagtgttc

SEQ ID NO: 240150 - DNA, 25 bp, Rattus norvegicus
catgggcctggaaccccagcaatgg

SEQ ID NO: 240151 - DNA, 25 bp, Rattus norvegicus
catgggcctggatccccagcaatgg

SEQ ID NO: 240152 - DNA, 25 bp, Rattus norvegicus
catgggcgagcgatccagcttctgg

SEQ ID NO: 240153 - DNA, 25 bp, Rattus norvegicus
catgggcgagcgttccagcttctgg

SEQ ID NO: 240154 - DNA, 25 bp, Rattus norvegicus
catgggctacctactatactttgta

SEQ ID NO: 240155 - DNA, 25 bp, Rattus norvegicus
catgggctaccttctatactttgta

SEQ ID NO: 240156 - DNA, 25 bp, Rattus norvegicus
catgggctgggaagcccctttgata

SEQ ID NO: 240157 - DNA, 25 bp, Rattus norvegicus
catgggctgggatgcccctttgata

SEQ ID NO: 240158 - DNA, 25 bp, Rattus norvegicus
catgggcttactcaaatccttactt

SEQ ID NO: 240159 - DNA, 25 bp, Rattus norvegicus
catgggcttactgaaatccttactt

SEQ ID NO: 240160 - DNA, 25 bp, Rattus norvegicus
catgggcttcctaattgctcaataa

SEQ ID NO: 240161 - DNA, 25 bp, Rattus norvegicus
catgggcttccttattgctcaataa

SEQ ID NO: 240162 - DNA, 25 bp, Rattus norvegicus
catgggcttggtatatacgaattgc

SEQ ID NO: 240163 - DNA, 25 bp, Rattus norvegicus
catgggcttggtttatacgaattgc

SEQ ID NO: 240164 - DNA, 25 bp, Rattus norvegicus
catgggctttctacattttggttgt

SEQ ID NO: 240165 - DNA, 25 bp, Rattus norvegicus
catgggctttcttcattttggttgt

SEQ ID NO: 240166 - DNA, 25 bp, Rattus norvegicus
catgggtaagttatgtttcgcctat

SEQ ID NO: 240167 - DNA, 25 bp, Rattus norvegicus
catgggtaagttttgtttcgcctat

SEQ ID NO: 240168 - DNA, 25 bp, Rattus norvegicus
catgggtaatggcttttgtctatat

SEQ ID NO: 240169 - DNA, 25 bp, Rattus norvegicus
catgggtaatgggttttgtctatat

SEQ ID NO: 240170 - DNA, 25 bp, Rattus norvegicus
catgggtacttgatcgcttcctgaa

SEQ ID NO: 240171 - DNA, 25 bp, Rattus norvegicus
catgggtacttgttcgcttcctgaa

SEQ ID NO: 240172 - DNA, 25 bp, Rattus norvegicus
catgggtagctgatgtagctgtcca

SEQ ID NO: 240173 - DNA, 25 bp, Rattus norvegicus
catgggtagctgttgtagctgtcca

SEQ ID NO: 240174 - DNA, 25 bp, Rattus norvegicus
catgggtcctgcaggatgacagtaa

SEQ ID NO: 240175 - DNA, 25 bp, Rattus norvegicus
catgggtcctgctggatgacagtaa

SEQ ID NO: 240176 - DNA, 25 bp, Rattus norvegicus
catgggtccttgatgttcagcagtg

SEQ ID NO: 240177 - DNA, 25 bp, Rattus norvegicus
catgggtccttgttgttcagcagtg

SEQ ID NO: 240178 - DNA, 25 bp, Rattus norvegicus
catgggtcggacattcatccacaaa

SEQ ID NO: 240179 - DNA, 25 bp, Rattus norvegicus
catgggtcggactttcatccacaaa

SEQ ID NO: 240180 - DNA, 25 bp, Rattus norvegicus
catgggtcggcaaaattcggcaggt

SEQ ID NO: 240181 - DNA, 25 bp, Rattus norvegicus
catgggtcggcataattcggcaggt

SEQ ID NO: 240182 - DNA, 25 bp, Rattus norvegicus
catgggtctggcctgtaaatattca

SEQ ID NO: 240183 - DNA, 25 bp, Rattus norvegicus
catgggtctggcgtgtaaatattca

SEQ ID NO: 240184 - DNA, 25 bp, Rattus norvegicus
catgggtgattaactcggcggcgtc

SEQ ID NO: 240185 - DNA, 25 bp, Rattus norvegicus
catgggtgattatctcggcggcgtc

SEQ ID NO: 240186 - DNA, 25 bp, Rattus norvegicus
catgggtgctgcacttttgtgagct

SEQ ID NO: 240187 - DNA, 25 bp, Rattus norvegicus
catgggtgctgctcttttgtgagct

SEQ ID NO: 240188 - DNA, 25 bp, Rattus norvegicus
catgggttagacaggactcacttga

SEQ ID NO: 240189 - DNA, 25 bp, Rattus norvegicus
catgggttagactggactcacttga

SEQ ID NO: 240190 - DNA, 25 bp, Rattus norvegicus
catgggttatgccaactgtgtctga

SEQ ID NO: 240191 - DNA, 25 bp, Rattus norvegicus
catgggttatgcgaactgtgtctga

SEQ ID NO: 240192 - DNA, 25 bp, Rattus norvegicus
catgggttattgaataggatcctaa

SEQ ID NO: 240193 - DNA, 25 bp, Rattus norvegicus
catgggttattgtataggatcctaa

SEQ ID NO: 240194 - DNA, 25 bp, Rattus norvegicus
catgggttgtggcaatcgaactcat

SEQ ID NO: 240195 - DNA, 25 bp, Rattus norvegicus
catgggttgtgggaatcgaactcat

SEQ ID NO: 240196 - DNA, 25 bp, Rattus norvegicus
catgggtttgcacagggtgctatcc

SEQ ID NO: 240197 - DNA, 25 bp, Rattus norvegicus
catgggtttgcagagggtgctatcc

SEQ ID NO: 240198 - DNA, 25 bp, Rattus norvegicus
catgggttttccacggctttggaga

SEQ ID NO: 240199 - DNA, 25 bp, Rattus norvegicus
catgggttttcctcggctttggaga

SEQ ID NO: 240200 - DNA, 25 bp, Rattus norvegicus
catggtagaatgaccgtcctgataa

SEQ ID NO: 240201 - DNA, 25 bp, Rattus norvegicus
catggtagaatgtccgtcctgataa

SEQ ID NO: 240202 - DNA, 25 bp, Rattus norvegicus
catggtaggcctccaatcagtggga

SEQ ID NO: 240203 - DNA, 25 bp, Rattus norvegicus
catggtaggcctgcaatcagtggga

SEQ ID NO: 240204 - DNA, 25 bp, Rattus norvegicus
catggtatagtgattccctgctagg

SEQ ID NO: 240205 - DNA, 25 bp, Rattus norvegicus
catggtatagtgtttccctgctagg

SEQ ID NO: 240206 - DNA, 25 bp, Rattus norvegicus
catggtcaaaccagcaggtctgaaa

SEQ ID NO: 240207 - DNA, 25 bp, Rattus norvegicus
catggtcaaacctgcaggtctgaaa

SEQ ID NO: 240208 - DNA, 25 bp, Rattus norvegicus
catggtcaccggctttgtcgacaat

SEQ ID NO: 240209 - DNA, 25 bp, Rattus norvegicus
catggtcaccgggtttgtcgacaat

SEQ ID NO: 240210 - DNA, 25 bp, Rattus norvegicus
catggtcacggtccaggccacgctg

SEQ ID NO: 240211 - DNA, 25 bp, Rattus norvegicus
catggtcacggtctccagtaaggaa

SEQ ID NO: 240212 - DNA, 25 bp, Rattus norvegicus
catggtcacggtgcaggccacgctg

SEQ ID NO: 240213 - DNA, 25 bp, Rattus norvegicus
catggtcacggtgtccagtaaggaa

SEQ ID NO: 240214 - DNA, 25 bp, Rattus norvegicus
catggtcactgtccagtctggagtt

SEQ ID NO: 240215 - DNA, 25 bp, Rattus norvegicus
catggtcactgtgcagtctggagtt

SEQ ID NO: 240216 - DNA, 25 bp, Rattus norvegicus
catggtcaggcacggccagcaagat

SEQ ID NO: 240217 - DNA, 25 bp, Rattus norvegicus
catggtcaggcagggccagcaagat

SEQ ID NO: 240218 - DNA, 25 bp, Rattus norvegicus
catggtcagggcaattttggagaga

SEQ ID NO: 240219 - DNA, 25 bp, Rattus norvegicus
catggtcagggctattttggagaga

SEQ ID NO: 240220 - DNA, 25 bp, Rattus norvegicus
catggtcagttgacttatcttgcag

SEQ ID NO: 240221 - DNA, 25 bp, Rattus norvegicus
catggtcagttgtcttatcttgcag

SEQ ID NO: 240222 - DNA, 25 bp, Rattus norvegicus
catggtcatgtcattctgaggtcac

SEQ ID NO: 240223 - DNA, 25 bp, Rattus norvegicus
catggtcatgtctttctgaggtcac

SEQ ID NO: 240224 - DNA, 25 bp, Rattus norvegicus
catggtccaacaattcctgggttta

SEQ ID NO: 240225 - DNA, 25 bp, Rattus norvegicus
catggtccaacatttcctgggttta

SEQ ID NO: 240226 - DNA, 25 bp, Rattus norvegicus
catggtccaccaagttgggctaaat

SEQ ID NO: 240227 - DNA, 25 bp, Rattus norvegicus
catggtccaccatgttgggctaaat

SEQ ID NO: 240228 - DNA, 25 bp, Rattus norvegicus
catggtccaggaatgcacagctgtc

SEQ ID NO: 240229 - DNA, 25 bp, Rattus norvegicus
catggtccaggattgcacagctgtc

SEQ ID NO: 240230 - DNA, 25 bp, Rattus norvegicus
catggtcccattccaggcctgttaa

SEQ ID NO: 240231 - DNA, 25 bp, Rattus norvegicus
catggtcccattgcaggcctgttaa

SEQ ID NO: 240232 - DNA, 25 bp, Rattus norvegicus
catggtccccatagagatctttggt

SEQ ID NO: 240233 - DNA, 25 bp, Rattus norvegicus
catggtccccattgagatctttggt

SEQ ID NO: 240234 - DNA, 25 bp, Rattus norvegicus
catggtcctctcaggccctgggagg

SEQ ID NO: 240235 - DNA, 25 bp, Rattus norvegicus
catggtcctctctggccctgggagg

SEQ ID NO: 240236 - DNA, 25 bp, Rattus norvegicus
catggtcctgtcatagtaggcctgt

SEQ ID NO: 240237 - DNA, 25 bp, Rattus norvegicus
catggtcctgtcttagtaggcctgt

SEQ ID NO: 240238 - DNA, 25 bp, Rattus norvegicus
catggtcgacgtcacggaagacttt

SEQ ID NO: 240239 - DNA, 25 bp, Rattus norvegicus
catggtcgacgtgacggaagacttt

SEQ ID NO: 240240 - DNA, 25 bp, Rattus norvegicus
catggtcggatactggagctgtggt

SEQ ID NO: 240241 - DNA, 25 bp, Rattus norvegicus
catggtcggatagtggagctgtggt

SEQ ID NO: 240242 - DNA, 25 bp, Rattus norvegicus
catggtcgggtgactctgcaaaagc

SEQ ID NO: 240243 - DNA, 25 bp, Rattus norvegicus
catggtcgggtgtctctgcaaaagc

SEQ ID NO: 240244 - DNA, 25 bp, Rattus norvegicus
catggtcgtttgaccgggttctgaa

SEQ ID NO: 240245 - DNA, 25 bp, Rattus norvegicus
catggtcgtttgtccgggttctgaa

SEQ ID NO: 240246 - DNA, 25 bp, Rattus norvegicus
catggtctgaaaattgcccacattt

SEQ ID NO: 240247 - DNA, 25 bp, Rattus norvegicus
catggtctgaaatttgcccacattt

SEQ ID NO: 240248 - DNA, 25 bp, Rattus norvegicus
catggtcttcttcttccagaggatg

SEQ ID NO: 240249 - DNA, 25 bp, Rattus norvegicus
catggtcttcttgttccagaggatg

SEQ ID NO: 240250 - DNA, 25 bp, Rattus norvegicus
catggtctttggagtgcccttaaaa

SEQ ID NO: 240251 - DNA, 25 bp, Rattus norvegicus
catggtctttggtgtgcccttaaaa

SEQ ID NO: 240252 - DNA, 25 bp, Rattus norvegicus
catggtctttgtcaacctgcttaga

SEQ ID NO: 240253 - DNA, 25 bp, Rattus norvegicus
catggtctttgtgaacctgcttaga

SEQ ID NO: 240254 - DNA, 25 bp, Rattus norvegicus
catggtgaacttaactgctgaggaa

SEQ ID NO: 240255 - DNA, 25 bp, Rattus norvegicus
catggtgaactttactgctgaggaa

SEQ ID NO: 240256 - DNA, 25 bp, Rattus norvegicus
catggtgaagatcttgctggcctct

SEQ ID NO: 240257 - DNA, 25 bp, Rattus norvegicus
catggtgaagatgttgctggcctct

SEQ ID NO: 240258 - DNA, 25 bp, Rattus norvegicus
catggtgacaaacgtcccatttata

SEQ ID NO: 240259 - DNA, 25 bp, Rattus norvegicus
catggtgacaaaggtcccatttata

SEQ ID NO: 240260 - DNA, 25 bp, Rattus norvegicus
catggtgacagtcgcctggcttgca

SEQ ID NO: 240261 - DNA, 25 bp, Rattus norvegicus
catggtgacagtggcctggcttgca

SEQ ID NO: 240262 - DNA, 25 bp, Rattus norvegicus
catggtgactctcctttactgaaag

SEQ ID NO: 240263 - DNA, 25 bp, Rattus norvegicus
catggtgactctgctttactgaaag

SEQ ID NO: 240264 - DNA, 25 bp, Rattus norvegicus
catggtgactggaacagatgggtta

SEQ ID NO: 240265 - DNA, 25 bp, Rattus norvegicus
catggtgactggtacagatgggtta

SEQ ID NO: 240266 - DNA, 25 bp, Rattus norvegicus
catggtgagcgtcccagtgttcagc

SEQ ID NO: 240267 - DNA, 25 bp, Rattus norvegicus
catggtgagcgtgccagtgttcagc

SEQ ID NO: 240268 - DNA, 25 bp, Rattus norvegicus
catggtgagtggaccaggcacacat

SEQ ID NO: 240269 - DNA, 25 bp, Rattus norvegicus
catggtgagtggtccaggcacacat

SEQ ID NO: 240270 - DNA, 25 bp, Rattus norvegicus
catggtgatcgtctcttggtatttt

SEQ ID NO: 240271 - DNA, 25 bp, Rattus norvegicus
catggtgatcgtgtcttggtatttt

SEQ ID NO: 240272 - DNA, 25 bp, Rattus norvegicus
catggtgcagccactgcaaggagat

SEQ ID NO: 240273 - DNA, 25 bp, Rattus norvegicus
catggtgcagcctctgcaaggagat

SEQ ID NO: 240274 - DNA, 25 bp, Rattus norvegicus
catggtgcccaacttattacttgaa

SEQ ID NO: 240275 - DNA, 25 bp, Rattus norvegicus
catggtgcccaagttattacttgaa

SEQ ID NO: 240276 - DNA, 25 bp, Rattus norvegicus
catggtgcctatagactttcggaat

SEQ ID NO: 240277 - DNA, 25 bp, Rattus norvegicus
catggtgcctattgactttcggaat

SEQ ID NO: 240278 - DNA, 25 bp, Rattus norvegicus
catggtgctaatctctatcaatccc

SEQ ID NO: 240279 - DNA, 25 bp, Rattus norvegicus
catggtgctaatgtctatcaatccc

SEQ ID NO: 240280 - DNA, 25 bp, Rattus norvegicus
catggtgctattacaggctgacaaa

SEQ ID NO: 240281 - DNA, 25 bp, Rattus norvegicus
catggtgctatttcaggctgacaaa

SEQ ID NO: 240282 - DNA, 25 bp, Rattus norvegicus
catggtgctggaataggccccacag

SEQ ID NO: 240283 - DNA, 25 bp, Rattus norvegicus
catggtgctggattaggccccacag

SEQ ID NO: 240284 - DNA, 25 bp, Rattus norvegicus
catggtgcttccatttgtttcataa

SEQ ID NO: 240285 - DNA, 25 bp, Rattus norvegicus
catggtgcttccttttgtttcataa

SEQ ID NO: 240286 - DNA, 25 bp, Rattus norvegicus
catggtgcttggatggctgatgctc

SEQ ID NO: 240287 - DNA, 25 bp, Rattus norvegicus
catggtgcttggttggctgatgctc

SEQ ID NO: 240288 - DNA, 25 bp, Rattus norvegicus
catggtggcatcagcctgtaggtgc

SEQ ID NO: 240289 - DNA, 25 bp, Rattus norvegicus
catggtggcatctgcctgtaggtgc

SEQ ID NO: 240290 - DNA, 25 bp, Rattus norvegicus
catggtggcatgagtagtccaagct

SEQ ID NO: 240291 - DNA, 25 bp, Rattus norvegicus
catggtggcatgtgtagtccaagct

SEQ ID NO: 240292 - DNA, 25 bp, Rattus norvegicus
catggtggccttagcgggcaagtat

SEQ ID NO: 240293 - DNA, 25 bp, Rattus norvegicus
catggtggcctttgcgggcaagtat

SEQ ID NO: 240294 - DNA, 25 bp, Rattus norvegicus
catggtgggtcacttcttttttaca

SEQ ID NO: 240295 - DNA, 25 bp, Rattus norvegicus
catggtgggtcagttcttttttaca

SEQ ID NO: 240296 - DNA, 25 bp, Rattus norvegicus
catggtggtgatctgctttctagta

SEQ ID NO: 240297 - DNA, 25 bp, Rattus norvegicus
catggtggtgatgtgctttctagta

SEQ ID NO: 240298 - DNA, 25 bp, Rattus norvegicus
catggtggtggacagagtcttcctc

SEQ ID NO: 240299 - DNA, 25 bp, Rattus norvegicus
catggtggtggagagagtcttcctc

SEQ ID NO: 240300 - DNA, 25 bp, Rattus norvegicus
catggtggtgttaacatcgggtact

SEQ ID NO: 240301 - DNA, 25 bp, Rattus norvegicus
catggtggtgtttacatcgggtact

SEQ ID NO: 240302 - DNA, 25 bp, Rattus norvegicus
catggtgtacatataaacttgctaa

SEQ ID NO: 240303 - DNA, 25 bp, Rattus norvegicus
catggtgtacatttaaacttgctaa

SEQ ID NO: 240304 - DNA, 25 bp, Rattus norvegicus
catggtgtactcacattttttattt

SEQ ID NO: 240305 - DNA, 25 bp, Rattus norvegicus
catggtgtactctcattttttattt

SEQ ID NO: 240306 - DNA, 25 bp, Rattus norvegicus
catggtgtagatccagccctctgga

SEQ ID NO: 240307 - DNA, 25 bp, Rattus norvegicus
catggtgtagatgcagccctctgga

SEQ ID NO: 240308 - DNA, 25 bp, Rattus norvegicus
catggtgtagccacttgttctgaga

SEQ ID NO: 240309 - DNA, 25 bp, Rattus norvegicus
catggtgtagcctcttgttctgaga

SEQ ID NO: 240310 - DNA, 25 bp, Rattus norvegicus
catggtgtcattatcttgcaatata

SEQ ID NO: 240311 - DNA, 25 bp, Rattus norvegicus
catggtgtcattttcttgcaatata

SEQ ID NO: 240312 - DNA, 25 bp, Rattus norvegicus
catggtgtccatagtaacgtcagta

SEQ ID NO: 240313 - DNA, 25 bp, Rattus norvegicus
catggtgtccatcctgtaacagtgg

SEQ ID NO: 240314 - DNA, 25 bp, Rattus norvegicus
catggtgtccatgctgtaacagtgg

SEQ ID NO: 240315 - DNA, 25 bp, Rattus norvegicus
catggtgtccattgtaacgtcagta

SEQ ID NO: 240316 - DNA, 25 bp, Rattus norvegicus
catggtgtcttgagccttagattga

SEQ ID NO: 240317 - DNA, 25 bp, Rattus norvegicus
catggtgtcttgtgccttagattga

SEQ ID NO: 240318 - DNA, 25 bp, Rattus norvegicus
catggtgtgcctcgttatacctcaa

SEQ ID NO: 240319 - DNA, 25 bp, Rattus norvegicus
catggtgtgcctggttatacctcaa

SEQ ID NO: 240320 - DNA, 25 bp, Rattus norvegicus
catggttaccatcgtttgttgtata

SEQ ID NO: 240321 - DNA, 25 bp, Rattus norvegicus
catggttaccatggtttgttgtata

SEQ ID NO: 240322 - DNA, 25 bp, Rattus norvegicus
catggttcacacactgcatgttgaa

SEQ ID NO: 240323 - DNA, 25 bp, Rattus norvegicus
catggttcacacagactcttctctg

SEQ ID NO: 240324 - DNA, 25 bp, Rattus norvegicus
catggttcacactctgcatgttgaa

SEQ ID NO: 240325 - DNA, 25 bp, Rattus norvegicus
catggttcacactgactcttctctg

SEQ ID NO: 240326 - DNA, 25 bp, Rattus norvegicus
catggttcatttacagatttcactg

SEQ ID NO: 240327 - DNA, 25 bp, Rattus norvegicus
catggttcattttcagatttcactg

SEQ ID NO: 240328 - DNA, 25 bp, Rattus norvegicus
catggttcccaaccagtttcactta

SEQ ID NO: 240329 - DNA, 25 bp, Rattus norvegicus
catggttcccaagcagtttcactta

SEQ ID NO: 240330 - DNA, 25 bp, Rattus norvegicus
catggttcctgaaggctgttgaagt

SEQ ID NO: 240331 - DNA, 25 bp, Rattus norvegicus
catggttcctgatggctgttgaagt

SEQ ID NO: 240332 - DNA, 25 bp, Rattus norvegicus
catggttctctcacactgggattaa

SEQ ID NO: 240333 - DNA, 25 bp, Rattus norvegicus
catggttctctctcactgggattaa

SEQ ID NO: 240334 - DNA, 25 bp, Rattus norvegicus
catggttctctgagttgtctcttgt

SEQ ID NO: 240335 - DNA, 25 bp, Rattus norvegicus
catggttctctgtgttgtctcttgt

SEQ ID NO: 240336 - DNA, 25 bp, Rattus norvegicus
catggttctcttattaaggtagcct

SEQ ID NO: 240337 - DNA, 25 bp, Rattus norvegicus
catggttctctttttaaggtagcct

SEQ ID NO: 240338 - DNA, 25 bp, Rattus norvegicus
catggttctgagatggttccttttc

SEQ ID NO: 240339 - DNA, 25 bp, Rattus norvegicus
catggttctgagttggttccttttc

SEQ ID NO: 240340 - DNA, 25 bp, Rattus norvegicus
catggttctgatatcttgtggcttt

SEQ ID NO: 240341 - DNA, 25 bp, Rattus norvegicus
catggttctgatttcttgtggcttt

SEQ ID NO: 240342 - DNA, 25 bp, Rattus norvegicus
catggttggcatactgtgtccttgt

SEQ ID NO: 240343 - DNA, 25 bp, Rattus norvegicus
catggttggcattctgtgtccttgt

SEQ ID NO: 240344 - DNA, 25 bp, Rattus norvegicus
catggttgggatcgtcatggccaaa

SEQ ID NO: 240345 - DNA, 25 bp, Rattus norvegicus
catggttgggatggtcatggccaaa

SEQ ID NO: 240346 - DNA, 25 bp, Rattus norvegicus
catggttgttcgctgtctgttccag

SEQ ID NO: 240347 - DNA, 25 bp, Rattus norvegicus
catggttgttcggtgtctgttccag

SEQ ID NO: 240348 - DNA, 25 bp, Rattus norvegicus
catggtttcattcttaccagcccaa

SEQ ID NO: 240349 - DNA, 25 bp, Rattus norvegicus
catggtttcattgttaccagcccaa

SEQ ID NO: 240350 - DNA, 25 bp, Rattus norvegicus
catggtttgcttagggcccaggttt

SEQ ID NO: 240351 - DNA, 25 bp, Rattus norvegicus
catggtttgctttgggcccaggttt

SEQ ID NO: 240352 - DNA, 25 bp, Rattus norvegicus
catggttttatgaaggctgccaaca

SEQ ID NO: 240353 - DNA, 25 bp, Rattus norvegicus
catggttttatgtaggctgccaaca

SEQ ID NO: 240354 - DNA, 25 bp, Rattus norvegicus
catggttttccacccagccaaagag

SEQ ID NO: 240355 - DNA, 25 bp, Rattus norvegicus
catggttttccagccagccaaagag

SEQ ID NO: 240356 - DNA, 25 bp, Rattus norvegicus
catgtaaatattcctatcccagata

SEQ ID NO: 240357 - DNA, 25 bp, Rattus norvegicus
catgtaaatattgctatcccagata

SEQ ID NO: 240358 - DNA, 25 bp, Rattus norvegicus
catgtaaatgtcctgttgtaatatt

SEQ ID NO: 240359 - DNA, 25 bp, Rattus norvegicus
catgtaaatgtcgtgttgtaatatt

SEQ ID NO: 240360 - DNA, 25 bp, Rattus norvegicus
catgtaaccactatgaattcttttt

SEQ ID NO: 240361 - DNA, 25 bp, Rattus norvegicus
catgtaaccactttgaattcttttt

SEQ ID NO: 240362 - DNA, 25 bp, Rattus norvegicus
catgtaagagccagatttctcctgt

SEQ ID NO: 240363 - DNA, 25 bp, Rattus norvegicus
catgtaagagcctgatttctcctgt

SEQ ID NO: 240364 - DNA, 25 bp, Rattus norvegicus
catgtaatcattaggctcagccgag

SEQ ID NO: 240365 - DNA, 25 bp, Rattus norvegicus
catgtaatcatttggctcagccgag

SEQ ID NO: 240366 - DNA, 25 bp, Rattus norvegicus
catgtaatgttgctagagtgacctt

SEQ ID NO: 240367 - DNA, 25 bp, Rattus norvegicus
catgtaatgttggtagagtgacctt

SEQ ID NO: 240368 - DNA, 25 bp, Rattus norvegicus
catgtacattcaatattaagactga

SEQ ID NO: 240369 - DNA, 25 bp, Rattus norvegicus
catgtacattcattattaagactga

SEQ ID NO: 240370 - DNA, 25 bp, Rattus norvegicus
catgtaccacggagaggttcactgt

SEQ ID NO: 240371 - DNA, 25 bp, Rattus norvegicus
catgtaccacggtgaggttcactgt

SEQ ID NO: 240372 - DNA, 25 bp, Rattus norvegicus
catgtacccaggcatcgctgacagg

SEQ ID NO: 240373 - DNA, 25 bp, Rattus norvegicus
catgtacccagggatcgctgacagg

SEQ ID NO: 240374 - DNA, 25 bp, Rattus norvegicus
catgtacggatgcttgtaggcgacc

SEQ ID NO: 240375 - DNA, 25 bp, Rattus norvegicus
catgtacggatggttgtaggcgacc

SEQ ID NO: 240376 - DNA, 25 bp, Rattus norvegicus
catgtacgtcatcggtgcacttggc

SEQ ID NO: 240377 - DNA, 25 bp, Rattus norvegicus
catgtacgtcatgggtgcacttggc

SEQ ID NO: 240378 - DNA, 25 bp, Rattus norvegicus
catgtactagctccatccatttcta

SEQ ID NO: 240379 - DNA, 25 bp, Rattus norvegicus
catgtactagctgcatccatttcta

SEQ ID NO: 240380 - DNA, 25 bp, Rattus norvegicus
catgtactcattaggcttggctttt

SEQ ID NO: 240381 - DNA, 25 bp, Rattus norvegicus
catgtactcatttggcttggctttt

SEQ ID NO: 240382 - DNA, 25 bp, Rattus norvegicus
catgtactcttgaggatcttggcca

SEQ ID NO: 240383 - DNA, 25 bp, Rattus norvegicus
catgtactcttgtggatcttggcca

SEQ ID NO: 240384 - DNA, 25 bp, Rattus norvegicus
catgtactgccaatattgatgaagt

SEQ ID NO: 240385 - DNA, 25 bp, Rattus norvegicus
catgtactgccattattgatgaagt

SEQ ID NO: 240386 - DNA, 25 bp, Rattus norvegicus
catgtacttctcagcatccatgaag

SEQ ID NO: 240387 - DNA, 25 bp, Rattus norvegicus
catgtacttctctgcatccatgaag

SEQ ID NO: 240388 - DNA, 25 bp, Rattus norvegicus
catgtagatttgattgccagtgttt

SEQ ID NO: 240389 - DNA, 25 bp, Rattus norvegicus
catgtagatttgtttgccagtgttt

SEQ ID NO: 240390 - DNA, 25 bp, Rattus norvegicus
catgtagtacacatacaaacacaca

SEQ ID NO: 240391 - DNA, 25 bp, Rattus norvegicus
catgtagtacacttacaaacacaca

SEQ ID NO: 240392 - DNA, 25 bp, Rattus norvegicus
catgtagtctagaatgctgcactta

SEQ ID NO: 240393 - DNA, 25 bp, Rattus norvegicus
catgtagtctagtatgctgcactta

SEQ ID NO: 240394 - DNA, 25 bp, Rattus norvegicus
catgtagtgtttcttcttctcaaga

SEQ ID NO: 240395 - DNA, 25 bp, Rattus norvegicus
catgtagtgtttgttcttctcaaga

SEQ ID NO: 240396 - DNA, 25 bp, Rattus norvegicus
catgtagttcagctggttgtaggtc

SEQ ID NO: 240397 - DNA, 25 bp, Rattus norvegicus
catgtagttcaggtggttgtaggtc

SEQ ID NO: 240398 - DNA, 25 bp, Rattus norvegicus
catgtagttgttattgatgccccaa

SEQ ID NO: 240399 - DNA, 25 bp, Rattus norvegicus
catgtagttgtttttgatgccccaa

SEQ ID NO: 240400 - DNA, 25 bp, Rattus norvegicus
catgtataattgagcacccctggga

SEQ ID NO: 240401 - DNA, 25 bp, Rattus norvegicus
catgtataattgtgcacccctggga

SEQ ID NO: 240402 - DNA, 25 bp, Rattus norvegicus
catgtatacatacacgtgtacagta

SEQ ID NO: 240403 - DNA, 25 bp, Rattus norvegicus
catgtatacatagacgtgtacagta

SEQ ID NO: 240404 - DNA, 25 bp, Rattus norvegicus
catgtatacccacgtgccagaagag

SEQ ID NO: 240405 - DNA, 25 bp, Rattus norvegicus
catgtatacccaggtgccagaagag

SEQ ID NO: 240406 - DNA, 25 bp, Rattus norvegicus
catgtatatgccaggtgccgtggag

SEQ ID NO: 240407 - DNA, 25 bp, Rattus norvegicus
catgtatatgcctggtgccgtggag

SEQ ID NO: 240408 - DNA, 25 bp, Rattus norvegicus
catgtatccctgcttaaaagacttt

SEQ ID NO: 240409 - DNA, 25 bp, Rattus norvegicus
catgtatccctggttaaaagacttt

SEQ ID NO: 240410 - DNA, 25 bp, Rattus norvegicus
catgtatctgtcagtagtgcttcaa

SEQ ID NO: 240411 - DNA, 25 bp, Rattus norvegicus
catgtatctgtctgtagtgcttcaa

SEQ ID NO: 240412 - DNA, 25 bp, Rattus norvegicus
catgtatgctctccgggaacggcgt

SEQ ID NO: 240413 - DNA, 25 bp, Rattus norvegicus
catgtatgctctgcgggaacggcgt

SEQ ID NO: 240414 - DNA, 25 bp, Rattus norvegicus
catgtatgctttcgagatgctctat

SEQ ID NO: 240415 - DNA, 25 bp, Rattus norvegicus
catgtatgctttggagatgctctat

SEQ ID NO: 240416 - DNA, 25 bp, Rattus norvegicus
catgtatggctcaggattgtccgct

SEQ ID NO: 240417 - DNA, 25 bp, Rattus norvegicus
catgtatggctctggattgtccgct

SEQ ID NO: 240418 - DNA, 25 bp, Rattus norvegicus
catgtatgtatgagggcaggaacac

SEQ ID NO: 240419 - DNA, 25 bp, Rattus norvegicus
catgtatgtatgtgggcaggaacac

SEQ ID NO: 240420 - DNA, 25 bp, Rattus norvegicus
catgtattcaatagtaaacttgtca

SEQ ID NO: 240421 - DNA, 25 bp, Rattus norvegicus
catgtattcaattgtaaacttgtca

SEQ ID NO: 240422 - DNA, 25 bp, Rattus norvegicus
catgtattctgcaccatttggctaa

SEQ ID NO: 240423 - DNA, 25 bp, Rattus norvegicus
catgtattctgctccatttggctaa

SEQ ID NO: 240424 - DNA, 25 bp, Rattus norvegicus
catgtattggccctgctaaaataga

SEQ ID NO: 240425 - DNA, 25 bp, Rattus norvegicus
catgtattggccgtgctaaaataga

SEQ ID NO: 240426 - DNA, 25 bp, Rattus norvegicus
catgtatttaaacagttggttccaa

SEQ ID NO: 240427 - DNA, 25 bp, Rattus norvegicus
catgtatttaaagagttggttccaa

SEQ ID NO: 240428 - DNA, 25 bp, Rattus norvegicus
catgtatttcgcatatgtgagttcc

SEQ ID NO: 240429 - DNA, 25 bp, Rattus norvegicus
catgtatttcgcttatgtgagttcc

SEQ ID NO: 240430 - DNA, 25 bp, Rattus norvegicus
catgtcaaatatctactgtgcccaa

SEQ ID NO: 240431 - DNA, 25 bp, Rattus norvegicus
catgtcaaatatgtactgtgcccaa

SEQ ID NO: 240432 - DNA, 25 bp, Rattus norvegicus
catgtcaaatgtcctggtttcagat

SEQ ID NO: 240433 - DNA, 25 bp, Rattus norvegicus
catgtcaaatgtgctggtttcagat

SEQ ID NO: 240434 - DNA, 25 bp, Rattus norvegicus
catgtcaccaagagcatatgctgtg

SEQ ID NO: 240435 - DNA, 25 bp, Rattus norvegicus
catgtcaccaagtgcatatgctgtg

SEQ ID NO: 240436 - DNA, 25 bp, Rattus norvegicus
catgtcacgcggactcgttcattct

SEQ ID NO: 240437 - DNA, 25 bp, Rattus norvegicus
catgtcacgcggtctcgttcattct

SEQ ID NO: 240438 - DNA, 25 bp, Rattus norvegicus
catgtcacgtttactgtttcaataa

SEQ ID NO: 240439 - DNA, 25 bp, Rattus norvegicus
catgtcacgttttctgtttcaataa

SEQ ID NO: 240440 - DNA, 25 bp, Rattus norvegicus
catgtcactcttaatgctgatctgt

SEQ ID NO: 240441 - DNA, 25 bp, Rattus norvegicus
catgtcactctttatgctgatctgt

SEQ ID NO: 240442 - DNA, 25 bp, Rattus norvegicus
catgtcagagcaatgggcaggcacc

SEQ ID NO: 240443 - DNA, 25 bp, Rattus norvegicus
catgtcagagcattgggcaggcacc

SEQ ID NO: 240444 - DNA, 25 bp, Rattus norvegicus
catgtcagccaaaccattcacattg

SEQ ID NO: 240445 - DNA, 25 bp, Rattus norvegicus
catgtcagccaatccattcacattg

SEQ ID NO: 240446 - DNA, 25 bp, Rattus norvegicus
catgtcaggcgtaaaactgtcagtc

SEQ ID NO: 240447 - DNA, 25 bp, Rattus norvegicus
catgtcaggcgttaaactgtcagtc

SEQ ID NO: 240448 - DNA, 25 bp, Rattus norvegicus
catgtcaggcttcctgctgtaggta

SEQ ID NO: 240449 - DNA, 25 bp, Rattus norvegicus
catgtcaggcttgctgctgtaggta

SEQ ID NO: 240450 - DNA, 25 bp, Rattus norvegicus
catgtcagggtacattatgaggccc

SEQ ID NO: 240451 - DNA, 25 bp, Rattus norvegicus
catgtcagggtagattatgaggccc

SEQ ID NO: 240452 - DNA, 25 bp, Rattus norvegicus
catgtcagtacacggctttcagacc

SEQ ID NO: 240453 - DNA, 25 bp, Rattus norvegicus
catgtcagtacagggctttcagacc

SEQ ID NO: 240454 - DNA, 25 bp, Rattus norvegicus
catgtcatatgcatgcctagtgcca

SEQ ID NO: 240455 - DNA, 25 bp, Rattus norvegicus
catgtcatatgcttgcctagtgcca

SEQ ID NO: 240456 - DNA, 25 bp, Rattus norvegicus
catgtcatccagactcatgacttca

SEQ ID NO: 240457 - DNA, 25 bp, Rattus norvegicus
catgtcatccagtctcatgacttca

SEQ ID NO: 240458 - DNA, 25 bp, Rattus norvegicus
catgtcatctttccctactgacaca

SEQ ID NO: 240459 - DNA, 25 bp, Rattus norvegicus
catgtcatctttgcctactgacaca

SEQ ID NO: 240460 - DNA, 25 bp, Rattus norvegicus
catgtccaaggaatggccgcttgtc

SEQ ID NO: 240461 - DNA, 25 bp, Rattus norvegicus
catgtccaaggattggccgcttgtc

SEQ ID NO: 240462 - DNA, 25 bp, Rattus norvegicus
catgtccacctcatgtctaagaatg

SEQ ID NO: 240463 - DNA, 25 bp, Rattus norvegicus
catgtccacctcttgtctaagaatg

SEQ ID NO: 240464 - DNA, 25 bp, Rattus norvegicus
catgtcccagacaagccaaggcttt

SEQ ID NO: 240465 - DNA, 25 bp, Rattus norvegicus
catgtcccagactagccaaggcttt

SEQ ID NO: 240466 - DNA, 25 bp, Rattus norvegicus
catgtcccagcccatgatgaacagt

SEQ ID NO: 240467 - DNA, 25 bp, Rattus norvegicus
catgtcccagccgatgatgaacagt

SEQ ID NO: 240468 - DNA, 25 bp, Rattus norvegicus
catgtcccaggaaaggtagttacta

SEQ ID NO: 240469 - DNA, 25 bp, Rattus norvegicus
catgtcccaggataggtagttacta

SEQ ID NO: 240470 - DNA, 25 bp, Rattus norvegicus
catgtccccatgagattctatttaa

SEQ ID NO: 240471 - DNA, 25 bp, Rattus norvegicus
catgtccccatgtgattctatttaa

SEQ ID NO: 240472 - DNA, 25 bp, Rattus norvegicus
catgtcccctaaatattctttgtta

SEQ ID NO: 240473 - DNA, 25 bp, Rattus norvegicus
catgtcccctaattattctttgtta

SEQ ID NO: 240474 - DNA, 25 bp, Rattus norvegicus
catgtcccctgacgaattcacagaa

SEQ ID NO: 240475 - DNA, 25 bp, Rattus norvegicus
catgtcccctgaggaattcacagaa

SEQ ID NO: 240476 - DNA, 25 bp, Rattus norvegicus
catgtcccgagactgttaacagctt

SEQ ID NO: 240477 - DNA, 25 bp, Rattus norvegicus
catgtcccgagagtgttaacagctt

SEQ ID NO: 240478 - DNA, 25 bp, Rattus norvegicus
catgtcccgtaaaacaaccagcaca

SEQ ID NO: 240479 - DNA, 25 bp, Rattus norvegicus
catgtcccgtaatacaaccagcaca

SEQ ID NO: 240480 - DNA, 25 bp, Rattus norvegicus
catgtccgagctctaaaccagggtg

SEQ ID NO: 240481 - DNA, 25 bp, Rattus norvegicus
catgtccgagctgtaaaccagggtg

SEQ ID NO: 240482 - DNA, 25 bp, Rattus norvegicus
catgtccgctctctacagaaggagg

SEQ ID NO: 240483 - DNA, 25 bp, Rattus norvegicus
catgtccgctctgtacagaaggagg

SEQ ID NO: 240484 - DNA, 25 bp, Rattus norvegicus
catgtccgtgtgagagattgtgcag

SEQ ID NO: 240485 - DNA, 25 bp, Rattus norvegicus
catgtccgtgtgtgagattgtgcag

SEQ ID NO: 240486 - DNA, 25 bp, Rattus norvegicus
catgtcctgcctaagtgttcagggt

SEQ ID NO: 240487 - DNA, 25 bp, Rattus norvegicus
catgtcctgccttagtgttcagggt

SEQ ID NO: 240488 - DNA, 25 bp, Rattus norvegicus
catgtccttcccatcccataattgt

SEQ ID NO: 240489 - DNA, 25 bp, Rattus norvegicus
catgtccttcccttcccataattgt

SEQ ID NO: 240490 - DNA, 25 bp, Rattus norvegicus
catgtccttgctcgcggctaacaac

SEQ ID NO: 240491 - DNA, 25 bp, Rattus norvegicus
catgtccttgctggcggctaacaac

SEQ ID NO: 240492 - DNA, 25 bp, Rattus norvegicus
catgtcctttttcacaccaaggcaa

SEQ ID NO: 240493 - DNA, 25 bp, Rattus norvegicus
catgtcctttttgacaccaaggcaa

SEQ ID NO: 240494 - DNA, 25 bp, Rattus norvegicus
catgtcgtagacacaatcgtctatt

SEQ ID NO: 240495 - DNA, 25 bp, Rattus norvegicus
catgtcgtagactcaatcgtctatt

SEQ ID NO: 240496 - DNA, 25 bp, Rattus norvegicus
catgtctaaagtacaggcccagtgt

SEQ ID NO: 240497 - DNA, 25 bp, Rattus norvegicus
catgtctaaagttcaggcccagtgt

SEQ ID NO: 240498 - DNA, 25 bp, Rattus norvegicus
catgtctagacacctgtattcagcc

SEQ ID NO: 240499 - DNA, 25 bp, Rattus norvegicus
catgtctagacagctgtattcagcc

SEQ ID NO: 240500 - DNA, 25 bp, Rattus norvegicus
catgtctagtgtcaagggcctggca

SEQ ID NO: 240501 - DNA, 25 bp, Rattus norvegicus
catgtctagtgtgaagggcctggca

SEQ ID NO: 240502 - DNA, 25 bp, Rattus norvegicus
catgtctagttcatactgcagccaa

SEQ ID NO: 240503 - DNA, 25 bp, Rattus norvegicus
catgtctagttcttactgcagccaa

SEQ ID NO: 240504 - DNA, 25 bp, Rattus norvegicus
catgtctataatcacagcattcggg

SEQ ID NO: 240505 - DNA, 25 bp, Rattus norvegicus
catgtctataatgacagcattcggg

SEQ ID NO: 240506 - DNA, 25 bp, Rattus norvegicus
catgtctcagacagtgtagggcttt

SEQ ID NO: 240507 - DNA, 25 bp, Rattus norvegicus
catgtctcagactgtgtagggcttt

SEQ ID NO: 240508 - DNA, 25 bp, Rattus norvegicus
catgtctcaggccagaaactttcac

SEQ ID NO: 240509 - DNA, 25 bp, Rattus norvegicus
catgtctcaggcgagaaactttcac

SEQ ID NO: 240510 - DNA, 25 bp, Rattus norvegicus
catgtctcatggatttcattgggta

SEQ ID NO: 240511 - DNA, 25 bp, Rattus norvegicus
catgtctcatggttttcattgggta

SEQ ID NO: 240512 - DNA, 25 bp, Rattus norvegicus
catgtctccaccatgctggaaaggc

SEQ ID NO: 240513 - DNA, 25 bp, Rattus norvegicus
catgtctccaccttgctggaaaggc

SEQ ID NO: 240514 - DNA, 25 bp, Rattus norvegicus
catgtctcctgtcttgtgggacgga

SEQ ID NO: 240515 - DNA, 25 bp, Rattus norvegicus
catgtctcctgtgttgtgggacgga

SEQ ID NO: 240516 - DNA, 25 bp, Rattus norvegicus
catgtctcctttacctgcagaagaa

SEQ ID NO: 240517 - DNA, 25 bp, Rattus norvegicus
catgtctccttttcctgcagaagaa

SEQ ID NO: 240518 - DNA, 25 bp, Rattus norvegicus
catgtctcgggtccttcagggaaaa

SEQ ID NO: 240519 - DNA, 25 bp, Rattus norvegicus
catgtctcgggtgcttcagggaaaa

SEQ ID NO: 240520 - DNA, 25 bp, Rattus norvegicus
catgtctctactctggcgggttgga

SEQ ID NO: 240521 - DNA, 25 bp, Rattus norvegicus
catgtctctactgtggcgggttgga

SEQ ID NO: 240522 - DNA, 25 bp, Rattus norvegicus
catgtctctgcaaatactgttttac

SEQ ID NO: 240523 - DNA, 25 bp, Rattus norvegicus
catgtctctgcatatactgttttac

SEQ ID NO: 240524 - DNA, 25 bp, Rattus norvegicus
catgtctgaactctgtcctttttac

SEQ ID NO: 240525 - DNA, 25 bp, Rattus norvegicus
catgtctgaactgtgtcctttttac

SEQ ID NO: 240526 - DNA, 25 bp, Rattus norvegicus
catgtctgaagtagtctgtctgcaa

SEQ ID NO: 240527 - DNA, 25 bp, Rattus norvegicus
catgtctgaagttgtctgtctgcaa

SEQ ID NO: 240528 - DNA, 25 bp, Rattus norvegicus
catgtctgagccacctgaagaaaag

SEQ ID NO: 240529 - DNA, 25 bp, Rattus norvegicus
catgtctgagcctcctgaagaaaag

SEQ ID NO: 240530 - DNA, 25 bp, Rattus norvegicus
catgtctgcaataagttctgggtta

SEQ ID NO: 240531 - DNA, 25 bp, Rattus norvegicus
catgtctgcaattagttctgggtta

SEQ ID NO: 240532 - DNA, 25 bp, Rattus norvegicus
catgtctgcatgctcttcgaagtac

SEQ ID NO: 240533 - DNA, 25 bp, Rattus norvegicus
catgtctgcatggtcttcgaagtac

SEQ ID NO: 240534 - DNA, 25 bp, Rattus norvegicus
catgtctgctatagataacttctta

SEQ ID NO: 240535 - DNA, 25 bp, Rattus norvegicus
catgtctgctattgataacttctta

SEQ ID NO: 240536 - DNA, 25 bp, Rattus norvegicus
catgtctgcttcattttatatttgt

SEQ ID NO: 240537 - DNA, 25 bp, Rattus norvegicus
catgtctgcttctttttatatttgt

SEQ ID NO: 240538 - DNA, 25 bp, Rattus norvegicus
catgtctggcctctgattcaagtga

SEQ ID NO: 240539 - DNA, 25 bp, Rattus norvegicus
catgtctggcctgtgattcaagtga

SEQ ID NO: 240540 - DNA, 25 bp, Rattus norvegicus
catgtctgtttgagtgtctcttaaa

SEQ ID NO: 240541 - DNA, 25 bp, Rattus norvegicus
catgtctgtttgtgtgtctcttaaa

SEQ ID NO: 240542 - DNA, 25 bp, Rattus norvegicus
catgtcttaatacttttctaccctt

SEQ ID NO: 240543 - DNA, 25 bp, Rattus norvegicus
catgtcttaatagttttctaccctt

SEQ ID NO: 240544 - DNA, 25 bp, Rattus norvegicus
catgtcttcaacacagttcagtcca

SEQ ID NO: 240545 - DNA, 25 bp, Rattus norvegicus
catgtcttcaactcagttcagtcca

SEQ ID NO: 240546 - DNA, 25 bp, Rattus norvegicus
catgtcttctttaccagagagtgga

SEQ ID NO: 240547 - DNA, 25 bp, Rattus norvegicus
catgtcttcttttccagagagtgga

SEQ ID NO: 240548 - DNA, 25 bp, Rattus norvegicus
catgtctttattcttgtgcggtgat

SEQ ID NO: 240549 - DNA, 25 bp, Rattus norvegicus
catgtctttattgttgtgcggtgat

SEQ ID NO: 240550 - DNA, 25 bp, Rattus norvegicus
catgtgaaatctctgcctatgctgc

SEQ ID NO: 240551 - DNA, 25 bp, Rattus norvegicus
catgtgaaatctgtgcctatgctgc

SEQ ID NO: 240552 - DNA, 25 bp, Rattus norvegicus
catgtgaacacgaccattgctggtt

SEQ ID NO: 240553 - DNA, 25 bp, Rattus norvegicus
catgtgaacacgtccattgctggtt

SEQ ID NO: 240554 - DNA, 25 bp, Rattus norvegicus
catgtgaacggacgctgcacagccc

SEQ ID NO: 240555 - DNA, 25 bp, Rattus norvegicus
catgtgaacggaggctgcacagccc

SEQ ID NO: 240556 - DNA, 25 bp, Rattus norvegicus
catgtgaagacccaatatccagccc

SEQ ID NO: 240557 - DNA, 25 bp, Rattus norvegicus
catgtgaagaccgaatatccagccc

SEQ ID NO: 240558 - DNA, 25 bp, Rattus norvegicus
catgtgaatcacatctgtctgttta

SEQ ID NO: 240559 - DNA, 25 bp, Rattus norvegicus
catgtgaatcacttctgtctgttta

SEQ ID NO: 240560 - DNA, 25 bp, Rattus norvegicus
catgtgaatttaagcctactactgc

SEQ ID NO: 240561 - DNA, 25 bp, Rattus norvegicus
catgtgaatttatgcctactactgc

SEQ ID NO: 240562 - DNA, 25 bp, Rattus norvegicus
catgtgacatggaggcatcctgagc

SEQ ID NO: 240563 - DNA, 25 bp, Rattus norvegicus
catgtgacatggtggcatcctgagc

SEQ ID NO: 240564 - DNA, 25 bp, Rattus norvegicus
catgtgaccggcaagagctttggga

SEQ ID NO: 240565 - DNA, 25 bp, Rattus norvegicus
catgtgaccggctagagctttggga

SEQ ID NO: 240566 - DNA, 25 bp, Rattus norvegicus
catgtgactcctagcaccatataaa

SEQ ID NO: 240567 - DNA, 25 bp, Rattus norvegicus
catgtgactccttgcaccatataaa

SEQ ID NO: 240568 - DNA, 25 bp, Rattus norvegicus
catgtgactctacggatgccgatct

SEQ ID NO: 240569 - DNA, 25 bp, Rattus norvegicus
catgtgactctagggatgccgatct

SEQ ID NO: 240570 - DNA, 25 bp, Rattus norvegicus
catgtgatcctactgaacctggcta

SEQ ID NO: 240571 - DNA, 25 bp, Rattus norvegicus
catgtgatcctagtgaacctggcta

SEQ ID NO: 240572 - DNA, 25 bp, Rattus norvegicus
catgtgattatgcatttggaaagat

SEQ ID NO: 240573 - DNA, 25 bp, Rattus norvegicus
catgtgattatggatttggaaagat

SEQ ID NO: 240574 - DNA, 25 bp, Rattus norvegicus
catgtgattcggagatggtgcctaa

SEQ ID NO: 240575 - DNA, 25 bp, Rattus norvegicus
catgtgattcggtgatggtgcctaa

SEQ ID NO: 240576 - DNA, 25 bp, Rattus norvegicus
catgtgattgttcaagtctgtgccc

SEQ ID NO: 240577 - DNA, 25 bp, Rattus norvegicus
catgtgattgttgaagtctgtgccc

SEQ ID NO: 240578 - DNA, 25 bp, Rattus norvegicus
catgtgcaccttcgacttctatgag

SEQ ID NO: 240579 - DNA, 25 bp, Rattus norvegicus
catgtgcaccttggacttctatgag

SEQ ID NO: 240580 - DNA, 25 bp, Rattus norvegicus
catgtgcactagcttccagacgaag

SEQ ID NO: 240581 - DNA, 25 bp, Rattus norvegicus
catgtgcactaggttccagacgaag

SEQ ID NO: 240582 - DNA, 25 bp, Rattus norvegicus
catgtgcagtgtcctcaagaggcaa

SEQ ID NO: 240583 - DNA, 25 bp, Rattus norvegicus
catgtgcagtgtgctcaagaggcaa

SEQ ID NO: 240584 - DNA, 25 bp, Rattus norvegicus
catgtgcatgccaggtagtactgag

SEQ ID NO: 240585 - DNA, 25 bp, Rattus norvegicus
catgtgcatgcctggtagtactgag

SEQ ID NO: 240586 - DNA, 25 bp, Rattus norvegicus
catgtgcatgtaccagagtccaacc

SEQ ID NO: 240587 - DNA, 25 bp, Rattus norvegicus
catgtgcatgtagcagagtccaacc

SEQ ID NO: 240588 - DNA, 25 bp, Rattus norvegicus
catgtgcatgtgcttgcgtgtaact

SEQ ID NO: 240589 - DNA, 25 bp, Rattus norvegicus
catgtgcatgtggttgcgtgtaact

SEQ ID NO: 240590 - DNA, 25 bp, Rattus norvegicus
catgtgccacttactatggaagtca

SEQ ID NO: 240591 - DNA, 25 bp, Rattus norvegicus
catgtgccactttctatggaagtca

SEQ ID NO: 240592 - DNA, 25 bp, Rattus norvegicus
catgtgccattcagatccaaatctt

SEQ ID NO: 240593 - DNA, 25 bp, Rattus norvegicus
catgtgccattctgatccaaatctt

SEQ ID NO: 240594 - DNA, 25 bp, Rattus norvegicus
catgtgcccatccttgccatggaga

SEQ ID NO: 240595 - DNA, 25 bp, Rattus norvegicus
catgtgcccatcgttgccatggaga

SEQ ID NO: 240596 - DNA, 25 bp, Rattus norvegicus
catgtgccctctcggaattgggctc

SEQ ID NO: 240597 - DNA, 25 bp, Rattus norvegicus
catgtgccctctgggaattgggctc

SEQ ID NO: 240598 - DNA, 25 bp, Rattus norvegicus
catgtgccgcgtctaagtagtccca

SEQ ID NO: 240599 - DNA, 25 bp, Rattus norvegicus
catgtgccgcgtgtaagtagtccca

SEQ ID NO: 240600 - DNA, 25 bp, Rattus norvegicus
catgtgcctgcaactctttaattag

SEQ ID NO: 240601 - DNA, 25 bp, Rattus norvegicus
catgtgcctgcatctctttaattag

SEQ ID NO: 240602 - DNA, 25 bp, Rattus norvegicus
catgtgcgagtgactggagtacagt

SEQ ID NO: 240603 - DNA, 25 bp, Rattus norvegicus
catgtgcgagtgtctggagtacagt

SEQ ID NO: 240604 - DNA, 25 bp, Rattus norvegicus
catgtgcgtcttaggttacctgatt

SEQ ID NO: 240605 - DNA, 25 bp, Rattus norvegicus
catgtgcgtctttggttacctgatt

SEQ ID NO: 240606 - DNA, 25 bp, Rattus norvegicus
catgtgctacacaaagcgtctgctc

SEQ ID NO: 240607 - DNA, 25 bp, Rattus norvegicus
catgtgctacactaagcgtctgctc

SEQ ID NO: 240608 - DNA, 25 bp, Rattus norvegicus
catgtgctagaacgcagctgggtcc

SEQ ID NO: 240609 - DNA, 25 bp, Rattus norvegicus
catgtgctagaaggcagctgggtcc

SEQ ID NO: 240610 - DNA, 25 bp, Rattus norvegicus
catgtgctcagtcttcagtggtgta

SEQ ID NO: 240611 - DNA, 25 bp, Rattus norvegicus
catgtgctcagtgttcagtggtgta

SEQ ID NO: 240612 - DNA, 25 bp, Rattus norvegicus
catgtgctctgcatcaggagggact

SEQ ID NO: 240613 - DNA, 25 bp, Rattus norvegicus
catgtgctctgcttcaggagggact

SEQ ID NO: 240614 - DNA, 25 bp, Rattus norvegicus
catgtgctgcttcaagagctcctat

SEQ ID NO: 240615 - DNA, 25 bp, Rattus norvegicus
catgtgctgcttgaagagctcctat

SEQ ID NO: 240616 - DNA, 25 bp, Rattus norvegicus
catgtgctggagaggctccccagaa

SEQ ID NO: 240617 - DNA, 25 bp, Rattus norvegicus
catgtgctggagtggctccccagaa

SEQ ID NO: 240618 - DNA, 25 bp, Rattus norvegicus
catgtgcttgctccagaggtggctc

SEQ ID NO: 240619 - DNA, 25 bp, Rattus norvegicus
catgtgcttgctgcagaggtggctc

SEQ ID NO: 240620 - DNA, 25 bp, Rattus norvegicus
catgtggaagccatgtctgggttta

SEQ ID NO: 240621 - DNA, 25 bp, Rattus norvegicus
catgtggaagccttgtctgggttta

SEQ ID NO: 240622 - DNA, 25 bp, Rattus norvegicus
catgtggacaaaaatctccccggta

SEQ ID NO: 240623 - DNA, 25 bp, Rattus norvegicus
catgtggacaaatatctccccggta

SEQ ID NO: 240624 - DNA, 25 bp, Rattus norvegicus
catgtggacaacagcagaagtgtgt

SEQ ID NO: 240625 - DNA, 25 bp, Rattus norvegicus
catgtggacaactgcagaagtgtgt

SEQ ID NO: 240626 - DNA, 25 bp, Rattus norvegicus
catgtggacccaaggagtgcccgat

SEQ ID NO: 240627 - DNA, 25 bp, Rattus norvegicus
catgtggacccatggagtgcccgat

SEQ ID NO: 240628 - DNA, 25 bp, Rattus norvegicus
catgtggactcacgtttttaccaaa

SEQ ID NO: 240629 - DNA, 25 bp, Rattus norvegicus
catgtggactcaggtttttaccaaa

SEQ ID NO: 240630 - DNA, 25 bp, Rattus norvegicus
catgtggagtagagcgacctgttta

SEQ ID NO: 240631 - DNA, 25 bp, Rattus norvegicus
catgtggagtagtgcgacctgttta

SEQ ID NO: 240632 - DNA, 25 bp, Rattus norvegicus
catgtggccatgaggttgaccagga

SEQ ID NO: 240633 - DNA, 25 bp, Rattus norvegicus
catgtggccatgtggttgaccagga

SEQ ID NO: 240634 - DNA, 25 bp, Rattus norvegicus
catgtggccgaacgctcttggagct

SEQ ID NO: 240635 - DNA, 25 bp, Rattus norvegicus
catgtggccgaaggctcttggagct

SEQ ID NO: 240636 - DNA, 25 bp, Rattus norvegicus
catgtggctgccctggatttgaact

SEQ ID NO: 240637 - DNA, 25 bp, Rattus norvegicus
catgtggctgccgtggatttgaact

SEQ ID NO: 240638 - DNA, 25 bp, Rattus norvegicus
catgtggcttgcacagtgtttactt

SEQ ID NO: 240639 - DNA, 25 bp, Rattus norvegicus
catgtggcttgctcagtgtttactt

SEQ ID NO: 240640 - DNA, 25 bp, Rattus norvegicus
catgtgggcagcctgaggatcttct

SEQ ID NO: 240641 - DNA, 25 bp, Rattus norvegicus
catgtgggcagcgtgaggatcttct

SEQ ID NO: 240642 - DNA, 25 bp, Rattus norvegicus
catgtgggcgatcctttgggatctt

SEQ ID NO: 240643 - DNA, 25 bp, Rattus norvegicus
catgtgggcgatgctttgggatctt

SEQ ID NO: 240644 - DNA, 25 bp, Rattus norvegicus
catgtgggtaaaagcctgggaaact

SEQ ID NO: 240645 - DNA, 25 bp, Rattus norvegicus
catgtgggtaaatgcctgggaaact

SEQ ID NO: 240646 - DNA, 25 bp, Rattus norvegicus
catgtgggtatcactgctaggaaaa

SEQ ID NO: 240647 - DNA, 25 bp, Rattus norvegicus
catgtgggtatctctgctaggaaaa

SEQ ID NO: 240648 - DNA, 25 bp, Rattus norvegicus
catgtgggtcttcagggtttgcttc

SEQ ID NO: 240649 - DNA, 25 bp, Rattus norvegicus
catgtgggtcttgagggtttgcttc

SEQ ID NO: 240650 - DNA, 25 bp, Rattus norvegicus
catgtggtgaataactgtcctcctc

SEQ ID NO: 240651 - DNA, 25 bp, Rattus norvegicus
catgtggtgaattactgtcctcctc

SEQ ID NO: 240652 - DNA, 25 bp, Rattus norvegicus
catgtggtttcaacgcaggtgcaaa

SEQ ID NO: 240653 - DNA, 25 bp, Rattus norvegicus
catgtggtttcatcgcaggtgcaaa

SEQ ID NO: 240654 - DNA, 25 bp, Rattus norvegicus
catgtgtaaattccctgtttgctgt

SEQ ID NO: 240655 - DNA, 25 bp, Rattus norvegicus
catgtgtaaattgcctgtttgctgt

SEQ ID NO: 240656 - DNA, 25 bp, Rattus norvegicus
catgtgtaactccaggcttcctgaa

SEQ ID NO: 240657 - DNA, 25 bp, Rattus norvegicus
catgtgtaactcgaggcttcctgaa

SEQ ID NO: 240658 - DNA, 25 bp, Rattus norvegicus
catgtgtaagatctgctgtaaccca

SEQ ID NO: 240659 - DNA, 25 bp, Rattus norvegicus
catgtgtaagatgtgctgtaaccca

SEQ ID NO: 240660 - DNA, 25 bp, Rattus norvegicus
catgtgtaccccaagaaatagatgg

SEQ ID NO: 240661 - DNA, 25 bp, Rattus norvegicus
catgtgtacccctagaaatagatgg

SEQ ID NO: 240662 - DNA, 25 bp, Rattus norvegicus
catgtgtacctaagtgtgtttgata

SEQ ID NO: 240663 - DNA, 25 bp, Rattus norvegicus
catgtgtacctatgtgtgtttgata

SEQ ID NO: 240664 - DNA, 25 bp, Rattus norvegicus
catgtgtacctgagtcttagtcttc

SEQ ID NO: 240665 - DNA, 25 bp, Rattus norvegicus
catgtgtacctgtgtcttagtcttc

SEQ ID NO: 240666 - DNA, 25 bp, Rattus norvegicus
catgtgtatccactgttgcctagtt

SEQ ID NO: 240667 - DNA, 25 bp, Rattus norvegicus
catgtgtatccagtgttgcctagtt

SEQ ID NO: 240668 - DNA, 25 bp, Rattus norvegicus
catgtgtattgaccagatagttttt

SEQ ID NO: 240669 - DNA, 25 bp, Rattus norvegicus
catgtgtattgagcagatagttttt

SEQ ID NO: 240670 - DNA, 25 bp, Rattus norvegicus
catgtgtcacacatggtttttcttt

SEQ ID NO: 240671 - DNA, 25 bp, Rattus norvegicus
catgtgtcacacttggtttttcttt

SEQ ID NO: 240672 - DNA, 25 bp, Rattus norvegicus
catgtgtccttcagagtcgctgtag

SEQ ID NO: 240673 - DNA, 25 bp, Rattus norvegicus
catgtgtccttctgagtcgctgtag

SEQ ID NO: 240674 - DNA, 25 bp, Rattus norvegicus
catgtgtgcccacgctggaactcag

SEQ ID NO: 240675 - DNA, 25 bp, Rattus norvegicus
catgtgtgcccaggctggaactcag

SEQ ID NO: 240676 - DNA, 25 bp, Rattus norvegicus
catgtgtgcgtgaagctgtgtctta

SEQ ID NO: 240677 - DNA, 25 bp, Rattus norvegicus
catgtgtgcgtgtagctgtgtctta

SEQ ID NO: 240678 - DNA, 25 bp, Rattus norvegicus
catgtgtggtcacggtcatggtctt

SEQ ID NO: 240679 - DNA, 25 bp, Rattus norvegicus
catgtgtggtcagggtcatggtctt

SEQ ID NO: 240680 - DNA, 25 bp, Rattus norvegicus
catgtgtgtcttaatgcaatcagaa

SEQ ID NO: 240681 - DNA, 25 bp, Rattus norvegicus
catgtgtgtctttatgcaatcagaa

SEQ ID NO: 240682 - DNA, 25 bp, Rattus norvegicus
catgtgtgtgccatgtgcttgagga

SEQ ID NO: 240683 - DNA, 25 bp, Rattus norvegicus
catgtgtgtgccttgtgcttgagga

SEQ ID NO: 240684 - DNA, 25 bp, Rattus norvegicus
catgtgtgtggtaaatctccattta

SEQ ID NO: 240685 - DNA, 25 bp, Rattus norvegicus
catgtgtgtggttaatctccattta

SEQ ID NO: 240686 - DNA, 25 bp, Rattus norvegicus
catgtgtgttgaatgacataaggac

SEQ ID NO: 240687 - DNA, 25 bp, Rattus norvegicus
catgtgtgttgattgacataaggac

SEQ ID NO: 240688 - DNA, 25 bp, Rattus norvegicus
catgtgttagccctcttgccctttc

SEQ ID NO: 240689 - DNA, 25 bp, Rattus norvegicus
catgtgttagccgtcttgccctttc

SEQ ID NO: 240690 - DNA, 25 bp, Rattus norvegicus
catgtgttccagcatgagctgcttt

SEQ ID NO: 240691 - DNA, 25 bp, Rattus norvegicus
catgtgttccaggatgagctgcttt

SEQ ID NO: 240692 - DNA, 25 bp, Rattus norvegicus
catgtgttgtctcattggcttgtag

SEQ ID NO: 240693 - DNA, 25 bp, Rattus norvegicus
catgtgttgtctccttttcttacga

SEQ ID NO: 240694 - DNA, 25 bp, Rattus norvegicus
catgtgttgtctgattggcttgtag

SEQ ID NO: 240695 - DNA, 25 bp, Rattus norvegicus
catgtgttgtctgcttttcttacga

SEQ ID NO: 240696 - DNA, 25 bp, Rattus norvegicus
catgtgttgtgtctcatgggatgtc

SEQ ID NO: 240697 - DNA, 25 bp, Rattus norvegicus
catgtgttgtgtgtcatgggatgtc

SEQ ID NO: 240698 - DNA, 25 bp, Rattus norvegicus
catgtgtttgtcctgtctactgtaa

SEQ ID NO: 240699 - DNA, 25 bp, Rattus norvegicus
catgtgtttgtcgtgtctactgtaa

SEQ ID NO: 240700 - DNA, 25 bp, Rattus norvegicus
catgtgtttgtgacgttcatctagt

SEQ ID NO: 240701 - DNA, 25 bp, Rattus norvegicus
catgtgtttgtgtcgttcatctagt

SEQ ID NO: 240702 - DNA, 25 bp, Rattus norvegicus
catgtgttttgaacaaatccacccc

SEQ ID NO: 240703 - DNA, 25 bp, Rattus norvegicus
catgtgttttgatcaaatccacccc

SEQ ID NO: 240704 - DNA, 25 bp, Rattus norvegicus
catgttaactttcactccagctgct

SEQ ID NO: 240705 - DNA, 25 bp, Rattus norvegicus
catgttaactttgactccagctgct

SEQ ID NO: 240706 - DNA, 25 bp, Rattus norvegicus
catgttaccgccctttgaaactcac

SEQ ID NO: 240707 - DNA, 25 bp, Rattus norvegicus
catgttaccgccgtttgaaactcac

SEQ ID NO: 240708 - DNA, 25 bp, Rattus norvegicus
catgttacttttagtctgtggttgt

SEQ ID NO: 240709 - DNA, 25 bp, Rattus norvegicus
catgttactttttgtctgtggttgt

SEQ ID NO: 240710 - DNA, 25 bp, Rattus norvegicus
catgttagaagccttggaaagagtc

SEQ ID NO: 240711 - DNA, 25 bp, Rattus norvegicus
catgttagaagcgttggaaagagtc

SEQ ID NO: 240712 - DNA, 25 bp, Rattus norvegicus
catgttagccagctggcgcacttta

SEQ ID NO: 240713 - DNA, 25 bp, Rattus norvegicus
catgttagccaggtggcgcacttta

SEQ ID NO: 240714 - DNA, 25 bp, Rattus norvegicus
catgttagctgtaccagtcagtaat

SEQ ID NO: 240715 - DNA, 25 bp, Rattus norvegicus
catgttagctgttccagtcagtaat

SEQ ID NO: 240716 - DNA, 25 bp, Rattus norvegicus
catgttatacatccgggcgctgggc

SEQ ID NO: 240717 - DNA, 25 bp, Rattus norvegicus
catgttatacatgcgggcgctgggc

SEQ ID NO: 240718 - DNA, 25 bp, Rattus norvegicus
catgttatctccatgctttgctttg

SEQ ID NO: 240719 - DNA, 25 bp, Rattus norvegicus
catgttatctccttgctttgctttg

SEQ ID NO: 240720 - DNA, 25 bp, Rattus norvegicus
catgttatggttccttctgaatttt

SEQ ID NO: 240721 - DNA, 25 bp, Rattus norvegicus
catgttatggttgcttctgaatttt

SEQ ID NO: 240722 - DNA, 25 bp, Rattus norvegicus
catgttcaaggacatggctggctct

SEQ ID NO: 240723 - DNA, 25 bp, Rattus norvegicus
catgttcaaggagatggctggctct

SEQ ID NO: 240724 - DNA, 25 bp, Rattus norvegicus
catgttcagactaaccaggcaatcc

SEQ ID NO: 240725 - DNA, 25 bp, Rattus norvegicus
catgttcagacttaccaggcaatcc

SEQ ID NO: 240726 - DNA, 25 bp, Rattus norvegicus
catgttcagagccagtttccaggat

SEQ ID NO: 240727 - DNA, 25 bp, Rattus norvegicus
catgttcagagcgagtttccaggat

SEQ ID NO: 240728 - DNA, 25 bp, Rattus norvegicus
catgttcaggcaagctccgaagttg

SEQ ID NO: 240729 - DNA, 25 bp, Rattus norvegicus
catgttcaggcatgctccgaagttg

SEQ ID NO: 240730 - DNA, 25 bp, Rattus norvegicus
catgttcagttaagtgtcacagcac

SEQ ID NO: 240731 - DNA, 25 bp, Rattus norvegicus
catgttcagttatgtgtcacagcac

SEQ ID NO: 240732 - DNA, 25 bp, Rattus norvegicus
catgttcatctaaaaagcctgccaa

SEQ ID NO: 240733 - DNA, 25 bp, Rattus norvegicus
catgttcatctataaagcctgccaa

SEQ ID NO: 240734 - DNA, 25 bp, Rattus norvegicus
catgttcatgttactggcgagctaa

SEQ ID NO: 240735 - DNA, 25 bp, Rattus norvegicus
catgttcatgtttctggcgagctaa

SEQ ID NO: 240736 - DNA, 25 bp, Rattus norvegicus
catgttcattctaagatacccacta

SEQ ID NO: 240737 - DNA, 25 bp, Rattus norvegicus
catgttcattcttagatacccacta

SEQ ID NO: 240738 - DNA, 25 bp, Rattus norvegicus
catgttcccctgctactttgtaaga

SEQ ID NO: 240739 - DNA, 25 bp, Rattus norvegicus
catgttcccctggtactttgtaaga

SEQ ID NO: 240740 - DNA, 25 bp, Rattus norvegicus
catgttcccgatacctgggcagaag

SEQ ID NO: 240741 - DNA, 25 bp, Rattus norvegicus
catgttcccgattcctgggcagaag

SEQ ID NO: 240742 - DNA, 25 bp, Rattus norvegicus
catgttcctgaaaattggtcctcaa

SEQ ID NO: 240743 - DNA, 25 bp, Rattus norvegicus
catgttcctgaatattggtcctcaa

SEQ ID NO: 240744 - DNA, 25 bp, Rattus norvegicus
catgttcctggcattgtttcagtat

SEQ ID NO: 240745 - DNA, 25 bp, Rattus norvegicus
catgttcctggctttgtttcagtat

SEQ ID NO: 240746 - DNA, 25 bp, Rattus norvegicus
catgttctaaatacccatcactgtg

SEQ ID NO: 240747 - DNA, 25 bp, Rattus norvegicus
catgttctaaattcccatcactgtg

SEQ ID NO: 240748 - DNA, 25 bp, Rattus norvegicus
catgttctaagcaggtgtttgttta

SEQ ID NO: 240749 - DNA, 25 bp, Rattus norvegicus
catgttctaagctggtgtttgttta

SEQ ID NO: 240750 - DNA, 25 bp, Rattus norvegicus
catgttctcatgaaagctgtctcgg

SEQ ID NO: 240751 - DNA, 25 bp, Rattus norvegicus
catgttctcatgtaagctgtctcgg

SEQ ID NO: 240752 - DNA, 25 bp, Rattus norvegicus
catgttctccagaaatgacttcagc

SEQ ID NO: 240753 - DNA, 25 bp, Rattus norvegicus
catgttctccagtaatgacttcagc

SEQ ID NO: 240754 - DNA, 25 bp, Rattus norvegicus
catgttctccatatgttccttattt

SEQ ID NO: 240755 - DNA, 25 bp, Rattus norvegicus
catgttctccatttgttccttattt

SEQ ID NO: 240756 - DNA, 25 bp, Rattus norvegicus
catgttctgctgaggccgcatacca

SEQ ID NO: 240757 - DNA, 25 bp, Rattus norvegicus
catgttctgctgtggccgcatacca

SEQ ID NO: 240758 - DNA, 25 bp, Rattus norvegicus
catgttctgtgcagccccgaggcaa

SEQ ID NO: 240759 - DNA, 25 bp, Rattus norvegicus
catgttctgtgctgccccgaggcaa

SEQ ID NO: 240760 - DNA, 25 bp, Rattus norvegicus
catgttcttactagaattggtgtca

SEQ ID NO: 240761 - DNA, 25 bp, Rattus norvegicus
catgttcttacttgaattggtgtca

SEQ ID NO: 240762 - DNA, 25 bp, Rattus norvegicus
catgttcttctgctagtgtttggat

SEQ ID NO: 240763 - DNA, 25 bp, Rattus norvegicus
catgttcttctggtagtgtttggat

SEQ ID NO: 240764 - DNA, 25 bp, Rattus norvegicus
catgttgatcatctgcaatatttct

SEQ ID NO: 240765 - DNA, 25 bp, Rattus norvegicus
catgttgatcatgtgcaatatttct

SEQ ID NO: 240766 - DNA, 25 bp, Rattus norvegicus
catgttgatcttccctgtcctgcct

SEQ ID NO: 240767 - DNA, 25 bp, Rattus norvegicus
catgttgatcttgcctgtcctgcct

SEQ ID NO: 240768 - DNA, 25 bp, Rattus norvegicus
catgttgatttcactgcctttactc

SEQ ID NO: 240769 - DNA, 25 bp, Rattus norvegicus
catgttgatttctctgcctttactc

SEQ ID NO: 240770 - DNA, 25 bp, Rattus norvegicus
catgttgccaacaccctgtagaaag

SEQ ID NO: 240771 - DNA, 25 bp, Rattus norvegicus
catgttgccaactccctgtagaaag

SEQ ID NO: 240772 - DNA, 25 bp, Rattus norvegicus
catgttgctgtgacctgttttattt

SEQ ID NO: 240773 - DNA, 25 bp, Rattus norvegicus
catgttgctgtgtcctgttttattt

SEQ ID NO: 240774 - DNA, 25 bp, Rattus norvegicus
catgttggaatcaagtgctctttta

SEQ ID NO: 240775 - DNA, 25 bp, Rattus norvegicus
catgttggaatctagtgctctttta

SEQ ID NO: 240776 - DNA, 25 bp, Rattus norvegicus
catgttgggcaaaactactcagttc

SEQ ID NO: 240777 - DNA, 25 bp, Rattus norvegicus
catgttgggcaatactactcagttc

SEQ ID NO: 240778 - DNA, 25 bp, Rattus norvegicus
catgttgggctaaatgtctttttta

SEQ ID NO: 240779 - DNA, 25 bp, Rattus norvegicus
catgttgggctatatgtctttttta

SEQ ID NO: 240780 - DNA, 25 bp, Rattus norvegicus
catgttggtctgactagttgtacga

SEQ ID NO: 240781 - DNA, 25 bp, Rattus norvegicus
catgttggtctgtctagttgtacga

SEQ ID NO: 240782 - DNA, 25 bp, Rattus norvegicus
catgttggtgctaacagttctgtgc

SEQ ID NO: 240783 - DNA, 25 bp, Rattus norvegicus
catgttggtgcttacagttctgtgc

SEQ ID NO: 240784 - DNA, 25 bp, Rattus norvegicus
catgttggtggtcgttctgacactt

SEQ ID NO: 240785 - DNA, 25 bp, Rattus norvegicus
catgttggtggtggttctgacactt

SEQ ID NO: 240786 - DNA, 25 bp, Rattus norvegicus
catgttgtacaactgatttcctaat

SEQ ID NO: 240787 - DNA, 25 bp, Rattus norvegicus
catgttgtacaagtgatttcctaat

SEQ ID NO: 240788 - DNA, 25 bp, Rattus norvegicus
catgttgtacgcacttcacttgaaa

SEQ ID NO: 240789 - DNA, 25 bp, Rattus norvegicus
catgttgtacgctcttcacttgaaa

SEQ ID NO: 240790 - DNA, 25 bp, Rattus norvegicus
catgttgtatctcgacgagtacgac

SEQ ID NO: 240791 - DNA, 25 bp, Rattus norvegicus
catgttgtatctcttcacagtcttt

SEQ ID NO: 240792 - DNA, 25 bp, Rattus norvegicus
catgttgtatctggacgagtacgac

SEQ ID NO: 240793 - DNA, 25 bp, Rattus norvegicus
catgttgtatctgttcacagtcttt

SEQ ID NO: 240794 - DNA, 25 bp, Rattus norvegicus
catgttgtcggcagggctctcgctg

SEQ ID NO: 240795 - DNA, 25 bp, Rattus norvegicus
catgttgtcggctgggctctcgctg

SEQ ID NO: 240796 - DNA, 25 bp, Rattus norvegicus
catgttgtgagaaccgaatcgccat

SEQ ID NO: 240797 - DNA, 25 bp, Rattus norvegicus
catgttgtgagatccgaatcgccat

SEQ ID NO: 240798 - DNA, 25 bp, Rattus norvegicus
catgttgttctaaacaggtgtttca

SEQ ID NO: 240799 - DNA, 25 bp, Rattus norvegicus
catgttgttctatacaggtgtttca

SEQ ID NO: 240800 - DNA, 25 bp, Rattus norvegicus
catgttgttgtacgtgcttgtcact

SEQ ID NO: 240801 - DNA, 25 bp, Rattus norvegicus
catgttgttgtaggtgcttgtcact

SEQ ID NO: 240802 - DNA, 25 bp, Rattus norvegicus
catgtttacatgatttgacgtgcaa

SEQ ID NO: 240803 - DNA, 25 bp, Rattus norvegicus
catgtttacatgttttgacgtgcaa

SEQ ID NO: 240804 - DNA, 25 bp, Rattus norvegicus
catgtttacctgacacagcagtgct

SEQ ID NO: 240805 - DNA, 25 bp, Rattus norvegicus
catgtttacctgtcacagcagtgct

SEQ ID NO: 240806 - DNA, 25 bp, Rattus norvegicus
catgtttaccttagtctaccctaag

SEQ ID NO: 240807 - DNA, 25 bp, Rattus norvegicus
catgtttacctttgtctaccctaag

SEQ ID NO: 240808 - DNA, 25 bp, Rattus norvegicus
catgtttcagaaacgctgggagcat

SEQ ID NO: 240809 - DNA, 25 bp, Rattus norvegicus
catgtttcagaatcgctgggagcat

SEQ ID NO: 240810 - DNA, 25 bp, Rattus norvegicus
catgtttccttaaagcagattgcct

SEQ ID NO: 240811 - DNA, 25 bp, Rattus norvegicus
catgtttccttatagcagattgcct

SEQ ID NO: 240812 - DNA, 25 bp, Rattus norvegicus
catgtttcgttaactggtgctgcag

SEQ ID NO: 240813 - DNA, 25 bp, Rattus norvegicus
catgtttcgttatctggtgctgcag

SEQ ID NO: 240814 - DNA, 25 bp, Rattus norvegicus
catgtttctcacagactccaacaat

SEQ ID NO: 240815 - DNA, 25 bp, Rattus norvegicus
catgtttctcactgactccaacaat

SEQ ID NO: 240816 - DNA, 25 bp, Rattus norvegicus
catgtttcttttctctgctctttat

SEQ ID NO: 240817 - DNA, 25 bp, Rattus norvegicus
catgtttcttttgtctgctctttat

SEQ ID NO: 240818 - DNA, 25 bp, Rattus norvegicus
catgtttgaagacagacctagctat

SEQ ID NO: 240819 - DNA, 25 bp, Rattus norvegicus
catgtttgaagagagacctagctat

SEQ ID NO: 240820 - DNA, 25 bp, Rattus norvegicus
catgtttgacagagccgtgaatctc

SEQ ID NO: 240821 - DNA, 25 bp, Rattus norvegicus
catgtttgacagtgccgtgaatctc

SEQ ID NO: 240822 - DNA, 25 bp, Rattus norvegicus
catgtttgccttccatcagttgaag

SEQ ID NO: 240823 - DNA, 25 bp, Rattus norvegicus
catgtttgccttgcatcagttgaag

SEQ ID NO: 240824 - DNA, 25 bp, Rattus norvegicus
catgtttgcttgcttaagcacttaa

SEQ ID NO: 240825 - DNA, 25 bp, Rattus norvegicus
catgtttgcttggttaagcacttaa

SEQ ID NO: 240826 - DNA, 25 bp, Rattus norvegicus
catgtttggaacagaggtattagac

SEQ ID NO: 240827 - DNA, 25 bp, Rattus norvegicus
catgtttggaactgaggtattagac

SEQ ID NO: 240828 - DNA, 25 bp, Rattus norvegicus
catgtttggtttctatgctgcgccc

SEQ ID NO: 240829 - DNA, 25 bp, Rattus norvegicus
catgtttggtttgtatgctgcgccc

SEQ ID NO: 240830 - DNA, 25 bp, Rattus norvegicus
catgtttgtaatatctccatagaaa

SEQ ID NO: 240831 - DNA, 25 bp, Rattus norvegicus
catgtttgtaatttctccatagaaa

SEQ ID NO: 240832 - DNA, 25 bp, Rattus norvegicus
catgtttgtgatctactgttgtaat

SEQ ID NO: 240833 - DNA, 25 bp, Rattus norvegicus
catgtttgtgatgtactgttgtaat

SEQ ID NO: 240834 - DNA, 25 bp, Rattus norvegicus
catgtttgtttaattctccttatga

SEQ ID NO: 240835 - DNA, 25 bp, Rattus norvegicus
catgtttgtttatttctccttatga

SEQ ID NO: 240836 - DNA, 25 bp, Rattus norvegicus
catgtttgtttcctagtgtttacaa

SEQ ID NO: 240837 - DNA, 25 bp, Rattus norvegicus
catgtttgtttcgtagtgtttacaa

SEQ ID NO: 240838 - DNA, 25 bp, Rattus norvegicus
catgttttacttcatcttctgctaa

SEQ ID NO: 240839 - DNA, 25 bp, Rattus norvegicus
catgttttacttgatcttctgctaa

SEQ ID NO: 240840 - DNA, 25 bp, Rattus norvegicus
catgttttagagctgcaatcgccga

SEQ ID NO: 240841 - DNA, 25 bp, Rattus norvegicus
catgttttagaggtgcaatcgccga

SEQ ID NO: 240842 - DNA, 25 bp, Rattus norvegicus
catgttttcaaaccattgtgttaga

SEQ ID NO: 240843 - DNA, 25 bp, Rattus norvegicus
catgttttcaaagcattgtgttaga

SEQ ID NO: 240844 - DNA, 25 bp, Rattus norvegicus
catgttttcaatcttgtggtcctgg

SEQ ID NO: 240845 - DNA, 25 bp, Rattus norvegicus
catgttttcaatgttgtggtcctgg

SEQ ID NO: 240846 - DNA, 25 bp, Rattus norvegicus
catgttttcattaccttatccctct

SEQ ID NO: 240847 - DNA, 25 bp, Rattus norvegicus
catgttttcatttccttatccctct

SEQ ID NO: 240848 - DNA, 25 bp, Rattus norvegicus
catgttttcccacttagcattcaaa

SEQ ID NO: 240849 - DNA, 25 bp, Rattus norvegicus
catgttttcccagttagcattcaaa

SEQ ID NO: 240850 - DNA, 25 bp, Rattus norvegicus
catgttttccccataaggacttgag

SEQ ID NO: 240851 - DNA, 25 bp, Rattus norvegicus
catgttttccccttaaggacttgag

SEQ ID NO: 240852 - DNA, 25 bp, Rattus norvegicus
catgttttctctcaggacactttct

SEQ ID NO: 240853 - DNA, 25 bp, Rattus norvegicus
catgttttctctgaggacactttct

SEQ ID NO: 240854 - DNA, 25 bp, Rattus norvegicus
catgttttctgcagggtgggatcta

SEQ ID NO: 240855 - DNA, 25 bp, Rattus norvegicus
catgttttctgcctcatcttttata

SEQ ID NO: 240856 - DNA, 25 bp, Rattus norvegicus
catgttttctgcgtcatcttttata

SEQ ID NO: 240857 - DNA, 25 bp, Rattus norvegicus
catgttttctgctgggtgggatcta

SEQ ID NO: 240858 - DNA, 25 bp, Rattus norvegicus
catgttttcttgcaatagcttggga

SEQ ID NO: 240859 - DNA, 25 bp, Rattus norvegicus
catgttttcttggaatagcttggga

SEQ ID NO: 240860 - DNA, 25 bp, Rattus norvegicus
catgttttgattaactgcccggtta

SEQ ID NO: 240861 - DNA, 25 bp, Rattus norvegicus
catgttttgatttactgcccggtta

SEQ ID NO: 240862 - DNA, 25 bp, Rattus norvegicus
catgttttgggcaatattggcacct

SEQ ID NO: 240863 - DNA, 25 bp, Rattus norvegicus
catgttttgggctatattggcacct

SEQ ID NO: 240864 - DNA, 25 bp, Rattus norvegicus
catgttttggtcaatgaacgtaaag

SEQ ID NO: 240865 - DNA, 25 bp, Rattus norvegicus
catgttttggtctatgaacgtaaag

SEQ ID NO: 240866 - DNA, 25 bp, Rattus norvegicus
catgttttgtaaagcttagccgtaa

SEQ ID NO: 240867 - DNA, 25 bp, Rattus norvegicus
catgttttgtaatgcttagccgtaa

SEQ ID NO: 240868 - DNA, 25 bp, Rattus norvegicus
catgttttgtttcctgggacctgag

SEQ ID NO: 240869 - DNA, 25 bp, Rattus norvegicus
catgttttgtttgctgggacctgag

SEQ ID NO: 240870 - DNA, 25 bp, Rattus norvegicus
cattaaaatgtaaggcgtttccctt

SEQ ID NO: 240871 - DNA, 25 bp, Rattus norvegicus
cattaaaatgtatggcgtttccctt

SEQ ID NO: 240872 - DNA, 25 bp, Rattus norvegicus
cattaaacctggcacactggcacat

SEQ ID NO: 240873 - DNA, 25 bp, Rattus norvegicus
cattaaacctgggacactggcacat

SEQ ID NO: 240874 - DNA, 25 bp, Rattus norvegicus
cattaaaggctccatcggcacctat

SEQ ID NO: 240875 - DNA, 25 bp, Rattus norvegicus
cattaaaggctcgatcggcacctat

SEQ ID NO: 240876 - DNA, 25 bp, Rattus norvegicus
cattaaagtactaccatgtcattca

SEQ ID NO: 240877 - DNA, 25 bp, Rattus norvegicus
cattaaagtacttccatgtcattca

SEQ ID NO: 240878 - DNA, 25 bp, Rattus norvegicus
cattaacatatcaatcccttcatcc

SEQ ID NO: 240879 - DNA, 25 bp, Rattus norvegicus
cattaacatatctatcccttcatcc

SEQ ID NO: 240880 - DNA, 25 bp, Rattus norvegicus
cattaacatgttcagccttttctct

SEQ ID NO: 240881 - DNA, 25 bp, Rattus norvegicus
cattaacatgttgagccttttctct

SEQ ID NO: 240882 - DNA, 25 bp, Rattus norvegicus
cattaaccctgtcaaaagagttctt

SEQ ID NO: 240883 - DNA, 25 bp, Rattus norvegicus
cattaaccctgtgaaaagagttctt

SEQ ID NO: 240884 - DNA, 25 bp, Rattus norvegicus
cattaaccctttctggaacaactag

SEQ ID NO: 240885 - DNA, 25 bp, Rattus norvegicus
cattaaccctttgtggaacaactag

SEQ ID NO: 240886 - DNA, 25 bp, Rattus norvegicus
cattaactaacactggaagacgcac

SEQ ID NO: 240887 - DNA, 25 bp, Rattus norvegicus
cattaactaacagtggaagacgcac

SEQ ID NO: 240888 - DNA, 25 bp, Rattus norvegicus
cattaactccgaccgttgcatgcat

SEQ ID NO: 240889 - DNA, 25 bp, Rattus norvegicus
cattaactccgagcgttgcatgcat

SEQ ID NO: 240890 - DNA, 25 bp, Rattus norvegicus
cattaactcttgcttgtctctcttg

SEQ ID NO: 240891 - DNA, 25 bp, Rattus norvegicus
cattaactcttggttgtctctcttg

SEQ ID NO: 240892 - DNA, 25 bp, Rattus norvegicus
cattaacttgggactatcttcaaca

SEQ ID NO: 240893 - DNA, 25 bp, Rattus norvegicus
cattaacttgggtctatcttcaaca

SEQ ID NO: 240894 - DNA, 25 bp, Rattus norvegicus
cattaagaaagtcctgtcgcagcaa

SEQ ID NO: 240895 - DNA, 25 bp, Rattus norvegicus
cattaagaaagtgctgtcgcagcaa

SEQ ID NO: 240896 - DNA, 25 bp, Rattus norvegicus
cattaagactgtctgtgctgctacc

SEQ ID NO: 240897 - DNA, 25 bp, Rattus norvegicus
cattaagactgtgtgtgctgctacc

SEQ ID NO: 240898 - DNA, 25 bp, Rattus norvegicus
cattaagccattattgcatttcaaa

SEQ ID NO: 240899 - DNA, 25 bp, Rattus norvegicus
cattaagccatttttgcatttcaaa

SEQ ID NO: 240900 - DNA, 25 bp, Rattus norvegicus
cattaagctggcccaatggtaaggg

SEQ ID NO: 240901 - DNA, 25 bp, Rattus norvegicus
cattaagctggcgcaatggtaaggg

SEQ ID NO: 240902 - DNA, 25 bp, Rattus norvegicus
cattaagggctactcctgggtgaca

SEQ ID NO: 240903 - DNA, 25 bp, Rattus norvegicus
cattaagggctagtcctgggtgaca

SEQ ID NO: 240904 - DNA, 25 bp, Rattus norvegicus
cattaaggtcctatttcctcaccag

SEQ ID NO: 240905 - DNA, 25 bp, Rattus norvegicus
cattaaggtcctttttcctcaccag

SEQ ID NO: 240906 - DNA, 25 bp, Rattus norvegicus
cattaagttggtcgtgaccctcttt

SEQ ID NO: 240907 - DNA, 25 bp, Rattus norvegicus
cattaagttggtggtgaccctcttt

SEQ ID NO: 240908 - DNA, 25 bp, Rattus norvegicus
cattaatcaccaacttcctcagaag

SEQ ID NO: 240909 - DNA, 25 bp, Rattus norvegicus
cattaatcaccatcttcctcagaag

SEQ ID NO: 240910 - DNA, 25 bp, Rattus norvegicus
cattaatccgttaatgtgatgtgta

SEQ ID NO: 240911 - DNA, 25 bp, Rattus norvegicus
cattaatccgtttatgtgatgtgta

SEQ ID NO: 240912 - DNA, 25 bp, Rattus norvegicus
cattaatgtctgacctgtagtttta

SEQ ID NO: 240913 - DNA, 25 bp, Rattus norvegicus
cattaatgtctgtcctgtagtttta

SEQ ID NO: 240914 - DNA, 25 bp, Rattus norvegicus
cattaatgtggaaggccttaccgca

SEQ ID NO: 240915 - DNA, 25 bp, Rattus norvegicus
cattaatgtggatggccttaccgca

SEQ ID NO: 240916 - DNA, 25 bp, Rattus norvegicus
cattaatttctgaaacacgccatgt

SEQ ID NO: 240917 - DNA, 25 bp, Rattus norvegicus
cattaatttctgtaacacgccatgt

SEQ ID NO: 240918 - DNA, 25 bp, Rattus norvegicus
cattacaagaccactcctgaagctg

SEQ ID NO: 240919 - DNA, 25 bp, Rattus norvegicus
cattacaagacctctcctgaagctg

SEQ ID NO: 240920 - DNA, 25 bp, Rattus norvegicus
cattacactggactgatgacatggg

SEQ ID NO: 240921 - DNA, 25 bp, Rattus norvegicus
cattacactggagtgatgacatggg

SEQ ID NO: 240922 - DNA, 25 bp, Rattus norvegicus
cattacacttgcagagtttggtctc

SEQ ID NO: 240923 - DNA, 25 bp, Rattus norvegicus
cattacacttgctgagtttggtctc

SEQ ID NO: 240924 - DNA, 25 bp, Rattus norvegicus
cattacaggttaccccattctgagg

SEQ ID NO: 240925 - DNA, 25 bp, Rattus norvegicus
cattacaggttagcccattctgagg

SEQ ID NO: 240926 - DNA, 25 bp, Rattus norvegicus
cattacattgataagcatttggctt

SEQ ID NO: 240927 - DNA, 25 bp, Rattus norvegicus
cattacattgattagcatttggctt

SEQ ID NO: 240928 - DNA, 25 bp, Rattus norvegicus
cattaccatgtacgccagagctaga

SEQ ID NO: 240929 - DNA, 25 bp, Rattus norvegicus
cattaccatgtaggccagagctaga

SEQ ID NO: 240930 - DNA, 25 bp, Rattus norvegicus
cattacccttctattctggataaat

SEQ ID NO: 240931 - DNA, 25 bp, Rattus norvegicus
cattacccttcttttctggataaat

SEQ ID NO: 240932 - DNA, 25 bp, Rattus norvegicus
cattaccgagttacctgtgaattct

SEQ ID NO: 240933 - DNA, 25 bp, Rattus norvegicus
cattaccgagtttcctgtgaattct

SEQ ID NO: 240934 - DNA, 25 bp, Rattus norvegicus
cattacgatccaaccagcaaagagg

SEQ ID NO: 240935 - DNA, 25 bp, Rattus norvegicus
cattacgatccatccagcaaagagg

SEQ ID NO: 240936 - DNA, 25 bp, Rattus norvegicus
cattacggttaaattgggccactgg

SEQ ID NO: 240937 - DNA, 25 bp, Rattus norvegicus
cattacggttaatttgggccactgg

SEQ ID NO: 240938 - DNA, 25 bp, Rattus norvegicus
cattacgtcattctgttctcattca

SEQ ID NO: 240939 - DNA, 25 bp, Rattus norvegicus
cattacgtcattgtgttctcattca

SEQ ID NO: 240940 - DNA, 25 bp, Rattus norvegicus
cattactagagtatggtttcccagg

SEQ ID NO: 240941 - DNA, 25 bp, Rattus norvegicus
cattactagagtttggtttcccagg

SEQ ID NO: 240942 - DNA, 25 bp, Rattus norvegicus
cattactcagttccctgtgtgtcaa

SEQ ID NO: 240943 - DNA, 25 bp, Rattus norvegicus
cattactcagttgcctgtgtgtcaa

SEQ ID NO: 240944 - DNA, 25 bp, Rattus norvegicus
cattactgatgtattttgacctgac

SEQ ID NO: 240945 - DNA, 25 bp, Rattus norvegicus
cattactgatgttttttgacctgac

SEQ ID NO: 240946 - DNA, 25 bp, Rattus norvegicus
cattacttcggacaaacctctcata

SEQ ID NO: 240947 - DNA, 25 bp, Rattus norvegicus
cattacttcggagaaacctctcata

SEQ ID NO: 240948 - DNA, 25 bp, Rattus norvegicus
cattacttgttcattgaccttcgca

SEQ ID NO: 240949 - DNA, 25 bp, Rattus norvegicus
cattacttgttctttgaccttcgca

SEQ ID NO: 240950 - DNA, 25 bp, Rattus norvegicus
cattactttatacccatgccatgta

SEQ ID NO: 240951 - DNA, 25 bp, Rattus norvegicus
cattactttatagccatgccatgta

SEQ ID NO: 240952 - DNA, 25 bp, Rattus norvegicus
cattactttctactctcttaattag

SEQ ID NO: 240953 - DNA, 25 bp, Rattus norvegicus
cattactttctagtctcttaattag

SEQ ID NO: 240954 - DNA, 25 bp, Rattus norvegicus
cattagaataaccttgtgattacag

SEQ ID NO: 240955 - DNA, 25 bp, Rattus norvegicus
cattagaataacgttgtgattacag

SEQ ID NO: 240956 - DNA, 25 bp, Rattus norvegicus
cattagacactacgactgactggta

SEQ ID NO: 240957 - DNA, 25 bp, Rattus norvegicus
cattagacactaggactgactggta

SEQ ID NO: 240958 - DNA, 25 bp, Rattus norvegicus
cattagagtattcctgggacagacc

SEQ ID NO: 240959 - DNA, 25 bp, Rattus norvegicus
cattagagtattgctgggacagacc

SEQ ID NO: 240960 - DNA, 25 bp, Rattus norvegicus
cattagatgcggatgtataagctcc

SEQ ID NO: 240961 - DNA, 25 bp, Rattus norvegicus
cattagatgcggttgtataagctcc

SEQ ID NO: 240962 - DNA, 25 bp, Rattus norvegicus
cattagccgtttcccagatccgagg

SEQ ID NO: 240963 - DNA, 25 bp, Rattus norvegicus
cattagccgtttgccagatccgagg

SEQ ID NO: 240964 - DNA, 25 bp, Rattus norvegicus
cattagcctaacacgagactcctat

SEQ ID NO: 240965 - DNA, 25 bp, Rattus norvegicus
cattagcctaactcgagactcctat

SEQ ID NO: 240966 - DNA, 25 bp, Rattus norvegicus
cattagcctgtaatccagtaggaaa

SEQ ID NO: 240967 - DNA, 25 bp, Rattus norvegicus
cattagcctgtattccagtaggaaa

SEQ ID NO: 240968 - DNA, 25 bp, Rattus norvegicus
cattagctaaggcatttttcaaggg

SEQ ID NO: 240969 - DNA, 25 bp, Rattus norvegicus
cattagctaagggatttttcaaggg

SEQ ID NO: 240970 - DNA, 25 bp, Rattus norvegicus
cattagctggctagacttagactta

SEQ ID NO: 240971 - DNA, 25 bp, Rattus norvegicus
cattagctggcttgacttagactta

SEQ ID NO: 240972 - DNA, 25 bp, Rattus norvegicus
cattaggaccctctgtgcattaact

SEQ ID NO: 240973 - DNA, 25 bp, Rattus norvegicus
cattaggaccctgtgtgcattaact

SEQ ID NO: 240974 - DNA, 25 bp, Rattus norvegicus
cattaggacggcagatggtgctgtt

SEQ ID NO: 240975 - DNA, 25 bp, Rattus norvegicus
cattaggacggctgatggtgctgtt

SEQ ID NO: 240976 - DNA, 25 bp, Rattus norvegicus
cattaggcagggatcggtgtgcatt

SEQ ID NO: 240977 - DNA, 25 bp, Rattus norvegicus
cattaggcagggttcggtgtgcatt

SEQ ID NO: 240978 - DNA, 25 bp, Rattus norvegicus
cattaggccataacacatgcttccc

SEQ ID NO: 240979 - DNA, 25 bp, Rattus norvegicus
cattaggccatatcacatgcttccc

SEQ ID NO: 240980 - DNA, 25 bp, Rattus norvegicus
cattagggttcaatgcgtgctgcag

SEQ ID NO: 240981 - DNA, 25 bp, Rattus norvegicus
cattagggttcattgcgtgctgcag

SEQ ID NO: 240982 - DNA, 25 bp, Rattus norvegicus
cattaggtcggtacctgcagcggtg

SEQ ID NO: 240983 - DNA, 25 bp, Rattus norvegicus
cattaggtcggttcctgcagcggtg

SEQ ID NO: 240984 - DNA, 25 bp, Rattus norvegicus
cattagtctactagtgggtgtgcaa

SEQ ID NO: 240985 - DNA, 25 bp, Rattus norvegicus
cattagtctacttgtgggtgtgcaa

SEQ ID NO: 240986 - DNA, 25 bp, Rattus norvegicus
cattagtctgacaagctctgcttca

SEQ ID NO: 240987 - DNA, 25 bp, Rattus norvegicus
cattagtctgactagctctgcttca

SEQ ID NO: 240988 - DNA, 25 bp, Rattus norvegicus
cattagtttccaatggcctgtgaaa

SEQ ID NO: 240989 - DNA, 25 bp, Rattus norvegicus
cattagtttccattggcctgtgaaa

SEQ ID NO: 240990 - DNA, 25 bp, Rattus norvegicus
cattataactctaacaaatctccct

SEQ ID NO: 240991 - DNA, 25 bp, Rattus norvegicus
cattataactcttacaaatctccct

SEQ ID NO: 240992 - DNA, 25 bp, Rattus norvegicus
cattatacctttacattttctgata

SEQ ID NO: 240993 - DNA, 25 bp, Rattus norvegicus
cattataccttttcattttctgata

SEQ ID NO: 240994 - DNA, 25 bp, Rattus norvegicus
cattatacttttatgtatgcctgaa

SEQ ID NO: 240995 - DNA, 25 bp, Rattus norvegicus
cattatacttttttgtatgcctgaa

SEQ ID NO: 240996 - DNA, 25 bp, Rattus norvegicus
cattatatatgtaatttggctagac

SEQ ID NO: 240997 - DNA, 25 bp, Rattus norvegicus
cattatatatgttatttggctagac

SEQ ID NO: 240998 - DNA, 25 bp, Rattus norvegicus
cattatatgcttagactgggtgttg

SEQ ID NO: 240999 - DNA, 25 bp, Rattus norvegicus
cattatatgctttgactgggtgttg

SEQ ID NO: 241000 - DNA, 25 bp, Rattus norvegicus
cattatcactagacgggacggccgg

SEQ ID NO: 241001 - DNA, 25 bp, Rattus norvegicus
cattatcactagtcgggacggccgg

SEQ ID NO: 241002 - DNA, 25 bp, Rattus norvegicus
cattatcatgctcctcttttgtaga

SEQ ID NO: 241003 - DNA, 25 bp, Rattus norvegicus
cattatcatgctgctcttttgtaga

SEQ ID NO: 241004 - DNA, 25 bp, Rattus norvegicus
cattatccagctcccctcgaagagg

SEQ ID NO: 241005 - DNA, 25 bp, Rattus norvegicus
cattatccagctgccctcgaagagg

SEQ ID NO: 241006 - DNA, 25 bp, Rattus norvegicus
cattatcccagcactagccaaggac

SEQ ID NO: 241007 - DNA, 25 bp, Rattus norvegicus
cattatcccagctctagccaaggac

SEQ ID NO: 241008 - DNA, 25 bp, Rattus norvegicus
cattatccccttcgtgtcttgagaa

SEQ ID NO: 241009 - DNA, 25 bp, Rattus norvegicus
cattatccccttggtgtcttgagaa

SEQ ID NO: 241010 - DNA, 25 bp, Rattus norvegicus
cattatccctaaactgaagcatgat

SEQ ID NO: 241011 - DNA, 25 bp, Rattus norvegicus
cattatccctaatctgaagcatgat

SEQ ID NO: 241012 - DNA, 25 bp, Rattus norvegicus
cattatcctctgcacctgccagtgt

SEQ ID NO: 241013 - DNA, 25 bp, Rattus norvegicus
cattatcctctggacctgccagtgt

SEQ ID NO: 241014 - DNA, 25 bp, Rattus norvegicus
cattatctatccctaatttccctaa

SEQ ID NO: 241015 - DNA, 25 bp, Rattus norvegicus
cattatctatccgtaatttccctaa

SEQ ID NO: 241016 - DNA, 25 bp, Rattus norvegicus
cattatctcattactcgggaaggca

SEQ ID NO: 241017 - DNA, 25 bp, Rattus norvegicus
cattatctcatttctcgggaaggca

SEQ ID NO: 241018 - DNA, 25 bp, Rattus norvegicus
cattatctctttcctttgcatttaa

SEQ ID NO: 241019 - DNA, 25 bp, Rattus norvegicus
cattatctctttgctttgcatttaa

SEQ ID NO: 241020 - DNA, 25 bp, Rattus norvegicus
cattatcttgtgaactattagctgt

SEQ ID NO: 241021 - DNA, 25 bp, Rattus norvegicus
cattatcttgtgtactattagctgt

SEQ ID NO: 241022 - DNA, 25 bp, Rattus norvegicus
cattatgagctcatggcacacaaaa

SEQ ID NO: 241023 - DNA, 25 bp, Rattus norvegicus
cattatgagctcttggcacacaaaa

SEQ ID NO: 241024 - DNA, 25 bp, Rattus norvegicus
cattatgcttacatctcagcagcac

SEQ ID NO: 241025 - DNA, 25 bp, Rattus norvegicus
cattatgcttacttctcagcagcac

SEQ ID NO: 241026 - DNA, 25 bp, Rattus norvegicus
cattatggccacctttttaggcctt

SEQ ID NO: 241027 - DNA, 25 bp, Rattus norvegicus
cattatggccacgtttttaggcctt

SEQ ID NO: 241028 - DNA, 25 bp, Rattus norvegicus
cattatgtgattccttctgtttgtt

SEQ ID NO: 241029 - DNA, 25 bp, Rattus norvegicus
cattatgtgattgcttctgtttgtt

SEQ ID NO: 241030 - DNA, 25 bp, Rattus norvegicus
cattatgtttatatcatgcttgtaa

SEQ ID NO: 241031 - DNA, 25 bp, Rattus norvegicus
cattatgtttatttcatgcttgtaa

SEQ ID NO: 241032 - DNA, 25 bp, Rattus norvegicus
cattatgtttctatttctcactgag

SEQ ID NO: 241033 - DNA, 25 bp, Rattus norvegicus
cattatgtttctttttctcactgag

SEQ ID NO: 241034 - DNA, 25 bp, Rattus norvegicus
cattatgttttcagatctgctcgta

SEQ ID NO: 241035 - DNA, 25 bp, Rattus norvegicus
cattatgttttctgatctgctcgta

SEQ ID NO: 241036 - DNA, 25 bp, Rattus norvegicus
cattattctcccagtgttcttgtaa

SEQ ID NO: 241037 - DNA, 25 bp, Rattus norvegicus
cattattctccctgtgttcttgtaa

SEQ ID NO: 241038 - DNA, 25 bp, Rattus norvegicus
cattattgcaggcattggactcaga

SEQ ID NO: 241039 - DNA, 25 bp, Rattus norvegicus
cattattgcagggattggactcaga

SEQ ID NO: 241040 - DNA, 25 bp, Rattus norvegicus
cattattgttcaaggtaactccttt

SEQ ID NO: 241041 - DNA, 25 bp, Rattus norvegicus
cattattgttcatggtaactccttt

SEQ ID NO: 241042 - DNA, 25 bp, Rattus norvegicus
cattcaaagcaaactcctctaggag

SEQ ID NO: 241043 - DNA, 25 bp, Rattus norvegicus
cattcaaagcaatctcctctaggag

SEQ ID NO: 241044 - DNA, 25 bp, Rattus norvegicus
cattcaagaggaagcacttggcccc

SEQ ID NO: 241045 - DNA, 25 bp, Rattus norvegicus
cattcaagaggatgcacttggcccc

SEQ ID NO: 241046 - DNA, 25 bp, Rattus norvegicus
cattcaaggcccacctgttttaagc

SEQ ID NO: 241047 - DNA, 25 bp, Rattus norvegicus
cattcaaggccctcctgttttaagc

SEQ ID NO: 241048 - DNA, 25 bp, Rattus norvegicus
cattcaattctaagaacctttccaa

SEQ ID NO: 241049 - DNA, 25 bp, Rattus norvegicus
cattcaattctatgaacctttccaa

SEQ ID NO: 241050 - DNA, 25 bp, Rattus norvegicus
cattcaattgagacgctgctatgca

SEQ ID NO: 241051 - DNA, 25 bp, Rattus norvegicus
cattcaattgagtcgctgctatgca

SEQ ID NO: 241052 - DNA, 25 bp, Rattus norvegicus
cattcacaagaacccaaacgcatcg

SEQ ID NO: 241053 - DNA, 25 bp, Rattus norvegicus
cattcacaagaagccaaacgcatcg

SEQ ID NO: 241054 - DNA, 25 bp, Rattus norvegicus
cattcacacaggcaatactggttgc

SEQ ID NO: 241055 - DNA, 25 bp, Rattus norvegicus
cattcacacagggaatactggttgc

SEQ ID NO: 241056 - DNA, 25 bp, Rattus norvegicus
cattcacacctacctctaggagaga

SEQ ID NO: 241057 - DNA, 25 bp, Rattus norvegicus
cattcacacctagctctaggagaga

SEQ ID NO: 241058 - DNA, 25 bp, Rattus norvegicus
cattcacaccttatcattggataag

SEQ ID NO: 241059 - DNA, 25 bp, Rattus norvegicus
cattcacaccttttcattggataag

SEQ ID NO: 241060 - DNA, 25 bp, Rattus norvegicus
cattcacagaatcttgtcagcctga

SEQ ID NO: 241061 - DNA, 25 bp, Rattus norvegicus
cattcacagaatgttgtcagcctga

SEQ ID NO: 241062 - DNA, 25 bp, Rattus norvegicus
cattcaccaattcttcaagccttct

SEQ ID NO: 241063 - DNA, 25 bp, Rattus norvegicus
cattcaccaattgttcaagccttct

SEQ ID NO: 241064 - DNA, 25 bp, Rattus norvegicus
cattcacccataacagtgccatgtt

SEQ ID NO: 241065 - DNA, 25 bp, Rattus norvegicus
cattcacccatatcagtgccatgtt

SEQ ID NO: 241066 - DNA, 25 bp, Rattus norvegicus
cattcacccgatccaaaggacttgg

SEQ ID NO: 241067 - DNA, 25 bp, Rattus norvegicus
cattcacccgatgcaaaggacttgg

SEQ ID NO: 241068 - DNA, 25 bp, Rattus norvegicus
cattcaccttatccagtcagggcac

SEQ ID NO: 241069 - DNA, 25 bp, Rattus norvegicus
cattcaccttatgcagtcagggcac

SEQ ID NO: 241070 - DNA, 25 bp, Rattus norvegicus
cattcactagttctattggtattgg

SEQ ID NO: 241071 - DNA, 25 bp, Rattus norvegicus
cattcactagttgtattggtattgg

SEQ ID NO: 241072 - DNA, 25 bp, Rattus norvegicus
cattcactcctgaggcatcgatgaa

SEQ ID NO: 241073 - DNA, 25 bp, Rattus norvegicus
cattcactcctgtggcatcgatgaa

SEQ ID NO: 241074 - DNA, 25 bp, Rattus norvegicus
cattcactgatgatagctttttatt

SEQ ID NO: 241075 - DNA, 25 bp, Rattus norvegicus
cattcactgatgttagctttttatt

SEQ ID NO: 241076 - DNA, 25 bp, Rattus norvegicus
cattcactgggtcttgtccgggcct

SEQ ID NO: 241077 - DNA, 25 bp, Rattus norvegicus
cattcactgggtgttgtccgggcct

SEQ ID NO: 241078 - DNA, 25 bp, Rattus norvegicus
cattcacttgataactttggtctgg

SEQ ID NO: 241079 - DNA, 25 bp, Rattus norvegicus
cattcacttgattactttggtctgg

SEQ ID NO: 241080 - DNA, 25 bp, Rattus norvegicus
cattcactttcccacacatgaggaa

SEQ ID NO: 241081 - DNA, 25 bp, Rattus norvegicus
cattcactttccgacacatgaggaa

SEQ ID NO: 241082 - DNA, 25 bp, Rattus norvegicus
cattcagaaggtatgcttgagcaca

SEQ ID NO: 241083 - DNA, 25 bp, Rattus norvegicus
cattcagaaggtttgcttgagcaca

SEQ ID NO: 241084 - DNA, 25 bp, Rattus norvegicus
cattcagaatccacccactatatga

SEQ ID NO: 241085 - DNA, 25 bp, Rattus norvegicus
cattcagaatcctcccactatatga

SEQ ID NO: 241086 - DNA, 25 bp, Rattus norvegicus
cattcagacggaccgtgcttaccaa

SEQ ID NO: 241087 - DNA, 25 bp, Rattus norvegicus
cattcagacggagcgtgcttaccaa

SEQ ID NO: 241088 - DNA, 25 bp, Rattus norvegicus
cattcagactggcagatcttctctt

SEQ ID NO: 241089 - DNA, 25 bp, Rattus norvegicus
cattcagactgggagatcttctctt

SEQ ID NO: 241090 - DNA, 25 bp, Rattus norvegicus
cattcagagtgcctgtgacacccag

SEQ ID NO: 241091 - DNA, 25 bp, Rattus norvegicus
cattcagagtgcgtgtgacacccag

SEQ ID NO: 241092 - DNA, 25 bp, Rattus norvegicus
cattcagcaccaactctgagaaggt

SEQ ID NO: 241093 - DNA, 25 bp, Rattus norvegicus
cattcagcaccatctctgagaaggt

SEQ ID NO: 241094 - DNA, 25 bp, Rattus norvegicus
cattcagccatcagccttatgaggg

SEQ ID NO: 241095 - DNA, 25 bp, Rattus norvegicus
cattcagccatctgccttatgaggg

SEQ ID NO: 241096 - DNA, 25 bp, Rattus norvegicus
cattcagcccatacagagcagttga

SEQ ID NO: 241097 - DNA, 25 bp, Rattus norvegicus
cattcagcccattcagagcagttga

SEQ ID NO: 241098 - DNA, 25 bp, Rattus norvegicus
cattcagctgctcggtgtccattgc

SEQ ID NO: 241099 - DNA, 25 bp, Rattus norvegicus
cattcagctgctgggtgtccattgc

SEQ ID NO: 241100 - DNA, 25 bp, Rattus norvegicus
cattcaggacctacacaacttctaa

SEQ ID NO: 241101 - DNA, 25 bp, Rattus norvegicus
cattcaggaccttcacaacttctaa

SEQ ID NO: 241102 - DNA, 25 bp, Rattus norvegicus
cattcaggagtcagttgcaggccga

SEQ ID NO: 241103 - DNA, 25 bp, Rattus norvegicus
cattcaggagtctgttgcaggccga

SEQ ID NO: 241104 - DNA, 25 bp, Rattus norvegicus
cattcaggatgtcggtgccttttcc

SEQ ID NO: 241105 - DNA, 25 bp, Rattus norvegicus
cattcaggatgtgggtgccttttcc

SEQ ID NO: 241106 - DNA, 25 bp, Rattus norvegicus
cattcagggatccatagtgtcccct

SEQ ID NO: 241107 - DNA, 25 bp, Rattus norvegicus
cattcagggatcgatagtgtcccct

SEQ ID NO: 241108 - DNA, 25 bp, Rattus norvegicus
cattcaggtaaactttcagtgtcac

SEQ ID NO: 241109 - DNA, 25 bp, Rattus norvegicus
cattcaggtaaagtttcagtgtcac

SEQ ID NO: 241110 - DNA, 25 bp, Rattus norvegicus
cattcagtaccaacacccattaaat

SEQ ID NO: 241111 - DNA, 25 bp, Rattus norvegicus
cattcagtaccatcacccattaaat

SEQ ID NO: 241112 - DNA, 25 bp, Rattus norvegicus
cattcagtcttccaggcatttgggt

SEQ ID NO: 241113 - DNA, 25 bp, Rattus norvegicus
cattcagtcttcgaggcatttgggt

SEQ ID NO: 241114 - DNA, 25 bp, Rattus norvegicus
cattcagtctttccctgacatggaa

SEQ ID NO: 241115 - DNA, 25 bp, Rattus norvegicus
cattcagtctttgcctgacatggaa

SEQ ID NO: 241116 - DNA, 25 bp, Rattus norvegicus
cattcagtgatgagttaactatgct

SEQ ID NO: 241117 - DNA, 25 bp, Rattus norvegicus
cattcagtgatgtgttaactatgct

SEQ ID NO: 241118 - DNA, 25 bp, Rattus norvegicus
cattcagtgggacgtgctcacgcta

SEQ ID NO: 241119 - DNA, 25 bp, Rattus norvegicus
cattcagtgggaggtgctcacgcta

SEQ ID NO: 241120 - DNA, 25 bp, Rattus norvegicus
cattcagtggtgacctagagtctta

SEQ ID NO: 241121 - DNA, 25 bp, Rattus norvegicus
cattcagtggtgctcaggccaaaaa

SEQ ID NO: 241122 - DNA, 25 bp, Rattus norvegicus
cattcagtggtggtcaggccaaaaa

SEQ ID NO: 241123 - DNA, 25 bp, Rattus norvegicus
cattcagtggtgtcctagagtctta

SEQ ID NO: 241124 - DNA, 25 bp, Rattus norvegicus
cattcagtgtcaactctgttgtgta

SEQ ID NO: 241125 - DNA, 25 bp, Rattus norvegicus
cattcagtgtcatctctgttgtgta

SEQ ID NO: 241126 - DNA, 25 bp, Rattus norvegicus
cattcagtttctaatgacgagcgaa

SEQ ID NO: 241127 - DNA, 25 bp, Rattus norvegicus
cattcagtttcttatgacgagcgaa

SEQ ID NO: 241128 - DNA, 25 bp, Rattus norvegicus
cattcatagaaaatcattctggcac

SEQ ID NO: 241129 - DNA, 25 bp, Rattus norvegicus
cattcatagaaattcattctggcac

SEQ ID NO: 241130 - DNA, 25 bp, Rattus norvegicus
cattcatatcgaccgtggtccgaaa

SEQ ID NO: 241131 - DNA, 25 bp, Rattus norvegicus
cattcatatcgagcgtggtccgaaa

SEQ ID NO: 241132 - DNA, 25 bp, Rattus norvegicus
cattcatcccaaactctgttcaaag

SEQ ID NO: 241133 - DNA, 25 bp, Rattus norvegicus
cattcatcccaatctctgttcaaag

SEQ ID NO: 241134 - DNA, 25 bp, Rattus norvegicus
cattcatcctacctcttcagaggag

SEQ ID NO: 241135 - DNA, 25 bp, Rattus norvegicus
cattcatcctacgtcttcagaggag

SEQ ID NO: 241136 - DNA, 25 bp, Rattus norvegicus
cattcatctgtcagttcctccatct

SEQ ID NO: 241137 - DNA, 25 bp, Rattus norvegicus
cattcatctgtctgttcctccatct

SEQ ID NO: 241138 - DNA, 25 bp, Rattus norvegicus
cattcatgcttaatattttggatac

SEQ ID NO: 241139 - DNA, 25 bp, Rattus norvegicus
cattcatgcttattattttggatac

SEQ ID NO: 241140 - DNA, 25 bp, Rattus norvegicus
cattcattacatcgtaggcctccaa

SEQ ID NO: 241141 - DNA, 25 bp, Rattus norvegicus
cattcattacatggtaggcctccaa

SEQ ID NO: 241142 - DNA, 25 bp, Rattus norvegicus
cattcattagttccgcttgtctttg

SEQ ID NO: 241143 - DNA, 25 bp, Rattus norvegicus
cattcattagttgcgcttgtctttg

SEQ ID NO: 241144 - DNA, 25 bp, Rattus norvegicus
cattcattgcctacttgcagaaaag

SEQ ID NO: 241145 - DNA, 25 bp, Rattus norvegicus
cattcattgccttcttgcagaaaag

SEQ ID NO: 241146 - DNA, 25 bp, Rattus norvegicus
cattcattgtgtattgggatctata

SEQ ID NO: 241147 - DNA, 25 bp, Rattus norvegicus
cattcattgtgttttgggatctata

SEQ ID NO: 241148 - DNA, 25 bp, Rattus norvegicus
cattcatttgctctccttgttttta

SEQ ID NO: 241149 - DNA, 25 bp, Rattus norvegicus
cattcatttgctgtccttgttttta

SEQ ID NO: 241150 - DNA, 25 bp, Rattus norvegicus
cattccaactgaagagccatgagat

SEQ ID NO: 241151 - DNA, 25 bp, Rattus norvegicus
cattccaactgatgagccatgagat

SEQ ID NO: 241152 - DNA, 25 bp, Rattus norvegicus
cattccaacttacggagcggtcgtg

SEQ ID NO: 241153 - DNA, 25 bp, Rattus norvegicus
cattccaacttagggagcggtcgtg

SEQ ID NO: 241154 - DNA, 25 bp, Rattus norvegicus
cattccaacttgctggccatgtatt

SEQ ID NO: 241155 - DNA, 25 bp, Rattus norvegicus
cattccaacttggtggccatgtatt

SEQ ID NO: 241156 - DNA, 25 bp, Rattus norvegicus
cattccaactttacggctgttccaa

SEQ ID NO: 241157 - DNA, 25 bp, Rattus norvegicus
cattccaacttttcggctgttccaa

SEQ ID NO: 241158 - DNA, 25 bp, Rattus norvegicus
cattccaatagtctttccctcatac

SEQ ID NO: 241159 - DNA, 25 bp, Rattus norvegicus
cattccaatagtgtttccctcatac

SEQ ID NO: 241160 - DNA, 25 bp, Rattus norvegicus
cattccaatgtcctgttttccacag

SEQ ID NO: 241161 - DNA, 25 bp, Rattus norvegicus
cattccaatgtcgtgttttccacag

SEQ ID NO: 241162 - DNA, 25 bp, Rattus norvegicus
cattccacaataatttccttgagtt

SEQ ID NO: 241163 - DNA, 25 bp, Rattus norvegicus
cattccacaatattttccttgagtt

SEQ ID NO: 241164 - DNA, 25 bp, Rattus norvegicus
cattccaccaagctgttacacttat

SEQ ID NO: 241165 - DNA, 25 bp, Rattus norvegicus
cattccaccaaggtgttacacttat

SEQ ID NO: 241166 - DNA, 25 bp, Rattus norvegicus
cattccaccagcattgctacagagg

SEQ ID NO: 241167 - DNA, 25 bp, Rattus norvegicus
cattccaccagctttgctacagagg

SEQ ID NO: 241168 - DNA, 25 bp, Rattus norvegicus
cattccagcactcgctggaagggct

SEQ ID NO: 241169 - DNA, 25 bp, Rattus norvegicus
cattccagcactggctggaagggct

SEQ ID NO: 241170 - DNA, 25 bp, Rattus norvegicus
cattccagccgtctgcaagtgtgta

SEQ ID NO: 241171 - DNA, 25 bp, Rattus norvegicus
cattccagccgtgtgcaagtgtgta

SEQ ID NO: 241172 - DNA, 25 bp, Rattus norvegicus
cattccataccacaatttcccttgg

SEQ ID NO: 241173 - DNA, 25 bp, Rattus norvegicus
cattccataccagaatttcccttgg

SEQ ID NO: 241174 - DNA, 25 bp, Rattus norvegicus
cattccatacttctaagtcttgtta

SEQ ID NO: 241175 - DNA, 25 bp, Rattus norvegicus
cattccatacttgtaagtcttgtta

SEQ ID NO: 241176 - DNA, 25 bp, Rattus norvegicus
cattccatgatgaagcttgttctga

SEQ ID NO: 241177 - DNA, 25 bp, Rattus norvegicus
cattccatgatgtagcttgttctga

SEQ ID NO: 241178 - DNA, 25 bp, Rattus norvegicus
cattccatgcagagtagtgagtcct

SEQ ID NO: 241179 - DNA, 25 bp, Rattus norvegicus
cattccatgcagtgtagtgagtcct

SEQ ID NO: 241180 - DNA, 25 bp, Rattus norvegicus
cattccatgcccactctgcttaggg

SEQ ID NO: 241181 - DNA, 25 bp, Rattus norvegicus
cattccatgcccatgctttaaaaat

SEQ ID NO: 241182 - DNA, 25 bp, Rattus norvegicus
cattccatgccctctctgcttaggg

SEQ ID NO: 241183 - DNA, 25 bp, Rattus norvegicus
cattccatgcccttgctttaaaaat

SEQ ID NO: 241184 - DNA, 25 bp, Rattus norvegicus
cattccatggagagtcgcagtatta

SEQ ID NO: 241185 - DNA, 25 bp, Rattus norvegicus
cattccatggagtgtcgcagtatta

SEQ ID NO: 241186 - DNA, 25 bp, Rattus norvegicus
cattccatgggcagcggctgcgtct

SEQ ID NO: 241187 - DNA, 25 bp, Rattus norvegicus
cattccatgggctgcggctgcgtct

SEQ ID NO: 241188 - DNA, 25 bp, Rattus norvegicus
cattccatttagagatcaagatacg

SEQ ID NO: 241189 - DNA, 25 bp, Rattus norvegicus
cattccatttagtgatcaagatacg

SEQ ID NO: 241190 - DNA, 25 bp, Rattus norvegicus
cattcccacaggctttagactttga

SEQ ID NO: 241191 - DNA, 25 bp, Rattus norvegicus
cattcccacagggtttagactttga

SEQ ID NO: 241192 - DNA, 25 bp, Rattus norvegicus
cattcccacatcagcctttattaaa

SEQ ID NO: 241193 - DNA, 25 bp, Rattus norvegicus
cattcccacatctgcctttattaaa

SEQ ID NO: 241194 - DNA, 25 bp, Rattus norvegicus
cattcccagctcaaaccacaggagt

SEQ ID NO: 241195 - DNA, 25 bp, Rattus norvegicus
cattcccagctctaaccacaggagt

SEQ ID NO: 241196 - DNA, 25 bp, Rattus norvegicus
cattccccaatgagtctgttcggtg

SEQ ID NO: 241197 - DNA, 25 bp, Rattus norvegicus
cattccccaatgtgtctgttcggtg

SEQ ID NO: 241198 - DNA, 25 bp, Rattus norvegicus
cattccccggagctggtgtgtgatc

SEQ ID NO: 241199 - DNA, 25 bp, Rattus norvegicus
cattccccggaggtggtgtgtgatc

SEQ ID NO: 241200 - DNA, 25 bp, Rattus norvegicus
cattcccctgtgacatctataaaaa

SEQ ID NO: 241201 - DNA, 25 bp, Rattus norvegicus
cattcccctgtgtcatctataaaaa

SEQ ID NO: 241202 - DNA, 25 bp, Rattus norvegicus
cattccccttccagttggaaagtag

SEQ ID NO: 241203 - DNA, 25 bp, Rattus norvegicus
cattccccttcctgttggaaagtag

SEQ ID NO: 241204 - DNA, 25 bp, Rattus norvegicus
cattcccggaaaaagaggttgctct

SEQ ID NO: 241205 - DNA, 25 bp, Rattus norvegicus
cattcccggaaatagaggttgctct

SEQ ID NO: 241206 - DNA, 25 bp, Rattus norvegicus
cattccctagatacacaggcgggca

SEQ ID NO: 241207 - DNA, 25 bp, Rattus norvegicus
cattccctagattcacaggcgggca

SEQ ID NO: 241208 - DNA, 25 bp, Rattus norvegicus
cattccctgacgagatggtatctta

SEQ ID NO: 241209 - DNA, 25 bp, Rattus norvegicus
cattccctgacgtgatggtatctta

SEQ ID NO: 241210 - DNA, 25 bp, Rattus norvegicus
cattccctggttaagatggctcttt

SEQ ID NO: 241211 - DNA, 25 bp, Rattus norvegicus
cattccctggtttagatggctcttt

SEQ ID NO: 241212 - DNA, 25 bp, Rattus norvegicus
cattccctttctaatgcatgtacgg

SEQ ID NO: 241213 - DNA, 25 bp, Rattus norvegicus
cattccctttcttatgcatgtacgg

SEQ ID NO: 241214 - DNA, 25 bp, Rattus norvegicus
cattccggttagatggctttacagc

SEQ ID NO: 241215 - DNA, 25 bp, Rattus norvegicus
cattccggttagttggctttacagc

SEQ ID NO: 241216 - DNA, 25 bp, Rattus norvegicus
cattccgtagttctgtgtagttcat

SEQ ID NO: 241217 - DNA, 25 bp, Rattus norvegicus
cattccgtagttgtgtgtagttcat

SEQ ID NO: 241218 - DNA, 25 bp, Rattus norvegicus
cattccgttactctgccctgtgtaa

SEQ ID NO: 241219 - DNA, 25 bp, Rattus norvegicus
cattccgttactgtgccctgtgtaa

SEQ ID NO: 241220 - DNA, 25 bp, Rattus norvegicus
cattccgtttagacccaatagggca

SEQ ID NO: 241221 - DNA, 25 bp, Rattus norvegicus
cattccgtttagtcccaatagggca

SEQ ID NO: 241222 - DNA, 25 bp, Rattus norvegicus
cattcctaggtaagtcagtcccaat

SEQ ID NO: 241223 - DNA, 25 bp, Rattus norvegicus
cattcctaggtatgtcagtcccaat

SEQ ID NO: 241224 - DNA, 25 bp, Rattus norvegicus
cattcctagtctctccctagcttgc

SEQ ID NO: 241225 - DNA, 25 bp, Rattus norvegicus
cattcctagtctgtccctagcttgc

SEQ ID NO: 241226 - DNA, 25 bp, Rattus norvegicus
cattcctctcacatgtggctaaggg

SEQ ID NO: 241227 - DNA, 25 bp, Rattus norvegicus
cattcctctcacttgtggctaaggg

SEQ ID NO: 241228 - DNA, 25 bp, Rattus norvegicus
cattcctctcttacaccaatgtgaa

SEQ ID NO: 241229 - DNA, 25 bp, Rattus norvegicus
cattcctctctttcaccaatgtgaa

SEQ ID NO: 241230 - DNA, 25 bp, Rattus norvegicus
cattcctcttatcgtcattgtttta

SEQ ID NO: 241231 - DNA, 25 bp, Rattus norvegicus
cattcctcttatggtcattgtttta

SEQ ID NO: 241232 - DNA, 25 bp, Rattus norvegicus
cattcctctttgactgtggacagaa

SEQ ID NO: 241233 - DNA, 25 bp, Rattus norvegicus
cattcctctttgtctgtggacagaa

SEQ ID NO: 241234 - DNA, 25 bp, Rattus norvegicus
cattcctgagctcgtatgcacaacc

SEQ ID NO: 241235 - DNA, 25 bp, Rattus norvegicus
cattcctgagctggtatgcacaacc

SEQ ID NO: 241236 - DNA, 25 bp, Rattus norvegicus
cattcctgaggtcttttatctgttg

SEQ ID NO: 241237 - DNA, 25 bp, Rattus norvegicus
cattcctgaggtgttttatctgttg

SEQ ID NO: 241238 - DNA, 25 bp, Rattus norvegicus
cattcctgcaaactccatcctgaaa

SEQ ID NO: 241239 - DNA, 25 bp, Rattus norvegicus
cattcctgcaaagtccatcctgaaa

SEQ ID NO: 241240 - DNA, 25 bp, Rattus norvegicus
cattcctgctgccttagacaagaca

SEQ ID NO: 241241 - DNA, 25 bp, Rattus norvegicus
cattcctgctgcgttagacaagaca

SEQ ID NO: 241242 - DNA, 25 bp, Rattus norvegicus
cattcctggctgcatcccattggta

SEQ ID NO: 241243 - DNA, 25 bp, Rattus norvegicus
cattcctggctggatcccattggta

SEQ ID NO: 241244 - DNA, 25 bp, Rattus norvegicus
cattcctggttcattgttcttactt

SEQ ID NO: 241245 - DNA, 25 bp, Rattus norvegicus
cattcctggttctttgttcttactt

SEQ ID NO: 241246 - DNA, 25 bp, Rattus norvegicus
cattcctggtttatgtctgcactaa

SEQ ID NO: 241247 - DNA, 25 bp, Rattus norvegicus
cattcctggtttttgtctgcactaa

SEQ ID NO: 241248 - DNA, 25 bp, Rattus norvegicus
cattcctgtagaaaagtgattccaa

SEQ ID NO: 241249 - DNA, 25 bp, Rattus norvegicus
cattcctgtagataagtgattccaa

SEQ ID NO: 241250 - DNA, 25 bp, Rattus norvegicus
cattcctgtggtctctagtagtaat

SEQ ID NO: 241251 - DNA, 25 bp, Rattus norvegicus
cattcctgtggtgtctagtagtaat

SEQ ID NO: 241252 - DNA, 25 bp, Rattus norvegicus
cattcctgtgtaaggtgtccagagt

SEQ ID NO: 241253 - DNA, 25 bp, Rattus norvegicus
cattcctgtgtatggtgtccagagt

SEQ ID NO: 241254 - DNA, 25 bp, Rattus norvegicus
cattcctgttccctaatccttggtt

SEQ ID NO: 241255 - DNA, 25 bp, Rattus norvegicus
cattcctgttccgtaatccttggtt

SEQ ID NO: 241256 - DNA, 25 bp, Rattus norvegicus
cattccttagtcaggctcagttttt

SEQ ID NO: 241257 - DNA, 25 bp, Rattus norvegicus
cattccttagtcattccaggcggat

SEQ ID NO: 241258 - DNA, 25 bp, Rattus norvegicus
cattccttagtctggctcagttttt

SEQ ID NO: 241259 - DNA, 25 bp, Rattus norvegicus
cattccttagtctttccaggcggat

SEQ ID NO: 241260 - DNA, 25 bp, Rattus norvegicus
cattccttcactcgcgctggagact

SEQ ID NO: 241261 - DNA, 25 bp, Rattus norvegicus
cattccttcactggcgctggagact

SEQ ID NO: 241262 - DNA, 25 bp, Rattus norvegicus
cattccttcagtctgttggtgcaaa

SEQ ID NO: 241263 - DNA, 25 bp, Rattus norvegicus
cattccttcagtgtgttggtgcaaa

SEQ ID NO: 241264 - DNA, 25 bp, Rattus norvegicus
cattccttcctaacaggcattcaag

SEQ ID NO: 241265 - DNA, 25 bp, Rattus norvegicus
cattccttcctatcaggcattcaag

SEQ ID NO: 241266 - DNA, 25 bp, Rattus norvegicus
cattccttccttatggttgttgttg

SEQ ID NO: 241267 - DNA, 25 bp, Rattus norvegicus
cattccttccttccacagtatacaa

SEQ ID NO: 241268 - DNA, 25 bp, Rattus norvegicus
cattccttccttgcacagtatacaa

SEQ ID NO: 241269 - DNA, 25 bp, Rattus norvegicus
cattccttccttttggttgttgttg

SEQ ID NO: 241270 - DNA, 25 bp, Rattus norvegicus
cattccttgtaaccactgagtgtcc

SEQ ID NO: 241271 - DNA, 25 bp, Rattus norvegicus
cattccttgtaagcactgagtgtcc

SEQ ID NO: 241272 - DNA, 25 bp, Rattus norvegicus
cattccttgtatcctgttgaccaca

SEQ ID NO: 241273 - DNA, 25 bp, Rattus norvegicus
cattccttgtatgctgttgaccaca

SEQ ID NO: 241274 - DNA, 25 bp, Rattus norvegicus
cattccttgtctccttaggtggcaa

SEQ ID NO: 241275 - DNA, 25 bp, Rattus norvegicus
cattccttgtctgcttaggtggcaa

SEQ ID NO: 241276 - DNA, 25 bp, Rattus norvegicus
cattcctttcaaccctctgtgtgag

SEQ ID NO: 241277 - DNA, 25 bp, Rattus norvegicus
cattcctttcaagcctctgtgtgag

SEQ ID NO: 241278 - DNA, 25 bp, Rattus norvegicus
cattcctttgctatgacaccttgga

SEQ ID NO: 241279 - DNA, 25 bp, Rattus norvegicus
cattcctttgctttgacaccttgga

SEQ ID NO: 241280 - DNA, 25 bp, Rattus norvegicus
cattcctttgtgatagcctgtggca

SEQ ID NO: 241281 - DNA, 25 bp, Rattus norvegicus
cattcctttgtgttagcctgtggca

SEQ ID NO: 241282 - DNA, 25 bp, Rattus norvegicus
cattccttttctcatgtgccaataa

SEQ ID NO: 241283 - DNA, 25 bp, Rattus norvegicus
cattccttttctgatgtgccaataa

SEQ ID NO: 241284 - DNA, 25 bp, Rattus norvegicus
cattcgagtttgcatctgcaggtgt

SEQ ID NO: 241285 - DNA, 25 bp, Rattus norvegicus
cattcgagtttggatctgcaggtgt

SEQ ID NO: 241286 - DNA, 25 bp, Rattus norvegicus
cattcgatatatacagcagggactt

SEQ ID NO: 241287 - DNA, 25 bp, Rattus norvegicus
cattcgatatattcagcagggactt

SEQ ID NO: 241288 - DNA, 25 bp, Rattus norvegicus
cattcgccctgaatctagacattaa

SEQ ID NO: 241289 - DNA, 25 bp, Rattus norvegicus
cattcgccctgattctagacattaa

SEQ ID NO: 241290 - DNA, 25 bp, Rattus norvegicus
cattcgcctgttcctggagtataca

SEQ ID NO: 241291 - DNA, 25 bp, Rattus norvegicus
cattcgcctgttgctggagtataca

SEQ ID NO: 241292 - DNA, 25 bp, Rattus norvegicus
cattcgctcaagatggcagaccaga

SEQ ID NO: 241293 - DNA, 25 bp, Rattus norvegicus
cattcgctcaagttggcagaccaga

SEQ ID NO: 241294 - DNA, 25 bp, Rattus norvegicus
cattcgctcgttacctggttttgat

SEQ ID NO: 241295 - DNA, 25 bp, Rattus norvegicus
cattcgctcgtttcctggttttgat

SEQ ID NO: 241296 - DNA, 25 bp, Rattus norvegicus
cattcgctgatgaaatttgctatac

SEQ ID NO: 241297 - DNA, 25 bp, Rattus norvegicus
cattcgctgatgtaatttgctatac

SEQ ID NO: 241298 - DNA, 25 bp, Rattus norvegicus
cattcgcttcttctacagtttctta

SEQ ID NO: 241299 - DNA, 25 bp, Rattus norvegicus
cattcgcttcttgtacagtttctta

SEQ ID NO: 241300 - DNA, 25 bp, Rattus norvegicus
cattcgctttgcacctgatttaaaa

SEQ ID NO: 241301 - DNA, 25 bp, Rattus norvegicus
cattcgctttgctcctgatttaaaa

SEQ ID NO: 241302 - DNA, 25 bp, Rattus norvegicus
cattcgctttggcatcagtacgcac

SEQ ID NO: 241303 - DNA, 25 bp, Rattus norvegicus
cattcgctttgggatcagtacgcac

SEQ ID NO: 241304 - DNA, 25 bp, Rattus norvegicus
cattcggaacgacctcatggacgga

SEQ ID NO: 241305 - DNA, 25 bp, Rattus norvegicus
cattcggaacgagctcatggacgga

SEQ ID NO: 241306 - DNA, 25 bp, Rattus norvegicus
cattcggagcgactggacaaaccca

SEQ ID NO: 241307 - DNA, 25 bp, Rattus norvegicus
cattcggagcgagtggacaaaccca

SEQ ID NO: 241308 - DNA, 25 bp, Rattus norvegicus
cattcggcaccgcattgttcatttc

SEQ ID NO: 241309 - DNA, 25 bp, Rattus norvegicus
cattcggcaccggattgttcatttc

SEQ ID NO: 241310 - DNA, 25 bp, Rattus norvegicus
cattcggctcagctattggcactgg

SEQ ID NO: 241311 - DNA, 25 bp, Rattus norvegicus
cattcggctcaggtattggcactgg

SEQ ID NO: 241312 - DNA, 25 bp, Rattus norvegicus
cattcgggagttcctggaccagtat

SEQ ID NO: 241313 - DNA, 25 bp, Rattus norvegicus
cattcgggagttgctggaccagtat

SEQ ID NO: 241314 - DNA, 25 bp, Rattus norvegicus
cattcgggatttacacagcagccat

SEQ ID NO: 241315 - DNA, 25 bp, Rattus norvegicus
cattcgggattttcacagcagccat

SEQ ID NO: 241316 - DNA, 25 bp, Rattus norvegicus
cattcggtgacaactcataggtgaa

SEQ ID NO: 241317 - DNA, 25 bp, Rattus norvegicus
cattcggtgacatctcataggtgaa

SEQ ID NO: 241318 - DNA, 25 bp, Rattus norvegicus
cattcggttttcattgcagtttcgt

SEQ ID NO: 241319 - DNA, 25 bp, Rattus norvegicus
cattcggttttctttgcagtttcgt

SEQ ID NO: 241320 - DNA, 25 bp, Rattus norvegicus
cattcgtaaggaaagctgtgcggac

SEQ ID NO: 241321 - DNA, 25 bp, Rattus norvegicus
cattcgtaaggatagctgtgcggac

SEQ ID NO: 241322 - DNA, 25 bp, Rattus norvegicus
cattcgtcagcgacaattggacaga

SEQ ID NO: 241323 - DNA, 25 bp, Rattus norvegicus
cattcgtcagcgtcaattggacaga

SEQ ID NO: 241324 - DNA, 25 bp, Rattus norvegicus
cattcgtcttcactctgcgtgttaa

SEQ ID NO: 241325 - DNA, 25 bp, Rattus norvegicus
cattcgtcttcagtctgcgtgttaa

SEQ ID NO: 241326 - DNA, 25 bp, Rattus norvegicus
cattcgtgcaatatcatttcatcaa

SEQ ID NO: 241327 - DNA, 25 bp, Rattus norvegicus
cattcgtgcaatttcatttcatcaa

SEQ ID NO: 241328 - DNA, 25 bp, Rattus norvegicus
cattcgtgggaaccgcagctggtcc

SEQ ID NO: 241329 - DNA, 25 bp, Rattus norvegicus
cattcgtgggaagcgcagctggtcc

SEQ ID NO: 241330 - DNA, 25 bp, Rattus norvegicus
cattctaaaggcacggagctcactg

SEQ ID NO: 241331 - DNA, 25 bp, Rattus norvegicus
cattctaaaggctcggagctcactg

SEQ ID NO: 241332 - DNA, 25 bp, Rattus norvegicus
cattctaacccacttttcagatctt

SEQ ID NO: 241333 - DNA, 25 bp, Rattus norvegicus
cattctaacccagttttcagatctt

SEQ ID NO: 241334 - DNA, 25 bp, Rattus norvegicus
cattctaagaatccatttattggag

SEQ ID NO: 241335 - DNA, 25 bp, Rattus norvegicus
cattctaagaatgcatttattggag

SEQ ID NO: 241336 - DNA, 25 bp, Rattus norvegicus
cattctactgatctgcttgactgaa

SEQ ID NO: 241337 - DNA, 25 bp, Rattus norvegicus
cattctactgatgtgcttgactgaa

SEQ ID NO: 241338 - DNA, 25 bp, Rattus norvegicus
cattctactttacccctataactgg

SEQ ID NO: 241339 - DNA, 25 bp, Rattus norvegicus
cattctactttagccctataactgg

SEQ ID NO: 241340 - DNA, 25 bp, Rattus norvegicus
cattctagctctatgcatgtacctt

SEQ ID NO: 241341 - DNA, 25 bp, Rattus norvegicus
cattctagctctttgcatgtacctt

SEQ ID NO: 241342 - DNA, 25 bp, Rattus norvegicus
cattctagtgcccagtgtagcatta

SEQ ID NO: 241343 - DNA, 25 bp, Rattus norvegicus
cattctagtgccgagtgtagcatta

SEQ ID NO: 241344 - DNA, 25 bp, Rattus norvegicus
cattctatccctagcttcagttctc

SEQ ID NO: 241345 - DNA, 25 bp, Rattus norvegicus
cattctatcccttgcttcagttctc

SEQ ID NO: 241346 - DNA, 25 bp, Rattus norvegicus
cattctattcttcgtccaggaaagt

SEQ ID NO: 241347 - DNA, 25 bp, Rattus norvegicus
cattctattcttggtccaggaaagt

SEQ ID NO: 241348 - DNA, 25 bp, Rattus norvegicus
cattctattgtgatgtcttctgaca

SEQ ID NO: 241349 - DNA, 25 bp, Rattus norvegicus
cattctattgtgttgtcttctgaca

SEQ ID NO: 241350 - DNA, 25 bp, Rattus norvegicus
cattctcaaatactgctgttactgt

SEQ ID NO: 241351 - DNA, 25 bp, Rattus norvegicus
cattctcaaatagtgctgttactgt

SEQ ID NO: 241352 - DNA, 25 bp, Rattus norvegicus
cattctcagagacgtggcacaagtt

SEQ ID NO: 241353 - DNA, 25 bp, Rattus norvegicus
cattctcagagaggtggcacaagtt

SEQ ID NO: 241354 - DNA, 25 bp, Rattus norvegicus
cattctcagcctctttgtcaacgtg

SEQ ID NO: 241355 - DNA, 25 bp, Rattus norvegicus
cattctcagcctgtttgtcaacgtg

SEQ ID NO: 241356 - DNA, 25 bp, Rattus norvegicus
cattctcaggtgaagctgtgtgcac

SEQ ID NO: 241357 - DNA, 25 bp, Rattus norvegicus
cattctcaggtgtagctgtgtgcac

SEQ ID NO: 241358 - DNA, 25 bp, Rattus norvegicus
cattctcagtttctttcctacaaaa

SEQ ID NO: 241359 - DNA, 25 bp, Rattus norvegicus
cattctcagtttgtttcctacaaaa

SEQ ID NO: 241360 - DNA, 25 bp, Rattus norvegicus
cattctcatatcactgtttcttcct

SEQ ID NO: 241361 - DNA, 25 bp, Rattus norvegicus
cattctcatatctctgtttcttcct

SEQ ID NO: 241362 - DNA, 25 bp, Rattus norvegicus
cattctcatcagacgcaatgattca

SEQ ID NO: 241363 - DNA, 25 bp, Rattus norvegicus
cattctcatcagtcgcaatgattca

SEQ ID NO: 241364 - DNA, 25 bp, Rattus norvegicus
cattctcatcatcggaccatcactt

SEQ ID NO: 241365 - DNA, 25 bp, Rattus norvegicus
cattctcatcatgggaccatcactt

SEQ ID NO: 241366 - DNA, 25 bp, Rattus norvegicus
cattctcatctgaagcaaaggccct

SEQ ID NO: 241367 - DNA, 25 bp, Rattus norvegicus
cattctcatctgtagcaaaggccct

SEQ ID NO: 241368 - DNA, 25 bp, Rattus norvegicus
cattctcatggccactgcatattta

SEQ ID NO: 241369 - DNA, 25 bp, Rattus norvegicus
cattctcatggcgactgcatattta

SEQ ID NO: 241370 - DNA, 25 bp, Rattus norvegicus
cattctccactaaagttagaccctc

SEQ ID NO: 241371 - DNA, 25 bp, Rattus norvegicus
cattctccactatagttagaccctc

SEQ ID NO: 241372 - DNA, 25 bp, Rattus norvegicus
cattctccaggaccatgggaacaat

SEQ ID NO: 241373 - DNA, 25 bp, Rattus norvegicus
cattctccaggagcatgggaacaat

SEQ ID NO: 241374 - DNA, 25 bp, Rattus norvegicus
cattctccatgaagacaatgtgtgg

SEQ ID NO: 241375 - DNA, 25 bp, Rattus norvegicus
cattctccatgatgacaatgtgtgg

SEQ ID NO: 241376 - DNA, 25 bp, Rattus norvegicus
cattctcccagaaagccttaggtaa

SEQ ID NO: 241377 - DNA, 25 bp, Rattus norvegicus
cattctcccagatagccttaggtaa

SEQ ID NO: 241378 - DNA, 25 bp, Rattus norvegicus
cattctccccagaacctgtaagtat

SEQ ID NO: 241379 - DNA, 25 bp, Rattus norvegicus
cattctccccagtacctgtaagtat

SEQ ID NO: 241380 - DNA, 25 bp, Rattus norvegicus
cattctcctcagcaaaagattccgc

SEQ ID NO: 241381 - DNA, 25 bp, Rattus norvegicus
cattctcctcaggaaaagattccgc

SEQ ID NO: 241382 - DNA, 25 bp, Rattus norvegicus
cattctcgtgctataggagctgtag

SEQ ID NO: 241383 - DNA, 25 bp, Rattus norvegicus
cattctcgtgctttaggagctgtag

SEQ ID NO: 241384 - DNA, 25 bp, Rattus norvegicus
cattctctcattatttccccattga

SEQ ID NO: 241385 - DNA, 25 bp, Rattus norvegicus
cattctctcattttttccccattga

SEQ ID NO: 241386 - DNA, 25 bp, Rattus norvegicus
cattctctccctactgcttcaaaga

SEQ ID NO: 241387 - DNA, 25 bp, Rattus norvegicus
cattctctcccttctgcttcaaaga

SEQ ID NO: 241388 - DNA, 25 bp, Rattus norvegicus
cattctctctgcctgtagacaagga

SEQ ID NO: 241389 - DNA, 25 bp, Rattus norvegicus
cattctctctgcgtgtagacaagga

SEQ ID NO: 241390 - DNA, 25 bp, Rattus norvegicus
cattctctcttgatccaaaactcta

SEQ ID NO: 241391 - DNA, 25 bp, Rattus norvegicus
cattctctcttgttccaaaactcta

SEQ ID NO: 241392 - DNA, 25 bp, Rattus norvegicus
cattctctgaataagcgattaatcg

SEQ ID NO: 241393 - DNA, 25 bp, Rattus norvegicus
cattctctgaattagcgattaatcg

SEQ ID NO: 241394 - DNA, 25 bp, Rattus norvegicus
cattctctgcctagtgacttgggag

SEQ ID NO: 241395 - DNA, 25 bp, Rattus norvegicus
cattctctgccttgtgacttgggag

SEQ ID NO: 241396 - DNA, 25 bp, Rattus norvegicus
cattctcttgtcattcaagggatct

SEQ ID NO: 241397 - DNA, 25 bp, Rattus norvegicus
cattctcttgtctttcaagggatct

SEQ ID NO: 241398 - DNA, 25 bp, Rattus norvegicus
cattctcttgttccaggtgctgcta

SEQ ID NO: 241399 - DNA, 25 bp, Rattus norvegicus
cattctcttgttgcaggtgctgcta

SEQ ID NO: 241400 - DNA, 25 bp, Rattus norvegicus
cattctgacaggactagttcccaat

SEQ ID NO: 241401 - DNA, 25 bp, Rattus norvegicus
cattctgacaggtctagttcccaat

SEQ ID NO: 241402 - DNA, 25 bp, Rattus norvegicus
cattctgactaccttgggcaagcta

SEQ ID NO: 241403 - DNA, 25 bp, Rattus norvegicus
cattctgactacgttgggcaagcta

SEQ ID NO: 241404 - DNA, 25 bp, Rattus norvegicus
cattctgagatgacatcccattcca

SEQ ID NO: 241405 - DNA, 25 bp, Rattus norvegicus
cattctgagatgtcatcccattcca

SEQ ID NO: 241406 - DNA, 25 bp, Rattus norvegicus
cattctgagttcagtgtgttgtcaa

SEQ ID NO: 241407 - DNA, 25 bp, Rattus norvegicus
cattctgagttctgtgtgttgtcaa

SEQ ID NO: 241408 - DNA, 25 bp, Rattus norvegicus
cattctgatgttctgcttcctgagt

SEQ ID NO: 241409 - DNA, 25 bp, Rattus norvegicus
cattctgatgttgtgcttcctgagt

SEQ ID NO: 241410 - DNA, 25 bp, Rattus norvegicus
cattctgatttcatcccggttctta

SEQ ID NO: 241411 - DNA, 25 bp, Rattus norvegicus
cattctgatttcttcccggttctta

SEQ ID NO: 241412 - DNA, 25 bp, Rattus norvegicus
cattctgcaggaaagccaccagtct

SEQ ID NO: 241413 - DNA, 25 bp, Rattus norvegicus
cattctgcaggatagccaccagtct

SEQ ID NO: 241414 - DNA, 25 bp, Rattus norvegicus
cattctgcatgtactatctggtgtg

SEQ ID NO: 241415 - DNA, 25 bp, Rattus norvegicus
cattctgcatgttctatctggtgtg

SEQ ID NO: 241416 - DNA, 25 bp, Rattus norvegicus
cattctgctcacctttgttcaaaag

SEQ ID NO: 241417 - DNA, 25 bp, Rattus norvegicus
cattctgctcacgtttgttcaaaag

SEQ ID NO: 241418 - DNA, 25 bp, Rattus norvegicus
cattctggaaggacctcgtcagggt

SEQ ID NO: 241419 - DNA, 25 bp, Rattus norvegicus
cattctggaaggtcctcgtcagggt

SEQ ID NO: 241420 - DNA, 25 bp, Rattus norvegicus
cattctggatatagctgggtttgaa

SEQ ID NO: 241421 - DNA, 25 bp, Rattus norvegicus
cattctggatattgctgggtttgaa

SEQ ID NO: 241422 - DNA, 25 bp, Rattus norvegicus
cattctggatggatcggctgcacga

SEQ ID NO: 241423 - DNA, 25 bp, Rattus norvegicus
cattctggatggttcggctgcacga

SEQ ID NO: 241424 - DNA, 25 bp, Rattus norvegicus
cattctgggactaattgcttcctcc

SEQ ID NO: 241425 - DNA, 25 bp, Rattus norvegicus
cattctgggacttattgcttcctcc

SEQ ID NO: 241426 - DNA, 25 bp, Rattus norvegicus
cattctgggcatctccagtctggaa

SEQ ID NO: 241427 - DNA, 25 bp, Rattus norvegicus
cattctgggcatgtccagtctggaa

SEQ ID NO: 241428 - DNA, 25 bp, Rattus norvegicus
cattctgggctgcaacgatgacaca

SEQ ID NO: 241429 - DNA, 25 bp, Rattus norvegicus
cattctgggctggaacgatgacaca

SEQ ID NO: 241430 - DNA, 25 bp, Rattus norvegicus
cattctggtgctcgacattttcttt

SEQ ID NO: 241431 - DNA, 25 bp, Rattus norvegicus
cattctggtgctggacattttcttt

SEQ ID NO: 241432 - DNA, 25 bp, Rattus norvegicus
cattctgtaagtatagtccatccct

SEQ ID NO: 241433 - DNA, 25 bp, Rattus norvegicus
cattctgtaagtttagtccatccct

SEQ ID NO: 241434 - DNA, 25 bp, Rattus norvegicus
cattctgtacctctgctgaagtacg

SEQ ID NO: 241435 - DNA, 25 bp, Rattus norvegicus
cattctgtacctgtgctgaagtacg

SEQ ID NO: 241436 - DNA, 25 bp, Rattus norvegicus
cattctgtatatatctcctaccatc

SEQ ID NO: 241437 - DNA, 25 bp, Rattus norvegicus
cattctgtatatttctcctaccatc

SEQ ID NO: 241438 - DNA, 25 bp, Rattus norvegicus
cattctgtattaacttcaggctgtg

SEQ ID NO: 241439 - DNA, 25 bp, Rattus norvegicus
cattctgtattatcttcaggctgtg

SEQ ID NO: 241440 - DNA, 25 bp, Rattus norvegicus
cattctgtattcctttctcttattt

SEQ ID NO: 241441 - DNA, 25 bp, Rattus norvegicus
cattctgtattcgtttctcttattt

SEQ ID NO: 241442 - DNA, 25 bp, Rattus norvegicus
cattctgtgctaagaccagtcttta

SEQ ID NO: 241443 - DNA, 25 bp, Rattus norvegicus
cattctgtgctatgaccagtcttta

SEQ ID NO: 241444 - DNA, 25 bp, Rattus norvegicus
cattctgtgctgaacacgtcccaaa

SEQ ID NO: 241445 - DNA, 25 bp, Rattus norvegicus
cattctgtgctgtacacgtcccaaa

SEQ ID NO: 241446 - DNA, 25 bp, Rattus norvegicus
cattctgtggcacagcatagctcct

SEQ ID NO: 241447 - DNA, 25 bp, Rattus norvegicus
cattctgtggcagagcatagctcct

SEQ ID NO: 241448 - DNA, 25 bp, Rattus norvegicus
cattctgtgtgtagttcgttgtaaa

SEQ ID NO: 241449 - DNA, 25 bp, Rattus norvegicus
cattctgtgtgttgttcgttgtaaa

SEQ ID NO: 241450 - DNA, 25 bp, Rattus norvegicus
cattctgtgttcaattggtgaggtt

SEQ ID NO: 241451 - DNA, 25 bp, Rattus norvegicus
cattctgtgttctattggtgaggtt

SEQ ID NO: 241452 - DNA, 25 bp, Rattus norvegicus
cattctgtgttgctctgcctcaaaa

SEQ ID NO: 241453 - DNA, 25 bp, Rattus norvegicus
cattctgtgttggtctgcctcaaaa

SEQ ID NO: 241454 - DNA, 25 bp, Rattus norvegicus
cattctgttatcaaccagcatggag

SEQ ID NO: 241455 - DNA, 25 bp, Rattus norvegicus
cattctgttatctaccagcatggag

SEQ ID NO: 241456 - DNA, 25 bp, Rattus norvegicus
cattctgttcttcatttctgaggac

SEQ ID NO: 241457 - DNA, 25 bp, Rattus norvegicus
cattctgttcttgatttctgaggac

SEQ ID NO: 241458 - DNA, 25 bp, Rattus norvegicus
cattctgtttcgaaccttgagagca

SEQ ID NO: 241459 - DNA, 25 bp, Rattus norvegicus
cattctgtttcgtaccttgagagca

SEQ ID NO: 241460 - DNA, 25 bp, Rattus norvegicus
cattctgtttgacggagcctggtca

SEQ ID NO: 241461 - DNA, 25 bp, Rattus norvegicus
cattctgtttgagggagcctggtca

SEQ ID NO: 241462 - DNA, 25 bp, Rattus norvegicus
cattcttaactcagcattctggctt

SEQ ID NO: 241463 - DNA, 25 bp, Rattus norvegicus
cattcttaactctgcattctggctt

SEQ ID NO: 241464 - DNA, 25 bp, Rattus norvegicus
cattcttacattccagcatcgcctg

SEQ ID NO: 241465 - DNA, 25 bp, Rattus norvegicus
cattcttacattgcagcatcgcctg

SEQ ID NO: 241466 - DNA, 25 bp, Rattus norvegicus
cattcttagtgcaccttgtgagaaa

SEQ ID NO: 241467 - DNA, 25 bp, Rattus norvegicus
cattcttagtgctccttgtgagaaa

SEQ ID NO: 241468 - DNA, 25 bp, Rattus norvegicus
cattcttcaaggctctgttttgttt

SEQ ID NO: 241469 - DNA, 25 bp, Rattus norvegicus
cattcttcaagggtctgttttgttt

SEQ ID NO: 241470 - DNA, 25 bp, Rattus norvegicus
cattcttcagggaagtttgggaaca

SEQ ID NO: 241471 - DNA, 25 bp, Rattus norvegicus
cattcttcagggtagtttgggaaca

SEQ ID NO: 241472 - DNA, 25 bp, Rattus norvegicus
cattcttcagttagggttgtttcat

SEQ ID NO: 241473 - DNA, 25 bp, Rattus norvegicus
cattcttcagttcagagacatctaa

SEQ ID NO: 241474 - DNA, 25 bp, Rattus norvegicus
cattcttcagttgagagacatctaa

SEQ ID NO: 241475 - DNA, 25 bp, Rattus norvegicus
cattcttcagtttgggttgtttcat

SEQ ID NO: 241476 - DNA, 25 bp, Rattus norvegicus
cattcttccaccattgatgctgggg

SEQ ID NO: 241477 - DNA, 25 bp, Rattus norvegicus
cattcttccacctttgatgctgggg

SEQ ID NO: 241478 - DNA, 25 bp, Rattus norvegicus
cattcttcctctccagatatttttg

SEQ ID NO: 241479 - DNA, 25 bp, Rattus norvegicus
cattcttcctctgcagatatttttg

SEQ ID NO: 241480 - DNA, 25 bp, Rattus norvegicus
cattcttcgatgagccctaactggg

SEQ ID NO: 241481 - DNA, 25 bp, Rattus norvegicus
cattcttcgatgtgccctaactggg

SEQ ID NO: 241482 - DNA, 25 bp, Rattus norvegicus
cattcttcggagagctcagtgacaa

SEQ ID NO: 241483 - DNA, 25 bp, Rattus norvegicus
cattcttcggagtgctcagtgacaa

SEQ ID NO: 241484 - DNA, 25 bp, Rattus norvegicus
cattcttctaagctgtctcttgtga

SEQ ID NO: 241485 - DNA, 25 bp, Rattus norvegicus
cattcttctaaggtgtctcttgtga

SEQ ID NO: 241486 - DNA, 25 bp, Rattus norvegicus
cattcttctaccctgatgtcataac

SEQ ID NO: 241487 - DNA, 25 bp, Rattus norvegicus
cattcttctaccgtgatgtcataac

SEQ ID NO: 241488 - DNA, 25 bp, Rattus norvegicus
cattcttctgaccttgcacttaata

SEQ ID NO: 241489 - DNA, 25 bp, Rattus norvegicus
cattcttctgacgttgcacttaata

SEQ ID NO: 241490 - DNA, 25 bp, Rattus norvegicus
cattcttctggtatgtactgcgtta

SEQ ID NO: 241491 - DNA, 25 bp, Rattus norvegicus
cattcttctggtttgtactgcgtta

SEQ ID NO: 241492 - DNA, 25 bp, Rattus norvegicus
cattcttcttaaacctcactcaaaa

SEQ ID NO: 241493 - DNA, 25 bp, Rattus norvegicus
cattcttcttaatcctcactcaaaa

SEQ ID NO: 241494 - DNA, 25 bp, Rattus norvegicus
cattcttgagtcacatgccctgctt

SEQ ID NO: 241495 - DNA, 25 bp, Rattus norvegicus
cattcttgagtctcatgccctgctt

SEQ ID NO: 241496 - DNA, 25 bp, Rattus norvegicus
cattcttgcttacttccactgcagt

SEQ ID NO: 241497 - DNA, 25 bp, Rattus norvegicus
cattcttgcttagttccactgcagt

SEQ ID NO: 241498 - DNA, 25 bp, Rattus norvegicus
cattcttgggatcacagagcagacc

SEQ ID NO: 241499 - DNA, 25 bp, Rattus norvegicus
cattcttgggatgacagagcagacc

SEQ ID NO: 241500 - DNA, 25 bp, Rattus norvegicus
cattcttgtctaatttttccctgca

SEQ ID NO: 241501 - DNA, 25 bp, Rattus norvegicus
cattcttgtctattttttccctgca

SEQ ID NO: 241502 - DNA, 25 bp, Rattus norvegicus
cattcttgtgtcaccatttggtact

SEQ ID NO: 241503 - DNA, 25 bp, Rattus norvegicus
cattcttgtgtctccatttggtact

SEQ ID NO: 241504 - DNA, 25 bp, Rattus norvegicus
cattcttgtttcctcgttgttgaac

SEQ ID NO: 241505 - DNA, 25 bp, Rattus norvegicus
cattcttgtttcgtcgttgttgaac

SEQ ID NO: 241506 - DNA, 25 bp, Rattus norvegicus
cattctttaaatctctccgataatt

SEQ ID NO: 241507 - DNA, 25 bp, Rattus norvegicus
cattctttaaatgtctccgataatt

SEQ ID NO: 241508 - DNA, 25 bp, Rattus norvegicus
cattctttagcgagacaggtctttc

SEQ ID NO: 241509 - DNA, 25 bp, Rattus norvegicus
cattctttagcgtgacaggtctttc

SEQ ID NO: 241510 - DNA, 25 bp, Rattus norvegicus
cattctttattcagggctcaggtca

SEQ ID NO: 241511 - DNA, 25 bp, Rattus norvegicus
cattctttattctgggctcaggtca

SEQ ID NO: 241512 - DNA, 25 bp, Rattus norvegicus
cattctttccctcttcattttaaag

SEQ ID NO: 241513 - DNA, 25 bp, Rattus norvegicus
cattctttccctgttcattttaaag

SEQ ID NO: 241514 - DNA, 25 bp, Rattus norvegicus
cattctttgactctctgcgtgcaga

SEQ ID NO: 241515 - DNA, 25 bp, Rattus norvegicus
cattctttgactgtctgcgtgcaga

SEQ ID NO: 241516 - DNA, 25 bp, Rattus norvegicus
cattctttgcagagaggaaggccac

SEQ ID NO: 241517 - DNA, 25 bp, Rattus norvegicus
cattctttgcagtgaggaaggccac

SEQ ID NO: 241518 - DNA, 25 bp, Rattus norvegicus
cattctttgcccctctttatttcta

SEQ ID NO: 241519 - DNA, 25 bp, Rattus norvegicus
cattctttgcccgtctttatttcta

SEQ ID NO: 241520 - DNA, 25 bp, Rattus norvegicus
cattctttggcaactgatgggcaga

SEQ ID NO: 241521 - DNA, 25 bp, Rattus norvegicus
cattctttggcatctgatgggcaga

SEQ ID NO: 241522 - DNA, 25 bp, Rattus norvegicus
cattctttgtttcggactgggtctt

SEQ ID NO: 241523 - DNA, 25 bp, Rattus norvegicus
cattctttgtttgggactgggtctt

SEQ ID NO: 241524 - DNA, 25 bp, Rattus norvegicus
cattcttttcccattcgtgagagtt

SEQ ID NO: 241525 - DNA, 25 bp, Rattus norvegicus
cattcttttccccaagacatcatga

SEQ ID NO: 241526 - DNA, 25 bp, Rattus norvegicus
cattcttttcccgaagacatcatga

SEQ ID NO: 241527 - DNA, 25 bp, Rattus norvegicus
cattcttttccctttcgtgagagtt

SEQ ID NO: 241528 - DNA, 25 bp, Rattus norvegicus
cattgaaaaagtccacctacccctt

SEQ ID NO: 241529 - DNA, 25 bp, Rattus norvegicus
cattgaaaaagtgcacctacccctt

SEQ ID NO: 241530 - DNA, 25 bp, Rattus norvegicus
cattgaaaactcagtcgctcgcgga

SEQ ID NO: 241531 - DNA, 25 bp, Rattus norvegicus
cattgaaaactctgtcgctcgcgga

SEQ ID NO: 241532 - DNA, 25 bp, Rattus norvegicus
cattgaaaccgtactctaagatgca

SEQ ID NO: 241533 - DNA, 25 bp, Rattus norvegicus
cattgaaaccgttctctaagatgca

SEQ ID NO: 241534 - DNA, 25 bp, Rattus norvegicus
cattgaaacctacctcataatttga

SEQ ID NO: 241535 - DNA, 25 bp, Rattus norvegicus
cattgaaacctagctcataatttga

SEQ ID NO: 241536 - DNA, 25 bp, Rattus norvegicus
cattgaaactgccttccaggcggaa

SEQ ID NO: 241537 - DNA, 25 bp, Rattus norvegicus
cattgaaactgcgttccaggcggaa

SEQ ID NO: 241538 - DNA, 25 bp, Rattus norvegicus
cattgaaacttacttgctgtgtgaa

SEQ ID NO: 241539 - DNA, 25 bp, Rattus norvegicus
cattgaaacttagttgctgtgtgaa

SEQ ID NO: 241540 - DNA, 25 bp, Rattus norvegicus
cattgaaagactcagagccccattt

SEQ ID NO: 241541 - DNA, 25 bp, Rattus norvegicus
cattgaaagactgagagccccattt

SEQ ID NO: 241542 - DNA, 25 bp, Rattus norvegicus
cattgaacccttatcttaacgtctc

SEQ ID NO: 241543 - DNA, 25 bp, Rattus norvegicus
cattgaacccttttcttaacgtctc

SEQ ID NO: 241544 - DNA, 25 bp, Rattus norvegicus
cattgaaggagacgaatcgagcagt

SEQ ID NO: 241545 - DNA, 25 bp, Rattus norvegicus
cattgaaggagaggaatcgagcagt

SEQ ID NO: 241546 - DNA, 25 bp, Rattus norvegicus
cattgaatgctgacgtctggtgtgt

SEQ ID NO: 241547 - DNA, 25 bp, Rattus norvegicus
cattgaatgctgtcgtctggtgtgt

SEQ ID NO: 241548 - DNA, 25 bp, Rattus norvegicus
cattgaattccaactcagggcagta

SEQ ID NO: 241549 - DNA, 25 bp, Rattus norvegicus
cattgaattccatctcagggcagta

SEQ ID NO: 241550 - DNA, 25 bp, Rattus norvegicus
cattgaatttacatcttaggtagtt

SEQ ID NO: 241551 - DNA, 25 bp, Rattus norvegicus
cattgaatttacttcttaggtagtt

SEQ ID NO: 241552 - DNA, 25 bp, Rattus norvegicus
cattgacaggttatctggagccctc

SEQ ID NO: 241553 - DNA, 25 bp, Rattus norvegicus
cattgacaggttttctggagccctc

SEQ ID NO: 241554 - DNA, 25 bp, Rattus norvegicus
cattgacagtgaagggcatcggtac

SEQ ID NO: 241555 - DNA, 25 bp, Rattus norvegicus
cattgacagtgatgggcatcggtac

SEQ ID NO: 241556 - DNA, 25 bp, Rattus norvegicus
cattgaccagacacgggcacgatgg

SEQ ID NO: 241557 - DNA, 25 bp, Rattus norvegicus
cattgaccagactcgggcacgatgg

SEQ ID NO: 241558 - DNA, 25 bp, Rattus norvegicus
cattgacgatgcaactgtgttttaa

SEQ ID NO: 241559 - DNA, 25 bp, Rattus norvegicus
cattgacgatgctactgtgttttaa

SEQ ID NO: 241560 - DNA, 25 bp, Rattus norvegicus
cattgacgttctatgtgtggtagca

SEQ ID NO: 241561 - DNA, 25 bp, Rattus norvegicus
cattgacgttctttgtgtggtagca

SEQ ID NO: 241562 - DNA, 25 bp, Rattus norvegicus
cattgacgttgtacgatcaggctac

SEQ ID NO: 241563 - DNA, 25 bp, Rattus norvegicus
cattgacgttgttcgatcaggctac

SEQ ID NO: 241564 - DNA, 25 bp, Rattus norvegicus
cattgactattaatacagcttggag

SEQ ID NO: 241565 - DNA, 25 bp, Rattus norvegicus
cattgactattattacagcttggag

SEQ ID NO: 241566 - DNA, 25 bp, Rattus norvegicus
cattgactcttgaggtgtgtgtcac

SEQ ID NO: 241567 - DNA, 25 bp, Rattus norvegicus
cattgactcttgtggtgtgtgtcac

SEQ ID NO: 241568 - DNA, 25 bp, Rattus norvegicus
cattgactttacagagctctttagg

SEQ ID NO: 241569 - DNA, 25 bp, Rattus norvegicus
cattgactttactgagctctttagg

SEQ ID NO: 241570 - DNA, 25 bp, Rattus norvegicus
cattgactttgtcaaactggcattt

SEQ ID NO: 241571 - DNA, 25 bp, Rattus norvegicus
cattgactttgtgaaactggcattt

SEQ ID NO: 241572 - DNA, 25 bp, Rattus norvegicus
cattgagacagaagtcacgctgtgt

SEQ ID NO: 241573 - DNA, 25 bp, Rattus norvegicus
cattgagacagatgtcacgctgtgt

SEQ ID NO: 241574 - DNA, 25 bp, Rattus norvegicus
cattgagactctcaatttggactct

SEQ ID NO: 241575 - DNA, 25 bp, Rattus norvegicus
cattgagactctgaatttggactct

SEQ ID NO: 241576 - DNA, 25 bp, Rattus norvegicus
cattgagagttgacgcttgaaccat

SEQ ID NO: 241577 - DNA, 25 bp, Rattus norvegicus
cattgagagttgtcgcttgaaccat

SEQ ID NO: 241578 - DNA, 25 bp, Rattus norvegicus
cattgagattgcacctcgtttgctg

SEQ ID NO: 241579 - DNA, 25 bp, Rattus norvegicus
cattgagattgctcctcgtttgctg

SEQ ID NO: 241580 - DNA, 25 bp, Rattus norvegicus
cattgagcccgactacatttatatt

SEQ ID NO: 241581 - DNA, 25 bp, Rattus norvegicus
cattgagcccgagtacatttatatt

SEQ ID NO: 241582 - DNA, 25 bp, Rattus norvegicus
cattgagctggtagcctaggttgct

SEQ ID NO: 241583 - DNA, 25 bp, Rattus norvegicus
cattgagctggttgcctaggttgct

SEQ ID NO: 241584 - DNA, 25 bp, Rattus norvegicus
cattgaggcgttagcttgaggtgct

SEQ ID NO: 241585 - DNA, 25 bp, Rattus norvegicus
cattgaggcgtttgcttgaggtgct

SEQ ID NO: 241586 - DNA, 25 bp, Rattus norvegicus
cattgaggctttctttggtttattt

SEQ ID NO: 241587 - DNA, 25 bp, Rattus norvegicus
cattgaggctttgtttggtttattt

SEQ ID NO: 241588 - DNA, 25 bp, Rattus norvegicus
cattgagggtctactttagtgctac

SEQ ID NO: 241589 - DNA, 25 bp, Rattus norvegicus
cattgagggtcttctttagtgctac

SEQ ID NO: 241590 - DNA, 25 bp, Rattus norvegicus
cattgaggtgacatgcgggctaata

SEQ ID NO: 241591 - DNA, 25 bp, Rattus norvegicus
cattgaggtgacttgcgggctaata

SEQ ID NO: 241592 - DNA, 25 bp, Rattus norvegicus
cattgagtatgtcacgcagaggaac

SEQ ID NO: 241593 - DNA, 25 bp, Rattus norvegicus
cattgagtatgtgacgcagaggaac

SEQ ID NO: 241594 - DNA, 25 bp, Rattus norvegicus
cattgagtcagaagcttgtgttagc

SEQ ID NO: 241595 - DNA, 25 bp, Rattus norvegicus
cattgagtcagatgcttgtgttagc

SEQ ID NO: 241596 - DNA, 25 bp, Rattus norvegicus
cattgagtctcactgctacgtgata

SEQ ID NO: 241597 - DNA, 25 bp, Rattus norvegicus
cattgagtctcagtgctacgtgata

SEQ ID NO: 241598 - DNA, 25 bp, Rattus norvegicus
cattgagtggtcagtgctgtgagtc

SEQ ID NO: 241599 - DNA, 25 bp, Rattus norvegicus
cattgagtggtctgtgctgtgagtc

SEQ ID NO: 241600 - DNA, 25 bp, Rattus norvegicus
cattgagtgtgtatggttgcagccg

SEQ ID NO: 241601 - DNA, 25 bp, Rattus norvegicus
cattgagtgtgtttggttgcagccg

SEQ ID NO: 241602 - DNA, 25 bp, Rattus norvegicus
cattgagtttcccttcacggtgacc

SEQ ID NO: 241603 - DNA, 25 bp, Rattus norvegicus
cattgagtttccgttcacggtgacc

SEQ ID NO: 241604 - DNA, 25 bp, Rattus norvegicus
cattgagtttctcagcagcttccag

SEQ ID NO: 241605 - DNA, 25 bp, Rattus norvegicus
cattgagtttctgagcagcttccag

SEQ ID NO: 241606 - DNA, 25 bp, Rattus norvegicus
cattgagttttgatggtcgtgcctg

SEQ ID NO: 241607 - DNA, 25 bp, Rattus norvegicus
cattgagttttgttggtcgtgcctg

SEQ ID NO: 241608 - DNA, 25 bp, Rattus norvegicus
cattgatatcacagatgggaacaca

SEQ ID NO: 241609 - DNA, 25 bp, Rattus norvegicus
cattgatatcactgatgggaacaca

SEQ ID NO: 241610 - DNA, 25 bp, Rattus norvegicus
cattgatgacccaatgatgccagcc

SEQ ID NO: 241611 - DNA, 25 bp, Rattus norvegicus
cattgatgaccctatgatgccagcc

SEQ ID NO: 241612 - DNA, 25 bp, Rattus norvegicus
cattgatgattaaggcgttgcctct

SEQ ID NO: 241613 - DNA, 25 bp, Rattus norvegicus
cattgatgattatggcgttgcctct

SEQ ID NO: 241614 - DNA, 25 bp, Rattus norvegicus
cattgatgcaaaacgggttcccatt

SEQ ID NO: 241615 - DNA, 25 bp, Rattus norvegicus
cattgatgcaaatcgggttcccatt

SEQ ID NO: 241616 - DNA, 25 bp, Rattus norvegicus
cattgatggttcactaaattggcta

SEQ ID NO: 241617 - DNA, 25 bp, Rattus norvegicus
cattgatggttctctaaattggcta

SEQ ID NO: 241618 - DNA, 25 bp, Rattus norvegicus
cattgattaagcatctgggcccaga

SEQ ID NO: 241619 - DNA, 25 bp, Rattus norvegicus
cattgattaagcttctgggcccaga

SEQ ID NO: 241620 - DNA, 25 bp, Rattus norvegicus
cattgattttaaacttcgggcccgg

SEQ ID NO: 241621 - DNA, 25 bp, Rattus norvegicus
cattgattttaatcttcgggcccgg

SEQ ID NO: 241622 - DNA, 25 bp, Rattus norvegicus
cattgattttctcgttgactgttta

SEQ ID NO: 241623 - DNA, 25 bp, Rattus norvegicus
cattgattttctggttgactgttta

SEQ ID NO: 241624 - DNA, 25 bp, Rattus norvegicus
cattgcaacaagctctcactgtctg

SEQ ID NO: 241625 - DNA, 25 bp, Rattus norvegicus
cattgcaacaaggtctcactgtctg

SEQ ID NO: 241626 - DNA, 25 bp, Rattus norvegicus
cattgcaagagtctgggctggccat

SEQ ID NO: 241627 - DNA, 25 bp, Rattus norvegicus
cattgcaagagtgtgggctggccat

SEQ ID NO: 241628 - DNA, 25 bp, Rattus norvegicus
cattgcaagtatcctcaaatgcccc

SEQ ID NO: 241629 - DNA, 25 bp, Rattus norvegicus
cattgcaagtatgctcaaatgcccc

SEQ ID NO: 241630 - DNA, 25 bp, Rattus norvegicus
cattgcacacgtcagccaggcatta

SEQ ID NO: 241631 - DNA, 25 bp, Rattus norvegicus
cattgcacacgtgagccaggcatta

SEQ ID NO: 241632 - DNA, 25 bp, Rattus norvegicus
cattgcactgtaaatccctgttaag

SEQ ID NO: 241633 - DNA, 25 bp, Rattus norvegicus
cattgcactgtatatccctgttaag

SEQ ID NO: 241634 - DNA, 25 bp, Rattus norvegicus
cattgcagccccacataagagttat

SEQ ID NO: 241635 - DNA, 25 bp, Rattus norvegicus
cattgcagcccctcataagagttat

SEQ ID NO: 241636 - DNA, 25 bp, Rattus norvegicus
cattgcatacaaatccaccaggctt

SEQ ID NO: 241637 - DNA, 25 bp, Rattus norvegicus
cattgcatacaattccaccaggctt

SEQ ID NO: 241638 - DNA, 25 bp, Rattus norvegicus
cattgcattgcacagtcaagagcag

SEQ ID NO: 241639 - DNA, 25 bp, Rattus norvegicus
cattgcattgcagagtcaagagcag

SEQ ID NO: 241640 - DNA, 25 bp, Rattus norvegicus
cattgcattttgacgtccttttaaa

SEQ ID NO: 241641 - DNA, 25 bp, Rattus norvegicus
cattgcattttgtcgtccttttaaa

SEQ ID NO: 241642 - DNA, 25 bp, Rattus norvegicus
cattgccaccctacacaagaagtgg

SEQ ID NO: 241643 - DNA, 25 bp, Rattus norvegicus
cattgccacccttcacaagaagtgg

SEQ ID NO: 241644 - DNA, 25 bp, Rattus norvegicus
cattgccactaaagtgactatgaac

SEQ ID NO: 241645 - DNA, 25 bp, Rattus norvegicus
cattgccactaatgtgactatgaac

SEQ ID NO: 241646 - DNA, 25 bp, Rattus norvegicus
cattgccaggcaccagattgtggaa

SEQ ID NO: 241647 - DNA, 25 bp, Rattus norvegicus
cattgccaggcagcagattgtggaa

SEQ ID NO: 241648 - DNA, 25 bp, Rattus norvegicus
cattgccaggctatgacaccaaggg

SEQ ID NO: 241649 - DNA, 25 bp, Rattus norvegicus
cattgccaggctttgacaccaaggg

SEQ ID NO: 241650 - DNA, 25 bp, Rattus norvegicus
cattgccagggtaccaaattcttct

SEQ ID NO: 241651 - DNA, 25 bp, Rattus norvegicus
cattgccagggttccaaattcttct

SEQ ID NO: 241652 - DNA, 25 bp, Rattus norvegicus
cattgccatcagacttacggactat

SEQ ID NO: 241653 - DNA, 25 bp, Rattus norvegicus
cattgccatcagtcttacggactat

SEQ ID NO: 241654 - DNA, 25 bp, Rattus norvegicus
cattgccatggaaacagctgggatg

SEQ ID NO: 241655 - DNA, 25 bp, Rattus norvegicus
cattgccatggatacagctgggatg

SEQ ID NO: 241656 - DNA, 25 bp, Rattus norvegicus
cattgcccactccagtgtgaattag

SEQ ID NO: 241657 - DNA, 25 bp, Rattus norvegicus
cattgcccactcgagtgtgaattag

SEQ ID NO: 241658 - DNA, 25 bp, Rattus norvegicus
cattgcccacttagtcactgtcagg

SEQ ID NO: 241659 - DNA, 25 bp, Rattus norvegicus
cattgcccactttgtcactgtcagg

SEQ ID NO: 241660 - DNA, 25 bp, Rattus norvegicus
cattgccccagcaagattttgaaag

SEQ ID NO: 241661 - DNA, 25 bp, Rattus norvegicus
cattgccccagctagattttgaaag

SEQ ID NO: 241662 - DNA, 25 bp, Rattus norvegicus
cattgccccattccgaggctgtgga

SEQ ID NO: 241663 - DNA, 25 bp, Rattus norvegicus
cattgccccattgcgaggctgtgga

SEQ ID NO: 241664 - DNA, 25 bp, Rattus norvegicus
cattgcccctgtctgggtttttata

SEQ ID NO: 241665 - DNA, 25 bp, Rattus norvegicus
cattgcccctgtgtgggtttttata

SEQ ID NO: 241666 - DNA, 25 bp, Rattus norvegicus
cattgcccggtgagtacggttcaaa

SEQ ID NO: 241667 - DNA, 25 bp, Rattus norvegicus
cattgcccggtgtgtacggttcaaa

SEQ ID NO: 241668 - DNA, 25 bp, Rattus norvegicus
cattgccctctaatctgtatggaat

SEQ ID NO: 241669 - DNA, 25 bp, Rattus norvegicus
cattgccctctattctgtatggaat

SEQ ID NO: 241670 - DNA, 25 bp, Rattus norvegicus
cattgccgaagtatttgttttccat

SEQ ID NO: 241671 - DNA, 25 bp, Rattus norvegicus
cattgccgaagtttttgttttccat

SEQ ID NO: 241672 - DNA, 25 bp, Rattus norvegicus
cattgcctagaaactgggacagctt

SEQ ID NO: 241673 - DNA, 25 bp, Rattus norvegicus
cattgcctagaatctgggacagctt

SEQ ID NO: 241674 - DNA, 25 bp, Rattus norvegicus
cattgcctcatccacttgaattagc

SEQ ID NO: 241675 - DNA, 25 bp, Rattus norvegicus
cattgcctcatcgacttgaattagc

SEQ ID NO: 241676 - DNA, 25 bp, Rattus norvegicus
cattgcctcgtaatagtgttgactt

SEQ ID NO: 241677 - DNA, 25 bp, Rattus norvegicus
cattgcctcgtattagtgttgactt

SEQ ID NO: 241678 - DNA, 25 bp, Rattus norvegicus
cattgcctgaataagtcgactgtgt

SEQ ID NO: 241679 - DNA, 25 bp, Rattus norvegicus
cattgcctgaatctctgaatactga

SEQ ID NO: 241680 - DNA, 25 bp, Rattus norvegicus
cattgcctgaatgtctgaatactga

SEQ ID NO: 241681 - DNA, 25 bp, Rattus norvegicus
cattgcctgaattagtcgactgtgt

SEQ ID NO: 241682 - DNA, 25 bp, Rattus norvegicus
cattgcctggcacatacatattatg

SEQ ID NO: 241683 - DNA, 25 bp, Rattus norvegicus
cattgcctggcagatacatattatg

SEQ ID NO: 241684 - DNA, 25 bp, Rattus norvegicus
cattgcctgtgaccctaggatcata

SEQ ID NO: 241685 - DNA, 25 bp, Rattus norvegicus
cattgcctgtgagcctaggatcata

SEQ ID NO: 241686 - DNA, 25 bp, Rattus norvegicus
cattgcctgttcaggaggccaccct

SEQ ID NO: 241687 - DNA, 25 bp, Rattus norvegicus
cattgcctgttctggaggccaccct

SEQ ID NO: 241688 - DNA, 25 bp, Rattus norvegicus
cattgccttatgatggataccgata

SEQ ID NO: 241689 - DNA, 25 bp, Rattus norvegicus
cattgccttatgttggataccgata

SEQ ID NO: 241690 - DNA, 25 bp, Rattus norvegicus
cattgcctttgtattctgctttaag

SEQ ID NO: 241691 - DNA, 25 bp, Rattus norvegicus
cattgcctttgttttctgctttaag

SEQ ID NO: 241692 - DNA, 25 bp, Rattus norvegicus
cattgcgaacccaaaggacccaaat

SEQ ID NO: 241693 - DNA, 25 bp, Rattus norvegicus
cattgcgaaccctaaggacccaaat

SEQ ID NO: 241694 - DNA, 25 bp, Rattus norvegicus
cattgcgagcgaaaaggaccctgct

SEQ ID NO: 241695 - DNA, 25 bp, Rattus norvegicus
cattgcgagcgataaggaccctgct

SEQ ID NO: 241696 - DNA, 25 bp, Rattus norvegicus
cattgctagatgctgtttgcgggct

SEQ ID NO: 241697 - DNA, 25 bp, Rattus norvegicus
cattgctagatggtgtttgcgggct

SEQ ID NO: 241698 - DNA, 25 bp, Rattus norvegicus
cattgctcattcacagaacttcctg

SEQ ID NO: 241699 - DNA, 25 bp, Rattus norvegicus
cattgctcattctcagaacttcctg

SEQ ID NO: 241700 - DNA, 25 bp, Rattus norvegicus
cattgctcgtgtcccacttgctggt

SEQ ID NO: 241701 - DNA, 25 bp, Rattus norvegicus
cattgctcgtgtgccacttgctggt

SEQ ID NO: 241702 - DNA, 25 bp, Rattus norvegicus
cattgctcttttcggctctttgtgg

SEQ ID NO: 241703 - DNA, 25 bp, Rattus norvegicus
cattgctcttttgggctctttgtgg

SEQ ID NO: 241704 - DNA, 25 bp, Rattus norvegicus
cattgctgagtaactgccagatgaa

SEQ ID NO: 241705 - DNA, 25 bp, Rattus norvegicus
cattgctgagtatctgccagatgaa

SEQ ID NO: 241706 - DNA, 25 bp, Rattus norvegicus
cattgctgagttcgacaccctgaat

SEQ ID NO: 241707 - DNA, 25 bp, Rattus norvegicus
cattgctgagttggacaccctgaat

SEQ ID NO: 241708 - DNA, 25 bp, Rattus norvegicus
cattgctgatatctctacatggtga

SEQ ID NO: 241709 - DNA, 25 bp, Rattus norvegicus
cattgctgatatgtctacatggtga

SEQ ID NO: 241710 - DNA, 25 bp, Rattus norvegicus
cattgctgattcctgtatcctgcag

SEQ ID NO: 241711 - DNA, 25 bp, Rattus norvegicus
cattgctgattcgtgtatcctgcag

SEQ ID NO: 241712 - DNA, 25 bp, Rattus norvegicus
cattgctggaggataccgggttcta

SEQ ID NO: 241713 - DNA, 25 bp, Rattus norvegicus
cattgctggaggttaccgggttcta

SEQ ID NO: 241714 - DNA, 25 bp, Rattus norvegicus
cattgctggcgtaactctgaagtca

SEQ ID NO: 241715 - DNA, 25 bp, Rattus norvegicus
cattgctggcgttactctgaagtca

SEQ ID NO: 241716 - DNA, 25 bp, Rattus norvegicus
cattgctgggttactgactttggtt

SEQ ID NO: 241717 - DNA, 25 bp, Rattus norvegicus
cattgctgggtttctgactttggtt

SEQ ID NO: 241718 - DNA, 25 bp, Rattus norvegicus
cattgctgtgtacttttggtgctta

SEQ ID NO: 241719 - DNA, 25 bp, Rattus norvegicus
cattgctgtgtagttttggtgctta

SEQ ID NO: 241720 - DNA, 25 bp, Rattus norvegicus
cattgcttagcccaaaggttccggg

SEQ ID NO: 241721 - DNA, 25 bp, Rattus norvegicus
cattgcttagccgaaaggttccggg

SEQ ID NO: 241722 - DNA, 25 bp, Rattus norvegicus
cattgcttctttcctttcttgataa

SEQ ID NO: 241723 - DNA, 25 bp, Rattus norvegicus
cattgcttctttgctttcttgataa

SEQ ID NO: 241724 - DNA, 25 bp, Rattus norvegicus
cattgcttgataccctctgtgaaaa

SEQ ID NO: 241725 - DNA, 25 bp, Rattus norvegicus
cattgcttgatagcctctgtgaaaa

SEQ ID NO: 241726 - DNA, 25 bp, Rattus norvegicus
cattgcttgatgctggtttaccaca

SEQ ID NO: 241727 - DNA, 25 bp, Rattus norvegicus
cattgcttgatggtggtttaccaca

SEQ ID NO: 241728 - DNA, 25 bp, Rattus norvegicus
cattgcttggcaacatgaactaggc

SEQ ID NO: 241729 - DNA, 25 bp, Rattus norvegicus
cattgcttggcatcatgaactaggc

SEQ ID NO: 241730 - DNA, 25 bp, Rattus norvegicus
cattgcttggctcggcactgcatta

SEQ ID NO: 241731 - DNA, 25 bp, Rattus norvegicus
cattgcttggctgggcactgcatta

SEQ ID NO: 241732 - DNA, 25 bp, Rattus norvegicus
cattgcttgttcatcctgcgtgaga

SEQ ID NO: 241733 - DNA, 25 bp, Rattus norvegicus
cattgcttgttcttcctgcgtgaga

SEQ ID NO: 241734 - DNA, 25 bp, Rattus norvegicus
cattgctttgttctgtttgaggact

SEQ ID NO: 241735 - DNA, 25 bp, Rattus norvegicus
cattgctttgttgtgtttgaggact

SEQ ID NO: 241736 - DNA, 25 bp, Rattus norvegicus
cattggaaatcaacccttttattaa

SEQ ID NO: 241737 - DNA, 25 bp, Rattus norvegicus
cattggaaatcatcccttttattaa

SEQ ID NO: 241738 - DNA, 25 bp, Rattus norvegicus
cattggaagacgcattttccgggtg

SEQ ID NO: 241739 - DNA, 25 bp, Rattus norvegicus
cattggaagacggattttccgggtg

SEQ ID NO: 241740 - DNA, 25 bp, Rattus norvegicus
cattggacagggactgtgcgcacac

SEQ ID NO: 241741 - DNA, 25 bp, Rattus norvegicus
cattggacagggtctgtgcgcacac

SEQ ID NO: 241742 - DNA, 25 bp, Rattus norvegicus
cattggactgtcatggtcggtaagt

SEQ ID NO: 241743 - DNA, 25 bp, Rattus norvegicus
cattggactgtcttggtcggtaagt

SEQ ID NO: 241744 - DNA, 25 bp, Rattus norvegicus
cattggacttagactcagcttcctg

SEQ ID NO: 241745 - DNA, 25 bp, Rattus norvegicus
cattggacttagtctcagcttcctg

SEQ ID NO: 241746 - DNA, 25 bp, Rattus norvegicus
cattggagatgtaggcctgcccagt

SEQ ID NO: 241747 - DNA, 25 bp, Rattus norvegicus
cattggagatgttggcctgcccagt

SEQ ID NO: 241748 - DNA, 25 bp, Rattus norvegicus
cattggagcagtcggcatcggtatc

SEQ ID NO: 241749 - DNA, 25 bp, Rattus norvegicus
cattggagcagtgggcatcggtatc

SEQ ID NO: 241750 - DNA, 25 bp, Rattus norvegicus
cattggaggagtaccctggcctgca

SEQ ID NO: 241751 - DNA, 25 bp, Rattus norvegicus
cattggaggagttccctggcctgca

SEQ ID NO: 241752 - DNA, 25 bp, Rattus norvegicus
cattggataaccattgagggcctta

SEQ ID NO: 241753 - DNA, 25 bp, Rattus norvegicus
cattggataacctttgagggcctta

SEQ ID NO: 241754 - DNA, 25 bp, Rattus norvegicus
cattggatcatgatgaaccgcaccc

SEQ ID NO: 241755 - DNA, 25 bp, Rattus norvegicus
cattggatcatgttgaaccgcaccc

SEQ ID NO: 241756 - DNA, 25 bp, Rattus norvegicus
cattggatttagctaccctgtggtc

SEQ ID NO: 241757 - DNA, 25 bp, Rattus norvegicus
cattggatttaggtaccctgtggtc

SEQ ID NO: 241758 - DNA, 25 bp, Rattus norvegicus
cattggattttcctaggctctctag

SEQ ID NO: 241759 - DNA, 25 bp, Rattus norvegicus
cattggattttcgtaggctctctag

SEQ ID NO: 241760 - DNA, 25 bp, Rattus norvegicus
cattggcaaatcataggttctgtta

SEQ ID NO: 241761 - DNA, 25 bp, Rattus norvegicus
cattggcaaatcttaggttctgtta

SEQ ID NO: 241762 - DNA, 25 bp, Rattus norvegicus
cattggcaagccagtcctaggaatt

SEQ ID NO: 241763 - DNA, 25 bp, Rattus norvegicus
cattggcaagcctgtcctaggaatt

SEQ ID NO: 241764 - DNA, 25 bp, Rattus norvegicus
cattggcaatttataactattactt

SEQ ID NO: 241765 - DNA, 25 bp, Rattus norvegicus
cattggcaatttttaactattactt

SEQ ID NO: 241766 - DNA, 25 bp, Rattus norvegicus
cattggcatgcaaactggagacgag

SEQ ID NO: 241767 - DNA, 25 bp, Rattus norvegicus
cattggcatgcatactggagacgag

SEQ ID NO: 241768 - DNA, 25 bp, Rattus norvegicus
cattggcatgttacttggtggcttg

SEQ ID NO: 241769 - DNA, 25 bp, Rattus norvegicus
cattggcatgtttcttggtggcttg

SEQ ID NO: 241770 - DNA, 25 bp, Rattus norvegicus
cattggcattgcattgtggactgat

SEQ ID NO: 241771 - DNA, 25 bp, Rattus norvegicus
cattggcattgctttgtggactgat

SEQ ID NO: 241772 - DNA, 25 bp, Rattus norvegicus
cattggccaagtacctgtgtgtgtt

SEQ ID NO: 241773 - DNA, 25 bp, Rattus norvegicus
cattggccaagttcctgtgtgtgtt

SEQ ID NO: 241774 - DNA, 25 bp, Rattus norvegicus
cattggccacctccgggatgagcag

SEQ ID NO: 241775 - DNA, 25 bp, Rattus norvegicus
cattggccacctgcgggatgagcag

SEQ ID NO: 241776 - DNA, 25 bp, Rattus norvegicus
cattggccatatatggtcggtctca

SEQ ID NO: 241777 - DNA, 25 bp, Rattus norvegicus
cattggccatatttggtcggtctca

SEQ ID NO: 241778 - DNA, 25 bp, Rattus norvegicus
cattggcccttccagtgagtgatgg

SEQ ID NO: 241779 - DNA, 25 bp, Rattus norvegicus
cattggcccttcgagtgagtgatgg

SEQ ID NO: 241780 - DNA, 25 bp, Rattus norvegicus
cattggccgatcacccgaggtggaa

SEQ ID NO: 241781 - DNA, 25 bp, Rattus norvegicus
cattggccgatctcccgaggtggaa

SEQ ID NO: 241782 - DNA, 25 bp, Rattus norvegicus
cattggcggtgaatctgtttgctgt

SEQ ID NO: 241783 - DNA, 25 bp, Rattus norvegicus
cattggcggtgattctgtttgctgt

SEQ ID NO: 241784 - DNA, 25 bp, Rattus norvegicus
cattggcggtgtcatattttgcttt

SEQ ID NO: 241785 - DNA, 25 bp, Rattus norvegicus
cattggcggtgtgatattttgcttt

SEQ ID NO: 241786 - DNA, 25 bp, Rattus norvegicus
cattggcgttgcactgttgaattta

SEQ ID NO: 241787 - DNA, 25 bp, Rattus norvegicus
cattggcgttgctctgttgaattta

SEQ ID NO: 241788 - DNA, 25 bp, Rattus norvegicus
cattggctacttatctttgcaggga

SEQ ID NO: 241789 - DNA, 25 bp, Rattus norvegicus
cattggctacttttctttgcaggga

SEQ ID NO: 241790 - DNA, 25 bp, Rattus norvegicus
cattggctgcaaactttgtcgatcc

SEQ ID NO: 241791 - DNA, 25 bp, Rattus norvegicus
cattggctgcaatctttgtcgatcc

SEQ ID NO: 241792 - DNA, 25 bp, Rattus norvegicus
cattggctgtgtctacatgggtacc

SEQ ID NO: 241793 - DNA, 25 bp, Rattus norvegicus
cattggctgtgtgtacatgggtacc

SEQ ID NO: 241794 - DNA, 25 bp, Rattus norvegicus
cattgggactttccatacttcagcc

SEQ ID NO: 241795 - DNA, 25 bp, Rattus norvegicus
cattgggactttgcatacttcagcc

SEQ ID NO: 241796 - DNA, 25 bp, Rattus norvegicus
cattgggatattactctttgttcat

SEQ ID NO: 241797 - DNA, 25 bp, Rattus norvegicus
cattgggatatttctctttgttcat

SEQ ID NO: 241798 - DNA, 25 bp, Rattus norvegicus
cattgggattctctgctgttgtaaa

SEQ ID NO: 241799 - DNA, 25 bp, Rattus norvegicus
cattgggattctgtgctgttgtaaa

SEQ ID NO: 241800 - DNA, 25 bp, Rattus norvegicus
cattgggccagcataatgttttctt

SEQ ID NO: 241801 - DNA, 25 bp, Rattus norvegicus
cattgggccagcttaatgttttctt

SEQ ID NO: 241802 - DNA, 25 bp, Rattus norvegicus
cattgggcctagagctgctcgtgga

SEQ ID NO: 241803 - DNA, 25 bp, Rattus norvegicus
cattgggcctagtgctgctcgtgga

SEQ ID NO: 241804 - DNA, 25 bp, Rattus norvegicus
cattgggcctggagctatgatgaat

SEQ ID NO: 241805 - DNA, 25 bp, Rattus norvegicus
cattgggcctggtgctatgatgaat

SEQ ID NO: 241806 - DNA, 25 bp, Rattus norvegicus
cattgggcctttaggtctgggattc

SEQ ID NO: 241807 - DNA, 25 bp, Rattus norvegicus
cattgggccttttggtctgggattc

SEQ ID NO: 241808 - DNA, 25 bp, Rattus norvegicus
cattgggcgatacactggcttgtac

SEQ ID NO: 241809 - DNA, 25 bp, Rattus norvegicus
cattgggcgatagactggcttgtac

SEQ ID NO: 241810 - DNA, 25 bp, Rattus norvegicus
cattgggctgtcatctttgagctgc

SEQ ID NO: 241811 - DNA, 25 bp, Rattus norvegicus
cattgggctgtcatgttaataggag

SEQ ID NO: 241812 - DNA, 25 bp, Rattus norvegicus
cattgggctgtcttctttgagctgc

SEQ ID NO: 241813 - DNA, 25 bp, Rattus norvegicus
cattgggctgtcttgttaataggag

SEQ ID NO: 241814 - DNA, 25 bp, Rattus norvegicus
cattgggctgtgattggctgtgtat

SEQ ID NO: 241815 - DNA, 25 bp, Rattus norvegicus
cattgggctgtgtttggctgtgtat

SEQ ID NO: 241816 - DNA, 25 bp, Rattus norvegicus
cattgggtcccaagaagaagctgga

SEQ ID NO: 241817 - DNA, 25 bp, Rattus norvegicus
cattgggtcccatgaagaagctgga

SEQ ID NO: 241818 - DNA, 25 bp, Rattus norvegicus
cattgggttgcaccccagcgtggcc

SEQ ID NO: 241819 - DNA, 25 bp, Rattus norvegicus
cattgggttgcagcccagcgtggcc

SEQ ID NO: 241820 - DNA, 25 bp, Rattus norvegicus
cattgggttggcagagcttgctact

SEQ ID NO: 241821 - DNA, 25 bp, Rattus norvegicus
cattgggttggctgagcttgctact

SEQ ID NO: 241822 - DNA, 25 bp, Rattus norvegicus
cattgggttgtaatcttcagtgtga

SEQ ID NO: 241823 - DNA, 25 bp, Rattus norvegicus
cattgggttgtattcttcagtgtga

SEQ ID NO: 241824 - DNA, 25 bp, Rattus norvegicus
cattgggttttcatttcacagtcct

SEQ ID NO: 241825 - DNA, 25 bp, Rattus norvegicus
cattgggttttcttttcacagtcct

SEQ ID NO: 241826 - DNA, 25 bp, Rattus norvegicus
cattggtagattacctgtgctcaga

SEQ ID NO: 241827 - DNA, 25 bp, Rattus norvegicus
cattggtagatttcctgtgctcaga

SEQ ID NO: 241828 - DNA, 25 bp, Rattus norvegicus
cattggtagctcattggagagaatc

SEQ ID NO: 241829 - DNA, 25 bp, Rattus norvegicus
cattggtagctctttggagagaatc

SEQ ID NO: 241830 - DNA, 25 bp, Rattus norvegicus
cattggtatcaacatggcttctttg

SEQ ID NO: 241831 - DNA, 25 bp, Rattus norvegicus
cattggtatcaagatggcttctttg

SEQ ID NO: 241832 - DNA, 25 bp, Rattus norvegicus
cattggtcagttcaggctacgtagc

SEQ ID NO: 241833 - DNA, 25 bp, Rattus norvegicus
cattggtcagttgaggctacgtagc

SEQ ID NO: 241834 - DNA, 25 bp, Rattus norvegicus
cattggtcctctcgtgtttgtttcc

SEQ ID NO: 241835 - DNA, 25 bp, Rattus norvegicus
cattggtcctctggtgtttgtttcc

SEQ ID NO: 241836 - DNA, 25 bp, Rattus norvegicus
cattggtcctgcatgtattatctga

SEQ ID NO: 241837 - DNA, 25 bp, Rattus norvegicus
cattggtcctgcttgtattatctga

SEQ ID NO: 241838 - DNA, 25 bp, Rattus norvegicus
cattggtctggtcagatgtttcata

SEQ ID NO: 241839 - DNA, 25 bp, Rattus norvegicus
cattggtctggtgagatgtttcata

SEQ ID NO: 241840 - DNA, 25 bp, Rattus norvegicus
cattggtgacgtccgaaacctctta

SEQ ID NO: 241841 - DNA, 25 bp, Rattus norvegicus
cattggtgacgtgcgaaacctctta

SEQ ID NO: 241842 - DNA, 25 bp, Rattus norvegicus
cattggtgccacactgtaagaagtt

SEQ ID NO: 241843 - DNA, 25 bp, Rattus norvegicus
cattggtgccactctgtaagaagtt

SEQ ID NO: 241844 - DNA, 25 bp, Rattus norvegicus
cattggtgccgtcagcatggatgat

SEQ ID NO: 241845 - DNA, 25 bp, Rattus norvegicus
cattggtgccgtgagcatggatgat

SEQ ID NO: 241846 - DNA, 25 bp, Rattus norvegicus
cattggtgcgaaactatactgtgta

SEQ ID NO: 241847 - DNA, 25 bp, Rattus norvegicus
cattggtgcgaatctatactgtgta

SEQ ID NO: 241848 - DNA, 25 bp, Rattus norvegicus
cattggtgctgaactgtggttagag

SEQ ID NO: 241849 - DNA, 25 bp, Rattus norvegicus
cattggtgctgatctgtggttagag

SEQ ID NO: 241850 - DNA, 25 bp, Rattus norvegicus
cattggtgctgcatgaggctactgg

SEQ ID NO: 241851 - DNA, 25 bp, Rattus norvegicus
cattggtgctgcttgaggctactgg

SEQ ID NO: 241852 - DNA, 25 bp, Rattus norvegicus
cattggtggattagacccattcccc

SEQ ID NO: 241853 - DNA, 25 bp, Rattus norvegicus
cattggtggatttgacccattcccc

SEQ ID NO: 241854 - DNA, 25 bp, Rattus norvegicus
cattggtggcatcgctgcaacatat

SEQ ID NO: 241855 - DNA, 25 bp, Rattus norvegicus
cattggtggcatggctgcaacatat

SEQ ID NO: 241856 - DNA, 25 bp, Rattus norvegicus
cattggtggctgacaatccaggcga

SEQ ID NO: 241857 - DNA, 25 bp, Rattus norvegicus
cattggtggctgtcaatccaggcga

SEQ ID NO: 241858 - DNA, 25 bp, Rattus norvegicus
cattggtgggttacagttaggcctt

SEQ ID NO: 241859 - DNA, 25 bp, Rattus norvegicus
cattggtgggtttcagttaggcctt

SEQ ID NO: 241860 - DNA, 25 bp, Rattus norvegicus
cattggtgttgaatctgtgcagagc

SEQ ID NO: 241861 - DNA, 25 bp, Rattus norvegicus
cattggtgttgattctgtgcagagc

SEQ ID NO: 241862 - DNA, 25 bp, Rattus norvegicus
cattggttctctcttatctttttat

SEQ ID NO: 241863 - DNA, 25 bp, Rattus norvegicus
cattggttctctgttatctttttat

SEQ ID NO: 241864 - DNA, 25 bp, Rattus norvegicus
cattggtttctgagagcatctgact

SEQ ID NO: 241865 - DNA, 25 bp, Rattus norvegicus
cattggtttctgtgagcatctgact

SEQ ID NO: 241866 - DNA, 25 bp, Rattus norvegicus
cattggtttgtaacttgggctcagt

SEQ ID NO: 241867 - DNA, 25 bp, Rattus norvegicus
cattggtttgtatcttgggctcagt

SEQ ID NO: 241868 - DNA, 25 bp, Rattus norvegicus
cattgtaactgacattctgagggac

SEQ ID NO: 241869 - DNA, 25 bp, Rattus norvegicus
cattgtaactgagattctgagggac

SEQ ID NO: 241870 - DNA, 25 bp, Rattus norvegicus
cattgtaattgacccattttggaaa

SEQ ID NO: 241871 - DNA, 25 bp, Rattus norvegicus
cattgtaattgagccattttggaaa

SEQ ID NO: 241872 - DNA, 25 bp, Rattus norvegicus
cattgtacaaaaattctcccagtga

SEQ ID NO: 241873 - DNA, 25 bp, Rattus norvegicus
cattgtacaaaatttctcccagtga

SEQ ID NO: 241874 - DNA, 25 bp, Rattus norvegicus
cattgtaccaacaaaccttccattt

SEQ ID NO: 241875 - DNA, 25 bp, Rattus norvegicus
cattgtaccaactaaccttccattt

SEQ ID NO: 241876 - DNA, 25 bp, Rattus norvegicus
cattgtacctgtcccttggaaacca

SEQ ID NO: 241877 - DNA, 25 bp, Rattus norvegicus
cattgtacctgtgccttggaaacca

SEQ ID NO: 241878 - DNA, 25 bp, Rattus norvegicus
cattgtacgcatacgcgggtggtat

SEQ ID NO: 241879 - DNA, 25 bp, Rattus norvegicus
cattgtacgcatagttccagctctg

SEQ ID NO: 241880 - DNA, 25 bp, Rattus norvegicus
cattgtacgcattcgcgggtggtat

SEQ ID NO: 241881 - DNA, 25 bp, Rattus norvegicus
cattgtacgcattgttccagctctg

SEQ ID NO: 241882 - DNA, 25 bp, Rattus norvegicus
cattgtactgaaatctttccctgtg

SEQ ID NO: 241883 - DNA, 25 bp, Rattus norvegicus
cattgtactgaattctttccctgtg

SEQ ID NO: 241884 - DNA, 25 bp, Rattus norvegicus
cattgtagaagaactgctggctgat

SEQ ID NO: 241885 - DNA, 25 bp, Rattus norvegicus
cattgtagaagatctgctggctgat

SEQ ID NO: 241886 - DNA, 25 bp, Rattus norvegicus
cattgtaggagacaggccagctttt

SEQ ID NO: 241887 - DNA, 25 bp, Rattus norvegicus
cattgtaggagagaggccagctttt

SEQ ID NO: 241888 - DNA, 25 bp, Rattus norvegicus
cattgtagttgtagccgtcattaga

SEQ ID NO: 241889 - DNA, 25 bp, Rattus norvegicus
cattgtagttgttgccgtcattaga

SEQ ID NO: 241890 - DNA, 25 bp, Rattus norvegicus
cattgtatatccatggactcagaga

SEQ ID NO: 241891 - DNA, 25 bp, Rattus norvegicus
cattgtatatccttggactcagaga

SEQ ID NO: 241892 - DNA, 25 bp, Rattus norvegicus
cattgtatccctcagtagctgaaga

SEQ ID NO: 241893 - DNA, 25 bp, Rattus norvegicus
cattgtatccctgagtagctgaaga

SEQ ID NO: 241894 - DNA, 25 bp, Rattus norvegicus
cattgtatccttcatgtgtctggaa

SEQ ID NO: 241895 - DNA, 25 bp, Rattus norvegicus
cattgtatccttgatgtgtctggaa

SEQ ID NO: 241896 - DNA, 25 bp, Rattus norvegicus
cattgtatctgaaaccctgtgcatt

SEQ ID NO: 241897 - DNA, 25 bp, Rattus norvegicus
cattgtatctgataccctgtgcatt

SEQ ID NO: 241898 - DNA, 25 bp, Rattus norvegicus
cattgtattgccacagccattacta

SEQ ID NO: 241899 - DNA, 25 bp, Rattus norvegicus
cattgtattgcctcagccattacta

SEQ ID NO: 241900 - DNA, 25 bp, Rattus norvegicus
cattgtatttacatctgccatttat

SEQ ID NO: 241901 - DNA, 25 bp, Rattus norvegicus
cattgtatttacttctgccatttat

SEQ ID NO: 241902 - DNA, 25 bp, Rattus norvegicus
cattgtattttcatgtgagctgtgt

SEQ ID NO: 241903 - DNA, 25 bp, Rattus norvegicus
cattgtattttcttgtgagctgtgt

SEQ ID NO: 241904 - DNA, 25 bp, Rattus norvegicus
cattgtcaaataatcccctccgaga

SEQ ID NO: 241905 - DNA, 25 bp, Rattus norvegicus
cattgtcaaatattcccctccgaga

SEQ ID NO: 241906 - DNA, 25 bp, Rattus norvegicus
cattgtcaacttaaacggcattttt

SEQ ID NO: 241907 - DNA, 25 bp, Rattus norvegicus
cattgtcaactttaacggcattttt

SEQ ID NO: 241908 - DNA, 25 bp, Rattus norvegicus
cattgtcaagttcccacaggtattt

SEQ ID NO: 241909 - DNA, 25 bp, Rattus norvegicus
cattgtcaagttgccacaggtattt

SEQ ID NO: 241910 - DNA, 25 bp, Rattus norvegicus
cattgtcactgaatttggcctgcca

SEQ ID NO: 241911 - DNA, 25 bp, Rattus norvegicus
cattgtcactgattttggcctgcca

SEQ ID NO: 241912 - DNA, 25 bp, Rattus norvegicus
cattgtcagagaagcttcgggcact

SEQ ID NO: 241913 - DNA, 25 bp, Rattus norvegicus
cattgtcagagatgcttcgggcact

SEQ ID NO: 241914 - DNA, 25 bp, Rattus norvegicus
cattgtcatacaccagtgtgaggtt

SEQ ID NO: 241915 - DNA, 25 bp, Rattus norvegicus
cattgtcatacagcagtgtgaggtt

SEQ ID NO: 241916 - DNA, 25 bp, Rattus norvegicus
cattgtcatctccaggtacctagaa

SEQ ID NO: 241917 - DNA, 25 bp, Rattus norvegicus
cattgtcatctcgaggtacctagaa

SEQ ID NO: 241918 - DNA, 25 bp, Rattus norvegicus
cattgtccccatacccagaacaaaa

SEQ ID NO: 241919 - DNA, 25 bp, Rattus norvegicus
cattgtccccattcccagaacaaaa

SEQ ID NO: 241920 - DNA, 25 bp, Rattus norvegicus
cattgtccctggcttcgtaagaagt

SEQ ID NO: 241921 - DNA, 25 bp, Rattus norvegicus
cattgtccctgggttcgtaagaagt

SEQ ID NO: 241922 - DNA, 25 bp, Rattus norvegicus
cattgtcccttgctttcagtgataa

SEQ ID NO: 241923 - DNA, 25 bp, Rattus norvegicus
cattgtcccttggtttcagtgataa

SEQ ID NO: 241924 - DNA, 25 bp, Rattus norvegicus
cattgtccgaagaaccctgattgtg

SEQ ID NO: 241925 - DNA, 25 bp, Rattus norvegicus
cattgtccgaagtaccctgattgtg

SEQ ID NO: 241926 - DNA, 25 bp, Rattus norvegicus
cattgtccttatagcagtgatttat

SEQ ID NO: 241927 - DNA, 25 bp, Rattus norvegicus
cattgtccttattgcagtgatttat

SEQ ID NO: 241928 - DNA, 25 bp, Rattus norvegicus
cattgtcgatttctgtaaactccat

SEQ ID NO: 241929 - DNA, 25 bp, Rattus norvegicus
cattgtcgatttgtgtaaactccat

SEQ ID NO: 241930 - DNA, 25 bp, Rattus norvegicus
cattgtcgtagcagggtactgtcaa

SEQ ID NO: 241931 - DNA, 25 bp, Rattus norvegicus
cattgtcgtagctgggtactgtcaa

SEQ ID NO: 241932 - DNA, 25 bp, Rattus norvegicus
cattgtctcaatccctgtttttaca

SEQ ID NO: 241933 - DNA, 25 bp, Rattus norvegicus
cattgtctcaatgcctgtttttaca

SEQ ID NO: 241934 - DNA, 25 bp, Rattus norvegicus
cattgtctgcaaaatttccctcttt

SEQ ID NO: 241935 - DNA, 25 bp, Rattus norvegicus
cattgtctgcaatatttccctcttt

SEQ ID NO: 241936 - DNA, 25 bp, Rattus norvegicus
cattgtctgggaagcaaaccttcaa

SEQ ID NO: 241937 - DNA, 25 bp, Rattus norvegicus
cattgtctgggatgcaaaccttcaa

SEQ ID NO: 241938 - DNA, 25 bp, Rattus norvegicus
cattgtctggtcactagttggtgga

SEQ ID NO: 241939 - DNA, 25 bp, Rattus norvegicus
cattgtctggtctctagttggtgga

SEQ ID NO: 241940 - DNA, 25 bp, Rattus norvegicus
cattgtctgttcatgtttcttgcat

SEQ ID NO: 241941 - DNA, 25 bp, Rattus norvegicus
cattgtctgttcttgtttcttgcat

SEQ ID NO: 241942 - DNA, 25 bp, Rattus norvegicus
cattgtcttcctcagggttgtgtga

SEQ ID NO: 241943 - DNA, 25 bp, Rattus norvegicus
cattgtcttcctgagggttgtgtga

SEQ ID NO: 241944 - DNA, 25 bp, Rattus norvegicus
cattgtcttctaatgattaaggagc

SEQ ID NO: 241945 - DNA, 25 bp, Rattus norvegicus
cattgtcttctattgattaaggagc

SEQ ID NO: 241946 - DNA, 25 bp, Rattus norvegicus
cattgtctttatcacttgctggaga

SEQ ID NO: 241947 - DNA, 25 bp, Rattus norvegicus
cattgtctttatgacttgctggaga

SEQ ID NO: 241948 - DNA, 25 bp, Rattus norvegicus
cattgtctttgaaggtaaccgtgtg

SEQ ID NO: 241949 - DNA, 25 bp, Rattus norvegicus
cattgtctttgatggtaaccgtgtg

SEQ ID NO: 241950 - DNA, 25 bp, Rattus norvegicus
cattgtgaaatgatcctggcctttt

SEQ ID NO: 241951 - DNA, 25 bp, Rattus norvegicus
cattgtgaaatgttcctggcctttt

SEQ ID NO: 241952 - DNA, 25 bp, Rattus norvegicus
cattgtgagtgaatgctttttcttt

SEQ ID NO: 241953 - DNA, 25 bp, Rattus norvegicus
cattgtgagtgattgctttttcttt

SEQ ID NO: 241954 - DNA, 25 bp, Rattus norvegicus
cattgtgatggactccggagacggg

SEQ ID NO: 241955 - DNA, 25 bp, Rattus norvegicus
cattgtgatggagtccggagacggg

SEQ ID NO: 241956 - DNA, 25 bp, Rattus norvegicus
cattgtgattttagtcctgtcttta

SEQ ID NO: 241957 - DNA, 25 bp, Rattus norvegicus
cattgtgatttttgtcctgtcttta

SEQ ID NO: 241958 - DNA, 25 bp, Rattus norvegicus
cattgtgcatttatgcatgccttta

SEQ ID NO: 241959 - DNA, 25 bp, Rattus norvegicus
cattgtgcatttttgcatgccttta

SEQ ID NO: 241960 - DNA, 25 bp, Rattus norvegicus
cattgtgccaacagattagaacatt

SEQ ID NO: 241961 - DNA, 25 bp, Rattus norvegicus
cattgtgccaactgattagaacatt

SEQ ID NO: 241962 - DNA, 25 bp, Rattus norvegicus
cattgtgccttcagcttggagttta

SEQ ID NO: 241963 - DNA, 25 bp, Rattus norvegicus
cattgtgccttctgcttggagttta

SEQ ID NO: 241964 - DNA, 25 bp, Rattus norvegicus
cattgtgctcacatgtgtactgtac

SEQ ID NO: 241965 - DNA, 25 bp, Rattus norvegicus
cattgtgctcacttgtgtactgtac

SEQ ID NO: 241966 - DNA, 25 bp, Rattus norvegicus
cattgtgcttttcatcattgtcatc

SEQ ID NO: 241967 - DNA, 25 bp, Rattus norvegicus
cattgtgcttttgatcattgtcatc

SEQ ID NO: 241968 - DNA, 25 bp, Rattus norvegicus
cattgtggacctcggagttgctgct

SEQ ID NO: 241969 - DNA, 25 bp, Rattus norvegicus
cattgtggacctgggagttgctgct

SEQ ID NO: 241970 - DNA, 25 bp, Rattus norvegicus
cattgtggaggacgccctgacagca

SEQ ID NO: 241971 - DNA, 25 bp, Rattus norvegicus
cattgtggaggaggccctgacagca

SEQ ID NO: 241972 - DNA, 25 bp, Rattus norvegicus
cattgtggcattatcatgggtttga

SEQ ID NO: 241973 - DNA, 25 bp, Rattus norvegicus
cattgtggcattttcatgggtttga

SEQ ID NO: 241974 - DNA, 25 bp, Rattus norvegicus
cattgtggccaaagcgttgctatgg

SEQ ID NO: 241975 - DNA, 25 bp, Rattus norvegicus
cattgtggccaatgcgttgctatgg

SEQ ID NO: 241976 - DNA, 25 bp, Rattus norvegicus
cattgtggcttgattgtaattcaga

SEQ ID NO: 241977 - DNA, 25 bp, Rattus norvegicus
cattgtggcttgtttgtaattcaga

SEQ ID NO: 241978 - DNA, 25 bp, Rattus norvegicus
cattgtggtcacatgtctggttaca

SEQ ID NO: 241979 - DNA, 25 bp, Rattus norvegicus
cattgtggtcacttgtctggttaca

SEQ ID NO: 241980 - DNA, 25 bp, Rattus norvegicus
cattgtggtgggaaacacgtgtgta

SEQ ID NO: 241981 - DNA, 25 bp, Rattus norvegicus
cattgtggtgggtaacacgtgtgta

SEQ ID NO: 241982 - DNA, 25 bp, Rattus norvegicus
cattgtgtaaacaccctgggtgttg

SEQ ID NO: 241983 - DNA, 25 bp, Rattus norvegicus
cattgtgtaaactccctgggtgttg

SEQ ID NO: 241984 - DNA, 25 bp, Rattus norvegicus
cattgtgtcctgagcagtgtctgtt

SEQ ID NO: 241985 - DNA, 25 bp, Rattus norvegicus
cattgtgtcctgtgcagtgtctgtt

SEQ ID NO: 241986 - DNA, 25 bp, Rattus norvegicus
cattgtgtcgagaccttgcagagaa

SEQ ID NO: 241987 - DNA, 25 bp, Rattus norvegicus
cattgtgtcgagtccttgcagagaa

SEQ ID NO: 241988 - DNA, 25 bp, Rattus norvegicus
cattgtgtctctacttttttaagca

SEQ ID NO: 241989 - DNA, 25 bp, Rattus norvegicus
cattgtgtctcttcttttttaagca

SEQ ID NO: 241990 - DNA, 25 bp, Rattus norvegicus
cattgtgtgcaaaacctgagtgaag

SEQ ID NO: 241991 - DNA, 25 bp, Rattus norvegicus
cattgtgtgcaatacctgagtgaag

SEQ ID NO: 241992 - DNA, 25 bp, Rattus norvegicus
cattgtgtgccaaagaattacccat

SEQ ID NO: 241993 - DNA, 25 bp, Rattus norvegicus
cattgtgtgccatagaattacccat

SEQ ID NO: 241994 - DNA, 25 bp, Rattus norvegicus
cattgtgtgcccctggtatggaaga

SEQ ID NO: 241995 - DNA, 25 bp, Rattus norvegicus
cattgtgtgcccgtggtatggaaga

SEQ ID NO: 241996 - DNA, 25 bp, Rattus norvegicus
cattgtgtgcttcccctcacagttt

SEQ ID NO: 241997 - DNA, 25 bp, Rattus norvegicus
cattgtgtgcttgccctcacagttt

SEQ ID NO: 241998 - DNA, 25 bp, Rattus norvegicus
cattgtgtgtgccttggacatcggc

SEQ ID NO: 241999 - DNA, 25 bp, Rattus norvegicus
cattgtgtgtgcgttggacatcggc

SEQ ID NO: 242000 - DNA, 25 bp, Rattus norvegicus
cattgtgtgttgctggactgttttg

SEQ ID NO: 242001 - DNA, 25 bp, Rattus norvegicus
cattgtgtgttggtggactgttttg

SEQ ID NO: 242002 - DNA, 25 bp, Rattus norvegicus
cattgtgttagaaacttccttagca

SEQ ID NO: 242003 - DNA, 25 bp, Rattus norvegicus
cattgtgttagatacttccttagca

SEQ ID NO: 242004 - DNA, 25 bp, Rattus norvegicus
cattgtgttgctatgtaggtgactt

SEQ ID NO: 242005 - DNA, 25 bp, Rattus norvegicus
cattgtgttgctttgtaggtgactt

SEQ ID NO: 242006 - DNA, 25 bp, Rattus norvegicus
cattgtgtttggacttacgcctaga

SEQ ID NO: 242007 - DNA, 25 bp, Rattus norvegicus
cattgtgtttggtcttacgcctaga

SEQ ID NO: 242008 - DNA, 25 bp, Rattus norvegicus
cattgttaaagacccatgtcccctc

SEQ ID NO: 242009 - DNA, 25 bp, Rattus norvegicus
cattgttaaagagccatgtcccctc

SEQ ID NO: 242010 - DNA, 25 bp, Rattus norvegicus
cattgttaagttaggagtcctttct

SEQ ID NO: 242011 - DNA, 25 bp, Rattus norvegicus
cattgttaagtttggagtcctttct

SEQ ID NO: 242012 - DNA, 25 bp, Rattus norvegicus
cattgttaatttctcagctttgcct

SEQ ID NO: 242013 - DNA, 25 bp, Rattus norvegicus
cattgttaatttgtcagctttgcct

SEQ ID NO: 242014 - DNA, 25 bp, Rattus norvegicus
cattgttagttccactcctttgtaa

SEQ ID NO: 242015 - DNA, 25 bp, Rattus norvegicus
cattgttagttcgactcctttgtaa

SEQ ID NO: 242016 - DNA, 25 bp, Rattus norvegicus
cattgttatgtcaacttgggaaaac

SEQ ID NO: 242017 - DNA, 25 bp, Rattus norvegicus
cattgttatgtctacttgggaaaac

SEQ ID NO: 242018 - DNA, 25 bp, Rattus norvegicus
cattgttatgtgaagactgcagaat

SEQ ID NO: 242019 - DNA, 25 bp, Rattus norvegicus
cattgttatgtgtagactgcagaat

SEQ ID NO: 242020 - DNA, 25 bp, Rattus norvegicus
cattgttattgcctatcgtcaccaa

SEQ ID NO: 242021 - DNA, 25 bp, Rattus norvegicus
cattgttattgcgtatcgtcaccaa

SEQ ID NO: 242022 - DNA, 25 bp, Rattus norvegicus
cattgttattttaatgctacatata

SEQ ID NO: 242023 - DNA, 25 bp, Rattus norvegicus
cattgttatttttatgctacatata

SEQ ID NO: 242024 - DNA, 25 bp, Rattus norvegicus
cattgttctcagaagaccctgtgtg

SEQ ID NO: 242025 - DNA, 25 bp, Rattus norvegicus
cattgttctcagtagaccctgtgtg

SEQ ID NO: 242026 - DNA, 25 bp, Rattus norvegicus
cattgttctgacagggctggcagct

SEQ ID NO: 242027 - DNA, 25 bp, Rattus norvegicus
cattgttctgactgggctggcagct

SEQ ID NO: 242028 - DNA, 25 bp, Rattus norvegicus
cattgttctgctctcggagtgatcc

SEQ ID NO: 242029 - DNA, 25 bp, Rattus norvegicus
cattgttctgctgtcggagtgatcc

SEQ ID NO: 242030 - DNA, 25 bp, Rattus norvegicus
cattgttctgtcacattaggtggga

SEQ ID NO: 242031 - DNA, 25 bp, Rattus norvegicus
cattgttctgtctcattaggtggga

SEQ ID NO: 242032 - DNA, 25 bp, Rattus norvegicus
cattgttcttttagacaagtggctt

SEQ ID NO: 242033 - DNA, 25 bp, Rattus norvegicus
cattgttctttttgacaagtggctt

SEQ ID NO: 242034 - DNA, 25 bp, Rattus norvegicus
cattgttgacatcgtccctggcaag

SEQ ID NO: 242035 - DNA, 25 bp, Rattus norvegicus
cattgttgacatggtccctggcaag

SEQ ID NO: 242036 - DNA, 25 bp, Rattus norvegicus
cattgttgctgaatctgttccggaa

SEQ ID NO: 242037 - DNA, 25 bp, Rattus norvegicus
cattgttgctgattctgttccggaa

SEQ ID NO: 242038 - DNA, 25 bp, Rattus norvegicus
cattgtttgctgatttcactcttga

SEQ ID NO: 242039 - DNA, 25 bp, Rattus norvegicus
cattgtttgctgttttcactcttga

SEQ ID NO: 242040 - DNA, 25 bp, Rattus norvegicus
cattgtttggtacagtctcctttgc

SEQ ID NO: 242041 - DNA, 25 bp, Rattus norvegicus
cattgtttggtagagtctcctttgc

SEQ ID NO: 242042 - DNA, 25 bp, Rattus norvegicus
cattgtttgtcaccgtcttctcaga

SEQ ID NO: 242043 - DNA, 25 bp, Rattus norvegicus
cattgtttgtcagcgtcttctcaga

SEQ ID NO: 242044 - DNA, 25 bp, Rattus norvegicus
cattgtttgtctctgatgctgctgc

SEQ ID NO: 242045 - DNA, 25 bp, Rattus norvegicus
cattgtttgtctgtgatgctgctgc

SEQ ID NO: 242046 - DNA, 25 bp, Rattus norvegicus
cattgtttgtgtcaaggcgctgctc

SEQ ID NO: 242047 - DNA, 25 bp, Rattus norvegicus
cattgtttgtgtgaaggcgctgctc

SEQ ID NO: 242048 - DNA, 25 bp, Rattus norvegicus
cattgttttaacacttcgtctcggt

SEQ ID NO: 242049 - DNA, 25 bp, Rattus norvegicus
cattgttttaactcttcgtctcggt

SEQ ID NO: 242050 - DNA, 25 bp, Rattus norvegicus
cattgttttataagattttcctaac

SEQ ID NO: 242051 - DNA, 25 bp, Rattus norvegicus
cattgttttatatgattttcctaac

SEQ ID NO: 242052 - DNA, 25 bp, Rattus norvegicus
cattgttttctccagccatggcttt

SEQ ID NO: 242053 - DNA, 25 bp, Rattus norvegicus
cattgttttctcgagccatggcttt

SEQ ID NO: 242054 - DNA, 25 bp, Rattus norvegicus
cattgttttttcacactggttttgg

SEQ ID NO: 242055 - DNA, 25 bp, Rattus norvegicus
cattgttttttctcactggttttgg

SEQ ID NO: 242056 - DNA, 25 bp, Rattus norvegicus
catttaaaagctcagccatcaggct

SEQ ID NO: 242057 - DNA, 25 bp, Rattus norvegicus
catttaaaagctgagccatcaggct

SEQ ID NO: 242058 - DNA, 25 bp, Rattus norvegicus
catttaaacatgagcctgttgctgt

SEQ ID NO: 242059 - DNA, 25 bp, Rattus norvegicus
catttaaacatgtgcctgttgctgt

SEQ ID NO: 242060 - DNA, 25 bp, Rattus norvegicus
catttaaacctgcaatattttatgc

SEQ ID NO: 242061 - DNA, 25 bp, Rattus norvegicus
catttaaacctggaatattttatgc

SEQ ID NO: 242062 - DNA, 25 bp, Rattus norvegicus
catttaaattttccctgtcagtcta

SEQ ID NO: 242063 - DNA, 25 bp, Rattus norvegicus
catttaaattttgcctgtcagtcta

SEQ ID NO: 242064 - DNA, 25 bp, Rattus norvegicus
catttaaccaggaatgcacaggctg

SEQ ID NO: 242065 - DNA, 25 bp, Rattus norvegicus
catttaaccaggtatgcacaggctg

SEQ ID NO: 242066 - DNA, 25 bp, Rattus norvegicus
catttaactctcctaccacctgaat

SEQ ID NO: 242067 - DNA, 25 bp, Rattus norvegicus
catttaactctcgtaccacctgaat

SEQ ID NO: 242068 - DNA, 25 bp, Rattus norvegicus
catttaatattgctaagtgttcgtc

SEQ ID NO: 242069 - DNA, 25 bp, Rattus norvegicus
catttaatattggtaagtgttcgtc

SEQ ID NO: 242070 - DNA, 25 bp, Rattus norvegicus
catttaatgcttatatcacgtcaca

SEQ ID NO: 242071 - DNA, 25 bp, Rattus norvegicus
catttaatgcttttatcacgtcaca

SEQ ID NO: 242072 - DNA, 25 bp, Rattus norvegicus
catttaattctgatgcttctgtgta

SEQ ID NO: 242073 - DNA, 25 bp, Rattus norvegicus
catttaattctgttgcttctgtgta

SEQ ID NO: 242074 - DNA, 25 bp, Rattus norvegicus
catttaattcttaggttctttgctg

SEQ ID NO: 242075 - DNA, 25 bp, Rattus norvegicus
catttaattctttggttctttgctg

SEQ ID NO: 242076 - DNA, 25 bp, Rattus norvegicus
catttacagagaatcaaccgtccct

SEQ ID NO: 242077 - DNA, 25 bp, Rattus norvegicus
catttacagagattcaaccgtccct

SEQ ID NO: 242078 - DNA, 25 bp, Rattus norvegicus
catttacagaggaagaccagtagta

SEQ ID NO: 242079 - DNA, 25 bp, Rattus norvegicus
catttacagaggtagaccagtagta

SEQ ID NO: 242080 - DNA, 25 bp, Rattus norvegicus
catttacagagtcccttgttacttt

SEQ ID NO: 242081 - DNA, 25 bp, Rattus norvegicus
catttacagagtgccttgttacttt

SEQ ID NO: 242082 - DNA, 25 bp, Rattus norvegicus
catttacatgtgacccatatccttc

SEQ ID NO: 242083 - DNA, 25 bp, Rattus norvegicus
catttacatgtgtcccatatccttc

SEQ ID NO: 242084 - DNA, 25 bp, Rattus norvegicus
catttaccgtcacctccctgtagta

SEQ ID NO: 242085 - DNA, 25 bp, Rattus norvegicus
catttaccgtcagctccctgtagta

SEQ ID NO: 242086 - DNA, 25 bp, Rattus norvegicus
catttacctgcaaaccatctttgtg

SEQ ID NO: 242087 - DNA, 25 bp, Rattus norvegicus
catttacctgcataccatctttgtg

SEQ ID NO: 242088 - DNA, 25 bp, Rattus norvegicus
catttactattcctttgggctcttt

SEQ ID NO: 242089 - DNA, 25 bp, Rattus norvegicus
catttactattcgtttgggctcttt

SEQ ID NO: 242090 - DNA, 25 bp, Rattus norvegicus
catttactctgtatggacatatgaa

SEQ ID NO: 242091 - DNA, 25 bp, Rattus norvegicus
catttactctgtttggacatatgaa

SEQ ID NO: 242092 - DNA, 25 bp, Rattus norvegicus
catttactgggaatacttgaggttt

SEQ ID NO: 242093 - DNA, 25 bp, Rattus norvegicus
catttactgggattacttgaggttt

SEQ ID NO: 242094 - DNA, 25 bp, Rattus norvegicus
catttacttatcagacattcgtgct

SEQ ID NO: 242095 - DNA, 25 bp, Rattus norvegicus
catttacttatctgacattcgtgct

SEQ ID NO: 242096 - DNA, 25 bp, Rattus norvegicus
catttacttattacccatttacaat

SEQ ID NO: 242097 - DNA, 25 bp, Rattus norvegicus
catttacttatttcccatttacaat

SEQ ID NO: 242098 - DNA, 25 bp, Rattus norvegicus
catttacttcgtcgtgctgcccggg

SEQ ID NO: 242099 - DNA, 25 bp, Rattus norvegicus
catttacttcgtggtgctgcccggg

SEQ ID NO: 242100 - DNA, 25 bp, Rattus norvegicus
catttacttctcaggtgtgacttta

SEQ ID NO: 242101 - DNA, 25 bp, Rattus norvegicus
catttacttctctggtgtgacttta

SEQ ID NO: 242102 - DNA, 25 bp, Rattus norvegicus
catttactttctcccctgggctttg

SEQ ID NO: 242103 - DNA, 25 bp, Rattus norvegicus
catttactttctgccctgggctttg

SEQ ID NO: 242104 - DNA, 25 bp, Rattus norvegicus
catttagacgataacttttttcagt

SEQ ID NO: 242105 - DNA, 25 bp, Rattus norvegicus
catttagacgattacttttttcagt

SEQ ID NO: 242106 - DNA, 25 bp, Rattus norvegicus
catttagttgccattatgtttctga

SEQ ID NO: 242107 - DNA, 25 bp, Rattus norvegicus
catttagttgcctttatgtttctga

SEQ ID NO: 242108 - DNA, 25 bp, Rattus norvegicus
catttatcagcgagggacatcggcc

SEQ ID NO: 242109 - DNA, 25 bp, Rattus norvegicus
catttatcagcgtgggacatcggcc

SEQ ID NO: 242110 - DNA, 25 bp, Rattus norvegicus
catttatctctaagggttacccaga

SEQ ID NO: 242111 - DNA, 25 bp, Rattus norvegicus
catttatctctatgggttacccaga

SEQ ID NO: 242112 - DNA, 25 bp, Rattus norvegicus
catttatggtgtcgtcccgtggaga

SEQ ID NO: 242113 - DNA, 25 bp, Rattus norvegicus
catttatggtgtggtcccgtggaga

SEQ ID NO: 242114 - DNA, 25 bp, Rattus norvegicus
catttatgtcgtccttggagctgtg

SEQ ID NO: 242115 - DNA, 25 bp, Rattus norvegicus
catttatgtcgtgcttggagctgtg

SEQ ID NO: 242116 - DNA, 25 bp, Rattus norvegicus
catttatgtgtaatttgtctccttc

SEQ ID NO: 242117 - DNA, 25 bp, Rattus norvegicus
catttatgtgtattttgtctccttc

SEQ ID NO: 242118 - DNA, 25 bp, Rattus norvegicus
catttattatgtctgcttgggctat

SEQ ID NO: 242119 - DNA, 25 bp, Rattus norvegicus
catttattatgtgtgcttgggctat

SEQ ID NO: 242120 - DNA, 25 bp, Rattus norvegicus
catttattgcttcttgggtctgacc

SEQ ID NO: 242121 - DNA, 25 bp, Rattus norvegicus
catttattgcttgttgggtctgacc

SEQ ID NO: 242122 - DNA, 25 bp, Rattus norvegicus
catttattgtgaccatccctaggga

SEQ ID NO: 242123 - DNA, 25 bp, Rattus norvegicus
catttattgtgagcatccctaggga

SEQ ID NO: 242124 - DNA, 25 bp, Rattus norvegicus
catttatttaacaaaactgtcttgg

SEQ ID NO: 242125 - DNA, 25 bp, Rattus norvegicus
catttatttaactaaactgtcttgg

SEQ ID NO: 242126 - DNA, 25 bp, Rattus norvegicus
catttatttcctataccgtctcagt

SEQ ID NO: 242127 - DNA, 25 bp, Rattus norvegicus
catttatttcctttaccgtctcagt

SEQ ID NO: 242128 - DNA, 25 bp, Rattus norvegicus
catttcaaatgcatgtgtaggtaca

SEQ ID NO: 242129 - DNA, 25 bp, Rattus norvegicus
catttcaaatgcttgtgtaggtaca

SEQ ID NO: 242130 - DNA, 25 bp, Rattus norvegicus
catttcaaggtactggactccagga

SEQ ID NO: 242131 - DNA, 25 bp, Rattus norvegicus
catttcaaggtagtggactccagga

SEQ ID NO: 242132 - DNA, 25 bp, Rattus norvegicus
catttcacacctccgtgtcctggat

SEQ ID NO: 242133 - DNA, 25 bp, Rattus norvegicus
catttcacacctgcgtgtcctggat

SEQ ID NO: 242134 - DNA, 25 bp, Rattus norvegicus
catttcacatcccactacctgagaa

SEQ ID NO: 242135 - DNA, 25 bp, Rattus norvegicus
catttcacatccgactacctgagaa

SEQ ID NO: 242136 - DNA, 25 bp, Rattus norvegicus
catttcaccgtaaggataagctaca

SEQ ID NO: 242137 - DNA, 25 bp, Rattus norvegicus
catttcaccgtatggataagctaca

SEQ ID NO: 242138 - DNA, 25 bp, Rattus norvegicus
catttcacctccatacatgttattc

SEQ ID NO: 242139 - DNA, 25 bp, Rattus norvegicus
catttcacctccttacatgttattc

SEQ ID NO: 242140 - DNA, 25 bp, Rattus norvegicus
catttcactcttcgttttcaggata

SEQ ID NO: 242141 - DNA, 25 bp, Rattus norvegicus
catttcactcttggttttcaggata

SEQ ID NO: 242142 - DNA, 25 bp, Rattus norvegicus
catttcactgagcatcatgtcctga

SEQ ID NO: 242143 - DNA, 25 bp, Rattus norvegicus
catttcactgaggatcatgtcctga

SEQ ID NO: 242144 - DNA, 25 bp, Rattus norvegicus
catttcaggaccatgcactgcacca

SEQ ID NO: 242145 - DNA, 25 bp, Rattus norvegicus
catttcaggaccttgcactgcacca

SEQ ID NO: 242146 - DNA, 25 bp, Rattus norvegicus
catttcagtggcatggcaatggtga

SEQ ID NO: 242147 - DNA, 25 bp, Rattus norvegicus
catttcagtggcttggcaatggtga

SEQ ID NO: 242148 - DNA, 25 bp, Rattus norvegicus
catttcatagaaactgtactgggtt

SEQ ID NO: 242149 - DNA, 25 bp, Rattus norvegicus
catttcatagaatctgtactgggtt

SEQ ID NO: 242150 - DNA, 25 bp, Rattus norvegicus
catttcatcttgatttcatgctgga

SEQ ID NO: 242151 - DNA, 25 bp, Rattus norvegicus
catttcatcttgttttcatgctgga

SEQ ID NO: 242152 - DNA, 25 bp, Rattus norvegicus
catttcatggacagattggtttcaa

SEQ ID NO: 242153 - DNA, 25 bp, Rattus norvegicus
catttcatggactgattggtttcaa

SEQ ID NO: 242154 - DNA, 25 bp, Rattus norvegicus
catttcatggttagtctcagagact

SEQ ID NO: 242155 - DNA, 25 bp, Rattus norvegicus
catttcatggtttgtctcagagact

SEQ ID NO: 242156 - DNA, 25 bp, Rattus norvegicus
catttcattagtctctgtcacctag

SEQ ID NO: 242157 - DNA, 25 bp, Rattus norvegicus
catttcattagtgtctgtcacctag

SEQ ID NO: 242158 - DNA, 25 bp, Rattus norvegicus
catttcattccacattttcccaggg

SEQ ID NO: 242159 - DNA, 25 bp, Rattus norvegicus
catttcattccagattttcccaggg

SEQ ID NO: 242160 - DNA, 25 bp, Rattus norvegicus
catttcattgggattttgccccatc

SEQ ID NO: 242161 - DNA, 25 bp, Rattus norvegicus
catttcattgggtttttgccccatc

SEQ ID NO: 242162 - DNA, 25 bp, Rattus norvegicus
catttccaaattaacaggcgtcttt

SEQ ID NO: 242163 - DNA, 25 bp, Rattus norvegicus
catttccaaatttacaggcgtcttt

SEQ ID NO: 242164 - DNA, 25 bp, Rattus norvegicus
catttccaacctctactgattttta

SEQ ID NO: 242165 - DNA, 25 bp, Rattus norvegicus
catttccaacctgtactgattttta

SEQ ID NO: 242166 - DNA, 25 bp, Rattus norvegicus
catttccaatagacctgaccttttc

SEQ ID NO: 242167 - DNA, 25 bp, Rattus norvegicus
catttccaatagtcctgaccttttc

SEQ ID NO: 242168 - DNA, 25 bp, Rattus norvegicus
catttccacctgcaattttcccaac

SEQ ID NO: 242169 - DNA, 25 bp, Rattus norvegicus
catttccacctggaattttcccaac

SEQ ID NO: 242170 - DNA, 25 bp, Rattus norvegicus
catttccagcctcttatgtatcaat

SEQ ID NO: 242171 - DNA, 25 bp, Rattus norvegicus
catttccagcctgttatgtatcaat

SEQ ID NO: 242172 - DNA, 25 bp, Rattus norvegicus
catttccagctaccgtgactttgtt

SEQ ID NO: 242173 - DNA, 25 bp, Rattus norvegicus
catttccagctagcgtgactttgtt

SEQ ID NO: 242174 - DNA, 25 bp, Rattus norvegicus
catttccagttccagatgagtcaaa

SEQ ID NO: 242175 - DNA, 25 bp, Rattus norvegicus
catttccagttcgagatgagtcaaa

SEQ ID NO: 242176 - DNA, 25 bp, Rattus norvegicus
catttccatctgaggtaaactttat

SEQ ID NO: 242177 - DNA, 25 bp, Rattus norvegicus
catttccatctgtggtaaactttat

SEQ ID NO: 242178 - DNA, 25 bp, Rattus norvegicus
catttccatttgcttctgtcagatt

SEQ ID NO: 242179 - DNA, 25 bp, Rattus norvegicus
catttccatttggttctgtcagatt

SEQ ID NO: 242180 - DNA, 25 bp, Rattus norvegicus
catttcccaaagaatgtgcagtctt

SEQ ID NO: 242181 - DNA, 25 bp, Rattus norvegicus
catttcccaaagtatgtgcagtctt

SEQ ID NO: 242182 - DNA, 25 bp, Rattus norvegicus
catttcccaaatcccttacttttca

SEQ ID NO: 242183 - DNA, 25 bp, Rattus norvegicus
catttcccaaatgccttacttttca

SEQ ID NO: 242184 - DNA, 25 bp, Rattus norvegicus
catttcccacggatgtaaagtgtgt

SEQ ID NO: 242185 - DNA, 25 bp, Rattus norvegicus
catttcccacggttgtaaagtgtgt

SEQ ID NO: 242186 - DNA, 25 bp, Rattus norvegicus
catttcccaggtagagccagatata

SEQ ID NO: 242187 - DNA, 25 bp, Rattus norvegicus
catttcccaggttgagccagatata

SEQ ID NO: 242188 - DNA, 25 bp, Rattus norvegicus
catttcccatctcctccaataaagg

SEQ ID NO: 242189 - DNA, 25 bp, Rattus norvegicus
catttcccatctgctccaataaagg

SEQ ID NO: 242190 - DNA, 25 bp, Rattus norvegicus
catttccccaatatactctcttagt

SEQ ID NO: 242191 - DNA, 25 bp, Rattus norvegicus
catttccccaatttactctcttagt

SEQ ID NO: 242192 - DNA, 25 bp, Rattus norvegicus
catttcccctgaacataatacaaca

SEQ ID NO: 242193 - DNA, 25 bp, Rattus norvegicus
catttcccctgatcataatacaaca

SEQ ID NO: 242194 - DNA, 25 bp, Rattus norvegicus
catttcccctttaaatctactgtct

SEQ ID NO: 242195 - DNA, 25 bp, Rattus norvegicus
catttccccttttaatctactgtct

SEQ ID NO: 242196 - DNA, 25 bp, Rattus norvegicus
catttcccgttaatgttacttcatc

SEQ ID NO: 242197 - DNA, 25 bp, Rattus norvegicus
catttcccgttattgttacttcatc

SEQ ID NO: 242198 - DNA, 25 bp, Rattus norvegicus
catttcccttgtagtcgttgtatat

SEQ ID NO: 242199 - DNA, 25 bp, Rattus norvegicus
catttcccttgttgtcgttgtatat

SEQ ID NO: 242200 - DNA, 25 bp, Rattus norvegicus
catttcctaggaaccgcatttgggt

SEQ ID NO: 242201 - DNA, 25 bp, Rattus norvegicus
catttcctaggatccgcatttgggt

SEQ ID NO: 242202 - DNA, 25 bp, Rattus norvegicus
catttcctcaaaagtgtgtgtctaa

SEQ ID NO: 242203 - DNA, 25 bp, Rattus norvegicus
catttcctcaaatgtgtgtgtctaa

SEQ ID NO: 242204 - DNA, 25 bp, Rattus norvegicus
catttcctcgttaactgcacttaat

SEQ ID NO: 242205 - DNA, 25 bp, Rattus norvegicus
catttcctcgtttactgcacttaat

SEQ ID NO: 242206 - DNA, 25 bp, Rattus norvegicus
catttcctctttattctaccaagct

SEQ ID NO: 242207 - DNA, 25 bp, Rattus norvegicus
catttcctcttttttctaccaagct

SEQ ID NO: 242208 - DNA, 25 bp, Rattus norvegicus
catttccttaaaatgttttgcagat

SEQ ID NO: 242209 - DNA, 25 bp, Rattus norvegicus
catttccttaaattgttttgcagat

SEQ ID NO: 242210 - DNA, 25 bp, Rattus norvegicus
catttccttccccatgtagaattgt

SEQ ID NO: 242211 - DNA, 25 bp, Rattus norvegicus
catttccttcccgatgtagaattgt

SEQ ID NO: 242212 - DNA, 25 bp, Rattus norvegicus
catttcctttaaaccagaactcctt

SEQ ID NO: 242213 - DNA, 25 bp, Rattus norvegicus
catttcctttaatccagaactcctt

SEQ ID NO: 242214 - DNA, 25 bp, Rattus norvegicus
catttcctttcaccatgatgatata

SEQ ID NO: 242215 - DNA, 25 bp, Rattus norvegicus
catttcctttcagcatgatgatata

SEQ ID NO: 242216 - DNA, 25 bp, Rattus norvegicus
catttcctttgcctgacagtcatag

SEQ ID NO: 242217 - DNA, 25 bp, Rattus norvegicus
catttcctttgcgtgacagtcatag

SEQ ID NO: 242218 - DNA, 25 bp, Rattus norvegicus
catttcgacataatagttacccaat

SEQ ID NO: 242219 - DNA, 25 bp, Rattus norvegicus
catttcgacatattagttacccaat

SEQ ID NO: 242220 - DNA, 25 bp, Rattus norvegicus
catttcgactctcttgaggacgttc

SEQ ID NO: 242221 - DNA, 25 bp, Rattus norvegicus
catttcgactctgttgaggacgttc

SEQ ID NO: 242222 - DNA, 25 bp, Rattus norvegicus
catttcgatcctcgtcaggtgcagg

SEQ ID NO: 242223 - DNA, 25 bp, Rattus norvegicus
catttcgatcctggtcaggtgcagg

SEQ ID NO: 242224 - DNA, 25 bp, Rattus norvegicus
catttcgcacatatggctgattgaa

SEQ ID NO: 242225 - DNA, 25 bp, Rattus norvegicus
catttcgcacatttggctgattgaa

SEQ ID NO: 242226 - DNA, 25 bp, Rattus norvegicus
catttcgcgtgtcgcagcaactggc

SEQ ID NO: 242227 - DNA, 25 bp, Rattus norvegicus
catttcgcgtgtggcagcaactggc

SEQ ID NO: 242228 - DNA, 25 bp, Rattus norvegicus
catttcggagctcagactatgtaca

SEQ ID NO: 242229 - DNA, 25 bp, Rattus norvegicus
catttcggagctgagactatgtaca

SEQ ID NO: 242230 - DNA, 25 bp, Rattus norvegicus
catttcggtaccactgagttttctt

SEQ ID NO: 242231 - DNA, 25 bp, Rattus norvegicus
catttcggtacctctgagttttctt

SEQ ID NO: 242232 - DNA, 25 bp, Rattus norvegicus
catttcggtatgacattgatatttt

SEQ ID NO: 242233 - DNA, 25 bp, Rattus norvegicus
catttcggtatgagaggttgccaac

SEQ ID NO: 242234 - DNA, 25 bp, Rattus norvegicus
catttcggtatgtcattgatatttt

SEQ ID NO: 242235 - DNA, 25 bp, Rattus norvegicus
catttcggtatgtgaggttgccaac

SEQ ID NO: 242236 - DNA, 25 bp, Rattus norvegicus
catttcgtcccaaagtctgagtact

SEQ ID NO: 242237 - DNA, 25 bp, Rattus norvegicus
catttcgtcccatagtctgagtact

SEQ ID NO: 242238 - DNA, 25 bp, Rattus norvegicus
catttcgttcatagtgtttgctgtt

SEQ ID NO: 242239 - DNA, 25 bp, Rattus norvegicus
catttcgttcattgtgtttgctgtt

SEQ ID NO: 242240 - DNA, 25 bp, Rattus norvegicus
catttcgttctgaattcttgtttct

SEQ ID NO: 242241 - DNA, 25 bp, Rattus norvegicus
catttcgttctgtattcttgtttct

SEQ ID NO: 242242 - DNA, 25 bp, Rattus norvegicus
catttctaccctatgctgcctagta

SEQ ID NO: 242243 - DNA, 25 bp, Rattus norvegicus
catttctaccctttgctgcctagta

SEQ ID NO: 242244 - DNA, 25 bp, Rattus norvegicus
catttctagatacccaatgcccttc

SEQ ID NO: 242245 - DNA, 25 bp, Rattus norvegicus
catttctagatagccaatgcccttc

SEQ ID NO: 242246 - DNA, 25 bp, Rattus norvegicus
catttctaggctccaggtactcaaa

SEQ ID NO: 242247 - DNA, 25 bp, Rattus norvegicus
catttctaggctgcaggtactcaaa

SEQ ID NO: 242248 - DNA, 25 bp, Rattus norvegicus
catttctagttcatcctggacttga

SEQ ID NO: 242249 - DNA, 25 bp, Rattus norvegicus
catttctagttcttcctggacttga

SEQ ID NO: 242250 - DNA, 25 bp, Rattus norvegicus
catttctataagctcgctctggata

SEQ ID NO: 242251 - DNA, 25 bp, Rattus norvegicus
catttctataaggtcgctctggata

SEQ ID NO: 242252 - DNA, 25 bp, Rattus norvegicus
catttctcagatattcttggtttta

SEQ ID NO: 242253 - DNA, 25 bp, Rattus norvegicus
catttctcagattttcttggtttta

SEQ ID NO: 242254 - DNA, 25 bp, Rattus norvegicus
catttctcccaaccaactctagtga

SEQ ID NO: 242255 - DNA, 25 bp, Rattus norvegicus
catttctcccaagcaactctagtga

SEQ ID NO: 242256 - DNA, 25 bp, Rattus norvegicus
catttctccctacttgatttttctt

SEQ ID NO: 242257 - DNA, 25 bp, Rattus norvegicus
catttctccctagttgatttttctt

SEQ ID NO: 242258 - DNA, 25 bp, Rattus norvegicus
catttctccgttccttacagatagc

SEQ ID NO: 242259 - DNA, 25 bp, Rattus norvegicus
catttctccgttgcttacagatagc

SEQ ID NO: 242260 - DNA, 25 bp, Rattus norvegicus
catttctcctctacattctgttgat

SEQ ID NO: 242261 - DNA, 25 bp, Rattus norvegicus
catttctcctcttcattctgttgat

SEQ ID NO: 242262 - DNA, 25 bp, Rattus norvegicus
catttctcctgcctttaggaacggg

SEQ ID NO: 242263 - DNA, 25 bp, Rattus norvegicus
catttctcctgcgtttaggaacggg

SEQ ID NO: 242264 - DNA, 25 bp, Rattus norvegicus
catttctcgtacagctgtgcagttt

SEQ ID NO: 242265 - DNA, 25 bp, Rattus norvegicus
catttctcgtactgctgtgcagttt

SEQ ID NO: 242266 - DNA, 25 bp, Rattus norvegicus
catttctctaaaaatcatcccgctg

SEQ ID NO: 242267 - DNA, 25 bp, Rattus norvegicus
catttctctaaatatcatcccgctg

SEQ ID NO: 242268 - DNA, 25 bp, Rattus norvegicus
catttctctctgagtcagctagaca

SEQ ID NO: 242269 - DNA, 25 bp, Rattus norvegicus
catttctctctgtgtcagctagaca

SEQ ID NO: 242270 - DNA, 25 bp, Rattus norvegicus
catttctctgtacgcatgtaaaata

SEQ ID NO: 242271 - DNA, 25 bp, Rattus norvegicus
catttctctgtaggcatgtaaaata

SEQ ID NO: 242272 - DNA, 25 bp, Rattus norvegicus
catttctctgttagtttttctgtgt

SEQ ID NO: 242273 - DNA, 25 bp, Rattus norvegicus
catttctctgtttgtttttctgtgt

SEQ ID NO: 242274 - DNA, 25 bp, Rattus norvegicus
catttctcttgcaaggatccctttg

SEQ ID NO: 242275 - DNA, 25 bp, Rattus norvegicus
catttctcttgctaggatccctttg

SEQ ID NO: 242276 - DNA, 25 bp, Rattus norvegicus
catttctgacttcagcttctaattt

SEQ ID NO: 242277 - DNA, 25 bp, Rattus norvegicus
catttctgacttgagcttctaattt

SEQ ID NO: 242278 - DNA, 25 bp, Rattus norvegicus
catttctgcgtgaggccttagtata

SEQ ID NO: 242279 - DNA, 25 bp, Rattus norvegicus
catttctgcgtgtggccttagtata

SEQ ID NO: 242280 - DNA, 25 bp, Rattus norvegicus
catttctgctgactttgcttgacca

SEQ ID NO: 242281 - DNA, 25 bp, Rattus norvegicus
catttctgctgagtttgcttgacca

SEQ ID NO: 242282 - DNA, 25 bp, Rattus norvegicus
catttctgcttcaactgggtgtgga

SEQ ID NO: 242283 - DNA, 25 bp, Rattus norvegicus
catttctgcttctactgggtgtgga

SEQ ID NO: 242284 - DNA, 25 bp, Rattus norvegicus
catttctgggtcataaactgcatat

SEQ ID NO: 242285 - DNA, 25 bp, Rattus norvegicus
catttctgggtcttaaactgcatat

SEQ ID NO: 242286 - DNA, 25 bp, Rattus norvegicus
catttctgtcctagtggtatggcac

SEQ ID NO: 242287 - DNA, 25 bp, Rattus norvegicus
catttctgtccttgtggtatggcac

SEQ ID NO: 242288 - DNA, 25 bp, Rattus norvegicus
catttcttacatagctccttcattg

SEQ ID NO: 242289 - DNA, 25 bp, Rattus norvegicus
catttcttacattgctccttcattg

SEQ ID NO: 242290 - DNA, 25 bp, Rattus norvegicus
catttcttcattacctatgtgcagt

SEQ ID NO: 242291 - DNA, 25 bp, Rattus norvegicus
catttcttcatttcctatgtgcagt

SEQ ID NO: 242292 - DNA, 25 bp, Rattus norvegicus
catttcttcttgaatcctggagctg

SEQ ID NO: 242293 - DNA, 25 bp, Rattus norvegicus
catttcttcttgtatcctggagctg

SEQ ID NO: 242294 - DNA, 25 bp, Rattus norvegicus
catttcttctttcttccatttactt

SEQ ID NO: 242295 - DNA, 25 bp, Rattus norvegicus
catttcttctttgttccatttactt

SEQ ID NO: 242296 - DNA, 25 bp, Rattus norvegicus
catttcttgacactgttctctggcg

SEQ ID NO: 242297 - DNA, 25 bp, Rattus norvegicus
catttcttgacagtgttctctggcg

SEQ ID NO: 242298 - DNA, 25 bp, Rattus norvegicus
catttcttgattctaacttttctga

SEQ ID NO: 242299 - DNA, 25 bp, Rattus norvegicus
catttcttgattgtaacttttctga

SEQ ID NO: 242300 - DNA, 25 bp, Rattus norvegicus
catttcttgttcagcgatatatggg

SEQ ID NO: 242301 - DNA, 25 bp, Rattus norvegicus
catttcttgttctgcgatatatggg

SEQ ID NO: 242302 - DNA, 25 bp, Rattus norvegicus
catttctttagaccttcgtttgttg

SEQ ID NO: 242303 - DNA, 25 bp, Rattus norvegicus
catttctttagagcttcgtttgttg

SEQ ID NO: 242304 - DNA, 25 bp, Rattus norvegicus
catttctttattactggttcttcag

SEQ ID NO: 242305 - DNA, 25 bp, Rattus norvegicus
catttctttatttctggttcttcag

SEQ ID NO: 242306 - DNA, 25 bp, Rattus norvegicus
catttctttgtcaggttctggctag

SEQ ID NO: 242307 - DNA, 25 bp, Rattus norvegicus
catttctttgtctggttctggctag

SEQ ID NO: 242308 - DNA, 25 bp, Rattus norvegicus
catttcttttacagggctgaaactc

SEQ ID NO: 242309 - DNA, 25 bp, Rattus norvegicus
catttcttttactgggctgaaactc

SEQ ID NO: 242310 - DNA, 25 bp, Rattus norvegicus
catttctttttcactggtagagaag

SEQ ID NO: 242311 - DNA, 25 bp, Rattus norvegicus
catttctttttctctggtagagaag

SEQ ID NO: 242312 - DNA, 25 bp, Rattus norvegicus
catttgaaccctagctttctttcct

SEQ ID NO: 242313 - DNA, 25 bp, Rattus norvegicus
catttgaacccttgctttctttcct

SEQ ID NO: 242314 - DNA, 25 bp, Rattus norvegicus
catttgacatccaccagacatcata

SEQ ID NO: 242315 - DNA, 25 bp, Rattus norvegicus
catttgacatcctccagacatcata

SEQ ID NO: 242316 - DNA, 25 bp, Rattus norvegicus
catttgacttctaaccaacctttgt

SEQ ID NO: 242317 - DNA, 25 bp, Rattus norvegicus
catttgacttcttaccaacctttgt

SEQ ID NO: 242318 - DNA, 25 bp, Rattus norvegicus
catttgaggagtaccgtcgcaaggg

SEQ ID NO: 242319 - DNA, 25 bp, Rattus norvegicus
catttgaggagttccgtcgcaaggg

SEQ ID NO: 242320 - DNA, 25 bp, Rattus norvegicus
catttgataattatcccagccagcc

SEQ ID NO: 242321 - DNA, 25 bp, Rattus norvegicus
catttgataattttcccagccagcc

SEQ ID NO: 242322 - DNA, 25 bp, Rattus norvegicus
catttgattcctattgtaaagctga

SEQ ID NO: 242323 - DNA, 25 bp, Rattus norvegicus
catttgattccttttgtaaagctga

SEQ ID NO: 242324 - DNA, 25 bp, Rattus norvegicus
catttgcaacagctgggactctctc

SEQ ID NO: 242325 - DNA, 25 bp, Rattus norvegicus
catttgcaacaggtgggactctctc

SEQ ID NO: 242326 - DNA, 25 bp, Rattus norvegicus
catttgcaattcagagtcctactaa

SEQ ID NO: 242327 - DNA, 25 bp, Rattus norvegicus
catttgcaattctgagtcctactaa

SEQ ID NO: 242328 - DNA, 25 bp, Rattus norvegicus
catttgcagcatacagtgttttcta

SEQ ID NO: 242329 - DNA, 25 bp, Rattus norvegicus
catttgcagcattcagtgttttcta

SEQ ID NO: 242330 - DNA, 25 bp, Rattus norvegicus
catttgcatatcctggtttgctttc

SEQ ID NO: 242331 - DNA, 25 bp, Rattus norvegicus
catttgcatatcgtggtttgctttc

SEQ ID NO: 242332 - DNA, 25 bp, Rattus norvegicus
catttgcatctgatacctctagtgt

SEQ ID NO: 242333 - DNA, 25 bp, Rattus norvegicus
catttgcatctgttacctctagtgt

SEQ ID NO: 242334 - DNA, 25 bp, Rattus norvegicus
catttgccaggactgtgaacgagat

SEQ ID NO: 242335 - DNA, 25 bp, Rattus norvegicus
catttgccaggagtgtgaacgagat

SEQ ID NO: 242336 - DNA, 25 bp, Rattus norvegicus
catttgccatctcttgctgctgctg

SEQ ID NO: 242337 - DNA, 25 bp, Rattus norvegicus
catttgccatctgttgctgctgctg

SEQ ID NO: 242338 - DNA, 25 bp, Rattus norvegicus
catttgccatgactgaattataatc

SEQ ID NO: 242339 - DNA, 25 bp, Rattus norvegicus
catttgccatgagtgaattataatc

SEQ ID NO: 242340 - DNA, 25 bp, Rattus norvegicus
catttgccatttatgctactgcctt

SEQ ID NO: 242341 - DNA, 25 bp, Rattus norvegicus
catttgccatttttgctactgcctt

SEQ ID NO: 242342 - DNA, 25 bp, Rattus norvegicus
catttgcccatgactttttattttt

SEQ ID NO: 242343 - DNA, 25 bp, Rattus norvegicus
catttgcccatgcttcagggtcaat

SEQ ID NO: 242344 - DNA, 25 bp, Rattus norvegicus
catttgcccatggttcagggtcaat

SEQ ID NO: 242345 - DNA, 25 bp, Rattus norvegicus
catttgcccatgtctttttattttt

SEQ ID NO: 242346 - DNA, 25 bp, Rattus norvegicus
catttgccccacataacacagtcaa

SEQ ID NO: 242347 - DNA, 25 bp, Rattus norvegicus
catttgccccacttaacacagtcaa

SEQ ID NO: 242348 - DNA, 25 bp, Rattus norvegicus
catttgctcatcagggtttagtgaa

SEQ ID NO: 242349 - DNA, 25 bp, Rattus norvegicus
catttgctcatctgggtttagtgaa

SEQ ID NO: 242350 - DNA, 25 bp, Rattus norvegicus
catttgctctcccaaaacagattag

SEQ ID NO: 242351 - DNA, 25 bp, Rattus norvegicus
catttgctctccgaaaacagattag

SEQ ID NO: 242352 - DNA, 25 bp, Rattus norvegicus
catttgctgaaaatcagaccttgca

SEQ ID NO: 242353 - DNA, 25 bp, Rattus norvegicus
catttgctgaaattcagaccttgca

SEQ ID NO: 242354 - DNA, 25 bp, Rattus norvegicus
catttgctgctcctgactttaagat

SEQ ID NO: 242355 - DNA, 25 bp, Rattus norvegicus
catttgctgctcgtgactttaagat

SEQ ID NO: 242356 - DNA, 25 bp, Rattus norvegicus
catttgctggtgataggtgtgctca

SEQ ID NO: 242357 - DNA, 25 bp, Rattus norvegicus
catttgctggtgttaggtgtgctca

SEQ ID NO: 242358 - DNA, 25 bp, Rattus norvegicus
catttgcttactcagatccactttt

SEQ ID NO: 242359 - DNA, 25 bp, Rattus norvegicus
catttgcttactgagatccactttt

SEQ ID NO: 242360 - DNA, 25 bp, Rattus norvegicus
catttgcttcgtaaccacttactaa

SEQ ID NO: 242361 - DNA, 25 bp, Rattus norvegicus
catttgcttcgttaccacttactaa

SEQ ID NO: 242362 - DNA, 25 bp, Rattus norvegicus
catttgctttttccttgtgctgaac

SEQ ID NO: 242363 - DNA, 25 bp, Rattus norvegicus
catttgctttttgcttgtgctgaac

SEQ ID NO: 242364 - DNA, 25 bp, Rattus norvegicus
catttggaagaacagggagcctcta

SEQ ID NO: 242365 - DNA, 25 bp, Rattus norvegicus
catttggaagaagagggagcctcta

SEQ ID NO: 242366 - DNA, 25 bp, Rattus norvegicus
catttggaatacatgaactgttcta

SEQ ID NO: 242367 - DNA, 25 bp, Rattus norvegicus
catttggaatacttgaactgttcta

SEQ ID NO: 242368 - DNA, 25 bp, Rattus norvegicus
catttggaccaaacactttattctg

SEQ ID NO: 242369 - DNA, 25 bp, Rattus norvegicus
catttggaccaatcactttattctg

SEQ ID NO: 242370 - DNA, 25 bp, Rattus norvegicus
catttggaccacaaatccctttact

SEQ ID NO: 242371 - DNA, 25 bp, Rattus norvegicus
catttggaccactaatccctttact

SEQ ID NO: 242372 - DNA, 25 bp, Rattus norvegicus
catttggactttagcacctgttgtt

SEQ ID NO: 242373 - DNA, 25 bp, Rattus norvegicus
catttggacttttgcacctgttgtt

SEQ ID NO: 242374 - DNA, 25 bp, Rattus norvegicus
catttggagctacgccttctacgaa

SEQ ID NO: 242375 - DNA, 25 bp, Rattus norvegicus
catttggagctaggccttctacgaa

SEQ ID NO: 242376 - DNA, 25 bp, Rattus norvegicus
catttggaggttctttctcttttct

SEQ ID NO: 242377 - DNA, 25 bp, Rattus norvegicus
catttggaggttgtttctcttttct

SEQ ID NO: 242378 - DNA, 25 bp, Rattus norvegicus
catttggattttccgtcttggagga

SEQ ID NO: 242379 - DNA, 25 bp, Rattus norvegicus
catttggattttgcgtcttggagga

SEQ ID NO: 242380 - DNA, 25 bp, Rattus norvegicus
catttggcaagcagaggactgtcct

SEQ ID NO: 242381 - DNA, 25 bp, Rattus norvegicus
catttggcaagctgaggactgtcct

SEQ ID NO: 242382 - DNA, 25 bp, Rattus norvegicus
catttggctatcatttttatttggg

SEQ ID NO: 242383 - DNA, 25 bp, Rattus norvegicus
catttggctatcttttttatttggg

SEQ ID NO: 242384 - DNA, 25 bp, Rattus norvegicus
catttgggaatgacgcttctcccga

SEQ ID NO: 242385 - DNA, 25 bp, Rattus norvegicus
catttgggaatgtcgcttctcccga

SEQ ID NO: 242386 - DNA, 25 bp, Rattus norvegicus
catttgggtttcagtgtggcatctc

SEQ ID NO: 242387 - DNA, 25 bp, Rattus norvegicus
catttgggtttctgtgtggcatctc

SEQ ID NO: 242388 - DNA, 25 bp, Rattus norvegicus
catttggtacatctgtgtctgctta

SEQ ID NO: 242389 - DNA, 25 bp, Rattus norvegicus
catttggtacatgtgtgtctgctta

SEQ ID NO: 242390 - DNA, 25 bp, Rattus norvegicus
catttggtaccaaagcgtgacgagc

SEQ ID NO: 242391 - DNA, 25 bp, Rattus norvegicus
catttggtaccatagcgtgacgagc

SEQ ID NO: 242392 - DNA, 25 bp, Rattus norvegicus
catttggtggtgaatgaacttcaga

SEQ ID NO: 242393 - DNA, 25 bp, Rattus norvegicus
catttggtggtgtatgaacttcaga

SEQ ID NO: 242394 - DNA, 25 bp, Rattus norvegicus
catttggttctcagtaagctctgtc

SEQ ID NO: 242395 - DNA, 25 bp, Rattus norvegicus
catttggttctctgtaagctctgtc

SEQ ID NO: 242396 - DNA, 25 bp, Rattus norvegicus
catttggtttgaacaggtccacttt

SEQ ID NO: 242397 - DNA, 25 bp, Rattus norvegicus
catttggtttgatcaggtccacttt

SEQ ID NO: 242398 - DNA, 25 bp, Rattus norvegicus
catttggttttcaagctgcacatcc

SEQ ID NO: 242399 - DNA, 25 bp, Rattus norvegicus
catttggttttcagcacgtggctgc

SEQ ID NO: 242400 - DNA, 25 bp, Rattus norvegicus
catttggttttctagctgcacatcc

SEQ ID NO: 242401 - DNA, 25 bp, Rattus norvegicus
catttggttttctgcacgtggctgc

SEQ ID NO: 242402 - DNA, 25 bp, Rattus norvegicus
catttgtaaactagctgtgggtcca

SEQ ID NO: 242403 - DNA, 25 bp, Rattus norvegicus
catttgtaaacttgctgtgggtcca

SEQ ID NO: 242404 - DNA, 25 bp, Rattus norvegicus
catttgtaatacaggctggcccgga

SEQ ID NO: 242405 - DNA, 25 bp, Rattus norvegicus
catttgtaatactggctggcccgga

SEQ ID NO: 242406 - DNA, 25 bp, Rattus norvegicus
catttgtataccagaatttatttta

SEQ ID NO: 242407 - DNA, 25 bp, Rattus norvegicus
catttgtatacctgaatttatttta

SEQ ID NO: 242408 - DNA, 25 bp, Rattus norvegicus
catttgtatcatctgttgttgtagg

SEQ ID NO: 242409 - DNA, 25 bp, Rattus norvegicus
catttgtatcatgtgttgttgtagg

SEQ ID NO: 242410 - DNA, 25 bp, Rattus norvegicus
catttgtatccaaggtgctgaatct

SEQ ID NO: 242411 - DNA, 25 bp, Rattus norvegicus
catttgtatccatggtgctgaatct

SEQ ID NO: 242412 - DNA, 25 bp, Rattus norvegicus
catttgtcagacaccacatgtggca

SEQ ID NO: 242413 - DNA, 25 bp, Rattus norvegicus
catttgtcagactccacatgtggca

SEQ ID NO: 242414 - DNA, 25 bp, Rattus norvegicus
catttgtctgctctaatttttatat

SEQ ID NO: 242415 - DNA, 25 bp, Rattus norvegicus
catttgtctgctgtaatttttatat

SEQ ID NO: 242416 - DNA, 25 bp, Rattus norvegicus
catttgtgccctcggttaatgtgtc

SEQ ID NO: 242417 - DNA, 25 bp, Rattus norvegicus
catttgtgccctgggttaatgtgtc

SEQ ID NO: 242418 - DNA, 25 bp, Rattus norvegicus
catttgtggaagcaacaccggccta

SEQ ID NO: 242419 - DNA, 25 bp, Rattus norvegicus
catttgtggaaggaacaccggccta

SEQ ID NO: 242420 - DNA, 25 bp, Rattus norvegicus
catttgtgtctcatttagtgcagta

SEQ ID NO: 242421 - DNA, 25 bp, Rattus norvegicus
catttgtgtctcttttagtgcagta

SEQ ID NO: 242422 - DNA, 25 bp, Rattus norvegicus
catttgttaccacctgcagcagatt

SEQ ID NO: 242423 - DNA, 25 bp, Rattus norvegicus
catttgttaccagctgcagcagatt

SEQ ID NO: 242424 - DNA, 25 bp, Rattus norvegicus
catttgttcaagacagtttggtgct

SEQ ID NO: 242425 - DNA, 25 bp, Rattus norvegicus
catttgttcaagtcagtttggtgct

SEQ ID NO: 242426 - DNA, 25 bp, Rattus norvegicus
catttgttcccaaggtgctggattc

SEQ ID NO: 242427 - DNA, 25 bp, Rattus norvegicus
catttgttcccatggtgctggattc

SEQ ID NO: 242428 - DNA, 25 bp, Rattus norvegicus
catttgttctgtagctttctccaac

SEQ ID NO: 242429 - DNA, 25 bp, Rattus norvegicus
catttgttctgttgctttctccaac

SEQ ID NO: 242430 - DNA, 25 bp, Rattus norvegicus
catttgttggacagcttccgactca

SEQ ID NO: 242431 - DNA, 25 bp, Rattus norvegicus
catttgttggactgcttccgactca

SEQ ID NO: 242432 - DNA, 25 bp, Rattus norvegicus
catttgtttaccacttgtttatgta

SEQ ID NO: 242433 - DNA, 25 bp, Rattus norvegicus
catttgtttacctcttgtttatgta

SEQ ID NO: 242434 - DNA, 25 bp, Rattus norvegicus
catttgtttattacctaccctgtca

SEQ ID NO: 242435 - DNA, 25 bp, Rattus norvegicus
catttgtttatttcctaccctgtca

SEQ ID NO: 242436 - DNA, 25 bp, Rattus norvegicus
catttgtttctaatcatctgaccac

SEQ ID NO: 242437 - DNA, 25 bp, Rattus norvegicus
catttgtttctattcatctgaccac

SEQ ID NO: 242438 - DNA, 25 bp, Rattus norvegicus
catttgtttctcatgaagggtctgt

SEQ ID NO: 242439 - DNA, 25 bp, Rattus norvegicus
catttgtttctcttgaagggtctgt

SEQ ID NO: 242440 - DNA, 25 bp, Rattus norvegicus
catttgtttgataatgtggtcctca

SEQ ID NO: 242441 - DNA, 25 bp, Rattus norvegicus
catttgtttgattatgtggtcctca

SEQ ID NO: 242442 - DNA, 25 bp, Rattus norvegicus
cattttaaacctctgtttttcatcg

SEQ ID NO: 242443 - DNA, 25 bp, Rattus norvegicus
cattttaaacctgtgtttttcatcg

SEQ ID NO: 242444 - DNA, 25 bp, Rattus norvegicus
cattttaaagctctggttgccattt

SEQ ID NO: 242445 - DNA, 25 bp, Rattus norvegicus
cattttaaagctgtggttgccattt

SEQ ID NO: 242446 - DNA, 25 bp, Rattus norvegicus
cattttaaaggcctttgctgcagaa

SEQ ID NO: 242447 - DNA, 25 bp, Rattus norvegicus
cattttaaaggcgtttgctgcagaa

SEQ ID NO: 242448 - DNA, 25 bp, Rattus norvegicus
cattttaatttcctgtcccttgtca

SEQ ID NO: 242449 - DNA, 25 bp, Rattus norvegicus
cattttaatttcgtgtcccttgtca

SEQ ID NO: 242450 - DNA, 25 bp, Rattus norvegicus
cattttacaaatctctcagtgcaga

SEQ ID NO: 242451 - DNA, 25 bp, Rattus norvegicus
cattttacaaatgtctcagtgcaga

SEQ ID NO: 242452 - DNA, 25 bp, Rattus norvegicus
cattttaccatcacaagcctcagaa

SEQ ID NO: 242453 - DNA, 25 bp, Rattus norvegicus
cattttaccatctcaagcctcagaa

SEQ ID NO: 242454 - DNA, 25 bp, Rattus norvegicus
cattttacccatactgccaggtttt

SEQ ID NO: 242455 - DNA, 25 bp, Rattus norvegicus
cattttacccattctgccaggtttt

SEQ ID NO: 242456 - DNA, 25 bp, Rattus norvegicus
cattttactcttattctgagcatgg

SEQ ID NO: 242457 - DNA, 25 bp, Rattus norvegicus
cattttactctttttctgagcatgg

SEQ ID NO: 242458 - DNA, 25 bp, Rattus norvegicus
cattttactggtcacgtcagcttca

SEQ ID NO: 242459 - DNA, 25 bp, Rattus norvegicus
cattttactggtgacgtcagcttca

SEQ ID NO: 242460 - DNA, 25 bp, Rattus norvegicus
cattttactgtaatgaggcgcgtgt

SEQ ID NO: 242461 - DNA, 25 bp, Rattus norvegicus
cattttactgtattgaggcgcgtgt

SEQ ID NO: 242462 - DNA, 25 bp, Rattus norvegicus
cattttagccccaaggactatcagt

SEQ ID NO: 242463 - DNA, 25 bp, Rattus norvegicus
cattttagcccctaggactatcagt

SEQ ID NO: 242464 - DNA, 25 bp, Rattus norvegicus
cattttatacttcttcctgttgagg

SEQ ID NO: 242465 - DNA, 25 bp, Rattus norvegicus
cattttatacttgttcctgttgagg

SEQ ID NO: 242466 - DNA, 25 bp, Rattus norvegicus
cattttatatctaattcgggaaata

SEQ ID NO: 242467 - DNA, 25 bp, Rattus norvegicus
cattttatatcttattcgggaaata

SEQ ID NO: 242468 - DNA, 25 bp, Rattus norvegicus
cattttatcattcactttgcagagt

SEQ ID NO: 242469 - DNA, 25 bp, Rattus norvegicus
cattttatcattgactttgcagagt

SEQ ID NO: 242470 - DNA, 25 bp, Rattus norvegicus
cattttcagcatcgttctagggaac

SEQ ID NO: 242471 - DNA, 25 bp, Rattus norvegicus
cattttcagcatggttctagggaac

SEQ ID NO: 242472 - DNA, 25 bp, Rattus norvegicus
cattttcataatcccaagcctgtcg

SEQ ID NO: 242473 - DNA, 25 bp, Rattus norvegicus
cattttcataatgccaagcctgtcg

SEQ ID NO: 242474 - DNA, 25 bp, Rattus norvegicus
cattttccagctacagtgttttgga

SEQ ID NO: 242475 - DNA, 25 bp, Rattus norvegicus
cattttccagcttcagtgttttgga

SEQ ID NO: 242476 - DNA, 25 bp, Rattus norvegicus
cattttcccaaacccatggtgcttc

SEQ ID NO: 242477 - DNA, 25 bp, Rattus norvegicus
cattttcccaaagccatggtgcttc

SEQ ID NO: 242478 - DNA, 25 bp, Rattus norvegicus
cattttccctgacttacaagtgtag

SEQ ID NO: 242479 - DNA, 25 bp, Rattus norvegicus
cattttccctgagttacaagtgtag

SEQ ID NO: 242480 - DNA, 25 bp, Rattus norvegicus
cattttcccttgaaaatgctccttc

SEQ ID NO: 242481 - DNA, 25 bp, Rattus norvegicus
cattttcccttgtaaatgctccttc

SEQ ID NO: 242482 - DNA, 25 bp, Rattus norvegicus
cattttcctatgcttctgaaggcta

SEQ ID NO: 242483 - DNA, 25 bp, Rattus norvegicus
cattttcctatggttctgaaggcta

SEQ ID NO: 242484 - DNA, 25 bp, Rattus norvegicus
cattttcctcctagacgtcgttgga

SEQ ID NO: 242485 - DNA, 25 bp, Rattus norvegicus
cattttcctccttgacgtcgttgga

SEQ ID NO: 242486 - DNA, 25 bp, Rattus norvegicus
cattttccttcacacttagactact

SEQ ID NO: 242487 - DNA, 25 bp, Rattus norvegicus
cattttccttcagacttagactact

SEQ ID NO: 242488 - DNA, 25 bp, Rattus norvegicus
cattttccttttacacggatttatg

SEQ ID NO: 242489 - DNA, 25 bp, Rattus norvegicus
cattttcctttttcacggatttatg

SEQ ID NO: 242490 - DNA, 25 bp, Rattus norvegicus
cattttcgtcggctttgttagtgga

SEQ ID NO: 242491 - DNA, 25 bp, Rattus norvegicus
cattttcgtcgggtttgttagtgga

SEQ ID NO: 242492 - DNA, 25 bp, Rattus norvegicus
cattttcgtggtcttgtttagggca

SEQ ID NO: 242493 - DNA, 25 bp, Rattus norvegicus
cattttcgtggtgttgtttagggca

SEQ ID NO: 242494 - DNA, 25 bp, Rattus norvegicus
cattttctgcataaccatctggttt

SEQ ID NO: 242495 - DNA, 25 bp, Rattus norvegicus
cattttctgcattaccatctggttt

SEQ ID NO: 242496 - DNA, 25 bp, Rattus norvegicus
cattttctgccccagcaggtagaaa

SEQ ID NO: 242497 - DNA, 25 bp, Rattus norvegicus
cattttctgcccgagcaggtagaaa

SEQ ID NO: 242498 - DNA, 25 bp, Rattus norvegicus
cattttctgctgataaccctgggta

SEQ ID NO: 242499 - DNA, 25 bp, Rattus norvegicus
cattttctgctgttaaccctgggta

SEQ ID NO: 242500 - DNA, 25 bp, Rattus norvegicus
cattttctggaacgtctgctgggcg

SEQ ID NO: 242501 - DNA, 25 bp, Rattus norvegicus
cattttctggaaggtctgctgggcg

SEQ ID NO: 242502 - DNA, 25 bp, Rattus norvegicus
cattttctggctacttctttcccag

SEQ ID NO: 242503 - DNA, 25 bp, Rattus norvegicus
cattttctggcttcttctttcccag

SEQ ID NO: 242504 - DNA, 25 bp, Rattus norvegicus
cattttctggttaggtgtttgagga

SEQ ID NO: 242505 - DNA, 25 bp, Rattus norvegicus
cattttctggtttggtgtttgagga

SEQ ID NO: 242506 - DNA, 25 bp, Rattus norvegicus
cattttctgtacacgatgttgacct

SEQ ID NO: 242507 - DNA, 25 bp, Rattus norvegicus
cattttctgtactcgatgttgacct

SEQ ID NO: 242508 - DNA, 25 bp, Rattus norvegicus
cattttcttagacgacacagctttc

SEQ ID NO: 242509 - DNA, 25 bp, Rattus norvegicus
cattttcttagaggacacagctttc

SEQ ID NO: 242510 - DNA, 25 bp, Rattus norvegicus
cattttcttgggagttgagtggagt

SEQ ID NO: 242511 - DNA, 25 bp, Rattus norvegicus
cattttcttgggtgttgagtggagt

SEQ ID NO: 242512 - DNA, 25 bp, Rattus norvegicus
cattttctttaacatctcggctact

SEQ ID NO: 242513 - DNA, 25 bp, Rattus norvegicus
cattttctttaagatctcggctact

SEQ ID NO: 242514 - DNA, 25 bp, Rattus norvegicus
cattttctttacaacacatgcccag

SEQ ID NO: 242515 - DNA, 25 bp, Rattus norvegicus
cattttctttactacacatgcccag

SEQ ID NO: 242516 - DNA, 25 bp, Rattus norvegicus
cattttcttttgcattcctgattat

SEQ ID NO: 242517 - DNA, 25 bp, Rattus norvegicus
cattttcttttggattcctgattat

SEQ ID NO: 242518 - DNA, 25 bp, Rattus norvegicus
cattttgacatgcttgatctccagt

SEQ ID NO: 242519 - DNA, 25 bp, Rattus norvegicus
cattttgacatggttgatctccagt

SEQ ID NO: 242520 - DNA, 25 bp, Rattus norvegicus
cattttgaccttaggacacccagag

SEQ ID NO: 242521 - DNA, 25 bp, Rattus norvegicus
cattttgacctttggacacccagag

SEQ ID NO: 242522 - DNA, 25 bp, Rattus norvegicus
cattttgatgcgcaccttggtgaca

SEQ ID NO: 242523 - DNA, 25 bp, Rattus norvegicus
cattttgatgcggaccttggtgaca

SEQ ID NO: 242524 - DNA, 25 bp, Rattus norvegicus
cattttgcatccatgtgacttgtca

SEQ ID NO: 242525 - DNA, 25 bp, Rattus norvegicus
cattttgcatccttgtgacttgtca

SEQ ID NO: 242526 - DNA, 25 bp, Rattus norvegicus
cattttgccaacaggttctgtgtta

SEQ ID NO: 242527 - DNA, 25 bp, Rattus norvegicus
cattttgccaactggttctgtgtta

SEQ ID NO: 242528 - DNA, 25 bp, Rattus norvegicus
cattttgccatcagtctcttatgat

SEQ ID NO: 242529 - DNA, 25 bp, Rattus norvegicus
cattttgccatctgtctcttatgat

SEQ ID NO: 242530 - DNA, 25 bp, Rattus norvegicus
cattttgcggctattggagtgagat

SEQ ID NO: 242531 - DNA, 25 bp, Rattus norvegicus
cattttgcggcttttggagtgagat

SEQ ID NO: 242532 - DNA, 25 bp, Rattus norvegicus
cattttgctatgcattcactctaat

SEQ ID NO: 242533 - DNA, 25 bp, Rattus norvegicus
cattttgctatggattcactctaat

SEQ ID NO: 242534 - DNA, 25 bp, Rattus norvegicus
cattttgctggcatgtgatgggctc

SEQ ID NO: 242535 - DNA, 25 bp, Rattus norvegicus
cattttgctggcttgtgatgggctc

SEQ ID NO: 242536 - DNA, 25 bp, Rattus norvegicus
cattttgctgtgagctacttcctgc

SEQ ID NO: 242537 - DNA, 25 bp, Rattus norvegicus
cattttgctgtgtgctacttcctgc

SEQ ID NO: 242538 - DNA, 25 bp, Rattus norvegicus
cattttggaagtcactgctgctgtt

SEQ ID NO: 242539 - DNA, 25 bp, Rattus norvegicus
cattttggaagtgactgctgctgtt

SEQ ID NO: 242540 - DNA, 25 bp, Rattus norvegicus
cattttggaccaaatctgtacatag

SEQ ID NO: 242541 - DNA, 25 bp, Rattus norvegicus
cattttggaccatatctgtacatag

SEQ ID NO: 242542 - DNA, 25 bp, Rattus norvegicus
cattttggcatccagctatggcttg

SEQ ID NO: 242543 - DNA, 25 bp, Rattus norvegicus
cattttggcatcgagctatggcttg

SEQ ID NO: 242544 - DNA, 25 bp, Rattus norvegicus
cattttggctgcagtattggtggta

SEQ ID NO: 242545 - DNA, 25 bp, Rattus norvegicus
cattttggctgctgtattggtggta

SEQ ID NO: 242546 - DNA, 25 bp, Rattus norvegicus
cattttgggctcacctctagagaga

SEQ ID NO: 242547 - DNA, 25 bp, Rattus norvegicus
cattttgggctctcctctagagaga

SEQ ID NO: 242548 - DNA, 25 bp, Rattus norvegicus
cattttggtttcatttcacagccct

SEQ ID NO: 242549 - DNA, 25 bp, Rattus norvegicus
cattttggtttcttttcacagccct

SEQ ID NO: 242550 - DNA, 25 bp, Rattus norvegicus
cattttggttttctatagcttatat

SEQ ID NO: 242551 - DNA, 25 bp, Rattus norvegicus
cattttggttttgtatagcttatat

SEQ ID NO: 242552 - DNA, 25 bp, Rattus norvegicus
cattttgtaacaatttgggtttcat

SEQ ID NO: 242553 - DNA, 25 bp, Rattus norvegicus
cattttgtaacattttgggtttcat

SEQ ID NO: 242554 - DNA, 25 bp, Rattus norvegicus
cattttgtaggcctggctggccttg

SEQ ID NO: 242555 - DNA, 25 bp, Rattus norvegicus
cattttgtaggcgtggctggccttg

SEQ ID NO: 242556 - DNA, 25 bp, Rattus norvegicus
cattttgtagttactgccttccaga

SEQ ID NO: 242557 - DNA, 25 bp, Rattus norvegicus
cattttgtagtttctgccttccaga

SEQ ID NO: 242558 - DNA, 25 bp, Rattus norvegicus
cattttgtcagtcatgaggcggtac

SEQ ID NO: 242559 - DNA, 25 bp, Rattus norvegicus
cattttgtcagtgatgaggcggtac

SEQ ID NO: 242560 - DNA, 25 bp, Rattus norvegicus
cattttgtccccatgtatgtattct

SEQ ID NO: 242561 - DNA, 25 bp, Rattus norvegicus
cattttgtccccttgtatgtattct

SEQ ID NO: 242562 - DNA, 25 bp, Rattus norvegicus
cattttgtgactcttgccgttttct

SEQ ID NO: 242563 - DNA, 25 bp, Rattus norvegicus
cattttgtgactgttgccgttttct

SEQ ID NO: 242564 - DNA, 25 bp, Rattus norvegicus
cattttgtgataacagatgctttga

SEQ ID NO: 242565 - DNA, 25 bp, Rattus norvegicus
cattttgtgatatcagatgctttga

SEQ ID NO: 242566 - DNA, 25 bp, Rattus norvegicus
cattttgtgtaacactgtctaattt

SEQ ID NO: 242567 - DNA, 25 bp, Rattus norvegicus
cattttgtgtaagactgtctaattt

SEQ ID NO: 242568 - DNA, 25 bp, Rattus norvegicus
cattttgtgttgattctggctttga

SEQ ID NO: 242569 - DNA, 25 bp, Rattus norvegicus
cattttgtgttgtttctggctttga

SEQ ID NO: 242570 - DNA, 25 bp, Rattus norvegicus
cattttgtttatccacttggtggat

SEQ ID NO: 242571 - DNA, 25 bp, Rattus norvegicus
cattttgtttatgcacttggtggat

SEQ ID NO: 242572 - DNA, 25 bp, Rattus norvegicus
cattttgtttgtactaccttgccaa

SEQ ID NO: 242573 - DNA, 25 bp, Rattus norvegicus
cattttgtttgttctaccttgccaa

SEQ ID NO: 242574 - DNA, 25 bp, Rattus norvegicus
catttttaacagatcacatgaataa

SEQ ID NO: 242575 - DNA, 25 bp, Rattus norvegicus
catttttaacagttcacatgaataa

SEQ ID NO: 242576 - DNA, 25 bp, Rattus norvegicus
catttttactttcctcttggagatt

SEQ ID NO: 242577 - DNA, 25 bp, Rattus norvegicus
catttttactttgctcttggagatt

SEQ ID NO: 242578 - DNA, 25 bp, Rattus norvegicus
catttttataacactatagcactag

SEQ ID NO: 242579 - DNA, 25 bp, Rattus norvegicus
catttttataactctatagcactag

SEQ ID NO: 242580 - DNA, 25 bp, Rattus norvegicus
catttttatacaatttagtggcctt

SEQ ID NO: 242581 - DNA, 25 bp, Rattus norvegicus
catttttatacacccctcatttgac

SEQ ID NO: 242582 - DNA, 25 bp, Rattus norvegicus
catttttatacagccctcatttgac

SEQ ID NO: 242583 - DNA, 25 bp, Rattus norvegicus
catttttatacattttagtggcctt

SEQ ID NO: 242584 - DNA, 25 bp, Rattus norvegicus
catttttatcacatctcttatccaa

SEQ ID NO: 242585 - DNA, 25 bp, Rattus norvegicus
catttttatcacttctcttatccaa

SEQ ID NO: 242586 - DNA, 25 bp, Rattus norvegicus
catttttcaaatcaaggtagttcaa

SEQ ID NO: 242587 - DNA, 25 bp, Rattus norvegicus
catttttcaaatgaaggtagttcaa

SEQ ID NO: 242588 - DNA, 25 bp, Rattus norvegicus
catttttcacagactctaacagtca

SEQ ID NO: 242589 - DNA, 25 bp, Rattus norvegicus
catttttcacagtctctaacagtca

SEQ ID NO: 242590 - DNA, 25 bp, Rattus norvegicus
catttttcagttactctttgggcac

SEQ ID NO: 242591 - DNA, 25 bp, Rattus norvegicus
catttttcagtttctctttgggcac

SEQ ID NO: 242592 - DNA, 25 bp, Rattus norvegicus
catttttcccaaatttctcctgatt

SEQ ID NO: 242593 - DNA, 25 bp, Rattus norvegicus
catttttcccaattttctcctgatt

SEQ ID NO: 242594 - DNA, 25 bp, Rattus norvegicus
catttttccgtcactgaagcgggaa

SEQ ID NO: 242595 - DNA, 25 bp, Rattus norvegicus
catttttccgtctctgaagcgggaa

SEQ ID NO: 242596 - DNA, 25 bp, Rattus norvegicus
catttttctaagaatggccttcagg

SEQ ID NO: 242597 - DNA, 25 bp, Rattus norvegicus
catttttctaagtatggccttcagg

SEQ ID NO: 242598 - DNA, 25 bp, Rattus norvegicus
catttttcttctctggctgaggctt

SEQ ID NO: 242599 - DNA, 25 bp, Rattus norvegicus
catttttcttctgtggctgaggctt

SEQ ID NO: 242600 - DNA, 25 bp, Rattus norvegicus
catttttcttgccatttatagtctt

SEQ ID NO: 242601 - DNA, 25 bp, Rattus norvegicus
catttttcttgcgatttatagtctt

SEQ ID NO: 242602 - DNA, 25 bp, Rattus norvegicus
catttttgactgaaccatttgctgg

SEQ ID NO: 242603 - DNA, 25 bp, Rattus norvegicus
catttttgactgtaccatttgctgg

SEQ ID NO: 242604 - DNA, 25 bp, Rattus norvegicus
catttttgtttccatgcttaagcat

SEQ ID NO: 242605 - DNA, 25 bp, Rattus norvegicus
catttttgtttcgatgcttaagcat

SEQ ID NO: 242606 - DNA, 25 bp, Rattus norvegicus
cattttttcctgaggaactccctgg

SEQ ID NO: 242607 - DNA, 25 bp, Rattus norvegicus
cattttttcctgtggaactccctgg

SEQ ID NO: 242608 - DNA, 25 bp, Rattus norvegicus
cattttttctggagcggtgtaggat

SEQ ID NO: 242609 - DNA, 25 bp, Rattus norvegicus
cattttttctggtgcggtgtaggat

SEQ ID NO: 242610 - DNA, 25 bp, Rattus norvegicus
ccaaaaagaagtcatccaggccaga

SEQ ID NO: 242611 - DNA, 25 bp, Rattus norvegicus
ccaaaaagaagtgatccaggccaga

SEQ ID NO: 242612 - DNA, 25 bp, Rattus norvegicus
ccaaaacatcctactataccacaag

SEQ ID NO: 242613 - DNA, 25 bp, Rattus norvegicus
ccaaaacatccttctataccacaag

SEQ ID NO: 242614 - DNA, 25 bp, Rattus norvegicus
ccaaaaccacatcggtagctgggag

SEQ ID NO: 242615 - DNA, 25 bp, Rattus norvegicus
ccaaaaccacatgggtagctgggag

SEQ ID NO: 242616 - DNA, 25 bp, Rattus norvegicus
ccaaaacggtttcccagctgaacag

SEQ ID NO: 242617 - DNA, 25 bp, Rattus norvegicus
ccaaaacggtttgccagctgaacag

SEQ ID NO: 242618 - DNA, 25 bp, Rattus norvegicus
ccaaaactagccatgcttgctgctg

SEQ ID NO: 242619 - DNA, 25 bp, Rattus norvegicus
ccaaaactagccttgcttgctgctg

SEQ ID NO: 242620 - DNA, 25 bp, Rattus norvegicus
ccaaaactgcttcttcttgatccta

SEQ ID NO: 242621 - DNA, 25 bp, Rattus norvegicus
ccaaaactgcttgttcttgatccta

SEQ ID NO: 242622 - DNA, 25 bp, Rattus norvegicus
ccaaaacttcctatatgcactcatt

SEQ ID NO: 242623 - DNA, 25 bp, Rattus norvegicus
ccaaaacttcctttatgcactcatt

SEQ ID NO: 242624 - DNA, 25 bp, Rattus norvegicus
ccaaaacttctacattcccctgtag

SEQ ID NO: 242625 - DNA, 25 bp, Rattus norvegicus
ccaaaacttctagattcccctgtag

SEQ ID NO: 242626 - DNA, 25 bp, Rattus norvegicus
ccaaaagatgatcgcttgaactcag

SEQ ID NO: 242627 - DNA, 25 bp, Rattus norvegicus
ccaaaagatgatggcttgaactcag

SEQ ID NO: 242628 - DNA, 25 bp, Rattus norvegicus
ccaaaagcttatctcgggcccaggc

SEQ ID NO: 242629 - DNA, 25 bp, Rattus norvegicus
ccaaaagcttatgtcgggcccaggc

SEQ ID NO: 242630 - DNA, 25 bp, Rattus norvegicus
ccaaaaggctatcttgttcctccat

SEQ ID NO: 242631 - DNA, 25 bp, Rattus norvegicus
ccaaaaggctatgttgttcctccat

SEQ ID NO: 242632 - DNA, 25 bp, Rattus norvegicus
ccaaaatatctccaggcaccctaaa

SEQ ID NO: 242633 - DNA, 25 bp, Rattus norvegicus
ccaaaatatctcgaggcaccctaaa

SEQ ID NO: 242634 - DNA, 25 bp, Rattus norvegicus
ccaaaatccttaccatgaacccata

SEQ ID NO: 242635 - DNA, 25 bp, Rattus norvegicus
ccaaaatccttagcatgaacccata

SEQ ID NO: 242636 - DNA, 25 bp, Rattus norvegicus
ccaaaatccttcactggctttcaca

SEQ ID NO: 242637 - DNA, 25 bp, Rattus norvegicus
ccaaaatccttctctggctttcaca

SEQ ID NO: 242638 - DNA, 25 bp, Rattus norvegicus
ccaaaattactcacgtcgagggcaa

SEQ ID NO: 242639 - DNA, 25 bp, Rattus norvegicus
ccaaaattactctcgtcgagggcaa

SEQ ID NO: 242640 - DNA, 25 bp, Rattus norvegicus
ccaaaattcgttatccacattccag

SEQ ID NO: 242641 - DNA, 25 bp, Rattus norvegicus
ccaaaattcgttttccacattccag

SEQ ID NO: 242642 - DNA, 25 bp, Rattus norvegicus
ccaaacaaggccaggcagtactagt

SEQ ID NO: 242643 - DNA, 25 bp, Rattus norvegicus
ccaaacaaggcctggcagtactagt

SEQ ID NO: 242644 - DNA, 25 bp, Rattus norvegicus
ccaaacaatctgaccgtcaactgaa

SEQ ID NO: 242645 - DNA, 25 bp, Rattus norvegicus
ccaaacaatctgtccgtcaactgaa

SEQ ID NO: 242646 - DNA, 25 bp, Rattus norvegicus
ccaaacacgcgcaggcataaggcag

SEQ ID NO: 242647 - DNA, 25 bp, Rattus norvegicus
ccaaacacgcgctggcataaggcag

SEQ ID NO: 242648 - DNA, 25 bp, Rattus norvegicus
ccaaacacggtgagacgactatgtc

SEQ ID NO: 242649 - DNA, 25 bp, Rattus norvegicus
ccaaacacggtgtgacgactatgtc

SEQ ID NO: 242650 - DNA, 25 bp, Rattus norvegicus
ccaaacacgtctccagtctacaaga

SEQ ID NO: 242651 - DNA, 25 bp, Rattus norvegicus
ccaaacacgtctgcagtctacaaga

SEQ ID NO: 242652 - DNA, 25 bp, Rattus norvegicus
ccaaacagtggtcccgggcaatgcg

SEQ ID NO: 242653 - DNA, 25 bp, Rattus norvegicus
ccaaacagtggtgccgggcaatgcg

SEQ ID NO: 242654 - DNA, 25 bp, Rattus norvegicus
ccaaaccaggctccgggatatacac

SEQ ID NO: 242655 - DNA, 25 bp, Rattus norvegicus
ccaaaccaggctgcgggatatacac

SEQ ID NO: 242656 - DNA, 25 bp, Rattus norvegicus
ccaaaccataggcacgagatcggat

SEQ ID NO: 242657 - DNA, 25 bp, Rattus norvegicus
ccaaaccatagggacgagatcggat

SEQ ID NO: 242658 - DNA, 25 bp, Rattus norvegicus
ccaaacctactgcagtaccaacagg

SEQ ID NO: 242659 - DNA, 25 bp, Rattus norvegicus
ccaaacctactggagtaccaacagg

SEQ ID NO: 242660 - DNA, 25 bp, Rattus norvegicus
ccaaacctcatccaaacctatgtga

SEQ ID NO: 242661 - DNA, 25 bp, Rattus norvegicus
ccaaacctcatcgaaacctatgtga

SEQ ID NO: 242662 - DNA, 25 bp, Rattus norvegicus
ccaaacctgaggcatagatcaagtg

SEQ ID NO: 242663 - DNA, 25 bp, Rattus norvegicus
ccaaacctgagggatagatcaagtg

SEQ ID NO: 242664 - DNA, 25 bp, Rattus norvegicus
ccaaaccttaccagctggccaatga

SEQ ID NO: 242665 - DNA, 25 bp, Rattus norvegicus
ccaaaccttacctgctggccaatga

SEQ ID NO: 242666 - DNA, 25 bp, Rattus norvegicus
ccaaacctttatcccagaagtccag

SEQ ID NO: 242667 - DNA, 25 bp, Rattus norvegicus
ccaaacctttatgccagaagtccag

SEQ ID NO: 242668 - DNA, 25 bp, Rattus norvegicus
ccaaacggatcgcttattcttcata

SEQ ID NO: 242669 - DNA, 25 bp, Rattus norvegicus
ccaaacggatcggttattcttcata

SEQ ID NO: 242670 - DNA, 25 bp, Rattus norvegicus
ccaaacgtctgaataaaggatgcaa

SEQ ID NO: 242671 - DNA, 25 bp, Rattus norvegicus
ccaaacgtctgattaaaggatgcaa

SEQ ID NO: 242672 - DNA, 25 bp, Rattus norvegicus
ccaaacgtgtttcacaaggaccata

SEQ ID NO: 242673 - DNA, 25 bp, Rattus norvegicus
ccaaacgtgtttgacaaggaccata

SEQ ID NO: 242674 - DNA, 25 bp, Rattus norvegicus
ccaaactccttgactctcatttgta

SEQ ID NO: 242675 - DNA, 25 bp, Rattus norvegicus
ccaaactccttgtctctcatttgta

SEQ ID NO: 242676 - DNA, 25 bp, Rattus norvegicus
ccaaactcgagaccctgcagggaga

SEQ ID NO: 242677 - DNA, 25 bp, Rattus norvegicus
ccaaactcgagagcctgcagggaga

SEQ ID NO: 242678 - DNA, 25 bp, Rattus norvegicus
ccaaactctgccctgactaatcatg

SEQ ID NO: 242679 - DNA, 25 bp, Rattus norvegicus
ccaaactctgccgtgactaatcatg

SEQ ID NO: 242680 - DNA, 25 bp, Rattus norvegicus
ccaaactggtatatcatactttaag

SEQ ID NO: 242681 - DNA, 25 bp, Rattus norvegicus
ccaaactggtatttcatactttaag

SEQ ID NO: 242682 - DNA, 25 bp, Rattus norvegicus
ccaaacttcaaccaaacttccaatg

SEQ ID NO: 242683 - DNA, 25 bp, Rattus norvegicus
ccaaacttcaacgaaacttccaatg

SEQ ID NO: 242684 - DNA, 25 bp, Rattus norvegicus
ccaaacttcaccctcttcaaaaatg

SEQ ID NO: 242685 - DNA, 25 bp, Rattus norvegicus
ccaaacttcaccgtcttcaaaaatg

SEQ ID NO: 242686 - DNA, 25 bp, Rattus norvegicus
ccaaacttgactactggatatcagt

SEQ ID NO: 242687 - DNA, 25 bp, Rattus norvegicus
ccaaacttgacttctggatatcagt

SEQ ID NO: 242688 - DNA, 25 bp, Rattus norvegicus
ccaaagactttcaactccaggctaa

SEQ ID NO: 242689 - DNA, 25 bp, Rattus norvegicus
ccaaagactttctactccaggctaa

SEQ ID NO: 242690 - DNA, 25 bp, Rattus norvegicus
ccaaagatcatgattctagtgtagt

SEQ ID NO: 242691 - DNA, 25 bp, Rattus norvegicus
ccaaagatcatgtttctagtgtagt

SEQ ID NO: 242692 - DNA, 25 bp, Rattus norvegicus
ccaaagattcaaacccctgggatcc

SEQ ID NO: 242693 - DNA, 25 bp, Rattus norvegicus
ccaaagattcaatcccctgggatcc

SEQ ID NO: 242694 - DNA, 25 bp, Rattus norvegicus
ccaaagcacacactcctcagaaaag

SEQ ID NO: 242695 - DNA, 25 bp, Rattus norvegicus
ccaaagcacacagtcctcagaaaag

SEQ ID NO: 242696 - DNA, 25 bp, Rattus norvegicus
ccaaagcacaggatcacactaacgt

SEQ ID NO: 242697 - DNA, 25 bp, Rattus norvegicus
ccaaagcacaggttcacactaacgt

SEQ ID NO: 242698 - DNA, 25 bp, Rattus norvegicus
ccaaagccatgtcctcagagcaata

SEQ ID NO: 242699 - DNA, 25 bp, Rattus norvegicus
ccaaagccatgtgctcagagcaata

SEQ ID NO: 242700 - DNA, 25 bp, Rattus norvegicus
ccaaagcctgctcccgtgatgaaaa

SEQ ID NO: 242701 - DNA, 25 bp, Rattus norvegicus
ccaaagcctgctgccgtgatgaaaa

SEQ ID NO: 242702 - DNA, 25 bp, Rattus norvegicus
ccaaagctgcggagctgtttgggct

SEQ ID NO: 242703 - DNA, 25 bp, Rattus norvegicus
ccaaagctgcggtgctgtttgggct

SEQ ID NO: 242704 - DNA, 25 bp, Rattus norvegicus
ccaaaggagaggagcaggccacaaa

SEQ ID NO: 242705 - DNA, 25 bp, Rattus norvegicus
ccaaaggagaggtgcaggccacaaa

SEQ ID NO: 242706 - DNA, 25 bp, Rattus norvegicus
ccaaaggagcttacatgttccctaa

SEQ ID NO: 242707 - DNA, 25 bp, Rattus norvegicus
ccaaaggagctttcatgttccctaa

SEQ ID NO: 242708 - DNA, 25 bp, Rattus norvegicus
ccaaaggagggcagttcttcctggt

SEQ ID NO: 242709 - DNA, 25 bp, Rattus norvegicus
ccaaaggagggctgttcttcctggt

SEQ ID NO: 242710 - DNA, 25 bp, Rattus norvegicus
ccaaaggccaacatagggtatccgt

SEQ ID NO: 242711 - DNA, 25 bp, Rattus norvegicus
ccaaaggccaacttagggtatccgt

SEQ ID NO: 242712 - DNA, 25 bp, Rattus norvegicus
ccaaaggctgcgagggccagtttga

SEQ ID NO: 242713 - DNA, 25 bp, Rattus norvegicus
ccaaaggctgcgtgggccagtttga

SEQ ID NO: 242714 - DNA, 25 bp, Rattus norvegicus
ccaaaggctgtcaaggttagaaact

SEQ ID NO: 242715 - DNA, 25 bp, Rattus norvegicus
ccaaaggctgtctaggttagaaact

SEQ ID NO: 242716 - DNA, 25 bp, Rattus norvegicus
ccaaaggcttctaccagtgtgtggt

SEQ ID NO: 242717 - DNA, 25 bp, Rattus norvegicus
ccaaaggcttcttccagtgtgtggt

SEQ ID NO: 242718 - DNA, 25 bp, Rattus norvegicus
ccaaagggtgagagatctctaatat

SEQ ID NO: 242719 - DNA, 25 bp, Rattus norvegicus
ccaaagggtgagtgatctctaatat

SEQ ID NO: 242720 - DNA, 25 bp, Rattus norvegicus
ccaaaggtcatcaaaaggaactaat

SEQ ID NO: 242721 - DNA, 25 bp, Rattus norvegicus
ccaaaggtcatctaaaggaactaat

SEQ ID NO: 242722 - DNA, 25 bp, Rattus norvegicus
ccaaaggtgatgcactttccccatt

SEQ ID NO: 242723 - DNA, 25 bp, Rattus norvegicus
ccaaaggtgatggactttccccatt

SEQ ID NO: 242724 - DNA, 25 bp, Rattus norvegicus
ccaaagtaatttctccttgtaagat

SEQ ID NO: 242725 - DNA, 25 bp, Rattus norvegicus
ccaaagtaatttgtccttgtaagat

SEQ ID NO: 242726 - DNA, 25 bp, Rattus norvegicus
ccaaagtatcttaaggcatcacccc

SEQ ID NO: 242727 - DNA, 25 bp, Rattus norvegicus
ccaaagtatctttaggcatcacccc

SEQ ID NO: 242728 - DNA, 25 bp, Rattus norvegicus
ccaaagtgcccaattttcatctctg

SEQ ID NO: 242729 - DNA, 25 bp, Rattus norvegicus
ccaaagtgcccatttttcatctctg

SEQ ID NO: 242730 - DNA, 25 bp, Rattus norvegicus
ccaaatagagttcgaatgtatgtca

SEQ ID NO: 242731 - DNA, 25 bp, Rattus norvegicus
ccaaatagagttggaatgtatgtca

SEQ ID NO: 242732 - DNA, 25 bp, Rattus norvegicus
ccaaatatttcgctctcagtctagt

SEQ ID NO: 242733 - DNA, 25 bp, Rattus norvegicus
ccaaatatttcggtctcagtctagt

SEQ ID NO: 242734 - DNA, 25 bp, Rattus norvegicus
ccaaatcacgtacgccagggactgt

SEQ ID NO: 242735 - DNA, 25 bp, Rattus norvegicus
ccaaatcacgtaggccagggactgt

SEQ ID NO: 242736 - DNA, 25 bp, Rattus norvegicus
ccaaatcccagtatttcagctcagg

SEQ ID NO: 242737 - DNA, 25 bp, Rattus norvegicus
ccaaatcccagtttttcagctcagg

SEQ ID NO: 242738 - DNA, 25 bp, Rattus norvegicus
ccaaatccccggatggcacaagggt

SEQ ID NO: 242739 - DNA, 25 bp, Rattus norvegicus
ccaaatccccggttggcacaagggt

SEQ ID NO: 242740 - DNA, 25 bp, Rattus norvegicus
ccaaatccctgtactctgaagcaag

SEQ ID NO: 242741 - DNA, 25 bp, Rattus norvegicus
ccaaatccctgttctctgaagcaag

SEQ ID NO: 242742 - DNA, 25 bp, Rattus norvegicus
ccaaatcctggactacattcataaa

SEQ ID NO: 242743 - DNA, 25 bp, Rattus norvegicus
ccaaatcctggagtacattcataaa

SEQ ID NO: 242744 - DNA, 25 bp, Rattus norvegicus
ccaaatgacacacagcttttcctat

SEQ ID NO: 242745 - DNA, 25 bp, Rattus norvegicus
ccaaatgacacagagcttttcctat

SEQ ID NO: 242746 - DNA, 25 bp, Rattus norvegicus
ccaaatgatccgcgtcccgaatgct

SEQ ID NO: 242747 - DNA, 25 bp, Rattus norvegicus
ccaaatgatccgggtcccgaatgct

SEQ ID NO: 242748 - DNA, 25 bp, Rattus norvegicus
ccaaatggtcctcagcagtgcagaa

SEQ ID NO: 242749 - DNA, 25 bp, Rattus norvegicus
ccaaatggtcctgagcagtgcagaa

SEQ ID NO: 242750 - DNA, 25 bp, Rattus norvegicus
ccaaatggtggcactaggttcaatg

SEQ ID NO: 242751 - DNA, 25 bp, Rattus norvegicus
ccaaatggtggctctaggttcaatg

SEQ ID NO: 242752 - DNA, 25 bp, Rattus norvegicus
ccaaatgtaccccatgtgttacctg

SEQ ID NO: 242753 - DNA, 25 bp, Rattus norvegicus
ccaaatgtacccgatgtgttacctg

SEQ ID NO: 242754 - DNA, 25 bp, Rattus norvegicus
ccaaatgtgcctcatctcatctgaa

SEQ ID NO: 242755 - DNA, 25 bp, Rattus norvegicus
ccaaatgtgcctgatctcatctgaa

SEQ ID NO: 242756 - DNA, 25 bp, Rattus norvegicus
ccaaatgttattctaattgcctaaa

SEQ ID NO: 242757 - DNA, 25 bp, Rattus norvegicus
ccaaatgttattgtaattgcctaaa

SEQ ID NO: 242758 - DNA, 25 bp, Rattus norvegicus
ccaaattattaacagccaacagcag

SEQ ID NO: 242759 - DNA, 25 bp, Rattus norvegicus
ccaaattattaagagccaacagcag

SEQ ID NO: 242760 - DNA, 25 bp, Rattus norvegicus
ccaaattctgctcctgtacttgcaa

SEQ ID NO: 242761 - DNA, 25 bp, Rattus norvegicus
ccaaattctgctgctgtacttgcaa

SEQ ID NO: 242762 - DNA, 25 bp, Rattus norvegicus
ccaaattctggacaggcaggtgcca

SEQ ID NO: 242763 - DNA, 25 bp, Rattus norvegicus
ccaaattctggagaggcaggtgcca

SEQ ID NO: 242764 - DNA, 25 bp, Rattus norvegicus
ccaaattctgttcttgcttaaccag

SEQ ID NO: 242765 - DNA, 25 bp, Rattus norvegicus
ccaaattctgttgttgcttaaccag

SEQ ID NO: 242766 - DNA, 25 bp, Rattus norvegicus
ccaaatttgcctcgcccattggttc

SEQ ID NO: 242767 - DNA, 25 bp, Rattus norvegicus
ccaaatttgcctggcccattggttc

SEQ ID NO: 242768 - DNA, 25 bp, Rattus norvegicus
ccaaattttgcgctcggtgcgatac

SEQ ID NO: 242769 - DNA, 25 bp, Rattus norvegicus
ccaaattttgcggtcggtgcgatac

SEQ ID NO: 242770 - DNA, 25 bp, Rattus norvegicus
ccaacaatgggtcctggtccagggt

SEQ ID NO: 242771 - DNA, 25 bp, Rattus norvegicus
ccaacaatgggtgctggtccagggt

SEQ ID NO: 242772 - DNA, 25 bp, Rattus norvegicus
ccaacaccaacaagggaatcgatgt

SEQ ID NO: 242773 - DNA, 25 bp, Rattus norvegicus
ccaacaccaacatgggaatcgatgt

SEQ ID NO: 242774 - DNA, 25 bp, Rattus norvegicus
ccaacacgtgggaagtggaagctga

SEQ ID NO: 242775 - DNA, 25 bp, Rattus norvegicus
ccaacacgtgggtagtggaagctga

SEQ ID NO: 242776 - DNA, 25 bp, Rattus norvegicus
ccaacactccttacttttattacat

SEQ ID NO: 242777 - DNA, 25 bp, Rattus norvegicus
ccaacactcctttcttttattacat

SEQ ID NO: 242778 - DNA, 25 bp, Rattus norvegicus
ccaacacttgctccctagtactatg

SEQ ID NO: 242779 - DNA, 25 bp, Rattus norvegicus
ccaacacttgctgcctagtactatg

SEQ ID NO: 242780 - DNA, 25 bp, Rattus norvegicus
ccaacagaggagaggcctttcagaa

SEQ ID NO: 242781 - DNA, 25 bp, Rattus norvegicus
ccaacagaggagtggcctttcagaa

SEQ ID NO: 242782 - DNA, 25 bp, Rattus norvegicus
ccaacagatcttccctacagtaaat

SEQ ID NO: 242783 - DNA, 25 bp, Rattus norvegicus
ccaacagatcttgcctacagtaaat

SEQ ID NO: 242784 - DNA, 25 bp, Rattus norvegicus
ccaacagcctcgcttgtcaaggaaa

SEQ ID NO: 242785 - DNA, 25 bp, Rattus norvegicus
ccaacagcctcggttgtcaaggaaa

SEQ ID NO: 242786 - DNA, 25 bp, Rattus norvegicus
ccaacagctgccaccgaggagagag

SEQ ID NO: 242787 - DNA, 25 bp, Rattus norvegicus
ccaacagctgcctccgaggagagag

SEQ ID NO: 242788 - DNA, 25 bp, Rattus norvegicus
ccaacaggacagatgccctgggctc

SEQ ID NO: 242789 - DNA, 25 bp, Rattus norvegicus
ccaacaggacagttgccctgggctc

SEQ ID NO: 242790 - DNA, 25 bp, Rattus norvegicus
ccaacagtctgtacccttgagaaga

SEQ ID NO: 242791 - DNA, 25 bp, Rattus norvegicus
ccaacagtctgttcccttgagaaga

SEQ ID NO: 242792 - DNA, 25 bp, Rattus norvegicus
ccaacagtgacaaactctgcctttc

SEQ ID NO: 242793 - DNA, 25 bp, Rattus norvegicus
ccaacagtgacatactctgcctttc

SEQ ID NO: 242794 - DNA, 25 bp, Rattus norvegicus
ccaacagtgaccaggtggatgtcga

SEQ ID NO: 242795 - DNA, 25 bp, Rattus norvegicus
ccaacagtgacctggtggatgtcga

SEQ ID NO: 242796 - DNA, 25 bp, Rattus norvegicus
ccaacagtgggtcgcctgacagaca

SEQ ID NO: 242797 - DNA, 25 bp, Rattus norvegicus
ccaacagtgggtggcctgacagaca

SEQ ID NO: 242798 - DNA, 25 bp, Rattus norvegicus
ccaacatcaaggaccaggaagagct

SEQ ID NO: 242799 - DNA, 25 bp, Rattus norvegicus
ccaacatcaaggtccaggaagagct

SEQ ID NO: 242800 - DNA, 25 bp, Rattus norvegicus
ccaacatcagatagagcgcggccgt

SEQ ID NO: 242801 - DNA, 25 bp, Rattus norvegicus
ccaacatcagattgagcgcggccgt

SEQ ID NO: 242802 - DNA, 25 bp, Rattus norvegicus
ccaacatgctggatgtcagggccat

SEQ ID NO: 242803 - DNA, 25 bp, Rattus norvegicus
ccaacatgctggttgtcagggccat

SEQ ID NO: 242804 - DNA, 25 bp, Rattus norvegicus
ccaacatgtcatagtgccatagtaa

SEQ ID NO: 242805 - DNA, 25 bp, Rattus norvegicus
ccaacatgtcattgtgccatagtaa

SEQ ID NO: 242806 - DNA, 25 bp, Rattus norvegicus
ccaacatgtgttatccaggctactg

SEQ ID NO: 242807 - DNA, 25 bp, Rattus norvegicus
ccaacatgtgttttccaggctactg

SEQ ID NO: 242808 - DNA, 25 bp, Rattus norvegicus
ccaacattactcaaggcaccggata

SEQ ID NO: 242809 - DNA, 25 bp, Rattus norvegicus
ccaacattactctaggcaccggata

SEQ ID NO: 242810 - DNA, 25 bp, Rattus norvegicus
ccaacattcactagcaactaatcca

SEQ ID NO: 242811 - DNA, 25 bp, Rattus norvegicus
ccaacattcacttgcaactaatcca

SEQ ID NO: 242812 - DNA, 25 bp, Rattus norvegicus
ccaacattcaggaggtagggaaaag

SEQ ID NO: 242813 - DNA, 25 bp, Rattus norvegicus
ccaacattcaggtggtagggaaaag

SEQ ID NO: 242814 - DNA, 25 bp, Rattus norvegicus
ccaaccaacacaccagagaatttct

SEQ ID NO: 242815 - DNA, 25 bp, Rattus norvegicus
ccaaccaacacagcagagaatttct

SEQ ID NO: 242816 - DNA, 25 bp, Rattus norvegicus
ccaaccaaccacaaacagaaaactg

SEQ ID NO: 242817 - DNA, 25 bp, Rattus norvegicus
ccaaccaaccactaacagaaaactg

SEQ ID NO: 242818 - DNA, 25 bp, Rattus norvegicus
ccaaccaaggatcacaagggctatt

SEQ ID NO: 242819 - DNA, 25 bp, Rattus norvegicus
ccaaccaaggatgacaagggctatt

SEQ ID NO: 242820 - DNA, 25 bp, Rattus norvegicus
ccaaccaatgggaagatacgtataa

SEQ ID NO: 242821 - DNA, 25 bp, Rattus norvegicus
ccaaccaatgggtagatacgtataa

SEQ ID NO: 242822 - DNA, 25 bp, Rattus norvegicus
ccaaccacaaccacagtattctgtt

SEQ ID NO: 242823 - DNA, 25 bp, Rattus norvegicus
ccaaccacaacctcagtattctgtt

SEQ ID NO: 242824 - DNA, 25 bp, Rattus norvegicus
ccaaccacagtccattctaagaaca

SEQ ID NO: 242825 - DNA, 25 bp, Rattus norvegicus
ccaaccacagtcgattctaagaaca

SEQ ID NO: 242826 - DNA, 25 bp, Rattus norvegicus
ccaaccataatgctgacaccatgtc

SEQ ID NO: 242827 - DNA, 25 bp, Rattus norvegicus
ccaaccataatggtgacaccatgtc

SEQ ID NO: 242828 - DNA, 25 bp, Rattus norvegicus
ccaaccatcaggaagtctctctttg

SEQ ID NO: 242829 - DNA, 25 bp, Rattus norvegicus
ccaaccatcaggtagtctctctttg

SEQ ID NO: 242830 - DNA, 25 bp, Rattus norvegicus
ccaaccatcttcagttgtcaagcag

SEQ ID NO: 242831 - DNA, 25 bp, Rattus norvegicus
ccaaccatcttctgttgtcaagcag

SEQ ID NO: 242832 - DNA, 25 bp, Rattus norvegicus
ccaaccatgctgattacaacctgta

SEQ ID NO: 242833 - DNA, 25 bp, Rattus norvegicus
ccaaccatgctgtttacaacctgta

SEQ ID NO: 242834 - DNA, 25 bp, Rattus norvegicus
ccaaccccaagacatgtcctttaga

SEQ ID NO: 242835 - DNA, 25 bp, Rattus norvegicus
ccaaccccaagagatgtcctttaga

SEQ ID NO: 242836 - DNA, 25 bp, Rattus norvegicus
ccaaccccacttcctaggaagagat

SEQ ID NO: 242837 - DNA, 25 bp, Rattus norvegicus
ccaaccccacttgctaggaagagat

SEQ ID NO: 242838 - DNA, 25 bp, Rattus norvegicus
ccaaccccgatgcttgcaggatttt

SEQ ID NO: 242839 - DNA, 25 bp, Rattus norvegicus
ccaaccccgatggttgcaggatttt

SEQ ID NO: 242840 - DNA, 25 bp, Rattus norvegicus
ccaacccctagcattgtatttttag

SEQ ID NO: 242841 - DNA, 25 bp, Rattus norvegicus
ccaacccctagctttgtatttttag

SEQ ID NO: 242842 - DNA, 25 bp, Rattus norvegicus
ccaaccctaacacctcatatgagat

SEQ ID NO: 242843 - DNA, 25 bp, Rattus norvegicus
ccaaccctaacagctcatatgagat

SEQ ID NO: 242844 - DNA, 25 bp, Rattus norvegicus
ccaaccctcaggagcatcaggaatt

SEQ ID NO: 242845 - DNA, 25 bp, Rattus norvegicus
ccaaccctcaggtgcatcaggaatt

SEQ ID NO: 242846 - DNA, 25 bp, Rattus norvegicus
ccaaccctgaaaatatttcgtaatg

SEQ ID NO: 242847 - DNA, 25 bp, Rattus norvegicus
ccaaccctgaaattatttcgtaatg

SEQ ID NO: 242848 - DNA, 25 bp, Rattus norvegicus
ccaaccctgaatactgtccttaaag

SEQ ID NO: 242849 - DNA, 25 bp, Rattus norvegicus
ccaaccctgaattctgtccttaaag

SEQ ID NO: 242850 - DNA, 25 bp, Rattus norvegicus
ccaaccctgactatctgagttcaat

SEQ ID NO: 242851 - DNA, 25 bp, Rattus norvegicus
ccaaccctgactttctgagttcaat

SEQ ID NO: 242852 - DNA, 25 bp, Rattus norvegicus
ccaaccctgataccctgagttcagt

SEQ ID NO: 242853 - DNA, 25 bp, Rattus norvegicus
ccaaccctgatagcctgagttcagt

SEQ ID NO: 242854 - DNA, 25 bp, Rattus norvegicus
ccaaccctgcctctgatgaataaag

SEQ ID NO: 242855 - DNA, 25 bp, Rattus norvegicus
ccaaccctgcctgtgatgaataaag

SEQ ID NO: 242856 - DNA, 25 bp, Rattus norvegicus
ccaaccgctgctctttatctaaagt

SEQ ID NO: 242857 - DNA, 25 bp, Rattus norvegicus
ccaaccgctgctgtttatctaaagt

SEQ ID NO: 242858 - DNA, 25 bp, Rattus norvegicus
ccaaccggctggaggagtccatgaa

SEQ ID NO: 242859 - DNA, 25 bp, Rattus norvegicus
ccaaccggctggtggagtccatgaa

SEQ ID NO: 242860 - DNA, 25 bp, Rattus norvegicus
ccaacctaagttacacccagtgtga

SEQ ID NO: 242861 - DNA, 25 bp, Rattus norvegicus
ccaacctaagtttcacccagtgtga

SEQ ID NO: 242862 - DNA, 25 bp, Rattus norvegicus
ccaacctcattcaccacgtaaaaat

SEQ ID NO: 242863 - DNA, 25 bp, Rattus norvegicus
ccaacctcattctccacgtaaaaat

SEQ ID NO: 242864 - DNA, 25 bp, Rattus norvegicus
ccaacctctaccaagtgcggaataa

SEQ ID NO: 242865 - DNA, 25 bp, Rattus norvegicus
ccaacctctacctagtgcggaataa

SEQ ID NO: 242866 - DNA, 25 bp, Rattus norvegicus
ccaacctggcatcggtctattgcag

SEQ ID NO: 242867 - DNA, 25 bp, Rattus norvegicus
ccaacctggcatgggtctattgcag

SEQ ID NO: 242868 - DNA, 25 bp, Rattus norvegicus
ccaaccttgggacatatttgttctt

SEQ ID NO: 242869 - DNA, 25 bp, Rattus norvegicus
ccaaccttgggagatatttgttctt

SEQ ID NO: 242870 - DNA, 25 bp, Rattus norvegicus
ccaacctttccaagcagagacttag

SEQ ID NO: 242871 - DNA, 25 bp, Rattus norvegicus
ccaacctttccatgcagagacttag

SEQ ID NO: 242872 - DNA, 25 bp, Rattus norvegicus
ccaacgaggagcctcccagataagt

SEQ ID NO: 242873 - DNA, 25 bp, Rattus norvegicus
ccaacgaggagcgtcccagataagt

SEQ ID NO: 242874 - DNA, 25 bp, Rattus norvegicus
ccaacgcagtggctttgtgcttgtt

SEQ ID NO: 242875 - DNA, 25 bp, Rattus norvegicus
ccaacgcagtgggtttgtgcttgtt

SEQ ID NO: 242876 - DNA, 25 bp, Rattus norvegicus
ccaacgcattgcattccagaacaga

SEQ ID NO: 242877 - DNA, 25 bp, Rattus norvegicus
ccaacgcattgctttccagaacaga

SEQ ID NO: 242878 - DNA, 25 bp, Rattus norvegicus
ccaacgccttctctttataaatcca

SEQ ID NO: 242879 - DNA, 25 bp, Rattus norvegicus
ccaacgccttctgtttataaatcca

SEQ ID NO: 242880 - DNA, 25 bp, Rattus norvegicus
ccaacgggtctgatcctggagacag

SEQ ID NO: 242881 - DNA, 25 bp, Rattus norvegicus
ccaacgggtctgttcctggagacag

SEQ ID NO: 242882 - DNA, 25 bp, Rattus norvegicus
ccaacggtacacaacacgggtcagt

SEQ ID NO: 242883 - DNA, 25 bp, Rattus norvegicus
ccaacggtacactacacgggtcagt

SEQ ID NO: 242884 - DNA, 25 bp, Rattus norvegicus
ccaacggttggtcgttcagggtcat

SEQ ID NO: 242885 - DNA, 25 bp, Rattus norvegicus
ccaacggttggtggttcagggtcat

SEQ ID NO: 242886 - DNA, 25 bp, Rattus norvegicus
ccaacgtaccacactatgccaaaaa

SEQ ID NO: 242887 - DNA, 25 bp, Rattus norvegicus
ccaacgtaccactctatgccaaaaa

SEQ ID NO: 242888 - DNA, 25 bp, Rattus norvegicus
ccaacgtactcacacatttccaagt

SEQ ID NO: 242889 - DNA, 25 bp, Rattus norvegicus
ccaacgtactcagacatttccaagt

SEQ ID NO: 242890 - DNA, 25 bp, Rattus norvegicus
ccaacgtcaacgagtctgtgatcat

SEQ ID NO: 242891 - DNA, 25 bp, Rattus norvegicus
ccaacgtcaacgtgtctgtgatcat

SEQ ID NO: 242892 - DNA, 25 bp, Rattus norvegicus
ccaacgtttgctctggcttatttgt

SEQ ID NO: 242893 - DNA, 25 bp, Rattus norvegicus
ccaacgtttgctgtggcttatttgt

SEQ ID NO: 242894 - DNA, 25 bp, Rattus norvegicus
ccaactaaaacgctccggacatttg

SEQ ID NO: 242895 - DNA, 25 bp, Rattus norvegicus
ccaactaaaacggtccggacatttg

SEQ ID NO: 242896 - DNA, 25 bp, Rattus norvegicus
ccaactatagctatttccaacctga

SEQ ID NO: 242897 - DNA, 25 bp, Rattus norvegicus
ccaactatagctttttccaacctga

SEQ ID NO: 242898 - DNA, 25 bp, Rattus norvegicus
ccaactcccagaatttggacaagtt

SEQ ID NO: 242899 - DNA, 25 bp, Rattus norvegicus
ccaactcccagattttggacaagtt

SEQ ID NO: 242900 - DNA, 25 bp, Rattus norvegicus
ccaactcccagcacattagtttaag

SEQ ID NO: 242901 - DNA, 25 bp, Rattus norvegicus
ccaactcccagctcattagtttaag

SEQ ID NO: 242902 - DNA, 25 bp, Rattus norvegicus
ccaactccgtgtatcgctaaggaat

SEQ ID NO: 242903 - DNA, 25 bp, Rattus norvegicus
ccaactccgtgtttcgctaaggaat

SEQ ID NO: 242904 - DNA, 25 bp, Rattus norvegicus
ccaactcctgtaacttcctaatgta

SEQ ID NO: 242905 - DNA, 25 bp, Rattus norvegicus
ccaactcctgtatcttcctaatgta

SEQ ID NO: 242906 - DNA, 25 bp, Rattus norvegicus
ccaactctcctcagattacttttaa

SEQ ID NO: 242907 - DNA, 25 bp, Rattus norvegicus
ccaactctcctctgattacttttaa

SEQ ID NO: 242908 - DNA, 25 bp, Rattus norvegicus
ccaactctgacaagttgtcctccaa

SEQ ID NO: 242909 - DNA, 25 bp, Rattus norvegicus
ccaactctgacatgttgtcctccaa

SEQ ID NO: 242910 - DNA, 25 bp, Rattus norvegicus
ccaactctgactactctgtttttaa

SEQ ID NO: 242911 - DNA, 25 bp, Rattus norvegicus
ccaactctgacttctctgtttttaa

SEQ ID NO: 242912 - DNA, 25 bp, Rattus norvegicus
ccaactctgaggatccccaatataa

SEQ ID NO: 242913 - DNA, 25 bp, Rattus norvegicus
ccaactctgaggttccccaatataa

SEQ ID NO: 242914 - DNA, 25 bp, Rattus norvegicus
ccaactctgtccagtgccacaagga

SEQ ID NO: 242915 - DNA, 25 bp, Rattus norvegicus
ccaactctgtcctgtgccacaagga

SEQ ID NO: 242916 - DNA, 25 bp, Rattus norvegicus
ccaactctgttgctccacaatcatt

SEQ ID NO: 242917 - DNA, 25 bp, Rattus norvegicus
ccaactctgttggtccacaatcatt

SEQ ID NO: 242918 - DNA, 25 bp, Rattus norvegicus
ccaactgccatccattgtttctttt

SEQ ID NO: 242919 - DNA, 25 bp, Rattus norvegicus
ccaactgccatcgattgtttctttt

SEQ ID NO: 242920 - DNA, 25 bp, Rattus norvegicus
ccaactgctttcataacggacgata

SEQ ID NO: 242921 - DNA, 25 bp, Rattus norvegicus
ccaactgctttcttaacggacgata

SEQ ID NO: 242922 - DNA, 25 bp, Rattus norvegicus
ccaactggcatgctggtcacattga

SEQ ID NO: 242923 - DNA, 25 bp, Rattus norvegicus
ccaactggcatggtggtcacattga

SEQ ID NO: 242924 - DNA, 25 bp, Rattus norvegicus
ccaactgtcccgatgaggtttatca

SEQ ID NO: 242925 - DNA, 25 bp, Rattus norvegicus
ccaactgtcccgttgaggtttatca

SEQ ID NO: 242926 - DNA, 25 bp, Rattus norvegicus
ccaactgttgctccctgaacaaaga

SEQ ID NO: 242927 - DNA, 25 bp, Rattus norvegicus
ccaactgttgctgcctgaacaaaga

SEQ ID NO: 242928 - DNA, 25 bp, Rattus norvegicus
ccaacttagaccaaagcctggcaaa

SEQ ID NO: 242929 - DNA, 25 bp, Rattus norvegicus
ccaacttagacctaagcctggcaaa

SEQ ID NO: 242930 - DNA, 25 bp, Rattus norvegicus
ccaacttcaaagacggctgctgcag

SEQ ID NO: 242931 - DNA, 25 bp, Rattus norvegicus
ccaacttcaaagtcggctgctgcag

SEQ ID NO: 242932 - DNA, 25 bp, Rattus norvegicus
ccaacttcatggagtgcctgacaga

SEQ ID NO: 242933 - DNA, 25 bp, Rattus norvegicus
ccaacttcatggtgtgcctgacaga

SEQ ID NO: 242934 - DNA, 25 bp, Rattus norvegicus
ccaacttcctcaacttgtcagaata

SEQ ID NO: 242935 - DNA, 25 bp, Rattus norvegicus
ccaacttcctcatcttgtcagaata

SEQ ID NO: 242936 - DNA, 25 bp, Rattus norvegicus
ccaacttcctgtagtctttatcaca

SEQ ID NO: 242937 - DNA, 25 bp, Rattus norvegicus
ccaacttcctgttgtctttatcaca

SEQ ID NO: 242938 - DNA, 25 bp, Rattus norvegicus
ccaacttcttgtaagcttgcgctaa

SEQ ID NO: 242939 - DNA, 25 bp, Rattus norvegicus
ccaacttcttgttagcttgcgctaa

SEQ ID NO: 242940 - DNA, 25 bp, Rattus norvegicus
ccaacttgagttccgtagggagaac

SEQ ID NO: 242941 - DNA, 25 bp, Rattus norvegicus
ccaacttgagttgcgtagggagaac

SEQ ID NO: 242942 - DNA, 25 bp, Rattus norvegicus
ccaactttgcatatcctggttcaaa

SEQ ID NO: 242943 - DNA, 25 bp, Rattus norvegicus
ccaactttgcatttcctggttcaaa

SEQ ID NO: 242944 - DNA, 25 bp, Rattus norvegicus
ccaactttgtggacgatctctgagc

SEQ ID NO: 242945 - DNA, 25 bp, Rattus norvegicus
ccaactttgtggtcgatctctgagc

SEQ ID NO: 242946 - DNA, 25 bp, Rattus norvegicus
ccaagaactcttcgctcggagcata

SEQ ID NO: 242947 - DNA, 25 bp, Rattus norvegicus
ccaagaactcttggctcggagcata

SEQ ID NO: 242948 - DNA, 25 bp, Rattus norvegicus
ccaagaagacaaactccctctgaga

SEQ ID NO: 242949 - DNA, 25 bp, Rattus norvegicus
ccaagaagacaatctccctctgaga

SEQ ID NO: 242950 - DNA, 25 bp, Rattus norvegicus
ccaagaagccttccattaataaagt

SEQ ID NO: 242951 - DNA, 25 bp, Rattus norvegicus
ccaagaagccttgcattaataaagt

SEQ ID NO: 242952 - DNA, 25 bp, Rattus norvegicus
ccaagaaggccgagaccaaggcgca

SEQ ID NO: 242953 - DNA, 25 bp, Rattus norvegicus
ccaagaaggccgtgaccaaggcgca

SEQ ID NO: 242954 - DNA, 25 bp, Rattus norvegicus
ccaagaatgttcagggttcaaatcc

SEQ ID NO: 242955 - DNA, 25 bp, Rattus norvegicus
ccaagaatgttctgggttcaaatcc

SEQ ID NO: 242956 - DNA, 25 bp, Rattus norvegicus
ccaagacactggacttcgagatgtt

SEQ ID NO: 242957 - DNA, 25 bp, Rattus norvegicus
ccaagacactggtcttcgagatgtt

SEQ ID NO: 242958 - DNA, 25 bp, Rattus norvegicus
ccaagacagcaactcggtactgggt

SEQ ID NO: 242959 - DNA, 25 bp, Rattus norvegicus
ccaagacagcaagtcggtactgggt

SEQ ID NO: 242960 - DNA, 25 bp, Rattus norvegicus
ccaagacattgcctaatccaacatc

SEQ ID NO: 242961 - DNA, 25 bp, Rattus norvegicus
ccaagacattgcgtaatccaacatc

SEQ ID NO: 242962 - DNA, 25 bp, Rattus norvegicus
ccaagaccggttaacaaagctacag

SEQ ID NO: 242963 - DNA, 25 bp, Rattus norvegicus
ccaagaccggtttacaaagctacag

SEQ ID NO: 242964 - DNA, 25 bp, Rattus norvegicus
ccaagacgggttagcacaggcctgg

SEQ ID NO: 242965 - DNA, 25 bp, Rattus norvegicus
ccaagacgggtttgcacaggcctgg

SEQ ID NO: 242966 - DNA, 25 bp, Rattus norvegicus
ccaagacttggccacagaagcagtt

SEQ ID NO: 242967 - DNA, 25 bp, Rattus norvegicus
ccaagacttggcgacagaagcagtt

SEQ ID NO: 242968 - DNA, 25 bp, Rattus norvegicus
ccaagagaactcatgtgcaccataa

SEQ ID NO: 242969 - DNA, 25 bp, Rattus norvegicus
ccaagagaactcttgtgcaccataa

SEQ ID NO: 242970 - DNA, 25 bp, Rattus norvegicus
ccaagagagcctcccgcgctgtggt

SEQ ID NO: 242971 - DNA, 25 bp, Rattus norvegicus
ccaagagagcctgccgcgctgtggt

SEQ ID NO: 242972 - DNA, 25 bp, Rattus norvegicus
ccaagagaggaaccgcgccaggtct

SEQ ID NO: 242973 - DNA, 25 bp, Rattus norvegicus
ccaagagaggaagcgcgccaggtct

SEQ ID NO: 242974 - DNA, 25 bp, Rattus norvegicus
ccaagagatggtagtgctttcctga

SEQ ID NO: 242975 - DNA, 25 bp, Rattus norvegicus
ccaagagatggttgtgctttcctga

SEQ ID NO: 242976 - DNA, 25 bp, Rattus norvegicus
ccaagagccgaaagtgacatccagt

SEQ ID NO: 242977 - DNA, 25 bp, Rattus norvegicus
ccaagagccgaatgtgacatccagt

SEQ ID NO: 242978 - DNA, 25 bp, Rattus norvegicus
ccaagagcgtccaccaagaagcaga

SEQ ID NO: 242979 - DNA, 25 bp, Rattus norvegicus
ccaagagcgtcctccaagaagcaga

SEQ ID NO: 242980 - DNA, 25 bp, Rattus norvegicus
ccaagagctggacccctgtgattca

SEQ ID NO: 242981 - DNA, 25 bp, Rattus norvegicus
ccaagagctggagccctgtgattca

SEQ ID NO: 242982 - DNA, 25 bp, Rattus norvegicus
ccaagagcttcacttctccaatcaa

SEQ ID NO: 242983 - DNA, 25 bp, Rattus norvegicus
ccaagagcttcagttctccaatcaa

SEQ ID NO: 242984 - DNA, 25 bp, Rattus norvegicus
ccaagaggactacagctgtgaagac

SEQ ID NO: 242985 - DNA, 25 bp, Rattus norvegicus
ccaagaggactagagctgtgaagac

SEQ ID NO: 242986 - DNA, 25 bp, Rattus norvegicus
ccaagaggagcccttggccgagacc

SEQ ID NO: 242987 - DNA, 25 bp, Rattus norvegicus
ccaagaggagccgttggccgagacc

SEQ ID NO: 242988 - DNA, 25 bp, Rattus norvegicus
ccaagaggaggtcgcttccctgcag

SEQ ID NO: 242989 - DNA, 25 bp, Rattus norvegicus
ccaagaggaggtggcttccctgcag

SEQ ID NO: 242990 - DNA, 25 bp, Rattus norvegicus
ccaagagggccactaatgaagatta

SEQ ID NO: 242991 - DNA, 25 bp, Rattus norvegicus
ccaagagggccagtaatgaagatta

SEQ ID NO: 242992 - DNA, 25 bp, Rattus norvegicus
ccaagaggtgatactggtgcagacg

SEQ ID NO: 242993 - DNA, 25 bp, Rattus norvegicus
ccaagaggtgattctggtgcagacg

SEQ ID NO: 242994 - DNA, 25 bp, Rattus norvegicus
ccaagatactctcgagtgggcttcc

SEQ ID NO: 242995 - DNA, 25 bp, Rattus norvegicus
ccaagatactctggagtgggcttcc

SEQ ID NO: 242996 - DNA, 25 bp, Rattus norvegicus
ccaagatccattagtttaagcaaac

SEQ ID NO: 242997 - DNA, 25 bp, Rattus norvegicus
ccaagatccatttgtttaagcaaac

SEQ ID NO: 242998 - DNA, 25 bp, Rattus norvegicus
ccaagatctggtcctcgaagagcaa

SEQ ID NO: 242999 - DNA, 25 bp, Rattus norvegicus
ccaagatctggtgctcgaagagcaa

SEQ ID NO: 243000 - DNA, 25 bp, Rattus norvegicus
ccaagatgatgaaagggcacccgtg

SEQ ID NO: 243001 - DNA, 25 bp, Rattus norvegicus
ccaagatgatgatagggcacccgtg

SEQ ID NO: 243002 - DNA, 25 bp, Rattus norvegicus
ccaagatgccgtactcaaaatcctc

SEQ ID NO: 243003 - DNA, 25 bp, Rattus norvegicus
ccaagatgccgttctcaaaatcctc

SEQ ID NO: 243004 - DNA, 25 bp, Rattus norvegicus
ccaagatggagacggcagccacctt

SEQ ID NO: 243005 - DNA, 25 bp, Rattus norvegicus
ccaagatggagagggcagccacctt

SEQ ID NO: 243006 - DNA, 25 bp, Rattus norvegicus
ccaagatggcgaagcaagcggctaa

SEQ ID NO: 243007 - DNA, 25 bp, Rattus norvegicus
ccaagatggcgatgcaagcggctaa

SEQ ID NO: 243008 - DNA, 25 bp, Rattus norvegicus
ccaagatgttttcgtcttctgctgt

SEQ ID NO: 243009 - DNA, 25 bp, Rattus norvegicus
ccaagatgttttggtcttctgctgt

SEQ ID NO: 243010 - DNA, 25 bp, Rattus norvegicus
ccaagattttgcacgaggattcccc

SEQ ID NO: 243011 - DNA, 25 bp, Rattus norvegicus
ccaagattttgctcgaggattcccc

SEQ ID NO: 243012 - DNA, 25 bp, Rattus norvegicus
ccaagcacatgacggaggccgtccg

SEQ ID NO: 243013 - DNA, 25 bp, Rattus norvegicus
ccaagcacatgagggaggccgtccg

SEQ ID NO: 243014 - DNA, 25 bp, Rattus norvegicus
ccaagcactcgcacacggaggcggg

SEQ ID NO: 243015 - DNA, 25 bp, Rattus norvegicus
ccaagcactcgctcacggaggcggg

SEQ ID NO: 243016 - DNA, 25 bp, Rattus norvegicus
ccaagcaggatgacatggtgtccat

SEQ ID NO: 243017 - DNA, 25 bp, Rattus norvegicus
ccaagcaggatgtcatggtgtccat

SEQ ID NO: 243018 - DNA, 25 bp, Rattus norvegicus
ccaagcagggacagctctgagagct

SEQ ID NO: 243019 - DNA, 25 bp, Rattus norvegicus
ccaagcagggactgctctgagagct

SEQ ID NO: 243020 - DNA, 25 bp, Rattus norvegicus
ccaagcatacataaaccccatacat

SEQ ID NO: 243021 - DNA, 25 bp, Rattus norvegicus
ccaagcatacattaaccccatacat

SEQ ID NO: 243022 - DNA, 25 bp, Rattus norvegicus
ccaagcatgaccagggccacttcat

SEQ ID NO: 243023 - DNA, 25 bp, Rattus norvegicus
ccaagcatgacctgggccacttcat

SEQ ID NO: 243024 - DNA, 25 bp, Rattus norvegicus
ccaagcatggtcaacactacgaagt

SEQ ID NO: 243025 - DNA, 25 bp, Rattus norvegicus
ccaagcatggtctacactacgaagt

SEQ ID NO: 243026 - DNA, 25 bp, Rattus norvegicus
ccaagccaagcaaagtcggatttag

SEQ ID NO: 243027 - DNA, 25 bp, Rattus norvegicus
ccaagccaagcatagtcggatttag

SEQ ID NO: 243028 - DNA, 25 bp, Rattus norvegicus
ccaagccaatggataacctggataa

SEQ ID NO: 243029 - DNA, 25 bp, Rattus norvegicus
ccaagccaatggttaacctggataa

SEQ ID NO: 243030 - DNA, 25 bp, Rattus norvegicus
ccaagccatggtccagtttcatcga

SEQ ID NO: 243031 - DNA, 25 bp, Rattus norvegicus
ccaagccatggtgcagtttcatcga

SEQ ID NO: 243032 - DNA, 25 bp, Rattus norvegicus
ccaagcccttagaccactattatgt

SEQ ID NO: 243033 - DNA, 25 bp, Rattus norvegicus
ccaagcccttagtccactattatgt

SEQ ID NO: 243034 - DNA, 25 bp, Rattus norvegicus
ccaagccctttgacacagtgactaa

SEQ ID NO: 243035 - DNA, 25 bp, Rattus norvegicus
ccaagccctttgtcacagtgactaa

SEQ ID NO: 243036 - DNA, 25 bp, Rattus norvegicus
ccaagccgagcaagacccagcaggg

SEQ ID NO: 243037 - DNA, 25 bp, Rattus norvegicus
ccaagccgagcatgacccagcaggg

SEQ ID NO: 243038 - DNA, 25 bp, Rattus norvegicus
ccaagcctagtgacagatacgccag

SEQ ID NO: 243039 - DNA, 25 bp, Rattus norvegicus
ccaagcctagtgtcagatacgccag

SEQ ID NO: 243040 - DNA, 25 bp, Rattus norvegicus
ccaagcctctttagggagactgagt

SEQ ID NO: 243041 - DNA, 25 bp, Rattus norvegicus
ccaagcctcttttgggagactgagt

SEQ ID NO: 243042 - DNA, 25 bp, Rattus norvegicus
ccaagcctggctattatgtgagtga

SEQ ID NO: 243043 - DNA, 25 bp, Rattus norvegicus
ccaagcctggcttttatgtgagtga

SEQ ID NO: 243044 - DNA, 25 bp, Rattus norvegicus
ccaagcctgggcagagagttctggt

SEQ ID NO: 243045 - DNA, 25 bp, Rattus norvegicus
ccaagcctgggctgagagttctggt

SEQ ID NO: 243046 - DNA, 25 bp, Rattus norvegicus
ccaagcgctttgctgcagggacagc

SEQ ID NO: 243047 - DNA, 25 bp, Rattus norvegicus
ccaagcgctttggtgcagggacagc

SEQ ID NO: 243048 - DNA, 25 bp, Rattus norvegicus
ccaagcggagctctctgggatagct

SEQ ID NO: 243049 - DNA, 25 bp, Rattus norvegicus
ccaagcggagctgtctgggatagct

SEQ ID NO: 243050 - DNA, 25 bp, Rattus norvegicus
ccaagcggagtgaggcacagcgaca

SEQ ID NO: 243051 - DNA, 25 bp, Rattus norvegicus
ccaagcggagtgtggcacagcgaca

SEQ ID NO: 243052 - DNA, 25 bp, Rattus norvegicus
ccaagcggcactcggagagacattt

SEQ ID NO: 243053 - DNA, 25 bp, Rattus norvegicus
ccaagcggcactgggagagacattt

SEQ ID NO: 243054 - DNA, 25 bp, Rattus norvegicus
ccaagctaacttcccttctatgaaa

SEQ ID NO: 243055 - DNA, 25 bp, Rattus norvegicus
ccaagctaacttgccttctatgaaa

SEQ ID NO: 243056 - DNA, 25 bp, Rattus norvegicus
ccaagctagtcaacttctgagggaa

SEQ ID NO: 243057 - DNA, 25 bp, Rattus norvegicus
ccaagctagtcatcttctgagggaa

SEQ ID NO: 243058 - DNA, 25 bp, Rattus norvegicus
ccaagctcaagaagatcctagacaa

SEQ ID NO: 243059 - DNA, 25 bp, Rattus norvegicus
ccaagctcaagatgatcctagacaa

SEQ ID NO: 243060 - DNA, 25 bp, Rattus norvegicus
ccaagctcaggcatacagcactttt

SEQ ID NO: 243061 - DNA, 25 bp, Rattus norvegicus
ccaagctcaggcttacagcactttt

SEQ ID NO: 243062 - DNA, 25 bp, Rattus norvegicus
ccaagctcggatccctgaattcgat

SEQ ID NO: 243063 - DNA, 25 bp, Rattus norvegicus
ccaagctcggatgcctgaattcgat

SEQ ID NO: 243064 - DNA, 25 bp, Rattus norvegicus
ccaagctctgtgagagtctggtggt

SEQ ID NO: 243065 - DNA, 25 bp, Rattus norvegicus
ccaagctctgtgtgagtctggtggt

SEQ ID NO: 243066 - DNA, 25 bp, Rattus norvegicus
ccaagctcttggagggtgacgagaa

SEQ ID NO: 243067 - DNA, 25 bp, Rattus norvegicus
ccaagctcttggtgggtgacgagaa

SEQ ID NO: 243068 - DNA, 25 bp, Rattus norvegicus
ccaagctgcagcaggtgcccgggct

SEQ ID NO: 243069 - DNA, 25 bp, Rattus norvegicus
ccaagctgcagctggtgcccgggct

SEQ ID NO: 243070 - DNA, 25 bp, Rattus norvegicus
ccaagctgcataaaggtcccaagga

SEQ ID NO: 243071 - DNA, 25 bp, Rattus norvegicus
ccaagctgcatataggtcccaagga

SEQ ID NO: 243072 - DNA, 25 bp, Rattus norvegicus
ccaagctgcctcaatgtgtaaaagt

SEQ ID NO: 243073 - DNA, 25 bp, Rattus norvegicus
ccaagctgcctctatgtgtaaaagt

SEQ ID NO: 243074 - DNA, 25 bp, Rattus norvegicus
ccaagcttggtgcactgagcgacta

SEQ ID NO: 243075 - DNA, 25 bp, Rattus norvegicus
ccaagcttggtggactgagcgacta

SEQ ID NO: 243076 - DNA, 25 bp, Rattus norvegicus
ccaagctttggcagtttgttaaatg

SEQ ID NO: 243077 - DNA, 25 bp, Rattus norvegicus
ccaagctttggctgtttgttaaatg

SEQ ID NO: 243078 - DNA, 25 bp, Rattus norvegicus
ccaagctttttcatactcattctca

SEQ ID NO: 243079 - DNA, 25 bp, Rattus norvegicus
ccaagctttttcttactcattctca

SEQ ID NO: 243080 - DNA, 25 bp, Rattus norvegicus
ccaaggaaacccaggctcatgagag

SEQ ID NO: 243081 - DNA, 25 bp, Rattus norvegicus
ccaaggaaaccctggctcatgagag

SEQ ID NO: 243082 - DNA, 25 bp, Rattus norvegicus
ccaaggaagagcacgggcagctcgc

SEQ ID NO: 243083 - DNA, 25 bp, Rattus norvegicus
ccaaggaagagctcgggcagctcgc

SEQ ID NO: 243084 - DNA, 25 bp, Rattus norvegicus
ccaaggaagttcaagctgaggccta

SEQ ID NO: 243085 - DNA, 25 bp, Rattus norvegicus
ccaaggaagttctagctgaggccta

SEQ ID NO: 243086 - DNA, 25 bp, Rattus norvegicus
ccaaggacacgtaacaggattctgt

SEQ ID NO: 243087 - DNA, 25 bp, Rattus norvegicus
ccaaggacacgttacaggattctgt

SEQ ID NO: 243088 - DNA, 25 bp, Rattus norvegicus
ccaaggacattgcttcccctggaga

SEQ ID NO: 243089 - DNA, 25 bp, Rattus norvegicus
ccaaggacattggttcccctggaga

SEQ ID NO: 243090 - DNA, 25 bp, Rattus norvegicus
ccaaggacctggctgtggctgaaca

SEQ ID NO: 243091 - DNA, 25 bp, Rattus norvegicus
ccaaggacctgggtgtggctgaaca

SEQ ID NO: 243092 - DNA, 25 bp, Rattus norvegicus
ccaaggacttgcctttccaggagtt

SEQ ID NO: 243093 - DNA, 25 bp, Rattus norvegicus
ccaaggacttgcgtttccaggagtt

SEQ ID NO: 243094 - DNA, 25 bp, Rattus norvegicus
ccaaggagcagcaaagtgggtgcca

SEQ ID NO: 243095 - DNA, 25 bp, Rattus norvegicus
ccaaggagcagctaagtgggtgcca

SEQ ID NO: 243096 - DNA, 25 bp, Rattus norvegicus
ccaaggagcctgagcttgagttgaa

SEQ ID NO: 243097 - DNA, 25 bp, Rattus norvegicus
ccaaggagcctgtgcttgagttgaa

SEQ ID NO: 243098 - DNA, 25 bp, Rattus norvegicus
ccaaggaggaagcagcttgattcca

SEQ ID NO: 243099 - DNA, 25 bp, Rattus norvegicus
ccaaggaggaaggagcttgattcca

SEQ ID NO: 243100 - DNA, 25 bp, Rattus norvegicus
ccaaggagtgctctcgagacctatt

SEQ ID NO: 243101 - DNA, 25 bp, Rattus norvegicus
ccaaggagtgctgtcgagacctatt

SEQ ID NO: 243102 - DNA, 25 bp, Rattus norvegicus
ccaaggagttcacaccccaagtaga

SEQ ID NO: 243103 - DNA, 25 bp, Rattus norvegicus
ccaaggagttcagaccccaagtaga

SEQ ID NO: 243104 - DNA, 25 bp, Rattus norvegicus
ccaaggcaatccagggacccgctta

SEQ ID NO: 243105 - DNA, 25 bp, Rattus norvegicus
ccaaggcaatcctgggacccgctta

SEQ ID NO: 243106 - DNA, 25 bp, Rattus norvegicus
ccaaggcacggcagaaggacaatgt

SEQ ID NO: 243107 - DNA, 25 bp, Rattus norvegicus
ccaaggcacggctgaaggacaatgt

SEQ ID NO: 243108 - DNA, 25 bp, Rattus norvegicus
ccaaggcagcgcagacagagctcaa

SEQ ID NO: 243109 - DNA, 25 bp, Rattus norvegicus
ccaaggcagcgctgacagagctcaa

SEQ ID NO: 243110 - DNA, 25 bp, Rattus norvegicus
ccaaggcagtcgagacctgtgcgga

SEQ ID NO: 243111 - DNA, 25 bp, Rattus norvegicus
ccaaggcagtcgtgacctgtgcgga

SEQ ID NO: 243112 - DNA, 25 bp, Rattus norvegicus
ccaaggccaaaaaccgcacggtgaa

SEQ ID NO: 243113 - DNA, 25 bp, Rattus norvegicus
ccaaggccaaaatccgcacggtgaa

SEQ ID NO: 243114 - DNA, 25 bp, Rattus norvegicus
ccaaggccaaacagtctccaaaaga

SEQ ID NO: 243115 - DNA, 25 bp, Rattus norvegicus
ccaaggccaaactgtctccaaaaga

SEQ ID NO: 243116 - DNA, 25 bp, Rattus norvegicus
ccaaggccacgcacggactgggtgt

SEQ ID NO: 243117 - DNA, 25 bp, Rattus norvegicus
ccaaggccacgctcggactgggtgt

SEQ ID NO: 243118 - DNA, 25 bp, Rattus norvegicus
ccaaggccattgcaacagatatttt

SEQ ID NO: 243119 - DNA, 25 bp, Rattus norvegicus
ccaaggccattggaacagatatttt

SEQ ID NO: 243120 - DNA, 25 bp, Rattus norvegicus
ccaaggcccgctagtaggatgggct

SEQ ID NO: 243121 - DNA, 25 bp, Rattus norvegicus
ccaaggcccgcttgtaggatgggct

SEQ ID NO: 243122 - DNA, 25 bp, Rattus norvegicus
ccaaggcccgtgctttttagcataa

SEQ ID NO: 243123 - DNA, 25 bp, Rattus norvegicus
ccaaggcccgtggtttttagcataa

SEQ ID NO: 243124 - DNA, 25 bp, Rattus norvegicus
ccaaggcccttccacatttggaaat

SEQ ID NO: 243125 - DNA, 25 bp, Rattus norvegicus
ccaaggcccttcgacatttggaaat

SEQ ID NO: 243126 - DNA, 25 bp, Rattus norvegicus
ccaaggcgaatcaactatagactct

SEQ ID NO: 243127 - DNA, 25 bp, Rattus norvegicus
ccaaggcgaatctactatagactct

SEQ ID NO: 243128 - DNA, 25 bp, Rattus norvegicus
ccaaggcgcaaacggagctgctgtc

SEQ ID NO: 243129 - DNA, 25 bp, Rattus norvegicus
ccaaggcgcaaagggagctgctgtc

SEQ ID NO: 243130 - DNA, 25 bp, Rattus norvegicus
ccaaggcgcccgagtcatcggagag

SEQ ID NO: 243131 - DNA, 25 bp, Rattus norvegicus
ccaaggcgcccgtgtcatcggagag

SEQ ID NO: 243132 - DNA, 25 bp, Rattus norvegicus
ccaaggcgctgcatgctctgagggt

SEQ ID NO: 243133 - DNA, 25 bp, Rattus norvegicus
ccaaggcgctgcttgctctgagggt

SEQ ID NO: 243134 - DNA, 25 bp, Rattus norvegicus
ccaaggcggatgacgtgtgttgtct

SEQ ID NO: 243135 - DNA, 25 bp, Rattus norvegicus
ccaaggcggatgtcgtgtgttgtct

SEQ ID NO: 243136 - DNA, 25 bp, Rattus norvegicus
ccaaggcggccgaatgtacatagct

SEQ ID NO: 243137 - DNA, 25 bp, Rattus norvegicus
ccaaggcggccgtatgtacatagct

SEQ ID NO: 243138 - DNA, 25 bp, Rattus norvegicus
ccaaggctaagacgcgaaacactac

SEQ ID NO: 243139 - DNA, 25 bp, Rattus norvegicus
ccaaggctaagaggcgaaacactac

SEQ ID NO: 243140 - DNA, 25 bp, Rattus norvegicus
ccaaggctgaaccacagggctgtca

SEQ ID NO: 243141 - DNA, 25 bp, Rattus norvegicus
ccaaggctgaacgacagggctgtca

SEQ ID NO: 243142 - DNA, 25 bp, Rattus norvegicus
ccaaggctgatcagcaaaattctat

SEQ ID NO: 243143 - DNA, 25 bp, Rattus norvegicus
ccaaggctgatctgcaaaattctat

SEQ ID NO: 243144 - DNA, 25 bp, Rattus norvegicus
ccaaggcttcgtatctatgcgtaaa

SEQ ID NO: 243145 - DNA, 25 bp, Rattus norvegicus
ccaaggcttcgtttctatgcgtaaa

SEQ ID NO: 243146 - DNA, 25 bp, Rattus norvegicus
ccaaggcttggtctgtcctaggcaa

SEQ ID NO: 243147 - DNA, 25 bp, Rattus norvegicus
ccaaggcttggtgtgtcctaggcaa

SEQ ID NO: 243148 - DNA, 25 bp, Rattus norvegicus
ccaaggctttcacagcaagcaggtt

SEQ ID NO: 243149 - DNA, 25 bp, Rattus norvegicus
ccaaggctttcagagcaagcaggtt

SEQ ID NO: 243150 - DNA, 25 bp, Rattus norvegicus
ccaagggaagtgctcaggtgactct

SEQ ID NO: 243151 - DNA, 25 bp, Rattus norvegicus
ccaagggaagtggtcaggtgactct

SEQ ID NO: 243152 - DNA, 25 bp, Rattus norvegicus
ccaagggaatatccctgtatatgaa

SEQ ID NO: 243153 - DNA, 25 bp, Rattus norvegicus
ccaagggaatatgcctgtatatgaa

SEQ ID NO: 243154 - DNA, 25 bp, Rattus norvegicus
ccaagggaggctcggctctgttaca

SEQ ID NO: 243155 - DNA, 25 bp, Rattus norvegicus
ccaagggaggctgggctctgttaca

SEQ ID NO: 243156 - DNA, 25 bp, Rattus norvegicus
ccaagggatgctcaggatctgcgca

SEQ ID NO: 243157 - DNA, 25 bp, Rattus norvegicus
ccaagggatgctgaggatctgcgca

SEQ ID NO: 243158 - DNA, 25 bp, Rattus norvegicus
ccaagggcagcccagggactagttt

SEQ ID NO: 243159 - DNA, 25 bp, Rattus norvegicus
ccaagggcagccgagggactagttt

SEQ ID NO: 243160 - DNA, 25 bp, Rattus norvegicus
ccaagggcagctctgaggcctgatt

SEQ ID NO: 243161 - DNA, 25 bp, Rattus norvegicus
ccaagggcagctgtgaggcctgatt

SEQ ID NO: 243162 - DNA, 25 bp, Rattus norvegicus
ccaagggcgtgaagcacctcgtagc

SEQ ID NO: 243163 - DNA, 25 bp, Rattus norvegicus
ccaagggcgtgatgcacctcgtagc

SEQ ID NO: 243164 - DNA, 25 bp, Rattus norvegicus
ccaagggctcctcacctgataggaa

SEQ ID NO: 243165 - DNA, 25 bp, Rattus norvegicus
ccaagggctcctgacctgataggaa

SEQ ID NO: 243166 - DNA, 25 bp, Rattus norvegicus
ccaagggctcttatgagtgagagga

SEQ ID NO: 243167 - DNA, 25 bp, Rattus norvegicus
ccaagggctcttttgagtgagagga

SEQ ID NO: 243168 - DNA, 25 bp, Rattus norvegicus
ccaagggtagggactggacctcaga

SEQ ID NO: 243169 - DNA, 25 bp, Rattus norvegicus
ccaagggtagggtctggacctcaga

SEQ ID NO: 243170 - DNA, 25 bp, Rattus norvegicus
ccaaggtacctacgccgagcttcag

SEQ ID NO: 243171 - DNA, 25 bp, Rattus norvegicus
ccaaggtacctaggccgagcttcag

SEQ ID NO: 243172 - DNA, 25 bp, Rattus norvegicus
ccaaggtatttcagggcgtcagcac

SEQ ID NO: 243173 - DNA, 25 bp, Rattus norvegicus
ccaaggtatttctgggcgtcagcac

SEQ ID NO: 243174 - DNA, 25 bp, Rattus norvegicus
ccaaggtcagtgagtttgatgtcat

SEQ ID NO: 243175 - DNA, 25 bp, Rattus norvegicus
ccaaggtcagtgtgtttgatgtcat

SEQ ID NO: 243176 - DNA, 25 bp, Rattus norvegicus
ccaaggtctcatcagtgtcgcagat

SEQ ID NO: 243177 - DNA, 25 bp, Rattus norvegicus
ccaaggtctcatgagtgtcgcagat

SEQ ID NO: 243178 - DNA, 25 bp, Rattus norvegicus
ccaaggtctcctcaggcgggatgat

SEQ ID NO: 243179 - DNA, 25 bp, Rattus norvegicus
ccaaggtctcctgaggcgggatgat

SEQ ID NO: 243180 - DNA, 25 bp, Rattus norvegicus
ccaaggtcttggaaaacaggcagtt

SEQ ID NO: 243181 - DNA, 25 bp, Rattus norvegicus
ccaaggtcttggaggtgctagctaa

SEQ ID NO: 243182 - DNA, 25 bp, Rattus norvegicus
ccaaggtcttggtaaacaggcagtt

SEQ ID NO: 243183 - DNA, 25 bp, Rattus norvegicus
ccaaggtcttggtggtgctagctaa

SEQ ID NO: 243184 - DNA, 25 bp, Rattus norvegicus
ccaaggtgcacccatgtcagagaag

SEQ ID NO: 243185 - DNA, 25 bp, Rattus norvegicus
ccaaggtgcaccgatgtcagagaag

SEQ ID NO: 243186 - DNA, 25 bp, Rattus norvegicus
ccaaggtggctgacccaccagagcg

SEQ ID NO: 243187 - DNA, 25 bp, Rattus norvegicus
ccaaggtggctgtcccaccagagcg

SEQ ID NO: 243188 - DNA, 25 bp, Rattus norvegicus
ccaaggttccctatgcagtgaagaa

SEQ ID NO: 243189 - DNA, 25 bp, Rattus norvegicus
ccaaggttccctttgcagtgaagaa

SEQ ID NO: 243190 - DNA, 25 bp, Rattus norvegicus
ccaagtacggcccagacaggatttg

SEQ ID NO: 243191 - DNA, 25 bp, Rattus norvegicus
ccaagtacggccgagacaggatttg

SEQ ID NO: 243192 - DNA, 25 bp, Rattus norvegicus
ccaagtattctcaggtccctgaaga

SEQ ID NO: 243193 - DNA, 25 bp, Rattus norvegicus
ccaagtattctctggtccctgaaga

SEQ ID NO: 243194 - DNA, 25 bp, Rattus norvegicus
ccaagtcaacagagccgggaaccga

SEQ ID NO: 243195 - DNA, 25 bp, Rattus norvegicus
ccaagtcaacagtgccgggaaccga

SEQ ID NO: 243196 - DNA, 25 bp, Rattus norvegicus
ccaagtcaccgtagacgctgtgcca

SEQ ID NO: 243197 - DNA, 25 bp, Rattus norvegicus
ccaagtcaccgttgacgctgtgcca

SEQ ID NO: 243198 - DNA, 25 bp, Rattus norvegicus
ccaagtcagagtaagggccattcac

SEQ ID NO: 243199 - DNA, 25 bp, Rattus norvegicus
ccaagtcagagttagggccattcac

SEQ ID NO: 243200 - DNA, 25 bp, Rattus norvegicus
ccaagtcagtcaagatggcgccagc

SEQ ID NO: 243201 - DNA, 25 bp, Rattus norvegicus
ccaagtcagtcatgatggcgccagc

SEQ ID NO: 243202 - DNA, 25 bp, Rattus norvegicus
ccaagtcagtgaccattgaagtaac

SEQ ID NO: 243203 - DNA, 25 bp, Rattus norvegicus
ccaagtcagtgagcattgaagtaac

SEQ ID NO: 243204 - DNA, 25 bp, Rattus norvegicus
ccaagtcattttctgctgagaaata

SEQ ID NO: 243205 - DNA, 25 bp, Rattus norvegicus
ccaagtcattttgtgctgagaaata

SEQ ID NO: 243206 - DNA, 25 bp, Rattus norvegicus
ccaagtcccactctatattctgaat

SEQ ID NO: 243207 - DNA, 25 bp, Rattus norvegicus
ccaagtcccactgtatattctgaat

SEQ ID NO: 243208 - DNA, 25 bp, Rattus norvegicus
ccaagtccccttcgcgatgagtgat

SEQ ID NO: 243209 - DNA, 25 bp, Rattus norvegicus
ccaagtccccttggcgatgagtgat

SEQ ID NO: 243210 - DNA, 25 bp, Rattus norvegicus
ccaagtcctccacttcacatttaag

SEQ ID NO: 243211 - DNA, 25 bp, Rattus norvegicus
ccaagtcctccagttcacatttaag

SEQ ID NO: 243212 - DNA, 25 bp, Rattus norvegicus
ccaagtcctcggcagcgtctctgga

SEQ ID NO: 243213 - DNA, 25 bp, Rattus norvegicus
ccaagtcctcgggagcgtctctgga

SEQ ID NO: 243214 - DNA, 25 bp, Rattus norvegicus
ccaagtcctgtgatgtgttttgtca

SEQ ID NO: 243215 - DNA, 25 bp, Rattus norvegicus
ccaagtcctgtgttgtgttttgtca

SEQ ID NO: 243216 - DNA, 25 bp, Rattus norvegicus
ccaagtccttggcttagcatggcat

SEQ ID NO: 243217 - DNA, 25 bp, Rattus norvegicus
ccaagtccttgggttagcatggcat

SEQ ID NO: 243218 - DNA, 25 bp, Rattus norvegicus
ccaagtcggctacattcgggtgaag

SEQ ID NO: 243219 - DNA, 25 bp, Rattus norvegicus
ccaagtcggctagattcgggtgaag

SEQ ID NO: 243220 - DNA, 25 bp, Rattus norvegicus
ccaagtctcggaaaggctcactgga

SEQ ID NO: 243221 - DNA, 25 bp, Rattus norvegicus
ccaagtctcggataggctcactgga

SEQ ID NO: 243222 - DNA, 25 bp, Rattus norvegicus
ccaagtctgagcagcagctccagga

SEQ ID NO: 243223 - DNA, 25 bp, Rattus norvegicus
ccaagtctgagctgcagctccagga

SEQ ID NO: 243224 - DNA, 25 bp, Rattus norvegicus
ccaagtctggttaccatgaggtgaa

SEQ ID NO: 243225 - DNA, 25 bp, Rattus norvegicus
ccaagtctggtttccatgaggtgaa

SEQ ID NO: 243226 - DNA, 25 bp, Rattus norvegicus
ccaagtctgtagagtgttgctctaa

SEQ ID NO: 243227 - DNA, 25 bp, Rattus norvegicus
ccaagtctgtagtgtgttgctctaa

SEQ ID NO: 243228 - DNA, 25 bp, Rattus norvegicus
ccaagtcttggcctttgcatttatt

SEQ ID NO: 243229 - DNA, 25 bp, Rattus norvegicus
ccaagtcttggcgtttgcatttatt

SEQ ID NO: 243230 - DNA, 25 bp, Rattus norvegicus
ccaagtgagttcacgaatcttcatg

SEQ ID NO: 243231 - DNA, 25 bp, Rattus norvegicus
ccaagtgagttctcgaatcttcatg

SEQ ID NO: 243232 - DNA, 25 bp, Rattus norvegicus
ccaagtgatcaactacatttgtaat

SEQ ID NO: 243233 - DNA, 25 bp, Rattus norvegicus
ccaagtgatcaagtacatttgtaat

SEQ ID NO: 243234 - DNA, 25 bp, Rattus norvegicus
ccaagtgatgaaacagcgggccgta

SEQ ID NO: 243235 - DNA, 25 bp, Rattus norvegicus
ccaagtgatgaatcagcgggccgta

SEQ ID NO: 243236 - DNA, 25 bp, Rattus norvegicus
ccaagtgcctgaagggtgaggacct

SEQ ID NO: 243237 - DNA, 25 bp, Rattus norvegicus
ccaagtgcctgatgggtgaggacct

SEQ ID NO: 243238 - DNA, 25 bp, Rattus norvegicus
ccaagtgctctcctgttagatttag

SEQ ID NO: 243239 - DNA, 25 bp, Rattus norvegicus
ccaagtgctctcgtgttagatttag

SEQ ID NO: 243240 - DNA, 25 bp, Rattus norvegicus
ccaagtgctcttattctggtgagaa

SEQ ID NO: 243241 - DNA, 25 bp, Rattus norvegicus
ccaagtgctctttttctggtgagaa

SEQ ID NO: 243242 - DNA, 25 bp, Rattus norvegicus
ccaagtgctgcgattagagatgagc

SEQ ID NO: 243243 - DNA, 25 bp, Rattus norvegicus
ccaagtgctgcgtttagagatgagc

SEQ ID NO: 243244 - DNA, 25 bp, Rattus norvegicus
ccaagtggacgtctaccctgcggct

SEQ ID NO: 243245 - DNA, 25 bp, Rattus norvegicus
ccaagtggacgtgtaccctgcggct

SEQ ID NO: 243246 - DNA, 25 bp, Rattus norvegicus
ccaagtggatgcacacagcctctgt

SEQ ID NO: 243247 - DNA, 25 bp, Rattus norvegicus
ccaagtggatgctcacagcctctgt

SEQ ID NO: 243248 - DNA, 25 bp, Rattus norvegicus
ccaagtgggcaacggctgacgagcc

SEQ ID NO: 243249 - DNA, 25 bp, Rattus norvegicus
ccaagtgggcaagggctgacgagcc

SEQ ID NO: 243250 - DNA, 25 bp, Rattus norvegicus
ccaagtgtcaggagagcgcatttct

SEQ ID NO: 243251 - DNA, 25 bp, Rattus norvegicus
ccaagtgtcaggtgagcgcatttct

SEQ ID NO: 243252 - DNA, 25 bp, Rattus norvegicus
ccaagtgtcttgagtccaggaattt

SEQ ID NO: 243253 - DNA, 25 bp, Rattus norvegicus
ccaagtgtcttgtgtccaggaattt

SEQ ID NO: 243254 - DNA, 25 bp, Rattus norvegicus
ccaagtgtggaaaccgaagtccatc

SEQ ID NO: 243255 - DNA, 25 bp, Rattus norvegicus
ccaagtgtggaatccgaagtccatc

SEQ ID NO: 243256 - DNA, 25 bp, Rattus norvegicus
ccaagtgttggcagtgatcgccgaa

SEQ ID NO: 243257 - DNA, 25 bp, Rattus norvegicus
ccaagtgttggctgtgatcgccgaa

SEQ ID NO: 243258 - DNA, 25 bp, Rattus norvegicus
ccaagttaaagccaagccctctgtg

SEQ ID NO: 243259 - DNA, 25 bp, Rattus norvegicus
ccaagttaaagcgaagccctctgtg

SEQ ID NO: 243260 - DNA, 25 bp, Rattus norvegicus
ccaagttcagtaaacacctcaaggg

SEQ ID NO: 243261 - DNA, 25 bp, Rattus norvegicus
ccaagttcagtatacacctcaaggg

SEQ ID NO: 243262 - DNA, 25 bp, Rattus norvegicus
ccaagttctctaccgtaatctgtat

SEQ ID NO: 243263 - DNA, 25 bp, Rattus norvegicus
ccaagttctctagcgtaatctgtat

SEQ ID NO: 243264 - DNA, 25 bp, Rattus norvegicus
ccaagttctgagattgcagccatga

SEQ ID NO: 243265 - DNA, 25 bp, Rattus norvegicus
ccaagttctgagtttgcagccatga

SEQ ID NO: 243266 - DNA, 25 bp, Rattus norvegicus
ccaagttcttatcatccatttgaag

SEQ ID NO: 243267 - DNA, 25 bp, Rattus norvegicus
ccaagttcttatgatccatttgaag

SEQ ID NO: 243268 - DNA, 25 bp, Rattus norvegicus
ccaagttcttgcctccaaaacatga

SEQ ID NO: 243269 - DNA, 25 bp, Rattus norvegicus
ccaagttcttgcgtccaaaacatga

SEQ ID NO: 243270 - DNA, 25 bp, Rattus norvegicus
ccaagttggatcactcaagtcaaat

SEQ ID NO: 243271 - DNA, 25 bp, Rattus norvegicus
ccaagttggatctctcaagtcaaat

SEQ ID NO: 243272 - DNA, 25 bp, Rattus norvegicus
ccaagtttacaacggcaggcagatc

SEQ ID NO: 243273 - DNA, 25 bp, Rattus norvegicus
ccaagtttacaagggcaggcagatc

SEQ ID NO: 243274 - DNA, 25 bp, Rattus norvegicus
ccaagtttattgaaatgtcctcatc

SEQ ID NO: 243275 - DNA, 25 bp, Rattus norvegicus
ccaagtttattgtaatgtcctcatc

SEQ ID NO: 243276 - DNA, 25 bp, Rattus norvegicus
ccaagtttgttgctggcacaggaca

SEQ ID NO: 243277 - DNA, 25 bp, Rattus norvegicus
ccaagtttgttggtggcacaggaca

SEQ ID NO: 243278 - DNA, 25 bp, Rattus norvegicus
ccaagttttggaatcacaggcatgt

SEQ ID NO: 243279 - DNA, 25 bp, Rattus norvegicus
ccaagttttggattcacaggcatgt

SEQ ID NO: 243280 - DNA, 25 bp, Rattus norvegicus
ccaataagctggaacaagtctgtaa

SEQ ID NO: 243281 - DNA, 25 bp, Rattus norvegicus
ccaataagctggtacaagtctgtaa

SEQ ID NO: 243282 - DNA, 25 bp, Rattus norvegicus
ccaatagattatacccggccaatga

SEQ ID NO: 243283 - DNA, 25 bp, Rattus norvegicus
ccaatagattattcccggccaatga

SEQ ID NO: 243284 - DNA, 25 bp, Rattus norvegicus
ccaataggccccatgagggcgtgag

SEQ ID NO: 243285 - DNA, 25 bp, Rattus norvegicus
ccaataggccccttgagggcgtgag

SEQ ID NO: 243286 - DNA, 25 bp, Rattus norvegicus
ccaatagtctctcgtgaagacaagt

SEQ ID NO: 243287 - DNA, 25 bp, Rattus norvegicus
ccaatagtctctggtgaagacaagt

SEQ ID NO: 243288 - DNA, 25 bp, Rattus norvegicus
ccaatatactacctaggctgcacat

SEQ ID NO: 243289 - DNA, 25 bp, Rattus norvegicus
ccaatatactacgtaggctgcacat

SEQ ID NO: 243290 - DNA, 25 bp, Rattus norvegicus
ccaatatgtgtgactgttctgcaac

SEQ ID NO: 243291 - DNA, 25 bp, Rattus norvegicus
ccaatatgtgtgtctgttctgcaac

SEQ ID NO: 243292 - DNA, 25 bp, Rattus norvegicus
ccaatattacttcaggacctctctt

SEQ ID NO: 243293 - DNA, 25 bp, Rattus norvegicus
ccaatattacttgaggacctctctt

SEQ ID NO: 243294 - DNA, 25 bp, Rattus norvegicus
ccaatcactaatacactcactcatt

SEQ ID NO: 243295 - DNA, 25 bp, Rattus norvegicus
ccaatcactaattcactcactcatt

SEQ ID NO: 243296 - DNA, 25 bp, Rattus norvegicus
ccaatcagccacagggttctagtat

SEQ ID NO: 243297 - DNA, 25 bp, Rattus norvegicus
ccaatcagccactgggttctagtat

SEQ ID NO: 243298 - DNA, 25 bp, Rattus norvegicus
ccaatccatcccaatgagcgatcat

SEQ ID NO: 243299 - DNA, 25 bp, Rattus norvegicus
ccaatccatccctatgagcgatcat

SEQ ID NO: 243300 - DNA, 25 bp, Rattus norvegicus
ccaatcccgggacagctaaaagcat

SEQ ID NO: 243301 - DNA, 25 bp, Rattus norvegicus
ccaatcccgggagagctaaaagcat

SEQ ID NO: 243302 - DNA, 25 bp, Rattus norvegicus
ccaatcccgggtactataaattcag

SEQ ID NO: 243303 - DNA, 25 bp, Rattus norvegicus
ccaatcccgggttctataaattcag

SEQ ID NO: 243304 - DNA, 25 bp, Rattus norvegicus
ccaatctccaatcagttcctggata

SEQ ID NO: 243305 - DNA, 25 bp, Rattus norvegicus
ccaatctccaatgagttcctggata

SEQ ID NO: 243306 - DNA, 25 bp, Rattus norvegicus
ccaatctcggcaacctattgacaga

SEQ ID NO: 243307 - DNA, 25 bp, Rattus norvegicus
ccaatctcggcatcctattgacaga

SEQ ID NO: 243308 - DNA, 25 bp, Rattus norvegicus
ccaatctctccaaacatctcaaagt

SEQ ID NO: 243309 - DNA, 25 bp, Rattus norvegicus
ccaatctctccatacatctcaaagt

SEQ ID NO: 243310 - DNA, 25 bp, Rattus norvegicus
ccaatctgactcagaatttcctaag

SEQ ID NO: 243311 - DNA, 25 bp, Rattus norvegicus
ccaatctgactctgaatttcctaag

SEQ ID NO: 243312 - DNA, 25 bp, Rattus norvegicus
ccaatctgccgccaatgtgaggaag

SEQ ID NO: 243313 - DNA, 25 bp, Rattus norvegicus
ccaatctgccgcgaatgtgaggaag

SEQ ID NO: 243314 - DNA, 25 bp, Rattus norvegicus
ccaatcttaggcaaaccagtttaat

SEQ ID NO: 243315 - DNA, 25 bp, Rattus norvegicus
ccaatcttaggctaaccagtttaat

SEQ ID NO: 243316 - DNA, 25 bp, Rattus norvegicus
ccaatcttcaccagcttcagaaatc

SEQ ID NO: 243317 - DNA, 25 bp, Rattus norvegicus
ccaatcttcacctgcttcagaaatc

SEQ ID NO: 243318 - DNA, 25 bp, Rattus norvegicus
ccaatcttggccatcttcttaattt

SEQ ID NO: 243319 - DNA, 25 bp, Rattus norvegicus
ccaatcttggccttcttcttaattt

SEQ ID NO: 243320 - DNA, 25 bp, Rattus norvegicus
ccaatctttcccaatgcccataaaa

SEQ ID NO: 243321 - DNA, 25 bp, Rattus norvegicus
ccaatctttccctatgcccataaaa

SEQ ID NO: 243322 - DNA, 25 bp, Rattus norvegicus
ccaatgaatcctcgggtgtatgctc

SEQ ID NO: 243323 - DNA, 25 bp, Rattus norvegicus
ccaatgaatcctggggtgtatgctc

SEQ ID NO: 243324 - DNA, 25 bp, Rattus norvegicus
ccaatgagctggcaccggatgcgat

SEQ ID NO: 243325 - DNA, 25 bp, Rattus norvegicus
ccaatgagctgggaccggatgcgat

SEQ ID NO: 243326 - DNA, 25 bp, Rattus norvegicus
ccaatgatgcgcatggttctcaggg

SEQ ID NO: 243327 - DNA, 25 bp, Rattus norvegicus
ccaatgatgcgcttggttctcaggg

SEQ ID NO: 243328 - DNA, 25 bp, Rattus norvegicus
ccaatgcaatggaggcccagttctg

SEQ ID NO: 243329 - DNA, 25 bp, Rattus norvegicus
ccaatgcaatggtggcccagttctg

SEQ ID NO: 243330 - DNA, 25 bp, Rattus norvegicus
ccaatgccagctacagtttttctat

SEQ ID NO: 243331 - DNA, 25 bp, Rattus norvegicus
ccaatgccagcttcagtttttctat

SEQ ID NO: 243332 - DNA, 25 bp, Rattus norvegicus
ccaatgcccagaacccacttaaagg

SEQ ID NO: 243333 - DNA, 25 bp, Rattus norvegicus
ccaatgcccagatcccacttaaagg

SEQ ID NO: 243334 - DNA, 25 bp, Rattus norvegicus
ccaatgccctgtcttctaggaacgt

SEQ ID NO: 243335 - DNA, 25 bp, Rattus norvegicus
ccaatgccctgtgttctaggaacgt

SEQ ID NO: 243336 - DNA, 25 bp, Rattus norvegicus
ccaatgctaatcactatcctttctg

SEQ ID NO: 243337 - DNA, 25 bp, Rattus norvegicus
ccaatgctaatctctatcctttctg

SEQ ID NO: 243338 - DNA, 25 bp, Rattus norvegicus
ccaatgctccagcttctctgggaaa

SEQ ID NO: 243339 - DNA, 25 bp, Rattus norvegicus
ccaatgctccaggttctctgggaaa

SEQ ID NO: 243340 - DNA, 25 bp, Rattus norvegicus
ccaatgctgctgattttcaataaaa

SEQ ID NO: 243341 - DNA, 25 bp, Rattus norvegicus
ccaatgctgctgtttttcaataaaa

SEQ ID NO: 243342 - DNA, 25 bp, Rattus norvegicus
ccaatgcttcccctgacagagagaa

SEQ ID NO: 243343 - DNA, 25 bp, Rattus norvegicus
ccaatgcttcccgtgacagagagaa

SEQ ID NO: 243344 - DNA, 25 bp, Rattus norvegicus
ccaatggaaagtctcctttcgcgat

SEQ ID NO: 243345 - DNA, 25 bp, Rattus norvegicus
ccaatggaaagtgtcctttcgcgat

SEQ ID NO: 243346 - DNA, 25 bp, Rattus norvegicus
ccaatggaatggaacagaggctgca

SEQ ID NO: 243347 - DNA, 25 bp, Rattus norvegicus
ccaatggaatggtacagaggctgca

SEQ ID NO: 243348 - DNA, 25 bp, Rattus norvegicus
ccaatggagattcacctgggtatgc

SEQ ID NO: 243349 - DNA, 25 bp, Rattus norvegicus
ccaatggagattgacctgggtatgc

SEQ ID NO: 243350 - DNA, 25 bp, Rattus norvegicus
ccaatggagtaacaagtaggccctt

SEQ ID NO: 243351 - DNA, 25 bp, Rattus norvegicus
ccaatggagtaagaagtaggccctt

SEQ ID NO: 243352 - DNA, 25 bp, Rattus norvegicus
ccaatggctgtgctcatgtttgcaa

SEQ ID NO: 243353 - DNA, 25 bp, Rattus norvegicus
ccaatggctgtggtcatgtttgcaa

SEQ ID NO: 243354 - DNA, 25 bp, Rattus norvegicus
ccaatggtgtgaagtacttcgccag

SEQ ID NO: 243355 - DNA, 25 bp, Rattus norvegicus
ccaatggtgtgatgtacttcgccag

SEQ ID NO: 243356 - DNA, 25 bp, Rattus norvegicus
ccaatgtaaataatgtcatgaacta

SEQ ID NO: 243357 - DNA, 25 bp, Rattus norvegicus
ccaatgtaaatattgtcatgaacta

SEQ ID NO: 243358 - DNA, 25 bp, Rattus norvegicus
ccaatgtaagctcccatgtgtctgt

SEQ ID NO: 243359 - DNA, 25 bp, Rattus norvegicus
ccaatgtaagctgccatgtgtctgt

SEQ ID NO: 243360 - DNA, 25 bp, Rattus norvegicus
ccaatgtatcttctttgcaccatag

SEQ ID NO: 243361 - DNA, 25 bp, Rattus norvegicus
ccaatgtatcttgtttgcaccatag

SEQ ID NO: 243362 - DNA, 25 bp, Rattus norvegicus
ccaatgtcacggaagcttctgttag

SEQ ID NO: 243363 - DNA, 25 bp, Rattus norvegicus
ccaatgtcacggtagcttctgttag

SEQ ID NO: 243364 - DNA, 25 bp, Rattus norvegicus
ccaatgtcccctacattttcaaagg

SEQ ID NO: 243365 - DNA, 25 bp, Rattus norvegicus
ccaatgtccccttcattttcaaagg

SEQ ID NO: 243366 - DNA, 25 bp, Rattus norvegicus
ccaatgtcctccagtttgtatggga

SEQ ID NO: 243367 - DNA, 25 bp, Rattus norvegicus
ccaatgtcctcctgtttgtatggga

SEQ ID NO: 243368 - DNA, 25 bp, Rattus norvegicus
ccaatgtgcgctccagatattcttg

SEQ ID NO: 243369 - DNA, 25 bp, Rattus norvegicus
ccaatgtgcgctgcagatattcttg

SEQ ID NO: 243370 - DNA, 25 bp, Rattus norvegicus
ccaatgtgctttacttgatggctaa

SEQ ID NO: 243371 - DNA, 25 bp, Rattus norvegicus
ccaatgtgcttttcttgatggctaa

SEQ ID NO: 243372 - DNA, 25 bp, Rattus norvegicus
ccaatgtgtaacatgtgactgtata

SEQ ID NO: 243373 - DNA, 25 bp, Rattus norvegicus
ccaatgtgtaacttgtgactgtata

SEQ ID NO: 243374 - DNA, 25 bp, Rattus norvegicus
ccaatgttggtcaccagtcctaggg

SEQ ID NO: 243375 - DNA, 25 bp, Rattus norvegicus
ccaatgttggtctccagtcctaggg

SEQ ID NO: 243376 - DNA, 25 bp, Rattus norvegicus
ccaatgtttagtatccttgtgacac

SEQ ID NO: 243377 - DNA, 25 bp, Rattus norvegicus
ccaatgtttagtttccttgtgacac

SEQ ID NO: 243378 - DNA, 25 bp, Rattus norvegicus
ccaattcaagctcgttccgggagaa

SEQ ID NO: 243379 - DNA, 25 bp, Rattus norvegicus
ccaattcaagctggttccgggagaa

SEQ ID NO: 243380 - DNA, 25 bp, Rattus norvegicus
ccaattcagaacatgggttgcattt

SEQ ID NO: 243381 - DNA, 25 bp, Rattus norvegicus
ccaattcagaacttgggttgcattt

SEQ ID NO: 243382 - DNA, 25 bp, Rattus norvegicus
ccaattcagtggatcatctatcaat

SEQ ID NO: 243383 - DNA, 25 bp, Rattus norvegicus
ccaattcagtggttcatctatcaat

SEQ ID NO: 243384 - DNA, 25 bp, Rattus norvegicus
ccaattcctagtatgctgagctcga

SEQ ID NO: 243385 - DNA, 25 bp, Rattus norvegicus
ccaattcctagtttgctgagctcga

SEQ ID NO: 243386 - DNA, 25 bp, Rattus norvegicus
ccaattctagacaaatgagttctgt

SEQ ID NO: 243387 - DNA, 25 bp, Rattus norvegicus
ccaattctagactaatgagttctgt

SEQ ID NO: 243388 - DNA, 25 bp, Rattus norvegicus
ccaattctagtgcttctctgtttcc

SEQ ID NO: 243389 - DNA, 25 bp, Rattus norvegicus
ccaattctagtggttctctgtttcc

SEQ ID NO: 243390 - DNA, 25 bp, Rattus norvegicus
ccaattctattaaacactgcggcat

SEQ ID NO: 243391 - DNA, 25 bp, Rattus norvegicus
ccaattctattatacactgcggcat

SEQ ID NO: 243392 - DNA, 25 bp, Rattus norvegicus
ccaattgaccttacttgttcctaat

SEQ ID NO: 243393 - DNA, 25 bp, Rattus norvegicus
ccaattgacctttcttgttcctaat

SEQ ID NO: 243394 - DNA, 25 bp, Rattus norvegicus
ccaattgccagaatgccgggaagta

SEQ ID NO: 243395 - DNA, 25 bp, Rattus norvegicus
ccaattgccagattgccgggaagta

SEQ ID NO: 243396 - DNA, 25 bp, Rattus norvegicus
ccaattgcctatcgcccctggaatt

SEQ ID NO: 243397 - DNA, 25 bp, Rattus norvegicus
ccaattgcctatggcccctggaatt

SEQ ID NO: 243398 - DNA, 25 bp, Rattus norvegicus
ccaattgcctcaatttcctgtaaag

SEQ ID NO: 243399 - DNA, 25 bp, Rattus norvegicus
ccaattgcctcattttcctgtaaag

SEQ ID NO: 243400 - DNA, 25 bp, Rattus norvegicus
ccaattgctagcctcttctttaggg

SEQ ID NO: 243401 - DNA, 25 bp, Rattus norvegicus
ccaattgctagcgtcttctttaggg

SEQ ID NO: 243402 - DNA, 25 bp, Rattus norvegicus
ccaattgggcagacctcagggacct

SEQ ID NO: 243403 - DNA, 25 bp, Rattus norvegicus
ccaattgggcagtcctcagggacct

SEQ ID NO: 243404 - DNA, 25 bp, Rattus norvegicus
ccaattgtagggaaatggaatccag

SEQ ID NO: 243405 - DNA, 25 bp, Rattus norvegicus
ccaattgtagggtaatggaatccag

SEQ ID NO: 243406 - DNA, 25 bp, Rattus norvegicus
ccaattgtcagtatccaccagggag

SEQ ID NO: 243407 - DNA, 25 bp, Rattus norvegicus
ccaattgtcagtttccaccagggag

SEQ ID NO: 243408 - DNA, 25 bp, Rattus norvegicus
ccaatttcaactatttctaccaccg

SEQ ID NO: 243409 - DNA, 25 bp, Rattus norvegicus
ccaatttcaactttttctaccaccg

SEQ ID NO: 243410 - DNA, 25 bp, Rattus norvegicus
ccaatttcacctctgggagcctgga

SEQ ID NO: 243411 - DNA, 25 bp, Rattus norvegicus
ccaatttcacctgtgggagcctgga

SEQ ID NO: 243412 - DNA, 25 bp, Rattus norvegicus
ccaattttggttctgcgggcacata

SEQ ID NO: 243413 - DNA, 25 bp, Rattus norvegicus
ccaattttggttgtgcgggcacata

SEQ ID NO: 243414 - DNA, 25 bp, Rattus norvegicus
ccacaaagggcgacggtcccgctgg

SEQ ID NO: 243415 - DNA, 25 bp, Rattus norvegicus
ccacaaagggcgtcggtcccgctgg

SEQ ID NO: 243416 - DNA, 25 bp, Rattus norvegicus
ccacaaagtcttcctgccaggatag

SEQ ID NO: 243417 - DNA, 25 bp, Rattus norvegicus
ccacaaagtcttgctgccaggatag

SEQ ID NO: 243418 - DNA, 25 bp, Rattus norvegicus
ccacaacaaaagaatctgctagaca

SEQ ID NO: 243419 - DNA, 25 bp, Rattus norvegicus
ccacaacaaaagtatctgctagaca

SEQ ID NO: 243420 - DNA, 25 bp, Rattus norvegicus
ccacaacagttgacagggcctctga

SEQ ID NO: 243421 - DNA, 25 bp, Rattus norvegicus
ccacaacagttgtcagggcctctga

SEQ ID NO: 243422 - DNA, 25 bp, Rattus norvegicus
ccacaacatttcctttttgtccagt

SEQ ID NO: 243423 - DNA, 25 bp, Rattus norvegicus
ccacaacatttcgtttttgtccagt

SEQ ID NO: 243424 - DNA, 25 bp, Rattus norvegicus
ccacaaccctgcctatttatttaag

SEQ ID NO: 243425 - DNA, 25 bp, Rattus norvegicus
ccacaaccctgcgtatttatttaag

SEQ ID NO: 243426 - DNA, 25 bp, Rattus norvegicus
ccacaacctgtcagtgcattcagaa

SEQ ID NO: 243427 - DNA, 25 bp, Rattus norvegicus
ccacaacctgtctgtgcattcagaa

SEQ ID NO: 243428 - DNA, 25 bp, Rattus norvegicus
ccacaactctggatcttctcctgtg

SEQ ID NO: 243429 - DNA, 25 bp, Rattus norvegicus
ccacaactctggttcttctcctgtg

SEQ ID NO: 243430 - DNA, 25 bp, Rattus norvegicus
ccacaagcaagcctactcggagcgg

SEQ ID NO: 243431 - DNA, 25 bp, Rattus norvegicus
ccacaagcaagcgtactcggagcgg

SEQ ID NO: 243432 - DNA, 25 bp, Rattus norvegicus
ccacaagcctctcattttcagggta

SEQ ID NO: 243433 - DNA, 25 bp, Rattus norvegicus
ccacaagcctctgattttcagggta

SEQ ID NO: 243434 - DNA, 25 bp, Rattus norvegicus
ccacaagctgcgattttatttatta

SEQ ID NO: 243435 - DNA, 25 bp, Rattus norvegicus
ccacaagctgcgtttttatttatta

SEQ ID NO: 243436 - DNA, 25 bp, Rattus norvegicus
ccacaagggctgattccgtagatca

SEQ ID NO: 243437 - DNA, 25 bp, Rattus norvegicus
ccacaagggctgtttccgtagatca

SEQ ID NO: 243438 - DNA, 25 bp, Rattus norvegicus
ccacaaggtcagcttcaggtcgggc

SEQ ID NO: 243439 - DNA, 25 bp, Rattus norvegicus
ccacaaggtcaggttcaggtcgggc

SEQ ID NO: 243440 - DNA, 25 bp, Rattus norvegicus
ccacaagtgtctcggtgcattgcga

SEQ ID NO: 243441 - DNA, 25 bp, Rattus norvegicus
ccacaagtgtctgggtgcattgcga

SEQ ID NO: 243442 - DNA, 25 bp, Rattus norvegicus
ccacaagtgttgatttggtagttga

SEQ ID NO: 243443 - DNA, 25 bp, Rattus norvegicus
ccacaagtgttgttttggtagttga

SEQ ID NO: 243444 - DNA, 25 bp, Rattus norvegicus
ccacaagttctacaatgaaggagca

SEQ ID NO: 243445 - DNA, 25 bp, Rattus norvegicus
ccacaagttctagaatgaaggagca

SEQ ID NO: 243446 - DNA, 25 bp, Rattus norvegicus
ccacaataatacagggagatatcaa

SEQ ID NO: 243447 - DNA, 25 bp, Rattus norvegicus
ccacaataatactgggagatatcaa

SEQ ID NO: 243448 - DNA, 25 bp, Rattus norvegicus
ccacaatatatcagtgagtgtgtgt

SEQ ID NO: 243449 - DNA, 25 bp, Rattus norvegicus
ccacaatatatctgtgagtgtgtgt

SEQ ID NO: 243450 - DNA, 25 bp, Rattus norvegicus
ccacaatcctgtccctatgaagaga

SEQ ID NO: 243451 - DNA, 25 bp, Rattus norvegicus
ccacaatcctgtgcctatgaagaga

SEQ ID NO: 243452 - DNA, 25 bp, Rattus norvegicus
ccacaatcttaaaccttggctgata

SEQ ID NO: 243453 - DNA, 25 bp, Rattus norvegicus
ccacaatcttaatccttggctgata

SEQ ID NO: 243454 - DNA, 25 bp, Rattus norvegicus
ccacaattctacaatttcccaggag

SEQ ID NO: 243455 - DNA, 25 bp, Rattus norvegicus
ccacaattctactatttcccaggag

SEQ ID NO: 243456 - DNA, 25 bp, Rattus norvegicus
ccacaatttatcagccattagccac

SEQ ID NO: 243457 - DNA, 25 bp, Rattus norvegicus
ccacaatttatctgccattagccac

SEQ ID NO: 243458 - DNA, 25 bp, Rattus norvegicus
ccacacatggctatctttcctcttt

SEQ ID NO: 243459 - DNA, 25 bp, Rattus norvegicus
ccacacatggctttctttcctcttt

SEQ ID NO: 243460 - DNA, 25 bp, Rattus norvegicus
ccacacattcatcttcagttagctg

SEQ ID NO: 243461 - DNA, 25 bp, Rattus norvegicus
ccacacattcatgttcagttagctg

SEQ ID NO: 243462 - DNA, 25 bp, Rattus norvegicus
ccacaccagaaaagcaggagtttgc

SEQ ID NO: 243463 - DNA, 25 bp, Rattus norvegicus
ccacaccagaaatgcaggagtttgc

SEQ ID NO: 243464 - DNA, 25 bp, Rattus norvegicus
ccacaccatgcacacagtcagtgtt

SEQ ID NO: 243465 - DNA, 25 bp, Rattus norvegicus
ccacaccatgcagacagtcagtgtt

SEQ ID NO: 243466 - DNA, 25 bp, Rattus norvegicus
ccacaccctttcactgggatctgta

SEQ ID NO: 243467 - DNA, 25 bp, Rattus norvegicus
ccacaccctttctctgggatctgta

SEQ ID NO: 243468 - DNA, 25 bp, Rattus norvegicus
ccacaccggcagattccaaaagagg

SEQ ID NO: 243469 - DNA, 25 bp, Rattus norvegicus
ccacaccggcagtttccaaaagagg

SEQ ID NO: 243470 - DNA, 25 bp, Rattus norvegicus
ccacacctgagtccctaatgtttag

SEQ ID NO: 243471 - DNA, 25 bp, Rattus norvegicus
ccacacctgagtgcctaatgtttag

SEQ ID NO: 243472 - DNA, 25 bp, Rattus norvegicus
ccacacctggccaaatggtctttaa

SEQ ID NO: 243473 - DNA, 25 bp, Rattus norvegicus
ccacacctggcctaatggtctttaa

SEQ ID NO: 243474 - DNA, 25 bp, Rattus norvegicus
ccacaccttataactctgcaaactg

SEQ ID NO: 243475 - DNA, 25 bp, Rattus norvegicus
ccacaccttatatctctgcaaactg

SEQ ID NO: 243476 - DNA, 25 bp, Rattus norvegicus
ccacacctttctagtcatgatgaat

SEQ ID NO: 243477 - DNA, 25 bp, Rattus norvegicus
ccacacctttcttgtcatgatgaat

SEQ ID NO: 243478 - DNA, 25 bp, Rattus norvegicus
ccacacctttgcattctttgaaaat

SEQ ID NO: 243479 - DNA, 25 bp, Rattus norvegicus
ccacacctttgctttctttgaaaat

SEQ ID NO: 243480 - DNA, 25 bp, Rattus norvegicus
ccacacgctcttcgagaagaaaaaa

SEQ ID NO: 243481 - DNA, 25 bp, Rattus norvegicus
ccacacgctcttggagaagaaaaaa

SEQ ID NO: 243482 - DNA, 25 bp, Rattus norvegicus
ccacacgtcaggcactagaacataa

SEQ ID NO: 243483 - DNA, 25 bp, Rattus norvegicus
ccacacgtcagggactagaacataa

SEQ ID NO: 243484 - DNA, 25 bp, Rattus norvegicus
ccacactagcacctacgatcataga

SEQ ID NO: 243485 - DNA, 25 bp, Rattus norvegicus
ccacactagcacgtacgatcataga

SEQ ID NO: 243486 - DNA, 25 bp, Rattus norvegicus
ccacactatgctcagggtaaccaga

SEQ ID NO: 243487 - DNA, 25 bp, Rattus norvegicus
ccacactatgctgagggtaaccaga

SEQ ID NO: 243488 - DNA, 25 bp, Rattus norvegicus
ccacactattctatcactacatctg

SEQ ID NO: 243489 - DNA, 25 bp, Rattus norvegicus
ccacactattctttcactacatctg

SEQ ID NO: 243490 - DNA, 25 bp, Rattus norvegicus
ccacactcagctaccgggaaaagga

SEQ ID NO: 243491 - DNA, 25 bp, Rattus norvegicus
ccacactcagcttccgggaaaagga

SEQ ID NO: 243492 - DNA, 25 bp, Rattus norvegicus
ccacactcagtgcttaggttctaaa

SEQ ID NO: 243493 - DNA, 25 bp, Rattus norvegicus
ccacactcagtggttaggttctaaa

SEQ ID NO: 243494 - DNA, 25 bp, Rattus norvegicus
ccacactcatacactgtgcttgaga

SEQ ID NO: 243495 - DNA, 25 bp, Rattus norvegicus
ccacactcatactctgtgcttgaga

SEQ ID NO: 243496 - DNA, 25 bp, Rattus norvegicus
ccacactcctatagttttgcctaac

SEQ ID NO: 243497 - DNA, 25 bp, Rattus norvegicus
ccacactcctattgttttgcctaac

SEQ ID NO: 243498 - DNA, 25 bp, Rattus norvegicus
ccacactcttgaccagtctggaaga

SEQ ID NO: 243499 - DNA, 25 bp, Rattus norvegicus
ccacactcttgagcagtctggaaga

SEQ ID NO: 243500 - DNA, 25 bp, Rattus norvegicus
ccacactgtggacgaagggacctgt

SEQ ID NO: 243501 - DNA, 25 bp, Rattus norvegicus
ccacactgtggaggaagggacctgt

SEQ ID NO: 243502 - DNA, 25 bp, Rattus norvegicus
ccacacttcctgcaatactgtttgt

SEQ ID NO: 243503 - DNA, 25 bp, Rattus norvegicus
ccacacttcctgcagtgaacactaa

SEQ ID NO: 243504 - DNA, 25 bp, Rattus norvegicus
ccacacttcctggaatactgtttgt

SEQ ID NO: 243505 - DNA, 25 bp, Rattus norvegicus
ccacacttcctggagtgaacactaa

SEQ ID NO: 243506 - DNA, 25 bp, Rattus norvegicus
ccacacttgggacggcagcttctag

SEQ ID NO: 243507 - DNA, 25 bp, Rattus norvegicus
ccacacttgggagggcagcttctag

SEQ ID NO: 243508 - DNA, 25 bp, Rattus norvegicus
ccacacttggtgactttgagtcatt

SEQ ID NO: 243509 - DNA, 25 bp, Rattus norvegicus
ccacacttggtgtctttgagtcatt

SEQ ID NO: 243510 - DNA, 25 bp, Rattus norvegicus
ccacactttggcctctatttatttc

SEQ ID NO: 243511 - DNA, 25 bp, Rattus norvegicus
ccacactttggcgtctatttatttc

SEQ ID NO: 243512 - DNA, 25 bp, Rattus norvegicus
ccacactttgggaacagcgtgcact

SEQ ID NO: 243513 - DNA, 25 bp, Rattus norvegicus
ccacactttgggactgttatcctat

SEQ ID NO: 243514 - DNA, 25 bp, Rattus norvegicus
ccacactttgggtacagcgtgcact

SEQ ID NO: 243515 - DNA, 25 bp, Rattus norvegicus
ccacactttgggtctgttatcctat

SEQ ID NO: 243516 - DNA, 25 bp, Rattus norvegicus
ccacagacagtgcttttctttatat

SEQ ID NO: 243517 - DNA, 25 bp, Rattus norvegicus
ccacagacagtggttttctttatat

SEQ ID NO: 243518 - DNA, 25 bp, Rattus norvegicus
ccacagaccagtctttgcgtagtgt

SEQ ID NO: 243519 - DNA, 25 bp, Rattus norvegicus
ccacagaccagtgtttgcgtagtgt

SEQ ID NO: 243520 - DNA, 25 bp, Rattus norvegicus
ccacagagatacctcaggaagaatg

SEQ ID NO: 243521 - DNA, 25 bp, Rattus norvegicus
ccacagagatacgtcaggaagaatg

SEQ ID NO: 243522 - DNA, 25 bp, Rattus norvegicus
ccacagagctagacgggagaaagaa

SEQ ID NO: 243523 - DNA, 25 bp, Rattus norvegicus
ccacagagctagtcgggagaaagaa

SEQ ID NO: 243524 - DNA, 25 bp, Rattus norvegicus
ccacagagctgtcctgaagggccat

SEQ ID NO: 243525 - DNA, 25 bp, Rattus norvegicus
ccacagagctgtgctgaagggccat

SEQ ID NO: 243526 - DNA, 25 bp, Rattus norvegicus
ccacagagtaatcctctgacctgga

SEQ ID NO: 243527 - DNA, 25 bp, Rattus norvegicus
ccacagagtaatgctctgacctgga

SEQ ID NO: 243528 - DNA, 25 bp, Rattus norvegicus
ccacagagtgggagctaccctcaga

SEQ ID NO: 243529 - DNA, 25 bp, Rattus norvegicus
ccacagagtgggtgctaccctcaga

SEQ ID NO: 243530 - DNA, 25 bp, Rattus norvegicus
ccacagagtggtacatgcagatcat

SEQ ID NO: 243531 - DNA, 25 bp, Rattus norvegicus
ccacagagtggttcatgcagatcat

SEQ ID NO: 243532 - DNA, 25 bp, Rattus norvegicus
ccacagcaaccacgcggcgagagga

SEQ ID NO: 243533 - DNA, 25 bp, Rattus norvegicus
ccacagcaaccaggcggcgagagga

SEQ ID NO: 243534 - DNA, 25 bp, Rattus norvegicus
ccacagcaggataacaccaaggcct

SEQ ID NO: 243535 - DNA, 25 bp, Rattus norvegicus
ccacagcaggattacaccaaggcct

SEQ ID NO: 243536 - DNA, 25 bp, Rattus norvegicus
ccacagccatgtatagtacctcagt

SEQ ID NO: 243537 - DNA, 25 bp, Rattus norvegicus
ccacagccatgtttagtacctcagt

SEQ ID NO: 243538 - DNA, 25 bp, Rattus norvegicus
ccacagccgcacaagcaaaagggaa

SEQ ID NO: 243539 - DNA, 25 bp, Rattus norvegicus
ccacagccgcactagcaaaagggaa

SEQ ID NO: 243540 - DNA, 25 bp, Rattus norvegicus
ccacagccgctcatggactttgata

SEQ ID NO: 243541 - DNA, 25 bp, Rattus norvegicus
ccacagccgctcttggactttgata

SEQ ID NO: 243542 - DNA, 25 bp, Rattus norvegicus
ccacagccgctgatctcaagaaagt

SEQ ID NO: 243543 - DNA, 25 bp, Rattus norvegicus
ccacagccgctgttctcaagaaagt

SEQ ID NO: 243544 - DNA, 25 bp, Rattus norvegicus
ccacagcctgggacttggtaatgta

SEQ ID NO: 243545 - DNA, 25 bp, Rattus norvegicus
ccacagcctgggtcttggtaatgta

SEQ ID NO: 243546 - DNA, 25 bp, Rattus norvegicus
ccacagcgaggtcacccgcaggaga

SEQ ID NO: 243547 - DNA, 25 bp, Rattus norvegicus
ccacagcgaggtgacccgcaggaga

SEQ ID NO: 243548 - DNA, 25 bp, Rattus norvegicus
ccacagctcaggaggatgaccggct

SEQ ID NO: 243549 - DNA, 25 bp, Rattus norvegicus
ccacagctcaggtggatgaccggct

SEQ ID NO: 243550 - DNA, 25 bp, Rattus norvegicus
ccacagctcctgaattgtcagaaga

SEQ ID NO: 243551 - DNA, 25 bp, Rattus norvegicus
ccacagctcctgtattgtcagaaga

SEQ ID NO: 243552 - DNA, 25 bp, Rattus norvegicus
ccacagctgcagaaggacctaagga

SEQ ID NO: 243553 - DNA, 25 bp, Rattus norvegicus
ccacagctgcagtaggacctaagga

SEQ ID NO: 243554 - DNA, 25 bp, Rattus norvegicus
ccacaggacttaaggagctccccat

SEQ ID NO: 243555 - DNA, 25 bp, Rattus norvegicus
ccacaggacttatggagctccccat

SEQ ID NO: 243556 - DNA, 25 bp, Rattus norvegicus
ccacaggcagttcactattccagga

SEQ ID NO: 243557 - DNA, 25 bp, Rattus norvegicus
ccacaggcagttgactattccagga

SEQ ID NO: 243558 - DNA, 25 bp, Rattus norvegicus
ccacaggcctttaagctctgactat

SEQ ID NO: 243559 - DNA, 25 bp, Rattus norvegicus
ccacaggccttttagctctgactat

SEQ ID NO: 243560 - DNA, 25 bp, Rattus norvegicus
ccacaggctcttatcttgagacata

SEQ ID NO: 243561 - DNA, 25 bp, Rattus norvegicus
ccacaggctcttttcttgagacata

SEQ ID NO: 243562 - DNA, 25 bp, Rattus norvegicus
ccacaggcttgaaacggagtcccaa

SEQ ID NO: 243563 - DNA, 25 bp, Rattus norvegicus
ccacaggcttgatacggagtcccaa

SEQ ID NO: 243564 - DNA, 25 bp, Rattus norvegicus
ccacagggatttcgccatgagcttt

SEQ ID NO: 243565 - DNA, 25 bp, Rattus norvegicus
ccacagggatttggccatgagcttt

SEQ ID NO: 243566 - DNA, 25 bp, Rattus norvegicus
ccacagggtgctccctggaggaact

SEQ ID NO: 243567 - DNA, 25 bp, Rattus norvegicus
ccacagggtgctgcctggaggaact

SEQ ID NO: 243568 - DNA, 25 bp, Rattus norvegicus
ccacaggtgcctctgtatcctgaaa

SEQ ID NO: 243569 - DNA, 25 bp, Rattus norvegicus
ccacaggtgcctgtgtatcctgaaa

SEQ ID NO: 243570 - DNA, 25 bp, Rattus norvegicus
ccacaggtgtggattgccggatcac

SEQ ID NO: 243571 - DNA, 25 bp, Rattus norvegicus
ccacaggtgtggtttgccggatcac

SEQ ID NO: 243572 - DNA, 25 bp, Rattus norvegicus
ccacaggttctgaagcatcttgcga

SEQ ID NO: 243573 - DNA, 25 bp, Rattus norvegicus
ccacaggttctgtagcatcttgcga

SEQ ID NO: 243574 - DNA, 25 bp, Rattus norvegicus
ccacagtaccatcttgggagcgatg

SEQ ID NO: 243575 - DNA, 25 bp, Rattus norvegicus
ccacagtaccatgttgggagcgatg

SEQ ID NO: 243576 - DNA, 25 bp, Rattus norvegicus
ccacagtcacttaccaaacactaga

SEQ ID NO: 243577 - DNA, 25 bp, Rattus norvegicus
ccacagtcactttccaaacactaga

SEQ ID NO: 243578 - DNA, 25 bp, Rattus norvegicus
ccacagtccagtcccgaggagacat

SEQ ID NO: 243579 - DNA, 25 bp, Rattus norvegicus
ccacagtccagtgccgaggagacat

SEQ ID NO: 243580 - DNA, 25 bp, Rattus norvegicus
ccacagtggtcacggagggaatcca

SEQ ID NO: 243581 - DNA, 25 bp, Rattus norvegicus
ccacagtggtcagggagggaatcca

SEQ ID NO: 243582 - DNA, 25 bp, Rattus norvegicus
ccacagtgttcgactaccgggaggg

SEQ ID NO: 243583 - DNA, 25 bp, Rattus norvegicus
ccacagtgttcgtctaccgggaggg

SEQ ID NO: 243584 - DNA, 25 bp, Rattus norvegicus
ccacagttaaatcgttaggcactta

SEQ ID NO: 243585 - DNA, 25 bp, Rattus norvegicus
ccacagttaaatggttaggcactta

SEQ ID NO: 243586 - DNA, 25 bp, Rattus norvegicus
ccacagttccctattggtgctaaat

SEQ ID NO: 243587 - DNA, 25 bp, Rattus norvegicus
ccacagttcccttttggtgctaaat

SEQ ID NO: 243588 - DNA, 25 bp, Rattus norvegicus
ccacagttgctaccactaagggaat

SEQ ID NO: 243589 - DNA, 25 bp, Rattus norvegicus
ccacagttgctagcactaagggaat

SEQ ID NO: 243590 - DNA, 25 bp, Rattus norvegicus
ccacatacggttcgctggtaaacag

SEQ ID NO: 243591 - DNA, 25 bp, Rattus norvegicus
ccacatacggttggctggtaaacag

SEQ ID NO: 243592 - DNA, 25 bp, Rattus norvegicus
ccacatactccgagcactgtaaaca

SEQ ID NO: 243593 - DNA, 25 bp, Rattus norvegicus
ccacatactccgtgcactgtaaaca

SEQ ID NO: 243594 - DNA, 25 bp, Rattus norvegicus
ccacatcacttaccttttccaatag

SEQ ID NO: 243595 - DNA, 25 bp, Rattus norvegicus
ccacatcacttagcttttccaatag

SEQ ID NO: 243596 - DNA, 25 bp, Rattus norvegicus
ccacatcatgcgcaatgggctggat

SEQ ID NO: 243597 - DNA, 25 bp, Rattus norvegicus
ccacatcatgcggaatgggctggat

SEQ ID NO: 243598 - DNA, 25 bp, Rattus norvegicus
ccacatccaactactgagcacaaat

SEQ ID NO: 243599 - DNA, 25 bp, Rattus norvegicus
ccacatccaacttctgagcacaaat

SEQ ID NO: 243600 - DNA, 25 bp, Rattus norvegicus
ccacatccttctatggaaaatgtat

SEQ ID NO: 243601 - DNA, 25 bp, Rattus norvegicus
ccacatccttctttggaaaatgtat

SEQ ID NO: 243602 - DNA, 25 bp, Rattus norvegicus
ccacatcctttcaagcacagtgtta

SEQ ID NO: 243603 - DNA, 25 bp, Rattus norvegicus
ccacatcctttctagcacagtgtta

SEQ ID NO: 243604 - DNA, 25 bp, Rattus norvegicus
ccacatcgatccaacgggagcgaga

SEQ ID NO: 243605 - DNA, 25 bp, Rattus norvegicus
ccacatcgatcctacgggagcgaga

SEQ ID NO: 243606 - DNA, 25 bp, Rattus norvegicus
ccacatcgtgggctctgtctgtctg

SEQ ID NO: 243607 - DNA, 25 bp, Rattus norvegicus
ccacatcgtggggtctgtctgtctg

SEQ ID NO: 243608 - DNA, 25 bp, Rattus norvegicus
ccacatcgtgtgactgccgtgataa

SEQ ID NO: 243609 - DNA, 25 bp, Rattus norvegicus
ccacatcgtgtgtctgccgtgataa

SEQ ID NO: 243610 - DNA, 25 bp, Rattus norvegicus
ccacatctgcccactaaagctaaga

SEQ ID NO: 243611 - DNA, 25 bp, Rattus norvegicus
ccacatctgccctctaaagctaaga

SEQ ID NO: 243612 - DNA, 25 bp, Rattus norvegicus
ccacatctgtggaccttgggtgaaa

SEQ ID NO: 243613 - DNA, 25 bp, Rattus norvegicus
ccacatctgtggctaggttaaccat

SEQ ID NO: 243614 - DNA, 25 bp, Rattus norvegicus
ccacatctgtgggtaggttaaccat

SEQ ID NO: 243615 - DNA, 25 bp, Rattus norvegicus
ccacatctgtggtccttgggtgaaa

SEQ ID NO: 243616 - DNA, 25 bp, Rattus norvegicus
ccacatcttatcctttctgatgacc

SEQ ID NO: 243617 - DNA, 25 bp, Rattus norvegicus
ccacatcttatcgtttctgatgacc

SEQ ID NO: 243618 - DNA, 25 bp, Rattus norvegicus
ccacatcttccaaatagctcatcta

SEQ ID NO: 243619 - DNA, 25 bp, Rattus norvegicus
ccacatcttccatatagctcatcta

SEQ ID NO: 243620 - DNA, 25 bp, Rattus norvegicus
ccacatcttctcatttgctaactag

SEQ ID NO: 243621 - DNA, 25 bp, Rattus norvegicus
ccacatcttctcttttgctaactag

SEQ ID NO: 243622 - DNA, 25 bp, Rattus norvegicus
ccacatctttatctagacccaagtc

SEQ ID NO: 243623 - DNA, 25 bp, Rattus norvegicus
ccacatctttatgtagacccaagtc

SEQ ID NO: 243624 - DNA, 25 bp, Rattus norvegicus
ccacatgacagtaaagccccagaaa

SEQ ID NO: 243625 - DNA, 25 bp, Rattus norvegicus
ccacatgacagttaagccccagaaa

SEQ ID NO: 243626 - DNA, 25 bp, Rattus norvegicus
ccacatgaggaacgcttcttctgag

SEQ ID NO: 243627 - DNA, 25 bp, Rattus norvegicus
ccacatgaggaaggcttcttctgag

SEQ ID NO: 243628 - DNA, 25 bp, Rattus norvegicus
ccacatgccctcctatgaatttaac

SEQ ID NO: 243629 - DNA, 25 bp, Rattus norvegicus
ccacatgccctcgtatgaatttaac

SEQ ID NO: 243630 - DNA, 25 bp, Rattus norvegicus
ccacatgcctctcacattctataaa

SEQ ID NO: 243631 - DNA, 25 bp, Rattus norvegicus
ccacatgcctctgacattctataaa

SEQ ID NO: 243632 - DNA, 25 bp, Rattus norvegicus
ccacatggaattactgcattgttat

SEQ ID NO: 243633 - DNA, 25 bp, Rattus norvegicus
ccacatggaatttctgcattgttat

SEQ ID NO: 243634 - DNA, 25 bp, Rattus norvegicus
ccacatggacatcgaggcgctcaag

SEQ ID NO: 243635 - DNA, 25 bp, Rattus norvegicus
ccacatggacatggaggcgctcaag

SEQ ID NO: 243636 - DNA, 25 bp, Rattus norvegicus
ccacatggcttgagtttatgtctta

SEQ ID NO: 243637 - DNA, 25 bp, Rattus norvegicus
ccacatggcttgtgtttatgtctta

SEQ ID NO: 243638 - DNA, 25 bp, Rattus norvegicus
ccacatgggagcaccaggtggatgt

SEQ ID NO: 243639 - DNA, 25 bp, Rattus norvegicus
ccacatgggagctccaggtggatgt

SEQ ID NO: 243640 - DNA, 25 bp, Rattus norvegicus
ccacatgggtttaataactgtctgt

SEQ ID NO: 243641 - DNA, 25 bp, Rattus norvegicus
ccacatgggttttataactgtctgt

SEQ ID NO: 243642 - DNA, 25 bp, Rattus norvegicus
ccacatggtccacagcagggagatt

SEQ ID NO: 243643 - DNA, 25 bp, Rattus norvegicus
ccacatggtccagagcagggagatt

SEQ ID NO: 243644 - DNA, 25 bp, Rattus norvegicus
ccacatggtggcatatgactgtcca

SEQ ID NO: 243645 - DNA, 25 bp, Rattus norvegicus
ccacatggtggcttatgactgtcca

SEQ ID NO: 243646 - DNA, 25 bp, Rattus norvegicus
ccacattcaccgcagcattaagggt

SEQ ID NO: 243647 - DNA, 25 bp, Rattus norvegicus
ccacattcaccggagcattaagggt

SEQ ID NO: 243648 - DNA, 25 bp, Rattus norvegicus
ccacattcagagcagatagagcgtc

SEQ ID NO: 243649 - DNA, 25 bp, Rattus norvegicus
ccacattcagaggagatagagcgtc

SEQ ID NO: 243650 - DNA, 25 bp, Rattus norvegicus
ccacattcctataagttgtctcatg

SEQ ID NO: 243651 - DNA, 25 bp, Rattus norvegicus
ccacattcctattagttgtctcatg

SEQ ID NO: 243652 - DNA, 25 bp, Rattus norvegicus
ccacattctttaaccattcttcagt

SEQ ID NO: 243653 - DNA, 25 bp, Rattus norvegicus
ccacattctttatccattcttcagt

SEQ ID NO: 243654 - DNA, 25 bp, Rattus norvegicus
ccacattgtgagattcatgacagcc

SEQ ID NO: 243655 - DNA, 25 bp, Rattus norvegicus
ccacattgtgagtttcatgacagcc

SEQ ID NO: 243656 - DNA, 25 bp, Rattus norvegicus
ccacattgtggaacgcaagcggcta

SEQ ID NO: 243657 - DNA, 25 bp, Rattus norvegicus
ccacattgtggatcgcaagcggcta

SEQ ID NO: 243658 - DNA, 25 bp, Rattus norvegicus
ccacatttccggagtcatctgatag

SEQ ID NO: 243659 - DNA, 25 bp, Rattus norvegicus
ccacatttccggtgtcatctgatag

SEQ ID NO: 243660 - DNA, 25 bp, Rattus norvegicus
ccacatttctccctgtctaaagagg

SEQ ID NO: 243661 - DNA, 25 bp, Rattus norvegicus
ccacatttctccgtgtctaaagagg

SEQ ID NO: 243662 - DNA, 25 bp, Rattus norvegicus
ccacatttgtggagcattctatata

SEQ ID NO: 243663 - DNA, 25 bp, Rattus norvegicus
ccacatttgtggtgcattctatata

SEQ ID NO: 243664 - DNA, 25 bp, Rattus norvegicus
ccacattttgagagggaacccatgt

SEQ ID NO: 243665 - DNA, 25 bp, Rattus norvegicus
ccacattttgagtgggaacccatgt

SEQ ID NO: 243666 - DNA, 25 bp, Rattus norvegicus
ccacattttgttcccagacattcta

SEQ ID NO: 243667 - DNA, 25 bp, Rattus norvegicus
ccacattttgttgccagacattcta

SEQ ID NO: 243668 - DNA, 25 bp, Rattus norvegicus
ccaccaagatgactcgacgggcaga

SEQ ID NO: 243669 - DNA, 25 bp, Rattus norvegicus
ccaccaagatgagtcgacgggcaga

SEQ ID NO: 243670 - DNA, 25 bp, Rattus norvegicus
ccaccaagcccaaggtcaaggttga

SEQ ID NO: 243671 - DNA, 25 bp, Rattus norvegicus
ccaccaagcccatggtcaaggttga

SEQ ID NO: 243672 - DNA, 25 bp, Rattus norvegicus
ccaccaagcttgctctgacagtatt

SEQ ID NO: 243673 - DNA, 25 bp, Rattus norvegicus
ccaccaagcttggtctgacagtatt

SEQ ID NO: 243674 - DNA, 25 bp, Rattus norvegicus
ccaccaaggcatccgttgaacaaac

SEQ ID NO: 243675 - DNA, 25 bp, Rattus norvegicus
ccaccaaggcatgcgttgaacaaac

SEQ ID NO: 243676 - DNA, 25 bp, Rattus norvegicus
ccaccaatctgtcccttgaagataa

SEQ ID NO: 243677 - DNA, 25 bp, Rattus norvegicus
ccaccaatctgtgccttgaagataa

SEQ ID NO: 243678 - DNA, 25 bp, Rattus norvegicus
ccaccaatcttcactttatctatgt

SEQ ID NO: 243679 - DNA, 25 bp, Rattus norvegicus
ccaccaatcttctctttatctatgt

SEQ ID NO: 243680 - DNA, 25 bp, Rattus norvegicus
ccaccacaaaccaggacttggagtt

SEQ ID NO: 243681 - DNA, 25 bp, Rattus norvegicus
ccaccacaaacctggacttggagtt

SEQ ID NO: 243682 - DNA, 25 bp, Rattus norvegicus
ccaccacagccaattttcattacta

SEQ ID NO: 243683 - DNA, 25 bp, Rattus norvegicus
ccaccacagccatttttcattacta

SEQ ID NO: 243684 - DNA, 25 bp, Rattus norvegicus
ccaccaccatacaggagtgattcca

SEQ ID NO: 243685 - DNA, 25 bp, Rattus norvegicus
ccaccaccatactggagtgattcca

SEQ ID NO: 243686 - DNA, 25 bp, Rattus norvegicus
ccaccaccatgcactgtgggaagaa

SEQ ID NO: 243687 - DNA, 25 bp, Rattus norvegicus
ccaccaccatgctctgtgggaagaa

SEQ ID NO: 243688 - DNA, 25 bp, Rattus norvegicus
ccaccaccgctaatctgtttggaag

SEQ ID NO: 243689 - DNA, 25 bp, Rattus norvegicus
ccaccaccgctattctgtttggaag

SEQ ID NO: 243690 - DNA, 25 bp, Rattus norvegicus
ccaccacctgaacattctcccactt

SEQ ID NO: 243691 - DNA, 25 bp, Rattus norvegicus
ccaccacctgaagattctcccactt

SEQ ID NO: 243692 - DNA, 25 bp, Rattus norvegicus
ccaccacgatggactgttgttgtaa

SEQ ID NO: 243693 - DNA, 25 bp, Rattus norvegicus
ccaccacgatggtctgttgttgtaa

SEQ ID NO: 243694 - DNA, 25 bp, Rattus norvegicus
ccaccacgcgggaggagaggagggc

SEQ ID NO: 243695 - DNA, 25 bp, Rattus norvegicus
ccaccacgcgggtggagaggagggc

SEQ ID NO: 243696 - DNA, 25 bp, Rattus norvegicus
ccaccacgggagactagagctgcag

SEQ ID NO: 243697 - DNA, 25 bp, Rattus norvegicus
ccaccacgggagtctagagctgcag

SEQ ID NO: 243698 - DNA, 25 bp, Rattus norvegicus
ccaccacttgacagagtcgctgaaa

SEQ ID NO: 243699 - DNA, 25 bp, Rattus norvegicus
ccaccacttgactgagtcgctgaaa

SEQ ID NO: 243700 - DNA, 25 bp, Rattus norvegicus
ccaccagcactccatggagacaaga

SEQ ID NO: 243701 - DNA, 25 bp, Rattus norvegicus
ccaccagcactcgatggagacaaga

SEQ ID NO: 243702 - DNA, 25 bp, Rattus norvegicus
ccaccagcagctatttctatacagt

SEQ ID NO: 243703 - DNA, 25 bp, Rattus norvegicus
ccaccagcagctttttctatacagt

SEQ ID NO: 243704 - DNA, 25 bp, Rattus norvegicus
ccaccagcagttaatccagcaaatg

SEQ ID NO: 243705 - DNA, 25 bp, Rattus norvegicus
ccaccagcagtttatccagcaaatg

SEQ ID NO: 243706 - DNA, 25 bp, Rattus norvegicus
ccaccagcatctaagtcaggactct

SEQ ID NO: 243707 - DNA, 25 bp, Rattus norvegicus
ccaccagcatcttagtcaggactct

SEQ ID NO: 243708 - DNA, 25 bp, Rattus norvegicus
ccaccagctctacatctgacagaag

SEQ ID NO: 243709 - DNA, 25 bp, Rattus norvegicus
ccaccagctctagatctgacagaag

SEQ ID NO: 243710 - DNA, 25 bp, Rattus norvegicus
ccaccagctgacacattggcattat

SEQ ID NO: 243711 - DNA, 25 bp, Rattus norvegicus
ccaccagctgactcattggcattat

SEQ ID NO: 243712 - DNA, 25 bp, Rattus norvegicus
ccaccaggtgggagggagtcttcta

SEQ ID NO: 243713 - DNA, 25 bp, Rattus norvegicus
ccaccaggtgggtgggagtcttcta

SEQ ID NO: 243714 - DNA, 25 bp, Rattus norvegicus
ccaccagtagcaatagcttggtgtc

SEQ ID NO: 243715 - DNA, 25 bp, Rattus norvegicus
ccaccagtagcattagcttggtgtc

SEQ ID NO: 243716 - DNA, 25 bp, Rattus norvegicus
ccaccatccctgaagattgatcatt

SEQ ID NO: 243717 - DNA, 25 bp, Rattus norvegicus
ccaccatccctgtagattgatcatt

SEQ ID NO: 243718 - DNA, 25 bp, Rattus norvegicus
ccaccatccggtcatcaagagaaca

SEQ ID NO: 243719 - DNA, 25 bp, Rattus norvegicus
ccaccatccggtgatcaagagaaca

SEQ ID NO: 243720 - DNA, 25 bp, Rattus norvegicus
ccaccatcgccaacagtcagttagg

SEQ ID NO: 243721 - DNA, 25 bp, Rattus norvegicus
ccaccatcgccatcagtcagttagg

SEQ ID NO: 243722 - DNA, 25 bp, Rattus norvegicus
ccaccatctcaacgctgtagtttta

SEQ ID NO: 243723 - DNA, 25 bp, Rattus norvegicus
ccaccatctcaaggctgtagtttta

SEQ ID NO: 243724 - DNA, 25 bp, Rattus norvegicus
ccaccatctcgaaattggcatccat

SEQ ID NO: 243725 - DNA, 25 bp, Rattus norvegicus
ccaccatctcgatattggcatccat

SEQ ID NO: 243726 - DNA, 25 bp, Rattus norvegicus
ccaccatctgatagtaaccactgtt

SEQ ID NO: 243727 - DNA, 25 bp, Rattus norvegicus
ccaccatctgattgtaaccactgtt

SEQ ID NO: 243728 - DNA, 25 bp, Rattus norvegicus
ccaccatcttttctcttatgttcag

SEQ ID NO: 243729 - DNA, 25 bp, Rattus norvegicus
ccaccatcttttgtcttatgttcag

SEQ ID NO: 243730 - DNA, 25 bp, Rattus norvegicus
ccaccatgacccaagatacgtgatg

SEQ ID NO: 243731 - DNA, 25 bp, Rattus norvegicus
ccaccatgaccctagatacgtgatg

SEQ ID NO: 243732 - DNA, 25 bp, Rattus norvegicus
ccaccatgcctgcttgacaatgatg

SEQ ID NO: 243733 - DNA, 25 bp, Rattus norvegicus
ccaccatgcctggttgacaatgatg

SEQ ID NO: 243734 - DNA, 25 bp, Rattus norvegicus
ccaccatggatgacttcaagcagga

SEQ ID NO: 243735 - DNA, 25 bp, Rattus norvegicus
ccaccatggatgtcttcaagcagga

SEQ ID NO: 243736 - DNA, 25 bp, Rattus norvegicus
ccaccatgtccaacctcataaaata

SEQ ID NO: 243737 - DNA, 25 bp, Rattus norvegicus
ccaccatgtccatcctcataaaata

SEQ ID NO: 243738 - DNA, 25 bp, Rattus norvegicus
ccaccattcttgatgctttcgagag

SEQ ID NO: 243739 - DNA, 25 bp, Rattus norvegicus
ccaccattcttgttgctttcgagag

SEQ ID NO: 243740 - DNA, 25 bp, Rattus norvegicus
ccaccattggtgcagttcgaacgaa

SEQ ID NO: 243741 - DNA, 25 bp, Rattus norvegicus
ccaccattggtggagttcgaacgaa

SEQ ID NO: 243742 - DNA, 25 bp, Rattus norvegicus
ccaccatttttgacttagtttagca

SEQ ID NO: 243743 - DNA, 25 bp, Rattus norvegicus
ccaccatttttgtcttagtttagca

SEQ ID NO: 243744 - DNA, 25 bp, Rattus norvegicus
ccacccaagggaacattctcttttt

SEQ ID NO: 243745 - DNA, 25 bp, Rattus norvegicus
ccacccaagggatcattctcttttt

SEQ ID NO: 243746 - DNA, 25 bp, Rattus norvegicus
ccacccaccgctctgattggtttaa

SEQ ID NO: 243747 - DNA, 25 bp, Rattus norvegicus
ccacccaccgctgtgattggtttaa

SEQ ID NO: 243748 - DNA, 25 bp, Rattus norvegicus
ccacccaccgtccttgtgagataga

SEQ ID NO: 243749 - DNA, 25 bp, Rattus norvegicus
ccacccaccgtcgttgtgagataga

SEQ ID NO: 243750 - DNA, 25 bp, Rattus norvegicus
ccacccactgtgcatttagctgaag

SEQ ID NO: 243751 - DNA, 25 bp, Rattus norvegicus
ccacccactgtggatttagctgaag

SEQ ID NO: 243752 - DNA, 25 bp, Rattus norvegicus
ccacccacttacagagatctcagaa

SEQ ID NO: 243753 - DNA, 25 bp, Rattus norvegicus
ccacccacttactgagatctcagaa

SEQ ID NO: 243754 - DNA, 25 bp, Rattus norvegicus
ccacccacttgtagctattagttac

SEQ ID NO: 243755 - DNA, 25 bp, Rattus norvegicus
ccacccacttgttgctattagttac

SEQ ID NO: 243756 - DNA, 25 bp, Rattus norvegicus
ccacccaggcagcacttagtgaagt

SEQ ID NO: 243757 - DNA, 25 bp, Rattus norvegicus
ccacccaggcaggacttagtgaagt

SEQ ID NO: 243758 - DNA, 25 bp, Rattus norvegicus
ccacccaggccacgtgggtagtgtc

SEQ ID NO: 243759 - DNA, 25 bp, Rattus norvegicus
ccacccaggccaggtgggtagtgtc

SEQ ID NO: 243760 - DNA, 25 bp, Rattus norvegicus
ccacccatctagaactctgattcat

SEQ ID NO: 243761 - DNA, 25 bp, Rattus norvegicus
ccacccatctagtactctgattcat

SEQ ID NO: 243762 - DNA, 25 bp, Rattus norvegicus
ccacccatgcccaaggagttactag

SEQ ID NO: 243763 - DNA, 25 bp, Rattus norvegicus
ccacccatgccctaggagttactag

SEQ ID NO: 243764 - DNA, 25 bp, Rattus norvegicus
ccacccatgtatctgaaaagcacct

SEQ ID NO: 243765 - DNA, 25 bp, Rattus norvegicus
ccacccatgtatgtgaaaagcacct

SEQ ID NO: 243766 - DNA, 25 bp, Rattus norvegicus
ccacccattttcaacatgctttgtt

SEQ ID NO: 243767 - DNA, 25 bp, Rattus norvegicus
ccacccattttctacatgctttgtt

SEQ ID NO: 243768 - DNA, 25 bp, Rattus norvegicus
ccaccccagtgcatttttgaattga

SEQ ID NO: 243769 - DNA, 25 bp, Rattus norvegicus
ccaccccagtgcttttttgaattga

SEQ ID NO: 243770 - DNA, 25 bp, Rattus norvegicus
ccaccccatgctatttacagaacat

SEQ ID NO: 243771 - DNA, 25 bp, Rattus norvegicus
ccaccccatgctttttacagaacat

SEQ ID NO: 243772 - DNA, 25 bp, Rattus norvegicus
ccaccccatggtactataacagctt

SEQ ID NO: 243773 - DNA, 25 bp, Rattus norvegicus
ccaccccatggttctataacagctt

SEQ ID NO: 243774 - DNA, 25 bp, Rattus norvegicus
ccaccccggctaaatgatcaaatgc

SEQ ID NO: 243775 - DNA, 25 bp, Rattus norvegicus
ccaccccggctatatgatcaaatgc

SEQ ID NO: 243776 - DNA, 25 bp, Rattus norvegicus
ccacccctaactcgagttctaagat

SEQ ID NO: 243777 - DNA, 25 bp, Rattus norvegicus
ccacccctaactggagttctaagat

SEQ ID NO: 243778 - DNA, 25 bp, Rattus norvegicus
ccacccctgcaaacaacaagtaaag

SEQ ID NO: 243779 - DNA, 25 bp, Rattus norvegicus
ccacccctgcaatcaacaagtaaag

SEQ ID NO: 243780 - DNA, 25 bp, Rattus norvegicus
ccaccccttattactttggaagctg

SEQ ID NO: 243781 - DNA, 25 bp, Rattus norvegicus
ccaccccttatttctttggaagctg

SEQ ID NO: 243782 - DNA, 25 bp, Rattus norvegicus
ccacccgtgcataaccgtgagaaag

SEQ ID NO: 243783 - DNA, 25 bp, Rattus norvegicus
ccacccgtgcattaccgtgagaaag

SEQ ID NO: 243784 - DNA, 25 bp, Rattus norvegicus
ccaccctcattgatgcattcatttt

SEQ ID NO: 243785 - DNA, 25 bp, Rattus norvegicus
ccaccctcattgttgcattcatttt

SEQ ID NO: 243786 - DNA, 25 bp, Rattus norvegicus
ccaccctcggtgcaagaagctacaa

SEQ ID NO: 243787 - DNA, 25 bp, Rattus norvegicus
ccaccctcggtggaagaagctacaa

SEQ ID NO: 243788 - DNA, 25 bp, Rattus norvegicus
ccaccctctacaatggcacaaggta

SEQ ID NO: 243789 - DNA, 25 bp, Rattus norvegicus
ccaccctctacattggcacaaggta

SEQ ID NO: 243790 - DNA, 25 bp, Rattus norvegicus
ccaccctgctttattcacgctagaa

SEQ ID NO: 243791 - DNA, 25 bp, Rattus norvegicus
ccaccctgcttttttcacgctagaa

SEQ ID NO: 243792 - DNA, 25 bp, Rattus norvegicus
ccaccctgggttcgtttggatgtca

SEQ ID NO: 243793 - DNA, 25 bp, Rattus norvegicus
ccaccctgggttggtttggatgtca

SEQ ID NO: 243794 - DNA, 25 bp, Rattus norvegicus
ccacccttgcgtagctagggagata

SEQ ID NO: 243795 - DNA, 25 bp, Rattus norvegicus
ccacccttgcgttgctagggagata

SEQ ID NO: 243796 - DNA, 25 bp, Rattus norvegicus
ccaccgaaatctccagagggcatca

SEQ ID NO: 243797 - DNA, 25 bp, Rattus norvegicus
ccaccgaaatctgcagagggcatca

SEQ ID NO: 243798 - DNA, 25 bp, Rattus norvegicus
ccaccgaaccttctggaagcggagt

SEQ ID NO: 243799 - DNA, 25 bp, Rattus norvegicus
ccaccgaaccttgtggaagcggagt

SEQ ID NO: 243800 - DNA, 25 bp, Rattus norvegicus
ccaccgcaggctatgactttcgaaa

SEQ ID NO: 243801 - DNA, 25 bp, Rattus norvegicus
ccaccgcaggctttgactttcgaaa

SEQ ID NO: 243802 - DNA, 25 bp, Rattus norvegicus
ccaccgcattttcttttcttatctt

SEQ ID NO: 243803 - DNA, 25 bp, Rattus norvegicus
ccaccgcattttgttttcttatctt

SEQ ID NO: 243804 - DNA, 25 bp, Rattus norvegicus
ccaccgccatttaggttcaattcaa

SEQ ID NO: 243805 - DNA, 25 bp, Rattus norvegicus
ccaccgccattttggttcaattcaa

SEQ ID NO: 243806 - DNA, 25 bp, Rattus norvegicus
ccaccgccccttcagagatttaagt

SEQ ID NO: 243807 - DNA, 25 bp, Rattus norvegicus
ccaccgccccttgagagatttaagt

SEQ ID NO: 243808 - DNA, 25 bp, Rattus norvegicus
ccaccgcctggcactgagaggagag

SEQ ID NO: 243809 - DNA, 25 bp, Rattus norvegicus
ccaccgcctggctctgagaggagag

SEQ ID NO: 243810 - DNA, 25 bp, Rattus norvegicus
ccaccgcctttcagttcatggaatt

SEQ ID NO: 243811 - DNA, 25 bp, Rattus norvegicus
ccaccgcctttctgttcatggaatt

SEQ ID NO: 243812 - DNA, 25 bp, Rattus norvegicus
ccaccgctataaattgactcaacca

SEQ ID NO: 243813 - DNA, 25 bp, Rattus norvegicus
ccaccgctataatttgactcaacca

SEQ ID NO: 243814 - DNA, 25 bp, Rattus norvegicus
ccaccgctctttcctttacaatttt

SEQ ID NO: 243815 - DNA, 25 bp, Rattus norvegicus
ccaccgctctttgctttacaatttt

SEQ ID NO: 243816 - DNA, 25 bp, Rattus norvegicus
ccaccgctgggcaaggatcatttta

SEQ ID NO: 243817 - DNA, 25 bp, Rattus norvegicus
ccaccgctgggctaggatcatttta

SEQ ID NO: 243818 - DNA, 25 bp, Rattus norvegicus
ccaccgcttagtctaatggaggcag

SEQ ID NO: 243819 - DNA, 25 bp, Rattus norvegicus
ccaccgcttagtgtaatggaggcag

SEQ ID NO: 243820 - DNA, 25 bp, Rattus norvegicus
ccaccgcttctgaacatgtctaaat

SEQ ID NO: 243821 - DNA, 25 bp, Rattus norvegicus
ccaccgcttctgtacatgtctaaat

SEQ ID NO: 243822 - DNA, 25 bp, Rattus norvegicus
ccaccgtaaccgatgcatactgatt

SEQ ID NO: 243823 - DNA, 25 bp, Rattus norvegicus
ccaccgtaaccgttgcatactgatt

SEQ ID NO: 243824 - DNA, 25 bp, Rattus norvegicus
ccaccgtcaaccaggacaactttat

SEQ ID NO: 243825 - DNA, 25 bp, Rattus norvegicus
ccaccgtcaacctggacaactttat

SEQ ID NO: 243826 - DNA, 25 bp, Rattus norvegicus
ccaccgtctactcggctatatttat

SEQ ID NO: 243827 - DNA, 25 bp, Rattus norvegicus
ccaccgtctactgggctatatttat

SEQ ID NO: 243828 - DNA, 25 bp, Rattus norvegicus
ccaccgtgaaggagctagaaatcga

SEQ ID NO: 243829 - DNA, 25 bp, Rattus norvegicus
ccaccgtgaaggtgctagaaatcga

SEQ ID NO: 243830 - DNA, 25 bp, Rattus norvegicus
ccaccgtgagctatggactcaggca

SEQ ID NO: 243831 - DNA, 25 bp, Rattus norvegicus
ccaccgtgagctttggactcaggca

SEQ ID NO: 243832 - DNA, 25 bp, Rattus norvegicus
ccaccgtgcacaaggctgagggaga

SEQ ID NO: 243833 - DNA, 25 bp, Rattus norvegicus
ccaccgtgcacatggctgagggaga

SEQ ID NO: 243834 - DNA, 25 bp, Rattus norvegicus
ccaccgtgggtcctaaagcaaactg

SEQ ID NO: 243835 - DNA, 25 bp, Rattus norvegicus
ccaccgtgggtcgtaaagcaaactg

SEQ ID NO: 243836 - DNA, 25 bp, Rattus norvegicus
ccaccgtgtcatcgcacatgtcaga

SEQ ID NO: 243837 - DNA, 25 bp, Rattus norvegicus
ccaccgtgtcatggcacatgtcaga

SEQ ID NO: 243838 - DNA, 25 bp, Rattus norvegicus
ccacctaacagcaacctgagttcaa

SEQ ID NO: 243839 - DNA, 25 bp, Rattus norvegicus
ccacctaacagctacctgagttcaa

SEQ ID NO: 243840 - DNA, 25 bp, Rattus norvegicus
ccacctaacttcaggcttgttgcaa

SEQ ID NO: 243841 - DNA, 25 bp, Rattus norvegicus
ccacctaacttctggcttgttgcaa

SEQ ID NO: 243842 - DNA, 25 bp, Rattus norvegicus
ccacctactgctcctaaaaatgtca

SEQ ID NO: 243843 - DNA, 25 bp, Rattus norvegicus
ccacctactgctgctaaaaatgtca

SEQ ID NO: 243844 - DNA, 25 bp, Rattus norvegicus
ccacctactggccaatcagactata

SEQ ID NO: 243845 - DNA, 25 bp, Rattus norvegicus
ccacctactggcgaatcagactata

SEQ ID NO: 243846 - DNA, 25 bp, Rattus norvegicus
ccacctagccatcagtgcaatctaa

SEQ ID NO: 243847 - DNA, 25 bp, Rattus norvegicus
ccacctagccatgagtgcaatctaa

SEQ ID NO: 243848 - DNA, 25 bp, Rattus norvegicus
ccacctaggcagacaacagagggct

SEQ ID NO: 243849 - DNA, 25 bp, Rattus norvegicus
ccacctaggcagtcaacagagggct

SEQ ID NO: 243850 - DNA, 25 bp, Rattus norvegicus
ccacctagggatacctgaacacagg

SEQ ID NO: 243851 - DNA, 25 bp, Rattus norvegicus
ccacctagggattcctgaacacagg

SEQ ID NO: 243852 - DNA, 25 bp, Rattus norvegicus
ccacctagtggtcacaactgggcta

SEQ ID NO: 243853 - DNA, 25 bp, Rattus norvegicus
ccacctagtggtgacaactgggcta

SEQ ID NO: 243854 - DNA, 25 bp, Rattus norvegicus
ccacctatcagcaatgtctacatta

SEQ ID NO: 243855 - DNA, 25 bp, Rattus norvegicus
ccacctatcagctatgtctacatta

SEQ ID NO: 243856 - DNA, 25 bp, Rattus norvegicus
ccacctatcagtacagtacaaaaag

SEQ ID NO: 243857 - DNA, 25 bp, Rattus norvegicus
ccacctatcagttcagtacaaaaag

SEQ ID NO: 243858 - DNA, 25 bp, Rattus norvegicus
ccacctatgttcagcgttactaaag

SEQ ID NO: 243859 - DNA, 25 bp, Rattus norvegicus
ccacctatgttctgcgttactaaag

SEQ ID NO: 243860 - DNA, 25 bp, Rattus norvegicus
ccacctcaccccaagatgggaggag

SEQ ID NO: 243861 - DNA, 25 bp, Rattus norvegicus
ccacctcacccctagatgggaggag

SEQ ID NO: 243862 - DNA, 25 bp, Rattus norvegicus
ccacctcactgcagttctaatcagt

SEQ ID NO: 243863 - DNA, 25 bp, Rattus norvegicus
ccacctcactgctgttctaatcagt

SEQ ID NO: 243864 - DNA, 25 bp, Rattus norvegicus
ccacctcagaccaaggatcagtgaa

SEQ ID NO: 243865 - DNA, 25 bp, Rattus norvegicus
ccacctcagacctaggatcagtgaa

SEQ ID NO: 243866 - DNA, 25 bp, Rattus norvegicus
ccacctcagcttcaattccagatga

SEQ ID NO: 243867 - DNA, 25 bp, Rattus norvegicus
ccacctcagcttgaattccagatga

SEQ ID NO: 243868 - DNA, 25 bp, Rattus norvegicus
ccacctcaggtgacatttttaatgt

SEQ ID NO: 243869 - DNA, 25 bp, Rattus norvegicus
ccacctcaggtgtcatttttaatgt

SEQ ID NO: 243870 - DNA, 25 bp, Rattus norvegicus
ccacctcaggttatcactttttgct

SEQ ID NO: 243871 - DNA, 25 bp, Rattus norvegicus
ccacctcaggttttcactttttgct

SEQ ID NO: 243872 - DNA, 25 bp, Rattus norvegicus
ccacctccattaaaagactccttgt

SEQ ID NO: 243873 - DNA, 25 bp, Rattus norvegicus
ccacctccattataagactccttgt

SEQ ID NO: 243874 - DNA, 25 bp, Rattus norvegicus
ccacctccctagaagttatgaacac

SEQ ID NO: 243875 - DNA, 25 bp, Rattus norvegicus
ccacctccctagtagttatgaacac

SEQ ID NO: 243876 - DNA, 25 bp, Rattus norvegicus
ccacctccctctcgaatggatatat

SEQ ID NO: 243877 - DNA, 25 bp, Rattus norvegicus
ccacctccctctggaatggatatat

SEQ ID NO: 243878 - DNA, 25 bp, Rattus norvegicus
ccacctcctgcacttctaatgtaaa

SEQ ID NO: 243879 - DNA, 25 bp, Rattus norvegicus
ccacctcctgcagttctaatgtaaa

SEQ ID NO: 243880 - DNA, 25 bp, Rattus norvegicus
ccacctcctggtcccaatgaggaga

SEQ ID NO: 243881 - DNA, 25 bp, Rattus norvegicus
ccacctcctggtgccaatgaggaga

SEQ ID NO: 243882 - DNA, 25 bp, Rattus norvegicus
ccacctccttttaattggcagcgag

SEQ ID NO: 243883 - DNA, 25 bp, Rattus norvegicus
ccacctcctttttattggcagcgag

SEQ ID NO: 243884 - DNA, 25 bp, Rattus norvegicus
ccacctcgacctccggagaaggaga

SEQ ID NO: 243885 - DNA, 25 bp, Rattus norvegicus
ccacctcgacctgcggagaaggaga

SEQ ID NO: 243886 - DNA, 25 bp, Rattus norvegicus
ccacctcgattactcttgtcattta

SEQ ID NO: 243887 - DNA, 25 bp, Rattus norvegicus
ccacctcgattagtcttgtcattta

SEQ ID NO: 243888 - DNA, 25 bp, Rattus norvegicus
ccacctcgggtgagctggatgtgaa

SEQ ID NO: 243889 - DNA, 25 bp, Rattus norvegicus
ccacctcgggtgtgctggatgtgaa

SEQ ID NO: 243890 - DNA, 25 bp, Rattus norvegicus
ccacctcgtgggaagacagtttgaa

SEQ ID NO: 243891 - DNA, 25 bp, Rattus norvegicus
ccacctcgtgggtagacagtttgaa

SEQ ID NO: 243892 - DNA, 25 bp, Rattus norvegicus
ccacctctacacagatttccattat

SEQ ID NO: 243893 - DNA, 25 bp, Rattus norvegicus
ccacctctacactgatttccattat

SEQ ID NO: 243894 - DNA, 25 bp, Rattus norvegicus
ccacctctgagaaagtaaatggaga

SEQ ID NO: 243895 - DNA, 25 bp, Rattus norvegicus
ccacctctgagatagtaaatggaga

SEQ ID NO: 243896 - DNA, 25 bp, Rattus norvegicus
ccacctctgagtatacagggccaaa

SEQ ID NO: 243897 - DNA, 25 bp, Rattus norvegicus
ccacctctgagtttacagggccaaa

SEQ ID NO: 243898 - DNA, 25 bp, Rattus norvegicus
ccacctctggagaggagcccagtga

SEQ ID NO: 243899 - DNA, 25 bp, Rattus norvegicus
ccacctctggagtggagcccagtga

SEQ ID NO: 243900 - DNA, 25 bp, Rattus norvegicus
ccacctctgtctcactatgaaatat

SEQ ID NO: 243901 - DNA, 25 bp, Rattus norvegicus
ccacctctgtctgactatgaaatat

SEQ ID NO: 243902 - DNA, 25 bp, Rattus norvegicus
ccacctcttctgattgctgtattga

SEQ ID NO: 243903 - DNA, 25 bp, Rattus norvegicus
ccacctcttctgtttgctgtattga

SEQ ID NO: 243904 - DNA, 25 bp, Rattus norvegicus
ccacctgacaagactgtctggacag

SEQ ID NO: 243905 - DNA, 25 bp, Rattus norvegicus
ccacctgacaagtctgtctggacag

SEQ ID NO: 243906 - DNA, 25 bp, Rattus norvegicus
ccacctgagacacctgcacaagaag

SEQ ID NO: 243907 - DNA, 25 bp, Rattus norvegicus
ccacctgagacagctgcacaagaag

SEQ ID NO: 243908 - DNA, 25 bp, Rattus norvegicus
ccacctgagtgtcttctctggttag

SEQ ID NO: 243909 - DNA, 25 bp, Rattus norvegicus
ccacctgagtgtgttctctggttag

SEQ ID NO: 243910 - DNA, 25 bp, Rattus norvegicus
ccacctgcacagctgatactattaa

SEQ ID NO: 243911 - DNA, 25 bp, Rattus norvegicus
ccacctgcacaggtgatactattaa

SEQ ID NO: 243912 - DNA, 25 bp, Rattus norvegicus
ccacctgcactgagttctgggtaaa

SEQ ID NO: 243913 - DNA, 25 bp, Rattus norvegicus
ccacctgcactgtgttctgggtaaa

SEQ ID NO: 243914 - DNA, 25 bp, Rattus norvegicus
ccacctgcggctctcaagaaaattg

SEQ ID NO: 243915 - DNA, 25 bp, Rattus norvegicus
ccacctgcggctgtcaagaaaattg

SEQ ID NO: 243916 - DNA, 25 bp, Rattus norvegicus
ccacctgcgtggaactgctttgctc

SEQ ID NO: 243917 - DNA, 25 bp, Rattus norvegicus
ccacctgcgtggtactgctttgctc

SEQ ID NO: 243918 - DNA, 25 bp, Rattus norvegicus
ccacctggagggatctgcctggcag

SEQ ID NO: 243919 - DNA, 25 bp, Rattus norvegicus
ccacctggagggttctgcctggcag

SEQ ID NO: 243920 - DNA, 25 bp, Rattus norvegicus
ccacctggagtgactggctttaaaa

SEQ ID NO: 243921 - DNA, 25 bp, Rattus norvegicus
ccacctggagtgtctggctttaaaa

SEQ ID NO: 243922 - DNA, 25 bp, Rattus norvegicus
ccacctggtggaaggtccgtacagt

SEQ ID NO: 243923 - DNA, 25 bp, Rattus norvegicus
ccacctggtggatggtccgtacagt

SEQ ID NO: 243924 - DNA, 25 bp, Rattus norvegicus
ccacctgtatggaggttccttctga

SEQ ID NO: 243925 - DNA, 25 bp, Rattus norvegicus
ccacctgtatggtggttccttctga

SEQ ID NO: 243926 - DNA, 25 bp, Rattus norvegicus
ccacctgtctcacagaggaggtcat

SEQ ID NO: 243927 - DNA, 25 bp, Rattus norvegicus
ccacctgtctcagagaggaggtcat

SEQ ID NO: 243928 - DNA, 25 bp, Rattus norvegicus
ccacctgtctgtcttccagggaggg

SEQ ID NO: 243929 - DNA, 25 bp, Rattus norvegicus
ccacctgtctgtgttccagggaggg

SEQ ID NO: 243930 - DNA, 25 bp, Rattus norvegicus
ccacctgtgggtctgtatgcggaat

SEQ ID NO: 243931 - DNA, 25 bp, Rattus norvegicus
ccacctgtgggtgtgtatgcggaat

SEQ ID NO: 243932 - DNA, 25 bp, Rattus norvegicus
ccacctgtgttaagagtcccatgag

SEQ ID NO: 243933 - DNA, 25 bp, Rattus norvegicus
ccacctgtgttatgagtcccatgag

SEQ ID NO: 243934 - DNA, 25 bp, Rattus norvegicus
ccaccttaagccagtgcaatgcatt

SEQ ID NO: 243935 - DNA, 25 bp, Rattus norvegicus
ccaccttaagcctgtgcaatgcatt

SEQ ID NO: 243936 - DNA, 25 bp, Rattus norvegicus
ccaccttatcagacttcagacaaaa

SEQ ID NO: 243937 - DNA, 25 bp, Rattus norvegicus
ccaccttatcagtcttcagacaaaa

SEQ ID NO: 243938 - DNA, 25 bp, Rattus norvegicus
ccaccttcaggtattgcgggagaag

SEQ ID NO: 243939 - DNA, 25 bp, Rattus norvegicus
ccaccttcaggttttgcgggagaag

SEQ ID NO: 243940 - DNA, 25 bp, Rattus norvegicus
ccaccttcatgtacagaccattttt

SEQ ID NO: 243941 - DNA, 25 bp, Rattus norvegicus
ccaccttcatgttcagaccattttt

SEQ ID NO: 243942 - DNA, 25 bp, Rattus norvegicus
ccaccttccctgagtctaaagtata

SEQ ID NO: 243943 - DNA, 25 bp, Rattus norvegicus
ccaccttccctgtgtctaaagtata

SEQ ID NO: 243944 - DNA, 25 bp, Rattus norvegicus
ccaccttctcacactagatggtaga

SEQ ID NO: 243945 - DNA, 25 bp, Rattus norvegicus
ccaccttctcactctagatggtaga

SEQ ID NO: 243946 - DNA, 25 bp, Rattus norvegicus
ccaccttctcagatgggttttctgt

SEQ ID NO: 243947 - DNA, 25 bp, Rattus norvegicus
ccaccttctcagttgggttttctgt

SEQ ID NO: 243948 - DNA, 25 bp, Rattus norvegicus
ccaccttctccaagttgttgaattc

SEQ ID NO: 243949 - DNA, 25 bp, Rattus norvegicus
ccaccttctccatgttgttgaattc

SEQ ID NO: 243950 - DNA, 25 bp, Rattus norvegicus
ccaccttctgggaaactggtcaagt

SEQ ID NO: 243951 - DNA, 25 bp, Rattus norvegicus
ccaccttctgggtaactggtcaagt

SEQ ID NO: 243952 - DNA, 25 bp, Rattus norvegicus
ccaccttgctatcacacatggagct

SEQ ID NO: 243953 - DNA, 25 bp, Rattus norvegicus
ccaccttgctatgacacatggagct

SEQ ID NO: 243954 - DNA, 25 bp, Rattus norvegicus
ccaccttgtggaatgaccctattga

SEQ ID NO: 243955 - DNA, 25 bp, Rattus norvegicus
ccaccttgtggattgaccctattga

SEQ ID NO: 243956 - DNA, 25 bp, Rattus norvegicus
ccacctttctctagtttactaagtg

SEQ ID NO: 243957 - DNA, 25 bp, Rattus norvegicus
ccacctttctctattatctgcagtt

SEQ ID NO: 243958 - DNA, 25 bp, Rattus norvegicus
ccacctttctcttgtttactaagtg

SEQ ID NO: 243959 - DNA, 25 bp, Rattus norvegicus
ccacctttctcttttatctgcagtt

SEQ ID NO: 243960 - DNA, 25 bp, Rattus norvegicus
ccacctttgggtatatcagaccaat

SEQ ID NO: 243961 - DNA, 25 bp, Rattus norvegicus
ccacctttgggtttatcagaccaat

SEQ ID NO: 243962 - DNA, 25 bp, Rattus norvegicus
ccacctttgtcccagcagtaaaatg

SEQ ID NO: 243963 - DNA, 25 bp, Rattus norvegicus
ccacctttgtccgagcagtaaaatg

SEQ ID NO: 243964 - DNA, 25 bp, Rattus norvegicus
ccaccttttgcaatgtagaattttt

SEQ ID NO: 243965 - DNA, 25 bp, Rattus norvegicus
ccaccttttgcattgtagaattttt

SEQ ID NO: 243966 - DNA, 25 bp, Rattus norvegicus
ccacgaatgactctttctccgtgtc

SEQ ID NO: 243967 - DNA, 25 bp, Rattus norvegicus
ccacgaatgactgtttctccgtgtc

SEQ ID NO: 243968 - DNA, 25 bp, Rattus norvegicus
ccacgacaatggagctggactgatt

SEQ ID NO: 243969 - DNA, 25 bp, Rattus norvegicus
ccacgacaatggtgctggactgatt

SEQ ID NO: 243970 - DNA, 25 bp, Rattus norvegicus
ccacgaccagatcgctctggtggaa

SEQ ID NO: 243971 - DNA, 25 bp, Rattus norvegicus
ccacgaccagatggctctggtggaa

SEQ ID NO: 243972 - DNA, 25 bp, Rattus norvegicus
ccacgagatgggatagtctggtcga

SEQ ID NO: 243973 - DNA, 25 bp, Rattus norvegicus
ccacgagatgggttagtctggtcga

SEQ ID NO: 243974 - DNA, 25 bp, Rattus norvegicus
ccacgagcagccactgtacaaggag

SEQ ID NO: 243975 - DNA, 25 bp, Rattus norvegicus
ccacgagcagcctctgtacaaggag

SEQ ID NO: 243976 - DNA, 25 bp, Rattus norvegicus
ccacgagcgcgcactcgaagtagtc

SEQ ID NO: 243977 - DNA, 25 bp, Rattus norvegicus
ccacgagcgcgctctcgaagtagtc

SEQ ID NO: 243978 - DNA, 25 bp, Rattus norvegicus
ccacgagctgccctgttagatggtg

SEQ ID NO: 243979 - DNA, 25 bp, Rattus norvegicus
ccacgagctgccgtgttagatggtg

SEQ ID NO: 243980 - DNA, 25 bp, Rattus norvegicus
ccacgagtttgacagggcacccagg

SEQ ID NO: 243981 - DNA, 25 bp, Rattus norvegicus
ccacgagtttgagagggcacccagg

SEQ ID NO: 243982 - DNA, 25 bp, Rattus norvegicus
ccacgatagcagagttcttgttcag

SEQ ID NO: 243983 - DNA, 25 bp, Rattus norvegicus
ccacgatagcagtgttcttgttcag

SEQ ID NO: 243984 - DNA, 25 bp, Rattus norvegicus
ccacgcaagaccagctaccagggag

SEQ ID NO: 243985 - DNA, 25 bp, Rattus norvegicus
ccacgcaagacctgctaccagggag

SEQ ID NO: 243986 - DNA, 25 bp, Rattus norvegicus
ccacgcagaagcagccgcatgtcaa

SEQ ID NO: 243987 - DNA, 25 bp, Rattus norvegicus
ccacgcagaagctgccgcatgtcaa

SEQ ID NO: 243988 - DNA, 25 bp, Rattus norvegicus
ccacgccatatgatacaaaggaagt

SEQ ID NO: 243989 - DNA, 25 bp, Rattus norvegicus
ccacgccatatgttacaaaggaagt

SEQ ID NO: 243990 - DNA, 25 bp, Rattus norvegicus
ccacgcccatgcattcagaatatta

SEQ ID NO: 243991 - DNA, 25 bp, Rattus norvegicus
ccacgcccatgctttcagaatatta

SEQ ID NO: 243992 - DNA, 25 bp, Rattus norvegicus
ccacgccggagtatctgagtgttta

SEQ ID NO: 243993 - DNA, 25 bp, Rattus norvegicus
ccacgccggagtttctgagtgttta

SEQ ID NO: 243994 - DNA, 25 bp, Rattus norvegicus
ccacgcctggctaatgattttcttg

SEQ ID NO: 243995 - DNA, 25 bp, Rattus norvegicus
ccacgcctggcttatgattttcttg

SEQ ID NO: 243996 - DNA, 25 bp, Rattus norvegicus
ccacgcctggtgattagtaaactct

SEQ ID NO: 243997 - DNA, 25 bp, Rattus norvegicus
ccacgcctggtgtttagtaaactct

SEQ ID NO: 243998 - DNA, 25 bp, Rattus norvegicus
ccacgcctgtggctgtttaatcgaa

SEQ ID NO: 243999 - DNA, 25 bp, Rattus norvegicus
ccacgcctgtgggtgtttaatcgaa

SEQ ID NO: 244000 - DNA, 25 bp, Rattus norvegicus
ccacgcgtgtgtccggtctgtgctt

SEQ ID NO: 244001 - DNA, 25 bp, Rattus norvegicus
ccacgcgtgtgtgcggtctgtgctt

SEQ ID NO: 244002 - DNA, 25 bp, Rattus norvegicus
ccacgctcagtgctataaccagtga

SEQ ID NO: 244003 - DNA, 25 bp, Rattus norvegicus
ccacgctcagtggtataaccagtga

SEQ ID NO: 244004 - DNA, 25 bp, Rattus norvegicus
ccacgctgcagcagatcttcaggct

SEQ ID NO: 244005 - DNA, 25 bp, Rattus norvegicus
ccacgctgcagctgatcttcaggct

SEQ ID NO: 244006 - DNA, 25 bp, Rattus norvegicus
ccacgcttcacaagcttatatcgag

SEQ ID NO: 244007 - DNA, 25 bp, Rattus norvegicus
ccacgcttcacatgcttatatcgag

SEQ ID NO: 244008 - DNA, 25 bp, Rattus norvegicus
ccacgcttcagcatgtgcaatatat

SEQ ID NO: 244009 - DNA, 25 bp, Rattus norvegicus
ccacgcttcagcttgtgcaatatat

SEQ ID NO: 244010 - DNA, 25 bp, Rattus norvegicus
ccacggacagcgatcttcagaaaag

SEQ ID NO: 244011 - DNA, 25 bp, Rattus norvegicus
ccacggacagcgttcttcagaaaag

SEQ ID NO: 244012 - DNA, 25 bp, Rattus norvegicus
ccacggacggcgagtttgactgcaa

SEQ ID NO: 244013 - DNA, 25 bp, Rattus norvegicus
ccacggacggcgtgtttgactgcaa

SEQ ID NO: 244014 - DNA, 25 bp, Rattus norvegicus
ccacggagtgttcgttcagccaaag

SEQ ID NO: 244015 - DNA, 25 bp, Rattus norvegicus
ccacggagtgttggttcagccaaag

SEQ ID NO: 244016 - DNA, 25 bp, Rattus norvegicus
ccacggatggacacttccaagcaat

SEQ ID NO: 244017 - DNA, 25 bp, Rattus norvegicus
ccacggatggactcttccaagcaat

SEQ ID NO: 244018 - DNA, 25 bp, Rattus norvegicus
ccacggattctacctggccaagaaa

SEQ ID NO: 244019 - DNA, 25 bp, Rattus norvegicus
ccacggattctagctggccaagaaa

SEQ ID NO: 244020 - DNA, 25 bp, Rattus norvegicus
ccacggattgctcaggtcatagaaa

SEQ ID NO: 244021 - DNA, 25 bp, Rattus norvegicus
ccacggattgctgaggtcatagaaa

SEQ ID NO: 244022 - DNA, 25 bp, Rattus norvegicus
ccacggcagagaacggagggcctta

SEQ ID NO: 244023 - DNA, 25 bp, Rattus norvegicus
ccacggcagagatcggagggcctta

SEQ ID NO: 244024 - DNA, 25 bp, Rattus norvegicus
ccacggccattaactcatgcaagaa

SEQ ID NO: 244025 - DNA, 25 bp, Rattus norvegicus
ccacggccattatctcatgcaagaa

SEQ ID NO: 244026 - DNA, 25 bp, Rattus norvegicus
ccacggcctcatctgcatgaattga

SEQ ID NO: 244027 - DNA, 25 bp, Rattus norvegicus
ccacggcctcatgtgcatgaattga

SEQ ID NO: 244028 - DNA, 25 bp, Rattus norvegicus
ccacggctccttcaggcagttgaaa

SEQ ID NO: 244029 - DNA, 25 bp, Rattus norvegicus
ccacggctccttgaggcagttgaaa

SEQ ID NO: 244030 - DNA, 25 bp, Rattus norvegicus
ccacggctgctgacaaggccgatga

SEQ ID NO: 244031 - DNA, 25 bp, Rattus norvegicus
ccacggctgctgtcaaggccgatga

SEQ ID NO: 244032 - DNA, 25 bp, Rattus norvegicus
ccacggcttccgagaagagttgctt

SEQ ID NO: 244033 - DNA, 25 bp, Rattus norvegicus
ccacggcttccgtgaagagttgctt

SEQ ID NO: 244034 - DNA, 25 bp, Rattus norvegicus
ccacgggtcggcactgaattgcaga

SEQ ID NO: 244035 - DNA, 25 bp, Rattus norvegicus
ccacgggtcggctctgaattgcaga

SEQ ID NO: 244036 - DNA, 25 bp, Rattus norvegicus
ccacgggtctggctacagcgatgaa

SEQ ID NO: 244037 - DNA, 25 bp, Rattus norvegicus
ccacgggtctgggtacagcgatgaa

SEQ ID NO: 244038 - DNA, 25 bp, Rattus norvegicus
ccacgggtgcccatgacggaaacgg

SEQ ID NO: 244039 - DNA, 25 bp, Rattus norvegicus
ccacgggtgcccttgacggaaacgg

SEQ ID NO: 244040 - DNA, 25 bp, Rattus norvegicus
ccacgggtttccagaaattctcaat

SEQ ID NO: 244041 - DNA, 25 bp, Rattus norvegicus
ccacgggtttcctgaaattctcaat

SEQ ID NO: 244042 - DNA, 25 bp, Rattus norvegicus
ccacggtacaccaacttgatgcatt

SEQ ID NO: 244043 - DNA, 25 bp, Rattus norvegicus
ccacggtacacctacttgatgcatt

SEQ ID NO: 244044 - DNA, 25 bp, Rattus norvegicus
ccacggtcctgtaatttgagtctca

SEQ ID NO: 244045 - DNA, 25 bp, Rattus norvegicus
ccacggtcctgttatttgagtctca

SEQ ID NO: 244046 - DNA, 25 bp, Rattus norvegicus
ccacggtctcgtaccggaagaggat

SEQ ID NO: 244047 - DNA, 25 bp, Rattus norvegicus
ccacggtctcgttccggaagaggat

SEQ ID NO: 244048 - DNA, 25 bp, Rattus norvegicus
ccacggtgatctacaaggaggcaaa

SEQ ID NO: 244049 - DNA, 25 bp, Rattus norvegicus
ccacggtgatcttcaaggaggcaaa

SEQ ID NO: 244050 - DNA, 25 bp, Rattus norvegicus
ccacggtggcctccggacaaagatg

SEQ ID NO: 244051 - DNA, 25 bp, Rattus norvegicus
ccacggtggcctgcggacaaagatg

SEQ ID NO: 244052 - DNA, 25 bp, Rattus norvegicus
ccacggttagtgattcttccacaga

SEQ ID NO: 244053 - DNA, 25 bp, Rattus norvegicus
ccacggttagtgtttcttccacaga

SEQ ID NO: 244054 - DNA, 25 bp, Rattus norvegicus
ccacgtatctaccaaactgcttttg

SEQ ID NO: 244055 - DNA, 25 bp, Rattus norvegicus
ccacgtatctacgaaactgcttttg

SEQ ID NO: 244056 - DNA, 25 bp, Rattus norvegicus
ccacgtcacactacagggttttata

SEQ ID NO: 244057 - DNA, 25 bp, Rattus norvegicus
ccacgtcacacttcagggttttata

SEQ ID NO: 244058 - DNA, 25 bp, Rattus norvegicus
ccacgtccgatacacagggcattga

SEQ ID NO: 244059 - DNA, 25 bp, Rattus norvegicus
ccacgtccgatagacagggcattga

SEQ ID NO: 244060 - DNA, 25 bp, Rattus norvegicus
ccacgtcttccactatgggtgaggt

SEQ ID NO: 244061 - DNA, 25 bp, Rattus norvegicus
ccacgtcttccagtatgggtgaggt

SEQ ID NO: 244062 - DNA, 25 bp, Rattus norvegicus
ccacgtgaaggcagaccatgctgat

SEQ ID NO: 244063 - DNA, 25 bp, Rattus norvegicus
ccacgtgaaggctgaccatgctgat

SEQ ID NO: 244064 - DNA, 25 bp, Rattus norvegicus
ccacgtgagtccacttggctctgtc

SEQ ID NO: 244065 - DNA, 25 bp, Rattus norvegicus
ccacgtgagtcctcttggctctgtc

SEQ ID NO: 244066 - DNA, 25 bp, Rattus norvegicus
ccacgtggaagacctgcttggtgcc

SEQ ID NO: 244067 - DNA, 25 bp, Rattus norvegicus
ccacgtggaagagctgcttggtgcc

SEQ ID NO: 244068 - DNA, 25 bp, Rattus norvegicus
ccacgtggactcactatgcttatga

SEQ ID NO: 244069 - DNA, 25 bp, Rattus norvegicus
ccacgtggactctctatgcttatga

SEQ ID NO: 244070 - DNA, 25 bp, Rattus norvegicus
ccacgtgggaaacaggactttgcaa

SEQ ID NO: 244071 - DNA, 25 bp, Rattus norvegicus
ccacgtgggaaagaggactttgcaa

SEQ ID NO: 244072 - DNA, 25 bp, Rattus norvegicus
ccacgtgggtctcaaacactgaagg

SEQ ID NO: 244073 - DNA, 25 bp, Rattus norvegicus
ccacgtgggtctgaaacactgaagg

SEQ ID NO: 244074 - DNA, 25 bp, Rattus norvegicus
ccacgtggtgtgcaccttgcaaaat

SEQ ID NO: 244075 - DNA, 25 bp, Rattus norvegicus
ccacgtggtgtggaccttgcaaaat

SEQ ID NO: 244076 - DNA, 25 bp, Rattus norvegicus
ccacgtggtttcacagctgtctata

SEQ ID NO: 244077 - DNA, 25 bp, Rattus norvegicus
ccacgtggtttctcagctgtctata

SEQ ID NO: 244078 - DNA, 25 bp, Rattus norvegicus
ccacgtgtgccaaagctagggagct

SEQ ID NO: 244079 - DNA, 25 bp, Rattus norvegicus
ccacgtgtgccatagctagggagct

SEQ ID NO: 244080 - DNA, 25 bp, Rattus norvegicus
ccacgtgtgctgagacaactttcta

SEQ ID NO: 244081 - DNA, 25 bp, Rattus norvegicus
ccacgtgtgctgtgacaactttcta

SEQ ID NO: 244082 - DNA, 25 bp, Rattus norvegicus
ccacgtgtggctatcattctgatga

SEQ ID NO: 244083 - DNA, 25 bp, Rattus norvegicus
ccacgtgtggctttcattctgatga

SEQ ID NO: 244084 - DNA, 25 bp, Rattus norvegicus
ccacgttctttcaagattctgtcca

SEQ ID NO: 244085 - DNA, 25 bp, Rattus norvegicus
ccacgttctttctagattctgtcca

SEQ ID NO: 244086 - DNA, 25 bp, Rattus norvegicus
ccacgtttgcctactgcttagatat

SEQ ID NO: 244087 - DNA, 25 bp, Rattus norvegicus
ccacgtttgccttctgcttagatat

SEQ ID NO: 244088 - DNA, 25 bp, Rattus norvegicus
ccactaaagcacagcacgtcctggg

SEQ ID NO: 244089 - DNA, 25 bp, Rattus norvegicus
ccactaaagcactgcacgtcctggg

SEQ ID NO: 244090 - DNA, 25 bp, Rattus norvegicus
ccactaaagggcatcctgggctaca

SEQ ID NO: 244091 - DNA, 25 bp, Rattus norvegicus
ccactaaagggcttcctgggctaca

SEQ ID NO: 244092 - DNA, 25 bp, Rattus norvegicus
ccactaagcaaaatcaaggcctggg

SEQ ID NO: 244093 - DNA, 25 bp, Rattus norvegicus
ccactaagcaaattcaaggcctggg

SEQ ID NO: 244094 - DNA, 25 bp, Rattus norvegicus
ccactaatgacccagactctaacaa

SEQ ID NO: 244095 - DNA, 25 bp, Rattus norvegicus
ccactaatgaccgagactctaacaa

SEQ ID NO: 244096 - DNA, 25 bp, Rattus norvegicus
ccactaccgggtctatccagataga

SEQ ID NO: 244097 - DNA, 25 bp, Rattus norvegicus
ccactaccgggtgtatccagataga

SEQ ID NO: 244098 - DNA, 25 bp, Rattus norvegicus
ccactacggcctaggagcttggagt

SEQ ID NO: 244099 - DNA, 25 bp, Rattus norvegicus
ccactacggccttggagcttggagt

SEQ ID NO: 244100 - DNA, 25 bp, Rattus norvegicus
ccactactctaccttatttgcttga

SEQ ID NO: 244101 - DNA, 25 bp, Rattus norvegicus
ccactactctacgttatttgcttga

SEQ ID NO: 244102 - DNA, 25 bp, Rattus norvegicus
ccactactgcgtcggcagcgggcta

SEQ ID NO: 244103 - DNA, 25 bp, Rattus norvegicus
ccactactgcgtgggcagcgggcta

SEQ ID NO: 244104 - DNA, 25 bp, Rattus norvegicus
ccactacttcctctggtacaaaatg

SEQ ID NO: 244105 - DNA, 25 bp, Rattus norvegicus
ccactacttcctgtggtacaaaatg

SEQ ID NO: 244106 - DNA, 25 bp, Rattus norvegicus
ccactagactgtatgacaccttaaa

SEQ ID NO: 244107 - DNA, 25 bp, Rattus norvegicus
ccactagactgtttgacaccttaaa

SEQ ID NO: 244108 - DNA, 25 bp, Rattus norvegicus
ccactagatagcacatttcaccatt

SEQ ID NO: 244109 - DNA, 25 bp, Rattus norvegicus
ccactagatagctcatttcaccatt

SEQ ID NO: 244110 - DNA, 25 bp, Rattus norvegicus
ccactaggagggagcccacccgatt

SEQ ID NO: 244111 - DNA, 25 bp, Rattus norvegicus
ccactaggagggtgcccacccgatt

SEQ ID NO: 244112 - DNA, 25 bp, Rattus norvegicus
ccactaggagtcaagttcatataga

SEQ ID NO: 244113 - DNA, 25 bp, Rattus norvegicus
ccactaggagtctagttcatataga

SEQ ID NO: 244114 - DNA, 25 bp, Rattus norvegicus
ccactatgccagaccttttgggtag

SEQ ID NO: 244115 - DNA, 25 bp, Rattus norvegicus
ccactatgccagtccttttgggtag

SEQ ID NO: 244116 - DNA, 25 bp, Rattus norvegicus
ccactatgtttaaccctcgtagcaa

SEQ ID NO: 244117 - DNA, 25 bp, Rattus norvegicus
ccactatgtttatccctcgtagcaa

SEQ ID NO: 244118 - DNA, 25 bp, Rattus norvegicus
ccactattccacaatcatgagggcc

SEQ ID NO: 244119 - DNA, 25 bp, Rattus norvegicus
ccactattccactatcatgagggcc

SEQ ID NO: 244120 - DNA, 25 bp, Rattus norvegicus
ccactcaagcctctctacgaaaatg

SEQ ID NO: 244121 - DNA, 25 bp, Rattus norvegicus
ccactcaagcctgtctacgaaaatg

SEQ ID NO: 244122 - DNA, 25 bp, Rattus norvegicus
ccactcaattcccttgtagctcaga

SEQ ID NO: 244123 - DNA, 25 bp, Rattus norvegicus
ccactcaattccgttgtagctcaga

SEQ ID NO: 244124 - DNA, 25 bp, Rattus norvegicus
ccactcacagggaccaatagaccag

SEQ ID NO: 244125 - DNA, 25 bp, Rattus norvegicus
ccactcacagggtccaatagaccag

SEQ ID NO: 244126 - DNA, 25 bp, Rattus norvegicus
ccactcaccagtcagtgctgagaga

SEQ ID NO: 244127 - DNA, 25 bp, Rattus norvegicus
ccactcaccagtgagtgctgagaga

SEQ ID NO: 244128 - DNA, 25 bp, Rattus norvegicus
ccactcactctgcatttctgaaatt

SEQ ID NO: 244129 - DNA, 25 bp, Rattus norvegicus
ccactcactctggatttctgaaatt

SEQ ID NO: 244130 - DNA, 25 bp, Rattus norvegicus
ccactcagcttgactaatccggaga

SEQ ID NO: 244131 - DNA, 25 bp, Rattus norvegicus
ccactcagcttgtctaatccggaga

SEQ ID NO: 244132 - DNA, 25 bp, Rattus norvegicus
ccactcagggatatctttcagggat

SEQ ID NO: 244133 - DNA, 25 bp, Rattus norvegicus
ccactcagggatttctttcagggat

SEQ ID NO: 244134 - DNA, 25 bp, Rattus norvegicus
ccactcagtgttccctgtgaaacag

SEQ ID NO: 244135 - DNA, 25 bp, Rattus norvegicus
ccactcagtgttgcctgtgaaacag

SEQ ID NO: 244136 - DNA, 25 bp, Rattus norvegicus
ccactcatcatccaagggcggaggg

SEQ ID NO: 244137 - DNA, 25 bp, Rattus norvegicus
ccactcatcatcgaagggcggaggg

SEQ ID NO: 244138 - DNA, 25 bp, Rattus norvegicus
ccactcatccaaccatttggctttg

SEQ ID NO: 244139 - DNA, 25 bp, Rattus norvegicus
ccactcatccaagcatttggctttg

SEQ ID NO: 244140 - DNA, 25 bp, Rattus norvegicus
ccactcattcctcggagggcataga

SEQ ID NO: 244141 - DNA, 25 bp, Rattus norvegicus
ccactcattcctgggagggcataga

SEQ ID NO: 244142 - DNA, 25 bp, Rattus norvegicus
ccactccaatggaagctaactgctg

SEQ ID NO: 244143 - DNA, 25 bp, Rattus norvegicus
ccactccaatggtagctaactgctg

SEQ ID NO: 244144 - DNA, 25 bp, Rattus norvegicus
ccactccagacacaagctcaggttg

SEQ ID NO: 244145 - DNA, 25 bp, Rattus norvegicus
ccactccagacagaagctcaggttg

SEQ ID NO: 244146 - DNA, 25 bp, Rattus norvegicus
ccactccatctcatacttgagaggt

SEQ ID NO: 244147 - DNA, 25 bp, Rattus norvegicus
ccactccatctcttacttgagaggt

SEQ ID NO: 244148 - DNA, 25 bp, Rattus norvegicus
ccactcccttgacccgtaatgaaga

SEQ ID NO: 244149 - DNA, 25 bp, Rattus norvegicus
ccactcccttgagccgtaatgaaga

SEQ ID NO: 244150 - DNA, 25 bp, Rattus norvegicus
ccactcctggaacttactgcatatg

SEQ ID NO: 244151 - DNA, 25 bp, Rattus norvegicus
ccactcctggaagttactgcatatg

SEQ ID NO: 244152 - DNA, 25 bp, Rattus norvegicus
ccactcctggataaacttccttata

SEQ ID NO: 244153 - DNA, 25 bp, Rattus norvegicus
ccactcctggattaacttccttata

SEQ ID NO: 244154 - DNA, 25 bp, Rattus norvegicus
ccactcgacaggcttgcagtttcaa

SEQ ID NO: 244155 - DNA, 25 bp, Rattus norvegicus
ccactcgacagggttgcagtttcaa

SEQ ID NO: 244156 - DNA, 25 bp, Rattus norvegicus
ccactcgaccgtcctgaacagtagg

SEQ ID NO: 244157 - DNA, 25 bp, Rattus norvegicus
ccactcgaccgtgctgaacagtagg

SEQ ID NO: 244158 - DNA, 25 bp, Rattus norvegicus
ccactcgatcctcaacatatactat

SEQ ID NO: 244159 - DNA, 25 bp, Rattus norvegicus
ccactcgatcctgaacatatactat

SEQ ID NO: 244160 - DNA, 25 bp, Rattus norvegicus
ccactcgggcacacttgatgggtta

SEQ ID NO: 244161 - DNA, 25 bp, Rattus norvegicus
ccactcgggcactcttgatgggtta

SEQ ID NO: 244162 - DNA, 25 bp, Rattus norvegicus
ccactcgtagatctgcgacagggtg

SEQ ID NO: 244163 - DNA, 25 bp, Rattus norvegicus
ccactcgtagatgtgcgacagggtg

SEQ ID NO: 244164 - DNA, 25 bp, Rattus norvegicus
ccactcgtctttccaacatttttgt

SEQ ID NO: 244165 - DNA, 25 bp, Rattus norvegicus
ccactcgtctttgcaacatttttgt

SEQ ID NO: 244166 - DNA, 25 bp, Rattus norvegicus
ccactcgtgaggactgtgacttgct

SEQ ID NO: 244167 - DNA, 25 bp, Rattus norvegicus
ccactcgtgaggtctgtgacttgct

SEQ ID NO: 244168 - DNA, 25 bp, Rattus norvegicus
ccactcgttccgattgcatgttggg

SEQ ID NO: 244169 - DNA, 25 bp, Rattus norvegicus
ccactcgttccgtttgcatgttggg

SEQ ID NO: 244170 - DNA, 25 bp, Rattus norvegicus
ccactctacctccattgtacaaaaa

SEQ ID NO: 244171 - DNA, 25 bp, Rattus norvegicus
ccactctacctcgattgtacaaaaa

SEQ ID NO: 244172 - DNA, 25 bp, Rattus norvegicus
ccactctcatccatactatatctag

SEQ ID NO: 244173 - DNA, 25 bp, Rattus norvegicus
ccactctcatccttactatatctag

SEQ ID NO: 244174 - DNA, 25 bp, Rattus norvegicus
ccactctcatggattctgtaagcac

SEQ ID NO: 244175 - DNA, 25 bp, Rattus norvegicus
ccactctcatggtttctgtaagcac

SEQ ID NO: 244176 - DNA, 25 bp, Rattus norvegicus
ccactctcatgtcattacgtgaact

SEQ ID NO: 244177 - DNA, 25 bp, Rattus norvegicus
ccactctcatgtgattacgtgaact

SEQ ID NO: 244178 - DNA, 25 bp, Rattus norvegicus
ccactctctcacaaacattagctaa

SEQ ID NO: 244179 - DNA, 25 bp, Rattus norvegicus
ccactctctcactaacattagctaa

SEQ ID NO: 244180 - DNA, 25 bp, Rattus norvegicus
ccactctctcatagctcacaagaag

SEQ ID NO: 244181 - DNA, 25 bp, Rattus norvegicus
ccactctctcattgctcacaagaag

SEQ ID NO: 244182 - DNA, 25 bp, Rattus norvegicus
ccactctgatcacggccaataaatg

SEQ ID NO: 244183 - DNA, 25 bp, Rattus norvegicus
ccactctgatcagggccaataaatg

SEQ ID NO: 244184 - DNA, 25 bp, Rattus norvegicus
ccactctgcctgcaggatctgaagg

SEQ ID NO: 244185 - DNA, 25 bp, Rattus norvegicus
ccactctgcctggaggatctgaagg

SEQ ID NO: 244186 - DNA, 25 bp, Rattus norvegicus
ccactctggactcttctataaagta

SEQ ID NO: 244187 - DNA, 25 bp, Rattus norvegicus
ccactctggactgttctataaagta

SEQ ID NO: 244188 - DNA, 25 bp, Rattus norvegicus
ccactctgtgttatagagaagtgat

SEQ ID NO: 244189 - DNA, 25 bp, Rattus norvegicus
ccactctgtgttttagagaagtgat

SEQ ID NO: 244190 - DNA, 25 bp, Rattus norvegicus
ccactcttatgtactgctcaggtaa

SEQ ID NO: 244191 - DNA, 25 bp, Rattus norvegicus
ccactcttatgttctgctcaggtaa

SEQ ID NO: 244192 - DNA, 25 bp, Rattus norvegicus
ccactcttggctctcatctatgaaa

SEQ ID NO: 244193 - DNA, 25 bp, Rattus norvegicus
ccactcttggctgtcatctatgaaa

SEQ ID NO: 244194 - DNA, 25 bp, Rattus norvegicus
ccactcttgggcagggactggaaaa

SEQ ID NO: 244195 - DNA, 25 bp, Rattus norvegicus
ccactcttgggctgggactggaaaa

SEQ ID NO: 244196 - DNA, 25 bp, Rattus norvegicus
ccactcttgggtagatctgcacaaa

SEQ ID NO: 244197 - DNA, 25 bp, Rattus norvegicus
ccactcttgggttgatctgcacaaa

SEQ ID NO: 244198 - DNA, 25 bp, Rattus norvegicus
ccactcttgtccagttttgtttata

SEQ ID NO: 244199 - DNA, 25 bp, Rattus norvegicus
ccactcttgtcctgttttgtttata

SEQ ID NO: 244200 - DNA, 25 bp, Rattus norvegicus
ccactgaaagcactggacttggagt

SEQ ID NO: 244201 - DNA, 25 bp, Rattus norvegicus
ccactgaaagcagtggacttggagt

SEQ ID NO: 244202 - DNA, 25 bp, Rattus norvegicus
ccactgaaggtgctcatggtactgg

SEQ ID NO: 244203 - DNA, 25 bp, Rattus norvegicus
ccactgaaggtggtcatggtactgg

SEQ ID NO: 244204 - DNA, 25 bp, Rattus norvegicus
ccactgaatctgcttctgttccgaa

SEQ ID NO: 244205 - DNA, 25 bp, Rattus norvegicus
ccactgaatctggttctgttccgaa

SEQ ID NO: 244206 - DNA, 25 bp, Rattus norvegicus
ccactgaccggaagtaagaatcttt

SEQ ID NO: 244207 - DNA, 25 bp, Rattus norvegicus
ccactgaccggatgtaagaatcttt

SEQ ID NO: 244208 - DNA, 25 bp, Rattus norvegicus
ccactgacctgtatgtacacaaaag

SEQ ID NO: 244209 - DNA, 25 bp, Rattus norvegicus
ccactgacctgtttgtacacaaaag

SEQ ID NO: 244210 - DNA, 25 bp, Rattus norvegicus
ccactgactggacaatcttgctgta

SEQ ID NO: 244211 - DNA, 25 bp, Rattus norvegicus
ccactgactggagaatcttgctgta

SEQ ID NO: 244212 - DNA, 25 bp, Rattus norvegicus
ccactgagatggatgctttttaaaa

SEQ ID NO: 244213 - DNA, 25 bp, Rattus norvegicus
ccactgagatggttgctttttaaaa

SEQ ID NO: 244214 - DNA, 25 bp, Rattus norvegicus
ccactgaggcctctgatgcgtgaag

SEQ ID NO: 244215 - DNA, 25 bp, Rattus norvegicus
ccactgaggcctgtgatgcgtgaag

SEQ ID NO: 244216 - DNA, 25 bp, Rattus norvegicus
ccactgcatcccataatttatttct

SEQ ID NO: 244217 - DNA, 25 bp, Rattus norvegicus
ccactgcatcccttaatttatttct

SEQ ID NO: 244218 - DNA, 25 bp, Rattus norvegicus
ccactgccacagctgatgggtgtaa

SEQ ID NO: 244219 - DNA, 25 bp, Rattus norvegicus
ccactgccacaggtgatgggtgtaa

SEQ ID NO: 244220 - DNA, 25 bp, Rattus norvegicus
ccactgccagcgactttgaaggaat

SEQ ID NO: 244221 - DNA, 25 bp, Rattus norvegicus
ccactgccagcgtctttgaaggaat

SEQ ID NO: 244222 - DNA, 25 bp, Rattus norvegicus
ccactgccatctaagttctacttta

SEQ ID NO: 244223 - DNA, 25 bp, Rattus norvegicus
ccactgccatcttagttctacttta

SEQ ID NO: 244224 - DNA, 25 bp, Rattus norvegicus
ccactgctgccaaatgagtccagaa

SEQ ID NO: 244225 - DNA, 25 bp, Rattus norvegicus
ccactgctgccatatgagtccagaa

SEQ ID NO: 244226 - DNA, 25 bp, Rattus norvegicus
ccactgctgtctctacactgtaaat

SEQ ID NO: 244227 - DNA, 25 bp, Rattus norvegicus
ccactgctgtctgtacactgtaaat

SEQ ID NO: 244228 - DNA, 25 bp, Rattus norvegicus
ccactgctgtgtccggctgatgtag

SEQ ID NO: 244229 - DNA, 25 bp, Rattus norvegicus
ccactgctgtgtgcggctgatgtag

SEQ ID NO: 244230 - DNA, 25 bp, Rattus norvegicus
ccactgcttctaattctgcaaaggt

SEQ ID NO: 244231 - DNA, 25 bp, Rattus norvegicus
ccactgcttctatttctgcaaaggt

SEQ ID NO: 244232 - DNA, 25 bp, Rattus norvegicus
ccactgcttggacgctacacagttt

SEQ ID NO: 244233 - DNA, 25 bp, Rattus norvegicus
ccactgcttggaggctacacagttt

SEQ ID NO: 244234 - DNA, 25 bp, Rattus norvegicus
ccactgcttgttctagcatcttgtt

SEQ ID NO: 244235 - DNA, 25 bp, Rattus norvegicus
ccactgcttgttgtagcatcttgtt

SEQ ID NO: 244236 - DNA, 25 bp, Rattus norvegicus
ccactgctttccactactagaagtt

SEQ ID NO: 244237 - DNA, 25 bp, Rattus norvegicus
ccactgctttcctctactagaagtt

SEQ ID NO: 244238 - DNA, 25 bp, Rattus norvegicus
ccactggaaagcaggcccggaggat

SEQ ID NO: 244239 - DNA, 25 bp, Rattus norvegicus
ccactggaaagctggcccggaggat

SEQ ID NO: 244240 - DNA, 25 bp, Rattus norvegicus
ccactggaccttcgcactggatgag

SEQ ID NO: 244241 - DNA, 25 bp, Rattus norvegicus
ccactggaccttggcactggatgag

SEQ ID NO: 244242 - DNA, 25 bp, Rattus norvegicus
ccactggactaacctttctcttgat

SEQ ID NO: 244243 - DNA, 25 bp, Rattus norvegicus
ccactggactaagctttctcttgat

SEQ ID NO: 244244 - DNA, 25 bp, Rattus norvegicus
ccactggagcacagaacacaatgta

SEQ ID NO: 244245 - DNA, 25 bp, Rattus norvegicus
ccactggagcactgaacacaatgta

SEQ ID NO: 244246 - DNA, 25 bp, Rattus norvegicus
ccactggattgcagcggtcagaact

SEQ ID NO: 244247 - DNA, 25 bp, Rattus norvegicus
ccactggattgctgcggtcagaact

SEQ ID NO: 244248 - DNA, 25 bp, Rattus norvegicus
ccactggcacagagtgtgtaaatgc

SEQ ID NO: 244249 - DNA, 25 bp, Rattus norvegicus
ccactggcacagtgtgtgtaaatgc

SEQ ID NO: 244250 - DNA, 25 bp, Rattus norvegicus
ccactggccctgatagaggagcgta

SEQ ID NO: 244251 - DNA, 25 bp, Rattus norvegicus
ccactggccctgttagaggagcgta

SEQ ID NO: 244252 - DNA, 25 bp, Rattus norvegicus
ccactggcctctcagaacttgagat

SEQ ID NO: 244253 - DNA, 25 bp, Rattus norvegicus
ccactggcctctgagaacttgagat

SEQ ID NO: 244254 - DNA, 25 bp, Rattus norvegicus
ccactggctagtccttgacttggga

SEQ ID NO: 244255 - DNA, 25 bp, Rattus norvegicus
ccactggctagtgcttgacttggga

SEQ ID NO: 244256 - DNA, 25 bp, Rattus norvegicus
ccactgggcgtgacaatgcttcctg

SEQ ID NO: 244257 - DNA, 25 bp, Rattus norvegicus
ccactgggcgtgtcaatgcttcctg

SEQ ID NO: 244258 - DNA, 25 bp, Rattus norvegicus
ccactgggctgtcgtcaagatgcta

SEQ ID NO: 244259 - DNA, 25 bp, Rattus norvegicus
ccactgggctgtggtcaagatgcta

SEQ ID NO: 244260 - DNA, 25 bp, Rattus norvegicus
ccactgggtggcactgctgagccag

SEQ ID NO: 244261 - DNA, 25 bp, Rattus norvegicus
ccactgggtggctctgctgagccag

SEQ ID NO: 244262 - DNA, 25 bp, Rattus norvegicus
ccactggtgagtccggcacttgaga

SEQ ID NO: 244263 - DNA, 25 bp, Rattus norvegicus
ccactggtgagtgcggcacttgaga

SEQ ID NO: 244264 - DNA, 25 bp, Rattus norvegicus
ccactggtggaaacatggccctggg

SEQ ID NO: 244265 - DNA, 25 bp, Rattus norvegicus
ccactggtggaatcatggccctggg

SEQ ID NO: 244266 - DNA, 25 bp, Rattus norvegicus
ccactggttcatctcatcgcgtaaa

SEQ ID NO: 244267 - DNA, 25 bp, Rattus norvegicus
ccactggttcatgtcatcgcgtaaa

SEQ ID NO: 244268 - DNA, 25 bp, Rattus norvegicus
ccactgtcaccgactttgaggatta

SEQ ID NO: 244269 - DNA, 25 bp, Rattus norvegicus
ccactgtcaccgtctttgaggatta

SEQ ID NO: 244270 - DNA, 25 bp, Rattus norvegicus
ccactgtcccagagcagggtatgca

SEQ ID NO: 244271 - DNA, 25 bp, Rattus norvegicus
ccactgtcccagcttaacaaggtct

SEQ ID NO: 244272 - DNA, 25 bp, Rattus norvegicus
ccactgtcccaggttaacaaggtct

SEQ ID NO: 244273 - DNA, 25 bp, Rattus norvegicus
ccactgtcccagtgcagggtatgca

SEQ ID NO: 244274 - DNA, 25 bp, Rattus norvegicus
ccactgtctttacagctcagtctaa

SEQ ID NO: 244275 - DNA, 25 bp, Rattus norvegicus
ccactgtctttagagctcagtctaa

SEQ ID NO: 244276 - DNA, 25 bp, Rattus norvegicus
ccactgtgaggaaatgcattgagct

SEQ ID NO: 244277 - DNA, 25 bp, Rattus norvegicus
ccactgtgaggatatgcattgagct

SEQ ID NO: 244278 - DNA, 25 bp, Rattus norvegicus
ccactgttacttctgtgtccgagaa

SEQ ID NO: 244279 - DNA, 25 bp, Rattus norvegicus
ccactgttacttgtgtgtccgagaa

SEQ ID NO: 244280 - DNA, 25 bp, Rattus norvegicus
ccactgttattacttcttggccgtt

SEQ ID NO: 244281 - DNA, 25 bp, Rattus norvegicus
ccactgttattagttcttggccgtt

SEQ ID NO: 244282 - DNA, 25 bp, Rattus norvegicus
ccactgttggagctttcttgttcat

SEQ ID NO: 244283 - DNA, 25 bp, Rattus norvegicus
ccactgttggaggtttcttgttcat

SEQ ID NO: 244284 - DNA, 25 bp, Rattus norvegicus
ccactgttgggcacaattgttactg

SEQ ID NO: 244285 - DNA, 25 bp, Rattus norvegicus
ccactgttgggctcaattgttactg

SEQ ID NO: 244286 - DNA, 25 bp, Rattus norvegicus
ccactgtttaggactatgttcccat

SEQ ID NO: 244287 - DNA, 25 bp, Rattus norvegicus
ccactgtttaggtctatgttcccat

SEQ ID NO: 244288 - DNA, 25 bp, Rattus norvegicus
ccacttaaactgaccttttctcaag

SEQ ID NO: 244289 - DNA, 25 bp, Rattus norvegicus
ccacttaaactgtccttttctcaag

SEQ ID NO: 244290 - DNA, 25 bp, Rattus norvegicus
ccacttaagagtctctgctctaggg

SEQ ID NO: 244291 - DNA, 25 bp, Rattus norvegicus
ccacttaagagtgtctgctctaggg

SEQ ID NO: 244292 - DNA, 25 bp, Rattus norvegicus
ccacttaatgccagcagcaaggctt

SEQ ID NO: 244293 - DNA, 25 bp, Rattus norvegicus
ccacttaatgcctgcagcaaggctt

SEQ ID NO: 244294 - DNA, 25 bp, Rattus norvegicus
ccacttaatgctccgggcacggcgg

SEQ ID NO: 244295 - DNA, 25 bp, Rattus norvegicus
ccacttaatgctgcgggcacggcgg

SEQ ID NO: 244296 - DNA, 25 bp, Rattus norvegicus
ccacttaatgtaagtcaccagaaga

SEQ ID NO: 244297 - DNA, 25 bp, Rattus norvegicus
ccacttaatgtatgtcaccagaaga

SEQ ID NO: 244298 - DNA, 25 bp, Rattus norvegicus
ccacttagctggctctctgaagata

SEQ ID NO: 244299 - DNA, 25 bp, Rattus norvegicus
ccacttagctgggtctctgaagata

SEQ ID NO: 244300 - DNA, 25 bp, Rattus norvegicus
ccacttatctttagccagtctacaa

SEQ ID NO: 244301 - DNA, 25 bp, Rattus norvegicus
ccacttatcttttgccagtctacaa

SEQ ID NO: 244302 - DNA, 25 bp, Rattus norvegicus
ccacttcaatgtccacctgtataaa

SEQ ID NO: 244303 - DNA, 25 bp, Rattus norvegicus
ccacttcaatgtgcacctgtataaa

SEQ ID NO: 244304 - DNA, 25 bp, Rattus norvegicus
ccacttcaggctctttgacgagaac

SEQ ID NO: 244305 - DNA, 25 bp, Rattus norvegicus
ccacttcaggctgtttgacgagaac

SEQ ID NO: 244306 - DNA, 25 bp, Rattus norvegicus
ccacttccagttcttatgagcctac

SEQ ID NO: 244307 - DNA, 25 bp, Rattus norvegicus
ccacttccagttgttatgagcctac

SEQ ID NO: 244308 - DNA, 25 bp, Rattus norvegicus
ccacttcccaggaccatgaggagat

SEQ ID NO: 244309 - DNA, 25 bp, Rattus norvegicus
ccacttcccaggtccatgaggagat

SEQ ID NO: 244310 - DNA, 25 bp, Rattus norvegicus
ccacttcctaggctgacttacagaa

SEQ ID NO: 244311 - DNA, 25 bp, Rattus norvegicus
ccacttcctagggtgacttacagaa

SEQ ID NO: 244312 - DNA, 25 bp, Rattus norvegicus
ccacttccttatcctgagggtatca

SEQ ID NO: 244313 - DNA, 25 bp, Rattus norvegicus
ccacttccttatgctgagggtatca

SEQ ID NO: 244314 - DNA, 25 bp, Rattus norvegicus
ccacttcgtgatcggttgcagtcaa

SEQ ID NO: 244315 - DNA, 25 bp, Rattus norvegicus
ccacttcgtgatgggttgcagtcaa

SEQ ID NO: 244316 - DNA, 25 bp, Rattus norvegicus
ccacttctgcttctgactagttcta

SEQ ID NO: 244317 - DNA, 25 bp, Rattus norvegicus
ccacttctgcttgtgactagttcta

SEQ ID NO: 244318 - DNA, 25 bp, Rattus norvegicus
ccacttctggttatcctctgaaata

SEQ ID NO: 244319 - DNA, 25 bp, Rattus norvegicus
ccacttctggttttcctctgaaata

SEQ ID NO: 244320 - DNA, 25 bp, Rattus norvegicus
ccacttcttcctctttgctgtatga

SEQ ID NO: 244321 - DNA, 25 bp, Rattus norvegicus
ccacttcttcctgtttgctgtatga

SEQ ID NO: 244322 - DNA, 25 bp, Rattus norvegicus
ccacttgaatggctctctctttaga

SEQ ID NO: 244323 - DNA, 25 bp, Rattus norvegicus
ccacttgaatgggtctctctttaga

SEQ ID NO: 244324 - DNA, 25 bp, Rattus norvegicus
ccacttgaccctcctgtgaggacaa

SEQ ID NO: 244325 - DNA, 25 bp, Rattus norvegicus
ccacttgaccctgctgtgaggacaa

SEQ ID NO: 244326 - DNA, 25 bp, Rattus norvegicus
ccacttgactctatcctaaaacact

SEQ ID NO: 244327 - DNA, 25 bp, Rattus norvegicus
ccacttgactctttcctaaaacact

SEQ ID NO: 244328 - DNA, 25 bp, Rattus norvegicus
ccacttgagtgtatactccctaaca

SEQ ID NO: 244329 - DNA, 25 bp, Rattus norvegicus
ccacttgagtgtttactccctaaca

SEQ ID NO: 244330 - DNA, 25 bp, Rattus norvegicus
ccacttgatgtcacccaacatggga

SEQ ID NO: 244331 - DNA, 25 bp, Rattus norvegicus
ccacttgatgtctcccaacatggga

SEQ ID NO: 244332 - DNA, 25 bp, Rattus norvegicus
ccacttgattgacggatctcgacca

SEQ ID NO: 244333 - DNA, 25 bp, Rattus norvegicus
ccacttgattgagggatctcgacca

SEQ ID NO: 244334 - DNA, 25 bp, Rattus norvegicus
ccacttgcagacattaatcctagtt

SEQ ID NO: 244335 - DNA, 25 bp, Rattus norvegicus
ccacttgcagactttaatcctagtt

SEQ ID NO: 244336 - DNA, 25 bp, Rattus norvegicus
ccacttggccacatttgctttaagc

SEQ ID NO: 244337 - DNA, 25 bp, Rattus norvegicus
ccacttggccacttttgctttaagc

SEQ ID NO: 244338 - DNA, 25 bp, Rattus norvegicus
ccacttggcgaccttcagggtagaa

SEQ ID NO: 244339 - DNA, 25 bp, Rattus norvegicus
ccacttggcgacgttcagggtagaa

SEQ ID NO: 244340 - DNA, 25 bp, Rattus norvegicus
ccacttgggctgattctaggatcac

SEQ ID NO: 244341 - DNA, 25 bp, Rattus norvegicus
ccacttgggctgtttctaggatcac

SEQ ID NO: 244342 - DNA, 25 bp, Rattus norvegicus
ccacttgtacccatagctcaggaga

SEQ ID NO: 244343 - DNA, 25 bp, Rattus norvegicus
ccacttgtacccttagctcaggaga

SEQ ID NO: 244344 - DNA, 25 bp, Rattus norvegicus
ccacttgtctagaccaaggcttgtt

SEQ ID NO: 244345 - DNA, 25 bp, Rattus norvegicus
ccacttgtctagtccaaggcttgtt

SEQ ID NO: 244346 - DNA, 25 bp, Rattus norvegicus
ccacttgtgcaaaaagaggtcttcg

SEQ ID NO: 244347 - DNA, 25 bp, Rattus norvegicus
ccacttgtgcaataagaggtcttcg

SEQ ID NO: 244348 - DNA, 25 bp, Rattus norvegicus
ccacttgtgtggctgctgaattaca

SEQ ID NO: 244349 - DNA, 25 bp, Rattus norvegicus
ccacttgtgtgggtgctgaattaca

SEQ ID NO: 244350 - DNA, 25 bp, Rattus norvegicus
ccactttccaatatctctgacagaa

SEQ ID NO: 244351 - DNA, 25 bp, Rattus norvegicus
ccactttccaatttctctgacagaa

SEQ ID NO: 244352 - DNA, 25 bp, Rattus norvegicus
ccactttccatccaaggccaaagag

SEQ ID NO: 244353 - DNA, 25 bp, Rattus norvegicus
ccactttccatcgaaggccaaagag

SEQ ID NO: 244354 - DNA, 25 bp, Rattus norvegicus
ccactttcctgccttaagattctaa

SEQ ID NO: 244355 - DNA, 25 bp, Rattus norvegicus
ccactttcctgcgttaagattctaa

SEQ ID NO: 244356 - DNA, 25 bp, Rattus norvegicus
ccactttctcttcacgataggcttt

SEQ ID NO: 244357 - DNA, 25 bp, Rattus norvegicus
ccactttctcttgacgataggcttt

SEQ ID NO: 244358 - DNA, 25 bp, Rattus norvegicus
ccactttgcccaacagggttgagga

SEQ ID NO: 244359 - DNA, 25 bp, Rattus norvegicus
ccactttgcccatcagggttgagga

SEQ ID NO: 244360 - DNA, 25 bp, Rattus norvegicus
ccactttggtttatcgtatatctgt

SEQ ID NO: 244361 - DNA, 25 bp, Rattus norvegicus
ccactttggtttttcgtatatctgt

SEQ ID NO: 244362 - DNA, 25 bp, Rattus norvegicus
ccacttttgaaaagcttgtcactgt

SEQ ID NO: 244363 - DNA, 25 bp, Rattus norvegicus
ccacttttgaaatgcttgtcactgt

SEQ ID NO: 244364 - DNA, 25 bp, Rattus norvegicus
ccacttttgactctgtgatgacccc

SEQ ID NO: 244365 - DNA, 25 bp, Rattus norvegicus
ccacttttgactgtgtgatgacccc

SEQ ID NO: 244366 - DNA, 25 bp, Rattus norvegicus
ccacttttgctcaggtttcgttgga

SEQ ID NO: 244367 - DNA, 25 bp, Rattus norvegicus
ccacttttgctctggtttcgttgga

SEQ ID NO: 244368 - DNA, 25 bp, Rattus norvegicus
ccacttttggccacgggattcagac

SEQ ID NO: 244369 - DNA, 25 bp, Rattus norvegicus
ccacttttggcctcgggattcagac

SEQ ID NO: 244370 - DNA, 25 bp, Rattus norvegicus
ccactttttaggcaggcaccaagga

SEQ ID NO: 244371 - DNA, 25 bp, Rattus norvegicus
ccactttttagggaggcaccaagga

SEQ ID NO: 244372 - DNA, 25 bp, Rattus norvegicus
ccagaaacaatgaccacttcaggct

SEQ ID NO: 244373 - DNA, 25 bp, Rattus norvegicus
ccagaaacaatgtccacttcaggct

SEQ ID NO: 244374 - DNA, 25 bp, Rattus norvegicus
ccagaaaggaagacatcactgcccc

SEQ ID NO: 244375 - DNA, 25 bp, Rattus norvegicus
ccagaaaggaagtcatcactgcccc

SEQ ID NO: 244376 - DNA, 25 bp, Rattus norvegicus
ccagaaaggagcatcagtgttcttg

SEQ ID NO: 244377 - DNA, 25 bp, Rattus norvegicus
ccagaaaggagcttcagtgttcttg

SEQ ID NO: 244378 - DNA, 25 bp, Rattus norvegicus
ccagaaatatttcgttgacttcaac

SEQ ID NO: 244379 - DNA, 25 bp, Rattus norvegicus
ccagaaatatttggttgacttcaac

SEQ ID NO: 244380 - DNA, 25 bp, Rattus norvegicus
ccagaaatggtgcttgcccctgtaa

SEQ ID NO: 244381 - DNA, 25 bp, Rattus norvegicus
ccagaaatggtggttgcccctgtaa

SEQ ID NO: 244382 - DNA, 25 bp, Rattus norvegicus
ccagaacactctctggtcaccaaag

SEQ ID NO: 244383 - DNA, 25 bp, Rattus norvegicus
ccagaacactctgtggtcaccaaag

SEQ ID NO: 244384 - DNA, 25 bp, Rattus norvegicus
ccagaacatgccatcagactgtggg

SEQ ID NO: 244385 - DNA, 25 bp, Rattus norvegicus
ccagaacatgccttcagactgtggg

SEQ ID NO: 244386 - DNA, 25 bp, Rattus norvegicus
ccagaacccatgaaagggttggaga

SEQ ID NO: 244387 - DNA, 25 bp, Rattus norvegicus
ccagaacccatgtaagggttggaga

SEQ ID NO: 244388 - DNA, 25 bp, Rattus norvegicus
ccagaaccgtgcactgtggtgcagc

SEQ ID NO: 244389 - DNA, 25 bp, Rattus norvegicus
ccagaaccgtgctctgtggtgcagc

SEQ ID NO: 244390 - DNA, 25 bp, Rattus norvegicus
ccagaacgaggtcccttggaatttg

SEQ ID NO: 244391 - DNA, 25 bp, Rattus norvegicus
ccagaacgaggtgccttggaatttg

SEQ ID NO: 244392 - DNA, 25 bp, Rattus norvegicus
ccagaactgggactgtctagcgaca

SEQ ID NO: 244393 - DNA, 25 bp, Rattus norvegicus
ccagaactgggagtgtctagcgaca

SEQ ID NO: 244394 - DNA, 25 bp, Rattus norvegicus
ccagaactgtgtagaacccatctca

SEQ ID NO: 244395 - DNA, 25 bp, Rattus norvegicus
ccagaactgtgtagagccagggcct

SEQ ID NO: 244396 - DNA, 25 bp, Rattus norvegicus
ccagaactgtgttgaacccatctca

SEQ ID NO: 244397 - DNA, 25 bp, Rattus norvegicus
ccagaactgtgttgagccagggcct

SEQ ID NO: 244398 - DNA, 25 bp, Rattus norvegicus
ccagaacttgcaatccgggaagctg

SEQ ID NO: 244399 - DNA, 25 bp, Rattus norvegicus
ccagaacttgcattccgggaagctg

SEQ ID NO: 244400 - DNA, 25 bp, Rattus norvegicus
ccagaagactttcactacgtagact

SEQ ID NO: 244401 - DNA, 25 bp, Rattus norvegicus
ccagaagactttgactacgtagact

SEQ ID NO: 244402 - DNA, 25 bp, Rattus norvegicus
ccagaagagactattgaaagatgat

SEQ ID NO: 244403 - DNA, 25 bp, Rattus norvegicus
ccagaagagacttttgaaagatgat

SEQ ID NO: 244404 - DNA, 25 bp, Rattus norvegicus
ccagaagatttcagtatagccgata

SEQ ID NO: 244405 - DNA, 25 bp, Rattus norvegicus
ccagaagatttctgtatagccgata

SEQ ID NO: 244406 - DNA, 25 bp, Rattus norvegicus
ccagaagccgcaccacgagagggca

SEQ ID NO: 244407 - DNA, 25 bp, Rattus norvegicus
ccagaagccgcagcacgagagggca

SEQ ID NO: 244408 - DNA, 25 bp, Rattus norvegicus
ccagaagctggtatggtaagcacaa

SEQ ID NO: 244409 - DNA, 25 bp, Rattus norvegicus
ccagaagctggtttggtaagcacaa

SEQ ID NO: 244410 - DNA, 25 bp, Rattus norvegicus
ccagaaggaaggacgggctcatttg

SEQ ID NO: 244411 - DNA, 25 bp, Rattus norvegicus
ccagaaggaaggtcgggctcatttg

SEQ ID NO: 244412 - DNA, 25 bp, Rattus norvegicus
ccagaaggatgccgcagaccattat

SEQ ID NO: 244413 - DNA, 25 bp, Rattus norvegicus
ccagaaggatgcggcagaccattat

SEQ ID NO: 244414 - DNA, 25 bp, Rattus norvegicus
ccagaaggccctacatactcaagag

SEQ ID NO: 244415 - DNA, 25 bp, Rattus norvegicus
ccagaaggcccttcatactcaagag

SEQ ID NO: 244416 - DNA, 25 bp, Rattus norvegicus
ccagaaggcctaagcgtacgcggat

SEQ ID NO: 244417 - DNA, 25 bp, Rattus norvegicus
ccagaaggcctatgcgtacgcggat

SEQ ID NO: 244418 - DNA, 25 bp, Rattus norvegicus
ccagaaggtcttcggcgcgcatttg

SEQ ID NO: 244419 - DNA, 25 bp, Rattus norvegicus
ccagaaggtcttgggcgcgcatttg

SEQ ID NO: 244420 - DNA, 25 bp, Rattus norvegicus
ccagaaggtgggagtgttatgctac

SEQ ID NO: 244421 - DNA, 25 bp, Rattus norvegicus
ccagaaggtgggtgtgttatgctac

SEQ ID NO: 244422 - DNA, 25 bp, Rattus norvegicus
ccagaagtcaatccaagaagtgctt

SEQ ID NO: 244423 - DNA, 25 bp, Rattus norvegicus
ccagaagtcaatcgaagacgttcgt

SEQ ID NO: 244424 - DNA, 25 bp, Rattus norvegicus
ccagaagtcaatgcaagaagtgctt

SEQ ID NO: 244425 - DNA, 25 bp, Rattus norvegicus
ccagaagtcaatggaagacgttcgt

SEQ ID NO: 244426 - DNA, 25 bp, Rattus norvegicus
ccagaagttgtgaaggcatctccaa

SEQ ID NO: 244427 - DNA, 25 bp, Rattus norvegicus
ccagaagttgtgtaggcatctccaa

SEQ ID NO: 244428 - DNA, 25 bp, Rattus norvegicus
ccagaagtttagatttaccaagcac

SEQ ID NO: 244429 - DNA, 25 bp, Rattus norvegicus
ccagaagtttagttttaccaagcac

SEQ ID NO: 244430 - DNA, 25 bp, Rattus norvegicus
ccagaatattcaataggccccacag

SEQ ID NO: 244431 - DNA, 25 bp, Rattus norvegicus
ccagaatattcattaggccccacag

SEQ ID NO: 244432 - DNA, 25 bp, Rattus norvegicus
ccagaatcctatccatattgtccag

SEQ ID NO: 244433 - DNA, 25 bp, Rattus norvegicus
ccagaatcctatgcatattgtccag

SEQ ID NO: 244434 - DNA, 25 bp, Rattus norvegicus
ccagaatctggacggagttgtcaat

SEQ ID NO: 244435 - DNA, 25 bp, Rattus norvegicus
ccagaatctggagggagttgtcaat

SEQ ID NO: 244436 - DNA, 25 bp, Rattus norvegicus
ccagaatgtgctcacttatttattt

SEQ ID NO: 244437 - DNA, 25 bp, Rattus norvegicus
ccagaatgtgctgacttatttattt

SEQ ID NO: 244438 - DNA, 25 bp, Rattus norvegicus
ccagaatttatcaagtgctgaggtt

SEQ ID NO: 244439 - DNA, 25 bp, Rattus norvegicus
ccagaatttatctagtgctgaggtt

SEQ ID NO: 244440 - DNA, 25 bp, Rattus norvegicus
ccagaatttcaaccaggcggccggg

SEQ ID NO: 244441 - DNA, 25 bp, Rattus norvegicus
ccagaatttcaagcaggcggccggg

SEQ ID NO: 244442 - DNA, 25 bp, Rattus norvegicus
ccagaatttcttcgtcatttttcca

SEQ ID NO: 244443 - DNA, 25 bp, Rattus norvegicus
ccagaatttcttggtcatttttcca

SEQ ID NO: 244444 - DNA, 25 bp, Rattus norvegicus
ccagacaaactgcaagaggttgagc

SEQ ID NO: 244445 - DNA, 25 bp, Rattus norvegicus
ccagacaaactggaagaggttgagc

SEQ ID NO: 244446 - DNA, 25 bp, Rattus norvegicus
ccagacactccaaacattcacttaa

SEQ ID NO: 244447 - DNA, 25 bp, Rattus norvegicus
ccagacactccatacattcacttaa

SEQ ID NO: 244448 - DNA, 25 bp, Rattus norvegicus
ccagacagttgtaccagctatgaga

SEQ ID NO: 244449 - DNA, 25 bp, Rattus norvegicus
ccagacagttgttccagctatgaga

SEQ ID NO: 244450 - DNA, 25 bp, Rattus norvegicus
ccagaccaggctaactgggccagtt

SEQ ID NO: 244451 - DNA, 25 bp, Rattus norvegicus
ccagaccaggcttactgggccagtt

SEQ ID NO: 244452 - DNA, 25 bp, Rattus norvegicus
ccagaccagtccatcctggaaaaga

SEQ ID NO: 244453 - DNA, 25 bp, Rattus norvegicus
ccagaccagtccttcctggaaaaga

SEQ ID NO: 244454 - DNA, 25 bp, Rattus norvegicus
ccagaccccacacggcggaagaagg

SEQ ID NO: 244455 - DNA, 25 bp, Rattus norvegicus
ccagaccccacagggcggaagaagg

SEQ ID NO: 244456 - DNA, 25 bp, Rattus norvegicus
ccagacccgggaatttgacggcact

SEQ ID NO: 244457 - DNA, 25 bp, Rattus norvegicus
ccagacccgggattttgacggcact

SEQ ID NO: 244458 - DNA, 25 bp, Rattus norvegicus
ccagaccgccttattctcttcataa

SEQ ID NO: 244459 - DNA, 25 bp, Rattus norvegicus
ccagaccgcctttttctcttcataa

SEQ ID NO: 244460 - DNA, 25 bp, Rattus norvegicus
ccagacctccatacagtatagactt

SEQ ID NO: 244461 - DNA, 25 bp, Rattus norvegicus
ccagacctccattcagtatagactt

SEQ ID NO: 244462 - DNA, 25 bp, Rattus norvegicus
ccagacctctggcagtaattgtgtt

SEQ ID NO: 244463 - DNA, 25 bp, Rattus norvegicus
ccagacctctgggagtaattgtgtt

SEQ ID NO: 244464 - DNA, 25 bp, Rattus norvegicus
ccagacgaatatcagttaccctgct

SEQ ID NO: 244465 - DNA, 25 bp, Rattus norvegicus
ccagacgaatatgagttaccctgct

SEQ ID NO: 244466 - DNA, 25 bp, Rattus norvegicus
ccagacgccggcagcagaaaggaga

SEQ ID NO: 244467 - DNA, 25 bp, Rattus norvegicus
ccagacgccggctgcagaaaggaga

SEQ ID NO: 244468 - DNA, 25 bp, Rattus norvegicus
ccagacgtagtgacacagtcctgta

SEQ ID NO: 244469 - DNA, 25 bp, Rattus norvegicus
ccagacgtagtgtcacagtcctgta

SEQ ID NO: 244470 - DNA, 25 bp, Rattus norvegicus
ccagactcaagccaagtttgcctta

SEQ ID NO: 244471 - DNA, 25 bp, Rattus norvegicus
ccagactcaagcgaagtttgcctta

SEQ ID NO: 244472 - DNA, 25 bp, Rattus norvegicus
ccagactcccaacgaatcaggtgat

SEQ ID NO: 244473 - DNA, 25 bp, Rattus norvegicus
ccagactcccaaggaatcaggtgat

SEQ ID NO: 244474 - DNA, 25 bp, Rattus norvegicus
ccagactcgccaattgaataccatt

SEQ ID NO: 244475 - DNA, 25 bp, Rattus norvegicus
ccagactcgccatttgaataccatt

SEQ ID NO: 244476 - DNA, 25 bp, Rattus norvegicus
ccagactgctagagtattccttact

SEQ ID NO: 244477 - DNA, 25 bp, Rattus norvegicus
ccagactgctagtgtattccttact

SEQ ID NO: 244478 - DNA, 25 bp, Rattus norvegicus
ccagactggacaatctgccttgatt

SEQ ID NO: 244479 - DNA, 25 bp, Rattus norvegicus
ccagactggacattctgccttgatt

SEQ ID NO: 244480 - DNA, 25 bp, Rattus norvegicus
ccagactgtccgattcaagggtgag

SEQ ID NO: 244481 - DNA, 25 bp, Rattus norvegicus
ccagactgtccgtttcaagggtgag

SEQ ID NO: 244482 - DNA, 25 bp, Rattus norvegicus
ccagactgtgtacggcgttcagcca

SEQ ID NO: 244483 - DNA, 25 bp, Rattus norvegicus
ccagactgtgtagggcgttcagcca

SEQ ID NO: 244484 - DNA, 25 bp, Rattus norvegicus
ccagacttacctcgtgtcagaacgc

SEQ ID NO: 244485 - DNA, 25 bp, Rattus norvegicus
ccagacttacctggtgtcagaacgc

SEQ ID NO: 244486 - DNA, 25 bp, Rattus norvegicus
ccagacttgctgctaatggagctca

SEQ ID NO: 244487 - DNA, 25 bp, Rattus norvegicus
ccagacttgctggtaatggagctca

SEQ ID NO: 244488 - DNA, 25 bp, Rattus norvegicus
ccagacttgtttccatcctcataaa

SEQ ID NO: 244489 - DNA, 25 bp, Rattus norvegicus
ccagacttgtttgcatcctcataaa

SEQ ID NO: 244490 - DNA, 25 bp, Rattus norvegicus
ccagactttagtaccatcccaggct

SEQ ID NO: 244491 - DNA, 25 bp, Rattus norvegicus
ccagactttagttccatcccaggct

SEQ ID NO: 244492 - DNA, 25 bp, Rattus norvegicus
ccagagaatggcatggtagcgtaca

SEQ ID NO: 244493 - DNA, 25 bp, Rattus norvegicus
ccagagaatggcttggtagcgtaca

SEQ ID NO: 244494 - DNA, 25 bp, Rattus norvegicus
ccagagacctgtcgtggttcagcca

SEQ ID NO: 244495 - DNA, 25 bp, Rattus norvegicus
ccagagacctgtggtggttcagcca

SEQ ID NO: 244496 - DNA, 25 bp, Rattus norvegicus
ccagagacggccacgaggagagaaa

SEQ ID NO: 244497 - DNA, 25 bp, Rattus norvegicus
ccagagacggcctcgaggagagaaa

SEQ ID NO: 244498 - DNA, 25 bp, Rattus norvegicus
ccagagacttgcagtgtctgtgcat

SEQ ID NO: 244499 - DNA, 25 bp, Rattus norvegicus
ccagagacttgctgtgtctgtgcat

SEQ ID NO: 244500 - DNA, 25 bp, Rattus norvegicus
ccagagagctgaagattttgtcttg

SEQ ID NO: 244501 - DNA, 25 bp, Rattus norvegicus
ccagagagctgatgattttgtcttg

SEQ ID NO: 244502 - DNA, 25 bp, Rattus norvegicus
ccagagagctgtaacttctgagcct

SEQ ID NO: 244503 - DNA, 25 bp, Rattus norvegicus
ccagagagctgttacttctgagcct

SEQ ID NO: 244504 - DNA, 25 bp, Rattus norvegicus
ccagagaggctgagtggatcttcga

SEQ ID NO: 244505 - DNA, 25 bp, Rattus norvegicus
ccagagaggctgtgtggatcttcga

SEQ ID NO: 244506 - DNA, 25 bp, Rattus norvegicus
ccagagagggtgacggatcccctag

SEQ ID NO: 244507 - DNA, 25 bp, Rattus norvegicus
ccagagagggtgtcggatcccctag

SEQ ID NO: 244508 - DNA, 25 bp, Rattus norvegicus
ccagagagtggtacagatcgctgta

SEQ ID NO: 244509 - DNA, 25 bp, Rattus norvegicus
ccagagagtggttcagatcgctgta

SEQ ID NO: 244510 - DNA, 25 bp, Rattus norvegicus
ccagagatagatccttagggcctta

SEQ ID NO: 244511 - DNA, 25 bp, Rattus norvegicus
ccagagatagatgcttagggcctta

SEQ ID NO: 244512 - DNA, 25 bp, Rattus norvegicus
ccagagatgatacccaggagccatg

SEQ ID NO: 244513 - DNA, 25 bp, Rattus norvegicus
ccagagatgatagccaggagccatg

SEQ ID NO: 244514 - DNA, 25 bp, Rattus norvegicus
ccagagatgctcagcaagggtttaa

SEQ ID NO: 244515 - DNA, 25 bp, Rattus norvegicus
ccagagatgctctgcaagggtttaa

SEQ ID NO: 244516 - DNA, 25 bp, Rattus norvegicus
ccagagatgctgctcacaccagaag

SEQ ID NO: 244517 - DNA, 25 bp, Rattus norvegicus
ccagagatgctggtcacaccagaag

SEQ ID NO: 244518 - DNA, 25 bp, Rattus norvegicus
ccagagcaagttatccccgtcaatg

SEQ ID NO: 244519 - DNA, 25 bp, Rattus norvegicus
ccagagcaagttctttggtgcgaat

SEQ ID NO: 244520 - DNA, 25 bp, Rattus norvegicus
ccagagcaagttgtttggtgcgaat

SEQ ID NO: 244521 - DNA, 25 bp, Rattus norvegicus
ccagagcaagttttccccgtcaatg

SEQ ID NO: 244522 - DNA, 25 bp, Rattus norvegicus
ccagagcacaggatcaagggccgaa

SEQ ID NO: 244523 - DNA, 25 bp, Rattus norvegicus
ccagagcacaggttcaagggccgaa

SEQ ID NO: 244524 - DNA, 25 bp, Rattus norvegicus
ccagagccatgcagaaagttttctt

SEQ ID NO: 244525 - DNA, 25 bp, Rattus norvegicus
ccagagccatgctgaaagttttctt

SEQ ID NO: 244526 - DNA, 25 bp, Rattus norvegicus
ccagagccccgtacttgtgaatgtt

SEQ ID NO: 244527 - DNA, 25 bp, Rattus norvegicus
ccagagccccgttcttgtgaatgtt

SEQ ID NO: 244528 - DNA, 25 bp, Rattus norvegicus
ccagagcccgtgagcttgtggaaag

SEQ ID NO: 244529 - DNA, 25 bp, Rattus norvegicus
ccagagcccgtgtgcttgtggaaag

SEQ ID NO: 244530 - DNA, 25 bp, Rattus norvegicus
ccagagccctttattcttgttgaga

SEQ ID NO: 244531 - DNA, 25 bp, Rattus norvegicus
ccagagcccttttttcttgttgaga

SEQ ID NO: 244532 - DNA, 25 bp, Rattus norvegicus
ccagagccttgaccttgcatagaat

SEQ ID NO: 244533 - DNA, 25 bp, Rattus norvegicus
ccagagccttgagcttgcatagaat

SEQ ID NO: 244534 - DNA, 25 bp, Rattus norvegicus
ccagagcgaattacctctcacagta

SEQ ID NO: 244535 - DNA, 25 bp, Rattus norvegicus
ccagagcgaatttcctctcacagta

SEQ ID NO: 244536 - DNA, 25 bp, Rattus norvegicus
ccagagctactgcaaacttctagaa

SEQ ID NO: 244537 - DNA, 25 bp, Rattus norvegicus
ccagagctactggaaacttctagaa

SEQ ID NO: 244538 - DNA, 25 bp, Rattus norvegicus
ccagagctcacaacggtgggatggt

SEQ ID NO: 244539 - DNA, 25 bp, Rattus norvegicus
ccagagctcacatcggtgggatggt

SEQ ID NO: 244540 - DNA, 25 bp, Rattus norvegicus
ccagaggactggaattcaatttcca

SEQ ID NO: 244541 - DNA, 25 bp, Rattus norvegicus
ccagaggactggtattcaatttcca

SEQ ID NO: 244542 - DNA, 25 bp, Rattus norvegicus
ccagaggagcctaacgtaacgtatt

SEQ ID NO: 244543 - DNA, 25 bp, Rattus norvegicus
ccagaggagccttacgtaacgtatt

SEQ ID NO: 244544 - DNA, 25 bp, Rattus norvegicus
ccagaggagtttcccgggcattact

SEQ ID NO: 244545 - DNA, 25 bp, Rattus norvegicus
ccagaggagtttgccgggcattact

SEQ ID NO: 244546 - DNA, 25 bp, Rattus norvegicus
ccagaggcctctcctgttagtggct

SEQ ID NO: 244547 - DNA, 25 bp, Rattus norvegicus
ccagaggcctctgctgttagtggct

SEQ ID NO: 244548 - DNA, 25 bp, Rattus norvegicus
ccagaggcctttatgtgctacacat

SEQ ID NO: 244549 - DNA, 25 bp, Rattus norvegicus
ccagaggcctttttgtgctacacat

SEQ ID NO: 244550 - DNA, 25 bp, Rattus norvegicus
ccagaggctgacactctacaagaga

SEQ ID NO: 244551 - DNA, 25 bp, Rattus norvegicus
ccagaggctgactctctacaagaga

SEQ ID NO: 244552 - DNA, 25 bp, Rattus norvegicus
ccagagggaaccaggcgctaggtcc

SEQ ID NO: 244553 - DNA, 25 bp, Rattus norvegicus
ccagagggaacctggcgctaggtcc

SEQ ID NO: 244554 - DNA, 25 bp, Rattus norvegicus
ccagagggaccacgagagctgtgtt

SEQ ID NO: 244555 - DNA, 25 bp, Rattus norvegicus
ccagagggaccaggagagctgtgtt

SEQ ID NO: 244556 - DNA, 25 bp, Rattus norvegicus
ccagagggagctaacagaagcgttt

SEQ ID NO: 244557 - DNA, 25 bp, Rattus norvegicus
ccagagggagcttacagaagcgttt

SEQ ID NO: 244558 - DNA, 25 bp, Rattus norvegicus
ccagagggcctcaaatagctgagaa

SEQ ID NO: 244559 - DNA, 25 bp, Rattus norvegicus
ccagagggcctctaatagctgagaa

SEQ ID NO: 244560 - DNA, 25 bp, Rattus norvegicus
ccagagggcgttagtggccttgtat

SEQ ID NO: 244561 - DNA, 25 bp, Rattus norvegicus
ccagagggcgtttgtggccttgtat

SEQ ID NO: 244562 - DNA, 25 bp, Rattus norvegicus
ccagagggctgtccaggacctgcct

SEQ ID NO: 244563 - DNA, 25 bp, Rattus norvegicus
ccagagggctgtgcaggacctgcct

SEQ ID NO: 244564 - DNA, 25 bp, Rattus norvegicus
ccagagggtccacaccggacagaga

SEQ ID NO: 244565 - DNA, 25 bp, Rattus norvegicus
ccagagggtccagaccggacagaga

SEQ ID NO: 244566 - DNA, 25 bp, Rattus norvegicus
ccagagggtgatctggtctatatct

SEQ ID NO: 244567 - DNA, 25 bp, Rattus norvegicus
ccagagggtgatgtggtctatatct

SEQ ID NO: 244568 - DNA, 25 bp, Rattus norvegicus
ccagaggtctgtcactaatgaagaa

SEQ ID NO: 244569 - DNA, 25 bp, Rattus norvegicus
ccagaggtctgtgactaatgaagaa

SEQ ID NO: 244570 - DNA, 25 bp, Rattus norvegicus
ccagaggtgctgcacatcacagagc

SEQ ID NO: 244571 - DNA, 25 bp, Rattus norvegicus
ccagaggtgctgctttcttcttgat

SEQ ID NO: 244572 - DNA, 25 bp, Rattus norvegicus
ccagaggtgctggacatcacagagc

SEQ ID NO: 244573 - DNA, 25 bp, Rattus norvegicus
ccagaggtgctggtttcttcttgat

SEQ ID NO: 244574 - DNA, 25 bp, Rattus norvegicus
ccagagtacaatattttcccgtgaa

SEQ ID NO: 244575 - DNA, 25 bp, Rattus norvegicus
ccagagtacaattttttcccgtgaa

SEQ ID NO: 244576 - DNA, 25 bp, Rattus norvegicus
ccagagtagaggcatttgtcacaag

SEQ ID NO: 244577 - DNA, 25 bp, Rattus norvegicus
ccagagtagagggatttgtcacaag

SEQ ID NO: 244578 - DNA, 25 bp, Rattus norvegicus
ccagagtatcctccccttgggagtc

SEQ ID NO: 244579 - DNA, 25 bp, Rattus norvegicus
ccagagtatcctgcccttgggagtc

SEQ ID NO: 244580 - DNA, 25 bp, Rattus norvegicus
ccagagtatgcccactgggtatcat

SEQ ID NO: 244581 - DNA, 25 bp, Rattus norvegicus
ccagagtatgccgactgggtatcat

SEQ ID NO: 244582 - DNA, 25 bp, Rattus norvegicus
ccagagtcgttcaccacagaggctt

SEQ ID NO: 244583 - DNA, 25 bp, Rattus norvegicus
ccagagtcgttctccacagaggctt

SEQ ID NO: 244584 - DNA, 25 bp, Rattus norvegicus
ccagagtctctcagtacaatgttta

SEQ ID NO: 244585 - DNA, 25 bp, Rattus norvegicus
ccagagtctctctgtacaatgttta

SEQ ID NO: 244586 - DNA, 25 bp, Rattus norvegicus
ccagagtctgctatggagttcgcca

SEQ ID NO: 244587 - DNA, 25 bp, Rattus norvegicus
ccagagtctgctttggagttcgcca

SEQ ID NO: 244588 - DNA, 25 bp, Rattus norvegicus
ccagagtgagggagcttgaaaacga

SEQ ID NO: 244589 - DNA, 25 bp, Rattus norvegicus
ccagagtgagggtgcttgaaaacga

SEQ ID NO: 244590 - DNA, 25 bp, Rattus norvegicus
ccagagtggacacgacttccttaat

SEQ ID NO: 244591 - DNA, 25 bp, Rattus norvegicus
ccagagtggacaggacttccttaat

SEQ ID NO: 244592 - DNA, 25 bp, Rattus norvegicus
ccagagtgggaaacttctttgtcaa

SEQ ID NO: 244593 - DNA, 25 bp, Rattus norvegicus
ccagagtgggaatcttctttgtcaa

SEQ ID NO: 244594 - DNA, 25 bp, Rattus norvegicus
ccagagtgggcgactggctgatctc

SEQ ID NO: 244595 - DNA, 25 bp, Rattus norvegicus
ccagagtgggcgtctggctgatctc

SEQ ID NO: 244596 - DNA, 25 bp, Rattus norvegicus
ccagagtggtttaggcccattcaaa

SEQ ID NO: 244597 - DNA, 25 bp, Rattus norvegicus
ccagagtggttttggcccattcaaa

SEQ ID NO: 244598 - DNA, 25 bp, Rattus norvegicus
ccagagtgttgaaaaggtcccttcc

SEQ ID NO: 244599 - DNA, 25 bp, Rattus norvegicus
ccagagtgttgataaggtcccttcc

SEQ ID NO: 244600 - DNA, 25 bp, Rattus norvegicus
ccagagttccacagtggcgtggagt

SEQ ID NO: 244601 - DNA, 25 bp, Rattus norvegicus
ccagagttccactgtggcgtggagt

SEQ ID NO: 244602 - DNA, 25 bp, Rattus norvegicus
ccagagttctcacggttgcattaaa

SEQ ID NO: 244603 - DNA, 25 bp, Rattus norvegicus
ccagagttctcagggttgcattaaa

SEQ ID NO: 244604 - DNA, 25 bp, Rattus norvegicus
ccagagtttctgagtgccttgttat

SEQ ID NO: 244605 - DNA, 25 bp, Rattus norvegicus
ccagagtttctgtgtgccttgttat

SEQ ID NO: 244606 - DNA, 25 bp, Rattus norvegicus
ccagataattggactctattgctcc

SEQ ID NO: 244607 - DNA, 25 bp, Rattus norvegicus
ccagataattggtctctattgctcc

SEQ ID NO: 244608 - DNA, 25 bp, Rattus norvegicus
ccagataccatcctagcacttaaag

SEQ ID NO: 244609 - DNA, 25 bp, Rattus norvegicus
ccagataccatcgtagcacttaaag

SEQ ID NO: 244610 - DNA, 25 bp, Rattus norvegicus
ccagatactattaaggccaggtgat

SEQ ID NO: 244611 - DNA, 25 bp, Rattus norvegicus
ccagatactatttaggccaggtgat

SEQ ID NO: 244612 - DNA, 25 bp, Rattus norvegicus
ccagatagcattagccaccctcggg

SEQ ID NO: 244613 - DNA, 25 bp, Rattus norvegicus
ccagatagcatttgccaccctcggg

SEQ ID NO: 244614 - DNA, 25 bp, Rattus norvegicus
ccagatagctggagtgatgtccaca

SEQ ID NO: 244615 - DNA, 25 bp, Rattus norvegicus
ccagatagctggtgtgatgtccaca

SEQ ID NO: 244616 - DNA, 25 bp, Rattus norvegicus
ccagatatctggaattttcttctat

SEQ ID NO: 244617 - DNA, 25 bp, Rattus norvegicus
ccagatatctggtattttcttctat

SEQ ID NO: 244618 - DNA, 25 bp, Rattus norvegicus
ccagatatggttagcgttcagagac

SEQ ID NO: 244619 - DNA, 25 bp, Rattus norvegicus
ccagatatggtttgcgttcagagac

SEQ ID NO: 244620 - DNA, 25 bp, Rattus norvegicus
ccagatcagccaaggatgccaccaa

SEQ ID NO: 244621 - DNA, 25 bp, Rattus norvegicus
ccagatcagccatggatgccaccaa

SEQ ID NO: 244622 - DNA, 25 bp, Rattus norvegicus
ccagatcaggtgactcgtcttgaga

SEQ ID NO: 244623 - DNA, 25 bp, Rattus norvegicus
ccagatcaggtgtctcgtcttgaga

SEQ ID NO: 244624 - DNA, 25 bp, Rattus norvegicus
ccagatccaggtctgcgggcataac

SEQ ID NO: 244625 - DNA, 25 bp, Rattus norvegicus
ccagatccaggtgtgcgggcataac

SEQ ID NO: 244626 - DNA, 25 bp, Rattus norvegicus
ccagatcctgacagatggaataact

SEQ ID NO: 244627 - DNA, 25 bp, Rattus norvegicus
ccagatcctgactgatggaataact

SEQ ID NO: 244628 - DNA, 25 bp, Rattus norvegicus
ccagatccttgccaggcacaggaaa

SEQ ID NO: 244629 - DNA, 25 bp, Rattus norvegicus
ccagatccttgcgaggcacaggaaa

SEQ ID NO: 244630 - DNA, 25 bp, Rattus norvegicus
ccagatctcaaaatctccacgtatt

SEQ ID NO: 244631 - DNA, 25 bp, Rattus norvegicus
ccagatctcaaattctccacgtatt

SEQ ID NO: 244632 - DNA, 25 bp, Rattus norvegicus
ccagatctcctaagcctatcagctg

SEQ ID NO: 244633 - DNA, 25 bp, Rattus norvegicus
ccagatctcctatgcctatcagctg

SEQ ID NO: 244634 - DNA, 25 bp, Rattus norvegicus
ccagatctgctgcttactcagagaa

SEQ ID NO: 244635 - DNA, 25 bp, Rattus norvegicus
ccagatctgctggttactcagagaa

SEQ ID NO: 244636 - DNA, 25 bp, Rattus norvegicus
ccagatctttagaagtggtctttca

SEQ ID NO: 244637 - DNA, 25 bp, Rattus norvegicus
ccagatctttagtagtggtctttca

SEQ ID NO: 244638 - DNA, 25 bp, Rattus norvegicus
ccagatgcagcacagccaggctcag

SEQ ID NO: 244639 - DNA, 25 bp, Rattus norvegicus
ccagatgcagcagagccaggctcag

SEQ ID NO: 244640 - DNA, 25 bp, Rattus norvegicus
ccagatgcatttcttgttccccgat

SEQ ID NO: 244641 - DNA, 25 bp, Rattus norvegicus
ccagatgcatttgttgttccccgat

SEQ ID NO: 244642 - DNA, 25 bp, Rattus norvegicus
ccagatgcctggaaaagtttcagta

SEQ ID NO: 244643 - DNA, 25 bp, Rattus norvegicus
ccagatgcctggtaaagtttcagta

SEQ ID NO: 244644 - DNA, 25 bp, Rattus norvegicus
ccagatgctgaactccatgtgtgct

SEQ ID NO: 244645 - DNA, 25 bp, Rattus norvegicus
ccagatgctgaagtccatgtgtgct

SEQ ID NO: 244646 - DNA, 25 bp, Rattus norvegicus
ccagatgggatcacccaaatccggg

SEQ ID NO: 244647 - DNA, 25 bp, Rattus norvegicus
ccagatgggatctcccaaatccggg

SEQ ID NO: 244648 - DNA, 25 bp, Rattus norvegicus
ccagatgggcgtcgcagcactcaga

SEQ ID NO: 244649 - DNA, 25 bp, Rattus norvegicus
ccagatgggcgtggcagcactcaga

SEQ ID NO: 244650 - DNA, 25 bp, Rattus norvegicus
ccagatgggtgtcgcaagtctttca

SEQ ID NO: 244651 - DNA, 25 bp, Rattus norvegicus
ccagatgggtgtggcaagtctttca

SEQ ID NO: 244652 - DNA, 25 bp, Rattus norvegicus
ccagatggtggacatcacagacgac

SEQ ID NO: 244653 - DNA, 25 bp, Rattus norvegicus
ccagatggtggagatcacagacgac

SEQ ID NO: 244654 - DNA, 25 bp, Rattus norvegicus
ccagatggtgggaatgtctcaagct

SEQ ID NO: 244655 - DNA, 25 bp, Rattus norvegicus
ccagatggtgggtatgtctcaagct

SEQ ID NO: 244656 - DNA, 25 bp, Rattus norvegicus
ccagatggttccatcagagacccac

SEQ ID NO: 244657 - DNA, 25 bp, Rattus norvegicus
ccagatggttccttcagagacccac

SEQ ID NO: 244658 - DNA, 25 bp, Rattus norvegicus
ccagatgtgcttatctcaagtgtca

SEQ ID NO: 244659 - DNA, 25 bp, Rattus norvegicus
ccagatgtgcttttctcaagtgtca

SEQ ID NO: 244660 - DNA, 25 bp, Rattus norvegicus
ccagattatcctcgtcaacgcagga

SEQ ID NO: 244661 - DNA, 25 bp, Rattus norvegicus
ccagattatcctggtcaacgcagga

SEQ ID NO: 244662 - DNA, 25 bp, Rattus norvegicus
ccagattccttgagattgtgatgga

SEQ ID NO: 244663 - DNA, 25 bp, Rattus norvegicus
ccagattccttgtgattgtgatgga

SEQ ID NO: 244664 - DNA, 25 bp, Rattus norvegicus
ccagattctggtccctttgtttatg

SEQ ID NO: 244665 - DNA, 25 bp, Rattus norvegicus
ccagattctggtgcctttgtttatg

SEQ ID NO: 244666 - DNA, 25 bp, Rattus norvegicus
ccagattctgttaatccttgggaca

SEQ ID NO: 244667 - DNA, 25 bp, Rattus norvegicus
ccagattctgtttatccttgggaca

SEQ ID NO: 244668 - DNA, 25 bp, Rattus norvegicus
ccagattgaagccatccatagcagg

SEQ ID NO: 244669 - DNA, 25 bp, Rattus norvegicus
ccagattgaagcgatccatagcagg

SEQ ID NO: 244670 - DNA, 25 bp, Rattus norvegicus
ccagattgcatcacctgctttgaac

SEQ ID NO: 244671 - DNA, 25 bp, Rattus norvegicus
ccagattgcatctcctgctttgaac

SEQ ID NO: 244672 - DNA, 25 bp, Rattus norvegicus
ccagattgggttaatgtgtgatgat

SEQ ID NO: 244673 - DNA, 25 bp, Rattus norvegicus
ccagattgggtttatgtgtgatgat

SEQ ID NO: 244674 - DNA, 25 bp, Rattus norvegicus
ccagatttctgcattagccacttac

SEQ ID NO: 244675 - DNA, 25 bp, Rattus norvegicus
ccagatttctgctttagccacttac

SEQ ID NO: 244676 - DNA, 25 bp, Rattus norvegicus
ccagcaaaggcaccgtgatgcttta

SEQ ID NO: 244677 - DNA, 25 bp, Rattus norvegicus
ccagcaaaggcagcgtgatgcttta

SEQ ID NO: 244678 - DNA, 25 bp, Rattus norvegicus
ccagcaaccatcaattctggaatct

SEQ ID NO: 244679 - DNA, 25 bp, Rattus norvegicus
ccagcaaccatctattctggaatct

SEQ ID NO: 244680 - DNA, 25 bp, Rattus norvegicus
ccagcaagagctatcctacctgtag

SEQ ID NO: 244681 - DNA, 25 bp, Rattus norvegicus
ccagcaagagctttcctacctgtag

SEQ ID NO: 244682 - DNA, 25 bp, Rattus norvegicus
ccagcaagatgtctccataggcaga

SEQ ID NO: 244683 - DNA, 25 bp, Rattus norvegicus
ccagcaagatgtgtccataggcaga

SEQ ID NO: 244684 - DNA, 25 bp, Rattus norvegicus
ccagcaaggtgtactctcggtagac

SEQ ID NO: 244685 - DNA, 25 bp, Rattus norvegicus
ccagcaaggtgttctctcggtagac

SEQ ID NO: 244686 - DNA, 25 bp, Rattus norvegicus
ccagcaagtggacccagccaggctt

SEQ ID NO: 244687 - DNA, 25 bp, Rattus norvegicus
ccagcaagtggagccagccaggctt

SEQ ID NO: 244688 - DNA, 25 bp, Rattus norvegicus
ccagcaagtttcaggccacctaggg

SEQ ID NO: 244689 - DNA, 25 bp, Rattus norvegicus
ccagcaagtttctggccacctaggg

SEQ ID NO: 244690 - DNA, 25 bp, Rattus norvegicus
ccagcaatccatactgtctcttata

SEQ ID NO: 244691 - DNA, 25 bp, Rattus norvegicus
ccagcaatccattctgtctcttata

SEQ ID NO: 244692 - DNA, 25 bp, Rattus norvegicus
ccagcacaatagcagcctatgaggt

SEQ ID NO: 244693 - DNA, 25 bp, Rattus norvegicus
ccagcacaataggagcctatgaggt

SEQ ID NO: 244694 - DNA, 25 bp, Rattus norvegicus
ccagcacaatcgctgctactttttt

SEQ ID NO: 244695 - DNA, 25 bp, Rattus norvegicus
ccagcacaatcggtgctactttttt

SEQ ID NO: 244696 - DNA, 25 bp, Rattus norvegicus
ccagcacagcagcaccaatgggatt

SEQ ID NO: 244697 - DNA, 25 bp, Rattus norvegicus
ccagcacagcaggaccaatgggatt

SEQ ID NO: 244698 - DNA, 25 bp, Rattus norvegicus
ccagcaccaagtctgggtgttcagt

SEQ ID NO: 244699 - DNA, 25 bp, Rattus norvegicus
ccagcaccaagtgtgggtgttcagt

SEQ ID NO: 244700 - DNA, 25 bp, Rattus norvegicus
ccagcaccagcgaggaggctttgga

SEQ ID NO: 244701 - DNA, 25 bp, Rattus norvegicus
ccagcaccagcgtggaggctttgga

SEQ ID NO: 244702 - DNA, 25 bp, Rattus norvegicus
ccagcacctcagaggatgttcgtaa

SEQ ID NO: 244703 - DNA, 25 bp, Rattus norvegicus
ccagcacctcagtggatgttcgtaa

SEQ ID NO: 244704 - DNA, 25 bp, Rattus norvegicus
ccagcacctggcagcgggatagatg

SEQ ID NO: 244705 - DNA, 25 bp, Rattus norvegicus
ccagcacctggctgcgggatagatg

SEQ ID NO: 244706 - DNA, 25 bp, Rattus norvegicus
ccagcaccttttactgcatgattga

SEQ ID NO: 244707 - DNA, 25 bp, Rattus norvegicus
ccagcacctttttctgcatgattga

SEQ ID NO: 244708 - DNA, 25 bp, Rattus norvegicus
ccagcacgctggatttgatgagcta

SEQ ID NO: 244709 - DNA, 25 bp, Rattus norvegicus
ccagcacgctggttttgatgagcta

SEQ ID NO: 244710 - DNA, 25 bp, Rattus norvegicus
ccagcactactactgatcagcggct

SEQ ID NO: 244711 - DNA, 25 bp, Rattus norvegicus
ccagcactactagtgatcagcggct

SEQ ID NO: 244712 - DNA, 25 bp, Rattus norvegicus
ccagcactcaacagggcagatgtta

SEQ ID NO: 244713 - DNA, 25 bp, Rattus norvegicus
ccagcactcaactgggcagatgtta

SEQ ID NO: 244714 - DNA, 25 bp, Rattus norvegicus
ccagcactcaggcttgatgccgtaa

SEQ ID NO: 244715 - DNA, 25 bp, Rattus norvegicus
ccagcactcagggttgatgccgtaa

SEQ ID NO: 244716 - DNA, 25 bp, Rattus norvegicus
ccagcactccaacttcaggtggtag

SEQ ID NO: 244717 - DNA, 25 bp, Rattus norvegicus
ccagcactccaagttcaggtggtag

SEQ ID NO: 244718 - DNA, 25 bp, Rattus norvegicus
ccagcactgctgctagtgacagtac

SEQ ID NO: 244719 - DNA, 25 bp, Rattus norvegicus
ccagcactgctggtagtgacagtac

SEQ ID NO: 244720 - DNA, 25 bp, Rattus norvegicus
ccagcacttggaaagctttggcagt

SEQ ID NO: 244721 - DNA, 25 bp, Rattus norvegicus
ccagcacttggatagctttggcagt

SEQ ID NO: 244722 - DNA, 25 bp, Rattus norvegicus
ccagcagaagacagaagggtggtca

SEQ ID NO: 244723 - DNA, 25 bp, Rattus norvegicus
ccagcagaagactgaagggtggtca

SEQ ID NO: 244724 - DNA, 25 bp, Rattus norvegicus
ccagcagacctgagcccaagggaaa

SEQ ID NO: 244725 - DNA, 25 bp, Rattus norvegicus
ccagcagacctgtgcccaagggaaa

SEQ ID NO: 244726 - DNA, 25 bp, Rattus norvegicus
ccagcagactggcttcactgttagt

SEQ ID NO: 244727 - DNA, 25 bp, Rattus norvegicus
ccagcagactgggttcactgttagt

SEQ ID NO: 244728 - DNA, 25 bp, Rattus norvegicus
ccagcagagacacagtttcaggtga

SEQ ID NO: 244729 - DNA, 25 bp, Rattus norvegicus
ccagcagagacagagtttcaggtga

SEQ ID NO: 244730 - DNA, 25 bp, Rattus norvegicus
ccagcagagggtagttttattacag

SEQ ID NO: 244731 - DNA, 25 bp, Rattus norvegicus
ccagcagagggttgttttattacag

SEQ ID NO: 244732 - DNA, 25 bp, Rattus norvegicus
ccagcagatccacttttcattacac

SEQ ID NO: 244733 - DNA, 25 bp, Rattus norvegicus
ccagcagatccagttttcattacac

SEQ ID NO: 244734 - DNA, 25 bp, Rattus norvegicus
ccagcagcaatacggaccacagact

SEQ ID NO: 244735 - DNA, 25 bp, Rattus norvegicus
ccagcagcaatagggaccacagact

SEQ ID NO: 244736 - DNA, 25 bp, Rattus norvegicus
ccagcagcagtaaggcttccagcac

SEQ ID NO: 244737 - DNA, 25 bp, Rattus norvegicus
ccagcagcagtatggcttccagcac

SEQ ID NO: 244738 - DNA, 25 bp, Rattus norvegicus
ccagcagcatgactcacctctgtga

SEQ ID NO: 244739 - DNA, 25 bp, Rattus norvegicus
ccagcagcatgagtcacctctgtga

SEQ ID NO: 244740 - DNA, 25 bp, Rattus norvegicus
ccagcagccaccatgtggaacaggg

SEQ ID NO: 244741 - DNA, 25 bp, Rattus norvegicus
ccagcagccaccttgtggaacaggg

SEQ ID NO: 244742 - DNA, 25 bp, Rattus norvegicus
ccagcagccttgcagtcctcgggtt

SEQ ID NO: 244743 - DNA, 25 bp, Rattus norvegicus
ccagcagccttggagtcctcgggtt

SEQ ID NO: 244744 - DNA, 25 bp, Rattus norvegicus
ccagcagcggcacgcagcatcaaaa

SEQ ID NO: 244745 - DNA, 25 bp, Rattus norvegicus
ccagcagcggcaggcagcatcaaaa

SEQ ID NO: 244746 - DNA, 25 bp, Rattus norvegicus
ccagcagctagcacagaaacttatt

SEQ ID NO: 244747 - DNA, 25 bp, Rattus norvegicus
ccagcagctagctcagaaacttatt

SEQ ID NO: 244748 - DNA, 25 bp, Rattus norvegicus
ccagcagctggtatctgttcattat

SEQ ID NO: 244749 - DNA, 25 bp, Rattus norvegicus
ccagcagctggtttctgttcattat

SEQ ID NO: 244750 - DNA, 25 bp, Rattus norvegicus
ccagcagctgtaacatctagacgct

SEQ ID NO: 244751 - DNA, 25 bp, Rattus norvegicus
ccagcagctgtatcatctagacgct

SEQ ID NO: 244752 - DNA, 25 bp, Rattus norvegicus
ccagcaggcgctcaaagaagagagc

SEQ ID NO: 244753 - DNA, 25 bp, Rattus norvegicus
ccagcaggcgctgaaagaagagagc

SEQ ID NO: 244754 - DNA, 25 bp, Rattus norvegicus
ccagcaggctgaagtgcttctgtct

SEQ ID NO: 244755 - DNA, 25 bp, Rattus norvegicus
ccagcaggctgatgtgcttctgtct

SEQ ID NO: 244756 - DNA, 25 bp, Rattus norvegicus
ccagcagggatgaaaatgccgccat

SEQ ID NO: 244757 - DNA, 25 bp, Rattus norvegicus
ccagcagggatgtaaatgccgccat

SEQ ID NO: 244758 - DNA, 25 bp, Rattus norvegicus
ccagcagggcatagcttagcccaaa

SEQ ID NO: 244759 - DNA, 25 bp, Rattus norvegicus
ccagcagggcattgcttagcccaaa

SEQ ID NO: 244760 - DNA, 25 bp, Rattus norvegicus
ccagcagggccgagatggagataat

SEQ ID NO: 244761 - DNA, 25 bp, Rattus norvegicus
ccagcagggccgtgatggagataat

SEQ ID NO: 244762 - DNA, 25 bp, Rattus norvegicus
ccagcagggcttataaaggtagcat

SEQ ID NO: 244763 - DNA, 25 bp, Rattus norvegicus
ccagcagggcttttaaaggtagcat

SEQ ID NO: 244764 - DNA, 25 bp, Rattus norvegicus
ccagcagggtgaccttaagaattaa

SEQ ID NO: 244765 - DNA, 25 bp, Rattus norvegicus
ccagcagggtgagcttaagaattaa

SEQ ID NO: 244766 - DNA, 25 bp, Rattus norvegicus
ccagcaggtccacagattcctagaa

SEQ ID NO: 244767 - DNA, 25 bp, Rattus norvegicus
ccagcaggtccagagattcctagaa

SEQ ID NO: 244768 - DNA, 25 bp, Rattus norvegicus
ccagcagtaaggactctagtcatct

SEQ ID NO: 244769 - DNA, 25 bp, Rattus norvegicus
ccagcagtaaggtctctagtcatct

SEQ ID NO: 244770 - DNA, 25 bp, Rattus norvegicus
ccagcagtcaggattcagtgtattc

SEQ ID NO: 244771 - DNA, 25 bp, Rattus norvegicus
ccagcagtcaggtttcagtgtattc

SEQ ID NO: 244772 - DNA, 25 bp, Rattus norvegicus
ccagcagtcattatgtttagagcag

SEQ ID NO: 244773 - DNA, 25 bp, Rattus norvegicus
ccagcagtcattttgtttagagcag

SEQ ID NO: 244774 - DNA, 25 bp, Rattus norvegicus
ccagcagtgatgcttgtccaagact

SEQ ID NO: 244775 - DNA, 25 bp, Rattus norvegicus
ccagcagtgatggttgtccaagact

SEQ ID NO: 244776 - DNA, 25 bp, Rattus norvegicus
ccagcagtgcctcccaaagtatctt

SEQ ID NO: 244777 - DNA, 25 bp, Rattus norvegicus
ccagcagtgcctgccaaagtatctt

SEQ ID NO: 244778 - DNA, 25 bp, Rattus norvegicus
ccagcagttcctcagttcatttgga

SEQ ID NO: 244779 - DNA, 25 bp, Rattus norvegicus
ccagcagttcctgagttcatttgga

SEQ ID NO: 244780 - DNA, 25 bp, Rattus norvegicus
ccagcagtttgcatcttgattgaac

SEQ ID NO: 244781 - DNA, 25 bp, Rattus norvegicus
ccagcagtttgcttcttgattgaac

SEQ ID NO: 244782 - DNA, 25 bp, Rattus norvegicus
ccagcatcatgtaccagtgcagtgt

SEQ ID NO: 244783 - DNA, 25 bp, Rattus norvegicus
ccagcatcatgttccagtgcagtgt

SEQ ID NO: 244784 - DNA, 25 bp, Rattus norvegicus
ccagcatccagtacacgcttagtat

SEQ ID NO: 244785 - DNA, 25 bp, Rattus norvegicus
ccagcatccagttcacgcttagtat

SEQ ID NO: 244786 - DNA, 25 bp, Rattus norvegicus
ccagcatccatgataggttttcaca

SEQ ID NO: 244787 - DNA, 25 bp, Rattus norvegicus
ccagcatccatgttaggttttcaca

SEQ ID NO: 244788 - DNA, 25 bp, Rattus norvegicus
ccagcatcctggctaaggtaaagct

SEQ ID NO: 244789 - DNA, 25 bp, Rattus norvegicus
ccagcatcctgggtaaggtaaagct

SEQ ID NO: 244790 - DNA, 25 bp, Rattus norvegicus
ccagcatcggtgacttctgtagcga

SEQ ID NO: 244791 - DNA, 25 bp, Rattus norvegicus
ccagcatcggtgtcttctgtagcga

SEQ ID NO: 244792 - DNA, 25 bp, Rattus norvegicus
ccagcatctcagcacttggtctaat

SEQ ID NO: 244793 - DNA, 25 bp, Rattus norvegicus
ccagcatctcaggacttggtctaat

SEQ ID NO: 244794 - DNA, 25 bp, Rattus norvegicus
ccagcatcttatctcagtcagtgta

SEQ ID NO: 244795 - DNA, 25 bp, Rattus norvegicus
ccagcatcttatgtcagtcagtgta

SEQ ID NO: 244796 - DNA, 25 bp, Rattus norvegicus
ccagcatgaagaccggagcggactt

SEQ ID NO: 244797 - DNA, 25 bp, Rattus norvegicus
ccagcatgaagagcggagcggactt

SEQ ID NO: 244798 - DNA, 25 bp, Rattus norvegicus
ccagcatgacccctttttataggta

SEQ ID NO: 244799 - DNA, 25 bp, Rattus norvegicus
ccagcatgacccgtttttataggta

SEQ ID NO: 244800 - DNA, 25 bp, Rattus norvegicus
ccagcatgccacagcatgttgtact

SEQ ID NO: 244801 - DNA, 25 bp, Rattus norvegicus
ccagcatgccactgcatgttgtact

SEQ ID NO: 244802 - DNA, 25 bp, Rattus norvegicus
ccagcatgctctccggaacagtgta

SEQ ID NO: 244803 - DNA, 25 bp, Rattus norvegicus
ccagcatgctctgcggaacagtgta

SEQ ID NO: 244804 - DNA, 25 bp, Rattus norvegicus
ccagcatggctgagagcactcatta

SEQ ID NO: 244805 - DNA, 25 bp, Rattus norvegicus
ccagcatggctgtgagcactcatta

SEQ ID NO: 244806 - DNA, 25 bp, Rattus norvegicus
ccagcattcgggagacaaaggtggt

SEQ ID NO: 244807 - DNA, 25 bp, Rattus norvegicus
ccagcattcgggaggtagacacaga

SEQ ID NO: 244808 - DNA, 25 bp, Rattus norvegicus
ccagcattcgggtgacaaaggtggt

SEQ ID NO: 244809 - DNA, 25 bp, Rattus norvegicus
ccagcattcgggtggtagacacaga

SEQ ID NO: 244810 - DNA, 25 bp, Rattus norvegicus
ccagcattcttcatgtccttaacat

SEQ ID NO: 244811 - DNA, 25 bp, Rattus norvegicus
ccagcattcttcttgtccttaacat

SEQ ID NO: 244812 - DNA, 25 bp, Rattus norvegicus
ccagcattgggcaatgtggcaagac

SEQ ID NO: 244813 - DNA, 25 bp, Rattus norvegicus
ccagcattgggctatgtggcaagac

SEQ ID NO: 244814 - DNA, 25 bp, Rattus norvegicus
ccagcattgtggcttgtcatgtcag

SEQ ID NO: 244815 - DNA, 25 bp, Rattus norvegicus
ccagcattgtgggttgtcatgtcag

SEQ ID NO: 244816 - DNA, 25 bp, Rattus norvegicus
ccagcatttaatctcgtggctgctt

SEQ ID NO: 244817 - DNA, 25 bp, Rattus norvegicus
ccagcatttaatgtcgtggctgctt

SEQ ID NO: 244818 - DNA, 25 bp, Rattus norvegicus
ccagccaaaagcagactgcctttta

SEQ ID NO: 244819 - DNA, 25 bp, Rattus norvegicus
ccagccaaaagctgactgcctttta

SEQ ID NO: 244820 - DNA, 25 bp, Rattus norvegicus
ccagccaactcgagttcatgaggat

SEQ ID NO: 244821 - DNA, 25 bp, Rattus norvegicus
ccagccaactcgtgttcatgaggat

SEQ ID NO: 244822 - DNA, 25 bp, Rattus norvegicus
ccagccaatcctacagaagagtatg

SEQ ID NO: 244823 - DNA, 25 bp, Rattus norvegicus
ccagccaatccttcagaagagtatg

SEQ ID NO: 244824 - DNA, 25 bp, Rattus norvegicus
ccagccaatctcaaaaatgcctctt

SEQ ID NO: 244825 - DNA, 25 bp, Rattus norvegicus
ccagccaatctctaaaatgcctctt

SEQ ID NO: 244826 - DNA, 25 bp, Rattus norvegicus
ccagccacaccaaacaaggaaacta

SEQ ID NO: 244827 - DNA, 25 bp, Rattus norvegicus
ccagccacaccatacaaggaaacta

SEQ ID NO: 244828 - DNA, 25 bp, Rattus norvegicus
ccagccactagactcggaggccagt

SEQ ID NO: 244829 - DNA, 25 bp, Rattus norvegicus
ccagccactagagtcggaggccagt

SEQ ID NO: 244830 - DNA, 25 bp, Rattus norvegicus
ccagccactgatctgtctagggcaa

SEQ ID NO: 244831 - DNA, 25 bp, Rattus norvegicus
ccagccactgatgtgtctagggcaa

SEQ ID NO: 244832 - DNA, 25 bp, Rattus norvegicus
ccagccactggacttctagagagaa

SEQ ID NO: 244833 - DNA, 25 bp, Rattus norvegicus
ccagccactggagttctagagagaa

SEQ ID NO: 244834 - DNA, 25 bp, Rattus norvegicus
ccagccactgttagtttccttataa

SEQ ID NO: 244835 - DNA, 25 bp, Rattus norvegicus
ccagccactgtttgtttccttataa

SEQ ID NO: 244836 - DNA, 25 bp, Rattus norvegicus
ccagccagagctagccaaaaagtga

SEQ ID NO: 244837 - DNA, 25 bp, Rattus norvegicus
ccagccagagcttgccaaaaagtga

SEQ ID NO: 244838 - DNA, 25 bp, Rattus norvegicus
ccagccagcagaatctcttctgtaa

SEQ ID NO: 244839 - DNA, 25 bp, Rattus norvegicus
ccagccagcagattctcttctgtaa

SEQ ID NO: 244840 - DNA, 25 bp, Rattus norvegicus
ccagccagcgttcttttgaataaaa

SEQ ID NO: 244841 - DNA, 25 bp, Rattus norvegicus
ccagccagcgttgttttgaataaaa

SEQ ID NO: 244842 - DNA, 25 bp, Rattus norvegicus
ccagccagtgataatgtgagaatat

SEQ ID NO: 244843 - DNA, 25 bp, Rattus norvegicus
ccagccagtgattatgtgagaatat

SEQ ID NO: 244844 - DNA, 25 bp, Rattus norvegicus
ccagccatcagcatctcatgatttt

SEQ ID NO: 244845 - DNA, 25 bp, Rattus norvegicus
ccagccatcagcttctcatgatttt

SEQ ID NO: 244846 - DNA, 25 bp, Rattus norvegicus
ccagccatcctgctactgtagttta

SEQ ID NO: 244847 - DNA, 25 bp, Rattus norvegicus
ccagccatcctggtactgtagttta

SEQ ID NO: 244848 - DNA, 25 bp, Rattus norvegicus
ccagccatggatcccctgacagaga

SEQ ID NO: 244849 - DNA, 25 bp, Rattus norvegicus
ccagccatggatgccctgacagaga

SEQ ID NO: 244850 - DNA, 25 bp, Rattus norvegicus
ccagccatggcacagagggttctca

SEQ ID NO: 244851 - DNA, 25 bp, Rattus norvegicus
ccagccatggcagagagggttctca

SEQ ID NO: 244852 - DNA, 25 bp, Rattus norvegicus
ccagccatggttacaccacagaatt

SEQ ID NO: 244853 - DNA, 25 bp, Rattus norvegicus
ccagccatggtttcaccacagaatt

SEQ ID NO: 244854 - DNA, 25 bp, Rattus norvegicus
ccagccatgttaccatgcagtagta

SEQ ID NO: 244855 - DNA, 25 bp, Rattus norvegicus
ccagccatgttagcatgcagtagta

SEQ ID NO: 244856 - DNA, 25 bp, Rattus norvegicus
ccagccattccaatagtcattttcc

SEQ ID NO: 244857 - DNA, 25 bp, Rattus norvegicus
ccagccattccattagtcattttcc

SEQ ID NO: 244858 - DNA, 25 bp, Rattus norvegicus
ccagcccaagatcatggctcttgat

SEQ ID NO: 244859 - DNA, 25 bp, Rattus norvegicus
ccagcccaagatgatggctcttgat

SEQ ID NO: 244860 - DNA, 25 bp, Rattus norvegicus
ccagcccaaggcatttttgtatgtt

SEQ ID NO: 244861 - DNA, 25 bp, Rattus norvegicus
ccagcccaaggcttttttgtatgtt

SEQ ID NO: 244862 - DNA, 25 bp, Rattus norvegicus
ccagcccacaatctctgtgtattga

SEQ ID NO: 244863 - DNA, 25 bp, Rattus norvegicus
ccagcccacaatgtctgtgtattga

SEQ ID NO: 244864 - DNA, 25 bp, Rattus norvegicus
ccagcccagaggagcaagtgcgcat

SEQ ID NO: 244865 - DNA, 25 bp, Rattus norvegicus
ccagcccagaggtgcaagtgcgcat

SEQ ID NO: 244866 - DNA, 25 bp, Rattus norvegicus
ccagcccagctactatttcacattt

SEQ ID NO: 244867 - DNA, 25 bp, Rattus norvegicus
ccagcccagctagtatttcacattt

SEQ ID NO: 244868 - DNA, 25 bp, Rattus norvegicus
ccagcccagctcaagatgcttggat

SEQ ID NO: 244869 - DNA, 25 bp, Rattus norvegicus
ccagcccagctctagatgcttggat

SEQ ID NO: 244870 - DNA, 25 bp, Rattus norvegicus
ccagcccagctgagctaacataagt

SEQ ID NO: 244871 - DNA, 25 bp, Rattus norvegicus
ccagcccagctgtgctaacataagt

SEQ ID NO: 244872 - DNA, 25 bp, Rattus norvegicus
ccagcccattttcaggaatgaagat

SEQ ID NO: 244873 - DNA, 25 bp, Rattus norvegicus
ccagcccattttgaggaatgaagat

SEQ ID NO: 244874 - DNA, 25 bp, Rattus norvegicus
ccagccccaaatatatcacttttct

SEQ ID NO: 244875 - DNA, 25 bp, Rattus norvegicus
ccagccccaaatttatcacttttct

SEQ ID NO: 244876 - DNA, 25 bp, Rattus norvegicus
ccagccccaattaacctaaagcttg

SEQ ID NO: 244877 - DNA, 25 bp, Rattus norvegicus
ccagccccaatttacctaaagcttg

SEQ ID NO: 244878 - DNA, 25 bp, Rattus norvegicus
ccagccccacacacttgagtaataa

SEQ ID NO: 244879 - DNA, 25 bp, Rattus norvegicus
ccagccccacactcttgagtaataa

SEQ ID NO: 244880 - DNA, 25 bp, Rattus norvegicus
ccagccccactgagatagttctatg

SEQ ID NO: 244881 - DNA, 25 bp, Rattus norvegicus
ccagccccactgtgatagttctatg

SEQ ID NO: 244882 - DNA, 25 bp, Rattus norvegicus
ccagccccagtactgacactaataa

SEQ ID NO: 244883 - DNA, 25 bp, Rattus norvegicus
ccagccccagtagtgacactaataa

SEQ ID NO: 244884 - DNA, 25 bp, Rattus norvegicus
ccagccccatataatcctaatcaat

SEQ ID NO: 244885 - DNA, 25 bp, Rattus norvegicus
ccagccccatattatcctaatcaat

SEQ ID NO: 244886 - DNA, 25 bp, Rattus norvegicus
ccagccccatctaggaggcagggta

SEQ ID NO: 244887 - DNA, 25 bp, Rattus norvegicus
ccagccccatcttggaggcagggta

SEQ ID NO: 244888 - DNA, 25 bp, Rattus norvegicus
ccagccccgtgtcttaggctaaaag

SEQ ID NO: 244889 - DNA, 25 bp, Rattus norvegicus
ccagccccgtgtgttaggctaaaag

SEQ ID NO: 244890 - DNA, 25 bp, Rattus norvegicus
ccagcccctgaaagtattaattcgg

SEQ ID NO: 244891 - DNA, 25 bp, Rattus norvegicus
ccagcccctgaatgtattaattcgg

SEQ ID NO: 244892 - DNA, 25 bp, Rattus norvegicus
ccagcccctgtaagggacactatgg

SEQ ID NO: 244893 - DNA, 25 bp, Rattus norvegicus
ccagcccctgtatgggacactatgg

SEQ ID NO: 244894 - DNA, 25 bp, Rattus norvegicus
ccagcccgtggtaaagacttatcta

SEQ ID NO: 244895 - DNA, 25 bp, Rattus norvegicus
ccagcccgtggttaagacttatcta

SEQ ID NO: 244896 - DNA, 25 bp, Rattus norvegicus
ccagcccgtgtcatttaacacaatt

SEQ ID NO: 244897 - DNA, 25 bp, Rattus norvegicus
ccagcccgtgtcttttaacacaatt

SEQ ID NO: 244898 - DNA, 25 bp, Rattus norvegicus
ccagccctaatccaacattagcttt

SEQ ID NO: 244899 - DNA, 25 bp, Rattus norvegicus
ccagccctaatcgaacattagcttt

SEQ ID NO: 244900 - DNA, 25 bp, Rattus norvegicus
ccagccctagacaagcagcaaggga

SEQ ID NO: 244901 - DNA, 25 bp, Rattus norvegicus
ccagccctagactagcagcaaggga

SEQ ID NO: 244902 - DNA, 25 bp, Rattus norvegicus
ccagccctagttagcagtttcagga

SEQ ID NO: 244903 - DNA, 25 bp, Rattus norvegicus
ccagccctagtttgcagtttcagga

SEQ ID NO: 244904 - DNA, 25 bp, Rattus norvegicus
ccagccctctttcattggtatggag

SEQ ID NO: 244905 - DNA, 25 bp, Rattus norvegicus
ccagccctctttgattggtatggag

SEQ ID NO: 244906 - DNA, 25 bp, Rattus norvegicus
ccagccctggacagctcagtaatga

SEQ ID NO: 244907 - DNA, 25 bp, Rattus norvegicus
ccagccctggactgctcagtaatga

SEQ ID NO: 244908 - DNA, 25 bp, Rattus norvegicus
ccagccctgggcaattgacataata

SEQ ID NO: 244909 - DNA, 25 bp, Rattus norvegicus
ccagccctgggctattgacataata

SEQ ID NO: 244910 - DNA, 25 bp, Rattus norvegicus
ccagcccttgcccttgaagtatagg

SEQ ID NO: 244911 - DNA, 25 bp, Rattus norvegicus
ccagcccttgccgttgaagtatagg

SEQ ID NO: 244912 - DNA, 25 bp, Rattus norvegicus
ccagcccttgtgattgcagtgttta

SEQ ID NO: 244913 - DNA, 25 bp, Rattus norvegicus
ccagcccttgtgtttgcagtgttta

SEQ ID NO: 244914 - DNA, 25 bp, Rattus norvegicus
ccagccgctacgcagtttacgtagc

SEQ ID NO: 244915 - DNA, 25 bp, Rattus norvegicus
ccagccgctacggagtttacgtagc

SEQ ID NO: 244916 - DNA, 25 bp, Rattus norvegicus
ccagccgcttctatgacaacattga

SEQ ID NO: 244917 - DNA, 25 bp, Rattus norvegicus
ccagccgcttctttgacaacattga

SEQ ID NO: 244918 - DNA, 25 bp, Rattus norvegicus
ccagccggctcaatatttgcttaat

SEQ ID NO: 244919 - DNA, 25 bp, Rattus norvegicus
ccagccggctcattatttgcttaat

SEQ ID NO: 244920 - DNA, 25 bp, Rattus norvegicus
ccagcctacgccaagattcctgtaa

SEQ ID NO: 244921 - DNA, 25 bp, Rattus norvegicus
ccagcctacgcctagattcctgtaa

SEQ ID NO: 244922 - DNA, 25 bp, Rattus norvegicus
ccagcctactctaggagtgccaaga

SEQ ID NO: 244923 - DNA, 25 bp, Rattus norvegicus
ccagcctactcttggagtgccaaga

SEQ ID NO: 244924 - DNA, 25 bp, Rattus norvegicus
ccagcctacttcatgctttagcaat

SEQ ID NO: 244925 - DNA, 25 bp, Rattus norvegicus
ccagcctacttcttgctttagcaat

SEQ ID NO: 244926 - DNA, 25 bp, Rattus norvegicus
ccagcctagcatccacaagttgttg

SEQ ID NO: 244927 - DNA, 25 bp, Rattus norvegicus
ccagcctagcatgcacaagttgttg

SEQ ID NO: 244928 - DNA, 25 bp, Rattus norvegicus
ccagcctcacaaagtgacccagtat

SEQ ID NO: 244929 - DNA, 25 bp, Rattus norvegicus
ccagcctcacaatgtgacccagtat

SEQ ID NO: 244930 - DNA, 25 bp, Rattus norvegicus
ccagcctcggccattttaaaaacag

SEQ ID NO: 244931 - DNA, 25 bp, Rattus norvegicus
ccagcctcggcctttttaaaaacag

SEQ ID NO: 244932 - DNA, 25 bp, Rattus norvegicus
ccagcctctagcagtcttctgagag

SEQ ID NO: 244933 - DNA, 25 bp, Rattus norvegicus
ccagcctctagctgtcttctgagag

SEQ ID NO: 244934 - DNA, 25 bp, Rattus norvegicus
ccagcctctggaccatcagtgaaat

SEQ ID NO: 244935 - DNA, 25 bp, Rattus norvegicus
ccagcctctggagcatcagtgaaat

SEQ ID NO: 244936 - DNA, 25 bp, Rattus norvegicus
ccagcctgacttccggtaatgttgt

SEQ ID NO: 244937 - DNA, 25 bp, Rattus norvegicus
ccagcctgacttgcggtaatgttgt

SEQ ID NO: 244938 - DNA, 25 bp, Rattus norvegicus
ccagcctgagctccaggagatgttt

SEQ ID NO: 244939 - DNA, 25 bp, Rattus norvegicus
ccagcctgagctgcaggagatgttt

SEQ ID NO: 244940 - DNA, 25 bp, Rattus norvegicus
ccagcctgcattaaacctttgacaa

SEQ ID NO: 244941 - DNA, 25 bp, Rattus norvegicus
ccagcctgcatttaacctttgacaa

SEQ ID NO: 244942 - DNA, 25 bp, Rattus norvegicus
ccagcctgcccaaagttgttggcaa

SEQ ID NO: 244943 - DNA, 25 bp, Rattus norvegicus
ccagcctgcccatagttgttggcaa

SEQ ID NO: 244944 - DNA, 25 bp, Rattus norvegicus
ccagcctgctacattctgtggagga

SEQ ID NO: 244945 - DNA, 25 bp, Rattus norvegicus
ccagcctgctactttctgtggagga

SEQ ID NO: 244946 - DNA, 25 bp, Rattus norvegicus
ccagcctggcaactatgacggtgag

SEQ ID NO: 244947 - DNA, 25 bp, Rattus norvegicus
ccagcctggcaagtatgacggtgag

SEQ ID NO: 244948 - DNA, 25 bp, Rattus norvegicus
ccagcctgggcaaagagcagcggta

SEQ ID NO: 244949 - DNA, 25 bp, Rattus norvegicus
ccagcctgggcatagagcagcggta

SEQ ID NO: 244950 - DNA, 25 bp, Rattus norvegicus
ccagcctgggctcccattcataata

SEQ ID NO: 244951 - DNA, 25 bp, Rattus norvegicus
ccagcctgggctgccattcataata

SEQ ID NO: 244952 - DNA, 25 bp, Rattus norvegicus
ccagcctggtcaccatagggagttt

SEQ ID NO: 244953 - DNA, 25 bp, Rattus norvegicus
ccagcctggtcagcatagggagttt

SEQ ID NO: 244954 - DNA, 25 bp, Rattus norvegicus
ccagcctggtctaaggatactcaga

SEQ ID NO: 244955 - DNA, 25 bp, Rattus norvegicus
ccagcctggtcttaggatactcaga

SEQ ID NO: 244956 - DNA, 25 bp, Rattus norvegicus
ccagcctggttcacacaatattttc

SEQ ID NO: 244957 - DNA, 25 bp, Rattus norvegicus
ccagcctggttctcacaatattttc

SEQ ID NO: 244958 - DNA, 25 bp, Rattus norvegicus
ccagcctgtctgcaaatgcttcaag

SEQ ID NO: 244959 - DNA, 25 bp, Rattus norvegicus
ccagcctgtctggaaatgcttcaag

SEQ ID NO: 244960 - DNA, 25 bp, Rattus norvegicus
ccagcctgttgccttaaacggacaa

SEQ ID NO: 244961 - DNA, 25 bp, Rattus norvegicus
ccagcctgttgcgttaaacggacaa

SEQ ID NO: 244962 - DNA, 25 bp, Rattus norvegicus
ccagccttctttatgtatagttaag

SEQ ID NO: 244963 - DNA, 25 bp, Rattus norvegicus
ccagccttctttttgtatagttaag

SEQ ID NO: 244964 - DNA, 25 bp, Rattus norvegicus
ccagccttgatacggccaccaggta

SEQ ID NO: 244965 - DNA, 25 bp, Rattus norvegicus
ccagccttgatagggccaccaggta

SEQ ID NO: 244966 - DNA, 25 bp, Rattus norvegicus
ccagcctttggactgtttgttttat

SEQ ID NO: 244967 - DNA, 25 bp, Rattus norvegicus
ccagcctttggagtgtttgttttat

SEQ ID NO: 244968 - DNA, 25 bp, Rattus norvegicus
ccagccttttcacatgggatctaag

SEQ ID NO: 244969 - DNA, 25 bp, Rattus norvegicus
ccagccttttcagatgggatctaag

SEQ ID NO: 244970 - DNA, 25 bp, Rattus norvegicus
ccagcgagaggcacgtgttcattgt

SEQ ID NO: 244971 - DNA, 25 bp, Rattus norvegicus
ccagcgagaggctcgtgttcattgt

SEQ ID NO: 244972 - DNA, 25 bp, Rattus norvegicus
ccagcgagctggagttcacttaact

SEQ ID NO: 244973 - DNA, 25 bp, Rattus norvegicus
ccagcgagctggtgttcacttaact

SEQ ID NO: 244974 - DNA, 25 bp, Rattus norvegicus
ccagcgaggcgccagctgcagaaaa

SEQ ID NO: 244975 - DNA, 25 bp, Rattus norvegicus
ccagcgaggcgcgagctgcagaaaa

SEQ ID NO: 244976 - DNA, 25 bp, Rattus norvegicus
ccagcgagtcgcacaggatcttcaa

SEQ ID NO: 244977 - DNA, 25 bp, Rattus norvegicus
ccagcgagtcgctcaggatcttcaa

SEQ ID NO: 244978 - DNA, 25 bp, Rattus norvegicus
ccagcgatttcgaccgagttcggga

SEQ ID NO: 244979 - DNA, 25 bp, Rattus norvegicus
ccagcgatttcgtccgagttcggga

SEQ ID NO: 244980 - DNA, 25 bp, Rattus norvegicus
ccagcgcagctcaacgaattggaga

SEQ ID NO: 244981 - DNA, 25 bp, Rattus norvegicus
ccagcgcagctctacgaattggaga

SEQ ID NO: 244982 - DNA, 25 bp, Rattus norvegicus
ccagcgcagctgaattgagaatatt

SEQ ID NO: 244983 - DNA, 25 bp, Rattus norvegicus
ccagcgcagctgtattgagaatatt

SEQ ID NO: 244984 - DNA, 25 bp, Rattus norvegicus
ccagcgccaggacctagaggaattt

SEQ ID NO: 244985 - DNA, 25 bp, Rattus norvegicus
ccagcgccaggagctagaggaattt

SEQ ID NO: 244986 - DNA, 25 bp, Rattus norvegicus
ccagcgcgaggtccacttcatgaag

SEQ ID NO: 244987 - DNA, 25 bp, Rattus norvegicus
ccagcgcgaggtgcacttcatgaag

SEQ ID NO: 244988 - DNA, 25 bp, Rattus norvegicus
ccagcgctgtgtccattaactttga

SEQ ID NO: 244989 - DNA, 25 bp, Rattus norvegicus
ccagcgctgtgtgcattaactttga

SEQ ID NO: 244990 - DNA, 25 bp, Rattus norvegicus
ccagcgcttgcgcagtctgtaggaa

SEQ ID NO: 244991 - DNA, 25 bp, Rattus norvegicus
ccagcgcttgcggagtctgtaggaa

SEQ ID NO: 244992 - DNA, 25 bp, Rattus norvegicus
ccagcgcttgtcctcgaagaagaag

SEQ ID NO: 244993 - DNA, 25 bp, Rattus norvegicus
ccagcgcttgtcgtcgaagaagaag

SEQ ID NO: 244994 - DNA, 25 bp, Rattus norvegicus
ccagcgctttggcaatttgaggcaa

SEQ ID NO: 244995 - DNA, 25 bp, Rattus norvegicus
ccagcgctttgggaatttgaggcaa

SEQ ID NO: 244996 - DNA, 25 bp, Rattus norvegicus
ccagcggacacaccgcactgtttaa

SEQ ID NO: 244997 - DNA, 25 bp, Rattus norvegicus
ccagcggacacagcgcactgtttaa

SEQ ID NO: 244998 - DNA, 25 bp, Rattus norvegicus
ccagcggacttgattctgcagtcac

SEQ ID NO: 244999 - DNA, 25 bp, Rattus norvegicus
ccagcggacttgtttctgcagtcac

SEQ ID NO: 245000 - DNA, 25 bp, Rattus norvegicus
ccagcggcctccagagatggataat

SEQ ID NO: 245001 - DNA, 25 bp, Rattus norvegicus
ccagcggcctcctgagatggataat

SEQ ID NO: 245002 - DNA, 25 bp, Rattus norvegicus
ccagcggcgcggcaggtccatgcga

SEQ ID NO: 245003 - DNA, 25 bp, Rattus norvegicus
ccagcggcgcgggaggtccatgcga

SEQ ID NO: 245004 - DNA, 25 bp, Rattus norvegicus
ccagcgggaggcacatactacatga

SEQ ID NO: 245005 - DNA, 25 bp, Rattus norvegicus
ccagcgggaggctcatactacatga

SEQ ID NO: 245006 - DNA, 25 bp, Rattus norvegicus
ccagcgggtttcaggaggcttaagc

SEQ ID NO: 245007 - DNA, 25 bp, Rattus norvegicus
ccagcgggtttctggaggcttaagc

SEQ ID NO: 245008 - DNA, 25 bp, Rattus norvegicus
ccagcggttgttctgtgaggtctat

SEQ ID NO: 245009 - DNA, 25 bp, Rattus norvegicus
ccagcggttgttgtgtgaggtctat

SEQ ID NO: 245010 - DNA, 25 bp, Rattus norvegicus
ccagcgtcactgctgcatgagcaga

SEQ ID NO: 245011 - DNA, 25 bp, Rattus norvegicus
ccagcgtcactggtgcatgagcaga

SEQ ID NO: 245012 - DNA, 25 bp, Rattus norvegicus
ccagcgtgcacacctgggtgaagtt

SEQ ID NO: 245013 - DNA, 25 bp, Rattus norvegicus
ccagcgtgcacagctgggtgaagtt

SEQ ID NO: 245014 - DNA, 25 bp, Rattus norvegicus
ccagcgtgcccaaggtgcccaaggg

SEQ ID NO: 245015 - DNA, 25 bp, Rattus norvegicus
ccagcgtgcccatggtgcccaaggg

SEQ ID NO: 245016 - DNA, 25 bp, Rattus norvegicus
ccagcgtggcatcccctttgggagt

SEQ ID NO: 245017 - DNA, 25 bp, Rattus norvegicus
ccagcgtggcatgccctttgggagt

SEQ ID NO: 245018 - DNA, 25 bp, Rattus norvegicus
ccagcgttaaagagcagacccattt

SEQ ID NO: 245019 - DNA, 25 bp, Rattus norvegicus
ccagcgttaaagtgcagacccattt

SEQ ID NO: 245020 - DNA, 25 bp, Rattus norvegicus
ccagcgtttagtacagcactgaaga

SEQ ID NO: 245021 - DNA, 25 bp, Rattus norvegicus
ccagcgtttagttcagcactgaaga

SEQ ID NO: 245022 - DNA, 25 bp, Rattus norvegicus
ccagctaaacatccttcatcgtcgg

SEQ ID NO: 245023 - DNA, 25 bp, Rattus norvegicus
ccagctaaacatgcttcatcgtcgg

SEQ ID NO: 245024 - DNA, 25 bp, Rattus norvegicus
ccagctacctgcatttgacagcaaa

SEQ ID NO: 245025 - DNA, 25 bp, Rattus norvegicus
ccagctacctgcttttgacagcaaa

SEQ ID NO: 245026 - DNA, 25 bp, Rattus norvegicus
ccagctaccttgattcctagatgga

SEQ ID NO: 245027 - DNA, 25 bp, Rattus norvegicus
ccagctaccttgtttcctagatgga

SEQ ID NO: 245028 - DNA, 25 bp, Rattus norvegicus
ccagctagggctacgtagtgaggtc

SEQ ID NO: 245029 - DNA, 25 bp, Rattus norvegicus
ccagctagggcttcgtagtgaggtc

SEQ ID NO: 245030 - DNA, 25 bp, Rattus norvegicus
ccagctagtcctcccgaaggagaaa

SEQ ID NO: 245031 - DNA, 25 bp, Rattus norvegicus
ccagctagtcctgccgaaggagaaa

SEQ ID NO: 245032 - DNA, 25 bp, Rattus norvegicus
ccagctatagctcaccacaagatta

SEQ ID NO: 245033 - DNA, 25 bp, Rattus norvegicus
ccagctatagctgaccacaagatta

SEQ ID NO: 245034 - DNA, 25 bp, Rattus norvegicus
ccagctatcaacacgcgccctggaa

SEQ ID NO: 245035 - DNA, 25 bp, Rattus norvegicus
ccagctatcaactcgcgccctggaa

SEQ ID NO: 245036 - DNA, 25 bp, Rattus norvegicus
ccagctatccaactattaaagtcca

SEQ ID NO: 245037 - DNA, 25 bp, Rattus norvegicus
ccagctatccaagtattaaagtcca

SEQ ID NO: 245038 - DNA, 25 bp, Rattus norvegicus
ccagctatccccaggtgaatggtgg

SEQ ID NO: 245039 - DNA, 25 bp, Rattus norvegicus
ccagctatcccctggtgaatggtgg

SEQ ID NO: 245040 - DNA, 25 bp, Rattus norvegicus
ccagctatgccaaggctcagagtac

SEQ ID NO: 245041 - DNA, 25 bp, Rattus norvegicus
ccagctatgccatggctcagagtac

SEQ ID NO: 245042 - DNA, 25 bp, Rattus norvegicus
ccagctattgctccacatgtgtgca

SEQ ID NO: 245043 - DNA, 25 bp, Rattus norvegicus
ccagctattgctgcacatgtgtgca

SEQ ID NO: 245044 - DNA, 25 bp, Rattus norvegicus
ccagctcactgtatcatgccagtaa

SEQ ID NO: 245045 - DNA, 25 bp, Rattus norvegicus
ccagctcactgtttcatgccagtaa

SEQ ID NO: 245046 - DNA, 25 bp, Rattus norvegicus
ccagctcagaagatgctcgggacta

SEQ ID NO: 245047 - DNA, 25 bp, Rattus norvegicus
ccagctcagaagttgctcgggacta

SEQ ID NO: 245048 - DNA, 25 bp, Rattus norvegicus
ccagctcagaccacagaggtggcaa

SEQ ID NO: 245049 - DNA, 25 bp, Rattus norvegicus
ccagctcagacctcagaggtggcaa

SEQ ID NO: 245050 - DNA, 25 bp, Rattus norvegicus
ccagctcagggaaactccttacaag

SEQ ID NO: 245051 - DNA, 25 bp, Rattus norvegicus
ccagctcagggatactccttacaag

SEQ ID NO: 245052 - DNA, 25 bp, Rattus norvegicus
ccagctcagggccatgattgtttat

SEQ ID NO: 245053 - DNA, 25 bp, Rattus norvegicus
ccagctcagggcgatgattgtttat

SEQ ID NO: 245054 - DNA, 25 bp, Rattus norvegicus
ccagctcatgctcaaggagtgaacc

SEQ ID NO: 245055 - DNA, 25 bp, Rattus norvegicus
ccagctcatgctgaaggagtgaacc

SEQ ID NO: 245056 - DNA, 25 bp, Rattus norvegicus
ccagctccaaggagggctcagggaa

SEQ ID NO: 245057 - DNA, 25 bp, Rattus norvegicus
ccagctccaaggtgggctcagggaa

SEQ ID NO: 245058 - DNA, 25 bp, Rattus norvegicus
ccagctccacaaccgtgtttgagtg

SEQ ID NO: 245059 - DNA, 25 bp, Rattus norvegicus
ccagctccacaagcgtgtttgagtg

SEQ ID NO: 245060 - DNA, 25 bp, Rattus norvegicus
ccagctccagtaatccctaaggtga

SEQ ID NO: 245061 - DNA, 25 bp, Rattus norvegicus
ccagctccagtattccctaaggtga

SEQ ID NO: 245062 - DNA, 25 bp, Rattus norvegicus
ccagctcccagacttcagagaaaga

SEQ ID NO: 245063 - DNA, 25 bp, Rattus norvegicus
ccagctcccagagttcagagaaaga

SEQ ID NO: 245064 - DNA, 25 bp, Rattus norvegicus
ccagctcccaggcaagcagttgctg

SEQ ID NO: 245065 - DNA, 25 bp, Rattus norvegicus
ccagctcccagggaagcagttgctg

SEQ ID NO: 245066 - DNA, 25 bp, Rattus norvegicus
ccagctcccatgcaaacaacttaaa

SEQ ID NO: 245067 - DNA, 25 bp, Rattus norvegicus
ccagctcccatggaaacaacttaaa

SEQ ID NO: 245068 - DNA, 25 bp, Rattus norvegicus
ccagctcccctacagagagatcagg

SEQ ID NO: 245069 - DNA, 25 bp, Rattus norvegicus
ccagctcccctagagagagatcagg

SEQ ID NO: 245070 - DNA, 25 bp, Rattus norvegicus
ccagctccctgtagccagatggaga

SEQ ID NO: 245071 - DNA, 25 bp, Rattus norvegicus
ccagctccctgttgccagatggaga

SEQ ID NO: 245072 - DNA, 25 bp, Rattus norvegicus
ccagctccgcgaaggcccgaagtgg

SEQ ID NO: 245073 - DNA, 25 bp, Rattus norvegicus
ccagctccgcgatggcccgaagtgg

SEQ ID NO: 245074 - DNA, 25 bp, Rattus norvegicus
ccagctctacccatgtatatttcta

SEQ ID NO: 245075 - DNA, 25 bp, Rattus norvegicus
ccagctctacccttgtatatttcta

SEQ ID NO: 245076 - DNA, 25 bp, Rattus norvegicus
ccagctctagccaaggtttttaggg

SEQ ID NO: 245077 - DNA, 25 bp, Rattus norvegicus
ccagctctagcctaggtttttaggg

SEQ ID NO: 245078 - DNA, 25 bp, Rattus norvegicus
ccagctctattacctactgcaagaa

SEQ ID NO: 245079 - DNA, 25 bp, Rattus norvegicus
ccagctctattagctactgcaagaa

SEQ ID NO: 245080 - DNA, 25 bp, Rattus norvegicus
ccagctctccatcttctaactgaat

SEQ ID NO: 245081 - DNA, 25 bp, Rattus norvegicus
ccagctctccatgttctaactgaat

SEQ ID NO: 245082 - DNA, 25 bp, Rattus norvegicus
ccagctctcgggaagctgaggctga

SEQ ID NO: 245083 - DNA, 25 bp, Rattus norvegicus
ccagctctcgggtagctgaggctga

SEQ ID NO: 245084 - DNA, 25 bp, Rattus norvegicus
ccagctctgcataaaaccgggtgtg

SEQ ID NO: 245085 - DNA, 25 bp, Rattus norvegicus
ccagctctgcattaaaccgggtgtg

SEQ ID NO: 245086 - DNA, 25 bp, Rattus norvegicus
ccagctctgcttcctgaaactggaa

SEQ ID NO: 245087 - DNA, 25 bp, Rattus norvegicus
ccagctctgcttgctgaaactggaa

SEQ ID NO: 245088 - DNA, 25 bp, Rattus norvegicus
ccagctctggcacaaggcagcaata

SEQ ID NO: 245089 - DNA, 25 bp, Rattus norvegicus
ccagctctggcagaaggcagcaata

SEQ ID NO: 245090 - DNA, 25 bp, Rattus norvegicus
ccagctctgtggactctaatcatat

SEQ ID NO: 245091 - DNA, 25 bp, Rattus norvegicus
ccagctctgtggtctctaatcatat

SEQ ID NO: 245092 - DNA, 25 bp, Rattus norvegicus
ccagctgaacacatctggtccatgt

SEQ ID NO: 245093 - DNA, 25 bp, Rattus norvegicus
ccagctgaacacttctggtccatgt

SEQ ID NO: 245094 - DNA, 25 bp, Rattus norvegicus
ccagctgaacagaccgaggcatagg

SEQ ID NO: 245095 - DNA, 25 bp, Rattus norvegicus
ccagctgaacagtccgaggcatagg

SEQ ID NO: 245096 - DNA, 25 bp, Rattus norvegicus
ccagctgaacccaaactacaagtgg

SEQ ID NO: 245097 - DNA, 25 bp, Rattus norvegicus
ccagctgaaccctaactacaagtgg

SEQ ID NO: 245098 - DNA, 25 bp, Rattus norvegicus
ccagctgacatgcttgtggtccctt

SEQ ID NO: 245099 - DNA, 25 bp, Rattus norvegicus
ccagctgacatggttgtggtccctt

SEQ ID NO: 245100 - DNA, 25 bp, Rattus norvegicus
ccagctgacccacgtttctttctag

SEQ ID NO: 245101 - DNA, 25 bp, Rattus norvegicus
ccagctgacccaggtttctttctag

SEQ ID NO: 245102 - DNA, 25 bp, Rattus norvegicus
ccagctgagggcatagcttccagaa

SEQ ID NO: 245103 - DNA, 25 bp, Rattus norvegicus
ccagctgagggcttagcttccagaa

SEQ ID NO: 245104 - DNA, 25 bp, Rattus norvegicus
ccagctgattctcgcgtaggagaga

SEQ ID NO: 245105 - DNA, 25 bp, Rattus norvegicus
ccagctgattctggcgtaggagaga

SEQ ID NO: 245106 - DNA, 25 bp, Rattus norvegicus
ccagctgcacttaaaccttagggca

SEQ ID NO: 245107 - DNA, 25 bp, Rattus norvegicus
ccagctgcactttaaccttagggca

SEQ ID NO: 245108 - DNA, 25 bp, Rattus norvegicus
ccagctgcagcgacatggcacggtg

SEQ ID NO: 245109 - DNA, 25 bp, Rattus norvegicus
ccagctgcagcgtcatggcacggtg

SEQ ID NO: 245110 - DNA, 25 bp, Rattus norvegicus
ccagctgccagtcagtgtgagcttt

SEQ ID NO: 245111 - DNA, 25 bp, Rattus norvegicus
ccagctgccagtgagtgtgagcttt

SEQ ID NO: 245112 - DNA, 25 bp, Rattus norvegicus
ccagctgcccgtcatcgagaacaag

SEQ ID NO: 245113 - DNA, 25 bp, Rattus norvegicus
ccagctgcccgtgatcgagaacaag

SEQ ID NO: 245114 - DNA, 25 bp, Rattus norvegicus
ccagctgcccttcacatgtaaaaag

SEQ ID NO: 245115 - DNA, 25 bp, Rattus norvegicus
ccagctgcccttgacatgtaaaaag

SEQ ID NO: 245116 - DNA, 25 bp, Rattus norvegicus
ccagctgcctgtattgcatggtatt

SEQ ID NO: 245117 - DNA, 25 bp, Rattus norvegicus
ccagctgcctgttttgcatggtatt

SEQ ID NO: 245118 - DNA, 25 bp, Rattus norvegicus
ccagctgctcacatccgttaagaag

SEQ ID NO: 245119 - DNA, 25 bp, Rattus norvegicus
ccagctgctcacttccgttaagaag

SEQ ID NO: 245120 - DNA, 25 bp, Rattus norvegicus
ccagctgctgacatctttgagggaa

SEQ ID NO: 245121 - DNA, 25 bp, Rattus norvegicus
ccagctgctgacttctttgagggaa

SEQ ID NO: 245122 - DNA, 25 bp, Rattus norvegicus
ccagctgctgccaagagtttaaaat

SEQ ID NO: 245123 - DNA, 25 bp, Rattus norvegicus
ccagctgctgcctagagtttaaaat

SEQ ID NO: 245124 - DNA, 25 bp, Rattus norvegicus
ccagctggaagacctcgtgatcgag

SEQ ID NO: 245125 - DNA, 25 bp, Rattus norvegicus
ccagctggaagagctcgtgatcgag

SEQ ID NO: 245126 - DNA, 25 bp, Rattus norvegicus
ccagctggagtaccggcaacaccta

SEQ ID NO: 245127 - DNA, 25 bp, Rattus norvegicus
ccagctggagtagcggcaacaccta

SEQ ID NO: 245128 - DNA, 25 bp, Rattus norvegicus
ccagctggctatcttcctattcgaa

SEQ ID NO: 245129 - DNA, 25 bp, Rattus norvegicus
ccagctggctatgttcctattcgaa

SEQ ID NO: 245130 - DNA, 25 bp, Rattus norvegicus
ccagctgggaatctggaagcctgcc

SEQ ID NO: 245131 - DNA, 25 bp, Rattus norvegicus
ccagctgggaatgtggaagcctgcc

SEQ ID NO: 245132 - DNA, 25 bp, Rattus norvegicus
ccagctgggtgaagccggctacata

SEQ ID NO: 245133 - DNA, 25 bp, Rattus norvegicus
ccagctgggtgatgccggctacata

SEQ ID NO: 245134 - DNA, 25 bp, Rattus norvegicus
ccagctgggttcaatcctctcatca

SEQ ID NO: 245135 - DNA, 25 bp, Rattus norvegicus
ccagctgggttctatcctctcatca

SEQ ID NO: 245136 - DNA, 25 bp, Rattus norvegicus
ccagctggtggtctagacttcgatg

SEQ ID NO: 245137 - DNA, 25 bp, Rattus norvegicus
ccagctggtggtgtagacttcgatg

SEQ ID NO: 245138 - DNA, 25 bp, Rattus norvegicus
ccagctggttttactcctacaaaga

SEQ ID NO: 245139 - DNA, 25 bp, Rattus norvegicus
ccagctggtttttctcctacaaaga

SEQ ID NO: 245140 - DNA, 25 bp, Rattus norvegicus
ccagctgtacaaacctgcactttga

SEQ ID NO: 245141 - DNA, 25 bp, Rattus norvegicus
ccagctgtacaatcctgcactttga

SEQ ID NO: 245142 - DNA, 25 bp, Rattus norvegicus
ccagctgtcagtacactcgtagaaa

SEQ ID NO: 245143 - DNA, 25 bp, Rattus norvegicus
ccagctgtcagttcactcgtagaaa

SEQ ID NO: 245144 - DNA, 25 bp, Rattus norvegicus
ccagctgtcattcttatcctaattg

SEQ ID NO: 245145 - DNA, 25 bp, Rattus norvegicus
ccagctgtcattgttatcctaattg

SEQ ID NO: 245146 - DNA, 25 bp, Rattus norvegicus
ccagctgtccaccaatggctttgat

SEQ ID NO: 245147 - DNA, 25 bp, Rattus norvegicus
ccagctgtccacgaatggctttgat

SEQ ID NO: 245148 - DNA, 25 bp, Rattus norvegicus
ccagctgtggcaaggttcccataaa

SEQ ID NO: 245149 - DNA, 25 bp, Rattus norvegicus
ccagctgtggcatggttcccataaa

SEQ ID NO: 245150 - DNA, 25 bp, Rattus norvegicus
ccagctgttcttagtggtggcacat

SEQ ID NO: 245151 - DNA, 25 bp, Rattus norvegicus
ccagctgttctttgtggtggcacat

SEQ ID NO: 245152 - DNA, 25 bp, Rattus norvegicus
ccagctgttgccagcgtttggaaaa

SEQ ID NO: 245153 - DNA, 25 bp, Rattus norvegicus
ccagctgttgcctgcgtttggaaaa

SEQ ID NO: 245154 - DNA, 25 bp, Rattus norvegicus
ccagctgttgtcagccatacagaag

SEQ ID NO: 245155 - DNA, 25 bp, Rattus norvegicus
ccagctgttgtctgccatacagaag

SEQ ID NO: 245156 - DNA, 25 bp, Rattus norvegicus
ccagctgttttcctcattgatcaga

SEQ ID NO: 245157 - DNA, 25 bp, Rattus norvegicus
ccagctgttttcgtcattgatcaga

SEQ ID NO: 245158 - DNA, 25 bp, Rattus norvegicus
ccagcttaaaccagactacccaagg

SEQ ID NO: 245159 - DNA, 25 bp, Rattus norvegicus
ccagcttaaacctgactacccaagg

SEQ ID NO: 245160 - DNA, 25 bp, Rattus norvegicus
ccagcttactccaattcattacaaa

SEQ ID NO: 245161 - DNA, 25 bp, Rattus norvegicus
ccagcttactcctattcattacaaa

SEQ ID NO: 245162 - DNA, 25 bp, Rattus norvegicus
ccagcttattccagacttgaaagca

SEQ ID NO: 245163 - DNA, 25 bp, Rattus norvegicus
ccagcttattcctgacttgaaagca

SEQ ID NO: 245164 - DNA, 25 bp, Rattus norvegicus
ccagcttatttcagaggtctctcta

SEQ ID NO: 245165 - DNA, 25 bp, Rattus norvegicus
ccagcttatttctgaggtctctcta

SEQ ID NO: 245166 - DNA, 25 bp, Rattus norvegicus
ccagcttcagataacccacaaatgt

SEQ ID NO: 245167 - DNA, 25 bp, Rattus norvegicus
ccagcttcagattacccacaaatgt

SEQ ID NO: 245168 - DNA, 25 bp, Rattus norvegicus
ccagcttccccaagatgtgattcaa

SEQ ID NO: 245169 - DNA, 25 bp, Rattus norvegicus
ccagcttccccatgatgtgattcaa

SEQ ID NO: 245170 - DNA, 25 bp, Rattus norvegicus
ccagcttccttcattgaacttgcta

SEQ ID NO: 245171 - DNA, 25 bp, Rattus norvegicus
ccagcttccttctttgaacttgcta

SEQ ID NO: 245172 - DNA, 25 bp, Rattus norvegicus
ccagcttcgcgtcgccaaagtgaca

SEQ ID NO: 245173 - DNA, 25 bp, Rattus norvegicus
ccagcttcgcgtggccaaagtgaca

SEQ ID NO: 245174 - DNA, 25 bp, Rattus norvegicus
ccagcttctggtcatgtgtgttcaa

SEQ ID NO: 245175 - DNA, 25 bp, Rattus norvegicus
ccagcttctggtgatgtgtgttcaa

SEQ ID NO: 245176 - DNA, 25 bp, Rattus norvegicus
ccagcttctttgcatgtgctagcca

SEQ ID NO: 245177 - DNA, 25 bp, Rattus norvegicus
ccagcttctttggatgtgctagcca

SEQ ID NO: 245178 - DNA, 25 bp, Rattus norvegicus
ccagcttgctcaccgaggacaagag

SEQ ID NO: 245179 - DNA, 25 bp, Rattus norvegicus
ccagcttgctcagcgaggacaagag

SEQ ID NO: 245180 - DNA, 25 bp, Rattus norvegicus
ccagcttgctggagtggtttagaga

SEQ ID NO: 245181 - DNA, 25 bp, Rattus norvegicus
ccagcttgctggtgtggtttagaga

SEQ ID NO: 245182 - DNA, 25 bp, Rattus norvegicus
ccagcttggccacctgatggagaat

SEQ ID NO: 245183 - DNA, 25 bp, Rattus norvegicus
ccagcttggccagctgatggagaat

SEQ ID NO: 245184 - DNA, 25 bp, Rattus norvegicus
ccagcttggccgcaacatgagggct

SEQ ID NO: 245185 - DNA, 25 bp, Rattus norvegicus
ccagcttggccggaacatgagggct

SEQ ID NO: 245186 - DNA, 25 bp, Rattus norvegicus
ccagcttgggtgagtcatgcgtggg

SEQ ID NO: 245187 - DNA, 25 bp, Rattus norvegicus
ccagcttgggtgtgtcatgcgtggg

SEQ ID NO: 245188 - DNA, 25 bp, Rattus norvegicus
ccagcttgtgcactttgggtgagca

SEQ ID NO: 245189 - DNA, 25 bp, Rattus norvegicus
ccagcttgtgcagtttgggtgagca

SEQ ID NO: 245190 - DNA, 25 bp, Rattus norvegicus
ccagcttgttctcttcttactgtta

SEQ ID NO: 245191 - DNA, 25 bp, Rattus norvegicus
ccagcttgttctgttcttactgtta

SEQ ID NO: 245192 - DNA, 25 bp, Rattus norvegicus
ccagctttacacctgtcagttcttt

SEQ ID NO: 245193 - DNA, 25 bp, Rattus norvegicus
ccagctttacacgtgtcagttcttt

SEQ ID NO: 245194 - DNA, 25 bp, Rattus norvegicus
ccagctttacctcgatgatctcttt

SEQ ID NO: 245195 - DNA, 25 bp, Rattus norvegicus
ccagctttacctggatgatctcttt

SEQ ID NO: 245196 - DNA, 25 bp, Rattus norvegicus
ccagctttccagattttattctgtg

SEQ ID NO: 245197 - DNA, 25 bp, Rattus norvegicus
ccagctttccagtttttattctgtg

SEQ ID NO: 245198 - DNA, 25 bp, Rattus norvegicus
ccagctttctctagtggtgaacacc

SEQ ID NO: 245199 - DNA, 25 bp, Rattus norvegicus
ccagctttctcttgtggtgaacacc

SEQ ID NO: 245200 - DNA, 25 bp, Rattus norvegicus
ccagctttctgtagttgtggtgaac

SEQ ID NO: 245201 - DNA, 25 bp, Rattus norvegicus
ccagctttctgttgttgtggtgaac

SEQ ID NO: 245202 - DNA, 25 bp, Rattus norvegicus
ccagctttggttctgagaccgtatt

SEQ ID NO: 245203 - DNA, 25 bp, Rattus norvegicus
ccagctttggttgtgagaccgtatt

SEQ ID NO: 245204 - DNA, 25 bp, Rattus norvegicus
ccagcttttaccacttgcgtataat

SEQ ID NO: 245205 - DNA, 25 bp, Rattus norvegicus
ccagcttttacctcttgcgtataat

SEQ ID NO: 245206 - DNA, 25 bp, Rattus norvegicus
ccagctttttgcagcactgattgca

SEQ ID NO: 245207 - DNA, 25 bp, Rattus norvegicus
ccagctttttgctgcactgattgca

SEQ ID NO: 245208 - DNA, 25 bp, Rattus norvegicus
ccaggaaaacgactgctgcctttag

SEQ ID NO: 245209 - DNA, 25 bp, Rattus norvegicus
ccaggaaaacgagtgctgcctttag

SEQ ID NO: 245210 - DNA, 25 bp, Rattus norvegicus
ccaggaacattaacagtgattgatt

SEQ ID NO: 245211 - DNA, 25 bp, Rattus norvegicus
ccaggaacattatcagtgattgatt

SEQ ID NO: 245212 - DNA, 25 bp, Rattus norvegicus
ccaggaactctcattcttagatggt

SEQ ID NO: 245213 - DNA, 25 bp, Rattus norvegicus
ccaggaactctctttcttagatggt

SEQ ID NO: 245214 - DNA, 25 bp, Rattus norvegicus
ccaggaagggctagagaccggacta

SEQ ID NO: 245215 - DNA, 25 bp, Rattus norvegicus
ccaggaagggcttgagaccggacta

SEQ ID NO: 245216 - DNA, 25 bp, Rattus norvegicus
ccaggaatctccacgactgtgatgt

SEQ ID NO: 245217 - DNA, 25 bp, Rattus norvegicus
ccaggaatctcctcgactgtgatgt

SEQ ID NO: 245218 - DNA, 25 bp, Rattus norvegicus
ccaggaatgcttagggccaggctga

SEQ ID NO: 245219 - DNA, 25 bp, Rattus norvegicus
ccaggaatgctttgggccaggctga

SEQ ID NO: 245220 - DNA, 25 bp, Rattus norvegicus
ccaggacaactgaggcacgtgatat

SEQ ID NO: 245221 - DNA, 25 bp, Rattus norvegicus
ccaggacaactgtggcacgtgatat

SEQ ID NO: 245222 - DNA, 25 bp, Rattus norvegicus
ccaggacaacttcccatctttgagc

SEQ ID NO: 245223 - DNA, 25 bp, Rattus norvegicus
ccaggacaacttgccatctttgagc

SEQ ID NO: 245224 - DNA, 25 bp, Rattus norvegicus
ccaggacaatcacggttgttacaca

SEQ ID NO: 245225 - DNA, 25 bp, Rattus norvegicus
ccaggacaatcagggttgttacaca

SEQ ID NO: 245226 - DNA, 25 bp, Rattus norvegicus
ccaggacacagtacattgagggaag

SEQ ID NO: 245227 - DNA, 25 bp, Rattus norvegicus
ccaggacacagtcctctgtcattta

SEQ ID NO: 245228 - DNA, 25 bp, Rattus norvegicus
ccaggacacagtgctctgtcattta

SEQ ID NO: 245229 - DNA, 25 bp, Rattus norvegicus
ccaggacacagttcattgagggaag

SEQ ID NO: 245230 - DNA, 25 bp, Rattus norvegicus
ccaggacacccaagccagagaacat

SEQ ID NO: 245231 - DNA, 25 bp, Rattus norvegicus
ccaggacacccatgccagagaacat

SEQ ID NO: 245232 - DNA, 25 bp, Rattus norvegicus
ccaggacaccctcggctgcagtgta

SEQ ID NO: 245233 - DNA, 25 bp, Rattus norvegicus
ccaggacaccctgggctgcagtgta

SEQ ID NO: 245234 - DNA, 25 bp, Rattus norvegicus
ccaggacagctcagactacatagtg

SEQ ID NO: 245235 - DNA, 25 bp, Rattus norvegicus
ccaggacagctctgactacatagtg

SEQ ID NO: 245236 - DNA, 25 bp, Rattus norvegicus
ccaggacaggacaccttactctgtt

SEQ ID NO: 245237 - DNA, 25 bp, Rattus norvegicus
ccaggacaggactccttactctgtt

SEQ ID NO: 245238 - DNA, 25 bp, Rattus norvegicus
ccaggacagggtataacttctccag

SEQ ID NO: 245239 - DNA, 25 bp, Rattus norvegicus
ccaggacagggtttaacttctccag

SEQ ID NO: 245240 - DNA, 25 bp, Rattus norvegicus
ccaggacagtgtccaggatgccaca

SEQ ID NO: 245241 - DNA, 25 bp, Rattus norvegicus
ccaggacagtgtgcaggatgccaca

SEQ ID NO: 245242 - DNA, 25 bp, Rattus norvegicus
ccaggacatggacttgtagtagaaa

SEQ ID NO: 245243 - DNA, 25 bp, Rattus norvegicus
ccaggacatggagttgtagtagaaa

SEQ ID NO: 245244 - DNA, 25 bp, Rattus norvegicus
ccaggacatgggagctgctgccttg

SEQ ID NO: 245245 - DNA, 25 bp, Rattus norvegicus
ccaggacatgggtgctgctgccttg

SEQ ID NO: 245246 - DNA, 25 bp, Rattus norvegicus
ccaggaccaccaccagggcgtagag

SEQ ID NO: 245247 - DNA, 25 bp, Rattus norvegicus
ccaggaccaccagcagggcgtagag

SEQ ID NO: 245248 - DNA, 25 bp, Rattus norvegicus
ccaggaccactgatctttttgtgtc

SEQ ID NO: 245249 - DNA, 25 bp, Rattus norvegicus
ccaggaccactgttctttttgtgtc

SEQ ID NO: 245250 - DNA, 25 bp, Rattus norvegicus
ccaggacccacactctaggaggaga

SEQ ID NO: 245251 - DNA, 25 bp, Rattus norvegicus
ccaggacccacagtctaggaggaga

SEQ ID NO: 245252 - DNA, 25 bp, Rattus norvegicus
ccaggaccccaacccttggagatga

SEQ ID NO: 245253 - DNA, 25 bp, Rattus norvegicus
ccaggaccccaagccttggagatga

SEQ ID NO: 245254 - DNA, 25 bp, Rattus norvegicus
ccaggacctctgaatctggtcaaga

SEQ ID NO: 245255 - DNA, 25 bp, Rattus norvegicus
ccaggacctctgtatctggtcaaga

SEQ ID NO: 245256 - DNA, 25 bp, Rattus norvegicus
ccaggacctcttatgcagtgtgcta

SEQ ID NO: 245257 - DNA, 25 bp, Rattus norvegicus
ccaggacctcttttgcagtgtgcta

SEQ ID NO: 245258 - DNA, 25 bp, Rattus norvegicus
ccaggacctggacatgcagctcagt

SEQ ID NO: 245259 - DNA, 25 bp, Rattus norvegicus
ccaggacctggagatgcagctcagt

SEQ ID NO: 245260 - DNA, 25 bp, Rattus norvegicus
ccaggacgttcacgactacacagag

SEQ ID NO: 245261 - DNA, 25 bp, Rattus norvegicus
ccaggacgttcaggactacacagag

SEQ ID NO: 245262 - DNA, 25 bp, Rattus norvegicus
ccaggactatagagaccttacctca

SEQ ID NO: 245263 - DNA, 25 bp, Rattus norvegicus
ccaggactatagtgaccttacctca

SEQ ID NO: 245264 - DNA, 25 bp, Rattus norvegicus
ccaggactccagcaaggcttgccgg

SEQ ID NO: 245265 - DNA, 25 bp, Rattus norvegicus
ccaggactccaggaaggcttgccgg

SEQ ID NO: 245266 - DNA, 25 bp, Rattus norvegicus
ccaggactcccaacagaacttgttt

SEQ ID NO: 245267 - DNA, 25 bp, Rattus norvegicus
ccaggactcccatcagaacttgttt

SEQ ID NO: 245268 - DNA, 25 bp, Rattus norvegicus
ccaggactccctcatcagtagagag

SEQ ID NO: 245269 - DNA, 25 bp, Rattus norvegicus
ccaggactccctgatcagtagagag

SEQ ID NO: 245270 - DNA, 25 bp, Rattus norvegicus
ccaggactctgaaggtaatcgggtt

SEQ ID NO: 245271 - DNA, 25 bp, Rattus norvegicus
ccaggactctgatggtaatcgggtt

SEQ ID NO: 245272 - DNA, 25 bp, Rattus norvegicus
ccaggactggttcgatggcctcatg

SEQ ID NO: 245273 - DNA, 25 bp, Rattus norvegicus
ccaggactggttggatggcctcatg

SEQ ID NO: 245274 - DNA, 25 bp, Rattus norvegicus
ccaggagacctcagtggatgtcatt

SEQ ID NO: 245275 - DNA, 25 bp, Rattus norvegicus
ccaggagacctctgtggatgtcatt

SEQ ID NO: 245276 - DNA, 25 bp, Rattus norvegicus
ccaggagactctagcggttcaggga

SEQ ID NO: 245277 - DNA, 25 bp, Rattus norvegicus
ccaggagactcttgcggttcaggga

SEQ ID NO: 245278 - DNA, 25 bp, Rattus norvegicus
ccaggagaggatcacttggactttg

SEQ ID NO: 245279 - DNA, 25 bp, Rattus norvegicus
ccaggagaggatgacttggactttg

SEQ ID NO: 245280 - DNA, 25 bp, Rattus norvegicus
ccaggagaggtgaccttggctacta

SEQ ID NO: 245281 - DNA, 25 bp, Rattus norvegicus
ccaggagaggtgtccttggctacta

SEQ ID NO: 245282 - DNA, 25 bp, Rattus norvegicus
ccaggagattggacacttagtgttc

SEQ ID NO: 245283 - DNA, 25 bp, Rattus norvegicus
ccaggagattggtcacttagtgttc

SEQ ID NO: 245284 - DNA, 25 bp, Rattus norvegicus
ccaggagcaccgagggaagcacagt

SEQ ID NO: 245285 - DNA, 25 bp, Rattus norvegicus
ccaggagcaccgtgggaagcacagt

SEQ ID NO: 245286 - DNA, 25 bp, Rattus norvegicus
ccaggagcatttaattcagatgcta

SEQ ID NO: 245287 - DNA, 25 bp, Rattus norvegicus
ccaggagcattttattcagatgcta

SEQ ID NO: 245288 - DNA, 25 bp, Rattus norvegicus
ccaggagccccaaaggcttgtgaat

SEQ ID NO: 245289 - DNA, 25 bp, Rattus norvegicus
ccaggagccccataggcttgtgaat

SEQ ID NO: 245290 - DNA, 25 bp, Rattus norvegicus
ccaggagccccgcagcaagtagaaa

SEQ ID NO: 245291 - DNA, 25 bp, Rattus norvegicus
ccaggagccccggagcaagtagaaa

SEQ ID NO: 245292 - DNA, 25 bp, Rattus norvegicus
ccaggagccgtcagagcccaaggag

SEQ ID NO: 245293 - DNA, 25 bp, Rattus norvegicus
ccaggagccgtctgagcccaaggag

SEQ ID NO: 245294 - DNA, 25 bp, Rattus norvegicus
ccaggagctattcgcacaccactat

SEQ ID NO: 245295 - DNA, 25 bp, Rattus norvegicus
ccaggagctattcgccaagcttcgg

SEQ ID NO: 245296 - DNA, 25 bp, Rattus norvegicus
ccaggagctattggcacaccactat

SEQ ID NO: 245297 - DNA, 25 bp, Rattus norvegicus
ccaggagctattggccaagcttcgg

SEQ ID NO: 245298 - DNA, 25 bp, Rattus norvegicus
ccaggagctcaaaggtgaaccagac

SEQ ID NO: 245299 - DNA, 25 bp, Rattus norvegicus
ccaggagctcaatggtgaaccagac

SEQ ID NO: 245300 - DNA, 25 bp, Rattus norvegicus
ccaggagctccaaggctgaggacaa

SEQ ID NO: 245301 - DNA, 25 bp, Rattus norvegicus
ccaggagctccatggctgaggacaa

SEQ ID NO: 245302 - DNA, 25 bp, Rattus norvegicus
ccaggagctgcacttggctgtaagc

SEQ ID NO: 245303 - DNA, 25 bp, Rattus norvegicus
ccaggagctgcagttggctgtaagc

SEQ ID NO: 245304 - DNA, 25 bp, Rattus norvegicus
ccaggagctggcactctgtatagga

SEQ ID NO: 245305 - DNA, 25 bp, Rattus norvegicus
ccaggagctggctctctgtatagga

SEQ ID NO: 245306 - DNA, 25 bp, Rattus norvegicus
ccaggagctggtcatggtttcccat

SEQ ID NO: 245307 - DNA, 25 bp, Rattus norvegicus
ccaggagctggtgatggtttcccat

SEQ ID NO: 245308 - DNA, 25 bp, Rattus norvegicus
ccaggaggaccacgatcttgccaaa

SEQ ID NO: 245309 - DNA, 25 bp, Rattus norvegicus
ccaggaggaccaggatcttgccaaa

SEQ ID NO: 245310 - DNA, 25 bp, Rattus norvegicus
ccaggaggcgctcaataagctgcta

SEQ ID NO: 245311 - DNA, 25 bp, Rattus norvegicus
ccaggaggcgctgaataagctgcta

SEQ ID NO: 245312 - DNA, 25 bp, Rattus norvegicus
ccaggagggccaaagactcattagt

SEQ ID NO: 245313 - DNA, 25 bp, Rattus norvegicus
ccaggagggccatagactcattagt

SEQ ID NO: 245314 - DNA, 25 bp, Rattus norvegicus
ccaggagggcccattacatcgggtt

SEQ ID NO: 245315 - DNA, 25 bp, Rattus norvegicus
ccaggagggccctttacatcgggtt

SEQ ID NO: 245316 - DNA, 25 bp, Rattus norvegicus
ccaggagggctaccggacattgatt

SEQ ID NO: 245317 - DNA, 25 bp, Rattus norvegicus
ccaggagggctagcggacattgatt

SEQ ID NO: 245318 - DNA, 25 bp, Rattus norvegicus
ccaggaggtgctcactcgtgttgtt

SEQ ID NO: 245319 - DNA, 25 bp, Rattus norvegicus
ccaggaggtgctgactcgtgttgtt

SEQ ID NO: 245320 - DNA, 25 bp, Rattus norvegicus
ccaggaggtggcacaccgagaagtt

SEQ ID NO: 245321 - DNA, 25 bp, Rattus norvegicus
ccaggaggtggctcaccgagaagtt

SEQ ID NO: 245322 - DNA, 25 bp, Rattus norvegicus
ccaggagtcccaccatgtacaagta

SEQ ID NO: 245323 - DNA, 25 bp, Rattus norvegicus
ccaggagtcccagcatgtacaagta

SEQ ID NO: 245324 - DNA, 25 bp, Rattus norvegicus
ccaggagttcaacgtcgtcttgggc

SEQ ID NO: 245325 - DNA, 25 bp, Rattus norvegicus
ccaggagttcaaggtcgtcttgggc

SEQ ID NO: 245326 - DNA, 25 bp, Rattus norvegicus
ccaggatatgaaccaaggaacctta

SEQ ID NO: 245327 - DNA, 25 bp, Rattus norvegicus
ccaggatatgaagcaaggaacctta

SEQ ID NO: 245328 - DNA, 25 bp, Rattus norvegicus
ccaggatcaacaactcagagggaaa

SEQ ID NO: 245329 - DNA, 25 bp, Rattus norvegicus
ccaggatcaacatctcagagggaaa

SEQ ID NO: 245330 - DNA, 25 bp, Rattus norvegicus
ccaggatcactgctgctagctgcac

SEQ ID NO: 245331 - DNA, 25 bp, Rattus norvegicus
ccaggatcactggtgctagctgcac

SEQ ID NO: 245332 - DNA, 25 bp, Rattus norvegicus
ccaggatcgcagcacgtgatgccga

SEQ ID NO: 245333 - DNA, 25 bp, Rattus norvegicus
ccaggatcgcaggacgtgatgccga

SEQ ID NO: 245334 - DNA, 25 bp, Rattus norvegicus
ccaggatgatatattcaaggcccat

SEQ ID NO: 245335 - DNA, 25 bp, Rattus norvegicus
ccaggatgatattttcaaggcccat

SEQ ID NO: 245336 - DNA, 25 bp, Rattus norvegicus
ccaggatggaggatcacttgggcca

SEQ ID NO: 245337 - DNA, 25 bp, Rattus norvegicus
ccaggatggaggttcacttgggcca

SEQ ID NO: 245338 - DNA, 25 bp, Rattus norvegicus
ccaggatgtcatcggctatggagta

SEQ ID NO: 245339 - DNA, 25 bp, Rattus norvegicus
ccaggatgtcatgggctatggagta

SEQ ID NO: 245340 - DNA, 25 bp, Rattus norvegicus
ccaggatgttaccttggaacctcat

SEQ ID NO: 245341 - DNA, 25 bp, Rattus norvegicus
ccaggatgttacgttggaacctcat

SEQ ID NO: 245342 - DNA, 25 bp, Rattus norvegicus
ccaggatgttccagtgtccatttga

SEQ ID NO: 245343 - DNA, 25 bp, Rattus norvegicus
ccaggatgttcctgtgtccatttga

SEQ ID NO: 245344 - DNA, 25 bp, Rattus norvegicus
ccaggattccatatgactctgaaat

SEQ ID NO: 245345 - DNA, 25 bp, Rattus norvegicus
ccaggattccatttgactctgaaat

SEQ ID NO: 245346 - DNA, 25 bp, Rattus norvegicus
ccaggattggatattttgaacgtag

SEQ ID NO: 245347 - DNA, 25 bp, Rattus norvegicus
ccaggattggattttttgaacgtag

SEQ ID NO: 245348 - DNA, 25 bp, Rattus norvegicus
ccaggatttatgaccctgtgtgtgg

SEQ ID NO: 245349 - DNA, 25 bp, Rattus norvegicus
ccaggatttatgtccctgtgtgtgg

SEQ ID NO: 245350 - DNA, 25 bp, Rattus norvegicus
ccaggatttgggacccgaggtgcct

SEQ ID NO: 245351 - DNA, 25 bp, Rattus norvegicus
ccaggatttgggtcccgaggtgcct

SEQ ID NO: 245352 - DNA, 25 bp, Rattus norvegicus
ccaggcaaacctctactcagatttt

SEQ ID NO: 245353 - DNA, 25 bp, Rattus norvegicus
ccaggcaaacctgtactcagatttt

SEQ ID NO: 245354 - DNA, 25 bp, Rattus norvegicus
ccaggcaaatatagtggatgacttt

SEQ ID NO: 245355 - DNA, 25 bp, Rattus norvegicus
ccaggcaaatattgtggatgacttt

SEQ ID NO: 245356 - DNA, 25 bp, Rattus norvegicus
ccaggcacaaggcttcggagaccgc

SEQ ID NO: 245357 - DNA, 25 bp, Rattus norvegicus
ccaggcacaagggttcggagaccgc

SEQ ID NO: 245358 - DNA, 25 bp, Rattus norvegicus
ccaggcacaggtactcagcaataat

SEQ ID NO: 245359 - DNA, 25 bp, Rattus norvegicus
ccaggcacaggttctcagcaataat

SEQ ID NO: 245360 - DNA, 25 bp, Rattus norvegicus
ccaggcaccctaaaggtatctgtca

SEQ ID NO: 245361 - DNA, 25 bp, Rattus norvegicus
ccaggcaccctataggtatctgtca

SEQ ID NO: 245362 - DNA, 25 bp, Rattus norvegicus
ccaggcactgtgacgtgcccggagt

SEQ ID NO: 245363 - DNA, 25 bp, Rattus norvegicus
ccaggcactgtgtcgtgcccggagt

SEQ ID NO: 245364 - DNA, 25 bp, Rattus norvegicus
ccaggcacttggacttctaagcagt

SEQ ID NO: 245365 - DNA, 25 bp, Rattus norvegicus
ccaggcacttggtcttctaagcagt

SEQ ID NO: 245366 - DNA, 25 bp, Rattus norvegicus
ccaggcagccccactagaggaaaat

SEQ ID NO: 245367 - DNA, 25 bp, Rattus norvegicus
ccaggcagcccctctagaggaaaat

SEQ ID NO: 245368 - DNA, 25 bp, Rattus norvegicus
ccaggcagctgccaggatttacagt

SEQ ID NO: 245369 - DNA, 25 bp, Rattus norvegicus
ccaggcagctgcgaggatttacagt

SEQ ID NO: 245370 - DNA, 25 bp, Rattus norvegicus
ccaggcagggacatctcttgtagat

SEQ ID NO: 245371 - DNA, 25 bp, Rattus norvegicus
ccaggcagggacttctcttgtagat

SEQ ID NO: 245372 - DNA, 25 bp, Rattus norvegicus
ccaggcagtattagcactctcttaa

SEQ ID NO: 245373 - DNA, 25 bp, Rattus norvegicus
ccaggcagtatttgcactctcttaa

SEQ ID NO: 245374 - DNA, 25 bp, Rattus norvegicus
ccaggcatggtaccatacacctata

SEQ ID NO: 245375 - DNA, 25 bp, Rattus norvegicus
ccaggcatggtagcatacacctata

SEQ ID NO: 245376 - DNA, 25 bp, Rattus norvegicus
ccaggcatttctatggacaactgaa

SEQ ID NO: 245377 - DNA, 25 bp, Rattus norvegicus
ccaggcatttctttggacaactgaa

SEQ ID NO: 245378 - DNA, 25 bp, Rattus norvegicus
ccaggccacttgcagattcagggag

SEQ ID NO: 245379 - DNA, 25 bp, Rattus norvegicus
ccaggccacttggagattcagggag

SEQ ID NO: 245380 - DNA, 25 bp, Rattus norvegicus
ccaggccagatcaccagcaatatgt

SEQ ID NO: 245381 - DNA, 25 bp, Rattus norvegicus
ccaggccagatctccagcaatatgt

SEQ ID NO: 245382 - DNA, 25 bp, Rattus norvegicus
ccaggccagccaaagttatatgtag

SEQ ID NO: 245383 - DNA, 25 bp, Rattus norvegicus
ccaggccagccatagttatatgtag

SEQ ID NO: 245384 - DNA, 25 bp, Rattus norvegicus
ccaggccaggacatggtacacagac

SEQ ID NO: 245385 - DNA, 25 bp, Rattus norvegicus
ccaggccaggacttggtacacagac

SEQ ID NO: 245386 - DNA, 25 bp, Rattus norvegicus
ccaggccagtggagcttagccggat

SEQ ID NO: 245387 - DNA, 25 bp, Rattus norvegicus
ccaggccagtggtgcttagccggat

SEQ ID NO: 245388 - DNA, 25 bp, Rattus norvegicus
ccaggccatcagcaacaacataagt

SEQ ID NO: 245389 - DNA, 25 bp, Rattus norvegicus
ccaggccatcaggaacaacataagt

SEQ ID NO: 245390 - DNA, 25 bp, Rattus norvegicus
ccaggccccaagctcaggagcagag

SEQ ID NO: 245391 - DNA, 25 bp, Rattus norvegicus
ccaggccccaaggtcaggagcagag

SEQ ID NO: 245392 - DNA, 25 bp, Rattus norvegicus
ccaggccccattccgtggagtataa

SEQ ID NO: 245393 - DNA, 25 bp, Rattus norvegicus
ccaggccccattgcgtggagtataa

SEQ ID NO: 245394 - DNA, 25 bp, Rattus norvegicus
ccaggccctctaagctttcgtgttt

SEQ ID NO: 245395 - DNA, 25 bp, Rattus norvegicus
ccaggccctctatgctttcgtgttt

SEQ ID NO: 245396 - DNA, 25 bp, Rattus norvegicus
ccaggccctggacatgttgatgttg

SEQ ID NO: 245397 - DNA, 25 bp, Rattus norvegicus
ccaggccctggagatgttgatgttg

SEQ ID NO: 245398 - DNA, 25 bp, Rattus norvegicus
ccaggccgtcggagtttctgtgtag

SEQ ID NO: 245399 - DNA, 25 bp, Rattus norvegicus
ccaggccgtcggtgtttctgtgtag

SEQ ID NO: 245400 - DNA, 25 bp, Rattus norvegicus
ccaggcctaaggagtctccgaatta

SEQ ID NO: 245401 - DNA, 25 bp, Rattus norvegicus
ccaggcctaaggtgtctccgaatta

SEQ ID NO: 245402 - DNA, 25 bp, Rattus norvegicus
ccaggcctgctgacttgagtacaaa

SEQ ID NO: 245403 - DNA, 25 bp, Rattus norvegicus
ccaggcctgctgtcttgagtacaaa

SEQ ID NO: 245404 - DNA, 25 bp, Rattus norvegicus
ccaggcctggcactaatgcattgtt

SEQ ID NO: 245405 - DNA, 25 bp, Rattus norvegicus
ccaggcctggcagtaatgcattgtt

SEQ ID NO: 245406 - DNA, 25 bp, Rattus norvegicus
ccaggccttctcataggttacaaat

SEQ ID NO: 245407 - DNA, 25 bp, Rattus norvegicus
ccaggccttctcttaggttacaaat

SEQ ID NO: 245408 - DNA, 25 bp, Rattus norvegicus
ccaggcgagacaagaactatccact

SEQ ID NO: 245409 - DNA, 25 bp, Rattus norvegicus
ccaggcgagacatgaactatccact

SEQ ID NO: 245410 - DNA, 25 bp, Rattus norvegicus
ccaggcgctggcacaggcaattaaa

SEQ ID NO: 245411 - DNA, 25 bp, Rattus norvegicus
ccaggcgctggctcaggcaattaaa

SEQ ID NO: 245412 - DNA, 25 bp, Rattus norvegicus
ccaggcgctgggaagggcgcgggcc

SEQ ID NO: 245413 - DNA, 25 bp, Rattus norvegicus
ccaggcgctgggtagggcgcgggcc

SEQ ID NO: 245414 - DNA, 25 bp, Rattus norvegicus
ccaggcgcttttctctaaggatcga

SEQ ID NO: 245415 - DNA, 25 bp, Rattus norvegicus
ccaggcgcttttgtctaaggatcga

SEQ ID NO: 245416 - DNA, 25 bp, Rattus norvegicus
ccaggcgggcttctagttttcagta

SEQ ID NO: 245417 - DNA, 25 bp, Rattus norvegicus
ccaggcgggcttgtagttttcagta

SEQ ID NO: 245418 - DNA, 25 bp, Rattus norvegicus
ccaggcgtgttcacaaccgtggaga

SEQ ID NO: 245419 - DNA, 25 bp, Rattus norvegicus
ccaggcgtgttctcaaccgtggaga

SEQ ID NO: 245420 - DNA, 25 bp, Rattus norvegicus
ccaggctaaacaaaccggctagagg

SEQ ID NO: 245421 - DNA, 25 bp, Rattus norvegicus
ccaggctaaacataccggctagagg

SEQ ID NO: 245422 - DNA, 25 bp, Rattus norvegicus
ccaggctaaatcacttcttccaggg

SEQ ID NO: 245423 - DNA, 25 bp, Rattus norvegicus
ccaggctaaatctcttcttccaggg

SEQ ID NO: 245424 - DNA, 25 bp, Rattus norvegicus
ccaggctagacgatagtgctcttta

SEQ ID NO: 245425 - DNA, 25 bp, Rattus norvegicus
ccaggctagacgttagtgctcttta

SEQ ID NO: 245426 - DNA, 25 bp, Rattus norvegicus
ccaggctagccactactacacagta

SEQ ID NO: 245427 - DNA, 25 bp, Rattus norvegicus
ccaggctagccagtactacacagta

SEQ ID NO: 245428 - DNA, 25 bp, Rattus norvegicus
ccaggctagcctcatgtagtgagtt

SEQ ID NO: 245429 - DNA, 25 bp, Rattus norvegicus
ccaggctagcctgatgtagtgagtt

SEQ ID NO: 245430 - DNA, 25 bp, Rattus norvegicus
ccaggctagcttcatacttgttgta

SEQ ID NO: 245431 - DNA, 25 bp, Rattus norvegicus
ccaggctagcttgatacttgttgta

SEQ ID NO: 245432 - DNA, 25 bp, Rattus norvegicus
ccaggctcccgcaatcagggaccga

SEQ ID NO: 245433 - DNA, 25 bp, Rattus norvegicus
ccaggctcccgctatcagggaccga

SEQ ID NO: 245434 - DNA, 25 bp, Rattus norvegicus
ccaggctccttacatttctacacaa

SEQ ID NO: 245435 - DNA, 25 bp, Rattus norvegicus
ccaggctccttagatttctacacaa

SEQ ID NO: 245436 - DNA, 25 bp, Rattus norvegicus
ccaggctcgcttcacagactaaaca

SEQ ID NO: 245437 - DNA, 25 bp, Rattus norvegicus
ccaggctcgcttgacagactaaaca

SEQ ID NO: 245438 - DNA, 25 bp, Rattus norvegicus
ccaggctcggatcacttctagtaca

SEQ ID NO: 245439 - DNA, 25 bp, Rattus norvegicus
ccaggctcggatgacttctagtaca

SEQ ID NO: 245440 - DNA, 25 bp, Rattus norvegicus
ccaggctctaggactgcagacaagt

SEQ ID NO: 245441 - DNA, 25 bp, Rattus norvegicus
ccaggctctaggtctgcagacaagt

SEQ ID NO: 245442 - DNA, 25 bp, Rattus norvegicus
ccaggctctgatcgcgtccggtgtc

SEQ ID NO: 245443 - DNA, 25 bp, Rattus norvegicus
ccaggctctgatggcgtccggtgtc

SEQ ID NO: 245444 - DNA, 25 bp, Rattus norvegicus
ccaggctctgcccaaatgctaggat

SEQ ID NO: 245445 - DNA, 25 bp, Rattus norvegicus
ccaggctctgccgaaatgctaggat

SEQ ID NO: 245446 - DNA, 25 bp, Rattus norvegicus
ccaggctgaaaacatatgcgaagct

SEQ ID NO: 245447 - DNA, 25 bp, Rattus norvegicus
ccaggctgaaaagatatgcgaagct

SEQ ID NO: 245448 - DNA, 25 bp, Rattus norvegicus
ccaggctgaagaccgcgaccgagat

SEQ ID NO: 245449 - DNA, 25 bp, Rattus norvegicus
ccaggctgaagagcgcgaccgagat

SEQ ID NO: 245450 - DNA, 25 bp, Rattus norvegicus
ccaggctgaaggcaaactaatctca

SEQ ID NO: 245451 - DNA, 25 bp, Rattus norvegicus
ccaggctgaagggaaactaatctca

SEQ ID NO: 245452 - DNA, 25 bp, Rattus norvegicus
ccaggctgcacaaccagcactggag

SEQ ID NO: 245453 - DNA, 25 bp, Rattus norvegicus
ccaggctgcacatccagcactggag

SEQ ID NO: 245454 - DNA, 25 bp, Rattus norvegicus
ccaggctgcagacagtctgtaagac

SEQ ID NO: 245455 - DNA, 25 bp, Rattus norvegicus
ccaggctgcagagagtctgtaagac

SEQ ID NO: 245456 - DNA, 25 bp, Rattus norvegicus
ccaggctgcctaagaagtcttgagt

SEQ ID NO: 245457 - DNA, 25 bp, Rattus norvegicus
ccaggctgcctaccgaggacgctga

SEQ ID NO: 245458 - DNA, 25 bp, Rattus norvegicus
ccaggctgcctagcgaggacgctga

SEQ ID NO: 245459 - DNA, 25 bp, Rattus norvegicus
ccaggctgcctatgaagtcttgagt

SEQ ID NO: 245460 - DNA, 25 bp, Rattus norvegicus
ccaggctgccttcatacatacttta

SEQ ID NO: 245461 - DNA, 25 bp, Rattus norvegicus
ccaggctgccttgatacatacttta

SEQ ID NO: 245462 - DNA, 25 bp, Rattus norvegicus
ccaggctggcctaagatttgtagtg

SEQ ID NO: 245463 - DNA, 25 bp, Rattus norvegicus
ccaggctggccttagatttgtagtg

SEQ ID NO: 245464 - DNA, 25 bp, Rattus norvegicus
ccaggctgggcaacctatttttgaa

SEQ ID NO: 245465 - DNA, 25 bp, Rattus norvegicus
ccaggctgggcatcctatttttgaa

SEQ ID NO: 245466 - DNA, 25 bp, Rattus norvegicus
ccaggctgggctagaactcactctg

SEQ ID NO: 245467 - DNA, 25 bp, Rattus norvegicus
ccaggctgggcttgaactcactctg

SEQ ID NO: 245468 - DNA, 25 bp, Rattus norvegicus
ccaggctggtcaaataaactcagac

SEQ ID NO: 245469 - DNA, 25 bp, Rattus norvegicus
ccaggctggtcatataaactcagac

SEQ ID NO: 245470 - DNA, 25 bp, Rattus norvegicus
ccaggctggtctcaagctcaggtac

SEQ ID NO: 245471 - DNA, 25 bp, Rattus norvegicus
ccaggctggtctgaagctcaggtac

SEQ ID NO: 245472 - DNA, 25 bp, Rattus norvegicus
ccaggctggttcagtctactttctt

SEQ ID NO: 245473 - DNA, 25 bp, Rattus norvegicus
ccaggctggttctgtctactttctt

SEQ ID NO: 245474 - DNA, 25 bp, Rattus norvegicus
ccaggctgtctaagcaggagttcca

SEQ ID NO: 245475 - DNA, 25 bp, Rattus norvegicus
ccaggctgtctatgcaggagttcca

SEQ ID NO: 245476 - DNA, 25 bp, Rattus norvegicus
ccaggctgtgccaagtgcgcccgag

SEQ ID NO: 245477 - DNA, 25 bp, Rattus norvegicus
ccaggctgtgcctagtgcgcccgag

SEQ ID NO: 245478 - DNA, 25 bp, Rattus norvegicus
ccaggctgtgctctcaggcctatga

SEQ ID NO: 245479 - DNA, 25 bp, Rattus norvegicus
ccaggctgtgctgtcaggcctatga

SEQ ID NO: 245480 - DNA, 25 bp, Rattus norvegicus
ccaggctgtgttctccctgtatgcc

SEQ ID NO: 245481 - DNA, 25 bp, Rattus norvegicus
ccaggctgtgttgtccctgtatgcc

SEQ ID NO: 245482 - DNA, 25 bp, Rattus norvegicus
ccaggcttcagaaaatcatccagaa

SEQ ID NO: 245483 - DNA, 25 bp, Rattus norvegicus
ccaggcttcagataatcatccagaa

SEQ ID NO: 245484 - DNA, 25 bp, Rattus norvegicus
ccaggcttcagcctggtcacaagat

SEQ ID NO: 245485 - DNA, 25 bp, Rattus norvegicus
ccaggcttcagcgtggtcacaagat

SEQ ID NO: 245486 - DNA, 25 bp, Rattus norvegicus
ccaggcttcatcactccaatagaga

SEQ ID NO: 245487 - DNA, 25 bp, Rattus norvegicus
ccaggcttcatctctccaatagaga

SEQ ID NO: 245488 - DNA, 25 bp, Rattus norvegicus
ccaggcttcctgcttgctagatgag

SEQ ID NO: 245489 - DNA, 25 bp, Rattus norvegicus
ccaggcttcctggttgctagatgag

SEQ ID NO: 245490 - DNA, 25 bp, Rattus norvegicus
ccaggctttcccacttagacaggga

SEQ ID NO: 245491 - DNA, 25 bp, Rattus norvegicus
ccaggctttcccagtacttgctatg

SEQ ID NO: 245492 - DNA, 25 bp, Rattus norvegicus
ccaggctttccctcttagacaggga

SEQ ID NO: 245493 - DNA, 25 bp, Rattus norvegicus
ccaggctttccctgtacttgctatg

SEQ ID NO: 245494 - DNA, 25 bp, Rattus norvegicus
ccaggctttcctcgcattgaggaga

SEQ ID NO: 245495 - DNA, 25 bp, Rattus norvegicus
ccaggctttcctggcattgaggaga

SEQ ID NO: 245496 - DNA, 25 bp, Rattus norvegicus
ccagggaactgtcccaaccatgatg

SEQ ID NO: 245497 - DNA, 25 bp, Rattus norvegicus
ccagggaactgtgccaaccatgatg

SEQ ID NO: 245498 - DNA, 25 bp, Rattus norvegicus
ccagggaatgacacagattttctca

SEQ ID NO: 245499 - DNA, 25 bp, Rattus norvegicus
ccagggaatgactcagattttctca

SEQ ID NO: 245500 - DNA, 25 bp, Rattus norvegicus
ccagggagccgcacatcagcagtga

SEQ ID NO: 245501 - DNA, 25 bp, Rattus norvegicus
ccagggagccgctcatcagcagtga

SEQ ID NO: 245502 - DNA, 25 bp, Rattus norvegicus
ccagggagtccaattgttgctttaa

SEQ ID NO: 245503 - DNA, 25 bp, Rattus norvegicus
ccagggagtccatttgttgctttaa

SEQ ID NO: 245504 - DNA, 25 bp, Rattus norvegicus
ccagggagttggctaatttatattc

SEQ ID NO: 245505 - DNA, 25 bp, Rattus norvegicus
ccagggagttgggtaatttatattc

SEQ ID NO: 245506 - DNA, 25 bp, Rattus norvegicus
ccagggatcgatccactgggtgctt

SEQ ID NO: 245507 - DNA, 25 bp, Rattus norvegicus
ccagggatcgatgcactgggtgctt

SEQ ID NO: 245508 - DNA, 25 bp, Rattus norvegicus
ccagggatctttcccaagttgttca

SEQ ID NO: 245509 - DNA, 25 bp, Rattus norvegicus
ccagggatctttgccaagttgttca

SEQ ID NO: 245510 - DNA, 25 bp, Rattus norvegicus
ccagggatgctgctacttgaggcca

SEQ ID NO: 245511 - DNA, 25 bp, Rattus norvegicus
ccagggatgctggtacttgaggcca

SEQ ID NO: 245512 - DNA, 25 bp, Rattus norvegicus
ccagggattacaccggtcatcgtgg

SEQ ID NO: 245513 - DNA, 25 bp, Rattus norvegicus
ccagggattacagcggtcatcgtgg

SEQ ID NO: 245514 - DNA, 25 bp, Rattus norvegicus
ccagggattctgcaggtgcaccgaa

SEQ ID NO: 245515 - DNA, 25 bp, Rattus norvegicus
ccagggattctggaggtgcaccgaa

SEQ ID NO: 245516 - DNA, 25 bp, Rattus norvegicus
ccagggcaacagacaaggcagcgct

SEQ ID NO: 245517 - DNA, 25 bp, Rattus norvegicus
ccagggcaacagtcaaggcagcgct

SEQ ID NO: 245518 - DNA, 25 bp, Rattus norvegicus
ccagggcaatggagggctacatagt

SEQ ID NO: 245519 - DNA, 25 bp, Rattus norvegicus
ccagggcaatggtgggctacatagt

SEQ ID NO: 245520 - DNA, 25 bp, Rattus norvegicus
ccagggcacaggcttgaacgtagta

SEQ ID NO: 245521 - DNA, 25 bp, Rattus norvegicus
ccagggcacagggttgaacgtagta

SEQ ID NO: 245522 - DNA, 25 bp, Rattus norvegicus
ccagggcacagtcttctgtttcgtt

SEQ ID NO: 245523 - DNA, 25 bp, Rattus norvegicus
ccagggcacagtgttctgtttcgtt

SEQ ID NO: 245524 - DNA, 25 bp, Rattus norvegicus
ccagggcacgacctattccagatag

SEQ ID NO: 245525 - DNA, 25 bp, Rattus norvegicus
ccagggcacgacgtattccagatag

SEQ ID NO: 245526 - DNA, 25 bp, Rattus norvegicus
ccagggcactctatgactttgaggc

SEQ ID NO: 245527 - DNA, 25 bp, Rattus norvegicus
ccagggcactctttgactttgaggc

SEQ ID NO: 245528 - DNA, 25 bp, Rattus norvegicus
ccagggcagctccaggtgaacacga

SEQ ID NO: 245529 - DNA, 25 bp, Rattus norvegicus
ccagggcagctcgaggtgaacacga

SEQ ID NO: 245530 - DNA, 25 bp, Rattus norvegicus
ccagggcagggcacagctcaggtca

SEQ ID NO: 245531 - DNA, 25 bp, Rattus norvegicus
ccagggcagggctcagctcaggtca

SEQ ID NO: 245532 - DNA, 25 bp, Rattus norvegicus
ccagggcagtgacttatttctttta

SEQ ID NO: 245533 - DNA, 25 bp, Rattus norvegicus
ccagggcagtgagttatttctttta

SEQ ID NO: 245534 - DNA, 25 bp, Rattus norvegicus
ccagggcagttcattttggttcatt

SEQ ID NO: 245535 - DNA, 25 bp, Rattus norvegicus
ccagggcagttctttttggttcatt

SEQ ID NO: 245536 - DNA, 25 bp, Rattus norvegicus
ccagggcccaggagtatgaatttgt

SEQ ID NO: 245537 - DNA, 25 bp, Rattus norvegicus
ccagggcccaggtgtatgaatttgt

SEQ ID NO: 245538 - DNA, 25 bp, Rattus norvegicus
ccagggcccatcattgggtacagta

SEQ ID NO: 245539 - DNA, 25 bp, Rattus norvegicus
ccagggcccatctttgggtacagta

SEQ ID NO: 245540 - DNA, 25 bp, Rattus norvegicus
ccagggccgggcagagtcaaatcga

SEQ ID NO: 245541 - DNA, 25 bp, Rattus norvegicus
ccagggccgggctgagtcaaatcga

SEQ ID NO: 245542 - DNA, 25 bp, Rattus norvegicus
ccagggccgtttcttgcctctgcaa

SEQ ID NO: 245543 - DNA, 25 bp, Rattus norvegicus
ccagggccgtttgttgcctctgcaa

SEQ ID NO: 245544 - DNA, 25 bp, Rattus norvegicus
ccagggcctatgcactgtgaacagg

SEQ ID NO: 245545 - DNA, 25 bp, Rattus norvegicus
ccagggcctatggactgtgaacagg

SEQ ID NO: 245546 - DNA, 25 bp, Rattus norvegicus
ccagggccttcaccctttggataag

SEQ ID NO: 245547 - DNA, 25 bp, Rattus norvegicus
ccagggccttcagcctttggataag

SEQ ID NO: 245548 - DNA, 25 bp, Rattus norvegicus
ccagggctagccacttagggttaga

SEQ ID NO: 245549 - DNA, 25 bp, Rattus norvegicus
ccagggctagcctcttagggttaga

SEQ ID NO: 245550 - DNA, 25 bp, Rattus norvegicus
ccagggctcggtaacatagtgagat

SEQ ID NO: 245551 - DNA, 25 bp, Rattus norvegicus
ccagggctcggtaccatggtgaaaa

SEQ ID NO: 245552 - DNA, 25 bp, Rattus norvegicus
ccagggctcggttacatagtgagat

SEQ ID NO: 245553 - DNA, 25 bp, Rattus norvegicus
ccagggctcggttccatggtgaaaa

SEQ ID NO: 245554 - DNA, 25 bp, Rattus norvegicus
ccagggctctaaagtgtccacacag

SEQ ID NO: 245555 - DNA, 25 bp, Rattus norvegicus
ccagggctctaatgtgtccacacag

SEQ ID NO: 245556 - DNA, 25 bp, Rattus norvegicus
ccagggctctacacaaggtaacctt

SEQ ID NO: 245557 - DNA, 25 bp, Rattus norvegicus
ccagggctctactcaaggtaacctt

SEQ ID NO: 245558 - DNA, 25 bp, Rattus norvegicus
ccagggctgccaagtgtgggtacca

SEQ ID NO: 245559 - DNA, 25 bp, Rattus norvegicus
ccagggctgccatgtgtgggtacca

SEQ ID NO: 245560 - DNA, 25 bp, Rattus norvegicus
ccagggctggcaagaagctctgcat

SEQ ID NO: 245561 - DNA, 25 bp, Rattus norvegicus
ccagggctggcatgaagctctgcat

SEQ ID NO: 245562 - DNA, 25 bp, Rattus norvegicus
ccagggctgtgtccctcaaagcagt

SEQ ID NO: 245563 - DNA, 25 bp, Rattus norvegicus
ccagggctgtgtgcctcaaagcagt

SEQ ID NO: 245564 - DNA, 25 bp, Rattus norvegicus
ccagggcttcacaagacatgtcttc

SEQ ID NO: 245565 - DNA, 25 bp, Rattus norvegicus
ccagggcttcactagacatgtcttc

SEQ ID NO: 245566 - DNA, 25 bp, Rattus norvegicus
ccagggcttcagatattttgcacga

SEQ ID NO: 245567 - DNA, 25 bp, Rattus norvegicus
ccagggcttcagttattttgcacga

SEQ ID NO: 245568 - DNA, 25 bp, Rattus norvegicus
ccagggcttcgtccaagctaaggaa

SEQ ID NO: 245569 - DNA, 25 bp, Rattus norvegicus
ccagggcttcgtgcaagctaaggaa

SEQ ID NO: 245570 - DNA, 25 bp, Rattus norvegicus
ccagggctttgtcctcattttaatt

SEQ ID NO: 245571 - DNA, 25 bp, Rattus norvegicus
ccagggctttgtgctcattttaatt

SEQ ID NO: 245572 - DNA, 25 bp, Rattus norvegicus
ccagggtaatccacagttgctttta

SEQ ID NO: 245573 - DNA, 25 bp, Rattus norvegicus
ccagggtaatcctcagttgctttta

SEQ ID NO: 245574 - DNA, 25 bp, Rattus norvegicus
ccagggtcccagattttcaagaagt

SEQ ID NO: 245575 - DNA, 25 bp, Rattus norvegicus
ccagggtcccagtttttcaagaagt

SEQ ID NO: 245576 - DNA, 25 bp, Rattus norvegicus
ccagggtccgacatagttcaggcac

SEQ ID NO: 245577 - DNA, 25 bp, Rattus norvegicus
ccagggtccgacttagttcaggcac

SEQ ID NO: 245578 - DNA, 25 bp, Rattus norvegicus
ccagggtctccgcataatgtgaagc

SEQ ID NO: 245579 - DNA, 25 bp, Rattus norvegicus
ccagggtctccggataatgtgaagc

SEQ ID NO: 245580 - DNA, 25 bp, Rattus norvegicus
ccagggtcttgtacctactagacaa

SEQ ID NO: 245581 - DNA, 25 bp, Rattus norvegicus
ccagggtcttgttcctactagacaa

SEQ ID NO: 245582 - DNA, 25 bp, Rattus norvegicus
ccagggtgcccaccttaaatgtgcc

SEQ ID NO: 245583 - DNA, 25 bp, Rattus norvegicus
ccagggtgcccagcttaaatgtgcc

SEQ ID NO: 245584 - DNA, 25 bp, Rattus norvegicus
ccagggtttccacgctcaagtggat

SEQ ID NO: 245585 - DNA, 25 bp, Rattus norvegicus
ccagggtttccaggctcaagtggat

SEQ ID NO: 245586 - DNA, 25 bp, Rattus norvegicus
ccagggtttttgacagtgcctttca

SEQ ID NO: 245587 - DNA, 25 bp, Rattus norvegicus
ccagggtttttgtcagtgcctttca

SEQ ID NO: 245588 - DNA, 25 bp, Rattus norvegicus
ccaggtaccacacggcatcggagaa

SEQ ID NO: 245589 - DNA, 25 bp, Rattus norvegicus
ccaggtaccacagggcatcggagaa

SEQ ID NO: 245590 - DNA, 25 bp, Rattus norvegicus
ccaggtactttgaggatcggcgttg

SEQ ID NO: 245591 - DNA, 25 bp, Rattus norvegicus
ccaggtactttgtggatcggcgttg

SEQ ID NO: 245592 - DNA, 25 bp, Rattus norvegicus
ccaggtagcaccatatgctgcttaa

SEQ ID NO: 245593 - DNA, 25 bp, Rattus norvegicus
ccaggtagcaccttatgctgcttaa

SEQ ID NO: 245594 - DNA, 25 bp, Rattus norvegicus
ccaggtagggtgacacagggcttta

SEQ ID NO: 245595 - DNA, 25 bp, Rattus norvegicus
ccaggtagggtgtcacagggcttta

SEQ ID NO: 245596 - DNA, 25 bp, Rattus norvegicus
ccaggtatcccgcagttggtggaat

SEQ ID NO: 245597 - DNA, 25 bp, Rattus norvegicus
ccaggtatcccggagttggtggaat

SEQ ID NO: 245598 - DNA, 25 bp, Rattus norvegicus
ccaggtattcggattgggcagcctt

SEQ ID NO: 245599 - DNA, 25 bp, Rattus norvegicus
ccaggtattcggtttgggcagcctt

SEQ ID NO: 245600 - DNA, 25 bp, Rattus norvegicus
ccaggtcaactgctcgggtagaaca

SEQ ID NO: 245601 - DNA, 25 bp, Rattus norvegicus
ccaggtcaactggtcgggtagaaca

SEQ ID NO: 245602 - DNA, 25 bp, Rattus norvegicus
ccaggtcaaggcacacggcaagaag

SEQ ID NO: 245603 - DNA, 25 bp, Rattus norvegicus
ccaggtcaaggctcacggcaagaag

SEQ ID NO: 245604 - DNA, 25 bp, Rattus norvegicus
ccaggtcaccggcttctttgaagtg

SEQ ID NO: 245605 - DNA, 25 bp, Rattus norvegicus
ccaggtcaccgggttctttgaagtg

SEQ ID NO: 245606 - DNA, 25 bp, Rattus norvegicus
ccaggtcagaggctcagtatgagaa

SEQ ID NO: 245607 - DNA, 25 bp, Rattus norvegicus
ccaggtcagagggtcagtatgagaa

SEQ ID NO: 245608 - DNA, 25 bp, Rattus norvegicus
ccaggtcagtcacggatagtcttaa

SEQ ID NO: 245609 - DNA, 25 bp, Rattus norvegicus
ccaggtcagtcagggatagtcttaa

SEQ ID NO: 245610 - DNA, 25 bp, Rattus norvegicus
ccaggtccaggacgtggctcaccga

SEQ ID NO: 245611 - DNA, 25 bp, Rattus norvegicus
ccaggtccaggaggtggctcaccga

SEQ ID NO: 245612 - DNA, 25 bp, Rattus norvegicus
ccaggtcccagcagggaatgtggaa

SEQ ID NO: 245613 - DNA, 25 bp, Rattus norvegicus
ccaggtcccagctgggaatgtggaa

SEQ ID NO: 245614 - DNA, 25 bp, Rattus norvegicus
ccaggtcctggcagcatagggtgat

SEQ ID NO: 245615 - DNA, 25 bp, Rattus norvegicus
ccaggtcctggctgcatagggtgat

SEQ ID NO: 245616 - DNA, 25 bp, Rattus norvegicus
ccaggtctacacactgcatgtgaga

SEQ ID NO: 245617 - DNA, 25 bp, Rattus norvegicus
ccaggtctacactctgcatgtgaga

SEQ ID NO: 245618 - DNA, 25 bp, Rattus norvegicus
ccaggtctactgacgtcgcggccgt

SEQ ID NO: 245619 - DNA, 25 bp, Rattus norvegicus
ccaggtctactgtcgtcgcggccgt

SEQ ID NO: 245620 - DNA, 25 bp, Rattus norvegicus
ccaggtctcacacagcggttttcaa

SEQ ID NO: 245621 - DNA, 25 bp, Rattus norvegicus
ccaggtctcacagagcggttttcaa

SEQ ID NO: 245622 - DNA, 25 bp, Rattus norvegicus
ccaggtctggacaaactattaaaat

SEQ ID NO: 245623 - DNA, 25 bp, Rattus norvegicus
ccaggtctggactaactattaaaat

SEQ ID NO: 245624 - DNA, 25 bp, Rattus norvegicus
ccaggtcttccgatttatgcgttta

SEQ ID NO: 245625 - DNA, 25 bp, Rattus norvegicus
ccaggtcttccgttttatgcgttta

SEQ ID NO: 245626 - DNA, 25 bp, Rattus norvegicus
ccaggtgaaggcatatttctgcttg

SEQ ID NO: 245627 - DNA, 25 bp, Rattus norvegicus
ccaggtgaaggcttatttctgcttg

SEQ ID NO: 245628 - DNA, 25 bp, Rattus norvegicus
ccaggtgaccctagttcgtatcaaa

SEQ ID NO: 245629 - DNA, 25 bp, Rattus norvegicus
ccaggtgacccttgttcgtatcaaa

SEQ ID NO: 245630 - DNA, 25 bp, Rattus norvegicus
ccaggtgagactctacttgtggctg

SEQ ID NO: 245631 - DNA, 25 bp, Rattus norvegicus
ccaggtgagactgtacttgtggctg

SEQ ID NO: 245632 - DNA, 25 bp, Rattus norvegicus
ccaggtgagggcagtactccttaaa

SEQ ID NO: 245633 - DNA, 25 bp, Rattus norvegicus
ccaggtgagggctgtactccttaaa

SEQ ID NO: 245634 - DNA, 25 bp, Rattus norvegicus
ccaggtgatggaaccctgaggacct

SEQ ID NO: 245635 - DNA, 25 bp, Rattus norvegicus
ccaggtgatggaacgactgcatggc

SEQ ID NO: 245636 - DNA, 25 bp, Rattus norvegicus
ccaggtgatggatccctgaggacct

SEQ ID NO: 245637 - DNA, 25 bp, Rattus norvegicus
ccaggtgatggatcgactgcatggc

SEQ ID NO: 245638 - DNA, 25 bp, Rattus norvegicus
ccaggtgcaactctgttcaaccata

SEQ ID NO: 245639 - DNA, 25 bp, Rattus norvegicus
ccaggtgcaactgtgttcaaccata

SEQ ID NO: 245640 - DNA, 25 bp, Rattus norvegicus
ccaggtgcaggtagctgtgccgaaa

SEQ ID NO: 245641 - DNA, 25 bp, Rattus norvegicus
ccaggtgcaggttgctgtgccgaaa

SEQ ID NO: 245642 - DNA, 25 bp, Rattus norvegicus
ccaggtgcgcagagactacgggaca

SEQ ID NO: 245643 - DNA, 25 bp, Rattus norvegicus
ccaggtgcgcagtgactacgggaca

SEQ ID NO: 245644 - DNA, 25 bp, Rattus norvegicus
ccaggtgctgtcacaaagccttctt

SEQ ID NO: 245645 - DNA, 25 bp, Rattus norvegicus
ccaggtgctgtctcaaagccttctt

SEQ ID NO: 245646 - DNA, 25 bp, Rattus norvegicus
ccaggtgcttgtcagcagcctaatt

SEQ ID NO: 245647 - DNA, 25 bp, Rattus norvegicus
ccaggtgcttgtgagcagcctaatt

SEQ ID NO: 245648 - DNA, 25 bp, Rattus norvegicus
ccaggtgctttcagctgtgtgtggg

SEQ ID NO: 245649 - DNA, 25 bp, Rattus norvegicus
ccaggtgctttctgctgtgtgtggg

SEQ ID NO: 245650 - DNA, 25 bp, Rattus norvegicus
ccaggtggacgtaatattgttttca

SEQ ID NO: 245651 - DNA, 25 bp, Rattus norvegicus
ccaggtggacgttatattgttttca

SEQ ID NO: 245652 - DNA, 25 bp, Rattus norvegicus
ccaggtggagcaaccctggtgtttg

SEQ ID NO: 245653 - DNA, 25 bp, Rattus norvegicus
ccaggtggagcatccctggtgtttg

SEQ ID NO: 245654 - DNA, 25 bp, Rattus norvegicus
ccaggtggatttatgttcctcctag

SEQ ID NO: 245655 - DNA, 25 bp, Rattus norvegicus
ccaggtggatttttgttcctcctag

SEQ ID NO: 245656 - DNA, 25 bp, Rattus norvegicus
ccaggtggccatcacaccgttgtaa

SEQ ID NO: 245657 - DNA, 25 bp, Rattus norvegicus
ccaggtggccatgacaccgttgtaa

SEQ ID NO: 245658 - DNA, 25 bp, Rattus norvegicus
ccaggtggcctcacggactgggaaa

SEQ ID NO: 245659 - DNA, 25 bp, Rattus norvegicus
ccaggtggcctctcggactgggaaa

SEQ ID NO: 245660 - DNA, 25 bp, Rattus norvegicus
ccaggtggcctgatctcggaattga

SEQ ID NO: 245661 - DNA, 25 bp, Rattus norvegicus
ccaggtggcctgttctcggaattga

SEQ ID NO: 245662 - DNA, 25 bp, Rattus norvegicus
ccaggtggcgccattggacaaggat

SEQ ID NO: 245663 - DNA, 25 bp, Rattus norvegicus
ccaggtggcgcctttggacaaggat

SEQ ID NO: 245664 - DNA, 25 bp, Rattus norvegicus
ccaggtgggatgaagcagttgtcac

SEQ ID NO: 245665 - DNA, 25 bp, Rattus norvegicus
ccaggtgggatgtagcagttgtcac

SEQ ID NO: 245666 - DNA, 25 bp, Rattus norvegicus
ccaggtgggcaaactccagtgagag

SEQ ID NO: 245667 - DNA, 25 bp, Rattus norvegicus
ccaggtgggcaatctccagtgagag

SEQ ID NO: 245668 - DNA, 25 bp, Rattus norvegicus
ccaggtggtcacatagctatctaaa

SEQ ID NO: 245669 - DNA, 25 bp, Rattus norvegicus
ccaggtggtcacttagctatctaaa

SEQ ID NO: 245670 - DNA, 25 bp, Rattus norvegicus
ccaggtggttgtcgctgcatgattt

SEQ ID NO: 245671 - DNA, 25 bp, Rattus norvegicus
ccaggtggttgtggctgcatgattt

SEQ ID NO: 245672 - DNA, 25 bp, Rattus norvegicus
ccaggtgtagttcgctttgttcttc

SEQ ID NO: 245673 - DNA, 25 bp, Rattus norvegicus
ccaggtgtagttggctttgttcttc

SEQ ID NO: 245674 - DNA, 25 bp, Rattus norvegicus
ccaggtgtccaaacatccatcattt

SEQ ID NO: 245675 - DNA, 25 bp, Rattus norvegicus
ccaggtgtccaatcatccatcattt

SEQ ID NO: 245676 - DNA, 25 bp, Rattus norvegicus
ccaggtgtccatctcaagtatcttc

SEQ ID NO: 245677 - DNA, 25 bp, Rattus norvegicus
ccaggtgtccatgtcaagtatcttc

SEQ ID NO: 245678 - DNA, 25 bp, Rattus norvegicus
ccaggtgtccctcctaagtggagaa

SEQ ID NO: 245679 - DNA, 25 bp, Rattus norvegicus
ccaggtgtccctgctaagtggagaa

SEQ ID NO: 245680 - DNA, 25 bp, Rattus norvegicus
ccaggtgtgccccaagcattaagtt

SEQ ID NO: 245681 - DNA, 25 bp, Rattus norvegicus
ccaggtgtgcccgaagcattaagtt

SEQ ID NO: 245682 - DNA, 25 bp, Rattus norvegicus
ccaggtgtggacattgagtattgca

SEQ ID NO: 245683 - DNA, 25 bp, Rattus norvegicus
ccaggtgtggactttgagtattgca

SEQ ID NO: 245684 - DNA, 25 bp, Rattus norvegicus
ccaggtgtgtcgacaagtgttcaaa

SEQ ID NO: 245685 - DNA, 25 bp, Rattus norvegicus
ccaggtgtgtcgtcaagtgttcaaa

SEQ ID NO: 245686 - DNA, 25 bp, Rattus norvegicus
ccaggtgtgtgactcttccatgcag

SEQ ID NO: 245687 - DNA, 25 bp, Rattus norvegicus
ccaggtgtgtgagtcttccatgcag

SEQ ID NO: 245688 - DNA, 25 bp, Rattus norvegicus
ccaggttacagcacattattgcatt

SEQ ID NO: 245689 - DNA, 25 bp, Rattus norvegicus
ccaggttacagctcattattgcatt

SEQ ID NO: 245690 - DNA, 25 bp, Rattus norvegicus
ccaggttcaaggattttgttgctat

SEQ ID NO: 245691 - DNA, 25 bp, Rattus norvegicus
ccaggttcaaggtttttgttgctat

SEQ ID NO: 245692 - DNA, 25 bp, Rattus norvegicus
ccaggttcagcccttctcttgaggg

SEQ ID NO: 245693 - DNA, 25 bp, Rattus norvegicus
ccaggttcagccgttctcttgaggg

SEQ ID NO: 245694 - DNA, 25 bp, Rattus norvegicus
ccaggttcatcaaatctagccttta

SEQ ID NO: 245695 - DNA, 25 bp, Rattus norvegicus
ccaggttcatcatatctagccttta

SEQ ID NO: 245696 - DNA, 25 bp, Rattus norvegicus
ccaggttcctggcaaattctgcttt

SEQ ID NO: 245697 - DNA, 25 bp, Rattus norvegicus
ccaggttcctgggaaattctgcttt

SEQ ID NO: 245698 - DNA, 25 bp, Rattus norvegicus
ccaggttcctgtctgatgttccaaa

SEQ ID NO: 245699 - DNA, 25 bp, Rattus norvegicus
ccaggttcctgtgtgatgttccaaa

SEQ ID NO: 245700 - DNA, 25 bp, Rattus norvegicus
ccaggttcgtggactatagctataa

SEQ ID NO: 245701 - DNA, 25 bp, Rattus norvegicus
ccaggttcgtggtctatagctataa

SEQ ID NO: 245702 - DNA, 25 bp, Rattus norvegicus
ccaggttctcttaaccaaggatttg

SEQ ID NO: 245703 - DNA, 25 bp, Rattus norvegicus
ccaggttctctttaccaaggatttg

SEQ ID NO: 245704 - DNA, 25 bp, Rattus norvegicus
ccaggttctgcacccgagtaggagt

SEQ ID NO: 245705 - DNA, 25 bp, Rattus norvegicus
ccaggttctgcagccgagtaggagt

SEQ ID NO: 245706 - DNA, 25 bp, Rattus norvegicus
ccaggttgacctatgattcttagca

SEQ ID NO: 245707 - DNA, 25 bp, Rattus norvegicus
ccaggttgacctttgattcttagca

SEQ ID NO: 245708 - DNA, 25 bp, Rattus norvegicus
ccaggttgccttagtttgccaggaa

SEQ ID NO: 245709 - DNA, 25 bp, Rattus norvegicus
ccaggttgcctttgtttgccaggaa

SEQ ID NO: 245710 - DNA, 25 bp, Rattus norvegicus
ccaggttggtctaggcttacagcaa

SEQ ID NO: 245711 - DNA, 25 bp, Rattus norvegicus
ccaggttggtcttggcttacagcaa

SEQ ID NO: 245712 - DNA, 25 bp, Rattus norvegicus
ccaggtttcagtcgttgacaaagca

SEQ ID NO: 245713 - DNA, 25 bp, Rattus norvegicus
ccaggtttcagtggttgacaaagca

SEQ ID NO: 245714 - DNA, 25 bp, Rattus norvegicus
ccaggtttcctgctgaaccccaaat

SEQ ID NO: 245715 - DNA, 25 bp, Rattus norvegicus
ccaggtttcctggtgaaccccaaat

SEQ ID NO: 245716 - DNA, 25 bp, Rattus norvegicus
ccaggtttgacgctcttcaggcaac

SEQ ID NO: 245717 - DNA, 25 bp, Rattus norvegicus
ccaggtttgacggtcttcaggcaac

SEQ ID NO: 245718 - DNA, 25 bp, Rattus norvegicus
ccaggtttgcctcacactgatataa

SEQ ID NO: 245719 - DNA, 25 bp, Rattus norvegicus
ccaggtttgcctgacactgatataa

SEQ ID NO: 245720 - DNA, 25 bp, Rattus norvegicus
ccaggtttgctgctccgcgtggaaa

SEQ ID NO: 245721 - DNA, 25 bp, Rattus norvegicus
ccaggtttgctggtccgcgtggaaa

SEQ ID NO: 245722 - DNA, 25 bp, Rattus norvegicus
ccaggtttggttcattccttcctga

SEQ ID NO: 245723 - DNA, 25 bp, Rattus norvegicus
ccaggtttggttgattccttcctga

SEQ ID NO: 245724 - DNA, 25 bp, Rattus norvegicus
ccaggttttaggctcatgtctctta

SEQ ID NO: 245725 - DNA, 25 bp, Rattus norvegicus
ccaggttttagggtcatgtctctta

SEQ ID NO: 245726 - DNA, 25 bp, Rattus norvegicus
ccagtaatctggctccagagttcaa

SEQ ID NO: 245727 - DNA, 25 bp, Rattus norvegicus
ccagtaatctgggtccagagttcaa

SEQ ID NO: 245728 - DNA, 25 bp, Rattus norvegicus
ccagtaatggctaatgaatcttaga

SEQ ID NO: 245729 - DNA, 25 bp, Rattus norvegicus
ccagtaatggcttatgaatcttaga

SEQ ID NO: 245730 - DNA, 25 bp, Rattus norvegicus
ccagtaatggtcaaagccacgcaaa

SEQ ID NO: 245731 - DNA, 25 bp, Rattus norvegicus
ccagtaatggtctaagccacgcaaa

SEQ ID NO: 245732 - DNA, 25 bp, Rattus norvegicus
ccagtacagtgtacttgctttaggt

SEQ ID NO: 245733 - DNA, 25 bp, Rattus norvegicus
ccagtacagtgttcttgctttaggt

SEQ ID NO: 245734 - DNA, 25 bp, Rattus norvegicus
ccagtaccagtcatggaaacctata

SEQ ID NO: 245735 - DNA, 25 bp, Rattus norvegicus
ccagtaccagtcttggaaacctata

SEQ ID NO: 245736 - DNA, 25 bp, Rattus norvegicus
ccagtacgctctctttgtttgttaa

SEQ ID NO: 245737 - DNA, 25 bp, Rattus norvegicus
ccagtacgctctgtttgtttgttaa

SEQ ID NO: 245738 - DNA, 25 bp, Rattus norvegicus
ccagtactctttcagctcagacttt

SEQ ID NO: 245739 - DNA, 25 bp, Rattus norvegicus
ccagtactctttgagctcagacttt

SEQ ID NO: 245740 - DNA, 25 bp, Rattus norvegicus
ccagtactgagccttgctttggaaa

SEQ ID NO: 245741 - DNA, 25 bp, Rattus norvegicus
ccagtactgagcgttgctttggaaa

SEQ ID NO: 245742 - DNA, 25 bp, Rattus norvegicus
ccagtacttgataggctttcttacc

SEQ ID NO: 245743 - DNA, 25 bp, Rattus norvegicus
ccagtacttgattggctttcttacc

SEQ ID NO: 245744 - DNA, 25 bp, Rattus norvegicus
ccagtactttggcaacctgccagga

SEQ ID NO: 245745 - DNA, 25 bp, Rattus norvegicus
ccagtactttgggaacctgccagga

SEQ ID NO: 245746 - DNA, 25 bp, Rattus norvegicus
ccagtagactctcccttataagatc

SEQ ID NO: 245747 - DNA, 25 bp, Rattus norvegicus
ccagtagactctgccttataagatc

SEQ ID NO: 245748 - DNA, 25 bp, Rattus norvegicus
ccagtagggcacatgggcgtcttac

SEQ ID NO: 245749 - DNA, 25 bp, Rattus norvegicus
ccagtagggcacttgggcgtcttac

SEQ ID NO: 245750 - DNA, 25 bp, Rattus norvegicus
ccagtaggtgacacctatcctagga

SEQ ID NO: 245751 - DNA, 25 bp, Rattus norvegicus
ccagtaggtgactcctatcctagga

SEQ ID NO: 245752 - DNA, 25 bp, Rattus norvegicus
ccagtagtcatgacagaagtctctt

SEQ ID NO: 245753 - DNA, 25 bp, Rattus norvegicus
ccagtagtcatgtcagaagtctctt

SEQ ID NO: 245754 - DNA, 25 bp, Rattus norvegicus
ccagtagtccacatcttcaagaaca

SEQ ID NO: 245755 - DNA, 25 bp, Rattus norvegicus
ccagtagtccacttcttcaagaaca

SEQ ID NO: 245756 - DNA, 25 bp, Rattus norvegicus
ccagtagtgcccagttttgggttat

SEQ ID NO: 245757 - DNA, 25 bp, Rattus norvegicus
ccagtagtgccctgttttgggttat

SEQ ID NO: 245758 - DNA, 25 bp, Rattus norvegicus
ccagtatataacctgctatcttggg

SEQ ID NO: 245759 - DNA, 25 bp, Rattus norvegicus
ccagtatataacgtgctatcttggg

SEQ ID NO: 245760 - DNA, 25 bp, Rattus norvegicus
ccagtatctcctcgctttttgaaag

SEQ ID NO: 245761 - DNA, 25 bp, Rattus norvegicus
ccagtatctcctggctttttgaaag

SEQ ID NO: 245762 - DNA, 25 bp, Rattus norvegicus
ccagtatggatgaaccagaggcaaa

SEQ ID NO: 245763 - DNA, 25 bp, Rattus norvegicus
ccagtatggatgtaccagaggcaaa

SEQ ID NO: 245764 - DNA, 25 bp, Rattus norvegicus
ccagtatgtcacattaataggcttt

SEQ ID NO: 245765 - DNA, 25 bp, Rattus norvegicus
ccagtatgtcactttaataggcttt

SEQ ID NO: 245766 - DNA, 25 bp, Rattus norvegicus
ccagtcaaaactcctcaactctgtt

SEQ ID NO: 245767 - DNA, 25 bp, Rattus norvegicus
ccagtcaaaactgctcaactctgtt

SEQ ID NO: 245768 - DNA, 25 bp, Rattus norvegicus
ccagtcaatgccagcccaggctgtg

SEQ ID NO: 245769 - DNA, 25 bp, Rattus norvegicus
ccagtcaatgcctgcccaggctgtg

SEQ ID NO: 245770 - DNA, 25 bp, Rattus norvegicus
ccagtcaccctcatgaattatcaga

SEQ ID NO: 245771 - DNA, 25 bp, Rattus norvegicus
ccagtcaccctcttgaattatcaga

SEQ ID NO: 245772 - DNA, 25 bp, Rattus norvegicus
ccagtcagcagtcgcgtccatgaag

SEQ ID NO: 245773 - DNA, 25 bp, Rattus norvegicus
ccagtcagcagtggcgtccatgaag

SEQ ID NO: 245774 - DNA, 25 bp, Rattus norvegicus
ccagtcagcctccttgaaagatcaa

SEQ ID NO: 245775 - DNA, 25 bp, Rattus norvegicus
ccagtcagcctcgttgaaagatcaa

SEQ ID NO: 245776 - DNA, 25 bp, Rattus norvegicus
ccagtcaggaggcatagtttttact

SEQ ID NO: 245777 - DNA, 25 bp, Rattus norvegicus
ccagtcaggagggatagtttttact

SEQ ID NO: 245778 - DNA, 25 bp, Rattus norvegicus
ccagtcagtaataatgtagaactac

SEQ ID NO: 245779 - DNA, 25 bp, Rattus norvegicus
ccagtcagtaattatgtagaactac

SEQ ID NO: 245780 - DNA, 25 bp, Rattus norvegicus
ccagtcattaaaacgggatctatcc

SEQ ID NO: 245781 - DNA, 25 bp, Rattus norvegicus
ccagtcattaaatcgggatctatcc

SEQ ID NO: 245782 - DNA, 25 bp, Rattus norvegicus
ccagtccagagccaactagggtaga

SEQ ID NO: 245783 - DNA, 25 bp, Rattus norvegicus
ccagtccagagcgaactagggtaga

SEQ ID NO: 245784 - DNA, 25 bp, Rattus norvegicus
ccagtccagggaccccacagaggtg

SEQ ID NO: 245785 - DNA, 25 bp, Rattus norvegicus
ccagtccagggagcccacagaggtg

SEQ ID NO: 245786 - DNA, 25 bp, Rattus norvegicus
ccagtccagggtacagaaataacga

SEQ ID NO: 245787 - DNA, 25 bp, Rattus norvegicus
ccagtccagggttcagaaataacga

SEQ ID NO: 245788 - DNA, 25 bp, Rattus norvegicus
ccagtccatggaaagcgagcgtgca

SEQ ID NO: 245789 - DNA, 25 bp, Rattus norvegicus
ccagtccatggatagcgagcgtgca

SEQ ID NO: 245790 - DNA, 25 bp, Rattus norvegicus
ccagtcccaaccacttgaagtaaat

SEQ ID NO: 245791 - DNA, 25 bp, Rattus norvegicus
ccagtcccaacctcttgaagtaaat

SEQ ID NO: 245792 - DNA, 25 bp, Rattus norvegicus
ccagtcccagagaacatgataccct

SEQ ID NO: 245793 - DNA, 25 bp, Rattus norvegicus
ccagtcccagagtacatgataccct

SEQ ID NO: 245794 - DNA, 25 bp, Rattus norvegicus
ccagtcccagatcacaggtttattg

SEQ ID NO: 245795 - DNA, 25 bp, Rattus norvegicus
ccagtcccagatgacaggtttattg

SEQ ID NO: 245796 - DNA, 25 bp, Rattus norvegicus
ccagtcccagctaggtgaggtttga

SEQ ID NO: 245797 - DNA, 25 bp, Rattus norvegicus
ccagtcccagcttggtgaggtttga

SEQ ID NO: 245798 - DNA, 25 bp, Rattus norvegicus
ccagtcccaggaatagaggtaccga

SEQ ID NO: 245799 - DNA, 25 bp, Rattus norvegicus
ccagtcccaggattagaggtaccga

SEQ ID NO: 245800 - DNA, 25 bp, Rattus norvegicus
ccagtccccattaggtggctataag

SEQ ID NO: 245801 - DNA, 25 bp, Rattus norvegicus
ccagtccccatttggtggctataag

SEQ ID NO: 245802 - DNA, 25 bp, Rattus norvegicus
ccagtccctgtaactatttaaaaag

SEQ ID NO: 245803 - DNA, 25 bp, Rattus norvegicus
ccagtccctgtatctatttaaaaag

SEQ ID NO: 245804 - DNA, 25 bp, Rattus norvegicus
ccagtcctacatcacccttagaaaa

SEQ ID NO: 245805 - DNA, 25 bp, Rattus norvegicus
ccagtcctacatgacccttagaaaa

SEQ ID NO: 245806 - DNA, 25 bp, Rattus norvegicus
ccagtcctaggaaatcccatgaact

SEQ ID NO: 245807 - DNA, 25 bp, Rattus norvegicus
ccagtcctaggatatcccatgaact

SEQ ID NO: 245808 - DNA, 25 bp, Rattus norvegicus
ccagtcctgccacaagtctaagata

SEQ ID NO: 245809 - DNA, 25 bp, Rattus norvegicus
ccagtcctgccagaagtctaagata

SEQ ID NO: 245810 - DNA, 25 bp, Rattus norvegicus
ccagtcctgtagaaatgcttgctat

SEQ ID NO: 245811 - DNA, 25 bp, Rattus norvegicus
ccagtcctgtagtaatgcttgctat

SEQ ID NO: 245812 - DNA, 25 bp, Rattus norvegicus
ccagtccttagtctgacggctttga

SEQ ID NO: 245813 - DNA, 25 bp, Rattus norvegicus
ccagtccttagtgtgacggctttga

SEQ ID NO: 245814 - DNA, 25 bp, Rattus norvegicus
ccagtccttcccattatacttgaaa

SEQ ID NO: 245815 - DNA, 25 bp, Rattus norvegicus
ccagtccttccctttatacttgaaa

SEQ ID NO: 245816 - DNA, 25 bp, Rattus norvegicus
ccagtcctttctaggtagatcctag

SEQ ID NO: 245817 - DNA, 25 bp, Rattus norvegicus
ccagtcctttcttggtagatcctag

SEQ ID NO: 245818 - DNA, 25 bp, Rattus norvegicus
ccagtcgaacttcggatgggacttt

SEQ ID NO: 245819 - DNA, 25 bp, Rattus norvegicus
ccagtcgaacttgggatgggacttt

SEQ ID NO: 245820 - DNA, 25 bp, Rattus norvegicus
ccagtcgttctcatagacatgcaca

SEQ ID NO: 245821 - DNA, 25 bp, Rattus norvegicus
ccagtcgttctcttagacatgcaca

SEQ ID NO: 245822 - DNA, 25 bp, Rattus norvegicus
ccagtctaggcgcagcttacaaata

SEQ ID NO: 245823 - DNA, 25 bp, Rattus norvegicus
ccagtctaggcggagcttacaaata

SEQ ID NO: 245824 - DNA, 25 bp, Rattus norvegicus
ccagtctcaaccaccagttttagat

SEQ ID NO: 245825 - DNA, 25 bp, Rattus norvegicus
ccagtctcaacctccagttttagat

SEQ ID NO: 245826 - DNA, 25 bp, Rattus norvegicus
ccagtctcgcttccaggctgaggaa

SEQ ID NO: 245827 - DNA, 25 bp, Rattus norvegicus
ccagtctcgcttgcaggctgaggaa

SEQ ID NO: 245828 - DNA, 25 bp, Rattus norvegicus
ccagtctctcccagatgattttgta

SEQ ID NO: 245829 - DNA, 25 bp, Rattus norvegicus
ccagtctctcccagtttgttattga

SEQ ID NO: 245830 - DNA, 25 bp, Rattus norvegicus
ccagtctctccctgatgattttgta

SEQ ID NO: 245831 - DNA, 25 bp, Rattus norvegicus
ccagtctctccctgtttgttattga

SEQ ID NO: 245832 - DNA, 25 bp, Rattus norvegicus
ccagtctctgggattgcacgtgtaa

SEQ ID NO: 245833 - DNA, 25 bp, Rattus norvegicus
ccagtctctgggtttgcacgtgtaa

SEQ ID NO: 245834 - DNA, 25 bp, Rattus norvegicus
ccagtctgaaagagtactcgtagca

SEQ ID NO: 245835 - DNA, 25 bp, Rattus norvegicus
ccagtctgaaagtgtactcgtagca

SEQ ID NO: 245836 - DNA, 25 bp, Rattus norvegicus
ccagtctgccctcccaaagaaaaga

SEQ ID NO: 245837 - DNA, 25 bp, Rattus norvegicus
ccagtctgccctgccaaagaaaaga

SEQ ID NO: 245838 - DNA, 25 bp, Rattus norvegicus
ccagtctgcgccagctaaaaggtat

SEQ ID NO: 245839 - DNA, 25 bp, Rattus norvegicus
ccagtctgcgcctgctaaaaggtat

SEQ ID NO: 245840 - DNA, 25 bp, Rattus norvegicus
ccagtctggcagagtttgatcttac

SEQ ID NO: 245841 - DNA, 25 bp, Rattus norvegicus
ccagtctggcagtgtttgatcttac

SEQ ID NO: 245842 - DNA, 25 bp, Rattus norvegicus
ccagtctgtcaaatctagggattcg

SEQ ID NO: 245843 - DNA, 25 bp, Rattus norvegicus
ccagtctgtcaattctagggattcg

SEQ ID NO: 245844 - DNA, 25 bp, Rattus norvegicus
ccagtcttctggaggattaagcaaa

SEQ ID NO: 245845 - DNA, 25 bp, Rattus norvegicus
ccagtcttctggtggattaagcaaa

SEQ ID NO: 245846 - DNA, 25 bp, Rattus norvegicus
ccagtcttggtccagttggttgtca

SEQ ID NO: 245847 - DNA, 25 bp, Rattus norvegicus
ccagtcttggtcgagttggttgtca

SEQ ID NO: 245848 - DNA, 25 bp, Rattus norvegicus
ccagtgaatgcactctgtgctttga

SEQ ID NO: 245849 - DNA, 25 bp, Rattus norvegicus
ccagtgaatgcagtctgtgctttga

SEQ ID NO: 245850 - DNA, 25 bp, Rattus norvegicus
ccagtgacaagccaggacgctgttt

SEQ ID NO: 245851 - DNA, 25 bp, Rattus norvegicus
ccagtgacaagcgaggacgctgttt

SEQ ID NO: 245852 - DNA, 25 bp, Rattus norvegicus
ccagtgaccattctctttaagacct

SEQ ID NO: 245853 - DNA, 25 bp, Rattus norvegicus
ccagtgaccattgtctttaagacct

SEQ ID NO: 245854 - DNA, 25 bp, Rattus norvegicus
ccagtgaccggcacgggcactaaac

SEQ ID NO: 245855 - DNA, 25 bp, Rattus norvegicus
ccagtgaccggctcgggcactaaac

SEQ ID NO: 245856 - DNA, 25 bp, Rattus norvegicus
ccagtgacctaaactttcttcttca

SEQ ID NO: 245857 - DNA, 25 bp, Rattus norvegicus
ccagtgacctaatctttcttcttca

SEQ ID NO: 245858 - DNA, 25 bp, Rattus norvegicus
ccagtgacgggcaacttcccttcta

SEQ ID NO: 245859 - DNA, 25 bp, Rattus norvegicus
ccagtgacgggctacttcccttcta

SEQ ID NO: 245860 - DNA, 25 bp, Rattus norvegicus
ccagtgactgcaattggatagttgt

SEQ ID NO: 245861 - DNA, 25 bp, Rattus norvegicus
ccagtgactgcatttggatagttgt

SEQ ID NO: 245862 - DNA, 25 bp, Rattus norvegicus
ccagtgactggccatagaaatgaca

SEQ ID NO: 245863 - DNA, 25 bp, Rattus norvegicus
ccagtgactggcgatagaaatgaca

SEQ ID NO: 245864 - DNA, 25 bp, Rattus norvegicus
ccagtgactgggaagatttgtatat

SEQ ID NO: 245865 - DNA, 25 bp, Rattus norvegicus
ccagtgactgggtagatttgtatat

SEQ ID NO: 245866 - DNA, 25 bp, Rattus norvegicus
ccagtgagccggagcttgctgtgca

SEQ ID NO: 245867 - DNA, 25 bp, Rattus norvegicus
ccagtgagccggtgcttgctgtgca

SEQ ID NO: 245868 - DNA, 25 bp, Rattus norvegicus
ccagtgagtgtgagcttttgcaggc

SEQ ID NO: 245869 - DNA, 25 bp, Rattus norvegicus
ccagtgagtgtgtgcttttgcaggc

SEQ ID NO: 245870 - DNA, 25 bp, Rattus norvegicus
ccagtgattgacatgccacttcatg

SEQ ID NO: 245871 - DNA, 25 bp, Rattus norvegicus
ccagtgattgacttgccacttcatg

SEQ ID NO: 245872 - DNA, 25 bp, Rattus norvegicus
ccagtgattgcaattgtcccagttt

SEQ ID NO: 245873 - DNA, 25 bp, Rattus norvegicus
ccagtgattgcatttgtcccagttt

SEQ ID NO: 245874 - DNA, 25 bp, Rattus norvegicus
ccagtgcaaattccctcaggttagt

SEQ ID NO: 245875 - DNA, 25 bp, Rattus norvegicus
ccagtgcaaattgcctcaggttagt

SEQ ID NO: 245876 - DNA, 25 bp, Rattus norvegicus
ccagtgcaagcaatctaaccctaat

SEQ ID NO: 245877 - DNA, 25 bp, Rattus norvegicus
ccagtgcaagcattctaaccctaat

SEQ ID NO: 245878 - DNA, 25 bp, Rattus norvegicus
ccagtgcactgtaggcttcatcagt

SEQ ID NO: 245879 - DNA, 25 bp, Rattus norvegicus
ccagtgcactgttggcttcatcagt

SEQ ID NO: 245880 - DNA, 25 bp, Rattus norvegicus
ccagtgccaagcaagcttcaggaga

SEQ ID NO: 245881 - DNA, 25 bp, Rattus norvegicus
ccagtgccaagctagcttcaggaga

SEQ ID NO: 245882 - DNA, 25 bp, Rattus norvegicus
ccagtgcccaggagtcctagtaagg

SEQ ID NO: 245883 - DNA, 25 bp, Rattus norvegicus
ccagtgcccaggtgtcctagtaagg

SEQ ID NO: 245884 - DNA, 25 bp, Rattus norvegicus
ccagtgccttccatcttagtataaa

SEQ ID NO: 245885 - DNA, 25 bp, Rattus norvegicus
ccagtgccttccttcttagtataaa

SEQ ID NO: 245886 - DNA, 25 bp, Rattus norvegicus
ccagtgccttctcctatgagaacga

SEQ ID NO: 245887 - DNA, 25 bp, Rattus norvegicus
ccagtgccttctgctatgagaacga

SEQ ID NO: 245888 - DNA, 25 bp, Rattus norvegicus
ccagtgctaacacgtgtgacatttt

SEQ ID NO: 245889 - DNA, 25 bp, Rattus norvegicus
ccagtgctaacaggtgtgacatttt

SEQ ID NO: 245890 - DNA, 25 bp, Rattus norvegicus
ccagtgctaacccagtagctgttgt

SEQ ID NO: 245891 - DNA, 25 bp, Rattus norvegicus
ccagtgctaaccgagtagctgttgt

SEQ ID NO: 245892 - DNA, 25 bp, Rattus norvegicus
ccagtgctcaacaagcagctgacct

SEQ ID NO: 245893 - DNA, 25 bp, Rattus norvegicus
ccagtgctcaactagcagctgacct

SEQ ID NO: 245894 - DNA, 25 bp, Rattus norvegicus
ccagtgctccctcgctgagaaggaa

SEQ ID NO: 245895 - DNA, 25 bp, Rattus norvegicus
ccagtgctccctggctgagaaggaa

SEQ ID NO: 245896 - DNA, 25 bp, Rattus norvegicus
ccagtgctctctccttgaatggcaa

SEQ ID NO: 245897 - DNA, 25 bp, Rattus norvegicus
ccagtgctctctgcttgaatggcaa

SEQ ID NO: 245898 - DNA, 25 bp, Rattus norvegicus
ccagtgctctgcaatggtgggatca

SEQ ID NO: 245899 - DNA, 25 bp, Rattus norvegicus
ccagtgctctgctatggtgggatca

SEQ ID NO: 245900 - DNA, 25 bp, Rattus norvegicus
ccagtgctggccaaagttctcagga

SEQ ID NO: 245901 - DNA, 25 bp, Rattus norvegicus
ccagtgctggcctaagttctcagga

SEQ ID NO: 245902 - DNA, 25 bp, Rattus norvegicus
ccagtgctgtctcctcacatttgaa

SEQ ID NO: 245903 - DNA, 25 bp, Rattus norvegicus
ccagtgctgtctgctcacatttgaa

SEQ ID NO: 245904 - DNA, 25 bp, Rattus norvegicus
ccagtggaaattagtctaggcctgt

SEQ ID NO: 245905 - DNA, 25 bp, Rattus norvegicus
ccagtggaaatttgtctaggcctgt

SEQ ID NO: 245906 - DNA, 25 bp, Rattus norvegicus
ccagtggaaccaaaaacgggcagct

SEQ ID NO: 245907 - DNA, 25 bp, Rattus norvegicus
ccagtggaaccataaacgggcagct

SEQ ID NO: 245908 - DNA, 25 bp, Rattus norvegicus
ccagtggagcatagaccggagccgt

SEQ ID NO: 245909 - DNA, 25 bp, Rattus norvegicus
ccagtggagcattgaccggagccgt

SEQ ID NO: 245910 - DNA, 25 bp, Rattus norvegicus
ccagtggcacgaatgtagggcattt

SEQ ID NO: 245911 - DNA, 25 bp, Rattus norvegicus
ccagtggcacgattgtagggcattt

SEQ ID NO: 245912 - DNA, 25 bp, Rattus norvegicus
ccagtggcactccttggcaactaga

SEQ ID NO: 245913 - DNA, 25 bp, Rattus norvegicus
ccagtggcactcgttggcaactaga

SEQ ID NO: 245914 - DNA, 25 bp, Rattus norvegicus
ccagtggccagtcccttacaatagg

SEQ ID NO: 245915 - DNA, 25 bp, Rattus norvegicus
ccagtggccagtgccttacaatagg

SEQ ID NO: 245916 - DNA, 25 bp, Rattus norvegicus
ccagtggccccgaaatcatggagat

SEQ ID NO: 245917 - DNA, 25 bp, Rattus norvegicus
ccagtggccccgtaatcatggagat

SEQ ID NO: 245918 - DNA, 25 bp, Rattus norvegicus
ccagtggctaatcaggtcctatgct

SEQ ID NO: 245919 - DNA, 25 bp, Rattus norvegicus
ccagtggctaatgaggtcctatgct

SEQ ID NO: 245920 - DNA, 25 bp, Rattus norvegicus
ccagtggcttaaactgtcttggact

SEQ ID NO: 245921 - DNA, 25 bp, Rattus norvegicus
ccagtggcttaatctgtcttggact

SEQ ID NO: 245922 - DNA, 25 bp, Rattus norvegicus
ccagtggcttcaatggtgggcacca

SEQ ID NO: 245923 - DNA, 25 bp, Rattus norvegicus
ccagtggcttcacgtctctgtataa

SEQ ID NO: 245924 - DNA, 25 bp, Rattus norvegicus
ccagtggcttcaggtctctgtataa

SEQ ID NO: 245925 - DNA, 25 bp, Rattus norvegicus
ccagtggcttcattggtgggcacca

SEQ ID NO: 245926 - DNA, 25 bp, Rattus norvegicus
ccagtgggtggcagactcagtgatt

SEQ ID NO: 245927 - DNA, 25 bp, Rattus norvegicus
ccagtgggtggctgactcagtgatt

SEQ ID NO: 245928 - DNA, 25 bp, Rattus norvegicus
ccagtgggtgttataggccttctaa

SEQ ID NO: 245929 - DNA, 25 bp, Rattus norvegicus
ccagtgggtgttttaggccttctaa

SEQ ID NO: 245930 - DNA, 25 bp, Rattus norvegicus
ccagtgggttctctttatcctctca

SEQ ID NO: 245931 - DNA, 25 bp, Rattus norvegicus
ccagtgggttctgtttatcctctca

SEQ ID NO: 245932 - DNA, 25 bp, Rattus norvegicus
ccagtggtctggcaagtgtcttgca

SEQ ID NO: 245933 - DNA, 25 bp, Rattus norvegicus
ccagtggtctgggaagtgtcttgca

SEQ ID NO: 245934 - DNA, 25 bp, Rattus norvegicus
ccagtgtacgttacttgaggttgta

SEQ ID NO: 245935 - DNA, 25 bp, Rattus norvegicus
ccagtgtacgtttcttgaggttgta

SEQ ID NO: 245936 - DNA, 25 bp, Rattus norvegicus
ccagtgtatcacatactttttcggg

SEQ ID NO: 245937 - DNA, 25 bp, Rattus norvegicus
ccagtgtatcacttactttttcggg

SEQ ID NO: 245938 - DNA, 25 bp, Rattus norvegicus
ccagtgtcccatacagctttttatt

SEQ ID NO: 245939 - DNA, 25 bp, Rattus norvegicus
ccagtgtcccattcagctttttatt

SEQ ID NO: 245940 - DNA, 25 bp, Rattus norvegicus
ccagtgtccctcagtactagaaagt

SEQ ID NO: 245941 - DNA, 25 bp, Rattus norvegicus
ccagtgtccctctgtactagaaagt

SEQ ID NO: 245942 - DNA, 25 bp, Rattus norvegicus
ccagtgtggacgacaagaatgttct

SEQ ID NO: 245943 - DNA, 25 bp, Rattus norvegicus
ccagtgtggacgtcaagaatgttct

SEQ ID NO: 245944 - DNA, 25 bp, Rattus norvegicus
ccagtgtggctccattaaagtccta

SEQ ID NO: 245945 - DNA, 25 bp, Rattus norvegicus
ccagtgtggctcgattaaagtccta

SEQ ID NO: 245946 - DNA, 25 bp, Rattus norvegicus
ccagtgtggttgagcacacctttaa

SEQ ID NO: 245947 - DNA, 25 bp, Rattus norvegicus
ccagtgtggttgtgcacacctttaa

SEQ ID NO: 245948 - DNA, 25 bp, Rattus norvegicus
ccagtgtgtcgcattggtcctgtgg

SEQ ID NO: 245949 - DNA, 25 bp, Rattus norvegicus
ccagtgtgtcgctttggtcctgtgg

SEQ ID NO: 245950 - DNA, 25 bp, Rattus norvegicus
ccagtgtgtctgaaaccgttctatc

SEQ ID NO: 245951 - DNA, 25 bp, Rattus norvegicus
ccagtgtgtctgtaaccgttctatc

SEQ ID NO: 245952 - DNA, 25 bp, Rattus norvegicus
ccagtgtgtgttctcgtttgctaac

SEQ ID NO: 245953 - DNA, 25 bp, Rattus norvegicus
ccagtgtgtgttgtcgtttgctaac

SEQ ID NO: 245954 - DNA, 25 bp, Rattus norvegicus
ccagtgttaacaccaagaaggtcaa

SEQ ID NO: 245955 - DNA, 25 bp, Rattus norvegicus
ccagtgttaacagcaagaaggtcaa

SEQ ID NO: 245956 - DNA, 25 bp, Rattus norvegicus
ccagtgttagtcatattgtacttga

SEQ ID NO: 245957 - DNA, 25 bp, Rattus norvegicus
ccagtgttagtcttattgtacttga

SEQ ID NO: 245958 - DNA, 25 bp, Rattus norvegicus
ccagtgttccaccaaacagggatgg

SEQ ID NO: 245959 - DNA, 25 bp, Rattus norvegicus
ccagtgttccacgaaacagggatgg

SEQ ID NO: 245960 - DNA, 25 bp, Rattus norvegicus
ccagtgttgaatctgtcttatttta

SEQ ID NO: 245961 - DNA, 25 bp, Rattus norvegicus
ccagtgttgaatgtgtcttatttta

SEQ ID NO: 245962 - DNA, 25 bp, Rattus norvegicus
ccagtgttgtctcttgccggcaata

SEQ ID NO: 245963 - DNA, 25 bp, Rattus norvegicus
ccagtgttgtctgttgccggcaata

SEQ ID NO: 245964 - DNA, 25 bp, Rattus norvegicus
ccagtgtttactatgttaagcttaa

SEQ ID NO: 245965 - DNA, 25 bp, Rattus norvegicus
ccagtgtttactttgttaagcttaa

SEQ ID NO: 245966 - DNA, 25 bp, Rattus norvegicus
ccagtgtttctcaccagaggcaaag

SEQ ID NO: 245967 - DNA, 25 bp, Rattus norvegicus
ccagtgtttctctccagaggcaaag

SEQ ID NO: 245968 - DNA, 25 bp, Rattus norvegicus
ccagtgtttctgagcgatacgatta

SEQ ID NO: 245969 - DNA, 25 bp, Rattus norvegicus
ccagtgtttctgtgcgatacgatta

SEQ ID NO: 245970 - DNA, 25 bp, Rattus norvegicus
ccagtgtttcttatcctttgttcat

SEQ ID NO: 245971 - DNA, 25 bp, Rattus norvegicus
ccagtgtttcttttcctttgttcat

SEQ ID NO: 245972 - DNA, 25 bp, Rattus norvegicus
ccagttacatacaaggatccggcat

SEQ ID NO: 245973 - DNA, 25 bp, Rattus norvegicus
ccagttacatactaggatccggcat

SEQ ID NO: 245974 - DNA, 25 bp, Rattus norvegicus
ccagttaccgtaatgttttgcagaa

SEQ ID NO: 245975 - DNA, 25 bp, Rattus norvegicus
ccagttaccgtattgttttgcagaa

SEQ ID NO: 245976 - DNA, 25 bp, Rattus norvegicus
ccagttactaaacggcttgtccatt

SEQ ID NO: 245977 - DNA, 25 bp, Rattus norvegicus
ccagttactaaagggcttgtccatt

SEQ ID NO: 245978 - DNA, 25 bp, Rattus norvegicus
ccagttacttccatcatgcattact

SEQ ID NO: 245979 - DNA, 25 bp, Rattus norvegicus
ccagttacttccttcatgcattact

SEQ ID NO: 245980 - DNA, 25 bp, Rattus norvegicus
ccagttagaaccaaaccctctgttg

SEQ ID NO: 245981 - DNA, 25 bp, Rattus norvegicus
ccagttagaacctaaccctctgttg

SEQ ID NO: 245982 - DNA, 25 bp, Rattus norvegicus
ccagttagagtacactttgttacca

SEQ ID NO: 245983 - DNA, 25 bp, Rattus norvegicus
ccagttagagtagactttgttacca

SEQ ID NO: 245984 - DNA, 25 bp, Rattus norvegicus
ccagttatgatgagtgtgcttcagt

SEQ ID NO: 245985 - DNA, 25 bp, Rattus norvegicus
ccagttatgatgtgtgtgcttcagt

SEQ ID NO: 245986 - DNA, 25 bp, Rattus norvegicus
ccagttcagcatcccatgtgggtat

SEQ ID NO: 245987 - DNA, 25 bp, Rattus norvegicus
ccagttcagcatgccatgtgggtat

SEQ ID NO: 245988 - DNA, 25 bp, Rattus norvegicus
ccagttccaacgatcttacatcaaa

SEQ ID NO: 245989 - DNA, 25 bp, Rattus norvegicus
ccagttccaacgttcttacatcaaa

SEQ ID NO: 245990 - DNA, 25 bp, Rattus norvegicus
ccagttccagagatcttatgccctc

SEQ ID NO: 245991 - DNA, 25 bp, Rattus norvegicus
ccagttccagagttcttatgccctc

SEQ ID NO: 245992 - DNA, 25 bp, Rattus norvegicus
ccagttccagtgaggatgtctccct

SEQ ID NO: 245993 - DNA, 25 bp, Rattus norvegicus
ccagttccagtgtggatgtctccct

SEQ ID NO: 245994 - DNA, 25 bp, Rattus norvegicus
ccagttccagttacgtatttttcat

SEQ ID NO: 245995 - DNA, 25 bp, Rattus norvegicus
ccagttccagtttcgtatttttcat

SEQ ID NO: 245996 - DNA, 25 bp, Rattus norvegicus
ccagttcccatgaagcagccataga

SEQ ID NO: 245997 - DNA, 25 bp, Rattus norvegicus
ccagttcccatgtagcagccataga

SEQ ID NO: 245998 - DNA, 25 bp, Rattus norvegicus
ccagttccctgacgctgcagagagg

SEQ ID NO: 245999 - DNA, 25 bp, Rattus norvegicus
ccagttccctgaggctgcagagagg

SEQ ID NO: 246000 - DNA, 25 bp, Rattus norvegicus
ccagttcctactccttgggagggat

SEQ ID NO: 246001 - DNA, 25 bp, Rattus norvegicus
ccagttcctactgcttgggagggat

SEQ ID NO: 246002 - DNA, 25 bp, Rattus norvegicus
ccagttctgtggattgatccttcag

SEQ ID NO: 246003 - DNA, 25 bp, Rattus norvegicus
ccagttctgtggtttgatccttcag

SEQ ID NO: 246004 - DNA, 25 bp, Rattus norvegicus
ccagttcttcctcacctgtgataag

SEQ ID NO: 246005 - DNA, 25 bp, Rattus norvegicus
ccagttcttcctgacctgtgataag

SEQ ID NO: 246006 - DNA, 25 bp, Rattus norvegicus
ccagttctttttaagctttcaatgt

SEQ ID NO: 246007 - DNA, 25 bp, Rattus norvegicus
ccagttcttttttagctttcaatgt

SEQ ID NO: 246008 - DNA, 25 bp, Rattus norvegicus
ccagttgccatcattgctgcaaatg

SEQ ID NO: 246009 - DNA, 25 bp, Rattus norvegicus
ccagttgccatctttgctgcaaatg

SEQ ID NO: 246010 - DNA, 25 bp, Rattus norvegicus
ccagttgcccgaacggtgtcagtaa

SEQ ID NO: 246011 - DNA, 25 bp, Rattus norvegicus
ccagttgcccgatcggtgtcagtaa

SEQ ID NO: 246012 - DNA, 25 bp, Rattus norvegicus
ccagttggagcgcatttcaggaaca

SEQ ID NO: 246013 - DNA, 25 bp, Rattus norvegicus
ccagttggagcggatttcaggaaca

SEQ ID NO: 246014 - DNA, 25 bp, Rattus norvegicus
ccagttggcttgaagggacattttc

SEQ ID NO: 246015 - DNA, 25 bp, Rattus norvegicus
ccagttggcttgtagggacattttc

SEQ ID NO: 246016 - DNA, 25 bp, Rattus norvegicus
ccagttggtagcattggttttccat

SEQ ID NO: 246017 - DNA, 25 bp, Rattus norvegicus
ccagttggtagctttggttttccat

SEQ ID NO: 246018 - DNA, 25 bp, Rattus norvegicus
ccagttggtctaccctgggctctgt

SEQ ID NO: 246019 - DNA, 25 bp, Rattus norvegicus
ccagttggtctagcctgggctctgt

SEQ ID NO: 246020 - DNA, 25 bp, Rattus norvegicus
ccagttgtaaccaccgcataaattc

SEQ ID NO: 246021 - DNA, 25 bp, Rattus norvegicus
ccagttgtaacctccgcataaattc

SEQ ID NO: 246022 - DNA, 25 bp, Rattus norvegicus
ccagttgtaagcagccgcggagcat

SEQ ID NO: 246023 - DNA, 25 bp, Rattus norvegicus
ccagttgtaagctgccgcggagcat

SEQ ID NO: 246024 - DNA, 25 bp, Rattus norvegicus
ccagttgtccagagagattttccac

SEQ ID NO: 246025 - DNA, 25 bp, Rattus norvegicus
ccagttgtccagtgagattttccac

SEQ ID NO: 246026 - DNA, 25 bp, Rattus norvegicus
ccagttgtgctcagttggctttatt

SEQ ID NO: 246027 - DNA, 25 bp, Rattus norvegicus
ccagttgtgctctgttggctttatt

SEQ ID NO: 246028 - DNA, 25 bp, Rattus norvegicus
ccagttgttggaagtcggtctctca

SEQ ID NO: 246029 - DNA, 25 bp, Rattus norvegicus
ccagttgttggatgtcggtctctca

SEQ ID NO: 246030 - DNA, 25 bp, Rattus norvegicus
ccagtttactctcctaactattcag

SEQ ID NO: 246031 - DNA, 25 bp, Rattus norvegicus
ccagtttactctgctaactattcag

SEQ ID NO: 246032 - DNA, 25 bp, Rattus norvegicus
ccagtttccatccatgacttgatac

SEQ ID NO: 246033 - DNA, 25 bp, Rattus norvegicus
ccagtttccatcgatgacttgatac

SEQ ID NO: 246034 - DNA, 25 bp, Rattus norvegicus
ccagtttcccatcgctcacagaaag

SEQ ID NO: 246035 - DNA, 25 bp, Rattus norvegicus
ccagtttcccatggctcacagaaag

SEQ ID NO: 246036 - DNA, 25 bp, Rattus norvegicus
ccagtttccctgatctgctagaaag

SEQ ID NO: 246037 - DNA, 25 bp, Rattus norvegicus
ccagtttccctgttctgctagaaag

SEQ ID NO: 246038 - DNA, 25 bp, Rattus norvegicus
ccagtttcctgacgtacttctgcaa

SEQ ID NO: 246039 - DNA, 25 bp, Rattus norvegicus
ccagtttcctgaggtacttctgcaa

SEQ ID NO: 246040 - DNA, 25 bp, Rattus norvegicus
ccagtttcggataaaggcaccttca

SEQ ID NO: 246041 - DNA, 25 bp, Rattus norvegicus
ccagtttcggattaaggcaccttca

SEQ ID NO: 246042 - DNA, 25 bp, Rattus norvegicus
ccagtttctggcatagcgctatttg

SEQ ID NO: 246043 - DNA, 25 bp, Rattus norvegicus
ccagtttctggcttagcgctatttg

SEQ ID NO: 246044 - DNA, 25 bp, Rattus norvegicus
ccagtttcttcaattccggattgag

SEQ ID NO: 246045 - DNA, 25 bp, Rattus norvegicus
ccagtttcttcatttccggattgag

SEQ ID NO: 246046 - DNA, 25 bp, Rattus norvegicus
ccagtttgatctactgactccataa

SEQ ID NO: 246047 - DNA, 25 bp, Rattus norvegicus
ccagtttgatcttctgactccataa

SEQ ID NO: 246048 - DNA, 25 bp, Rattus norvegicus
ccagtttgccagatgtgttattcct

SEQ ID NO: 246049 - DNA, 25 bp, Rattus norvegicus
ccagtttgccagttgtgttattcct

SEQ ID NO: 246050 - DNA, 25 bp, Rattus norvegicus
ccagttttcaacacaagtcccagtt

SEQ ID NO: 246051 - DNA, 25 bp, Rattus norvegicus
ccagttttcaactcaagtcccagtt

SEQ ID NO: 246052 - DNA, 25 bp, Rattus norvegicus
ccagttttgaaaagtactggcccaa

SEQ ID NO: 246053 - DNA, 25 bp, Rattus norvegicus
ccagttttgaaatgtactggcccaa

SEQ ID NO: 246054 - DNA, 25 bp, Rattus norvegicus
ccataaaccgagctgttagtcttgt

SEQ ID NO: 246055 - DNA, 25 bp, Rattus norvegicus
ccataaaccgaggtgttagtcttgt

SEQ ID NO: 246056 - DNA, 25 bp, Rattus norvegicus
ccataaacgggcataactcagcttt

SEQ ID NO: 246057 - DNA, 25 bp, Rattus norvegicus
ccataaacgggcttaactcagcttt

SEQ ID NO: 246058 - DNA, 25 bp, Rattus norvegicus
ccataaatacctcggcatcgggaag

SEQ ID NO: 246059 - DNA, 25 bp, Rattus norvegicus
ccataaatacctgggcatcgggaag

SEQ ID NO: 246060 - DNA, 25 bp, Rattus norvegicus
ccataaccacgcacaatatttccaa

SEQ ID NO: 246061 - DNA, 25 bp, Rattus norvegicus
ccataaccacgctcaatatttccaa

SEQ ID NO: 246062 - DNA, 25 bp, Rattus norvegicus
ccataacccttgctgtgctgagtaa

SEQ ID NO: 246063 - DNA, 25 bp, Rattus norvegicus
ccataacccttggtgtgctgagtaa

SEQ ID NO: 246064 - DNA, 25 bp, Rattus norvegicus
ccataagcagctatctggagcggaa

SEQ ID NO: 246065 - DNA, 25 bp, Rattus norvegicus
ccataagcagctttctggagcggaa

SEQ ID NO: 246066 - DNA, 25 bp, Rattus norvegicus
ccataagctgctctgggttaaccat

SEQ ID NO: 246067 - DNA, 25 bp, Rattus norvegicus
ccataagctgctgtgggttaaccat

SEQ ID NO: 246068 - DNA, 25 bp, Rattus norvegicus
ccataaggttttaggcgttgcttgt

SEQ ID NO: 246069 - DNA, 25 bp, Rattus norvegicus
ccataaggtttttggcgttgcttgt

SEQ ID NO: 246070 - DNA, 25 bp, Rattus norvegicus
ccataagtgactatccagccttggt

SEQ ID NO: 246071 - DNA, 25 bp, Rattus norvegicus
ccataagtgactttccagccttggt

SEQ ID NO: 246072 - DNA, 25 bp, Rattus norvegicus
ccataatatgggatctgtaaagggt

SEQ ID NO: 246073 - DNA, 25 bp, Rattus norvegicus
ccataatatgggttctgtaaagggt

SEQ ID NO: 246074 - DNA, 25 bp, Rattus norvegicus
ccatacatttgtagattttgaggaa

SEQ ID NO: 246075 - DNA, 25 bp, Rattus norvegicus
ccatacatttgttgattttgaggaa

SEQ ID NO: 246076 - DNA, 25 bp, Rattus norvegicus
ccatacccagccaacttgtgtataa

SEQ ID NO: 246077 - DNA, 25 bp, Rattus norvegicus
ccatacccagcctacttgtgtataa

SEQ ID NO: 246078 - DNA, 25 bp, Rattus norvegicus
ccataccccgtaattctcaaggatt

SEQ ID NO: 246079 - DNA, 25 bp, Rattus norvegicus
ccataccccgtatttctcaaggatt

SEQ ID NO: 246080 - DNA, 25 bp, Rattus norvegicus
ccatacctgagcacgctggcttctc

SEQ ID NO: 246081 - DNA, 25 bp, Rattus norvegicus
ccatacctgagctcgctggcttctc

SEQ ID NO: 246082 - DNA, 25 bp, Rattus norvegicus
ccatacctgcttctcagtgttggtg

SEQ ID NO: 246083 - DNA, 25 bp, Rattus norvegicus
ccatacctgcttgtcagtgttggtg

SEQ ID NO: 246084 - DNA, 25 bp, Rattus norvegicus
ccataccttgttattaaagccagag

SEQ ID NO: 246085 - DNA, 25 bp, Rattus norvegicus
ccataccttgtttttaaagccagag

SEQ ID NO: 246086 - DNA, 25 bp, Rattus norvegicus
ccatactacaatcactcaaaactgg

SEQ ID NO: 246087 - DNA, 25 bp, Rattus norvegicus
ccatactacaatgactcaaaactgg

SEQ ID NO: 246088 - DNA, 25 bp, Rattus norvegicus
ccatactctcatcaaatcccaagaa

SEQ ID NO: 246089 - DNA, 25 bp, Rattus norvegicus
ccatactctcatgaaatcccaagaa

SEQ ID NO: 246090 - DNA, 25 bp, Rattus norvegicus
ccatactggcaaatgctgagagcat

SEQ ID NO: 246091 - DNA, 25 bp, Rattus norvegicus
ccatactggcaattgctgagagcat

SEQ ID NO: 246092 - DNA, 25 bp, Rattus norvegicus
ccatactgttggcacctacataaaa

SEQ ID NO: 246093 - DNA, 25 bp, Rattus norvegicus
ccatactgttgggacctacataaaa

SEQ ID NO: 246094 - DNA, 25 bp, Rattus norvegicus
ccatacttgccccggcggagaagat

SEQ ID NO: 246095 - DNA, 25 bp, Rattus norvegicus
ccatacttgcccgggcggagaagat

SEQ ID NO: 246096 - DNA, 25 bp, Rattus norvegicus
ccatactttctaactgattccgcta

SEQ ID NO: 246097 - DNA, 25 bp, Rattus norvegicus
ccatactttctatctgattccgcta

SEQ ID NO: 246098 - DNA, 25 bp, Rattus norvegicus
ccatagagcatgagtgttgattgac

SEQ ID NO: 246099 - DNA, 25 bp, Rattus norvegicus
ccatagagcatgtgtgttgattgac

SEQ ID NO: 246100 - DNA, 25 bp, Rattus norvegicus
ccatagatggcaagtgggaccctct

SEQ ID NO: 246101 - DNA, 25 bp, Rattus norvegicus
ccatagatggcatgtgggaccctct

SEQ ID NO: 246102 - DNA, 25 bp, Rattus norvegicus
ccatagcatgtgcactaaagcatca

SEQ ID NO: 246103 - DNA, 25 bp, Rattus norvegicus
ccatagcatgtggactaaagcatca

SEQ ID NO: 246104 - DNA, 25 bp, Rattus norvegicus
ccatagcctccaattactgcttatt

SEQ ID NO: 246105 - DNA, 25 bp, Rattus norvegicus
ccatagcctccatttactgcttatt

SEQ ID NO: 246106 - DNA, 25 bp, Rattus norvegicus
ccatagcctgcaaaagtggtttttt

SEQ ID NO: 246107 - DNA, 25 bp, Rattus norvegicus
ccatagcctgcataagtggtttttt

SEQ ID NO: 246108 - DNA, 25 bp, Rattus norvegicus
ccatagcctggtccctgaggaacga

SEQ ID NO: 246109 - DNA, 25 bp, Rattus norvegicus
ccatagcctggtgcctgaggaacga

SEQ ID NO: 246110 - DNA, 25 bp, Rattus norvegicus
ccatagctctttacccacagggaat

SEQ ID NO: 246111 - DNA, 25 bp, Rattus norvegicus
ccatagctcttttcccacagggaat

SEQ ID NO: 246112 - DNA, 25 bp, Rattus norvegicus
ccatagctggacatacatctcttaa

SEQ ID NO: 246113 - DNA, 25 bp, Rattus norvegicus
ccatagctggacttacatctcttaa

SEQ ID NO: 246114 - DNA, 25 bp, Rattus norvegicus
ccataggatcatattgcctgttctt

SEQ ID NO: 246115 - DNA, 25 bp, Rattus norvegicus
ccataggatcattttgcctgttctt

SEQ ID NO: 246116 - DNA, 25 bp, Rattus norvegicus
ccataggatctgctctgcggtgaag

SEQ ID NO: 246117 - DNA, 25 bp, Rattus norvegicus
ccataggatctggtctgcggtgaag

SEQ ID NO: 246118 - DNA, 25 bp, Rattus norvegicus
ccataggctgtgattgctggtatta

SEQ ID NO: 246119 - DNA, 25 bp, Rattus norvegicus
ccataggctgtgtttgctggtatta

SEQ ID NO: 246120 - DNA, 25 bp, Rattus norvegicus
ccataggtctggctcttgatgccaa

SEQ ID NO: 246121 - DNA, 25 bp, Rattus norvegicus
ccataggtctgggtcttgatgccaa

SEQ ID NO: 246122 - DNA, 25 bp, Rattus norvegicus
ccatagtcgagtagctggcgctgaa

SEQ ID NO: 246123 - DNA, 25 bp, Rattus norvegicus
ccatagtcgagttgctggcgctgaa

SEQ ID NO: 246124 - DNA, 25 bp, Rattus norvegicus
ccatagtgatgcacagactggtctg

SEQ ID NO: 246125 - DNA, 25 bp, Rattus norvegicus
ccatagtgatgctcagactggtctg

SEQ ID NO: 246126 - DNA, 25 bp, Rattus norvegicus
ccatagtggagtatgcaactgtcag

SEQ ID NO: 246127 - DNA, 25 bp, Rattus norvegicus
ccatagtggagtttgcaactgtcag

SEQ ID NO: 246128 - DNA, 25 bp, Rattus norvegicus
ccatagttatctcattcttgcaagt

SEQ ID NO: 246129 - DNA, 25 bp, Rattus norvegicus
ccatagttatctgattcttgcaagt

SEQ ID NO: 246130 - DNA, 25 bp, Rattus norvegicus
ccatagttatttaggtcagttaagt

SEQ ID NO: 246131 - DNA, 25 bp, Rattus norvegicus
ccatagttattttggtcagttaagt

SEQ ID NO: 246132 - DNA, 25 bp, Rattus norvegicus
ccatatcaagggatcttactgctgt

SEQ ID NO: 246133 - DNA, 25 bp, Rattus norvegicus
ccatatcaagggttcttactgctgt

SEQ ID NO: 246134 - DNA, 25 bp, Rattus norvegicus
ccatatcagctccactcgatggata

SEQ ID NO: 246135 - DNA, 25 bp, Rattus norvegicus
ccatatcagctcgactcgatggata

SEQ ID NO: 246136 - DNA, 25 bp, Rattus norvegicus
ccatatctactaatttcctactcga

SEQ ID NO: 246137 - DNA, 25 bp, Rattus norvegicus
ccatatctactattttcctactcga

SEQ ID NO: 246138 - DNA, 25 bp, Rattus norvegicus
ccatatctcaacaaggtgtccacct

SEQ ID NO: 246139 - DNA, 25 bp, Rattus norvegicus
ccatatctcaactaggtgtccacct

SEQ ID NO: 246140 - DNA, 25 bp, Rattus norvegicus
ccatatgcatggaaggttctagaat

SEQ ID NO: 246141 - DNA, 25 bp, Rattus norvegicus
ccatatgcatggtaggttctagaat

SEQ ID NO: 246142 - DNA, 25 bp, Rattus norvegicus
ccatatggacgaatcatgaaccttt

SEQ ID NO: 246143 - DNA, 25 bp, Rattus norvegicus
ccatatggacgattcatgaaccttt

SEQ ID NO: 246144 - DNA, 25 bp, Rattus norvegicus
ccatatggtttgatgatgccggcta

SEQ ID NO: 246145 - DNA, 25 bp, Rattus norvegicus
ccatatggtttgttgatgccggcta

SEQ ID NO: 246146 - DNA, 25 bp, Rattus norvegicus
ccatatgttgaaactgtccctggaa

SEQ ID NO: 246147 - DNA, 25 bp, Rattus norvegicus
ccatatgttgaatctgtccctggaa

SEQ ID NO: 246148 - DNA, 25 bp, Rattus norvegicus
ccatatgttggcatggtcaccatta

SEQ ID NO: 246149 - DNA, 25 bp, Rattus norvegicus
ccatatgttggcttggtcaccatta

SEQ ID NO: 246150 - DNA, 25 bp, Rattus norvegicus
ccatattgaaaacccaaggcccagg

SEQ ID NO: 246151 - DNA, 25 bp, Rattus norvegicus
ccatattgaaaagccaaggcccagg

SEQ ID NO: 246152 - DNA, 25 bp, Rattus norvegicus
ccatattgggttatcaaagtgcctt

SEQ ID NO: 246153 - DNA, 25 bp, Rattus norvegicus
ccatattgggttttcaaagtgcctt

SEQ ID NO: 246154 - DNA, 25 bp, Rattus norvegicus
ccatattgtgttagggacctccaga

SEQ ID NO: 246155 - DNA, 25 bp, Rattus norvegicus
ccatattgtgtttgggacctccaga

SEQ ID NO: 246156 - DNA, 25 bp, Rattus norvegicus
ccatatttgtttagtgttctgctta

SEQ ID NO: 246157 - DNA, 25 bp, Rattus norvegicus
ccatatttgttttgtgttctgctta

SEQ ID NO: 246158 - DNA, 25 bp, Rattus norvegicus
ccatcaaagtgcatcttggttgtgt

SEQ ID NO: 246159 - DNA, 25 bp, Rattus norvegicus
ccatcaaagtgcttcttggttgtgt

SEQ ID NO: 246160 - DNA, 25 bp, Rattus norvegicus
ccatcaacagatcaagtttccggaa

SEQ ID NO: 246161 - DNA, 25 bp, Rattus norvegicus
ccatcaacagatgaagtttccggaa

SEQ ID NO: 246162 - DNA, 25 bp, Rattus norvegicus
ccatcaacgggtcgccagacgataa

SEQ ID NO: 246163 - DNA, 25 bp, Rattus norvegicus
ccatcaacgggtggccagacgataa

SEQ ID NO: 246164 - DNA, 25 bp, Rattus norvegicus
ccatcaagccatactaccagaagaa

SEQ ID NO: 246165 - DNA, 25 bp, Rattus norvegicus
ccatcaagccattctaccagaagaa

SEQ ID NO: 246166 - DNA, 25 bp, Rattus norvegicus
ccatcaaggtggaggtgtacgactg

SEQ ID NO: 246167 - DNA, 25 bp, Rattus norvegicus
ccatcaaggtggtggtgtacgactg

SEQ ID NO: 246168 - DNA, 25 bp, Rattus norvegicus
ccatcaatttgacccgcagcatcga

SEQ ID NO: 246169 - DNA, 25 bp, Rattus norvegicus
ccatcaatttgagccgcagcatcga

SEQ ID NO: 246170 - DNA, 25 bp, Rattus norvegicus
ccatcacagcctagcgggaaatcaa

SEQ ID NO: 246171 - DNA, 25 bp, Rattus norvegicus
ccatcacagccttgcgggaaatcaa

SEQ ID NO: 246172 - DNA, 25 bp, Rattus norvegicus
ccatcacagtagaagaggcacaagg

SEQ ID NO: 246173 - DNA, 25 bp, Rattus norvegicus
ccatcacagtagtagaggcacaagg

SEQ ID NO: 246174 - DNA, 25 bp, Rattus norvegicus
ccatcaccagtgatttctttagcct

SEQ ID NO: 246175 - DNA, 25 bp, Rattus norvegicus
ccatcaccagtgttttctttagcct

SEQ ID NO: 246176 - DNA, 25 bp, Rattus norvegicus
ccatcacccattagatttttctgaa

SEQ ID NO: 246177 - DNA, 25 bp, Rattus norvegicus
ccatcacccatttgatttttctgaa

SEQ ID NO: 246178 - DNA, 25 bp, Rattus norvegicus
ccatcacccctactgtaaggaactt

SEQ ID NO: 246179 - DNA, 25 bp, Rattus norvegicus
ccatcacccctagtgtaaggaactt

SEQ ID NO: 246180 - DNA, 25 bp, Rattus norvegicus
ccatcaccctctatctggagaagga

SEQ ID NO: 246181 - DNA, 25 bp, Rattus norvegicus
ccatcaccctctttctggagaagga

SEQ ID NO: 246182 - DNA, 25 bp, Rattus norvegicus
ccatcacctgtaattgcctctaaaa

SEQ ID NO: 246183 - DNA, 25 bp, Rattus norvegicus
ccatcacctgtatttgcctctaaaa

SEQ ID NO: 246184 - DNA, 25 bp, Rattus norvegicus
ccatcaccttccagactttttattt

SEQ ID NO: 246185 - DNA, 25 bp, Rattus norvegicus
ccatcaccttcctgactttttattt

SEQ ID NO: 246186 - DNA, 25 bp, Rattus norvegicus
ccatcaccttgaccttcattgataa

SEQ ID NO: 246187 - DNA, 25 bp, Rattus norvegicus
ccatcaccttgagcttcattgataa

SEQ ID NO: 246188 - DNA, 25 bp, Rattus norvegicus
ccatcacgatcgattggattgggat

SEQ ID NO: 246189 - DNA, 25 bp, Rattus norvegicus
ccatcacgatcgtttggattgggat

SEQ ID NO: 246190 - DNA, 25 bp, Rattus norvegicus
ccatcactctggcttgcccaaaaaa

SEQ ID NO: 246191 - DNA, 25 bp, Rattus norvegicus
ccatcactctgggttgcccaaaaaa

SEQ ID NO: 246192 - DNA, 25 bp, Rattus norvegicus
ccatcacttattcatttcccagaga

SEQ ID NO: 246193 - DNA, 25 bp, Rattus norvegicus
ccatcacttattgatttcccagaga

SEQ ID NO: 246194 - DNA, 25 bp, Rattus norvegicus
ccatcacttctcattggtggtagtt

SEQ ID NO: 246195 - DNA, 25 bp, Rattus norvegicus
ccatcacttctctttggtggtagtt

SEQ ID NO: 246196 - DNA, 25 bp, Rattus norvegicus
ccatcagaccagctgggtgcacaaa

SEQ ID NO: 246197 - DNA, 25 bp, Rattus norvegicus
ccatcagaccaggtgggtgcacaaa

SEQ ID NO: 246198 - DNA, 25 bp, Rattus norvegicus
ccatcagcagtgacgggacttggtt

SEQ ID NO: 246199 - DNA, 25 bp, Rattus norvegicus
ccatcagcagtgtcgggacttggtt

SEQ ID NO: 246200 - DNA, 25 bp, Rattus norvegicus
ccatcaggaattagagttctctcta

SEQ ID NO: 246201 - DNA, 25 bp, Rattus norvegicus
ccatcaggaatttgagttctctcta

SEQ ID NO: 246202 - DNA, 25 bp, Rattus norvegicus
ccatcaggtactagccgatgagctt

SEQ ID NO: 246203 - DNA, 25 bp, Rattus norvegicus
ccatcaggtacttgccgatgagctt

SEQ ID NO: 246204 - DNA, 25 bp, Rattus norvegicus
ccatcaggtgctcagggagaaaaaa

SEQ ID NO: 246205 - DNA, 25 bp, Rattus norvegicus
ccatcaggtgctgagggagaaaaaa

SEQ ID NO: 246206 - DNA, 25 bp, Rattus norvegicus
ccatcagtactgagtctctgcaggt

SEQ ID NO: 246207 - DNA, 25 bp, Rattus norvegicus
ccatcagtactgtgtctctgcaggt

SEQ ID NO: 246208 - DNA, 25 bp, Rattus norvegicus
ccatcagtgcggcactttgtgaact

SEQ ID NO: 246209 - DNA, 25 bp, Rattus norvegicus
ccatcagtgcgggactttgtgaact

SEQ ID NO: 246210 - DNA, 25 bp, Rattus norvegicus
ccatcagtgggactgctgtcagtat

SEQ ID NO: 246211 - DNA, 25 bp, Rattus norvegicus
ccatcagtgggagtgctgtcagtat

SEQ ID NO: 246212 - DNA, 25 bp, Rattus norvegicus
ccatcagtgttaactccctgagaca

SEQ ID NO: 246213 - DNA, 25 bp, Rattus norvegicus
ccatcagtgttatctccctgagaca

SEQ ID NO: 246214 - DNA, 25 bp, Rattus norvegicus
ccatcatcatttctgagaagaagca

SEQ ID NO: 246215 - DNA, 25 bp, Rattus norvegicus
ccatcatcatttgtgagaagaagca

SEQ ID NO: 246216 - DNA, 25 bp, Rattus norvegicus
ccatcatccgatctctgggaatctg

SEQ ID NO: 246217 - DNA, 25 bp, Rattus norvegicus
ccatcatccgatgtctgggaatctg

SEQ ID NO: 246218 - DNA, 25 bp, Rattus norvegicus
ccatcatgcaggacacacaggatct

SEQ ID NO: 246219 - DNA, 25 bp, Rattus norvegicus
ccatcatgcaggtcacacaggatct

SEQ ID NO: 246220 - DNA, 25 bp, Rattus norvegicus
ccatcatgggttcctgttctgtatc

SEQ ID NO: 246221 - DNA, 25 bp, Rattus norvegicus
ccatcatgggttgctgttctgtatc

SEQ ID NO: 246222 - DNA, 25 bp, Rattus norvegicus
ccatcattatccacattatcatcac

SEQ ID NO: 246223 - DNA, 25 bp, Rattus norvegicus
ccatcattatcctcattatcatcac

SEQ ID NO: 246224 - DNA, 25 bp, Rattus norvegicus
ccatcattcgccatcttagagtttt

SEQ ID NO: 246225 - DNA, 25 bp, Rattus norvegicus
ccatcattcgccttcttagagtttt

SEQ ID NO: 246226 - DNA, 25 bp, Rattus norvegicus
ccatcattgtagatgtagccgtcat

SEQ ID NO: 246227 - DNA, 25 bp, Rattus norvegicus
ccatcattgtagttgtagccgtcat

SEQ ID NO: 246228 - DNA, 25 bp, Rattus norvegicus
ccatcattgttaagtgactagagta

SEQ ID NO: 246229 - DNA, 25 bp, Rattus norvegicus
ccatcattgttatgtgactagagta

SEQ ID NO: 246230 - DNA, 25 bp, Rattus norvegicus
ccatccaaatacatctccgaacaaa

SEQ ID NO: 246231 - DNA, 25 bp, Rattus norvegicus
ccatccaaatacttctccgaacaaa

SEQ ID NO: 246232 - DNA, 25 bp, Rattus norvegicus
ccatccaactagattcttctacggg

SEQ ID NO: 246233 - DNA, 25 bp, Rattus norvegicus
ccatccaactagtttcttctacggg

SEQ ID NO: 246234 - DNA, 25 bp, Rattus norvegicus
ccatccacggctacagggagacaga

SEQ ID NO: 246235 - DNA, 25 bp, Rattus norvegicus
ccatccacggcttcagggagacaga

SEQ ID NO: 246236 - DNA, 25 bp, Rattus norvegicus
ccatccactgtgaagccaacttgaa

SEQ ID NO: 246237 - DNA, 25 bp, Rattus norvegicus
ccatccactgtgtagccaacttgaa

SEQ ID NO: 246238 - DNA, 25 bp, Rattus norvegicus
ccatccagatataggtagcctggcc

SEQ ID NO: 246239 - DNA, 25 bp, Rattus norvegicus
ccatccagatattggtagcctggcc

SEQ ID NO: 246240 - DNA, 25 bp, Rattus norvegicus
ccatccagcacgacatcaactatga

SEQ ID NO: 246241 - DNA, 25 bp, Rattus norvegicus
ccatccagcacgtcatcaactatga

SEQ ID NO: 246242 - DNA, 25 bp, Rattus norvegicus
ccatccagcattaagtttcctcgaa

SEQ ID NO: 246243 - DNA, 25 bp, Rattus norvegicus
ccatccagcatttagtttcctcgaa

SEQ ID NO: 246244 - DNA, 25 bp, Rattus norvegicus
ccatccagtcctatatccaatagta

SEQ ID NO: 246245 - DNA, 25 bp, Rattus norvegicus
ccatccagtcctttatccaatagta

SEQ ID NO: 246246 - DNA, 25 bp, Rattus norvegicus
ccatccataggtatcttagaagctg

SEQ ID NO: 246247 - DNA, 25 bp, Rattus norvegicus
ccatccataggtttcttagaagctg

SEQ ID NO: 246248 - DNA, 25 bp, Rattus norvegicus
ccatccatcccaatgcataggttta

SEQ ID NO: 246249 - DNA, 25 bp, Rattus norvegicus
ccatccatcccattgcataggttta

SEQ ID NO: 246250 - DNA, 25 bp, Rattus norvegicus
ccatccatgagtcctttcttgggaa

SEQ ID NO: 246251 - DNA, 25 bp, Rattus norvegicus
ccatccatgagtgctttcttgggaa

SEQ ID NO: 246252 - DNA, 25 bp, Rattus norvegicus
ccatccatgcctacgtgtgattaaa

SEQ ID NO: 246253 - DNA, 25 bp, Rattus norvegicus
ccatccatgccttcgtgtgattaaa

SEQ ID NO: 246254 - DNA, 25 bp, Rattus norvegicus
ccatccatgctcagccctttaggga

SEQ ID NO: 246255 - DNA, 25 bp, Rattus norvegicus
ccatccatgctctgccctttaggga

SEQ ID NO: 246256 - DNA, 25 bp, Rattus norvegicus
ccatccatgtatactctctgggagt

SEQ ID NO: 246257 - DNA, 25 bp, Rattus norvegicus
ccatccatgtattctctctgggagt

SEQ ID NO: 246258 - DNA, 25 bp, Rattus norvegicus
ccatcccactggattgtctaatgaa

SEQ ID NO: 246259 - DNA, 25 bp, Rattus norvegicus
ccatcccactggtttgtctaatgaa

SEQ ID NO: 246260 - DNA, 25 bp, Rattus norvegicus
ccatcccagagtccgggcttgtttt

SEQ ID NO: 246261 - DNA, 25 bp, Rattus norvegicus
ccatcccagagtgcgggcttgtttt

SEQ ID NO: 246262 - DNA, 25 bp, Rattus norvegicus
ccatcccagcatccgagaacagatt

SEQ ID NO: 246263 - DNA, 25 bp, Rattus norvegicus
ccatcccagcatgcgagaacagatt

SEQ ID NO: 246264 - DNA, 25 bp, Rattus norvegicus
ccatcccaggctcttgtaacagaaa

SEQ ID NO: 246265 - DNA, 25 bp, Rattus norvegicus
ccatcccaggctgttgtaacagaaa

SEQ ID NO: 246266 - DNA, 25 bp, Rattus norvegicus
ccatcccagggaaaagctataacaa

SEQ ID NO: 246267 - DNA, 25 bp, Rattus norvegicus
ccatcccagggataagctataacaa

SEQ ID NO: 246268 - DNA, 25 bp, Rattus norvegicus
ccatccccgtcactgtaaatgctat

SEQ ID NO: 246269 - DNA, 25 bp, Rattus norvegicus
ccatccccgtcagtgtaaatgctat

SEQ ID NO: 246270 - DNA, 25 bp, Rattus norvegicus
ccatcccgagctcaatatcggggtc

SEQ ID NO: 246271 - DNA, 25 bp, Rattus norvegicus
ccatcccgagctgaatatcggggtc

SEQ ID NO: 246272 - DNA, 25 bp, Rattus norvegicus
ccatccctccataaaagttcttact

SEQ ID NO: 246273 - DNA, 25 bp, Rattus norvegicus
ccatccctccattaaagttcttact

SEQ ID NO: 246274 - DNA, 25 bp, Rattus norvegicus
ccatccctctgtctttaaaggtcta

SEQ ID NO: 246275 - DNA, 25 bp, Rattus norvegicus
ccatccctctgtgtttaaaggtcta

SEQ ID NO: 246276 - DNA, 25 bp, Rattus norvegicus
ccatccctgaggattaactgtgttt

SEQ ID NO: 246277 - DNA, 25 bp, Rattus norvegicus
ccatccctgaggtttaactgtgttt

SEQ ID NO: 246278 - DNA, 25 bp, Rattus norvegicus
ccatccctggttagaatacgtcttg

SEQ ID NO: 246279 - DNA, 25 bp, Rattus norvegicus
ccatccctggtttgaatacgtcttg

SEQ ID NO: 246280 - DNA, 25 bp, Rattus norvegicus
ccatccctgtctacatcgagaataa

SEQ ID NO: 246281 - DNA, 25 bp, Rattus norvegicus
ccatccctgtcttcatcgagaataa

SEQ ID NO: 246282 - DNA, 25 bp, Rattus norvegicus
ccatccgagccgaggaggtgatctt

SEQ ID NO: 246283 - DNA, 25 bp, Rattus norvegicus
ccatccgagccgtggaggtgatctt

SEQ ID NO: 246284 - DNA, 25 bp, Rattus norvegicus
ccatccgattaaataccgtggatta

SEQ ID NO: 246285 - DNA, 25 bp, Rattus norvegicus
ccatccgattaattaccgtggatta

SEQ ID NO: 246286 - DNA, 25 bp, Rattus norvegicus
ccatccgctgctattccaagaaaaa

SEQ ID NO: 246287 - DNA, 25 bp, Rattus norvegicus
ccatccgctgcttttccaagaaaaa

SEQ ID NO: 246288 - DNA, 25 bp, Rattus norvegicus
ccatccgctgtaattagtctgcaat

SEQ ID NO: 246289 - DNA, 25 bp, Rattus norvegicus
ccatccgctgtatttagtctgcaat

SEQ ID NO: 246290 - DNA, 25 bp, Rattus norvegicus
ccatccgggcagcatttctggagaa

SEQ ID NO: 246291 - DNA, 25 bp, Rattus norvegicus
ccatccgggcaggatttctggagaa

SEQ ID NO: 246292 - DNA, 25 bp, Rattus norvegicus
ccatccggtgcgaaagagacagtct

SEQ ID NO: 246293 - DNA, 25 bp, Rattus norvegicus
ccatccggtgcgtaagagacagtct

SEQ ID NO: 246294 - DNA, 25 bp, Rattus norvegicus
ccatcctaaactcggctgggtgctt

SEQ ID NO: 246295 - DNA, 25 bp, Rattus norvegicus
ccatcctaaactgggctgggtgctt

SEQ ID NO: 246296 - DNA, 25 bp, Rattus norvegicus
ccatcctagtgtcagctccatttga

SEQ ID NO: 246297 - DNA, 25 bp, Rattus norvegicus
ccatcctagtgtgagctccatttga

SEQ ID NO: 246298 - DNA, 25 bp, Rattus norvegicus
ccatcctattggatcatccagtgtt

SEQ ID NO: 246299 - DNA, 25 bp, Rattus norvegicus
ccatcctattggttcatccagtgtt

SEQ ID NO: 246300 - DNA, 25 bp, Rattus norvegicus
ccatcctcacttacgttacatatct

SEQ ID NO: 246301 - DNA, 25 bp, Rattus norvegicus
ccatcctcactttcgttacatatct

SEQ ID NO: 246302 - DNA, 25 bp, Rattus norvegicus
ccatcctccactagtagccaaaaga

SEQ ID NO: 246303 - DNA, 25 bp, Rattus norvegicus
ccatcctccacttgtagccaaaaga

SEQ ID NO: 246304 - DNA, 25 bp, Rattus norvegicus
ccatcctcctgaagtgtcagacaga

SEQ ID NO: 246305 - DNA, 25 bp, Rattus norvegicus
ccatcctcctgatgtgtcagacaga

SEQ ID NO: 246306 - DNA, 25 bp, Rattus norvegicus
ccatcctctcagacttgaactttaa

SEQ ID NO: 246307 - DNA, 25 bp, Rattus norvegicus
ccatcctctcagtcttgaactttaa

SEQ ID NO: 246308 - DNA, 25 bp, Rattus norvegicus
ccatcctctgctctggtgggtatga

SEQ ID NO: 246309 - DNA, 25 bp, Rattus norvegicus
ccatcctctgctcttcttcaggaaa

SEQ ID NO: 246310 - DNA, 25 bp, Rattus norvegicus
ccatcctctgctgtggtgggtatga

SEQ ID NO: 246311 - DNA, 25 bp, Rattus norvegicus
ccatcctctgctgttcttcaggaaa

SEQ ID NO: 246312 - DNA, 25 bp, Rattus norvegicus
ccatcctgctgtaagtgtcaactat

SEQ ID NO: 246313 - DNA, 25 bp, Rattus norvegicus
ccatcctgctgttagtgtcaactat

SEQ ID NO: 246314 - DNA, 25 bp, Rattus norvegicus
ccatcctgtatccactaacttgagt

SEQ ID NO: 246315 - DNA, 25 bp, Rattus norvegicus
ccatcctgtatcgactaacttgagt

SEQ ID NO: 246316 - DNA, 25 bp, Rattus norvegicus
ccatcctgtcagcttggtgcggaag

SEQ ID NO: 246317 - DNA, 25 bp, Rattus norvegicus
ccatcctgtcaggttggtgcggaag

SEQ ID NO: 246318 - DNA, 25 bp, Rattus norvegicus
ccatccttctgtattgtcgtcaaat

SEQ ID NO: 246319 - DNA, 25 bp, Rattus norvegicus
ccatccttctgttttgtcgtcaaat

SEQ ID NO: 246320 - DNA, 25 bp, Rattus norvegicus
ccatccttgactacgtgactgaatc

SEQ ID NO: 246321 - DNA, 25 bp, Rattus norvegicus
ccatccttgacttcgtgactgaatc

SEQ ID NO: 246322 - DNA, 25 bp, Rattus norvegicus
ccatccttgggcattggctatgaat

SEQ ID NO: 246323 - DNA, 25 bp, Rattus norvegicus
ccatccttgggctttggctatgaat

SEQ ID NO: 246324 - DNA, 25 bp, Rattus norvegicus
ccatccttgggtcttggctatgaac

SEQ ID NO: 246325 - DNA, 25 bp, Rattus norvegicus
ccatccttgggtgttggctatgaac

SEQ ID NO: 246326 - DNA, 25 bp, Rattus norvegicus
ccatcctttgctatgtgttgtgaac

SEQ ID NO: 246327 - DNA, 25 bp, Rattus norvegicus
ccatcctttgctttgtgttgtgaac

SEQ ID NO: 246328 - DNA, 25 bp, Rattus norvegicus
ccatcctttggtaataaacttacat

SEQ ID NO: 246329 - DNA, 25 bp, Rattus norvegicus
ccatcctttggttataaacttacat

SEQ ID NO: 246330 - DNA, 25 bp, Rattus norvegicus
ccatcgacccataagtccttgagaa

SEQ ID NO: 246331 - DNA, 25 bp, Rattus norvegicus
ccatcgacccattagtccttgagaa

SEQ ID NO: 246332 - DNA, 25 bp, Rattus norvegicus
ccatcgactcaccggatattgacca

SEQ ID NO: 246333 - DNA, 25 bp, Rattus norvegicus
ccatcgactcacgggatattgacca

SEQ ID NO: 246334 - DNA, 25 bp, Rattus norvegicus
ccatcgagctgcatagctatacttc

SEQ ID NO: 246335 - DNA, 25 bp, Rattus norvegicus
ccatcgagctgcttagctatacttc

SEQ ID NO: 246336 - DNA, 25 bp, Rattus norvegicus
ccatcgaggcatatagggcaaaaag

SEQ ID NO: 246337 - DNA, 25 bp, Rattus norvegicus
ccatcgaggcatttagggcaaaaag

SEQ ID NO: 246338 - DNA, 25 bp, Rattus norvegicus
ccatcgatatctaggttattctcaa

SEQ ID NO: 246339 - DNA, 25 bp, Rattus norvegicus
ccatcgatatcttggttattctcaa

SEQ ID NO: 246340 - DNA, 25 bp, Rattus norvegicus
ccatcgatcgggagtcctcgtgaca

SEQ ID NO: 246341 - DNA, 25 bp, Rattus norvegicus
ccatcgatcgggtgtcctcgtgaca

SEQ ID NO: 246342 - DNA, 25 bp, Rattus norvegicus
ccatcgatgaagacctcccagagga

SEQ ID NO: 246343 - DNA, 25 bp, Rattus norvegicus
ccatcgatgaagtcctcccagagga

SEQ ID NO: 246344 - DNA, 25 bp, Rattus norvegicus
ccatcgctactcaatcactttttaa

SEQ ID NO: 246345 - DNA, 25 bp, Rattus norvegicus
ccatcgctactctatcactttttaa

SEQ ID NO: 246346 - DNA, 25 bp, Rattus norvegicus
ccatcgcttagcaatcgctgaagaa

SEQ ID NO: 246347 - DNA, 25 bp, Rattus norvegicus
ccatcgcttagctatcgctgaagaa

SEQ ID NO: 246348 - DNA, 25 bp, Rattus norvegicus
ccatcggctggcatttgtaatcggt

SEQ ID NO: 246349 - DNA, 25 bp, Rattus norvegicus
ccatcggctggcttttgtaatcggt

SEQ ID NO: 246350 - DNA, 25 bp, Rattus norvegicus
ccatcgggccttaaaattctagtat

SEQ ID NO: 246351 - DNA, 25 bp, Rattus norvegicus
ccatcgggcctttaaattctagtat

SEQ ID NO: 246352 - DNA, 25 bp, Rattus norvegicus
ccatcgggtattcgagtcagtcgga

SEQ ID NO: 246353 - DNA, 25 bp, Rattus norvegicus
ccatcgggtattggagtcagtcgga

SEQ ID NO: 246354 - DNA, 25 bp, Rattus norvegicus
ccatcggtagatattgtttgtacaa

SEQ ID NO: 246355 - DNA, 25 bp, Rattus norvegicus
ccatcggtagattttgtttgtacaa

SEQ ID NO: 246356 - DNA, 25 bp, Rattus norvegicus
ccatcggtgatgctttttcctgcaa

SEQ ID NO: 246357 - DNA, 25 bp, Rattus norvegicus
ccatcggtgatggtttttcctgcaa

SEQ ID NO: 246358 - DNA, 25 bp, Rattus norvegicus
ccatcgtcattcagcttctaggtga

SEQ ID NO: 246359 - DNA, 25 bp, Rattus norvegicus
ccatcgtcattctgcttctaggtga

SEQ ID NO: 246360 - DNA, 25 bp, Rattus norvegicus
ccatcgtgacctagactggctatga

SEQ ID NO: 246361 - DNA, 25 bp, Rattus norvegicus
ccatcgtgaccttgactggctatga

SEQ ID NO: 246362 - DNA, 25 bp, Rattus norvegicus
ccatcgtgcatgacaaggtgttgaa

SEQ ID NO: 246363 - DNA, 25 bp, Rattus norvegicus
ccatcgtgcatgtcaaggtgttgaa

SEQ ID NO: 246364 - DNA, 25 bp, Rattus norvegicus
ccatcgtgtgctactcagatttgta

SEQ ID NO: 246365 - DNA, 25 bp, Rattus norvegicus
ccatcgtgtgcttctcagatttgta

SEQ ID NO: 246366 - DNA, 25 bp, Rattus norvegicus
ccatcgtgtttgagactgtccaggg

SEQ ID NO: 246367 - DNA, 25 bp, Rattus norvegicus
ccatcgtgtttgtgactgtccaggg

SEQ ID NO: 246368 - DNA, 25 bp, Rattus norvegicus
ccatcgttcagaaagggcagacata

SEQ ID NO: 246369 - DNA, 25 bp, Rattus norvegicus
ccatcgttcagatagggcagacata

SEQ ID NO: 246370 - DNA, 25 bp, Rattus norvegicus
ccatctaaacagaccgagagtttga

SEQ ID NO: 246371 - DNA, 25 bp, Rattus norvegicus
ccatctaaacagtccgagagtttga

SEQ ID NO: 246372 - DNA, 25 bp, Rattus norvegicus
ccatctacacgtattgtttcctgac

SEQ ID NO: 246373 - DNA, 25 bp, Rattus norvegicus
ccatctacacgttttgtttcctgac

SEQ ID NO: 246374 - DNA, 25 bp, Rattus norvegicus
ccatctagtgttcctcagtgacgaa

SEQ ID NO: 246375 - DNA, 25 bp, Rattus norvegicus
ccatctagtgttgctcagtgacgaa

SEQ ID NO: 246376 - DNA, 25 bp, Rattus norvegicus
ccatctatccatattagcctcaagt

SEQ ID NO: 246377 - DNA, 25 bp, Rattus norvegicus
ccatctatccattttagcctcaagt

SEQ ID NO: 246378 - DNA, 25 bp, Rattus norvegicus
ccatctcatgcccaggaggaatcat

SEQ ID NO: 246379 - DNA, 25 bp, Rattus norvegicus
ccatctcatgccgaggaggaatcat

SEQ ID NO: 246380 - DNA, 25 bp, Rattus norvegicus
ccatctccactaactcagctaaaaa

SEQ ID NO: 246381 - DNA, 25 bp, Rattus norvegicus
ccatctccactatctcagctaaaaa

SEQ ID NO: 246382 - DNA, 25 bp, Rattus norvegicus
ccatctccagcccagatttttaaga

SEQ ID NO: 246383 - DNA, 25 bp, Rattus norvegicus
ccatctccagccgagatttttaaga

SEQ ID NO: 246384 - DNA, 25 bp, Rattus norvegicus
ccatctcccgatctaatcatactaa

SEQ ID NO: 246385 - DNA, 25 bp, Rattus norvegicus
ccatctcccgatgtaatcatactaa

SEQ ID NO: 246386 - DNA, 25 bp, Rattus norvegicus
ccatctccggttaggcagcagagga

SEQ ID NO: 246387 - DNA, 25 bp, Rattus norvegicus
ccatctccggtttggcagcagagga

SEQ ID NO: 246388 - DNA, 25 bp, Rattus norvegicus
ccatctcctatcagaagacctttaa

SEQ ID NO: 246389 - DNA, 25 bp, Rattus norvegicus
ccatctcctatctgaagacctttaa

SEQ ID NO: 246390 - DNA, 25 bp, Rattus norvegicus
ccatctcctccaatgtcattcaatg

SEQ ID NO: 246391 - DNA, 25 bp, Rattus norvegicus
ccatctcctccattgtcattcaatg

SEQ ID NO: 246392 - DNA, 25 bp, Rattus norvegicus
ccatctcctcctacagacatgtttt

SEQ ID NO: 246393 - DNA, 25 bp, Rattus norvegicus
ccatctcctccttcagacatgtttt

SEQ ID NO: 246394 - DNA, 25 bp, Rattus norvegicus
ccatctcgagatctctgtacaatag

SEQ ID NO: 246395 - DNA, 25 bp, Rattus norvegicus
ccatctcgagatgtctgtacaatag

SEQ ID NO: 246396 - DNA, 25 bp, Rattus norvegicus
ccatctctactcaatcctgaggtat

SEQ ID NO: 246397 - DNA, 25 bp, Rattus norvegicus
ccatctctactctatcctgaggtat

SEQ ID NO: 246398 - DNA, 25 bp, Rattus norvegicus
ccatctctcaacactagtttcaggg

SEQ ID NO: 246399 - DNA, 25 bp, Rattus norvegicus
ccatctctcaactctagtttcaggg

SEQ ID NO: 246400 - DNA, 25 bp, Rattus norvegicus
ccatctctcctacctaaattcatat

SEQ ID NO: 246401 - DNA, 25 bp, Rattus norvegicus
ccatctctcctagctaaattcatat

SEQ ID NO: 246402 - DNA, 25 bp, Rattus norvegicus
ccatctctgaatctcctgaaccata

SEQ ID NO: 246403 - DNA, 25 bp, Rattus norvegicus
ccatctctgaatgtcctgaaccata

SEQ ID NO: 246404 - DNA, 25 bp, Rattus norvegicus
ccatctctgggtaatatgtccttat

SEQ ID NO: 246405 - DNA, 25 bp, Rattus norvegicus
ccatctctgggttatatgtccttat

SEQ ID NO: 246406 - DNA, 25 bp, Rattus norvegicus
ccatctcttacaacagtgatagtgt

SEQ ID NO: 246407 - DNA, 25 bp, Rattus norvegicus
ccatctcttacatcagtgatagtgt

SEQ ID NO: 246408 - DNA, 25 bp, Rattus norvegicus
ccatctcttcaaatgcttgctctaa

SEQ ID NO: 246409 - DNA, 25 bp, Rattus norvegicus
ccatctcttcaattgcttgctctaa

SEQ ID NO: 246410 - DNA, 25 bp, Rattus norvegicus
ccatctgactgcacagcatctgggt

SEQ ID NO: 246411 - DNA, 25 bp, Rattus norvegicus
ccatctgactgctcagcatctgggt

SEQ ID NO: 246412 - DNA, 25 bp, Rattus norvegicus
ccatctgatccgctcttatcaatga

SEQ ID NO: 246413 - DNA, 25 bp, Rattus norvegicus
ccatctgatccggtcttatcaatga

SEQ ID NO: 246414 - DNA, 25 bp, Rattus norvegicus
ccatctgcaggcactgtggtgagga

SEQ ID NO: 246415 - DNA, 25 bp, Rattus norvegicus
ccatctgcaggctctgtggtgagga

SEQ ID NO: 246416 - DNA, 25 bp, Rattus norvegicus
ccatctgcattacatctcgtggcaa

SEQ ID NO: 246417 - DNA, 25 bp, Rattus norvegicus
ccatctgcattagatctcgtggcaa

SEQ ID NO: 246418 - DNA, 25 bp, Rattus norvegicus
ccatctgcctggctttgtggagcaa

SEQ ID NO: 246419 - DNA, 25 bp, Rattus norvegicus
ccatctgcctgggtttgtggagcaa

SEQ ID NO: 246420 - DNA, 25 bp, Rattus norvegicus
ccatctgccttccttgcacagtggg

SEQ ID NO: 246421 - DNA, 25 bp, Rattus norvegicus
ccatctgccttcgttgcacagtggg

SEQ ID NO: 246422 - DNA, 25 bp, Rattus norvegicus
ccatctgctatgctctctggaggat

SEQ ID NO: 246423 - DNA, 25 bp, Rattus norvegicus
ccatctgctatggtctctggaggat

SEQ ID NO: 246424 - DNA, 25 bp, Rattus norvegicus
ccatctgctgtgatcatttctctaa

SEQ ID NO: 246425 - DNA, 25 bp, Rattus norvegicus
ccatctgctgtgttcatttctctaa

SEQ ID NO: 246426 - DNA, 25 bp, Rattus norvegicus
ccatctggaatgaaaattgtttcat

SEQ ID NO: 246427 - DNA, 25 bp, Rattus norvegicus
ccatctggaatgtaaattgtttcat

SEQ ID NO: 246428 - DNA, 25 bp, Rattus norvegicus
ccatctggcagtctgacagcaagtt

SEQ ID NO: 246429 - DNA, 25 bp, Rattus norvegicus
ccatctggcagtgtgacagcaagtt

SEQ ID NO: 246430 - DNA, 25 bp, Rattus norvegicus
ccatctgggtaccaggacaggttga

SEQ ID NO: 246431 - DNA, 25 bp, Rattus norvegicus
ccatctgggtacgaggacaggttga

SEQ ID NO: 246432 - DNA, 25 bp, Rattus norvegicus
ccatctgtagatactgggcttctag

SEQ ID NO: 246433 - DNA, 25 bp, Rattus norvegicus
ccatctgtagattctgggcttctag

SEQ ID NO: 246434 - DNA, 25 bp, Rattus norvegicus
ccatctgtcctaccctgactgtggg

SEQ ID NO: 246435 - DNA, 25 bp, Rattus norvegicus
ccatctgtcctagcctgactgtggg

SEQ ID NO: 246436 - DNA, 25 bp, Rattus norvegicus
ccatctgtcctcagtgtacgggaaa

SEQ ID NO: 246437 - DNA, 25 bp, Rattus norvegicus
ccatctgtcctctgtgtacgggaaa

SEQ ID NO: 246438 - DNA, 25 bp, Rattus norvegicus
ccatctgtgatgctaagtctctgag

SEQ ID NO: 246439 - DNA, 25 bp, Rattus norvegicus
ccatctgtgatggtaagtctctgag

SEQ ID NO: 246440 - DNA, 25 bp, Rattus norvegicus
ccatctgtgggtcaggctgtacgta

SEQ ID NO: 246441 - DNA, 25 bp, Rattus norvegicus
ccatctgtgggtgaggctgtacgta

SEQ ID NO: 246442 - DNA, 25 bp, Rattus norvegicus
ccatctgtgtggatctcagtcaaca

SEQ ID NO: 246443 - DNA, 25 bp, Rattus norvegicus
ccatctgtgtggttctcagtcaaca

SEQ ID NO: 246444 - DNA, 25 bp, Rattus norvegicus
ccatctgttccactcggagcaggta

SEQ ID NO: 246445 - DNA, 25 bp, Rattus norvegicus
ccatctgttccagtcggagcaggta

SEQ ID NO: 246446 - DNA, 25 bp, Rattus norvegicus
ccatctgttgggaagtgcggttact

SEQ ID NO: 246447 - DNA, 25 bp, Rattus norvegicus
ccatctgttgggtagtgcggttact

SEQ ID NO: 246448 - DNA, 25 bp, Rattus norvegicus
ccatctgttttcctgcttgttgtag

SEQ ID NO: 246449 - DNA, 25 bp, Rattus norvegicus
ccatctgttttcgtgcttgttgtag

SEQ ID NO: 246450 - DNA, 25 bp, Rattus norvegicus
ccatcttcaccacattagcaagcta

SEQ ID NO: 246451 - DNA, 25 bp, Rattus norvegicus
ccatcttcaccagattagcaagcta

SEQ ID NO: 246452 - DNA, 25 bp, Rattus norvegicus
ccatcttcaggtagggcaggttcat

SEQ ID NO: 246453 - DNA, 25 bp, Rattus norvegicus
ccatcttcaggttgggcaggttcat

SEQ ID NO: 246454 - DNA, 25 bp, Rattus norvegicus
ccatcttcatccctatcattgtgat

SEQ ID NO: 246455 - DNA, 25 bp, Rattus norvegicus
ccatcttcatccgtatcattgtgat

SEQ ID NO: 246456 - DNA, 25 bp, Rattus norvegicus
ccatcttcattgagcagctggtgca

SEQ ID NO: 246457 - DNA, 25 bp, Rattus norvegicus
ccatcttcattgtgcagctggtgca

SEQ ID NO: 246458 - DNA, 25 bp, Rattus norvegicus
ccatcttccaccagtttggtggtct

SEQ ID NO: 246459 - DNA, 25 bp, Rattus norvegicus
ccatcttccacctgtttggtggtct

SEQ ID NO: 246460 - DNA, 25 bp, Rattus norvegicus
ccatcttccagccagtgtatggttt

SEQ ID NO: 246461 - DNA, 25 bp, Rattus norvegicus
ccatcttccagcgagtgtatggttt

SEQ ID NO: 246462 - DNA, 25 bp, Rattus norvegicus
ccatcttcctggctgttgtgagaca

SEQ ID NO: 246463 - DNA, 25 bp, Rattus norvegicus
ccatcttcctgggtgttgtgagaca

SEQ ID NO: 246464 - DNA, 25 bp, Rattus norvegicus
ccatcttctctaagggacggtgtga

SEQ ID NO: 246465 - DNA, 25 bp, Rattus norvegicus
ccatcttctctatgggacggtgtga

SEQ ID NO: 246466 - DNA, 25 bp, Rattus norvegicus
ccatcttctgctacaagggctatac

SEQ ID NO: 246467 - DNA, 25 bp, Rattus norvegicus
ccatcttctgcttcaagggctatac

SEQ ID NO: 246468 - DNA, 25 bp, Rattus norvegicus
ccatcttcttcaaatcttaccttaa

SEQ ID NO: 246469 - DNA, 25 bp, Rattus norvegicus
ccatcttcttcatatcttaccttaa

SEQ ID NO: 246470 - DNA, 25 bp, Rattus norvegicus
ccatcttctttgagtaactgctata

SEQ ID NO: 246471 - DNA, 25 bp, Rattus norvegicus
ccatcttctttgtgtaactgctata

SEQ ID NO: 246472 - DNA, 25 bp, Rattus norvegicus
ccatcttgcaggctcagtatctcaa

SEQ ID NO: 246473 - DNA, 25 bp, Rattus norvegicus
ccatcttgcagggtcagtatctcaa

SEQ ID NO: 246474 - DNA, 25 bp, Rattus norvegicus
ccatcttggtctccgatgcgtaaca

SEQ ID NO: 246475 - DNA, 25 bp, Rattus norvegicus
ccatcttggtctgcgatgcgtaaca

SEQ ID NO: 246476 - DNA, 25 bp, Rattus norvegicus
ccatcttgtcttaccctgaagggta

SEQ ID NO: 246477 - DNA, 25 bp, Rattus norvegicus
ccatcttgtctttccctgaagggta

SEQ ID NO: 246478 - DNA, 25 bp, Rattus norvegicus
ccatcttgttttcccctttacgttg

SEQ ID NO: 246479 - DNA, 25 bp, Rattus norvegicus
ccatcttgttttgccctttacgttg

SEQ ID NO: 246480 - DNA, 25 bp, Rattus norvegicus
ccatctttcactcagactgtataag

SEQ ID NO: 246481 - DNA, 25 bp, Rattus norvegicus
ccatctttcactgagactgtataag

SEQ ID NO: 246482 - DNA, 25 bp, Rattus norvegicus
ccatctttcctaactgaggcctgaa

SEQ ID NO: 246483 - DNA, 25 bp, Rattus norvegicus
ccatctttcctatctgaggcctgaa

SEQ ID NO: 246484 - DNA, 25 bp, Rattus norvegicus
ccatctttgacgacttttctcatta

SEQ ID NO: 246485 - DNA, 25 bp, Rattus norvegicus
ccatctttgacgtcttttctcatta

SEQ ID NO: 246486 - DNA, 25 bp, Rattus norvegicus
ccatctttggctccatggcagataa

SEQ ID NO: 246487 - DNA, 25 bp, Rattus norvegicus
ccatctttggctgcatggcagataa

SEQ ID NO: 246488 - DNA, 25 bp, Rattus norvegicus
ccatctttgtggaggcctcagcatc

SEQ ID NO: 246489 - DNA, 25 bp, Rattus norvegicus
ccatctttgtggtggcctcagcatc

SEQ ID NO: 246490 - DNA, 25 bp, Rattus norvegicus
ccatcttttctaatgcacgtgtaaa

SEQ ID NO: 246491 - DNA, 25 bp, Rattus norvegicus
ccatcttttctattgcacgtgtaaa

SEQ ID NO: 246492 - DNA, 25 bp, Rattus norvegicus
ccatctttttgcactttctgggtga

SEQ ID NO: 246493 - DNA, 25 bp, Rattus norvegicus
ccatctttttgctctttctgggtga

SEQ ID NO: 246494 - DNA, 25 bp, Rattus norvegicus
ccatgaaggcgtccacacgcagtaa

SEQ ID NO: 246495 - DNA, 25 bp, Rattus norvegicus
ccatgaaggcgtgcacacgcagtaa

SEQ ID NO: 246496 - DNA, 25 bp, Rattus norvegicus
ccatgaaggtacctgtggttctcaa

SEQ ID NO: 246497 - DNA, 25 bp, Rattus norvegicus
ccatgaaggtacgtgtggttctcaa

SEQ ID NO: 246498 - DNA, 25 bp, Rattus norvegicus
ccatgacaagccctaacagttttaa

SEQ ID NO: 246499 - DNA, 25 bp, Rattus norvegicus
ccatgacaagccgtaacagttttaa

SEQ ID NO: 246500 - DNA, 25 bp, Rattus norvegicus
ccatgacacaggctacttgtctgaa

SEQ ID NO: 246501 - DNA, 25 bp, Rattus norvegicus
ccatgacacagggtacttgtctgaa

SEQ ID NO: 246502 - DNA, 25 bp, Rattus norvegicus
ccatgacactctacattcctatgta

SEQ ID NO: 246503 - DNA, 25 bp, Rattus norvegicus
ccatgacactcttcattcctatgta

SEQ ID NO: 246504 - DNA, 25 bp, Rattus norvegicus
ccatgacactggctttctaaaaaga

SEQ ID NO: 246505 - DNA, 25 bp, Rattus norvegicus
ccatgacactgggtttctaaaaaga

SEQ ID NO: 246506 - DNA, 25 bp, Rattus norvegicus
ccatgacaggttcggttcctcgaaa

SEQ ID NO: 246507 - DNA, 25 bp, Rattus norvegicus
ccatgacaggttgggttcctcgaaa

SEQ ID NO: 246508 - DNA, 25 bp, Rattus norvegicus
ccatgacatagtccttctttcccag

SEQ ID NO: 246509 - DNA, 25 bp, Rattus norvegicus
ccatgacatagtgcttctttcccag

SEQ ID NO: 246510 - DNA, 25 bp, Rattus norvegicus
ccatgaccccttcattttacagatg

SEQ ID NO: 246511 - DNA, 25 bp, Rattus norvegicus
ccatgaccccttgattttacagatg

SEQ ID NO: 246512 - DNA, 25 bp, Rattus norvegicus
ccatgaccctttctgtgtcatcaca

SEQ ID NO: 246513 - DNA, 25 bp, Rattus norvegicus
ccatgaccctttgtgtgtcatcaca

SEQ ID NO: 246514 - DNA, 25 bp, Rattus norvegicus
ccatgaccgcctctgctttgtgatg

SEQ ID NO: 246515 - DNA, 25 bp, Rattus norvegicus
ccatgaccgcctgtgctttgtgatg

SEQ ID NO: 246516 - DNA, 25 bp, Rattus norvegicus
ccatgaccttgcacctggcaggaga

SEQ ID NO: 246517 - DNA, 25 bp, Rattus norvegicus
ccatgaccttgctcctggcaggaga

SEQ ID NO: 246518 - DNA, 25 bp, Rattus norvegicus
ccatgactctgtagctttcacataa

SEQ ID NO: 246519 - DNA, 25 bp, Rattus norvegicus
ccatgactctgttgctttcacataa

SEQ ID NO: 246520 - DNA, 25 bp, Rattus norvegicus
ccatgactgtagatctccaggtact

SEQ ID NO: 246521 - DNA, 25 bp, Rattus norvegicus
ccatgactgtagttctccaggtact

SEQ ID NO: 246522 - DNA, 25 bp, Rattus norvegicus
ccatgacttccgagctgcaaagaga

SEQ ID NO: 246523 - DNA, 25 bp, Rattus norvegicus
ccatgacttccgtgctgcaaagaga

SEQ ID NO: 246524 - DNA, 25 bp, Rattus norvegicus
ccatgagcctatcctgcttggtaaa

SEQ ID NO: 246525 - DNA, 25 bp, Rattus norvegicus
ccatgagcctatgctgcttggtaaa

SEQ ID NO: 246526 - DNA, 25 bp, Rattus norvegicus
ccatgagctgatctatgtggaaagc

SEQ ID NO: 246527 - DNA, 25 bp, Rattus norvegicus
ccatgagctgatgtatgtggaaagc

SEQ ID NO: 246528 - DNA, 25 bp, Rattus norvegicus
ccatgaggatgtctatgaggaaaag

SEQ ID NO: 246529 - DNA, 25 bp, Rattus norvegicus
ccatgaggatgtgtatgaggaaaag

SEQ ID NO: 246530 - DNA, 25 bp, Rattus norvegicus
ccatgagtaccccagtgatcttgaa

SEQ ID NO: 246531 - DNA, 25 bp, Rattus norvegicus
ccatgagtacccgagtgatcttgaa

SEQ ID NO: 246532 - DNA, 25 bp, Rattus norvegicus
ccatgataacatccatctcctctta

SEQ ID NO: 246533 - DNA, 25 bp, Rattus norvegicus
ccatgataacatgcatctcctctta

SEQ ID NO: 246534 - DNA, 25 bp, Rattus norvegicus
ccatgatcctatagaactgtactta

SEQ ID NO: 246535 - DNA, 25 bp, Rattus norvegicus
ccatgatcctattgaactgtactta

SEQ ID NO: 246536 - DNA, 25 bp, Rattus norvegicus
ccatgatcgcctacaagctggatga

SEQ ID NO: 246537 - DNA, 25 bp, Rattus norvegicus
ccatgatcgccttcaagctggatga

SEQ ID NO: 246538 - DNA, 25 bp, Rattus norvegicus
ccatgatcgtaacagtgtgtcaatg

SEQ ID NO: 246539 - DNA, 25 bp, Rattus norvegicus
ccatgatcgtaagagtgtgtcaatg

SEQ ID NO: 246540 - DNA, 25 bp, Rattus norvegicus
ccatgatgacaaagtgtggagaggc

SEQ ID NO: 246541 - DNA, 25 bp, Rattus norvegicus
ccatgatgacaatgtgtggagaggc

SEQ ID NO: 246542 - DNA, 25 bp, Rattus norvegicus
ccatgatggtccaggcagcctctga

SEQ ID NO: 246543 - DNA, 25 bp, Rattus norvegicus
ccatgatggtcctggcagcctctga

SEQ ID NO: 246544 - DNA, 25 bp, Rattus norvegicus
ccatgatggtggcagctggcacaac

SEQ ID NO: 246545 - DNA, 25 bp, Rattus norvegicus
ccatgatggtgggagctggcacaac

SEQ ID NO: 246546 - DNA, 25 bp, Rattus norvegicus
ccatgatgtaagcaaggccagcaag

SEQ ID NO: 246547 - DNA, 25 bp, Rattus norvegicus
ccatgatgtaaggaaggccagcaag

SEQ ID NO: 246548 - DNA, 25 bp, Rattus norvegicus
ccatgatgtccccagctaaacaaag

SEQ ID NO: 246549 - DNA, 25 bp, Rattus norvegicus
ccatgatgtcccgagctaaacaaag

SEQ ID NO: 246550 - DNA, 25 bp, Rattus norvegicus
ccatgatgttttccacactgttgtg

SEQ ID NO: 246551 - DNA, 25 bp, Rattus norvegicus
ccatgatgttttgcacactgttgtg

SEQ ID NO: 246552 - DNA, 25 bp, Rattus norvegicus
ccatgattatgaagggtcaccccga

SEQ ID NO: 246553 - DNA, 25 bp, Rattus norvegicus
ccatgattatgatgggtcaccccga

SEQ ID NO: 246554 - DNA, 25 bp, Rattus norvegicus
ccatgattgcggagcagttgtccat

SEQ ID NO: 246555 - DNA, 25 bp, Rattus norvegicus
ccatgattgcggtgcagttgtccat

SEQ ID NO: 246556 - DNA, 25 bp, Rattus norvegicus
ccatgattggtgacttggtgtcttt

SEQ ID NO: 246557 - DNA, 25 bp, Rattus norvegicus
ccatgattggtgtcttggtgtcttt

SEQ ID NO: 246558 - DNA, 25 bp, Rattus norvegicus
ccatgatttactattcttgccacaa

SEQ ID NO: 246559 - DNA, 25 bp, Rattus norvegicus
ccatgatttacttttcttgccacaa

SEQ ID NO: 246560 - DNA, 25 bp, Rattus norvegicus
ccatgcaatcttacacatctcttga

SEQ ID NO: 246561 - DNA, 25 bp, Rattus norvegicus
ccatgcaatctttcacatctcttga

SEQ ID NO: 246562 - DNA, 25 bp, Rattus norvegicus
ccatgcacttggaatctctttcata

SEQ ID NO: 246563 - DNA, 25 bp, Rattus norvegicus
ccatgcacttggtatctctttcata

SEQ ID NO: 246564 - DNA, 25 bp, Rattus norvegicus
ccatgcactttcctattgccaagaa

SEQ ID NO: 246565 - DNA, 25 bp, Rattus norvegicus
ccatgcactttcgtattgccaagaa

SEQ ID NO: 246566 - DNA, 25 bp, Rattus norvegicus
ccatgcagaaaacctctcggcggag

SEQ ID NO: 246567 - DNA, 25 bp, Rattus norvegicus
ccatgcagaaaagctctcggcggag

SEQ ID NO: 246568 - DNA, 25 bp, Rattus norvegicus
ccatgcagactgctggtgtttccag

SEQ ID NO: 246569 - DNA, 25 bp, Rattus norvegicus
ccatgcagactggtggtgtttccag

SEQ ID NO: 246570 - DNA, 25 bp, Rattus norvegicus
ccatgcagccagattaagccagttt

SEQ ID NO: 246571 - DNA, 25 bp, Rattus norvegicus
ccatgcagccagtttaagccagttt

SEQ ID NO: 246572 - DNA, 25 bp, Rattus norvegicus
ccatgcatctgtataagggctagtt

SEQ ID NO: 246573 - DNA, 25 bp, Rattus norvegicus
ccatgcatctgtttaagggctagtt

SEQ ID NO: 246574 - DNA, 25 bp, Rattus norvegicus
ccatgcatgcctctttgggactgga

SEQ ID NO: 246575 - DNA, 25 bp, Rattus norvegicus
ccatgcatgcctgtttgggactgga

SEQ ID NO: 246576 - DNA, 25 bp, Rattus norvegicus
ccatgcattttcctctgatgttggg

SEQ ID NO: 246577 - DNA, 25 bp, Rattus norvegicus
ccatgcattttcgtctgatgttggg

SEQ ID NO: 246578 - DNA, 25 bp, Rattus norvegicus
ccatgccagtgcaacaaatgttttt

SEQ ID NO: 246579 - DNA, 25 bp, Rattus norvegicus
ccatgccagtgctacaaatgttttt

SEQ ID NO: 246580 - DNA, 25 bp, Rattus norvegicus
ccatgccctggtcgctggaattgac

SEQ ID NO: 246581 - DNA, 25 bp, Rattus norvegicus
ccatgccctggtggctggaattgac

SEQ ID NO: 246582 - DNA, 25 bp, Rattus norvegicus
ccatgcccttgcagttacgttaaaa

SEQ ID NO: 246583 - DNA, 25 bp, Rattus norvegicus
ccatgcccttgctgttacgttaaaa

SEQ ID NO: 246584 - DNA, 25 bp, Rattus norvegicus
ccatgccgactgattttctaatcaa

SEQ ID NO: 246585 - DNA, 25 bp, Rattus norvegicus
ccatgccgactgtttttctaatcaa

SEQ ID NO: 246586 - DNA, 25 bp, Rattus norvegicus
ccatgccgcactacatgttttcaaa

SEQ ID NO: 246587 - DNA, 25 bp, Rattus norvegicus
ccatgccgcacttcatgttttcaaa

SEQ ID NO: 246588 - DNA, 25 bp, Rattus norvegicus
ccatgcctaccgactcagttagaga

SEQ ID NO: 246589 - DNA, 25 bp, Rattus norvegicus
ccatgcctaccgtctcagttagaga

SEQ ID NO: 246590 - DNA, 25 bp, Rattus norvegicus
ccatgcctactaacttttttccaga

SEQ ID NO: 246591 - DNA, 25 bp, Rattus norvegicus
ccatgcctactatcttttttccaga

SEQ ID NO: 246592 - DNA, 25 bp, Rattus norvegicus
ccatgcctcagcacgtaggtactaa

SEQ ID NO: 246593 - DNA, 25 bp, Rattus norvegicus
ccatgcctcagctcgtaggtactaa

SEQ ID NO: 246594 - DNA, 25 bp, Rattus norvegicus
ccatgcctgcagcagacaactcatt

SEQ ID NO: 246595 - DNA, 25 bp, Rattus norvegicus
ccatgcctgcaggagacaactcatt

SEQ ID NO: 246596 - DNA, 25 bp, Rattus norvegicus
ccatgcctgtgaccgaactgactga

SEQ ID NO: 246597 - DNA, 25 bp, Rattus norvegicus
ccatgcctgtgactagaacctgttt

SEQ ID NO: 246598 - DNA, 25 bp, Rattus norvegicus
ccatgcctgtgagcgaactgactga

SEQ ID NO: 246599 - DNA, 25 bp, Rattus norvegicus
ccatgcctgtgagtagaacctgttt

SEQ ID NO: 246600 - DNA, 25 bp, Rattus norvegicus
ccatgccttcttccagacaggaaac

SEQ ID NO: 246601 - DNA, 25 bp, Rattus norvegicus
ccatgccttcttgcagacaggaaac

SEQ ID NO: 246602 - DNA, 25 bp, Rattus norvegicus
ccatgccttttcaggtcaagtgttt

SEQ ID NO: 246603 - DNA, 25 bp, Rattus norvegicus
ccatgccttttctggtcaagtgttt

SEQ ID NO: 246604 - DNA, 25 bp, Rattus norvegicus
ccatgcgtgcgcagtactcagagca

SEQ ID NO: 246605 - DNA, 25 bp, Rattus norvegicus
ccatgcgtgcgctgtactcagagca

SEQ ID NO: 246606 - DNA, 25 bp, Rattus norvegicus
ccatgcgtgtgcctctggagaagaa

SEQ ID NO: 246607 - DNA, 25 bp, Rattus norvegicus
ccatgcgtgtgcgtctggagaagaa

SEQ ID NO: 246608 - DNA, 25 bp, Rattus norvegicus
ccatgctatcatccggattcttaac

SEQ ID NO: 246609 - DNA, 25 bp, Rattus norvegicus
ccatgctatcatgcggattcttaac

SEQ ID NO: 246610 - DNA, 25 bp, Rattus norvegicus
ccatgctcacagattccacaggata

SEQ ID NO: 246611 - DNA, 25 bp, Rattus norvegicus
ccatgctcacagtttccacaggata

SEQ ID NO: 246612 - DNA, 25 bp, Rattus norvegicus
ccatgctccataatgctactgtcaa

SEQ ID NO: 246613 - DNA, 25 bp, Rattus norvegicus
ccatgctccatattgctactgtcaa

SEQ ID NO: 246614 - DNA, 25 bp, Rattus norvegicus
ccatgctccccaacatgataatgaa

SEQ ID NO: 246615 - DNA, 25 bp, Rattus norvegicus
ccatgctccccatcatgataatgaa

SEQ ID NO: 246616 - DNA, 25 bp, Rattus norvegicus
ccatgctcccgcaggcagggaccgg

SEQ ID NO: 246617 - DNA, 25 bp, Rattus norvegicus
ccatgctcccgctggcagggaccgg

SEQ ID NO: 246618 - DNA, 25 bp, Rattus norvegicus
ccatgctctgctattgctcattttt

SEQ ID NO: 246619 - DNA, 25 bp, Rattus norvegicus
ccatgctctgcttttgctcattttt

SEQ ID NO: 246620 - DNA, 25 bp, Rattus norvegicus
ccatgctgcagactgtggccaagaa

SEQ ID NO: 246621 - DNA, 25 bp, Rattus norvegicus
ccatgctgcagagtgtggccaagaa

SEQ ID NO: 246622 - DNA, 25 bp, Rattus norvegicus
ccatgctgccatactgttttgttgt

SEQ ID NO: 246623 - DNA, 25 bp, Rattus norvegicus
ccatgctgccattctgttttgttgt

SEQ ID NO: 246624 - DNA, 25 bp, Rattus norvegicus
ccatgctggcagaggccgcgctcta

SEQ ID NO: 246625 - DNA, 25 bp, Rattus norvegicus
ccatgctggcagtggccgcgctcta

SEQ ID NO: 246626 - DNA, 25 bp, Rattus norvegicus
ccatgctgggttatcatgaagggct

SEQ ID NO: 246627 - DNA, 25 bp, Rattus norvegicus
ccatgctgggttcgctttgatgatg

SEQ ID NO: 246628 - DNA, 25 bp, Rattus norvegicus
ccatgctgggttggctttgatgatg

SEQ ID NO: 246629 - DNA, 25 bp, Rattus norvegicus
ccatgctgggttttcatgaagggct

SEQ ID NO: 246630 - DNA, 25 bp, Rattus norvegicus
ccatgcttcaccacaaaaactcatt

SEQ ID NO: 246631 - DNA, 25 bp, Rattus norvegicus
ccatgcttcacctcaaaaactcatt

SEQ ID NO: 246632 - DNA, 25 bp, Rattus norvegicus
ccatgcttgtggcttctgctgaaga

SEQ ID NO: 246633 - DNA, 25 bp, Rattus norvegicus
ccatgcttgtgggttctgctgaaga

SEQ ID NO: 246634 - DNA, 25 bp, Rattus norvegicus
ccatgctttgccatgtcccaggtgt

SEQ ID NO: 246635 - DNA, 25 bp, Rattus norvegicus
ccatgctttgccttgtcccaggtgt

SEQ ID NO: 246636 - DNA, 25 bp, Rattus norvegicus
ccatggactgtgagttccttgaagt

SEQ ID NO: 246637 - DNA, 25 bp, Rattus norvegicus
ccatggactgtgtgttccttgaagt

SEQ ID NO: 246638 - DNA, 25 bp, Rattus norvegicus
ccatggagaaaccttggctctgaat

SEQ ID NO: 246639 - DNA, 25 bp, Rattus norvegicus
ccatggagaaacgttggctctgaat

SEQ ID NO: 246640 - DNA, 25 bp, Rattus norvegicus
ccatggagcatgagcgccctgtggc

SEQ ID NO: 246641 - DNA, 25 bp, Rattus norvegicus
ccatggagcatgtgcgccctgtggc

SEQ ID NO: 246642 - DNA, 25 bp, Rattus norvegicus
ccatggaggagtcctttacttgctt

SEQ ID NO: 246643 - DNA, 25 bp, Rattus norvegicus
ccatggaggagtgctttacttgctt

SEQ ID NO: 246644 - DNA, 25 bp, Rattus norvegicus
ccatggagtcttcgcggttcggaat

SEQ ID NO: 246645 - DNA, 25 bp, Rattus norvegicus
ccatggagtcttggcggttcggaat

SEQ ID NO: 246646 - DNA, 25 bp, Rattus norvegicus
ccatggatgtgtcagagttcctgtc

SEQ ID NO: 246647 - DNA, 25 bp, Rattus norvegicus
ccatggatgtgtgagagttcctgtc

SEQ ID NO: 246648 - DNA, 25 bp, Rattus norvegicus
ccatggattgtgatttctccttaca

SEQ ID NO: 246649 - DNA, 25 bp, Rattus norvegicus
ccatggattgtgttttctccttaca

SEQ ID NO: 246650 - DNA, 25 bp, Rattus norvegicus
ccatggatttcaaggctctgtttca

SEQ ID NO: 246651 - DNA, 25 bp, Rattus norvegicus
ccatggatttcatggctctgtttca

SEQ ID NO: 246652 - DNA, 25 bp, Rattus norvegicus
ccatggcacgtgaacccgatgtagc

SEQ ID NO: 246653 - DNA, 25 bp, Rattus norvegicus
ccatggcacgtgtacccgatgtagc

SEQ ID NO: 246654 - DNA, 25 bp, Rattus norvegicus
ccatggcagaagacggagacccctt

SEQ ID NO: 246655 - DNA, 25 bp, Rattus norvegicus
ccatggcagaagtcggagacccctt

SEQ ID NO: 246656 - DNA, 25 bp, Rattus norvegicus
ccatggccgttgcacctggtggtaa

SEQ ID NO: 246657 - DNA, 25 bp, Rattus norvegicus
ccatggccgttggacctggtggtaa

SEQ ID NO: 246658 - DNA, 25 bp, Rattus norvegicus
ccatggcctgccatctatttttgtt

SEQ ID NO: 246659 - DNA, 25 bp, Rattus norvegicus
ccatggcctgccttctatttttgtt

SEQ ID NO: 246660 - DNA, 25 bp, Rattus norvegicus
ccatggctacgccacagtcaagagc

SEQ ID NO: 246661 - DNA, 25 bp, Rattus norvegicus
ccatggctacgcgacagtcaagagc

SEQ ID NO: 246662 - DNA, 25 bp, Rattus norvegicus
ccatggctattaaagtaccgaaggt

SEQ ID NO: 246663 - DNA, 25 bp, Rattus norvegicus
ccatggctattatagtaccgaaggt

SEQ ID NO: 246664 - DNA, 25 bp, Rattus norvegicus
ccatggctcatgaagatacgaacag

SEQ ID NO: 246665 - DNA, 25 bp, Rattus norvegicus
ccatggctcatgtagatacgaacag

SEQ ID NO: 246666 - DNA, 25 bp, Rattus norvegicus
ccatggctctaacgaggtgaaaggc

SEQ ID NO: 246667 - DNA, 25 bp, Rattus norvegicus
ccatggctctaaggaggtgaaaggc

SEQ ID NO: 246668 - DNA, 25 bp, Rattus norvegicus
ccatggctctctcgccttggaaagg

SEQ ID NO: 246669 - DNA, 25 bp, Rattus norvegicus
ccatggctctctggccttggaaagg

SEQ ID NO: 246670 - DNA, 25 bp, Rattus norvegicus
ccatggcttctgagtcttagcagta

SEQ ID NO: 246671 - DNA, 25 bp, Rattus norvegicus
ccatggcttctgtgtcttagcagta

SEQ ID NO: 246672 - DNA, 25 bp, Rattus norvegicus
ccatggctttggctttagtgtgaca

SEQ ID NO: 246673 - DNA, 25 bp, Rattus norvegicus
ccatggctttgggtttagtgtgaca

SEQ ID NO: 246674 - DNA, 25 bp, Rattus norvegicus
ccatgggaagctctttctctctgaa

SEQ ID NO: 246675 - DNA, 25 bp, Rattus norvegicus
ccatgggaagctgtttctctctgaa

SEQ ID NO: 246676 - DNA, 25 bp, Rattus norvegicus
ccatgggaccgacgagggccttaca

SEQ ID NO: 246677 - DNA, 25 bp, Rattus norvegicus
ccatgggaccgaggagggccttaca

SEQ ID NO: 246678 - DNA, 25 bp, Rattus norvegicus
ccatgggatcctcactgctcactgg

SEQ ID NO: 246679 - DNA, 25 bp, Rattus norvegicus
ccatgggatcctgactgctcactgg

SEQ ID NO: 246680 - DNA, 25 bp, Rattus norvegicus
ccatgggatgacctgcgtgttttat

SEQ ID NO: 246681 - DNA, 25 bp, Rattus norvegicus
ccatgggatgacgtgcgtgttttat

SEQ ID NO: 246682 - DNA, 25 bp, Rattus norvegicus
ccatgggcaggtcggtcaagggaca

SEQ ID NO: 246683 - DNA, 25 bp, Rattus norvegicus
ccatgggcaggtgggtcaagggaca

SEQ ID NO: 246684 - DNA, 25 bp, Rattus norvegicus
ccatgggccattatgatccaaattt

SEQ ID NO: 246685 - DNA, 25 bp, Rattus norvegicus
ccatgggccattttgatccaaattt

SEQ ID NO: 246686 - DNA, 25 bp, Rattus norvegicus
ccatgggccgcgagtttgggaacct

SEQ ID NO: 246687 - DNA, 25 bp, Rattus norvegicus
ccatgggccgcgtgtttgggaacct

SEQ ID NO: 246688 - DNA, 25 bp, Rattus norvegicus
ccatgggctactccatgcgtgggat

SEQ ID NO: 246689 - DNA, 25 bp, Rattus norvegicus
ccatgggctactgcatgcgtgggat

SEQ ID NO: 246690 - DNA, 25 bp, Rattus norvegicus
ccatgggctggcatgcctaaaggga

SEQ ID NO: 246691 - DNA, 25 bp, Rattus norvegicus
ccatgggctggcttgcctaaaggga

SEQ ID NO: 246692 - DNA, 25 bp, Rattus norvegicus
ccatgggctttaaccactagcttat

SEQ ID NO: 246693 - DNA, 25 bp, Rattus norvegicus
ccatgggctttatccactagcttat

SEQ ID NO: 246694 - DNA, 25 bp, Rattus norvegicus
ccatgggtctgtctaagtgtcttcc

SEQ ID NO: 246695 - DNA, 25 bp, Rattus norvegicus
ccatgggtctgtgtaagtgtcttcc

SEQ ID NO: 246696 - DNA, 25 bp, Rattus norvegicus
ccatgggtgctgataggtttgtcta

SEQ ID NO: 246697 - DNA, 25 bp, Rattus norvegicus
ccatgggtgctgttaggtttgtcta

SEQ ID NO: 246698 - DNA, 25 bp, Rattus norvegicus
ccatgggtgtggcttataccttgaa

SEQ ID NO: 246699 - DNA, 25 bp, Rattus norvegicus
ccatgggtgtgggttataccttgaa

SEQ ID NO: 246700 - DNA, 25 bp, Rattus norvegicus
ccatggtatccacagctattgtcct

SEQ ID NO: 246701 - DNA, 25 bp, Rattus norvegicus
ccatggtatccagagctattgtcct

SEQ ID NO: 246702 - DNA, 25 bp, Rattus norvegicus
ccatggtcaggtacaattgtacttt

SEQ ID NO: 246703 - DNA, 25 bp, Rattus norvegicus
ccatggtcaggttcaattgtacttt

SEQ ID NO: 246704 - DNA, 25 bp, Rattus norvegicus
ccatggtcctcacggatagggagag

SEQ ID NO: 246705 - DNA, 25 bp, Rattus norvegicus
ccatggtcctcagggatagggagag

SEQ ID NO: 246706 - DNA, 25 bp, Rattus norvegicus
ccatggtcgctgaggtttggcaaga

SEQ ID NO: 246707 - DNA, 25 bp, Rattus norvegicus
ccatggtcgctgtggtttggcaaga

SEQ ID NO: 246708 - DNA, 25 bp, Rattus norvegicus
ccatggtcgcttaacctttgagaac

SEQ ID NO: 246709 - DNA, 25 bp, Rattus norvegicus
ccatggtcgctttacctttgagaac

SEQ ID NO: 246710 - DNA, 25 bp, Rattus norvegicus
ccatggtctctgagctgtgcagctg

SEQ ID NO: 246711 - DNA, 25 bp, Rattus norvegicus
ccatggtctctgtgctgtgcagctg

SEQ ID NO: 246712 - DNA, 25 bp, Rattus norvegicus
ccatggtgaccgacaggttggtgac

SEQ ID NO: 246713 - DNA, 25 bp, Rattus norvegicus
ccatggtgaccgtcaggttggtgac

SEQ ID NO: 246714 - DNA, 25 bp, Rattus norvegicus
ccatggtgactaagggctgcggaat

SEQ ID NO: 246715 - DNA, 25 bp, Rattus norvegicus
ccatggtgactatgggctgcggaat

SEQ ID NO: 246716 - DNA, 25 bp, Rattus norvegicus
ccatggtgactgcagggactctatc

SEQ ID NO: 246717 - DNA, 25 bp, Rattus norvegicus
ccatggtgactggagggactctatc

SEQ ID NO: 246718 - DNA, 25 bp, Rattus norvegicus
ccatggtgggctctttgatattttt

SEQ ID NO: 246719 - DNA, 25 bp, Rattus norvegicus
ccatggtgggctgtttgatattttt

SEQ ID NO: 246720 - DNA, 25 bp, Rattus norvegicus
ccatggttcttgctgactacatata

SEQ ID NO: 246721 - DNA, 25 bp, Rattus norvegicus
ccatggttcttggtgactacatata

SEQ ID NO: 246722 - DNA, 25 bp, Rattus norvegicus
ccatggttggtcagtactacatcaa

SEQ ID NO: 246723 - DNA, 25 bp, Rattus norvegicus
ccatggttggtctgtactacatcaa

SEQ ID NO: 246724 - DNA, 25 bp, Rattus norvegicus
ccatgtaaagctcgcgtgctgtcta

SEQ ID NO: 246725 - DNA, 25 bp, Rattus norvegicus
ccatgtaaagctggcgtgctgtcta

SEQ ID NO: 246726 - DNA, 25 bp, Rattus norvegicus
ccatgtaacctacgttggcctgttt

SEQ ID NO: 246727 - DNA, 25 bp, Rattus norvegicus
ccatgtaacctaggttggcctgttt

SEQ ID NO: 246728 - DNA, 25 bp, Rattus norvegicus
ccatgtaatattcctgtaaatgatg

SEQ ID NO: 246729 - DNA, 25 bp, Rattus norvegicus
ccatgtaatattgctgtaaatgatg

SEQ ID NO: 246730 - DNA, 25 bp, Rattus norvegicus
ccatgtacacgtcaggcagcagcta

SEQ ID NO: 246731 - DNA, 25 bp, Rattus norvegicus
ccatgtacacgtgaggcagcagcta

SEQ ID NO: 246732 - DNA, 25 bp, Rattus norvegicus
ccatgtacgaatccaggtgttcata

SEQ ID NO: 246733 - DNA, 25 bp, Rattus norvegicus
ccatgtacgaatgcaggtgttcata

SEQ ID NO: 246734 - DNA, 25 bp, Rattus norvegicus
ccatgtacgagtcgccgccgttgga

SEQ ID NO: 246735 - DNA, 25 bp, Rattus norvegicus
ccatgtacgagtggccgccgttgga

SEQ ID NO: 246736 - DNA, 25 bp, Rattus norvegicus
ccatgtactatgaaggcttttgcta

SEQ ID NO: 246737 - DNA, 25 bp, Rattus norvegicus
ccatgtactatgtaggcttttgcta

SEQ ID NO: 246738 - DNA, 25 bp, Rattus norvegicus
ccatgtacttggagggacagcaaac

SEQ ID NO: 246739 - DNA, 25 bp, Rattus norvegicus
ccatgtacttggtgggacagcaaac

SEQ ID NO: 246740 - DNA, 25 bp, Rattus norvegicus
ccatgtagccggcagcgcaagcgca

SEQ ID NO: 246741 - DNA, 25 bp, Rattus norvegicus
ccatgtagccgggagcgcaagcgca

SEQ ID NO: 246742 - DNA, 25 bp, Rattus norvegicus
ccatgtatatgtctttagcacacac

SEQ ID NO: 246743 - DNA, 25 bp, Rattus norvegicus
ccatgtatatgtgtttagcacacac

SEQ ID NO: 246744 - DNA, 25 bp, Rattus norvegicus
ccatgtatgctgcactgggtttctc

SEQ ID NO: 246745 - DNA, 25 bp, Rattus norvegicus
ccatgtatgctggactgggtttctc

SEQ ID NO: 246746 - DNA, 25 bp, Rattus norvegicus
ccatgtcactgcatctagagaaatg

SEQ ID NO: 246747 - DNA, 25 bp, Rattus norvegicus
ccatgtcactgcttctagagaaatg

SEQ ID NO: 246748 - DNA, 25 bp, Rattus norvegicus
ccatgtccgtgcagggcgagtatga

SEQ ID NO: 246749 - DNA, 25 bp, Rattus norvegicus
ccatgtccgtgctgggcgagtatga

SEQ ID NO: 246750 - DNA, 25 bp, Rattus norvegicus
ccatgtcctcctcggggtctggtca

SEQ ID NO: 246751 - DNA, 25 bp, Rattus norvegicus
ccatgtcctcctgggggtctggtca

SEQ ID NO: 246752 - DNA, 25 bp, Rattus norvegicus
ccatgtcctgttcattttgttatca

SEQ ID NO: 246753 - DNA, 25 bp, Rattus norvegicus
ccatgtcctgttgattttgttatca

SEQ ID NO: 246754 - DNA, 25 bp, Rattus norvegicus
ccatgtcgccagagccaacgtcaaa

SEQ ID NO: 246755 - DNA, 25 bp, Rattus norvegicus
ccatgtcgccagtgccaacgtcaaa

SEQ ID NO: 246756 - DNA, 25 bp, Rattus norvegicus
ccatgtctcccgaggtgtgggccag

SEQ ID NO: 246757 - DNA, 25 bp, Rattus norvegicus
ccatgtctcccgtggtgtgggccag

SEQ ID NO: 246758 - DNA, 25 bp, Rattus norvegicus
ccatgtctctcaaggtagaagggct

SEQ ID NO: 246759 - DNA, 25 bp, Rattus norvegicus
ccatgtctctcatggtagaagggct

SEQ ID NO: 246760 - DNA, 25 bp, Rattus norvegicus
ccatgtctctggcttcaaaattgta

SEQ ID NO: 246761 - DNA, 25 bp, Rattus norvegicus
ccatgtctctgggttcaaaattgta

SEQ ID NO: 246762 - DNA, 25 bp, Rattus norvegicus
ccatgtctgaccctagttgttagaa

SEQ ID NO: 246763 - DNA, 25 bp, Rattus norvegicus
ccatgtctgaccgtagttgttagaa

SEQ ID NO: 246764 - DNA, 25 bp, Rattus norvegicus
ccatgtctggacaactcactatgat

SEQ ID NO: 246765 - DNA, 25 bp, Rattus norvegicus
ccatgtctggactactcactatgat

SEQ ID NO: 246766 - DNA, 25 bp, Rattus norvegicus
ccatgtcttagtaggatgtccctga

SEQ ID NO: 246767 - DNA, 25 bp, Rattus norvegicus
ccatgtcttagttggatgtccctga

SEQ ID NO: 246768 - DNA, 25 bp, Rattus norvegicus
ccatgtgatcagaccttttcagccc

SEQ ID NO: 246769 - DNA, 25 bp, Rattus norvegicus
ccatgtgatcagtccttttcagccc

SEQ ID NO: 246770 - DNA, 25 bp, Rattus norvegicus
ccatgtgattggcttcgtcctctta

SEQ ID NO: 246771 - DNA, 25 bp, Rattus norvegicus
ccatgtgattgggttcgtcctctta

SEQ ID NO: 246772 - DNA, 25 bp, Rattus norvegicus
ccatgtgcactgcagcctttggatt

SEQ ID NO: 246773 - DNA, 25 bp, Rattus norvegicus
ccatgtgcactggagcctttggatt

SEQ ID NO: 246774 - DNA, 25 bp, Rattus norvegicus
ccatgtgcattgcaccttgatgtct

SEQ ID NO: 246775 - DNA, 25 bp, Rattus norvegicus
ccatgtgcattggaccttgatgtct

SEQ ID NO: 246776 - DNA, 25 bp, Rattus norvegicus
ccatgtgccattcgagctccttaaa

SEQ ID NO: 246777 - DNA, 25 bp, Rattus norvegicus
ccatgtgccattggagctccttaaa

SEQ ID NO: 246778 - DNA, 25 bp, Rattus norvegicus
ccatgtgcctatatgtttgtaatct

SEQ ID NO: 246779 - DNA, 25 bp, Rattus norvegicus
ccatgtgcctatttgtttgtaatct

SEQ ID NO: 246780 - DNA, 25 bp, Rattus norvegicus
ccatgtgctgtgatggctggttcca

SEQ ID NO: 246781 - DNA, 25 bp, Rattus norvegicus
ccatgtgctgtgttggctggttcca

SEQ ID NO: 246782 - DNA, 25 bp, Rattus norvegicus
ccatgtggaattctctgggcgcaga

SEQ ID NO: 246783 - DNA, 25 bp, Rattus norvegicus
ccatgtggaattgtctgggcgcaga

SEQ ID NO: 246784 - DNA, 25 bp, Rattus norvegicus
ccatgtggatttaacgagaagagaa

SEQ ID NO: 246785 - DNA, 25 bp, Rattus norvegicus
ccatgtggattttacgagaagagaa

SEQ ID NO: 246786 - DNA, 25 bp, Rattus norvegicus
ccatgtggcatcacttgtgtgcaaa

SEQ ID NO: 246787 - DNA, 25 bp, Rattus norvegicus
ccatgtggcatctcttgtgtgcaaa

SEQ ID NO: 246788 - DNA, 25 bp, Rattus norvegicus
ccatgtgggcgtactcggttgtaga

SEQ ID NO: 246789 - DNA, 25 bp, Rattus norvegicus
ccatgtgggcgttctcggttgtaga

SEQ ID NO: 246790 - DNA, 25 bp, Rattus norvegicus
ccatgtgggctcacacaggcaacaa

SEQ ID NO: 246791 - DNA, 25 bp, Rattus norvegicus
ccatgtgggctctcacaggcaacaa

SEQ ID NO: 246792 - DNA, 25 bp, Rattus norvegicus
ccatgtgggtgcaggaatttgcatc

SEQ ID NO: 246793 - DNA, 25 bp, Rattus norvegicus
ccatgtgggtgctggaatttgcatc

SEQ ID NO: 246794 - DNA, 25 bp, Rattus norvegicus
ccatgtgggtgtcactgatctcagt

SEQ ID NO: 246795 - DNA, 25 bp, Rattus norvegicus
ccatgtgggtgtgactgatctcagt

SEQ ID NO: 246796 - DNA, 25 bp, Rattus norvegicus
ccatgtggtatcaggtgtcttcttt

SEQ ID NO: 246797 - DNA, 25 bp, Rattus norvegicus
ccatgtggtatctggtgtcttcttt

SEQ ID NO: 246798 - DNA, 25 bp, Rattus norvegicus
ccatgtggtgagaggatctcttgat

SEQ ID NO: 246799 - DNA, 25 bp, Rattus norvegicus
ccatgtggtgagtggatctcttgat

SEQ ID NO: 246800 - DNA, 25 bp, Rattus norvegicus
ccatgtgtcagacgcacttttggta

SEQ ID NO: 246801 - DNA, 25 bp, Rattus norvegicus
ccatgtgtcagaggcacttttggta

SEQ ID NO: 246802 - DNA, 25 bp, Rattus norvegicus
ccatgtgtgattccataaccggttt

SEQ ID NO: 246803 - DNA, 25 bp, Rattus norvegicus
ccatgtgtgattgcataaccggttt

SEQ ID NO: 246804 - DNA, 25 bp, Rattus norvegicus
ccatgtgtgcaccaatggctgctca

SEQ ID NO: 246805 - DNA, 25 bp, Rattus norvegicus
ccatgtgtgcacgaatggctgctca

SEQ ID NO: 246806 - DNA, 25 bp, Rattus norvegicus
ccatgtgtggataggccctttggca

SEQ ID NO: 246807 - DNA, 25 bp, Rattus norvegicus
ccatgtgtggattggccctttggca

SEQ ID NO: 246808 - DNA, 25 bp, Rattus norvegicus
ccatgtgtgtctatctgtttgtctt

SEQ ID NO: 246809 - DNA, 25 bp, Rattus norvegicus
ccatgtgtgtctttctgtttgtctt

SEQ ID NO: 246810 - DNA, 25 bp, Rattus norvegicus
ccatgtgttctaaaggctgatactc

SEQ ID NO: 246811 - DNA, 25 bp, Rattus norvegicus
ccatgtgttctataggctgatactc

SEQ ID NO: 246812 - DNA, 25 bp, Rattus norvegicus
ccatgtgttggcatgcttttggaac

SEQ ID NO: 246813 - DNA, 25 bp, Rattus norvegicus
ccatgtgttggcttgcttttggaac

SEQ ID NO: 246814 - DNA, 25 bp, Rattus norvegicus
ccatgtgttgttagtttgtagcagt

SEQ ID NO: 246815 - DNA, 25 bp, Rattus norvegicus
ccatgtgttgtttgtttgtagcagt

SEQ ID NO: 246816 - DNA, 25 bp, Rattus norvegicus
ccatgttacattaattttccctctg

SEQ ID NO: 246817 - DNA, 25 bp, Rattus norvegicus
ccatgttacatttattttccctctg

SEQ ID NO: 246818 - DNA, 25 bp, Rattus norvegicus
ccatgttacgatcctaataaagtat

SEQ ID NO: 246819 - DNA, 25 bp, Rattus norvegicus
ccatgttacgatgctaataaagtat

SEQ ID NO: 246820 - DNA, 25 bp, Rattus norvegicus
ccatgttcaacccttttctgttatt

SEQ ID NO: 246821 - DNA, 25 bp, Rattus norvegicus
ccatgttcaaccgttttctgttatt

SEQ ID NO: 246822 - DNA, 25 bp, Rattus norvegicus
ccatgttcatggaccggtataaggt

SEQ ID NO: 246823 - DNA, 25 bp, Rattus norvegicus
ccatgttcatggtccggtataaggt

SEQ ID NO: 246824 - DNA, 25 bp, Rattus norvegicus
ccatgttcctgcataactccagtaa

SEQ ID NO: 246825 - DNA, 25 bp, Rattus norvegicus
ccatgttcctgcttaactccagtaa

SEQ ID NO: 246826 - DNA, 25 bp, Rattus norvegicus
ccatgttcctgtaggtcgtgggact

SEQ ID NO: 246827 - DNA, 25 bp, Rattus norvegicus
ccatgttcctgttggtcgtgggact

SEQ ID NO: 246828 - DNA, 25 bp, Rattus norvegicus
ccatgttctgggactcttcagatac

SEQ ID NO: 246829 - DNA, 25 bp, Rattus norvegicus
ccatgttctgggtctcttcagatac

SEQ ID NO: 246830 - DNA, 25 bp, Rattus norvegicus
ccatgttcttatcgcagccattatt

SEQ ID NO: 246831 - DNA, 25 bp, Rattus norvegicus
ccatgttcttatggcagccattatt

SEQ ID NO: 246832 - DNA, 25 bp, Rattus norvegicus
ccatgttgcggtctgtgtctgtata

SEQ ID NO: 246833 - DNA, 25 bp, Rattus norvegicus
ccatgttgcggtgtgtgtctgtata

SEQ ID NO: 246834 - DNA, 25 bp, Rattus norvegicus
ccatgttgtctgaattcctgtttgt

SEQ ID NO: 246835 - DNA, 25 bp, Rattus norvegicus
ccatgttgtctgtattcctgtttgt

SEQ ID NO: 246836 - DNA, 25 bp, Rattus norvegicus
ccatgttgtgagagtggaccaagtc

SEQ ID NO: 246837 - DNA, 25 bp, Rattus norvegicus
ccatgttgtgagtgtggaccaagtc

SEQ ID NO: 246838 - DNA, 25 bp, Rattus norvegicus
ccatgttgtgtgattgaccaattca

SEQ ID NO: 246839 - DNA, 25 bp, Rattus norvegicus
ccatgttgtgtgtttgaccaattca

SEQ ID NO: 246840 - DNA, 25 bp, Rattus norvegicus
ccatgtttgcagatttctattgtcc

SEQ ID NO: 246841 - DNA, 25 bp, Rattus norvegicus
ccatgtttgcagttttctattgtcc

SEQ ID NO: 246842 - DNA, 25 bp, Rattus norvegicus
ccatgtttgtccaccagaaggccgg

SEQ ID NO: 246843 - DNA, 25 bp, Rattus norvegicus
ccatgtttgtcctccagaaggccgg

SEQ ID NO: 246844 - DNA, 25 bp, Rattus norvegicus
ccatgtttgtgaagggtgtgaacca

SEQ ID NO: 246845 - DNA, 25 bp, Rattus norvegicus
ccatgtttgtgatgggtgtgaacca

SEQ ID NO: 246846 - DNA, 25 bp, Rattus norvegicus
ccatgttttacacccttcgtgtggt

SEQ ID NO: 246847 - DNA, 25 bp, Rattus norvegicus
ccatgttttacagccttcgtgtggt

SEQ ID NO: 246848 - DNA, 25 bp, Rattus norvegicus
ccatgttttcccagtgtttcagaga

SEQ ID NO: 246849 - DNA, 25 bp, Rattus norvegicus
ccatgttttccctgtgtttcagaga

SEQ ID NO: 246850 - DNA, 25 bp, Rattus norvegicus
ccatgttttcgtcttgttcagctga

SEQ ID NO: 246851 - DNA, 25 bp, Rattus norvegicus
ccatgttttcgtgttgttcagctga

SEQ ID NO: 246852 - DNA, 25 bp, Rattus norvegicus
ccatgttttctacccttcactaagg

SEQ ID NO: 246853 - DNA, 25 bp, Rattus norvegicus
ccatgttttctagccttcactaagg

SEQ ID NO: 246854 - DNA, 25 bp, Rattus norvegicus
ccatgttttctcatcaactgtttaa

SEQ ID NO: 246855 - DNA, 25 bp, Rattus norvegicus
ccatgttttctcttcaactgtttaa

SEQ ID NO: 246856 - DNA, 25 bp, Rattus norvegicus
ccattaaatgctacatggtcgttta

SEQ ID NO: 246857 - DNA, 25 bp, Rattus norvegicus
ccattaaatgcttcatggtcgttta

SEQ ID NO: 246858 - DNA, 25 bp, Rattus norvegicus
ccattaacgactactcccgtgagaa

SEQ ID NO: 246859 - DNA, 25 bp, Rattus norvegicus
ccattaacgacttctcccgtgagaa

SEQ ID NO: 246860 - DNA, 25 bp, Rattus norvegicus
ccattacagcccctacggaagtaga

SEQ ID NO: 246861 - DNA, 25 bp, Rattus norvegicus
ccattacagcccgtacggaagtaga

SEQ ID NO: 246862 - DNA, 25 bp, Rattus norvegicus
ccattactgatgattgtgagtcacc

SEQ ID NO: 246863 - DNA, 25 bp, Rattus norvegicus
ccattactgatgtttgtgagtcacc

SEQ ID NO: 246864 - DNA, 25 bp, Rattus norvegicus
ccattagagtagaccctgtaagcaa

SEQ ID NO: 246865 - DNA, 25 bp, Rattus norvegicus
ccattagagtagtccctgtaagcaa

SEQ ID NO: 246866 - DNA, 25 bp, Rattus norvegicus
ccattagattcgctgctgtgctcta

SEQ ID NO: 246867 - DNA, 25 bp, Rattus norvegicus
ccattagattcggtgctgtgctcta

SEQ ID NO: 246868 - DNA, 25 bp, Rattus norvegicus
ccattagcaataattccaggtacag

SEQ ID NO: 246869 - DNA, 25 bp, Rattus norvegicus
ccattagcaatatttccaggtacag

SEQ ID NO: 246870 - DNA, 25 bp, Rattus norvegicus
ccattagctgtaccaggcttggtcc

SEQ ID NO: 246871 - DNA, 25 bp, Rattus norvegicus
ccattagctgtagcaggcttggtcc

SEQ ID NO: 246872 - DNA, 25 bp, Rattus norvegicus
ccattaggttgtctgtgtccccatc

SEQ ID NO: 246873 - DNA, 25 bp, Rattus norvegicus
ccattaggttgtgtgtgtccccatc

SEQ ID NO: 246874 - DNA, 25 bp, Rattus norvegicus
ccattattcccgaactgcatttttt

SEQ ID NO: 246875 - DNA, 25 bp, Rattus norvegicus
ccattattcccgtactgcatttttt

SEQ ID NO: 246876 - DNA, 25 bp, Rattus norvegicus
ccattcaacgggagggatgcgacag

SEQ ID NO: 246877 - DNA, 25 bp, Rattus norvegicus
ccattcaacgggtgggatgcgacag

SEQ ID NO: 246878 - DNA, 25 bp, Rattus norvegicus
ccattcacagctagttgggtaaaca

SEQ ID NO: 246879 - DNA, 25 bp, Rattus norvegicus
ccattcacagcttgttgggtaaaca

SEQ ID NO: 246880 - DNA, 25 bp, Rattus norvegicus
ccattcacatggcactgtcacagaa

SEQ ID NO: 246881 - DNA, 25 bp, Rattus norvegicus
ccattcacatgggactgtcacagaa

SEQ ID NO: 246882 - DNA, 25 bp, Rattus norvegicus
ccattcacctcaaagagtgctcttt

SEQ ID NO: 246883 - DNA, 25 bp, Rattus norvegicus
ccattcacctcatagagtgctcttt

SEQ ID NO: 246884 - DNA, 25 bp, Rattus norvegicus
ccattcaggtaaattaggcattgta

SEQ ID NO: 246885 - DNA, 25 bp, Rattus norvegicus
ccattcaggtaatttaggcattgta

SEQ ID NO: 246886 - DNA, 25 bp, Rattus norvegicus
ccattcagttctacccagtgggatg

SEQ ID NO: 246887 - DNA, 25 bp, Rattus norvegicus
ccattcagttcttcccagtgggatg

SEQ ID NO: 246888 - DNA, 25 bp, Rattus norvegicus
ccattccaacagctctaaggtgaga

SEQ ID NO: 246889 - DNA, 25 bp, Rattus norvegicus
ccattccaacaggtctaaggtgaga

SEQ ID NO: 246890 - DNA, 25 bp, Rattus norvegicus
ccattccacagaaacggagtcccaa

SEQ ID NO: 246891 - DNA, 25 bp, Rattus norvegicus
ccattccacagatacggagtcccaa

SEQ ID NO: 246892 - DNA, 25 bp, Rattus norvegicus
ccattccacctcagcatttagaaaa

SEQ ID NO: 246893 - DNA, 25 bp, Rattus norvegicus
ccattccacctctgcatttagaaaa

SEQ ID NO: 246894 - DNA, 25 bp, Rattus norvegicus
ccattccagggcaaccctgaggaag

SEQ ID NO: 246895 - DNA, 25 bp, Rattus norvegicus
ccattccagggctaccctgaggaag

SEQ ID NO: 246896 - DNA, 25 bp, Rattus norvegicus
ccattccatagactcattgcctttg

SEQ ID NO: 246897 - DNA, 25 bp, Rattus norvegicus
ccattccatagagtcattgcctttg

SEQ ID NO: 246898 - DNA, 25 bp, Rattus norvegicus
ccattcccactcagacaagtttttt

SEQ ID NO: 246899 - DNA, 25 bp, Rattus norvegicus
ccattcccactctgacaagtttttt

SEQ ID NO: 246900 - DNA, 25 bp, Rattus norvegicus
ccattcccagagcttcgttagacag

SEQ ID NO: 246901 - DNA, 25 bp, Rattus norvegicus
ccattcccagaggttcgttagacag

SEQ ID NO: 246902 - DNA, 25 bp, Rattus norvegicus
ccattcccagtaacacgctttgaaa

SEQ ID NO: 246903 - DNA, 25 bp, Rattus norvegicus
ccattcccagtatcacgctttgaaa

SEQ ID NO: 246904 - DNA, 25 bp, Rattus norvegicus
ccattccccactaggtgataagctt

SEQ ID NO: 246905 - DNA, 25 bp, Rattus norvegicus
ccattccccacttggtgataagctt

SEQ ID NO: 246906 - DNA, 25 bp, Rattus norvegicus
ccattccgcttcaaggcagagcaaa

SEQ ID NO: 246907 - DNA, 25 bp, Rattus norvegicus
ccattccgcttctaggcagagcaaa

SEQ ID NO: 246908 - DNA, 25 bp, Rattus norvegicus
ccattccggtctctgaaggttttca

SEQ ID NO: 246909 - DNA, 25 bp, Rattus norvegicus
ccattccggtctgtgaaggttttca

SEQ ID NO: 246910 - DNA, 25 bp, Rattus norvegicus
ccattcctacaaccttcacagagtt

SEQ ID NO: 246911 - DNA, 25 bp, Rattus norvegicus
ccattcctacaagcttcacagagtt

SEQ ID NO: 246912 - DNA, 25 bp, Rattus norvegicus
ccattcctactcacagatgctgtta

SEQ ID NO: 246913 - DNA, 25 bp, Rattus norvegicus
ccattcctactctcagatgctgtta

SEQ ID NO: 246914 - DNA, 25 bp, Rattus norvegicus
ccattcctccgtctgaaacttaaag

SEQ ID NO: 246915 - DNA, 25 bp, Rattus norvegicus
ccattcctccgtgtgaaacttaaag

SEQ ID NO: 246916 - DNA, 25 bp, Rattus norvegicus
ccattcctctgcatcattaacttta

SEQ ID NO: 246917 - DNA, 25 bp, Rattus norvegicus
ccattcctctgcttcattaacttta

SEQ ID NO: 246918 - DNA, 25 bp, Rattus norvegicus
ccattcctggatcagtaggagccaa

SEQ ID NO: 246919 - DNA, 25 bp, Rattus norvegicus
ccattcctggatgagtaggagccaa

SEQ ID NO: 246920 - DNA, 25 bp, Rattus norvegicus
ccattcctttccaagcagaattgat

SEQ ID NO: 246921 - DNA, 25 bp, Rattus norvegicus
ccattcctttcctagcagaattgat

SEQ ID NO: 246922 - DNA, 25 bp, Rattus norvegicus
ccattcgactctacagctaagctga

SEQ ID NO: 246923 - DNA, 25 bp, Rattus norvegicus
ccattcgactcttcagctaagctga

SEQ ID NO: 246924 - DNA, 25 bp, Rattus norvegicus
ccattcgcatttagtatcggttcat

SEQ ID NO: 246925 - DNA, 25 bp, Rattus norvegicus
ccattcgcattttgtatcggttcat

SEQ ID NO: 246926 - DNA, 25 bp, Rattus norvegicus
ccattcgctctacgtggacttcagt

SEQ ID NO: 246927 - DNA, 25 bp, Rattus norvegicus
ccattcgctctaggtggacttcagt

SEQ ID NO: 246928 - DNA, 25 bp, Rattus norvegicus
ccattcggagggagaccctgttggt

SEQ ID NO: 246929 - DNA, 25 bp, Rattus norvegicus
ccattcggagggtgaccctgttggt

SEQ ID NO: 246930 - DNA, 25 bp, Rattus norvegicus
ccattcgtgaggaggccagagccat

SEQ ID NO: 246931 - DNA, 25 bp, Rattus norvegicus
ccattcgtgaggtggccagagccat

SEQ ID NO: 246932 - DNA, 25 bp, Rattus norvegicus
ccattctaatcccttgtttacactg

SEQ ID NO: 246933 - DNA, 25 bp, Rattus norvegicus
ccattctaatccgttgtttacactg

SEQ ID NO: 246934 - DNA, 25 bp, Rattus norvegicus
ccattctcgcacagcagttacatta

SEQ ID NO: 246935 - DNA, 25 bp, Rattus norvegicus
ccattctcgcactgcagttacatta

SEQ ID NO: 246936 - DNA, 25 bp, Rattus norvegicus
ccattctctatcagtgcagggacat

SEQ ID NO: 246937 - DNA, 25 bp, Rattus norvegicus
ccattctctatctgtgcagggacat

SEQ ID NO: 246938 - DNA, 25 bp, Rattus norvegicus
ccattctctatgctttcctggatga

SEQ ID NO: 246939 - DNA, 25 bp, Rattus norvegicus
ccattctctatggtttcctggatga

SEQ ID NO: 246940 - DNA, 25 bp, Rattus norvegicus
ccattctctggtcccaactgcaagg

SEQ ID NO: 246941 - DNA, 25 bp, Rattus norvegicus
ccattctctggtgccaactgcaagg

SEQ ID NO: 246942 - DNA, 25 bp, Rattus norvegicus
ccattctctttaagacctaggacct

SEQ ID NO: 246943 - DNA, 25 bp, Rattus norvegicus
ccattctctttatgacctaggacct

SEQ ID NO: 246944 - DNA, 25 bp, Rattus norvegicus
ccattctgaactcctaccttgaaaa

SEQ ID NO: 246945 - DNA, 25 bp, Rattus norvegicus
ccattctgaactgctaccttgaaaa

SEQ ID NO: 246946 - DNA, 25 bp, Rattus norvegicus
ccattctgtaggatgatattctctt

SEQ ID NO: 246947 - DNA, 25 bp, Rattus norvegicus
ccattctgtaggttgatattctctt

SEQ ID NO: 246948 - DNA, 25 bp, Rattus norvegicus
ccattcttatgaaacccaggtccag

SEQ ID NO: 246949 - DNA, 25 bp, Rattus norvegicus
ccattcttatgatacccaggtccag

SEQ ID NO: 246950 - DNA, 25 bp, Rattus norvegicus
ccattcttcagtcaggcaccttttt

SEQ ID NO: 246951 - DNA, 25 bp, Rattus norvegicus
ccattcttcagtgaggcaccttttt

SEQ ID NO: 246952 - DNA, 25 bp, Rattus norvegicus
ccattcttccagcatacctttcaga

SEQ ID NO: 246953 - DNA, 25 bp, Rattus norvegicus
ccattcttccagctccataataata

SEQ ID NO: 246954 - DNA, 25 bp, Rattus norvegicus
ccattcttccaggatacctttcaga

SEQ ID NO: 246955 - DNA, 25 bp, Rattus norvegicus
ccattcttccaggtccataataata

SEQ ID NO: 246956 - DNA, 25 bp, Rattus norvegicus
ccattcttcgttagctcactttata

SEQ ID NO: 246957 - DNA, 25 bp, Rattus norvegicus
ccattcttcgtttgctcactttata

SEQ ID NO: 246958 - DNA, 25 bp, Rattus norvegicus
ccattcttctcaaccatgtagctat

SEQ ID NO: 246959 - DNA, 25 bp, Rattus norvegicus
ccattcttctcatccatgtagctat

SEQ ID NO: 246960 - DNA, 25 bp, Rattus norvegicus
ccattcttgtgacttcagcaaccta

SEQ ID NO: 246961 - DNA, 25 bp, Rattus norvegicus
ccattcttgtgagttcagcaaccta

SEQ ID NO: 246962 - DNA, 25 bp, Rattus norvegicus
ccattcttttcaacttcagcacaag

SEQ ID NO: 246963 - DNA, 25 bp, Rattus norvegicus
ccattcttttcatcttcagcacaag

SEQ ID NO: 246964 - DNA, 25 bp, Rattus norvegicus
ccattgaaaggtagctgggttccca

SEQ ID NO: 246965 - DNA, 25 bp, Rattus norvegicus
ccattgaaaggttgctgggttccca

SEQ ID NO: 246966 - DNA, 25 bp, Rattus norvegicus
ccattgaggtggaggtcgagcttat

SEQ ID NO: 246967 - DNA, 25 bp, Rattus norvegicus
ccattgaggtggtggtcgagcttat

SEQ ID NO: 246968 - DNA, 25 bp, Rattus norvegicus
ccattgatggtgacttccaacttat

SEQ ID NO: 246969 - DNA, 25 bp, Rattus norvegicus
ccattgatggtgtcttccaacttat

SEQ ID NO: 246970 - DNA, 25 bp, Rattus norvegicus
ccattgattacactgggtgcccagt

SEQ ID NO: 246971 - DNA, 25 bp, Rattus norvegicus
ccattgattacagtgggtgcccagt

SEQ ID NO: 246972 - DNA, 25 bp, Rattus norvegicus
ccattgatttcaaaggccactgatc

SEQ ID NO: 246973 - DNA, 25 bp, Rattus norvegicus
ccattgatttcataggccactgatc

SEQ ID NO: 246974 - DNA, 25 bp, Rattus norvegicus
ccattgccatggctgggacattcaa

SEQ ID NO: 246975 - DNA, 25 bp, Rattus norvegicus
ccattgccatgggtgggacattcaa

SEQ ID NO: 246976 - DNA, 25 bp, Rattus norvegicus
ccattgccctctaaagaagccagaa

SEQ ID NO: 246977 - DNA, 25 bp, Rattus norvegicus
ccattgccctcttaagaagccagaa

SEQ ID NO: 246978 - DNA, 25 bp, Rattus norvegicus
ccattgcgtctcctgactgtaagaa

SEQ ID NO: 246979 - DNA, 25 bp, Rattus norvegicus
ccattgcgtctcgtgactgtaagaa

SEQ ID NO: 246980 - DNA, 25 bp, Rattus norvegicus
ccattgctaggcaaattgggaccaa

SEQ ID NO: 246981 - DNA, 25 bp, Rattus norvegicus
ccattgctaggctaattgggaccaa

SEQ ID NO: 246982 - DNA, 25 bp, Rattus norvegicus
ccattgctcctgcttactgtagaat

SEQ ID NO: 246983 - DNA, 25 bp, Rattus norvegicus
ccattgctcctggttactgtagaat

SEQ ID NO: 246984 - DNA, 25 bp, Rattus norvegicus
ccattgctgtctagtttgcggtagt

SEQ ID NO: 246985 - DNA, 25 bp, Rattus norvegicus
ccattgctgtcttgtttgcggtagt

SEQ ID NO: 246986 - DNA, 25 bp, Rattus norvegicus
ccattgcttggtcgactgaagtcac

SEQ ID NO: 246987 - DNA, 25 bp, Rattus norvegicus
ccattgcttggtggactgaagtcac

SEQ ID NO: 246988 - DNA, 25 bp, Rattus norvegicus
ccattggcacttagttaggattatt

SEQ ID NO: 246989 - DNA, 25 bp, Rattus norvegicus
ccattggcactttgttaggattatt

SEQ ID NO: 246990 - DNA, 25 bp, Rattus norvegicus
ccattggcagcaattgactttaaaa

SEQ ID NO: 246991 - DNA, 25 bp, Rattus norvegicus
ccattggcagcatttgactttaaaa

SEQ ID NO: 246992 - DNA, 25 bp, Rattus norvegicus
ccattggcaggcattggcttgttct

SEQ ID NO: 246993 - DNA, 25 bp, Rattus norvegicus
ccattggcaggctttggcttgttct

SEQ ID NO: 246994 - DNA, 25 bp, Rattus norvegicus
ccattggccaaacctctgtgcaata

SEQ ID NO: 246995 - DNA, 25 bp, Rattus norvegicus
ccattggccaaagctctgtgcaata

SEQ ID NO: 246996 - DNA, 25 bp, Rattus norvegicus
ccattggccaggagcgcttccgctg

SEQ ID NO: 246997 - DNA, 25 bp, Rattus norvegicus
ccattggccaggtgcgcttccgctg

SEQ ID NO: 246998 - DNA, 25 bp, Rattus norvegicus
ccattggctctcagcgaggatttaa

SEQ ID NO: 246999 - DNA, 25 bp, Rattus norvegicus
ccattggctctctgcgaggatttaa

SEQ ID NO: 247000 - DNA, 25 bp, Rattus norvegicus
ccattgggatggaaggactctgaat

SEQ ID NO: 247001 - DNA, 25 bp, Rattus norvegicus
ccattgggatggtaggactctgaat

SEQ ID NO: 247002 - DNA, 25 bp, Rattus norvegicus
ccattgggccagcttaatgttttct

SEQ ID NO: 247003 - DNA, 25 bp, Rattus norvegicus
ccattgggccaggttaatgttttct

SEQ ID NO: 247004 - DNA, 25 bp, Rattus norvegicus
ccattgggtctgatatttgtgttgg

SEQ ID NO: 247005 - DNA, 25 bp, Rattus norvegicus
ccattgggtctgttatttgtgttgg

SEQ ID NO: 247006 - DNA, 25 bp, Rattus norvegicus
ccattggtcgtcacctcggcgggag

SEQ ID NO: 247007 - DNA, 25 bp, Rattus norvegicus
ccattggtcgtctcctcggcgggag

SEQ ID NO: 247008 - DNA, 25 bp, Rattus norvegicus
ccattggtctagcaagagggctctt

SEQ ID NO: 247009 - DNA, 25 bp, Rattus norvegicus
ccattggtctaggaagagggctctt

SEQ ID NO: 247010 - DNA, 25 bp, Rattus norvegicus
ccattggtgcatcgaattatggttt

SEQ ID NO: 247011 - DNA, 25 bp, Rattus norvegicus
ccattggtgcatggaattatggttt

SEQ ID NO: 247012 - DNA, 25 bp, Rattus norvegicus
ccattggtttctctagtttcagata

SEQ ID NO: 247013 - DNA, 25 bp, Rattus norvegicus
ccattggtttctgtagtttcagata

SEQ ID NO: 247014 - DNA, 25 bp, Rattus norvegicus
ccattgtactttctcacttgacttt

SEQ ID NO: 247015 - DNA, 25 bp, Rattus norvegicus
ccattgtactttgtcacttgacttt

SEQ ID NO: 247016 - DNA, 25 bp, Rattus norvegicus
ccattgtcactgataggcttgctta

SEQ ID NO: 247017 - DNA, 25 bp, Rattus norvegicus
ccattgtcactgctgttataattta

SEQ ID NO: 247018 - DNA, 25 bp, Rattus norvegicus
ccattgtcactggtgttataattta

SEQ ID NO: 247019 - DNA, 25 bp, Rattus norvegicus
ccattgtcactgttaggcttgctta

SEQ ID NO: 247020 - DNA, 25 bp, Rattus norvegicus
ccattgtcccctactatttctaaat

SEQ ID NO: 247021 - DNA, 25 bp, Rattus norvegicus
ccattgtccccttctatttctaaat

SEQ ID NO: 247022 - DNA, 25 bp, Rattus norvegicus
ccattgtggaggcactcagtggcaa

SEQ ID NO: 247023 - DNA, 25 bp, Rattus norvegicus
ccattgtggagggactcagtggcaa

SEQ ID NO: 247024 - DNA, 25 bp, Rattus norvegicus
ccattgtgtttcctgcgtgccttaa

SEQ ID NO: 247025 - DNA, 25 bp, Rattus norvegicus
ccattgtgtttcgtgcgtgccttaa

SEQ ID NO: 247026 - DNA, 25 bp, Rattus norvegicus
ccattgttctctcaggagggcatca

SEQ ID NO: 247027 - DNA, 25 bp, Rattus norvegicus
ccattgttctctgaggagggcatca

SEQ ID NO: 247028 - DNA, 25 bp, Rattus norvegicus
ccattgttgggactttctgtaccgc

SEQ ID NO: 247029 - DNA, 25 bp, Rattus norvegicus
ccattgttgggagtttctgtaccgc

SEQ ID NO: 247030 - DNA, 25 bp, Rattus norvegicus
ccattgttgtctcgctggagaatca

SEQ ID NO: 247031 - DNA, 25 bp, Rattus norvegicus
ccattgttgtctggctggagaatca

SEQ ID NO: 247032 - DNA, 25 bp, Rattus norvegicus
ccattgtttattaatagccactctc

SEQ ID NO: 247033 - DNA, 25 bp, Rattus norvegicus
ccattgtttatttatagccactctc

SEQ ID NO: 247034 - DNA, 25 bp, Rattus norvegicus
ccattgtttcttccgacttgtgtct

SEQ ID NO: 247035 - DNA, 25 bp, Rattus norvegicus
ccattgtttcttgcgacttgtgtct

SEQ ID NO: 247036 - DNA, 25 bp, Rattus norvegicus
ccatttagaactccgccggaactca

SEQ ID NO: 247037 - DNA, 25 bp, Rattus norvegicus
ccatttagaactgcgccggaactca

SEQ ID NO: 247038 - DNA, 25 bp, Rattus norvegicus
ccatttagctggcttgtgatttctc

SEQ ID NO: 247039 - DNA, 25 bp, Rattus norvegicus
ccatttagctgggttgtgatttctc

SEQ ID NO: 247040 - DNA, 25 bp, Rattus norvegicus
ccatttaggcctcgcttgacagaag

SEQ ID NO: 247041 - DNA, 25 bp, Rattus norvegicus
ccatttaggcctggcttgacagaag

SEQ ID NO: 247042 - DNA, 25 bp, Rattus norvegicus
ccatttagtattagcatctctgata

SEQ ID NO: 247043 - DNA, 25 bp, Rattus norvegicus
ccatttagtatttgcatctctgata

SEQ ID NO: 247044 - DNA, 25 bp, Rattus norvegicus
ccatttatggagactcagtctctga

SEQ ID NO: 247045 - DNA, 25 bp, Rattus norvegicus
ccatttatggagtctcagtctctga

SEQ ID NO: 247046 - DNA, 25 bp, Rattus norvegicus
ccatttatgttaccccctgttgcag

SEQ ID NO: 247047 - DNA, 25 bp, Rattus norvegicus
ccatttatgttagcccctgttgcag

SEQ ID NO: 247048 - DNA, 25 bp, Rattus norvegicus
ccatttcaagttatcgtgtgtgtgt

SEQ ID NO: 247049 - DNA, 25 bp, Rattus norvegicus
ccatttcaagttatctgtctctgct

SEQ ID NO: 247050 - DNA, 25 bp, Rattus norvegicus
ccatttcaagttttcgtgtgtgtgt

SEQ ID NO: 247051 - DNA, 25 bp, Rattus norvegicus
ccatttcaagttttctgtctctgct

SEQ ID NO: 247052 - DNA, 25 bp, Rattus norvegicus
ccatttcaccatacagtcctgagag

SEQ ID NO: 247053 - DNA, 25 bp, Rattus norvegicus
ccatttcaccattcagtcctgagag

SEQ ID NO: 247054 - DNA, 25 bp, Rattus norvegicus
ccatttcagttcagcttcttgcaaa

SEQ ID NO: 247055 - DNA, 25 bp, Rattus norvegicus
ccatttcagttctgcttcttgcaaa

SEQ ID NO: 247056 - DNA, 25 bp, Rattus norvegicus
ccatttcccagtctttgtgttttga

SEQ ID NO: 247057 - DNA, 25 bp, Rattus norvegicus
ccatttcccagtgtttgtgttttga

SEQ ID NO: 247058 - DNA, 25 bp, Rattus norvegicus
ccatttccctttacaggtgacgaga

SEQ ID NO: 247059 - DNA, 25 bp, Rattus norvegicus
ccatttcccttttcaggtgacgaga

SEQ ID NO: 247060 - DNA, 25 bp, Rattus norvegicus
ccatttcctatgactactccagtaa

SEQ ID NO: 247061 - DNA, 25 bp, Rattus norvegicus
ccatttcctatgtctactccagtaa

SEQ ID NO: 247062 - DNA, 25 bp, Rattus norvegicus
ccatttcctctgcaacttgaggctg

SEQ ID NO: 247063 - DNA, 25 bp, Rattus norvegicus
ccatttcctctggaacttgaggctg

SEQ ID NO: 247064 - DNA, 25 bp, Rattus norvegicus
ccatttctcaggctagggcagagga

SEQ ID NO: 247065 - DNA, 25 bp, Rattus norvegicus
ccatttctcagggtagggcagagga

SEQ ID NO: 247066 - DNA, 25 bp, Rattus norvegicus
ccatttctctcaccttgaaagactc

SEQ ID NO: 247067 - DNA, 25 bp, Rattus norvegicus
ccatttctctcagcttgaaagactc

SEQ ID NO: 247068 - DNA, 25 bp, Rattus norvegicus
ccatttctctgcctaggagggtcta

SEQ ID NO: 247069 - DNA, 25 bp, Rattus norvegicus
ccatttctctgcgtaggagggtcta

SEQ ID NO: 247070 - DNA, 25 bp, Rattus norvegicus
ccatttctctggaccttgttttatt

SEQ ID NO: 247071 - DNA, 25 bp, Rattus norvegicus
ccatttctctggtccttgttttatt

SEQ ID NO: 247072 - DNA, 25 bp, Rattus norvegicus
ccatttcttttaatctccctgagcc

SEQ ID NO: 247073 - DNA, 25 bp, Rattus norvegicus
ccatttcttttattctccctgagcc

SEQ ID NO: 247074 - DNA, 25 bp, Rattus norvegicus
ccatttgatcccactcagtgggaaa

SEQ ID NO: 247075 - DNA, 25 bp, Rattus norvegicus
ccatttgatccctctcagtgggaaa

SEQ ID NO: 247076 - DNA, 25 bp, Rattus norvegicus
ccatttgccctgacagctggtctga

SEQ ID NO: 247077 - DNA, 25 bp, Rattus norvegicus
ccatttgccctgtcagctggtctga

SEQ ID NO: 247078 - DNA, 25 bp, Rattus norvegicus
ccatttggctgtccagagatgacca

SEQ ID NO: 247079 - DNA, 25 bp, Rattus norvegicus
ccatttggctgtgcagagatgacca

SEQ ID NO: 247080 - DNA, 25 bp, Rattus norvegicus
ccatttgggaggatgacacttgctt

SEQ ID NO: 247081 - DNA, 25 bp, Rattus norvegicus
ccatttgggaggttgacacttgctt

SEQ ID NO: 247082 - DNA, 25 bp, Rattus norvegicus
ccatttggtgccaacatacagtgaa

SEQ ID NO: 247083 - DNA, 25 bp, Rattus norvegicus
ccatttggtgcctacatacagtgaa

SEQ ID NO: 247084 - DNA, 25 bp, Rattus norvegicus
ccatttgtcatgatttccctattcc

SEQ ID NO: 247085 - DNA, 25 bp, Rattus norvegicus
ccatttgtcatgttttccctattcc

SEQ ID NO: 247086 - DNA, 25 bp, Rattus norvegicus
ccatttgtgtggaacgactgcagaa

SEQ ID NO: 247087 - DNA, 25 bp, Rattus norvegicus
ccatttgtgtggtacgactgcagaa

SEQ ID NO: 247088 - DNA, 25 bp, Rattus norvegicus
ccatttgttacaaaactgaggaaag

SEQ ID NO: 247089 - DNA, 25 bp, Rattus norvegicus
ccatttgttacataactgaggaaag

SEQ ID NO: 247090 - DNA, 25 bp, Rattus norvegicus
ccatttgttattaggcagttgctga

SEQ ID NO: 247091 - DNA, 25 bp, Rattus norvegicus
ccatttgttatttggcagttgctga

SEQ ID NO: 247092 - DNA, 25 bp, Rattus norvegicus
ccattttaagagagaagagccagac

SEQ ID NO: 247093 - DNA, 25 bp, Rattus norvegicus
ccattttaagagtgaagagccagac

SEQ ID NO: 247094 - DNA, 25 bp, Rattus norvegicus
ccattttattcccaacctagtcatt

SEQ ID NO: 247095 - DNA, 25 bp, Rattus norvegicus
ccattttattccgaacctagtcatt

SEQ ID NO: 247096 - DNA, 25 bp, Rattus norvegicus
ccattttattctcggcgtccatctt

SEQ ID NO: 247097 - DNA, 25 bp, Rattus norvegicus
ccattttattctgggcgtccatctt

SEQ ID NO: 247098 - DNA, 25 bp, Rattus norvegicus
ccattttccactcacttatcttaaa

SEQ ID NO: 247099 - DNA, 25 bp, Rattus norvegicus
ccattttccactgacttatcttaaa

SEQ ID NO: 247100 - DNA, 25 bp, Rattus norvegicus
ccattttcctgcatctgtatttcaa

SEQ ID NO: 247101 - DNA, 25 bp, Rattus norvegicus
ccattttcctgcttctgtatttcaa

SEQ ID NO: 247102 - DNA, 25 bp, Rattus norvegicus
ccattttccttcaacgtgctacaga

SEQ ID NO: 247103 - DNA, 25 bp, Rattus norvegicus
ccattttccttctacgtgctacaga

SEQ ID NO: 247104 - DNA, 25 bp, Rattus norvegicus
ccattttgcatgaccctgttgaata

SEQ ID NO: 247105 - DNA, 25 bp, Rattus norvegicus
ccattttgcatgtccctgttgaata

SEQ ID NO: 247106 - DNA, 25 bp, Rattus norvegicus
ccattttgctctacagtcttaagtg

SEQ ID NO: 247107 - DNA, 25 bp, Rattus norvegicus
ccattttgctcttcagtcttaagtg

SEQ ID NO: 247108 - DNA, 25 bp, Rattus norvegicus
ccattttgtttcagagtccatctat

SEQ ID NO: 247109 - DNA, 25 bp, Rattus norvegicus
ccattttgtttctgagtccatctat

SEQ ID NO: 247110 - DNA, 25 bp, Rattus norvegicus
cccaaaagttgtactgtagtcctca

SEQ ID NO: 247111 - DNA, 25 bp, Rattus norvegicus
cccaaaagttgttctgtagtcctca

SEQ ID NO: 247112 - DNA, 25 bp, Rattus norvegicus
cccaaacatttcacttcacacataa

SEQ ID NO: 247113 - DNA, 25 bp, Rattus norvegicus
cccaaacatttctcttcacacataa

SEQ ID NO: 247114 - DNA, 25 bp, Rattus norvegicus
cccaaaccctgactgtaggctgtaa

SEQ ID NO: 247115 - DNA, 25 bp, Rattus norvegicus
cccaaaccctgagtgtaggctgtaa

SEQ ID NO: 247116 - DNA, 25 bp, Rattus norvegicus
cccaaacctgagcaggcctgaggat

SEQ ID NO: 247117 - DNA, 25 bp, Rattus norvegicus
cccaaacctgaggaggcctgaggat

SEQ ID NO: 247118 - DNA, 25 bp, Rattus norvegicus
cccaaactaatcagcccaggcggat

SEQ ID NO: 247119 - DNA, 25 bp, Rattus norvegicus
cccaaactaatctgcccaggcggat

SEQ ID NO: 247120 - DNA, 25 bp, Rattus norvegicus
cccaaactccttccagaatttcata

SEQ ID NO: 247121 - DNA, 25 bp, Rattus norvegicus
cccaaactccttgcagaatttcata

SEQ ID NO: 247122 - DNA, 25 bp, Rattus norvegicus
cccaaacttcagacaagaacatgaa

SEQ ID NO: 247123 - DNA, 25 bp, Rattus norvegicus
cccaaacttcagtcaagaacatgaa

SEQ ID NO: 247124 - DNA, 25 bp, Rattus norvegicus
cccaaagaacttctcttcctgatgg

SEQ ID NO: 247125 - DNA, 25 bp, Rattus norvegicus
cccaaagaacttgtcttcctgatgg

SEQ ID NO: 247126 - DNA, 25 bp, Rattus norvegicus
cccaaagaatccaacagtgtccagc

SEQ ID NO: 247127 - DNA, 25 bp, Rattus norvegicus
cccaaagaatcctacagtgtccagc

SEQ ID NO: 247128 - DNA, 25 bp, Rattus norvegicus
cccaaagcgtccctgttgtagttga

SEQ ID NO: 247129 - DNA, 25 bp, Rattus norvegicus
cccaaagcgtccgtgttgtagttga

SEQ ID NO: 247130 - DNA, 25 bp, Rattus norvegicus
cccaaagtctgtctctggaattgag

SEQ ID NO: 247131 - DNA, 25 bp, Rattus norvegicus
cccaaagtctgtgtctggaattgag

SEQ ID NO: 247132 - DNA, 25 bp, Rattus norvegicus
cccaaagtcttcagccgtgcaaaga

SEQ ID NO: 247133 - DNA, 25 bp, Rattus norvegicus
cccaaagtcttctgccgtgcaaaga

SEQ ID NO: 247134 - DNA, 25 bp, Rattus norvegicus
cccaaagtgcttagtagattaacac

SEQ ID NO: 247135 - DNA, 25 bp, Rattus norvegicus
cccaaagtgctttgtagattaacac

SEQ ID NO: 247136 - DNA, 25 bp, Rattus norvegicus
cccaaatcttggacttaggcagtgt

SEQ ID NO: 247137 - DNA, 25 bp, Rattus norvegicus
cccaaatcttggtcttaggcagtgt

SEQ ID NO: 247138 - DNA, 25 bp, Rattus norvegicus
cccaaatgccagaatttcaaccagg

SEQ ID NO: 247139 - DNA, 25 bp, Rattus norvegicus
cccaaatgccagtatttcaaccagg

SEQ ID NO: 247140 - DNA, 25 bp, Rattus norvegicus
cccaaatgtcttacactctcaataa

SEQ ID NO: 247141 - DNA, 25 bp, Rattus norvegicus
cccaaatgtctttcactctcaataa

SEQ ID NO: 247142 - DNA, 25 bp, Rattus norvegicus
cccaaatgtttgcaactccagttcc

SEQ ID NO: 247143 - DNA, 25 bp, Rattus norvegicus
cccaaatgtttggaactccagttcc

SEQ ID NO: 247144 - DNA, 25 bp, Rattus norvegicus
cccaacagttggaggacgcgtgcac

SEQ ID NO: 247145 - DNA, 25 bp, Rattus norvegicus
cccaacagttggtggacgcgtgcac

SEQ ID NO: 247146 - DNA, 25 bp, Rattus norvegicus
cccaaccaaagcaccgaaagaatgt

SEQ ID NO: 247147 - DNA, 25 bp, Rattus norvegicus
cccaaccaaagctccgaaagaatgt

SEQ ID NO: 247148 - DNA, 25 bp, Rattus norvegicus
cccaaccaacttactcaacaatatt

SEQ ID NO: 247149 - DNA, 25 bp, Rattus norvegicus
cccaaccaactttctcaacaatatt

SEQ ID NO: 247150 - DNA, 25 bp, Rattus norvegicus
cccaaccatcacctctttgaattaa

SEQ ID NO: 247151 - DNA, 25 bp, Rattus norvegicus
cccaaccatcacgtctttgaattaa

SEQ ID NO: 247152 - DNA, 25 bp, Rattus norvegicus
cccaacccatcaagtttacagggtt

SEQ ID NO: 247153 - DNA, 25 bp, Rattus norvegicus
cccaacccatcatgtttacagggtt

SEQ ID NO: 247154 - DNA, 25 bp, Rattus norvegicus
cccaaccccagcacagaaataggaa

SEQ ID NO: 247155 - DNA, 25 bp, Rattus norvegicus
cccaaccccagctcagaaataggaa

SEQ ID NO: 247156 - DNA, 25 bp, Rattus norvegicus
cccaaccccataagcgtacatttta

SEQ ID NO: 247157 - DNA, 25 bp, Rattus norvegicus
cccaaccccatatgcgtacatttta

SEQ ID NO: 247158 - DNA, 25 bp, Rattus norvegicus
cccaacctcattcttattttttcat

SEQ ID NO: 247159 - DNA, 25 bp, Rattus norvegicus
cccaacctcattgttattttttcat

SEQ ID NO: 247160 - DNA, 25 bp, Rattus norvegicus
cccaacctgttcaaggtgacctaga

SEQ ID NO: 247161 - DNA, 25 bp, Rattus norvegicus
cccaacctgttctaggtgacctaga

SEQ ID NO: 247162 - DNA, 25 bp, Rattus norvegicus
cccaacctttcacttaccataagag

SEQ ID NO: 247163 - DNA, 25 bp, Rattus norvegicus
cccaacctttcagttaccataagag

SEQ ID NO: 247164 - DNA, 25 bp, Rattus norvegicus
cccaacgcttttaggcagagtgagt

SEQ ID NO: 247165 - DNA, 25 bp, Rattus norvegicus
cccaacgctttttggcagagtgagt

SEQ ID NO: 247166 - DNA, 25 bp, Rattus norvegicus
cccaactaccgcctgcatgtggatg

SEQ ID NO: 247167 - DNA, 25 bp, Rattus norvegicus
cccaactaccgcgtgcatgtggatg

SEQ ID NO: 247168 - DNA, 25 bp, Rattus norvegicus
cccaactattacactggtctccagt

SEQ ID NO: 247169 - DNA, 25 bp, Rattus norvegicus
cccaactattactctggtctccagt

SEQ ID NO: 247170 - DNA, 25 bp, Rattus norvegicus
cccaactctgttcccttgtggaaga

SEQ ID NO: 247171 - DNA, 25 bp, Rattus norvegicus
cccaactctgttgccttgtggaaga

SEQ ID NO: 247172 - DNA, 25 bp, Rattus norvegicus
cccaacttccctctgtagatatata

SEQ ID NO: 247173 - DNA, 25 bp, Rattus norvegicus
cccaacttccctgtgtagatatata

SEQ ID NO: 247174 - DNA, 25 bp, Rattus norvegicus
cccaacttctctcagttattgatta

SEQ ID NO: 247175 - DNA, 25 bp, Rattus norvegicus
cccaacttctctgagttattgatta

SEQ ID NO: 247176 - DNA, 25 bp, Rattus norvegicus
cccaactttttcctaataactgcat

SEQ ID NO: 247177 - DNA, 25 bp, Rattus norvegicus
cccaactttttcgtaataactgcat

SEQ ID NO: 247178 - DNA, 25 bp, Rattus norvegicus
cccaagaacggcagcgagcgcgtga

SEQ ID NO: 247179 - DNA, 25 bp, Rattus norvegicus
cccaagaacggctgcgagcgcgtga

SEQ ID NO: 247180 - DNA, 25 bp, Rattus norvegicus
cccaagacagagatgtgagcgaact

SEQ ID NO: 247181 - DNA, 25 bp, Rattus norvegicus
cccaagacagagttgtgagcgaact

SEQ ID NO: 247182 - DNA, 25 bp, Rattus norvegicus
cccaagagagggagcattaagaata

SEQ ID NO: 247183 - DNA, 25 bp, Rattus norvegicus
cccaagagagggtgcattaagaata

SEQ ID NO: 247184 - DNA, 25 bp, Rattus norvegicus
cccaagagccttatgatagagggac

SEQ ID NO: 247185 - DNA, 25 bp, Rattus norvegicus
cccaagagccttttgatagagggac

SEQ ID NO: 247186 - DNA, 25 bp, Rattus norvegicus
cccaagagtaccagtcatgtgctat

SEQ ID NO: 247187 - DNA, 25 bp, Rattus norvegicus
cccaagagtacctgtcatgtgctat

SEQ ID NO: 247188 - DNA, 25 bp, Rattus norvegicus
cccaagatcctaagtgtctccaaga

SEQ ID NO: 247189 - DNA, 25 bp, Rattus norvegicus
cccaagatcctatgtgtctccaaga

SEQ ID NO: 247190 - DNA, 25 bp, Rattus norvegicus
cccaagattcttcaactcgcagatc

SEQ ID NO: 247191 - DNA, 25 bp, Rattus norvegicus
cccaagattcttgaactcgcagatc

SEQ ID NO: 247192 - DNA, 25 bp, Rattus norvegicus
cccaagcaggccaagcgagcgaaga

SEQ ID NO: 247193 - DNA, 25 bp, Rattus norvegicus
cccaagcaggcctagcgagcgaaga

SEQ ID NO: 247194 - DNA, 25 bp, Rattus norvegicus
cccaagcctcagcagactggaaggt

SEQ ID NO: 247195 - DNA, 25 bp, Rattus norvegicus
cccaagcctcaggagactggaaggt

SEQ ID NO: 247196 - DNA, 25 bp, Rattus norvegicus
cccaagcctccacattgattttttc

SEQ ID NO: 247197 - DNA, 25 bp, Rattus norvegicus
cccaagcctccagattgattttttc

SEQ ID NO: 247198 - DNA, 25 bp, Rattus norvegicus
cccaagcggctactatcctagaaaa

SEQ ID NO: 247199 - DNA, 25 bp, Rattus norvegicus
cccaagcggctagtatcctagaaaa

SEQ ID NO: 247200 - DNA, 25 bp, Rattus norvegicus
cccaagcttccacgcatgcatttaa

SEQ ID NO: 247201 - DNA, 25 bp, Rattus norvegicus
cccaagcttccaggcatgcatttaa

SEQ ID NO: 247202 - DNA, 25 bp, Rattus norvegicus
cccaagcttctgactacacaagtta

SEQ ID NO: 247203 - DNA, 25 bp, Rattus norvegicus
cccaagcttctgtctacacaagtta

SEQ ID NO: 247204 - DNA, 25 bp, Rattus norvegicus
cccaaggccggacactttgcttcgg

SEQ ID NO: 247205 - DNA, 25 bp, Rattus norvegicus
cccaaggccggagactttgcttcgg

SEQ ID NO: 247206 - DNA, 25 bp, Rattus norvegicus
cccaaggctgcaaaaccataggtgt

SEQ ID NO: 247207 - DNA, 25 bp, Rattus norvegicus
cccaaggctgcataaccataggtgt

SEQ ID NO: 247208 - DNA, 25 bp, Rattus norvegicus
cccaagggcggacgcatttgtgttc

SEQ ID NO: 247209 - DNA, 25 bp, Rattus norvegicus
cccaagggcggaggcatttgtgttc

SEQ ID NO: 247210 - DNA, 25 bp, Rattus norvegicus
cccaaggtcatgagctggaatggca

SEQ ID NO: 247211 - DNA, 25 bp, Rattus norvegicus
cccaaggtcatgtgctggaatggca

SEQ ID NO: 247212 - DNA, 25 bp, Rattus norvegicus
cccaagtatttgacatgtgtgtatt

SEQ ID NO: 247213 - DNA, 25 bp, Rattus norvegicus
cccaagtatttgtcatgtgtgtatt

SEQ ID NO: 247214 - DNA, 25 bp, Rattus norvegicus
cccaagtccaaaagcctgtgtcaga

SEQ ID NO: 247215 - DNA, 25 bp, Rattus norvegicus
cccaagtccaaatgcctgtgtcaga

SEQ ID NO: 247216 - DNA, 25 bp, Rattus norvegicus
cccaagtccaagacttacggtgcaa

SEQ ID NO: 247217 - DNA, 25 bp, Rattus norvegicus
cccaagtccaagtcttacggtgcaa

SEQ ID NO: 247218 - DNA, 25 bp, Rattus norvegicus
cccaagtgccttagctgtttttata

SEQ ID NO: 247219 - DNA, 25 bp, Rattus norvegicus
cccaagtgcctttgctgtttttata

SEQ ID NO: 247220 - DNA, 25 bp, Rattus norvegicus
cccaagtggctcagtgtctatttta

SEQ ID NO: 247221 - DNA, 25 bp, Rattus norvegicus
cccaagtggctctgtgtctatttta

SEQ ID NO: 247222 - DNA, 25 bp, Rattus norvegicus
cccaagttctggactcttctgaaaa

SEQ ID NO: 247223 - DNA, 25 bp, Rattus norvegicus
cccaagttctggtctcttctgaaaa

SEQ ID NO: 247224 - DNA, 25 bp, Rattus norvegicus
cccaatacggtccatgaagctgtga

SEQ ID NO: 247225 - DNA, 25 bp, Rattus norvegicus
cccaatacggtcgatgaagctgtga

SEQ ID NO: 247226 - DNA, 25 bp, Rattus norvegicus
cccaatcccgacaaaatcatttctt

SEQ ID NO: 247227 - DNA, 25 bp, Rattus norvegicus
cccaatcccgactaaatcatttctt

SEQ ID NO: 247228 - DNA, 25 bp, Rattus norvegicus
cccaatctcacaataaattcagggt

SEQ ID NO: 247229 - DNA, 25 bp, Rattus norvegicus
cccaatctcacattaaattcagggt

SEQ ID NO: 247230 - DNA, 25 bp, Rattus norvegicus
cccaatgagaggaaggctactgctg

SEQ ID NO: 247231 - DNA, 25 bp, Rattus norvegicus
cccaatgagaggtaggctactgctg

SEQ ID NO: 247232 - DNA, 25 bp, Rattus norvegicus
cccaatgaggtgatttccaaagtag

SEQ ID NO: 247233 - DNA, 25 bp, Rattus norvegicus
cccaatgaggtgttttccaaagtag

SEQ ID NO: 247234 - DNA, 25 bp, Rattus norvegicus
cccaatgcccttagacgggtgaata

SEQ ID NO: 247235 - DNA, 25 bp, Rattus norvegicus
cccaatgccctttgacgggtgaata

SEQ ID NO: 247236 - DNA, 25 bp, Rattus norvegicus
cccaatggtattcctactggccaca

SEQ ID NO: 247237 - DNA, 25 bp, Rattus norvegicus
cccaatggtattgctactggccaca

SEQ ID NO: 247238 - DNA, 25 bp, Rattus norvegicus
cccaatgtatcccttgtggatctga

SEQ ID NO: 247239 - DNA, 25 bp, Rattus norvegicus
cccaatgtatccgttgtggatctga

SEQ ID NO: 247240 - DNA, 25 bp, Rattus norvegicus
cccaatgtcaagattttaccctgca

SEQ ID NO: 247241 - DNA, 25 bp, Rattus norvegicus
cccaatgtcaagtttttaccctgca

SEQ ID NO: 247242 - DNA, 25 bp, Rattus norvegicus
cccaatgtcacaactggtctacaga

SEQ ID NO: 247243 - DNA, 25 bp, Rattus norvegicus
cccaatgtcacatctggtctacaga

SEQ ID NO: 247244 - DNA, 25 bp, Rattus norvegicus
cccaatgtggagatgtgccgggaca

SEQ ID NO: 247245 - DNA, 25 bp, Rattus norvegicus
cccaatgtggagttgtgccgggaca

SEQ ID NO: 247246 - DNA, 25 bp, Rattus norvegicus
cccaattattgccagttaacttaga

SEQ ID NO: 247247 - DNA, 25 bp, Rattus norvegicus
cccaattattgcgagttaacttaga

SEQ ID NO: 247248 - DNA, 25 bp, Rattus norvegicus
cccaattccaggacgcttgaaagtc

SEQ ID NO: 247249 - DNA, 25 bp, Rattus norvegicus
cccaattccaggtcgcttgaaagtc

SEQ ID NO: 247250 - DNA, 25 bp, Rattus norvegicus
cccaattcttctcacaactgcaaaa

SEQ ID NO: 247251 - DNA, 25 bp, Rattus norvegicus
cccaattcttctgacaactgcaaaa

SEQ ID NO: 247252 - DNA, 25 bp, Rattus norvegicus
cccaattgtaggctcatggccaagg

SEQ ID NO: 247253 - DNA, 25 bp, Rattus norvegicus
cccaattgtagggtcatggccaagg

SEQ ID NO: 247254 - DNA, 25 bp, Rattus norvegicus
cccacaagtggcacacaactgagga

SEQ ID NO: 247255 - DNA, 25 bp, Rattus norvegicus
cccacaagtggctcacaactgagga

SEQ ID NO: 247256 - DNA, 25 bp, Rattus norvegicus
cccacacaatctcagcaatcttaaa

SEQ ID NO: 247257 - DNA, 25 bp, Rattus norvegicus
cccacacaatctgagcaatcttaaa

SEQ ID NO: 247258 - DNA, 25 bp, Rattus norvegicus
cccacacagcaaatacaccatgaat

SEQ ID NO: 247259 - DNA, 25 bp, Rattus norvegicus
cccacacagcaattacaccatgaat

SEQ ID NO: 247260 - DNA, 25 bp, Rattus norvegicus
cccacacaggacaagcttggctgag

SEQ ID NO: 247261 - DNA, 25 bp, Rattus norvegicus
cccacacaggactagcttggctgag

SEQ ID NO: 247262 - DNA, 25 bp, Rattus norvegicus
cccacacagtggctgatctgagtca

SEQ ID NO: 247263 - DNA, 25 bp, Rattus norvegicus
cccacacagtgggtgatctgagtca

SEQ ID NO: 247264 - DNA, 25 bp, Rattus norvegicus
cccacacatgccaatgagggtcaag

SEQ ID NO: 247265 - DNA, 25 bp, Rattus norvegicus
cccacacatgcctatgagggtcaag

SEQ ID NO: 247266 - DNA, 25 bp, Rattus norvegicus
cccacaccaaagaccttactagatt

SEQ ID NO: 247267 - DNA, 25 bp, Rattus norvegicus
cccacaccaaagtccttactagatt

SEQ ID NO: 247268 - DNA, 25 bp, Rattus norvegicus
cccacaccagccattgtaactaatg

SEQ ID NO: 247269 - DNA, 25 bp, Rattus norvegicus
cccacaccagcctttgtaactaatg

SEQ ID NO: 247270 - DNA, 25 bp, Rattus norvegicus
cccacaccatatctctgtacattta

SEQ ID NO: 247271 - DNA, 25 bp, Rattus norvegicus
cccacaccatatgtctgtacattta

SEQ ID NO: 247272 - DNA, 25 bp, Rattus norvegicus
cccacaccctacatagtacttgaaa

SEQ ID NO: 247273 - DNA, 25 bp, Rattus norvegicus
cccacaccctacttagtacttgaaa

SEQ ID NO: 247274 - DNA, 25 bp, Rattus norvegicus
cccacaccctccaggtaataaagat

SEQ ID NO: 247275 - DNA, 25 bp, Rattus norvegicus
cccacaccctcctggtaataaagat

SEQ ID NO: 247276 - DNA, 25 bp, Rattus norvegicus
cccacaccctggaggctagaggaga

SEQ ID NO: 247277 - DNA, 25 bp, Rattus norvegicus
cccacaccctggtggctagaggaga

SEQ ID NO: 247278 - DNA, 25 bp, Rattus norvegicus
cccacacgtgacctcggaggtgagg

SEQ ID NO: 247279 - DNA, 25 bp, Rattus norvegicus
cccacacgtgacgtcggaggtgagg

SEQ ID NO: 247280 - DNA, 25 bp, Rattus norvegicus
cccacactgtacacggcgttttaat

SEQ ID NO: 247281 - DNA, 25 bp, Rattus norvegicus
cccacactgtactcggcgttttaat

SEQ ID NO: 247282 - DNA, 25 bp, Rattus norvegicus
cccacacttggcaagggagggcaga

SEQ ID NO: 247283 - DNA, 25 bp, Rattus norvegicus
cccacacttggctagggagggcaga

SEQ ID NO: 247284 - DNA, 25 bp, Rattus norvegicus
cccacagactctattgatactgaag

SEQ ID NO: 247285 - DNA, 25 bp, Rattus norvegicus
cccacagactcttttgatactgaag

SEQ ID NO: 247286 - DNA, 25 bp, Rattus norvegicus
cccacagaggtgcttagtgcctaaa

SEQ ID NO: 247287 - DNA, 25 bp, Rattus norvegicus
cccacagaggtggttagtgcctaaa

SEQ ID NO: 247288 - DNA, 25 bp, Rattus norvegicus
cccacagatcagatttggtcctgaa

SEQ ID NO: 247289 - DNA, 25 bp, Rattus norvegicus
cccacagatcagttttggtcctgaa

SEQ ID NO: 247290 - DNA, 25 bp, Rattus norvegicus
cccacagcacctcaagtatctaagt

SEQ ID NO: 247291 - DNA, 25 bp, Rattus norvegicus
cccacagcacctgaagtatctaagt

SEQ ID NO: 247292 - DNA, 25 bp, Rattus norvegicus
cccacagccccaatgtataaacaga

SEQ ID NO: 247293 - DNA, 25 bp, Rattus norvegicus
cccacagccccattgtataaacaga

SEQ ID NO: 247294 - DNA, 25 bp, Rattus norvegicus
cccacaggactgcataggtgtttaa

SEQ ID NO: 247295 - DNA, 25 bp, Rattus norvegicus
cccacaggactggataggtgtttaa

SEQ ID NO: 247296 - DNA, 25 bp, Rattus norvegicus
cccacagtctctaacgggcatgtta

SEQ ID NO: 247297 - DNA, 25 bp, Rattus norvegicus
cccacagtctcttacgggcatgtta

SEQ ID NO: 247298 - DNA, 25 bp, Rattus norvegicus
cccacagtgaggacatgaaggcagt

SEQ ID NO: 247299 - DNA, 25 bp, Rattus norvegicus
cccacagtgaggtcatgaaggcagt

SEQ ID NO: 247300 - DNA, 25 bp, Rattus norvegicus
cccacagtgatgatgtcgagatcgg

SEQ ID NO: 247301 - DNA, 25 bp, Rattus norvegicus
cccacagtgatgttgtcgagatcgg

SEQ ID NO: 247302 - DNA, 25 bp, Rattus norvegicus
cccacagtgtttcaaaggcagcctt

SEQ ID NO: 247303 - DNA, 25 bp, Rattus norvegicus
cccacagtgtttgaaaggcagcctt

SEQ ID NO: 247304 - DNA, 25 bp, Rattus norvegicus
cccacagttctgcattttcttgatt

SEQ ID NO: 247305 - DNA, 25 bp, Rattus norvegicus
cccacagttctggattttcttgatt

SEQ ID NO: 247306 - DNA, 25 bp, Rattus norvegicus
cccacatccttactttctgaatgag

SEQ ID NO: 247307 - DNA, 25 bp, Rattus norvegicus
cccacatccttagtttctgaatgag

SEQ ID NO: 247308 - DNA, 25 bp, Rattus norvegicus
cccacatgccacacacttgaagaaa

SEQ ID NO: 247309 - DNA, 25 bp, Rattus norvegicus
cccacatgccactcacttgaagaaa

SEQ ID NO: 247310 - DNA, 25 bp, Rattus norvegicus
cccacatgcccacagggtgcagatg

SEQ ID NO: 247311 - DNA, 25 bp, Rattus norvegicus
cccacatgcccagagggtgcagatg

SEQ ID NO: 247312 - DNA, 25 bp, Rattus norvegicus
cccacatgctggatggcggaaggca

SEQ ID NO: 247313 - DNA, 25 bp, Rattus norvegicus
cccacatgctggcttctggaatgca

SEQ ID NO: 247314 - DNA, 25 bp, Rattus norvegicus
cccacatgctgggttctggaatgca

SEQ ID NO: 247315 - DNA, 25 bp, Rattus norvegicus
cccacatgctggttggcggaaggca

SEQ ID NO: 247316 - DNA, 25 bp, Rattus norvegicus
cccacatgggtacctccaggtgatg

SEQ ID NO: 247317 - DNA, 25 bp, Rattus norvegicus
cccacatgggtagctccaggtgatg

SEQ ID NO: 247318 - DNA, 25 bp, Rattus norvegicus
cccacattggatcccggtatgttca

SEQ ID NO: 247319 - DNA, 25 bp, Rattus norvegicus
cccacattggatgccggtatgttca

SEQ ID NO: 247320 - DNA, 25 bp, Rattus norvegicus
cccacatttttgaccatcctaatta

SEQ ID NO: 247321 - DNA, 25 bp, Rattus norvegicus
cccacatttttgtccatcctaatta

SEQ ID NO: 247322 - DNA, 25 bp, Rattus norvegicus
cccaccaaaacactcaatggagtct

SEQ ID NO: 247323 - DNA, 25 bp, Rattus norvegicus
cccaccaaaacagtcaatggagtct

SEQ ID NO: 247324 - DNA, 25 bp, Rattus norvegicus
cccaccaaagcaaacactgaatatc

SEQ ID NO: 247325 - DNA, 25 bp, Rattus norvegicus
cccaccaaagcatacactgaatatc

SEQ ID NO: 247326 - DNA, 25 bp, Rattus norvegicus
cccaccacacatacctttgaaataa

SEQ ID NO: 247327 - DNA, 25 bp, Rattus norvegicus
cccaccacacattcctttgaaataa

SEQ ID NO: 247328 - DNA, 25 bp, Rattus norvegicus
cccaccaccctacatattgagttta

SEQ ID NO: 247329 - DNA, 25 bp, Rattus norvegicus
cccaccaccctagatattgagttta

SEQ ID NO: 247330 - DNA, 25 bp, Rattus norvegicus
cccaccacctggagtgtttcagaga

SEQ ID NO: 247331 - DNA, 25 bp, Rattus norvegicus
cccaccacctggtgtgtttcagaga

SEQ ID NO: 247332 - DNA, 25 bp, Rattus norvegicus
cccaccacgaggcactttacagatg

SEQ ID NO: 247333 - DNA, 25 bp, Rattus norvegicus
cccaccacgagggactttacagatg

SEQ ID NO: 247334 - DNA, 25 bp, Rattus norvegicus
cccaccactgtgacagtttttcata

SEQ ID NO: 247335 - DNA, 25 bp, Rattus norvegicus
cccaccactgtgtcagtttttcata

SEQ ID NO: 247336 - DNA, 25 bp, Rattus norvegicus
cccaccacttgtccttgagatgaag

SEQ ID NO: 247337 - DNA, 25 bp, Rattus norvegicus
cccaccacttgtgcttgagatgaag

SEQ ID NO: 247338 - DNA, 25 bp, Rattus norvegicus
cccaccagcctaacgtgtatagaca

SEQ ID NO: 247339 - DNA, 25 bp, Rattus norvegicus
cccaccagcctatcgtgtatagaca

SEQ ID NO: 247340 - DNA, 25 bp, Rattus norvegicus
cccaccagtagaatggatttcactc

SEQ ID NO: 247341 - DNA, 25 bp, Rattus norvegicus
cccaccagtagattggatttcactc

SEQ ID NO: 247342 - DNA, 25 bp, Rattus norvegicus
cccaccagtcagcagcaaacagtgt

SEQ ID NO: 247343 - DNA, 25 bp, Rattus norvegicus
cccaccagtcaggagcaaacagtgt

SEQ ID NO: 247344 - DNA, 25 bp, Rattus norvegicus
cccaccagtgtgagagcgaggccaa

SEQ ID NO: 247345 - DNA, 25 bp, Rattus norvegicus
cccaccagtgtgcttttaataatta

SEQ ID NO: 247346 - DNA, 25 bp, Rattus norvegicus
cccaccagtgtggttttaataatta

SEQ ID NO: 247347 - DNA, 25 bp, Rattus norvegicus
cccaccagtgtgtgagcgaggccaa

SEQ ID NO: 247348 - DNA, 25 bp, Rattus norvegicus
cccaccattatacgctctgtctgga

SEQ ID NO: 247349 - DNA, 25 bp, Rattus norvegicus
cccaccattataggctctgtctgga

SEQ ID NO: 247350 - DNA, 25 bp, Rattus norvegicus
cccaccatttgtcactaccataata

SEQ ID NO: 247351 - DNA, 25 bp, Rattus norvegicus
cccaccatttgtgactaccataata

SEQ ID NO: 247352 - DNA, 25 bp, Rattus norvegicus
cccacccagaggatgctccttgtgt

SEQ ID NO: 247353 - DNA, 25 bp, Rattus norvegicus
cccacccagaggttgctccttgtgt

SEQ ID NO: 247354 - DNA, 25 bp, Rattus norvegicus
cccacccatcagatttctttagaag

SEQ ID NO: 247355 - DNA, 25 bp, Rattus norvegicus
cccacccatcagttttctttagaag

SEQ ID NO: 247356 - DNA, 25 bp, Rattus norvegicus
cccaccccaggactctaaattattg

SEQ ID NO: 247357 - DNA, 25 bp, Rattus norvegicus
cccaccccaggagtctaaattattg

SEQ ID NO: 247358 - DNA, 25 bp, Rattus norvegicus
cccaccccatccagaaaatgaggat

SEQ ID NO: 247359 - DNA, 25 bp, Rattus norvegicus
cccaccccatcctgaaaatgaggat

SEQ ID NO: 247360 - DNA, 25 bp, Rattus norvegicus
cccaccccatggaaagtcttgaaca

SEQ ID NO: 247361 - DNA, 25 bp, Rattus norvegicus
cccaccccatggtaagtcttgaaca

SEQ ID NO: 247362 - DNA, 25 bp, Rattus norvegicus
cccacccctggtatgtgcaaagata

SEQ ID NO: 247363 - DNA, 25 bp, Rattus norvegicus
cccacccctggtttgtgcaaagata

SEQ ID NO: 247364 - DNA, 25 bp, Rattus norvegicus
cccaccctccagaaagaagcaatgt

SEQ ID NO: 247365 - DNA, 25 bp, Rattus norvegicus
cccaccctccagattttatatgagg

SEQ ID NO: 247366 - DNA, 25 bp, Rattus norvegicus
cccaccctccagtaagaagcaatgt

SEQ ID NO: 247367 - DNA, 25 bp, Rattus norvegicus
cccaccctccagtttttatatgagg

SEQ ID NO: 247368 - DNA, 25 bp, Rattus norvegicus
cccaccctgcataatctgtatttta

SEQ ID NO: 247369 - DNA, 25 bp, Rattus norvegicus
cccaccctgcattatctgtatttta

SEQ ID NO: 247370 - DNA, 25 bp, Rattus norvegicus
cccaccctgtggactttgtagaaca

SEQ ID NO: 247371 - DNA, 25 bp, Rattus norvegicus
cccaccctgtggtctttgtagaaca

SEQ ID NO: 247372 - DNA, 25 bp, Rattus norvegicus
cccaccctttgaacggaatatgcac

SEQ ID NO: 247373 - DNA, 25 bp, Rattus norvegicus
cccaccctttgatcggaatatgcac

SEQ ID NO: 247374 - DNA, 25 bp, Rattus norvegicus
cccaccgccatgcatgatgggtgaa

SEQ ID NO: 247375 - DNA, 25 bp, Rattus norvegicus
cccaccgccatggatgatgggtgaa

SEQ ID NO: 247376 - DNA, 25 bp, Rattus norvegicus
cccaccgcgctgctgttgtgaaaat

SEQ ID NO: 247377 - DNA, 25 bp, Rattus norvegicus
cccaccgcgctggtgttgtgaaaat

SEQ ID NO: 247378 - DNA, 25 bp, Rattus norvegicus
cccaccgctgtgattggtttaacaa

SEQ ID NO: 247379 - DNA, 25 bp, Rattus norvegicus
cccaccgctgtgtttggtttaacaa

SEQ ID NO: 247380 - DNA, 25 bp, Rattus norvegicus
cccacctactatatttgtcatcttg

SEQ ID NO: 247381 - DNA, 25 bp, Rattus norvegicus
cccacctactatttttgtcatcttg

SEQ ID NO: 247382 - DNA, 25 bp, Rattus norvegicus
cccacctagcctagtatgtaaacac

SEQ ID NO: 247383 - DNA, 25 bp, Rattus norvegicus
cccacctagccttgtatgtaaacac

SEQ ID NO: 247384 - DNA, 25 bp, Rattus norvegicus
cccacctattggagagattatttac

SEQ ID NO: 247385 - DNA, 25 bp, Rattus norvegicus
cccacctattggtgagattatttac

SEQ ID NO: 247386 - DNA, 25 bp, Rattus norvegicus
cccacctccattacaggaagctgta

SEQ ID NO: 247387 - DNA, 25 bp, Rattus norvegicus
cccacctccatttcaggaagctgta

SEQ ID NO: 247388 - DNA, 25 bp, Rattus norvegicus
cccacctcctaacaagtctggaaag

SEQ ID NO: 247389 - DNA, 25 bp, Rattus norvegicus
cccacctcctaagaagtctggaaag

SEQ ID NO: 247390 - DNA, 25 bp, Rattus norvegicus
cccacctctcataatggactttgtg

SEQ ID NO: 247391 - DNA, 25 bp, Rattus norvegicus
cccacctctcattatggactttgtg

SEQ ID NO: 247392 - DNA, 25 bp, Rattus norvegicus
cccacctgactgagagcggatgact

SEQ ID NO: 247393 - DNA, 25 bp, Rattus norvegicus
cccacctgactgtgagcggatgact

SEQ ID NO: 247394 - DNA, 25 bp, Rattus norvegicus
cccacctgatcacgtggtgaggcct

SEQ ID NO: 247395 - DNA, 25 bp, Rattus norvegicus
cccacctgatcaggtggtgaggcct

SEQ ID NO: 247396 - DNA, 25 bp, Rattus norvegicus
cccacctgcagcacatggagagagg

SEQ ID NO: 247397 - DNA, 25 bp, Rattus norvegicus
cccacctgcagctcatggagagagg

SEQ ID NO: 247398 - DNA, 25 bp, Rattus norvegicus
cccacctgcataatgtacccataat

SEQ ID NO: 247399 - DNA, 25 bp, Rattus norvegicus
cccacctgcatattgtacccataat

SEQ ID NO: 247400 - DNA, 25 bp, Rattus norvegicus
cccacctgccacataaaatgactta

SEQ ID NO: 247401 - DNA, 25 bp, Rattus norvegicus
cccacctgccacttaaaatgactta

SEQ ID NO: 247402 - DNA, 25 bp, Rattus norvegicus
cccacctgcctgataacaggaacaa

SEQ ID NO: 247403 - DNA, 25 bp, Rattus norvegicus
cccacctgcctgttaacaggaacaa

SEQ ID NO: 247404 - DNA, 25 bp, Rattus norvegicus
cccaccttggtcaggcagggatatt

SEQ ID NO: 247405 - DNA, 25 bp, Rattus norvegicus
cccaccttggtctggcagggatatt

SEQ ID NO: 247406 - DNA, 25 bp, Rattus norvegicus
cccacctttaacaggcacggacaat

SEQ ID NO: 247407 - DNA, 25 bp, Rattus norvegicus
cccacctttaactggcacggacaat

SEQ ID NO: 247408 - DNA, 25 bp, Rattus norvegicus
cccacctttttgacttctgaagagc

SEQ ID NO: 247409 - DNA, 25 bp, Rattus norvegicus
cccacctttttgtcttctgaagagc

SEQ ID NO: 247410 - DNA, 25 bp, Rattus norvegicus
cccacgactgttcagccttttaaat

SEQ ID NO: 247411 - DNA, 25 bp, Rattus norvegicus
cccacgactgttgagccttttaaat

SEQ ID NO: 247412 - DNA, 25 bp, Rattus norvegicus
cccacgagatcgatgctgacttaac

SEQ ID NO: 247413 - DNA, 25 bp, Rattus norvegicus
cccacgagatcgttgctgacttaac

SEQ ID NO: 247414 - DNA, 25 bp, Rattus norvegicus
cccacgatctgacagctcaacaaaa

SEQ ID NO: 247415 - DNA, 25 bp, Rattus norvegicus
cccacgatctgagagctcaacaaaa

SEQ ID NO: 247416 - DNA, 25 bp, Rattus norvegicus
cccacgccacagattttgaagcagt

SEQ ID NO: 247417 - DNA, 25 bp, Rattus norvegicus
cccacgccacagtttttgaagcagt

SEQ ID NO: 247418 - DNA, 25 bp, Rattus norvegicus
cccacgcccctaagtgaggattgat

SEQ ID NO: 247419 - DNA, 25 bp, Rattus norvegicus
cccacgcccctatgtgaggattgat

SEQ ID NO: 247420 - DNA, 25 bp, Rattus norvegicus
cccacgcgcgtgctagttttagtgt

SEQ ID NO: 247421 - DNA, 25 bp, Rattus norvegicus
cccacgcgcgtggtagttttagtgt

SEQ ID NO: 247422 - DNA, 25 bp, Rattus norvegicus
cccacggaggtgctgagacatcgaa

SEQ ID NO: 247423 - DNA, 25 bp, Rattus norvegicus
cccacggaggtggtgagacatcgaa

SEQ ID NO: 247424 - DNA, 25 bp, Rattus norvegicus
cccacggagtgcctgatgtgtttat

SEQ ID NO: 247425 - DNA, 25 bp, Rattus norvegicus
cccacggagtgcgtgatgtgtttat

SEQ ID NO: 247426 - DNA, 25 bp, Rattus norvegicus
cccacggcacgcactttagtaagtt

SEQ ID NO: 247427 - DNA, 25 bp, Rattus norvegicus
cccacggcacgctctttagtaagtt

SEQ ID NO: 247428 - DNA, 25 bp, Rattus norvegicus
cccacggctgaaatctcggtgatga

SEQ ID NO: 247429 - DNA, 25 bp, Rattus norvegicus
cccacggctgaattctcggtgatga

SEQ ID NO: 247430 - DNA, 25 bp, Rattus norvegicus
cccacgggtttaaacaatgcgctga

SEQ ID NO: 247431 - DNA, 25 bp, Rattus norvegicus
cccacgggtttatacaatgcgctga

SEQ ID NO: 247432 - DNA, 25 bp, Rattus norvegicus
cccacgtcttggatttgtcagactg

SEQ ID NO: 247433 - DNA, 25 bp, Rattus norvegicus
cccacgtcttggttttgtcagactg

SEQ ID NO: 247434 - DNA, 25 bp, Rattus norvegicus
cccacgtggaggaggtcgatgttca

SEQ ID NO: 247435 - DNA, 25 bp, Rattus norvegicus
cccacgtggaggtggtcgatgttca

SEQ ID NO: 247436 - DNA, 25 bp, Rattus norvegicus
cccacgtggatcacatagtcctaga

SEQ ID NO: 247437 - DNA, 25 bp, Rattus norvegicus
cccacgtggatctcatagtcctaga

SEQ ID NO: 247438 - DNA, 25 bp, Rattus norvegicus
cccacgtggttcacatctggtaaga

SEQ ID NO: 247439 - DNA, 25 bp, Rattus norvegicus
cccacgtggttctcatctggtaaga

SEQ ID NO: 247440 - DNA, 25 bp, Rattus norvegicus
cccacgttggatcctggacaagcta

SEQ ID NO: 247441 - DNA, 25 bp, Rattus norvegicus
cccacgttggatgctggacaagcta

SEQ ID NO: 247442 - DNA, 25 bp, Rattus norvegicus
cccactcaccgcatagattactttg

SEQ ID NO: 247443 - DNA, 25 bp, Rattus norvegicus
cccactcaccgcttagattactttg

SEQ ID NO: 247444 - DNA, 25 bp, Rattus norvegicus
cccactccctacacagagaaagaat

SEQ ID NO: 247445 - DNA, 25 bp, Rattus norvegicus
cccactccctactcagagaaagaat

SEQ ID NO: 247446 - DNA, 25 bp, Rattus norvegicus
cccactcccttgaaaatacatttgg

SEQ ID NO: 247447 - DNA, 25 bp, Rattus norvegicus
cccactcccttgtaaatacatttgg

SEQ ID NO: 247448 - DNA, 25 bp, Rattus norvegicus
cccactcctcttatgtacagagtat

SEQ ID NO: 247449 - DNA, 25 bp, Rattus norvegicus
cccactcctcttttgtacagagtat

SEQ ID NO: 247450 - DNA, 25 bp, Rattus norvegicus
cccactccttctaggcatctaagag

SEQ ID NO: 247451 - DNA, 25 bp, Rattus norvegicus
cccactccttcttggcatctaagag

SEQ ID NO: 247452 - DNA, 25 bp, Rattus norvegicus
cccactctacccagagacttgatga

SEQ ID NO: 247453 - DNA, 25 bp, Rattus norvegicus
cccactctaccctgagacttgatga

SEQ ID NO: 247454 - DNA, 25 bp, Rattus norvegicus
cccactcttggaaggtgttcatgtg

SEQ ID NO: 247455 - DNA, 25 bp, Rattus norvegicus
cccactcttggatggtgttcatgtg

SEQ ID NO: 247456 - DNA, 25 bp, Rattus norvegicus
cccactgactgacagccagattgtt

SEQ ID NO: 247457 - DNA, 25 bp, Rattus norvegicus
cccactgactgagagccagattgtt

SEQ ID NO: 247458 - DNA, 25 bp, Rattus norvegicus
cccactgccatcagaactattttat

SEQ ID NO: 247459 - DNA, 25 bp, Rattus norvegicus
cccactgccatctgaactattttat

SEQ ID NO: 247460 - DNA, 25 bp, Rattus norvegicus
cccactggagcgctcgcggtatatg

SEQ ID NO: 247461 - DNA, 25 bp, Rattus norvegicus
cccactggagcggtcgcggtatatg

SEQ ID NO: 247462 - DNA, 25 bp, Rattus norvegicus
cccactggcttcaaggttggcatta

SEQ ID NO: 247463 - DNA, 25 bp, Rattus norvegicus
cccactggcttctaggttggcatta

SEQ ID NO: 247464 - DNA, 25 bp, Rattus norvegicus
cccactgggcaactatctctaaatg

SEQ ID NO: 247465 - DNA, 25 bp, Rattus norvegicus
cccactgggcaagtatctctaaatg

SEQ ID NO: 247466 - DNA, 25 bp, Rattus norvegicus
cccactgggtatcattgacccaggg

SEQ ID NO: 247467 - DNA, 25 bp, Rattus norvegicus
cccactgggtatgattgacccaggg

SEQ ID NO: 247468 - DNA, 25 bp, Rattus norvegicus
cccactgtcagcactggacatatca

SEQ ID NO: 247469 - DNA, 25 bp, Rattus norvegicus
cccactgtcagctctggacatatca

SEQ ID NO: 247470 - DNA, 25 bp, Rattus norvegicus
cccactgtcatgagtctgaagggca

SEQ ID NO: 247471 - DNA, 25 bp, Rattus norvegicus
cccactgtcatgtgtctgaagggca

SEQ ID NO: 247472 - DNA, 25 bp, Rattus norvegicus
cccactgtgagacttgttcgactgt

SEQ ID NO: 247473 - DNA, 25 bp, Rattus norvegicus
cccactgtgagagttgttcgactgt

SEQ ID NO: 247474 - DNA, 25 bp, Rattus norvegicus
cccactgttcagcttggctgtgtat

SEQ ID NO: 247475 - DNA, 25 bp, Rattus norvegicus
cccactgttcaggttggctgtgtat

SEQ ID NO: 247476 - DNA, 25 bp, Rattus norvegicus
cccactgttggccatgattttcttt

SEQ ID NO: 247477 - DNA, 25 bp, Rattus norvegicus
cccactgttggcgatgattttcttt

SEQ ID NO: 247478 - DNA, 25 bp, Rattus norvegicus
cccactgtttctctctggttttaga

SEQ ID NO: 247479 - DNA, 25 bp, Rattus norvegicus
cccactgtttctgtctggttttaga

SEQ ID NO: 247480 - DNA, 25 bp, Rattus norvegicus
cccacttaagtgcaattcgtcatta

SEQ ID NO: 247481 - DNA, 25 bp, Rattus norvegicus
cccacttaagtggaattcgtcatta

SEQ ID NO: 247482 - DNA, 25 bp, Rattus norvegicus
cccacttcctgtacctaaatgatac

SEQ ID NO: 247483 - DNA, 25 bp, Rattus norvegicus
cccacttcctgtatgtaagcggtga

SEQ ID NO: 247484 - DNA, 25 bp, Rattus norvegicus
cccacttcctgttcctaaatgatac

SEQ ID NO: 247485 - DNA, 25 bp, Rattus norvegicus
cccacttcctgtttgtaagcggtga

SEQ ID NO: 247486 - DNA, 25 bp, Rattus norvegicus
cccacttcgctcaactttgtatata

SEQ ID NO: 247487 - DNA, 25 bp, Rattus norvegicus
cccacttcgctctactttgtatata

SEQ ID NO: 247488 - DNA, 25 bp, Rattus norvegicus
cccacttctgggagagacttacgaa

SEQ ID NO: 247489 - DNA, 25 bp, Rattus norvegicus
cccacttctgggtgagacttacgaa

SEQ ID NO: 247490 - DNA, 25 bp, Rattus norvegicus
cccacttgatttaaggcctacactg

SEQ ID NO: 247491 - DNA, 25 bp, Rattus norvegicus
cccacttgattttaggcctacactg

SEQ ID NO: 247492 - DNA, 25 bp, Rattus norvegicus
cccacttgccttaagctagtgtcaa

SEQ ID NO: 247493 - DNA, 25 bp, Rattus norvegicus
cccacttgcctttagctagtgtcaa

SEQ ID NO: 247494 - DNA, 25 bp, Rattus norvegicus
cccacttggagacctataagagaag

SEQ ID NO: 247495 - DNA, 25 bp, Rattus norvegicus
cccacttggagagctataagagaag

SEQ ID NO: 247496 - DNA, 25 bp, Rattus norvegicus
cccacttgtcaaactaggctaatta

SEQ ID NO: 247497 - DNA, 25 bp, Rattus norvegicus
cccacttgtcaatctaggctaatta

SEQ ID NO: 247498 - DNA, 25 bp, Rattus norvegicus
cccactttatggctgtgcctagatt

SEQ ID NO: 247499 - DNA, 25 bp, Rattus norvegicus
cccactttatgggtgtgcctagatt

SEQ ID NO: 247500 - DNA, 25 bp, Rattus norvegicus
cccactttctgcagagcctgattaa

SEQ ID NO: 247501 - DNA, 25 bp, Rattus norvegicus
cccactttctgctgagcctgattaa

SEQ ID NO: 247502 - DNA, 25 bp, Rattus norvegicus
cccactttgccaatatatttgtagg

SEQ ID NO: 247503 - DNA, 25 bp, Rattus norvegicus
cccactttgccattatatttgtagg

SEQ ID NO: 247504 - DNA, 25 bp, Rattus norvegicus
cccactttgggcacagtatttttag

SEQ ID NO: 247505 - DNA, 25 bp, Rattus norvegicus
cccactttgggctcagtatttttag

SEQ ID NO: 247506 - DNA, 25 bp, Rattus norvegicus
cccactttgtgactgtgcatagaaa

SEQ ID NO: 247507 - DNA, 25 bp, Rattus norvegicus
cccactttgtgagtgtgcatagaaa

SEQ ID NO: 247508 - DNA, 25 bp, Rattus norvegicus
cccacttttcaaacttttcgctaat

SEQ ID NO: 247509 - DNA, 25 bp, Rattus norvegicus
cccacttttcaatcttttcgctaat

SEQ ID NO: 247510 - DNA, 25 bp, Rattus norvegicus
cccacttttgatctcctcacattta

SEQ ID NO: 247511 - DNA, 25 bp, Rattus norvegicus
cccacttttgatgtcctcacattta

SEQ ID NO: 247512 - DNA, 25 bp, Rattus norvegicus
cccagaacaactcttcctgaagatt

SEQ ID NO: 247513 - DNA, 25 bp, Rattus norvegicus
cccagaacaactgttcctgaagatt

SEQ ID NO: 247514 - DNA, 25 bp, Rattus norvegicus
cccagaacatggctagcttagttaa

SEQ ID NO: 247515 - DNA, 25 bp, Rattus norvegicus
cccagaacatgggtagcttagttaa

SEQ ID NO: 247516 - DNA, 25 bp, Rattus norvegicus
cccagaagattcagagccgatcagt

SEQ ID NO: 247517 - DNA, 25 bp, Rattus norvegicus
cccagaagattctgagccgatcagt

SEQ ID NO: 247518 - DNA, 25 bp, Rattus norvegicus
cccagaattcccaaatgtgctttac

SEQ ID NO: 247519 - DNA, 25 bp, Rattus norvegicus
cccagaattccctaatgtgctttac

SEQ ID NO: 247520 - DNA, 25 bp, Rattus norvegicus
cccagaattgccatctttcttttga

SEQ ID NO: 247521 - DNA, 25 bp, Rattus norvegicus
cccagaattgccttctttcttttga

SEQ ID NO: 247522 - DNA, 25 bp, Rattus norvegicus
cccagacaagggacctcagtcagga

SEQ ID NO: 247523 - DNA, 25 bp, Rattus norvegicus
cccagacaagggtcctcagtcagga

SEQ ID NO: 247524 - DNA, 25 bp, Rattus norvegicus
cccagacactgacttctttagctta

SEQ ID NO: 247525 - DNA, 25 bp, Rattus norvegicus
cccagacactgagttctttagctta

SEQ ID NO: 247526 - DNA, 25 bp, Rattus norvegicus
cccagaccatctagacaggtagttt

SEQ ID NO: 247527 - DNA, 25 bp, Rattus norvegicus
cccagaccatcttgacaggtagttt

SEQ ID NO: 247528 - DNA, 25 bp, Rattus norvegicus
cccagacccaggcagagagcatggt

SEQ ID NO: 247529 - DNA, 25 bp, Rattus norvegicus
cccagacccagggagagagcatggt

SEQ ID NO: 247530 - DNA, 25 bp, Rattus norvegicus
cccagaccctgaaggctgcagagta

SEQ ID NO: 247531 - DNA, 25 bp, Rattus norvegicus
cccagaccctgatggctgcagagta

SEQ ID NO: 247532 - DNA, 25 bp, Rattus norvegicus
cccagaccggaactcccagaagaag

SEQ ID NO: 247533 - DNA, 25 bp, Rattus norvegicus
cccagaccggaagtcccagaagaag

SEQ ID NO: 247534 - DNA, 25 bp, Rattus norvegicus
cccagacctgtcatcatgttttaaa

SEQ ID NO: 247535 - DNA, 25 bp, Rattus norvegicus
cccagacctgtcttcatgttttaaa

SEQ ID NO: 247536 - DNA, 25 bp, Rattus norvegicus
cccagacctttaatttgatctttag

SEQ ID NO: 247537 - DNA, 25 bp, Rattus norvegicus
cccagacctttattttgatctttag

SEQ ID NO: 247538 - DNA, 25 bp, Rattus norvegicus
cccagacgtctgagttttcaaagga

SEQ ID NO: 247539 - DNA, 25 bp, Rattus norvegicus
cccagacgtctgtgttttcaaagga

SEQ ID NO: 247540 - DNA, 25 bp, Rattus norvegicus
cccagactaaggctgcataagtgaa

SEQ ID NO: 247541 - DNA, 25 bp, Rattus norvegicus
cccagactaagggtgcataagtgaa

SEQ ID NO: 247542 - DNA, 25 bp, Rattus norvegicus
cccagactcagacccaggtgtgata

SEQ ID NO: 247543 - DNA, 25 bp, Rattus norvegicus
cccagactcagagccaggtgtgata

SEQ ID NO: 247544 - DNA, 25 bp, Rattus norvegicus
cccagactccaaaggtcacatttga

SEQ ID NO: 247545 - DNA, 25 bp, Rattus norvegicus
cccagactccaatggtcacatttga

SEQ ID NO: 247546 - DNA, 25 bp, Rattus norvegicus
cccagactgtctcgttttgcttatt

SEQ ID NO: 247547 - DNA, 25 bp, Rattus norvegicus
cccagactgtctggttttgcttatt

SEQ ID NO: 247548 - DNA, 25 bp, Rattus norvegicus
cccagacttcttaagccattgactt

SEQ ID NO: 247549 - DNA, 25 bp, Rattus norvegicus
cccagacttctttagccattgactt

SEQ ID NO: 247550 - DNA, 25 bp, Rattus norvegicus
cccagagaacatcgtgcatggcagt

SEQ ID NO: 247551 - DNA, 25 bp, Rattus norvegicus
cccagagaacatggtgcatggcagt

SEQ ID NO: 247552 - DNA, 25 bp, Rattus norvegicus
cccagagagagcacacttcctaaat

SEQ ID NO: 247553 - DNA, 25 bp, Rattus norvegicus
cccagagagagctcacttcctaaat

SEQ ID NO: 247554 - DNA, 25 bp, Rattus norvegicus
cccagagaggtgatggcccttgaca

SEQ ID NO: 247555 - DNA, 25 bp, Rattus norvegicus
cccagagaggtgttggcccttgaca

SEQ ID NO: 247556 - DNA, 25 bp, Rattus norvegicus
cccagagatttcaatagagttgaat

SEQ ID NO: 247557 - DNA, 25 bp, Rattus norvegicus
cccagagatttctatagagttgaat

SEQ ID NO: 247558 - DNA, 25 bp, Rattus norvegicus
cccagagcatatccaagccatcaag

SEQ ID NO: 247559 - DNA, 25 bp, Rattus norvegicus
cccagagcatatgcaagccatcaag

SEQ ID NO: 247560 - DNA, 25 bp, Rattus norvegicus
cccagagcctgaagtctccagtaaa

SEQ ID NO: 247561 - DNA, 25 bp, Rattus norvegicus
cccagagcctgatgtctccagtaaa

SEQ ID NO: 247562 - DNA, 25 bp, Rattus norvegicus
cccagagctcagcacttaggttttt

SEQ ID NO: 247563 - DNA, 25 bp, Rattus norvegicus
cccagagctcaggacttaggttttt

SEQ ID NO: 247564 - DNA, 25 bp, Rattus norvegicus
cccagagctccacacagttgtttta

SEQ ID NO: 247565 - DNA, 25 bp, Rattus norvegicus
cccagagctccagacagttgtttta

SEQ ID NO: 247566 - DNA, 25 bp, Rattus norvegicus
cccagaggccttcaaggtcttgtga

SEQ ID NO: 247567 - DNA, 25 bp, Rattus norvegicus
cccagaggccttgaaggtcttgtga

SEQ ID NO: 247568 - DNA, 25 bp, Rattus norvegicus
cccagaggtctgcagagggtctcat

SEQ ID NO: 247569 - DNA, 25 bp, Rattus norvegicus
cccagaggtctggagagggtctcat

SEQ ID NO: 247570 - DNA, 25 bp, Rattus norvegicus
cccagaggtggccttcagtgtcaga

SEQ ID NO: 247571 - DNA, 25 bp, Rattus norvegicus
cccagaggtggcgttcagtgtcaga

SEQ ID NO: 247572 - DNA, 25 bp, Rattus norvegicus
cccagaggtgtgatatcttctagct

SEQ ID NO: 247573 - DNA, 25 bp, Rattus norvegicus
cccagaggtgtgttatcttctagct

SEQ ID NO: 247574 - DNA, 25 bp, Rattus norvegicus
cccagagtacttattcaggtcttag

SEQ ID NO: 247575 - DNA, 25 bp, Rattus norvegicus
cccagagtactttttcaggtcttag

SEQ ID NO: 247576 - DNA, 25 bp, Rattus norvegicus
cccagagtctggcttctgtgtgtat

SEQ ID NO: 247577 - DNA, 25 bp, Rattus norvegicus
cccagagtctgggttctgtgtgtat

SEQ ID NO: 247578 - DNA, 25 bp, Rattus norvegicus
cccagagtgaaaccgtgcaccgcat

SEQ ID NO: 247579 - DNA, 25 bp, Rattus norvegicus
cccagagtgaaagcgtgcaccgcat

SEQ ID NO: 247580 - DNA, 25 bp, Rattus norvegicus
cccagagtgtgtcacttcctcagtg

SEQ ID NO: 247581 - DNA, 25 bp, Rattus norvegicus
cccagagtgtgtgacttcctcagtg

SEQ ID NO: 247582 - DNA, 25 bp, Rattus norvegicus
cccagagttcgaaaggaccagcgga

SEQ ID NO: 247583 - DNA, 25 bp, Rattus norvegicus
cccagagttcgataggaccagcgga

SEQ ID NO: 247584 - DNA, 25 bp, Rattus norvegicus
cccagagttctgagcttcatttatc

SEQ ID NO: 247585 - DNA, 25 bp, Rattus norvegicus
cccagagttctgtgcttcatttatc

SEQ ID NO: 247586 - DNA, 25 bp, Rattus norvegicus
cccagagtttccctgatcatcaata

SEQ ID NO: 247587 - DNA, 25 bp, Rattus norvegicus
cccagagtttccgtgatcatcaata

SEQ ID NO: 247588 - DNA, 25 bp, Rattus norvegicus
cccagagttttcatcggagagcgga

SEQ ID NO: 247589 - DNA, 25 bp, Rattus norvegicus
cccagagttttcttcggagagcgga

SEQ ID NO: 247590 - DNA, 25 bp, Rattus norvegicus
cccagatatgggaataggcggtgcc

SEQ ID NO: 247591 - DNA, 25 bp, Rattus norvegicus
cccagatatgggtataggcggtgcc

SEQ ID NO: 247592 - DNA, 25 bp, Rattus norvegicus
cccagatccttaattcaccttttat

SEQ ID NO: 247593 - DNA, 25 bp, Rattus norvegicus
cccagatccttatttcaccttttat

SEQ ID NO: 247594 - DNA, 25 bp, Rattus norvegicus
cccagatctcatattgcagccaaat

SEQ ID NO: 247595 - DNA, 25 bp, Rattus norvegicus
cccagatctcattttgcagccaaat

SEQ ID NO: 247596 - DNA, 25 bp, Rattus norvegicus
cccagatgatccctcgggttcagat

SEQ ID NO: 247597 - DNA, 25 bp, Rattus norvegicus
cccagatgatccgtcgggttcagat

SEQ ID NO: 247598 - DNA, 25 bp, Rattus norvegicus
cccagatgcctgaggctgagggcaa

SEQ ID NO: 247599 - DNA, 25 bp, Rattus norvegicus
cccagatgcctgtggctgagggcaa

SEQ ID NO: 247600 - DNA, 25 bp, Rattus norvegicus
cccagatgtgccctttgtcaagagg

SEQ ID NO: 247601 - DNA, 25 bp, Rattus norvegicus
cccagatgtgccgtttgtcaagagg

SEQ ID NO: 247602 - DNA, 25 bp, Rattus norvegicus
cccagattctggaggagaggcccat

SEQ ID NO: 247603 - DNA, 25 bp, Rattus norvegicus
cccagattctggtggagaggcccat

SEQ ID NO: 247604 - DNA, 25 bp, Rattus norvegicus
cccagattgggtcgtgtttgttttg

SEQ ID NO: 247605 - DNA, 25 bp, Rattus norvegicus
cccagattgggtggtgtttgttttg

SEQ ID NO: 247606 - DNA, 25 bp, Rattus norvegicus
cccagcaatctcagggttttggcaa

SEQ ID NO: 247607 - DNA, 25 bp, Rattus norvegicus
cccagcaatctctgggttttggcaa

SEQ ID NO: 247608 - DNA, 25 bp, Rattus norvegicus
cccagcacaggtcacactgctaatt

SEQ ID NO: 247609 - DNA, 25 bp, Rattus norvegicus
cccagcacaggtgacactgctaatt

SEQ ID NO: 247610 - DNA, 25 bp, Rattus norvegicus
cccagcaccatcatccataattttg

SEQ ID NO: 247611 - DNA, 25 bp, Rattus norvegicus
cccagcaccatcttccataattttg

SEQ ID NO: 247612 - DNA, 25 bp, Rattus norvegicus
cccagcaccggcagttgaagttgtt

SEQ ID NO: 247613 - DNA, 25 bp, Rattus norvegicus
cccagcaccggctgttgaagttgtt

SEQ ID NO: 247614 - DNA, 25 bp, Rattus norvegicus
cccagcacctggcagatgaatgaga

SEQ ID NO: 247615 - DNA, 25 bp, Rattus norvegicus
cccagcacctgggagatgaatgaga

SEQ ID NO: 247616 - DNA, 25 bp, Rattus norvegicus
cccagcagccctagttcaaataatg

SEQ ID NO: 247617 - DNA, 25 bp, Rattus norvegicus
cccagcagcccttgttcaaataatg

SEQ ID NO: 247618 - DNA, 25 bp, Rattus norvegicus
cccagcaggaaacatggctccctgt

SEQ ID NO: 247619 - DNA, 25 bp, Rattus norvegicus
cccagcaggaaagatggctccctgt

SEQ ID NO: 247620 - DNA, 25 bp, Rattus norvegicus
cccagcaggccacaggcagttggta

SEQ ID NO: 247621 - DNA, 25 bp, Rattus norvegicus
cccagcaggccagaggcagttggta

SEQ ID NO: 247622 - DNA, 25 bp, Rattus norvegicus
cccagcagggtaagagacaccaata

SEQ ID NO: 247623 - DNA, 25 bp, Rattus norvegicus
cccagcagggtatgagacaccaata

SEQ ID NO: 247624 - DNA, 25 bp, Rattus norvegicus
cccagcagtctaaggtggtaaacct

SEQ ID NO: 247625 - DNA, 25 bp, Rattus norvegicus
cccagcagtctatggtggtaaacct

SEQ ID NO: 247626 - DNA, 25 bp, Rattus norvegicus
cccagcatctggaggcgagcctttg

SEQ ID NO: 247627 - DNA, 25 bp, Rattus norvegicus
cccagcatctggcttgggctttgat

SEQ ID NO: 247628 - DNA, 25 bp, Rattus norvegicus
cccagcatctgggttgggctttgat

SEQ ID NO: 247629 - DNA, 25 bp, Rattus norvegicus
cccagcatctggtggcgagcctttg

SEQ ID NO: 247630 - DNA, 25 bp, Rattus norvegicus
cccagcatgcttcagtctgctaaga

SEQ ID NO: 247631 - DNA, 25 bp, Rattus norvegicus
cccagcatgcttgagtctgctaaga

SEQ ID NO: 247632 - DNA, 25 bp, Rattus norvegicus
cccagcatgtgcactactatgaatc

SEQ ID NO: 247633 - DNA, 25 bp, Rattus norvegicus
cccagcatgtgctctactatgaatc

SEQ ID NO: 247634 - DNA, 25 bp, Rattus norvegicus
cccagcattaagcatctagagacag

SEQ ID NO: 247635 - DNA, 25 bp, Rattus norvegicus
cccagcattaaggatctagagacag

SEQ ID NO: 247636 - DNA, 25 bp, Rattus norvegicus
cccagccaagtgctttgagtactat

SEQ ID NO: 247637 - DNA, 25 bp, Rattus norvegicus
cccagccaagtggtttgagtactat

SEQ ID NO: 247638 - DNA, 25 bp, Rattus norvegicus
cccagccactcgattttctgagaaa

SEQ ID NO: 247639 - DNA, 25 bp, Rattus norvegicus
cccagccactcgtttttctgagaaa

SEQ ID NO: 247640 - DNA, 25 bp, Rattus norvegicus
cccagccactttaatgactctttag

SEQ ID NO: 247641 - DNA, 25 bp, Rattus norvegicus
cccagccacttttatgactctttag

SEQ ID NO: 247642 - DNA, 25 bp, Rattus norvegicus
cccagccagagccacgtggtggaaa

SEQ ID NO: 247643 - DNA, 25 bp, Rattus norvegicus
cccagccagagcgacgtggtggaaa

SEQ ID NO: 247644 - DNA, 25 bp, Rattus norvegicus
cccagccagagtagaagcctaaagt

SEQ ID NO: 247645 - DNA, 25 bp, Rattus norvegicus
cccagccagagtcagcagttgtggt

SEQ ID NO: 247646 - DNA, 25 bp, Rattus norvegicus
cccagccagagtgagcagttgtggt

SEQ ID NO: 247647 - DNA, 25 bp, Rattus norvegicus
cccagccagagttgaagcctaaagt

SEQ ID NO: 247648 - DNA, 25 bp, Rattus norvegicus
cccagccagctgagtgttaagataa

SEQ ID NO: 247649 - DNA, 25 bp, Rattus norvegicus
cccagccagctgtgtgttaagataa

SEQ ID NO: 247650 - DNA, 25 bp, Rattus norvegicus
cccagccagtttctttcatacgaca

SEQ ID NO: 247651 - DNA, 25 bp, Rattus norvegicus
cccagccagtttgtttcatacgaca

SEQ ID NO: 247652 - DNA, 25 bp, Rattus norvegicus
cccagccatggtagaagaattttgt

SEQ ID NO: 247653 - DNA, 25 bp, Rattus norvegicus
cccagccatggttgaagaattttgt

SEQ ID NO: 247654 - DNA, 25 bp, Rattus norvegicus
cccagccattggcaaatgccgtcaa

SEQ ID NO: 247655 - DNA, 25 bp, Rattus norvegicus
cccagccattgggaaatgccgtcaa

SEQ ID NO: 247656 - DNA, 25 bp, Rattus norvegicus
cccagcccagcaccagattgaaaga

SEQ ID NO: 247657 - DNA, 25 bp, Rattus norvegicus
cccagcccagcacgtgtgtgggata

SEQ ID NO: 247658 - DNA, 25 bp, Rattus norvegicus
cccagcccagcagcagattgaaaga

SEQ ID NO: 247659 - DNA, 25 bp, Rattus norvegicus
cccagcccagcaggtgtgtgggata

SEQ ID NO: 247660 - DNA, 25 bp, Rattus norvegicus
cccagcccctgaaatctttacaagg

SEQ ID NO: 247661 - DNA, 25 bp, Rattus norvegicus
cccagcccctgaagtcgagattaat

SEQ ID NO: 247662 - DNA, 25 bp, Rattus norvegicus
cccagcccctgatatctttacaagg

SEQ ID NO: 247663 - DNA, 25 bp, Rattus norvegicus
cccagcccctgatgtcgagattaat

SEQ ID NO: 247664 - DNA, 25 bp, Rattus norvegicus
cccagccctgtcaaaagaataagtg

SEQ ID NO: 247665 - DNA, 25 bp, Rattus norvegicus
cccagccctgtctaaagaataagtg

SEQ ID NO: 247666 - DNA, 25 bp, Rattus norvegicus
cccagcccttagcacagagagggag

SEQ ID NO: 247667 - DNA, 25 bp, Rattus norvegicus
cccagcccttaggacagagagggag

SEQ ID NO: 247668 - DNA, 25 bp, Rattus norvegicus
cccagcccttccctagaagtataat

SEQ ID NO: 247669 - DNA, 25 bp, Rattus norvegicus
cccagcccttccgtagaagtataat

SEQ ID NO: 247670 - DNA, 25 bp, Rattus norvegicus
cccagcctcatgacttctgattaag

SEQ ID NO: 247671 - DNA, 25 bp, Rattus norvegicus
cccagcctcatgtcttctgattaag

SEQ ID NO: 247672 - DNA, 25 bp, Rattus norvegicus
cccagcctgtttactacaagttcta

SEQ ID NO: 247673 - DNA, 25 bp, Rattus norvegicus
cccagcctgttttctacaagttcta

SEQ ID NO: 247674 - DNA, 25 bp, Rattus norvegicus
cccagcggcctgatcagatggtgaa

SEQ ID NO: 247675 - DNA, 25 bp, Rattus norvegicus
cccagcggcctgttcagatggtgaa

SEQ ID NO: 247676 - DNA, 25 bp, Rattus norvegicus
cccagcgtccagaagcggcttgaag

SEQ ID NO: 247677 - DNA, 25 bp, Rattus norvegicus
cccagcgtccagtagcggcttgaag

SEQ ID NO: 247678 - DNA, 25 bp, Rattus norvegicus
cccagcgtgtggaaaaaactccaga

SEQ ID NO: 247679 - DNA, 25 bp, Rattus norvegicus
cccagcgtgtggtaaaaactccaga

SEQ ID NO: 247680 - DNA, 25 bp, Rattus norvegicus
cccagctacctgattacattgtcag

SEQ ID NO: 247681 - DNA, 25 bp, Rattus norvegicus
cccagctacctgtttacattgtcag

SEQ ID NO: 247682 - DNA, 25 bp, Rattus norvegicus
cccagctcaaccaactgtgtcaagg

SEQ ID NO: 247683 - DNA, 25 bp, Rattus norvegicus
cccagctcaacctactgtgtcaagg

SEQ ID NO: 247684 - DNA, 25 bp, Rattus norvegicus
cccagctcaaggacatgttcacttt

SEQ ID NO: 247685 - DNA, 25 bp, Rattus norvegicus
cccagctcaaggtcatgttcacttt

SEQ ID NO: 247686 - DNA, 25 bp, Rattus norvegicus
cccagctcagtccttacaaaacata

SEQ ID NO: 247687 - DNA, 25 bp, Rattus norvegicus
cccagctcagtcgttacaaaacata

SEQ ID NO: 247688 - DNA, 25 bp, Rattus norvegicus
cccagctctagtactttcattttga

SEQ ID NO: 247689 - DNA, 25 bp, Rattus norvegicus
cccagctctagttctttcattttga

SEQ ID NO: 247690 - DNA, 25 bp, Rattus norvegicus
cccagctgccaaactgactttgtaa

SEQ ID NO: 247691 - DNA, 25 bp, Rattus norvegicus
cccagctgccaatctgactttgtaa

SEQ ID NO: 247692 - DNA, 25 bp, Rattus norvegicus
cccagctgcgcaaagcgtgcgaggt

SEQ ID NO: 247693 - DNA, 25 bp, Rattus norvegicus
cccagctgcgcatagcgtgcgaggt

SEQ ID NO: 247694 - DNA, 25 bp, Rattus norvegicus
cccagctgctggactgctcaaggaa

SEQ ID NO: 247695 - DNA, 25 bp, Rattus norvegicus
cccagctgctggaggtggatgacat

SEQ ID NO: 247696 - DNA, 25 bp, Rattus norvegicus
cccagctgctggtctgctcaaggaa

SEQ ID NO: 247697 - DNA, 25 bp, Rattus norvegicus
cccagctgctggtggtggatgacat

SEQ ID NO: 247698 - DNA, 25 bp, Rattus norvegicus
cccagctggctgagattcgttgtga

SEQ ID NO: 247699 - DNA, 25 bp, Rattus norvegicus
cccagctggctgtgattcgttgtga

SEQ ID NO: 247700 - DNA, 25 bp, Rattus norvegicus
cccagctgtcggacgagcaggttat

SEQ ID NO: 247701 - DNA, 25 bp, Rattus norvegicus
cccagctgtcggtcgagcaggttat

SEQ ID NO: 247702 - DNA, 25 bp, Rattus norvegicus
cccagctgtctcatggatcagttgt

SEQ ID NO: 247703 - DNA, 25 bp, Rattus norvegicus
cccagctgtctcttggatcagttgt

SEQ ID NO: 247704 - DNA, 25 bp, Rattus norvegicus
cccagctgtggaatctatactagat

SEQ ID NO: 247705 - DNA, 25 bp, Rattus norvegicus
cccagctgtggattctatactagat

SEQ ID NO: 247706 - DNA, 25 bp, Rattus norvegicus
cccagctgtgggagtactcaggcgt

SEQ ID NO: 247707 - DNA, 25 bp, Rattus norvegicus
cccagctgtgggtgtactcaggcgt

SEQ ID NO: 247708 - DNA, 25 bp, Rattus norvegicus
cccagctgttgaaggatttattcga

SEQ ID NO: 247709 - DNA, 25 bp, Rattus norvegicus
cccagctgttgatggatttattcga

SEQ ID NO: 247710 - DNA, 25 bp, Rattus norvegicus
cccagcttacgcatattcctatata

SEQ ID NO: 247711 - DNA, 25 bp, Rattus norvegicus
cccagcttacgcttattcctatata

SEQ ID NO: 247712 - DNA, 25 bp, Rattus norvegicus
cccagcttcctgagtttttaatata

SEQ ID NO: 247713 - DNA, 25 bp, Rattus norvegicus
cccagcttcctgtgtttttaatata

SEQ ID NO: 247714 - DNA, 25 bp, Rattus norvegicus
cccagcttctccatgtaggaacttt

SEQ ID NO: 247715 - DNA, 25 bp, Rattus norvegicus
cccagcttctccttgtaggaacttt

SEQ ID NO: 247716 - DNA, 25 bp, Rattus norvegicus
cccagcttctggaaattgcccaaag

SEQ ID NO: 247717 - DNA, 25 bp, Rattus norvegicus
cccagcttctggtaattgcccaaag

SEQ ID NO: 247718 - DNA, 25 bp, Rattus norvegicus
cccagcttggccaagcaaggtacat

SEQ ID NO: 247719 - DNA, 25 bp, Rattus norvegicus
cccagcttggcccagttgtggaaag

SEQ ID NO: 247720 - DNA, 25 bp, Rattus norvegicus
cccagcttggccgagttgtggaaag

SEQ ID NO: 247721 - DNA, 25 bp, Rattus norvegicus
cccagcttggcctagcaaggtacat

SEQ ID NO: 247722 - DNA, 25 bp, Rattus norvegicus
cccaggaatgctccattgacagagt

SEQ ID NO: 247723 - DNA, 25 bp, Rattus norvegicus
cccaggaatgctgcattgacagagt

SEQ ID NO: 247724 - DNA, 25 bp, Rattus norvegicus
cccaggacactcaggcacttaaatg

SEQ ID NO: 247725 - DNA, 25 bp, Rattus norvegicus
cccaggacactctggcacttaaatg

SEQ ID NO: 247726 - DNA, 25 bp, Rattus norvegicus
cccaggacaggcagtgtcagacact

SEQ ID NO: 247727 - DNA, 25 bp, Rattus norvegicus
cccaggacaggctgtgtcagacact

SEQ ID NO: 247728 - DNA, 25 bp, Rattus norvegicus
cccaggacgcctatagatgtgatat

SEQ ID NO: 247729 - DNA, 25 bp, Rattus norvegicus
cccaggacgcctttagatgtgatat

SEQ ID NO: 247730 - DNA, 25 bp, Rattus norvegicus
cccaggactagacccctggtaggct

SEQ ID NO: 247731 - DNA, 25 bp, Rattus norvegicus
cccaggactagagccctggtaggct

SEQ ID NO: 247732 - DNA, 25 bp, Rattus norvegicus
cccaggactctaagccccatttaat

SEQ ID NO: 247733 - DNA, 25 bp, Rattus norvegicus
cccaggactctatgccccatttaat

SEQ ID NO: 247734 - DNA, 25 bp, Rattus norvegicus
cccaggactgctaggaccggagttt

SEQ ID NO: 247735 - DNA, 25 bp, Rattus norvegicus
cccaggactgcttggaccggagttt

SEQ ID NO: 247736 - DNA, 25 bp, Rattus norvegicus
cccaggacttgtcatttcttttaca

SEQ ID NO: 247737 - DNA, 25 bp, Rattus norvegicus
cccaggacttgtgatttcttttaca

SEQ ID NO: 247738 - DNA, 25 bp, Rattus norvegicus
cccaggagaacacgagtgtgctgca

SEQ ID NO: 247739 - DNA, 25 bp, Rattus norvegicus
cccaggagaacaggagtgtgctgca

SEQ ID NO: 247740 - DNA, 25 bp, Rattus norvegicus
cccaggagacgtacgggacagcact

SEQ ID NO: 247741 - DNA, 25 bp, Rattus norvegicus
cccaggagacgttcgggacagcact

SEQ ID NO: 247742 - DNA, 25 bp, Rattus norvegicus
cccaggagataaagaggtaaaacaa

SEQ ID NO: 247743 - DNA, 25 bp, Rattus norvegicus
cccaggagataatgaggtaaaacaa

SEQ ID NO: 247744 - DNA, 25 bp, Rattus norvegicus
cccaggagctccactattaattact

SEQ ID NO: 247745 - DNA, 25 bp, Rattus norvegicus
cccaggagctcctctattaattact

SEQ ID NO: 247746 - DNA, 25 bp, Rattus norvegicus
cccaggagttcaagctgcgtgcgag

SEQ ID NO: 247747 - DNA, 25 bp, Rattus norvegicus
cccaggagttcatgctgcgtgcgag

SEQ ID NO: 247748 - DNA, 25 bp, Rattus norvegicus
cccaggatacctattttgacacata

SEQ ID NO: 247749 - DNA, 25 bp, Rattus norvegicus
cccaggataccttttttgacacata

SEQ ID NO: 247750 - DNA, 25 bp, Rattus norvegicus
cccaggattctgctaggagccacag

SEQ ID NO: 247751 - DNA, 25 bp, Rattus norvegicus
cccaggattctggtaggagccacag

SEQ ID NO: 247752 - DNA, 25 bp, Rattus norvegicus
cccaggcaagggagtgtgtatatgt

SEQ ID NO: 247753 - DNA, 25 bp, Rattus norvegicus
cccaggcaagggtgtgtgtatatgt

SEQ ID NO: 247754 - DNA, 25 bp, Rattus norvegicus
cccaggcacactattctctagaaat

SEQ ID NO: 247755 - DNA, 25 bp, Rattus norvegicus
cccaggcacacttttctctagaaat

SEQ ID NO: 247756 - DNA, 25 bp, Rattus norvegicus
cccaggcatcgcagacaggatgcag

SEQ ID NO: 247757 - DNA, 25 bp, Rattus norvegicus
cccaggcatcgctgacaggatgcag

SEQ ID NO: 247758 - DNA, 25 bp, Rattus norvegicus
cccaggcatggaaatagacgtcaga

SEQ ID NO: 247759 - DNA, 25 bp, Rattus norvegicus
cccaggcatggatatagacgtcaga

SEQ ID NO: 247760 - DNA, 25 bp, Rattus norvegicus
cccaggccttggaccaggaagagaa

SEQ ID NO: 247761 - DNA, 25 bp, Rattus norvegicus
cccaggccttggtccaggaagagaa

SEQ ID NO: 247762 - DNA, 25 bp, Rattus norvegicus
cccaggcggcggaaagagcgcacca

SEQ ID NO: 247763 - DNA, 25 bp, Rattus norvegicus
cccaggcggcggtaagagcgcacca

SEQ ID NO: 247764 - DNA, 25 bp, Rattus norvegicus
cccaggctagctactgctatgtata

SEQ ID NO: 247765 - DNA, 25 bp, Rattus norvegicus
cccaggctagcttctgctatgtata

SEQ ID NO: 247766 - DNA, 25 bp, Rattus norvegicus
cccaggctcagcctgtgttgagtag

SEQ ID NO: 247767 - DNA, 25 bp, Rattus norvegicus
cccaggctcagcgtgtgttgagtag

SEQ ID NO: 247768 - DNA, 25 bp, Rattus norvegicus
cccaggctggctctgaaatcatgac

SEQ ID NO: 247769 - DNA, 25 bp, Rattus norvegicus
cccaggctggctgtgaaatcatgac

SEQ ID NO: 247770 - DNA, 25 bp, Rattus norvegicus
cccaggcttccacgacatagtctga

SEQ ID NO: 247771 - DNA, 25 bp, Rattus norvegicus
cccaggcttccaggacatagtctga

SEQ ID NO: 247772 - DNA, 25 bp, Rattus norvegicus
cccaggcttgctactcgattaagaa

SEQ ID NO: 247773 - DNA, 25 bp, Rattus norvegicus
cccaggcttgcttctcgattaagaa

SEQ ID NO: 247774 - DNA, 25 bp, Rattus norvegicus
cccagggactgacctctctggtgag

SEQ ID NO: 247775 - DNA, 25 bp, Rattus norvegicus
cccagggactgagctctctggtgag

SEQ ID NO: 247776 - DNA, 25 bp, Rattus norvegicus
cccagggagacccaggaccagtctg

SEQ ID NO: 247777 - DNA, 25 bp, Rattus norvegicus
cccagggagaccgaggaccagtctg

SEQ ID NO: 247778 - DNA, 25 bp, Rattus norvegicus
cccagggagacgattgtgcggacta

SEQ ID NO: 247779 - DNA, 25 bp, Rattus norvegicus
cccagggagacgtttgtgcggacta

SEQ ID NO: 247780 - DNA, 25 bp, Rattus norvegicus
cccagggcagcaccgaggatcgtga

SEQ ID NO: 247781 - DNA, 25 bp, Rattus norvegicus
cccagggcagcagcgaggatcgtga

SEQ ID NO: 247782 - DNA, 25 bp, Rattus norvegicus
cccagggcccatagtgctttaggaa

SEQ ID NO: 247783 - DNA, 25 bp, Rattus norvegicus
cccagggcccattgtgctttaggaa

SEQ ID NO: 247784 - DNA, 25 bp, Rattus norvegicus
cccagggcgtgccaatgagatcacg

SEQ ID NO: 247785 - DNA, 25 bp, Rattus norvegicus
cccagggcgtgcgaatgagatcacg

SEQ ID NO: 247786 - DNA, 25 bp, Rattus norvegicus
cccagggcttgcctttttagagcta

SEQ ID NO: 247787 - DNA, 25 bp, Rattus norvegicus
cccagggcttgcgtttttagagcta

SEQ ID NO: 247788 - DNA, 25 bp, Rattus norvegicus
cccagggtagctcaagtcttggaag

SEQ ID NO: 247789 - DNA, 25 bp, Rattus norvegicus
cccagggtagctgaagtcttggaag

SEQ ID NO: 247790 - DNA, 25 bp, Rattus norvegicus
cccagggtcccaaaagagtgtcatt

SEQ ID NO: 247791 - DNA, 25 bp, Rattus norvegicus
cccagggtcccataagagtgtcatt

SEQ ID NO: 247792 - DNA, 25 bp, Rattus norvegicus
cccagggtctccagtcagtgatgtg

SEQ ID NO: 247793 - DNA, 25 bp, Rattus norvegicus
cccagggtctcctgtcagtgatgtg

SEQ ID NO: 247794 - DNA, 25 bp, Rattus norvegicus
cccagggtgggaacaaagtcttgat

SEQ ID NO: 247795 - DNA, 25 bp, Rattus norvegicus
cccagggtgggaattgtgtgctcta

SEQ ID NO: 247796 - DNA, 25 bp, Rattus norvegicus
cccagggtgggatcaaagtcttgat

SEQ ID NO: 247797 - DNA, 25 bp, Rattus norvegicus
cccagggtgggatttgtgtgctcta

SEQ ID NO: 247798 - DNA, 25 bp, Rattus norvegicus
cccagggttcccatgtagatgactt

SEQ ID NO: 247799 - DNA, 25 bp, Rattus norvegicus
cccagggttcccttgtagatgactt

SEQ ID NO: 247800 - DNA, 25 bp, Rattus norvegicus
cccagggttggaataggcttgtgtc

SEQ ID NO: 247801 - DNA, 25 bp, Rattus norvegicus
cccagggttggattaggcttgtgtc

SEQ ID NO: 247802 - DNA, 25 bp, Rattus norvegicus
cccaggtccacaaggtgaatccaga

SEQ ID NO: 247803 - DNA, 25 bp, Rattus norvegicus
cccaggtccacatggtgaatccaga

SEQ ID NO: 247804 - DNA, 25 bp, Rattus norvegicus
cccaggtcctgtcgtcagagctgaa

SEQ ID NO: 247805 - DNA, 25 bp, Rattus norvegicus
cccaggtcctgtggtcagagctgaa

SEQ ID NO: 247806 - DNA, 25 bp, Rattus norvegicus
cccaggtctgcacgccaaggctgga

SEQ ID NO: 247807 - DNA, 25 bp, Rattus norvegicus
cccaggtctgcaggccaaggctgga

SEQ ID NO: 247808 - DNA, 25 bp, Rattus norvegicus
cccaggtctttaagtcttgattcat

SEQ ID NO: 247809 - DNA, 25 bp, Rattus norvegicus
cccaggtctttatgtcttgattcat

SEQ ID NO: 247810 - DNA, 25 bp, Rattus norvegicus
cccaggtgccacagatttcatatca

SEQ ID NO: 247811 - DNA, 25 bp, Rattus norvegicus
cccaggtgccactgatttcatatca

SEQ ID NO: 247812 - DNA, 25 bp, Rattus norvegicus
cccaggtgtagaagtgtcttttata

SEQ ID NO: 247813 - DNA, 25 bp, Rattus norvegicus
cccaggtgtagatgtgtcttttata

SEQ ID NO: 247814 - DNA, 25 bp, Rattus norvegicus
cccaggttccagagcatgcattgaa

SEQ ID NO: 247815 - DNA, 25 bp, Rattus norvegicus
cccaggttccagtgcatgcattgaa

SEQ ID NO: 247816 - DNA, 25 bp, Rattus norvegicus
cccaggttccatcacattttttcat

SEQ ID NO: 247817 - DNA, 25 bp, Rattus norvegicus
cccaggttccatgacattttttcat

SEQ ID NO: 247818 - DNA, 25 bp, Rattus norvegicus
cccaggttggcgctgtgagacctaa

SEQ ID NO: 247819 - DNA, 25 bp, Rattus norvegicus
cccaggttggcggtgtgagacctaa

SEQ ID NO: 247820 - DNA, 25 bp, Rattus norvegicus
cccaggttgggcataaactatgatg

SEQ ID NO: 247821 - DNA, 25 bp, Rattus norvegicus
cccaggttgggcttaaactatgatg

SEQ ID NO: 247822 - DNA, 25 bp, Rattus norvegicus
cccaggtttcccaagtatcagcatg

SEQ ID NO: 247823 - DNA, 25 bp, Rattus norvegicus
cccaggtttccctagtatcagcatg

SEQ ID NO: 247824 - DNA, 25 bp, Rattus norvegicus
cccaggtttggccaagtgctattta

SEQ ID NO: 247825 - DNA, 25 bp, Rattus norvegicus
cccaggtttggcgaagtgctattta

SEQ ID NO: 247826 - DNA, 25 bp, Rattus norvegicus
cccagtaagatgcttttgtgcttct

SEQ ID NO: 247827 - DNA, 25 bp, Rattus norvegicus
cccagtaagatggttttgtgcttct

SEQ ID NO: 247828 - DNA, 25 bp, Rattus norvegicus
cccagtaagctcataggttcaccaa

SEQ ID NO: 247829 - DNA, 25 bp, Rattus norvegicus
cccagtaagctcttaggttcaccaa

SEQ ID NO: 247830 - DNA, 25 bp, Rattus norvegicus
cccagtaatctgaaatattcttgat

SEQ ID NO: 247831 - DNA, 25 bp, Rattus norvegicus
cccagtaatctgtaatattcttgat

SEQ ID NO: 247832 - DNA, 25 bp, Rattus norvegicus
cccagtaccttcatcagcataatta

SEQ ID NO: 247833 - DNA, 25 bp, Rattus norvegicus
cccagtaccttcttcagcataatta

SEQ ID NO: 247834 - DNA, 25 bp, Rattus norvegicus
cccagtagacagattggcgtgccag

SEQ ID NO: 247835 - DNA, 25 bp, Rattus norvegicus
cccagtagacagtttggcgtgccag

SEQ ID NO: 247836 - DNA, 25 bp, Rattus norvegicus
cccagtagatgcacacttccttaaa

SEQ ID NO: 247837 - DNA, 25 bp, Rattus norvegicus
cccagtagatgctcacttccttaaa

SEQ ID NO: 247838 - DNA, 25 bp, Rattus norvegicus
cccagtagggtgaccttcaaggcca

SEQ ID NO: 247839 - DNA, 25 bp, Rattus norvegicus
cccagtagggtgtccttcaaggcca

SEQ ID NO: 247840 - DNA, 25 bp, Rattus norvegicus
cccagtagtggtcttcagggccctg

SEQ ID NO: 247841 - DNA, 25 bp, Rattus norvegicus
cccagtagtggtgttcagggccctg

SEQ ID NO: 247842 - DNA, 25 bp, Rattus norvegicus
cccagtatcgctcgtgcggtgtgat

SEQ ID NO: 247843 - DNA, 25 bp, Rattus norvegicus
cccagtatcgctggtgcggtgtgat

SEQ ID NO: 247844 - DNA, 25 bp, Rattus norvegicus
cccagtcagtatccggcccagtttg

SEQ ID NO: 247845 - DNA, 25 bp, Rattus norvegicus
cccagtcagtatgcggcccagtttg

SEQ ID NO: 247846 - DNA, 25 bp, Rattus norvegicus
cccagtccaagcatcagtggcagaa

SEQ ID NO: 247847 - DNA, 25 bp, Rattus norvegicus
cccagtccaagcttcagtggcagaa

SEQ ID NO: 247848 - DNA, 25 bp, Rattus norvegicus
cccagtcccagaatgatgagttcca

SEQ ID NO: 247849 - DNA, 25 bp, Rattus norvegicus
cccagtcccagattgatgagttcca

SEQ ID NO: 247850 - DNA, 25 bp, Rattus norvegicus
cccagtcccaggctgattgtctgag

SEQ ID NO: 247851 - DNA, 25 bp, Rattus norvegicus
cccagtcccagggtgattgtctgag

SEQ ID NO: 247852 - DNA, 25 bp, Rattus norvegicus
cccagtcccctcaaataatttgtca

SEQ ID NO: 247853 - DNA, 25 bp, Rattus norvegicus
cccagtcccctctaataatttgtca

SEQ ID NO: 247854 - DNA, 25 bp, Rattus norvegicus
cccagtccgctgagtgaagagtatc

SEQ ID NO: 247855 - DNA, 25 bp, Rattus norvegicus
cccagtccgctgtgtgaagagtatc

SEQ ID NO: 247856 - DNA, 25 bp, Rattus norvegicus
cccagtccgtgactttgtcatttta

SEQ ID NO: 247857 - DNA, 25 bp, Rattus norvegicus
cccagtccgtgagtttgtcatttta

SEQ ID NO: 247858 - DNA, 25 bp, Rattus norvegicus
cccagtcgataaatttcccatttgc

SEQ ID NO: 247859 - DNA, 25 bp, Rattus norvegicus
cccagtcgataattttcccatttgc

SEQ ID NO: 247860 - DNA, 25 bp, Rattus norvegicus
cccagtctctgactgtcaggatggt

SEQ ID NO: 247861 - DNA, 25 bp, Rattus norvegicus
cccagtctctgagtgtcaggatggt

SEQ ID NO: 247862 - DNA, 25 bp, Rattus norvegicus
cccagtctgcgacctgcctgtgtgg

SEQ ID NO: 247863 - DNA, 25 bp, Rattus norvegicus
cccagtctgcgagctgcctgtgtgg

SEQ ID NO: 247864 - DNA, 25 bp, Rattus norvegicus
cccagtctgtggaccctgaggaagg

SEQ ID NO: 247865 - DNA, 25 bp, Rattus norvegicus
cccagtctgtggtccctgaggaagg

SEQ ID NO: 247866 - DNA, 25 bp, Rattus norvegicus
cccagtctgtttcgaagcacaatgg

SEQ ID NO: 247867 - DNA, 25 bp, Rattus norvegicus
cccagtctgtttggaagcacaatgg

SEQ ID NO: 247868 - DNA, 25 bp, Rattus norvegicus
cccagtcttactatctctgtttgaa

SEQ ID NO: 247869 - DNA, 25 bp, Rattus norvegicus
cccagtcttactttctctgtttgaa

SEQ ID NO: 247870 - DNA, 25 bp, Rattus norvegicus
cccagtcttcttactacttcatggt

SEQ ID NO: 247871 - DNA, 25 bp, Rattus norvegicus
cccagtcttctttctacttcatggt

SEQ ID NO: 247872 - DNA, 25 bp, Rattus norvegicus
cccagtgatagcaaggagttcccca

SEQ ID NO: 247873 - DNA, 25 bp, Rattus norvegicus
cccagtgatagctaggagttcccca

SEQ ID NO: 247874 - DNA, 25 bp, Rattus norvegicus
cccagtgatgtacaaattccctcgt

SEQ ID NO: 247875 - DNA, 25 bp, Rattus norvegicus
cccagtgatgtagaaattccctcgt

SEQ ID NO: 247876 - DNA, 25 bp, Rattus norvegicus
cccagtgccgtgattccaggtatga

SEQ ID NO: 247877 - DNA, 25 bp, Rattus norvegicus
cccagtgccgtgtttccaggtatga

SEQ ID NO: 247878 - DNA, 25 bp, Rattus norvegicus
cccagtgcctggaatattcgatttg

SEQ ID NO: 247879 - DNA, 25 bp, Rattus norvegicus
cccagtgcctggtatattcgatttg

SEQ ID NO: 247880 - DNA, 25 bp, Rattus norvegicus
cccagtgcggctaaggcgagcggat

SEQ ID NO: 247881 - DNA, 25 bp, Rattus norvegicus
cccagtgcggcttaggcgagcggat

SEQ ID NO: 247882 - DNA, 25 bp, Rattus norvegicus
cccagtgcgtgtctagctctgagaa

SEQ ID NO: 247883 - DNA, 25 bp, Rattus norvegicus
cccagtgcgtgtgtagctctgagaa

SEQ ID NO: 247884 - DNA, 25 bp, Rattus norvegicus
cccagtgctaccctgaaggaggaag

SEQ ID NO: 247885 - DNA, 25 bp, Rattus norvegicus
cccagtgctaccgtgaaggaggaag

SEQ ID NO: 247886 - DNA, 25 bp, Rattus norvegicus
cccagtgctaggcaaagctccttaa

SEQ ID NO: 247887 - DNA, 25 bp, Rattus norvegicus
cccagtgctagggaaagctccttaa

SEQ ID NO: 247888 - DNA, 25 bp, Rattus norvegicus
cccagtgctgccaaggatccaaaag

SEQ ID NO: 247889 - DNA, 25 bp, Rattus norvegicus
cccagtgctgcctaggatccaaaag

SEQ ID NO: 247890 - DNA, 25 bp, Rattus norvegicus
cccagtggctgacacttgtgagtca

SEQ ID NO: 247891 - DNA, 25 bp, Rattus norvegicus
cccagtggctgagacttgtgagtca

SEQ ID NO: 247892 - DNA, 25 bp, Rattus norvegicus
cccagtgggactcactggttccagg

SEQ ID NO: 247893 - DNA, 25 bp, Rattus norvegicus
cccagtgggactgactggttccagg

SEQ ID NO: 247894 - DNA, 25 bp, Rattus norvegicus
cccagtggtaagcaggctagtgcta

SEQ ID NO: 247895 - DNA, 25 bp, Rattus norvegicus
cccagtggtaaggaggctagtgcta

SEQ ID NO: 247896 - DNA, 25 bp, Rattus norvegicus
cccagtggtattccaggagcctttc

SEQ ID NO: 247897 - DNA, 25 bp, Rattus norvegicus
cccagtggtattgcaggagcctttc

SEQ ID NO: 247898 - DNA, 25 bp, Rattus norvegicus
cccagtggtctgctacttttaggaa

SEQ ID NO: 247899 - DNA, 25 bp, Rattus norvegicus
cccagtggtctggtacttttaggaa

SEQ ID NO: 247900 - DNA, 25 bp, Rattus norvegicus
cccagtggtgtactttctctagcaa

SEQ ID NO: 247901 - DNA, 25 bp, Rattus norvegicus
cccagtggtgtagtttctctagcaa

SEQ ID NO: 247902 - DNA, 25 bp, Rattus norvegicus
cccagtggttcgcataactgccgct

SEQ ID NO: 247903 - DNA, 25 bp, Rattus norvegicus
cccagtggttcggataactgccgct

SEQ ID NO: 247904 - DNA, 25 bp, Rattus norvegicus
cccagtgtacgcatgtagtgtttta

SEQ ID NO: 247905 - DNA, 25 bp, Rattus norvegicus
cccagtgtacgcttgtagtgtttta

SEQ ID NO: 247906 - DNA, 25 bp, Rattus norvegicus
cccagtgtccgtcgccagaaggtga

SEQ ID NO: 247907 - DNA, 25 bp, Rattus norvegicus
cccagtgtccgtggccagaaggtga

SEQ ID NO: 247908 - DNA, 25 bp, Rattus norvegicus
cccagtgtctctcttactttctaaa

SEQ ID NO: 247909 - DNA, 25 bp, Rattus norvegicus
cccagtgtctctgttactttctaaa

SEQ ID NO: 247910 - DNA, 25 bp, Rattus norvegicus
cccagtgtggctcgtcttgagacca

SEQ ID NO: 247911 - DNA, 25 bp, Rattus norvegicus
cccagtgtggctggtcttgagacca

SEQ ID NO: 247912 - DNA, 25 bp, Rattus norvegicus
cccagtgtttctcagggatgtgcct

SEQ ID NO: 247913 - DNA, 25 bp, Rattus norvegicus
cccagtgtttctgagggatgtgcct

SEQ ID NO: 247914 - DNA, 25 bp, Rattus norvegicus
cccagttaaggcctgtgacctgcgt

SEQ ID NO: 247915 - DNA, 25 bp, Rattus norvegicus
cccagttaaggcgtgtgacctgcgt

SEQ ID NO: 247916 - DNA, 25 bp, Rattus norvegicus
cccagttactcgctattgaaagtat

SEQ ID NO: 247917 - DNA, 25 bp, Rattus norvegicus
cccagttactcggtattgaaagtat

SEQ ID NO: 247918 - DNA, 25 bp, Rattus norvegicus
cccagttagggcacatcgaagaatg

SEQ ID NO: 247919 - DNA, 25 bp, Rattus norvegicus
cccagttagggctcatcgaagaatg

SEQ ID NO: 247920 - DNA, 25 bp, Rattus norvegicus
cccagttatctgatcttatcaatat

SEQ ID NO: 247921 - DNA, 25 bp, Rattus norvegicus
cccagttatctgttcttatcaatat

SEQ ID NO: 247922 - DNA, 25 bp, Rattus norvegicus
cccagttcactcaggtgtcacaata

SEQ ID NO: 247923 - DNA, 25 bp, Rattus norvegicus
cccagttcactctggtgtcacaata

SEQ ID NO: 247924 - DNA, 25 bp, Rattus norvegicus
cccagttcatgacgcctggctattg

SEQ ID NO: 247925 - DNA, 25 bp, Rattus norvegicus
cccagttcatgaggcctggctattg

SEQ ID NO: 247926 - DNA, 25 bp, Rattus norvegicus
cccagttccagaatccagacagtat

SEQ ID NO: 247927 - DNA, 25 bp, Rattus norvegicus
cccagttccagattccagacagtat

SEQ ID NO: 247928 - DNA, 25 bp, Rattus norvegicus
cccagttccctaatgccttgaagaa

SEQ ID NO: 247929 - DNA, 25 bp, Rattus norvegicus
cccagttccctattgccttgaagaa

SEQ ID NO: 247930 - DNA, 25 bp, Rattus norvegicus
cccagttcctgtagtgaccgggaga

SEQ ID NO: 247931 - DNA, 25 bp, Rattus norvegicus
cccagttcctgttgtgaccgggaga

SEQ ID NO: 247932 - DNA, 25 bp, Rattus norvegicus
cccagttctgcgacttcataattgt

SEQ ID NO: 247933 - DNA, 25 bp, Rattus norvegicus
cccagttctgcgtcttcataattgt

SEQ ID NO: 247934 - DNA, 25 bp, Rattus norvegicus
cccagttgacccagtaaggccatgg

SEQ ID NO: 247935 - DNA, 25 bp, Rattus norvegicus
cccagttgaccctgtaaggccatgg

SEQ ID NO: 247936 - DNA, 25 bp, Rattus norvegicus
cccagttgcttgattggtagcccaa

SEQ ID NO: 247937 - DNA, 25 bp, Rattus norvegicus
cccagttgcttgtttggtagcccaa

SEQ ID NO: 247938 - DNA, 25 bp, Rattus norvegicus
cccagtttagagcaggctgttcaaa

SEQ ID NO: 247939 - DNA, 25 bp, Rattus norvegicus
cccagtttagaggaggctgttcaaa

SEQ ID NO: 247940 - DNA, 25 bp, Rattus norvegicus
cccagtttcagtagtcttttaaatg

SEQ ID NO: 247941 - DNA, 25 bp, Rattus norvegicus
cccagtttcagttgtcttttaaatg

SEQ ID NO: 247942 - DNA, 25 bp, Rattus norvegicus
cccagtttgtgaactgcttttcaag

SEQ ID NO: 247943 - DNA, 25 bp, Rattus norvegicus
cccagtttgtgatctgcttttcaag

SEQ ID NO: 247944 - DNA, 25 bp, Rattus norvegicus
cccataatctaaccgcctgggaggg

SEQ ID NO: 247945 - DNA, 25 bp, Rattus norvegicus
cccataatctaagcgcctgggaggg

SEQ ID NO: 247946 - DNA, 25 bp, Rattus norvegicus
cccatacaagacacctcgcaaaagt

SEQ ID NO: 247947 - DNA, 25 bp, Rattus norvegicus
cccatacaagactcctcgcaaaagt

SEQ ID NO: 247948 - DNA, 25 bp, Rattus norvegicus
cccatacccttgctttgtaagttga

SEQ ID NO: 247949 - DNA, 25 bp, Rattus norvegicus
cccatacccttggtttgtaagttga

SEQ ID NO: 247950 - DNA, 25 bp, Rattus norvegicus
cccatacgtcgtcgaaatgagtcat

SEQ ID NO: 247951 - DNA, 25 bp, Rattus norvegicus
cccatacgtcgtggaaatgagtcat

SEQ ID NO: 247952 - DNA, 25 bp, Rattus norvegicus
cccatactctgccatatctatcaaa

SEQ ID NO: 247953 - DNA, 25 bp, Rattus norvegicus
cccatactctgcgatatctatcaaa

SEQ ID NO: 247954 - DNA, 25 bp, Rattus norvegicus
cccatagcccagctctttgagtaac

SEQ ID NO: 247955 - DNA, 25 bp, Rattus norvegicus
cccatagcccaggtctttgagtaac

SEQ ID NO: 247956 - DNA, 25 bp, Rattus norvegicus
cccatagccgacacgtggtggtgtg

SEQ ID NO: 247957 - DNA, 25 bp, Rattus norvegicus
cccatagccgactcgtggtggtgtg

SEQ ID NO: 247958 - DNA, 25 bp, Rattus norvegicus
cccatagcgtgacgcctacagttat

SEQ ID NO: 247959 - DNA, 25 bp, Rattus norvegicus
cccatagcgtgaggcctacagttat

SEQ ID NO: 247960 - DNA, 25 bp, Rattus norvegicus
cccatagctattcctggcttgctgt

SEQ ID NO: 247961 - DNA, 25 bp, Rattus norvegicus
cccatagctattgctggcttgctgt

SEQ ID NO: 247962 - DNA, 25 bp, Rattus norvegicus
cccataggagatctctttatcgatt

SEQ ID NO: 247963 - DNA, 25 bp, Rattus norvegicus
cccataggagatgtctttatcgatt

SEQ ID NO: 247964 - DNA, 25 bp, Rattus norvegicus
cccatatgcctcatccagtttagaa

SEQ ID NO: 247965 - DNA, 25 bp, Rattus norvegicus
cccatatgcctcttccagtttagaa

SEQ ID NO: 247966 - DNA, 25 bp, Rattus norvegicus
cccatatggctcctctctaatatat

SEQ ID NO: 247967 - DNA, 25 bp, Rattus norvegicus
cccatatggctcgtctctaatatat

SEQ ID NO: 247968 - DNA, 25 bp, Rattus norvegicus
cccatatgtgggaggctctgcatgt

SEQ ID NO: 247969 - DNA, 25 bp, Rattus norvegicus
cccatatgtgggtggctctgcatgt

SEQ ID NO: 247970 - DNA, 25 bp, Rattus norvegicus
cccatcaccagtacatccaatagaa

SEQ ID NO: 247971 - DNA, 25 bp, Rattus norvegicus
cccatcaccagttcatccaatagaa

SEQ ID NO: 247972 - DNA, 25 bp, Rattus norvegicus
cccatcaccttcaggagtgaggact

SEQ ID NO: 247973 - DNA, 25 bp, Rattus norvegicus
cccatcaccttctggagtgaggact

SEQ ID NO: 247974 - DNA, 25 bp, Rattus norvegicus
cccatcatggtgctaacaagccctg

SEQ ID NO: 247975 - DNA, 25 bp, Rattus norvegicus
cccatcatggtggtaacaagccctg

SEQ ID NO: 247976 - DNA, 25 bp, Rattus norvegicus
cccatcatgtttacagggttgcggg

SEQ ID NO: 247977 - DNA, 25 bp, Rattus norvegicus
cccatcatgttttcagggttgcggg

SEQ ID NO: 247978 - DNA, 25 bp, Rattus norvegicus
cccatcattgggaacctacgatatg

SEQ ID NO: 247979 - DNA, 25 bp, Rattus norvegicus
cccatcattgggtacctacgatatg

SEQ ID NO: 247980 - DNA, 25 bp, Rattus norvegicus
cccatcattgttacgtggacactga

SEQ ID NO: 247981 - DNA, 25 bp, Rattus norvegicus
cccatcattgtttcgtggacactga

SEQ ID NO: 247982 - DNA, 25 bp, Rattus norvegicus
cccatccaatttagtacttgtcctg

SEQ ID NO: 247983 - DNA, 25 bp, Rattus norvegicus
cccatccaattttgtacttgtcctg

SEQ ID NO: 247984 - DNA, 25 bp, Rattus norvegicus
cccatcccacgtagtattcagaata

SEQ ID NO: 247985 - DNA, 25 bp, Rattus norvegicus
cccatcccacgttgtattcagaata

SEQ ID NO: 247986 - DNA, 25 bp, Rattus norvegicus
cccatcccagttataactctaagca

SEQ ID NO: 247987 - DNA, 25 bp, Rattus norvegicus
cccatcccagttttaactctaagca

SEQ ID NO: 247988 - DNA, 25 bp, Rattus norvegicus
cccatccctaaaacctgagggtgaa

SEQ ID NO: 247989 - DNA, 25 bp, Rattus norvegicus
cccatccctaaatcctgagggtgaa

SEQ ID NO: 247990 - DNA, 25 bp, Rattus norvegicus
cccatccctgtactttgtaatgtca

SEQ ID NO: 247991 - DNA, 25 bp, Rattus norvegicus
cccatccctgtagtttgtaatgtca

SEQ ID NO: 247992 - DNA, 25 bp, Rattus norvegicus
cccatccctgtgatgtttctaggaa

SEQ ID NO: 247993 - DNA, 25 bp, Rattus norvegicus
cccatccctgtgttgtttctaggaa

SEQ ID NO: 247994 - DNA, 25 bp, Rattus norvegicus
cccatcctggtccaaggaacggcag

SEQ ID NO: 247995 - DNA, 25 bp, Rattus norvegicus
cccatcctggtcgaaggaacggcag

SEQ ID NO: 247996 - DNA, 25 bp, Rattus norvegicus
cccatccttgtgatcagcatgttaa

SEQ ID NO: 247997 - DNA, 25 bp, Rattus norvegicus
cccatccttgtgttcagcatgttaa

SEQ ID NO: 247998 - DNA, 25 bp, Rattus norvegicus
cccatcgggacccacagagcttggg

SEQ ID NO: 247999 - DNA, 25 bp, Rattus norvegicus
cccatcgggaccgacagagcttggg

SEQ ID NO: 248000 - DNA, 25 bp, Rattus norvegicus
cccatcgtgggtcctattcttatag

SEQ ID NO: 248001 - DNA, 25 bp, Rattus norvegicus
cccatcgtgggtgctattcttatag

SEQ ID NO: 248002 - DNA, 25 bp, Rattus norvegicus
cccatctcactgactgtgatgttag

SEQ ID NO: 248003 - DNA, 25 bp, Rattus norvegicus
cccatctcactgtctgtgatgttag

SEQ ID NO: 248004 - DNA, 25 bp, Rattus norvegicus
cccatctctgtcagtggtcagtaga

SEQ ID NO: 248005 - DNA, 25 bp, Rattus norvegicus
cccatctctgtctgtggtcagtaga

SEQ ID NO: 248006 - DNA, 25 bp, Rattus norvegicus
cccatctcttccaattagacgtatg

SEQ ID NO: 248007 - DNA, 25 bp, Rattus norvegicus
cccatctcttcctattagacgtatg

SEQ ID NO: 248008 - DNA, 25 bp, Rattus norvegicus
cccatctgcagcctgactagagagg

SEQ ID NO: 248009 - DNA, 25 bp, Rattus norvegicus
cccatctgcagcgtgactagagagg

SEQ ID NO: 248010 - DNA, 25 bp, Rattus norvegicus
cccatctgctccaatgaggctaata

SEQ ID NO: 248011 - DNA, 25 bp, Rattus norvegicus
cccatctgctcctatgaggctaata

SEQ ID NO: 248012 - DNA, 25 bp, Rattus norvegicus
cccatctggttcattttgatataaa

SEQ ID NO: 248013 - DNA, 25 bp, Rattus norvegicus
cccatctggttctttttgatataaa

SEQ ID NO: 248014 - DNA, 25 bp, Rattus norvegicus
cccatctgttatcccagtatctcag

SEQ ID NO: 248015 - DNA, 25 bp, Rattus norvegicus
cccatctgttatgccagtatctcag

SEQ ID NO: 248016 - DNA, 25 bp, Rattus norvegicus
cccatcttctagagttccgacttaa

SEQ ID NO: 248017 - DNA, 25 bp, Rattus norvegicus
cccatcttctagtgttccgacttaa

SEQ ID NO: 248018 - DNA, 25 bp, Rattus norvegicus
cccatcttcttcattcagatcatta

SEQ ID NO: 248019 - DNA, 25 bp, Rattus norvegicus
cccatcttcttctttcagatcatta

SEQ ID NO: 248020 - DNA, 25 bp, Rattus norvegicus
cccatcttgggcactcagaaaggtt

SEQ ID NO: 248021 - DNA, 25 bp, Rattus norvegicus
cccatcttgggctctcagaaaggtt

SEQ ID NO: 248022 - DNA, 25 bp, Rattus norvegicus
cccatctttcagaaggcatttgtta

SEQ ID NO: 248023 - DNA, 25 bp, Rattus norvegicus
cccatctttcagtaggcatttgtta

SEQ ID NO: 248024 - DNA, 25 bp, Rattus norvegicus
cccatctttctcaggcacagaagaa

SEQ ID NO: 248025 - DNA, 25 bp, Rattus norvegicus
cccatctttctctggcacagaagaa

SEQ ID NO: 248026 - DNA, 25 bp, Rattus norvegicus
cccatctttcttccattcaatattt

SEQ ID NO: 248027 - DNA, 25 bp, Rattus norvegicus
cccatctttcttgcattcaatattt

SEQ ID NO: 248028 - DNA, 25 bp, Rattus norvegicus
cccatctttgggaactttcatctag

SEQ ID NO: 248029 - DNA, 25 bp, Rattus norvegicus
cccatctttgggtactttcatctag

SEQ ID NO: 248030 - DNA, 25 bp, Rattus norvegicus
cccatgactctaagtgtggagaagg

SEQ ID NO: 248031 - DNA, 25 bp, Rattus norvegicus
cccatgactctatgtgtggagaagg

SEQ ID NO: 248032 - DNA, 25 bp, Rattus norvegicus
cccatgataatcaccagttctatcc

SEQ ID NO: 248033 - DNA, 25 bp, Rattus norvegicus
cccatgataatctccagttctatcc

SEQ ID NO: 248034 - DNA, 25 bp, Rattus norvegicus
cccatgatccccacggaggaggagg

SEQ ID NO: 248035 - DNA, 25 bp, Rattus norvegicus
cccatgatcccctcggaggaggagg

SEQ ID NO: 248036 - DNA, 25 bp, Rattus norvegicus
cccatgatgcttctttctcacagga

SEQ ID NO: 248037 - DNA, 25 bp, Rattus norvegicus
cccatgatgcttgtttctcacagga

SEQ ID NO: 248038 - DNA, 25 bp, Rattus norvegicus
cccatgcaactgcttgtaactcaag

SEQ ID NO: 248039 - DNA, 25 bp, Rattus norvegicus
cccatgcaactggttgtaactcaag

SEQ ID NO: 248040 - DNA, 25 bp, Rattus norvegicus
cccatgcatcatcgagaggtgacat

SEQ ID NO: 248041 - DNA, 25 bp, Rattus norvegicus
cccatgcatcatggagaggtgacat

SEQ ID NO: 248042 - DNA, 25 bp, Rattus norvegicus
cccatgcatggtcttagatactttt

SEQ ID NO: 248043 - DNA, 25 bp, Rattus norvegicus
cccatgcatggtgttagatactttt

SEQ ID NO: 248044 - DNA, 25 bp, Rattus norvegicus
cccatgccccagattctaaggaaag

SEQ ID NO: 248045 - DNA, 25 bp, Rattus norvegicus
cccatgccccagtttctaaggaaag

SEQ ID NO: 248046 - DNA, 25 bp, Rattus norvegicus
cccatgctacttattctgagggcag

SEQ ID NO: 248047 - DNA, 25 bp, Rattus norvegicus
cccatgctactttttctgagggcag

SEQ ID NO: 248048 - DNA, 25 bp, Rattus norvegicus
cccatgctgagccaccataggaaat

SEQ ID NO: 248049 - DNA, 25 bp, Rattus norvegicus
cccatgctgagcgaccataggaaat

SEQ ID NO: 248050 - DNA, 25 bp, Rattus norvegicus
cccatgctgaggcttctaatgagga

SEQ ID NO: 248051 - DNA, 25 bp, Rattus norvegicus
cccatgctgagggttctaatgagga

SEQ ID NO: 248052 - DNA, 25 bp, Rattus norvegicus
cccatgctggtaatttttcaatagt

SEQ ID NO: 248053 - DNA, 25 bp, Rattus norvegicus
cccatgctggtattttttcaatagt

SEQ ID NO: 248054 - DNA, 25 bp, Rattus norvegicus
cccatgctgtatacatgctatatac

SEQ ID NO: 248055 - DNA, 25 bp, Rattus norvegicus
cccatgctgtattcatgctatatac

SEQ ID NO: 248056 - DNA, 25 bp, Rattus norvegicus
cccatggaagccctgagttactcag

SEQ ID NO: 248057 - DNA, 25 bp, Rattus norvegicus
cccatggaagccgtgagttactcag

SEQ ID NO: 248058 - DNA, 25 bp, Rattus norvegicus
cccatggaggacatgcagaacctgt

SEQ ID NO: 248059 - DNA, 25 bp, Rattus norvegicus
cccatggaggacttgcagaacctgt

SEQ ID NO: 248060 - DNA, 25 bp, Rattus norvegicus
cccatggccttgatcctgaaaatga

SEQ ID NO: 248061 - DNA, 25 bp, Rattus norvegicus
cccatggccttgttcctgaaaatga

SEQ ID NO: 248062 - DNA, 25 bp, Rattus norvegicus
cccatggcgggtagcgacctggcta

SEQ ID NO: 248063 - DNA, 25 bp, Rattus norvegicus
cccatggcgggttgcgacctggcta

SEQ ID NO: 248064 - DNA, 25 bp, Rattus norvegicus
cccatggctggcagggaacgcccat

SEQ ID NO: 248065 - DNA, 25 bp, Rattus norvegicus
cccatggctggctgggaacgcccat

SEQ ID NO: 248066 - DNA, 25 bp, Rattus norvegicus
cccatggcttcgagtcactgaaatt

SEQ ID NO: 248067 - DNA, 25 bp, Rattus norvegicus
cccatggcttcgtgtcactgaaatt

SEQ ID NO: 248068 - DNA, 25 bp, Rattus norvegicus
cccatgggaggtccgttgacttaga

SEQ ID NO: 248069 - DNA, 25 bp, Rattus norvegicus
cccatgggaggtgcgttgacttaga

SEQ ID NO: 248070 - DNA, 25 bp, Rattus norvegicus
cccatgggccatattgatccaaatt

SEQ ID NO: 248071 - DNA, 25 bp, Rattus norvegicus
cccatgggccattttgatccaaatt

SEQ ID NO: 248072 - DNA, 25 bp, Rattus norvegicus
cccatggtctctacctttgtaaagg

SEQ ID NO: 248073 - DNA, 25 bp, Rattus norvegicus
cccatggtctcttcctttgtaaagg

SEQ ID NO: 248074 - DNA, 25 bp, Rattus norvegicus
cccatggtgataccgtgaagagctt

SEQ ID NO: 248075 - DNA, 25 bp, Rattus norvegicus
cccatggtgatagcgtgaagagctt

SEQ ID NO: 248076 - DNA, 25 bp, Rattus norvegicus
cccatggttccaataaagtctctct

SEQ ID NO: 248077 - DNA, 25 bp, Rattus norvegicus
cccatggttccattaaagtctctct

SEQ ID NO: 248078 - DNA, 25 bp, Rattus norvegicus
cccatgtagcccctgtgagtagtga

SEQ ID NO: 248079 - DNA, 25 bp, Rattus norvegicus
cccatgtagcccgtgtgagtagtga

SEQ ID NO: 248080 - DNA, 25 bp, Rattus norvegicus
cccatgtatgctccactgggtttct

SEQ ID NO: 248081 - DNA, 25 bp, Rattus norvegicus
cccatgtatgctgcactgggtttct

SEQ ID NO: 248082 - DNA, 25 bp, Rattus norvegicus
cccatgtcctgtaaagtgtctctgt

SEQ ID NO: 248083 - DNA, 25 bp, Rattus norvegicus
cccatgtcctgttaagtgtctctgt

SEQ ID NO: 248084 - DNA, 25 bp, Rattus norvegicus
cccatgtctttgcttttggtggcta

SEQ ID NO: 248085 - DNA, 25 bp, Rattus norvegicus
cccatgtctttggttttggtggcta

SEQ ID NO: 248086 - DNA, 25 bp, Rattus norvegicus
cccatgtgcatgcaagaaatgttca

SEQ ID NO: 248087 - DNA, 25 bp, Rattus norvegicus
cccatgtgcatggaagaaatgttca

SEQ ID NO: 248088 - DNA, 25 bp, Rattus norvegicus
cccatgtgtcttaccacgggagaga

SEQ ID NO: 248089 - DNA, 25 bp, Rattus norvegicus
cccatgtgtctttccacgggagaga

SEQ ID NO: 248090 - DNA, 25 bp, Rattus norvegicus
cccatgtttctgcagtcatccaata

SEQ ID NO: 248091 - DNA, 25 bp, Rattus norvegicus
cccatgtttctggagtcatccaata

SEQ ID NO: 248092 - DNA, 25 bp, Rattus norvegicus
cccattaacagtactaccgtgaaat

SEQ ID NO: 248093 - DNA, 25 bp, Rattus norvegicus
cccattaacagttctaccgtgaaat

SEQ ID NO: 248094 - DNA, 25 bp, Rattus norvegicus
cccattaattagaggtggcttctca

SEQ ID NO: 248095 - DNA, 25 bp, Rattus norvegicus
cccattaattagtggtggcttctca

SEQ ID NO: 248096 - DNA, 25 bp, Rattus norvegicus
cccattatgctgattcctgaggata

SEQ ID NO: 248097 - DNA, 25 bp, Rattus norvegicus
cccattatgctgtttcctgaggata

SEQ ID NO: 248098 - DNA, 25 bp, Rattus norvegicus
cccattcaacatcggattttgccag

SEQ ID NO: 248099 - DNA, 25 bp, Rattus norvegicus
cccattcaacatgggattttgccag

SEQ ID NO: 248100 - DNA, 25 bp, Rattus norvegicus
cccattcagcttactgtgctcagaa

SEQ ID NO: 248101 - DNA, 25 bp, Rattus norvegicus
cccattcagctttctgtgctcagaa

SEQ ID NO: 248102 - DNA, 25 bp, Rattus norvegicus
cccattcataaaatctccgtcggct

SEQ ID NO: 248103 - DNA, 25 bp, Rattus norvegicus
cccattcataaattctccgtcggct

SEQ ID NO: 248104 - DNA, 25 bp, Rattus norvegicus
cccattcatcttccctgcttttgta

SEQ ID NO: 248105 - DNA, 25 bp, Rattus norvegicus
cccattcatcttgcctgcttttgta

SEQ ID NO: 248106 - DNA, 25 bp, Rattus norvegicus
cccattcccgcacaattttcattgg

SEQ ID NO: 248107 - DNA, 25 bp, Rattus norvegicus
cccattcccgcagaattttcattgg

SEQ ID NO: 248108 - DNA, 25 bp, Rattus norvegicus
cccattcctcagaaatccctagtta

SEQ ID NO: 248109 - DNA, 25 bp, Rattus norvegicus
cccattcctcagtaatccctagtta

SEQ ID NO: 248110 - DNA, 25 bp, Rattus norvegicus
cccattcctggtattgctattattt

SEQ ID NO: 248111 - DNA, 25 bp, Rattus norvegicus
cccattcctggttttgctattattt

SEQ ID NO: 248112 - DNA, 25 bp, Rattus norvegicus
cccattcttcacattcactatttag

SEQ ID NO: 248113 - DNA, 25 bp, Rattus norvegicus
cccattcttcactttcactatttag

SEQ ID NO: 248114 - DNA, 25 bp, Rattus norvegicus
cccattgaagggaaccaggcaggtg

SEQ ID NO: 248115 - DNA, 25 bp, Rattus norvegicus
cccattgaagggtaccaggcaggtg

SEQ ID NO: 248116 - DNA, 25 bp, Rattus norvegicus
cccattgagtcaacttcctggtact

SEQ ID NO: 248117 - DNA, 25 bp, Rattus norvegicus
cccattgagtcatcttcctggtact

SEQ ID NO: 248118 - DNA, 25 bp, Rattus norvegicus
cccattgcagttccccaactattta

SEQ ID NO: 248119 - DNA, 25 bp, Rattus norvegicus
cccattgcagttgcccaactattta

SEQ ID NO: 248120 - DNA, 25 bp, Rattus norvegicus
cccattgctgccctacattttagta

SEQ ID NO: 248121 - DNA, 25 bp, Rattus norvegicus
cccattgctgccgtacattttagta

SEQ ID NO: 248122 - DNA, 25 bp, Rattus norvegicus
cccattgtggagactctgcggcaga

SEQ ID NO: 248123 - DNA, 25 bp, Rattus norvegicus
cccattgtggagtctctgcggcaga

SEQ ID NO: 248124 - DNA, 25 bp, Rattus norvegicus
cccatttaacaacgtgtgtactgta

SEQ ID NO: 248125 - DNA, 25 bp, Rattus norvegicus
cccatttaacaaggtgtgtactgta

SEQ ID NO: 248126 - DNA, 25 bp, Rattus norvegicus
cccatttcagcaacctagtgcttta

SEQ ID NO: 248127 - DNA, 25 bp, Rattus norvegicus
cccatttcagcatcctagtgcttta

SEQ ID NO: 248128 - DNA, 25 bp, Rattus norvegicus
cccatttccatacctgctatattgt

SEQ ID NO: 248129 - DNA, 25 bp, Rattus norvegicus
cccatttccatagctgctatattgt

SEQ ID NO: 248130 - DNA, 25 bp, Rattus norvegicus
cccatttctctcaccttgaaagact

SEQ ID NO: 248131 - DNA, 25 bp, Rattus norvegicus
cccatttctctctccttgaaagact

SEQ ID NO: 248132 - DNA, 25 bp, Rattus norvegicus
cccatttgaaatccgttagcgagtt

SEQ ID NO: 248133 - DNA, 25 bp, Rattus norvegicus
cccatttgaaatgcgttagcgagtt

SEQ ID NO: 248134 - DNA, 25 bp, Rattus norvegicus
cccatttgctgcaatgccagtggtt

SEQ ID NO: 248135 - DNA, 25 bp, Rattus norvegicus
cccatttgctgctatgccagtggtt

SEQ ID NO: 248136 - DNA, 25 bp, Rattus norvegicus
cccatttgtagtctggctcctatat

SEQ ID NO: 248137 - DNA, 25 bp, Rattus norvegicus
cccatttgtagtgtggctcctatat

SEQ ID NO: 248138 - DNA, 25 bp, Rattus norvegicus
cccatttgtgctcttctcggtatat

SEQ ID NO: 248139 - DNA, 25 bp, Rattus norvegicus
cccatttgtgctgttctcggtatat

SEQ ID NO: 248140 - DNA, 25 bp, Rattus norvegicus
cccattttccttaggtcagagaggc

SEQ ID NO: 248141 - DNA, 25 bp, Rattus norvegicus
cccattttcctttggtcagagaggc

SEQ ID NO: 248142 - DNA, 25 bp, Rattus norvegicus
cccattttgacaaacgcaggtctaa

SEQ ID NO: 248143 - DNA, 25 bp, Rattus norvegicus
cccattttgacatacgcaggtctaa

SEQ ID NO: 248144 - DNA, 25 bp, Rattus norvegicus
cccattttggcccataggtagaaag

SEQ ID NO: 248145 - DNA, 25 bp, Rattus norvegicus
cccattttggccgataggtagaaag

SEQ ID NO: 248146 - DNA, 25 bp, Rattus norvegicus
cccattttgtttactagtggccaat

SEQ ID NO: 248147 - DNA, 25 bp, Rattus norvegicus
cccattttgttttctagtggccaat

SEQ ID NO: 248148 - DNA, 25 bp, Rattus norvegicus
cccatttttatgctcagtcttagca

SEQ ID NO: 248149 - DNA, 25 bp, Rattus norvegicus
cccatttttatggtcagtcttagca

SEQ ID NO: 248150 - DNA, 25 bp, Rattus norvegicus
ccccaaactattcttctagcttgtg

SEQ ID NO: 248151 - DNA, 25 bp, Rattus norvegicus
ccccaaactattgttctagcttgtg

SEQ ID NO: 248152 - DNA, 25 bp, Rattus norvegicus
ccccaaactgttcttacgtcatgag

SEQ ID NO: 248153 - DNA, 25 bp, Rattus norvegicus
ccccaaactgttgttacgtcatgag

SEQ ID NO: 248154 - DNA, 25 bp, Rattus norvegicus
ccccaaacttcacgatgcattgagt

SEQ ID NO: 248155 - DNA, 25 bp, Rattus norvegicus
ccccaaacttcaggatgcattgagt

SEQ ID NO: 248156 - DNA, 25 bp, Rattus norvegicus
ccccaaactttgagtctgctgtgaa

SEQ ID NO: 248157 - DNA, 25 bp, Rattus norvegicus
ccccaaactttgtgtctgctgtgaa

SEQ ID NO: 248158 - DNA, 25 bp, Rattus norvegicus
ccccaaagaccacagatacattatt

SEQ ID NO: 248159 - DNA, 25 bp, Rattus norvegicus
ccccaaagaccagagatacattatt

SEQ ID NO: 248160 - DNA, 25 bp, Rattus norvegicus
ccccaaagcatcatgttctgactga

SEQ ID NO: 248161 - DNA, 25 bp, Rattus norvegicus
ccccaaagcatcttgttctgactga

SEQ ID NO: 248162 - DNA, 25 bp, Rattus norvegicus
ccccaaagcctgcatgaatgtttta

SEQ ID NO: 248163 - DNA, 25 bp, Rattus norvegicus
ccccaaagcctggatgaatgtttta

SEQ ID NO: 248164 - DNA, 25 bp, Rattus norvegicus
ccccaaagcttcagtttctgtgaag

SEQ ID NO: 248165 - DNA, 25 bp, Rattus norvegicus
ccccaaagcttctgtttctgtgaag

SEQ ID NO: 248166 - DNA, 25 bp, Rattus norvegicus
ccccaaaggaatagcgactcatagg

SEQ ID NO: 248167 - DNA, 25 bp, Rattus norvegicus
ccccaaaggaattgcgactcatagg

SEQ ID NO: 248168 - DNA, 25 bp, Rattus norvegicus
ccccaaataactcgtctatatgagt

SEQ ID NO: 248169 - DNA, 25 bp, Rattus norvegicus
ccccaaataactggtctatatgagt

SEQ ID NO: 248170 - DNA, 25 bp, Rattus norvegicus
ccccaaatgactctcttttagtgat

SEQ ID NO: 248171 - DNA, 25 bp, Rattus norvegicus
ccccaaatgactgtcttttagtgat

SEQ ID NO: 248172 - DNA, 25 bp, Rattus norvegicus
ccccaaatgtctagtatcttatgtt

SEQ ID NO: 248173 - DNA, 25 bp, Rattus norvegicus
ccccaaatgtcttgtatcttatgtt

SEQ ID NO: 248174 - DNA, 25 bp, Rattus norvegicus
ccccaaattgtaacctgagaagaaa

SEQ ID NO: 248175 - DNA, 25 bp, Rattus norvegicus
ccccaaattgtatcctgagaagaaa

SEQ ID NO: 248176 - DNA, 25 bp, Rattus norvegicus
ccccaacatcaacagtgtgagaaat

SEQ ID NO: 248177 - DNA, 25 bp, Rattus norvegicus
ccccaacatcaagagtgtgagaaat

SEQ ID NO: 248178 - DNA, 25 bp, Rattus norvegicus
ccccaacatggcagtcggtaacatg

SEQ ID NO: 248179 - DNA, 25 bp, Rattus norvegicus
ccccaacatggctgtcggtaacatg

SEQ ID NO: 248180 - DNA, 25 bp, Rattus norvegicus
ccccaacatttgactactgaaaaga

SEQ ID NO: 248181 - DNA, 25 bp, Rattus norvegicus
ccccaacatttgtctactgaaaaga

SEQ ID NO: 248182 - DNA, 25 bp, Rattus norvegicus
ccccaaccactccatgttaatattt

SEQ ID NO: 248183 - DNA, 25 bp, Rattus norvegicus
ccccaaccactcgatgttaatattt

SEQ ID NO: 248184 - DNA, 25 bp, Rattus norvegicus
ccccaacccgtgatatatcagtaaa

SEQ ID NO: 248185 - DNA, 25 bp, Rattus norvegicus
ccccaacccgtgttatatcagtaaa

SEQ ID NO: 248186 - DNA, 25 bp, Rattus norvegicus
ccccaactggtcactaaagatcact

SEQ ID NO: 248187 - DNA, 25 bp, Rattus norvegicus
ccccaactggtctctaaagatcact

SEQ ID NO: 248188 - DNA, 25 bp, Rattus norvegicus
ccccaactgtggagttagcaactgt

SEQ ID NO: 248189 - DNA, 25 bp, Rattus norvegicus
ccccaactgtggtgttagcaactgt

SEQ ID NO: 248190 - DNA, 25 bp, Rattus norvegicus
ccccaacttgtgaatctgattcttg

SEQ ID NO: 248191 - DNA, 25 bp, Rattus norvegicus
ccccaacttgtgtatctgattcttg

SEQ ID NO: 248192 - DNA, 25 bp, Rattus norvegicus
ccccaagaagaaccctttgagtcgc

SEQ ID NO: 248193 - DNA, 25 bp, Rattus norvegicus
ccccaagaagaagcctttgagtcgc

SEQ ID NO: 248194 - DNA, 25 bp, Rattus norvegicus
ccccaagactcgcagcggtggaatg

SEQ ID NO: 248195 - DNA, 25 bp, Rattus norvegicus
ccccaagactcggagcggtggaatg

SEQ ID NO: 248196 - DNA, 25 bp, Rattus norvegicus
ccccaagatgtgaatgccatccgtg

SEQ ID NO: 248197 - DNA, 25 bp, Rattus norvegicus
ccccaagatgtgtatgccatccgtg

SEQ ID NO: 248198 - DNA, 25 bp, Rattus norvegicus
ccccaagcctagatgtgctttttgt

SEQ ID NO: 248199 - DNA, 25 bp, Rattus norvegicus
ccccaagcctagttgtgctttttgt

SEQ ID NO: 248200 - DNA, 25 bp, Rattus norvegicus
ccccaagcgtatacttcatgtttaa

SEQ ID NO: 248201 - DNA, 25 bp, Rattus norvegicus
ccccaagcgtattcttcatgtttaa

SEQ ID NO: 248202 - DNA, 25 bp, Rattus norvegicus
ccccaagctcagatcagcagggaac

SEQ ID NO: 248203 - DNA, 25 bp, Rattus norvegicus
ccccaagctcagttcagcagggaac

SEQ ID NO: 248204 - DNA, 25 bp, Rattus norvegicus
ccccaagctgcgatttttatagtag

SEQ ID NO: 248205 - DNA, 25 bp, Rattus norvegicus
ccccaagctgcgttttttatagtag

SEQ ID NO: 248206 - DNA, 25 bp, Rattus norvegicus
ccccaaggactgaggacacaaatct

SEQ ID NO: 248207 - DNA, 25 bp, Rattus norvegicus
ccccaaggactgtggacacaaatct

SEQ ID NO: 248208 - DNA, 25 bp, Rattus norvegicus
ccccaaggcctgagcagtttatcat

SEQ ID NO: 248209 - DNA, 25 bp, Rattus norvegicus
ccccaaggcctgtgcagtttatcat

SEQ ID NO: 248210 - DNA, 25 bp, Rattus norvegicus
ccccaaggtggactccagcgtggta

SEQ ID NO: 248211 - DNA, 25 bp, Rattus norvegicus
ccccaaggtggagtccagcgtggta

SEQ ID NO: 248212 - DNA, 25 bp, Rattus norvegicus
ccccaagtaccgaggcggtggagat

SEQ ID NO: 248213 - DNA, 25 bp, Rattus norvegicus
ccccaagtaccgtggcggtggagat

SEQ ID NO: 248214 - DNA, 25 bp, Rattus norvegicus
ccccaagtctgcatgtatttcaagt

SEQ ID NO: 248215 - DNA, 25 bp, Rattus norvegicus
ccccaagtctgcttgtatttcaagt

SEQ ID NO: 248216 - DNA, 25 bp, Rattus norvegicus
ccccaataaagcctctctgggcttg

SEQ ID NO: 248217 - DNA, 25 bp, Rattus norvegicus
ccccaataaagcgtctctgggcttg

SEQ ID NO: 248218 - DNA, 25 bp, Rattus norvegicus
ccccaatccgctattttgataactc

SEQ ID NO: 248219 - DNA, 25 bp, Rattus norvegicus
ccccaatccgcttttttgataactc

SEQ ID NO: 248220 - DNA, 25 bp, Rattus norvegicus
ccccaatccttgcatttcttgtaga

SEQ ID NO: 248221 - DNA, 25 bp, Rattus norvegicus
ccccaatccttggatttcttgtaga

SEQ ID NO: 248222 - DNA, 25 bp, Rattus norvegicus
ccccaatcttgaacagctctggagt

SEQ ID NO: 248223 - DNA, 25 bp, Rattus norvegicus
ccccaatcttgatcagctctggagt

SEQ ID NO: 248224 - DNA, 25 bp, Rattus norvegicus
ccccaatgtcaaagtggcctccgat

SEQ ID NO: 248225 - DNA, 25 bp, Rattus norvegicus
ccccaatgtcaatgtggcctccgat

SEQ ID NO: 248226 - DNA, 25 bp, Rattus norvegicus
ccccaattccttctgatactttata

SEQ ID NO: 248227 - DNA, 25 bp, Rattus norvegicus
ccccaattccttgtgatactttata

SEQ ID NO: 248228 - DNA, 25 bp, Rattus norvegicus
ccccaattcgaactctccattagga

SEQ ID NO: 248229 - DNA, 25 bp, Rattus norvegicus
ccccaattcgaagtctccattagga

SEQ ID NO: 248230 - DNA, 25 bp, Rattus norvegicus
ccccaattctgcaggtggaggttgt

SEQ ID NO: 248231 - DNA, 25 bp, Rattus norvegicus
ccccaattctgctggtggaggttgt

SEQ ID NO: 248232 - DNA, 25 bp, Rattus norvegicus
ccccaattctggcaatcagagccag

SEQ ID NO: 248233 - DNA, 25 bp, Rattus norvegicus
ccccaattctgggaatcagagccag

SEQ ID NO: 248234 - DNA, 25 bp, Rattus norvegicus
ccccaattcttcagtttaagctcat

SEQ ID NO: 248235 - DNA, 25 bp, Rattus norvegicus
ccccaattcttctgtttaagctcat

SEQ ID NO: 248236 - DNA, 25 bp, Rattus norvegicus
ccccaatttcctctaggcaggtaca

SEQ ID NO: 248237 - DNA, 25 bp, Rattus norvegicus
ccccaatttcctgtaggcaggtaca

SEQ ID NO: 248238 - DNA, 25 bp, Rattus norvegicus
ccccacaagcctatattctgttata

SEQ ID NO: 248239 - DNA, 25 bp, Rattus norvegicus
ccccacaagcctttattctgttata

SEQ ID NO: 248240 - DNA, 25 bp, Rattus norvegicus
ccccacaaggctcggcatggttcaa

SEQ ID NO: 248241 - DNA, 25 bp, Rattus norvegicus
ccccacaaggctgggcatggttcaa

SEQ ID NO: 248242 - DNA, 25 bp, Rattus norvegicus
ccccacaagttactggaccatcggg

SEQ ID NO: 248243 - DNA, 25 bp, Rattus norvegicus
ccccacaagttagtggaccatcggg

SEQ ID NO: 248244 - DNA, 25 bp, Rattus norvegicus
ccccacaatgttctattttccacgt

SEQ ID NO: 248245 - DNA, 25 bp, Rattus norvegicus
ccccacaatgttgtattttccacgt

SEQ ID NO: 248246 - DNA, 25 bp, Rattus norvegicus
ccccacacctatattatacagttca

SEQ ID NO: 248247 - DNA, 25 bp, Rattus norvegicus
ccccacacctattttatacagttca

SEQ ID NO: 248248 - DNA, 25 bp, Rattus norvegicus
ccccacacttggaagcttgtaggaa

SEQ ID NO: 248249 - DNA, 25 bp, Rattus norvegicus
ccccacacttggtagcttgtaggaa

SEQ ID NO: 248250 - DNA, 25 bp, Rattus norvegicus
ccccacaggatgatgtacagcaatg

SEQ ID NO: 248251 - DNA, 25 bp, Rattus norvegicus
ccccacaggatgttgtacagcaatg

SEQ ID NO: 248252 - DNA, 25 bp, Rattus norvegicus
ccccacataggtcttagagattgtt

SEQ ID NO: 248253 - DNA, 25 bp, Rattus norvegicus
ccccacataggtgttagagattgtt

SEQ ID NO: 248254 - DNA, 25 bp, Rattus norvegicus
ccccacatatcacagatctatgagc

SEQ ID NO: 248255 - DNA, 25 bp, Rattus norvegicus
ccccacatatcagagatctatgagc

SEQ ID NO: 248256 - DNA, 25 bp, Rattus norvegicus
ccccacccagacactaatgtattgt

SEQ ID NO: 248257 - DNA, 25 bp, Rattus norvegicus
ccccacccagactctaatgtattgt

SEQ ID NO: 248258 - DNA, 25 bp, Rattus norvegicus
ccccacccgtgaacagtattgaagc

SEQ ID NO: 248259 - DNA, 25 bp, Rattus norvegicus
ccccacccgtgatcagtattgaagc

SEQ ID NO: 248260 - DNA, 25 bp, Rattus norvegicus
ccccaccctgtgatcagagattgaa

SEQ ID NO: 248261 - DNA, 25 bp, Rattus norvegicus
ccccaccctgtgttcagagattgaa

SEQ ID NO: 248262 - DNA, 25 bp, Rattus norvegicus
ccccaccggatcctgttagagagta

SEQ ID NO: 248263 - DNA, 25 bp, Rattus norvegicus
ccccaccggatcgtgttagagagta

SEQ ID NO: 248264 - DNA, 25 bp, Rattus norvegicus
ccccacctactcagggtattgaagt

SEQ ID NO: 248265 - DNA, 25 bp, Rattus norvegicus
ccccacctactctgggtattgaagt

SEQ ID NO: 248266 - DNA, 25 bp, Rattus norvegicus
ccccacctaggtattatatcatgta

SEQ ID NO: 248267 - DNA, 25 bp, Rattus norvegicus
ccccacctaggttttatatcatgta

SEQ ID NO: 248268 - DNA, 25 bp, Rattus norvegicus
ccccacctgacacatgctataaatg

SEQ ID NO: 248269 - DNA, 25 bp, Rattus norvegicus
ccccacctgacagatgctataaatg

SEQ ID NO: 248270 - DNA, 25 bp, Rattus norvegicus
ccccaccttcagattttgcatcaag

SEQ ID NO: 248271 - DNA, 25 bp, Rattus norvegicus
ccccaccttcagtttttgcatcaag

SEQ ID NO: 248272 - DNA, 25 bp, Rattus norvegicus
ccccacgaatacatctgcggtgtaa

SEQ ID NO: 248273 - DNA, 25 bp, Rattus norvegicus
ccccacgaatacttctgcggtgtaa

SEQ ID NO: 248274 - DNA, 25 bp, Rattus norvegicus
ccccacgctgataattctctattta

SEQ ID NO: 248275 - DNA, 25 bp, Rattus norvegicus
ccccacgctgattattctctattta

SEQ ID NO: 248276 - DNA, 25 bp, Rattus norvegicus
ccccacgtggagacatcttacaaag

SEQ ID NO: 248277 - DNA, 25 bp, Rattus norvegicus
ccccacgtggagtcatcttacaaag

SEQ ID NO: 248278 - DNA, 25 bp, Rattus norvegicus
ccccactagtgcagtgcatttgtat

SEQ ID NO: 248279 - DNA, 25 bp, Rattus norvegicus
ccccactagtgctgtgcatttgtat

SEQ ID NO: 248280 - DNA, 25 bp, Rattus norvegicus
ccccactatggcaatccgtgagata

SEQ ID NO: 248281 - DNA, 25 bp, Rattus norvegicus
ccccactatggctatccgtgagata

SEQ ID NO: 248282 - DNA, 25 bp, Rattus norvegicus
ccccactcccacagttgtataaaag

SEQ ID NO: 248283 - DNA, 25 bp, Rattus norvegicus
ccccactcccactgttgtataaaag

SEQ ID NO: 248284 - DNA, 25 bp, Rattus norvegicus
ccccactcgagaagtctggagatga

SEQ ID NO: 248285 - DNA, 25 bp, Rattus norvegicus
ccccactcgagatgtctggagatga

SEQ ID NO: 248286 - DNA, 25 bp, Rattus norvegicus
ccccactcgtagcatccaaaattag

SEQ ID NO: 248287 - DNA, 25 bp, Rattus norvegicus
ccccactcgtaggatccaaaattag

SEQ ID NO: 248288 - DNA, 25 bp, Rattus norvegicus
ccccactgaggcatatcaaggtcta

SEQ ID NO: 248289 - DNA, 25 bp, Rattus norvegicus
ccccactgaggcttatcaaggtcta

SEQ ID NO: 248290 - DNA, 25 bp, Rattus norvegicus
ccccactggaggaacagggagctct

SEQ ID NO: 248291 - DNA, 25 bp, Rattus norvegicus
ccccactggaggtacagggagctct

SEQ ID NO: 248292 - DNA, 25 bp, Rattus norvegicus
ccccactgtacgagatttctgatca

SEQ ID NO: 248293 - DNA, 25 bp, Rattus norvegicus
ccccactgtacgtgatttctgatca

SEQ ID NO: 248294 - DNA, 25 bp, Rattus norvegicus
ccccactgtagtcttctgagtaatt

SEQ ID NO: 248295 - DNA, 25 bp, Rattus norvegicus
ccccactgtagtgttctgagtaatt

SEQ ID NO: 248296 - DNA, 25 bp, Rattus norvegicus
ccccactgtggacataaaagtcggg

SEQ ID NO: 248297 - DNA, 25 bp, Rattus norvegicus
ccccactgtggagataaaagtcggg

SEQ ID NO: 248298 - DNA, 25 bp, Rattus norvegicus
ccccactgtgggagggaacagcttg

SEQ ID NO: 248299 - DNA, 25 bp, Rattus norvegicus
ccccactgtgggtgggaacagcttg

SEQ ID NO: 248300 - DNA, 25 bp, Rattus norvegicus
ccccacttctagcatttgtgtgtgt

SEQ ID NO: 248301 - DNA, 25 bp, Rattus norvegicus
ccccacttctaggatttgtgtgtgt

SEQ ID NO: 248302 - DNA, 25 bp, Rattus norvegicus
ccccacttctgacttggtatctaat

SEQ ID NO: 248303 - DNA, 25 bp, Rattus norvegicus
ccccacttctgagttggtatctaat

SEQ ID NO: 248304 - DNA, 25 bp, Rattus norvegicus
ccccacttctgtattgtaatgaata

SEQ ID NO: 248305 - DNA, 25 bp, Rattus norvegicus
ccccacttctgttttgtaatgaata

SEQ ID NO: 248306 - DNA, 25 bp, Rattus norvegicus
ccccacttgaacatcttagcactgt

SEQ ID NO: 248307 - DNA, 25 bp, Rattus norvegicus
ccccacttgaacttcttagcactgt

SEQ ID NO: 248308 - DNA, 25 bp, Rattus norvegicus
ccccacttgagcacatctaagatct

SEQ ID NO: 248309 - DNA, 25 bp, Rattus norvegicus
ccccacttgagctcatctaagatct

SEQ ID NO: 248310 - DNA, 25 bp, Rattus norvegicus
ccccacttgagtacactgcacaaat

SEQ ID NO: 248311 - DNA, 25 bp, Rattus norvegicus
ccccacttgagttcactgcacaaat

SEQ ID NO: 248312 - DNA, 25 bp, Rattus norvegicus
ccccacttgcttcgccatgtaggaa

SEQ ID NO: 248313 - DNA, 25 bp, Rattus norvegicus
ccccacttgcttggccatgtaggaa

SEQ ID NO: 248314 - DNA, 25 bp, Rattus norvegicus
ccccacttgggcattttggaagcta

SEQ ID NO: 248315 - DNA, 25 bp, Rattus norvegicus
ccccacttgggctttttggaagcta

SEQ ID NO: 248316 - DNA, 25 bp, Rattus norvegicus
ccccacttgtgaatgctggttacca

SEQ ID NO: 248317 - DNA, 25 bp, Rattus norvegicus
ccccacttgtgattgctggttacca

SEQ ID NO: 248318 - DNA, 25 bp, Rattus norvegicus
ccccagaaaattcaggcaccaggtt

SEQ ID NO: 248319 - DNA, 25 bp, Rattus norvegicus
ccccagaaaattgaggcaccaggtt

SEQ ID NO: 248320 - DNA, 25 bp, Rattus norvegicus
ccccagaattggcaactgctccaga

SEQ ID NO: 248321 - DNA, 25 bp, Rattus norvegicus
ccccagaattgggaactgctccaga

SEQ ID NO: 248322 - DNA, 25 bp, Rattus norvegicus
ccccagacagttcaagacctttaca

SEQ ID NO: 248323 - DNA, 25 bp, Rattus norvegicus
ccccagacagttgaagacctttaca

SEQ ID NO: 248324 - DNA, 25 bp, Rattus norvegicus
ccccagactggcatgtggttctgtt

SEQ ID NO: 248325 - DNA, 25 bp, Rattus norvegicus
ccccagactggcttgtggttctgtt

SEQ ID NO: 248326 - DNA, 25 bp, Rattus norvegicus
ccccagagatgtatgtgttttgaaa

SEQ ID NO: 248327 - DNA, 25 bp, Rattus norvegicus
ccccagagatgtttgtgttttgaaa

SEQ ID NO: 248328 - DNA, 25 bp, Rattus norvegicus
ccccagagcagacaaggcggcctta

SEQ ID NO: 248329 - DNA, 25 bp, Rattus norvegicus
ccccagagcagagaaggcggcctta

SEQ ID NO: 248330 - DNA, 25 bp, Rattus norvegicus
ccccagagccggaactggcatgtga

SEQ ID NO: 248331 - DNA, 25 bp, Rattus norvegicus
ccccagagccggtactggcatgtga

SEQ ID NO: 248332 - DNA, 25 bp, Rattus norvegicus
ccccagagctatccagggcttcgtg

SEQ ID NO: 248333 - DNA, 25 bp, Rattus norvegicus
ccccagagctatgcagggcttcgtg

SEQ ID NO: 248334 - DNA, 25 bp, Rattus norvegicus
ccccagagggaaagctaccaggaaa

SEQ ID NO: 248335 - DNA, 25 bp, Rattus norvegicus
ccccagagggaatgctaccaggaaa

SEQ ID NO: 248336 - DNA, 25 bp, Rattus norvegicus
ccccagaggtcgaatgtgcgcagat

SEQ ID NO: 248337 - DNA, 25 bp, Rattus norvegicus
ccccagaggtcgtatgtgcgcagat

SEQ ID NO: 248338 - DNA, 25 bp, Rattus norvegicus
ccccagagttgaacaggaggccgtg

SEQ ID NO: 248339 - DNA, 25 bp, Rattus norvegicus
ccccagagttgatcaggaggccgtg

SEQ ID NO: 248340 - DNA, 25 bp, Rattus norvegicus
ccccagatagttctgccgtgtaggt

SEQ ID NO: 248341 - DNA, 25 bp, Rattus norvegicus
ccccagatagttgtgccgtgtaggt

SEQ ID NO: 248342 - DNA, 25 bp, Rattus norvegicus
ccccagatatcaactacctagattt

SEQ ID NO: 248343 - DNA, 25 bp, Rattus norvegicus
ccccagatatcatctacctagattt

SEQ ID NO: 248344 - DNA, 25 bp, Rattus norvegicus
ccccagatccttattctaatatgaa

SEQ ID NO: 248345 - DNA, 25 bp, Rattus norvegicus
ccccagatcctttttctaatatgaa

SEQ ID NO: 248346 - DNA, 25 bp, Rattus norvegicus
ccccagatctgacatgtattcgaaa

SEQ ID NO: 248347 - DNA, 25 bp, Rattus norvegicus
ccccagatctgagatgtattcgaaa

SEQ ID NO: 248348 - DNA, 25 bp, Rattus norvegicus
ccccagatgaccctgacagtgtcaa

SEQ ID NO: 248349 - DNA, 25 bp, Rattus norvegicus
ccccagatgaccgtgacagtgtcaa

SEQ ID NO: 248350 - DNA, 25 bp, Rattus norvegicus
ccccagatgcttatagggctcatgt

SEQ ID NO: 248351 - DNA, 25 bp, Rattus norvegicus
ccccagatgcttttagggctcatgt

SEQ ID NO: 248352 - DNA, 25 bp, Rattus norvegicus
ccccagatggacaatactgccttga

SEQ ID NO: 248353 - DNA, 25 bp, Rattus norvegicus
ccccagatggactatactgccttga

SEQ ID NO: 248354 - DNA, 25 bp, Rattus norvegicus
ccccagattggactattttgtataa

SEQ ID NO: 248355 - DNA, 25 bp, Rattus norvegicus
ccccagattggagtattttgtataa

SEQ ID NO: 248356 - DNA, 25 bp, Rattus norvegicus
ccccagcaaagacttcactttcaat

SEQ ID NO: 248357 - DNA, 25 bp, Rattus norvegicus
ccccagcaaagagttcactttcaat

SEQ ID NO: 248358 - DNA, 25 bp, Rattus norvegicus
ccccagcaagagctgcatgggagca

SEQ ID NO: 248359 - DNA, 25 bp, Rattus norvegicus
ccccagcaagaggtgcatgggagca

SEQ ID NO: 248360 - DNA, 25 bp, Rattus norvegicus
ccccagcacaaacagggcaactaag

SEQ ID NO: 248361 - DNA, 25 bp, Rattus norvegicus
ccccagcacaaagagggcaactaag

SEQ ID NO: 248362 - DNA, 25 bp, Rattus norvegicus
ccccagcacattaggatttaaattt

SEQ ID NO: 248363 - DNA, 25 bp, Rattus norvegicus
ccccagcacatttggatttaaattt

SEQ ID NO: 248364 - DNA, 25 bp, Rattus norvegicus
ccccagcagattcacgcgttaggat

SEQ ID NO: 248365 - DNA, 25 bp, Rattus norvegicus
ccccagcagattgacgcgttaggat

SEQ ID NO: 248366 - DNA, 25 bp, Rattus norvegicus
ccccagcaggctctgtgtcggtgca

SEQ ID NO: 248367 - DNA, 25 bp, Rattus norvegicus
ccccagcaggctgtgtgtcggtgca

SEQ ID NO: 248368 - DNA, 25 bp, Rattus norvegicus
ccccagccatttagtaccattatat

SEQ ID NO: 248369 - DNA, 25 bp, Rattus norvegicus
ccccagccattttgtaccattatat

SEQ ID NO: 248370 - DNA, 25 bp, Rattus norvegicus
ccccagcccaataatgctttcagat

SEQ ID NO: 248371 - DNA, 25 bp, Rattus norvegicus
ccccagcccaattatgctttcagat

SEQ ID NO: 248372 - DNA, 25 bp, Rattus norvegicus
ccccagccctgacaatatagtacta

SEQ ID NO: 248373 - DNA, 25 bp, Rattus norvegicus
ccccagccctgagaatatagtacta

SEQ ID NO: 248374 - DNA, 25 bp, Rattus norvegicus
ccccagccctggaggcataatacaa

SEQ ID NO: 248375 - DNA, 25 bp, Rattus norvegicus
ccccagccctggtggcataatacaa

SEQ ID NO: 248376 - DNA, 25 bp, Rattus norvegicus
ccccagcctgttatttgagctaaga

SEQ ID NO: 248377 - DNA, 25 bp, Rattus norvegicus
ccccagcctgttttttgagctaaga

SEQ ID NO: 248378 - DNA, 25 bp, Rattus norvegicus
ccccagccttggctaggtggatgtc

SEQ ID NO: 248379 - DNA, 25 bp, Rattus norvegicus
ccccagccttgggtaggtggatgtc

SEQ ID NO: 248380 - DNA, 25 bp, Rattus norvegicus
ccccagcgcagacctatgaatgaag

SEQ ID NO: 248381 - DNA, 25 bp, Rattus norvegicus
ccccagcgcagagctatgaatgaag

SEQ ID NO: 248382 - DNA, 25 bp, Rattus norvegicus
ccccagctcaaacaatacggacagt

SEQ ID NO: 248383 - DNA, 25 bp, Rattus norvegicus
ccccagctcaaagaatacggacagt

SEQ ID NO: 248384 - DNA, 25 bp, Rattus norvegicus
ccccagctctggcatcaggtaaata

SEQ ID NO: 248385 - DNA, 25 bp, Rattus norvegicus
ccccagctctgggatcaggtaaata

SEQ ID NO: 248386 - DNA, 25 bp, Rattus norvegicus
ccccagctgtgaatcttgctgataa

SEQ ID NO: 248387 - DNA, 25 bp, Rattus norvegicus
ccccagctgtgattcttgctgataa

SEQ ID NO: 248388 - DNA, 25 bp, Rattus norvegicus
ccccagctgtgccttaaggactaat

SEQ ID NO: 248389 - DNA, 25 bp, Rattus norvegicus
ccccagctgtgcgttaaggactaat

SEQ ID NO: 248390 - DNA, 25 bp, Rattus norvegicus
ccccagcttgggagagtcatgcgtg

SEQ ID NO: 248391 - DNA, 25 bp, Rattus norvegicus
ccccagcttgggtgagtcatgcgtg

SEQ ID NO: 248392 - DNA, 25 bp, Rattus norvegicus
ccccagctttcactgtggcaattag

SEQ ID NO: 248393 - DNA, 25 bp, Rattus norvegicus
ccccagctttcagtgtggcaattag

SEQ ID NO: 248394 - DNA, 25 bp, Rattus norvegicus
ccccagctttgacgacagaaaatgt

SEQ ID NO: 248395 - DNA, 25 bp, Rattus norvegicus
ccccagctttgaggacagaaaatgt

SEQ ID NO: 248396 - DNA, 25 bp, Rattus norvegicus
ccccagctttgtactgaaggatcaa

SEQ ID NO: 248397 - DNA, 25 bp, Rattus norvegicus
ccccagctttgttctgaaggatcaa

SEQ ID NO: 248398 - DNA, 25 bp, Rattus norvegicus
ccccaggaaagaccattctgtattt

SEQ ID NO: 248399 - DNA, 25 bp, Rattus norvegicus
ccccaggaaagagcattctgtattt

SEQ ID NO: 248400 - DNA, 25 bp, Rattus norvegicus
ccccaggagtgaccagaagagattt

SEQ ID NO: 248401 - DNA, 25 bp, Rattus norvegicus
ccccaggagtgagcagaagagattt

SEQ ID NO: 248402 - DNA, 25 bp, Rattus norvegicus
ccccaggcactaatcacacaggtaa

SEQ ID NO: 248403 - DNA, 25 bp, Rattus norvegicus
ccccaggcactattcacacaggtaa

SEQ ID NO: 248404 - DNA, 25 bp, Rattus norvegicus
ccccaggctgataatttcccgatta

SEQ ID NO: 248405 - DNA, 25 bp, Rattus norvegicus
ccccaggctgattatttcccgatta

SEQ ID NO: 248406 - DNA, 25 bp, Rattus norvegicus
ccccaggctgggaatgtgtaattta

SEQ ID NO: 248407 - DNA, 25 bp, Rattus norvegicus
ccccaggctgggtatgtgtaattta

SEQ ID NO: 248408 - DNA, 25 bp, Rattus norvegicus
ccccaggcttcccaaatgagtatga

SEQ ID NO: 248409 - DNA, 25 bp, Rattus norvegicus
ccccaggcttccgaaatgagtatga

SEQ ID NO: 248410 - DNA, 25 bp, Rattus norvegicus
ccccaggcttggcacaaatactgtg

SEQ ID NO: 248411 - DNA, 25 bp, Rattus norvegicus
ccccaggcttgggacaaatactgtg

SEQ ID NO: 248412 - DNA, 25 bp, Rattus norvegicus
ccccagggatggatctcaataaaga

SEQ ID NO: 248413 - DNA, 25 bp, Rattus norvegicus
ccccagggatggttctcaataaaga

SEQ ID NO: 248414 - DNA, 25 bp, Rattus norvegicus
ccccagggcacacagatatatatat

SEQ ID NO: 248415 - DNA, 25 bp, Rattus norvegicus
ccccagggcacagagatatatatat

SEQ ID NO: 248416 - DNA, 25 bp, Rattus norvegicus
ccccagggcctactctgtttttatg

SEQ ID NO: 248417 - DNA, 25 bp, Rattus norvegicus
ccccagggcctagtctgtttttatg

SEQ ID NO: 248418 - DNA, 25 bp, Rattus norvegicus
ccccagggctccaggacagatcagg

SEQ ID NO: 248419 - DNA, 25 bp, Rattus norvegicus
ccccagggctcctggacagatcagg

SEQ ID NO: 248420 - DNA, 25 bp, Rattus norvegicus
ccccagggtactagcactgacataa

SEQ ID NO: 248421 - DNA, 25 bp, Rattus norvegicus
ccccagggtacttgcactgacataa

SEQ ID NO: 248422 - DNA, 25 bp, Rattus norvegicus
ccccagggtggactggtaccaaatg

SEQ ID NO: 248423 - DNA, 25 bp, Rattus norvegicus
ccccagggtggagtggtaccaaatg

SEQ ID NO: 248424 - DNA, 25 bp, Rattus norvegicus
ccccaggtactgaggttcaaagata

SEQ ID NO: 248425 - DNA, 25 bp, Rattus norvegicus
ccccaggtactgcacttaaggattc

SEQ ID NO: 248426 - DNA, 25 bp, Rattus norvegicus
ccccaggtactggacttaaggattc

SEQ ID NO: 248427 - DNA, 25 bp, Rattus norvegicus
ccccaggtactgtggttcaaagata

SEQ ID NO: 248428 - DNA, 25 bp, Rattus norvegicus
ccccaggtagctactgtagacagac

SEQ ID NO: 248429 - DNA, 25 bp, Rattus norvegicus
ccccaggtagcttctgtagacagac

SEQ ID NO: 248430 - DNA, 25 bp, Rattus norvegicus
ccccaggtgaccatggttagtattt

SEQ ID NO: 248431 - DNA, 25 bp, Rattus norvegicus
ccccaggtgaccttggttagtattt

SEQ ID NO: 248432 - DNA, 25 bp, Rattus norvegicus
ccccaggtgggaatcgactggtcta

SEQ ID NO: 248433 - DNA, 25 bp, Rattus norvegicus
ccccaggtgggattcgactggtcta

SEQ ID NO: 248434 - DNA, 25 bp, Rattus norvegicus
ccccaggtgtctaccaaaatggcta

SEQ ID NO: 248435 - DNA, 25 bp, Rattus norvegicus
ccccaggtgtcttccaaaatggcta

SEQ ID NO: 248436 - DNA, 25 bp, Rattus norvegicus
ccccaggttcaacagcagtttgtca

SEQ ID NO: 248437 - DNA, 25 bp, Rattus norvegicus
ccccaggttcaagagcagtttgtca

SEQ ID NO: 248438 - DNA, 25 bp, Rattus norvegicus
ccccagtacctcagatgttttatcc

SEQ ID NO: 248439 - DNA, 25 bp, Rattus norvegicus
ccccagtacctctgatgttttatcc

SEQ ID NO: 248440 - DNA, 25 bp, Rattus norvegicus
ccccagtcactaaccaatggtactt

SEQ ID NO: 248441 - DNA, 25 bp, Rattus norvegicus
ccccagtcactatccaatggtactt

SEQ ID NO: 248442 - DNA, 25 bp, Rattus norvegicus
ccccagtcctggctgaagttggcaa

SEQ ID NO: 248443 - DNA, 25 bp, Rattus norvegicus
ccccagtcctgggtgaagttggcaa

SEQ ID NO: 248444 - DNA, 25 bp, Rattus norvegicus
ccccagtcgtatagcttctattttc

SEQ ID NO: 248445 - DNA, 25 bp, Rattus norvegicus
ccccagtcgtattgcttctattttc

SEQ ID NO: 248446 - DNA, 25 bp, Rattus norvegicus
ccccagtctgggagagttgtgttca

SEQ ID NO: 248447 - DNA, 25 bp, Rattus norvegicus
ccccagtctgggtgagttgtgttca

SEQ ID NO: 248448 - DNA, 25 bp, Rattus norvegicus
ccccagtctgttacttctgaggaaa

SEQ ID NO: 248449 - DNA, 25 bp, Rattus norvegicus
ccccagtctgtttcttctgaggaaa

SEQ ID NO: 248450 - DNA, 25 bp, Rattus norvegicus
ccccagtcttccattatttataatg

SEQ ID NO: 248451 - DNA, 25 bp, Rattus norvegicus
ccccagtcttcctttatttataatg

SEQ ID NO: 248452 - DNA, 25 bp, Rattus norvegicus
ccccagtcttttcgagtctgtgaca

SEQ ID NO: 248453 - DNA, 25 bp, Rattus norvegicus
ccccagtcttttggagtctgtgaca

SEQ ID NO: 248454 - DNA, 25 bp, Rattus norvegicus
ccccagtgagggagagtagcttgta

SEQ ID NO: 248455 - DNA, 25 bp, Rattus norvegicus
ccccagtgagggtgagtagcttgta

SEQ ID NO: 248456 - DNA, 25 bp, Rattus norvegicus
ccccagtgatcccaattctcagatg

SEQ ID NO: 248457 - DNA, 25 bp, Rattus norvegicus
ccccagtgatccgaattctcagatg

SEQ ID NO: 248458 - DNA, 25 bp, Rattus norvegicus
ccccagtgcaacaaccgagaagagt

SEQ ID NO: 248459 - DNA, 25 bp, Rattus norvegicus
ccccagtgcaactaccgagaagagt

SEQ ID NO: 248460 - DNA, 25 bp, Rattus norvegicus
ccccagtgccggacaaggaggagtt

SEQ ID NO: 248461 - DNA, 25 bp, Rattus norvegicus
ccccagtgccggtcaaggaggagtt

SEQ ID NO: 248462 - DNA, 25 bp, Rattus norvegicus
ccccagtggttcaggctctagaatg

SEQ ID NO: 248463 - DNA, 25 bp, Rattus norvegicus
ccccagtggttctggctctagaatg

SEQ ID NO: 248464 - DNA, 25 bp, Rattus norvegicus
ccccagtgttccatgagcaagtttt

SEQ ID NO: 248465 - DNA, 25 bp, Rattus norvegicus
ccccagtgttccttgagcaagtttt

SEQ ID NO: 248466 - DNA, 25 bp, Rattus norvegicus
ccccagttactgctattcactcatg

SEQ ID NO: 248467 - DNA, 25 bp, Rattus norvegicus
ccccagttactggtattcactcatg

SEQ ID NO: 248468 - DNA, 25 bp, Rattus norvegicus
ccccagttagataagtgtttacaca

SEQ ID NO: 248469 - DNA, 25 bp, Rattus norvegicus
ccccagttagattagtgtttacaca

SEQ ID NO: 248470 - DNA, 25 bp, Rattus norvegicus
ccccagttgaggatgtgcagtagtt

SEQ ID NO: 248471 - DNA, 25 bp, Rattus norvegicus
ccccagttgaggttgtgcagtagtt

SEQ ID NO: 248472 - DNA, 25 bp, Rattus norvegicus
ccccagttgatgacccacagagtgg

SEQ ID NO: 248473 - DNA, 25 bp, Rattus norvegicus
ccccagttgatgtcccacagagtgg

SEQ ID NO: 248474 - DNA, 25 bp, Rattus norvegicus
ccccagtttataattagctgccaaa

SEQ ID NO: 248475 - DNA, 25 bp, Rattus norvegicus
ccccagtttatatttagctgccaaa

SEQ ID NO: 248476 - DNA, 25 bp, Rattus norvegicus
ccccataaaacgcattgctactata

SEQ ID NO: 248477 - DNA, 25 bp, Rattus norvegicus
ccccataaaacggattgctactata

SEQ ID NO: 248478 - DNA, 25 bp, Rattus norvegicus
ccccataagcagatcagctcttaga

SEQ ID NO: 248479 - DNA, 25 bp, Rattus norvegicus
ccccataagcagttcagctcttaga

SEQ ID NO: 248480 - DNA, 25 bp, Rattus norvegicus
ccccatacatccaactgtactaggt

SEQ ID NO: 248481 - DNA, 25 bp, Rattus norvegicus
ccccatacatcctactgtactaggt

SEQ ID NO: 248482 - DNA, 25 bp, Rattus norvegicus
ccccataccttaaaggtcctctgat

SEQ ID NO: 248483 - DNA, 25 bp, Rattus norvegicus
ccccataccttataggtcctctgat

SEQ ID NO: 248484 - DNA, 25 bp, Rattus norvegicus
ccccatagcggtctcgtcaaggaat

SEQ ID NO: 248485 - DNA, 25 bp, Rattus norvegicus
ccccatagcggtgtcgtcaaggaat

SEQ ID NO: 248486 - DNA, 25 bp, Rattus norvegicus
ccccataggctcaaaaatttgcgtg

SEQ ID NO: 248487 - DNA, 25 bp, Rattus norvegicus
ccccataggctctaaaatttgcgtg

SEQ ID NO: 248488 - DNA, 25 bp, Rattus norvegicus
ccccatagggcgagatatttgaata

SEQ ID NO: 248489 - DNA, 25 bp, Rattus norvegicus
ccccatagggcgtgatatttgaata

SEQ ID NO: 248490 - DNA, 25 bp, Rattus norvegicus
ccccataggtttccggcactgcaaa

SEQ ID NO: 248491 - DNA, 25 bp, Rattus norvegicus
ccccataggtttgcggcactgcaaa

SEQ ID NO: 248492 - DNA, 25 bp, Rattus norvegicus
ccccatagtgctcagtggagtctct

SEQ ID NO: 248493 - DNA, 25 bp, Rattus norvegicus
ccccatagtgctgagtggagtctct

SEQ ID NO: 248494 - DNA, 25 bp, Rattus norvegicus
ccccatatgtgtctgtcgtacattc

SEQ ID NO: 248495 - DNA, 25 bp, Rattus norvegicus
ccccatatgtgtgtgtcgtacattc

SEQ ID NO: 248496 - DNA, 25 bp, Rattus norvegicus
ccccatcaatgtcaggtgcttgttt

SEQ ID NO: 248497 - DNA, 25 bp, Rattus norvegicus
ccccatcaatgtgaggtgcttgttt

SEQ ID NO: 248498 - DNA, 25 bp, Rattus norvegicus
ccccatcacagcaaggtctaagaaa

SEQ ID NO: 248499 - DNA, 25 bp, Rattus norvegicus
ccccatcacagctaggtctaagaaa

SEQ ID NO: 248500 - DNA, 25 bp, Rattus norvegicus
ccccatcacatcatggacgagaggg

SEQ ID NO: 248501 - DNA, 25 bp, Rattus norvegicus
ccccatcacatcttggacgagaggg

SEQ ID NO: 248502 - DNA, 25 bp, Rattus norvegicus
ccccatcactttacctagttttatg

SEQ ID NO: 248503 - DNA, 25 bp, Rattus norvegicus
ccccatcacttttcctagttttatg

SEQ ID NO: 248504 - DNA, 25 bp, Rattus norvegicus
ccccatcagcccatctgtaatgaga

SEQ ID NO: 248505 - DNA, 25 bp, Rattus norvegicus
ccccatcagcccttctgtaatgaga

SEQ ID NO: 248506 - DNA, 25 bp, Rattus norvegicus
ccccatcagcttcagactggataaa

SEQ ID NO: 248507 - DNA, 25 bp, Rattus norvegicus
ccccatcagcttgagactggataaa

SEQ ID NO: 248508 - DNA, 25 bp, Rattus norvegicus
ccccatcatccactttctaaaagaa

SEQ ID NO: 248509 - DNA, 25 bp, Rattus norvegicus
ccccatcatccagtttctaaaagaa

SEQ ID NO: 248510 - DNA, 25 bp, Rattus norvegicus
ccccatccaaaacgtacagatcgat

SEQ ID NO: 248511 - DNA, 25 bp, Rattus norvegicus
ccccatccaaaaggtacagatcgat

SEQ ID NO: 248512 - DNA, 25 bp, Rattus norvegicus
ccccatccttgtagaatttctttgg

SEQ ID NO: 248513 - DNA, 25 bp, Rattus norvegicus
ccccatccttgttgaatttctttgg

SEQ ID NO: 248514 - DNA, 25 bp, Rattus norvegicus
ccccatcgtggtaattgtgtttttg

SEQ ID NO: 248515 - DNA, 25 bp, Rattus norvegicus
ccccatcgtggttattgtgtttttg

SEQ ID NO: 248516 - DNA, 25 bp, Rattus norvegicus
ccccatctattgaaattaccaagga

SEQ ID NO: 248517 - DNA, 25 bp, Rattus norvegicus
ccccatctattgtaattaccaagga

SEQ ID NO: 248518 - DNA, 25 bp, Rattus norvegicus
ccccatcttctcctttggaaaagag

SEQ ID NO: 248519 - DNA, 25 bp, Rattus norvegicus
ccccatcttctcgtttggaaaagag

SEQ ID NO: 248520 - DNA, 25 bp, Rattus norvegicus
ccccatcttgctaacctgtatttta

SEQ ID NO: 248521 - DNA, 25 bp, Rattus norvegicus
ccccatcttgcttacctgtatttta

SEQ ID NO: 248522 - DNA, 25 bp, Rattus norvegicus
ccccatctttacctgcagacaaaaa

SEQ ID NO: 248523 - DNA, 25 bp, Rattus norvegicus
ccccatctttacgtgcagacaaaaa

SEQ ID NO: 248524 - DNA, 25 bp, Rattus norvegicus
ccccatgccattaagcagttatcac

SEQ ID NO: 248525 - DNA, 25 bp, Rattus norvegicus
ccccatgccattagagttctcattt

SEQ ID NO: 248526 - DNA, 25 bp, Rattus norvegicus
ccccatgccatttagcagttatcac

SEQ ID NO: 248527 - DNA, 25 bp, Rattus norvegicus
ccccatgccatttgagttctcattt

SEQ ID NO: 248528 - DNA, 25 bp, Rattus norvegicus
ccccatgctcacctgacattaaaag

SEQ ID NO: 248529 - DNA, 25 bp, Rattus norvegicus
ccccatgctcacgtgacattaaaag

SEQ ID NO: 248530 - DNA, 25 bp, Rattus norvegicus
ccccatgctgtaaacatgctatata

SEQ ID NO: 248531 - DNA, 25 bp, Rattus norvegicus
ccccatgctgtatacatgctatata

SEQ ID NO: 248532 - DNA, 25 bp, Rattus norvegicus
ccccatgcttgtctgtcattagtgt

SEQ ID NO: 248533 - DNA, 25 bp, Rattus norvegicus
ccccatgcttgtgtgtcattagtgt

SEQ ID NO: 248534 - DNA, 25 bp, Rattus norvegicus
ccccatgcttttaccatacagtatg

SEQ ID NO: 248535 - DNA, 25 bp, Rattus norvegicus
ccccatgctttttccatacagtatg

SEQ ID NO: 248536 - DNA, 25 bp, Rattus norvegicus
ccccatggagagatctggttattca

SEQ ID NO: 248537 - DNA, 25 bp, Rattus norvegicus
ccccatggagagttctggttattca

SEQ ID NO: 248538 - DNA, 25 bp, Rattus norvegicus
ccccatggttacattcaaaatctga

SEQ ID NO: 248539 - DNA, 25 bp, Rattus norvegicus
ccccatggttactttcaaaatctga

SEQ ID NO: 248540 - DNA, 25 bp, Rattus norvegicus
ccccatgtccagatgctgggaatgg

SEQ ID NO: 248541 - DNA, 25 bp, Rattus norvegicus
ccccatgtccagttgctgggaatgg

SEQ ID NO: 248542 - DNA, 25 bp, Rattus norvegicus
ccccatgtctacacaaggctattta

SEQ ID NO: 248543 - DNA, 25 bp, Rattus norvegicus
ccccatgtctactcaaggctattta

SEQ ID NO: 248544 - DNA, 25 bp, Rattus norvegicus
ccccatgtgtttcctgtcagagtcc

SEQ ID NO: 248545 - DNA, 25 bp, Rattus norvegicus
ccccatgtgtttgctgtcagagtcc

SEQ ID NO: 248546 - DNA, 25 bp, Rattus norvegicus
ccccatgttgcaacctgtgattaac

SEQ ID NO: 248547 - DNA, 25 bp, Rattus norvegicus
ccccatgttgcatcctgtgattaac

SEQ ID NO: 248548 - DNA, 25 bp, Rattus norvegicus
ccccatgtttctcaagtgatcccaa

SEQ ID NO: 248549 - DNA, 25 bp, Rattus norvegicus
ccccatgtttctgaagtgatcccaa

SEQ ID NO: 248550 - DNA, 25 bp, Rattus norvegicus
ccccattcaacaagggattttgcca

SEQ ID NO: 248551 - DNA, 25 bp, Rattus norvegicus
ccccattcaacatgggattttgcca

SEQ ID NO: 248552 - DNA, 25 bp, Rattus norvegicus
ccccattcactcacagttggaacaa

SEQ ID NO: 248553 - DNA, 25 bp, Rattus norvegicus
ccccattcactctcagttggaacaa

SEQ ID NO: 248554 - DNA, 25 bp, Rattus norvegicus
ccccattccagtacgtaatgtgtgc

SEQ ID NO: 248555 - DNA, 25 bp, Rattus norvegicus
ccccattccagttcgtaatgtgtgc

SEQ ID NO: 248556 - DNA, 25 bp, Rattus norvegicus
ccccattccattactgactttattc

SEQ ID NO: 248557 - DNA, 25 bp, Rattus norvegicus
ccccattccatttctgactttattc

SEQ ID NO: 248558 - DNA, 25 bp, Rattus norvegicus
ccccattcccaaaatttcctgagag

SEQ ID NO: 248559 - DNA, 25 bp, Rattus norvegicus
ccccattcccaatatttcctgagag

SEQ ID NO: 248560 - DNA, 25 bp, Rattus norvegicus
ccccattcgtgtacagagaaattat

SEQ ID NO: 248561 - DNA, 25 bp, Rattus norvegicus
ccccattcgtgttcagagaaattat

SEQ ID NO: 248562 - DNA, 25 bp, Rattus norvegicus
ccccattctccaaggtggaacgaga

SEQ ID NO: 248563 - DNA, 25 bp, Rattus norvegicus
ccccattctccatggtggaacgaga

SEQ ID NO: 248564 - DNA, 25 bp, Rattus norvegicus
ccccattgaggcattaatcgactga

SEQ ID NO: 248565 - DNA, 25 bp, Rattus norvegicus
ccccattgaggctttaatcgactga

SEQ ID NO: 248566 - DNA, 25 bp, Rattus norvegicus
ccccattgcagaagaccatcaagaa

SEQ ID NO: 248567 - DNA, 25 bp, Rattus norvegicus
ccccattgcagatgaccatcaagaa

SEQ ID NO: 248568 - DNA, 25 bp, Rattus norvegicus
ccccattggaagaagctgcagccaa

SEQ ID NO: 248569 - DNA, 25 bp, Rattus norvegicus
ccccattggaagtagctgcagccaa

SEQ ID NO: 248570 - DNA, 25 bp, Rattus norvegicus
ccccattggtagctctttggagaga

SEQ ID NO: 248571 - DNA, 25 bp, Rattus norvegicus
ccccattggtaggtctttggagaga

SEQ ID NO: 248572 - DNA, 25 bp, Rattus norvegicus
ccccattgtcaaaactctttgtggt

SEQ ID NO: 248573 - DNA, 25 bp, Rattus norvegicus
ccccattgtcaatactctttgtggt

SEQ ID NO: 248574 - DNA, 25 bp, Rattus norvegicus
ccccattgtggtattagcatcttgt

SEQ ID NO: 248575 - DNA, 25 bp, Rattus norvegicus
ccccattgtggttttagcatcttgt

SEQ ID NO: 248576 - DNA, 25 bp, Rattus norvegicus
ccccatttcttcattgagttttgca

SEQ ID NO: 248577 - DNA, 25 bp, Rattus norvegicus
ccccatttcttctttgagttttgca

SEQ ID NO: 248578 - DNA, 25 bp, Rattus norvegicus
ccccatttgcacagagaagagaaac

SEQ ID NO: 248579 - DNA, 25 bp, Rattus norvegicus
ccccatttgcactgagaagagaaac

SEQ ID NO: 248580 - DNA, 25 bp, Rattus norvegicus
ccccattttgatacgtgttaagact

SEQ ID NO: 248581 - DNA, 25 bp, Rattus norvegicus
ccccattttgattcgtgttaagact

SEQ ID NO: 248582 - DNA, 25 bp, Rattus norvegicus
ccccattttgctcttgagtctggta

SEQ ID NO: 248583 - DNA, 25 bp, Rattus norvegicus
ccccattttgctgttgagtctggta

SEQ ID NO: 248584 - DNA, 25 bp, Rattus norvegicus
ccccattttgggaccagggcagagt

SEQ ID NO: 248585 - DNA, 25 bp, Rattus norvegicus
ccccattttgggtccagggcagagt

SEQ ID NO: 248586 - DNA, 25 bp, Rattus norvegicus
ccccgaagaagaaagccccatggct

SEQ ID NO: 248587 - DNA, 25 bp, Rattus norvegicus
ccccgaagaagatagccccatggct

SEQ ID NO: 248588 - DNA, 25 bp, Rattus norvegicus
ccccgaattgctcgtgagcggaata

SEQ ID NO: 248589 - DNA, 25 bp, Rattus norvegicus
ccccgaattgctggtgagcggaata

SEQ ID NO: 248590 - DNA, 25 bp, Rattus norvegicus
ccccgaccagcgaagctgagaaatt

SEQ ID NO: 248591 - DNA, 25 bp, Rattus norvegicus
ccccgaccagcgtagctgagaaatt

SEQ ID NO: 248592 - DNA, 25 bp, Rattus norvegicus
ccccgactcactctaaagtctttgg

SEQ ID NO: 248593 - DNA, 25 bp, Rattus norvegicus
ccccgactcactgtaaagtctttgg

SEQ ID NO: 248594 - DNA, 25 bp, Rattus norvegicus
ccccgacttggtagtgtcttgcata

SEQ ID NO: 248595 - DNA, 25 bp, Rattus norvegicus
ccccgacttggttgtgtcttgcata

SEQ ID NO: 248596 - DNA, 25 bp, Rattus norvegicus
ccccgagagagaacttctaacaaag

SEQ ID NO: 248597 - DNA, 25 bp, Rattus norvegicus
ccccgagagagatcttctaacaaag

SEQ ID NO: 248598 - DNA, 25 bp, Rattus norvegicus
ccccgagataggatttctttgtgtg

SEQ ID NO: 248599 - DNA, 25 bp, Rattus norvegicus
ccccgagataggttttctttgtgtg

SEQ ID NO: 248600 - DNA, 25 bp, Rattus norvegicus
ccccgagccattaataaccagtact

SEQ ID NO: 248601 - DNA, 25 bp, Rattus norvegicus
ccccgagccatttataaccagtact

SEQ ID NO: 248602 - DNA, 25 bp, Rattus norvegicus
ccccgagcctataggttggatagag

SEQ ID NO: 248603 - DNA, 25 bp, Rattus norvegicus
ccccgagcctattggttggatagag

SEQ ID NO: 248604 - DNA, 25 bp, Rattus norvegicus
ccccgagctaagaggccaagtggtt

SEQ ID NO: 248605 - DNA, 25 bp, Rattus norvegicus
ccccgagctaagtggccaagtggtt

SEQ ID NO: 248606 - DNA, 25 bp, Rattus norvegicus
ccccgagggagcagatgccaaggaa

SEQ ID NO: 248607 - DNA, 25 bp, Rattus norvegicus
ccccgagggagctgatgccaaggaa

SEQ ID NO: 248608 - DNA, 25 bp, Rattus norvegicus
ccccgagtacatctagtaggcgatg

SEQ ID NO: 248609 - DNA, 25 bp, Rattus norvegicus
ccccgagtacatgtagtaggcgatg

SEQ ID NO: 248610 - DNA, 25 bp, Rattus norvegicus
ccccgagtcgggagctagacaggaa

SEQ ID NO: 248611 - DNA, 25 bp, Rattus norvegicus
ccccgagtcgggtgctagacaggaa

SEQ ID NO: 248612 - DNA, 25 bp, Rattus norvegicus
ccccgagtgacactgttgacaaggt

SEQ ID NO: 248613 - DNA, 25 bp, Rattus norvegicus
ccccgagtgacagtgttgacaaggt

SEQ ID NO: 248614 - DNA, 25 bp, Rattus norvegicus
ccccgagtgagaagaagcgatcttt

SEQ ID NO: 248615 - DNA, 25 bp, Rattus norvegicus
ccccgagtgagatgaagcgatcttt

SEQ ID NO: 248616 - DNA, 25 bp, Rattus norvegicus
ccccgagtttgcacagtggctgaaa

SEQ ID NO: 248617 - DNA, 25 bp, Rattus norvegicus
ccccgagtttgctcagtggctgaaa

SEQ ID NO: 248618 - DNA, 25 bp, Rattus norvegicus
ccccgatcagctaattggactatat

SEQ ID NO: 248619 - DNA, 25 bp, Rattus norvegicus
ccccgatcagcttattggactatat

SEQ ID NO: 248620 - DNA, 25 bp, Rattus norvegicus
ccccgatgcgtgacacaaagctgga

SEQ ID NO: 248621 - DNA, 25 bp, Rattus norvegicus
ccccgatgcgtgtcacaaagctgga

SEQ ID NO: 248622 - DNA, 25 bp, Rattus norvegicus
ccccgatgtctgctttttaacgtag

SEQ ID NO: 248623 - DNA, 25 bp, Rattus norvegicus
ccccgatgtctggtttttaacgtag

SEQ ID NO: 248624 - DNA, 25 bp, Rattus norvegicus
ccccgcagcgagcaggataacgagc

SEQ ID NO: 248625 - DNA, 25 bp, Rattus norvegicus
ccccgcagcgaggaggataacgagc

SEQ ID NO: 248626 - DNA, 25 bp, Rattus norvegicus
ccccgccaggatcaaaaatatgcat

SEQ ID NO: 248627 - DNA, 25 bp, Rattus norvegicus
ccccgccaggatgaaaaatatgcat

SEQ ID NO: 248628 - DNA, 25 bp, Rattus norvegicus
ccccgcccatggagataaggattgc

SEQ ID NO: 248629 - DNA, 25 bp, Rattus norvegicus
ccccgcccatggtgataaggattgc

SEQ ID NO: 248630 - DNA, 25 bp, Rattus norvegicus
ccccgccctgaaatgactagttaat

SEQ ID NO: 248631 - DNA, 25 bp, Rattus norvegicus
ccccgccctgaattgactagttaat

SEQ ID NO: 248632 - DNA, 25 bp, Rattus norvegicus
ccccgcctaattcttagagcttcat

SEQ ID NO: 248633 - DNA, 25 bp, Rattus norvegicus
ccccgcctaattgttagagcttcat

SEQ ID NO: 248634 - DNA, 25 bp, Rattus norvegicus
ccccgcctgagtacatcattgagta

SEQ ID NO: 248635 - DNA, 25 bp, Rattus norvegicus
ccccgcctgagttcatcattgagta

SEQ ID NO: 248636 - DNA, 25 bp, Rattus norvegicus
ccccgcggagtgattggtccatgtt

SEQ ID NO: 248637 - DNA, 25 bp, Rattus norvegicus
ccccgcggagtgtttggtccatgtt

SEQ ID NO: 248638 - DNA, 25 bp, Rattus norvegicus
ccccgctacccaacatgaaagaaat

SEQ ID NO: 248639 - DNA, 25 bp, Rattus norvegicus
ccccgctacccatcatgaaagaaat

SEQ ID NO: 248640 - DNA, 25 bp, Rattus norvegicus
ccccgctactgaatcttgacaagat

SEQ ID NO: 248641 - DNA, 25 bp, Rattus norvegicus
ccccgctactgattcttgacaagat

SEQ ID NO: 248642 - DNA, 25 bp, Rattus norvegicus
ccccgctgtactctagaggctgaca

SEQ ID NO: 248643 - DNA, 25 bp, Rattus norvegicus
ccccgctgtactgtagaggctgaca

SEQ ID NO: 248644 - DNA, 25 bp, Rattus norvegicus
ccccgctgtgagaacatctgagtca

SEQ ID NO: 248645 - DNA, 25 bp, Rattus norvegicus
ccccgctgtgagtacatctgagtca

SEQ ID NO: 248646 - DNA, 25 bp, Rattus norvegicus
ccccgcttgtccattgacagaagta

SEQ ID NO: 248647 - DNA, 25 bp, Rattus norvegicus
ccccgcttgtcctttgacagaagta

SEQ ID NO: 248648 - DNA, 25 bp, Rattus norvegicus
ccccgctttagcatcagggttgcaa

SEQ ID NO: 248649 - DNA, 25 bp, Rattus norvegicus
ccccgctttagcttcagggttgcaa

SEQ ID NO: 248650 - DNA, 25 bp, Rattus norvegicus
ccccggaagtgtatagtgccttgtt

SEQ ID NO: 248651 - DNA, 25 bp, Rattus norvegicus
ccccggaagtgtttagtgccttgtt

SEQ ID NO: 248652 - DNA, 25 bp, Rattus norvegicus
ccccggaattatagttacagatgat

SEQ ID NO: 248653 - DNA, 25 bp, Rattus norvegicus
ccccggaattattgttacagatgat

SEQ ID NO: 248654 - DNA, 25 bp, Rattus norvegicus
ccccggacagtgacaggcttgttta

SEQ ID NO: 248655 - DNA, 25 bp, Rattus norvegicus
ccccggacagtgtcaggcttgttta

SEQ ID NO: 248656 - DNA, 25 bp, Rattus norvegicus
ccccggactgggatgaaacctcatt

SEQ ID NO: 248657 - DNA, 25 bp, Rattus norvegicus
ccccggactgggttgaaacctcatt

SEQ ID NO: 248658 - DNA, 25 bp, Rattus norvegicus
ccccggcactgcacttaacagttat

SEQ ID NO: 248659 - DNA, 25 bp, Rattus norvegicus
ccccggcactgctcttaacagttat

SEQ ID NO: 248660 - DNA, 25 bp, Rattus norvegicus
ccccggcagtccatctgtgtgggtg

SEQ ID NO: 248661 - DNA, 25 bp, Rattus norvegicus
ccccggcagtccttctgtgtgggtg

SEQ ID NO: 248662 - DNA, 25 bp, Rattus norvegicus
ccccggccctgtaacatagttgagt

SEQ ID NO: 248663 - DNA, 25 bp, Rattus norvegicus
ccccggccctgttacatagttgagt

SEQ ID NO: 248664 - DNA, 25 bp, Rattus norvegicus
ccccggcggatgatgacattgtgtt

SEQ ID NO: 248665 - DNA, 25 bp, Rattus norvegicus
ccccggcggatgttgacattgtgtt

SEQ ID NO: 248666 - DNA, 25 bp, Rattus norvegicus
ccccggctgtgtatttatagatgga

SEQ ID NO: 248667 - DNA, 25 bp, Rattus norvegicus
ccccggctgtgtttttatagatgga

SEQ ID NO: 248668 - DNA, 25 bp, Rattus norvegicus
ccccgggaaccacgactgagacaat

SEQ ID NO: 248669 - DNA, 25 bp, Rattus norvegicus
ccccgggaaccaggactgagacaat

SEQ ID NO: 248670 - DNA, 25 bp, Rattus norvegicus
ccccgggataataaggctctgtctc

SEQ ID NO: 248671 - DNA, 25 bp, Rattus norvegicus
ccccgggataattaggctctgtctc

SEQ ID NO: 248672 - DNA, 25 bp, Rattus norvegicus
ccccgggctatgcacaagatgtacg

SEQ ID NO: 248673 - DNA, 25 bp, Rattus norvegicus
ccccgggctatggacaagatgtacg

SEQ ID NO: 248674 - DNA, 25 bp, Rattus norvegicus
ccccggtctatgctggaagttgtca

SEQ ID NO: 248675 - DNA, 25 bp, Rattus norvegicus
ccccggtctatggtggaagttgtca

SEQ ID NO: 248676 - DNA, 25 bp, Rattus norvegicus
ccccggtcttggaagatgctaataa

SEQ ID NO: 248677 - DNA, 25 bp, Rattus norvegicus
ccccggtcttggattctgagatcag

SEQ ID NO: 248678 - DNA, 25 bp, Rattus norvegicus
ccccggtcttggtagatgctaataa

SEQ ID NO: 248679 - DNA, 25 bp, Rattus norvegicus
ccccggtcttggtttctgagatcag

SEQ ID NO: 248680 - DNA, 25 bp, Rattus norvegicus
ccccggtgcaagaggcgcaaacaag

SEQ ID NO: 248681 - DNA, 25 bp, Rattus norvegicus
ccccggtgcaagtggcgcaaacaag

SEQ ID NO: 248682 - DNA, 25 bp, Rattus norvegicus
ccccggtgtactaggcggctgtgct

SEQ ID NO: 248683 - DNA, 25 bp, Rattus norvegicus
ccccggtgtacttggcggctgtgct

SEQ ID NO: 248684 - DNA, 25 bp, Rattus norvegicus
ccccgtaacctcagcatagtaatta

SEQ ID NO: 248685 - DNA, 25 bp, Rattus norvegicus
ccccgtaacctctgcatagtaatta

SEQ ID NO: 248686 - DNA, 25 bp, Rattus norvegicus
ccccgtagagcgactgcatagcaga

SEQ ID NO: 248687 - DNA, 25 bp, Rattus norvegicus
ccccgtagagcgtctgcatagcaga

SEQ ID NO: 248688 - DNA, 25 bp, Rattus norvegicus
ccccgtaggtctcatgcgagggcat

SEQ ID NO: 248689 - DNA, 25 bp, Rattus norvegicus
ccccgtaggtctgatgcgagggcat

SEQ ID NO: 248690 - DNA, 25 bp, Rattus norvegicus
ccccgtatgaggatctggtgtgcta

SEQ ID NO: 248691 - DNA, 25 bp, Rattus norvegicus
ccccgtatgaggttctggtgtgcta

SEQ ID NO: 248692 - DNA, 25 bp, Rattus norvegicus
ccccgtgagcagaggactatatctt

SEQ ID NO: 248693 - DNA, 25 bp, Rattus norvegicus
ccccgtgagcagtggactatatctt

SEQ ID NO: 248694 - DNA, 25 bp, Rattus norvegicus
ccccgtgcacggatcaatggtagat

SEQ ID NO: 248695 - DNA, 25 bp, Rattus norvegicus
ccccgtgcacggttcaatggtagat

SEQ ID NO: 248696 - DNA, 25 bp, Rattus norvegicus
ccccgtggctcgattgcataaatga

SEQ ID NO: 248697 - DNA, 25 bp, Rattus norvegicus
ccccgtggctcgtttgcataaatga

SEQ ID NO: 248698 - DNA, 25 bp, Rattus norvegicus
ccccgtggtggaaatgtgaacttct

SEQ ID NO: 248699 - DNA, 25 bp, Rattus norvegicus
ccccgtggtggatatgtgaacttct

SEQ ID NO: 248700 - DNA, 25 bp, Rattus norvegicus
ccccgtggtgtgagaagagcctcga

SEQ ID NO: 248701 - DNA, 25 bp, Rattus norvegicus
ccccgtggtgtgtgaagagcctcga

SEQ ID NO: 248702 - DNA, 25 bp, Rattus norvegicus
ccccgtggttgtattgttctgattt

SEQ ID NO: 248703 - DNA, 25 bp, Rattus norvegicus
ccccgtggttgttttgttctgattt

SEQ ID NO: 248704 - DNA, 25 bp, Rattus norvegicus
ccccgtgtgcatcccaacagagttt

SEQ ID NO: 248705 - DNA, 25 bp, Rattus norvegicus
ccccgtgtgcatgccaacagagttt

SEQ ID NO: 248706 - DNA, 25 bp, Rattus norvegicus
ccccgtgtggtgagtatatcctggg

SEQ ID NO: 248707 - DNA, 25 bp, Rattus norvegicus
ccccgtgtggtgtgtatatcctggg

SEQ ID NO: 248708 - DNA, 25 bp, Rattus norvegicus
ccccgtgttgggaagaggcatgact

SEQ ID NO: 248709 - DNA, 25 bp, Rattus norvegicus
ccccgtgttgggtagaggcatgact

SEQ ID NO: 248710 - DNA, 25 bp, Rattus norvegicus
ccccgtgtttggatctattcttagt

SEQ ID NO: 248711 - DNA, 25 bp, Rattus norvegicus
ccccgtgtttggttctattcttagt

SEQ ID NO: 248712 - DNA, 25 bp, Rattus norvegicus
ccccgttattctaggtagtgagcac

SEQ ID NO: 248713 - DNA, 25 bp, Rattus norvegicus
ccccgttattcttggtagtgagcac

SEQ ID NO: 248714 - DNA, 25 bp, Rattus norvegicus
ccccgttctgagcatagtgccaaca

SEQ ID NO: 248715 - DNA, 25 bp, Rattus norvegicus
ccccgttctgaggatagtgccaaca

SEQ ID NO: 248716 - DNA, 25 bp, Rattus norvegicus
ccccgtttgagacgtgctgccgagt

SEQ ID NO: 248717 - DNA, 25 bp, Rattus norvegicus
ccccgtttgagaggtgctgccgagt

SEQ ID NO: 248718 - DNA, 25 bp, Rattus norvegicus
cccctaaaatataacctgttatgtg

SEQ ID NO: 248719 - DNA, 25 bp, Rattus norvegicus
cccctaaaatattacctgttatgtg

SEQ ID NO: 248720 - DNA, 25 bp, Rattus norvegicus
cccctaaagcatacttcatatggtt

SEQ ID NO: 248721 - DNA, 25 bp, Rattus norvegicus
cccctaaagcattcttcatatggtt

SEQ ID NO: 248722 - DNA, 25 bp, Rattus norvegicus
cccctaactgtcaactactttgata

SEQ ID NO: 248723 - DNA, 25 bp, Rattus norvegicus
cccctaactgtctactactttgata

SEQ ID NO: 248724 - DNA, 25 bp, Rattus norvegicus
cccctaagaagtcctgtgtccaagt

SEQ ID NO: 248725 - DNA, 25 bp, Rattus norvegicus
cccctaagaagtgctgtgtccaagt

SEQ ID NO: 248726 - DNA, 25 bp, Rattus norvegicus
cccctaagggctctagtgtggcata

SEQ ID NO: 248727 - DNA, 25 bp, Rattus norvegicus
cccctaagggctgtagtgtggcata

SEQ ID NO: 248728 - DNA, 25 bp, Rattus norvegicus
cccctaagttgtacatgtcttgcca

SEQ ID NO: 248729 - DNA, 25 bp, Rattus norvegicus
cccctaagttgttcatgtcttgcca

SEQ ID NO: 248730 - DNA, 25 bp, Rattus norvegicus
cccctaatattaaacacacacgtat

SEQ ID NO: 248731 - DNA, 25 bp, Rattus norvegicus
cccctaatattatacacacacgtat

SEQ ID NO: 248732 - DNA, 25 bp, Rattus norvegicus
cccctaatgtgaccttctcctttaa

SEQ ID NO: 248733 - DNA, 25 bp, Rattus norvegicus
cccctaatgtgagcttctcctttaa

SEQ ID NO: 248734 - DNA, 25 bp, Rattus norvegicus
cccctacatagtatctgtttctact

SEQ ID NO: 248735 - DNA, 25 bp, Rattus norvegicus
cccctacatagtttctgtttctact

SEQ ID NO: 248736 - DNA, 25 bp, Rattus norvegicus
cccctaccagtaaacaagtgtgcca

SEQ ID NO: 248737 - DNA, 25 bp, Rattus norvegicus
cccctaccagtatacaagtgtgcca

SEQ ID NO: 248738 - DNA, 25 bp, Rattus norvegicus
cccctagagaacctgagcattcgtg

SEQ ID NO: 248739 - DNA, 25 bp, Rattus norvegicus
cccctagagaacgtgagcattcgtg

SEQ ID NO: 248740 - DNA, 25 bp, Rattus norvegicus
cccctagaggcacgaacgtgtttga

SEQ ID NO: 248741 - DNA, 25 bp, Rattus norvegicus
cccctagaggcaggaacgtgtttga

SEQ ID NO: 248742 - DNA, 25 bp, Rattus norvegicus
cccctagcatggctcgaagtcgaat

SEQ ID NO: 248743 - DNA, 25 bp, Rattus norvegicus
cccctagcatgggtcgaagtcgaat

SEQ ID NO: 248744 - DNA, 25 bp, Rattus norvegicus
cccctagcctggatgctgggtagga

SEQ ID NO: 248745 - DNA, 25 bp, Rattus norvegicus
cccctagcctggttgctgggtagga

SEQ ID NO: 248746 - DNA, 25 bp, Rattus norvegicus
cccctaggaattctgtttgtgtaat

SEQ ID NO: 248747 - DNA, 25 bp, Rattus norvegicus
cccctaggaattgtgtttgtgtaat

SEQ ID NO: 248748 - DNA, 25 bp, Rattus norvegicus
cccctatcagggagtagttacatcc

SEQ ID NO: 248749 - DNA, 25 bp, Rattus norvegicus
cccctatcagggtgtagttacatcc

SEQ ID NO: 248750 - DNA, 25 bp, Rattus norvegicus
cccctatccaaacgaatcggctgtg

SEQ ID NO: 248751 - DNA, 25 bp, Rattus norvegicus
cccctatccaaaggaatcggctgtg

SEQ ID NO: 248752 - DNA, 25 bp, Rattus norvegicus
cccctatcccaaactgcatttataa

SEQ ID NO: 248753 - DNA, 25 bp, Rattus norvegicus
cccctatcccaatctgcatttataa

SEQ ID NO: 248754 - DNA, 25 bp, Rattus norvegicus
cccctatctgttaagctagtctcaa

SEQ ID NO: 248755 - DNA, 25 bp, Rattus norvegicus
cccctatctgtttagctagtctcaa

SEQ ID NO: 248756 - DNA, 25 bp, Rattus norvegicus
cccctatgatttctaaagcttgtga

SEQ ID NO: 248757 - DNA, 25 bp, Rattus norvegicus
cccctatgatttgtaaagcttgtga

SEQ ID NO: 248758 - DNA, 25 bp, Rattus norvegicus
cccctatgcattattgccttgcagt

SEQ ID NO: 248759 - DNA, 25 bp, Rattus norvegicus
cccctatgcatttttgccttgcagt

SEQ ID NO: 248760 - DNA, 25 bp, Rattus norvegicus
cccctatggcatagggatgtgatac

SEQ ID NO: 248761 - DNA, 25 bp, Rattus norvegicus
cccctatggcattgggatgtgatac

SEQ ID NO: 248762 - DNA, 25 bp, Rattus norvegicus
cccctattcctgatgtagcagtgat

SEQ ID NO: 248763 - DNA, 25 bp, Rattus norvegicus
cccctattcctgttgtagcagtgat

SEQ ID NO: 248764 - DNA, 25 bp, Rattus norvegicus
cccctcaaactcattgcagcagata

SEQ ID NO: 248765 - DNA, 25 bp, Rattus norvegicus
cccctcaaactctttgcagcagata

SEQ ID NO: 248766 - DNA, 25 bp, Rattus norvegicus
cccctcaaatccattctgaactgga

SEQ ID NO: 248767 - DNA, 25 bp, Rattus norvegicus
cccctcaaatcctttctgaactgga

SEQ ID NO: 248768 - DNA, 25 bp, Rattus norvegicus
cccctcaagcttctttcagatgtaa

SEQ ID NO: 248769 - DNA, 25 bp, Rattus norvegicus
cccctcaagcttgtttcagatgtaa

SEQ ID NO: 248770 - DNA, 25 bp, Rattus norvegicus
cccctcaagtgcaattttctggtat

SEQ ID NO: 248771 - DNA, 25 bp, Rattus norvegicus
cccctcaagtgctattttctggtat

SEQ ID NO: 248772 - DNA, 25 bp, Rattus norvegicus
cccctcaatggtctggagcgacata

SEQ ID NO: 248773 - DNA, 25 bp, Rattus norvegicus
cccctcaatggtgtggagcgacata

SEQ ID NO: 248774 - DNA, 25 bp, Rattus norvegicus
cccctcaattaaacatcgttattct

SEQ ID NO: 248775 - DNA, 25 bp, Rattus norvegicus
cccctcaattaatcatcgttattct

SEQ ID NO: 248776 - DNA, 25 bp, Rattus norvegicus
cccctcacaagcactggttgtactt

SEQ ID NO: 248777 - DNA, 25 bp, Rattus norvegicus
cccctcacaagctctggttgtactt

SEQ ID NO: 248778 - DNA, 25 bp, Rattus norvegicus
cccctcacacacagttgttggaatt

SEQ ID NO: 248779 - DNA, 25 bp, Rattus norvegicus
cccctcacacactgttgttggaatt

SEQ ID NO: 248780 - DNA, 25 bp, Rattus norvegicus
cccctcactaagcaaaattatgtga

SEQ ID NO: 248781 - DNA, 25 bp, Rattus norvegicus
cccctcactaaggaaaattatgtga

SEQ ID NO: 248782 - DNA, 25 bp, Rattus norvegicus
cccctcactcctatttattaagcat

SEQ ID NO: 248783 - DNA, 25 bp, Rattus norvegicus
cccctcactcctttttattaagcat

SEQ ID NO: 248784 - DNA, 25 bp, Rattus norvegicus
cccctcagtagtaggtcttgtaaat

SEQ ID NO: 248785 - DNA, 25 bp, Rattus norvegicus
cccctcagtagttggtcttgtaaat

SEQ ID NO: 248786 - DNA, 25 bp, Rattus norvegicus
cccctcattgtaagttactcagaat

SEQ ID NO: 248787 - DNA, 25 bp, Rattus norvegicus
cccctcattgtatgttactcagaat

SEQ ID NO: 248788 - DNA, 25 bp, Rattus norvegicus
cccctccaaaggaggcattgaagga

SEQ ID NO: 248789 - DNA, 25 bp, Rattus norvegicus
cccctccaaaggtggcattgaagga

SEQ ID NO: 248790 - DNA, 25 bp, Rattus norvegicus
cccctccctcagactggaagatgga

SEQ ID NO: 248791 - DNA, 25 bp, Rattus norvegicus
cccctccctcagtctggaagatgga

SEQ ID NO: 248792 - DNA, 25 bp, Rattus norvegicus
cccctcctaattaccagtattcata

SEQ ID NO: 248793 - DNA, 25 bp, Rattus norvegicus
cccctcctaatttccagtattcata

SEQ ID NO: 248794 - DNA, 25 bp, Rattus norvegicus
cccctcctgcttctggtaacatgga

SEQ ID NO: 248795 - DNA, 25 bp, Rattus norvegicus
cccctcctgcttgtggtaacatgga

SEQ ID NO: 248796 - DNA, 25 bp, Rattus norvegicus
cccctccttgatcttaaacttacag

SEQ ID NO: 248797 - DNA, 25 bp, Rattus norvegicus
cccctccttgatgttaaacttacag

SEQ ID NO: 248798 - DNA, 25 bp, Rattus norvegicus
cccctccttgctcttctggaaaggg

SEQ ID NO: 248799 - DNA, 25 bp, Rattus norvegicus
cccctccttgctgttctggaaaggg

SEQ ID NO: 248800 - DNA, 25 bp, Rattus norvegicus
cccctcctttagacattgacctgga

SEQ ID NO: 248801 - DNA, 25 bp, Rattus norvegicus
cccctcctttagtcattgacctgga

SEQ ID NO: 248802 - DNA, 25 bp, Rattus norvegicus
cccctcggagcaccaaggtgaatgg

SEQ ID NO: 248803 - DNA, 25 bp, Rattus norvegicus
cccctcggagcagcaaggtgaatgg

SEQ ID NO: 248804 - DNA, 25 bp, Rattus norvegicus
cccctcgtgggtccgtgtagccaag

SEQ ID NO: 248805 - DNA, 25 bp, Rattus norvegicus
cccctcgtgggtgcgtgtagccaag

SEQ ID NO: 248806 - DNA, 25 bp, Rattus norvegicus
cccctctaactcactattgatgtgt

SEQ ID NO: 248807 - DNA, 25 bp, Rattus norvegicus
cccctctaactctctattgatgtgt

SEQ ID NO: 248808 - DNA, 25 bp, Rattus norvegicus
cccctctcaaggagatctgttttca

SEQ ID NO: 248809 - DNA, 25 bp, Rattus norvegicus
cccctctcaaggtgatctgttttca

SEQ ID NO: 248810 - DNA, 25 bp, Rattus norvegicus
cccctctcaagtcacaagcattttt

SEQ ID NO: 248811 - DNA, 25 bp, Rattus norvegicus
cccctctcaagtgacaagcattttt

SEQ ID NO: 248812 - DNA, 25 bp, Rattus norvegicus
cccctctcattcctaatttgtttat

SEQ ID NO: 248813 - DNA, 25 bp, Rattus norvegicus
cccctctcattcgtaatttgtttat

SEQ ID NO: 248814 - DNA, 25 bp, Rattus norvegicus
cccctctccattatgggaattctat

SEQ ID NO: 248815 - DNA, 25 bp, Rattus norvegicus
cccctctccattattagaaccagtg

SEQ ID NO: 248816 - DNA, 25 bp, Rattus norvegicus
cccctctccattttgggaattctat

SEQ ID NO: 248817 - DNA, 25 bp, Rattus norvegicus
cccctctccatttttagaaccagtg

SEQ ID NO: 248818 - DNA, 25 bp, Rattus norvegicus
cccctctctcagaattccaaatata

SEQ ID NO: 248819 - DNA, 25 bp, Rattus norvegicus
cccctctctcagtattccaaatata

SEQ ID NO: 248820 - DNA, 25 bp, Rattus norvegicus
cccctctctgaaagttaatgactcc

SEQ ID NO: 248821 - DNA, 25 bp, Rattus norvegicus
cccctctctgaatgttaatgactcc

SEQ ID NO: 248822 - DNA, 25 bp, Rattus norvegicus
cccctctctgtacatgtagaacatt

SEQ ID NO: 248823 - DNA, 25 bp, Rattus norvegicus
cccctctctgtagatgtagaacatt

SEQ ID NO: 248824 - DNA, 25 bp, Rattus norvegicus
cccctctctgtgaatctttcttaga

SEQ ID NO: 248825 - DNA, 25 bp, Rattus norvegicus
cccctctctgtgtatctttcttaga

SEQ ID NO: 248826 - DNA, 25 bp, Rattus norvegicus
cccctctgagcaaatggatcgatta

SEQ ID NO: 248827 - DNA, 25 bp, Rattus norvegicus
cccctctgagcatatggatcgatta

SEQ ID NO: 248828 - DNA, 25 bp, Rattus norvegicus
cccctctgagtacctatgtaggatt

SEQ ID NO: 248829 - DNA, 25 bp, Rattus norvegicus
cccctctgagtagctatgtaggatt

SEQ ID NO: 248830 - DNA, 25 bp, Rattus norvegicus
cccctctgcacactactgtggagaa

SEQ ID NO: 248831 - DNA, 25 bp, Rattus norvegicus
cccctctgcacagtactgtggagaa

SEQ ID NO: 248832 - DNA, 25 bp, Rattus norvegicus
cccctctggaaacctgtggcgtgat

SEQ ID NO: 248833 - DNA, 25 bp, Rattus norvegicus
cccctctggaaagctgtggcgtgat

SEQ ID NO: 248834 - DNA, 25 bp, Rattus norvegicus
cccctctgtctcagaaaagaaagat

SEQ ID NO: 248835 - DNA, 25 bp, Rattus norvegicus
cccctctgtctctgaaaagaaagat

SEQ ID NO: 248836 - DNA, 25 bp, Rattus norvegicus
cccctcttcaacagaatcctgaaga

SEQ ID NO: 248837 - DNA, 25 bp, Rattus norvegicus
cccctcttcaactgaatcctgaaga

SEQ ID NO: 248838 - DNA, 25 bp, Rattus norvegicus
cccctcttcctaagtagctttaatg

SEQ ID NO: 248839 - DNA, 25 bp, Rattus norvegicus
cccctcttcctatgtagctttaatg

SEQ ID NO: 248840 - DNA, 25 bp, Rattus norvegicus
cccctcttgagaagctaatttctga

SEQ ID NO: 248841 - DNA, 25 bp, Rattus norvegicus
cccctcttgagatgctaatttctga

SEQ ID NO: 248842 - DNA, 25 bp, Rattus norvegicus
cccctcttgtcgagtgaggtgatgg

SEQ ID NO: 248843 - DNA, 25 bp, Rattus norvegicus
cccctcttgtcgtgtgaggtgatgg

SEQ ID NO: 248844 - DNA, 25 bp, Rattus norvegicus
cccctcttgtgaattgatactttat

SEQ ID NO: 248845 - DNA, 25 bp, Rattus norvegicus
cccctcttgtgatttgatactttat

SEQ ID NO: 248846 - DNA, 25 bp, Rattus norvegicus
cccctgaactgccttctgaggataa

SEQ ID NO: 248847 - DNA, 25 bp, Rattus norvegicus
cccctgaactgcgttctgaggataa

SEQ ID NO: 248848 - DNA, 25 bp, Rattus norvegicus
cccctgaagtcacctgatgttctta

SEQ ID NO: 248849 - DNA, 25 bp, Rattus norvegicus
cccctgaagtcagctgatgttctta

SEQ ID NO: 248850 - DNA, 25 bp, Rattus norvegicus
cccctgaatctgagttcttatcttg

SEQ ID NO: 248851 - DNA, 25 bp, Rattus norvegicus
cccctgaatctgtgttcttatcttg

SEQ ID NO: 248852 - DNA, 25 bp, Rattus norvegicus
cccctgaatgttactgactttaatg

SEQ ID NO: 248853 - DNA, 25 bp, Rattus norvegicus
cccctgaatgtttctgactttaatg

SEQ ID NO: 248854 - DNA, 25 bp, Rattus norvegicus
cccctgaattggcaattacctgatg

SEQ ID NO: 248855 - DNA, 25 bp, Rattus norvegicus
cccctgaattgggaattacctgatg

SEQ ID NO: 248856 - DNA, 25 bp, Rattus norvegicus
cccctgacgttgcaaacacctgtgt

SEQ ID NO: 248857 - DNA, 25 bp, Rattus norvegicus
cccctgacgttggaaacacctgtgt

SEQ ID NO: 248858 - DNA, 25 bp, Rattus norvegicus
cccctgacttcaatggctgctgagt

SEQ ID NO: 248859 - DNA, 25 bp, Rattus norvegicus
cccctgacttcattggctgctgagt

SEQ ID NO: 248860 - DNA, 25 bp, Rattus norvegicus
cccctgagagcactttagccaaaaa

SEQ ID NO: 248861 - DNA, 25 bp, Rattus norvegicus
cccctgagagcagtttagccaaaaa

SEQ ID NO: 248862 - DNA, 25 bp, Rattus norvegicus
cccctgagattcatggcaatcttaa

SEQ ID NO: 248863 - DNA, 25 bp, Rattus norvegicus
cccctgagattcttggcaatcttaa

SEQ ID NO: 248864 - DNA, 25 bp, Rattus norvegicus
cccctgagcaagagcatcctagata

SEQ ID NO: 248865 - DNA, 25 bp, Rattus norvegicus
cccctgagcaagtgcatcctagata

SEQ ID NO: 248866 - DNA, 25 bp, Rattus norvegicus
cccctgagccataggactgctgaaa

SEQ ID NO: 248867 - DNA, 25 bp, Rattus norvegicus
cccctgagccattggactgctgaaa

SEQ ID NO: 248868 - DNA, 25 bp, Rattus norvegicus
cccctgaggatacattgcaagaact

SEQ ID NO: 248869 - DNA, 25 bp, Rattus norvegicus
cccctgaggatagattgcaagaact

SEQ ID NO: 248870 - DNA, 25 bp, Rattus norvegicus
cccctgagtgggacgaagctgagat

SEQ ID NO: 248871 - DNA, 25 bp, Rattus norvegicus
cccctgagtgggtcgaagctgagat

SEQ ID NO: 248872 - DNA, 25 bp, Rattus norvegicus
cccctgatcggacaccctattaaga

SEQ ID NO: 248873 - DNA, 25 bp, Rattus norvegicus
cccctgatcggagaccctattaaga

SEQ ID NO: 248874 - DNA, 25 bp, Rattus norvegicus
cccctgatctgacttttgtttttgg

SEQ ID NO: 248875 - DNA, 25 bp, Rattus norvegicus
cccctgatctgagttttgtttttgg

SEQ ID NO: 248876 - DNA, 25 bp, Rattus norvegicus
cccctgatggaacaactgtacattt

SEQ ID NO: 248877 - DNA, 25 bp, Rattus norvegicus
cccctgatggaagaactgtacattt

SEQ ID NO: 248878 - DNA, 25 bp, Rattus norvegicus
cccctgatggctcgataccggagta

SEQ ID NO: 248879 - DNA, 25 bp, Rattus norvegicus
cccctgatggctggataccggagta

SEQ ID NO: 248880 - DNA, 25 bp, Rattus norvegicus
cccctgatgttcagcagtcagatgt

SEQ ID NO: 248881 - DNA, 25 bp, Rattus norvegicus
cccctgatgttctgcagtcagatgt

SEQ ID NO: 248882 - DNA, 25 bp, Rattus norvegicus
cccctgcaacttactgtacatatga

SEQ ID NO: 248883 - DNA, 25 bp, Rattus norvegicus
cccctgcaactttctgtacatatga

SEQ ID NO: 248884 - DNA, 25 bp, Rattus norvegicus
cccctgcaccagagtcacttatata

SEQ ID NO: 248885 - DNA, 25 bp, Rattus norvegicus
cccctgcaccagtgtcacttatata

SEQ ID NO: 248886 - DNA, 25 bp, Rattus norvegicus
cccctgcagaggagacagtgacagc

SEQ ID NO: 248887 - DNA, 25 bp, Rattus norvegicus
cccctgcagaggtgacagtgacagc

SEQ ID NO: 248888 - DNA, 25 bp, Rattus norvegicus
cccctgcaggtgagaggatgctgtc

SEQ ID NO: 248889 - DNA, 25 bp, Rattus norvegicus
cccctgcaggtgtgaggatgctgtc

SEQ ID NO: 248890 - DNA, 25 bp, Rattus norvegicus
cccctgccaagaagactgtcaattt

SEQ ID NO: 248891 - DNA, 25 bp, Rattus norvegicus
cccctgccaagatgactgtcaattt

SEQ ID NO: 248892 - DNA, 25 bp, Rattus norvegicus
cccctgccccagaatataatttgtt

SEQ ID NO: 248893 - DNA, 25 bp, Rattus norvegicus
cccctgccccagtatataatttgtt

SEQ ID NO: 248894 - DNA, 25 bp, Rattus norvegicus
cccctgcctcggctgtaagtgacag

SEQ ID NO: 248895 - DNA, 25 bp, Rattus norvegicus
cccctgcctcgggtgtaagtgacag

SEQ ID NO: 248896 - DNA, 25 bp, Rattus norvegicus
cccctgcctcgtcttttgagaaaag

SEQ ID NO: 248897 - DNA, 25 bp, Rattus norvegicus
cccctgcctcgtgttttgagaaaag

SEQ ID NO: 248898 - DNA, 25 bp, Rattus norvegicus
cccctgcctctgaagagcaaagatg

SEQ ID NO: 248899 - DNA, 25 bp, Rattus norvegicus
cccctgcctctgtagagcaaagatg

SEQ ID NO: 248900 - DNA, 25 bp, Rattus norvegicus
cccctgcctcttatagtaacattca

SEQ ID NO: 248901 - DNA, 25 bp, Rattus norvegicus
cccctgcctcttttagtaacattca

SEQ ID NO: 248902 - DNA, 25 bp, Rattus norvegicus
cccctgcgctgccagataatgtgaa

SEQ ID NO: 248903 - DNA, 25 bp, Rattus norvegicus
cccctgcgctgcgagataatgtgaa

SEQ ID NO: 248904 - DNA, 25 bp, Rattus norvegicus
cccctgcggatcaacagtgaggcaa

SEQ ID NO: 248905 - DNA, 25 bp, Rattus norvegicus
cccctgcggatctacagtgaggcaa

SEQ ID NO: 248906 - DNA, 25 bp, Rattus norvegicus
cccctgctcaaccggcagtgaggag

SEQ ID NO: 248907 - DNA, 25 bp, Rattus norvegicus
cccctgctcaacgggcagtgaggag

SEQ ID NO: 248908 - DNA, 25 bp, Rattus norvegicus
cccctgctggaaagtgtgacctgga

SEQ ID NO: 248909 - DNA, 25 bp, Rattus norvegicus
cccctgctggaatgtgtgacctgga

SEQ ID NO: 248910 - DNA, 25 bp, Rattus norvegicus
cccctgctgtcgcagatgtagaaac

SEQ ID NO: 248911 - DNA, 25 bp, Rattus norvegicus
cccctgctgtcggagatgtagaaac

SEQ ID NO: 248912 - DNA, 25 bp, Rattus norvegicus
cccctgcttcggatggtgacagaag

SEQ ID NO: 248913 - DNA, 25 bp, Rattus norvegicus
cccctgcttcggttggtgacagaag

SEQ ID NO: 248914 - DNA, 25 bp, Rattus norvegicus
cccctgctttgtacagtatctggca

SEQ ID NO: 248915 - DNA, 25 bp, Rattus norvegicus
cccctgctttgttcagtatctggca

SEQ ID NO: 248916 - DNA, 25 bp, Rattus norvegicus
cccctggacaggctgtacgagatcc

SEQ ID NO: 248917 - DNA, 25 bp, Rattus norvegicus
cccctggacagggtgtacgagatcc

SEQ ID NO: 248918 - DNA, 25 bp, Rattus norvegicus
cccctggagaggagaatagatatga

SEQ ID NO: 248919 - DNA, 25 bp, Rattus norvegicus
cccctggagaggtgaatagatatga

SEQ ID NO: 248920 - DNA, 25 bp, Rattus norvegicus
cccctggagattctctttcataaca

SEQ ID NO: 248921 - DNA, 25 bp, Rattus norvegicus
cccctggagattgtctttcataaca

SEQ ID NO: 248922 - DNA, 25 bp, Rattus norvegicus
cccctggatgtgagacgaaatcgca

SEQ ID NO: 248923 - DNA, 25 bp, Rattus norvegicus
cccctggatgtgtgacgaaatcgca

SEQ ID NO: 248924 - DNA, 25 bp, Rattus norvegicus
cccctggctactatgactgtggaga

SEQ ID NO: 248925 - DNA, 25 bp, Rattus norvegicus
cccctggctactttgactgtggaga

SEQ ID NO: 248926 - DNA, 25 bp, Rattus norvegicus
cccctgggaggcatctgtgagttac

SEQ ID NO: 248927 - DNA, 25 bp, Rattus norvegicus
cccctgggaggcttctgtgagttac

SEQ ID NO: 248928 - DNA, 25 bp, Rattus norvegicus
cccctggtagataagctggctgtca

SEQ ID NO: 248929 - DNA, 25 bp, Rattus norvegicus
cccctggtagattagctggctgtca

SEQ ID NO: 248930 - DNA, 25 bp, Rattus norvegicus
cccctggtgatgaacttgagtggct

SEQ ID NO: 248931 - DNA, 25 bp, Rattus norvegicus
cccctggtgatgtacttgagtggct

SEQ ID NO: 248932 - DNA, 25 bp, Rattus norvegicus
cccctggtggtaccttacagagatt

SEQ ID NO: 248933 - DNA, 25 bp, Rattus norvegicus
cccctggtggtagcttacagagatt

SEQ ID NO: 248934 - DNA, 25 bp, Rattus norvegicus
cccctggttgtgacatactgaaata

SEQ ID NO: 248935 - DNA, 25 bp, Rattus norvegicus
cccctggttgtgtcatactgaaata

SEQ ID NO: 248936 - DNA, 25 bp, Rattus norvegicus
cccctgtacagtattgcagcaaact

SEQ ID NO: 248937 - DNA, 25 bp, Rattus norvegicus
cccctgtacagttttgcagcaaact

SEQ ID NO: 248938 - DNA, 25 bp, Rattus norvegicus
cccctgtaccatcaacatagactta

SEQ ID NO: 248939 - DNA, 25 bp, Rattus norvegicus
cccctgtaccatgaacatagactta

SEQ ID NO: 248940 - DNA, 25 bp, Rattus norvegicus
cccctgtagattactatgagcctaa

SEQ ID NO: 248941 - DNA, 25 bp, Rattus norvegicus
cccctgtagatttctatgagcctaa

SEQ ID NO: 248942 - DNA, 25 bp, Rattus norvegicus
cccctgtctacacagtccgagaata

SEQ ID NO: 248943 - DNA, 25 bp, Rattus norvegicus
cccctgtctacagagtccgagaata

SEQ ID NO: 248944 - DNA, 25 bp, Rattus norvegicus
cccctgtctcctatgtgttgggaaa

SEQ ID NO: 248945 - DNA, 25 bp, Rattus norvegicus
cccctgtctcctttgtgttgggaaa

SEQ ID NO: 248946 - DNA, 25 bp, Rattus norvegicus
cccctgtcttcaagttcaaatctga

SEQ ID NO: 248947 - DNA, 25 bp, Rattus norvegicus
cccctgtcttcatgttcaaatctga

SEQ ID NO: 248948 - DNA, 25 bp, Rattus norvegicus
cccctgtcttgccatatatcgttaa

SEQ ID NO: 248949 - DNA, 25 bp, Rattus norvegicus
cccctgtcttgcgatatatcgttaa

SEQ ID NO: 248950 - DNA, 25 bp, Rattus norvegicus
cccctgtgaacaagctcttgaagta

SEQ ID NO: 248951 - DNA, 25 bp, Rattus norvegicus
cccctgtgaacatgctcttgaagta

SEQ ID NO: 248952 - DNA, 25 bp, Rattus norvegicus
cccctgtgaagtaactctggtttgt

SEQ ID NO: 248953 - DNA, 25 bp, Rattus norvegicus
cccctgtgaagttactctggtttgt

SEQ ID NO: 248954 - DNA, 25 bp, Rattus norvegicus
cccctgtgagcccttatagaactga

SEQ ID NO: 248955 - DNA, 25 bp, Rattus norvegicus
cccctgtgagccgttatagaactga

SEQ ID NO: 248956 - DNA, 25 bp, Rattus norvegicus
cccctgtgccaactggtggtgtaaa

SEQ ID NO: 248957 - DNA, 25 bp, Rattus norvegicus
cccctgtgccaagtggtggtgtaaa

SEQ ID NO: 248958 - DNA, 25 bp, Rattus norvegicus
cccctgtgtgttagagttctttcat

SEQ ID NO: 248959 - DNA, 25 bp, Rattus norvegicus
cccctgtgtgtttgagttctttcat

SEQ ID NO: 248960 - DNA, 25 bp, Rattus norvegicus
cccctgtgttgaatagctacctcaa

SEQ ID NO: 248961 - DNA, 25 bp, Rattus norvegicus
cccctgtgttgattagctacctcaa

SEQ ID NO: 248962 - DNA, 25 bp, Rattus norvegicus
cccctgttcattcaacgatgaagag

SEQ ID NO: 248963 - DNA, 25 bp, Rattus norvegicus
cccctgttcattgaacgatgaagag

SEQ ID NO: 248964 - DNA, 25 bp, Rattus norvegicus
cccctgttctgaagtgcctttcgca

SEQ ID NO: 248965 - DNA, 25 bp, Rattus norvegicus
cccctgttctgatgtgcctttcgca

SEQ ID NO: 248966 - DNA, 25 bp, Rattus norvegicus
ccccttagctgcattgtccaggaaa

SEQ ID NO: 248967 - DNA, 25 bp, Rattus norvegicus
ccccttagctgctttgtccaggaaa

SEQ ID NO: 248968 - DNA, 25 bp, Rattus norvegicus
ccccttaggcagctgctgaacataa

SEQ ID NO: 248969 - DNA, 25 bp, Rattus norvegicus
ccccttaggcaggtgctgaacataa

SEQ ID NO: 248970 - DNA, 25 bp, Rattus norvegicus
ccccttagttctagaattgttatga

SEQ ID NO: 248971 - DNA, 25 bp, Rattus norvegicus
ccccttagttcttgaattgttatga

SEQ ID NO: 248972 - DNA, 25 bp, Rattus norvegicus
ccccttatcctcaagagtcataaaa

SEQ ID NO: 248973 - DNA, 25 bp, Rattus norvegicus
ccccttatcctctagagtcataaaa

SEQ ID NO: 248974 - DNA, 25 bp, Rattus norvegicus
ccccttatgtgtagaacagactgta

SEQ ID NO: 248975 - DNA, 25 bp, Rattus norvegicus
ccccttatgtgttgaacagactgta

SEQ ID NO: 248976 - DNA, 25 bp, Rattus norvegicus
ccccttcaagacagtacctttggat

SEQ ID NO: 248977 - DNA, 25 bp, Rattus norvegicus
ccccttcaagactgtacctttggat

SEQ ID NO: 248978 - DNA, 25 bp, Rattus norvegicus
ccccttcatcttcatcaagaactgg

SEQ ID NO: 248979 - DNA, 25 bp, Rattus norvegicus
ccccttcatcttgatcaagaactgg

SEQ ID NO: 248980 - DNA, 25 bp, Rattus norvegicus
ccccttcattacatgagcatcatga

SEQ ID NO: 248981 - DNA, 25 bp, Rattus norvegicus
ccccttcattacttgagcatcatga

SEQ ID NO: 248982 - DNA, 25 bp, Rattus norvegicus
ccccttcccaggaatagcatctagg

SEQ ID NO: 248983 - DNA, 25 bp, Rattus norvegicus
ccccttcccaggtatagcatctagg

SEQ ID NO: 248984 - DNA, 25 bp, Rattus norvegicus
ccccttcctaagagtgattctcaca

SEQ ID NO: 248985 - DNA, 25 bp, Rattus norvegicus
ccccttcctaagtgtgattctcaca

SEQ ID NO: 248986 - DNA, 25 bp, Rattus norvegicus
ccccttcctagtccgatgtaataat

SEQ ID NO: 248987 - DNA, 25 bp, Rattus norvegicus
ccccttcctagtgcgatgtaataat

SEQ ID NO: 248988 - DNA, 25 bp, Rattus norvegicus
ccccttccttagcacttggtgagtg

SEQ ID NO: 248989 - DNA, 25 bp, Rattus norvegicus
ccccttccttaggacttggtgagtg

SEQ ID NO: 248990 - DNA, 25 bp, Rattus norvegicus
ccccttcgcttcaattattcatgaa

SEQ ID NO: 248991 - DNA, 25 bp, Rattus norvegicus
ccccttcgcttctattattcatgaa

SEQ ID NO: 248992 - DNA, 25 bp, Rattus norvegicus
ccccttcggtggatgctatggaagt

SEQ ID NO: 248993 - DNA, 25 bp, Rattus norvegicus
ccccttcggtggttgctatggaagt

SEQ ID NO: 248994 - DNA, 25 bp, Rattus norvegicus
ccccttctatccagacttggtgaaa

SEQ ID NO: 248995 - DNA, 25 bp, Rattus norvegicus
ccccttctatcctgacttggtgaaa

SEQ ID NO: 248996 - DNA, 25 bp, Rattus norvegicus
ccccttctcagacgaggatctgggt

SEQ ID NO: 248997 - DNA, 25 bp, Rattus norvegicus
ccccttctcagaggaggatctgggt

SEQ ID NO: 248998 - DNA, 25 bp, Rattus norvegicus
ccccttctgaaaatcggcattggat

SEQ ID NO: 248999 - DNA, 25 bp, Rattus norvegicus
ccccttctgaaattcggcattggat

SEQ ID NO: 249000 - DNA, 25 bp, Rattus norvegicus
ccccttctgaacagagtaattctgt

SEQ ID NO: 249001 - DNA, 25 bp, Rattus norvegicus
ccccttctgaactgagtaattctgt

SEQ ID NO: 249002 - DNA, 25 bp, Rattus norvegicus
ccccttctgtatctgtgttgaccta

SEQ ID NO: 249003 - DNA, 25 bp, Rattus norvegicus
ccccttctgtatgtgtgttgaccta

SEQ ID NO: 249004 - DNA, 25 bp, Rattus norvegicus
ccccttctgtttattgcatggctat

SEQ ID NO: 249005 - DNA, 25 bp, Rattus norvegicus
ccccttctgttttttgcatggctat

SEQ ID NO: 249006 - DNA, 25 bp, Rattus norvegicus
ccccttcttatgaattatgcctgca

SEQ ID NO: 249007 - DNA, 25 bp, Rattus norvegicus
ccccttcttatgtattatgcctgca

SEQ ID NO: 249008 - DNA, 25 bp, Rattus norvegicus
ccccttctttttcctgatttgcaca

SEQ ID NO: 249009 - DNA, 25 bp, Rattus norvegicus
ccccttctttttgctgatttgcaca

SEQ ID NO: 249010 - DNA, 25 bp, Rattus norvegicus
ccccttgaaggactactttgcatgt

SEQ ID NO: 249011 - DNA, 25 bp, Rattus norvegicus
ccccttgaaggagtactttgcatgt

SEQ ID NO: 249012 - DNA, 25 bp, Rattus norvegicus
ccccttgaatggactctagctgagc

SEQ ID NO: 249013 - DNA, 25 bp, Rattus norvegicus
ccccttgaatggtctctagctgagc

SEQ ID NO: 249014 - DNA, 25 bp, Rattus norvegicus
ccccttgaatttcgatgcgaataac

SEQ ID NO: 249015 - DNA, 25 bp, Rattus norvegicus
ccccttgaatttggatgcgaataac

SEQ ID NO: 249016 - DNA, 25 bp, Rattus norvegicus
ccccttgagaaaaactggacatggg

SEQ ID NO: 249017 - DNA, 25 bp, Rattus norvegicus
ccccttgagaaatactggacatggg

SEQ ID NO: 249018 - DNA, 25 bp, Rattus norvegicus
ccccttgagatgcatcccaatttga

SEQ ID NO: 249019 - DNA, 25 bp, Rattus norvegicus
ccccttgagatggatcccaatttga

SEQ ID NO: 249020 - DNA, 25 bp, Rattus norvegicus
ccccttgagtttcgcatatatgaat

SEQ ID NO: 249021 - DNA, 25 bp, Rattus norvegicus
ccccttgagtttggcatatatgaat

SEQ ID NO: 249022 - DNA, 25 bp, Rattus norvegicus
ccccttgcaactcggccagtgctgt

SEQ ID NO: 249023 - DNA, 25 bp, Rattus norvegicus
ccccttgcaactgggccagtgctgt

SEQ ID NO: 249024 - DNA, 25 bp, Rattus norvegicus
ccccttgcaggcaggaagcaatcgt

SEQ ID NO: 249025 - DNA, 25 bp, Rattus norvegicus
ccccttgcaggctggaagcaatcgt

SEQ ID NO: 249026 - DNA, 25 bp, Rattus norvegicus
ccccttgcatcaactggaacatggt

SEQ ID NO: 249027 - DNA, 25 bp, Rattus norvegicus
ccccttgcatcatctggaacatggt

SEQ ID NO: 249028 - DNA, 25 bp, Rattus norvegicus
ccccttgcatgtcagtgaaatgtca

SEQ ID NO: 249029 - DNA, 25 bp, Rattus norvegicus
ccccttgcatgtgagtgaaatgtca

SEQ ID NO: 249030 - DNA, 25 bp, Rattus norvegicus
ccccttgcttggatcctgggaacaa

SEQ ID NO: 249031 - DNA, 25 bp, Rattus norvegicus
ccccttgcttggttcctgggaacaa

SEQ ID NO: 249032 - DNA, 25 bp, Rattus norvegicus
ccccttggagctcattctgggcaca

SEQ ID NO: 249033 - DNA, 25 bp, Rattus norvegicus
ccccttggagctgattctgggcaca

SEQ ID NO: 249034 - DNA, 25 bp, Rattus norvegicus
ccccttggagtaaatcctggtaaat

SEQ ID NO: 249035 - DNA, 25 bp, Rattus norvegicus
ccccttggagtatatcctggtaaat

SEQ ID NO: 249036 - DNA, 25 bp, Rattus norvegicus
ccccttggcagacagctatgtggaa

SEQ ID NO: 249037 - DNA, 25 bp, Rattus norvegicus
ccccttggcagagagctatgtggaa

SEQ ID NO: 249038 - DNA, 25 bp, Rattus norvegicus
ccccttggctctcgttaaattgtat

SEQ ID NO: 249039 - DNA, 25 bp, Rattus norvegicus
ccccttggctctggttaaattgtat

SEQ ID NO: 249040 - DNA, 25 bp, Rattus norvegicus
ccccttgggcttctagtatggacat

SEQ ID NO: 249041 - DNA, 25 bp, Rattus norvegicus
ccccttgggcttgtagtatggacat

SEQ ID NO: 249042 - DNA, 25 bp, Rattus norvegicus
ccccttggtagcattagtcaataca

SEQ ID NO: 249043 - DNA, 25 bp, Rattus norvegicus
ccccttggtagctttagtcaataca

SEQ ID NO: 249044 - DNA, 25 bp, Rattus norvegicus
ccccttggtcacacttgaatgtgta

SEQ ID NO: 249045 - DNA, 25 bp, Rattus norvegicus
ccccttggtcactcttgaatgtgta

SEQ ID NO: 249046 - DNA, 25 bp, Rattus norvegicus
ccccttggtctcatcatgatgaaat

SEQ ID NO: 249047 - DNA, 25 bp, Rattus norvegicus
ccccttggtctcttcatgatgaaat

SEQ ID NO: 249048 - DNA, 25 bp, Rattus norvegicus
ccccttgtagcgcttgtgtttaatg

SEQ ID NO: 249049 - DNA, 25 bp, Rattus norvegicus
ccccttgtagcggttgtgtttaatg

SEQ ID NO: 249050 - DNA, 25 bp, Rattus norvegicus
ccccttgtagctatcattttctcta

SEQ ID NO: 249051 - DNA, 25 bp, Rattus norvegicus
ccccttgtagctttcattttctcta

SEQ ID NO: 249052 - DNA, 25 bp, Rattus norvegicus
ccccttgtcaggagtgtacatgtac

SEQ ID NO: 249053 - DNA, 25 bp, Rattus norvegicus
ccccttgtcaggtgtgtacatgtac

SEQ ID NO: 249054 - DNA, 25 bp, Rattus norvegicus
ccccttgtcatgacttagatctaca

SEQ ID NO: 249055 - DNA, 25 bp, Rattus norvegicus
ccccttgtcatgtcttagatctaca

SEQ ID NO: 249056 - DNA, 25 bp, Rattus norvegicus
ccccttgtcctcatggtatcagaaa

SEQ ID NO: 249057 - DNA, 25 bp, Rattus norvegicus
ccccttgtcctcttggtatcagaaa

SEQ ID NO: 249058 - DNA, 25 bp, Rattus norvegicus
ccccttgtgtgtatatggtaacctt

SEQ ID NO: 249059 - DNA, 25 bp, Rattus norvegicus
ccccttgtgtgtttatggtaacctt

SEQ ID NO: 249060 - DNA, 25 bp, Rattus norvegicus
ccccttgttcttcgccagagtgaga

SEQ ID NO: 249061 - DNA, 25 bp, Rattus norvegicus
ccccttgttcttggccagagtgaga

SEQ ID NO: 249062 - DNA, 25 bp, Rattus norvegicus
ccccttgttgagaaacgctctcatt

SEQ ID NO: 249063 - DNA, 25 bp, Rattus norvegicus
ccccttgttgagtaacgctctcatt

SEQ ID NO: 249064 - DNA, 25 bp, Rattus norvegicus
cccctttaagctcgtctaatgaata

SEQ ID NO: 249065 - DNA, 25 bp, Rattus norvegicus
cccctttaagctggtctaatgaata

SEQ ID NO: 249066 - DNA, 25 bp, Rattus norvegicus
cccctttcctgtctgaaccgagatg

SEQ ID NO: 249067 - DNA, 25 bp, Rattus norvegicus
cccctttcctgtgtgaaccgagatg

SEQ ID NO: 249068 - DNA, 25 bp, Rattus norvegicus
cccctttccttgagagtgggattga

SEQ ID NO: 249069 - DNA, 25 bp, Rattus norvegicus
cccctttccttgtgagtgggattga

SEQ ID NO: 249070 - DNA, 25 bp, Rattus norvegicus
cccctttctaagctagtgtggctta

SEQ ID NO: 249071 - DNA, 25 bp, Rattus norvegicus
cccctttctaaggtagtgtggctta

SEQ ID NO: 249072 - DNA, 25 bp, Rattus norvegicus
cccctttctccaaacatgtgtagca

SEQ ID NO: 249073 - DNA, 25 bp, Rattus norvegicus
cccctttctccatacatgtgtagca

SEQ ID NO: 249074 - DNA, 25 bp, Rattus norvegicus
cccctttgatggactatcgttttat

SEQ ID NO: 249075 - DNA, 25 bp, Rattus norvegicus
cccctttgatggtctatcgttttat

SEQ ID NO: 249076 - DNA, 25 bp, Rattus norvegicus
cccctttggaggcatgtctcagcga

SEQ ID NO: 249077 - DNA, 25 bp, Rattus norvegicus
cccctttggagggatgtctcagcga

SEQ ID NO: 249078 - DNA, 25 bp, Rattus norvegicus
cccctttgtcctctgaggcatatta

SEQ ID NO: 249079 - DNA, 25 bp, Rattus norvegicus
cccctttgtcctgtgaggcatatta

SEQ ID NO: 249080 - DNA, 25 bp, Rattus norvegicus
cccctttgtgtacttcaagtcttgg

SEQ ID NO: 249081 - DNA, 25 bp, Rattus norvegicus
cccctttgtgtagttcaagtcttgg

SEQ ID NO: 249082 - DNA, 25 bp, Rattus norvegicus
cccctttgtttaagataatctactt

SEQ ID NO: 249083 - DNA, 25 bp, Rattus norvegicus
cccctttgtttatgataatctactt

SEQ ID NO: 249084 - DNA, 25 bp, Rattus norvegicus
ccccttttatatctgcactactctg

SEQ ID NO: 249085 - DNA, 25 bp, Rattus norvegicus
ccccttttatatgtgcactactctg

SEQ ID NO: 249086 - DNA, 25 bp, Rattus norvegicus
ccccttttatgcactaaggcagtag

SEQ ID NO: 249087 - DNA, 25 bp, Rattus norvegicus
ccccttttatgctctaaggcagtag

SEQ ID NO: 249088 - DNA, 25 bp, Rattus norvegicus
ccccttttcctgcaaattgtacgtg

SEQ ID NO: 249089 - DNA, 25 bp, Rattus norvegicus
ccccttttcctggaaattgtacgtg

SEQ ID NO: 249090 - DNA, 25 bp, Rattus norvegicus
ccccttttctatctttctactgttg

SEQ ID NO: 249091 - DNA, 25 bp, Rattus norvegicus
ccccttttctatgtttctactgttg

SEQ ID NO: 249092 - DNA, 25 bp, Rattus norvegicus
ccccttttctgtagtgtgagtgtgc

SEQ ID NO: 249093 - DNA, 25 bp, Rattus norvegicus
ccccttttctgttgtgtgagtgtgc

SEQ ID NO: 249094 - DNA, 25 bp, Rattus norvegicus
ccccttttgatcagaaatggcacct

SEQ ID NO: 249095 - DNA, 25 bp, Rattus norvegicus
ccccttttgatctgaaatggcacct

SEQ ID NO: 249096 - DNA, 25 bp, Rattus norvegicus
ccccttttgcttagagagctttcat

SEQ ID NO: 249097 - DNA, 25 bp, Rattus norvegicus
ccccttttgctttgagagctttcat

SEQ ID NO: 249098 - DNA, 25 bp, Rattus norvegicus
cccctttttccacgctcagaagatg

SEQ ID NO: 249099 - DNA, 25 bp, Rattus norvegicus
cccctttttccaggctcagaagatg

SEQ ID NO: 249100 - DNA, 25 bp, Rattus norvegicus
cccgaaagcactagcagtttttggg

SEQ ID NO: 249101 - DNA, 25 bp, Rattus norvegicus
cccgaaagcacttgcagtttttggg

SEQ ID NO: 249102 - DNA, 25 bp, Rattus norvegicus
cccgaacctgatcatagtttgcctt

SEQ ID NO: 249103 - DNA, 25 bp, Rattus norvegicus
cccgaacctgatgatagtttgcctt

SEQ ID NO: 249104 - DNA, 25 bp, Rattus norvegicus
cccgaagcctaaacagacacagctg

SEQ ID NO: 249105 - DNA, 25 bp, Rattus norvegicus
cccgaagcctaatcagacacagctg

SEQ ID NO: 249106 - DNA, 25 bp, Rattus norvegicus
cccgaatgctgacattgacgtagtc

SEQ ID NO: 249107 - DNA, 25 bp, Rattus norvegicus
cccgaatgctgagattgacgtagtc

SEQ ID NO: 249108 - DNA, 25 bp, Rattus norvegicus
cccgaatgtccgatctgtgggagaa

SEQ ID NO: 249109 - DNA, 25 bp, Rattus norvegicus
cccgaatgtccgttctgtgggagaa

SEQ ID NO: 249110 - DNA, 25 bp, Rattus norvegicus
cccgacacaagaaccaggccaaata

SEQ ID NO: 249111 - DNA, 25 bp, Rattus norvegicus
cccgacacaagatccaggccaaata

SEQ ID NO: 249112 - DNA, 25 bp, Rattus norvegicus
cccgacacgagcatattttctagta

SEQ ID NO: 249113 - DNA, 25 bp, Rattus norvegicus
cccgacacgagcttattttctagta

SEQ ID NO: 249114 - DNA, 25 bp, Rattus norvegicus
cccgaccaccaaccggaagtgaggt

SEQ ID NO: 249115 - DNA, 25 bp, Rattus norvegicus
cccgaccaccaagcggaagtgaggt

SEQ ID NO: 249116 - DNA, 25 bp, Rattus norvegicus
cccgacctctaaagtgcatcaggtt

SEQ ID NO: 249117 - DNA, 25 bp, Rattus norvegicus
cccgacctctaatgtgcatcaggtt

SEQ ID NO: 249118 - DNA, 25 bp, Rattus norvegicus
cccgacgataaacaggacttgcctt

SEQ ID NO: 249119 - DNA, 25 bp, Rattus norvegicus
cccgacgataaagaggacttgcctt

SEQ ID NO: 249120 - DNA, 25 bp, Rattus norvegicus
cccgacggcggcaaagccgagaact

SEQ ID NO: 249121 - DNA, 25 bp, Rattus norvegicus
cccgacggcggctaagccgagaact

SEQ ID NO: 249122 - DNA, 25 bp, Rattus norvegicus
cccgactgaactcgagtcagccatt

SEQ ID NO: 249123 - DNA, 25 bp, Rattus norvegicus
cccgactgaactggagtcagccatt

SEQ ID NO: 249124 - DNA, 25 bp, Rattus norvegicus
cccgagacttctcttcttagataac

SEQ ID NO: 249125 - DNA, 25 bp, Rattus norvegicus
cccgagacttctgttcttagataac

SEQ ID NO: 249126 - DNA, 25 bp, Rattus norvegicus
cccgagaggccgaggacttggacca

SEQ ID NO: 249127 - DNA, 25 bp, Rattus norvegicus
cccgagaggccgtggacttggacca

SEQ ID NO: 249128 - DNA, 25 bp, Rattus norvegicus
cccgagagtactcggactatgaatc

SEQ ID NO: 249129 - DNA, 25 bp, Rattus norvegicus
cccgagagtactgggactatgaatc

SEQ ID NO: 249130 - DNA, 25 bp, Rattus norvegicus
cccgagatgtggcttttcatgtgtt

SEQ ID NO: 249131 - DNA, 25 bp, Rattus norvegicus
cccgagatgtgggttttcatgtgtt

SEQ ID NO: 249132 - DNA, 25 bp, Rattus norvegicus
cccgagcacttgagccagatgacag

SEQ ID NO: 249133 - DNA, 25 bp, Rattus norvegicus
cccgagcacttgtgccagatgacag

SEQ ID NO: 249134 - DNA, 25 bp, Rattus norvegicus
cccgaggaaggcattcctgaataca

SEQ ID NO: 249135 - DNA, 25 bp, Rattus norvegicus
cccgaggaaggctttcctgaataca

SEQ ID NO: 249136 - DNA, 25 bp, Rattus norvegicus
cccgaggagcggatttctgtgactg

SEQ ID NO: 249137 - DNA, 25 bp, Rattus norvegicus
cccgaggagcggttttctgtgactg

SEQ ID NO: 249138 - DNA, 25 bp, Rattus norvegicus
cccgaggaggagagcgactgttttt

SEQ ID NO: 249139 - DNA, 25 bp, Rattus norvegicus
cccgaggaggagtgcgactgttttt

SEQ ID NO: 249140 - DNA, 25 bp, Rattus norvegicus
cccgaggatcaaattcgtggcgccc

SEQ ID NO: 249141 - DNA, 25 bp, Rattus norvegicus
cccgaggatcaatttcgtggcgccc

SEQ ID NO: 249142 - DNA, 25 bp, Rattus norvegicus
cccgaggcctgtagtggtggaaaca

SEQ ID NO: 249143 - DNA, 25 bp, Rattus norvegicus
cccgaggcctgttgtggtggaaaca

SEQ ID NO: 249144 - DNA, 25 bp, Rattus norvegicus
cccgaggctcaactttgctcgcggg

SEQ ID NO: 249145 - DNA, 25 bp, Rattus norvegicus
cccgaggctcaagtttgctcgcggg

SEQ ID NO: 249146 - DNA, 25 bp, Rattus norvegicus
cccgaggctctacatatttgcaggt

SEQ ID NO: 249147 - DNA, 25 bp, Rattus norvegicus
cccgaggctctagatatttgcaggt

SEQ ID NO: 249148 - DNA, 25 bp, Rattus norvegicus
cccgagggctggcaaccaagagtct

SEQ ID NO: 249149 - DNA, 25 bp, Rattus norvegicus
cccgagggctgggaaccaagagtct

SEQ ID NO: 249150 - DNA, 25 bp, Rattus norvegicus
cccgaggtcctgaccttggaggcag

SEQ ID NO: 249151 - DNA, 25 bp, Rattus norvegicus
cccgaggtcctgtccttggaggcag

SEQ ID NO: 249152 - DNA, 25 bp, Rattus norvegicus
cccgaggtgctacagccacagagaa

SEQ ID NO: 249153 - DNA, 25 bp, Rattus norvegicus
cccgaggtgctagagccacagagaa

SEQ ID NO: 249154 - DNA, 25 bp, Rattus norvegicus
cccgagtcccttagcaagaacagaa

SEQ ID NO: 249155 - DNA, 25 bp, Rattus norvegicus
cccgagtccctttgcaagaacagaa

SEQ ID NO: 249156 - DNA, 25 bp, Rattus norvegicus
cccgagtggtcaacagcagctgcaa

SEQ ID NO: 249157 - DNA, 25 bp, Rattus norvegicus
cccgagtggtcatcagcagctgcaa

SEQ ID NO: 249158 - DNA, 25 bp, Rattus norvegicus
cccgatctcgtcagatctcggaagc

SEQ ID NO: 249159 - DNA, 25 bp, Rattus norvegicus
cccgatctcgtctgatctcggaagc

SEQ ID NO: 249160 - DNA, 25 bp, Rattus norvegicus
cccgatgaactgactgaggagcaga

SEQ ID NO: 249161 - DNA, 25 bp, Rattus norvegicus
cccgatgaactgtctgaggagcaga

SEQ ID NO: 249162 - DNA, 25 bp, Rattus norvegicus
cccgatgactcaactctcagtgaaa

SEQ ID NO: 249163 - DNA, 25 bp, Rattus norvegicus
cccgatgactcatctctcagtgaaa

SEQ ID NO: 249164 - DNA, 25 bp, Rattus norvegicus
cccgatgagcggagtggccccgaca

SEQ ID NO: 249165 - DNA, 25 bp, Rattus norvegicus
cccgatgagcggtgtggccccgaca

SEQ ID NO: 249166 - DNA, 25 bp, Rattus norvegicus
cccgatgttcctcataatcttgaaa

SEQ ID NO: 249167 - DNA, 25 bp, Rattus norvegicus
cccgatgttcctgataatcttgaaa

SEQ ID NO: 249168 - DNA, 25 bp, Rattus norvegicus
cccgcaagacggaggagcaactgaa

SEQ ID NO: 249169 - DNA, 25 bp, Rattus norvegicus
cccgcaagacggtggagcaactgaa

SEQ ID NO: 249170 - DNA, 25 bp, Rattus norvegicus
cccgcaagagggacacgtaagatga

SEQ ID NO: 249171 - DNA, 25 bp, Rattus norvegicus
cccgcaagagggtcacgtaagatga

SEQ ID NO: 249172 - DNA, 25 bp, Rattus norvegicus
cccgcaccaaaccaacaggaataga

SEQ ID NO: 249173 - DNA, 25 bp, Rattus norvegicus
cccgcaccaaacgaacaggaataga

SEQ ID NO: 249174 - DNA, 25 bp, Rattus norvegicus
cccgcactgcggataatttatctgt

SEQ ID NO: 249175 - DNA, 25 bp, Rattus norvegicus
cccgcactgcggttaatttatctgt

SEQ ID NO: 249176 - DNA, 25 bp, Rattus norvegicus
cccgcactgcttacgtgaattttgt

SEQ ID NO: 249177 - DNA, 25 bp, Rattus norvegicus
cccgcactgctttcgtgaattttgt

SEQ ID NO: 249178 - DNA, 25 bp, Rattus norvegicus
cccgcagacggtatccaatttgtgg

SEQ ID NO: 249179 - DNA, 25 bp, Rattus norvegicus
cccgcagacggtttccaatttgtgg

SEQ ID NO: 249180 - DNA, 25 bp, Rattus norvegicus
cccgcaggctttcgatcttgtacag

SEQ ID NO: 249181 - DNA, 25 bp, Rattus norvegicus
cccgcaggctttggatcttgtacag

SEQ ID NO: 249182 - DNA, 25 bp, Rattus norvegicus
cccgcagtaggcacattggttgtgg

SEQ ID NO: 249183 - DNA, 25 bp, Rattus norvegicus
cccgcagtaggctcattggttgtgg

SEQ ID NO: 249184 - DNA, 25 bp, Rattus norvegicus
cccgcatgattcccgcgccgctgct

SEQ ID NO: 249185 - DNA, 25 bp, Rattus norvegicus
cccgcatgattcgcgcgccgctgct

SEQ ID NO: 249186 - DNA, 25 bp, Rattus norvegicus
cccgcatgggctagatatcctggaa

SEQ ID NO: 249187 - DNA, 25 bp, Rattus norvegicus
cccgcatgggcttgatatcctggaa

SEQ ID NO: 249188 - DNA, 25 bp, Rattus norvegicus
cccgcatttgtgctgggtaattgcc

SEQ ID NO: 249189 - DNA, 25 bp, Rattus norvegicus
cccgcatttgtggtgggtaattgcc

SEQ ID NO: 249190 - DNA, 25 bp, Rattus norvegicus
cccgccaattcccatgagtttctga

SEQ ID NO: 249191 - DNA, 25 bp, Rattus norvegicus
cccgccaattccgatgagtttctga

SEQ ID NO: 249192 - DNA, 25 bp, Rattus norvegicus
cccgcccgaggcacaggagaagaag

SEQ ID NO: 249193 - DNA, 25 bp, Rattus norvegicus
cccgcccgaggctcaggagaagaag

SEQ ID NO: 249194 - DNA, 25 bp, Rattus norvegicus
cccgcccgtgtccacaagggtagag

SEQ ID NO: 249195 - DNA, 25 bp, Rattus norvegicus
cccgcccgtgtcgacaagggtagag

SEQ ID NO: 249196 - DNA, 25 bp, Rattus norvegicus
cccgcccgttatagtggcagggaag

SEQ ID NO: 249197 - DNA, 25 bp, Rattus norvegicus
cccgcccgttattgtggcagggaag

SEQ ID NO: 249198 - DNA, 25 bp, Rattus norvegicus
cccgccctgttaaaatcatctattt

SEQ ID NO: 249199 - DNA, 25 bp, Rattus norvegicus
cccgccctgttataatcatctattt

SEQ ID NO: 249200 - DNA, 25 bp, Rattus norvegicus
cccgccgaaggaacactctattatt

SEQ ID NO: 249201 - DNA, 25 bp, Rattus norvegicus
cccgccgaaggatcactctattatt

SEQ ID NO: 249202 - DNA, 25 bp, Rattus norvegicus
cccgccgacgccagtaggtgacagg

SEQ ID NO: 249203 - DNA, 25 bp, Rattus norvegicus
cccgccgacgcctgtaggtgacagg

SEQ ID NO: 249204 - DNA, 25 bp, Rattus norvegicus
cccgccgggattaattgagtatttg

SEQ ID NO: 249205 - DNA, 25 bp, Rattus norvegicus
cccgccgggatttattgagtatttg

SEQ ID NO: 249206 - DNA, 25 bp, Rattus norvegicus
cccgccgtcgggagtcggtcatcgt

SEQ ID NO: 249207 - DNA, 25 bp, Rattus norvegicus
cccgccgtcgggtgtcggtcatcgt

SEQ ID NO: 249208 - DNA, 25 bp, Rattus norvegicus
cccgcctccgtgagatttcagatta

SEQ ID NO: 249209 - DNA, 25 bp, Rattus norvegicus
cccgcctccgtgtgatttcagatta

SEQ ID NO: 249210 - DNA, 25 bp, Rattus norvegicus
cccgcctggagacgagacattctta

SEQ ID NO: 249211 - DNA, 25 bp, Rattus norvegicus
cccgcctggagaggagacattctta

SEQ ID NO: 249212 - DNA, 25 bp, Rattus norvegicus
cccgcctgtattaagcaagcctgag

SEQ ID NO: 249213 - DNA, 25 bp, Rattus norvegicus
cccgcctgtatttagcaagcctgag

SEQ ID NO: 249214 - DNA, 25 bp, Rattus norvegicus
cccgcctgtgtcaggtgcaaataat

SEQ ID NO: 249215 - DNA, 25 bp, Rattus norvegicus
cccgcctgtgtctggtgcaaataat

SEQ ID NO: 249216 - DNA, 25 bp, Rattus norvegicus
cccgccttactaaagacggacatgg

SEQ ID NO: 249217 - DNA, 25 bp, Rattus norvegicus
cccgccttactacagtgattcagaa

SEQ ID NO: 249218 - DNA, 25 bp, Rattus norvegicus
cccgccttactagagtgattcagaa

SEQ ID NO: 249219 - DNA, 25 bp, Rattus norvegicus
cccgccttactatagacggacatgg

SEQ ID NO: 249220 - DNA, 25 bp, Rattus norvegicus
cccgccttccacagcatttataagt

SEQ ID NO: 249221 - DNA, 25 bp, Rattus norvegicus
cccgccttccactgcatttataagt

SEQ ID NO: 249222 - DNA, 25 bp, Rattus norvegicus
cccgcctttatacctgtcttggtat

SEQ ID NO: 249223 - DNA, 25 bp, Rattus norvegicus
cccgcctttatagctgtcttggtat

SEQ ID NO: 249224 - DNA, 25 bp, Rattus norvegicus
cccgcgcaggctatacattggtgta

SEQ ID NO: 249225 - DNA, 25 bp, Rattus norvegicus
cccgcgcaggctttacattggtgta

SEQ ID NO: 249226 - DNA, 25 bp, Rattus norvegicus
cccgcgccctggaagtgctgtggca

SEQ ID NO: 249227 - DNA, 25 bp, Rattus norvegicus
cccgcgccctggtagtgctgtggca

SEQ ID NO: 249228 - DNA, 25 bp, Rattus norvegicus
cccgcgcgcctaagtttagatttgt

SEQ ID NO: 249229 - DNA, 25 bp, Rattus norvegicus
cccgcgcgcctatgtttagatttgt

SEQ ID NO: 249230 - DNA, 25 bp, Rattus norvegicus
cccgcgctaggcacagagggcagca

SEQ ID NO: 249231 - DNA, 25 bp, Rattus norvegicus
cccgcgctaggctcagagggcagca

SEQ ID NO: 249232 - DNA, 25 bp, Rattus norvegicus
cccgcgctggatcagtcctagagaa

SEQ ID NO: 249233 - DNA, 25 bp, Rattus norvegicus
cccgcgctggatgagtcctagagaa

SEQ ID NO: 249234 - DNA, 25 bp, Rattus norvegicus
cccgcgctgttcagtgtgcaaggaa

SEQ ID NO: 249235 - DNA, 25 bp, Rattus norvegicus
cccgcgctgttctgtgtgcaaggaa

SEQ ID NO: 249236 - DNA, 25 bp, Rattus norvegicus
cccgcgctttttctttatctggata

SEQ ID NO: 249237 - DNA, 25 bp, Rattus norvegicus
cccgcgctttttgtttatctggata

SEQ ID NO: 249238 - DNA, 25 bp, Rattus norvegicus
cccgcggaccatcatgactttgtga

SEQ ID NO: 249239 - DNA, 25 bp, Rattus norvegicus
cccgcggaccatgatgactttgtga

SEQ ID NO: 249240 - DNA, 25 bp, Rattus norvegicus
cccgcgggtcggaatggattacagt

SEQ ID NO: 249241 - DNA, 25 bp, Rattus norvegicus
cccgcgggtcggtatggattacagt

SEQ ID NO: 249242 - DNA, 25 bp, Rattus norvegicus
cccgcgtccactaggtgatggaaaa

SEQ ID NO: 249243 - DNA, 25 bp, Rattus norvegicus
cccgcgtccacttggtgatggaaaa

SEQ ID NO: 249244 - DNA, 25 bp, Rattus norvegicus
cccgcgttcataatgcaactctgat

SEQ ID NO: 249245 - DNA, 25 bp, Rattus norvegicus
cccgcgttcatattgcaactctgat

SEQ ID NO: 249246 - DNA, 25 bp, Rattus norvegicus
cccgctaccagtactttgtggttga

SEQ ID NO: 249247 - DNA, 25 bp, Rattus norvegicus
cccgctaccagttctttgtggttga

SEQ ID NO: 249248 - DNA, 25 bp, Rattus norvegicus
cccgctactgtgagtattgagccac

SEQ ID NO: 249249 - DNA, 25 bp, Rattus norvegicus
cccgctactgtgtgtattgagccac

SEQ ID NO: 249250 - DNA, 25 bp, Rattus norvegicus
cccgctcacttcaggactttgctat

SEQ ID NO: 249251 - DNA, 25 bp, Rattus norvegicus
cccgctcacttctggactttgctat

SEQ ID NO: 249252 - DNA, 25 bp, Rattus norvegicus
cccgctcatatgcagcagatatgca

SEQ ID NO: 249253 - DNA, 25 bp, Rattus norvegicus
cccgctcatatggagcagatatgca

SEQ ID NO: 249254 - DNA, 25 bp, Rattus norvegicus
cccgctctatatccactttgtttat

SEQ ID NO: 249255 - DNA, 25 bp, Rattus norvegicus
cccgctctatatgcactttgtttat

SEQ ID NO: 249256 - DNA, 25 bp, Rattus norvegicus
cccgctctccaaattaccataattg

SEQ ID NO: 249257 - DNA, 25 bp, Rattus norvegicus
cccgctctccaatttaccataattg

SEQ ID NO: 249258 - DNA, 25 bp, Rattus norvegicus
cccgctctcctcaaagaactaaaga

SEQ ID NO: 249259 - DNA, 25 bp, Rattus norvegicus
cccgctctcctctaagaactaaaga

SEQ ID NO: 249260 - DNA, 25 bp, Rattus norvegicus
cccgctgaccgcccagccgcatgaa

SEQ ID NO: 249261 - DNA, 25 bp, Rattus norvegicus
cccgctgaccgcgcagccgcatgaa

SEQ ID NO: 249262 - DNA, 25 bp, Rattus norvegicus
cccgctgcgatcaggccaggaggta

SEQ ID NO: 249263 - DNA, 25 bp, Rattus norvegicus
cccgctgcgatctggccaggaggta

SEQ ID NO: 249264 - DNA, 25 bp, Rattus norvegicus
cccgctgcgatgatctttggcaaga

SEQ ID NO: 249265 - DNA, 25 bp, Rattus norvegicus
cccgctgcgatgttctttggcaaga

SEQ ID NO: 249266 - DNA, 25 bp, Rattus norvegicus
cccgctgctgccatgaaactgagaa

SEQ ID NO: 249267 - DNA, 25 bp, Rattus norvegicus
cccgctgctgccttgaaactgagaa

SEQ ID NO: 249268 - DNA, 25 bp, Rattus norvegicus
cccgctggcccaaaatattctattt

SEQ ID NO: 249269 - DNA, 25 bp, Rattus norvegicus
cccgctggcccataatattctattt

SEQ ID NO: 249270 - DNA, 25 bp, Rattus norvegicus
cccgctgtagggatgcagggccaca

SEQ ID NO: 249271 - DNA, 25 bp, Rattus norvegicus
cccgctgtagggttgcagggccaca

SEQ ID NO: 249272 - DNA, 25 bp, Rattus norvegicus
cccgctgtgaacctgggtggcaaca

SEQ ID NO: 249273 - DNA, 25 bp, Rattus norvegicus
cccgctgtgaacgtgggtggcaaca

SEQ ID NO: 249274 - DNA, 25 bp, Rattus norvegicus
cccgctgtgttcacatgctaaatag

SEQ ID NO: 249275 - DNA, 25 bp, Rattus norvegicus
cccgctgtgttctcatgctaaatag

SEQ ID NO: 249276 - DNA, 25 bp, Rattus norvegicus
cccgctttatcccacacaaatgtaa

SEQ ID NO: 249277 - DNA, 25 bp, Rattus norvegicus
cccgctttatccgacacaaatgtaa

SEQ ID NO: 249278 - DNA, 25 bp, Rattus norvegicus
cccggaaactgtcagctaaggagac

SEQ ID NO: 249279 - DNA, 25 bp, Rattus norvegicus
cccggaaactgtgagctaaggagac

SEQ ID NO: 249280 - DNA, 25 bp, Rattus norvegicus
cccggaacctttcggctaagcaatg

SEQ ID NO: 249281 - DNA, 25 bp, Rattus norvegicus
cccggaacctttgggctaagcaatg

SEQ ID NO: 249282 - DNA, 25 bp, Rattus norvegicus
cccggaagtcatcccagactttata

SEQ ID NO: 249283 - DNA, 25 bp, Rattus norvegicus
cccggaagtcatgccagactttata

SEQ ID NO: 249284 - DNA, 25 bp, Rattus norvegicus
cccggaattgcgagtcggtgtgttc

SEQ ID NO: 249285 - DNA, 25 bp, Rattus norvegicus
cccggaattgcgtgtcggtgtgttc

SEQ ID NO: 249286 - DNA, 25 bp, Rattus norvegicus
cccggacaatttctgcctcagacaa

SEQ ID NO: 249287 - DNA, 25 bp, Rattus norvegicus
cccggacaatttgtgcctcagacaa

SEQ ID NO: 249288 - DNA, 25 bp, Rattus norvegicus
cccggacatggacgttaagtatccg

SEQ ID NO: 249289 - DNA, 25 bp, Rattus norvegicus
cccggacatggaggttaagtatccg

SEQ ID NO: 249290 - DNA, 25 bp, Rattus norvegicus
cccggacccgggatgagagcataaa

SEQ ID NO: 249291 - DNA, 25 bp, Rattus norvegicus
cccggacccgggttgagagcataaa

SEQ ID NO: 249292 - DNA, 25 bp, Rattus norvegicus
cccggagacaacatggaggcttcaa

SEQ ID NO: 249293 - DNA, 25 bp, Rattus norvegicus
cccggagacaacttggaggcttcaa

SEQ ID NO: 249294 - DNA, 25 bp, Rattus norvegicus
cccggagacgtcaatcatctgcata

SEQ ID NO: 249295 - DNA, 25 bp, Rattus norvegicus
cccggagacgtctatcatctgcata

SEQ ID NO: 249296 - DNA, 25 bp, Rattus norvegicus
cccggagcccagaagtttagacttg

SEQ ID NO: 249297 - DNA, 25 bp, Rattus norvegicus
cccggagcccagtagtttagacttg

SEQ ID NO: 249298 - DNA, 25 bp, Rattus norvegicus
cccggagcccggagatggatgaact

SEQ ID NO: 249299 - DNA, 25 bp, Rattus norvegicus
cccggagcccggtgatggatgaact

SEQ ID NO: 249300 - DNA, 25 bp, Rattus norvegicus
cccggatataagaggccgtggccat

SEQ ID NO: 249301 - DNA, 25 bp, Rattus norvegicus
cccggatataagtggccgtggccat

SEQ ID NO: 249302 - DNA, 25 bp, Rattus norvegicus
cccggatatggcacgtggacagcag

SEQ ID NO: 249303 - DNA, 25 bp, Rattus norvegicus
cccggatatggctcgtggacagcag

SEQ ID NO: 249304 - DNA, 25 bp, Rattus norvegicus
cccggatcgcggaatatagagatat

SEQ ID NO: 249305 - DNA, 25 bp, Rattus norvegicus
cccggatcgcggtatatagagatat

SEQ ID NO: 249306 - DNA, 25 bp, Rattus norvegicus
cccggatgacccatagaaccacaaa

SEQ ID NO: 249307 - DNA, 25 bp, Rattus norvegicus
cccggatgacccttagaaccacaaa

SEQ ID NO: 249308 - DNA, 25 bp, Rattus norvegicus
cccggcagccaaaagggcgagcaca

SEQ ID NO: 249309 - DNA, 25 bp, Rattus norvegicus
cccggcagccaatagggcgagcaca

SEQ ID NO: 249310 - DNA, 25 bp, Rattus norvegicus
cccggcatgaataccctaatctttg

SEQ ID NO: 249311 - DNA, 25 bp, Rattus norvegicus
cccggcatgaattccctaatctttg

SEQ ID NO: 249312 - DNA, 25 bp, Rattus norvegicus
cccggcatgaccactgtaaggagtt

SEQ ID NO: 249313 - DNA, 25 bp, Rattus norvegicus
cccggcatgacctctgtaaggagtt

SEQ ID NO: 249314 - DNA, 25 bp, Rattus norvegicus
cccggccgcctgcttgaaattctgg

SEQ ID NO: 249315 - DNA, 25 bp, Rattus norvegicus
cccggccgcctggttgaaattctgg

SEQ ID NO: 249316 - DNA, 25 bp, Rattus norvegicus
cccggcctgttgaagtcatgaactc

SEQ ID NO: 249317 - DNA, 25 bp, Rattus norvegicus
cccggcctgttgtagtcatgaactc

SEQ ID NO: 249318 - DNA, 25 bp, Rattus norvegicus
cccggctacctcatttgtatatgat

SEQ ID NO: 249319 - DNA, 25 bp, Rattus norvegicus
cccggctacctcttttgtatatgat

SEQ ID NO: 249320 - DNA, 25 bp, Rattus norvegicus
cccggctccattcccttgaagaaag

SEQ ID NO: 249321 - DNA, 25 bp, Rattus norvegicus
cccggctccattgccttgaagaaag

SEQ ID NO: 249322 - DNA, 25 bp, Rattus norvegicus
cccggctctgtgacttaaggtggac

SEQ ID NO: 249323 - DNA, 25 bp, Rattus norvegicus
cccggctctgtgtcttaaggtggac

SEQ ID NO: 249324 - DNA, 25 bp, Rattus norvegicus
cccggctgctgacgactagatgaga

SEQ ID NO: 249325 - DNA, 25 bp, Rattus norvegicus
cccggctgctgaggactagatgaga

SEQ ID NO: 249326 - DNA, 25 bp, Rattus norvegicus
cccggctggaggcacttgttgctaa

SEQ ID NO: 249327 - DNA, 25 bp, Rattus norvegicus
cccggctggagggacttgttgctaa

SEQ ID NO: 249328 - DNA, 25 bp, Rattus norvegicus
cccggcttgctgcagagcttcataa

SEQ ID NO: 249329 - DNA, 25 bp, Rattus norvegicus
cccggcttgctggagagcttcataa

SEQ ID NO: 249330 - DNA, 25 bp, Rattus norvegicus
cccggcttgtggaaagggcttcaca

SEQ ID NO: 249331 - DNA, 25 bp, Rattus norvegicus
cccggcttgtggtaagggcttcaca

SEQ ID NO: 249332 - DNA, 25 bp, Rattus norvegicus
cccgggaaggctcgaccgagactca

SEQ ID NO: 249333 - DNA, 25 bp, Rattus norvegicus
cccgggaaggctggaccgagactca

SEQ ID NO: 249334 - DNA, 25 bp, Rattus norvegicus
cccgggaatcttcttcaattggcga

SEQ ID NO: 249335 - DNA, 25 bp, Rattus norvegicus
cccgggaatcttgttcaattggcga

SEQ ID NO: 249336 - DNA, 25 bp, Rattus norvegicus
cccgggaggcaaatgctccatcaaa

SEQ ID NO: 249337 - DNA, 25 bp, Rattus norvegicus
cccgggaggcaattgctccatcaaa

SEQ ID NO: 249338 - DNA, 25 bp, Rattus norvegicus
cccgggagtcagacgagtggatttt

SEQ ID NO: 249339 - DNA, 25 bp, Rattus norvegicus
cccgggagtcagtcgagtggatttt

SEQ ID NO: 249340 - DNA, 25 bp, Rattus norvegicus
cccgggcacttcaagaacatctgga

SEQ ID NO: 249341 - DNA, 25 bp, Rattus norvegicus
cccgggcacttctagaacatctgga

SEQ ID NO: 249342 - DNA, 25 bp, Rattus norvegicus
cccgggcagcagaaactccgggagc

SEQ ID NO: 249343 - DNA, 25 bp, Rattus norvegicus
cccgggcagcagtaactccgggagc

SEQ ID NO: 249344 - DNA, 25 bp, Rattus norvegicus
cccgggcagccaatgagcatatcaa

SEQ ID NO: 249345 - DNA, 25 bp, Rattus norvegicus
cccgggcagccattgagcatatcaa

SEQ ID NO: 249346 - DNA, 25 bp, Rattus norvegicus
cccgggcatgtacacagagtctcta

SEQ ID NO: 249347 - DNA, 25 bp, Rattus norvegicus
cccgggcatgtagacagagtctcta

SEQ ID NO: 249348 - DNA, 25 bp, Rattus norvegicus
cccgggccacaaatgttcttgcaaa

SEQ ID NO: 249349 - DNA, 25 bp, Rattus norvegicus
cccgggccacaattgttcttgcaaa

SEQ ID NO: 249350 - DNA, 25 bp, Rattus norvegicus
cccgggctgtgtagaagcagttcca

SEQ ID NO: 249351 - DNA, 25 bp, Rattus norvegicus
cccgggctgtgttgaagcagttcca

SEQ ID NO: 249352 - DNA, 25 bp, Rattus norvegicus
cccgggtccattcaggtcaaagtgt

SEQ ID NO: 249353 - DNA, 25 bp, Rattus norvegicus
cccgggtccattgaggtcaaagtgt

SEQ ID NO: 249354 - DNA, 25 bp, Rattus norvegicus
cccgggtggcttcagacaggtaaca

SEQ ID NO: 249355 - DNA, 25 bp, Rattus norvegicus
cccgggtggcttgagacaggtaaca

SEQ ID NO: 249356 - DNA, 25 bp, Rattus norvegicus
cccgggtgttaacccagtgctggat

SEQ ID NO: 249357 - DNA, 25 bp, Rattus norvegicus
cccgggtgttaagccagtgctggat

SEQ ID NO: 249358 - DNA, 25 bp, Rattus norvegicus
cccgggttggacacctggagctgat

SEQ ID NO: 249359 - DNA, 25 bp, Rattus norvegicus
cccgggttggactcctggagctgat

SEQ ID NO: 249360 - DNA, 25 bp, Rattus norvegicus
cccgggtttgggaagtctcagacag

SEQ ID NO: 249361 - DNA, 25 bp, Rattus norvegicus
cccgggtttgggtagtctcagacag

SEQ ID NO: 249362 - DNA, 25 bp, Rattus norvegicus
cccggtacagacagcctttgttgat

SEQ ID NO: 249363 - DNA, 25 bp, Rattus norvegicus
cccggtacagactgcctttgttgat

SEQ ID NO: 249364 - DNA, 25 bp, Rattus norvegicus
cccggtcactctcagggtgacatca

SEQ ID NO: 249365 - DNA, 25 bp, Rattus norvegicus
cccggtcactctgagggtgacatca

SEQ ID NO: 249366 - DNA, 25 bp, Rattus norvegicus
cccggtccgcgaatgctcaagaaga

SEQ ID NO: 249367 - DNA, 25 bp, Rattus norvegicus
cccggtccgcgattgctcaagaaga

SEQ ID NO: 249368 - DNA, 25 bp, Rattus norvegicus
cccggtcgagggagaagacaggtca

SEQ ID NO: 249369 - DNA, 25 bp, Rattus norvegicus
cccggtcgagggtgaagacaggtca

SEQ ID NO: 249370 - DNA, 25 bp, Rattus norvegicus
cccggtctggccaagaactttgaat

SEQ ID NO: 249371 - DNA, 25 bp, Rattus norvegicus
cccggtctggcctagaactttgaat

SEQ ID NO: 249372 - DNA, 25 bp, Rattus norvegicus
cccggtgactgtcgagtgagcctca

SEQ ID NO: 249373 - DNA, 25 bp, Rattus norvegicus
cccggtgactgtggagtgagcctca

SEQ ID NO: 249374 - DNA, 25 bp, Rattus norvegicus
cccggtgagggcactaagtagtttg

SEQ ID NO: 249375 - DNA, 25 bp, Rattus norvegicus
cccggtgagggcatgcacacaggtc

SEQ ID NO: 249376 - DNA, 25 bp, Rattus norvegicus
cccggtgagggctctaagtagtttg

SEQ ID NO: 249377 - DNA, 25 bp, Rattus norvegicus
cccggtgagggcttgcacacaggtc

SEQ ID NO: 249378 - DNA, 25 bp, Rattus norvegicus
cccggtggtcctcatctataaaaca

SEQ ID NO: 249379 - DNA, 25 bp, Rattus norvegicus
cccggtggtcctgatctataaaaca

SEQ ID NO: 249380 - DNA, 25 bp, Rattus norvegicus
cccggttgaattctctgcaggacag

SEQ ID NO: 249381 - DNA, 25 bp, Rattus norvegicus
cccggttgaattgtctgcaggacag

SEQ ID NO: 249382 - DNA, 25 bp, Rattus norvegicus
cccgtaagctggacatcatcgagag

SEQ ID NO: 249383 - DNA, 25 bp, Rattus norvegicus
cccgtaagctggtcatcatcgagag

SEQ ID NO: 249384 - DNA, 25 bp, Rattus norvegicus
cccgtaccccagagaaagttctgag

SEQ ID NO: 249385 - DNA, 25 bp, Rattus norvegicus
cccgtaccccagtgaaagttctgag

SEQ ID NO: 249386 - DNA, 25 bp, Rattus norvegicus
cccgtagagggtcctgaagggcccg

SEQ ID NO: 249387 - DNA, 25 bp, Rattus norvegicus
cccgtagagggtgctgaagggcccg

SEQ ID NO: 249388 - DNA, 25 bp, Rattus norvegicus
cccgtagtccttacactgaatcgat

SEQ ID NO: 249389 - DNA, 25 bp, Rattus norvegicus
cccgtagtcctttcactgaatcgat

SEQ ID NO: 249390 - DNA, 25 bp, Rattus norvegicus
cccgtcacatctactttactgtaaa

SEQ ID NO: 249391 - DNA, 25 bp, Rattus norvegicus
cccgtcacatcttctttactgtaaa

SEQ ID NO: 249392 - DNA, 25 bp, Rattus norvegicus
cccgtcatgcttcgtagagctttga

SEQ ID NO: 249393 - DNA, 25 bp, Rattus norvegicus
cccgtcatgcttggtagagctttga

SEQ ID NO: 249394 - DNA, 25 bp, Rattus norvegicus
cccgtcctcttgctcatagtatttg

SEQ ID NO: 249395 - DNA, 25 bp, Rattus norvegicus
cccgtcctcttggtcatagtatttg

SEQ ID NO: 249396 - DNA, 25 bp, Rattus norvegicus
cccgtcctgagcaacttagtttcaa

SEQ ID NO: 249397 - DNA, 25 bp, Rattus norvegicus
cccgtcctgagctacttagtttcaa

SEQ ID NO: 249398 - DNA, 25 bp, Rattus norvegicus
cccgtctctgcactgagatacataa

SEQ ID NO: 249399 - DNA, 25 bp, Rattus norvegicus
cccgtctctgcagtgagatacataa

SEQ ID NO: 249400 - DNA, 25 bp, Rattus norvegicus
cccgtcttcggtctctgaggagtgt

SEQ ID NO: 249401 - DNA, 25 bp, Rattus norvegicus
cccgtcttcggtgtctgaggagtgt

SEQ ID NO: 249402 - DNA, 25 bp, Rattus norvegicus
cccgtgaaggctctgcacactgtaa

SEQ ID NO: 249403 - DNA, 25 bp, Rattus norvegicus
cccgtgaaggctgtgcacactgtaa

SEQ ID NO: 249404 - DNA, 25 bp, Rattus norvegicus
cccgtgacatctatgggcacagatt

SEQ ID NO: 249405 - DNA, 25 bp, Rattus norvegicus
cccgtgacatctttgggcacagatt

SEQ ID NO: 249406 - DNA, 25 bp, Rattus norvegicus
cccgtgaccagacacctgatgagaa

SEQ ID NO: 249407 - DNA, 25 bp, Rattus norvegicus
cccgtgaccagagacctgatgagaa

SEQ ID NO: 249408 - DNA, 25 bp, Rattus norvegicus
cccgtgcacagcctgatagagttaa

SEQ ID NO: 249409 - DNA, 25 bp, Rattus norvegicus
cccgtgcacagcgtgatagagttaa

SEQ ID NO: 249410 - DNA, 25 bp, Rattus norvegicus
cccgtgcatgaacccaaagccagtt

SEQ ID NO: 249411 - DNA, 25 bp, Rattus norvegicus
cccgtgcatgaagccaaagccagtt

SEQ ID NO: 249412 - DNA, 25 bp, Rattus norvegicus
cccgtgcccattctatgcagtggga

SEQ ID NO: 249413 - DNA, 25 bp, Rattus norvegicus
cccgtgcccattgtatgcagtggga

SEQ ID NO: 249414 - DNA, 25 bp, Rattus norvegicus
cccgtgcccgtgcagaagccataga

SEQ ID NO: 249415 - DNA, 25 bp, Rattus norvegicus
cccgtgcccgtggagaagccataga

SEQ ID NO: 249416 - DNA, 25 bp, Rattus norvegicus
cccgtgctgccgaggagtcaggaga

SEQ ID NO: 249417 - DNA, 25 bp, Rattus norvegicus
cccgtgctgccgtggagtcaggaga

SEQ ID NO: 249418 - DNA, 25 bp, Rattus norvegicus
cccgtggacggccttctagcttagg

SEQ ID NO: 249419 - DNA, 25 bp, Rattus norvegicus
cccgtggacggcgttctagcttagg

SEQ ID NO: 249420 - DNA, 25 bp, Rattus norvegicus
cccgtgtagcctacgttgacaaata

SEQ ID NO: 249421 - DNA, 25 bp, Rattus norvegicus
cccgtgtagccttcgttgacaaata

SEQ ID NO: 249422 - DNA, 25 bp, Rattus norvegicus
cccgtgtcctgcacaggaagggatg

SEQ ID NO: 249423 - DNA, 25 bp, Rattus norvegicus
cccgtgtcctgctcaggaagggatg

SEQ ID NO: 249424 - DNA, 25 bp, Rattus norvegicus
cccgtgtcctggattacatttgtat

SEQ ID NO: 249425 - DNA, 25 bp, Rattus norvegicus
cccgtgtcctggtttacatttgtat

SEQ ID NO: 249426 - DNA, 25 bp, Rattus norvegicus
cccgtgtgacaaactgtggcttaga

SEQ ID NO: 249427 - DNA, 25 bp, Rattus norvegicus
cccgtgtgacaatctgtggcttaga

SEQ ID NO: 249428 - DNA, 25 bp, Rattus norvegicus
cccgtgtgctgcagaagctggttga

SEQ ID NO: 249429 - DNA, 25 bp, Rattus norvegicus
cccgtgtgctgctgaagctggttga

SEQ ID NO: 249430 - DNA, 25 bp, Rattus norvegicus
cccgtgtggactctctgatgaatgt

SEQ ID NO: 249431 - DNA, 25 bp, Rattus norvegicus
cccgtgtggactgtctgatgaatgt

SEQ ID NO: 249432 - DNA, 25 bp, Rattus norvegicus
cccgtgttgctcattcagctgtgag

SEQ ID NO: 249433 - DNA, 25 bp, Rattus norvegicus
cccgtgttgctctttcagctgtgag

SEQ ID NO: 249434 - DNA, 25 bp, Rattus norvegicus
cccgttcatcacctagagacacaga

SEQ ID NO: 249435 - DNA, 25 bp, Rattus norvegicus
cccgttcatcacgtagagacacaga

SEQ ID NO: 249436 - DNA, 25 bp, Rattus norvegicus
cccgttgacgatcgctggttcgcta

SEQ ID NO: 249437 - DNA, 25 bp, Rattus norvegicus
cccgttgacgatggctggttcgcta

SEQ ID NO: 249438 - DNA, 25 bp, Rattus norvegicus
cccgttgcatccataactcatgaat

SEQ ID NO: 249439 - DNA, 25 bp, Rattus norvegicus
cccgttgcatccttaactcatgaat

SEQ ID NO: 249440 - DNA, 25 bp, Rattus norvegicus
cccgttggaactacaggcgcattta

SEQ ID NO: 249441 - DNA, 25 bp, Rattus norvegicus
cccgttggaacttcaggcgcattta

SEQ ID NO: 249442 - DNA, 25 bp, Rattus norvegicus
cccgttggctggattctagttggat

SEQ ID NO: 249443 - DNA, 25 bp, Rattus norvegicus
cccgttggctggtttctagttggat

SEQ ID NO: 249444 - DNA, 25 bp, Rattus norvegicus
cccgttggtgtgatggtagcattat

SEQ ID NO: 249445 - DNA, 25 bp, Rattus norvegicus
cccgttggtgtgttggtagcattat

SEQ ID NO: 249446 - DNA, 25 bp, Rattus norvegicus
cccgtttcctctccagttcatttaa

SEQ ID NO: 249447 - DNA, 25 bp, Rattus norvegicus
cccgtttcctctgcagttcatttaa

SEQ ID NO: 249448 - DNA, 25 bp, Rattus norvegicus
cccgtttcttctatcccaggaatag

SEQ ID NO: 249449 - DNA, 25 bp, Rattus norvegicus
cccgtttcttctttcccaggaatag

SEQ ID NO: 249450 - DNA, 25 bp, Rattus norvegicus
cccgtttgtaataggacttagcgat

SEQ ID NO: 249451 - DNA, 25 bp, Rattus norvegicus
cccgtttgtaattggacttagcgat

SEQ ID NO: 249452 - DNA, 25 bp, Rattus norvegicus
cccgttttgactcaaaatgtcctat

SEQ ID NO: 249453 - DNA, 25 bp, Rattus norvegicus
cccgttttgactgaaaatgtcctat

SEQ ID NO: 249454 - DNA, 25 bp, Rattus norvegicus
ccctaaagtgacaaaagccctccat

SEQ ID NO: 249455 - DNA, 25 bp, Rattus norvegicus
ccctaaagtgactaaagccctccat

SEQ ID NO: 249456 - DNA, 25 bp, Rattus norvegicus
ccctaaccaccaatccatatgttaa

SEQ ID NO: 249457 - DNA, 25 bp, Rattus norvegicus
ccctaaccaccattccatatgttaa

SEQ ID NO: 249458 - DNA, 25 bp, Rattus norvegicus
ccctaaccctcaatgtgacatttgg

SEQ ID NO: 249459 - DNA, 25 bp, Rattus norvegicus
ccctaaccctcattgtgacatttgg

SEQ ID NO: 249460 - DNA, 25 bp, Rattus norvegicus
ccctaactcggtcgccgcgtgagga

SEQ ID NO: 249461 - DNA, 25 bp, Rattus norvegicus
ccctaactcggtggccgcgtgagga

SEQ ID NO: 249462 - DNA, 25 bp, Rattus norvegicus
ccctaactttccattctctgatgaa

SEQ ID NO: 249463 - DNA, 25 bp, Rattus norvegicus
ccctaactttcctttctctgatgaa

SEQ ID NO: 249464 - DNA, 25 bp, Rattus norvegicus
ccctaactttgacctgttgctgagt

SEQ ID NO: 249465 - DNA, 25 bp, Rattus norvegicus
ccctaactttgagctgttgctgagt

SEQ ID NO: 249466 - DNA, 25 bp, Rattus norvegicus
ccctaagtctcactcttgatcatta

SEQ ID NO: 249467 - DNA, 25 bp, Rattus norvegicus
ccctaagtctcagtcttgatcatta

SEQ ID NO: 249468 - DNA, 25 bp, Rattus norvegicus
ccctaatcccggaattcagtggtga

SEQ ID NO: 249469 - DNA, 25 bp, Rattus norvegicus
ccctaatcccggtattcagtggtga

SEQ ID NO: 249470 - DNA, 25 bp, Rattus norvegicus
ccctaattctggcattgtggctaaa

SEQ ID NO: 249471 - DNA, 25 bp, Rattus norvegicus
ccctaattctgggattgtggctaaa

SEQ ID NO: 249472 - DNA, 25 bp, Rattus norvegicus
ccctacaaccttccgtataagtata

SEQ ID NO: 249473 - DNA, 25 bp, Rattus norvegicus
ccctacaaccttgcgtataagtata

SEQ ID NO: 249474 - DNA, 25 bp, Rattus norvegicus
ccctacaactggattcaagccaatt

SEQ ID NO: 249475 - DNA, 25 bp, Rattus norvegicus
ccctacaactggtttcaagccaatt

SEQ ID NO: 249476 - DNA, 25 bp, Rattus norvegicus
ccctacacccggatatcaaagctgg

SEQ ID NO: 249477 - DNA, 25 bp, Rattus norvegicus
ccctacacccggttatcaaagctgg

SEQ ID NO: 249478 - DNA, 25 bp, Rattus norvegicus
ccctacacgtgtcgcgagtgcggca

SEQ ID NO: 249479 - DNA, 25 bp, Rattus norvegicus
ccctacacgtgtggcgagtgcggca

SEQ ID NO: 249480 - DNA, 25 bp, Rattus norvegicus
ccctacattcctcagctttctagaa

SEQ ID NO: 249481 - DNA, 25 bp, Rattus norvegicus
ccctacattcctgagctttctagaa

SEQ ID NO: 249482 - DNA, 25 bp, Rattus norvegicus
ccctaccacggccacatatataaat

SEQ ID NO: 249483 - DNA, 25 bp, Rattus norvegicus
ccctaccacggcgacatatataaat

SEQ ID NO: 249484 - DNA, 25 bp, Rattus norvegicus
ccctaccagggcatttagctatgtt

SEQ ID NO: 249485 - DNA, 25 bp, Rattus norvegicus
ccctaccagggcttttagctatgtt

SEQ ID NO: 249486 - DNA, 25 bp, Rattus norvegicus
ccctacccaatcctgaagaaattct

SEQ ID NO: 249487 - DNA, 25 bp, Rattus norvegicus
ccctacccaatcgtgaagaaattct

SEQ ID NO: 249488 - DNA, 25 bp, Rattus norvegicus
ccctacccagtccaagaaagagaag

SEQ ID NO: 249489 - DNA, 25 bp, Rattus norvegicus
ccctacccagtcgaagaaagagaag

SEQ ID NO: 249490 - DNA, 25 bp, Rattus norvegicus
ccctaccccaggcaatgttgagaat

SEQ ID NO: 249491 - DNA, 25 bp, Rattus norvegicus
ccctaccccagggaatgttgagaat

SEQ ID NO: 249492 - DNA, 25 bp, Rattus norvegicus
ccctacccggtgataaatcatcaga

SEQ ID NO: 249493 - DNA, 25 bp, Rattus norvegicus
ccctacccggtgttaaatcatcaga

SEQ ID NO: 249494 - DNA, 25 bp, Rattus norvegicus
ccctacctagtgacctggcataaaa

SEQ ID NO: 249495 - DNA, 25 bp, Rattus norvegicus
ccctacctagtgtcctggcataaaa

SEQ ID NO: 249496 - DNA, 25 bp, Rattus norvegicus
ccctacctctgtcgccaatgtggaa

SEQ ID NO: 249497 - DNA, 25 bp, Rattus norvegicus
ccctacctctgtggccaatgtggaa

SEQ ID NO: 249498 - DNA, 25 bp, Rattus norvegicus
ccctaccttgctagtctagtgggtt

SEQ ID NO: 249499 - DNA, 25 bp, Rattus norvegicus
ccctaccttgcttgtctagtgggtt

SEQ ID NO: 249500 - DNA, 25 bp, Rattus norvegicus
ccctactaatgaatctttcttccac

SEQ ID NO: 249501 - DNA, 25 bp, Rattus norvegicus
ccctactaatgattctttcttccac

SEQ ID NO: 249502 - DNA, 25 bp, Rattus norvegicus
ccctactgaggtatggatgtgatct

SEQ ID NO: 249503 - DNA, 25 bp, Rattus norvegicus
ccctactgaggtttggatgtgatct

SEQ ID NO: 249504 - DNA, 25 bp, Rattus norvegicus
ccctactgggcacttggaggcagtc

SEQ ID NO: 249505 - DNA, 25 bp, Rattus norvegicus
ccctactgggcagttggaggcagtc

SEQ ID NO: 249506 - DNA, 25 bp, Rattus norvegicus
ccctacttctctcctgttaggttaa

SEQ ID NO: 249507 - DNA, 25 bp, Rattus norvegicus
ccctacttctctgctgttaggttaa

SEQ ID NO: 249508 - DNA, 25 bp, Rattus norvegicus
ccctacttctgtctgggaggtattt

SEQ ID NO: 249509 - DNA, 25 bp, Rattus norvegicus
ccctacttctgtgtgggaggtattt

SEQ ID NO: 249510 - DNA, 25 bp, Rattus norvegicus
ccctagaccagcaaatgttcctttt

SEQ ID NO: 249511 - DNA, 25 bp, Rattus norvegicus
ccctagaccagctaatgttcctttt

SEQ ID NO: 249512 - DNA, 25 bp, Rattus norvegicus
ccctagacggctctgtatagtccat

SEQ ID NO: 249513 - DNA, 25 bp, Rattus norvegicus
ccctagacggctgtgtatagtccat

SEQ ID NO: 249514 - DNA, 25 bp, Rattus norvegicus
ccctagatggtgatgctgtggacaa

SEQ ID NO: 249515 - DNA, 25 bp, Rattus norvegicus
ccctagatggtgttgctgtggacaa

SEQ ID NO: 249516 - DNA, 25 bp, Rattus norvegicus
ccctagcaaggacagctttgggaat

SEQ ID NO: 249517 - DNA, 25 bp, Rattus norvegicus
ccctagcaaggagagctttgggaat

SEQ ID NO: 249518 - DNA, 25 bp, Rattus norvegicus
ccctagccagcgattgtatatactc

SEQ ID NO: 249519 - DNA, 25 bp, Rattus norvegicus
ccctagccagcgtttgtatatactc

SEQ ID NO: 249520 - DNA, 25 bp, Rattus norvegicus
ccctagccttgcacagttcagtgaa

SEQ ID NO: 249521 - DNA, 25 bp, Rattus norvegicus
ccctagccttgctcagttcagtgaa

SEQ ID NO: 249522 - DNA, 25 bp, Rattus norvegicus
ccctaggcccttagatggtcaatat

SEQ ID NO: 249523 - DNA, 25 bp, Rattus norvegicus
ccctaggccctttgatggtcaatat

SEQ ID NO: 249524 - DNA, 25 bp, Rattus norvegicus
ccctaggccggtcatcttggagatt

SEQ ID NO: 249525 - DNA, 25 bp, Rattus norvegicus
ccctaggccggtgatcttggagatt

SEQ ID NO: 249526 - DNA, 25 bp, Rattus norvegicus
ccctagggaggtcgccaagatctct

SEQ ID NO: 249527 - DNA, 25 bp, Rattus norvegicus
ccctagggaggtggccaagatctct

SEQ ID NO: 249528 - DNA, 25 bp, Rattus norvegicus
ccctaggttctcatcagacgttaat

SEQ ID NO: 249529 - DNA, 25 bp, Rattus norvegicus
ccctaggttctcttcagacgttaat

SEQ ID NO: 249530 - DNA, 25 bp, Rattus norvegicus
ccctagtgctccatggaaaattact

SEQ ID NO: 249531 - DNA, 25 bp, Rattus norvegicus
ccctagtgctccttggaaaattact

SEQ ID NO: 249532 - DNA, 25 bp, Rattus norvegicus
ccctagtgggctccagaagcggcac

SEQ ID NO: 249533 - DNA, 25 bp, Rattus norvegicus
ccctagtgggctgcagaagcggcac

SEQ ID NO: 249534 - DNA, 25 bp, Rattus norvegicus
ccctagtttgggatgtctggcacag

SEQ ID NO: 249535 - DNA, 25 bp, Rattus norvegicus
ccctagtttgggttgtctggcacag

SEQ ID NO: 249536 - DNA, 25 bp, Rattus norvegicus
ccctatcatctcagtatggctcaaa

SEQ ID NO: 249537 - DNA, 25 bp, Rattus norvegicus
ccctatcatctctgtatggctcaaa

SEQ ID NO: 249538 - DNA, 25 bp, Rattus norvegicus
ccctatccccacagagatcaaatta

SEQ ID NO: 249539 - DNA, 25 bp, Rattus norvegicus
ccctatccccactgagatcaaatta

SEQ ID NO: 249540 - DNA, 25 bp, Rattus norvegicus
ccctatcccttgagtaatgccaaat

SEQ ID NO: 249541 - DNA, 25 bp, Rattus norvegicus
ccctatcccttgtgtaatgccaaat

SEQ ID NO: 249542 - DNA, 25 bp, Rattus norvegicus
ccctatccttagctcgtttactatt

SEQ ID NO: 249543 - DNA, 25 bp, Rattus norvegicus
ccctatccttaggtcgtttactatt

SEQ ID NO: 249544 - DNA, 25 bp, Rattus norvegicus
ccctatctgcctacgtatgttatta

SEQ ID NO: 249545 - DNA, 25 bp, Rattus norvegicus
ccctatctgccttcgtatgttatta

SEQ ID NO: 249546 - DNA, 25 bp, Rattus norvegicus
ccctatctgtggcacttggagacgt

SEQ ID NO: 249547 - DNA, 25 bp, Rattus norvegicus
ccctatctgtgggacttggagacgt

SEQ ID NO: 249548 - DNA, 25 bp, Rattus norvegicus
ccctatcttggactcatccttcaaa

SEQ ID NO: 249549 - DNA, 25 bp, Rattus norvegicus
ccctatcttggagtcatccttcaaa

SEQ ID NO: 249550 - DNA, 25 bp, Rattus norvegicus
ccctatcttttcaacatagccaatc

SEQ ID NO: 249551 - DNA, 25 bp, Rattus norvegicus
ccctatcttttctacatagccaatc

SEQ ID NO: 249552 - DNA, 25 bp, Rattus norvegicus
ccctatggatctcgtgttgcactgg

SEQ ID NO: 249553 - DNA, 25 bp, Rattus norvegicus
ccctatggatctggtgttgcactgg

SEQ ID NO: 249554 - DNA, 25 bp, Rattus norvegicus
ccctatggtggtaggattcctcaaa

SEQ ID NO: 249555 - DNA, 25 bp, Rattus norvegicus
ccctatggtggtcgctatggatctg

SEQ ID NO: 249556 - DNA, 25 bp, Rattus norvegicus
ccctatggtggtggctatggatctg

SEQ ID NO: 249557 - DNA, 25 bp, Rattus norvegicus
ccctatggtggttggattcctcaaa

SEQ ID NO: 249558 - DNA, 25 bp, Rattus norvegicus
ccctatgtcctaccaactttgaata

SEQ ID NO: 249559 - DNA, 25 bp, Rattus norvegicus
ccctatgtcctagcaactttgaata

SEQ ID NO: 249560 - DNA, 25 bp, Rattus norvegicus
ccctattaaattacctgcggtgcct

SEQ ID NO: 249561 - DNA, 25 bp, Rattus norvegicus
ccctattaaatttcctgcggtgcct

SEQ ID NO: 249562 - DNA, 25 bp, Rattus norvegicus
ccctattacggcctaagcaattgct

SEQ ID NO: 249563 - DNA, 25 bp, Rattus norvegicus
ccctattacggcgtaagcaattgct

SEQ ID NO: 249564 - DNA, 25 bp, Rattus norvegicus
ccctattctggacgattcgtctgaa

SEQ ID NO: 249565 - DNA, 25 bp, Rattus norvegicus
ccctattctggaggattcgtctgaa

SEQ ID NO: 249566 - DNA, 25 bp, Rattus norvegicus
ccctattttctgatgttatagagga

SEQ ID NO: 249567 - DNA, 25 bp, Rattus norvegicus
ccctattttctgttgttatagagga

SEQ ID NO: 249568 - DNA, 25 bp, Rattus norvegicus
ccctcaaagagtcatgccaataaag

SEQ ID NO: 249569 - DNA, 25 bp, Rattus norvegicus
ccctcaaagagtgatgccaataaag

SEQ ID NO: 249570 - DNA, 25 bp, Rattus norvegicus
ccctcaaatgggatatgtaaataac

SEQ ID NO: 249571 - DNA, 25 bp, Rattus norvegicus
ccctcaaatgggttatgtaaataac

SEQ ID NO: 249572 - DNA, 25 bp, Rattus norvegicus
ccctcaacgctgattcacaagatgg

SEQ ID NO: 249573 - DNA, 25 bp, Rattus norvegicus
ccctcaacgctgtttcacaagatgg

SEQ ID NO: 249574 - DNA, 25 bp, Rattus norvegicus
ccctcaactgacctgcagatctaaa

SEQ ID NO: 249575 - DNA, 25 bp, Rattus norvegicus
ccctcaactgacgtgcagatctaaa

SEQ ID NO: 249576 - DNA, 25 bp, Rattus norvegicus
ccctcaactgttctaaatcatgcaa

SEQ ID NO: 249577 - DNA, 25 bp, Rattus norvegicus
ccctcaactgttgtaaatcatgcaa

SEQ ID NO: 249578 - DNA, 25 bp, Rattus norvegicus
ccctcaagattgacagcaatgcatc

SEQ ID NO: 249579 - DNA, 25 bp, Rattus norvegicus
ccctcaagattgtcagcaatgcatc

SEQ ID NO: 249580 - DNA, 25 bp, Rattus norvegicus
ccctcaaggcacagaaagctagcat

SEQ ID NO: 249581 - DNA, 25 bp, Rattus norvegicus
ccctcaaggcactgaaagctagcat

SEQ ID NO: 249582 - DNA, 25 bp, Rattus norvegicus
ccctcaagtctacatgctctgttta

SEQ ID NO: 249583 - DNA, 25 bp, Rattus norvegicus
ccctcaagtctagatgctctgttta

SEQ ID NO: 249584 - DNA, 25 bp, Rattus norvegicus
ccctcaatccttaattttcttccat

SEQ ID NO: 249585 - DNA, 25 bp, Rattus norvegicus
ccctcaatcctttattttcttccat

SEQ ID NO: 249586 - DNA, 25 bp, Rattus norvegicus
ccctcaatgtgcctctaatctaaaa

SEQ ID NO: 249587 - DNA, 25 bp, Rattus norvegicus
ccctcaatgtgcgtctaatctaaaa

SEQ ID NO: 249588 - DNA, 25 bp, Rattus norvegicus
ccctcacactccaatcaaatttatg

SEQ ID NO: 249589 - DNA, 25 bp, Rattus norvegicus
ccctcacactcctatcaaatttatg

SEQ ID NO: 249590 - DNA, 25 bp, Rattus norvegicus
ccctcaccgacactttgatggcgaa

SEQ ID NO: 249591 - DNA, 25 bp, Rattus norvegicus
ccctcaccgacagtttgatggcgaa

SEQ ID NO: 249592 - DNA, 25 bp, Rattus norvegicus
ccctcacctactcacggaagtggga

SEQ ID NO: 249593 - DNA, 25 bp, Rattus norvegicus
ccctcacctactgacggaagtggga

SEQ ID NO: 249594 - DNA, 25 bp, Rattus norvegicus
ccctcacctgacatttccagataga

SEQ ID NO: 249595 - DNA, 25 bp, Rattus norvegicus
ccctcacctgacttttccagataga

SEQ ID NO: 249596 - DNA, 25 bp, Rattus norvegicus
ccctcacggaggaaatagttttgct

SEQ ID NO: 249597 - DNA, 25 bp, Rattus norvegicus
ccctcacggaggtaatagttttgct

SEQ ID NO: 249598 - DNA, 25 bp, Rattus norvegicus
ccctcacgggtcagggtgattacag

SEQ ID NO: 249599 - DNA, 25 bp, Rattus norvegicus
ccctcacgggtctgggtgattacag

SEQ ID NO: 249600 - DNA, 25 bp, Rattus norvegicus
ccctcactgaggaaagactgctggt

SEQ ID NO: 249601 - DNA, 25 bp, Rattus norvegicus
ccctcactgaggtaagactgctggt

SEQ ID NO: 249602 - DNA, 25 bp, Rattus norvegicus
ccctcactgttactacgtaagttat

SEQ ID NO: 249603 - DNA, 25 bp, Rattus norvegicus
ccctcactgttagtacgtaagttat

SEQ ID NO: 249604 - DNA, 25 bp, Rattus norvegicus
ccctcactgtttcgaccagattgga

SEQ ID NO: 249605 - DNA, 25 bp, Rattus norvegicus
ccctcactgtttggaccagattgga

SEQ ID NO: 249606 - DNA, 25 bp, Rattus norvegicus
ccctcacttgacactatcattgttt

SEQ ID NO: 249607 - DNA, 25 bp, Rattus norvegicus
ccctcacttgactctatcattgttt

SEQ ID NO: 249608 - DNA, 25 bp, Rattus norvegicus
ccctcagacagtcacgcaaagcgga

SEQ ID NO: 249609 - DNA, 25 bp, Rattus norvegicus
ccctcagacagtgacgcaaagcgga

SEQ ID NO: 249610 - DNA, 25 bp, Rattus norvegicus
ccctcagagtgcaagaggatgctct

SEQ ID NO: 249611 - DNA, 25 bp, Rattus norvegicus
ccctcagagtgctagaggatgctct

SEQ ID NO: 249612 - DNA, 25 bp, Rattus norvegicus
ccctcagcaaatcctacagtgtaac

SEQ ID NO: 249613 - DNA, 25 bp, Rattus norvegicus
ccctcagcaaatgctacagtgtaac

SEQ ID NO: 249614 - DNA, 25 bp, Rattus norvegicus
ccctcagcatgcacacaagtatgca

SEQ ID NO: 249615 - DNA, 25 bp, Rattus norvegicus
ccctcagcatgctcacaagtatgca

SEQ ID NO: 249616 - DNA, 25 bp, Rattus norvegicus
ccctcagccattacaatgttgaagg

SEQ ID NO: 249617 - DNA, 25 bp, Rattus norvegicus
ccctcagccatttcaatgttgaagg

SEQ ID NO: 249618 - DNA, 25 bp, Rattus norvegicus
ccctcagctgttaccatttcatgtt

SEQ ID NO: 249619 - DNA, 25 bp, Rattus norvegicus
ccctcagctgtttccatttcatgtt

SEQ ID NO: 249620 - DNA, 25 bp, Rattus norvegicus
ccctcaggacccacagatcaggaga

SEQ ID NO: 249621 - DNA, 25 bp, Rattus norvegicus
ccctcaggaccctcagatcaggaga

SEQ ID NO: 249622 - DNA, 25 bp, Rattus norvegicus
ccctcatagactctaagcctctgga

SEQ ID NO: 249623 - DNA, 25 bp, Rattus norvegicus
ccctcatagactgtaagcctctgga

SEQ ID NO: 249624 - DNA, 25 bp, Rattus norvegicus
ccctcatcagagatatgtatccatt

SEQ ID NO: 249625 - DNA, 25 bp, Rattus norvegicus
ccctcatcagagttatgtatccatt

SEQ ID NO: 249626 - DNA, 25 bp, Rattus norvegicus
ccctcatcgccgacggtgacagtga

SEQ ID NO: 249627 - DNA, 25 bp, Rattus norvegicus
ccctcatcgccgtcggtgacagtga

SEQ ID NO: 249628 - DNA, 25 bp, Rattus norvegicus
ccctcattccatcagaagaaccaag

SEQ ID NO: 249629 - DNA, 25 bp, Rattus norvegicus
ccctcattccatgagaagaaccaag

SEQ ID NO: 249630 - DNA, 25 bp, Rattus norvegicus
ccctcattgaaaacttagccctggt

SEQ ID NO: 249631 - DNA, 25 bp, Rattus norvegicus
ccctcattgaaatcttagccctggt

SEQ ID NO: 249632 - DNA, 25 bp, Rattus norvegicus
ccctccaagcttatgagtcttttct

SEQ ID NO: 249633 - DNA, 25 bp, Rattus norvegicus
ccctccaagcttttgagtcttttct

SEQ ID NO: 249634 - DNA, 25 bp, Rattus norvegicus
ccctccacgggcagattggcggctg

SEQ ID NO: 249635 - DNA, 25 bp, Rattus norvegicus
ccctccacgggctgattggcggctg

SEQ ID NO: 249636 - DNA, 25 bp, Rattus norvegicus
ccctccagagacagatagctcggat

SEQ ID NO: 249637 - DNA, 25 bp, Rattus norvegicus
ccctccagagactgatagctcggat

SEQ ID NO: 249638 - DNA, 25 bp, Rattus norvegicus
ccctccagagttcccttcaatgtaa

SEQ ID NO: 249639 - DNA, 25 bp, Rattus norvegicus
ccctccagagttgccttcaatgtaa

SEQ ID NO: 249640 - DNA, 25 bp, Rattus norvegicus
ccctccagatcgacaaatgcctgga

SEQ ID NO: 249641 - DNA, 25 bp, Rattus norvegicus
ccctccagatcgtcaaatgcctgga

SEQ ID NO: 249642 - DNA, 25 bp, Rattus norvegicus
ccctccagcataccaaaatcttgtg

SEQ ID NO: 249643 - DNA, 25 bp, Rattus norvegicus
ccctccagcatagcaaaatcttgtg

SEQ ID NO: 249644 - DNA, 25 bp, Rattus norvegicus
ccctccatatcaagttgctggcaag

SEQ ID NO: 249645 - DNA, 25 bp, Rattus norvegicus
ccctccatatcatgttgctggcaag

SEQ ID NO: 249646 - DNA, 25 bp, Rattus norvegicus
ccctccatcaacagcattttattct

SEQ ID NO: 249647 - DNA, 25 bp, Rattus norvegicus
ccctccatcaactgcattttattct

SEQ ID NO: 249648 - DNA, 25 bp, Rattus norvegicus
ccctccatcatgagcaatccagaaa

SEQ ID NO: 249649 - DNA, 25 bp, Rattus norvegicus
ccctccatcatgtgcaatccagaaa

SEQ ID NO: 249650 - DNA, 25 bp, Rattus norvegicus
ccctccatctatcatgacttactaa

SEQ ID NO: 249651 - DNA, 25 bp, Rattus norvegicus
ccctccatctatgatgacttactaa

SEQ ID NO: 249652 - DNA, 25 bp, Rattus norvegicus
ccctccatctgtatgttgctttaaa

SEQ ID NO: 249653 - DNA, 25 bp, Rattus norvegicus
ccctccatctgtttgttgctttaaa

SEQ ID NO: 249654 - DNA, 25 bp, Rattus norvegicus
ccctccatgatcacctattgatttg

SEQ ID NO: 249655 - DNA, 25 bp, Rattus norvegicus
ccctccatgatctcctattgatttg

SEQ ID NO: 249656 - DNA, 25 bp, Rattus norvegicus
ccctccattctcaccaaagtaaatt

SEQ ID NO: 249657 - DNA, 25 bp, Rattus norvegicus
ccctccattctctccaaagtaaatt

SEQ ID NO: 249658 - DNA, 25 bp, Rattus norvegicus
ccctcccatcaactactgagataaa

SEQ ID NO: 249659 - DNA, 25 bp, Rattus norvegicus
ccctcccatcaagtactgagataaa

SEQ ID NO: 249660 - DNA, 25 bp, Rattus norvegicus
ccctccccatctcatgaataaagtt

SEQ ID NO: 249661 - DNA, 25 bp, Rattus norvegicus
ccctccccatctgatgaataaagtt

SEQ ID NO: 249662 - DNA, 25 bp, Rattus norvegicus
ccctcccggtgtagaagtgactttg

SEQ ID NO: 249663 - DNA, 25 bp, Rattus norvegicus
ccctcccggtgttgaagtgactttg

SEQ ID NO: 249664 - DNA, 25 bp, Rattus norvegicus
ccctccctaactactcaagtagttg

SEQ ID NO: 249665 - DNA, 25 bp, Rattus norvegicus
ccctccctaacttctcaagtagttg

SEQ ID NO: 249666 - DNA, 25 bp, Rattus norvegicus
ccctccctcagcagaaaagtacagt

SEQ ID NO: 249667 - DNA, 25 bp, Rattus norvegicus
ccctccctcagctgaaaagtacagt

SEQ ID NO: 249668 - DNA, 25 bp, Rattus norvegicus
ccctccctgattaattggttgtaat

SEQ ID NO: 249669 - DNA, 25 bp, Rattus norvegicus
ccctccctgatttattggttgtaat

SEQ ID NO: 249670 - DNA, 25 bp, Rattus norvegicus
ccctcccttgctatacttttagaat

SEQ ID NO: 249671 - DNA, 25 bp, Rattus norvegicus
ccctcccttgctttacttttagaat

SEQ ID NO: 249672 - DNA, 25 bp, Rattus norvegicus
ccctcccttggacaacatgaagttg

SEQ ID NO: 249673 - DNA, 25 bp, Rattus norvegicus
ccctcccttggagaacatgaagttg

SEQ ID NO: 249674 - DNA, 25 bp, Rattus norvegicus
ccctccgagtgaatgcccaggactt

SEQ ID NO: 249675 - DNA, 25 bp, Rattus norvegicus
ccctccgagtgattgcccaggactt

SEQ ID NO: 249676 - DNA, 25 bp, Rattus norvegicus
ccctccgatcccatgtagagtataa

SEQ ID NO: 249677 - DNA, 25 bp, Rattus norvegicus
ccctccgatcccttgtagagtataa

SEQ ID NO: 249678 - DNA, 25 bp, Rattus norvegicus
ccctccgcttagatgggacataact

SEQ ID NO: 249679 - DNA, 25 bp, Rattus norvegicus
ccctccgcttagttgggacataact

SEQ ID NO: 249680 - DNA, 25 bp, Rattus norvegicus
ccctcctatgatctcaccattatgg

SEQ ID NO: 249681 - DNA, 25 bp, Rattus norvegicus
ccctcctatgatgtcaccattatgg

SEQ ID NO: 249682 - DNA, 25 bp, Rattus norvegicus
ccctcctattatctctgtaccttga

SEQ ID NO: 249683 - DNA, 25 bp, Rattus norvegicus
ccctcctattatgtctgtaccttga

SEQ ID NO: 249684 - DNA, 25 bp, Rattus norvegicus
ccctcctcatctcagtgaaggcaga

SEQ ID NO: 249685 - DNA, 25 bp, Rattus norvegicus
ccctcctcatctgagtgaaggcaga

SEQ ID NO: 249686 - DNA, 25 bp, Rattus norvegicus
ccctcctccactatgatgaaatgtt

SEQ ID NO: 249687 - DNA, 25 bp, Rattus norvegicus
ccctcctccactttgatgaaatgtt

SEQ ID NO: 249688 - DNA, 25 bp, Rattus norvegicus
ccctcctccattcctgagaaaagag

SEQ ID NO: 249689 - DNA, 25 bp, Rattus norvegicus
ccctcctccattgctgagaaaagag

SEQ ID NO: 249690 - DNA, 25 bp, Rattus norvegicus
ccctcctcctcaagaatcatattgt

SEQ ID NO: 249691 - DNA, 25 bp, Rattus norvegicus
ccctcctcctcatgaatcatattgt

SEQ ID NO: 249692 - DNA, 25 bp, Rattus norvegicus
ccctcctcgctacataaaatacatt

SEQ ID NO: 249693 - DNA, 25 bp, Rattus norvegicus
ccctcctcgctagataaaatacatt

SEQ ID NO: 249694 - DNA, 25 bp, Rattus norvegicus
ccctcctcgggaagtacatatgcag

SEQ ID NO: 249695 - DNA, 25 bp, Rattus norvegicus
ccctcctcgggatgtacatatgcag

SEQ ID NO: 249696 - DNA, 25 bp, Rattus norvegicus
ccctcctctggtctgcgagcatgaa

SEQ ID NO: 249697 - DNA, 25 bp, Rattus norvegicus
ccctcctctggtgtgcgagcatgaa

SEQ ID NO: 249698 - DNA, 25 bp, Rattus norvegicus
ccctcctgatgtctccattatataa

SEQ ID NO: 249699 - DNA, 25 bp, Rattus norvegicus
ccctcctgatgtgtccattatataa

SEQ ID NO: 249700 - DNA, 25 bp, Rattus norvegicus
ccctcctgtactcaaaacgtagact

SEQ ID NO: 249701 - DNA, 25 bp, Rattus norvegicus
ccctcctgtactgaaaacgtagact

SEQ ID NO: 249702 - DNA, 25 bp, Rattus norvegicus
ccctcctgtgtgcttgatgaacttt

SEQ ID NO: 249703 - DNA, 25 bp, Rattus norvegicus
ccctcctgtgtggttgatgaacttt

SEQ ID NO: 249704 - DNA, 25 bp, Rattus norvegicus
ccctccttacgtatatgtcagtcag

SEQ ID NO: 249705 - DNA, 25 bp, Rattus norvegicus
ccctccttacgtttatgtcagtcag

SEQ ID NO: 249706 - DNA, 25 bp, Rattus norvegicus
ccctccttaggtactgtttcataat

SEQ ID NO: 249707 - DNA, 25 bp, Rattus norvegicus
ccctccttaggttctgtttcataat

SEQ ID NO: 249708 - DNA, 25 bp, Rattus norvegicus
ccctccttatgacctgacactttat

SEQ ID NO: 249709 - DNA, 25 bp, Rattus norvegicus
ccctccttatgagctgacactttat

SEQ ID NO: 249710 - DNA, 25 bp, Rattus norvegicus
ccctccttcctgatcttgttaataa

SEQ ID NO: 249711 - DNA, 25 bp, Rattus norvegicus
ccctccttcctgttcttgttaataa

SEQ ID NO: 249712 - DNA, 25 bp, Rattus norvegicus
ccctcctttcccatggtatgtaaga

SEQ ID NO: 249713 - DNA, 25 bp, Rattus norvegicus
ccctcctttcccttggtatgtaaga

SEQ ID NO: 249714 - DNA, 25 bp, Rattus norvegicus
ccctcctttctacaagttgctgtgg

SEQ ID NO: 249715 - DNA, 25 bp, Rattus norvegicus
ccctcctttctagaagttgctgtgg

SEQ ID NO: 249716 - DNA, 25 bp, Rattus norvegicus
ccctcgaccatccaattaatactgt

SEQ ID NO: 249717 - DNA, 25 bp, Rattus norvegicus
ccctcgaccatcgaattaatactgt

SEQ ID NO: 249718 - DNA, 25 bp, Rattus norvegicus
ccctcgactgatattctggtggatt

SEQ ID NO: 249719 - DNA, 25 bp, Rattus norvegicus
ccctcgactgattttctggtggatt

SEQ ID NO: 249720 - DNA, 25 bp, Rattus norvegicus
ccctcgatcctgaacactactagaa

SEQ ID NO: 249721 - DNA, 25 bp, Rattus norvegicus
ccctcgatcctgtacactactagaa

SEQ ID NO: 249722 - DNA, 25 bp, Rattus norvegicus
ccctcgcctctaatgtttgacattt

SEQ ID NO: 249723 - DNA, 25 bp, Rattus norvegicus
ccctcgcctctattgtttgacattt

SEQ ID NO: 249724 - DNA, 25 bp, Rattus norvegicus
ccctcgcttgttaagttattaccat

SEQ ID NO: 249725 - DNA, 25 bp, Rattus norvegicus
ccctcgcttgtttagttattaccat

SEQ ID NO: 249726 - DNA, 25 bp, Rattus norvegicus
ccctcgtggaggaccctgctcaggg

SEQ ID NO: 249727 - DNA, 25 bp, Rattus norvegicus
ccctcgtggaggtccctgctcaggg

SEQ ID NO: 249728 - DNA, 25 bp, Rattus norvegicus
ccctcgtggagtccctcagattgaa

SEQ ID NO: 249729 - DNA, 25 bp, Rattus norvegicus
ccctcgtggagtgcctcagattgaa

SEQ ID NO: 249730 - DNA, 25 bp, Rattus norvegicus
ccctcgtggtgcaacgggatgcagt

SEQ ID NO: 249731 - DNA, 25 bp, Rattus norvegicus
ccctcgtggtgctacgggatgcagt

SEQ ID NO: 249732 - DNA, 25 bp, Rattus norvegicus
ccctcgtgtcagagctctgaaaatg

SEQ ID NO: 249733 - DNA, 25 bp, Rattus norvegicus
ccctcgtgtcagtgctctgaaaatg

SEQ ID NO: 249734 - DNA, 25 bp, Rattus norvegicus
ccctcgtgtggaccctaagagaaca

SEQ ID NO: 249735 - DNA, 25 bp, Rattus norvegicus
ccctcgtgtggagcctaagagaaca

SEQ ID NO: 249736 - DNA, 25 bp, Rattus norvegicus
ccctctaagtgccttcttttaatgt

SEQ ID NO: 249737 - DNA, 25 bp, Rattus norvegicus
ccctctaagtgcgttcttttaatgt

SEQ ID NO: 249738 - DNA, 25 bp, Rattus norvegicus
ccctctaatgacagccttggatgtg

SEQ ID NO: 249739 - DNA, 25 bp, Rattus norvegicus
ccctctaatgactgccttggatgtg

SEQ ID NO: 249740 - DNA, 25 bp, Rattus norvegicus
ccctctacctacagattttgctgat

SEQ ID NO: 249741 - DNA, 25 bp, Rattus norvegicus
ccctctacctactgattttgctgat

SEQ ID NO: 249742 - DNA, 25 bp, Rattus norvegicus
ccctctagccagcaatctgttgttt

SEQ ID NO: 249743 - DNA, 25 bp, Rattus norvegicus
ccctctagccaggaatctgttgttt

SEQ ID NO: 249744 - DNA, 25 bp, Rattus norvegicus
ccctctaggcagctgtccacaataa

SEQ ID NO: 249745 - DNA, 25 bp, Rattus norvegicus
ccctctaggcaggtgtccacaataa

SEQ ID NO: 249746 - DNA, 25 bp, Rattus norvegicus
ccctctaggcgtattcttatttctg

SEQ ID NO: 249747 - DNA, 25 bp, Rattus norvegicus
ccctctaggcgttttcttatttctg

SEQ ID NO: 249748 - DNA, 25 bp, Rattus norvegicus
ccctctatgctgcacgcagtgttag

SEQ ID NO: 249749 - DNA, 25 bp, Rattus norvegicus
ccctctatgctggacgcagtgttag

SEQ ID NO: 249750 - DNA, 25 bp, Rattus norvegicus
ccctctatggccctatctatgtgga

SEQ ID NO: 249751 - DNA, 25 bp, Rattus norvegicus
ccctctatggccgtatctatgtgga

SEQ ID NO: 249752 - DNA, 25 bp, Rattus norvegicus
ccctctattcacacacatgcagtaa

SEQ ID NO: 249753 - DNA, 25 bp, Rattus norvegicus
ccctctattcactcacatgcagtaa

SEQ ID NO: 249754 - DNA, 25 bp, Rattus norvegicus
ccctctcaatcgctgtaaacttttg

SEQ ID NO: 249755 - DNA, 25 bp, Rattus norvegicus
ccctctcaatcggtgtaaacttttg

SEQ ID NO: 249756 - DNA, 25 bp, Rattus norvegicus
ccctctcctaagaatcagcacttta

SEQ ID NO: 249757 - DNA, 25 bp, Rattus norvegicus
ccctctcctaagtatcagcacttta

SEQ ID NO: 249758 - DNA, 25 bp, Rattus norvegicus
ccctctcctccaattagtaattgaa

SEQ ID NO: 249759 - DNA, 25 bp, Rattus norvegicus
ccctctcctccatttagtaattgaa

SEQ ID NO: 249760 - DNA, 25 bp, Rattus norvegicus
ccctctcctgtgaggaacctaataa

SEQ ID NO: 249761 - DNA, 25 bp, Rattus norvegicus
ccctctcctgtgtggaacctaataa

SEQ ID NO: 249762 - DNA, 25 bp, Rattus norvegicus
ccctctctatcactgttgcatgtaa

SEQ ID NO: 249763 - DNA, 25 bp, Rattus norvegicus
ccctctctatcagtgttgcatgtaa

SEQ ID NO: 249764 - DNA, 25 bp, Rattus norvegicus
ccctctctcaagattgctgtagcag

SEQ ID NO: 249765 - DNA, 25 bp, Rattus norvegicus
ccctctctcaagtttgctgtagcag

SEQ ID NO: 249766 - DNA, 25 bp, Rattus norvegicus
ccctctctccttcataatttgttaa

SEQ ID NO: 249767 - DNA, 25 bp, Rattus norvegicus
ccctctctccttgataatttgttaa

SEQ ID NO: 249768 - DNA, 25 bp, Rattus norvegicus
ccctctctcttgcacaacaataaaa

SEQ ID NO: 249769 - DNA, 25 bp, Rattus norvegicus
ccctctctcttggacaacaataaaa

SEQ ID NO: 249770 - DNA, 25 bp, Rattus norvegicus
ccctctctgagacttacagtcttgt

SEQ ID NO: 249771 - DNA, 25 bp, Rattus norvegicus
ccctctctgagagttacagtcttgt

SEQ ID NO: 249772 - DNA, 25 bp, Rattus norvegicus
ccctctctggatcagtggcacagat

SEQ ID NO: 249773 - DNA, 25 bp, Rattus norvegicus
ccctctctggatgagtggcacagat

SEQ ID NO: 249774 - DNA, 25 bp, Rattus norvegicus
ccctctctggtcaatgtctgtgtta

SEQ ID NO: 249775 - DNA, 25 bp, Rattus norvegicus
ccctctctggtctatgtctgtgtta

SEQ ID NO: 249776 - DNA, 25 bp, Rattus norvegicus
ccctctctgttgacatttaatgtcc

SEQ ID NO: 249777 - DNA, 25 bp, Rattus norvegicus
ccctctctgttgtcatttaatgtcc

SEQ ID NO: 249778 - DNA, 25 bp, Rattus norvegicus
ccctctcttctaccttggtaatgaa

SEQ ID NO: 249779 - DNA, 25 bp, Rattus norvegicus
ccctctcttctagcttggtaatgaa

SEQ ID NO: 249780 - DNA, 25 bp, Rattus norvegicus
ccctctcttgttcagactttgttta

SEQ ID NO: 249781 - DNA, 25 bp, Rattus norvegicus
ccctctcttgttgagactttgttta

SEQ ID NO: 249782 - DNA, 25 bp, Rattus norvegicus
ccctctgaaaccagcctataaataa

SEQ ID NO: 249783 - DNA, 25 bp, Rattus norvegicus
ccctctgaaacctgcctataaataa

SEQ ID NO: 249784 - DNA, 25 bp, Rattus norvegicus
ccctctgaaggcagtgttctgctga

SEQ ID NO: 249785 - DNA, 25 bp, Rattus norvegicus
ccctctgaaggctgtgttctgctga

SEQ ID NO: 249786 - DNA, 25 bp, Rattus norvegicus
ccctctgaagtcaccttcttttatt

SEQ ID NO: 249787 - DNA, 25 bp, Rattus norvegicus
ccctctgaagtctccttcttttatt

SEQ ID NO: 249788 - DNA, 25 bp, Rattus norvegicus
ccctctgatccaactgcaggtatta

SEQ ID NO: 249789 - DNA, 25 bp, Rattus norvegicus
ccctctgatccatctgcaggtatta

SEQ ID NO: 249790 - DNA, 25 bp, Rattus norvegicus
ccctctgcacttagtttacttgttt

SEQ ID NO: 249791 - DNA, 25 bp, Rattus norvegicus
ccctctgcactttgtttacttgttt

SEQ ID NO: 249792 - DNA, 25 bp, Rattus norvegicus
ccctctgcctgaagcgagaatcata

SEQ ID NO: 249793 - DNA, 25 bp, Rattus norvegicus
ccctctgcctgatgcgagaatcata

SEQ ID NO: 249794 - DNA, 25 bp, Rattus norvegicus
ccctctgctggcattgtttgaaaat

SEQ ID NO: 249795 - DNA, 25 bp, Rattus norvegicus
ccctctgctggctttgtttgaaaat

SEQ ID NO: 249796 - DNA, 25 bp, Rattus norvegicus
ccctctgcttggacagattcacaaa

SEQ ID NO: 249797 - DNA, 25 bp, Rattus norvegicus
ccctctgcttggtcagattcacaaa

SEQ ID NO: 249798 - DNA, 25 bp, Rattus norvegicus
ccctctggcctgacaaatcttgtta

SEQ ID NO: 249799 - DNA, 25 bp, Rattus norvegicus
ccctctggcctgtcaaatcttgtta

SEQ ID NO: 249800 - DNA, 25 bp, Rattus norvegicus
ccctctggcttacgcggtggagaaa

SEQ ID NO: 249801 - DNA, 25 bp, Rattus norvegicus
ccctctggcttaggcggtggagaaa

SEQ ID NO: 249802 - DNA, 25 bp, Rattus norvegicus
ccctctgggagcagaaattggacct

SEQ ID NO: 249803 - DNA, 25 bp, Rattus norvegicus
ccctctgggagctgaaattggacct

SEQ ID NO: 249804 - DNA, 25 bp, Rattus norvegicus
ccctctgggtgcatgggtatgcctg

SEQ ID NO: 249805 - DNA, 25 bp, Rattus norvegicus
ccctctgggtgcttgggtatgcctg

SEQ ID NO: 249806 - DNA, 25 bp, Rattus norvegicus
ccctctgggttcaggccaatgagaa

SEQ ID NO: 249807 - DNA, 25 bp, Rattus norvegicus
ccctctgggttctggccaatgagaa

SEQ ID NO: 249808 - DNA, 25 bp, Rattus norvegicus
ccctctggtggtctgttgtggaatt

SEQ ID NO: 249809 - DNA, 25 bp, Rattus norvegicus
ccctctggtggtgtgttgtggaatt

SEQ ID NO: 249810 - DNA, 25 bp, Rattus norvegicus
ccctctggttatactgtgtgcagta

SEQ ID NO: 249811 - DNA, 25 bp, Rattus norvegicus
ccctctggttattctgtgtgcagta

SEQ ID NO: 249812 - DNA, 25 bp, Rattus norvegicus
ccctctgtaagcaatggaacccata

SEQ ID NO: 249813 - DNA, 25 bp, Rattus norvegicus
ccctctgtaagctatggaacccata

SEQ ID NO: 249814 - DNA, 25 bp, Rattus norvegicus
ccctctgtatacctttaactcattt

SEQ ID NO: 249815 - DNA, 25 bp, Rattus norvegicus
ccctctgtatacgtttaactcattt

SEQ ID NO: 249816 - DNA, 25 bp, Rattus norvegicus
ccctctgttgggagcttcatagata

SEQ ID NO: 249817 - DNA, 25 bp, Rattus norvegicus
ccctctgttgggtgcttcatagata

SEQ ID NO: 249818 - DNA, 25 bp, Rattus norvegicus
ccctctgttgtgacgtttactgaag

SEQ ID NO: 249819 - DNA, 25 bp, Rattus norvegicus
ccctctgttgtgtcgtttactgaag

SEQ ID NO: 249820 - DNA, 25 bp, Rattus norvegicus
ccctcttagggaagctgtgtgccaa

SEQ ID NO: 249821 - DNA, 25 bp, Rattus norvegicus
ccctcttagggatgctgtgtgccaa

SEQ ID NO: 249822 - DNA, 25 bp, Rattus norvegicus
ccctcttatttactggctacggtga

SEQ ID NO: 249823 - DNA, 25 bp, Rattus norvegicus
ccctcttatttagtggctacggtga

SEQ ID NO: 249824 - DNA, 25 bp, Rattus norvegicus
ccctcttattttactaccgattgct

SEQ ID NO: 249825 - DNA, 25 bp, Rattus norvegicus
ccctcttatttttctaccgattgct

SEQ ID NO: 249826 - DNA, 25 bp, Rattus norvegicus
ccctcttccttaatattatcctatg

SEQ ID NO: 249827 - DNA, 25 bp, Rattus norvegicus
ccctcttccttattattatcctatg

SEQ ID NO: 249828 - DNA, 25 bp, Rattus norvegicus
ccctcttcgcttatctatggtaatt

SEQ ID NO: 249829 - DNA, 25 bp, Rattus norvegicus
ccctcttcgcttttctatggtaatt

SEQ ID NO: 249830 - DNA, 25 bp, Rattus norvegicus
ccctcttctgtgaagctttctataa

SEQ ID NO: 249831 - DNA, 25 bp, Rattus norvegicus
ccctcttctgtgtagctttctataa

SEQ ID NO: 249832 - DNA, 25 bp, Rattus norvegicus
ccctcttgattcatgggccaaggca

SEQ ID NO: 249833 - DNA, 25 bp, Rattus norvegicus
ccctcttgattcttgggccaaggca

SEQ ID NO: 249834 - DNA, 25 bp, Rattus norvegicus
ccctcttgggtcacttggatctatg

SEQ ID NO: 249835 - DNA, 25 bp, Rattus norvegicus
ccctcttgggtctcttggatctatg

SEQ ID NO: 249836 - DNA, 25 bp, Rattus norvegicus
ccctcttgggtgattgcattgtgga

SEQ ID NO: 249837 - DNA, 25 bp, Rattus norvegicus
ccctcttgggtgtttgcattgtgga

SEQ ID NO: 249838 - DNA, 25 bp, Rattus norvegicus
ccctcttgttctagtcattgttgta

SEQ ID NO: 249839 - DNA, 25 bp, Rattus norvegicus
ccctcttgttcttgtcattgttgta

SEQ ID NO: 249840 - DNA, 25 bp, Rattus norvegicus
ccctctttagcccatatttgcaagg

SEQ ID NO: 249841 - DNA, 25 bp, Rattus norvegicus
ccctctttagccgatatttgcaagg

SEQ ID NO: 249842 - DNA, 25 bp, Rattus norvegicus
ccctctttgaagaccatgctactaa

SEQ ID NO: 249843 - DNA, 25 bp, Rattus norvegicus
ccctctttgaagtccatgctactaa

SEQ ID NO: 249844 - DNA, 25 bp, Rattus norvegicus
ccctctttggtcctgtggtatagaa

SEQ ID NO: 249845 - DNA, 25 bp, Rattus norvegicus
ccctctttggtcgtgtggtatagaa

SEQ ID NO: 249846 - DNA, 25 bp, Rattus norvegicus
ccctcttttagtcttgctcattgga

SEQ ID NO: 249847 - DNA, 25 bp, Rattus norvegicus
ccctcttttagtgttgctcattgga

SEQ ID NO: 249848 - DNA, 25 bp, Rattus norvegicus
ccctcttttgttcggaagctcattt

SEQ ID NO: 249849 - DNA, 25 bp, Rattus norvegicus
ccctcttttgttgggaagctcattt

SEQ ID NO: 249850 - DNA, 25 bp, Rattus norvegicus
ccctgaaaagtcattttgtttacat

SEQ ID NO: 249851 - DNA, 25 bp, Rattus norvegicus
ccctgaaaagtctttttgtttacat

SEQ ID NO: 249852 - DNA, 25 bp, Rattus norvegicus
ccctgaaactgtcgagcccatggat

SEQ ID NO: 249853 - DNA, 25 bp, Rattus norvegicus
ccctgaaactgtggagcccatggat

SEQ ID NO: 249854 - DNA, 25 bp, Rattus norvegicus
ccctgaacctgactgtttccatgaa

SEQ ID NO: 249855 - DNA, 25 bp, Rattus norvegicus
ccctgaacctgagtgtttccatgaa

SEQ ID NO: 249856 - DNA, 25 bp, Rattus norvegicus
ccctgaactctgagtaactgtgcta

SEQ ID NO: 249857 - DNA, 25 bp, Rattus norvegicus
ccctgaactctgtgtaactgtgcta

SEQ ID NO: 249858 - DNA, 25 bp, Rattus norvegicus
ccctgaagatccaatgttccgggag

SEQ ID NO: 249859 - DNA, 25 bp, Rattus norvegicus
ccctgaagatcctatgttccgggag

SEQ ID NO: 249860 - DNA, 25 bp, Rattus norvegicus
ccctgaaggcctatatcttgctaca

SEQ ID NO: 249861 - DNA, 25 bp, Rattus norvegicus
ccctgaaggcctttatcttgctaca

SEQ ID NO: 249862 - DNA, 25 bp, Rattus norvegicus
ccctgaatttacatgggttttgtat

SEQ ID NO: 249863 - DNA, 25 bp, Rattus norvegicus
ccctgaatttacttgggttttgtat

SEQ ID NO: 249864 - DNA, 25 bp, Rattus norvegicus
ccctgacatcagcaagacattctcg

SEQ ID NO: 249865 - DNA, 25 bp, Rattus norvegicus
ccctgacatcaggaagacattctcg

SEQ ID NO: 249866 - DNA, 25 bp, Rattus norvegicus
ccctgacatgagacggaatggtatt

SEQ ID NO: 249867 - DNA, 25 bp, Rattus norvegicus
ccctgacatgagtcggaatggtatt

SEQ ID NO: 249868 - DNA, 25 bp, Rattus norvegicus
ccctgacctaggcacgcggatcgtg

SEQ ID NO: 249869 - DNA, 25 bp, Rattus norvegicus
ccctgacctagggacgcggatcgtg

SEQ ID NO: 249870 - DNA, 25 bp, Rattus norvegicus
ccctgacctgtccttggataacaga

SEQ ID NO: 249871 - DNA, 25 bp, Rattus norvegicus
ccctgacctgtcgttggataacaga

SEQ ID NO: 249872 - DNA, 25 bp, Rattus norvegicus
ccctgaccttggagcttgtgaacga

SEQ ID NO: 249873 - DNA, 25 bp, Rattus norvegicus
ccctgaccttggtgcttgtgaacga

SEQ ID NO: 249874 - DNA, 25 bp, Rattus norvegicus
ccctgactcggaaagttccattttg

SEQ ID NO: 249875 - DNA, 25 bp, Rattus norvegicus
ccctgactcggatagttccattttg

SEQ ID NO: 249876 - DNA, 25 bp, Rattus norvegicus
ccctgactctcaagtggccatttga

SEQ ID NO: 249877 - DNA, 25 bp, Rattus norvegicus
ccctgactctcatgtggccatttga

SEQ ID NO: 249878 - DNA, 25 bp, Rattus norvegicus
ccctgacttctgatgacagactgtg

SEQ ID NO: 249879 - DNA, 25 bp, Rattus norvegicus
ccctgacttctgttgacagactgtg

SEQ ID NO: 249880 - DNA, 25 bp, Rattus norvegicus
ccctgactttcccagtgggtgagat

SEQ ID NO: 249881 - DNA, 25 bp, Rattus norvegicus
ccctgactttccgagtgggtgagat

SEQ ID NO: 249882 - DNA, 25 bp, Rattus norvegicus
ccctgactttctccggttatgacaa

SEQ ID NO: 249883 - DNA, 25 bp, Rattus norvegicus
ccctgactttctgcggttatgacaa

SEQ ID NO: 249884 - DNA, 25 bp, Rattus norvegicus
ccctgagagctcatttgttttcatg

SEQ ID NO: 249885 - DNA, 25 bp, Rattus norvegicus
ccctgagagctcttttgttttcatg

SEQ ID NO: 249886 - DNA, 25 bp, Rattus norvegicus
ccctgagaggagactctgcgtggtt

SEQ ID NO: 249887 - DNA, 25 bp, Rattus norvegicus
ccctgagaggagtctctgcgtggtt

SEQ ID NO: 249888 - DNA, 25 bp, Rattus norvegicus
ccctgagcatctatgggagcttgtt

SEQ ID NO: 249889 - DNA, 25 bp, Rattus norvegicus
ccctgagcatctttgggagcttgtt

SEQ ID NO: 249890 - DNA, 25 bp, Rattus norvegicus
ccctgagcatgtctgcctgcagtgg

SEQ ID NO: 249891 - DNA, 25 bp, Rattus norvegicus
ccctgagcatgtgtgcctgcagtgg

SEQ ID NO: 249892 - DNA, 25 bp, Rattus norvegicus
ccctgagcgcttacatgaacacgaa

SEQ ID NO: 249893 - DNA, 25 bp, Rattus norvegicus
ccctgagcgctttcatgaacacgaa

SEQ ID NO: 249894 - DNA, 25 bp, Rattus norvegicus
ccctgagctgcccttaggaacatag

SEQ ID NO: 249895 - DNA, 25 bp, Rattus norvegicus
ccctgagctgccgttaggaacatag

SEQ ID NO: 249896 - DNA, 25 bp, Rattus norvegicus
ccctgagctttgacctgaaggagaa

SEQ ID NO: 249897 - DNA, 25 bp, Rattus norvegicus
ccctgagctttgtcctgaaggagaa

SEQ ID NO: 249898 - DNA, 25 bp, Rattus norvegicus
ccctgaggagcaccctgtgctgctc

SEQ ID NO: 249899 - DNA, 25 bp, Rattus norvegicus
ccctgaggagcagcctgtgctgctc

SEQ ID NO: 249900 - DNA, 25 bp, Rattus norvegicus
ccctgaggctggagtctacattatt

SEQ ID NO: 249901 - DNA, 25 bp, Rattus norvegicus
ccctgaggctggtgtctacattatt

SEQ ID NO: 249902 - DNA, 25 bp, Rattus norvegicus
ccctgagggagccacctgtgatgaa

SEQ ID NO: 249903 - DNA, 25 bp, Rattus norvegicus
ccctgagggagcgacctgtgatgaa

SEQ ID NO: 249904 - DNA, 25 bp, Rattus norvegicus
ccctgaggtcccataaaggctcaat

SEQ ID NO: 249905 - DNA, 25 bp, Rattus norvegicus
ccctgaggtcccttaaaggctcaat

SEQ ID NO: 249906 - DNA, 25 bp, Rattus norvegicus
ccctgagtagtgattttgcctgtgt

SEQ ID NO: 249907 - DNA, 25 bp, Rattus norvegicus
ccctgagtagtgtttttgcctgtgt

SEQ ID NO: 249908 - DNA, 25 bp, Rattus norvegicus
ccctgagtggccatctctgctaaag

SEQ ID NO: 249909 - DNA, 25 bp, Rattus norvegicus
ccctgagtggccttctctgctaaag

SEQ ID NO: 249910 - DNA, 25 bp, Rattus norvegicus
ccctgagtggttcttgagtctgttt

SEQ ID NO: 249911 - DNA, 25 bp, Rattus norvegicus
ccctgagtggttgttgagtctgttt

SEQ ID NO: 249912 - DNA, 25 bp, Rattus norvegicus
ccctgatattttcggcacaagtagt

SEQ ID NO: 249913 - DNA, 25 bp, Rattus norvegicus
ccctgatattttgggcacaagtagt

SEQ ID NO: 249914 - DNA, 25 bp, Rattus norvegicus
ccctgatctgggaaatgctggcatt

SEQ ID NO: 249915 - DNA, 25 bp, Rattus norvegicus
ccctgatctgggtaatgctggcatt

SEQ ID NO: 249916 - DNA, 25 bp, Rattus norvegicus
ccctgatgagccatcagaagcactt

SEQ ID NO: 249917 - DNA, 25 bp, Rattus norvegicus
ccctgatgagccttcagaagcactt

SEQ ID NO: 249918 - DNA, 25 bp, Rattus norvegicus
ccctgatgaggactgctatggagat

SEQ ID NO: 249919 - DNA, 25 bp, Rattus norvegicus
ccctgatgaggagtgctatggagat

SEQ ID NO: 249920 - DNA, 25 bp, Rattus norvegicus
ccctgatggtgtcccaatggtgccc

SEQ ID NO: 249921 - DNA, 25 bp, Rattus norvegicus
ccctgatggtgtgccaatggtgccc

SEQ ID NO: 249922 - DNA, 25 bp, Rattus norvegicus
ccctgattagagatagtttacaccc

SEQ ID NO: 249923 - DNA, 25 bp, Rattus norvegicus
ccctgattagagttagtttacaccc

SEQ ID NO: 249924 - DNA, 25 bp, Rattus norvegicus
ccctgatttctaagttcccttgtaa

SEQ ID NO: 249925 - DNA, 25 bp, Rattus norvegicus
ccctgatttctatgttcccttgtaa

SEQ ID NO: 249926 - DNA, 25 bp, Rattus norvegicus
ccctgcaaacagaccctttgtggga

SEQ ID NO: 249927 - DNA, 25 bp, Rattus norvegicus
ccctgcaaacagtccctttgtggga

SEQ ID NO: 249928 - DNA, 25 bp, Rattus norvegicus
ccctgcacattcagtgggtggtgtt

SEQ ID NO: 249929 - DNA, 25 bp, Rattus norvegicus
ccctgcacattctgtgggtggtgtt

SEQ ID NO: 249930 - DNA, 25 bp, Rattus norvegicus
ccctgcactggacctactggttgga

SEQ ID NO: 249931 - DNA, 25 bp, Rattus norvegicus
ccctgcactggagctactggttgga

SEQ ID NO: 249932 - DNA, 25 bp, Rattus norvegicus
ccctgcagatccacttgtgctattt

SEQ ID NO: 249933 - DNA, 25 bp, Rattus norvegicus
ccctgcagatcctcttgtgctattt

SEQ ID NO: 249934 - DNA, 25 bp, Rattus norvegicus
ccctgcaggatgagagaagtgtgcc

SEQ ID NO: 249935 - DNA, 25 bp, Rattus norvegicus
ccctgcaggatgtgagaagtgtgcc

SEQ ID NO: 249936 - DNA, 25 bp, Rattus norvegicus
ccctgcaggcacagagaccgagagg

SEQ ID NO: 249937 - DNA, 25 bp, Rattus norvegicus
ccctgcaggcactgagaccgagagg

SEQ ID NO: 249938 - DNA, 25 bp, Rattus norvegicus
ccctgcaggttcatctggtcatctg

SEQ ID NO: 249939 - DNA, 25 bp, Rattus norvegicus
ccctgcaggttcttctggtcatctg

SEQ ID NO: 249940 - DNA, 25 bp, Rattus norvegicus
ccctgcatagggaggtgtgtaactg

SEQ ID NO: 249941 - DNA, 25 bp, Rattus norvegicus
ccctgcatagggtggtgtgtaactg

SEQ ID NO: 249942 - DNA, 25 bp, Rattus norvegicus
ccctgcatgaaaaccccactaaagt

SEQ ID NO: 249943 - DNA, 25 bp, Rattus norvegicus
ccctgcatgaaatccccactaaagt

SEQ ID NO: 249944 - DNA, 25 bp, Rattus norvegicus
ccctgcattctgaggctactacaga

SEQ ID NO: 249945 - DNA, 25 bp, Rattus norvegicus
ccctgcattctgtggctactacaga

SEQ ID NO: 249946 - DNA, 25 bp, Rattus norvegicus
ccctgcattgtcaacttcatgggaa

SEQ ID NO: 249947 - DNA, 25 bp, Rattus norvegicus
ccctgcattgtctacttcatgggaa

SEQ ID NO: 249948 - DNA, 25 bp, Rattus norvegicus
ccctgccaactcctttcaagataaa

SEQ ID NO: 249949 - DNA, 25 bp, Rattus norvegicus
ccctgccaactcgtttcaagataaa

SEQ ID NO: 249950 - DNA, 25 bp, Rattus norvegicus
ccctgccaaggccagagcggtaaag

SEQ ID NO: 249951 - DNA, 25 bp, Rattus norvegicus
ccctgccaaggcgagagcggtaaag

SEQ ID NO: 249952 - DNA, 25 bp, Rattus norvegicus
ccctgccagagcatgccggataaaa

SEQ ID NO: 249953 - DNA, 25 bp, Rattus norvegicus
ccctgccagagcttgccggataaaa

SEQ ID NO: 249954 - DNA, 25 bp, Rattus norvegicus
ccctgccattatcggcctgggctag

SEQ ID NO: 249955 - DNA, 25 bp, Rattus norvegicus
ccctgccattatgggcctgggctag

SEQ ID NO: 249956 - DNA, 25 bp, Rattus norvegicus
ccctgcccagacagcaaaatgtcat

SEQ ID NO: 249957 - DNA, 25 bp, Rattus norvegicus
ccctgcccagactgcaaaatgtcat

SEQ ID NO: 249958 - DNA, 25 bp, Rattus norvegicus
ccctgcccagtgatgattgtacttt

SEQ ID NO: 249959 - DNA, 25 bp, Rattus norvegicus
ccctgcccagtgttgattgtacttt

SEQ ID NO: 249960 - DNA, 25 bp, Rattus norvegicus
ccctgcccatctatttgtaaaactg

SEQ ID NO: 249961 - DNA, 25 bp, Rattus norvegicus
ccctgcccatctttttgtaaaactg

SEQ ID NO: 249962 - DNA, 25 bp, Rattus norvegicus
ccctgcccctggaaaagccatagag

SEQ ID NO: 249963 - DNA, 25 bp, Rattus norvegicus
ccctgcccctggtaaagccatagag

SEQ ID NO: 249964 - DNA, 25 bp, Rattus norvegicus
ccctgcccgtttctgttctgaagaa

SEQ ID NO: 249965 - DNA, 25 bp, Rattus norvegicus
ccctgcccgtttgtgttctgaagaa

SEQ ID NO: 249966 - DNA, 25 bp, Rattus norvegicus
ccctgccctttgctcagtaaaggtt

SEQ ID NO: 249967 - DNA, 25 bp, Rattus norvegicus
ccctgccctttggtcagtaaaggtt

SEQ ID NO: 249968 - DNA, 25 bp, Rattus norvegicus
ccctgcctcaacactcaaatggatg

SEQ ID NO: 249969 - DNA, 25 bp, Rattus norvegicus
ccctgcctcaactctcaaatggatg

SEQ ID NO: 249970 - DNA, 25 bp, Rattus norvegicus
ccctgcctcacccaataatgaagat

SEQ ID NO: 249971 - DNA, 25 bp, Rattus norvegicus
ccctgcctcaccgaataatgaagat

SEQ ID NO: 249972 - DNA, 25 bp, Rattus norvegicus
ccctgcctgaccacatgtttaagat

SEQ ID NO: 249973 - DNA, 25 bp, Rattus norvegicus
ccctgcctgacctcatgtttaagat

SEQ ID NO: 249974 - DNA, 25 bp, Rattus norvegicus
ccctgcctggctaagagatgtctat

SEQ ID NO: 249975 - DNA, 25 bp, Rattus norvegicus
ccctgcctggcttagagatgtctat

SEQ ID NO: 249976 - DNA, 25 bp, Rattus norvegicus
ccctgcctgtcaagtttttatacca

SEQ ID NO: 249977 - DNA, 25 bp, Rattus norvegicus
ccctgcctgtcatgtttttatacca

SEQ ID NO: 249978 - DNA, 25 bp, Rattus norvegicus
ccctgcctgtttcgactttgtaatt

SEQ ID NO: 249979 - DNA, 25 bp, Rattus norvegicus
ccctgcctgtttggactttgtaatt

SEQ ID NO: 249980 - DNA, 25 bp, Rattus norvegicus
ccctgccttcaaacagttctttgag

SEQ ID NO: 249981 - DNA, 25 bp, Rattus norvegicus
ccctgccttcaatcagttctttgag

SEQ ID NO: 249982 - DNA, 25 bp, Rattus norvegicus
ccctgcgcatttatctgtagacttt

SEQ ID NO: 249983 - DNA, 25 bp, Rattus norvegicus
ccctgcgcatttttctgtagacttt

SEQ ID NO: 249984 - DNA, 25 bp, Rattus norvegicus
ccctgcgtcttaccccagtttttat

SEQ ID NO: 249985 - DNA, 25 bp, Rattus norvegicus
ccctgcgtcttagcccagtttttat

SEQ ID NO: 249986 - DNA, 25 bp, Rattus norvegicus
ccctgctacaatcgccgaattgctg

SEQ ID NO: 249987 - DNA, 25 bp, Rattus norvegicus
ccctgctacaatggccgaattgctg

SEQ ID NO: 249988 - DNA, 25 bp, Rattus norvegicus
ccctgctaggtgaattcactctgtt

SEQ ID NO: 249989 - DNA, 25 bp, Rattus norvegicus
ccctgctaggtgtattcactctgtt

SEQ ID NO: 249990 - DNA, 25 bp, Rattus norvegicus
ccctgctcacaaagtatgtcctgta

SEQ ID NO: 249991 - DNA, 25 bp, Rattus norvegicus
ccctgctcacaatgtatgtcctgta

SEQ ID NO: 249992 - DNA, 25 bp, Rattus norvegicus
ccctgctcagggaccatgatgagtt

SEQ ID NO: 249993 - DNA, 25 bp, Rattus norvegicus
ccctgctcagggtccatgatgagtt

SEQ ID NO: 249994 - DNA, 25 bp, Rattus norvegicus
ccctgctcatttctccttgataaga

SEQ ID NO: 249995 - DNA, 25 bp, Rattus norvegicus
ccctgctcatttgtccttgataaga

SEQ ID NO: 249996 - DNA, 25 bp, Rattus norvegicus
ccctgctcctgacactttgaataaa

SEQ ID NO: 249997 - DNA, 25 bp, Rattus norvegicus
ccctgctcctgagactttgaataaa

SEQ ID NO: 249998 - DNA, 25 bp, Rattus norvegicus
ccctgctctacaagctggagaagtg

SEQ ID NO: 249999 - DNA, 25 bp, Rattus norvegicus
ccctgctctacatgctggagaagtg

SEQ ID NO: 250000 - DNA, 25 bp, Rattus norvegicus
ccctgctgacagagcatttgtattt

SEQ ID NO: 250001 - DNA, 25 bp, Rattus norvegicus
ccctgctgacagagctcgggaggta

SEQ ID NO: 250002 - DNA, 25 bp, Rattus norvegicus
ccctgctgacagtgcatttgtattt

SEQ ID NO: 250003 - DNA, 25 bp, Rattus norvegicus
ccctgctgacagtgctcgggaggta

SEQ ID NO: 250004 - DNA, 25 bp, Rattus norvegicus
ccctgctgagataactcttcctaat

SEQ ID NO: 250005 - DNA, 25 bp, Rattus norvegicus
ccctgctgagattactcttcctaat

SEQ ID NO: 250006 - DNA, 25 bp, Rattus norvegicus
ccctgctgcaaaagtttttacaaag

SEQ ID NO: 250007 - DNA, 25 bp, Rattus norvegicus
ccctgctgcaaatgtttttacaaag

SEQ ID NO: 250008 - DNA, 25 bp, Rattus norvegicus
ccctgctgccagatgtgtatgattg

SEQ ID NO: 250009 - DNA, 25 bp, Rattus norvegicus
ccctgctgccagttgtgtatgattg

SEQ ID NO: 250010 - DNA, 25 bp, Rattus norvegicus
ccctgctgcgggaaactgtacatgc

SEQ ID NO: 250011 - DNA, 25 bp, Rattus norvegicus
ccctgctgcgggtaactgtacatgc

SEQ ID NO: 250012 - DNA, 25 bp, Rattus norvegicus
ccctgctgctcaatcattaagtgac

SEQ ID NO: 250013 - DNA, 25 bp, Rattus norvegicus
ccctgctgctcattcattaagtgac

SEQ ID NO: 250014 - DNA, 25 bp, Rattus norvegicus
ccctgctgtacaatccgaagttggt

SEQ ID NO: 250015 - DNA, 25 bp, Rattus norvegicus
ccctgctgtacattccgaagttggt

SEQ ID NO: 250016 - DNA, 25 bp, Rattus norvegicus
ccctgctgtcatatgtatggctgta

SEQ ID NO: 250017 - DNA, 25 bp, Rattus norvegicus
ccctgctgtcatttgtatggctgta

SEQ ID NO: 250018 - DNA, 25 bp, Rattus norvegicus
ccctgctgtctgcagatttcagtag

SEQ ID NO: 250019 - DNA, 25 bp, Rattus norvegicus
ccctgctgtctggagatttcagtag

SEQ ID NO: 250020 - DNA, 25 bp, Rattus norvegicus
ccctgctgtgccactttaaattatg

SEQ ID NO: 250021 - DNA, 25 bp, Rattus norvegicus
ccctgctgtgcctctttaaattatg

SEQ ID NO: 250022 - DNA, 25 bp, Rattus norvegicus
ccctgctgtgtaaatagtctcccca

SEQ ID NO: 250023 - DNA, 25 bp, Rattus norvegicus
ccctgctgtgtatatagtctcccca

SEQ ID NO: 250024 - DNA, 25 bp, Rattus norvegicus
ccctgctgttgaagtggccgtgaaa

SEQ ID NO: 250025 - DNA, 25 bp, Rattus norvegicus
ccctgctgttgatgtggccgtgaaa

SEQ ID NO: 250026 - DNA, 25 bp, Rattus norvegicus
ccctgctgtttcatatgccatggaa

SEQ ID NO: 250027 - DNA, 25 bp, Rattus norvegicus
ccctgctgtttcctgtagtacttaa

SEQ ID NO: 250028 - DNA, 25 bp, Rattus norvegicus
ccctgctgtttcgtgtagtacttaa

SEQ ID NO: 250029 - DNA, 25 bp, Rattus norvegicus
ccctgctgtttcttatgccatggaa

SEQ ID NO: 250030 - DNA, 25 bp, Rattus norvegicus
ccctgcttgggtcgctctttagaga

SEQ ID NO: 250031 - DNA, 25 bp, Rattus norvegicus
ccctgcttgggtggctctttagaga

SEQ ID NO: 250032 - DNA, 25 bp, Rattus norvegicus
ccctgcttgtctatttaactgccaa

SEQ ID NO: 250033 - DNA, 25 bp, Rattus norvegicus
ccctgcttgtctttttaactgccaa

SEQ ID NO: 250034 - DNA, 25 bp, Rattus norvegicus
ccctgctttcctctagacagataga

SEQ ID NO: 250035 - DNA, 25 bp, Rattus norvegicus
ccctgctttcctgtagacagataga

SEQ ID NO: 250036 - DNA, 25 bp, Rattus norvegicus
ccctgctttcttcttggtggaaaga

SEQ ID NO: 250037 - DNA, 25 bp, Rattus norvegicus
ccctgctttcttgttggtggaaaga

SEQ ID NO: 250038 - DNA, 25 bp, Rattus norvegicus
ccctggacacttcacctcataaaaa

SEQ ID NO: 250039 - DNA, 25 bp, Rattus norvegicus
ccctggacacttgacctcataaaaa

SEQ ID NO: 250040 - DNA, 25 bp, Rattus norvegicus
ccctggagaagtatggtctgggtct

SEQ ID NO: 250041 - DNA, 25 bp, Rattus norvegicus
ccctggagaagtttggtctgggtct

SEQ ID NO: 250042 - DNA, 25 bp, Rattus norvegicus
ccctggagacatcatgctgtgcact

SEQ ID NO: 250043 - DNA, 25 bp, Rattus norvegicus
ccctggagacatgatgctgtgcact

SEQ ID NO: 250044 - DNA, 25 bp, Rattus norvegicus
ccctggagcccaacttaagagacaa

SEQ ID NO: 250045 - DNA, 25 bp, Rattus norvegicus
ccctggagcccatcttaagagacaa

SEQ ID NO: 250046 - DNA, 25 bp, Rattus norvegicus
ccctggagctgcaacgggttaggaa

SEQ ID NO: 250047 - DNA, 25 bp, Rattus norvegicus
ccctggagctgctacgggttaggaa

SEQ ID NO: 250048 - DNA, 25 bp, Rattus norvegicus
ccctggaggaggaaaggccatccct

SEQ ID NO: 250049 - DNA, 25 bp, Rattus norvegicus
ccctggaggaggtaaggccatccct

SEQ ID NO: 250050 - DNA, 25 bp, Rattus norvegicus
ccctggaggtgtccctggtaagaat

SEQ ID NO: 250051 - DNA, 25 bp, Rattus norvegicus
ccctggaggtgtgcctggtaagaat

SEQ ID NO: 250052 - DNA, 25 bp, Rattus norvegicus
ccctggagttgaccttagtatttgc

SEQ ID NO: 250053 - DNA, 25 bp, Rattus norvegicus
ccctggagttgagcttagtatttgc

SEQ ID NO: 250054 - DNA, 25 bp, Rattus norvegicus
ccctggatcttgctgggctgccact

SEQ ID NO: 250055 - DNA, 25 bp, Rattus norvegicus
ccctggatcttggtgggctgccact

SEQ ID NO: 250056 - DNA, 25 bp, Rattus norvegicus
ccctggatgactcatgtggtgccgt

SEQ ID NO: 250057 - DNA, 25 bp, Rattus norvegicus
ccctggatgactgatgtggtgccgt

SEQ ID NO: 250058 - DNA, 25 bp, Rattus norvegicus
ccctggattctactaccttcagtta

SEQ ID NO: 250059 - DNA, 25 bp, Rattus norvegicus
ccctggattctagtaccttcagtta

SEQ ID NO: 250060 - DNA, 25 bp, Rattus norvegicus
ccctggcaagcccatgtgtgttgaa

SEQ ID NO: 250061 - DNA, 25 bp, Rattus norvegicus
ccctggcaagccgatgtgtgttgaa

SEQ ID NO: 250062 - DNA, 25 bp, Rattus norvegicus
ccctggcaagcgagactctgaagag

SEQ ID NO: 250063 - DNA, 25 bp, Rattus norvegicus
ccctggcaagcgcttctgagttata

SEQ ID NO: 250064 - DNA, 25 bp, Rattus norvegicus
ccctggcaagcggttctgagttata

SEQ ID NO: 250065 - DNA, 25 bp, Rattus norvegicus
ccctggcaagcgtgactctgaagag

SEQ ID NO: 250066 - DNA, 25 bp, Rattus norvegicus
ccctggcacccgaaagattgagtta

SEQ ID NO: 250067 - DNA, 25 bp, Rattus norvegicus
ccctggcacccgtaagattgagtta

SEQ ID NO: 250068 - DNA, 25 bp, Rattus norvegicus
ccctggcacgtgattggagttcatg

SEQ ID NO: 250069 - DNA, 25 bp, Rattus norvegicus
ccctggcacgtgtttggagttcatg

SEQ ID NO: 250070 - DNA, 25 bp, Rattus norvegicus
ccctggcactggattgtttgtatca

SEQ ID NO: 250071 - DNA, 25 bp, Rattus norvegicus
ccctggcactggtttgtttgtatca

SEQ ID NO: 250072 - DNA, 25 bp, Rattus norvegicus
ccctggcacttacctgcagatatga

SEQ ID NO: 250073 - DNA, 25 bp, Rattus norvegicus
ccctggcacttagctgcagatatga

SEQ ID NO: 250074 - DNA, 25 bp, Rattus norvegicus
ccctggcaggttcgcttcagagaaa

SEQ ID NO: 250075 - DNA, 25 bp, Rattus norvegicus
ccctggcaggttggcttcagagaaa

SEQ ID NO: 250076 - DNA, 25 bp, Rattus norvegicus
ccctggccaaggacatccatgacaa

SEQ ID NO: 250077 - DNA, 25 bp, Rattus norvegicus
ccctggccaaggtcatccatgacaa

SEQ ID NO: 250078 - DNA, 25 bp, Rattus norvegicus
ccctggccagggaatcgatgtctag

SEQ ID NO: 250079 - DNA, 25 bp, Rattus norvegicus
ccctggccagggtatcgatgtctag

SEQ ID NO: 250080 - DNA, 25 bp, Rattus norvegicus
ccctggccatgtcattgtgtttggt

SEQ ID NO: 250081 - DNA, 25 bp, Rattus norvegicus
ccctggccatgtgattgtgtttggt

SEQ ID NO: 250082 - DNA, 25 bp, Rattus norvegicus
ccctggcccatcatcaaaagtgcag

SEQ ID NO: 250083 - DNA, 25 bp, Rattus norvegicus
ccctggcccatcttcaaaagtgcag

SEQ ID NO: 250084 - DNA, 25 bp, Rattus norvegicus
ccctggccctctagagagttgtaaa

SEQ ID NO: 250085 - DNA, 25 bp, Rattus norvegicus
ccctggccctcttgagagttgtaaa

SEQ ID NO: 250086 - DNA, 25 bp, Rattus norvegicus
ccctggcccttcaaatgtagcaaat

SEQ ID NO: 250087 - DNA, 25 bp, Rattus norvegicus
ccctggcccttctaatgtagcaaat

SEQ ID NO: 250088 - DNA, 25 bp, Rattus norvegicus
ccctggcctgtgaagaagttcctca

SEQ ID NO: 250089 - DNA, 25 bp, Rattus norvegicus
ccctggcctgtgtagaagttcctca

SEQ ID NO: 250090 - DNA, 25 bp, Rattus norvegicus
ccctggccttttatgcaagactgga

SEQ ID NO: 250091 - DNA, 25 bp, Rattus norvegicus
ccctggccttttttgcaagactgga

SEQ ID NO: 250092 - DNA, 25 bp, Rattus norvegicus
ccctggctagccatggtcaagaaca

SEQ ID NO: 250093 - DNA, 25 bp, Rattus norvegicus
ccctggctagccttggtcaagaaca

SEQ ID NO: 250094 - DNA, 25 bp, Rattus norvegicus
ccctggctctgaacggtggtgatga

SEQ ID NO: 250095 - DNA, 25 bp, Rattus norvegicus
ccctggctctgatcggtggtgatga

SEQ ID NO: 250096 - DNA, 25 bp, Rattus norvegicus
ccctggcttggacttgcctggaaga

SEQ ID NO: 250097 - DNA, 25 bp, Rattus norvegicus
ccctggcttggagttgcctggaaga

SEQ ID NO: 250098 - DNA, 25 bp, Rattus norvegicus
ccctggcttgggaccagggagacct

SEQ ID NO: 250099 - DNA, 25 bp, Rattus norvegicus
ccctggcttgggtccagggagacct

SEQ ID NO: 250100 - DNA, 25 bp, Rattus norvegicus
ccctggcttgtcctcaaattttgta

SEQ ID NO: 250101 - DNA, 25 bp, Rattus norvegicus
ccctggcttgtcgtcaaattttgta

SEQ ID NO: 250102 - DNA, 25 bp, Rattus norvegicus
ccctggctttacaactcatttgatg

SEQ ID NO: 250103 - DNA, 25 bp, Rattus norvegicus
ccctggctttactactcatttgatg

SEQ ID NO: 250104 - DNA, 25 bp, Rattus norvegicus
ccctgggaagctcctattttctgaa

SEQ ID NO: 250105 - DNA, 25 bp, Rattus norvegicus
ccctgggaagctgctattttctgaa

SEQ ID NO: 250106 - DNA, 25 bp, Rattus norvegicus
ccctgggaatgcactgactgtagcc

SEQ ID NO: 250107 - DNA, 25 bp, Rattus norvegicus
ccctgggaatgctctgactgtagcc

SEQ ID NO: 250108 - DNA, 25 bp, Rattus norvegicus
ccctgggacactcctctgatgacaa

SEQ ID NO: 250109 - DNA, 25 bp, Rattus norvegicus
ccctgggacactgctctgatgacaa

SEQ ID NO: 250110 - DNA, 25 bp, Rattus norvegicus
ccctgggactcacttctctattgaa

SEQ ID NO: 250111 - DNA, 25 bp, Rattus norvegicus
ccctgggactcagttctctattgaa

SEQ ID NO: 250112 - DNA, 25 bp, Rattus norvegicus
ccctgggactctaagcagccaaatc

SEQ ID NO: 250113 - DNA, 25 bp, Rattus norvegicus
ccctgggactcttagcagccaaatc

SEQ ID NO: 250114 - DNA, 25 bp, Rattus norvegicus
ccctgggagctgctatttttccaaa

SEQ ID NO: 250115 - DNA, 25 bp, Rattus norvegicus
ccctgggagctggtatttttccaaa

SEQ ID NO: 250116 - DNA, 25 bp, Rattus norvegicus
ccctgggagttgagctggtctttga

SEQ ID NO: 250117 - DNA, 25 bp, Rattus norvegicus
ccctgggagttgtgctggtctttga

SEQ ID NO: 250118 - DNA, 25 bp, Rattus norvegicus
ccctgggagtttaacacattgtctt

SEQ ID NO: 250119 - DNA, 25 bp, Rattus norvegicus
ccctgggagttttacacattgtctt

SEQ ID NO: 250120 - DNA, 25 bp, Rattus norvegicus
ccctgggatgttcctctacataaga

SEQ ID NO: 250121 - DNA, 25 bp, Rattus norvegicus
ccctgggatgttgctctacataaga

SEQ ID NO: 250122 - DNA, 25 bp, Rattus norvegicus
ccctgggattgcagatcgtatgcaa

SEQ ID NO: 250123 - DNA, 25 bp, Rattus norvegicus
ccctgggattgctgatcgtatgcaa

SEQ ID NO: 250124 - DNA, 25 bp, Rattus norvegicus
ccctgggcctagaattcctgttgag

SEQ ID NO: 250125 - DNA, 25 bp, Rattus norvegicus
ccctgggcctagtattcctgttgag

SEQ ID NO: 250126 - DNA, 25 bp, Rattus norvegicus
ccctgggctgtcctagaagtcaatt

SEQ ID NO: 250127 - DNA, 25 bp, Rattus norvegicus
ccctgggctgtcgtagaagtcaatt

SEQ ID NO: 250128 - DNA, 25 bp, Rattus norvegicus
ccctgggctgttcatatactagcta

SEQ ID NO: 250129 - DNA, 25 bp, Rattus norvegicus
ccctgggctgttgatatactagcta

SEQ ID NO: 250130 - DNA, 25 bp, Rattus norvegicus
ccctgggcttctaggatcatatgga

SEQ ID NO: 250131 - DNA, 25 bp, Rattus norvegicus
ccctgggcttcttggatcatatgga

SEQ ID NO: 250132 - DNA, 25 bp, Rattus norvegicus
ccctgggtcaggaaacactctcaaa

SEQ ID NO: 250133 - DNA, 25 bp, Rattus norvegicus
ccctgggtcaggataactgctcgat

SEQ ID NO: 250134 - DNA, 25 bp, Rattus norvegicus
ccctgggtcaggcaaatgatcccaa

SEQ ID NO: 250135 - DNA, 25 bp, Rattus norvegicus
ccctgggtcagggaaatgatcccaa

SEQ ID NO: 250136 - DNA, 25 bp, Rattus norvegicus
ccctgggtcaggtaacactctcaaa

SEQ ID NO: 250137 - DNA, 25 bp, Rattus norvegicus
ccctgggtcaggttaactgctcgat

SEQ ID NO: 250138 - DNA, 25 bp, Rattus norvegicus
ccctgggtgcagcacggaggctggt

SEQ ID NO: 250139 - DNA, 25 bp, Rattus norvegicus
ccctgggtgcaggacggaggctggt

SEQ ID NO: 250140 - DNA, 25 bp, Rattus norvegicus
ccctgggtggccaagggcaagcaat

SEQ ID NO: 250141 - DNA, 25 bp, Rattus norvegicus
ccctgggtggcctagggcaagcaat

SEQ ID NO: 250142 - DNA, 25 bp, Rattus norvegicus
ccctgggttcccaataggacaattg

SEQ ID NO: 250143 - DNA, 25 bp, Rattus norvegicus
ccctgggttccctataggacaattg

SEQ ID NO: 250144 - DNA, 25 bp, Rattus norvegicus
ccctgggttggtaagcatatgcttc

SEQ ID NO: 250145 - DNA, 25 bp, Rattus norvegicus
ccctgggttggttagcatatgcttc

SEQ ID NO: 250146 - DNA, 25 bp, Rattus norvegicus
ccctgggtttatctgctgctaagaa

SEQ ID NO: 250147 - DNA, 25 bp, Rattus norvegicus
ccctgggtttatgtgctgctaagaa

SEQ ID NO: 250148 - DNA, 25 bp, Rattus norvegicus
ccctggtagaatatttggagtcact

SEQ ID NO: 250149 - DNA, 25 bp, Rattus norvegicus
ccctggtagaatttttggagtcact

SEQ ID NO: 250150 - DNA, 25 bp, Rattus norvegicus
ccctggtataggaggtatcaatgca

SEQ ID NO: 250151 - DNA, 25 bp, Rattus norvegicus
ccctggtataggtggtatcaatgca

SEQ ID NO: 250152 - DNA, 25 bp, Rattus norvegicus
ccctggtcaactccgttaattctag

SEQ ID NO: 250153 - DNA, 25 bp, Rattus norvegicus
ccctggtcaactgcgttaattctag

SEQ ID NO: 250154 - DNA, 25 bp, Rattus norvegicus
ccctggtccttacagtttggaacag

SEQ ID NO: 250155 - DNA, 25 bp, Rattus norvegicus
ccctggtccttagagtttggaacag

SEQ ID NO: 250156 - DNA, 25 bp, Rattus norvegicus
ccctggtccttcacgggatgtatca

SEQ ID NO: 250157 - DNA, 25 bp, Rattus norvegicus
ccctggtccttctcgggatgtatca

SEQ ID NO: 250158 - DNA, 25 bp, Rattus norvegicus
ccctggtcttctccgagagcaacaa

SEQ ID NO: 250159 - DNA, 25 bp, Rattus norvegicus
ccctggtcttctgcgagagcaacaa

SEQ ID NO: 250160 - DNA, 25 bp, Rattus norvegicus
ccctggtcttgtcgaatttaacaga

SEQ ID NO: 250161 - DNA, 25 bp, Rattus norvegicus
ccctggtcttgtggaatttaacaga

SEQ ID NO: 250162 - DNA, 25 bp, Rattus norvegicus
ccctggtgctttcttgtctgttgta

SEQ ID NO: 250163 - DNA, 25 bp, Rattus norvegicus
ccctggtgctttgttgtctgttgta

SEQ ID NO: 250164 - DNA, 25 bp, Rattus norvegicus
ccctggtggctgctcctgatgaaaa

SEQ ID NO: 250165 - DNA, 25 bp, Rattus norvegicus
ccctggtggctggtcctgatgaaaa

SEQ ID NO: 250166 - DNA, 25 bp, Rattus norvegicus
ccctggtgtaatccctaggcttcaa

SEQ ID NO: 250167 - DNA, 25 bp, Rattus norvegicus
ccctggtgtaatgcctaggcttcaa

SEQ ID NO: 250168 - DNA, 25 bp, Rattus norvegicus
ccctggttaggtctacgtgcactgt

SEQ ID NO: 250169 - DNA, 25 bp, Rattus norvegicus
ccctggttaggtgtacgtgcactgt

SEQ ID NO: 250170 - DNA, 25 bp, Rattus norvegicus
ccctggttatctatcccgtgaagta

SEQ ID NO: 250171 - DNA, 25 bp, Rattus norvegicus
ccctggttatctttcccgtgaagta

SEQ ID NO: 250172 - DNA, 25 bp, Rattus norvegicus
ccctggttccttcttataatgcata

SEQ ID NO: 250173 - DNA, 25 bp, Rattus norvegicus
ccctggttccttgttataatgcata

SEQ ID NO: 250174 - DNA, 25 bp, Rattus norvegicus
ccctggttgcttccaatagtatcac

SEQ ID NO: 250175 - DNA, 25 bp, Rattus norvegicus
ccctggttgcttgcaatagtatcac

SEQ ID NO: 250176 - DNA, 25 bp, Rattus norvegicus
ccctggtttttcatgtcatcatgta

SEQ ID NO: 250177 - DNA, 25 bp, Rattus norvegicus
ccctggtttttcttgtcatcatgta

SEQ ID NO: 250178 - DNA, 25 bp, Rattus norvegicus
ccctgtaatgcaagtactaccctga

SEQ ID NO: 250179 - DNA, 25 bp, Rattus norvegicus
ccctgtaatgcatgtactaccctga

SEQ ID NO: 250180 - DNA, 25 bp, Rattus norvegicus
ccctgtaatgctcttgtggtggata

SEQ ID NO: 250181 - DNA, 25 bp, Rattus norvegicus
ccctgtaatgctgttgtggtggata

SEQ ID NO: 250182 - DNA, 25 bp, Rattus norvegicus
ccctgtacaagaatccacgttctta

SEQ ID NO: 250183 - DNA, 25 bp, Rattus norvegicus
ccctgtacaagattccacgttctta

SEQ ID NO: 250184 - DNA, 25 bp, Rattus norvegicus
ccctgtagatggatgtgtgccacca

SEQ ID NO: 250185 - DNA, 25 bp, Rattus norvegicus
ccctgtagatggttgtgtgccacca

SEQ ID NO: 250186 - DNA, 25 bp, Rattus norvegicus
ccctgtaggctgatttcttttgtgt

SEQ ID NO: 250187 - DNA, 25 bp, Rattus norvegicus
ccctgtaggctgttttcttttgtgt

SEQ ID NO: 250188 - DNA, 25 bp, Rattus norvegicus
ccctgtcactcaccatttgaatcaa

SEQ ID NO: 250189 - DNA, 25 bp, Rattus norvegicus
ccctgtcactcagcatttgaatcaa

SEQ ID NO: 250190 - DNA, 25 bp, Rattus norvegicus
ccctgtcatgacaatttctgccata

SEQ ID NO: 250191 - DNA, 25 bp, Rattus norvegicus
ccctgtcatgactatttctgccata

SEQ ID NO: 250192 - DNA, 25 bp, Rattus norvegicus
ccctgtccagaaaaatgttagagtg

SEQ ID NO: 250193 - DNA, 25 bp, Rattus norvegicus
ccctgtccagaataatgttagagtg

SEQ ID NO: 250194 - DNA, 25 bp, Rattus norvegicus
ccctgtcccagcacattgaagaaga

SEQ ID NO: 250195 - DNA, 25 bp, Rattus norvegicus
ccctgtcccagctcattgaagaaga

SEQ ID NO: 250196 - DNA, 25 bp, Rattus norvegicus
ccctgtccctttagtgcatatttat

SEQ ID NO: 250197 - DNA, 25 bp, Rattus norvegicus
ccctgtcccttttgtgcatatttat

SEQ ID NO: 250198 - DNA, 25 bp, Rattus norvegicus
ccctgtcctcctatattgttaagaa

SEQ ID NO: 250199 - DNA, 25 bp, Rattus norvegicus
ccctgtcctcctttattgttaagaa

SEQ ID NO: 250200 - DNA, 25 bp, Rattus norvegicus
ccctgtcctgtgctgtacaagcaat

SEQ ID NO: 250201 - DNA, 25 bp, Rattus norvegicus
ccctgtcctgtggtgtacaagcaat

SEQ ID NO: 250202 - DNA, 25 bp, Rattus norvegicus
ccctgtccttggctttgtagatgat

SEQ ID NO: 250203 - DNA, 25 bp, Rattus norvegicus
ccctgtccttgggtttgtagatgat

SEQ ID NO: 250204 - DNA, 25 bp, Rattus norvegicus
ccctgtccttttacaggagcagtgg

SEQ ID NO: 250205 - DNA, 25 bp, Rattus norvegicus
ccctgtcctttttcaggagcagtgg

SEQ ID NO: 250206 - DNA, 25 bp, Rattus norvegicus
ccctgtctacagatctaggctatgg

SEQ ID NO: 250207 - DNA, 25 bp, Rattus norvegicus
ccctgtctacagttctaggctatgg

SEQ ID NO: 250208 - DNA, 25 bp, Rattus norvegicus
ccctgtctatatcccttttgaaaaa

SEQ ID NO: 250209 - DNA, 25 bp, Rattus norvegicus
ccctgtctatatgccttttgaaaaa

SEQ ID NO: 250210 - DNA, 25 bp, Rattus norvegicus
ccctgtctcatacttgtgatctcaa

SEQ ID NO: 250211 - DNA, 25 bp, Rattus norvegicus
ccctgtctcatagttgtgatctcaa

SEQ ID NO: 250212 - DNA, 25 bp, Rattus norvegicus
ccctgtctgtatattctcacggaaa

SEQ ID NO: 250213 - DNA, 25 bp, Rattus norvegicus
ccctgtctgtattttctcacggaaa

SEQ ID NO: 250214 - DNA, 25 bp, Rattus norvegicus
ccctgtcttgttatggcctagtggt

SEQ ID NO: 250215 - DNA, 25 bp, Rattus norvegicus
ccctgtcttgttttggcctagtggt

SEQ ID NO: 250216 - DNA, 25 bp, Rattus norvegicus
ccctgtcttttgcatgcctgaagaa

SEQ ID NO: 250217 - DNA, 25 bp, Rattus norvegicus
ccctgtcttttggatgcctgaagaa

SEQ ID NO: 250218 - DNA, 25 bp, Rattus norvegicus
ccctgtgaccttcaacttatgactc

SEQ ID NO: 250219 - DNA, 25 bp, Rattus norvegicus
ccctgtgaccttgaacttatgactc

SEQ ID NO: 250220 - DNA, 25 bp, Rattus norvegicus
ccctgtgactggcagcaagtgctgt

SEQ ID NO: 250221 - DNA, 25 bp, Rattus norvegicus
ccctgtgactgggagcaagtgctgt

SEQ ID NO: 250222 - DNA, 25 bp, Rattus norvegicus
ccctgtgcatgtatctttttctttc

SEQ ID NO: 250223 - DNA, 25 bp, Rattus norvegicus
ccctgtgcatgtttctttttctttc

SEQ ID NO: 250224 - DNA, 25 bp, Rattus norvegicus
ccctgtgccttaacaacttgggaca

SEQ ID NO: 250225 - DNA, 25 bp, Rattus norvegicus
ccctgtgccttatcaacttgggaca

SEQ ID NO: 250226 - DNA, 25 bp, Rattus norvegicus
ccctgtgctgccactaaagacaaga

SEQ ID NO: 250227 - DNA, 25 bp, Rattus norvegicus
ccctgtgctgcctctaaagacaaga

SEQ ID NO: 250228 - DNA, 25 bp, Rattus norvegicus
ccctgtgctgtgctattatctctag

SEQ ID NO: 250229 - DNA, 25 bp, Rattus norvegicus
ccctgtgctgtggtattatctctag

SEQ ID NO: 250230 - DNA, 25 bp, Rattus norvegicus
ccctgtgcttttaaagctctgcagt

SEQ ID NO: 250231 - DNA, 25 bp, Rattus norvegicus
ccctgtgctttttaagctctgcagt

SEQ ID NO: 250232 - DNA, 25 bp, Rattus norvegicus
ccctgtggctaacaaggctgcgcct

SEQ ID NO: 250233 - DNA, 25 bp, Rattus norvegicus
ccctgtggctaagaaggctgcgcct

SEQ ID NO: 250234 - DNA, 25 bp, Rattus norvegicus
ccctgtggtagaaaccttatgcctg

SEQ ID NO: 250235 - DNA, 25 bp, Rattus norvegicus
ccctgtggtagataccttatgcctg

SEQ ID NO: 250236 - DNA, 25 bp, Rattus norvegicus
ccctgtggtcacaagttcagctgaa

SEQ ID NO: 250237 - DNA, 25 bp, Rattus norvegicus
ccctgtggtcactagttcagctgaa

SEQ ID NO: 250238 - DNA, 25 bp, Rattus norvegicus
ccctgtggtttcaccagctgagaga

SEQ ID NO: 250239 - DNA, 25 bp, Rattus norvegicus
ccctgtggtttctccagctgagaga

SEQ ID NO: 250240 - DNA, 25 bp, Rattus norvegicus
ccctgtgtaactcaccatctggaat

SEQ ID NO: 250241 - DNA, 25 bp, Rattus norvegicus
ccctgtgtaactgaccatctggaat

SEQ ID NO: 250242 - DNA, 25 bp, Rattus norvegicus
ccctgtgtccttcaagctctgatag

SEQ ID NO: 250243 - DNA, 25 bp, Rattus norvegicus
ccctgtgtccttgaagctctgatag

SEQ ID NO: 250244 - DNA, 25 bp, Rattus norvegicus
ccctgtgtcttcagaaccttaacat

SEQ ID NO: 250245 - DNA, 25 bp, Rattus norvegicus
ccctgtgtcttctgaaccttaacat

SEQ ID NO: 250246 - DNA, 25 bp, Rattus norvegicus
ccctgtgtgataaggtttcggttat

SEQ ID NO: 250247 - DNA, 25 bp, Rattus norvegicus
ccctgtgtgatatggtttcggttat

SEQ ID NO: 250248 - DNA, 25 bp, Rattus norvegicus
ccctgtgtgcatatcttgttattaa

SEQ ID NO: 250249 - DNA, 25 bp, Rattus norvegicus
ccctgtgtgcatcgcatgttgattg

SEQ ID NO: 250250 - DNA, 25 bp, Rattus norvegicus
ccctgtgtgcatggcatgttgattg

SEQ ID NO: 250251 - DNA, 25 bp, Rattus norvegicus
ccctgtgtgcatttcttgttattaa

SEQ ID NO: 250252 - DNA, 25 bp, Rattus norvegicus
ccctgtgtgcttcttcctgtgagaa

SEQ ID NO: 250253 - DNA, 25 bp, Rattus norvegicus
ccctgtgtgcttgttcctgtgagaa

SEQ ID NO: 250254 - DNA, 25 bp, Rattus norvegicus
ccctgtgtggagatacctccaggta

SEQ ID NO: 250255 - DNA, 25 bp, Rattus norvegicus
ccctgtgtggagttacctccaggta

SEQ ID NO: 250256 - DNA, 25 bp, Rattus norvegicus
ccctgtgttcttctcgaggttcaaa

SEQ ID NO: 250257 - DNA, 25 bp, Rattus norvegicus
ccctgtgttcttgtcgaggttcaaa

SEQ ID NO: 250258 - DNA, 25 bp, Rattus norvegicus
ccctgtgttgttctcctgagagtta

SEQ ID NO: 250259 - DNA, 25 bp, Rattus norvegicus
ccctgtgttgttgtcctgagagtta

SEQ ID NO: 250260 - DNA, 25 bp, Rattus norvegicus
ccctgtgtttatcctgtgcagacaa

SEQ ID NO: 250261 - DNA, 25 bp, Rattus norvegicus
ccctgtgtttatctgctttactgag

SEQ ID NO: 250262 - DNA, 25 bp, Rattus norvegicus
ccctgtgtttatgctgtgcagacaa

SEQ ID NO: 250263 - DNA, 25 bp, Rattus norvegicus
ccctgtgtttatgtgctttactgag

SEQ ID NO: 250264 - DNA, 25 bp, Rattus norvegicus
ccctgttaactcaccataaatttgg

SEQ ID NO: 250265 - DNA, 25 bp, Rattus norvegicus
ccctgttaactctccataaatttgg

SEQ ID NO: 250266 - DNA, 25 bp, Rattus norvegicus
ccctgttcacacaaggtgtttccta

SEQ ID NO: 250267 - DNA, 25 bp, Rattus norvegicus
ccctgttcacactaggtgtttccta

SEQ ID NO: 250268 - DNA, 25 bp, Rattus norvegicus
ccctgttccattatgttagttcatt

SEQ ID NO: 250269 - DNA, 25 bp, Rattus norvegicus
ccctgttccattttgttagttcatt

SEQ ID NO: 250270 - DNA, 25 bp, Rattus norvegicus
ccctgttcctgtagacttatagatt

SEQ ID NO: 250271 - DNA, 25 bp, Rattus norvegicus
ccctgttcctgttgacttatagatt

SEQ ID NO: 250272 - DNA, 25 bp, Rattus norvegicus
ccctgttcctttcttagacacgaat

SEQ ID NO: 250273 - DNA, 25 bp, Rattus norvegicus
ccctgttcctttgttagacacgaat

SEQ ID NO: 250274 - DNA, 25 bp, Rattus norvegicus
ccctgttctggcatgaagacagtga

SEQ ID NO: 250275 - DNA, 25 bp, Rattus norvegicus
ccctgttctggcttgaagacagtga

SEQ ID NO: 250276 - DNA, 25 bp, Rattus norvegicus
ccctgttcttctccattaacttgag

SEQ ID NO: 250277 - DNA, 25 bp, Rattus norvegicus
ccctgttcttctgcattaacttgag

SEQ ID NO: 250278 - DNA, 25 bp, Rattus norvegicus
ccctgttctttacgccccttgagag

SEQ ID NO: 250279 - DNA, 25 bp, Rattus norvegicus
ccctgttctttaggccccttgagag

SEQ ID NO: 250280 - DNA, 25 bp, Rattus norvegicus
ccctgttgacttctgactgtggtaa

SEQ ID NO: 250281 - DNA, 25 bp, Rattus norvegicus
ccctgttgacttgtgactgtggtaa

SEQ ID NO: 250282 - DNA, 25 bp, Rattus norvegicus
ccctgttgccctccaatagaaatgt

SEQ ID NO: 250283 - DNA, 25 bp, Rattus norvegicus
ccctgttgccctgcaatagaaatgt

SEQ ID NO: 250284 - DNA, 25 bp, Rattus norvegicus
ccctgttggtagctttgtagagaga

SEQ ID NO: 250285 - DNA, 25 bp, Rattus norvegicus
ccctgttggtaggtttgtagagaga

SEQ ID NO: 250286 - DNA, 25 bp, Rattus norvegicus
ccctgtttcttactttaatctacat

SEQ ID NO: 250287 - DNA, 25 bp, Rattus norvegicus
ccctgtttcttagtttaatctacat

SEQ ID NO: 250288 - DNA, 25 bp, Rattus norvegicus
ccctgtttgagtattggcttgactt

SEQ ID NO: 250289 - DNA, 25 bp, Rattus norvegicus
ccctgtttgagttttggcttgactt

SEQ ID NO: 250290 - DNA, 25 bp, Rattus norvegicus
ccctgtttgtacacctctgatgaaa

SEQ ID NO: 250291 - DNA, 25 bp, Rattus norvegicus
ccctgtttgtactcctctgatgaaa

SEQ ID NO: 250292 - DNA, 25 bp, Rattus norvegicus
cccttaaagacaacactggcacgta

SEQ ID NO: 250293 - DNA, 25 bp, Rattus norvegicus
cccttaaagacatcactggcacgta

SEQ ID NO: 250294 - DNA, 25 bp, Rattus norvegicus
cccttaaggtgtacagttgctgtca

SEQ ID NO: 250295 - DNA, 25 bp, Rattus norvegicus
cccttaaggtgttcagttgctgtca

SEQ ID NO: 250296 - DNA, 25 bp, Rattus norvegicus
cccttaccataacctcttgaaactg

SEQ ID NO: 250297 - DNA, 25 bp, Rattus norvegicus
cccttaccataagctcttgaaactg

SEQ ID NO: 250298 - DNA, 25 bp, Rattus norvegicus
cccttaccctgaatctatgtttact

SEQ ID NO: 250299 - DNA, 25 bp, Rattus norvegicus
cccttaccctgattctatgtttact

SEQ ID NO: 250300 - DNA, 25 bp, Rattus norvegicus
cccttacgtaatcgcggctgttcaa

SEQ ID NO: 250301 - DNA, 25 bp, Rattus norvegicus
cccttacgtaatggcggctgttcaa

SEQ ID NO: 250302 - DNA, 25 bp, Rattus norvegicus
cccttacgtcgaaagcaggtgagat

SEQ ID NO: 250303 - DNA, 25 bp, Rattus norvegicus
cccttacgtcgatagcaggtgagat

SEQ ID NO: 250304 - DNA, 25 bp, Rattus norvegicus
cccttactctgactgattctgacaa

SEQ ID NO: 250305 - DNA, 25 bp, Rattus norvegicus
cccttactctgagtgattctgacaa

SEQ ID NO: 250306 - DNA, 25 bp, Rattus norvegicus
cccttagcccttcagcagaatgctg

SEQ ID NO: 250307 - DNA, 25 bp, Rattus norvegicus
cccttagcccttgagcagaatgctg

SEQ ID NO: 250308 - DNA, 25 bp, Rattus norvegicus
cccttagctgtgaccatcatcatga

SEQ ID NO: 250309 - DNA, 25 bp, Rattus norvegicus
cccttagctgtgtccatcatcatga

SEQ ID NO: 250310 - DNA, 25 bp, Rattus norvegicus
cccttagtgcttagttgctgttttg

SEQ ID NO: 250311 - DNA, 25 bp, Rattus norvegicus
cccttagtgctttgttgctgttttg

SEQ ID NO: 250312 - DNA, 25 bp, Rattus norvegicus
cccttagtgttgaggtgacctctta

SEQ ID NO: 250313 - DNA, 25 bp, Rattus norvegicus
cccttagtgttgtggtgacctctta

SEQ ID NO: 250314 - DNA, 25 bp, Rattus norvegicus
cccttatattcaccctctcaaaaat

SEQ ID NO: 250315 - DNA, 25 bp, Rattus norvegicus
cccttatattcagcctctcaaaaat

SEQ ID NO: 250316 - DNA, 25 bp, Rattus norvegicus
cccttatgttacagttctgcctgaa

SEQ ID NO: 250317 - DNA, 25 bp, Rattus norvegicus
cccttatgttactgttctgcctgaa

SEQ ID NO: 250318 - DNA, 25 bp, Rattus norvegicus
cccttattgcttagtgggcctgata

SEQ ID NO: 250319 - DNA, 25 bp, Rattus norvegicus
cccttattgctttgtgggcctgata

SEQ ID NO: 250320 - DNA, 25 bp, Rattus norvegicus
cccttatttctgatggtagctctga

SEQ ID NO: 250321 - DNA, 25 bp, Rattus norvegicus
cccttatttctgttggtagctctga

SEQ ID NO: 250322 - DNA, 25 bp, Rattus norvegicus
cccttcaaaagcctgattatcatac

SEQ ID NO: 250323 - DNA, 25 bp, Rattus norvegicus
cccttcaaaagcgtgattatcatac

SEQ ID NO: 250324 - DNA, 25 bp, Rattus norvegicus
cccttcaacatgagggcagcgtgag

SEQ ID NO: 250325 - DNA, 25 bp, Rattus norvegicus
cccttcaacatgtgggcagcgtgag

SEQ ID NO: 250326 - DNA, 25 bp, Rattus norvegicus
cccttcaacgggaagctgtggagca

SEQ ID NO: 250327 - DNA, 25 bp, Rattus norvegicus
cccttcaacgggtagctgtggagca

SEQ ID NO: 250328 - DNA, 25 bp, Rattus norvegicus
cccttcaagtctcagtgccaaagtt

SEQ ID NO: 250329 - DNA, 25 bp, Rattus norvegicus
cccttcaagtctgagtgccaaagtt

SEQ ID NO: 250330 - DNA, 25 bp, Rattus norvegicus
cccttcaatgctaccctagaattta

SEQ ID NO: 250331 - DNA, 25 bp, Rattus norvegicus
cccttcaatgcttccctagaattta

SEQ ID NO: 250332 - DNA, 25 bp, Rattus norvegicus
cccttcacatgcatgatatctgaca

SEQ ID NO: 250333 - DNA, 25 bp, Rattus norvegicus
cccttcacatgcttgatatctgaca

SEQ ID NO: 250334 - DNA, 25 bp, Rattus norvegicus
cccttcacctccattacttagaaag

SEQ ID NO: 250335 - DNA, 25 bp, Rattus norvegicus
cccttcacctcctttacttagaaag

SEQ ID NO: 250336 - DNA, 25 bp, Rattus norvegicus
cccttcactggcaactaggaactga

SEQ ID NO: 250337 - DNA, 25 bp, Rattus norvegicus
cccttcactggctactaggaactga

SEQ ID NO: 250338 - DNA, 25 bp, Rattus norvegicus
cccttcactgtccttagtacttgat

SEQ ID NO: 250339 - DNA, 25 bp, Rattus norvegicus
cccttcactgtcgttagtacttgat

SEQ ID NO: 250340 - DNA, 25 bp, Rattus norvegicus
cccttcagacccatattcatttatt

SEQ ID NO: 250341 - DNA, 25 bp, Rattus norvegicus
cccttcagacccttattcatttatt

SEQ ID NO: 250342 - DNA, 25 bp, Rattus norvegicus
cccttcaggtgcatttgtggctaaa

SEQ ID NO: 250343 - DNA, 25 bp, Rattus norvegicus
cccttcaggtgcttttgtggctaaa

SEQ ID NO: 250344 - DNA, 25 bp, Rattus norvegicus
cccttcagtttcacctaattaacat

SEQ ID NO: 250345 - DNA, 25 bp, Rattus norvegicus
cccttcagtttctcctaattaacat

SEQ ID NO: 250346 - DNA, 25 bp, Rattus norvegicus
cccttcatctatctccttaatattg

SEQ ID NO: 250347 - DNA, 25 bp, Rattus norvegicus
cccttcatctatgtccttaatattg

SEQ ID NO: 250348 - DNA, 25 bp, Rattus norvegicus
cccttcatctccatgtactaaattg

SEQ ID NO: 250349 - DNA, 25 bp, Rattus norvegicus
cccttcatctccttgtactaaattg

SEQ ID NO: 250350 - DNA, 25 bp, Rattus norvegicus
cccttcatgtccattccgattagaa

SEQ ID NO: 250351 - DNA, 25 bp, Rattus norvegicus
cccttcatgtcctttccgattagaa

SEQ ID NO: 250352 - DNA, 25 bp, Rattus norvegicus
cccttccacattctttgtctgatat

SEQ ID NO: 250353 - DNA, 25 bp, Rattus norvegicus
cccttccacattgtttgtctgatat

SEQ ID NO: 250354 - DNA, 25 bp, Rattus norvegicus
cccttcccaaggaacagagcaatgg

SEQ ID NO: 250355 - DNA, 25 bp, Rattus norvegicus
cccttcccaaggtacagagcaatgg

SEQ ID NO: 250356 - DNA, 25 bp, Rattus norvegicus
cccttcccagttctcatttgtcatg

SEQ ID NO: 250357 - DNA, 25 bp, Rattus norvegicus
cccttcccagttgtcatttgtcatg

SEQ ID NO: 250358 - DNA, 25 bp, Rattus norvegicus
cccttcccatctatggagctaattg

SEQ ID NO: 250359 - DNA, 25 bp, Rattus norvegicus
cccttcccatctttggagctaattg

SEQ ID NO: 250360 - DNA, 25 bp, Rattus norvegicus
cccttccccttcatgaattattgtt

SEQ ID NO: 250361 - DNA, 25 bp, Rattus norvegicus
cccttccccttcttgaattattgtt

SEQ ID NO: 250362 - DNA, 25 bp, Rattus norvegicus
cccttccgtttaactgctctataaa

SEQ ID NO: 250363 - DNA, 25 bp, Rattus norvegicus
cccttccgtttatctgctctataaa

SEQ ID NO: 250364 - DNA, 25 bp, Rattus norvegicus
cccttcctattcacacagatattgg

SEQ ID NO: 250365 - DNA, 25 bp, Rattus norvegicus
cccttcctattctcacagatattgg

SEQ ID NO: 250366 - DNA, 25 bp, Rattus norvegicus
cccttcctcatgctagtaaatgcca

SEQ ID NO: 250367 - DNA, 25 bp, Rattus norvegicus
cccttcctcatggtagtaaatgcca

SEQ ID NO: 250368 - DNA, 25 bp, Rattus norvegicus
cccttcctcgggatatgatgtaatt

SEQ ID NO: 250369 - DNA, 25 bp, Rattus norvegicus
cccttcctcgggttatgatgtaatt

SEQ ID NO: 250370 - DNA, 25 bp, Rattus norvegicus
cccttcctgctcctgataatagtga

SEQ ID NO: 250371 - DNA, 25 bp, Rattus norvegicus
cccttcctgctcgtgataatagtga

SEQ ID NO: 250372 - DNA, 25 bp, Rattus norvegicus
cccttcctggagacaagtgccaaga

SEQ ID NO: 250373 - DNA, 25 bp, Rattus norvegicus
cccttcctggagtcaagtgccaaga

SEQ ID NO: 250374 - DNA, 25 bp, Rattus norvegicus
cccttcctgtggctattatcagcag

SEQ ID NO: 250375 - DNA, 25 bp, Rattus norvegicus
cccttcctgtgggtattatcagcag

SEQ ID NO: 250376 - DNA, 25 bp, Rattus norvegicus
cccttcctgtttagcgtgctatgag

SEQ ID NO: 250377 - DNA, 25 bp, Rattus norvegicus
cccttcctgttttgcgtgctatgag

SEQ ID NO: 250378 - DNA, 25 bp, Rattus norvegicus
cccttccttagcacacctgtgtggg

SEQ ID NO: 250379 - DNA, 25 bp, Rattus norvegicus
cccttccttagctcacctgtgtggg

SEQ ID NO: 250380 - DNA, 25 bp, Rattus norvegicus
cccttcgagggcagttttgcagtga

SEQ ID NO: 250381 - DNA, 25 bp, Rattus norvegicus
cccttcgagggctgttttgcagtga

SEQ ID NO: 250382 - DNA, 25 bp, Rattus norvegicus
cccttcgtctccagagagctagaaa

SEQ ID NO: 250383 - DNA, 25 bp, Rattus norvegicus
cccttcgtctcctgagagctagaaa

SEQ ID NO: 250384 - DNA, 25 bp, Rattus norvegicus
cccttctaagctcggcctgagaact

SEQ ID NO: 250385 - DNA, 25 bp, Rattus norvegicus
cccttctaagctcgtgagctgggct

SEQ ID NO: 250386 - DNA, 25 bp, Rattus norvegicus
cccttctaagctgggcctgagaact

SEQ ID NO: 250387 - DNA, 25 bp, Rattus norvegicus
cccttctaagctggtgagctgggct

SEQ ID NO: 250388 - DNA, 25 bp, Rattus norvegicus
cccttctatatcatcaatgtctcgt

SEQ ID NO: 250389 - DNA, 25 bp, Rattus norvegicus
cccttctatatcttcaatgtctcgt

SEQ ID NO: 250390 - DNA, 25 bp, Rattus norvegicus
cccttctatcgcacaactgtatttg

SEQ ID NO: 250391 - DNA, 25 bp, Rattus norvegicus
cccttctatcgctcaactgtatttg

SEQ ID NO: 250392 - DNA, 25 bp, Rattus norvegicus
cccttctcaactctgtaacatggac

SEQ ID NO: 250393 - DNA, 25 bp, Rattus norvegicus
cccttctcaactgtgtaacatggac

SEQ ID NO: 250394 - DNA, 25 bp, Rattus norvegicus
cccttctcagttagctggcttagaa

SEQ ID NO: 250395 - DNA, 25 bp, Rattus norvegicus
cccttctcagtttgctggcttagaa

SEQ ID NO: 250396 - DNA, 25 bp, Rattus norvegicus
cccttctcatctacgtgtatgacga

SEQ ID NO: 250397 - DNA, 25 bp, Rattus norvegicus
cccttctcatcttcgtgtatgacga

SEQ ID NO: 250398 - DNA, 25 bp, Rattus norvegicus
cccttctcccacaaaatactgtatt

SEQ ID NO: 250399 - DNA, 25 bp, Rattus norvegicus
cccttctcccactaaatactgtatt

SEQ ID NO: 250400 - DNA, 25 bp, Rattus norvegicus
cccttctcttctaataactgtgcaa

SEQ ID NO: 250401 - DNA, 25 bp, Rattus norvegicus
cccttctcttcttataactgtgcaa

SEQ ID NO: 250402 - DNA, 25 bp, Rattus norvegicus
cccttctctttcatccagatggatt

SEQ ID NO: 250403 - DNA, 25 bp, Rattus norvegicus
cccttctctttcttccagatggatt

SEQ ID NO: 250404 - DNA, 25 bp, Rattus norvegicus
cccttctgactacccctggagataa

SEQ ID NO: 250405 - DNA, 25 bp, Rattus norvegicus
cccttctgactagccctggagataa

SEQ ID NO: 250406 - DNA, 25 bp, Rattus norvegicus
cccttctgagaaaccattcctgtgg

SEQ ID NO: 250407 - DNA, 25 bp, Rattus norvegicus
cccttctgagaatccattcctgtgg

SEQ ID NO: 250408 - DNA, 25 bp, Rattus norvegicus
cccttctgcagcagcttaggttgaa

SEQ ID NO: 250409 - DNA, 25 bp, Rattus norvegicus
cccttctgcagctgcttaggttgaa

SEQ ID NO: 250410 - DNA, 25 bp, Rattus norvegicus
cccttctgtattaggtagtgtccgt

SEQ ID NO: 250411 - DNA, 25 bp, Rattus norvegicus
cccttctgtatttggtagtgtccgt

SEQ ID NO: 250412 - DNA, 25 bp, Rattus norvegicus
cccttcttatctagcacatactttg

SEQ ID NO: 250413 - DNA, 25 bp, Rattus norvegicus
cccttcttatcttgcacatactttg

SEQ ID NO: 250414 - DNA, 25 bp, Rattus norvegicus
cccttcttctccctgtgaggatata

SEQ ID NO: 250415 - DNA, 25 bp, Rattus norvegicus
cccttcttctccgtgtgaggatata

SEQ ID NO: 250416 - DNA, 25 bp, Rattus norvegicus
cccttcttgacactcaggtagagcc

SEQ ID NO: 250417 - DNA, 25 bp, Rattus norvegicus
cccttcttgacagtcaggtagagcc

SEQ ID NO: 250418 - DNA, 25 bp, Rattus norvegicus
cccttcttgggtatgagcagtttca

SEQ ID NO: 250419 - DNA, 25 bp, Rattus norvegicus
cccttcttgggtttgagcagtttca

SEQ ID NO: 250420 - DNA, 25 bp, Rattus norvegicus
cccttcttttggcatctgggcagaa

SEQ ID NO: 250421 - DNA, 25 bp, Rattus norvegicus
cccttcttttgggatctgggcagaa

SEQ ID NO: 250422 - DNA, 25 bp, Rattus norvegicus
cccttgaaacaactgtcttactctg

SEQ ID NO: 250423 - DNA, 25 bp, Rattus norvegicus
cccttgaaacaagtgtcttactctg

SEQ ID NO: 250424 - DNA, 25 bp, Rattus norvegicus
cccttgaatacccttgagagtttga

SEQ ID NO: 250425 - DNA, 25 bp, Rattus norvegicus
cccttgaataccgttgagagtttga

SEQ ID NO: 250426 - DNA, 25 bp, Rattus norvegicus
cccttgaatattagcctctctgaga

SEQ ID NO: 250427 - DNA, 25 bp, Rattus norvegicus
cccttgaatatttgcctctctgaga

SEQ ID NO: 250428 - DNA, 25 bp, Rattus norvegicus
cccttgaatctactctggcttttga

SEQ ID NO: 250429 - DNA, 25 bp, Rattus norvegicus
cccttgaatctagtctggcttttga

SEQ ID NO: 250430 - DNA, 25 bp, Rattus norvegicus
cccttgaccctgatttatatctcag

SEQ ID NO: 250431 - DNA, 25 bp, Rattus norvegicus
cccttgaccctgttttatatctcag

SEQ ID NO: 250432 - DNA, 25 bp, Rattus norvegicus
cccttgagcctaccgatttgggctt

SEQ ID NO: 250433 - DNA, 25 bp, Rattus norvegicus
cccttgagcctagcgatttgggctt

SEQ ID NO: 250434 - DNA, 25 bp, Rattus norvegicus
cccttgagggcgagagagttccctg

SEQ ID NO: 250435 - DNA, 25 bp, Rattus norvegicus
cccttgagggcgtgagagttccctg

SEQ ID NO: 250436 - DNA, 25 bp, Rattus norvegicus
cccttgcacctgattggaggacgaa

SEQ ID NO: 250437 - DNA, 25 bp, Rattus norvegicus
cccttgcacctgtttggaggacgaa

SEQ ID NO: 250438 - DNA, 25 bp, Rattus norvegicus
cccttgcagggaaccagacacttgg

SEQ ID NO: 250439 - DNA, 25 bp, Rattus norvegicus
cccttgcagggatccagacacttgg

SEQ ID NO: 250440 - DNA, 25 bp, Rattus norvegicus
cccttgcagttcatggtttttggtg

SEQ ID NO: 250441 - DNA, 25 bp, Rattus norvegicus
cccttgcagttcttggtttttggtg

SEQ ID NO: 250442 - DNA, 25 bp, Rattus norvegicus
cccttgcatcatcgctcagtttgga

SEQ ID NO: 250443 - DNA, 25 bp, Rattus norvegicus
cccttgcatcatggctcagtttgga

SEQ ID NO: 250444 - DNA, 25 bp, Rattus norvegicus
cccttgccaaatcgtgtcccatggt

SEQ ID NO: 250445 - DNA, 25 bp, Rattus norvegicus
cccttgccaaatggtgtcccatggt

SEQ ID NO: 250446 - DNA, 25 bp, Rattus norvegicus
cccttgcctggtctctaaaacataa

SEQ ID NO: 250447 - DNA, 25 bp, Rattus norvegicus
cccttgcctggtgtctaaaacataa

SEQ ID NO: 250448 - DNA, 25 bp, Rattus norvegicus
cccttgccttgccagtgactaaata

SEQ ID NO: 250449 - DNA, 25 bp, Rattus norvegicus
cccttgccttgcgagtgactaaata

SEQ ID NO: 250450 - DNA, 25 bp, Rattus norvegicus
cccttgctgctacatgtatgctatt

SEQ ID NO: 250451 - DNA, 25 bp, Rattus norvegicus
cccttgctgctagatgtatgctatt

SEQ ID NO: 250452 - DNA, 25 bp, Rattus norvegicus
cccttgctgttcactggaagtgagt

SEQ ID NO: 250453 - DNA, 25 bp, Rattus norvegicus
cccttgctgttctctggaagtgagt

SEQ ID NO: 250454 - DNA, 25 bp, Rattus norvegicus
cccttgcttgccattttcagagaaa

SEQ ID NO: 250455 - DNA, 25 bp, Rattus norvegicus
cccttgcttgcctttttcagagaaa

SEQ ID NO: 250456 - DNA, 25 bp, Rattus norvegicus
cccttggagggacctgagtaacttt

SEQ ID NO: 250457 - DNA, 25 bp, Rattus norvegicus
cccttggagggagctgagtaacttt

SEQ ID NO: 250458 - DNA, 25 bp, Rattus norvegicus
cccttggcaggtagcttgagttgta

SEQ ID NO: 250459 - DNA, 25 bp, Rattus norvegicus
cccttggcaggttgcttgagttgta

SEQ ID NO: 250460 - DNA, 25 bp, Rattus norvegicus
cccttggccactcaggctttaagtt

SEQ ID NO: 250461 - DNA, 25 bp, Rattus norvegicus
cccttggccactgaggctttaagtt

SEQ ID NO: 250462 - DNA, 25 bp, Rattus norvegicus
cccttggcttgactagaggctctat

SEQ ID NO: 250463 - DNA, 25 bp, Rattus norvegicus
cccttggcttgagtagaggctctat

SEQ ID NO: 250464 - DNA, 25 bp, Rattus norvegicus
cccttggcttgcagtgcaaagattc

SEQ ID NO: 250465 - DNA, 25 bp, Rattus norvegicus
cccttggcttgctgtgcaaagattc

SEQ ID NO: 250466 - DNA, 25 bp, Rattus norvegicus
cccttgggacacatactggcagaat

SEQ ID NO: 250467 - DNA, 25 bp, Rattus norvegicus
cccttgggacacttactggcagaat

SEQ ID NO: 250468 - DNA, 25 bp, Rattus norvegicus
cccttgggatggagtagaaggtcta

SEQ ID NO: 250469 - DNA, 25 bp, Rattus norvegicus
cccttgggatggtgtagaaggtcta

SEQ ID NO: 250470 - DNA, 25 bp, Rattus norvegicus
cccttgggcattcctcgaaggatta

SEQ ID NO: 250471 - DNA, 25 bp, Rattus norvegicus
cccttgggcattgctcgaaggatta

SEQ ID NO: 250472 - DNA, 25 bp, Rattus norvegicus
cccttgggcctcacttttgagaata

SEQ ID NO: 250473 - DNA, 25 bp, Rattus norvegicus
cccttgggcctctcttttgagaata

SEQ ID NO: 250474 - DNA, 25 bp, Rattus norvegicus
cccttgggccttctagaggtggtat

SEQ ID NO: 250475 - DNA, 25 bp, Rattus norvegicus
cccttgggccttgtagaggtggtat

SEQ ID NO: 250476 - DNA, 25 bp, Rattus norvegicus
cccttgggcttcacatttatcttaa

SEQ ID NO: 250477 - DNA, 25 bp, Rattus norvegicus
cccttgggcttctcatttatcttaa

SEQ ID NO: 250478 - DNA, 25 bp, Rattus norvegicus
cccttggtcctgctgcatataaaga

SEQ ID NO: 250479 - DNA, 25 bp, Rattus norvegicus
cccttggtcctggtgcatataaaga

SEQ ID NO: 250480 - DNA, 25 bp, Rattus norvegicus
cccttggtggtcagctagctacaat

SEQ ID NO: 250481 - DNA, 25 bp, Rattus norvegicus
cccttggtggtctgctagctacaat

SEQ ID NO: 250482 - DNA, 25 bp, Rattus norvegicus
cccttggtggtgaagcttatgccta

SEQ ID NO: 250483 - DNA, 25 bp, Rattus norvegicus
cccttggtggtgtagcttatgccta

SEQ ID NO: 250484 - DNA, 25 bp, Rattus norvegicus
cccttgtagcatcttttccaaactt

SEQ ID NO: 250485 - DNA, 25 bp, Rattus norvegicus
cccttgtagcatgttttccaaactt

SEQ ID NO: 250486 - DNA, 25 bp, Rattus norvegicus
cccttgtagtccaagcactgggtag

SEQ ID NO: 250487 - DNA, 25 bp, Rattus norvegicus
cccttgtagtcctagcactgggtag

SEQ ID NO: 250488 - DNA, 25 bp, Rattus norvegicus
cccttgtccagaatttgtgcgttga

SEQ ID NO: 250489 - DNA, 25 bp, Rattus norvegicus
cccttgtccagattttgtgcgttga

SEQ ID NO: 250490 - DNA, 25 bp, Rattus norvegicus
cccttgtccccactgtagagctaag

SEQ ID NO: 250491 - DNA, 25 bp, Rattus norvegicus
cccttgtccccagtgtagagctaag

SEQ ID NO: 250492 - DNA, 25 bp, Rattus norvegicus
cccttgtgctcccaatctaaagaga

SEQ ID NO: 250493 - DNA, 25 bp, Rattus norvegicus
cccttgtgctccgaatctaaagaga

SEQ ID NO: 250494 - DNA, 25 bp, Rattus norvegicus
cccttgtgcttcactataactttgt

SEQ ID NO: 250495 - DNA, 25 bp, Rattus norvegicus
cccttgtgcttctctataactttgt

SEQ ID NO: 250496 - DNA, 25 bp, Rattus norvegicus
cccttgttcattatctctgaccaaa

SEQ ID NO: 250497 - DNA, 25 bp, Rattus norvegicus
cccttgttcattttctctgaccaaa

SEQ ID NO: 250498 - DNA, 25 bp, Rattus norvegicus
cccttgttctctattcacgttgtaa

SEQ ID NO: 250499 - DNA, 25 bp, Rattus norvegicus
cccttgttctcttttcacgttgtaa

SEQ ID NO: 250500 - DNA, 25 bp, Rattus norvegicus
cccttgtttgccaggttgtatctga

SEQ ID NO: 250501 - DNA, 25 bp, Rattus norvegicus
cccttgtttgcctggttgtatctga

SEQ ID NO: 250502 - DNA, 25 bp, Rattus norvegicus
ccctttaactggacttgcagctgca

SEQ ID NO: 250503 - DNA, 25 bp, Rattus norvegicus
ccctttaactggtcttgcagctgca

SEQ ID NO: 250504 - DNA, 25 bp, Rattus norvegicus
ccctttaagagaatttggctggata

SEQ ID NO: 250505 - DNA, 25 bp, Rattus norvegicus
ccctttaagagattttggctggata

SEQ ID NO: 250506 - DNA, 25 bp, Rattus norvegicus
ccctttactgggagctacttgagac

SEQ ID NO: 250507 - DNA, 25 bp, Rattus norvegicus
ccctttactgggtgctacttgagac

SEQ ID NO: 250508 - DNA, 25 bp, Rattus norvegicus
ccctttagccatatgctgtaccgta

SEQ ID NO: 250509 - DNA, 25 bp, Rattus norvegicus
ccctttagccatttgctgtaccgta

SEQ ID NO: 250510 - DNA, 25 bp, Rattus norvegicus
ccctttagggacaggtgttgtgaat

SEQ ID NO: 250511 - DNA, 25 bp, Rattus norvegicus
ccctttagggactggtgttgtgaat

SEQ ID NO: 250512 - DNA, 25 bp, Rattus norvegicus
ccctttatcctgatacactagctaa

SEQ ID NO: 250513 - DNA, 25 bp, Rattus norvegicus
ccctttatcctgttacactagctaa

SEQ ID NO: 250514 - DNA, 25 bp, Rattus norvegicus
ccctttcactcacacatagagctag

SEQ ID NO: 250515 - DNA, 25 bp, Rattus norvegicus
ccctttcactcagacatagagctag

SEQ ID NO: 250516 - DNA, 25 bp, Rattus norvegicus
ccctttcagcgtctggtgcgagaaa

SEQ ID NO: 250517 - DNA, 25 bp, Rattus norvegicus
ccctttcagcgtgtggtgcgagaaa

SEQ ID NO: 250518 - DNA, 25 bp, Rattus norvegicus
ccctttcatgtcactgtgccttaaa

SEQ ID NO: 250519 - DNA, 25 bp, Rattus norvegicus
ccctttcatgtctctgtgccttaaa

SEQ ID NO: 250520 - DNA, 25 bp, Rattus norvegicus
ccctttcattctctctgtttggcaa

SEQ ID NO: 250521 - DNA, 25 bp, Rattus norvegicus
ccctttcattctgtctgtttggcaa

SEQ ID NO: 250522 - DNA, 25 bp, Rattus norvegicus
ccctttccactgatttccattagag

SEQ ID NO: 250523 - DNA, 25 bp, Rattus norvegicus
ccctttccactgttttccattagag

SEQ ID NO: 250524 - DNA, 25 bp, Rattus norvegicus
ccctttcccgatcagtggacggtag

SEQ ID NO: 250525 - DNA, 25 bp, Rattus norvegicus
ccctttcccgatgagtggacggtag

SEQ ID NO: 250526 - DNA, 25 bp, Rattus norvegicus
ccctttccctgcagagactaaatga

SEQ ID NO: 250527 - DNA, 25 bp, Rattus norvegicus
ccctttccctgctgagactaaatga

SEQ ID NO: 250528 - DNA, 25 bp, Rattus norvegicus
ccctttctcaggcagcaggtgacta

SEQ ID NO: 250529 - DNA, 25 bp, Rattus norvegicus
ccctttctcagggagcaggtgacta

SEQ ID NO: 250530 - DNA, 25 bp, Rattus norvegicus
ccctttctgcaaaatggtacatccc

SEQ ID NO: 250531 - DNA, 25 bp, Rattus norvegicus
ccctttctgcaatatggtacatccc

SEQ ID NO: 250532 - DNA, 25 bp, Rattus norvegicus
ccctttctgcttactagaacggagt

SEQ ID NO: 250533 - DNA, 25 bp, Rattus norvegicus
ccctttctgctttctagaacggagt

SEQ ID NO: 250534 - DNA, 25 bp, Rattus norvegicus
ccctttctgtcaccgctaattcaaa

SEQ ID NO: 250535 - DNA, 25 bp, Rattus norvegicus
ccctttctgtcagcgctaattcaaa

SEQ ID NO: 250536 - DNA, 25 bp, Rattus norvegicus
ccctttcttcagagcttagacagca

SEQ ID NO: 250537 - DNA, 25 bp, Rattus norvegicus
ccctttcttcagtgcttagacagca

SEQ ID NO: 250538 - DNA, 25 bp, Rattus norvegicus
ccctttcttgtcacccaattgataa

SEQ ID NO: 250539 - DNA, 25 bp, Rattus norvegicus
ccctttcttgtctcccaattgataa

SEQ ID NO: 250540 - DNA, 25 bp, Rattus norvegicus
ccctttgaaggcagtctctttgaga

SEQ ID NO: 250541 - DNA, 25 bp, Rattus norvegicus
ccctttgaaggctgtctctttgaga

SEQ ID NO: 250542 - DNA, 25 bp, Rattus norvegicus
ccctttgacattccccttttcagag

SEQ ID NO: 250543 - DNA, 25 bp, Rattus norvegicus
ccctttgacattgcccttttcagag

SEQ ID NO: 250544 - DNA, 25 bp, Rattus norvegicus
ccctttgagactcaatgaccctttc

SEQ ID NO: 250545 - DNA, 25 bp, Rattus norvegicus
ccctttgagactgaatgaccctttc

SEQ ID NO: 250546 - DNA, 25 bp, Rattus norvegicus
ccctttgagtgtacagacagccttt

SEQ ID NO: 250547 - DNA, 25 bp, Rattus norvegicus
ccctttgagtgttcagacagccttt

SEQ ID NO: 250548 - DNA, 25 bp, Rattus norvegicus
ccctttgatgatcgcgtgtgatata

SEQ ID NO: 250549 - DNA, 25 bp, Rattus norvegicus
ccctttgatgatggcgtgtgatata

SEQ ID NO: 250550 - DNA, 25 bp, Rattus norvegicus
ccctttgcagctcttccaggaagta

SEQ ID NO: 250551 - DNA, 25 bp, Rattus norvegicus
ccctttgcagctgttccaggaagta

SEQ ID NO: 250552 - DNA, 25 bp, Rattus norvegicus
ccctttgctatcagtttcctttgct

SEQ ID NO: 250553 - DNA, 25 bp, Rattus norvegicus
ccctttgctatctgtttcctttgct

SEQ ID NO: 250554 - DNA, 25 bp, Rattus norvegicus
ccctttgctttgcattggtgtcatt

SEQ ID NO: 250555 - DNA, 25 bp, Rattus norvegicus
ccctttgctttggattggtgtcatt

SEQ ID NO: 250556 - DNA, 25 bp, Rattus norvegicus
ccctttggaaatatcatcgacctct

SEQ ID NO: 250557 - DNA, 25 bp, Rattus norvegicus
ccctttggaaatttcatcgacctct

SEQ ID NO: 250558 - DNA, 25 bp, Rattus norvegicus
ccctttggacgcagctgagagcaga

SEQ ID NO: 250559 - DNA, 25 bp, Rattus norvegicus
ccctttggacgctgctgagagcaga

SEQ ID NO: 250560 - DNA, 25 bp, Rattus norvegicus
ccctttggcatcaactctgggaaga

SEQ ID NO: 250561 - DNA, 25 bp, Rattus norvegicus
ccctttggcatctactctgggaaga

SEQ ID NO: 250562 - DNA, 25 bp, Rattus norvegicus
ccctttgggttcatttgctgttttg

SEQ ID NO: 250563 - DNA, 25 bp, Rattus norvegicus
ccctttgggttcttttgctgttttg

SEQ ID NO: 250564 - DNA, 25 bp, Rattus norvegicus
ccctttgtctgtctggattctatac

SEQ ID NO: 250565 - DNA, 25 bp, Rattus norvegicus
ccctttgtctgtgtggattctatac

SEQ ID NO: 250566 - DNA, 25 bp, Rattus norvegicus
ccctttgttgtgctcagtatttgta

SEQ ID NO: 250567 - DNA, 25 bp, Rattus norvegicus
ccctttgttgtggtcagtatttgta

SEQ ID NO: 250568 - DNA, 25 bp, Rattus norvegicus
cccttttaaaagagcctagtgacag

SEQ ID NO: 250569 - DNA, 25 bp, Rattus norvegicus
cccttttaaaagtgcctagtgacag

SEQ ID NO: 250570 - DNA, 25 bp, Rattus norvegicus
cccttttacttcaggcttgttgcaa

SEQ ID NO: 250571 - DNA, 25 bp, Rattus norvegicus
cccttttacttctggcttgttgcaa

SEQ ID NO: 250572 - DNA, 25 bp, Rattus norvegicus
cccttttattttagtgcgcgatact

SEQ ID NO: 250573 - DNA, 25 bp, Rattus norvegicus
cccttttatttttgtgcgcgatact

SEQ ID NO: 250574 - DNA, 25 bp, Rattus norvegicus
cccttttcagagctcgtgacaagtg

SEQ ID NO: 250575 - DNA, 25 bp, Rattus norvegicus
cccttttcagaggtcgtgacaagtg

SEQ ID NO: 250576 - DNA, 25 bp, Rattus norvegicus
cccttttccttaaattcctgcatta

SEQ ID NO: 250577 - DNA, 25 bp, Rattus norvegicus
cccttttccttatattcctgcatta

SEQ ID NO: 250578 - DNA, 25 bp, Rattus norvegicus
cccttttctaggacatggagctagt

SEQ ID NO: 250579 - DNA, 25 bp, Rattus norvegicus
cccttttctaggtcatggagctagt

SEQ ID NO: 250580 - DNA, 25 bp, Rattus norvegicus
cccttttctatccttgcaagagtca

SEQ ID NO: 250581 - DNA, 25 bp, Rattus norvegicus
cccttttctatcgttgcaagagtca

SEQ ID NO: 250582 - DNA, 25 bp, Rattus norvegicus
cccttttctatgagtgtttggtcta

SEQ ID NO: 250583 - DNA, 25 bp, Rattus norvegicus
cccttttctatgtgtgtttggtcta

SEQ ID NO: 250584 - DNA, 25 bp, Rattus norvegicus
cccttttctgggagatcttgtggca

SEQ ID NO: 250585 - DNA, 25 bp, Rattus norvegicus
cccttttctgggtgatcttgtggca

SEQ ID NO: 250586 - DNA, 25 bp, Rattus norvegicus
cccttttgcctaacagtaatccttg

SEQ ID NO: 250587 - DNA, 25 bp, Rattus norvegicus
cccttttgcctatcagtaatccttg

SEQ ID NO: 250588 - DNA, 25 bp, Rattus norvegicus
cccttttggttgagccctggcagga

SEQ ID NO: 250589 - DNA, 25 bp, Rattus norvegicus
cccttttggttgtgccctggcagga

SEQ ID NO: 250590 - DNA, 25 bp, Rattus norvegicus
ccctttttgattattctgagacaag

SEQ ID NO: 250591 - DNA, 25 bp, Rattus norvegicus
ccctttttgatttttctgagacaag

SEQ ID NO: 250592 - DNA, 25 bp, Rattus norvegicus
cccttttttgctagcacaggttgca

SEQ ID NO: 250593 - DNA, 25 bp, Rattus norvegicus
cccttttttgcttgcacaggttgca

SEQ ID NO: 250594 - DNA, 25 bp, Rattus norvegicus
ccgaaaaacttcagtgcatcttata

SEQ ID NO: 250595 - DNA, 25 bp, Rattus norvegicus
ccgaaaaacttctgtgcatcttata

SEQ ID NO: 250596 - DNA, 25 bp, Rattus norvegicus
ccgaaaagcaggcaaacatctttgt

SEQ ID NO: 250597 - DNA, 25 bp, Rattus norvegicus
ccgaaaagcagggaaacatctttgt

SEQ ID NO: 250598 - DNA, 25 bp, Rattus norvegicus
ccgaaacagcacaggaaggacatca

SEQ ID NO: 250599 - DNA, 25 bp, Rattus norvegicus
ccgaaacagcactggaaggacatca

SEQ ID NO: 250600 - DNA, 25 bp, Rattus norvegicus
ccgaaacattgtagctccctgataa

SEQ ID NO: 250601 - DNA, 25 bp, Rattus norvegicus
ccgaaacattgttgctccctgataa

SEQ ID NO: 250602 - DNA, 25 bp, Rattus norvegicus
ccgaaaccaacaaagctgagccgag

SEQ ID NO: 250603 - DNA, 25 bp, Rattus norvegicus
ccgaaaccaacatagctgagccgag

SEQ ID NO: 250604 - DNA, 25 bp, Rattus norvegicus
ccgaaagggcagctactctgagcgc

SEQ ID NO: 250605 - DNA, 25 bp, Rattus norvegicus
ccgaaagggcaggtactctgagcgc

SEQ ID NO: 250606 - DNA, 25 bp, Rattus norvegicus
ccgaaatcctctcactgttgttgaa

SEQ ID NO: 250607 - DNA, 25 bp, Rattus norvegicus
ccgaaatcctctgactgttgttgaa

SEQ ID NO: 250608 - DNA, 25 bp, Rattus norvegicus
ccgaacacagaacgactatggcaaa

SEQ ID NO: 250609 - DNA, 25 bp, Rattus norvegicus
ccgaacacagaaggactatggcaaa

SEQ ID NO: 250610 - DNA, 25 bp, Rattus norvegicus
ccgaacactctcatcagatgcaaag

SEQ ID NO: 250611 - DNA, 25 bp, Rattus norvegicus
ccgaacactctcttcagatgcaaag

SEQ ID NO: 250612 - DNA, 25 bp, Rattus norvegicus
ccgaacagcacgctcggtctttgtt

SEQ ID NO: 250613 - DNA, 25 bp, Rattus norvegicus
ccgaacagcacggtcggtctttgtt

SEQ ID NO: 250614 - DNA, 25 bp, Rattus norvegicus
ccgaacatgttgcttaccgcaccat

SEQ ID NO: 250615 - DNA, 25 bp, Rattus norvegicus
ccgaacatgttggttaccgcaccat

SEQ ID NO: 250616 - DNA, 25 bp, Rattus norvegicus
ccgaacccgggacctgtggcagaaa

SEQ ID NO: 250617 - DNA, 25 bp, Rattus norvegicus
ccgaacccgggagctgtggcagaaa

SEQ ID NO: 250618 - DNA, 25 bp, Rattus norvegicus
ccgaaccctgaactctttcacagaa

SEQ ID NO: 250619 - DNA, 25 bp, Rattus norvegicus
ccgaaccctgaagtctttcacagaa

SEQ ID NO: 250620 - DNA, 25 bp, Rattus norvegicus
ccgaacgacatgactggcttgtgta

SEQ ID NO: 250621 - DNA, 25 bp, Rattus norvegicus
ccgaacgacatgtctggcttgtgta

SEQ ID NO: 250622 - DNA, 25 bp, Rattus norvegicus
ccgaactcccgaaggcaaaactgga

SEQ ID NO: 250623 - DNA, 25 bp, Rattus norvegicus
ccgaactcccgatggcaaaactgga

SEQ ID NO: 250624 - DNA, 25 bp, Rattus norvegicus
ccgaactggagaaagtcctgtccca

SEQ ID NO: 250625 - DNA, 25 bp, Rattus norvegicus
ccgaactggagatagtcctgtccca

SEQ ID NO: 250626 - DNA, 25 bp, Rattus norvegicus
ccgaactgtcttcgcattgccaaag

SEQ ID NO: 250627 - DNA, 25 bp, Rattus norvegicus
ccgaactgtcttggcattgccaaag

SEQ ID NO: 250628 - DNA, 25 bp, Rattus norvegicus
ccgaagatgccaacctttctacaat

SEQ ID NO: 250629 - DNA, 25 bp, Rattus norvegicus
ccgaagatgccatcctttctacaat

SEQ ID NO: 250630 - DNA, 25 bp, Rattus norvegicus
ccgaagatttacaggatggtgttct

SEQ ID NO: 250631 - DNA, 25 bp, Rattus norvegicus
ccgaagatttactggatggtgttct

SEQ ID NO: 250632 - DNA, 25 bp, Rattus norvegicus
ccgaagcagcttaacaacccgagtg

SEQ ID NO: 250633 - DNA, 25 bp, Rattus norvegicus
ccgaagcagctttacaacccgagtg

SEQ ID NO: 250634 - DNA, 25 bp, Rattus norvegicus
ccgaagccatggagacagcgagcat

SEQ ID NO: 250635 - DNA, 25 bp, Rattus norvegicus
ccgaagccatggtgacagcgagcat

SEQ ID NO: 250636 - DNA, 25 bp, Rattus norvegicus
ccgaagcccctcagactggtgaagg

SEQ ID NO: 250637 - DNA, 25 bp, Rattus norvegicus
ccgaagcccctctgactggtgaagg

SEQ ID NO: 250638 - DNA, 25 bp, Rattus norvegicus
ccgaagcggtgcagctcaggtgtta

SEQ ID NO: 250639 - DNA, 25 bp, Rattus norvegicus
ccgaagcggtgctgctcaggtgtta

SEQ ID NO: 250640 - DNA, 25 bp, Rattus norvegicus
ccgaagctgtgtctgatctggatct

SEQ ID NO: 250641 - DNA, 25 bp, Rattus norvegicus
ccgaagctgtgtgtgatctggatct

SEQ ID NO: 250642 - DNA, 25 bp, Rattus norvegicus
ccgaaggcctcgaagtggccgcgca

SEQ ID NO: 250643 - DNA, 25 bp, Rattus norvegicus
ccgaaggcctcgtagtggccgcgca

SEQ ID NO: 250644 - DNA, 25 bp, Rattus norvegicus
ccgaagggtccacattacttgagaa

SEQ ID NO: 250645 - DNA, 25 bp, Rattus norvegicus
ccgaagggtccagattacttgagaa

SEQ ID NO: 250646 - DNA, 25 bp, Rattus norvegicus
ccgaaggtatatacccttcttgcca

SEQ ID NO: 250647 - DNA, 25 bp, Rattus norvegicus
ccgaaggtatattcccttcttgcca

SEQ ID NO: 250648 - DNA, 25 bp, Rattus norvegicus
ccgaagtgctagctatctgctgaaa

SEQ ID NO: 250649 - DNA, 25 bp, Rattus norvegicus
ccgaagtgctaggtatctgctgaaa

SEQ ID NO: 250650 - DNA, 25 bp, Rattus norvegicus
ccgaatgccttcatgttttccaaag

SEQ ID NO: 250651 - DNA, 25 bp, Rattus norvegicus
ccgaatgccttcttgttttccaaag

SEQ ID NO: 250652 - DNA, 25 bp, Rattus norvegicus
ccgaatgtataaagctgacgttctt

SEQ ID NO: 250653 - DNA, 25 bp, Rattus norvegicus
ccgaatgtataatgctgacgttctt

SEQ ID NO: 250654 - DNA, 25 bp, Rattus norvegicus
ccgaattgtttcatggtgccaggct

SEQ ID NO: 250655 - DNA, 25 bp, Rattus norvegicus
ccgaattgtttcttggtgccaggct

SEQ ID NO: 250656 - DNA, 25 bp, Rattus norvegicus
ccgacaacaattatacaacccagaa

SEQ ID NO: 250657 - DNA, 25 bp, Rattus norvegicus
ccgacaacaattttacaacccagaa

SEQ ID NO: 250658 - DNA, 25 bp, Rattus norvegicus
ccgacaagttccacaacggagttgg

SEQ ID NO: 250659 - DNA, 25 bp, Rattus norvegicus
ccgacaagttcctcaacggagttgg

SEQ ID NO: 250660 - DNA, 25 bp, Rattus norvegicus
ccgacactcgggagccactgtaggg

SEQ ID NO: 250661 - DNA, 25 bp, Rattus norvegicus
ccgacactcgggtgccactgtaggg

SEQ ID NO: 250662 - DNA, 25 bp, Rattus norvegicus
ccgacagagcggaacccatggttat

SEQ ID NO: 250663 - DNA, 25 bp, Rattus norvegicus
ccgacagagcggtacccatggttat

SEQ ID NO: 250664 - DNA, 25 bp, Rattus norvegicus
ccgacagcacgtcgagacatttttc

SEQ ID NO: 250665 - DNA, 25 bp, Rattus norvegicus
ccgacagcacgtggagacatttttc

SEQ ID NO: 250666 - DNA, 25 bp, Rattus norvegicus
ccgacaggctgcagtaggaggtaac

SEQ ID NO: 250667 - DNA, 25 bp, Rattus norvegicus
ccgacaggctgctgtaggaggtaac

SEQ ID NO: 250668 - DNA, 25 bp, Rattus norvegicus
ccgacaggtactactgctgcttgaa

SEQ ID NO: 250669 - DNA, 25 bp, Rattus norvegicus
ccgacaggtacttctgctgcttgaa

SEQ ID NO: 250670 - DNA, 25 bp, Rattus norvegicus
ccgacagtgggtaatgccttccgct

SEQ ID NO: 250671 - DNA, 25 bp, Rattus norvegicus
ccgacagtgggttatgccttccgct

SEQ ID NO: 250672 - DNA, 25 bp, Rattus norvegicus
ccgacatctgccaaaatctatctac

SEQ ID NO: 250673 - DNA, 25 bp, Rattus norvegicus
ccgacatctgcctaaatctatctac

SEQ ID NO: 250674 - DNA, 25 bp, Rattus norvegicus
ccgacatctgggaactcatacacat

SEQ ID NO: 250675 - DNA, 25 bp, Rattus norvegicus
ccgacatctgggtactcatacacat

SEQ ID NO: 250676 - DNA, 25 bp, Rattus norvegicus
ccgacatgagcacgcgcgaagagat

SEQ ID NO: 250677 - DNA, 25 bp, Rattus norvegicus
ccgacatgagcaggcgcgaagagat

SEQ ID NO: 250678 - DNA, 25 bp, Rattus norvegicus
ccgacatgatgtatggcttctgatg

SEQ ID NO: 250679 - DNA, 25 bp, Rattus norvegicus
ccgacatgatgtttggcttctgatg

SEQ ID NO: 250680 - DNA, 25 bp, Rattus norvegicus
ccgacattctgaaggccttctatat

SEQ ID NO: 250681 - DNA, 25 bp, Rattus norvegicus
ccgacattctgatggccttctatat

SEQ ID NO: 250682 - DNA, 25 bp, Rattus norvegicus
ccgaccacgactaggcttccttgtg

SEQ ID NO: 250683 - DNA, 25 bp, Rattus norvegicus
ccgaccacgacttggcttccttgtg

SEQ ID NO: 250684 - DNA, 25 bp, Rattus norvegicus
ccgacccagagaccttcctaaagga

SEQ ID NO: 250685 - DNA, 25 bp, Rattus norvegicus
ccgacccagagagcttcctaaagga

SEQ ID NO: 250686 - DNA, 25 bp, Rattus norvegicus
ccgaccccagtgatttcatagtatt

SEQ ID NO: 250687 - DNA, 25 bp, Rattus norvegicus
ccgaccccagtgttttcatagtatt

SEQ ID NO: 250688 - DNA, 25 bp, Rattus norvegicus
ccgacccgctatagtgtctgtaaat

SEQ ID NO: 250689 - DNA, 25 bp, Rattus norvegicus
ccgacccgctattgtgtctgtaaat

SEQ ID NO: 250690 - DNA, 25 bp, Rattus norvegicus
ccgacctaacctcaggacagatggg

SEQ ID NO: 250691 - DNA, 25 bp, Rattus norvegicus
ccgacctaacctgaggacagatggg

SEQ ID NO: 250692 - DNA, 25 bp, Rattus norvegicus
ccgacctcctagattctgggattat

SEQ ID NO: 250693 - DNA, 25 bp, Rattus norvegicus
ccgacctcctagtttctgggattat

SEQ ID NO: 250694 - DNA, 25 bp, Rattus norvegicus
ccgacctctctcaatttctgtgagg

SEQ ID NO: 250695 - DNA, 25 bp, Rattus norvegicus
ccgacctctctctatttctgtgagg

SEQ ID NO: 250696 - DNA, 25 bp, Rattus norvegicus
ccgacctctgacatgcatacatata

SEQ ID NO: 250697 - DNA, 25 bp, Rattus norvegicus
ccgacctctgacttgcatacatata

SEQ ID NO: 250698 - DNA, 25 bp, Rattus norvegicus
ccgacctgacttaatcagctcttac

SEQ ID NO: 250699 - DNA, 25 bp, Rattus norvegicus
ccgacctgactttatcagctcttac

SEQ ID NO: 250700 - DNA, 25 bp, Rattus norvegicus
ccgaccttgcagactcttattggag

SEQ ID NO: 250701 - DNA, 25 bp, Rattus norvegicus
ccgaccttgcagtctcttattggag

SEQ ID NO: 250702 - DNA, 25 bp, Rattus norvegicus
ccgacgagccaaatgtgcttttcca

SEQ ID NO: 250703 - DNA, 25 bp, Rattus norvegicus
ccgacgagccaattgtgcttttcca

SEQ ID NO: 250704 - DNA, 25 bp, Rattus norvegicus
ccgacgccagtacgtgacaggcgat

SEQ ID NO: 250705 - DNA, 25 bp, Rattus norvegicus
ccgacgccagtaggtgacaggcgat

SEQ ID NO: 250706 - DNA, 25 bp, Rattus norvegicus
ccgacgtatttcaatttatggcatc

SEQ ID NO: 250707 - DNA, 25 bp, Rattus norvegicus
ccgacgtatttctatttatggcatc

SEQ ID NO: 250708 - DNA, 25 bp, Rattus norvegicus
ccgacgtgtacacccgcgaagagtt

SEQ ID NO: 250709 - DNA, 25 bp, Rattus norvegicus
ccgacgtgtacagccgcgaagagtt

SEQ ID NO: 250710 - DNA, 25 bp, Rattus norvegicus
ccgactacagttatgtgtgtggtta

SEQ ID NO: 250711 - DNA, 25 bp, Rattus norvegicus
ccgactacagttttgtgtgtggtta

SEQ ID NO: 250712 - DNA, 25 bp, Rattus norvegicus
ccgactcttttcatgctggtcatga

SEQ ID NO: 250713 - DNA, 25 bp, Rattus norvegicus
ccgactcttttcttgctggtcatga

SEQ ID NO: 250714 - DNA, 25 bp, Rattus norvegicus
ccgactgccagcactgatatggaga

SEQ ID NO: 250715 - DNA, 25 bp, Rattus norvegicus
ccgactgccagctctgatatggaga

SEQ ID NO: 250716 - DNA, 25 bp, Rattus norvegicus
ccgactgcccctatgatcaagaaaa

SEQ ID NO: 250717 - DNA, 25 bp, Rattus norvegicus
ccgactgcccctttgatcaagaaaa

SEQ ID NO: 250718 - DNA, 25 bp, Rattus norvegicus
ccgactgcgtcgagtgcggtcagca

SEQ ID NO: 250719 - DNA, 25 bp, Rattus norvegicus
ccgactgcgtcgtgtgcggtcagca

SEQ ID NO: 250720 - DNA, 25 bp, Rattus norvegicus
ccgactggccaacggtgaacttctg

SEQ ID NO: 250721 - DNA, 25 bp, Rattus norvegicus
ccgactggccaagggtgaacttctg

SEQ ID NO: 250722 - DNA, 25 bp, Rattus norvegicus
ccgactggtctgagggtgtgcaggt

SEQ ID NO: 250723 - DNA, 25 bp, Rattus norvegicus
ccgactggtctgtgggtgtgcaggt

SEQ ID NO: 250724 - DNA, 25 bp, Rattus norvegicus
ccgacttcacttccatgtttggttt

SEQ ID NO: 250725 - DNA, 25 bp, Rattus norvegicus
ccgacttcacttgcatgtttggttt

SEQ ID NO: 250726 - DNA, 25 bp, Rattus norvegicus
ccgactttctctctgccttgaaaag

SEQ ID NO: 250727 - DNA, 25 bp, Rattus norvegicus
ccgactttctctgtgccttgaaaag

SEQ ID NO: 250728 - DNA, 25 bp, Rattus norvegicus
ccgagaaagagtctcagctcctgcg

SEQ ID NO: 250729 - DNA, 25 bp, Rattus norvegicus
ccgagaaagagtgtcagctcctgcg

SEQ ID NO: 250730 - DNA, 25 bp, Rattus norvegicus
ccgagaagttagaggcagagcatta

SEQ ID NO: 250731 - DNA, 25 bp, Rattus norvegicus
ccgagaagttagtggcagagcatta

SEQ ID NO: 250732 - DNA, 25 bp, Rattus norvegicus
ccgagaagttctagcgcgcctgggc

SEQ ID NO: 250733 - DNA, 25 bp, Rattus norvegicus
ccgagaagttcttgcgcgcctgggc

SEQ ID NO: 250734 - DNA, 25 bp, Rattus norvegicus
ccgagaccctgacgtggttaacgat

SEQ ID NO: 250735 - DNA, 25 bp, Rattus norvegicus
ccgagaccctgaggtggttaacgat

SEQ ID NO: 250736 - DNA, 25 bp, Rattus norvegicus
ccgagacccttgattgatagtgctt

SEQ ID NO: 250737 - DNA, 25 bp, Rattus norvegicus
ccgagacccttgtttgatagtgctt

SEQ ID NO: 250738 - DNA, 25 bp, Rattus norvegicus
ccgagactgggcaagtgggtaccca

SEQ ID NO: 250739 - DNA, 25 bp, Rattus norvegicus
ccgagactgggctagtgggtaccca

SEQ ID NO: 250740 - DNA, 25 bp, Rattus norvegicus
ccgagactggtcactctgcacggga

SEQ ID NO: 250741 - DNA, 25 bp, Rattus norvegicus
ccgagactggtctctctgcacggga

SEQ ID NO: 250742 - DNA, 25 bp, Rattus norvegicus
ccgagactgtggagcggaatcgcca

SEQ ID NO: 250743 - DNA, 25 bp, Rattus norvegicus
ccgagactgtggtgcggaatcgcca

SEQ ID NO: 250744 - DNA, 25 bp, Rattus norvegicus
ccgagagaaggcaagagaacagcta

SEQ ID NO: 250745 - DNA, 25 bp, Rattus norvegicus
ccgagagaaggctagagaacagcta

SEQ ID NO: 250746 - DNA, 25 bp, Rattus norvegicus
ccgagagcaaatccacgggctgccg

SEQ ID NO: 250747 - DNA, 25 bp, Rattus norvegicus
ccgagagcaaatgcacgggctgccg

SEQ ID NO: 250748 - DNA, 25 bp, Rattus norvegicus
ccgagagcagtcaggcggtcatgtc

SEQ ID NO: 250749 - DNA, 25 bp, Rattus norvegicus
ccgagagcagtctggcggtcatgtc

SEQ ID NO: 250750 - DNA, 25 bp, Rattus norvegicus
ccgagagcctagagcctctgaaagg

SEQ ID NO: 250751 - DNA, 25 bp, Rattus norvegicus
ccgagagcctagtgcctctgaaagg

SEQ ID NO: 250752 - DNA, 25 bp, Rattus norvegicus
ccgagagctcccaaggaaggatgga

SEQ ID NO: 250753 - DNA, 25 bp, Rattus norvegicus
ccgagagctccctaggaaggatgga

SEQ ID NO: 250754 - DNA, 25 bp, Rattus norvegicus
ccgagagctgttagacactgtccaa

SEQ ID NO: 250755 - DNA, 25 bp, Rattus norvegicus
ccgagagctgtttgacactgtccaa

SEQ ID NO: 250756 - DNA, 25 bp, Rattus norvegicus
ccgagagcttcgaggcagattacat

SEQ ID NO: 250757 - DNA, 25 bp, Rattus norvegicus
ccgagagcttcgtggcagattacat

SEQ ID NO: 250758 - DNA, 25 bp, Rattus norvegicus
ccgagagtttataaccttgcctcac

SEQ ID NO: 250759 - DNA, 25 bp, Rattus norvegicus
ccgagagtttattaccttgcctcac

SEQ ID NO: 250760 - DNA, 25 bp, Rattus norvegicus
ccgagataaaccctgtgttctgctc

SEQ ID NO: 250761 - DNA, 25 bp, Rattus norvegicus
ccgagataaaccgtgtgttctgctc

SEQ ID NO: 250762 - DNA, 25 bp, Rattus norvegicus
ccgagatcggcgaaaccgggaccag

SEQ ID NO: 250763 - DNA, 25 bp, Rattus norvegicus
ccgagatcggcgtaaccgggaccag

SEQ ID NO: 250764 - DNA, 25 bp, Rattus norvegicus
ccgagatgagaaaccttgtgggaca

SEQ ID NO: 250765 - DNA, 25 bp, Rattus norvegicus
ccgagatgagaatccttgtgggaca

SEQ ID NO: 250766 - DNA, 25 bp, Rattus norvegicus
ccgagcagcgagaactggttgagta

SEQ ID NO: 250767 - DNA, 25 bp, Rattus norvegicus
ccgagcagcgagtactggttgagta

SEQ ID NO: 250768 - DNA, 25 bp, Rattus norvegicus
ccgagccccaggagtcagaagcaaa

SEQ ID NO: 250769 - DNA, 25 bp, Rattus norvegicus
ccgagccccaggtgtcagaagcaaa

SEQ ID NO: 250770 - DNA, 25 bp, Rattus norvegicus
ccgagcccgacgaggacaaggagct

SEQ ID NO: 250771 - DNA, 25 bp, Rattus norvegicus
ccgagcccgacgtggacaaggagct

SEQ ID NO: 250772 - DNA, 25 bp, Rattus norvegicus
ccgagccctcagattattgcatgac

SEQ ID NO: 250773 - DNA, 25 bp, Rattus norvegicus
ccgagccctcagtttattgcatgac

SEQ ID NO: 250774 - DNA, 25 bp, Rattus norvegicus
ccgagccctgggatggttctagagc

SEQ ID NO: 250775 - DNA, 25 bp, Rattus norvegicus
ccgagccctgggttggttctagagc

SEQ ID NO: 250776 - DNA, 25 bp, Rattus norvegicus
ccgagccgagcacgaaggtttcaga

SEQ ID NO: 250777 - DNA, 25 bp, Rattus norvegicus
ccgagccgagcaggaaggtttcaga

SEQ ID NO: 250778 - DNA, 25 bp, Rattus norvegicus
ccgagccgtgcaccaagcgtgaaaa

SEQ ID NO: 250779 - DNA, 25 bp, Rattus norvegicus
ccgagccgtgcagcaagcgtgaaaa

SEQ ID NO: 250780 - DNA, 25 bp, Rattus norvegicus
ccgagcctggccagaggcagaggca

SEQ ID NO: 250781 - DNA, 25 bp, Rattus norvegicus
ccgagcctggcctgaggcagaggca

SEQ ID NO: 250782 - DNA, 25 bp, Rattus norvegicus
ccgagcctttagacgtgtacacagt

SEQ ID NO: 250783 - DNA, 25 bp, Rattus norvegicus
ccgagcctttagtcgtgtacacagt

SEQ ID NO: 250784 - DNA, 25 bp, Rattus norvegicus
ccgagcggagggactcttctcaggc

SEQ ID NO: 250785 - DNA, 25 bp, Rattus norvegicus
ccgagcggagggtctcttctcaggc

SEQ ID NO: 250786 - DNA, 25 bp, Rattus norvegicus
ccgagctcagctacacttgaatttt

SEQ ID NO: 250787 - DNA, 25 bp, Rattus norvegicus
ccgagctcagcttcacttgaatttt

SEQ ID NO: 250788 - DNA, 25 bp, Rattus norvegicus
ccgagctcagtcacagcatggacaa

SEQ ID NO: 250789 - DNA, 25 bp, Rattus norvegicus
ccgagctcagtctcagcatggacaa

SEQ ID NO: 250790 - DNA, 25 bp, Rattus norvegicus
ccgagctggccccagagagtttttt

SEQ ID NO: 250791 - DNA, 25 bp, Rattus norvegicus
ccgagctggcccgagagagtttttt

SEQ ID NO: 250792 - DNA, 25 bp, Rattus norvegicus
ccgagctgtgccattggcctggagt

SEQ ID NO: 250793 - DNA, 25 bp, Rattus norvegicus
ccgagctgtgcctttggcctggagt

SEQ ID NO: 250794 - DNA, 25 bp, Rattus norvegicus
ccgagcttagaacggctttcaggca

SEQ ID NO: 250795 - DNA, 25 bp, Rattus norvegicus
ccgagcttagaagggctttcaggca

SEQ ID NO: 250796 - DNA, 25 bp, Rattus norvegicus
ccgagcttcatgcttgggtttggcc

SEQ ID NO: 250797 - DNA, 25 bp, Rattus norvegicus
ccgagcttcatggttgggtttggcc

SEQ ID NO: 250798 - DNA, 25 bp, Rattus norvegicus
ccgagcttcgacattattggtgaca

SEQ ID NO: 250799 - DNA, 25 bp, Rattus norvegicus
ccgagcttcgactttattggtgaca

SEQ ID NO: 250800 - DNA, 25 bp, Rattus norvegicus
ccgagcttctcacaggagttctgga

SEQ ID NO: 250801 - DNA, 25 bp, Rattus norvegicus
ccgagcttctcagaggagttctgga

SEQ ID NO: 250802 - DNA, 25 bp, Rattus norvegicus
ccgaggaaacagcatcatcatgtta

SEQ ID NO: 250803 - DNA, 25 bp, Rattus norvegicus
ccgaggaaacaggatcatcatgtta

SEQ ID NO: 250804 - DNA, 25 bp, Rattus norvegicus
ccgaggaccagaccgcagaattcaa

SEQ ID NO: 250805 - DNA, 25 bp, Rattus norvegicus
ccgaggaccagagcgcagaattcaa

SEQ ID NO: 250806 - DNA, 25 bp, Rattus norvegicus
ccgaggacgaggcacttgcaaagct

SEQ ID NO: 250807 - DNA, 25 bp, Rattus norvegicus
ccgaggacgagggacttgcaaagct

SEQ ID NO: 250808 - DNA, 25 bp, Rattus norvegicus
ccgaggatgctcaggtgttttaata

SEQ ID NO: 250809 - DNA, 25 bp, Rattus norvegicus
ccgaggatgctctggtgttttaata

SEQ ID NO: 250810 - DNA, 25 bp, Rattus norvegicus
ccgaggcagtagagaccgtagagca

SEQ ID NO: 250811 - DNA, 25 bp, Rattus norvegicus
ccgaggcagtagtgaccgtagagca

SEQ ID NO: 250812 - DNA, 25 bp, Rattus norvegicus
ccgaggcagtttccatgagagcccc

SEQ ID NO: 250813 - DNA, 25 bp, Rattus norvegicus
ccgaggcagtttgcatgagagcccc

SEQ ID NO: 250814 - DNA, 25 bp, Rattus norvegicus
ccgaggcccagcagtcagggcacag

SEQ ID NO: 250815 - DNA, 25 bp, Rattus norvegicus
ccgaggcccagctgtcagggcacag

SEQ ID NO: 250816 - DNA, 25 bp, Rattus norvegicus
ccgaggcctgtactggtggaaacac

SEQ ID NO: 250817 - DNA, 25 bp, Rattus norvegicus
ccgaggcctgtagtggtggaaacac

SEQ ID NO: 250818 - DNA, 25 bp, Rattus norvegicus
ccgaggcgaacactgaggcaatcca

SEQ ID NO: 250819 - DNA, 25 bp, Rattus norvegicus
ccgaggcgaacagtgaggcaatcca

SEQ ID NO: 250820 - DNA, 25 bp, Rattus norvegicus
ccgaggctaattatccactatgcag

SEQ ID NO: 250821 - DNA, 25 bp, Rattus norvegicus
ccgaggctaattttccactatgcag

SEQ ID NO: 250822 - DNA, 25 bp, Rattus norvegicus
ccgaggctgtccatgtacgttaagt

SEQ ID NO: 250823 - DNA, 25 bp, Rattus norvegicus
ccgaggctgtccttgtacgttaagt

SEQ ID NO: 250824 - DNA, 25 bp, Rattus norvegicus
ccgagggcacttcgtgttctgatta

SEQ ID NO: 250825 - DNA, 25 bp, Rattus norvegicus
ccgagggcacttggtgttctgatta

SEQ ID NO: 250826 - DNA, 25 bp, Rattus norvegicus
ccgagggcctctaagcgtgaaggat

SEQ ID NO: 250827 - DNA, 25 bp, Rattus norvegicus
ccgagggcctcttagcgtgaaggat

SEQ ID NO: 250828 - DNA, 25 bp, Rattus norvegicus
ccgagggctttacggacttgtccat

SEQ ID NO: 250829 - DNA, 25 bp, Rattus norvegicus
ccgagggctttagggacttgtccat

SEQ ID NO: 250830 - DNA, 25 bp, Rattus norvegicus
ccgagggtcctacagctatgtggct

SEQ ID NO: 250831 - DNA, 25 bp, Rattus norvegicus
ccgagggtcctagagctatgtggct

SEQ ID NO: 250832 - DNA, 25 bp, Rattus norvegicus
ccgaggtcactaacctaagcgggat

SEQ ID NO: 250833 - DNA, 25 bp, Rattus norvegicus
ccgaggtcactatcctaagcgggat

SEQ ID NO: 250834 - DNA, 25 bp, Rattus norvegicus
ccgaggtcgcttaggcatcatggag

SEQ ID NO: 250835 - DNA, 25 bp, Rattus norvegicus
ccgaggtcgctttggcatcatggag

SEQ ID NO: 250836 - DNA, 25 bp, Rattus norvegicus
ccgaggtctataagaaccagtattt

SEQ ID NO: 250837 - DNA, 25 bp, Rattus norvegicus
ccgaggtctatatgaaccagtattt

SEQ ID NO: 250838 - DNA, 25 bp, Rattus norvegicus
ccgaggtctgttatcgctgagtcat

SEQ ID NO: 250839 - DNA, 25 bp, Rattus norvegicus
ccgaggtctgttttcgctgagtcat

SEQ ID NO: 250840 - DNA, 25 bp, Rattus norvegicus
ccgaggtcttttctctgcggctgcg

SEQ ID NO: 250841 - DNA, 25 bp, Rattus norvegicus
ccgaggtcttttgtctgcggctgcg

SEQ ID NO: 250842 - DNA, 25 bp, Rattus norvegicus
ccgagtaatgaaaacatcaaagctg

SEQ ID NO: 250843 - DNA, 25 bp, Rattus norvegicus
ccgagtaatgaatacatcaaagctg

SEQ ID NO: 250844 - DNA, 25 bp, Rattus norvegicus
ccgagtactaccacaatggcggcag

SEQ ID NO: 250845 - DNA, 25 bp, Rattus norvegicus
ccgagtactacctcaatggcggcag

SEQ ID NO: 250846 - DNA, 25 bp, Rattus norvegicus
ccgagtatccagagccgtgaaggca

SEQ ID NO: 250847 - DNA, 25 bp, Rattus norvegicus
ccgagtatccagtgccgtgaaggca

SEQ ID NO: 250848 - DNA, 25 bp, Rattus norvegicus
ccgagtatggtgctgtgcaccttta

SEQ ID NO: 250849 - DNA, 25 bp, Rattus norvegicus
ccgagtatggtggtgtgcaccttta

SEQ ID NO: 250850 - DNA, 25 bp, Rattus norvegicus
ccgagtcagtcgatatgttccaaga

SEQ ID NO: 250851 - DNA, 25 bp, Rattus norvegicus
ccgagtcagtcgttatgttccaaga

SEQ ID NO: 250852 - DNA, 25 bp, Rattus norvegicus
ccgagtccattcacttcaactagaa

SEQ ID NO: 250853 - DNA, 25 bp, Rattus norvegicus
ccgagtccattctcttcaactagaa

SEQ ID NO: 250854 - DNA, 25 bp, Rattus norvegicus
ccgagtgactgaagcgcccgcaggt

SEQ ID NO: 250855 - DNA, 25 bp, Rattus norvegicus
ccgagtgactgatgcgcccgcaggt

SEQ ID NO: 250856 - DNA, 25 bp, Rattus norvegicus
ccgagtgcacagctgcatgcttaat

SEQ ID NO: 250857 - DNA, 25 bp, Rattus norvegicus
ccgagtgcacaggtgcatgcttaat

SEQ ID NO: 250858 - DNA, 25 bp, Rattus norvegicus
ccgagtgccagtcttgccggttgtc

SEQ ID NO: 250859 - DNA, 25 bp, Rattus norvegicus
ccgagtgccagtgttgccggttgtc

SEQ ID NO: 250860 - DNA, 25 bp, Rattus norvegicus
ccgagtgcctcgaatttattcaatt

SEQ ID NO: 250861 - DNA, 25 bp, Rattus norvegicus
ccgagtgcctcgtatttattcaatt

SEQ ID NO: 250862 - DNA, 25 bp, Rattus norvegicus
ccgagtgcctgcagcttgtggtgaa

SEQ ID NO: 250863 - DNA, 25 bp, Rattus norvegicus
ccgagtgcctgctgcttgtggtgaa

SEQ ID NO: 250864 - DNA, 25 bp, Rattus norvegicus
ccgagtgtcggcagtggcgccatcc

SEQ ID NO: 250865 - DNA, 25 bp, Rattus norvegicus
ccgagtgtcggctgtggcgccatcc

SEQ ID NO: 250866 - DNA, 25 bp, Rattus norvegicus
ccgagtgtgatgacattgaaaccag

SEQ ID NO: 250867 - DNA, 25 bp, Rattus norvegicus
ccgagtgtgatgtcattgaaaccag

SEQ ID NO: 250868 - DNA, 25 bp, Rattus norvegicus
ccgagtgtgcaaaccctagggtgac

SEQ ID NO: 250869 - DNA, 25 bp, Rattus norvegicus
ccgagtgtgcaatccctagggtgac

SEQ ID NO: 250870 - DNA, 25 bp, Rattus norvegicus
ccgagtgtgccgatgactgctggca

SEQ ID NO: 250871 - DNA, 25 bp, Rattus norvegicus
ccgagtgtgccgttgactgctggca

SEQ ID NO: 250872 - DNA, 25 bp, Rattus norvegicus
ccgagttcgggcaacggcacggcac

SEQ ID NO: 250873 - DNA, 25 bp, Rattus norvegicus
ccgagttcgggctacggcacggcac

SEQ ID NO: 250874 - DNA, 25 bp, Rattus norvegicus
ccgagttctcgtcgtctctgtttga

SEQ ID NO: 250875 - DNA, 25 bp, Rattus norvegicus
ccgagttctcgtggtctctgtttga

SEQ ID NO: 250876 - DNA, 25 bp, Rattus norvegicus
ccgagttcttaaactttggtataag

SEQ ID NO: 250877 - DNA, 25 bp, Rattus norvegicus
ccgagttcttaatctttggtataag

SEQ ID NO: 250878 - DNA, 25 bp, Rattus norvegicus
ccgagttctttactttctcagcctg

SEQ ID NO: 250879 - DNA, 25 bp, Rattus norvegicus
ccgagttctttagtttctcagcctg

SEQ ID NO: 250880 - DNA, 25 bp, Rattus norvegicus
ccgagtttacccctaagagagctgg

SEQ ID NO: 250881 - DNA, 25 bp, Rattus norvegicus
ccgagtttacccgtaagagagctgg

SEQ ID NO: 250882 - DNA, 25 bp, Rattus norvegicus
ccgagtttctggatctgggttatga

SEQ ID NO: 250883 - DNA, 25 bp, Rattus norvegicus
ccgagtttctggttctgggttatga

SEQ ID NO: 250884 - DNA, 25 bp, Rattus norvegicus
ccgagtttgcagagattctaagtga

SEQ ID NO: 250885 - DNA, 25 bp, Rattus norvegicus
ccgagtttgcagtgattctaagtga

SEQ ID NO: 250886 - DNA, 25 bp, Rattus norvegicus
ccgagttttaatactggatctcatt

SEQ ID NO: 250887 - DNA, 25 bp, Rattus norvegicus
ccgagttttaattctggatctcatt

SEQ ID NO: 250888 - DNA, 25 bp, Rattus norvegicus
ccgataggctttagtgtcctgtttc

SEQ ID NO: 250889 - DNA, 25 bp, Rattus norvegicus
ccgataggcttttgtgtcctgtttc

SEQ ID NO: 250890 - DNA, 25 bp, Rattus norvegicus
ccgatcacagctatgcccttttgga

SEQ ID NO: 250891 - DNA, 25 bp, Rattus norvegicus
ccgatcacagctttgcccttttgga

SEQ ID NO: 250892 - DNA, 25 bp, Rattus norvegicus
ccgatcctttatatgtgtttggagc

SEQ ID NO: 250893 - DNA, 25 bp, Rattus norvegicus
ccgatcctttatttgtgtttggagc

SEQ ID NO: 250894 - DNA, 25 bp, Rattus norvegicus
ccgatctcgtctcatctcggaagct

SEQ ID NO: 250895 - DNA, 25 bp, Rattus norvegicus
ccgatctcgtctgatctcggaagct

SEQ ID NO: 250896 - DNA, 25 bp, Rattus norvegicus
ccgatcttctctagggtgacatgca

SEQ ID NO: 250897 - DNA, 25 bp, Rattus norvegicus
ccgatcttctcttgggtgacatgca

SEQ ID NO: 250898 - DNA, 25 bp, Rattus norvegicus
ccgatgagactcagcggctctggcg

SEQ ID NO: 250899 - DNA, 25 bp, Rattus norvegicus
ccgatgagactctgcggctctggcg

SEQ ID NO: 250900 - DNA, 25 bp, Rattus norvegicus
ccgatgaggatcacgttgcccgccg

SEQ ID NO: 250901 - DNA, 25 bp, Rattus norvegicus
ccgatgaggatctcgttgcccgccg

SEQ ID NO: 250902 - DNA, 25 bp, Rattus norvegicus
ccgatgagtctcaagggatctttgt

SEQ ID NO: 250903 - DNA, 25 bp, Rattus norvegicus
ccgatgagtctctagggatctttgt

SEQ ID NO: 250904 - DNA, 25 bp, Rattus norvegicus
ccgatgatattactgaggcctgaaa

SEQ ID NO: 250905 - DNA, 25 bp, Rattus norvegicus
ccgatgatattagtgaggcctgaaa

SEQ ID NO: 250906 - DNA, 25 bp, Rattus norvegicus
ccgatgcagctgacgaggagcgcca

SEQ ID NO: 250907 - DNA, 25 bp, Rattus norvegicus
ccgatgcagctgtcgaggagcgcca

SEQ ID NO: 250908 - DNA, 25 bp, Rattus norvegicus
ccgatgcatccacgtctataacaag

SEQ ID NO: 250909 - DNA, 25 bp, Rattus norvegicus
ccgatgcatccaggtctataacaag

SEQ ID NO: 250910 - DNA, 25 bp, Rattus norvegicus
ccgatgctacccagcagtgcaaaaa

SEQ ID NO: 250911 - DNA, 25 bp, Rattus norvegicus
ccgatgctaccctgcagtgcaaaaa

SEQ ID NO: 250912 - DNA, 25 bp, Rattus norvegicus
ccgatgctgcctcatcaggagagag

SEQ ID NO: 250913 - DNA, 25 bp, Rattus norvegicus
ccgatgctgcctgatcaggagagag

SEQ ID NO: 250914 - DNA, 25 bp, Rattus norvegicus
ccgatggagcccaggtgctgagctt

SEQ ID NO: 250915 - DNA, 25 bp, Rattus norvegicus
ccgatggagccctggtgctgagctt

SEQ ID NO: 250916 - DNA, 25 bp, Rattus norvegicus
ccgatggcacatacagggatatagc

SEQ ID NO: 250917 - DNA, 25 bp, Rattus norvegicus
ccgatggcacattcagggatatagc

SEQ ID NO: 250918 - DNA, 25 bp, Rattus norvegicus
ccgatggctccaatgcttacaaaga

SEQ ID NO: 250919 - DNA, 25 bp, Rattus norvegicus
ccgatggctccattgcttacaaaga

SEQ ID NO: 250920 - DNA, 25 bp, Rattus norvegicus
ccgatggtccgtcatcaccaaggaa

SEQ ID NO: 250921 - DNA, 25 bp, Rattus norvegicus
ccgatggtccgtgatcaccaaggaa

SEQ ID NO: 250922 - DNA, 25 bp, Rattus norvegicus
ccgatgtccgatccgggccattttg

SEQ ID NO: 250923 - DNA, 25 bp, Rattus norvegicus
ccgatgtccgatgcgggccattttg

SEQ ID NO: 250924 - DNA, 25 bp, Rattus norvegicus
ccgatgtgtctgctctggtagttta

SEQ ID NO: 250925 - DNA, 25 bp, Rattus norvegicus
ccgatgtgtctggtctggtagttta

SEQ ID NO: 250926 - DNA, 25 bp, Rattus norvegicus
ccgattcaccacaactgtacgtggt

SEQ ID NO: 250927 - DNA, 25 bp, Rattus norvegicus
ccgattcaccactactgtacgtggt

SEQ ID NO: 250928 - DNA, 25 bp, Rattus norvegicus
ccgattgaaaatagttgcgtccctt

SEQ ID NO: 250929 - DNA, 25 bp, Rattus norvegicus
ccgattgaaaattgttgcgtccctt

SEQ ID NO: 250930 - DNA, 25 bp, Rattus norvegicus
ccgatttccaagacatcttcgggaa

SEQ ID NO: 250931 - DNA, 25 bp, Rattus norvegicus
ccgatttccaagtcatcttcgggaa

SEQ ID NO: 250932 - DNA, 25 bp, Rattus norvegicus
ccgatttcctgtaagcatgggcttg

SEQ ID NO: 250933 - DNA, 25 bp, Rattus norvegicus
ccgatttcctgttagcatgggcttg

SEQ ID NO: 250934 - DNA, 25 bp, Rattus norvegicus
ccgcaacaacctactcattgagatg

SEQ ID NO: 250935 - DNA, 25 bp, Rattus norvegicus
ccgcaacaaccttctcattgagatg

SEQ ID NO: 250936 - DNA, 25 bp, Rattus norvegicus
ccgcaacttttgctggttcccgaga

SEQ ID NO: 250937 - DNA, 25 bp, Rattus norvegicus
ccgcaacttttggtggttcccgaga

SEQ ID NO: 250938 - DNA, 25 bp, Rattus norvegicus
ccgcaagcactgactgggaaggaaa

SEQ ID NO: 250939 - DNA, 25 bp, Rattus norvegicus
ccgcaagcactgtctgggaaggaaa

SEQ ID NO: 250940 - DNA, 25 bp, Rattus norvegicus
ccgcaaggagcaagaactggaggat

SEQ ID NO: 250941 - DNA, 25 bp, Rattus norvegicus
ccgcaaggagcatgaactggaggat

SEQ ID NO: 250942 - DNA, 25 bp, Rattus norvegicus
ccgcaaggattgacccagaatgggt

SEQ ID NO: 250943 - DNA, 25 bp, Rattus norvegicus
ccgcaaggattgtcccagaatgggt

SEQ ID NO: 250944 - DNA, 25 bp, Rattus norvegicus
ccgcaagtgctaccgcatggttggc

SEQ ID NO: 250945 - DNA, 25 bp, Rattus norvegicus
ccgcaagtgctagcgcatggttggc

SEQ ID NO: 250946 - DNA, 25 bp, Rattus norvegicus
ccgcaatgaaaacactgaggtgtct

SEQ ID NO: 250947 - DNA, 25 bp, Rattus norvegicus
ccgcaatgaaaagactgaggtgtct

SEQ ID NO: 250948 - DNA, 25 bp, Rattus norvegicus
ccgcaattctttaagacaggaacaa

SEQ ID NO: 250949 - DNA, 25 bp, Rattus norvegicus
ccgcaattcttttagacaggaacaa

SEQ ID NO: 250950 - DNA, 25 bp, Rattus norvegicus
ccgcacaaaaccaatgctctagtca

SEQ ID NO: 250951 - DNA, 25 bp, Rattus norvegicus
ccgcacaaaacctatgctctagtca

SEQ ID NO: 250952 - DNA, 25 bp, Rattus norvegicus
ccgcacattattactgcccagaatt

SEQ ID NO: 250953 - DNA, 25 bp, Rattus norvegicus
ccgcacattatttctgcccagaatt

SEQ ID NO: 250954 - DNA, 25 bp, Rattus norvegicus
ccgcacattttgcacgcattctgtt

SEQ ID NO: 250955 - DNA, 25 bp, Rattus norvegicus
ccgcacattttggacgcattctgtt

SEQ ID NO: 250956 - DNA, 25 bp, Rattus norvegicus
ccgcaccattcccgagtgtatagat

SEQ ID NO: 250957 - DNA, 25 bp, Rattus norvegicus
ccgcaccattccggagtgtatagat

SEQ ID NO: 250958 - DNA, 25 bp, Rattus norvegicus
ccgcacctgccaatagttgggcaat

SEQ ID NO: 250959 - DNA, 25 bp, Rattus norvegicus
ccgcacctgccattagttgggcaat

SEQ ID NO: 250960 - DNA, 25 bp, Rattus norvegicus
ccgcacctttgcagacattttattt

SEQ ID NO: 250961 - DNA, 25 bp, Rattus norvegicus
ccgcacctttgctgacattttattt

SEQ ID NO: 250962 - DNA, 25 bp, Rattus norvegicus
ccgcacgcactaacttttcaatata

SEQ ID NO: 250963 - DNA, 25 bp, Rattus norvegicus
ccgcacgcactatcttttcaatata

SEQ ID NO: 250964 - DNA, 25 bp, Rattus norvegicus
ccgcacgggcagaggatgttgacct

SEQ ID NO: 250965 - DNA, 25 bp, Rattus norvegicus
ccgcacgggcagtggatgttgacct

SEQ ID NO: 250966 - DNA, 25 bp, Rattus norvegicus
ccgcacgtacagcttgggcaagagt

SEQ ID NO: 250967 - DNA, 25 bp, Rattus norvegicus
ccgcacgtacaggttgggcaagagt

SEQ ID NO: 250968 - DNA, 25 bp, Rattus norvegicus
ccgcacgtatgtctgggcactaaat

SEQ ID NO: 250969 - DNA, 25 bp, Rattus norvegicus
ccgcacgtatgtgtgggcactaaat

SEQ ID NO: 250970 - DNA, 25 bp, Rattus norvegicus
ccgcactactcaactaagcttagct

SEQ ID NO: 250971 - DNA, 25 bp, Rattus norvegicus
ccgcactactcatctaagcttagct

SEQ ID NO: 250972 - DNA, 25 bp, Rattus norvegicus
ccgcagacctggaaggttgtctttt

SEQ ID NO: 250973 - DNA, 25 bp, Rattus norvegicus
ccgcagacctggtaggttgtctttt

SEQ ID NO: 250974 - DNA, 25 bp, Rattus norvegicus
ccgcagagcgaacggcccaggcttt

SEQ ID NO: 250975 - DNA, 25 bp, Rattus norvegicus
ccgcagagcgaagggcccaggcttt

SEQ ID NO: 250976 - DNA, 25 bp, Rattus norvegicus
ccgcagaggtcaatgtggagtccct

SEQ ID NO: 250977 - DNA, 25 bp, Rattus norvegicus
ccgcagaggtcattgtggagtccct

SEQ ID NO: 250978 - DNA, 25 bp, Rattus norvegicus
ccgcagatcggacgcgggcgaagat

SEQ ID NO: 250979 - DNA, 25 bp, Rattus norvegicus
ccgcagatcggaggcgggcgaagat

SEQ ID NO: 250980 - DNA, 25 bp, Rattus norvegicus
ccgcagcacttgataacggtcacaa

SEQ ID NO: 250981 - DNA, 25 bp, Rattus norvegicus
ccgcagcacttgttaacggtcacaa

SEQ ID NO: 250982 - DNA, 25 bp, Rattus norvegicus
ccgcagcagtgtctctgaggactaa

SEQ ID NO: 250983 - DNA, 25 bp, Rattus norvegicus
ccgcagcagtgtgtctgaggactaa

SEQ ID NO: 250984 - DNA, 25 bp, Rattus norvegicus
ccgcagctctgcactgggagactga

SEQ ID NO: 250985 - DNA, 25 bp, Rattus norvegicus
ccgcagctctgctctgggagactga

SEQ ID NO: 250986 - DNA, 25 bp, Rattus norvegicus
ccgcagctgtgtacttgtttgcatt

SEQ ID NO: 250987 - DNA, 25 bp, Rattus norvegicus
ccgcagctgtgttcttgtttgcatt

SEQ ID NO: 250988 - DNA, 25 bp, Rattus norvegicus
ccgcagcttctgaagtgtgggacaa

SEQ ID NO: 250989 - DNA, 25 bp, Rattus norvegicus
ccgcagcttctgtagtgtgggacaa

SEQ ID NO: 250990 - DNA, 25 bp, Rattus norvegicus
ccgcaggaagttcccgcaaaacttt

SEQ ID NO: 250991 - DNA, 25 bp, Rattus norvegicus
ccgcaggaagttgccgcaaaacttt

SEQ ID NO: 250992 - DNA, 25 bp, Rattus norvegicus
ccgcaggcctacacactatgttagt

SEQ ID NO: 250993 - DNA, 25 bp, Rattus norvegicus
ccgcaggcctactcactatgttagt

SEQ ID NO: 250994 - DNA, 25 bp, Rattus norvegicus
ccgcagggcggtcttggaggtgact

SEQ ID NO: 250995 - DNA, 25 bp, Rattus norvegicus
ccgcagggcggtgttggaggtgact

SEQ ID NO: 250996 - DNA, 25 bp, Rattus norvegicus
ccgcagggtggcaacggttctgtaa

SEQ ID NO: 250997 - DNA, 25 bp, Rattus norvegicus
ccgcagggtggctacggttctgtaa

SEQ ID NO: 250998 - DNA, 25 bp, Rattus norvegicus
ccgcagtcacacattagggttagta

SEQ ID NO: 250999 - DNA, 25 bp, Rattus norvegicus
ccgcagtcacactttagggttagta

SEQ ID NO: 251000 - DNA, 25 bp, Rattus norvegicus
ccgcagtgtcgcaatggaaacagaa

SEQ ID NO: 251001 - DNA, 25 bp, Rattus norvegicus
ccgcagtgtcgctatggaaacagaa

SEQ ID NO: 251002 - DNA, 25 bp, Rattus norvegicus
ccgcagtgtggccaccaacgctgtg

SEQ ID NO: 251003 - DNA, 25 bp, Rattus norvegicus
ccgcagtgtggcgaccaacgctgtg

SEQ ID NO: 251004 - DNA, 25 bp, Rattus norvegicus
ccgcagttctgtatgtttaccatca

SEQ ID NO: 251005 - DNA, 25 bp, Rattus norvegicus
ccgcagttctgtttgtttaccatca

SEQ ID NO: 251006 - DNA, 25 bp, Rattus norvegicus
ccgcagttggtgaagctgcaagtgt

SEQ ID NO: 251007 - DNA, 25 bp, Rattus norvegicus
ccgcagttggtgtagctgcaagtgt

SEQ ID NO: 251008 - DNA, 25 bp, Rattus norvegicus
ccgcatcccctaaataaccgaaaat

SEQ ID NO: 251009 - DNA, 25 bp, Rattus norvegicus
ccgcatcccctatataaccgaaaat

SEQ ID NO: 251010 - DNA, 25 bp, Rattus norvegicus
ccgcatctcccaattgaccaaaatt

SEQ ID NO: 251011 - DNA, 25 bp, Rattus norvegicus
ccgcatctcccatttgaccaaaatt

SEQ ID NO: 251012 - DNA, 25 bp, Rattus norvegicus
ccgcatctctggctacaatggtgat

SEQ ID NO: 251013 - DNA, 25 bp, Rattus norvegicus
ccgcatctctgggtacaatggtgat

SEQ ID NO: 251014 - DNA, 25 bp, Rattus norvegicus
ccgcatcttttcattcgatggcaga

SEQ ID NO: 251015 - DNA, 25 bp, Rattus norvegicus
ccgcatcttttctttcgatggcaga

SEQ ID NO: 251016 - DNA, 25 bp, Rattus norvegicus
ccgcatggtgctagcagttttaaat

SEQ ID NO: 251017 - DNA, 25 bp, Rattus norvegicus
ccgcatggtgcttgcagttttaaat

SEQ ID NO: 251018 - DNA, 25 bp, Rattus norvegicus
ccgcattccaacatctctgattggt

SEQ ID NO: 251019 - DNA, 25 bp, Rattus norvegicus
ccgcattccaacttctctgattggt

SEQ ID NO: 251020 - DNA, 25 bp, Rattus norvegicus
ccgcattggtggatctggcagagac

SEQ ID NO: 251021 - DNA, 25 bp, Rattus norvegicus
ccgcattggtggttctggcagagac

SEQ ID NO: 251022 - DNA, 25 bp, Rattus norvegicus
ccgcattgtgcgcagacttcagaac

SEQ ID NO: 251023 - DNA, 25 bp, Rattus norvegicus
ccgcattgtgcggagacttcagaac

SEQ ID NO: 251024 - DNA, 25 bp, Rattus norvegicus
ccgccaaattgcagacttctaacat

SEQ ID NO: 251025 - DNA, 25 bp, Rattus norvegicus
ccgccaaattgctgacttctaacat

SEQ ID NO: 251026 - DNA, 25 bp, Rattus norvegicus
ccgccacctttgatgagctgaaagt

SEQ ID NO: 251027 - DNA, 25 bp, Rattus norvegicus
ccgccacctttgttgagctgaaagt

SEQ ID NO: 251028 - DNA, 25 bp, Rattus norvegicus
ccgccactgttgcacatttactgag

SEQ ID NO: 251029 - DNA, 25 bp, Rattus norvegicus
ccgccactgttggacatttactgag

SEQ ID NO: 251030 - DNA, 25 bp, Rattus norvegicus
ccgccagccaccagagggtgaaggt

SEQ ID NO: 251031 - DNA, 25 bp, Rattus norvegicus
ccgccagccacctgagggtgaaggt

SEQ ID NO: 251032 - DNA, 25 bp, Rattus norvegicus
ccgccagtgcgcacagagagagcaa

SEQ ID NO: 251033 - DNA, 25 bp, Rattus norvegicus
ccgccagtgcgctcagagagagcaa

SEQ ID NO: 251034 - DNA, 25 bp, Rattus norvegicus
ccgccataccggcagtgtggtcata

SEQ ID NO: 251035 - DNA, 25 bp, Rattus norvegicus
ccgccataccgggagtgtggtcata

SEQ ID NO: 251036 - DNA, 25 bp, Rattus norvegicus
ccgccatccatcatctgtagttgat

SEQ ID NO: 251037 - DNA, 25 bp, Rattus norvegicus
ccgccatccatcttctgtagttgat

SEQ ID NO: 251038 - DNA, 25 bp, Rattus norvegicus
ccgccatctaaacagtgcgctttta

SEQ ID NO: 251039 - DNA, 25 bp, Rattus norvegicus
ccgccatctaaagagtgcgctttta

SEQ ID NO: 251040 - DNA, 25 bp, Rattus norvegicus
ccgccatgatccagctggaggtgaa

SEQ ID NO: 251041 - DNA, 25 bp, Rattus norvegicus
ccgccatgatcctgctggaggtgaa

SEQ ID NO: 251042 - DNA, 25 bp, Rattus norvegicus
ccgccatgccttaggtgttggaaaa

SEQ ID NO: 251043 - DNA, 25 bp, Rattus norvegicus
ccgccatgcctttggtgttggaaaa

SEQ ID NO: 251044 - DNA, 25 bp, Rattus norvegicus
ccgccatgttccagctttgatggaa

SEQ ID NO: 251045 - DNA, 25 bp, Rattus norvegicus
ccgccatgttcctgctttgatggaa

SEQ ID NO: 251046 - DNA, 25 bp, Rattus norvegicus
ccgcccaccaagagttagagcctaa

SEQ ID NO: 251047 - DNA, 25 bp, Rattus norvegicus
ccgcccaccaagtgttagagcctaa

SEQ ID NO: 251048 - DNA, 25 bp, Rattus norvegicus
ccgcccaggcagagtatgtggagaa

SEQ ID NO: 251049 - DNA, 25 bp, Rattus norvegicus
ccgcccaggcagtgtatgtggagaa

SEQ ID NO: 251050 - DNA, 25 bp, Rattus norvegicus
ccgcccattcgcacaggttaaagga

SEQ ID NO: 251051 - DNA, 25 bp, Rattus norvegicus
ccgcccattcgctcaggttaaagga

SEQ ID NO: 251052 - DNA, 25 bp, Rattus norvegicus
ccgccccaacagagacggatttttg

SEQ ID NO: 251053 - DNA, 25 bp, Rattus norvegicus
ccgccccaacagtgacggatttttg

SEQ ID NO: 251054 - DNA, 25 bp, Rattus norvegicus
ccgcccctagttaagctagtcaaat

SEQ ID NO: 251055 - DNA, 25 bp, Rattus norvegicus
ccgcccctagtttagctagtcaaat

SEQ ID NO: 251056 - DNA, 25 bp, Rattus norvegicus
ccgcccctttccagtcatctttggg

SEQ ID NO: 251057 - DNA, 25 bp, Rattus norvegicus
ccgcccctttcctgtcatctttggg

SEQ ID NO: 251058 - DNA, 25 bp, Rattus norvegicus
ccgcccgctgacattatttttatat

SEQ ID NO: 251059 - DNA, 25 bp, Rattus norvegicus
ccgcccgctgactttatttttatat

SEQ ID NO: 251060 - DNA, 25 bp, Rattus norvegicus
ccgcccggtcgcagcgtgaagctga

SEQ ID NO: 251061 - DNA, 25 bp, Rattus norvegicus
ccgcccggtcgctgcgtgaagctga

SEQ ID NO: 251062 - DNA, 25 bp, Rattus norvegicus
ccgcccgtttgtagcagcttattat

SEQ ID NO: 251063 - DNA, 25 bp, Rattus norvegicus
ccgcccgtttgttgcagcttattat

SEQ ID NO: 251064 - DNA, 25 bp, Rattus norvegicus
ccgccctaggcaccagggtgtgatg

SEQ ID NO: 251065 - DNA, 25 bp, Rattus norvegicus
ccgccctaggcagcagggtgtgatg

SEQ ID NO: 251066 - DNA, 25 bp, Rattus norvegicus
ccgccctagtccctgggcagagaac

SEQ ID NO: 251067 - DNA, 25 bp, Rattus norvegicus
ccgccctagtccgtgggcagagaac

SEQ ID NO: 251068 - DNA, 25 bp, Rattus norvegicus
ccgcccttacgcatttggagaagat

SEQ ID NO: 251069 - DNA, 25 bp, Rattus norvegicus
ccgcccttacgcttttggagaagat

SEQ ID NO: 251070 - DNA, 25 bp, Rattus norvegicus
ccgcccttatgtcactcctgaaaga

SEQ ID NO: 251071 - DNA, 25 bp, Rattus norvegicus
ccgcccttatgtgactcctgaaaga

SEQ ID NO: 251072 - DNA, 25 bp, Rattus norvegicus
ccgcccttcatgatggatccaatgt

SEQ ID NO: 251073 - DNA, 25 bp, Rattus norvegicus
ccgcccttcatgttggatccaatgt

SEQ ID NO: 251074 - DNA, 25 bp, Rattus norvegicus
ccgcccttggagatgctggaggaat

SEQ ID NO: 251075 - DNA, 25 bp, Rattus norvegicus
ccgcccttggagttgctggaggaat

SEQ ID NO: 251076 - DNA, 25 bp, Rattus norvegicus
ccgccctttggtctggatacctttg

SEQ ID NO: 251077 - DNA, 25 bp, Rattus norvegicus
ccgccctttggtgtggatacctttg

SEQ ID NO: 251078 - DNA, 25 bp, Rattus norvegicus
ccgccgcggtgcagccaagaagaaa

SEQ ID NO: 251079 - DNA, 25 bp, Rattus norvegicus
ccgccgcggtgctgccaagaagaaa

SEQ ID NO: 251080 - DNA, 25 bp, Rattus norvegicus
ccgccggacctgacgcgtgatggac

SEQ ID NO: 251081 - DNA, 25 bp, Rattus norvegicus
ccgccggacctgtcgcgtgatggac

SEQ ID NO: 251082 - DNA, 25 bp, Rattus norvegicus
ccgccgtccaatattaatcatcgtt

SEQ ID NO: 251083 - DNA, 25 bp, Rattus norvegicus
ccgccgtccaattttaatcatcgtt

SEQ ID NO: 251084 - DNA, 25 bp, Rattus norvegicus
ccgccgtgacacattctacaaggag

SEQ ID NO: 251085 - DNA, 25 bp, Rattus norvegicus
ccgccgtgacactttctacaaggag

SEQ ID NO: 251086 - DNA, 25 bp, Rattus norvegicus
ccgccgtggcttcgataatgactat

SEQ ID NO: 251087 - DNA, 25 bp, Rattus norvegicus
ccgccgtggcttggataatgactat

SEQ ID NO: 251088 - DNA, 25 bp, Rattus norvegicus
ccgcctacagtgctatgcctaataa

SEQ ID NO: 251089 - DNA, 25 bp, Rattus norvegicus
ccgcctacagtggtatgcctaataa

SEQ ID NO: 251090 - DNA, 25 bp, Rattus norvegicus
ccgcctaccttgcttcaatggaagg

SEQ ID NO: 251091 - DNA, 25 bp, Rattus norvegicus
ccgcctaccttggttcaatggaagg

SEQ ID NO: 251092 - DNA, 25 bp, Rattus norvegicus
ccgcctagacatcgctctgaggaga

SEQ ID NO: 251093 - DNA, 25 bp, Rattus norvegicus
ccgcctagacatggctctgaggaga

SEQ ID NO: 251094 - DNA, 25 bp, Rattus norvegicus
ccgcctaggtacacatggtcaaact

SEQ ID NO: 251095 - DNA, 25 bp, Rattus norvegicus
ccgcctaggtactcatggtcaaact

SEQ ID NO: 251096 - DNA, 25 bp, Rattus norvegicus
ccgcctcaaaacactgcgtagttta

SEQ ID NO: 251097 - DNA, 25 bp, Rattus norvegicus
ccgcctcaaaactctgcgtagttta

SEQ ID NO: 251098 - DNA, 25 bp, Rattus norvegicus
ccgcctcaagcgctggaattaaagg

SEQ ID NO: 251099 - DNA, 25 bp, Rattus norvegicus
ccgcctcaagcggtggaattaaagg

SEQ ID NO: 251100 - DNA, 25 bp, Rattus norvegicus
ccgcctcctggtagtgggagagcaa

SEQ ID NO: 251101 - DNA, 25 bp, Rattus norvegicus
ccgcctcctggttgtgggagagcaa

SEQ ID NO: 251102 - DNA, 25 bp, Rattus norvegicus
ccgcctgaccttacaatgatactta

SEQ ID NO: 251103 - DNA, 25 bp, Rattus norvegicus
ccgcctgacctttcaatgatactta

SEQ ID NO: 251104 - DNA, 25 bp, Rattus norvegicus
ccgcctgcatgtcgatggtggtcct

SEQ ID NO: 251105 - DNA, 25 bp, Rattus norvegicus
ccgcctgcatgtggatggtggtcct

SEQ ID NO: 251106 - DNA, 25 bp, Rattus norvegicus
ccgcctgccattaagatttttccaa

SEQ ID NO: 251107 - DNA, 25 bp, Rattus norvegicus
ccgcctgccatttagatttttccaa

SEQ ID NO: 251108 - DNA, 25 bp, Rattus norvegicus
ccgcctgccttactgttgtaacaag

SEQ ID NO: 251109 - DNA, 25 bp, Rattus norvegicus
ccgcctgccttagtgttgtaacaag

SEQ ID NO: 251110 - DNA, 25 bp, Rattus norvegicus
ccgcctgctggaaaaggctgaaaac

SEQ ID NO: 251111 - DNA, 25 bp, Rattus norvegicus
ccgcctgctggataaggctgaaaac

SEQ ID NO: 251112 - DNA, 25 bp, Rattus norvegicus
ccgcctggaccacaagtttgacttg

SEQ ID NO: 251113 - DNA, 25 bp, Rattus norvegicus
ccgcctggaccagaagtttgacttg

SEQ ID NO: 251114 - DNA, 25 bp, Rattus norvegicus
ccgcctggacttcttaagactatct

SEQ ID NO: 251115 - DNA, 25 bp, Rattus norvegicus
ccgcctggacttgttaagactatct

SEQ ID NO: 251116 - DNA, 25 bp, Rattus norvegicus
ccgcctggagaaacctgccaagtat

SEQ ID NO: 251117 - DNA, 25 bp, Rattus norvegicus
ccgcctggagaatcctgccaagtat

SEQ ID NO: 251118 - DNA, 25 bp, Rattus norvegicus
ccgcctgggaataccgggtgctgta

SEQ ID NO: 251119 - DNA, 25 bp, Rattus norvegicus
ccgcctgggaattccgggtgctgta

SEQ ID NO: 251120 - DNA, 25 bp, Rattus norvegicus
ccgcctggttgaaattctggcattt

SEQ ID NO: 251121 - DNA, 25 bp, Rattus norvegicus
ccgcctggttgatattctggcattt

SEQ ID NO: 251122 - DNA, 25 bp, Rattus norvegicus
ccgcctgtgcttcactgacagtata

SEQ ID NO: 251123 - DNA, 25 bp, Rattus norvegicus
ccgcctgtgcttgactgacagtata

SEQ ID NO: 251124 - DNA, 25 bp, Rattus norvegicus
ccgcctgtgggaccctgaattgata

SEQ ID NO: 251125 - DNA, 25 bp, Rattus norvegicus
ccgcctgtgggagcctgaattgata

SEQ ID NO: 251126 - DNA, 25 bp, Rattus norvegicus
ccgccttctcaaagtcagtggcaga

SEQ ID NO: 251127 - DNA, 25 bp, Rattus norvegicus
ccgccttctcaatgtcagtggcaga

SEQ ID NO: 251128 - DNA, 25 bp, Rattus norvegicus
ccgccttgagccagtgagtaagtac

SEQ ID NO: 251129 - DNA, 25 bp, Rattus norvegicus
ccgccttgagcctgtgagtaagtac

SEQ ID NO: 251130 - DNA, 25 bp, Rattus norvegicus
ccgccttttatgaggtggagtgcat

SEQ ID NO: 251131 - DNA, 25 bp, Rattus norvegicus
ccgccttttatgtggtggagtgcat

SEQ ID NO: 251132 - DNA, 25 bp, Rattus norvegicus
ccgcgacagagaaggccggccctga

SEQ ID NO: 251133 - DNA, 25 bp, Rattus norvegicus
ccgcgacagagatggccggccctga

SEQ ID NO: 251134 - DNA, 25 bp, Rattus norvegicus
ccgcgagccggcagctgagtaatcc

SEQ ID NO: 251135 - DNA, 25 bp, Rattus norvegicus
ccgcgagccggctgctgagtaatcc

SEQ ID NO: 251136 - DNA, 25 bp, Rattus norvegicus
ccgcgatattgccagaggctcaaaa

SEQ ID NO: 251137 - DNA, 25 bp, Rattus norvegicus
ccgcgatattgcgagaggctcaaaa

SEQ ID NO: 251138 - DNA, 25 bp, Rattus norvegicus
ccgcgatccattaaataaagaatct

SEQ ID NO: 251139 - DNA, 25 bp, Rattus norvegicus
ccgcgatccatttaataaagaatct

SEQ ID NO: 251140 - DNA, 25 bp, Rattus norvegicus
ccgcgatcgggcacggctagtcacg

SEQ ID NO: 251141 - DNA, 25 bp, Rattus norvegicus
ccgcgatcgggctcggctagtcacg

SEQ ID NO: 251142 - DNA, 25 bp, Rattus norvegicus
ccgcgatgctggagcagatcgccat

SEQ ID NO: 251143 - DNA, 25 bp, Rattus norvegicus
ccgcgatgctggtgcagatcgccat

SEQ ID NO: 251144 - DNA, 25 bp, Rattus norvegicus
ccgcgatttcatatccattttaggt

SEQ ID NO: 251145 - DNA, 25 bp, Rattus norvegicus
ccgcgatttcatttccattttaggt

SEQ ID NO: 251146 - DNA, 25 bp, Rattus norvegicus
ccgcgcacggtcaagaaggtactgg

SEQ ID NO: 251147 - DNA, 25 bp, Rattus norvegicus
ccgcgcacggtctagaaggtactgg

SEQ ID NO: 251148 - DNA, 25 bp, Rattus norvegicus
ccgcgcagcttgaacgactaaagca

SEQ ID NO: 251149 - DNA, 25 bp, Rattus norvegicus
ccgcgcagcttgtacgactaaagca

SEQ ID NO: 251150 - DNA, 25 bp, Rattus norvegicus
ccgcgcattatcactgctgaatgga

SEQ ID NO: 251151 - DNA, 25 bp, Rattus norvegicus
ccgcgcattatctctgctgaatgga

SEQ ID NO: 251152 - DNA, 25 bp, Rattus norvegicus
ccgcgccgccagaagagctggaaga

SEQ ID NO: 251153 - DNA, 25 bp, Rattus norvegicus
ccgcgccgccagtagagctggaaga

SEQ ID NO: 251154 - DNA, 25 bp, Rattus norvegicus
ccgcgcgccttacagtttggtttag

SEQ ID NO: 251155 - DNA, 25 bp, Rattus norvegicus
ccgcgcgccttagagtttggtttag

SEQ ID NO: 251156 - DNA, 25 bp, Rattus norvegicus
ccgcgctcaaggacatcaacatggg

SEQ ID NO: 251157 - DNA, 25 bp, Rattus norvegicus
ccgcgctcaaggtcatcaacatggg

SEQ ID NO: 251158 - DNA, 25 bp, Rattus norvegicus
ccgcgctcactaatttatttccaag

SEQ ID NO: 251159 - DNA, 25 bp, Rattus norvegicus
ccgcgctcactattttatttccaag

SEQ ID NO: 251160 - DNA, 25 bp, Rattus norvegicus
ccgcgctgctagctttagagtctga

SEQ ID NO: 251161 - DNA, 25 bp, Rattus norvegicus
ccgcgctgctaggtttagagtctga

SEQ ID NO: 251162 - DNA, 25 bp, Rattus norvegicus
ccgcgcttttgtcatggagtgctgt

SEQ ID NO: 251163 - DNA, 25 bp, Rattus norvegicus
ccgcgcttttgtgatggagtgctgt

SEQ ID NO: 251164 - DNA, 25 bp, Rattus norvegicus
ccgcggaatatgctcatctggtaca

SEQ ID NO: 251165 - DNA, 25 bp, Rattus norvegicus
ccgcggaatatggtcatctggtaca

SEQ ID NO: 251166 - DNA, 25 bp, Rattus norvegicus
ccgcggagccttctttggtgcaaat

SEQ ID NO: 251167 - DNA, 25 bp, Rattus norvegicus
ccgcggagccttgtttggtgcaaat

SEQ ID NO: 251168 - DNA, 25 bp, Rattus norvegicus
ccgcggcacacgaggactgcagagc

SEQ ID NO: 251169 - DNA, 25 bp, Rattus norvegicus
ccgcggcacacgtggactgcagagc

SEQ ID NO: 251170 - DNA, 25 bp, Rattus norvegicus
ccgcggcatcgactgagctaagaga

SEQ ID NO: 251171 - DNA, 25 bp, Rattus norvegicus
ccgcggcatcgagtgagctaagaga

SEQ ID NO: 251172 - DNA, 25 bp, Rattus norvegicus
ccgcggcgcaagcagaagccccgct

SEQ ID NO: 251173 - DNA, 25 bp, Rattus norvegicus
ccgcggcgcaaggagaagccccgct

SEQ ID NO: 251174 - DNA, 25 bp, Rattus norvegicus
ccgcggcggtgaatcacacgggaca

SEQ ID NO: 251175 - DNA, 25 bp, Rattus norvegicus
ccgcggcggtgattcacacgggaca

SEQ ID NO: 251176 - DNA, 25 bp, Rattus norvegicus
ccgcggctctgcagtatattttcaa

SEQ ID NO: 251177 - DNA, 25 bp, Rattus norvegicus
ccgcggctctgctgtatattttcaa

SEQ ID NO: 251178 - DNA, 25 bp, Rattus norvegicus
ccgcgggcaggaagaatcgagccaa

SEQ ID NO: 251179 - DNA, 25 bp, Rattus norvegicus
ccgcgggcaggatgaatcgagccaa

SEQ ID NO: 251180 - DNA, 25 bp, Rattus norvegicus
ccgcgggtgtaactcttttgtcttg

SEQ ID NO: 251181 - DNA, 25 bp, Rattus norvegicus
ccgcgggtgtaagtcttttgtcttg

SEQ ID NO: 251182 - DNA, 25 bp, Rattus norvegicus
ccgcggtccggcaccagcgtgtagt

SEQ ID NO: 251183 - DNA, 25 bp, Rattus norvegicus
ccgcggtccggctccagcgtgtagt

SEQ ID NO: 251184 - DNA, 25 bp, Rattus norvegicus
ccgcggtggttgaagcgtctccaag

SEQ ID NO: 251185 - DNA, 25 bp, Rattus norvegicus
ccgcggtggttgtagcgtctccaag

SEQ ID NO: 251186 - DNA, 25 bp, Rattus norvegicus
ccgcggtgtcggagctggccccaaa

SEQ ID NO: 251187 - DNA, 25 bp, Rattus norvegicus
ccgcggtgtcggtgctggccccaaa

SEQ ID NO: 251188 - DNA, 25 bp, Rattus norvegicus
ccgcgtcagcttcttttgttgggaa

SEQ ID NO: 251189 - DNA, 25 bp, Rattus norvegicus
ccgcgtcagcttgttttgttgggaa

SEQ ID NO: 251190 - DNA, 25 bp, Rattus norvegicus
ccgcgtcgtggtagctctgtaagga

SEQ ID NO: 251191 - DNA, 25 bp, Rattus norvegicus
ccgcgtcgtggttgctctgtaagga

SEQ ID NO: 251192 - DNA, 25 bp, Rattus norvegicus
ccgcgtgaacaacgatgagaccggg

SEQ ID NO: 251193 - DNA, 25 bp, Rattus norvegicus
ccgcgtgaacaaggatgagaccggg

SEQ ID NO: 251194 - DNA, 25 bp, Rattus norvegicus
ccgcgtgattgcagggcccgctgcc

SEQ ID NO: 251195 - DNA, 25 bp, Rattus norvegicus
ccgcgtgattgctgggcccgctgcc

SEQ ID NO: 251196 - DNA, 25 bp, Rattus norvegicus
ccgcgtgcccagacagaggaagatt

SEQ ID NO: 251197 - DNA, 25 bp, Rattus norvegicus
ccgcgtgcccagtcagaggaagatt

SEQ ID NO: 251198 - DNA, 25 bp, Rattus norvegicus
ccgcgtgcctgaaatttttgtttgt

SEQ ID NO: 251199 - DNA, 25 bp, Rattus norvegicus
ccgcgtgcctgatatttttgtttgt

SEQ ID NO: 251200 - DNA, 25 bp, Rattus norvegicus
ccgcgttaacttacaggatgcaggt

SEQ ID NO: 251201 - DNA, 25 bp, Rattus norvegicus
ccgcgttaactttcaggatgcaggt

SEQ ID NO: 251202 - DNA, 25 bp, Rattus norvegicus
ccgcgttgtttgaaagtaccaccag

SEQ ID NO: 251203 - DNA, 25 bp, Rattus norvegicus
ccgcgttgtttgtaagtaccaccag

SEQ ID NO: 251204 - DNA, 25 bp, Rattus norvegicus
ccgctaaacatacatgccagcatag

SEQ ID NO: 251205 - DNA, 25 bp, Rattus norvegicus
ccgctaaacatagatgccagcatag

SEQ ID NO: 251206 - DNA, 25 bp, Rattus norvegicus
ccgctaagacctcggatctcgttaa

SEQ ID NO: 251207 - DNA, 25 bp, Rattus norvegicus
ccgctaagacctgggatctcgttaa

SEQ ID NO: 251208 - DNA, 25 bp, Rattus norvegicus
ccgctaagcgttccgggccgatctt

SEQ ID NO: 251209 - DNA, 25 bp, Rattus norvegicus
ccgctaagcgttgcgggccgatctt

SEQ ID NO: 251210 - DNA, 25 bp, Rattus norvegicus
ccgctacctattatgattgttccca

SEQ ID NO: 251211 - DNA, 25 bp, Rattus norvegicus
ccgctacctattttgattgttccca

SEQ ID NO: 251212 - DNA, 25 bp, Rattus norvegicus
ccgctactgactcctgtgaactgaa

SEQ ID NO: 251213 - DNA, 25 bp, Rattus norvegicus
ccgctactgactgctgtgaactgaa

SEQ ID NO: 251214 - DNA, 25 bp, Rattus norvegicus
ccgctagtaggaagggctttctttc

SEQ ID NO: 251215 - DNA, 25 bp, Rattus norvegicus
ccgctagtaggatgggctttctttc

SEQ ID NO: 251216 - DNA, 25 bp, Rattus norvegicus
ccgctagttactcccttgattaaat

SEQ ID NO: 251217 - DNA, 25 bp, Rattus norvegicus
ccgctagttactgccttgattaaat

SEQ ID NO: 251218 - DNA, 25 bp, Rattus norvegicus
ccgctattccggcttgtgcaataac

SEQ ID NO: 251219 - DNA, 25 bp, Rattus norvegicus
ccgctattccgggttgtgcaataac

SEQ ID NO: 251220 - DNA, 25 bp, Rattus norvegicus
ccgctattctttctcattctgtaga

SEQ ID NO: 251221 - DNA, 25 bp, Rattus norvegicus
ccgctattctttgtcattctgtaga

SEQ ID NO: 251222 - DNA, 25 bp, Rattus norvegicus
ccgctattgttgctctgtgttcaaa

SEQ ID NO: 251223 - DNA, 25 bp, Rattus norvegicus
ccgctattgttggtctgtgttcaaa

SEQ ID NO: 251224 - DNA, 25 bp, Rattus norvegicus
ccgctcacatatactcactgttttc

SEQ ID NO: 251225 - DNA, 25 bp, Rattus norvegicus
ccgctcacatattctcactgttttc

SEQ ID NO: 251226 - DNA, 25 bp, Rattus norvegicus
ccgctcactgtgacctgaactaata

SEQ ID NO: 251227 - DNA, 25 bp, Rattus norvegicus
ccgctcactgtgtcctgaactaata

SEQ ID NO: 251228 - DNA, 25 bp, Rattus norvegicus
ccgctcagctgcctgaagtccgggt

SEQ ID NO: 251229 - DNA, 25 bp, Rattus norvegicus
ccgctcagctgcgtgaagtccgggt

SEQ ID NO: 251230 - DNA, 25 bp, Rattus norvegicus
ccgctcatcgctcgcaagtaaacta

SEQ ID NO: 251231 - DNA, 25 bp, Rattus norvegicus
ccgctcatcgctggcaagtaaacta

SEQ ID NO: 251232 - DNA, 25 bp, Rattus norvegicus
ccgctccaaactctgatgctatcaa

SEQ ID NO: 251233 - DNA, 25 bp, Rattus norvegicus
ccgctccaaactgtgatgctatcaa

SEQ ID NO: 251234 - DNA, 25 bp, Rattus norvegicus
ccgctcctacaaagccgaattttag

SEQ ID NO: 251235 - DNA, 25 bp, Rattus norvegicus
ccgctcctacaatgccgaattttag

SEQ ID NO: 251236 - DNA, 25 bp, Rattus norvegicus
ccgctcctgttcaggtggtttaaga

SEQ ID NO: 251237 - DNA, 25 bp, Rattus norvegicus
ccgctcctgttctggtggtttaaga

SEQ ID NO: 251238 - DNA, 25 bp, Rattus norvegicus
ccgctcgatgccacgcatttgaaaa

SEQ ID NO: 251239 - DNA, 25 bp, Rattus norvegicus
ccgctcgatgcctcgcatttgaaaa

SEQ ID NO: 251240 - DNA, 25 bp, Rattus norvegicus
ccgctcgcacagatcaggtcatggt

SEQ ID NO: 251241 - DNA, 25 bp, Rattus norvegicus
ccgctcgcacagttcaggtcatggt

SEQ ID NO: 251242 - DNA, 25 bp, Rattus norvegicus
ccgctcgggtggaccgacagagcct

SEQ ID NO: 251243 - DNA, 25 bp, Rattus norvegicus
ccgctcgggtggtccgacagagcct

SEQ ID NO: 251244 - DNA, 25 bp, Rattus norvegicus
ccgctctcctagctctggaagaaaa

SEQ ID NO: 251245 - DNA, 25 bp, Rattus norvegicus
ccgctctcctaggtctggaagaaaa

SEQ ID NO: 251246 - DNA, 25 bp, Rattus norvegicus
ccgctctcgggaatgtttaggccaa

SEQ ID NO: 251247 - DNA, 25 bp, Rattus norvegicus
ccgctctcgggattgtttaggccaa

SEQ ID NO: 251248 - DNA, 25 bp, Rattus norvegicus
ccgctctgcctaagagctggagcta

SEQ ID NO: 251249 - DNA, 25 bp, Rattus norvegicus
ccgctctgcctatgagctggagcta

SEQ ID NO: 251250 - DNA, 25 bp, Rattus norvegicus
ccgctctgtggaagctctagatgat

SEQ ID NO: 251251 - DNA, 25 bp, Rattus norvegicus
ccgctctgtggatgctctagatgat

SEQ ID NO: 251252 - DNA, 25 bp, Rattus norvegicus
ccgctcttaactctggttctttcaa

SEQ ID NO: 251253 - DNA, 25 bp, Rattus norvegicus
ccgctcttaactgtggttctttcaa

SEQ ID NO: 251254 - DNA, 25 bp, Rattus norvegicus
ccgctgaccctcctggactgggaag

SEQ ID NO: 251255 - DNA, 25 bp, Rattus norvegicus
ccgctgaccctcgtggactgggaag

SEQ ID NO: 251256 - DNA, 25 bp, Rattus norvegicus
ccgctgatgcccccatgtttgtgat

SEQ ID NO: 251257 - DNA, 25 bp, Rattus norvegicus
ccgctgatgcccgcatgtttgtgat

SEQ ID NO: 251258 - DNA, 25 bp, Rattus norvegicus
ccgctgcagcagagacgtgaggttc

SEQ ID NO: 251259 - DNA, 25 bp, Rattus norvegicus
ccgctgcagcagtgacgtgaggttc

SEQ ID NO: 251260 - DNA, 25 bp, Rattus norvegicus
ccgctgccccttatatgcaaaagat

SEQ ID NO: 251261 - DNA, 25 bp, Rattus norvegicus
ccgctgccccttttatgcaaaagat

SEQ ID NO: 251262 - DNA, 25 bp, Rattus norvegicus
ccgctgcctcatcgcgctgaaagtg

SEQ ID NO: 251263 - DNA, 25 bp, Rattus norvegicus
ccgctgcctcatggcgctgaaagtg

SEQ ID NO: 251264 - DNA, 25 bp, Rattus norvegicus
ccgctgctgcggatgtctgtggacc

SEQ ID NO: 251265 - DNA, 25 bp, Rattus norvegicus
ccgctgctgcggttgtctgtggacc

SEQ ID NO: 251266 - DNA, 25 bp, Rattus norvegicus
ccgctgctggcaaagagtcacgtaa

SEQ ID NO: 251267 - DNA, 25 bp, Rattus norvegicus
ccgctgctggcaacgctttagtggg

SEQ ID NO: 251268 - DNA, 25 bp, Rattus norvegicus
ccgctgctggcatagagtcacgtaa

SEQ ID NO: 251269 - DNA, 25 bp, Rattus norvegicus
ccgctgctggcatcgctttagtggg

SEQ ID NO: 251270 - DNA, 25 bp, Rattus norvegicus
ccgctgctgggacagatcccctggc

SEQ ID NO: 251271 - DNA, 25 bp, Rattus norvegicus
ccgctgctgggagagatcccctggc

SEQ ID NO: 251272 - DNA, 25 bp, Rattus norvegicus
ccgctgctttgaaagagaacctaga

SEQ ID NO: 251273 - DNA, 25 bp, Rattus norvegicus
ccgctgctttgatagagaacctaga

SEQ ID NO: 251274 - DNA, 25 bp, Rattus norvegicus
ccgctggatccgcatgtatcaggct

SEQ ID NO: 251275 - DNA, 25 bp, Rattus norvegicus
ccgctggatccggatgtatcaggct

SEQ ID NO: 251276 - DNA, 25 bp, Rattus norvegicus
ccgctggcattgattctgactgtca

SEQ ID NO: 251277 - DNA, 25 bp, Rattus norvegicus
ccgctggcattgtttctgactgtca

SEQ ID NO: 251278 - DNA, 25 bp, Rattus norvegicus
ccgctgggccggcagactgtacgca

SEQ ID NO: 251279 - DNA, 25 bp, Rattus norvegicus
ccgctgggccgggagactgtacgca

SEQ ID NO: 251280 - DNA, 25 bp, Rattus norvegicus
ccgctgggtcagaatggcatccgaa

SEQ ID NO: 251281 - DNA, 25 bp, Rattus norvegicus
ccgctgggtcagtatggcatccgaa

SEQ ID NO: 251282 - DNA, 25 bp, Rattus norvegicus
ccgctggtttgcaggagaaagtcct

SEQ ID NO: 251283 - DNA, 25 bp, Rattus norvegicus
ccgctggtttgctggagaaagtcct

SEQ ID NO: 251284 - DNA, 25 bp, Rattus norvegicus
ccgctgtcttcgaggtcttctggaa

SEQ ID NO: 251285 - DNA, 25 bp, Rattus norvegicus
ccgctgtcttcgtggtcttctggaa

SEQ ID NO: 251286 - DNA, 25 bp, Rattus norvegicus
ccgctgtgattaccccatagcagtt

SEQ ID NO: 251287 - DNA, 25 bp, Rattus norvegicus
ccgctgtgattagcccatagcagtt

SEQ ID NO: 251288 - DNA, 25 bp, Rattus norvegicus
ccgctgtgcagaaagggccatggat

SEQ ID NO: 251289 - DNA, 25 bp, Rattus norvegicus
ccgctgtgcagatagggccatggat

SEQ ID NO: 251290 - DNA, 25 bp, Rattus norvegicus
ccgctgtgcgggagcattaacttat

SEQ ID NO: 251291 - DNA, 25 bp, Rattus norvegicus
ccgctgtgcgggtgcattaacttat

SEQ ID NO: 251292 - DNA, 25 bp, Rattus norvegicus
ccgctgtgtgctatgccaagatgag

SEQ ID NO: 251293 - DNA, 25 bp, Rattus norvegicus
ccgctgtgtgctttgccaagatgag

SEQ ID NO: 251294 - DNA, 25 bp, Rattus norvegicus
ccgctgttcgcaaattgctgagttt

SEQ ID NO: 251295 - DNA, 25 bp, Rattus norvegicus
ccgctgttcgcatattgctgagttt

SEQ ID NO: 251296 - DNA, 25 bp, Rattus norvegicus
ccgctgtttccccatataagctaaa

SEQ ID NO: 251297 - DNA, 25 bp, Rattus norvegicus
ccgctgtttcccgatataagctaaa

SEQ ID NO: 251298 - DNA, 25 bp, Rattus norvegicus
ccgcttagtctaatggaggcagttt

SEQ ID NO: 251299 - DNA, 25 bp, Rattus norvegicus
ccgcttagtctattggaggcagttt

SEQ ID NO: 251300 - DNA, 25 bp, Rattus norvegicus
ccgcttcatactcaccgaggcaaat

SEQ ID NO: 251301 - DNA, 25 bp, Rattus norvegicus
ccgcttcatactgaccgaggcaaat

SEQ ID NO: 251302 - DNA, 25 bp, Rattus norvegicus
ccgcttcatttcctgctttacgtta

SEQ ID NO: 251303 - DNA, 25 bp, Rattus norvegicus
ccgcttcatttcgtgctttacgtta

SEQ ID NO: 251304 - DNA, 25 bp, Rattus norvegicus
ccgcttcctggaacgcattcgaaag

SEQ ID NO: 251305 - DNA, 25 bp, Rattus norvegicus
ccgcttcctggatcgcattcgaaag

SEQ ID NO: 251306 - DNA, 25 bp, Rattus norvegicus
ccgcttctcactatgcttttgtaga

SEQ ID NO: 251307 - DNA, 25 bp, Rattus norvegicus
ccgcttctcactttgcttttgtaga

SEQ ID NO: 251308 - DNA, 25 bp, Rattus norvegicus
ccgcttctgatgaatatcgctgcat

SEQ ID NO: 251309 - DNA, 25 bp, Rattus norvegicus
ccgcttctgatgtatatcgctgcat

SEQ ID NO: 251310 - DNA, 25 bp, Rattus norvegicus
ccgcttctttcgcactggtttcatt

SEQ ID NO: 251311 - DNA, 25 bp, Rattus norvegicus
ccgcttctttcggactggtttcatt

SEQ ID NO: 251312 - DNA, 25 bp, Rattus norvegicus
ccgctttggtcacccttcttgaaag

SEQ ID NO: 251313 - DNA, 25 bp, Rattus norvegicus
ccgctttggtcagccttcttgaaag

SEQ ID NO: 251314 - DNA, 25 bp, Rattus norvegicus
ccggaaacgatgcaggcaccagagc

SEQ ID NO: 251315 - DNA, 25 bp, Rattus norvegicus
ccggaaacgatggaggcaccagagc

SEQ ID NO: 251316 - DNA, 25 bp, Rattus norvegicus
ccggaaagagacagcggtttggaat

SEQ ID NO: 251317 - DNA, 25 bp, Rattus norvegicus
ccggaaagagactgcggtttggaat

SEQ ID NO: 251318 - DNA, 25 bp, Rattus norvegicus
ccggaaagcccaccatgagctagag

SEQ ID NO: 251319 - DNA, 25 bp, Rattus norvegicus
ccggaaagcccagcatgagctagag

SEQ ID NO: 251320 - DNA, 25 bp, Rattus norvegicus
ccggaaatcactctcctgtttacta

SEQ ID NO: 251321 - DNA, 25 bp, Rattus norvegicus
ccggaaatcactgtcctgtttacta

SEQ ID NO: 251322 - DNA, 25 bp, Rattus norvegicus
ccggaacttggccttatgtccagaa

SEQ ID NO: 251323 - DNA, 25 bp, Rattus norvegicus
ccggaacttggcgttatgtccagaa

SEQ ID NO: 251324 - DNA, 25 bp, Rattus norvegicus
ccggaactttgacttggactaggag

SEQ ID NO: 251325 - DNA, 25 bp, Rattus norvegicus
ccggaactttgagttggactaggag

SEQ ID NO: 251326 - DNA, 25 bp, Rattus norvegicus
ccggaagcttctctgtggtatggct

SEQ ID NO: 251327 - DNA, 25 bp, Rattus norvegicus
ccggaagcttctgtgtggtatggct

SEQ ID NO: 251328 - DNA, 25 bp, Rattus norvegicus
ccggaagggcgcacgatgacgattt

SEQ ID NO: 251329 - DNA, 25 bp, Rattus norvegicus
ccggaagggcgctcgatgacgattt

SEQ ID NO: 251330 - DNA, 25 bp, Rattus norvegicus
ccggaagggtgcacttactgctgga

SEQ ID NO: 251331 - DNA, 25 bp, Rattus norvegicus
ccggaagggtgctcttactgctgga

SEQ ID NO: 251332 - DNA, 25 bp, Rattus norvegicus
ccggaagtctacctgtcctgaggac

SEQ ID NO: 251333 - DNA, 25 bp, Rattus norvegicus
ccggaagtctacgtgtcctgaggac

SEQ ID NO: 251334 - DNA, 25 bp, Rattus norvegicus
ccggaagttccgcaaagcctatggg

SEQ ID NO: 251335 - DNA, 25 bp, Rattus norvegicus
ccggaagttccggaaagcctatggg

SEQ ID NO: 251336 - DNA, 25 bp, Rattus norvegicus
ccggaatagtccaccatgtacactg

SEQ ID NO: 251337 - DNA, 25 bp, Rattus norvegicus
ccggaatagtcctccatgtacactg

SEQ ID NO: 251338 - DNA, 25 bp, Rattus norvegicus
ccggaatgcctcacactgtgtaaag

SEQ ID NO: 251339 - DNA, 25 bp, Rattus norvegicus
ccggaatgcctctcactgtgtaaag

SEQ ID NO: 251340 - DNA, 25 bp, Rattus norvegicus
ccggaatggttcaacgtgtacaaca

SEQ ID NO: 251341 - DNA, 25 bp, Rattus norvegicus
ccggaatggttctacgtgtacaaca

SEQ ID NO: 251342 - DNA, 25 bp, Rattus norvegicus
ccggaattaaaacatggagctctga

SEQ ID NO: 251343 - DNA, 25 bp, Rattus norvegicus
ccggaattaaaagatggagctctga

SEQ ID NO: 251344 - DNA, 25 bp, Rattus norvegicus
ccggaattatggatcctaatgccaa

SEQ ID NO: 251345 - DNA, 25 bp, Rattus norvegicus
ccggaattatggttcctaatgccaa

SEQ ID NO: 251346 - DNA, 25 bp, Rattus norvegicus
ccggaattggctcctggtggcctcc

SEQ ID NO: 251347 - DNA, 25 bp, Rattus norvegicus
ccggaattggctcgttgtctacaca

SEQ ID NO: 251348 - DNA, 25 bp, Rattus norvegicus
ccggaattggctgctggtggcctcc

SEQ ID NO: 251349 - DNA, 25 bp, Rattus norvegicus
ccggaattggctggttgtctacaca

SEQ ID NO: 251350 - DNA, 25 bp, Rattus norvegicus
ccggacactggcactttcctaaaat

SEQ ID NO: 251351 - DNA, 25 bp, Rattus norvegicus
ccggacactggctctttcctaaaat

SEQ ID NO: 251352 - DNA, 25 bp, Rattus norvegicus
ccggacagacttcaggtgaggccta

SEQ ID NO: 251353 - DNA, 25 bp, Rattus norvegicus
ccggacagacttgaggtgaggccta

SEQ ID NO: 251354 - DNA, 25 bp, Rattus norvegicus
ccggacagcgccatgggcagcagct

SEQ ID NO: 251355 - DNA, 25 bp, Rattus norvegicus
ccggacagcgccttgggcagcagct

SEQ ID NO: 251356 - DNA, 25 bp, Rattus norvegicus
ccggacatactgagggagagccctt

SEQ ID NO: 251357 - DNA, 25 bp, Rattus norvegicus
ccggacatactgtgggagagccctt

SEQ ID NO: 251358 - DNA, 25 bp, Rattus norvegicus
ccggacatcctcagggttcatgaag

SEQ ID NO: 251359 - DNA, 25 bp, Rattus norvegicus
ccggacatcctctgggttcatgaag

SEQ ID NO: 251360 - DNA, 25 bp, Rattus norvegicus
ccggacatctctagtttcatacatg

SEQ ID NO: 251361 - DNA, 25 bp, Rattus norvegicus
ccggacatctcttgtttcatacatg

SEQ ID NO: 251362 - DNA, 25 bp, Rattus norvegicus
ccggacattgataacttctgccact

SEQ ID NO: 251363 - DNA, 25 bp, Rattus norvegicus
ccggacattgattacttctgccact

SEQ ID NO: 251364 - DNA, 25 bp, Rattus norvegicus
ccggaccagctcatgacttttagtg

SEQ ID NO: 251365 - DNA, 25 bp, Rattus norvegicus
ccggaccagctcttgacttttagtg

SEQ ID NO: 251366 - DNA, 25 bp, Rattus norvegicus
ccggaccgcggcagctttgggattt

SEQ ID NO: 251367 - DNA, 25 bp, Rattus norvegicus
ccggaccgcggctgctttgggattt

SEQ ID NO: 251368 - DNA, 25 bp, Rattus norvegicus
ccggacggacttccattttggatgt

SEQ ID NO: 251369 - DNA, 25 bp, Rattus norvegicus
ccggacggacttgcattttggatgt

SEQ ID NO: 251370 - DNA, 25 bp, Rattus norvegicus
ccggactacacgctatgacattgac

SEQ ID NO: 251371 - DNA, 25 bp, Rattus norvegicus
ccggactacacggtatgacattgac

SEQ ID NO: 251372 - DNA, 25 bp, Rattus norvegicus
ccggagacgccgctcgggagtcggc

SEQ ID NO: 251373 - DNA, 25 bp, Rattus norvegicus
ccggagacgccggtcgggagtcggc

SEQ ID NO: 251374 - DNA, 25 bp, Rattus norvegicus
ccggagactttacattcctttctgg

SEQ ID NO: 251375 - DNA, 25 bp, Rattus norvegicus
ccggagactttagattcctttctgg

SEQ ID NO: 251376 - DNA, 25 bp, Rattus norvegicus
ccggagatcgttcgctcgccttgca

SEQ ID NO: 251377 - DNA, 25 bp, Rattus norvegicus
ccggagatcgttggctcgccttgca

SEQ ID NO: 251378 - DNA, 25 bp, Rattus norvegicus
ccggagccatggctggaggcctggg

SEQ ID NO: 251379 - DNA, 25 bp, Rattus norvegicus
ccggagccatgggtggaggcctggg

SEQ ID NO: 251380 - DNA, 25 bp, Rattus norvegicus
ccggagccgctgaccgctgctgaag

SEQ ID NO: 251381 - DNA, 25 bp, Rattus norvegicus
ccggagccgctgtccgctgctgaag

SEQ ID NO: 251382 - DNA, 25 bp, Rattus norvegicus
ccggagccggtcagcagcagagtct

SEQ ID NO: 251383 - DNA, 25 bp, Rattus norvegicus
ccggagccggtctgcagcagagtct

SEQ ID NO: 251384 - DNA, 25 bp, Rattus norvegicus
ccggagcctcatatgcagtgatttg

SEQ ID NO: 251385 - DNA, 25 bp, Rattus norvegicus
ccggagcctcatttgcagtgatttg

SEQ ID NO: 251386 - DNA, 25 bp, Rattus norvegicus
ccggagcctccacatcgagaacaga

SEQ ID NO: 251387 - DNA, 25 bp, Rattus norvegicus
ccggagcctccagatcgagaacaga

SEQ ID NO: 251388 - DNA, 25 bp, Rattus norvegicus
ccggagctggctcccgctagcttca

SEQ ID NO: 251389 - DNA, 25 bp, Rattus norvegicus
ccggagctggctgccgctagcttca

SEQ ID NO: 251390 - DNA, 25 bp, Rattus norvegicus
ccggagcttcaacgagcaaggctta

SEQ ID NO: 251391 - DNA, 25 bp, Rattus norvegicus
ccggagcttcaaggagcaaggctta

SEQ ID NO: 251392 - DNA, 25 bp, Rattus norvegicus
ccggaggcagctactttgagcacga

SEQ ID NO: 251393 - DNA, 25 bp, Rattus norvegicus
ccggaggcagcttctttgagcacga

SEQ ID NO: 251394 - DNA, 25 bp, Rattus norvegicus
ccggaggctctacttctgtcaaata

SEQ ID NO: 251395 - DNA, 25 bp, Rattus norvegicus
ccggaggctctagttctgtcaaata

SEQ ID NO: 251396 - DNA, 25 bp, Rattus norvegicus
ccggaggtcagacgcctgtctgaat

SEQ ID NO: 251397 - DNA, 25 bp, Rattus norvegicus
ccggaggtcagaggcctgtctgaat

SEQ ID NO: 251398 - DNA, 25 bp, Rattus norvegicus
ccggaggtccagactttcgaggaga

SEQ ID NO: 251399 - DNA, 25 bp, Rattus norvegicus
ccggaggtccagtctttcgaggaga

SEQ ID NO: 251400 - DNA, 25 bp, Rattus norvegicus
ccggagttgctgagggcagacccca

SEQ ID NO: 251401 - DNA, 25 bp, Rattus norvegicus
ccggagttgctgtgggcagacccca

SEQ ID NO: 251402 - DNA, 25 bp, Rattus norvegicus
ccggatatgactcagcattctccat

SEQ ID NO: 251403 - DNA, 25 bp, Rattus norvegicus
ccggatatgactgagcattctccat

SEQ ID NO: 251404 - DNA, 25 bp, Rattus norvegicus
ccggatcatgtgctggctttatttc

SEQ ID NO: 251405 - DNA, 25 bp, Rattus norvegicus
ccggatcatgtggtggctttatttc

SEQ ID NO: 251406 - DNA, 25 bp, Rattus norvegicus
ccggatccctgcaaacataatttct

SEQ ID NO: 251407 - DNA, 25 bp, Rattus norvegicus
ccggatccctgctaacataatttct

SEQ ID NO: 251408 - DNA, 25 bp, Rattus norvegicus
ccggatcttcatagcgctgtggaat

SEQ ID NO: 251409 - DNA, 25 bp, Rattus norvegicus
ccggatcttcattgcgctgtggaat

SEQ ID NO: 251410 - DNA, 25 bp, Rattus norvegicus
ccggatgcccagatttgtctgtgaa

SEQ ID NO: 251411 - DNA, 25 bp, Rattus norvegicus
ccggatgcccagttttgtctgtgaa

SEQ ID NO: 251412 - DNA, 25 bp, Rattus norvegicus
ccggatgcctggacatctgtggcga

SEQ ID NO: 251413 - DNA, 25 bp, Rattus norvegicus
ccggatgcctggtcatctgtggcga

SEQ ID NO: 251414 - DNA, 25 bp, Rattus norvegicus
ccggatgctggaacacctgaccaag

SEQ ID NO: 251415 - DNA, 25 bp, Rattus norvegicus
ccggatgctggatcacctgaccaag

SEQ ID NO: 251416 - DNA, 25 bp, Rattus norvegicus
ccggatgcttttctacgggaagatc

SEQ ID NO: 251417 - DNA, 25 bp, Rattus norvegicus
ccggatgcttttgtacgggaagatc

SEQ ID NO: 251418 - DNA, 25 bp, Rattus norvegicus
ccggatgttttaccaaatgttctgt

SEQ ID NO: 251419 - DNA, 25 bp, Rattus norvegicus
ccggatgttttagcaaatgttctgt

SEQ ID NO: 251420 - DNA, 25 bp, Rattus norvegicus
ccggattattgcagcaactggcaaa

SEQ ID NO: 251421 - DNA, 25 bp, Rattus norvegicus
ccggattattgctgcaactggcaaa

SEQ ID NO: 251422 - DNA, 25 bp, Rattus norvegicus
ccggatttggctccttacctagaaa

SEQ ID NO: 251423 - DNA, 25 bp, Rattus norvegicus
ccggatttggctgcttacctagaaa

SEQ ID NO: 251424 - DNA, 25 bp, Rattus norvegicus
ccggcaactctcctgtgaaacaata

SEQ ID NO: 251425 - DNA, 25 bp, Rattus norvegicus
ccggcaactctcgtgtgaaacaata

SEQ ID NO: 251426 - DNA, 25 bp, Rattus norvegicus
ccggcaactgcaacggcagcaggaa

SEQ ID NO: 251427 - DNA, 25 bp, Rattus norvegicus
ccggcaactgcatcggcagcaggaa

SEQ ID NO: 251428 - DNA, 25 bp, Rattus norvegicus
ccggcacactaacctgttactgctt

SEQ ID NO: 251429 - DNA, 25 bp, Rattus norvegicus
ccggcacactaagctgttactgctt

SEQ ID NO: 251430 - DNA, 25 bp, Rattus norvegicus
ccggcagctgcacagaatcacttta

SEQ ID NO: 251431 - DNA, 25 bp, Rattus norvegicus
ccggcagctgcagagaatcacttta

SEQ ID NO: 251432 - DNA, 25 bp, Rattus norvegicus
ccggcagctgtgatttaggagcctt

SEQ ID NO: 251433 - DNA, 25 bp, Rattus norvegicus
ccggcagctgtgttttaggagcctt

SEQ ID NO: 251434 - DNA, 25 bp, Rattus norvegicus
ccggcaggccctcgtttctatgtat

SEQ ID NO: 251435 - DNA, 25 bp, Rattus norvegicus
ccggcaggccctggtttctatgtat

SEQ ID NO: 251436 - DNA, 25 bp, Rattus norvegicus
ccggcaggcggcaatggcaacaaga

SEQ ID NO: 251437 - DNA, 25 bp, Rattus norvegicus
ccggcaggcggctatggcaacaaga

SEQ ID NO: 251438 - DNA, 25 bp, Rattus norvegicus
ccggcagtagatattgggcacacaa

SEQ ID NO: 251439 - DNA, 25 bp, Rattus norvegicus
ccggcagtagattttgggcacacaa

SEQ ID NO: 251440 - DNA, 25 bp, Rattus norvegicus
ccggcagttccacaagaccaaaata

SEQ ID NO: 251441 - DNA, 25 bp, Rattus norvegicus
ccggcagttccagaagaccaaaata

SEQ ID NO: 251442 - DNA, 25 bp, Rattus norvegicus
ccggcatcttgcagctgttaacagt

SEQ ID NO: 251443 - DNA, 25 bp, Rattus norvegicus
ccggcatcttgctgctgttaacagt

SEQ ID NO: 251444 - DNA, 25 bp, Rattus norvegicus
ccggcatgctggctatcatcatcat

SEQ ID NO: 251445 - DNA, 25 bp, Rattus norvegicus
ccggcatgctgggtatcatcatcat

SEQ ID NO: 251446 - DNA, 25 bp, Rattus norvegicus
ccggcatgtcatcttacccagagaa

SEQ ID NO: 251447 - DNA, 25 bp, Rattus norvegicus
ccggcatgtcatgttacccagagaa

SEQ ID NO: 251448 - DNA, 25 bp, Rattus norvegicus
ccggccaagcggatgactgcatatg

SEQ ID NO: 251449 - DNA, 25 bp, Rattus norvegicus
ccggccaagcggttgactgcatatg

SEQ ID NO: 251450 - DNA, 25 bp, Rattus norvegicus
ccggccaatggacgcgttttagact

SEQ ID NO: 251451 - DNA, 25 bp, Rattus norvegicus
ccggccaatggaggcgttttagact

SEQ ID NO: 251452 - DNA, 25 bp, Rattus norvegicus
ccggccacgggcacgatatctatgg

SEQ ID NO: 251453 - DNA, 25 bp, Rattus norvegicus
ccggccacgggctcgatatctatgg

SEQ ID NO: 251454 - DNA, 25 bp, Rattus norvegicus
ccggccactcggaagatctgaggtt

SEQ ID NO: 251455 - DNA, 25 bp, Rattus norvegicus
ccggccactcggtagatctgaggtt

SEQ ID NO: 251456 - DNA, 25 bp, Rattus norvegicus
ccggccatcactctgttgtgttagt

SEQ ID NO: 251457 - DNA, 25 bp, Rattus norvegicus
ccggccatcactgtgttgtgttagt

SEQ ID NO: 251458 - DNA, 25 bp, Rattus norvegicus
ccggcccttgcactttaatcaggtg

SEQ ID NO: 251459 - DNA, 25 bp, Rattus norvegicus
ccggcccttgcagtttaatcaggtg

SEQ ID NO: 251460 - DNA, 25 bp, Rattus norvegicus
ccggccgagcagcatatggtctttt

SEQ ID NO: 251461 - DNA, 25 bp, Rattus norvegicus
ccggccgagcaggatatggtctttt

SEQ ID NO: 251462 - DNA, 25 bp, Rattus norvegicus
ccggccggcgacagaggagagcaag

SEQ ID NO: 251463 - DNA, 25 bp, Rattus norvegicus
ccggccggcgactgaggagagcaag

SEQ ID NO: 251464 - DNA, 25 bp, Rattus norvegicus
ccggccgtgggaactatgatgcttt

SEQ ID NO: 251465 - DNA, 25 bp, Rattus norvegicus
ccggccgtgggatctatgatgcttt

SEQ ID NO: 251466 - DNA, 25 bp, Rattus norvegicus
ccggccgttgctactgtatatagag

SEQ ID NO: 251467 - DNA, 25 bp, Rattus norvegicus
ccggccgttgcttctgtatatagag

SEQ ID NO: 251468 - DNA, 25 bp, Rattus norvegicus
ccggcctactctagtgacgtacttc

SEQ ID NO: 251469 - DNA, 25 bp, Rattus norvegicus
ccggcctactcttgtgacgtacttc

SEQ ID NO: 251470 - DNA, 25 bp, Rattus norvegicus
ccggcctcagcactttgatgtcatg

SEQ ID NO: 251471 - DNA, 25 bp, Rattus norvegicus
ccggcctcagcagtttgatgtcatg

SEQ ID NO: 251472 - DNA, 25 bp, Rattus norvegicus
ccggcctcctgcaggctggtgaaag

SEQ ID NO: 251473 - DNA, 25 bp, Rattus norvegicus
ccggcctcctgctggctggtgaaag

SEQ ID NO: 251474 - DNA, 25 bp, Rattus norvegicus
ccggcctcgcgcagagagaagatga

SEQ ID NO: 251475 - DNA, 25 bp, Rattus norvegicus
ccggcctcgcgctgagagaagatga

SEQ ID NO: 251476 - DNA, 25 bp, Rattus norvegicus
ccggcctggcagaagagaagatctt

SEQ ID NO: 251477 - DNA, 25 bp, Rattus norvegicus
ccggcctggcagtagagaagatctt

SEQ ID NO: 251478 - DNA, 25 bp, Rattus norvegicus
ccggcctgtacgattctgattatga

SEQ ID NO: 251479 - DNA, 25 bp, Rattus norvegicus
ccggcctgtacgtttctgattatga

SEQ ID NO: 251480 - DNA, 25 bp, Rattus norvegicus
ccggccttactcctagtggcggaag

SEQ ID NO: 251481 - DNA, 25 bp, Rattus norvegicus
ccggccttactcgtagtggcggaag

SEQ ID NO: 251482 - DNA, 25 bp, Rattus norvegicus
ccggccttctgtaagtctgcagggt

SEQ ID NO: 251483 - DNA, 25 bp, Rattus norvegicus
ccggccttctgttagtctgcagggt

SEQ ID NO: 251484 - DNA, 25 bp, Rattus norvegicus
ccggcgaaaagtctggtgtgatacc

SEQ ID NO: 251485 - DNA, 25 bp, Rattus norvegicus
ccggcgaaaagtgtggtgtgatacc

SEQ ID NO: 251486 - DNA, 25 bp, Rattus norvegicus
ccggcgcttgtgcatactcaggatg

SEQ ID NO: 251487 - DNA, 25 bp, Rattus norvegicus
ccggcgcttgtggatactcaggatg

SEQ ID NO: 251488 - DNA, 25 bp, Rattus norvegicus
ccggcggcgggaccctcagtctttt

SEQ ID NO: 251489 - DNA, 25 bp, Rattus norvegicus
ccggcggcgggagcctcagtctttt

SEQ ID NO: 251490 - DNA, 25 bp, Rattus norvegicus
ccggcgggcactcatggcattactc

SEQ ID NO: 251491 - DNA, 25 bp, Rattus norvegicus
ccggcgggcactgatggcattactc

SEQ ID NO: 251492 - DNA, 25 bp, Rattus norvegicus
ccggcggtgaagagcacttccggtt

SEQ ID NO: 251493 - DNA, 25 bp, Rattus norvegicus
ccggcggtgaagtgcacttccggtt

SEQ ID NO: 251494 - DNA, 25 bp, Rattus norvegicus
ccggcggttgtgaagtacaccttat

SEQ ID NO: 251495 - DNA, 25 bp, Rattus norvegicus
ccggcggttgtgtagtacaccttat

SEQ ID NO: 251496 - DNA, 25 bp, Rattus norvegicus
ccggcgtttgttcgaagaagctagc

SEQ ID NO: 251497 - DNA, 25 bp, Rattus norvegicus
ccggcgtttgttggaagaagctagc

SEQ ID NO: 251498 - DNA, 25 bp, Rattus norvegicus
ccggctaacaccactggaagcttgt

SEQ ID NO: 251499 - DNA, 25 bp, Rattus norvegicus
ccggctaacacctctggaagcttgt

SEQ ID NO: 251500 - DNA, 25 bp, Rattus norvegicus
ccggctaattaaaatgtcgtgtgac

SEQ ID NO: 251501 - DNA, 25 bp, Rattus norvegicus
ccggctaattaatatgtcgtgtgac

SEQ ID NO: 251502 - DNA, 25 bp, Rattus norvegicus
ccggctacagcgctcagaacagcat

SEQ ID NO: 251503 - DNA, 25 bp, Rattus norvegicus
ccggctacagcggtcagaacagcat

SEQ ID NO: 251504 - DNA, 25 bp, Rattus norvegicus
ccggctagccaaccagtactatgag

SEQ ID NO: 251505 - DNA, 25 bp, Rattus norvegicus
ccggctagccaagcagtactatgag

SEQ ID NO: 251506 - DNA, 25 bp, Rattus norvegicus
ccggctatgtcacgcatctgatgaa

SEQ ID NO: 251507 - DNA, 25 bp, Rattus norvegicus
ccggctatgtcaggcatctgatgaa

SEQ ID NO: 251508 - DNA, 25 bp, Rattus norvegicus
ccggctcctggacggagacactgaa

SEQ ID NO: 251509 - DNA, 25 bp, Rattus norvegicus
ccggctcctggagggagacactgaa

SEQ ID NO: 251510 - DNA, 25 bp, Rattus norvegicus
ccggctctcgggacgccgcggcatc

SEQ ID NO: 251511 - DNA, 25 bp, Rattus norvegicus
ccggctctcgggtcgccgcggcatc

SEQ ID NO: 251512 - DNA, 25 bp, Rattus norvegicus
ccggctcttcttcagctttgtggaa

SEQ ID NO: 251513 - DNA, 25 bp, Rattus norvegicus
ccggctcttcttgagctttgtggaa

SEQ ID NO: 251514 - DNA, 25 bp, Rattus norvegicus
ccggctgaggacaaaggcttctatt

SEQ ID NO: 251515 - DNA, 25 bp, Rattus norvegicus
ccggctgaggactaaggcttctatt

SEQ ID NO: 251516 - DNA, 25 bp, Rattus norvegicus
ccggctgctcggactgaatgaacta

SEQ ID NO: 251517 - DNA, 25 bp, Rattus norvegicus
ccggctgctcggtctgaatgaacta

SEQ ID NO: 251518 - DNA, 25 bp, Rattus norvegicus
ccggctggctttatgtcaactgaca

SEQ ID NO: 251519 - DNA, 25 bp, Rattus norvegicus
ccggctggctttttgtcaactgaca

SEQ ID NO: 251520 - DNA, 25 bp, Rattus norvegicus
ccggctgtcagacattcttcctaag

SEQ ID NO: 251521 - DNA, 25 bp, Rattus norvegicus
ccggctgtcagagattcttcctaag

SEQ ID NO: 251522 - DNA, 25 bp, Rattus norvegicus
ccggctgtcctactactaatattta

SEQ ID NO: 251523 - DNA, 25 bp, Rattus norvegicus
ccggctgtcctagtactaatattta

SEQ ID NO: 251524 - DNA, 25 bp, Rattus norvegicus
ccggcttatcctctgaaaactttgt

SEQ ID NO: 251525 - DNA, 25 bp, Rattus norvegicus
ccggcttatcctgtgaaaactttgt

SEQ ID NO: 251526 - DNA, 25 bp, Rattus norvegicus
ccggcttatcggcacaatcagtgga

SEQ ID NO: 251527 - DNA, 25 bp, Rattus norvegicus
ccggcttatcgggacaatcagtgga

SEQ ID NO: 251528 - DNA, 25 bp, Rattus norvegicus
ccggcttggaaccttatctacagtt

SEQ ID NO: 251529 - DNA, 25 bp, Rattus norvegicus
ccggcttggaacgttatctacagtt

SEQ ID NO: 251530 - DNA, 25 bp, Rattus norvegicus
ccggctttgctcctgttaattaagt

SEQ ID NO: 251531 - DNA, 25 bp, Rattus norvegicus
ccggctttgctcgtgttaattaagt

SEQ ID NO: 251532 - DNA, 25 bp, Rattus norvegicus
ccgggaaagctcacggtcaagagtt

SEQ ID NO: 251533 - DNA, 25 bp, Rattus norvegicus
ccgggaaagctctcggtcaagagtt

SEQ ID NO: 251534 - DNA, 25 bp, Rattus norvegicus
ccgggaacacggagtccaactggag

SEQ ID NO: 251535 - DNA, 25 bp, Rattus norvegicus
ccgggaacacggtgtccaactggag

SEQ ID NO: 251536 - DNA, 25 bp, Rattus norvegicus
ccgggacctccacaaggtatgagca

SEQ ID NO: 251537 - DNA, 25 bp, Rattus norvegicus
ccgggacctccagaaggtatgagca

SEQ ID NO: 251538 - DNA, 25 bp, Rattus norvegicus
ccgggactgagtaggactagcgaca

SEQ ID NO: 251539 - DNA, 25 bp, Rattus norvegicus
ccgggactgagttggactagcgaca

SEQ ID NO: 251540 - DNA, 25 bp, Rattus norvegicus
ccgggactggtcagcctagactgat

SEQ ID NO: 251541 - DNA, 25 bp, Rattus norvegicus
ccgggactggtctgcctagactgat

SEQ ID NO: 251542 - DNA, 25 bp, Rattus norvegicus
ccgggagaccgaatagagacagcac

SEQ ID NO: 251543 - DNA, 25 bp, Rattus norvegicus
ccgggagaccgattagagacagcac

SEQ ID NO: 251544 - DNA, 25 bp, Rattus norvegicus
ccgggagcagaaagtgggccactta

SEQ ID NO: 251545 - DNA, 25 bp, Rattus norvegicus
ccgggagcagaatgtgggccactta

SEQ ID NO: 251546 - DNA, 25 bp, Rattus norvegicus
ccgggagcctgtatggttgacttga

SEQ ID NO: 251547 - DNA, 25 bp, Rattus norvegicus
ccgggagcctgtttggttgacttga

SEQ ID NO: 251548 - DNA, 25 bp, Rattus norvegicus
ccgggagctggaacagtatggccaa

SEQ ID NO: 251549 - DNA, 25 bp, Rattus norvegicus
ccgggagctggatcagtatggccaa

SEQ ID NO: 251550 - DNA, 25 bp, Rattus norvegicus
ccgggaggttctagatggtgttaat

SEQ ID NO: 251551 - DNA, 25 bp, Rattus norvegicus
ccgggaggttcttgatggtgttaat

SEQ ID NO: 251552 - DNA, 25 bp, Rattus norvegicus
ccgggagtccaaagagtgcatgcta

SEQ ID NO: 251553 - DNA, 25 bp, Rattus norvegicus
ccgggagtccaatgagtgcatgcta

SEQ ID NO: 251554 - DNA, 25 bp, Rattus norvegicus
ccgggataaaataacgattgccatt

SEQ ID NO: 251555 - DNA, 25 bp, Rattus norvegicus
ccgggataaaattacgattgccatt

SEQ ID NO: 251556 - DNA, 25 bp, Rattus norvegicus
ccgggatcaaagactgttctggcgg

SEQ ID NO: 251557 - DNA, 25 bp, Rattus norvegicus
ccgggatcaaagtctgttctggcgg

SEQ ID NO: 251558 - DNA, 25 bp, Rattus norvegicus
ccgggatcactgacaggacgtgact

SEQ ID NO: 251559 - DNA, 25 bp, Rattus norvegicus
ccgggatcactgtcaggacgtgact

SEQ ID NO: 251560 - DNA, 25 bp, Rattus norvegicus
ccgggatttcttagtgtttctgcga

SEQ ID NO: 251561 - DNA, 25 bp, Rattus norvegicus
ccgggatttctttgtgtttctgcga

SEQ ID NO: 251562 - DNA, 25 bp, Rattus norvegicus
ccgggattttgaagctggctctatt

SEQ ID NO: 251563 - DNA, 25 bp, Rattus norvegicus
ccgggattttgatgctggctctatt

SEQ ID NO: 251564 - DNA, 25 bp, Rattus norvegicus
ccgggcacatggcagtctgtcagaa

SEQ ID NO: 251565 - DNA, 25 bp, Rattus norvegicus
ccgggcacatgggagtctgtcagaa

SEQ ID NO: 251566 - DNA, 25 bp, Rattus norvegicus
ccgggcagtagcacttgggaagcca

SEQ ID NO: 251567 - DNA, 25 bp, Rattus norvegicus
ccgggcagtagctcttgggaagcca

SEQ ID NO: 251568 - DNA, 25 bp, Rattus norvegicus
ccgggccagtctagtacaggagttg

SEQ ID NO: 251569 - DNA, 25 bp, Rattus norvegicus
ccgggccagtcttgtacaggagttg

SEQ ID NO: 251570 - DNA, 25 bp, Rattus norvegicus
ccgggccccagtcattagtctaaga

SEQ ID NO: 251571 - DNA, 25 bp, Rattus norvegicus
ccgggccccagtgattagtctaaga

SEQ ID NO: 251572 - DNA, 25 bp, Rattus norvegicus
ccgggcccgaagattaaaatcaatg

SEQ ID NO: 251573 - DNA, 25 bp, Rattus norvegicus
ccgggcccgaagtttaaaatcaatg

SEQ ID NO: 251574 - DNA, 25 bp, Rattus norvegicus
ccgggcctgactccaaatctttggt

SEQ ID NO: 251575 - DNA, 25 bp, Rattus norvegicus
ccgggcctgactgcaaatctttggt

SEQ ID NO: 251576 - DNA, 25 bp, Rattus norvegicus
ccgggcctttcaacactgggagata

SEQ ID NO: 251577 - DNA, 25 bp, Rattus norvegicus
ccgggcctttcatcactgggagata

SEQ ID NO: 251578 - DNA, 25 bp, Rattus norvegicus
ccgggcgctggcagggctaacttcc

SEQ ID NO: 251579 - DNA, 25 bp, Rattus norvegicus
ccgggcgctggctgggctaacttcc

SEQ ID NO: 251580 - DNA, 25 bp, Rattus norvegicus
ccgggcgggttaatagcaaaagatg

SEQ ID NO: 251581 - DNA, 25 bp, Rattus norvegicus
ccgggcgggttattagcaaaagatg

SEQ ID NO: 251582 - DNA, 25 bp, Rattus norvegicus
ccgggctagaacctcgtgacattga

SEQ ID NO: 251583 - DNA, 25 bp, Rattus norvegicus
ccgggctagaacgtcgtgacattga

SEQ ID NO: 251584 - DNA, 25 bp, Rattus norvegicus
ccgggctcccgtcgcatatataaaa

SEQ ID NO: 251585 - DNA, 25 bp, Rattus norvegicus
ccgggctcccgtggcatatataaaa

SEQ ID NO: 251586 - DNA, 25 bp, Rattus norvegicus
ccgggctgccaccaccaagtgacag

SEQ ID NO: 251587 - DNA, 25 bp, Rattus norvegicus
ccgggctgccacgaccaagtgacag

SEQ ID NO: 251588 - DNA, 25 bp, Rattus norvegicus
ccgggctgctgtctgcatgacagat

SEQ ID NO: 251589 - DNA, 25 bp, Rattus norvegicus
ccgggctgctgtgtgcatgacagat

SEQ ID NO: 251590 - DNA, 25 bp, Rattus norvegicus
ccggggtgacaccagcattgagccc

SEQ ID NO: 251591 - DNA, 25 bp, Rattus norvegicus
ccggggtgacacgagcattgagccc

SEQ ID NO: 251592 - DNA, 25 bp, Rattus norvegicus
ccgggtcaagccaccagtctggtgg

SEQ ID NO: 251593 - DNA, 25 bp, Rattus norvegicus
ccgggtcaagcctccagtctggtgg

SEQ ID NO: 251594 - DNA, 25 bp, Rattus norvegicus
ccgggtcccaagatcgtggcatgga

SEQ ID NO: 251595 - DNA, 25 bp, Rattus norvegicus
ccgggtcccaagttcgtggcatgga

SEQ ID NO: 251596 - DNA, 25 bp, Rattus norvegicus
ccgggtcctctcagaaaggtcaagt

SEQ ID NO: 251597 - DNA, 25 bp, Rattus norvegicus
ccgggtcctctctgaaaggtcaagt

SEQ ID NO: 251598 - DNA, 25 bp, Rattus norvegicus
ccgggtcggtacagctgaaggttca

SEQ ID NO: 251599 - DNA, 25 bp, Rattus norvegicus
ccgggtcggtactgctgaaggttca

SEQ ID NO: 251600 - DNA, 25 bp, Rattus norvegicus
ccgggtcttcctctcttcacaataa

SEQ ID NO: 251601 - DNA, 25 bp, Rattus norvegicus
ccgggtcttcctgtcttcacaataa

SEQ ID NO: 251602 - DNA, 25 bp, Rattus norvegicus
ccgggtcttctgctgtatctagaat

SEQ ID NO: 251603 - DNA, 25 bp, Rattus norvegicus
ccgggtcttctggtgtatctagaat

SEQ ID NO: 251604 - DNA, 25 bp, Rattus norvegicus
ccgggtcttgatattgtcacctgaa

SEQ ID NO: 251605 - DNA, 25 bp, Rattus norvegicus
ccgggtcttgattttgtcacctgaa

SEQ ID NO: 251606 - DNA, 25 bp, Rattus norvegicus
ccgggtgatgttcgcacacgccttt

SEQ ID NO: 251607 - DNA, 25 bp, Rattus norvegicus
ccgggtgatgttggcacacgccttt

SEQ ID NO: 251608 - DNA, 25 bp, Rattus norvegicus
ccgggtgcagctctgaaggttcctc

SEQ ID NO: 251609 - DNA, 25 bp, Rattus norvegicus
ccgggtgcagctgtgaaggttcctc

SEQ ID NO: 251610 - DNA, 25 bp, Rattus norvegicus
ccgggtggtctgatctgagtttaat

SEQ ID NO: 251611 - DNA, 25 bp, Rattus norvegicus
ccgggtggtctgttctgagtttaat

SEQ ID NO: 251612 - DNA, 25 bp, Rattus norvegicus
ccgggtggtggtctcagcaacatca

SEQ ID NO: 251613 - DNA, 25 bp, Rattus norvegicus
ccgggtggtggtgtcagcaacatca

SEQ ID NO: 251614 - DNA, 25 bp, Rattus norvegicus
ccgggtgttgcgcttcttgtaagat

SEQ ID NO: 251615 - DNA, 25 bp, Rattus norvegicus
ccgggtgttgcggttcttgtaagat

SEQ ID NO: 251616 - DNA, 25 bp, Rattus norvegicus
ccgggttaccaaatctgctaggcat

SEQ ID NO: 251617 - DNA, 25 bp, Rattus norvegicus
ccgggttaccaattctgctaggcat

SEQ ID NO: 251618 - DNA, 25 bp, Rattus norvegicus
ccgggttgcctcagatattcaggta

SEQ ID NO: 251619 - DNA, 25 bp, Rattus norvegicus
ccgggttgcctctgatattcaggta

SEQ ID NO: 251620 - DNA, 25 bp, Rattus norvegicus
ccgggttggatcacaccctgaaggt

SEQ ID NO: 251621 - DNA, 25 bp, Rattus norvegicus
ccgggttggatctcaccctgaaggt

SEQ ID NO: 251622 - DNA, 25 bp, Rattus norvegicus
ccgggtttaacaactcctggagcga

SEQ ID NO: 251623 - DNA, 25 bp, Rattus norvegicus
ccgggtttaacatctcctggagcga

SEQ ID NO: 251624 - DNA, 25 bp, Rattus norvegicus
ccgggtttggaacagattagtcaat

SEQ ID NO: 251625 - DNA, 25 bp, Rattus norvegicus
ccgggtttggaagagattagtcaat

SEQ ID NO: 251626 - DNA, 25 bp, Rattus norvegicus
ccgggtttgtccacatgtcatgatt

SEQ ID NO: 251627 - DNA, 25 bp, Rattus norvegicus
ccgggtttgtcctcatgtcatgatt

SEQ ID NO: 251628 - DNA, 25 bp, Rattus norvegicus
ccggtaccgataccactggcaatgt

SEQ ID NO: 251629 - DNA, 25 bp, Rattus norvegicus
ccggtaccgatagcactggcaatgt

SEQ ID NO: 251630 - DNA, 25 bp, Rattus norvegicus
ccggtatatcgactgggagaaactc

SEQ ID NO: 251631 - DNA, 25 bp, Rattus norvegicus
ccggtatatcgagtgggagaaactc

SEQ ID NO: 251632 - DNA, 25 bp, Rattus norvegicus
ccggtatgggtcaactttgttctga

SEQ ID NO: 251633 - DNA, 25 bp, Rattus norvegicus
ccggtatgggtctactttgttctga

SEQ ID NO: 251634 - DNA, 25 bp, Rattus norvegicus
ccggtcctcagaccctgtgtgggta

SEQ ID NO: 251635 - DNA, 25 bp, Rattus norvegicus
ccggtcctcagagcctgtgtgggta

SEQ ID NO: 251636 - DNA, 25 bp, Rattus norvegicus
ccggtcgagcttctccgggaagcaa

SEQ ID NO: 251637 - DNA, 25 bp, Rattus norvegicus
ccggtcgagcttgtccgggaagcaa

SEQ ID NO: 251638 - DNA, 25 bp, Rattus norvegicus
ccggtctatttcagccttatgttaa

SEQ ID NO: 251639 - DNA, 25 bp, Rattus norvegicus
ccggtctatttctgccttatgttaa

SEQ ID NO: 251640 - DNA, 25 bp, Rattus norvegicus
ccggtctgtgacattctcaaagagt

SEQ ID NO: 251641 - DNA, 25 bp, Rattus norvegicus
ccggtctgtgactttctcaaagagt

SEQ ID NO: 251642 - DNA, 25 bp, Rattus norvegicus
ccggtcttcgccacgggaaatgaat

SEQ ID NO: 251643 - DNA, 25 bp, Rattus norvegicus
ccggtcttcgcctcgggaaatgaat

SEQ ID NO: 251644 - DNA, 25 bp, Rattus norvegicus
ccggtcttgcccaaatattatcatg

SEQ ID NO: 251645 - DNA, 25 bp, Rattus norvegicus
ccggtcttgccctaatattatcatg

SEQ ID NO: 251646 - DNA, 25 bp, Rattus norvegicus
ccggtgacggccagttcaatctggg

SEQ ID NO: 251647 - DNA, 25 bp, Rattus norvegicus
ccggtgacggcctgttcaatctggg

SEQ ID NO: 251648 - DNA, 25 bp, Rattus norvegicus
ccggtgagctccatgaattcggatt

SEQ ID NO: 251649 - DNA, 25 bp, Rattus norvegicus
ccggtgagctccttgaattcggatt

SEQ ID NO: 251650 - DNA, 25 bp, Rattus norvegicus
ccggtgagggctagcacacaggtcc

SEQ ID NO: 251651 - DNA, 25 bp, Rattus norvegicus
ccggtgagggcttgcacacaggtcc

SEQ ID NO: 251652 - DNA, 25 bp, Rattus norvegicus
ccggtggcaccgcaaaaatgctatg

SEQ ID NO: 251653 - DNA, 25 bp, Rattus norvegicus
ccggtggcaccggaaaaatgctatg

SEQ ID NO: 251654 - DNA, 25 bp, Rattus norvegicus
ccggtggcacctccacgttggtgaa

SEQ ID NO: 251655 - DNA, 25 bp, Rattus norvegicus
ccggtggcacctgcacgttggtgaa

SEQ ID NO: 251656 - DNA, 25 bp, Rattus norvegicus
ccggtggcatttctttctgggaagt

SEQ ID NO: 251657 - DNA, 25 bp, Rattus norvegicus
ccggtggcatttgtttctgggaagt

SEQ ID NO: 251658 - DNA, 25 bp, Rattus norvegicus
ccggtggctgggagttctatacaca

SEQ ID NO: 251659 - DNA, 25 bp, Rattus norvegicus
ccggtggctgggtgttctatacaca

SEQ ID NO: 251660 - DNA, 25 bp, Rattus norvegicus
ccggtgtatctgactacagaaacca

SEQ ID NO: 251661 - DNA, 25 bp, Rattus norvegicus
ccggtgtatctgtctacagaaacca

SEQ ID NO: 251662 - DNA, 25 bp, Rattus norvegicus
ccggtgttctgcatggattcggcat

SEQ ID NO: 251663 - DNA, 25 bp, Rattus norvegicus
ccggtgttctgcttggattcggcat

SEQ ID NO: 251664 - DNA, 25 bp, Rattus norvegicus
ccggttagagttcggcaccgcagtt

SEQ ID NO: 251665 - DNA, 25 bp, Rattus norvegicus
ccggttagagttgggcaccgcagtt

SEQ ID NO: 251666 - DNA, 25 bp, Rattus norvegicus
ccggttagctgaataggtcaagaat

SEQ ID NO: 251667 - DNA, 25 bp, Rattus norvegicus
ccggttagctgattaggtcaagaat

SEQ ID NO: 251668 - DNA, 25 bp, Rattus norvegicus
ccggttattggcagttttccattca

SEQ ID NO: 251669 - DNA, 25 bp, Rattus norvegicus
ccggttattggctgttttccattca

SEQ ID NO: 251670 - DNA, 25 bp, Rattus norvegicus
ccggttctctctccatagaaggtat

SEQ ID NO: 251671 - DNA, 25 bp, Rattus norvegicus
ccggttctctctgcatagaaggtat

SEQ ID NO: 251672 - DNA, 25 bp, Rattus norvegicus
ccggttgcctctcaagatgctgtga

SEQ ID NO: 251673 - DNA, 25 bp, Rattus norvegicus
ccggttgcctctgaagatgctgtga

SEQ ID NO: 251674 - DNA, 25 bp, Rattus norvegicus
ccggttgctgacatttggctgtaat

SEQ ID NO: 251675 - DNA, 25 bp, Rattus norvegicus
ccggttgctgacttttggctgtaat

SEQ ID NO: 251676 - DNA, 25 bp, Rattus norvegicus
ccggtttatgacattgccaataact

SEQ ID NO: 251677 - DNA, 25 bp, Rattus norvegicus
ccggtttatgactttgccaataact

SEQ ID NO: 251678 - DNA, 25 bp, Rattus norvegicus
ccggtttcactgaggtgtgcatgtg

SEQ ID NO: 251679 - DNA, 25 bp, Rattus norvegicus
ccggtttcactgtggtgtgcatgtg

SEQ ID NO: 251680 - DNA, 25 bp, Rattus norvegicus
ccggtttggtgcaatcttgcgtgaa

SEQ ID NO: 251681 - DNA, 25 bp, Rattus norvegicus
ccggtttggtgctatcttgcgtgaa

SEQ ID NO: 251682 - DNA, 25 bp, Rattus norvegicus
ccggttttgacgctgctgcaagcag

SEQ ID NO: 251683 - DNA, 25 bp, Rattus norvegicus
ccggttttgacggtgctgcaagcag

SEQ ID NO: 251684 - DNA, 25 bp, Rattus norvegicus
ccggttttgtgcaccaagggagctc

SEQ ID NO: 251685 - DNA, 25 bp, Rattus norvegicus
ccggttttgtgctccaagggagctc

SEQ ID NO: 251686 - DNA, 25 bp, Rattus norvegicus
ccgtaaagtctgctaggctggctag

SEQ ID NO: 251687 - DNA, 25 bp, Rattus norvegicus
ccgtaaagtctggtaggctggctag

SEQ ID NO: 251688 - DNA, 25 bp, Rattus norvegicus
ccgtaaccgtggcatgttcatgaaa

SEQ ID NO: 251689 - DNA, 25 bp, Rattus norvegicus
ccgtaaccgtgggatgttcatgaaa

SEQ ID NO: 251690 - DNA, 25 bp, Rattus norvegicus
ccgtaactggccaggaggatgtctt

SEQ ID NO: 251691 - DNA, 25 bp, Rattus norvegicus
ccgtaactggcctggaggatgtctt

SEQ ID NO: 251692 - DNA, 25 bp, Rattus norvegicus
ccgtaagacatcacatagtacatga

SEQ ID NO: 251693 - DNA, 25 bp, Rattus norvegicus
ccgtaagacatctcatagtacatga

SEQ ID NO: 251694 - DNA, 25 bp, Rattus norvegicus
ccgtaaggacgtcggctgttcagaa

SEQ ID NO: 251695 - DNA, 25 bp, Rattus norvegicus
ccgtaaggacgtgggctgttcagaa

SEQ ID NO: 251696 - DNA, 25 bp, Rattus norvegicus
ccgtacctatttcaagctatcgtca

SEQ ID NO: 251697 - DNA, 25 bp, Rattus norvegicus
ccgtacctatttgaagctatcgtca

SEQ ID NO: 251698 - DNA, 25 bp, Rattus norvegicus
ccgtacttacggactgtatgggagc

SEQ ID NO: 251699 - DNA, 25 bp, Rattus norvegicus
ccgtacttacggtctgtatgggagc

SEQ ID NO: 251700 - DNA, 25 bp, Rattus norvegicus
ccgtagccgtcactgttccagggag

SEQ ID NO: 251701 - DNA, 25 bp, Rattus norvegicus
ccgtagccgtcagtgttccagggag

SEQ ID NO: 251702 - DNA, 25 bp, Rattus norvegicus
ccgtagcctggtagtgagccacaaa

SEQ ID NO: 251703 - DNA, 25 bp, Rattus norvegicus
ccgtagcctggttgtgagccacaaa

SEQ ID NO: 251704 - DNA, 25 bp, Rattus norvegicus
ccgtagcttgccacaagtggctaaa

SEQ ID NO: 251705 - DNA, 25 bp, Rattus norvegicus
ccgtagcttgcctcaagtggctaaa

SEQ ID NO: 251706 - DNA, 25 bp, Rattus norvegicus
ccgtaggaatggcacagcttgtgaa

SEQ ID NO: 251707 - DNA, 25 bp, Rattus norvegicus
ccgtaggaatgggacagcttgtgaa

SEQ ID NO: 251708 - DNA, 25 bp, Rattus norvegicus
ccgtaggtcacacctctaaactctt

SEQ ID NO: 251709 - DNA, 25 bp, Rattus norvegicus
ccgtaggtcacacggcaggcaacat

SEQ ID NO: 251710 - DNA, 25 bp, Rattus norvegicus
ccgtaggtcacagctctaaactctt

SEQ ID NO: 251711 - DNA, 25 bp, Rattus norvegicus
ccgtaggtcacagggcaggcaacat

SEQ ID NO: 251712 - DNA, 25 bp, Rattus norvegicus
ccgtagttatacaccatatgcctca

SEQ ID NO: 251713 - DNA, 25 bp, Rattus norvegicus
ccgtagttatactccatatgcctca

SEQ ID NO: 251714 - DNA, 25 bp, Rattus norvegicus
ccgtagttgtagaatgtaagtgtgc

SEQ ID NO: 251715 - DNA, 25 bp, Rattus norvegicus
ccgtagttgtagtatgtaagtgtgc

SEQ ID NO: 251716 - DNA, 25 bp, Rattus norvegicus
ccgtatatcgttatcactgggtttg

SEQ ID NO: 251717 - DNA, 25 bp, Rattus norvegicus
ccgtatatcgttttcactgggtttg

SEQ ID NO: 251718 - DNA, 25 bp, Rattus norvegicus
ccgtatcactacagaccttggtttt

SEQ ID NO: 251719 - DNA, 25 bp, Rattus norvegicus
ccgtatcactactgaccttggtttt

SEQ ID NO: 251720 - DNA, 25 bp, Rattus norvegicus
ccgtatcataatagggaccgtggga

SEQ ID NO: 251721 - DNA, 25 bp, Rattus norvegicus
ccgtatcataattgggaccgtggga

SEQ ID NO: 251722 - DNA, 25 bp, Rattus norvegicus
ccgtatcatcaactcccttaaggaa

SEQ ID NO: 251723 - DNA, 25 bp, Rattus norvegicus
ccgtatcatcaagtcccttaaggaa

SEQ ID NO: 251724 - DNA, 25 bp, Rattus norvegicus
ccgtatctcttaatacttcctgtgt

SEQ ID NO: 251725 - DNA, 25 bp, Rattus norvegicus
ccgtatctcttattacttcctgtgt

SEQ ID NO: 251726 - DNA, 25 bp, Rattus norvegicus
ccgtatgaggtaagcatttggatgt

SEQ ID NO: 251727 - DNA, 25 bp, Rattus norvegicus
ccgtatgaggtatgcatttggatgt

SEQ ID NO: 251728 - DNA, 25 bp, Rattus norvegicus
ccgtatgcaggcaccacagatgaga

SEQ ID NO: 251729 - DNA, 25 bp, Rattus norvegicus
ccgtatgcaggctccacagatgaga

SEQ ID NO: 251730 - DNA, 25 bp, Rattus norvegicus
ccgtatgccgtgcttgcgtcaatta

SEQ ID NO: 251731 - DNA, 25 bp, Rattus norvegicus
ccgtatgccgtggttgcgtcaatta

SEQ ID NO: 251732 - DNA, 25 bp, Rattus norvegicus
ccgtatgttgttcccggcttcggga

SEQ ID NO: 251733 - DNA, 25 bp, Rattus norvegicus
ccgtatgttgttgccggcttcggga

SEQ ID NO: 251734 - DNA, 25 bp, Rattus norvegicus
ccgtattagaacagtaaggctgatt

SEQ ID NO: 251735 - DNA, 25 bp, Rattus norvegicus
ccgtattagaactgtaaggctgatt

SEQ ID NO: 251736 - DNA, 25 bp, Rattus norvegicus
ccgtatttcagcagcattttcacaa

SEQ ID NO: 251737 - DNA, 25 bp, Rattus norvegicus
ccgtatttcagctgcattttcacaa

SEQ ID NO: 251738 - DNA, 25 bp, Rattus norvegicus
ccgtcacatcctatttcaacatggg

SEQ ID NO: 251739 - DNA, 25 bp, Rattus norvegicus
ccgtcacatcctttttcaacatggg

SEQ ID NO: 251740 - DNA, 25 bp, Rattus norvegicus
ccgtcacccaacatggagtctgtgt

SEQ ID NO: 251741 - DNA, 25 bp, Rattus norvegicus
ccgtcacccaacttggagtctgtgt

SEQ ID NO: 251742 - DNA, 25 bp, Rattus norvegicus
ccgtcactagtgagtctgactgatt

SEQ ID NO: 251743 - DNA, 25 bp, Rattus norvegicus
ccgtcactagtgtgtctgactgatt

SEQ ID NO: 251744 - DNA, 25 bp, Rattus norvegicus
ccgtcactcaggctgtcactacttt

SEQ ID NO: 251745 - DNA, 25 bp, Rattus norvegicus
ccgtcactcagggtgtcactacttt

SEQ ID NO: 251746 - DNA, 25 bp, Rattus norvegicus
ccgtcactgcctatgactgtgggaa

SEQ ID NO: 251747 - DNA, 25 bp, Rattus norvegicus
ccgtcactgcctttgactgtgggaa

SEQ ID NO: 251748 - DNA, 25 bp, Rattus norvegicus
ccgtcagccaatatccatttgtatg

SEQ ID NO: 251749 - DNA, 25 bp, Rattus norvegicus
ccgtcagccaatttccatttgtatg

SEQ ID NO: 251750 - DNA, 25 bp, Rattus norvegicus
ccgtcagctgtacgccatggtgtag

SEQ ID NO: 251751 - DNA, 25 bp, Rattus norvegicus
ccgtcagctgtaggccatggtgtag

SEQ ID NO: 251752 - DNA, 25 bp, Rattus norvegicus
ccgtcaggccacactcgtaaagaaa

SEQ ID NO: 251753 - DNA, 25 bp, Rattus norvegicus
ccgtcaggccactctcgtaaagaaa

SEQ ID NO: 251754 - DNA, 25 bp, Rattus norvegicus
ccgtcagtcctgagggcatcagaca

SEQ ID NO: 251755 - DNA, 25 bp, Rattus norvegicus
ccgtcagtcctgtgggcatcagaca

SEQ ID NO: 251756 - DNA, 25 bp, Rattus norvegicus
ccgtcatatcctaatattctacgcc

SEQ ID NO: 251757 - DNA, 25 bp, Rattus norvegicus
ccgtcatatccttatattctacgcc

SEQ ID NO: 251758 - DNA, 25 bp, Rattus norvegicus
ccgtcatcaggtcaaatccaggcta

SEQ ID NO: 251759 - DNA, 25 bp, Rattus norvegicus
ccgtcatcaggtgaaatccaggcta

SEQ ID NO: 251760 - DNA, 25 bp, Rattus norvegicus
ccgtcatcttccacacttttaagaa

SEQ ID NO: 251761 - DNA, 25 bp, Rattus norvegicus
ccgtcatcttcctcacttttaagaa

SEQ ID NO: 251762 - DNA, 25 bp, Rattus norvegicus
ccgtcatgccgcagcaggttaatta

SEQ ID NO: 251763 - DNA, 25 bp, Rattus norvegicus
ccgtcatgccgctgcaggttaatta

SEQ ID NO: 251764 - DNA, 25 bp, Rattus norvegicus
ccgtcatggctccaaaggcactgaa

SEQ ID NO: 251765 - DNA, 25 bp, Rattus norvegicus
ccgtcatggctcgaaaggcactgaa

SEQ ID NO: 251766 - DNA, 25 bp, Rattus norvegicus
ccgtcattagaactgttgtgaggaa

SEQ ID NO: 251767 - DNA, 25 bp, Rattus norvegicus
ccgtcattagaagtgttgtgaggaa

SEQ ID NO: 251768 - DNA, 25 bp, Rattus norvegicus
ccgtcattagacaccctcagatgat

SEQ ID NO: 251769 - DNA, 25 bp, Rattus norvegicus
ccgtcattagactccctcagatgat

SEQ ID NO: 251770 - DNA, 25 bp, Rattus norvegicus
ccgtccaaccttctcataaaagtag

SEQ ID NO: 251771 - DNA, 25 bp, Rattus norvegicus
ccgtccaaccttgtcataaaagtag

SEQ ID NO: 251772 - DNA, 25 bp, Rattus norvegicus
ccgtccatcgtgatgctgttgcaat

SEQ ID NO: 251773 - DNA, 25 bp, Rattus norvegicus
ccgtccatcgtgttgctgttgcaat

SEQ ID NO: 251774 - DNA, 25 bp, Rattus norvegicus
ccgtccccagcacatgaatcaagat

SEQ ID NO: 251775 - DNA, 25 bp, Rattus norvegicus
ccgtccccagcagatgaatcaagat

SEQ ID NO: 251776 - DNA, 25 bp, Rattus norvegicus
ccgtccctaacaactttatctacat

SEQ ID NO: 251777 - DNA, 25 bp, Rattus norvegicus
ccgtccctaacatctttatctacat

SEQ ID NO: 251778 - DNA, 25 bp, Rattus norvegicus
ccgtccctcatacacaatctgaaga

SEQ ID NO: 251779 - DNA, 25 bp, Rattus norvegicus
ccgtccctcatagacaatctgaaga

SEQ ID NO: 251780 - DNA, 25 bp, Rattus norvegicus
ccgtcctagttgaagcatctcggat

SEQ ID NO: 251781 - DNA, 25 bp, Rattus norvegicus
ccgtcctagttgtagcatctcggat

SEQ ID NO: 251782 - DNA, 25 bp, Rattus norvegicus
ccgtcctccaatacatttcactaga

SEQ ID NO: 251783 - DNA, 25 bp, Rattus norvegicus
ccgtcctccaattcatttcactaga

SEQ ID NO: 251784 - DNA, 25 bp, Rattus norvegicus
ccgtcctgcaggctcttagctaaaa

SEQ ID NO: 251785 - DNA, 25 bp, Rattus norvegicus
ccgtcctgcagggtcttagctaaaa

SEQ ID NO: 251786 - DNA, 25 bp, Rattus norvegicus
ccgtcctgctgaagtggtaggctag

SEQ ID NO: 251787 - DNA, 25 bp, Rattus norvegicus
ccgtcctgctgatgtggtaggctag

SEQ ID NO: 251788 - DNA, 25 bp, Rattus norvegicus
ccgtcctgggcgatattatgagcaa

SEQ ID NO: 251789 - DNA, 25 bp, Rattus norvegicus
ccgtcctgggcgttattatgagcaa

SEQ ID NO: 251790 - DNA, 25 bp, Rattus norvegicus
ccgtcctgtgtgagggagtgcccaa

SEQ ID NO: 251791 - DNA, 25 bp, Rattus norvegicus
ccgtcctgtgtgtgggagtgcccaa

SEQ ID NO: 251792 - DNA, 25 bp, Rattus norvegicus
ccgtccttgtggaagcattatctta

SEQ ID NO: 251793 - DNA, 25 bp, Rattus norvegicus
ccgtccttgtggtagcattatctta

SEQ ID NO: 251794 - DNA, 25 bp, Rattus norvegicus
ccgtcctttcatagctgttaggaga

SEQ ID NO: 251795 - DNA, 25 bp, Rattus norvegicus
ccgtcctttcattgctgttaggaga

SEQ ID NO: 251796 - DNA, 25 bp, Rattus norvegicus
ccgtccttttggctagctaatcatg

SEQ ID NO: 251797 - DNA, 25 bp, Rattus norvegicus
ccgtccttttgggtagctaatcatg

SEQ ID NO: 251798 - DNA, 25 bp, Rattus norvegicus
ccgtcgccgctcagctgcgtgaagt

SEQ ID NO: 251799 - DNA, 25 bp, Rattus norvegicus
ccgtcgccgctctgctgcgtgaagt

SEQ ID NO: 251800 - DNA, 25 bp, Rattus norvegicus
ccgtcgctgcgaatccaagaagttt

SEQ ID NO: 251801 - DNA, 25 bp, Rattus norvegicus
ccgtcgctgcgattccaagaagttt

SEQ ID NO: 251802 - DNA, 25 bp, Rattus norvegicus
ccgtcgggacgccagtgtctcagca

SEQ ID NO: 251803 - DNA, 25 bp, Rattus norvegicus
ccgtcgggacgcgagtgtctcagca

SEQ ID NO: 251804 - DNA, 25 bp, Rattus norvegicus
ccgtcgggtgctaatgctggtcgaa

SEQ ID NO: 251805 - DNA, 25 bp, Rattus norvegicus
ccgtcgggtgcttatgctggtcgaa

SEQ ID NO: 251806 - DNA, 25 bp, Rattus norvegicus
ccgtcgtgaagtcgaggacccgcaa

SEQ ID NO: 251807 - DNA, 25 bp, Rattus norvegicus
ccgtcgtgaagtggaggacccgcaa

SEQ ID NO: 251808 - DNA, 25 bp, Rattus norvegicus
ccgtctagcagccaagcagaggact

SEQ ID NO: 251809 - DNA, 25 bp, Rattus norvegicus
ccgtctagcagcgaagcagaggact

SEQ ID NO: 251810 - DNA, 25 bp, Rattus norvegicus
ccgtctccacctattgtacaaagat

SEQ ID NO: 251811 - DNA, 25 bp, Rattus norvegicus
ccgtctccaccttttgtacaaagat

SEQ ID NO: 251812 - DNA, 25 bp, Rattus norvegicus
ccgtctccagagattgcaggtttca

SEQ ID NO: 251813 - DNA, 25 bp, Rattus norvegicus
ccgtctccagagtttgcaggtttca

SEQ ID NO: 251814 - DNA, 25 bp, Rattus norvegicus
ccgtctccctgcaagttttatattt

SEQ ID NO: 251815 - DNA, 25 bp, Rattus norvegicus
ccgtctccctgctagttttatattt

SEQ ID NO: 251816 - DNA, 25 bp, Rattus norvegicus
ccgtctccttcaaacacagtattga

SEQ ID NO: 251817 - DNA, 25 bp, Rattus norvegicus
ccgtctccttcatacacagtattga

SEQ ID NO: 251818 - DNA, 25 bp, Rattus norvegicus
ccgtctcggtgcaagtctacttatt

SEQ ID NO: 251819 - DNA, 25 bp, Rattus norvegicus
ccgtctcggtgctagtctacttatt

SEQ ID NO: 251820 - DNA, 25 bp, Rattus norvegicus
ccgtctctacgccaagtattttcaa

SEQ ID NO: 251821 - DNA, 25 bp, Rattus norvegicus
ccgtctctacgcgaagtattttcaa

SEQ ID NO: 251822 - DNA, 25 bp, Rattus norvegicus
ccgtctctgggaattaaactctatt

SEQ ID NO: 251823 - DNA, 25 bp, Rattus norvegicus
ccgtctctgggatttaaactctatt

SEQ ID NO: 251824 - DNA, 25 bp, Rattus norvegicus
ccgtctcttcttctgatgtttagtg

SEQ ID NO: 251825 - DNA, 25 bp, Rattus norvegicus
ccgtctcttcttgtgatgtttagtg

SEQ ID NO: 251826 - DNA, 25 bp, Rattus norvegicus
ccgtctcttgttatgggattgttag

SEQ ID NO: 251827 - DNA, 25 bp, Rattus norvegicus
ccgtctcttgttttgggattgttag

SEQ ID NO: 251828 - DNA, 25 bp, Rattus norvegicus
ccgtctgaccttcacatacattatt

SEQ ID NO: 251829 - DNA, 25 bp, Rattus norvegicus
ccgtctgaccttgacatacattatt

SEQ ID NO: 251830 - DNA, 25 bp, Rattus norvegicus
ccgtctgggtctctgttttagcgaa

SEQ ID NO: 251831 - DNA, 25 bp, Rattus norvegicus
ccgtctgggtctgtgttttagcgaa

SEQ ID NO: 251832 - DNA, 25 bp, Rattus norvegicus
ccgtctggtcacaaactttctgttt

SEQ ID NO: 251833 - DNA, 25 bp, Rattus norvegicus
ccgtctggtcactaactttctgttt

SEQ ID NO: 251834 - DNA, 25 bp, Rattus norvegicus
ccgtctgtaaccatacgctgttgat

SEQ ID NO: 251835 - DNA, 25 bp, Rattus norvegicus
ccgtctgtaaccttacgctgttgat

SEQ ID NO: 251836 - DNA, 25 bp, Rattus norvegicus
ccgtctgttgcgcaagggaaactac

SEQ ID NO: 251837 - DNA, 25 bp, Rattus norvegicus
ccgtctgttgcggaagggaaactac

SEQ ID NO: 251838 - DNA, 25 bp, Rattus norvegicus
ccgtctgtttgaccagccgaagata

SEQ ID NO: 251839 - DNA, 25 bp, Rattus norvegicus
ccgtctgtttgagcagccgaagata

SEQ ID NO: 251840 - DNA, 25 bp, Rattus norvegicus
ccgtcttcacccatagcaaaatgta

SEQ ID NO: 251841 - DNA, 25 bp, Rattus norvegicus
ccgtcttcacccttagcaaaatgta

SEQ ID NO: 251842 - DNA, 25 bp, Rattus norvegicus
ccgtcttcctataggcaagccagaa

SEQ ID NO: 251843 - DNA, 25 bp, Rattus norvegicus
ccgtcttcctattggcaagccagaa

SEQ ID NO: 251844 - DNA, 25 bp, Rattus norvegicus
ccgtcttctggtatagggattgcta

SEQ ID NO: 251845 - DNA, 25 bp, Rattus norvegicus
ccgtcttctggtttagggattgcta

SEQ ID NO: 251846 - DNA, 25 bp, Rattus norvegicus
ccgtcttgacatattgtttatcctg

SEQ ID NO: 251847 - DNA, 25 bp, Rattus norvegicus
ccgtcttgacattttgtttatcctg

SEQ ID NO: 251848 - DNA, 25 bp, Rattus norvegicus
ccgtcttgatggcagcttcttctgg

SEQ ID NO: 251849 - DNA, 25 bp, Rattus norvegicus
ccgtcttgatgggagcttcttctgg

SEQ ID NO: 251850 - DNA, 25 bp, Rattus norvegicus
ccgtcttgtgctagacatgttcatt

SEQ ID NO: 251851 - DNA, 25 bp, Rattus norvegicus
ccgtcttgtgcttgacatgttcatt

SEQ ID NO: 251852 - DNA, 25 bp, Rattus norvegicus
ccgtcttgtggcattctttgtcttt

SEQ ID NO: 251853 - DNA, 25 bp, Rattus norvegicus
ccgtcttgtggctttctttgtcttt

SEQ ID NO: 251854 - DNA, 25 bp, Rattus norvegicus
ccgtctttctgtccttctcaataat

SEQ ID NO: 251855 - DNA, 25 bp, Rattus norvegicus
ccgtctttctgtgcttctcaataat

SEQ ID NO: 251856 - DNA, 25 bp, Rattus norvegicus
ccgtgaacgcacctgagtttggcat

SEQ ID NO: 251857 - DNA, 25 bp, Rattus norvegicus
ccgtgaacgcacgtgagtttggcat

SEQ ID NO: 251858 - DNA, 25 bp, Rattus norvegicus
ccgtgaacgtcaaggcatgtccaag

SEQ ID NO: 251859 - DNA, 25 bp, Rattus norvegicus
ccgtgaacgtcatggcatgtccaag

SEQ ID NO: 251860 - DNA, 25 bp, Rattus norvegicus
ccgtgaactaccctgttagatggtg

SEQ ID NO: 251861 - DNA, 25 bp, Rattus norvegicus
ccgtgaactaccgtgttagatggtg

SEQ ID NO: 251862 - DNA, 25 bp, Rattus norvegicus
ccgtgacatccccaaaatgcttgaa

SEQ ID NO: 251863 - DNA, 25 bp, Rattus norvegicus
ccgtgacatcccgaaaatgcttgaa

SEQ ID NO: 251864 - DNA, 25 bp, Rattus norvegicus
ccgtgaccctcgagagagagttcat

SEQ ID NO: 251865 - DNA, 25 bp, Rattus norvegicus
ccgtgaccctcgtgagagagttcat

SEQ ID NO: 251866 - DNA, 25 bp, Rattus norvegicus
ccgtgactgcagagaagaatgccca

SEQ ID NO: 251867 - DNA, 25 bp, Rattus norvegicus
ccgtgactgcagtgaagaatgccca

SEQ ID NO: 251868 - DNA, 25 bp, Rattus norvegicus
ccgtgagagcgtcggcatgtttcaa

SEQ ID NO: 251869 - DNA, 25 bp, Rattus norvegicus
ccgtgagagcgtgggcatgtttcaa

SEQ ID NO: 251870 - DNA, 25 bp, Rattus norvegicus
ccgtgagatattaccttgtgaaagt

SEQ ID NO: 251871 - DNA, 25 bp, Rattus norvegicus
ccgtgagatatttccttgtgaaagt

SEQ ID NO: 251872 - DNA, 25 bp, Rattus norvegicus
ccgtgagcgccaacgtgcagaaggt

SEQ ID NO: 251873 - DNA, 25 bp, Rattus norvegicus
ccgtgagcgccatcgtgcagaaggt

SEQ ID NO: 251874 - DNA, 25 bp, Rattus norvegicus
ccgtgagctcgtcctataaagttgt

SEQ ID NO: 251875 - DNA, 25 bp, Rattus norvegicus
ccgtgagctcgtgctataaagttgt

SEQ ID NO: 251876 - DNA, 25 bp, Rattus norvegicus
ccgtgaggacgcagctgtagaccgt

SEQ ID NO: 251877 - DNA, 25 bp, Rattus norvegicus
ccgtgaggacgctgctgtagaccgt

SEQ ID NO: 251878 - DNA, 25 bp, Rattus norvegicus
ccgtgagttctccagacagtgtata

SEQ ID NO: 251879 - DNA, 25 bp, Rattus norvegicus
ccgtgagttctcgagacagtgtata

SEQ ID NO: 251880 - DNA, 25 bp, Rattus norvegicus
ccgtgatcgcgtcggcagacaagaa

SEQ ID NO: 251881 - DNA, 25 bp, Rattus norvegicus
ccgtgatcgcgtgggcagacaagaa

SEQ ID NO: 251882 - DNA, 25 bp, Rattus norvegicus
ccgtgatggaacagtcaggagcatg

SEQ ID NO: 251883 - DNA, 25 bp, Rattus norvegicus
ccgtgatggaactgtcaggagcatg

SEQ ID NO: 251884 - DNA, 25 bp, Rattus norvegicus
ccgtgattaactaccctgctgaagg

SEQ ID NO: 251885 - DNA, 25 bp, Rattus norvegicus
ccgtgattaacttccctgctgaagg

SEQ ID NO: 251886 - DNA, 25 bp, Rattus norvegicus
ccgtgcagtagacccagcctgagca

SEQ ID NO: 251887 - DNA, 25 bp, Rattus norvegicus
ccgtgcagtagagccagcctgagca

SEQ ID NO: 251888 - DNA, 25 bp, Rattus norvegicus
ccgtgccaaactacttaccgaatat

SEQ ID NO: 251889 - DNA, 25 bp, Rattus norvegicus
ccgtgccaaacttcttaccgaatat

SEQ ID NO: 251890 - DNA, 25 bp, Rattus norvegicus
ccgtgccagatactccaggaatgtt

SEQ ID NO: 251891 - DNA, 25 bp, Rattus norvegicus
ccgtgccagatagtccaggaatgtt

SEQ ID NO: 251892 - DNA, 25 bp, Rattus norvegicus
ccgtgcccacgtcaaggagtatttt

SEQ ID NO: 251893 - DNA, 25 bp, Rattus norvegicus
ccgtgcccacgtgaaggagtatttt

SEQ ID NO: 251894 - DNA, 25 bp, Rattus norvegicus
ccgtgcccttcgaatatgtatgtgc

SEQ ID NO: 251895 - DNA, 25 bp, Rattus norvegicus
ccgtgcccttcgtatatgtatgtgc

SEQ ID NO: 251896 - DNA, 25 bp, Rattus norvegicus
ccgtgccgttccatgtgagacagtg

SEQ ID NO: 251897 - DNA, 25 bp, Rattus norvegicus
ccgtgccgttccttgtgagacagtg

SEQ ID NO: 251898 - DNA, 25 bp, Rattus norvegicus
ccgtgcctacttacactggaaacta

SEQ ID NO: 251899 - DNA, 25 bp, Rattus norvegicus
ccgtgcctactttcactggaaacta

SEQ ID NO: 251900 - DNA, 25 bp, Rattus norvegicus
ccgtgcctctggagtatgggtaaca

SEQ ID NO: 251901 - DNA, 25 bp, Rattus norvegicus
ccgtgcctctggtgtatgggtaaca

SEQ ID NO: 251902 - DNA, 25 bp, Rattus norvegicus
ccgtgccttctcaggttctgggaat

SEQ ID NO: 251903 - DNA, 25 bp, Rattus norvegicus
ccgtgccttctctggttctgggaat

SEQ ID NO: 251904 - DNA, 25 bp, Rattus norvegicus
ccgtgccttggcctgatggagtaat

SEQ ID NO: 251905 - DNA, 25 bp, Rattus norvegicus
ccgtgccttggcgtgatggagtaat

SEQ ID NO: 251906 - DNA, 25 bp, Rattus norvegicus
ccgtgcgagactactagggagccga

SEQ ID NO: 251907 - DNA, 25 bp, Rattus norvegicus
ccgtgcgagacttctagggagccga

SEQ ID NO: 251908 - DNA, 25 bp, Rattus norvegicus
ccgtgcgcatgtctatttccgaaga

SEQ ID NO: 251909 - DNA, 25 bp, Rattus norvegicus
ccgtgcgcatgtgtatttccgaaga

SEQ ID NO: 251910 - DNA, 25 bp, Rattus norvegicus
ccgtgcgcgggcatgtgaatgaagc

SEQ ID NO: 251911 - DNA, 25 bp, Rattus norvegicus
ccgtgcgcgggcttgtgaatgaagc

SEQ ID NO: 251912 - DNA, 25 bp, Rattus norvegicus
ccgtgctcagtccaagaggctttga

SEQ ID NO: 251913 - DNA, 25 bp, Rattus norvegicus
ccgtgctcagtcgaagaggctttga

SEQ ID NO: 251914 - DNA, 25 bp, Rattus norvegicus
ccgtgctgatttacacacactacat

SEQ ID NO: 251915 - DNA, 25 bp, Rattus norvegicus
ccgtgctgattttcacacactacat

SEQ ID NO: 251916 - DNA, 25 bp, Rattus norvegicus
ccgtgcttgccaatctgtgttgaga

SEQ ID NO: 251917 - DNA, 25 bp, Rattus norvegicus
ccgtgcttgccattctgtgttgaga

SEQ ID NO: 251918 - DNA, 25 bp, Rattus norvegicus
ccgtgctttcctactgagggtttag

SEQ ID NO: 251919 - DNA, 25 bp, Rattus norvegicus
ccgtgctttccttctgagggtttag

SEQ ID NO: 251920 - DNA, 25 bp, Rattus norvegicus
ccgtgctttgtgagccctgatgtcc

SEQ ID NO: 251921 - DNA, 25 bp, Rattus norvegicus
ccgtgctttgtgtgccctgatgtcc

SEQ ID NO: 251922 - DNA, 25 bp, Rattus norvegicus
ccgtgcttttgtattatgccactga

SEQ ID NO: 251923 - DNA, 25 bp, Rattus norvegicus
ccgtgcttttgttttatgccactga

SEQ ID NO: 251924 - DNA, 25 bp, Rattus norvegicus
ccgtggaagcaccaagttcagcagt

SEQ ID NO: 251925 - DNA, 25 bp, Rattus norvegicus
ccgtggaagcacgaagttcagcagt

SEQ ID NO: 251926 - DNA, 25 bp, Rattus norvegicus
ccgtggactcaacgtgcatctgcta

SEQ ID NO: 251927 - DNA, 25 bp, Rattus norvegicus
ccgtggactcaaggtgcatctgcta

SEQ ID NO: 251928 - DNA, 25 bp, Rattus norvegicus
ccgtggactcggaatcagagaagcc

SEQ ID NO: 251929 - DNA, 25 bp, Rattus norvegicus
ccgtggactcggtatcagagaagcc

SEQ ID NO: 251930 - DNA, 25 bp, Rattus norvegicus
ccgtggagtttgcttttgccttgat

SEQ ID NO: 251931 - DNA, 25 bp, Rattus norvegicus
ccgtggagtttggttttgccttgat

SEQ ID NO: 251932 - DNA, 25 bp, Rattus norvegicus
ccgtggatctctcaggaagcggccc

SEQ ID NO: 251933 - DNA, 25 bp, Rattus norvegicus
ccgtggatctctgaggaagcggccc

SEQ ID NO: 251934 - DNA, 25 bp, Rattus norvegicus
ccgtggcagacaactttgacagaga

SEQ ID NO: 251935 - DNA, 25 bp, Rattus norvegicus
ccgtggcagacatctttgacagaga

SEQ ID NO: 251936 - DNA, 25 bp, Rattus norvegicus
ccgtggcagcgtctggcttcaacca

SEQ ID NO: 251937 - DNA, 25 bp, Rattus norvegicus
ccgtggcagcgtgtggcttcaacca

SEQ ID NO: 251938 - DNA, 25 bp, Rattus norvegicus
ccgtggccccgaaagtgcaggaaca

SEQ ID NO: 251939 - DNA, 25 bp, Rattus norvegicus
ccgtggccccgatagtgcaggaaca

SEQ ID NO: 251940 - DNA, 25 bp, Rattus norvegicus
ccgtggcctcttatcaaatactgtt

SEQ ID NO: 251941 - DNA, 25 bp, Rattus norvegicus
ccgtggcctcttttcaaatactgtt

SEQ ID NO: 251942 - DNA, 25 bp, Rattus norvegicus
ccgtggccttctcaaactcaagtgt

SEQ ID NO: 251943 - DNA, 25 bp, Rattus norvegicus
ccgtggccttctgaaactcaagtgt

SEQ ID NO: 251944 - DNA, 25 bp, Rattus norvegicus
ccgtggctatctagggcaggagtca

SEQ ID NO: 251945 - DNA, 25 bp, Rattus norvegicus
ccgtggctatcttgggcaggagtca

SEQ ID NO: 251946 - DNA, 25 bp, Rattus norvegicus
ccgtggctcactacggtgaattaca

SEQ ID NO: 251947 - DNA, 25 bp, Rattus norvegicus
ccgtggctcacttcggtgaattaca

SEQ ID NO: 251948 - DNA, 25 bp, Rattus norvegicus
ccgtggctggacctgggttatttat

SEQ ID NO: 251949 - DNA, 25 bp, Rattus norvegicus
ccgtggctggacgtgggttatttat

SEQ ID NO: 251950 - DNA, 25 bp, Rattus norvegicus
ccgtgggacagtacgtactgtgact

SEQ ID NO: 251951 - DNA, 25 bp, Rattus norvegicus
ccgtgggacagttcgtactgtgact

SEQ ID NO: 251952 - DNA, 25 bp, Rattus norvegicus
ccgtgggacgccatgtgttgtgaac

SEQ ID NO: 251953 - DNA, 25 bp, Rattus norvegicus
ccgtgggacgccttgtgttgtgaac

SEQ ID NO: 251954 - DNA, 25 bp, Rattus norvegicus
ccgtgggactttcgactttcatatc

SEQ ID NO: 251955 - DNA, 25 bp, Rattus norvegicus
ccgtgggactttggactttcatatc

SEQ ID NO: 251956 - DNA, 25 bp, Rattus norvegicus
ccgtgggattatactgacatggctt

SEQ ID NO: 251957 - DNA, 25 bp, Rattus norvegicus
ccgtgggattattctgacatggctt

SEQ ID NO: 251958 - DNA, 25 bp, Rattus norvegicus
ccgtgggccgtgatcaccggctgct

SEQ ID NO: 251959 - DNA, 25 bp, Rattus norvegicus
ccgtgggccgtgttcaccggctgct

SEQ ID NO: 251960 - DNA, 25 bp, Rattus norvegicus
ccgtgggcgggccatgctgcagctg

SEQ ID NO: 251961 - DNA, 25 bp, Rattus norvegicus
ccgtgggcgggcgatgctgcagctg

SEQ ID NO: 251962 - DNA, 25 bp, Rattus norvegicus
ccgtgggtatttcttagagctctag

SEQ ID NO: 251963 - DNA, 25 bp, Rattus norvegicus
ccgtgggtatttgttagagctctag

SEQ ID NO: 251964 - DNA, 25 bp, Rattus norvegicus
ccgtggtaacgtccgtctgtagtta

SEQ ID NO: 251965 - DNA, 25 bp, Rattus norvegicus
ccgtggtaacgtgcgtctgtagtta

SEQ ID NO: 251966 - DNA, 25 bp, Rattus norvegicus
ccgtggtacgtgctgatgaccgttc

SEQ ID NO: 251967 - DNA, 25 bp, Rattus norvegicus
ccgtggtacgtggtgatgaccgttc

SEQ ID NO: 251968 - DNA, 25 bp, Rattus norvegicus
ccgtggtctatgcttcagttcctgt

SEQ ID NO: 251969 - DNA, 25 bp, Rattus norvegicus
ccgtggtctatggttcagttcctgt

SEQ ID NO: 251970 - DNA, 25 bp, Rattus norvegicus
ccgtggtctgggaatcaatgcttgt

SEQ ID NO: 251971 - DNA, 25 bp, Rattus norvegicus
ccgtggtctgggtatcaatgcttgt

SEQ ID NO: 251972 - DNA, 25 bp, Rattus norvegicus
ccgtggtttctactttacttgcaat

SEQ ID NO: 251973 - DNA, 25 bp, Rattus norvegicus
ccgtggtttctagtttacttgcaat

SEQ ID NO: 251974 - DNA, 25 bp, Rattus norvegicus
ccgtgtacttaaagcctgtggtcca

SEQ ID NO: 251975 - DNA, 25 bp, Rattus norvegicus
ccgtgtacttaatgcctgtggtcca

SEQ ID NO: 251976 - DNA, 25 bp, Rattus norvegicus
ccgtgtacttttcaatcgttgtcca

SEQ ID NO: 251977 - DNA, 25 bp, Rattus norvegicus
ccgtgtacttttgaatcgttgtcca

SEQ ID NO: 251978 - DNA, 25 bp, Rattus norvegicus
ccgtgtatccagacgtgtatgttga

SEQ ID NO: 251979 - DNA, 25 bp, Rattus norvegicus
ccgtgtatccagtcgtgtatgttga

SEQ ID NO: 251980 - DNA, 25 bp, Rattus norvegicus
ccgtgtcagtacagtttcctgtaat

SEQ ID NO: 251981 - DNA, 25 bp, Rattus norvegicus
ccgtgtcagtactgtttcctgtaat

SEQ ID NO: 251982 - DNA, 25 bp, Rattus norvegicus
ccgtgtcctgaacctgtttgggtat

SEQ ID NO: 251983 - DNA, 25 bp, Rattus norvegicus
ccgtgtcctgaagctgtttgggtat

SEQ ID NO: 251984 - DNA, 25 bp, Rattus norvegicus
ccgtgtcgtggaagctctggagaat

SEQ ID NO: 251985 - DNA, 25 bp, Rattus norvegicus
ccgtgtcgtggatgctctggagaat

SEQ ID NO: 251986 - DNA, 25 bp, Rattus norvegicus
ccgtgtcgtgtcacatgaggagatc

SEQ ID NO: 251987 - DNA, 25 bp, Rattus norvegicus
ccgtgtcgtgtctcatgaggagatc

SEQ ID NO: 251988 - DNA, 25 bp, Rattus norvegicus
ccgtgtctcaccagtgtgcatatgg

SEQ ID NO: 251989 - DNA, 25 bp, Rattus norvegicus
ccgtgtctcacctgtgtgcatatgg

SEQ ID NO: 251990 - DNA, 25 bp, Rattus norvegicus
ccgtgtctgattccgccggcggcaa

SEQ ID NO: 251991 - DNA, 25 bp, Rattus norvegicus
ccgtgtctgattgcgccggcggcaa

SEQ ID NO: 251992 - DNA, 25 bp, Rattus norvegicus
ccgtgtctgtgcatagttgttaatg

SEQ ID NO: 251993 - DNA, 25 bp, Rattus norvegicus
ccgtgtctgtgcttagttgttaatg

SEQ ID NO: 251994 - DNA, 25 bp, Rattus norvegicus
ccgtgtgaagacaggtgcaagcatt

SEQ ID NO: 251995 - DNA, 25 bp, Rattus norvegicus
ccgtgtgaagactggtgcaagcatt

SEQ ID NO: 251996 - DNA, 25 bp, Rattus norvegicus
ccgtgtgcacacagaatggcttgct

SEQ ID NO: 251997 - DNA, 25 bp, Rattus norvegicus
ccgtgtgcacactgaatggcttgct

SEQ ID NO: 251998 - DNA, 25 bp, Rattus norvegicus
ccgtgtgcaggcagctgatgctagc

SEQ ID NO: 251999 - DNA, 25 bp, Rattus norvegicus
ccgtgtgcaggctgctgatgctagc

SEQ ID NO: 252000 - DNA, 25 bp, Rattus norvegicus
ccgtgtgctaacaacagtgacgctc

SEQ ID NO: 252001 - DNA, 25 bp, Rattus norvegicus
ccgtgtgctaactacagtgacgctc

SEQ ID NO: 252002 - DNA, 25 bp, Rattus norvegicus
ccgtgtgctgtacgcccttggaaac

SEQ ID NO: 252003 - DNA, 25 bp, Rattus norvegicus
ccgtgtgctgtaggcccttggaaac

SEQ ID NO: 252004 - DNA, 25 bp, Rattus norvegicus
ccgtgtggaaccaaggaaagctgct

SEQ ID NO: 252005 - DNA, 25 bp, Rattus norvegicus
ccgtgtggaacctaggaaagctgct

SEQ ID NO: 252006 - DNA, 25 bp, Rattus norvegicus
ccgtgtggattcacatgttagactt

SEQ ID NO: 252007 - DNA, 25 bp, Rattus norvegicus
ccgtgtggattctcatgttagactt

SEQ ID NO: 252008 - DNA, 25 bp, Rattus norvegicus
ccgtgtggcttgacacctaggaagc

SEQ ID NO: 252009 - DNA, 25 bp, Rattus norvegicus
ccgtgtggcttgtcacctaggaagc

SEQ ID NO: 252010 - DNA, 25 bp, Rattus norvegicus
ccgtgtggtacgatctgtttgtaat

SEQ ID NO: 252011 - DNA, 25 bp, Rattus norvegicus
ccgtgtggtacgttctgtttgtaat

SEQ ID NO: 252012 - DNA, 25 bp, Rattus norvegicus
ccgtgtgtccgacgtcaatgtgcag

SEQ ID NO: 252013 - DNA, 25 bp, Rattus norvegicus
ccgtgtgtccgaggtcaatgtgcag

SEQ ID NO: 252014 - DNA, 25 bp, Rattus norvegicus
ccgtgtgtcctgagctttggttaat

SEQ ID NO: 252015 - DNA, 25 bp, Rattus norvegicus
ccgtgtgtcctgtgctttggttaat

SEQ ID NO: 252016 - DNA, 25 bp, Rattus norvegicus
ccgtgtgtgcaacttagaaagtgac

SEQ ID NO: 252017 - DNA, 25 bp, Rattus norvegicus
ccgtgtgtgcaagttagaaagtgac

SEQ ID NO: 252018 - DNA, 25 bp, Rattus norvegicus
ccgtgtgtgggcagcacttggccct

SEQ ID NO: 252019 - DNA, 25 bp, Rattus norvegicus
ccgtgtgtgggctgcacttggccct

SEQ ID NO: 252020 - DNA, 25 bp, Rattus norvegicus
ccgtgtgttacaatcttctgagttt

SEQ ID NO: 252021 - DNA, 25 bp, Rattus norvegicus
ccgtgtgttacattcttctgagttt

SEQ ID NO: 252022 - DNA, 25 bp, Rattus norvegicus
ccgtgtgttcttcctttgaggtagt

SEQ ID NO: 252023 - DNA, 25 bp, Rattus norvegicus
ccgtgtgttcttgctttgaggtagt

SEQ ID NO: 252024 - DNA, 25 bp, Rattus norvegicus
ccgtgttcaggcaggtctgctgaga

SEQ ID NO: 252025 - DNA, 25 bp, Rattus norvegicus
ccgtgttcaggctggtctgctgaga

SEQ ID NO: 252026 - DNA, 25 bp, Rattus norvegicus
ccgtgttcatggctgaggtttctct

SEQ ID NO: 252027 - DNA, 25 bp, Rattus norvegicus
ccgtgttcatgggtgaggtttctct

SEQ ID NO: 252028 - DNA, 25 bp, Rattus norvegicus
ccgtgttcccatcctgacatactga

SEQ ID NO: 252029 - DNA, 25 bp, Rattus norvegicus
ccgtgttcccatgctgacatactga

SEQ ID NO: 252030 - DNA, 25 bp, Rattus norvegicus
ccgtgtttgcttaccgagcagtgaa

SEQ ID NO: 252031 - DNA, 25 bp, Rattus norvegicus
ccgtgtttgctttccgagcagtgaa

SEQ ID NO: 252032 - DNA, 25 bp, Rattus norvegicus
ccgtgtttgtggatacacacataaa

SEQ ID NO: 252033 - DNA, 25 bp, Rattus norvegicus
ccgtgtttgtggttacacacataaa

SEQ ID NO: 252034 - DNA, 25 bp, Rattus norvegicus
ccgtgtttgtgtctttcattgtggt

SEQ ID NO: 252035 - DNA, 25 bp, Rattus norvegicus
ccgtgtttgtgtgtttcattgtggt

SEQ ID NO: 252036 - DNA, 25 bp, Rattus norvegicus
ccgttacacagacgctttgctgcag

SEQ ID NO: 252037 - DNA, 25 bp, Rattus norvegicus
ccgttacacagaggctttgctgcag

SEQ ID NO: 252038 - DNA, 25 bp, Rattus norvegicus
ccgttaccatggaccgcaatgtgta

SEQ ID NO: 252039 - DNA, 25 bp, Rattus norvegicus
ccgttaccatggtccgcaatgtgta

SEQ ID NO: 252040 - DNA, 25 bp, Rattus norvegicus
ccgttacctggacgtggtcaatcgg

SEQ ID NO: 252041 - DNA, 25 bp, Rattus norvegicus
ccgttacctggaggtggtcaatcgg

SEQ ID NO: 252042 - DNA, 25 bp, Rattus norvegicus
ccgttagcgagtctgtgtttgccaa

SEQ ID NO: 252043 - DNA, 25 bp, Rattus norvegicus
ccgttagcgagtgtgtgtttgccaa

SEQ ID NO: 252044 - DNA, 25 bp, Rattus norvegicus
ccgttagtctagcatctttcaagat

SEQ ID NO: 252045 - DNA, 25 bp, Rattus norvegicus
ccgttagtctaggatctttcaagat

SEQ ID NO: 252046 - DNA, 25 bp, Rattus norvegicus
ccgttatatgttctgtgtttaaaga

SEQ ID NO: 252047 - DNA, 25 bp, Rattus norvegicus
ccgttatatgttgtgtgtttaaaga

SEQ ID NO: 252048 - DNA, 25 bp, Rattus norvegicus
ccgttcaccatgctgtacacaggct

SEQ ID NO: 252049 - DNA, 25 bp, Rattus norvegicus
ccgttcaccatggtgtacacaggct

SEQ ID NO: 252050 - DNA, 25 bp, Rattus norvegicus
ccgttcacgtctctgtcttcagatg

SEQ ID NO: 252051 - DNA, 25 bp, Rattus norvegicus
ccgttcacgtctgtgtcttcagatg

SEQ ID NO: 252052 - DNA, 25 bp, Rattus norvegicus
ccgttcagccttaccttattgtaga

SEQ ID NO: 252053 - DNA, 25 bp, Rattus norvegicus
ccgttcagcctttccttattgtaga

SEQ ID NO: 252054 - DNA, 25 bp, Rattus norvegicus
ccgttcatattgctgacacagcttt

SEQ ID NO: 252055 - DNA, 25 bp, Rattus norvegicus
ccgttcatattggtgacacagcttt

SEQ ID NO: 252056 - DNA, 25 bp, Rattus norvegicus
ccgttcatgggcatgtttgtattgg

SEQ ID NO: 252057 - DNA, 25 bp, Rattus norvegicus
ccgttcatgggcttgtttgtattgg

SEQ ID NO: 252058 - DNA, 25 bp, Rattus norvegicus
ccgttcatgtttagacagccacttt

SEQ ID NO: 252059 - DNA, 25 bp, Rattus norvegicus
ccgttcatgttttgacagccacttt

SEQ ID NO: 252060 - DNA, 25 bp, Rattus norvegicus
ccgttcctttctctgtaggcattga

SEQ ID NO: 252061 - DNA, 25 bp, Rattus norvegicus
ccgttcctttctgtgtaggcattga

SEQ ID NO: 252062 - DNA, 25 bp, Rattus norvegicus
ccgttctccttacccagcatggaaa

SEQ ID NO: 252063 - DNA, 25 bp, Rattus norvegicus
ccgttctccttagccagcatggaaa

SEQ ID NO: 252064 - DNA, 25 bp, Rattus norvegicus
ccgttctgcatcatgttccaattaa

SEQ ID NO: 252065 - DNA, 25 bp, Rattus norvegicus
ccgttctgcatcttgttccaattaa

SEQ ID NO: 252066 - DNA, 25 bp, Rattus norvegicus
ccgttgatcccgatgattcagacat

SEQ ID NO: 252067 - DNA, 25 bp, Rattus norvegicus
ccgttgatcccgttgattcagacat

SEQ ID NO: 252068 - DNA, 25 bp, Rattus norvegicus
ccgttgcatgataggctattgacta

SEQ ID NO: 252069 - DNA, 25 bp, Rattus norvegicus
ccgttgcatgattggctattgacta

SEQ ID NO: 252070 - DNA, 25 bp, Rattus norvegicus
ccgttgctctgcagcgcaccgtagt

SEQ ID NO: 252071 - DNA, 25 bp, Rattus norvegicus
ccgttgctctgctgcgcaccgtagt

SEQ ID NO: 252072 - DNA, 25 bp, Rattus norvegicus
ccgttggcatctcgcattgtggttc

SEQ ID NO: 252073 - DNA, 25 bp, Rattus norvegicus
ccgttggcatctggcattgtggttc

SEQ ID NO: 252074 - DNA, 25 bp, Rattus norvegicus
ccgttggctcttcaataagcagagt

SEQ ID NO: 252075 - DNA, 25 bp, Rattus norvegicus
ccgttggctcttgaataagcagagt

SEQ ID NO: 252076 - DNA, 25 bp, Rattus norvegicus
ccgttgggtttcagcctcagaggca

SEQ ID NO: 252077 - DNA, 25 bp, Rattus norvegicus
ccgttgggtttctgcctcagaggca

SEQ ID NO: 252078 - DNA, 25 bp, Rattus norvegicus
ccgttgtcttctataccacacgaga

SEQ ID NO: 252079 - DNA, 25 bp, Rattus norvegicus
ccgttgtcttctttaccacacgaga

SEQ ID NO: 252080 - DNA, 25 bp, Rattus norvegicus
ccgttgtcttttccagtgtgggtag

SEQ ID NO: 252081 - DNA, 25 bp, Rattus norvegicus
ccgttgtcttttgcagtgtgggtag

SEQ ID NO: 252082 - DNA, 25 bp, Rattus norvegicus
ccgttgttactgcatcgtttaataa

SEQ ID NO: 252083 - DNA, 25 bp, Rattus norvegicus
ccgttgttactggatcgtttaataa

SEQ ID NO: 252084 - DNA, 25 bp, Rattus norvegicus
ccgtttaactctccggtggtaactg

SEQ ID NO: 252085 - DNA, 25 bp, Rattus norvegicus
ccgtttaactctgcggtggtaactg

SEQ ID NO: 252086 - DNA, 25 bp, Rattus norvegicus
ccgtttatgaaaacggcgccggtgc

SEQ ID NO: 252087 - DNA, 25 bp, Rattus norvegicus
ccgtttatgaaatcggcgccggtgc

SEQ ID NO: 252088 - DNA, 25 bp, Rattus norvegicus
ccgtttatgtgaagtgtattccatt

SEQ ID NO: 252089 - DNA, 25 bp, Rattus norvegicus
ccgtttatgtgatgtgtattccatt

SEQ ID NO: 252090 - DNA, 25 bp, Rattus norvegicus
ccgtttccacggctgctgacaaggc

SEQ ID NO: 252091 - DNA, 25 bp, Rattus norvegicus
ccgtttccacgggtgctgacaaggc

SEQ ID NO: 252092 - DNA, 25 bp, Rattus norvegicus
ccgtttccagcaactatgtcttagt

SEQ ID NO: 252093 - DNA, 25 bp, Rattus norvegicus
ccgtttccagcatctatgtcttagt

SEQ ID NO: 252094 - DNA, 25 bp, Rattus norvegicus
ccgtttccccagagcggagaggtat

SEQ ID NO: 252095 - DNA, 25 bp, Rattus norvegicus
ccgtttccccagtgcggagaggtat

SEQ ID NO: 252096 - DNA, 25 bp, Rattus norvegicus
ccgtttctctcacaccaataaagta

SEQ ID NO: 252097 - DNA, 25 bp, Rattus norvegicus
ccgtttctctcagaccaataaagta

SEQ ID NO: 252098 - DNA, 25 bp, Rattus norvegicus
ccgtttctcttcatgctgcaaaata

SEQ ID NO: 252099 - DNA, 25 bp, Rattus norvegicus
ccgtttctcttcttgctgcaaaata

SEQ ID NO: 252100 - DNA, 25 bp, Rattus norvegicus
ccgtttctgtccatggtactgagca

SEQ ID NO: 252101 - DNA, 25 bp, Rattus norvegicus
ccgtttctgtccttggtactgagca

SEQ ID NO: 252102 - DNA, 25 bp, Rattus norvegicus
ccgtttgaccatcccctgatatggg

SEQ ID NO: 252103 - DNA, 25 bp, Rattus norvegicus
ccgtttgaccatgccctgatatggg

SEQ ID NO: 252104 - DNA, 25 bp, Rattus norvegicus
ccgtttgcatctctgggactgggat

SEQ ID NO: 252105 - DNA, 25 bp, Rattus norvegicus
ccgtttgcatctgtgggactgggat

SEQ ID NO: 252106 - DNA, 25 bp, Rattus norvegicus
ccgtttgctgacagtacagtcctga

SEQ ID NO: 252107 - DNA, 25 bp, Rattus norvegicus
ccgtttgctgactgtacagtcctga

SEQ ID NO: 252108 - DNA, 25 bp, Rattus norvegicus
ccgtttgcttggaccctatatgcat

SEQ ID NO: 252109 - DNA, 25 bp, Rattus norvegicus
ccgtttgcttggtccctatatgcat

SEQ ID NO: 252110 - DNA, 25 bp, Rattus norvegicus
ccgtttggctcgagaaggttggtca

SEQ ID NO: 252111 - DNA, 25 bp, Rattus norvegicus
ccgtttggctcgtgaaggttggtca

SEQ ID NO: 252112 - DNA, 25 bp, Rattus norvegicus
ccgtttgtatggctttgctgtcagt

SEQ ID NO: 252113 - DNA, 25 bp, Rattus norvegicus
ccgtttgtatgggtttgctgtcagt

SEQ ID NO: 252114 - DNA, 25 bp, Rattus norvegicus
ccgttttctttacatccttctagat

SEQ ID NO: 252115 - DNA, 25 bp, Rattus norvegicus
ccgttttctttagatccttctagat

SEQ ID NO: 252116 - DNA, 25 bp, Rattus norvegicus
cctaaaccactcatcctcaggaggg

SEQ ID NO: 252117 - DNA, 25 bp, Rattus norvegicus
cctaaaccactcttcctcaggaggg

SEQ ID NO: 252118 - DNA, 25 bp, Rattus norvegicus
cctaaactcgttagttcctgcagag

SEQ ID NO: 252119 - DNA, 25 bp, Rattus norvegicus
cctaaactcgtttgttcctgcagag

SEQ ID NO: 252120 - DNA, 25 bp, Rattus norvegicus
cctaaactcttcagccttacatgga

SEQ ID NO: 252121 - DNA, 25 bp, Rattus norvegicus
cctaaactcttctgccttacatgga

SEQ ID NO: 252122 - DNA, 25 bp, Rattus norvegicus
cctaaactgttgatccgggatggtg

SEQ ID NO: 252123 - DNA, 25 bp, Rattus norvegicus
cctaaactgttgttccgggatggtg

SEQ ID NO: 252124 - DNA, 25 bp, Rattus norvegicus
cctaaagcagccaacccagataaag

SEQ ID NO: 252125 - DNA, 25 bp, Rattus norvegicus
cctaaagcagcctacccagataaag

SEQ ID NO: 252126 - DNA, 25 bp, Rattus norvegicus
cctaaagctacaaggcatttccgcc

SEQ ID NO: 252127 - DNA, 25 bp, Rattus norvegicus
cctaaagctacatggcatttccgcc

SEQ ID NO: 252128 - DNA, 25 bp, Rattus norvegicus
cctaaaggctttctagtcactgtta

SEQ ID NO: 252129 - DNA, 25 bp, Rattus norvegicus
cctaaaggctttgtagtcactgtta

SEQ ID NO: 252130 - DNA, 25 bp, Rattus norvegicus
cctaaagttgtgctacttgctggaa

SEQ ID NO: 252131 - DNA, 25 bp, Rattus norvegicus
cctaaagttgtggtacttgctggaa

SEQ ID NO: 252132 - DNA, 25 bp, Rattus norvegicus
cctaaatctcttaatctccttcatt

SEQ ID NO: 252133 - DNA, 25 bp, Rattus norvegicus
cctaaatctctttatctccttcatt

SEQ ID NO: 252134 - DNA, 25 bp, Rattus norvegicus
cctaaatggactagaactcactatg

SEQ ID NO: 252135 - DNA, 25 bp, Rattus norvegicus
cctaaatggacttgaactcactatg

SEQ ID NO: 252136 - DNA, 25 bp, Rattus norvegicus
cctaacaactttaatcaccatcctt

SEQ ID NO: 252137 - DNA, 25 bp, Rattus norvegicus
cctaacaacttttatcaccatcctt

SEQ ID NO: 252138 - DNA, 25 bp, Rattus norvegicus
cctaacactctaattgcttctctaa

SEQ ID NO: 252139 - DNA, 25 bp, Rattus norvegicus
cctaacactctatttgcttctctaa

SEQ ID NO: 252140 - DNA, 25 bp, Rattus norvegicus
cctaacagaagcactggtgggacta

SEQ ID NO: 252141 - DNA, 25 bp, Rattus norvegicus
cctaacagaagctctggtgggacta

SEQ ID NO: 252142 - DNA, 25 bp, Rattus norvegicus
cctaacatggatcaggccctgagtt

SEQ ID NO: 252143 - DNA, 25 bp, Rattus norvegicus
cctaacatggatgaggccctgagtt

SEQ ID NO: 252144 - DNA, 25 bp, Rattus norvegicus
cctaacattcctatttcttcatcta

SEQ ID NO: 252145 - DNA, 25 bp, Rattus norvegicus
cctaacattcctttttcttcatcta

SEQ ID NO: 252146 - DNA, 25 bp, Rattus norvegicus
cctaacctacctagttttctcatat

SEQ ID NO: 252147 - DNA, 25 bp, Rattus norvegicus
cctaacctaccttgttttctcatat

SEQ ID NO: 252148 - DNA, 25 bp, Rattus norvegicus
cctaacgttgtgagaatctatcgac

SEQ ID NO: 252149 - DNA, 25 bp, Rattus norvegicus
cctaacgttgtgtgaatctatcgac

SEQ ID NO: 252150 - DNA, 25 bp, Rattus norvegicus
cctaactcatcaacttgctgtctaa

SEQ ID NO: 252151 - DNA, 25 bp, Rattus norvegicus
cctaactcatcatcttgctgtctaa

SEQ ID NO: 252152 - DNA, 25 bp, Rattus norvegicus
cctaactctgttatgcattgctcta

SEQ ID NO: 252153 - DNA, 25 bp, Rattus norvegicus
cctaactctgttttgcattgctcta

SEQ ID NO: 252154 - DNA, 25 bp, Rattus norvegicus
cctaacttacttattggtctactca

SEQ ID NO: 252155 - DNA, 25 bp, Rattus norvegicus
cctaacttactttttggtctactca

SEQ ID NO: 252156 - DNA, 25 bp, Rattus norvegicus
cctaagaaatggattgtctccactg

SEQ ID NO: 252157 - DNA, 25 bp, Rattus norvegicus
cctaagaaatggtttgtctccactg

SEQ ID NO: 252158 - DNA, 25 bp, Rattus norvegicus
cctaagagattgattgggcgctgtc

SEQ ID NO: 252159 - DNA, 25 bp, Rattus norvegicus
cctaagagattgtttgggcgctgtc

SEQ ID NO: 252160 - DNA, 25 bp, Rattus norvegicus
cctaagagcaggaagccaggccgcg

SEQ ID NO: 252161 - DNA, 25 bp, Rattus norvegicus
cctaagagcaggtagccaggccgcg

SEQ ID NO: 252162 - DNA, 25 bp, Rattus norvegicus
cctaagagtgggaagctgcaacagt

SEQ ID NO: 252163 - DNA, 25 bp, Rattus norvegicus
cctaagagtgggtagctgcaacagt

SEQ ID NO: 252164 - DNA, 25 bp, Rattus norvegicus
cctaagcaaattatgggatgtccca

SEQ ID NO: 252165 - DNA, 25 bp, Rattus norvegicus
cctaagcaaattttgggatgtccca

SEQ ID NO: 252166 - DNA, 25 bp, Rattus norvegicus
cctaagctttttacagtgacctgaa

SEQ ID NO: 252167 - DNA, 25 bp, Rattus norvegicus
cctaagcttttttcagtgacctgaa

SEQ ID NO: 252168 - DNA, 25 bp, Rattus norvegicus
cctaaggacctgactgagacatgca

SEQ ID NO: 252169 - DNA, 25 bp, Rattus norvegicus
cctaaggacctgtctgagacatgca

SEQ ID NO: 252170 - DNA, 25 bp, Rattus norvegicus
cctaaggctttgacgcaggtgctaa

SEQ ID NO: 252171 - DNA, 25 bp, Rattus norvegicus
cctaaggctttgtcgcaggtgctaa

SEQ ID NO: 252172 - DNA, 25 bp, Rattus norvegicus
cctaataactacatgtggctcacag

SEQ ID NO: 252173 - DNA, 25 bp, Rattus norvegicus
cctaataactacttgtggctcacag

SEQ ID NO: 252174 - DNA, 25 bp, Rattus norvegicus
cctaatagatcgacttctaccaaga

SEQ ID NO: 252175 - DNA, 25 bp, Rattus norvegicus
cctaatagatcgtcttctaccaaga

SEQ ID NO: 252176 - DNA, 25 bp, Rattus norvegicus
cctaatattctgcaaggtctttaat

SEQ ID NO: 252177 - DNA, 25 bp, Rattus norvegicus
cctaatattctggaaggtctttaat

SEQ ID NO: 252178 - DNA, 25 bp, Rattus norvegicus
cctaatgggcacaatcggcggcgga

SEQ ID NO: 252179 - DNA, 25 bp, Rattus norvegicus
cctaatgggcactatcggcggcgga

SEQ ID NO: 252180 - DNA, 25 bp, Rattus norvegicus
cctaatgttgctaggaggtctccca

SEQ ID NO: 252181 - DNA, 25 bp, Rattus norvegicus
cctaatgttgcttggaggtctccca

SEQ ID NO: 252182 - DNA, 25 bp, Rattus norvegicus
cctaatgttggcattttcctaagag

SEQ ID NO: 252183 - DNA, 25 bp, Rattus norvegicus
cctaatgttggctttttcctaagag

SEQ ID NO: 252184 - DNA, 25 bp, Rattus norvegicus
cctaatttctagactgcactcttca

SEQ ID NO: 252185 - DNA, 25 bp, Rattus norvegicus
cctaatttctagtctgcactcttca

SEQ ID NO: 252186 - DNA, 25 bp, Rattus norvegicus
cctaatttgggtactggcgagtggt

SEQ ID NO: 252187 - DNA, 25 bp, Rattus norvegicus
cctaatttgggttctggcgagtggt

SEQ ID NO: 252188 - DNA, 25 bp, Rattus norvegicus
cctaatttgtgtacagagctgtgtt

SEQ ID NO: 252189 - DNA, 25 bp, Rattus norvegicus
cctaatttgtgttcagagctgtgtt

SEQ ID NO: 252190 - DNA, 25 bp, Rattus norvegicus
cctacaaacacgcagcaggctattt

SEQ ID NO: 252191 - DNA, 25 bp, Rattus norvegicus
cctacaaacacggagcaggctattt

SEQ ID NO: 252192 - DNA, 25 bp, Rattus norvegicus
cctacaaacccaacagtctgggaga

SEQ ID NO: 252193 - DNA, 25 bp, Rattus norvegicus
cctacaaacccatcagtctgggaga

SEQ ID NO: 252194 - DNA, 25 bp, Rattus norvegicus
cctacaaagggtacagtttccacag

SEQ ID NO: 252195 - DNA, 25 bp, Rattus norvegicus
cctacaaagggttcagtttccacag

SEQ ID NO: 252196 - DNA, 25 bp, Rattus norvegicus
cctacacaatatctacactggtttt

SEQ ID NO: 252197 - DNA, 25 bp, Rattus norvegicus
cctacacaatatgtacactggtttt

SEQ ID NO: 252198 - DNA, 25 bp, Rattus norvegicus
cctacaccattgctcaggctgagta

SEQ ID NO: 252199 - DNA, 25 bp, Rattus norvegicus
cctacaccattggtcaggctgagta

SEQ ID NO: 252200 - DNA, 25 bp, Rattus norvegicus
cctacacccagtatgctagcatgat

SEQ ID NO: 252201 - DNA, 25 bp, Rattus norvegicus
cctacacccagtttgctagcatgat

SEQ ID NO: 252202 - DNA, 25 bp, Rattus norvegicus
cctacagaaagcatgccgcgtggca

SEQ ID NO: 252203 - DNA, 25 bp, Rattus norvegicus
cctacagaaagcttgccgcgtggca

SEQ ID NO: 252204 - DNA, 25 bp, Rattus norvegicus
cctacagcctggacgcacggacgga

SEQ ID NO: 252205 - DNA, 25 bp, Rattus norvegicus
cctacagcctggtcgcacggacgga

SEQ ID NO: 252206 - DNA, 25 bp, Rattus norvegicus
cctacagtgactcagagtgttttga

SEQ ID NO: 252207 - DNA, 25 bp, Rattus norvegicus
cctacagtgactgagagtgttttga

SEQ ID NO: 252208 - DNA, 25 bp, Rattus norvegicus
cctacagtggtaactgctcttttgt

SEQ ID NO: 252209 - DNA, 25 bp, Rattus norvegicus
cctacagtggtatctgctcttttgt

SEQ ID NO: 252210 - DNA, 25 bp, Rattus norvegicus
cctacatccaccactaagaaacagt

SEQ ID NO: 252211 - DNA, 25 bp, Rattus norvegicus
cctacatccacctctaagaaacagt

SEQ ID NO: 252212 - DNA, 25 bp, Rattus norvegicus
cctacatctctcatcaggatctaat

SEQ ID NO: 252213 - DNA, 25 bp, Rattus norvegicus
cctacatctctcttcaggatctaat

SEQ ID NO: 252214 - DNA, 25 bp, Rattus norvegicus
cctacatctgagagccatctgtaaa

SEQ ID NO: 252215 - DNA, 25 bp, Rattus norvegicus
cctacatctgagtgccatctgtaaa

SEQ ID NO: 252216 - DNA, 25 bp, Rattus norvegicus
cctacatctggaaacggcccatata

SEQ ID NO: 252217 - DNA, 25 bp, Rattus norvegicus
cctacatctggatacggcccatata

SEQ ID NO: 252218 - DNA, 25 bp, Rattus norvegicus
cctacatgtacccatcctatgaata

SEQ ID NO: 252219 - DNA, 25 bp, Rattus norvegicus
cctacatgtaccgatcctatgaata

SEQ ID NO: 252220 - DNA, 25 bp, Rattus norvegicus
cctacatgtgtaatccttttcctga

SEQ ID NO: 252221 - DNA, 25 bp, Rattus norvegicus
cctacatgtgtattccttttcctga

SEQ ID NO: 252222 - DNA, 25 bp, Rattus norvegicus
cctaccaattaccacaagctcaaaa

SEQ ID NO: 252223 - DNA, 25 bp, Rattus norvegicus
cctaccaattacgacaagctcaaaa

SEQ ID NO: 252224 - DNA, 25 bp, Rattus norvegicus
cctaccacaggcatccatgtataat

SEQ ID NO: 252225 - DNA, 25 bp, Rattus norvegicus
cctaccacaggcttccatgtataat

SEQ ID NO: 252226 - DNA, 25 bp, Rattus norvegicus
cctaccacagtgactatatcggaga

SEQ ID NO: 252227 - DNA, 25 bp, Rattus norvegicus
cctaccacagtgtctatatcggaga

SEQ ID NO: 252228 - DNA, 25 bp, Rattus norvegicus
cctaccagcaccacataaatatcag

SEQ ID NO: 252229 - DNA, 25 bp, Rattus norvegicus
cctaccagcacctcataaatatcag

SEQ ID NO: 252230 - DNA, 25 bp, Rattus norvegicus
cctacccacttgcattctattagta

SEQ ID NO: 252231 - DNA, 25 bp, Rattus norvegicus
cctacccacttggattctattagta

SEQ ID NO: 252232 - DNA, 25 bp, Rattus norvegicus
cctacccagcaacacttcaaaatta

SEQ ID NO: 252233 - DNA, 25 bp, Rattus norvegicus
cctacccagcaagacttcaaaatta

SEQ ID NO: 252234 - DNA, 25 bp, Rattus norvegicus
cctacccatccacatacagtaatag

SEQ ID NO: 252235 - DNA, 25 bp, Rattus norvegicus
cctacccatccagatacagtaatag

SEQ ID NO: 252236 - DNA, 25 bp, Rattus norvegicus
cctacccctccaacttaaacataca

SEQ ID NO: 252237 - DNA, 25 bp, Rattus norvegicus
cctacccctccatcttaaacataca

SEQ ID NO: 252238 - DNA, 25 bp, Rattus norvegicus
cctacccttatgacttttcatgtgt

SEQ ID NO: 252239 - DNA, 25 bp, Rattus norvegicus
cctacccttatgtcttttcatgtgt

SEQ ID NO: 252240 - DNA, 25 bp, Rattus norvegicus
cctacccttcaaactttgctgttaa

SEQ ID NO: 252241 - DNA, 25 bp, Rattus norvegicus
cctacccttcaatctttgctgttaa

SEQ ID NO: 252242 - DNA, 25 bp, Rattus norvegicus
cctaccgtacgtcaatgcagccaga

SEQ ID NO: 252243 - DNA, 25 bp, Rattus norvegicus
cctaccgtacgtgaatgcagccaga

SEQ ID NO: 252244 - DNA, 25 bp, Rattus norvegicus
cctaccgtctgcagtgatgggattg

SEQ ID NO: 252245 - DNA, 25 bp, Rattus norvegicus
cctaccgtctgctgtgatgggattg

SEQ ID NO: 252246 - DNA, 25 bp, Rattus norvegicus
cctacctactttcctgatggagacg

SEQ ID NO: 252247 - DNA, 25 bp, Rattus norvegicus
cctacctactttgctgatggagacg

SEQ ID NO: 252248 - DNA, 25 bp, Rattus norvegicus
cctacctcaaggacaagatgcgaaa

SEQ ID NO: 252249 - DNA, 25 bp, Rattus norvegicus
cctacctcaaggtcaagatgcgaaa

SEQ ID NO: 252250 - DNA, 25 bp, Rattus norvegicus
cctacctccctaaatcaagcatgat

SEQ ID NO: 252251 - DNA, 25 bp, Rattus norvegicus
cctacctccctatatcaagcatgat

SEQ ID NO: 252252 - DNA, 25 bp, Rattus norvegicus
cctacctccgttcatgacttttgtg

SEQ ID NO: 252253 - DNA, 25 bp, Rattus norvegicus
cctacctccgttgatgacttttgtg

SEQ ID NO: 252254 - DNA, 25 bp, Rattus norvegicus
cctacctccttcaattgttggaaca

SEQ ID NO: 252255 - DNA, 25 bp, Rattus norvegicus
cctacctccttctattgttggaaca

SEQ ID NO: 252256 - DNA, 25 bp, Rattus norvegicus
cctacctctgaacttgtccatttta

SEQ ID NO: 252257 - DNA, 25 bp, Rattus norvegicus
cctacctctgaagttgtccatttta

SEQ ID NO: 252258 - DNA, 25 bp, Rattus norvegicus
cctacctgcttcagtctagagagat

SEQ ID NO: 252259 - DNA, 25 bp, Rattus norvegicus
cctacctgcttctgtctagagagat

SEQ ID NO: 252260 - DNA, 25 bp, Rattus norvegicus
cctacctggcttaagcgggaagaat

SEQ ID NO: 252261 - DNA, 25 bp, Rattus norvegicus
cctacctggctttagcgggaagaat

SEQ ID NO: 252262 - DNA, 25 bp, Rattus norvegicus
cctacctgtagccagtctgtggaag

SEQ ID NO: 252263 - DNA, 25 bp, Rattus norvegicus
cctacctgtagcgagtctgtggaag

SEQ ID NO: 252264 - DNA, 25 bp, Rattus norvegicus
cctacctgtaggcaatagattgcta

SEQ ID NO: 252265 - DNA, 25 bp, Rattus norvegicus
cctacctgtagggaatagattgcta

SEQ ID NO: 252266 - DNA, 25 bp, Rattus norvegicus
cctacgaagaagcatgggcagtgcc

SEQ ID NO: 252267 - DNA, 25 bp, Rattus norvegicus
cctacgaagaaggatgggcagtgcc

SEQ ID NO: 252268 - DNA, 25 bp, Rattus norvegicus
cctacgactgtcattaaactggtgt

SEQ ID NO: 252269 - DNA, 25 bp, Rattus norvegicus
cctacgactgtctttaaactggtgt

SEQ ID NO: 252270 - DNA, 25 bp, Rattus norvegicus
cctacgcaccgtatctatggatttg

SEQ ID NO: 252271 - DNA, 25 bp, Rattus norvegicus
cctacgcaccgtttctatggatttg

SEQ ID NO: 252272 - DNA, 25 bp, Rattus norvegicus
cctacgcatgtgagttccacacaaa

SEQ ID NO: 252273 - DNA, 25 bp, Rattus norvegicus
cctacgcatgtgtgttccacacaaa

SEQ ID NO: 252274 - DNA, 25 bp, Rattus norvegicus
cctacgcttatactttctggactta

SEQ ID NO: 252275 - DNA, 25 bp, Rattus norvegicus
cctacgcttatagtttctggactta

SEQ ID NO: 252276 - DNA, 25 bp, Rattus norvegicus
cctacgggagccagtcagtggaaca

SEQ ID NO: 252277 - DNA, 25 bp, Rattus norvegicus
cctacgggagcctgtcagtggaaca

SEQ ID NO: 252278 - DNA, 25 bp, Rattus norvegicus
cctacggtttatcctctttgcttaa

SEQ ID NO: 252279 - DNA, 25 bp, Rattus norvegicus
cctacggtttatgctctttgcttaa

SEQ ID NO: 252280 - DNA, 25 bp, Rattus norvegicus
cctacgtgtgccagccgtgtgcaag

SEQ ID NO: 252281 - DNA, 25 bp, Rattus norvegicus
cctacgtgtgcctgccgtgtgcaag

SEQ ID NO: 252282 - DNA, 25 bp, Rattus norvegicus
cctactatgtatcttttgccttttc

SEQ ID NO: 252283 - DNA, 25 bp, Rattus norvegicus
cctactatgtatgttttgccttttc

SEQ ID NO: 252284 - DNA, 25 bp, Rattus norvegicus
cctactccacctagtgtcattgtaa

SEQ ID NO: 252285 - DNA, 25 bp, Rattus norvegicus
cctactccaccttgtgtcattgtaa

SEQ ID NO: 252286 - DNA, 25 bp, Rattus norvegicus
cctactccattgaggttctttgaga

SEQ ID NO: 252287 - DNA, 25 bp, Rattus norvegicus
cctactccattgtggttctttgaga

SEQ ID NO: 252288 - DNA, 25 bp, Rattus norvegicus
cctactcccttcagaaatgagcctt

SEQ ID NO: 252289 - DNA, 25 bp, Rattus norvegicus
cctactcccttctgaaatgagcctt

SEQ ID NO: 252290 - DNA, 25 bp, Rattus norvegicus
cctactccgctgacacattatgtga

SEQ ID NO: 252291 - DNA, 25 bp, Rattus norvegicus
cctactccgctgtcacattatgtga

SEQ ID NO: 252292 - DNA, 25 bp, Rattus norvegicus
cctactcgacccagtttttatgata

SEQ ID NO: 252293 - DNA, 25 bp, Rattus norvegicus
cctactcgaccctgtttttatgata

SEQ ID NO: 252294 - DNA, 25 bp, Rattus norvegicus
cctactctcaagattctctgtggaa

SEQ ID NO: 252295 - DNA, 25 bp, Rattus norvegicus
cctactctcaagtttctctgtggaa

SEQ ID NO: 252296 - DNA, 25 bp, Rattus norvegicus
cctactctgtttcctgtgtgtggag

SEQ ID NO: 252297 - DNA, 25 bp, Rattus norvegicus
cctactctgtttgctgtgtgtggag

SEQ ID NO: 252298 - DNA, 25 bp, Rattus norvegicus
cctactcttctactcttacagagga

SEQ ID NO: 252299 - DNA, 25 bp, Rattus norvegicus
cctactcttctagtcttacagagga

SEQ ID NO: 252300 - DNA, 25 bp, Rattus norvegicus
cctactgcgactccaggacctggtg

SEQ ID NO: 252301 - DNA, 25 bp, Rattus norvegicus
cctactgcgactgcaggacctggtg

SEQ ID NO: 252302 - DNA, 25 bp, Rattus norvegicus
cctactggatgactcctgaagtcat

SEQ ID NO: 252303 - DNA, 25 bp, Rattus norvegicus
cctactggatgagtcctgaagtcat

SEQ ID NO: 252304 - DNA, 25 bp, Rattus norvegicus
cctactgggttgaggagtctacgtg

SEQ ID NO: 252305 - DNA, 25 bp, Rattus norvegicus
cctactgggttgtggagtctacgtg

SEQ ID NO: 252306 - DNA, 25 bp, Rattus norvegicus
cctactgtagctatctcagggttaa

SEQ ID NO: 252307 - DNA, 25 bp, Rattus norvegicus
cctactgtagctttctcagggttaa

SEQ ID NO: 252308 - DNA, 25 bp, Rattus norvegicus
cctactgtataaattggatcactgg

SEQ ID NO: 252309 - DNA, 25 bp, Rattus norvegicus
cctactgtataatttggatcactgg

SEQ ID NO: 252310 - DNA, 25 bp, Rattus norvegicus
cctactgtcttaatcatccctaaga

SEQ ID NO: 252311 - DNA, 25 bp, Rattus norvegicus
cctactgtcttattcatccctaaga

SEQ ID NO: 252312 - DNA, 25 bp, Rattus norvegicus
cctactgttacccaagaagtgcctt

SEQ ID NO: 252313 - DNA, 25 bp, Rattus norvegicus
cctactgttaccgaagaagtgcctt

SEQ ID NO: 252314 - DNA, 25 bp, Rattus norvegicus
cctactgttcttccctgcagatcga

SEQ ID NO: 252315 - DNA, 25 bp, Rattus norvegicus
cctactgttcttgcctgcagatcga

SEQ ID NO: 252316 - DNA, 25 bp, Rattus norvegicus
cctacttatttgaggttcggtacag

SEQ ID NO: 252317 - DNA, 25 bp, Rattus norvegicus
cctacttatttgtggttcggtacag

SEQ ID NO: 252318 - DNA, 25 bp, Rattus norvegicus
cctacttcaaagcaatggaagggcg

SEQ ID NO: 252319 - DNA, 25 bp, Rattus norvegicus
cctacttcaaaggaatggaagggcg

SEQ ID NO: 252320 - DNA, 25 bp, Rattus norvegicus
cctacttcactcctgttggtacgaa

SEQ ID NO: 252321 - DNA, 25 bp, Rattus norvegicus
cctacttcactcgtgttggtacgaa

SEQ ID NO: 252322 - DNA, 25 bp, Rattus norvegicus
cctacttccctcactttaatacaag

SEQ ID NO: 252323 - DNA, 25 bp, Rattus norvegicus
cctacttccctctctttaatacaag

SEQ ID NO: 252324 - DNA, 25 bp, Rattus norvegicus
cctacttccctgctatgtgaagcga

SEQ ID NO: 252325 - DNA, 25 bp, Rattus norvegicus
cctacttccctggtatgtgaagcga

SEQ ID NO: 252326 - DNA, 25 bp, Rattus norvegicus
cctacttctctcacattgatgtaag

SEQ ID NO: 252327 - DNA, 25 bp, Rattus norvegicus
cctacttctctctcattgatgtaag

SEQ ID NO: 252328 - DNA, 25 bp, Rattus norvegicus
cctacttggctgatgactcgggcaa

SEQ ID NO: 252329 - DNA, 25 bp, Rattus norvegicus
cctacttggctgttgactcgggcaa

SEQ ID NO: 252330 - DNA, 25 bp, Rattus norvegicus
cctactttccatattcttccattat

SEQ ID NO: 252331 - DNA, 25 bp, Rattus norvegicus
cctactttccattttcttccattat

SEQ ID NO: 252332 - DNA, 25 bp, Rattus norvegicus
cctagaagggagactgctgccattt

SEQ ID NO: 252333 - DNA, 25 bp, Rattus norvegicus
cctagaagggagtctgctgccattt

SEQ ID NO: 252334 - DNA, 25 bp, Rattus norvegicus
cctagactagcaccaagggaccagt

SEQ ID NO: 252335 - DNA, 25 bp, Rattus norvegicus
cctagactagcagcaagggaccagt

SEQ ID NO: 252336 - DNA, 25 bp, Rattus norvegicus
cctagactctgcatggcagctaggg

SEQ ID NO: 252337 - DNA, 25 bp, Rattus norvegicus
cctagactctgcttggcagctaggg

SEQ ID NO: 252338 - DNA, 25 bp, Rattus norvegicus
cctagactgtgtacatttttacgag

SEQ ID NO: 252339 - DNA, 25 bp, Rattus norvegicus
cctagactgtgttcatttttacgag

SEQ ID NO: 252340 - DNA, 25 bp, Rattus norvegicus
cctagacttcgaccaagagatggcc

SEQ ID NO: 252341 - DNA, 25 bp, Rattus norvegicus
cctagacttcgagcaagagatggcc

SEQ ID NO: 252342 - DNA, 25 bp, Rattus norvegicus
cctagacttctgagccttggatggt

SEQ ID NO: 252343 - DNA, 25 bp, Rattus norvegicus
cctagacttctgtgccttggatggt

SEQ ID NO: 252344 - DNA, 25 bp, Rattus norvegicus
cctagagaactaatcttgggcttca

SEQ ID NO: 252345 - DNA, 25 bp, Rattus norvegicus
cctagagaactattcttgggcttca

SEQ ID NO: 252346 - DNA, 25 bp, Rattus norvegicus
cctagagacagaccgacgacggcaa

SEQ ID NO: 252347 - DNA, 25 bp, Rattus norvegicus
cctagagacagagcgacgacggcaa

SEQ ID NO: 252348 - DNA, 25 bp, Rattus norvegicus
cctagagcacagacttggacagcat

SEQ ID NO: 252349 - DNA, 25 bp, Rattus norvegicus
cctagagcacagtcttggacagcat

SEQ ID NO: 252350 - DNA, 25 bp, Rattus norvegicus
cctagagccggccagcgtttgagaa

SEQ ID NO: 252351 - DNA, 25 bp, Rattus norvegicus
cctagagccggcgagcgtttgagaa

SEQ ID NO: 252352 - DNA, 25 bp, Rattus norvegicus
cctagagctaggcagtttgctacta

SEQ ID NO: 252353 - DNA, 25 bp, Rattus norvegicus
cctagagctagggagtttgctacta

SEQ ID NO: 252354 - DNA, 25 bp, Rattus norvegicus
cctagaggacctcccacagggtgtg

SEQ ID NO: 252355 - DNA, 25 bp, Rattus norvegicus
cctagaggacctgccacagggtgtg

SEQ ID NO: 252356 - DNA, 25 bp, Rattus norvegicus
cctagaggccatccgagtttgagct

SEQ ID NO: 252357 - DNA, 25 bp, Rattus norvegicus
cctagaggccatgcgagtttgagct

SEQ ID NO: 252358 - DNA, 25 bp, Rattus norvegicus
cctagaggcctcattctggaagaac

SEQ ID NO: 252359 - DNA, 25 bp, Rattus norvegicus
cctagaggcctctttctggaagaac

SEQ ID NO: 252360 - DNA, 25 bp, Rattus norvegicus
cctagagtgcgccttgtgtataaga

SEQ ID NO: 252361 - DNA, 25 bp, Rattus norvegicus
cctagagtgcgcgttgtgtataaga

SEQ ID NO: 252362 - DNA, 25 bp, Rattus norvegicus
cctagataacccctgtgctatttac

SEQ ID NO: 252363 - DNA, 25 bp, Rattus norvegicus
cctagataacccgtgtgctatttac

SEQ ID NO: 252364 - DNA, 25 bp, Rattus norvegicus
cctagatattgaatttgccacccgc

SEQ ID NO: 252365 - DNA, 25 bp, Rattus norvegicus
cctagatattgattttgccacccgc

SEQ ID NO: 252366 - DNA, 25 bp, Rattus norvegicus
cctagatccccgagctgacttaggg

SEQ ID NO: 252367 - DNA, 25 bp, Rattus norvegicus
cctagatccccgtgctgacttaggg

SEQ ID NO: 252368 - DNA, 25 bp, Rattus norvegicus
cctagatgtgttacagaagcacagt

SEQ ID NO: 252369 - DNA, 25 bp, Rattus norvegicus
cctagatgtgtttcagaagcacagt

SEQ ID NO: 252370 - DNA, 25 bp, Rattus norvegicus
cctagcacagtgcagattttcataa

SEQ ID NO: 252371 - DNA, 25 bp, Rattus norvegicus
cctagcacagtggagattttcataa

SEQ ID NO: 252372 - DNA, 25 bp, Rattus norvegicus
cctagcactgggattctactggtat

SEQ ID NO: 252373 - DNA, 25 bp, Rattus norvegicus
cctagcactgggtttctactggtat

SEQ ID NO: 252374 - DNA, 25 bp, Rattus norvegicus
cctagcatatggattttcagcccac

SEQ ID NO: 252375 - DNA, 25 bp, Rattus norvegicus
cctagcatatggtttttcagcccac

SEQ ID NO: 252376 - DNA, 25 bp, Rattus norvegicus
cctagcctcaggctctgcttaaaaa

SEQ ID NO: 252377 - DNA, 25 bp, Rattus norvegicus
cctagcctcagggtctgcttaaaaa

SEQ ID NO: 252378 - DNA, 25 bp, Rattus norvegicus
cctagcctcattcactttgttcaag

SEQ ID NO: 252379 - DNA, 25 bp, Rattus norvegicus
cctagcctcattgactttgttcaag

SEQ ID NO: 252380 - DNA, 25 bp, Rattus norvegicus
cctagcctgtgcctatttgtgcagg

SEQ ID NO: 252381 - DNA, 25 bp, Rattus norvegicus
cctagcctgtgcgtatttgtgcagg

SEQ ID NO: 252382 - DNA, 25 bp, Rattus norvegicus
cctagcgagtccagcgaatctgaaa

SEQ ID NO: 252383 - DNA, 25 bp, Rattus norvegicus
cctagcgagtcctgcgaatctgaaa

SEQ ID NO: 252384 - DNA, 25 bp, Rattus norvegicus
cctagctcctaaactactgtagtca

SEQ ID NO: 252385 - DNA, 25 bp, Rattus norvegicus
cctagctcctaatctactgtagtca

SEQ ID NO: 252386 - DNA, 25 bp, Rattus norvegicus
cctagctgagctccgcctttaatgg

SEQ ID NO: 252387 - DNA, 25 bp, Rattus norvegicus
cctagctgagctgcgcctttaatgg

SEQ ID NO: 252388 - DNA, 25 bp, Rattus norvegicus
cctagctgtggtacgcaggtgtgta

SEQ ID NO: 252389 - DNA, 25 bp, Rattus norvegicus
cctagctgtggttcgcaggtgtgta

SEQ ID NO: 252390 - DNA, 25 bp, Rattus norvegicus
cctagcttccttccttcagaattga

SEQ ID NO: 252391 - DNA, 25 bp, Rattus norvegicus
cctagcttccttgcttcagaattga

SEQ ID NO: 252392 - DNA, 25 bp, Rattus norvegicus
cctagcttttggatgtttcaacatt

SEQ ID NO: 252393 - DNA, 25 bp, Rattus norvegicus
cctagcttttggttgtttcaacatt

SEQ ID NO: 252394 - DNA, 25 bp, Rattus norvegicus
cctaggaagagccacaaattgaaac

SEQ ID NO: 252395 - DNA, 25 bp, Rattus norvegicus
cctaggaagagcgacaaattgaaac

SEQ ID NO: 252396 - DNA, 25 bp, Rattus norvegicus
cctaggactcccagctcaaataaat

SEQ ID NO: 252397 - DNA, 25 bp, Rattus norvegicus
cctaggactccctgctcaaataaat

SEQ ID NO: 252398 - DNA, 25 bp, Rattus norvegicus
cctaggactgtcctcaggcagtaaa

SEQ ID NO: 252399 - DNA, 25 bp, Rattus norvegicus
cctaggactgtcgtcaggcagtaaa

SEQ ID NO: 252400 - DNA, 25 bp, Rattus norvegicus
cctaggagctttcgtttggtgtctg

SEQ ID NO: 252401 - DNA, 25 bp, Rattus norvegicus
cctaggagctttggtttggtgtctg

SEQ ID NO: 252402 - DNA, 25 bp, Rattus norvegicus
cctaggagtaggctgtctgcacaga

SEQ ID NO: 252403 - DNA, 25 bp, Rattus norvegicus
cctaggagtagggtgtctgcacaga

SEQ ID NO: 252404 - DNA, 25 bp, Rattus norvegicus
cctaggattcccataaaagccacat

SEQ ID NO: 252405 - DNA, 25 bp, Rattus norvegicus
cctaggattcccttaaaagccacat

SEQ ID NO: 252406 - DNA, 25 bp, Rattus norvegicus
cctaggcatcctacttttgtttata

SEQ ID NO: 252407 - DNA, 25 bp, Rattus norvegicus
cctaggcatccttcttttgtttata

SEQ ID NO: 252408 - DNA, 25 bp, Rattus norvegicus
cctaggccccttatatcatatcaat

SEQ ID NO: 252409 - DNA, 25 bp, Rattus norvegicus
cctaggccccttttatcatatcaat

SEQ ID NO: 252410 - DNA, 25 bp, Rattus norvegicus
cctaggccggtgatcttggagattt

SEQ ID NO: 252411 - DNA, 25 bp, Rattus norvegicus
cctaggccggtgttcttggagattt

SEQ ID NO: 252412 - DNA, 25 bp, Rattus norvegicus
cctaggcgggtcacaaacatctgga

SEQ ID NO: 252413 - DNA, 25 bp, Rattus norvegicus
cctaggcgggtctcaaacatctgga

SEQ ID NO: 252414 - DNA, 25 bp, Rattus norvegicus
cctaggcgtggtctgtgtgacatct

SEQ ID NO: 252415 - DNA, 25 bp, Rattus norvegicus
cctaggcgtggtgtgtgtgacatct

SEQ ID NO: 252416 - DNA, 25 bp, Rattus norvegicus
cctaggctacagaagaaattgggct

SEQ ID NO: 252417 - DNA, 25 bp, Rattus norvegicus
cctaggctacagtagaaattgggct

SEQ ID NO: 252418 - DNA, 25 bp, Rattus norvegicus
cctaggctagtcaggaatttgagtc

SEQ ID NO: 252419 - DNA, 25 bp, Rattus norvegicus
cctaggctagtctggaatttgagtc

SEQ ID NO: 252420 - DNA, 25 bp, Rattus norvegicus
cctagggatcccagatgtcatcatg

SEQ ID NO: 252421 - DNA, 25 bp, Rattus norvegicus
cctagggatccctgatgtcatcatg

SEQ ID NO: 252422 - DNA, 25 bp, Rattus norvegicus
cctagggctcctaaccatcaacatt

SEQ ID NO: 252423 - DNA, 25 bp, Rattus norvegicus
cctagggctccttaccatcaacatt

SEQ ID NO: 252424 - DNA, 25 bp, Rattus norvegicus
cctagggtattgcaggcaggtacta

SEQ ID NO: 252425 - DNA, 25 bp, Rattus norvegicus
cctagggtattggaggcaggtacta

SEQ ID NO: 252426 - DNA, 25 bp, Rattus norvegicus
cctagggtccgccttgtagagactt

SEQ ID NO: 252427 - DNA, 25 bp, Rattus norvegicus
cctagggtccgcgttgtagagactt

SEQ ID NO: 252428 - DNA, 25 bp, Rattus norvegicus
cctaggtattttccgtttctgtgat

SEQ ID NO: 252429 - DNA, 25 bp, Rattus norvegicus
cctaggtattttgcgtttctgtgat

SEQ ID NO: 252430 - DNA, 25 bp, Rattus norvegicus
cctaggtcaagtctgctggtccaga

SEQ ID NO: 252431 - DNA, 25 bp, Rattus norvegicus
cctaggtcaagtgtgctggtccaga

SEQ ID NO: 252432 - DNA, 25 bp, Rattus norvegicus
cctaggtgacctcagatgctgggca

SEQ ID NO: 252433 - DNA, 25 bp, Rattus norvegicus
cctaggtgacctgagatgctgggca

SEQ ID NO: 252434 - DNA, 25 bp, Rattus norvegicus
cctaggtgtcccacaatagaagaat

SEQ ID NO: 252435 - DNA, 25 bp, Rattus norvegicus
cctaggtgtccctcaatagaagaat

SEQ ID NO: 252436 - DNA, 25 bp, Rattus norvegicus
cctaggttcttcagtcgcatttgaa

SEQ ID NO: 252437 - DNA, 25 bp, Rattus norvegicus
cctaggttcttctgtcgcatttgaa

SEQ ID NO: 252438 - DNA, 25 bp, Rattus norvegicus
cctaggttgtcaaggttactttgaa

SEQ ID NO: 252439 - DNA, 25 bp, Rattus norvegicus
cctaggttgtcatggttactttgaa

SEQ ID NO: 252440 - DNA, 25 bp, Rattus norvegicus
cctagtacagttcttggtgctcaat

SEQ ID NO: 252441 - DNA, 25 bp, Rattus norvegicus
cctagtacagttgttggtgctcaat

SEQ ID NO: 252442 - DNA, 25 bp, Rattus norvegicus
cctagtcaccgtaccttaaacaatg

SEQ ID NO: 252443 - DNA, 25 bp, Rattus norvegicus
cctagtcaccgttccttaaacaatg

SEQ ID NO: 252444 - DNA, 25 bp, Rattus norvegicus
cctagtccatttactgatcagtctg

SEQ ID NO: 252445 - DNA, 25 bp, Rattus norvegicus
cctagtccattttctgatcagtctg

SEQ ID NO: 252446 - DNA, 25 bp, Rattus norvegicus
cctagtcccagcatcttgtaaaaat

SEQ ID NO: 252447 - DNA, 25 bp, Rattus norvegicus
cctagtcccagcttcttgtaaaaat

SEQ ID NO: 252448 - DNA, 25 bp, Rattus norvegicus
cctagtcgatggctgatctctgagt

SEQ ID NO: 252449 - DNA, 25 bp, Rattus norvegicus
cctagtcgatgggtgatctctgagt

SEQ ID NO: 252450 - DNA, 25 bp, Rattus norvegicus
cctagtgactcaatcttatggcaga

SEQ ID NO: 252451 - DNA, 25 bp, Rattus norvegicus
cctagtgactcattcttatggcaga

SEQ ID NO: 252452 - DNA, 25 bp, Rattus norvegicus
cctagtgagctgatgtccggatgac

SEQ ID NO: 252453 - DNA, 25 bp, Rattus norvegicus
cctagtgagctgttgtccggatgac

SEQ ID NO: 252454 - DNA, 25 bp, Rattus norvegicus
cctagtgagtgtcaagccctggctt

SEQ ID NO: 252455 - DNA, 25 bp, Rattus norvegicus
cctagtgagtgtgaagccctggctt

SEQ ID NO: 252456 - DNA, 25 bp, Rattus norvegicus
cctagtgcgggacctcaaggagtcc

SEQ ID NO: 252457 - DNA, 25 bp, Rattus norvegicus
cctagtgcgggagctcaaggagtcc

SEQ ID NO: 252458 - DNA, 25 bp, Rattus norvegicus
cctagtgctgtgatggtggtgcctt

SEQ ID NO: 252459 - DNA, 25 bp, Rattus norvegicus
cctagtgctgtgttggtggtgcctt

SEQ ID NO: 252460 - DNA, 25 bp, Rattus norvegicus
cctagtgcttcacggtctggagaat

SEQ ID NO: 252461 - DNA, 25 bp, Rattus norvegicus
cctagtgcttcagggtctggagaat

SEQ ID NO: 252462 - DNA, 25 bp, Rattus norvegicus
cctagtggctgacgagtgctctgca

SEQ ID NO: 252463 - DNA, 25 bp, Rattus norvegicus
cctagtggctgaggagtgctctgca

SEQ ID NO: 252464 - DNA, 25 bp, Rattus norvegicus
cctagtgggtctaggcgctgctgta

SEQ ID NO: 252465 - DNA, 25 bp, Rattus norvegicus
cctagtgggtcttggcgctgctgta

SEQ ID NO: 252466 - DNA, 25 bp, Rattus norvegicus
cctagtgtagtgctgctgctcaata

SEQ ID NO: 252467 - DNA, 25 bp, Rattus norvegicus
cctagtgtagtggtgctgctcaata

SEQ ID NO: 252468 - DNA, 25 bp, Rattus norvegicus
cctagttatttaacttgtatagtgg

SEQ ID NO: 252469 - DNA, 25 bp, Rattus norvegicus
cctagttatttatcttgtatagtgg

SEQ ID NO: 252470 - DNA, 25 bp, Rattus norvegicus
cctagttcaagtactctaccatgtg

SEQ ID NO: 252471 - DNA, 25 bp, Rattus norvegicus
cctagttcaagttctctaccatgtg

SEQ ID NO: 252472 - DNA, 25 bp, Rattus norvegicus
cctagttcagtccacggcttttact

SEQ ID NO: 252473 - DNA, 25 bp, Rattus norvegicus
cctagttcagtcgacggcttttact

SEQ ID NO: 252474 - DNA, 25 bp, Rattus norvegicus
cctagttgggacactgtgagaggta

SEQ ID NO: 252475 - DNA, 25 bp, Rattus norvegicus
cctagttgggactctgtgagaggta

SEQ ID NO: 252476 - DNA, 25 bp, Rattus norvegicus
cctagtttaactcgccttgatgtct

SEQ ID NO: 252477 - DNA, 25 bp, Rattus norvegicus
cctagtttaactggccttgatgtct

SEQ ID NO: 252478 - DNA, 25 bp, Rattus norvegicus
cctagtttgtgacaagttgaccttc

SEQ ID NO: 252479 - DNA, 25 bp, Rattus norvegicus
cctagtttgtgagaagttgaccttc

SEQ ID NO: 252480 - DNA, 25 bp, Rattus norvegicus
cctagtttgtgtcaatggctggact

SEQ ID NO: 252481 - DNA, 25 bp, Rattus norvegicus
cctagtttgtgtgaatggctggact

SEQ ID NO: 252482 - DNA, 25 bp, Rattus norvegicus
cctagttttcctatggccgtgggtg

SEQ ID NO: 252483 - DNA, 25 bp, Rattus norvegicus
cctagttttcctttggccgtgggtg

SEQ ID NO: 252484 - DNA, 25 bp, Rattus norvegicus
cctatacaccctattaatctcactg

SEQ ID NO: 252485 - DNA, 25 bp, Rattus norvegicus
cctatacacccttttaatctcactg

SEQ ID NO: 252486 - DNA, 25 bp, Rattus norvegicus
cctatactcaagagggtgcctgtgt

SEQ ID NO: 252487 - DNA, 25 bp, Rattus norvegicus
cctatactcaagtgggtgcctgtgt

SEQ ID NO: 252488 - DNA, 25 bp, Rattus norvegicus
cctatagcatgcatgcgtgacgaga

SEQ ID NO: 252489 - DNA, 25 bp, Rattus norvegicus
cctatagcatgcttgcgtgacgaga

SEQ ID NO: 252490 - DNA, 25 bp, Rattus norvegicus
cctatatgtggtcggatcgtcctct

SEQ ID NO: 252491 - DNA, 25 bp, Rattus norvegicus
cctatatgtggtgggatcgtcctct

SEQ ID NO: 252492 - DNA, 25 bp, Rattus norvegicus
cctatattgcctcctgatctttttt

SEQ ID NO: 252493 - DNA, 25 bp, Rattus norvegicus
cctatattgcctgctgatctttttt

SEQ ID NO: 252494 - DNA, 25 bp, Rattus norvegicus
cctatcagcagtcttgtatcctcgg

SEQ ID NO: 252495 - DNA, 25 bp, Rattus norvegicus
cctatcagcagtgttgtatcctcgg

SEQ ID NO: 252496 - DNA, 25 bp, Rattus norvegicus
cctatcatgtgaacagtggtatgct

SEQ ID NO: 252497 - DNA, 25 bp, Rattus norvegicus
cctatcatgtgatcagtggtatgct

SEQ ID NO: 252498 - DNA, 25 bp, Rattus norvegicus
cctatcccaaagctggtgctcaata

SEQ ID NO: 252499 - DNA, 25 bp, Rattus norvegicus
cctatcccaaaggtggtgctcaata

SEQ ID NO: 252500 - DNA, 25 bp, Rattus norvegicus
cctatccccggacatttgtgacaaa

SEQ ID NO: 252501 - DNA, 25 bp, Rattus norvegicus
cctatccccggagatttgtgacaaa

SEQ ID NO: 252502 - DNA, 25 bp, Rattus norvegicus
cctatccctacccttgtatatattt

SEQ ID NO: 252503 - DNA, 25 bp, Rattus norvegicus
cctatccctaccgttgtatatattt

SEQ ID NO: 252504 - DNA, 25 bp, Rattus norvegicus
cctatccctggtctgtgctccagag

SEQ ID NO: 252505 - DNA, 25 bp, Rattus norvegicus
cctatccctggtgtgtgctccagag

SEQ ID NO: 252506 - DNA, 25 bp, Rattus norvegicus
cctatcctcacccagaatttgatga

SEQ ID NO: 252507 - DNA, 25 bp, Rattus norvegicus
cctatcctcaccgagaatttgatga

SEQ ID NO: 252508 - DNA, 25 bp, Rattus norvegicus
cctatcctgggaaggtgaaccgaga

SEQ ID NO: 252509 - DNA, 25 bp, Rattus norvegicus
cctatcctgggatggtgaaccgaga

SEQ ID NO: 252510 - DNA, 25 bp, Rattus norvegicus
cctatctccctcacattacaagaga

SEQ ID NO: 252511 - DNA, 25 bp, Rattus norvegicus
cctatctccctctcattacaagaga

SEQ ID NO: 252512 - DNA, 25 bp, Rattus norvegicus
cctatctctctcatttcctattttt

SEQ ID NO: 252513 - DNA, 25 bp, Rattus norvegicus
cctatctctctcttttcctattttt

SEQ ID NO: 252514 - DNA, 25 bp, Rattus norvegicus
cctatctgacctccctcatgatgcc

SEQ ID NO: 252515 - DNA, 25 bp, Rattus norvegicus
cctatctgacctgcctcatgatgcc

SEQ ID NO: 252516 - DNA, 25 bp, Rattus norvegicus
cctatctggccaatggtttcgtgga

SEQ ID NO: 252517 - DNA, 25 bp, Rattus norvegicus
cctatctggccattggtttcgtgga

SEQ ID NO: 252518 - DNA, 25 bp, Rattus norvegicus
cctatcttgcttaggaatgattgga

SEQ ID NO: 252519 - DNA, 25 bp, Rattus norvegicus
cctatcttgctttggaatgattgga

SEQ ID NO: 252520 - DNA, 25 bp, Rattus norvegicus
cctatcttggatcgcccactctggg

SEQ ID NO: 252521 - DNA, 25 bp, Rattus norvegicus
cctatcttggatggcccactctggg

SEQ ID NO: 252522 - DNA, 25 bp, Rattus norvegicus
cctatgacacagactcccttaaaat

SEQ ID NO: 252523 - DNA, 25 bp, Rattus norvegicus
cctatgacacagtctcccttaaaat

SEQ ID NO: 252524 - DNA, 25 bp, Rattus norvegicus
cctatgagttcaagtgtttgcacat

SEQ ID NO: 252525 - DNA, 25 bp, Rattus norvegicus
cctatgagttcatgtgtttgcacat

SEQ ID NO: 252526 - DNA, 25 bp, Rattus norvegicus
cctatgatagccatgtagaggatat

SEQ ID NO: 252527 - DNA, 25 bp, Rattus norvegicus
cctatgatagccttgtagaggatat

SEQ ID NO: 252528 - DNA, 25 bp, Rattus norvegicus
cctatgattggtcctttcctgggag

SEQ ID NO: 252529 - DNA, 25 bp, Rattus norvegicus
cctatgattggtgctttcctgggag

SEQ ID NO: 252530 - DNA, 25 bp, Rattus norvegicus
cctatgccccataaaattacagtgt

SEQ ID NO: 252531 - DNA, 25 bp, Rattus norvegicus
cctatgccccattaaattacagtgt

SEQ ID NO: 252532 - DNA, 25 bp, Rattus norvegicus
cctatgcctttaacttcatcttgaa

SEQ ID NO: 252533 - DNA, 25 bp, Rattus norvegicus
cctatgcctttatcttcatcttgaa

SEQ ID NO: 252534 - DNA, 25 bp, Rattus norvegicus
cctatgctcaagctctgacctgtga

SEQ ID NO: 252535 - DNA, 25 bp, Rattus norvegicus
cctatgctcaaggtctgacctgtga

SEQ ID NO: 252536 - DNA, 25 bp, Rattus norvegicus
cctatgctcctgagctgagacagaa

SEQ ID NO: 252537 - DNA, 25 bp, Rattus norvegicus
cctatgctcctgtgctgagacagaa

SEQ ID NO: 252538 - DNA, 25 bp, Rattus norvegicus
cctatggatgtgattgatgcggtaa

SEQ ID NO: 252539 - DNA, 25 bp, Rattus norvegicus
cctatggatgtgtttgatgcggtaa

SEQ ID NO: 252540 - DNA, 25 bp, Rattus norvegicus
cctatggcctttattctgtactttt

SEQ ID NO: 252541 - DNA, 25 bp, Rattus norvegicus
cctatggccttttttctgtactttt

SEQ ID NO: 252542 - DNA, 25 bp, Rattus norvegicus
cctatggcgactcccctggtgtcaa

SEQ ID NO: 252543 - DNA, 25 bp, Rattus norvegicus
cctatggcgactgccctggtgtcaa

SEQ ID NO: 252544 - DNA, 25 bp, Rattus norvegicus
cctatgggccacaaatctctacaag

SEQ ID NO: 252545 - DNA, 25 bp, Rattus norvegicus
cctatgggccactaatctctacaag

SEQ ID NO: 252546 - DNA, 25 bp, Rattus norvegicus
cctatgtaggctaggtcacttgtgg

SEQ ID NO: 252547 - DNA, 25 bp, Rattus norvegicus
cctatgtaggcttggtcacttgtgg

SEQ ID NO: 252548 - DNA, 25 bp, Rattus norvegicus
cctatgtcctatcgccagggcagaa

SEQ ID NO: 252549 - DNA, 25 bp, Rattus norvegicus
cctatgtcctatggccagggcagaa

SEQ ID NO: 252550 - DNA, 25 bp, Rattus norvegicus
cctatgtcgccaatgctattcttga

SEQ ID NO: 252551 - DNA, 25 bp, Rattus norvegicus
cctatgtcgccattgctattcttga

SEQ ID NO: 252552 - DNA, 25 bp, Rattus norvegicus
cctatgtcttttactccacttaaca

SEQ ID NO: 252553 - DNA, 25 bp, Rattus norvegicus
cctatgtctttttctccacttaaca

SEQ ID NO: 252554 - DNA, 25 bp, Rattus norvegicus
cctatgttaagcctgggtgggctaa

SEQ ID NO: 252555 - DNA, 25 bp, Rattus norvegicus
cctatgttaagcgtgggtgggctaa

SEQ ID NO: 252556 - DNA, 25 bp, Rattus norvegicus
cctatgttactcagcaccgaggaat

SEQ ID NO: 252557 - DNA, 25 bp, Rattus norvegicus
cctatgttactctgcaccgaggaat

SEQ ID NO: 252558 - DNA, 25 bp, Rattus norvegicus
cctatgttctctctggttctctaaa

SEQ ID NO: 252559 - DNA, 25 bp, Rattus norvegicus
cctatgttctctgtggttctctaaa

SEQ ID NO: 252560 - DNA, 25 bp, Rattus norvegicus
cctatgttgagtatgcgccgcggac

SEQ ID NO: 252561 - DNA, 25 bp, Rattus norvegicus
cctatgttgagtttgcgccgcggac

SEQ ID NO: 252562 - DNA, 25 bp, Rattus norvegicus
cctattcactagacagtccaggcag

SEQ ID NO: 252563 - DNA, 25 bp, Rattus norvegicus
cctattcactagtcagtccaggcag

SEQ ID NO: 252564 - DNA, 25 bp, Rattus norvegicus
cctattcctccaatgcactaagcat

SEQ ID NO: 252565 - DNA, 25 bp, Rattus norvegicus
cctattcctccattgcactaagcat

SEQ ID NO: 252566 - DNA, 25 bp, Rattus norvegicus
cctattcgctctatcttttatgcag

SEQ ID NO: 252567 - DNA, 25 bp, Rattus norvegicus
cctattcgctctttcttttatgcag

SEQ ID NO: 252568 - DNA, 25 bp, Rattus norvegicus
cctattgaattgacctcgggtgaag

SEQ ID NO: 252569 - DNA, 25 bp, Rattus norvegicus
cctattgaattgtcctcgggtgaag

SEQ ID NO: 252570 - DNA, 25 bp, Rattus norvegicus
cctattgccttgactttcccagtga

SEQ ID NO: 252571 - DNA, 25 bp, Rattus norvegicus
cctattgccttgtctttcccagtga

SEQ ID NO: 252572 - DNA, 25 bp, Rattus norvegicus
cctattgcttccaggcctaaaacaa

SEQ ID NO: 252573 - DNA, 25 bp, Rattus norvegicus
cctattgcttcctggcctaaaacaa

SEQ ID NO: 252574 - DNA, 25 bp, Rattus norvegicus
cctattggattcctcgggtacatgt

SEQ ID NO: 252575 - DNA, 25 bp, Rattus norvegicus
cctattggattcgtcgggtacatgt

SEQ ID NO: 252576 - DNA, 25 bp, Rattus norvegicus
cctattgtactgcagaagctgggaa

SEQ ID NO: 252577 - DNA, 25 bp, Rattus norvegicus
cctattgtactggagaagctgggaa

SEQ ID NO: 252578 - DNA, 25 bp, Rattus norvegicus
cctattttaggcatgcattcagaaa

SEQ ID NO: 252579 - DNA, 25 bp, Rattus norvegicus
cctattttaggcttgcattcagaaa

SEQ ID NO: 252580 - DNA, 25 bp, Rattus norvegicus
cctcaaaatttgaatcttcccagat

SEQ ID NO: 252581 - DNA, 25 bp, Rattus norvegicus
cctcaaaatttgtatcttcccagat

SEQ ID NO: 252582 - DNA, 25 bp, Rattus norvegicus
cctcaaagactgagggctcttctga

SEQ ID NO: 252583 - DNA, 25 bp, Rattus norvegicus
cctcaaagactgtgggctcttctga

SEQ ID NO: 252584 - DNA, 25 bp, Rattus norvegicus
cctcaaatcttaagtcccaccaaga

SEQ ID NO: 252585 - DNA, 25 bp, Rattus norvegicus
cctcaaatcttatgtcccaccaaga

SEQ ID NO: 252586 - DNA, 25 bp, Rattus norvegicus
cctcaacctggccaatactgtgaag

SEQ ID NO: 252587 - DNA, 25 bp, Rattus norvegicus
cctcaacctggcgaatactgtgaag

SEQ ID NO: 252588 - DNA, 25 bp, Rattus norvegicus
cctcaactctgcataaacctgaact

SEQ ID NO: 252589 - DNA, 25 bp, Rattus norvegicus
cctcaactctgcttaaacctgaact

SEQ ID NO: 252590 - DNA, 25 bp, Rattus norvegicus
cctcaactgcctctggaagcaaagt

SEQ ID NO: 252591 - DNA, 25 bp, Rattus norvegicus
cctcaactgcctgtggaagcaaagt

SEQ ID NO: 252592 - DNA, 25 bp, Rattus norvegicus
cctcaacttcctcctctgtaaaatg

SEQ ID NO: 252593 - DNA, 25 bp, Rattus norvegicus
cctcaacttcctgctctgtaaaatg

SEQ ID NO: 252594 - DNA, 25 bp, Rattus norvegicus
cctcaactttggcttacatcgctaa

SEQ ID NO: 252595 - DNA, 25 bp, Rattus norvegicus
cctcaactttggcttcttaacacaa

SEQ ID NO: 252596 - DNA, 25 bp, Rattus norvegicus
cctcaactttgggttacatcgctaa

SEQ ID NO: 252597 - DNA, 25 bp, Rattus norvegicus
cctcaactttgggttcttaacacaa

SEQ ID NO: 252598 - DNA, 25 bp, Rattus norvegicus
cctcaagaacttatggagccctgtt

SEQ ID NO: 252599 - DNA, 25 bp, Rattus norvegicus
cctcaagaacttttggagccctgtt

SEQ ID NO: 252600 - DNA, 25 bp, Rattus norvegicus
cctcaagagatgatccagggacctt

SEQ ID NO: 252601 - DNA, 25 bp, Rattus norvegicus
cctcaagagatgttccagggacctt

SEQ ID NO: 252602 - DNA, 25 bp, Rattus norvegicus
cctcaagcacaacttcccatggctc

SEQ ID NO: 252603 - DNA, 25 bp, Rattus norvegicus
cctcaagcacaagttcccatggctc

SEQ ID NO: 252604 - DNA, 25 bp, Rattus norvegicus
cctcaagccccaaggccagggagga

SEQ ID NO: 252605 - DNA, 25 bp, Rattus norvegicus
cctcaagccccatggccagggagga

SEQ ID NO: 252606 - DNA, 25 bp, Rattus norvegicus
cctcaagctcttagttctccagaaa

SEQ ID NO: 252607 - DNA, 25 bp, Rattus norvegicus
cctcaagctctttgttctccagaaa

SEQ ID NO: 252608 - DNA, 25 bp, Rattus norvegicus
cctcaaggagttcggcctggccgaa

SEQ ID NO: 252609 - DNA, 25 bp, Rattus norvegicus
cctcaaggagttgggcctggccgaa

SEQ ID NO: 252610 - DNA, 25 bp, Rattus norvegicus
cctcaagggagtactgggcagagct

SEQ ID NO: 252611 - DNA, 25 bp, Rattus norvegicus
cctcaagggagttctgggcagagct

SEQ ID NO: 252612 - DNA, 25 bp, Rattus norvegicus
cctcaagttgcacaacgaacgcggg

SEQ ID NO: 252613 - DNA, 25 bp, Rattus norvegicus
cctcaagttgcagaacgaacgcggg

SEQ ID NO: 252614 - DNA, 25 bp, Rattus norvegicus
cctcaatccagaaccgtatccggaa

SEQ ID NO: 252615 - DNA, 25 bp, Rattus norvegicus
cctcaatccagatccgtatccggaa

SEQ ID NO: 252616 - DNA, 25 bp, Rattus norvegicus
cctcaatcctctcctttgctgtggg

SEQ ID NO: 252617 - DNA, 25 bp, Rattus norvegicus
cctcaatcctctgctttgctgtggg

SEQ ID NO: 252618 - DNA, 25 bp, Rattus norvegicus
cctcaatgatggcatatggcctaca

SEQ ID NO: 252619 - DNA, 25 bp, Rattus norvegicus
cctcaatgatgggatatggcctaca

SEQ ID NO: 252620 - DNA, 25 bp, Rattus norvegicus
cctcaatgctctcgacctgtctatt

SEQ ID NO: 252621 - DNA, 25 bp, Rattus norvegicus
cctcaatgctctggacctgtctatt

SEQ ID NO: 252622 - DNA, 25 bp, Rattus norvegicus
cctcaattcccgagtggccactgtg

SEQ ID NO: 252623 - DNA, 25 bp, Rattus norvegicus
cctcaattcccgtgtggccactgtg

SEQ ID NO: 252624 - DNA, 25 bp, Rattus norvegicus
cctcacaaccatcaagtcaattctg

SEQ ID NO: 252625 - DNA, 25 bp, Rattus norvegicus
cctcacaaccatgaagtcaattctg

SEQ ID NO: 252626 - DNA, 25 bp, Rattus norvegicus
cctcacacatttctcagggccagag

SEQ ID NO: 252627 - DNA, 25 bp, Rattus norvegicus
cctcacacatttgtcagggccagag

SEQ ID NO: 252628 - DNA, 25 bp, Rattus norvegicus
cctcacactgttccagagattcttt

SEQ ID NO: 252629 - DNA, 25 bp, Rattus norvegicus
cctcacactgttgcagagattcttt

SEQ ID NO: 252630 - DNA, 25 bp, Rattus norvegicus
cctcacagcctgctatatatacaac

SEQ ID NO: 252631 - DNA, 25 bp, Rattus norvegicus
cctcacagcctggtatatatacaac

SEQ ID NO: 252632 - DNA, 25 bp, Rattus norvegicus
cctcacaggataactctgctgcaga

SEQ ID NO: 252633 - DNA, 25 bp, Rattus norvegicus
cctcacaggatatctctgctgcaga

SEQ ID NO: 252634 - DNA, 25 bp, Rattus norvegicus
cctcacagggtaagtattggctttc

SEQ ID NO: 252635 - DNA, 25 bp, Rattus norvegicus
cctcacagggtatgtattggctttc

SEQ ID NO: 252636 - DNA, 25 bp, Rattus norvegicus
cctcaccaagcaacttagcctaaag

SEQ ID NO: 252637 - DNA, 25 bp, Rattus norvegicus
cctcaccaagcatcttagcctaaag

SEQ ID NO: 252638 - DNA, 25 bp, Rattus norvegicus
cctcaccaggttattgcattgtcat

SEQ ID NO: 252639 - DNA, 25 bp, Rattus norvegicus
cctcaccaggtttttgcattgtcat

SEQ ID NO: 252640 - DNA, 25 bp, Rattus norvegicus
cctcacccaactattattactagcg

SEQ ID NO: 252641 - DNA, 25 bp, Rattus norvegicus
cctcacccaacttttattactagcg

SEQ ID NO: 252642 - DNA, 25 bp, Rattus norvegicus
cctcacccctgaaaaatgtatgcct

SEQ ID NO: 252643 - DNA, 25 bp, Rattus norvegicus
cctcacccctgataaatgtatgcct

SEQ ID NO: 252644 - DNA, 25 bp, Rattus norvegicus
cctcaccctgatcaagactcttgaa

SEQ ID NO: 252645 - DNA, 25 bp, Rattus norvegicus
cctcaccctgatgaagactcttgaa

SEQ ID NO: 252646 - DNA, 25 bp, Rattus norvegicus
cctcaccgaatcaccttaggaagga

SEQ ID NO: 252647 - DNA, 25 bp, Rattus norvegicus
cctcaccgaatctccttaggaagga

SEQ ID NO: 252648 - DNA, 25 bp, Rattus norvegicus
cctcacctatttcagtcagttatca

SEQ ID NO: 252649 - DNA, 25 bp, Rattus norvegicus
cctcacctatttgagtcagttatca

SEQ ID NO: 252650 - DNA, 25 bp, Rattus norvegicus
cctcacctcaacacatatttaacaa

SEQ ID NO: 252651 - DNA, 25 bp, Rattus norvegicus
cctcacctcaactcatatttaacaa

SEQ ID NO: 252652 - DNA, 25 bp, Rattus norvegicus
cctcacctccaaagcaggtggtgtg

SEQ ID NO: 252653 - DNA, 25 bp, Rattus norvegicus
cctcacctccaatgcaggtggtgtg

SEQ ID NO: 252654 - DNA, 25 bp, Rattus norvegicus
cctcaccttctcactattttgttgt

SEQ ID NO: 252655 - DNA, 25 bp, Rattus norvegicus
cctcaccttctctctattttgttgt

SEQ ID NO: 252656 - DNA, 25 bp, Rattus norvegicus
cctcaccttgttctctcatatatac

SEQ ID NO: 252657 - DNA, 25 bp, Rattus norvegicus
cctcaccttgttgtctcatatatac

SEQ ID NO: 252658 - DNA, 25 bp, Rattus norvegicus
cctcacctttaacttactgggactg

SEQ ID NO: 252659 - DNA, 25 bp, Rattus norvegicus
cctcacctttaagttactgggactg

SEQ ID NO: 252660 - DNA, 25 bp, Rattus norvegicus
cctcacgtctcccaggagagcggag

SEQ ID NO: 252661 - DNA, 25 bp, Rattus norvegicus
cctcacgtctccgaggagagcggag

SEQ ID NO: 252662 - DNA, 25 bp, Rattus norvegicus
cctcacgttggtcgctgttggagtt

SEQ ID NO: 252663 - DNA, 25 bp, Rattus norvegicus
cctcacgttggtggctgttggagtt

SEQ ID NO: 252664 - DNA, 25 bp, Rattus norvegicus
cctcactacctcctttattacaaat

SEQ ID NO: 252665 - DNA, 25 bp, Rattus norvegicus
cctcactacctcgtttattacaaat

SEQ ID NO: 252666 - DNA, 25 bp, Rattus norvegicus
cctcactagaatctatccacatcag

SEQ ID NO: 252667 - DNA, 25 bp, Rattus norvegicus
cctcactagaatgtatccacatcag

SEQ ID NO: 252668 - DNA, 25 bp, Rattus norvegicus
cctcactagcccatgaagacattgg

SEQ ID NO: 252669 - DNA, 25 bp, Rattus norvegicus
cctcactagcccttgaagacattgg

SEQ ID NO: 252670 - DNA, 25 bp, Rattus norvegicus
cctcactagggcatacatatactat

SEQ ID NO: 252671 - DNA, 25 bp, Rattus norvegicus
cctcactagggcttacatatactat

SEQ ID NO: 252672 - DNA, 25 bp, Rattus norvegicus
cctcactatggaatgattttgttgc

SEQ ID NO: 252673 - DNA, 25 bp, Rattus norvegicus
cctcactatggattgattttgttgc

SEQ ID NO: 252674 - DNA, 25 bp, Rattus norvegicus
cctcactgcgtccttttaaaacatg

SEQ ID NO: 252675 - DNA, 25 bp, Rattus norvegicus
cctcactgcgtcgttttaaaacatg

SEQ ID NO: 252676 - DNA, 25 bp, Rattus norvegicus
cctcactgctgacaactgacaattg

SEQ ID NO: 252677 - DNA, 25 bp, Rattus norvegicus
cctcactgctgagaactgacaattg

SEQ ID NO: 252678 - DNA, 25 bp, Rattus norvegicus
cctcactgtggtatgctagctggca

SEQ ID NO: 252679 - DNA, 25 bp, Rattus norvegicus
cctcactgtggtttgctagctggca

SEQ ID NO: 252680 - DNA, 25 bp, Rattus norvegicus
cctcactgttgaagcggactctctt

SEQ ID NO: 252681 - DNA, 25 bp, Rattus norvegicus
cctcactgttgatgcggactctctt

SEQ ID NO: 252682 - DNA, 25 bp, Rattus norvegicus
cctcacttcacaaaccagtgctggg

SEQ ID NO: 252683 - DNA, 25 bp, Rattus norvegicus
cctcacttcacataccagtgctggg

SEQ ID NO: 252684 - DNA, 25 bp, Rattus norvegicus
cctcacttccacaagcttagttaga

SEQ ID NO: 252685 - DNA, 25 bp, Rattus norvegicus
cctcacttccactagcttagttaga

SEQ ID NO: 252686 - DNA, 25 bp, Rattus norvegicus
cctcacttccggattataatcgcag

SEQ ID NO: 252687 - DNA, 25 bp, Rattus norvegicus
cctcacttccggtttataatcgcag

SEQ ID NO: 252688 - DNA, 25 bp, Rattus norvegicus
cctcacttctgcaactagggtttga

SEQ ID NO: 252689 - DNA, 25 bp, Rattus norvegicus
cctcacttctgctactagggtttga

SEQ ID NO: 252690 - DNA, 25 bp, Rattus norvegicus
cctcacttgggcagggaactgacag

SEQ ID NO: 252691 - DNA, 25 bp, Rattus norvegicus
cctcacttgggctgggaactgacag

SEQ ID NO: 252692 - DNA, 25 bp, Rattus norvegicus
cctcagaagcatcggacctgggact

SEQ ID NO: 252693 - DNA, 25 bp, Rattus norvegicus
cctcagaagcatgggacctgggact

SEQ ID NO: 252694 - DNA, 25 bp, Rattus norvegicus
cctcagaagcgacgcctccaaggga

SEQ ID NO: 252695 - DNA, 25 bp, Rattus norvegicus
cctcagaagcgaggcctccaaggga

SEQ ID NO: 252696 - DNA, 25 bp, Rattus norvegicus
cctcagactacccagaacatctaga

SEQ ID NO: 252697 - DNA, 25 bp, Rattus norvegicus
cctcagactaccgagaacatctaga

SEQ ID NO: 252698 - DNA, 25 bp, Rattus norvegicus
cctcagactgacacgcaatgtgcta

SEQ ID NO: 252699 - DNA, 25 bp, Rattus norvegicus
cctcagactgactcgcaatgtgcta

SEQ ID NO: 252700 - DNA, 25 bp, Rattus norvegicus
cctcagactgtacgaatgagtcata

SEQ ID NO: 252701 - DNA, 25 bp, Rattus norvegicus
cctcagactgtaggaatgagtcata

SEQ ID NO: 252702 - DNA, 25 bp, Rattus norvegicus
cctcagagaccccattggtgctgga

SEQ ID NO: 252703 - DNA, 25 bp, Rattus norvegicus
cctcagagacccgattggtgctgga

SEQ ID NO: 252704 - DNA, 25 bp, Rattus norvegicus
cctcagagttccctaaggctttgat

SEQ ID NO: 252705 - DNA, 25 bp, Rattus norvegicus
cctcagagttccgtaaggctttgat

SEQ ID NO: 252706 - DNA, 25 bp, Rattus norvegicus
cctcagattctgacctcagtggaga

SEQ ID NO: 252707 - DNA, 25 bp, Rattus norvegicus
cctcagattctgtcctcagtggaga

SEQ ID NO: 252708 - DNA, 25 bp, Rattus norvegicus
cctcagccagcaacaatgggttggt

SEQ ID NO: 252709 - DNA, 25 bp, Rattus norvegicus
cctcagccagcatcaatgggttggt

SEQ ID NO: 252710 - DNA, 25 bp, Rattus norvegicus
cctcagccctgcagttgtgaatgga

SEQ ID NO: 252711 - DNA, 25 bp, Rattus norvegicus
cctcagccctgctgttgtgaatgga

SEQ ID NO: 252712 - DNA, 25 bp, Rattus norvegicus
cctcagccctgtcacgattaaaaac

SEQ ID NO: 252713 - DNA, 25 bp, Rattus norvegicus
cctcagccctgtgacgattaaaaac

SEQ ID NO: 252714 - DNA, 25 bp, Rattus norvegicus
cctcagcctcagatgctggaattgt

SEQ ID NO: 252715 - DNA, 25 bp, Rattus norvegicus
cctcagcctcagttgctggaattgt

SEQ ID NO: 252716 - DNA, 25 bp, Rattus norvegicus
cctcagcgaggccaacaagtcctaa

SEQ ID NO: 252717 - DNA, 25 bp, Rattus norvegicus
cctcagcgaggcgaacaagtcctaa

SEQ ID NO: 252718 - DNA, 25 bp, Rattus norvegicus
cctcagcgtctcatgcagatgcaaa

SEQ ID NO: 252719 - DNA, 25 bp, Rattus norvegicus
cctcagcgtctcttgcagatgcaaa

SEQ ID NO: 252720 - DNA, 25 bp, Rattus norvegicus
cctcagctctttcagaatatgtgtg

SEQ ID NO: 252721 - DNA, 25 bp, Rattus norvegicus
cctcagctctttgagaatatgtgtg

SEQ ID NO: 252722 - DNA, 25 bp, Rattus norvegicus
cctcagctgactcatctgtctaaag

SEQ ID NO: 252723 - DNA, 25 bp, Rattus norvegicus
cctcagctgactgatctgtctaaag

SEQ ID NO: 252724 - DNA, 25 bp, Rattus norvegicus
cctcagcttggcatggaccttcggg

SEQ ID NO: 252725 - DNA, 25 bp, Rattus norvegicus
cctcagcttggcttggaccttcggg

SEQ ID NO: 252726 - DNA, 25 bp, Rattus norvegicus
cctcagctttggcagagatctctct

SEQ ID NO: 252727 - DNA, 25 bp, Rattus norvegicus
cctcagctttgggagagatctctct

SEQ ID NO: 252728 - DNA, 25 bp, Rattus norvegicus
cctcaggaaagcctgtcaagaataa

SEQ ID NO: 252729 - DNA, 25 bp, Rattus norvegicus
cctcaggaaagcgtgtcaagaataa

SEQ ID NO: 252730 - DNA, 25 bp, Rattus norvegicus
cctcaggaagcacgaatgtggttct

SEQ ID NO: 252731 - DNA, 25 bp, Rattus norvegicus
cctcaggaagcaggaatgtggttct

SEQ ID NO: 252732 - DNA, 25 bp, Rattus norvegicus
cctcaggaagggactcgtttggcag

SEQ ID NO: 252733 - DNA, 25 bp, Rattus norvegicus
cctcaggaagggtctcgtttggcag

SEQ ID NO: 252734 - DNA, 25 bp, Rattus norvegicus
cctcaggacctacctggtgagcgtg

SEQ ID NO: 252735 - DNA, 25 bp, Rattus norvegicus
cctcaggacctagctggtgagcgtg

SEQ ID NO: 252736 - DNA, 25 bp, Rattus norvegicus
cctcaggagactcttaatagctggg

SEQ ID NO: 252737 - DNA, 25 bp, Rattus norvegicus
cctcaggagactgttaatagctggg

SEQ ID NO: 252738 - DNA, 25 bp, Rattus norvegicus
cctcaggcaaaaaagtttcccacag

SEQ ID NO: 252739 - DNA, 25 bp, Rattus norvegicus
cctcaggcaaaatagtttcccacag

SEQ ID NO: 252740 - DNA, 25 bp, Rattus norvegicus
cctcaggcctccagagaggatgcgg

SEQ ID NO: 252741 - DNA, 25 bp, Rattus norvegicus
cctcaggcctcctgagaggatgcgg

SEQ ID NO: 252742 - DNA, 25 bp, Rattus norvegicus
cctcagggctggcacttattttatt

SEQ ID NO: 252743 - DNA, 25 bp, Rattus norvegicus
cctcagggctgggacttattttatt

SEQ ID NO: 252744 - DNA, 25 bp, Rattus norvegicus
cctcaggttttgagggttgctacat

SEQ ID NO: 252745 - DNA, 25 bp, Rattus norvegicus
cctcaggttttgtgggttgctacat

SEQ ID NO: 252746 - DNA, 25 bp, Rattus norvegicus
cctcagtagagtctgggcttggaat

SEQ ID NO: 252747 - DNA, 25 bp, Rattus norvegicus
cctcagtagagtgtgggcttggaat

SEQ ID NO: 252748 - DNA, 25 bp, Rattus norvegicus
cctcagtattagatggtggctctcg

SEQ ID NO: 252749 - DNA, 25 bp, Rattus norvegicus
cctcagtattagttggtggctctcg

SEQ ID NO: 252750 - DNA, 25 bp, Rattus norvegicus
cctcagtcaactatctccttaagta

SEQ ID NO: 252751 - DNA, 25 bp, Rattus norvegicus
cctcagtcaactttctccttaagta

SEQ ID NO: 252752 - DNA, 25 bp, Rattus norvegicus
cctcagtcctcccatatgtaaaatg

SEQ ID NO: 252753 - DNA, 25 bp, Rattus norvegicus
cctcagtcctccgatatgtaaaatg

SEQ ID NO: 252754 - DNA, 25 bp, Rattus norvegicus
cctcagtcttgtcacatggtttaaa

SEQ ID NO: 252755 - DNA, 25 bp, Rattus norvegicus
cctcagtcttgtgacatggtttaaa

SEQ ID NO: 252756 - DNA, 25 bp, Rattus norvegicus
cctcagtgaacactcggcagtcgat

SEQ ID NO: 252757 - DNA, 25 bp, Rattus norvegicus
cctcagtgaacagtcggcagtcgat

SEQ ID NO: 252758 - DNA, 25 bp, Rattus norvegicus
cctcagtgctttacctacatttgaa

SEQ ID NO: 252759 - DNA, 25 bp, Rattus norvegicus
cctcagtgcttttcctacatttgaa

SEQ ID NO: 252760 - DNA, 25 bp, Rattus norvegicus
cctcagtggcaactaccttcgtgga

SEQ ID NO: 252761 - DNA, 25 bp, Rattus norvegicus
cctcagtggcaagtaccttcgtgga

SEQ ID NO: 252762 - DNA, 25 bp, Rattus norvegicus
cctcagtggtaaaggccggcccttg

SEQ ID NO: 252763 - DNA, 25 bp, Rattus norvegicus
cctcagtggtaatggccggcccttg

SEQ ID NO: 252764 - DNA, 25 bp, Rattus norvegicus
cctcagtgtggcacataaatgtctt

SEQ ID NO: 252765 - DNA, 25 bp, Rattus norvegicus
cctcagtgtggctcataaatgtctt

SEQ ID NO: 252766 - DNA, 25 bp, Rattus norvegicus
cctcagtgttcccatctgcaaaatg

SEQ ID NO: 252767 - DNA, 25 bp, Rattus norvegicus
cctcagtgttccgatctgcaaaatg

SEQ ID NO: 252768 - DNA, 25 bp, Rattus norvegicus
cctcagtttactccccaagcaggaa

SEQ ID NO: 252769 - DNA, 25 bp, Rattus norvegicus
cctcagtttactgcccaagcaggaa

SEQ ID NO: 252770 - DNA, 25 bp, Rattus norvegicus
cctcagtttcccaagtgctaaattc

SEQ ID NO: 252771 - DNA, 25 bp, Rattus norvegicus
cctcagtttccctagtgctaaattc

SEQ ID NO: 252772 - DNA, 25 bp, Rattus norvegicus
cctcatacacacacctttagcatat

SEQ ID NO: 252773 - DNA, 25 bp, Rattus norvegicus
cctcatacacactcctttagcatat

SEQ ID NO: 252774 - DNA, 25 bp, Rattus norvegicus
cctcatactcctcttggcaaactgg

SEQ ID NO: 252775 - DNA, 25 bp, Rattus norvegicus
cctcatactcctgttggcaaactgg

SEQ ID NO: 252776 - DNA, 25 bp, Rattus norvegicus
cctcatactgagctttttgcactga

SEQ ID NO: 252777 - DNA, 25 bp, Rattus norvegicus
cctcatactgaggtttttgcactga

SEQ ID NO: 252778 - DNA, 25 bp, Rattus norvegicus
cctcatagttagagactcatcccgg

SEQ ID NO: 252779 - DNA, 25 bp, Rattus norvegicus
cctcatagttagtgactcatcccgg

SEQ ID NO: 252780 - DNA, 25 bp, Rattus norvegicus
cctcatcaactcctactcaagaaaa

SEQ ID NO: 252781 - DNA, 25 bp, Rattus norvegicus
cctcatcaactcgtactcaagaaaa

SEQ ID NO: 252782 - DNA, 25 bp, Rattus norvegicus
cctcatcccgatccaataaattagc

SEQ ID NO: 252783 - DNA, 25 bp, Rattus norvegicus
cctcatcccgatgcaataaattagc

SEQ ID NO: 252784 - DNA, 25 bp, Rattus norvegicus
cctcatcctaacagttgcgctaaga

SEQ ID NO: 252785 - DNA, 25 bp, Rattus norvegicus
cctcatcctaactgttgcgctaaga

SEQ ID NO: 252786 - DNA, 25 bp, Rattus norvegicus
cctcatcctccgaactgttgagtaa

SEQ ID NO: 252787 - DNA, 25 bp, Rattus norvegicus
cctcatcctccgtactgttgagtaa

SEQ ID NO: 252788 - DNA, 25 bp, Rattus norvegicus
cctcatcctcctactcaaaaaggat

SEQ ID NO: 252789 - DNA, 25 bp, Rattus norvegicus
cctcatcctccttctcaaaaaggat

SEQ ID NO: 252790 - DNA, 25 bp, Rattus norvegicus
cctcatcctgacagtccttataaga

SEQ ID NO: 252791 - DNA, 25 bp, Rattus norvegicus
cctcatcctgactgtccttataaga

SEQ ID NO: 252792 - DNA, 25 bp, Rattus norvegicus
cctcatctatagcttcctgggagag

SEQ ID NO: 252793 - DNA, 25 bp, Rattus norvegicus
cctcatctataggttcctgggagag

SEQ ID NO: 252794 - DNA, 25 bp, Rattus norvegicus
cctcatctgctgaggagttgcgtaa

SEQ ID NO: 252795 - DNA, 25 bp, Rattus norvegicus
cctcatctgctgtggagttgcgtaa

SEQ ID NO: 252796 - DNA, 25 bp, Rattus norvegicus
cctcatcttctaagccagcaaactg

SEQ ID NO: 252797 - DNA, 25 bp, Rattus norvegicus
cctcatcttctatgccagcaaactg

SEQ ID NO: 252798 - DNA, 25 bp, Rattus norvegicus
cctcatcttttcagtatcagcctta

SEQ ID NO: 252799 - DNA, 25 bp, Rattus norvegicus
cctcatcttttctgtatcagcctta

SEQ ID NO: 252800 - DNA, 25 bp, Rattus norvegicus
cctcatgaagttactttcccagctt

SEQ ID NO: 252801 - DNA, 25 bp, Rattus norvegicus
cctcatgaagtttctttcccagctt

SEQ ID NO: 252802 - DNA, 25 bp, Rattus norvegicus
cctcatgctggtagtggtgtgactg

SEQ ID NO: 252803 - DNA, 25 bp, Rattus norvegicus
cctcatgctggttgtggtgtgactg

SEQ ID NO: 252804 - DNA, 25 bp, Rattus norvegicus
cctcatggctggatttatacccaca

SEQ ID NO: 252805 - DNA, 25 bp, Rattus norvegicus
cctcatggctggttttatacccaca

SEQ ID NO: 252806 - DNA, 25 bp, Rattus norvegicus
cctcatgggctcagaaaggtcattg

SEQ ID NO: 252807 - DNA, 25 bp, Rattus norvegicus
cctcatgggctctgaaaggtcattg

SEQ ID NO: 252808 - DNA, 25 bp, Rattus norvegicus
cctcatgtagcccatcaatgtgact

SEQ ID NO: 252809 - DNA, 25 bp, Rattus norvegicus
cctcatgtagccgatcaatgtgact

SEQ ID NO: 252810 - DNA, 25 bp, Rattus norvegicus
cctcatgtcagtcttgggattccaa

SEQ ID NO: 252811 - DNA, 25 bp, Rattus norvegicus
cctcatgtcagtgttgggattccaa

SEQ ID NO: 252812 - DNA, 25 bp, Rattus norvegicus
cctcatgtgaggaccctgcgtgtgg

SEQ ID NO: 252813 - DNA, 25 bp, Rattus norvegicus
cctcatgtgaggtccctgcgtgtgg

SEQ ID NO: 252814 - DNA, 25 bp, Rattus norvegicus
cctcatgttgctcctgtgcagaacg

SEQ ID NO: 252815 - DNA, 25 bp, Rattus norvegicus
cctcatgttgctgctgtgcagaacg

SEQ ID NO: 252816 - DNA, 25 bp, Rattus norvegicus
cctcatgtttccatcgcagtaatag

SEQ ID NO: 252817 - DNA, 25 bp, Rattus norvegicus
cctcatgtttccttcgcagtaatag

SEQ ID NO: 252818 - DNA, 25 bp, Rattus norvegicus
cctcattacagcaccaattggaagc

SEQ ID NO: 252819 - DNA, 25 bp, Rattus norvegicus
cctcattacagctccaattggaagc

SEQ ID NO: 252820 - DNA, 25 bp, Rattus norvegicus
cctcattagcctctgtttggacgga

SEQ ID NO: 252821 - DNA, 25 bp, Rattus norvegicus
cctcattagcctgtgtttggacgga

SEQ ID NO: 252822 - DNA, 25 bp, Rattus norvegicus
cctcattccagacagcaagctttga

SEQ ID NO: 252823 - DNA, 25 bp, Rattus norvegicus
cctcattccagagagcaagctttga

SEQ ID NO: 252824 - DNA, 25 bp, Rattus norvegicus
cctcattctcccatcttgaaataag

SEQ ID NO: 252825 - DNA, 25 bp, Rattus norvegicus
cctcattctcccttcttgaaataag

SEQ ID NO: 252826 - DNA, 25 bp, Rattus norvegicus
cctcattgctgccatcatgtccaag

SEQ ID NO: 252827 - DNA, 25 bp, Rattus norvegicus
cctcattgctgcgatcatgtccaag

SEQ ID NO: 252828 - DNA, 25 bp, Rattus norvegicus
cctcattggccacagtatgaccaga

SEQ ID NO: 252829 - DNA, 25 bp, Rattus norvegicus
cctcattggccagagtatgaccaga

SEQ ID NO: 252830 - DNA, 25 bp, Rattus norvegicus
cctcattgtctgcagaacttgctaa

SEQ ID NO: 252831 - DNA, 25 bp, Rattus norvegicus
cctcattgtctggagaacttgctaa

SEQ ID NO: 252832 - DNA, 25 bp, Rattus norvegicus
cctcatttgggtagtgtgttgtttt

SEQ ID NO: 252833 - DNA, 25 bp, Rattus norvegicus
cctcatttgggttgtgtgttgtttt

SEQ ID NO: 252834 - DNA, 25 bp, Rattus norvegicus
cctcatttttcccatgtatgtattt

SEQ ID NO: 252835 - DNA, 25 bp, Rattus norvegicus
cctcatttttccgatgtatgtattt

SEQ ID NO: 252836 - DNA, 25 bp, Rattus norvegicus
cctccaaaggagctaaggacacatg

SEQ ID NO: 252837 - DNA, 25 bp, Rattus norvegicus
cctccaaaggaggtaaggacacatg

SEQ ID NO: 252838 - DNA, 25 bp, Rattus norvegicus
cctccaaaggctctgggaatttaga

SEQ ID NO: 252839 - DNA, 25 bp, Rattus norvegicus
cctccaaaggctgtgggaatttaga

SEQ ID NO: 252840 - DNA, 25 bp, Rattus norvegicus
cctccaaatctactcttcttttaag

SEQ ID NO: 252841 - DNA, 25 bp, Rattus norvegicus
cctccaaatctagtcttcttttaag

SEQ ID NO: 252842 - DNA, 25 bp, Rattus norvegicus
cctccaaatggtacgtagtcagtgt

SEQ ID NO: 252843 - DNA, 25 bp, Rattus norvegicus
cctccaaatggttcgtagtcagtgt

SEQ ID NO: 252844 - DNA, 25 bp, Rattus norvegicus
cctccaacccagaattcaactgagt

SEQ ID NO: 252845 - DNA, 25 bp, Rattus norvegicus
cctccaacccagtattcaactgagt

SEQ ID NO: 252846 - DNA, 25 bp, Rattus norvegicus
cctccaacccataacatcgtggtga

SEQ ID NO: 252847 - DNA, 25 bp, Rattus norvegicus
cctccaacccattacatcgtggtga

SEQ ID NO: 252848 - DNA, 25 bp, Rattus norvegicus
cctccaacctatagagctgactgca

SEQ ID NO: 252849 - DNA, 25 bp, Rattus norvegicus
cctccaacctattgagctgactgca

SEQ ID NO: 252850 - DNA, 25 bp, Rattus norvegicus
cctccaagctgtccctttgaaaggg

SEQ ID NO: 252851 - DNA, 25 bp, Rattus norvegicus
cctccaagctgtgcctttgaaaggg

SEQ ID NO: 252852 - DNA, 25 bp, Rattus norvegicus
cctccaaggtcactgctgcttcgtg

SEQ ID NO: 252853 - DNA, 25 bp, Rattus norvegicus
cctccaaggtcagtgctgcttcgtg

SEQ ID NO: 252854 - DNA, 25 bp, Rattus norvegicus
cctccaatactcagctgaatctttt

SEQ ID NO: 252855 - DNA, 25 bp, Rattus norvegicus
cctccaatactctgctgaatctttt

SEQ ID NO: 252856 - DNA, 25 bp, Rattus norvegicus
cctccaatatcccatgattccatga

SEQ ID NO: 252857 - DNA, 25 bp, Rattus norvegicus
cctccaatatccgatgattccatga

SEQ ID NO: 252858 - DNA, 25 bp, Rattus norvegicus
cctccacactaactaggcatagcac

SEQ ID NO: 252859 - DNA, 25 bp, Rattus norvegicus
cctccacactaagtaggcatagcac

SEQ ID NO: 252860 - DNA, 25 bp, Rattus norvegicus
cctccacagcgtactgtgtgggaaa

SEQ ID NO: 252861 - DNA, 25 bp, Rattus norvegicus
cctccacagcgttctgtgtgggaaa

SEQ ID NO: 252862 - DNA, 25 bp, Rattus norvegicus
cctccaccccacaatgaatgtattt

SEQ ID NO: 252863 - DNA, 25 bp, Rattus norvegicus
cctccaccccactatgaatgtattt

SEQ ID NO: 252864 - DNA, 25 bp, Rattus norvegicus
cctccaccccttaacatatataatt

SEQ ID NO: 252865 - DNA, 25 bp, Rattus norvegicus
cctccacccctttacatatataatt

SEQ ID NO: 252866 - DNA, 25 bp, Rattus norvegicus
cctccacctccaacagagaaagaat

SEQ ID NO: 252867 - DNA, 25 bp, Rattus norvegicus
cctccacctccatcagagaaagaat

SEQ ID NO: 252868 - DNA, 25 bp, Rattus norvegicus
cctccacctctgagataccagatag

SEQ ID NO: 252869 - DNA, 25 bp, Rattus norvegicus
cctccacctctgtgataccagatag

SEQ ID NO: 252870 - DNA, 25 bp, Rattus norvegicus
cctccacctttcagaatgacttcat

SEQ ID NO: 252871 - DNA, 25 bp, Rattus norvegicus
cctccacctttctgaatgacttcat

SEQ ID NO: 252872 - DNA, 25 bp, Rattus norvegicus
cctccacggcctcggatgagaagga

SEQ ID NO: 252873 - DNA, 25 bp, Rattus norvegicus
cctccacggcctgggatgagaagga

SEQ ID NO: 252874 - DNA, 25 bp, Rattus norvegicus
cctccacggtggactgtaagcaaag

SEQ ID NO: 252875 - DNA, 25 bp, Rattus norvegicus
cctccacggtggtctgtaagcaaag

SEQ ID NO: 252876 - DNA, 25 bp, Rattus norvegicus
cctccactatggaatttccctagta

SEQ ID NO: 252877 - DNA, 25 bp, Rattus norvegicus
cctccactatggtatttccctagta

SEQ ID NO: 252878 - DNA, 25 bp, Rattus norvegicus
cctccactccagaaacacttaaatt

SEQ ID NO: 252879 - DNA, 25 bp, Rattus norvegicus
cctccactccagtaacacttaaatt

SEQ ID NO: 252880 - DNA, 25 bp, Rattus norvegicus
cctccacttgtacccaaaagaagga

SEQ ID NO: 252881 - DNA, 25 bp, Rattus norvegicus
cctccacttgtagccaaaagaagga

SEQ ID NO: 252882 - DNA, 25 bp, Rattus norvegicus
cctccagaaactatacctattgcca

SEQ ID NO: 252883 - DNA, 25 bp, Rattus norvegicus
cctccagaaactttacctattgcca

SEQ ID NO: 252884 - DNA, 25 bp, Rattus norvegicus
cctccagcaatcatagaccttcata

SEQ ID NO: 252885 - DNA, 25 bp, Rattus norvegicus
cctccagcaatcttagaccttcata

SEQ ID NO: 252886 - DNA, 25 bp, Rattus norvegicus
cctccagcagagatctaagggcctg

SEQ ID NO: 252887 - DNA, 25 bp, Rattus norvegicus
cctccagcagagttctaagggcctg

SEQ ID NO: 252888 - DNA, 25 bp, Rattus norvegicus
cctccagcagtcagttccagataag

SEQ ID NO: 252889 - DNA, 25 bp, Rattus norvegicus
cctccagcagtctgttccagataag

SEQ ID NO: 252890 - DNA, 25 bp, Rattus norvegicus
cctccagccaagaaactcaactttg

SEQ ID NO: 252891 - DNA, 25 bp, Rattus norvegicus
cctccagccaagtaactcaactttg

SEQ ID NO: 252892 - DNA, 25 bp, Rattus norvegicus
cctccagccccgagtataaggaaga

SEQ ID NO: 252893 - DNA, 25 bp, Rattus norvegicus
cctccagccccgtgtataaggaaga

SEQ ID NO: 252894 - DNA, 25 bp, Rattus norvegicus
cctccagctcctaaagtgaattcga

SEQ ID NO: 252895 - DNA, 25 bp, Rattus norvegicus
cctccagctccttaagtgaattcga

SEQ ID NO: 252896 - DNA, 25 bp, Rattus norvegicus
cctccagctctgaggatgaaagagt

SEQ ID NO: 252897 - DNA, 25 bp, Rattus norvegicus
cctccagctctgtggatgaaagagt

SEQ ID NO: 252898 - DNA, 25 bp, Rattus norvegicus
cctccagctgtgaccttgaaatcag

SEQ ID NO: 252899 - DNA, 25 bp, Rattus norvegicus
cctccagctgtgtccttgaaatcag

SEQ ID NO: 252900 - DNA, 25 bp, Rattus norvegicus
cctccagctttgcagtacagttaaa

SEQ ID NO: 252901 - DNA, 25 bp, Rattus norvegicus
cctccagctttggagtacagttaaa

SEQ ID NO: 252902 - DNA, 25 bp, Rattus norvegicus
cctccaggaagtctgttgccatcta

SEQ ID NO: 252903 - DNA, 25 bp, Rattus norvegicus
cctccaggaagtgtgttgccatcta

SEQ ID NO: 252904 - DNA, 25 bp, Rattus norvegicus
cctccaggacagaccaactgaagtc

SEQ ID NO: 252905 - DNA, 25 bp, Rattus norvegicus
cctccaggacagtccaactgaagtc

SEQ ID NO: 252906 - DNA, 25 bp, Rattus norvegicus
cctccaggagagatgttcacacttt

SEQ ID NO: 252907 - DNA, 25 bp, Rattus norvegicus
cctccaggagagttgttcacacttt

SEQ ID NO: 252908 - DNA, 25 bp, Rattus norvegicus
cctccaggccaaagtgcaataccaa

SEQ ID NO: 252909 - DNA, 25 bp, Rattus norvegicus
cctccaggccaatgtgcaataccaa

SEQ ID NO: 252910 - DNA, 25 bp, Rattus norvegicus
cctccaggctttcttttgttgtcaa

SEQ ID NO: 252911 - DNA, 25 bp, Rattus norvegicus
cctccaggctttgttttgttgtcaa

SEQ ID NO: 252912 - DNA, 25 bp, Rattus norvegicus
cctccagggacgaggaacctgctgc

SEQ ID NO: 252913 - DNA, 25 bp, Rattus norvegicus
cctccagggacgtggaacctgctgc

SEQ ID NO: 252914 - DNA, 25 bp, Rattus norvegicus
cctccaggttggatttgtgtttgct

SEQ ID NO: 252915 - DNA, 25 bp, Rattus norvegicus
cctccaggttggttttgtgtttgct

SEQ ID NO: 252916 - DNA, 25 bp, Rattus norvegicus
cctccagtaccaccagttcttaata

SEQ ID NO: 252917 - DNA, 25 bp, Rattus norvegicus
cctccagtaccagcagttcttaata

SEQ ID NO: 252918 - DNA, 25 bp, Rattus norvegicus
cctccagtaggcattgtgaacagtg

SEQ ID NO: 252919 - DNA, 25 bp, Rattus norvegicus
cctccagtaggctttgtgaacagtg

SEQ ID NO: 252920 - DNA, 25 bp, Rattus norvegicus
cctccagtgagcacttcgaacgtaa

SEQ ID NO: 252921 - DNA, 25 bp, Rattus norvegicus
cctccagtgagctcttcgaacgtaa

SEQ ID NO: 252922 - DNA, 25 bp, Rattus norvegicus
cctccagtgatccatgctacagaaa

SEQ ID NO: 252923 - DNA, 25 bp, Rattus norvegicus
cctccagtgatcgatgctacagaaa

SEQ ID NO: 252924 - DNA, 25 bp, Rattus norvegicus
cctccagtgggtatttctcttttga

SEQ ID NO: 252925 - DNA, 25 bp, Rattus norvegicus
cctccagtgggtttttctcttttga

SEQ ID NO: 252926 - DNA, 25 bp, Rattus norvegicus
cctccagttattaaacggtgcggat

SEQ ID NO: 252927 - DNA, 25 bp, Rattus norvegicus
cctccagttatttaacggtgcggat

SEQ ID NO: 252928 - DNA, 25 bp, Rattus norvegicus
cctccagtttgtcgcatcagctaac

SEQ ID NO: 252929 - DNA, 25 bp, Rattus norvegicus
cctccagtttgtggcatcagctaac

SEQ ID NO: 252930 - DNA, 25 bp, Rattus norvegicus
cctccatatctcaagttctgcatag

SEQ ID NO: 252931 - DNA, 25 bp, Rattus norvegicus
cctccatatctctagttctgcatag

SEQ ID NO: 252932 - DNA, 25 bp, Rattus norvegicus
cctccatccttcaggttttgatgta

SEQ ID NO: 252933 - DNA, 25 bp, Rattus norvegicus
cctccatccttctggttttgatgta

SEQ ID NO: 252934 - DNA, 25 bp, Rattus norvegicus
cctccatctctgacacaagtatagc

SEQ ID NO: 252935 - DNA, 25 bp, Rattus norvegicus
cctccatctctgtcacaagtatagc

SEQ ID NO: 252936 - DNA, 25 bp, Rattus norvegicus
cctccatgacatccggtaccaaaag

SEQ ID NO: 252937 - DNA, 25 bp, Rattus norvegicus
cctccatgacatgcggtaccaaaag

SEQ ID NO: 252938 - DNA, 25 bp, Rattus norvegicus
cctccatgagatccattttgctcaa

SEQ ID NO: 252939 - DNA, 25 bp, Rattus norvegicus
cctccatgagatgcattttgctcaa

SEQ ID NO: 252940 - DNA, 25 bp, Rattus norvegicus
cctccatgatttcgccatcttcaat

SEQ ID NO: 252941 - DNA, 25 bp, Rattus norvegicus
cctccatgatttggccatcttcaat

SEQ ID NO: 252942 - DNA, 25 bp, Rattus norvegicus
cctccatggacactgcacatatatg

SEQ ID NO: 252943 - DNA, 25 bp, Rattus norvegicus
cctccatggacagtgcacatatatg

SEQ ID NO: 252944 - DNA, 25 bp, Rattus norvegicus
cctccattctgtctttcatttagtg

SEQ ID NO: 252945 - DNA, 25 bp, Rattus norvegicus
cctccattctgtgtttcatttagtg

SEQ ID NO: 252946 - DNA, 25 bp, Rattus norvegicus
cctccattgggacctgctgtataca

SEQ ID NO: 252947 - DNA, 25 bp, Rattus norvegicus
cctccattgggagctgctgtataca

SEQ ID NO: 252948 - DNA, 25 bp, Rattus norvegicus
cctccatttatgcttgtggttcaca

SEQ ID NO: 252949 - DNA, 25 bp, Rattus norvegicus
cctccatttatggttgtggttcaca

SEQ ID NO: 252950 - DNA, 25 bp, Rattus norvegicus
cctccatttctgaaacgtccatatg

SEQ ID NO: 252951 - DNA, 25 bp, Rattus norvegicus
cctccatttctgtaacgtccatatg

SEQ ID NO: 252952 - DNA, 25 bp, Rattus norvegicus
cctcccaacactactaactgtaagt

SEQ ID NO: 252953 - DNA, 25 bp, Rattus norvegicus
cctcccaacacttctaactgtaagt

SEQ ID NO: 252954 - DNA, 25 bp, Rattus norvegicus
cctcccaagggcaattttcagaaca

SEQ ID NO: 252955 - DNA, 25 bp, Rattus norvegicus
cctcccaagggctattttcagaaca

SEQ ID NO: 252956 - DNA, 25 bp, Rattus norvegicus
cctcccaagggtccacagagattgt

SEQ ID NO: 252957 - DNA, 25 bp, Rattus norvegicus
cctcccaagggtgcacagagattgt

SEQ ID NO: 252958 - DNA, 25 bp, Rattus norvegicus
cctcccaagtgcaaggtatacactc

SEQ ID NO: 252959 - DNA, 25 bp, Rattus norvegicus
cctcccaagtgctaggtatacactc

SEQ ID NO: 252960 - DNA, 25 bp, Rattus norvegicus
cctcccacctacactttatagaagt

SEQ ID NO: 252961 - DNA, 25 bp, Rattus norvegicus
cctcccacctactctttatagaagt

SEQ ID NO: 252962 - DNA, 25 bp, Rattus norvegicus
cctcccacgcaaccatggatatgtg

SEQ ID NO: 252963 - DNA, 25 bp, Rattus norvegicus
cctcccacgcaagcatggatatgtg

SEQ ID NO: 252964 - DNA, 25 bp, Rattus norvegicus
cctcccagaggacgcctagtgtgtg

SEQ ID NO: 252965 - DNA, 25 bp, Rattus norvegicus
cctcccagaggaggcctagtgtgtg

SEQ ID NO: 252966 - DNA, 25 bp, Rattus norvegicus
cctcccagcagacagggcagtgagt

SEQ ID NO: 252967 - DNA, 25 bp, Rattus norvegicus
cctcccagcagagagggcagtgagt

SEQ ID NO: 252968 - DNA, 25 bp, Rattus norvegicus
cctcccatagctaaagaagccctgg

SEQ ID NO: 252969 - DNA, 25 bp, Rattus norvegicus
cctcccatagcttaagaagccctgg

SEQ ID NO: 252970 - DNA, 25 bp, Rattus norvegicus
cctcccatgggacttattgttacaa

SEQ ID NO: 252971 - DNA, 25 bp, Rattus norvegicus
cctcccatgggagttattgttacaa

SEQ ID NO: 252972 - DNA, 25 bp, Rattus norvegicus
cctcccatgtcccttgtaaatagaa

SEQ ID NO: 252973 - DNA, 25 bp, Rattus norvegicus
cctcccatgtccgttgtaaatagaa

SEQ ID NO: 252974 - DNA, 25 bp, Rattus norvegicus
cctcccatttttaggaattgacctg

SEQ ID NO: 252975 - DNA, 25 bp, Rattus norvegicus
cctcccattttttggaattgacctg

SEQ ID NO: 252976 - DNA, 25 bp, Rattus norvegicus
cctccccaaaggacatgtcagtaga

SEQ ID NO: 252977 - DNA, 25 bp, Rattus norvegicus
cctccccaaaggtcatgtcagtaga

SEQ ID NO: 252978 - DNA, 25 bp, Rattus norvegicus
cctccccaagtgcatatgtggctgt

SEQ ID NO: 252979 - DNA, 25 bp, Rattus norvegicus
cctccccaagtggatatgtggctgt

SEQ ID NO: 252980 - DNA, 25 bp, Rattus norvegicus
cctccccgctgaccgccatccagga

SEQ ID NO: 252981 - DNA, 25 bp, Rattus norvegicus
cctccccgctgagcgccatccagga

SEQ ID NO: 252982 - DNA, 25 bp, Rattus norvegicus
cctcccctacagataatttgtctct

SEQ ID NO: 252983 - DNA, 25 bp, Rattus norvegicus
cctcccctacagttaatttgtctct

SEQ ID NO: 252984 - DNA, 25 bp, Rattus norvegicus
cctcccctctgcaaatacaatgtag

SEQ ID NO: 252985 - DNA, 25 bp, Rattus norvegicus
cctcccctctgctaatacaatgtag

SEQ ID NO: 252986 - DNA, 25 bp, Rattus norvegicus
cctcccctgaggaccaggaagaatt

SEQ ID NO: 252987 - DNA, 25 bp, Rattus norvegicus
cctcccctgaggtccaggaagaatt

SEQ ID NO: 252988 - DNA, 25 bp, Rattus norvegicus
cctccccttggaatgaaaactgaat

SEQ ID NO: 252989 - DNA, 25 bp, Rattus norvegicus
cctccccttggattgaaaactgaat

SEQ ID NO: 252990 - DNA, 25 bp, Rattus norvegicus
cctcccgaacatactgtagtggtga

SEQ ID NO: 252991 - DNA, 25 bp, Rattus norvegicus
cctcccgaacattctgtagtggtga

SEQ ID NO: 252992 - DNA, 25 bp, Rattus norvegicus
cctcccgcagacatgtatgtattac

SEQ ID NO: 252993 - DNA, 25 bp, Rattus norvegicus
cctcccgcagacttgtatgtattac

SEQ ID NO: 252994 - DNA, 25 bp, Rattus norvegicus
cctcccgccattctacaaaggattt

SEQ ID NO: 252995 - DNA, 25 bp, Rattus norvegicus
cctcccgccattgtacaaaggattt

SEQ ID NO: 252996 - DNA, 25 bp, Rattus norvegicus
cctcccggtatcatctgactaagga

SEQ ID NO: 252997 - DNA, 25 bp, Rattus norvegicus
cctcccggtatcttctgactaagga

SEQ ID NO: 252998 - DNA, 25 bp, Rattus norvegicus
cctcccgtagtgactccagaaggaa

SEQ ID NO: 252999 - DNA, 25 bp, Rattus norvegicus
cctcccgtagtgtctccagaaggaa

SEQ ID NO: 253000 - DNA, 25 bp, Rattus norvegicus
cctcccgtcttgattatggtatctt

SEQ ID NO: 253001 - DNA, 25 bp, Rattus norvegicus
cctcccgtcttgtttatggtatctt

SEQ ID NO: 253002 - DNA, 25 bp, Rattus norvegicus
cctcccgtgtgaagccattagaact

SEQ ID NO: 253003 - DNA, 25 bp, Rattus norvegicus
cctcccgtgtgatgccattagaact

SEQ ID NO: 253004 - DNA, 25 bp, Rattus norvegicus
cctcccgtttgtactcagatgagac

SEQ ID NO: 253005 - DNA, 25 bp, Rattus norvegicus
cctcccgtttgttctcagatgagac

SEQ ID NO: 253006 - DNA, 25 bp, Rattus norvegicus
cctccctacgcgatcggtaatgtaa

SEQ ID NO: 253007 - DNA, 25 bp, Rattus norvegicus
cctccctacgcgttcggtaatgtaa

SEQ ID NO: 253008 - DNA, 25 bp, Rattus norvegicus
cctccctactttcatcatttgttgt

SEQ ID NO: 253009 - DNA, 25 bp, Rattus norvegicus
cctccctactttgatcatttgttgt

SEQ ID NO: 253010 - DNA, 25 bp, Rattus norvegicus
cctccctcacgtaagcaagtgctga

SEQ ID NO: 253011 - DNA, 25 bp, Rattus norvegicus
cctccctcacgttagcaagtgctga

SEQ ID NO: 253012 - DNA, 25 bp, Rattus norvegicus
cctccctcaggaatgatgtcgtatc

SEQ ID NO: 253013 - DNA, 25 bp, Rattus norvegicus
cctccctcaggattgatgtcgtatc

SEQ ID NO: 253014 - DNA, 25 bp, Rattus norvegicus
cctccctcatatctttcttcttaat

SEQ ID NO: 253015 - DNA, 25 bp, Rattus norvegicus
cctccctcatatgtttcttcttaat

SEQ ID NO: 253016 - DNA, 25 bp, Rattus norvegicus
cctccctccatgcactttatttaat

SEQ ID NO: 253017 - DNA, 25 bp, Rattus norvegicus
cctccctccatggactttatttaat

SEQ ID NO: 253018 - DNA, 25 bp, Rattus norvegicus
cctccctctagcaatttagtactac

SEQ ID NO: 253019 - DNA, 25 bp, Rattus norvegicus
cctccctctagctatttagtactac

SEQ ID NO: 253020 - DNA, 25 bp, Rattus norvegicus
cctccctctctcagttgttttgcag

SEQ ID NO: 253021 - DNA, 25 bp, Rattus norvegicus
cctccctctctctgttgttttgcag

SEQ ID NO: 253022 - DNA, 25 bp, Rattus norvegicus
cctccctctctgaaatgaaatctct

SEQ ID NO: 253023 - DNA, 25 bp, Rattus norvegicus
cctccctctctgatgatatgttgaa

SEQ ID NO: 253024 - DNA, 25 bp, Rattus norvegicus
cctccctctctgtaatgaaatctct

SEQ ID NO: 253025 - DNA, 25 bp, Rattus norvegicus
cctccctctctgttgatatgttgaa

SEQ ID NO: 253026 - DNA, 25 bp, Rattus norvegicus
cctccctctgagactgttgatgtat

SEQ ID NO: 253027 - DNA, 25 bp, Rattus norvegicus
cctccctctgagtctgttgatgtat

SEQ ID NO: 253028 - DNA, 25 bp, Rattus norvegicus
cctccctcttagaatttcacaactg

SEQ ID NO: 253029 - DNA, 25 bp, Rattus norvegicus
cctccctcttagtatttcacaactg

SEQ ID NO: 253030 - DNA, 25 bp, Rattus norvegicus
cctccctgacatatccaagtttagt

SEQ ID NO: 253031 - DNA, 25 bp, Rattus norvegicus
cctccctgacatttccaagtttagt

SEQ ID NO: 253032 - DNA, 25 bp, Rattus norvegicus
cctccctgaggaagatttctagaaa

SEQ ID NO: 253033 - DNA, 25 bp, Rattus norvegicus
cctccctgaggatgatttctagaaa

SEQ ID NO: 253034 - DNA, 25 bp, Rattus norvegicus
cctccctgagtaatagctgcactgg

SEQ ID NO: 253035 - DNA, 25 bp, Rattus norvegicus
cctccctgagtattagctgcactgg

SEQ ID NO: 253036 - DNA, 25 bp, Rattus norvegicus
cctccctgatctcagcatggaggga

SEQ ID NO: 253037 - DNA, 25 bp, Rattus norvegicus
cctccctgatctgagcatggaggga

SEQ ID NO: 253038 - DNA, 25 bp, Rattus norvegicus
cctccctgcaagataggcttctcaa

SEQ ID NO: 253039 - DNA, 25 bp, Rattus norvegicus
cctccctgcaagttaggcttctcaa

SEQ ID NO: 253040 - DNA, 25 bp, Rattus norvegicus
cctccctgctgtctgaatggtgctg

SEQ ID NO: 253041 - DNA, 25 bp, Rattus norvegicus
cctccctgctgtgtgaatggtgctg

SEQ ID NO: 253042 - DNA, 25 bp, Rattus norvegicus
cctccctgtttcagcatgataattg

SEQ ID NO: 253043 - DNA, 25 bp, Rattus norvegicus
cctccctgtttctgcatgataattg

SEQ ID NO: 253044 - DNA, 25 bp, Rattus norvegicus
cctcccttacatagttgttctgtta

SEQ ID NO: 253045 - DNA, 25 bp, Rattus norvegicus
cctcccttacattgttgttctgtta

SEQ ID NO: 253046 - DNA, 25 bp, Rattus norvegicus
cctcccttcaagctactgactgaaa

SEQ ID NO: 253047 - DNA, 25 bp, Rattus norvegicus
cctcccttcaagctcagaagagttt

SEQ ID NO: 253048 - DNA, 25 bp, Rattus norvegicus
cctcccttcaaggtactgactgaaa

SEQ ID NO: 253049 - DNA, 25 bp, Rattus norvegicus
cctcccttcaaggtcagaagagttt

SEQ ID NO: 253050 - DNA, 25 bp, Rattus norvegicus
cctccctttggtaggcatgatgcaa

SEQ ID NO: 253051 - DNA, 25 bp, Rattus norvegicus
cctccctttggttggcatgatgcaa

SEQ ID NO: 253052 - DNA, 25 bp, Rattus norvegicus
cctcccttttgaccctgaagacagt

SEQ ID NO: 253053 - DNA, 25 bp, Rattus norvegicus
cctcccttttgagcctgaagacagt

SEQ ID NO: 253054 - DNA, 25 bp, Rattus norvegicus
cctcccttttgcaaccttgatatag

SEQ ID NO: 253055 - DNA, 25 bp, Rattus norvegicus
cctcccttttgctaccttgatatag

SEQ ID NO: 253056 - DNA, 25 bp, Rattus norvegicus
cctccgaaggcacttgtggctgact

SEQ ID NO: 253057 - DNA, 25 bp, Rattus norvegicus
cctccgaaggcagttgtggctgact

SEQ ID NO: 253058 - DNA, 25 bp, Rattus norvegicus
cctccgagatgcaggtgttggttat

SEQ ID NO: 253059 - DNA, 25 bp, Rattus norvegicus
cctccgagatgctggtgttggttat

SEQ ID NO: 253060 - DNA, 25 bp, Rattus norvegicus
cctccgaggaggctctggtataact

SEQ ID NO: 253061 - DNA, 25 bp, Rattus norvegicus
cctccgaggagggtctggtataact

SEQ ID NO: 253062 - DNA, 25 bp, Rattus norvegicus
cctccgaggatcatctgtcaaacag

SEQ ID NO: 253063 - DNA, 25 bp, Rattus norvegicus
cctccgaggatcttctgtcaaacag

SEQ ID NO: 253064 - DNA, 25 bp, Rattus norvegicus
cctccggagcttccagatgtgatga

SEQ ID NO: 253065 - DNA, 25 bp, Rattus norvegicus
cctccggagcttgcagatgtgatga

SEQ ID NO: 253066 - DNA, 25 bp, Rattus norvegicus
cctccggcagtaagcagcttgtgaa

SEQ ID NO: 253067 - DNA, 25 bp, Rattus norvegicus
cctccggcagtatgcagcttgtgaa

SEQ ID NO: 253068 - DNA, 25 bp, Rattus norvegicus
cctccgggacacactaagcttggaa

SEQ ID NO: 253069 - DNA, 25 bp, Rattus norvegicus
cctccgggacactctaagcttggaa

SEQ ID NO: 253070 - DNA, 25 bp, Rattus norvegicus
cctccgggtctcagggaactcaaga

SEQ ID NO: 253071 - DNA, 25 bp, Rattus norvegicus
cctccgggtctctgggaactcaaga

SEQ ID NO: 253072 - DNA, 25 bp, Rattus norvegicus
cctccgtcattacccacagtgagga

SEQ ID NO: 253073 - DNA, 25 bp, Rattus norvegicus
cctccgtcattagccacagtgagga

SEQ ID NO: 253074 - DNA, 25 bp, Rattus norvegicus
cctccgttcctgcttctaatagaga

SEQ ID NO: 253075 - DNA, 25 bp, Rattus norvegicus
cctccgttcctggttctaatagaga

SEQ ID NO: 253076 - DNA, 25 bp, Rattus norvegicus
cctccgttcttcactgaaaggtgtt

SEQ ID NO: 253077 - DNA, 25 bp, Rattus norvegicus
cctccgttcttctctgaaaggtgtt

SEQ ID NO: 253078 - DNA, 25 bp, Rattus norvegicus
cctccgttgggacccagcgtggaca

SEQ ID NO: 253079 - DNA, 25 bp, Rattus norvegicus
cctccgttgggagccagcgtggaca

SEQ ID NO: 253080 - DNA, 25 bp, Rattus norvegicus
cctcctaaaacaccacatgcttaat

SEQ ID NO: 253081 - DNA, 25 bp, Rattus norvegicus
cctcctaaaacagcacatgcttaat

SEQ ID NO: 253082 - DNA, 25 bp, Rattus norvegicus
cctcctaaacgtctacaatagctat

SEQ ID NO: 253083 - DNA, 25 bp, Rattus norvegicus
cctcctaaacgtgtacaatagctat

SEQ ID NO: 253084 - DNA, 25 bp, Rattus norvegicus
cctcctacacagacaagccaatata

SEQ ID NO: 253085 - DNA, 25 bp, Rattus norvegicus
cctcctacacagtcaagccaatata

SEQ ID NO: 253086 - DNA, 25 bp, Rattus norvegicus
cctcctacatttattactctgcaaa

SEQ ID NO: 253087 - DNA, 25 bp, Rattus norvegicus
cctcctacattttttactctgcaaa

SEQ ID NO: 253088 - DNA, 25 bp, Rattus norvegicus
cctcctatagtacccatgatacatc

SEQ ID NO: 253089 - DNA, 25 bp, Rattus norvegicus
cctcctatagtagccatgatacatc

SEQ ID NO: 253090 - DNA, 25 bp, Rattus norvegicus
cctcctcaaagcaaagccctaggga

SEQ ID NO: 253091 - DNA, 25 bp, Rattus norvegicus
cctcctcaaagctaagccctaggga

SEQ ID NO: 253092 - DNA, 25 bp, Rattus norvegicus
cctcctcaagagacagcactacaaa

SEQ ID NO: 253093 - DNA, 25 bp, Rattus norvegicus
cctcctcaagagtcagcactacaaa

SEQ ID NO: 253094 - DNA, 25 bp, Rattus norvegicus
cctcctcaaggcctgaatacagact

SEQ ID NO: 253095 - DNA, 25 bp, Rattus norvegicus
cctcctcaaggcgtgaatacagact

SEQ ID NO: 253096 - DNA, 25 bp, Rattus norvegicus
cctcctcagctacactttcttgtaa

SEQ ID NO: 253097 - DNA, 25 bp, Rattus norvegicus
cctcctcagctagactttcttgtaa

SEQ ID NO: 253098 - DNA, 25 bp, Rattus norvegicus
cctcctcatattactgtaaatgcta

SEQ ID NO: 253099 - DNA, 25 bp, Rattus norvegicus
cctcctcatatttctgtaaatgcta

SEQ ID NO: 253100 - DNA, 25 bp, Rattus norvegicus
cctcctccattcatctgcatagagg

SEQ ID NO: 253101 - DNA, 25 bp, Rattus norvegicus
cctcctccattcttctgcatagagg

SEQ ID NO: 253102 - DNA, 25 bp, Rattus norvegicus
cctcctcccaacaacaaatttgctt

SEQ ID NO: 253103 - DNA, 25 bp, Rattus norvegicus
cctcctcccaactacaaatttgctt

SEQ ID NO: 253104 - DNA, 25 bp, Rattus norvegicus
cctcctcccgtgagagcagaattaa

SEQ ID NO: 253105 - DNA, 25 bp, Rattus norvegicus
cctcctcccgtgtgagcagaattaa

SEQ ID NO: 253106 - DNA, 25 bp, Rattus norvegicus
cctcctccctccaaagaatattaat

SEQ ID NO: 253107 - DNA, 25 bp, Rattus norvegicus
cctcctccctcctaagaatattaat

SEQ ID NO: 253108 - DNA, 25 bp, Rattus norvegicus
cctcctccctgtaattttcaagtag

SEQ ID NO: 253109 - DNA, 25 bp, Rattus norvegicus
cctcctccctgtacagtagcataaa

SEQ ID NO: 253110 - DNA, 25 bp, Rattus norvegicus
cctcctccctgttattttcaagtag

SEQ ID NO: 253111 - DNA, 25 bp, Rattus norvegicus
cctcctccctgttcagtagcataaa

SEQ ID NO: 253112 - DNA, 25 bp, Rattus norvegicus
cctcctcctcaaagctctatataaa

SEQ ID NO: 253113 - DNA, 25 bp, Rattus norvegicus
cctcctcctcaatgctctatataaa

SEQ ID NO: 253114 - DNA, 25 bp, Rattus norvegicus
cctcctcctttgcaatttttctgtg

SEQ ID NO: 253115 - DNA, 25 bp, Rattus norvegicus
cctcctcctttggaatttttctgtg

SEQ ID NO: 253116 - DNA, 25 bp, Rattus norvegicus
cctcctcgagtaactcttcatttga

SEQ ID NO: 253117 - DNA, 25 bp, Rattus norvegicus
cctcctcgagtatctcttcatttga

SEQ ID NO: 253118 - DNA, 25 bp, Rattus norvegicus
cctcctcgtagaattcatcgaaatc

SEQ ID NO: 253119 - DNA, 25 bp, Rattus norvegicus
cctcctcgtagatttcatcgaaatc

SEQ ID NO: 253120 - DNA, 25 bp, Rattus norvegicus
cctcctcgtcgtcctcttgggagga

SEQ ID NO: 253121 - DNA, 25 bp, Rattus norvegicus
cctcctcgtcgtgctcttgggagga

SEQ ID NO: 253122 - DNA, 25 bp, Rattus norvegicus
cctcctctattcatcgactctaaaa

SEQ ID NO: 253123 - DNA, 25 bp, Rattus norvegicus
cctcctctattcttcgactctaaaa

SEQ ID NO: 253124 - DNA, 25 bp, Rattus norvegicus
cctcctctccatctgtgggttttgt

SEQ ID NO: 253125 - DNA, 25 bp, Rattus norvegicus
cctcctctccatgtgtgggttttgt

SEQ ID NO: 253126 - DNA, 25 bp, Rattus norvegicus
cctcctctccttctatgtaatatct

SEQ ID NO: 253127 - DNA, 25 bp, Rattus norvegicus
cctcctctccttgtatgtaatatct

SEQ ID NO: 253128 - DNA, 25 bp, Rattus norvegicus
cctcctctcgttcgatgtgagctcg

SEQ ID NO: 253129 - DNA, 25 bp, Rattus norvegicus
cctcctctcgttggatgtgagctcg

SEQ ID NO: 253130 - DNA, 25 bp, Rattus norvegicus
cctcctctctggctgggtatgggac

SEQ ID NO: 253131 - DNA, 25 bp, Rattus norvegicus
cctcctctctgggtgggtatgggac

SEQ ID NO: 253132 - DNA, 25 bp, Rattus norvegicus
cctcctctctttacatgtcaaaatg

SEQ ID NO: 253133 - DNA, 25 bp, Rattus norvegicus
cctcctctcttttcatgtcaaaatg

SEQ ID NO: 253134 - DNA, 25 bp, Rattus norvegicus
cctcctctgaggaagacatcattga

SEQ ID NO: 253135 - DNA, 25 bp, Rattus norvegicus
cctcctctgaggtagacatcattga

SEQ ID NO: 253136 - DNA, 25 bp, Rattus norvegicus
cctcctctgatgattatccctgatg

SEQ ID NO: 253137 - DNA, 25 bp, Rattus norvegicus
cctcctctgatgtttatccctgatg

SEQ ID NO: 253138 - DNA, 25 bp, Rattus norvegicus
cctcctcttatgctttagggcatag

SEQ ID NO: 253139 - DNA, 25 bp, Rattus norvegicus
cctcctcttatggtttagggcatag

SEQ ID NO: 253140 - DNA, 25 bp, Rattus norvegicus
cctcctcttggacagctcagttaat

SEQ ID NO: 253141 - DNA, 25 bp, Rattus norvegicus
cctcctcttggagagctcagttaat

SEQ ID NO: 253142 - DNA, 25 bp, Rattus norvegicus
cctcctctttttctacatttcacag

SEQ ID NO: 253143 - DNA, 25 bp, Rattus norvegicus
cctcctctttttgtacatttcacag

SEQ ID NO: 253144 - DNA, 25 bp, Rattus norvegicus
cctcctgaatctccacgaagtctga

SEQ ID NO: 253145 - DNA, 25 bp, Rattus norvegicus
cctcctgaatctgcacgaagtctga

SEQ ID NO: 253146 - DNA, 25 bp, Rattus norvegicus
cctcctgacctgattgctagaatga

SEQ ID NO: 253147 - DNA, 25 bp, Rattus norvegicus
cctcctgacctgtttgctagaatga

SEQ ID NO: 253148 - DNA, 25 bp, Rattus norvegicus
cctcctgatgaacacctggacagta

SEQ ID NO: 253149 - DNA, 25 bp, Rattus norvegicus
cctcctgatgaagacctggacagta

SEQ ID NO: 253150 - DNA, 25 bp, Rattus norvegicus
cctcctgcaggcaatttccaaaaga

SEQ ID NO: 253151 - DNA, 25 bp, Rattus norvegicus
cctcctgcaggctatttccaaaaga

SEQ ID NO: 253152 - DNA, 25 bp, Rattus norvegicus
cctcctgcatgcaggtgaggattat

SEQ ID NO: 253153 - DNA, 25 bp, Rattus norvegicus
cctcctgcatgctggtgaggattat

SEQ ID NO: 253154 - DNA, 25 bp, Rattus norvegicus
cctcctgccactctaagtattgaat

SEQ ID NO: 253155 - DNA, 25 bp, Rattus norvegicus
cctcctgccactgtaagtattgaat

SEQ ID NO: 253156 - DNA, 25 bp, Rattus norvegicus
cctcctgccttgagtgattcatgca

SEQ ID NO: 253157 - DNA, 25 bp, Rattus norvegicus
cctcctgccttgtgtgattcatgca

SEQ ID NO: 253158 - DNA, 25 bp, Rattus norvegicus
cctcctgcgtccataggttgttgag

SEQ ID NO: 253159 - DNA, 25 bp, Rattus norvegicus
cctcctgcgtccttaggttgttgag

SEQ ID NO: 253160 - DNA, 25 bp, Rattus norvegicus
cctcctgctgtaagcgacttacaag

SEQ ID NO: 253161 - DNA, 25 bp, Rattus norvegicus
cctcctgctgtatgcgacttacaag

SEQ ID NO: 253162 - DNA, 25 bp, Rattus norvegicus
cctcctggaaggcataactggcttt

SEQ ID NO: 253163 - DNA, 25 bp, Rattus norvegicus
cctcctggaagggataactggcttt

SEQ ID NO: 253164 - DNA, 25 bp, Rattus norvegicus
cctcctggctccaacaaagtggaaa

SEQ ID NO: 253165 - DNA, 25 bp, Rattus norvegicus
cctcctggctcctacaaagtggaaa

SEQ ID NO: 253166 - DNA, 25 bp, Rattus norvegicus
cctcctgggatgatcacggttatat

SEQ ID NO: 253167 - DNA, 25 bp, Rattus norvegicus
cctcctgggatgttcacggttatat

SEQ ID NO: 253168 - DNA, 25 bp, Rattus norvegicus
cctcctggtgaaagggcacagcatg

SEQ ID NO: 253169 - DNA, 25 bp, Rattus norvegicus
cctcctggtgaatgggcacagcatg

SEQ ID NO: 253170 - DNA, 25 bp, Rattus norvegicus
cctcctgtcttcactaaaggccaat

SEQ ID NO: 253171 - DNA, 25 bp, Rattus norvegicus
cctcctgtcttctctaaaggccaat

SEQ ID NO: 253172 - DNA, 25 bp, Rattus norvegicus
cctcctgtgactccacgttagagaa

SEQ ID NO: 253173 - DNA, 25 bp, Rattus norvegicus
cctcctgtgactcttgtggctatca

SEQ ID NO: 253174 - DNA, 25 bp, Rattus norvegicus
cctcctgtgactgcacgttagagaa

SEQ ID NO: 253175 - DNA, 25 bp, Rattus norvegicus
cctcctgtgactgttgtggctatca

SEQ ID NO: 253176 - DNA, 25 bp, Rattus norvegicus
cctcctgtggcaactcaaatttgtc

SEQ ID NO: 253177 - DNA, 25 bp, Rattus norvegicus
cctcctgtggcatctcaaatttgtc

SEQ ID NO: 253178 - DNA, 25 bp, Rattus norvegicus
cctcctgtggtgatcctagatcaag

SEQ ID NO: 253179 - DNA, 25 bp, Rattus norvegicus
cctcctgtggtgttcctagatcaag

SEQ ID NO: 253180 - DNA, 25 bp, Rattus norvegicus
cctcctgtggttatgtgcatactga

SEQ ID NO: 253181 - DNA, 25 bp, Rattus norvegicus
cctcctgtggttttgtgcatactga

SEQ ID NO: 253182 - DNA, 25 bp, Rattus norvegicus
cctcctgtgtgcaagggttaaagat

SEQ ID NO: 253183 - DNA, 25 bp, Rattus norvegicus
cctcctgtgtgctagggttaaagat

SEQ ID NO: 253184 - DNA, 25 bp, Rattus norvegicus
cctccttagtagatagtgtctgcct

SEQ ID NO: 253185 - DNA, 25 bp, Rattus norvegicus
cctccttagtagttagtgtctgcct

SEQ ID NO: 253186 - DNA, 25 bp, Rattus norvegicus
cctccttcccataattgcaaggcaa

SEQ ID NO: 253187 - DNA, 25 bp, Rattus norvegicus
cctccttcccattattgcaaggcaa

SEQ ID NO: 253188 - DNA, 25 bp, Rattus norvegicus
cctccttctaccaggatttcagaag

SEQ ID NO: 253189 - DNA, 25 bp, Rattus norvegicus
cctccttctacctggatttcagaag

SEQ ID NO: 253190 - DNA, 25 bp, Rattus norvegicus
cctccttctagcagcctgagagatt

SEQ ID NO: 253191 - DNA, 25 bp, Rattus norvegicus
cctccttctagctgcctgagagatt

SEQ ID NO: 253192 - DNA, 25 bp, Rattus norvegicus
cctccttctccaagatgtaactgtt

SEQ ID NO: 253193 - DNA, 25 bp, Rattus norvegicus
cctccttctccatgatgtaactgtt

SEQ ID NO: 253194 - DNA, 25 bp, Rattus norvegicus
cctccttgccagcataaactactgt

SEQ ID NO: 253195 - DNA, 25 bp, Rattus norvegicus
cctccttgccaggataaactactgt

SEQ ID NO: 253196 - DNA, 25 bp, Rattus norvegicus
cctccttgtctaactgtataaccag

SEQ ID NO: 253197 - DNA, 25 bp, Rattus norvegicus
cctccttgtctatctgtataaccag

SEQ ID NO: 253198 - DNA, 25 bp, Rattus norvegicus
cctccttgtggcacaagatgttgct

SEQ ID NO: 253199 - DNA, 25 bp, Rattus norvegicus
cctccttgtggctcaagatgttgct

SEQ ID NO: 253200 - DNA, 25 bp, Rattus norvegicus
cctcctttagtgagcatatgacctt

SEQ ID NO: 253201 - DNA, 25 bp, Rattus norvegicus
cctcctttagtgtgcatatgacctt

SEQ ID NO: 253202 - DNA, 25 bp, Rattus norvegicus
cctcctttatttcctgaatgtgcac

SEQ ID NO: 253203 - DNA, 25 bp, Rattus norvegicus
cctcctttatttccttatatgcaca

SEQ ID NO: 253204 - DNA, 25 bp, Rattus norvegicus
cctcctttatttgctgaatgtgcac

SEQ ID NO: 253205 - DNA, 25 bp, Rattus norvegicus
cctcctttatttgcttatatgcaca

SEQ ID NO: 253206 - DNA, 25 bp, Rattus norvegicus
cctcctttcaagagttcagttctca

SEQ ID NO: 253207 - DNA, 25 bp, Rattus norvegicus
cctcctttcaagtgttcagttctca

SEQ ID NO: 253208 - DNA, 25 bp, Rattus norvegicus
cctcctttctatctttgttttcatt

SEQ ID NO: 253209 - DNA, 25 bp, Rattus norvegicus
cctcctttctatgtttgttttcatt

SEQ ID NO: 253210 - DNA, 25 bp, Rattus norvegicus
cctcctttgggacattctatatcac

SEQ ID NO: 253211 - DNA, 25 bp, Rattus norvegicus
cctcctttgggagattctatatcac

SEQ ID NO: 253212 - DNA, 25 bp, Rattus norvegicus
cctcctttggttccttggaaagcat

SEQ ID NO: 253213 - DNA, 25 bp, Rattus norvegicus
cctcctttggttgcttggaaagcat

SEQ ID NO: 253214 - DNA, 25 bp, Rattus norvegicus
cctccttttaacctcagctgttgag

SEQ ID NO: 253215 - DNA, 25 bp, Rattus norvegicus
cctccttttaacgtcagctgttgag

SEQ ID NO: 253216 - DNA, 25 bp, Rattus norvegicus
cctccttttcttaggtgtattgtga

SEQ ID NO: 253217 - DNA, 25 bp, Rattus norvegicus
cctccttttctttggtgtattgtga

SEQ ID NO: 253218 - DNA, 25 bp, Rattus norvegicus
cctcgaatgacacccactgatgata

SEQ ID NO: 253219 - DNA, 25 bp, Rattus norvegicus
cctcgaatgacagccactgatgata

SEQ ID NO: 253220 - DNA, 25 bp, Rattus norvegicus
cctcgacctgctctattctataagc

SEQ ID NO: 253221 - DNA, 25 bp, Rattus norvegicus
cctcgacctgctgtattctataagc

SEQ ID NO: 253222 - DNA, 25 bp, Rattus norvegicus
cctcgagagaccacgtgacccagag

SEQ ID NO: 253223 - DNA, 25 bp, Rattus norvegicus
cctcgagagacctcgtgacccagag

SEQ ID NO: 253224 - DNA, 25 bp, Rattus norvegicus
cctcgagagactatccacacaggaa

SEQ ID NO: 253225 - DNA, 25 bp, Rattus norvegicus
cctcgagagactttccacacaggaa

SEQ ID NO: 253226 - DNA, 25 bp, Rattus norvegicus
cctcgagccatgactgtgctatgaa

SEQ ID NO: 253227 - DNA, 25 bp, Rattus norvegicus
cctcgagccatgtctgtgctatgaa

SEQ ID NO: 253228 - DNA, 25 bp, Rattus norvegicus
cctcgagtctccctgaagctgaaaa

SEQ ID NO: 253229 - DNA, 25 bp, Rattus norvegicus
cctcgagtctccgtgaagctgaaaa

SEQ ID NO: 253230 - DNA, 25 bp, Rattus norvegicus
cctcgagtgcagctgtcctgggtga

SEQ ID NO: 253231 - DNA, 25 bp, Rattus norvegicus
cctcgagtgcaggtgtcctgggtga

SEQ ID NO: 253232 - DNA, 25 bp, Rattus norvegicus
cctcgatgctctatcttaacttata

SEQ ID NO: 253233 - DNA, 25 bp, Rattus norvegicus
cctcgatgctctttcttaacttata

SEQ ID NO: 253234 - DNA, 25 bp, Rattus norvegicus
cctcgcacctttagttttcacataa

SEQ ID NO: 253235 - DNA, 25 bp, Rattus norvegicus
cctcgcaccttttgttttcacataa

SEQ ID NO: 253236 - DNA, 25 bp, Rattus norvegicus
cctcgcacttgaactgactcatttg

SEQ ID NO: 253237 - DNA, 25 bp, Rattus norvegicus
cctcgcacttgatctgactcatttg

SEQ ID NO: 253238 - DNA, 25 bp, Rattus norvegicus
cctcgcagagctcctgaggtgagat

SEQ ID NO: 253239 - DNA, 25 bp, Rattus norvegicus
cctcgcagagctgctgaggtgagat

SEQ ID NO: 253240 - DNA, 25 bp, Rattus norvegicus
cctcgccattgcactgcggtctgag

SEQ ID NO: 253241 - DNA, 25 bp, Rattus norvegicus
cctcgccattgctctgcggtctgag

SEQ ID NO: 253242 - DNA, 25 bp, Rattus norvegicus
cctcgccctttgagaagccgtaaga

SEQ ID NO: 253243 - DNA, 25 bp, Rattus norvegicus
cctcgccctttgtgaagccgtaaga

SEQ ID NO: 253244 - DNA, 25 bp, Rattus norvegicus
cctcgcgagaagacggttctggtcg

SEQ ID NO: 253245 - DNA, 25 bp, Rattus norvegicus
cctcgcgagaagtcggttctggtcg

SEQ ID NO: 253246 - DNA, 25 bp, Rattus norvegicus
cctcgctgcgcacgcaaacaggaag

SEQ ID NO: 253247 - DNA, 25 bp, Rattus norvegicus
cctcgctgcgcaggcaaacaggaag

SEQ ID NO: 253248 - DNA, 25 bp, Rattus norvegicus
cctcgctgctagacctaaggatgtt

SEQ ID NO: 253249 - DNA, 25 bp, Rattus norvegicus
cctcgctgctagtcctaaggatgtt

SEQ ID NO: 253250 - DNA, 25 bp, Rattus norvegicus
cctcgctgctttagctcaagattat

SEQ ID NO: 253251 - DNA, 25 bp, Rattus norvegicus
cctcgctgcttttgctcaagattat

SEQ ID NO: 253252 - DNA, 25 bp, Rattus norvegicus
cctcgctttctgagtgggtgctgga

SEQ ID NO: 253253 - DNA, 25 bp, Rattus norvegicus
cctcgctttctgtgtgggtgctgga

SEQ ID NO: 253254 - DNA, 25 bp, Rattus norvegicus
cctcggacgacgatgcggacgacgc

SEQ ID NO: 253255 - DNA, 25 bp, Rattus norvegicus
cctcggacgacgttgcggacgacgc

SEQ ID NO: 253256 - DNA, 25 bp, Rattus norvegicus
cctcggagagtccttttctgtgaga

SEQ ID NO: 253257 - DNA, 25 bp, Rattus norvegicus
cctcggagagtcgttttctgtgaga

SEQ ID NO: 253258 - DNA, 25 bp, Rattus norvegicus
cctcggatcctgactactttaaaca

SEQ ID NO: 253259 - DNA, 25 bp, Rattus norvegicus
cctcggatcctgtctactttaaaca

SEQ ID NO: 253260 - DNA, 25 bp, Rattus norvegicus
cctcggatccttcggccagtgaaga

SEQ ID NO: 253261 - DNA, 25 bp, Rattus norvegicus
cctcggatccttgggccagtgaaga

SEQ ID NO: 253262 - DNA, 25 bp, Rattus norvegicus
cctcggcctgcaaagctagtaattt

SEQ ID NO: 253263 - DNA, 25 bp, Rattus norvegicus
cctcggcctgcatagctagtaattt

SEQ ID NO: 253264 - DNA, 25 bp, Rattus norvegicus
cctcggctgagtctccaagtgatga

SEQ ID NO: 253265 - DNA, 25 bp, Rattus norvegicus
cctcggctgagtgtccaagtgatga

SEQ ID NO: 253266 - DNA, 25 bp, Rattus norvegicus
cctcggctgtaaaacgcttgtggaa

SEQ ID NO: 253267 - DNA, 25 bp, Rattus norvegicus
cctcggctgtaatacgcttgtggaa

SEQ ID NO: 253268 - DNA, 25 bp, Rattus norvegicus
cctcgggactatctccaaggtgaat

SEQ ID NO: 253269 - DNA, 25 bp, Rattus norvegicus
cctcgggactatgtccaaggtgaat

SEQ ID NO: 253270 - DNA, 25 bp, Rattus norvegicus
cctcgggactgcacataggtctaaa

SEQ ID NO: 253271 - DNA, 25 bp, Rattus norvegicus
cctcgggactgctcataggtctaaa

SEQ ID NO: 253272 - DNA, 25 bp, Rattus norvegicus
cctcgggcttataccaactgaatgt

SEQ ID NO: 253273 - DNA, 25 bp, Rattus norvegicus
cctcgggcttattccaactgaatgt

SEQ ID NO: 253274 - DNA, 25 bp, Rattus norvegicus
cctcgggtactcaaaattcctgaat

SEQ ID NO: 253275 - DNA, 25 bp, Rattus norvegicus
cctcgggtactctaaattcctgaat

SEQ ID NO: 253276 - DNA, 25 bp, Rattus norvegicus
cctcgggtagtccaactgccaaaga

SEQ ID NO: 253277 - DNA, 25 bp, Rattus norvegicus
cctcgggtagtcgaactgccaaaga

SEQ ID NO: 253278 - DNA, 25 bp, Rattus norvegicus
cctcgggtctatacagtttcactta

SEQ ID NO: 253279 - DNA, 25 bp, Rattus norvegicus
cctcgggtctattcagtttcactta

SEQ ID NO: 253280 - DNA, 25 bp, Rattus norvegicus
cctcggttctcgaggacgctcgcgg

SEQ ID NO: 253281 - DNA, 25 bp, Rattus norvegicus
cctcggttctcgtggacgctcgcgg

SEQ ID NO: 253282 - DNA, 25 bp, Rattus norvegicus
cctcgtccaagaagtccagtccagt

SEQ ID NO: 253283 - DNA, 25 bp, Rattus norvegicus
cctcgtccaagatgtccagtccagt

SEQ ID NO: 253284 - DNA, 25 bp, Rattus norvegicus
cctcgtctcatgaacatcgtgacat

SEQ ID NO: 253285 - DNA, 25 bp, Rattus norvegicus
cctcgtctcatgtacatcgtgacat

SEQ ID NO: 253286 - DNA, 25 bp, Rattus norvegicus
cctcgtcttaggatattctgtgggt

SEQ ID NO: 253287 - DNA, 25 bp, Rattus norvegicus
cctcgtcttaggttattctgtgggt

SEQ ID NO: 253288 - DNA, 25 bp, Rattus norvegicus
cctcgtgatacgctgcagggccaaa

SEQ ID NO: 253289 - DNA, 25 bp, Rattus norvegicus
cctcgtgatacggtgcagggccaaa

SEQ ID NO: 253290 - DNA, 25 bp, Rattus norvegicus
cctcgtgcctacacagcaaatgaac

SEQ ID NO: 253291 - DNA, 25 bp, Rattus norvegicus
cctcgtgcctactcagcaaatgaac

SEQ ID NO: 253292 - DNA, 25 bp, Rattus norvegicus
cctcgtgggaccattgggatggatt

SEQ ID NO: 253293 - DNA, 25 bp, Rattus norvegicus
cctcgtgggacctttgggatggatt

SEQ ID NO: 253294 - DNA, 25 bp, Rattus norvegicus
cctcgtggtctaaacttgctacagt

SEQ ID NO: 253295 - DNA, 25 bp, Rattus norvegicus
cctcgtggtctatacttgctacagt

SEQ ID NO: 253296 - DNA, 25 bp, Rattus norvegicus
cctcgtggttggagtatggagccca

SEQ ID NO: 253297 - DNA, 25 bp, Rattus norvegicus
cctcgtggttggtgtatggagccca

SEQ ID NO: 253298 - DNA, 25 bp, Rattus norvegicus
cctcgtgtaaacacacaaccatcaa

SEQ ID NO: 253299 - DNA, 25 bp, Rattus norvegicus
cctcgtgtaaactcacaaccatcaa

SEQ ID NO: 253300 - DNA, 25 bp, Rattus norvegicus
cctcgtgtctgtacatagtggccag

SEQ ID NO: 253301 - DNA, 25 bp, Rattus norvegicus
cctcgtgtctgttcatagtggccag

SEQ ID NO: 253302 - DNA, 25 bp, Rattus norvegicus
cctcgtgttcctcaattatttccca

SEQ ID NO: 253303 - DNA, 25 bp, Rattus norvegicus
cctcgtgttcctgaattatttccca

SEQ ID NO: 253304 - DNA, 25 bp, Rattus norvegicus
cctcgttcatataccaggtgtagct

SEQ ID NO: 253305 - DNA, 25 bp, Rattus norvegicus
cctcgttcatattccaggtgtagct

SEQ ID NO: 253306 - DNA, 25 bp, Rattus norvegicus
cctcgttcctctatcagggattgaa

SEQ ID NO: 253307 - DNA, 25 bp, Rattus norvegicus
cctcgttcctctttcagggattgaa

SEQ ID NO: 253308 - DNA, 25 bp, Rattus norvegicus
cctcgttgacagcacagttgaccta

SEQ ID NO: 253309 - DNA, 25 bp, Rattus norvegicus
cctcgttgacaggacagttgaccta

SEQ ID NO: 253310 - DNA, 25 bp, Rattus norvegicus
cctcgttgcccacatgtgagtgcaa

SEQ ID NO: 253311 - DNA, 25 bp, Rattus norvegicus
cctcgttgcccagatgtgagtgcaa

SEQ ID NO: 253312 - DNA, 25 bp, Rattus norvegicus
cctcgtttcctcaagttgtcatttg

SEQ ID NO: 253313 - DNA, 25 bp, Rattus norvegicus
cctcgtttcctctagttgtcatttg

SEQ ID NO: 253314 - DNA, 25 bp, Rattus norvegicus
cctcgtttctatacttctcagatga

SEQ ID NO: 253315 - DNA, 25 bp, Rattus norvegicus
cctcgtttctattcttctcagatga

SEQ ID NO: 253316 - DNA, 25 bp, Rattus norvegicus
cctcgtttgataaatgggtctgctt

SEQ ID NO: 253317 - DNA, 25 bp, Rattus norvegicus
cctcgtttgatatatgggtctgctt

SEQ ID NO: 253318 - DNA, 25 bp, Rattus norvegicus
cctctaaaccatccaatctgcattt

SEQ ID NO: 253319 - DNA, 25 bp, Rattus norvegicus
cctctaaaccatgcaatctgcattt

SEQ ID NO: 253320 - DNA, 25 bp, Rattus norvegicus
cctctaactactcaacctgggtggg

SEQ ID NO: 253321 - DNA, 25 bp, Rattus norvegicus
cctctaactactgaacctgggtggg

SEQ ID NO: 253322 - DNA, 25 bp, Rattus norvegicus
cctctaagacttcgctgctgtttta

SEQ ID NO: 253323 - DNA, 25 bp, Rattus norvegicus
cctctaagacttggctgctgtttta

SEQ ID NO: 253324 - DNA, 25 bp, Rattus norvegicus
cctctaagcttcaacagtctgtctg

SEQ ID NO: 253325 - DNA, 25 bp, Rattus norvegicus
cctctaagcttctacagtctgtctg

SEQ ID NO: 253326 - DNA, 25 bp, Rattus norvegicus
cctctaatatcaccccttgtctgaa

SEQ ID NO: 253327 - DNA, 25 bp, Rattus norvegicus
cctctaatatcagcccttgtctgaa

SEQ ID NO: 253328 - DNA, 25 bp, Rattus norvegicus
cctctaattgggaactcatcactga

SEQ ID NO: 253329 - DNA, 25 bp, Rattus norvegicus
cctctaattgggtactcatcactga

SEQ ID NO: 253330 - DNA, 25 bp, Rattus norvegicus
cctctacatgctatattccactata

SEQ ID NO: 253331 - DNA, 25 bp, Rattus norvegicus
cctctacatgctttattccactata

SEQ ID NO: 253332 - DNA, 25 bp, Rattus norvegicus
cctctactaatgagacagggtctga

SEQ ID NO: 253333 - DNA, 25 bp, Rattus norvegicus
cctctactaatgtgacagggtctga

SEQ ID NO: 253334 - DNA, 25 bp, Rattus norvegicus
cctctagctgagatgtttgtactac

SEQ ID NO: 253335 - DNA, 25 bp, Rattus norvegicus
cctctagctgagttgtttgtactac

SEQ ID NO: 253336 - DNA, 25 bp, Rattus norvegicus
cctctagggcctaaccaatacagta

SEQ ID NO: 253337 - DNA, 25 bp, Rattus norvegicus
cctctagggccttaccaatacagta

SEQ ID NO: 253338 - DNA, 25 bp, Rattus norvegicus
cctctatggaggaggctgagtgcat

SEQ ID NO: 253339 - DNA, 25 bp, Rattus norvegicus
cctctatggaggtggctgagtgcat

SEQ ID NO: 253340 - DNA, 25 bp, Rattus norvegicus
cctctattaagaaggtgcacacctt

SEQ ID NO: 253341 - DNA, 25 bp, Rattus norvegicus
cctctattaagatggtgcacacctt

SEQ ID NO: 253342 - DNA, 25 bp, Rattus norvegicus
cctctcaaaagcaaaggatatagaa

SEQ ID NO: 253343 - DNA, 25 bp, Rattus norvegicus
cctctcaaaagctaaggatatagaa

SEQ ID NO: 253344 - DNA, 25 bp, Rattus norvegicus
cctctcaacaacacttcctatttat

SEQ ID NO: 253345 - DNA, 25 bp, Rattus norvegicus
cctctcaacaactcttcctatttat

SEQ ID NO: 253346 - DNA, 25 bp, Rattus norvegicus
cctctcaagtgtctgggatccatgt

SEQ ID NO: 253347 - DNA, 25 bp, Rattus norvegicus
cctctcaagtgtgtgggatccatgt

SEQ ID NO: 253348 - DNA, 25 bp, Rattus norvegicus
cctctcacctgccatatgacaggat

SEQ ID NO: 253349 - DNA, 25 bp, Rattus norvegicus
cctctcacctgcgatatgacaggat

SEQ ID NO: 253350 - DNA, 25 bp, Rattus norvegicus
cctctcacctgtatactgactgtag

SEQ ID NO: 253351 - DNA, 25 bp, Rattus norvegicus
cctctcacctgtttactgactgtag

SEQ ID NO: 253352 - DNA, 25 bp, Rattus norvegicus
cctctcataactcgtcaacgactgt

SEQ ID NO: 253353 - DNA, 25 bp, Rattus norvegicus
cctctcataactggtcaacgactgt

SEQ ID NO: 253354 - DNA, 25 bp, Rattus norvegicus
cctctcatagctccagttacatcta

SEQ ID NO: 253355 - DNA, 25 bp, Rattus norvegicus
cctctcatagctgcagttacatcta

SEQ ID NO: 253356 - DNA, 25 bp, Rattus norvegicus
cctctcatatcaaccggtcatcaag

SEQ ID NO: 253357 - DNA, 25 bp, Rattus norvegicus
cctctcatatcatccggtcatcaag

SEQ ID NO: 253358 - DNA, 25 bp, Rattus norvegicus
cctctcatcttcaggtattacgtta

SEQ ID NO: 253359 - DNA, 25 bp, Rattus norvegicus
cctctcatcttctggtattacgtta

SEQ ID NO: 253360 - DNA, 25 bp, Rattus norvegicus
cctctcattaggagatcctccagct

SEQ ID NO: 253361 - DNA, 25 bp, Rattus norvegicus
cctctcattaggtgatcctccagct

SEQ ID NO: 253362 - DNA, 25 bp, Rattus norvegicus
cctctcatttctacttgacagtatc

SEQ ID NO: 253363 - DNA, 25 bp, Rattus norvegicus
cctctcatttcttcttgacagtatc

SEQ ID NO: 253364 - DNA, 25 bp, Rattus norvegicus
cctctccacgtgcaaatgcttttat

SEQ ID NO: 253365 - DNA, 25 bp, Rattus norvegicus
cctctccacgtggaaatgcttttat

SEQ ID NO: 253366 - DNA, 25 bp, Rattus norvegicus
cctctccagcttctttgtttgggaa

SEQ ID NO: 253367 - DNA, 25 bp, Rattus norvegicus
cctctccagcttgtttgtttgggaa

SEQ ID NO: 253368 - DNA, 25 bp, Rattus norvegicus
cctctccattaccagtgaacagttg

SEQ ID NO: 253369 - DNA, 25 bp, Rattus norvegicus
cctctccattacgagtgaacagttg

SEQ ID NO: 253370 - DNA, 25 bp, Rattus norvegicus
cctctcccagttcctttgtgcctca

SEQ ID NO: 253371 - DNA, 25 bp, Rattus norvegicus
cctctcccagttgctttgtgcctca

SEQ ID NO: 253372 - DNA, 25 bp, Rattus norvegicus
cctctcccctgcagtaatgtatatt

SEQ ID NO: 253373 - DNA, 25 bp, Rattus norvegicus
cctctcccctgctgtaatgtatatt

SEQ ID NO: 253374 - DNA, 25 bp, Rattus norvegicus
cctctccctatgatgttgctgtaaa

SEQ ID NO: 253375 - DNA, 25 bp, Rattus norvegicus
cctctccctatgttgttgctgtaaa

SEQ ID NO: 253376 - DNA, 25 bp, Rattus norvegicus
cctctccctattaaattctcatgtg

SEQ ID NO: 253377 - DNA, 25 bp, Rattus norvegicus
cctctccctatttaattctcatgtg

SEQ ID NO: 253378 - DNA, 25 bp, Rattus norvegicus
cctctccctcagaatgtattacaag

SEQ ID NO: 253379 - DNA, 25 bp, Rattus norvegicus
cctctccctcagtatgtattacaag

SEQ ID NO: 253380 - DNA, 25 bp, Rattus norvegicus
cctctccgtttgctgctagcagaaa

SEQ ID NO: 253381 - DNA, 25 bp, Rattus norvegicus
cctctccgtttggtgctagcagaaa

SEQ ID NO: 253382 - DNA, 25 bp, Rattus norvegicus
cctctcctcactatcagaaatgcat

SEQ ID NO: 253383 - DNA, 25 bp, Rattus norvegicus
cctctcctcactttcagaaatgcat

SEQ ID NO: 253384 - DNA, 25 bp, Rattus norvegicus
cctctcctcagtattctgtatgtac

SEQ ID NO: 253385 - DNA, 25 bp, Rattus norvegicus
cctctcctcagttttctgtatgtac

SEQ ID NO: 253386 - DNA, 25 bp, Rattus norvegicus
cctctccttgttctggtaatgtata

SEQ ID NO: 253387 - DNA, 25 bp, Rattus norvegicus
cctctccttgttgtggtaatgtata

SEQ ID NO: 253388 - DNA, 25 bp, Rattus norvegicus
cctctcggccagatgtgatgtttat

SEQ ID NO: 253389 - DNA, 25 bp, Rattus norvegicus
cctctcggccagttgtgatgtttat

SEQ ID NO: 253390 - DNA, 25 bp, Rattus norvegicus
cctctctatggaatgtggtatatgc

SEQ ID NO: 253391 - DNA, 25 bp, Rattus norvegicus
cctctctatggattgtggtatatgc

SEQ ID NO: 253392 - DNA, 25 bp, Rattus norvegicus
cctctctcaaacacatgactcagat

SEQ ID NO: 253393 - DNA, 25 bp, Rattus norvegicus
cctctctcaaactcatgactcagat

SEQ ID NO: 253394 - DNA, 25 bp, Rattus norvegicus
cctctctcacacaaaccaataataa

SEQ ID NO: 253395 - DNA, 25 bp, Rattus norvegicus
cctctctcacactaaccaataataa

SEQ ID NO: 253396 - DNA, 25 bp, Rattus norvegicus
cctctctcaggtaggtcagtgggct

SEQ ID NO: 253397 - DNA, 25 bp, Rattus norvegicus
cctctctcaggttggtcagtgggct

SEQ ID NO: 253398 - DNA, 25 bp, Rattus norvegicus
cctctctcctgtatcttggctgaag

SEQ ID NO: 253399 - DNA, 25 bp, Rattus norvegicus
cctctctcctgtttcttggctgaag

SEQ ID NO: 253400 - DNA, 25 bp, Rattus norvegicus
cctctctcgttcaatgatgggtata

SEQ ID NO: 253401 - DNA, 25 bp, Rattus norvegicus
cctctctcgttctatgatgggtata

SEQ ID NO: 253402 - DNA, 25 bp, Rattus norvegicus
cctctctctcttatgttgctttagt

SEQ ID NO: 253403 - DNA, 25 bp, Rattus norvegicus
cctctctctcttttgttgctttagt

SEQ ID NO: 253404 - DNA, 25 bp, Rattus norvegicus
cctctctgacctatggtgtggcaaa

SEQ ID NO: 253405 - DNA, 25 bp, Rattus norvegicus
cctctctgacctttggtgtggcaaa

SEQ ID NO: 253406 - DNA, 25 bp, Rattus norvegicus
cctctctgacttcgctgttgttcta

SEQ ID NO: 253407 - DNA, 25 bp, Rattus norvegicus
cctctctgacttctgtacgatcaaa

SEQ ID NO: 253408 - DNA, 25 bp, Rattus norvegicus
cctctctgacttggctgttgttcta

SEQ ID NO: 253409 - DNA, 25 bp, Rattus norvegicus
cctctctgacttgtgtacgatcaaa

SEQ ID NO: 253410 - DNA, 25 bp, Rattus norvegicus
cctctctgagcacccagtgcagtga

SEQ ID NO: 253411 - DNA, 25 bp, Rattus norvegicus
cctctctgagcagccagtgcagtga

SEQ ID NO: 253412 - DNA, 25 bp, Rattus norvegicus
cctctctgccagctcgttggaaaca

SEQ ID NO: 253413 - DNA, 25 bp, Rattus norvegicus
cctctctgccaggtcgttggaaaca

SEQ ID NO: 253414 - DNA, 25 bp, Rattus norvegicus
cctctctgcttgctcgatagtaaat

SEQ ID NO: 253415 - DNA, 25 bp, Rattus norvegicus
cctctctgcttggtcgatagtaaat

SEQ ID NO: 253416 - DNA, 25 bp, Rattus norvegicus
cctctctggccactatggaattcta

SEQ ID NO: 253417 - DNA, 25 bp, Rattus norvegicus
cctctctggccagtatggaattcta

SEQ ID NO: 253418 - DNA, 25 bp, Rattus norvegicus
cctctctgggctcggtcatctgaaa

SEQ ID NO: 253419 - DNA, 25 bp, Rattus norvegicus
cctctctgggctgggtcatctgaaa

SEQ ID NO: 253420 - DNA, 25 bp, Rattus norvegicus
cctctctgggtgagatggtgcttag

SEQ ID NO: 253421 - DNA, 25 bp, Rattus norvegicus
cctctctgggtgtgatggtgcttag

SEQ ID NO: 253422 - DNA, 25 bp, Rattus norvegicus
cctctctgtttaccttccaacaaat

SEQ ID NO: 253423 - DNA, 25 bp, Rattus norvegicus
cctctctgtttagcttccaacaaat

SEQ ID NO: 253424 - DNA, 25 bp, Rattus norvegicus
cctctcttcccaaggttcatattaa

SEQ ID NO: 253425 - DNA, 25 bp, Rattus norvegicus
cctctcttcccatggttcatattaa

SEQ ID NO: 253426 - DNA, 25 bp, Rattus norvegicus
cctctcttcctaaatgcatgttcaa

SEQ ID NO: 253427 - DNA, 25 bp, Rattus norvegicus
cctctcttcctaatgctgtatgcta

SEQ ID NO: 253428 - DNA, 25 bp, Rattus norvegicus
cctctcttcctatatgcatgttcaa

SEQ ID NO: 253429 - DNA, 25 bp, Rattus norvegicus
cctctcttcctattgctgtatgcta

SEQ ID NO: 253430 - DNA, 25 bp, Rattus norvegicus
cctctcttgtttagtcctctagaat

SEQ ID NO: 253431 - DNA, 25 bp, Rattus norvegicus
cctctcttgttttgtcctctagaat

SEQ ID NO: 253432 - DNA, 25 bp, Rattus norvegicus
cctctgaacctcaggccgactggaa

SEQ ID NO: 253433 - DNA, 25 bp, Rattus norvegicus
cctctgaacctctggccgactggaa

SEQ ID NO: 253434 - DNA, 25 bp, Rattus norvegicus
cctctgaatgacctcttccttaaag

SEQ ID NO: 253435 - DNA, 25 bp, Rattus norvegicus
cctctgaatgacgtcttccttaaag

SEQ ID NO: 253436 - DNA, 25 bp, Rattus norvegicus
cctctgaattctccaggatctgctt

SEQ ID NO: 253437 - DNA, 25 bp, Rattus norvegicus
cctctgaattctgcaggatctgctt

SEQ ID NO: 253438 - DNA, 25 bp, Rattus norvegicus
cctctgacctgccttgaagtggaat

SEQ ID NO: 253439 - DNA, 25 bp, Rattus norvegicus
cctctgacctgcgttgaagtggaat

SEQ ID NO: 253440 - DNA, 25 bp, Rattus norvegicus
cctctgaccttcacaatgtacattg

SEQ ID NO: 253441 - DNA, 25 bp, Rattus norvegicus
cctctgaccttctcaatgtacattg

SEQ ID NO: 253442 - DNA, 25 bp, Rattus norvegicus
cctctgacgtcaactcagggattta

SEQ ID NO: 253443 - DNA, 25 bp, Rattus norvegicus
cctctgacgtcatctcagggattta

SEQ ID NO: 253444 - DNA, 25 bp, Rattus norvegicus
cctctgactctgagcgggtgagaat

SEQ ID NO: 253445 - DNA, 25 bp, Rattus norvegicus
cctctgactctgtgcgggtgagaat

SEQ ID NO: 253446 - DNA, 25 bp, Rattus norvegicus
cctctgagcccaagggttgatgcta

SEQ ID NO: 253447 - DNA, 25 bp, Rattus norvegicus
cctctgagcccatgggttgatgcta

SEQ ID NO: 253448 - DNA, 25 bp, Rattus norvegicus
cctctgagctgaccctgaagtagaa

SEQ ID NO: 253449 - DNA, 25 bp, Rattus norvegicus
cctctgagctgagcctgaagtagaa

SEQ ID NO: 253450 - DNA, 25 bp, Rattus norvegicus
cctctgagttctctctgcttagaaa

SEQ ID NO: 253451 - DNA, 25 bp, Rattus norvegicus
cctctgagttctgtctgcttagaaa

SEQ ID NO: 253452 - DNA, 25 bp, Rattus norvegicus
cctctgatgggtcggcgtctttgat

SEQ ID NO: 253453 - DNA, 25 bp, Rattus norvegicus
cctctgatgggtgggcgtctttgat

SEQ ID NO: 253454 - DNA, 25 bp, Rattus norvegicus
cctctgcagaagcttcacagctcaa

SEQ ID NO: 253455 - DNA, 25 bp, Rattus norvegicus
cctctgcagaaggttcacagctcaa

SEQ ID NO: 253456 - DNA, 25 bp, Rattus norvegicus
cctctgcatcctatgttctgggatt

SEQ ID NO: 253457 - DNA, 25 bp, Rattus norvegicus
cctctgcatcctttgttctgggatt

SEQ ID NO: 253458 - DNA, 25 bp, Rattus norvegicus
cctctgcatgagctttggtattgaa

SEQ ID NO: 253459 - DNA, 25 bp, Rattus norvegicus
cctctgcatgaggtttggtattgaa

SEQ ID NO: 253460 - DNA, 25 bp, Rattus norvegicus
cctctgccacctccagggatagaaa

SEQ ID NO: 253461 - DNA, 25 bp, Rattus norvegicus
cctctgccacctgcagggatagaaa

SEQ ID NO: 253462 - DNA, 25 bp, Rattus norvegicus
cctctgccctagacttgttttgatc

SEQ ID NO: 253463 - DNA, 25 bp, Rattus norvegicus
cctctgccctagtcttgttttgatc

SEQ ID NO: 253464 - DNA, 25 bp, Rattus norvegicus
cctctgcctgagctatcacggctgt

SEQ ID NO: 253465 - DNA, 25 bp, Rattus norvegicus
cctctgcctgaggtatcacggctgt

SEQ ID NO: 253466 - DNA, 25 bp, Rattus norvegicus
cctctgcctgtcctgtcacatctgt

SEQ ID NO: 253467 - DNA, 25 bp, Rattus norvegicus
cctctgcctgtcgtgtcacatctgt

SEQ ID NO: 253468 - DNA, 25 bp, Rattus norvegicus
cctctgctcatcctaactgtagaat

SEQ ID NO: 253469 - DNA, 25 bp, Rattus norvegicus
cctctgctcatcgtaactgtagaat

SEQ ID NO: 253470 - DNA, 25 bp, Rattus norvegicus
cctctgctgacaccattgctgtggt

SEQ ID NO: 253471 - DNA, 25 bp, Rattus norvegicus
cctctgctgacagcattgctgtggt

SEQ ID NO: 253472 - DNA, 25 bp, Rattus norvegicus
cctctgcttcttatttcaactgcaa

SEQ ID NO: 253473 - DNA, 25 bp, Rattus norvegicus
cctctgcttcttttttcaactgcaa

SEQ ID NO: 253474 - DNA, 25 bp, Rattus norvegicus
cctctgcttgcgatcatggtgtatg

SEQ ID NO: 253475 - DNA, 25 bp, Rattus norvegicus
cctctgcttgcgttcatggtgtatg

SEQ ID NO: 253476 - DNA, 25 bp, Rattus norvegicus
cctctggaaaaacagttcatgctct

SEQ ID NO: 253477 - DNA, 25 bp, Rattus norvegicus
cctctggaaaaagagttcatgctct

SEQ ID NO: 253478 - DNA, 25 bp, Rattus norvegicus
cctctggaaagcagtggcgtgatgg

SEQ ID NO: 253479 - DNA, 25 bp, Rattus norvegicus
cctctggaaagctgtggcgtgatgg

SEQ ID NO: 253480 - DNA, 25 bp, Rattus norvegicus
cctctggaagatatctggagtctga

SEQ ID NO: 253481 - DNA, 25 bp, Rattus norvegicus
cctctggaagatttctggagtctga

SEQ ID NO: 253482 - DNA, 25 bp, Rattus norvegicus
cctctggaaggcacaactggtaaaa

SEQ ID NO: 253483 - DNA, 25 bp, Rattus norvegicus
cctctggaaggctcaactggtaaaa

SEQ ID NO: 253484 - DNA, 25 bp, Rattus norvegicus
cctctggaagtgcagctgttctctg

SEQ ID NO: 253485 - DNA, 25 bp, Rattus norvegicus
cctctggaagtggagctgttctctg

SEQ ID NO: 253486 - DNA, 25 bp, Rattus norvegicus
cctctggaccgactcactgaatttg

SEQ ID NO: 253487 - DNA, 25 bp, Rattus norvegicus
cctctggaccgagtcactgaatttg

SEQ ID NO: 253488 - DNA, 25 bp, Rattus norvegicus
cctctggagactcaactgaaccgtg

SEQ ID NO: 253489 - DNA, 25 bp, Rattus norvegicus
cctctggagactgaactgaaccgtg

SEQ ID NO: 253490 - DNA, 25 bp, Rattus norvegicus
cctctggagcttctacgttcaagaa

SEQ ID NO: 253491 - DNA, 25 bp, Rattus norvegicus
cctctggagcttgtacgttcaagaa

SEQ ID NO: 253492 - DNA, 25 bp, Rattus norvegicus
cctctggaggttcgtctgttttgaa

SEQ ID NO: 253493 - DNA, 25 bp, Rattus norvegicus
cctctggaggttcttggcacattta

SEQ ID NO: 253494 - DNA, 25 bp, Rattus norvegicus
cctctggaggttggtctgttttgaa

SEQ ID NO: 253495 - DNA, 25 bp, Rattus norvegicus
cctctggaggttgttggcacattta

SEQ ID NO: 253496 - DNA, 25 bp, Rattus norvegicus
cctctggcaaatctgaagtcctata

SEQ ID NO: 253497 - DNA, 25 bp, Rattus norvegicus
cctctggcaaatgtgaagtcctata

SEQ ID NO: 253498 - DNA, 25 bp, Rattus norvegicus
cctctggcaaggatacggactccat

SEQ ID NO: 253499 - DNA, 25 bp, Rattus norvegicus
cctctggcaaggttacggactccat

SEQ ID NO: 253500 - DNA, 25 bp, Rattus norvegicus
cctctggcacatccggcacagatgg

SEQ ID NO: 253501 - DNA, 25 bp, Rattus norvegicus
cctctggcacatgcggcacagatgg

SEQ ID NO: 253502 - DNA, 25 bp, Rattus norvegicus
cctctggcagcgaaaagaccccgga

SEQ ID NO: 253503 - DNA, 25 bp, Rattus norvegicus
cctctggcagcgtaaagaccccgga

SEQ ID NO: 253504 - DNA, 25 bp, Rattus norvegicus
cctctggcatggagtctggtgttga

SEQ ID NO: 253505 - DNA, 25 bp, Rattus norvegicus
cctctggcatggtgtctggtgttga

SEQ ID NO: 253506 - DNA, 25 bp, Rattus norvegicus
cctctggccgacactgagaagttga

SEQ ID NO: 253507 - DNA, 25 bp, Rattus norvegicus
cctctggccgactctgagaagttga

SEQ ID NO: 253508 - DNA, 25 bp, Rattus norvegicus
cctctggcctgtagttcttgtaaag

SEQ ID NO: 253509 - DNA, 25 bp, Rattus norvegicus
cctctggcctgttgttcttgtaaag

SEQ ID NO: 253510 - DNA, 25 bp, Rattus norvegicus
cctctggctcagagtttgtggccaa

SEQ ID NO: 253511 - DNA, 25 bp, Rattus norvegicus
cctctggctcagtgtttgtggccaa

SEQ ID NO: 253512 - DNA, 25 bp, Rattus norvegicus
cctctggctggaatatagacatgac

SEQ ID NO: 253513 - DNA, 25 bp, Rattus norvegicus
cctctggctggattatagacatgac

SEQ ID NO: 253514 - DNA, 25 bp, Rattus norvegicus
cctctggctgtgctctctcacatat

SEQ ID NO: 253515 - DNA, 25 bp, Rattus norvegicus
cctctggctgtggtctctcacatat

SEQ ID NO: 253516 - DNA, 25 bp, Rattus norvegicus
cctctgggaggaagtgcgaccctgt

SEQ ID NO: 253517 - DNA, 25 bp, Rattus norvegicus
cctctgggaggatgtgcgaccctgt

SEQ ID NO: 253518 - DNA, 25 bp, Rattus norvegicus
cctctgggattgaggtgcttgacta

SEQ ID NO: 253519 - DNA, 25 bp, Rattus norvegicus
cctctgggattgtggtgcttgacta

SEQ ID NO: 253520 - DNA, 25 bp, Rattus norvegicus
cctctgggcctaaatgttctgcatt

SEQ ID NO: 253521 - DNA, 25 bp, Rattus norvegicus
cctctgggcctatatgttctgcatt

SEQ ID NO: 253522 - DNA, 25 bp, Rattus norvegicus
cctctgggtttcagtttcctcatat

SEQ ID NO: 253523 - DNA, 25 bp, Rattus norvegicus
cctctgggtttctgtttcctcatat

SEQ ID NO: 253524 - DNA, 25 bp, Rattus norvegicus
cctctggtattcagggtctgacaca

SEQ ID NO: 253525 - DNA, 25 bp, Rattus norvegicus
cctctggtattctgggtctgacaca

SEQ ID NO: 253526 - DNA, 25 bp, Rattus norvegicus
cctctggtatttcctctgggtaggg

SEQ ID NO: 253527 - DNA, 25 bp, Rattus norvegicus
cctctggtatttgctctgggtaggg

SEQ ID NO: 253528 - DNA, 25 bp, Rattus norvegicus
cctctggtgcccaggaagcagttgt

SEQ ID NO: 253529 - DNA, 25 bp, Rattus norvegicus
cctctggtgccctggaagcagttgt

SEQ ID NO: 253530 - DNA, 25 bp, Rattus norvegicus
cctctggttctgcttagtcctatag

SEQ ID NO: 253531 - DNA, 25 bp, Rattus norvegicus
cctctggttctggttagtcctatag

SEQ ID NO: 253532 - DNA, 25 bp, Rattus norvegicus
cctctggttgccatgcatacctgca

SEQ ID NO: 253533 - DNA, 25 bp, Rattus norvegicus
cctctggttgccttgcatacctgca

SEQ ID NO: 253534 - DNA, 25 bp, Rattus norvegicus
cctctgtaacttcggtttcaataat

SEQ ID NO: 253535 - DNA, 25 bp, Rattus norvegicus
cctctgtaacttgggtttcaataat

SEQ ID NO: 253536 - DNA, 25 bp, Rattus norvegicus
cctctgtaattcagggtacctcaca

SEQ ID NO: 253537 - DNA, 25 bp, Rattus norvegicus
cctctgtaattctgggtacctcaca

SEQ ID NO: 253538 - DNA, 25 bp, Rattus norvegicus
cctctgtactctatagcccattaaa

SEQ ID NO: 253539 - DNA, 25 bp, Rattus norvegicus
cctctgtactctttagcccattaaa

SEQ ID NO: 253540 - DNA, 25 bp, Rattus norvegicus
cctctgtcactgcttttatcattgt

SEQ ID NO: 253541 - DNA, 25 bp, Rattus norvegicus
cctctgtcactggttttatcattgt

SEQ ID NO: 253542 - DNA, 25 bp, Rattus norvegicus
cctctgtcacttccaagaccaaaaa

SEQ ID NO: 253543 - DNA, 25 bp, Rattus norvegicus
cctctgtcacttgcaagaccaaaaa

SEQ ID NO: 253544 - DNA, 25 bp, Rattus norvegicus
cctctgtcagacattcctgaacata

SEQ ID NO: 253545 - DNA, 25 bp, Rattus norvegicus
cctctgtcagactttcctgaacata

SEQ ID NO: 253546 - DNA, 25 bp, Rattus norvegicus
cctctgtcagatcgcgcgggaactg

SEQ ID NO: 253547 - DNA, 25 bp, Rattus norvegicus
cctctgtcagatggcgcgggaactg

SEQ ID NO: 253548 - DNA, 25 bp, Rattus norvegicus
cctctgtccccactgatgtagaaat

SEQ ID NO: 253549 - DNA, 25 bp, Rattus norvegicus
cctctgtccccagtgatgtagaaat

SEQ ID NO: 253550 - DNA, 25 bp, Rattus norvegicus
cctctgtctatcagcccctgaagaa

SEQ ID NO: 253551 - DNA, 25 bp, Rattus norvegicus
cctctgtctatctgcccctgaagaa

SEQ ID NO: 253552 - DNA, 25 bp, Rattus norvegicus
cctctgtctccgagaagtgctggga

SEQ ID NO: 253553 - DNA, 25 bp, Rattus norvegicus
cctctgtctccgtgaagtgctggga

SEQ ID NO: 253554 - DNA, 25 bp, Rattus norvegicus
cctctgtctgttaggttcatgtgaa

SEQ ID NO: 253555 - DNA, 25 bp, Rattus norvegicus
cctctgtctgtttggttcatgtgaa

SEQ ID NO: 253556 - DNA, 25 bp, Rattus norvegicus
cctctgtgactgaaaggctctccag

SEQ ID NO: 253557 - DNA, 25 bp, Rattus norvegicus
cctctgtgactgtaaggctctccag

SEQ ID NO: 253558 - DNA, 25 bp, Rattus norvegicus
cctctgtgctctcctcacaaaagga

SEQ ID NO: 253559 - DNA, 25 bp, Rattus norvegicus
cctctgtgctctgctcacaaaagga

SEQ ID NO: 253560 - DNA, 25 bp, Rattus norvegicus
cctctgtggaacactgtctgattga

SEQ ID NO: 253561 - DNA, 25 bp, Rattus norvegicus
cctctgtggaactctgtctgattga

SEQ ID NO: 253562 - DNA, 25 bp, Rattus norvegicus
cctctgtggaggcacttcagttaca

SEQ ID NO: 253563 - DNA, 25 bp, Rattus norvegicus
cctctgtggagggacttcagttaca

SEQ ID NO: 253564 - DNA, 25 bp, Rattus norvegicus
cctctgtggctcagagtggtactaa

SEQ ID NO: 253565 - DNA, 25 bp, Rattus norvegicus
cctctgtggctctgagtggtactaa

SEQ ID NO: 253566 - DNA, 25 bp, Rattus norvegicus
cctctgtggtggatgctgttgctaa

SEQ ID NO: 253567 - DNA, 25 bp, Rattus norvegicus
cctctgtggtggttgctgttgctaa

SEQ ID NO: 253568 - DNA, 25 bp, Rattus norvegicus
cctctgtgtggcatgggtttacgga

SEQ ID NO: 253569 - DNA, 25 bp, Rattus norvegicus
cctctgtgtggcttgggtttacgga

SEQ ID NO: 253570 - DNA, 25 bp, Rattus norvegicus
cctctgtgttagctgtgttttgcct

SEQ ID NO: 253571 - DNA, 25 bp, Rattus norvegicus
cctctgtgttaggtgtgttttgcct

SEQ ID NO: 253572 - DNA, 25 bp, Rattus norvegicus
cctctgttccacattttacttcagt

SEQ ID NO: 253573 - DNA, 25 bp, Rattus norvegicus
cctctgttccactttttacttcagt

SEQ ID NO: 253574 - DNA, 25 bp, Rattus norvegicus
cctctgttctgcagggtctgtggga

SEQ ID NO: 253575 - DNA, 25 bp, Rattus norvegicus
cctctgttctgctgggtctgtggga

SEQ ID NO: 253576 - DNA, 25 bp, Rattus norvegicus
cctctgttgacaccaggcacataag

SEQ ID NO: 253577 - DNA, 25 bp, Rattus norvegicus
cctctgttgacagcaggcacataag

SEQ ID NO: 253578 - DNA, 25 bp, Rattus norvegicus
cctctgttgcagattttgatccctt

SEQ ID NO: 253579 - DNA, 25 bp, Rattus norvegicus
cctctgttgcagtttttgatccctt

SEQ ID NO: 253580 - DNA, 25 bp, Rattus norvegicus
cctctgttgtctatgatatcctgga

SEQ ID NO: 253581 - DNA, 25 bp, Rattus norvegicus
cctctgttgtctttgatatcctgga

SEQ ID NO: 253582 - DNA, 25 bp, Rattus norvegicus
cctctgtttcagagggaggctcaga

SEQ ID NO: 253583 - DNA, 25 bp, Rattus norvegicus
cctctgtttcagtgggaggctcaga

SEQ ID NO: 253584 - DNA, 25 bp, Rattus norvegicus
cctcttaaccagcagttcttgtctg

SEQ ID NO: 253585 - DNA, 25 bp, Rattus norvegicus
cctcttaaccaggagttcttgtctg

SEQ ID NO: 253586 - DNA, 25 bp, Rattus norvegicus
cctcttaaccttcgctctagactgt

SEQ ID NO: 253587 - DNA, 25 bp, Rattus norvegicus
cctcttaaccttggctctagactgt

SEQ ID NO: 253588 - DNA, 25 bp, Rattus norvegicus
cctcttacctctcacaatgtgctga

SEQ ID NO: 253589 - DNA, 25 bp, Rattus norvegicus
cctcttacctctgacaatgtgctga

SEQ ID NO: 253590 - DNA, 25 bp, Rattus norvegicus
cctcttactcccagttggtaatgaa

SEQ ID NO: 253591 - DNA, 25 bp, Rattus norvegicus
cctcttactccctgttggtaatgaa

SEQ ID NO: 253592 - DNA, 25 bp, Rattus norvegicus
cctcttacttgtctgcttttgcaac

SEQ ID NO: 253593 - DNA, 25 bp, Rattus norvegicus
cctcttacttgtgtgcttttgcaac

SEQ ID NO: 253594 - DNA, 25 bp, Rattus norvegicus
cctcttaggcacaactagctctaga

SEQ ID NO: 253595 - DNA, 25 bp, Rattus norvegicus
cctcttaggcactactagctctaga

SEQ ID NO: 253596 - DNA, 25 bp, Rattus norvegicus
cctcttagttccaagctgcagctag

SEQ ID NO: 253597 - DNA, 25 bp, Rattus norvegicus
cctcttagttcctagctgcagctag

SEQ ID NO: 253598 - DNA, 25 bp, Rattus norvegicus
cctcttatgagaccagctgttcctg

SEQ ID NO: 253599 - DNA, 25 bp, Rattus norvegicus
cctcttatgagagcagctgttcctg

SEQ ID NO: 253600 - DNA, 25 bp, Rattus norvegicus
cctcttcaaaggacactgtctataa

SEQ ID NO: 253601 - DNA, 25 bp, Rattus norvegicus
cctcttcaaaggtcactgtctataa

SEQ ID NO: 253602 - DNA, 25 bp, Rattus norvegicus
cctcttcaaggacatgagccatcca

SEQ ID NO: 253603 - DNA, 25 bp, Rattus norvegicus
cctcttcaaggagatgagccatcca

SEQ ID NO: 253604 - DNA, 25 bp, Rattus norvegicus
cctcttcaaggtacatttttcgtcg

SEQ ID NO: 253605 - DNA, 25 bp, Rattus norvegicus
cctcttcaaggttcatttttcgtcg

SEQ ID NO: 253606 - DNA, 25 bp, Rattus norvegicus
cctcttcactgcattgtgactctgg

SEQ ID NO: 253607 - DNA, 25 bp, Rattus norvegicus
cctcttcactgctttgtgactctgg

SEQ ID NO: 253608 - DNA, 25 bp, Rattus norvegicus
cctcttcagcaaactgtgcctgttg

SEQ ID NO: 253609 - DNA, 25 bp, Rattus norvegicus
cctcttcagcaatctgtgcctgttg

SEQ ID NO: 253610 - DNA, 25 bp, Rattus norvegicus
cctcttcatcctactgagacaatta

SEQ ID NO: 253611 - DNA, 25 bp, Rattus norvegicus
cctcttcatccttctgagacaatta

SEQ ID NO: 253612 - DNA, 25 bp, Rattus norvegicus
cctcttccaacaaggtatgcctgtt

SEQ ID NO: 253613 - DNA, 25 bp, Rattus norvegicus
cctcttccaacatggtatgcctgtt

SEQ ID NO: 253614 - DNA, 25 bp, Rattus norvegicus
cctcttccacacagaagtttcagga

SEQ ID NO: 253615 - DNA, 25 bp, Rattus norvegicus
cctcttccacactgaagtttcagga

SEQ ID NO: 253616 - DNA, 25 bp, Rattus norvegicus
cctcttccacggaatgctcgatgaa

SEQ ID NO: 253617 - DNA, 25 bp, Rattus norvegicus
cctcttccacggtatgctcgatgaa

SEQ ID NO: 253618 - DNA, 25 bp, Rattus norvegicus
cctcttccattcctatttaaacatc

SEQ ID NO: 253619 - DNA, 25 bp, Rattus norvegicus
cctcttccattcgtatttaaacatc

SEQ ID NO: 253620 - DNA, 25 bp, Rattus norvegicus
cctcttcctaagacaatccactatt

SEQ ID NO: 253621 - DNA, 25 bp, Rattus norvegicus
cctcttcctaagtcaatccactatt

SEQ ID NO: 253622 - DNA, 25 bp, Rattus norvegicus
cctcttcgggtgattttgtaatgtg

SEQ ID NO: 253623 - DNA, 25 bp, Rattus norvegicus
cctcttcgggtgtttttgtaatgtg

SEQ ID NO: 253624 - DNA, 25 bp, Rattus norvegicus
cctcttctagaccaaagctgccaaa

SEQ ID NO: 253625 - DNA, 25 bp, Rattus norvegicus
cctcttctagacgaaagctgccaaa

SEQ ID NO: 253626 - DNA, 25 bp, Rattus norvegicus
cctcttctccttagcattaactgca

SEQ ID NO: 253627 - DNA, 25 bp, Rattus norvegicus
cctcttctccttagtagtgtctaat

SEQ ID NO: 253628 - DNA, 25 bp, Rattus norvegicus
cctcttctcctttgcattaactgca

SEQ ID NO: 253629 - DNA, 25 bp, Rattus norvegicus
cctcttctcctttgtagtgtctaat

SEQ ID NO: 253630 - DNA, 25 bp, Rattus norvegicus
cctcttctctctaacattcaaggat

SEQ ID NO: 253631 - DNA, 25 bp, Rattus norvegicus
cctcttctctcttacattcaaggat

SEQ ID NO: 253632 - DNA, 25 bp, Rattus norvegicus
cctcttctgtcaacaggcacatgag

SEQ ID NO: 253633 - DNA, 25 bp, Rattus norvegicus
cctcttctgtcatcaggcacatgag

SEQ ID NO: 253634 - DNA, 25 bp, Rattus norvegicus
cctcttctgtgaatgctgtagtttc

SEQ ID NO: 253635 - DNA, 25 bp, Rattus norvegicus
cctcttctgtgattgctgtagtttc

SEQ ID NO: 253636 - DNA, 25 bp, Rattus norvegicus
cctcttcttactcactacggatcaa

SEQ ID NO: 253637 - DNA, 25 bp, Rattus norvegicus
cctcttcttactgactacggatcaa

SEQ ID NO: 253638 - DNA, 25 bp, Rattus norvegicus
cctcttcttagcctgctgtgtgaga

SEQ ID NO: 253639 - DNA, 25 bp, Rattus norvegicus
cctcttcttagcgtgctgtgtgaga

SEQ ID NO: 253640 - DNA, 25 bp, Rattus norvegicus
cctcttcttaggactggattacggg

SEQ ID NO: 253641 - DNA, 25 bp, Rattus norvegicus
cctcttcttaggtctggattacggg

SEQ ID NO: 253642 - DNA, 25 bp, Rattus norvegicus
cctcttgattgcactgggactacag

SEQ ID NO: 253643 - DNA, 25 bp, Rattus norvegicus
cctcttgattgctctgggactacag

SEQ ID NO: 253644 - DNA, 25 bp, Rattus norvegicus
cctcttgctgccagttgactttgga

SEQ ID NO: 253645 - DNA, 25 bp, Rattus norvegicus
cctcttgctgcctgttgactttgga

SEQ ID NO: 253646 - DNA, 25 bp, Rattus norvegicus
cctcttggacctccgcggagacgtg

SEQ ID NO: 253647 - DNA, 25 bp, Rattus norvegicus
cctcttggacctgcgcggagacgtg

SEQ ID NO: 253648 - DNA, 25 bp, Rattus norvegicus
cctcttggccttcctcaaaagggac

SEQ ID NO: 253649 - DNA, 25 bp, Rattus norvegicus
cctcttggccttgctcaaaagggac

SEQ ID NO: 253650 - DNA, 25 bp, Rattus norvegicus
cctcttggtggactggaagacccca

SEQ ID NO: 253651 - DNA, 25 bp, Rattus norvegicus
cctcttggtggagtggaagacccca

SEQ ID NO: 253652 - DNA, 25 bp, Rattus norvegicus
cctcttgtctgcatttggacaaaat

SEQ ID NO: 253653 - DNA, 25 bp, Rattus norvegicus
cctcttgtctgcttttggacaaaat

SEQ ID NO: 253654 - DNA, 25 bp, Rattus norvegicus
cctcttgtctgtatcacactgtgat

SEQ ID NO: 253655 - DNA, 25 bp, Rattus norvegicus
cctcttgtctgtttcacactgtgat

SEQ ID NO: 253656 - DNA, 25 bp, Rattus norvegicus
cctcttgtcttgaatgtgcatcacg

SEQ ID NO: 253657 - DNA, 25 bp, Rattus norvegicus
cctcttgtcttgtatgtgcatcacg

SEQ ID NO: 253658 - DNA, 25 bp, Rattus norvegicus
cctcttgttctgagggatcttctaa

SEQ ID NO: 253659 - DNA, 25 bp, Rattus norvegicus
cctcttgttctgtgggatcttctaa

SEQ ID NO: 253660 - DNA, 25 bp, Rattus norvegicus
cctctttaagacaagggctgggaga

SEQ ID NO: 253661 - DNA, 25 bp, Rattus norvegicus
cctctttaagactagggctgggaga

SEQ ID NO: 253662 - DNA, 25 bp, Rattus norvegicus
cctctttaatgcctagactcacaag

SEQ ID NO: 253663 - DNA, 25 bp, Rattus norvegicus
cctctttaatgcgtagactcacaag

SEQ ID NO: 253664 - DNA, 25 bp, Rattus norvegicus
cctctttaattacttctggtctctt

SEQ ID NO: 253665 - DNA, 25 bp, Rattus norvegicus
cctctttaattagttctggtctctt

SEQ ID NO: 253666 - DNA, 25 bp, Rattus norvegicus
cctctttacgggatatgctacaccg

SEQ ID NO: 253667 - DNA, 25 bp, Rattus norvegicus
cctctttacgggttatgctacaccg

SEQ ID NO: 253668 - DNA, 25 bp, Rattus norvegicus
cctctttactgaatggttctctcca

SEQ ID NO: 253669 - DNA, 25 bp, Rattus norvegicus
cctctttactgattggttctctcca

SEQ ID NO: 253670 - DNA, 25 bp, Rattus norvegicus
cctctttccaggatcatcttcagaa

SEQ ID NO: 253671 - DNA, 25 bp, Rattus norvegicus
cctctttccaggttcatcttcagaa

SEQ ID NO: 253672 - DNA, 25 bp, Rattus norvegicus
cctctttcccttatcatttattctg

SEQ ID NO: 253673 - DNA, 25 bp, Rattus norvegicus
cctctttcccttttcatttattctg

SEQ ID NO: 253674 - DNA, 25 bp, Rattus norvegicus
cctctttctcctacttaagtcattt

SEQ ID NO: 253675 - DNA, 25 bp, Rattus norvegicus
cctctttctccttcttaagtcattt

SEQ ID NO: 253676 - DNA, 25 bp, Rattus norvegicus
cctctttcttgcaggtgtttctaaa

SEQ ID NO: 253677 - DNA, 25 bp, Rattus norvegicus
cctctttcttgctggtgtttctaaa

SEQ ID NO: 253678 - DNA, 25 bp, Rattus norvegicus
cctctttgagaaagctgaagctaat

SEQ ID NO: 253679 - DNA, 25 bp, Rattus norvegicus
cctctttgagaatgctgaagctaat

SEQ ID NO: 253680 - DNA, 25 bp, Rattus norvegicus
cctctttggatgagcgtttgggccg

SEQ ID NO: 253681 - DNA, 25 bp, Rattus norvegicus
cctctttggatgtgcgtttgggccg

SEQ ID NO: 253682 - DNA, 25 bp, Rattus norvegicus
cctctttgtcagagggtgctgaggt

SEQ ID NO: 253683 - DNA, 25 bp, Rattus norvegicus
cctctttgtcagtgggtgctgaggt

SEQ ID NO: 253684 - DNA, 25 bp, Rattus norvegicus
cctctttgttgtcatgtctcatgga

SEQ ID NO: 253685 - DNA, 25 bp, Rattus norvegicus
cctctttgttgtgatgtctcatgga

SEQ ID NO: 253686 - DNA, 25 bp, Rattus norvegicus
cctcttttaaccacttcaagcatca

SEQ ID NO: 253687 - DNA, 25 bp, Rattus norvegicus
cctcttttaacctcttcaagcatca

SEQ ID NO: 253688 - DNA, 25 bp, Rattus norvegicus
cctcttttcctccattaagtcaagt

SEQ ID NO: 253689 - DNA, 25 bp, Rattus norvegicus
cctcttttcctcgattaagtcaagt

SEQ ID NO: 253690 - DNA, 25 bp, Rattus norvegicus
cctcttttgctgacctcaagtgaag

SEQ ID NO: 253691 - DNA, 25 bp, Rattus norvegicus
cctcttttgctgtcctcaagtgaag

SEQ ID NO: 253692 - DNA, 25 bp, Rattus norvegicus
cctctttttcttactcagactctta

SEQ ID NO: 253693 - DNA, 25 bp, Rattus norvegicus
cctctttttctttctcagactctta

SEQ ID NO: 253694 - DNA, 25 bp, Rattus norvegicus
cctgaaaacactcacccaacaaatg

SEQ ID NO: 253695 - DNA, 25 bp, Rattus norvegicus
cctgaaaacactgacccaacaaatg

SEQ ID NO: 253696 - DNA, 25 bp, Rattus norvegicus
cctgaaaactccattgcaccaatga

SEQ ID NO: 253697 - DNA, 25 bp, Rattus norvegicus
cctgaaaactcctttgcaccaatga

SEQ ID NO: 253698 - DNA, 25 bp, Rattus norvegicus
cctgaaaatttcagtctgtgccagc

SEQ ID NO: 253699 - DNA, 25 bp, Rattus norvegicus
cctgaaaatttctgtctgtgccagc

SEQ ID NO: 253700 - DNA, 25 bp, Rattus norvegicus
cctgaaagtcatagccacctgggag

SEQ ID NO: 253701 - DNA, 25 bp, Rattus norvegicus
cctgaaagtcattgccacctgggag

SEQ ID NO: 253702 - DNA, 25 bp, Rattus norvegicus
cctgaaatgacgcaggcccagattc

SEQ ID NO: 253703 - DNA, 25 bp, Rattus norvegicus
cctgaaatgacggaggcccagattc

SEQ ID NO: 253704 - DNA, 25 bp, Rattus norvegicus
cctgaacccggacctgatgaagaac

SEQ ID NO: 253705 - DNA, 25 bp, Rattus norvegicus
cctgaacccggagctgatgaagaac

SEQ ID NO: 253706 - DNA, 25 bp, Rattus norvegicus
cctgaacctgacaccattgatgtga

SEQ ID NO: 253707 - DNA, 25 bp, Rattus norvegicus
cctgaacctgactccattgatgtga

SEQ ID NO: 253708 - DNA, 25 bp, Rattus norvegicus
cctgaacctttgagccaccctgagc

SEQ ID NO: 253709 - DNA, 25 bp, Rattus norvegicus
cctgaacctttgtgccaccctgagc

SEQ ID NO: 253710 - DNA, 25 bp, Rattus norvegicus
cctgaacgcgcccgatctcgtctga

SEQ ID NO: 253711 - DNA, 25 bp, Rattus norvegicus
cctgaacgcgccggatctcgtctga

SEQ ID NO: 253712 - DNA, 25 bp, Rattus norvegicus
cctgaactccttcctgtggactatt

SEQ ID NO: 253713 - DNA, 25 bp, Rattus norvegicus
cctgaactccttgctgtggactatt

SEQ ID NO: 253714 - DNA, 25 bp, Rattus norvegicus
cctgaactgtctcccagaaatctgg

SEQ ID NO: 253715 - DNA, 25 bp, Rattus norvegicus
cctgaactgtctgccagaaatctgg

SEQ ID NO: 253716 - DNA, 25 bp, Rattus norvegicus
cctgaagcccacactgctcgtggga

SEQ ID NO: 253717 - DNA, 25 bp, Rattus norvegicus
cctgaagcccactctgctcgtggga

SEQ ID NO: 253718 - DNA, 25 bp, Rattus norvegicus
cctgaagccttgagtccctgtgtgc

SEQ ID NO: 253719 - DNA, 25 bp, Rattus norvegicus
cctgaagccttgtgtccctgtgtgc

SEQ ID NO: 253720 - DNA, 25 bp, Rattus norvegicus
cctgaagcctttatatccttggcct

SEQ ID NO: 253721 - DNA, 25 bp, Rattus norvegicus
cctgaagcctttcgcctagccattg

SEQ ID NO: 253722 - DNA, 25 bp, Rattus norvegicus
cctgaagcctttggcctagccattg

SEQ ID NO: 253723 - DNA, 25 bp, Rattus norvegicus
cctgaagcctttttatccttggcct

SEQ ID NO: 253724 - DNA, 25 bp, Rattus norvegicus
cctgaagctgataggcatggccggt

SEQ ID NO: 253725 - DNA, 25 bp, Rattus norvegicus
cctgaagctgattggcatggccggt

SEQ ID NO: 253726 - DNA, 25 bp, Rattus norvegicus
cctgaagctgcacgcttgggacctg

SEQ ID NO: 253727 - DNA, 25 bp, Rattus norvegicus
cctgaagctgcaggcttgggacctg

SEQ ID NO: 253728 - DNA, 25 bp, Rattus norvegicus
cctgaaggagttcctggccgtcaag

SEQ ID NO: 253729 - DNA, 25 bp, Rattus norvegicus
cctgaaggagttgctggccgtcaag

SEQ ID NO: 253730 - DNA, 25 bp, Rattus norvegicus
cctgaagggtggctacatgtctgta

SEQ ID NO: 253731 - DNA, 25 bp, Rattus norvegicus
cctgaagggtgggtacatgtctgta

SEQ ID NO: 253732 - DNA, 25 bp, Rattus norvegicus
cctgaagtgggaccaagcaggcttc

SEQ ID NO: 253733 - DNA, 25 bp, Rattus norvegicus
cctgaagtgggagcaagcaggcttc

SEQ ID NO: 253734 - DNA, 25 bp, Rattus norvegicus
cctgaagtgtctcagtgctgctgaa

SEQ ID NO: 253735 - DNA, 25 bp, Rattus norvegicus
cctgaagtgtctgagtgctgctgaa

SEQ ID NO: 253736 - DNA, 25 bp, Rattus norvegicus
cctgaagttcgaattcgggtccata

SEQ ID NO: 253737 - DNA, 25 bp, Rattus norvegicus
cctgaagttcgatttcgggtccata

SEQ ID NO: 253738 - DNA, 25 bp, Rattus norvegicus
cctgaagttctgaccttaactcttt

SEQ ID NO: 253739 - DNA, 25 bp, Rattus norvegicus
cctgaagttctgtccttaactcttt

SEQ ID NO: 253740 - DNA, 25 bp, Rattus norvegicus
cctgaataaacgagggctctgaaaa

SEQ ID NO: 253741 - DNA, 25 bp, Rattus norvegicus
cctgaataaacgtgggctctgaaaa

SEQ ID NO: 253742 - DNA, 25 bp, Rattus norvegicus
cctgaatacaccctgggcactgaat

SEQ ID NO: 253743 - DNA, 25 bp, Rattus norvegicus
cctgaatacaccgtgggcactgaat

SEQ ID NO: 253744 - DNA, 25 bp, Rattus norvegicus
cctgaatcaggacggcaagccgctg

SEQ ID NO: 253745 - DNA, 25 bp, Rattus norvegicus
cctgaatcaggagggcaagccgctg

SEQ ID NO: 253746 - DNA, 25 bp, Rattus norvegicus
cctgaatgactcatgggtggcaaag

SEQ ID NO: 253747 - DNA, 25 bp, Rattus norvegicus
cctgaatgactcttgggtggcaaag

SEQ ID NO: 253748 - DNA, 25 bp, Rattus norvegicus
cctgaatggcacagcagtcttggct

SEQ ID NO: 253749 - DNA, 25 bp, Rattus norvegicus
cctgaatggcactgcagtcttggct

SEQ ID NO: 253750 - DNA, 25 bp, Rattus norvegicus
cctgaatggcagcagtctgtggcct

SEQ ID NO: 253751 - DNA, 25 bp, Rattus norvegicus
cctgaatggcaggagtctgtggcct

SEQ ID NO: 253752 - DNA, 25 bp, Rattus norvegicus
cctgaatggtacctgtgggctgaat

SEQ ID NO: 253753 - DNA, 25 bp, Rattus norvegicus
cctgaatggtacgtgtgggctgaat

SEQ ID NO: 253754 - DNA, 25 bp, Rattus norvegicus
cctgaatgtttactacggtcctcct

SEQ ID NO: 253755 - DNA, 25 bp, Rattus norvegicus
cctgaatgtttagtacggtcctcct

SEQ ID NO: 253756 - DNA, 25 bp, Rattus norvegicus
cctgaattctctcccagtttgggaa

SEQ ID NO: 253757 - DNA, 25 bp, Rattus norvegicus
cctgaattctctgccagtttgggaa

SEQ ID NO: 253758 - DNA, 25 bp, Rattus norvegicus
cctgaatttccccagtctttgattt

SEQ ID NO: 253759 - DNA, 25 bp, Rattus norvegicus
cctgaatttcccgagtctttgattt

SEQ ID NO: 253760 - DNA, 25 bp, Rattus norvegicus
cctgacaacctgctttctggaaaag

SEQ ID NO: 253761 - DNA, 25 bp, Rattus norvegicus
cctgacaacctggtttctggaaaag

SEQ ID NO: 253762 - DNA, 25 bp, Rattus norvegicus
cctgacaagggcaagggttcttctt

SEQ ID NO: 253763 - DNA, 25 bp, Rattus norvegicus
cctgacaagggctagggttcttctt

SEQ ID NO: 253764 - DNA, 25 bp, Rattus norvegicus
cctgacagactacctcatgaagatc

SEQ ID NO: 253765 - DNA, 25 bp, Rattus norvegicus
cctgacagactagctcatgaagatc

SEQ ID NO: 253766 - DNA, 25 bp, Rattus norvegicus
cctgacatgccaagttttacgtgat

SEQ ID NO: 253767 - DNA, 25 bp, Rattus norvegicus
cctgacatgccatgttttacgtgat

SEQ ID NO: 253768 - DNA, 25 bp, Rattus norvegicus
cctgacattaatcaggcttgaggca

SEQ ID NO: 253769 - DNA, 25 bp, Rattus norvegicus
cctgacattaatgaggcttgaggca

SEQ ID NO: 253770 - DNA, 25 bp, Rattus norvegicus
cctgacattcacagacgtgtgcttt

SEQ ID NO: 253771 - DNA, 25 bp, Rattus norvegicus
cctgacattcactgacgtgtgcttt

SEQ ID NO: 253772 - DNA, 25 bp, Rattus norvegicus
cctgaccaatttacctctttcaagg

SEQ ID NO: 253773 - DNA, 25 bp, Rattus norvegicus
cctgaccaattttcctctttcaagg

SEQ ID NO: 253774 - DNA, 25 bp, Rattus norvegicus
cctgaccagaacagtggcaatcctt

SEQ ID NO: 253775 - DNA, 25 bp, Rattus norvegicus
cctgaccagaactgtggcaatcctt

SEQ ID NO: 253776 - DNA, 25 bp, Rattus norvegicus
cctgaccagattccagaggcagctg

SEQ ID NO: 253777 - DNA, 25 bp, Rattus norvegicus
cctgaccagattgcagaggcagctg

SEQ ID NO: 253778 - DNA, 25 bp, Rattus norvegicus
cctgaccccatcatgaaatggctgt

SEQ ID NO: 253779 - DNA, 25 bp, Rattus norvegicus
cctgaccccatcttgaaatggctgt

SEQ ID NO: 253780 - DNA, 25 bp, Rattus norvegicus
cctgaccctctcagtacttagagaa

SEQ ID NO: 253781 - DNA, 25 bp, Rattus norvegicus
cctgaccctctctgtacttagagaa

SEQ ID NO: 253782 - DNA, 25 bp, Rattus norvegicus
cctgaccgcaggaagtcgtctgagt

SEQ ID NO: 253783 - DNA, 25 bp, Rattus norvegicus
cctgaccgcaggtagtcgtctgagt

SEQ ID NO: 253784 - DNA, 25 bp, Rattus norvegicus
cctgacctaggcacgcggatcgtgg

SEQ ID NO: 253785 - DNA, 25 bp, Rattus norvegicus
cctgacctaggctcgcggatcgtgg

SEQ ID NO: 253786 - DNA, 25 bp, Rattus norvegicus
cctgacctaggtctctatatgtgga

SEQ ID NO: 253787 - DNA, 25 bp, Rattus norvegicus
cctgacctaggtgtctatatgtgga

SEQ ID NO: 253788 - DNA, 25 bp, Rattus norvegicus
cctgacctccagctattaaacgtgt

SEQ ID NO: 253789 - DNA, 25 bp, Rattus norvegicus
cctgacctccaggtattaaacgtgt

SEQ ID NO: 253790 - DNA, 25 bp, Rattus norvegicus
cctgaccttgtaagcttcctgtaat

SEQ ID NO: 253791 - DNA, 25 bp, Rattus norvegicus
cctgaccttgtatgcttcctgtaat

SEQ ID NO: 253792 - DNA, 25 bp, Rattus norvegicus
cctgacgcctaaaatatttgtaact

SEQ ID NO: 253793 - DNA, 25 bp, Rattus norvegicus
cctgacgcctaatatatttgtaact

SEQ ID NO: 253794 - DNA, 25 bp, Rattus norvegicus
cctgacgtaggtcttggagccagct

SEQ ID NO: 253795 - DNA, 25 bp, Rattus norvegicus
cctgacgtaggtgttggagccagct

SEQ ID NO: 253796 - DNA, 25 bp, Rattus norvegicus
cctgactcaatgctgttgccctaaa

SEQ ID NO: 253797 - DNA, 25 bp, Rattus norvegicus
cctgactcaatggtgttgccctaaa

SEQ ID NO: 253798 - DNA, 25 bp, Rattus norvegicus
cctgactcatttagtgtgcctctgt

SEQ ID NO: 253799 - DNA, 25 bp, Rattus norvegicus
cctgactcattttgtgtgcctctgt

SEQ ID NO: 253800 - DNA, 25 bp, Rattus norvegicus
cctgactccaggcagaggcattcat

SEQ ID NO: 253801 - DNA, 25 bp, Rattus norvegicus
cctgactccagggagaggcattcat

SEQ ID NO: 253802 - DNA, 25 bp, Rattus norvegicus
cctgactccctcaaatgttgattga

SEQ ID NO: 253803 - DNA, 25 bp, Rattus norvegicus
cctgactccctctaatgttgattga

SEQ ID NO: 253804 - DNA, 25 bp, Rattus norvegicus
cctgactctgaactaccccatagag

SEQ ID NO: 253805 - DNA, 25 bp, Rattus norvegicus
cctgactctgaagtaccccatagag

SEQ ID NO: 253806 - DNA, 25 bp, Rattus norvegicus
cctgactctgctattcttggagaaa

SEQ ID NO: 253807 - DNA, 25 bp, Rattus norvegicus
cctgactctgcttttcttggagaaa

SEQ ID NO: 253808 - DNA, 25 bp, Rattus norvegicus
cctgactctgggactagcgatgcat

SEQ ID NO: 253809 - DNA, 25 bp, Rattus norvegicus
cctgactctgggtctagcgatgcat

SEQ ID NO: 253810 - DNA, 25 bp, Rattus norvegicus
cctgactctgtgagcaatgttatga

SEQ ID NO: 253811 - DNA, 25 bp, Rattus norvegicus
cctgactctgtgtgcaatgttatga

SEQ ID NO: 253812 - DNA, 25 bp, Rattus norvegicus
cctgactgaaagagcgagacacaag

SEQ ID NO: 253813 - DNA, 25 bp, Rattus norvegicus
cctgactgaaagtgcgagacacaag

SEQ ID NO: 253814 - DNA, 25 bp, Rattus norvegicus
cctgactgacagcaattcttctgaa

SEQ ID NO: 253815 - DNA, 25 bp, Rattus norvegicus
cctgactgacaggaattcttctgaa

SEQ ID NO: 253816 - DNA, 25 bp, Rattus norvegicus
cctgactgagtgctctccagagaag

SEQ ID NO: 253817 - DNA, 25 bp, Rattus norvegicus
cctgactgagtggtctccagagaag

SEQ ID NO: 253818 - DNA, 25 bp, Rattus norvegicus
cctgactgggccattgttttttttg

SEQ ID NO: 253819 - DNA, 25 bp, Rattus norvegicus
cctgactgggcctttgttttttttg

SEQ ID NO: 253820 - DNA, 25 bp, Rattus norvegicus
cctgactgtggcaagagctaccgct

SEQ ID NO: 253821 - DNA, 25 bp, Rattus norvegicus
cctgactgtggctagagctaccgct

SEQ ID NO: 253822 - DNA, 25 bp, Rattus norvegicus
cctgactgttgacttgaatgtgcct

SEQ ID NO: 253823 - DNA, 25 bp, Rattus norvegicus
cctgactgttgagttgaatgtgcct

SEQ ID NO: 253824 - DNA, 25 bp, Rattus norvegicus
cctgacttaacaatgggccaacaac

SEQ ID NO: 253825 - DNA, 25 bp, Rattus norvegicus
cctgacttaacattgggccaacaac

SEQ ID NO: 253826 - DNA, 25 bp, Rattus norvegicus
cctgacttactgctgcaactgggtg

SEQ ID NO: 253827 - DNA, 25 bp, Rattus norvegicus
cctgacttactggtgcaactgggtg

SEQ ID NO: 253828 - DNA, 25 bp, Rattus norvegicus
cctgacttaggaacatgcttgcttt

SEQ ID NO: 253829 - DNA, 25 bp, Rattus norvegicus
cctgacttaggatcatgcttgcttt

SEQ ID NO: 253830 - DNA, 25 bp, Rattus norvegicus
cctgacttccctagtgatgtttcta

SEQ ID NO: 253831 - DNA, 25 bp, Rattus norvegicus
cctgacttcccttgtgatgtttcta

SEQ ID NO: 253832 - DNA, 25 bp, Rattus norvegicus
cctgacttttccagcgcaatggaga

SEQ ID NO: 253833 - DNA, 25 bp, Rattus norvegicus
cctgacttttcctgcgcaatggaga

SEQ ID NO: 253834 - DNA, 25 bp, Rattus norvegicus
cctgagaacccaatagctgatagct

SEQ ID NO: 253835 - DNA, 25 bp, Rattus norvegicus
cctgagaacccattagctgatagct

SEQ ID NO: 253836 - DNA, 25 bp, Rattus norvegicus
cctgagaaggcgactcttggagact

SEQ ID NO: 253837 - DNA, 25 bp, Rattus norvegicus
cctgagaaggcgtctcttggagact

SEQ ID NO: 253838 - DNA, 25 bp, Rattus norvegicus
cctgagacccaaatgccttaaaact

SEQ ID NO: 253839 - DNA, 25 bp, Rattus norvegicus
cctgagacccaattgccttaaaact

SEQ ID NO: 253840 - DNA, 25 bp, Rattus norvegicus
cctgagaccggcattgatgtcttga

SEQ ID NO: 253841 - DNA, 25 bp, Rattus norvegicus
cctgagaccggctttgatgtcttga

SEQ ID NO: 253842 - DNA, 25 bp, Rattus norvegicus
cctgagagctgacgtgagacctatg

SEQ ID NO: 253843 - DNA, 25 bp, Rattus norvegicus
cctgagagctgaggtgagacctatg

SEQ ID NO: 253844 - DNA, 25 bp, Rattus norvegicus
cctgagaggtcgcatgccttgtcct

SEQ ID NO: 253845 - DNA, 25 bp, Rattus norvegicus
cctgagaggtcggatgccttgtcct

SEQ ID NO: 253846 - DNA, 25 bp, Rattus norvegicus
cctgagagtcgtattggttttgcat

SEQ ID NO: 253847 - DNA, 25 bp, Rattus norvegicus
cctgagagtcgttttggttttgcat

SEQ ID NO: 253848 - DNA, 25 bp, Rattus norvegicus
cctgagataaaaagccatgtggatt

SEQ ID NO: 253849 - DNA, 25 bp, Rattus norvegicus
cctgagataaaatgccatgtggatt

SEQ ID NO: 253850 - DNA, 25 bp, Rattus norvegicus
cctgagattatccattgaccctaca

SEQ ID NO: 253851 - DNA, 25 bp, Rattus norvegicus
cctgagattatcgattgaccctaca

SEQ ID NO: 253852 - DNA, 25 bp, Rattus norvegicus
cctgagatttctcggcttgggatgt

SEQ ID NO: 253853 - DNA, 25 bp, Rattus norvegicus
cctgagatttctgggcttgggatgt

SEQ ID NO: 253854 - DNA, 25 bp, Rattus norvegicus
cctgagcagcggaccactttggaga

SEQ ID NO: 253855 - DNA, 25 bp, Rattus norvegicus
cctgagcagcggtccactttggaga

SEQ ID NO: 253856 - DNA, 25 bp, Rattus norvegicus
cctgagccagctacctgagatagaa

SEQ ID NO: 253857 - DNA, 25 bp, Rattus norvegicus
cctgagccagcttcctgagatagaa

SEQ ID NO: 253858 - DNA, 25 bp, Rattus norvegicus
cctgagccaggcctagactgtagaa

SEQ ID NO: 253859 - DNA, 25 bp, Rattus norvegicus
cctgagccaggcgtagactgtagaa

SEQ ID NO: 253860 - DNA, 25 bp, Rattus norvegicus
cctgagccctcaataagaccaataa

SEQ ID NO: 253861 - DNA, 25 bp, Rattus norvegicus
cctgagccctcattaagaccaataa

SEQ ID NO: 253862 - DNA, 25 bp, Rattus norvegicus
cctgagccgtgacctaataaacttg

SEQ ID NO: 253863 - DNA, 25 bp, Rattus norvegicus
cctgagccgtgagctaataaacttg

SEQ ID NO: 253864 - DNA, 25 bp, Rattus norvegicus
cctgagccgttcagcatgagtgatg

SEQ ID NO: 253865 - DNA, 25 bp, Rattus norvegicus
cctgagccgttctgcatgagtgatg

SEQ ID NO: 253866 - DNA, 25 bp, Rattus norvegicus
cctgagcctcagcatggagccgaga

SEQ ID NO: 253867 - DNA, 25 bp, Rattus norvegicus
cctgagcctcaggatggagccgaga

SEQ ID NO: 253868 - DNA, 25 bp, Rattus norvegicus
cctgagcctccactgctgagtggag

SEQ ID NO: 253869 - DNA, 25 bp, Rattus norvegicus
cctgagcctccagtgctgagtggag

SEQ ID NO: 253870 - DNA, 25 bp, Rattus norvegicus
cctgagcggtttcttctgtttcgaa

SEQ ID NO: 253871 - DNA, 25 bp, Rattus norvegicus
cctgagcggtttgttctgtttcgaa

SEQ ID NO: 253872 - DNA, 25 bp, Rattus norvegicus
cctgagctagacaatgtgcagcact

SEQ ID NO: 253873 - DNA, 25 bp, Rattus norvegicus
cctgagctagactatgtgcagcact

SEQ ID NO: 253874 - DNA, 25 bp, Rattus norvegicus
cctgagctgtggatttgatactgat

SEQ ID NO: 253875 - DNA, 25 bp, Rattus norvegicus
cctgagctgtggttttgatactgat

SEQ ID NO: 253876 - DNA, 25 bp, Rattus norvegicus
cctgagctgtttcactacgggataa

SEQ ID NO: 253877 - DNA, 25 bp, Rattus norvegicus
cctgagctgtttgactacgggataa

SEQ ID NO: 253878 - DNA, 25 bp, Rattus norvegicus
cctgagcttattcggtgccacgaaa

SEQ ID NO: 253879 - DNA, 25 bp, Rattus norvegicus
cctgagcttattgggtgccacgaaa

SEQ ID NO: 253880 - DNA, 25 bp, Rattus norvegicus
cctgaggaaagtccccagtctggag

SEQ ID NO: 253881 - DNA, 25 bp, Rattus norvegicus
cctgaggaaagtgcccagtctggag

SEQ ID NO: 253882 - DNA, 25 bp, Rattus norvegicus
cctgaggacctcatgcttgaagttt

SEQ ID NO: 253883 - DNA, 25 bp, Rattus norvegicus
cctgaggacctcttgcttgaagttt

SEQ ID NO: 253884 - DNA, 25 bp, Rattus norvegicus
cctgaggacctgagttggatctctg

SEQ ID NO: 253885 - DNA, 25 bp, Rattus norvegicus
cctgaggacctgtgttggatctctg

SEQ ID NO: 253886 - DNA, 25 bp, Rattus norvegicus
cctgaggaggccaagaccgaggtct

SEQ ID NO: 253887 - DNA, 25 bp, Rattus norvegicus
cctgaggaggcctagaccgaggtct

SEQ ID NO: 253888 - DNA, 25 bp, Rattus norvegicus
cctgaggcctccagattctaagaaa

SEQ ID NO: 253889 - DNA, 25 bp, Rattus norvegicus
cctgaggcctcctgattctaagaaa

SEQ ID NO: 253890 - DNA, 25 bp, Rattus norvegicus
cctgaggctcccagcggagcggaca

SEQ ID NO: 253891 - DNA, 25 bp, Rattus norvegicus
cctgaggctccctgcggagcggaca

SEQ ID NO: 253892 - DNA, 25 bp, Rattus norvegicus
cctgaggctctactgtgtgacgtaa

SEQ ID NO: 253893 - DNA, 25 bp, Rattus norvegicus
cctgaggctctagtgtgtgacgtaa

SEQ ID NO: 253894 - DNA, 25 bp, Rattus norvegicus
cctgaggctctgacgaagtgtggaa

SEQ ID NO: 253895 - DNA, 25 bp, Rattus norvegicus
cctgaggctctgtcgaagtgtggaa

SEQ ID NO: 253896 - DNA, 25 bp, Rattus norvegicus
cctgagggaggcagggcatctccct

SEQ ID NO: 253897 - DNA, 25 bp, Rattus norvegicus
cctgagggaggctgggcatctccct

SEQ ID NO: 253898 - DNA, 25 bp, Rattus norvegicus
cctgagggatgcatgttggaagtac

SEQ ID NO: 253899 - DNA, 25 bp, Rattus norvegicus
cctgagggatgcttgttggaagtac

SEQ ID NO: 253900 - DNA, 25 bp, Rattus norvegicus
cctgagggtcagagtgtttgtagaa

SEQ ID NO: 253901 - DNA, 25 bp, Rattus norvegicus
cctgagggtcagtgtgtttgtagaa

SEQ ID NO: 253902 - DNA, 25 bp, Rattus norvegicus
cctgagggtgaaataacttggcata

SEQ ID NO: 253903 - DNA, 25 bp, Rattus norvegicus
cctgagggtgaattaacttggcata

SEQ ID NO: 253904 - DNA, 25 bp, Rattus norvegicus
cctgaggtaagaattgggcatgcat

SEQ ID NO: 253905 - DNA, 25 bp, Rattus norvegicus
cctgaggtaagatttgggcatgcat

SEQ ID NO: 253906 - DNA, 25 bp, Rattus norvegicus
cctgaggtcactagttggaactgca

SEQ ID NO: 253907 - DNA, 25 bp, Rattus norvegicus
cctgaggtcacttgttggaactgca

SEQ ID NO: 253908 - DNA, 25 bp, Rattus norvegicus
cctgaggtccagagtgaggatccga

SEQ ID NO: 253909 - DNA, 25 bp, Rattus norvegicus
cctgaggtccagtgtgaggatccga

SEQ ID NO: 253910 - DNA, 25 bp, Rattus norvegicus
cctgaggtgcttcagacactataaa

SEQ ID NO: 253911 - DNA, 25 bp, Rattus norvegicus
cctgaggtgcttgagacactataaa

SEQ ID NO: 253912 - DNA, 25 bp, Rattus norvegicus
cctgagtactctcgtgggtttgttt

SEQ ID NO: 253913 - DNA, 25 bp, Rattus norvegicus
cctgagtactctggtgggtttgttt

SEQ ID NO: 253914 - DNA, 25 bp, Rattus norvegicus
cctgagtatggtatcgggagcgact

SEQ ID NO: 253915 - DNA, 25 bp, Rattus norvegicus
cctgagtatggtttcgggagcgact

SEQ ID NO: 253916 - DNA, 25 bp, Rattus norvegicus
cctgagtccaggcaggtttccgacg

SEQ ID NO: 253917 - DNA, 25 bp, Rattus norvegicus
cctgagtccagggaggtttccgacg

SEQ ID NO: 253918 - DNA, 25 bp, Rattus norvegicus
cctgagtgctggcaccgatggccac

SEQ ID NO: 253919 - DNA, 25 bp, Rattus norvegicus
cctgagtgctgggaccgatggccac

SEQ ID NO: 253920 - DNA, 25 bp, Rattus norvegicus
cctgagtggcaaatgaggacataga

SEQ ID NO: 253921 - DNA, 25 bp, Rattus norvegicus
cctgagtggcaattgaggacataga

SEQ ID NO: 253922 - DNA, 25 bp, Rattus norvegicus
cctgagtgtatacggtggtcacaat

SEQ ID NO: 253923 - DNA, 25 bp, Rattus norvegicus
cctgagtgtatagggtggtcacaat

SEQ ID NO: 253924 - DNA, 25 bp, Rattus norvegicus
cctgagtgtgagacatcctggtcaa

SEQ ID NO: 253925 - DNA, 25 bp, Rattus norvegicus
cctgagtgtgagtcatcctggtcaa

SEQ ID NO: 253926 - DNA, 25 bp, Rattus norvegicus
cctgagtttcagctgctgggagttt

SEQ ID NO: 253927 - DNA, 25 bp, Rattus norvegicus
cctgagtttcaggtgctgggagttt

SEQ ID NO: 253928 - DNA, 25 bp, Rattus norvegicus
cctgagtttctcagttcatctgtga

SEQ ID NO: 253929 - DNA, 25 bp, Rattus norvegicus
cctgagtttctctgttcatctgtga

SEQ ID NO: 253930 - DNA, 25 bp, Rattus norvegicus
cctgagtttgaacccagaacgtatg

SEQ ID NO: 253931 - DNA, 25 bp, Rattus norvegicus
cctgagtttgaagccagaacgtatg

SEQ ID NO: 253932 - DNA, 25 bp, Rattus norvegicus
cctgagtttttcaactcctatgcaa

SEQ ID NO: 253933 - DNA, 25 bp, Rattus norvegicus
cctgagtttttctactcctatgcaa

SEQ ID NO: 253934 - DNA, 25 bp, Rattus norvegicus
cctgatacttcccaaaaacacactt

SEQ ID NO: 253935 - DNA, 25 bp, Rattus norvegicus
cctgatacttccgaaaaacacactt

SEQ ID NO: 253936 - DNA, 25 bp, Rattus norvegicus
cctgatagatttcttgtggtctcaa

SEQ ID NO: 253937 - DNA, 25 bp, Rattus norvegicus
cctgatagatttgttgtggtctcaa

SEQ ID NO: 253938 - DNA, 25 bp, Rattus norvegicus
cctgataggcccaaagatgctgatt

SEQ ID NO: 253939 - DNA, 25 bp, Rattus norvegicus
cctgataggccctaagatgctgatt

SEQ ID NO: 253940 - DNA, 25 bp, Rattus norvegicus
cctgatattggtcctgtgtactctg

SEQ ID NO: 253941 - DNA, 25 bp, Rattus norvegicus
cctgatattggtgctgtgtactctg

SEQ ID NO: 253942 - DNA, 25 bp, Rattus norvegicus
cctgatccctgtctttgcagagtgt

SEQ ID NO: 253943 - DNA, 25 bp, Rattus norvegicus
cctgatccctgtgtttgcagagtgt

SEQ ID NO: 253944 - DNA, 25 bp, Rattus norvegicus
cctgatcctctacagtgagttccag

SEQ ID NO: 253945 - DNA, 25 bp, Rattus norvegicus
cctgatcctctagagtgagttccag

SEQ ID NO: 253946 - DNA, 25 bp, Rattus norvegicus
cctgatcctttcacttgctgatata

SEQ ID NO: 253947 - DNA, 25 bp, Rattus norvegicus
cctgatcctttctcttgctgatata

SEQ ID NO: 253948 - DNA, 25 bp, Rattus norvegicus
cctgatctcagtagcccgtggctgt

SEQ ID NO: 253949 - DNA, 25 bp, Rattus norvegicus
cctgatctcagttgcccgtggctgt

SEQ ID NO: 253950 - DNA, 25 bp, Rattus norvegicus
cctgatctctccattatgcttttaa

SEQ ID NO: 253951 - DNA, 25 bp, Rattus norvegicus
cctgatctctcctttatgcttttaa

SEQ ID NO: 253952 - DNA, 25 bp, Rattus norvegicus
cctgatctgatcctgttcctgcagt

SEQ ID NO: 253953 - DNA, 25 bp, Rattus norvegicus
cctgatctgatcgtgttcctgcagt

SEQ ID NO: 253954 - DNA, 25 bp, Rattus norvegicus
cctgatcttagaacagtggaagtgt

SEQ ID NO: 253955 - DNA, 25 bp, Rattus norvegicus
cctgatcttagatcagtggaagtgt

SEQ ID NO: 253956 - DNA, 25 bp, Rattus norvegicus
cctgatcttgagatggacctgctag

SEQ ID NO: 253957 - DNA, 25 bp, Rattus norvegicus
cctgatcttgagttggacctgctag

SEQ ID NO: 253958 - DNA, 25 bp, Rattus norvegicus
cctgatgactgcattgggctgagaa

SEQ ID NO: 253959 - DNA, 25 bp, Rattus norvegicus
cctgatgactgctttgggctgagaa

SEQ ID NO: 253960 - DNA, 25 bp, Rattus norvegicus
cctgatgatcagctgacccagaaga

SEQ ID NO: 253961 - DNA, 25 bp, Rattus norvegicus
cctgatgatcaggtgacccagaaga

SEQ ID NO: 253962 - DNA, 25 bp, Rattus norvegicus
cctgatgatcctccgcttgaagagt

SEQ ID NO: 253963 - DNA, 25 bp, Rattus norvegicus
cctgatgatcctgcgcttgaagagt

SEQ ID NO: 253964 - DNA, 25 bp, Rattus norvegicus
cctgatgatgagaagccaccacctg

SEQ ID NO: 253965 - DNA, 25 bp, Rattus norvegicus
cctgatgatgagtagccaccacctg

SEQ ID NO: 253966 - DNA, 25 bp, Rattus norvegicus
cctgatggcccacccagggtggaca

SEQ ID NO: 253967 - DNA, 25 bp, Rattus norvegicus
cctgatggcccagccagggtggaca

SEQ ID NO: 253968 - DNA, 25 bp, Rattus norvegicus
cctgatgggttgcttgtgtttctaa

SEQ ID NO: 253969 - DNA, 25 bp, Rattus norvegicus
cctgatgggttggttgtgtttctaa

SEQ ID NO: 253970 - DNA, 25 bp, Rattus norvegicus
cctgatggtgggatgtctcacctga

SEQ ID NO: 253971 - DNA, 25 bp, Rattus norvegicus
cctgatggtgggttgtctcacctga

SEQ ID NO: 253972 - DNA, 25 bp, Rattus norvegicus
cctgatgtcaggcattagagaaatg

SEQ ID NO: 253973 - DNA, 25 bp, Rattus norvegicus
cctgatgtcagggattagagaaatg

SEQ ID NO: 253974 - DNA, 25 bp, Rattus norvegicus
cctgattaccgcctgtggatgaaga

SEQ ID NO: 253975 - DNA, 25 bp, Rattus norvegicus
cctgattaccgcgtgtggatgaaga

SEQ ID NO: 253976 - DNA, 25 bp, Rattus norvegicus
cctgattacctacgttccatttcca

SEQ ID NO: 253977 - DNA, 25 bp, Rattus norvegicus
cctgattacctaggttccatttcca

SEQ ID NO: 253978 - DNA, 25 bp, Rattus norvegicus
cctgattccaggcactccatgtaga

SEQ ID NO: 253979 - DNA, 25 bp, Rattus norvegicus
cctgattccagggactccatgtaga

SEQ ID NO: 253980 - DNA, 25 bp, Rattus norvegicus
cctgattggcctcaacatgcatctg

SEQ ID NO: 253981 - DNA, 25 bp, Rattus norvegicus
cctgattggcctgaacatgcatctg

SEQ ID NO: 253982 - DNA, 25 bp, Rattus norvegicus
cctgattttgatcgatcggtggccc

SEQ ID NO: 253983 - DNA, 25 bp, Rattus norvegicus
cctgattttgatggatcggtggccc

SEQ ID NO: 253984 - DNA, 25 bp, Rattus norvegicus
cctgcaacccctacatttgtatgaa

SEQ ID NO: 253985 - DNA, 25 bp, Rattus norvegicus
cctgcaaccccttcatttgtatgaa

SEQ ID NO: 253986 - DNA, 25 bp, Rattus norvegicus
cctgcaagagccacacactggtgaa

SEQ ID NO: 253987 - DNA, 25 bp, Rattus norvegicus
cctgcaagagcctcacactggtgaa

SEQ ID NO: 253988 - DNA, 25 bp, Rattus norvegicus
cctgcaaggctgacaacagcctcgg

SEQ ID NO: 253989 - DNA, 25 bp, Rattus norvegicus
cctgcaaggctgtcaacagcctcgg

SEQ ID NO: 253990 - DNA, 25 bp, Rattus norvegicus
cctgcaaggtcaacggatgctgttt

SEQ ID NO: 253991 - DNA, 25 bp, Rattus norvegicus
cctgcaaggtcatcggatgctgttt

SEQ ID NO: 253992 - DNA, 25 bp, Rattus norvegicus
cctgcaagtgtactacagactgtgt

SEQ ID NO: 253993 - DNA, 25 bp, Rattus norvegicus
cctgcaagtgtagtacagactgtgt

SEQ ID NO: 253994 - DNA, 25 bp, Rattus norvegicus
cctgcacaatgcactggagagatgt

SEQ ID NO: 253995 - DNA, 25 bp, Rattus norvegicus
cctgcacaatgctctggagagatgt

SEQ ID NO: 253996 - DNA, 25 bp, Rattus norvegicus
cctgcacagactacctgaggagtgg

SEQ ID NO: 253997 - DNA, 25 bp, Rattus norvegicus
cctgcacagacttcctgaggagtgg

SEQ ID NO: 253998 - DNA, 25 bp, Rattus norvegicus
cctgcaccatttaacttgaccagtt

SEQ ID NO: 253999 - DNA, 25 bp, Rattus norvegicus
cctgcaccattttacttgaccagtt

SEQ ID NO: 254000 - DNA, 25 bp, Rattus norvegicus
cctgcaccgactcgaggttgagcca

SEQ ID NO: 254001 - DNA, 25 bp, Rattus norvegicus
cctgcaccgactggaggttgagcca

SEQ ID NO: 254002 - DNA, 25 bp, Rattus norvegicus
cctgcacgaccgaacgactgaagat

SEQ ID NO: 254003 - DNA, 25 bp, Rattus norvegicus
cctgcacgaccgtacgactgaagat

SEQ ID NO: 254004 - DNA, 25 bp, Rattus norvegicus
cctgcacgtgctcatgtctgttgag

SEQ ID NO: 254005 - DNA, 25 bp, Rattus norvegicus
cctgcacgtgctgatgtctgttgag

SEQ ID NO: 254006 - DNA, 25 bp, Rattus norvegicus
cctgcactcaataaaccctcaataa

SEQ ID NO: 254007 - DNA, 25 bp, Rattus norvegicus
cctgcactcaattaaccctcaataa

SEQ ID NO: 254008 - DNA, 25 bp, Rattus norvegicus
cctgcactgaccaggacactgctga

SEQ ID NO: 254009 - DNA, 25 bp, Rattus norvegicus
cctgcactgacctggacactgctga

SEQ ID NO: 254010 - DNA, 25 bp, Rattus norvegicus
cctgcacttctcagtggtatgggat

SEQ ID NO: 254011 - DNA, 25 bp, Rattus norvegicus
cctgcacttctctgtggtatgggat

SEQ ID NO: 254012 - DNA, 25 bp, Rattus norvegicus
cctgcacttgagcagcatggtggac

SEQ ID NO: 254013 - DNA, 25 bp, Rattus norvegicus
cctgcacttgaggagcatggtggac

SEQ ID NO: 254014 - DNA, 25 bp, Rattus norvegicus
cctgcacttttgaggacccaatagt

SEQ ID NO: 254015 - DNA, 25 bp, Rattus norvegicus
cctgcacttttgtggacccaatagt

SEQ ID NO: 254016 - DNA, 25 bp, Rattus norvegicus
cctgcagacactagcagccttaata

SEQ ID NO: 254017 - DNA, 25 bp, Rattus norvegicus
cctgcagacacttgcagccttaata

SEQ ID NO: 254018 - DNA, 25 bp, Rattus norvegicus
cctgcagagcagacatgagcgggaa

SEQ ID NO: 254019 - DNA, 25 bp, Rattus norvegicus
cctgcagagcagtcatgagcgggaa

SEQ ID NO: 254020 - DNA, 25 bp, Rattus norvegicus
cctgcagagctgacctgggaagcca

SEQ ID NO: 254021 - DNA, 25 bp, Rattus norvegicus
cctgcagagctgtcctgggaagcca

SEQ ID NO: 254022 - DNA, 25 bp, Rattus norvegicus
cctgcagaggccacgctgagtccga

SEQ ID NO: 254023 - DNA, 25 bp, Rattus norvegicus
cctgcagaggcctcgctgagtccga

SEQ ID NO: 254024 - DNA, 25 bp, Rattus norvegicus
cctgcagagggcacactacactgag

SEQ ID NO: 254025 - DNA, 25 bp, Rattus norvegicus
cctgcagagggctcactacactgag

SEQ ID NO: 254026 - DNA, 25 bp, Rattus norvegicus
cctgcagatcttatcctttggatgg

SEQ ID NO: 254027 - DNA, 25 bp, Rattus norvegicus
cctgcagatcttttcctttggatgg

SEQ ID NO: 254028 - DNA, 25 bp, Rattus norvegicus
cctgcagatgccatcatgtgtgtgg

SEQ ID NO: 254029 - DNA, 25 bp, Rattus norvegicus
cctgcagatgccttcatgtgtgtgg

SEQ ID NO: 254030 - DNA, 25 bp, Rattus norvegicus
cctgcagatgttcctgcattacggt

SEQ ID NO: 254031 - DNA, 25 bp, Rattus norvegicus
cctgcagatgttgctgcattacggt

SEQ ID NO: 254032 - DNA, 25 bp, Rattus norvegicus
cctgcagcacttagttttgggaaac

SEQ ID NO: 254033 - DNA, 25 bp, Rattus norvegicus
cctgcagcactttgttttgggaaac

SEQ ID NO: 254034 - DNA, 25 bp, Rattus norvegicus
cctgcagcccaactgttgctaggga

SEQ ID NO: 254035 - DNA, 25 bp, Rattus norvegicus
cctgcagcccaagtgttgctaggga

SEQ ID NO: 254036 - DNA, 25 bp, Rattus norvegicus
cctgcagcgcacacatgacgagatt

SEQ ID NO: 254037 - DNA, 25 bp, Rattus norvegicus
cctgcagcgcactcatgacgagatt

SEQ ID NO: 254038 - DNA, 25 bp, Rattus norvegicus
cctgcagctgcaaagtgagtaagaa

SEQ ID NO: 254039 - DNA, 25 bp, Rattus norvegicus
cctgcagctgcatagtgagtaagaa

SEQ ID NO: 254040 - DNA, 25 bp, Rattus norvegicus
cctgcagctggaatacgcaacagta

SEQ ID NO: 254041 - DNA, 25 bp, Rattus norvegicus
cctgcagctggattacgcaacagta

SEQ ID NO: 254042 - DNA, 25 bp, Rattus norvegicus
cctgcaggctgtcctagggccacgt

SEQ ID NO: 254043 - DNA, 25 bp, Rattus norvegicus
cctgcaggctgtgctagggccacgt

SEQ ID NO: 254044 - DNA, 25 bp, Rattus norvegicus
cctgcaggtcggagatcctgttgag

SEQ ID NO: 254045 - DNA, 25 bp, Rattus norvegicus
cctgcaggtcggtgatcctgttgag

SEQ ID NO: 254046 - DNA, 25 bp, Rattus norvegicus
cctgcagtcgcaccagtcgggtaga

SEQ ID NO: 254047 - DNA, 25 bp, Rattus norvegicus
cctgcagtcgcagcagtcgggtaga

SEQ ID NO: 254048 - DNA, 25 bp, Rattus norvegicus
cctgcagtctttagccacgatgaag

SEQ ID NO: 254049 - DNA, 25 bp, Rattus norvegicus
cctgcagtcttttgccacgatgaag

SEQ ID NO: 254050 - DNA, 25 bp, Rattus norvegicus
cctgcagtgggcactcagaaggtcc

SEQ ID NO: 254051 - DNA, 25 bp, Rattus norvegicus
cctgcagtgggctctcagaaggtcc

SEQ ID NO: 254052 - DNA, 25 bp, Rattus norvegicus
cctgcagttggtaggcgaagctcac

SEQ ID NO: 254053 - DNA, 25 bp, Rattus norvegicus
cctgcagttggttggcgaagctcac

SEQ ID NO: 254054 - DNA, 25 bp, Rattus norvegicus
cctgcatagggtccttggtagacta

SEQ ID NO: 254055 - DNA, 25 bp, Rattus norvegicus
cctgcatagggtgcttggtagacta

SEQ ID NO: 254056 - DNA, 25 bp, Rattus norvegicus
cctgcatcactcctaaattacaact

SEQ ID NO: 254057 - DNA, 25 bp, Rattus norvegicus
cctgcatcactcgtaaattacaact

SEQ ID NO: 254058 - DNA, 25 bp, Rattus norvegicus
cctgcatcccaacatgtcatgtgga

SEQ ID NO: 254059 - DNA, 25 bp, Rattus norvegicus
cctgcatcccaagatgtcatgtgga

SEQ ID NO: 254060 - DNA, 25 bp, Rattus norvegicus
cctgcatcctctacatagcattata

SEQ ID NO: 254061 - DNA, 25 bp, Rattus norvegicus
cctgcatcctcttcatagcattata

SEQ ID NO: 254062 - DNA, 25 bp, Rattus norvegicus
cctgcatcctgaattcgggtgagaa

SEQ ID NO: 254063 - DNA, 25 bp, Rattus norvegicus
cctgcatcctgatttcgggtgagaa

SEQ ID NO: 254064 - DNA, 25 bp, Rattus norvegicus
cctgcatctaccatttactgtgtat

SEQ ID NO: 254065 - DNA, 25 bp, Rattus norvegicus
cctgcatctaccttttactgtgtat

SEQ ID NO: 254066 - DNA, 25 bp, Rattus norvegicus
cctgcatctctgacttcctggacta

SEQ ID NO: 254067 - DNA, 25 bp, Rattus norvegicus
cctgcatctctgtcttcctggacta

SEQ ID NO: 254068 - DNA, 25 bp, Rattus norvegicus
cctgcatgatcgacgtgggtgagca

SEQ ID NO: 254069 - DNA, 25 bp, Rattus norvegicus
cctgcatgatcgtcgtgggtgagca

SEQ ID NO: 254070 - DNA, 25 bp, Rattus norvegicus
cctgcatgccagattaaattgttta

SEQ ID NO: 254071 - DNA, 25 bp, Rattus norvegicus
cctgcatgccagtttaaattgttta

SEQ ID NO: 254072 - DNA, 25 bp, Rattus norvegicus
cctgcatgctgcctgagataatatt

SEQ ID NO: 254073 - DNA, 25 bp, Rattus norvegicus
cctgcatgctgcgtgagataatatt

SEQ ID NO: 254074 - DNA, 25 bp, Rattus norvegicus
cctgcattatttcagggctgtaaaa

SEQ ID NO: 254075 - DNA, 25 bp, Rattus norvegicus
cctgcattatttgagggctgtaaaa

SEQ ID NO: 254076 - DNA, 25 bp, Rattus norvegicus
cctgccaagtgcagagactaaagat

SEQ ID NO: 254077 - DNA, 25 bp, Rattus norvegicus
cctgccaagtgctgagactaaagat

SEQ ID NO: 254078 - DNA, 25 bp, Rattus norvegicus
cctgccacagtaagggaagttcgct

SEQ ID NO: 254079 - DNA, 25 bp, Rattus norvegicus
cctgccacagtatgggaagttcgct

SEQ ID NO: 254080 - DNA, 25 bp, Rattus norvegicus
cctgccagatcacatcttcagttaa

SEQ ID NO: 254081 - DNA, 25 bp, Rattus norvegicus
cctgccagatcagatcttcagttaa

SEQ ID NO: 254082 - DNA, 25 bp, Rattus norvegicus
cctgccagcgttactagtagtatca

SEQ ID NO: 254083 - DNA, 25 bp, Rattus norvegicus
cctgccagcgtttctagtagtatca

SEQ ID NO: 254084 - DNA, 25 bp, Rattus norvegicus
cctgccagctggactttattggtaa

SEQ ID NO: 254085 - DNA, 25 bp, Rattus norvegicus
cctgccagctggtctttattggtaa

SEQ ID NO: 254086 - DNA, 25 bp, Rattus norvegicus
cctgccagctttcttaggcttcgag

SEQ ID NO: 254087 - DNA, 25 bp, Rattus norvegicus
cctgccagctttgttaggcttcgag

SEQ ID NO: 254088 - DNA, 25 bp, Rattus norvegicus
cctgccaggaatctcgtgtgggaaa

SEQ ID NO: 254089 - DNA, 25 bp, Rattus norvegicus
cctgccaggaatgtcgtgtgggaaa

SEQ ID NO: 254090 - DNA, 25 bp, Rattus norvegicus
cctgccatccagaaagtgaacaata

SEQ ID NO: 254091 - DNA, 25 bp, Rattus norvegicus
cctgccatccagtaagtgaacaata

SEQ ID NO: 254092 - DNA, 25 bp, Rattus norvegicus
cctgccatcccaccagggaggtgga

SEQ ID NO: 254093 - DNA, 25 bp, Rattus norvegicus
cctgccatcccagcagggaggtgga

SEQ ID NO: 254094 - DNA, 25 bp, Rattus norvegicus
cctgccatgaacatggattgtaatg

SEQ ID NO: 254095 - DNA, 25 bp, Rattus norvegicus
cctgccatgaacttggattgtaatg

SEQ ID NO: 254096 - DNA, 25 bp, Rattus norvegicus
cctgccatgtctctgaccataatga

SEQ ID NO: 254097 - DNA, 25 bp, Rattus norvegicus
cctgccatgtctgtgaccataatga

SEQ ID NO: 254098 - DNA, 25 bp, Rattus norvegicus
cctgccatgttcagccatggacagt

SEQ ID NO: 254099 - DNA, 25 bp, Rattus norvegicus
cctgccatgttctgccatggacagt

SEQ ID NO: 254100 - DNA, 25 bp, Rattus norvegicus
cctgcccaatacacagtgtgttttg

SEQ ID NO: 254101 - DNA, 25 bp, Rattus norvegicus
cctgcccaatactcagtgtgttttg

SEQ ID NO: 254102 - DNA, 25 bp, Rattus norvegicus
cctgcccagctaagaattccgtaga

SEQ ID NO: 254103 - DNA, 25 bp, Rattus norvegicus
cctgcccagctatgaattccgtaga

SEQ ID NO: 254104 - DNA, 25 bp, Rattus norvegicus
cctgcccaggcacgatgtggaggca

SEQ ID NO: 254105 - DNA, 25 bp, Rattus norvegicus
cctgcccaggcaggatgtggaggca

SEQ ID NO: 254106 - DNA, 25 bp, Rattus norvegicus
cctgcccagtccagcacttggaaag

SEQ ID NO: 254107 - DNA, 25 bp, Rattus norvegicus
cctgcccagtcctgcacttggaaag

SEQ ID NO: 254108 - DNA, 25 bp, Rattus norvegicus
cctgcccatcagaattttagtattt

SEQ ID NO: 254109 - DNA, 25 bp, Rattus norvegicus
cctgcccatcagtattttagtattt

SEQ ID NO: 254110 - DNA, 25 bp, Rattus norvegicus
cctgcccattgcattgtcactggaa

SEQ ID NO: 254111 - DNA, 25 bp, Rattus norvegicus
cctgcccattgctttgtcactggaa

SEQ ID NO: 254112 - DNA, 25 bp, Rattus norvegicus
cctgcccggcagagatcatgtattg

SEQ ID NO: 254113 - DNA, 25 bp, Rattus norvegicus
cctgcccggcagtgatcatgtattg

SEQ ID NO: 254114 - DNA, 25 bp, Rattus norvegicus
cctgccctaggaactcctgggtgga

SEQ ID NO: 254115 - DNA, 25 bp, Rattus norvegicus
cctgccctaggatctcctgggtgga

SEQ ID NO: 254116 - DNA, 25 bp, Rattus norvegicus
cctgccctatacaactttggtcaag

SEQ ID NO: 254117 - DNA, 25 bp, Rattus norvegicus
cctgccctatactactttggtcaag

SEQ ID NO: 254118 - DNA, 25 bp, Rattus norvegicus
cctgccctcaagatatctgattggt

SEQ ID NO: 254119 - DNA, 25 bp, Rattus norvegicus
cctgccctcaagttatctgattggt

SEQ ID NO: 254120 - DNA, 25 bp, Rattus norvegicus
cctgccctgctgagtatagatggaa

SEQ ID NO: 254121 - DNA, 25 bp, Rattus norvegicus
cctgccctgctgataagaacaggct

SEQ ID NO: 254122 - DNA, 25 bp, Rattus norvegicus
cctgccctgctgtgtatagatggaa

SEQ ID NO: 254123 - DNA, 25 bp, Rattus norvegicus
cctgccctgctgttaagaacaggct

SEQ ID NO: 254124 - DNA, 25 bp, Rattus norvegicus
cctgccctggcaagtgagagacaca

SEQ ID NO: 254125 - DNA, 25 bp, Rattus norvegicus
cctgccctggcatgtgagagacaca

SEQ ID NO: 254126 - DNA, 25 bp, Rattus norvegicus
cctgccctggctctgtagagctgga

SEQ ID NO: 254127 - DNA, 25 bp, Rattus norvegicus
cctgccctggctgtgtagagctgga

SEQ ID NO: 254128 - DNA, 25 bp, Rattus norvegicus
cctgccctgggcatgtaaatagtcc

SEQ ID NO: 254129 - DNA, 25 bp, Rattus norvegicus
cctgccctgggcttgtaaatagtcc

SEQ ID NO: 254130 - DNA, 25 bp, Rattus norvegicus
cctgccctgtgaacatgttctgtag

SEQ ID NO: 254131 - DNA, 25 bp, Rattus norvegicus
cctgccctgtgatcatgttctgtag

SEQ ID NO: 254132 - DNA, 25 bp, Rattus norvegicus
cctgccctgtgtacagtgtgttata

SEQ ID NO: 254133 - DNA, 25 bp, Rattus norvegicus
cctgccctgtgttcagtgtgttata

SEQ ID NO: 254134 - DNA, 25 bp, Rattus norvegicus
cctgcccttgtgataaactcatttg

SEQ ID NO: 254135 - DNA, 25 bp, Rattus norvegicus
cctgcccttgtgttaaactcatttg

SEQ ID NO: 254136 - DNA, 25 bp, Rattus norvegicus
cctgccgaccagagaacacggagct

SEQ ID NO: 254137 - DNA, 25 bp, Rattus norvegicus
cctgccgaccagtgaacacggagct

SEQ ID NO: 254138 - DNA, 25 bp, Rattus norvegicus
cctgccgaggtcacaggtgagctga

SEQ ID NO: 254139 - DNA, 25 bp, Rattus norvegicus
cctgccgaggtctcaggtgagctga

SEQ ID NO: 254140 - DNA, 25 bp, Rattus norvegicus
cctgccgagtttagttgttttctgt

SEQ ID NO: 254141 - DNA, 25 bp, Rattus norvegicus
cctgccgagttttgttgttttctgt

SEQ ID NO: 254142 - DNA, 25 bp, Rattus norvegicus
cctgccgcatctccgatgactttgg

SEQ ID NO: 254143 - DNA, 25 bp, Rattus norvegicus
cctgccgcatctgcgatgactttgg

SEQ ID NO: 254144 - DNA, 25 bp, Rattus norvegicus
cctgccgccatgattcctgatgtga

SEQ ID NO: 254145 - DNA, 25 bp, Rattus norvegicus
cctgccgccatgtttcctgatgtga

SEQ ID NO: 254146 - DNA, 25 bp, Rattus norvegicus
cctgcctaaaacaacttctgggatt

SEQ ID NO: 254147 - DNA, 25 bp, Rattus norvegicus
cctgcctaaaactacttctgggatt

SEQ ID NO: 254148 - DNA, 25 bp, Rattus norvegicus
cctgcctaagccagggctgtattgt

SEQ ID NO: 254149 - DNA, 25 bp, Rattus norvegicus
cctgcctaagcctgggctgtattgt

SEQ ID NO: 254150 - DNA, 25 bp, Rattus norvegicus
cctgcctaggctcaagtacatgttt

SEQ ID NO: 254151 - DNA, 25 bp, Rattus norvegicus
cctgcctaggctgaagtacatgttt

SEQ ID NO: 254152 - DNA, 25 bp, Rattus norvegicus
cctgcctagttgaggcctggcctgg

SEQ ID NO: 254153 - DNA, 25 bp, Rattus norvegicus
cctgcctagttgtggcctggcctgg

SEQ ID NO: 254154 - DNA, 25 bp, Rattus norvegicus
cctgcctatcagctgaggaactcga

SEQ ID NO: 254155 - DNA, 25 bp, Rattus norvegicus
cctgcctatcaggtgaggaactcga

SEQ ID NO: 254156 - DNA, 25 bp, Rattus norvegicus
cctgcctcacatcatttgcgagtag

SEQ ID NO: 254157 - DNA, 25 bp, Rattus norvegicus
cctgcctcacatgatttgcgagtag

SEQ ID NO: 254158 - DNA, 25 bp, Rattus norvegicus
cctgcctcagttcctaaatgctaga

SEQ ID NO: 254159 - DNA, 25 bp, Rattus norvegicus
cctgcctcagttgctaaatgctaga

SEQ ID NO: 254160 - DNA, 25 bp, Rattus norvegicus
cctgcctcatgtactttagctgttt

SEQ ID NO: 254161 - DNA, 25 bp, Rattus norvegicus
cctgcctcatgttctttagctgttt

SEQ ID NO: 254162 - DNA, 25 bp, Rattus norvegicus
cctgcctccaggacttggtggaaga

SEQ ID NO: 254163 - DNA, 25 bp, Rattus norvegicus
cctgcctccaggtcttggtggaaga

SEQ ID NO: 254164 - DNA, 25 bp, Rattus norvegicus
cctgcctccagtattattgcttgaa

SEQ ID NO: 254165 - DNA, 25 bp, Rattus norvegicus
cctgcctccagttttattgcttgaa

SEQ ID NO: 254166 - DNA, 25 bp, Rattus norvegicus
cctgcctctgctctgaattaacttg

SEQ ID NO: 254167 - DNA, 25 bp, Rattus norvegicus
cctgcctctgctgtgaattaacttg

SEQ ID NO: 254168 - DNA, 25 bp, Rattus norvegicus
cctgcctctggcagctataaatatg

SEQ ID NO: 254169 - DNA, 25 bp, Rattus norvegicus
cctgcctctggctgctataaatatg

SEQ ID NO: 254170 - DNA, 25 bp, Rattus norvegicus
cctgcctcttccatggtaatgaata

SEQ ID NO: 254171 - DNA, 25 bp, Rattus norvegicus
cctgcctcttccttggtaatgaata

SEQ ID NO: 254172 - DNA, 25 bp, Rattus norvegicus
cctgcctcttgcattcttgaaatgg

SEQ ID NO: 254173 - DNA, 25 bp, Rattus norvegicus
cctgcctcttgctttcttgaaatgg

SEQ ID NO: 254174 - DNA, 25 bp, Rattus norvegicus
cctgcctgaatcatccaagtgttgg

SEQ ID NO: 254175 - DNA, 25 bp, Rattus norvegicus
cctgcctgaatcttccaagtgttgg

SEQ ID NO: 254176 - DNA, 25 bp, Rattus norvegicus
cctgcctgagagctggaacctgaga

SEQ ID NO: 254177 - DNA, 25 bp, Rattus norvegicus
cctgcctgagaggtggaacctgaga

SEQ ID NO: 254178 - DNA, 25 bp, Rattus norvegicus
cctgcctgagcacagggttccttaa

SEQ ID NO: 254179 - DNA, 25 bp, Rattus norvegicus
cctgcctgagcagagggttccttaa

SEQ ID NO: 254180 - DNA, 25 bp, Rattus norvegicus
cctgcctgagccatctgagtagtag

SEQ ID NO: 254181 - DNA, 25 bp, Rattus norvegicus
cctgcctgagccttctgagtagtag

SEQ ID NO: 254182 - DNA, 25 bp, Rattus norvegicus
cctgcctgatgactttgttgggaca

SEQ ID NO: 254183 - DNA, 25 bp, Rattus norvegicus
cctgcctgatgagtttgttgggaca

SEQ ID NO: 254184 - DNA, 25 bp, Rattus norvegicus
cctgcctgcaggactatttgcagat

SEQ ID NO: 254185 - DNA, 25 bp, Rattus norvegicus
cctgcctgcaggtctatttgcagat

SEQ ID NO: 254186 - DNA, 25 bp, Rattus norvegicus
cctgcctgcatgagtcctaaggtaa

SEQ ID NO: 254187 - DNA, 25 bp, Rattus norvegicus
cctgcctgcatgtgtcctaaggtaa

SEQ ID NO: 254188 - DNA, 25 bp, Rattus norvegicus
cctgcctggcctatttacactggaa

SEQ ID NO: 254189 - DNA, 25 bp, Rattus norvegicus
cctgcctggcctttttacactggaa

SEQ ID NO: 254190 - DNA, 25 bp, Rattus norvegicus
cctgcctgggatatctagcatcaaa

SEQ ID NO: 254191 - DNA, 25 bp, Rattus norvegicus
cctgcctgggatttctagcatcaaa

SEQ ID NO: 254192 - DNA, 25 bp, Rattus norvegicus
cctgcctgggcaatggacagtctat

SEQ ID NO: 254193 - DNA, 25 bp, Rattus norvegicus
cctgcctgggcattggacagtctat

SEQ ID NO: 254194 - DNA, 25 bp, Rattus norvegicus
cctgcctgtaatcttgggacttggg

SEQ ID NO: 254195 - DNA, 25 bp, Rattus norvegicus
cctgcctgtaatgttgggacttggg

SEQ ID NO: 254196 - DNA, 25 bp, Rattus norvegicus
cctgcctgtcatcatttgcttcttt

SEQ ID NO: 254197 - DNA, 25 bp, Rattus norvegicus
cctgcctgtcatgatttgcttcttt

SEQ ID NO: 254198 - DNA, 25 bp, Rattus norvegicus
cctgcctgtcttcattgtcttaaac

SEQ ID NO: 254199 - DNA, 25 bp, Rattus norvegicus
cctgcctgtcttgattgtcttaaac

SEQ ID NO: 254200 - DNA, 25 bp, Rattus norvegicus
cctgcctgtggactatgagatcgaa

SEQ ID NO: 254201 - DNA, 25 bp, Rattus norvegicus
cctgcctgtggagtatgagatcgaa

SEQ ID NO: 254202 - DNA, 25 bp, Rattus norvegicus
cctgccttaggaagatgtacgggag

SEQ ID NO: 254203 - DNA, 25 bp, Rattus norvegicus
cctgccttaggatgatgtacgggag

SEQ ID NO: 254204 - DNA, 25 bp, Rattus norvegicus
cctgccttagggatctttgcttaca

SEQ ID NO: 254205 - DNA, 25 bp, Rattus norvegicus
cctgccttagggttctttgcttaca

SEQ ID NO: 254206 - DNA, 25 bp, Rattus norvegicus
cctgccttcagaagcttctgtatga

SEQ ID NO: 254207 - DNA, 25 bp, Rattus norvegicus
cctgccttcagatgcttctgtatga

SEQ ID NO: 254208 - DNA, 25 bp, Rattus norvegicus
cctgccttcatgctttggaatcttt

SEQ ID NO: 254209 - DNA, 25 bp, Rattus norvegicus
cctgccttcatggtttggaatcttt

SEQ ID NO: 254210 - DNA, 25 bp, Rattus norvegicus
cctgccttcgttctgtgtagattga

SEQ ID NO: 254211 - DNA, 25 bp, Rattus norvegicus
cctgccttcgttgtgtgtagattga

SEQ ID NO: 254212 - DNA, 25 bp, Rattus norvegicus
cctgccttctttctttgaataccag

SEQ ID NO: 254213 - DNA, 25 bp, Rattus norvegicus
cctgccttctttgtttgaataccag

SEQ ID NO: 254214 - DNA, 25 bp, Rattus norvegicus
cctgccttgatactgaagaatctgt

SEQ ID NO: 254215 - DNA, 25 bp, Rattus norvegicus
cctgccttgatagtgaagaatctgt

SEQ ID NO: 254216 - DNA, 25 bp, Rattus norvegicus
cctgccttgatgctaatgaactaac

SEQ ID NO: 254217 - DNA, 25 bp, Rattus norvegicus
cctgccttgatggtaatgaactaac

SEQ ID NO: 254218 - DNA, 25 bp, Rattus norvegicus
cctgcctttaagaagcctcctaata

SEQ ID NO: 254219 - DNA, 25 bp, Rattus norvegicus
cctgcctttaagtagcctcctaata

SEQ ID NO: 254220 - DNA, 25 bp, Rattus norvegicus
cctgcctttcagagagagacatttt

SEQ ID NO: 254221 - DNA, 25 bp, Rattus norvegicus
cctgcctttcagtgagagacatttt

SEQ ID NO: 254222 - DNA, 25 bp, Rattus norvegicus
cctgccttttctcttgtatattaag

SEQ ID NO: 254223 - DNA, 25 bp, Rattus norvegicus
cctgccttttctgttgtatattaag

SEQ ID NO: 254224 - DNA, 25 bp, Rattus norvegicus
cctgcgatatctctgcaggagtgct

SEQ ID NO: 254225 - DNA, 25 bp, Rattus norvegicus
cctgcgatatctgtgcaggagtgct

SEQ ID NO: 254226 - DNA, 25 bp, Rattus norvegicus
cctgcgatcggcagccagagaagca

SEQ ID NO: 254227 - DNA, 25 bp, Rattus norvegicus
cctgcgatcggctgccagagaagca

SEQ ID NO: 254228 - DNA, 25 bp, Rattus norvegicus
cctgcgatctgtatttcctgagaga

SEQ ID NO: 254229 - DNA, 25 bp, Rattus norvegicus
cctgcgatctgtttttcctgagaga

SEQ ID NO: 254230 - DNA, 25 bp, Rattus norvegicus
cctgcgcacggcaattgttggcaca

SEQ ID NO: 254231 - DNA, 25 bp, Rattus norvegicus
cctgcgcacggctattgttggcaca

SEQ ID NO: 254232 - DNA, 25 bp, Rattus norvegicus
cctgcgcagtggataaatcctgtct

SEQ ID NO: 254233 - DNA, 25 bp, Rattus norvegicus
cctgcgcagtggttaaatcctgtct

SEQ ID NO: 254234 - DNA, 25 bp, Rattus norvegicus
cctgcgccgatcataagatttccat

SEQ ID NO: 254235 - DNA, 25 bp, Rattus norvegicus
cctgcgccgatcttaagatttccat

SEQ ID NO: 254236 - DNA, 25 bp, Rattus norvegicus
cctgcgccgcggctatgagcaatac

SEQ ID NO: 254237 - DNA, 25 bp, Rattus norvegicus
cctgcgccgcgggtatgagcaatac

SEQ ID NO: 254238 - DNA, 25 bp, Rattus norvegicus
cctgcgcgtccgacattttgaggga

SEQ ID NO: 254239 - DNA, 25 bp, Rattus norvegicus
cctgcgcgtccgtcattttgaggga

SEQ ID NO: 254240 - DNA, 25 bp, Rattus norvegicus
cctgcggacgctcgtttgtgagcac

SEQ ID NO: 254241 - DNA, 25 bp, Rattus norvegicus
cctgcggacgctggtttgtgagcac

SEQ ID NO: 254242 - DNA, 25 bp, Rattus norvegicus
cctgcggagggacagcgcggttcgc

SEQ ID NO: 254243 - DNA, 25 bp, Rattus norvegicus
cctgcggagggagagcgcggttcgc

SEQ ID NO: 254244 - DNA, 25 bp, Rattus norvegicus
cctgcggcagggaaggtccctcaag

SEQ ID NO: 254245 - DNA, 25 bp, Rattus norvegicus
cctgcggcagggtaggtccctcaag

SEQ ID NO: 254246 - DNA, 25 bp, Rattus norvegicus
cctgcgggcaggacagattttgagt

SEQ ID NO: 254247 - DNA, 25 bp, Rattus norvegicus
cctgcgggcaggtcagattttgagt

SEQ ID NO: 254248 - DNA, 25 bp, Rattus norvegicus
cctgcggtcaacactgtcatttatt

SEQ ID NO: 254249 - DNA, 25 bp, Rattus norvegicus
cctgcggtcaactctgtcatttatt

SEQ ID NO: 254250 - DNA, 25 bp, Rattus norvegicus
cctgcggtcagcatatgcctatgga

SEQ ID NO: 254251 - DNA, 25 bp, Rattus norvegicus
cctgcggtcagcttatgcctatgga

SEQ ID NO: 254252 - DNA, 25 bp, Rattus norvegicus
cctgcggtgcctcgtgtagttgttc

SEQ ID NO: 254253 - DNA, 25 bp, Rattus norvegicus
cctgcggtgcctggtgtagttgttc

SEQ ID NO: 254254 - DNA, 25 bp, Rattus norvegicus
cctgcggttcagaactgggtgcaag

SEQ ID NO: 254255 - DNA, 25 bp, Rattus norvegicus
cctgcggttcagtactgggtgcaag

SEQ ID NO: 254256 - DNA, 25 bp, Rattus norvegicus
cctgcgtctagcagagatgctgact

SEQ ID NO: 254257 - DNA, 25 bp, Rattus norvegicus
cctgcgtctagctgagatgctgact

SEQ ID NO: 254258 - DNA, 25 bp, Rattus norvegicus
cctgcgtggccaaagtgctgggcca

SEQ ID NO: 254259 - DNA, 25 bp, Rattus norvegicus
cctgcgtggccatagtgctgggcca

SEQ ID NO: 254260 - DNA, 25 bp, Rattus norvegicus
cctgcgtgggcgacaggtggatcat

SEQ ID NO: 254261 - DNA, 25 bp, Rattus norvegicus
cctgcgtgggcgtcaggtggatcat

SEQ ID NO: 254262 - DNA, 25 bp, Rattus norvegicus
cctgcgttatttatgctatgctgct

SEQ ID NO: 254263 - DNA, 25 bp, Rattus norvegicus
cctgcgttatttttgctatgctgct

SEQ ID NO: 254264 - DNA, 25 bp, Rattus norvegicus
cctgcgtttgaaatctctcacgtta

SEQ ID NO: 254265 - DNA, 25 bp, Rattus norvegicus
cctgcgtttgaattctctcacgtta

SEQ ID NO: 254266 - DNA, 25 bp, Rattus norvegicus
cctgctaatagaaggttgctgttgt

SEQ ID NO: 254267 - DNA, 25 bp, Rattus norvegicus
cctgctaatagatggttgctgttgt

SEQ ID NO: 254268 - DNA, 25 bp, Rattus norvegicus
cctgctacatcactggcgatgttcg

SEQ ID NO: 254269 - DNA, 25 bp, Rattus norvegicus
cctgctacatcagtggcgatgttcg

SEQ ID NO: 254270 - DNA, 25 bp, Rattus norvegicus
cctgctaccttaagaagaccggctt

SEQ ID NO: 254271 - DNA, 25 bp, Rattus norvegicus
cctgctaccttatgaagaccggctt

SEQ ID NO: 254272 - DNA, 25 bp, Rattus norvegicus
cctgctagccgtcacatcgaagtga

SEQ ID NO: 254273 - DNA, 25 bp, Rattus norvegicus
cctgctagccgtgacatcgaagtga

SEQ ID NO: 254274 - DNA, 25 bp, Rattus norvegicus
cctgctatatctactgtacttgtca

SEQ ID NO: 254275 - DNA, 25 bp, Rattus norvegicus
cctgctatatcttctgtacttgtca

SEQ ID NO: 254276 - DNA, 25 bp, Rattus norvegicus
cctgctatctctcaagttaccttga

SEQ ID NO: 254277 - DNA, 25 bp, Rattus norvegicus
cctgctatctctgaagttaccttga

SEQ ID NO: 254278 - DNA, 25 bp, Rattus norvegicus
cctgctatgcctcgaattctgttgt

SEQ ID NO: 254279 - DNA, 25 bp, Rattus norvegicus
cctgctatgcctggaattctgttgt

SEQ ID NO: 254280 - DNA, 25 bp, Rattus norvegicus
cctgctattattagggtttgtctta

SEQ ID NO: 254281 - DNA, 25 bp, Rattus norvegicus
cctgctattatttgggtttgtctta

SEQ ID NO: 254282 - DNA, 25 bp, Rattus norvegicus
cctgctcaatgtaaagatggctctt

SEQ ID NO: 254283 - DNA, 25 bp, Rattus norvegicus
cctgctcaatgttaagatggctctt

SEQ ID NO: 254284 - DNA, 25 bp, Rattus norvegicus
cctgctcagcatctgtcagtggaag

SEQ ID NO: 254285 - DNA, 25 bp, Rattus norvegicus
cctgctcagcatgtgtcagtggaag

SEQ ID NO: 254286 - DNA, 25 bp, Rattus norvegicus
cctgctcagggacttggtatctaaa

SEQ ID NO: 254287 - DNA, 25 bp, Rattus norvegicus
cctgctcagggagttggtatctaaa

SEQ ID NO: 254288 - DNA, 25 bp, Rattus norvegicus
cctgctcagtggcatggcccagaag

SEQ ID NO: 254289 - DNA, 25 bp, Rattus norvegicus
cctgctcagtgggatggcccagaag

SEQ ID NO: 254290 - DNA, 25 bp, Rattus norvegicus
cctgctcatggcaggtgcacagaaa

SEQ ID NO: 254291 - DNA, 25 bp, Rattus norvegicus
cctgctcatggctggtgcacagaaa

SEQ ID NO: 254292 - DNA, 25 bp, Rattus norvegicus
cctgctccagaacgtgtggcaaagt

SEQ ID NO: 254293 - DNA, 25 bp, Rattus norvegicus
cctgctccagaaggtgtggcaaagt

SEQ ID NO: 254294 - DNA, 25 bp, Rattus norvegicus
cctgctccagttattatgcctataa

SEQ ID NO: 254295 - DNA, 25 bp, Rattus norvegicus
cctgctccagtttttatgcctataa

SEQ ID NO: 254296 - DNA, 25 bp, Rattus norvegicus
cctgctcccacaatagatctttcta

SEQ ID NO: 254297 - DNA, 25 bp, Rattus norvegicus
cctgctcccacattagatctttcta

SEQ ID NO: 254298 - DNA, 25 bp, Rattus norvegicus
cctgctcccatacccaggtttggtt

SEQ ID NO: 254299 - DNA, 25 bp, Rattus norvegicus
cctgctcccatagccaggtttggtt

SEQ ID NO: 254300 - DNA, 25 bp, Rattus norvegicus
cctgctcccttcattattagttgta

SEQ ID NO: 254301 - DNA, 25 bp, Rattus norvegicus
cctgctcccttctttattagttgta

SEQ ID NO: 254302 - DNA, 25 bp, Rattus norvegicus
cctgctcctaatactcaaagcggga

SEQ ID NO: 254303 - DNA, 25 bp, Rattus norvegicus
cctgctcctaattctcaaagcggga

SEQ ID NO: 254304 - DNA, 25 bp, Rattus norvegicus
cctgctcctcaaacattttggcata

SEQ ID NO: 254305 - DNA, 25 bp, Rattus norvegicus
cctgctcctcaatcattttggcata

SEQ ID NO: 254306 - DNA, 25 bp, Rattus norvegicus
cctgctcctgaacactcaagtttaa

SEQ ID NO: 254307 - DNA, 25 bp, Rattus norvegicus
cctgctcctgaagactcaagtttaa

SEQ ID NO: 254308 - DNA, 25 bp, Rattus norvegicus
cctgctcgtattcgatcctgttgaa

SEQ ID NO: 254309 - DNA, 25 bp, Rattus norvegicus
cctgctcgtattggatcctgttgaa

SEQ ID NO: 254310 - DNA, 25 bp, Rattus norvegicus
cctgctcgttctattgttaacgtgg

SEQ ID NO: 254311 - DNA, 25 bp, Rattus norvegicus
cctgctcgttcttttgttaacgtgg

SEQ ID NO: 254312 - DNA, 25 bp, Rattus norvegicus
cctgctctacatagtatatttcaga

SEQ ID NO: 254313 - DNA, 25 bp, Rattus norvegicus
cctgctctacattgtatatttcaga

SEQ ID NO: 254314 - DNA, 25 bp, Rattus norvegicus
cctgctctatgcatactggactatg

SEQ ID NO: 254315 - DNA, 25 bp, Rattus norvegicus
cctgctctatgcttactggactatg

SEQ ID NO: 254316 - DNA, 25 bp, Rattus norvegicus
cctgctctcaggacagcaccagagg

SEQ ID NO: 254317 - DNA, 25 bp, Rattus norvegicus
cctgctctcaggtcagcaccagagg

SEQ ID NO: 254318 - DNA, 25 bp, Rattus norvegicus
cctgctctctgaatttgtaaactcc

SEQ ID NO: 254319 - DNA, 25 bp, Rattus norvegicus
cctgctctctgattttgtaaactcc

SEQ ID NO: 254320 - DNA, 25 bp, Rattus norvegicus
cctgctctggtgacacccatttgaa

SEQ ID NO: 254321 - DNA, 25 bp, Rattus norvegicus
cctgctctggtgtcacccatttgaa

SEQ ID NO: 254322 - DNA, 25 bp, Rattus norvegicus
cctgctcttcgtaggactcctgaat

SEQ ID NO: 254323 - DNA, 25 bp, Rattus norvegicus
cctgctcttcgttggactcctgaat

SEQ ID NO: 254324 - DNA, 25 bp, Rattus norvegicus
cctgctctttgcaggctatgatgac

SEQ ID NO: 254325 - DNA, 25 bp, Rattus norvegicus
cctgctctttgctggctatgatgac

SEQ ID NO: 254326 - DNA, 25 bp, Rattus norvegicus
cctgctgaataaactaactgacccc

SEQ ID NO: 254327 - DNA, 25 bp, Rattus norvegicus
cctgctgaataatctaactgacccc

SEQ ID NO: 254328 - DNA, 25 bp, Rattus norvegicus
cctgctgactgcattctgagaacca

SEQ ID NO: 254329 - DNA, 25 bp, Rattus norvegicus
cctgctgactgctttctgagaacca

SEQ ID NO: 254330 - DNA, 25 bp, Rattus norvegicus
cctgctgagggcctaataattctat

SEQ ID NO: 254331 - DNA, 25 bp, Rattus norvegicus
cctgctgagggcgtaataattctat

SEQ ID NO: 254332 - DNA, 25 bp, Rattus norvegicus
cctgctgagtgtctatgaatttgct

SEQ ID NO: 254333 - DNA, 25 bp, Rattus norvegicus
cctgctgagtgtgtatgaatttgct

SEQ ID NO: 254334 - DNA, 25 bp, Rattus norvegicus
cctgctgccattcccattggtataa

SEQ ID NO: 254335 - DNA, 25 bp, Rattus norvegicus
cctgctgccattgccattggtataa

SEQ ID NO: 254336 - DNA, 25 bp, Rattus norvegicus
cctgctgcctgactgatattggcta

SEQ ID NO: 254337 - DNA, 25 bp, Rattus norvegicus
cctgctgcctgagtgatattggcta

SEQ ID NO: 254338 - DNA, 25 bp, Rattus norvegicus
cctgctgcctgtatagctttgtcta

SEQ ID NO: 254339 - DNA, 25 bp, Rattus norvegicus
cctgctgcctgtttagctttgtcta

SEQ ID NO: 254340 - DNA, 25 bp, Rattus norvegicus
cctgctgcctttctcatatttagaa

SEQ ID NO: 254341 - DNA, 25 bp, Rattus norvegicus
cctgctgcctttgtcatatttagaa

SEQ ID NO: 254342 - DNA, 25 bp, Rattus norvegicus
cctgctgctcggaacactgttaatt

SEQ ID NO: 254343 - DNA, 25 bp, Rattus norvegicus
cctgctgctcggtacactgttaatt

SEQ ID NO: 254344 - DNA, 25 bp, Rattus norvegicus
cctgctgcttctcatatgtggtcca

SEQ ID NO: 254345 - DNA, 25 bp, Rattus norvegicus
cctgctgcttctgatatgtggtcca

SEQ ID NO: 254346 - DNA, 25 bp, Rattus norvegicus
cctgctggaaatatgtggaactgct

SEQ ID NO: 254347 - DNA, 25 bp, Rattus norvegicus
cctgctggaaatttgtggaactgct

SEQ ID NO: 254348 - DNA, 25 bp, Rattus norvegicus
cctgctggaaccaccatgtgaacag

SEQ ID NO: 254349 - DNA, 25 bp, Rattus norvegicus
cctgctggaacctccatgtgaacag

SEQ ID NO: 254350 - DNA, 25 bp, Rattus norvegicus
cctgctggaataattggcctatcat

SEQ ID NO: 254351 - DNA, 25 bp, Rattus norvegicus
cctgctggaatatttggcctatcat

SEQ ID NO: 254352 - DNA, 25 bp, Rattus norvegicus
cctgctggaccccttgatgaaattc

SEQ ID NO: 254353 - DNA, 25 bp, Rattus norvegicus
cctgctggacccgttgatgaaattc

SEQ ID NO: 254354 - DNA, 25 bp, Rattus norvegicus
cctgctggacctcaacgagatgtag

SEQ ID NO: 254355 - DNA, 25 bp, Rattus norvegicus
cctgctggacctgaacgagatgtag

SEQ ID NO: 254356 - DNA, 25 bp, Rattus norvegicus
cctgctggccagcaggagaagaatt

SEQ ID NO: 254357 - DNA, 25 bp, Rattus norvegicus
cctgctggccaggaggagaagaatt

SEQ ID NO: 254358 - DNA, 25 bp, Rattus norvegicus
cctgctggcctgagttgtatgtgat

SEQ ID NO: 254359 - DNA, 25 bp, Rattus norvegicus
cctgctggcctgctgaacgtagtga

SEQ ID NO: 254360 - DNA, 25 bp, Rattus norvegicus
cctgctggcctggtgaacgtagtga

SEQ ID NO: 254361 - DNA, 25 bp, Rattus norvegicus
cctgctggcctgtgttgtatgtgat

SEQ ID NO: 254362 - DNA, 25 bp, Rattus norvegicus
cctgctgggtaaaggcttggttact

SEQ ID NO: 254363 - DNA, 25 bp, Rattus norvegicus
cctgctgggtaatggcttggttact

SEQ ID NO: 254364 - DNA, 25 bp, Rattus norvegicus
cctgctggtcacatttgtgttctaa

SEQ ID NO: 254365 - DNA, 25 bp, Rattus norvegicus
cctgctggtcacttttgtgttctaa

SEQ ID NO: 254366 - DNA, 25 bp, Rattus norvegicus
cctgctggtcccagatcaaatgcac

SEQ ID NO: 254367 - DNA, 25 bp, Rattus norvegicus
cctgctggtccctgatcaaatgcac

SEQ ID NO: 254368 - DNA, 25 bp, Rattus norvegicus
cctgctggtctgacatgtgtttgga

SEQ ID NO: 254369 - DNA, 25 bp, Rattus norvegicus
cctgctggtctgtcatgtgtttgga

SEQ ID NO: 254370 - DNA, 25 bp, Rattus norvegicus
cctgctggtgtcaacacttggtgag

SEQ ID NO: 254371 - DNA, 25 bp, Rattus norvegicus
cctgctggtgtctacacttggtgag

SEQ ID NO: 254372 - DNA, 25 bp, Rattus norvegicus
cctgctgtaccgaggtgatgtggtc

SEQ ID NO: 254373 - DNA, 25 bp, Rattus norvegicus
cctgctgtaccgtggtgatgtggtc

SEQ ID NO: 254374 - DNA, 25 bp, Rattus norvegicus
cctgctgtagggactgttaaatctc

SEQ ID NO: 254375 - DNA, 25 bp, Rattus norvegicus
cctgctgtagggtctgttaaatctc

SEQ ID NO: 254376 - DNA, 25 bp, Rattus norvegicus
cctgctgtatatccctccattgtat

SEQ ID NO: 254377 - DNA, 25 bp, Rattus norvegicus
cctgctgtatatgcctccattgtat

SEQ ID NO: 254378 - DNA, 25 bp, Rattus norvegicus
cctgctgtccggctccaaggagaag

SEQ ID NO: 254379 - DNA, 25 bp, Rattus norvegicus
cctgctgtccgggtccaaggagaag

SEQ ID NO: 254380 - DNA, 25 bp, Rattus norvegicus
cctgctgtctttctttcgaattcta

SEQ ID NO: 254381 - DNA, 25 bp, Rattus norvegicus
cctgctgtctttgtttcgaattcta

SEQ ID NO: 254382 - DNA, 25 bp, Rattus norvegicus
cctgctgtgctgcatggcatggact

SEQ ID NO: 254383 - DNA, 25 bp, Rattus norvegicus
cctgctgtgctggatggcatggact

SEQ ID NO: 254384 - DNA, 25 bp, Rattus norvegicus
cctgctgttgctcctttgacaaaag

SEQ ID NO: 254385 - DNA, 25 bp, Rattus norvegicus
cctgctgttgctgctttgacaaaag

SEQ ID NO: 254386 - DNA, 25 bp, Rattus norvegicus
cctgcttaccaaccatctagatgtg

SEQ ID NO: 254387 - DNA, 25 bp, Rattus norvegicus
cctgcttaccaagcatctagatgtg

SEQ ID NO: 254388 - DNA, 25 bp, Rattus norvegicus
cctgcttacggaaagttttcttcat

SEQ ID NO: 254389 - DNA, 25 bp, Rattus norvegicus
cctgcttacggatagttttcttcat

SEQ ID NO: 254390 - DNA, 25 bp, Rattus norvegicus
cctgcttacttcatattgggtgttt

SEQ ID NO: 254391 - DNA, 25 bp, Rattus norvegicus
cctgcttacttcttattgggtgttt

SEQ ID NO: 254392 - DNA, 25 bp, Rattus norvegicus
cctgcttatattccctggtgcttga

SEQ ID NO: 254393 - DNA, 25 bp, Rattus norvegicus
cctgcttatattgcctggtgcttga

SEQ ID NO: 254394 - DNA, 25 bp, Rattus norvegicus
cctgcttcccttagtaattactaag

SEQ ID NO: 254395 - DNA, 25 bp, Rattus norvegicus
cctgcttccctttgtaattactaag

SEQ ID NO: 254396 - DNA, 25 bp, Rattus norvegicus
cctgcttcgcacacattcatttgaa

SEQ ID NO: 254397 - DNA, 25 bp, Rattus norvegicus
cctgcttcgcactcattcatttgaa

SEQ ID NO: 254398 - DNA, 25 bp, Rattus norvegicus
cctgcttcgctcagtggacgttaaa

SEQ ID NO: 254399 - DNA, 25 bp, Rattus norvegicus
cctgcttcgctctgtggacgttaaa

SEQ ID NO: 254400 - DNA, 25 bp, Rattus norvegicus
cctgcttcgctgagcagcacaggaa

SEQ ID NO: 254401 - DNA, 25 bp, Rattus norvegicus
cctgcttcgctgtgcagcacaggaa

SEQ ID NO: 254402 - DNA, 25 bp, Rattus norvegicus
cctgcttctactctgaatactgagg

SEQ ID NO: 254403 - DNA, 25 bp, Rattus norvegicus
cctgcttctactgtgaatactgagg

SEQ ID NO: 254404 - DNA, 25 bp, Rattus norvegicus
cctgcttctgtgacctgtatgctaa

SEQ ID NO: 254405 - DNA, 25 bp, Rattus norvegicus
cctgcttctgtgtcctgtatgctaa

SEQ ID NO: 254406 - DNA, 25 bp, Rattus norvegicus
cctgcttgaagacctggctgctgga

SEQ ID NO: 254407 - DNA, 25 bp, Rattus norvegicus
cctgcttgaagagctggctgctgga

SEQ ID NO: 254408 - DNA, 25 bp, Rattus norvegicus
cctgcttgagcaacgcccgggagct

SEQ ID NO: 254409 - DNA, 25 bp, Rattus norvegicus
cctgcttgagcatcgcccgggagct

SEQ ID NO: 254410 - DNA, 25 bp, Rattus norvegicus
cctgcttgcctgagtgctggccatt

SEQ ID NO: 254411 - DNA, 25 bp, Rattus norvegicus
cctgcttgcctgtgtgctggccatt

SEQ ID NO: 254412 - DNA, 25 bp, Rattus norvegicus
cctgcttgccttcgttaagccagaa

SEQ ID NO: 254413 - DNA, 25 bp, Rattus norvegicus
cctgcttgccttggttaagccagaa

SEQ ID NO: 254414 - DNA, 25 bp, Rattus norvegicus
cctgcttgctacatgattttatcct

SEQ ID NO: 254415 - DNA, 25 bp, Rattus norvegicus
cctgcttgctacttgattttatcct

SEQ ID NO: 254416 - DNA, 25 bp, Rattus norvegicus
cctgcttgggccctaggaatgaaga

SEQ ID NO: 254417 - DNA, 25 bp, Rattus norvegicus
cctgcttgggccgtaggaatgaaga

SEQ ID NO: 254418 - DNA, 25 bp, Rattus norvegicus
cctgcttgttggctataatgtcttt

SEQ ID NO: 254419 - DNA, 25 bp, Rattus norvegicus
cctgcttgttgggtataatgtcttt

SEQ ID NO: 254420 - DNA, 25 bp, Rattus norvegicus
cctgctttatggctggttttgttat

SEQ ID NO: 254421 - DNA, 25 bp, Rattus norvegicus
cctgctttatgggtggttttgttat

SEQ ID NO: 254422 - DNA, 25 bp, Rattus norvegicus
cctgctttccttagtttctatgtta

SEQ ID NO: 254423 - DNA, 25 bp, Rattus norvegicus
cctgctttcctttgtttctatgtta

SEQ ID NO: 254424 - DNA, 25 bp, Rattus norvegicus
cctgctttgaagctagggtagattt

SEQ ID NO: 254425 - DNA, 25 bp, Rattus norvegicus
cctgctttgaaggtagggtagattt

SEQ ID NO: 254426 - DNA, 25 bp, Rattus norvegicus
cctgctttgctaccatcgtggaaga

SEQ ID NO: 254427 - DNA, 25 bp, Rattus norvegicus
cctgctttgctagcatcgtggaaga

SEQ ID NO: 254428 - DNA, 25 bp, Rattus norvegicus
cctgcttttcctcagattgtctaaa

SEQ ID NO: 254429 - DNA, 25 bp, Rattus norvegicus
cctgcttttcctgagattgtctaaa

SEQ ID NO: 254430 - DNA, 25 bp, Rattus norvegicus
cctggaaacctaacttcctgatcta

SEQ ID NO: 254431 - DNA, 25 bp, Rattus norvegicus
cctggaaacctatcttcctgatcta

SEQ ID NO: 254432 - DNA, 25 bp, Rattus norvegicus
cctggaaacttgcactactggacat

SEQ ID NO: 254433 - DNA, 25 bp, Rattus norvegicus
cctggaaacttggactactggacat

SEQ ID NO: 254434 - DNA, 25 bp, Rattus norvegicus
cctggaacacgcctgtgcggttaca

SEQ ID NO: 254435 - DNA, 25 bp, Rattus norvegicus
cctggaacacgcgtgtgcggttaca

SEQ ID NO: 254436 - DNA, 25 bp, Rattus norvegicus
cctggaacatggcagctgaacctga

SEQ ID NO: 254437 - DNA, 25 bp, Rattus norvegicus
cctggaacatgggagctgaacctga

SEQ ID NO: 254438 - DNA, 25 bp, Rattus norvegicus
cctggaacgtgtcctggtatttgat

SEQ ID NO: 254439 - DNA, 25 bp, Rattus norvegicus
cctggaacgtgtgctggtatttgat

SEQ ID NO: 254440 - DNA, 25 bp, Rattus norvegicus
cctggaactctgaggcttagcttgg

SEQ ID NO: 254441 - DNA, 25 bp, Rattus norvegicus
cctggaactctgtggcttagcttgg

SEQ ID NO: 254442 - DNA, 25 bp, Rattus norvegicus
cctggaacttctactttgtaaaatg

SEQ ID NO: 254443 - DNA, 25 bp, Rattus norvegicus
cctggaacttcttctttgtaaaatg

SEQ ID NO: 254444 - DNA, 25 bp, Rattus norvegicus
cctggaacttggaatgtagacacat

SEQ ID NO: 254445 - DNA, 25 bp, Rattus norvegicus
cctggaacttggtatgtagacacat

SEQ ID NO: 254446 - DNA, 25 bp, Rattus norvegicus
cctggaagacgaatgcctgctgctc

SEQ ID NO: 254447 - DNA, 25 bp, Rattus norvegicus
cctggaagacgattgcctgctgctc

SEQ ID NO: 254448 - DNA, 25 bp, Rattus norvegicus
cctggaagaggtcccgattcacatc

SEQ ID NO: 254449 - DNA, 25 bp, Rattus norvegicus
cctggaagaggtgccgattcacatc

SEQ ID NO: 254450 - DNA, 25 bp, Rattus norvegicus
cctggaaggagtatgtggctacatg

SEQ ID NO: 254451 - DNA, 25 bp, Rattus norvegicus
cctggaaggagtttgtggctacatg

SEQ ID NO: 254452 - DNA, 25 bp, Rattus norvegicus
cctggaagttatatctttcctgaat

SEQ ID NO: 254453 - DNA, 25 bp, Rattus norvegicus
cctggaagttatttctttcctgaat

SEQ ID NO: 254454 - DNA, 25 bp, Rattus norvegicus
cctggaatttgcaagcgctggctat

SEQ ID NO: 254455 - DNA, 25 bp, Rattus norvegicus
cctggaatttgctagcgctggctat

SEQ ID NO: 254456 - DNA, 25 bp, Rattus norvegicus
cctggacaagtcctatgtgaactgt

SEQ ID NO: 254457 - DNA, 25 bp, Rattus norvegicus
cctggacaagtcgtatgtgaactgt

SEQ ID NO: 254458 - DNA, 25 bp, Rattus norvegicus
cctggacagggtatcatcttacttc

SEQ ID NO: 254459 - DNA, 25 bp, Rattus norvegicus
cctggacagggtttcatcttacttc

SEQ ID NO: 254460 - DNA, 25 bp, Rattus norvegicus
cctggacattctaggctagtggtga

SEQ ID NO: 254461 - DNA, 25 bp, Rattus norvegicus
cctggacattcttggctagtggtga

SEQ ID NO: 254462 - DNA, 25 bp, Rattus norvegicus
cctggaccaagtctgtattattcat

SEQ ID NO: 254463 - DNA, 25 bp, Rattus norvegicus
cctggaccaagtgtgtattattcat

SEQ ID NO: 254464 - DNA, 25 bp, Rattus norvegicus
cctggaccactgctttttcgaatag

SEQ ID NO: 254465 - DNA, 25 bp, Rattus norvegicus
cctggaccactggtttttcgaatag

SEQ ID NO: 254466 - DNA, 25 bp, Rattus norvegicus
cctggaccctgcatatctgagatgg

SEQ ID NO: 254467 - DNA, 25 bp, Rattus norvegicus
cctggaccctgcttatctgagatgg

SEQ ID NO: 254468 - DNA, 25 bp, Rattus norvegicus
cctggaccggggaggtgccctgcct

SEQ ID NO: 254469 - DNA, 25 bp, Rattus norvegicus
cctggaccggggtggtgccctgcct

SEQ ID NO: 254470 - DNA, 25 bp, Rattus norvegicus
cctggactcctgaatctatctctgt

SEQ ID NO: 254471 - DNA, 25 bp, Rattus norvegicus
cctggactcctgtatctatctctgt

SEQ ID NO: 254472 - DNA, 25 bp, Rattus norvegicus
cctggactgggtcccgtacatcaat

SEQ ID NO: 254473 - DNA, 25 bp, Rattus norvegicus
cctggactgggtgccgtacatcaat

SEQ ID NO: 254474 - DNA, 25 bp, Rattus norvegicus
cctggactggtgaccgagaagcgca

SEQ ID NO: 254475 - DNA, 25 bp, Rattus norvegicus
cctggactggtgtccgagaagcgca

SEQ ID NO: 254476 - DNA, 25 bp, Rattus norvegicus
cctggacttaacattctttatagag

SEQ ID NO: 254477 - DNA, 25 bp, Rattus norvegicus
cctggacttaactttctttatagag

SEQ ID NO: 254478 - DNA, 25 bp, Rattus norvegicus
cctggacttctgcattttgtgacaa

SEQ ID NO: 254479 - DNA, 25 bp, Rattus norvegicus
cctggacttctggattttgtgacaa

SEQ ID NO: 254480 - DNA, 25 bp, Rattus norvegicus
cctggagaacgtatggacttcaata

SEQ ID NO: 254481 - DNA, 25 bp, Rattus norvegicus
cctggagaacgtttggacttcaata

SEQ ID NO: 254482 - DNA, 25 bp, Rattus norvegicus
cctggagaacttcggtcctgctctg

SEQ ID NO: 254483 - DNA, 25 bp, Rattus norvegicus
cctggagaacttgggtcctgctctg

SEQ ID NO: 254484 - DNA, 25 bp, Rattus norvegicus
cctggagaatggcatctttggtatt

SEQ ID NO: 254485 - DNA, 25 bp, Rattus norvegicus
cctggagaatgggatctttggtatt

SEQ ID NO: 254486 - DNA, 25 bp, Rattus norvegicus
cctggagacctcatgtcactttaat

SEQ ID NO: 254487 - DNA, 25 bp, Rattus norvegicus
cctggagacctcttgtcactttaat

SEQ ID NO: 254488 - DNA, 25 bp, Rattus norvegicus
cctggagatgtcagtgtgtttcctc

SEQ ID NO: 254489 - DNA, 25 bp, Rattus norvegicus
cctggagatgtctgtgtgtttcctc

SEQ ID NO: 254490 - DNA, 25 bp, Rattus norvegicus
cctggagcacgacttggctgtgaaa

SEQ ID NO: 254491 - DNA, 25 bp, Rattus norvegicus
cctggagcacgagttggctgtgaaa

SEQ ID NO: 254492 - DNA, 25 bp, Rattus norvegicus
cctggagcccacaggtgcacttgtt

SEQ ID NO: 254493 - DNA, 25 bp, Rattus norvegicus
cctggagcccactggtgcacttgtt

SEQ ID NO: 254494 - DNA, 25 bp, Rattus norvegicus
cctggagcctgcatcagcagttaaa

SEQ ID NO: 254495 - DNA, 25 bp, Rattus norvegicus
cctggagcctgcttcagcagttaaa

SEQ ID NO: 254496 - DNA, 25 bp, Rattus norvegicus
cctggagcggctcagttctggcaaa

SEQ ID NO: 254497 - DNA, 25 bp, Rattus norvegicus
cctggagcggctgagttctggcaaa

SEQ ID NO: 254498 - DNA, 25 bp, Rattus norvegicus
cctggagctgagaacaaggccaaga

SEQ ID NO: 254499 - DNA, 25 bp, Rattus norvegicus
cctggagctgagtacaaggccaaga

SEQ ID NO: 254500 - DNA, 25 bp, Rattus norvegicus
cctggagctgtaaaaggtggtaagt

SEQ ID NO: 254501 - DNA, 25 bp, Rattus norvegicus
cctggagctgtataaggtggtaagt

SEQ ID NO: 254502 - DNA, 25 bp, Rattus norvegicus
cctggagcttaacttacttgtgctt

SEQ ID NO: 254503 - DNA, 25 bp, Rattus norvegicus
cctggagcttaagttacttgtgctt

SEQ ID NO: 254504 - DNA, 25 bp, Rattus norvegicus
cctggaggaagcagagttctacaac

SEQ ID NO: 254505 - DNA, 25 bp, Rattus norvegicus
cctggaggaagctgagttctacaac

SEQ ID NO: 254506 - DNA, 25 bp, Rattus norvegicus
cctggaggagtgagagcctagtact

SEQ ID NO: 254507 - DNA, 25 bp, Rattus norvegicus
cctggaggagtgtgagcctagtact

SEQ ID NO: 254508 - DNA, 25 bp, Rattus norvegicus
cctggaggcacaaggacagcacagg

SEQ ID NO: 254509 - DNA, 25 bp, Rattus norvegicus
cctggaggcacatggacagcacagg

SEQ ID NO: 254510 - DNA, 25 bp, Rattus norvegicus
cctggaggccctattcctaaatctg

SEQ ID NO: 254511 - DNA, 25 bp, Rattus norvegicus
cctggaggcccttttcctaaatctg

SEQ ID NO: 254512 - DNA, 25 bp, Rattus norvegicus
cctggaggcctgataccctaagaca

SEQ ID NO: 254513 - DNA, 25 bp, Rattus norvegicus
cctggaggcctgttaccctaagaca

SEQ ID NO: 254514 - DNA, 25 bp, Rattus norvegicus
cctggagtaactcatggaatcatct

SEQ ID NO: 254515 - DNA, 25 bp, Rattus norvegicus
cctggagtaactgatggaatcatct

SEQ ID NO: 254516 - DNA, 25 bp, Rattus norvegicus
cctggagtgaaaaggctggactgta

SEQ ID NO: 254517 - DNA, 25 bp, Rattus norvegicus
cctggagtgaaatggctggactgta

SEQ ID NO: 254518 - DNA, 25 bp, Rattus norvegicus
cctggagtggctactcagatacctg

SEQ ID NO: 254519 - DNA, 25 bp, Rattus norvegicus
cctggagtggcttctcagatacctg

SEQ ID NO: 254520 - DNA, 25 bp, Rattus norvegicus
cctggagttgtcatcaagggagcag

SEQ ID NO: 254521 - DNA, 25 bp, Rattus norvegicus
cctggagttgtcttcaagggagcag

SEQ ID NO: 254522 - DNA, 25 bp, Rattus norvegicus
cctggatagctcctttgcatactaa

SEQ ID NO: 254523 - DNA, 25 bp, Rattus norvegicus
cctggatagctcgtttgcatactaa

SEQ ID NO: 254524 - DNA, 25 bp, Rattus norvegicus
cctggatcaaggatcgccggcgtga

SEQ ID NO: 254525 - DNA, 25 bp, Rattus norvegicus
cctggatcaaggttcgccggcgtga

SEQ ID NO: 254526 - DNA, 25 bp, Rattus norvegicus
cctggatcccaactttctctttaag

SEQ ID NO: 254527 - DNA, 25 bp, Rattus norvegicus
cctggatcccaagtttctctttaag

SEQ ID NO: 254528 - DNA, 25 bp, Rattus norvegicus
cctggatccgtgacgccactgacaa

SEQ ID NO: 254529 - DNA, 25 bp, Rattus norvegicus
cctggatccgtgtcgccactgacaa

SEQ ID NO: 254530 - DNA, 25 bp, Rattus norvegicus
cctggatcctagctgagggcagtca

SEQ ID NO: 254531 - DNA, 25 bp, Rattus norvegicus
cctggatcctaggtgagggcagtca

SEQ ID NO: 254532 - DNA, 25 bp, Rattus norvegicus
cctggatcctctcttctgaatcaaa

SEQ ID NO: 254533 - DNA, 25 bp, Rattus norvegicus
cctggatcctctgttctgaatcaaa

SEQ ID NO: 254534 - DNA, 25 bp, Rattus norvegicus
cctggatctgatcccttcagaggat

SEQ ID NO: 254535 - DNA, 25 bp, Rattus norvegicus
cctggatctgatgccttcagaggat

SEQ ID NO: 254536 - DNA, 25 bp, Rattus norvegicus
cctggatgaagcaagggcctgctct

SEQ ID NO: 254537 - DNA, 25 bp, Rattus norvegicus
cctggatgaagctagggcctgctct

SEQ ID NO: 254538 - DNA, 25 bp, Rattus norvegicus
cctggatgagttagttcagttcctc

SEQ ID NO: 254539 - DNA, 25 bp, Rattus norvegicus
cctggatgagtttgttcagttcctc

SEQ ID NO: 254540 - DNA, 25 bp, Rattus norvegicus
cctggatgcccaatacctttaattt

SEQ ID NO: 254541 - DNA, 25 bp, Rattus norvegicus
cctggatgcccattacctttaattt

SEQ ID NO: 254542 - DNA, 25 bp, Rattus norvegicus
cctggatgctctagtgtcactgctg

SEQ ID NO: 254543 - DNA, 25 bp, Rattus norvegicus
cctggatgctcttgtgtcactgctg

SEQ ID NO: 254544 - DNA, 25 bp, Rattus norvegicus
cctggatggcagcagcatgcagata

SEQ ID NO: 254545 - DNA, 25 bp, Rattus norvegicus
cctggatggcaggagcatgcagata

SEQ ID NO: 254546 - DNA, 25 bp, Rattus norvegicus
cctggatgtgctctcttttttattt

SEQ ID NO: 254547 - DNA, 25 bp, Rattus norvegicus
cctggatgtgctgtcttttttattt

SEQ ID NO: 254548 - DNA, 25 bp, Rattus norvegicus
cctggattcctgactcacagcatgg

SEQ ID NO: 254549 - DNA, 25 bp, Rattus norvegicus
cctggattcctgtctcacagcatgg

SEQ ID NO: 254550 - DNA, 25 bp, Rattus norvegicus
cctggcaaagctctgatgggcagaa

SEQ ID NO: 254551 - DNA, 25 bp, Rattus norvegicus
cctggcaaagctgtgatgggcagaa

SEQ ID NO: 254552 - DNA, 25 bp, Rattus norvegicus
cctggcaagcccctaaaagtcaatt

SEQ ID NO: 254553 - DNA, 25 bp, Rattus norvegicus
cctggcaagcccgtaaaagtcaatt

SEQ ID NO: 254554 - DNA, 25 bp, Rattus norvegicus
cctggcacttttactactttagctg

SEQ ID NO: 254555 - DNA, 25 bp, Rattus norvegicus
cctggcactttttctactttagctg

SEQ ID NO: 254556 - DNA, 25 bp, Rattus norvegicus
cctggcagagtgatacttgcccctt

SEQ ID NO: 254557 - DNA, 25 bp, Rattus norvegicus
cctggcagagtgttacttgcccctt

SEQ ID NO: 254558 - DNA, 25 bp, Rattus norvegicus
cctggcagcagaacactctttaata

SEQ ID NO: 254559 - DNA, 25 bp, Rattus norvegicus
cctggcagcagatcactctttaata

SEQ ID NO: 254560 - DNA, 25 bp, Rattus norvegicus
cctggcagccacacatatttgcatg

SEQ ID NO: 254561 - DNA, 25 bp, Rattus norvegicus
cctggcagccactcatatttgcatg

SEQ ID NO: 254562 - DNA, 25 bp, Rattus norvegicus
cctggcagctcaccagcagtgttaa

SEQ ID NO: 254563 - DNA, 25 bp, Rattus norvegicus
cctggcagctcagcagcagtgttaa

SEQ ID NO: 254564 - DNA, 25 bp, Rattus norvegicus
cctggcaggcaacgctaagcatata

SEQ ID NO: 254565 - DNA, 25 bp, Rattus norvegicus
cctggcaggcaaggctaagcatata

SEQ ID NO: 254566 - DNA, 25 bp, Rattus norvegicus
cctggcaggctccagaatcaggaga

SEQ ID NO: 254567 - DNA, 25 bp, Rattus norvegicus
cctggcaggctcgagaatcaggaga

SEQ ID NO: 254568 - DNA, 25 bp, Rattus norvegicus
cctggcagggatcacttcctgatgg

SEQ ID NO: 254569 - DNA, 25 bp, Rattus norvegicus
cctggcagggatgacttcctgatgg

SEQ ID NO: 254570 - DNA, 25 bp, Rattus norvegicus
cctggcatggccaacaagttttaat

SEQ ID NO: 254571 - DNA, 25 bp, Rattus norvegicus
cctggcatggcctacaagttttaat

SEQ ID NO: 254572 - DNA, 25 bp, Rattus norvegicus
cctggcatttacactcatctttaaa

SEQ ID NO: 254573 - DNA, 25 bp, Rattus norvegicus
cctggcatttactctcatctttaaa

SEQ ID NO: 254574 - DNA, 25 bp, Rattus norvegicus
cctggcatttgaagtcactgtttct

SEQ ID NO: 254575 - DNA, 25 bp, Rattus norvegicus
cctggcatttgatgtcactgtttct

SEQ ID NO: 254576 - DNA, 25 bp, Rattus norvegicus
cctggcatttgcagaactaagttct

SEQ ID NO: 254577 - DNA, 25 bp, Rattus norvegicus
cctggcatttgctgaactaagttct

SEQ ID NO: 254578 - DNA, 25 bp, Rattus norvegicus
cctggccaccttcggcaggaagcat

SEQ ID NO: 254579 - DNA, 25 bp, Rattus norvegicus
cctggccaccttgggcaggaagcat

SEQ ID NO: 254580 - DNA, 25 bp, Rattus norvegicus
cctggccacggaatacgagagctat

SEQ ID NO: 254581 - DNA, 25 bp, Rattus norvegicus
cctggccacggattacgagagctat

SEQ ID NO: 254582 - DNA, 25 bp, Rattus norvegicus
cctggccactctctgaatacacgat

SEQ ID NO: 254583 - DNA, 25 bp, Rattus norvegicus
cctggccactctgtgaatacacgat

SEQ ID NO: 254584 - DNA, 25 bp, Rattus norvegicus
cctggccagcgtcaagcatcttgaa

SEQ ID NO: 254585 - DNA, 25 bp, Rattus norvegicus
cctggccagcgtgaagcatcttgaa

SEQ ID NO: 254586 - DNA, 25 bp, Rattus norvegicus
cctggccaggttctttagttacaca

SEQ ID NO: 254587 - DNA, 25 bp, Rattus norvegicus
cctggccaggttgtttagttacaca

SEQ ID NO: 254588 - DNA, 25 bp, Rattus norvegicus
cctggccagtggattgtatgtgaac

SEQ ID NO: 254589 - DNA, 25 bp, Rattus norvegicus
cctggccagtggtttgtatgtgaac

SEQ ID NO: 254590 - DNA, 25 bp, Rattus norvegicus
cctggcccactgatttacatgtgat

SEQ ID NO: 254591 - DNA, 25 bp, Rattus norvegicus
cctggcccactgttttacatgtgat

SEQ ID NO: 254592 - DNA, 25 bp, Rattus norvegicus
cctggcccctgccaattgaggtaat

SEQ ID NO: 254593 - DNA, 25 bp, Rattus norvegicus
cctggcccctgcgaattgaggtaat

SEQ ID NO: 254594 - DNA, 25 bp, Rattus norvegicus
cctggccctgcacatgaagaggcat

SEQ ID NO: 254595 - DNA, 25 bp, Rattus norvegicus
cctggccctgcagatgaagaggcat

SEQ ID NO: 254596 - DNA, 25 bp, Rattus norvegicus
cctggcccttgcatgagaattcata

SEQ ID NO: 254597 - DNA, 25 bp, Rattus norvegicus
cctggcccttgcttgagaattcata

SEQ ID NO: 254598 - DNA, 25 bp, Rattus norvegicus
cctggcctaagcatgattctatcta

SEQ ID NO: 254599 - DNA, 25 bp, Rattus norvegicus
cctggcctaagcttgattctatcta

SEQ ID NO: 254600 - DNA, 25 bp, Rattus norvegicus
cctggcctacctcatgatgaagaaa

SEQ ID NO: 254601 - DNA, 25 bp, Rattus norvegicus
cctggcctacctgatgatgaagaaa

SEQ ID NO: 254602 - DNA, 25 bp, Rattus norvegicus
cctggcctagctcttcaatttgaag

SEQ ID NO: 254603 - DNA, 25 bp, Rattus norvegicus
cctggcctagctgttcaatttgaag

SEQ ID NO: 254604 - DNA, 25 bp, Rattus norvegicus
cctggcctctcaattttgaatcaac

SEQ ID NO: 254605 - DNA, 25 bp, Rattus norvegicus
cctggcctctcatttttgaatcaac

SEQ ID NO: 254606 - DNA, 25 bp, Rattus norvegicus
cctggcctgggtagctgttaactga

SEQ ID NO: 254607 - DNA, 25 bp, Rattus norvegicus
cctggcctgggttgctgttaactga

SEQ ID NO: 254608 - DNA, 25 bp, Rattus norvegicus
cctggccttcagattgcgagattac

SEQ ID NO: 254609 - DNA, 25 bp, Rattus norvegicus
cctggccttcagtttgcgagattac

SEQ ID NO: 254610 - DNA, 25 bp, Rattus norvegicus
cctggccttccgcagggagtaatag

SEQ ID NO: 254611 - DNA, 25 bp, Rattus norvegicus
cctggccttccggagggagtaatag

SEQ ID NO: 254612 - DNA, 25 bp, Rattus norvegicus
cctggccttcttagttgtcaaatca

SEQ ID NO: 254613 - DNA, 25 bp, Rattus norvegicus
cctggccttctttgttgtcaaatca

SEQ ID NO: 254614 - DNA, 25 bp, Rattus norvegicus
cctggccttggcatcctagactggg

SEQ ID NO: 254615 - DNA, 25 bp, Rattus norvegicus
cctggccttggcttcctagactggg

SEQ ID NO: 254616 - DNA, 25 bp, Rattus norvegicus
cctggccttggtcactctacatgag

SEQ ID NO: 254617 - DNA, 25 bp, Rattus norvegicus
cctggccttggtgactctacatgag

SEQ ID NO: 254618 - DNA, 25 bp, Rattus norvegicus
cctggcgctgttcggttgtgattaa

SEQ ID NO: 254619 - DNA, 25 bp, Rattus norvegicus
cctggcgctgttgggttgtgattaa

SEQ ID NO: 254620 - DNA, 25 bp, Rattus norvegicus
cctggcgggagcagcgggagggcgg

SEQ ID NO: 254621 - DNA, 25 bp, Rattus norvegicus
cctggcgggagctgcgggagggcgg

SEQ ID NO: 254622 - DNA, 25 bp, Rattus norvegicus
cctggcgtcaggatgtcatggttca

SEQ ID NO: 254623 - DNA, 25 bp, Rattus norvegicus
cctggcgtcaggttgtcatggttca

SEQ ID NO: 254624 - DNA, 25 bp, Rattus norvegicus
cctggctactctcgtgaggactgtg

SEQ ID NO: 254625 - DNA, 25 bp, Rattus norvegicus
cctggctactctggtgaggactgtg

SEQ ID NO: 254626 - DNA, 25 bp, Rattus norvegicus
cctggctcacgtatgttttttaatg

SEQ ID NO: 254627 - DNA, 25 bp, Rattus norvegicus
cctggctcacgtttgttttttaatg

SEQ ID NO: 254628 - DNA, 25 bp, Rattus norvegicus
cctggctcagtacctccaataaagt

SEQ ID NO: 254629 - DNA, 25 bp, Rattus norvegicus
cctggctcagtagctccaataaagt

SEQ ID NO: 254630 - DNA, 25 bp, Rattus norvegicus
cctggctccaagagaggcctgagta

SEQ ID NO: 254631 - DNA, 25 bp, Rattus norvegicus
cctggctccaagtgaggcctgagta

SEQ ID NO: 254632 - DNA, 25 bp, Rattus norvegicus
cctggctcctttccaagaagtggat

SEQ ID NO: 254633 - DNA, 25 bp, Rattus norvegicus
cctggctcctttgcaagaagtggat

SEQ ID NO: 254634 - DNA, 25 bp, Rattus norvegicus
cctggctcgtcacttcagtatagga

SEQ ID NO: 254635 - DNA, 25 bp, Rattus norvegicus
cctggctcgtcagttcagtatagga

SEQ ID NO: 254636 - DNA, 25 bp, Rattus norvegicus
cctggctctctacacaatacttgaa

SEQ ID NO: 254637 - DNA, 25 bp, Rattus norvegicus
cctggctctctagacaatacttgaa

SEQ ID NO: 254638 - DNA, 25 bp, Rattus norvegicus
cctggctctctcagataatcacata

SEQ ID NO: 254639 - DNA, 25 bp, Rattus norvegicus
cctggctctctctgataatcacata

SEQ ID NO: 254640 - DNA, 25 bp, Rattus norvegicus
cctggctgccgcacatagtagtggg

SEQ ID NO: 254641 - DNA, 25 bp, Rattus norvegicus
cctggctgccgctcatagtagtggg

SEQ ID NO: 254642 - DNA, 25 bp, Rattus norvegicus
cctggctgggtgagactgctcaact

SEQ ID NO: 254643 - DNA, 25 bp, Rattus norvegicus
cctggctgggtgtgactgctcaact

SEQ ID NO: 254644 - DNA, 25 bp, Rattus norvegicus
cctggctgtccacatggaagaattg

SEQ ID NO: 254645 - DNA, 25 bp, Rattus norvegicus
cctggctgtccagatggaagaattg

SEQ ID NO: 254646 - DNA, 25 bp, Rattus norvegicus
cctggctgtcctcagctgaagacta

SEQ ID NO: 254647 - DNA, 25 bp, Rattus norvegicus
cctggctgtcctgagctgaagacta

SEQ ID NO: 254648 - DNA, 25 bp, Rattus norvegicus
cctggctgtcggaggcagcttgaaa

SEQ ID NO: 254649 - DNA, 25 bp, Rattus norvegicus
cctggctgtcggtggcagcttgaaa

SEQ ID NO: 254650 - DNA, 25 bp, Rattus norvegicus
cctggctgtctaagcgagaattaga

SEQ ID NO: 254651 - DNA, 25 bp, Rattus norvegicus
cctggctgtctatgcgagaattaga

SEQ ID NO: 254652 - DNA, 25 bp, Rattus norvegicus
cctggctgtgatcgaaactgcagtg

SEQ ID NO: 254653 - DNA, 25 bp, Rattus norvegicus
cctggctgtgatggaaactgcagtg

SEQ ID NO: 254654 - DNA, 25 bp, Rattus norvegicus
cctggctgtgctccaagctgagaga

SEQ ID NO: 254655 - DNA, 25 bp, Rattus norvegicus
cctggctgtgctgcaagctgagaga

SEQ ID NO: 254656 - DNA, 25 bp, Rattus norvegicus
cctggctgtggcattggaaacctca

SEQ ID NO: 254657 - DNA, 25 bp, Rattus norvegicus
cctggctgtggctttggaaacctca

SEQ ID NO: 254658 - DNA, 25 bp, Rattus norvegicus
cctggctgtgtgactgttaattgca

SEQ ID NO: 254659 - DNA, 25 bp, Rattus norvegicus
cctggctgtgtgtctgttaattgca

SEQ ID NO: 254660 - DNA, 25 bp, Rattus norvegicus
cctggcttcactcggatatctcggg

SEQ ID NO: 254661 - DNA, 25 bp, Rattus norvegicus
cctggcttcactgggatatctcggg

SEQ ID NO: 254662 - DNA, 25 bp, Rattus norvegicus
cctggcttcagcaggtgatttttaa

SEQ ID NO: 254663 - DNA, 25 bp, Rattus norvegicus
cctggcttcagctggtgatttttaa

SEQ ID NO: 254664 - DNA, 25 bp, Rattus norvegicus
cctggcttcccactcaagattgaaa

SEQ ID NO: 254665 - DNA, 25 bp, Rattus norvegicus
cctggcttcccagtcaagattgaaa

SEQ ID NO: 254666 - DNA, 25 bp, Rattus norvegicus
cctggcttctgaatctttgttcata

SEQ ID NO: 254667 - DNA, 25 bp, Rattus norvegicus
cctggcttctgattctttgttcata

SEQ ID NO: 254668 - DNA, 25 bp, Rattus norvegicus
cctggcttggccagcgaaggtgaac

SEQ ID NO: 254669 - DNA, 25 bp, Rattus norvegicus
cctggcttggcctgcgaaggtgaac

SEQ ID NO: 254670 - DNA, 25 bp, Rattus norvegicus
cctggcttgtataccttgttgtaga

SEQ ID NO: 254671 - DNA, 25 bp, Rattus norvegicus
cctggcttgtattccttgttgtaga

SEQ ID NO: 254672 - DNA, 25 bp, Rattus norvegicus
cctggctttgaaacctgcgggcagg

SEQ ID NO: 254673 - DNA, 25 bp, Rattus norvegicus
cctggctttgaatcctgcgggcagg

SEQ ID NO: 254674 - DNA, 25 bp, Rattus norvegicus
cctgggaaaaggctgcttgtcgctt

SEQ ID NO: 254675 - DNA, 25 bp, Rattus norvegicus
cctgggaaaagggtgcttgtcgctt

SEQ ID NO: 254676 - DNA, 25 bp, Rattus norvegicus
cctgggaaacaacatcctacttggc

SEQ ID NO: 254677 - DNA, 25 bp, Rattus norvegicus
cctgggaaacaagatcctacttggc

SEQ ID NO: 254678 - DNA, 25 bp, Rattus norvegicus
cctgggaaaggcacccatttgaggc

SEQ ID NO: 254679 - DNA, 25 bp, Rattus norvegicus
cctgggaaaggctcccatttgaggc

SEQ ID NO: 254680 - DNA, 25 bp, Rattus norvegicus
cctgggaacaatctgggccttatga

SEQ ID NO: 254681 - DNA, 25 bp, Rattus norvegicus
cctgggaacaatgtgggccttatga

SEQ ID NO: 254682 - DNA, 25 bp, Rattus norvegicus
cctgggaagcgccaaggcagttcta

SEQ ID NO: 254683 - DNA, 25 bp, Rattus norvegicus
cctgggaagcgcgaaggcagttcta

SEQ ID NO: 254684 - DNA, 25 bp, Rattus norvegicus
cctgggaatagtcaacggaaacgca

SEQ ID NO: 254685 - DNA, 25 bp, Rattus norvegicus
cctgggaatagtgaacggaaacgca

SEQ ID NO: 254686 - DNA, 25 bp, Rattus norvegicus
cctgggaatccgagtggcctgtgaa

SEQ ID NO: 254687 - DNA, 25 bp, Rattus norvegicus
cctgggaatccgtgtggcctgtgaa

SEQ ID NO: 254688 - DNA, 25 bp, Rattus norvegicus
cctgggaccaagattcctgagcaga

SEQ ID NO: 254689 - DNA, 25 bp, Rattus norvegicus
cctgggaccaagtttcctgagcaga

SEQ ID NO: 254690 - DNA, 25 bp, Rattus norvegicus
cctgggacctttcctgctttgggag

SEQ ID NO: 254691 - DNA, 25 bp, Rattus norvegicus
cctgggacctttgctgctttgggag

SEQ ID NO: 254692 - DNA, 25 bp, Rattus norvegicus
cctgggacgtgtcacgtacagacca

SEQ ID NO: 254693 - DNA, 25 bp, Rattus norvegicus
cctgggacgtgtgacgtacagacca

SEQ ID NO: 254694 - DNA, 25 bp, Rattus norvegicus
cctgggactgcacatgagtggttca

SEQ ID NO: 254695 - DNA, 25 bp, Rattus norvegicus
cctgggactgcagatgagtggttca

SEQ ID NO: 254696 - DNA, 25 bp, Rattus norvegicus
cctgggactggcactgtgataaaaa

SEQ ID NO: 254697 - DNA, 25 bp, Rattus norvegicus
cctgggactggctctgtgataaaaa

SEQ ID NO: 254698 - DNA, 25 bp, Rattus norvegicus
cctgggacttttcacaatggacact

SEQ ID NO: 254699 - DNA, 25 bp, Rattus norvegicus
cctgggacttttgacaatggacact

SEQ ID NO: 254700 - DNA, 25 bp, Rattus norvegicus
cctgggagaagcactatccttgaat

SEQ ID NO: 254701 - DNA, 25 bp, Rattus norvegicus
cctgggagaagctctatccttgaat

SEQ ID NO: 254702 - DNA, 25 bp, Rattus norvegicus
cctgggaggcctactgtgcacagat

SEQ ID NO: 254703 - DNA, 25 bp, Rattus norvegicus
cctgggaggccttctgtgcacagat

SEQ ID NO: 254704 - DNA, 25 bp, Rattus norvegicus
cctgggatctgtcgtaatggagaca

SEQ ID NO: 254705 - DNA, 25 bp, Rattus norvegicus
cctgggatctgtggtaatggagaca

SEQ ID NO: 254706 - DNA, 25 bp, Rattus norvegicus
cctgggatcttaactcacacaacat

SEQ ID NO: 254707 - DNA, 25 bp, Rattus norvegicus
cctgggatcttatctcacacaacat

SEQ ID NO: 254708 - DNA, 25 bp, Rattus norvegicus
cctgggatgtgaccctggttcagaa

SEQ ID NO: 254709 - DNA, 25 bp, Rattus norvegicus
cctgggatgtgagcctggttcagaa

SEQ ID NO: 254710 - DNA, 25 bp, Rattus norvegicus
cctgggatgtgcacttgatctggaa

SEQ ID NO: 254711 - DNA, 25 bp, Rattus norvegicus
cctgggatgtgctcttgatctggaa

SEQ ID NO: 254712 - DNA, 25 bp, Rattus norvegicus
cctgggattgatcttgggcgcattt

SEQ ID NO: 254713 - DNA, 25 bp, Rattus norvegicus
cctgggattgatgttgggcgcattt

SEQ ID NO: 254714 - DNA, 25 bp, Rattus norvegicus
cctgggcacattagccttttgtgaa

SEQ ID NO: 254715 - DNA, 25 bp, Rattus norvegicus
cctgggcacatttgccttttgtgaa

SEQ ID NO: 254716 - DNA, 25 bp, Rattus norvegicus
cctgggcaccagaggctgatatttt

SEQ ID NO: 254717 - DNA, 25 bp, Rattus norvegicus
cctgggcaccagtggctgatatttt

SEQ ID NO: 254718 - DNA, 25 bp, Rattus norvegicus
cctgggcagagaaacgtggctataa

SEQ ID NO: 254719 - DNA, 25 bp, Rattus norvegicus
cctgggcagagatacgtggctataa

SEQ ID NO: 254720 - DNA, 25 bp, Rattus norvegicus
cctgggcagccaagattaagaaagt

SEQ ID NO: 254721 - DNA, 25 bp, Rattus norvegicus
cctgggcagccatgattaagaaagt

SEQ ID NO: 254722 - DNA, 25 bp, Rattus norvegicus
cctgggcagcttcgtgtggacaaca

SEQ ID NO: 254723 - DNA, 25 bp, Rattus norvegicus
cctgggcagcttggtgtggacaaca

SEQ ID NO: 254724 - DNA, 25 bp, Rattus norvegicus
cctgggcattagacttggtgaaata

SEQ ID NO: 254725 - DNA, 25 bp, Rattus norvegicus
cctgggcattagtcttggtgaaata

SEQ ID NO: 254726 - DNA, 25 bp, Rattus norvegicus
cctgggcatttccaaccactggaaa

SEQ ID NO: 254727 - DNA, 25 bp, Rattus norvegicus
cctgggcatttcgaaccactggaaa

SEQ ID NO: 254728 - DNA, 25 bp, Rattus norvegicus
cctgggcatttgcaggaaggccaac

SEQ ID NO: 254729 - DNA, 25 bp, Rattus norvegicus
cctgggcatttggaggaaggccaac

SEQ ID NO: 254730 - DNA, 25 bp, Rattus norvegicus
cctgggccatctcagattctgtatt

SEQ ID NO: 254731 - DNA, 25 bp, Rattus norvegicus
cctgggccatctgagattctgtatt

SEQ ID NO: 254732 - DNA, 25 bp, Rattus norvegicus
cctgggcccacgaggagtacagatt

SEQ ID NO: 254733 - DNA, 25 bp, Rattus norvegicus
cctgggcccacgtggagtacagatt

SEQ ID NO: 254734 - DNA, 25 bp, Rattus norvegicus
cctgggccgggactatggaattcat

SEQ ID NO: 254735 - DNA, 25 bp, Rattus norvegicus
cctgggccgggagtatggaattcat

SEQ ID NO: 254736 - DNA, 25 bp, Rattus norvegicus
cctgggcctcatatggacgattatc

SEQ ID NO: 254737 - DNA, 25 bp, Rattus norvegicus
cctgggcctcatttggacgattatc

SEQ ID NO: 254738 - DNA, 25 bp, Rattus norvegicus
cctgggcctctactgtattgtatta

SEQ ID NO: 254739 - DNA, 25 bp, Rattus norvegicus
cctgggcctctagtgtattgtatta

SEQ ID NO: 254740 - DNA, 25 bp, Rattus norvegicus
cctgggcctcttaggatgtgtactt

SEQ ID NO: 254741 - DNA, 25 bp, Rattus norvegicus
cctgggcctctttggatgtgtactt

SEQ ID NO: 254742 - DNA, 25 bp, Rattus norvegicus
cctgggccttctactacaaatttga

SEQ ID NO: 254743 - DNA, 25 bp, Rattus norvegicus
cctgggccttcttctacaaatttga

SEQ ID NO: 254744 - DNA, 25 bp, Rattus norvegicus
cctgggctacaccatttctagagaa

SEQ ID NO: 254745 - DNA, 25 bp, Rattus norvegicus
cctgggctacacgatttctagagaa

SEQ ID NO: 254746 - DNA, 25 bp, Rattus norvegicus
cctgggctcaaaaatcagcaccaat

SEQ ID NO: 254747 - DNA, 25 bp, Rattus norvegicus
cctgggctcaaatatcagcaccaat

SEQ ID NO: 254748 - DNA, 25 bp, Rattus norvegicus
cctgggctcctgacattgttaatca

SEQ ID NO: 254749 - DNA, 25 bp, Rattus norvegicus
cctgggctcctgtcattgttaatca

SEQ ID NO: 254750 - DNA, 25 bp, Rattus norvegicus
cctgggctctctcccagatgataaa

SEQ ID NO: 254751 - DNA, 25 bp, Rattus norvegicus
cctgggctctctgccagatgataaa

SEQ ID NO: 254752 - DNA, 25 bp, Rattus norvegicus
cctgggctctggcattaggtgccaa

SEQ ID NO: 254753 - DNA, 25 bp, Rattus norvegicus
cctgggctctgggattaggtgccaa

SEQ ID NO: 254754 - DNA, 25 bp, Rattus norvegicus
cctgggcttgcactcattgtgtgtt

SEQ ID NO: 254755 - DNA, 25 bp, Rattus norvegicus
cctgggcttgcagtcattgtgtgtt

SEQ ID NO: 254756 - DNA, 25 bp, Rattus norvegicus
cctgggcttgggatttctctgagaa

SEQ ID NO: 254757 - DNA, 25 bp, Rattus norvegicus
cctgggcttgggttttctctgagaa

SEQ ID NO: 254758 - DNA, 25 bp, Rattus norvegicus
cctgggtacctcagtgggcatcctg

SEQ ID NO: 254759 - DNA, 25 bp, Rattus norvegicus
cctgggtacctctgtgggcatcctg

SEQ ID NO: 254760 - DNA, 25 bp, Rattus norvegicus
cctgggtacctgctcaaaatgctta

SEQ ID NO: 254761 - DNA, 25 bp, Rattus norvegicus
cctgggtacctggtcaaaatgctta

SEQ ID NO: 254762 - DNA, 25 bp, Rattus norvegicus
cctgggtaggtaattctgagttgta

SEQ ID NO: 254763 - DNA, 25 bp, Rattus norvegicus
cctgggtaggtatttctgagttgta

SEQ ID NO: 254764 - DNA, 25 bp, Rattus norvegicus
cctgggtcaactactagcactggga

SEQ ID NO: 254765 - DNA, 25 bp, Rattus norvegicus
cctgggtcaacttctagcactggga

SEQ ID NO: 254766 - DNA, 25 bp, Rattus norvegicus
cctgggtcacatagtaagatccttt

SEQ ID NO: 254767 - DNA, 25 bp, Rattus norvegicus
cctgggtcacattgtaagatccttt

SEQ ID NO: 254768 - DNA, 25 bp, Rattus norvegicus
cctgggtcccagaggtggtgatatt

SEQ ID NO: 254769 - DNA, 25 bp, Rattus norvegicus
cctgggtcccagtggtggtgatatt

SEQ ID NO: 254770 - DNA, 25 bp, Rattus norvegicus
cctgggtctcagcactgaactgaac

SEQ ID NO: 254771 - DNA, 25 bp, Rattus norvegicus
cctgggtctcaggactgaactgaac

SEQ ID NO: 254772 - DNA, 25 bp, Rattus norvegicus
cctgggtcttctatggcctggaaaa

SEQ ID NO: 254773 - DNA, 25 bp, Rattus norvegicus
cctgggtcttctttggcctggaaaa

SEQ ID NO: 254774 - DNA, 25 bp, Rattus norvegicus
cctgggtgatggctggtgctctcgc

SEQ ID NO: 254775 - DNA, 25 bp, Rattus norvegicus
cctgggtgatgggtggtgctctcgc

SEQ ID NO: 254776 - DNA, 25 bp, Rattus norvegicus
cctgggtgggctctgaatcttcata

SEQ ID NO: 254777 - DNA, 25 bp, Rattus norvegicus
cctgggtgggctgtgaatcttcata

SEQ ID NO: 254778 - DNA, 25 bp, Rattus norvegicus
cctgggtggtccacacaagggctga

SEQ ID NO: 254779 - DNA, 25 bp, Rattus norvegicus
cctgggtggtcctcacaagggctga

SEQ ID NO: 254780 - DNA, 25 bp, Rattus norvegicus
cctgggtgtgggacctcagtgctct

SEQ ID NO: 254781 - DNA, 25 bp, Rattus norvegicus
cctgggtgtgggtcctcagtgctct

SEQ ID NO: 254782 - DNA, 25 bp, Rattus norvegicus
cctgggttaagcactcttggtattg

SEQ ID NO: 254783 - DNA, 25 bp, Rattus norvegicus
cctgggttaagctctcttggtattg

SEQ ID NO: 254784 - DNA, 25 bp, Rattus norvegicus
cctgggttcagtctctaagtactac

SEQ ID NO: 254785 - DNA, 25 bp, Rattus norvegicus
cctgggttcagtgtctaagtactac

SEQ ID NO: 254786 - DNA, 25 bp, Rattus norvegicus
cctgggttccatacatagcactgaa

SEQ ID NO: 254787 - DNA, 25 bp, Rattus norvegicus
cctgggttccattcatagcactgaa

SEQ ID NO: 254788 - DNA, 25 bp, Rattus norvegicus
cctgggttctatcgtgttcctataa

SEQ ID NO: 254789 - DNA, 25 bp, Rattus norvegicus
cctgggttctatggtgttcctataa

SEQ ID NO: 254790 - DNA, 25 bp, Rattus norvegicus
cctgggttctttcgtttgttcatgg

SEQ ID NO: 254791 - DNA, 25 bp, Rattus norvegicus
cctgggttctttggtttgttcatgg

SEQ ID NO: 254792 - DNA, 25 bp, Rattus norvegicus
cctgggtttcaacgtgtgagtctca

SEQ ID NO: 254793 - DNA, 25 bp, Rattus norvegicus
cctgggtttcaaggtgtgagtctca

SEQ ID NO: 254794 - DNA, 25 bp, Rattus norvegicus
cctgggtttcctcatccaaggagaa

SEQ ID NO: 254795 - DNA, 25 bp, Rattus norvegicus
cctgggtttcctgatccaaggagaa

SEQ ID NO: 254796 - DNA, 25 bp, Rattus norvegicus
cctgggttttatattcttcagtgat

SEQ ID NO: 254797 - DNA, 25 bp, Rattus norvegicus
cctgggttttattttcttcagtgat

SEQ ID NO: 254798 - DNA, 25 bp, Rattus norvegicus
cctggtaagtgaaaggattatcctc

SEQ ID NO: 254799 - DNA, 25 bp, Rattus norvegicus
cctggtaagtgataggattatcctc

SEQ ID NO: 254800 - DNA, 25 bp, Rattus norvegicus
cctggtaatcctattgccatgccct

SEQ ID NO: 254801 - DNA, 25 bp, Rattus norvegicus
cctggtaatccttttgccatgccct

SEQ ID NO: 254802 - DNA, 25 bp, Rattus norvegicus
cctggtaatgttcttgatggtttgc

SEQ ID NO: 254803 - DNA, 25 bp, Rattus norvegicus
cctggtaatgttgttgatggtttgc

SEQ ID NO: 254804 - DNA, 25 bp, Rattus norvegicus
cctggtaattggcagttggaactac

SEQ ID NO: 254805 - DNA, 25 bp, Rattus norvegicus
cctggtaattgggagttggaactac

SEQ ID NO: 254806 - DNA, 25 bp, Rattus norvegicus
cctggtaccctaaggctactggaaa

SEQ ID NO: 254807 - DNA, 25 bp, Rattus norvegicus
cctggtaccctatggctactggaaa

SEQ ID NO: 254808 - DNA, 25 bp, Rattus norvegicus
cctggtacccttcttttcatataga

SEQ ID NO: 254809 - DNA, 25 bp, Rattus norvegicus
cctggtacccttgttttcatataga

SEQ ID NO: 254810 - DNA, 25 bp, Rattus norvegicus
cctggtactgtaccactccgagaaa

SEQ ID NO: 254811 - DNA, 25 bp, Rattus norvegicus
cctggtactgtagcactccgagaaa

SEQ ID NO: 254812 - DNA, 25 bp, Rattus norvegicus
cctggtagtaagaagctctcttgat

SEQ ID NO: 254813 - DNA, 25 bp, Rattus norvegicus
cctggtagtaagtagctctcttgat

SEQ ID NO: 254814 - DNA, 25 bp, Rattus norvegicus
cctggtatcgcaactgggcctcggg

SEQ ID NO: 254815 - DNA, 25 bp, Rattus norvegicus
cctggtatcgcatctgggcctcggg

SEQ ID NO: 254816 - DNA, 25 bp, Rattus norvegicus
cctggtatttaacgccgtcctgatt

SEQ ID NO: 254817 - DNA, 25 bp, Rattus norvegicus
cctggtatttaaggccgtcctgatt

SEQ ID NO: 254818 - DNA, 25 bp, Rattus norvegicus
cctggtcaccagcatgttgcagtat

SEQ ID NO: 254819 - DNA, 25 bp, Rattus norvegicus
cctggtcaccaggatgttgcagtat

SEQ ID NO: 254820 - DNA, 25 bp, Rattus norvegicus
cctggtcactcaccatttcagataa

SEQ ID NO: 254821 - DNA, 25 bp, Rattus norvegicus
cctggtcactcagcatttcagataa

SEQ ID NO: 254822 - DNA, 25 bp, Rattus norvegicus
cctggtcagcatacgtggtgtggac

SEQ ID NO: 254823 - DNA, 25 bp, Rattus norvegicus
cctggtcagcattcgtggtgtggac

SEQ ID NO: 254824 - DNA, 25 bp, Rattus norvegicus
cctggtcatatcattggatctgtaa

SEQ ID NO: 254825 - DNA, 25 bp, Rattus norvegicus
cctggtcatatctttggatctgtaa

SEQ ID NO: 254826 - DNA, 25 bp, Rattus norvegicus
cctggtcatgatcattgtccgtggt

SEQ ID NO: 254827 - DNA, 25 bp, Rattus norvegicus
cctggtcatgatgattgtccgtggt

SEQ ID NO: 254828 - DNA, 25 bp, Rattus norvegicus
cctggtccacacagggcggcagaag

SEQ ID NO: 254829 - DNA, 25 bp, Rattus norvegicus
cctggtccacactgggcggcagaag

SEQ ID NO: 254830 - DNA, 25 bp, Rattus norvegicus
cctggtccagggaggtatgcatgct

SEQ ID NO: 254831 - DNA, 25 bp, Rattus norvegicus
cctggtccagggtggtatgcatgct

SEQ ID NO: 254832 - DNA, 25 bp, Rattus norvegicus
cctggtcccgcgagcttcaggtgcg

SEQ ID NO: 254833 - DNA, 25 bp, Rattus norvegicus
cctggtcccgcgtgcttcaggtgcg

SEQ ID NO: 254834 - DNA, 25 bp, Rattus norvegicus
cctggtcctgataatcctctttttt

SEQ ID NO: 254835 - DNA, 25 bp, Rattus norvegicus
cctggtcctgattatcctctttttt

SEQ ID NO: 254836 - DNA, 25 bp, Rattus norvegicus
cctggtcctgtgcactgtagtgaat

SEQ ID NO: 254837 - DNA, 25 bp, Rattus norvegicus
cctggtcctgtggactgtagtgaat

SEQ ID NO: 254838 - DNA, 25 bp, Rattus norvegicus
cctggtcggaagagaggccttgtca

SEQ ID NO: 254839 - DNA, 25 bp, Rattus norvegicus
cctggtcggaagtgaggccttgtca

SEQ ID NO: 254840 - DNA, 25 bp, Rattus norvegicus
cctggtctactgactatttgcatgt

SEQ ID NO: 254841 - DNA, 25 bp, Rattus norvegicus
cctggtctactgtctatttgcatgt

SEQ ID NO: 254842 - DNA, 25 bp, Rattus norvegicus
cctggtctagcaattcttggaacag

SEQ ID NO: 254843 - DNA, 25 bp, Rattus norvegicus
cctggtctagcatttcttggaacag

SEQ ID NO: 254844 - DNA, 25 bp, Rattus norvegicus
cctggtctccttagggtggcgaatg

SEQ ID NO: 254845 - DNA, 25 bp, Rattus norvegicus
cctggtctcctttgggtggcgaatg

SEQ ID NO: 254846 - DNA, 25 bp, Rattus norvegicus
cctggtctctgaagcatggttttgg

SEQ ID NO: 254847 - DNA, 25 bp, Rattus norvegicus
cctggtctctgatgcatggttttgg

SEQ ID NO: 254848 - DNA, 25 bp, Rattus norvegicus
cctggtcttgtgcactagctactga

SEQ ID NO: 254849 - DNA, 25 bp, Rattus norvegicus
cctggtcttgtggactagctactga

SEQ ID NO: 254850 - DNA, 25 bp, Rattus norvegicus
cctggtgacctacctagtctgtaga

SEQ ID NO: 254851 - DNA, 25 bp, Rattus norvegicus
cctggtgacctagctagtctgtaga

SEQ ID NO: 254852 - DNA, 25 bp, Rattus norvegicus
cctggtgatcacatgacacagttca

SEQ ID NO: 254853 - DNA, 25 bp, Rattus norvegicus
cctggtgatcacttgacacagttca

SEQ ID NO: 254854 - DNA, 25 bp, Rattus norvegicus
cctggtgatgccagcccctaggtgc

SEQ ID NO: 254855 - DNA, 25 bp, Rattus norvegicus
cctggtgatgcctgcccctaggtgc

SEQ ID NO: 254856 - DNA, 25 bp, Rattus norvegicus
cctggtgatgctatatgctctacat

SEQ ID NO: 254857 - DNA, 25 bp, Rattus norvegicus
cctggtgatgctttatgctctacat

SEQ ID NO: 254858 - DNA, 25 bp, Rattus norvegicus
cctggtgcagcgaacttcagttcta

SEQ ID NO: 254859 - DNA, 25 bp, Rattus norvegicus
cctggtgcagcgtacttcagttcta

SEQ ID NO: 254860 - DNA, 25 bp, Rattus norvegicus
cctggtgcccaccagtctggcagta

SEQ ID NO: 254861 - DNA, 25 bp, Rattus norvegicus
cctggtgcccacgagtctggcagta

SEQ ID NO: 254862 - DNA, 25 bp, Rattus norvegicus
cctggtgcctctcggattagattat

SEQ ID NO: 254863 - DNA, 25 bp, Rattus norvegicus
cctggtgcctctgggattagattat

SEQ ID NO: 254864 - DNA, 25 bp, Rattus norvegicus
cctggtgctaggctgcagtaaacct

SEQ ID NO: 254865 - DNA, 25 bp, Rattus norvegicus
cctggtgctagggtgcagtaaacct

SEQ ID NO: 254866 - DNA, 25 bp, Rattus norvegicus
cctggtgctgatcctggtagactgc

SEQ ID NO: 254867 - DNA, 25 bp, Rattus norvegicus
cctggtgctgatgctggtagactgc

SEQ ID NO: 254868 - DNA, 25 bp, Rattus norvegicus
cctggtgctgccatgaaagggactg

SEQ ID NO: 254869 - DNA, 25 bp, Rattus norvegicus
cctggtgctgccttgaaagggactg

SEQ ID NO: 254870 - DNA, 25 bp, Rattus norvegicus
cctggtgctggtcggattctagaac

SEQ ID NO: 254871 - DNA, 25 bp, Rattus norvegicus
cctggtgctggtgggattctagaac

SEQ ID NO: 254872 - DNA, 25 bp, Rattus norvegicus
cctggtggagaaagcattggcctat

SEQ ID NO: 254873 - DNA, 25 bp, Rattus norvegicus
cctggtggagaatgcattggcctat

SEQ ID NO: 254874 - DNA, 25 bp, Rattus norvegicus
cctggtggatacaagatagatcttt

SEQ ID NO: 254875 - DNA, 25 bp, Rattus norvegicus
cctggtggatactagatagatcttt

SEQ ID NO: 254876 - DNA, 25 bp, Rattus norvegicus
cctggtggcactcgtgtcataggac

SEQ ID NO: 254877 - DNA, 25 bp, Rattus norvegicus
cctggtggcactggtgtcataggac

SEQ ID NO: 254878 - DNA, 25 bp, Rattus norvegicus
cctggtggcctgaatctgctatata

SEQ ID NO: 254879 - DNA, 25 bp, Rattus norvegicus
cctggtggcctgcttttgagataca

SEQ ID NO: 254880 - DNA, 25 bp, Rattus norvegicus
cctggtggcctggttttgagataca

SEQ ID NO: 254881 - DNA, 25 bp, Rattus norvegicus
cctggtggcctgtatctgctatata

SEQ ID NO: 254882 - DNA, 25 bp, Rattus norvegicus
cctggtgggataatctgtcagacac

SEQ ID NO: 254883 - DNA, 25 bp, Rattus norvegicus
cctggtgggatattctgtcagacac

SEQ ID NO: 254884 - DNA, 25 bp, Rattus norvegicus
cctggtgggcgacatcatcaagcga

SEQ ID NO: 254885 - DNA, 25 bp, Rattus norvegicus
cctggtgggcgagatcatcaagcga

SEQ ID NO: 254886 - DNA, 25 bp, Rattus norvegicus
cctggtgggctaaagatgtggctca

SEQ ID NO: 254887 - DNA, 25 bp, Rattus norvegicus
cctggtgggctatagatgtggctca

SEQ ID NO: 254888 - DNA, 25 bp, Rattus norvegicus
cctggtgggcttcatggtgaccaat

SEQ ID NO: 254889 - DNA, 25 bp, Rattus norvegicus
cctggtgggcttgatggtgaccaat

SEQ ID NO: 254890 - DNA, 25 bp, Rattus norvegicus
cctggtggtcatatgttggcctgaa

SEQ ID NO: 254891 - DNA, 25 bp, Rattus norvegicus
cctggtggtcatttgttggcctgaa

SEQ ID NO: 254892 - DNA, 25 bp, Rattus norvegicus
cctggtggtggtcccacataccttt

SEQ ID NO: 254893 - DNA, 25 bp, Rattus norvegicus
cctggtggtggtgccacataccttt

SEQ ID NO: 254894 - DNA, 25 bp, Rattus norvegicus
cctggtggttgtaagcgggattaca

SEQ ID NO: 254895 - DNA, 25 bp, Rattus norvegicus
cctggtggttgttagcgggattaca

SEQ ID NO: 254896 - DNA, 25 bp, Rattus norvegicus
cctggtgtaccaagtttgctatgca

SEQ ID NO: 254897 - DNA, 25 bp, Rattus norvegicus
cctggtgtaccatgtttgctatgca

SEQ ID NO: 254898 - DNA, 25 bp, Rattus norvegicus
cctggtgtacttatttagcctgcgt

SEQ ID NO: 254899 - DNA, 25 bp, Rattus norvegicus
cctggtgtacttttttagcctgcgt

SEQ ID NO: 254900 - DNA, 25 bp, Rattus norvegicus
cctggtgtagatcaaacaactggtt

SEQ ID NO: 254901 - DNA, 25 bp, Rattus norvegicus
cctggtgtagatgaaacaactggtt

SEQ ID NO: 254902 - DNA, 25 bp, Rattus norvegicus
cctggtgtcaatccttggggccagt

SEQ ID NO: 254903 - DNA, 25 bp, Rattus norvegicus
cctggtgtcaatgcttggggccagt

SEQ ID NO: 254904 - DNA, 25 bp, Rattus norvegicus
cctggtgtctccatggaccaaattt

SEQ ID NO: 254905 - DNA, 25 bp, Rattus norvegicus
cctggtgtctccttggaccaaattt

SEQ ID NO: 254906 - DNA, 25 bp, Rattus norvegicus
cctggtgtctctaagtttcaaagca

SEQ ID NO: 254907 - DNA, 25 bp, Rattus norvegicus
cctggtgtctcttagtttcaaagca

SEQ ID NO: 254908 - DNA, 25 bp, Rattus norvegicus
cctggtgtgctcagggatatgcata

SEQ ID NO: 254909 - DNA, 25 bp, Rattus norvegicus
cctggtgtgctctgggatatgcata

SEQ ID NO: 254910 - DNA, 25 bp, Rattus norvegicus
cctggtgtgttgaagcagacgctgt

SEQ ID NO: 254911 - DNA, 25 bp, Rattus norvegicus
cctggtgtgttgtagcagacgctgt

SEQ ID NO: 254912 - DNA, 25 bp, Rattus norvegicus
cctggtgttcagagtagagttcatg

SEQ ID NO: 254913 - DNA, 25 bp, Rattus norvegicus
cctggtgttcagtgtagagttcatg

SEQ ID NO: 254914 - DNA, 25 bp, Rattus norvegicus
cctggtgttccactgcggccatgga

SEQ ID NO: 254915 - DNA, 25 bp, Rattus norvegicus
cctggtgttccagtgcggccatgga

SEQ ID NO: 254916 - DNA, 25 bp, Rattus norvegicus
cctggtgtttatcgactcttgcaaa

SEQ ID NO: 254917 - DNA, 25 bp, Rattus norvegicus
cctggtgtttatggactcttgcaaa

SEQ ID NO: 254918 - DNA, 25 bp, Rattus norvegicus
cctggtgtttgacgtggaactgctc

SEQ ID NO: 254919 - DNA, 25 bp, Rattus norvegicus
cctggtgtttgaggtggaactgctc

SEQ ID NO: 254920 - DNA, 25 bp, Rattus norvegicus
cctggttaaacactcttcatctggg

SEQ ID NO: 254921 - DNA, 25 bp, Rattus norvegicus
cctggttaaacagtcttcatctggg

SEQ ID NO: 254922 - DNA, 25 bp, Rattus norvegicus
cctggttaccctacaatggtcattt

SEQ ID NO: 254923 - DNA, 25 bp, Rattus norvegicus
cctggttacccttcaatggtcattt

SEQ ID NO: 254924 - DNA, 25 bp, Rattus norvegicus
cctggttaccgcagcttgaaggagt

SEQ ID NO: 254925 - DNA, 25 bp, Rattus norvegicus
cctggttaccgctgcttgaaggagt

SEQ ID NO: 254926 - DNA, 25 bp, Rattus norvegicus
cctggttagtccaggccttcaggaa

SEQ ID NO: 254927 - DNA, 25 bp, Rattus norvegicus
cctggttagtcctggccttcaggaa

SEQ ID NO: 254928 - DNA, 25 bp, Rattus norvegicus
cctggttataacctgatgctaaaac

SEQ ID NO: 254929 - DNA, 25 bp, Rattus norvegicus
cctggttataacgtgatgctaaaac

SEQ ID NO: 254930 - DNA, 25 bp, Rattus norvegicus
cctggttcacacacttgttgtaaat

SEQ ID NO: 254931 - DNA, 25 bp, Rattus norvegicus
cctggttcacactcttgttgtaaat

SEQ ID NO: 254932 - DNA, 25 bp, Rattus norvegicus
cctggttccctcatggtgccttggg

SEQ ID NO: 254933 - DNA, 25 bp, Rattus norvegicus
cctggttccctcttggtgccttggg

SEQ ID NO: 254934 - DNA, 25 bp, Rattus norvegicus
cctggttctctacactcaagcaaat

SEQ ID NO: 254935 - DNA, 25 bp, Rattus norvegicus
cctggttctctagactcaagcaaat

SEQ ID NO: 254936 - DNA, 25 bp, Rattus norvegicus
cctggttgaaatactggcatttggg

SEQ ID NO: 254937 - DNA, 25 bp, Rattus norvegicus
cctggttgaaattctggcatttggg

SEQ ID NO: 254938 - DNA, 25 bp, Rattus norvegicus
cctggttgaactagttgcgagcata

SEQ ID NO: 254939 - DNA, 25 bp, Rattus norvegicus
cctggttgaacttgttgcgagcata

SEQ ID NO: 254940 - DNA, 25 bp, Rattus norvegicus
cctggttgtcagctttggttcataa

SEQ ID NO: 254941 - DNA, 25 bp, Rattus norvegicus
cctggttgtcaggtttggttcataa

SEQ ID NO: 254942 - DNA, 25 bp, Rattus norvegicus
cctggtttcagcatgtcctatactt

SEQ ID NO: 254943 - DNA, 25 bp, Rattus norvegicus
cctggtttcagcttgtcctatactt

SEQ ID NO: 254944 - DNA, 25 bp, Rattus norvegicus
cctggtttcctcagcatattttaca

SEQ ID NO: 254945 - DNA, 25 bp, Rattus norvegicus
cctggtttcctctgcatattttaca

SEQ ID NO: 254946 - DNA, 25 bp, Rattus norvegicus
cctggtttcttaaattctgttatag

SEQ ID NO: 254947 - DNA, 25 bp, Rattus norvegicus
cctggtttcttatattctgttatag

SEQ ID NO: 254948 - DNA, 25 bp, Rattus norvegicus
cctggtttgtcaaggagcctccgag

SEQ ID NO: 254949 - DNA, 25 bp, Rattus norvegicus
cctggtttgtcatggagcctccgag

SEQ ID NO: 254950 - DNA, 25 bp, Rattus norvegicus
cctgtaaattcaattgtcattcaaa

SEQ ID NO: 254951 - DNA, 25 bp, Rattus norvegicus
cctgtaaattcatttgtcattcaaa

SEQ ID NO: 254952 - DNA, 25 bp, Rattus norvegicus
cctgtaacacctctactatgggaag

SEQ ID NO: 254953 - DNA, 25 bp, Rattus norvegicus
cctgtaacacctgtactatgggaag

SEQ ID NO: 254954 - DNA, 25 bp, Rattus norvegicus
cctgtaaggtacacactacatatta

SEQ ID NO: 254955 - DNA, 25 bp, Rattus norvegicus
cctgtaaggtactcactacatatta

SEQ ID NO: 254956 - DNA, 25 bp, Rattus norvegicus
cctgtaatactactgctcgggctga

SEQ ID NO: 254957 - DNA, 25 bp, Rattus norvegicus
cctgtaatactagtgctcgggctga

SEQ ID NO: 254958 - DNA, 25 bp, Rattus norvegicus
cctgtaatatgtccctagccatttg

SEQ ID NO: 254959 - DNA, 25 bp, Rattus norvegicus
cctgtaatatgtgcctagccatttg

SEQ ID NO: 254960 - DNA, 25 bp, Rattus norvegicus
cctgtacacattcctgagtttaaat

SEQ ID NO: 254961 - DNA, 25 bp, Rattus norvegicus
cctgtacacattgctgagtttaaat

SEQ ID NO: 254962 - DNA, 25 bp, Rattus norvegicus
cctgtacagatacaagcagccggga

SEQ ID NO: 254963 - DNA, 25 bp, Rattus norvegicus
cctgtacagatagaagcagccggga

SEQ ID NO: 254964 - DNA, 25 bp, Rattus norvegicus
cctgtacctcccatgttgattaaga

SEQ ID NO: 254965 - DNA, 25 bp, Rattus norvegicus
cctgtacctcccttgttgattaaga

SEQ ID NO: 254966 - DNA, 25 bp, Rattus norvegicus
cctgtactagaaatggtgtgtccct

SEQ ID NO: 254967 - DNA, 25 bp, Rattus norvegicus
cctgtactagaattggtgtgtccct

SEQ ID NO: 254968 - DNA, 25 bp, Rattus norvegicus
cctgtactcccacccgtaaagatga

SEQ ID NO: 254969 - DNA, 25 bp, Rattus norvegicus
cctgtactcccagccgtaaagatga

SEQ ID NO: 254970 - DNA, 25 bp, Rattus norvegicus
cctgtactcggtcgctgcgggacta

SEQ ID NO: 254971 - DNA, 25 bp, Rattus norvegicus
cctgtactcggtggctgcgggacta

SEQ ID NO: 254972 - DNA, 25 bp, Rattus norvegicus
cctgtactgtttaggttctgcgaaa

SEQ ID NO: 254973 - DNA, 25 bp, Rattus norvegicus
cctgtactgttttggttctgcgaaa

SEQ ID NO: 254974 - DNA, 25 bp, Rattus norvegicus
cctgtacttcttagtcctggactgt

SEQ ID NO: 254975 - DNA, 25 bp, Rattus norvegicus
cctgtacttctttgtcctggactgt

SEQ ID NO: 254976 - DNA, 25 bp, Rattus norvegicus
cctgtagacaggactctgtgtgcaa

SEQ ID NO: 254977 - DNA, 25 bp, Rattus norvegicus
cctgtagacaggtctctgtgtgcaa

SEQ ID NO: 254978 - DNA, 25 bp, Rattus norvegicus
cctgtagattccacatgccacagag

SEQ ID NO: 254979 - DNA, 25 bp, Rattus norvegicus
cctgtagattcctcatgccacagag

SEQ ID NO: 254980 - DNA, 25 bp, Rattus norvegicus
cctgtaggtcttcgactctatggaa

SEQ ID NO: 254981 - DNA, 25 bp, Rattus norvegicus
cctgtaggtcttggactctatggaa

SEQ ID NO: 254982 - DNA, 25 bp, Rattus norvegicus
cctgtagtcctcaacctgtgaaggg

SEQ ID NO: 254983 - DNA, 25 bp, Rattus norvegicus
cctgtagtcctctacctgtgaaggg

SEQ ID NO: 254984 - DNA, 25 bp, Rattus norvegicus
cctgtagtgcggatgctgggtaatt

SEQ ID NO: 254985 - DNA, 25 bp, Rattus norvegicus
cctgtagtgcggttgctgggtaatt

SEQ ID NO: 254986 - DNA, 25 bp, Rattus norvegicus
cctgtagtggtgcaaacacggccca

SEQ ID NO: 254987 - DNA, 25 bp, Rattus norvegicus
cctgtagtggtggaaacacggccca

SEQ ID NO: 254988 - DNA, 25 bp, Rattus norvegicus
cctgtatatagaagacgcctcctgt

SEQ ID NO: 254989 - DNA, 25 bp, Rattus norvegicus
cctgtatatagatgacgcctcctgt

SEQ ID NO: 254990 - DNA, 25 bp, Rattus norvegicus
cctgtatcgactccgctcagatggg

SEQ ID NO: 254991 - DNA, 25 bp, Rattus norvegicus
cctgtatcgactgcgctcagatggg

SEQ ID NO: 254992 - DNA, 25 bp, Rattus norvegicus
cctgtatctgggagagtagcatttt

SEQ ID NO: 254993 - DNA, 25 bp, Rattus norvegicus
cctgtatctgggtgagtagcatttt

SEQ ID NO: 254994 - DNA, 25 bp, Rattus norvegicus
cctgtatgacgacgagctggcccag

SEQ ID NO: 254995 - DNA, 25 bp, Rattus norvegicus
cctgtatgacgaggagctggcccag

SEQ ID NO: 254996 - DNA, 25 bp, Rattus norvegicus
cctgtatgtgtcaacctctggaaaa

SEQ ID NO: 254997 - DNA, 25 bp, Rattus norvegicus
cctgtatgtgtctacctctggaaaa

SEQ ID NO: 254998 - DNA, 25 bp, Rattus norvegicus
cctgtatgttggatcctgatggatt

SEQ ID NO: 254999 - DNA, 25 bp, Rattus norvegicus
cctgtatgttggctctttggtacta

SEQ ID NO: 255000 - DNA, 25 bp, Rattus norvegicus
cctgtatgttgggtctttggtacta

SEQ ID NO: 255001 - DNA, 25 bp, Rattus norvegicus
cctgtatgttggttcctgatggatt

SEQ ID NO: 255002 - DNA, 25 bp, Rattus norvegicus
cctgtatgtttcaacttggagctta

SEQ ID NO: 255003 - DNA, 25 bp, Rattus norvegicus
cctgtatgtttctacttggagctta

SEQ ID NO: 255004 - DNA, 25 bp, Rattus norvegicus
cctgtcaaaaatagagtcacgtccg

SEQ ID NO: 255005 - DNA, 25 bp, Rattus norvegicus
cctgtcaaaaattgagtcacgtccg

SEQ ID NO: 255006 - DNA, 25 bp, Rattus norvegicus
cctgtcaaagcacaccctatatgta

SEQ ID NO: 255007 - DNA, 25 bp, Rattus norvegicus
cctgtcaaagcagaccctatatgta

SEQ ID NO: 255008 - DNA, 25 bp, Rattus norvegicus
cctgtcacatacaatttggcaatac

SEQ ID NO: 255009 - DNA, 25 bp, Rattus norvegicus
cctgtcacatactatttggcaatac

SEQ ID NO: 255010 - DNA, 25 bp, Rattus norvegicus
cctgtcacattgccgactgatgaag

SEQ ID NO: 255011 - DNA, 25 bp, Rattus norvegicus
cctgtcacattggcgactgatgaag

SEQ ID NO: 255012 - DNA, 25 bp, Rattus norvegicus
cctgtcactggaattctcaccagaa

SEQ ID NO: 255013 - DNA, 25 bp, Rattus norvegicus
cctgtcactggatttctcaccagaa

SEQ ID NO: 255014 - DNA, 25 bp, Rattus norvegicus
cctgtcaggttcactacagagactt

SEQ ID NO: 255015 - DNA, 25 bp, Rattus norvegicus
cctgtcaggttctctacagagactt

SEQ ID NO: 255016 - DNA, 25 bp, Rattus norvegicus
cctgtcagttttccctggtgcaaaa

SEQ ID NO: 255017 - DNA, 25 bp, Rattus norvegicus
cctgtcagttttgcctggtgcaaaa

SEQ ID NO: 255018 - DNA, 25 bp, Rattus norvegicus
cctgtcataccacagcctgagagat

SEQ ID NO: 255019 - DNA, 25 bp, Rattus norvegicus
cctgtcataccagagcctgagagat

SEQ ID NO: 255020 - DNA, 25 bp, Rattus norvegicus
cctgtcatcccaagggccattttga

SEQ ID NO: 255021 - DNA, 25 bp, Rattus norvegicus
cctgtcatcccatgggccattttga

SEQ ID NO: 255022 - DNA, 25 bp, Rattus norvegicus
cctgtcatgtgtcctctcacgtgtc

SEQ ID NO: 255023 - DNA, 25 bp, Rattus norvegicus
cctgtcatgtgtgctctcacgtgtc

SEQ ID NO: 255024 - DNA, 25 bp, Rattus norvegicus
cctgtcatttttacacttctgtttt

SEQ ID NO: 255025 - DNA, 25 bp, Rattus norvegicus
cctgtcattttttcacttctgtttt

SEQ ID NO: 255026 - DNA, 25 bp, Rattus norvegicus
cctgtcccaaggagaagcgctgaga

SEQ ID NO: 255027 - DNA, 25 bp, Rattus norvegicus
cctgtcccaaggtgaagcgctgaga

SEQ ID NO: 255028 - DNA, 25 bp, Rattus norvegicus
cctgtcccacagatacaaacacatt

SEQ ID NO: 255029 - DNA, 25 bp, Rattus norvegicus
cctgtcccacagttacaaacacatt

SEQ ID NO: 255030 - DNA, 25 bp, Rattus norvegicus
cctgtcccaggaaatatgtgtgttt

SEQ ID NO: 255031 - DNA, 25 bp, Rattus norvegicus
cctgtcccaggatatatgtgtgttt

SEQ ID NO: 255032 - DNA, 25 bp, Rattus norvegicus
cctgtcccatgtccatcttatttaa

SEQ ID NO: 255033 - DNA, 25 bp, Rattus norvegicus
cctgtcccatgtgcatcttatttaa

SEQ ID NO: 255034 - DNA, 25 bp, Rattus norvegicus
cctgtcccgtccattgtgaaattat

SEQ ID NO: 255035 - DNA, 25 bp, Rattus norvegicus
cctgtcccgtcctttgtgaaattat

SEQ ID NO: 255036 - DNA, 25 bp, Rattus norvegicus
cctgtccctggaagtgcgtcgtgca

SEQ ID NO: 255037 - DNA, 25 bp, Rattus norvegicus
cctgtccctggatgtgcgtcgtgca

SEQ ID NO: 255038 - DNA, 25 bp, Rattus norvegicus
cctgtccgctgcagtgtgcccagaa

SEQ ID NO: 255039 - DNA, 25 bp, Rattus norvegicus
cctgtccgctgctgtgtgcccagaa

SEQ ID NO: 255040 - DNA, 25 bp, Rattus norvegicus
cctgtccgtgctccttaaataattg

SEQ ID NO: 255041 - DNA, 25 bp, Rattus norvegicus
cctgtccgtgctgcttaaataattg

SEQ ID NO: 255042 - DNA, 25 bp, Rattus norvegicus
cctgtcctaactacctttgatgata

SEQ ID NO: 255043 - DNA, 25 bp, Rattus norvegicus
cctgtcctaacttcctttgatgata

SEQ ID NO: 255044 - DNA, 25 bp, Rattus norvegicus
cctgtcctcaccaactctgggaagt

SEQ ID NO: 255045 - DNA, 25 bp, Rattus norvegicus
cctgtcctcacctactctgggaagt

SEQ ID NO: 255046 - DNA, 25 bp, Rattus norvegicus
cctgtcctggagcagctattgcaaa

SEQ ID NO: 255047 - DNA, 25 bp, Rattus norvegicus
cctgtcctggaggagctattgcaaa

SEQ ID NO: 255048 - DNA, 25 bp, Rattus norvegicus
cctgtcctgttcacgatttcatggg

SEQ ID NO: 255049 - DNA, 25 bp, Rattus norvegicus
cctgtcctgttctcgatttcatggg

SEQ ID NO: 255050 - DNA, 25 bp, Rattus norvegicus
cctgtccttggcatgttttgtatca

SEQ ID NO: 255051 - DNA, 25 bp, Rattus norvegicus
cctgtccttggcttgttttgtatca

SEQ ID NO: 255052 - DNA, 25 bp, Rattus norvegicus
cctgtcgcccttctggttaaatgta

SEQ ID NO: 255053 - DNA, 25 bp, Rattus norvegicus
cctgtcgcccttgtggttaaatgta

SEQ ID NO: 255054 - DNA, 25 bp, Rattus norvegicus
cctgtcgcctttaactgcaagaatt

SEQ ID NO: 255055 - DNA, 25 bp, Rattus norvegicus
cctgtcgccttttactgcaagaatt

SEQ ID NO: 255056 - DNA, 25 bp, Rattus norvegicus
cctgtcgtgaatactgtcttgctaa

SEQ ID NO: 255057 - DNA, 25 bp, Rattus norvegicus
cctgtcgtgaattctgtcttgctaa

SEQ ID NO: 255058 - DNA, 25 bp, Rattus norvegicus
cctgtcgtgcttactctgagttaga

SEQ ID NO: 255059 - DNA, 25 bp, Rattus norvegicus
cctgtcgtgctttctctgagttaga

SEQ ID NO: 255060 - DNA, 25 bp, Rattus norvegicus
cctgtctacatccttcagagattgc

SEQ ID NO: 255061 - DNA, 25 bp, Rattus norvegicus
cctgtctacatcgttcagagattgc

SEQ ID NO: 255062 - DNA, 25 bp, Rattus norvegicus
cctgtctcagccacttgtaaattat

SEQ ID NO: 255063 - DNA, 25 bp, Rattus norvegicus
cctgtctcagcctcttgtaaattat

SEQ ID NO: 255064 - DNA, 25 bp, Rattus norvegicus
cctgtctcagggaatgggttgctct

SEQ ID NO: 255065 - DNA, 25 bp, Rattus norvegicus
cctgtctcagggtatgggttgctct

SEQ ID NO: 255066 - DNA, 25 bp, Rattus norvegicus
cctgtctcattgctagtgccagaag

SEQ ID NO: 255067 - DNA, 25 bp, Rattus norvegicus
cctgtctcattggtagtgccagaag

SEQ ID NO: 255068 - DNA, 25 bp, Rattus norvegicus
cctgtctccctacctggtgggagat

SEQ ID NO: 255069 - DNA, 25 bp, Rattus norvegicus
cctgtctccctagctggtgggagat

SEQ ID NO: 255070 - DNA, 25 bp, Rattus norvegicus
cctgtctcctaaccactgggaggaa

SEQ ID NO: 255071 - DNA, 25 bp, Rattus norvegicus
cctgtctcctaagcactgggaggaa

SEQ ID NO: 255072 - DNA, 25 bp, Rattus norvegicus
cctgtctctctgacttgtagtgaga

SEQ ID NO: 255073 - DNA, 25 bp, Rattus norvegicus
cctgtctctctgtcttgtagtgaga

SEQ ID NO: 255074 - DNA, 25 bp, Rattus norvegicus
cctgtctctgcacatttcagtttga

SEQ ID NO: 255075 - DNA, 25 bp, Rattus norvegicus
cctgtctctgcagatttcagtttga

SEQ ID NO: 255076 - DNA, 25 bp, Rattus norvegicus
cctgtctcttttagtgtctcatcaa

SEQ ID NO: 255077 - DNA, 25 bp, Rattus norvegicus
cctgtctctttttgtgtctcatcaa

SEQ ID NO: 255078 - DNA, 25 bp, Rattus norvegicus
cctgtctgaaggaggccaaggccta

SEQ ID NO: 255079 - DNA, 25 bp, Rattus norvegicus
cctgtctgaaggcactgggtaaaac

SEQ ID NO: 255080 - DNA, 25 bp, Rattus norvegicus
cctgtctgaagggactgggtaaaac

SEQ ID NO: 255081 - DNA, 25 bp, Rattus norvegicus
cctgtctgaaggtggccaaggccta

SEQ ID NO: 255082 - DNA, 25 bp, Rattus norvegicus
cctgtctgcgttctgccgggaatca

SEQ ID NO: 255083 - DNA, 25 bp, Rattus norvegicus
cctgtctgcgttgtgccgggaatca

SEQ ID NO: 255084 - DNA, 25 bp, Rattus norvegicus
cctgtctgctcgcacatgtatacaa

SEQ ID NO: 255085 - DNA, 25 bp, Rattus norvegicus
cctgtctgctcggacatgtatacaa

SEQ ID NO: 255086 - DNA, 25 bp, Rattus norvegicus
cctgtctgcttcacaagtgctaaga

SEQ ID NO: 255087 - DNA, 25 bp, Rattus norvegicus
cctgtctgcttctcaagtgctaaga

SEQ ID NO: 255088 - DNA, 25 bp, Rattus norvegicus
cctgtctgtaaacctccacaaagtt

SEQ ID NO: 255089 - DNA, 25 bp, Rattus norvegicus
cctgtctgtaaagctccacaaagtt

SEQ ID NO: 255090 - DNA, 25 bp, Rattus norvegicus
cctgtctgtataaccctgggtccca

SEQ ID NO: 255091 - DNA, 25 bp, Rattus norvegicus
cctgtctgtatatccctgggtccca

SEQ ID NO: 255092 - DNA, 25 bp, Rattus norvegicus
cctgtcttaattcttctttccatag

SEQ ID NO: 255093 - DNA, 25 bp, Rattus norvegicus
cctgtcttaattgttctttccatag

SEQ ID NO: 255094 - DNA, 25 bp, Rattus norvegicus
cctgtcttacagatgcgtctgggta

SEQ ID NO: 255095 - DNA, 25 bp, Rattus norvegicus
cctgtcttacagttgcgtctgggta

SEQ ID NO: 255096 - DNA, 25 bp, Rattus norvegicus
cctgtcttactgcattgttctggtt

SEQ ID NO: 255097 - DNA, 25 bp, Rattus norvegicus
cctgtcttactggattgttctggtt

SEQ ID NO: 255098 - DNA, 25 bp, Rattus norvegicus
cctgtcttaggcctgagtcatgaac

SEQ ID NO: 255099 - DNA, 25 bp, Rattus norvegicus
cctgtcttaggcgtgagtcatgaac

SEQ ID NO: 255100 - DNA, 25 bp, Rattus norvegicus
cctgtcttagtcagcctctagaaaa

SEQ ID NO: 255101 - DNA, 25 bp, Rattus norvegicus
cctgtcttagtctgcctctagaaaa

SEQ ID NO: 255102 - DNA, 25 bp, Rattus norvegicus
cctgtcttctgtccggcaaataaat

SEQ ID NO: 255103 - DNA, 25 bp, Rattus norvegicus
cctgtcttctgtgcggcaaataaat

SEQ ID NO: 255104 - DNA, 25 bp, Rattus norvegicus
cctgtctttctcaagaagggtgatg

SEQ ID NO: 255105 - DNA, 25 bp, Rattus norvegicus
cctgtctttctctagaagggtgatg

SEQ ID NO: 255106 - DNA, 25 bp, Rattus norvegicus
cctgtgaactggagtgaccaaacac

SEQ ID NO: 255107 - DNA, 25 bp, Rattus norvegicus
cctgtgaactggtgtgaccaaacac

SEQ ID NO: 255108 - DNA, 25 bp, Rattus norvegicus
cctgtgacaagtaccctcatgagaa

SEQ ID NO: 255109 - DNA, 25 bp, Rattus norvegicus
cctgtgacaagttccctcatgagaa

SEQ ID NO: 255110 - DNA, 25 bp, Rattus norvegicus
cctgtgacatggactgcagcatcat

SEQ ID NO: 255111 - DNA, 25 bp, Rattus norvegicus
cctgtgacatggtctgcagcatcat

SEQ ID NO: 255112 - DNA, 25 bp, Rattus norvegicus
cctgtgaccattcatcttgtgtgtt

SEQ ID NO: 255113 - DNA, 25 bp, Rattus norvegicus
cctgtgaccattgatcttgtgtgtt

SEQ ID NO: 255114 - DNA, 25 bp, Rattus norvegicus
cctgtgaccctcagtgaagtggtga

SEQ ID NO: 255115 - DNA, 25 bp, Rattus norvegicus
cctgtgaccctctgtgaagtggtga

SEQ ID NO: 255116 - DNA, 25 bp, Rattus norvegicus
cctgtgacctcaacttatattccaa

SEQ ID NO: 255117 - DNA, 25 bp, Rattus norvegicus
cctgtgacctcatcttatattccaa

SEQ ID NO: 255118 - DNA, 25 bp, Rattus norvegicus
cctgtgacctgtcggtagacctgct

SEQ ID NO: 255119 - DNA, 25 bp, Rattus norvegicus
cctgtgacctgtgggtagacctgct

SEQ ID NO: 255120 - DNA, 25 bp, Rattus norvegicus
cctgtgactctgaccttaggatgca

SEQ ID NO: 255121 - DNA, 25 bp, Rattus norvegicus
cctgtgactctgtccttaggatgca

SEQ ID NO: 255122 - DNA, 25 bp, Rattus norvegicus
cctgtgacttttctactgtggtaga

SEQ ID NO: 255123 - DNA, 25 bp, Rattus norvegicus
cctgtgacttttgtactgtggtaga

SEQ ID NO: 255124 - DNA, 25 bp, Rattus norvegicus
cctgtgagaagcagggcatccgagt

SEQ ID NO: 255125 - DNA, 25 bp, Rattus norvegicus
cctgtgagaagctgggcatccgagt

SEQ ID NO: 255126 - DNA, 25 bp, Rattus norvegicus
cctgtgagctgcactgctggtggca

SEQ ID NO: 255127 - DNA, 25 bp, Rattus norvegicus
cctgtgagctgctctgctggtggca

SEQ ID NO: 255128 - DNA, 25 bp, Rattus norvegicus
cctgtgagctgtactgtcttctgca

SEQ ID NO: 255129 - DNA, 25 bp, Rattus norvegicus
cctgtgagctgttctgtcttctgca

SEQ ID NO: 255130 - DNA, 25 bp, Rattus norvegicus
cctgtgaggataaggcgccgcctag

SEQ ID NO: 255131 - DNA, 25 bp, Rattus norvegicus
cctgtgaggatatggcgccgcctag

SEQ ID NO: 255132 - DNA, 25 bp, Rattus norvegicus
cctgtgatcatcatgggcccaatga

SEQ ID NO: 255133 - DNA, 25 bp, Rattus norvegicus
cctgtgatcatcttgggcccaatga

SEQ ID NO: 255134 - DNA, 25 bp, Rattus norvegicus
cctgtgatgtctctcttctttacga

SEQ ID NO: 255135 - DNA, 25 bp, Rattus norvegicus
cctgtgatgtctgtcttctttacga

SEQ ID NO: 255136 - DNA, 25 bp, Rattus norvegicus
cctgtgattcagcagcgtgactggt

SEQ ID NO: 255137 - DNA, 25 bp, Rattus norvegicus
cctgtgattcaggagcgtgactggt

SEQ ID NO: 255138 - DNA, 25 bp, Rattus norvegicus
cctgtgcactaaagggccagatttt

SEQ ID NO: 255139 - DNA, 25 bp, Rattus norvegicus
cctgtgcactaatgggccagatttt

SEQ ID NO: 255140 - DNA, 25 bp, Rattus norvegicus
cctgtgcactctacgttctgtagca

SEQ ID NO: 255141 - DNA, 25 bp, Rattus norvegicus
cctgtgcactcttcgttctgtagca

SEQ ID NO: 255142 - DNA, 25 bp, Rattus norvegicus
cctgtgcagtgcctgtttggttgct

SEQ ID NO: 255143 - DNA, 25 bp, Rattus norvegicus
cctgtgcagtgcgtgtttggttgct

SEQ ID NO: 255144 - DNA, 25 bp, Rattus norvegicus
cctgtgcatcgcacctgaagaagaa

SEQ ID NO: 255145 - DNA, 25 bp, Rattus norvegicus
cctgtgcatcgctcctgaagaagaa

SEQ ID NO: 255146 - DNA, 25 bp, Rattus norvegicus
cctgtgccacccagattgtgaataa

SEQ ID NO: 255147 - DNA, 25 bp, Rattus norvegicus
cctgtgccaccctgattgtgaataa

SEQ ID NO: 255148 - DNA, 25 bp, Rattus norvegicus
cctgtgcccacaactggaatacgaa

SEQ ID NO: 255149 - DNA, 25 bp, Rattus norvegicus
cctgtgcccacatctggaatacgaa

SEQ ID NO: 255150 - DNA, 25 bp, Rattus norvegicus
cctgtgcctgctatagcgtaggaaa

SEQ ID NO: 255151 - DNA, 25 bp, Rattus norvegicus
cctgtgcctgctttagcgtaggaaa

SEQ ID NO: 255152 - DNA, 25 bp, Rattus norvegicus
cctgtgcctggcaaggatctgggat

SEQ ID NO: 255153 - DNA, 25 bp, Rattus norvegicus
cctgtgcctggctaggatctgggat

SEQ ID NO: 255154 - DNA, 25 bp, Rattus norvegicus
cctgtgccttctaagtgctgggata

SEQ ID NO: 255155 - DNA, 25 bp, Rattus norvegicus
cctgtgccttcttagtgctgggata

SEQ ID NO: 255156 - DNA, 25 bp, Rattus norvegicus
cctgtgctcagactctccaacaaag

SEQ ID NO: 255157 - DNA, 25 bp, Rattus norvegicus
cctgtgctcagagtctccaacaaag

SEQ ID NO: 255158 - DNA, 25 bp, Rattus norvegicus
cctgtgctcagtcttctctggaaga

SEQ ID NO: 255159 - DNA, 25 bp, Rattus norvegicus
cctgtgctcagtgttctctggaaga

SEQ ID NO: 255160 - DNA, 25 bp, Rattus norvegicus
cctgtgctccatcggaaggctgcag

SEQ ID NO: 255161 - DNA, 25 bp, Rattus norvegicus
cctgtgctccatgggaaggctgcag

SEQ ID NO: 255162 - DNA, 25 bp, Rattus norvegicus
cctgtgctctggaatagactgttgt

SEQ ID NO: 255163 - DNA, 25 bp, Rattus norvegicus
cctgtgctctggtatagactgttgt

SEQ ID NO: 255164 - DNA, 25 bp, Rattus norvegicus
cctgtgctgcatcggtgttcaagtt

SEQ ID NO: 255165 - DNA, 25 bp, Rattus norvegicus
cctgtgctgcatgggtgttcaagtt

SEQ ID NO: 255166 - DNA, 25 bp, Rattus norvegicus
cctgtgctggacacaccttcaactt

SEQ ID NO: 255167 - DNA, 25 bp, Rattus norvegicus
cctgtgctggactcaccttcaactt

SEQ ID NO: 255168 - DNA, 25 bp, Rattus norvegicus
cctgtgcttgccaacgggtaaatgg

SEQ ID NO: 255169 - DNA, 25 bp, Rattus norvegicus
cctgtgcttgcctacgggtaaatgg

SEQ ID NO: 255170 - DNA, 25 bp, Rattus norvegicus
cctgtgcttgctctgtttgtaaatt

SEQ ID NO: 255171 - DNA, 25 bp, Rattus norvegicus
cctgtgcttgctgtgtttgtaaatt

SEQ ID NO: 255172 - DNA, 25 bp, Rattus norvegicus
cctgtgctttacagtatcttcctga

SEQ ID NO: 255173 - DNA, 25 bp, Rattus norvegicus
cctgtgctttactgtatcttcctga

SEQ ID NO: 255174 - DNA, 25 bp, Rattus norvegicus
cctgtgctttttagtgcatgttctg

SEQ ID NO: 255175 - DNA, 25 bp, Rattus norvegicus
cctgtgcttttttgtgcatgttctg

SEQ ID NO: 255176 - DNA, 25 bp, Rattus norvegicus
cctgtggaaactcaaccctttgtag

SEQ ID NO: 255177 - DNA, 25 bp, Rattus norvegicus
cctgtggaaactgaaccctttgtag

SEQ ID NO: 255178 - DNA, 25 bp, Rattus norvegicus
cctgtggaaccacctgtagtggaga

SEQ ID NO: 255179 - DNA, 25 bp, Rattus norvegicus
cctgtggaaccagctgtagtggaga

SEQ ID NO: 255180 - DNA, 25 bp, Rattus norvegicus
cctgtggaatccaagcacgtcggaa

SEQ ID NO: 255181 - DNA, 25 bp, Rattus norvegicus
cctgtggaatcctagcacgtcggaa

SEQ ID NO: 255182 - DNA, 25 bp, Rattus norvegicus
cctgtggatcaacgccttgcttgga

SEQ ID NO: 255183 - DNA, 25 bp, Rattus norvegicus
cctgtggatcaaggccttgcttgga

SEQ ID NO: 255184 - DNA, 25 bp, Rattus norvegicus
cctgtggatctgctgcctctggaga

SEQ ID NO: 255185 - DNA, 25 bp, Rattus norvegicus
cctgtggatctggtgcctctggaga

SEQ ID NO: 255186 - DNA, 25 bp, Rattus norvegicus
cctgtggcaaacaacctgttttcga

SEQ ID NO: 255187 - DNA, 25 bp, Rattus norvegicus
cctgtggcaaactacctgttttcga

SEQ ID NO: 255188 - DNA, 25 bp, Rattus norvegicus
cctgtggcactgaaggcaccttcca

SEQ ID NO: 255189 - DNA, 25 bp, Rattus norvegicus
cctgtggcactgtaggcaccttcca

SEQ ID NO: 255190 - DNA, 25 bp, Rattus norvegicus
cctgtggcatccatgggttttatag

SEQ ID NO: 255191 - DNA, 25 bp, Rattus norvegicus
cctgtggcatccttgggttttatag

SEQ ID NO: 255192 - DNA, 25 bp, Rattus norvegicus
cctgtggcatcgacaagttccgagg

SEQ ID NO: 255193 - DNA, 25 bp, Rattus norvegicus
cctgtggcatcgtcaagttccgagg

SEQ ID NO: 255194 - DNA, 25 bp, Rattus norvegicus
cctgtggccagaaccagtgtggaga

SEQ ID NO: 255195 - DNA, 25 bp, Rattus norvegicus
cctgtggccagatccagtgtggaga

SEQ ID NO: 255196 - DNA, 25 bp, Rattus norvegicus
cctgtggcttaacccctcttggaaa

SEQ ID NO: 255197 - DNA, 25 bp, Rattus norvegicus
cctgtggcttaagccctcttggaaa

SEQ ID NO: 255198 - DNA, 25 bp, Rattus norvegicus
cctgtggcttttaaagcccatgtga

SEQ ID NO: 255199 - DNA, 25 bp, Rattus norvegicus
cctgtggctttttaagcccatgtga

SEQ ID NO: 255200 - DNA, 25 bp, Rattus norvegicus
cctgtgggcacgactgttcggagaa

SEQ ID NO: 255201 - DNA, 25 bp, Rattus norvegicus
cctgtgggcacgtctgttcggagaa

SEQ ID NO: 255202 - DNA, 25 bp, Rattus norvegicus
cctgtgggcctcatgctgggtaagt

SEQ ID NO: 255203 - DNA, 25 bp, Rattus norvegicus
cctgtgggcctcttgctgggtaagt

SEQ ID NO: 255204 - DNA, 25 bp, Rattus norvegicus
cctgtgggtcctcttcattttgcga

SEQ ID NO: 255205 - DNA, 25 bp, Rattus norvegicus
cctgtgggtcctgttcattttgcga

SEQ ID NO: 255206 - DNA, 25 bp, Rattus norvegicus
cctgtgggtcgtcagtggtacctaa

SEQ ID NO: 255207 - DNA, 25 bp, Rattus norvegicus
cctgtgggtcgtgagtggtacctaa

SEQ ID NO: 255208 - DNA, 25 bp, Rattus norvegicus
cctgtgggtgtgagtatttgtgaaa

SEQ ID NO: 255209 - DNA, 25 bp, Rattus norvegicus
cctgtgggtgtgtgtatttgtgaaa

SEQ ID NO: 255210 - DNA, 25 bp, Rattus norvegicus
cctgtgggttggaggaattactctt

SEQ ID NO: 255211 - DNA, 25 bp, Rattus norvegicus
cctgtgggttggtggaattactctt

SEQ ID NO: 255212 - DNA, 25 bp, Rattus norvegicus
cctgtgggttttaggttctgttcag

SEQ ID NO: 255213 - DNA, 25 bp, Rattus norvegicus
cctgtgggtttttggttctgttcag

SEQ ID NO: 255214 - DNA, 25 bp, Rattus norvegicus
cctgtggtatgtccatactatgaga

SEQ ID NO: 255215 - DNA, 25 bp, Rattus norvegicus
cctgtggtatgtgcatactatgaga

SEQ ID NO: 255216 - DNA, 25 bp, Rattus norvegicus
cctgtggtcactcaatcatcttaat

SEQ ID NO: 255217 - DNA, 25 bp, Rattus norvegicus
cctgtggtcactgaatcatcttaat

SEQ ID NO: 255218 - DNA, 25 bp, Rattus norvegicus
cctgtggtccttcggcctataaaga

SEQ ID NO: 255219 - DNA, 25 bp, Rattus norvegicus
cctgtggtccttgggcctataaaga

SEQ ID NO: 255220 - DNA, 25 bp, Rattus norvegicus
cctgtggtcttgagctggctggcaa

SEQ ID NO: 255221 - DNA, 25 bp, Rattus norvegicus
cctgtggtcttgtgctggctggcaa

SEQ ID NO: 255222 - DNA, 25 bp, Rattus norvegicus
cctgtggtgagcaatgcctactgta

SEQ ID NO: 255223 - DNA, 25 bp, Rattus norvegicus
cctgtggtgagctatgcctactgta

SEQ ID NO: 255224 - DNA, 25 bp, Rattus norvegicus
cctgtggtgggtaatgtgttttgtc

SEQ ID NO: 255225 - DNA, 25 bp, Rattus norvegicus
cctgtggtgggttatgtgttttgtc

SEQ ID NO: 255226 - DNA, 25 bp, Rattus norvegicus
cctgtggttaccctggccgcatcta

SEQ ID NO: 255227 - DNA, 25 bp, Rattus norvegicus
cctgtggttaccgtggccgcatcta

SEQ ID NO: 255228 - DNA, 25 bp, Rattus norvegicus
cctgtggtttccacagaattaactt

SEQ ID NO: 255229 - DNA, 25 bp, Rattus norvegicus
cctgtggtttcctcagaattaactt

SEQ ID NO: 255230 - DNA, 25 bp, Rattus norvegicus
cctgtggtttttctccagtaactga

SEQ ID NO: 255231 - DNA, 25 bp, Rattus norvegicus
cctgtggtttttgtccagtaactga

SEQ ID NO: 255232 - DNA, 25 bp, Rattus norvegicus
cctgtgtacaatatcttatgacata

SEQ ID NO: 255233 - DNA, 25 bp, Rattus norvegicus
cctgtgtacaatttcttatgacata

SEQ ID NO: 255234 - DNA, 25 bp, Rattus norvegicus
cctgtgtacagtattttccttgcat

SEQ ID NO: 255235 - DNA, 25 bp, Rattus norvegicus
cctgtgtacagttttttccttgcat

SEQ ID NO: 255236 - DNA, 25 bp, Rattus norvegicus
cctgtgtaccttctgagctagtgat

SEQ ID NO: 255237 - DNA, 25 bp, Rattus norvegicus
cctgtgtaccttgtgagctagtgat

SEQ ID NO: 255238 - DNA, 25 bp, Rattus norvegicus
cctgtgtactttactgtactgtggg

SEQ ID NO: 255239 - DNA, 25 bp, Rattus norvegicus
cctgtgtacttttctgtactgtggg

SEQ ID NO: 255240 - DNA, 25 bp, Rattus norvegicus
cctgtgtagctgagctgcatgtgaa

SEQ ID NO: 255241 - DNA, 25 bp, Rattus norvegicus
cctgtgtagctgtgctgcatgtgaa

SEQ ID NO: 255242 - DNA, 25 bp, Rattus norvegicus
cctgtgtattttaggtatcgtgtaa

SEQ ID NO: 255243 - DNA, 25 bp, Rattus norvegicus
cctgtgtatttttggtatcgtgtaa

SEQ ID NO: 255244 - DNA, 25 bp, Rattus norvegicus
cctgtgtccattaccaaaacttgca

SEQ ID NO: 255245 - DNA, 25 bp, Rattus norvegicus
cctgtgtccatttccaaaacttgca

SEQ ID NO: 255246 - DNA, 25 bp, Rattus norvegicus
cctgtgtcctatcggttactagatc

SEQ ID NO: 255247 - DNA, 25 bp, Rattus norvegicus
cctgtgtcctatgggttactagatc

SEQ ID NO: 255248 - DNA, 25 bp, Rattus norvegicus
cctgtgtcctggaggcttaaagcca

SEQ ID NO: 255249 - DNA, 25 bp, Rattus norvegicus
cctgtgtcctggtggcttaaagcca

SEQ ID NO: 255250 - DNA, 25 bp, Rattus norvegicus
cctgtgtctgagatcctattttcat

SEQ ID NO: 255251 - DNA, 25 bp, Rattus norvegicus
cctgtgtctgagttcctattttcat

SEQ ID NO: 255252 - DNA, 25 bp, Rattus norvegicus
cctgtgtctgcacagtgccttcaaa

SEQ ID NO: 255253 - DNA, 25 bp, Rattus norvegicus
cctgtgtctgcagagtgccttcaaa

SEQ ID NO: 255254 - DNA, 25 bp, Rattus norvegicus
cctgtgtgaatgaatggccgactgt

SEQ ID NO: 255255 - DNA, 25 bp, Rattus norvegicus
cctgtgtgaatgtatggccgactgt

SEQ ID NO: 255256 - DNA, 25 bp, Rattus norvegicus
cctgtgtgagggacatcttggtaat

SEQ ID NO: 255257 - DNA, 25 bp, Rattus norvegicus
cctgtgtgagggtcatcttggtaat

SEQ ID NO: 255258 - DNA, 25 bp, Rattus norvegicus
cctgtgtgcaaaacatcatgtccct

SEQ ID NO: 255259 - DNA, 25 bp, Rattus norvegicus
cctgtgtgcaaatcatcatgtccct

SEQ ID NO: 255260 - DNA, 25 bp, Rattus norvegicus
cctgtgtgccatctgcggaatctga

SEQ ID NO: 255261 - DNA, 25 bp, Rattus norvegicus
cctgtgtgccatgtgcggaatctga

SEQ ID NO: 255262 - DNA, 25 bp, Rattus norvegicus
cctgtgtgcctgagtcctttagaga

SEQ ID NO: 255263 - DNA, 25 bp, Rattus norvegicus
cctgtgtgcctgtgtcctttagaga

SEQ ID NO: 255264 - DNA, 25 bp, Rattus norvegicus
cctgtgtggctgagttgatacctca

SEQ ID NO: 255265 - DNA, 25 bp, Rattus norvegicus
cctgtgtggctgtgttgatacctca

SEQ ID NO: 255266 - DNA, 25 bp, Rattus norvegicus
cctgtgtgtaaccagaagagtgatg

SEQ ID NO: 255267 - DNA, 25 bp, Rattus norvegicus
cctgtgtgtaacgagaagagtgatg

SEQ ID NO: 255268 - DNA, 25 bp, Rattus norvegicus
cctgtgtgtcacattcaactgataa

SEQ ID NO: 255269 - DNA, 25 bp, Rattus norvegicus
cctgtgtgtcactttcaactgataa

SEQ ID NO: 255270 - DNA, 25 bp, Rattus norvegicus
cctgtgtgtgaaacccttgtgtaga

SEQ ID NO: 255271 - DNA, 25 bp, Rattus norvegicus
cctgtgtgtgaatcccttgtgtaga

SEQ ID NO: 255272 - DNA, 25 bp, Rattus norvegicus
cctgtgtgtggccatatgggcacaa

SEQ ID NO: 255273 - DNA, 25 bp, Rattus norvegicus
cctgtgtgtggcgatatgggcacaa

SEQ ID NO: 255274 - DNA, 25 bp, Rattus norvegicus
cctgtgtgtgggactaacggaatta

SEQ ID NO: 255275 - DNA, 25 bp, Rattus norvegicus
cctgtgtgtgggtctaacggaatta

SEQ ID NO: 255276 - DNA, 25 bp, Rattus norvegicus
cctgtgtgtggtactgacggaaaaa

SEQ ID NO: 255277 - DNA, 25 bp, Rattus norvegicus
cctgtgtgtggttctgacggaaaaa

SEQ ID NO: 255278 - DNA, 25 bp, Rattus norvegicus
cctgtgtgttctactgggccaagca

SEQ ID NO: 255279 - DNA, 25 bp, Rattus norvegicus
cctgtgtgttcttctgggccaagca

SEQ ID NO: 255280 - DNA, 25 bp, Rattus norvegicus
cctgtgttacacacctttgaataat

SEQ ID NO: 255281 - DNA, 25 bp, Rattus norvegicus
cctgtgttacactcctttgaataat

SEQ ID NO: 255282 - DNA, 25 bp, Rattus norvegicus
cctgtgttcagtccagcagtgcaaa

SEQ ID NO: 255283 - DNA, 25 bp, Rattus norvegicus
cctgtgttcagtgcagcagtgcaaa

SEQ ID NO: 255284 - DNA, 25 bp, Rattus norvegicus
cctgtgttcgctatctgggactgaa

SEQ ID NO: 255285 - DNA, 25 bp, Rattus norvegicus
cctgtgttcgctttctgggactgaa

SEQ ID NO: 255286 - DNA, 25 bp, Rattus norvegicus
cctgtgttctggcttttaatatggc

SEQ ID NO: 255287 - DNA, 25 bp, Rattus norvegicus
cctgtgttctgggttttaatatggc

SEQ ID NO: 255288 - DNA, 25 bp, Rattus norvegicus
cctgtgttgggcaataaagatctca

SEQ ID NO: 255289 - DNA, 25 bp, Rattus norvegicus
cctgtgttgggctataaagatctca

SEQ ID NO: 255290 - DNA, 25 bp, Rattus norvegicus
cctgtgttggtaatggcttctctaa

SEQ ID NO: 255291 - DNA, 25 bp, Rattus norvegicus
cctgtgttggtattggcttctctaa

SEQ ID NO: 255292 - DNA, 25 bp, Rattus norvegicus
cctgtgtttccaattactgaagcaa

SEQ ID NO: 255293 - DNA, 25 bp, Rattus norvegicus
cctgtgtttccatttactgaagcaa

SEQ ID NO: 255294 - DNA, 25 bp, Rattus norvegicus
cctgtgtttcctctactgagctata

SEQ ID NO: 255295 - DNA, 25 bp, Rattus norvegicus
cctgtgtttcctgtactgagctata

SEQ ID NO: 255296 - DNA, 25 bp, Rattus norvegicus
cctgttaaaatcagctcctgacatg

SEQ ID NO: 255297 - DNA, 25 bp, Rattus norvegicus
cctgttaaaatctgctcctgacatg

SEQ ID NO: 255298 - DNA, 25 bp, Rattus norvegicus
cctgttaattttcttactcttgaga

SEQ ID NO: 255299 - DNA, 25 bp, Rattus norvegicus
cctgttaattttgttactcttgaga

SEQ ID NO: 255300 - DNA, 25 bp, Rattus norvegicus
cctgttacacctcctctgaaggtca

SEQ ID NO: 255301 - DNA, 25 bp, Rattus norvegicus
cctgttacacctgctctgaaggtca

SEQ ID NO: 255302 - DNA, 25 bp, Rattus norvegicus
cctgttactctgagctgccctgagc

SEQ ID NO: 255303 - DNA, 25 bp, Rattus norvegicus
cctgttactctgtgctgccctgagc

SEQ ID NO: 255304 - DNA, 25 bp, Rattus norvegicus
cctgttatttatactgctttccttc

SEQ ID NO: 255305 - DNA, 25 bp, Rattus norvegicus
cctgttatttattctgctttccttc

SEQ ID NO: 255306 - DNA, 25 bp, Rattus norvegicus
cctgttcaataaagtggacggccac

SEQ ID NO: 255307 - DNA, 25 bp, Rattus norvegicus
cctgttcaataatgtggacggccac

SEQ ID NO: 255308 - DNA, 25 bp, Rattus norvegicus
cctgttcaatatcgagcttacggat

SEQ ID NO: 255309 - DNA, 25 bp, Rattus norvegicus
cctgttcaatatggagcttacggat

SEQ ID NO: 255310 - DNA, 25 bp, Rattus norvegicus
cctgttcaatctcggcggcacgctg

SEQ ID NO: 255311 - DNA, 25 bp, Rattus norvegicus
cctgttcaatctgggcggcacgctg

SEQ ID NO: 255312 - DNA, 25 bp, Rattus norvegicus
cctgttcacaggctgtgaggcttca

SEQ ID NO: 255313 - DNA, 25 bp, Rattus norvegicus
cctgttcacagggtgtgaggcttca

SEQ ID NO: 255314 - DNA, 25 bp, Rattus norvegicus
cctgttccatgactgctctgaagaa

SEQ ID NO: 255315 - DNA, 25 bp, Rattus norvegicus
cctgttccatgagtgctctgaagaa

SEQ ID NO: 255316 - DNA, 25 bp, Rattus norvegicus
cctgttccatggcttctgtgagtag

SEQ ID NO: 255317 - DNA, 25 bp, Rattus norvegicus
cctgttccatgggttctgtgagtag

SEQ ID NO: 255318 - DNA, 25 bp, Rattus norvegicus
cctgttcccacaagtgttttcagaa

SEQ ID NO: 255319 - DNA, 25 bp, Rattus norvegicus
cctgttcccacatgtgttttcagaa

SEQ ID NO: 255320 - DNA, 25 bp, Rattus norvegicus
cctgttccccatagtgaggataata

SEQ ID NO: 255321 - DNA, 25 bp, Rattus norvegicus
cctgttccccattgtgaggataata

SEQ ID NO: 255322 - DNA, 25 bp, Rattus norvegicus
cctgttccctttccagtagtaacta

SEQ ID NO: 255323 - DNA, 25 bp, Rattus norvegicus
cctgttccctttgcagtagtaacta

SEQ ID NO: 255324 - DNA, 25 bp, Rattus norvegicus
cctgttccgatcacagtctggccaa

SEQ ID NO: 255325 - DNA, 25 bp, Rattus norvegicus
cctgttccgatctcagtctggccaa

SEQ ID NO: 255326 - DNA, 25 bp, Rattus norvegicus
cctgttcctgacagctttctgtaaa

SEQ ID NO: 255327 - DNA, 25 bp, Rattus norvegicus
cctgttcctgactgctttctgtaaa

SEQ ID NO: 255328 - DNA, 25 bp, Rattus norvegicus
cctgttcctgcaactgttgaaggga

SEQ ID NO: 255329 - DNA, 25 bp, Rattus norvegicus
cctgttcctgcatctgttgaaggga

SEQ ID NO: 255330 - DNA, 25 bp, Rattus norvegicus
cctgttcctggccagtggattgtat

SEQ ID NO: 255331 - DNA, 25 bp, Rattus norvegicus
cctgttcctggcgagtggattgtat

SEQ ID NO: 255332 - DNA, 25 bp, Rattus norvegicus
cctgttcggtacactggaggctaat

SEQ ID NO: 255333 - DNA, 25 bp, Rattus norvegicus
cctgttcggtactctggaggctaat

SEQ ID NO: 255334 - DNA, 25 bp, Rattus norvegicus
cctgttctaaaaagctgaatactat

SEQ ID NO: 255335 - DNA, 25 bp, Rattus norvegicus
cctgttctaaaatgctgaatactat

SEQ ID NO: 255336 - DNA, 25 bp, Rattus norvegicus
cctgttctacaacgtgagttccaag

SEQ ID NO: 255337 - DNA, 25 bp, Rattus norvegicus
cctgttctacaaggtgagttccaag

SEQ ID NO: 255338 - DNA, 25 bp, Rattus norvegicus
cctgttctacttacttatctctaac

SEQ ID NO: 255339 - DNA, 25 bp, Rattus norvegicus
cctgttctactttcttatctctaac

SEQ ID NO: 255340 - DNA, 25 bp, Rattus norvegicus
cctgttctatccatcaaatacccaa

SEQ ID NO: 255341 - DNA, 25 bp, Rattus norvegicus
cctgttctatccttcaaatacccaa

SEQ ID NO: 255342 - DNA, 25 bp, Rattus norvegicus
cctgttctcattatccactaacgaa

SEQ ID NO: 255343 - DNA, 25 bp, Rattus norvegicus
cctgttctcattttccactaacgaa

SEQ ID NO: 255344 - DNA, 25 bp, Rattus norvegicus
cctgttctccacacacaagtgtaga

SEQ ID NO: 255345 - DNA, 25 bp, Rattus norvegicus
cctgttctccactcacaagtgtaga

SEQ ID NO: 255346 - DNA, 25 bp, Rattus norvegicus
cctgttctctagacaatgctggcac

SEQ ID NO: 255347 - DNA, 25 bp, Rattus norvegicus
cctgttctctagtcaatgctggcac

SEQ ID NO: 255348 - DNA, 25 bp, Rattus norvegicus
cctgttctctttccactgttggaaa

SEQ ID NO: 255349 - DNA, 25 bp, Rattus norvegicus
cctgttctctttgcactgttggaaa

SEQ ID NO: 255350 - DNA, 25 bp, Rattus norvegicus
cctgttctgatcctggcctaagttg

SEQ ID NO: 255351 - DNA, 25 bp, Rattus norvegicus
cctgttctgatcgtggcctaagttg

SEQ ID NO: 255352 - DNA, 25 bp, Rattus norvegicus
cctgttctgtgtctctgtagctgtg

SEQ ID NO: 255353 - DNA, 25 bp, Rattus norvegicus
cctgttctgtgtgtctgtagctgtg

SEQ ID NO: 255354 - DNA, 25 bp, Rattus norvegicus
cctgttcttgaacttggtggagtag

SEQ ID NO: 255355 - DNA, 25 bp, Rattus norvegicus
cctgttcttgaagttggtggagtag

SEQ ID NO: 255356 - DNA, 25 bp, Rattus norvegicus
cctgttcttggcaggatgtgctgaa

SEQ ID NO: 255357 - DNA, 25 bp, Rattus norvegicus
cctgttcttggctggatgtgctgaa

SEQ ID NO: 255358 - DNA, 25 bp, Rattus norvegicus
cctgttgagacgagaaatgccctat

SEQ ID NO: 255359 - DNA, 25 bp, Rattus norvegicus
cctgttgagacgtgaaatgccctat

SEQ ID NO: 255360 - DNA, 25 bp, Rattus norvegicus
cctgttgcaaaccaatagccttctg

SEQ ID NO: 255361 - DNA, 25 bp, Rattus norvegicus
cctgttgcaaacgaatagccttctg

SEQ ID NO: 255362 - DNA, 25 bp, Rattus norvegicus
cctgttgccatgctggtttcaaaga

SEQ ID NO: 255363 - DNA, 25 bp, Rattus norvegicus
cctgttgccatggtggtttcaaaga

SEQ ID NO: 255364 - DNA, 25 bp, Rattus norvegicus
cctgttgcccatagccaataagcat

SEQ ID NO: 255365 - DNA, 25 bp, Rattus norvegicus
cctgttgcccattgccaataagcat

SEQ ID NO: 255366 - DNA, 25 bp, Rattus norvegicus
cctgttgcggagagcagcaggtcct

SEQ ID NO: 255367 - DNA, 25 bp, Rattus norvegicus
cctgttgcggagtgcagcaggtcct

SEQ ID NO: 255368 - DNA, 25 bp, Rattus norvegicus
cctgttgctggaccagcgcgctgct

SEQ ID NO: 255369 - DNA, 25 bp, Rattus norvegicus
cctgttgctggagcagcgcgctgct

SEQ ID NO: 255370 - DNA, 25 bp, Rattus norvegicus
cctgttggagcacagtaaccggaga

SEQ ID NO: 255371 - DNA, 25 bp, Rattus norvegicus
cctgttggagcagagtaaccggaga

SEQ ID NO: 255372 - DNA, 25 bp, Rattus norvegicus
cctgttggcttgagaagagcttgct

SEQ ID NO: 255373 - DNA, 25 bp, Rattus norvegicus
cctgttggcttgtgaagagcttgct

SEQ ID NO: 255374 - DNA, 25 bp, Rattus norvegicus
cctgttgtctctccttatcactaaa

SEQ ID NO: 255375 - DNA, 25 bp, Rattus norvegicus
cctgttgtctctgcttatcactaaa

SEQ ID NO: 255376 - DNA, 25 bp, Rattus norvegicus
cctgttgtgaggatctgtgcttgtt

SEQ ID NO: 255377 - DNA, 25 bp, Rattus norvegicus
cctgttgtgaggttctgtgcttgtt

SEQ ID NO: 255378 - DNA, 25 bp, Rattus norvegicus
cctgttgttatgattctgacctcca

SEQ ID NO: 255379 - DNA, 25 bp, Rattus norvegicus
cctgttgttatgtttctgacctcca

SEQ ID NO: 255380 - DNA, 25 bp, Rattus norvegicus
cctgttgttcttcgccagtagtttc

SEQ ID NO: 255381 - DNA, 25 bp, Rattus norvegicus
cctgttgttcttggccagtagtttc

SEQ ID NO: 255382 - DNA, 25 bp, Rattus norvegicus
cctgttgttgggatgttccatttct

SEQ ID NO: 255383 - DNA, 25 bp, Rattus norvegicus
cctgttgttgggttgttccatttct

SEQ ID NO: 255384 - DNA, 25 bp, Rattus norvegicus
cctgtttactataccagagctctag

SEQ ID NO: 255385 - DNA, 25 bp, Rattus norvegicus
cctgtttactattccagagctctag

SEQ ID NO: 255386 - DNA, 25 bp, Rattus norvegicus
cctgtttactctagctcaactttaa

SEQ ID NO: 255387 - DNA, 25 bp, Rattus norvegicus
cctgtttactcttgctcaactttaa

SEQ ID NO: 255388 - DNA, 25 bp, Rattus norvegicus
cctgtttcactcatagctgctttta

SEQ ID NO: 255389 - DNA, 25 bp, Rattus norvegicus
cctgtttcactcttagctgctttta

SEQ ID NO: 255390 - DNA, 25 bp, Rattus norvegicus
cctgtttccaggcagttggtgcaca

SEQ ID NO: 255391 - DNA, 25 bp, Rattus norvegicus
cctgtttccagggagttggtgcaca

SEQ ID NO: 255392 - DNA, 25 bp, Rattus norvegicus
cctgtttcctgccatttccggtgtc

SEQ ID NO: 255393 - DNA, 25 bp, Rattus norvegicus
cctgtttcctgcgatttccggtgtc

SEQ ID NO: 255394 - DNA, 25 bp, Rattus norvegicus
cctgtttctgtgcacgcggttctca

SEQ ID NO: 255395 - DNA, 25 bp, Rattus norvegicus
cctgtttctgtggacgcggttctca

SEQ ID NO: 255396 - DNA, 25 bp, Rattus norvegicus
cctgtttctgttagaggcttttctg

SEQ ID NO: 255397 - DNA, 25 bp, Rattus norvegicus
cctgtttctgtttgaggcttttctg

SEQ ID NO: 255398 - DNA, 25 bp, Rattus norvegicus
cctgtttcttccacctaaatgctgg

SEQ ID NO: 255399 - DNA, 25 bp, Rattus norvegicus
cctgtttcttcctcctaaatgctgg

SEQ ID NO: 255400 - DNA, 25 bp, Rattus norvegicus
cctgtttgacttctcaaggattgct

SEQ ID NO: 255401 - DNA, 25 bp, Rattus norvegicus
cctgtttgacttgtcaaggattgct

SEQ ID NO: 255402 - DNA, 25 bp, Rattus norvegicus
cctgtttgtagccagtcttgttttt

SEQ ID NO: 255403 - DNA, 25 bp, Rattus norvegicus
cctgtttgtagcgagtcttgttttt

SEQ ID NO: 255404 - DNA, 25 bp, Rattus norvegicus
cctgtttgttctaggagactccctt

SEQ ID NO: 255405 - DNA, 25 bp, Rattus norvegicus
cctgtttgttcttggagactccctt

SEQ ID NO: 255406 - DNA, 25 bp, Rattus norvegicus
cctgttttaaggacgcgaggcgtag

SEQ ID NO: 255407 - DNA, 25 bp, Rattus norvegicus
cctgttttaaggtcgcgaggcgtag

SEQ ID NO: 255408 - DNA, 25 bp, Rattus norvegicus
cctgttttctttacctatgtcatag

SEQ ID NO: 255409 - DNA, 25 bp, Rattus norvegicus
cctgttttcttttcctatgtcatag

SEQ ID NO: 255410 - DNA, 25 bp, Rattus norvegicus
cctgttttggcaaccactgtggaat

SEQ ID NO: 255411 - DNA, 25 bp, Rattus norvegicus
cctgttttggcatccactgtggaat

SEQ ID NO: 255412 - DNA, 25 bp, Rattus norvegicus
cctgttttgtaccaccctccattgg

SEQ ID NO: 255413 - DNA, 25 bp, Rattus norvegicus
cctgttttgtacgaccctccattgg

SEQ ID NO: 255414 - DNA, 25 bp, Rattus norvegicus
cctgtttttagacctcttataactt

SEQ ID NO: 255415 - DNA, 25 bp, Rattus norvegicus
cctgtttttagagctcttataactt

SEQ ID NO: 255416 - DNA, 25 bp, Rattus norvegicus
ccttaaaaaaccagccttcctgcag

SEQ ID NO: 255417 - DNA, 25 bp, Rattus norvegicus
ccttaaaaaacctgccttcctgcag

SEQ ID NO: 255418 - DNA, 25 bp, Rattus norvegicus
ccttaaagccccagtagtaggtgag

SEQ ID NO: 255419 - DNA, 25 bp, Rattus norvegicus
ccttaaagcccctgtagtaggtgag

SEQ ID NO: 255420 - DNA, 25 bp, Rattus norvegicus
ccttaaatacatctgctggcctcct

SEQ ID NO: 255421 - DNA, 25 bp, Rattus norvegicus
ccttaaatacatgtgctggcctcct

SEQ ID NO: 255422 - DNA, 25 bp, Rattus norvegicus
ccttaaccttaaagctgccttcatt

SEQ ID NO: 255423 - DNA, 25 bp, Rattus norvegicus
ccttaaccttaatgctgccttcatt

SEQ ID NO: 255424 - DNA, 25 bp, Rattus norvegicus
ccttaatgtaaacattttgtgctat

SEQ ID NO: 255425 - DNA, 25 bp, Rattus norvegicus
ccttaatgtaaagattttgtgctat

SEQ ID NO: 255426 - DNA, 25 bp, Rattus norvegicus
ccttacaccgtgcagacaatcattt

SEQ ID NO: 255427 - DNA, 25 bp, Rattus norvegicus
ccttacaccgtggagacaatcattt

SEQ ID NO: 255428 - DNA, 25 bp, Rattus norvegicus
ccttacactgccctcattgaagtta

SEQ ID NO: 255429 - DNA, 25 bp, Rattus norvegicus
ccttacactgccgtcattgaagtta

SEQ ID NO: 255430 - DNA, 25 bp, Rattus norvegicus
ccttacagtcctctgtgagtgagag

SEQ ID NO: 255431 - DNA, 25 bp, Rattus norvegicus
ccttacagtcctgtgtgagtgagag

SEQ ID NO: 255432 - DNA, 25 bp, Rattus norvegicus
ccttacagtggtcagatcacgtggt

SEQ ID NO: 255433 - DNA, 25 bp, Rattus norvegicus
ccttacagtggtgagatcacgtggt

SEQ ID NO: 255434 - DNA, 25 bp, Rattus norvegicus
ccttacatcccacttttgctacaaa

SEQ ID NO: 255435 - DNA, 25 bp, Rattus norvegicus
ccttacatcccagttttgctacaaa

SEQ ID NO: 255436 - DNA, 25 bp, Rattus norvegicus
ccttacatttggcataccttgattt

SEQ ID NO: 255437 - DNA, 25 bp, Rattus norvegicus
ccttacatttgggataccttgattt

SEQ ID NO: 255438 - DNA, 25 bp, Rattus norvegicus
ccttaccagtggcagtgttgccaaa

SEQ ID NO: 255439 - DNA, 25 bp, Rattus norvegicus
ccttaccagtgggagtgttgccaaa

SEQ ID NO: 255440 - DNA, 25 bp, Rattus norvegicus
ccttacccaaggcactggaacttga

SEQ ID NO: 255441 - DNA, 25 bp, Rattus norvegicus
ccttacccaagggactggaacttga

SEQ ID NO: 255442 - DNA, 25 bp, Rattus norvegicus
ccttacctatctctgcagtaactgt

SEQ ID NO: 255443 - DNA, 25 bp, Rattus norvegicus
ccttacctatctgtgcagtaactgt

SEQ ID NO: 255444 - DNA, 25 bp, Rattus norvegicus
ccttacctcttgaaccaatgtctga

SEQ ID NO: 255445 - DNA, 25 bp, Rattus norvegicus
ccttacctcttgtaccaatgtctga

SEQ ID NO: 255446 - DNA, 25 bp, Rattus norvegicus
ccttactgcacaccagctgtgagga

SEQ ID NO: 255447 - DNA, 25 bp, Rattus norvegicus
ccttactgcacagcagctgtgagga

SEQ ID NO: 255448 - DNA, 25 bp, Rattus norvegicus
ccttactgtctgatcatcttgggaa

SEQ ID NO: 255449 - DNA, 25 bp, Rattus norvegicus
ccttactgtctgttcatcttgggaa

SEQ ID NO: 255450 - DNA, 25 bp, Rattus norvegicus
ccttactttgtaacctggcggatga

SEQ ID NO: 255451 - DNA, 25 bp, Rattus norvegicus
ccttactttgtatcctggcggatga

SEQ ID NO: 255452 - DNA, 25 bp, Rattus norvegicus
ccttagacccttcgtgttgtcactg

SEQ ID NO: 255453 - DNA, 25 bp, Rattus norvegicus
ccttagacccttggtgttgtcactg

SEQ ID NO: 255454 - DNA, 25 bp, Rattus norvegicus
ccttagcatatacagtgggcggtta

SEQ ID NO: 255455 - DNA, 25 bp, Rattus norvegicus
ccttagcatatagagtgggcggtta

SEQ ID NO: 255456 - DNA, 25 bp, Rattus norvegicus
ccttagccttcgctgtatctgagat

SEQ ID NO: 255457 - DNA, 25 bp, Rattus norvegicus
ccttagccttcggtgtatctgagat

SEQ ID NO: 255458 - DNA, 25 bp, Rattus norvegicus
ccttagcgtatcaagttgcagtaag

SEQ ID NO: 255459 - DNA, 25 bp, Rattus norvegicus
ccttagcgtatctagttgcagtaag

SEQ ID NO: 255460 - DNA, 25 bp, Rattus norvegicus
ccttagctatcaattcccagtggaa

SEQ ID NO: 255461 - DNA, 25 bp, Rattus norvegicus
ccttagctatcatttcccagtggaa

SEQ ID NO: 255462 - DNA, 25 bp, Rattus norvegicus
ccttagctcattccactactgtgac

SEQ ID NO: 255463 - DNA, 25 bp, Rattus norvegicus
ccttagctcattgcactactgtgac

SEQ ID NO: 255464 - DNA, 25 bp, Rattus norvegicus
ccttagctccgtctactgaatacag

SEQ ID NO: 255465 - DNA, 25 bp, Rattus norvegicus
ccttagctccgtgtactgaatacag

SEQ ID NO: 255466 - DNA, 25 bp, Rattus norvegicus
ccttagctcctgagtttgtgtgtaa

SEQ ID NO: 255467 - DNA, 25 bp, Rattus norvegicus
ccttagctcctgtgtttgtgtgtaa

SEQ ID NO: 255468 - DNA, 25 bp, Rattus norvegicus
ccttagctcgtccgacgctttagat

SEQ ID NO: 255469 - DNA, 25 bp, Rattus norvegicus
ccttagctcgtcggacgctttagat

SEQ ID NO: 255470 - DNA, 25 bp, Rattus norvegicus
ccttaggaccgtcaccagagcagta

SEQ ID NO: 255471 - DNA, 25 bp, Rattus norvegicus
ccttaggaccgtgaccagagcagta

SEQ ID NO: 255472 - DNA, 25 bp, Rattus norvegicus
ccttaggactatccttctcagtgga

SEQ ID NO: 255473 - DNA, 25 bp, Rattus norvegicus
ccttaggactatgcttctcagtgga

SEQ ID NO: 255474 - DNA, 25 bp, Rattus norvegicus
ccttaggccgctcggattttgatac

SEQ ID NO: 255475 - DNA, 25 bp, Rattus norvegicus
ccttaggccgctgggattttgatac

SEQ ID NO: 255476 - DNA, 25 bp, Rattus norvegicus
ccttaggcttacaccttcagttgga

SEQ ID NO: 255477 - DNA, 25 bp, Rattus norvegicus
ccttaggcttactccttcagttgga

SEQ ID NO: 255478 - DNA, 25 bp, Rattus norvegicus
ccttaggttgtcaggcgagtctgtg

SEQ ID NO: 255479 - DNA, 25 bp, Rattus norvegicus
ccttaggttgtctggcgagtctgtg

SEQ ID NO: 255480 - DNA, 25 bp, Rattus norvegicus
ccttagtcatctatcttccaagcat

SEQ ID NO: 255481 - DNA, 25 bp, Rattus norvegicus
ccttagtcatctttcttccaagcat

SEQ ID NO: 255482 - DNA, 25 bp, Rattus norvegicus
ccttagtctgcaagcatttcaatac

SEQ ID NO: 255483 - DNA, 25 bp, Rattus norvegicus
ccttagtctgcatgcatttcaatac

SEQ ID NO: 255484 - DNA, 25 bp, Rattus norvegicus
ccttagtttatgaggcccggcccag

SEQ ID NO: 255485 - DNA, 25 bp, Rattus norvegicus
ccttagtttatgtggcccggcccag

SEQ ID NO: 255486 - DNA, 25 bp, Rattus norvegicus
ccttataggctgcttccagtcaggt

SEQ ID NO: 255487 - DNA, 25 bp, Rattus norvegicus
ccttataggctggttccagtcaggt

SEQ ID NO: 255488 - DNA, 25 bp, Rattus norvegicus
ccttatccccacactacattaaagt

SEQ ID NO: 255489 - DNA, 25 bp, Rattus norvegicus
ccttatccccactctacattaaagt

SEQ ID NO: 255490 - DNA, 25 bp, Rattus norvegicus
ccttatctccacatctctgtaattt

SEQ ID NO: 255491 - DNA, 25 bp, Rattus norvegicus
ccttatctccacttctctgtaattt

SEQ ID NO: 255492 - DNA, 25 bp, Rattus norvegicus
ccttatgactgtattctgttgctgt

SEQ ID NO: 255493 - DNA, 25 bp, Rattus norvegicus
ccttatgactgttttctgttgctgt

SEQ ID NO: 255494 - DNA, 25 bp, Rattus norvegicus
ccttatggttgaacgcggttggcta

SEQ ID NO: 255495 - DNA, 25 bp, Rattus norvegicus
ccttatggttgatcgcggttggcta

SEQ ID NO: 255496 - DNA, 25 bp, Rattus norvegicus
ccttatgttgccactcacttaaata

SEQ ID NO: 255497 - DNA, 25 bp, Rattus norvegicus
ccttatgttgcctctcacttaaata

SEQ ID NO: 255498 - DNA, 25 bp, Rattus norvegicus
ccttatgtttaccttggcagcctga

SEQ ID NO: 255499 - DNA, 25 bp, Rattus norvegicus
ccttatgtttacgttggcagcctga

SEQ ID NO: 255500 - DNA, 25 bp, Rattus norvegicus
ccttattctccacgcatgcaatgtt

SEQ ID NO: 255501 - DNA, 25 bp, Rattus norvegicus
ccttattctccaggcatgcaatgtt

SEQ ID NO: 255502 - DNA, 25 bp, Rattus norvegicus
ccttattctttcacacagtggtgac

SEQ ID NO: 255503 - DNA, 25 bp, Rattus norvegicus
ccttattctttctcacagtggtgac

SEQ ID NO: 255504 - DNA, 25 bp, Rattus norvegicus
ccttattgcaggagaagttgggagc

SEQ ID NO: 255505 - DNA, 25 bp, Rattus norvegicus
ccttattgcaggatcgtgggctaat

SEQ ID NO: 255506 - DNA, 25 bp, Rattus norvegicus
ccttattgcaggtgaagttgggagc

SEQ ID NO: 255507 - DNA, 25 bp, Rattus norvegicus
ccttattgcaggttcgtgggctaat

SEQ ID NO: 255508 - DNA, 25 bp, Rattus norvegicus
ccttatttatggcaaccacttcatt

SEQ ID NO: 255509 - DNA, 25 bp, Rattus norvegicus
ccttatttatgggaaccacttcatt

SEQ ID NO: 255510 - DNA, 25 bp, Rattus norvegicus
ccttattttttcacagccggagcaa

SEQ ID NO: 255511 - DNA, 25 bp, Rattus norvegicus
ccttattttttctcagccggagcaa

SEQ ID NO: 255512 - DNA, 25 bp, Rattus norvegicus
ccttcaaatagtccttcctgcaaaa

SEQ ID NO: 255513 - DNA, 25 bp, Rattus norvegicus
ccttcaaatagtgcttcctgcaaaa

SEQ ID NO: 255514 - DNA, 25 bp, Rattus norvegicus
ccttcaacatggacacgcgtgctct

SEQ ID NO: 255515 - DNA, 25 bp, Rattus norvegicus
ccttcaacatggtcacgcgtgctct

SEQ ID NO: 255516 - DNA, 25 bp, Rattus norvegicus
ccttcaactaatcccagagtacctg

SEQ ID NO: 255517 - DNA, 25 bp, Rattus norvegicus
ccttcaactaatgccagagtacctg

SEQ ID NO: 255518 - DNA, 25 bp, Rattus norvegicus
ccttcaaggtatagctactggagca

SEQ ID NO: 255519 - DNA, 25 bp, Rattus norvegicus
ccttcaaggtattgctactggagca

SEQ ID NO: 255520 - DNA, 25 bp, Rattus norvegicus
ccttcaatcctgccacccgaaaagc

SEQ ID NO: 255521 - DNA, 25 bp, Rattus norvegicus
ccttcaatcctggcacccgaaaagc

SEQ ID NO: 255522 - DNA, 25 bp, Rattus norvegicus
ccttcaatgggacaggaagtaccta

SEQ ID NO: 255523 - DNA, 25 bp, Rattus norvegicus
ccttcaatgggagaggaagtaccta

SEQ ID NO: 255524 - DNA, 25 bp, Rattus norvegicus
ccttcacactccagggctggctctt

SEQ ID NO: 255525 - DNA, 25 bp, Rattus norvegicus
ccttcacactcctgggctggctctt

SEQ ID NO: 255526 - DNA, 25 bp, Rattus norvegicus
ccttcacagactcctttcttataag

SEQ ID NO: 255527 - DNA, 25 bp, Rattus norvegicus
ccttcacagactgctttcttataag

SEQ ID NO: 255528 - DNA, 25 bp, Rattus norvegicus
ccttcacagcataatcacctcagat

SEQ ID NO: 255529 - DNA, 25 bp, Rattus norvegicus
ccttcacagcattatcacctcagat

SEQ ID NO: 255530 - DNA, 25 bp, Rattus norvegicus
ccttcacagttcactttgcatttta

SEQ ID NO: 255531 - DNA, 25 bp, Rattus norvegicus
ccttcacagttctctttgcatttta

SEQ ID NO: 255532 - DNA, 25 bp, Rattus norvegicus
ccttcacatgtacaagcacacactt

SEQ ID NO: 255533 - DNA, 25 bp, Rattus norvegicus
ccttcacatgtagaagcacacactt

SEQ ID NO: 255534 - DNA, 25 bp, Rattus norvegicus
ccttcacattgacgatctgccggaa

SEQ ID NO: 255535 - DNA, 25 bp, Rattus norvegicus
ccttcacattgaggatctgccggaa

SEQ ID NO: 255536 - DNA, 25 bp, Rattus norvegicus
ccttcacctgttcgtggctaaaagt

SEQ ID NO: 255537 - DNA, 25 bp, Rattus norvegicus
ccttcacctgttggtggctaaaagt

SEQ ID NO: 255538 - DNA, 25 bp, Rattus norvegicus
ccttcaccttagagggctcaaacga

SEQ ID NO: 255539 - DNA, 25 bp, Rattus norvegicus
ccttcaccttagtgggctcaaacga

SEQ ID NO: 255540 - DNA, 25 bp, Rattus norvegicus
ccttcactgtggcaggtacatgcac

SEQ ID NO: 255541 - DNA, 25 bp, Rattus norvegicus
ccttcactgtgggaggtacatgcac

SEQ ID NO: 255542 - DNA, 25 bp, Rattus norvegicus
ccttcagaagtccacctgtggcaaa

SEQ ID NO: 255543 - DNA, 25 bp, Rattus norvegicus
ccttcagaagtcgacctgtggcaaa

SEQ ID NO: 255544 - DNA, 25 bp, Rattus norvegicus
ccttcagacctaatcagctcttact

SEQ ID NO: 255545 - DNA, 25 bp, Rattus norvegicus
ccttcagacctattcagctcttact

SEQ ID NO: 255546 - DNA, 25 bp, Rattus norvegicus
ccttcagatgacattgcagtttggg

SEQ ID NO: 255547 - DNA, 25 bp, Rattus norvegicus
ccttcagatgactttgcagtttggg

SEQ ID NO: 255548 - DNA, 25 bp, Rattus norvegicus
ccttcagatgagcacggtttaccct

SEQ ID NO: 255549 - DNA, 25 bp, Rattus norvegicus
ccttcagatgaggacggtttaccct

SEQ ID NO: 255550 - DNA, 25 bp, Rattus norvegicus
ccttcagatgttagtcctccaacaa

SEQ ID NO: 255551 - DNA, 25 bp, Rattus norvegicus
ccttcagatgtttgtcctccaacaa

SEQ ID NO: 255552 - DNA, 25 bp, Rattus norvegicus
ccttcagattctacccagtagtgta

SEQ ID NO: 255553 - DNA, 25 bp, Rattus norvegicus
ccttcagattcttcccagtagtgta

SEQ ID NO: 255554 - DNA, 25 bp, Rattus norvegicus
ccttcagcagctagtcctgtatgac

SEQ ID NO: 255555 - DNA, 25 bp, Rattus norvegicus
ccttcagcagcttgtcctgtatgac

SEQ ID NO: 255556 - DNA, 25 bp, Rattus norvegicus
ccttcagcccggcatgatagcaagt

SEQ ID NO: 255557 - DNA, 25 bp, Rattus norvegicus
ccttcagcccgggatgatagcaagt

SEQ ID NO: 255558 - DNA, 25 bp, Rattus norvegicus
ccttcagcctgcaagggaagcaaaa

SEQ ID NO: 255559 - DNA, 25 bp, Rattus norvegicus
ccttcagcctgctagggaagcaaaa

SEQ ID NO: 255560 - DNA, 25 bp, Rattus norvegicus
ccttcagcgagtatccctataacaa

SEQ ID NO: 255561 - DNA, 25 bp, Rattus norvegicus
ccttcagcgagtttccctataacaa

SEQ ID NO: 255562 - DNA, 25 bp, Rattus norvegicus
ccttcagcttcccaaagttaattat

SEQ ID NO: 255563 - DNA, 25 bp, Rattus norvegicus
ccttcagcttccgaaagttaattat

SEQ ID NO: 255564 - DNA, 25 bp, Rattus norvegicus
ccttcagggtggctctttcagcaaa

SEQ ID NO: 255565 - DNA, 25 bp, Rattus norvegicus
ccttcagggtgggtctttcagcaaa

SEQ ID NO: 255566 - DNA, 25 bp, Rattus norvegicus
ccttcagtctctcgtgacgtgcaat

SEQ ID NO: 255567 - DNA, 25 bp, Rattus norvegicus
ccttcagtctctggtgacgtgcaat

SEQ ID NO: 255568 - DNA, 25 bp, Rattus norvegicus
ccttcagtttgaacagcgggagttt

SEQ ID NO: 255569 - DNA, 25 bp, Rattus norvegicus
ccttcagtttgatcagcgggagttt

SEQ ID NO: 255570 - DNA, 25 bp, Rattus norvegicus
ccttcagtttttctgctttgggaca

SEQ ID NO: 255571 - DNA, 25 bp, Rattus norvegicus
ccttcagtttttgtgctttgggaca

SEQ ID NO: 255572 - DNA, 25 bp, Rattus norvegicus
ccttcatagtctccggcgaaaagtc

SEQ ID NO: 255573 - DNA, 25 bp, Rattus norvegicus
ccttcatagtctgcggcgaaaagtc

SEQ ID NO: 255574 - DNA, 25 bp, Rattus norvegicus
ccttcatattctaccttctacaaat

SEQ ID NO: 255575 - DNA, 25 bp, Rattus norvegicus
ccttcatattcttccttctacaaat

SEQ ID NO: 255576 - DNA, 25 bp, Rattus norvegicus
ccttcatcatatagagcacgttcac

SEQ ID NO: 255577 - DNA, 25 bp, Rattus norvegicus
ccttcatcatattgagcacgttcac

SEQ ID NO: 255578 - DNA, 25 bp, Rattus norvegicus
ccttcatcatccaagacttctgaca

SEQ ID NO: 255579 - DNA, 25 bp, Rattus norvegicus
ccttcatcatcctagacttctgaca

SEQ ID NO: 255580 - DNA, 25 bp, Rattus norvegicus
ccttcatcatgtattggagactgtt

SEQ ID NO: 255581 - DNA, 25 bp, Rattus norvegicus
ccttcatcatgttttggagactgtt

SEQ ID NO: 255582 - DNA, 25 bp, Rattus norvegicus
ccttcatccttcaccagaagaggag

SEQ ID NO: 255583 - DNA, 25 bp, Rattus norvegicus
ccttcatccttctccagaagaggag

SEQ ID NO: 255584 - DNA, 25 bp, Rattus norvegicus
ccttcatcgggactcacgtgtgtat

SEQ ID NO: 255585 - DNA, 25 bp, Rattus norvegicus
ccttcatcgggagtcacgtgtgtat

SEQ ID NO: 255586 - DNA, 25 bp, Rattus norvegicus
ccttcatctcttcacaggtgggtta

SEQ ID NO: 255587 - DNA, 25 bp, Rattus norvegicus
ccttcatctcttgacaggtgggtta

SEQ ID NO: 255588 - DNA, 25 bp, Rattus norvegicus
ccttcatcttcacggcagagtttta

SEQ ID NO: 255589 - DNA, 25 bp, Rattus norvegicus
ccttcatcttcagggcagagtttta

SEQ ID NO: 255590 - DNA, 25 bp, Rattus norvegicus
ccttcatcttccatttggtctacaa

SEQ ID NO: 255591 - DNA, 25 bp, Rattus norvegicus
ccttcatcttccttttggtctacaa

SEQ ID NO: 255592 - DNA, 25 bp, Rattus norvegicus
ccttcatgaatgaggtgaaacccaa

SEQ ID NO: 255593 - DNA, 25 bp, Rattus norvegicus
ccttcatgaatgtggtgaaacccaa

SEQ ID NO: 255594 - DNA, 25 bp, Rattus norvegicus
ccttcatgcccgcacaatggatgga

SEQ ID NO: 255595 - DNA, 25 bp, Rattus norvegicus
ccttcatgcccggacaatggatgga

SEQ ID NO: 255596 - DNA, 25 bp, Rattus norvegicus
ccttcatggcccaaatgctgggttt

SEQ ID NO: 255597 - DNA, 25 bp, Rattus norvegicus
ccttcatggccctaatgctgggttt

SEQ ID NO: 255598 - DNA, 25 bp, Rattus norvegicus
ccttcatgggcacctgtacgtatat

SEQ ID NO: 255599 - DNA, 25 bp, Rattus norvegicus
ccttcatgggcagctgtacgtatat

SEQ ID NO: 255600 - DNA, 25 bp, Rattus norvegicus
ccttcatgttgacccagccttagaa

SEQ ID NO: 255601 - DNA, 25 bp, Rattus norvegicus
ccttcatgttgagccagccttagaa

SEQ ID NO: 255602 - DNA, 25 bp, Rattus norvegicus
ccttcattaagtcaggccttcctac

SEQ ID NO: 255603 - DNA, 25 bp, Rattus norvegicus
ccttcattaagtgaggccttcctac

SEQ ID NO: 255604 - DNA, 25 bp, Rattus norvegicus
ccttcattacttacctgcattattg

SEQ ID NO: 255605 - DNA, 25 bp, Rattus norvegicus
ccttcattacttaggcacacatgct

SEQ ID NO: 255606 - DNA, 25 bp, Rattus norvegicus
ccttcattactttcctgcattattg

SEQ ID NO: 255607 - DNA, 25 bp, Rattus norvegicus
ccttcattactttggcacacatgct

SEQ ID NO: 255608 - DNA, 25 bp, Rattus norvegicus
ccttcattcattagcctctcagaat

SEQ ID NO: 255609 - DNA, 25 bp, Rattus norvegicus
ccttcattcatttgcctctcagaat

SEQ ID NO: 255610 - DNA, 25 bp, Rattus norvegicus
ccttccaaatgaccttcctacagag

SEQ ID NO: 255611 - DNA, 25 bp, Rattus norvegicus
ccttccaaatgagcttcctacagag

SEQ ID NO: 255612 - DNA, 25 bp, Rattus norvegicus
ccttccaacagtatgacctcaagtt

SEQ ID NO: 255613 - DNA, 25 bp, Rattus norvegicus
ccttccaacagtttgacctcaagtt

SEQ ID NO: 255614 - DNA, 25 bp, Rattus norvegicus
ccttccaacatcatgttctactttg

SEQ ID NO: 255615 - DNA, 25 bp, Rattus norvegicus
ccttccaacatcttgttctactttg

SEQ ID NO: 255616 - DNA, 25 bp, Rattus norvegicus
ccttccaaggagacacatgtagtca

SEQ ID NO: 255617 - DNA, 25 bp, Rattus norvegicus
ccttccaaggagtcacatgtagtca

SEQ ID NO: 255618 - DNA, 25 bp, Rattus norvegicus
ccttccaagttgaatgtctgtgcat

SEQ ID NO: 255619 - DNA, 25 bp, Rattus norvegicus
ccttccaagttgtatgtctgtgcat

SEQ ID NO: 255620 - DNA, 25 bp, Rattus norvegicus
ccttccaatcttcctctttagaata

SEQ ID NO: 255621 - DNA, 25 bp, Rattus norvegicus
ccttccaatcttgctctttagaata

SEQ ID NO: 255622 - DNA, 25 bp, Rattus norvegicus
ccttccacaataaactgtttcccta

SEQ ID NO: 255623 - DNA, 25 bp, Rattus norvegicus
ccttccacaatatactgtttcccta

SEQ ID NO: 255624 - DNA, 25 bp, Rattus norvegicus
ccttccacacagaaacgtaagatgg

SEQ ID NO: 255625 - DNA, 25 bp, Rattus norvegicus
ccttccacacagtaacgtaagatgg

SEQ ID NO: 255626 - DNA, 25 bp, Rattus norvegicus
ccttccacgtaccattttgcagagt

SEQ ID NO: 255627 - DNA, 25 bp, Rattus norvegicus
ccttccacgtacgattttgcagagt

SEQ ID NO: 255628 - DNA, 25 bp, Rattus norvegicus
ccttccacgtgcattattcattcat

SEQ ID NO: 255629 - DNA, 25 bp, Rattus norvegicus
ccttccacgtgctttattcattcat

SEQ ID NO: 255630 - DNA, 25 bp, Rattus norvegicus
ccttccactctgcatgttttcagga

SEQ ID NO: 255631 - DNA, 25 bp, Rattus norvegicus
ccttccactctggatgttttcagga

SEQ ID NO: 255632 - DNA, 25 bp, Rattus norvegicus
ccttccactggaagacttgtctgaa

SEQ ID NO: 255633 - DNA, 25 bp, Rattus norvegicus
ccttccactggatgacttgtctgaa

SEQ ID NO: 255634 - DNA, 25 bp, Rattus norvegicus
ccttccagaatccattcctttttag

SEQ ID NO: 255635 - DNA, 25 bp, Rattus norvegicus
ccttccagaatcgattcctttttag

SEQ ID NO: 255636 - DNA, 25 bp, Rattus norvegicus
ccttccagccagaattagctatcac

SEQ ID NO: 255637 - DNA, 25 bp, Rattus norvegicus
ccttccagccagtattagctatcac

SEQ ID NO: 255638 - DNA, 25 bp, Rattus norvegicus
ccttccatataaccttccttattct

SEQ ID NO: 255639 - DNA, 25 bp, Rattus norvegicus
ccttccatataagcttccttattct

SEQ ID NO: 255640 - DNA, 25 bp, Rattus norvegicus
ccttcccaaggactggaggctctgg

SEQ ID NO: 255641 - DNA, 25 bp, Rattus norvegicus
ccttcccaaggagtggaggctctgg

SEQ ID NO: 255642 - DNA, 25 bp, Rattus norvegicus
ccttcccacagtaatcacagattgc

SEQ ID NO: 255643 - DNA, 25 bp, Rattus norvegicus
ccttcccacagttatcacagattgc

SEQ ID NO: 255644 - DNA, 25 bp, Rattus norvegicus
ccttcccactccaatttcaaatgga

SEQ ID NO: 255645 - DNA, 25 bp, Rattus norvegicus
ccttcccactcctatttcaaatgga

SEQ ID NO: 255646 - DNA, 25 bp, Rattus norvegicus
ccttcccagagcagtcatggagttt

SEQ ID NO: 255647 - DNA, 25 bp, Rattus norvegicus
ccttcccagagctgtcatggagttt

SEQ ID NO: 255648 - DNA, 25 bp, Rattus norvegicus
ccttcccagattccagtctttaatt

SEQ ID NO: 255649 - DNA, 25 bp, Rattus norvegicus
ccttcccagattgcagtctttaatt

SEQ ID NO: 255650 - DNA, 25 bp, Rattus norvegicus
ccttcccagtcaatggacactgaga

SEQ ID NO: 255651 - DNA, 25 bp, Rattus norvegicus
ccttcccagtcattggacactgaga

SEQ ID NO: 255652 - DNA, 25 bp, Rattus norvegicus
ccttccccacatatcttttaaagca

SEQ ID NO: 255653 - DNA, 25 bp, Rattus norvegicus
ccttccccacatttcttttaaagca

SEQ ID NO: 255654 - DNA, 25 bp, Rattus norvegicus
ccttccccacggaaggaacatagcg

SEQ ID NO: 255655 - DNA, 25 bp, Rattus norvegicus
ccttccccacggtaggaacatagcg

SEQ ID NO: 255656 - DNA, 25 bp, Rattus norvegicus
ccttccccagatatgtgaactgtga

SEQ ID NO: 255657 - DNA, 25 bp, Rattus norvegicus
ccttccccagatttgtgaactgtga

SEQ ID NO: 255658 - DNA, 25 bp, Rattus norvegicus
ccttcccctcaactgaaaatcataa

SEQ ID NO: 255659 - DNA, 25 bp, Rattus norvegicus
ccttcccctcaagtgaaaatcataa

SEQ ID NO: 255660 - DNA, 25 bp, Rattus norvegicus
ccttcccctcgactgtattgtgtgg

SEQ ID NO: 255661 - DNA, 25 bp, Rattus norvegicus
ccttcccctcgagtgtattgtgtgg

SEQ ID NO: 255662 - DNA, 25 bp, Rattus norvegicus
ccttcccctcttataggagcaatga

SEQ ID NO: 255663 - DNA, 25 bp, Rattus norvegicus
ccttcccctcttttaggagcaatga

SEQ ID NO: 255664 - DNA, 25 bp, Rattus norvegicus
ccttcccgttgactgtatagctaat

SEQ ID NO: 255665 - DNA, 25 bp, Rattus norvegicus
ccttcccgttgagtgtatagctaat

SEQ ID NO: 255666 - DNA, 25 bp, Rattus norvegicus
ccttccctagtcatgcattgcaaag

SEQ ID NO: 255667 - DNA, 25 bp, Rattus norvegicus
ccttccctagtcttgcattgcaaag

SEQ ID NO: 255668 - DNA, 25 bp, Rattus norvegicus
ccttccctcaggacacagatgtgtt

SEQ ID NO: 255669 - DNA, 25 bp, Rattus norvegicus
ccttccctcaggtcacagatgtgtt

SEQ ID NO: 255670 - DNA, 25 bp, Rattus norvegicus
ccttccctcattagtgctttcaaaa

SEQ ID NO: 255671 - DNA, 25 bp, Rattus norvegicus
ccttccctcatttgtgctttcaaaa

SEQ ID NO: 255672 - DNA, 25 bp, Rattus norvegicus
ccttccctgagtattgttctctgtc

SEQ ID NO: 255673 - DNA, 25 bp, Rattus norvegicus
ccttccctgagttttgttctctgtc

SEQ ID NO: 255674 - DNA, 25 bp, Rattus norvegicus
ccttccctgtccataaactatcagt

SEQ ID NO: 255675 - DNA, 25 bp, Rattus norvegicus
ccttccctgtccttaaactatcagt

SEQ ID NO: 255676 - DNA, 25 bp, Rattus norvegicus
ccttcccttgacattcttttgttgt

SEQ ID NO: 255677 - DNA, 25 bp, Rattus norvegicus
ccttcccttgactttcttttgttgt

SEQ ID NO: 255678 - DNA, 25 bp, Rattus norvegicus
ccttcccttgtaaccttacatgtaa

SEQ ID NO: 255679 - DNA, 25 bp, Rattus norvegicus
ccttcccttgtatccttacatgtaa

SEQ ID NO: 255680 - DNA, 25 bp, Rattus norvegicus
ccttccgactgccaggagtgtatta

SEQ ID NO: 255681 - DNA, 25 bp, Rattus norvegicus
ccttccgactgcgaggagtgtatta

SEQ ID NO: 255682 - DNA, 25 bp, Rattus norvegicus
ccttccgctataaacattccaattg

SEQ ID NO: 255683 - DNA, 25 bp, Rattus norvegicus
ccttccgctatatacattccaattg

SEQ ID NO: 255684 - DNA, 25 bp, Rattus norvegicus
ccttccggactcagaacacaatgta

SEQ ID NO: 255685 - DNA, 25 bp, Rattus norvegicus
ccttccggactctgaacacaatgta

SEQ ID NO: 255686 - DNA, 25 bp, Rattus norvegicus
ccttccgtgaggaaaagtgcccatc

SEQ ID NO: 255687 - DNA, 25 bp, Rattus norvegicus
ccttccgtgaggtaaagtgcccatc

SEQ ID NO: 255688 - DNA, 25 bp, Rattus norvegicus
ccttccgtgctgagtgtcattgaga

SEQ ID NO: 255689 - DNA, 25 bp, Rattus norvegicus
ccttccgtgctgtgtgtcattgaga

SEQ ID NO: 255690 - DNA, 25 bp, Rattus norvegicus
ccttccgtttctactttctctatgt

SEQ ID NO: 255691 - DNA, 25 bp, Rattus norvegicus
ccttccgtttcttctttctctatgt

SEQ ID NO: 255692 - DNA, 25 bp, Rattus norvegicus
ccttcctaacagactattgcaatta

SEQ ID NO: 255693 - DNA, 25 bp, Rattus norvegicus
ccttcctaacagtctattgcaatta

SEQ ID NO: 255694 - DNA, 25 bp, Rattus norvegicus
ccttcctaaggacggttcagacatt

SEQ ID NO: 255695 - DNA, 25 bp, Rattus norvegicus
ccttcctaaggagggttcagacatt

SEQ ID NO: 255696 - DNA, 25 bp, Rattus norvegicus
ccttcctagcagatctcgtttgtaa

SEQ ID NO: 255697 - DNA, 25 bp, Rattus norvegicus
ccttcctagcagttctcgtttgtaa

SEQ ID NO: 255698 - DNA, 25 bp, Rattus norvegicus
ccttcctatcacacctgtttaataa

SEQ ID NO: 255699 - DNA, 25 bp, Rattus norvegicus
ccttcctatcactcctgtttaataa

SEQ ID NO: 255700 - DNA, 25 bp, Rattus norvegicus
ccttcctcagagagtcttctgtcaa

SEQ ID NO: 255701 - DNA, 25 bp, Rattus norvegicus
ccttcctcagagtgtcttctgtcaa

SEQ ID NO: 255702 - DNA, 25 bp, Rattus norvegicus
ccttcctcagctacgtgtgaaataa

SEQ ID NO: 255703 - DNA, 25 bp, Rattus norvegicus
ccttcctcagcttcgtgtgaaataa

SEQ ID NO: 255704 - DNA, 25 bp, Rattus norvegicus
ccttcctcctataatccagggtagg

SEQ ID NO: 255705 - DNA, 25 bp, Rattus norvegicus
ccttcctcctattatccagggtagg

SEQ ID NO: 255706 - DNA, 25 bp, Rattus norvegicus
ccttcctcgaggaacaacagactat

SEQ ID NO: 255707 - DNA, 25 bp, Rattus norvegicus
ccttcctcgaggtacaacagactat

SEQ ID NO: 255708 - DNA, 25 bp, Rattus norvegicus
ccttcctctcttacatagattcttt

SEQ ID NO: 255709 - DNA, 25 bp, Rattus norvegicus
ccttcctctctttcatagattcttt

SEQ ID NO: 255710 - DNA, 25 bp, Rattus norvegicus
ccttcctctgctcggtttgcagata

SEQ ID NO: 255711 - DNA, 25 bp, Rattus norvegicus
ccttcctctgctgggtttgcagata

SEQ ID NO: 255712 - DNA, 25 bp, Rattus norvegicus
ccttcctctttgaccttcaagaata

SEQ ID NO: 255713 - DNA, 25 bp, Rattus norvegicus
ccttcctctttgtccttcaagaata

SEQ ID NO: 255714 - DNA, 25 bp, Rattus norvegicus
ccttcctgaaggaggagcgtggcca

SEQ ID NO: 255715 - DNA, 25 bp, Rattus norvegicus
ccttcctgaaggtggagcgtggcca

SEQ ID NO: 255716 - DNA, 25 bp, Rattus norvegicus
ccttcctgatgtcttggacgccttt

SEQ ID NO: 255717 - DNA, 25 bp, Rattus norvegicus
ccttcctgatgtgttggacgccttt

SEQ ID NO: 255718 - DNA, 25 bp, Rattus norvegicus
ccttcctgattgcacgctgtacata

SEQ ID NO: 255719 - DNA, 25 bp, Rattus norvegicus
ccttcctgattggacgctgtacata

SEQ ID NO: 255720 - DNA, 25 bp, Rattus norvegicus
ccttcctgctcaatcatcttttaag

SEQ ID NO: 255721 - DNA, 25 bp, Rattus norvegicus
ccttcctgctcattcatcttttaag

SEQ ID NO: 255722 - DNA, 25 bp, Rattus norvegicus
ccttcctgcttgctttttcaataaa

SEQ ID NO: 255723 - DNA, 25 bp, Rattus norvegicus
ccttcctgcttggtttttcaataaa

SEQ ID NO: 255724 - DNA, 25 bp, Rattus norvegicus
ccttcctggaggcttgaggttatgt

SEQ ID NO: 255725 - DNA, 25 bp, Rattus norvegicus
ccttcctggagggttgaggttatgt

SEQ ID NO: 255726 - DNA, 25 bp, Rattus norvegicus
ccttcctggatgctgattgctgtca

SEQ ID NO: 255727 - DNA, 25 bp, Rattus norvegicus
ccttcctggatggtgattgctgtca

SEQ ID NO: 255728 - DNA, 25 bp, Rattus norvegicus
ccttcctggcgtacacagaacagat

SEQ ID NO: 255729 - DNA, 25 bp, Rattus norvegicus
ccttcctggcgttcacagaacagat

SEQ ID NO: 255730 - DNA, 25 bp, Rattus norvegicus
ccttcctgggtgatgtgtgacttca

SEQ ID NO: 255731 - DNA, 25 bp, Rattus norvegicus
ccttcctgggtgttgtgtgacttca

SEQ ID NO: 255732 - DNA, 25 bp, Rattus norvegicus
ccttcctggtctcattgtcaatcgg

SEQ ID NO: 255733 - DNA, 25 bp, Rattus norvegicus
ccttcctggtctgattgtcaatcgg

SEQ ID NO: 255734 - DNA, 25 bp, Rattus norvegicus
ccttcctgtgctctttcgggaaagt

SEQ ID NO: 255735 - DNA, 25 bp, Rattus norvegicus
ccttcctgtgctgtttcgggaaagt

SEQ ID NO: 255736 - DNA, 25 bp, Rattus norvegicus
ccttcctgtgggaatcatttagact

SEQ ID NO: 255737 - DNA, 25 bp, Rattus norvegicus
ccttcctgtgggtatcatttagact

SEQ ID NO: 255738 - DNA, 25 bp, Rattus norvegicus
ccttcctgttctcttggtcttcata

SEQ ID NO: 255739 - DNA, 25 bp, Rattus norvegicus
ccttcctgttctgttggtcttcata

SEQ ID NO: 255740 - DNA, 25 bp, Rattus norvegicus
ccttccttaactccatgcgatggtg

SEQ ID NO: 255741 - DNA, 25 bp, Rattus norvegicus
ccttccttaactgcatgcgatggtg

SEQ ID NO: 255742 - DNA, 25 bp, Rattus norvegicus
ccttccttacaacccatgggttggt

SEQ ID NO: 255743 - DNA, 25 bp, Rattus norvegicus
ccttccttacaagccatgggttggt

SEQ ID NO: 255744 - DNA, 25 bp, Rattus norvegicus
ccttccttcatcctgtttattggga

SEQ ID NO: 255745 - DNA, 25 bp, Rattus norvegicus
ccttccttcatcgtgtttattggga

SEQ ID NO: 255746 - DNA, 25 bp, Rattus norvegicus
ccttccttggctatcatttgatttg

SEQ ID NO: 255747 - DNA, 25 bp, Rattus norvegicus
ccttccttggctttcatttgatttg

SEQ ID NO: 255748 - DNA, 25 bp, Rattus norvegicus
ccttcctttagacagcccagatgta

SEQ ID NO: 255749 - DNA, 25 bp, Rattus norvegicus
ccttcctttagagagcccagatgta

SEQ ID NO: 255750 - DNA, 25 bp, Rattus norvegicus
ccttcctttatcctgtctcaaggta

SEQ ID NO: 255751 - DNA, 25 bp, Rattus norvegicus
ccttcctttatcgtgtctcaaggta

SEQ ID NO: 255752 - DNA, 25 bp, Rattus norvegicus
ccttccttttgtatagttccgtgtg

SEQ ID NO: 255753 - DNA, 25 bp, Rattus norvegicus
ccttccttttgtttagttccgtgtg

SEQ ID NO: 255754 - DNA, 25 bp, Rattus norvegicus
ccttcgactcttctcagtgcagact

SEQ ID NO: 255755 - DNA, 25 bp, Rattus norvegicus
ccttcgactcttgtcagtgcagact

SEQ ID NO: 255756 - DNA, 25 bp, Rattus norvegicus
ccttcgatttcaagggttttatatc

SEQ ID NO: 255757 - DNA, 25 bp, Rattus norvegicus
ccttcgatttcatgggttttatatc

SEQ ID NO: 255758 - DNA, 25 bp, Rattus norvegicus
ccttcgcatgggatctgagactgga

SEQ ID NO: 255759 - DNA, 25 bp, Rattus norvegicus
ccttcgcatgggttctgagactgga

SEQ ID NO: 255760 - DNA, 25 bp, Rattus norvegicus
ccttcgccaaggcaactacgcagag

SEQ ID NO: 255761 - DNA, 25 bp, Rattus norvegicus
ccttcgccaagggaactacgcagag

SEQ ID NO: 255762 - DNA, 25 bp, Rattus norvegicus
ccttcgctctgtaagtcattcgtaa

SEQ ID NO: 255763 - DNA, 25 bp, Rattus norvegicus
ccttcgctctgttagtcattcgtaa

SEQ ID NO: 255764 - DNA, 25 bp, Rattus norvegicus
ccttcgctttgtcaccctgggcaag

SEQ ID NO: 255765 - DNA, 25 bp, Rattus norvegicus
ccttcgctttgtgaccctgggcaag

SEQ ID NO: 255766 - DNA, 25 bp, Rattus norvegicus
ccttcggatgggagtagttacatta

SEQ ID NO: 255767 - DNA, 25 bp, Rattus norvegicus
ccttcggatgggtgtagttacatta

SEQ ID NO: 255768 - DNA, 25 bp, Rattus norvegicus
ccttcggctgagatccagaactgaa

SEQ ID NO: 255769 - DNA, 25 bp, Rattus norvegicus
ccttcggctgagttccagaactgaa

SEQ ID NO: 255770 - DNA, 25 bp, Rattus norvegicus
ccttcgggaacacagggccttagtg

SEQ ID NO: 255771 - DNA, 25 bp, Rattus norvegicus
ccttcgggaacagagggccttagtg

SEQ ID NO: 255772 - DNA, 25 bp, Rattus norvegicus
ccttcggtctggatcagagggtgaa

SEQ ID NO: 255773 - DNA, 25 bp, Rattus norvegicus
ccttcggtctggttcagagggtgaa

SEQ ID NO: 255774 - DNA, 25 bp, Rattus norvegicus
ccttcggtgtaaatgtctctagctt

SEQ ID NO: 255775 - DNA, 25 bp, Rattus norvegicus
ccttcggtgtaattgtctctagctt

SEQ ID NO: 255776 - DNA, 25 bp, Rattus norvegicus
ccttcgtaatgtccgccagctggaa

SEQ ID NO: 255777 - DNA, 25 bp, Rattus norvegicus
ccttcgtaatgtgcgccagctggaa

SEQ ID NO: 255778 - DNA, 25 bp, Rattus norvegicus
ccttcgtgagctcgagactgtcaag

SEQ ID NO: 255779 - DNA, 25 bp, Rattus norvegicus
ccttcgtgagctggagactgtcaag

SEQ ID NO: 255780 - DNA, 25 bp, Rattus norvegicus
ccttcgtggtgactggtttaactat

SEQ ID NO: 255781 - DNA, 25 bp, Rattus norvegicus
ccttcgtggtgagtggtttaactat

SEQ ID NO: 255782 - DNA, 25 bp, Rattus norvegicus
ccttcgtgtggtatcttcagcagta

SEQ ID NO: 255783 - DNA, 25 bp, Rattus norvegicus
ccttcgtgtggtttcttcagcagta

SEQ ID NO: 255784 - DNA, 25 bp, Rattus norvegicus
ccttctaatatgagactccagtcct

SEQ ID NO: 255785 - DNA, 25 bp, Rattus norvegicus
ccttctaatatgtgactccagtcct

SEQ ID NO: 255786 - DNA, 25 bp, Rattus norvegicus
ccttctaccgtgacctagcaaaaat

SEQ ID NO: 255787 - DNA, 25 bp, Rattus norvegicus
ccttctaccgtgtcctagcaaaaat

SEQ ID NO: 255788 - DNA, 25 bp, Rattus norvegicus
ccttctagaagaatggctttccttt

SEQ ID NO: 255789 - DNA, 25 bp, Rattus norvegicus
ccttctagaagattggctttccttt

SEQ ID NO: 255790 - DNA, 25 bp, Rattus norvegicus
ccttctagcatgcttccagtcaggt

SEQ ID NO: 255791 - DNA, 25 bp, Rattus norvegicus
ccttctagcatggttccagtcaggt

SEQ ID NO: 255792 - DNA, 25 bp, Rattus norvegicus
ccttctataaagaacacatttgtga

SEQ ID NO: 255793 - DNA, 25 bp, Rattus norvegicus
ccttctataaagtacacatttgtga

SEQ ID NO: 255794 - DNA, 25 bp, Rattus norvegicus
ccttctcaacatcgactggtcttta

SEQ ID NO: 255795 - DNA, 25 bp, Rattus norvegicus
ccttctcaacatggactggtcttta

SEQ ID NO: 255796 - DNA, 25 bp, Rattus norvegicus
ccttctcaatgtcaacggcaactca

SEQ ID NO: 255797 - DNA, 25 bp, Rattus norvegicus
ccttctcaatgtgaacggcaactca

SEQ ID NO: 255798 - DNA, 25 bp, Rattus norvegicus
ccttctcactcaaacatcagctatg

SEQ ID NO: 255799 - DNA, 25 bp, Rattus norvegicus
ccttctcactcatacatcagctatg

SEQ ID NO: 255800 - DNA, 25 bp, Rattus norvegicus
ccttctcagaggaggatctgggtga

SEQ ID NO: 255801 - DNA, 25 bp, Rattus norvegicus
ccttctcagaggtggatctgggtga

SEQ ID NO: 255802 - DNA, 25 bp, Rattus norvegicus
ccttctcagctgactcaagtgtgag

SEQ ID NO: 255803 - DNA, 25 bp, Rattus norvegicus
ccttctcagctgtctcaagtgtgag

SEQ ID NO: 255804 - DNA, 25 bp, Rattus norvegicus
ccttctccagccatgatttgatttt

SEQ ID NO: 255805 - DNA, 25 bp, Rattus norvegicus
ccttctccagccttgatttgatttt

SEQ ID NO: 255806 - DNA, 25 bp, Rattus norvegicus
ccttctcccaacctgtgcaataaag

SEQ ID NO: 255807 - DNA, 25 bp, Rattus norvegicus
ccttctcccaacgtgtgcaataaag

SEQ ID NO: 255808 - DNA, 25 bp, Rattus norvegicus
ccttctcctgagaactctgtgtgga

SEQ ID NO: 255809 - DNA, 25 bp, Rattus norvegicus
ccttctcctgagtactctgtgtgga

SEQ ID NO: 255810 - DNA, 25 bp, Rattus norvegicus
ccttctcctggaaactctttgaaag

SEQ ID NO: 255811 - DNA, 25 bp, Rattus norvegicus
ccttctcctggatactctttgaaag

SEQ ID NO: 255812 - DNA, 25 bp, Rattus norvegicus
ccttctcctggcagagtgatacttg

SEQ ID NO: 255813 - DNA, 25 bp, Rattus norvegicus
ccttctcctggctgagtgatacttg

SEQ ID NO: 255814 - DNA, 25 bp, Rattus norvegicus
ccttctcctttgcaacaagttgtca

SEQ ID NO: 255815 - DNA, 25 bp, Rattus norvegicus
ccttctcctttggaacaagttgtca

SEQ ID NO: 255816 - DNA, 25 bp, Rattus norvegicus
ccttctcgggcgctctaagggccga

SEQ ID NO: 255817 - DNA, 25 bp, Rattus norvegicus
ccttctcgggcggtctaagggccga

SEQ ID NO: 255818 - DNA, 25 bp, Rattus norvegicus
ccttctctattcaacagcctgtaaa

SEQ ID NO: 255819 - DNA, 25 bp, Rattus norvegicus
ccttctctattctacagcctgtaaa

SEQ ID NO: 255820 - DNA, 25 bp, Rattus norvegicus
ccttctctcccaagtttgattttga

SEQ ID NO: 255821 - DNA, 25 bp, Rattus norvegicus
ccttctctcccatgtttgattttga

SEQ ID NO: 255822 - DNA, 25 bp, Rattus norvegicus
ccttctctctagctaatcaccaaag

SEQ ID NO: 255823 - DNA, 25 bp, Rattus norvegicus
ccttctctctaggtaatcaccaaag

SEQ ID NO: 255824 - DNA, 25 bp, Rattus norvegicus
ccttctctctcaagtatttctggga

SEQ ID NO: 255825 - DNA, 25 bp, Rattus norvegicus
ccttctctctcatgtatttctggga

SEQ ID NO: 255826 - DNA, 25 bp, Rattus norvegicus
ccttctctctggcattcgggaaaag

SEQ ID NO: 255827 - DNA, 25 bp, Rattus norvegicus
ccttctctctgggattcgggaaaag

SEQ ID NO: 255828 - DNA, 25 bp, Rattus norvegicus
ccttctctgaacactggcatacata

SEQ ID NO: 255829 - DNA, 25 bp, Rattus norvegicus
ccttctctgaactctggcatacata

SEQ ID NO: 255830 - DNA, 25 bp, Rattus norvegicus
ccttctctgaagctggtctgtggca

SEQ ID NO: 255831 - DNA, 25 bp, Rattus norvegicus
ccttctctgaaggtggtctgtggca

SEQ ID NO: 255832 - DNA, 25 bp, Rattus norvegicus
ccttctctggtcaagttcttagttt

SEQ ID NO: 255833 - DNA, 25 bp, Rattus norvegicus
ccttctctggtctagttcttagttt

SEQ ID NO: 255834 - DNA, 25 bp, Rattus norvegicus
ccttctcttgggagtagccttggaa

SEQ ID NO: 255835 - DNA, 25 bp, Rattus norvegicus
ccttctcttgggtgtagccttggaa

SEQ ID NO: 255836 - DNA, 25 bp, Rattus norvegicus
ccttctcttttaatcatctgcattg

SEQ ID NO: 255837 - DNA, 25 bp, Rattus norvegicus
ccttctcttttattcatctgcattg

SEQ ID NO: 255838 - DNA, 25 bp, Rattus norvegicus
ccttctgcaagccactttactttta

SEQ ID NO: 255839 - DNA, 25 bp, Rattus norvegicus
ccttctgcaagcgactttactttta

SEQ ID NO: 255840 - DNA, 25 bp, Rattus norvegicus
ccttctgcacccagtttatttatta

SEQ ID NO: 255841 - DNA, 25 bp, Rattus norvegicus
ccttctgcaccctgtttatttatta

SEQ ID NO: 255842 - DNA, 25 bp, Rattus norvegicus
ccttctgcgcctagggatgaaacaa

SEQ ID NO: 255843 - DNA, 25 bp, Rattus norvegicus
ccttctgcgccttgggatgaaacaa

SEQ ID NO: 255844 - DNA, 25 bp, Rattus norvegicus
ccttctgctgttcatattaaccttg

SEQ ID NO: 255845 - DNA, 25 bp, Rattus norvegicus
ccttctgctgttgatattaaccttg

SEQ ID NO: 255846 - DNA, 25 bp, Rattus norvegicus
ccttctggacaaccacttctgtatt

SEQ ID NO: 255847 - DNA, 25 bp, Rattus norvegicus
ccttctggacaagcacttctgtatt

SEQ ID NO: 255848 - DNA, 25 bp, Rattus norvegicus
ccttctggaggcagctcggacgcgt

SEQ ID NO: 255849 - DNA, 25 bp, Rattus norvegicus
ccttctggaggctgctcggacgcgt

SEQ ID NO: 255850 - DNA, 25 bp, Rattus norvegicus
ccttctgtaactcccattttatgta

SEQ ID NO: 255851 - DNA, 25 bp, Rattus norvegicus
ccttctgtaactgccattttatgta

SEQ ID NO: 255852 - DNA, 25 bp, Rattus norvegicus
ccttctgtcattcgatttggcacgt

SEQ ID NO: 255853 - DNA, 25 bp, Rattus norvegicus
ccttctgtcattggatttggcacgt

SEQ ID NO: 255854 - DNA, 25 bp, Rattus norvegicus
ccttctgtctgtatcctaataaaag

SEQ ID NO: 255855 - DNA, 25 bp, Rattus norvegicus
ccttctgtctgtttcctaataaaag

SEQ ID NO: 255856 - DNA, 25 bp, Rattus norvegicus
ccttctgtggctcctactgtgtcag

SEQ ID NO: 255857 - DNA, 25 bp, Rattus norvegicus
ccttctgtggctgctactgtgtcag

SEQ ID NO: 255858 - DNA, 25 bp, Rattus norvegicus
ccttctgtgtgcattgtctctgaat

SEQ ID NO: 255859 - DNA, 25 bp, Rattus norvegicus
ccttctgtgtgctttgtctctgaat

SEQ ID NO: 255860 - DNA, 25 bp, Rattus norvegicus
ccttctgttattccatttcagccat

SEQ ID NO: 255861 - DNA, 25 bp, Rattus norvegicus
ccttctgttattgcatttcagccat

SEQ ID NO: 255862 - DNA, 25 bp, Rattus norvegicus
ccttctgttgagctgtctgatgtcc

SEQ ID NO: 255863 - DNA, 25 bp, Rattus norvegicus
ccttctgttgaggtgtctgatgtcc

SEQ ID NO: 255864 - DNA, 25 bp, Rattus norvegicus
ccttctgtttctaacgtgatctcaa

SEQ ID NO: 255865 - DNA, 25 bp, Rattus norvegicus
ccttctgtttcttacgtgatctcaa

SEQ ID NO: 255866 - DNA, 25 bp, Rattus norvegicus
ccttctgttttgcaggcatagatgc

SEQ ID NO: 255867 - DNA, 25 bp, Rattus norvegicus
ccttctgttttggaggcatagatgc

SEQ ID NO: 255868 - DNA, 25 bp, Rattus norvegicus
ccttcttactgaactatgacaccca

SEQ ID NO: 255869 - DNA, 25 bp, Rattus norvegicus
ccttcttactgatctatgacaccca

SEQ ID NO: 255870 - DNA, 25 bp, Rattus norvegicus
ccttcttattgtacacgtgagggaa

SEQ ID NO: 255871 - DNA, 25 bp, Rattus norvegicus
ccttcttattgttcacgtgagggaa

SEQ ID NO: 255872 - DNA, 25 bp, Rattus norvegicus
ccttcttcagagactatgcttccag

SEQ ID NO: 255873 - DNA, 25 bp, Rattus norvegicus
ccttcttcagagtctatgcttccag

SEQ ID NO: 255874 - DNA, 25 bp, Rattus norvegicus
ccttcttccacactcaatttcttga

SEQ ID NO: 255875 - DNA, 25 bp, Rattus norvegicus
ccttcttccacagtcaatttcttga

SEQ ID NO: 255876 - DNA, 25 bp, Rattus norvegicus
ccttcttcccatagactaatacttt

SEQ ID NO: 255877 - DNA, 25 bp, Rattus norvegicus
ccttcttcccattgactaatacttt

SEQ ID NO: 255878 - DNA, 25 bp, Rattus norvegicus
ccttcttcccttcgtgtaggtgaga

SEQ ID NO: 255879 - DNA, 25 bp, Rattus norvegicus
ccttcttcccttggtgtaggtgaga

SEQ ID NO: 255880 - DNA, 25 bp, Rattus norvegicus
ccttcttccttcaggtttaactgtg

SEQ ID NO: 255881 - DNA, 25 bp, Rattus norvegicus
ccttcttccttctggtttaactgtg

SEQ ID NO: 255882 - DNA, 25 bp, Rattus norvegicus
ccttcttccttgagggttgaactct

SEQ ID NO: 255883 - DNA, 25 bp, Rattus norvegicus
ccttcttccttgtgggttgaactct

SEQ ID NO: 255884 - DNA, 25 bp, Rattus norvegicus
ccttcttctatcacaggctgaacat

SEQ ID NO: 255885 - DNA, 25 bp, Rattus norvegicus
ccttcttctatctcaggctgaacat

SEQ ID NO: 255886 - DNA, 25 bp, Rattus norvegicus
ccttcttctccaagtagcagcaact

SEQ ID NO: 255887 - DNA, 25 bp, Rattus norvegicus
ccttcttctccatgtagcagcaact

SEQ ID NO: 255888 - DNA, 25 bp, Rattus norvegicus
ccttcttgctacactatttcgatga

SEQ ID NO: 255889 - DNA, 25 bp, Rattus norvegicus
ccttcttgctactctatttcgatga

SEQ ID NO: 255890 - DNA, 25 bp, Rattus norvegicus
ccttcttggattacgggctacatgt

SEQ ID NO: 255891 - DNA, 25 bp, Rattus norvegicus
ccttcttggatttcgggctacatgt

SEQ ID NO: 255892 - DNA, 25 bp, Rattus norvegicus
ccttcttgggctcgtttatctaact

SEQ ID NO: 255893 - DNA, 25 bp, Rattus norvegicus
ccttcttgggctggtttatctaact

SEQ ID NO: 255894 - DNA, 25 bp, Rattus norvegicus
ccttcttggtcaacccttatgaatt

SEQ ID NO: 255895 - DNA, 25 bp, Rattus norvegicus
ccttcttggtcatcccttatgaatt

SEQ ID NO: 255896 - DNA, 25 bp, Rattus norvegicus
ccttcttgtctcctgtgaatcatta

SEQ ID NO: 255897 - DNA, 25 bp, Rattus norvegicus
ccttcttgtctcgtgtgaatcatta

SEQ ID NO: 255898 - DNA, 25 bp, Rattus norvegicus
ccttctttacatcactactctggta

SEQ ID NO: 255899 - DNA, 25 bp, Rattus norvegicus
ccttctttacatgactactctggta

SEQ ID NO: 255900 - DNA, 25 bp, Rattus norvegicus
ccttctttcagcactcgttttatta

SEQ ID NO: 255901 - DNA, 25 bp, Rattus norvegicus
ccttctttcagctctcgttttatta

SEQ ID NO: 255902 - DNA, 25 bp, Rattus norvegicus
ccttctttcgtacacatattcctgg

SEQ ID NO: 255903 - DNA, 25 bp, Rattus norvegicus
ccttctttcgtagacatattcctgg

SEQ ID NO: 255904 - DNA, 25 bp, Rattus norvegicus
ccttctttctggctgacaatgggct

SEQ ID NO: 255905 - DNA, 25 bp, Rattus norvegicus
ccttctttctgggtgacaatgggct

SEQ ID NO: 255906 - DNA, 25 bp, Rattus norvegicus
ccttctttctgtcagtcttagctac

SEQ ID NO: 255907 - DNA, 25 bp, Rattus norvegicus
ccttctttctgtgagtcttagctac

SEQ ID NO: 255908 - DNA, 25 bp, Rattus norvegicus
ccttctttgaagcactccgagacaa

SEQ ID NO: 255909 - DNA, 25 bp, Rattus norvegicus
ccttctttgaaggactccgagacaa

SEQ ID NO: 255910 - DNA, 25 bp, Rattus norvegicus
ccttctttgctgcttgctaatgtaa

SEQ ID NO: 255911 - DNA, 25 bp, Rattus norvegicus
ccttctttgctggttgctaatgtaa

SEQ ID NO: 255912 - DNA, 25 bp, Rattus norvegicus
ccttctttgtatatgggcgtctcac

SEQ ID NO: 255913 - DNA, 25 bp, Rattus norvegicus
ccttctttgtatttgggcgtctcac

SEQ ID NO: 255914 - DNA, 25 bp, Rattus norvegicus
ccttcttttctcatcactcaataaa

SEQ ID NO: 255915 - DNA, 25 bp, Rattus norvegicus
ccttcttttctcttcactcaataaa

SEQ ID NO: 255916 - DNA, 25 bp, Rattus norvegicus
ccttgaaaatcaattgttgaatata

SEQ ID NO: 255917 - DNA, 25 bp, Rattus norvegicus
ccttgaaaatcatttgttgaatata

SEQ ID NO: 255918 - DNA, 25 bp, Rattus norvegicus
ccttgaaacggtctgaatgctgtaa

SEQ ID NO: 255919 - DNA, 25 bp, Rattus norvegicus
ccttgaaacggtgtgaatgctgtaa

SEQ ID NO: 255920 - DNA, 25 bp, Rattus norvegicus
ccttgaaactcacagagtaccatgt

SEQ ID NO: 255921 - DNA, 25 bp, Rattus norvegicus
ccttgaaactcagagagtaccatgt

SEQ ID NO: 255922 - DNA, 25 bp, Rattus norvegicus
ccttgaacaaggattgaggcgagga

SEQ ID NO: 255923 - DNA, 25 bp, Rattus norvegicus
ccttgaacaaggtttgaggcgagga

SEQ ID NO: 255924 - DNA, 25 bp, Rattus norvegicus
ccttgaactgttaggcccttcagat

SEQ ID NO: 255925 - DNA, 25 bp, Rattus norvegicus
ccttgaactgtttggcccttcagat

SEQ ID NO: 255926 - DNA, 25 bp, Rattus norvegicus
ccttgaaggcctatgtgccccattg

SEQ ID NO: 255927 - DNA, 25 bp, Rattus norvegicus
ccttgaaggcctttgtgccccattg

SEQ ID NO: 255928 - DNA, 25 bp, Rattus norvegicus
ccttgaatctgtagggtggtcctgt

SEQ ID NO: 255929 - DNA, 25 bp, Rattus norvegicus
ccttgaatctgttgggtggtcctgt

SEQ ID NO: 255930 - DNA, 25 bp, Rattus norvegicus
ccttgaatgtccagtgaccaatctt

SEQ ID NO: 255931 - DNA, 25 bp, Rattus norvegicus
ccttgaatgtcctgtgaccaatctt

SEQ ID NO: 255932 - DNA, 25 bp, Rattus norvegicus
ccttgacagcgccttgatgttgagt

SEQ ID NO: 255933 - DNA, 25 bp, Rattus norvegicus
ccttgacagcgcgttgatgttgagt

SEQ ID NO: 255934 - DNA, 25 bp, Rattus norvegicus
ccttgacctttgcagatggagacct

SEQ ID NO: 255935 - DNA, 25 bp, Rattus norvegicus
ccttgacctttggagatggagacct

SEQ ID NO: 255936 - DNA, 25 bp, Rattus norvegicus
ccttgactctcaattgtaattgtat

SEQ ID NO: 255937 - DNA, 25 bp, Rattus norvegicus
ccttgactctcatttgtaattgtat

SEQ ID NO: 255938 - DNA, 25 bp, Rattus norvegicus
ccttgactgtcaactctggttatca

SEQ ID NO: 255939 - DNA, 25 bp, Rattus norvegicus
ccttgactgtcatctctggttatca

SEQ ID NO: 255940 - DNA, 25 bp, Rattus norvegicus
ccttgacttagtaacatccctgatg

SEQ ID NO: 255941 - DNA, 25 bp, Rattus norvegicus
ccttgacttagttacatccctgatg

SEQ ID NO: 255942 - DNA, 25 bp, Rattus norvegicus
ccttgacttatgacgctagcagaat

SEQ ID NO: 255943 - DNA, 25 bp, Rattus norvegicus
ccttgacttatgtcgctagcagaat

SEQ ID NO: 255944 - DNA, 25 bp, Rattus norvegicus
ccttgactttctccaggaatctact

SEQ ID NO: 255945 - DNA, 25 bp, Rattus norvegicus
ccttgactttctgcaggaatctact

SEQ ID NO: 255946 - DNA, 25 bp, Rattus norvegicus
ccttgagcattgagtacagtacatt

SEQ ID NO: 255947 - DNA, 25 bp, Rattus norvegicus
ccttgagcattgtgtacagtacatt

SEQ ID NO: 255948 - DNA, 25 bp, Rattus norvegicus
ccttgagctggtcgctggagacacc

SEQ ID NO: 255949 - DNA, 25 bp, Rattus norvegicus
ccttgagctggtggctggagacacc

SEQ ID NO: 255950 - DNA, 25 bp, Rattus norvegicus
ccttgaggatttctatggccctgca

SEQ ID NO: 255951 - DNA, 25 bp, Rattus norvegicus
ccttgaggatttgtatggccctgca

SEQ ID NO: 255952 - DNA, 25 bp, Rattus norvegicus
ccttgagggcgtcagagttccctgt

SEQ ID NO: 255953 - DNA, 25 bp, Rattus norvegicus
ccttgagggcgtgagagttccctgt

SEQ ID NO: 255954 - DNA, 25 bp, Rattus norvegicus
ccttgagttcctacttggcttctgt

SEQ ID NO: 255955 - DNA, 25 bp, Rattus norvegicus
ccttgagttccttcttggcttctgt

SEQ ID NO: 255956 - DNA, 25 bp, Rattus norvegicus
ccttgagtttggaatctttggccta

SEQ ID NO: 255957 - DNA, 25 bp, Rattus norvegicus
ccttgagtttggtatctttggccta

SEQ ID NO: 255958 - DNA, 25 bp, Rattus norvegicus
ccttgataaactccagctgtcacag

SEQ ID NO: 255959 - DNA, 25 bp, Rattus norvegicus
ccttgataaactgcagctgtcacag

SEQ ID NO: 255960 - DNA, 25 bp, Rattus norvegicus
ccttgataagggatactgcagcttt

SEQ ID NO: 255961 - DNA, 25 bp, Rattus norvegicus
ccttgataagggttactgcagcttt

SEQ ID NO: 255962 - DNA, 25 bp, Rattus norvegicus
ccttgatacgttaatgaccagccta

SEQ ID NO: 255963 - DNA, 25 bp, Rattus norvegicus
ccttgatacgtttatgaccagccta

SEQ ID NO: 255964 - DNA, 25 bp, Rattus norvegicus
ccttgatcagccaagctgctgttaa

SEQ ID NO: 255965 - DNA, 25 bp, Rattus norvegicus
ccttgatcagcctagctgctgttaa

SEQ ID NO: 255966 - DNA, 25 bp, Rattus norvegicus
ccttgatcaggtaggcttgtggcca

SEQ ID NO: 255967 - DNA, 25 bp, Rattus norvegicus
ccttgatcaggttggcttgtggcca

SEQ ID NO: 255968 - DNA, 25 bp, Rattus norvegicus
ccttgatcttatatgatcgggtcgt

SEQ ID NO: 255969 - DNA, 25 bp, Rattus norvegicus
ccttgatcttatttgatcgggtcgt

SEQ ID NO: 255970 - DNA, 25 bp, Rattus norvegicus
ccttgatgccaactgcttagctgca

SEQ ID NO: 255971 - DNA, 25 bp, Rattus norvegicus
ccttgatgccaagtgcttagctgca

SEQ ID NO: 255972 - DNA, 25 bp, Rattus norvegicus
ccttgattattcaacaaattctatc

SEQ ID NO: 255973 - DNA, 25 bp, Rattus norvegicus
ccttgattattctacaaattctatc

SEQ ID NO: 255974 - DNA, 25 bp, Rattus norvegicus
ccttgatttcatatgccctaagcta

SEQ ID NO: 255975 - DNA, 25 bp, Rattus norvegicus
ccttgatttcatttgccctaagcta

SEQ ID NO: 255976 - DNA, 25 bp, Rattus norvegicus
ccttgcaacttcagccttagctcaa

SEQ ID NO: 255977 - DNA, 25 bp, Rattus norvegicus
ccttgcaacttctgccttagctcaa

SEQ ID NO: 255978 - DNA, 25 bp, Rattus norvegicus
ccttgcaagaaaaatacagactcct

SEQ ID NO: 255979 - DNA, 25 bp, Rattus norvegicus
ccttgcaagaaatatacagactcct

SEQ ID NO: 255980 - DNA, 25 bp, Rattus norvegicus
ccttgcaatcttcggagttccttac

SEQ ID NO: 255981 - DNA, 25 bp, Rattus norvegicus
ccttgcaatcttgggagttccttac

SEQ ID NO: 255982 - DNA, 25 bp, Rattus norvegicus
ccttgcaccctcagtaactctagtt

SEQ ID NO: 255983 - DNA, 25 bp, Rattus norvegicus
ccttgcaccctctgtaactctagtt

SEQ ID NO: 255984 - DNA, 25 bp, Rattus norvegicus
ccttgcacctgcattgggtgttaga

SEQ ID NO: 255985 - DNA, 25 bp, Rattus norvegicus
ccttgcacctgctttgggtgttaga

SEQ ID NO: 255986 - DNA, 25 bp, Rattus norvegicus
ccttgcactgttcccggaggctgaa

SEQ ID NO: 255987 - DNA, 25 bp, Rattus norvegicus
ccttgcactgttgccggaggctgaa

SEQ ID NO: 255988 - DNA, 25 bp, Rattus norvegicus
ccttgcagatgtaattggagtcctt

SEQ ID NO: 255989 - DNA, 25 bp, Rattus norvegicus
ccttgcagatgttattggagtcctt

SEQ ID NO: 255990 - DNA, 25 bp, Rattus norvegicus
ccttgcaggcaaagggtatgattct

SEQ ID NO: 255991 - DNA, 25 bp, Rattus norvegicus
ccttgcaggcaatgggtatgattct

SEQ ID NO: 255992 - DNA, 25 bp, Rattus norvegicus
ccttgcagggcaatctcagaactca

SEQ ID NO: 255993 - DNA, 25 bp, Rattus norvegicus
ccttgcagggcattctcagaactca

SEQ ID NO: 255994 - DNA, 25 bp, Rattus norvegicus
ccttgcagtccccagattgatgatg

SEQ ID NO: 255995 - DNA, 25 bp, Rattus norvegicus
ccttgcagtcccgagattgatgatg

SEQ ID NO: 255996 - DNA, 25 bp, Rattus norvegicus
ccttgcatcctcagtttgggttgtt

SEQ ID NO: 255997 - DNA, 25 bp, Rattus norvegicus
ccttgcatcctctgtttgggttgtt

SEQ ID NO: 255998 - DNA, 25 bp, Rattus norvegicus
ccttgcatggcactaaagagagtca

SEQ ID NO: 255999 - DNA, 25 bp, Rattus norvegicus
ccttgcatggcagtaaagagagtca

SEQ ID NO: 256000 - DNA, 25 bp, Rattus norvegicus
ccttgccagcatcttctagaacaga

SEQ ID NO: 256001 - DNA, 25 bp, Rattus norvegicus
ccttgccagcatgttctagaacaga

SEQ ID NO: 256002 - DNA, 25 bp, Rattus norvegicus
ccttgccaggtgcttgccaacattg

SEQ ID NO: 256003 - DNA, 25 bp, Rattus norvegicus
ccttgccaggtggttgccaacattg

SEQ ID NO: 256004 - DNA, 25 bp, Rattus norvegicus
ccttgccatcagattgggctgtgaa

SEQ ID NO: 256005 - DNA, 25 bp, Rattus norvegicus
ccttgccatcagtttgggctgtgaa

SEQ ID NO: 256006 - DNA, 25 bp, Rattus norvegicus
ccttgccatctactgttgtacacat

SEQ ID NO: 256007 - DNA, 25 bp, Rattus norvegicus
ccttgccatctagtgttgtacacat

SEQ ID NO: 256008 - DNA, 25 bp, Rattus norvegicus
ccttgcccagcaacgttaatgacaa

SEQ ID NO: 256009 - DNA, 25 bp, Rattus norvegicus
ccttgcccagcatcgttaatgacaa

SEQ ID NO: 256010 - DNA, 25 bp, Rattus norvegicus
ccttgccccatactgaatgcagatt

SEQ ID NO: 256011 - DNA, 25 bp, Rattus norvegicus
ccttgccccatagtgaatgcagatt

SEQ ID NO: 256012 - DNA, 25 bp, Rattus norvegicus
ccttgccccatgacagaaatctttt

SEQ ID NO: 256013 - DNA, 25 bp, Rattus norvegicus
ccttgccccatgtcagaaatctttt

SEQ ID NO: 256014 - DNA, 25 bp, Rattus norvegicus
ccttgccgagaacgccccttggtga

SEQ ID NO: 256015 - DNA, 25 bp, Rattus norvegicus
ccttgccgagaaggccccttggtga

SEQ ID NO: 256016 - DNA, 25 bp, Rattus norvegicus
ccttgcctcagtcgtcggagatgga

SEQ ID NO: 256017 - DNA, 25 bp, Rattus norvegicus
ccttgcctcagtggtcggagatgga

SEQ ID NO: 256018 - DNA, 25 bp, Rattus norvegicus
ccttgcctcttcatctgttggttaa

SEQ ID NO: 256019 - DNA, 25 bp, Rattus norvegicus
ccttgcctcttcttctgttggttaa

SEQ ID NO: 256020 - DNA, 25 bp, Rattus norvegicus
ccttgcctttttagtcaccagataa

SEQ ID NO: 256021 - DNA, 25 bp, Rattus norvegicus
ccttgccttttttgtcaccagataa

SEQ ID NO: 256022 - DNA, 25 bp, Rattus norvegicus
ccttgcgacctgagcggaaaaacat

SEQ ID NO: 256023 - DNA, 25 bp, Rattus norvegicus
ccttgcgacctgtgcggaaaaacat

SEQ ID NO: 256024 - DNA, 25 bp, Rattus norvegicus
ccttgcgtgcctcggaacatttgta

SEQ ID NO: 256025 - DNA, 25 bp, Rattus norvegicus
ccttgcgtgcctgggaacatttgta

SEQ ID NO: 256026 - DNA, 25 bp, Rattus norvegicus
ccttgctaccagaatagtcatatga

SEQ ID NO: 256027 - DNA, 25 bp, Rattus norvegicus
ccttgctaccagtatagtcatatga

SEQ ID NO: 256028 - DNA, 25 bp, Rattus norvegicus
ccttgctatctcacttggtaaaaat

SEQ ID NO: 256029 - DNA, 25 bp, Rattus norvegicus
ccttgctatctctcttggtaaaaat

SEQ ID NO: 256030 - DNA, 25 bp, Rattus norvegicus
ccttgctcattcctcaggtttgaaa

SEQ ID NO: 256031 - DNA, 25 bp, Rattus norvegicus
ccttgctcattcgtcaggtttgaaa

SEQ ID NO: 256032 - DNA, 25 bp, Rattus norvegicus
ccttgctctcaactcctgtattgag

SEQ ID NO: 256033 - DNA, 25 bp, Rattus norvegicus
ccttgctctcaagtcctgtattgag

SEQ ID NO: 256034 - DNA, 25 bp, Rattus norvegicus
ccttgctgcagcaggtttctggaaa

SEQ ID NO: 256035 - DNA, 25 bp, Rattus norvegicus
ccttgctgcagctggtttctggaaa

SEQ ID NO: 256036 - DNA, 25 bp, Rattus norvegicus
ccttgctgcctcatcctaaataaag

SEQ ID NO: 256037 - DNA, 25 bp, Rattus norvegicus
ccttgctgcctcttcctaaataaag

SEQ ID NO: 256038 - DNA, 25 bp, Rattus norvegicus
ccttgctgccttatgatttgtatcc

SEQ ID NO: 256039 - DNA, 25 bp, Rattus norvegicus
ccttgctgccttttgatttgtatcc

SEQ ID NO: 256040 - DNA, 25 bp, Rattus norvegicus
ccttgctgctatcgctatctgtata

SEQ ID NO: 256041 - DNA, 25 bp, Rattus norvegicus
ccttgctgctatggctatctgtata

SEQ ID NO: 256042 - DNA, 25 bp, Rattus norvegicus
ccttgctgctgcatttaaactgtat

SEQ ID NO: 256043 - DNA, 25 bp, Rattus norvegicus
ccttgctgctgcttttaaactgtat

SEQ ID NO: 256044 - DNA, 25 bp, Rattus norvegicus
ccttgctggcttcttgggacatagc

SEQ ID NO: 256045 - DNA, 25 bp, Rattus norvegicus
ccttgctggcttgttgggacatagc

SEQ ID NO: 256046 - DNA, 25 bp, Rattus norvegicus
ccttgctggtcacccggtccagtga

SEQ ID NO: 256047 - DNA, 25 bp, Rattus norvegicus
ccttgctggtcagccggtccagtga

SEQ ID NO: 256048 - DNA, 25 bp, Rattus norvegicus
ccttgctggtctctcgggaattgaa

SEQ ID NO: 256049 - DNA, 25 bp, Rattus norvegicus
ccttgctggtctgtcgggaattgaa

SEQ ID NO: 256050 - DNA, 25 bp, Rattus norvegicus
ccttgctgtcggcttttggctaaga

SEQ ID NO: 256051 - DNA, 25 bp, Rattus norvegicus
ccttgctgtcgggttttggctaaga

SEQ ID NO: 256052 - DNA, 25 bp, Rattus norvegicus
ccttgctgtgcgatggatgtgtgaa

SEQ ID NO: 256053 - DNA, 25 bp, Rattus norvegicus
ccttgctgtgcgttggatgtgtgaa

SEQ ID NO: 256054 - DNA, 25 bp, Rattus norvegicus
ccttgctgtggcactttatggactg

SEQ ID NO: 256055 - DNA, 25 bp, Rattus norvegicus
ccttgctgtggctctttatggactg

SEQ ID NO: 256056 - DNA, 25 bp, Rattus norvegicus
ccttgcttccttactgtcttgtttt

SEQ ID NO: 256057 - DNA, 25 bp, Rattus norvegicus
ccttgcttcctttctgtcttgtttt

SEQ ID NO: 256058 - DNA, 25 bp, Rattus norvegicus
ccttgcttgcatctgtatatagtgt

SEQ ID NO: 256059 - DNA, 25 bp, Rattus norvegicus
ccttgcttgcatgtgtatatagtgt

SEQ ID NO: 256060 - DNA, 25 bp, Rattus norvegicus
ccttgcttgtgtcagcaacgtggaa

SEQ ID NO: 256061 - DNA, 25 bp, Rattus norvegicus
ccttgcttgtgtgagcaacgtggaa

SEQ ID NO: 256062 - DNA, 25 bp, Rattus norvegicus
ccttgctttagcctggatgtgtgac

SEQ ID NO: 256063 - DNA, 25 bp, Rattus norvegicus
ccttgctttagcgtggatgtgtgac

SEQ ID NO: 256064 - DNA, 25 bp, Rattus norvegicus
ccttggaaggaacccatattctgat

SEQ ID NO: 256065 - DNA, 25 bp, Rattus norvegicus
ccttggaaggaagccatattctgat

SEQ ID NO: 256066 - DNA, 25 bp, Rattus norvegicus
ccttggaaggtgatcttaccctctg

SEQ ID NO: 256067 - DNA, 25 bp, Rattus norvegicus
ccttggaaggtgttcttaccctctg

SEQ ID NO: 256068 - DNA, 25 bp, Rattus norvegicus
ccttggaatgctcttggctcaggca

SEQ ID NO: 256069 - DNA, 25 bp, Rattus norvegicus
ccttggaatgctgttggctcaggca

SEQ ID NO: 256070 - DNA, 25 bp, Rattus norvegicus
ccttggacagtcaaaattggtttca

SEQ ID NO: 256071 - DNA, 25 bp, Rattus norvegicus
ccttggacagtctaaattggtttca

SEQ ID NO: 256072 - DNA, 25 bp, Rattus norvegicus
ccttggactgataacccctatttgt

SEQ ID NO: 256073 - DNA, 25 bp, Rattus norvegicus
ccttggactgattacccctatttgt

SEQ ID NO: 256074 - DNA, 25 bp, Rattus norvegicus
ccttggagactcctgtatggagaga

SEQ ID NO: 256075 - DNA, 25 bp, Rattus norvegicus
ccttggagactcgtgtatggagaga

SEQ ID NO: 256076 - DNA, 25 bp, Rattus norvegicus
ccttggagatcgatgcagaaagtga

SEQ ID NO: 256077 - DNA, 25 bp, Rattus norvegicus
ccttggagatcgttgcagaaagtga

SEQ ID NO: 256078 - DNA, 25 bp, Rattus norvegicus
ccttggatgtttaaggtgtcccatt

SEQ ID NO: 256079 - DNA, 25 bp, Rattus norvegicus
ccttggatgttttaggtgtcccatt

SEQ ID NO: 256080 - DNA, 25 bp, Rattus norvegicus
ccttggattcttccccaggcagggc

SEQ ID NO: 256081 - DNA, 25 bp, Rattus norvegicus
ccttggattcttgcccaggcagggc

SEQ ID NO: 256082 - DNA, 25 bp, Rattus norvegicus
ccttggattggcctttggaataatt

SEQ ID NO: 256083 - DNA, 25 bp, Rattus norvegicus
ccttggattggcgtttggaataatt

SEQ ID NO: 256084 - DNA, 25 bp, Rattus norvegicus
ccttggcaaaatctggtctgggtag

SEQ ID NO: 256085 - DNA, 25 bp, Rattus norvegicus
ccttggcaaaatgtggtctgggtag

SEQ ID NO: 256086 - DNA, 25 bp, Rattus norvegicus
ccttggcaatgcataatgtatctta

SEQ ID NO: 256087 - DNA, 25 bp, Rattus norvegicus
ccttggcaatgcttaatgtatctta

SEQ ID NO: 256088 - DNA, 25 bp, Rattus norvegicus
ccttggcagggcatggtcttcaaag

SEQ ID NO: 256089 - DNA, 25 bp, Rattus norvegicus
ccttggcagggcttggtcttcaaag

SEQ ID NO: 256090 - DNA, 25 bp, Rattus norvegicus
ccttggccaaacacgtcagggcaga

SEQ ID NO: 256091 - DNA, 25 bp, Rattus norvegicus
ccttggccaaactcgtcagggcaga

SEQ ID NO: 256092 - DNA, 25 bp, Rattus norvegicus
ccttggcccactctatgaactgtat

SEQ ID NO: 256093 - DNA, 25 bp, Rattus norvegicus
ccttggcccactgtatgaactgtat

SEQ ID NO: 256094 - DNA, 25 bp, Rattus norvegicus
ccttggcccgcgcagacttggtgtc

SEQ ID NO: 256095 - DNA, 25 bp, Rattus norvegicus
ccttggcccgcggagacttggtgtc

SEQ ID NO: 256096 - DNA, 25 bp, Rattus norvegicus
ccttggcctaggagctcaggaaact

SEQ ID NO: 256097 - DNA, 25 bp, Rattus norvegicus
ccttggcctaggtgctcaggaaact

SEQ ID NO: 256098 - DNA, 25 bp, Rattus norvegicus
ccttggcctcagctggtatattaca

SEQ ID NO: 256099 - DNA, 25 bp, Rattus norvegicus
ccttggcctcaggtggtatattaca

SEQ ID NO: 256100 - DNA, 25 bp, Rattus norvegicus
ccttggccttgaccatgagatggat

SEQ ID NO: 256101 - DNA, 25 bp, Rattus norvegicus
ccttggccttgagcatgagatggat

SEQ ID NO: 256102 - DNA, 25 bp, Rattus norvegicus
ccttggcgaccgcaatgatccagaa

SEQ ID NO: 256103 - DNA, 25 bp, Rattus norvegicus
ccttggcgaccggaatgatccagaa

SEQ ID NO: 256104 - DNA, 25 bp, Rattus norvegicus
ccttggcgggaaattcacctttgca

SEQ ID NO: 256105 - DNA, 25 bp, Rattus norvegicus
ccttggcgggaatttcacctttgca

SEQ ID NO: 256106 - DNA, 25 bp, Rattus norvegicus
ccttggcggtcgcaaccactgtggt

SEQ ID NO: 256107 - DNA, 25 bp, Rattus norvegicus
ccttggcggtcggaaccactgtggt

SEQ ID NO: 256108 - DNA, 25 bp, Rattus norvegicus
ccttggcttctgctaggcttagcta

SEQ ID NO: 256109 - DNA, 25 bp, Rattus norvegicus
ccttggcttctggtaggcttagcta

SEQ ID NO: 256110 - DNA, 25 bp, Rattus norvegicus
ccttggctttgacttcatggtggat

SEQ ID NO: 256111 - DNA, 25 bp, Rattus norvegicus
ccttggctttgagttcatggtggat

SEQ ID NO: 256112 - DNA, 25 bp, Rattus norvegicus
ccttgggagccacaggattgtaact

SEQ ID NO: 256113 - DNA, 25 bp, Rattus norvegicus
ccttgggagccagaggattgtaact

SEQ ID NO: 256114 - DNA, 25 bp, Rattus norvegicus
ccttgggatccaccgcacagcggtg

SEQ ID NO: 256115 - DNA, 25 bp, Rattus norvegicus
ccttgggatccagcgcacagcggtg

SEQ ID NO: 256116 - DNA, 25 bp, Rattus norvegicus
ccttgggatgtcagcagctctaaga

SEQ ID NO: 256117 - DNA, 25 bp, Rattus norvegicus
ccttgggatgtctgcagctctaaga

SEQ ID NO: 256118 - DNA, 25 bp, Rattus norvegicus
ccttgggcagtgctgttggatctat

SEQ ID NO: 256119 - DNA, 25 bp, Rattus norvegicus
ccttgggcagtggtgttggatctat

SEQ ID NO: 256120 - DNA, 25 bp, Rattus norvegicus
ccttgggccttgatacacaccaata

SEQ ID NO: 256121 - DNA, 25 bp, Rattus norvegicus
ccttgggccttgttacacaccaata

SEQ ID NO: 256122 - DNA, 25 bp, Rattus norvegicus
ccttgggttccccactggaaagatg

SEQ ID NO: 256123 - DNA, 25 bp, Rattus norvegicus
ccttgggttcccgactggaaagatg

SEQ ID NO: 256124 - DNA, 25 bp, Rattus norvegicus
ccttggtaagcccactgttatttat

SEQ ID NO: 256125 - DNA, 25 bp, Rattus norvegicus
ccttggtaagccgactgttatttat

SEQ ID NO: 256126 - DNA, 25 bp, Rattus norvegicus
ccttggtagagcacctgaggcagtg

SEQ ID NO: 256127 - DNA, 25 bp, Rattus norvegicus
ccttggtagagctcctgaggcagtg

SEQ ID NO: 256128 - DNA, 25 bp, Rattus norvegicus
ccttggtcagaaccgcagttagtgg

SEQ ID NO: 256129 - DNA, 25 bp, Rattus norvegicus
ccttggtcagaagcgcagttagtgg

SEQ ID NO: 256130 - DNA, 25 bp, Rattus norvegicus
ccttggtcccttaggtgtatactga

SEQ ID NO: 256131 - DNA, 25 bp, Rattus norvegicus
ccttggtccctttggtgtatactga

SEQ ID NO: 256132 - DNA, 25 bp, Rattus norvegicus
ccttggtctgccagtcatgttgtga

SEQ ID NO: 256133 - DNA, 25 bp, Rattus norvegicus
ccttggtctgcctgtcatgttgtga

SEQ ID NO: 256134 - DNA, 25 bp, Rattus norvegicus
ccttggtcttcaaaactgtggtcat

SEQ ID NO: 256135 - DNA, 25 bp, Rattus norvegicus
ccttggtcttcacttctgcagggaa

SEQ ID NO: 256136 - DNA, 25 bp, Rattus norvegicus
ccttggtcttcagttctgcagggaa

SEQ ID NO: 256137 - DNA, 25 bp, Rattus norvegicus
ccttggtcttcataactgtggtcat

SEQ ID NO: 256138 - DNA, 25 bp, Rattus norvegicus
ccttggtggcctagtatggtttcaa

SEQ ID NO: 256139 - DNA, 25 bp, Rattus norvegicus
ccttggtggccttgtatggtttcaa

SEQ ID NO: 256140 - DNA, 25 bp, Rattus norvegicus
ccttggtgtagaccgacttctcaaa

SEQ ID NO: 256141 - DNA, 25 bp, Rattus norvegicus
ccttggtgtagagcgacttctcaaa

SEQ ID NO: 256142 - DNA, 25 bp, Rattus norvegicus
ccttggttctgccagcacgagaata

SEQ ID NO: 256143 - DNA, 25 bp, Rattus norvegicus
ccttggttctgcgagcacgagaata

SEQ ID NO: 256144 - DNA, 25 bp, Rattus norvegicus
ccttggttggtgatctggactctgg

SEQ ID NO: 256145 - DNA, 25 bp, Rattus norvegicus
ccttggttggtgttctggactctgg

SEQ ID NO: 256146 - DNA, 25 bp, Rattus norvegicus
ccttgtaagcctccttgtgaactga

SEQ ID NO: 256147 - DNA, 25 bp, Rattus norvegicus
ccttgtaagcctgcttgtgaactga

SEQ ID NO: 256148 - DNA, 25 bp, Rattus norvegicus
ccttgtaccttcattgagcattgag

SEQ ID NO: 256149 - DNA, 25 bp, Rattus norvegicus
ccttgtaccttctttgagcattgag

SEQ ID NO: 256150 - DNA, 25 bp, Rattus norvegicus
ccttgtagaaaaaagtggccgcttt

SEQ ID NO: 256151 - DNA, 25 bp, Rattus norvegicus
ccttgtagaaaatagtggccgcttt

SEQ ID NO: 256152 - DNA, 25 bp, Rattus norvegicus
ccttgtcacatcagtcagctgtagt

SEQ ID NO: 256153 - DNA, 25 bp, Rattus norvegicus
ccttgtcacatctgtcagctgtagt

SEQ ID NO: 256154 - DNA, 25 bp, Rattus norvegicus
ccttgtcacccacacgttgatggat

SEQ ID NO: 256155 - DNA, 25 bp, Rattus norvegicus
ccttgtcacccagacgttgatggat

SEQ ID NO: 256156 - DNA, 25 bp, Rattus norvegicus
ccttgtcactgacttttctcacttt

SEQ ID NO: 256157 - DNA, 25 bp, Rattus norvegicus
ccttgtcactgagttttctcacttt

SEQ ID NO: 256158 - DNA, 25 bp, Rattus norvegicus
ccttgtcagactcaatgggaggaga

SEQ ID NO: 256159 - DNA, 25 bp, Rattus norvegicus
ccttgtcagactgaatgggaggaga

SEQ ID NO: 256160 - DNA, 25 bp, Rattus norvegicus
ccttgtcatgagatggaggtcctct

SEQ ID NO: 256161 - DNA, 25 bp, Rattus norvegicus
ccttgtcatgagttggaggtcctct

SEQ ID NO: 256162 - DNA, 25 bp, Rattus norvegicus
ccttgtcatgcaacacatacaggag

SEQ ID NO: 256163 - DNA, 25 bp, Rattus norvegicus
ccttgtcatgcatcacatacaggag

SEQ ID NO: 256164 - DNA, 25 bp, Rattus norvegicus
ccttgtccactcagtgcagaagtta

SEQ ID NO: 256165 - DNA, 25 bp, Rattus norvegicus
ccttgtccactctgtgcagaagtta

SEQ ID NO: 256166 - DNA, 25 bp, Rattus norvegicus
ccttgtccagggacagccagagaga

SEQ ID NO: 256167 - DNA, 25 bp, Rattus norvegicus
ccttgtccagggtcagccagagaga

SEQ ID NO: 256168 - DNA, 25 bp, Rattus norvegicus
ccttgtcctgacatggtatgtggat

SEQ ID NO: 256169 - DNA, 25 bp, Rattus norvegicus
ccttgtcctgacttggtatgtggat

SEQ ID NO: 256170 - DNA, 25 bp, Rattus norvegicus
ccttgtcctttcaggttcaggcgca

SEQ ID NO: 256171 - DNA, 25 bp, Rattus norvegicus
ccttgtcctttcagttaggacttca

SEQ ID NO: 256172 - DNA, 25 bp, Rattus norvegicus
ccttgtcctttctggttcaggcgca

SEQ ID NO: 256173 - DNA, 25 bp, Rattus norvegicus
ccttgtcctttctgttaggacttca

SEQ ID NO: 256174 - DNA, 25 bp, Rattus norvegicus
ccttgtccttttctatcactgaagg

SEQ ID NO: 256175 - DNA, 25 bp, Rattus norvegicus
ccttgtccttttgtatcactgaagg

SEQ ID NO: 256176 - DNA, 25 bp, Rattus norvegicus
ccttgtcgcacgattaccgttatat

SEQ ID NO: 256177 - DNA, 25 bp, Rattus norvegicus
ccttgtcgcacgtttaccgttatat

SEQ ID NO: 256178 - DNA, 25 bp, Rattus norvegicus
ccttgtctcaaaaggtgtttcttgt

SEQ ID NO: 256179 - DNA, 25 bp, Rattus norvegicus
ccttgtctcaaatggtgtttcttgt

SEQ ID NO: 256180 - DNA, 25 bp, Rattus norvegicus
ccttgtctccaaactcttatgtgaa

SEQ ID NO: 256181 - DNA, 25 bp, Rattus norvegicus
ccttgtctccaatctcttatgtgaa

SEQ ID NO: 256182 - DNA, 25 bp, Rattus norvegicus
ccttgtctgggacagggcgttgggt

SEQ ID NO: 256183 - DNA, 25 bp, Rattus norvegicus
ccttgtctgggagagggcgttgggt

SEQ ID NO: 256184 - DNA, 25 bp, Rattus norvegicus
ccttgtctgggtactgaatgcatca

SEQ ID NO: 256185 - DNA, 25 bp, Rattus norvegicus
ccttgtctgggttctgaatgcatca

SEQ ID NO: 256186 - DNA, 25 bp, Rattus norvegicus
ccttgtctgtacctcgtgtgtatct

SEQ ID NO: 256187 - DNA, 25 bp, Rattus norvegicus
ccttgtctgtacgtcgtgtgtatct

SEQ ID NO: 256188 - DNA, 25 bp, Rattus norvegicus
ccttgtctgtcgaggtactatggca

SEQ ID NO: 256189 - DNA, 25 bp, Rattus norvegicus
ccttgtctgtcgtggtactatggca

SEQ ID NO: 256190 - DNA, 25 bp, Rattus norvegicus
ccttgtcttaaaagggctttgcctt

SEQ ID NO: 256191 - DNA, 25 bp, Rattus norvegicus
ccttgtcttaaatgggctttgcctt

SEQ ID NO: 256192 - DNA, 25 bp, Rattus norvegicus
ccttgtcttaagacattggtcatac

SEQ ID NO: 256193 - DNA, 25 bp, Rattus norvegicus
ccttgtcttaagtcattggtcatac

SEQ ID NO: 256194 - DNA, 25 bp, Rattus norvegicus
ccttgtcttcttactctgagagagt

SEQ ID NO: 256195 - DNA, 25 bp, Rattus norvegicus
ccttgtcttctttctctgagagagt

SEQ ID NO: 256196 - DNA, 25 bp, Rattus norvegicus
ccttgtctttccaactattgcgaca

SEQ ID NO: 256197 - DNA, 25 bp, Rattus norvegicus
ccttgtctttcctactattgcgaca

SEQ ID NO: 256198 - DNA, 25 bp, Rattus norvegicus
ccttgtgaaagtccatttctgtaaa

SEQ ID NO: 256199 - DNA, 25 bp, Rattus norvegicus
ccttgtgaaagtgcatttctgtaaa

SEQ ID NO: 256200 - DNA, 25 bp, Rattus norvegicus
ccttgtgaagacctgactggactac

SEQ ID NO: 256201 - DNA, 25 bp, Rattus norvegicus
ccttgtgaagacgtgactggactac

SEQ ID NO: 256202 - DNA, 25 bp, Rattus norvegicus
ccttgtgagcttactggtgggattc

SEQ ID NO: 256203 - DNA, 25 bp, Rattus norvegicus
ccttgtgagctttctggtgggattc

SEQ ID NO: 256204 - DNA, 25 bp, Rattus norvegicus
ccttgtgatatcatttggagttgct

SEQ ID NO: 256205 - DNA, 25 bp, Rattus norvegicus
ccttgtgatatcttttggagttgct

SEQ ID NO: 256206 - DNA, 25 bp, Rattus norvegicus
ccttgtgcagtgacctaacaagcta

SEQ ID NO: 256207 - DNA, 25 bp, Rattus norvegicus
ccttgtgcagtgtcctaacaagcta

SEQ ID NO: 256208 - DNA, 25 bp, Rattus norvegicus
ccttgtgccagtcgcgcagctgtgt

SEQ ID NO: 256209 - DNA, 25 bp, Rattus norvegicus
ccttgtgccagtggcgcagctgtgt

SEQ ID NO: 256210 - DNA, 25 bp, Rattus norvegicus
ccttgtgcccagcaacaattcttgg

SEQ ID NO: 256211 - DNA, 25 bp, Rattus norvegicus
ccttgtgcccaggaacaattcttgg

SEQ ID NO: 256212 - DNA, 25 bp, Rattus norvegicus
ccttgtgccgtactttgtctccggg

SEQ ID NO: 256213 - DNA, 25 bp, Rattus norvegicus
ccttgtgccgtagtttgtctccggg

SEQ ID NO: 256214 - DNA, 25 bp, Rattus norvegicus
ccttgtgctctaccagaggtgtgat

SEQ ID NO: 256215 - DNA, 25 bp, Rattus norvegicus
ccttgtgctctagcagaggtgtgat

SEQ ID NO: 256216 - DNA, 25 bp, Rattus norvegicus
ccttgtgctttgaggtgatggttaa

SEQ ID NO: 256217 - DNA, 25 bp, Rattus norvegicus
ccttgtgctttgtggtgatggttaa

SEQ ID NO: 256218 - DNA, 25 bp, Rattus norvegicus
ccttgtggctaaatttttgtggctt

SEQ ID NO: 256219 - DNA, 25 bp, Rattus norvegicus
ccttgtggctaattttttgtggctt

SEQ ID NO: 256220 - DNA, 25 bp, Rattus norvegicus
ccttgtggctatcggcgcaggcaca

SEQ ID NO: 256221 - DNA, 25 bp, Rattus norvegicus
ccttgtggctatgggcgcaggcaca

SEQ ID NO: 256222 - DNA, 25 bp, Rattus norvegicus
ccttgtggttctaatatatctctgt

SEQ ID NO: 256223 - DNA, 25 bp, Rattus norvegicus
ccttgtggttcttatatatctctgt

SEQ ID NO: 256224 - DNA, 25 bp, Rattus norvegicus
ccttgtgtcagtcctcaggtctgtg

SEQ ID NO: 256225 - DNA, 25 bp, Rattus norvegicus
ccttgtgtcagtgctcaggtctgtg

SEQ ID NO: 256226 - DNA, 25 bp, Rattus norvegicus
ccttgtgtggctctgatgtgcacat

SEQ ID NO: 256227 - DNA, 25 bp, Rattus norvegicus
ccttgtgtggctgtgatgtgcacat

SEQ ID NO: 256228 - DNA, 25 bp, Rattus norvegicus
ccttgtgtgtctagtgggccaacaa

SEQ ID NO: 256229 - DNA, 25 bp, Rattus norvegicus
ccttgtgtgtcttgtgggccaacaa

SEQ ID NO: 256230 - DNA, 25 bp, Rattus norvegicus
ccttgtgtgttgaagctcatttgtt

SEQ ID NO: 256231 - DNA, 25 bp, Rattus norvegicus
ccttgtgtgttgtagctcatttgtt

SEQ ID NO: 256232 - DNA, 25 bp, Rattus norvegicus
ccttgtgttaacatattgctgggac

SEQ ID NO: 256233 - DNA, 25 bp, Rattus norvegicus
ccttgtgttaacttattgctgggac

SEQ ID NO: 256234 - DNA, 25 bp, Rattus norvegicus
ccttgtgttggtatctacgatggag

SEQ ID NO: 256235 - DNA, 25 bp, Rattus norvegicus
ccttgtgttggtttctacgatggag

SEQ ID NO: 256236 - DNA, 25 bp, Rattus norvegicus
ccttgttaattcacacgcgtcagat

SEQ ID NO: 256237 - DNA, 25 bp, Rattus norvegicus
ccttgttaattctcacgcgtcagat

SEQ ID NO: 256238 - DNA, 25 bp, Rattus norvegicus
ccttgttaccggaggtgtgtcactg

SEQ ID NO: 256239 - DNA, 25 bp, Rattus norvegicus
ccttgttaccggtggtgtgtcactg

SEQ ID NO: 256240 - DNA, 25 bp, Rattus norvegicus
ccttgttatcatagcctggactgca

SEQ ID NO: 256241 - DNA, 25 bp, Rattus norvegicus
ccttgttatcattgcctggactgca

SEQ ID NO: 256242 - DNA, 25 bp, Rattus norvegicus
ccttgttctagactagtgagtccat

SEQ ID NO: 256243 - DNA, 25 bp, Rattus norvegicus
ccttgttctagagtagtgagtccat

SEQ ID NO: 256244 - DNA, 25 bp, Rattus norvegicus
ccttgttctggtcgctttctgtaaa

SEQ ID NO: 256245 - DNA, 25 bp, Rattus norvegicus
ccttgttctggtggctttctgtaaa

SEQ ID NO: 256246 - DNA, 25 bp, Rattus norvegicus
ccttgttctgtcctgactcaataca

SEQ ID NO: 256247 - DNA, 25 bp, Rattus norvegicus
ccttgttctgtcgtgactcaataca

SEQ ID NO: 256248 - DNA, 25 bp, Rattus norvegicus
ccttgttgtgggatgagtatttagc

SEQ ID NO: 256249 - DNA, 25 bp, Rattus norvegicus
ccttgttgtgggttgagtatttagc

SEQ ID NO: 256250 - DNA, 25 bp, Rattus norvegicus
ccttgtttcctaatacgtgtgtggc

SEQ ID NO: 256251 - DNA, 25 bp, Rattus norvegicus
ccttgtttcctattacgtgtgtggc

SEQ ID NO: 256252 - DNA, 25 bp, Rattus norvegicus
ccttgtttgaggatgggtttggatc

SEQ ID NO: 256253 - DNA, 25 bp, Rattus norvegicus
ccttgtttgaggttgggtttggatc

SEQ ID NO: 256254 - DNA, 25 bp, Rattus norvegicus
ccttgtttgctcatgagtgctgtga

SEQ ID NO: 256255 - DNA, 25 bp, Rattus norvegicus
ccttgtttgctcttgagtgctgtga

SEQ ID NO: 256256 - DNA, 25 bp, Rattus norvegicus
ccttgtttggtacgccagcactgca

SEQ ID NO: 256257 - DNA, 25 bp, Rattus norvegicus
ccttgtttggtaggccagcactgca

SEQ ID NO: 256258 - DNA, 25 bp, Rattus norvegicus
ccttgttttgcaacgttttcggaat

SEQ ID NO: 256259 - DNA, 25 bp, Rattus norvegicus
ccttgttttgcatcgttttcggaat

SEQ ID NO: 256260 - DNA, 25 bp, Rattus norvegicus
ccttgttttgtgatgtgtaatggga

SEQ ID NO: 256261 - DNA, 25 bp, Rattus norvegicus
ccttgttttgtgttgtgtaatggga

SEQ ID NO: 256262 - DNA, 25 bp, Rattus norvegicus
cctttaaccctcacttactgttctg

SEQ ID NO: 256263 - DNA, 25 bp, Rattus norvegicus
cctttaaccctctcttactgttctg

SEQ ID NO: 256264 - DNA, 25 bp, Rattus norvegicus
cctttaactcccatcgatagactga

SEQ ID NO: 256265 - DNA, 25 bp, Rattus norvegicus
cctttaactcccttcgatagactga

SEQ ID NO: 256266 - DNA, 25 bp, Rattus norvegicus
cctttaactgtcacaggttgcagct

SEQ ID NO: 256267 - DNA, 25 bp, Rattus norvegicus
cctttaactgtctcaggttgcagct

SEQ ID NO: 256268 - DNA, 25 bp, Rattus norvegicus
cctttaatcccaccgaaggcacagg

SEQ ID NO: 256269 - DNA, 25 bp, Rattus norvegicus
cctttaatcccagcgaaggcacagg

SEQ ID NO: 256270 - DNA, 25 bp, Rattus norvegicus
cctttacctctgatctttcaacaag

SEQ ID NO: 256271 - DNA, 25 bp, Rattus norvegicus
cctttacctctgttctttcaacaag

SEQ ID NO: 256272 - DNA, 25 bp, Rattus norvegicus
cctttactcattctacatggatgga

SEQ ID NO: 256273 - DNA, 25 bp, Rattus norvegicus
cctttactcattgtacatggatgga

SEQ ID NO: 256274 - DNA, 25 bp, Rattus norvegicus
cctttactcctaaatcatcaccaag

SEQ ID NO: 256275 - DNA, 25 bp, Rattus norvegicus
cctttactcctatatcatcaccaag

SEQ ID NO: 256276 - DNA, 25 bp, Rattus norvegicus
cctttactcctgaactgtggtgaat

SEQ ID NO: 256277 - DNA, 25 bp, Rattus norvegicus
cctttactcctgtactgtggtgaat

SEQ ID NO: 256278 - DNA, 25 bp, Rattus norvegicus
cctttactggctcaggatagggaaa

SEQ ID NO: 256279 - DNA, 25 bp, Rattus norvegicus
cctttactggctgaggatagggaaa

SEQ ID NO: 256280 - DNA, 25 bp, Rattus norvegicus
cctttacttttccttccatgtgtat

SEQ ID NO: 256281 - DNA, 25 bp, Rattus norvegicus
cctttacttttcgttccatgtgtat

SEQ ID NO: 256282 - DNA, 25 bp, Rattus norvegicus
cctttagctttcactggtctataca

SEQ ID NO: 256283 - DNA, 25 bp, Rattus norvegicus
cctttagctttctctggtctataca

SEQ ID NO: 256284 - DNA, 25 bp, Rattus norvegicus
cctttaggacaacctgggcagggat

SEQ ID NO: 256285 - DNA, 25 bp, Rattus norvegicus
cctttaggacaagctgggcagggat

SEQ ID NO: 256286 - DNA, 25 bp, Rattus norvegicus
cctttaggccacaaagttctatttg

SEQ ID NO: 256287 - DNA, 25 bp, Rattus norvegicus
cctttaggccactaagttctatttg

SEQ ID NO: 256288 - DNA, 25 bp, Rattus norvegicus
cctttagttctgaggttgacatgtc

SEQ ID NO: 256289 - DNA, 25 bp, Rattus norvegicus
cctttagttctgtggttgacatgtc

SEQ ID NO: 256290 - DNA, 25 bp, Rattus norvegicus
cctttatgactgagacatgtctgta

SEQ ID NO: 256291 - DNA, 25 bp, Rattus norvegicus
cctttatgactgtgacatgtctgta

SEQ ID NO: 256292 - DNA, 25 bp, Rattus norvegicus
cctttatgagtgcacgctgcagcag

SEQ ID NO: 256293 - DNA, 25 bp, Rattus norvegicus
cctttatgagtggacgctgcagcag

SEQ ID NO: 256294 - DNA, 25 bp, Rattus norvegicus
cctttatgctccagtaatcggctaa

SEQ ID NO: 256295 - DNA, 25 bp, Rattus norvegicus
cctttatgctcctgtaatcggctaa

SEQ ID NO: 256296 - DNA, 25 bp, Rattus norvegicus
cctttattaccaatttgtacttgat

SEQ ID NO: 256297 - DNA, 25 bp, Rattus norvegicus
cctttattaccattttgtacttgat

SEQ ID NO: 256298 - DNA, 25 bp, Rattus norvegicus
cctttatttcacctgagacctcaga

SEQ ID NO: 256299 - DNA, 25 bp, Rattus norvegicus
cctttatttcacgtgagacctcaga

SEQ ID NO: 256300 - DNA, 25 bp, Rattus norvegicus
cctttattttgactgctgtttcctt

SEQ ID NO: 256301 - DNA, 25 bp, Rattus norvegicus
cctttattttgagtgctgtttcctt

SEQ ID NO: 256302 - DNA, 25 bp, Rattus norvegicus
cctttcaagcttatcctgggcaggg

SEQ ID NO: 256303 - DNA, 25 bp, Rattus norvegicus
cctttcaagcttttcctgggcaggg

SEQ ID NO: 256304 - DNA, 25 bp, Rattus norvegicus
cctttcaagtgacgtccttattgct

SEQ ID NO: 256305 - DNA, 25 bp, Rattus norvegicus
cctttcaagtgaggtccttattgct

SEQ ID NO: 256306 - DNA, 25 bp, Rattus norvegicus
cctttcactctccatgccatatgag

SEQ ID NO: 256307 - DNA, 25 bp, Rattus norvegicus
cctttcactctcgatgccatatgag

SEQ ID NO: 256308 - DNA, 25 bp, Rattus norvegicus
cctttcactgtcatcttgacacaat

SEQ ID NO: 256309 - DNA, 25 bp, Rattus norvegicus
cctttcactgtcttcttgacacaat

SEQ ID NO: 256310 - DNA, 25 bp, Rattus norvegicus
cctttcagacctaggctaagcttag

SEQ ID NO: 256311 - DNA, 25 bp, Rattus norvegicus
cctttcagaccttggctaagcttag

SEQ ID NO: 256312 - DNA, 25 bp, Rattus norvegicus
cctttcagctccagaaacagctggg

SEQ ID NO: 256313 - DNA, 25 bp, Rattus norvegicus
cctttcagctcctgaaacagctggg

SEQ ID NO: 256314 - DNA, 25 bp, Rattus norvegicus
cctttcaggctgaccatcggaggaa

SEQ ID NO: 256315 - DNA, 25 bp, Rattus norvegicus
cctttcaggctgtccatcggaggaa

SEQ ID NO: 256316 - DNA, 25 bp, Rattus norvegicus
cctttcatcaggatcccattgagga

SEQ ID NO: 256317 - DNA, 25 bp, Rattus norvegicus
cctttcatcaggttcccattgagga

SEQ ID NO: 256318 - DNA, 25 bp, Rattus norvegicus
cctttcattctgcagctgtgggaac

SEQ ID NO: 256319 - DNA, 25 bp, Rattus norvegicus
cctttcattctggagctgtgggaac

SEQ ID NO: 256320 - DNA, 25 bp, Rattus norvegicus
cctttccaactccttgctaacaaat

SEQ ID NO: 256321 - DNA, 25 bp, Rattus norvegicus
cctttccaactcgttgctaacaaat

SEQ ID NO: 256322 - DNA, 25 bp, Rattus norvegicus
cctttccacagacggctattggcta

SEQ ID NO: 256323 - DNA, 25 bp, Rattus norvegicus
cctttccacagagggctattggcta

SEQ ID NO: 256324 - DNA, 25 bp, Rattus norvegicus
cctttccagatcatcataccttaaa

SEQ ID NO: 256325 - DNA, 25 bp, Rattus norvegicus
cctttccagatcttcataccttaaa

SEQ ID NO: 256326 - DNA, 25 bp, Rattus norvegicus
cctttccagctgacttacttgagta

SEQ ID NO: 256327 - DNA, 25 bp, Rattus norvegicus
cctttccagctgtcttacttgagta

SEQ ID NO: 256328 - DNA, 25 bp, Rattus norvegicus
cctttccatcctaaacatatccata

SEQ ID NO: 256329 - DNA, 25 bp, Rattus norvegicus
cctttccatccttaacatatccata

SEQ ID NO: 256330 - DNA, 25 bp, Rattus norvegicus
cctttccattagatcttcttctact

SEQ ID NO: 256331 - DNA, 25 bp, Rattus norvegicus
cctttccattagttcttcttctact

SEQ ID NO: 256332 - DNA, 25 bp, Rattus norvegicus
cctttccattatacagacgtgtgta

SEQ ID NO: 256333 - DNA, 25 bp, Rattus norvegicus
cctttccattatacatagcagcatt

SEQ ID NO: 256334 - DNA, 25 bp, Rattus norvegicus
cctttccattattcagacgtgtgta

SEQ ID NO: 256335 - DNA, 25 bp, Rattus norvegicus
cctttccattattcatagcagcatt

SEQ ID NO: 256336 - DNA, 25 bp, Rattus norvegicus
cctttccattgtctccttattttat

SEQ ID NO: 256337 - DNA, 25 bp, Rattus norvegicus
cctttccattgtgtccttattttat

SEQ ID NO: 256338 - DNA, 25 bp, Rattus norvegicus
cctttcccaaacacgacacgagtag

SEQ ID NO: 256339 - DNA, 25 bp, Rattus norvegicus
cctttcccaaactcgacacgagtag

SEQ ID NO: 256340 - DNA, 25 bp, Rattus norvegicus
cctttcccgatgcttacgctttggt

SEQ ID NO: 256341 - DNA, 25 bp, Rattus norvegicus
cctttcccgatggttacgctttggt

SEQ ID NO: 256342 - DNA, 25 bp, Rattus norvegicus
cctttcctacttctgttaacacaca

SEQ ID NO: 256343 - DNA, 25 bp, Rattus norvegicus
cctttcctacttgtgttaacacaca

SEQ ID NO: 256344 - DNA, 25 bp, Rattus norvegicus
cctttcctgactccatctatataat

SEQ ID NO: 256345 - DNA, 25 bp, Rattus norvegicus
cctttcctgactgcatctatataat

SEQ ID NO: 256346 - DNA, 25 bp, Rattus norvegicus
cctttcctgagcaacttcttaagaa

SEQ ID NO: 256347 - DNA, 25 bp, Rattus norvegicus
cctttcctgagctacttcttaagaa

SEQ ID NO: 256348 - DNA, 25 bp, Rattus norvegicus
cctttcctgcttctctatgcacaaa

SEQ ID NO: 256349 - DNA, 25 bp, Rattus norvegicus
cctttcctgcttgtctatgcacaaa

SEQ ID NO: 256350 - DNA, 25 bp, Rattus norvegicus
cctttcctggcacgtaagtcattag

SEQ ID NO: 256351 - DNA, 25 bp, Rattus norvegicus
cctttcctggcaggtaagtcattag

SEQ ID NO: 256352 - DNA, 25 bp, Rattus norvegicus
cctttcctggccatgatcaaatcaa

SEQ ID NO: 256353 - DNA, 25 bp, Rattus norvegicus
cctttcctggccttgatcaaatcaa

SEQ ID NO: 256354 - DNA, 25 bp, Rattus norvegicus
cctttcctgggaagagctcgctttc

SEQ ID NO: 256355 - DNA, 25 bp, Rattus norvegicus
cctttcctgggatgagctcgctttc

SEQ ID NO: 256356 - DNA, 25 bp, Rattus norvegicus
cctttcctgtcaccaagtgtttgat

SEQ ID NO: 256357 - DNA, 25 bp, Rattus norvegicus
cctttcctgtcagcaagtgtttgat

SEQ ID NO: 256358 - DNA, 25 bp, Rattus norvegicus
cctttccttatactcccagcttata

SEQ ID NO: 256359 - DNA, 25 bp, Rattus norvegicus
cctttccttatagtcccagcttata

SEQ ID NO: 256360 - DNA, 25 bp, Rattus norvegicus
cctttccttgtaatttatcgaagca

SEQ ID NO: 256361 - DNA, 25 bp, Rattus norvegicus
cctttccttgtattttatcgaagca

SEQ ID NO: 256362 - DNA, 25 bp, Rattus norvegicus
cctttccttgtgacccattgttgga

SEQ ID NO: 256363 - DNA, 25 bp, Rattus norvegicus
cctttccttgtgtcccattgttgga

SEQ ID NO: 256364 - DNA, 25 bp, Rattus norvegicus
cctttcgcatgtccacatgtgtgta

SEQ ID NO: 256365 - DNA, 25 bp, Rattus norvegicus
cctttcgcatgtgcacatgtgtgta

SEQ ID NO: 256366 - DNA, 25 bp, Rattus norvegicus
cctttcgccttcacaggacttgcag

SEQ ID NO: 256367 - DNA, 25 bp, Rattus norvegicus
cctttcgccttctcaggacttgcag

SEQ ID NO: 256368 - DNA, 25 bp, Rattus norvegicus
cctttcggcctactcagatgggtgt

SEQ ID NO: 256369 - DNA, 25 bp, Rattus norvegicus
cctttcggcctagtcagatgggtgt

SEQ ID NO: 256370 - DNA, 25 bp, Rattus norvegicus
cctttcggtcctagctatgttaatc

SEQ ID NO: 256371 - DNA, 25 bp, Rattus norvegicus
cctttcggtccttgctatgttaatc

SEQ ID NO: 256372 - DNA, 25 bp, Rattus norvegicus
cctttcgtcgacaccctgatgagaa

SEQ ID NO: 256373 - DNA, 25 bp, Rattus norvegicus
cctttcgtcgactccctgatgagaa

SEQ ID NO: 256374 - DNA, 25 bp, Rattus norvegicus
cctttcgtgaggatgcgcagctatc

SEQ ID NO: 256375 - DNA, 25 bp, Rattus norvegicus
cctttcgtgaggttgcgcagctatc

SEQ ID NO: 256376 - DNA, 25 bp, Rattus norvegicus
cctttctccgtcaaggcatcagaag

SEQ ID NO: 256377 - DNA, 25 bp, Rattus norvegicus
cctttctccgtctaggcatcagaag

SEQ ID NO: 256378 - DNA, 25 bp, Rattus norvegicus
cctttctccttcctgtaatggtatg

SEQ ID NO: 256379 - DNA, 25 bp, Rattus norvegicus
cctttctccttcgtgtaatggtatg

SEQ ID NO: 256380 - DNA, 25 bp, Rattus norvegicus
cctttctctatcagtatctattttg

SEQ ID NO: 256381 - DNA, 25 bp, Rattus norvegicus
cctttctctatctgtatctattttg

SEQ ID NO: 256382 - DNA, 25 bp, Rattus norvegicus
cctttctctcctcattgctaatgta

SEQ ID NO: 256383 - DNA, 25 bp, Rattus norvegicus
cctttctctcctgattgctaatgta

SEQ ID NO: 256384 - DNA, 25 bp, Rattus norvegicus
cctttctctctcactagaagtggta

SEQ ID NO: 256385 - DNA, 25 bp, Rattus norvegicus
cctttctctctctctagaagtggta

SEQ ID NO: 256386 - DNA, 25 bp, Rattus norvegicus
cctttctgcgtcagggatcctggaa

SEQ ID NO: 256387 - DNA, 25 bp, Rattus norvegicus
cctttctgcgtctgggatcctggaa

SEQ ID NO: 256388 - DNA, 25 bp, Rattus norvegicus
cctttctgctctatgtttactattc

SEQ ID NO: 256389 - DNA, 25 bp, Rattus norvegicus
cctttctgctctttgtttactattc

SEQ ID NO: 256390 - DNA, 25 bp, Rattus norvegicus
cctttctggcacagtttctgcaaac

SEQ ID NO: 256391 - DNA, 25 bp, Rattus norvegicus
cctttctggcactgtttctgcaaac

SEQ ID NO: 256392 - DNA, 25 bp, Rattus norvegicus
cctttctgtgcacgcctggctgaag

SEQ ID NO: 256393 - DNA, 25 bp, Rattus norvegicus
cctttctgtgcaggcctggctgaag

SEQ ID NO: 256394 - DNA, 25 bp, Rattus norvegicus
cctttctgtggtattttgtcctgta

SEQ ID NO: 256395 - DNA, 25 bp, Rattus norvegicus
cctttctgtggttttttgtcctgta

SEQ ID NO: 256396 - DNA, 25 bp, Rattus norvegicus
cctttctgtgtacaaggcaccaaag

SEQ ID NO: 256397 - DNA, 25 bp, Rattus norvegicus
cctttctgtgtagaaggcaccaaag

SEQ ID NO: 256398 - DNA, 25 bp, Rattus norvegicus
cctttcttaatgatcaggctgcaga

SEQ ID NO: 256399 - DNA, 25 bp, Rattus norvegicus
cctttcttaatgttcaggctgcaga

SEQ ID NO: 256400 - DNA, 25 bp, Rattus norvegicus
cctttcttcaaactcatctccagag

SEQ ID NO: 256401 - DNA, 25 bp, Rattus norvegicus
cctttcttcaaagtcatctccagag

SEQ ID NO: 256402 - DNA, 25 bp, Rattus norvegicus
cctttcttccacacttcgaggataa

SEQ ID NO: 256403 - DNA, 25 bp, Rattus norvegicus
cctttcttccactcttcgaggataa

SEQ ID NO: 256404 - DNA, 25 bp, Rattus norvegicus
cctttcttctctctacttgatggga

SEQ ID NO: 256405 - DNA, 25 bp, Rattus norvegicus
cctttcttctctgtacttgatggga

SEQ ID NO: 256406 - DNA, 25 bp, Rattus norvegicus
cctttcttgctaacactacgatcta

SEQ ID NO: 256407 - DNA, 25 bp, Rattus norvegicus
cctttcttgctatcactacgatcta

SEQ ID NO: 256408 - DNA, 25 bp, Rattus norvegicus
cctttcttgtctacagtgacgtttg

SEQ ID NO: 256409 - DNA, 25 bp, Rattus norvegicus
cctttcttgtcttcagtgacgtttg

SEQ ID NO: 256410 - DNA, 25 bp, Rattus norvegicus
cctttctttgcacgtatgtgcccgt

SEQ ID NO: 256411 - DNA, 25 bp, Rattus norvegicus
cctttctttgcaggtatgtgcccgt

SEQ ID NO: 256412 - DNA, 25 bp, Rattus norvegicus
cctttctttgtccacactactgaat

SEQ ID NO: 256413 - DNA, 25 bp, Rattus norvegicus
cctttctttgtcgacactactgaat

SEQ ID NO: 256414 - DNA, 25 bp, Rattus norvegicus
cctttcttttgcaaattgtgctaag

SEQ ID NO: 256415 - DNA, 25 bp, Rattus norvegicus
cctttcttttgctaattgtgctaag

SEQ ID NO: 256416 - DNA, 25 bp, Rattus norvegicus
cctttctttttcagcagtactggag

SEQ ID NO: 256417 - DNA, 25 bp, Rattus norvegicus
cctttctttttctgcagtactggag

SEQ ID NO: 256418 - DNA, 25 bp, Rattus norvegicus
cctttgaaaaatcgtgtgcctgaaa

SEQ ID NO: 256419 - DNA, 25 bp, Rattus norvegicus
cctttgaaaaatggtgtgcctgaaa

SEQ ID NO: 256420 - DNA, 25 bp, Rattus norvegicus
cctttgaagccccattactgtgtga

SEQ ID NO: 256421 - DNA, 25 bp, Rattus norvegicus
cctttgaagcccgattactgtgtga

SEQ ID NO: 256422 - DNA, 25 bp, Rattus norvegicus
cctttgacaaacacccatagacttt

SEQ ID NO: 256423 - DNA, 25 bp, Rattus norvegicus
cctttgacaaactcccatagacttt

SEQ ID NO: 256424 - DNA, 25 bp, Rattus norvegicus
cctttgaccttgactgactccagaa

SEQ ID NO: 256425 - DNA, 25 bp, Rattus norvegicus
cctttgaccttgtctgactccagaa

SEQ ID NO: 256426 - DNA, 25 bp, Rattus norvegicus
cctttgactcatacttcctaatatc

SEQ ID NO: 256427 - DNA, 25 bp, Rattus norvegicus
cctttgactcattcttcctaatatc

SEQ ID NO: 256428 - DNA, 25 bp, Rattus norvegicus
cctttgaggagtctcttcgcttgaa

SEQ ID NO: 256429 - DNA, 25 bp, Rattus norvegicus
cctttgaggagtgtcttcgcttgaa

SEQ ID NO: 256430 - DNA, 25 bp, Rattus norvegicus
cctttgatagtgcttcttatgtgta

SEQ ID NO: 256431 - DNA, 25 bp, Rattus norvegicus
cctttgatagtggttcttatgtgta

SEQ ID NO: 256432 - DNA, 25 bp, Rattus norvegicus
cctttgatcacactattcccatata

SEQ ID NO: 256433 - DNA, 25 bp, Rattus norvegicus
cctttgatcacagtattcccatata

SEQ ID NO: 256434 - DNA, 25 bp, Rattus norvegicus
cctttgatcttaccactccgtgagt

SEQ ID NO: 256435 - DNA, 25 bp, Rattus norvegicus
cctttgatcttagcactccgtgagt

SEQ ID NO: 256436 - DNA, 25 bp, Rattus norvegicus
cctttgatgtctcttatcagcaagt

SEQ ID NO: 256437 - DNA, 25 bp, Rattus norvegicus
cctttgatgtctgttatcagcaagt

SEQ ID NO: 256438 - DNA, 25 bp, Rattus norvegicus
cctttgcaccccaagagaatctatt

SEQ ID NO: 256439 - DNA, 25 bp, Rattus norvegicus
cctttgcacccctagagaatctatt

SEQ ID NO: 256440 - DNA, 25 bp, Rattus norvegicus
cctttgcagcttactatggagtctt

SEQ ID NO: 256441 - DNA, 25 bp, Rattus norvegicus
cctttgcagctttctatggagtctt

SEQ ID NO: 256442 - DNA, 25 bp, Rattus norvegicus
cctttgcagtacatgggttttatat

SEQ ID NO: 256443 - DNA, 25 bp, Rattus norvegicus
cctttgcagtacttgggttttatat

SEQ ID NO: 256444 - DNA, 25 bp, Rattus norvegicus
cctttgcatctcactcagttagtga

SEQ ID NO: 256445 - DNA, 25 bp, Rattus norvegicus
cctttgcatctctctcagttagtga

SEQ ID NO: 256446 - DNA, 25 bp, Rattus norvegicus
cctttgcatggacggcttttgtcac

SEQ ID NO: 256447 - DNA, 25 bp, Rattus norvegicus
cctttgcatggagggcttttgtcac

SEQ ID NO: 256448 - DNA, 25 bp, Rattus norvegicus
cctttgccacccagaaatgttgagt

SEQ ID NO: 256449 - DNA, 25 bp, Rattus norvegicus
cctttgccaccctgaaatgttgagt

SEQ ID NO: 256450 - DNA, 25 bp, Rattus norvegicus
cctttgccagagaatccttatcact

SEQ ID NO: 256451 - DNA, 25 bp, Rattus norvegicus
cctttgccagagtatccttatcact

SEQ ID NO: 256452 - DNA, 25 bp, Rattus norvegicus
cctttgcccttcaaactgcagattt

SEQ ID NO: 256453 - DNA, 25 bp, Rattus norvegicus
cctttgcccttctaactgcagattt

SEQ ID NO: 256454 - DNA, 25 bp, Rattus norvegicus
cctttgcgggaacagcactcgtgcg

SEQ ID NO: 256455 - DNA, 25 bp, Rattus norvegicus
cctttgcgggaagagcactcgtgcg

SEQ ID NO: 256456 - DNA, 25 bp, Rattus norvegicus
cctttgcgtaacatcttgggctgaa

SEQ ID NO: 256457 - DNA, 25 bp, Rattus norvegicus
cctttgcgtaacttcttgggctgaa

SEQ ID NO: 256458 - DNA, 25 bp, Rattus norvegicus
cctttgcgtactcctggatggagtt

SEQ ID NO: 256459 - DNA, 25 bp, Rattus norvegicus
cctttgcgtactgctggatggagtt

SEQ ID NO: 256460 - DNA, 25 bp, Rattus norvegicus
cctttgctccgtctagtgttttgaa

SEQ ID NO: 256461 - DNA, 25 bp, Rattus norvegicus
cctttgctccgtgtagtgttttgaa

SEQ ID NO: 256462 - DNA, 25 bp, Rattus norvegicus
cctttgctctgtagtactgattggg

SEQ ID NO: 256463 - DNA, 25 bp, Rattus norvegicus
cctttgctctgttgtactgattggg

SEQ ID NO: 256464 - DNA, 25 bp, Rattus norvegicus
cctttgctgtgcctgggaaatacaa

SEQ ID NO: 256465 - DNA, 25 bp, Rattus norvegicus
cctttgctgtgcgtgggaaatacaa

SEQ ID NO: 256466 - DNA, 25 bp, Rattus norvegicus
cctttgctgtttagtcggcaaccaa

SEQ ID NO: 256467 - DNA, 25 bp, Rattus norvegicus
cctttgctgttttgtcggcaaccaa

SEQ ID NO: 256468 - DNA, 25 bp, Rattus norvegicus
cctttgcttcatagctattcttaat

SEQ ID NO: 256469 - DNA, 25 bp, Rattus norvegicus
cctttgcttcattgctattcttaat

SEQ ID NO: 256470 - DNA, 25 bp, Rattus norvegicus
cctttggacccaacatctcaagatg

SEQ ID NO: 256471 - DNA, 25 bp, Rattus norvegicus
cctttggacccatcatctcaagatg

SEQ ID NO: 256472 - DNA, 25 bp, Rattus norvegicus
cctttggaccgtagtgtggcatcaa

SEQ ID NO: 256473 - DNA, 25 bp, Rattus norvegicus
cctttggaccgttgtgtggcatcaa

SEQ ID NO: 256474 - DNA, 25 bp, Rattus norvegicus
cctttggactgtcgccgctgaatca

SEQ ID NO: 256475 - DNA, 25 bp, Rattus norvegicus
cctttggactgtggccgctgaatca

SEQ ID NO: 256476 - DNA, 25 bp, Rattus norvegicus
cctttggagagtcactgtccgtgtg

SEQ ID NO: 256477 - DNA, 25 bp, Rattus norvegicus
cctttggagagtgactgtccgtgtg

SEQ ID NO: 256478 - DNA, 25 bp, Rattus norvegicus
cctttggagtgaacctgttttcctc

SEQ ID NO: 256479 - DNA, 25 bp, Rattus norvegicus
cctttggagtgatcctgttttcctc

SEQ ID NO: 256480 - DNA, 25 bp, Rattus norvegicus
cctttggatggtctctggtagcagt

SEQ ID NO: 256481 - DNA, 25 bp, Rattus norvegicus
cctttggatggtgtctggtagcagt

SEQ ID NO: 256482 - DNA, 25 bp, Rattus norvegicus
cctttggccagcctgtggagagcat

SEQ ID NO: 256483 - DNA, 25 bp, Rattus norvegicus
cctttggccagcgtgtggagagcat

SEQ ID NO: 256484 - DNA, 25 bp, Rattus norvegicus
cctttggccctcagcagagttggtg

SEQ ID NO: 256485 - DNA, 25 bp, Rattus norvegicus
cctttggccctctgcagagttggtg

SEQ ID NO: 256486 - DNA, 25 bp, Rattus norvegicus
cctttggccttaaatacttgggtat

SEQ ID NO: 256487 - DNA, 25 bp, Rattus norvegicus
cctttggccttatatacttgggtat

SEQ ID NO: 256488 - DNA, 25 bp, Rattus norvegicus
cctttggcttccctaagaattctgg

SEQ ID NO: 256489 - DNA, 25 bp, Rattus norvegicus
cctttggcttccgtaagaattctgg

SEQ ID NO: 256490 - DNA, 25 bp, Rattus norvegicus
cctttggcttgaccttgtcttatat

SEQ ID NO: 256491 - DNA, 25 bp, Rattus norvegicus
cctttggcttgagcttgtcttatat

SEQ ID NO: 256492 - DNA, 25 bp, Rattus norvegicus
cctttgggagtcatggctcagggtt

SEQ ID NO: 256493 - DNA, 25 bp, Rattus norvegicus
cctttgggagtcttggctcagggtt

SEQ ID NO: 256494 - DNA, 25 bp, Rattus norvegicus
cctttggtcttcattttcttgatgg

SEQ ID NO: 256495 - DNA, 25 bp, Rattus norvegicus
cctttggtcttctttttcttgatgg

SEQ ID NO: 256496 - DNA, 25 bp, Rattus norvegicus
cctttgtctctgcaactttctagtt

SEQ ID NO: 256497 - DNA, 25 bp, Rattus norvegicus
cctttgtctctggaactttctagtt

SEQ ID NO: 256498 - DNA, 25 bp, Rattus norvegicus
cctttgtctgacagccagtttttga

SEQ ID NO: 256499 - DNA, 25 bp, Rattus norvegicus
cctttgtctgactgccagtttttga

SEQ ID NO: 256500 - DNA, 25 bp, Rattus norvegicus
cctttgtcttctcaatgtggttcta

SEQ ID NO: 256501 - DNA, 25 bp, Rattus norvegicus
cctttgtcttctgaatgtggttcta

SEQ ID NO: 256502 - DNA, 25 bp, Rattus norvegicus
cctttgtggtccacacctggtggag

SEQ ID NO: 256503 - DNA, 25 bp, Rattus norvegicus
cctttgtggtcctcacctggtggag

SEQ ID NO: 256504 - DNA, 25 bp, Rattus norvegicus
cctttgtggttcacacttggtggaa

SEQ ID NO: 256505 - DNA, 25 bp, Rattus norvegicus
cctttgtggttctcacttggtggaa

SEQ ID NO: 256506 - DNA, 25 bp, Rattus norvegicus
cctttgtgttgtctggactctactt

SEQ ID NO: 256507 - DNA, 25 bp, Rattus norvegicus
cctttgtgttgtgtggactctactt

SEQ ID NO: 256508 - DNA, 25 bp, Rattus norvegicus
cctttgttattccttgtctctggag

SEQ ID NO: 256509 - DNA, 25 bp, Rattus norvegicus
cctttgttattcgttgtctctggag

SEQ ID NO: 256510 - DNA, 25 bp, Rattus norvegicus
cctttgttcctacctgcacttaaat

SEQ ID NO: 256511 - DNA, 25 bp, Rattus norvegicus
cctttgttcctagctgcacttaaat

SEQ ID NO: 256512 - DNA, 25 bp, Rattus norvegicus
cctttgttgcacactcacttgttaa

SEQ ID NO: 256513 - DNA, 25 bp, Rattus norvegicus
cctttgttgcactctcacttgttaa

SEQ ID NO: 256514 - DNA, 25 bp, Rattus norvegicus
cctttgttgtggattggagccctat

SEQ ID NO: 256515 - DNA, 25 bp, Rattus norvegicus
cctttgttgtggtttggagccctat

SEQ ID NO: 256516 - DNA, 25 bp, Rattus norvegicus
cctttgtttgagctctgttgggctt

SEQ ID NO: 256517 - DNA, 25 bp, Rattus norvegicus
cctttgtttgaggtctgttgggctt

SEQ ID NO: 256518 - DNA, 25 bp, Rattus norvegicus
cctttgtttgccacagtttggacag

SEQ ID NO: 256519 - DNA, 25 bp, Rattus norvegicus
cctttgtttgcctcagtttggacag

SEQ ID NO: 256520 - DNA, 25 bp, Rattus norvegicus
cctttgtttggtcaggtgtgtgtcc

SEQ ID NO: 256521 - DNA, 25 bp, Rattus norvegicus
cctttgtttggtgaggtgtgtgtcc

SEQ ID NO: 256522 - DNA, 25 bp, Rattus norvegicus
ccttttaattctctgtcctcggaag

SEQ ID NO: 256523 - DNA, 25 bp, Rattus norvegicus
ccttttaattctgtgtcctcggaag

SEQ ID NO: 256524 - DNA, 25 bp, Rattus norvegicus
ccttttacatgcacacaagtgccag

SEQ ID NO: 256525 - DNA, 25 bp, Rattus norvegicus
ccttttacatgctcacaagtgccag

SEQ ID NO: 256526 - DNA, 25 bp, Rattus norvegicus
ccttttaccactatgcatctcttga

SEQ ID NO: 256527 - DNA, 25 bp, Rattus norvegicus
ccttttaccactttgcatctcttga

SEQ ID NO: 256528 - DNA, 25 bp, Rattus norvegicus
ccttttagcctcatctagggacagg

SEQ ID NO: 256529 - DNA, 25 bp, Rattus norvegicus
ccttttagcctccatgagcatggtg

SEQ ID NO: 256530 - DNA, 25 bp, Rattus norvegicus
ccttttagcctcgatgagcatggtg

SEQ ID NO: 256531 - DNA, 25 bp, Rattus norvegicus
ccttttagcctcttctagggacagg

SEQ ID NO: 256532 - DNA, 25 bp, Rattus norvegicus
ccttttagctttcctagtgctgaga

SEQ ID NO: 256533 - DNA, 25 bp, Rattus norvegicus
ccttttagctttgctagtgctgaga

SEQ ID NO: 256534 - DNA, 25 bp, Rattus norvegicus
ccttttatggatcccctacaggact

SEQ ID NO: 256535 - DNA, 25 bp, Rattus norvegicus
ccttttatggatgccctacaggact

SEQ ID NO: 256536 - DNA, 25 bp, Rattus norvegicus
ccttttatttaaaccatggcatatg

SEQ ID NO: 256537 - DNA, 25 bp, Rattus norvegicus
ccttttatttaatccatggcatatg

SEQ ID NO: 256538 - DNA, 25 bp, Rattus norvegicus
ccttttcaatccaagcacattctta

SEQ ID NO: 256539 - DNA, 25 bp, Rattus norvegicus
ccttttcaatcctagcacattctta

SEQ ID NO: 256540 - DNA, 25 bp, Rattus norvegicus
ccttttcaccagaaccacagtggaa

SEQ ID NO: 256541 - DNA, 25 bp, Rattus norvegicus
ccttttcaccagtaccacagtggaa

SEQ ID NO: 256542 - DNA, 25 bp, Rattus norvegicus
ccttttcactccacatggaagcatg

SEQ ID NO: 256543 - DNA, 25 bp, Rattus norvegicus
ccttttcactcctcatggaagcatg

SEQ ID NO: 256544 - DNA, 25 bp, Rattus norvegicus
ccttttcacttcagctttggagcta

SEQ ID NO: 256545 - DNA, 25 bp, Rattus norvegicus
ccttttcacttctgctttggagcta

SEQ ID NO: 256546 - DNA, 25 bp, Rattus norvegicus
ccttttcagggcattatcttgggag

SEQ ID NO: 256547 - DNA, 25 bp, Rattus norvegicus
ccttttcagggctttatcttgggag

SEQ ID NO: 256548 - DNA, 25 bp, Rattus norvegicus
ccttttcagtggagcttgtctggga

SEQ ID NO: 256549 - DNA, 25 bp, Rattus norvegicus
ccttttcagtggtgcttgtctggga

SEQ ID NO: 256550 - DNA, 25 bp, Rattus norvegicus
ccttttcatggcagttattcttttg

SEQ ID NO: 256551 - DNA, 25 bp, Rattus norvegicus
ccttttcatggctgttattcttttg

SEQ ID NO: 256552 - DNA, 25 bp, Rattus norvegicus
ccttttcattgccatttgggaaaga

SEQ ID NO: 256553 - DNA, 25 bp, Rattus norvegicus
ccttttcattgcgatttgggaaaga

SEQ ID NO: 256554 - DNA, 25 bp, Rattus norvegicus
ccttttccaatgaccattcttaggg

SEQ ID NO: 256555 - DNA, 25 bp, Rattus norvegicus
ccttttccaatgtccattcttaggg

SEQ ID NO: 256556 - DNA, 25 bp, Rattus norvegicus
ccttttccaattatggtctcacctt

SEQ ID NO: 256557 - DNA, 25 bp, Rattus norvegicus
ccttttccaattttggtctcacctt

SEQ ID NO: 256558 - DNA, 25 bp, Rattus norvegicus
ccttttccctatacatatgtgaact

SEQ ID NO: 256559 - DNA, 25 bp, Rattus norvegicus
ccttttccctattcatatgtgaact

SEQ ID NO: 256560 - DNA, 25 bp, Rattus norvegicus
ccttttcctgcacttctagtgttac

SEQ ID NO: 256561 - DNA, 25 bp, Rattus norvegicus
ccttttcctgcagttctagtgttac

SEQ ID NO: 256562 - DNA, 25 bp, Rattus norvegicus
ccttttcctgttaatcagcagttgt

SEQ ID NO: 256563 - DNA, 25 bp, Rattus norvegicus
ccttttcctgtttatcagcagttgt

SEQ ID NO: 256564 - DNA, 25 bp, Rattus norvegicus
ccttttcctttcatgagattgcata

SEQ ID NO: 256565 - DNA, 25 bp, Rattus norvegicus
ccttttcctttcttgagattgcata

SEQ ID NO: 256566 - DNA, 25 bp, Rattus norvegicus
ccttttctaggtagttgcagtctga

SEQ ID NO: 256567 - DNA, 25 bp, Rattus norvegicus
ccttttctaggttgttgcagtctga

SEQ ID NO: 256568 - DNA, 25 bp, Rattus norvegicus
ccttttctctatcccttcttgaata

SEQ ID NO: 256569 - DNA, 25 bp, Rattus norvegicus
ccttttctctatgccttcttgaata

SEQ ID NO: 256570 - DNA, 25 bp, Rattus norvegicus
ccttttctgattaggtgctacggac

SEQ ID NO: 256571 - DNA, 25 bp, Rattus norvegicus
ccttttctgatttggtgctacggac

SEQ ID NO: 256572 - DNA, 25 bp, Rattus norvegicus
ccttttcttaaacgtccattcatct

SEQ ID NO: 256573 - DNA, 25 bp, Rattus norvegicus
ccttttcttaaaggtccattcatct

SEQ ID NO: 256574 - DNA, 25 bp, Rattus norvegicus
ccttttgaacacagtccttgggaat

SEQ ID NO: 256575 - DNA, 25 bp, Rattus norvegicus
ccttttgaacactgtccttgggaat

SEQ ID NO: 256576 - DNA, 25 bp, Rattus norvegicus
ccttttgaagggatcgtgtgtacta

SEQ ID NO: 256577 - DNA, 25 bp, Rattus norvegicus
ccttttgaagggttcgtgtgtacta

SEQ ID NO: 256578 - DNA, 25 bp, Rattus norvegicus
ccttttgcctgtccccaggactaga

SEQ ID NO: 256579 - DNA, 25 bp, Rattus norvegicus
ccttttgcctgtgcccaggactaga

SEQ ID NO: 256580 - DNA, 25 bp, Rattus norvegicus
ccttttgctgatatatagtgacctt

SEQ ID NO: 256581 - DNA, 25 bp, Rattus norvegicus
ccttttgctgatttatagtgacctt

SEQ ID NO: 256582 - DNA, 25 bp, Rattus norvegicus
ccttttggatgcatgtgtgggtata

SEQ ID NO: 256583 - DNA, 25 bp, Rattus norvegicus
ccttttggatgcttgtgtgggtata

SEQ ID NO: 256584 - DNA, 25 bp, Rattus norvegicus
ccttttggctgcagccctgtgtgga

SEQ ID NO: 256585 - DNA, 25 bp, Rattus norvegicus
ccttttggctgctgccctgtgtgga

SEQ ID NO: 256586 - DNA, 25 bp, Rattus norvegicus
ccttttgtacttaggaacagcaaat

SEQ ID NO: 256587 - DNA, 25 bp, Rattus norvegicus
ccttttgtactttggaacagcaaat

SEQ ID NO: 256588 - DNA, 25 bp, Rattus norvegicus
ccttttgtctttcaccgtatggtag

SEQ ID NO: 256589 - DNA, 25 bp, Rattus norvegicus
ccttttgtctttgaccgtatggtag

SEQ ID NO: 256590 - DNA, 25 bp, Rattus norvegicus
ccttttgtgcgtctgttgggaattg

SEQ ID NO: 256591 - DNA, 25 bp, Rattus norvegicus
ccttttgtgcgtgtgttgggaattg

SEQ ID NO: 256592 - DNA, 25 bp, Rattus norvegicus
cctttttacatacactggccatttc

SEQ ID NO: 256593 - DNA, 25 bp, Rattus norvegicus
cctttttacatagactggccatttc

SEQ ID NO: 256594 - DNA, 25 bp, Rattus norvegicus
cctttttattctcagggcccataga

SEQ ID NO: 256595 - DNA, 25 bp, Rattus norvegicus
cctttttattctgagggcccataga

SEQ ID NO: 256596 - DNA, 25 bp, Rattus norvegicus
cctttttattgcagttgctttccaa

SEQ ID NO: 256597 - DNA, 25 bp, Rattus norvegicus
cctttttattgctgttgctttccaa

SEQ ID NO: 256598 - DNA, 25 bp, Rattus norvegicus
cctttttccccaagttaatgctcaa

SEQ ID NO: 256599 - DNA, 25 bp, Rattus norvegicus
cctttttccccatgttaatgctcaa

SEQ ID NO: 256600 - DNA, 25 bp, Rattus norvegicus
cctttttctgctactttttgtgtgt

SEQ ID NO: 256601 - DNA, 25 bp, Rattus norvegicus
cctttttctgcttctttttgtgtgt

SEQ ID NO: 256602 - DNA, 25 bp, Rattus norvegicus
cctttttcttgtcctcagtatctaa

SEQ ID NO: 256603 - DNA, 25 bp, Rattus norvegicus
cctttttcttgtgctcagtatctaa

SEQ ID NO: 256604 - DNA, 25 bp, Rattus norvegicus
cctttttgcttcacagtgtcttcta

SEQ ID NO: 256605 - DNA, 25 bp, Rattus norvegicus
cctttttgcttctcagtgtcttcta

SEQ ID NO: 256606 - DNA, 25 bp, Rattus norvegicus
cctttttgtcagatgggagtgtgtc

SEQ ID NO: 256607 - DNA, 25 bp, Rattus norvegicus
cctttttgtcagttgggagtgtgtc

SEQ ID NO: 256608 - DNA, 25 bp, Rattus norvegicus
cgaaaagaccttccagtagtccaag

SEQ ID NO: 256609 - DNA, 25 bp, Rattus norvegicus
cgaaaagaccttgcagtagtccaag

SEQ ID NO: 256610 - DNA, 25 bp, Rattus norvegicus
cgaaaagcagggaccgtttgttcat

SEQ ID NO: 256611 - DNA, 25 bp, Rattus norvegicus
cgaaaagcagggtccgtttgttcat

SEQ ID NO: 256612 - DNA, 25 bp, Rattus norvegicus
cgaaaataagcgatctgtcacctcc

SEQ ID NO: 256613 - DNA, 25 bp, Rattus norvegicus
cgaaaataagcgttctgtcacctcc

SEQ ID NO: 256614 - DNA, 25 bp, Rattus norvegicus
cgaaaatgtttcagctagtcaaagc

SEQ ID NO: 256615 - DNA, 25 bp, Rattus norvegicus
cgaaaatgtttctgctagtcaaagc

SEQ ID NO: 256616 - DNA, 25 bp, Rattus norvegicus
cgaaacatggtgacgatcctttggc

SEQ ID NO: 256617 - DNA, 25 bp, Rattus norvegicus
cgaaacatggtgtcgatcctttggc

SEQ ID NO: 256618 - DNA, 25 bp, Rattus norvegicus
cgaaactcatttacagcagcgcaga

SEQ ID NO: 256619 - DNA, 25 bp, Rattus norvegicus
cgaaactcattttcagcagcgcaga

SEQ ID NO: 256620 - DNA, 25 bp, Rattus norvegicus
cgaaactccaggcaccagagctgtc

SEQ ID NO: 256621 - DNA, 25 bp, Rattus norvegicus
cgaaactccagggaccagagctgtc

SEQ ID NO: 256622 - DNA, 25 bp, Rattus norvegicus
cgaaactggacaccgccgtcaattg

SEQ ID NO: 256623 - DNA, 25 bp, Rattus norvegicus
cgaaactggacagcgccgtcaattg

SEQ ID NO: 256624 - DNA, 25 bp, Rattus norvegicus
cgaaacttaccaacgcataaagagt

SEQ ID NO: 256625 - DNA, 25 bp, Rattus norvegicus
cgaaacttaccatcgcataaagagt

SEQ ID NO: 256626 - DNA, 25 bp, Rattus norvegicus
cgaaagaccagccaactctcagact

SEQ ID NO: 256627 - DNA, 25 bp, Rattus norvegicus
cgaaagaccagcgaactctcagact

SEQ ID NO: 256628 - DNA, 25 bp, Rattus norvegicus
cgaaagccatccatccagagaggaa

SEQ ID NO: 256629 - DNA, 25 bp, Rattus norvegicus
cgaaagccatccttccagagaggaa

SEQ ID NO: 256630 - DNA, 25 bp, Rattus norvegicus
cgaaaggaacatctccttctataac

SEQ ID NO: 256631 - DNA, 25 bp, Rattus norvegicus
cgaaaggaacatgtccttctataac

SEQ ID NO: 256632 - DNA, 25 bp, Rattus norvegicus
cgaaagggcacaaccccaagctggg

SEQ ID NO: 256633 - DNA, 25 bp, Rattus norvegicus
cgaaagggcacatccccaagctggg

SEQ ID NO: 256634 - DNA, 25 bp, Rattus norvegicus
cgaaagtgcgatagaaagatgggat

SEQ ID NO: 256635 - DNA, 25 bp, Rattus norvegicus
cgaaagtgcgattgaaagatgggat

SEQ ID NO: 256636 - DNA, 25 bp, Rattus norvegicus
cgaaatcctggaccttgcggctaat

SEQ ID NO: 256637 - DNA, 25 bp, Rattus norvegicus
cgaaatcctggagcttgcggctaat

SEQ ID NO: 256638 - DNA, 25 bp, Rattus norvegicus
cgaaatctcgggatttcagcttgag

SEQ ID NO: 256639 - DNA, 25 bp, Rattus norvegicus
cgaaatctcgggttttcagcttgag

SEQ ID NO: 256640 - DNA, 25 bp, Rattus norvegicus
cgaaatctgcagagggcatcagatg

SEQ ID NO: 256641 - DNA, 25 bp, Rattus norvegicus
cgaaatctgcagtgggcatcagatg

SEQ ID NO: 256642 - DNA, 25 bp, Rattus norvegicus
cgaaatcttcagcatgtctcattgg

SEQ ID NO: 256643 - DNA, 25 bp, Rattus norvegicus
cgaaatcttcaggatgtctcattgg

SEQ ID NO: 256644 - DNA, 25 bp, Rattus norvegicus
cgaaatgtcggacaagtcaggccag

SEQ ID NO: 256645 - DNA, 25 bp, Rattus norvegicus
cgaaatgtcggagaagtcaggccag

SEQ ID NO: 256646 - DNA, 25 bp, Rattus norvegicus
cgaaattctgtactgggacgctgcc

SEQ ID NO: 256647 - DNA, 25 bp, Rattus norvegicus
cgaaattctgtagtgggacgctgcc

SEQ ID NO: 256648 - DNA, 25 bp, Rattus norvegicus
cgaacacctaaaccctcggtaactg

SEQ ID NO: 256649 - DNA, 25 bp, Rattus norvegicus
cgaacacctaaagcctcggtaactg

SEQ ID NO: 256650 - DNA, 25 bp, Rattus norvegicus
cgaacactagttaactctcttctca

SEQ ID NO: 256651 - DNA, 25 bp, Rattus norvegicus
cgaacactagtttactctcttctca

SEQ ID NO: 256652 - DNA, 25 bp, Rattus norvegicus
cgaacaggatggagcttcagccgat

SEQ ID NO: 256653 - DNA, 25 bp, Rattus norvegicus
cgaacaggatggtgcttcagccgat

SEQ ID NO: 256654 - DNA, 25 bp, Rattus norvegicus
cgaacatgttgcataccgcaccatt

SEQ ID NO: 256655 - DNA, 25 bp, Rattus norvegicus
cgaacatgttgcttaccgcaccatt

SEQ ID NO: 256656 - DNA, 25 bp, Rattus norvegicus
cgaaccaatgcgatggtgccatcag

SEQ ID NO: 256657 - DNA, 25 bp, Rattus norvegicus
cgaaccaatgcgttggtgccatcag

SEQ ID NO: 256658 - DNA, 25 bp, Rattus norvegicus
cgaaccacgcggcagagtcaataat

SEQ ID NO: 256659 - DNA, 25 bp, Rattus norvegicus
cgaaccacgcgggagagtcaataat

SEQ ID NO: 256660 - DNA, 25 bp, Rattus norvegicus
cgaacccaggtgcaactgtgttcaa

SEQ ID NO: 256661 - DNA, 25 bp, Rattus norvegicus
cgaacccaggtggaactgtgttcaa

SEQ ID NO: 256662 - DNA, 25 bp, Rattus norvegicus
cgaacccatgggcactagagaaaat

SEQ ID NO: 256663 - DNA, 25 bp, Rattus norvegicus
cgaacccatggggactagagaaaat

SEQ ID NO: 256664 - DNA, 25 bp, Rattus norvegicus
cgaaccccggtaagtggtgtccatg

SEQ ID NO: 256665 - DNA, 25 bp, Rattus norvegicus
cgaaccccggtatgtggtgtccatg

SEQ ID NO: 256666 - DNA, 25 bp, Rattus norvegicus
cgaaccctaacgactgaactgagaa

SEQ ID NO: 256667 - DNA, 25 bp, Rattus norvegicus
cgaaccctaacgtctgaactgagaa

SEQ ID NO: 256668 - DNA, 25 bp, Rattus norvegicus
cgaacctctttaatttccttgctag

SEQ ID NO: 256669 - DNA, 25 bp, Rattus norvegicus
cgaacctctttattttccttgctag

SEQ ID NO: 256670 - DNA, 25 bp, Rattus norvegicus
cgaacctgagttcgccgaagcaaga

SEQ ID NO: 256671 - DNA, 25 bp, Rattus norvegicus
cgaacctgagttggccgaagcaaga

SEQ ID NO: 256672 - DNA, 25 bp, Rattus norvegicus
cgaaccttctggaagcggagtccca

SEQ ID NO: 256673 - DNA, 25 bp, Rattus norvegicus
cgaaccttctggtagcggagtccca

SEQ ID NO: 256674 - DNA, 25 bp, Rattus norvegicus
cgaacggttggcaggaggactctaa

SEQ ID NO: 256675 - DNA, 25 bp, Rattus norvegicus
cgaacggttggctggaggactctaa

SEQ ID NO: 256676 - DNA, 25 bp, Rattus norvegicus
cgaacgtcttacatcccagaggaga

SEQ ID NO: 256677 - DNA, 25 bp, Rattus norvegicus
cgaacgtcttacttcccagaggaga

SEQ ID NO: 256678 - DNA, 25 bp, Rattus norvegicus
cgaactaaacgcacgggcagcttct

SEQ ID NO: 256679 - DNA, 25 bp, Rattus norvegicus
cgaactaaacgctcgggcagcttct

SEQ ID NO: 256680 - DNA, 25 bp, Rattus norvegicus
cgaactactttaagccccaagacaa

SEQ ID NO: 256681 - DNA, 25 bp, Rattus norvegicus
cgaactactttatgccccaagacaa

SEQ ID NO: 256682 - DNA, 25 bp, Rattus norvegicus
cgaactatgttcctagtcctctgaa

SEQ ID NO: 256683 - DNA, 25 bp, Rattus norvegicus
cgaactatgttcgtagtcctctgaa

SEQ ID NO: 256684 - DNA, 25 bp, Rattus norvegicus
cgaactcctgaactgtctggcttgt

SEQ ID NO: 256685 - DNA, 25 bp, Rattus norvegicus
cgaactcctgaagtgtctggcttgt

SEQ ID NO: 256686 - DNA, 25 bp, Rattus norvegicus
cgaactcgacttactgtataactgt

SEQ ID NO: 256687 - DNA, 25 bp, Rattus norvegicus
cgaactcgactttctgtataactgt

SEQ ID NO: 256688 - DNA, 25 bp, Rattus norvegicus
cgaactctactcatactgtgcaata

SEQ ID NO: 256689 - DNA, 25 bp, Rattus norvegicus
cgaactctactcttactgtgcaata

SEQ ID NO: 256690 - DNA, 25 bp, Rattus norvegicus
cgaactgagagtcccgtttctggat

SEQ ID NO: 256691 - DNA, 25 bp, Rattus norvegicus
cgaactgagagtgccgtttctggat

SEQ ID NO: 256692 - DNA, 25 bp, Rattus norvegicus
cgaactgcacggacagggcggattt

SEQ ID NO: 256693 - DNA, 25 bp, Rattus norvegicus
cgaactgcacggtcagggcggattt

SEQ ID NO: 256694 - DNA, 25 bp, Rattus norvegicus
cgaactgctgcaccttccaggaaag

SEQ ID NO: 256695 - DNA, 25 bp, Rattus norvegicus
cgaactgctgcagcttccaggaaag

SEQ ID NO: 256696 - DNA, 25 bp, Rattus norvegicus
cgaactgtagcgaagctgtctgtat

SEQ ID NO: 256697 - DNA, 25 bp, Rattus norvegicus
cgaactgtagcgtagctgtctgtat

SEQ ID NO: 256698 - DNA, 25 bp, Rattus norvegicus
cgaactgtttgcagtgatggcctgt

SEQ ID NO: 256699 - DNA, 25 bp, Rattus norvegicus
cgaactgtttgctgtgatggcctgt

SEQ ID NO: 256700 - DNA, 25 bp, Rattus norvegicus
cgaacttaacaccagcttttccacg

SEQ ID NO: 256701 - DNA, 25 bp, Rattus norvegicus
cgaacttaacacgagcttttccacg

SEQ ID NO: 256702 - DNA, 25 bp, Rattus norvegicus
cgaacttctgctcctattctgagaa

SEQ ID NO: 256703 - DNA, 25 bp, Rattus norvegicus
cgaacttctgctgctattctgagaa

SEQ ID NO: 256704 - DNA, 25 bp, Rattus norvegicus
cgaactttccttctctgtggtagag

SEQ ID NO: 256705 - DNA, 25 bp, Rattus norvegicus
cgaactttccttgtctgtggtagag

SEQ ID NO: 256706 - DNA, 25 bp, Rattus norvegicus
cgaagaacatccagcaaccagctga

SEQ ID NO: 256707 - DNA, 25 bp, Rattus norvegicus
cgaagaacatcctgcaaccagctga

SEQ ID NO: 256708 - DNA, 25 bp, Rattus norvegicus
cgaagaaggcccagagcgcctgcga

SEQ ID NO: 256709 - DNA, 25 bp, Rattus norvegicus
cgaagaaggccctgagcgcctgcga

SEQ ID NO: 256710 - DNA, 25 bp, Rattus norvegicus
cgaagaagggcgacccgatagccga

SEQ ID NO: 256711 - DNA, 25 bp, Rattus norvegicus
cgaagaagggcgtcccgatagccga

SEQ ID NO: 256712 - DNA, 25 bp, Rattus norvegicus
cgaagaatgttcaccccagggatta

SEQ ID NO: 256713 - DNA, 25 bp, Rattus norvegicus
cgaagaatgttctccccagggatta

SEQ ID NO: 256714 - DNA, 25 bp, Rattus norvegicus
cgaagacacagaccccagcagcagt

SEQ ID NO: 256715 - DNA, 25 bp, Rattus norvegicus
cgaagacacagagcccagcagcagt

SEQ ID NO: 256716 - DNA, 25 bp, Rattus norvegicus
cgaagacctttgcttgtgaatcaga

SEQ ID NO: 256717 - DNA, 25 bp, Rattus norvegicus
cgaagacctttggttgtgaatcaga

SEQ ID NO: 256718 - DNA, 25 bp, Rattus norvegicus
cgaagacgttcgaaatgggttcctg

SEQ ID NO: 256719 - DNA, 25 bp, Rattus norvegicus
cgaagacgttcgtaatgggttcctg

SEQ ID NO: 256720 - DNA, 25 bp, Rattus norvegicus
cgaagactgcaccagccctgctggg

SEQ ID NO: 256721 - DNA, 25 bp, Rattus norvegicus
cgaagactgcacgagccctgctggg

SEQ ID NO: 256722 - DNA, 25 bp, Rattus norvegicus
cgaagactggtcctactctactggg

SEQ ID NO: 256723 - DNA, 25 bp, Rattus norvegicus
cgaagactggtcgtactctactggg

SEQ ID NO: 256724 - DNA, 25 bp, Rattus norvegicus
cgaagagactctactcaaaataccc

SEQ ID NO: 256725 - DNA, 25 bp, Rattus norvegicus
cgaagagactcttctcaaaataccc

SEQ ID NO: 256726 - DNA, 25 bp, Rattus norvegicus
cgaagagcacttaaaaatgttgatc

SEQ ID NO: 256727 - DNA, 25 bp, Rattus norvegicus
cgaagagcactttaaaatgttgatc

SEQ ID NO: 256728 - DNA, 25 bp, Rattus norvegicus
cgaagagcccatcgccttcttggcg

SEQ ID NO: 256729 - DNA, 25 bp, Rattus norvegicus
cgaagagcccatggccttcttggcg

SEQ ID NO: 256730 - DNA, 25 bp, Rattus norvegicus
cgaagagctgcaatcggacagggat

SEQ ID NO: 256731 - DNA, 25 bp, Rattus norvegicus
cgaagagctgcattcggacagggat

SEQ ID NO: 256732 - DNA, 25 bp, Rattus norvegicus
cgaagaggaagccattgttcgcatg

SEQ ID NO: 256733 - DNA, 25 bp, Rattus norvegicus
cgaagaggaagcgattgttcgcatg

SEQ ID NO: 256734 - DNA, 25 bp, Rattus norvegicus
cgaagagtggttcatatggtacccc

SEQ ID NO: 256735 - DNA, 25 bp, Rattus norvegicus
cgaagagtggttgatatggtacccc

SEQ ID NO: 256736 - DNA, 25 bp, Rattus norvegicus
cgaagatgatgaccgatcctctcct

SEQ ID NO: 256737 - DNA, 25 bp, Rattus norvegicus
cgaagatgatgagcgatcctctcct

SEQ ID NO: 256738 - DNA, 25 bp, Rattus norvegicus
cgaagattcgtaaggctgcccggga

SEQ ID NO: 256739 - DNA, 25 bp, Rattus norvegicus
cgaagattcgtatggctgcccggga

SEQ ID NO: 256740 - DNA, 25 bp, Rattus norvegicus
cgaagcattcagcaagtggtggcaa

SEQ ID NO: 256741 - DNA, 25 bp, Rattus norvegicus
cgaagcattcaggaagtggtggcaa

SEQ ID NO: 256742 - DNA, 25 bp, Rattus norvegicus
cgaagccaaagccaaggccttgaaa

SEQ ID NO: 256743 - DNA, 25 bp, Rattus norvegicus
cgaagccaaagcgaaggccttgaaa

SEQ ID NO: 256744 - DNA, 25 bp, Rattus norvegicus
cgaagccaaggcaccagtgggctga

SEQ ID NO: 256745 - DNA, 25 bp, Rattus norvegicus
cgaagccaaggctccagtgggctga

SEQ ID NO: 256746 - DNA, 25 bp, Rattus norvegicus
cgaagccccattatgctgggtgata

SEQ ID NO: 256747 - DNA, 25 bp, Rattus norvegicus
cgaagccccattttgctgggtgata

SEQ ID NO: 256748 - DNA, 25 bp, Rattus norvegicus
cgaagcccctgtaagcatcttgtgg

SEQ ID NO: 256749 - DNA, 25 bp, Rattus norvegicus
cgaagcccctgttagcatcttgtgg

SEQ ID NO: 256750 - DNA, 25 bp, Rattus norvegicus
cgaagcctcagtatgagcgtctgta

SEQ ID NO: 256751 - DNA, 25 bp, Rattus norvegicus
cgaagcctcagtttgagcgtctgta

SEQ ID NO: 256752 - DNA, 25 bp, Rattus norvegicus
cgaagcgtgagcattctgagcaagg

SEQ ID NO: 256753 - DNA, 25 bp, Rattus norvegicus
cgaagcgtgagctttctgagcaagg

SEQ ID NO: 256754 - DNA, 25 bp, Rattus norvegicus
cgaagctcgggcatgatctctgagc

SEQ ID NO: 256755 - DNA, 25 bp, Rattus norvegicus
cgaagctcgggcttgatctctgagc

SEQ ID NO: 256756 - DNA, 25 bp, Rattus norvegicus
cgaagctcgtaactgcacatgggac

SEQ ID NO: 256757 - DNA, 25 bp, Rattus norvegicus
cgaagctcgtaagtgcacatgggac

SEQ ID NO: 256758 - DNA, 25 bp, Rattus norvegicus
cgaagctgtaacacctctcctaaac

SEQ ID NO: 256759 - DNA, 25 bp, Rattus norvegicus
cgaagctgtaactcctctcctaaac

SEQ ID NO: 256760 - DNA, 25 bp, Rattus norvegicus
cgaaggactcggactgcctggccag

SEQ ID NO: 256761 - DNA, 25 bp, Rattus norvegicus
cgaaggactcggtctgcctggccag

SEQ ID NO: 256762 - DNA, 25 bp, Rattus norvegicus
cgaaggagcactatccaggcacatt

SEQ ID NO: 256763 - DNA, 25 bp, Rattus norvegicus
cgaaggagcactttccaggcacatt

SEQ ID NO: 256764 - DNA, 25 bp, Rattus norvegicus
cgaaggcacccactggtcagtgctt

SEQ ID NO: 256765 - DNA, 25 bp, Rattus norvegicus
cgaaggcacccagtggtcagtgctt

SEQ ID NO: 256766 - DNA, 25 bp, Rattus norvegicus
cgaaggcataaacaccgcgtggcag

SEQ ID NO: 256767 - DNA, 25 bp, Rattus norvegicus
cgaaggcataaagaccgcgtggcag

SEQ ID NO: 256768 - DNA, 25 bp, Rattus norvegicus
cgaaggcgagaacggctgaggccct

SEQ ID NO: 256769 - DNA, 25 bp, Rattus norvegicus
cgaaggcgagaagggctgaggccct

SEQ ID NO: 256770 - DNA, 25 bp, Rattus norvegicus
cgaaggctggctatggctgccaaaa

SEQ ID NO: 256771 - DNA, 25 bp, Rattus norvegicus
cgaaggctggctttggctgccaaaa

SEQ ID NO: 256772 - DNA, 25 bp, Rattus norvegicus
cgaagggcagctacccggaaaggca

SEQ ID NO: 256773 - DNA, 25 bp, Rattus norvegicus
cgaagggcagcttcccggaaaggca

SEQ ID NO: 256774 - DNA, 25 bp, Rattus norvegicus
cgaagggctgtcaccggaatctaga

SEQ ID NO: 256775 - DNA, 25 bp, Rattus norvegicus
cgaagggctgtctccggaatctaga

SEQ ID NO: 256776 - DNA, 25 bp, Rattus norvegicus
cgaaggtcctggattcaactctcag

SEQ ID NO: 256777 - DNA, 25 bp, Rattus norvegicus
cgaaggtcctggtttcaactctcag

SEQ ID NO: 256778 - DNA, 25 bp, Rattus norvegicus
cgaaggtgccagatgctgctcagca

SEQ ID NO: 256779 - DNA, 25 bp, Rattus norvegicus
cgaaggtgccagttgctgctcagca

SEQ ID NO: 256780 - DNA, 25 bp, Rattus norvegicus
cgaaggtggccaagtcggacatacc

SEQ ID NO: 256781 - DNA, 25 bp, Rattus norvegicus
cgaaggtggccatgtcggacatacc

SEQ ID NO: 256782 - DNA, 25 bp, Rattus norvegicus
cgaaggttctgcaggagacttcccc

SEQ ID NO: 256783 - DNA, 25 bp, Rattus norvegicus
cgaaggttctgctggagacttcccc

SEQ ID NO: 256784 - DNA, 25 bp, Rattus norvegicus
cgaagtagctctctcttaaaactgt

SEQ ID NO: 256785 - DNA, 25 bp, Rattus norvegicus
cgaagtagctctgtcttaaaactgt

SEQ ID NO: 256786 - DNA, 25 bp, Rattus norvegicus
cgaagtattcgactacaggagcatt

SEQ ID NO: 256787 - DNA, 25 bp, Rattus norvegicus
cgaagtattcgagtacaggagcatt

SEQ ID NO: 256788 - DNA, 25 bp, Rattus norvegicus
cgaagtccatacactatgcatgaat

SEQ ID NO: 256789 - DNA, 25 bp, Rattus norvegicus
cgaagtccatactctatgcatgaat

SEQ ID NO: 256790 - DNA, 25 bp, Rattus norvegicus
cgaagtctacaactcaatggttttt

SEQ ID NO: 256791 - DNA, 25 bp, Rattus norvegicus
cgaagtctacaagtcaatggttttt

SEQ ID NO: 256792 - DNA, 25 bp, Rattus norvegicus
cgaagtcttgtgaacctggttggca

SEQ ID NO: 256793 - DNA, 25 bp, Rattus norvegicus
cgaagtcttgtgtacctggttggca

SEQ ID NO: 256794 - DNA, 25 bp, Rattus norvegicus
cgaagtgacgcacgccaacggcaag

SEQ ID NO: 256795 - DNA, 25 bp, Rattus norvegicus
cgaagtgacgcaggccaacggcaag

SEQ ID NO: 256796 - DNA, 25 bp, Rattus norvegicus
cgaagtgccccaagtgcgacaagga

SEQ ID NO: 256797 - DNA, 25 bp, Rattus norvegicus
cgaagtgccccatgtgcgacaagga

SEQ ID NO: 256798 - DNA, 25 bp, Rattus norvegicus
cgaagtgcttgcagcatatgcgtgg

SEQ ID NO: 256799 - DNA, 25 bp, Rattus norvegicus
cgaagtgcttgctgcatatgcgtgg

SEQ ID NO: 256800 - DNA, 25 bp, Rattus norvegicus
cgaagtggtcacactcagccttggg

SEQ ID NO: 256801 - DNA, 25 bp, Rattus norvegicus
cgaagtggtcactctcagccttggg

SEQ ID NO: 256802 - DNA, 25 bp, Rattus norvegicus
cgaagtggtggcaacggaggagacc

SEQ ID NO: 256803 - DNA, 25 bp, Rattus norvegicus
cgaagtggtggctacggaggagacc

SEQ ID NO: 256804 - DNA, 25 bp, Rattus norvegicus
cgaagtgttcctcgtttgtgtctgt

SEQ ID NO: 256805 - DNA, 25 bp, Rattus norvegicus
cgaagtgttcctggtttgtgtctgt

SEQ ID NO: 256806 - DNA, 25 bp, Rattus norvegicus
cgaagttcaggtatccatggggaat

SEQ ID NO: 256807 - DNA, 25 bp, Rattus norvegicus
cgaagttcaggtttccatggggaat

SEQ ID NO: 256808 - DNA, 25 bp, Rattus norvegicus
cgaagttgcaacagacaaaggcgga

SEQ ID NO: 256809 - DNA, 25 bp, Rattus norvegicus
cgaagttgcaactgacaaaggcgga

SEQ ID NO: 256810 - DNA, 25 bp, Rattus norvegicus
cgaagttgcctacttctgattcctt

SEQ ID NO: 256811 - DNA, 25 bp, Rattus norvegicus
cgaagttgcctagttctgattcctt

SEQ ID NO: 256812 - DNA, 25 bp, Rattus norvegicus
cgaatatgagaaagtcctgagggta

SEQ ID NO: 256813 - DNA, 25 bp, Rattus norvegicus
cgaatatgagaatgtcctgagggta

SEQ ID NO: 256814 - DNA, 25 bp, Rattus norvegicus
cgaatatggctacagtcaccgggta

SEQ ID NO: 256815 - DNA, 25 bp, Rattus norvegicus
cgaatatggctagagtcaccgggta

SEQ ID NO: 256816 - DNA, 25 bp, Rattus norvegicus
cgaatcagtgccatccattgctgtt

SEQ ID NO: 256817 - DNA, 25 bp, Rattus norvegicus
cgaatcagtgccttccattgctgtt

SEQ ID NO: 256818 - DNA, 25 bp, Rattus norvegicus
cgaatccacggacttttcagtcact

SEQ ID NO: 256819 - DNA, 25 bp, Rattus norvegicus
cgaatccacggagttttcagtcact

SEQ ID NO: 256820 - DNA, 25 bp, Rattus norvegicus
cgaatccattcaactatctatccac

SEQ ID NO: 256821 - DNA, 25 bp, Rattus norvegicus
cgaatccattcatctatctatccac

SEQ ID NO: 256822 - DNA, 25 bp, Rattus norvegicus
cgaatcgaggctctggcccgaagca

SEQ ID NO: 256823 - DNA, 25 bp, Rattus norvegicus
cgaatcgaggctgtggcccgaagca

SEQ ID NO: 256824 - DNA, 25 bp, Rattus norvegicus
cgaatcgccttcacgggttggacaa

SEQ ID NO: 256825 - DNA, 25 bp, Rattus norvegicus
cgaatcgccttctcgggttggacaa

SEQ ID NO: 256826 - DNA, 25 bp, Rattus norvegicus
cgaatcgctttgcatggtctcatga

SEQ ID NO: 256827 - DNA, 25 bp, Rattus norvegicus
cgaatcgctttggatggtctcatga

SEQ ID NO: 256828 - DNA, 25 bp, Rattus norvegicus
cgaatctggtcgagtgtgtacttgt

SEQ ID NO: 256829 - DNA, 25 bp, Rattus norvegicus
cgaatctggtcgtgtgtgtacttgt

SEQ ID NO: 256830 - DNA, 25 bp, Rattus norvegicus
cgaatcttccttctcccatataata

SEQ ID NO: 256831 - DNA, 25 bp, Rattus norvegicus
cgaatcttccttgtcccatataata

SEQ ID NO: 256832 - DNA, 25 bp, Rattus norvegicus
cgaatgaacttgacttctgagtccc

SEQ ID NO: 256833 - DNA, 25 bp, Rattus norvegicus
cgaatgaacttgtcttctgagtccc

SEQ ID NO: 256834 - DNA, 25 bp, Rattus norvegicus
cgaatgatgactcacgcgggtctgc

SEQ ID NO: 256835 - DNA, 25 bp, Rattus norvegicus
cgaatgatgactgacgcgggtctgc

SEQ ID NO: 256836 - DNA, 25 bp, Rattus norvegicus
cgaatgcaagaaacttcctggcact

SEQ ID NO: 256837 - DNA, 25 bp, Rattus norvegicus
cgaatgcaagaatcttcctggcact

SEQ ID NO: 256838 - DNA, 25 bp, Rattus norvegicus
cgaatggctgaaatatgctggatcc

SEQ ID NO: 256839 - DNA, 25 bp, Rattus norvegicus
cgaatggctgaattatgctggatcc

SEQ ID NO: 256840 - DNA, 25 bp, Rattus norvegicus
cgaatgggctctagcagaccccagt

SEQ ID NO: 256841 - DNA, 25 bp, Rattus norvegicus
cgaatgggctcttgcagaccccagt

SEQ ID NO: 256842 - DNA, 25 bp, Rattus norvegicus
cgaattatactcagttatgactaac

SEQ ID NO: 256843 - DNA, 25 bp, Rattus norvegicus
cgaattatactctgttatgactaac

SEQ ID NO: 256844 - DNA, 25 bp, Rattus norvegicus
cgaattatgactctggttgacccca

SEQ ID NO: 256845 - DNA, 25 bp, Rattus norvegicus
cgaattatgactgtggttgacccca

SEQ ID NO: 256846 - DNA, 25 bp, Rattus norvegicus
cgaattcaagttctctcatgagtga

SEQ ID NO: 256847 - DNA, 25 bp, Rattus norvegicus
cgaattcaagttgtctcatgagtga

SEQ ID NO: 256848 - DNA, 25 bp, Rattus norvegicus
cgaattccagaaagtttccccagag

SEQ ID NO: 256849 - DNA, 25 bp, Rattus norvegicus
cgaattccagaatgtttccccagag

SEQ ID NO: 256850 - DNA, 25 bp, Rattus norvegicus
cgaattctagggagactgatggttt

SEQ ID NO: 256851 - DNA, 25 bp, Rattus norvegicus
cgaattctagggtgactgatggttt

SEQ ID NO: 256852 - DNA, 25 bp, Rattus norvegicus
cgaattctccatatgttcaacaggg

SEQ ID NO: 256853 - DNA, 25 bp, Rattus norvegicus
cgaattctccatttgttcaacaggg

SEQ ID NO: 256854 - DNA, 25 bp, Rattus norvegicus
cgaattgctgccatgcttgtaggga

SEQ ID NO: 256855 - DNA, 25 bp, Rattus norvegicus
cgaattgctgccttgcttgtaggga

SEQ ID NO: 256856 - DNA, 25 bp, Rattus norvegicus
cgaattgttaccatttagctctgaa

SEQ ID NO: 256857 - DNA, 25 bp, Rattus norvegicus
cgaattgttaccttttagctctgaa

SEQ ID NO: 256858 - DNA, 25 bp, Rattus norvegicus
cgaatttccattcagtgccttgtga

SEQ ID NO: 256859 - DNA, 25 bp, Rattus norvegicus
cgaatttccattgagtgccttgtga

SEQ ID NO: 256860 - DNA, 25 bp, Rattus norvegicus
cgaatttgtcaccacaagggaacct

SEQ ID NO: 256861 - DNA, 25 bp, Rattus norvegicus
cgaatttgtcacgacaagggaacct

SEQ ID NO: 256862 - DNA, 25 bp, Rattus norvegicus
cgacaacgggtccgccatgtgcaag

SEQ ID NO: 256863 - DNA, 25 bp, Rattus norvegicus
cgacaacgggtcggccatgtgcaag

SEQ ID NO: 256864 - DNA, 25 bp, Rattus norvegicus
cgacaaggactcacagtgtggagga

SEQ ID NO: 256865 - DNA, 25 bp, Rattus norvegicus
cgacaaggactctcagtgtggagga

SEQ ID NO: 256866 - DNA, 25 bp, Rattus norvegicus
cgacaaggctgtcagtattcttcct

SEQ ID NO: 256867 - DNA, 25 bp, Rattus norvegicus
cgacaaggctgtgagtattcttcct

SEQ ID NO: 256868 - DNA, 25 bp, Rattus norvegicus
cgacaagtcagacccgaaccttaat

SEQ ID NO: 256869 - DNA, 25 bp, Rattus norvegicus
cgacaagtcagagccgaaccttaat

SEQ ID NO: 256870 - DNA, 25 bp, Rattus norvegicus
cgacacagactgatgggcaggccat

SEQ ID NO: 256871 - DNA, 25 bp, Rattus norvegicus
cgacacagactgttgggcaggccat

SEQ ID NO: 256872 - DNA, 25 bp, Rattus norvegicus
cgacaccaaactctccaaaatcaag

SEQ ID NO: 256873 - DNA, 25 bp, Rattus norvegicus
cgacaccaaactgtccaaaatcaag

SEQ ID NO: 256874 - DNA, 25 bp, Rattus norvegicus
cgacacccagacagtggagctgcca

SEQ ID NO: 256875 - DNA, 25 bp, Rattus norvegicus
cgacacccagactgtggagctgcca

SEQ ID NO: 256876 - DNA, 25 bp, Rattus norvegicus
cgacactggtctcggaggactcgaa

SEQ ID NO: 256877 - DNA, 25 bp, Rattus norvegicus
cgacactggtctgggaggactcgaa

SEQ ID NO: 256878 - DNA, 25 bp, Rattus norvegicus
cgacagcccggactagacgtttggc

SEQ ID NO: 256879 - DNA, 25 bp, Rattus norvegicus
cgacagcccggagtagacgtttggc

SEQ ID NO: 256880 - DNA, 25 bp, Rattus norvegicus
cgacagctaccaccagggactgtag

SEQ ID NO: 256881 - DNA, 25 bp, Rattus norvegicus
cgacagctaccagcagggactgtag

SEQ ID NO: 256882 - DNA, 25 bp, Rattus norvegicus
cgacagctccagcttctggacaata

SEQ ID NO: 256883 - DNA, 25 bp, Rattus norvegicus
cgacagctccaggttctggacaata

SEQ ID NO: 256884 - DNA, 25 bp, Rattus norvegicus
cgacaggacactcgaccaactttgt

SEQ ID NO: 256885 - DNA, 25 bp, Rattus norvegicus
cgacaggacactggaccaactttgt

SEQ ID NO: 256886 - DNA, 25 bp, Rattus norvegicus
cgacaggccttccatgtaacatgtg

SEQ ID NO: 256887 - DNA, 25 bp, Rattus norvegicus
cgacaggccttcgatgtaacatgtg

SEQ ID NO: 256888 - DNA, 25 bp, Rattus norvegicus
cgacaggtctgtatcacatcctatg

SEQ ID NO: 256889 - DNA, 25 bp, Rattus norvegicus
cgacaggtctgtttcacatcctatg

SEQ ID NO: 256890 - DNA, 25 bp, Rattus norvegicus
cgacagtaggtgagtccctgctcta

SEQ ID NO: 256891 - DNA, 25 bp, Rattus norvegicus
cgacagtaggtgtgtccctgctcta

SEQ ID NO: 256892 - DNA, 25 bp, Rattus norvegicus
cgacagtcaagaccctatcgcctgg

SEQ ID NO: 256893 - DNA, 25 bp, Rattus norvegicus
cgacagtcaagagcctatcgcctgg

SEQ ID NO: 256894 - DNA, 25 bp, Rattus norvegicus
cgacagtcatgtcgtgtccctcgtg

SEQ ID NO: 256895 - DNA, 25 bp, Rattus norvegicus
cgacagtcatgtggtgtccctcgtg

SEQ ID NO: 256896 - DNA, 25 bp, Rattus norvegicus
cgacagtcttgcacagtttacacag

SEQ ID NO: 256897 - DNA, 25 bp, Rattus norvegicus
cgacagtcttgctcagtttacacag

SEQ ID NO: 256898 - DNA, 25 bp, Rattus norvegicus
cgacagtgtcggcatcaacagaaaa

SEQ ID NO: 256899 - DNA, 25 bp, Rattus norvegicus
cgacagtgtcgggatcaacagaaaa

SEQ ID NO: 256900 - DNA, 25 bp, Rattus norvegicus
cgacatcagtgtcacagaccctgaa

SEQ ID NO: 256901 - DNA, 25 bp, Rattus norvegicus
cgacatcagtgtgacagaccctgaa

SEQ ID NO: 256902 - DNA, 25 bp, Rattus norvegicus
cgacatcgtgatccgggccaaagtg

SEQ ID NO: 256903 - DNA, 25 bp, Rattus norvegicus
cgacatcgtgatgcgggccaaagtg

SEQ ID NO: 256904 - DNA, 25 bp, Rattus norvegicus
cgacatcttcatccgtgaggagcta

SEQ ID NO: 256905 - DNA, 25 bp, Rattus norvegicus
cgacatcttcatgcgtgaggagcta

SEQ ID NO: 256906 - DNA, 25 bp, Rattus norvegicus
cgacatgatgctccggcagtttctt

SEQ ID NO: 256907 - DNA, 25 bp, Rattus norvegicus
cgacatgatgctgcggcagtttctt

SEQ ID NO: 256908 - DNA, 25 bp, Rattus norvegicus
cgacatgattttatggttccaacct

SEQ ID NO: 256909 - DNA, 25 bp, Rattus norvegicus
cgacatgattttttggttccaacct

SEQ ID NO: 256910 - DNA, 25 bp, Rattus norvegicus
cgacatgggttacaaagtcttggaa

SEQ ID NO: 256911 - DNA, 25 bp, Rattus norvegicus
cgacatgggttagaaagtcttggaa

SEQ ID NO: 256912 - DNA, 25 bp, Rattus norvegicus
cgacattcttgtctctgctttagaa

SEQ ID NO: 256913 - DNA, 25 bp, Rattus norvegicus
cgacattcttgtgtctgctttagaa

SEQ ID NO: 256914 - DNA, 25 bp, Rattus norvegicus
cgaccaccctttcattttcatgata

SEQ ID NO: 256915 - DNA, 25 bp, Rattus norvegicus
cgaccaccctttgattttcatgata

SEQ ID NO: 256916 - DNA, 25 bp, Rattus norvegicus
cgaccagactatcccatctcgtgga

SEQ ID NO: 256917 - DNA, 25 bp, Rattus norvegicus
cgaccagactatgccatctcgtgga

SEQ ID NO: 256918 - DNA, 25 bp, Rattus norvegicus
cgaccaggtcagagttttaatctaa

SEQ ID NO: 256919 - DNA, 25 bp, Rattus norvegicus
cgaccaggtcagtgttttaatctaa

SEQ ID NO: 256920 - DNA, 25 bp, Rattus norvegicus
cgaccatgtcggaggtgctgcccta

SEQ ID NO: 256921 - DNA, 25 bp, Rattus norvegicus
cgaccatgtcggtggtgctgcccta

SEQ ID NO: 256922 - DNA, 25 bp, Rattus norvegicus
cgacccagaggaccgtggccaagca

SEQ ID NO: 256923 - DNA, 25 bp, Rattus norvegicus
cgacccagaggagcgtggccaagca

SEQ ID NO: 256924 - DNA, 25 bp, Rattus norvegicus
cgacccatccttcagagagcaaaat

SEQ ID NO: 256925 - DNA, 25 bp, Rattus norvegicus
cgacccatccttgagagagcaaaat

SEQ ID NO: 256926 - DNA, 25 bp, Rattus norvegicus
cgacccattcacatcataaaacatc

SEQ ID NO: 256927 - DNA, 25 bp, Rattus norvegicus
cgacccattcacttcataaaacatc

SEQ ID NO: 256928 - DNA, 25 bp, Rattus norvegicus
cgaccccacttcattaagctgagta

SEQ ID NO: 256929 - DNA, 25 bp, Rattus norvegicus
cgaccccacttctttaagctgagta

SEQ ID NO: 256930 - DNA, 25 bp, Rattus norvegicus
cgaccccgaggaagctgaagggcct

SEQ ID NO: 256931 - DNA, 25 bp, Rattus norvegicus
cgaccccgaggatgctgaagggcct

SEQ ID NO: 256932 - DNA, 25 bp, Rattus norvegicus
cgaccccggcgcacggtaactggag

SEQ ID NO: 256933 - DNA, 25 bp, Rattus norvegicus
cgaccccggcgctcggtaactggag

SEQ ID NO: 256934 - DNA, 25 bp, Rattus norvegicus
cgacccctcaggaggctggagttaa

SEQ ID NO: 256935 - DNA, 25 bp, Rattus norvegicus
cgacccctcaggtggctggagttaa

SEQ ID NO: 256936 - DNA, 25 bp, Rattus norvegicus
cgacccctttgtctgaggccaggct

SEQ ID NO: 256937 - DNA, 25 bp, Rattus norvegicus
cgacccctttgtgtgaggccaggct

SEQ ID NO: 256938 - DNA, 25 bp, Rattus norvegicus
cgacccgggaagagcagcgaccaac

SEQ ID NO: 256939 - DNA, 25 bp, Rattus norvegicus
cgacccgggaagtgcagcgaccaac

SEQ ID NO: 256940 - DNA, 25 bp, Rattus norvegicus
cgacccgtggcaatgtgctcgaaaa

SEQ ID NO: 256941 - DNA, 25 bp, Rattus norvegicus
cgacccgtggcattgtgctcgaaaa

SEQ ID NO: 256942 - DNA, 25 bp, Rattus norvegicus
cgaccctgggaacactttatttgct

SEQ ID NO: 256943 - DNA, 25 bp, Rattus norvegicus
cgaccctgggaagactttatttgct

SEQ ID NO: 256944 - DNA, 25 bp, Rattus norvegicus
cgaccctgtgcacctttgaagagat

SEQ ID NO: 256945 - DNA, 25 bp, Rattus norvegicus
cgaccctgtgcagctttgaagagat

SEQ ID NO: 256946 - DNA, 25 bp, Rattus norvegicus
cgaccggagacaaagcttttcacat

SEQ ID NO: 256947 - DNA, 25 bp, Rattus norvegicus
cgaccggagacatagcttttcacat

SEQ ID NO: 256948 - DNA, 25 bp, Rattus norvegicus
cgacctagacagagacttttggaat

SEQ ID NO: 256949 - DNA, 25 bp, Rattus norvegicus
cgacctagacagtgacttttggaat

SEQ ID NO: 256950 - DNA, 25 bp, Rattus norvegicus
cgacctagtgttctttcctggatca

SEQ ID NO: 256951 - DNA, 25 bp, Rattus norvegicus
cgacctagtgttgtttcctggatca

SEQ ID NO: 256952 - DNA, 25 bp, Rattus norvegicus
cgacctcccggaatgggcagattta

SEQ ID NO: 256953 - DNA, 25 bp, Rattus norvegicus
cgacctcccggattgggcagattta

SEQ ID NO: 256954 - DNA, 25 bp, Rattus norvegicus
cgacctcttcaacagcaatcacaaa

SEQ ID NO: 256955 - DNA, 25 bp, Rattus norvegicus
cgacctcttcaagagcaatcacaaa

SEQ ID NO: 256956 - DNA, 25 bp, Rattus norvegicus
cgacctgcggcacaagattcttctt

SEQ ID NO: 256957 - DNA, 25 bp, Rattus norvegicus
cgacctgcggcagaagattcttctt

SEQ ID NO: 256958 - DNA, 25 bp, Rattus norvegicus
cgacctggatatatagtgaccttaa

SEQ ID NO: 256959 - DNA, 25 bp, Rattus norvegicus
cgacctggatatttagtgaccttaa

SEQ ID NO: 256960 - DNA, 25 bp, Rattus norvegicus
cgacctggctaaccacgatgaggaa

SEQ ID NO: 256961 - DNA, 25 bp, Rattus norvegicus
cgacctggctaagcacgatgaggaa

SEQ ID NO: 256962 - DNA, 25 bp, Rattus norvegicus
cgacctgggcaacgatgctctggaa

SEQ ID NO: 256963 - DNA, 25 bp, Rattus norvegicus
cgacctgggcaaggatgctctggaa

SEQ ID NO: 256964 - DNA, 25 bp, Rattus norvegicus
cgacctgttgcgaacatatgaggca

SEQ ID NO: 256965 - DNA, 25 bp, Rattus norvegicus
cgacctgttgcgtacatatgaggca

SEQ ID NO: 256966 - DNA, 25 bp, Rattus norvegicus
cgaccttcataccttattcaacatc

SEQ ID NO: 256967 - DNA, 25 bp, Rattus norvegicus
cgaccttcatacgttattcaacatc

SEQ ID NO: 256968 - DNA, 25 bp, Rattus norvegicus
cgaccttgattcaagttctctgggc

SEQ ID NO: 256969 - DNA, 25 bp, Rattus norvegicus
cgaccttgattctagttctctgggc

SEQ ID NO: 256970 - DNA, 25 bp, Rattus norvegicus
cgacgaagcaggcagcggtgcgagt

SEQ ID NO: 256971 - DNA, 25 bp, Rattus norvegicus
cgacgaagcagggagcggtgcgagt

SEQ ID NO: 256972 - DNA, 25 bp, Rattus norvegicus
cgacgagagtccattacctatgagc

SEQ ID NO: 256973 - DNA, 25 bp, Rattus norvegicus
cgacgagagtcctttacctatgagc

SEQ ID NO: 256974 - DNA, 25 bp, Rattus norvegicus
cgacgagcaccaccatagagaacat

SEQ ID NO: 256975 - DNA, 25 bp, Rattus norvegicus
cgacgagcaccagcatagagaacat

SEQ ID NO: 256976 - DNA, 25 bp, Rattus norvegicus
cgacgaggtctgagtgcaggttact

SEQ ID NO: 256977 - DNA, 25 bp, Rattus norvegicus
cgacgaggtctgtgtgcaggttact

SEQ ID NO: 256978 - DNA, 25 bp, Rattus norvegicus
cgacgatcctttctgcggagtttgt

SEQ ID NO: 256979 - DNA, 25 bp, Rattus norvegicus
cgacgatcctttgtgcggagtttgt

SEQ ID NO: 256980 - DNA, 25 bp, Rattus norvegicus
cgacgatcgccgagttccatcttcg

SEQ ID NO: 256981 - DNA, 25 bp, Rattus norvegicus
cgacgatcgccgtgttccatcttcg

SEQ ID NO: 256982 - DNA, 25 bp, Rattus norvegicus
cgacgatggccacgttttgcgtgtt

SEQ ID NO: 256983 - DNA, 25 bp, Rattus norvegicus
cgacgatggccaggttttgcgtgtt

SEQ ID NO: 256984 - DNA, 25 bp, Rattus norvegicus
cgacgccaatatccccgaaagacta

SEQ ID NO: 256985 - DNA, 25 bp, Rattus norvegicus
cgacgccaatatgcccgaaagacta

SEQ ID NO: 256986 - DNA, 25 bp, Rattus norvegicus
cgacgcgtccatcggtaacgtgacc

SEQ ID NO: 256987 - DNA, 25 bp, Rattus norvegicus
cgacgcgtccatgggtaacgtgacc

SEQ ID NO: 256988 - DNA, 25 bp, Rattus norvegicus
cgacgcttgaatcctcgtatgattt

SEQ ID NO: 256989 - DNA, 25 bp, Rattus norvegicus
cgacgcttgaatgctcgtatgattt

SEQ ID NO: 256990 - DNA, 25 bp, Rattus norvegicus
cgacggacaattattgaagctgctg

SEQ ID NO: 256991 - DNA, 25 bp, Rattus norvegicus
cgacggacaatttttgaagctgctg

SEQ ID NO: 256992 - DNA, 25 bp, Rattus norvegicus
cgacggactgagaccaaactgcaaa

SEQ ID NO: 256993 - DNA, 25 bp, Rattus norvegicus
cgacggactgagtccaaactgcaaa

SEQ ID NO: 256994 - DNA, 25 bp, Rattus norvegicus
cgacggagatctaagctgtgtgtgt

SEQ ID NO: 256995 - DNA, 25 bp, Rattus norvegicus
cgacggagatcttagctgtgtgtgt

SEQ ID NO: 256996 - DNA, 25 bp, Rattus norvegicus
cgacggaggctgagtgctttctaca

SEQ ID NO: 256997 - DNA, 25 bp, Rattus norvegicus
cgacggaggctgtgtgctttctaca

SEQ ID NO: 256998 - DNA, 25 bp, Rattus norvegicus
cgacggatttgacaaggcttggtca

SEQ ID NO: 256999 - DNA, 25 bp, Rattus norvegicus
cgacggatttgagaaggcttggtca

SEQ ID NO: 257000 - DNA, 25 bp, Rattus norvegicus
cgacggcactgacggacatgtgaca

SEQ ID NO: 257001 - DNA, 25 bp, Rattus norvegicus
cgacggcactgagggacatgtgaca

SEQ ID NO: 257002 - DNA, 25 bp, Rattus norvegicus
cgacggctccgtcaactctaaataa

SEQ ID NO: 257003 - DNA, 25 bp, Rattus norvegicus
cgacggctccgtgaactctaaataa

SEQ ID NO: 257004 - DNA, 25 bp, Rattus norvegicus
cgacgggaagccatcaaggtatgag

SEQ ID NO: 257005 - DNA, 25 bp, Rattus norvegicus
cgacgggaagccttcaaggtatgag

SEQ ID NO: 257006 - DNA, 25 bp, Rattus norvegicus
cgacgggtaagacagtgatatgttc

SEQ ID NO: 257007 - DNA, 25 bp, Rattus norvegicus
cgacgggtaagagagtgatatgttc

SEQ ID NO: 257008 - DNA, 25 bp, Rattus norvegicus
cgacggtctgatctcgcagcgagac

SEQ ID NO: 257009 - DNA, 25 bp, Rattus norvegicus
cgacggtctgatgtcgcagcgagac

SEQ ID NO: 257010 - DNA, 25 bp, Rattus norvegicus
cgacgtgatggtcttcaagcagcag

SEQ ID NO: 257011 - DNA, 25 bp, Rattus norvegicus
cgacgtgatggtgttcaagcagcag

SEQ ID NO: 257012 - DNA, 25 bp, Rattus norvegicus
cgacgtggtcttccacatgctgcag

SEQ ID NO: 257013 - DNA, 25 bp, Rattus norvegicus
cgacgtggtcttgcacatgctgcag

SEQ ID NO: 257014 - DNA, 25 bp, Rattus norvegicus
cgacgtgtttgtcaatctggcagac

SEQ ID NO: 257015 - DNA, 25 bp, Rattus norvegicus
cgacgtgtttgtgaatctggcagac

SEQ ID NO: 257016 - DNA, 25 bp, Rattus norvegicus
cgacgttcgatcatgcatggagcaa

SEQ ID NO: 257017 - DNA, 25 bp, Rattus norvegicus
cgacgttcgatcttgcatggagcaa

SEQ ID NO: 257018 - DNA, 25 bp, Rattus norvegicus
cgactaacgttgaatgccatctgaa

SEQ ID NO: 257019 - DNA, 25 bp, Rattus norvegicus
cgactaacgttgtatgccatctgaa

SEQ ID NO: 257020 - DNA, 25 bp, Rattus norvegicus
cgactacacactcctttgacaaagt

SEQ ID NO: 257021 - DNA, 25 bp, Rattus norvegicus
cgactacacactgctttgacaaagt

SEQ ID NO: 257022 - DNA, 25 bp, Rattus norvegicus
cgactactatgaattcgtggccgct

SEQ ID NO: 257023 - DNA, 25 bp, Rattus norvegicus
cgactactatgatttcgtggccgct

SEQ ID NO: 257024 - DNA, 25 bp, Rattus norvegicus
cgactatggatcactgtgggaatca

SEQ ID NO: 257025 - DNA, 25 bp, Rattus norvegicus
cgactatggatctctgtgggaatca

SEQ ID NO: 257026 - DNA, 25 bp, Rattus norvegicus
cgactattggtgctttgctccttat

SEQ ID NO: 257027 - DNA, 25 bp, Rattus norvegicus
cgactattggtggtttgctccttat

SEQ ID NO: 257028 - DNA, 25 bp, Rattus norvegicus
cgactcacgggtatcacaggctgaa

SEQ ID NO: 257029 - DNA, 25 bp, Rattus norvegicus
cgactcacgggtttcacaggctgaa

SEQ ID NO: 257030 - DNA, 25 bp, Rattus norvegicus
cgactcactcgtctgcacgttcagg

SEQ ID NO: 257031 - DNA, 25 bp, Rattus norvegicus
cgactcactcgtgtgcacgttcagg

SEQ ID NO: 257032 - DNA, 25 bp, Rattus norvegicus
cgactcagggagctttggactttaa

SEQ ID NO: 257033 - DNA, 25 bp, Rattus norvegicus
cgactcagggaggtttggactttaa

SEQ ID NO: 257034 - DNA, 25 bp, Rattus norvegicus
cgactcatattgacccctagaatgg

SEQ ID NO: 257035 - DNA, 25 bp, Rattus norvegicus
cgactcatattgtcccctagaatgg

SEQ ID NO: 257036 - DNA, 25 bp, Rattus norvegicus
cgactcccacgtccttgaattaaag

SEQ ID NO: 257037 - DNA, 25 bp, Rattus norvegicus
cgactcccacgtgcttgaattaaag

SEQ ID NO: 257038 - DNA, 25 bp, Rattus norvegicus
cgactctggcgtagaacccgcggga

SEQ ID NO: 257039 - DNA, 25 bp, Rattus norvegicus
cgactctggcgttgaacccgcggga

SEQ ID NO: 257040 - DNA, 25 bp, Rattus norvegicus
cgactctgtcctcgataccgatggg

SEQ ID NO: 257041 - DNA, 25 bp, Rattus norvegicus
cgactctgtcctggataccgatggg

SEQ ID NO: 257042 - DNA, 25 bp, Rattus norvegicus
cgactgaaacgtccctttttatcct

SEQ ID NO: 257043 - DNA, 25 bp, Rattus norvegicus
cgactgaaacgtgcctttttatcct

SEQ ID NO: 257044 - DNA, 25 bp, Rattus norvegicus
cgactgaccccgagtatggattaaa

SEQ ID NO: 257045 - DNA, 25 bp, Rattus norvegicus
cgactgaccccgtgtatggattaaa

SEQ ID NO: 257046 - DNA, 25 bp, Rattus norvegicus
cgactgagtatgcgttcctcggact

SEQ ID NO: 257047 - DNA, 25 bp, Rattus norvegicus
cgactgagtatgggttcctcggact

SEQ ID NO: 257048 - DNA, 25 bp, Rattus norvegicus
cgactgatccagattgaacctcaaa

SEQ ID NO: 257049 - DNA, 25 bp, Rattus norvegicus
cgactgatccagtttgaacctcaaa

SEQ ID NO: 257050 - DNA, 25 bp, Rattus norvegicus
cgactggaggccacgcaactggaag

SEQ ID NO: 257051 - DNA, 25 bp, Rattus norvegicus
cgactggaggcctcgcaactggaag

SEQ ID NO: 257052 - DNA, 25 bp, Rattus norvegicus
cgactggatctgacttgtgaaccaa

SEQ ID NO: 257053 - DNA, 25 bp, Rattus norvegicus
cgactggatctgtcttgtgaaccaa

SEQ ID NO: 257054 - DNA, 25 bp, Rattus norvegicus
cgactggctctactactatgtttac

SEQ ID NO: 257055 - DNA, 25 bp, Rattus norvegicus
cgactggctctagtactatgtttac

SEQ ID NO: 257056 - DNA, 25 bp, Rattus norvegicus
cgactgggatcgagatggcagccat

SEQ ID NO: 257057 - DNA, 25 bp, Rattus norvegicus
cgactgggatcgtgatggcagccat

SEQ ID NO: 257058 - DNA, 25 bp, Rattus norvegicus
cgactgtgatcaccccttgttccaa

SEQ ID NO: 257059 - DNA, 25 bp, Rattus norvegicus
cgactgtgatcagcccttgttccaa

SEQ ID NO: 257060 - DNA, 25 bp, Rattus norvegicus
cgacttaaactgaggctgcgctgag

SEQ ID NO: 257061 - DNA, 25 bp, Rattus norvegicus
cgacttaaactgtggctgcgctgag

SEQ ID NO: 257062 - DNA, 25 bp, Rattus norvegicus
cgacttaagtccctaatgcctatgg

SEQ ID NO: 257063 - DNA, 25 bp, Rattus norvegicus
cgacttaagtccgtaatgcctatgg

SEQ ID NO: 257064 - DNA, 25 bp, Rattus norvegicus
cgacttacccagctgctggtatcat

SEQ ID NO: 257065 - DNA, 25 bp, Rattus norvegicus
cgacttacccaggtgctggtatcat

SEQ ID NO: 257066 - DNA, 25 bp, Rattus norvegicus
cgacttcactgtcactctgaaaaca

SEQ ID NO: 257067 - DNA, 25 bp, Rattus norvegicus
cgacttcactgtgactctgaaaaca

SEQ ID NO: 257068 - DNA, 25 bp, Rattus norvegicus
cgacttcccggacggccctggagat

SEQ ID NO: 257069 - DNA, 25 bp, Rattus norvegicus
cgacttcccggagggccctggagat

SEQ ID NO: 257070 - DNA, 25 bp, Rattus norvegicus
cgacttccctgccttgggaatagaa

SEQ ID NO: 257071 - DNA, 25 bp, Rattus norvegicus
cgacttccctgcgttgggaatagaa

SEQ ID NO: 257072 - DNA, 25 bp, Rattus norvegicus
cgacttcgagccatctgccaagaag

SEQ ID NO: 257073 - DNA, 25 bp, Rattus norvegicus
cgacttcgagccttctgccaagaag

SEQ ID NO: 257074 - DNA, 25 bp, Rattus norvegicus
cgacttcgtgaaagcgatccgcagc

SEQ ID NO: 257075 - DNA, 25 bp, Rattus norvegicus
cgacttcgtgaatgcgatccgcagc

SEQ ID NO: 257076 - DNA, 25 bp, Rattus norvegicus
cgacttgatcctatgtggttttgca

SEQ ID NO: 257077 - DNA, 25 bp, Rattus norvegicus
cgacttgatcctttgtggttttgca

SEQ ID NO: 257078 - DNA, 25 bp, Rattus norvegicus
cgacttgccatcagtgctgatatta

SEQ ID NO: 257079 - DNA, 25 bp, Rattus norvegicus
cgacttgccatctgtgctgatatta

SEQ ID NO: 257080 - DNA, 25 bp, Rattus norvegicus
cgacttgcccctaactttcgatggg

SEQ ID NO: 257081 - DNA, 25 bp, Rattus norvegicus
cgacttgccccttactttcgatggg

SEQ ID NO: 257082 - DNA, 25 bp, Rattus norvegicus
cgacttgcctcaatgtgacactggg

SEQ ID NO: 257083 - DNA, 25 bp, Rattus norvegicus
cgacttgcctcattgtgacactggg

SEQ ID NO: 257084 - DNA, 25 bp, Rattus norvegicus
cgacttgtcgcaaggttctgtgtga

SEQ ID NO: 257085 - DNA, 25 bp, Rattus norvegicus
cgacttgtcgcatggttctgtgtga

SEQ ID NO: 257086 - DNA, 25 bp, Rattus norvegicus
cgactttagtccagagctcttgtga

SEQ ID NO: 257087 - DNA, 25 bp, Rattus norvegicus
cgactttagtcctgagctcttgtga

SEQ ID NO: 257088 - DNA, 25 bp, Rattus norvegicus
cgactttctggcagctgtgaccact

SEQ ID NO: 257089 - DNA, 25 bp, Rattus norvegicus
cgactttctggctgctgtgaccact

SEQ ID NO: 257090 - DNA, 25 bp, Rattus norvegicus
cgactttgccagagctcttcttgtc

SEQ ID NO: 257091 - DNA, 25 bp, Rattus norvegicus
cgactttgccagtgctcttcttgtc

SEQ ID NO: 257092 - DNA, 25 bp, Rattus norvegicus
cgagaaccaggacactcagggctac

SEQ ID NO: 257093 - DNA, 25 bp, Rattus norvegicus
cgagaaccaggagactcagggctac

SEQ ID NO: 257094 - DNA, 25 bp, Rattus norvegicus
cgagaagacttgagactgggtcccc

SEQ ID NO: 257095 - DNA, 25 bp, Rattus norvegicus
cgagaagacttgtgactgggtcccc

SEQ ID NO: 257096 - DNA, 25 bp, Rattus norvegicus
cgagaagagctcagcagtggacatt

SEQ ID NO: 257097 - DNA, 25 bp, Rattus norvegicus
cgagaagagctctgcagtggacatt

SEQ ID NO: 257098 - DNA, 25 bp, Rattus norvegicus
cgagaagcagcgctggctccaccat

SEQ ID NO: 257099 - DNA, 25 bp, Rattus norvegicus
cgagaagcagcggtggctccaccat

SEQ ID NO: 257100 - DNA, 25 bp, Rattus norvegicus
cgagaagcgctcagtctttgcagcc

SEQ ID NO: 257101 - DNA, 25 bp, Rattus norvegicus
cgagaagcgctctgtctttgcagcc

SEQ ID NO: 257102 - DNA, 25 bp, Rattus norvegicus
cgagaagtcctccagaaggctttgg

SEQ ID NO: 257103 - DNA, 25 bp, Rattus norvegicus
cgagaagtcctcgagaaggctttgg

SEQ ID NO: 257104 - DNA, 25 bp, Rattus norvegicus
cgagaccacaaactggcctgctggt

SEQ ID NO: 257105 - DNA, 25 bp, Rattus norvegicus
cgagaccacaaagtggcctgctggt

SEQ ID NO: 257106 - DNA, 25 bp, Rattus norvegicus
cgagaccatcgcagtcaggcaggga

SEQ ID NO: 257107 - DNA, 25 bp, Rattus norvegicus
cgagaccatcgctgtcaggcaggga

SEQ ID NO: 257108 - DNA, 25 bp, Rattus norvegicus
cgagaccccagtccgttatcaggaa

SEQ ID NO: 257109 - DNA, 25 bp, Rattus norvegicus
cgagaccccagtgcgttatcaggaa

SEQ ID NO: 257110 - DNA, 25 bp, Rattus norvegicus
cgagaccgcaaacgctatcagcaag

SEQ ID NO: 257111 - DNA, 25 bp, Rattus norvegicus
cgagaccgcaaaggctatcagcaag

SEQ ID NO: 257112 - DNA, 25 bp, Rattus norvegicus
cgagacctaggcagagacggcgcaa

SEQ ID NO: 257113 - DNA, 25 bp, Rattus norvegicus
cgagacctaggctgagacggcgcaa

SEQ ID NO: 257114 - DNA, 25 bp, Rattus norvegicus
cgagaccttctgagctgttgtatat

SEQ ID NO: 257115 - DNA, 25 bp, Rattus norvegicus
cgagaccttctgtgctgttgtatat

SEQ ID NO: 257116 - DNA, 25 bp, Rattus norvegicus
cgagacgccgcgaggacgacacgct

SEQ ID NO: 257117 - DNA, 25 bp, Rattus norvegicus
cgagacgccgcgtggacgacacgct

SEQ ID NO: 257118 - DNA, 25 bp, Rattus norvegicus
cgagacgctggtcccgcggcgggcg

SEQ ID NO: 257119 - DNA, 25 bp, Rattus norvegicus
cgagacgctggtgccgcggcgggcg

SEQ ID NO: 257120 - DNA, 25 bp, Rattus norvegicus
cgagacggccgtatgttgctattaa

SEQ ID NO: 257121 - DNA, 25 bp, Rattus norvegicus
cgagacggccgtttgttgctattaa

SEQ ID NO: 257122 - DNA, 25 bp, Rattus norvegicus
cgagacgtaaccatgttagccacat

SEQ ID NO: 257123 - DNA, 25 bp, Rattus norvegicus
cgagacgtaaccttgttagccacat

SEQ ID NO: 257124 - DNA, 25 bp, Rattus norvegicus
cgagactcagatacccagagcggga

SEQ ID NO: 257125 - DNA, 25 bp, Rattus norvegicus
cgagactcagattcccagagcggga

SEQ ID NO: 257126 - DNA, 25 bp, Rattus norvegicus
cgagactgactgacagacacgcaaa

SEQ ID NO: 257127 - DNA, 25 bp, Rattus norvegicus
cgagactgactgtcagacacgcaaa

SEQ ID NO: 257128 - DNA, 25 bp, Rattus norvegicus
cgagactgtgccaaccattttgagc

SEQ ID NO: 257129 - DNA, 25 bp, Rattus norvegicus
cgagactgtgcctaccattttgagc

SEQ ID NO: 257130 - DNA, 25 bp, Rattus norvegicus
cgagagcaaccgcataggcgcatgc

SEQ ID NO: 257131 - DNA, 25 bp, Rattus norvegicus
cgagagcaaccggataggcgcatgc

SEQ ID NO: 257132 - DNA, 25 bp, Rattus norvegicus
cgagagcaccagagctgttcggcag

SEQ ID NO: 257133 - DNA, 25 bp, Rattus norvegicus
cgagagcaccagtgctgttcggcag

SEQ ID NO: 257134 - DNA, 25 bp, Rattus norvegicus
cgagagcacgcgagtccatgttgaa

SEQ ID NO: 257135 - DNA, 25 bp, Rattus norvegicus
cgagagcacgcgtgtccatgttgaa

SEQ ID NO: 257136 - DNA, 25 bp, Rattus norvegicus
cgagagccatttcaacaagtacctg

SEQ ID NO: 257137 - DNA, 25 bp, Rattus norvegicus
cgagagccatttgaacaagtacctg

SEQ ID NO: 257138 - DNA, 25 bp, Rattus norvegicus
cgagagctggacaggtgcagaaact

SEQ ID NO: 257139 - DNA, 25 bp, Rattus norvegicus
cgagagctggactggtgcagaaact

SEQ ID NO: 257140 - DNA, 25 bp, Rattus norvegicus
cgagaggaagctctgtctgttcaca

SEQ ID NO: 257141 - DNA, 25 bp, Rattus norvegicus
cgagaggaagctgtgtctgttcaca

SEQ ID NO: 257142 - DNA, 25 bp, Rattus norvegicus
cgagaggacctccatcccagaacga

SEQ ID NO: 257143 - DNA, 25 bp, Rattus norvegicus
cgagaggacctcgatcccagaacga

SEQ ID NO: 257144 - DNA, 25 bp, Rattus norvegicus
cgagaggccccgacgcaataggaag

SEQ ID NO: 257145 - DNA, 25 bp, Rattus norvegicus
cgagaggccccgtcgcaataggaag

SEQ ID NO: 257146 - DNA, 25 bp, Rattus norvegicus
cgagaggcgaggatctgttcacgct

SEQ ID NO: 257147 - DNA, 25 bp, Rattus norvegicus
cgagaggcgaggttctgttcacgct

SEQ ID NO: 257148 - DNA, 25 bp, Rattus norvegicus
cgagagggtcaacgccctgtttcta

SEQ ID NO: 257149 - DNA, 25 bp, Rattus norvegicus
cgagagggtcaaggccctgtttcta

SEQ ID NO: 257150 - DNA, 25 bp, Rattus norvegicus
cgagagtgacgacaacgatgacatt

SEQ ID NO: 257151 - DNA, 25 bp, Rattus norvegicus
cgagagtgacgagaacgatgacatt

SEQ ID NO: 257152 - DNA, 25 bp, Rattus norvegicus
cgagagtgagctacttggctgtcaa

SEQ ID NO: 257153 - DNA, 25 bp, Rattus norvegicus
cgagagtgagcttcttggctgtcaa

SEQ ID NO: 257154 - DNA, 25 bp, Rattus norvegicus
cgagagttgtagagcaagtgcccta

SEQ ID NO: 257155 - DNA, 25 bp, Rattus norvegicus
cgagagttgtagtgcaagtgcccta

SEQ ID NO: 257156 - DNA, 25 bp, Rattus norvegicus
cgagatatggccagcagcgatgatg

SEQ ID NO: 257157 - DNA, 25 bp, Rattus norvegicus
cgagatatggcccgcgctggagttt

SEQ ID NO: 257158 - DNA, 25 bp, Rattus norvegicus
cgagatatggccggcgctggagttt

SEQ ID NO: 257159 - DNA, 25 bp, Rattus norvegicus
cgagatatggcctgcagcgatgatg

SEQ ID NO: 257160 - DNA, 25 bp, Rattus norvegicus
cgagatcattttcctcatgttcacc

SEQ ID NO: 257161 - DNA, 25 bp, Rattus norvegicus
cgagatcattttgctcatgttcacc

SEQ ID NO: 257162 - DNA, 25 bp, Rattus norvegicus
cgagatccagatcccctcaagtaag

SEQ ID NO: 257163 - DNA, 25 bp, Rattus norvegicus
cgagatccagatgccctcaagtaag

SEQ ID NO: 257164 - DNA, 25 bp, Rattus norvegicus
cgagatccggacatgtgacagctat

SEQ ID NO: 257165 - DNA, 25 bp, Rattus norvegicus
cgagatccggacttgtgacagctat

SEQ ID NO: 257166 - DNA, 25 bp, Rattus norvegicus
cgagatcctgcaccgtccgaagaca

SEQ ID NO: 257167 - DNA, 25 bp, Rattus norvegicus
cgagatcctgcagcgtccgaagaca

SEQ ID NO: 257168 - DNA, 25 bp, Rattus norvegicus
cgagatcgtggtctccctggtgaac

SEQ ID NO: 257169 - DNA, 25 bp, Rattus norvegicus
cgagatcgtggtgtccctggtgaac

SEQ ID NO: 257170 - DNA, 25 bp, Rattus norvegicus
cgagatgaatgtcctggtccctcag

SEQ ID NO: 257171 - DNA, 25 bp, Rattus norvegicus
cgagatgaatgtgctggtccctcag

SEQ ID NO: 257172 - DNA, 25 bp, Rattus norvegicus
cgagatggcgaaccggagcgacgga

SEQ ID NO: 257173 - DNA, 25 bp, Rattus norvegicus
cgagatggcgaagcggagcgacgga

SEQ ID NO: 257174 - DNA, 25 bp, Rattus norvegicus
cgagatggtactcggcactaccttt

SEQ ID NO: 257175 - DNA, 25 bp, Rattus norvegicus
cgagatggtactgggcactaccttt

SEQ ID NO: 257176 - DNA, 25 bp, Rattus norvegicus
cgagatgtcgttactgctctgaaga

SEQ ID NO: 257177 - DNA, 25 bp, Rattus norvegicus
cgagatgtcgtttctgctctgaaga

SEQ ID NO: 257178 - DNA, 25 bp, Rattus norvegicus
cgagatgtttccatgaaaatcgcag

SEQ ID NO: 257179 - DNA, 25 bp, Rattus norvegicus
cgagatgtttccttgaaaatcgcag

SEQ ID NO: 257180 - DNA, 25 bp, Rattus norvegicus
cgagattccatccttgctcaagaga

SEQ ID NO: 257181 - DNA, 25 bp, Rattus norvegicus
cgagattccatcgttgctcaagaga

SEQ ID NO: 257182 - DNA, 25 bp, Rattus norvegicus
cgagattgagacacacgtattggga

SEQ ID NO: 257183 - DNA, 25 bp, Rattus norvegicus
cgagattgagactcacgtattggga

SEQ ID NO: 257184 - DNA, 25 bp, Rattus norvegicus
cgagattgtggccacactagagaag

SEQ ID NO: 257185 - DNA, 25 bp, Rattus norvegicus
cgagattgtggcgacactagagaag

SEQ ID NO: 257186 - DNA, 25 bp, Rattus norvegicus
cgagatttccgaagagttcctggta

SEQ ID NO: 257187 - DNA, 25 bp, Rattus norvegicus
cgagatttccgatgagttcctggta

SEQ ID NO: 257188 - DNA, 25 bp, Rattus norvegicus
cgagcaaagccacggagcagctgca

SEQ ID NO: 257189 - DNA, 25 bp, Rattus norvegicus
cgagcaaagccagggagcagctgca

SEQ ID NO: 257190 - DNA, 25 bp, Rattus norvegicus
cgagcaagctcgagtctatgtggat

SEQ ID NO: 257191 - DNA, 25 bp, Rattus norvegicus
cgagcaagctcgtgtctatgtggat

SEQ ID NO: 257192 - DNA, 25 bp, Rattus norvegicus
cgagcaccctagattgatttccagt

SEQ ID NO: 257193 - DNA, 25 bp, Rattus norvegicus
cgagcaccctagtttgatttccagt

SEQ ID NO: 257194 - DNA, 25 bp, Rattus norvegicus
cgagcactcttaaacactgactgga

SEQ ID NO: 257195 - DNA, 25 bp, Rattus norvegicus
cgagcactcttatacactgactgga

SEQ ID NO: 257196 - DNA, 25 bp, Rattus norvegicus
cgagcagatgaacgaacagactcag

SEQ ID NO: 257197 - DNA, 25 bp, Rattus norvegicus
cgagcagatgaaggaacagactcag

SEQ ID NO: 257198 - DNA, 25 bp, Rattus norvegicus
cgagcagctattcccaactgagtgc

SEQ ID NO: 257199 - DNA, 25 bp, Rattus norvegicus
cgagcagctattgccaactgagtgc

SEQ ID NO: 257200 - DNA, 25 bp, Rattus norvegicus
cgagcaggattgatagcagtagact

SEQ ID NO: 257201 - DNA, 25 bp, Rattus norvegicus
cgagcaggattgttagcagtagact

SEQ ID NO: 257202 - DNA, 25 bp, Rattus norvegicus
cgagcaggcaccagcggtcacagga

SEQ ID NO: 257203 - DNA, 25 bp, Rattus norvegicus
cgagcaggcacctgcggtcacagga

SEQ ID NO: 257204 - DNA, 25 bp, Rattus norvegicus
cgagcagtagtgatagcatttccca

SEQ ID NO: 257205 - DNA, 25 bp, Rattus norvegicus
cgagcagtagtgttagcatttccca

SEQ ID NO: 257206 - DNA, 25 bp, Rattus norvegicus
cgagcagtctgcaaacgggaaagtt

SEQ ID NO: 257207 - DNA, 25 bp, Rattus norvegicus
cgagcagtctgctaacgggaaagtt

SEQ ID NO: 257208 - DNA, 25 bp, Rattus norvegicus
cgagcagttacacaggatccaggtt

SEQ ID NO: 257209 - DNA, 25 bp, Rattus norvegicus
cgagcagttacagaggatccaggtt

SEQ ID NO: 257210 - DNA, 25 bp, Rattus norvegicus
cgagcagttcgacgtgatttctcaa

SEQ ID NO: 257211 - DNA, 25 bp, Rattus norvegicus
cgagcagttcgaggtgatttctcaa

SEQ ID NO: 257212 - DNA, 25 bp, Rattus norvegicus
cgagcagttcttatggcgtttacaa

SEQ ID NO: 257213 - DNA, 25 bp, Rattus norvegicus
cgagcagttcttttggcgtttacaa

SEQ ID NO: 257214 - DNA, 25 bp, Rattus norvegicus
cgagcataagcacagcacatccatg

SEQ ID NO: 257215 - DNA, 25 bp, Rattus norvegicus
cgagcataagcagagcacatccatg

SEQ ID NO: 257216 - DNA, 25 bp, Rattus norvegicus
cgagcatgatagaagcgacacattt

SEQ ID NO: 257217 - DNA, 25 bp, Rattus norvegicus
cgagcatgatagtagcgacacattt

SEQ ID NO: 257218 - DNA, 25 bp, Rattus norvegicus
cgagcatggcacagtgacggcagtt

SEQ ID NO: 257219 - DNA, 25 bp, Rattus norvegicus
cgagcatggcactgtgacggcagtt

SEQ ID NO: 257220 - DNA, 25 bp, Rattus norvegicus
cgagcatttggcaggcgggataatt

SEQ ID NO: 257221 - DNA, 25 bp, Rattus norvegicus
cgagcatttggctggcgggataatt

SEQ ID NO: 257222 - DNA, 25 bp, Rattus norvegicus
cgagccaaactgatgcatgatgcct

SEQ ID NO: 257223 - DNA, 25 bp, Rattus norvegicus
cgagccaaactgttgcatgatgcct

SEQ ID NO: 257224 - DNA, 25 bp, Rattus norvegicus
cgagccagggcacaagtactcactg

SEQ ID NO: 257225 - DNA, 25 bp, Rattus norvegicus
cgagccagggcagaagtactcactg

SEQ ID NO: 257226 - DNA, 25 bp, Rattus norvegicus
cgagccatcgccacacaaagaataa

SEQ ID NO: 257227 - DNA, 25 bp, Rattus norvegicus
cgagccatcgcctcacaaagaataa

SEQ ID NO: 257228 - DNA, 25 bp, Rattus norvegicus
cgagccatgggcatttgaccagatt

SEQ ID NO: 257229 - DNA, 25 bp, Rattus norvegicus
cgagccatgggcttttgaccagatt

SEQ ID NO: 257230 - DNA, 25 bp, Rattus norvegicus
cgagcccactcacacgctgtgaaga

SEQ ID NO: 257231 - DNA, 25 bp, Rattus norvegicus
cgagcccactcagacgctgtgaaga

SEQ ID NO: 257232 - DNA, 25 bp, Rattus norvegicus
cgagccccgaagacatggcaggtgt

SEQ ID NO: 257233 - DNA, 25 bp, Rattus norvegicus
cgagccccgaagtcatggcaggtgt

SEQ ID NO: 257234 - DNA, 25 bp, Rattus norvegicus
cgagccccgaatcctgtagagagtg

SEQ ID NO: 257235 - DNA, 25 bp, Rattus norvegicus
cgagccccgaatgctgtagagagtg

SEQ ID NO: 257236 - DNA, 25 bp, Rattus norvegicus
cgagccgcgaacatttccggaggag

SEQ ID NO: 257237 - DNA, 25 bp, Rattus norvegicus
cgagccgcgaacttttccggaggag

SEQ ID NO: 257238 - DNA, 25 bp, Rattus norvegicus
cgagcctccaagacagcagcgagcg

SEQ ID NO: 257239 - DNA, 25 bp, Rattus norvegicus
cgagcctccaagtcagcagcgagcg

SEQ ID NO: 257240 - DNA, 25 bp, Rattus norvegicus
cgagcctcgcttagagaggcttctt

SEQ ID NO: 257241 - DNA, 25 bp, Rattus norvegicus
cgagcctcgctttgagaggcttctt

SEQ ID NO: 257242 - DNA, 25 bp, Rattus norvegicus
cgagcctggatcacaaatgttgcag

SEQ ID NO: 257243 - DNA, 25 bp, Rattus norvegicus
cgagcctggatctcaaatgttgcag

SEQ ID NO: 257244 - DNA, 25 bp, Rattus norvegicus
cgagccttggcgatgtggtgatttc

SEQ ID NO: 257245 - DNA, 25 bp, Rattus norvegicus
cgagccttggcgttgtggtgatttc

SEQ ID NO: 257246 - DNA, 25 bp, Rattus norvegicus
cgagcgatcaagatgcgggagacaa

SEQ ID NO: 257247 - DNA, 25 bp, Rattus norvegicus
cgagcgatcaagttgcgggagacaa

SEQ ID NO: 257248 - DNA, 25 bp, Rattus norvegicus
cgagcgcatgcaacagggaccaagt

SEQ ID NO: 257249 - DNA, 25 bp, Rattus norvegicus
cgagcgcatgcatcagggaccaagt

SEQ ID NO: 257250 - DNA, 25 bp, Rattus norvegicus
cgagcgcctctcataccttcgttgt

SEQ ID NO: 257251 - DNA, 25 bp, Rattus norvegicus
cgagcgcctctcttaccttcgttgt

SEQ ID NO: 257252 - DNA, 25 bp, Rattus norvegicus
cgagcgccttgaacggcctggtcag

SEQ ID NO: 257253 - DNA, 25 bp, Rattus norvegicus
cgagcgccttgatcggcctggtcag

SEQ ID NO: 257254 - DNA, 25 bp, Rattus norvegicus
cgagcgctagctacagcgacgggaa

SEQ ID NO: 257255 - DNA, 25 bp, Rattus norvegicus
cgagcgctagcttcagcgacgggaa

SEQ ID NO: 257256 - DNA, 25 bp, Rattus norvegicus
cgagcgctcagcatcaagcgtggag

SEQ ID NO: 257257 - DNA, 25 bp, Rattus norvegicus
cgagcgctcagcttcaagcgtggag

SEQ ID NO: 257258 - DNA, 25 bp, Rattus norvegicus
cgagcgctctcgatggtttgaagac

SEQ ID NO: 257259 - DNA, 25 bp, Rattus norvegicus
cgagcgctctcgttggtttgaagac

SEQ ID NO: 257260 - DNA, 25 bp, Rattus norvegicus
cgagcggtgtgcatcctttgggatt

SEQ ID NO: 257261 - DNA, 25 bp, Rattus norvegicus
cgagcggtgtgcttcctttgggatt

SEQ ID NO: 257262 - DNA, 25 bp, Rattus norvegicus
cgagcgtctcctcaagttgcagaac

SEQ ID NO: 257263 - DNA, 25 bp, Rattus norvegicus
cgagcgtctcctgaagttgcagaac

SEQ ID NO: 257264 - DNA, 25 bp, Rattus norvegicus
cgagcgtggctacagcttcaccacc

SEQ ID NO: 257265 - DNA, 25 bp, Rattus norvegicus
cgagcgtggctagagcttcaccacc

SEQ ID NO: 257266 - DNA, 25 bp, Rattus norvegicus
cgagcgtgtgcaatcattgggtcat

SEQ ID NO: 257267 - DNA, 25 bp, Rattus norvegicus
cgagcgtgtgcattcattgggtcat

SEQ ID NO: 257268 - DNA, 25 bp, Rattus norvegicus
cgagctcatgatctactgcctagag

SEQ ID NO: 257269 - DNA, 25 bp, Rattus norvegicus
cgagctcatgatgtactgcctagag

SEQ ID NO: 257270 - DNA, 25 bp, Rattus norvegicus
cgagctcatgggagtacattatcat

SEQ ID NO: 257271 - DNA, 25 bp, Rattus norvegicus
cgagctcatgggtgtacattatcat

SEQ ID NO: 257272 - DNA, 25 bp, Rattus norvegicus
cgagctccacgtcggaatgctaagt

SEQ ID NO: 257273 - DNA, 25 bp, Rattus norvegicus
cgagctccacgtgggaatgctaagt

SEQ ID NO: 257274 - DNA, 25 bp, Rattus norvegicus
cgagctcccttccacttaacagaag

SEQ ID NO: 257275 - DNA, 25 bp, Rattus norvegicus
cgagctcccttcgacttaacagaag

SEQ ID NO: 257276 - DNA, 25 bp, Rattus norvegicus
cgagctccgtttccgacgtagatct

SEQ ID NO: 257277 - DNA, 25 bp, Rattus norvegicus
cgagctccgtttgcgacgtagatct

SEQ ID NO: 257278 - DNA, 25 bp, Rattus norvegicus
cgagctctcgatcgccttggtgatg

SEQ ID NO: 257279 - DNA, 25 bp, Rattus norvegicus
cgagctctcgatggccttggtgatg

SEQ ID NO: 257280 - DNA, 25 bp, Rattus norvegicus
cgagctctggttcccatgtaaactt

SEQ ID NO: 257281 - DNA, 25 bp, Rattus norvegicus
cgagctctggttgccatgtaaactt

SEQ ID NO: 257282 - DNA, 25 bp, Rattus norvegicus
cgagctctgtaaaggtccctccaaa

SEQ ID NO: 257283 - DNA, 25 bp, Rattus norvegicus
cgagctctgtaatggtccctccaaa

SEQ ID NO: 257284 - DNA, 25 bp, Rattus norvegicus
cgagctctgtgcagcctatgcaagg

SEQ ID NO: 257285 - DNA, 25 bp, Rattus norvegicus
cgagctctgtgctgcctatgcaagg

SEQ ID NO: 257286 - DNA, 25 bp, Rattus norvegicus
cgagctgacatacgccaggactatt

SEQ ID NO: 257287 - DNA, 25 bp, Rattus norvegicus
cgagctgacataggccaggactatt

SEQ ID NO: 257288 - DNA, 25 bp, Rattus norvegicus
cgagctgaccgaagtggcacactat

SEQ ID NO: 257289 - DNA, 25 bp, Rattus norvegicus
cgagctgaccgatgtggcacactat

SEQ ID NO: 257290 - DNA, 25 bp, Rattus norvegicus
cgagctgatcacaaactcttaggta

SEQ ID NO: 257291 - DNA, 25 bp, Rattus norvegicus
cgagctgatcactaactcttaggta

SEQ ID NO: 257292 - DNA, 25 bp, Rattus norvegicus
cgagctgatgctcgttttgtataca

SEQ ID NO: 257293 - DNA, 25 bp, Rattus norvegicus
cgagctgatgctggttttgtataca

SEQ ID NO: 257294 - DNA, 25 bp, Rattus norvegicus
cgagctgctcggaggcggtggtgca

SEQ ID NO: 257295 - DNA, 25 bp, Rattus norvegicus
cgagctgctcggtggcggtggtgca

SEQ ID NO: 257296 - DNA, 25 bp, Rattus norvegicus
cgagctggagatcgcccatggcctc

SEQ ID NO: 257297 - DNA, 25 bp, Rattus norvegicus
cgagctggagatggcccatggcctc

SEQ ID NO: 257298 - DNA, 25 bp, Rattus norvegicus
cgagctggcagactcccgttgccga

SEQ ID NO: 257299 - DNA, 25 bp, Rattus norvegicus
cgagctggcagagtcccgttgccga

SEQ ID NO: 257300 - DNA, 25 bp, Rattus norvegicus
cgagctggtgctcactggtttatac

SEQ ID NO: 257301 - DNA, 25 bp, Rattus norvegicus
cgagctggtgctgactggtttatac

SEQ ID NO: 257302 - DNA, 25 bp, Rattus norvegicus
cgagctgtcccaatctgagttaaaa

SEQ ID NO: 257303 - DNA, 25 bp, Rattus norvegicus
cgagctgtcccattctgagttaaaa

SEQ ID NO: 257304 - DNA, 25 bp, Rattus norvegicus
cgagctgtgcagatttagtgggtac

SEQ ID NO: 257305 - DNA, 25 bp, Rattus norvegicus
cgagctgtgcagttttagtgggtac

SEQ ID NO: 257306 - DNA, 25 bp, Rattus norvegicus
cgagctgtgtgcctgtgaactgaat

SEQ ID NO: 257307 - DNA, 25 bp, Rattus norvegicus
cgagctgtgtgcgtgtgaactgaat

SEQ ID NO: 257308 - DNA, 25 bp, Rattus norvegicus
cgagcttctacaccacagggctgga

SEQ ID NO: 257309 - DNA, 25 bp, Rattus norvegicus
cgagcttctacagcacagggctgga

SEQ ID NO: 257310 - DNA, 25 bp, Rattus norvegicus
cgagcttctcaacatcaaatcactt

SEQ ID NO: 257311 - DNA, 25 bp, Rattus norvegicus
cgagcttctcaagatcaaatcactt

SEQ ID NO: 257312 - DNA, 25 bp, Rattus norvegicus
cgagcttctggccaatcaatacaac

SEQ ID NO: 257313 - DNA, 25 bp, Rattus norvegicus
cgagcttctggcgaatcaatacaac

SEQ ID NO: 257314 - DNA, 25 bp, Rattus norvegicus
cgagcttcttgccttagtcagtgct

SEQ ID NO: 257315 - DNA, 25 bp, Rattus norvegicus
cgagcttcttgcgttagtcagtgct

SEQ ID NO: 257316 - DNA, 25 bp, Rattus norvegicus
cgaggaagacttaggctttgaagca

SEQ ID NO: 257317 - DNA, 25 bp, Rattus norvegicus
cgaggaagactttggctttgaagca

SEQ ID NO: 257318 - DNA, 25 bp, Rattus norvegicus
cgaggacatacccactgctgataaa

SEQ ID NO: 257319 - DNA, 25 bp, Rattus norvegicus
cgaggacataccgactgctgataaa

SEQ ID NO: 257320 - DNA, 25 bp, Rattus norvegicus
cgaggacatcgacgccggctgttat

SEQ ID NO: 257321 - DNA, 25 bp, Rattus norvegicus
cgaggacatcgaggccggctgttat

SEQ ID NO: 257322 - DNA, 25 bp, Rattus norvegicus
cgaggaccccagatcttcaagaaag

SEQ ID NO: 257323 - DNA, 25 bp, Rattus norvegicus
cgaggaccccagttcttcaagaaag

SEQ ID NO: 257324 - DNA, 25 bp, Rattus norvegicus
cgaggaccctgtaattcctggtagt

SEQ ID NO: 257325 - DNA, 25 bp, Rattus norvegicus
cgaggaccctgttattcctggtagt

SEQ ID NO: 257326 - DNA, 25 bp, Rattus norvegicus
cgaggacctcagattgattttcaga

SEQ ID NO: 257327 - DNA, 25 bp, Rattus norvegicus
cgaggacctcagtttgattttcaga

SEQ ID NO: 257328 - DNA, 25 bp, Rattus norvegicus
cgaggacgtatcaacaggctggcta

SEQ ID NO: 257329 - DNA, 25 bp, Rattus norvegicus
cgaggacgtatctacaggctggcta

SEQ ID NO: 257330 - DNA, 25 bp, Rattus norvegicus
cgaggactagtgctctcacccagag

SEQ ID NO: 257331 - DNA, 25 bp, Rattus norvegicus
cgaggactagtggtctcacccagag

SEQ ID NO: 257332 - DNA, 25 bp, Rattus norvegicus
cgaggactccttagacaacctcggg

SEQ ID NO: 257333 - DNA, 25 bp, Rattus norvegicus
cgaggactcctttgacaacctcggg

SEQ ID NO: 257334 - DNA, 25 bp, Rattus norvegicus
cgaggactcttaagggccgtggact

SEQ ID NO: 257335 - DNA, 25 bp, Rattus norvegicus
cgaggactcttatgggccgtggact

SEQ ID NO: 257336 - DNA, 25 bp, Rattus norvegicus
cgaggactgcctcgatgatctgtat

SEQ ID NO: 257337 - DNA, 25 bp, Rattus norvegicus
cgaggactgcctggatgatctgtat

SEQ ID NO: 257338 - DNA, 25 bp, Rattus norvegicus
cgaggagacagcattgaccgtttat

SEQ ID NO: 257339 - DNA, 25 bp, Rattus norvegicus
cgaggagacagctttgaccgtttat

SEQ ID NO: 257340 - DNA, 25 bp, Rattus norvegicus
cgaggagaccttcaattctgacatt

SEQ ID NO: 257341 - DNA, 25 bp, Rattus norvegicus
cgaggagaccttgaattctgacatt

SEQ ID NO: 257342 - DNA, 25 bp, Rattus norvegicus
cgaggagagcggacgcagccatatt

SEQ ID NO: 257343 - DNA, 25 bp, Rattus norvegicus
cgaggagagcggtcgcagccatatt

SEQ ID NO: 257344 - DNA, 25 bp, Rattus norvegicus
cgaggagatcgaatccctgatgaag

SEQ ID NO: 257345 - DNA, 25 bp, Rattus norvegicus
cgaggagatcgattccctgatgaag

SEQ ID NO: 257346 - DNA, 25 bp, Rattus norvegicus
cgaggagcacaacccgccatagttg

SEQ ID NO: 257347 - DNA, 25 bp, Rattus norvegicus
cgaggagcacaagccgccatagttg

SEQ ID NO: 257348 - DNA, 25 bp, Rattus norvegicus
cgaggagccggcactgagcagttct

SEQ ID NO: 257349 - DNA, 25 bp, Rattus norvegicus
cgaggagccggctctgagcagttct

SEQ ID NO: 257350 - DNA, 25 bp, Rattus norvegicus
cgaggagcctcacctgttggcatga

SEQ ID NO: 257351 - DNA, 25 bp, Rattus norvegicus
cgaggagcctcagctgttggcatga

SEQ ID NO: 257352 - DNA, 25 bp, Rattus norvegicus
cgaggagcggcgattgttcccacaa

SEQ ID NO: 257353 - DNA, 25 bp, Rattus norvegicus
cgaggagcggcgtttgttcccacaa

SEQ ID NO: 257354 - DNA, 25 bp, Rattus norvegicus
cgaggaggacatatacgagctgctt

SEQ ID NO: 257355 - DNA, 25 bp, Rattus norvegicus
cgaggaggacatttacgagctgctt

SEQ ID NO: 257356 - DNA, 25 bp, Rattus norvegicus
cgaggaggacgcaccagcctgtgct

SEQ ID NO: 257357 - DNA, 25 bp, Rattus norvegicus
cgaggaggacgctccagcctgtgct

SEQ ID NO: 257358 - DNA, 25 bp, Rattus norvegicus
cgaggaggcgaaagccgcagccgcg

SEQ ID NO: 257359 - DNA, 25 bp, Rattus norvegicus
cgaggaggcgaatgccgcagccgcg

SEQ ID NO: 257360 - DNA, 25 bp, Rattus norvegicus
cgaggagtactaacggatcgtctta

SEQ ID NO: 257361 - DNA, 25 bp, Rattus norvegicus
cgaggagtactatcggatcgtctta

SEQ ID NO: 257362 - DNA, 25 bp, Rattus norvegicus
cgaggagttgttctcctgagtcaga

SEQ ID NO: 257363 - DNA, 25 bp, Rattus norvegicus
cgaggagttgttgtcctgagtcaga

SEQ ID NO: 257364 - DNA, 25 bp, Rattus norvegicus
cgaggatgaggcatgagttccccag

SEQ ID NO: 257365 - DNA, 25 bp, Rattus norvegicus
cgaggatgaggcttgagttccccag

SEQ ID NO: 257366 - DNA, 25 bp, Rattus norvegicus
cgaggcacacctccgatgaatatta

SEQ ID NO: 257367 - DNA, 25 bp, Rattus norvegicus
cgaggcacacctgcgatgaatatta

SEQ ID NO: 257368 - DNA, 25 bp, Rattus norvegicus
cgaggcaggatcaaccttcaaggta

SEQ ID NO: 257369 - DNA, 25 bp, Rattus norvegicus
cgaggcaggatctaccttcaaggta

SEQ ID NO: 257370 - DNA, 25 bp, Rattus norvegicus
cgaggcaggtgcctgttttacttca

SEQ ID NO: 257371 - DNA, 25 bp, Rattus norvegicus
cgaggcaggtgcgtgttttacttca

SEQ ID NO: 257372 - DNA, 25 bp, Rattus norvegicus
cgaggcatgctgagtagtgcaacaa

SEQ ID NO: 257373 - DNA, 25 bp, Rattus norvegicus
cgaggcatgctgtgtagtgcaacaa

SEQ ID NO: 257374 - DNA, 25 bp, Rattus norvegicus
cgaggcatgcttctgagctgcttct

SEQ ID NO: 257375 - DNA, 25 bp, Rattus norvegicus
cgaggcatgcttgtgagctgcttct

SEQ ID NO: 257376 - DNA, 25 bp, Rattus norvegicus
cgaggccatcttcagactctgtaag

SEQ ID NO: 257377 - DNA, 25 bp, Rattus norvegicus
cgaggccatcttgagactctgtaag

SEQ ID NO: 257378 - DNA, 25 bp, Rattus norvegicus
cgaggcccagagcaactgagtgatt

SEQ ID NO: 257379 - DNA, 25 bp, Rattus norvegicus
cgaggcccagagcaagagaggcatc

SEQ ID NO: 257380 - DNA, 25 bp, Rattus norvegicus
cgaggcccagaggaactgagtgatt

SEQ ID NO: 257381 - DNA, 25 bp, Rattus norvegicus
cgaggcccagaggaagagaggcatc

SEQ ID NO: 257382 - DNA, 25 bp, Rattus norvegicus
cgaggcccagtactagcaagtctta

SEQ ID NO: 257383 - DNA, 25 bp, Rattus norvegicus
cgaggcccagtagtagcaagtctta

SEQ ID NO: 257384 - DNA, 25 bp, Rattus norvegicus
cgaggccgagccagagcagagtgtg

SEQ ID NO: 257385 - DNA, 25 bp, Rattus norvegicus
cgaggccgagcctgagcagagtgtg

SEQ ID NO: 257386 - DNA, 25 bp, Rattus norvegicus
cgaggccgggagctgcagacagaca

SEQ ID NO: 257387 - DNA, 25 bp, Rattus norvegicus
cgaggccgggaggtgcagacagaca

SEQ ID NO: 257388 - DNA, 25 bp, Rattus norvegicus
cgaggcgtctttctcctggaagaat

SEQ ID NO: 257389 - DNA, 25 bp, Rattus norvegicus
cgaggcgtctttgtcctggaagaat

SEQ ID NO: 257390 - DNA, 25 bp, Rattus norvegicus
cgaggctacatgagaccacgtctaa

SEQ ID NO: 257391 - DNA, 25 bp, Rattus norvegicus
cgaggctacatgtgaccacgtctaa

SEQ ID NO: 257392 - DNA, 25 bp, Rattus norvegicus
cgaggctatcgcagtcaggactgtg

SEQ ID NO: 257393 - DNA, 25 bp, Rattus norvegicus
cgaggctatcgctgtcaggactgtg

SEQ ID NO: 257394 - DNA, 25 bp, Rattus norvegicus
cgaggctccgtgacacacaataaag

SEQ ID NO: 257395 - DNA, 25 bp, Rattus norvegicus
cgaggctccgtgtcacacaataaag

SEQ ID NO: 257396 - DNA, 25 bp, Rattus norvegicus
cgaggctcctccaaagggacaataa

SEQ ID NO: 257397 - DNA, 25 bp, Rattus norvegicus
cgaggctcctcctaagggacaataa

SEQ ID NO: 257398 - DNA, 25 bp, Rattus norvegicus
cgaggctctgtgagcatggtactca

SEQ ID NO: 257399 - DNA, 25 bp, Rattus norvegicus
cgaggctctgtgtgcatggtactca

SEQ ID NO: 257400 - DNA, 25 bp, Rattus norvegicus
cgaggctgagcgactgtgtaattgt

SEQ ID NO: 257401 - DNA, 25 bp, Rattus norvegicus
cgaggctgagcgtctgtgtaattgt

SEQ ID NO: 257402 - DNA, 25 bp, Rattus norvegicus
cgaggctgcgcaaagtatgcggccc

SEQ ID NO: 257403 - DNA, 25 bp, Rattus norvegicus
cgaggctgcgcatagtatgcggccc

SEQ ID NO: 257404 - DNA, 25 bp, Rattus norvegicus
cgaggctggtacagttctggtttgc

SEQ ID NO: 257405 - DNA, 25 bp, Rattus norvegicus
cgaggctggtactgttctggtttgc

SEQ ID NO: 257406 - DNA, 25 bp, Rattus norvegicus
cgaggctgtcccatctcatgactca

SEQ ID NO: 257407 - DNA, 25 bp, Rattus norvegicus
cgaggctgtcccttctcatgactca

SEQ ID NO: 257408 - DNA, 25 bp, Rattus norvegicus
cgaggctgtggaagcttacgcgaca

SEQ ID NO: 257409 - DNA, 25 bp, Rattus norvegicus
cgaggctgtggatgcttacgcgaca

SEQ ID NO: 257410 - DNA, 25 bp, Rattus norvegicus
cgaggctgtgttactacgtggagtt

SEQ ID NO: 257411 - DNA, 25 bp, Rattus norvegicus
cgaggctgtgtttctacgtggagtt

SEQ ID NO: 257412 - DNA, 25 bp, Rattus norvegicus
cgaggcttcctgatatgctgtataa

SEQ ID NO: 257413 - DNA, 25 bp, Rattus norvegicus
cgaggcttcctgttatgctgtataa

SEQ ID NO: 257414 - DNA, 25 bp, Rattus norvegicus
cgaggcttcggccacaggaacagga

SEQ ID NO: 257415 - DNA, 25 bp, Rattus norvegicus
cgaggcttcggcgacaggaacagga

SEQ ID NO: 257416 - DNA, 25 bp, Rattus norvegicus
cgaggcttgaagactcttgcacaga

SEQ ID NO: 257417 - DNA, 25 bp, Rattus norvegicus
cgaggcttgaagtctcttgcacaga

SEQ ID NO: 257418 - DNA, 25 bp, Rattus norvegicus
cgaggcttgtttaattcctgtgcaa

SEQ ID NO: 257419 - DNA, 25 bp, Rattus norvegicus
cgaggcttgttttattcctgtgcaa

SEQ ID NO: 257420 - DNA, 25 bp, Rattus norvegicus
cgaggctttgctattcttatgatct

SEQ ID NO: 257421 - DNA, 25 bp, Rattus norvegicus
cgaggctttgcttttcttatgatct

SEQ ID NO: 257422 - DNA, 25 bp, Rattus norvegicus
cgagggaacattcccgggtgcgcca

SEQ ID NO: 257423 - DNA, 25 bp, Rattus norvegicus
cgagggaacattgccgggtgcgcca

SEQ ID NO: 257424 - DNA, 25 bp, Rattus norvegicus
cgagggaccagacgatgtgctgcaa

SEQ ID NO: 257425 - DNA, 25 bp, Rattus norvegicus
cgagggaccagaggatgtgctgcaa

SEQ ID NO: 257426 - DNA, 25 bp, Rattus norvegicus
cgagggaccccactctttagcatga

SEQ ID NO: 257427 - DNA, 25 bp, Rattus norvegicus
cgagggaccccagtctttagcatga

SEQ ID NO: 257428 - DNA, 25 bp, Rattus norvegicus
cgagggacgccgaactgagatgcaa

SEQ ID NO: 257429 - DNA, 25 bp, Rattus norvegicus
cgagggacgccgtactgagatgcaa

SEQ ID NO: 257430 - DNA, 25 bp, Rattus norvegicus
cgagggagctcaccgggcttcctca

SEQ ID NO: 257431 - DNA, 25 bp, Rattus norvegicus
cgagggagctcagcgggcttcctca

SEQ ID NO: 257432 - DNA, 25 bp, Rattus norvegicus
cgagggaggtcaccacggacgcgtg

SEQ ID NO: 257433 - DNA, 25 bp, Rattus norvegicus
cgagggaggtcagcacggacgcgtg

SEQ ID NO: 257434 - DNA, 25 bp, Rattus norvegicus
cgagggagtcacctctaatattttg

SEQ ID NO: 257435 - DNA, 25 bp, Rattus norvegicus
cgagggagtcacgtctaatattttg

SEQ ID NO: 257436 - DNA, 25 bp, Rattus norvegicus
cgagggatacaacccgtactacatc

SEQ ID NO: 257437 - DNA, 25 bp, Rattus norvegicus
cgagggatacaagccgtactacatc

SEQ ID NO: 257438 - DNA, 25 bp, Rattus norvegicus
cgagggcaccatccccttcagtaag

SEQ ID NO: 257439 - DNA, 25 bp, Rattus norvegicus
cgagggcaccatgcccttcagtaag

SEQ ID NO: 257440 - DNA, 25 bp, Rattus norvegicus
cgagggccacatatactctacagtg

SEQ ID NO: 257441 - DNA, 25 bp, Rattus norvegicus
cgagggccacatttactctacagtg

SEQ ID NO: 257442 - DNA, 25 bp, Rattus norvegicus
cgagggccagctcctgtaggttcca

SEQ ID NO: 257443 - DNA, 25 bp, Rattus norvegicus
cgagggccagctgctgtaggttcca

SEQ ID NO: 257444 - DNA, 25 bp, Rattus norvegicus
cgagggcgtcccagttcaagaagga

SEQ ID NO: 257445 - DNA, 25 bp, Rattus norvegicus
cgagggcgtccctgttcaagaagga

SEQ ID NO: 257446 - DNA, 25 bp, Rattus norvegicus
cgagggctacatccgacagtgtcgt

SEQ ID NO: 257447 - DNA, 25 bp, Rattus norvegicus
cgagggctacatgcgacagtgtcgt

SEQ ID NO: 257448 - DNA, 25 bp, Rattus norvegicus
cgagggctgaccaggcctaaaaagg

SEQ ID NO: 257449 - DNA, 25 bp, Rattus norvegicus
cgagggctgacctggcctaaaaagg

SEQ ID NO: 257450 - DNA, 25 bp, Rattus norvegicus
cgaggggtccagcaggtctccaaat

SEQ ID NO: 257451 - DNA, 25 bp, Rattus norvegicus
cgaggggtccaggaggtctccaaat

SEQ ID NO: 257452 - DNA, 25 bp, Rattus norvegicus
cgaggtagtagaccttacagaaata

SEQ ID NO: 257453 - DNA, 25 bp, Rattus norvegicus
cgaggtagtagagcttacagaaata

SEQ ID NO: 257454 - DNA, 25 bp, Rattus norvegicus
cgaggtcactttccctaacatttgt

SEQ ID NO: 257455 - DNA, 25 bp, Rattus norvegicus
cgaggtcactttgcctaacatttgt

SEQ ID NO: 257456 - DNA, 25 bp, Rattus norvegicus
cgaggtcagggtccccatgagcatc

SEQ ID NO: 257457 - DNA, 25 bp, Rattus norvegicus
cgaggtcagggtgcccatgagcatc

SEQ ID NO: 257458 - DNA, 25 bp, Rattus norvegicus
cgaggtcccattctgatgttgcagt

SEQ ID NO: 257459 - DNA, 25 bp, Rattus norvegicus
cgaggtcccattgtgatgttgcagt

SEQ ID NO: 257460 - DNA, 25 bp, Rattus norvegicus
cgaggtctcgcaccaaagcctggtg

SEQ ID NO: 257461 - DNA, 25 bp, Rattus norvegicus
cgaggtctcgcagcaaagcctggtg

SEQ ID NO: 257462 - DNA, 25 bp, Rattus norvegicus
cgaggtctggtcatgctttcttttt

SEQ ID NO: 257463 - DNA, 25 bp, Rattus norvegicus
cgaggtctggtcttgctttcttttt

SEQ ID NO: 257464 - DNA, 25 bp, Rattus norvegicus
cgaggtcttcgccagccaggtgtct

SEQ ID NO: 257465 - DNA, 25 bp, Rattus norvegicus
cgaggtcttcgcgagccaggtgtct

SEQ ID NO: 257466 - DNA, 25 bp, Rattus norvegicus
cgaggtgcccgcaaatagctagcat

SEQ ID NO: 257467 - DNA, 25 bp, Rattus norvegicus
cgaggtgcccgctaatagctagcat

SEQ ID NO: 257468 - DNA, 25 bp, Rattus norvegicus
cgaggtggaataactgtcctctaag

SEQ ID NO: 257469 - DNA, 25 bp, Rattus norvegicus
cgaggtggaatatctgtcctctaag

SEQ ID NO: 257470 - DNA, 25 bp, Rattus norvegicus
cgaggttcacacaaaagtcataagt

SEQ ID NO: 257471 - DNA, 25 bp, Rattus norvegicus
cgaggttcacactaaagtcataagt

SEQ ID NO: 257472 - DNA, 25 bp, Rattus norvegicus
cgaggttgcctcaccctgtgaggat

SEQ ID NO: 257473 - DNA, 25 bp, Rattus norvegicus
cgaggttgcctctccctgtgaggat

SEQ ID NO: 257474 - DNA, 25 bp, Rattus norvegicus
cgaggttttactctcaggttgtgga

SEQ ID NO: 257475 - DNA, 25 bp, Rattus norvegicus
cgaggttttactgtcaggttgtgga

SEQ ID NO: 257476 - DNA, 25 bp, Rattus norvegicus
cgagtaactactattatctaaatat

SEQ ID NO: 257477 - DNA, 25 bp, Rattus norvegicus
cgagtaactacttttatctaaatat

SEQ ID NO: 257478 - DNA, 25 bp, Rattus norvegicus
cgagtaactgtgagaccaccgtcaa

SEQ ID NO: 257479 - DNA, 25 bp, Rattus norvegicus
cgagtaactgtgtgaccaccgtcaa

SEQ ID NO: 257480 - DNA, 25 bp, Rattus norvegicus
cgagtaactttccatgtgcttttct

SEQ ID NO: 257481 - DNA, 25 bp, Rattus norvegicus
cgagtaactttcgatgtgcttttct

SEQ ID NO: 257482 - DNA, 25 bp, Rattus norvegicus
cgagtactgactactttctctagtg

SEQ ID NO: 257483 - DNA, 25 bp, Rattus norvegicus
cgagtactgacttctttctctagtg

SEQ ID NO: 257484 - DNA, 25 bp, Rattus norvegicus
cgagtagtatggaaacttggcatct

SEQ ID NO: 257485 - DNA, 25 bp, Rattus norvegicus
cgagtagtatggtaacttggcatct

SEQ ID NO: 257486 - DNA, 25 bp, Rattus norvegicus
cgagtatcagatagacaccgcgtct

SEQ ID NO: 257487 - DNA, 25 bp, Rattus norvegicus
cgagtatcagattgacaccgcgtct

SEQ ID NO: 257488 - DNA, 25 bp, Rattus norvegicus
cgagtatccctgcatagactggaac

SEQ ID NO: 257489 - DNA, 25 bp, Rattus norvegicus
cgagtatccctggatagactggaac

SEQ ID NO: 257490 - DNA, 25 bp, Rattus norvegicus
cgagtatgcgctcatggctgccatg

SEQ ID NO: 257491 - DNA, 25 bp, Rattus norvegicus
cgagtatgcgctgatggctgccatg

SEQ ID NO: 257492 - DNA, 25 bp, Rattus norvegicus
cgagtattccgcacgaattagtgga

SEQ ID NO: 257493 - DNA, 25 bp, Rattus norvegicus
cgagtattccgctcgaattagtgga

SEQ ID NO: 257494 - DNA, 25 bp, Rattus norvegicus
cgagtcacctgcagatggcgaggtt

SEQ ID NO: 257495 - DNA, 25 bp, Rattus norvegicus
cgagtcacctgctgatggcgaggtt

SEQ ID NO: 257496 - DNA, 25 bp, Rattus norvegicus
cgagtcaggcccacgtgtagagcga

SEQ ID NO: 257497 - DNA, 25 bp, Rattus norvegicus
cgagtcaggccctcgtgtagagcga

SEQ ID NO: 257498 - DNA, 25 bp, Rattus norvegicus
cgagtccctcttcctattaactata

SEQ ID NO: 257499 - DNA, 25 bp, Rattus norvegicus
cgagtccctcttgctattaactata

SEQ ID NO: 257500 - DNA, 25 bp, Rattus norvegicus
cgagtccttttgaccaagatggcgg

SEQ ID NO: 257501 - DNA, 25 bp, Rattus norvegicus
cgagtccttttgtccaagatggcgg

SEQ ID NO: 257502 - DNA, 25 bp, Rattus norvegicus
cgagtcgcccacagtgtttagaaat

SEQ ID NO: 257503 - DNA, 25 bp, Rattus norvegicus
cgagtcgcccactgtgtttagaaat

SEQ ID NO: 257504 - DNA, 25 bp, Rattus norvegicus
cgagtcgctttcactaggtgtaatt

SEQ ID NO: 257505 - DNA, 25 bp, Rattus norvegicus
cgagtcgctttctctaggtgtaatt

SEQ ID NO: 257506 - DNA, 25 bp, Rattus norvegicus
cgagtcggagaaccggccgttcatc

SEQ ID NO: 257507 - DNA, 25 bp, Rattus norvegicus
cgagtcggagaagcggccgttcatc

SEQ ID NO: 257508 - DNA, 25 bp, Rattus norvegicus
cgagtctctaagcttccactgaaaa

SEQ ID NO: 257509 - DNA, 25 bp, Rattus norvegicus
cgagtctctaaggttccactgaaaa

SEQ ID NO: 257510 - DNA, 25 bp, Rattus norvegicus
cgagtctctggaaaatggagagcaa

SEQ ID NO: 257511 - DNA, 25 bp, Rattus norvegicus
cgagtctctggataatggagagcaa

SEQ ID NO: 257512 - DNA, 25 bp, Rattus norvegicus
cgagtctgaggtacgtcaactttcg

SEQ ID NO: 257513 - DNA, 25 bp, Rattus norvegicus
cgagtctgaggttcgtcaactttcg

SEQ ID NO: 257514 - DNA, 25 bp, Rattus norvegicus
cgagtctggcacagagcaggctctg

SEQ ID NO: 257515 - DNA, 25 bp, Rattus norvegicus
cgagtctggcactgagcaggctctg

SEQ ID NO: 257516 - DNA, 25 bp, Rattus norvegicus
cgagtgacagccaggcagggacctt

SEQ ID NO: 257517 - DNA, 25 bp, Rattus norvegicus
cgagtgacagcctggcagggacctt

SEQ ID NO: 257518 - DNA, 25 bp, Rattus norvegicus
cgagtgacccaaccggatgcatttg

SEQ ID NO: 257519 - DNA, 25 bp, Rattus norvegicus
cgagtgacccaagcggatgcatttg

SEQ ID NO: 257520 - DNA, 25 bp, Rattus norvegicus
cgagtgagtgcaatccggctttgga

SEQ ID NO: 257521 - DNA, 25 bp, Rattus norvegicus
cgagtgagtgcattccggctttgga

SEQ ID NO: 257522 - DNA, 25 bp, Rattus norvegicus
cgagtgcatactctgctgctttgag

SEQ ID NO: 257523 - DNA, 25 bp, Rattus norvegicus
cgagtgcatactgtgctgctttgag

SEQ ID NO: 257524 - DNA, 25 bp, Rattus norvegicus
cgagtgctttatattcttgtggtac

SEQ ID NO: 257525 - DNA, 25 bp, Rattus norvegicus
cgagtgctttattttcttgtggtac

SEQ ID NO: 257526 - DNA, 25 bp, Rattus norvegicus
cgagtgggcacacgtgtccttccca

SEQ ID NO: 257527 - DNA, 25 bp, Rattus norvegicus
cgagtgggcacaggtgtccttccca

SEQ ID NO: 257528 - DNA, 25 bp, Rattus norvegicus
cgagtgggcgttatcaggtgccaac

SEQ ID NO: 257529 - DNA, 25 bp, Rattus norvegicus
cgagtgggcgttttcaggtgccaac

SEQ ID NO: 257530 - DNA, 25 bp, Rattus norvegicus
cgagtgggtcacagcggcagataaa

SEQ ID NO: 257531 - DNA, 25 bp, Rattus norvegicus
cgagtgggtcactgcggcagataaa

SEQ ID NO: 257532 - DNA, 25 bp, Rattus norvegicus
cgagtggtctcacaagtgccttcaa

SEQ ID NO: 257533 - DNA, 25 bp, Rattus norvegicus
cgagtggtctcagaagtgccttcaa

SEQ ID NO: 257534 - DNA, 25 bp, Rattus norvegicus
cgagtgtccgcaagcatgtggagtt

SEQ ID NO: 257535 - DNA, 25 bp, Rattus norvegicus
cgagtgtccgcatgcatgtggagtt

SEQ ID NO: 257536 - DNA, 25 bp, Rattus norvegicus
cgagtgtttgacagtagtggcttct

SEQ ID NO: 257537 - DNA, 25 bp, Rattus norvegicus
cgagtgtttgactgtagtggcttct

SEQ ID NO: 257538 - DNA, 25 bp, Rattus norvegicus
cgagttacctggacgttctgggcta

SEQ ID NO: 257539 - DNA, 25 bp, Rattus norvegicus
cgagttacctggtcgttctgggcta

SEQ ID NO: 257540 - DNA, 25 bp, Rattus norvegicus
cgagttacctttctttgtatttcag

SEQ ID NO: 257541 - DNA, 25 bp, Rattus norvegicus
cgagttacctttgtttgtatttcag

SEQ ID NO: 257542 - DNA, 25 bp, Rattus norvegicus
cgagttagagatccttagtacgcct

SEQ ID NO: 257543 - DNA, 25 bp, Rattus norvegicus
cgagttagagatgcttagtacgcct

SEQ ID NO: 257544 - DNA, 25 bp, Rattus norvegicus
cgagttcaaagccatacacagctat

SEQ ID NO: 257545 - DNA, 25 bp, Rattus norvegicus
cgagttcaaagcgatacacagctat

SEQ ID NO: 257546 - DNA, 25 bp, Rattus norvegicus
cgagttcaggcccaagttcaggtct

SEQ ID NO: 257547 - DNA, 25 bp, Rattus norvegicus
cgagttcaggccgaagttcaggtct

SEQ ID NO: 257548 - DNA, 25 bp, Rattus norvegicus
cgagttcgtccactggtaccagaaa

SEQ ID NO: 257549 - DNA, 25 bp, Rattus norvegicus
cgagttcgtccagtggtaccagaaa

SEQ ID NO: 257550 - DNA, 25 bp, Rattus norvegicus
cgagttctatttatacatgcagctt

SEQ ID NO: 257551 - DNA, 25 bp, Rattus norvegicus
cgagttctatttttacatgcagctt

SEQ ID NO: 257552 - DNA, 25 bp, Rattus norvegicus
cgagttctctctcgatgtgccttaa

SEQ ID NO: 257553 - DNA, 25 bp, Rattus norvegicus
cgagttctctctggatgtgccttaa

SEQ ID NO: 257554 - DNA, 25 bp, Rattus norvegicus
cgagttctgcttccggtgctaaagc

SEQ ID NO: 257555 - DNA, 25 bp, Rattus norvegicus
cgagttctgcttgcggtgctaaagc

SEQ ID NO: 257556 - DNA, 25 bp, Rattus norvegicus
cgagttgatgcccacaggtgtattg

SEQ ID NO: 257557 - DNA, 25 bp, Rattus norvegicus
cgagttgatgccgacaggtgtattg

SEQ ID NO: 257558 - DNA, 25 bp, Rattus norvegicus
cgagttgcctctcctgctgcaaagt

SEQ ID NO: 257559 - DNA, 25 bp, Rattus norvegicus
cgagttgcctctgctgctgcaaagt

SEQ ID NO: 257560 - DNA, 25 bp, Rattus norvegicus
cgagtttgggccatggtgtcacagt

SEQ ID NO: 257561 - DNA, 25 bp, Rattus norvegicus
cgagtttgggccttggtgtcacagt

SEQ ID NO: 257562 - DNA, 25 bp, Rattus norvegicus
cgagtttttctcagatttccacatg

SEQ ID NO: 257563 - DNA, 25 bp, Rattus norvegicus
cgagtttttctctgatttccacatg

SEQ ID NO: 257564 - DNA, 25 bp, Rattus norvegicus
cgataaccgagtcggctagggacca

SEQ ID NO: 257565 - DNA, 25 bp, Rattus norvegicus
cgataaccgagtgggctagggacca

SEQ ID NO: 257566 - DNA, 25 bp, Rattus norvegicus
cgataacttcatcagctgcttggtc

SEQ ID NO: 257567 - DNA, 25 bp, Rattus norvegicus
cgataacttcatgagctgcttggtc

SEQ ID NO: 257568 - DNA, 25 bp, Rattus norvegicus
cgataagcccaacactctcaaaatg

SEQ ID NO: 257569 - DNA, 25 bp, Rattus norvegicus
cgataagcccaagactctcaaaatg

SEQ ID NO: 257570 - DNA, 25 bp, Rattus norvegicus
cgataatgcacaacaacacccaagc

SEQ ID NO: 257571 - DNA, 25 bp, Rattus norvegicus
cgataatgcacatcaacacccaagc

SEQ ID NO: 257572 - DNA, 25 bp, Rattus norvegicus
cgatacaaggtgcagggcttcccca

SEQ ID NO: 257573 - DNA, 25 bp, Rattus norvegicus
cgatacaaggtggagggcttcccca

SEQ ID NO: 257574 - DNA, 25 bp, Rattus norvegicus
cgataccgcttcactgggaggcaga

SEQ ID NO: 257575 - DNA, 25 bp, Rattus norvegicus
cgataccgcttctctgggaggcaga

SEQ ID NO: 257576 - DNA, 25 bp, Rattus norvegicus
cgatactgctgtacacacatgtgat

SEQ ID NO: 257577 - DNA, 25 bp, Rattus norvegicus
cgatactgctgtccatgaggccctg

SEQ ID NO: 257578 - DNA, 25 bp, Rattus norvegicus
cgatactgctgtgcatgaggccctg

SEQ ID NO: 257579 - DNA, 25 bp, Rattus norvegicus
cgatactgctgttcacacatgtgat

SEQ ID NO: 257580 - DNA, 25 bp, Rattus norvegicus
cgatagagaattcccgcggagagca

SEQ ID NO: 257581 - DNA, 25 bp, Rattus norvegicus
cgatagagaattgccgcggagagca

SEQ ID NO: 257582 - DNA, 25 bp, Rattus norvegicus
cgatagaggtcgagcgcgaagccca

SEQ ID NO: 257583 - DNA, 25 bp, Rattus norvegicus
cgatagaggtcgtgcgcgaagccca

SEQ ID NO: 257584 - DNA, 25 bp, Rattus norvegicus
cgatagctccccagagtctgactgg

SEQ ID NO: 257585 - DNA, 25 bp, Rattus norvegicus
cgatagctcccctgagtctgactgg

SEQ ID NO: 257586 - DNA, 25 bp, Rattus norvegicus
cgatatactggtcggacatgctgtc

SEQ ID NO: 257587 - DNA, 25 bp, Rattus norvegicus
cgatatactggtgggacatgctgtc

SEQ ID NO: 257588 - DNA, 25 bp, Rattus norvegicus
cgatatcctgcaaatccgatattta

SEQ ID NO: 257589 - DNA, 25 bp, Rattus norvegicus
cgatatcctgcatatccgatattta

SEQ ID NO: 257590 - DNA, 25 bp, Rattus norvegicus
cgatatgtcataacctgaggctctt

SEQ ID NO: 257591 - DNA, 25 bp, Rattus norvegicus
cgatatgtcatatcctgaggctctt

SEQ ID NO: 257592 - DNA, 25 bp, Rattus norvegicus
cgatatgttccccaggaggccgccg

SEQ ID NO: 257593 - DNA, 25 bp, Rattus norvegicus
cgatatgttcccgaggaggccgccg

SEQ ID NO: 257594 - DNA, 25 bp, Rattus norvegicus
cgatattctgttcttcacttgggac

SEQ ID NO: 257595 - DNA, 25 bp, Rattus norvegicus
cgatattctgttgttcacttgggac

SEQ ID NO: 257596 - DNA, 25 bp, Rattus norvegicus
cgatcaaagaagaactcacagcccc

SEQ ID NO: 257597 - DNA, 25 bp, Rattus norvegicus
cgatcaaagaagtactcacagcccc

SEQ ID NO: 257598 - DNA, 25 bp, Rattus norvegicus
cgatcaaatcgtccacatttttgga

SEQ ID NO: 257599 - DNA, 25 bp, Rattus norvegicus
cgatcaaatcgtgcacatttttgga

SEQ ID NO: 257600 - DNA, 25 bp, Rattus norvegicus
cgatcaccaggcctgtccgaagagc

SEQ ID NO: 257601 - DNA, 25 bp, Rattus norvegicus
cgatcaccaggcgtgtccgaagagc

SEQ ID NO: 257602 - DNA, 25 bp, Rattus norvegicus
cgatcactgttgagactgacggctg

SEQ ID NO: 257603 - DNA, 25 bp, Rattus norvegicus
cgatcactgttgtgactgacggctg

SEQ ID NO: 257604 - DNA, 25 bp, Rattus norvegicus
cgatcagcggcgcatgtctgaaatt

SEQ ID NO: 257605 - DNA, 25 bp, Rattus norvegicus
cgatcagcggcggatgtctgaaatt

SEQ ID NO: 257606 - DNA, 25 bp, Rattus norvegicus
cgatcagtccttcttttagctttag

SEQ ID NO: 257607 - DNA, 25 bp, Rattus norvegicus
cgatcagtccttgttttagctttag

SEQ ID NO: 257608 - DNA, 25 bp, Rattus norvegicus
cgatcattggcgacatcaacacggt

SEQ ID NO: 257609 - DNA, 25 bp, Rattus norvegicus
cgatcattggcgtcatcaacacggt

SEQ ID NO: 257610 - DNA, 25 bp, Rattus norvegicus
cgatccacctgacctttgacataga

SEQ ID NO: 257611 - DNA, 25 bp, Rattus norvegicus
cgatccacctgagctttgacataga

SEQ ID NO: 257612 - DNA, 25 bp, Rattus norvegicus
cgatcccaacaccttcaatgagtaa

SEQ ID NO: 257613 - DNA, 25 bp, Rattus norvegicus
cgatcccaacacgttcaatgagtaa

SEQ ID NO: 257614 - DNA, 25 bp, Rattus norvegicus
cgatcccagtctccctgattaatac

SEQ ID NO: 257615 - DNA, 25 bp, Rattus norvegicus
cgatcccagtctgcctgattaatac

SEQ ID NO: 257616 - DNA, 25 bp, Rattus norvegicus
cgatcccgaggccagagcgagctct

SEQ ID NO: 257617 - DNA, 25 bp, Rattus norvegicus
cgatcccgaggcgagagcgagctct

SEQ ID NO: 257618 - DNA, 25 bp, Rattus norvegicus
cgatccgaggtgcagctgtgcatcc

SEQ ID NO: 257619 - DNA, 25 bp, Rattus norvegicus
cgatccgaggtggagctgtgcatcc

SEQ ID NO: 257620 - DNA, 25 bp, Rattus norvegicus
cgatcctcgtcacgtgcaggtcagc

SEQ ID NO: 257621 - DNA, 25 bp, Rattus norvegicus
cgatcctcgtcaggtgcaggtcagc

SEQ ID NO: 257622 - DNA, 25 bp, Rattus norvegicus
cgatcctttgtgatctctgagagca

SEQ ID NO: 257623 - DNA, 25 bp, Rattus norvegicus
cgatcctttgtgttctctgagagca

SEQ ID NO: 257624 - DNA, 25 bp, Rattus norvegicus
cgatcgagacgtacaggcagcagca

SEQ ID NO: 257625 - DNA, 25 bp, Rattus norvegicus
cgatcgagacgttcaggcagcagca

SEQ ID NO: 257626 - DNA, 25 bp, Rattus norvegicus
cgatcgccccggagggagcttagaa

SEQ ID NO: 257627 - DNA, 25 bp, Rattus norvegicus
cgatcgccccggtgggagcttagaa

SEQ ID NO: 257628 - DNA, 25 bp, Rattus norvegicus
cgatcgcgcgggagtgaagttactt

SEQ ID NO: 257629 - DNA, 25 bp, Rattus norvegicus
cgatcgcgcgggtgtgaagttactt

SEQ ID NO: 257630 - DNA, 25 bp, Rattus norvegicus
cgatcgctacagaggccgggagccc

SEQ ID NO: 257631 - DNA, 25 bp, Rattus norvegicus
cgatcgctacagtggccgggagccc

SEQ ID NO: 257632 - DNA, 25 bp, Rattus norvegicus
cgatcgcttggtccctgttgaggac

SEQ ID NO: 257633 - DNA, 25 bp, Rattus norvegicus
cgatcgcttggtgcctgttgaggac

SEQ ID NO: 257634 - DNA, 25 bp, Rattus norvegicus
cgatcggcagccagagaagcagcag

SEQ ID NO: 257635 - DNA, 25 bp, Rattus norvegicus
cgatcggcagcctgagaagcagcag

SEQ ID NO: 257636 - DNA, 25 bp, Rattus norvegicus
cgatcgtggtctccaagcctgaaga

SEQ ID NO: 257637 - DNA, 25 bp, Rattus norvegicus
cgatcgtggtctgcaagcctgaaga

SEQ ID NO: 257638 - DNA, 25 bp, Rattus norvegicus
cgatctaggctgagcttttggtgat

SEQ ID NO: 257639 - DNA, 25 bp, Rattus norvegicus
cgatctaggctgagtgactgctgtt

SEQ ID NO: 257640 - DNA, 25 bp, Rattus norvegicus
cgatctaggctgtgcttttggtgat

SEQ ID NO: 257641 - DNA, 25 bp, Rattus norvegicus
cgatctaggctgtgtgactgctgtt

SEQ ID NO: 257642 - DNA, 25 bp, Rattus norvegicus
cgatctattggaccccagttctgga

SEQ ID NO: 257643 - DNA, 25 bp, Rattus norvegicus
cgatctattggagcccagttctgga

SEQ ID NO: 257644 - DNA, 25 bp, Rattus norvegicus
cgatctcaagagagctgcgacggga

SEQ ID NO: 257645 - DNA, 25 bp, Rattus norvegicus
cgatctcaagagtgctgcgacggga

SEQ ID NO: 257646 - DNA, 25 bp, Rattus norvegicus
cgatctcctcggcagaacattccag

SEQ ID NO: 257647 - DNA, 25 bp, Rattus norvegicus
cgatctcctcgggagaacattccag

SEQ ID NO: 257648 - DNA, 25 bp, Rattus norvegicus
cgatctcgtctgatctcggaagcta

SEQ ID NO: 257649 - DNA, 25 bp, Rattus norvegicus
cgatctcgtctgttctcggaagcta

SEQ ID NO: 257650 - DNA, 25 bp, Rattus norvegicus
cgatctctatacctacttcaccatg

SEQ ID NO: 257651 - DNA, 25 bp, Rattus norvegicus
cgatctctatacgtacttcaccatg

SEQ ID NO: 257652 - DNA, 25 bp, Rattus norvegicus
cgatcttgaactcgcgtttgccata

SEQ ID NO: 257653 - DNA, 25 bp, Rattus norvegicus
cgatcttgaactggcgtttgccata

SEQ ID NO: 257654 - DNA, 25 bp, Rattus norvegicus
cgatcttggcaactttctcgtactt

SEQ ID NO: 257655 - DNA, 25 bp, Rattus norvegicus
cgatcttggcaagtttctcgtactt

SEQ ID NO: 257656 - DNA, 25 bp, Rattus norvegicus
cgatcttgtacactggaggccgtca

SEQ ID NO: 257657 - DNA, 25 bp, Rattus norvegicus
cgatcttgtacagtggaggccgtca

SEQ ID NO: 257658 - DNA, 25 bp, Rattus norvegicus
cgatgaacatgtaacttcccttgcc

SEQ ID NO: 257659 - DNA, 25 bp, Rattus norvegicus
cgatgaacatgttacttcccttgcc

SEQ ID NO: 257660 - DNA, 25 bp, Rattus norvegicus
cgatgaaccttgagtcgggccaact

SEQ ID NO: 257661 - DNA, 25 bp, Rattus norvegicus
cgatgaaccttgtgtcgggccaact

SEQ ID NO: 257662 - DNA, 25 bp, Rattus norvegicus
cgatgaagctacagtccgaggaggt

SEQ ID NO: 257663 - DNA, 25 bp, Rattus norvegicus
cgatgaagctactgtccgaggaggt

SEQ ID NO: 257664 - DNA, 25 bp, Rattus norvegicus
cgatgacattgaattagaagctgaa

SEQ ID NO: 257665 - DNA, 25 bp, Rattus norvegicus
cgatgacattgatttagaagctgaa

SEQ ID NO: 257666 - DNA, 25 bp, Rattus norvegicus
cgatgaccctttatctctagtgaag

SEQ ID NO: 257667 - DNA, 25 bp, Rattus norvegicus
cgatgaccctttttctctagtgaag

SEQ ID NO: 257668 - DNA, 25 bp, Rattus norvegicus
cgatgacctggaagagactttggct

SEQ ID NO: 257669 - DNA, 25 bp, Rattus norvegicus
cgatgacctggaagatgaagtctat

SEQ ID NO: 257670 - DNA, 25 bp, Rattus norvegicus
cgatgacctggatgagactttggct

SEQ ID NO: 257671 - DNA, 25 bp, Rattus norvegicus
cgatgacctggatgatgaagtctat

SEQ ID NO: 257672 - DNA, 25 bp, Rattus norvegicus
cgatgacgtcacagggtctgtgaaa

SEQ ID NO: 257673 - DNA, 25 bp, Rattus norvegicus
cgatgacgtcactgggtctgtgaaa

SEQ ID NO: 257674 - DNA, 25 bp, Rattus norvegicus
cgatgagaacatagcctgggccgga

SEQ ID NO: 257675 - DNA, 25 bp, Rattus norvegicus
cgatgagaacattgcctgggccgga

SEQ ID NO: 257676 - DNA, 25 bp, Rattus norvegicus
cgatgagaatcaagttcgtgtgtct

SEQ ID NO: 257677 - DNA, 25 bp, Rattus norvegicus
cgatgagaatcatgttcgtgtgtct

SEQ ID NO: 257678 - DNA, 25 bp, Rattus norvegicus
cgatgagactctccggctctggcgc

SEQ ID NO: 257679 - DNA, 25 bp, Rattus norvegicus
cgatgagactctgcggctctggcgc

SEQ ID NO: 257680 - DNA, 25 bp, Rattus norvegicus
cgatgagagagtctgcagatatgac

SEQ ID NO: 257681 - DNA, 25 bp, Rattus norvegicus
cgatgagagagtgtgcagatatgac

SEQ ID NO: 257682 - DNA, 25 bp, Rattus norvegicus
cgatgagagcggaaacccctttggg

SEQ ID NO: 257683 - DNA, 25 bp, Rattus norvegicus
cgatgagagcggtaacccctttggg

SEQ ID NO: 257684 - DNA, 25 bp, Rattus norvegicus
cgatgagatcatctcccaggctgat

SEQ ID NO: 257685 - DNA, 25 bp, Rattus norvegicus
cgatgagatcatgtcccaggctgat

SEQ ID NO: 257686 - DNA, 25 bp, Rattus norvegicus
cgatgagcatccagttggcctttat

SEQ ID NO: 257687 - DNA, 25 bp, Rattus norvegicus
cgatgagcatcctgttggcctttat

SEQ ID NO: 257688 - DNA, 25 bp, Rattus norvegicus
cgatgagcgccaccagcgagctgaa

SEQ ID NO: 257689 - DNA, 25 bp, Rattus norvegicus
cgatgagcgccagcagcgagctgaa

SEQ ID NO: 257690 - DNA, 25 bp, Rattus norvegicus
cgatgaggcggaactggtagatcca

SEQ ID NO: 257691 - DNA, 25 bp, Rattus norvegicus
cgatgaggcggatctggtagatcca

SEQ ID NO: 257692 - DNA, 25 bp, Rattus norvegicus
cgatgagggccccagtcctccagag

SEQ ID NO: 257693 - DNA, 25 bp, Rattus norvegicus
cgatgagggcccgagtcctccagag

SEQ ID NO: 257694 - DNA, 25 bp, Rattus norvegicus
cgatgatatggtacgtcccttccga

SEQ ID NO: 257695 - DNA, 25 bp, Rattus norvegicus
cgatgatatggttcgtcccttccga

SEQ ID NO: 257696 - DNA, 25 bp, Rattus norvegicus
cgatgattaggaaatccccgcgttc

SEQ ID NO: 257697 - DNA, 25 bp, Rattus norvegicus
cgatgattaggatatccccgcgttc

SEQ ID NO: 257698 - DNA, 25 bp, Rattus norvegicus
cgatgattgtacagccacagcgaat

SEQ ID NO: 257699 - DNA, 25 bp, Rattus norvegicus
cgatgattgtactgccacagcgaat

SEQ ID NO: 257700 - DNA, 25 bp, Rattus norvegicus
cgatgcaaaatgacagctggtggct

SEQ ID NO: 257701 - DNA, 25 bp, Rattus norvegicus
cgatgcaaaatgtcagctggtggct

SEQ ID NO: 257702 - DNA, 25 bp, Rattus norvegicus
cgatgcacaggcagtttgggttcct

SEQ ID NO: 257703 - DNA, 25 bp, Rattus norvegicus
cgatgcacaggctgtttgggttcct

SEQ ID NO: 257704 - DNA, 25 bp, Rattus norvegicus
cgatgcatatttagaatcccctccc

SEQ ID NO: 257705 - DNA, 25 bp, Rattus norvegicus
cgatgcatattttgaatcccctccc

SEQ ID NO: 257706 - DNA, 25 bp, Rattus norvegicus
cgatgccctgttctggcatgaagac

SEQ ID NO: 257707 - DNA, 25 bp, Rattus norvegicus
cgatgccctgttgtggcatgaagac

SEQ ID NO: 257708 - DNA, 25 bp, Rattus norvegicus
cgatgccgatgaaccggacggagct

SEQ ID NO: 257709 - DNA, 25 bp, Rattus norvegicus
cgatgccgatgatccggacggagct

SEQ ID NO: 257710 - DNA, 25 bp, Rattus norvegicus
cgatgcctggctctgatgttcttta

SEQ ID NO: 257711 - DNA, 25 bp, Rattus norvegicus
cgatgcctggctgtgatgttcttta

SEQ ID NO: 257712 - DNA, 25 bp, Rattus norvegicus
cgatgcgggagtctcatttcttaga

SEQ ID NO: 257713 - DNA, 25 bp, Rattus norvegicus
cgatgcgggagtgtcatttcttaga

SEQ ID NO: 257714 - DNA, 25 bp, Rattus norvegicus
cgatgcgtgattactgtgcctttgt

SEQ ID NO: 257715 - DNA, 25 bp, Rattus norvegicus
cgatgcgtgatttctgtgcctttgt

SEQ ID NO: 257716 - DNA, 25 bp, Rattus norvegicus
cgatgcgtgcggcaaaggcttcagt

SEQ ID NO: 257717 - DNA, 25 bp, Rattus norvegicus
cgatgcgtgcgggaaaggcttcagt

SEQ ID NO: 257718 - DNA, 25 bp, Rattus norvegicus
cgatgctcgtgaaggcctggtgtta

SEQ ID NO: 257719 - DNA, 25 bp, Rattus norvegicus
cgatgctcgtgatggcctggtgtta

SEQ ID NO: 257720 - DNA, 25 bp, Rattus norvegicus
cgatggcacatcacacattgttgta

SEQ ID NO: 257721 - DNA, 25 bp, Rattus norvegicus
cgatggcacatctcacattgttgta

SEQ ID NO: 257722 - DNA, 25 bp, Rattus norvegicus
cgatggcagcccaggatcaggcctc

SEQ ID NO: 257723 - DNA, 25 bp, Rattus norvegicus
cgatggcagccctggatcaggcctc

SEQ ID NO: 257724 - DNA, 25 bp, Rattus norvegicus
cgatggcccagcaggagtttgctga

SEQ ID NO: 257725 - DNA, 25 bp, Rattus norvegicus
cgatggcccagctggagtttgctga

SEQ ID NO: 257726 - DNA, 25 bp, Rattus norvegicus
cgatggccgcacctttgtgtcaggt

SEQ ID NO: 257727 - DNA, 25 bp, Rattus norvegicus
cgatggccgcacgtttgtgtcaggt

SEQ ID NO: 257728 - DNA, 25 bp, Rattus norvegicus
cgatggccttgtagttacacaggat

SEQ ID NO: 257729 - DNA, 25 bp, Rattus norvegicus
cgatggccttgttgttacacaggat

SEQ ID NO: 257730 - DNA, 25 bp, Rattus norvegicus
cgatggctctttcggaactctctgt

SEQ ID NO: 257731 - DNA, 25 bp, Rattus norvegicus
cgatggctctttgggaactctctgt

SEQ ID NO: 257732 - DNA, 25 bp, Rattus norvegicus
cgatgggaattgagaacctgagatt

SEQ ID NO: 257733 - DNA, 25 bp, Rattus norvegicus
cgatgggaattgtgaacctgagatt

SEQ ID NO: 257734 - DNA, 25 bp, Rattus norvegicus
cgatgggccggtcctgtcgtaacca

SEQ ID NO: 257735 - DNA, 25 bp, Rattus norvegicus
cgatgggccggtgctgtcgtaacca

SEQ ID NO: 257736 - DNA, 25 bp, Rattus norvegicus
cgatgggtgatcaacaatgaccaca

SEQ ID NO: 257737 - DNA, 25 bp, Rattus norvegicus
cgatgggtgatctacaatgaccaca

SEQ ID NO: 257738 - DNA, 25 bp, Rattus norvegicus
cgatgggtggttactgtggctatct

SEQ ID NO: 257739 - DNA, 25 bp, Rattus norvegicus
cgatgggtggtttctgtggctatct

SEQ ID NO: 257740 - DNA, 25 bp, Rattus norvegicus
cgatggtgtatcactctgtaatggt

SEQ ID NO: 257741 - DNA, 25 bp, Rattus norvegicus
cgatggtgtatctctctgtaatggt

SEQ ID NO: 257742 - DNA, 25 bp, Rattus norvegicus
cgatggttaccacagagcagctttg

SEQ ID NO: 257743 - DNA, 25 bp, Rattus norvegicus
cgatggttaccagagagcagctttg

SEQ ID NO: 257744 - DNA, 25 bp, Rattus norvegicus
cgatggttggctacatatcacttaa

SEQ ID NO: 257745 - DNA, 25 bp, Rattus norvegicus
cgatggttggcttcatatcacttaa

SEQ ID NO: 257746 - DNA, 25 bp, Rattus norvegicus
cgatggttttatagggatgcacccc

SEQ ID NO: 257747 - DNA, 25 bp, Rattus norvegicus
cgatggttttattgggatgcacccc

SEQ ID NO: 257748 - DNA, 25 bp, Rattus norvegicus
cgatggtttttcagtaatggattta

SEQ ID NO: 257749 - DNA, 25 bp, Rattus norvegicus
cgatggtttttctgtaatggattta

SEQ ID NO: 257750 - DNA, 25 bp, Rattus norvegicus
cgatgtaagagaccccgggccccag

SEQ ID NO: 257751 - DNA, 25 bp, Rattus norvegicus
cgatgtaagagagcccgggccccag

SEQ ID NO: 257752 - DNA, 25 bp, Rattus norvegicus
cgatgtattttgatggtcagtactg

SEQ ID NO: 257753 - DNA, 25 bp, Rattus norvegicus
cgatgtattttgttggtcagtactg

SEQ ID NO: 257754 - DNA, 25 bp, Rattus norvegicus
cgatgtcaacgtcgccttgcgaaaa

SEQ ID NO: 257755 - DNA, 25 bp, Rattus norvegicus
cgatgtcaacgtggccttgcgaaaa

SEQ ID NO: 257756 - DNA, 25 bp, Rattus norvegicus
cgatgtccccatcgtgatagcgtga

SEQ ID NO: 257757 - DNA, 25 bp, Rattus norvegicus
cgatgtccccatggtgatagcgtga

SEQ ID NO: 257758 - DNA, 25 bp, Rattus norvegicus
cgatgtcgcagaaccttttgtctag

SEQ ID NO: 257759 - DNA, 25 bp, Rattus norvegicus
cgatgtcgcagatccttttgtctag

SEQ ID NO: 257760 - DNA, 25 bp, Rattus norvegicus
cgatgtctttatacctctctttaaa

SEQ ID NO: 257761 - DNA, 25 bp, Rattus norvegicus
cgatgtctttattcctctctttaaa

SEQ ID NO: 257762 - DNA, 25 bp, Rattus norvegicus
cgatgtgactttatctatgattgac

SEQ ID NO: 257763 - DNA, 25 bp, Rattus norvegicus
cgatgtgactttttctatgattgac

SEQ ID NO: 257764 - DNA, 25 bp, Rattus norvegicus
cgatgtgcagatactagcccggatg

SEQ ID NO: 257765 - DNA, 25 bp, Rattus norvegicus
cgatgtgcagattctagcccggatg

SEQ ID NO: 257766 - DNA, 25 bp, Rattus norvegicus
cgatgttcagctcgcgttcaaggca

SEQ ID NO: 257767 - DNA, 25 bp, Rattus norvegicus
cgatgttcagctggcgttcaaggca

SEQ ID NO: 257768 - DNA, 25 bp, Rattus norvegicus
cgatgttccaaaccccaagaattgt

SEQ ID NO: 257769 - DNA, 25 bp, Rattus norvegicus
cgatgttccaaagcccaagaattgt

SEQ ID NO: 257770 - DNA, 25 bp, Rattus norvegicus
cgatgttctcatcatttgtcatgta

SEQ ID NO: 257771 - DNA, 25 bp, Rattus norvegicus
cgatgttctcatgatttgtcatgta

SEQ ID NO: 257772 - DNA, 25 bp, Rattus norvegicus
cgatgttttgagcttttgtggtagt

SEQ ID NO: 257773 - DNA, 25 bp, Rattus norvegicus
cgatgttttgaggttttgtggtagt

SEQ ID NO: 257774 - DNA, 25 bp, Rattus norvegicus
cgattacatcctattcatcaccata

SEQ ID NO: 257775 - DNA, 25 bp, Rattus norvegicus
cgattacatccttttcatcaccata

SEQ ID NO: 257776 - DNA, 25 bp, Rattus norvegicus
cgattatcctggctgtggtttcttt

SEQ ID NO: 257777 - DNA, 25 bp, Rattus norvegicus
cgattatcctgggtgtggtttcttt

SEQ ID NO: 257778 - DNA, 25 bp, Rattus norvegicus
cgattattattgatttgtcccagat

SEQ ID NO: 257779 - DNA, 25 bp, Rattus norvegicus
cgattattattgttttgtcccagat

SEQ ID NO: 257780 - DNA, 25 bp, Rattus norvegicus
cgattattgaggaggtgacacctga

SEQ ID NO: 257781 - DNA, 25 bp, Rattus norvegicus
cgattattgaggtggtgacacctga

SEQ ID NO: 257782 - DNA, 25 bp, Rattus norvegicus
cgattcaagttcacgtcacactggg

SEQ ID NO: 257783 - DNA, 25 bp, Rattus norvegicus
cgattcaagttctcgtcacactggg

SEQ ID NO: 257784 - DNA, 25 bp, Rattus norvegicus
cgattccgaaaccagattgagacct

SEQ ID NO: 257785 - DNA, 25 bp, Rattus norvegicus
cgattccgaaacgagattgagacct

SEQ ID NO: 257786 - DNA, 25 bp, Rattus norvegicus
cgattctgtcaccactcgggtattg

SEQ ID NO: 257787 - DNA, 25 bp, Rattus norvegicus
cgattctgtcacgactcgggtattg

SEQ ID NO: 257788 - DNA, 25 bp, Rattus norvegicus
cgattctttctgacctgcattataa

SEQ ID NO: 257789 - DNA, 25 bp, Rattus norvegicus
cgattctttctgtcctgcattataa

SEQ ID NO: 257790 - DNA, 25 bp, Rattus norvegicus
cgattgtcaatccatgccatcgccg

SEQ ID NO: 257791 - DNA, 25 bp, Rattus norvegicus
cgattgtcaatcgatgccatcgccg

SEQ ID NO: 257792 - DNA, 25 bp, Rattus norvegicus
cgattgtcccaacgccttttcatac

SEQ ID NO: 257793 - DNA, 25 bp, Rattus norvegicus
cgattgtcccaaggccttttcatac

SEQ ID NO: 257794 - DNA, 25 bp, Rattus norvegicus
cgatttagacttcattccaactgcc

SEQ ID NO: 257795 - DNA, 25 bp, Rattus norvegicus
cgatttagacttgattccaactgcc

SEQ ID NO: 257796 - DNA, 25 bp, Rattus norvegicus
cgatttcctgttaagcctggctggg

SEQ ID NO: 257797 - DNA, 25 bp, Rattus norvegicus
cgatttcctgtttagcctggctggg

SEQ ID NO: 257798 - DNA, 25 bp, Rattus norvegicus
cgatttcggtgtatgaatctttcaa

SEQ ID NO: 257799 - DNA, 25 bp, Rattus norvegicus
cgatttcggtgtttgaatctttcaa

SEQ ID NO: 257800 - DNA, 25 bp, Rattus norvegicus
cgatttctgctaagttttcccaaca

SEQ ID NO: 257801 - DNA, 25 bp, Rattus norvegicus
cgatttctgctatgttttcccaaca

SEQ ID NO: 257802 - DNA, 25 bp, Rattus norvegicus
cgcaaaagtcggacagcactggtga

SEQ ID NO: 257803 - DNA, 25 bp, Rattus norvegicus
cgcaaaagtcggtcagcactggtga

SEQ ID NO: 257804 - DNA, 25 bp, Rattus norvegicus
cgcaaacccataaattcccagtagc

SEQ ID NO: 257805 - DNA, 25 bp, Rattus norvegicus
cgcaaacccatatattcccagtagc

SEQ ID NO: 257806 - DNA, 25 bp, Rattus norvegicus
cgcaaactaaagactcatggcatga

SEQ ID NO: 257807 - DNA, 25 bp, Rattus norvegicus
cgcaaactaaagtctcatggcatga

SEQ ID NO: 257808 - DNA, 25 bp, Rattus norvegicus
cgcaaacttcacattacaggccaaa

SEQ ID NO: 257809 - DNA, 25 bp, Rattus norvegicus
cgcaaacttcactttacaggccaaa

SEQ ID NO: 257810 - DNA, 25 bp, Rattus norvegicus
cgcaaagccactacccataagggaa

SEQ ID NO: 257811 - DNA, 25 bp, Rattus norvegicus
cgcaaagccacttcccataagggaa

SEQ ID NO: 257812 - DNA, 25 bp, Rattus norvegicus
cgcaaatctgtaccctgaggttgtt

SEQ ID NO: 257813 - DNA, 25 bp, Rattus norvegicus
cgcaaatctgtagcctgaggttgtt

SEQ ID NO: 257814 - DNA, 25 bp, Rattus norvegicus
cgcaaatgcttcaagatggactgag

SEQ ID NO: 257815 - DNA, 25 bp, Rattus norvegicus
cgcaaatgcttctagatggactgag

SEQ ID NO: 257816 - DNA, 25 bp, Rattus norvegicus
cgcaacagtaaaaccttacaccttc

SEQ ID NO: 257817 - DNA, 25 bp, Rattus norvegicus
cgcaacagtaaatccttacaccttc

SEQ ID NO: 257818 - DNA, 25 bp, Rattus norvegicus
cgcaaccactggcaaaaaggctttg

SEQ ID NO: 257819 - DNA, 25 bp, Rattus norvegicus
cgcaaccactgggaaaaaggctttg

SEQ ID NO: 257820 - DNA, 25 bp, Rattus norvegicus
cgcaacgtgtgtacgtttcgcaatt

SEQ ID NO: 257821 - DNA, 25 bp, Rattus norvegicus
cgcaacgtgtgttcgtttcgcaatt

SEQ ID NO: 257822 - DNA, 25 bp, Rattus norvegicus
cgcaactacagtactagaccttcta

SEQ ID NO: 257823 - DNA, 25 bp, Rattus norvegicus
cgcaactacagttctagaccttcta

SEQ ID NO: 257824 - DNA, 25 bp, Rattus norvegicus
cgcaactctgttcggcatcgcaggt

SEQ ID NO: 257825 - DNA, 25 bp, Rattus norvegicus
cgcaactctgttgggcatcgcaggt

SEQ ID NO: 257826 - DNA, 25 bp, Rattus norvegicus
cgcaactgtggtccggcgacggcca

SEQ ID NO: 257827 - DNA, 25 bp, Rattus norvegicus
cgcaactgtggtgcggcgacggcca

SEQ ID NO: 257828 - DNA, 25 bp, Rattus norvegicus
cgcaacttgttaaagcagcccattt

SEQ ID NO: 257829 - DNA, 25 bp, Rattus norvegicus
cgcaacttgttatagcagcccattt

SEQ ID NO: 257830 - DNA, 25 bp, Rattus norvegicus
cgcaagagggcacaccgatagaatc

SEQ ID NO: 257831 - DNA, 25 bp, Rattus norvegicus
cgcaagagggcagaccgatagaatc

SEQ ID NO: 257832 - DNA, 25 bp, Rattus norvegicus
cgcaagcacgtgactctgagagcat

SEQ ID NO: 257833 - DNA, 25 bp, Rattus norvegicus
cgcaagcacgtgtctctgagagcat

SEQ ID NO: 257834 - DNA, 25 bp, Rattus norvegicus
cgcaagcctctccatcaagtataaa

SEQ ID NO: 257835 - DNA, 25 bp, Rattus norvegicus
cgcaagcctctcgatcaagtataaa

SEQ ID NO: 257836 - DNA, 25 bp, Rattus norvegicus
cgcaagtctgtaatgtaggaagcca

SEQ ID NO: 257837 - DNA, 25 bp, Rattus norvegicus
cgcaagtctgtattgtaggaagcca

SEQ ID NO: 257838 - DNA, 25 bp, Rattus norvegicus
cgcaatagcgacccgctggcgttac

SEQ ID NO: 257839 - DNA, 25 bp, Rattus norvegicus
cgcaatagcgacgcgctggcgttac

SEQ ID NO: 257840 - DNA, 25 bp, Rattus norvegicus
cgcaatcccctcatatagtctttaa

SEQ ID NO: 257841 - DNA, 25 bp, Rattus norvegicus
cgcaatcccctcttatagtctttaa

SEQ ID NO: 257842 - DNA, 25 bp, Rattus norvegicus
cgcaatgctgccagatgctgctgct

SEQ ID NO: 257843 - DNA, 25 bp, Rattus norvegicus
cgcaatgctgcctgatgctgctgct

SEQ ID NO: 257844 - DNA, 25 bp, Rattus norvegicus
cgcaatgtatttcagctgggacccc

SEQ ID NO: 257845 - DNA, 25 bp, Rattus norvegicus
cgcaatgtatttgagctgggacccc

SEQ ID NO: 257846 - DNA, 25 bp, Rattus norvegicus
cgcacaaggccgacgtggacatgaa

SEQ ID NO: 257847 - DNA, 25 bp, Rattus norvegicus
cgcacaaggccgtcgtggacatgaa

SEQ ID NO: 257848 - DNA, 25 bp, Rattus norvegicus
cgcacacgggcgagaagaagttcag

SEQ ID NO: 257849 - DNA, 25 bp, Rattus norvegicus
cgcacacgggcgtgaagaagttcag

SEQ ID NO: 257850 - DNA, 25 bp, Rattus norvegicus
cgcacactatgaccaacatgcagat

SEQ ID NO: 257851 - DNA, 25 bp, Rattus norvegicus
cgcacactatgagcaacatgcagat

SEQ ID NO: 257852 - DNA, 25 bp, Rattus norvegicus
cgcacagaccagatccaggagagaa

SEQ ID NO: 257853 - DNA, 25 bp, Rattus norvegicus
cgcacagaccagttccaggagagaa

SEQ ID NO: 257854 - DNA, 25 bp, Rattus norvegicus
cgcacagatgtgcagcagattggaa

SEQ ID NO: 257855 - DNA, 25 bp, Rattus norvegicus
cgcacagatgtggagcagattggaa

SEQ ID NO: 257856 - DNA, 25 bp, Rattus norvegicus
cgcacagcacccaggagaaagcaaa

SEQ ID NO: 257857 - DNA, 25 bp, Rattus norvegicus
cgcacagcaccctggagaaagcaaa

SEQ ID NO: 257858 - DNA, 25 bp, Rattus norvegicus
cgcacagtgctgacacatatctcag

SEQ ID NO: 257859 - DNA, 25 bp, Rattus norvegicus
cgcacagtgctgtcacatatctcag

SEQ ID NO: 257860 - DNA, 25 bp, Rattus norvegicus
cgcacagtgtccatggatgagcagt

SEQ ID NO: 257861 - DNA, 25 bp, Rattus norvegicus
cgcacagtgtccttggatgagcagt

SEQ ID NO: 257862 - DNA, 25 bp, Rattus norvegicus
cgcacatcgatgctcttcggaatta

SEQ ID NO: 257863 - DNA, 25 bp, Rattus norvegicus
cgcacatcgatggtcttcggaatta

SEQ ID NO: 257864 - DNA, 25 bp, Rattus norvegicus
cgcacatgctgaactgagtggctca

SEQ ID NO: 257865 - DNA, 25 bp, Rattus norvegicus
cgcacatgctgatctgagtggctca

SEQ ID NO: 257866 - DNA, 25 bp, Rattus norvegicus
cgcacatgtgtgacacattcggtga

SEQ ID NO: 257867 - DNA, 25 bp, Rattus norvegicus
cgcacatgtgtgtcacattcggtga

SEQ ID NO: 257868 - DNA, 25 bp, Rattus norvegicus
cgcaccactgctacttttggaaata

SEQ ID NO: 257869 - DNA, 25 bp, Rattus norvegicus
cgcaccactgcttcttttggaaata

SEQ ID NO: 257870 - DNA, 25 bp, Rattus norvegicus
cgcaccagagttaaatgtcggacat

SEQ ID NO: 257871 - DNA, 25 bp, Rattus norvegicus
cgcaccagagtttaatgtcggacat

SEQ ID NO: 257872 - DNA, 25 bp, Rattus norvegicus
cgcaccctagtgaatgttaccattg

SEQ ID NO: 257873 - DNA, 25 bp, Rattus norvegicus
cgcaccctagtgtatgttaccattg

SEQ ID NO: 257874 - DNA, 25 bp, Rattus norvegicus
cgcaccctgcagacggtagatttaa

SEQ ID NO: 257875 - DNA, 25 bp, Rattus norvegicus
cgcaccctgcagtcggtagatttaa

SEQ ID NO: 257876 - DNA, 25 bp, Rattus norvegicus
cgcaccggacgtacagcagacagga

SEQ ID NO: 257877 - DNA, 25 bp, Rattus norvegicus
cgcaccggacgttcagcagacagga

SEQ ID NO: 257878 - DNA, 25 bp, Rattus norvegicus
cgcaccgtttgtatcctatatacag

SEQ ID NO: 257879 - DNA, 25 bp, Rattus norvegicus
cgcaccgtttgtttcctatatacag

SEQ ID NO: 257880 - DNA, 25 bp, Rattus norvegicus
cgcacctaccatcggctttggaaag

SEQ ID NO: 257881 - DNA, 25 bp, Rattus norvegicus
cgcacctaccatgggctttggaaag

SEQ ID NO: 257882 - DNA, 25 bp, Rattus norvegicus
cgcacctctgtcatgtatgctgagt

SEQ ID NO: 257883 - DNA, 25 bp, Rattus norvegicus
cgcacctctgtcttgtatgctgagt

SEQ ID NO: 257884 - DNA, 25 bp, Rattus norvegicus
cgcacctgagccagtagatcgaaga

SEQ ID NO: 257885 - DNA, 25 bp, Rattus norvegicus
cgcacctgagcctgtagatcgaaga

SEQ ID NO: 257886 - DNA, 25 bp, Rattus norvegicus
cgcaccttcagcaacatcaggaata

SEQ ID NO: 257887 - DNA, 25 bp, Rattus norvegicus
cgcaccttcagctacatcaggaata

SEQ ID NO: 257888 - DNA, 25 bp, Rattus norvegicus
cgcaccttctaaactgctctagagt

SEQ ID NO: 257889 - DNA, 25 bp, Rattus norvegicus
cgcaccttctaatctgctctagagt

SEQ ID NO: 257890 - DNA, 25 bp, Rattus norvegicus
cgcacgatgcctcgagttactgtaa

SEQ ID NO: 257891 - DNA, 25 bp, Rattus norvegicus
cgcacgatgcctggagttactgtaa

SEQ ID NO: 257892 - DNA, 25 bp, Rattus norvegicus
cgcacgccacatacggagatatctg

SEQ ID NO: 257893 - DNA, 25 bp, Rattus norvegicus
cgcacgccacattcggagatatctg

SEQ ID NO: 257894 - DNA, 25 bp, Rattus norvegicus
cgcacgcgcaacagaaaagagacat

SEQ ID NO: 257895 - DNA, 25 bp, Rattus norvegicus
cgcacgcgcaactgaaaagagacat

SEQ ID NO: 257896 - DNA, 25 bp, Rattus norvegicus
cgcacgtatccccaataaagttctt

SEQ ID NO: 257897 - DNA, 25 bp, Rattus norvegicus
cgcacgtatcccgaataaagttctt

SEQ ID NO: 257898 - DNA, 25 bp, Rattus norvegicus
cgcactctgggcagtttcataaaca

SEQ ID NO: 257899 - DNA, 25 bp, Rattus norvegicus
cgcactctgggctgtttcataaaca

SEQ ID NO: 257900 - DNA, 25 bp, Rattus norvegicus
cgcactgccatgctctgtgtgacat

SEQ ID NO: 257901 - DNA, 25 bp, Rattus norvegicus
cgcactgccatggtctgtgtgacat

SEQ ID NO: 257902 - DNA, 25 bp, Rattus norvegicus
cgcactgcgcgcactggtgcggctt

SEQ ID NO: 257903 - DNA, 25 bp, Rattus norvegicus
cgcactgcgcgctctggtgcggctt

SEQ ID NO: 257904 - DNA, 25 bp, Rattus norvegicus
cgcactgctcacagattcggataag

SEQ ID NO: 257905 - DNA, 25 bp, Rattus norvegicus
cgcactgctcactgattcggataag

SEQ ID NO: 257906 - DNA, 25 bp, Rattus norvegicus
cgcactgctggacccaacatgatta

SEQ ID NO: 257907 - DNA, 25 bp, Rattus norvegicus
cgcactgctggagccaacatgatta

SEQ ID NO: 257908 - DNA, 25 bp, Rattus norvegicus
cgcactggaataccgtttagctatt

SEQ ID NO: 257909 - DNA, 25 bp, Rattus norvegicus
cgcactggaatagcgtttagctatt

SEQ ID NO: 257910 - DNA, 25 bp, Rattus norvegicus
cgcactggcacgcagttggtgttac

SEQ ID NO: 257911 - DNA, 25 bp, Rattus norvegicus
cgcactggcacggagttggtgttac

SEQ ID NO: 257912 - DNA, 25 bp, Rattus norvegicus
cgcacttcagttccgatctcaagga

SEQ ID NO: 257913 - DNA, 25 bp, Rattus norvegicus
cgcacttcagttgcgatctcaagga

SEQ ID NO: 257914 - DNA, 25 bp, Rattus norvegicus
cgcacttgaccacggcacaggcttg

SEQ ID NO: 257915 - DNA, 25 bp, Rattus norvegicus
cgcacttgaccagggcacaggcttg

SEQ ID NO: 257916 - DNA, 25 bp, Rattus norvegicus
cgcacttgtgttcacgatggaccag

SEQ ID NO: 257917 - DNA, 25 bp, Rattus norvegicus
cgcacttgtgttgacgatggaccag

SEQ ID NO: 257918 - DNA, 25 bp, Rattus norvegicus
cgcagaaagcatataaatacaaggg

SEQ ID NO: 257919 - DNA, 25 bp, Rattus norvegicus
cgcagaaagcatttaaatacaaggg

SEQ ID NO: 257920 - DNA, 25 bp, Rattus norvegicus
cgcagaaccgcgagccggagtccgt

SEQ ID NO: 257921 - DNA, 25 bp, Rattus norvegicus
cgcagaaccgcgtgccggagtccgt

SEQ ID NO: 257922 - DNA, 25 bp, Rattus norvegicus
cgcagaagccggcaggctgacacat

SEQ ID NO: 257923 - DNA, 25 bp, Rattus norvegicus
cgcagaagccgggaggctgacacat

SEQ ID NO: 257924 - DNA, 25 bp, Rattus norvegicus
cgcagacactgcatattccggagga

SEQ ID NO: 257925 - DNA, 25 bp, Rattus norvegicus
cgcagacactgcttattccggagga

SEQ ID NO: 257926 - DNA, 25 bp, Rattus norvegicus
cgcagaccactgacctatgttttag

SEQ ID NO: 257927 - DNA, 25 bp, Rattus norvegicus
cgcagaccactgtcctatgttttag

SEQ ID NO: 257928 - DNA, 25 bp, Rattus norvegicus
cgcagaccggaacttagctttcttt

SEQ ID NO: 257929 - DNA, 25 bp, Rattus norvegicus
cgcagaccggaagttagctttcttt

SEQ ID NO: 257930 - DNA, 25 bp, Rattus norvegicus
cgcagagaagtcacgggccgctgcc

SEQ ID NO: 257931 - DNA, 25 bp, Rattus norvegicus
cgcagagaagtctcgggccgctgcc

SEQ ID NO: 257932 - DNA, 25 bp, Rattus norvegicus
cgcagagagctgcaggtcctgtacc

SEQ ID NO: 257933 - DNA, 25 bp, Rattus norvegicus
cgcagagagctggaggtcctgtacc

SEQ ID NO: 257934 - DNA, 25 bp, Rattus norvegicus
cgcagagtacctcgacattggcaaa

SEQ ID NO: 257935 - DNA, 25 bp, Rattus norvegicus
cgcagagtacctggacattggcaaa

SEQ ID NO: 257936 - DNA, 25 bp, Rattus norvegicus
cgcagagtcagaccgggccctttca

SEQ ID NO: 257937 - DNA, 25 bp, Rattus norvegicus
cgcagagtcagagcgggccctttca

SEQ ID NO: 257938 - DNA, 25 bp, Rattus norvegicus
cgcagatgcccaccggaatggagaa

SEQ ID NO: 257939 - DNA, 25 bp, Rattus norvegicus
cgcagatgcccagcggaatggagaa

SEQ ID NO: 257940 - DNA, 25 bp, Rattus norvegicus
cgcagatgcttgcaaagttcttcat

SEQ ID NO: 257941 - DNA, 25 bp, Rattus norvegicus
cgcagatgcttggaaagttcttcat

SEQ ID NO: 257942 - DNA, 25 bp, Rattus norvegicus
cgcagcaaactgccgtgctggcagg

SEQ ID NO: 257943 - DNA, 25 bp, Rattus norvegicus
cgcagcaaactggcgtgctggcagg

SEQ ID NO: 257944 - DNA, 25 bp, Rattus norvegicus
cgcagcatctgcagtcaggatggat

SEQ ID NO: 257945 - DNA, 25 bp, Rattus norvegicus
cgcagcatctgctgtcaggatggat

SEQ ID NO: 257946 - DNA, 25 bp, Rattus norvegicus
cgcagcatttaaagttccgggttct

SEQ ID NO: 257947 - DNA, 25 bp, Rattus norvegicus
cgcagcatttaatgttccgggttct

SEQ ID NO: 257948 - DNA, 25 bp, Rattus norvegicus
cgcagccaccgcaggccatgggaac

SEQ ID NO: 257949 - DNA, 25 bp, Rattus norvegicus
cgcagccaccgctggccatgggaac

SEQ ID NO: 257950 - DNA, 25 bp, Rattus norvegicus
cgcagccccagtatgatcgaaagac

SEQ ID NO: 257951 - DNA, 25 bp, Rattus norvegicus
cgcagccccagtttgatcgaaagac

SEQ ID NO: 257952 - DNA, 25 bp, Rattus norvegicus
cgcagccgtacacccttcgaaggag

SEQ ID NO: 257953 - DNA, 25 bp, Rattus norvegicus
cgcagccgtacagccttcgaaggag

SEQ ID NO: 257954 - DNA, 25 bp, Rattus norvegicus
cgcagcgagcagagctctgctgtga

SEQ ID NO: 257955 - DNA, 25 bp, Rattus norvegicus
cgcagcgagcagtgctctgctgtga

SEQ ID NO: 257956 - DNA, 25 bp, Rattus norvegicus
cgcagctcgtgcaggtcatcaagaa

SEQ ID NO: 257957 - DNA, 25 bp, Rattus norvegicus
cgcagctcgtgctggtcatcaagaa

SEQ ID NO: 257958 - DNA, 25 bp, Rattus norvegicus
cgcagctctaccaccaaattagtaa

SEQ ID NO: 257959 - DNA, 25 bp, Rattus norvegicus
cgcagctctacctccaaattagtaa

SEQ ID NO: 257960 - DNA, 25 bp, Rattus norvegicus
cgcagctgtcccaggcggtcgacga

SEQ ID NO: 257961 - DNA, 25 bp, Rattus norvegicus
cgcagctgtccctggcggtcgacga

SEQ ID NO: 257962 - DNA, 25 bp, Rattus norvegicus
cgcagctgttcgatctgtacgagaa

SEQ ID NO: 257963 - DNA, 25 bp, Rattus norvegicus
cgcagctgttcgttctgtacgagaa

SEQ ID NO: 257964 - DNA, 25 bp, Rattus norvegicus
cgcaggacggttcccgtattggcac

SEQ ID NO: 257965 - DNA, 25 bp, Rattus norvegicus
cgcaggacggttgccgtattggcac

SEQ ID NO: 257966 - DNA, 25 bp, Rattus norvegicus
cgcaggactccccagaggactcagg

SEQ ID NO: 257967 - DNA, 25 bp, Rattus norvegicus
cgcaggactcccgagaggactcagg

SEQ ID NO: 257968 - DNA, 25 bp, Rattus norvegicus
cgcaggcatcacacttgaacggttt

SEQ ID NO: 257969 - DNA, 25 bp, Rattus norvegicus
cgcaggcatcactcttgaacggttt

SEQ ID NO: 257970 - DNA, 25 bp, Rattus norvegicus
cgcaggcggagcaagtgagctttct

SEQ ID NO: 257971 - DNA, 25 bp, Rattus norvegicus
cgcaggcggagctagtgagctttct

SEQ ID NO: 257972 - DNA, 25 bp, Rattus norvegicus
cgcaggcttttgaaacatgtggtcc

SEQ ID NO: 257973 - DNA, 25 bp, Rattus norvegicus
cgcaggcttttgtaacatgtggtcc

SEQ ID NO: 257974 - DNA, 25 bp, Rattus norvegicus
cgcagggatgcgagaatagcctata

SEQ ID NO: 257975 - DNA, 25 bp, Rattus norvegicus
cgcagggatgcgtgaatagcctata

SEQ ID NO: 257976 - DNA, 25 bp, Rattus norvegicus
cgcagggatggacgacgattaaaaa

SEQ ID NO: 257977 - DNA, 25 bp, Rattus norvegicus
cgcagggatggaggacgattaaaaa

SEQ ID NO: 257978 - DNA, 25 bp, Rattus norvegicus
cgcagggcttctccatgagatagga

SEQ ID NO: 257979 - DNA, 25 bp, Rattus norvegicus
cgcagggcttctgcatgagatagga

SEQ ID NO: 257980 - DNA, 25 bp, Rattus norvegicus
cgcagggtacttcactgagcgcagt

SEQ ID NO: 257981 - DNA, 25 bp, Rattus norvegicus
cgcagggtacttgactgagcgcagt

SEQ ID NO: 257982 - DNA, 25 bp, Rattus norvegicus
cgcagggttgagacagaatatccac

SEQ ID NO: 257983 - DNA, 25 bp, Rattus norvegicus
cgcagggttgagtcagaatatccac

SEQ ID NO: 257984 - DNA, 25 bp, Rattus norvegicus
cgcaggtgtgtaagcctaattcttt

SEQ ID NO: 257985 - DNA, 25 bp, Rattus norvegicus
cgcaggtgtgtatgcctaattcttt

SEQ ID NO: 257986 - DNA, 25 bp, Rattus norvegicus
cgcaggttgctgcagcccgaagaac

SEQ ID NO: 257987 - DNA, 25 bp, Rattus norvegicus
cgcaggttgctggagcccgaagaac

SEQ ID NO: 257988 - DNA, 25 bp, Rattus norvegicus
cgcaggttgcttcccatgtaaaatt

SEQ ID NO: 257989 - DNA, 25 bp, Rattus norvegicus
cgcaggttgcttgccatgtaaaatt

SEQ ID NO: 257990 - DNA, 25 bp, Rattus norvegicus
cgcagtaatagtcgccttgtcttca

SEQ ID NO: 257991 - DNA, 25 bp, Rattus norvegicus
cgcagtaatagtggccttgtcttca

SEQ ID NO: 257992 - DNA, 25 bp, Rattus norvegicus
cgcagtacctggctgtcatcaaagc

SEQ ID NO: 257993 - DNA, 25 bp, Rattus norvegicus
cgcagtacctgggtgtcatcaaagc

SEQ ID NO: 257994 - DNA, 25 bp, Rattus norvegicus
cgcagtccttgacgtaccctaaatg

SEQ ID NO: 257995 - DNA, 25 bp, Rattus norvegicus
cgcagtccttgaggtaccctaaatg

SEQ ID NO: 257996 - DNA, 25 bp, Rattus norvegicus
cgcagtcgtgatatctgggtggcta

SEQ ID NO: 257997 - DNA, 25 bp, Rattus norvegicus
cgcagtcgtgatttctgggtggcta

SEQ ID NO: 257998 - DNA, 25 bp, Rattus norvegicus
cgcagtctctttctgttcagaggca

SEQ ID NO: 257999 - DNA, 25 bp, Rattus norvegicus
cgcagtctctttgtgttcagaggca

SEQ ID NO: 258000 - DNA, 25 bp, Rattus norvegicus
cgcagtgcaggtcctcatgggtttc

SEQ ID NO: 258001 - DNA, 25 bp, Rattus norvegicus
cgcagtgcaggtgctcatgggtttc

SEQ ID NO: 258002 - DNA, 25 bp, Rattus norvegicus
cgcagtgcccacagaagtttttctt

SEQ ID NO: 258003 - DNA, 25 bp, Rattus norvegicus
cgcagtgcccactgaagtttttctt

SEQ ID NO: 258004 - DNA, 25 bp, Rattus norvegicus
cgcagtgcctgtcagcctggagaaa

SEQ ID NO: 258005 - DNA, 25 bp, Rattus norvegicus
cgcagtgcctgtgagcctggagaaa

SEQ ID NO: 258006 - DNA, 25 bp, Rattus norvegicus
cgcagtgctggacatcaaattcagt

SEQ ID NO: 258007 - DNA, 25 bp, Rattus norvegicus
cgcagtgctggagatcaaattcagt

SEQ ID NO: 258008 - DNA, 25 bp, Rattus norvegicus
cgcagtgctgtgacatttgagtgta

SEQ ID NO: 258009 - DNA, 25 bp, Rattus norvegicus
cgcagtgctgtgtcatttgagtgta

SEQ ID NO: 258010 - DNA, 25 bp, Rattus norvegicus
cgcagtggcttgactttggtatttt

SEQ ID NO: 258011 - DNA, 25 bp, Rattus norvegicus
cgcagtggcttgtctttggtatttt

SEQ ID NO: 258012 - DNA, 25 bp, Rattus norvegicus
cgcagtgggtttaaggtgtctgtct

SEQ ID NO: 258013 - DNA, 25 bp, Rattus norvegicus
cgcagtgggttttaggtgtctgtct

SEQ ID NO: 258014 - DNA, 25 bp, Rattus norvegicus
cgcagtgttgatagaacgcttcgtt

SEQ ID NO: 258015 - DNA, 25 bp, Rattus norvegicus
cgcagtgttgattgaacgcttcgtt

SEQ ID NO: 258016 - DNA, 25 bp, Rattus norvegicus
cgcagttggtgcaggcgtctgtcac

SEQ ID NO: 258017 - DNA, 25 bp, Rattus norvegicus
cgcagttggtgctggcgtctgtcac

SEQ ID NO: 258018 - DNA, 25 bp, Rattus norvegicus
cgcatactgggcaggcgctctacca

SEQ ID NO: 258019 - DNA, 25 bp, Rattus norvegicus
cgcatactgggctggcgctctacca

SEQ ID NO: 258020 - DNA, 25 bp, Rattus norvegicus
cgcatagcctcaagtcaagacggaa

SEQ ID NO: 258021 - DNA, 25 bp, Rattus norvegicus
cgcatagcctcatgtcaagacggaa

SEQ ID NO: 258022 - DNA, 25 bp, Rattus norvegicus
cgcatagcgaggcttcaaaggatta

SEQ ID NO: 258023 - DNA, 25 bp, Rattus norvegicus
cgcatagcgagggttcaaaggatta

SEQ ID NO: 258024 - DNA, 25 bp, Rattus norvegicus
cgcatagctacaattttgtggaaaa

SEQ ID NO: 258025 - DNA, 25 bp, Rattus norvegicus
cgcatagctacatttttgtggaaaa

SEQ ID NO: 258026 - DNA, 25 bp, Rattus norvegicus
cgcataggatcgagggttttaacaa

SEQ ID NO: 258027 - DNA, 25 bp, Rattus norvegicus
cgcataggatcgtgggttttaacaa

SEQ ID NO: 258028 - DNA, 25 bp, Rattus norvegicus
cgcatatggcccattctgaatcaaa

SEQ ID NO: 258029 - DNA, 25 bp, Rattus norvegicus
cgcatatggccctttctgaatcaaa

SEQ ID NO: 258030 - DNA, 25 bp, Rattus norvegicus
cgcatcagagaccaagaggcccaga

SEQ ID NO: 258031 - DNA, 25 bp, Rattus norvegicus
cgcatcagagacgaagaggcccaga

SEQ ID NO: 258032 - DNA, 25 bp, Rattus norvegicus
cgcatccctggtatggcatctgcat

SEQ ID NO: 258033 - DNA, 25 bp, Rattus norvegicus
cgcatccctggtttggcatctgcat

SEQ ID NO: 258034 - DNA, 25 bp, Rattus norvegicus
cgcatcctgggcatgttggagaact

SEQ ID NO: 258035 - DNA, 25 bp, Rattus norvegicus
cgcatcctgggcttgttggagaact

SEQ ID NO: 258036 - DNA, 25 bp, Rattus norvegicus
cgcatcgctaccaggttgggaacct

SEQ ID NO: 258037 - DNA, 25 bp, Rattus norvegicus
cgcatcgctacctggttgggaacct

SEQ ID NO: 258038 - DNA, 25 bp, Rattus norvegicus
cgcatctaccgactctgttgctgag

SEQ ID NO: 258039 - DNA, 25 bp, Rattus norvegicus
cgcatctaccgagtctgttgctgag

SEQ ID NO: 258040 - DNA, 25 bp, Rattus norvegicus
cgcatctgcttaccctgtaagtgtg

SEQ ID NO: 258041 - DNA, 25 bp, Rattus norvegicus
cgcatctgcttacgaggagtggtct

SEQ ID NO: 258042 - DNA, 25 bp, Rattus norvegicus
cgcatctgcttagcctgtaagtgtg

SEQ ID NO: 258043 - DNA, 25 bp, Rattus norvegicus
cgcatctgcttaggaggagtggtct

SEQ ID NO: 258044 - DNA, 25 bp, Rattus norvegicus
cgcatcttgaggaggccgccaagtg

SEQ ID NO: 258045 - DNA, 25 bp, Rattus norvegicus
cgcatcttgaggtggccgccaagtg

SEQ ID NO: 258046 - DNA, 25 bp, Rattus norvegicus
cgcatctttccaatactcattatcg

SEQ ID NO: 258047 - DNA, 25 bp, Rattus norvegicus
cgcatctttccattactcattatcg

SEQ ID NO: 258048 - DNA, 25 bp, Rattus norvegicus
cgcatgacgggcatgcgtggcctct

SEQ ID NO: 258049 - DNA, 25 bp, Rattus norvegicus
cgcatgacgggcttgcgtggcctct

SEQ ID NO: 258050 - DNA, 25 bp, Rattus norvegicus
cgcatgactcggacggagctgaagc

SEQ ID NO: 258051 - DNA, 25 bp, Rattus norvegicus
cgcatgactcggtcggagctgaagc

SEQ ID NO: 258052 - DNA, 25 bp, Rattus norvegicus
cgcatgactgtgcaggcctgagcaa

SEQ ID NO: 258053 - DNA, 25 bp, Rattus norvegicus
cgcatgactgtggaggcctgagcaa

SEQ ID NO: 258054 - DNA, 25 bp, Rattus norvegicus
cgcatgccccacacatgttaatgaa

SEQ ID NO: 258055 - DNA, 25 bp, Rattus norvegicus
cgcatgccccactcatgttaatgaa

SEQ ID NO: 258056 - DNA, 25 bp, Rattus norvegicus
cgcatgtccctgctgaagcggagat

SEQ ID NO: 258057 - DNA, 25 bp, Rattus norvegicus
cgcatgtccctggtgaagcggagat

SEQ ID NO: 258058 - DNA, 25 bp, Rattus norvegicus
cgcatgtgggagccccgtcccatgt

SEQ ID NO: 258059 - DNA, 25 bp, Rattus norvegicus
cgcatgtgggaggcccgtcccatgt

SEQ ID NO: 258060 - DNA, 25 bp, Rattus norvegicus
cgcattatcatcagtgagctcctga

SEQ ID NO: 258061 - DNA, 25 bp, Rattus norvegicus
cgcattatcatctgtgagctcctga

SEQ ID NO: 258062 - DNA, 25 bp, Rattus norvegicus
cgcattcctcgtcaggtctagaaat

SEQ ID NO: 258063 - DNA, 25 bp, Rattus norvegicus
cgcattcctcgtgaggtctagaaat

SEQ ID NO: 258064 - DNA, 25 bp, Rattus norvegicus
cgcattcgttgtcgccctaggagtt

SEQ ID NO: 258065 - DNA, 25 bp, Rattus norvegicus
cgcattcgttgtggccctaggagtt

SEQ ID NO: 258066 - DNA, 25 bp, Rattus norvegicus
cgcattgccaccaagcggaatggag

SEQ ID NO: 258067 - DNA, 25 bp, Rattus norvegicus
cgcattgccacctagcggaatggag

SEQ ID NO: 258068 - DNA, 25 bp, Rattus norvegicus
cgcattgctcttattcgtggacatt

SEQ ID NO: 258069 - DNA, 25 bp, Rattus norvegicus
cgcattgctctttttcgtggacatt

SEQ ID NO: 258070 - DNA, 25 bp, Rattus norvegicus
cgcatttcctgcagctgacaggcat

SEQ ID NO: 258071 - DNA, 25 bp, Rattus norvegicus
cgcatttcctgctgctgacaggcat

SEQ ID NO: 258072 - DNA, 25 bp, Rattus norvegicus
cgcatttgaaggctctgacagttaa

SEQ ID NO: 258073 - DNA, 25 bp, Rattus norvegicus
cgcatttgaagggtctgacagttaa

SEQ ID NO: 258074 - DNA, 25 bp, Rattus norvegicus
cgccaaaatggcataactgagataa

SEQ ID NO: 258075 - DNA, 25 bp, Rattus norvegicus
cgccaaaatggcttaactgagataa

SEQ ID NO: 258076 - DNA, 25 bp, Rattus norvegicus
cgccaaaggcttccgggactgcgac

SEQ ID NO: 258077 - DNA, 25 bp, Rattus norvegicus
cgccaaaggcttgcgggactgcgac

SEQ ID NO: 258078 - DNA, 25 bp, Rattus norvegicus
cgccaacgacctacgagtggaagtg

SEQ ID NO: 258079 - DNA, 25 bp, Rattus norvegicus
cgccaacgaccttcgagtggaagtg

SEQ ID NO: 258080 - DNA, 25 bp, Rattus norvegicus
cgccaacttcgccatgactagaata

SEQ ID NO: 258081 - DNA, 25 bp, Rattus norvegicus
cgccaacttcgcgatgactagaata

SEQ ID NO: 258082 - DNA, 25 bp, Rattus norvegicus
cgccaagaacccacacagtgatatg

SEQ ID NO: 258083 - DNA, 25 bp, Rattus norvegicus
cgccaagaaccctcacagtgatatg

SEQ ID NO: 258084 - DNA, 25 bp, Rattus norvegicus
cgccaagagcttagtgttgaacctg

SEQ ID NO: 258085 - DNA, 25 bp, Rattus norvegicus
cgccaagagctttgtgttgaacctg

SEQ ID NO: 258086 - DNA, 25 bp, Rattus norvegicus
cgccaagcttgcactcggtgaggtg

SEQ ID NO: 258087 - DNA, 25 bp, Rattus norvegicus
cgccaagcttgctctcggtgaggtg

SEQ ID NO: 258088 - DNA, 25 bp, Rattus norvegicus
cgccaaggagtccagcacggtgttc

SEQ ID NO: 258089 - DNA, 25 bp, Rattus norvegicus
cgccaaggagtcgagcacggtgttc

SEQ ID NO: 258090 - DNA, 25 bp, Rattus norvegicus
cgccaaggcagaatgccgatggttt

SEQ ID NO: 258091 - DNA, 25 bp, Rattus norvegicus
cgccaaggcagattgccgatggttt

SEQ ID NO: 258092 - DNA, 25 bp, Rattus norvegicus
cgccaagtcgttattctaagccata

SEQ ID NO: 258093 - DNA, 25 bp, Rattus norvegicus
cgccaagtcgtttttctaagccata

SEQ ID NO: 258094 - DNA, 25 bp, Rattus norvegicus
cgccaatatgttcccgatgcgtgat

SEQ ID NO: 258095 - DNA, 25 bp, Rattus norvegicus
cgccaatatgttgccgatgcgtgat

SEQ ID NO: 258096 - DNA, 25 bp, Rattus norvegicus
cgccacagcagccttaaatgaagtt

SEQ ID NO: 258097 - DNA, 25 bp, Rattus norvegicus
cgccacagcagcgttaaatgaagtt

SEQ ID NO: 258098 - DNA, 25 bp, Rattus norvegicus
cgccaccaaatgaaggacagggata

SEQ ID NO: 258099 - DNA, 25 bp, Rattus norvegicus
cgccaccaaatgtaggacagggata

SEQ ID NO: 258100 - DNA, 25 bp, Rattus norvegicus
cgccaccaacttcatctgagagtag

SEQ ID NO: 258101 - DNA, 25 bp, Rattus norvegicus
cgccaccaacttgatctgagagtag

SEQ ID NO: 258102 - DNA, 25 bp, Rattus norvegicus
cgccaccaccggagaatgagagaaa

SEQ ID NO: 258103 - DNA, 25 bp, Rattus norvegicus
cgccaccaccggtgaatgagagaaa

SEQ ID NO: 258104 - DNA, 25 bp, Rattus norvegicus
cgccaccagctcagccgagagaagt

SEQ ID NO: 258105 - DNA, 25 bp, Rattus norvegicus
cgccaccagctctgccgagagaagt

SEQ ID NO: 258106 - DNA, 25 bp, Rattus norvegicus
cgccaccccgcaccagatttggatc

SEQ ID NO: 258107 - DNA, 25 bp, Rattus norvegicus
cgccaccccgcagcagatttggatc

SEQ ID NO: 258108 - DNA, 25 bp, Rattus norvegicus
cgccacccgggtcatggtgtaataa

SEQ ID NO: 258109 - DNA, 25 bp, Rattus norvegicus
cgccacccgggtgatggtgtaataa

SEQ ID NO: 258110 - DNA, 25 bp, Rattus norvegicus
cgccacgagagaccccgtctgaatg

SEQ ID NO: 258111 - DNA, 25 bp, Rattus norvegicus
cgccacgagagagcccgtctgaatg

SEQ ID NO: 258112 - DNA, 25 bp, Rattus norvegicus
cgccacgggttcagggaaatcaaat

SEQ ID NO: 258113 - DNA, 25 bp, Rattus norvegicus
cgccacgggttctgggaaatcaaat

SEQ ID NO: 258114 - DNA, 25 bp, Rattus norvegicus
cgccactgtaagaagcactgctgtt

SEQ ID NO: 258115 - DNA, 25 bp, Rattus norvegicus
cgccactgtaagtagcactgctgtt

SEQ ID NO: 258116 - DNA, 25 bp, Rattus norvegicus
cgccactgttgacgatctatttgta

SEQ ID NO: 258117 - DNA, 25 bp, Rattus norvegicus
cgccactgttgaggatctatttgta

SEQ ID NO: 258118 - DNA, 25 bp, Rattus norvegicus
cgccactttgtaagcactctgcaaa

SEQ ID NO: 258119 - DNA, 25 bp, Rattus norvegicus
cgccactttgtatgcactctgcaaa

SEQ ID NO: 258120 - DNA, 25 bp, Rattus norvegicus
cgccagacatctcccaggttgtaga

SEQ ID NO: 258121 - DNA, 25 bp, Rattus norvegicus
cgccagacatctgccaggttgtaga

SEQ ID NO: 258122 - DNA, 25 bp, Rattus norvegicus
cgccagatagagacggaagtacaaa

SEQ ID NO: 258123 - DNA, 25 bp, Rattus norvegicus
cgccagatagagtcggaagtacaaa

SEQ ID NO: 258124 - DNA, 25 bp, Rattus norvegicus
cgccaggaatctccgcagcttgtca

SEQ ID NO: 258125 - DNA, 25 bp, Rattus norvegicus
cgccaggaatctgcgcagcttgtca

SEQ ID NO: 258126 - DNA, 25 bp, Rattus norvegicus
cgccaggcaaggaggcacaggactt

SEQ ID NO: 258127 - DNA, 25 bp, Rattus norvegicus
cgccaggcaaggtggcacaggactt

SEQ ID NO: 258128 - DNA, 25 bp, Rattus norvegicus
cgccaggccgcgcagagatgaactt

SEQ ID NO: 258129 - DNA, 25 bp, Rattus norvegicus
cgccaggccgcggagagatgaactt

SEQ ID NO: 258130 - DNA, 25 bp, Rattus norvegicus
cgccagggtgatcctaaggagccaa

SEQ ID NO: 258131 - DNA, 25 bp, Rattus norvegicus
cgccagggtgatgctaaggagccaa

SEQ ID NO: 258132 - DNA, 25 bp, Rattus norvegicus
cgccaggtgcgcaccattgtggaag

SEQ ID NO: 258133 - DNA, 25 bp, Rattus norvegicus
cgccaggtgcgctccattgtggaag

SEQ ID NO: 258134 - DNA, 25 bp, Rattus norvegicus
cgccagtaggtgacaggcgatcctc

SEQ ID NO: 258135 - DNA, 25 bp, Rattus norvegicus
cgccagtaggtgtcaggcgatcctc

SEQ ID NO: 258136 - DNA, 25 bp, Rattus norvegicus
cgccagttgtgcacttttacaagcc

SEQ ID NO: 258137 - DNA, 25 bp, Rattus norvegicus
cgccagttgtgctcttttacaagcc

SEQ ID NO: 258138 - DNA, 25 bp, Rattus norvegicus
cgccatcaccacaggttcaggagaa

SEQ ID NO: 258139 - DNA, 25 bp, Rattus norvegicus
cgccatcaccactggttcaggagaa

SEQ ID NO: 258140 - DNA, 25 bp, Rattus norvegicus
cgccatccagatccatcttgtattt

SEQ ID NO: 258141 - DNA, 25 bp, Rattus norvegicus
cgccatccagatgcatcttgtattt

SEQ ID NO: 258142 - DNA, 25 bp, Rattus norvegicus
cgccatcttccaactcagattatgt

SEQ ID NO: 258143 - DNA, 25 bp, Rattus norvegicus
cgccatcttccatctcagattatgt

SEQ ID NO: 258144 - DNA, 25 bp, Rattus norvegicus
cgccatcttcgaaactcttgattag

SEQ ID NO: 258145 - DNA, 25 bp, Rattus norvegicus
cgccatcttcgatactcttgattag

SEQ ID NO: 258146 - DNA, 25 bp, Rattus norvegicus
cgccatgacgacactgttgccatga

SEQ ID NO: 258147 - DNA, 25 bp, Rattus norvegicus
cgccatgacgactctgttgccatga

SEQ ID NO: 258148 - DNA, 25 bp, Rattus norvegicus
cgccatgccgctctaaatagactca

SEQ ID NO: 258149 - DNA, 25 bp, Rattus norvegicus
cgccatgccgctgtaaatagactca

SEQ ID NO: 258150 - DNA, 25 bp, Rattus norvegicus
cgccatgtgcaacgccggcttcgcg

SEQ ID NO: 258151 - DNA, 25 bp, Rattus norvegicus
cgccatgtgcaaggccggcttcgcg

SEQ ID NO: 258152 - DNA, 25 bp, Rattus norvegicus
cgccattccctcagcatagaagtga

SEQ ID NO: 258153 - DNA, 25 bp, Rattus norvegicus
cgccattccctctgcatagaagtga

SEQ ID NO: 258154 - DNA, 25 bp, Rattus norvegicus
cgcccaaattcccagagagcaactt

SEQ ID NO: 258155 - DNA, 25 bp, Rattus norvegicus
cgcccaaattccgagagagcaactt

SEQ ID NO: 258156 - DNA, 25 bp, Rattus norvegicus
cgcccaaggcagagtgtcaggacat

SEQ ID NO: 258157 - DNA, 25 bp, Rattus norvegicus
cgcccaaggcagtgtgtcaggacat

SEQ ID NO: 258158 - DNA, 25 bp, Rattus norvegicus
cgcccacattggctgagacataaaa

SEQ ID NO: 258159 - DNA, 25 bp, Rattus norvegicus
cgcccacattgggtgagacataaaa

SEQ ID NO: 258160 - DNA, 25 bp, Rattus norvegicus
cgcccaccagcaaagcagagtaaat

SEQ ID NO: 258161 - DNA, 25 bp, Rattus norvegicus
cgcccaccagcatagcagagtaaat

SEQ ID NO: 258162 - DNA, 25 bp, Rattus norvegicus
cgcccacggtggctgtgaacacaaa

SEQ ID NO: 258163 - DNA, 25 bp, Rattus norvegicus
cgcccacggtgggtgtgaacacaaa

SEQ ID NO: 258164 - DNA, 25 bp, Rattus norvegicus
cgcccacttaccagacaatcatatg

SEQ ID NO: 258165 - DNA, 25 bp, Rattus norvegicus
cgcccacttacctgacaatcatatg

SEQ ID NO: 258166 - DNA, 25 bp, Rattus norvegicus
cgcccagaggaaccggtttaccaga

SEQ ID NO: 258167 - DNA, 25 bp, Rattus norvegicus
cgcccagaggaagcggtttaccaga

SEQ ID NO: 258168 - DNA, 25 bp, Rattus norvegicus
cgcccatccttgagcctagaaaatg

SEQ ID NO: 258169 - DNA, 25 bp, Rattus norvegicus
cgcccatccttgtgcctagaaaatg

SEQ ID NO: 258170 - DNA, 25 bp, Rattus norvegicus
cgcccatgcttcatacggaaaaaca

SEQ ID NO: 258171 - DNA, 25 bp, Rattus norvegicus
cgcccatgcttcttacggaaaaaca

SEQ ID NO: 258172 - DNA, 25 bp, Rattus norvegicus
cgcccatggaccaggagcctagaga

SEQ ID NO: 258173 - DNA, 25 bp, Rattus norvegicus
cgcccatggacctggagcctagaga

SEQ ID NO: 258174 - DNA, 25 bp, Rattus norvegicus
cgcccatgggcgagatgcagttcaa

SEQ ID NO: 258175 - DNA, 25 bp, Rattus norvegicus
cgcccatgggcgtgatgcagttcaa

SEQ ID NO: 258176 - DNA, 25 bp, Rattus norvegicus
cgcccatgttccatggatcgggaat

SEQ ID NO: 258177 - DNA, 25 bp, Rattus norvegicus
cgcccatgttccttggatcgggaat

SEQ ID NO: 258178 - DNA, 25 bp, Rattus norvegicus
cgcccattggcgcaacttgtttgtg

SEQ ID NO: 258179 - DNA, 25 bp, Rattus norvegicus
cgcccattggcggaacttgtttgtg

SEQ ID NO: 258180 - DNA, 25 bp, Rattus norvegicus
cgcccattttttcgaggtaaagcag

SEQ ID NO: 258181 - DNA, 25 bp, Rattus norvegicus
cgcccattttttggaggtaaagcag

SEQ ID NO: 258182 - DNA, 25 bp, Rattus norvegicus
cgccccagactactgtgactgagaa

SEQ ID NO: 258183 - DNA, 25 bp, Rattus norvegicus
cgccccagactagtgtgactgagaa

SEQ ID NO: 258184 - DNA, 25 bp, Rattus norvegicus
cgccccatgagtcttcactagaaag

SEQ ID NO: 258185 - DNA, 25 bp, Rattus norvegicus
cgccccatgagtgttcactagaaag

SEQ ID NO: 258186 - DNA, 25 bp, Rattus norvegicus
cgccccatgggccaaagaaaatgat

SEQ ID NO: 258187 - DNA, 25 bp, Rattus norvegicus
cgccccatgggcgaaagaaaatgat

SEQ ID NO: 258188 - DNA, 25 bp, Rattus norvegicus
cgccccgaagaacggctccaagaag

SEQ ID NO: 258189 - DNA, 25 bp, Rattus norvegicus
cgccccgaagaagggctccaagaag

SEQ ID NO: 258190 - DNA, 25 bp, Rattus norvegicus
cgccccggccggagcagtgatgaca

SEQ ID NO: 258191 - DNA, 25 bp, Rattus norvegicus
cgccccggccggtgcagtgatgaca

SEQ ID NO: 258192 - DNA, 25 bp, Rattus norvegicus
cgcccctgaagcactgtgtggttag

SEQ ID NO: 258193 - DNA, 25 bp, Rattus norvegicus
cgcccctgaagctctgtgtggttag

SEQ ID NO: 258194 - DNA, 25 bp, Rattus norvegicus
cgcccgaagcttcagaaaccctggt

SEQ ID NO: 258195 - DNA, 25 bp, Rattus norvegicus
cgcccgaagcttgagaaaccctggt

SEQ ID NO: 258196 - DNA, 25 bp, Rattus norvegicus
cgcccgaattctatagtgagccatt

SEQ ID NO: 258197 - DNA, 25 bp, Rattus norvegicus
cgcccgaattctttagtgagccatt

SEQ ID NO: 258198 - DNA, 25 bp, Rattus norvegicus
cgcccgaattgcaacagtttcttgg

SEQ ID NO: 258199 - DNA, 25 bp, Rattus norvegicus
cgcccgaattgctacagtttcttgg

SEQ ID NO: 258200 - DNA, 25 bp, Rattus norvegicus
cgcccgccatgaagctaggtaacaa

SEQ ID NO: 258201 - DNA, 25 bp, Rattus norvegicus
cgcccgccatgatgctaggtaacaa

SEQ ID NO: 258202 - DNA, 25 bp, Rattus norvegicus
cgcccgcgagttcatcctgaagatg

SEQ ID NO: 258203 - DNA, 25 bp, Rattus norvegicus
cgcccgcgagttgatcctgaagatg

SEQ ID NO: 258204 - DNA, 25 bp, Rattus norvegicus
cgcccgcgatccaggtgacgggtct

SEQ ID NO: 258205 - DNA, 25 bp, Rattus norvegicus
cgcccgcgatcctggtgacgggtct

SEQ ID NO: 258206 - DNA, 25 bp, Rattus norvegicus
cgcccgctcgtactgtgtttccaag

SEQ ID NO: 258207 - DNA, 25 bp, Rattus norvegicus
cgcccgctcgtagtgtgtttccaag

SEQ ID NO: 258208 - DNA, 25 bp, Rattus norvegicus
cgcccggaacataggcttctgtaaa

SEQ ID NO: 258209 - DNA, 25 bp, Rattus norvegicus
cgcccggaacattggcttctgtaaa

SEQ ID NO: 258210 - DNA, 25 bp, Rattus norvegicus
cgcccgtcaataattgtattatggt

SEQ ID NO: 258211 - DNA, 25 bp, Rattus norvegicus
cgcccgtcaatatttgtattatggt

SEQ ID NO: 258212 - DNA, 25 bp, Rattus norvegicus
cgccctatgtatcccatcctaagat

SEQ ID NO: 258213 - DNA, 25 bp, Rattus norvegicus
cgccctatgtatgccatcctaagat

SEQ ID NO: 258214 - DNA, 25 bp, Rattus norvegicus
cgccctcagtacaggtccgagaaag

SEQ ID NO: 258215 - DNA, 25 bp, Rattus norvegicus
cgccctcagtactggtccgagaaag

SEQ ID NO: 258216 - DNA, 25 bp, Rattus norvegicus
cgccctcatcttatggtgacataga

SEQ ID NO: 258217 - DNA, 25 bp, Rattus norvegicus
cgccctcatcttttggtgacataga

SEQ ID NO: 258218 - DNA, 25 bp, Rattus norvegicus
cgccctccaagaatgtgtacttcat

SEQ ID NO: 258219 - DNA, 25 bp, Rattus norvegicus
cgccctccaagattgtgtacttcat

SEQ ID NO: 258220 - DNA, 25 bp, Rattus norvegicus
cgccctctggcgcttgaagtgagaa

SEQ ID NO: 258221 - DNA, 25 bp, Rattus norvegicus
cgccctctggcggttgaagtgagaa

SEQ ID NO: 258222 - DNA, 25 bp, Rattus norvegicus
cgccctcttattactgcatgcagta

SEQ ID NO: 258223 - DNA, 25 bp, Rattus norvegicus
cgccctcttatttctgcatgcagta

SEQ ID NO: 258224 - DNA, 25 bp, Rattus norvegicus
cgccctgaagggaactgagtgtgta

SEQ ID NO: 258225 - DNA, 25 bp, Rattus norvegicus
cgccctgaagggtactgagtgtgta

SEQ ID NO: 258226 - DNA, 25 bp, Rattus norvegicus
cgccctgcccttcacaaagaaaaga

SEQ ID NO: 258227 - DNA, 25 bp, Rattus norvegicus
cgccctgcccttgacaaagaaaaga

SEQ ID NO: 258228 - DNA, 25 bp, Rattus norvegicus
cgccctgggaagagattctttaaat

SEQ ID NO: 258229 - DNA, 25 bp, Rattus norvegicus
cgccctgggaagtgattctttaaat

SEQ ID NO: 258230 - DNA, 25 bp, Rattus norvegicus
cgccctgggactcacggaaagacaa

SEQ ID NO: 258231 - DNA, 25 bp, Rattus norvegicus
cgccctgggactgacggaaagacaa

SEQ ID NO: 258232 - DNA, 25 bp, Rattus norvegicus
cgccctggtgggagagcctcttgca

SEQ ID NO: 258233 - DNA, 25 bp, Rattus norvegicus
cgccctggtgggtgagcctcttgca

SEQ ID NO: 258234 - DNA, 25 bp, Rattus norvegicus
cgccctgtactcagaatctgtggac

SEQ ID NO: 258235 - DNA, 25 bp, Rattus norvegicus
cgccctgtactctgaatctgtggac

SEQ ID NO: 258236 - DNA, 25 bp, Rattus norvegicus
cgccctgtctagatgttgctgggaa

SEQ ID NO: 258237 - DNA, 25 bp, Rattus norvegicus
cgccctgtctagttgttgctgggaa

SEQ ID NO: 258238 - DNA, 25 bp, Rattus norvegicus
cgccctgtgcacctgatgagtgagt

SEQ ID NO: 258239 - DNA, 25 bp, Rattus norvegicus
cgccctgtgcacgtgatgagtgagt

SEQ ID NO: 258240 - DNA, 25 bp, Rattus norvegicus
cgcccttgagttacagccttaggaa

SEQ ID NO: 258241 - DNA, 25 bp, Rattus norvegicus
cgcccttgagtttcagccttaggaa

SEQ ID NO: 258242 - DNA, 25 bp, Rattus norvegicus
cgcccttttctgaggtcacatgatt

SEQ ID NO: 258243 - DNA, 25 bp, Rattus norvegicus
cgcccttttctgtggtcacatgatt

SEQ ID NO: 258244 - DNA, 25 bp, Rattus norvegicus
cgccctttttgcctcattaaatcaa

SEQ ID NO: 258245 - DNA, 25 bp, Rattus norvegicus
cgccctttttgcgtcattaaatcaa

SEQ ID NO: 258246 - DNA, 25 bp, Rattus norvegicus
cgccgaaaaggccagcgagtcgcat

SEQ ID NO: 258247 - DNA, 25 bp, Rattus norvegicus
cgccgaaaaggcgagcgagtcgcat

SEQ ID NO: 258248 - DNA, 25 bp, Rattus norvegicus
cgccgaacagttctgcgctggtctt

SEQ ID NO: 258249 - DNA, 25 bp, Rattus norvegicus
cgccgaacagttgtgcgctggtctt

SEQ ID NO: 258250 - DNA, 25 bp, Rattus norvegicus
cgccgaagatacagtcttccttaca

SEQ ID NO: 258251 - DNA, 25 bp, Rattus norvegicus
cgccgaagatactgtcttccttaca

SEQ ID NO: 258252 - DNA, 25 bp, Rattus norvegicus
cgccgaagtgtcaacctacaatatt

SEQ ID NO: 258253 - DNA, 25 bp, Rattus norvegicus
cgccgaagtgtctacctacaatatt

SEQ ID NO: 258254 - DNA, 25 bp, Rattus norvegicus
cgccgactctggaggcggccctgat

SEQ ID NO: 258255 - DNA, 25 bp, Rattus norvegicus
cgccgactctggtggcggccctgat

SEQ ID NO: 258256 - DNA, 25 bp, Rattus norvegicus
cgccgagagcgcatcgaggatatca

SEQ ID NO: 258257 - DNA, 25 bp, Rattus norvegicus
cgccgagagcgcttcgaggatatca

SEQ ID NO: 258258 - DNA, 25 bp, Rattus norvegicus
cgccgagcagacatccatgtgggtg

SEQ ID NO: 258259 - DNA, 25 bp, Rattus norvegicus
cgccgagcagacttccatgtgggtg

SEQ ID NO: 258260 - DNA, 25 bp, Rattus norvegicus
cgccgagctgctcagaacattagtg

SEQ ID NO: 258261 - DNA, 25 bp, Rattus norvegicus
cgccgagctgctgagaacattagtg

SEQ ID NO: 258262 - DNA, 25 bp, Rattus norvegicus
cgccgatctggcagtggcaagagac

SEQ ID NO: 258263 - DNA, 25 bp, Rattus norvegicus
cgccgatctggctgtggcaagagac

SEQ ID NO: 258264 - DNA, 25 bp, Rattus norvegicus
cgccgcatggatcaccagcgtgtaa

SEQ ID NO: 258265 - DNA, 25 bp, Rattus norvegicus
cgccgcatggatgaccagcgtgtaa

SEQ ID NO: 258266 - DNA, 25 bp, Rattus norvegicus
cgccgccaatgcatgttcaggcacg

SEQ ID NO: 258267 - DNA, 25 bp, Rattus norvegicus
cgccgccaatgcttgttcaggcacg

SEQ ID NO: 258268 - DNA, 25 bp, Rattus norvegicus
cgccgccagaggcagagctatgaaa

SEQ ID NO: 258269 - DNA, 25 bp, Rattus norvegicus
cgccgccagagggagagctatgaaa

SEQ ID NO: 258270 - DNA, 25 bp, Rattus norvegicus
cgccgcccctttagttgaagagctt

SEQ ID NO: 258271 - DNA, 25 bp, Rattus norvegicus
cgccgccccttttgttgaagagctt

SEQ ID NO: 258272 - DNA, 25 bp, Rattus norvegicus
cgccgcgatgttcatgcccaagaag

SEQ ID NO: 258273 - DNA, 25 bp, Rattus norvegicus
cgccgcgatgttgatgcccaagaag

SEQ ID NO: 258274 - DNA, 25 bp, Rattus norvegicus
cgccgcggccggaatttataatccg

SEQ ID NO: 258275 - DNA, 25 bp, Rattus norvegicus
cgccgcggccggtatttataatccg

SEQ ID NO: 258276 - DNA, 25 bp, Rattus norvegicus
cgccgcgtgcagacagtggtattgt

SEQ ID NO: 258277 - DNA, 25 bp, Rattus norvegicus
cgccgcgtgcagtcagtggtattgt

SEQ ID NO: 258278 - DNA, 25 bp, Rattus norvegicus
cgccgctagcgtagtagggatttgt

SEQ ID NO: 258279 - DNA, 25 bp, Rattus norvegicus
cgccgctagcgttgtagggatttgt

SEQ ID NO: 258280 - DNA, 25 bp, Rattus norvegicus
cgccgctggttgcaagcgcaagtat

SEQ ID NO: 258281 - DNA, 25 bp, Rattus norvegicus
cgccgctggttggaagcgcaagtat

SEQ ID NO: 258282 - DNA, 25 bp, Rattus norvegicus
cgccggaaagcgagccaatcaacat

SEQ ID NO: 258283 - DNA, 25 bp, Rattus norvegicus
cgccggaaagcgtgccaatcaacat

SEQ ID NO: 258284 - DNA, 25 bp, Rattus norvegicus
cgccggacagtgcatggccttgact

SEQ ID NO: 258285 - DNA, 25 bp, Rattus norvegicus
cgccggacagtggatggccttgact

SEQ ID NO: 258286 - DNA, 25 bp, Rattus norvegicus
cgccggaggcggaggaatcacttcc

SEQ ID NO: 258287 - DNA, 25 bp, Rattus norvegicus
cgccggaggcggtggaatcacttcc

SEQ ID NO: 258288 - DNA, 25 bp, Rattus norvegicus
cgccgggacaagctcacctttgtag

SEQ ID NO: 258289 - DNA, 25 bp, Rattus norvegicus
cgccgggacaaggtcacctttgtag

SEQ ID NO: 258290 - DNA, 25 bp, Rattus norvegicus
cgccgggactcaagagctgagcgcc

SEQ ID NO: 258291 - DNA, 25 bp, Rattus norvegicus
cgccgggactcatgagctgagcgcc

SEQ ID NO: 258292 - DNA, 25 bp, Rattus norvegicus
cgccgggcgtccaggagcacagaca

SEQ ID NO: 258293 - DNA, 25 bp, Rattus norvegicus
cgccgggcgtcctggagcacagaca

SEQ ID NO: 258294 - DNA, 25 bp, Rattus norvegicus
cgccggtaccacctgagatgtctgt

SEQ ID NO: 258295 - DNA, 25 bp, Rattus norvegicus
cgccggtaccacgtgagatgtctgt

SEQ ID NO: 258296 - DNA, 25 bp, Rattus norvegicus
cgccggtctgtgattgctgagatca

SEQ ID NO: 258297 - DNA, 25 bp, Rattus norvegicus
cgccggtctgtgtttgctgagatca

SEQ ID NO: 258298 - DNA, 25 bp, Rattus norvegicus
cgccggtgtcggaccctactcaggg

SEQ ID NO: 258299 - DNA, 25 bp, Rattus norvegicus
cgccggtgtcggtccctactcaggg

SEQ ID NO: 258300 - DNA, 25 bp, Rattus norvegicus
cgccggttgacgatggccactgagt

SEQ ID NO: 258301 - DNA, 25 bp, Rattus norvegicus
cgccggttgacgttggccactgagt

SEQ ID NO: 258302 - DNA, 25 bp, Rattus norvegicus
cgccgtagtacacgtgcagagcact

SEQ ID NO: 258303 - DNA, 25 bp, Rattus norvegicus
cgccgtagtacaggtgcagagcact

SEQ ID NO: 258304 - DNA, 25 bp, Rattus norvegicus
cgccgtatgatcactctggaaacac

SEQ ID NO: 258305 - DNA, 25 bp, Rattus norvegicus
cgccgtatgatctctctggaaacac

SEQ ID NO: 258306 - DNA, 25 bp, Rattus norvegicus
cgccgtccggtcagagatagggttt

SEQ ID NO: 258307 - DNA, 25 bp, Rattus norvegicus
cgccgtccggtctgagatagggttt

SEQ ID NO: 258308 - DNA, 25 bp, Rattus norvegicus
cgccgtcggttcaggagatcctgga

SEQ ID NO: 258309 - DNA, 25 bp, Rattus norvegicus
cgccgtcggttctggagatcctgga

SEQ ID NO: 258310 - DNA, 25 bp, Rattus norvegicus
cgccgtgctcaacattttgtgcagt

SEQ ID NO: 258311 - DNA, 25 bp, Rattus norvegicus
cgccgtgctcaagattttgtgcagt

SEQ ID NO: 258312 - DNA, 25 bp, Rattus norvegicus
cgccgtggtgttacagaagcgccag

SEQ ID NO: 258313 - DNA, 25 bp, Rattus norvegicus
cgccgtggtgtttcagaagcgccag

SEQ ID NO: 258314 - DNA, 25 bp, Rattus norvegicus
cgccgtgtgcagaaagcgggacttt

SEQ ID NO: 258315 - DNA, 25 bp, Rattus norvegicus
cgccgtgtgcagtaagcgggacttt

SEQ ID NO: 258316 - DNA, 25 bp, Rattus norvegicus
cgccgttatcagcaccagcttgaag

SEQ ID NO: 258317 - DNA, 25 bp, Rattus norvegicus
cgccgttatcaggaccagcttgaag

SEQ ID NO: 258318 - DNA, 25 bp, Rattus norvegicus
cgccgttgctcacactggcttcaaa

SEQ ID NO: 258319 - DNA, 25 bp, Rattus norvegicus
cgccgttgctcagactggcttcaaa

SEQ ID NO: 258320 - DNA, 25 bp, Rattus norvegicus
cgcctacacgtgaccgcgggaggct

SEQ ID NO: 258321 - DNA, 25 bp, Rattus norvegicus
cgcctacacgtgtccgcgggaggct

SEQ ID NO: 258322 - DNA, 25 bp, Rattus norvegicus
cgcctactggtcctgtttttagaag

SEQ ID NO: 258323 - DNA, 25 bp, Rattus norvegicus
cgcctactggtcgtgtttttagaag

SEQ ID NO: 258324 - DNA, 25 bp, Rattus norvegicus
cgcctagcactacccatggagctga

SEQ ID NO: 258325 - DNA, 25 bp, Rattus norvegicus
cgcctagcactagccatggagctga

SEQ ID NO: 258326 - DNA, 25 bp, Rattus norvegicus
cgcctatatttcaccagttcattga

SEQ ID NO: 258327 - DNA, 25 bp, Rattus norvegicus
cgcctatatttctccagttcattga

SEQ ID NO: 258328 - DNA, 25 bp, Rattus norvegicus
cgcctatctggtaataactgcggtg

SEQ ID NO: 258329 - DNA, 25 bp, Rattus norvegicus
cgcctatctggttataactgcggtg

SEQ ID NO: 258330 - DNA, 25 bp, Rattus norvegicus
cgcctcaaacgcaagaccattcatt

SEQ ID NO: 258331 - DNA, 25 bp, Rattus norvegicus
cgcctcaaacgctagaccattcatt

SEQ ID NO: 258332 - DNA, 25 bp, Rattus norvegicus
cgcctcaaagatcgcgctggtttcc

SEQ ID NO: 258333 - DNA, 25 bp, Rattus norvegicus
cgcctcaaagatggcgctggtttcc

SEQ ID NO: 258334 - DNA, 25 bp, Rattus norvegicus
cgcctcaacgggatggctgcgcagc

SEQ ID NO: 258335 - DNA, 25 bp, Rattus norvegicus
cgcctcaacgggttggctgcgcagc

SEQ ID NO: 258336 - DNA, 25 bp, Rattus norvegicus
cgcctcagcttaaacattgaccctg

SEQ ID NO: 258337 - DNA, 25 bp, Rattus norvegicus
cgcctcagcttacgagcgttgtgat

SEQ ID NO: 258338 - DNA, 25 bp, Rattus norvegicus
cgcctcagcttaggagcgttgtgat

SEQ ID NO: 258339 - DNA, 25 bp, Rattus norvegicus
cgcctcagcttatacattgaccctg

SEQ ID NO: 258340 - DNA, 25 bp, Rattus norvegicus
cgcctcaggtggaggagaccgaccc

SEQ ID NO: 258341 - DNA, 25 bp, Rattus norvegicus
cgcctcaggtggattttgtgttact

SEQ ID NO: 258342 - DNA, 25 bp, Rattus norvegicus
cgcctcaggtggtggagaccgaccc

SEQ ID NO: 258343 - DNA, 25 bp, Rattus norvegicus
cgcctcaggtggtttttgtgttact

SEQ ID NO: 258344 - DNA, 25 bp, Rattus norvegicus
cgcctcagtatcctcatcatagtga

SEQ ID NO: 258345 - DNA, 25 bp, Rattus norvegicus
cgcctcagtatcgtcatcatagtga

SEQ ID NO: 258346 - DNA, 25 bp, Rattus norvegicus
cgcctcgggcgaaggttattttctg

SEQ ID NO: 258347 - DNA, 25 bp, Rattus norvegicus
cgcctcgggcgatggttattttctg

SEQ ID NO: 258348 - DNA, 25 bp, Rattus norvegicus
cgcctcgtgggaattagtgcagaga

SEQ ID NO: 258349 - DNA, 25 bp, Rattus norvegicus
cgcctcgtgggatttagtgcagaga

SEQ ID NO: 258350 - DNA, 25 bp, Rattus norvegicus
cgcctctctgcaagtggtggattct

SEQ ID NO: 258351 - DNA, 25 bp, Rattus norvegicus
cgcctctctgcatgtggtggattct

SEQ ID NO: 258352 - DNA, 25 bp, Rattus norvegicus
cgcctctgaatcagtgagactccct

SEQ ID NO: 258353 - DNA, 25 bp, Rattus norvegicus
cgcctctgaatctgtgagactccct

SEQ ID NO: 258354 - DNA, 25 bp, Rattus norvegicus
cgcctctgggagaccgaattcaggt

SEQ ID NO: 258355 - DNA, 25 bp, Rattus norvegicus
cgcctctgggagtccgaattcaggt

SEQ ID NO: 258356 - DNA, 25 bp, Rattus norvegicus
cgcctctttcatagtggttatccga

SEQ ID NO: 258357 - DNA, 25 bp, Rattus norvegicus
cgcctctttcattgtggttatccga

SEQ ID NO: 258358 - DNA, 25 bp, Rattus norvegicus
cgcctgaccattcatttttcttgtt

SEQ ID NO: 258359 - DNA, 25 bp, Rattus norvegicus
cgcctgaccattgatttttcttgtt

SEQ ID NO: 258360 - DNA, 25 bp, Rattus norvegicus
cgcctgaccgttcttgtgtttacaa

SEQ ID NO: 258361 - DNA, 25 bp, Rattus norvegicus
cgcctgaccgttgttgtgtttacaa

SEQ ID NO: 258362 - DNA, 25 bp, Rattus norvegicus
cgcctgcagccaagattttgttacg

SEQ ID NO: 258363 - DNA, 25 bp, Rattus norvegicus
cgcctgcagccatgattttgttacg

SEQ ID NO: 258364 - DNA, 25 bp, Rattus norvegicus
cgcctgccctagagtgtcgaagatg

SEQ ID NO: 258365 - DNA, 25 bp, Rattus norvegicus
cgcctgccctagtgtgtcgaagatg

SEQ ID NO: 258366 - DNA, 25 bp, Rattus norvegicus
cgcctgccgactacacatacaaaga

SEQ ID NO: 258367 - DNA, 25 bp, Rattus norvegicus
cgcctgccgacttcacatacaaaga

SEQ ID NO: 258368 - DNA, 25 bp, Rattus norvegicus
cgcctgccggtacacttagctgaag

SEQ ID NO: 258369 - DNA, 25 bp, Rattus norvegicus
cgcctgccggtagacttagctgaag

SEQ ID NO: 258370 - DNA, 25 bp, Rattus norvegicus
cgcctgcgggaaacactgggtttgc

SEQ ID NO: 258371 - DNA, 25 bp, Rattus norvegicus
cgcctgcgggaatcactgggtttgc

SEQ ID NO: 258372 - DNA, 25 bp, Rattus norvegicus
cgcctgcgggatataatgcttcgag

SEQ ID NO: 258373 - DNA, 25 bp, Rattus norvegicus
cgcctgcgggatttaatgcttcgag

SEQ ID NO: 258374 - DNA, 25 bp, Rattus norvegicus
cgcctggcacttatacgggatcaaa

SEQ ID NO: 258375 - DNA, 25 bp, Rattus norvegicus
cgcctggcacttttacgggatcaaa

SEQ ID NO: 258376 - DNA, 25 bp, Rattus norvegicus
cgcctggcttatctcagtgctataa

SEQ ID NO: 258377 - DNA, 25 bp, Rattus norvegicus
cgcctggcttatgtcagtgctataa

SEQ ID NO: 258378 - DNA, 25 bp, Rattus norvegicus
cgcctggcttggagcgtcacagtcg

SEQ ID NO: 258379 - DNA, 25 bp, Rattus norvegicus
cgcctggcttggtgcgtcacagtcg

SEQ ID NO: 258380 - DNA, 25 bp, Rattus norvegicus
cgcctggctttaagcatgctggaga

SEQ ID NO: 258381 - DNA, 25 bp, Rattus norvegicus
cgcctggctttatgcatgctggaga

SEQ ID NO: 258382 - DNA, 25 bp, Rattus norvegicus
cgcctgggcatcataatgagacccc

SEQ ID NO: 258383 - DNA, 25 bp, Rattus norvegicus
cgcctgggcatcttaatgagacccc

SEQ ID NO: 258384 - DNA, 25 bp, Rattus norvegicus
cgcctgggccccaagttgcaggaag

SEQ ID NO: 258385 - DNA, 25 bp, Rattus norvegicus
cgcctgggcccctagttgcaggaag

SEQ ID NO: 258386 - DNA, 25 bp, Rattus norvegicus
cgcctggttgaaattctggcatttg

SEQ ID NO: 258387 - DNA, 25 bp, Rattus norvegicus
cgcctggttgaatttctggcatttg

SEQ ID NO: 258388 - DNA, 25 bp, Rattus norvegicus
cgcctgtaaaacacgatctgaccat

SEQ ID NO: 258389 - DNA, 25 bp, Rattus norvegicus
cgcctgtaaaactcgatctgaccat

SEQ ID NO: 258390 - DNA, 25 bp, Rattus norvegicus
cgcctgtatgggagcgaccgtgctt

SEQ ID NO: 258391 - DNA, 25 bp, Rattus norvegicus
cgcctgtatgggtgcgaccgtgctt

SEQ ID NO: 258392 - DNA, 25 bp, Rattus norvegicus
cgcctgtccagcctgcagctttggg

SEQ ID NO: 258393 - DNA, 25 bp, Rattus norvegicus
cgcctgtccagcgtgcagctttggg

SEQ ID NO: 258394 - DNA, 25 bp, Rattus norvegicus
cgcctgtctgcacagtattacgtaa

SEQ ID NO: 258395 - DNA, 25 bp, Rattus norvegicus
cgcctgtctgcagagtattacgtaa

SEQ ID NO: 258396 - DNA, 25 bp, Rattus norvegicus
cgcctgtgaatgaagctccgggtga

SEQ ID NO: 258397 - DNA, 25 bp, Rattus norvegicus
cgcctgtgaatgtagctccgggtga

SEQ ID NO: 258398 - DNA, 25 bp, Rattus norvegicus
cgcctgtgtgatccttctgtgaaga

SEQ ID NO: 258399 - DNA, 25 bp, Rattus norvegicus
cgcctgtgtgatgcttctgtgaaga

SEQ ID NO: 258400 - DNA, 25 bp, Rattus norvegicus
cgccttatctccagctttgagaatg

SEQ ID NO: 258401 - DNA, 25 bp, Rattus norvegicus
cgccttatctcctgctttgagaatg

SEQ ID NO: 258402 - DNA, 25 bp, Rattus norvegicus
cgccttcagctccaaggccaaggtg

SEQ ID NO: 258403 - DNA, 25 bp, Rattus norvegicus
cgccttcagctcgaaggccaaggtg

SEQ ID NO: 258404 - DNA, 25 bp, Rattus norvegicus
cgccttcctgttctcatgagattac

SEQ ID NO: 258405 - DNA, 25 bp, Rattus norvegicus
cgccttcctgttgtcatgagattac

SEQ ID NO: 258406 - DNA, 25 bp, Rattus norvegicus
cgccttcggttcattgactaaccag

SEQ ID NO: 258407 - DNA, 25 bp, Rattus norvegicus
cgccttcggttctttgactaaccag

SEQ ID NO: 258408 - DNA, 25 bp, Rattus norvegicus
cgccttcgtttgcagcctagcaaag

SEQ ID NO: 258409 - DNA, 25 bp, Rattus norvegicus
cgccttcgtttggagcctagcaaag

SEQ ID NO: 258410 - DNA, 25 bp, Rattus norvegicus
cgccttgaaggcctgatgttaattt

SEQ ID NO: 258411 - DNA, 25 bp, Rattus norvegicus
cgccttgaaggcgtgatgttaattt

SEQ ID NO: 258412 - DNA, 25 bp, Rattus norvegicus
cgccttgcgtagagtctgtgcccag

SEQ ID NO: 258413 - DNA, 25 bp, Rattus norvegicus
cgccttgcgtagtgtctgtgcccag

SEQ ID NO: 258414 - DNA, 25 bp, Rattus norvegicus
cgcctttgaaggagtccacactcct

SEQ ID NO: 258415 - DNA, 25 bp, Rattus norvegicus
cgcctttgaaggtgtccacactcct

SEQ ID NO: 258416 - DNA, 25 bp, Rattus norvegicus
cgcctttggccgagtccaggtaggt

SEQ ID NO: 258417 - DNA, 25 bp, Rattus norvegicus
cgcctttggccgtgtccaggtaggt

SEQ ID NO: 258418 - DNA, 25 bp, Rattus norvegicus
cgcctttgtcttcctggttataaag

SEQ ID NO: 258419 - DNA, 25 bp, Rattus norvegicus
cgcctttgtcttgctggttataaag

SEQ ID NO: 258420 - DNA, 25 bp, Rattus norvegicus
cgcgaatgcctcactatactatgac

SEQ ID NO: 258421 - DNA, 25 bp, Rattus norvegicus
cgcgaatgcctctctatactatgac

SEQ ID NO: 258422 - DNA, 25 bp, Rattus norvegicus
cgcgacaacaagaagacccgcatca

SEQ ID NO: 258423 - DNA, 25 bp, Rattus norvegicus
cgcgacaacaagtagacccgcatca

SEQ ID NO: 258424 - DNA, 25 bp, Rattus norvegicus
cgcgaccagaaccatggacttttcg

SEQ ID NO: 258425 - DNA, 25 bp, Rattus norvegicus
cgcgaccagaacgatggacttttcg

SEQ ID NO: 258426 - DNA, 25 bp, Rattus norvegicus
cgcgacgtctatctgggaaggccca

SEQ ID NO: 258427 - DNA, 25 bp, Rattus norvegicus
cgcgacgtctatgtgggaaggccca

SEQ ID NO: 258428 - DNA, 25 bp, Rattus norvegicus
cgcgactctggccacatgaaataca

SEQ ID NO: 258429 - DNA, 25 bp, Rattus norvegicus
cgcgactctggcgacatgaaataca

SEQ ID NO: 258430 - DNA, 25 bp, Rattus norvegicus
cgcgagactgttctgcttaggttga

SEQ ID NO: 258431 - DNA, 25 bp, Rattus norvegicus
cgcgagactgttgtgcttaggttga

SEQ ID NO: 258432 - DNA, 25 bp, Rattus norvegicus
cgcgaggtgtcgctagatgcttttt

SEQ ID NO: 258433 - DNA, 25 bp, Rattus norvegicus
cgcgaggtgtcggtagatgcttttt

SEQ ID NO: 258434 - DNA, 25 bp, Rattus norvegicus
cgcgagtcttctatgacgtggacat

SEQ ID NO: 258435 - DNA, 25 bp, Rattus norvegicus
cgcgagtcttctttgacgtggacat

SEQ ID NO: 258436 - DNA, 25 bp, Rattus norvegicus
cgcgagtgtccactgtacttgcaaa

SEQ ID NO: 258437 - DNA, 25 bp, Rattus norvegicus
cgcgagtgtccagtgtacttgcaaa

SEQ ID NO: 258438 - DNA, 25 bp, Rattus norvegicus
cgcgatcctggtcacgggtctcggg

SEQ ID NO: 258439 - DNA, 25 bp, Rattus norvegicus
cgcgatcctggtgacgggtctcggg

SEQ ID NO: 258440 - DNA, 25 bp, Rattus norvegicus
cgcgatgccaccattaatcgatcat

SEQ ID NO: 258441 - DNA, 25 bp, Rattus norvegicus
cgcgatgccacctttaatcgatcat

SEQ ID NO: 258442 - DNA, 25 bp, Rattus norvegicus
cgcgattggaatattgggccctgaa

SEQ ID NO: 258443 - DNA, 25 bp, Rattus norvegicus
cgcgattggaattttgggccctgaa

SEQ ID NO: 258444 - DNA, 25 bp, Rattus norvegicus
cgcgcaactgctcgcttattgatta

SEQ ID NO: 258445 - DNA, 25 bp, Rattus norvegicus
cgcgcaactgctggcttattgatta

SEQ ID NO: 258446 - DNA, 25 bp, Rattus norvegicus
cgcgcaaggcgcaggacaagtcaat

SEQ ID NO: 258447 - DNA, 25 bp, Rattus norvegicus
cgcgcaaggcgctggacaagtcaat

SEQ ID NO: 258448 - DNA, 25 bp, Rattus norvegicus
cgcgcacagcgaagaaggcccagag

SEQ ID NO: 258449 - DNA, 25 bp, Rattus norvegicus
cgcgcacagcgatgaaggcccagag

SEQ ID NO: 258450 - DNA, 25 bp, Rattus norvegicus
cgcgcaccagcacgcgctgaaagaa

SEQ ID NO: 258451 - DNA, 25 bp, Rattus norvegicus
cgcgcaccagcaggcgctgaaagaa

SEQ ID NO: 258452 - DNA, 25 bp, Rattus norvegicus
cgcgcagaacaacgccagctccgtg

SEQ ID NO: 258453 - DNA, 25 bp, Rattus norvegicus
cgcgcagaacaaggccagctccgtg

SEQ ID NO: 258454 - DNA, 25 bp, Rattus norvegicus
cgcgcagatgtccaaaagtctaaat

SEQ ID NO: 258455 - DNA, 25 bp, Rattus norvegicus
cgcgcagatgtcgaaaagtctaaat

SEQ ID NO: 258456 - DNA, 25 bp, Rattus norvegicus
cgcgcagcacttcgaagtcactgtt

SEQ ID NO: 258457 - DNA, 25 bp, Rattus norvegicus
cgcgcagcacttggaagtcactgtt

SEQ ID NO: 258458 - DNA, 25 bp, Rattus norvegicus
cgcgcagggcttctccatgagatag

SEQ ID NO: 258459 - DNA, 25 bp, Rattus norvegicus
cgcgcagggcttgtccatgagatag

SEQ ID NO: 258460 - DNA, 25 bp, Rattus norvegicus
cgcgcatacataccccacatataga

SEQ ID NO: 258461 - DNA, 25 bp, Rattus norvegicus
cgcgcatacatagcccacatataga

SEQ ID NO: 258462 - DNA, 25 bp, Rattus norvegicus
cgcgccaaatggacttacgtattca

SEQ ID NO: 258463 - DNA, 25 bp, Rattus norvegicus
cgcgccaaatggtcttacgtattca

SEQ ID NO: 258464 - DNA, 25 bp, Rattus norvegicus
cgcgccacctcgagcggagctttgg

SEQ ID NO: 258465 - DNA, 25 bp, Rattus norvegicus
cgcgccacctcgtgcggagctttgg

SEQ ID NO: 258466 - DNA, 25 bp, Rattus norvegicus
cgcgcccatctgcacggaactgagg

SEQ ID NO: 258467 - DNA, 25 bp, Rattus norvegicus
cgcgcccatctggacggaactgagg

SEQ ID NO: 258468 - DNA, 25 bp, Rattus norvegicus
cgcgcccatggcaaccggagtgctg

SEQ ID NO: 258469 - DNA, 25 bp, Rattus norvegicus
cgcgcccatggctaccggagtgctg

SEQ ID NO: 258470 - DNA, 25 bp, Rattus norvegicus
cgcgcccgatctcgtctgatctcgg

SEQ ID NO: 258471 - DNA, 25 bp, Rattus norvegicus
cgcgcccgatctggtctgatctcgg

SEQ ID NO: 258472 - DNA, 25 bp, Rattus norvegicus
cgcgccgctgctcggagagatcccc

SEQ ID NO: 258473 - DNA, 25 bp, Rattus norvegicus
cgcgccgctgctgggagagatcccc

SEQ ID NO: 258474 - DNA, 25 bp, Rattus norvegicus
cgcgccggcgccacaagaaagagaa

SEQ ID NO: 258475 - DNA, 25 bp, Rattus norvegicus
cgcgccggcgcctcaagaaagagaa

SEQ ID NO: 258476 - DNA, 25 bp, Rattus norvegicus
cgcgccgggtctaacagaactaagt

SEQ ID NO: 258477 - DNA, 25 bp, Rattus norvegicus
cgcgccgggtcttacagaactaagt

SEQ ID NO: 258478 - DNA, 25 bp, Rattus norvegicus
cgcgcctctatcctaatttgaggta

SEQ ID NO: 258479 - DNA, 25 bp, Rattus norvegicus
cgcgcctctatcgtaatttgaggta

SEQ ID NO: 258480 - DNA, 25 bp, Rattus norvegicus
cgcgcgcacacgctcgggattaaga

SEQ ID NO: 258481 - DNA, 25 bp, Rattus norvegicus
cgcgcgcacacggtcgggattaaga

SEQ ID NO: 258482 - DNA, 25 bp, Rattus norvegicus
cgcgcgccaacgatgacaaggtatt

SEQ ID NO: 258483 - DNA, 25 bp, Rattus norvegicus
cgcgcgccaacgttgacaaggtatt

SEQ ID NO: 258484 - DNA, 25 bp, Rattus norvegicus
cgcgcggctcgcaactaaagtgtga

SEQ ID NO: 258485 - DNA, 25 bp, Rattus norvegicus
cgcgcggctcgctactaaagtgtga

SEQ ID NO: 258486 - DNA, 25 bp, Rattus norvegicus
cgcgctaacggcctttctaacaatt

SEQ ID NO: 258487 - DNA, 25 bp, Rattus norvegicus
cgcgctaacggcgtttctaacaatt

SEQ ID NO: 258488 - DNA, 25 bp, Rattus norvegicus
cgcgctacaaaaccgggctggaagc

SEQ ID NO: 258489 - DNA, 25 bp, Rattus norvegicus
cgcgctacaaaagcgggctggaagc

SEQ ID NO: 258490 - DNA, 25 bp, Rattus norvegicus
cgcgctcctaacatttcaacatttg

SEQ ID NO: 258491 - DNA, 25 bp, Rattus norvegicus
cgcgctcctaacttttcaacatttg

SEQ ID NO: 258492 - DNA, 25 bp, Rattus norvegicus
cgcgctcctgcgaaaataggcggtt

SEQ ID NO: 258493 - DNA, 25 bp, Rattus norvegicus
cgcgctcctgcgtaaataggcggtt

SEQ ID NO: 258494 - DNA, 25 bp, Rattus norvegicus
cgcgctctcttccaattttaacgaa

SEQ ID NO: 258495 - DNA, 25 bp, Rattus norvegicus
cgcgctctcttcgaattttaacgaa

SEQ ID NO: 258496 - DNA, 25 bp, Rattus norvegicus
cgcgctctgcatcagtgacggtaag

SEQ ID NO: 258497 - DNA, 25 bp, Rattus norvegicus
cgcgctctgcatgagtgacggtaag

SEQ ID NO: 258498 - DNA, 25 bp, Rattus norvegicus
cgcgctggctcccaggtgatccgaa

SEQ ID NO: 258499 - DNA, 25 bp, Rattus norvegicus
cgcgctggctccgaggtgatccgaa

SEQ ID NO: 258500 - DNA, 25 bp, Rattus norvegicus
cgcgcttacgccagtgttgatggaa

SEQ ID NO: 258501 - DNA, 25 bp, Rattus norvegicus
cgcgcttacgcctgtgttgatggaa

SEQ ID NO: 258502 - DNA, 25 bp, Rattus norvegicus
cgcgcttctgagcaggcttgactat

SEQ ID NO: 258503 - DNA, 25 bp, Rattus norvegicus
cgcgcttctgaggaggcttgactat

SEQ ID NO: 258504 - DNA, 25 bp, Rattus norvegicus
cgcggaagttgtccagctcgaagtc

SEQ ID NO: 258505 - DNA, 25 bp, Rattus norvegicus
cgcggaagttgtgcagctcgaagtc

SEQ ID NO: 258506 - DNA, 25 bp, Rattus norvegicus
cgcggacacctccagttgagcacga

SEQ ID NO: 258507 - DNA, 25 bp, Rattus norvegicus
cgcggacacctcgagttgagcacga

SEQ ID NO: 258508 - DNA, 25 bp, Rattus norvegicus
cgcggagagagcatcgactgtcacc

SEQ ID NO: 258509 - DNA, 25 bp, Rattus norvegicus
cgcggagagagcttcgactgtcacc

SEQ ID NO: 258510 - DNA, 25 bp, Rattus norvegicus
cgcggagcatgcaggaagtttccat

SEQ ID NO: 258511 - DNA, 25 bp, Rattus norvegicus
cgcggagcatgctggaagtttccat

SEQ ID NO: 258512 - DNA, 25 bp, Rattus norvegicus
cgcggagccacaaggcccggaacgt

SEQ ID NO: 258513 - DNA, 25 bp, Rattus norvegicus
cgcggagccacatggcccggaacgt

SEQ ID NO: 258514 - DNA, 25 bp, Rattus norvegicus
cgcggagcgcgtacactcagggaac

SEQ ID NO: 258515 - DNA, 25 bp, Rattus norvegicus
cgcggagcgcgttcactcagggaac

SEQ ID NO: 258516 - DNA, 25 bp, Rattus norvegicus
cgcggcaggtttaggagacacgtaa

SEQ ID NO: 258517 - DNA, 25 bp, Rattus norvegicus
cgcggcaggttttggagacacgtaa

SEQ ID NO: 258518 - DNA, 25 bp, Rattus norvegicus
cgcggccgaagtaagctttccagag

SEQ ID NO: 258519 - DNA, 25 bp, Rattus norvegicus
cgcggccgaagttagctttccagag

SEQ ID NO: 258520 - DNA, 25 bp, Rattus norvegicus
cgcggccgccgacatgttcgacaac

SEQ ID NO: 258521 - DNA, 25 bp, Rattus norvegicus
cgcggccgccgagatgttcgacaac

SEQ ID NO: 258522 - DNA, 25 bp, Rattus norvegicus
cgcggccgtcgcaatggagacagat

SEQ ID NO: 258523 - DNA, 25 bp, Rattus norvegicus
cgcggccgtcgctatggagacagat

SEQ ID NO: 258524 - DNA, 25 bp, Rattus norvegicus
cgcggccttgctacatcttaagaat

SEQ ID NO: 258525 - DNA, 25 bp, Rattus norvegicus
cgcggccttgcttcatcttaagaat

SEQ ID NO: 258526 - DNA, 25 bp, Rattus norvegicus
cgcggcgcacggaaataactttgaa

SEQ ID NO: 258527 - DNA, 25 bp, Rattus norvegicus
cgcggcgcacggtaataactttgaa

SEQ ID NO: 258528 - DNA, 25 bp, Rattus norvegicus
cgcggcgcatggattcggagtcctt

SEQ ID NO: 258529 - DNA, 25 bp, Rattus norvegicus
cgcggcgcatggtttcggagtcctt

SEQ ID NO: 258530 - DNA, 25 bp, Rattus norvegicus
cgcggcgcgtgtcgttgagctggat

SEQ ID NO: 258531 - DNA, 25 bp, Rattus norvegicus
cgcggcgcgtgtggttgagctggat

SEQ ID NO: 258532 - DNA, 25 bp, Rattus norvegicus
cgcggcggcagcagtaggcacgcag

SEQ ID NO: 258533 - DNA, 25 bp, Rattus norvegicus
cgcggcggcagctgtaggcacgcag

SEQ ID NO: 258534 - DNA, 25 bp, Rattus norvegicus
cgcggctagcggagtagttacagaa

SEQ ID NO: 258535 - DNA, 25 bp, Rattus norvegicus
cgcggctagcggtgtagttacagaa

SEQ ID NO: 258536 - DNA, 25 bp, Rattus norvegicus
cgcggctcgcaactaaagtgtgaaa

SEQ ID NO: 258537 - DNA, 25 bp, Rattus norvegicus
cgcggctcgcaagtaaagtgtgaaa

SEQ ID NO: 258538 - DNA, 25 bp, Rattus norvegicus
cgcggcttttgcattggtgtctgaa

SEQ ID NO: 258539 - DNA, 25 bp, Rattus norvegicus
cgcggcttttgctttggtgtctgaa

SEQ ID NO: 258540 - DNA, 25 bp, Rattus norvegicus
cgcgggatacggagcctgctgctaa

SEQ ID NO: 258541 - DNA, 25 bp, Rattus norvegicus
cgcgggatacggtgcctgctgctaa

SEQ ID NO: 258542 - DNA, 25 bp, Rattus norvegicus
cgcgggatctgaaggctgtcaagta

SEQ ID NO: 258543 - DNA, 25 bp, Rattus norvegicus
cgcgggatctgatggctgtcaagta

SEQ ID NO: 258544 - DNA, 25 bp, Rattus norvegicus
cgcgggcaggagatcctggatccaa

SEQ ID NO: 258545 - DNA, 25 bp, Rattus norvegicus
cgcgggcaggagttcctggatccaa

SEQ ID NO: 258546 - DNA, 25 bp, Rattus norvegicus
cgcgggcgcactacgagaagcagcc

SEQ ID NO: 258547 - DNA, 25 bp, Rattus norvegicus
cgcgggcgcacttcgagaagcagcc

SEQ ID NO: 258548 - DNA, 25 bp, Rattus norvegicus
cgcgggcttggtagtccaaactgaa

SEQ ID NO: 258549 - DNA, 25 bp, Rattus norvegicus
cgcgggcttggttgtccaaactgaa

SEQ ID NO: 258550 - DNA, 25 bp, Rattus norvegicus
cgcgggctttggctatgacatgaac

SEQ ID NO: 258551 - DNA, 25 bp, Rattus norvegicus
cgcgggctttgggtatgacatgaac

SEQ ID NO: 258552 - DNA, 25 bp, Rattus norvegicus
cgcgggttcatacttcctcaggaag

SEQ ID NO: 258553 - DNA, 25 bp, Rattus norvegicus
cgcgggttcatagttcctcaggaag

SEQ ID NO: 258554 - DNA, 25 bp, Rattus norvegicus
cgcggtctcgcgcagaacaataaat

SEQ ID NO: 258555 - DNA, 25 bp, Rattus norvegicus
cgcggtctcgcggagaacaataaat

SEQ ID NO: 258556 - DNA, 25 bp, Rattus norvegicus
cgcggtgctcctagaagcagaagct

SEQ ID NO: 258557 - DNA, 25 bp, Rattus norvegicus
cgcggtgctccttgaagcagaagct

SEQ ID NO: 258558 - DNA, 25 bp, Rattus norvegicus
cgcggttatggaaaatttcagcaaa

SEQ ID NO: 258559 - DNA, 25 bp, Rattus norvegicus
cgcggttatggataatttcagcaaa

SEQ ID NO: 258560 - DNA, 25 bp, Rattus norvegicus
cgcggttggaccattgctaacaatt

SEQ ID NO: 258561 - DNA, 25 bp, Rattus norvegicus
cgcggttggacctttgctaacaatt

SEQ ID NO: 258562 - DNA, 25 bp, Rattus norvegicus
cgcgtcctatatctagcagcatggg

SEQ ID NO: 258563 - DNA, 25 bp, Rattus norvegicus
cgcgtcctatatgtagcagcatggg

SEQ ID NO: 258564 - DNA, 25 bp, Rattus norvegicus
cgcgtcctcaggatgctcgggagct

SEQ ID NO: 258565 - DNA, 25 bp, Rattus norvegicus
cgcgtcctcaggttgctcgggagct

SEQ ID NO: 258566 - DNA, 25 bp, Rattus norvegicus
cgcgtctcgagtatgttgcgcaaga

SEQ ID NO: 258567 - DNA, 25 bp, Rattus norvegicus
cgcgtctcgagtttgttgcgcaaga

SEQ ID NO: 258568 - DNA, 25 bp, Rattus norvegicus
cgcgtctggacaaggcatcgccaga

SEQ ID NO: 258569 - DNA, 25 bp, Rattus norvegicus
cgcgtctggacatggcatcgccaga

SEQ ID NO: 258570 - DNA, 25 bp, Rattus norvegicus
cgcgtcttatgtctgcttgactata

SEQ ID NO: 258571 - DNA, 25 bp, Rattus norvegicus
cgcgtcttatgtgtgcttgactata

SEQ ID NO: 258572 - DNA, 25 bp, Rattus norvegicus
cgcgtgatgaggaggatcgatactt

SEQ ID NO: 258573 - DNA, 25 bp, Rattus norvegicus
cgcgtgatgaggtggatcgatactt

SEQ ID NO: 258574 - DNA, 25 bp, Rattus norvegicus
cgcgtgcgtaccagtgtgtctagac

SEQ ID NO: 258575 - DNA, 25 bp, Rattus norvegicus
cgcgtgcgtacctgtgtgtctagac

SEQ ID NO: 258576 - DNA, 25 bp, Rattus norvegicus
cgcgtgcgtttcaacctgatggaga

SEQ ID NO: 258577 - DNA, 25 bp, Rattus norvegicus
cgcgtgcgtttctacctgatggaga

SEQ ID NO: 258578 - DNA, 25 bp, Rattus norvegicus
cgcgtgctaggcctttgtacaaaaa

SEQ ID NO: 258579 - DNA, 25 bp, Rattus norvegicus
cgcgtgctaggcgtttgtacaaaaa

SEQ ID NO: 258580 - DNA, 25 bp, Rattus norvegicus
cgcgtgtcttggactaatcagtgct

SEQ ID NO: 258581 - DNA, 25 bp, Rattus norvegicus
cgcgtgtcttggtctaatcagtgct

SEQ ID NO: 258582 - DNA, 25 bp, Rattus norvegicus
cgcgtgtgtgctcgttatttattta

SEQ ID NO: 258583 - DNA, 25 bp, Rattus norvegicus
cgcgtgtgtgctggttatttattta

SEQ ID NO: 258584 - DNA, 25 bp, Rattus norvegicus
cgcgtgtgtgtccatctgcatgtgt

SEQ ID NO: 258585 - DNA, 25 bp, Rattus norvegicus
cgcgtgtgtgtcgatctgcatgtgt

SEQ ID NO: 258586 - DNA, 25 bp, Rattus norvegicus
cgcgttctttgtaccgcgccgcggg

SEQ ID NO: 258587 - DNA, 25 bp, Rattus norvegicus
cgcgttctttgttccgcgccgcggg

SEQ ID NO: 258588 - DNA, 25 bp, Rattus norvegicus
cgcgttggagctccctcgctaggac

SEQ ID NO: 258589 - DNA, 25 bp, Rattus norvegicus
cgcgttggagctgcctcgctaggac

SEQ ID NO: 258590 - DNA, 25 bp, Rattus norvegicus
cgcgttgtgcttaaaagtaggcctt

SEQ ID NO: 258591 - DNA, 25 bp, Rattus norvegicus
cgcgttgtgctttaaagtaggcctt

SEQ ID NO: 258592 - DNA, 25 bp, Rattus norvegicus
cgctaaaattctcctcacgtaaact

SEQ ID NO: 258593 - DNA, 25 bp, Rattus norvegicus
cgctaaaattctgctcacgtaaact

SEQ ID NO: 258594 - DNA, 25 bp, Rattus norvegicus
cgctaactcattcccttgtcttaag

SEQ ID NO: 258595 - DNA, 25 bp, Rattus norvegicus
cgctaactcattgccttgtcttaag

SEQ ID NO: 258596 - DNA, 25 bp, Rattus norvegicus
cgctaactccataaaactccacaaa

SEQ ID NO: 258597 - DNA, 25 bp, Rattus norvegicus
cgctaactccattaaactccacaaa

SEQ ID NO: 258598 - DNA, 25 bp, Rattus norvegicus
cgctaagcatggcaatcgctctgtc

SEQ ID NO: 258599 - DNA, 25 bp, Rattus norvegicus
cgctaagcatgggaatcgctctgtc

SEQ ID NO: 258600 - DNA, 25 bp, Rattus norvegicus
cgctacacttccaacctagagggaa

SEQ ID NO: 258601 - DNA, 25 bp, Rattus norvegicus
cgctacacttcctacctagagggaa

SEQ ID NO: 258602 - DNA, 25 bp, Rattus norvegicus
cgctacagtccgcagccaataaagt

SEQ ID NO: 258603 - DNA, 25 bp, Rattus norvegicus
cgctacagtccggagccaataaagt

SEQ ID NO: 258604 - DNA, 25 bp, Rattus norvegicus
cgctacgccagtcagaatgtcaata

SEQ ID NO: 258605 - DNA, 25 bp, Rattus norvegicus
cgctacgccagtgagaatgtcaata

SEQ ID NO: 258606 - DNA, 25 bp, Rattus norvegicus
cgctacgtttttcggtgagcaacca

SEQ ID NO: 258607 - DNA, 25 bp, Rattus norvegicus
cgctacgtttttgggtgagcaacca

SEQ ID NO: 258608 - DNA, 25 bp, Rattus norvegicus
cgctactgtgacacgatttgtctaa

SEQ ID NO: 258609 - DNA, 25 bp, Rattus norvegicus
cgctactgtgactcgatttgtctaa

SEQ ID NO: 258610 - DNA, 25 bp, Rattus norvegicus
cgctactgtggaacaaaccgtttat

SEQ ID NO: 258611 - DNA, 25 bp, Rattus norvegicus
cgctactgtggatcaaaccgtttat

SEQ ID NO: 258612 - DNA, 25 bp, Rattus norvegicus
cgctagagcccgctaacttctgagg

SEQ ID NO: 258613 - DNA, 25 bp, Rattus norvegicus
cgctagagcccggtaacttctgagg

SEQ ID NO: 258614 - DNA, 25 bp, Rattus norvegicus
cgctagcatcgaaattccttcagga

SEQ ID NO: 258615 - DNA, 25 bp, Rattus norvegicus
cgctagcatcgatattccttcagga

SEQ ID NO: 258616 - DNA, 25 bp, Rattus norvegicus
cgctagctggctctgttggtattta

SEQ ID NO: 258617 - DNA, 25 bp, Rattus norvegicus
cgctagctggctgtgttggtattta

SEQ ID NO: 258618 - DNA, 25 bp, Rattus norvegicus
cgctagttcctaacttttggcttta

SEQ ID NO: 258619 - DNA, 25 bp, Rattus norvegicus
cgctagttcctatcttttggcttta

SEQ ID NO: 258620 - DNA, 25 bp, Rattus norvegicus
cgctatccctctccagcagtgccgg

SEQ ID NO: 258621 - DNA, 25 bp, Rattus norvegicus
cgctatccctctgcagcagtgccgg

SEQ ID NO: 258622 - DNA, 25 bp, Rattus norvegicus
cgctatgaccttactcacatcattt

SEQ ID NO: 258623 - DNA, 25 bp, Rattus norvegicus
cgctatgacctttctcacatcattt

SEQ ID NO: 258624 - DNA, 25 bp, Rattus norvegicus
cgctatgcagtaccaccttttaaag

SEQ ID NO: 258625 - DNA, 25 bp, Rattus norvegicus
cgctatgcagtagcaccttttaaag

SEQ ID NO: 258626 - DNA, 25 bp, Rattus norvegicus
cgctattcttgtagcctttttgtaa

SEQ ID NO: 258627 - DNA, 25 bp, Rattus norvegicus
cgctattcttgttgcctttttgtaa

SEQ ID NO: 258628 - DNA, 25 bp, Rattus norvegicus
cgctcacacattactgttccagatg

SEQ ID NO: 258629 - DNA, 25 bp, Rattus norvegicus
cgctcacacatttctgttccagatg

SEQ ID NO: 258630 - DNA, 25 bp, Rattus norvegicus
cgctcacactgtctttttggtattt

SEQ ID NO: 258631 - DNA, 25 bp, Rattus norvegicus
cgctcacactgtgtttttggtattt

SEQ ID NO: 258632 - DNA, 25 bp, Rattus norvegicus
cgctcaccacgaagacgaagccaat

SEQ ID NO: 258633 - DNA, 25 bp, Rattus norvegicus
cgctcaccacgatgacgaagccaat

SEQ ID NO: 258634 - DNA, 25 bp, Rattus norvegicus
cgctcaccagaacgcctagtcagga

SEQ ID NO: 258635 - DNA, 25 bp, Rattus norvegicus
cgctcaccagaaggcctagtcagga

SEQ ID NO: 258636 - DNA, 25 bp, Rattus norvegicus
cgctcaccagtgaccttttaaagaa

SEQ ID NO: 258637 - DNA, 25 bp, Rattus norvegicus
cgctcaccagtgtccttttaaagaa

SEQ ID NO: 258638 - DNA, 25 bp, Rattus norvegicus
cgctcacgtctgcttttaattccag

SEQ ID NO: 258639 - DNA, 25 bp, Rattus norvegicus
cgctcacgtctggttttaattccag

SEQ ID NO: 258640 - DNA, 25 bp, Rattus norvegicus
cgctcactaccaagttctacaaaat

SEQ ID NO: 258641 - DNA, 25 bp, Rattus norvegicus
cgctcactaccatgttctacaaaat

SEQ ID NO: 258642 - DNA, 25 bp, Rattus norvegicus
cgctcactgcggactccatgtggag

SEQ ID NO: 258643 - DNA, 25 bp, Rattus norvegicus
cgctcactgcggtctccatgtggag

SEQ ID NO: 258644 - DNA, 25 bp, Rattus norvegicus
cgctcactggtgctgtttcccatgg

SEQ ID NO: 258645 - DNA, 25 bp, Rattus norvegicus
cgctcactggtggtgtttcccatgg

SEQ ID NO: 258646 - DNA, 25 bp, Rattus norvegicus
cgctcatacgcgcatatatttgaat

SEQ ID NO: 258647 - DNA, 25 bp, Rattus norvegicus
cgctcatacgcggatatatttgaat

SEQ ID NO: 258648 - DNA, 25 bp, Rattus norvegicus
cgctcatcatcaaggtcttctttaa

SEQ ID NO: 258649 - DNA, 25 bp, Rattus norvegicus
cgctcatcatcatggtcttctttaa

SEQ ID NO: 258650 - DNA, 25 bp, Rattus norvegicus
cgctcatcgtgtcgctgctggtgaa

SEQ ID NO: 258651 - DNA, 25 bp, Rattus norvegicus
cgctcatcgtgtggctgctggtgaa

SEQ ID NO: 258652 - DNA, 25 bp, Rattus norvegicus
cgctcatgcatcagacatctgaaca

SEQ ID NO: 258653 - DNA, 25 bp, Rattus norvegicus
cgctcatgcatctgacatctgaaca

SEQ ID NO: 258654 - DNA, 25 bp, Rattus norvegicus
cgctccagggaaactacgtcgcttt

SEQ ID NO: 258655 - DNA, 25 bp, Rattus norvegicus
cgctccagggaatctacgtcgcttt

SEQ ID NO: 258656 - DNA, 25 bp, Rattus norvegicus
cgctccccagatctggtgtgattga

SEQ ID NO: 258657 - DNA, 25 bp, Rattus norvegicus
cgctccccagatgtggtgtgattga

SEQ ID NO: 258658 - DNA, 25 bp, Rattus norvegicus
cgctccccatctcgtgtaaaggcaa

SEQ ID NO: 258659 - DNA, 25 bp, Rattus norvegicus
cgctccccatctggtgtaaaggcaa

SEQ ID NO: 258660 - DNA, 25 bp, Rattus norvegicus
cgctccgcactgagtaggttgggaa

SEQ ID NO: 258661 - DNA, 25 bp, Rattus norvegicus
cgctccgcactgtgtaggttgggaa

SEQ ID NO: 258662 - DNA, 25 bp, Rattus norvegicus
cgctccgttccaaggttaaaaacat

SEQ ID NO: 258663 - DNA, 25 bp, Rattus norvegicus
cgctccgttccatggttaaaaacat

SEQ ID NO: 258664 - DNA, 25 bp, Rattus norvegicus
cgctcctcacggcaggacaagtatt

SEQ ID NO: 258665 - DNA, 25 bp, Rattus norvegicus
cgctcctcacgggaggacaagtatt

SEQ ID NO: 258666 - DNA, 25 bp, Rattus norvegicus
cgctcctcgataagtacggataggc

SEQ ID NO: 258667 - DNA, 25 bp, Rattus norvegicus
cgctcctcgatatgtacggataggc

SEQ ID NO: 258668 - DNA, 25 bp, Rattus norvegicus
cgctcctctgtgagatctgggatgt

SEQ ID NO: 258669 - DNA, 25 bp, Rattus norvegicus
cgctcctctgtgtgatctgggatgt

SEQ ID NO: 258670 - DNA, 25 bp, Rattus norvegicus
cgctcctggtcgctcctggaagcag

SEQ ID NO: 258671 - DNA, 25 bp, Rattus norvegicus
cgctcctggtcggtcctggaagcag

SEQ ID NO: 258672 - DNA, 25 bp, Rattus norvegicus
cgctcgcccgcgacggtgaagccgc

SEQ ID NO: 258673 - DNA, 25 bp, Rattus norvegicus
cgctcgcccgcgtcggtgaagccgc

SEQ ID NO: 258674 - DNA, 25 bp, Rattus norvegicus
cgctcggccgggacgttgctgtgga

SEQ ID NO: 258675 - DNA, 25 bp, Rattus norvegicus
cgctcggccgggtcgttgctgtgga

SEQ ID NO: 258676 - DNA, 25 bp, Rattus norvegicus
cgctcggtgcgaaactgatgatgaa

SEQ ID NO: 258677 - DNA, 25 bp, Rattus norvegicus
cgctcggtgcgatactgatgatgaa

SEQ ID NO: 258678 - DNA, 25 bp, Rattus norvegicus
cgctcggttcccatgtgttgaggta

SEQ ID NO: 258679 - DNA, 25 bp, Rattus norvegicus
cgctcggttcccttgtgttgaggta

SEQ ID NO: 258680 - DNA, 25 bp, Rattus norvegicus
cgctcgtgcggtctcaacgctgcag

SEQ ID NO: 258681 - DNA, 25 bp, Rattus norvegicus
cgctcgtgcggtgtcaacgctgcag

SEQ ID NO: 258682 - DNA, 25 bp, Rattus norvegicus
cgctctacagcgaaggctcttaaat

SEQ ID NO: 258683 - DNA, 25 bp, Rattus norvegicus
cgctctacagcgtaggctcttaaat

SEQ ID NO: 258684 - DNA, 25 bp, Rattus norvegicus
cgctctactgtgaggattggcctta

SEQ ID NO: 258685 - DNA, 25 bp, Rattus norvegicus
cgctctactgtgtggattggcctta

SEQ ID NO: 258686 - DNA, 25 bp, Rattus norvegicus
cgctctagcttacgtctgagacaaa

SEQ ID NO: 258687 - DNA, 25 bp, Rattus norvegicus
cgctctagcttaggtctgagacaaa

SEQ ID NO: 258688 - DNA, 25 bp, Rattus norvegicus
cgctctcaacgaaatgacttccata

SEQ ID NO: 258689 - DNA, 25 bp, Rattus norvegicus
cgctctcaacgatatgacttccata

SEQ ID NO: 258690 - DNA, 25 bp, Rattus norvegicus
cgctctcaaggacccggcgaggaca

SEQ ID NO: 258691 - DNA, 25 bp, Rattus norvegicus
cgctctcaaggagccggcgaggaca

SEQ ID NO: 258692 - DNA, 25 bp, Rattus norvegicus
cgctctcagcatagggagcgcaggc

SEQ ID NO: 258693 - DNA, 25 bp, Rattus norvegicus
cgctctcagcattgggagcgcaggc

SEQ ID NO: 258694 - DNA, 25 bp, Rattus norvegicus
cgctctctctttcccaaagacaata

SEQ ID NO: 258695 - DNA, 25 bp, Rattus norvegicus
cgctctctctttgccaaagacaata

SEQ ID NO: 258696 - DNA, 25 bp, Rattus norvegicus
cgctctctgcaaaccttagacattg

SEQ ID NO: 258697 - DNA, 25 bp, Rattus norvegicus
cgctctctgcaatccttagacattg

SEQ ID NO: 258698 - DNA, 25 bp, Rattus norvegicus
cgctctgatagcatcttgtttgtca

SEQ ID NO: 258699 - DNA, 25 bp, Rattus norvegicus
cgctctgatagcttcttgtttgtca

SEQ ID NO: 258700 - DNA, 25 bp, Rattus norvegicus
cgctctggagcccatgttaaagatg

SEQ ID NO: 258701 - DNA, 25 bp, Rattus norvegicus
cgctctggagccgatgttaaagatg

SEQ ID NO: 258702 - DNA, 25 bp, Rattus norvegicus
cgctctggagctcttaatgactgca

SEQ ID NO: 258703 - DNA, 25 bp, Rattus norvegicus
cgctctggagctgttaatgactgca

SEQ ID NO: 258704 - DNA, 25 bp, Rattus norvegicus
cgctctgggcgtaggtgtagttaca

SEQ ID NO: 258705 - DNA, 25 bp, Rattus norvegicus
cgctctgggcgttggtgtagttaca

SEQ ID NO: 258706 - DNA, 25 bp, Rattus norvegicus
cgctctgtccacacttggaggagat

SEQ ID NO: 258707 - DNA, 25 bp, Rattus norvegicus
cgctctgtccactcttggaggagat

SEQ ID NO: 258708 - DNA, 25 bp, Rattus norvegicus
cgctctgtggagctcctagattgca

SEQ ID NO: 258709 - DNA, 25 bp, Rattus norvegicus
cgctctgtggaggtcctagattgca

SEQ ID NO: 258710 - DNA, 25 bp, Rattus norvegicus
cgctcttcctggagttttgatttta

SEQ ID NO: 258711 - DNA, 25 bp, Rattus norvegicus
cgctcttcctggtgttttgatttta

SEQ ID NO: 258712 - DNA, 25 bp, Rattus norvegicus
cgctcttcgttgaaaatatcgctag

SEQ ID NO: 258713 - DNA, 25 bp, Rattus norvegicus
cgctcttcgttgtaaatatcgctag

SEQ ID NO: 258714 - DNA, 25 bp, Rattus norvegicus
cgctcttgcccgaggtaaatcttgg

SEQ ID NO: 258715 - DNA, 25 bp, Rattus norvegicus
cgctcttgcccgtggtaaatcttgg

SEQ ID NO: 258716 - DNA, 25 bp, Rattus norvegicus
cgctgaaaacttagcgtcctcttcc

SEQ ID NO: 258717 - DNA, 25 bp, Rattus norvegicus
cgctgaaaactttgcgtcctcttcc

SEQ ID NO: 258718 - DNA, 25 bp, Rattus norvegicus
cgctgaacctgaagtgcggtggcaa

SEQ ID NO: 258719 - DNA, 25 bp, Rattus norvegicus
cgctgaacctgatgtgcggtggcaa

SEQ ID NO: 258720 - DNA, 25 bp, Rattus norvegicus
cgctgaactttgacccttgatagat

SEQ ID NO: 258721 - DNA, 25 bp, Rattus norvegicus
cgctgaactttgtcccttgatagat

SEQ ID NO: 258722 - DNA, 25 bp, Rattus norvegicus
cgctgaccgagcagctgcagtgtaa

SEQ ID NO: 258723 - DNA, 25 bp, Rattus norvegicus
cgctgaccgagctgctgcagtgtaa

SEQ ID NO: 258724 - DNA, 25 bp, Rattus norvegicus
cgctgactgcctcggagacttcatg

SEQ ID NO: 258725 - DNA, 25 bp, Rattus norvegicus
cgctgactgcctgggagacttcatg

SEQ ID NO: 258726 - DNA, 25 bp, Rattus norvegicus
cgctgactgcttacttacttttctt

SEQ ID NO: 258727 - DNA, 25 bp, Rattus norvegicus
cgctgactgctttcttacttttctt

SEQ ID NO: 258728 - DNA, 25 bp, Rattus norvegicus
cgctgactggccaatggaactattt

SEQ ID NO: 258729 - DNA, 25 bp, Rattus norvegicus
cgctgactggcctatggaactattt

SEQ ID NO: 258730 - DNA, 25 bp, Rattus norvegicus
cgctgacttccaagcttaactgaaa

SEQ ID NO: 258731 - DNA, 25 bp, Rattus norvegicus
cgctgacttccatgcttaactgaaa

SEQ ID NO: 258732 - DNA, 25 bp, Rattus norvegicus
cgctgagcagctatctaatttccta

SEQ ID NO: 258733 - DNA, 25 bp, Rattus norvegicus
cgctgagcagctttctaatttccta

SEQ ID NO: 258734 - DNA, 25 bp, Rattus norvegicus
cgctgagctgcccataagtcgtttt

SEQ ID NO: 258735 - DNA, 25 bp, Rattus norvegicus
cgctgagctgccgataagtcgtttt

SEQ ID NO: 258736 - DNA, 25 bp, Rattus norvegicus
cgctgaggaaatccgccaccacagt

SEQ ID NO: 258737 - DNA, 25 bp, Rattus norvegicus
cgctgaggaaatgcgccaccacagt

SEQ ID NO: 258738 - DNA, 25 bp, Rattus norvegicus
cgctgaggatgtcctggaccccaga

SEQ ID NO: 258739 - DNA, 25 bp, Rattus norvegicus
cgctgaggatgtgctggaccccaga

SEQ ID NO: 258740 - DNA, 25 bp, Rattus norvegicus
cgctgatatgcgagtaccacttata

SEQ ID NO: 258741 - DNA, 25 bp, Rattus norvegicus
cgctgatatgcgtgtaccacttata

SEQ ID NO: 258742 - DNA, 25 bp, Rattus norvegicus
cgctgatctccacgcgcaggtagtg

SEQ ID NO: 258743 - DNA, 25 bp, Rattus norvegicus
cgctgatctccaggcgcaggtagtg

SEQ ID NO: 258744 - DNA, 25 bp, Rattus norvegicus
cgctgatgctctatgcttctttgat

SEQ ID NO: 258745 - DNA, 25 bp, Rattus norvegicus
cgctgatgctctttgcttctttgat

SEQ ID NO: 258746 - DNA, 25 bp, Rattus norvegicus
cgctgatggtacacaaggaactgat

SEQ ID NO: 258747 - DNA, 25 bp, Rattus norvegicus
cgctgatggtactcaaggaactgat

SEQ ID NO: 258748 - DNA, 25 bp, Rattus norvegicus
cgctgattcttcaattagtcctgtt

SEQ ID NO: 258749 - DNA, 25 bp, Rattus norvegicus
cgctgattcttctattagtcctgtt

SEQ ID NO: 258750 - DNA, 25 bp, Rattus norvegicus
cgctgcaaacgcatccgatggattg

SEQ ID NO: 258751 - DNA, 25 bp, Rattus norvegicus
cgctgcaaacgcttccgatggattg

SEQ ID NO: 258752 - DNA, 25 bp, Rattus norvegicus
cgctgcaagaaccaccgatgacaaa

SEQ ID NO: 258753 - DNA, 25 bp, Rattus norvegicus
cgctgcaagaacgaccgatgacaaa

SEQ ID NO: 258754 - DNA, 25 bp, Rattus norvegicus
cgctgcacgcggaggctctgcgcag

SEQ ID NO: 258755 - DNA, 25 bp, Rattus norvegicus
cgctgcacgcggtggctctgcgcag

SEQ ID NO: 258756 - DNA, 25 bp, Rattus norvegicus
cgctgcagacagcttcttatggtgg

SEQ ID NO: 258757 - DNA, 25 bp, Rattus norvegicus
cgctgcagacaggttcttatggtgg

SEQ ID NO: 258758 - DNA, 25 bp, Rattus norvegicus
cgctgccaccgaagataatcacatt

SEQ ID NO: 258759 - DNA, 25 bp, Rattus norvegicus
cgctgccaccgatgataatcacatt

SEQ ID NO: 258760 - DNA, 25 bp, Rattus norvegicus
cgctgccacttcctcagaaataaag

SEQ ID NO: 258761 - DNA, 25 bp, Rattus norvegicus
cgctgccacttcgtcagaaataaag

SEQ ID NO: 258762 - DNA, 25 bp, Rattus norvegicus
cgctgcccaatcacttaaaagctta

SEQ ID NO: 258763 - DNA, 25 bp, Rattus norvegicus
cgctgcccaatctcttaaaagctta

SEQ ID NO: 258764 - DNA, 25 bp, Rattus norvegicus
cgctgccctttcaattggtggagaa

SEQ ID NO: 258765 - DNA, 25 bp, Rattus norvegicus
cgctgccctttctattggtggagaa

SEQ ID NO: 258766 - DNA, 25 bp, Rattus norvegicus
cgctgccgccacatatgacaaattg

SEQ ID NO: 258767 - DNA, 25 bp, Rattus norvegicus
cgctgccgccacttatgacaaattg

SEQ ID NO: 258768 - DNA, 25 bp, Rattus norvegicus
cgctgccgcgagataaaatcaaaga

SEQ ID NO: 258769 - DNA, 25 bp, Rattus norvegicus
cgctgccgcgagttaaaatcaaaga

SEQ ID NO: 258770 - DNA, 25 bp, Rattus norvegicus
cgctgccgggtcaatgggattccat

SEQ ID NO: 258771 - DNA, 25 bp, Rattus norvegicus
cgctgccgggtctatgggattccat

SEQ ID NO: 258772 - DNA, 25 bp, Rattus norvegicus
cgctgccgtgcactgggttaaaaac

SEQ ID NO: 258773 - DNA, 25 bp, Rattus norvegicus
cgctgccgtgcagtgggttaaaaac

SEQ ID NO: 258774 - DNA, 25 bp, Rattus norvegicus
cgctgcctgcagatagtgaccaaaa

SEQ ID NO: 258775 - DNA, 25 bp, Rattus norvegicus
cgctgcctgcagttagtgaccaaaa

SEQ ID NO: 258776 - DNA, 25 bp, Rattus norvegicus
cgctgcctgcgactgttggagttac

SEQ ID NO: 258777 - DNA, 25 bp, Rattus norvegicus
cgctgcctgcgagtgttggagttac

SEQ ID NO: 258778 - DNA, 25 bp, Rattus norvegicus
cgctgccttcctctttatgattaac

SEQ ID NO: 258779 - DNA, 25 bp, Rattus norvegicus
cgctgccttcctgtttatgattaac

SEQ ID NO: 258780 - DNA, 25 bp, Rattus norvegicus
cgctgcgcgcaaagtttgggctcta

SEQ ID NO: 258781 - DNA, 25 bp, Rattus norvegicus
cgctgcgcgcaatgtttgggctcta

SEQ ID NO: 258782 - DNA, 25 bp, Rattus norvegicus
cgctgcgctcgtcgtcgacaacggg

SEQ ID NO: 258783 - DNA, 25 bp, Rattus norvegicus
cgctgcgctcgtggtcgacaacggg

SEQ ID NO: 258784 - DNA, 25 bp, Rattus norvegicus
cgctgcggagagcaagccttacaaa

SEQ ID NO: 258785 - DNA, 25 bp, Rattus norvegicus
cgctgcggagaggaagccttacaaa

SEQ ID NO: 258786 - DNA, 25 bp, Rattus norvegicus
cgctgctccgggacagtctttagga

SEQ ID NO: 258787 - DNA, 25 bp, Rattus norvegicus
cgctgctccgggtcagtctttagga

SEQ ID NO: 258788 - DNA, 25 bp, Rattus norvegicus
cgctgctctacaagctattcaagac

SEQ ID NO: 258789 - DNA, 25 bp, Rattus norvegicus
cgctgctctacatgctattcaagac

SEQ ID NO: 258790 - DNA, 25 bp, Rattus norvegicus
cgctgctgaagcaccggccgagcgt

SEQ ID NO: 258791 - DNA, 25 bp, Rattus norvegicus
cgctgctgaagctccggccgagcgt

SEQ ID NO: 258792 - DNA, 25 bp, Rattus norvegicus
cgctgctgcgctctcgttgatagga

SEQ ID NO: 258793 - DNA, 25 bp, Rattus norvegicus
cgctgctgcgctgtcgttgatagga

SEQ ID NO: 258794 - DNA, 25 bp, Rattus norvegicus
cgctgctgctgactaagctggagta

SEQ ID NO: 258795 - DNA, 25 bp, Rattus norvegicus
cgctgctgctgagtaagctggagta

SEQ ID NO: 258796 - DNA, 25 bp, Rattus norvegicus
cgctgctggactcgacctacagaaa

SEQ ID NO: 258797 - DNA, 25 bp, Rattus norvegicus
cgctgctggactggacctacagaaa

SEQ ID NO: 258798 - DNA, 25 bp, Rattus norvegicus
cgctgctgtgcacaaccagtaacca

SEQ ID NO: 258799 - DNA, 25 bp, Rattus norvegicus
cgctgctgtgcagaaccagtaacca

SEQ ID NO: 258800 - DNA, 25 bp, Rattus norvegicus
cgctgctgttcccaggacattgtgc

SEQ ID NO: 258801 - DNA, 25 bp, Rattus norvegicus
cgctgctgttccgaggacattgtgc

SEQ ID NO: 258802 - DNA, 25 bp, Rattus norvegicus
cgctgcttgtggctaagactcttag

SEQ ID NO: 258803 - DNA, 25 bp, Rattus norvegicus
cgctgcttgtgggtaagactcttag

SEQ ID NO: 258804 - DNA, 25 bp, Rattus norvegicus
cgctgctttgctaggcggtagctaa

SEQ ID NO: 258805 - DNA, 25 bp, Rattus norvegicus
cgctgctttgcttggcggtagctaa

SEQ ID NO: 258806 - DNA, 25 bp, Rattus norvegicus
cgctgctttgggacgtttggataac

SEQ ID NO: 258807 - DNA, 25 bp, Rattus norvegicus
cgctgctttgggtcgtttggataac

SEQ ID NO: 258808 - DNA, 25 bp, Rattus norvegicus
cgctggaacgcacatccgggagtta

SEQ ID NO: 258809 - DNA, 25 bp, Rattus norvegicus
cgctggaacgcagatccgggagtta

SEQ ID NO: 258810 - DNA, 25 bp, Rattus norvegicus
cgctggacctacatacgcattatta

SEQ ID NO: 258811 - DNA, 25 bp, Rattus norvegicus
cgctggacctacttacgcattatta

SEQ ID NO: 258812 - DNA, 25 bp, Rattus norvegicus
cgctggagcagaacgaggccttctt

SEQ ID NO: 258813 - DNA, 25 bp, Rattus norvegicus
cgctggagcagatcgaggccttctt

SEQ ID NO: 258814 - DNA, 25 bp, Rattus norvegicus
cgctggcagccgcaggactgcataa

SEQ ID NO: 258815 - DNA, 25 bp, Rattus norvegicus
cgctggcagccggaggactgcataa

SEQ ID NO: 258816 - DNA, 25 bp, Rattus norvegicus
cgctggcatgaacatgacgaccctt

SEQ ID NO: 258817 - DNA, 25 bp, Rattus norvegicus
cgctggcatgaagatgacgaccctt

SEQ ID NO: 258818 - DNA, 25 bp, Rattus norvegicus
cgctggccatccaactttattagct

SEQ ID NO: 258819 - DNA, 25 bp, Rattus norvegicus
cgctggccatcctactttattagct

SEQ ID NO: 258820 - DNA, 25 bp, Rattus norvegicus
cgctggcggccgagagcacgccttt

SEQ ID NO: 258821 - DNA, 25 bp, Rattus norvegicus
cgctggcggccgtgagcacgccttt

SEQ ID NO: 258822 - DNA, 25 bp, Rattus norvegicus
cgctggctccatatcgtgaaatttt

SEQ ID NO: 258823 - DNA, 25 bp, Rattus norvegicus
cgctggctccatttcgtgaaatttt

SEQ ID NO: 258824 - DNA, 25 bp, Rattus norvegicus
cgctggctcgcgcatgaggacaaaa

SEQ ID NO: 258825 - DNA, 25 bp, Rattus norvegicus
cgctggctcgcggatgaggacaaaa

SEQ ID NO: 258826 - DNA, 25 bp, Rattus norvegicus
cgctggctgtgactggtttgtacat

SEQ ID NO: 258827 - DNA, 25 bp, Rattus norvegicus
cgctggctgtgagtggtttgtacat

SEQ ID NO: 258828 - DNA, 25 bp, Rattus norvegicus
cgctgggacccaaaattacctatca

SEQ ID NO: 258829 - DNA, 25 bp, Rattus norvegicus
cgctgggacccataattacctatca

SEQ ID NO: 258830 - DNA, 25 bp, Rattus norvegicus
cgctgggcacgcatggcatgagata

SEQ ID NO: 258831 - DNA, 25 bp, Rattus norvegicus
cgctgggcacgcttggcatgagata

SEQ ID NO: 258832 - DNA, 25 bp, Rattus norvegicus
cgctgggcagtgacaggtctacaaa

SEQ ID NO: 258833 - DNA, 25 bp, Rattus norvegicus
cgctgggcagtgtcaggtctacaaa

SEQ ID NO: 258834 - DNA, 25 bp, Rattus norvegicus
cgctgggctagcatcatggacgccg

SEQ ID NO: 258835 - DNA, 25 bp, Rattus norvegicus
cgctgggctagcttcatggacgccg

SEQ ID NO: 258836 - DNA, 25 bp, Rattus norvegicus
cgctgggtccctcctgtaggcagaa

SEQ ID NO: 258837 - DNA, 25 bp, Rattus norvegicus
cgctgggtccctgctgtaggcagaa

SEQ ID NO: 258838 - DNA, 25 bp, Rattus norvegicus
cgctgggttcttactgggcctggca

SEQ ID NO: 258839 - DNA, 25 bp, Rattus norvegicus
cgctgggttctttctgggcctggca

SEQ ID NO: 258840 - DNA, 25 bp, Rattus norvegicus
cgctggtgcaggcatcgttacccga

SEQ ID NO: 258841 - DNA, 25 bp, Rattus norvegicus
cgctggtgcagggatcgttacccga

SEQ ID NO: 258842 - DNA, 25 bp, Rattus norvegicus
cgctggttagcaccgcaggtgtaga

SEQ ID NO: 258843 - DNA, 25 bp, Rattus norvegicus
cgctggttagcagcgcaggtgtaga

SEQ ID NO: 258844 - DNA, 25 bp, Rattus norvegicus
cgctgtagctgtcgcttttgaccgc

SEQ ID NO: 258845 - DNA, 25 bp, Rattus norvegicus
cgctgtagctgtggcttttgaccgc

SEQ ID NO: 258846 - DNA, 25 bp, Rattus norvegicus
cgctgtatatggatgccgcttgcaa

SEQ ID NO: 258847 - DNA, 25 bp, Rattus norvegicus
cgctgtatatggttgccgcttgcaa

SEQ ID NO: 258848 - DNA, 25 bp, Rattus norvegicus
cgctgtatctgaccccttttgggaa

SEQ ID NO: 258849 - DNA, 25 bp, Rattus norvegicus
cgctgtatctgagcccttttgggaa

SEQ ID NO: 258850 - DNA, 25 bp, Rattus norvegicus
cgctgtcctgaacttggcctgtgca

SEQ ID NO: 258851 - DNA, 25 bp, Rattus norvegicus
cgctgtcctgaagttggcctgtgca

SEQ ID NO: 258852 - DNA, 25 bp, Rattus norvegicus
cgctgtcgcctcaagtttttaagtt

SEQ ID NO: 258853 - DNA, 25 bp, Rattus norvegicus
cgctgtcgcctctagtttttaagtt

SEQ ID NO: 258854 - DNA, 25 bp, Rattus norvegicus
cgctgtcgtggacgcctttaaccaa

SEQ ID NO: 258855 - DNA, 25 bp, Rattus norvegicus
cgctgtcgtggaggcctttaaccaa

SEQ ID NO: 258856 - DNA, 25 bp, Rattus norvegicus
cgctgtgccctcattgtcacctcta

SEQ ID NO: 258857 - DNA, 25 bp, Rattus norvegicus
cgctgtgccctctttgtcacctcta

SEQ ID NO: 258858 - DNA, 25 bp, Rattus norvegicus
cgctgtgccgggagcagaagtcctt

SEQ ID NO: 258859 - DNA, 25 bp, Rattus norvegicus
cgctgtgccgggtgcagaagtcctt

SEQ ID NO: 258860 - DNA, 25 bp, Rattus norvegicus
cgctgtgcctaccaagtgacgcagg

SEQ ID NO: 258861 - DNA, 25 bp, Rattus norvegicus
cgctgtgcctacgaagtgacgcagg

SEQ ID NO: 258862 - DNA, 25 bp, Rattus norvegicus
cgctgtgctttcagagggcctagat

SEQ ID NO: 258863 - DNA, 25 bp, Rattus norvegicus
cgctgtgctttctgagggcctagat

SEQ ID NO: 258864 - DNA, 25 bp, Rattus norvegicus
cgctgtgggcctcgacttcctgctt

SEQ ID NO: 258865 - DNA, 25 bp, Rattus norvegicus
cgctgtgggcctggacttcctgctt

SEQ ID NO: 258866 - DNA, 25 bp, Rattus norvegicus
cgctgttcagttcggtttcatgttc

SEQ ID NO: 258867 - DNA, 25 bp, Rattus norvegicus
cgctgttcagttgggtttcatgttc

SEQ ID NO: 258868 - DNA, 25 bp, Rattus norvegicus
cgctgttccaggcaaggtgcagcca

SEQ ID NO: 258869 - DNA, 25 bp, Rattus norvegicus
cgctgttccagggaaggtgcagcca

SEQ ID NO: 258870 - DNA, 25 bp, Rattus norvegicus
cgctgttgtggaaacttactacatc

SEQ ID NO: 258871 - DNA, 25 bp, Rattus norvegicus
cgctgttgtggatacttactacatc

SEQ ID NO: 258872 - DNA, 25 bp, Rattus norvegicus
cgctgtttacggctgccatgaggca

SEQ ID NO: 258873 - DNA, 25 bp, Rattus norvegicus
cgctgtttacgggtgccatgaggca

SEQ ID NO: 258874 - DNA, 25 bp, Rattus norvegicus
cgctgtttcacacaactgggtttaa

SEQ ID NO: 258875 - DNA, 25 bp, Rattus norvegicus
cgctgtttcacagaactgggtttaa

SEQ ID NO: 258876 - DNA, 25 bp, Rattus norvegicus
cgcttagcctctaggacgacatgaa

SEQ ID NO: 258877 - DNA, 25 bp, Rattus norvegicus
cgcttagcctcttggacgacatgaa

SEQ ID NO: 258878 - DNA, 25 bp, Rattus norvegicus
cgcttcaactgccaggttgtcttaa

SEQ ID NO: 258879 - DNA, 25 bp, Rattus norvegicus
cgcttcaactgcgaggttgtcttaa

SEQ ID NO: 258880 - DNA, 25 bp, Rattus norvegicus
cgcttcaagcgaatatccgggacat

SEQ ID NO: 258881 - DNA, 25 bp, Rattus norvegicus
cgcttcaagcgattatccgggacat

SEQ ID NO: 258882 - DNA, 25 bp, Rattus norvegicus
cgcttcaaggcacagcaaatgtgac

SEQ ID NO: 258883 - DNA, 25 bp, Rattus norvegicus
cgcttcaaggcagagcaaatgtgac

SEQ ID NO: 258884 - DNA, 25 bp, Rattus norvegicus
cgcttcacagaaccctcaatgaggt

SEQ ID NO: 258885 - DNA, 25 bp, Rattus norvegicus
cgcttcacagaagcctcaatgaggt

SEQ ID NO: 258886 - DNA, 25 bp, Rattus norvegicus
cgcttcactcggaggaagggttact

SEQ ID NO: 258887 - DNA, 25 bp, Rattus norvegicus
cgcttcactcggtggaagggttact

SEQ ID NO: 258888 - DNA, 25 bp, Rattus norvegicus
cgcttcagcacgcagatattctagt

SEQ ID NO: 258889 - DNA, 25 bp, Rattus norvegicus
cgcttcagcacggagatattctagt

SEQ ID NO: 258890 - DNA, 25 bp, Rattus norvegicus
cgcttcaggctgcatgactatgtga

SEQ ID NO: 258891 - DNA, 25 bp, Rattus norvegicus
cgcttcaggctggatgactatgtga

SEQ ID NO: 258892 - DNA, 25 bp, Rattus norvegicus
cgcttcatcggtctgttctgtaatg

SEQ ID NO: 258893 - DNA, 25 bp, Rattus norvegicus
cgcttcatcggtgtgttctgtaatg

SEQ ID NO: 258894 - DNA, 25 bp, Rattus norvegicus
cgcttcatctgacctggcacagtga

SEQ ID NO: 258895 - DNA, 25 bp, Rattus norvegicus
cgcttcatctgagctggcacagtga

SEQ ID NO: 258896 - DNA, 25 bp, Rattus norvegicus
cgcttccgaacgaatcatcgtcacg

SEQ ID NO: 258897 - DNA, 25 bp, Rattus norvegicus
cgcttccgaacgtatcatcgtcacg

SEQ ID NO: 258898 - DNA, 25 bp, Rattus norvegicus
cgcttcctcaacatggagaccattg

SEQ ID NO: 258899 - DNA, 25 bp, Rattus norvegicus
cgcttcctcaacttggagaccattg

SEQ ID NO: 258900 - DNA, 25 bp, Rattus norvegicus
cgcttcctcaagatcgccgaggtgg

SEQ ID NO: 258901 - DNA, 25 bp, Rattus norvegicus
cgcttcctcaagttcgccgaggtgg

SEQ ID NO: 258902 - DNA, 25 bp, Rattus norvegicus
cgcttcggaatcaccagattgtttt

SEQ ID NO: 258903 - DNA, 25 bp, Rattus norvegicus
cgcttcggaatctccagattgtttt

SEQ ID NO: 258904 - DNA, 25 bp, Rattus norvegicus
cgcttctcagccacataaggcagaa

SEQ ID NO: 258905 - DNA, 25 bp, Rattus norvegicus
cgcttctcagcctcataaggcagaa

SEQ ID NO: 258906 - DNA, 25 bp, Rattus norvegicus
cgcttctctcgtcggcggacttgtg

SEQ ID NO: 258907 - DNA, 25 bp, Rattus norvegicus
cgcttctctcgtgggcggacttgtg

SEQ ID NO: 258908 - DNA, 25 bp, Rattus norvegicus
cgcttgagcaccccatcggctgcat

SEQ ID NO: 258909 - DNA, 25 bp, Rattus norvegicus
cgcttgagcaccgcatcggctgcat

SEQ ID NO: 258910 - DNA, 25 bp, Rattus norvegicus
cgcttgatgtgtacttcccgcagat

SEQ ID NO: 258911 - DNA, 25 bp, Rattus norvegicus
cgcttgatgtgttcttcccgcagat

SEQ ID NO: 258912 - DNA, 25 bp, Rattus norvegicus
cgctttattttgctttgcttgccca

SEQ ID NO: 258913 - DNA, 25 bp, Rattus norvegicus
cgctttattttggtttgcttgccca

SEQ ID NO: 258914 - DNA, 25 bp, Rattus norvegicus
cgctttcaaagcctgaatgctgaag

SEQ ID NO: 258915 - DNA, 25 bp, Rattus norvegicus
cgctttcaaagcgtgaatgctgaag

SEQ ID NO: 258916 - DNA, 25 bp, Rattus norvegicus
cgctttcactgcattctatgacgaa

SEQ ID NO: 258917 - DNA, 25 bp, Rattus norvegicus
cgctttcactgctttctatgacgaa

SEQ ID NO: 258918 - DNA, 25 bp, Rattus norvegicus
cgctttcatgtcacgtatttcttgt

SEQ ID NO: 258919 - DNA, 25 bp, Rattus norvegicus
cgctttcatgtctcgtatttcttgt

SEQ ID NO: 258920 - DNA, 25 bp, Rattus norvegicus
cgctttccgagaaactttcactttt

SEQ ID NO: 258921 - DNA, 25 bp, Rattus norvegicus
cgctttccgagatactttcactttt

SEQ ID NO: 258922 - DNA, 25 bp, Rattus norvegicus
cgctttctagcacaaatcacgtttt

SEQ ID NO: 258923 - DNA, 25 bp, Rattus norvegicus
cgctttctagcagaaatcacgtttt

SEQ ID NO: 258924 - DNA, 25 bp, Rattus norvegicus
cgctttctccttagttattcggatg

SEQ ID NO: 258925 - DNA, 25 bp, Rattus norvegicus
cgctttctcctttgttattcggatg

SEQ ID NO: 258926 - DNA, 25 bp, Rattus norvegicus
cgctttctgagcactgtatcagggt

SEQ ID NO: 258927 - DNA, 25 bp, Rattus norvegicus
cgctttctgagctctgtatcagggt

SEQ ID NO: 258928 - DNA, 25 bp, Rattus norvegicus
cgctttgatgcccactatgctaaga

SEQ ID NO: 258929 - DNA, 25 bp, Rattus norvegicus
cgctttgatgccgactatgctaaga

SEQ ID NO: 258930 - DNA, 25 bp, Rattus norvegicus
cgctttgcctggatttctcggtaaa

SEQ ID NO: 258931 - DNA, 25 bp, Rattus norvegicus
cgctttgcctggttttctcggtaaa

SEQ ID NO: 258932 - DNA, 25 bp, Rattus norvegicus
cgctttgctatcagtggttgttgag

SEQ ID NO: 258933 - DNA, 25 bp, Rattus norvegicus
cgctttgctatctgtggttgttgag

SEQ ID NO: 258934 - DNA, 25 bp, Rattus norvegicus
cgctttgcttccaaggtgaaccagt

SEQ ID NO: 258935 - DNA, 25 bp, Rattus norvegicus
cgctttgcttcctaggtgaaccagt

SEQ ID NO: 258936 - DNA, 25 bp, Rattus norvegicus
cgctttgcttctctttatttcctaa

SEQ ID NO: 258937 - DNA, 25 bp, Rattus norvegicus
cgctttgcttctgtttatttcctaa

SEQ ID NO: 258938 - DNA, 25 bp, Rattus norvegicus
cgctttggctttcctctgcaggaaa

SEQ ID NO: 258939 - DNA, 25 bp, Rattus norvegicus
cgctttggctttgctctgcaggaaa

SEQ ID NO: 258940 - DNA, 25 bp, Rattus norvegicus
cggaaaactgccatggttcatttgt

SEQ ID NO: 258941 - DNA, 25 bp, Rattus norvegicus
cggaaaactgccttggttcatttgt

SEQ ID NO: 258942 - DNA, 25 bp, Rattus norvegicus
cggaaaccgttacctagccgcattc

SEQ ID NO: 258943 - DNA, 25 bp, Rattus norvegicus
cggaaaccgttagctagccgcattc

SEQ ID NO: 258944 - DNA, 25 bp, Rattus norvegicus
cggaaacttcacatcagtgttctgt

SEQ ID NO: 258945 - DNA, 25 bp, Rattus norvegicus
cggaaacttcacttcagtgttctgt

SEQ ID NO: 258946 - DNA, 25 bp, Rattus norvegicus
cggaaagcgtgccaatcaacatgct

SEQ ID NO: 258947 - DNA, 25 bp, Rattus norvegicus
cggaaagcgtgcgaatcaacatgct

SEQ ID NO: 258948 - DNA, 25 bp, Rattus norvegicus
cggaaagctgagcatgacttctgcc

SEQ ID NO: 258949 - DNA, 25 bp, Rattus norvegicus
cggaaagctgaggatgacttctgcc

SEQ ID NO: 258950 - DNA, 25 bp, Rattus norvegicus
cggaaatgccttctagctttaggat

SEQ ID NO: 258951 - DNA, 25 bp, Rattus norvegicus
cggaaatgccttgtagctttaggat

SEQ ID NO: 258952 - DNA, 25 bp, Rattus norvegicus
cggaaatggtttcccgcagaacctg

SEQ ID NO: 258953 - DNA, 25 bp, Rattus norvegicus
cggaaatggtttgccgcagaacctg

SEQ ID NO: 258954 - DNA, 25 bp, Rattus norvegicus
cggaacaccttgagcaccggtggag

SEQ ID NO: 258955 - DNA, 25 bp, Rattus norvegicus
cggaacaccttgtgcaccggtggag

SEQ ID NO: 258956 - DNA, 25 bp, Rattus norvegicus
cggaaccatctcatcatcctaataa

SEQ ID NO: 258957 - DNA, 25 bp, Rattus norvegicus
cggaaccatctcttcatcctaataa

SEQ ID NO: 258958 - DNA, 25 bp, Rattus norvegicus
cggaacctttgaatgccttcagcct

SEQ ID NO: 258959 - DNA, 25 bp, Rattus norvegicus
cggaacctttgattgccttcagcct

SEQ ID NO: 258960 - DNA, 25 bp, Rattus norvegicus
cggaacgtgacgatggtacaggaac

SEQ ID NO: 258961 - DNA, 25 bp, Rattus norvegicus
cggaacgtgacgttggtacaggaac

SEQ ID NO: 258962 - DNA, 25 bp, Rattus norvegicus
cggaacttgcgcaccaaggctagaa

SEQ ID NO: 258963 - DNA, 25 bp, Rattus norvegicus
cggaacttgcgctccaaggctagaa

SEQ ID NO: 258964 - DNA, 25 bp, Rattus norvegicus
cggaagaaccggctgtctgcttttc

SEQ ID NO: 258965 - DNA, 25 bp, Rattus norvegicus
cggaagaaccgggtgtctgcttttc

SEQ ID NO: 258966 - DNA, 25 bp, Rattus norvegicus
cggaagagcgtgcatttcctctgtc

SEQ ID NO: 258967 - DNA, 25 bp, Rattus norvegicus
cggaagagcgtggatttcctctgtc

SEQ ID NO: 258968 - DNA, 25 bp, Rattus norvegicus
cggaagcaaggcatgttcgtgacat

SEQ ID NO: 258969 - DNA, 25 bp, Rattus norvegicus
cggaagcaaggcttgttcgtgacat

SEQ ID NO: 258970 - DNA, 25 bp, Rattus norvegicus
cggaagcactgcctttctggaagtg

SEQ ID NO: 258971 - DNA, 25 bp, Rattus norvegicus
cggaagcactgcgtttctggaagtg

SEQ ID NO: 258972 - DNA, 25 bp, Rattus norvegicus
cggaagccggaaatcgacgtcgcgc

SEQ ID NO: 258973 - DNA, 25 bp, Rattus norvegicus
cggaagccggaattcgacgtcgcgc

SEQ ID NO: 258974 - DNA, 25 bp, Rattus norvegicus
cggaagcggcgcaacagcaagaaat

SEQ ID NO: 258975 - DNA, 25 bp, Rattus norvegicus
cggaagcggcgctacagcaagaaat

SEQ ID NO: 258976 - DNA, 25 bp, Rattus norvegicus
cggaagctctgactcgaaatggcgt

SEQ ID NO: 258977 - DNA, 25 bp, Rattus norvegicus
cggaagctctgagtcgaaatggcgt

SEQ ID NO: 258978 - DNA, 25 bp, Rattus norvegicus
cggaagctggacagacaaccctacc

SEQ ID NO: 258979 - DNA, 25 bp, Rattus norvegicus
cggaagctggactgacaaccctacc

SEQ ID NO: 258980 - DNA, 25 bp, Rattus norvegicus
cggaaggaccccacatgatgactgg

SEQ ID NO: 258981 - DNA, 25 bp, Rattus norvegicus
cggaaggacccctcatgatgactgg

SEQ ID NO: 258982 - DNA, 25 bp, Rattus norvegicus
cggaaggcgttacccatgagcaagc

SEQ ID NO: 258983 - DNA, 25 bp, Rattus norvegicus
cggaaggcgttagccatgagcaagc

SEQ ID NO: 258984 - DNA, 25 bp, Rattus norvegicus
cggaagggcctcaatgtggaagaaa

SEQ ID NO: 258985 - DNA, 25 bp, Rattus norvegicus
cggaagggcctctatgtggaagaaa

SEQ ID NO: 258986 - DNA, 25 bp, Rattus norvegicus
cggaagttccttcagcaacagctta

SEQ ID NO: 258987 - DNA, 25 bp, Rattus norvegicus
cggaagttccttgagcaacagctta

SEQ ID NO: 258988 - DNA, 25 bp, Rattus norvegicus
cggaatcagaaacgcctctagtggg

SEQ ID NO: 258989 - DNA, 25 bp, Rattus norvegicus
cggaatcagaaaggcctctagtggg

SEQ ID NO: 258990 - DNA, 25 bp, Rattus norvegicus
cggaatcagtgtcaggctctggcaa

SEQ ID NO: 258991 - DNA, 25 bp, Rattus norvegicus
cggaatcagtgtgaggctctggcaa

SEQ ID NO: 258992 - DNA, 25 bp, Rattus norvegicus
cggaatcattccaaggccaagctgc

SEQ ID NO: 258993 - DNA, 25 bp, Rattus norvegicus
cggaatcattcctaggccaagctgc

SEQ ID NO: 258994 - DNA, 25 bp, Rattus norvegicus
cggaatccgggaatgttgctgacat

SEQ ID NO: 258995 - DNA, 25 bp, Rattus norvegicus
cggaatccgggattgttgctgacat

SEQ ID NO: 258996 - DNA, 25 bp, Rattus norvegicus
cggaatcgccgacaggaaccaagat

SEQ ID NO: 258997 - DNA, 25 bp, Rattus norvegicus
cggaatcgccgagaggaaccaagat

SEQ ID NO: 258998 - DNA, 25 bp, Rattus norvegicus
cggaatgaacgacggcccactgact

SEQ ID NO: 258999 - DNA, 25 bp, Rattus norvegicus
cggaatgaacgagggcccactgact

SEQ ID NO: 259000 - DNA, 25 bp, Rattus norvegicus
cggaatgaatacaggctctgtgaga

SEQ ID NO: 259001 - DNA, 25 bp, Rattus norvegicus
cggaatgaatactggctctgtgaga

SEQ ID NO: 259002 - DNA, 25 bp, Rattus norvegicus
cggacaaagttcacctcaacttctt

SEQ ID NO: 259003 - DNA, 25 bp, Rattus norvegicus
cggacaaagttctcctcaacttctt

SEQ ID NO: 259004 - DNA, 25 bp, Rattus norvegicus
cggacaacatttccattctccataa

SEQ ID NO: 259005 - DNA, 25 bp, Rattus norvegicus
cggacaacatttgcattctccataa

SEQ ID NO: 259006 - DNA, 25 bp, Rattus norvegicus
cggacaatatttcgcacggcctgaa

SEQ ID NO: 259007 - DNA, 25 bp, Rattus norvegicus
cggacaatatttggcacggcctgaa

SEQ ID NO: 259008 - DNA, 25 bp, Rattus norvegicus
cggacacccgagactatgtggcaaa

SEQ ID NO: 259009 - DNA, 25 bp, Rattus norvegicus
cggacacccgagtctatgtggcaaa

SEQ ID NO: 259010 - DNA, 25 bp, Rattus norvegicus
cggacacctgggaaccggcagagcc

SEQ ID NO: 259011 - DNA, 25 bp, Rattus norvegicus
cggacacctgggtaccggcagagcc

SEQ ID NO: 259012 - DNA, 25 bp, Rattus norvegicus
cggacacttgttcaaatcctagttc

SEQ ID NO: 259013 - DNA, 25 bp, Rattus norvegicus
cggacacttgttgaaatcctagttc

SEQ ID NO: 259014 - DNA, 25 bp, Rattus norvegicus
cggacagactgtactgcctcagagg

SEQ ID NO: 259015 - DNA, 25 bp, Rattus norvegicus
cggacagactgttctgcctcagagg

SEQ ID NO: 259016 - DNA, 25 bp, Rattus norvegicus
cggacagcaggtcctatgtcagcaa

SEQ ID NO: 259017 - DNA, 25 bp, Rattus norvegicus
cggacagcaggtgctatgtcagcaa

SEQ ID NO: 259018 - DNA, 25 bp, Rattus norvegicus
cggacagtgagacggccattgctat

SEQ ID NO: 259019 - DNA, 25 bp, Rattus norvegicus
cggacagtgagagggccattgctat

SEQ ID NO: 259020 - DNA, 25 bp, Rattus norvegicus
cggacataccttacttcaattcata

SEQ ID NO: 259021 - DNA, 25 bp, Rattus norvegicus
cggacatacctttcttcaattcata

SEQ ID NO: 259022 - DNA, 25 bp, Rattus norvegicus
cggacatcagtgaacgggctcgcag

SEQ ID NO: 259023 - DNA, 25 bp, Rattus norvegicus
cggacatcagtgtacgggctcgcag

SEQ ID NO: 259024 - DNA, 25 bp, Rattus norvegicus
cggacatcgtctacccggagagcgg

SEQ ID NO: 259025 - DNA, 25 bp, Rattus norvegicus
cggacatcgtcttcccggagagcgg

SEQ ID NO: 259026 - DNA, 25 bp, Rattus norvegicus
cggacatgcgccaggctgtagtcgc

SEQ ID NO: 259027 - DNA, 25 bp, Rattus norvegicus
cggacatgcgcctggctgtagtcgc

SEQ ID NO: 259028 - DNA, 25 bp, Rattus norvegicus
cggacattagccatgttcaacatat

SEQ ID NO: 259029 - DNA, 25 bp, Rattus norvegicus
cggacattagccttgttcaacatat

SEQ ID NO: 259030 - DNA, 25 bp, Rattus norvegicus
cggacattgggacagacacacgtgt

SEQ ID NO: 259031 - DNA, 25 bp, Rattus norvegicus
cggacattgggagagacacacgtgt

SEQ ID NO: 259032 - DNA, 25 bp, Rattus norvegicus
cggaccaatggacatcgtgctgcct

SEQ ID NO: 259033 - DNA, 25 bp, Rattus norvegicus
cggaccaatggagatcgtgctgcct

SEQ ID NO: 259034 - DNA, 25 bp, Rattus norvegicus
cggaccatctcgcagtcaaagcaaa

SEQ ID NO: 259035 - DNA, 25 bp, Rattus norvegicus
cggaccatctcggagtcaaagcaaa

SEQ ID NO: 259036 - DNA, 25 bp, Rattus norvegicus
cggacccagggcaataggaccagta

SEQ ID NO: 259037 - DNA, 25 bp, Rattus norvegicus
cggacccagggctataggaccagta

SEQ ID NO: 259038 - DNA, 25 bp, Rattus norvegicus
cggacccatggtactgaagctcagt

SEQ ID NO: 259039 - DNA, 25 bp, Rattus norvegicus
cggacccatggttctgaagctcagt

SEQ ID NO: 259040 - DNA, 25 bp, Rattus norvegicus
cggaccctcgtgatacaaaccaaat

SEQ ID NO: 259041 - DNA, 25 bp, Rattus norvegicus
cggaccctcgtgttacaaaccaaat

SEQ ID NO: 259042 - DNA, 25 bp, Rattus norvegicus
cggaccctggcgacaacgaatgtaa

SEQ ID NO: 259043 - DNA, 25 bp, Rattus norvegicus
cggaccctggcgtcaacgaatgtaa

SEQ ID NO: 259044 - DNA, 25 bp, Rattus norvegicus
cggaccctgtgcagaaaacttctta

SEQ ID NO: 259045 - DNA, 25 bp, Rattus norvegicus
cggaccctgtgccagaagacgagaa

SEQ ID NO: 259046 - DNA, 25 bp, Rattus norvegicus
cggaccctgtgcgagaagacgagaa

SEQ ID NO: 259047 - DNA, 25 bp, Rattus norvegicus
cggaccctgtgctgaaaacttctta

SEQ ID NO: 259048 - DNA, 25 bp, Rattus norvegicus
cggaccgctcggcttaactagctgg

SEQ ID NO: 259049 - DNA, 25 bp, Rattus norvegicus
cggaccgctcgggttaactagctgg

SEQ ID NO: 259050 - DNA, 25 bp, Rattus norvegicus
cggacctcgggcagcccagtgacga

SEQ ID NO: 259051 - DNA, 25 bp, Rattus norvegicus
cggacctcgggctgcccagtgacga

SEQ ID NO: 259052 - DNA, 25 bp, Rattus norvegicus
cggacctgctgtctgtcatagagga

SEQ ID NO: 259053 - DNA, 25 bp, Rattus norvegicus
cggacctgctgtgtgtcatagagga

SEQ ID NO: 259054 - DNA, 25 bp, Rattus norvegicus
cggacctggtgtaggaagccctaga

SEQ ID NO: 259055 - DNA, 25 bp, Rattus norvegicus
cggacctggtgttggaagccctaga

SEQ ID NO: 259056 - DNA, 25 bp, Rattus norvegicus
cggacgacttggctggctcatttgc

SEQ ID NO: 259057 - DNA, 25 bp, Rattus norvegicus
cggacgacttgggtggctcatttgc

SEQ ID NO: 259058 - DNA, 25 bp, Rattus norvegicus
cggacgctgcttacacacaaaatgt

SEQ ID NO: 259059 - DNA, 25 bp, Rattus norvegicus
cggacgctgctttcacacaaaatgt

SEQ ID NO: 259060 - DNA, 25 bp, Rattus norvegicus
cggacgcttggtagtgttcaaaaca

SEQ ID NO: 259061 - DNA, 25 bp, Rattus norvegicus
cggacgcttggttgtgttcaaaaca

SEQ ID NO: 259062 - DNA, 25 bp, Rattus norvegicus
cggacggagaatcagtctttccttg

SEQ ID NO: 259063 - DNA, 25 bp, Rattus norvegicus
cggacggagaatgagtctttccttg

SEQ ID NO: 259064 - DNA, 25 bp, Rattus norvegicus
cggacggcttatcgcaatggtgtaa

SEQ ID NO: 259065 - DNA, 25 bp, Rattus norvegicus
cggacggcttatggcaatggtgtaa

SEQ ID NO: 259066 - DNA, 25 bp, Rattus norvegicus
cggacggctttgagcagttagactt

SEQ ID NO: 259067 - DNA, 25 bp, Rattus norvegicus
cggacggctttgtgcagttagactt

SEQ ID NO: 259068 - DNA, 25 bp, Rattus norvegicus
cggacgtgcgcaacaccggctgagc

SEQ ID NO: 259069 - DNA, 25 bp, Rattus norvegicus
cggacgtgcgcatcaccggctgagc

SEQ ID NO: 259070 - DNA, 25 bp, Rattus norvegicus
cggacgtggctcaccgaggtcgctc

SEQ ID NO: 259071 - DNA, 25 bp, Rattus norvegicus
cggacgtggctctccgaggtcgctc

SEQ ID NO: 259072 - DNA, 25 bp, Rattus norvegicus
cggactatgtcacagcgtgttgttc

SEQ ID NO: 259073 - DNA, 25 bp, Rattus norvegicus
cggactatgtcagagcgtgttgttc

SEQ ID NO: 259074 - DNA, 25 bp, Rattus norvegicus
cggactcgtcggagagcatggattc

SEQ ID NO: 259075 - DNA, 25 bp, Rattus norvegicus
cggactcgtcggtgagcatggattc

SEQ ID NO: 259076 - DNA, 25 bp, Rattus norvegicus
cggactctcctgcagtccgacaggg

SEQ ID NO: 259077 - DNA, 25 bp, Rattus norvegicus
cggactctcctggagtccgacaggg

SEQ ID NO: 259078 - DNA, 25 bp, Rattus norvegicus
cggactgaattcacacttccatgaa

SEQ ID NO: 259079 - DNA, 25 bp, Rattus norvegicus
cggactgaattctcacttccatgaa

SEQ ID NO: 259080 - DNA, 25 bp, Rattus norvegicus
cggactgacaagatggcccggctgt

SEQ ID NO: 259081 - DNA, 25 bp, Rattus norvegicus
cggactgacaagttggcccggctgt

SEQ ID NO: 259082 - DNA, 25 bp, Rattus norvegicus
cggactggtctcagcttgctagata

SEQ ID NO: 259083 - DNA, 25 bp, Rattus norvegicus
cggactggtctctgcttgctagata

SEQ ID NO: 259084 - DNA, 25 bp, Rattus norvegicus
cggactgtatgaataatcacgatgt

SEQ ID NO: 259085 - DNA, 25 bp, Rattus norvegicus
cggactgtatgattaatcacgatgt

SEQ ID NO: 259086 - DNA, 25 bp, Rattus norvegicus
cggactgttactcagctgcgtttta

SEQ ID NO: 259087 - DNA, 25 bp, Rattus norvegicus
cggactgttactgagctgcgtttta

SEQ ID NO: 259088 - DNA, 25 bp, Rattus norvegicus
cggactttaggacgcggatgcttta

SEQ ID NO: 259089 - DNA, 25 bp, Rattus norvegicus
cggactttaggaggcggatgcttta

SEQ ID NO: 259090 - DNA, 25 bp, Rattus norvegicus
cggagaaagcgtatgcgtgcacaga

SEQ ID NO: 259091 - DNA, 25 bp, Rattus norvegicus
cggagaaagcgtttgcgtgcacaga

SEQ ID NO: 259092 - DNA, 25 bp, Rattus norvegicus
cggagaaagctcagtaccgtgcaga

SEQ ID NO: 259093 - DNA, 25 bp, Rattus norvegicus
cggagaaagctctgtaccgtgcaga

SEQ ID NO: 259094 - DNA, 25 bp, Rattus norvegicus
cggagaacccgtcgctgacagagta

SEQ ID NO: 259095 - DNA, 25 bp, Rattus norvegicus
cggagaacccgtggctgacagagta

SEQ ID NO: 259096 - DNA, 25 bp, Rattus norvegicus
cggagaagaaatccccactatgcct

SEQ ID NO: 259097 - DNA, 25 bp, Rattus norvegicus
cggagaagaaatgcccactatgcct

SEQ ID NO: 259098 - DNA, 25 bp, Rattus norvegicus
cggagaagtggccatccaacatcca

SEQ ID NO: 259099 - DNA, 25 bp, Rattus norvegicus
cggagaagtggcgatccaacatcca

SEQ ID NO: 259100 - DNA, 25 bp, Rattus norvegicus
cggagaatgtttacactcatgggat

SEQ ID NO: 259101 - DNA, 25 bp, Rattus norvegicus
cggagaatgttttcactcatgggat

SEQ ID NO: 259102 - DNA, 25 bp, Rattus norvegicus
cggagagaacgtcactcagtgcaaa

SEQ ID NO: 259103 - DNA, 25 bp, Rattus norvegicus
cggagagaacgtgactcagtgcaaa

SEQ ID NO: 259104 - DNA, 25 bp, Rattus norvegicus
cggagagactatagtcatcagtgac

SEQ ID NO: 259105 - DNA, 25 bp, Rattus norvegicus
cggagagactattgtcatcagtgac

SEQ ID NO: 259106 - DNA, 25 bp, Rattus norvegicus
cggagagagcgaagttcagcagcta

SEQ ID NO: 259107 - DNA, 25 bp, Rattus norvegicus
cggagagagcgatgttcagcagcta

SEQ ID NO: 259108 - DNA, 25 bp, Rattus norvegicus
cggagagccagtccacttttaaaat

SEQ ID NO: 259109 - DNA, 25 bp, Rattus norvegicus
cggagagccagtgcacttttaaaat

SEQ ID NO: 259110 - DNA, 25 bp, Rattus norvegicus
cggagagccctgcataccaactact

SEQ ID NO: 259111 - DNA, 25 bp, Rattus norvegicus
cggagagccctggataccaactact

SEQ ID NO: 259112 - DNA, 25 bp, Rattus norvegicus
cggagagctgtcagctaaggatgct

SEQ ID NO: 259113 - DNA, 25 bp, Rattus norvegicus
cggagagctgtctgctaaggatgct

SEQ ID NO: 259114 - DNA, 25 bp, Rattus norvegicus
cggagataaaccagagccttagctc

SEQ ID NO: 259115 - DNA, 25 bp, Rattus norvegicus
cggagataaacctgagccttagctc

SEQ ID NO: 259116 - DNA, 25 bp, Rattus norvegicus
cggagatgaaatatgccccttacct

SEQ ID NO: 259117 - DNA, 25 bp, Rattus norvegicus
cggagatgaaatttgccccttacct

SEQ ID NO: 259118 - DNA, 25 bp, Rattus norvegicus
cggagcaccatacaagagccacgtt

SEQ ID NO: 259119 - DNA, 25 bp, Rattus norvegicus
cggagcaccatagaagagccacgtt

SEQ ID NO: 259120 - DNA, 25 bp, Rattus norvegicus
cggagcagagcgaggagcacaccca

SEQ ID NO: 259121 - DNA, 25 bp, Rattus norvegicus
cggagcagagcgtggagcacaccca

SEQ ID NO: 259122 - DNA, 25 bp, Rattus norvegicus
cggagcaggcaccttttatcatgta

SEQ ID NO: 259123 - DNA, 25 bp, Rattus norvegicus
cggagcaggcacgttttatcatgta

SEQ ID NO: 259124 - DNA, 25 bp, Rattus norvegicus
cggagcaggcccaacgattctcgtc

SEQ ID NO: 259125 - DNA, 25 bp, Rattus norvegicus
cggagcaggccctacgattctcgtc

SEQ ID NO: 259126 - DNA, 25 bp, Rattus norvegicus
cggagcagggttcgctttctagctt

SEQ ID NO: 259127 - DNA, 25 bp, Rattus norvegicus
cggagcagggttggctttctagctt

SEQ ID NO: 259128 - DNA, 25 bp, Rattus norvegicus
cggagcagtctacaggagccacagc

SEQ ID NO: 259129 - DNA, 25 bp, Rattus norvegicus
cggagcagtctagaggagccacagc

SEQ ID NO: 259130 - DNA, 25 bp, Rattus norvegicus
cggagcagtgacagccttatcagaa

SEQ ID NO: 259131 - DNA, 25 bp, Rattus norvegicus
cggagcagtgactgccttatcagaa

SEQ ID NO: 259132 - DNA, 25 bp, Rattus norvegicus
cggagcatcaacctcagcctgaagg

SEQ ID NO: 259133 - DNA, 25 bp, Rattus norvegicus
cggagcatcaacgtcagcctgaagg

SEQ ID NO: 259134 - DNA, 25 bp, Rattus norvegicus
cggagcattcccagggtctggagaa

SEQ ID NO: 259135 - DNA, 25 bp, Rattus norvegicus
cggagcattccctgggtctggagaa

SEQ ID NO: 259136 - DNA, 25 bp, Rattus norvegicus
cggagcccaaatcaggttttgaaga

SEQ ID NO: 259137 - DNA, 25 bp, Rattus norvegicus
cggagcccaaatgaggttttgaaga

SEQ ID NO: 259138 - DNA, 25 bp, Rattus norvegicus
cggagccgactcagtcccgcgattg

SEQ ID NO: 259139 - DNA, 25 bp, Rattus norvegicus
cggagccgactctgtcccgcgattg

SEQ ID NO: 259140 - DNA, 25 bp, Rattus norvegicus
cggagcctactaagcgttgtttcat

SEQ ID NO: 259141 - DNA, 25 bp, Rattus norvegicus
cggagcctactatgcgttgtttcat

SEQ ID NO: 259142 - DNA, 25 bp, Rattus norvegicus
cggagcctgctaaccagtagacgag

SEQ ID NO: 259143 - DNA, 25 bp, Rattus norvegicus
cggagcctgctatccagtagacgag

SEQ ID NO: 259144 - DNA, 25 bp, Rattus norvegicus
cggagcctggctacatcaattacac

SEQ ID NO: 259145 - DNA, 25 bp, Rattus norvegicus
cggagcctggcttcatcaattacac

SEQ ID NO: 259146 - DNA, 25 bp, Rattus norvegicus
cggagccttaagagttgcacagaac

SEQ ID NO: 259147 - DNA, 25 bp, Rattus norvegicus
cggagccttaagtgttgcacagaac

SEQ ID NO: 259148 - DNA, 25 bp, Rattus norvegicus
cggagcgcccacctacatgtatgag

SEQ ID NO: 259149 - DNA, 25 bp, Rattus norvegicus
cggagcgcccacgtacatgtatgag

SEQ ID NO: 259150 - DNA, 25 bp, Rattus norvegicus
cggagcggtattacccgggaatcat

SEQ ID NO: 259151 - DNA, 25 bp, Rattus norvegicus
cggagcggtatttcccgggaatcat

SEQ ID NO: 259152 - DNA, 25 bp, Rattus norvegicus
cggagctggccgacagaaatgaagt

SEQ ID NO: 259153 - DNA, 25 bp, Rattus norvegicus
cggagctggccgtcagaaatgaagt

SEQ ID NO: 259154 - DNA, 25 bp, Rattus norvegicus
cggagcttctgcagtccgaggaata

SEQ ID NO: 259155 - DNA, 25 bp, Rattus norvegicus
cggagcttctgctgtccgaggaata

SEQ ID NO: 259156 - DNA, 25 bp, Rattus norvegicus
cggagctttgccattgatttccaaa

SEQ ID NO: 259157 - DNA, 25 bp, Rattus norvegicus
cggagctttgcctttgatttccaaa

SEQ ID NO: 259158 - DNA, 25 bp, Rattus norvegicus
cggaggacggatccacacacacaca

SEQ ID NO: 259159 - DNA, 25 bp, Rattus norvegicus
cggaggacggatgcacacacacaca

SEQ ID NO: 259160 - DNA, 25 bp, Rattus norvegicus
cggaggagctccctcaacattttgt

SEQ ID NO: 259161 - DNA, 25 bp, Rattus norvegicus
cggaggagctccgtcaacattttgt

SEQ ID NO: 259162 - DNA, 25 bp, Rattus norvegicus
cggaggagctgacccgctactatgc

SEQ ID NO: 259163 - DNA, 25 bp, Rattus norvegicus
cggaggagctgagccgctactatgc

SEQ ID NO: 259164 - DNA, 25 bp, Rattus norvegicus
cggaggcttgacatggaaccatgaa

SEQ ID NO: 259165 - DNA, 25 bp, Rattus norvegicus
cggaggcttgacttggaaccatgaa

SEQ ID NO: 259166 - DNA, 25 bp, Rattus norvegicus
cggagggctgatcgccttttagcca

SEQ ID NO: 259167 - DNA, 25 bp, Rattus norvegicus
cggagggctgatggccttttagcca

SEQ ID NO: 259168 - DNA, 25 bp, Rattus norvegicus
cggagggctttaacagtggctgcta

SEQ ID NO: 259169 - DNA, 25 bp, Rattus norvegicus
cggagggctttatcagtggctgcta

SEQ ID NO: 259170 - DNA, 25 bp, Rattus norvegicus
cggagggtctcacatggtcacagaa

SEQ ID NO: 259171 - DNA, 25 bp, Rattus norvegicus
cggagggtctcagatggtcacagaa

SEQ ID NO: 259172 - DNA, 25 bp, Rattus norvegicus
cggaggttgaccactgagctctaaa

SEQ ID NO: 259173 - DNA, 25 bp, Rattus norvegicus
cggaggttgacctctgagctctaaa

SEQ ID NO: 259174 - DNA, 25 bp, Rattus norvegicus
cggagtcccaaaaatctgtgtgccc

SEQ ID NO: 259175 - DNA, 25 bp, Rattus norvegicus
cggagtcccaaatatctgtgtgccc

SEQ ID NO: 259176 - DNA, 25 bp, Rattus norvegicus
cggagtcgcgacaccaggttcctgg

SEQ ID NO: 259177 - DNA, 25 bp, Rattus norvegicus
cggagtcgcgactccaggttcctgg

SEQ ID NO: 259178 - DNA, 25 bp, Rattus norvegicus
cggagtcggaatcctgccatggtca

SEQ ID NO: 259179 - DNA, 25 bp, Rattus norvegicus
cggagtcggaatgctgccatggtca

SEQ ID NO: 259180 - DNA, 25 bp, Rattus norvegicus
cggagtctttcccagatgaacattt

SEQ ID NO: 259181 - DNA, 25 bp, Rattus norvegicus
cggagtctttccgagatgaacattt

SEQ ID NO: 259182 - DNA, 25 bp, Rattus norvegicus
cggagtgaacaccatttcttcttta

SEQ ID NO: 259183 - DNA, 25 bp, Rattus norvegicus
cggagtgaacacgatttcttcttta

SEQ ID NO: 259184 - DNA, 25 bp, Rattus norvegicus
cggagtgaggcacagcgacaggctc

SEQ ID NO: 259185 - DNA, 25 bp, Rattus norvegicus
cggagtgaggcagagcgacaggctc

SEQ ID NO: 259186 - DNA, 25 bp, Rattus norvegicus
cggagtgggaatcatgctgtccttt

SEQ ID NO: 259187 - DNA, 25 bp, Rattus norvegicus
cggagtgggaatgatgctgtccttt

SEQ ID NO: 259188 - DNA, 25 bp, Rattus norvegicus
cggagtgtcaccacctgggtcatga

SEQ ID NO: 259189 - DNA, 25 bp, Rattus norvegicus
cggagtgtcacctcctgggtcatga

SEQ ID NO: 259190 - DNA, 25 bp, Rattus norvegicus
cggagttcggacatgattcaggctt

SEQ ID NO: 259191 - DNA, 25 bp, Rattus norvegicus
cggagttcggacttgattcaggctt

SEQ ID NO: 259192 - DNA, 25 bp, Rattus norvegicus
cggagttgacagagatggcagccat

SEQ ID NO: 259193 - DNA, 25 bp, Rattus norvegicus
cggagttgacagtgatggcagccat

SEQ ID NO: 259194 - DNA, 25 bp, Rattus norvegicus
cggagttgcagcctctgtttacatt

SEQ ID NO: 259195 - DNA, 25 bp, Rattus norvegicus
cggagttgcagcgtctgtttacatt

SEQ ID NO: 259196 - DNA, 25 bp, Rattus norvegicus
cggatacagtgcatgttacaaccta

SEQ ID NO: 259197 - DNA, 25 bp, Rattus norvegicus
cggatacagtgcttgttacaaccta

SEQ ID NO: 259198 - DNA, 25 bp, Rattus norvegicus
cggatacattgtccacccttagtga

SEQ ID NO: 259199 - DNA, 25 bp, Rattus norvegicus
cggatacattgtgcacccttagtga

SEQ ID NO: 259200 - DNA, 25 bp, Rattus norvegicus
cggataggatatccctttgccactt

SEQ ID NO: 259201 - DNA, 25 bp, Rattus norvegicus
cggataggatatgcctttgccactt

SEQ ID NO: 259202 - DNA, 25 bp, Rattus norvegicus
cggatatgactcaggtcagcggaca

SEQ ID NO: 259203 - DNA, 25 bp, Rattus norvegicus
cggatatgactctggtcagcggaca

SEQ ID NO: 259204 - DNA, 25 bp, Rattus norvegicus
cggatatgtatccatgccttttagt

SEQ ID NO: 259205 - DNA, 25 bp, Rattus norvegicus
cggatatgtatcgatgccttttagt

SEQ ID NO: 259206 - DNA, 25 bp, Rattus norvegicus
cggatattaatcaggatgtcccaca

SEQ ID NO: 259207 - DNA, 25 bp, Rattus norvegicus
cggatattaatctggatgtcccaca

SEQ ID NO: 259208 - DNA, 25 bp, Rattus norvegicus
cggatcacaaacctgcctgacttgc

SEQ ID NO: 259209 - DNA, 25 bp, Rattus norvegicus
cggatcacaaacgtgcctgacttgc

SEQ ID NO: 259210 - DNA, 25 bp, Rattus norvegicus
cggatccagagcctgccagatttat

SEQ ID NO: 259211 - DNA, 25 bp, Rattus norvegicus
cggatccagagcgtgccagatttat

SEQ ID NO: 259212 - DNA, 25 bp, Rattus norvegicus
cggatcctggaacgtcatcatgttt

SEQ ID NO: 259213 - DNA, 25 bp, Rattus norvegicus
cggatcctggaaggtcatcatgttt

SEQ ID NO: 259214 - DNA, 25 bp, Rattus norvegicus
cggatcgatatcacggctaagctgt

SEQ ID NO: 259215 - DNA, 25 bp, Rattus norvegicus
cggatcgatatctcggctaagctgt

SEQ ID NO: 259216 - DNA, 25 bp, Rattus norvegicus
cggatcttgttcattgcagcgtcaa

SEQ ID NO: 259217 - DNA, 25 bp, Rattus norvegicus
cggatcttgttctttgcagcgtcaa

SEQ ID NO: 259218 - DNA, 25 bp, Rattus norvegicus
cggatgacatcacctggagaacaga

SEQ ID NO: 259219 - DNA, 25 bp, Rattus norvegicus
cggatgacatcagctggagaacaga

SEQ ID NO: 259220 - DNA, 25 bp, Rattus norvegicus
cggatgagcacaccccagagacagc

SEQ ID NO: 259221 - DNA, 25 bp, Rattus norvegicus
cggatgagcacagcccagagacagc

SEQ ID NO: 259222 - DNA, 25 bp, Rattus norvegicus
cggatgcatgtcactgagctgcgtg

SEQ ID NO: 259223 - DNA, 25 bp, Rattus norvegicus
cggatgcatgtctctgagctgcgtg

SEQ ID NO: 259224 - DNA, 25 bp, Rattus norvegicus
cggatgctgtctcccttggctgtgc

SEQ ID NO: 259225 - DNA, 25 bp, Rattus norvegicus
cggatgctgtctgccttggctgtgc

SEQ ID NO: 259226 - DNA, 25 bp, Rattus norvegicus
cggatggacttacagcttactgctg

SEQ ID NO: 259227 - DNA, 25 bp, Rattus norvegicus
cggatggacttagagcttactgctg

SEQ ID NO: 259228 - DNA, 25 bp, Rattus norvegicus
cggatgggtcctccctaattttaat

SEQ ID NO: 259229 - DNA, 25 bp, Rattus norvegicus
cggatgggtcctgcctaattttaat

SEQ ID NO: 259230 - DNA, 25 bp, Rattus norvegicus
cggatggttcagacttcttgattta

SEQ ID NO: 259231 - DNA, 25 bp, Rattus norvegicus
cggatggttcagtcttcttgattta

SEQ ID NO: 259232 - DNA, 25 bp, Rattus norvegicus
cggatgtaagtccaggcccaaggca

SEQ ID NO: 259233 - DNA, 25 bp, Rattus norvegicus
cggatgtaagtcgaggcccaaggca

SEQ ID NO: 259234 - DNA, 25 bp, Rattus norvegicus
cggatgttcctgactttgctgtatt

SEQ ID NO: 259235 - DNA, 25 bp, Rattus norvegicus
cggatgttcctgtctttgctgtatt

SEQ ID NO: 259236 - DNA, 25 bp, Rattus norvegicus
cggattcggtctcaagaggtgcata

SEQ ID NO: 259237 - DNA, 25 bp, Rattus norvegicus
cggattcggtctgaagaggtgcata

SEQ ID NO: 259238 - DNA, 25 bp, Rattus norvegicus
cggattgatgctcgaacattcttct

SEQ ID NO: 259239 - DNA, 25 bp, Rattus norvegicus
cggattgatgctggaacattcttct

SEQ ID NO: 259240 - DNA, 25 bp, Rattus norvegicus
cggattgggaacagcactgtgcact

SEQ ID NO: 259241 - DNA, 25 bp, Rattus norvegicus
cggattgggaactgcactgtgcact

SEQ ID NO: 259242 - DNA, 25 bp, Rattus norvegicus
cggattggtgtcagggctactaaac

SEQ ID NO: 259243 - DNA, 25 bp, Rattus norvegicus
cggattggtgtctgggctactaaac

SEQ ID NO: 259244 - DNA, 25 bp, Rattus norvegicus
cggcaaattaacaggactgtcctct

SEQ ID NO: 259245 - DNA, 25 bp, Rattus norvegicus
cggcaaattaactggactgtcctct

SEQ ID NO: 259246 - DNA, 25 bp, Rattus norvegicus
cggcaaccggacaggcacctggagc

SEQ ID NO: 259247 - DNA, 25 bp, Rattus norvegicus
cggcaaccggactggcacctggagc

SEQ ID NO: 259248 - DNA, 25 bp, Rattus norvegicus
cggcaacggcaaagagtgggcacct

SEQ ID NO: 259249 - DNA, 25 bp, Rattus norvegicus
cggcaacggcaatgagtgggcacct

SEQ ID NO: 259250 - DNA, 25 bp, Rattus norvegicus
cggcaacttggccacctaaaggatg

SEQ ID NO: 259251 - DNA, 25 bp, Rattus norvegicus
cggcaacttggcgacctaaaggatg

SEQ ID NO: 259252 - DNA, 25 bp, Rattus norvegicus
cggcaactttggattctacgtctga

SEQ ID NO: 259253 - DNA, 25 bp, Rattus norvegicus
cggcaactttggtttctacgtctga

SEQ ID NO: 259254 - DNA, 25 bp, Rattus norvegicus
cggcaatctcagctgtcttgaacat

SEQ ID NO: 259255 - DNA, 25 bp, Rattus norvegicus
cggcaatctcaggtgtcttgaacat

SEQ ID NO: 259256 - DNA, 25 bp, Rattus norvegicus
cggcaattctctccgctgtaaatat

SEQ ID NO: 259257 - DNA, 25 bp, Rattus norvegicus
cggcaattctctgcgctgtaaatat

SEQ ID NO: 259258 - DNA, 25 bp, Rattus norvegicus
cggcaccaacttcttcatcaaggtt

SEQ ID NO: 259259 - DNA, 25 bp, Rattus norvegicus
cggcaccaacttgttcatcaaggtt

SEQ ID NO: 259260 - DNA, 25 bp, Rattus norvegicus
cggcactggcatccagacctgaggt

SEQ ID NO: 259261 - DNA, 25 bp, Rattus norvegicus
cggcactggcatgcagacctgaggt

SEQ ID NO: 259262 - DNA, 25 bp, Rattus norvegicus
cggcactttctcagtcattgaggaa

SEQ ID NO: 259263 - DNA, 25 bp, Rattus norvegicus
cggcactttctctgtcattgaggaa

SEQ ID NO: 259264 - DNA, 25 bp, Rattus norvegicus
cggcagaaatccaccatggtggaca

SEQ ID NO: 259265 - DNA, 25 bp, Rattus norvegicus
cggcagaaatcctccatggtggaca

SEQ ID NO: 259266 - DNA, 25 bp, Rattus norvegicus
cggcagaagttcaggcagtcagaga

SEQ ID NO: 259267 - DNA, 25 bp, Rattus norvegicus
cggcagaagttctggcagtcagaga

SEQ ID NO: 259268 - DNA, 25 bp, Rattus norvegicus
cggcagacattcctttgtgacacaa

SEQ ID NO: 259269 - DNA, 25 bp, Rattus norvegicus
cggcagacattcgtttgtgacacaa

SEQ ID NO: 259270 - DNA, 25 bp, Rattus norvegicus
cggcagagggcgctttaatttcaaa

SEQ ID NO: 259271 - DNA, 25 bp, Rattus norvegicus
cggcagagggcggtttaatttcaaa

SEQ ID NO: 259272 - DNA, 25 bp, Rattus norvegicus
cggcagcacgtacaccgtccgggtt

SEQ ID NO: 259273 - DNA, 25 bp, Rattus norvegicus
cggcagcacgtagaccgtccgggtt

SEQ ID NO: 259274 - DNA, 25 bp, Rattus norvegicus
cggcagcagtgaagaagaggaaaca

SEQ ID NO: 259275 - DNA, 25 bp, Rattus norvegicus
cggcagcagtgatgaagaggaaaca

SEQ ID NO: 259276 - DNA, 25 bp, Rattus norvegicus
cggcagcatatgcagcccgtgctaa

SEQ ID NO: 259277 - DNA, 25 bp, Rattus norvegicus
cggcagcatatggagcccgtgctaa

SEQ ID NO: 259278 - DNA, 25 bp, Rattus norvegicus
cggcagctctccatggctaaaaggg

SEQ ID NO: 259279 - DNA, 25 bp, Rattus norvegicus
cggcagctctccttggctaaaaggg

SEQ ID NO: 259280 - DNA, 25 bp, Rattus norvegicus
cggcagctggagatctacagggcca

SEQ ID NO: 259281 - DNA, 25 bp, Rattus norvegicus
cggcagctggagttctacagggcca

SEQ ID NO: 259282 - DNA, 25 bp, Rattus norvegicus
cggcagcttcctcttaaccttcaag

SEQ ID NO: 259283 - DNA, 25 bp, Rattus norvegicus
cggcagcttcctgttaaccttcaag

SEQ ID NO: 259284 - DNA, 25 bp, Rattus norvegicus
cggcaggatcctcttgtgcagcaac

SEQ ID NO: 259285 - DNA, 25 bp, Rattus norvegicus
cggcaggatcctgttgtgcagcaac

SEQ ID NO: 259286 - DNA, 25 bp, Rattus norvegicus
cggcaggatcgacgcgcttctgtat

SEQ ID NO: 259287 - DNA, 25 bp, Rattus norvegicus
cggcaggatcgaggcgcttctgtat

SEQ ID NO: 259288 - DNA, 25 bp, Rattus norvegicus
cggcaggattgcatgggattctaaa

SEQ ID NO: 259289 - DNA, 25 bp, Rattus norvegicus
cggcaggattgcttgggattctaaa

SEQ ID NO: 259290 - DNA, 25 bp, Rattus norvegicus
cggcagggagccactctgagcacca

SEQ ID NO: 259291 - DNA, 25 bp, Rattus norvegicus
cggcagggagcctctctgagcacca

SEQ ID NO: 259292 - DNA, 25 bp, Rattus norvegicus
cggcagggatgcacagcacgttgaa

SEQ ID NO: 259293 - DNA, 25 bp, Rattus norvegicus
cggcagggatgctcagcacgttgaa

SEQ ID NO: 259294 - DNA, 25 bp, Rattus norvegicus
cggcagtagaagcacggaccctaat

SEQ ID NO: 259295 - DNA, 25 bp, Rattus norvegicus
cggcagtagaaggacggaccctaat

SEQ ID NO: 259296 - DNA, 25 bp, Rattus norvegicus
cggcagtttgagacctgactctgga

SEQ ID NO: 259297 - DNA, 25 bp, Rattus norvegicus
cggcagtttgagtcctgactctgga

SEQ ID NO: 259298 - DNA, 25 bp, Rattus norvegicus
cggcagtttgtacgttcccttgtcg

SEQ ID NO: 259299 - DNA, 25 bp, Rattus norvegicus
cggcagtttgtaggttcccttgtcg

SEQ ID NO: 259300 - DNA, 25 bp, Rattus norvegicus
cggcataaggtcacggagtccagca

SEQ ID NO: 259301 - DNA, 25 bp, Rattus norvegicus
cggcataaggtctcggagtccagca

SEQ ID NO: 259302 - DNA, 25 bp, Rattus norvegicus
cggcatatcctacagccttgtaagt

SEQ ID NO: 259303 - DNA, 25 bp, Rattus norvegicus
cggcatatcctagagccttgtaagt

SEQ ID NO: 259304 - DNA, 25 bp, Rattus norvegicus
cggcatccacgcagagctggaggaa

SEQ ID NO: 259305 - DNA, 25 bp, Rattus norvegicus
cggcatccacgctgagctggaggaa

SEQ ID NO: 259306 - DNA, 25 bp, Rattus norvegicus
cggcatctaagcacactgggaacaa

SEQ ID NO: 259307 - DNA, 25 bp, Rattus norvegicus
cggcatctaagctcactgggaacaa

SEQ ID NO: 259308 - DNA, 25 bp, Rattus norvegicus
cggcatctaccacttcatcatggac

SEQ ID NO: 259309 - DNA, 25 bp, Rattus norvegicus
cggcatctaccagttcatcatggac

SEQ ID NO: 259310 - DNA, 25 bp, Rattus norvegicus
cggcatcttgggatcttatgttaca

SEQ ID NO: 259311 - DNA, 25 bp, Rattus norvegicus
cggcatcttgggttcttatgttaca

SEQ ID NO: 259312 - DNA, 25 bp, Rattus norvegicus
cggcatgatgagctatggacagtca

SEQ ID NO: 259313 - DNA, 25 bp, Rattus norvegicus
cggcatgatgaggtatggacagtca

SEQ ID NO: 259314 - DNA, 25 bp, Rattus norvegicus
cggcatggtcttactcaagtggtga

SEQ ID NO: 259315 - DNA, 25 bp, Rattus norvegicus
cggcatggtctttctcaagtggtga

SEQ ID NO: 259316 - DNA, 25 bp, Rattus norvegicus
cggcattccgtcctaacaatattta

SEQ ID NO: 259317 - DNA, 25 bp, Rattus norvegicus
cggcattccgtcgtaacaatattta

SEQ ID NO: 259318 - DNA, 25 bp, Rattus norvegicus
cggcattctgggactgggcgcacac

SEQ ID NO: 259319 - DNA, 25 bp, Rattus norvegicus
cggcattctgggtctgggcgcacac

SEQ ID NO: 259320 - DNA, 25 bp, Rattus norvegicus
cggcattgaatgctctggaactgga

SEQ ID NO: 259321 - DNA, 25 bp, Rattus norvegicus
cggcattgaatggtctggaactgga

SEQ ID NO: 259322 - DNA, 25 bp, Rattus norvegicus
cggcatttatttaagcagcctcatt

SEQ ID NO: 259323 - DNA, 25 bp, Rattus norvegicus
cggcatttattttagcagcctcatt

SEQ ID NO: 259324 - DNA, 25 bp, Rattus norvegicus
cggccaagaaacacccagaagcatt

SEQ ID NO: 259325 - DNA, 25 bp, Rattus norvegicus
cggccaagaaactcccagaagcatt

SEQ ID NO: 259326 - DNA, 25 bp, Rattus norvegicus
cggccaagaggcagacccaggaaat

SEQ ID NO: 259327 - DNA, 25 bp, Rattus norvegicus
cggccaagaggctgacccaggaaat

SEQ ID NO: 259328 - DNA, 25 bp, Rattus norvegicus
cggccaccatacatacttttatcta

SEQ ID NO: 259329 - DNA, 25 bp, Rattus norvegicus
cggccaccatacttacttttatcta

SEQ ID NO: 259330 - DNA, 25 bp, Rattus norvegicus
cggccacgtctgctgtattattaaa

SEQ ID NO: 259331 - DNA, 25 bp, Rattus norvegicus
cggccacgtctggtgtattattaaa

SEQ ID NO: 259332 - DNA, 25 bp, Rattus norvegicus
cggccagaccggattacagtgagaa

SEQ ID NO: 259333 - DNA, 25 bp, Rattus norvegicus
cggccagaccggtttacagtgagaa

SEQ ID NO: 259334 - DNA, 25 bp, Rattus norvegicus
cggccagatatccttgtcatgtgtg

SEQ ID NO: 259335 - DNA, 25 bp, Rattus norvegicus
cggccagatatcgttgtcatgtgtg

SEQ ID NO: 259336 - DNA, 25 bp, Rattus norvegicus
cggccagcacctaggttgggagata

SEQ ID NO: 259337 - DNA, 25 bp, Rattus norvegicus
cggccagcaccttggttgggagata

SEQ ID NO: 259338 - DNA, 25 bp, Rattus norvegicus
cggccaggcctccaaatgcaatgag

SEQ ID NO: 259339 - DNA, 25 bp, Rattus norvegicus
cggccaggcctcgaaatgcaatgag

SEQ ID NO: 259340 - DNA, 25 bp, Rattus norvegicus
cggccaggctgaatggaattccatt

SEQ ID NO: 259341 - DNA, 25 bp, Rattus norvegicus
cggccaggctgattggaattccatt

SEQ ID NO: 259342 - DNA, 25 bp, Rattus norvegicus
cggccaggctggcatgaagtttcac

SEQ ID NO: 259343 - DNA, 25 bp, Rattus norvegicus
cggccaggctgggatgaagtttcac

SEQ ID NO: 259344 - DNA, 25 bp, Rattus norvegicus
cggccaggtcccactataaacagag

SEQ ID NO: 259345 - DNA, 25 bp, Rattus norvegicus
cggccaggtccctctataaacagag

SEQ ID NO: 259346 - DNA, 25 bp, Rattus norvegicus
cggccatcatggctaatccccagat

SEQ ID NO: 259347 - DNA, 25 bp, Rattus norvegicus
cggccatcatgggtaatccccagat

SEQ ID NO: 259348 - DNA, 25 bp, Rattus norvegicus
cggccatcttgcagtgtttgattaa

SEQ ID NO: 259349 - DNA, 25 bp, Rattus norvegicus
cggccatcttgctgtgtttgattaa

SEQ ID NO: 259350 - DNA, 25 bp, Rattus norvegicus
cggccatgctctattgagctgtgta

SEQ ID NO: 259351 - DNA, 25 bp, Rattus norvegicus
cggccatgctcttttgagctgtgta

SEQ ID NO: 259352 - DNA, 25 bp, Rattus norvegicus
cggccatggaagcttctcaggactt

SEQ ID NO: 259353 - DNA, 25 bp, Rattus norvegicus
cggccatggaaggttctcaggactt

SEQ ID NO: 259354 - DNA, 25 bp, Rattus norvegicus
cggcccaattggctttgtcacagtc

SEQ ID NO: 259355 - DNA, 25 bp, Rattus norvegicus
cggcccaattgggtttgtcacagtc

SEQ ID NO: 259356 - DNA, 25 bp, Rattus norvegicus
cggcccagtcatctcatgggtgatt

SEQ ID NO: 259357 - DNA, 25 bp, Rattus norvegicus
cggcccagtcatgtcatgggtgatt

SEQ ID NO: 259358 - DNA, 25 bp, Rattus norvegicus
cggcccagttgaaaggtccatgtgt

SEQ ID NO: 259359 - DNA, 25 bp, Rattus norvegicus
cggcccagttgataggtccatgtgt

SEQ ID NO: 259360 - DNA, 25 bp, Rattus norvegicus
cggcccattcccaatgtcaaaagtt

SEQ ID NO: 259361 - DNA, 25 bp, Rattus norvegicus
cggcccattccctatgtcaaaagtt

SEQ ID NO: 259362 - DNA, 25 bp, Rattus norvegicus
cggccccggcggatgttgacattgt

SEQ ID NO: 259363 - DNA, 25 bp, Rattus norvegicus
cggccccggcggttgttgacattgt

SEQ ID NO: 259364 - DNA, 25 bp, Rattus norvegicus
cggccccggtttaagctgaaatatg

SEQ ID NO: 259365 - DNA, 25 bp, Rattus norvegicus
cggccccggttttagctgaaatatg

SEQ ID NO: 259366 - DNA, 25 bp, Rattus norvegicus
cggcccggccgcagtcatgtagtcg

SEQ ID NO: 259367 - DNA, 25 bp, Rattus norvegicus
cggcccggccgctgtcatgtagtcg

SEQ ID NO: 259368 - DNA, 25 bp, Rattus norvegicus
cggcccgggagcaacagttctgtgt

SEQ ID NO: 259369 - DNA, 25 bp, Rattus norvegicus
cggcccgggagctacagttctgtgt

SEQ ID NO: 259370 - DNA, 25 bp, Rattus norvegicus
cggcccgtggtgactcttagagtga

SEQ ID NO: 259371 - DNA, 25 bp, Rattus norvegicus
cggcccgtggtgtctcttagagtga

SEQ ID NO: 259372 - DNA, 25 bp, Rattus norvegicus
cggcccgtggttctccttgaaagat

SEQ ID NO: 259373 - DNA, 25 bp, Rattus norvegicus
cggcccgtggttgtccttgaaagat

SEQ ID NO: 259374 - DNA, 25 bp, Rattus norvegicus
cggccctactagagacctgcagagc

SEQ ID NO: 259375 - DNA, 25 bp, Rattus norvegicus
cggccctactagtgacctgcagagc

SEQ ID NO: 259376 - DNA, 25 bp, Rattus norvegicus
cggccctggcagatgatgtggatca

SEQ ID NO: 259377 - DNA, 25 bp, Rattus norvegicus
cggccctggcagttgatgtggatca

SEQ ID NO: 259378 - DNA, 25 bp, Rattus norvegicus
cggccgaaaagaccctcatggtttt

SEQ ID NO: 259379 - DNA, 25 bp, Rattus norvegicus
cggccgaaaagagcctcatggtttt

SEQ ID NO: 259380 - DNA, 25 bp, Rattus norvegicus
cggccgaagaggaagaccacccaat

SEQ ID NO: 259381 - DNA, 25 bp, Rattus norvegicus
cggccgaagaggtagaccacccaat

SEQ ID NO: 259382 - DNA, 25 bp, Rattus norvegicus
cggccgaatgccaggagtcccctaa

SEQ ID NO: 259383 - DNA, 25 bp, Rattus norvegicus
cggccgaatgcctggagtcccctaa

SEQ ID NO: 259384 - DNA, 25 bp, Rattus norvegicus
cggccgaccaacacaattgtgttta

SEQ ID NO: 259385 - DNA, 25 bp, Rattus norvegicus
cggccgaccaactcaattgtgttta

SEQ ID NO: 259386 - DNA, 25 bp, Rattus norvegicus
cggccgattatcagcaaccaaacac

SEQ ID NO: 259387 - DNA, 25 bp, Rattus norvegicus
cggccgattatctgcaaccaaacac

SEQ ID NO: 259388 - DNA, 25 bp, Rattus norvegicus
cggccgcagccgacatagtctatga

SEQ ID NO: 259389 - DNA, 25 bp, Rattus norvegicus
cggccgcagccgtcatagtctatga

SEQ ID NO: 259390 - DNA, 25 bp, Rattus norvegicus
cggccgcctggtagaaattctggca

SEQ ID NO: 259391 - DNA, 25 bp, Rattus norvegicus
cggccgcctggttgaaattctggca

SEQ ID NO: 259392 - DNA, 25 bp, Rattus norvegicus
cggccggagccaagcattggactat

SEQ ID NO: 259393 - DNA, 25 bp, Rattus norvegicus
cggccggagccatgcattggactat

SEQ ID NO: 259394 - DNA, 25 bp, Rattus norvegicus
cggccggagcccaaatgaggttttg

SEQ ID NO: 259395 - DNA, 25 bp, Rattus norvegicus
cggccggagccctaatgaggttttg

SEQ ID NO: 259396 - DNA, 25 bp, Rattus norvegicus
cggccggattaacccatacatgagc

SEQ ID NO: 259397 - DNA, 25 bp, Rattus norvegicus
cggccggattaagccatacatgagc

SEQ ID NO: 259398 - DNA, 25 bp, Rattus norvegicus
cggccggcggagacgacgactacat

SEQ ID NO: 259399 - DNA, 25 bp, Rattus norvegicus
cggccggcggagtcgacgactacat

SEQ ID NO: 259400 - DNA, 25 bp, Rattus norvegicus
cggccggcgtgacccgtacaaaatc

SEQ ID NO: 259401 - DNA, 25 bp, Rattus norvegicus
cggccggcgtgagccgtacaaaatc

SEQ ID NO: 259402 - DNA, 25 bp, Rattus norvegicus
cggccggctcagaagagaggcccac

SEQ ID NO: 259403 - DNA, 25 bp, Rattus norvegicus
cggccggctcagtagagaggcccac

SEQ ID NO: 259404 - DNA, 25 bp, Rattus norvegicus
cggccgtctgttagggaaagcagtt

SEQ ID NO: 259405 - DNA, 25 bp, Rattus norvegicus
cggccgtctgtttgggaaagcagtt

SEQ ID NO: 259406 - DNA, 25 bp, Rattus norvegicus
cggccgtgatctcggcttatacaca

SEQ ID NO: 259407 - DNA, 25 bp, Rattus norvegicus
cggccgtgatctgggcttatacaca

SEQ ID NO: 259408 - DNA, 25 bp, Rattus norvegicus
cggcctagcctaagccatctagatg

SEQ ID NO: 259409 - DNA, 25 bp, Rattus norvegicus
cggcctagcctatgccatctagatg

SEQ ID NO: 259410 - DNA, 25 bp, Rattus norvegicus
cggcctatgaagagtcggagctgct

SEQ ID NO: 259411 - DNA, 25 bp, Rattus norvegicus
cggcctatgaagtgtcggagctgct

SEQ ID NO: 259412 - DNA, 25 bp, Rattus norvegicus
cggcctcagcgcagagctttagaaa

SEQ ID NO: 259413 - DNA, 25 bp, Rattus norvegicus
cggcctcagcgctgagctttagaaa

SEQ ID NO: 259414 - DNA, 25 bp, Rattus norvegicus
cggcctccctcaatttatttatgtt

SEQ ID NO: 259415 - DNA, 25 bp, Rattus norvegicus
cggcctccctcattttatttatgtt

SEQ ID NO: 259416 - DNA, 25 bp, Rattus norvegicus
cggcctccggttatgctgtatcttt

SEQ ID NO: 259417 - DNA, 25 bp, Rattus norvegicus
cggcctccggttttgctgtatcttt

SEQ ID NO: 259418 - DNA, 25 bp, Rattus norvegicus
cggcctctagccactttgctatgcg

SEQ ID NO: 259419 - DNA, 25 bp, Rattus norvegicus
cggcctctagcctctttgctatgcg

SEQ ID NO: 259420 - DNA, 25 bp, Rattus norvegicus
cggcctctgtggaggtgctaacgac

SEQ ID NO: 259421 - DNA, 25 bp, Rattus norvegicus
cggcctctgtggtggtgctaacgac

SEQ ID NO: 259422 - DNA, 25 bp, Rattus norvegicus
cggcctcttactccttttgtatagt

SEQ ID NO: 259423 - DNA, 25 bp, Rattus norvegicus
cggcctcttactgcttttgtatagt

SEQ ID NO: 259424 - DNA, 25 bp, Rattus norvegicus
cggcctgaccagagactgatggaaa

SEQ ID NO: 259425 - DNA, 25 bp, Rattus norvegicus
cggcctgaccagtgactgatggaaa

SEQ ID NO: 259426 - DNA, 25 bp, Rattus norvegicus
cggcctgatcataggcacaggcacc

SEQ ID NO: 259427 - DNA, 25 bp, Rattus norvegicus
cggcctgatcattggcacaggcacc

SEQ ID NO: 259428 - DNA, 25 bp, Rattus norvegicus
cggcctgcagggacaatcttgatgt

SEQ ID NO: 259429 - DNA, 25 bp, Rattus norvegicus
cggcctgcagggtcaatcttgatgt

SEQ ID NO: 259430 - DNA, 25 bp, Rattus norvegicus
cggcctgcatgacgatgacgagacc

SEQ ID NO: 259431 - DNA, 25 bp, Rattus norvegicus
cggcctgcatgaggatgacgagacc

SEQ ID NO: 259432 - DNA, 25 bp, Rattus norvegicus
cggcctgggcctcttctgagaagca

SEQ ID NO: 259433 - DNA, 25 bp, Rattus norvegicus
cggcctgggcctgttctgagaagca

SEQ ID NO: 259434 - DNA, 25 bp, Rattus norvegicus
cggcctgtcgtcatgtgaagtccag

SEQ ID NO: 259435 - DNA, 25 bp, Rattus norvegicus
cggcctgtcgtcttgtgaagtccag

SEQ ID NO: 259436 - DNA, 25 bp, Rattus norvegicus
cggccttatgtacatttcccaacaa

SEQ ID NO: 259437 - DNA, 25 bp, Rattus norvegicus
cggccttatgtagatttcccaacaa

SEQ ID NO: 259438 - DNA, 25 bp, Rattus norvegicus
cggccttcaccgcatttgaggaggt

SEQ ID NO: 259439 - DNA, 25 bp, Rattus norvegicus
cggccttcaccggatttgaggaggt

SEQ ID NO: 259440 - DNA, 25 bp, Rattus norvegicus
cggccttcatgtctgagaccgaact

SEQ ID NO: 259441 - DNA, 25 bp, Rattus norvegicus
cggccttcatgtgtgagaccgaact

SEQ ID NO: 259442 - DNA, 25 bp, Rattus norvegicus
cggccttctgccctaagtgaaaatg

SEQ ID NO: 259443 - DNA, 25 bp, Rattus norvegicus
cggccttctgccgtaagtgaaaatg

SEQ ID NO: 259444 - DNA, 25 bp, Rattus norvegicus
cggccttctgtactgctcttcaaag

SEQ ID NO: 259445 - DNA, 25 bp, Rattus norvegicus
cggccttctgtagtgctcttcaaag

SEQ ID NO: 259446 - DNA, 25 bp, Rattus norvegicus
cggccttgttgtatgacctatgata

SEQ ID NO: 259447 - DNA, 25 bp, Rattus norvegicus
cggccttgttgtttgacctatgata

SEQ ID NO: 259448 - DNA, 25 bp, Rattus norvegicus
cggcctttcggaactgaagcagtca

SEQ ID NO: 259449 - DNA, 25 bp, Rattus norvegicus
cggcctttcggatctgaagcagtca

SEQ ID NO: 259450 - DNA, 25 bp, Rattus norvegicus
cggcgacagcggaaagatcgtgatc

SEQ ID NO: 259451 - DNA, 25 bp, Rattus norvegicus
cggcgacagcggtaagatcgtgatc

SEQ ID NO: 259452 - DNA, 25 bp, Rattus norvegicus
cggcgaccggagaagggcgcgcgac

SEQ ID NO: 259453 - DNA, 25 bp, Rattus norvegicus
cggcgaccggagtagggcgcgcgac

SEQ ID NO: 259454 - DNA, 25 bp, Rattus norvegicus
cggcgagaagttacgggactcctat

SEQ ID NO: 259455 - DNA, 25 bp, Rattus norvegicus
cggcgagaagtttcgggactcctat

SEQ ID NO: 259456 - DNA, 25 bp, Rattus norvegicus
cggcgagccaggctttgctgcacct

SEQ ID NO: 259457 - DNA, 25 bp, Rattus norvegicus
cggcgagccagggtttgctgcacct

SEQ ID NO: 259458 - DNA, 25 bp, Rattus norvegicus
cggcgaggcggcatcatagccctag

SEQ ID NO: 259459 - DNA, 25 bp, Rattus norvegicus
cggcgaggcggcttcatagccctag

SEQ ID NO: 259460 - DNA, 25 bp, Rattus norvegicus
cggcgagggctgaagccctctccag

SEQ ID NO: 259461 - DNA, 25 bp, Rattus norvegicus
cggcgagggctgtagccctctccag

SEQ ID NO: 259462 - DNA, 25 bp, Rattus norvegicus
cggcgatgctgactttccaaacaaa

SEQ ID NO: 259463 - DNA, 25 bp, Rattus norvegicus
cggcgatgctgagtttccaaacaaa

SEQ ID NO: 259464 - DNA, 25 bp, Rattus norvegicus
cggcgcaaagctacagacttctttt

SEQ ID NO: 259465 - DNA, 25 bp, Rattus norvegicus
cggcgcaaagcttcagacttctttt

SEQ ID NO: 259466 - DNA, 25 bp, Rattus norvegicus
cggcgcaatgcccaatagtggtaag

SEQ ID NO: 259467 - DNA, 25 bp, Rattus norvegicus
cggcgcaatgccgaatagtggtaag

SEQ ID NO: 259468 - DNA, 25 bp, Rattus norvegicus
cggcgcagcggacgacaaacttaca

SEQ ID NO: 259469 - DNA, 25 bp, Rattus norvegicus
cggcgcagcggaggacaaacttaca

SEQ ID NO: 259470 - DNA, 25 bp, Rattus norvegicus
cggcgcccaaggaaaagagtgctgt

SEQ ID NO: 259471 - DNA, 25 bp, Rattus norvegicus
cggcgcccaaggtaaagagtgctgt

SEQ ID NO: 259472 - DNA, 25 bp, Rattus norvegicus
cggcgcctaccacggctggaagaac

SEQ ID NO: 259473 - DNA, 25 bp, Rattus norvegicus
cggcgcctaccagggctggaagaac

SEQ ID NO: 259474 - DNA, 25 bp, Rattus norvegicus
cggcgcgagttccaccgtgactctg

SEQ ID NO: 259475 - DNA, 25 bp, Rattus norvegicus
cggcgcgagttcgaccgtgactctg

SEQ ID NO: 259476 - DNA, 25 bp, Rattus norvegicus
cggcgcgggcgcagctggtgaaagc

SEQ ID NO: 259477 - DNA, 25 bp, Rattus norvegicus
cggcgcgggcgctgctggtgaaagc

SEQ ID NO: 259478 - DNA, 25 bp, Rattus norvegicus
cggcgctacctcaacaatggacttg

SEQ ID NO: 259479 - DNA, 25 bp, Rattus norvegicus
cggcgctacctctacaatggacttg

SEQ ID NO: 259480 - DNA, 25 bp, Rattus norvegicus
cggcgcttccttcttgagtggctct

SEQ ID NO: 259481 - DNA, 25 bp, Rattus norvegicus
cggcgcttccttgttgagtggctct

SEQ ID NO: 259482 - DNA, 25 bp, Rattus norvegicus
cggcggaccggaccataatgctaaa

SEQ ID NO: 259483 - DNA, 25 bp, Rattus norvegicus
cggcggaccggagcataatgctaaa

SEQ ID NO: 259484 - DNA, 25 bp, Rattus norvegicus
cggcggacttgtcatcggcctgcat

SEQ ID NO: 259485 - DNA, 25 bp, Rattus norvegicus
cggcggacttgtgatcggcctgcat

SEQ ID NO: 259486 - DNA, 25 bp, Rattus norvegicus
cggcggatgcagcagatgctacaca

SEQ ID NO: 259487 - DNA, 25 bp, Rattus norvegicus
cggcggatgcaggagatgctacaca

SEQ ID NO: 259488 - DNA, 25 bp, Rattus norvegicus
cggcggcagaaaagatggaagaact

SEQ ID NO: 259489 - DNA, 25 bp, Rattus norvegicus
cggcggcagaaatgatggaagaact

SEQ ID NO: 259490 - DNA, 25 bp, Rattus norvegicus
cggcggcggacaccaggacttacta

SEQ ID NO: 259491 - DNA, 25 bp, Rattus norvegicus
cggcggcggacagcaggacttacta

SEQ ID NO: 259492 - DNA, 25 bp, Rattus norvegicus
cggcggctaagaaacaaagtgaaat

SEQ ID NO: 259493 - DNA, 25 bp, Rattus norvegicus
cggcggctaagatacaaagtgaaat

SEQ ID NO: 259494 - DNA, 25 bp, Rattus norvegicus
cggcggctggccagggaacggagct

SEQ ID NO: 259495 - DNA, 25 bp, Rattus norvegicus
cggcggctggcctgggaacggagct

SEQ ID NO: 259496 - DNA, 25 bp, Rattus norvegicus
cggcggcttcagactctaaacctag

SEQ ID NO: 259497 - DNA, 25 bp, Rattus norvegicus
cggcggcttcagtctctaaacctag

SEQ ID NO: 259498 - DNA, 25 bp, Rattus norvegicus
cggcgggcactgatggcattactct

SEQ ID NO: 259499 - DNA, 25 bp, Rattus norvegicus
cggcgggcactgttggcattactct

SEQ ID NO: 259500 - DNA, 25 bp, Rattus norvegicus
cggcgggccgagaattgcacttgat

SEQ ID NO: 259501 - DNA, 25 bp, Rattus norvegicus
cggcgggccgagtattgcacttgat

SEQ ID NO: 259502 - DNA, 25 bp, Rattus norvegicus
cggcgtgacagaaggcttcttttgc

SEQ ID NO: 259503 - DNA, 25 bp, Rattus norvegicus
cggcgtgacagatggcttcttttgc

SEQ ID NO: 259504 - DNA, 25 bp, Rattus norvegicus
cggcgtgccctcagaagcagaggtt

SEQ ID NO: 259505 - DNA, 25 bp, Rattus norvegicus
cggcgtgccctctgaagcagaggtt

SEQ ID NO: 259506 - DNA, 25 bp, Rattus norvegicus
cggcgttggaatacctgggcagctt

SEQ ID NO: 259507 - DNA, 25 bp, Rattus norvegicus
cggcgttggaattcctgggcagctt

SEQ ID NO: 259508 - DNA, 25 bp, Rattus norvegicus
cggctaaagggccattttcaatgga

SEQ ID NO: 259509 - DNA, 25 bp, Rattus norvegicus
cggctaaagggcgattttcaatgga

SEQ ID NO: 259510 - DNA, 25 bp, Rattus norvegicus
cggctactctgacccttatgtgaag

SEQ ID NO: 259511 - DNA, 25 bp, Rattus norvegicus
cggctactctgagccttatgtgaag

SEQ ID NO: 259512 - DNA, 25 bp, Rattus norvegicus
cggctagactcacaaggcgaggcat

SEQ ID NO: 259513 - DNA, 25 bp, Rattus norvegicus
cggctagactcagaaggcgaggcat

SEQ ID NO: 259514 - DNA, 25 bp, Rattus norvegicus
cggctagtctggagctcactatgaa

SEQ ID NO: 259515 - DNA, 25 bp, Rattus norvegicus
cggctagtctggtgctcactatgaa

SEQ ID NO: 259516 - DNA, 25 bp, Rattus norvegicus
cggctatcagatatccagacgagta

SEQ ID NO: 259517 - DNA, 25 bp, Rattus norvegicus
cggctatcagatttccagacgagta

SEQ ID NO: 259518 - DNA, 25 bp, Rattus norvegicus
cggctcacgtctacagctgtttggg

SEQ ID NO: 259519 - DNA, 25 bp, Rattus norvegicus
cggctcacgtcttcagctgtttggg

SEQ ID NO: 259520 - DNA, 25 bp, Rattus norvegicus
cggctcaggaccacatagcatttta

SEQ ID NO: 259521 - DNA, 25 bp, Rattus norvegicus
cggctcaggacctcatagcatttta

SEQ ID NO: 259522 - DNA, 25 bp, Rattus norvegicus
cggctcatcacaatttctttcttaa

SEQ ID NO: 259523 - DNA, 25 bp, Rattus norvegicus
cggctcatcacattttctttcttaa

SEQ ID NO: 259524 - DNA, 25 bp, Rattus norvegicus
cggctcatgtcaatgctgtctacaa

SEQ ID NO: 259525 - DNA, 25 bp, Rattus norvegicus
cggctcatgtcattgctgtctacaa

SEQ ID NO: 259526 - DNA, 25 bp, Rattus norvegicus
cggctcattggtatcttttagctga

SEQ ID NO: 259527 - DNA, 25 bp, Rattus norvegicus
cggctcattggtttcttttagctga

SEQ ID NO: 259528 - DNA, 25 bp, Rattus norvegicus
cggctccatgccagcctggagcagg

SEQ ID NO: 259529 - DNA, 25 bp, Rattus norvegicus
cggctccatgcctgcctggagcagg

SEQ ID NO: 259530 - DNA, 25 bp, Rattus norvegicus
cggctcctaacacctatgcaaagaa

SEQ ID NO: 259531 - DNA, 25 bp, Rattus norvegicus
cggctcctaacagctatgcaaagaa

SEQ ID NO: 259532 - DNA, 25 bp, Rattus norvegicus
cggctcctggtgacagctggtgcca

SEQ ID NO: 259533 - DNA, 25 bp, Rattus norvegicus
cggctcctggtgtcagctggtgcca

SEQ ID NO: 259534 - DNA, 25 bp, Rattus norvegicus
cggctccttaagaccagggttctgg

SEQ ID NO: 259535 - DNA, 25 bp, Rattus norvegicus
cggctccttaagtccagggttctgg

SEQ ID NO: 259536 - DNA, 25 bp, Rattus norvegicus
cggctccttatcaggttttcatgga

SEQ ID NO: 259537 - DNA, 25 bp, Rattus norvegicus
cggctccttatcatctgaagaccat

SEQ ID NO: 259538 - DNA, 25 bp, Rattus norvegicus
cggctccttatctggttttcatgga

SEQ ID NO: 259539 - DNA, 25 bp, Rattus norvegicus
cggctccttatcttctgaagaccat

SEQ ID NO: 259540 - DNA, 25 bp, Rattus norvegicus
cggctccttcaacctgctttttgaa

SEQ ID NO: 259541 - DNA, 25 bp, Rattus norvegicus
cggctccttcaagctgctttttgaa

SEQ ID NO: 259542 - DNA, 25 bp, Rattus norvegicus
cggctcggcgcaactttaacttgat

SEQ ID NO: 259543 - DNA, 25 bp, Rattus norvegicus
cggctcggcgcatctttaacttgat

SEQ ID NO: 259544 - DNA, 25 bp, Rattus norvegicus
cggctcgttctgaaatcattcgtag

SEQ ID NO: 259545 - DNA, 25 bp, Rattus norvegicus
cggctcgttctgtaatcattcgtag

SEQ ID NO: 259546 - DNA, 25 bp, Rattus norvegicus
cggctctcacttacaatcgggaaga

SEQ ID NO: 259547 - DNA, 25 bp, Rattus norvegicus
cggctctcactttcaatcgggaaga

SEQ ID NO: 259548 - DNA, 25 bp, Rattus norvegicus
cggctctcatttcgcttgtaattgg

SEQ ID NO: 259549 - DNA, 25 bp, Rattus norvegicus
cggctctcatttggcttgtaattgg

SEQ ID NO: 259550 - DNA, 25 bp, Rattus norvegicus
cggctctcgccgcatggaaagatat

SEQ ID NO: 259551 - DNA, 25 bp, Rattus norvegicus
cggctctcgccggatggaaagatat

SEQ ID NO: 259552 - DNA, 25 bp, Rattus norvegicus
cggctctgaggccaaagttgttatt

SEQ ID NO: 259553 - DNA, 25 bp, Rattus norvegicus
cggctctgaggcgaaagttgttatt

SEQ ID NO: 259554 - DNA, 25 bp, Rattus norvegicus
cggctctggcgcagctttgagctgg

SEQ ID NO: 259555 - DNA, 25 bp, Rattus norvegicus
cggctctggcgctgctttgagctgg

SEQ ID NO: 259556 - DNA, 25 bp, Rattus norvegicus
cggctcttaagtagcatcgctatta

SEQ ID NO: 259557 - DNA, 25 bp, Rattus norvegicus
cggctcttaagttgcatcgctatta

SEQ ID NO: 259558 - DNA, 25 bp, Rattus norvegicus
cggctcttagaccttcatgtgtata

SEQ ID NO: 259559 - DNA, 25 bp, Rattus norvegicus
cggctcttagacgttcatgtgtata

SEQ ID NO: 259560 - DNA, 25 bp, Rattus norvegicus
cggctcttatgcatgcttaatcagt

SEQ ID NO: 259561 - DNA, 25 bp, Rattus norvegicus
cggctcttatgcttgcttaatcagt

SEQ ID NO: 259562 - DNA, 25 bp, Rattus norvegicus
cggctcttcaacaggacccaagttt

SEQ ID NO: 259563 - DNA, 25 bp, Rattus norvegicus
cggctcttcaactggacccaagttt

SEQ ID NO: 259564 - DNA, 25 bp, Rattus norvegicus
cggctcttcgtacgcgatgccgatg

SEQ ID NO: 259565 - DNA, 25 bp, Rattus norvegicus
cggctcttcgtaggcgatgccgatg

SEQ ID NO: 259566 - DNA, 25 bp, Rattus norvegicus
cggctgaccctgacccgcagttggg

SEQ ID NO: 259567 - DNA, 25 bp, Rattus norvegicus
cggctgaccctgtcccgcagttggg

SEQ ID NO: 259568 - DNA, 25 bp, Rattus norvegicus
cggctgacggcaaagccaggctcaa

SEQ ID NO: 259569 - DNA, 25 bp, Rattus norvegicus
cggctgacggcatagccaggctcaa

SEQ ID NO: 259570 - DNA, 25 bp, Rattus norvegicus
cggctgacttctcgatgaacttgta

SEQ ID NO: 259571 - DNA, 25 bp, Rattus norvegicus
cggctgacttctggatgaacttgta

SEQ ID NO: 259572 - DNA, 25 bp, Rattus norvegicus
cggctgacttttactcaacatcatt

SEQ ID NO: 259573 - DNA, 25 bp, Rattus norvegicus
cggctgactttttctcaacatcatt

SEQ ID NO: 259574 - DNA, 25 bp, Rattus norvegicus
cggctgagacttatactggcttccc

SEQ ID NO: 259575 - DNA, 25 bp, Rattus norvegicus
cggctgagacttttactggcttccc

SEQ ID NO: 259576 - DNA, 25 bp, Rattus norvegicus
cggctgagcctcagttcgacctcaa

SEQ ID NO: 259577 - DNA, 25 bp, Rattus norvegicus
cggctgagcctctgttcgacctcaa

SEQ ID NO: 259578 - DNA, 25 bp, Rattus norvegicus
cggctgccgcttctttaatcagctc

SEQ ID NO: 259579 - DNA, 25 bp, Rattus norvegicus
cggctgccgcttgtttaatcagctc

SEQ ID NO: 259580 - DNA, 25 bp, Rattus norvegicus
cggctgcctcagatatgagctgcaa

SEQ ID NO: 259581 - DNA, 25 bp, Rattus norvegicus
cggctgcctcagttatgagctgcaa

SEQ ID NO: 259582 - DNA, 25 bp, Rattus norvegicus
cggctgccttttctgtgacagacga

SEQ ID NO: 259583 - DNA, 25 bp, Rattus norvegicus
cggctgccttttgtgtgacagacga

SEQ ID NO: 259584 - DNA, 25 bp, Rattus norvegicus
cggctgcttttaccgaaggacattt

SEQ ID NO: 259585 - DNA, 25 bp, Rattus norvegicus
cggctgcttttagcgaaggacattt

SEQ ID NO: 259586 - DNA, 25 bp, Rattus norvegicus
cggctggaacttatctgtggacaat

SEQ ID NO: 259587 - DNA, 25 bp, Rattus norvegicus
cggctggaacttttctgtggacaat

SEQ ID NO: 259588 - DNA, 25 bp, Rattus norvegicus
cggctggcacagacttttacatatt

SEQ ID NO: 259589 - DNA, 25 bp, Rattus norvegicus
cggctggcacagtcttttacatatt

SEQ ID NO: 259590 - DNA, 25 bp, Rattus norvegicus
cggctggccagtcggtgcatacaaa

SEQ ID NO: 259591 - DNA, 25 bp, Rattus norvegicus
cggctggccagtgggtgcatacaaa

SEQ ID NO: 259592 - DNA, 25 bp, Rattus norvegicus
cggctgtaagaaacgcgcggtgttg

SEQ ID NO: 259593 - DNA, 25 bp, Rattus norvegicus
cggctgtaagaatcgcgcggtgttg

SEQ ID NO: 259594 - DNA, 25 bp, Rattus norvegicus
cggctgtcaaggagtggatcgtttt

SEQ ID NO: 259595 - DNA, 25 bp, Rattus norvegicus
cggctgtcaaggtgtggatcgtttt

SEQ ID NO: 259596 - DNA, 25 bp, Rattus norvegicus
cggctgtcaccccagagtcagcaat

SEQ ID NO: 259597 - DNA, 25 bp, Rattus norvegicus
cggctgtcacccgagagtcagcaat

SEQ ID NO: 259598 - DNA, 25 bp, Rattus norvegicus
cggctgtgatgtcaagctgcttcct

SEQ ID NO: 259599 - DNA, 25 bp, Rattus norvegicus
cggctgtgatgtgaagctgcttcct

SEQ ID NO: 259600 - DNA, 25 bp, Rattus norvegicus
cggctgtgtgaccttgaacctctca

SEQ ID NO: 259601 - DNA, 25 bp, Rattus norvegicus
cggctgtgtgacgttgaacctctca

SEQ ID NO: 259602 - DNA, 25 bp, Rattus norvegicus
cggcttccctagatcttttatcaag

SEQ ID NO: 259603 - DNA, 25 bp, Rattus norvegicus
cggcttccctagttcttttatcaag

SEQ ID NO: 259604 - DNA, 25 bp, Rattus norvegicus
cggcttcgagggacacatctgtgaa

SEQ ID NO: 259605 - DNA, 25 bp, Rattus norvegicus
cggcttcgagggtcacatctgtgaa

SEQ ID NO: 259606 - DNA, 25 bp, Rattus norvegicus
cggcttcggatcaattcgctcagaa

SEQ ID NO: 259607 - DNA, 25 bp, Rattus norvegicus
cggcttcggatctattcgctcagaa

SEQ ID NO: 259608 - DNA, 25 bp, Rattus norvegicus
cggcttctacagattcttgttcaga

SEQ ID NO: 259609 - DNA, 25 bp, Rattus norvegicus
cggcttctacagtttcttgttcaga

SEQ ID NO: 259610 - DNA, 25 bp, Rattus norvegicus
cggcttctgactaccaggcatggtg

SEQ ID NO: 259611 - DNA, 25 bp, Rattus norvegicus
cggcttctgacttccaggcatggtg

SEQ ID NO: 259612 - DNA, 25 bp, Rattus norvegicus
cggcttctgcgtaggtgccaagccc

SEQ ID NO: 259613 - DNA, 25 bp, Rattus norvegicus
cggcttctgcgttggtgccaagccc

SEQ ID NO: 259614 - DNA, 25 bp, Rattus norvegicus
cggcttctgcttatggacacagtga

SEQ ID NO: 259615 - DNA, 25 bp, Rattus norvegicus
cggcttctgcttttggacacagtga

SEQ ID NO: 259616 - DNA, 25 bp, Rattus norvegicus
cggcttcttcatagctgtgtttgaa

SEQ ID NO: 259617 - DNA, 25 bp, Rattus norvegicus
cggcttcttcattgctgtgtttgaa

SEQ ID NO: 259618 - DNA, 25 bp, Rattus norvegicus
cggcttcttcccaattaattacgtg

SEQ ID NO: 259619 - DNA, 25 bp, Rattus norvegicus
cggcttcttcccaggtcaaaataag

SEQ ID NO: 259620 - DNA, 25 bp, Rattus norvegicus
cggcttcttccctattaattacgtg

SEQ ID NO: 259621 - DNA, 25 bp, Rattus norvegicus
cggcttcttccctggtcaaaataag

SEQ ID NO: 259622 - DNA, 25 bp, Rattus norvegicus
cggcttgaagggatagatgtttgtc

SEQ ID NO: 259623 - DNA, 25 bp, Rattus norvegicus
cggcttgaagggttagatgtttgtc

SEQ ID NO: 259624 - DNA, 25 bp, Rattus norvegicus
cggcttgcttgcatctgagatatag

SEQ ID NO: 259625 - DNA, 25 bp, Rattus norvegicus
cggcttgcttgcttctgagatatag

SEQ ID NO: 259626 - DNA, 25 bp, Rattus norvegicus
cggctttcaaatctgttccaaaact

SEQ ID NO: 259627 - DNA, 25 bp, Rattus norvegicus
cggctttcaaatgtgttccaaaact

SEQ ID NO: 259628 - DNA, 25 bp, Rattus norvegicus
cggctttcattcagctatggctaga

SEQ ID NO: 259629 - DNA, 25 bp, Rattus norvegicus
cggctttcattctgctatggctaga

SEQ ID NO: 259630 - DNA, 25 bp, Rattus norvegicus
cggctttccacgagagtgttgctga

SEQ ID NO: 259631 - DNA, 25 bp, Rattus norvegicus
cggctttccacgtgagtgttgctga

SEQ ID NO: 259632 - DNA, 25 bp, Rattus norvegicus
cggctttgcgttaggatgctctgat

SEQ ID NO: 259633 - DNA, 25 bp, Rattus norvegicus
cggctttgcgtttggatgctctgat

SEQ ID NO: 259634 - DNA, 25 bp, Rattus norvegicus
cggctttgctttatcacgtgattaa

SEQ ID NO: 259635 - DNA, 25 bp, Rattus norvegicus
cggctttgctttttcacgtgattaa

SEQ ID NO: 259636 - DNA, 25 bp, Rattus norvegicus
cgggaaagcctgatggtgagattca

SEQ ID NO: 259637 - DNA, 25 bp, Rattus norvegicus
cgggaaagcctgttggtgagattca

SEQ ID NO: 259638 - DNA, 25 bp, Rattus norvegicus
cgggaaatgggccacattcttcttc

SEQ ID NO: 259639 - DNA, 25 bp, Rattus norvegicus
cgggaaatgggcgacattcttcttc

SEQ ID NO: 259640 - DNA, 25 bp, Rattus norvegicus
cgggaactatgcaacagtcatctcc

SEQ ID NO: 259641 - DNA, 25 bp, Rattus norvegicus
cgggaactatgctacagtcatctcc

SEQ ID NO: 259642 - DNA, 25 bp, Rattus norvegicus
cgggaaggaggcagcccctaaagct

SEQ ID NO: 259643 - DNA, 25 bp, Rattus norvegicus
cgggaaggaggctgcccctaaagct

SEQ ID NO: 259644 - DNA, 25 bp, Rattus norvegicus
cgggaagggcgcacgcggccgtgcg

SEQ ID NO: 259645 - DNA, 25 bp, Rattus norvegicus
cgggaagggcgctcgcggccgtgcg

SEQ ID NO: 259646 - DNA, 25 bp, Rattus norvegicus
cgggaagttcagacggccatttgta

SEQ ID NO: 259647 - DNA, 25 bp, Rattus norvegicus
cgggaagttcagtcggccatttgta

SEQ ID NO: 259648 - DNA, 25 bp, Rattus norvegicus
cgggaagttgttacggtctgctgta

SEQ ID NO: 259649 - DNA, 25 bp, Rattus norvegicus
cgggaagttgtttcggtctgctgta

SEQ ID NO: 259650 - DNA, 25 bp, Rattus norvegicus
cgggaatccacacccgatggttatg

SEQ ID NO: 259651 - DNA, 25 bp, Rattus norvegicus
cgggaatccacagccgatggttatg

SEQ ID NO: 259652 - DNA, 25 bp, Rattus norvegicus
cgggaatggtttagccccagtgaga

SEQ ID NO: 259653 - DNA, 25 bp, Rattus norvegicus
cgggaatggttttgccccagtgaga

SEQ ID NO: 259654 - DNA, 25 bp, Rattus norvegicus
cgggacaacacacccatcatcaata

SEQ ID NO: 259655 - DNA, 25 bp, Rattus norvegicus
cgggacaacacagccatcatcaata

SEQ ID NO: 259656 - DNA, 25 bp, Rattus norvegicus
cgggacactattaccttgggtgcta

SEQ ID NO: 259657 - DNA, 25 bp, Rattus norvegicus
cgggacactatttccttgggtgcta

SEQ ID NO: 259658 - DNA, 25 bp, Rattus norvegicus
cgggacatctcccatggttgagaat

SEQ ID NO: 259659 - DNA, 25 bp, Rattus norvegicus
cgggacatctccgatggttgagaat

SEQ ID NO: 259660 - DNA, 25 bp, Rattus norvegicus
cgggaccacaccatgaaggcattca

SEQ ID NO: 259661 - DNA, 25 bp, Rattus norvegicus
cgggaccacaccttgaaggcattca

SEQ ID NO: 259662 - DNA, 25 bp, Rattus norvegicus
cgggaccctcgaccagtgtgctaat

SEQ ID NO: 259663 - DNA, 25 bp, Rattus norvegicus
cgggaccctcgagcagtgtgctaat

SEQ ID NO: 259664 - DNA, 25 bp, Rattus norvegicus
cgggaccgaccaacgttcctggtag

SEQ ID NO: 259665 - DNA, 25 bp, Rattus norvegicus
cgggaccgaccatcgttcctggtag

SEQ ID NO: 259666 - DNA, 25 bp, Rattus norvegicus
cgggacctctagcacatagcgtcga

SEQ ID NO: 259667 - DNA, 25 bp, Rattus norvegicus
cgggacctctaggacatagcgtcga

SEQ ID NO: 259668 - DNA, 25 bp, Rattus norvegicus
cgggacgcgcacacgggttcgactc

SEQ ID NO: 259669 - DNA, 25 bp, Rattus norvegicus
cgggacgcgcactcgggttcgactc

SEQ ID NO: 259670 - DNA, 25 bp, Rattus norvegicus
cgggacgctgagctgcaagcacata

SEQ ID NO: 259671 - DNA, 25 bp, Rattus norvegicus
cgggacgctgaggtgcaagcacata

SEQ ID NO: 259672 - DNA, 25 bp, Rattus norvegicus
cgggactaaagcactccaccgtgag

SEQ ID NO: 259673 - DNA, 25 bp, Rattus norvegicus
cgggactaaagctctccaccgtgag

SEQ ID NO: 259674 - DNA, 25 bp, Rattus norvegicus
cgggactatctccattatatccgaa

SEQ ID NO: 259675 - DNA, 25 bp, Rattus norvegicus
cgggactatctcgattatatccgaa

SEQ ID NO: 259676 - DNA, 25 bp, Rattus norvegicus
cgggagaatctcagcgtggacgaat

SEQ ID NO: 259677 - DNA, 25 bp, Rattus norvegicus
cgggagaatctctgcgtggacgaat

SEQ ID NO: 259678 - DNA, 25 bp, Rattus norvegicus
cgggagaccagcaaagcggtgtttt

SEQ ID NO: 259679 - DNA, 25 bp, Rattus norvegicus
cgggagaccagctaagcggtgtttt

SEQ ID NO: 259680 - DNA, 25 bp, Rattus norvegicus
cgggagagcagaccttttgactcgt

SEQ ID NO: 259681 - DNA, 25 bp, Rattus norvegicus
cgggagagcagagcttttgactcgt

SEQ ID NO: 259682 - DNA, 25 bp, Rattus norvegicus
cgggagctgcgcaagtatacctatg

SEQ ID NO: 259683 - DNA, 25 bp, Rattus norvegicus
cgggagctgcgctagtatacctatg

SEQ ID NO: 259684 - DNA, 25 bp, Rattus norvegicus
cgggaggagcgtaccttgtcagcac

SEQ ID NO: 259685 - DNA, 25 bp, Rattus norvegicus
cgggaggagcgttccttgtcagcac

SEQ ID NO: 259686 - DNA, 25 bp, Rattus norvegicus
cgggaggctgtgcaaatgtttattt

SEQ ID NO: 259687 - DNA, 25 bp, Rattus norvegicus
cgggaggctgtggaaatgtttattt

SEQ ID NO: 259688 - DNA, 25 bp, Rattus norvegicus
cgggagtctctgaggactctatttt

SEQ ID NO: 259689 - DNA, 25 bp, Rattus norvegicus
cgggagtctctgtggactctatttt

SEQ ID NO: 259690 - DNA, 25 bp, Rattus norvegicus
cgggataaactcacagtcagccatg

SEQ ID NO: 259691 - DNA, 25 bp, Rattus norvegicus
cgggataaactctcagtcagccatg

SEQ ID NO: 259692 - DNA, 25 bp, Rattus norvegicus
cgggataaggtcaccagccagaagt

SEQ ID NO: 259693 - DNA, 25 bp, Rattus norvegicus
cgggataaggtctccagccagaagt

SEQ ID NO: 259694 - DNA, 25 bp, Rattus norvegicus
cgggatcaaagtctgttctggcggc

SEQ ID NO: 259695 - DNA, 25 bp, Rattus norvegicus
cgggatcaaagtgtgttctggcggc

SEQ ID NO: 259696 - DNA, 25 bp, Rattus norvegicus
cgggatccacgtcaattagggttat

SEQ ID NO: 259697 - DNA, 25 bp, Rattus norvegicus
cgggatccacgtgaattagggttat

SEQ ID NO: 259698 - DNA, 25 bp, Rattus norvegicus
cgggatccagaaagtttttcttatt

SEQ ID NO: 259699 - DNA, 25 bp, Rattus norvegicus
cgggatccagaatgtttttcttatt

SEQ ID NO: 259700 - DNA, 25 bp, Rattus norvegicus
cgggatcccaccaagatgtcaagta

SEQ ID NO: 259701 - DNA, 25 bp, Rattus norvegicus
cgggatcccacctagatgtcaagta

SEQ ID NO: 259702 - DNA, 25 bp, Rattus norvegicus
cgggatggtaaacagcggctcctct

SEQ ID NO: 259703 - DNA, 25 bp, Rattus norvegicus
cgggatggtaaagagcggctcctct

SEQ ID NO: 259704 - DNA, 25 bp, Rattus norvegicus
cgggatgtcaacactttagtggata

SEQ ID NO: 259705 - DNA, 25 bp, Rattus norvegicus
cgggatgtcaactctttagtggata

SEQ ID NO: 259706 - DNA, 25 bp, Rattus norvegicus
cgggattaccctacctggatatggt

SEQ ID NO: 259707 - DNA, 25 bp, Rattus norvegicus
cgggattacccttcctggatatggt

SEQ ID NO: 259708 - DNA, 25 bp, Rattus norvegicus
cgggattccggcagaggtgataaac

SEQ ID NO: 259709 - DNA, 25 bp, Rattus norvegicus
cgggattccggctgaggtgataaac

SEQ ID NO: 259710 - DNA, 25 bp, Rattus norvegicus
cgggattctccaattcggcagtaga

SEQ ID NO: 259711 - DNA, 25 bp, Rattus norvegicus
cgggattctccatttcggcagtaga

SEQ ID NO: 259712 - DNA, 25 bp, Rattus norvegicus
cgggatttgaacacggtttctgatc

SEQ ID NO: 259713 - DNA, 25 bp, Rattus norvegicus
cgggatttgaactcggtttctgatc

SEQ ID NO: 259714 - DNA, 25 bp, Rattus norvegicus
cgggcaagctctctgagtcactgca

SEQ ID NO: 259715 - DNA, 25 bp, Rattus norvegicus
cgggcaagctctgtgagtcactgca

SEQ ID NO: 259716 - DNA, 25 bp, Rattus norvegicus
cgggcaaggtctcgtgcagacacat

SEQ ID NO: 259717 - DNA, 25 bp, Rattus norvegicus
cgggcaaggtctggtgcagacacat

SEQ ID NO: 259718 - DNA, 25 bp, Rattus norvegicus
cgggcaatcgccacggcttgggaaa

SEQ ID NO: 259719 - DNA, 25 bp, Rattus norvegicus
cgggcaatcgcctcggcttgggaaa

SEQ ID NO: 259720 - DNA, 25 bp, Rattus norvegicus
cgggcacacacgaacgtcagagaga

SEQ ID NO: 259721 - DNA, 25 bp, Rattus norvegicus
cgggcacacacgtacgtcagagaga

SEQ ID NO: 259722 - DNA, 25 bp, Rattus norvegicus
cgggcacccatacctgggttctcat

SEQ ID NO: 259723 - DNA, 25 bp, Rattus norvegicus
cgggcacccatagctgggttctcat

SEQ ID NO: 259724 - DNA, 25 bp, Rattus norvegicus
cgggcacgtgtcacaatcaaagttt

SEQ ID NO: 259725 - DNA, 25 bp, Rattus norvegicus
cgggcacgtgtctcaatcaaagttt

SEQ ID NO: 259726 - DNA, 25 bp, Rattus norvegicus
cgggcacgttgtaaaactgttgccg

SEQ ID NO: 259727 - DNA, 25 bp, Rattus norvegicus
cgggcacgttgttaaactgttgccg

SEQ ID NO: 259728 - DNA, 25 bp, Rattus norvegicus
cgggcacttaaaacctccaaacaag

SEQ ID NO: 259729 - DNA, 25 bp, Rattus norvegicus
cgggcacttaaatcctccaaacaag

SEQ ID NO: 259730 - DNA, 25 bp, Rattus norvegicus
cgggcagatttcaatgagttcaagg

SEQ ID NO: 259731 - DNA, 25 bp, Rattus norvegicus
cgggcagatttctatgagttcaagg

SEQ ID NO: 259732 - DNA, 25 bp, Rattus norvegicus
cgggcagccctcacagaagcaataa

SEQ ID NO: 259733 - DNA, 25 bp, Rattus norvegicus
cgggcagccctctcagaagcaataa

SEQ ID NO: 259734 - DNA, 25 bp, Rattus norvegicus
cgggcagcctcgacagagagctccg

SEQ ID NO: 259735 - DNA, 25 bp, Rattus norvegicus
cgggcagcctcgtcagagagctccg

SEQ ID NO: 259736 - DNA, 25 bp, Rattus norvegicus
cgggcaggctctcactgatgtagaa

SEQ ID NO: 259737 - DNA, 25 bp, Rattus norvegicus
cgggcaggctctgactgatgtagaa

SEQ ID NO: 259738 - DNA, 25 bp, Rattus norvegicus
cgggcaggtctactttggagtcatt

SEQ ID NO: 259739 - DNA, 25 bp, Rattus norvegicus
cgggcaggtctagtttggagtcatt

SEQ ID NO: 259740 - DNA, 25 bp, Rattus norvegicus
cgggcatcatggctcagcagcactg

SEQ ID NO: 259741 - DNA, 25 bp, Rattus norvegicus
cgggcatcatgggtcagcagcactg

SEQ ID NO: 259742 - DNA, 25 bp, Rattus norvegicus
cgggcatccttcactgaggacgggt

SEQ ID NO: 259743 - DNA, 25 bp, Rattus norvegicus
cgggcatccttctctgaggacgggt

SEQ ID NO: 259744 - DNA, 25 bp, Rattus norvegicus
cgggcattttgtagctcgcttacaa

SEQ ID NO: 259745 - DNA, 25 bp, Rattus norvegicus
cgggcattttgttgctcgcttacaa

SEQ ID NO: 259746 - DNA, 25 bp, Rattus norvegicus
cgggccaaactgactgctcttattt

SEQ ID NO: 259747 - DNA, 25 bp, Rattus norvegicus
cgggccaaactgtctgctcttattt

SEQ ID NO: 259748 - DNA, 25 bp, Rattus norvegicus
cgggccaagcacacacaggagaatt

SEQ ID NO: 259749 - DNA, 25 bp, Rattus norvegicus
cgggccaagcactcacaggagaatt

SEQ ID NO: 259750 - DNA, 25 bp, Rattus norvegicus
cgggccacggtcaacatatttgaga

SEQ ID NO: 259751 - DNA, 25 bp, Rattus norvegicus
cgggccacggtctacatatttgaga

SEQ ID NO: 259752 - DNA, 25 bp, Rattus norvegicus
cgggccaggcttaacaggtacagat

SEQ ID NO: 259753 - DNA, 25 bp, Rattus norvegicus
cgggccaggctttacaggtacagat

SEQ ID NO: 259754 - DNA, 25 bp, Rattus norvegicus
cgggccatggccaaatcaaatcaaa

SEQ ID NO: 259755 - DNA, 25 bp, Rattus norvegicus
cgggccatggcctaatcaaatcaaa

SEQ ID NO: 259756 - DNA, 25 bp, Rattus norvegicus
cgggccatttcaacagtcacagttt

SEQ ID NO: 259757 - DNA, 25 bp, Rattus norvegicus
cgggccatttcatcagtcacagttt

SEQ ID NO: 259758 - DNA, 25 bp, Rattus norvegicus
cgggccattttccaaatctacatca

SEQ ID NO: 259759 - DNA, 25 bp, Rattus norvegicus
cgggccattttcgaaatctacatca

SEQ ID NO: 259760 - DNA, 25 bp, Rattus norvegicus
cgggcccagcataacccgggacgtg

SEQ ID NO: 259761 - DNA, 25 bp, Rattus norvegicus
cgggcccagcattacccgggacgtg

SEQ ID NO: 259762 - DNA, 25 bp, Rattus norvegicus
cgggcccatagtctccaggaagagt

SEQ ID NO: 259763 - DNA, 25 bp, Rattus norvegicus
cgggcccatagtgtccaggaagagt

SEQ ID NO: 259764 - DNA, 25 bp, Rattus norvegicus
cgggccccaagtactgcaaagccgg

SEQ ID NO: 259765 - DNA, 25 bp, Rattus norvegicus
cgggccccaagttctgcaaagccgg

SEQ ID NO: 259766 - DNA, 25 bp, Rattus norvegicus
cgggcccctttgctacaagatggaa

SEQ ID NO: 259767 - DNA, 25 bp, Rattus norvegicus
cgggcccctttggtacaagatggaa

SEQ ID NO: 259768 - DNA, 25 bp, Rattus norvegicus
cgggccctcgctcaataaatctgca

SEQ ID NO: 259769 - DNA, 25 bp, Rattus norvegicus
cgggccctcgctgaataaatctgca

SEQ ID NO: 259770 - DNA, 25 bp, Rattus norvegicus
cgggcccttagtcgccagtgagcaa

SEQ ID NO: 259771 - DNA, 25 bp, Rattus norvegicus
cgggcccttagtggccagtgagcaa

SEQ ID NO: 259772 - DNA, 25 bp, Rattus norvegicus
cgggccgagtgcaggaacttaccga

SEQ ID NO: 259773 - DNA, 25 bp, Rattus norvegicus
cgggccgagtgctggaacttaccga

SEQ ID NO: 259774 - DNA, 25 bp, Rattus norvegicus
cgggccgccccgaaatgaaaagcag

SEQ ID NO: 259775 - DNA, 25 bp, Rattus norvegicus
cgggccgccccgtaatgaaaagcag

SEQ ID NO: 259776 - DNA, 25 bp, Rattus norvegicus
cgggccggacggaggtgaacgcaga

SEQ ID NO: 259777 - DNA, 25 bp, Rattus norvegicus
cgggccggacggtggtgaacgcaga

SEQ ID NO: 259778 - DNA, 25 bp, Rattus norvegicus
cgggccgttctcacgtgggagacgc

SEQ ID NO: 259779 - DNA, 25 bp, Rattus norvegicus
cgggccgttctctcgtgggagacgc

SEQ ID NO: 259780 - DNA, 25 bp, Rattus norvegicus
cgggccttctttccagtacaatttg

SEQ ID NO: 259781 - DNA, 25 bp, Rattus norvegicus
cgggccttctttgcagtacaatttg

SEQ ID NO: 259782 - DNA, 25 bp, Rattus norvegicus
cgggccttttaaaacatgtttgaag

SEQ ID NO: 259783 - DNA, 25 bp, Rattus norvegicus
cgggccttttaatacatgtttgaag

SEQ ID NO: 259784 - DNA, 25 bp, Rattus norvegicus
cgggcgagcccaacgcgccgtagta

SEQ ID NO: 259785 - DNA, 25 bp, Rattus norvegicus
cgggcgagcccatcgcgccgtagta

SEQ ID NO: 259786 - DNA, 25 bp, Rattus norvegicus
cgggcgcctgggaattgattattcc

SEQ ID NO: 259787 - DNA, 25 bp, Rattus norvegicus
cgggcgcctgggtattgattattcc

SEQ ID NO: 259788 - DNA, 25 bp, Rattus norvegicus
cgggcgcggcacagttcacgtgaca

SEQ ID NO: 259789 - DNA, 25 bp, Rattus norvegicus
cgggcgcggcactgttcacgtgaca

SEQ ID NO: 259790 - DNA, 25 bp, Rattus norvegicus
cgggcggaaagcatcctttctctgt

SEQ ID NO: 259791 - DNA, 25 bp, Rattus norvegicus
cgggcggaaagcttcctttctctgt

SEQ ID NO: 259792 - DNA, 25 bp, Rattus norvegicus
cgggcggcagttaacgttctgatct

SEQ ID NO: 259793 - DNA, 25 bp, Rattus norvegicus
cgggcggcagtttacgttctgatct

SEQ ID NO: 259794 - DNA, 25 bp, Rattus norvegicus
cgggcgtgcaacactggctggatta

SEQ ID NO: 259795 - DNA, 25 bp, Rattus norvegicus
cgggcgtgcaactctggctggatta

SEQ ID NO: 259796 - DNA, 25 bp, Rattus norvegicus
cgggcgtgtgacactttattgggaa

SEQ ID NO: 259797 - DNA, 25 bp, Rattus norvegicus
cgggcgtgtgactctttattgggaa

SEQ ID NO: 259798 - DNA, 25 bp, Rattus norvegicus
cgggcgtgtgttactcatggcatac

SEQ ID NO: 259799 - DNA, 25 bp, Rattus norvegicus
cgggcgtgtgtttctcatggcatac

SEQ ID NO: 259800 - DNA, 25 bp, Rattus norvegicus
cgggcgttcattcgtgtttcatgtt

SEQ ID NO: 259801 - DNA, 25 bp, Rattus norvegicus
cgggcgttcattggtgtttcatgtt

SEQ ID NO: 259802 - DNA, 25 bp, Rattus norvegicus
cgggcgttctgcagctagaagttat

SEQ ID NO: 259803 - DNA, 25 bp, Rattus norvegicus
cgggcgttctgctgctagaagttat

SEQ ID NO: 259804 - DNA, 25 bp, Rattus norvegicus
cgggcgttcttgagttattctagtt

SEQ ID NO: 259805 - DNA, 25 bp, Rattus norvegicus
cgggcgttcttgtgttattctagtt

SEQ ID NO: 259806 - DNA, 25 bp, Rattus norvegicus
cgggctaaacccatgccatattaga

SEQ ID NO: 259807 - DNA, 25 bp, Rattus norvegicus
cgggctaaacccttgccatattaga

SEQ ID NO: 259808 - DNA, 25 bp, Rattus norvegicus
cgggctatatcgaaaatggctctaa

SEQ ID NO: 259809 - DNA, 25 bp, Rattus norvegicus
cgggctatatcgtaaatggctctaa

SEQ ID NO: 259810 - DNA, 25 bp, Rattus norvegicus
cgggctccgcgcagctaggtttaga

SEQ ID NO: 259811 - DNA, 25 bp, Rattus norvegicus
cgggctccgcgctgctaggtttaga

SEQ ID NO: 259812 - DNA, 25 bp, Rattus norvegicus
cgggctcctctgattgccaagatgt

SEQ ID NO: 259813 - DNA, 25 bp, Rattus norvegicus
cgggctcctctgtttgccaagatgt

SEQ ID NO: 259814 - DNA, 25 bp, Rattus norvegicus
cgggctcggtgtcctgttaaccaca

SEQ ID NO: 259815 - DNA, 25 bp, Rattus norvegicus
cgggctcggtgtgctgttaaccaca

SEQ ID NO: 259816 - DNA, 25 bp, Rattus norvegicus
cgggctcttttcagtagtggtgcta

SEQ ID NO: 259817 - DNA, 25 bp, Rattus norvegicus
cgggctcttttctgtagtggtgcta

SEQ ID NO: 259818 - DNA, 25 bp, Rattus norvegicus
cgggctgcagttcccagtgggtcgc

SEQ ID NO: 259819 - DNA, 25 bp, Rattus norvegicus
cgggctgcagttgccagtgggtcgc

SEQ ID NO: 259820 - DNA, 25 bp, Rattus norvegicus
cgggctgctaccagctaaagggcat

SEQ ID NO: 259821 - DNA, 25 bp, Rattus norvegicus
cgggctgctacctgctaaagggcat

SEQ ID NO: 259822 - DNA, 25 bp, Rattus norvegicus
cgggctgtcaacagtactcaggtac

SEQ ID NO: 259823 - DNA, 25 bp, Rattus norvegicus
cgggctgtcaactgtactcaggtac

SEQ ID NO: 259824 - DNA, 25 bp, Rattus norvegicus
cgggcttaagagctaacctgaccta

SEQ ID NO: 259825 - DNA, 25 bp, Rattus norvegicus
cgggcttaagaggtaacctgaccta

SEQ ID NO: 259826 - DNA, 25 bp, Rattus norvegicus
cgggcttacacgctttgactggttg

SEQ ID NO: 259827 - DNA, 25 bp, Rattus norvegicus
cgggcttacacggtttgactggttg

SEQ ID NO: 259828 - DNA, 25 bp, Rattus norvegicus
cgggcttattctaggttcatcacac

SEQ ID NO: 259829 - DNA, 25 bp, Rattus norvegicus
cgggcttattcttggttcatcacac

SEQ ID NO: 259830 - DNA, 25 bp, Rattus norvegicus
cgggcttcaaatatgctgacagcta

SEQ ID NO: 259831 - DNA, 25 bp, Rattus norvegicus
cgggcttcaaatttgctgacagcta

SEQ ID NO: 259832 - DNA, 25 bp, Rattus norvegicus
cgggcttgacacactgcggaagagc

SEQ ID NO: 259833 - DNA, 25 bp, Rattus norvegicus
cgggcttgacactctgcggaagagc

SEQ ID NO: 259834 - DNA, 25 bp, Rattus norvegicus
cggggaactggcattgtcctgttgc

SEQ ID NO: 259835 - DNA, 25 bp, Rattus norvegicus
cggggaactggctttgtcctgttgc

SEQ ID NO: 259836 - DNA, 25 bp, Rattus norvegicus
cggggcgctgcaaagagtgctgtct

SEQ ID NO: 259837 - DNA, 25 bp, Rattus norvegicus
cggggcgctgcatagagtgctgtct

SEQ ID NO: 259838 - DNA, 25 bp, Rattus norvegicus
cgggtaaagctgagcgcacggctgg

SEQ ID NO: 259839 - DNA, 25 bp, Rattus norvegicus
cgggtaaagctgtgcgcacggctgg

SEQ ID NO: 259840 - DNA, 25 bp, Rattus norvegicus
cgggtaaaggcgagctgctcattgc

SEQ ID NO: 259841 - DNA, 25 bp, Rattus norvegicus
cgggtaaaggcgtgctgctcattgc

SEQ ID NO: 259842 - DNA, 25 bp, Rattus norvegicus
cgggtacaacatcgagcaggctctt

SEQ ID NO: 259843 - DNA, 25 bp, Rattus norvegicus
cgggtacaacatggagcaggctctt

SEQ ID NO: 259844 - DNA, 25 bp, Rattus norvegicus
cgggtactcgaaacggctgcgttgt

SEQ ID NO: 259845 - DNA, 25 bp, Rattus norvegicus
cgggtactcgaatcggctgcgttgt

SEQ ID NO: 259846 - DNA, 25 bp, Rattus norvegicus
cgggtagccaacagactctgtcaag

SEQ ID NO: 259847 - DNA, 25 bp, Rattus norvegicus
cgggtagccaactgactctgtcaag

SEQ ID NO: 259848 - DNA, 25 bp, Rattus norvegicus
cgggtaggatcaatcttttcagtat

SEQ ID NO: 259849 - DNA, 25 bp, Rattus norvegicus
cgggtaggatcattcttttcagtat

SEQ ID NO: 259850 - DNA, 25 bp, Rattus norvegicus
cgggtatagtagatccgtatggcta

SEQ ID NO: 259851 - DNA, 25 bp, Rattus norvegicus
cgggtatagtagttccgtatggcta

SEQ ID NO: 259852 - DNA, 25 bp, Rattus norvegicus
cgggtatcatcaaacagtctccttt

SEQ ID NO: 259853 - DNA, 25 bp, Rattus norvegicus
cgggtatcatcatacagtctccttt

SEQ ID NO: 259854 - DNA, 25 bp, Rattus norvegicus
cgggtatcccacatgttccttgtga

SEQ ID NO: 259855 - DNA, 25 bp, Rattus norvegicus
cgggtatcccacttgttccttgtga

SEQ ID NO: 259856 - DNA, 25 bp, Rattus norvegicus
cgggtatccttgattgctcctgaga

SEQ ID NO: 259857 - DNA, 25 bp, Rattus norvegicus
cgggtatccttgtttgctcctgaga

SEQ ID NO: 259858 - DNA, 25 bp, Rattus norvegicus
cgggtcactggaagagtggtctcca

SEQ ID NO: 259859 - DNA, 25 bp, Rattus norvegicus
cgggtcactggatgagtggtctcca

SEQ ID NO: 259860 - DNA, 25 bp, Rattus norvegicus
cgggtcattttaatgcctacttgat

SEQ ID NO: 259861 - DNA, 25 bp, Rattus norvegicus
cgggtcattttattgcctacttgat

SEQ ID NO: 259862 - DNA, 25 bp, Rattus norvegicus
cgggtccagcagaatcctggctgaa

SEQ ID NO: 259863 - DNA, 25 bp, Rattus norvegicus
cgggtccagcagtatcctggctgaa

SEQ ID NO: 259864 - DNA, 25 bp, Rattus norvegicus
cgggtccagtgtatgtaccacatca

SEQ ID NO: 259865 - DNA, 25 bp, Rattus norvegicus
cgggtccagtgtttgtaccacatca

SEQ ID NO: 259866 - DNA, 25 bp, Rattus norvegicus
cgggtccatctaacgtcagaatgta

SEQ ID NO: 259867 - DNA, 25 bp, Rattus norvegicus
cgggtccatctatcgtcagaatgta

SEQ ID NO: 259868 - DNA, 25 bp, Rattus norvegicus
cgggtcccaggacttatctgatgaa

SEQ ID NO: 259869 - DNA, 25 bp, Rattus norvegicus
cgggtcccaggagttatctgatgaa

SEQ ID NO: 259870 - DNA, 25 bp, Rattus norvegicus
cgggtcctcattcacggcgtggaat

SEQ ID NO: 259871 - DNA, 25 bp, Rattus norvegicus
cgggtcctcattgacggcgtggaat

SEQ ID NO: 259872 - DNA, 25 bp, Rattus norvegicus
cgggtctgacttcattatgctgcga

SEQ ID NO: 259873 - DNA, 25 bp, Rattus norvegicus
cgggtctgacttgattatgctgcga

SEQ ID NO: 259874 - DNA, 25 bp, Rattus norvegicus
cgggtctgcctcaagggccctgatg

SEQ ID NO: 259875 - DNA, 25 bp, Rattus norvegicus
cgggtctgcctctagggccctgatg

SEQ ID NO: 259876 - DNA, 25 bp, Rattus norvegicus
cgggtctgcgcgatagccctcacag

SEQ ID NO: 259877 - DNA, 25 bp, Rattus norvegicus
cgggtctgcgcgttagccctcacag

SEQ ID NO: 259878 - DNA, 25 bp, Rattus norvegicus
cgggtgacctccagtgatgaacatg

SEQ ID NO: 259879 - DNA, 25 bp, Rattus norvegicus
cgggtgacctcctgtgatgaacatg

SEQ ID NO: 259880 - DNA, 25 bp, Rattus norvegicus
cgggtgacgtacaacctggactgga

SEQ ID NO: 259881 - DNA, 25 bp, Rattus norvegicus
cgggtgacgtactacctggactgga

SEQ ID NO: 259882 - DNA, 25 bp, Rattus norvegicus
cgggtgaggagcactatgctatcaa

SEQ ID NO: 259883 - DNA, 25 bp, Rattus norvegicus
cgggtgaggagctctatgctatcaa

SEQ ID NO: 259884 - DNA, 25 bp, Rattus norvegicus
cgggtgatacccaggaactgtccta

SEQ ID NO: 259885 - DNA, 25 bp, Rattus norvegicus
cgggtgataccctggaactgtccta

SEQ ID NO: 259886 - DNA, 25 bp, Rattus norvegicus
cgggtgcagcacacttgtgtatgat

SEQ ID NO: 259887 - DNA, 25 bp, Rattus norvegicus
cgggtgcagcactcttgtgtatgat

SEQ ID NO: 259888 - DNA, 25 bp, Rattus norvegicus
cgggtgcctatgctgctaagtgctt

SEQ ID NO: 259889 - DNA, 25 bp, Rattus norvegicus
cgggtgcctatggtgctaagtgctt

SEQ ID NO: 259890 - DNA, 25 bp, Rattus norvegicus
cgggtggaggatcgctctttcccaa

SEQ ID NO: 259891 - DNA, 25 bp, Rattus norvegicus
cgggtggaggatggctctttcccaa

SEQ ID NO: 259892 - DNA, 25 bp, Rattus norvegicus
cgggtgtcagccaggttatttttat

SEQ ID NO: 259893 - DNA, 25 bp, Rattus norvegicus
cgggtgtcagcctggttatttttat

SEQ ID NO: 259894 - DNA, 25 bp, Rattus norvegicus
cgggtgtgatgcagcctgccgtcat

SEQ ID NO: 259895 - DNA, 25 bp, Rattus norvegicus
cgggtgtgatgctgcctgccgtcat

SEQ ID NO: 259896 - DNA, 25 bp, Rattus norvegicus
cgggtgtgcctgagctacttggtta

SEQ ID NO: 259897 - DNA, 25 bp, Rattus norvegicus
cgggtgtgcctgtgctacttggtta

SEQ ID NO: 259898 - DNA, 25 bp, Rattus norvegicus
cgggtgtttgttatcgttcagacag

SEQ ID NO: 259899 - DNA, 25 bp, Rattus norvegicus
cgggtgtttgttttcgttcagacag

SEQ ID NO: 259900 - DNA, 25 bp, Rattus norvegicus
cgggttacgtgtacccagtggcaca

SEQ ID NO: 259901 - DNA, 25 bp, Rattus norvegicus
cgggttacgtgttcccagtggcaca

SEQ ID NO: 259902 - DNA, 25 bp, Rattus norvegicus
cgggttctgccaaccgttgatgtga

SEQ ID NO: 259903 - DNA, 25 bp, Rattus norvegicus
cgggttctgccatccgttgatgtga

SEQ ID NO: 259904 - DNA, 25 bp, Rattus norvegicus
cgggttctgggcacaaaatgtctct

SEQ ID NO: 259905 - DNA, 25 bp, Rattus norvegicus
cgggttctgggctcaaaatgtctct

SEQ ID NO: 259906 - DNA, 25 bp, Rattus norvegicus
cgggttgaaccacatgctaacttct

SEQ ID NO: 259907 - DNA, 25 bp, Rattus norvegicus
cgggttgaaccagatgctaacttct

SEQ ID NO: 259908 - DNA, 25 bp, Rattus norvegicus
cgggttgaggagatggtatttgtgt

SEQ ID NO: 259909 - DNA, 25 bp, Rattus norvegicus
cgggttgaggagttggtatttgtgt

SEQ ID NO: 259910 - DNA, 25 bp, Rattus norvegicus
cgggttgctgcgatgactgacagat

SEQ ID NO: 259911 - DNA, 25 bp, Rattus norvegicus
cgggttgctgcgttgactgacagat

SEQ ID NO: 259912 - DNA, 25 bp, Rattus norvegicus
cgggttggcattcatcttttcttaa

SEQ ID NO: 259913 - DNA, 25 bp, Rattus norvegicus
cgggttggcattgatcttttcttaa

SEQ ID NO: 259914 - DNA, 25 bp, Rattus norvegicus
cgggtttcgatcaccattgggccag

SEQ ID NO: 259915 - DNA, 25 bp, Rattus norvegicus
cgggtttcgatctccattgggccag

SEQ ID NO: 259916 - DNA, 25 bp, Rattus norvegicus
cggtaacagatacgctgcccctctg

SEQ ID NO: 259917 - DNA, 25 bp, Rattus norvegicus
cggtaacagataggctgcccctctg

SEQ ID NO: 259918 - DNA, 25 bp, Rattus norvegicus
cggtaatacttcactttgggctctg

SEQ ID NO: 259919 - DNA, 25 bp, Rattus norvegicus
cggtaatacttctctttgggctctg

SEQ ID NO: 259920 - DNA, 25 bp, Rattus norvegicus
cggtaatttacaacgttcagcagtg

SEQ ID NO: 259921 - DNA, 25 bp, Rattus norvegicus
cggtaatttacatcgttcagcagtg

SEQ ID NO: 259922 - DNA, 25 bp, Rattus norvegicus
cggtacctagtaccgctagcggtat

SEQ ID NO: 259923 - DNA, 25 bp, Rattus norvegicus
cggtacctagtagcgctagcggtat

SEQ ID NO: 259924 - DNA, 25 bp, Rattus norvegicus
cggtactcagccatttgggaacagc

SEQ ID NO: 259925 - DNA, 25 bp, Rattus norvegicus
cggtactcagccttttgggaacagc

SEQ ID NO: 259926 - DNA, 25 bp, Rattus norvegicus
cggtagcttgcgacagtttattact

SEQ ID NO: 259927 - DNA, 25 bp, Rattus norvegicus
cggtagcttgcgtcagtttattact

SEQ ID NO: 259928 - DNA, 25 bp, Rattus norvegicus
cggtaggataataatggttctccct

SEQ ID NO: 259929 - DNA, 25 bp, Rattus norvegicus
cggtaggataattatggttctccct

SEQ ID NO: 259930 - DNA, 25 bp, Rattus norvegicus
cggtagtggccactcattttgtgct

SEQ ID NO: 259931 - DNA, 25 bp, Rattus norvegicus
cggtagtggccagtcattttgtgct

SEQ ID NO: 259932 - DNA, 25 bp, Rattus norvegicus
cggtataggcctccactgtgattca

SEQ ID NO: 259933 - DNA, 25 bp, Rattus norvegicus
cggtataggcctgcactgtgattca

SEQ ID NO: 259934 - DNA, 25 bp, Rattus norvegicus
cggtatcgctgaccgcatgcagaag

SEQ ID NO: 259935 - DNA, 25 bp, Rattus norvegicus
cggtatcgctgagcgcatgcagaag

SEQ ID NO: 259936 - DNA, 25 bp, Rattus norvegicus
cggtatggctcacgcttcgctttgg

SEQ ID NO: 259937 - DNA, 25 bp, Rattus norvegicus
cggtatggctcaggcttcgctttgg

SEQ ID NO: 259938 - DNA, 25 bp, Rattus norvegicus
cggtcacctcaacccactgttaagt

SEQ ID NO: 259939 - DNA, 25 bp, Rattus norvegicus
cggtcacctcaagccactgttaagt

SEQ ID NO: 259940 - DNA, 25 bp, Rattus norvegicus
cggtcagactggaggtcgaagcaat

SEQ ID NO: 259941 - DNA, 25 bp, Rattus norvegicus
cggtcagactggtggtcgaagcaat

SEQ ID NO: 259942 - DNA, 25 bp, Rattus norvegicus
cggtcagcacttccgggctttagaa

SEQ ID NO: 259943 - DNA, 25 bp, Rattus norvegicus
cggtcagcacttgcgggctttagaa

SEQ ID NO: 259944 - DNA, 25 bp, Rattus norvegicus
cggtcagcagtcactgtgcatttga

SEQ ID NO: 259945 - DNA, 25 bp, Rattus norvegicus
cggtcagcagtctctgtgcatttga

SEQ ID NO: 259946 - DNA, 25 bp, Rattus norvegicus
cggtcagcattcacactcaggtaag

SEQ ID NO: 259947 - DNA, 25 bp, Rattus norvegicus
cggtcagcattctcactcaggtaag

SEQ ID NO: 259948 - DNA, 25 bp, Rattus norvegicus
cggtcagcggcgagcccgagcaggt

SEQ ID NO: 259949 - DNA, 25 bp, Rattus norvegicus
cggtcagcggcgtgcccgagcaggt

SEQ ID NO: 259950 - DNA, 25 bp, Rattus norvegicus
cggtcagggctgatactttttatgg

SEQ ID NO: 259951 - DNA, 25 bp, Rattus norvegicus
cggtcagggctgttactttttatgg

SEQ ID NO: 259952 - DNA, 25 bp, Rattus norvegicus
cggtcagtcatgctccttgcaggag

SEQ ID NO: 259953 - DNA, 25 bp, Rattus norvegicus
cggtcagtcatggtccttgcaggag

SEQ ID NO: 259954 - DNA, 25 bp, Rattus norvegicus
cggtcatcttcaccttcttttaaga

SEQ ID NO: 259955 - DNA, 25 bp, Rattus norvegicus
cggtcatcttcagcttcttttaaga

SEQ ID NO: 259956 - DNA, 25 bp, Rattus norvegicus
cggtccacccacagagcaggcgata

SEQ ID NO: 259957 - DNA, 25 bp, Rattus norvegicus
cggtccacccactgagcaggcgata

SEQ ID NO: 259958 - DNA, 25 bp, Rattus norvegicus
cggtccagcttcagtttacgtcaga

SEQ ID NO: 259959 - DNA, 25 bp, Rattus norvegicus
cggtccagcttctgtttacgtcaga

SEQ ID NO: 259960 - DNA, 25 bp, Rattus norvegicus
cggtccaggtccagatcagttgaca

SEQ ID NO: 259961 - DNA, 25 bp, Rattus norvegicus
cggtccaggtcctgatcagttgaca

SEQ ID NO: 259962 - DNA, 25 bp, Rattus norvegicus
cggtccatagacacaagcacagagt

SEQ ID NO: 259963 - DNA, 25 bp, Rattus norvegicus
cggtccatagactcaagcacagagt

SEQ ID NO: 259964 - DNA, 25 bp, Rattus norvegicus
cggtccatcttcagttgacacaaag

SEQ ID NO: 259965 - DNA, 25 bp, Rattus norvegicus
cggtccatcttctgttgacacaaag

SEQ ID NO: 259966 - DNA, 25 bp, Rattus norvegicus
cggtccatttccactaagtatctat

SEQ ID NO: 259967 - DNA, 25 bp, Rattus norvegicus
cggtccatttcctctaagtatctat

SEQ ID NO: 259968 - DNA, 25 bp, Rattus norvegicus
cggtcccgggatacttgagctgtgc

SEQ ID NO: 259969 - DNA, 25 bp, Rattus norvegicus
cggtcccgggattcttgagctgtgc

SEQ ID NO: 259970 - DNA, 25 bp, Rattus norvegicus
cggtcccggtgcacgatcctgggtc

SEQ ID NO: 259971 - DNA, 25 bp, Rattus norvegicus
cggtcccggtgctcgatcctgggtc

SEQ ID NO: 259972 - DNA, 25 bp, Rattus norvegicus
cggtccctggaacttacatgtataa

SEQ ID NO: 259973 - DNA, 25 bp, Rattus norvegicus
cggtccctggaagttacatgtataa

SEQ ID NO: 259974 - DNA, 25 bp, Rattus norvegicus
cggtcctcagtaccccttagtgtgt

SEQ ID NO: 259975 - DNA, 25 bp, Rattus norvegicus
cggtcctcagtagcccttagtgtgt

SEQ ID NO: 259976 - DNA, 25 bp, Rattus norvegicus
cggtcctgatgaagggttctgaact

SEQ ID NO: 259977 - DNA, 25 bp, Rattus norvegicus
cggtcctgatgatgggttctgaact

SEQ ID NO: 259978 - DNA, 25 bp, Rattus norvegicus
cggtcctgtggaaattggcaatgca

SEQ ID NO: 259979 - DNA, 25 bp, Rattus norvegicus
cggtcctgtggatattggcaatgca

SEQ ID NO: 259980 - DNA, 25 bp, Rattus norvegicus
cggtccttcagtactggtttagtca

SEQ ID NO: 259981 - DNA, 25 bp, Rattus norvegicus
cggtccttcagttctggtttagtca

SEQ ID NO: 259982 - DNA, 25 bp, Rattus norvegicus
cggtccttgcacacaactttgagaa

SEQ ID NO: 259983 - DNA, 25 bp, Rattus norvegicus
cggtccttgcactcaactttgagaa

SEQ ID NO: 259984 - DNA, 25 bp, Rattus norvegicus
cggtcgcacgccagcggactctgga

SEQ ID NO: 259985 - DNA, 25 bp, Rattus norvegicus
cggtcgcacgcctgcggactctgga

SEQ ID NO: 259986 - DNA, 25 bp, Rattus norvegicus
cggtcggtccatactttattgaaat

SEQ ID NO: 259987 - DNA, 25 bp, Rattus norvegicus
cggtcggtccattctttattgaaat

SEQ ID NO: 259988 - DNA, 25 bp, Rattus norvegicus
cggtcggtctcacctagtcatggga

SEQ ID NO: 259989 - DNA, 25 bp, Rattus norvegicus
cggtcggtctcagctagtcatggga

SEQ ID NO: 259990 - DNA, 25 bp, Rattus norvegicus
cggtctaatgggagccatggcagca

SEQ ID NO: 259991 - DNA, 25 bp, Rattus norvegicus
cggtctaatgggtgccatggcagca

SEQ ID NO: 259992 - DNA, 25 bp, Rattus norvegicus
cggtctacatttccaaaggtctctg

SEQ ID NO: 259993 - DNA, 25 bp, Rattus norvegicus
cggtctacatttgcaaaggtctctg

SEQ ID NO: 259994 - DNA, 25 bp, Rattus norvegicus
cggtctagacccaagccaagtaact

SEQ ID NO: 259995 - DNA, 25 bp, Rattus norvegicus
cggtctagaccctagccaagtaact

SEQ ID NO: 259996 - DNA, 25 bp, Rattus norvegicus
cggtctagccttagtgaagttcctg

SEQ ID NO: 259997 - DNA, 25 bp, Rattus norvegicus
cggtctagcctttgtgaagttcctg

SEQ ID NO: 259998 - DNA, 25 bp, Rattus norvegicus
cggtctcatcttcccttaagtgtta

SEQ ID NO: 259999 - DNA, 25 bp, Rattus norvegicus
cggtctcatcttgccttaagtgtta

SEQ ID NO: 260000 - DNA, 25 bp, Rattus norvegicus
cggtctccattcactgtcacacagg

SEQ ID NO: 260001 - DNA, 25 bp, Rattus norvegicus
cggtctccattctctgtcacacagg

SEQ ID NO: 260002 - DNA, 25 bp, Rattus norvegicus
cggtctccctcacagctggaatgta

SEQ ID NO: 260003 - DNA, 25 bp, Rattus norvegicus
cggtctccctcagagctggaatgta

SEQ ID NO: 260004 - DNA, 25 bp, Rattus norvegicus
cggtctcgtatcagttctctgtgaa

SEQ ID NO: 260005 - DNA, 25 bp, Rattus norvegicus
cggtctcgtatctgttctctgtgaa

SEQ ID NO: 260006 - DNA, 25 bp, Rattus norvegicus
cggtctctgaggagaagcgagttat

SEQ ID NO: 260007 - DNA, 25 bp, Rattus norvegicus
cggtctctgaggtgaagcgagttat

SEQ ID NO: 260008 - DNA, 25 bp, Rattus norvegicus
cggtctgacggtccttggctttaaa

SEQ ID NO: 260009 - DNA, 25 bp, Rattus norvegicus
cggtctgacggtgcttggctttaaa

SEQ ID NO: 260010 - DNA, 25 bp, Rattus norvegicus
cggtctggtctgagttcatggatta

SEQ ID NO: 260011 - DNA, 25 bp, Rattus norvegicus
cggtctggtctgtgttcatggatta

SEQ ID NO: 260012 - DNA, 25 bp, Rattus norvegicus
cggtctgtattcatccagttggttt

SEQ ID NO: 260013 - DNA, 25 bp, Rattus norvegicus
cggtctgtattcttccagttggttt

SEQ ID NO: 260014 - DNA, 25 bp, Rattus norvegicus
cggtctgtctctcccagtatacgaa

SEQ ID NO: 260015 - DNA, 25 bp, Rattus norvegicus
cggtctgtctctgccagtatacgaa

SEQ ID NO: 260016 - DNA, 25 bp, Rattus norvegicus
cggtcttcgggcctgacaaatggaa

SEQ ID NO: 260017 - DNA, 25 bp, Rattus norvegicus
cggtcttcgggcgtgacaaatggaa

SEQ ID NO: 260018 - DNA, 25 bp, Rattus norvegicus
cggtgaaagccgagatggaacagtc

SEQ ID NO: 260019 - DNA, 25 bp, Rattus norvegicus
cggtgaaagccgtgatggaacagtc

SEQ ID NO: 260020 - DNA, 25 bp, Rattus norvegicus
cggtgaaaggcaagctgctgctgct

SEQ ID NO: 260021 - DNA, 25 bp, Rattus norvegicus
cggtgaaaggcatgctgctgctgct

SEQ ID NO: 260022 - DNA, 25 bp, Rattus norvegicus
cggtgaaccccacacgaagtgcgta

SEQ ID NO: 260023 - DNA, 25 bp, Rattus norvegicus
cggtgaaccccagacgaagtgcgta

SEQ ID NO: 260024 - DNA, 25 bp, Rattus norvegicus
cggtgaagcctgatcctttgatgga

SEQ ID NO: 260025 - DNA, 25 bp, Rattus norvegicus
cggtgaagcctgttcctttgatgga

SEQ ID NO: 260026 - DNA, 25 bp, Rattus norvegicus
cggtgaaggtgtactgagcccagtt

SEQ ID NO: 260027 - DNA, 25 bp, Rattus norvegicus
cggtgaaggtgttctgagcccagtt

SEQ ID NO: 260028 - DNA, 25 bp, Rattus norvegicus
cggtgaatacttacatggtcttaat

SEQ ID NO: 260029 - DNA, 25 bp, Rattus norvegicus
cggtgaatactttcatggtcttaat

SEQ ID NO: 260030 - DNA, 25 bp, Rattus norvegicus
cggtgaatgaacaccagaatttatc

SEQ ID NO: 260031 - DNA, 25 bp, Rattus norvegicus
cggtgaatgaactccagaatttatc

SEQ ID NO: 260032 - DNA, 25 bp, Rattus norvegicus
cggtgacaaactagaagaccttgaa

SEQ ID NO: 260033 - DNA, 25 bp, Rattus norvegicus
cggtgacaaacttgaagaccttgaa

SEQ ID NO: 260034 - DNA, 25 bp, Rattus norvegicus
cggtgacatggacgctcagttccca

SEQ ID NO: 260035 - DNA, 25 bp, Rattus norvegicus
cggtgacatggaggctcagttccca

SEQ ID NO: 260036 - DNA, 25 bp, Rattus norvegicus
cggtgacgcgtgaattgctttttgt

SEQ ID NO: 260037 - DNA, 25 bp, Rattus norvegicus
cggtgacgcgtgtattgctttttgt

SEQ ID NO: 260038 - DNA, 25 bp, Rattus norvegicus
cggtgactgcttactgttccaaatt

SEQ ID NO: 260039 - DNA, 25 bp, Rattus norvegicus
cggtgactgctttctgttccaaatt

SEQ ID NO: 260040 - DNA, 25 bp, Rattus norvegicus
cggtgagatcccagaacactgtttc

SEQ ID NO: 260041 - DNA, 25 bp, Rattus norvegicus
cggtgagatccctgaacactgtttc

SEQ ID NO: 260042 - DNA, 25 bp, Rattus norvegicus
cggtgagcgccaaagacccagacaa

SEQ ID NO: 260043 - DNA, 25 bp, Rattus norvegicus
cggtgagcgccatagacccagacaa

SEQ ID NO: 260044 - DNA, 25 bp, Rattus norvegicus
cggtgagcgcctcgtcagtgatcca

SEQ ID NO: 260045 - DNA, 25 bp, Rattus norvegicus
cggtgagcgcctggtcagtgatcca

SEQ ID NO: 260046 - DNA, 25 bp, Rattus norvegicus
cggtgaggagggatcagcttgtatg

SEQ ID NO: 260047 - DNA, 25 bp, Rattus norvegicus
cggtgaggagggttcagcttgtatg

SEQ ID NO: 260048 - DNA, 25 bp, Rattus norvegicus
cggtgatacttcagcagagctgcca

SEQ ID NO: 260049 - DNA, 25 bp, Rattus norvegicus
cggtgatacttctgcagagctgcca

SEQ ID NO: 260050 - DNA, 25 bp, Rattus norvegicus
cggtgatatccacctgacacacgtg

SEQ ID NO: 260051 - DNA, 25 bp, Rattus norvegicus
cggtgatatccagctgacacacgtg

SEQ ID NO: 260052 - DNA, 25 bp, Rattus norvegicus
cggtgatgggcgactttgttgattc

SEQ ID NO: 260053 - DNA, 25 bp, Rattus norvegicus
cggtgatgggcgtctttgttgattc

SEQ ID NO: 260054 - DNA, 25 bp, Rattus norvegicus
cggtgcaccatgcattgcaacgaca

SEQ ID NO: 260055 - DNA, 25 bp, Rattus norvegicus
cggtgcaccatggattgcaacgaca

SEQ ID NO: 260056 - DNA, 25 bp, Rattus norvegicus
cggtgcatagcacttgggttctacg

SEQ ID NO: 260057 - DNA, 25 bp, Rattus norvegicus
cggtgcatagcagttgggttctacg

SEQ ID NO: 260058 - DNA, 25 bp, Rattus norvegicus
cggtgcatgcgcagggatacacata

SEQ ID NO: 260059 - DNA, 25 bp, Rattus norvegicus
cggtgcatgcgctgggatacacata

SEQ ID NO: 260060 - DNA, 25 bp, Rattus norvegicus
cggtgccacgcaacttcatgaaggg

SEQ ID NO: 260061 - DNA, 25 bp, Rattus norvegicus
cggtgccacgcatcttcatgaaggg

SEQ ID NO: 260062 - DNA, 25 bp, Rattus norvegicus
cggtgcctaaaacgtatgaaagctg

SEQ ID NO: 260063 - DNA, 25 bp, Rattus norvegicus
cggtgcctaaaaggtatgaaagctg

SEQ ID NO: 260064 - DNA, 25 bp, Rattus norvegicus
cggtgcctcctactagtgtgaatgt

SEQ ID NO: 260065 - DNA, 25 bp, Rattus norvegicus
cggtgcctcctagtagtgtgaatgt

SEQ ID NO: 260066 - DNA, 25 bp, Rattus norvegicus
cggtgcctcttgatattgttgggat

SEQ ID NO: 260067 - DNA, 25 bp, Rattus norvegicus
cggtgcctcttgttattgttgggat

SEQ ID NO: 260068 - DNA, 25 bp, Rattus norvegicus
cggtgcctggccatgtgggaaccaa

SEQ ID NO: 260069 - DNA, 25 bp, Rattus norvegicus
cggtgcctggccttgtgggaaccaa

SEQ ID NO: 260070 - DNA, 25 bp, Rattus norvegicus
cggtgcctgtgacgccatcttgaag

SEQ ID NO: 260071 - DNA, 25 bp, Rattus norvegicus
cggtgcctgtgaggccatcttgaag

SEQ ID NO: 260072 - DNA, 25 bp, Rattus norvegicus
cggtgcgcatcaaggccgagagcaa

SEQ ID NO: 260073 - DNA, 25 bp, Rattus norvegicus
cggtgcgcatcatggccgagagcaa

SEQ ID NO: 260074 - DNA, 25 bp, Rattus norvegicus
cggtgctcacacagtcggtcaaaaa

SEQ ID NO: 260075 - DNA, 25 bp, Rattus norvegicus
cggtgctcacactgtcggtcaaaaa

SEQ ID NO: 260076 - DNA, 25 bp, Rattus norvegicus
cggtgctcaccgacattaaatggaa

SEQ ID NO: 260077 - DNA, 25 bp, Rattus norvegicus
cggtgctcaccgtcattaaatggaa

SEQ ID NO: 260078 - DNA, 25 bp, Rattus norvegicus
cggtgctcctgactttgctgaatga

SEQ ID NO: 260079 - DNA, 25 bp, Rattus norvegicus
cggtgctcctgagtttgctgaatga

SEQ ID NO: 260080 - DNA, 25 bp, Rattus norvegicus
cggtgctgaatcaggtgtggtttct

SEQ ID NO: 260081 - DNA, 25 bp, Rattus norvegicus
cggtgctgaatctggtgtggtttct

SEQ ID NO: 260082 - DNA, 25 bp, Rattus norvegicus
cggtgctgaggcaccttgatttgga

SEQ ID NO: 260083 - DNA, 25 bp, Rattus norvegicus
cggtgctgaggctccttgatttgga

SEQ ID NO: 260084 - DNA, 25 bp, Rattus norvegicus
cggtgctgatggctacgtcttatcg

SEQ ID NO: 260085 - DNA, 25 bp, Rattus norvegicus
cggtgctgatgggtacgtcttatcg

SEQ ID NO: 260086 - DNA, 25 bp, Rattus norvegicus
cggtgctgcgctaggtcctagccct

SEQ ID NO: 260087 - DNA, 25 bp, Rattus norvegicus
cggtgctgcgcttggtcctagccct

SEQ ID NO: 260088 - DNA, 25 bp, Rattus norvegicus
cggtggaaatgccttctgtcagtat

SEQ ID NO: 260089 - DNA, 25 bp, Rattus norvegicus
cggtggaaatgcgttctgtcagtat

SEQ ID NO: 260090 - DNA, 25 bp, Rattus norvegicus
cggtggaagagcataaaggtgccta

SEQ ID NO: 260091 - DNA, 25 bp, Rattus norvegicus
cggtggaagagcttaaaggtgccta

SEQ ID NO: 260092 - DNA, 25 bp, Rattus norvegicus
cggtggaccatgatctttagactac

SEQ ID NO: 260093 - DNA, 25 bp, Rattus norvegicus
cggtggaccatgttctttagactac

SEQ ID NO: 260094 - DNA, 25 bp, Rattus norvegicus
cggtggcagcttcaagtttcccaag

SEQ ID NO: 260095 - DNA, 25 bp, Rattus norvegicus
cggtggcagcttgaagtttcccaag

SEQ ID NO: 260096 - DNA, 25 bp, Rattus norvegicus
cggtggcatcctcgctgtgcgccat

SEQ ID NO: 260097 - DNA, 25 bp, Rattus norvegicus
cggtggcatcctggctgtgcgccat

SEQ ID NO: 260098 - DNA, 25 bp, Rattus norvegicus
cggtggcattcgactccgcagtcgg

SEQ ID NO: 260099 - DNA, 25 bp, Rattus norvegicus
cggtggcattcgtctccgcagtcgg

SEQ ID NO: 260100 - DNA, 25 bp, Rattus norvegicus
cggtggcccaggacagtctgagcac

SEQ ID NO: 260101 - DNA, 25 bp, Rattus norvegicus
cggtggcccaggtcagtctgagcac

SEQ ID NO: 260102 - DNA, 25 bp, Rattus norvegicus
cggtggcccgctagcagatgctctg

SEQ ID NO: 260103 - DNA, 25 bp, Rattus norvegicus
cggtggcccgcttgcagatgctctg

SEQ ID NO: 260104 - DNA, 25 bp, Rattus norvegicus
cggtggccgccgagttccgcgactc

SEQ ID NO: 260105 - DNA, 25 bp, Rattus norvegicus
cggtggccgccgtgttccgcgactc

SEQ ID NO: 260106 - DNA, 25 bp, Rattus norvegicus
cggtggccgcgtctcctggtactct

SEQ ID NO: 260107 - DNA, 25 bp, Rattus norvegicus
cggtggccgcgtgtcctggtactct

SEQ ID NO: 260108 - DNA, 25 bp, Rattus norvegicus
cggtggcggcgaacctgtaaagact

SEQ ID NO: 260109 - DNA, 25 bp, Rattus norvegicus
cggtggcggcgatcctgtaaagact

SEQ ID NO: 260110 - DNA, 25 bp, Rattus norvegicus
cggtggctccgaaaagctgtactat

SEQ ID NO: 260111 - DNA, 25 bp, Rattus norvegicus
cggtggctccgataagctgtactat

SEQ ID NO: 260112 - DNA, 25 bp, Rattus norvegicus
cggtggctctagatcttcttgatta

SEQ ID NO: 260113 - DNA, 25 bp, Rattus norvegicus
cggtggctctagttcttcttgatta

SEQ ID NO: 260114 - DNA, 25 bp, Rattus norvegicus
cggtgggacccaagacagtgaaaga

SEQ ID NO: 260115 - DNA, 25 bp, Rattus norvegicus
cggtgggacccatgacagtgaaaga

SEQ ID NO: 260116 - DNA, 25 bp, Rattus norvegicus
cggtgggctcagaaggtgaaaacca

SEQ ID NO: 260117 - DNA, 25 bp, Rattus norvegicus
cggtgggctcagtaggtgaaaacca

SEQ ID NO: 260118 - DNA, 25 bp, Rattus norvegicus
cggtgggtggtgatattgtcctcca

SEQ ID NO: 260119 - DNA, 25 bp, Rattus norvegicus
cggtgggtggtgttattgtcctcca

SEQ ID NO: 260120 - DNA, 25 bp, Rattus norvegicus
cggtggtccccacagaaacaactat

SEQ ID NO: 260121 - DNA, 25 bp, Rattus norvegicus
cggtggtccccagagaaacaactat

SEQ ID NO: 260122 - DNA, 25 bp, Rattus norvegicus
cggtggtcgcacattctttgctaac

SEQ ID NO: 260123 - DNA, 25 bp, Rattus norvegicus
cggtggtcgcactttctttgctaac

SEQ ID NO: 260124 - DNA, 25 bp, Rattus norvegicus
cggtggtggaggcagctactggaag

SEQ ID NO: 260125 - DNA, 25 bp, Rattus norvegicus
cggtggtggagggagctactggaag

SEQ ID NO: 260126 - DNA, 25 bp, Rattus norvegicus
cggtggtgtctgacctcaagcctag

SEQ ID NO: 260127 - DNA, 25 bp, Rattus norvegicus
cggtggtgtctgtcctcaagcctag

SEQ ID NO: 260128 - DNA, 25 bp, Rattus norvegicus
cggtggttcagtcctgtcttctggt

SEQ ID NO: 260129 - DNA, 25 bp, Rattus norvegicus
cggtggttcagtgctgtcttctggt

SEQ ID NO: 260130 - DNA, 25 bp, Rattus norvegicus
cggtggttcctaattcttgtttgat

SEQ ID NO: 260131 - DNA, 25 bp, Rattus norvegicus
cggtggttcctatttcttgtttgat

SEQ ID NO: 260132 - DNA, 25 bp, Rattus norvegicus
cggtgtaaactgagaagggttctca

SEQ ID NO: 260133 - DNA, 25 bp, Rattus norvegicus
cggtgtaaactgtgaagggttctca

SEQ ID NO: 260134 - DNA, 25 bp, Rattus norvegicus
cggtgtcaaaatcctgctcatgtta

SEQ ID NO: 260135 - DNA, 25 bp, Rattus norvegicus
cggtgtcaaaatgctgctcatgtta

SEQ ID NO: 260136 - DNA, 25 bp, Rattus norvegicus
cggtgtcagcttccttcagtaaaaa

SEQ ID NO: 260137 - DNA, 25 bp, Rattus norvegicus
cggtgtcagcttgcttcagtaaaaa

SEQ ID NO: 260138 - DNA, 25 bp, Rattus norvegicus
cggtgtccgacgagaagttcagcca

SEQ ID NO: 260139 - DNA, 25 bp, Rattus norvegicus
cggtgtccgacgtgaagttcagcca

SEQ ID NO: 260140 - DNA, 25 bp, Rattus norvegicus
cggtgtcggcgtcgagttttctctc

SEQ ID NO: 260141 - DNA, 25 bp, Rattus norvegicus
cggtgtcggcgtggagttttctctc

SEQ ID NO: 260142 - DNA, 25 bp, Rattus norvegicus
cggtgtctgaccacattgtgggtaa

SEQ ID NO: 260143 - DNA, 25 bp, Rattus norvegicus
cggtgtctgacctcattgtgggtaa

SEQ ID NO: 260144 - DNA, 25 bp, Rattus norvegicus
cggtgtgactgtacgataaaatagc

SEQ ID NO: 260145 - DNA, 25 bp, Rattus norvegicus
cggtgtgactgttcgataaaatagc

SEQ ID NO: 260146 - DNA, 25 bp, Rattus norvegicus
cggtgtgccctgcagacaaggtcat

SEQ ID NO: 260147 - DNA, 25 bp, Rattus norvegicus
cggtgtgccctggagacaaggtcat

SEQ ID NO: 260148 - DNA, 25 bp, Rattus norvegicus
cggtgtgcgctcacggcactgctat

SEQ ID NO: 260149 - DNA, 25 bp, Rattus norvegicus
cggtgtgcgctctcggcactgctat

SEQ ID NO: 260150 - DNA, 25 bp, Rattus norvegicus
cggtgtgcgttaccttaaagtgtaa

SEQ ID NO: 260151 - DNA, 25 bp, Rattus norvegicus
cggtgtgcgttagcttaaagtgtaa

SEQ ID NO: 260152 - DNA, 25 bp, Rattus norvegicus
cggtgtgctggcagtaggtctcaaa

SEQ ID NO: 260153 - DNA, 25 bp, Rattus norvegicus
cggtgtgctggctgtaggtctcaaa

SEQ ID NO: 260154 - DNA, 25 bp, Rattus norvegicus
cggtgtgggcatccgcgcgtgggta

SEQ ID NO: 260155 - DNA, 25 bp, Rattus norvegicus
cggtgtgggcatgcgcgcgtgggta

SEQ ID NO: 260156 - DNA, 25 bp, Rattus norvegicus
cggtgttgcatccatacaggcaggt

SEQ ID NO: 260157 - DNA, 25 bp, Rattus norvegicus
cggtgttgcatcgatacaggcaggt

SEQ ID NO: 260158 - DNA, 25 bp, Rattus norvegicus
cggtgtttatctactctgtaaccat

SEQ ID NO: 260159 - DNA, 25 bp, Rattus norvegicus
cggtgtttatcttctctgtaaccat

SEQ ID NO: 260160 - DNA, 25 bp, Rattus norvegicus
cggttaaaatatccactaagtctct

SEQ ID NO: 260161 - DNA, 25 bp, Rattus norvegicus
cggttaaaatatgcactaagtctct

SEQ ID NO: 260162 - DNA, 25 bp, Rattus norvegicus
cggttaccaacactgcagcatgagg

SEQ ID NO: 260163 - DNA, 25 bp, Rattus norvegicus
cggttaccaacagtgcagcatgagg

SEQ ID NO: 260164 - DNA, 25 bp, Rattus norvegicus
cggttaccgggtacacagagccagg

SEQ ID NO: 260165 - DNA, 25 bp, Rattus norvegicus
cggttaccgggttcacagagccagg

SEQ ID NO: 260166 - DNA, 25 bp, Rattus norvegicus
cggttagctcttcttctttggtagt

SEQ ID NO: 260167 - DNA, 25 bp, Rattus norvegicus
cggttagctcttgttctttggtagt

SEQ ID NO: 260168 - DNA, 25 bp, Rattus norvegicus
cggttatggcggcatgaacctgacc

SEQ ID NO: 260169 - DNA, 25 bp, Rattus norvegicus
cggttatggcgggatgaacctgacc

SEQ ID NO: 260170 - DNA, 25 bp, Rattus norvegicus
cggttcaacattccgtgtttgtgcc

SEQ ID NO: 260171 - DNA, 25 bp, Rattus norvegicus
cggttcaacattgcgtgtttgtgcc

SEQ ID NO: 260172 - DNA, 25 bp, Rattus norvegicus
cggttcacttagctcgggattttgg

SEQ ID NO: 260173 - DNA, 25 bp, Rattus norvegicus
cggttcacttaggtcgggattttgg

SEQ ID NO: 260174 - DNA, 25 bp, Rattus norvegicus
cggttcagccaaaactgtcttctgt

SEQ ID NO: 260175 - DNA, 25 bp, Rattus norvegicus
cggttcagccaatactgtcttctgt

SEQ ID NO: 260176 - DNA, 25 bp, Rattus norvegicus
cggttcatgtctcccttctgtagac

SEQ ID NO: 260177 - DNA, 25 bp, Rattus norvegicus
cggttcatgtctgccttctgtagac

SEQ ID NO: 260178 - DNA, 25 bp, Rattus norvegicus
cggttcattcgtctccgtgaggata

SEQ ID NO: 260179 - DNA, 25 bp, Rattus norvegicus
cggttcattcgtgtccgtgaggata

SEQ ID NO: 260180 - DNA, 25 bp, Rattus norvegicus
cggttccccaagactaaacatcatg

SEQ ID NO: 260181 - DNA, 25 bp, Rattus norvegicus
cggttccccaagtctaaacatcatg

SEQ ID NO: 260182 - DNA, 25 bp, Rattus norvegicus
cggttcctcctgcacattcagaaat

SEQ ID NO: 260183 - DNA, 25 bp, Rattus norvegicus
cggttcctcctggacattcagaaat

SEQ ID NO: 260184 - DNA, 25 bp, Rattus norvegicus
cggttcctggagattctagtctcag

SEQ ID NO: 260185 - DNA, 25 bp, Rattus norvegicus
cggttcctggagtttctagtctcag

SEQ ID NO: 260186 - DNA, 25 bp, Rattus norvegicus
cggttcgccgtcctatgatgatgca

SEQ ID NO: 260187 - DNA, 25 bp, Rattus norvegicus
cggttcgccgtcgtatgatgatgca

SEQ ID NO: 260188 - DNA, 25 bp, Rattus norvegicus
cggttcgtccataccattctaatta

SEQ ID NO: 260189 - DNA, 25 bp, Rattus norvegicus
cggttcgtccattccattctaatta

SEQ ID NO: 260190 - DNA, 25 bp, Rattus norvegicus
cggttcttcatcatgcacagtattt

SEQ ID NO: 260191 - DNA, 25 bp, Rattus norvegicus
cggttcttcatcttgcacagtattt

SEQ ID NO: 260192 - DNA, 25 bp, Rattus norvegicus
cggttcttccaaaagctgcgaggga

SEQ ID NO: 260193 - DNA, 25 bp, Rattus norvegicus
cggttcttccaatagctgcgaggga

SEQ ID NO: 260194 - DNA, 25 bp, Rattus norvegicus
cggttgaacattcccgtcatatgga

SEQ ID NO: 260195 - DNA, 25 bp, Rattus norvegicus
cggttgaacattgccgtcatatgga

SEQ ID NO: 260196 - DNA, 25 bp, Rattus norvegicus
cggttgatggagaagctggctcaaa

SEQ ID NO: 260197 - DNA, 25 bp, Rattus norvegicus
cggttgatggagtagctggctcaaa

SEQ ID NO: 260198 - DNA, 25 bp, Rattus norvegicus
cggttgcattccaaaagccatttat

SEQ ID NO: 260199 - DNA, 25 bp, Rattus norvegicus
cggttgcattcctaaagccatttat

SEQ ID NO: 260200 - DNA, 25 bp, Rattus norvegicus
cggttgctgtctccggaagtgacta

SEQ ID NO: 260201 - DNA, 25 bp, Rattus norvegicus
cggttgctgtctgcggaagtgacta

SEQ ID NO: 260202 - DNA, 25 bp, Rattus norvegicus
cggttggagtccagatgagaatatt

SEQ ID NO: 260203 - DNA, 25 bp, Rattus norvegicus
cggttggagtcctgatgagaatatt

SEQ ID NO: 260204 - DNA, 25 bp, Rattus norvegicus
cggttggtctgccacaagactgaga

SEQ ID NO: 260205 - DNA, 25 bp, Rattus norvegicus
cggttggtctgcgacaagactgaga

SEQ ID NO: 260206 - DNA, 25 bp, Rattus norvegicus
cggttggtggtaactgtggcctcta

SEQ ID NO: 260207 - DNA, 25 bp, Rattus norvegicus
cggttggtggtatctgtggcctcta

SEQ ID NO: 260208 - DNA, 25 bp, Rattus norvegicus
cggttggtggtccaggccttccatt

SEQ ID NO: 260209 - DNA, 25 bp, Rattus norvegicus
cggttggtggtcgaggccttccatt

SEQ ID NO: 260210 - DNA, 25 bp, Rattus norvegicus
cggttgttgggcacctgcacagaga

SEQ ID NO: 260211 - DNA, 25 bp, Rattus norvegicus
cggttgttgggctcctgcacagaga

SEQ ID NO: 260212 - DNA, 25 bp, Rattus norvegicus
cggtttatcgacagagtgacttgct

SEQ ID NO: 260213 - DNA, 25 bp, Rattus norvegicus
cggtttatcgactgagtgacttgct

SEQ ID NO: 260214 - DNA, 25 bp, Rattus norvegicus
cggtttatctctacctatttcgaat

SEQ ID NO: 260215 - DNA, 25 bp, Rattus norvegicus
cggtttatctcttcctatttcgaat

SEQ ID NO: 260216 - DNA, 25 bp, Rattus norvegicus
cggtttattcgcattctgagacagg

SEQ ID NO: 260217 - DNA, 25 bp, Rattus norvegicus
cggtttattcgctttctgagacagg

SEQ ID NO: 260218 - DNA, 25 bp, Rattus norvegicus
cggtttcagcccagagcagagagct

SEQ ID NO: 260219 - DNA, 25 bp, Rattus norvegicus
cggtttcagccctgagcagagagct

SEQ ID NO: 260220 - DNA, 25 bp, Rattus norvegicus
cggtttcatcgtctgcatttggcaa

SEQ ID NO: 260221 - DNA, 25 bp, Rattus norvegicus
cggtttcatcgtgtgcatttggcaa

SEQ ID NO: 260222 - DNA, 25 bp, Rattus norvegicus
cggtttcctcgtataccagactgaa

SEQ ID NO: 260223 - DNA, 25 bp, Rattus norvegicus
cggtttcctcgtttaccagactgaa

SEQ ID NO: 260224 - DNA, 25 bp, Rattus norvegicus
cggtttctggtgaccgagctgttca

SEQ ID NO: 260225 - DNA, 25 bp, Rattus norvegicus
cggtttctggtgtccgagctgttca

SEQ ID NO: 260226 - DNA, 25 bp, Rattus norvegicus
cggtttgccagcagaacagggatct

SEQ ID NO: 260227 - DNA, 25 bp, Rattus norvegicus
cggtttgccagctgaacagggatct

SEQ ID NO: 260228 - DNA, 25 bp, Rattus norvegicus
cggtttggaataagcagatggcctt

SEQ ID NO: 260229 - DNA, 25 bp, Rattus norvegicus
cggtttggaatatgcagatggcctt

SEQ ID NO: 260230 - DNA, 25 bp, Rattus norvegicus
cggtttgtgggcatagtctactgta

SEQ ID NO: 260231 - DNA, 25 bp, Rattus norvegicus
cggtttgtgggcttagtctactgta

SEQ ID NO: 260232 - DNA, 25 bp, Rattus norvegicus
cggttttcacctcggagtcgctcgc

SEQ ID NO: 260233 - DNA, 25 bp, Rattus norvegicus
cggttttcacctgggagtcgctcgc

SEQ ID NO: 260234 - DNA, 25 bp, Rattus norvegicus
cggttttcttttccgttcattcgca

SEQ ID NO: 260235 - DNA, 25 bp, Rattus norvegicus
cggttttcttttgcgttcattcgca

SEQ ID NO: 260236 - DNA, 25 bp, Rattus norvegicus
cgtaaagggactcaactctctctga

SEQ ID NO: 260237 - DNA, 25 bp, Rattus norvegicus
cgtaaagggactgaactctctctga

SEQ ID NO: 260238 - DNA, 25 bp, Rattus norvegicus
cgtaaccagtgcaaagaccttccga

SEQ ID NO: 260239 - DNA, 25 bp, Rattus norvegicus
cgtaaccagtgctaagaccttccga

SEQ ID NO: 260240 - DNA, 25 bp, Rattus norvegicus
cgtaactattctcatgtcactcaac

SEQ ID NO: 260241 - DNA, 25 bp, Rattus norvegicus
cgtaactattctgatgtcactcaac

SEQ ID NO: 260242 - DNA, 25 bp, Rattus norvegicus
cgtaagacttttagaggcccatctc

SEQ ID NO: 260243 - DNA, 25 bp, Rattus norvegicus
cgtaagactttttgaggcccatctc

SEQ ID NO: 260244 - DNA, 25 bp, Rattus norvegicus
cgtaagctaaatcatggcctatcta

SEQ ID NO: 260245 - DNA, 25 bp, Rattus norvegicus
cgtaagctaaatgatggcctatcta

SEQ ID NO: 260246 - DNA, 25 bp, Rattus norvegicus
cgtaagtcatagatcagtccctggg

SEQ ID NO: 260247 - DNA, 25 bp, Rattus norvegicus
cgtaagtcatagttcagtccctggg

SEQ ID NO: 260248 - DNA, 25 bp, Rattus norvegicus
cgtaatagtacccaacacagcaatt

SEQ ID NO: 260249 - DNA, 25 bp, Rattus norvegicus
cgtaatagtaccgaacacagcaatt

SEQ ID NO: 260250 - DNA, 25 bp, Rattus norvegicus
cgtaatggaattagtttctcccctg

SEQ ID NO: 260251 - DNA, 25 bp, Rattus norvegicus
cgtaatggaatttgtttctcccctg

SEQ ID NO: 260252 - DNA, 25 bp, Rattus norvegicus
cgtaatgtgctgcttctattctgaa

SEQ ID NO: 260253 - DNA, 25 bp, Rattus norvegicus
cgtaatgtgctggttctattctgaa

SEQ ID NO: 260254 - DNA, 25 bp, Rattus norvegicus
cgtaattctgtaacttctctgatgt

SEQ ID NO: 260255 - DNA, 25 bp, Rattus norvegicus
cgtaattctgtatcttctctgatgt

SEQ ID NO: 260256 - DNA, 25 bp, Rattus norvegicus
cgtacaagcaggagccgggcagccc

SEQ ID NO: 260257 - DNA, 25 bp, Rattus norvegicus
cgtacaagcaggtgccgggcagccc

SEQ ID NO: 260258 - DNA, 25 bp, Rattus norvegicus
cgtacaccgtgaatgtgagggcctt

SEQ ID NO: 260259 - DNA, 25 bp, Rattus norvegicus
cgtacaccgtgattgtgagggcctt

SEQ ID NO: 260260 - DNA, 25 bp, Rattus norvegicus
cgtacacgagtgctcagctggtaga

SEQ ID NO: 260261 - DNA, 25 bp, Rattus norvegicus
cgtacacgagtggtcagctggtaga

SEQ ID NO: 260262 - DNA, 25 bp, Rattus norvegicus
cgtacactagccatttggactgttt

SEQ ID NO: 260263 - DNA, 25 bp, Rattus norvegicus
cgtacactagccttttggactgttt

SEQ ID NO: 260264 - DNA, 25 bp, Rattus norvegicus
cgtacagcatgactcccttatagca

SEQ ID NO: 260265 - DNA, 25 bp, Rattus norvegicus
cgtacagcatgagtcccttatagca

SEQ ID NO: 260266 - DNA, 25 bp, Rattus norvegicus
cgtacagtcataacacatccttcta

SEQ ID NO: 260267 - DNA, 25 bp, Rattus norvegicus
cgtacagtcatatcacatccttcta

SEQ ID NO: 260268 - DNA, 25 bp, Rattus norvegicus
cgtacagtggtgcatctagtgctca

SEQ ID NO: 260269 - DNA, 25 bp, Rattus norvegicus
cgtacagtggtggatctagtgctca

SEQ ID NO: 260270 - DNA, 25 bp, Rattus norvegicus
cgtacatccattaatccttatcact

SEQ ID NO: 260271 - DNA, 25 bp, Rattus norvegicus
cgtacatccatttatccttatcact

SEQ ID NO: 260272 - DNA, 25 bp, Rattus norvegicus
cgtacattcataattttgtttttca

SEQ ID NO: 260273 - DNA, 25 bp, Rattus norvegicus
cgtacattcatatttttgtttttca

SEQ ID NO: 260274 - DNA, 25 bp, Rattus norvegicus
cgtaccctccaacattgtcgtgaat

SEQ ID NO: 260275 - DNA, 25 bp, Rattus norvegicus
cgtaccctccaagattgtcgtgaat

SEQ ID NO: 260276 - DNA, 25 bp, Rattus norvegicus
cgtacccttggtatttatctcacat

SEQ ID NO: 260277 - DNA, 25 bp, Rattus norvegicus
cgtacccttggtttttatctcacat

SEQ ID NO: 260278 - DNA, 25 bp, Rattus norvegicus
cgtaccggacacatcattctgagtt

SEQ ID NO: 260279 - DNA, 25 bp, Rattus norvegicus
cgtaccggacacttcattctgagtt

SEQ ID NO: 260280 - DNA, 25 bp, Rattus norvegicus
cgtacctacagaagatgaacccctt

SEQ ID NO: 260281 - DNA, 25 bp, Rattus norvegicus
cgtacctacagatgatgaacccctt

SEQ ID NO: 260282 - DNA, 25 bp, Rattus norvegicus
cgtacctctggaattgatggcgtgt

SEQ ID NO: 260283 - DNA, 25 bp, Rattus norvegicus
cgtacctctggatttgatggcgtgt

SEQ ID NO: 260284 - DNA, 25 bp, Rattus norvegicus
cgtaccttcacccagtgcaatatat

SEQ ID NO: 260285 - DNA, 25 bp, Rattus norvegicus
cgtaccttcaccgagtgcaatatat

SEQ ID NO: 260286 - DNA, 25 bp, Rattus norvegicus
cgtacgtgtgtgagtgaggctctta

SEQ ID NO: 260287 - DNA, 25 bp, Rattus norvegicus
cgtacgtgtgtgtgtgaggctctta

SEQ ID NO: 260288 - DNA, 25 bp, Rattus norvegicus
cgtactatccacatcctcaaagata

SEQ ID NO: 260289 - DNA, 25 bp, Rattus norvegicus
cgtactatccacttcctcaaagata

SEQ ID NO: 260290 - DNA, 25 bp, Rattus norvegicus
cgtactcctgtgcttattttttatt

SEQ ID NO: 260291 - DNA, 25 bp, Rattus norvegicus
cgtactcctgtggttattttttatt

SEQ ID NO: 260292 - DNA, 25 bp, Rattus norvegicus
cgtactctcagaccgtttgtgatta

SEQ ID NO: 260293 - DNA, 25 bp, Rattus norvegicus
cgtactctcagagcgtttgtgatta

SEQ ID NO: 260294 - DNA, 25 bp, Rattus norvegicus
cgtactgagggaacgtaggcaagct

SEQ ID NO: 260295 - DNA, 25 bp, Rattus norvegicus
cgtactgagggatcgtaggcaagct

SEQ ID NO: 260296 - DNA, 25 bp, Rattus norvegicus
cgtactggctgtaggcgtagctgca

SEQ ID NO: 260297 - DNA, 25 bp, Rattus norvegicus
cgtactggctgttggcgtagctgca

SEQ ID NO: 260298 - DNA, 25 bp, Rattus norvegicus
cgtactggtttgacatacatgctca

SEQ ID NO: 260299 - DNA, 25 bp, Rattus norvegicus
cgtactggtttgtcatacatgctca

SEQ ID NO: 260300 - DNA, 25 bp, Rattus norvegicus
cgtactgtaaccatttctcctttat

SEQ ID NO: 260301 - DNA, 25 bp, Rattus norvegicus
cgtactgtaaccttttctcctttat

SEQ ID NO: 260302 - DNA, 25 bp, Rattus norvegicus
cgtacttcattacttctgccataat

SEQ ID NO: 260303 - DNA, 25 bp, Rattus norvegicus
cgtacttcattagttctgccataat

SEQ ID NO: 260304 - DNA, 25 bp, Rattus norvegicus
cgtactttgtcccagtgaagctact

SEQ ID NO: 260305 - DNA, 25 bp, Rattus norvegicus
cgtactttgtccgagtgaagctact

SEQ ID NO: 260306 - DNA, 25 bp, Rattus norvegicus
cgtacttttgtgacattcttcagca

SEQ ID NO: 260307 - DNA, 25 bp, Rattus norvegicus
cgtacttttgtgtcattcttcagca

SEQ ID NO: 260308 - DNA, 25 bp, Rattus norvegicus
cgtagacctcttccgtaatgcagga

SEQ ID NO: 260309 - DNA, 25 bp, Rattus norvegicus
cgtagacctcttgcgtaatgcagga

SEQ ID NO: 260310 - DNA, 25 bp, Rattus norvegicus
cgtagacgcggtcgtgttgacccta

SEQ ID NO: 260311 - DNA, 25 bp, Rattus norvegicus
cgtagacgcggtggtgttgacccta

SEQ ID NO: 260312 - DNA, 25 bp, Rattus norvegicus
cgtagactccataacggttctgtgt

SEQ ID NO: 260313 - DNA, 25 bp, Rattus norvegicus
cgtagactccattacggttctgtgt

SEQ ID NO: 260314 - DNA, 25 bp, Rattus norvegicus
cgtagagaacccagaggtgctcttt

SEQ ID NO: 260315 - DNA, 25 bp, Rattus norvegicus
cgtagagaaccctgaggtgctcttt

SEQ ID NO: 260316 - DNA, 25 bp, Rattus norvegicus
cgtagaggagccaccaccggccgtg

SEQ ID NO: 260317 - DNA, 25 bp, Rattus norvegicus
cgtagaggagcctccaccggccgtg

SEQ ID NO: 260318 - DNA, 25 bp, Rattus norvegicus
cgtagatatggtacctctccctgac

SEQ ID NO: 260319 - DNA, 25 bp, Rattus norvegicus
cgtagatatggttcctctccctgac

SEQ ID NO: 260320 - DNA, 25 bp, Rattus norvegicus
cgtagcagggctcgctgtgtctcac

SEQ ID NO: 260321 - DNA, 25 bp, Rattus norvegicus
cgtagcagggctggctgtgtctcac

SEQ ID NO: 260322 - DNA, 25 bp, Rattus norvegicus
cgtagcatagttctcacagtctcca

SEQ ID NO: 260323 - DNA, 25 bp, Rattus norvegicus
cgtagcatagttgtcacagtctcca

SEQ ID NO: 260324 - DNA, 25 bp, Rattus norvegicus
cgtagccatcttagtaagcaatgat

SEQ ID NO: 260325 - DNA, 25 bp, Rattus norvegicus
cgtagccatctttgtaagcaatgat

SEQ ID NO: 260326 - DNA, 25 bp, Rattus norvegicus
cgtagcgtatcccacttattttaat

SEQ ID NO: 260327 - DNA, 25 bp, Rattus norvegicus
cgtagcgtatccgacttattttaat

SEQ ID NO: 260328 - DNA, 25 bp, Rattus norvegicus
cgtagctccctgaagtcaggtttac

SEQ ID NO: 260329 - DNA, 25 bp, Rattus norvegicus
cgtagctccctgtagtcaggtttac

SEQ ID NO: 260330 - DNA, 25 bp, Rattus norvegicus
cgtagctgctctctgtatcatattt

SEQ ID NO: 260331 - DNA, 25 bp, Rattus norvegicus
cgtagctgctctgtgtatcatattt

SEQ ID NO: 260332 - DNA, 25 bp, Rattus norvegicus
cgtaggctcactcggatttgtagtt

SEQ ID NO: 260333 - DNA, 25 bp, Rattus norvegicus
cgtaggctcactgggatttgtagtt

SEQ ID NO: 260334 - DNA, 25 bp, Rattus norvegicus
cgtagggtgtcactatcacgtaagt

SEQ ID NO: 260335 - DNA, 25 bp, Rattus norvegicus
cgtagggtgtcagtatcacgtaagt

SEQ ID NO: 260336 - DNA, 25 bp, Rattus norvegicus
cgtaggtctgaaaacacaggcttca

SEQ ID NO: 260337 - DNA, 25 bp, Rattus norvegicus
cgtaggtctgaatacacaggcttca

SEQ ID NO: 260338 - DNA, 25 bp, Rattus norvegicus
cgtagtactgcaccccattttgcgg

SEQ ID NO: 260339 - DNA, 25 bp, Rattus norvegicus
cgtagtactgcagcccattttgcgg

SEQ ID NO: 260340 - DNA, 25 bp, Rattus norvegicus
cgtagtatcaggctgtaggctgatt

SEQ ID NO: 260341 - DNA, 25 bp, Rattus norvegicus
cgtagtatcagggtgtaggctgatt

SEQ ID NO: 260342 - DNA, 25 bp, Rattus norvegicus
cgtagtccatttccgagagctctat

SEQ ID NO: 260343 - DNA, 25 bp, Rattus norvegicus
cgtagtccatttgcgagagctctat

SEQ ID NO: 260344 - DNA, 25 bp, Rattus norvegicus
cgtagtgacacactcctgtaatccc

SEQ ID NO: 260345 - DNA, 25 bp, Rattus norvegicus
cgtagtgacacagtcctgtaatccc

SEQ ID NO: 260346 - DNA, 25 bp, Rattus norvegicus
cgtatacccttgaccgaagactggt

SEQ ID NO: 260347 - DNA, 25 bp, Rattus norvegicus
cgtatacccttgtccgaagactggt

SEQ ID NO: 260348 - DNA, 25 bp, Rattus norvegicus
cgtatactctcaaggtctctttcaa

SEQ ID NO: 260349 - DNA, 25 bp, Rattus norvegicus
cgtatactctcatggtctctttcaa

SEQ ID NO: 260350 - DNA, 25 bp, Rattus norvegicus
cgtatagtaatcatgttcaccttat

SEQ ID NO: 260351 - DNA, 25 bp, Rattus norvegicus
cgtatagtaatcttgttcaccttat

SEQ ID NO: 260352 - DNA, 25 bp, Rattus norvegicus
cgtatcaccacgattgacttcagtg

SEQ ID NO: 260353 - DNA, 25 bp, Rattus norvegicus
cgtatcaccacgtttgacttcagtg

SEQ ID NO: 260354 - DNA, 25 bp, Rattus norvegicus
cgtatccagaagctcagaggccagt

SEQ ID NO: 260355 - DNA, 25 bp, Rattus norvegicus
cgtatccagaaggtcagaggccagt

SEQ ID NO: 260356 - DNA, 25 bp, Rattus norvegicus
cgtatccagcctatagctctataga

SEQ ID NO: 260357 - DNA, 25 bp, Rattus norvegicus
cgtatccagcctttagctctataga

SEQ ID NO: 260358 - DNA, 25 bp, Rattus norvegicus
cgtatccctagcattgacaaacctg

SEQ ID NO: 260359 - DNA, 25 bp, Rattus norvegicus
cgtatccctagctttgacaaacctg

SEQ ID NO: 260360 - DNA, 25 bp, Rattus norvegicus
cgtatgcttctgattgtgtgcttca

SEQ ID NO: 260361 - DNA, 25 bp, Rattus norvegicus
cgtatgcttctgtttgtgtgcttca

SEQ ID NO: 260362 - DNA, 25 bp, Rattus norvegicus
cgtatgggatccattggctgtctga

SEQ ID NO: 260363 - DNA, 25 bp, Rattus norvegicus
cgtatgggatcctttggctgtctga

SEQ ID NO: 260364 - DNA, 25 bp, Rattus norvegicus
cgtatgtacagccactctctgaaca

SEQ ID NO: 260365 - DNA, 25 bp, Rattus norvegicus
cgtatgtacagcgactctctgaaca

SEQ ID NO: 260366 - DNA, 25 bp, Rattus norvegicus
cgtatgtatcagattatattgtgga

SEQ ID NO: 260367 - DNA, 25 bp, Rattus norvegicus
cgtatgtatcagtttatattgtgga

SEQ ID NO: 260368 - DNA, 25 bp, Rattus norvegicus
cgtatgtatcatctcgggctcgaat

SEQ ID NO: 260369 - DNA, 25 bp, Rattus norvegicus
cgtatgtatcatgtcgggctcgaat

SEQ ID NO: 260370 - DNA, 25 bp, Rattus norvegicus
cgtatgtcttccaccattacagaca

SEQ ID NO: 260371 - DNA, 25 bp, Rattus norvegicus
cgtatgtcttcctccattacagaca

SEQ ID NO: 260372 - DNA, 25 bp, Rattus norvegicus
cgtatgtgacgcagctcttagcgca

SEQ ID NO: 260373 - DNA, 25 bp, Rattus norvegicus
cgtatgtgacgctgctcttagcgca

SEQ ID NO: 260374 - DNA, 25 bp, Rattus norvegicus
cgtatgtgcatcacgccgtcggagg

SEQ ID NO: 260375 - DNA, 25 bp, Rattus norvegicus
cgtatgtgcatctcgccgtcggagg

SEQ ID NO: 260376 - DNA, 25 bp, Rattus norvegicus
cgtatgtgctctatggttgttatcc

SEQ ID NO: 260377 - DNA, 25 bp, Rattus norvegicus
cgtatgtgctctttggttgttatcc

SEQ ID NO: 260378 - DNA, 25 bp, Rattus norvegicus
cgtatgtgttctccaccaggatgaa

SEQ ID NO: 260379 - DNA, 25 bp, Rattus norvegicus
cgtatgtgttctgcaccaggatgaa

SEQ ID NO: 260380 - DNA, 25 bp, Rattus norvegicus
cgtattataacactttcgtagcaaa

SEQ ID NO: 260381 - DNA, 25 bp, Rattus norvegicus
cgtattataacagtttcgtagcaaa

SEQ ID NO: 260382 - DNA, 25 bp, Rattus norvegicus
cgtattcccaaaagtgatgtttcag

SEQ ID NO: 260383 - DNA, 25 bp, Rattus norvegicus
cgtattcccaaatgtgatgtttcag

SEQ ID NO: 260384 - DNA, 25 bp, Rattus norvegicus
cgtatttcttttcctcacgaacaga

SEQ ID NO: 260385 - DNA, 25 bp, Rattus norvegicus
cgtatttcttttgctcacgaacaga

SEQ ID NO: 260386 - DNA, 25 bp, Rattus norvegicus
cgtatttgtatgagcctgggtgtca

SEQ ID NO: 260387 - DNA, 25 bp, Rattus norvegicus
cgtatttgtatgtgcctgggtgtca

SEQ ID NO: 260388 - DNA, 25 bp, Rattus norvegicus
cgtatttgtctgatcgcatcgaacc

SEQ ID NO: 260389 - DNA, 25 bp, Rattus norvegicus
cgtatttgtctgttcgcatcgaacc

SEQ ID NO: 260390 - DNA, 25 bp, Rattus norvegicus
cgtcaacatcaaacaggccctggaa

SEQ ID NO: 260391 - DNA, 25 bp, Rattus norvegicus
cgtcaacatcaatcaggccctggaa

SEQ ID NO: 260392 - DNA, 25 bp, Rattus norvegicus
cgtcaacatctacatcgagcgcagc

SEQ ID NO: 260393 - DNA, 25 bp, Rattus norvegicus
cgtcaacatctagatcgagcgcagc

SEQ ID NO: 260394 - DNA, 25 bp, Rattus norvegicus
cgtcaaccaagccactgtcagaaag

SEQ ID NO: 260395 - DNA, 25 bp, Rattus norvegicus
cgtcaaccaagcgactgtcagaaag

SEQ ID NO: 260396 - DNA, 25 bp, Rattus norvegicus
cgtcaagatcaaatggggtgatgct

SEQ ID NO: 260397 - DNA, 25 bp, Rattus norvegicus
cgtcaagatcaattggggtgatgct

SEQ ID NO: 260398 - DNA, 25 bp, Rattus norvegicus
cgtcaagtttcccattaaagccact

SEQ ID NO: 260399 - DNA, 25 bp, Rattus norvegicus
cgtcaagtttccgattaaagccact

SEQ ID NO: 260400 - DNA, 25 bp, Rattus norvegicus
cgtcaatttgtgatttccgcgtcat

SEQ ID NO: 260401 - DNA, 25 bp, Rattus norvegicus
cgtcaatttgtgttttccgcgtcat

SEQ ID NO: 260402 - DNA, 25 bp, Rattus norvegicus
cgtcacacaaataagtctccacctg

SEQ ID NO: 260403 - DNA, 25 bp, Rattus norvegicus
cgtcacacaaattagtctccacctg

SEQ ID NO: 260404 - DNA, 25 bp, Rattus norvegicus
cgtcaccagggcatcacaagcctga

SEQ ID NO: 260405 - DNA, 25 bp, Rattus norvegicus
cgtcaccagggcttcacaagcctga

SEQ ID NO: 260406 - DNA, 25 bp, Rattus norvegicus
cgtcacgctgaaaatatgaccacgc

SEQ ID NO: 260407 - DNA, 25 bp, Rattus norvegicus
cgtcacgctgaatatatgaccacgc

SEQ ID NO: 260408 - DNA, 25 bp, Rattus norvegicus
cgtcacgcttctacttggacaaaga

SEQ ID NO: 260409 - DNA, 25 bp, Rattus norvegicus
cgtcacgcttcttcttggacaaaga

SEQ ID NO: 260410 - DNA, 25 bp, Rattus norvegicus
cgtcacgttgtgactgtatttaagg

SEQ ID NO: 260411 - DNA, 25 bp, Rattus norvegicus
cgtcacgttgtgtctgtatttaagg

SEQ ID NO: 260412 - DNA, 25 bp, Rattus norvegicus
cgtcacttccatatagctcaactga

SEQ ID NO: 260413 - DNA, 25 bp, Rattus norvegicus
cgtcacttccatttagctcaactga

SEQ ID NO: 260414 - DNA, 25 bp, Rattus norvegicus
cgtcactttacgatctggacttggg

SEQ ID NO: 260415 - DNA, 25 bp, Rattus norvegicus
cgtcactttacgttctggacttggg

SEQ ID NO: 260416 - DNA, 25 bp, Rattus norvegicus
cgtcagacgattcctatggctcctg

SEQ ID NO: 260417 - DNA, 25 bp, Rattus norvegicus
cgtcagacgattgctatggctcctg

SEQ ID NO: 260418 - DNA, 25 bp, Rattus norvegicus
cgtcagatccatacaggccaatatt

SEQ ID NO: 260419 - DNA, 25 bp, Rattus norvegicus
cgtcagatccattcaggccaatatt

SEQ ID NO: 260420 - DNA, 25 bp, Rattus norvegicus
cgtcagcatggactctgagatctac

SEQ ID NO: 260421 - DNA, 25 bp, Rattus norvegicus
cgtcagcatggagtctgagatctac

SEQ ID NO: 260422 - DNA, 25 bp, Rattus norvegicus
cgtcagctgcctagtggcctcatga

SEQ ID NO: 260423 - DNA, 25 bp, Rattus norvegicus
cgtcagctgccttgtggcctcatga

SEQ ID NO: 260424 - DNA, 25 bp, Rattus norvegicus
cgtcaggctattatctctgctttaa

SEQ ID NO: 260425 - DNA, 25 bp, Rattus norvegicus
cgtcaggctattttctctgctttaa

SEQ ID NO: 260426 - DNA, 25 bp, Rattus norvegicus
cgtcagggcacgattcttaattaat

SEQ ID NO: 260427 - DNA, 25 bp, Rattus norvegicus
cgtcagggcacgtttcttaattaat

SEQ ID NO: 260428 - DNA, 25 bp, Rattus norvegicus
cgtcatctctgcctgtaacggagat

SEQ ID NO: 260429 - DNA, 25 bp, Rattus norvegicus
cgtcatctctgcgtgtaacggagat

SEQ ID NO: 260430 - DNA, 25 bp, Rattus norvegicus
cgtcatgacccacttgctgacagta

SEQ ID NO: 260431 - DNA, 25 bp, Rattus norvegicus
cgtcatgacccagttgctgacagta

SEQ ID NO: 260432 - DNA, 25 bp, Rattus norvegicus
cgtcatgagtgtcaaatgtgtcccc

SEQ ID NO: 260433 - DNA, 25 bp, Rattus norvegicus
cgtcatgagtgtgaaatgtgtcccc

SEQ ID NO: 260434 - DNA, 25 bp, Rattus norvegicus
cgtcatgctaacagatacacgctgc

SEQ ID NO: 260435 - DNA, 25 bp, Rattus norvegicus
cgtcatgctaactgatacacgctgc

SEQ ID NO: 260436 - DNA, 25 bp, Rattus norvegicus
cgtcatgtctctatcgtgcctttct

SEQ ID NO: 260437 - DNA, 25 bp, Rattus norvegicus
cgtcatgtctctttcgtgcctttct

SEQ ID NO: 260438 - DNA, 25 bp, Rattus norvegicus
cgtcatgttggccatggtggacaca

SEQ ID NO: 260439 - DNA, 25 bp, Rattus norvegicus
cgtcatgttggcgatggtggacaca

SEQ ID NO: 260440 - DNA, 25 bp, Rattus norvegicus
cgtcattaacgcctctgatgatgag

SEQ ID NO: 260441 - DNA, 25 bp, Rattus norvegicus
cgtcattaacgcgtctgatgatgag

SEQ ID NO: 260442 - DNA, 25 bp, Rattus norvegicus
cgtcattgtcagaagccggctatgt

SEQ ID NO: 260443 - DNA, 25 bp, Rattus norvegicus
cgtcattgtcagtagccggctatgt

SEQ ID NO: 260444 - DNA, 25 bp, Rattus norvegicus
cgtcattgtcgtcgtggtgttagca

SEQ ID NO: 260445 - DNA, 25 bp, Rattus norvegicus
cgtcattgtcgtggtggtgttagca

SEQ ID NO: 260446 - DNA, 25 bp, Rattus norvegicus
cgtccaatgggcacctgcggcacat

SEQ ID NO: 260447 - DNA, 25 bp, Rattus norvegicus
cgtccaatgggctcctgcggcacat

SEQ ID NO: 260448 - DNA, 25 bp, Rattus norvegicus
cgtccacagcgtccattctgagata

SEQ ID NO: 260449 - DNA, 25 bp, Rattus norvegicus
cgtccacagcgtgcattctgagata

SEQ ID NO: 260450 - DNA, 25 bp, Rattus norvegicus
cgtccaccgtgtacagttactagaa

SEQ ID NO: 260451 - DNA, 25 bp, Rattus norvegicus
cgtccaccgtgttcagttactagaa

SEQ ID NO: 260452 - DNA, 25 bp, Rattus norvegicus
cgtccacgtgctctacagattgtat

SEQ ID NO: 260453 - DNA, 25 bp, Rattus norvegicus
cgtccacgtgctgtacagattgtat

SEQ ID NO: 260454 - DNA, 25 bp, Rattus norvegicus
cgtccacgttctagccagggaaatg

SEQ ID NO: 260455 - DNA, 25 bp, Rattus norvegicus
cgtccacgttcttgccagggaaatg

SEQ ID NO: 260456 - DNA, 25 bp, Rattus norvegicus
cgtccagaacgaaggcagtttccct

SEQ ID NO: 260457 - DNA, 25 bp, Rattus norvegicus
cgtccagaacgatggcagtttccct

SEQ ID NO: 260458 - DNA, 25 bp, Rattus norvegicus
cgtccagggctgcagaatccgcagc

SEQ ID NO: 260459 - DNA, 25 bp, Rattus norvegicus
cgtccagggctggagaatccgcagc

SEQ ID NO: 260460 - DNA, 25 bp, Rattus norvegicus
cgtccagtatttagagccagcactt

SEQ ID NO: 260461 - DNA, 25 bp, Rattus norvegicus
cgtccagtattttgagccagcactt

SEQ ID NO: 260462 - DNA, 25 bp, Rattus norvegicus
cgtccagtgtgactagcccagaaat

SEQ ID NO: 260463 - DNA, 25 bp, Rattus norvegicus
cgtccagtgtgagtagcccagaaat

SEQ ID NO: 260464 - DNA, 25 bp, Rattus norvegicus
cgtccatatttcctaacatcccggg

SEQ ID NO: 260465 - DNA, 25 bp, Rattus norvegicus
cgtccatatttcgtaacatcccggg

SEQ ID NO: 260466 - DNA, 25 bp, Rattus norvegicus
cgtccatctggcacctgtcaaggat

SEQ ID NO: 260467 - DNA, 25 bp, Rattus norvegicus
cgtccatctggctcctgtcaaggat

SEQ ID NO: 260468 - DNA, 25 bp, Rattus norvegicus
cgtccattgtcaagtcgtcagttga

SEQ ID NO: 260469 - DNA, 25 bp, Rattus norvegicus
cgtccattgtcatgtcgtcagttga

SEQ ID NO: 260470 - DNA, 25 bp, Rattus norvegicus
cgtcccagtgtccttgacttcagga

SEQ ID NO: 260471 - DNA, 25 bp, Rattus norvegicus
cgtcccagtgtcgttgacttcagga

SEQ ID NO: 260472 - DNA, 25 bp, Rattus norvegicus
cgtcccattacaactgaggaatccg

SEQ ID NO: 260473 - DNA, 25 bp, Rattus norvegicus
cgtcccattacatctgaggaatccg

SEQ ID NO: 260474 - DNA, 25 bp, Rattus norvegicus
cgtccccaacgcagctggaaatgag

SEQ ID NO: 260475 - DNA, 25 bp, Rattus norvegicus
cgtccccaacgctgctggaaatgag

SEQ ID NO: 260476 - DNA, 25 bp, Rattus norvegicus
cgtccccactgtagtgaatttgcta

SEQ ID NO: 260477 - DNA, 25 bp, Rattus norvegicus
cgtccccactgttgtgaatttgcta

SEQ ID NO: 260478 - DNA, 25 bp, Rattus norvegicus
cgtcccctatagcatgcttgcgtga

SEQ ID NO: 260479 - DNA, 25 bp, Rattus norvegicus
cgtcccctataggatgcttgcgtga

SEQ ID NO: 260480 - DNA, 25 bp, Rattus norvegicus
cgtcccctgcaaatgattccatgaa

SEQ ID NO: 260481 - DNA, 25 bp, Rattus norvegicus
cgtcccctgcaattgattccatgaa

SEQ ID NO: 260482 - DNA, 25 bp, Rattus norvegicus
cgtccctaccttctctgaaaatgtt

SEQ ID NO: 260483 - DNA, 25 bp, Rattus norvegicus
cgtccctaccttgtctgaaaatgtt

SEQ ID NO: 260484 - DNA, 25 bp, Rattus norvegicus
cgtccctataaaaagtctcgatgat

SEQ ID NO: 260485 - DNA, 25 bp, Rattus norvegicus
cgtccctataaatagtctcgatgat

SEQ ID NO: 260486 - DNA, 25 bp, Rattus norvegicus
cgtccctatgtacctctgttattac

SEQ ID NO: 260487 - DNA, 25 bp, Rattus norvegicus
cgtccctatgtagctctgttattac

SEQ ID NO: 260488 - DNA, 25 bp, Rattus norvegicus
cgtccctgcctgaagtgcgagaaat

SEQ ID NO: 260489 - DNA, 25 bp, Rattus norvegicus
cgtccctgcctgtagtgcgagaaat

SEQ ID NO: 260490 - DNA, 25 bp, Rattus norvegicus
cgtccctgtgtgacagagctatttt

SEQ ID NO: 260491 - DNA, 25 bp, Rattus norvegicus
cgtccctgtgtgtcagagctatttt

SEQ ID NO: 260492 - DNA, 25 bp, Rattus norvegicus
cgtcccttacacaggtggccaagct

SEQ ID NO: 260493 - DNA, 25 bp, Rattus norvegicus
cgtcccttacactggtggccaagct

SEQ ID NO: 260494 - DNA, 25 bp, Rattus norvegicus
cgtcccttgaccatggcagaattga

SEQ ID NO: 260495 - DNA, 25 bp, Rattus norvegicus
cgtcccttgaccttggcagaattga

SEQ ID NO: 260496 - DNA, 25 bp, Rattus norvegicus
cgtcccttgtctatggttagccata

SEQ ID NO: 260497 - DNA, 25 bp, Rattus norvegicus
cgtcccttgtctttggttagccata

SEQ ID NO: 260498 - DNA, 25 bp, Rattus norvegicus
cgtccgcatgctaatcgctttttac

SEQ ID NO: 260499 - DNA, 25 bp, Rattus norvegicus
cgtccgcatgcttatcgctttttac

SEQ ID NO: 260500 - DNA, 25 bp, Rattus norvegicus
cgtccgcgtagcagccatctggcat

SEQ ID NO: 260501 - DNA, 25 bp, Rattus norvegicus
cgtccgcgtagctgccatctggcat

SEQ ID NO: 260502 - DNA, 25 bp, Rattus norvegicus
cgtcctacctgacaggtctggagta

SEQ ID NO: 260503 - DNA, 25 bp, Rattus norvegicus
cgtcctacctgagaggtctggagta

SEQ ID NO: 260504 - DNA, 25 bp, Rattus norvegicus
cgtcctcactacctgctgggctgag

SEQ ID NO: 260505 - DNA, 25 bp, Rattus norvegicus
cgtcctcactacgtgctgggctgag

SEQ ID NO: 260506 - DNA, 25 bp, Rattus norvegicus
cgtcctccacacagcatgtagaaga

SEQ ID NO: 260507 - DNA, 25 bp, Rattus norvegicus
cgtcctccacactgcatgtagaaga

SEQ ID NO: 260508 - DNA, 25 bp, Rattus norvegicus
cgtcctcccgttccacaagaaatga

SEQ ID NO: 260509 - DNA, 25 bp, Rattus norvegicus
cgtcctcccgttgcacaagaaatga

SEQ ID NO: 260510 - DNA, 25 bp, Rattus norvegicus
cgtcctcgttcactttcatatgtaa

SEQ ID NO: 260511 - DNA, 25 bp, Rattus norvegicus
cgtcctcgttcagtttcatatgtaa

SEQ ID NO: 260512 - DNA, 25 bp, Rattus norvegicus
cgtcctctagatacgccagaagaca

SEQ ID NO: 260513 - DNA, 25 bp, Rattus norvegicus
cgtcctctagattcgccagaagaca

SEQ ID NO: 260514 - DNA, 25 bp, Rattus norvegicus
cgtcctctgggaagctcctggagca

SEQ ID NO: 260515 - DNA, 25 bp, Rattus norvegicus
cgtcctctgggatgctcctggagca

SEQ ID NO: 260516 - DNA, 25 bp, Rattus norvegicus
cgtcctgagggaagggtagcttcat

SEQ ID NO: 260517 - DNA, 25 bp, Rattus norvegicus
cgtcctgagggatgggtagcttcat

SEQ ID NO: 260518 - DNA, 25 bp, Rattus norvegicus
cgtcctgggccactacaaatagcgg

SEQ ID NO: 260519 - DNA, 25 bp, Rattus norvegicus
cgtcctgggccagtacaaatagcgg

SEQ ID NO: 260520 - DNA, 25 bp, Rattus norvegicus
cgtcctgtcaccatctaacaataag

SEQ ID NO: 260521 - DNA, 25 bp, Rattus norvegicus
cgtcctgtcaccttctaacaataag

SEQ ID NO: 260522 - DNA, 25 bp, Rattus norvegicus
cgtcctgtcctcctgttggtgtgtg

SEQ ID NO: 260523 - DNA, 25 bp, Rattus norvegicus
cgtcctgtcctcgtgttggtgtgtg

SEQ ID NO: 260524 - DNA, 25 bp, Rattus norvegicus
cgtcctgttgtgacagcacctgata

SEQ ID NO: 260525 - DNA, 25 bp, Rattus norvegicus
cgtcctgttgtgtcagcacctgata

SEQ ID NO: 260526 - DNA, 25 bp, Rattus norvegicus
cgtccttagtgacctagcttcgaaa

SEQ ID NO: 260527 - DNA, 25 bp, Rattus norvegicus
cgtccttagtgagctagcttcgaaa

SEQ ID NO: 260528 - DNA, 25 bp, Rattus norvegicus
cgtccttatttcaatgcagatcgtc

SEQ ID NO: 260529 - DNA, 25 bp, Rattus norvegicus
cgtccttatttctatgcagatcgtc

SEQ ID NO: 260530 - DNA, 25 bp, Rattus norvegicus
cgtccttcacacagctgttaccaga

SEQ ID NO: 260531 - DNA, 25 bp, Rattus norvegicus
cgtccttcacactgctgttaccaga

SEQ ID NO: 260532 - DNA, 25 bp, Rattus norvegicus
cgtccttcaggtatgagtccttcaa

SEQ ID NO: 260533 - DNA, 25 bp, Rattus norvegicus
cgtccttcaggtttgagtccttcaa

SEQ ID NO: 260534 - DNA, 25 bp, Rattus norvegicus
cgtccttggagtctcgaggctgaaa

SEQ ID NO: 260535 - DNA, 25 bp, Rattus norvegicus
cgtccttggagtgtcgaggctgaaa

SEQ ID NO: 260536 - DNA, 25 bp, Rattus norvegicus
cgtccttgtctcctgtaatatactg

SEQ ID NO: 260537 - DNA, 25 bp, Rattus norvegicus
cgtccttgtctcgtgtaatatactg

SEQ ID NO: 260538 - DNA, 25 bp, Rattus norvegicus
cgtcctttccagattggatcagcta

SEQ ID NO: 260539 - DNA, 25 bp, Rattus norvegicus
cgtcctttccagtttggatcagcta

SEQ ID NO: 260540 - DNA, 25 bp, Rattus norvegicus
cgtcctttctatataaatgccctgc

SEQ ID NO: 260541 - DNA, 25 bp, Rattus norvegicus
cgtcctttctatttaaatgccctgc

SEQ ID NO: 260542 - DNA, 25 bp, Rattus norvegicus
cgtcgaacactccttgagtcattgt

SEQ ID NO: 260543 - DNA, 25 bp, Rattus norvegicus
cgtcgaacactcgttgagtcattgt

SEQ ID NO: 260544 - DNA, 25 bp, Rattus norvegicus
cgtcgatgagctccgcgtccatgca

SEQ ID NO: 260545 - DNA, 25 bp, Rattus norvegicus
cgtcgatgagctgcgcgtccatgca

SEQ ID NO: 260546 - DNA, 25 bp, Rattus norvegicus
cgtcgatgggttacagctgatgcct

SEQ ID NO: 260547 - DNA, 25 bp, Rattus norvegicus
cgtcgatgggtttcagctgatgcct

SEQ ID NO: 260548 - DNA, 25 bp, Rattus norvegicus
cgtcgcagccctcaggttgttgcct

SEQ ID NO: 260549 - DNA, 25 bp, Rattus norvegicus
cgtcgcagccctgaggttgttgcct

SEQ ID NO: 260550 - DNA, 25 bp, Rattus norvegicus
cgtcgccatgccacggaaaattgag

SEQ ID NO: 260551 - DNA, 25 bp, Rattus norvegicus
cgtcgccatgcctcggaaaattgag

SEQ ID NO: 260552 - DNA, 25 bp, Rattus norvegicus
cgtcgccgcagcagtggtcactgtt

SEQ ID NO: 260553 - DNA, 25 bp, Rattus norvegicus
cgtcgccgcagctgtggtcactgtt

SEQ ID NO: 260554 - DNA, 25 bp, Rattus norvegicus
cgtcgcctatcacgatgtagacagc

SEQ ID NO: 260555 - DNA, 25 bp, Rattus norvegicus
cgtcgcctatcaggatgtagacagc

SEQ ID NO: 260556 - DNA, 25 bp, Rattus norvegicus
cgtcgcggaggcactttggtccaga

SEQ ID NO: 260557 - DNA, 25 bp, Rattus norvegicus
cgtcgcggaggctctttggtccaga

SEQ ID NO: 260558 - DNA, 25 bp, Rattus norvegicus
cgtcgctcctggacagagccgcagg

SEQ ID NO: 260559 - DNA, 25 bp, Rattus norvegicus
cgtcgctcctggtcagagccgcagg

SEQ ID NO: 260560 - DNA, 25 bp, Rattus norvegicus
cgtcgctcgcgtagggccctggcgt

SEQ ID NO: 260561 - DNA, 25 bp, Rattus norvegicus
cgtcgctcgcgttgggccctggcgt

SEQ ID NO: 260562 - DNA, 25 bp, Rattus norvegicus
cgtcggatggcaccctacaaaggat

SEQ ID NO: 260563 - DNA, 25 bp, Rattus norvegicus
cgtcggatggcagcctacaaaggat

SEQ ID NO: 260564 - DNA, 25 bp, Rattus norvegicus
cgtcgggaattgaagtttgcgtaag

SEQ ID NO: 260565 - DNA, 25 bp, Rattus norvegicus
cgtcgggaattgtagtttgcgtaag

SEQ ID NO: 260566 - DNA, 25 bp, Rattus norvegicus
cgtcgggcacagaggcgtagctatt

SEQ ID NO: 260567 - DNA, 25 bp, Rattus norvegicus
cgtcgggcacagtggcgtagctatt

SEQ ID NO: 260568 - DNA, 25 bp, Rattus norvegicus
cgtcgggcacgcatcgggagtacaa

SEQ ID NO: 260569 - DNA, 25 bp, Rattus norvegicus
cgtcgggcacgcttcgggagtacaa

SEQ ID NO: 260570 - DNA, 25 bp, Rattus norvegicus
cgtcggtagcctatgtgtgtactta

SEQ ID NO: 260571 - DNA, 25 bp, Rattus norvegicus
cgtcggtagcctttgtgtgtactta

SEQ ID NO: 260572 - DNA, 25 bp, Rattus norvegicus
cgtcggtattcgcttctgccaggaa

SEQ ID NO: 260573 - DNA, 25 bp, Rattus norvegicus
cgtcggtattcggttctgccaggaa

SEQ ID NO: 260574 - DNA, 25 bp, Rattus norvegicus
cgtcggtgcgcaagctctccaagat

SEQ ID NO: 260575 - DNA, 25 bp, Rattus norvegicus
cgtcggtgcgcatgctctccaagat

SEQ ID NO: 260576 - DNA, 25 bp, Rattus norvegicus
cgtcggtgtcacaaaaatgttaaga

SEQ ID NO: 260577 - DNA, 25 bp, Rattus norvegicus
cgtcggtgtcactaaaatgttaaga

SEQ ID NO: 260578 - DNA, 25 bp, Rattus norvegicus
cgtcgtcaccgaccgttagtgggaa

SEQ ID NO: 260579 - DNA, 25 bp, Rattus norvegicus
cgtcgtcaccgagcgttagtgggaa

SEQ ID NO: 260580 - DNA, 25 bp, Rattus norvegicus
cgtcgtcacctcagtaatcgctgta

SEQ ID NO: 260581 - DNA, 25 bp, Rattus norvegicus
cgtcgtcacctctgtaatcgctgta

SEQ ID NO: 260582 - DNA, 25 bp, Rattus norvegicus
cgtcgtcatggtaaccggcccggcg

SEQ ID NO: 260583 - DNA, 25 bp, Rattus norvegicus
cgtcgtcatggttaccggcccggcg

SEQ ID NO: 260584 - DNA, 25 bp, Rattus norvegicus
cgtcgtgagtccaagagatgtcgtc

SEQ ID NO: 260585 - DNA, 25 bp, Rattus norvegicus
cgtcgtgagtcctagagatgtcgtc

SEQ ID NO: 260586 - DNA, 25 bp, Rattus norvegicus
cgtcgtgcttgccattcagaaaact

SEQ ID NO: 260587 - DNA, 25 bp, Rattus norvegicus
cgtcgtgcttgcgattcagaaaact

SEQ ID NO: 260588 - DNA, 25 bp, Rattus norvegicus
cgtcgtgtaatgagtgtgcgcctcc

SEQ ID NO: 260589 - DNA, 25 bp, Rattus norvegicus
cgtcgtgtaatgtgtgtgcgcctcc

SEQ ID NO: 260590 - DNA, 25 bp, Rattus norvegicus
cgtcgttttcggatgttcattcatg

SEQ ID NO: 260591 - DNA, 25 bp, Rattus norvegicus
cgtcgttttcggttgttcattcatg

SEQ ID NO: 260592 - DNA, 25 bp, Rattus norvegicus
cgtctacagtttcgccctgagatga

SEQ ID NO: 260593 - DNA, 25 bp, Rattus norvegicus
cgtctacagtttggccctgagatga

SEQ ID NO: 260594 - DNA, 25 bp, Rattus norvegicus
cgtctacatggacgccgcaagcaga

SEQ ID NO: 260595 - DNA, 25 bp, Rattus norvegicus
cgtctacatggaggccgcaagcaga

SEQ ID NO: 260596 - DNA, 25 bp, Rattus norvegicus
cgtctcacacggagcagccacggag

SEQ ID NO: 260597 - DNA, 25 bp, Rattus norvegicus
cgtctcacacggtgcagccacggag

SEQ ID NO: 260598 - DNA, 25 bp, Rattus norvegicus
cgtctcattaggagcacccatgtga

SEQ ID NO: 260599 - DNA, 25 bp, Rattus norvegicus
cgtctcattaggtgcacccatgtga

SEQ ID NO: 260600 - DNA, 25 bp, Rattus norvegicus
cgtctccagagccaagtcatttatt

SEQ ID NO: 260601 - DNA, 25 bp, Rattus norvegicus
cgtctccagagcgaagtcatttatt

SEQ ID NO: 260602 - DNA, 25 bp, Rattus norvegicus
cgtctccccagactcagtgttgaaa

SEQ ID NO: 260603 - DNA, 25 bp, Rattus norvegicus
cgtctccccagagtcagtgttgaaa

SEQ ID NO: 260604 - DNA, 25 bp, Rattus norvegicus
cgtctcgtcgcgaggccaggaactg

SEQ ID NO: 260605 - DNA, 25 bp, Rattus norvegicus
cgtctcgtcgcgtggccaggaactg

SEQ ID NO: 260606 - DNA, 25 bp, Rattus norvegicus
cgtctctaagagacccaaagtgaga

SEQ ID NO: 260607 - DNA, 25 bp, Rattus norvegicus
cgtctctaagagtcccaaagtgaga

SEQ ID NO: 260608 - DNA, 25 bp, Rattus norvegicus
cgtctctccagtactagcatgttta

SEQ ID NO: 260609 - DNA, 25 bp, Rattus norvegicus
cgtctctccagttctagcatgttta

SEQ ID NO: 260610 - DNA, 25 bp, Rattus norvegicus
cgtctcttccaacttcttgttagat

SEQ ID NO: 260611 - DNA, 25 bp, Rattus norvegicus
cgtctcttccaagttcttgttagat

SEQ ID NO: 260612 - DNA, 25 bp, Rattus norvegicus
cgtctcttctgaatactttgatttc

SEQ ID NO: 260613 - DNA, 25 bp, Rattus norvegicus
cgtctcttctgattactttgatttc

SEQ ID NO: 260614 - DNA, 25 bp, Rattus norvegicus
cgtctgaaacatccatgatgaccac

SEQ ID NO: 260615 - DNA, 25 bp, Rattus norvegicus
cgtctgaaacatgcatgatgaccac

SEQ ID NO: 260616 - DNA, 25 bp, Rattus norvegicus
cgtctgacggaactgccggtctgta

SEQ ID NO: 260617 - DNA, 25 bp, Rattus norvegicus
cgtctgacggaagtgccggtctgta

SEQ ID NO: 260618 - DNA, 25 bp, Rattus norvegicus
cgtctgactgtaagtgttggacacc

SEQ ID NO: 260619 - DNA, 25 bp, Rattus norvegicus
cgtctgactgtatgtgttggacacc

SEQ ID NO: 260620 - DNA, 25 bp, Rattus norvegicus
cgtctgatgaccacgtatcatgtta

SEQ ID NO: 260621 - DNA, 25 bp, Rattus norvegicus
cgtctgatgacctcgtatcatgtta

SEQ ID NO: 260622 - DNA, 25 bp, Rattus norvegicus
cgtctgcatcccatctggaaatggt

SEQ ID NO: 260623 - DNA, 25 bp, Rattus norvegicus
cgtctgcatcccttctggaaatggt

SEQ ID NO: 260624 - DNA, 25 bp, Rattus norvegicus
cgtctgctaatgctggcactgttta

SEQ ID NO: 260625 - DNA, 25 bp, Rattus norvegicus
cgtctgctaatggtggcactgttta

SEQ ID NO: 260626 - DNA, 25 bp, Rattus norvegicus
cgtctgctggttctggactatgcca

SEQ ID NO: 260627 - DNA, 25 bp, Rattus norvegicus
cgtctgctggttgtggactatgcca

SEQ ID NO: 260628 - DNA, 25 bp, Rattus norvegicus
cgtctgctgtgaacaaaacggcata

SEQ ID NO: 260629 - DNA, 25 bp, Rattus norvegicus
cgtctgctgtgatcaaaacggcata

SEQ ID NO: 260630 - DNA, 25 bp, Rattus norvegicus
cgtctgctttacaagggcaactact

SEQ ID NO: 260631 - DNA, 25 bp, Rattus norvegicus
cgtctgctttactagggcaactact

SEQ ID NO: 260632 - DNA, 25 bp, Rattus norvegicus
cgtctggatacgaaaatgattctgt

SEQ ID NO: 260633 - DNA, 25 bp, Rattus norvegicus
cgtctggatacgtaaatgattctgt

SEQ ID NO: 260634 - DNA, 25 bp, Rattus norvegicus
cgtctgtacaagatggtatccccat

SEQ ID NO: 260635 - DNA, 25 bp, Rattus norvegicus
cgtctgtacaagttggtatccccat

SEQ ID NO: 260636 - DNA, 25 bp, Rattus norvegicus
cgtctgtaccagatgtcctgtctga

SEQ ID NO: 260637 - DNA, 25 bp, Rattus norvegicus
cgtctgtaccagttgtcctgtctga

SEQ ID NO: 260638 - DNA, 25 bp, Rattus norvegicus
cgtctgtctgttaattccggatttg

SEQ ID NO: 260639 - DNA, 25 bp, Rattus norvegicus
cgtctgtctgtttattccggatttg

SEQ ID NO: 260640 - DNA, 25 bp, Rattus norvegicus
cgtctgtggcgacttccttaggata

SEQ ID NO: 260641 - DNA, 25 bp, Rattus norvegicus
cgtctgtggcgagttccttaggata

SEQ ID NO: 260642 - DNA, 25 bp, Rattus norvegicus
cgtctgttaagacggtgatcttatt

SEQ ID NO: 260643 - DNA, 25 bp, Rattus norvegicus
cgtctgttaagagggtgatcttatt

SEQ ID NO: 260644 - DNA, 25 bp, Rattus norvegicus
cgtcttagccttccggacagtttta

SEQ ID NO: 260645 - DNA, 25 bp, Rattus norvegicus
cgtcttagccttgcggacagtttta

SEQ ID NO: 260646 - DNA, 25 bp, Rattus norvegicus
cgtcttcaccaccatggagaaggct

SEQ ID NO: 260647 - DNA, 25 bp, Rattus norvegicus
cgtcttcaccacgatggagaaggct

SEQ ID NO: 260648 - DNA, 25 bp, Rattus norvegicus
cgtcttcagatcatccttcctatat

SEQ ID NO: 260649 - DNA, 25 bp, Rattus norvegicus
cgtcttcagatcttccttcctatat

SEQ ID NO: 260650 - DNA, 25 bp, Rattus norvegicus
cgtcttccaagacctgggcaggata

SEQ ID NO: 260651 - DNA, 25 bp, Rattus norvegicus
cgtcttccaagagctgggcaggata

SEQ ID NO: 260652 - DNA, 25 bp, Rattus norvegicus
cgtcttctgtggcttgatcatgtac

SEQ ID NO: 260653 - DNA, 25 bp, Rattus norvegicus
cgtcttctgtgggttgatcatgtac

SEQ ID NO: 260654 - DNA, 25 bp, Rattus norvegicus
cgtcttgaacagccgctgatgaccc

SEQ ID NO: 260655 - DNA, 25 bp, Rattus norvegicus
cgtcttgaacaggcgctgatgaccc

SEQ ID NO: 260656 - DNA, 25 bp, Rattus norvegicus
cgtcttgctgataggagttggctat

SEQ ID NO: 260657 - DNA, 25 bp, Rattus norvegicus
cgtcttgctgattggagttggctat

SEQ ID NO: 260658 - DNA, 25 bp, Rattus norvegicus
cgtcttgctttaccccaagcttaca

SEQ ID NO: 260659 - DNA, 25 bp, Rattus norvegicus
cgtcttgctttagcccaagcttaca

SEQ ID NO: 260660 - DNA, 25 bp, Rattus norvegicus
cgtctttccaaaaatccacctggag

SEQ ID NO: 260661 - DNA, 25 bp, Rattus norvegicus
cgtctttccaaatatccacctggag

SEQ ID NO: 260662 - DNA, 25 bp, Rattus norvegicus
cgtctttcctggatcactacagtga

SEQ ID NO: 260663 - DNA, 25 bp, Rattus norvegicus
cgtctttcctggttcactacagtga

SEQ ID NO: 260664 - DNA, 25 bp, Rattus norvegicus
cgtctttgccggagtactcgaaggg

SEQ ID NO: 260665 - DNA, 25 bp, Rattus norvegicus
cgtctttgccggtgtactcgaaggg

SEQ ID NO: 260666 - DNA, 25 bp, Rattus norvegicus
cgtctttgccgtaagctagtattat

SEQ ID NO: 260667 - DNA, 25 bp, Rattus norvegicus
cgtctttgccgttagctagtattat

SEQ ID NO: 260668 - DNA, 25 bp, Rattus norvegicus
cgtctttttcttccttcattagtag

SEQ ID NO: 260669 - DNA, 25 bp, Rattus norvegicus
cgtctttttcttgcttcattagtag

SEQ ID NO: 260670 - DNA, 25 bp, Rattus norvegicus
cgtgaaatttcactcgtgccgaatt

SEQ ID NO: 260671 - DNA, 25 bp, Rattus norvegicus
cgtgaaatttcagtcgtgccgaatt

SEQ ID NO: 260672 - DNA, 25 bp, Rattus norvegicus
cgtgaacactgcatccaggatggaa

SEQ ID NO: 260673 - DNA, 25 bp, Rattus norvegicus
cgtgaacactgcttccaggatggaa

SEQ ID NO: 260674 - DNA, 25 bp, Rattus norvegicus
cgtgaacctgctcctcaataaggga

SEQ ID NO: 260675 - DNA, 25 bp, Rattus norvegicus
cgtgaacctgctgctcaataaggga

SEQ ID NO: 260676 - DNA, 25 bp, Rattus norvegicus
cgtgaagcttatatccaactcggat

SEQ ID NO: 260677 - DNA, 25 bp, Rattus norvegicus
cgtgaagcttatttccaactcggat

SEQ ID NO: 260678 - DNA, 25 bp, Rattus norvegicus
cgtgaagggcctatgtgaccttcgt

SEQ ID NO: 260679 - DNA, 25 bp, Rattus norvegicus
cgtgaagggcctttgtgaccttcgt

SEQ ID NO: 260680 - DNA, 25 bp, Rattus norvegicus
cgtgaatggcccactgcaggctgga

SEQ ID NO: 260681 - DNA, 25 bp, Rattus norvegicus
cgtgaatggccctctgcaggctgga

SEQ ID NO: 260682 - DNA, 25 bp, Rattus norvegicus
cgtgaatttgaactccaggctctaa

SEQ ID NO: 260683 - DNA, 25 bp, Rattus norvegicus
cgtgaatttgaagtccaggctctaa

SEQ ID NO: 260684 - DNA, 25 bp, Rattus norvegicus
cgtgacaaccagcaaaggtgctttc

SEQ ID NO: 260685 - DNA, 25 bp, Rattus norvegicus
cgtgacaaccaggaaaggtgctttc

SEQ ID NO: 260686 - DNA, 25 bp, Rattus norvegicus
cgtgacagatggcttcttttgctgc

SEQ ID NO: 260687 - DNA, 25 bp, Rattus norvegicus
cgtgacagatgggttcttttgctgc

SEQ ID NO: 260688 - DNA, 25 bp, Rattus norvegicus
cgtgacagtcgcacgttagggaaat

SEQ ID NO: 260689 - DNA, 25 bp, Rattus norvegicus
cgtgacagtcgctcgttagggaaat

SEQ ID NO: 260690 - DNA, 25 bp, Rattus norvegicus
cgtgaccaacgtacgaactgtactc

SEQ ID NO: 260691 - DNA, 25 bp, Rattus norvegicus
cgtgaccaacgttcgaactgtactc

SEQ ID NO: 260692 - DNA, 25 bp, Rattus norvegicus
cgtgacctcacacccatggatggaa

SEQ ID NO: 260693 - DNA, 25 bp, Rattus norvegicus
cgtgacctcacagccatggatggaa

SEQ ID NO: 260694 - DNA, 25 bp, Rattus norvegicus
cgtgacgtcatgatctacctggaga

SEQ ID NO: 260695 - DNA, 25 bp, Rattus norvegicus
cgtgacgtcatgttctacctggaga

SEQ ID NO: 260696 - DNA, 25 bp, Rattus norvegicus
cgtgacgtgggtacaatcagccaga

SEQ ID NO: 260697 - DNA, 25 bp, Rattus norvegicus
cgtgacgtgggttcaatcagccaga

SEQ ID NO: 260698 - DNA, 25 bp, Rattus norvegicus
cgtgactgacacagacttggagata

SEQ ID NO: 260699 - DNA, 25 bp, Rattus norvegicus
cgtgactgacactgacttggagata

SEQ ID NO: 260700 - DNA, 25 bp, Rattus norvegicus
cgtgacttactacttcttttatgaa

SEQ ID NO: 260701 - DNA, 25 bp, Rattus norvegicus
cgtgacttactagttcttttatgaa

SEQ ID NO: 260702 - DNA, 25 bp, Rattus norvegicus
cgtgacttctgtctattctggtcca

SEQ ID NO: 260703 - DNA, 25 bp, Rattus norvegicus
cgtgacttctgtgtattctggtcca

SEQ ID NO: 260704 - DNA, 25 bp, Rattus norvegicus
cgtgagaacgagctcctggaagcct

SEQ ID NO: 260705 - DNA, 25 bp, Rattus norvegicus
cgtgagaacgaggtcctggaagcct

SEQ ID NO: 260706 - DNA, 25 bp, Rattus norvegicus
cgtgagacggccctggaaagcgcgg

SEQ ID NO: 260707 - DNA, 25 bp, Rattus norvegicus
cgtgagacggccgtggaaagcgcgg

SEQ ID NO: 260708 - DNA, 25 bp, Rattus norvegicus
cgtgagatacagcaccaggcagttt

SEQ ID NO: 260709 - DNA, 25 bp, Rattus norvegicus
cgtgagatacaggaccaggcagttt

SEQ ID NO: 260710 - DNA, 25 bp, Rattus norvegicus
cgtgagatcgtgcaccgcaagtaca

SEQ ID NO: 260711 - DNA, 25 bp, Rattus norvegicus
cgtgagatcgtggaccgcaagtaca

SEQ ID NO: 260712 - DNA, 25 bp, Rattus norvegicus
cgtgagcaccccagggaggtcatgc

SEQ ID NO: 260713 - DNA, 25 bp, Rattus norvegicus
cgtgagcacccctgggaggtcatgc

SEQ ID NO: 260714 - DNA, 25 bp, Rattus norvegicus
cgtgagcccgagattatgagaatta

SEQ ID NO: 260715 - DNA, 25 bp, Rattus norvegicus
cgtgagcccgagtttatgagaatta

SEQ ID NO: 260716 - DNA, 25 bp, Rattus norvegicus
cgtgagcctgaaagagatgcgctgt

SEQ ID NO: 260717 - DNA, 25 bp, Rattus norvegicus
cgtgagcctgaatgagatgcgctgt

SEQ ID NO: 260718 - DNA, 25 bp, Rattus norvegicus
cgtgaggcacgaaagaataataata

SEQ ID NO: 260719 - DNA, 25 bp, Rattus norvegicus
cgtgaggcacgatagaataataata

SEQ ID NO: 260720 - DNA, 25 bp, Rattus norvegicus
cgtgaggccagcattcattaacttt

SEQ ID NO: 260721 - DNA, 25 bp, Rattus norvegicus
cgtgaggccagctttcattaacttt

SEQ ID NO: 260722 - DNA, 25 bp, Rattus norvegicus
cgtgagttccctcgcaccagcggga

SEQ ID NO: 260723 - DNA, 25 bp, Rattus norvegicus
cgtgagttccctggcaccagcggga

SEQ ID NO: 260724 - DNA, 25 bp, Rattus norvegicus
cgtgatatgggcatccaggatgacg

SEQ ID NO: 260725 - DNA, 25 bp, Rattus norvegicus
cgtgatatgggcttccaggatgacg

SEQ ID NO: 260726 - DNA, 25 bp, Rattus norvegicus
cgtgatctggatcccgattatgttc

SEQ ID NO: 260727 - DNA, 25 bp, Rattus norvegicus
cgtgatctggatgccgattatgttc

SEQ ID NO: 260728 - DNA, 25 bp, Rattus norvegicus
cgtgcaaatggcaagtgtagaaatt

SEQ ID NO: 260729 - DNA, 25 bp, Rattus norvegicus
cgtgcaaatggctagtgtagaaatt

SEQ ID NO: 260730 - DNA, 25 bp, Rattus norvegicus
cgtgcaaccaccaacttttgttatc

SEQ ID NO: 260731 - DNA, 25 bp, Rattus norvegicus
cgtgcaaccacctacttttgttatc

SEQ ID NO: 260732 - DNA, 25 bp, Rattus norvegicus
cgtgcaagggtgaatgttcgtctca

SEQ ID NO: 260733 - DNA, 25 bp, Rattus norvegicus
cgtgcaagggtgtatgttcgtctca

SEQ ID NO: 260734 - DNA, 25 bp, Rattus norvegicus
cgtgcaatgcttcttgtccagccaa

SEQ ID NO: 260735 - DNA, 25 bp, Rattus norvegicus
cgtgcaatgcttgttgtccagccaa

SEQ ID NO: 260736 - DNA, 25 bp, Rattus norvegicus
cgtgcacagaggagggacgctttcc

SEQ ID NO: 260737 - DNA, 25 bp, Rattus norvegicus
cgtgcacagaggtgggacgctttcc

SEQ ID NO: 260738 - DNA, 25 bp, Rattus norvegicus
cgtgcacgacctacagcagggactt

SEQ ID NO: 260739 - DNA, 25 bp, Rattus norvegicus
cgtgcacgaccttcagcagggactt

SEQ ID NO: 260740 - DNA, 25 bp, Rattus norvegicus
cgtgcactatatacagtgacttcct

SEQ ID NO: 260741 - DNA, 25 bp, Rattus norvegicus
cgtgcactatattcagtgacttcct

SEQ ID NO: 260742 - DNA, 25 bp, Rattus norvegicus
cgtgcactcacaataggctatcttg

SEQ ID NO: 260743 - DNA, 25 bp, Rattus norvegicus
cgtgcactcacattaggctatcttg

SEQ ID NO: 260744 - DNA, 25 bp, Rattus norvegicus
cgtgcactcttgacaagccatttat

SEQ ID NO: 260745 - DNA, 25 bp, Rattus norvegicus
cgtgcactcttgtcaagccatttat

SEQ ID NO: 260746 - DNA, 25 bp, Rattus norvegicus
cgtgcactgtgcagtattccaagta

SEQ ID NO: 260747 - DNA, 25 bp, Rattus norvegicus
cgtgcactgtgctgtattccaagta

SEQ ID NO: 260748 - DNA, 25 bp, Rattus norvegicus
cgtgcagagacgagtggacgccaat

SEQ ID NO: 260749 - DNA, 25 bp, Rattus norvegicus
cgtgcagagacgtgtggacgccaat

SEQ ID NO: 260750 - DNA, 25 bp, Rattus norvegicus
cgtgcagagagacgcgcaaagacta

SEQ ID NO: 260751 - DNA, 25 bp, Rattus norvegicus
cgtgcagagagaggcgcaaagacta

SEQ ID NO: 260752 - DNA, 25 bp, Rattus norvegicus
cgtgcagcaagcctgaaaagattct

SEQ ID NO: 260753 - DNA, 25 bp, Rattus norvegicus
cgtgcagcaagcgtgaaaagattct

SEQ ID NO: 260754 - DNA, 25 bp, Rattus norvegicus
cgtgcagcactaagtccctgagttc

SEQ ID NO: 260755 - DNA, 25 bp, Rattus norvegicus
cgtgcagcactatgtccctgagttc

SEQ ID NO: 260756 - DNA, 25 bp, Rattus norvegicus
cgtgcagccttgattcttgcagtag

SEQ ID NO: 260757 - DNA, 25 bp, Rattus norvegicus
cgtgcagccttgtttcttgcagtag

SEQ ID NO: 260758 - DNA, 25 bp, Rattus norvegicus
cgtgcagcgtggacttctgagtgaa

SEQ ID NO: 260759 - DNA, 25 bp, Rattus norvegicus
cgtgcagcgtggtcttctgagtgaa

SEQ ID NO: 260760 - DNA, 25 bp, Rattus norvegicus
cgtgcagctcgcacaggagatggca

SEQ ID NO: 260761 - DNA, 25 bp, Rattus norvegicus
cgtgcagctcgctcaggagatggca

SEQ ID NO: 260762 - DNA, 25 bp, Rattus norvegicus
cgtgcaggacgcaacgccccgggaa

SEQ ID NO: 260763 - DNA, 25 bp, Rattus norvegicus
cgtgcaggacgctacgccccgggaa

SEQ ID NO: 260764 - DNA, 25 bp, Rattus norvegicus
cgtgcagtcattacaagccttgtta

SEQ ID NO: 260765 - DNA, 25 bp, Rattus norvegicus
cgtgcagtcatttcaagccttgtta

SEQ ID NO: 260766 - DNA, 25 bp, Rattus norvegicus
cgtgcagttgagctgtgagcttcca

SEQ ID NO: 260767 - DNA, 25 bp, Rattus norvegicus
cgtgcagttgaggtgtgagcttcca

SEQ ID NO: 260768 - DNA, 25 bp, Rattus norvegicus
cgtgcatccccacacttaattgaac

SEQ ID NO: 260769 - DNA, 25 bp, Rattus norvegicus
cgtgcatccccagacttaattgaac

SEQ ID NO: 260770 - DNA, 25 bp, Rattus norvegicus
cgtgccaaacccaagatgtcctgag

SEQ ID NO: 260771 - DNA, 25 bp, Rattus norvegicus
cgtgccaaaccctagatgtcctgag

SEQ ID NO: 260772 - DNA, 25 bp, Rattus norvegicus
cgtgccaatcttagaacgtgatagt

SEQ ID NO: 260773 - DNA, 25 bp, Rattus norvegicus
cgtgccaatctttgaacgtgatagt

SEQ ID NO: 260774 - DNA, 25 bp, Rattus norvegicus
cgtgccagagatagaggtccaggtc

SEQ ID NO: 260775 - DNA, 25 bp, Rattus norvegicus
cgtgccagagattgaggtccaggtc

SEQ ID NO: 260776 - DNA, 25 bp, Rattus norvegicus
cgtgcccaatgacggttgcttgaac

SEQ ID NO: 260777 - DNA, 25 bp, Rattus norvegicus
cgtgcccaatgagggttgcttgaac

SEQ ID NO: 260778 - DNA, 25 bp, Rattus norvegicus
cgtgcccacgtgctctgttacagag

SEQ ID NO: 260779 - DNA, 25 bp, Rattus norvegicus
cgtgcccacgtggtctgttacagag

SEQ ID NO: 260780 - DNA, 25 bp, Rattus norvegicus
cgtgcccgacaactgcaagtttcta

SEQ ID NO: 260781 - DNA, 25 bp, Rattus norvegicus
cgtgcccgacaagtgcaagtttcta

SEQ ID NO: 260782 - DNA, 25 bp, Rattus norvegicus
cgtgccctggacagtagtgtttaga

SEQ ID NO: 260783 - DNA, 25 bp, Rattus norvegicus
cgtgccctggactgtagtgtttaga

SEQ ID NO: 260784 - DNA, 25 bp, Rattus norvegicus
cgtgccctgggacagtgtttatttc

SEQ ID NO: 260785 - DNA, 25 bp, Rattus norvegicus
cgtgccctgggagagtgtttatttc

SEQ ID NO: 260786 - DNA, 25 bp, Rattus norvegicus
cgtgccgagacgacgaggccagtca

SEQ ID NO: 260787 - DNA, 25 bp, Rattus norvegicus
cgtgccgagacgtcgaggccagtca

SEQ ID NO: 260788 - DNA, 25 bp, Rattus norvegicus
cgtgcctacatgaacctggacatat

SEQ ID NO: 260789 - DNA, 25 bp, Rattus norvegicus
cgtgcctacatgtacctggacatat

SEQ ID NO: 260790 - DNA, 25 bp, Rattus norvegicus
cgtgcctaccatcaaatacatcttt

SEQ ID NO: 260791 - DNA, 25 bp, Rattus norvegicus
cgtgcctaccatgaaatacatcttt

SEQ ID NO: 260792 - DNA, 25 bp, Rattus norvegicus
cgtgcctaggctccaggacacatgg

SEQ ID NO: 260793 - DNA, 25 bp, Rattus norvegicus
cgtgcctaggctgcaggacacatgg

SEQ ID NO: 260794 - DNA, 25 bp, Rattus norvegicus
cgtgcctgattgagtctgtggatga

SEQ ID NO: 260795 - DNA, 25 bp, Rattus norvegicus
cgtgcctgattgtgtctgtggatga

SEQ ID NO: 260796 - DNA, 25 bp, Rattus norvegicus
cgtgcctgtcacacacaggatatga

SEQ ID NO: 260797 - DNA, 25 bp, Rattus norvegicus
cgtgcctgtcactcacaggatatga

SEQ ID NO: 260798 - DNA, 25 bp, Rattus norvegicus
cgtgccttaacgacctgagaatgtt

SEQ ID NO: 260799 - DNA, 25 bp, Rattus norvegicus
cgtgccttaacgtcctgagaatgtt

SEQ ID NO: 260800 - DNA, 25 bp, Rattus norvegicus
cgtgccttggttagtcacatatcaa

SEQ ID NO: 260801 - DNA, 25 bp, Rattus norvegicus
cgtgccttggtttgtcacatatcaa

SEQ ID NO: 260802 - DNA, 25 bp, Rattus norvegicus
cgtgcgacacttccggacagaatac

SEQ ID NO: 260803 - DNA, 25 bp, Rattus norvegicus
cgtgcgacacttgcggacagaatac

SEQ ID NO: 260804 - DNA, 25 bp, Rattus norvegicus
cgtgcgatgggtcctcgcttcgtct

SEQ ID NO: 260805 - DNA, 25 bp, Rattus norvegicus
cgtgcgatgggtgctcgcttcgtct

SEQ ID NO: 260806 - DNA, 25 bp, Rattus norvegicus
cgtgcggatctaatacagctgttta

SEQ ID NO: 260807 - DNA, 25 bp, Rattus norvegicus
cgtgcggatctattacagctgttta

SEQ ID NO: 260808 - DNA, 25 bp, Rattus norvegicus
cgtgcggctggtatgtgtttccacc

SEQ ID NO: 260809 - DNA, 25 bp, Rattus norvegicus
cgtgcggctggtttgtgtttccacc

SEQ ID NO: 260810 - DNA, 25 bp, Rattus norvegicus
cgtgcgggcaatatgttctgattct

SEQ ID NO: 260811 - DNA, 25 bp, Rattus norvegicus
cgtgcgggcaatttgttctgattct

SEQ ID NO: 260812 - DNA, 25 bp, Rattus norvegicus
cgtgcggtgtttcccagaagtcctt

SEQ ID NO: 260813 - DNA, 25 bp, Rattus norvegicus
cgtgcggtgtttgccagaagtcctt

SEQ ID NO: 260814 - DNA, 25 bp, Rattus norvegicus
cgtgcgtcagcgagatcttcggtaa

SEQ ID NO: 260815 - DNA, 25 bp, Rattus norvegicus
cgtgcgtcagcgtgatcttcggtaa

SEQ ID NO: 260816 - DNA, 25 bp, Rattus norvegicus
cgtgctattttaacatgtgtgccga

SEQ ID NO: 260817 - DNA, 25 bp, Rattus norvegicus
cgtgctattttatcatgtgtgccga

SEQ ID NO: 260818 - DNA, 25 bp, Rattus norvegicus
cgtgctcagttccattacagtttta

SEQ ID NO: 260819 - DNA, 25 bp, Rattus norvegicus
cgtgctcagttcgattacagtttta

SEQ ID NO: 260820 - DNA, 25 bp, Rattus norvegicus
cgtgctcctagaagtactcctgcca

SEQ ID NO: 260821 - DNA, 25 bp, Rattus norvegicus
cgtgctcctagatgtactcctgcca

SEQ ID NO: 260822 - DNA, 25 bp, Rattus norvegicus
cgtgctcctcatcaattttgtgttt

SEQ ID NO: 260823 - DNA, 25 bp, Rattus norvegicus
cgtgctcctcatgaattttgtgttt

SEQ ID NO: 260824 - DNA, 25 bp, Rattus norvegicus
cgtgctctcattcgcttggaagtgg

SEQ ID NO: 260825 - DNA, 25 bp, Rattus norvegicus
cgtgctctcattggcttggaagtgg

SEQ ID NO: 260826 - DNA, 25 bp, Rattus norvegicus
cgtgctctcgttcacgccgaagtgg

SEQ ID NO: 260827 - DNA, 25 bp, Rattus norvegicus
cgtgctctcgttgacgccgaagtgg

SEQ ID NO: 260828 - DNA, 25 bp, Rattus norvegicus
cgtgctgacaccacagggcttttgg

SEQ ID NO: 260829 - DNA, 25 bp, Rattus norvegicus
cgtgctgacacctcagggcttttgg

SEQ ID NO: 260830 - DNA, 25 bp, Rattus norvegicus
cgtgctgagcagattcctagaagat

SEQ ID NO: 260831 - DNA, 25 bp, Rattus norvegicus
cgtgctgagcagtttcctagaagat

SEQ ID NO: 260832 - DNA, 25 bp, Rattus norvegicus
cgtgctgaggcaattgtgtgttcca

SEQ ID NO: 260833 - DNA, 25 bp, Rattus norvegicus
cgtgctgaggcatttgtgtgttcca

SEQ ID NO: 260834 - DNA, 25 bp, Rattus norvegicus
cgtgctgccacgagtagtggcttta

SEQ ID NO: 260835 - DNA, 25 bp, Rattus norvegicus
cgtgctgccacgtgtagtggcttta

SEQ ID NO: 260836 - DNA, 25 bp, Rattus norvegicus
cgtgctgctcgcaagttgaggcaat

SEQ ID NO: 260837 - DNA, 25 bp, Rattus norvegicus
cgtgctgctcgctagttgaggcaat

SEQ ID NO: 260838 - DNA, 25 bp, Rattus norvegicus
cgtgctgggctgcatactttttgtt

SEQ ID NO: 260839 - DNA, 25 bp, Rattus norvegicus
cgtgctgggctggatactttttgtt

SEQ ID NO: 260840 - DNA, 25 bp, Rattus norvegicus
cgtgctgtcttcacaaacgtggtgt

SEQ ID NO: 260841 - DNA, 25 bp, Rattus norvegicus
cgtgctgtcttctcaaacgtggtgt

SEQ ID NO: 260842 - DNA, 25 bp, Rattus norvegicus
cgtgctgtgctgcaatgttgtgact

SEQ ID NO: 260843 - DNA, 25 bp, Rattus norvegicus
cgtgctgtgctggaatgttgtgact

SEQ ID NO: 260844 - DNA, 25 bp, Rattus norvegicus
cgtgctgttgtgagaatgcttccta

SEQ ID NO: 260845 - DNA, 25 bp, Rattus norvegicus
cgtgctgttgtgtgaatgcttccta

SEQ ID NO: 260846 - DNA, 25 bp, Rattus norvegicus
cgtgctgtttgaaccgacgggctga

SEQ ID NO: 260847 - DNA, 25 bp, Rattus norvegicus
cgtgctgtttgatccgacgggctga

SEQ ID NO: 260848 - DNA, 25 bp, Rattus norvegicus
cgtgcttaatatagtatcactgaag

SEQ ID NO: 260849 - DNA, 25 bp, Rattus norvegicus
cgtgcttaatattgtatcactgaag

SEQ ID NO: 260850 - DNA, 25 bp, Rattus norvegicus
cgtgcttcagttagttacctttgta

SEQ ID NO: 260851 - DNA, 25 bp, Rattus norvegicus
cgtgcttcagtttgttacctttgta

SEQ ID NO: 260852 - DNA, 25 bp, Rattus norvegicus
cgtgcttcgacccacttatatatgg

SEQ ID NO: 260853 - DNA, 25 bp, Rattus norvegicus
cgtgcttcgaccgacttatatatgg

SEQ ID NO: 260854 - DNA, 25 bp, Rattus norvegicus
cgtgcttctacgcagaggagtgtca

SEQ ID NO: 260855 - DNA, 25 bp, Rattus norvegicus
cgtgcttctacggagaggagtgtca

SEQ ID NO: 260856 - DNA, 25 bp, Rattus norvegicus
cgtggaaacactacaggactacttt

SEQ ID NO: 260857 - DNA, 25 bp, Rattus norvegicus
cgtggaaacacttcaggactacttt

SEQ ID NO: 260858 - DNA, 25 bp, Rattus norvegicus
cgtggaacctggacagtgggcctcc

SEQ ID NO: 260859 - DNA, 25 bp, Rattus norvegicus
cgtggaacctggtcagtgggcctcc

SEQ ID NO: 260860 - DNA, 25 bp, Rattus norvegicus
cgtggaaccttacggtgaacctcat

SEQ ID NO: 260861 - DNA, 25 bp, Rattus norvegicus
cgtggaaccttagggtgaacctcat

SEQ ID NO: 260862 - DNA, 25 bp, Rattus norvegicus
cgtggaagacctccttggtgccctg

SEQ ID NO: 260863 - DNA, 25 bp, Rattus norvegicus
cgtggaagacctgcttggtgccctg

SEQ ID NO: 260864 - DNA, 25 bp, Rattus norvegicus
cgtggacagaccaataacgccgctt

SEQ ID NO: 260865 - DNA, 25 bp, Rattus norvegicus
cgtggacagacctataacgccgctt

SEQ ID NO: 260866 - DNA, 25 bp, Rattus norvegicus
cgtggacagtatatcctcagaggaa

SEQ ID NO: 260867 - DNA, 25 bp, Rattus norvegicus
cgtggacagtatttcctcagaggaa

SEQ ID NO: 260868 - DNA, 25 bp, Rattus norvegicus
cgtggacatcacatggacagcagga

SEQ ID NO: 260869 - DNA, 25 bp, Rattus norvegicus
cgtggacatcacttggacagcagga

SEQ ID NO: 260870 - DNA, 25 bp, Rattus norvegicus
cgtggacatgatattgggccgttct

SEQ ID NO: 260871 - DNA, 25 bp, Rattus norvegicus
cgtggacatgattttgggccgttct

SEQ ID NO: 260872 - DNA, 25 bp, Rattus norvegicus
cgtggaccctcgacgggagcacgaa

SEQ ID NO: 260873 - DNA, 25 bp, Rattus norvegicus
cgtggaccctcgtcgggagcacgaa

SEQ ID NO: 260874 - DNA, 25 bp, Rattus norvegicus
cgtggacctccaaggcagcggcaag

SEQ ID NO: 260875 - DNA, 25 bp, Rattus norvegicus
cgtggacctccatggcagcggcaag

SEQ ID NO: 260876 - DNA, 25 bp, Rattus norvegicus
cgtggactgactcggtttggattat

SEQ ID NO: 260877 - DNA, 25 bp, Rattus norvegicus
cgtggactgactgggtttggattat

SEQ ID NO: 260878 - DNA, 25 bp, Rattus norvegicus
cgtggactgcctactcctagaaatc

SEQ ID NO: 260879 - DNA, 25 bp, Rattus norvegicus
cgtggactgccttctcctagaaatc

SEQ ID NO: 260880 - DNA, 25 bp, Rattus norvegicus
cgtggactggctccccagagagaca

SEQ ID NO: 260881 - DNA, 25 bp, Rattus norvegicus
cgtggactggctgcccagagagaca

SEQ ID NO: 260882 - DNA, 25 bp, Rattus norvegicus
cgtggacttgatccagtgacgacaa

SEQ ID NO: 260883 - DNA, 25 bp, Rattus norvegicus
cgtggacttgatgcagtgacgacaa

SEQ ID NO: 260884 - DNA, 25 bp, Rattus norvegicus
cgtggagaagacagtggcccctaca

SEQ ID NO: 260885 - DNA, 25 bp, Rattus norvegicus
cgtggagaagactgtggcccctaca

SEQ ID NO: 260886 - DNA, 25 bp, Rattus norvegicus
cgtggagaatgcacaaggcttcgaa

SEQ ID NO: 260887 - DNA, 25 bp, Rattus norvegicus
cgtggagaatgctcaaggcttcgaa

SEQ ID NO: 260888 - DNA, 25 bp, Rattus norvegicus
cgtggagatcttaggcagtgccatt

SEQ ID NO: 260889 - DNA, 25 bp, Rattus norvegicus
cgtggagatctttggcagtgccatt

SEQ ID NO: 260890 - DNA, 25 bp, Rattus norvegicus
cgtggagcaagtaaacctttttcat

SEQ ID NO: 260891 - DNA, 25 bp, Rattus norvegicus
cgtggagcaagttaacctttttcat

SEQ ID NO: 260892 - DNA, 25 bp, Rattus norvegicus
cgtggagcagctcatgtacgtcaag

SEQ ID NO: 260893 - DNA, 25 bp, Rattus norvegicus
cgtggagcagctgatgtacgtcaag

SEQ ID NO: 260894 - DNA, 25 bp, Rattus norvegicus
cgtggaggtgcacccatcccagtgt

SEQ ID NO: 260895 - DNA, 25 bp, Rattus norvegicus
cgtggaggtgcagccatcccagtgt

SEQ ID NO: 260896 - DNA, 25 bp, Rattus norvegicus
cgtggagtatacagtccgacaaatt

SEQ ID NO: 260897 - DNA, 25 bp, Rattus norvegicus
cgtggagtatactgtccgacaaatt

SEQ ID NO: 260898 - DNA, 25 bp, Rattus norvegicus
cgtggagttcacctagcgagcactc

SEQ ID NO: 260899 - DNA, 25 bp, Rattus norvegicus
cgtggagttcacgtagcgagcactc

SEQ ID NO: 260900 - DNA, 25 bp, Rattus norvegicus
cgtggatcttggcagctcatgcttg

SEQ ID NO: 260901 - DNA, 25 bp, Rattus norvegicus
cgtggatcttgggagctcatgcttg

SEQ ID NO: 260902 - DNA, 25 bp, Rattus norvegicus
cgtggatgtatccagctccctgagg

SEQ ID NO: 260903 - DNA, 25 bp, Rattus norvegicus
cgtggatgtatcgagctccctgagg

SEQ ID NO: 260904 - DNA, 25 bp, Rattus norvegicus
cgtggcaaacctcctttcagaaagc

SEQ ID NO: 260905 - DNA, 25 bp, Rattus norvegicus
cgtggcaaacctgctttcagaaagc

SEQ ID NO: 260906 - DNA, 25 bp, Rattus norvegicus
cgtggcagagctcgcgtgacaccta

SEQ ID NO: 260907 - DNA, 25 bp, Rattus norvegicus
cgtggcagagctggcgtgacaccta

SEQ ID NO: 260908 - DNA, 25 bp, Rattus norvegicus
cgtggcagcagtcacagccggtcct

SEQ ID NO: 260909 - DNA, 25 bp, Rattus norvegicus
cgtggcagcagtgacagccggtcct

SEQ ID NO: 260910 - DNA, 25 bp, Rattus norvegicus
cgtggcagtcatccttagtctagaa

SEQ ID NO: 260911 - DNA, 25 bp, Rattus norvegicus
cgtggcagtcatgcttagtctagaa

SEQ ID NO: 260912 - DNA, 25 bp, Rattus norvegicus
cgtggcatccagacactcgaaaagc

SEQ ID NO: 260913 - DNA, 25 bp, Rattus norvegicus
cgtggcatccagtcactcgaaaagc

SEQ ID NO: 260914 - DNA, 25 bp, Rattus norvegicus
cgtggccctacgagatggagctaaa

SEQ ID NO: 260915 - DNA, 25 bp, Rattus norvegicus
cgtggccctacgtgatggagctaaa

SEQ ID NO: 260916 - DNA, 25 bp, Rattus norvegicus
cgtggccctgccatgtcttgaaatg

SEQ ID NO: 260917 - DNA, 25 bp, Rattus norvegicus
cgtggccctgccttgtcttgaaatg

SEQ ID NO: 260918 - DNA, 25 bp, Rattus norvegicus
cgtggccgcgagcaagccatcatga

SEQ ID NO: 260919 - DNA, 25 bp, Rattus norvegicus
cgtggccgcgaggaagccatcatga

SEQ ID NO: 260920 - DNA, 25 bp, Rattus norvegicus
cgtggcctctcacaatctgatgttt

SEQ ID NO: 260921 - DNA, 25 bp, Rattus norvegicus
cgtggcctctcagaatctgatgttt

SEQ ID NO: 260922 - DNA, 25 bp, Rattus norvegicus
cgtggcctgcttccaatgaaacgct

SEQ ID NO: 260923 - DNA, 25 bp, Rattus norvegicus
cgtggcctgcttgcaatgaaacgct

SEQ ID NO: 260924 - DNA, 25 bp, Rattus norvegicus
cgtggcgacattaaactgttatctc

SEQ ID NO: 260925 - DNA, 25 bp, Rattus norvegicus
cgtggcgacatttaactgttatctc

SEQ ID NO: 260926 - DNA, 25 bp, Rattus norvegicus
cgtggcgatgccctctggctgctta

SEQ ID NO: 260927 - DNA, 25 bp, Rattus norvegicus
cgtggcgatgccgtctggctgctta

SEQ ID NO: 260928 - DNA, 25 bp, Rattus norvegicus
cgtggcgctgtgcacctggtaaccc

SEQ ID NO: 260929 - DNA, 25 bp, Rattus norvegicus
cgtggcgctgtggacctggtaaccc

SEQ ID NO: 260930 - DNA, 25 bp, Rattus norvegicus
cgtggctacgagctttctggtaatt

SEQ ID NO: 260931 - DNA, 25 bp, Rattus norvegicus
cgtggctacgaggtttctggtaatt

SEQ ID NO: 260932 - DNA, 25 bp, Rattus norvegicus
cgtggctagccgagtgagctccgcc

SEQ ID NO: 260933 - DNA, 25 bp, Rattus norvegicus
cgtggctagccgtgtgagctccgcc

SEQ ID NO: 260934 - DNA, 25 bp, Rattus norvegicus
cgtggctatcgaccatactaaaata

SEQ ID NO: 260935 - DNA, 25 bp, Rattus norvegicus
cgtggctatcgagcatactaaaata

SEQ ID NO: 260936 - DNA, 25 bp, Rattus norvegicus
cgtggctctaaaaccgcgtgggtga

SEQ ID NO: 260937 - DNA, 25 bp, Rattus norvegicus
cgtggctctaaatccgcgtgggtga

SEQ ID NO: 260938 - DNA, 25 bp, Rattus norvegicus
cgtggctgtggaattttcatggcat

SEQ ID NO: 260939 - DNA, 25 bp, Rattus norvegicus
cgtggctgtggatttttcatggcat

SEQ ID NO: 260940 - DNA, 25 bp, Rattus norvegicus
cgtgggaataaacgttctcagtcct

SEQ ID NO: 260941 - DNA, 25 bp, Rattus norvegicus
cgtgggaataaaggttctcagtcct

SEQ ID NO: 260942 - DNA, 25 bp, Rattus norvegicus
cgtgggacttgaagatggccccttt

SEQ ID NO: 260943 - DNA, 25 bp, Rattus norvegicus
cgtgggacttgatgatggccccttt

SEQ ID NO: 260944 - DNA, 25 bp, Rattus norvegicus
cgtgggatcatgacgtggcactatc

SEQ ID NO: 260945 - DNA, 25 bp, Rattus norvegicus
cgtgggatcatgtcgtggcactatc

SEQ ID NO: 260946 - DNA, 25 bp, Rattus norvegicus
cgtgggcaactaccggctcaaggaa

SEQ ID NO: 260947 - DNA, 25 bp, Rattus norvegicus
cgtgggcaactagcggctcaaggaa

SEQ ID NO: 260948 - DNA, 25 bp, Rattus norvegicus
cgtgggcctaatagaagcctcgggt

SEQ ID NO: 260949 - DNA, 25 bp, Rattus norvegicus
cgtgggcctaattgaagcctcgggt

SEQ ID NO: 260950 - DNA, 25 bp, Rattus norvegicus
cgtgggctacacaggcctagaactc

SEQ ID NO: 260951 - DNA, 25 bp, Rattus norvegicus
cgtgggctacactggcctagaactc

SEQ ID NO: 260952 - DNA, 25 bp, Rattus norvegicus
cgtgggctcatgaatgttgtaggct

SEQ ID NO: 260953 - DNA, 25 bp, Rattus norvegicus
cgtgggctcatgtatgttgtaggct

SEQ ID NO: 260954 - DNA, 25 bp, Rattus norvegicus
cgtgggctccttcacttgcaaataa

SEQ ID NO: 260955 - DNA, 25 bp, Rattus norvegicus
cgtgggctccttgacttgcaaataa

SEQ ID NO: 260956 - DNA, 25 bp, Rattus norvegicus
cgtgggctgcctcagtggaaacctt

SEQ ID NO: 260957 - DNA, 25 bp, Rattus norvegicus
cgtgggctgcctgagtggaaacctt

SEQ ID NO: 260958 - DNA, 25 bp, Rattus norvegicus
cgtgggttcaaacccagaaagccaa

SEQ ID NO: 260959 - DNA, 25 bp, Rattus norvegicus
cgtgggttcaaagccagaaagccaa

SEQ ID NO: 260960 - DNA, 25 bp, Rattus norvegicus
cgtggtaatagactccaagcattta

SEQ ID NO: 260961 - DNA, 25 bp, Rattus norvegicus
cgtggtaatagagtccaagcattta

SEQ ID NO: 260962 - DNA, 25 bp, Rattus norvegicus
cgtggtactttgaactgcctttatt

SEQ ID NO: 260963 - DNA, 25 bp, Rattus norvegicus
cgtggtactttgtactgcctttatt

SEQ ID NO: 260964 - DNA, 25 bp, Rattus norvegicus
cgtggtagacgaacgcccagccgcg

SEQ ID NO: 260965 - DNA, 25 bp, Rattus norvegicus
cgtggtagacgatcgcccagccgcg

SEQ ID NO: 260966 - DNA, 25 bp, Rattus norvegicus
cgtggtaggcttactcggcagagac

SEQ ID NO: 260967 - DNA, 25 bp, Rattus norvegicus
cgtggtaggctttctcggcagagac

SEQ ID NO: 260968 - DNA, 25 bp, Rattus norvegicus
cgtggtatttgaaagctgcagcatg

SEQ ID NO: 260969 - DNA, 25 bp, Rattus norvegicus
cgtggtatttgatagctgcagcatg

SEQ ID NO: 260970 - DNA, 25 bp, Rattus norvegicus
cgtggtcaacgtcgcgcacgacctg

SEQ ID NO: 260971 - DNA, 25 bp, Rattus norvegicus
cgtggtcaacgtggcgcacgacctg

SEQ ID NO: 260972 - DNA, 25 bp, Rattus norvegicus
cgtggtcactctcgaaaacctgtgc

SEQ ID NO: 260973 - DNA, 25 bp, Rattus norvegicus
cgtggtcactctggaaaacctgtgc

SEQ ID NO: 260974 - DNA, 25 bp, Rattus norvegicus
cgtggtccacgacggtctgcacaat

SEQ ID NO: 260975 - DNA, 25 bp, Rattus norvegicus
cgtggtccacgagggtctgcacaat

SEQ ID NO: 260976 - DNA, 25 bp, Rattus norvegicus
cgtggtcggaggacttaatttctga

SEQ ID NO: 260977 - DNA, 25 bp, Rattus norvegicus
cgtggtcggaggtcttaatttctga

SEQ ID NO: 260978 - DNA, 25 bp, Rattus norvegicus
cgtggtctaacgatcatgcatgtgt

SEQ ID NO: 260979 - DNA, 25 bp, Rattus norvegicus
cgtggtctaacgttcatgcatgtgt

SEQ ID NO: 260980 - DNA, 25 bp, Rattus norvegicus
cgtggtctaggcagtgtcttgcaaa

SEQ ID NO: 260981 - DNA, 25 bp, Rattus norvegicus
cgtggtctaggctgtgtcttgcaaa

SEQ ID NO: 260982 - DNA, 25 bp, Rattus norvegicus
cgtggtctcacacatcctgaagaag

SEQ ID NO: 260983 - DNA, 25 bp, Rattus norvegicus
cgtggtctcacagatcctgaagaag

SEQ ID NO: 260984 - DNA, 25 bp, Rattus norvegicus
cgtggtcttcgcaggcgtcgtaagt

SEQ ID NO: 260985 - DNA, 25 bp, Rattus norvegicus
cgtggtcttcgctggcgtcgtaagt

SEQ ID NO: 260986 - DNA, 25 bp, Rattus norvegicus
cgtggtgagcacagtatcttccgag

SEQ ID NO: 260987 - DNA, 25 bp, Rattus norvegicus
cgtggtgagcactgtatcttccgag

SEQ ID NO: 260988 - DNA, 25 bp, Rattus norvegicus
cgtggtgccataattagctactaaa

SEQ ID NO: 260989 - DNA, 25 bp, Rattus norvegicus
cgtggtgccatatttagctactaaa

SEQ ID NO: 260990 - DNA, 25 bp, Rattus norvegicus
cgtggtgttcagagatgcggcctca

SEQ ID NO: 260991 - DNA, 25 bp, Rattus norvegicus
cgtggtgttcagtgatgcggcctca

SEQ ID NO: 260992 - DNA, 25 bp, Rattus norvegicus
cgtggttaacgtatcgatcgcgact

SEQ ID NO: 260993 - DNA, 25 bp, Rattus norvegicus
cgtggttaacgtttcgatcgcgact

SEQ ID NO: 260994 - DNA, 25 bp, Rattus norvegicus
cgtggttagtttattgctcctctga

SEQ ID NO: 260995 - DNA, 25 bp, Rattus norvegicus
cgtggttagttttttgctcctctga

SEQ ID NO: 260996 - DNA, 25 bp, Rattus norvegicus
cgtggttcctatattctaaatggag

SEQ ID NO: 260997 - DNA, 25 bp, Rattus norvegicus
cgtggttcctattttctaaatggag

SEQ ID NO: 260998 - DNA, 25 bp, Rattus norvegicus
cgtggttgacctaaccatttcaaag

SEQ ID NO: 260999 - DNA, 25 bp, Rattus norvegicus
cgtggttgaccttaccatttcaaag

SEQ ID NO: 261000 - DNA, 25 bp, Rattus norvegicus
cgtggttggctaagggactcttgat

SEQ ID NO: 261001 - DNA, 25 bp, Rattus norvegicus
cgtggttggctatgggactcttgat

SEQ ID NO: 261002 - DNA, 25 bp, Rattus norvegicus
cgtggtttcgtcactgtcctggaaa

SEQ ID NO: 261003 - DNA, 25 bp, Rattus norvegicus
cgtggtttcgtctctgtcctggaaa

SEQ ID NO: 261004 - DNA, 25 bp, Rattus norvegicus
cgtggtttggttagaacccgcacat

SEQ ID NO: 261005 - DNA, 25 bp, Rattus norvegicus
cgtggtttggtttgaacccgcacat

SEQ ID NO: 261006 - DNA, 25 bp, Rattus norvegicus
cgtgtacatcccagtctgatggaga

SEQ ID NO: 261007 - DNA, 25 bp, Rattus norvegicus
cgtgtacatccctgtctgatggaga

SEQ ID NO: 261008 - DNA, 25 bp, Rattus norvegicus
cgtgtaggtgtcaaatacatcgtga

SEQ ID NO: 261009 - DNA, 25 bp, Rattus norvegicus
cgtgtaggtgtctaatacatcgtga

SEQ ID NO: 261010 - DNA, 25 bp, Rattus norvegicus
cgtgtatcacacctgcttctttggg

SEQ ID NO: 261011 - DNA, 25 bp, Rattus norvegicus
cgtgtatcacacgtgcttctttggg

SEQ ID NO: 261012 - DNA, 25 bp, Rattus norvegicus
cgtgtatgctgtcgattgggcctca

SEQ ID NO: 261013 - DNA, 25 bp, Rattus norvegicus
cgtgtatgctgtggattgggcctca

SEQ ID NO: 261014 - DNA, 25 bp, Rattus norvegicus
cgtgtcaatgaccttttccgtatca

SEQ ID NO: 261015 - DNA, 25 bp, Rattus norvegicus
cgtgtcaatgacgttttccgtatca

SEQ ID NO: 261016 - DNA, 25 bp, Rattus norvegicus
cgtgtcagaacccagcgtatgtagc

SEQ ID NO: 261017 - DNA, 25 bp, Rattus norvegicus
cgtgtcagaaccgagcgtatgtagc

SEQ ID NO: 261018 - DNA, 25 bp, Rattus norvegicus
cgtgtccatattattcatgtgtctg

SEQ ID NO: 261019 - DNA, 25 bp, Rattus norvegicus
cgtgtccatatttttcatgtgtctg

SEQ ID NO: 261020 - DNA, 25 bp, Rattus norvegicus
cgtgtccatggaacatgccctgtaa

SEQ ID NO: 261021 - DNA, 25 bp, Rattus norvegicus
cgtgtccatggatcatgccctgtaa

SEQ ID NO: 261022 - DNA, 25 bp, Rattus norvegicus
cgtgtccattcccatagtcttaagg

SEQ ID NO: 261023 - DNA, 25 bp, Rattus norvegicus
cgtgtccattccgatagtcttaagg

SEQ ID NO: 261024 - DNA, 25 bp, Rattus norvegicus
cgtgtcccacttaaactgagcttag

SEQ ID NO: 261025 - DNA, 25 bp, Rattus norvegicus
cgtgtcccactttaactgagcttag

SEQ ID NO: 261026 - DNA, 25 bp, Rattus norvegicus
cgtgtcccttgcagtgttgtggaac

SEQ ID NO: 261027 - DNA, 25 bp, Rattus norvegicus
cgtgtcccttgctgtgttgtggaac

SEQ ID NO: 261028 - DNA, 25 bp, Rattus norvegicus
cgtgtcccttttacaaacagcctat

SEQ ID NO: 261029 - DNA, 25 bp, Rattus norvegicus
cgtgtccctttttcaaacagcctat

SEQ ID NO: 261030 - DNA, 25 bp, Rattus norvegicus
cgtgtcctcgttatcattcaaatga

SEQ ID NO: 261031 - DNA, 25 bp, Rattus norvegicus
cgtgtcctcgttttcattcaaatga

SEQ ID NO: 261032 - DNA, 25 bp, Rattus norvegicus
cgtgtctacttccagctggatctga

SEQ ID NO: 261033 - DNA, 25 bp, Rattus norvegicus
cgtgtctacttcgagctggatctga

SEQ ID NO: 261034 - DNA, 25 bp, Rattus norvegicus
cgtgtctcaaggaagttgcacacct

SEQ ID NO: 261035 - DNA, 25 bp, Rattus norvegicus
cgtgtctcaaggtagttgcacacct

SEQ ID NO: 261036 - DNA, 25 bp, Rattus norvegicus
cgtgtctcagacacccaggctggag

SEQ ID NO: 261037 - DNA, 25 bp, Rattus norvegicus
cgtgtctcagactcccaggctggag

SEQ ID NO: 261038 - DNA, 25 bp, Rattus norvegicus
cgtgtctgctttctttgtttcatgt

SEQ ID NO: 261039 - DNA, 25 bp, Rattus norvegicus
cgtgtctgctttgtttgtttcatgt

SEQ ID NO: 261040 - DNA, 25 bp, Rattus norvegicus
cgtgtctgtcttagtgggctttatc

SEQ ID NO: 261041 - DNA, 25 bp, Rattus norvegicus
cgtgtctgtctttgtgggctttatc

SEQ ID NO: 261042 - DNA, 25 bp, Rattus norvegicus
cgtgtgaaaaatcccaataaccttg

SEQ ID NO: 261043 - DNA, 25 bp, Rattus norvegicus
cgtgtgaaaaatgccaataaccttg

SEQ ID NO: 261044 - DNA, 25 bp, Rattus norvegicus
cgtgtgaatgtgattgtgcctgtat

SEQ ID NO: 261045 - DNA, 25 bp, Rattus norvegicus
cgtgtgaatgtgtttgtgcctgtat

SEQ ID NO: 261046 - DNA, 25 bp, Rattus norvegicus
cgtgtgacacagatctcattactcc

SEQ ID NO: 261047 - DNA, 25 bp, Rattus norvegicus
cgtgtgacacagttctcattactcc

SEQ ID NO: 261048 - DNA, 25 bp, Rattus norvegicus
cgtgtgactgtacttgccgaacatt

SEQ ID NO: 261049 - DNA, 25 bp, Rattus norvegicus
cgtgtgactgtagttgccgaacatt

SEQ ID NO: 261050 - DNA, 25 bp, Rattus norvegicus
cgtgtgatgggaccactggcaccaa

SEQ ID NO: 261051 - DNA, 25 bp, Rattus norvegicus
cgtgtgatgggagcactggcaccaa

SEQ ID NO: 261052 - DNA, 25 bp, Rattus norvegicus
cgtgtgatttggcttgctgggaagg

SEQ ID NO: 261053 - DNA, 25 bp, Rattus norvegicus
cgtgtgatttgggttgctgggaagg

SEQ ID NO: 261054 - DNA, 25 bp, Rattus norvegicus
cgtgtgcacagacgccggcatgtat

SEQ ID NO: 261055 - DNA, 25 bp, Rattus norvegicus
cgtgtgcacagaggccggcatgtat

SEQ ID NO: 261056 - DNA, 25 bp, Rattus norvegicus
cgtgtgcacttcctgtagcgtaaag

SEQ ID NO: 261057 - DNA, 25 bp, Rattus norvegicus
cgtgtgcacttcgtgtagcgtaaag

SEQ ID NO: 261058 - DNA, 25 bp, Rattus norvegicus
cgtgtgcagacacccgatccaaatg

SEQ ID NO: 261059 - DNA, 25 bp, Rattus norvegicus
cgtgtgcagacagccgatccaaatg

SEQ ID NO: 261060 - DNA, 25 bp, Rattus norvegicus
cgtgtgcatgtaacgatttctagga

SEQ ID NO: 261061 - DNA, 25 bp, Rattus norvegicus
cgtgtgcatgtatcgatttctagga

SEQ ID NO: 261062 - DNA, 25 bp, Rattus norvegicus
cgtgtgccgagacctactgcagcag

SEQ ID NO: 261063 - DNA, 25 bp, Rattus norvegicus
cgtgtgccgagagctactgcagcag

SEQ ID NO: 261064 - DNA, 25 bp, Rattus norvegicus
cgtgtgcctaataaacctacttaat

SEQ ID NO: 261065 - DNA, 25 bp, Rattus norvegicus
cgtgtgcctaattaacctacttaat

SEQ ID NO: 261066 - DNA, 25 bp, Rattus norvegicus
cgtgtgctgtgtcaatatgttggtt

SEQ ID NO: 261067 - DNA, 25 bp, Rattus norvegicus
cgtgtgctgtgtgaatatgttggtt

SEQ ID NO: 261068 - DNA, 25 bp, Rattus norvegicus
cgtgtggaaattctccttctcgttc

SEQ ID NO: 261069 - DNA, 25 bp, Rattus norvegicus
cgtgtggaaattgtccttctcgttc

SEQ ID NO: 261070 - DNA, 25 bp, Rattus norvegicus
cgtgtggaactgaacacaccttagt

SEQ ID NO: 261071 - DNA, 25 bp, Rattus norvegicus
cgtgtggaactgtacacaccttagt

SEQ ID NO: 261072 - DNA, 25 bp, Rattus norvegicus
cgtgtggaatctccctgctaatgtc

SEQ ID NO: 261073 - DNA, 25 bp, Rattus norvegicus
cgtgtggaatctgcctgctaatgtc

SEQ ID NO: 261074 - DNA, 25 bp, Rattus norvegicus
cgtgtggagatgaaatgtgcttttc

SEQ ID NO: 261075 - DNA, 25 bp, Rattus norvegicus
cgtgtggagatgtaatgtgcttttc

SEQ ID NO: 261076 - DNA, 25 bp, Rattus norvegicus
cgtgtggattgaaatgtggtctctc

SEQ ID NO: 261077 - DNA, 25 bp, Rattus norvegicus
cgtgtggattgatatgtggtctctc

SEQ ID NO: 261078 - DNA, 25 bp, Rattus norvegicus
cgtgtggtcaatcctggtcgcttca

SEQ ID NO: 261079 - DNA, 25 bp, Rattus norvegicus
cgtgtggtcaatgctggtcgcttca

SEQ ID NO: 261080 - DNA, 25 bp, Rattus norvegicus
cgtgtgtacataagggattggtgaa

SEQ ID NO: 261081 - DNA, 25 bp, Rattus norvegicus
cgtgtgtacatatgggattggtgaa

SEQ ID NO: 261082 - DNA, 25 bp, Rattus norvegicus
cgtgtgtataaaactccttctctgt

SEQ ID NO: 261083 - DNA, 25 bp, Rattus norvegicus
cgtgtgtataaatctccttctctgt

SEQ ID NO: 261084 - DNA, 25 bp, Rattus norvegicus
cgtgtgtgacaacagagcctatgga

SEQ ID NO: 261085 - DNA, 25 bp, Rattus norvegicus
cgtgtgtgacaagagagcctatgga

SEQ ID NO: 261086 - DNA, 25 bp, Rattus norvegicus
cgtgtgtgcatgaggcgtctcctca

SEQ ID NO: 261087 - DNA, 25 bp, Rattus norvegicus
cgtgtgtgcatgtggcgtctcctca

SEQ ID NO: 261088 - DNA, 25 bp, Rattus norvegicus
cgtgtgtgctggatatttatttatt

SEQ ID NO: 261089 - DNA, 25 bp, Rattus norvegicus
cgtgtgtgctggttatttatttatt

SEQ ID NO: 261090 - DNA, 25 bp, Rattus norvegicus
cgtgtgtgtaacagtagtgtagtca

SEQ ID NO: 261091 - DNA, 25 bp, Rattus norvegicus
cgtgtgtgtaactgtagtgtagtca

SEQ ID NO: 261092 - DNA, 25 bp, Rattus norvegicus
cgtgtgtgtcacaaggaaggcccca

SEQ ID NO: 261093 - DNA, 25 bp, Rattus norvegicus
cgtgtgtgtcactaggaaggcccca

SEQ ID NO: 261094 - DNA, 25 bp, Rattus norvegicus
cgtgtgtgtgcaaacaatgttactc

SEQ ID NO: 261095 - DNA, 25 bp, Rattus norvegicus
cgtgtgtgtgcatacaatgttactc

SEQ ID NO: 261096 - DNA, 25 bp, Rattus norvegicus
cgtgtgtgtggtcaagggcagcccc

SEQ ID NO: 261097 - DNA, 25 bp, Rattus norvegicus
cgtgtgtgtggtgaagggcagcccc

SEQ ID NO: 261098 - DNA, 25 bp, Rattus norvegicus
cgtgtgtgtgtgattctctgtgccc

SEQ ID NO: 261099 - DNA, 25 bp, Rattus norvegicus
cgtgtgtgtgtgtttctctgtgccc

SEQ ID NO: 261100 - DNA, 25 bp, Rattus norvegicus
cgtgttaatgtcagccccggaaaga

SEQ ID NO: 261101 - DNA, 25 bp, Rattus norvegicus
cgtgttaatgtctgccccggaaaga

SEQ ID NO: 261102 - DNA, 25 bp, Rattus norvegicus
cgtgttcactgcatcttcagatgat

SEQ ID NO: 261103 - DNA, 25 bp, Rattus norvegicus
cgtgttcactgcttcttcagatgat

SEQ ID NO: 261104 - DNA, 25 bp, Rattus norvegicus
cgtgttcagagaaccgccttcagac

SEQ ID NO: 261105 - DNA, 25 bp, Rattus norvegicus
cgtgttcagagatccgccttcagac

SEQ ID NO: 261106 - DNA, 25 bp, Rattus norvegicus
cgtgttcaggttagcgcccatgaga

SEQ ID NO: 261107 - DNA, 25 bp, Rattus norvegicus
cgtgttcaggtttgcgcccatgaga

SEQ ID NO: 261108 - DNA, 25 bp, Rattus norvegicus
cgtgttccgaccagcatatgtgtaa

SEQ ID NO: 261109 - DNA, 25 bp, Rattus norvegicus
cgtgttccgacctgcatatgtgtaa

SEQ ID NO: 261110 - DNA, 25 bp, Rattus norvegicus
cgtgttctaagtctgattggctgga

SEQ ID NO: 261111 - DNA, 25 bp, Rattus norvegicus
cgtgttctaagtgtgattggctgga

SEQ ID NO: 261112 - DNA, 25 bp, Rattus norvegicus
cgtgttcttcagagtttacgttctt

SEQ ID NO: 261113 - DNA, 25 bp, Rattus norvegicus
cgtgttcttcagtgtttacgttctt

SEQ ID NO: 261114 - DNA, 25 bp, Rattus norvegicus
cgtgttcttctgctcttctaagaaa

SEQ ID NO: 261115 - DNA, 25 bp, Rattus norvegicus
cgtgttcttctggtcttctaagaaa

SEQ ID NO: 261116 - DNA, 25 bp, Rattus norvegicus
cgtgttgaccgaaaggtgcagatgt

SEQ ID NO: 261117 - DNA, 25 bp, Rattus norvegicus
cgtgttgaccgataggtgcagatgt

SEQ ID NO: 261118 - DNA, 25 bp, Rattus norvegicus
cgtgttgacctcacttggagtggaa

SEQ ID NO: 261119 - DNA, 25 bp, Rattus norvegicus
cgtgttgacctctcttggagtggaa

SEQ ID NO: 261120 - DNA, 25 bp, Rattus norvegicus
cgtgttgatgggagcggtaaaccac

SEQ ID NO: 261121 - DNA, 25 bp, Rattus norvegicus
cgtgttgatgggtgcggtaaaccac

SEQ ID NO: 261122 - DNA, 25 bp, Rattus norvegicus
cgtgttgccaatactgcacagagca

SEQ ID NO: 261123 - DNA, 25 bp, Rattus norvegicus
cgtgttgccaattctgcacagagca

SEQ ID NO: 261124 - DNA, 25 bp, Rattus norvegicus
cgtgttgctttgatgctagtatgta

SEQ ID NO: 261125 - DNA, 25 bp, Rattus norvegicus
cgtgttgctttgttgctagtatgta

SEQ ID NO: 261126 - DNA, 25 bp, Rattus norvegicus
cgtgttggtgatacagctgtgccta

SEQ ID NO: 261127 - DNA, 25 bp, Rattus norvegicus
cgtgttggtgattcagctgtgccta

SEQ ID NO: 261128 - DNA, 25 bp, Rattus norvegicus
cgtgtttaaatacctgccatccagt

SEQ ID NO: 261129 - DNA, 25 bp, Rattus norvegicus
cgtgtttaaatagctgccatccagt

SEQ ID NO: 261130 - DNA, 25 bp, Rattus norvegicus
cgtgtttaagcaagccctcaccagc

SEQ ID NO: 261131 - DNA, 25 bp, Rattus norvegicus
cgtgtttaagcatgccctcaccagc

SEQ ID NO: 261132 - DNA, 25 bp, Rattus norvegicus
cgtgtttatatgaaaagggctttag

SEQ ID NO: 261133 - DNA, 25 bp, Rattus norvegicus
cgtgtttatatgtaaagggctttag

SEQ ID NO: 261134 - DNA, 25 bp, Rattus norvegicus
cgtgtttccttgcttgcgctattac

SEQ ID NO: 261135 - DNA, 25 bp, Rattus norvegicus
cgtgtttccttggttgcgctattac

SEQ ID NO: 261136 - DNA, 25 bp, Rattus norvegicus
cgtgtttgccagctggagaccataa

SEQ ID NO: 261137 - DNA, 25 bp, Rattus norvegicus
cgtgtttgccaggtggagaccataa

SEQ ID NO: 261138 - DNA, 25 bp, Rattus norvegicus
cgtgttttaatgacctgtactgcta

SEQ ID NO: 261139 - DNA, 25 bp, Rattus norvegicus
cgtgttttaatgtcctgtactgcta

SEQ ID NO: 261140 - DNA, 25 bp, Rattus norvegicus
cgtgttttctctccgatggccataa

SEQ ID NO: 261141 - DNA, 25 bp, Rattus norvegicus
cgtgttttctctgcgatggccataa

SEQ ID NO: 261142 - DNA, 25 bp, Rattus norvegicus
cgtgttttgtgcacggttacgccga

SEQ ID NO: 261143 - DNA, 25 bp, Rattus norvegicus
cgtgttttgtgctcggttacgccga

SEQ ID NO: 261144 - DNA, 25 bp, Rattus norvegicus
cgtgtttttaacatcaatctgcttg

SEQ ID NO: 261145 - DNA, 25 bp, Rattus norvegicus
cgtgtttttaacttcaatctgcttg

SEQ ID NO: 261146 - DNA, 25 bp, Rattus norvegicus
cgttaactacggagtcttgggcata

SEQ ID NO: 261147 - DNA, 25 bp, Rattus norvegicus
cgttaactacggtgtcttgggcata

SEQ ID NO: 261148 - DNA, 25 bp, Rattus norvegicus
cgttaagatgtgcagctctgcccgt

SEQ ID NO: 261149 - DNA, 25 bp, Rattus norvegicus
cgttaagatgtggagctctgcccgt

SEQ ID NO: 261150 - DNA, 25 bp, Rattus norvegicus
cgttaagttattccagatcccacat

SEQ ID NO: 261151 - DNA, 25 bp, Rattus norvegicus
cgttaagttattgcagatcccacat

SEQ ID NO: 261152 - DNA, 25 bp, Rattus norvegicus
cgttacagaccactgtcaacttcaa

SEQ ID NO: 261153 - DNA, 25 bp, Rattus norvegicus
cgttacagaccagtgtcaacttcaa

SEQ ID NO: 261154 - DNA, 25 bp, Rattus norvegicus
cgttacagcctgatcttgttttggc

SEQ ID NO: 261155 - DNA, 25 bp, Rattus norvegicus
cgttacagcctgttcttgttttggc

SEQ ID NO: 261156 - DNA, 25 bp, Rattus norvegicus
cgttacagcgcaacagcagcctgca

SEQ ID NO: 261157 - DNA, 25 bp, Rattus norvegicus
cgttacagcgcatcagcagcctgca

SEQ ID NO: 261158 - DNA, 25 bp, Rattus norvegicus
cgttacagcgttcggtccactatta

SEQ ID NO: 261159 - DNA, 25 bp, Rattus norvegicus
cgttacagcgttgggtccactatta

SEQ ID NO: 261160 - DNA, 25 bp, Rattus norvegicus
cgttacagggacacactaatagagt

SEQ ID NO: 261161 - DNA, 25 bp, Rattus norvegicus
cgttacagggactcactaatagagt

SEQ ID NO: 261162 - DNA, 25 bp, Rattus norvegicus
cgttacgaacttcactatatcttgt

SEQ ID NO: 261163 - DNA, 25 bp, Rattus norvegicus
cgttacgaacttgactatatcttgt

SEQ ID NO: 261164 - DNA, 25 bp, Rattus norvegicus
cgttacgtgtccaacaggtgttcac

SEQ ID NO: 261165 - DNA, 25 bp, Rattus norvegicus
cgttacgtgtcctacaggtgttcac

SEQ ID NO: 261166 - DNA, 25 bp, Rattus norvegicus
cgttactatcctattctttgtcaat

SEQ ID NO: 261167 - DNA, 25 bp, Rattus norvegicus
cgttactatccttttctttgtcaat

SEQ ID NO: 261168 - DNA, 25 bp, Rattus norvegicus
cgttactgcattaccacattcattt

SEQ ID NO: 261169 - DNA, 25 bp, Rattus norvegicus
cgttactgcatttccacattcattt

SEQ ID NO: 261170 - DNA, 25 bp, Rattus norvegicus
cgttagcatttaattggtggcagaa

SEQ ID NO: 261171 - DNA, 25 bp, Rattus norvegicus
cgttagcatttatttggtggcagaa

SEQ ID NO: 261172 - DNA, 25 bp, Rattus norvegicus
cgttagcgactgcgacgttcgatct

SEQ ID NO: 261173 - DNA, 25 bp, Rattus norvegicus
cgttagcgactgggacgttcgatct

SEQ ID NO: 261174 - DNA, 25 bp, Rattus norvegicus
cgttagctatttatccctctgaaga

SEQ ID NO: 261175 - DNA, 25 bp, Rattus norvegicus
cgttagctatttttccctctgaaga

SEQ ID NO: 261176 - DNA, 25 bp, Rattus norvegicus
cgttagctcactatataatttgtat

SEQ ID NO: 261177 - DNA, 25 bp, Rattus norvegicus
cgttagctcactttataatttgtat

SEQ ID NO: 261178 - DNA, 25 bp, Rattus norvegicus
cgttagtgtttacctccatgagaca

SEQ ID NO: 261179 - DNA, 25 bp, Rattus norvegicus
cgttagtgtttagctccatgagaca

SEQ ID NO: 261180 - DNA, 25 bp, Rattus norvegicus
cgttataagtgcctgttttgtacaa

SEQ ID NO: 261181 - DNA, 25 bp, Rattus norvegicus
cgttataagtgcgtgttttgtacaa

SEQ ID NO: 261182 - DNA, 25 bp, Rattus norvegicus
cgttatactgcccttgctgatatgg

SEQ ID NO: 261183 - DNA, 25 bp, Rattus norvegicus
cgttatactgccgttgctgatatgg

SEQ ID NO: 261184 - DNA, 25 bp, Rattus norvegicus
cgttatatggagctctatgacctta

SEQ ID NO: 261185 - DNA, 25 bp, Rattus norvegicus
cgttatatggaggtctatgacctta

SEQ ID NO: 261186 - DNA, 25 bp, Rattus norvegicus
cgttatcactggctttgaagtcacc

SEQ ID NO: 261187 - DNA, 25 bp, Rattus norvegicus
cgttatcactgggtttgaagtcacc

SEQ ID NO: 261188 - DNA, 25 bp, Rattus norvegicus
cgttatccttggcacggctgttgga

SEQ ID NO: 261189 - DNA, 25 bp, Rattus norvegicus
cgttatccttgggacggctgttgga

SEQ ID NO: 261190 - DNA, 25 bp, Rattus norvegicus
cgttattgaggtaggactggctgta

SEQ ID NO: 261191 - DNA, 25 bp, Rattus norvegicus
cgttattgaggttggactggctgta

SEQ ID NO: 261192 - DNA, 25 bp, Rattus norvegicus
cgttatttctttcagcttcttacct

SEQ ID NO: 261193 - DNA, 25 bp, Rattus norvegicus
cgttatttctttgagcttcttacct

SEQ ID NO: 261194 - DNA, 25 bp, Rattus norvegicus
cgttcaactactacattgctgtggc

SEQ ID NO: 261195 - DNA, 25 bp, Rattus norvegicus
cgttcaactacttcattgctgtggc

SEQ ID NO: 261196 - DNA, 25 bp, Rattus norvegicus
cgttcaactgtgaatccagcgtgtc

SEQ ID NO: 261197 - DNA, 25 bp, Rattus norvegicus
cgttcaactgtgtatccagcgtgtc

SEQ ID NO: 261198 - DNA, 25 bp, Rattus norvegicus
cgttcacctcttagggatctgcgag

SEQ ID NO: 261199 - DNA, 25 bp, Rattus norvegicus
cgttcacctctttgggatctgcgag

SEQ ID NO: 261200 - DNA, 25 bp, Rattus norvegicus
cgttcagatctacggctggactcta

SEQ ID NO: 261201 - DNA, 25 bp, Rattus norvegicus
cgttcagatctagggctggactcta

SEQ ID NO: 261202 - DNA, 25 bp, Rattus norvegicus
cgttcagccctgacggaaagtattt

SEQ ID NO: 261203 - DNA, 25 bp, Rattus norvegicus
cgttcagccctgtcggaaagtattt

SEQ ID NO: 261204 - DNA, 25 bp, Rattus norvegicus
cgttcaggccgaactggtggtcgat

SEQ ID NO: 261205 - DNA, 25 bp, Rattus norvegicus
cgttcaggccgatctggtggtcgat

SEQ ID NO: 261206 - DNA, 25 bp, Rattus norvegicus
cgttcaggtttcccattcttggaca

SEQ ID NO: 261207 - DNA, 25 bp, Rattus norvegicus
cgttcaggtttcgcattcttggaca

SEQ ID NO: 261208 - DNA, 25 bp, Rattus norvegicus
cgttcagttgtgaagctcatgtata

SEQ ID NO: 261209 - DNA, 25 bp, Rattus norvegicus
cgttcagttgtgtagctcatgtata

SEQ ID NO: 261210 - DNA, 25 bp, Rattus norvegicus
cgttcatacattagttcaactgtga

SEQ ID NO: 261211 - DNA, 25 bp, Rattus norvegicus
cgttcatacatttgttcaactgtga

SEQ ID NO: 261212 - DNA, 25 bp, Rattus norvegicus
cgttcatcttcaacctgcttgagaa

SEQ ID NO: 261213 - DNA, 25 bp, Rattus norvegicus
cgttcatcttcatcctgcttgagaa

SEQ ID NO: 261214 - DNA, 25 bp, Rattus norvegicus
cgttcatgtaaccttaagtctccta

SEQ ID NO: 261215 - DNA, 25 bp, Rattus norvegicus
cgttcatgtaacgttaagtctccta

SEQ ID NO: 261216 - DNA, 25 bp, Rattus norvegicus
cgttcccagtacagacctcatctgt

SEQ ID NO: 261217 - DNA, 25 bp, Rattus norvegicus
cgttcccagtactgacctcatctgt

SEQ ID NO: 261218 - DNA, 25 bp, Rattus norvegicus
cgttccctgtctacagtcttagaag

SEQ ID NO: 261219 - DNA, 25 bp, Rattus norvegicus
cgttccctgtcttcagtcttagaag

SEQ ID NO: 261220 - DNA, 25 bp, Rattus norvegicus
cgttccgtggagagcatcggtactt

SEQ ID NO: 261221 - DNA, 25 bp, Rattus norvegicus
cgttccgtggagtgcatcggtactt

SEQ ID NO: 261222 - DNA, 25 bp, Rattus norvegicus
cgttcctagcctctgcctatttgtg

SEQ ID NO: 261223 - DNA, 25 bp, Rattus norvegicus
cgttcctagcctgtgcctatttgtg

SEQ ID NO: 261224 - DNA, 25 bp, Rattus norvegicus
cgttcctctgcaccctgttcagtgt

SEQ ID NO: 261225 - DNA, 25 bp, Rattus norvegicus
cgttcctctgcagcctgttcagtgt

SEQ ID NO: 261226 - DNA, 25 bp, Rattus norvegicus
cgttcctctgtgattctgatgtcta

SEQ ID NO: 261227 - DNA, 25 bp, Rattus norvegicus
cgttcctctgtgtttctgatgtcta

SEQ ID NO: 261228 - DNA, 25 bp, Rattus norvegicus
cgttcctgattccaggtcttcatag

SEQ ID NO: 261229 - DNA, 25 bp, Rattus norvegicus
cgttcctgattcgaggtcttcatag

SEQ ID NO: 261230 - DNA, 25 bp, Rattus norvegicus
cgttcctgtgggactcatcaaatag

SEQ ID NO: 261231 - DNA, 25 bp, Rattus norvegicus
cgttcctgtgggtctcatcaaatag

SEQ ID NO: 261232 - DNA, 25 bp, Rattus norvegicus
cgttccttcagacttgctgcagaat

SEQ ID NO: 261233 - DNA, 25 bp, Rattus norvegicus
cgttccttcagagttgctgcagaat

SEQ ID NO: 261234 - DNA, 25 bp, Rattus norvegicus
cgttccttcattcatcttggtgatg

SEQ ID NO: 261235 - DNA, 25 bp, Rattus norvegicus
cgttccttcattgatcttggtgatg

SEQ ID NO: 261236 - DNA, 25 bp, Rattus norvegicus
cgttccttttgtctatagccagcag

SEQ ID NO: 261237 - DNA, 25 bp, Rattus norvegicus
cgttccttttgtgtatagccagcag

SEQ ID NO: 261238 - DNA, 25 bp, Rattus norvegicus
cgttcgggaacgacaagctggtagt

SEQ ID NO: 261239 - DNA, 25 bp, Rattus norvegicus
cgttcgggaacgtcaagctggtagt

SEQ ID NO: 261240 - DNA, 25 bp, Rattus norvegicus
cgttcggtgttaactggttatctgc

SEQ ID NO: 261241 - DNA, 25 bp, Rattus norvegicus
cgttcggtgttatctggttatctgc

SEQ ID NO: 261242 - DNA, 25 bp, Rattus norvegicus
cgttcgtaatggcttcctgtattct

SEQ ID NO: 261243 - DNA, 25 bp, Rattus norvegicus
cgttcgtaatgggttcctgtattct

SEQ ID NO: 261244 - DNA, 25 bp, Rattus norvegicus
cgttctccatttctcttgtgtaata

SEQ ID NO: 261245 - DNA, 25 bp, Rattus norvegicus
cgttctccatttgtcttgtgtaata

SEQ ID NO: 261246 - DNA, 25 bp, Rattus norvegicus
cgttctcggcttagactgcacaaga

SEQ ID NO: 261247 - DNA, 25 bp, Rattus norvegicus
cgttctcggctttgactgcacaaga

SEQ ID NO: 261248 - DNA, 25 bp, Rattus norvegicus
cgttctctctcaactagatcactag

SEQ ID NO: 261249 - DNA, 25 bp, Rattus norvegicus
cgttctctctcatctagatcactag

SEQ ID NO: 261250 - DNA, 25 bp, Rattus norvegicus
cgttctctgggtagctctaaggtaa

SEQ ID NO: 261251 - DNA, 25 bp, Rattus norvegicus
cgttctctgggttgctctaaggtaa

SEQ ID NO: 261252 - DNA, 25 bp, Rattus norvegicus
cgttctcttagacatgcacacaggc

SEQ ID NO: 261253 - DNA, 25 bp, Rattus norvegicus
cgttctcttagagatgcacacaggc

SEQ ID NO: 261254 - DNA, 25 bp, Rattus norvegicus
cgttctgggcagacgcctgtgtgca

SEQ ID NO: 261255 - DNA, 25 bp, Rattus norvegicus
cgttctgggcagtcgcctgtgtgca

SEQ ID NO: 261256 - DNA, 25 bp, Rattus norvegicus
cgttctggttaaatgcaactttatt

SEQ ID NO: 261257 - DNA, 25 bp, Rattus norvegicus
cgttctggttaattgcaactttatt

SEQ ID NO: 261258 - DNA, 25 bp, Rattus norvegicus
cgttctgtcagtattaactcacgca

SEQ ID NO: 261259 - DNA, 25 bp, Rattus norvegicus
cgttctgtcagttttaactcacgca

SEQ ID NO: 261260 - DNA, 25 bp, Rattus norvegicus
cgttctgtgggcagatgatctgact

SEQ ID NO: 261261 - DNA, 25 bp, Rattus norvegicus
cgttctgtgggctgatgatctgact

SEQ ID NO: 261262 - DNA, 25 bp, Rattus norvegicus
cgttcttaaacacccagtctccgta

SEQ ID NO: 261263 - DNA, 25 bp, Rattus norvegicus
cgttcttaaacagccagtctccgta

SEQ ID NO: 261264 - DNA, 25 bp, Rattus norvegicus
cgttcttgggtgctgagctatgtca

SEQ ID NO: 261265 - DNA, 25 bp, Rattus norvegicus
cgttcttgggtggtgagctatgtca

SEQ ID NO: 261266 - DNA, 25 bp, Rattus norvegicus
cgttctttctggatgactctgctca

SEQ ID NO: 261267 - DNA, 25 bp, Rattus norvegicus
cgttctttctggttgactctgctca

SEQ ID NO: 261268 - DNA, 25 bp, Rattus norvegicus
cgttctttttaaatccattgaccat

SEQ ID NO: 261269 - DNA, 25 bp, Rattus norvegicus
cgttctttttaattccattgaccat

SEQ ID NO: 261270 - DNA, 25 bp, Rattus norvegicus
cgttgacaccgtcttgatggtttta

SEQ ID NO: 261271 - DNA, 25 bp, Rattus norvegicus
cgttgacaccgtgttgatggtttta

SEQ ID NO: 261272 - DNA, 25 bp, Rattus norvegicus
cgttgactacggagcttcttgggaa

SEQ ID NO: 261273 - DNA, 25 bp, Rattus norvegicus
cgttgactacggtgcttcttgggaa

SEQ ID NO: 261274 - DNA, 25 bp, Rattus norvegicus
cgttgagacccaattcctttagaga

SEQ ID NO: 261275 - DNA, 25 bp, Rattus norvegicus
cgttgagacccatttcctttagaga

SEQ ID NO: 261276 - DNA, 25 bp, Rattus norvegicus
cgttgaggtgatctgagttgactaa

SEQ ID NO: 261277 - DNA, 25 bp, Rattus norvegicus
cgttgaggtgatgtgagttgactaa

SEQ ID NO: 261278 - DNA, 25 bp, Rattus norvegicus
cgttgccagagcagtgtcgtctgat

SEQ ID NO: 261279 - DNA, 25 bp, Rattus norvegicus
cgttgccagagctgtgtcgtctgat

SEQ ID NO: 261280 - DNA, 25 bp, Rattus norvegicus
cgttgccagcccatggtgttggatg

SEQ ID NO: 261281 - DNA, 25 bp, Rattus norvegicus
cgttgccagcccttggtgttggatg

SEQ ID NO: 261282 - DNA, 25 bp, Rattus norvegicus
cgttgcctggcgcagcatggccata

SEQ ID NO: 261283 - DNA, 25 bp, Rattus norvegicus
cgttgcctggcggagcatggccata

SEQ ID NO: 261284 - DNA, 25 bp, Rattus norvegicus
cgttgccttcgaagagctggtgaga

SEQ ID NO: 261285 - DNA, 25 bp, Rattus norvegicus
cgttgccttcgatgagctggtgaga

SEQ ID NO: 261286 - DNA, 25 bp, Rattus norvegicus
cgttgccttgggacctatctgatta

SEQ ID NO: 261287 - DNA, 25 bp, Rattus norvegicus
cgttgccttgggtcctatctgatta

SEQ ID NO: 261288 - DNA, 25 bp, Rattus norvegicus
cgttgcggcgcgacgaactggtctt

SEQ ID NO: 261289 - DNA, 25 bp, Rattus norvegicus
cgttgcggcgcgtcgaactggtctt

SEQ ID NO: 261290 - DNA, 25 bp, Rattus norvegicus
cgttgctcacttctgggattatgta

SEQ ID NO: 261291 - DNA, 25 bp, Rattus norvegicus
cgttgctcacttgtgggattatgta

SEQ ID NO: 261292 - DNA, 25 bp, Rattus norvegicus
cgttgctttgcccacaggataaatt

SEQ ID NO: 261293 - DNA, 25 bp, Rattus norvegicus
cgttgctttgccgacaggataaatt

SEQ ID NO: 261294 - DNA, 25 bp, Rattus norvegicus
cgttgctttgtgaactttaagggct

SEQ ID NO: 261295 - DNA, 25 bp, Rattus norvegicus
cgttgctttgtgtactttaagggct

SEQ ID NO: 261296 - DNA, 25 bp, Rattus norvegicus
cgttggaccccaagcccagagagaa

SEQ ID NO: 261297 - DNA, 25 bp, Rattus norvegicus
cgttggaccccatgcccagagagaa

SEQ ID NO: 261298 - DNA, 25 bp, Rattus norvegicus
cgttggcctctgattgctgaaggag

SEQ ID NO: 261299 - DNA, 25 bp, Rattus norvegicus
cgttggcctctgtttgctgaaggag

SEQ ID NO: 261300 - DNA, 25 bp, Rattus norvegicus
cgttgggacaacagagctgcatctt

SEQ ID NO: 261301 - DNA, 25 bp, Rattus norvegicus
cgttgggacaactgagctgcatctt

SEQ ID NO: 261302 - DNA, 25 bp, Rattus norvegicus
cgttgggatgggattctcgccgacc

SEQ ID NO: 261303 - DNA, 25 bp, Rattus norvegicus
cgttgggatgggtttctcgccgacc

SEQ ID NO: 261304 - DNA, 25 bp, Rattus norvegicus
cgttgggtggccactggtatttatt

SEQ ID NO: 261305 - DNA, 25 bp, Rattus norvegicus
cgttgggtggcctctggtatttatt

SEQ ID NO: 261306 - DNA, 25 bp, Rattus norvegicus
cgttggtcttggagttaagtgctcc

SEQ ID NO: 261307 - DNA, 25 bp, Rattus norvegicus
cgttggtcttggtgttaagtgctcc

SEQ ID NO: 261308 - DNA, 25 bp, Rattus norvegicus
cgttgtaaaacaagccagggccact

SEQ ID NO: 261309 - DNA, 25 bp, Rattus norvegicus
cgttgtaaaacatgccagggccact

SEQ ID NO: 261310 - DNA, 25 bp, Rattus norvegicus
cgttgtagacgcattttgagaattg

SEQ ID NO: 261311 - DNA, 25 bp, Rattus norvegicus
cgttgtagacgctttttgagaattg

SEQ ID NO: 261312 - DNA, 25 bp, Rattus norvegicus
cgttgtcctaaccatgctgaatttc

SEQ ID NO: 261313 - DNA, 25 bp, Rattus norvegicus
cgttgtcctaacgatgctgaatttc

SEQ ID NO: 261314 - DNA, 25 bp, Rattus norvegicus
cgttgtctgtgcagtaattcatact

SEQ ID NO: 261315 - DNA, 25 bp, Rattus norvegicus
cgttgtctgtgctgtaattcatact

SEQ ID NO: 261316 - DNA, 25 bp, Rattus norvegicus
cgttgtgccccaaagcgaagccggg

SEQ ID NO: 261317 - DNA, 25 bp, Rattus norvegicus
cgttgtgccccatagcgaagccggg

SEQ ID NO: 261318 - DNA, 25 bp, Rattus norvegicus
cgttgtggcaacatgggagtagtta

SEQ ID NO: 261319 - DNA, 25 bp, Rattus norvegicus
cgttgtggcaacttgggagtagtta

SEQ ID NO: 261320 - DNA, 25 bp, Rattus norvegicus
cgttgtgtcaacctagtcctttcac

SEQ ID NO: 261321 - DNA, 25 bp, Rattus norvegicus
cgttgtgtcaacgtagtcctttcac

SEQ ID NO: 261322 - DNA, 25 bp, Rattus norvegicus
cgttgttaactcaagactctctggt

SEQ ID NO: 261323 - DNA, 25 bp, Rattus norvegicus
cgttgttaactctagactctctggt

SEQ ID NO: 261324 - DNA, 25 bp, Rattus norvegicus
cgttgttggtacagtggacttgcgc

SEQ ID NO: 261325 - DNA, 25 bp, Rattus norvegicus
cgttgttggtactgtggacttgcgc

SEQ ID NO: 261326 - DNA, 25 bp, Rattus norvegicus
cgttgttggtgtagtggctggtggg

SEQ ID NO: 261327 - DNA, 25 bp, Rattus norvegicus
cgttgttggtgttgtggctggtggg

SEQ ID NO: 261328 - DNA, 25 bp, Rattus norvegicus
cgttgtttacaactgctcgcagagg

SEQ ID NO: 261329 - DNA, 25 bp, Rattus norvegicus
cgttgtttacaagtgctcgcagagg

SEQ ID NO: 261330 - DNA, 25 bp, Rattus norvegicus
cgttgtttgaatctgttgctatgct

SEQ ID NO: 261331 - DNA, 25 bp, Rattus norvegicus
cgttgtttgaatgtgttgctatgct

SEQ ID NO: 261332 - DNA, 25 bp, Rattus norvegicus
cgttgttttagacaagtaggcccag

SEQ ID NO: 261333 - DNA, 25 bp, Rattus norvegicus
cgttgttttagagaagtaggcccag

SEQ ID NO: 261334 - DNA, 25 bp, Rattus norvegicus
cgttgttttgggaccagcacacagt

SEQ ID NO: 261335 - DNA, 25 bp, Rattus norvegicus
cgttgttttgggtccagcacacagt

SEQ ID NO: 261336 - DNA, 25 bp, Rattus norvegicus
cgtttaacccacacgatttggctat

SEQ ID NO: 261337 - DNA, 25 bp, Rattus norvegicus
cgtttaacccactcgatttggctat

SEQ ID NO: 261338 - DNA, 25 bp, Rattus norvegicus
cgtttaatgttgaagcttttgcgaa

SEQ ID NO: 261339 - DNA, 25 bp, Rattus norvegicus
cgtttaatgttgtagcttttgcgaa

SEQ ID NO: 261340 - DNA, 25 bp, Rattus norvegicus
cgtttacagttcacgtgcacacaag

SEQ ID NO: 261341 - DNA, 25 bp, Rattus norvegicus
cgtttacagttctcgtgcacacaag

SEQ ID NO: 261342 - DNA, 25 bp, Rattus norvegicus
cgtttactgacgatggttttgccat

SEQ ID NO: 261343 - DNA, 25 bp, Rattus norvegicus
cgtttactgacgttggttttgccat

SEQ ID NO: 261344 - DNA, 25 bp, Rattus norvegicus
cgtttatgtcatcccctaaaagagg

SEQ ID NO: 261345 - DNA, 25 bp, Rattus norvegicus
cgtttatgtcatgccctaaaagagg

SEQ ID NO: 261346 - DNA, 25 bp, Rattus norvegicus
cgtttcaattctatcgggtgctatt

SEQ ID NO: 261347 - DNA, 25 bp, Rattus norvegicus
cgtttcaattctttcgggtgctatt

SEQ ID NO: 261348 - DNA, 25 bp, Rattus norvegicus
cgtttcatcattcggcgtgcgaatt

SEQ ID NO: 261349 - DNA, 25 bp, Rattus norvegicus
cgtttcatcattgggcgtgcgaatt

SEQ ID NO: 261350 - DNA, 25 bp, Rattus norvegicus
cgtttcatcctgatgggcattacat

SEQ ID NO: 261351 - DNA, 25 bp, Rattus norvegicus
cgtttcatcctgttgggcattacat

SEQ ID NO: 261352 - DNA, 25 bp, Rattus norvegicus
cgtttccagttgacctcttagaaga

SEQ ID NO: 261353 - DNA, 25 bp, Rattus norvegicus
cgtttccagttgtcctcttagaaga

SEQ ID NO: 261354 - DNA, 25 bp, Rattus norvegicus
cgtttccgcaacagctccaacttgg

SEQ ID NO: 261355 - DNA, 25 bp, Rattus norvegicus
cgtttccgcaactgctccaacttgg

SEQ ID NO: 261356 - DNA, 25 bp, Rattus norvegicus
cgtttcctggctccggcaaggtttt

SEQ ID NO: 261357 - DNA, 25 bp, Rattus norvegicus
cgtttcctggctgcggcaaggtttt

SEQ ID NO: 261358 - DNA, 25 bp, Rattus norvegicus
cgtttcctttcaaaaccttactgtg

SEQ ID NO: 261359 - DNA, 25 bp, Rattus norvegicus
cgtttcctttcataaccttactgtg

SEQ ID NO: 261360 - DNA, 25 bp, Rattus norvegicus
cgtttcgcaatacagtgtctccatt

SEQ ID NO: 261361 - DNA, 25 bp, Rattus norvegicus
cgtttcgcaatagagtgtctccatt

SEQ ID NO: 261362 - DNA, 25 bp, Rattus norvegicus
cgtttctagggccacagtcattgaa

SEQ ID NO: 261363 - DNA, 25 bp, Rattus norvegicus
cgtttctagggcgacagtcattgaa

SEQ ID NO: 261364 - DNA, 25 bp, Rattus norvegicus
cgtttctccacgaaactcgtggttg

SEQ ID NO: 261365 - DNA, 25 bp, Rattus norvegicus
cgtttctccacgtaactcgtggttg

SEQ ID NO: 261366 - DNA, 25 bp, Rattus norvegicus
cgtttctctccgctcaggacgtggg

SEQ ID NO: 261367 - DNA, 25 bp, Rattus norvegicus
cgtttctctccggtcaggacgtggg

SEQ ID NO: 261368 - DNA, 25 bp, Rattus norvegicus
cgtttctgccacagacaattactgt

SEQ ID NO: 261369 - DNA, 25 bp, Rattus norvegicus
cgtttctgccactgacaattactgt

SEQ ID NO: 261370 - DNA, 25 bp, Rattus norvegicus
cgtttctgctccattctcggatgag

SEQ ID NO: 261371 - DNA, 25 bp, Rattus norvegicus
cgtttctgctcctttctcggatgag

SEQ ID NO: 261372 - DNA, 25 bp, Rattus norvegicus
cgtttctttgcacacatcacaggtg

SEQ ID NO: 261373 - DNA, 25 bp, Rattus norvegicus
cgtttctttgcagacatcacaggtg

SEQ ID NO: 261374 - DNA, 25 bp, Rattus norvegicus
cgtttctttgcccatttttgaatgt

SEQ ID NO: 261375 - DNA, 25 bp, Rattus norvegicus
cgtttctttgccgatttttgaatgt

SEQ ID NO: 261376 - DNA, 25 bp, Rattus norvegicus
cgtttgatcctcatacactcaggga

SEQ ID NO: 261377 - DNA, 25 bp, Rattus norvegicus
cgtttgatcctcttacactcaggga

SEQ ID NO: 261378 - DNA, 25 bp, Rattus norvegicus
cgtttgattgcccaggacctggaaa

SEQ ID NO: 261379 - DNA, 25 bp, Rattus norvegicus
cgtttgattgccgaggacctggaaa

SEQ ID NO: 261380 - DNA, 25 bp, Rattus norvegicus
cgtttgcacacgacgcacggtggat

SEQ ID NO: 261381 - DNA, 25 bp, Rattus norvegicus
cgtttgcacacgtcgcacggtggat

SEQ ID NO: 261382 - DNA, 25 bp, Rattus norvegicus
cgtttgccctggatcatggacatga

SEQ ID NO: 261383 - DNA, 25 bp, Rattus norvegicus
cgtttgccctggttcatggacatga

SEQ ID NO: 261384 - DNA, 25 bp, Rattus norvegicus
cgtttgctttatcgagctctctgtg

SEQ ID NO: 261385 - DNA, 25 bp, Rattus norvegicus
cgtttgctttatggagctctctgtg

SEQ ID NO: 261386 - DNA, 25 bp, Rattus norvegicus
cgtttggatatacctggtcgggacc

SEQ ID NO: 261387 - DNA, 25 bp, Rattus norvegicus
cgtttggatatagctggtcgggacc

SEQ ID NO: 261388 - DNA, 25 bp, Rattus norvegicus
cgtttggtcagtctcgtgtgctgac

SEQ ID NO: 261389 - DNA, 25 bp, Rattus norvegicus
cgtttggtcagtgtcgtgtgctgac

SEQ ID NO: 261390 - DNA, 25 bp, Rattus norvegicus
cgtttgtggtgacccttgtgttatt

SEQ ID NO: 261391 - DNA, 25 bp, Rattus norvegicus
cgtttgtggtgagccttgtgttatt

SEQ ID NO: 261392 - DNA, 25 bp, Rattus norvegicus
cgtttgttccttatcattgctgaga

SEQ ID NO: 261393 - DNA, 25 bp, Rattus norvegicus
cgtttgttccttttcattgctgaga

SEQ ID NO: 261394 - DNA, 25 bp, Rattus norvegicus
cgttttcagagtattgtgtgccaat

SEQ ID NO: 261395 - DNA, 25 bp, Rattus norvegicus
cgttttcagagttttgtgtgccaat

SEQ ID NO: 261396 - DNA, 25 bp, Rattus norvegicus
cgttttcccatgctcaactatacaa

SEQ ID NO: 261397 - DNA, 25 bp, Rattus norvegicus
cgttttcccatggtcaactatacaa

SEQ ID NO: 261398 - DNA, 25 bp, Rattus norvegicus
cgttttccggaaagcagcatggtat

SEQ ID NO: 261399 - DNA, 25 bp, Rattus norvegicus
cgttttccggaatgcagcatggtat

SEQ ID NO: 261400 - DNA, 25 bp, Rattus norvegicus
cgttttgtttgcatcacctgactaa

SEQ ID NO: 261401 - DNA, 25 bp, Rattus norvegicus
cgttttgtttgcttcacctgactaa

SEQ ID NO: 261402 - DNA, 25 bp, Rattus norvegicus
cgtttttacactccttgcctagaaa

SEQ ID NO: 261403 - DNA, 25 bp, Rattus norvegicus
cgtttttacactgcttgcctagaaa

SEQ ID NO: 261404 - DNA, 25 bp, Rattus norvegicus
cgtttttcttccaatgactctacaa

SEQ ID NO: 261405 - DNA, 25 bp, Rattus norvegicus
cgtttttcttcctatgactctacaa

SEQ ID NO: 261406 - DNA, 25 bp, Rattus norvegicus
ctaaaacaagtgcatggctccaaat

SEQ ID NO: 261407 - DNA, 25 bp, Rattus norvegicus
ctaaaacaagtggatggctccaaat

SEQ ID NO: 261408 - DNA, 25 bp, Rattus norvegicus
ctaaaacataggacagtggtctgcg

SEQ ID NO: 261409 - DNA, 25 bp, Rattus norvegicus
ctaaaacataggtcagtggtctgcg

SEQ ID NO: 261410 - DNA, 25 bp, Rattus norvegicus
ctaaaacctgtaatcacaatgtgta

SEQ ID NO: 261411 - DNA, 25 bp, Rattus norvegicus
ctaaaacctgtattcacaatgtgta

SEQ ID NO: 261412 - DNA, 25 bp, Rattus norvegicus
ctaaaaggatggctgttcccactcc

SEQ ID NO: 261413 - DNA, 25 bp, Rattus norvegicus
ctaaaaggatgggtgttcccactcc

SEQ ID NO: 261414 - DNA, 25 bp, Rattus norvegicus
ctaaaaggttctacttcagcaaaca

SEQ ID NO: 261415 - DNA, 25 bp, Rattus norvegicus
ctaaaaggttcttcttcagcaaaca

SEQ ID NO: 261416 - DNA, 25 bp, Rattus norvegicus
ctaaaagtctgaaagcctaggcggg

SEQ ID NO: 261417 - DNA, 25 bp, Rattus norvegicus
ctaaaagtctgatagcctaggcggg

SEQ ID NO: 261418 - DNA, 25 bp, Rattus norvegicus
ctaaaatactgtacaccactcatcc

SEQ ID NO: 261419 - DNA, 25 bp, Rattus norvegicus
ctaaaatactgttcaccactcatcc

SEQ ID NO: 261420 - DNA, 25 bp, Rattus norvegicus
ctaaaataggctccgggagtggatt

SEQ ID NO: 261421 - DNA, 25 bp, Rattus norvegicus
ctaaaataggctgcgggagtggatt

SEQ ID NO: 261422 - DNA, 25 bp, Rattus norvegicus
ctaaaatcacttcggcgaccttgag

SEQ ID NO: 261423 - DNA, 25 bp, Rattus norvegicus
ctaaaatcacttgggcgaccttgag

SEQ ID NO: 261424 - DNA, 25 bp, Rattus norvegicus
ctaaaatgatttatgctggtatcaa

SEQ ID NO: 261425 - DNA, 25 bp, Rattus norvegicus
ctaaaatgatttttgctggtatcaa

SEQ ID NO: 261426 - DNA, 25 bp, Rattus norvegicus
ctaaaatgtgttagtgcagctcaaa

SEQ ID NO: 261427 - DNA, 25 bp, Rattus norvegicus
ctaaaatgtgtttgtgcagctcaaa

SEQ ID NO: 261428 - DNA, 25 bp, Rattus norvegicus
ctaaaattcagcaatatgcggatat

SEQ ID NO: 261429 - DNA, 25 bp, Rattus norvegicus
ctaaaattcagctatatgcggatat

SEQ ID NO: 261430 - DNA, 25 bp, Rattus norvegicus
ctaaacaaattcagtccccttcagt

SEQ ID NO: 261431 - DNA, 25 bp, Rattus norvegicus
ctaaacaaattctgtccccttcagt

SEQ ID NO: 261432 - DNA, 25 bp, Rattus norvegicus
ctaaacagcttgaacgcccatcatt

SEQ ID NO: 261433 - DNA, 25 bp, Rattus norvegicus
ctaaacagcttgtacgcccatcatt

SEQ ID NO: 261434 - DNA, 25 bp, Rattus norvegicus
ctaaacagtgagctgtcctggtggt

SEQ ID NO: 261435 - DNA, 25 bp, Rattus norvegicus
ctaaacagtgaggtgtcctggtggt

SEQ ID NO: 261436 - DNA, 25 bp, Rattus norvegicus
ctaaacatcatcatggaccatctct

SEQ ID NO: 261437 - DNA, 25 bp, Rattus norvegicus
ctaaacatcatcttggaccatctct

SEQ ID NO: 261438 - DNA, 25 bp, Rattus norvegicus
ctaaaccatagcattttcaggtctg

SEQ ID NO: 261439 - DNA, 25 bp, Rattus norvegicus
ctaaaccatagctttttcaggtctg

SEQ ID NO: 261440 - DNA, 25 bp, Rattus norvegicus
ctaaaccctttcaccacatgttata

SEQ ID NO: 261441 - DNA, 25 bp, Rattus norvegicus
ctaaaccctttctccacatgttata

SEQ ID NO: 261442 - DNA, 25 bp, Rattus norvegicus
ctaaacctatgcaggcttctctgag

SEQ ID NO: 261443 - DNA, 25 bp, Rattus norvegicus
ctaaacctatgctggcttctctgag

SEQ ID NO: 261444 - DNA, 25 bp, Rattus norvegicus
ctaaaccttactcgccgtagcagag

SEQ ID NO: 261445 - DNA, 25 bp, Rattus norvegicus
ctaaaccttactggccgtagcagag

SEQ ID NO: 261446 - DNA, 25 bp, Rattus norvegicus
ctaaaccttgctcattctttttctc

SEQ ID NO: 261447 - DNA, 25 bp, Rattus norvegicus
ctaaaccttgctgattctttttctc

SEQ ID NO: 261448 - DNA, 25 bp, Rattus norvegicus
ctaaactcttttcagtgtttcttgg

SEQ ID NO: 261449 - DNA, 25 bp, Rattus norvegicus
ctaaactcttttgagtgtttcttgg

SEQ ID NO: 261450 - DNA, 25 bp, Rattus norvegicus
ctaaactgtggaccttgggagaaga

SEQ ID NO: 261451 - DNA, 25 bp, Rattus norvegicus
ctaaactgtggagcttgggagaaga

SEQ ID NO: 261452 - DNA, 25 bp, Rattus norvegicus
ctaaacttagggaggctgtgtcaca

SEQ ID NO: 261453 - DNA, 25 bp, Rattus norvegicus
ctaaacttagggtggctgtgtcaca

SEQ ID NO: 261454 - DNA, 25 bp, Rattus norvegicus
ctaaacttgcagatttgtattatac

SEQ ID NO: 261455 - DNA, 25 bp, Rattus norvegicus
ctaaacttgcagttttgtattatac

SEQ ID NO: 261456 - DNA, 25 bp, Rattus norvegicus
ctaaagaggcttactgtgctggaat

SEQ ID NO: 261457 - DNA, 25 bp, Rattus norvegicus
ctaaagaggctttctgtgctggaat

SEQ ID NO: 261458 - DNA, 25 bp, Rattus norvegicus
ctaaagagtggtctcatctccttcc

SEQ ID NO: 261459 - DNA, 25 bp, Rattus norvegicus
ctaaagagtggtgtcatctccttcc

SEQ ID NO: 261460 - DNA, 25 bp, Rattus norvegicus
ctaaagatacggcattccagagctt

SEQ ID NO: 261461 - DNA, 25 bp, Rattus norvegicus
ctaaagatacgggattccagagctt

SEQ ID NO: 261462 - DNA, 25 bp, Rattus norvegicus
ctaaagatctacaggcctcgactat

SEQ ID NO: 261463 - DNA, 25 bp, Rattus norvegicus
ctaaagatctactggcctcgactat

SEQ ID NO: 261464 - DNA, 25 bp, Rattus norvegicus
ctaaagatttttcagaccccacaca

SEQ ID NO: 261465 - DNA, 25 bp, Rattus norvegicus
ctaaagatttttgagaccccacaca

SEQ ID NO: 261466 - DNA, 25 bp, Rattus norvegicus
ctaaagcaagatctcccttcgagga

SEQ ID NO: 261467 - DNA, 25 bp, Rattus norvegicus
ctaaagcaagatgtcccttcgagga

SEQ ID NO: 261468 - DNA, 25 bp, Rattus norvegicus
ctaaagcagaaacacttgggagtct

SEQ ID NO: 261469 - DNA, 25 bp, Rattus norvegicus
ctaaagcagaaagacttgggagtct

SEQ ID NO: 261470 - DNA, 25 bp, Rattus norvegicus
ctaaagcatgtccatgtggcgtcaa

SEQ ID NO: 261471 - DNA, 25 bp, Rattus norvegicus
ctaaagcatgtcgatgtggcgtcaa

SEQ ID NO: 261472 - DNA, 25 bp, Rattus norvegicus
ctaaagccatgacggagtccgtaca

SEQ ID NO: 261473 - DNA, 25 bp, Rattus norvegicus
ctaaagccatgagggagtccgtaca

SEQ ID NO: 261474 - DNA, 25 bp, Rattus norvegicus
ctaaagctttagactcggcctgtgt

SEQ ID NO: 261475 - DNA, 25 bp, Rattus norvegicus
ctaaagctttagtctcggcctgtgt

SEQ ID NO: 261476 - DNA, 25 bp, Rattus norvegicus
ctaaaggacaaccatctgcagatgt

SEQ ID NO: 261477 - DNA, 25 bp, Rattus norvegicus
ctaaaggacaacgatctgcagatgt

SEQ ID NO: 261478 - DNA, 25 bp, Rattus norvegicus
ctaaaggaccttagctgtctgctgt

SEQ ID NO: 261479 - DNA, 25 bp, Rattus norvegicus
ctaaaggacctttgctgtctgctgt

SEQ ID NO: 261480 - DNA, 25 bp, Rattus norvegicus
ctaaaggcacctagtttcagtttgt

SEQ ID NO: 261481 - DNA, 25 bp, Rattus norvegicus
ctaaaggcaccttgtttcagtttgt

SEQ ID NO: 261482 - DNA, 25 bp, Rattus norvegicus
ctaaaggccagtcagttgaagtctc

SEQ ID NO: 261483 - DNA, 25 bp, Rattus norvegicus
ctaaaggccagtgagttgaagtctc

SEQ ID NO: 261484 - DNA, 25 bp, Rattus norvegicus
ctaaaggctcctcggtggctgtgta

SEQ ID NO: 261485 - DNA, 25 bp, Rattus norvegicus
ctaaaggctcctgggtggctgtgta

SEQ ID NO: 261486 - DNA, 25 bp, Rattus norvegicus
ctaaaggctgctccccaagggcgtg

SEQ ID NO: 261487 - DNA, 25 bp, Rattus norvegicus
ctaaaggctgctgcccaagggcgtg

SEQ ID NO: 261488 - DNA, 25 bp, Rattus norvegicus
ctaaaggctttgcttgcgcagtggt

SEQ ID NO: 261489 - DNA, 25 bp, Rattus norvegicus
ctaaaggctttggttgcgcagtggt

SEQ ID NO: 261490 - DNA, 25 bp, Rattus norvegicus
ctaaagtaggtgaggcagggcccat

SEQ ID NO: 261491 - DNA, 25 bp, Rattus norvegicus
ctaaagtaggtgtggcagggcccat

SEQ ID NO: 261492 - DNA, 25 bp, Rattus norvegicus
ctaaagtagtccagtcttggcagcc

SEQ ID NO: 261493 - DNA, 25 bp, Rattus norvegicus
ctaaagtagtcctgtcttggcagcc

SEQ ID NO: 261494 - DNA, 25 bp, Rattus norvegicus
ctaaagtgtagtagtctgccctgag

SEQ ID NO: 261495 - DNA, 25 bp, Rattus norvegicus
ctaaagtgtagttgtctgccctgag

SEQ ID NO: 261496 - DNA, 25 bp, Rattus norvegicus
ctaaagtgtgaaagaagcggtggcc

SEQ ID NO: 261497 - DNA, 25 bp, Rattus norvegicus
ctaaagtgtgaatgaagcggtggcc

SEQ ID NO: 261498 - DNA, 25 bp, Rattus norvegicus
ctaaagttgaacagaccggtgacca

SEQ ID NO: 261499 - DNA, 25 bp, Rattus norvegicus
ctaaagttgaactgaccggtgacca

SEQ ID NO: 261500 - DNA, 25 bp, Rattus norvegicus
ctaaagttgagcagtgtgcccgttc

SEQ ID NO: 261501 - DNA, 25 bp, Rattus norvegicus
ctaaagttgagctgtgtgcccgttc

SEQ ID NO: 261502 - DNA, 25 bp, Rattus norvegicus
ctaaagttgccacatcttcgatctt

SEQ ID NO: 261503 - DNA, 25 bp, Rattus norvegicus
ctaaagttgccagatcttcgatctt

SEQ ID NO: 261504 - DNA, 25 bp, Rattus norvegicus
ctaaataaagacataaccccttgca

SEQ ID NO: 261505 - DNA, 25 bp, Rattus norvegicus
ctaaataaagacttaaccccttgca

SEQ ID NO: 261506 - DNA, 25 bp, Rattus norvegicus
ctaaatacctgtctttctcttgatc

SEQ ID NO: 261507 - DNA, 25 bp, Rattus norvegicus
ctaaatacctgtgtttctcttgatc

SEQ ID NO: 261508 - DNA, 25 bp, Rattus norvegicus
ctaaatcagcgtatgcattctcggc

SEQ ID NO: 261509 - DNA, 25 bp, Rattus norvegicus
ctaaatcagcgtttgcattctcggc

SEQ ID NO: 261510 - DNA, 25 bp, Rattus norvegicus
ctaaatccattcatattaccagttg

SEQ ID NO: 261511 - DNA, 25 bp, Rattus norvegicus
ctaaatccattcttattaccagttg

SEQ ID NO: 261512 - DNA, 25 bp, Rattus norvegicus
ctaaatcctggcactcaggaggtag

SEQ ID NO: 261513 - DNA, 25 bp, Rattus norvegicus
ctaaatcctggctctcaggaggtag

SEQ ID NO: 261514 - DNA, 25 bp, Rattus norvegicus
ctaaatcgcctgatactgggtgtca

SEQ ID NO: 261515 - DNA, 25 bp, Rattus norvegicus
ctaaatcgcctgttactgggtgtca

SEQ ID NO: 261516 - DNA, 25 bp, Rattus norvegicus
ctaaatctggcaacctgagttcaaa

SEQ ID NO: 261517 - DNA, 25 bp, Rattus norvegicus
ctaaatctggcatcctgagttcaaa

SEQ ID NO: 261518 - DNA, 25 bp, Rattus norvegicus
ctaaatgcattcacctactttctgt

SEQ ID NO: 261519 - DNA, 25 bp, Rattus norvegicus
ctaaatgcattctcctactttctgt

SEQ ID NO: 261520 - DNA, 25 bp, Rattus norvegicus
ctaaatgctgttactttctgatctt

SEQ ID NO: 261521 - DNA, 25 bp, Rattus norvegicus
ctaaatgctgtttctttctgatctt

SEQ ID NO: 261522 - DNA, 25 bp, Rattus norvegicus
ctaaatggagttcttctgggagctg

SEQ ID NO: 261523 - DNA, 25 bp, Rattus norvegicus
ctaaatggagttgttctgggagctg

SEQ ID NO: 261524 - DNA, 25 bp, Rattus norvegicus
ctaaatgggatcctcacaggttcca

SEQ ID NO: 261525 - DNA, 25 bp, Rattus norvegicus
ctaaatgggatcgtcacaggttcca

SEQ ID NO: 261526 - DNA, 25 bp, Rattus norvegicus
ctaaatgtaagacccagcctggtgt

SEQ ID NO: 261527 - DNA, 25 bp, Rattus norvegicus
ctaaatgtaagagccagcctggtgt

SEQ ID NO: 261528 - DNA, 25 bp, Rattus norvegicus
ctaaatgtcagtctgttcaaacccc

SEQ ID NO: 261529 - DNA, 25 bp, Rattus norvegicus
ctaaatgtcagtgtgttcaaacccc

SEQ ID NO: 261530 - DNA, 25 bp, Rattus norvegicus
ctaaatgtctttcggctggatgggt

SEQ ID NO: 261531 - DNA, 25 bp, Rattus norvegicus
ctaaatgtctttgggctggatgggt

SEQ ID NO: 261532 - DNA, 25 bp, Rattus norvegicus
ctaaatgttgcgagggtggcatgaa

SEQ ID NO: 261533 - DNA, 25 bp, Rattus norvegicus
ctaaatgttgcgtgggtggcatgaa

SEQ ID NO: 261534 - DNA, 25 bp, Rattus norvegicus
ctaaattgctgtaatctgtgtatgc

SEQ ID NO: 261535 - DNA, 25 bp, Rattus norvegicus
ctaaattgctgttatctgtgtatgc

SEQ ID NO: 261536 - DNA, 25 bp, Rattus norvegicus
ctaaatttagtaccctcctggtggg

SEQ ID NO: 261537 - DNA, 25 bp, Rattus norvegicus
ctaaatttagtagcctcctggtggg

SEQ ID NO: 261538 - DNA, 25 bp, Rattus norvegicus
ctaaatttcatcagagagcattgat

SEQ ID NO: 261539 - DNA, 25 bp, Rattus norvegicus
ctaaatttcatctgagagcattgat

SEQ ID NO: 261540 - DNA, 25 bp, Rattus norvegicus
ctaaatttctccaacacgtctgtac

SEQ ID NO: 261541 - DNA, 25 bp, Rattus norvegicus
ctaaatttctcctacacgtctgtac

SEQ ID NO: 261542 - DNA, 25 bp, Rattus norvegicus
ctaaatttgctgaggaaccaacggg

SEQ ID NO: 261543 - DNA, 25 bp, Rattus norvegicus
ctaaatttgctgtggaaccaacggg

SEQ ID NO: 261544 - DNA, 25 bp, Rattus norvegicus
ctaacaaagcacagtcgcatctctc

SEQ ID NO: 261545 - DNA, 25 bp, Rattus norvegicus
ctaacaaagcactgtcgcatctctc

SEQ ID NO: 261546 - DNA, 25 bp, Rattus norvegicus
ctaacaacagtgacgctctggcttg

SEQ ID NO: 261547 - DNA, 25 bp, Rattus norvegicus
ctaacaacagtgtcgctctggcttg

SEQ ID NO: 261548 - DNA, 25 bp, Rattus norvegicus
ctaacaacatggctgactctcacag

SEQ ID NO: 261549 - DNA, 25 bp, Rattus norvegicus
ctaacaacatgggtgactctcacag

SEQ ID NO: 261550 - DNA, 25 bp, Rattus norvegicus
ctaacaactttgctctggatgggaa

SEQ ID NO: 261551 - DNA, 25 bp, Rattus norvegicus
ctaacaactttggtctggatgggaa

SEQ ID NO: 261552 - DNA, 25 bp, Rattus norvegicus
ctaacaagatttcggctctcgtccg

SEQ ID NO: 261553 - DNA, 25 bp, Rattus norvegicus
ctaacaagatttgggctctcgtccg

SEQ ID NO: 261554 - DNA, 25 bp, Rattus norvegicus
ctaacacactgaccacactgtattg

SEQ ID NO: 261555 - DNA, 25 bp, Rattus norvegicus
ctaacacactgagcacactgtattg

SEQ ID NO: 261556 - DNA, 25 bp, Rattus norvegicus
ctaacacattggcttctcccagcat

SEQ ID NO: 261557 - DNA, 25 bp, Rattus norvegicus
ctaacacattgggttctcccagcat

SEQ ID NO: 261558 - DNA, 25 bp, Rattus norvegicus
ctaacaccggctctactagactttc

SEQ ID NO: 261559 - DNA, 25 bp, Rattus norvegicus
ctaacaccggctgtactagactttc

SEQ ID NO: 261560 - DNA, 25 bp, Rattus norvegicus
ctaacactctcaagtcactattctt

SEQ ID NO: 261561 - DNA, 25 bp, Rattus norvegicus
ctaacactctcatgtcactattctt

SEQ ID NO: 261562 - DNA, 25 bp, Rattus norvegicus
ctaacaggcctgatgtgttgcataa

SEQ ID NO: 261563 - DNA, 25 bp, Rattus norvegicus
ctaacaggcctgttgtgttgcataa

SEQ ID NO: 261564 - DNA, 25 bp, Rattus norvegicus
ctaacagggcacagtactctgctat

SEQ ID NO: 261565 - DNA, 25 bp, Rattus norvegicus
ctaacagggcactgtactctgctat

SEQ ID NO: 261566 - DNA, 25 bp, Rattus norvegicus
ctaacaggtcaaacaatcaggttct

SEQ ID NO: 261567 - DNA, 25 bp, Rattus norvegicus
ctaacaggtcaatcaatcaggttct

SEQ ID NO: 261568 - DNA, 25 bp, Rattus norvegicus
ctaacagttcctactgagtcctggg

SEQ ID NO: 261569 - DNA, 25 bp, Rattus norvegicus
ctaacagttccttctgagtcctggg

SEQ ID NO: 261570 - DNA, 25 bp, Rattus norvegicus
ctaacataggttataccaatatatt

SEQ ID NO: 261571 - DNA, 25 bp, Rattus norvegicus
ctaacataggttttaccaatatatt

SEQ ID NO: 261572 - DNA, 25 bp, Rattus norvegicus
ctaacatctcagacagagccaaggg

SEQ ID NO: 261573 - DNA, 25 bp, Rattus norvegicus
ctaacatctcagtcagagccaaggg

SEQ ID NO: 261574 - DNA, 25 bp, Rattus norvegicus
ctaacattgttacatgggcatccct

SEQ ID NO: 261575 - DNA, 25 bp, Rattus norvegicus
ctaacattgttagatgggcatccct

SEQ ID NO: 261576 - DNA, 25 bp, Rattus norvegicus
ctaacatttgccaagtcttcctggg

SEQ ID NO: 261577 - DNA, 25 bp, Rattus norvegicus
ctaacatttgcctagtcttcctggg

SEQ ID NO: 261578 - DNA, 25 bp, Rattus norvegicus
ctaaccaagcccaggattccatttt

SEQ ID NO: 261579 - DNA, 25 bp, Rattus norvegicus
ctaaccaagccctggattccatttt

SEQ ID NO: 261580 - DNA, 25 bp, Rattus norvegicus
ctaaccacagcgattgtgccttcag

SEQ ID NO: 261581 - DNA, 25 bp, Rattus norvegicus
ctaaccacagcgtttgtgccttcag

SEQ ID NO: 261582 - DNA, 25 bp, Rattus norvegicus
ctaaccactgacctataacccaggt

SEQ ID NO: 261583 - DNA, 25 bp, Rattus norvegicus
ctaaccactgacgtataacccaggt

SEQ ID NO: 261584 - DNA, 25 bp, Rattus norvegicus
ctaaccactgctctgtgctgaatat

SEQ ID NO: 261585 - DNA, 25 bp, Rattus norvegicus
ctaaccactgctgtgtgctgaatat

SEQ ID NO: 261586 - DNA, 25 bp, Rattus norvegicus
ctaaccagtagcagtggaaactcac

SEQ ID NO: 261587 - DNA, 25 bp, Rattus norvegicus
ctaaccagtagctgtggaaactcac

SEQ ID NO: 261588 - DNA, 25 bp, Rattus norvegicus
ctaaccagtgttcagcagtgtgtcc

SEQ ID NO: 261589 - DNA, 25 bp, Rattus norvegicus
ctaaccagtgttgagcagtgtgtcc

SEQ ID NO: 261590 - DNA, 25 bp, Rattus norvegicus
ctaaccatgttacttctttcctctc

SEQ ID NO: 261591 - DNA, 25 bp, Rattus norvegicus
ctaaccatgttagttctttcctctc

SEQ ID NO: 261592 - DNA, 25 bp, Rattus norvegicus
ctaaccattttcatactcttacctg

SEQ ID NO: 261593 - DNA, 25 bp, Rattus norvegicus
ctaaccattttcttactcttacctg

SEQ ID NO: 261594 - DNA, 25 bp, Rattus norvegicus
ctaacccaggaacggcggtgcttct

SEQ ID NO: 261595 - DNA, 25 bp, Rattus norvegicus
ctaacccaggaagggcggtgcttct

SEQ ID NO: 261596 - DNA, 25 bp, Rattus norvegicus
ctaacccaggttatgctgctgtgaa

SEQ ID NO: 261597 - DNA, 25 bp, Rattus norvegicus
ctaacccaggttttgctgctgtgaa

SEQ ID NO: 261598 - DNA, 25 bp, Rattus norvegicus
ctaacccagttgacttaataatgct

SEQ ID NO: 261599 - DNA, 25 bp, Rattus norvegicus
ctaacccagttgtcttaataatgct

SEQ ID NO: 261600 - DNA, 25 bp, Rattus norvegicus
ctaacccctttgagcagcagcagga

SEQ ID NO: 261601 - DNA, 25 bp, Rattus norvegicus
ctaacccctttgtgcagcagcagga

SEQ ID NO: 261602 - DNA, 25 bp, Rattus norvegicus
ctaaccctccctaaagctgtaggag

SEQ ID NO: 261603 - DNA, 25 bp, Rattus norvegicus
ctaaccctcccttaagctgtaggag

SEQ ID NO: 261604 - DNA, 25 bp, Rattus norvegicus
ctaaccctggaaaatgatgcatctt

SEQ ID NO: 261605 - DNA, 25 bp, Rattus norvegicus
ctaaccctggaatatgatgcatctt

SEQ ID NO: 261606 - DNA, 25 bp, Rattus norvegicus
ctaaccctggctcttactgttaata

SEQ ID NO: 261607 - DNA, 25 bp, Rattus norvegicus
ctaaccctggctgttactgttaata

SEQ ID NO: 261608 - DNA, 25 bp, Rattus norvegicus
ctaaccgagctgatgttggtgtcgt

SEQ ID NO: 261609 - DNA, 25 bp, Rattus norvegicus
ctaaccgagctgttgttggtgtcgt

SEQ ID NO: 261610 - DNA, 25 bp, Rattus norvegicus
ctaacctcaaacatctatgtctctg

SEQ ID NO: 261611 - DNA, 25 bp, Rattus norvegicus
ctaacctcaaacttctatgtctctg

SEQ ID NO: 261612 - DNA, 25 bp, Rattus norvegicus
ctaacctcaagtcagtgcccaataa

SEQ ID NO: 261613 - DNA, 25 bp, Rattus norvegicus
ctaacctcaagtgagtgcccaataa

SEQ ID NO: 261614 - DNA, 25 bp, Rattus norvegicus
ctaacctcaataacatgcagcgcca

SEQ ID NO: 261615 - DNA, 25 bp, Rattus norvegicus
ctaacctcaatatcatgcagcgcca

SEQ ID NO: 261616 - DNA, 25 bp, Rattus norvegicus
ctaacctcagtcatcacttctggag

SEQ ID NO: 261617 - DNA, 25 bp, Rattus norvegicus
ctaacctcagtcttcacttctggag

SEQ ID NO: 261618 - DNA, 25 bp, Rattus norvegicus
ctaacctgaaggatgtgtgctcgta

SEQ ID NO: 261619 - DNA, 25 bp, Rattus norvegicus
ctaacctgaaggttgtgtgctcgta

SEQ ID NO: 261620 - DNA, 25 bp, Rattus norvegicus
ctaacctgtgatagggtatgggctt

SEQ ID NO: 261621 - DNA, 25 bp, Rattus norvegicus
ctaacctgtgattgggtatgggctt

SEQ ID NO: 261622 - DNA, 25 bp, Rattus norvegicus
ctaacgaatctgcgacgtgcctaag

SEQ ID NO: 261623 - DNA, 25 bp, Rattus norvegicus
ctaacgaatctgggacgtgcctaag

SEQ ID NO: 261624 - DNA, 25 bp, Rattus norvegicus
ctaacgagtcatacttttgctttaa

SEQ ID NO: 261625 - DNA, 25 bp, Rattus norvegicus
ctaacgagtcattcttttgctttaa

SEQ ID NO: 261626 - DNA, 25 bp, Rattus norvegicus
ctaacgcccagtcgctcggcggtga

SEQ ID NO: 261627 - DNA, 25 bp, Rattus norvegicus
ctaacgcccagtggctcggcggtga

SEQ ID NO: 261628 - DNA, 25 bp, Rattus norvegicus
ctaacgctgtggatggtttgcccat

SEQ ID NO: 261629 - DNA, 25 bp, Rattus norvegicus
ctaacgctgtggttggtttgcccat

SEQ ID NO: 261630 - DNA, 25 bp, Rattus norvegicus
ctaacggattatagcgctgcgctgt

SEQ ID NO: 261631 - DNA, 25 bp, Rattus norvegicus
ctaacggattattgcgctgcgctgt

SEQ ID NO: 261632 - DNA, 25 bp, Rattus norvegicus
ctaacggctcacaacacatctttaa

SEQ ID NO: 261633 - DNA, 25 bp, Rattus norvegicus
ctaacggctcactacacatctttaa

SEQ ID NO: 261634 - DNA, 25 bp, Rattus norvegicus
ctaacggctgttactctcttgagag

SEQ ID NO: 261635 - DNA, 25 bp, Rattus norvegicus
ctaacggctgtttctctcttgagag

SEQ ID NO: 261636 - DNA, 25 bp, Rattus norvegicus
ctaacgtggtttatctttctcatgt

SEQ ID NO: 261637 - DNA, 25 bp, Rattus norvegicus
ctaacgtggtttttctttctcatgt

SEQ ID NO: 261638 - DNA, 25 bp, Rattus norvegicus
ctaacgtgtcaccttcaactgtaat

SEQ ID NO: 261639 - DNA, 25 bp, Rattus norvegicus
ctaacgtgtcacgttcaactgtaat

SEQ ID NO: 261640 - DNA, 25 bp, Rattus norvegicus
ctaacgttgatgaagcgacacgact

SEQ ID NO: 261641 - DNA, 25 bp, Rattus norvegicus
ctaacgttgatgtagcgacacgact

SEQ ID NO: 261642 - DNA, 25 bp, Rattus norvegicus
ctaacgtttaagcattggaggacat

SEQ ID NO: 261643 - DNA, 25 bp, Rattus norvegicus
ctaacgtttaaggattggaggacat

SEQ ID NO: 261644 - DNA, 25 bp, Rattus norvegicus
ctaacgtttcttcggctgggctggc

SEQ ID NO: 261645 - DNA, 25 bp, Rattus norvegicus
ctaacgtttcttgggctgggctggc

SEQ ID NO: 261646 - DNA, 25 bp, Rattus norvegicus
ctaactactagtccatttcctgatc

SEQ ID NO: 261647 - DNA, 25 bp, Rattus norvegicus
ctaactactagtgcatttcctgatc

SEQ ID NO: 261648 - DNA, 25 bp, Rattus norvegicus
ctaactatggtgactgacctgggca

SEQ ID NO: 261649 - DNA, 25 bp, Rattus norvegicus
ctaactatggtgtctgacctgggca

SEQ ID NO: 261650 - DNA, 25 bp, Rattus norvegicus
ctaactcagctcagtggtcacagga

SEQ ID NO: 261651 - DNA, 25 bp, Rattus norvegicus
ctaactcagctctgtggtcacagga

SEQ ID NO: 261652 - DNA, 25 bp, Rattus norvegicus
ctaactcaggtcagctggcaggact

SEQ ID NO: 261653 - DNA, 25 bp, Rattus norvegicus
ctaactcaggtctgctggcaggact

SEQ ID NO: 261654 - DNA, 25 bp, Rattus norvegicus
ctaactcagtgtagcttcagcttca

SEQ ID NO: 261655 - DNA, 25 bp, Rattus norvegicus
ctaactcagtgttgcttcagcttca

SEQ ID NO: 261656 - DNA, 25 bp, Rattus norvegicus
ctaactccagccaattgagggtagg

SEQ ID NO: 261657 - DNA, 25 bp, Rattus norvegicus
ctaactccagcctattgagggtagg

SEQ ID NO: 261658 - DNA, 25 bp, Rattus norvegicus
ctaactcccataccaccaaaggaat

SEQ ID NO: 261659 - DNA, 25 bp, Rattus norvegicus
ctaactcccatagcaccaaaggaat

SEQ ID NO: 261660 - DNA, 25 bp, Rattus norvegicus
ctaactcctgaacatctgggctaat

SEQ ID NO: 261661 - DNA, 25 bp, Rattus norvegicus
ctaactcctgaagatctgggctaat

SEQ ID NO: 261662 - DNA, 25 bp, Rattus norvegicus
ctaactctgaagcagccaagccctt

SEQ ID NO: 261663 - DNA, 25 bp, Rattus norvegicus
ctaactctgaaggagccaagccctt

SEQ ID NO: 261664 - DNA, 25 bp, Rattus norvegicus
ctaactctgatgctaaggaggctga

SEQ ID NO: 261665 - DNA, 25 bp, Rattus norvegicus
ctaactctgatggtaaggaggctga

SEQ ID NO: 261666 - DNA, 25 bp, Rattus norvegicus
ctaactcttgcaaattgttctctca

SEQ ID NO: 261667 - DNA, 25 bp, Rattus norvegicus
ctaactcttgcatattgttctctca

SEQ ID NO: 261668 - DNA, 25 bp, Rattus norvegicus
ctaactcttttcacctcttaagtga

SEQ ID NO: 261669 - DNA, 25 bp, Rattus norvegicus
ctaactcttttctcctcttaagtga

SEQ ID NO: 261670 - DNA, 25 bp, Rattus norvegicus
ctaactgatctgctctctgtatttg

SEQ ID NO: 261671 - DNA, 25 bp, Rattus norvegicus
ctaactgatctggtctctgtatttg

SEQ ID NO: 261672 - DNA, 25 bp, Rattus norvegicus
ctaactgcagaacccgatgcctgtc

SEQ ID NO: 261673 - DNA, 25 bp, Rattus norvegicus
ctaactgcagaagccgatgcctgtc

SEQ ID NO: 261674 - DNA, 25 bp, Rattus norvegicus
ctaactgctaaaaccattcttccac

SEQ ID NO: 261675 - DNA, 25 bp, Rattus norvegicus
ctaactgctaaatccattcttccac

SEQ ID NO: 261676 - DNA, 25 bp, Rattus norvegicus
ctaactgcttatctggctagggaaa

SEQ ID NO: 261677 - DNA, 25 bp, Rattus norvegicus
ctaactgcttatgtggctagggaaa

SEQ ID NO: 261678 - DNA, 25 bp, Rattus norvegicus
ctaactggagatatggttgcgggct

SEQ ID NO: 261679 - DNA, 25 bp, Rattus norvegicus
ctaactggagatttggttgcgggct

SEQ ID NO: 261680 - DNA, 25 bp, Rattus norvegicus
ctaactgggtgtcctttatgcttca

SEQ ID NO: 261681 - DNA, 25 bp, Rattus norvegicus
ctaactgggtgtgctttatgcttca

SEQ ID NO: 261682 - DNA, 25 bp, Rattus norvegicus
ctaactggtcctattcttgtctgtg

SEQ ID NO: 261683 - DNA, 25 bp, Rattus norvegicus
ctaactggtccttttcttgtctgtg

SEQ ID NO: 261684 - DNA, 25 bp, Rattus norvegicus
ctaactgtatatcgttcttctggat

SEQ ID NO: 261685 - DNA, 25 bp, Rattus norvegicus
ctaactgtatatggttcttctggat

SEQ ID NO: 261686 - DNA, 25 bp, Rattus norvegicus
ctaactgtcacactggaggctgccg

SEQ ID NO: 261687 - DNA, 25 bp, Rattus norvegicus
ctaactgtcacagtggaggctgccg

SEQ ID NO: 261688 - DNA, 25 bp, Rattus norvegicus
ctaactgtccctactgaatattcct

SEQ ID NO: 261689 - DNA, 25 bp, Rattus norvegicus
ctaactgtcccttctgaatattcct

SEQ ID NO: 261690 - DNA, 25 bp, Rattus norvegicus
ctaactgtggcccttttaaatgtgc

SEQ ID NO: 261691 - DNA, 25 bp, Rattus norvegicus
ctaactgtggccgttttaaatgtgc

SEQ ID NO: 261692 - DNA, 25 bp, Rattus norvegicus
ctaactgtgttcatgcctccctgtg

SEQ ID NO: 261693 - DNA, 25 bp, Rattus norvegicus
ctaactgtgttcttgcctccctgtg

SEQ ID NO: 261694 - DNA, 25 bp, Rattus norvegicus
ctaactgttatgcacgcctcatctc

SEQ ID NO: 261695 - DNA, 25 bp, Rattus norvegicus
ctaactgttatggacgcctcatctc

SEQ ID NO: 261696 - DNA, 25 bp, Rattus norvegicus
ctaacttagtctcaacatgccatct

SEQ ID NO: 261697 - DNA, 25 bp, Rattus norvegicus
ctaacttagtctgaacatgccatct

SEQ ID NO: 261698 - DNA, 25 bp, Rattus norvegicus
ctaacttcaagtactgttttgctgt

SEQ ID NO: 261699 - DNA, 25 bp, Rattus norvegicus
ctaacttcaagttctgttttgctgt

SEQ ID NO: 261700 - DNA, 25 bp, Rattus norvegicus
ctaacttgatccagagtgggcctca

SEQ ID NO: 261701 - DNA, 25 bp, Rattus norvegicus
ctaacttgatcctgagtgggcctca

SEQ ID NO: 261702 - DNA, 25 bp, Rattus norvegicus
ctaacttgccaccagataagatcta

SEQ ID NO: 261703 - DNA, 25 bp, Rattus norvegicus
ctaacttgccacgagataagatcta

SEQ ID NO: 261704 - DNA, 25 bp, Rattus norvegicus
ctaacttgctccaggctgggattaa

SEQ ID NO: 261705 - DNA, 25 bp, Rattus norvegicus
ctaacttgctcctggctgggattaa

SEQ ID NO: 261706 - DNA, 25 bp, Rattus norvegicus
ctaacttggatcacttttcttattc

SEQ ID NO: 261707 - DNA, 25 bp, Rattus norvegicus
ctaacttggatctcttttcttattc

SEQ ID NO: 261708 - DNA, 25 bp, Rattus norvegicus
ctaacttgttagcaacctgggagtg

SEQ ID NO: 261709 - DNA, 25 bp, Rattus norvegicus
ctaacttgttaggaacctgggagtg

SEQ ID NO: 261710 - DNA, 25 bp, Rattus norvegicus
ctaactttcactaatcctctcttat

SEQ ID NO: 261711 - DNA, 25 bp, Rattus norvegicus
ctaactttcacttatcctctcttat

SEQ ID NO: 261712 - DNA, 25 bp, Rattus norvegicus
ctaactttccggcatcatggaccat

SEQ ID NO: 261713 - DNA, 25 bp, Rattus norvegicus
ctaactttccgggatcatggaccat

SEQ ID NO: 261714 - DNA, 25 bp, Rattus norvegicus
ctaagaacgaggctggtgtgaccca

SEQ ID NO: 261715 - DNA, 25 bp, Rattus norvegicus
ctaagaacgagggtggtgtgaccca

SEQ ID NO: 261716 - DNA, 25 bp, Rattus norvegicus
ctaagaagaccactttcttccggtg

SEQ ID NO: 261717 - DNA, 25 bp, Rattus norvegicus
ctaagaagaccagtttcttccggtg

SEQ ID NO: 261718 - DNA, 25 bp, Rattus norvegicus
ctaagaatctgtcggcgctctgctc

SEQ ID NO: 261719 - DNA, 25 bp, Rattus norvegicus
ctaagaatctgtgggcgctctgctc

SEQ ID NO: 261720 - DNA, 25 bp, Rattus norvegicus
ctaagaattcagctgtaaaggatat

SEQ ID NO: 261721 - DNA, 25 bp, Rattus norvegicus
ctaagaattcaggtgtaaaggatat

SEQ ID NO: 261722 - DNA, 25 bp, Rattus norvegicus
ctaagacaaacgaagcctccagggt

SEQ ID NO: 261723 - DNA, 25 bp, Rattus norvegicus
ctaagacaaacgtagcctccagggt

SEQ ID NO: 261724 - DNA, 25 bp, Rattus norvegicus
ctaagacagaaacgcagttccggtt

SEQ ID NO: 261725 - DNA, 25 bp, Rattus norvegicus
ctaagacagaaaggcagttccggtt

SEQ ID NO: 261726 - DNA, 25 bp, Rattus norvegicus
ctaagacagacaccgctacatagtg

SEQ ID NO: 261727 - DNA, 25 bp, Rattus norvegicus
ctaagacagacagcgctacatagtg

SEQ ID NO: 261728 - DNA, 25 bp, Rattus norvegicus
ctaagacagcctcggtcagcgagat

SEQ ID NO: 261729 - DNA, 25 bp, Rattus norvegicus
ctaagacagcctgggtcagcgagat

SEQ ID NO: 261730 - DNA, 25 bp, Rattus norvegicus
ctaagaccgtgtctctgcgtgcaca

SEQ ID NO: 261731 - DNA, 25 bp, Rattus norvegicus
ctaagaccgtgtgtctgcgtgcaca

SEQ ID NO: 261732 - DNA, 25 bp, Rattus norvegicus
ctaagacgccgcatggcgctcagga

SEQ ID NO: 261733 - DNA, 25 bp, Rattus norvegicus
ctaagacgccgcttggcgctcagga

SEQ ID NO: 261734 - DNA, 25 bp, Rattus norvegicus
ctaagactatgacactaccttcctc

SEQ ID NO: 261735 - DNA, 25 bp, Rattus norvegicus
ctaagactatgagactaccttcctc

SEQ ID NO: 261736 - DNA, 25 bp, Rattus norvegicus
ctaagactgagcagccggcaactat

SEQ ID NO: 261737 - DNA, 25 bp, Rattus norvegicus
ctaagactgagctgccggcaactat

SEQ ID NO: 261738 - DNA, 25 bp, Rattus norvegicus
ctaagactgctgaccggtggcagtg

SEQ ID NO: 261739 - DNA, 25 bp, Rattus norvegicus
ctaagactgctgtccggtggcagtg

SEQ ID NO: 261740 - DNA, 25 bp, Rattus norvegicus
ctaagacttacaagtgttcagcact

SEQ ID NO: 261741 - DNA, 25 bp, Rattus norvegicus
ctaagacttacatgtgttcagcact

SEQ ID NO: 261742 - DNA, 25 bp, Rattus norvegicus
ctaagacttctacctatgcagccgt

SEQ ID NO: 261743 - DNA, 25 bp, Rattus norvegicus
ctaagacttctagctatgcagccgt

SEQ ID NO: 261744 - DNA, 25 bp, Rattus norvegicus
ctaagagatggcagacactgaattt

SEQ ID NO: 261745 - DNA, 25 bp, Rattus norvegicus
ctaagagatggctgacactgaattt

SEQ ID NO: 261746 - DNA, 25 bp, Rattus norvegicus
ctaagagcaccaagacagtacagtt

SEQ ID NO: 261747 - DNA, 25 bp, Rattus norvegicus
ctaagagcaccatgacagtacagtt

SEQ ID NO: 261748 - DNA, 25 bp, Rattus norvegicus
ctaagagctggtccgaatcttccct

SEQ ID NO: 261749 - DNA, 25 bp, Rattus norvegicus
ctaagagctggtgcgaatcttccct

SEQ ID NO: 261750 - DNA, 25 bp, Rattus norvegicus
ctaagaggaagcacagcccgtgtat

SEQ ID NO: 261751 - DNA, 25 bp, Rattus norvegicus
ctaagaggaagctcagcccgtgtat

SEQ ID NO: 261752 - DNA, 25 bp, Rattus norvegicus
ctaagagggcttactttttctctgc

SEQ ID NO: 261753 - DNA, 25 bp, Rattus norvegicus
ctaagagggctttctttttctctgc

SEQ ID NO: 261754 - DNA, 25 bp, Rattus norvegicus
ctaagagtgagtacgtgagttccag

SEQ ID NO: 261755 - DNA, 25 bp, Rattus norvegicus
ctaagagtgagttcgtgagttccag

SEQ ID NO: 261756 - DNA, 25 bp, Rattus norvegicus
ctaagatctcatacggctgcacttt

SEQ ID NO: 261757 - DNA, 25 bp, Rattus norvegicus
ctaagatctcattcggctgcacttt

SEQ ID NO: 261758 - DNA, 25 bp, Rattus norvegicus
ctaagatctcttctgtgcatgctac

SEQ ID NO: 261759 - DNA, 25 bp, Rattus norvegicus
ctaagatctcttgtgtgcatgctac

SEQ ID NO: 261760 - DNA, 25 bp, Rattus norvegicus
ctaagatgcatgcacgcgccctcat

SEQ ID NO: 261761 - DNA, 25 bp, Rattus norvegicus
ctaagatgcatggacgcgccctcat

SEQ ID NO: 261762 - DNA, 25 bp, Rattus norvegicus
ctaagatgctgtcttgtatcctgga

SEQ ID NO: 261763 - DNA, 25 bp, Rattus norvegicus
ctaagatgctgtgttgtatcctgga

SEQ ID NO: 261764 - DNA, 25 bp, Rattus norvegicus
ctaagatggcggctgtttctctggc

SEQ ID NO: 261765 - DNA, 25 bp, Rattus norvegicus
ctaagatggcgggtgtttctctggc

SEQ ID NO: 261766 - DNA, 25 bp, Rattus norvegicus
ctaagatggtggagccagccaggaa

SEQ ID NO: 261767 - DNA, 25 bp, Rattus norvegicus
ctaagatggtggtgccagccaggaa

SEQ ID NO: 261768 - DNA, 25 bp, Rattus norvegicus
ctaagattaatcatgtgcctttcat

SEQ ID NO: 261769 - DNA, 25 bp, Rattus norvegicus
ctaagattaatcttgtgcctttcat

SEQ ID NO: 261770 - DNA, 25 bp, Rattus norvegicus
ctaagcacagacacggcagagatta

SEQ ID NO: 261771 - DNA, 25 bp, Rattus norvegicus
ctaagcacagactcggcagagatta

SEQ ID NO: 261772 - DNA, 25 bp, Rattus norvegicus
ctaagcagatctactcttggaggat

SEQ ID NO: 261773 - DNA, 25 bp, Rattus norvegicus
ctaagcagatcttctcttggaggat

SEQ ID NO: 261774 - DNA, 25 bp, Rattus norvegicus
ctaagcattcctagggccactgaag

SEQ ID NO: 261775 - DNA, 25 bp, Rattus norvegicus
ctaagcattccttgggccactgaag

SEQ ID NO: 261776 - DNA, 25 bp, Rattus norvegicus
ctaagcattgtgaggttttgccaat

SEQ ID NO: 261777 - DNA, 25 bp, Rattus norvegicus
ctaagcattgtgtggttttgccaat

SEQ ID NO: 261778 - DNA, 25 bp, Rattus norvegicus
ctaagccaatggaacagtttctgtc

SEQ ID NO: 261779 - DNA, 25 bp, Rattus norvegicus
ctaagccaatggtacagtttctgtc

SEQ ID NO: 261780 - DNA, 25 bp, Rattus norvegicus
ctaagccctagacctttctctgaag

SEQ ID NO: 261781 - DNA, 25 bp, Rattus norvegicus
ctaagccctagagctttctctgaag

SEQ ID NO: 261782 - DNA, 25 bp, Rattus norvegicus
ctaagccctgcaattctgagaactg

SEQ ID NO: 261783 - DNA, 25 bp, Rattus norvegicus
ctaagccctgcatttctgagaactg

SEQ ID NO: 261784 - DNA, 25 bp, Rattus norvegicus
ctaagccctgctattagaggtaaca

SEQ ID NO: 261785 - DNA, 25 bp, Rattus norvegicus
ctaagccctgcttttagaggtaaca

SEQ ID NO: 261786 - DNA, 25 bp, Rattus norvegicus
ctaagccttggacatgatggaatat

SEQ ID NO: 261787 - DNA, 25 bp, Rattus norvegicus
ctaagccttggagatgatggaatat

SEQ ID NO: 261788 - DNA, 25 bp, Rattus norvegicus
ctaagcggtagtaatgtggcgtcac

SEQ ID NO: 261789 - DNA, 25 bp, Rattus norvegicus
ctaagcggtagttatgtggcgtcac

SEQ ID NO: 261790 - DNA, 25 bp, Rattus norvegicus
ctaagctaagcccattcagtctttc

SEQ ID NO: 261791 - DNA, 25 bp, Rattus norvegicus
ctaagctaagccgattcagtctttc

SEQ ID NO: 261792 - DNA, 25 bp, Rattus norvegicus
ctaagctaatcaaggttattttggg

SEQ ID NO: 261793 - DNA, 25 bp, Rattus norvegicus
ctaagctaatcatggttattttggg

SEQ ID NO: 261794 - DNA, 25 bp, Rattus norvegicus
ctaagctcactgactaatgccaatg

SEQ ID NO: 261795 - DNA, 25 bp, Rattus norvegicus
ctaagctcactgtctaatgccaatg

SEQ ID NO: 261796 - DNA, 25 bp, Rattus norvegicus
ctaagctcccttccatatatttcaa

SEQ ID NO: 261797 - DNA, 25 bp, Rattus norvegicus
ctaagctcccttgcatatatttcaa

SEQ ID NO: 261798 - DNA, 25 bp, Rattus norvegicus
ctaagctgctatcgtctgagtggac

SEQ ID NO: 261799 - DNA, 25 bp, Rattus norvegicus
ctaagctgctatggtctgagtggac

SEQ ID NO: 261800 - DNA, 25 bp, Rattus norvegicus
ctaagctgcttgaacattctaaagg

SEQ ID NO: 261801 - DNA, 25 bp, Rattus norvegicus
ctaagctgcttgtacattctaaagg

SEQ ID NO: 261802 - DNA, 25 bp, Rattus norvegicus
ctaagctgtactcggcaagcctggc

SEQ ID NO: 261803 - DNA, 25 bp, Rattus norvegicus
ctaagctgtactgggcaagcctggc

SEQ ID NO: 261804 - DNA, 25 bp, Rattus norvegicus
ctaagctgtctcatgtgatgaatga

SEQ ID NO: 261805 - DNA, 25 bp, Rattus norvegicus
ctaagctgtctcttgtgatgaatga

SEQ ID NO: 261806 - DNA, 25 bp, Rattus norvegicus
ctaagcttcatgacctcagttcaac

SEQ ID NO: 261807 - DNA, 25 bp, Rattus norvegicus
ctaagcttcatgtcctcagttcaac

SEQ ID NO: 261808 - DNA, 25 bp, Rattus norvegicus
ctaagcttcctgagtctagttatct

SEQ ID NO: 261809 - DNA, 25 bp, Rattus norvegicus
ctaagcttcctgtgtctagttatct

SEQ ID NO: 261810 - DNA, 25 bp, Rattus norvegicus
ctaagcttgtgaagtgtgccctgca

SEQ ID NO: 261811 - DNA, 25 bp, Rattus norvegicus
ctaagcttgtgatgtgtgccctgca

SEQ ID NO: 261812 - DNA, 25 bp, Rattus norvegicus
ctaagctttatcaaatctctctctc

SEQ ID NO: 261813 - DNA, 25 bp, Rattus norvegicus
ctaagctttatctaatctctctctc

SEQ ID NO: 261814 - DNA, 25 bp, Rattus norvegicus
ctaagctttcaaaacctgccttggg

SEQ ID NO: 261815 - DNA, 25 bp, Rattus norvegicus
ctaagctttcaatacctgccttggg

SEQ ID NO: 261816 - DNA, 25 bp, Rattus norvegicus
ctaagctttgctcaacccattgtta

SEQ ID NO: 261817 - DNA, 25 bp, Rattus norvegicus
ctaagctttgctgaacccattgtta

SEQ ID NO: 261818 - DNA, 25 bp, Rattus norvegicus
ctaaggaagtcacgcctgagggcca

SEQ ID NO: 261819 - DNA, 25 bp, Rattus norvegicus
ctaaggaagtcaggcctgagggcca

SEQ ID NO: 261820 - DNA, 25 bp, Rattus norvegicus
ctaaggaatttgagaaagcgtttca

SEQ ID NO: 261821 - DNA, 25 bp, Rattus norvegicus
ctaaggaatttgtgaaagcgtttca

SEQ ID NO: 261822 - DNA, 25 bp, Rattus norvegicus
ctaaggaccttacatgtttgctacc

SEQ ID NO: 261823 - DNA, 25 bp, Rattus norvegicus
ctaaggaccttagatgtttgctacc

SEQ ID NO: 261824 - DNA, 25 bp, Rattus norvegicus
ctaaggagacgtccaggccgagctt

SEQ ID NO: 261825 - DNA, 25 bp, Rattus norvegicus
ctaaggagacgtgcaggccgagctt

SEQ ID NO: 261826 - DNA, 25 bp, Rattus norvegicus
ctaaggagtggtatgtgcggctctc

SEQ ID NO: 261827 - DNA, 25 bp, Rattus norvegicus
ctaaggagtggtttgtgcggctctc

SEQ ID NO: 261828 - DNA, 25 bp, Rattus norvegicus
ctaaggcaccacattggtgtcctgc

SEQ ID NO: 261829 - DNA, 25 bp, Rattus norvegicus
ctaaggcaccactttggtgtcctgc

SEQ ID NO: 261830 - DNA, 25 bp, Rattus norvegicus
ctaaggcaggcacggtcacaagttt

SEQ ID NO: 261831 - DNA, 25 bp, Rattus norvegicus
ctaaggcaggcagggtcacaagttt

SEQ ID NO: 261832 - DNA, 25 bp, Rattus norvegicus
ctaaggccgcatagcttttgtcaaa

SEQ ID NO: 261833 - DNA, 25 bp, Rattus norvegicus
ctaaggccgcattgcttttgtcaaa

SEQ ID NO: 261834 - DNA, 25 bp, Rattus norvegicus
ctaaggccggcaaccatgttttatg

SEQ ID NO: 261835 - DNA, 25 bp, Rattus norvegicus
ctaaggccggcatccatgttttatg

SEQ ID NO: 261836 - DNA, 25 bp, Rattus norvegicus
ctaaggcctcctcaagtctgaaaag

SEQ ID NO: 261837 - DNA, 25 bp, Rattus norvegicus
ctaaggcctcctgaagtctgaaaag

SEQ ID NO: 261838 - DNA, 25 bp, Rattus norvegicus
ctaaggcgactaccagccacgcgtg

SEQ ID NO: 261839 - DNA, 25 bp, Rattus norvegicus
ctaaggcgactagcagccacgcgtg

SEQ ID NO: 261840 - DNA, 25 bp, Rattus norvegicus
ctaaggcgactcagaaccatctgta

SEQ ID NO: 261841 - DNA, 25 bp, Rattus norvegicus
ctaaggcgactctgaaccatctgta

SEQ ID NO: 261842 - DNA, 25 bp, Rattus norvegicus
ctaaggcgtcagccagcagctgtga

SEQ ID NO: 261843 - DNA, 25 bp, Rattus norvegicus
ctaaggcgtcaggcagcagctgtga

SEQ ID NO: 261844 - DNA, 25 bp, Rattus norvegicus
ctaaggctagcaaaggagtgtgtga

SEQ ID NO: 261845 - DNA, 25 bp, Rattus norvegicus
ctaaggctagcataggagtgtgtga

SEQ ID NO: 261846 - DNA, 25 bp, Rattus norvegicus
ctaaggctcccaattttactgttga

SEQ ID NO: 261847 - DNA, 25 bp, Rattus norvegicus
ctaaggctcccatttttactgttga

SEQ ID NO: 261848 - DNA, 25 bp, Rattus norvegicus
ctaaggctgaccctgtgtttatcta

SEQ ID NO: 261849 - DNA, 25 bp, Rattus norvegicus
ctaaggctgaccgtgtgtttatcta

SEQ ID NO: 261850 - DNA, 25 bp, Rattus norvegicus
ctaaggctgcttcgtgtttgttctc

SEQ ID NO: 261851 - DNA, 25 bp, Rattus norvegicus
ctaaggctgcttggtgtttgttctc

SEQ ID NO: 261852 - DNA, 25 bp, Rattus norvegicus
ctaaggctgggtcccaaagctgact

SEQ ID NO: 261853 - DNA, 25 bp, Rattus norvegicus
ctaaggctgggtgccaaagctgact

SEQ ID NO: 261854 - DNA, 25 bp, Rattus norvegicus
ctaagggctttgctctctgaggtca

SEQ ID NO: 261855 - DNA, 25 bp, Rattus norvegicus
ctaagggctttggtctctgaggtca

SEQ ID NO: 261856 - DNA, 25 bp, Rattus norvegicus
ctaaggtgacttcaggagcctccaa

SEQ ID NO: 261857 - DNA, 25 bp, Rattus norvegicus
ctaaggtgacttgaggagcctccaa

SEQ ID NO: 261858 - DNA, 25 bp, Rattus norvegicus
ctaaggtgttcacggtccacagaaa

SEQ ID NO: 261859 - DNA, 25 bp, Rattus norvegicus
ctaaggtgttcagggtccacagaaa

SEQ ID NO: 261860 - DNA, 25 bp, Rattus norvegicus
ctaaggttcgacaacggagggcaga

SEQ ID NO: 261861 - DNA, 25 bp, Rattus norvegicus
ctaaggttcgactacggagggcaga

SEQ ID NO: 261862 - DNA, 25 bp, Rattus norvegicus
ctaaggttcggcagtttgatttcaa

SEQ ID NO: 261863 - DNA, 25 bp, Rattus norvegicus
ctaaggttcggctgtttgatttcaa

SEQ ID NO: 261864 - DNA, 25 bp, Rattus norvegicus
ctaaggttcttgctcacttctgtaa

SEQ ID NO: 261865 - DNA, 25 bp, Rattus norvegicus
ctaaggttcttggtcacttctgtaa

SEQ ID NO: 261866 - DNA, 25 bp, Rattus norvegicus
ctaaggttgaaccagctgatggcta

SEQ ID NO: 261867 - DNA, 25 bp, Rattus norvegicus
ctaaggttgaacgagctgatggcta

SEQ ID NO: 261868 - DNA, 25 bp, Rattus norvegicus
ctaagtaccgttaacaatgtggcat

SEQ ID NO: 261869 - DNA, 25 bp, Rattus norvegicus
ctaagtaccgtttacaatgtggcat

SEQ ID NO: 261870 - DNA, 25 bp, Rattus norvegicus
ctaagtactgtacgctctgggtgtt

SEQ ID NO: 261871 - DNA, 25 bp, Rattus norvegicus
ctaagtactgtaggctctgggtgtt

SEQ ID NO: 261872 - DNA, 25 bp, Rattus norvegicus
ctaagtagccagaagacagtacctt

SEQ ID NO: 261873 - DNA, 25 bp, Rattus norvegicus
ctaagtagccagtagacagtacctt

SEQ ID NO: 261874 - DNA, 25 bp, Rattus norvegicus
ctaagtatgtgtccagcatctgtgc

SEQ ID NO: 261875 - DNA, 25 bp, Rattus norvegicus
ctaagtatgtgtgcagcatctgtgc

SEQ ID NO: 261876 - DNA, 25 bp, Rattus norvegicus
ctaagtcaggtgatctgggaaggat

SEQ ID NO: 261877 - DNA, 25 bp, Rattus norvegicus
ctaagtcaggtgttctgggaaggat

SEQ ID NO: 261878 - DNA, 25 bp, Rattus norvegicus
ctaagtcatggaacactgctctggt

SEQ ID NO: 261879 - DNA, 25 bp, Rattus norvegicus
ctaagtcatggatcactgctctggt

SEQ ID NO: 261880 - DNA, 25 bp, Rattus norvegicus
ctaagtctagaaattttgcctggga

SEQ ID NO: 261881 - DNA, 25 bp, Rattus norvegicus
ctaagtctagaatttttgcctggga

SEQ ID NO: 261882 - DNA, 25 bp, Rattus norvegicus
ctaagtctcagtactgtggcttaaa

SEQ ID NO: 261883 - DNA, 25 bp, Rattus norvegicus
ctaagtctcagttctgtggcttaaa

SEQ ID NO: 261884 - DNA, 25 bp, Rattus norvegicus
ctaagtctctcgctacgtgtgtggg

SEQ ID NO: 261885 - DNA, 25 bp, Rattus norvegicus
ctaagtctctcggtacgtgtgtggg

SEQ ID NO: 261886 - DNA, 25 bp, Rattus norvegicus
ctaagtgcactgatggttcctgtct

SEQ ID NO: 261887 - DNA, 25 bp, Rattus norvegicus
ctaagtgcactgttggttcctgtct

SEQ ID NO: 261888 - DNA, 25 bp, Rattus norvegicus
ctaagtgcagctccctagttgggta

SEQ ID NO: 261889 - DNA, 25 bp, Rattus norvegicus
ctaagtgcagctgcctagttgggta

SEQ ID NO: 261890 - DNA, 25 bp, Rattus norvegicus
ctaagtgcgttgactctgattgcgt

SEQ ID NO: 261891 - DNA, 25 bp, Rattus norvegicus
ctaagtgcgttgtctctgattgcgt

SEQ ID NO: 261892 - DNA, 25 bp, Rattus norvegicus
ctaagtgctgctcatggattggtat

SEQ ID NO: 261893 - DNA, 25 bp, Rattus norvegicus
ctaagtgctgctgatggattggtat

SEQ ID NO: 261894 - DNA, 25 bp, Rattus norvegicus
ctaagtggctggacctcaggacctg

SEQ ID NO: 261895 - DNA, 25 bp, Rattus norvegicus
ctaagtggctggtcctcaggacctg

SEQ ID NO: 261896 - DNA, 25 bp, Rattus norvegicus
ctaagtgtaatgaatctgtcagtca

SEQ ID NO: 261897 - DNA, 25 bp, Rattus norvegicus
ctaagtgtaatgtatctgtcagtca

SEQ ID NO: 261898 - DNA, 25 bp, Rattus norvegicus
ctaagtgtctagagagatggcccag

SEQ ID NO: 261899 - DNA, 25 bp, Rattus norvegicus
ctaagtgtctagtgagatggcccag

SEQ ID NO: 261900 - DNA, 25 bp, Rattus norvegicus
ctaagtgtctctcccttctgcttta

SEQ ID NO: 261901 - DNA, 25 bp, Rattus norvegicus
ctaagtgtctctgccttctgcttta

SEQ ID NO: 261902 - DNA, 25 bp, Rattus norvegicus
ctaagtgtgacccttgggctttcaa

SEQ ID NO: 261903 - DNA, 25 bp, Rattus norvegicus
ctaagtgtgaccgttgggctttcaa

SEQ ID NO: 261904 - DNA, 25 bp, Rattus norvegicus
ctaagtgtgcccattgaccactgaa

SEQ ID NO: 261905 - DNA, 25 bp, Rattus norvegicus
ctaagtgtgccctttgaccactgaa

SEQ ID NO: 261906 - DNA, 25 bp, Rattus norvegicus
ctaagttcaaacacagcccctgagg

SEQ ID NO: 261907 - DNA, 25 bp, Rattus norvegicus
ctaagttcaaactcagcccctgagg

SEQ ID NO: 261908 - DNA, 25 bp, Rattus norvegicus
ctaagttccttgcttttgtgggcac

SEQ ID NO: 261909 - DNA, 25 bp, Rattus norvegicus
ctaagttccttggttttgtgggcac

SEQ ID NO: 261910 - DNA, 25 bp, Rattus norvegicus
ctaagttctttgaccacagcgggac

SEQ ID NO: 261911 - DNA, 25 bp, Rattus norvegicus
ctaagttctttgtccacagcgggac

SEQ ID NO: 261912 - DNA, 25 bp, Rattus norvegicus
ctaagttgagcgagctacacgccta

SEQ ID NO: 261913 - DNA, 25 bp, Rattus norvegicus
ctaagttgagcgtgctacacgccta

SEQ ID NO: 261914 - DNA, 25 bp, Rattus norvegicus
ctaagttgctagactccttggctat

SEQ ID NO: 261915 - DNA, 25 bp, Rattus norvegicus
ctaagttgctagtctccttggctat

SEQ ID NO: 261916 - DNA, 25 bp, Rattus norvegicus
ctaagttgctgcagggactagtcaa

SEQ ID NO: 261917 - DNA, 25 bp, Rattus norvegicus
ctaagttgctgctgggactagtcaa

SEQ ID NO: 261918 - DNA, 25 bp, Rattus norvegicus
ctaagttgtcttaagctgtgtctac

SEQ ID NO: 261919 - DNA, 25 bp, Rattus norvegicus
ctaagttgtctttagctgtgtctac

SEQ ID NO: 261920 - DNA, 25 bp, Rattus norvegicus
ctaagtttacttcaggaccgagtct

SEQ ID NO: 261921 - DNA, 25 bp, Rattus norvegicus
ctaagtttacttgaggaccgagtct

SEQ ID NO: 261922 - DNA, 25 bp, Rattus norvegicus
ctaagttttgtcagttattcatgca

SEQ ID NO: 261923 - DNA, 25 bp, Rattus norvegicus
ctaagttttgtctgttattcatgca

SEQ ID NO: 261924 - DNA, 25 bp, Rattus norvegicus
ctaataaagcgtcctctgagccaat

SEQ ID NO: 261925 - DNA, 25 bp, Rattus norvegicus
ctaataaagcgtgctctgagccaat

SEQ ID NO: 261926 - DNA, 25 bp, Rattus norvegicus
ctaataaaggttactgaggcactgc

SEQ ID NO: 261927 - DNA, 25 bp, Rattus norvegicus
ctaataaaggtttctgaggcactgc

SEQ ID NO: 261928 - DNA, 25 bp, Rattus norvegicus
ctaataatctgtcccaactctacct

SEQ ID NO: 261929 - DNA, 25 bp, Rattus norvegicus
ctaataatctgtgccaactctacct

SEQ ID NO: 261930 - DNA, 25 bp, Rattus norvegicus
ctaatacaaactccagagtcctggg

SEQ ID NO: 261931 - DNA, 25 bp, Rattus norvegicus
ctaatacaaactgcagagtcctggg

SEQ ID NO: 261932 - DNA, 25 bp, Rattus norvegicus
ctaataccaaacctggaaacagatg

SEQ ID NO: 261933 - DNA, 25 bp, Rattus norvegicus
ctaataccaaacgtggaaacagatg

SEQ ID NO: 261934 - DNA, 25 bp, Rattus norvegicus
ctaatacccttactccatggatctt

SEQ ID NO: 261935 - DNA, 25 bp, Rattus norvegicus
ctaatacccttagtccatggatctt

SEQ ID NO: 261936 - DNA, 25 bp, Rattus norvegicus
ctaatacgtgtgaggcaagcagttt

SEQ ID NO: 261937 - DNA, 25 bp, Rattus norvegicus
ctaatacgtgtgtggcaagcagttt

SEQ ID NO: 261938 - DNA, 25 bp, Rattus norvegicus
ctaatacttcttagggtgggagcac

SEQ ID NO: 261939 - DNA, 25 bp, Rattus norvegicus
ctaatacttctttgggtgggagcac

SEQ ID NO: 261940 - DNA, 25 bp, Rattus norvegicus
ctaatagaccaaaggacccttgccc

SEQ ID NO: 261941 - DNA, 25 bp, Rattus norvegicus
ctaatagaccaatggacccttgccc

SEQ ID NO: 261942 - DNA, 25 bp, Rattus norvegicus
ctaatagatctgaccctatctctgt

SEQ ID NO: 261943 - DNA, 25 bp, Rattus norvegicus
ctaatagatctgtccctatctctgt

SEQ ID NO: 261944 - DNA, 25 bp, Rattus norvegicus
ctaatccacttcaaccaagaactct

SEQ ID NO: 261945 - DNA, 25 bp, Rattus norvegicus
ctaatccacttctaccaagaactct

SEQ ID NO: 261946 - DNA, 25 bp, Rattus norvegicus
ctaatccctaaaacctgtctcataa

SEQ ID NO: 261947 - DNA, 25 bp, Rattus norvegicus
ctaatccctaaatcctgtctcataa

SEQ ID NO: 261948 - DNA, 25 bp, Rattus norvegicus
ctaatcctcaagaccactttcaggg

SEQ ID NO: 261949 - DNA, 25 bp, Rattus norvegicus
ctaatcctcaagtccactttcaggg

SEQ ID NO: 261950 - DNA, 25 bp, Rattus norvegicus
ctaatccttgtaacttggcagtgta

SEQ ID NO: 261951 - DNA, 25 bp, Rattus norvegicus
ctaatccttgtatcttggcagtgta

SEQ ID NO: 261952 - DNA, 25 bp, Rattus norvegicus
ctaatcggaatgcttcgaggccatg

SEQ ID NO: 261953 - DNA, 25 bp, Rattus norvegicus
ctaatcggaatggttcgaggccatg

SEQ ID NO: 261954 - DNA, 25 bp, Rattus norvegicus
ctaatctcacctacccaagtatatt

SEQ ID NO: 261955 - DNA, 25 bp, Rattus norvegicus
ctaatctcaccttcccaagtatatt

SEQ ID NO: 261956 - DNA, 25 bp, Rattus norvegicus
ctaatctctcacaggctaatgcttt

SEQ ID NO: 261957 - DNA, 25 bp, Rattus norvegicus
ctaatctctcactggctaatgcttt

SEQ ID NO: 261958 - DNA, 25 bp, Rattus norvegicus
ctaatctcttcaagtgacacatccc

SEQ ID NO: 261959 - DNA, 25 bp, Rattus norvegicus
ctaatctcttcatgtgacacatccc

SEQ ID NO: 261960 - DNA, 25 bp, Rattus norvegicus
ctaatctgtacaagaggcttccttc

SEQ ID NO: 261961 - DNA, 25 bp, Rattus norvegicus
ctaatctgtacatgaggcttccttc

SEQ ID NO: 261962 - DNA, 25 bp, Rattus norvegicus
ctaatcttcagtagcttcagcctat

SEQ ID NO: 261963 - DNA, 25 bp, Rattus norvegicus
ctaatcttcagttgcttcagcctat

SEQ ID NO: 261964 - DNA, 25 bp, Rattus norvegicus
ctaatctttaccagaagccgagagc

SEQ ID NO: 261965 - DNA, 25 bp, Rattus norvegicus
ctaatctttacctgaagccgagagc

SEQ ID NO: 261966 - DNA, 25 bp, Rattus norvegicus
ctaatgacaggaaaatagcttggca

SEQ ID NO: 261967 - DNA, 25 bp, Rattus norvegicus
ctaatgacaggataatagcttggca

SEQ ID NO: 261968 - DNA, 25 bp, Rattus norvegicus
ctaatgacataaacctcagctgact

SEQ ID NO: 261969 - DNA, 25 bp, Rattus norvegicus
ctaatgacataatcctcagctgact

SEQ ID NO: 261970 - DNA, 25 bp, Rattus norvegicus
ctaatgattctgagactctggtttt

SEQ ID NO: 261971 - DNA, 25 bp, Rattus norvegicus
ctaatgattctgtgactctggtttt

SEQ ID NO: 261972 - DNA, 25 bp, Rattus norvegicus
ctaatgccacacctctttaaaacag

SEQ ID NO: 261973 - DNA, 25 bp, Rattus norvegicus
ctaatgccacacgtctttaaaacag

SEQ ID NO: 261974 - DNA, 25 bp, Rattus norvegicus
ctaatgccatggatttgctattctg

SEQ ID NO: 261975 - DNA, 25 bp, Rattus norvegicus
ctaatgccatggttttgctattctg

SEQ ID NO: 261976 - DNA, 25 bp, Rattus norvegicus
ctaatgcgagaactcagccatccaa

SEQ ID NO: 261977 - DNA, 25 bp, Rattus norvegicus
ctaatgcgagaagtcagccatccaa

SEQ ID NO: 261978 - DNA, 25 bp, Rattus norvegicus
ctaatgctatctatttggcctcttc

SEQ ID NO: 261979 - DNA, 25 bp, Rattus norvegicus
ctaatgctatctttttggcctcttc

SEQ ID NO: 261980 - DNA, 25 bp, Rattus norvegicus
ctaatgctggccagactggttgtca

SEQ ID NO: 261981 - DNA, 25 bp, Rattus norvegicus
ctaatgctggcctgactggttgtca

SEQ ID NO: 261982 - DNA, 25 bp, Rattus norvegicus
ctaatgctgttaccccagcagacct

SEQ ID NO: 261983 - DNA, 25 bp, Rattus norvegicus
ctaatgctgttagcccagcagacct

SEQ ID NO: 261984 - DNA, 25 bp, Rattus norvegicus
ctaatgcttctcaattccagggaat

SEQ ID NO: 261985 - DNA, 25 bp, Rattus norvegicus
ctaatgcttctctattccagggaat

SEQ ID NO: 261986 - DNA, 25 bp, Rattus norvegicus
ctaatgcttgataggagggcttgga

SEQ ID NO: 261987 - DNA, 25 bp, Rattus norvegicus
ctaatgcttgattggagggcttgga

SEQ ID NO: 261988 - DNA, 25 bp, Rattus norvegicus
ctaatggacaggctccttggtgacc

SEQ ID NO: 261989 - DNA, 25 bp, Rattus norvegicus
ctaatggacagggtccttggtgacc

SEQ ID NO: 261990 - DNA, 25 bp, Rattus norvegicus
ctaatggagttgctttggattttct

SEQ ID NO: 261991 - DNA, 25 bp, Rattus norvegicus
ctaatggagttggtttggattttct

SEQ ID NO: 261992 - DNA, 25 bp, Rattus norvegicus
ctaatggcctgaatggcatctccag

SEQ ID NO: 261993 - DNA, 25 bp, Rattus norvegicus
ctaatggcctgattggcatctccag

SEQ ID NO: 261994 - DNA, 25 bp, Rattus norvegicus
ctaatgggaatgctgctgggccact

SEQ ID NO: 261995 - DNA, 25 bp, Rattus norvegicus
ctaatgggaatggtgctgggccact

SEQ ID NO: 261996 - DNA, 25 bp, Rattus norvegicus
ctaatgtcacaactgcctcctgcaa

SEQ ID NO: 261997 - DNA, 25 bp, Rattus norvegicus
ctaatgtcacaagtgcctcctgcaa

SEQ ID NO: 261998 - DNA, 25 bp, Rattus norvegicus
ctaatgtctgtcagtggatattgca

SEQ ID NO: 261999 - DNA, 25 bp, Rattus norvegicus
ctaatgtctgtctgtggatattgca

SEQ ID NO: 262000 - DNA, 25 bp, Rattus norvegicus
ctaatgtgactaatcttgggcgatt

SEQ ID NO: 262001 - DNA, 25 bp, Rattus norvegicus
ctaatgtgactattcttgggcgatt

SEQ ID NO: 262002 - DNA, 25 bp, Rattus norvegicus
ctaatgttgggacctgtgtgctgtt

SEQ ID NO: 262003 - DNA, 25 bp, Rattus norvegicus
ctaatgttgggagctgtgtgctgtt

SEQ ID NO: 262004 - DNA, 25 bp, Rattus norvegicus
ctaattaatgccacagctaccgctg

SEQ ID NO: 262005 - DNA, 25 bp, Rattus norvegicus
ctaattaatgcctcagctaccgctg

SEQ ID NO: 262006 - DNA, 25 bp, Rattus norvegicus
ctaattagcatccttattccacctg

SEQ ID NO: 262007 - DNA, 25 bp, Rattus norvegicus
ctaattagcatcgttattccacctg

SEQ ID NO: 262008 - DNA, 25 bp, Rattus norvegicus
ctaattcatttcatatacccgctcc

SEQ ID NO: 262009 - DNA, 25 bp, Rattus norvegicus
ctaattcatttcttatacccgctcc

SEQ ID NO: 262010 - DNA, 25 bp, Rattus norvegicus
ctaattctaagaatggcagagtcaa

SEQ ID NO: 262011 - DNA, 25 bp, Rattus norvegicus
ctaattctaagattggcagagtcaa

SEQ ID NO: 262012 - DNA, 25 bp, Rattus norvegicus
ctaattcttaaaactcatccccttg

SEQ ID NO: 262013 - DNA, 25 bp, Rattus norvegicus
ctaattcttaaatctcatccccttg

SEQ ID NO: 262014 - DNA, 25 bp, Rattus norvegicus
ctaattcttacccagacctcaataa

SEQ ID NO: 262015 - DNA, 25 bp, Rattus norvegicus
ctaattcttaccgagacctcaataa

SEQ ID NO: 262016 - DNA, 25 bp, Rattus norvegicus
ctaattcttggtacttgcccctgtc

SEQ ID NO: 262017 - DNA, 25 bp, Rattus norvegicus
ctaattcttggttcttgcccctgtc

SEQ ID NO: 262018 - DNA, 25 bp, Rattus norvegicus
ctaattctttctcctgtttgtcaca

SEQ ID NO: 262019 - DNA, 25 bp, Rattus norvegicus
ctaattctttctgctgtttgtcaca

SEQ ID NO: 262020 - DNA, 25 bp, Rattus norvegicus
ctaattgcactgagcaagcgagcta

SEQ ID NO: 262021 - DNA, 25 bp, Rattus norvegicus
ctaattgcactgtgcaagcgagcta

SEQ ID NO: 262022 - DNA, 25 bp, Rattus norvegicus
ctaattgttagccagtgtattcatc

SEQ ID NO: 262023 - DNA, 25 bp, Rattus norvegicus
ctaattgttagcgagtgtattcatc

SEQ ID NO: 262024 - DNA, 25 bp, Rattus norvegicus
ctaatttcatcccaccagagttttt

SEQ ID NO: 262025 - DNA, 25 bp, Rattus norvegicus
ctaatttcatccgaccagagttttt

SEQ ID NO: 262026 - DNA, 25 bp, Rattus norvegicus
ctaattttctgtattctgtcctgga

SEQ ID NO: 262027 - DNA, 25 bp, Rattus norvegicus
ctaattttctgttttctgtcctgga

SEQ ID NO: 262028 - DNA, 25 bp, Rattus norvegicus
ctaattttgtaacaaccctgagtca

SEQ ID NO: 262029 - DNA, 25 bp, Rattus norvegicus
ctaattttgtaagaaccctgagtca

SEQ ID NO: 262030 - DNA, 25 bp, Rattus norvegicus
ctacaaaaagcgacactgaggcgtg

SEQ ID NO: 262031 - DNA, 25 bp, Rattus norvegicus
ctacaaaaagcgtcactgaggcgtg

SEQ ID NO: 262032 - DNA, 25 bp, Rattus norvegicus
ctacaaaaggagattccagacaaat

SEQ ID NO: 262033 - DNA, 25 bp, Rattus norvegicus
ctacaaaaggagtttccagacaaat

SEQ ID NO: 262034 - DNA, 25 bp, Rattus norvegicus
ctacaaatatttccctacccgcttg

SEQ ID NO: 262035 - DNA, 25 bp, Rattus norvegicus
ctacaaatatttgcctacccgcttg

SEQ ID NO: 262036 - DNA, 25 bp, Rattus norvegicus
ctacaaattgagatcctggacagca

SEQ ID NO: 262037 - DNA, 25 bp, Rattus norvegicus
ctacaaattgagttcctggacagca

SEQ ID NO: 262038 - DNA, 25 bp, Rattus norvegicus
ctacaacacataagctgagcccttc

SEQ ID NO: 262039 - DNA, 25 bp, Rattus norvegicus
ctacaacacatatgctgagcccttc

SEQ ID NO: 262040 - DNA, 25 bp, Rattus norvegicus
ctacaacagtcacagcagccttggg

SEQ ID NO: 262041 - DNA, 25 bp, Rattus norvegicus
ctacaacagtcagagcagccttggg

SEQ ID NO: 262042 - DNA, 25 bp, Rattus norvegicus
ctacaaccgtgaacctttctgagag

SEQ ID NO: 262043 - DNA, 25 bp, Rattus norvegicus
ctacaaccgtgatcctttctgagag

SEQ ID NO: 262044 - DNA, 25 bp, Rattus norvegicus
ctacaacctctccaatacagacagt

SEQ ID NO: 262045 - DNA, 25 bp, Rattus norvegicus
ctacaacctctcgaatacagacagt

SEQ ID NO: 262046 - DNA, 25 bp, Rattus norvegicus
ctacaactatttcaagaccatacag

SEQ ID NO: 262047 - DNA, 25 bp, Rattus norvegicus
ctacaactatttgaagaccatacag

SEQ ID NO: 262048 - DNA, 25 bp, Rattus norvegicus
ctacaagaggatccctgcttgcttg

SEQ ID NO: 262049 - DNA, 25 bp, Rattus norvegicus
ctacaagaggatgcctgcttgcttg

SEQ ID NO: 262050 - DNA, 25 bp, Rattus norvegicus
ctacaagagtcacgcccctttaagg

SEQ ID NO: 262051 - DNA, 25 bp, Rattus norvegicus
ctacaagagtcaggcccctttaagg

SEQ ID NO: 262052 - DNA, 25 bp, Rattus norvegicus
ctacaagcccttcgtctgcgagttt

SEQ ID NO: 262053 - DNA, 25 bp, Rattus norvegicus
ctacaagcccttggtctgcgagttt

SEQ ID NO: 262054 - DNA, 25 bp, Rattus norvegicus
ctacaagcggctactggattctggg

SEQ ID NO: 262055 - DNA, 25 bp, Rattus norvegicus
ctacaagcggcttctggattctggg

SEQ ID NO: 262056 - DNA, 25 bp, Rattus norvegicus
ctacaaggagacagaagcaacatca

SEQ ID NO: 262057 - DNA, 25 bp, Rattus norvegicus
ctacaaggagactgaagcaacatca

SEQ ID NO: 262058 - DNA, 25 bp, Rattus norvegicus
ctacaatcacgtaatgctgctttcc

SEQ ID NO: 262059 - DNA, 25 bp, Rattus norvegicus
ctacaatcacgttatgctgctttcc

SEQ ID NO: 262060 - DNA, 25 bp, Rattus norvegicus
ctacaatcatagctattcagacagt

SEQ ID NO: 262061 - DNA, 25 bp, Rattus norvegicus
ctacaatcataggtattcagacagt

SEQ ID NO: 262062 - DNA, 25 bp, Rattus norvegicus
ctacaatgagctccgtgtggcccct

SEQ ID NO: 262063 - DNA, 25 bp, Rattus norvegicus
ctacaatgagctgcgtgtggcccct

SEQ ID NO: 262064 - DNA, 25 bp, Rattus norvegicus
ctacaatttgacaatttctatttgc

SEQ ID NO: 262065 - DNA, 25 bp, Rattus norvegicus
ctacaatttgactatttctatttgc

SEQ ID NO: 262066 - DNA, 25 bp, Rattus norvegicus
ctacaattttggatgcttactgcta

SEQ ID NO: 262067 - DNA, 25 bp, Rattus norvegicus
ctacaattttggttgcttactgcta

SEQ ID NO: 262068 - DNA, 25 bp, Rattus norvegicus
ctacacaatggaaggatgctctcta

SEQ ID NO: 262069 - DNA, 25 bp, Rattus norvegicus
ctacacaatggatggatgctctcta

SEQ ID NO: 262070 - DNA, 25 bp, Rattus norvegicus
ctacacacacagcttgtgaggttca

SEQ ID NO: 262071 - DNA, 25 bp, Rattus norvegicus
ctacacacacaggttgtgaggttca

SEQ ID NO: 262072 - DNA, 25 bp, Rattus norvegicus
ctacacataccactctttcttggaa

SEQ ID NO: 262073 - DNA, 25 bp, Rattus norvegicus
ctacacataccagtctttcttggaa

SEQ ID NO: 262074 - DNA, 25 bp, Rattus norvegicus
ctacaccatgatcacccatgcctta

SEQ ID NO: 262075 - DNA, 25 bp, Rattus norvegicus
ctacaccatgatgacccatgcctta

SEQ ID NO: 262076 - DNA, 25 bp, Rattus norvegicus
ctacacccacaacagactcagaagt

SEQ ID NO: 262077 - DNA, 25 bp, Rattus norvegicus
ctacacccacaagagactcagaagt

SEQ ID NO: 262078 - DNA, 25 bp, Rattus norvegicus
ctacacccgtgtcgctaagaacagt

SEQ ID NO: 262079 - DNA, 25 bp, Rattus norvegicus
ctacacccgtgtggctaagaacagt

SEQ ID NO: 262080 - DNA, 25 bp, Rattus norvegicus
ctacaccctggacgctgcggagcaa

SEQ ID NO: 262081 - DNA, 25 bp, Rattus norvegicus
ctacaccctggaggctgcggagcaa

SEQ ID NO: 262082 - DNA, 25 bp, Rattus norvegicus
ctacacccttttcccatcaaagtgg

SEQ ID NO: 262083 - DNA, 25 bp, Rattus norvegicus
ctacacccttttgccatcaaagtgg

SEQ ID NO: 262084 - DNA, 25 bp, Rattus norvegicus
ctacacctcaacacatttagagaat

SEQ ID NO: 262085 - DNA, 25 bp, Rattus norvegicus
ctacacctcaactcatttagagaat

SEQ ID NO: 262086 - DNA, 25 bp, Rattus norvegicus
ctacacctggtcatagtcttgagat

SEQ ID NO: 262087 - DNA, 25 bp, Rattus norvegicus
ctacacctggtcttagtcttgagat

SEQ ID NO: 262088 - DNA, 25 bp, Rattus norvegicus
ctacaccttggtcaacttttctgag

SEQ ID NO: 262089 - DNA, 25 bp, Rattus norvegicus
ctacaccttggtgaacttttctgag

SEQ ID NO: 262090 - DNA, 25 bp, Rattus norvegicus
ctacacgagggtatttcagaaaatg

SEQ ID NO: 262091 - DNA, 25 bp, Rattus norvegicus
ctacacgagggtttttcagaaaatg

SEQ ID NO: 262092 - DNA, 25 bp, Rattus norvegicus
ctacactcagatccatgtgctggga

SEQ ID NO: 262093 - DNA, 25 bp, Rattus norvegicus
ctacactcagatgcatgtgctggga

SEQ ID NO: 262094 - DNA, 25 bp, Rattus norvegicus
ctacactgaggaccaggttgtctcc

SEQ ID NO: 262095 - DNA, 25 bp, Rattus norvegicus
ctacactgaggagcaggttgtctcc

SEQ ID NO: 262096 - DNA, 25 bp, Rattus norvegicus
ctacactggaggaagcgtctggcat

SEQ ID NO: 262097 - DNA, 25 bp, Rattus norvegicus
ctacactggaggtagcgtctggcat

SEQ ID NO: 262098 - DNA, 25 bp, Rattus norvegicus
ctacactggtggctttttaagtaat

SEQ ID NO: 262099 - DNA, 25 bp, Rattus norvegicus
ctacactggtgggtttttaagtaat

SEQ ID NO: 262100 - DNA, 25 bp, Rattus norvegicus
ctacacttcctgcacgtctttgaaa

SEQ ID NO: 262101 - DNA, 25 bp, Rattus norvegicus
ctacacttcctggacgtctttgaaa

SEQ ID NO: 262102 - DNA, 25 bp, Rattus norvegicus
ctacacttgcgcattgcggatgaat

SEQ ID NO: 262103 - DNA, 25 bp, Rattus norvegicus
ctacacttgcgctttgcggatgaat

SEQ ID NO: 262104 - DNA, 25 bp, Rattus norvegicus
ctacacttgggaacagccctgtaac

SEQ ID NO: 262105 - DNA, 25 bp, Rattus norvegicus
ctacacttgggatcagccctgtaac

SEQ ID NO: 262106 - DNA, 25 bp, Rattus norvegicus
ctacagaaagcaagccgcgtggcac

SEQ ID NO: 262107 - DNA, 25 bp, Rattus norvegicus
ctacagaaagcatgccgcgtggcac

SEQ ID NO: 262108 - DNA, 25 bp, Rattus norvegicus
ctacagaaatggacttcgaagtagt

SEQ ID NO: 262109 - DNA, 25 bp, Rattus norvegicus
ctacagaaatggtcttcgaagtagt

SEQ ID NO: 262110 - DNA, 25 bp, Rattus norvegicus
ctacagaagacgcagcccggaggca

SEQ ID NO: 262111 - DNA, 25 bp, Rattus norvegicus
ctacagaagacggagcccggaggca

SEQ ID NO: 262112 - DNA, 25 bp, Rattus norvegicus
ctacagaagtggactggcggtccgc

SEQ ID NO: 262113 - DNA, 25 bp, Rattus norvegicus
ctacagaagtggtctggcggtccgc

SEQ ID NO: 262114 - DNA, 25 bp, Rattus norvegicus
ctacagaatcagcaagttcagcccc

SEQ ID NO: 262115 - DNA, 25 bp, Rattus norvegicus
ctacagaatcaggaagttcagcccc

SEQ ID NO: 262116 - DNA, 25 bp, Rattus norvegicus
ctacagaatctcatctgtctcctga

SEQ ID NO: 262117 - DNA, 25 bp, Rattus norvegicus
ctacagaatctcttctgtctcctga

SEQ ID NO: 262118 - DNA, 25 bp, Rattus norvegicus
ctacagacagaacagcgcgcaactt

SEQ ID NO: 262119 - DNA, 25 bp, Rattus norvegicus
ctacagacagaagagcgcgcaactt

SEQ ID NO: 262120 - DNA, 25 bp, Rattus norvegicus
ctacagacagatccggccgtgtaca

SEQ ID NO: 262121 - DNA, 25 bp, Rattus norvegicus
ctacagacagatgcggccgtgtaca

SEQ ID NO: 262122 - DNA, 25 bp, Rattus norvegicus
ctacagacagccacggctatgtaga

SEQ ID NO: 262123 - DNA, 25 bp, Rattus norvegicus
ctacagacagcctcggctatgtaga

SEQ ID NO: 262124 - DNA, 25 bp, Rattus norvegicus
ctacagacctatcccacagacttaa

SEQ ID NO: 262125 - DNA, 25 bp, Rattus norvegicus
ctacagacctatgccacagacttaa

SEQ ID NO: 262126 - DNA, 25 bp, Rattus norvegicus
ctacagagagacatcctcacaaatc

SEQ ID NO: 262127 - DNA, 25 bp, Rattus norvegicus
ctacagagagacttcctcacaaatc

SEQ ID NO: 262128 - DNA, 25 bp, Rattus norvegicus
ctacagagcctccaggctgaggata

SEQ ID NO: 262129 - DNA, 25 bp, Rattus norvegicus
ctacagagcctcgaggctgaggata

SEQ ID NO: 262130 - DNA, 25 bp, Rattus norvegicus
ctacagaggatcaagtggagactac

SEQ ID NO: 262131 - DNA, 25 bp, Rattus norvegicus
ctacagaggatctagtggagactac

SEQ ID NO: 262132 - DNA, 25 bp, Rattus norvegicus
ctacagaggcagctctaggtcagtg

SEQ ID NO: 262133 - DNA, 25 bp, Rattus norvegicus
ctacagaggcaggtctaggtcagtg

SEQ ID NO: 262134 - DNA, 25 bp, Rattus norvegicus
ctacagagttgcctcccaaaggagt

SEQ ID NO: 262135 - DNA, 25 bp, Rattus norvegicus
ctacagagttgcgtcccaaaggagt

SEQ ID NO: 262136 - DNA, 25 bp, Rattus norvegicus
ctacagagttgtcccagttcagagt

SEQ ID NO: 262137 - DNA, 25 bp, Rattus norvegicus
ctacagagttgtgccagttcagagt

SEQ ID NO: 262138 - DNA, 25 bp, Rattus norvegicus
ctacagatgcctagccttgagccat

SEQ ID NO: 262139 - DNA, 25 bp, Rattus norvegicus
ctacagatgccttgccttgagccat

SEQ ID NO: 262140 - DNA, 25 bp, Rattus norvegicus
ctacagatggctcctggccctctgg

SEQ ID NO: 262141 - DNA, 25 bp, Rattus norvegicus
ctacagatggctgctggccctctgg

SEQ ID NO: 262142 - DNA, 25 bp, Rattus norvegicus
ctacagcagttccaatccactcggg

SEQ ID NO: 262143 - DNA, 25 bp, Rattus norvegicus
ctacagcagttcgaatccactcggg

SEQ ID NO: 262144 - DNA, 25 bp, Rattus norvegicus
ctacagcatggtacggtttctgccg

SEQ ID NO: 262145 - DNA, 25 bp, Rattus norvegicus
ctacagcatggttcggtttctgccg

SEQ ID NO: 262146 - DNA, 25 bp, Rattus norvegicus
ctacagccagccaagcagtggatgt

SEQ ID NO: 262147 - DNA, 25 bp, Rattus norvegicus
ctacagccagcctagcagtggatgt

SEQ ID NO: 262148 - DNA, 25 bp, Rattus norvegicus
ctacagcctctgaggactttgaaca

SEQ ID NO: 262149 - DNA, 25 bp, Rattus norvegicus
ctacagcctctgtggactttgaaca

SEQ ID NO: 262150 - DNA, 25 bp, Rattus norvegicus
ctacagcctgtacttcctaaaccta

SEQ ID NO: 262151 - DNA, 25 bp, Rattus norvegicus
ctacagcctgtagttcctaaaccta

SEQ ID NO: 262152 - DNA, 25 bp, Rattus norvegicus
ctacagcgggtgagtctgcagagct

SEQ ID NO: 262153 - DNA, 25 bp, Rattus norvegicus
ctacagcgggtgtgtctgcagagct

SEQ ID NO: 262154 - DNA, 25 bp, Rattus norvegicus
ctacaggaaggaaacagtgacatta

SEQ ID NO: 262155 - DNA, 25 bp, Rattus norvegicus
ctacaggaaggatacagtgacatta

SEQ ID NO: 262156 - DNA, 25 bp, Rattus norvegicus
ctacaggacctacgcacgcatgcgt

SEQ ID NO: 262157 - DNA, 25 bp, Rattus norvegicus
ctacaggacctaggcacgcatgcgt

SEQ ID NO: 262158 - DNA, 25 bp, Rattus norvegicus
ctacaggagtttcccagaggctcca

SEQ ID NO: 262159 - DNA, 25 bp, Rattus norvegicus
ctacaggagtttgccagaggctcca

SEQ ID NO: 262160 - DNA, 25 bp, Rattus norvegicus
ctacaggatccaagtgcttcatcat

SEQ ID NO: 262161 - DNA, 25 bp, Rattus norvegicus
ctacaggatccatgtgcttcatcat

SEQ ID NO: 262162 - DNA, 25 bp, Rattus norvegicus
ctacaggatcggagaagttctacag

SEQ ID NO: 262163 - DNA, 25 bp, Rattus norvegicus
ctacaggatcggtgaagttctacag

SEQ ID NO: 262164 - DNA, 25 bp, Rattus norvegicus
ctacagggacatcgagggaatctca

SEQ ID NO: 262165 - DNA, 25 bp, Rattus norvegicus
ctacagggacatggagggaatctca

SEQ ID NO: 262166 - DNA, 25 bp, Rattus norvegicus
ctacagggagtcattcacggagtct

SEQ ID NO: 262167 - DNA, 25 bp, Rattus norvegicus
ctacagggagtctttcacggagtct

SEQ ID NO: 262168 - DNA, 25 bp, Rattus norvegicus
ctacagggatccacgggctttctca

SEQ ID NO: 262169 - DNA, 25 bp, Rattus norvegicus
ctacagggatcctcgggctttctca

SEQ ID NO: 262170 - DNA, 25 bp, Rattus norvegicus
ctacagggcagaacgatggtgaaat

SEQ ID NO: 262171 - DNA, 25 bp, Rattus norvegicus
ctacagggcagatcgatggtgaaat

SEQ ID NO: 262172 - DNA, 25 bp, Rattus norvegicus
ctacagggcctgaagcaactgattc

SEQ ID NO: 262173 - DNA, 25 bp, Rattus norvegicus
ctacagggcctgtagcaactgattc

SEQ ID NO: 262174 - DNA, 25 bp, Rattus norvegicus
ctacaggtgatcactgcgcgaagaa

SEQ ID NO: 262175 - DNA, 25 bp, Rattus norvegicus
ctacaggtgatctctgcgcgaagaa

SEQ ID NO: 262176 - DNA, 25 bp, Rattus norvegicus
ctacaggttaagcttttcagggcat

SEQ ID NO: 262177 - DNA, 25 bp, Rattus norvegicus
ctacaggttaaggttttcagggcat

SEQ ID NO: 262178 - DNA, 25 bp, Rattus norvegicus
ctacaggttgatcctgtgaggccca

SEQ ID NO: 262179 - DNA, 25 bp, Rattus norvegicus
ctacaggttgatgctgtgaggccca

SEQ ID NO: 262180 - DNA, 25 bp, Rattus norvegicus
ctacaggttgtaaagcgggctcttg

SEQ ID NO: 262181 - DNA, 25 bp, Rattus norvegicus
ctacaggttgtatagcgggctcttg

SEQ ID NO: 262182 - DNA, 25 bp, Rattus norvegicus
ctacagtatttcaggtgcctaccac

SEQ ID NO: 262183 - DNA, 25 bp, Rattus norvegicus
ctacagtatttctggtgcctaccac

SEQ ID NO: 262184 - DNA, 25 bp, Rattus norvegicus
ctacagtctaaacgccatatccagg

SEQ ID NO: 262185 - DNA, 25 bp, Rattus norvegicus
ctacagtctaaaggccatatccagg

SEQ ID NO: 262186 - DNA, 25 bp, Rattus norvegicus
ctacagtgaactactgcaatatcag

SEQ ID NO: 262187 - DNA, 25 bp, Rattus norvegicus
ctacagtgaacttctgcaatatcag

SEQ ID NO: 262188 - DNA, 25 bp, Rattus norvegicus
ctacagtggacaaactgctggctta

SEQ ID NO: 262189 - DNA, 25 bp, Rattus norvegicus
ctacagtggacatactgctggctta

SEQ ID NO: 262190 - DNA, 25 bp, Rattus norvegicus
ctacagtgtgtactgtgctctgggt

SEQ ID NO: 262191 - DNA, 25 bp, Rattus norvegicus
ctacagtgtgtagtgtgctctgggt

SEQ ID NO: 262192 - DNA, 25 bp, Rattus norvegicus
ctacagttatgtatggccacgtcct

SEQ ID NO: 262193 - DNA, 25 bp, Rattus norvegicus
ctacagttatgtttggccacgtcct

SEQ ID NO: 262194 - DNA, 25 bp, Rattus norvegicus
ctacagttccagcagtgagttccag

SEQ ID NO: 262195 - DNA, 25 bp, Rattus norvegicus
ctacagttccaggagtgagttccag

SEQ ID NO: 262196 - DNA, 25 bp, Rattus norvegicus
ctacagtttctgaaaggtctctgcc

SEQ ID NO: 262197 - DNA, 25 bp, Rattus norvegicus
ctacagtttctgtaaggtctctgcc

SEQ ID NO: 262198 - DNA, 25 bp, Rattus norvegicus
ctacataatgcccaagcctgcaaga

SEQ ID NO: 262199 - DNA, 25 bp, Rattus norvegicus
ctacataatgccgaagcctgcaaga

SEQ ID NO: 262200 - DNA, 25 bp, Rattus norvegicus
ctacatacactacgccagcagcaga

SEQ ID NO: 262201 - DNA, 25 bp, Rattus norvegicus
ctacatacactaggccagcagcaga

SEQ ID NO: 262202 - DNA, 25 bp, Rattus norvegicus
ctacatagccctacctgtcctgaaa

SEQ ID NO: 262203 - DNA, 25 bp, Rattus norvegicus
ctacatagcccttcctgtcctgaaa

SEQ ID NO: 262204 - DNA, 25 bp, Rattus norvegicus
ctacatagtgaaaccgaggccagcc

SEQ ID NO: 262205 - DNA, 25 bp, Rattus norvegicus
ctacatagtgaatccgaggccagcc

SEQ ID NO: 262206 - DNA, 25 bp, Rattus norvegicus
ctacatagtgttaggcgtggtgctt

SEQ ID NO: 262207 - DNA, 25 bp, Rattus norvegicus
ctacatagtgtttggcgtggtgctt

SEQ ID NO: 262208 - DNA, 25 bp, Rattus norvegicus
ctacatataataaacgctaagcatc

SEQ ID NO: 262209 - DNA, 25 bp, Rattus norvegicus
ctacatataatatacgctaagcatc

SEQ ID NO: 262210 - DNA, 25 bp, Rattus norvegicus
ctacatatctcacgatggccttgaa

SEQ ID NO: 262211 - DNA, 25 bp, Rattus norvegicus
ctacatatctcaggatggccttgaa

SEQ ID NO: 262212 - DNA, 25 bp, Rattus norvegicus
ctacatcactgtacagcgcctggga

SEQ ID NO: 262213 - DNA, 25 bp, Rattus norvegicus
ctacatcactgttcagcgcctggga

SEQ ID NO: 262214 - DNA, 25 bp, Rattus norvegicus
ctacatcatgagatccgaggtggag

SEQ ID NO: 262215 - DNA, 25 bp, Rattus norvegicus
ctacatcatgagttccgaggtggag

SEQ ID NO: 262216 - DNA, 25 bp, Rattus norvegicus
ctacatccaaggacttcagctttaa

SEQ ID NO: 262217 - DNA, 25 bp, Rattus norvegicus
ctacatccaaggtcttcagctttaa

SEQ ID NO: 262218 - DNA, 25 bp, Rattus norvegicus
ctacatccatcaccctgtgtctgtg

SEQ ID NO: 262219 - DNA, 25 bp, Rattus norvegicus
ctacatccatcagcctgtgtctgtg

SEQ ID NO: 262220 - DNA, 25 bp, Rattus norvegicus
ctacatcccttcctttctgaagaag

SEQ ID NO: 262221 - DNA, 25 bp, Rattus norvegicus
ctacatcccttcgtttctgaagaag

SEQ ID NO: 262222 - DNA, 25 bp, Rattus norvegicus
ctacatccggtaaagagcacttggg

SEQ ID NO: 262223 - DNA, 25 bp, Rattus norvegicus
ctacatccggtatagagcacttggg

SEQ ID NO: 262224 - DNA, 25 bp, Rattus norvegicus
ctacatcttcgacctcttttacaag

SEQ ID NO: 262225 - DNA, 25 bp, Rattus norvegicus
ctacatcttcgagctcttttacaag

SEQ ID NO: 262226 - DNA, 25 bp, Rattus norvegicus
ctacatcttctcatgctctcttagg

SEQ ID NO: 262227 - DNA, 25 bp, Rattus norvegicus
ctacatcttctcttgctctcttagg

SEQ ID NO: 262228 - DNA, 25 bp, Rattus norvegicus
ctacatgacccacatggcttgctag

SEQ ID NO: 262229 - DNA, 25 bp, Rattus norvegicus
ctacatgacccagatggcttgctag

SEQ ID NO: 262230 - DNA, 25 bp, Rattus norvegicus
ctacatgcaaaacccagtgacactg

SEQ ID NO: 262231 - DNA, 25 bp, Rattus norvegicus
ctacatgcaaaagccagtgacactg

SEQ ID NO: 262232 - DNA, 25 bp, Rattus norvegicus
ctacatgcaggtagtgagctggaaa

SEQ ID NO: 262233 - DNA, 25 bp, Rattus norvegicus
ctacatgcaggttgtgagctggaaa

SEQ ID NO: 262234 - DNA, 25 bp, Rattus norvegicus
ctacatgctgtaatttaaggtctaa

SEQ ID NO: 262235 - DNA, 25 bp, Rattus norvegicus
ctacatgctgtattttaaggtctaa

SEQ ID NO: 262236 - DNA, 25 bp, Rattus norvegicus
ctacatgcttccagacccttgtcag

SEQ ID NO: 262237 - DNA, 25 bp, Rattus norvegicus
ctacatgcttcctgacccttgtcag

SEQ ID NO: 262238 - DNA, 25 bp, Rattus norvegicus
ctacatgtcttcctcagggctggat

SEQ ID NO: 262239 - DNA, 25 bp, Rattus norvegicus
ctacatgtcttcgtcagggctggat

SEQ ID NO: 262240 - DNA, 25 bp, Rattus norvegicus
ctacatgttccactatgactctacc

SEQ ID NO: 262241 - DNA, 25 bp, Rattus norvegicus
ctacatgttccagtatgactctacc

SEQ ID NO: 262242 - DNA, 25 bp, Rattus norvegicus
ctacattacccactaaggcttcagg

SEQ ID NO: 262243 - DNA, 25 bp, Rattus norvegicus
ctacattacccagtaaggcttcagg

SEQ ID NO: 262244 - DNA, 25 bp, Rattus norvegicus
ctacattagaggctcaagtacccta

SEQ ID NO: 262245 - DNA, 25 bp, Rattus norvegicus
ctacattagagggtcaagtacccta

SEQ ID NO: 262246 - DNA, 25 bp, Rattus norvegicus
ctacattcatcacagagtccacacg

SEQ ID NO: 262247 - DNA, 25 bp, Rattus norvegicus
ctacattcatcagagagtccacacg

SEQ ID NO: 262248 - DNA, 25 bp, Rattus norvegicus
ctacattctgtgactactctggaaa

SEQ ID NO: 262249 - DNA, 25 bp, Rattus norvegicus
ctacattctgtgtctactctggaaa

SEQ ID NO: 262250 - DNA, 25 bp, Rattus norvegicus
ctacattgggagctcttgagtttta

SEQ ID NO: 262251 - DNA, 25 bp, Rattus norvegicus
ctacattgggaggtcttgagtttta

SEQ ID NO: 262252 - DNA, 25 bp, Rattus norvegicus
ctacatttacacatctagcagtcag

SEQ ID NO: 262253 - DNA, 25 bp, Rattus norvegicus
ctacatttacacttctagcagtcag

SEQ ID NO: 262254 - DNA, 25 bp, Rattus norvegicus
ctacatttatctacagtcctgctaa

SEQ ID NO: 262255 - DNA, 25 bp, Rattus norvegicus
ctacatttatcttcagtcctgctaa

SEQ ID NO: 262256 - DNA, 25 bp, Rattus norvegicus
ctacatttcccacaagtccgcatag

SEQ ID NO: 262257 - DNA, 25 bp, Rattus norvegicus
ctacatttcccagaagtccgcatag

SEQ ID NO: 262258 - DNA, 25 bp, Rattus norvegicus
ctacatttttgacgtcatggactgt

SEQ ID NO: 262259 - DNA, 25 bp, Rattus norvegicus
ctacatttttgaggtcatggactgt

SEQ ID NO: 262260 - DNA, 25 bp, Rattus norvegicus
ctaccaacccatcctaatattaact

SEQ ID NO: 262261 - DNA, 25 bp, Rattus norvegicus
ctaccaacccatgctaatattaact

SEQ ID NO: 262262 - DNA, 25 bp, Rattus norvegicus
ctaccaagggttcattttgagaaca

SEQ ID NO: 262263 - DNA, 25 bp, Rattus norvegicus
ctaccaagggttgattttgagaaca

SEQ ID NO: 262264 - DNA, 25 bp, Rattus norvegicus
ctaccaccaaacatgagggcctgaa

SEQ ID NO: 262265 - DNA, 25 bp, Rattus norvegicus
ctaccaccaaacttgagggcctgaa

SEQ ID NO: 262266 - DNA, 25 bp, Rattus norvegicus
ctaccactgagaccttgctgtgtga

SEQ ID NO: 262267 - DNA, 25 bp, Rattus norvegicus
ctaccactgagagcttgctgtgtga

SEQ ID NO: 262268 - DNA, 25 bp, Rattus norvegicus
ctaccactgtccacagacaacttag

SEQ ID NO: 262269 - DNA, 25 bp, Rattus norvegicus
ctaccactgtcctcagacaacttag

SEQ ID NO: 262270 - DNA, 25 bp, Rattus norvegicus
ctaccagaaggccaacacggacaat

SEQ ID NO: 262271 - DNA, 25 bp, Rattus norvegicus
ctaccagaaggcgaacacggacaat

SEQ ID NO: 262272 - DNA, 25 bp, Rattus norvegicus
ctaccagaccttccggcagtactgt

SEQ ID NO: 262273 - DNA, 25 bp, Rattus norvegicus
ctaccagaccttgcggcagtactgt

SEQ ID NO: 262274 - DNA, 25 bp, Rattus norvegicus
ctaccagacgatacacttggctgtg

SEQ ID NO: 262275 - DNA, 25 bp, Rattus norvegicus
ctaccagacgattcacttggctgtg

SEQ ID NO: 262276 - DNA, 25 bp, Rattus norvegicus
ctaccagagaagctggctttgccca

SEQ ID NO: 262277 - DNA, 25 bp, Rattus norvegicus
ctaccagagaaggtggctttgccca

SEQ ID NO: 262278 - DNA, 25 bp, Rattus norvegicus
ctaccagatcatagagagccctcag

SEQ ID NO: 262279 - DNA, 25 bp, Rattus norvegicus
ctaccagatcattgagagccctcag

SEQ ID NO: 262280 - DNA, 25 bp, Rattus norvegicus
ctaccagcaggcacaagtttctgaa

SEQ ID NO: 262281 - DNA, 25 bp, Rattus norvegicus
ctaccagcaggctcaagtttctgaa

SEQ ID NO: 262282 - DNA, 25 bp, Rattus norvegicus
ctaccagcatcccagtttggaaggt

SEQ ID NO: 262283 - DNA, 25 bp, Rattus norvegicus
ctaccagcatccgagtttggaaggt

SEQ ID NO: 262284 - DNA, 25 bp, Rattus norvegicus
ctaccagctttcatccacagtttta

SEQ ID NO: 262285 - DNA, 25 bp, Rattus norvegicus
ctaccagctttcttccacagtttta

SEQ ID NO: 262286 - DNA, 25 bp, Rattus norvegicus
ctaccaggctgtccgcaaagaaggc

SEQ ID NO: 262287 - DNA, 25 bp, Rattus norvegicus
ctaccaggctgtgcgcaaagaaggc

SEQ ID NO: 262288 - DNA, 25 bp, Rattus norvegicus
ctaccagggtacaagcaagcattct

SEQ ID NO: 262289 - DNA, 25 bp, Rattus norvegicus
ctaccagggtactagcaagcattct

SEQ ID NO: 262290 - DNA, 25 bp, Rattus norvegicus
ctaccaggtttcacgggagcctaag

SEQ ID NO: 262291 - DNA, 25 bp, Rattus norvegicus
ctaccaggtttctcgggagcctaag

SEQ ID NO: 262292 - DNA, 25 bp, Rattus norvegicus
ctaccagtacttagagatcttcgtc

SEQ ID NO: 262293 - DNA, 25 bp, Rattus norvegicus
ctaccagtactttgagatcttcgtc

SEQ ID NO: 262294 - DNA, 25 bp, Rattus norvegicus
ctaccagtagcaagagacaccccaa

SEQ ID NO: 262295 - DNA, 25 bp, Rattus norvegicus
ctaccagtagcatgagacaccccaa

SEQ ID NO: 262296 - DNA, 25 bp, Rattus norvegicus
ctaccagtattaaccattcccgatg

SEQ ID NO: 262297 - DNA, 25 bp, Rattus norvegicus
ctaccagtattatccattcccgatg

SEQ ID NO: 262298 - DNA, 25 bp, Rattus norvegicus
ctaccagtgagacgccgtgagactt

SEQ ID NO: 262299 - DNA, 25 bp, Rattus norvegicus
ctaccagtgagaggccgtgagactt

SEQ ID NO: 262300 - DNA, 25 bp, Rattus norvegicus
ctaccagttggcctagtttccctgt

SEQ ID NO: 262301 - DNA, 25 bp, Rattus norvegicus
ctaccagttggcgtagtttccctgt

SEQ ID NO: 262302 - DNA, 25 bp, Rattus norvegicus
ctaccagttttccacaatgcacttt

SEQ ID NO: 262303 - DNA, 25 bp, Rattus norvegicus
ctaccagttttcgacaatgcacttt

SEQ ID NO: 262304 - DNA, 25 bp, Rattus norvegicus
ctaccatcatttccctgctgatgca

SEQ ID NO: 262305 - DNA, 25 bp, Rattus norvegicus
ctaccatcatttgcctgctgatgca

SEQ ID NO: 262306 - DNA, 25 bp, Rattus norvegicus
ctaccatgccctaagtctgtaatca

SEQ ID NO: 262307 - DNA, 25 bp, Rattus norvegicus
ctaccatgcccttagtctgtaatca

SEQ ID NO: 262308 - DNA, 25 bp, Rattus norvegicus
ctaccatggaagagagttttctact

SEQ ID NO: 262309 - DNA, 25 bp, Rattus norvegicus
ctaccatggaagtgagttttctact

SEQ ID NO: 262310 - DNA, 25 bp, Rattus norvegicus
ctaccatttggcacacatgctactt

SEQ ID NO: 262311 - DNA, 25 bp, Rattus norvegicus
ctaccatttggctcacatgctactt

SEQ ID NO: 262312 - DNA, 25 bp, Rattus norvegicus
ctacccaagggtaccacagagagaa

SEQ ID NO: 262313 - DNA, 25 bp, Rattus norvegicus
ctacccaagggttccacagagagaa

SEQ ID NO: 262314 - DNA, 25 bp, Rattus norvegicus
ctacccacacaacattgtctgatca

SEQ ID NO: 262315 - DNA, 25 bp, Rattus norvegicus
ctacccacacaagattgtctgatca

SEQ ID NO: 262316 - DNA, 25 bp, Rattus norvegicus
ctacccacaggtcagaaacgtcttt

SEQ ID NO: 262317 - DNA, 25 bp, Rattus norvegicus
ctacccacaggtgagaaacgtcttt

SEQ ID NO: 262318 - DNA, 25 bp, Rattus norvegicus
ctacccacgattctcactagaagtg

SEQ ID NO: 262319 - DNA, 25 bp, Rattus norvegicus
ctacccacgattgtcactagaagtg

SEQ ID NO: 262320 - DNA, 25 bp, Rattus norvegicus
ctacccagagacatgatgagacctt

SEQ ID NO: 262321 - DNA, 25 bp, Rattus norvegicus
ctacccagagacttgatgagacctt

SEQ ID NO: 262322 - DNA, 25 bp, Rattus norvegicus
ctacccatgcgacaagcagagctga

SEQ ID NO: 262323 - DNA, 25 bp, Rattus norvegicus
ctacccatgcgagaagcagagctga

SEQ ID NO: 262324 - DNA, 25 bp, Rattus norvegicus
ctacccatgtgtctttctattcagg

SEQ ID NO: 262325 - DNA, 25 bp, Rattus norvegicus
ctacccatgtgtgtttctattcagg

SEQ ID NO: 262326 - DNA, 25 bp, Rattus norvegicus
ctaccccaaactcaggagctataga

SEQ ID NO: 262327 - DNA, 25 bp, Rattus norvegicus
ctaccccaaactgaggagctataga

SEQ ID NO: 262328 - DNA, 25 bp, Rattus norvegicus
ctaccccaagaaatgcctgctgaag

SEQ ID NO: 262329 - DNA, 25 bp, Rattus norvegicus
ctaccccaagaattgcctgctgaag

SEQ ID NO: 262330 - DNA, 25 bp, Rattus norvegicus
ctaccccatgacactatgtgtggag

SEQ ID NO: 262331 - DNA, 25 bp, Rattus norvegicus
ctaccccatgactctatgtgtggag

SEQ ID NO: 262332 - DNA, 25 bp, Rattus norvegicus
ctacccccaatgattcagtgacatt

SEQ ID NO: 262333 - DNA, 25 bp, Rattus norvegicus
ctacccccaatgtttcagtgacatt

SEQ ID NO: 262334 - DNA, 25 bp, Rattus norvegicus
ctaccccgattccagatccaggaat

SEQ ID NO: 262335 - DNA, 25 bp, Rattus norvegicus
ctaccccgattcgagatccaggaat

SEQ ID NO: 262336 - DNA, 25 bp, Rattus norvegicus
ctaccccgctgtcccagtaagaagg

SEQ ID NO: 262337 - DNA, 25 bp, Rattus norvegicus
ctaccccgctgtgccagtaagaagg

SEQ ID NO: 262338 - DNA, 25 bp, Rattus norvegicus
ctaccccggattcagtgcggaaaat

SEQ ID NO: 262339 - DNA, 25 bp, Rattus norvegicus
ctaccccggattgagtgcggaaaat

SEQ ID NO: 262340 - DNA, 25 bp, Rattus norvegicus
ctacccctaatcacaatgtcacaaa

SEQ ID NO: 262341 - DNA, 25 bp, Rattus norvegicus
ctacccctaatctcaatgtcacaaa

SEQ ID NO: 262342 - DNA, 25 bp, Rattus norvegicus
ctacccctattgctgtcagagtcaa

SEQ ID NO: 262343 - DNA, 25 bp, Rattus norvegicus
ctacccctattggtgtcagagtcaa

SEQ ID NO: 262344 - DNA, 25 bp, Rattus norvegicus
ctacccctctaaagcattgaacact

SEQ ID NO: 262345 - DNA, 25 bp, Rattus norvegicus
ctacccctctaatgcattgaacact

SEQ ID NO: 262346 - DNA, 25 bp, Rattus norvegicus
ctacccgtgctgcactcagatgagt

SEQ ID NO: 262347 - DNA, 25 bp, Rattus norvegicus
ctacccgtgctggactcagatgagt

SEQ ID NO: 262348 - DNA, 25 bp, Rattus norvegicus
ctacccgttgagctgatactgaagt

SEQ ID NO: 262349 - DNA, 25 bp, Rattus norvegicus
ctacccgttgaggtgatactgaagt

SEQ ID NO: 262350 - DNA, 25 bp, Rattus norvegicus
ctaccctacggccaggacaagatgg

SEQ ID NO: 262351 - DNA, 25 bp, Rattus norvegicus
ctaccctacggcgaggacaagatgg

SEQ ID NO: 262352 - DNA, 25 bp, Rattus norvegicus
ctaccctcacctcattaactgtaat

SEQ ID NO: 262353 - DNA, 25 bp, Rattus norvegicus
ctaccctcacctgattaactgtaat

SEQ ID NO: 262354 - DNA, 25 bp, Rattus norvegicus
ctaccctctagaatgttggctgata

SEQ ID NO: 262355 - DNA, 25 bp, Rattus norvegicus
ctaccctctagattgttggctgata

SEQ ID NO: 262356 - DNA, 25 bp, Rattus norvegicus
ctaccctgacttcgcagactagaag

SEQ ID NO: 262357 - DNA, 25 bp, Rattus norvegicus
ctaccctgacttggcagactagaag

SEQ ID NO: 262358 - DNA, 25 bp, Rattus norvegicus
ctaccctgaggactatgcactgcgt

SEQ ID NO: 262359 - DNA, 25 bp, Rattus norvegicus
ctaccctgaggagtatgcactgcgt

SEQ ID NO: 262360 - DNA, 25 bp, Rattus norvegicus
ctaccctgattccaatcctgtgtaa

SEQ ID NO: 262361 - DNA, 25 bp, Rattus norvegicus
ctaccctgattcgaatcctgtgtaa

SEQ ID NO: 262362 - DNA, 25 bp, Rattus norvegicus
ctaccctgctggcttttaggaatag

SEQ ID NO: 262363 - DNA, 25 bp, Rattus norvegicus
ctaccctgctgggttttaggaatag

SEQ ID NO: 262364 - DNA, 25 bp, Rattus norvegicus
ctaccctggaaacatcactgacaac

SEQ ID NO: 262365 - DNA, 25 bp, Rattus norvegicus
ctaccctggaaagatcactgacaac

SEQ ID NO: 262366 - DNA, 25 bp, Rattus norvegicus
ctaccctggaggatattggagccgg

SEQ ID NO: 262367 - DNA, 25 bp, Rattus norvegicus
ctaccctggaggttattggagccgg

SEQ ID NO: 262368 - DNA, 25 bp, Rattus norvegicus
ctaccctggcatatgcacttagtga

SEQ ID NO: 262369 - DNA, 25 bp, Rattus norvegicus
ctaccctggcatttgcacttagtga

SEQ ID NO: 262370 - DNA, 25 bp, Rattus norvegicus
ctacccttacacacatctttggaat

SEQ ID NO: 262371 - DNA, 25 bp, Rattus norvegicus
ctacccttacactcatctttggaat

SEQ ID NO: 262372 - DNA, 25 bp, Rattus norvegicus
ctacccttcttaccactgtaacagg

SEQ ID NO: 262373 - DNA, 25 bp, Rattus norvegicus
ctacccttcttagcactgtaacagg

SEQ ID NO: 262374 - DNA, 25 bp, Rattus norvegicus
ctacccttgcacatacaccaaatgt

SEQ ID NO: 262375 - DNA, 25 bp, Rattus norvegicus
ctacccttgcacttacaccaaatgt

SEQ ID NO: 262376 - DNA, 25 bp, Rattus norvegicus
ctaccctttccaaccagggaaggat

SEQ ID NO: 262377 - DNA, 25 bp, Rattus norvegicus
ctaccctttccatccagggaaggat

SEQ ID NO: 262378 - DNA, 25 bp, Rattus norvegicus
ctaccgactgaaccatctctaaatt

SEQ ID NO: 262379 - DNA, 25 bp, Rattus norvegicus
ctaccgactgaagcatctctaaatt

SEQ ID NO: 262380 - DNA, 25 bp, Rattus norvegicus
ctaccgaggaagcagcttggtgtca

SEQ ID NO: 262381 - DNA, 25 bp, Rattus norvegicus
ctaccgaggaaggagcttggtgtca

SEQ ID NO: 262382 - DNA, 25 bp, Rattus norvegicus
ctaccgcactggcaaagagagcaaa

SEQ ID NO: 262383 - DNA, 25 bp, Rattus norvegicus
ctaccgcactgggaaagagagcaaa

SEQ ID NO: 262384 - DNA, 25 bp, Rattus norvegicus
ctaccgcagagcaacagcgggcagc

SEQ ID NO: 262385 - DNA, 25 bp, Rattus norvegicus
ctaccgcagagctacagcgggcagc

SEQ ID NO: 262386 - DNA, 25 bp, Rattus norvegicus
ctaccgcatccaagttaaaccctaa

SEQ ID NO: 262387 - DNA, 25 bp, Rattus norvegicus
ctaccgcatccatgttaaaccctaa

SEQ ID NO: 262388 - DNA, 25 bp, Rattus norvegicus
ctaccgcttgttatgcacttaataa

SEQ ID NO: 262389 - DNA, 25 bp, Rattus norvegicus
ctaccgcttgttttgcacttaataa

SEQ ID NO: 262390 - DNA, 25 bp, Rattus norvegicus
ctaccggtgctgagcccgctacagt

SEQ ID NO: 262391 - DNA, 25 bp, Rattus norvegicus
ctaccggtgctgtgcccgctacagt

SEQ ID NO: 262392 - DNA, 25 bp, Rattus norvegicus
ctaccggtgggcctggccaagaaca

SEQ ID NO: 262393 - DNA, 25 bp, Rattus norvegicus
ctaccggtgggcgtggccaagaaca

SEQ ID NO: 262394 - DNA, 25 bp, Rattus norvegicus
ctaccgttaactctgtggccaatta

SEQ ID NO: 262395 - DNA, 25 bp, Rattus norvegicus
ctaccgttaactgtgtggccaatta

SEQ ID NO: 262396 - DNA, 25 bp, Rattus norvegicus
ctaccgttatcacagaaggaagcct

SEQ ID NO: 262397 - DNA, 25 bp, Rattus norvegicus
ctaccgttatcagagaaggaagcct

SEQ ID NO: 262398 - DNA, 25 bp, Rattus norvegicus
ctaccgttcttacctagtccaaaca

SEQ ID NO: 262399 - DNA, 25 bp, Rattus norvegicus
ctaccgttcttagctagtccaaaca

SEQ ID NO: 262400 - DNA, 25 bp, Rattus norvegicus
ctacctaagtgactcccaggacgtt

SEQ ID NO: 262401 - DNA, 25 bp, Rattus norvegicus
ctacctaagtgagtcccaggacgtt

SEQ ID NO: 262402 - DNA, 25 bp, Rattus norvegicus
ctacctaccctgatgtggtgttgaa

SEQ ID NO: 262403 - DNA, 25 bp, Rattus norvegicus
ctacctaccctgttgtggtgttgaa

SEQ ID NO: 262404 - DNA, 25 bp, Rattus norvegicus
ctacctaccttgaggcactgggtat

SEQ ID NO: 262405 - DNA, 25 bp, Rattus norvegicus
ctacctaccttgtggcactgggtat

SEQ ID NO: 262406 - DNA, 25 bp, Rattus norvegicus
ctacctagcgttcccagctataggg

SEQ ID NO: 262407 - DNA, 25 bp, Rattus norvegicus
ctacctagcgttgccagctataggg

SEQ ID NO: 262408 - DNA, 25 bp, Rattus norvegicus
ctacctattagccatcaactctgag

SEQ ID NO: 262409 - DNA, 25 bp, Rattus norvegicus
ctacctattagcgatcaactctgag

SEQ ID NO: 262410 - DNA, 25 bp, Rattus norvegicus
ctacctcaacacacctgagattgtt

SEQ ID NO: 262411 - DNA, 25 bp, Rattus norvegicus
ctacctcaacactcctgagattgtt

SEQ ID NO: 262412 - DNA, 25 bp, Rattus norvegicus
ctacctcaagctcctgtggttgtga

SEQ ID NO: 262413 - DNA, 25 bp, Rattus norvegicus
ctacctcaagctgctgtggttgtga

SEQ ID NO: 262414 - DNA, 25 bp, Rattus norvegicus
ctacctcaccttagagccttagatt

SEQ ID NO: 262415 - DNA, 25 bp, Rattus norvegicus
ctacctcacctttgagccttagatt

SEQ ID NO: 262416 - DNA, 25 bp, Rattus norvegicus
ctacctcactaaatgacaaggcaga

SEQ ID NO: 262417 - DNA, 25 bp, Rattus norvegicus
ctacctcactaattgacaaggcaga

SEQ ID NO: 262418 - DNA, 25 bp, Rattus norvegicus
ctacctcactgacatcctaatggaa

SEQ ID NO: 262419 - DNA, 25 bp, Rattus norvegicus
ctacctcactgagatcctaatggaa

SEQ ID NO: 262420 - DNA, 25 bp, Rattus norvegicus
ctacctcagggtcgtcaggaggatt

SEQ ID NO: 262421 - DNA, 25 bp, Rattus norvegicus
ctacctcagggtggtcaggaggatt

SEQ ID NO: 262422 - DNA, 25 bp, Rattus norvegicus
ctacctcaggttagaagaccctaag

SEQ ID NO: 262423 - DNA, 25 bp, Rattus norvegicus
ctacctcaggtttgaagaccctaag

SEQ ID NO: 262424 - DNA, 25 bp, Rattus norvegicus
ctacctcatcaaaggtggtgtcgtc

SEQ ID NO: 262425 - DNA, 25 bp, Rattus norvegicus
ctacctcatcaatggtggtgtcgtc

SEQ ID NO: 262426 - DNA, 25 bp, Rattus norvegicus
ctacctcatccgatgaacctgagaa

SEQ ID NO: 262427 - DNA, 25 bp, Rattus norvegicus
ctacctcatccgttgaacctgagaa

SEQ ID NO: 262428 - DNA, 25 bp, Rattus norvegicus
ctacctcatcttcttgatctctgga

SEQ ID NO: 262429 - DNA, 25 bp, Rattus norvegicus
ctacctcatcttgttgatctctgga

SEQ ID NO: 262430 - DNA, 25 bp, Rattus norvegicus
ctacctcatgctctctgatttgtga

SEQ ID NO: 262431 - DNA, 25 bp, Rattus norvegicus
ctacctcatgctgtctgatttgtga

SEQ ID NO: 262432 - DNA, 25 bp, Rattus norvegicus
ctacctcattgcaagcagcacaggg

SEQ ID NO: 262433 - DNA, 25 bp, Rattus norvegicus
ctacctcattgctagcagcacaggg

SEQ ID NO: 262434 - DNA, 25 bp, Rattus norvegicus
ctacctccagtacttacaagcaggg

SEQ ID NO: 262435 - DNA, 25 bp, Rattus norvegicus
ctacctccagtagttacaagcaggg

SEQ ID NO: 262436 - DNA, 25 bp, Rattus norvegicus
ctacctcccaaaccactgaatattt

SEQ ID NO: 262437 - DNA, 25 bp, Rattus norvegicus
ctacctcccaaagcactgaatattt

SEQ ID NO: 262438 - DNA, 25 bp, Rattus norvegicus
ctacctcccaacaccattatggaat

SEQ ID NO: 262439 - DNA, 25 bp, Rattus norvegicus
ctacctcccaacattaccaatgagg

SEQ ID NO: 262440 - DNA, 25 bp, Rattus norvegicus
ctacctcccaactccattatggaat

SEQ ID NO: 262441 - DNA, 25 bp, Rattus norvegicus
ctacctcccaactttaccaatgagg

SEQ ID NO: 262442 - DNA, 25 bp, Rattus norvegicus
ctacctctacacatctagctttata

SEQ ID NO: 262443 - DNA, 25 bp, Rattus norvegicus
ctacctctacacttctagctttata

SEQ ID NO: 262444 - DNA, 25 bp, Rattus norvegicus
ctacctctcaacacctatattttcg

SEQ ID NO: 262445 - DNA, 25 bp, Rattus norvegicus
ctacctctcaactcctatattttcg

SEQ ID NO: 262446 - DNA, 25 bp, Rattus norvegicus
ctacctctctgaattttcatgaatt

SEQ ID NO: 262447 - DNA, 25 bp, Rattus norvegicus
ctacctctctgatttttcatgaatt

SEQ ID NO: 262448 - DNA, 25 bp, Rattus norvegicus
ctacctctctggattttcatggatc

SEQ ID NO: 262449 - DNA, 25 bp, Rattus norvegicus
ctacctctctggtttttcatggatc

SEQ ID NO: 262450 - DNA, 25 bp, Rattus norvegicus
ctacctctgcccaagctaggaatag

SEQ ID NO: 262451 - DNA, 25 bp, Rattus norvegicus
ctacctctgccctagctaggaatag

SEQ ID NO: 262452 - DNA, 25 bp, Rattus norvegicus
ctacctgaaattacctaggcatggt

SEQ ID NO: 262453 - DNA, 25 bp, Rattus norvegicus
ctacctgaaatttcctaggcatggt

SEQ ID NO: 262454 - DNA, 25 bp, Rattus norvegicus
ctacctgaaggtaagtatgaagcca

SEQ ID NO: 262455 - DNA, 25 bp, Rattus norvegicus
ctacctgaaggttagtatgaagcca

SEQ ID NO: 262456 - DNA, 25 bp, Rattus norvegicus
ctacctgactgaacggcaatgcttt

SEQ ID NO: 262457 - DNA, 25 bp, Rattus norvegicus
ctacctgactgatcggcaatgcttt

SEQ ID NO: 262458 - DNA, 25 bp, Rattus norvegicus
ctacctgacttcatgtttgaccttg

SEQ ID NO: 262459 - DNA, 25 bp, Rattus norvegicus
ctacctgacttcttgtttgaccttg

SEQ ID NO: 262460 - DNA, 25 bp, Rattus norvegicus
ctacctgagcctcccagtggaaaaa

SEQ ID NO: 262461 - DNA, 25 bp, Rattus norvegicus
ctacctgagcctgccagtggaaaaa

SEQ ID NO: 262462 - DNA, 25 bp, Rattus norvegicus
ctacctgagggcattttcatgttgt

SEQ ID NO: 262463 - DNA, 25 bp, Rattus norvegicus
ctacctgagggctttttcatgttgt

SEQ ID NO: 262464 - DNA, 25 bp, Rattus norvegicus
ctacctgatatgatcctgggaccca

SEQ ID NO: 262465 - DNA, 25 bp, Rattus norvegicus
ctacctgatatgttcctgggaccca

SEQ ID NO: 262466 - DNA, 25 bp, Rattus norvegicus
ctacctgattgaactgccaaggatt

SEQ ID NO: 262467 - DNA, 25 bp, Rattus norvegicus
ctacctgattgatctgccaaggatt

SEQ ID NO: 262468 - DNA, 25 bp, Rattus norvegicus
ctacctgccactcgtacggatgatt

SEQ ID NO: 262469 - DNA, 25 bp, Rattus norvegicus
ctacctgccactggtacggatgatt

SEQ ID NO: 262470 - DNA, 25 bp, Rattus norvegicus
ctacctgccagtacaaaagttcgat

SEQ ID NO: 262471 - DNA, 25 bp, Rattus norvegicus
ctacctgccagttcaaaagttcgat

SEQ ID NO: 262472 - DNA, 25 bp, Rattus norvegicus
ctacctgcgtttcttgcccaggaaa

SEQ ID NO: 262473 - DNA, 25 bp, Rattus norvegicus
ctacctgcgtttgttgcccaggaaa

SEQ ID NO: 262474 - DNA, 25 bp, Rattus norvegicus
ctacctgctctgcagtagcgggact

SEQ ID NO: 262475 - DNA, 25 bp, Rattus norvegicus
ctacctgctctggagtagcgggact

SEQ ID NO: 262476 - DNA, 25 bp, Rattus norvegicus
ctacctgcttcaaagtgctggaaca

SEQ ID NO: 262477 - DNA, 25 bp, Rattus norvegicus
ctacctgcttcatagtgctggaaca

SEQ ID NO: 262478 - DNA, 25 bp, Rattus norvegicus
ctacctggacttcaattcggactca

SEQ ID NO: 262479 - DNA, 25 bp, Rattus norvegicus
ctacctggacttgaattcggactca

SEQ ID NO: 262480 - DNA, 25 bp, Rattus norvegicus
ctacctggagggaccctgcctggag

SEQ ID NO: 262481 - DNA, 25 bp, Rattus norvegicus
ctacctggagggtccctgcctggag

SEQ ID NO: 262482 - DNA, 25 bp, Rattus norvegicus
ctacctgtacttcgttcagctggaa

SEQ ID NO: 262483 - DNA, 25 bp, Rattus norvegicus
ctacctgtacttggttcagctggaa

SEQ ID NO: 262484 - DNA, 25 bp, Rattus norvegicus
ctacctgtagtgcaggctgctggct

SEQ ID NO: 262485 - DNA, 25 bp, Rattus norvegicus
ctacctgtagtggaggctgctggct

SEQ ID NO: 262486 - DNA, 25 bp, Rattus norvegicus
ctacctgtgcccagaggagctttaa

SEQ ID NO: 262487 - DNA, 25 bp, Rattus norvegicus
ctacctgtgccctgaggagctttaa

SEQ ID NO: 262488 - DNA, 25 bp, Rattus norvegicus
ctacctgtgtgtctgctgacgaaca

SEQ ID NO: 262489 - DNA, 25 bp, Rattus norvegicus
ctacctgtgtgtgtgctgacgaaca

SEQ ID NO: 262490 - DNA, 25 bp, Rattus norvegicus
ctaccttagcccatttgaattcttg

SEQ ID NO: 262491 - DNA, 25 bp, Rattus norvegicus
ctaccttagcccttttgaattcttg

SEQ ID NO: 262492 - DNA, 25 bp, Rattus norvegicus
ctaccttatgcaatctgggatttga

SEQ ID NO: 262493 - DNA, 25 bp, Rattus norvegicus
ctaccttatgcattctgggatttga

SEQ ID NO: 262494 - DNA, 25 bp, Rattus norvegicus
ctaccttctgctatcctggaaaaga

SEQ ID NO: 262495 - DNA, 25 bp, Rattus norvegicus
ctaccttctgctttcctggaaaaga

SEQ ID NO: 262496 - DNA, 25 bp, Rattus norvegicus
ctaccttctttcctatcactatagt

SEQ ID NO: 262497 - DNA, 25 bp, Rattus norvegicus
ctaccttctttcgtatcactatagt

SEQ ID NO: 262498 - DNA, 25 bp, Rattus norvegicus
ctaccttgaacacctaactcttgag

SEQ ID NO: 262499 - DNA, 25 bp, Rattus norvegicus
ctaccttgaacagctaactcttgag

SEQ ID NO: 262500 - DNA, 25 bp, Rattus norvegicus
ctaccttggaccctgctgtataata

SEQ ID NO: 262501 - DNA, 25 bp, Rattus norvegicus
ctaccttggaccgtgctgtataata

SEQ ID NO: 262502 - DNA, 25 bp, Rattus norvegicus
ctaccttgtgctcaattctgctttt

SEQ ID NO: 262503 - DNA, 25 bp, Rattus norvegicus
ctaccttgtgctgaattctgctttt

SEQ ID NO: 262504 - DNA, 25 bp, Rattus norvegicus
ctaccttgtggtctggaatctggaa

SEQ ID NO: 262505 - DNA, 25 bp, Rattus norvegicus
ctaccttgtggtgtggaatctggaa

SEQ ID NO: 262506 - DNA, 25 bp, Rattus norvegicus
ctacctttaaacacacagactggaa

SEQ ID NO: 262507 - DNA, 25 bp, Rattus norvegicus
ctacctttaaactcacagactggaa

SEQ ID NO: 262508 - DNA, 25 bp, Rattus norvegicus
ctacgaactgttccacggagctggc

SEQ ID NO: 262509 - DNA, 25 bp, Rattus norvegicus
ctacgaactgttgcacggagctggc

SEQ ID NO: 262510 - DNA, 25 bp, Rattus norvegicus
ctacgaagctgtatctttaccaaag

SEQ ID NO: 262511 - DNA, 25 bp, Rattus norvegicus
ctacgaagctgtttctttaccaaag

SEQ ID NO: 262512 - DNA, 25 bp, Rattus norvegicus
ctacgacaaggcatacacggacgag

SEQ ID NO: 262513 - DNA, 25 bp, Rattus norvegicus
ctacgacaaggcttacacggacgag

SEQ ID NO: 262514 - DNA, 25 bp, Rattus norvegicus
ctacgacctgagcatcctggagcga

SEQ ID NO: 262515 - DNA, 25 bp, Rattus norvegicus
ctacgacctgaggatcctggagcga

SEQ ID NO: 262516 - DNA, 25 bp, Rattus norvegicus
ctacgacgatatcgctatgactcaa

SEQ ID NO: 262517 - DNA, 25 bp, Rattus norvegicus
ctacgacgatatggctatgactcaa

SEQ ID NO: 262518 - DNA, 25 bp, Rattus norvegicus
ctacgactatcaacagagctggagc

SEQ ID NO: 262519 - DNA, 25 bp, Rattus norvegicus
ctacgactatcatcagagctggagc

SEQ ID NO: 262520 - DNA, 25 bp, Rattus norvegicus
ctacgacttgtcaaaggaccctggt

SEQ ID NO: 262521 - DNA, 25 bp, Rattus norvegicus
ctacgacttgtctaaggaccctggt

SEQ ID NO: 262522 - DNA, 25 bp, Rattus norvegicus
ctacgagcatctatggcacttttat

SEQ ID NO: 262523 - DNA, 25 bp, Rattus norvegicus
ctacgagcatctttggcacttttat

SEQ ID NO: 262524 - DNA, 25 bp, Rattus norvegicus
ctacgagtgacaagactggcctgct

SEQ ID NO: 262525 - DNA, 25 bp, Rattus norvegicus
ctacgagtgacatgactggcctgct

SEQ ID NO: 262526 - DNA, 25 bp, Rattus norvegicus
ctacgagtgtgacagcccctgggct

SEQ ID NO: 262527 - DNA, 25 bp, Rattus norvegicus
ctacgagtgtgagagcccctgggct

SEQ ID NO: 262528 - DNA, 25 bp, Rattus norvegicus
ctacgatccaaacactcaggtgttt

SEQ ID NO: 262529 - DNA, 25 bp, Rattus norvegicus
ctacgatccaaagactcaggtgttt

SEQ ID NO: 262530 - DNA, 25 bp, Rattus norvegicus
ctacgatgagggactagggccgtcc

SEQ ID NO: 262531 - DNA, 25 bp, Rattus norvegicus
ctacgatgagggtctagggccgtcc

SEQ ID NO: 262532 - DNA, 25 bp, Rattus norvegicus
ctacgcaaaatcctacaccttggta

SEQ ID NO: 262533 - DNA, 25 bp, Rattus norvegicus
ctacgcaaaatcgtacaccttggta

SEQ ID NO: 262534 - DNA, 25 bp, Rattus norvegicus
ctacgcatttgcaaagttcttttgg

SEQ ID NO: 262535 - DNA, 25 bp, Rattus norvegicus
ctacgcatttgctaagttcttttgg

SEQ ID NO: 262536 - DNA, 25 bp, Rattus norvegicus
ctacgcgtggttactgggtcgactg

SEQ ID NO: 262537 - DNA, 25 bp, Rattus norvegicus
ctacgcgtggtttctgggtcgactg

SEQ ID NO: 262538 - DNA, 25 bp, Rattus norvegicus
ctacgctaatgtcaaacagtggctg

SEQ ID NO: 262539 - DNA, 25 bp, Rattus norvegicus
ctacgctaatgtgaaacagtggctg

SEQ ID NO: 262540 - DNA, 25 bp, Rattus norvegicus
ctacgctgacccctaagatgctagg

SEQ ID NO: 262541 - DNA, 25 bp, Rattus norvegicus
ctacgctgacccgtaagatgctagg

SEQ ID NO: 262542 - DNA, 25 bp, Rattus norvegicus
ctacgctgactgacccagttagaga

SEQ ID NO: 262543 - DNA, 25 bp, Rattus norvegicus
ctacgctgactgtcccagttagaga

SEQ ID NO: 262544 - DNA, 25 bp, Rattus norvegicus
ctacgctgagtgctgagcaggccct

SEQ ID NO: 262545 - DNA, 25 bp, Rattus norvegicus
ctacgctgagtggtgagcaggccct

SEQ ID NO: 262546 - DNA, 25 bp, Rattus norvegicus
ctacgctgcaaaccctcacagagag

SEQ ID NO: 262547 - DNA, 25 bp, Rattus norvegicus
ctacgctgcaaagcctcacagagag

SEQ ID NO: 262548 - DNA, 25 bp, Rattus norvegicus
ctacgcttcttactgccatggaagg

SEQ ID NO: 262549 - DNA, 25 bp, Rattus norvegicus
ctacgcttcttagtgccatggaagg

SEQ ID NO: 262550 - DNA, 25 bp, Rattus norvegicus
ctacggactcagatctaggacagct

SEQ ID NO: 262551 - DNA, 25 bp, Rattus norvegicus
ctacggactcagttctaggacagct

SEQ ID NO: 262552 - DNA, 25 bp, Rattus norvegicus
ctacggaggccgaagcggtcagaca

SEQ ID NO: 262553 - DNA, 25 bp, Rattus norvegicus
ctacggaggccgtagcggtcagaca

SEQ ID NO: 262554 - DNA, 25 bp, Rattus norvegicus
ctacggatgcttatctgaaggtctt

SEQ ID NO: 262555 - DNA, 25 bp, Rattus norvegicus
ctacggatgcttttctgaaggtctt

SEQ ID NO: 262556 - DNA, 25 bp, Rattus norvegicus
ctacggcgtgatattttgcattaaa

SEQ ID NO: 262557 - DNA, 25 bp, Rattus norvegicus
ctacggcgtgattttttgcattaaa

SEQ ID NO: 262558 - DNA, 25 bp, Rattus norvegicus
ctacgggcacgtactggagcggcaa

SEQ ID NO: 262559 - DNA, 25 bp, Rattus norvegicus
ctacgggcacgttctggagcggcaa

SEQ ID NO: 262560 - DNA, 25 bp, Rattus norvegicus
ctacggtaggttattgttgtgagca

SEQ ID NO: 262561 - DNA, 25 bp, Rattus norvegicus
ctacggtaggtttttgttgtgagca

SEQ ID NO: 262562 - DNA, 25 bp, Rattus norvegicus
ctacggttgcgtatgctttgaatta

SEQ ID NO: 262563 - DNA, 25 bp, Rattus norvegicus
ctacggttgcgtttgctttgaatta

SEQ ID NO: 262564 - DNA, 25 bp, Rattus norvegicus
ctacggttttgaagcccttgtggaa

SEQ ID NO: 262565 - DNA, 25 bp, Rattus norvegicus
ctacggttttgatgcccttgtggaa

SEQ ID NO: 262566 - DNA, 25 bp, Rattus norvegicus
ctacgtactggccttggaaatcctt

SEQ ID NO: 262567 - DNA, 25 bp, Rattus norvegicus
ctacgtactggcgttggaaatcctt

SEQ ID NO: 262568 - DNA, 25 bp, Rattus norvegicus
ctacgtagccctcgttgtactggaa

SEQ ID NO: 262569 - DNA, 25 bp, Rattus norvegicus
ctacgtagccctggttgtactggaa

SEQ ID NO: 262570 - DNA, 25 bp, Rattus norvegicus
ctacgtagtgagatacccaaggtca

SEQ ID NO: 262571 - DNA, 25 bp, Rattus norvegicus
ctacgtagtgagttacccaaggtca

SEQ ID NO: 262572 - DNA, 25 bp, Rattus norvegicus
ctacgtccaggacctagggcatgtg

SEQ ID NO: 262573 - DNA, 25 bp, Rattus norvegicus
ctacgtccaggagctagggcatgtg

SEQ ID NO: 262574 - DNA, 25 bp, Rattus norvegicus
ctacgtcgcctcacggagtaatcgc

SEQ ID NO: 262575 - DNA, 25 bp, Rattus norvegicus
ctacgtcgcctctcggagtaatcgc

SEQ ID NO: 262576 - DNA, 25 bp, Rattus norvegicus
ctacgtctagaacaggacacttaaa

SEQ ID NO: 262577 - DNA, 25 bp, Rattus norvegicus
ctacgtctagaagaggacacttaaa

SEQ ID NO: 262578 - DNA, 25 bp, Rattus norvegicus
ctacgtctgtgtaccaagtgcatga

SEQ ID NO: 262579 - DNA, 25 bp, Rattus norvegicus
ctacgtctgtgttccaagtgcatga

SEQ ID NO: 262580 - DNA, 25 bp, Rattus norvegicus
ctacgtgcgcctcgatggatagata

SEQ ID NO: 262581 - DNA, 25 bp, Rattus norvegicus
ctacgtgcgcctggatggatagata

SEQ ID NO: 262582 - DNA, 25 bp, Rattus norvegicus
ctacgtggactacactgaccttgaa

SEQ ID NO: 262583 - DNA, 25 bp, Rattus norvegicus
ctacgtggactagactgaccttgaa

SEQ ID NO: 262584 - DNA, 25 bp, Rattus norvegicus
ctacgtggatctacaaggtgctgca

SEQ ID NO: 262585 - DNA, 25 bp, Rattus norvegicus
ctacgtggatcttcaaggtgctgca

SEQ ID NO: 262586 - DNA, 25 bp, Rattus norvegicus
ctacgtgtattgcattgctcagaac

SEQ ID NO: 262587 - DNA, 25 bp, Rattus norvegicus
ctacgtgtattggattgctcagaac

SEQ ID NO: 262588 - DNA, 25 bp, Rattus norvegicus
ctacgttcagatacaaagagctcct

SEQ ID NO: 262589 - DNA, 25 bp, Rattus norvegicus
ctacgttcagattcaaagagctcct

SEQ ID NO: 262590 - DNA, 25 bp, Rattus norvegicus
ctacgttgagatatccccatggaga

SEQ ID NO: 262591 - DNA, 25 bp, Rattus norvegicus
ctacgttgagatttccccatggaga

SEQ ID NO: 262592 - DNA, 25 bp, Rattus norvegicus
ctactaacgttgaatgccatctgaa

SEQ ID NO: 262593 - DNA, 25 bp, Rattus norvegicus
ctactaacgttgtatgccatctgaa

SEQ ID NO: 262594 - DNA, 25 bp, Rattus norvegicus
ctactaatctgaagtgctccgtgat

SEQ ID NO: 262595 - DNA, 25 bp, Rattus norvegicus
ctactaatctgatgtgctccgtgat

SEQ ID NO: 262596 - DNA, 25 bp, Rattus norvegicus
ctactaatgacaatgtgtgcgtgtc

SEQ ID NO: 262597 - DNA, 25 bp, Rattus norvegicus
ctactaatgacattgtgtgcgtgtc

SEQ ID NO: 262598 - DNA, 25 bp, Rattus norvegicus
ctactaatgttgattgatctgtgtt

SEQ ID NO: 262599 - DNA, 25 bp, Rattus norvegicus
ctactaatgttgtttgatctgtgtt

SEQ ID NO: 262600 - DNA, 25 bp, Rattus norvegicus
ctactacaccttccatgcttcgaga

SEQ ID NO: 262601 - DNA, 25 bp, Rattus norvegicus
ctactacaccttgcatgcttcgaga

SEQ ID NO: 262602 - DNA, 25 bp, Rattus norvegicus
ctactacactgccttattctacgag

SEQ ID NO: 262603 - DNA, 25 bp, Rattus norvegicus
ctactacactgcgttattctacgag

SEQ ID NO: 262604 - DNA, 25 bp, Rattus norvegicus
ctactacaggtcattctcttcagaa

SEQ ID NO: 262605 - DNA, 25 bp, Rattus norvegicus
ctactacaggtctttctcttcagaa

SEQ ID NO: 262606 - DNA, 25 bp, Rattus norvegicus
ctactaccccttaagcatcaaagac

SEQ ID NO: 262607 - DNA, 25 bp, Rattus norvegicus
ctactacccctttagcatcaaagac

SEQ ID NO: 262608 - DNA, 25 bp, Rattus norvegicus
ctactactctaacatgtctctttca

SEQ ID NO: 262609 - DNA, 25 bp, Rattus norvegicus
ctactactctaagatgtctctttca

SEQ ID NO: 262610 - DNA, 25 bp, Rattus norvegicus
ctactacttcctcagtgcggattaa

SEQ ID NO: 262611 - DNA, 25 bp, Rattus norvegicus
ctactacttcctgagtgcggattaa

SEQ ID NO: 262612 - DNA, 25 bp, Rattus norvegicus
ctactagaggcaactaacctgggca

SEQ ID NO: 262613 - DNA, 25 bp, Rattus norvegicus
ctactagaggcatctaacctgggca

SEQ ID NO: 262614 - DNA, 25 bp, Rattus norvegicus
ctactagctggactgccttgtctca

SEQ ID NO: 262615 - DNA, 25 bp, Rattus norvegicus
ctactagctggagtgccttgtctca

SEQ ID NO: 262616 - DNA, 25 bp, Rattus norvegicus
ctactaggatgcacttgataccacc

SEQ ID NO: 262617 - DNA, 25 bp, Rattus norvegicus
ctactaggatgctcttgataccacc

SEQ ID NO: 262618 - DNA, 25 bp, Rattus norvegicus
ctactagggcctaatacttttatat

SEQ ID NO: 262619 - DNA, 25 bp, Rattus norvegicus
ctactagggccttatacttttatat

SEQ ID NO: 262620 - DNA, 25 bp, Rattus norvegicus
ctactaggtagactggcatttgggt

SEQ ID NO: 262621 - DNA, 25 bp, Rattus norvegicus
ctactaggtagagtggcatttgggt

SEQ ID NO: 262622 - DNA, 25 bp, Rattus norvegicus
ctactaggtagcacttgggcagttt

SEQ ID NO: 262623 - DNA, 25 bp, Rattus norvegicus
ctactaggtagctcttgggcagttt

SEQ ID NO: 262624 - DNA, 25 bp, Rattus norvegicus
ctactagtcgccctgatttgattga

SEQ ID NO: 262625 - DNA, 25 bp, Rattus norvegicus
ctactagtcgccgtgatttgattga

SEQ ID NO: 262626 - DNA, 25 bp, Rattus norvegicus
ctactatacatcactgttccattcc

SEQ ID NO: 262627 - DNA, 25 bp, Rattus norvegicus
ctactatacatctctgttccattcc

SEQ ID NO: 262628 - DNA, 25 bp, Rattus norvegicus
ctactatatcctcggcacgaccatg

SEQ ID NO: 262629 - DNA, 25 bp, Rattus norvegicus
ctactatatcctgggcacgaccatg

SEQ ID NO: 262630 - DNA, 25 bp, Rattus norvegicus
ctactatgagcgctggactttcttc

SEQ ID NO: 262631 - DNA, 25 bp, Rattus norvegicus
ctactatgagcggtggactttcttc

SEQ ID NO: 262632 - DNA, 25 bp, Rattus norvegicus
ctactatgtggaaatcaaggattga

SEQ ID NO: 262633 - DNA, 25 bp, Rattus norvegicus
ctactatgtggatatcaaggattga

SEQ ID NO: 262634 - DNA, 25 bp, Rattus norvegicus
ctactatttactcttacctccttgt

SEQ ID NO: 262635 - DNA, 25 bp, Rattus norvegicus
ctactatttactgttacctccttgt

SEQ ID NO: 262636 - DNA, 25 bp, Rattus norvegicus
ctactcacatttacttgggcaactt

SEQ ID NO: 262637 - DNA, 25 bp, Rattus norvegicus
ctactcacattttcttgggcaactt

SEQ ID NO: 262638 - DNA, 25 bp, Rattus norvegicus
ctactcaccgagcagctatctgtgt

SEQ ID NO: 262639 - DNA, 25 bp, Rattus norvegicus
ctactcaccgaggagctatctgtgt

SEQ ID NO: 262640 - DNA, 25 bp, Rattus norvegicus
ctactcaggatgaccaaaagccatt

SEQ ID NO: 262641 - DNA, 25 bp, Rattus norvegicus
ctactcaggatgtccaaaagccatt

SEQ ID NO: 262642 - DNA, 25 bp, Rattus norvegicus
ctactcaggccacgtcaattaagga

SEQ ID NO: 262643 - DNA, 25 bp, Rattus norvegicus
ctactcaggccaggtcaattaagga

SEQ ID NO: 262644 - DNA, 25 bp, Rattus norvegicus
ctactcaggtcccttgactgggatt

SEQ ID NO: 262645 - DNA, 25 bp, Rattus norvegicus
ctactcaggtccgttgactgggatt

SEQ ID NO: 262646 - DNA, 25 bp, Rattus norvegicus
ctactcagtggtcaggcgtgcttct

SEQ ID NO: 262647 - DNA, 25 bp, Rattus norvegicus
ctactcagtggtgaggcgtgcttct

SEQ ID NO: 262648 - DNA, 25 bp, Rattus norvegicus
ctactcagttctcctggagccatga

SEQ ID NO: 262649 - DNA, 25 bp, Rattus norvegicus
ctactcagttctgctggagccatga

SEQ ID NO: 262650 - DNA, 25 bp, Rattus norvegicus
ctactcatatagaccagttatttgg

SEQ ID NO: 262651 - DNA, 25 bp, Rattus norvegicus
ctactcatatagtccagttatttgg

SEQ ID NO: 262652 - DNA, 25 bp, Rattus norvegicus
ctactcattgcaccggccggagaag

SEQ ID NO: 262653 - DNA, 25 bp, Rattus norvegicus
ctactcattgcagcggccggagaag

SEQ ID NO: 262654 - DNA, 25 bp, Rattus norvegicus
ctactcattttgaattctgttcaga

SEQ ID NO: 262655 - DNA, 25 bp, Rattus norvegicus
ctactcattttgtattctgttcaga

SEQ ID NO: 262656 - DNA, 25 bp, Rattus norvegicus
ctactccgaaatattctgcttccag

SEQ ID NO: 262657 - DNA, 25 bp, Rattus norvegicus
ctactccgaaattttctgcttccag

SEQ ID NO: 262658 - DNA, 25 bp, Rattus norvegicus
ctactcctctgacgaatgggtatat

SEQ ID NO: 262659 - DNA, 25 bp, Rattus norvegicus
ctactcctctgaggaatgggtatat

SEQ ID NO: 262660 - DNA, 25 bp, Rattus norvegicus
ctactcctgagcatactgatttggg

SEQ ID NO: 262661 - DNA, 25 bp, Rattus norvegicus
ctactcctgagcttactgatttggg

SEQ ID NO: 262662 - DNA, 25 bp, Rattus norvegicus
ctactcctgcggatccttgctggac

SEQ ID NO: 262663 - DNA, 25 bp, Rattus norvegicus
ctactcctgcggttccttgctggac

SEQ ID NO: 262664 - DNA, 25 bp, Rattus norvegicus
ctactcctgtctccttagggctacg

SEQ ID NO: 262665 - DNA, 25 bp, Rattus norvegicus
ctactcctgtctgcttagggctacg

SEQ ID NO: 262666 - DNA, 25 bp, Rattus norvegicus
ctactcggttgtacgtggctgtgac

SEQ ID NO: 262667 - DNA, 25 bp, Rattus norvegicus
ctactcggttgttcgtggctgtgac

SEQ ID NO: 262668 - DNA, 25 bp, Rattus norvegicus
ctactcgtctggaccacagttgaga

SEQ ID NO: 262669 - DNA, 25 bp, Rattus norvegicus
ctactcgtctggtccacagttgaga

SEQ ID NO: 262670 - DNA, 25 bp, Rattus norvegicus
ctactcgtggtaaattgctttgctg

SEQ ID NO: 262671 - DNA, 25 bp, Rattus norvegicus
ctactcgtggtatattgctttgctg

SEQ ID NO: 262672 - DNA, 25 bp, Rattus norvegicus
ctactcgtttccctgcaagtgaaat

SEQ ID NO: 262673 - DNA, 25 bp, Rattus norvegicus
ctactcgtttccgtgcaagtgaaat

SEQ ID NO: 262674 - DNA, 25 bp, Rattus norvegicus
ctactctacccgatatatctacttt

SEQ ID NO: 262675 - DNA, 25 bp, Rattus norvegicus
ctactctacccgttatatctacttt

SEQ ID NO: 262676 - DNA, 25 bp, Rattus norvegicus
ctactctatgctagccatggttgat

SEQ ID NO: 262677 - DNA, 25 bp, Rattus norvegicus
ctactctatgcttgccatggttgat

SEQ ID NO: 262678 - DNA, 25 bp, Rattus norvegicus
ctactctattttccatgcactcgaa

SEQ ID NO: 262679 - DNA, 25 bp, Rattus norvegicus
ctactctattttgcatgcactcgaa

SEQ ID NO: 262680 - DNA, 25 bp, Rattus norvegicus
ctactctccactctggtgaacagaa

SEQ ID NO: 262681 - DNA, 25 bp, Rattus norvegicus
ctactctccactgtggtgaacagaa

SEQ ID NO: 262682 - DNA, 25 bp, Rattus norvegicus
ctactctctgctcgtactcaaaaaa

SEQ ID NO: 262683 - DNA, 25 bp, Rattus norvegicus
ctactctctgctggtactcaaaaaa

SEQ ID NO: 262684 - DNA, 25 bp, Rattus norvegicus
ctactctggattctgctgctacaaa

SEQ ID NO: 262685 - DNA, 25 bp, Rattus norvegicus
ctactctggattgtgctgctacaaa

SEQ ID NO: 262686 - DNA, 25 bp, Rattus norvegicus
ctactctgtaatattcactggaact

SEQ ID NO: 262687 - DNA, 25 bp, Rattus norvegicus
ctactctgtaattttcactggaact

SEQ ID NO: 262688 - DNA, 25 bp, Rattus norvegicus
ctactctgtctgacttgggcattct

SEQ ID NO: 262689 - DNA, 25 bp, Rattus norvegicus
ctactctgtctgtcttgggcattct

SEQ ID NO: 262690 - DNA, 25 bp, Rattus norvegicus
ctactctgtggcagcactatgtgat

SEQ ID NO: 262691 - DNA, 25 bp, Rattus norvegicus
ctactctgtggctgcactatgtgat

SEQ ID NO: 262692 - DNA, 25 bp, Rattus norvegicus
ctactctgttgccagcatttgctga

SEQ ID NO: 262693 - DNA, 25 bp, Rattus norvegicus
ctactctgttgcgagcatttgctga

SEQ ID NO: 262694 - DNA, 25 bp, Rattus norvegicus
ctactcttagctctggtcttgccag

SEQ ID NO: 262695 - DNA, 25 bp, Rattus norvegicus
ctactcttagctgtggtcttgccag

SEQ ID NO: 262696 - DNA, 25 bp, Rattus norvegicus
ctactcttatgacttagctccacga

SEQ ID NO: 262697 - DNA, 25 bp, Rattus norvegicus
ctactcttatgagttagctccacga

SEQ ID NO: 262698 - DNA, 25 bp, Rattus norvegicus
ctactcttctctcttgcactaggaa

SEQ ID NO: 262699 - DNA, 25 bp, Rattus norvegicus
ctactcttctctgttgcactaggaa

SEQ ID NO: 262700 - DNA, 25 bp, Rattus norvegicus
ctactcttgacgattccagtgcagt

SEQ ID NO: 262701 - DNA, 25 bp, Rattus norvegicus
ctactcttgacgtttccagtgcagt

SEQ ID NO: 262702 - DNA, 25 bp, Rattus norvegicus
ctactcttgctcaaagccagcagag

SEQ ID NO: 262703 - DNA, 25 bp, Rattus norvegicus
ctactcttgctctaagccagcagag

SEQ ID NO: 262704 - DNA, 25 bp, Rattus norvegicus
ctactcttggcaaaggaacctgatt

SEQ ID NO: 262705 - DNA, 25 bp, Rattus norvegicus
ctactcttggcataggaacctgatt

SEQ ID NO: 262706 - DNA, 25 bp, Rattus norvegicus
ctactcttgtggctgctttctttgg

SEQ ID NO: 262707 - DNA, 25 bp, Rattus norvegicus
ctactcttgtgggtgctttctttgg

SEQ ID NO: 262708 - DNA, 25 bp, Rattus norvegicus
ctactctttcacatcacagcttgat

SEQ ID NO: 262709 - DNA, 25 bp, Rattus norvegicus
ctactctttcacttcacagcttgat

SEQ ID NO: 262710 - DNA, 25 bp, Rattus norvegicus
ctactctttttcagtaatgcatgcc

SEQ ID NO: 262711 - DNA, 25 bp, Rattus norvegicus
ctactctttttctgtaatgcatgcc

SEQ ID NO: 262712 - DNA, 25 bp, Rattus norvegicus
ctactgaattctaggagtttctatt

SEQ ID NO: 262713 - DNA, 25 bp, Rattus norvegicus
ctactgaattcttggagtttctatt

SEQ ID NO: 262714 - DNA, 25 bp, Rattus norvegicus
ctactgacattgctgtccccagaca

SEQ ID NO: 262715 - DNA, 25 bp, Rattus norvegicus
ctactgacattggtgtccccagaca

SEQ ID NO: 262716 - DNA, 25 bp, Rattus norvegicus
ctactgagaccacccaaaaggcgaa

SEQ ID NO: 262717 - DNA, 25 bp, Rattus norvegicus
ctactgagaccagccaaaaggcgaa

SEQ ID NO: 262718 - DNA, 25 bp, Rattus norvegicus
ctactgattgtactttatggcttga

SEQ ID NO: 262719 - DNA, 25 bp, Rattus norvegicus
ctactgattgtagtttatggcttga

SEQ ID NO: 262720 - DNA, 25 bp, Rattus norvegicus
ctactgcaggagacagaaacacatt

SEQ ID NO: 262721 - DNA, 25 bp, Rattus norvegicus
ctactgcaggagtcagaaacacatt

SEQ ID NO: 262722 - DNA, 25 bp, Rattus norvegicus
ctactgcatcttcctgttctttgtg

SEQ ID NO: 262723 - DNA, 25 bp, Rattus norvegicus
ctactgcatcttgctgttctttgtg

SEQ ID NO: 262724 - DNA, 25 bp, Rattus norvegicus
ctactgccgagtctgtctgatgttt

SEQ ID NO: 262725 - DNA, 25 bp, Rattus norvegicus
ctactgccgagtgtgtctgatgttt

SEQ ID NO: 262726 - DNA, 25 bp, Rattus norvegicus
ctactgccttctattccaagtactt

SEQ ID NO: 262727 - DNA, 25 bp, Rattus norvegicus
ctactgccttcttttccaagtactt

SEQ ID NO: 262728 - DNA, 25 bp, Rattus norvegicus
ctactgcttatgaaaccaagtgtct

SEQ ID NO: 262729 - DNA, 25 bp, Rattus norvegicus
ctactgcttatgtaaccaagtgtct

SEQ ID NO: 262730 - DNA, 25 bp, Rattus norvegicus
ctactgcttggtcgcgtttgttaga

SEQ ID NO: 262731 - DNA, 25 bp, Rattus norvegicus
ctactgcttggtggcgtttgttaga

SEQ ID NO: 262732 - DNA, 25 bp, Rattus norvegicus
ctactggccagcctttggtaatgaa

SEQ ID NO: 262733 - DNA, 25 bp, Rattus norvegicus
ctactggccagcgtttggtaatgaa

SEQ ID NO: 262734 - DNA, 25 bp, Rattus norvegicus
ctactgggtagtatttatgtcggca

SEQ ID NO: 262735 - DNA, 25 bp, Rattus norvegicus
ctactgggtagtttttatgtcggca

SEQ ID NO: 262736 - DNA, 25 bp, Rattus norvegicus
ctactggtttgcagctgttggacat

SEQ ID NO: 262737 - DNA, 25 bp, Rattus norvegicus
ctactggtttgctgctgttggacat

SEQ ID NO: 262738 - DNA, 25 bp, Rattus norvegicus
ctactgtaaacccagtcatcctgaa

SEQ ID NO: 262739 - DNA, 25 bp, Rattus norvegicus
ctactgtaaaccgagtcatcctgaa

SEQ ID NO: 262740 - DNA, 25 bp, Rattus norvegicus
ctactgtacatcaaggaatgccttt

SEQ ID NO: 262741 - DNA, 25 bp, Rattus norvegicus
ctactgtacatctaggaatgccttt

SEQ ID NO: 262742 - DNA, 25 bp, Rattus norvegicus
ctactgtactgtattagaggcttac

SEQ ID NO: 262743 - DNA, 25 bp, Rattus norvegicus
ctactgtactgttttagaggcttac

SEQ ID NO: 262744 - DNA, 25 bp, Rattus norvegicus
ctactgtagaatctcgtccagccta

SEQ ID NO: 262745 - DNA, 25 bp, Rattus norvegicus
ctactgtagaatgtcgtccagccta

SEQ ID NO: 262746 - DNA, 25 bp, Rattus norvegicus
ctactgtagggtccccaggccagga

SEQ ID NO: 262747 - DNA, 25 bp, Rattus norvegicus
ctactgtagggtgcccaggccagga

SEQ ID NO: 262748 - DNA, 25 bp, Rattus norvegicus
ctactgtcagctcgcctcgagaaga

SEQ ID NO: 262749 - DNA, 25 bp, Rattus norvegicus
ctactgtcagctggcctcgagaaga

SEQ ID NO: 262750 - DNA, 25 bp, Rattus norvegicus
ctactgtcccagacgcattggaaaa

SEQ ID NO: 262751 - DNA, 25 bp, Rattus norvegicus
ctactgtcccagtcgcattggaaaa

SEQ ID NO: 262752 - DNA, 25 bp, Rattus norvegicus
ctactgtgcatgatgctggttttga

SEQ ID NO: 262753 - DNA, 25 bp, Rattus norvegicus
ctactgtgcatgttgctggttttga

SEQ ID NO: 262754 - DNA, 25 bp, Rattus norvegicus
ctactgtgcctccaaagtacttcgt

SEQ ID NO: 262755 - DNA, 25 bp, Rattus norvegicus
ctactgtgcctcgaaagtacttcgt

SEQ ID NO: 262756 - DNA, 25 bp, Rattus norvegicus
ctactgtggatcattggtggctaac

SEQ ID NO: 262757 - DNA, 25 bp, Rattus norvegicus
ctactgtggatctttggtggctaac

SEQ ID NO: 262758 - DNA, 25 bp, Rattus norvegicus
ctactgtgggatctggttttccttt

SEQ ID NO: 262759 - DNA, 25 bp, Rattus norvegicus
ctactgtgggatgtggttttccttt

SEQ ID NO: 262760 - DNA, 25 bp, Rattus norvegicus
ctactgtggtccctacaagatcaac

SEQ ID NO: 262761 - DNA, 25 bp, Rattus norvegicus
ctactgtggtccgtacaagatcaac

SEQ ID NO: 262762 - DNA, 25 bp, Rattus norvegicus
ctactgtgtttgagagcccctcctt

SEQ ID NO: 262763 - DNA, 25 bp, Rattus norvegicus
ctactgtgtttgtgagcccctcctt

SEQ ID NO: 262764 - DNA, 25 bp, Rattus norvegicus
ctactgttagggattgtcttctgtc

SEQ ID NO: 262765 - DNA, 25 bp, Rattus norvegicus
ctactgttagggtttgtcttctgtc

SEQ ID NO: 262766 - DNA, 25 bp, Rattus norvegicus
ctactgttctggaagcttgcttgaa

SEQ ID NO: 262767 - DNA, 25 bp, Rattus norvegicus
ctactgttctggtagcttgcttgaa

SEQ ID NO: 262768 - DNA, 25 bp, Rattus norvegicus
ctactgttgtaaatttcttggcttt

SEQ ID NO: 262769 - DNA, 25 bp, Rattus norvegicus
ctactgttgtaattttcttggcttt

SEQ ID NO: 262770 - DNA, 25 bp, Rattus norvegicus
ctactgttgttaagttttcccactg

SEQ ID NO: 262771 - DNA, 25 bp, Rattus norvegicus
ctactgttgttatgttttcccactg

SEQ ID NO: 262772 - DNA, 25 bp, Rattus norvegicus
ctactgtttattaattgtactctag

SEQ ID NO: 262773 - DNA, 25 bp, Rattus norvegicus
ctactgtttatttattgtactctag

SEQ ID NO: 262774 - DNA, 25 bp, Rattus norvegicus
ctacttaacttccacagacgttctt

SEQ ID NO: 262775 - DNA, 25 bp, Rattus norvegicus
ctacttaacttcgacagacgttctt

SEQ ID NO: 262776 - DNA, 25 bp, Rattus norvegicus
ctacttaaggaaacgtggcgtccct

SEQ ID NO: 262777 - DNA, 25 bp, Rattus norvegicus
ctacttaaggaatcgtggcgtccct

SEQ ID NO: 262778 - DNA, 25 bp, Rattus norvegicus
ctacttaattggatatagactctaa

SEQ ID NO: 262779 - DNA, 25 bp, Rattus norvegicus
ctacttaattggttatagactctaa

SEQ ID NO: 262780 - DNA, 25 bp, Rattus norvegicus
ctacttacctggctgactatgggca

SEQ ID NO: 262781 - DNA, 25 bp, Rattus norvegicus
ctacttacctgggtgactatgggca

SEQ ID NO: 262782 - DNA, 25 bp, Rattus norvegicus
ctacttactgttcgagatactctga

SEQ ID NO: 262783 - DNA, 25 bp, Rattus norvegicus
ctacttactgttggagatactctga

SEQ ID NO: 262784 - DNA, 25 bp, Rattus norvegicus
ctacttagggccaccagatactgga

SEQ ID NO: 262785 - DNA, 25 bp, Rattus norvegicus
ctacttagggcctccagatactgga

SEQ ID NO: 262786 - DNA, 25 bp, Rattus norvegicus
ctacttatacatcgttttgattctg

SEQ ID NO: 262787 - DNA, 25 bp, Rattus norvegicus
ctacttatacatggttttgattctg

SEQ ID NO: 262788 - DNA, 25 bp, Rattus norvegicus
ctacttatgagtaactttcgcggaa

SEQ ID NO: 262789 - DNA, 25 bp, Rattus norvegicus
ctacttatgagttactttcgcggaa

SEQ ID NO: 262790 - DNA, 25 bp, Rattus norvegicus
ctacttcatagtccctaccaggatg

SEQ ID NO: 262791 - DNA, 25 bp, Rattus norvegicus
ctacttcatagtgcctaccaggatg

SEQ ID NO: 262792 - DNA, 25 bp, Rattus norvegicus
ctacttcatttgctgtttggatata

SEQ ID NO: 262793 - DNA, 25 bp, Rattus norvegicus
ctacttcatttggtgtttggatata

SEQ ID NO: 262794 - DNA, 25 bp, Rattus norvegicus
ctacttccaagacgacagcctaaaa

SEQ ID NO: 262795 - DNA, 25 bp, Rattus norvegicus
ctacttccaagaggacagcctaaaa

SEQ ID NO: 262796 - DNA, 25 bp, Rattus norvegicus
ctacttcccaaactcctcatattta

SEQ ID NO: 262797 - DNA, 25 bp, Rattus norvegicus
ctacttcccaaagtcctcatattta

SEQ ID NO: 262798 - DNA, 25 bp, Rattus norvegicus
ctacttccccttacaaagcattgaa

SEQ ID NO: 262799 - DNA, 25 bp, Rattus norvegicus
ctacttcccctttcaaagcattgaa

SEQ ID NO: 262800 - DNA, 25 bp, Rattus norvegicus
ctacttcctgacagtgccgtatgag

SEQ ID NO: 262801 - DNA, 25 bp, Rattus norvegicus
ctacttcctgactgtgccgtatgag

SEQ ID NO: 262802 - DNA, 25 bp, Rattus norvegicus
ctacttcgagctcgatctgacagat

SEQ ID NO: 262803 - DNA, 25 bp, Rattus norvegicus
ctacttcgagctggatctgacagat

SEQ ID NO: 262804 - DNA, 25 bp, Rattus norvegicus
ctacttcgctatatctgttctttga

SEQ ID NO: 262805 - DNA, 25 bp, Rattus norvegicus
ctacttcgctatttctgttctttga

SEQ ID NO: 262806 - DNA, 25 bp, Rattus norvegicus
ctacttcggagcacgcatgtgaatg

SEQ ID NO: 262807 - DNA, 25 bp, Rattus norvegicus
ctacttcggagctcgcatgtgaatg

SEQ ID NO: 262808 - DNA, 25 bp, Rattus norvegicus
ctacttcgggcccatattgaacttc

SEQ ID NO: 262809 - DNA, 25 bp, Rattus norvegicus
ctacttcgggccgatattgaacttc

SEQ ID NO: 262810 - DNA, 25 bp, Rattus norvegicus
ctacttctagctctcgactgcaaag

SEQ ID NO: 262811 - DNA, 25 bp, Rattus norvegicus
ctacttctagctgtcgactgcaaag

SEQ ID NO: 262812 - DNA, 25 bp, Rattus norvegicus
ctacttctatggcatgcacggcatc

SEQ ID NO: 262813 - DNA, 25 bp, Rattus norvegicus
ctacttctatgggatgcacggcatc

SEQ ID NO: 262814 - DNA, 25 bp, Rattus norvegicus
ctacttctcgtgagggtgctagcaa

SEQ ID NO: 262815 - DNA, 25 bp, Rattus norvegicus
ctacttctcgtgtgggtgctagcaa

SEQ ID NO: 262816 - DNA, 25 bp, Rattus norvegicus
ctacttctgtctcctattaccaaaa

SEQ ID NO: 262817 - DNA, 25 bp, Rattus norvegicus
ctacttctgtctgctattaccaaaa

SEQ ID NO: 262818 - DNA, 25 bp, Rattus norvegicus
ctacttcttcctaccattattgtta

SEQ ID NO: 262819 - DNA, 25 bp, Rattus norvegicus
ctacttcttccttccattattgtta

SEQ ID NO: 262820 - DNA, 25 bp, Rattus norvegicus
ctacttgacatcatttatctccttc

SEQ ID NO: 262821 - DNA, 25 bp, Rattus norvegicus
ctacttgacatcttttatctccttc

SEQ ID NO: 262822 - DNA, 25 bp, Rattus norvegicus
ctacttgaggccctgtcgtaaaaca

SEQ ID NO: 262823 - DNA, 25 bp, Rattus norvegicus
ctacttgaggccgtgtcgtaaaaca

SEQ ID NO: 262824 - DNA, 25 bp, Rattus norvegicus
ctacttgcaatcctcttgctctctt

SEQ ID NO: 262825 - DNA, 25 bp, Rattus norvegicus
ctacttgcaatcgtcttgctctctt

SEQ ID NO: 262826 - DNA, 25 bp, Rattus norvegicus
ctacttgctacccatctgtgagaag

SEQ ID NO: 262827 - DNA, 25 bp, Rattus norvegicus
ctacttgctaccgatctgtgagaag

SEQ ID NO: 262828 - DNA, 25 bp, Rattus norvegicus
ctacttgctgctacatcacatgtta

SEQ ID NO: 262829 - DNA, 25 bp, Rattus norvegicus
ctacttgctgcttcatcacatgtta

SEQ ID NO: 262830 - DNA, 25 bp, Rattus norvegicus
ctacttgggagactgccactctaaa

SEQ ID NO: 262831 - DNA, 25 bp, Rattus norvegicus
ctacttgggagagtgccactctaaa

SEQ ID NO: 262832 - DNA, 25 bp, Rattus norvegicus
ctacttgtatccctatcctataaac

SEQ ID NO: 262833 - DNA, 25 bp, Rattus norvegicus
ctacttgtatccgtatcctataaac

SEQ ID NO: 262834 - DNA, 25 bp, Rattus norvegicus
ctacttgtcagcaaccaggagatcc

SEQ ID NO: 262835 - DNA, 25 bp, Rattus norvegicus
ctacttgtcagctaccaggagatcc

SEQ ID NO: 262836 - DNA, 25 bp, Rattus norvegicus
ctacttgtccaccttacttgtttca

SEQ ID NO: 262837 - DNA, 25 bp, Rattus norvegicus
ctacttgtccacgttacttgtttca

SEQ ID NO: 262838 - DNA, 25 bp, Rattus norvegicus
ctacttgtcctgaaacgtgttgcat

SEQ ID NO: 262839 - DNA, 25 bp, Rattus norvegicus
ctacttgtcctgtaacgtgttgcat

SEQ ID NO: 262840 - DNA, 25 bp, Rattus norvegicus
ctacttgtgtccatactaatgtgtg

SEQ ID NO: 262841 - DNA, 25 bp, Rattus norvegicus
ctacttgtgtccttactaatgtgtg

SEQ ID NO: 262842 - DNA, 25 bp, Rattus norvegicus
ctacttgttgctctacatcttcatt

SEQ ID NO: 262843 - DNA, 25 bp, Rattus norvegicus
ctacttgttgctgtacatcttcatt

SEQ ID NO: 262844 - DNA, 25 bp, Rattus norvegicus
ctactttattagatcactgattcag

SEQ ID NO: 262845 - DNA, 25 bp, Rattus norvegicus
ctactttattagttcactgattcag

SEQ ID NO: 262846 - DNA, 25 bp, Rattus norvegicus
ctactttctggcagctagggagaca

SEQ ID NO: 262847 - DNA, 25 bp, Rattus norvegicus
ctactttctggctgctagggagaca

SEQ ID NO: 262848 - DNA, 25 bp, Rattus norvegicus
ctactttgagtaagtcctggttctt

SEQ ID NO: 262849 - DNA, 25 bp, Rattus norvegicus
ctactttgagtatgtcctggttctt

SEQ ID NO: 262850 - DNA, 25 bp, Rattus norvegicus
ctactttgcaggatgggctgtataa

SEQ ID NO: 262851 - DNA, 25 bp, Rattus norvegicus
ctactttgcaggttgggctgtataa

SEQ ID NO: 262852 - DNA, 25 bp, Rattus norvegicus
ctactttgctacattcctgactgta

SEQ ID NO: 262853 - DNA, 25 bp, Rattus norvegicus
ctactttgctactttcctgactgta

SEQ ID NO: 262854 - DNA, 25 bp, Rattus norvegicus
ctactttgggatacctcaggtcttt

SEQ ID NO: 262855 - DNA, 25 bp, Rattus norvegicus
ctactttgggattcctcaggtcttt

SEQ ID NO: 262856 - DNA, 25 bp, Rattus norvegicus
ctacttttctgtaggatggtttgga

SEQ ID NO: 262857 - DNA, 25 bp, Rattus norvegicus
ctacttttctgttggatggtttgga

SEQ ID NO: 262858 - DNA, 25 bp, Rattus norvegicus
ctactttttggaagcggccacagca

SEQ ID NO: 262859 - DNA, 25 bp, Rattus norvegicus
ctactttttggatgcggccacagca

SEQ ID NO: 262860 - DNA, 25 bp, Rattus norvegicus
ctactttttgtcatccatattcacc

SEQ ID NO: 262861 - DNA, 25 bp, Rattus norvegicus
ctactttttgtcttccatattcacc

SEQ ID NO: 262862 - DNA, 25 bp, Rattus norvegicus
ctagaaattcttagttctctgatgc

SEQ ID NO: 262863 - DNA, 25 bp, Rattus norvegicus
ctagaaattctttgttctctgatgc

SEQ ID NO: 262864 - DNA, 25 bp, Rattus norvegicus
ctagaactatgtaggccaggccagc

SEQ ID NO: 262865 - DNA, 25 bp, Rattus norvegicus
ctagaactatgttggccaggccagc

SEQ ID NO: 262866 - DNA, 25 bp, Rattus norvegicus
ctagaactccagcatctattagcct

SEQ ID NO: 262867 - DNA, 25 bp, Rattus norvegicus
ctagaactccaggatctattagcct

SEQ ID NO: 262868 - DNA, 25 bp, Rattus norvegicus
ctagaagaatgtcgcccagagctct

SEQ ID NO: 262869 - DNA, 25 bp, Rattus norvegicus
ctagaagaatgtggcccagagctct

SEQ ID NO: 262870 - DNA, 25 bp, Rattus norvegicus
ctagaagagagccaggacttcgcgc

SEQ ID NO: 262871 - DNA, 25 bp, Rattus norvegicus
ctagaagagagcgaggacttcgcgc

SEQ ID NO: 262872 - DNA, 25 bp, Rattus norvegicus
ctagaagcaatcaaaatgggccggt

SEQ ID NO: 262873 - DNA, 25 bp, Rattus norvegicus
ctagaagcaatctaaatgggccggt

SEQ ID NO: 262874 - DNA, 25 bp, Rattus norvegicus
ctagaagcagcccttgtgtatactt

SEQ ID NO: 262875 - DNA, 25 bp, Rattus norvegicus
ctagaagcagccgttgtgtatactt

SEQ ID NO: 262876 - DNA, 25 bp, Rattus norvegicus
ctagaagctgttactctatggaggc

SEQ ID NO: 262877 - DNA, 25 bp, Rattus norvegicus
ctagaagctgtttctctatggaggc

SEQ ID NO: 262878 - DNA, 25 bp, Rattus norvegicus
ctagaaggacgccagctcagagctc

SEQ ID NO: 262879 - DNA, 25 bp, Rattus norvegicus
ctagaaggacgcgagctcagagctc

SEQ ID NO: 262880 - DNA, 25 bp, Rattus norvegicus
ctagaaggcgctcctttcagggttg

SEQ ID NO: 262881 - DNA, 25 bp, Rattus norvegicus
ctagaaggcgctgctttcagggttg

SEQ ID NO: 262882 - DNA, 25 bp, Rattus norvegicus
ctagaagtcatcctgcaagtccaag

SEQ ID NO: 262883 - DNA, 25 bp, Rattus norvegicus
ctagaagtcatcgtgcaagtccaag

SEQ ID NO: 262884 - DNA, 25 bp, Rattus norvegicus
ctagaagtggatatgaagtgcaacc

SEQ ID NO: 262885 - DNA, 25 bp, Rattus norvegicus
ctagaagtggatttgaagtgcaacc

SEQ ID NO: 262886 - DNA, 25 bp, Rattus norvegicus
ctagaatattatagcttgccctgaa

SEQ ID NO: 262887 - DNA, 25 bp, Rattus norvegicus
ctagaatattattgcttgccctgaa

SEQ ID NO: 262888 - DNA, 25 bp, Rattus norvegicus
ctagaatcacggatggcggtggcat

SEQ ID NO: 262889 - DNA, 25 bp, Rattus norvegicus
ctagaatcacggttggcggtggcat

SEQ ID NO: 262890 - DNA, 25 bp, Rattus norvegicus
ctagaatctgttctattaaaagcat

SEQ ID NO: 262891 - DNA, 25 bp, Rattus norvegicus
ctagaatctgttgtattaaaagcat

SEQ ID NO: 262892 - DNA, 25 bp, Rattus norvegicus
ctagaattctagagtgccagaggtg

SEQ ID NO: 262893 - DNA, 25 bp, Rattus norvegicus
ctagaattctagtgtgccagaggtg

SEQ ID NO: 262894 - DNA, 25 bp, Rattus norvegicus
ctagacactgaacggtttcctcatt

SEQ ID NO: 262895 - DNA, 25 bp, Rattus norvegicus
ctagacactgaagggtttcctcatt

SEQ ID NO: 262896 - DNA, 25 bp, Rattus norvegicus
ctagacaggctaaccatgtgaaaat

SEQ ID NO: 262897 - DNA, 25 bp, Rattus norvegicus
ctagacaggctatccatgtgaaaat

SEQ ID NO: 262898 - DNA, 25 bp, Rattus norvegicus
ctagacagtgttagctgggtaagca

SEQ ID NO: 262899 - DNA, 25 bp, Rattus norvegicus
ctagacagtgtttgctgggtaagca

SEQ ID NO: 262900 - DNA, 25 bp, Rattus norvegicus
ctagacatatatcccacctctggaa

SEQ ID NO: 262901 - DNA, 25 bp, Rattus norvegicus
ctagacatatatgccacctctggaa

SEQ ID NO: 262902 - DNA, 25 bp, Rattus norvegicus
ctagacccacaaagccaagccaagg

SEQ ID NO: 262903 - DNA, 25 bp, Rattus norvegicus
ctagacccacaatgccaagccaagg

SEQ ID NO: 262904 - DNA, 25 bp, Rattus norvegicus
ctagacccactcagtatttagcttg

SEQ ID NO: 262905 - DNA, 25 bp, Rattus norvegicus
ctagacccactctgtatttagcttg

SEQ ID NO: 262906 - DNA, 25 bp, Rattus norvegicus
ctagacccagagatcatggctgtgg

SEQ ID NO: 262907 - DNA, 25 bp, Rattus norvegicus
ctagacccagagttcatggctgtgg

SEQ ID NO: 262908 - DNA, 25 bp, Rattus norvegicus
ctagaccccttgaagccgctttgga

SEQ ID NO: 262909 - DNA, 25 bp, Rattus norvegicus
ctagaccccttgtagccgctttgga

SEQ ID NO: 262910 - DNA, 25 bp, Rattus norvegicus
ctagacctccctctatcgaagagaa

SEQ ID NO: 262911 - DNA, 25 bp, Rattus norvegicus
ctagacctccctgtatcgaagagaa

SEQ ID NO: 262912 - DNA, 25 bp, Rattus norvegicus
ctagacctgggtcttatgttcctaa

SEQ ID NO: 262913 - DNA, 25 bp, Rattus norvegicus
ctagacctgggtgttatgttcctaa

SEQ ID NO: 262914 - DNA, 25 bp, Rattus norvegicus
ctagacctgtctatgcggcatcaga

SEQ ID NO: 262915 - DNA, 25 bp, Rattus norvegicus
ctagacctgtctttgcggcatcaga

SEQ ID NO: 262916 - DNA, 25 bp, Rattus norvegicus
ctagacgtagagactgttgtgagct

SEQ ID NO: 262917 - DNA, 25 bp, Rattus norvegicus
ctagacgtagagtctgttgtgagct

SEQ ID NO: 262918 - DNA, 25 bp, Rattus norvegicus
ctagacgtcccacaaactttgtttg

SEQ ID NO: 262919 - DNA, 25 bp, Rattus norvegicus
ctagacgtcccagaaactttgtttg

SEQ ID NO: 262920 - DNA, 25 bp, Rattus norvegicus
ctagactccaggcacagaggtagaa

SEQ ID NO: 262921 - DNA, 25 bp, Rattus norvegicus
ctagactccagggacagaggtagaa

SEQ ID NO: 262922 - DNA, 25 bp, Rattus norvegicus
ctagactcctcaaaaccactggata

SEQ ID NO: 262923 - DNA, 25 bp, Rattus norvegicus
ctagactcctcataaccactggata

SEQ ID NO: 262924 - DNA, 25 bp, Rattus norvegicus
ctagactgctttaataatccacaaa

SEQ ID NO: 262925 - DNA, 25 bp, Rattus norvegicus
ctagactgcttttataatccacaaa

SEQ ID NO: 262926 - DNA, 25 bp, Rattus norvegicus
ctagactggcagatttaccgtaatt

SEQ ID NO: 262927 - DNA, 25 bp, Rattus norvegicus
ctagactggcagttttaccgtaatt

SEQ ID NO: 262928 - DNA, 25 bp, Rattus norvegicus
ctagactttacaaaaatgcgggctc

SEQ ID NO: 262929 - DNA, 25 bp, Rattus norvegicus
ctagactttacataaatgcgggctc

SEQ ID NO: 262930 - DNA, 25 bp, Rattus norvegicus
ctagagaacatcaggccttgggagc

SEQ ID NO: 262931 - DNA, 25 bp, Rattus norvegicus
ctagagaacatctggccttgggagc

SEQ ID NO: 262932 - DNA, 25 bp, Rattus norvegicus
ctagagaacctcaggactccattct

SEQ ID NO: 262933 - DNA, 25 bp, Rattus norvegicus
ctagagaacctctggactccattct

SEQ ID NO: 262934 - DNA, 25 bp, Rattus norvegicus
ctagagaagcctcgcgttcccgatg

SEQ ID NO: 262935 - DNA, 25 bp, Rattus norvegicus
ctagagaagcctggcgttcccgatg

SEQ ID NO: 262936 - DNA, 25 bp, Rattus norvegicus
ctagagaccaacactgcgggcgtgt

SEQ ID NO: 262937 - DNA, 25 bp, Rattus norvegicus
ctagagaccaactctgcgggcgtgt

SEQ ID NO: 262938 - DNA, 25 bp, Rattus norvegicus
ctagagagctccatacaacagtgtt

SEQ ID NO: 262939 - DNA, 25 bp, Rattus norvegicus
ctagagagctccttacaacagtgtt

SEQ ID NO: 262940 - DNA, 25 bp, Rattus norvegicus
ctagagatcctaattgcctttcaag

SEQ ID NO: 262941 - DNA, 25 bp, Rattus norvegicus
ctagagatcctatttgcctttcaag

SEQ ID NO: 262942 - DNA, 25 bp, Rattus norvegicus
ctagagatgcttatgctgggcttgc

SEQ ID NO: 262943 - DNA, 25 bp, Rattus norvegicus
ctagagatgcttttgctgggcttgc

SEQ ID NO: 262944 - DNA, 25 bp, Rattus norvegicus
ctagagattctcagttttcggtaat

SEQ ID NO: 262945 - DNA, 25 bp, Rattus norvegicus
ctagagattctctgttttcggtaat

SEQ ID NO: 262946 - DNA, 25 bp, Rattus norvegicus
ctagagatttttaacaagcctgtgg

SEQ ID NO: 262947 - DNA, 25 bp, Rattus norvegicus
ctagagattttttacaagcctgtgg

SEQ ID NO: 262948 - DNA, 25 bp, Rattus norvegicus
ctagagcactttacttctgagcaaa

SEQ ID NO: 262949 - DNA, 25 bp, Rattus norvegicus
ctagagcacttttcttctgagcaaa

SEQ ID NO: 262950 - DNA, 25 bp, Rattus norvegicus
ctagagcccagaacattgactttaa

SEQ ID NO: 262951 - DNA, 25 bp, Rattus norvegicus
ctagagcccagatcattgactttaa

SEQ ID NO: 262952 - DNA, 25 bp, Rattus norvegicus
ctagagcctttgcagacatgggatg

SEQ ID NO: 262953 - DNA, 25 bp, Rattus norvegicus
ctagagcctttggagacatgggatg

SEQ ID NO: 262954 - DNA, 25 bp, Rattus norvegicus
ctagagctagagattgagttcaagg

SEQ ID NO: 262955 - DNA, 25 bp, Rattus norvegicus
ctagagctagagtttgagttcaagg

SEQ ID NO: 262956 - DNA, 25 bp, Rattus norvegicus
ctagagctctagagttcccaaagta

SEQ ID NO: 262957 - DNA, 25 bp, Rattus norvegicus
ctagagctctagtgttcccaaagta

SEQ ID NO: 262958 - DNA, 25 bp, Rattus norvegicus
ctagagcttgtaacctgttaataat

SEQ ID NO: 262959 - DNA, 25 bp, Rattus norvegicus
ctagagcttgtatcctgttaataat

SEQ ID NO: 262960 - DNA, 25 bp, Rattus norvegicus
ctagaggacctaacagcagacagtt

SEQ ID NO: 262961 - DNA, 25 bp, Rattus norvegicus
ctagaggacctatcagcagacagtt

SEQ ID NO: 262962 - DNA, 25 bp, Rattus norvegicus
ctagaggctgctcctgtgaagcaaa

SEQ ID NO: 262963 - DNA, 25 bp, Rattus norvegicus
ctagaggctgctgctgtgaagcaaa

SEQ ID NO: 262964 - DNA, 25 bp, Rattus norvegicus
ctagaggtctctagattatacttat

SEQ ID NO: 262965 - DNA, 25 bp, Rattus norvegicus
ctagaggtctcttgattatacttat

SEQ ID NO: 262966 - DNA, 25 bp, Rattus norvegicus
ctagaggtgaatcggcctcctctcg

SEQ ID NO: 262967 - DNA, 25 bp, Rattus norvegicus
ctagaggtgaatgggcctcctctcg

SEQ ID NO: 262968 - DNA, 25 bp, Rattus norvegicus
ctagagtcattgattagacctcatg

SEQ ID NO: 262969 - DNA, 25 bp, Rattus norvegicus
ctagagtcattgtttagacctcatg

SEQ ID NO: 262970 - DNA, 25 bp, Rattus norvegicus
ctagagtctagacgctctttgccgt

SEQ ID NO: 262971 - DNA, 25 bp, Rattus norvegicus
ctagagtctagaggctctttgccgt

SEQ ID NO: 262972 - DNA, 25 bp, Rattus norvegicus
ctagagtggcctccccacgtaattt

SEQ ID NO: 262973 - DNA, 25 bp, Rattus norvegicus
ctagagtggcctgcccacgtaattt

SEQ ID NO: 262974 - DNA, 25 bp, Rattus norvegicus
ctagagtgtatactcctgggcaaac

SEQ ID NO: 262975 - DNA, 25 bp, Rattus norvegicus
ctagagtgtatagtcctgggcaaac

SEQ ID NO: 262976 - DNA, 25 bp, Rattus norvegicus
ctagagtgtgttagcatggtgacca

SEQ ID NO: 262977 - DNA, 25 bp, Rattus norvegicus
ctagagtgtgtttgcatggtgacca

SEQ ID NO: 262978 - DNA, 25 bp, Rattus norvegicus
ctagagttctgaccatcaccaaagc

SEQ ID NO: 262979 - DNA, 25 bp, Rattus norvegicus
ctagagttctgagcatcaccaaagc

SEQ ID NO: 262980 - DNA, 25 bp, Rattus norvegicus
ctagagtttttacccttgctgcttc

SEQ ID NO: 262981 - DNA, 25 bp, Rattus norvegicus
ctagagtttttagccttgctgcttc

SEQ ID NO: 262982 - DNA, 25 bp, Rattus norvegicus
ctagataagggcacactcgtggctc

SEQ ID NO: 262983 - DNA, 25 bp, Rattus norvegicus
ctagataagggctcactcgtggctc

SEQ ID NO: 262984 - DNA, 25 bp, Rattus norvegicus
ctagatacctagcaagagccacaaa

SEQ ID NO: 262985 - DNA, 25 bp, Rattus norvegicus
ctagatacctaggaagagccacaaa

SEQ ID NO: 262986 - DNA, 25 bp, Rattus norvegicus
ctagatagcgcacgtctgggagcca

SEQ ID NO: 262987 - DNA, 25 bp, Rattus norvegicus
ctagatagcgcaggtctgggagcca

SEQ ID NO: 262988 - DNA, 25 bp, Rattus norvegicus
ctagatatgttgagcatacctgcat

SEQ ID NO: 262989 - DNA, 25 bp, Rattus norvegicus
ctagatatgttgtgcatacctgcat

SEQ ID NO: 262990 - DNA, 25 bp, Rattus norvegicus
ctagatcatctcagtctttgtgttt

SEQ ID NO: 262991 - DNA, 25 bp, Rattus norvegicus
ctagatcatctctgtctttgtgttt

SEQ ID NO: 262992 - DNA, 25 bp, Rattus norvegicus
ctagatccatacatgcaggcagatt

SEQ ID NO: 262993 - DNA, 25 bp, Rattus norvegicus
ctagatccatacttgcaggcagatt

SEQ ID NO: 262994 - DNA, 25 bp, Rattus norvegicus
ctagatccgaatactttacctcctt

SEQ ID NO: 262995 - DNA, 25 bp, Rattus norvegicus
ctagatccgaattctttacctcctt

SEQ ID NO: 262996 - DNA, 25 bp, Rattus norvegicus
ctagatcctcttctcattcttagga

SEQ ID NO: 262997 - DNA, 25 bp, Rattus norvegicus
ctagatcctcttgtcattcttagga

SEQ ID NO: 262998 - DNA, 25 bp, Rattus norvegicus
ctagatcgttggagggcttcccatt

SEQ ID NO: 262999 - DNA, 25 bp, Rattus norvegicus
ctagatcgttggtgggcttcccatt

SEQ ID NO: 263000 - DNA, 25 bp, Rattus norvegicus
ctagatctcctaaatcttggcttct

SEQ ID NO: 263001 - DNA, 25 bp, Rattus norvegicus
ctagatctcctatatcttggcttct

SEQ ID NO: 263002 - DNA, 25 bp, Rattus norvegicus
ctagatgaaattaacgttgcacggc

SEQ ID NO: 263003 - DNA, 25 bp, Rattus norvegicus
ctagatgaaatttacgttgcacggc

SEQ ID NO: 263004 - DNA, 25 bp, Rattus norvegicus
ctagatgagctactcggtgccattg

SEQ ID NO: 263005 - DNA, 25 bp, Rattus norvegicus
ctagatgagctagtcggtgccattg

SEQ ID NO: 263006 - DNA, 25 bp, Rattus norvegicus
ctagatgccggtcaagggtgactta

SEQ ID NO: 263007 - DNA, 25 bp, Rattus norvegicus
ctagatgccggtgaagggtgactta

SEQ ID NO: 263008 - DNA, 25 bp, Rattus norvegicus
ctagatggcatcacttagctgaaaa

SEQ ID NO: 263009 - DNA, 25 bp, Rattus norvegicus
ctagatggcatctcttagctgaaaa

SEQ ID NO: 263010 - DNA, 25 bp, Rattus norvegicus
ctagatgggtctagctttaaatttc

SEQ ID NO: 263011 - DNA, 25 bp, Rattus norvegicus
ctagatgggtcttgctttaaatttc

SEQ ID NO: 263012 - DNA, 25 bp, Rattus norvegicus
ctagatgtcatcacaaactctgcca

SEQ ID NO: 263013 - DNA, 25 bp, Rattus norvegicus
ctagatgtcatctcaaactctgcca

SEQ ID NO: 263014 - DNA, 25 bp, Rattus norvegicus
ctagatgtgattcctgaaagtcccc

SEQ ID NO: 263015 - DNA, 25 bp, Rattus norvegicus
ctagatgtgattgctgaaagtcccc

SEQ ID NO: 263016 - DNA, 25 bp, Rattus norvegicus
ctagatgtgtataccttgtctttcc

SEQ ID NO: 263017 - DNA, 25 bp, Rattus norvegicus
ctagatgtgtattccttgtctttcc

SEQ ID NO: 263018 - DNA, 25 bp, Rattus norvegicus
ctagattcattgaatcagtgtgcaa

SEQ ID NO: 263019 - DNA, 25 bp, Rattus norvegicus
ctagattcattgtatcagtgtgcaa

SEQ ID NO: 263020 - DNA, 25 bp, Rattus norvegicus
ctagattcctgacaaaacgccgaaa

SEQ ID NO: 263021 - DNA, 25 bp, Rattus norvegicus
ctagattcctgagaaaacgccgaaa

SEQ ID NO: 263022 - DNA, 25 bp, Rattus norvegicus
ctagattctagcaacgcagtcccct

SEQ ID NO: 263023 - DNA, 25 bp, Rattus norvegicus
ctagattctagctacgcagtcccct

SEQ ID NO: 263024 - DNA, 25 bp, Rattus norvegicus
ctagatttagctcttcatgtgcaaa

SEQ ID NO: 263025 - DNA, 25 bp, Rattus norvegicus
ctagatttagctgttcatgtgcaaa

SEQ ID NO: 263026 - DNA, 25 bp, Rattus norvegicus
ctagattttatgacttcctttgatg

SEQ ID NO: 263027 - DNA, 25 bp, Rattus norvegicus
ctagattttatgtcttcctttgatg

SEQ ID NO: 263028 - DNA, 25 bp, Rattus norvegicus
ctagcaacacttcggctgcaggagt

SEQ ID NO: 263029 - DNA, 25 bp, Rattus norvegicus
ctagcaacacttgggctgcaggagt

SEQ ID NO: 263030 - DNA, 25 bp, Rattus norvegicus
ctagcaaccttgcttttttctggtt

SEQ ID NO: 263031 - DNA, 25 bp, Rattus norvegicus
ctagcaaccttggttttttctggtt

SEQ ID NO: 263032 - DNA, 25 bp, Rattus norvegicus
ctagcaacgtaacccatgacctcag

SEQ ID NO: 263033 - DNA, 25 bp, Rattus norvegicus
ctagcaacgtaagccatgacctcag

SEQ ID NO: 263034 - DNA, 25 bp, Rattus norvegicus
ctagcaactttgaggccagcaggac

SEQ ID NO: 263035 - DNA, 25 bp, Rattus norvegicus
ctagcaactttgtggccagcaggac

SEQ ID NO: 263036 - DNA, 25 bp, Rattus norvegicus
ctagcaatcaccacagactcagaga

SEQ ID NO: 263037 - DNA, 25 bp, Rattus norvegicus
ctagcaatcacctcagactcagaga

SEQ ID NO: 263038 - DNA, 25 bp, Rattus norvegicus
ctagcaattgccctgtatctgtctt

SEQ ID NO: 263039 - DNA, 25 bp, Rattus norvegicus
ctagcaattgccgtgtatctgtctt

SEQ ID NO: 263040 - DNA, 25 bp, Rattus norvegicus
ctagcacactcacggccatatttca

SEQ ID NO: 263041 - DNA, 25 bp, Rattus norvegicus
ctagcacactcagggccatatttca

SEQ ID NO: 263042 - DNA, 25 bp, Rattus norvegicus
ctagcaccaacgaccacatttatat

SEQ ID NO: 263043 - DNA, 25 bp, Rattus norvegicus
ctagcaccaacgtccacatttatat

SEQ ID NO: 263044 - DNA, 25 bp, Rattus norvegicus
ctagcacccactacaggcaagagtg

SEQ ID NO: 263045 - DNA, 25 bp, Rattus norvegicus
ctagcacccacttcaggcaagagtg

SEQ ID NO: 263046 - DNA, 25 bp, Rattus norvegicus
ctagcacgtgtgaggccagggttta

SEQ ID NO: 263047 - DNA, 25 bp, Rattus norvegicus
ctagcacgtgtgtggccagggttta

SEQ ID NO: 263048 - DNA, 25 bp, Rattus norvegicus
ctagcactctgaaaccctggacctt

SEQ ID NO: 263049 - DNA, 25 bp, Rattus norvegicus
ctagcactctgataccctggacctt

SEQ ID NO: 263050 - DNA, 25 bp, Rattus norvegicus
ctagcagaaagcaacgtctcttatt

SEQ ID NO: 263051 - DNA, 25 bp, Rattus norvegicus
ctagcagaaagctacgtctcttatt

SEQ ID NO: 263052 - DNA, 25 bp, Rattus norvegicus
ctagcagcaaggcaccagtctgaga

SEQ ID NO: 263053 - DNA, 25 bp, Rattus norvegicus
ctagcagcaagggaccagtctgaga

SEQ ID NO: 263054 - DNA, 25 bp, Rattus norvegicus
ctagcagcacataaactgggcatgc

SEQ ID NO: 263055 - DNA, 25 bp, Rattus norvegicus
ctagcagcacattaactgggcatgc

SEQ ID NO: 263056 - DNA, 25 bp, Rattus norvegicus
ctagcagctcatatcctacacaaga

SEQ ID NO: 263057 - DNA, 25 bp, Rattus norvegicus
ctagcagctcatttcctacacaaga

SEQ ID NO: 263058 - DNA, 25 bp, Rattus norvegicus
ctagcaggtgctatcgagcattttt

SEQ ID NO: 263059 - DNA, 25 bp, Rattus norvegicus
ctagcaggtgctttcgagcattttt

SEQ ID NO: 263060 - DNA, 25 bp, Rattus norvegicus
ctagcagtcgctctacttcaaggag

SEQ ID NO: 263061 - DNA, 25 bp, Rattus norvegicus
ctagcagtcgctgtacttcaaggag

SEQ ID NO: 263062 - DNA, 25 bp, Rattus norvegicus
ctagcagtggccacataacttgaac

SEQ ID NO: 263063 - DNA, 25 bp, Rattus norvegicus
ctagcagtggcctcataacttgaac

SEQ ID NO: 263064 - DNA, 25 bp, Rattus norvegicus
ctagcagtgtgtactgtggccctgg

SEQ ID NO: 263065 - DNA, 25 bp, Rattus norvegicus
ctagcagtgtgttctgtggccctgg

SEQ ID NO: 263066 - DNA, 25 bp, Rattus norvegicus
ctagcatagcaaccgtgttcccagg

SEQ ID NO: 263067 - DNA, 25 bp, Rattus norvegicus
ctagcatagcaagcgtgttcccagg

SEQ ID NO: 263068 - DNA, 25 bp, Rattus norvegicus
ctagcatagtatcagtcagacttct

SEQ ID NO: 263069 - DNA, 25 bp, Rattus norvegicus
ctagcatagtatgagtcagacttct

SEQ ID NO: 263070 - DNA, 25 bp, Rattus norvegicus
ctagcatcaaagatcttcaggattt

SEQ ID NO: 263071 - DNA, 25 bp, Rattus norvegicus
ctagcatcaaagttcttcaggattt

SEQ ID NO: 263072 - DNA, 25 bp, Rattus norvegicus
ctagcatcccaactcaaacgtttgg

SEQ ID NO: 263073 - DNA, 25 bp, Rattus norvegicus
ctagcatcccaagtcaaacgtttgg

SEQ ID NO: 263074 - DNA, 25 bp, Rattus norvegicus
ctagcatctcttccttctgaaattt

SEQ ID NO: 263075 - DNA, 25 bp, Rattus norvegicus
ctagcatctcttgcttctgaaattt

SEQ ID NO: 263076 - DNA, 25 bp, Rattus norvegicus
ctagcatggacgactttgtgtttgt

SEQ ID NO: 263077 - DNA, 25 bp, Rattus norvegicus
ctagcatggacgtctttgtgtttgt

SEQ ID NO: 263078 - DNA, 25 bp, Rattus norvegicus
ctagccaacttgagtaccccgaggg

SEQ ID NO: 263079 - DNA, 25 bp, Rattus norvegicus
ctagccaacttgtgtaccccgaggg

SEQ ID NO: 263080 - DNA, 25 bp, Rattus norvegicus
ctagccaccacaagtgtctgtacta

SEQ ID NO: 263081 - DNA, 25 bp, Rattus norvegicus
ctagccaccacatgtgtctgtacta

SEQ ID NO: 263082 - DNA, 25 bp, Rattus norvegicus
ctagccacgtgtacatacctgtttt

SEQ ID NO: 263083 - DNA, 25 bp, Rattus norvegicus
ctagccacgtgttcatacctgtttt

SEQ ID NO: 263084 - DNA, 25 bp, Rattus norvegicus
ctagccagaaaacgccacaaactct

SEQ ID NO: 263085 - DNA, 25 bp, Rattus norvegicus
ctagccagaaaaggccacaaactct

SEQ ID NO: 263086 - DNA, 25 bp, Rattus norvegicus
ctagccagatggattcttgcaatat

SEQ ID NO: 263087 - DNA, 25 bp, Rattus norvegicus
ctagccagatggtttcttgcaatat

SEQ ID NO: 263088 - DNA, 25 bp, Rattus norvegicus
ctagccagcatacggagctccaggt

SEQ ID NO: 263089 - DNA, 25 bp, Rattus norvegicus
ctagccagcatagggagctccaggt

SEQ ID NO: 263090 - DNA, 25 bp, Rattus norvegicus
ctagccagctgaccaataacacttt

SEQ ID NO: 263091 - DNA, 25 bp, Rattus norvegicus
ctagccagctgagcaataacacttt

SEQ ID NO: 263092 - DNA, 25 bp, Rattus norvegicus
ctagccaggagaacaggttttaaca

SEQ ID NO: 263093 - DNA, 25 bp, Rattus norvegicus
ctagccaggagatcaggttttaaca

SEQ ID NO: 263094 - DNA, 25 bp, Rattus norvegicus
ctagccatatacctttgcctttaag

SEQ ID NO: 263095 - DNA, 25 bp, Rattus norvegicus
ctagccatatacgtttgcctttaag

SEQ ID NO: 263096 - DNA, 25 bp, Rattus norvegicus
ctagccatcatgattgttcctacag

SEQ ID NO: 263097 - DNA, 25 bp, Rattus norvegicus
ctagccatcatgtttgttcctacag

SEQ ID NO: 263098 - DNA, 25 bp, Rattus norvegicus
ctagccattgttctgtccttgtttg

SEQ ID NO: 263099 - DNA, 25 bp, Rattus norvegicus
ctagccattgttgtgtccttgtttg

SEQ ID NO: 263100 - DNA, 25 bp, Rattus norvegicus
ctagcccaatgcctcactaagtgtg

SEQ ID NO: 263101 - DNA, 25 bp, Rattus norvegicus
ctagcccaatgcgtcactaagtgtg

SEQ ID NO: 263102 - DNA, 25 bp, Rattus norvegicus
ctagcccatgtcatgtcagtggcca

SEQ ID NO: 263103 - DNA, 25 bp, Rattus norvegicus
ctagcccatgtcttgtcagtggcca

SEQ ID NO: 263104 - DNA, 25 bp, Rattus norvegicus
ctagccccggctcttgttgaggtga

SEQ ID NO: 263105 - DNA, 25 bp, Rattus norvegicus
ctagccccggctgttgttgaggtga

SEQ ID NO: 263106 - DNA, 25 bp, Rattus norvegicus
ctagcccggtatatatttacattgc

SEQ ID NO: 263107 - DNA, 25 bp, Rattus norvegicus
ctagcccggtatttatttacattgc

SEQ ID NO: 263108 - DNA, 25 bp, Rattus norvegicus
ctagccctaataacagcctttacat

SEQ ID NO: 263109 - DNA, 25 bp, Rattus norvegicus
ctagccctaatatcagcctttacat

SEQ ID NO: 263110 - DNA, 25 bp, Rattus norvegicus
ctagccctggctccgaaggtgaaga

SEQ ID NO: 263111 - DNA, 25 bp, Rattus norvegicus
ctagccctggctgcgaaggtgaaga

SEQ ID NO: 263112 - DNA, 25 bp, Rattus norvegicus
ctagccgagcttagatgtgattttt

SEQ ID NO: 263113 - DNA, 25 bp, Rattus norvegicus
ctagccgagctttgatgtgattttt

SEQ ID NO: 263114 - DNA, 25 bp, Rattus norvegicus
ctagccgctgctattgggttgtgtg

SEQ ID NO: 263115 - DNA, 25 bp, Rattus norvegicus
ctagccgctgcttttgggttgtgtg

SEQ ID NO: 263116 - DNA, 25 bp, Rattus norvegicus
ctagccgcttttagactgcatggtt

SEQ ID NO: 263117 - DNA, 25 bp, Rattus norvegicus
ctagccgctttttgactgcatggtt

SEQ ID NO: 263118 - DNA, 25 bp, Rattus norvegicus
ctagccggatacaattagcctgcaa

SEQ ID NO: 263119 - DNA, 25 bp, Rattus norvegicus
ctagccggatactattagcctgcaa

SEQ ID NO: 263120 - DNA, 25 bp, Rattus norvegicus
ctagccggcagcagtaatagcagaa

SEQ ID NO: 263121 - DNA, 25 bp, Rattus norvegicus
ctagccggcagctgtaatagcagaa

SEQ ID NO: 263122 - DNA, 25 bp, Rattus norvegicus
ctagcctaacggaggcgccaggtcc

SEQ ID NO: 263123 - DNA, 25 bp, Rattus norvegicus
ctagcctaacggtggcgccaggtcc

SEQ ID NO: 263124 - DNA, 25 bp, Rattus norvegicus
ctagcctaggccacttagcaagttt

SEQ ID NO: 263125 - DNA, 25 bp, Rattus norvegicus
ctagcctaggcctcttagcaagttt

SEQ ID NO: 263126 - DNA, 25 bp, Rattus norvegicus
ctagcctccagacgatttcatgcta

SEQ ID NO: 263127 - DNA, 25 bp, Rattus norvegicus
ctagcctccagaggatttcatgcta

SEQ ID NO: 263128 - DNA, 25 bp, Rattus norvegicus
ctagcctcccataataactgagcac

SEQ ID NO: 263129 - DNA, 25 bp, Rattus norvegicus
ctagcctcccattataactgagcac

SEQ ID NO: 263130 - DNA, 25 bp, Rattus norvegicus
ctagcctgatgtactgagggcccga

SEQ ID NO: 263131 - DNA, 25 bp, Rattus norvegicus
ctagcctgatgttctgagggcccga

SEQ ID NO: 263132 - DNA, 25 bp, Rattus norvegicus
ctagcctggtggacttcaaactaca

SEQ ID NO: 263133 - DNA, 25 bp, Rattus norvegicus
ctagcctggtggtcttcaaactaca

SEQ ID NO: 263134 - DNA, 25 bp, Rattus norvegicus
ctagcctgtgtgacctgctaatgca

SEQ ID NO: 263135 - DNA, 25 bp, Rattus norvegicus
ctagcctgtgtgtcctgctaatgca

SEQ ID NO: 263136 - DNA, 25 bp, Rattus norvegicus
ctagcctttcttcagttttccaaga

SEQ ID NO: 263137 - DNA, 25 bp, Rattus norvegicus
ctagcctttcttgagttttccaaga

SEQ ID NO: 263138 - DNA, 25 bp, Rattus norvegicus
ctagccttttgtcttggcactgaag

SEQ ID NO: 263139 - DNA, 25 bp, Rattus norvegicus
ctagccttttgtgttggcactgaag

SEQ ID NO: 263140 - DNA, 25 bp, Rattus norvegicus
ctagcgctaggaaaggaacgtctgg

SEQ ID NO: 263141 - DNA, 25 bp, Rattus norvegicus
ctagcgctaggataggaacgtctgg

SEQ ID NO: 263142 - DNA, 25 bp, Rattus norvegicus
ctagctaaaatgactcttgatcccc

SEQ ID NO: 263143 - DNA, 25 bp, Rattus norvegicus
ctagctaaaatgtctcttgatcccc

SEQ ID NO: 263144 - DNA, 25 bp, Rattus norvegicus
ctagctacacccctttgcaaagagt

SEQ ID NO: 263145 - DNA, 25 bp, Rattus norvegicus
ctagctacacccgtttgcaaagagt

SEQ ID NO: 263146 - DNA, 25 bp, Rattus norvegicus
ctagctacatttctgtctactgtga

SEQ ID NO: 263147 - DNA, 25 bp, Rattus norvegicus
ctagctacatttgtgtctactgtga

SEQ ID NO: 263148 - DNA, 25 bp, Rattus norvegicus
ctagctaggctccttctggaggaat

SEQ ID NO: 263149 - DNA, 25 bp, Rattus norvegicus
ctagctaggctcgttctggaggaat

SEQ ID NO: 263150 - DNA, 25 bp, Rattus norvegicus
ctagctcacttacggccatatctca

SEQ ID NO: 263151 - DNA, 25 bp, Rattus norvegicus
ctagctcacttagggccatatctca

SEQ ID NO: 263152 - DNA, 25 bp, Rattus norvegicus
ctagctcagataagcactttaccct

SEQ ID NO: 263153 - DNA, 25 bp, Rattus norvegicus
ctagctcagatatgcactttaccct

SEQ ID NO: 263154 - DNA, 25 bp, Rattus norvegicus
ctagctcaggcgaccaaggagtcga

SEQ ID NO: 263155 - DNA, 25 bp, Rattus norvegicus
ctagctcaggcgtccaaggagtcga

SEQ ID NO: 263156 - DNA, 25 bp, Rattus norvegicus
ctagctcatgtacctgtattaaaat

SEQ ID NO: 263157 - DNA, 25 bp, Rattus norvegicus
ctagctcatgtagctgtattaaaat

SEQ ID NO: 263158 - DNA, 25 bp, Rattus norvegicus
ctagctcattgcatcttgttttgaa

SEQ ID NO: 263159 - DNA, 25 bp, Rattus norvegicus
ctagctcattgcttcttgttttgaa

SEQ ID NO: 263160 - DNA, 25 bp, Rattus norvegicus
ctagctccacccattggaacaggaa

SEQ ID NO: 263161 - DNA, 25 bp, Rattus norvegicus
ctagctccaccctttggaacaggaa

SEQ ID NO: 263162 - DNA, 25 bp, Rattus norvegicus
ctagctccatgcctttaggaatgac

SEQ ID NO: 263163 - DNA, 25 bp, Rattus norvegicus
ctagctccatgcgtttaggaatgac

SEQ ID NO: 263164 - DNA, 25 bp, Rattus norvegicus
ctagctcgacatccaataactcttg

SEQ ID NO: 263165 - DNA, 25 bp, Rattus norvegicus
ctagctcgacatgcaataactcttg

SEQ ID NO: 263166 - DNA, 25 bp, Rattus norvegicus
ctagctctaggcatatttacaggat

SEQ ID NO: 263167 - DNA, 25 bp, Rattus norvegicus
ctagctctaggcttatttacaggat

SEQ ID NO: 263168 - DNA, 25 bp, Rattus norvegicus
ctagctctatctcttgcatgtgtaa

SEQ ID NO: 263169 - DNA, 25 bp, Rattus norvegicus
ctagctctatctgttgcatgtgtaa

SEQ ID NO: 263170 - DNA, 25 bp, Rattus norvegicus
ctagctctcctgacacatgaggtgt

SEQ ID NO: 263171 - DNA, 25 bp, Rattus norvegicus
ctagctctcctgtcacatgaggtgt

SEQ ID NO: 263172 - DNA, 25 bp, Rattus norvegicus
ctagctctgggtaatggtgtacttt

SEQ ID NO: 263173 - DNA, 25 bp, Rattus norvegicus
ctagctctgggttatggtgtacttt

SEQ ID NO: 263174 - DNA, 25 bp, Rattus norvegicus
ctagctcttcaaatttttcatcccg

SEQ ID NO: 263175 - DNA, 25 bp, Rattus norvegicus
ctagctcttcaattttttcatcccg

SEQ ID NO: 263176 - DNA, 25 bp, Rattus norvegicus
ctagctcttcatcgtcctggaaagt

SEQ ID NO: 263177 - DNA, 25 bp, Rattus norvegicus
ctagctcttcatggtcctggaaagt

SEQ ID NO: 263178 - DNA, 25 bp, Rattus norvegicus
ctagctcttgctataatttgggtgt

SEQ ID NO: 263179 - DNA, 25 bp, Rattus norvegicus
ctagctcttgctttaatttgggtgt

SEQ ID NO: 263180 - DNA, 25 bp, Rattus norvegicus
ctagctgaacctaccttgggcaaaa

SEQ ID NO: 263181 - DNA, 25 bp, Rattus norvegicus
ctagctgaaccttccttgggcaaaa

SEQ ID NO: 263182 - DNA, 25 bp, Rattus norvegicus
ctagctgactgacgagacttaaaca

SEQ ID NO: 263183 - DNA, 25 bp, Rattus norvegicus
ctagctgactgaggagacttaaaca

SEQ ID NO: 263184 - DNA, 25 bp, Rattus norvegicus
ctagctgatggaacacctgctcaat

SEQ ID NO: 263185 - DNA, 25 bp, Rattus norvegicus
ctagctgatggatcacctgctcaat

SEQ ID NO: 263186 - DNA, 25 bp, Rattus norvegicus
ctagctgatgttatattctccaaca

SEQ ID NO: 263187 - DNA, 25 bp, Rattus norvegicus
ctagctgatgttttattctccaaca

SEQ ID NO: 263188 - DNA, 25 bp, Rattus norvegicus
ctagctgccctacaaggtaggtgct

SEQ ID NO: 263189 - DNA, 25 bp, Rattus norvegicus
ctagctgccctagaaggtaggtgct

SEQ ID NO: 263190 - DNA, 25 bp, Rattus norvegicus
ctagctgccctgaagaaacaccatg

SEQ ID NO: 263191 - DNA, 25 bp, Rattus norvegicus
ctagctgccctgtagaaacaccatg

SEQ ID NO: 263192 - DNA, 25 bp, Rattus norvegicus
ctagctgcccttctgttagtgaaga

SEQ ID NO: 263193 - DNA, 25 bp, Rattus norvegicus
ctagctgcccttgtgttagtgaaga

SEQ ID NO: 263194 - DNA, 25 bp, Rattus norvegicus
ctagctgccgtcatgtagatatgga

SEQ ID NO: 263195 - DNA, 25 bp, Rattus norvegicus
ctagctgccgtcttgtagatatgga

SEQ ID NO: 263196 - DNA, 25 bp, Rattus norvegicus
ctagctgctaggatttcaatttcga

SEQ ID NO: 263197 - DNA, 25 bp, Rattus norvegicus
ctagctgctaggttttcaatttcga

SEQ ID NO: 263198 - DNA, 25 bp, Rattus norvegicus
ctagctgctcctacagatagctggg

SEQ ID NO: 263199 - DNA, 25 bp, Rattus norvegicus
ctagctgctccttcagatagctggg

SEQ ID NO: 263200 - DNA, 25 bp, Rattus norvegicus
ctagctgctgaactcttgcgaagta

SEQ ID NO: 263201 - DNA, 25 bp, Rattus norvegicus
ctagctgctgaagtcttgcgaagta

SEQ ID NO: 263202 - DNA, 25 bp, Rattus norvegicus
ctagctgcttatctggtccatttga

SEQ ID NO: 263203 - DNA, 25 bp, Rattus norvegicus
ctagctgcttatgtggtccatttga

SEQ ID NO: 263204 - DNA, 25 bp, Rattus norvegicus
ctagctgcttcactggacacaaata

SEQ ID NO: 263205 - DNA, 25 bp, Rattus norvegicus
ctagctgcttcagtggacacaaata

SEQ ID NO: 263206 - DNA, 25 bp, Rattus norvegicus
ctagctgggcggatgggttagatgc

SEQ ID NO: 263207 - DNA, 25 bp, Rattus norvegicus
ctagctgggcggttgggttagatgc

SEQ ID NO: 263208 - DNA, 25 bp, Rattus norvegicus
ctagctgggttcatatttggcatgc

SEQ ID NO: 263209 - DNA, 25 bp, Rattus norvegicus
ctagctgggttcttatttggcatgc

SEQ ID NO: 263210 - DNA, 25 bp, Rattus norvegicus
ctagctgtctaccaggtctgtggat

SEQ ID NO: 263211 - DNA, 25 bp, Rattus norvegicus
ctagctgtctacgaggtctgtggat

SEQ ID NO: 263212 - DNA, 25 bp, Rattus norvegicus
ctagctgtgctgatgttgtatttga

SEQ ID NO: 263213 - DNA, 25 bp, Rattus norvegicus
ctagctgtgctgttgttgtatttga

SEQ ID NO: 263214 - DNA, 25 bp, Rattus norvegicus
ctagctgttaaaataccttgtgcac

SEQ ID NO: 263215 - DNA, 25 bp, Rattus norvegicus
ctagctgttaaattaccttgtgcac

SEQ ID NO: 263216 - DNA, 25 bp, Rattus norvegicus
ctagcttactcgctttgtcattaaa

SEQ ID NO: 263217 - DNA, 25 bp, Rattus norvegicus
ctagcttactcggtttgtcattaaa

SEQ ID NO: 263218 - DNA, 25 bp, Rattus norvegicus
ctagcttagactagctttgggttaa

SEQ ID NO: 263219 - DNA, 25 bp, Rattus norvegicus
ctagcttagacttgctttgggttaa

SEQ ID NO: 263220 - DNA, 25 bp, Rattus norvegicus
ctagcttagtagatggacccattta

SEQ ID NO: 263221 - DNA, 25 bp, Rattus norvegicus
ctagcttagtagttggacccattta

SEQ ID NO: 263222 - DNA, 25 bp, Rattus norvegicus
ctagcttgaggtaggtcctgcagtg

SEQ ID NO: 263223 - DNA, 25 bp, Rattus norvegicus
ctagcttgaggttggtcctgcagtg

SEQ ID NO: 263224 - DNA, 25 bp, Rattus norvegicus
ctagcttgctgtaaggttccatcaa

SEQ ID NO: 263225 - DNA, 25 bp, Rattus norvegicus
ctagcttgctgttaggttccatcaa

SEQ ID NO: 263226 - DNA, 25 bp, Rattus norvegicus
ctagcttggttaatattttcgttgg

SEQ ID NO: 263227 - DNA, 25 bp, Rattus norvegicus
ctagcttggttattattttcgttgg

SEQ ID NO: 263228 - DNA, 25 bp, Rattus norvegicus
ctagcttgtgtaaggccttgggttt

SEQ ID NO: 263229 - DNA, 25 bp, Rattus norvegicus
ctagcttgtgtatggccttgggttt

SEQ ID NO: 263230 - DNA, 25 bp, Rattus norvegicus
ctagctttaggtccgctggaaccct

SEQ ID NO: 263231 - DNA, 25 bp, Rattus norvegicus
ctagctttaggtgcgctggaaccct

SEQ ID NO: 263232 - DNA, 25 bp, Rattus norvegicus
ctagcttttgagcagtggacactga

SEQ ID NO: 263233 - DNA, 25 bp, Rattus norvegicus
ctagcttttgaggagtggacactga

SEQ ID NO: 263234 - DNA, 25 bp, Rattus norvegicus
ctagcttttggcaggcaggagactc

SEQ ID NO: 263235 - DNA, 25 bp, Rattus norvegicus
ctagcttttggctggcaggagactc

SEQ ID NO: 263236 - DNA, 25 bp, Rattus norvegicus
ctaggaaacttcaagtgctgggatt

SEQ ID NO: 263237 - DNA, 25 bp, Rattus norvegicus
ctaggaaacttctagtgctgggatt

SEQ ID NO: 263238 - DNA, 25 bp, Rattus norvegicus
ctaggaactcctcaggcctggtgaa

SEQ ID NO: 263239 - DNA, 25 bp, Rattus norvegicus
ctaggaactcctgaggcctggtgaa

SEQ ID NO: 263240 - DNA, 25 bp, Rattus norvegicus
ctaggaactctacactgcacccagt

SEQ ID NO: 263241 - DNA, 25 bp, Rattus norvegicus
ctaggaactctagactgcacccagt

SEQ ID NO: 263242 - DNA, 25 bp, Rattus norvegicus
ctaggaactgttcatggctctctct

SEQ ID NO: 263243 - DNA, 25 bp, Rattus norvegicus
ctaggaactgttgatggctctctct

SEQ ID NO: 263244 - DNA, 25 bp, Rattus norvegicus
ctaggaacttctccctttgagacta

SEQ ID NO: 263245 - DNA, 25 bp, Rattus norvegicus
ctaggaacttctgcctttgagacta

SEQ ID NO: 263246 - DNA, 25 bp, Rattus norvegicus
ctaggaagaagcagccctggaatct

SEQ ID NO: 263247 - DNA, 25 bp, Rattus norvegicus
ctaggaagaagctgccctggaatct

SEQ ID NO: 263248 - DNA, 25 bp, Rattus norvegicus
ctaggaatgaagatggccagctgag

SEQ ID NO: 263249 - DNA, 25 bp, Rattus norvegicus
ctaggaatgaagttggccagctgag

SEQ ID NO: 263250 - DNA, 25 bp, Rattus norvegicus
ctaggaattctgcttcgctctcagt

SEQ ID NO: 263251 - DNA, 25 bp, Rattus norvegicus
ctaggaattctggttcgctctcagt

SEQ ID NO: 263252 - DNA, 25 bp, Rattus norvegicus
ctaggaattgtcagtgttgtgaaac

SEQ ID NO: 263253 - DNA, 25 bp, Rattus norvegicus
ctaggaattgtctgtgttgtgaaac

SEQ ID NO: 263254 - DNA, 25 bp, Rattus norvegicus
ctaggacagtacaggctctctgaga

SEQ ID NO: 263255 - DNA, 25 bp, Rattus norvegicus
ctaggacagtactggctctctgaga

SEQ ID NO: 263256 - DNA, 25 bp, Rattus norvegicus
ctaggacattggaacaggaggcccc

SEQ ID NO: 263257 - DNA, 25 bp, Rattus norvegicus
ctaggacattggtacaggaggcccc

SEQ ID NO: 263258 - DNA, 25 bp, Rattus norvegicus
ctaggaccacccagagttacaaagt

SEQ ID NO: 263259 - DNA, 25 bp, Rattus norvegicus
ctaggaccaccctgagttacaaagt

SEQ ID NO: 263260 - DNA, 25 bp, Rattus norvegicus
ctaggacccagtatcttttactgat

SEQ ID NO: 263261 - DNA, 25 bp, Rattus norvegicus
ctaggacccagtttcttttactgat

SEQ ID NO: 263262 - DNA, 25 bp, Rattus norvegicus
ctaggaccttagcttgtgttccgtg

SEQ ID NO: 263263 - DNA, 25 bp, Rattus norvegicus
ctaggaccttaggttgtgttccgtg

SEQ ID NO: 263264 - DNA, 25 bp, Rattus norvegicus
ctaggactagaacgccaccatggtt

SEQ ID NO: 263265 - DNA, 25 bp, Rattus norvegicus
ctaggactagaaggccaccatggtt

SEQ ID NO: 263266 - DNA, 25 bp, Rattus norvegicus
ctaggactcatgaatccagaagtac

SEQ ID NO: 263267 - DNA, 25 bp, Rattus norvegicus
ctaggactcatgtatccagaagtac

SEQ ID NO: 263268 - DNA, 25 bp, Rattus norvegicus
ctaggactgtggacttcgtagaaat

SEQ ID NO: 263269 - DNA, 25 bp, Rattus norvegicus
ctaggactgtggtcttcgtagaaat

SEQ ID NO: 263270 - DNA, 25 bp, Rattus norvegicus
ctaggactttagcttggtcatccaa

SEQ ID NO: 263271 - DNA, 25 bp, Rattus norvegicus
ctaggactttaggttggtcatccaa

SEQ ID NO: 263272 - DNA, 25 bp, Rattus norvegicus
ctaggagaaaggcacttgcgtgcct

SEQ ID NO: 263273 - DNA, 25 bp, Rattus norvegicus
ctaggagaaagggacttgcgtgcct

SEQ ID NO: 263274 - DNA, 25 bp, Rattus norvegicus
ctaggagatgtgatcggagtcccaa

SEQ ID NO: 263275 - DNA, 25 bp, Rattus norvegicus
ctaggagatgtgttcggagtcccaa

SEQ ID NO: 263276 - DNA, 25 bp, Rattus norvegicus
ctaggagcagaccaccaagcacatg

SEQ ID NO: 263277 - DNA, 25 bp, Rattus norvegicus
ctaggagcagacgaccaagcacatg

SEQ ID NO: 263278 - DNA, 25 bp, Rattus norvegicus
ctaggataatttcagctccacccag

SEQ ID NO: 263279 - DNA, 25 bp, Rattus norvegicus
ctaggataatttgagctccacccag

SEQ ID NO: 263280 - DNA, 25 bp, Rattus norvegicus
ctaggatcagaactgctgcctgcag

SEQ ID NO: 263281 - DNA, 25 bp, Rattus norvegicus
ctaggatcagaagtgctgcctgcag

SEQ ID NO: 263282 - DNA, 25 bp, Rattus norvegicus
ctaggatgacctaccccaatgagaa

SEQ ID NO: 263283 - DNA, 25 bp, Rattus norvegicus
ctaggatgaccttccccaatgagaa

SEQ ID NO: 263284 - DNA, 25 bp, Rattus norvegicus
ctaggatgatctctactgccaggta

SEQ ID NO: 263285 - DNA, 25 bp, Rattus norvegicus
ctaggatgatctgtactgccaggta

SEQ ID NO: 263286 - DNA, 25 bp, Rattus norvegicus
ctaggatgtaggagactcatgagta

SEQ ID NO: 263287 - DNA, 25 bp, Rattus norvegicus
ctaggatgtaggtgactcatgagta

SEQ ID NO: 263288 - DNA, 25 bp, Rattus norvegicus
ctaggatgtggtagtggagtactca

SEQ ID NO: 263289 - DNA, 25 bp, Rattus norvegicus
ctaggatgtggttgtggagtactca

SEQ ID NO: 263290 - DNA, 25 bp, Rattus norvegicus
ctaggattgtggacatgcaaggctt

SEQ ID NO: 263291 - DNA, 25 bp, Rattus norvegicus
ctaggattgtggtcatgcaaggctt

SEQ ID NO: 263292 - DNA, 25 bp, Rattus norvegicus
ctaggatttcgcaggagcgccccgg

SEQ ID NO: 263293 - DNA, 25 bp, Rattus norvegicus
ctaggatttcgctggagcgccccgg

SEQ ID NO: 263294 - DNA, 25 bp, Rattus norvegicus
ctaggcaaccccaccattgcaaggg

SEQ ID NO: 263295 - DNA, 25 bp, Rattus norvegicus
ctaggcaacccctccattgcaaggg

SEQ ID NO: 263296 - DNA, 25 bp, Rattus norvegicus
ctaggcaaggcgacacactttgggt

SEQ ID NO: 263297 - DNA, 25 bp, Rattus norvegicus
ctaggcaaggcgtcacactttgggt

SEQ ID NO: 263298 - DNA, 25 bp, Rattus norvegicus
ctaggcacatgcactactcaggtgg

SEQ ID NO: 263299 - DNA, 25 bp, Rattus norvegicus
ctaggcacatgctctactcaggtgg

SEQ ID NO: 263300 - DNA, 25 bp, Rattus norvegicus
ctaggcaccggacggaagcagcatt

SEQ ID NO: 263301 - DNA, 25 bp, Rattus norvegicus
ctaggcaccggagggaagcagcatt

SEQ ID NO: 263302 - DNA, 25 bp, Rattus norvegicus
ctaggcacgcggatcgtgggcatgt

SEQ ID NO: 263303 - DNA, 25 bp, Rattus norvegicus
ctaggcacgcggttcgtgggcatgt

SEQ ID NO: 263304 - DNA, 25 bp, Rattus norvegicus
ctaggcactgttcccggcacaggtg

SEQ ID NO: 263305 - DNA, 25 bp, Rattus norvegicus
ctaggcactgttgccggcacaggtg

SEQ ID NO: 263306 - DNA, 25 bp, Rattus norvegicus
ctaggcagccctactcatgcgggat

SEQ ID NO: 263307 - DNA, 25 bp, Rattus norvegicus
ctaggcagcccttctcatgcgggat

SEQ ID NO: 263308 - DNA, 25 bp, Rattus norvegicus
ctaggcagctgacgatgtggcactt

SEQ ID NO: 263309 - DNA, 25 bp, Rattus norvegicus
ctaggcagctgaggatgtggcactt

SEQ ID NO: 263310 - DNA, 25 bp, Rattus norvegicus
ctaggcatagccatttcaactggga

SEQ ID NO: 263311 - DNA, 25 bp, Rattus norvegicus
ctaggcatagccttttcaactggga

SEQ ID NO: 263312 - DNA, 25 bp, Rattus norvegicus
ctaggcatcttcattgtcgtggctt

SEQ ID NO: 263313 - DNA, 25 bp, Rattus norvegicus
ctaggcatcttctttgtcgtggctt

SEQ ID NO: 263314 - DNA, 25 bp, Rattus norvegicus
ctaggcatggccaacccggagaatg

SEQ ID NO: 263315 - DNA, 25 bp, Rattus norvegicus
ctaggcatggcctacccggagaatg

SEQ ID NO: 263316 - DNA, 25 bp, Rattus norvegicus
ctaggcatgtttatcttgtgactta

SEQ ID NO: 263317 - DNA, 25 bp, Rattus norvegicus
ctaggcatgtttttcttgtgactta

SEQ ID NO: 263318 - DNA, 25 bp, Rattus norvegicus
ctaggcattgttatcctggtgttca

SEQ ID NO: 263319 - DNA, 25 bp, Rattus norvegicus
ctaggcattgttttcctggtgttca

SEQ ID NO: 263320 - DNA, 25 bp, Rattus norvegicus
ctaggccagcagagcggtaggtctt

SEQ ID NO: 263321 - DNA, 25 bp, Rattus norvegicus
ctaggccagcagtgcggtaggtctt

SEQ ID NO: 263322 - DNA, 25 bp, Rattus norvegicus
ctaggccagcgacggctgcacagta

SEQ ID NO: 263323 - DNA, 25 bp, Rattus norvegicus
ctaggccagcgagggctgcacagta

SEQ ID NO: 263324 - DNA, 25 bp, Rattus norvegicus
ctaggccagctacaacagcatagtt

SEQ ID NO: 263325 - DNA, 25 bp, Rattus norvegicus
ctaggccagctagaacagcatagtt

SEQ ID NO: 263326 - DNA, 25 bp, Rattus norvegicus
ctaggccatgtaataagcaggtttg

SEQ ID NO: 263327 - DNA, 25 bp, Rattus norvegicus
ctaggccatgtattaagcaggtttg

SEQ ID NO: 263328 - DNA, 25 bp, Rattus norvegicus
ctaggcccagaccatgaagcctgac

SEQ ID NO: 263329 - DNA, 25 bp, Rattus norvegicus
ctaggcccagacgatgaagcctgac

SEQ ID NO: 263330 - DNA, 25 bp, Rattus norvegicus
ctaggccctgggaatcagttacaag

SEQ ID NO: 263331 - DNA, 25 bp, Rattus norvegicus
ctaggccctgggtatcagttacaag

SEQ ID NO: 263332 - DNA, 25 bp, Rattus norvegicus
ctaggccctttgatggatggtcatg

SEQ ID NO: 263333 - DNA, 25 bp, Rattus norvegicus
ctaggccctttgttggatggtcatg

SEQ ID NO: 263334 - DNA, 25 bp, Rattus norvegicus
ctaggccgaggcagagccctttgga

SEQ ID NO: 263335 - DNA, 25 bp, Rattus norvegicus
ctaggccgaggctgagccctttgga

SEQ ID NO: 263336 - DNA, 25 bp, Rattus norvegicus
ctaggccgccgtaaacaaagatcta

SEQ ID NO: 263337 - DNA, 25 bp, Rattus norvegicus
ctaggccgccgttaacaaagatcta

SEQ ID NO: 263338 - DNA, 25 bp, Rattus norvegicus
ctaggccggctgcaactacagtgat

SEQ ID NO: 263339 - DNA, 25 bp, Rattus norvegicus
ctaggccggctggaactacagtgat

SEQ ID NO: 263340 - DNA, 25 bp, Rattus norvegicus
ctaggcctaaggcattgtcctgtgc

SEQ ID NO: 263341 - DNA, 25 bp, Rattus norvegicus
ctaggcctaagggattgtcctgtgc

SEQ ID NO: 263342 - DNA, 25 bp, Rattus norvegicus
ctaggcctacctccagtagttacaa

SEQ ID NO: 263343 - DNA, 25 bp, Rattus norvegicus
ctaggcctacctgcagtagttacaa

SEQ ID NO: 263344 - DNA, 25 bp, Rattus norvegicus
ctaggcctcctgacctataaatgga

SEQ ID NO: 263345 - DNA, 25 bp, Rattus norvegicus
ctaggcctcctgtcctataaatgga

SEQ ID NO: 263346 - DNA, 25 bp, Rattus norvegicus
ctaggcctctgcattggaactggaa

SEQ ID NO: 263347 - DNA, 25 bp, Rattus norvegicus
ctaggcctctgctttggaactggaa

SEQ ID NO: 263348 - DNA, 25 bp, Rattus norvegicus
ctaggcctgtagagaatgacccaat

SEQ ID NO: 263349 - DNA, 25 bp, Rattus norvegicus
ctaggcctgtagtgaatgacccaat

SEQ ID NO: 263350 - DNA, 25 bp, Rattus norvegicus
ctaggcctgtctagattctcatgaa

SEQ ID NO: 263351 - DNA, 25 bp, Rattus norvegicus
ctaggcctgtcttgattctcatgaa

SEQ ID NO: 263352 - DNA, 25 bp, Rattus norvegicus
ctaggcctgtgtctgctaaaacaaa

SEQ ID NO: 263353 - DNA, 25 bp, Rattus norvegicus
ctaggcctgtgtgtgctaaaacaaa

SEQ ID NO: 263354 - DNA, 25 bp, Rattus norvegicus
ctaggcggttagacttcggcagagc

SEQ ID NO: 263355 - DNA, 25 bp, Rattus norvegicus
ctaggcggttagtcttcggcagagc

SEQ ID NO: 263356 - DNA, 25 bp, Rattus norvegicus
ctaggctaaattaatgtcaggtgca

SEQ ID NO: 263357 - DNA, 25 bp, Rattus norvegicus
ctaggctaaatttatgtcaggtgca

SEQ ID NO: 263358 - DNA, 25 bp, Rattus norvegicus
ctaggctacttacgagctactccca

SEQ ID NO: 263359 - DNA, 25 bp, Rattus norvegicus
ctaggctacttaggagctactccca

SEQ ID NO: 263360 - DNA, 25 bp, Rattus norvegicus
ctaggctacttgctcttgtgactga

SEQ ID NO: 263361 - DNA, 25 bp, Rattus norvegicus
ctaggctacttggtcttgtgactga

SEQ ID NO: 263362 - DNA, 25 bp, Rattus norvegicus
ctaggctagacaccttctgggacta

SEQ ID NO: 263363 - DNA, 25 bp, Rattus norvegicus
ctaggctagacagcttctgggacta

SEQ ID NO: 263364 - DNA, 25 bp, Rattus norvegicus
ctaggctaggccacttgccagctgg

SEQ ID NO: 263365 - DNA, 25 bp, Rattus norvegicus
ctaggctaggcctcttgccagctgg

SEQ ID NO: 263366 - DNA, 25 bp, Rattus norvegicus
ctaggctcagttctcttagacccgg

SEQ ID NO: 263367 - DNA, 25 bp, Rattus norvegicus
ctaggctcagttgtcttagacccgg

SEQ ID NO: 263368 - DNA, 25 bp, Rattus norvegicus
ctaggctcctcacggctcatgggaa

SEQ ID NO: 263369 - DNA, 25 bp, Rattus norvegicus
ctaggctcctcagggctcatgggaa

SEQ ID NO: 263370 - DNA, 25 bp, Rattus norvegicus
ctaggctcctttagacttacttttg

SEQ ID NO: 263371 - DNA, 25 bp, Rattus norvegicus
ctaggctccttttgacttacttttg

SEQ ID NO: 263372 - DNA, 25 bp, Rattus norvegicus
ctaggctctgcacataaactggctg

SEQ ID NO: 263373 - DNA, 25 bp, Rattus norvegicus
ctaggctctgcagataaactggctg

SEQ ID NO: 263374 - DNA, 25 bp, Rattus norvegicus
ctaggctctttcattgtgtgggttc

SEQ ID NO: 263375 - DNA, 25 bp, Rattus norvegicus
ctaggctctttctttgtgtgggttc

SEQ ID NO: 263376 - DNA, 25 bp, Rattus norvegicus
ctaggctgaatgactcttctgatct

SEQ ID NO: 263377 - DNA, 25 bp, Rattus norvegicus
ctaggctgaatgtctcttctgatct

SEQ ID NO: 263378 - DNA, 25 bp, Rattus norvegicus
ctaggctgaccactgattccagaat

SEQ ID NO: 263379 - DNA, 25 bp, Rattus norvegicus
ctaggctgaccagtgattccagaat

SEQ ID NO: 263380 - DNA, 25 bp, Rattus norvegicus
ctaggctgagctattgttataaacc

SEQ ID NO: 263381 - DNA, 25 bp, Rattus norvegicus
ctaggctgagcttttgttataaacc

SEQ ID NO: 263382 - DNA, 25 bp, Rattus norvegicus
ctaggctggcctaggatttggtatc

SEQ ID NO: 263383 - DNA, 25 bp, Rattus norvegicus
ctaggctggccttggatttggtatc

SEQ ID NO: 263384 - DNA, 25 bp, Rattus norvegicus
ctaggctggctcctgaaaagtgtcc

SEQ ID NO: 263385 - DNA, 25 bp, Rattus norvegicus
ctaggctggctcgtgaaaagtgtcc

SEQ ID NO: 263386 - DNA, 25 bp, Rattus norvegicus
ctaggctgggccatgtggactttgt

SEQ ID NO: 263387 - DNA, 25 bp, Rattus norvegicus
ctaggctgggccttgtggactttgt

SEQ ID NO: 263388 - DNA, 25 bp, Rattus norvegicus
ctaggcttcatgatgcatttctaaa

SEQ ID NO: 263389 - DNA, 25 bp, Rattus norvegicus
ctaggcttcatgttgcatttctaaa

SEQ ID NO: 263390 - DNA, 25 bp, Rattus norvegicus
ctaggcttcttcagggaaactccat

SEQ ID NO: 263391 - DNA, 25 bp, Rattus norvegicus
ctaggcttcttctgggaaactccat

SEQ ID NO: 263392 - DNA, 25 bp, Rattus norvegicus
ctagggaaatttcgcttgctgtttt

SEQ ID NO: 263393 - DNA, 25 bp, Rattus norvegicus
ctagggaaatttggcttgctgtttt

SEQ ID NO: 263394 - DNA, 25 bp, Rattus norvegicus
ctagggaacagcagtaagtctcttc

SEQ ID NO: 263395 - DNA, 25 bp, Rattus norvegicus
ctagggaacagctgtaagtctcttc

SEQ ID NO: 263396 - DNA, 25 bp, Rattus norvegicus
ctagggaatctgacattttcatttc

SEQ ID NO: 263397 - DNA, 25 bp, Rattus norvegicus
ctagggaatctgtcattttcatttc

SEQ ID NO: 263398 - DNA, 25 bp, Rattus norvegicus
ctagggaatttccatattggcagat

SEQ ID NO: 263399 - DNA, 25 bp, Rattus norvegicus
ctagggaatttcgatattggcagat

SEQ ID NO: 263400 - DNA, 25 bp, Rattus norvegicus
ctagggacaaacaggttcatttagc

SEQ ID NO: 263401 - DNA, 25 bp, Rattus norvegicus
ctagggacaaactggttcatttagc

SEQ ID NO: 263402 - DNA, 25 bp, Rattus norvegicus
ctagggacaggtatttggccaggca

SEQ ID NO: 263403 - DNA, 25 bp, Rattus norvegicus
ctagggacaggtttttggccaggca

SEQ ID NO: 263404 - DNA, 25 bp, Rattus norvegicus
ctagggaccttcatagatgccataa

SEQ ID NO: 263405 - DNA, 25 bp, Rattus norvegicus
ctagggaccttcttagatgccataa

SEQ ID NO: 263406 - DNA, 25 bp, Rattus norvegicus
ctagggagaagtatcatccagaaat

SEQ ID NO: 263407 - DNA, 25 bp, Rattus norvegicus
ctagggagaagtttcatccagaaat

SEQ ID NO: 263408 - DNA, 25 bp, Rattus norvegicus
ctagggaggcggatctctgaatttg

SEQ ID NO: 263409 - DNA, 25 bp, Rattus norvegicus
ctagggaggcggttctctgaatttg

SEQ ID NO: 263410 - DNA, 25 bp, Rattus norvegicus
ctagggcatgccatgtgctgttaat

SEQ ID NO: 263411 - DNA, 25 bp, Rattus norvegicus
ctagggcatgccttgtgctgttaat

SEQ ID NO: 263412 - DNA, 25 bp, Rattus norvegicus
ctagggcccaggagtacacataagc

SEQ ID NO: 263413 - DNA, 25 bp, Rattus norvegicus
ctagggcccaggtgtacacataagc

SEQ ID NO: 263414 - DNA, 25 bp, Rattus norvegicus
ctagggcctgctctgtgtatgtaag

SEQ ID NO: 263415 - DNA, 25 bp, Rattus norvegicus
ctagggcctgctgtgtgtatgtaag

SEQ ID NO: 263416 - DNA, 25 bp, Rattus norvegicus
ctagggccttggagtagagcgactt

SEQ ID NO: 263417 - DNA, 25 bp, Rattus norvegicus
ctagggccttggtgtagagcgactt

SEQ ID NO: 263418 - DNA, 25 bp, Rattus norvegicus
ctagggctctcaccccaacaaaaag

SEQ ID NO: 263419 - DNA, 25 bp, Rattus norvegicus
ctagggctctcagcccaacaaaaag

SEQ ID NO: 263420 - DNA, 25 bp, Rattus norvegicus
ctagggcttcccaggagcttttaca

SEQ ID NO: 263421 - DNA, 25 bp, Rattus norvegicus
ctagggcttccctggagcttttaca

SEQ ID NO: 263422 - DNA, 25 bp, Rattus norvegicus
ctagggcttgataaacgtgcataac

SEQ ID NO: 263423 - DNA, 25 bp, Rattus norvegicus
ctagggcttgattaacgtgcataac

SEQ ID NO: 263424 - DNA, 25 bp, Rattus norvegicus
ctaggggtcgccacagcctttgcgc

SEQ ID NO: 263425 - DNA, 25 bp, Rattus norvegicus
ctaggggtcgcctcagcctttgcgc

SEQ ID NO: 263426 - DNA, 25 bp, Rattus norvegicus
ctagggtatttcatctgacctcagc

SEQ ID NO: 263427 - DNA, 25 bp, Rattus norvegicus
ctagggtatttcttctgacctcagc

SEQ ID NO: 263428 - DNA, 25 bp, Rattus norvegicus
ctagggtcaggcaactatgatttta

SEQ ID NO: 263429 - DNA, 25 bp, Rattus norvegicus
ctagggtcaggctactatgatttta

SEQ ID NO: 263430 - DNA, 25 bp, Rattus norvegicus
ctagggtccctgatagaccagatca

SEQ ID NO: 263431 - DNA, 25 bp, Rattus norvegicus
ctagggtccctgttagaccagatca

SEQ ID NO: 263432 - DNA, 25 bp, Rattus norvegicus
ctagggtcgctacatcagggctttg

SEQ ID NO: 263433 - DNA, 25 bp, Rattus norvegicus
ctagggtcgctagatcagggctttg

SEQ ID NO: 263434 - DNA, 25 bp, Rattus norvegicus
ctagggtctcctactttgacaagtg

SEQ ID NO: 263435 - DNA, 25 bp, Rattus norvegicus
ctagggtctccttctttgacaagtg

SEQ ID NO: 263436 - DNA, 25 bp, Rattus norvegicus
ctagggtgtcatattagctctgtga

SEQ ID NO: 263437 - DNA, 25 bp, Rattus norvegicus
ctagggtgtcattttagctctgtga

SEQ ID NO: 263438 - DNA, 25 bp, Rattus norvegicus
ctaggtaacgtaaagccgacatgat

SEQ ID NO: 263439 - DNA, 25 bp, Rattus norvegicus
ctaggtaacgtatagccgacatgat

SEQ ID NO: 263440 - DNA, 25 bp, Rattus norvegicus
ctaggtaactaacctgactccaaca

SEQ ID NO: 263441 - DNA, 25 bp, Rattus norvegicus
ctaggtaactaagctgactccaaca

SEQ ID NO: 263442 - DNA, 25 bp, Rattus norvegicus
ctaggtacaactcaatatcattatc

SEQ ID NO: 263443 - DNA, 25 bp, Rattus norvegicus
ctaggtacaactgaatatcattatc

SEQ ID NO: 263444 - DNA, 25 bp, Rattus norvegicus
ctaggtacagacaaacccagatttt

SEQ ID NO: 263445 - DNA, 25 bp, Rattus norvegicus
ctaggtacagactaacccagatttt

SEQ ID NO: 263446 - DNA, 25 bp, Rattus norvegicus
ctaggtactgcacactggcctgact

SEQ ID NO: 263447 - DNA, 25 bp, Rattus norvegicus
ctaggtactgcagactggcctgact

SEQ ID NO: 263448 - DNA, 25 bp, Rattus norvegicus
ctaggtagagcgctttgacttcgag

SEQ ID NO: 263449 - DNA, 25 bp, Rattus norvegicus
ctaggtagagcggtttgacttcgag

SEQ ID NO: 263450 - DNA, 25 bp, Rattus norvegicus
ctaggtatgtgaattgtttccccaa

SEQ ID NO: 263451 - DNA, 25 bp, Rattus norvegicus
ctaggtatgtgatttgtttccccaa

SEQ ID NO: 263452 - DNA, 25 bp, Rattus norvegicus
ctaggtcacgttcctttcttcattt

SEQ ID NO: 263453 - DNA, 25 bp, Rattus norvegicus
ctaggtcacgttgctttcttcattt

SEQ ID NO: 263454 - DNA, 25 bp, Rattus norvegicus
ctaggtcagtttactttgtttctct

SEQ ID NO: 263455 - DNA, 25 bp, Rattus norvegicus
ctaggtcagttttctttgtttctct

SEQ ID NO: 263456 - DNA, 25 bp, Rattus norvegicus
ctaggtcggcctcaaacttgaagat

SEQ ID NO: 263457 - DNA, 25 bp, Rattus norvegicus
ctaggtcggcctgaaacttgaagat

SEQ ID NO: 263458 - DNA, 25 bp, Rattus norvegicus
ctaggtctcacaaaaggatcttata

SEQ ID NO: 263459 - DNA, 25 bp, Rattus norvegicus
ctaggtctcacataaggatcttata

SEQ ID NO: 263460 - DNA, 25 bp, Rattus norvegicus
ctaggtctcagtcctcccggatgga

SEQ ID NO: 263461 - DNA, 25 bp, Rattus norvegicus
ctaggtctcagtgctcccggatgga

SEQ ID NO: 263462 - DNA, 25 bp, Rattus norvegicus
ctaggtctcattagggttgcacata

SEQ ID NO: 263463 - DNA, 25 bp, Rattus norvegicus
ctaggtctcatttgggttgcacata

SEQ ID NO: 263464 - DNA, 25 bp, Rattus norvegicus
ctaggtctgtgtcatctggctggaa

SEQ ID NO: 263465 - DNA, 25 bp, Rattus norvegicus
ctaggtctgtgtgatctggctggaa

SEQ ID NO: 263466 - DNA, 25 bp, Rattus norvegicus
ctaggtgacacaagaagtatgatac

SEQ ID NO: 263467 - DNA, 25 bp, Rattus norvegicus
ctaggtgacacatgaagtatgatac

SEQ ID NO: 263468 - DNA, 25 bp, Rattus norvegicus
ctaggtgatggtactgtctctcaga

SEQ ID NO: 263469 - DNA, 25 bp, Rattus norvegicus
ctaggtgatggttctgtctctcaga

SEQ ID NO: 263470 - DNA, 25 bp, Rattus norvegicus
ctaggtgctatgaagccagctgaca

SEQ ID NO: 263471 - DNA, 25 bp, Rattus norvegicus
ctaggtgctatgtagccagctgaca

SEQ ID NO: 263472 - DNA, 25 bp, Rattus norvegicus
ctaggtggaatcatctggaggtcaa

SEQ ID NO: 263473 - DNA, 25 bp, Rattus norvegicus
ctaggtggaatcttctggaggtcaa

SEQ ID NO: 263474 - DNA, 25 bp, Rattus norvegicus
ctaggtggctccataattgtagcgt

SEQ ID NO: 263475 - DNA, 25 bp, Rattus norvegicus
ctaggtggctccttaattgtagcgt

SEQ ID NO: 263476 - DNA, 25 bp, Rattus norvegicus
ctaggtgggatccacagccacggaa

SEQ ID NO: 263477 - DNA, 25 bp, Rattus norvegicus
ctaggtgggatcgacagccacggaa

SEQ ID NO: 263478 - DNA, 25 bp, Rattus norvegicus
ctaggtggtgtacattcaggcaaag

SEQ ID NO: 263479 - DNA, 25 bp, Rattus norvegicus
ctaggtggtgtagattcaggcaaag

SEQ ID NO: 263480 - DNA, 25 bp, Rattus norvegicus
ctaggtggttttccccatatagatt

SEQ ID NO: 263481 - DNA, 25 bp, Rattus norvegicus
ctaggtggttttgcccatatagatt

SEQ ID NO: 263482 - DNA, 25 bp, Rattus norvegicus
ctaggtgtctcgaggtctctggaga

SEQ ID NO: 263483 - DNA, 25 bp, Rattus norvegicus
ctaggtgtctcgtggtctctggaga

SEQ ID NO: 263484 - DNA, 25 bp, Rattus norvegicus
ctaggtgtgatgctctgtaatctca

SEQ ID NO: 263485 - DNA, 25 bp, Rattus norvegicus
ctaggtgtgatggtctgtaatctca

SEQ ID NO: 263486 - DNA, 25 bp, Rattus norvegicus
ctaggtgtggtaatggacttgtctt

SEQ ID NO: 263487 - DNA, 25 bp, Rattus norvegicus
ctaggtgtggtattggacttgtctt

SEQ ID NO: 263488 - DNA, 25 bp, Rattus norvegicus
ctaggtgttcctagttttctgggtg

SEQ ID NO: 263489 - DNA, 25 bp, Rattus norvegicus
ctaggtgttccttgttttctgggtg

SEQ ID NO: 263490 - DNA, 25 bp, Rattus norvegicus
ctaggttagtcgacaggaaggctct

SEQ ID NO: 263491 - DNA, 25 bp, Rattus norvegicus
ctaggttagtcgtcaggaaggctct

SEQ ID NO: 263492 - DNA, 25 bp, Rattus norvegicus
ctaggttccagcagggttggcacga

SEQ ID NO: 263493 - DNA, 25 bp, Rattus norvegicus
ctaggttccagctgggttggcacga

SEQ ID NO: 263494 - DNA, 25 bp, Rattus norvegicus
ctaggttcttttcctcatctttact

SEQ ID NO: 263495 - DNA, 25 bp, Rattus norvegicus
ctaggttcttttgctcatctttact

SEQ ID NO: 263496 - DNA, 25 bp, Rattus norvegicus
ctaggttgctagctgaaatctcagt

SEQ ID NO: 263497 - DNA, 25 bp, Rattus norvegicus
ctaggttgctaggtgaaatctcagt

SEQ ID NO: 263498 - DNA, 25 bp, Rattus norvegicus
ctaggttgttgacggtcgcagccac

SEQ ID NO: 263499 - DNA, 25 bp, Rattus norvegicus
ctaggttgttgagggtcgcagccac

SEQ ID NO: 263500 - DNA, 25 bp, Rattus norvegicus
ctaggtttagacatggctcctgtga

SEQ ID NO: 263501 - DNA, 25 bp, Rattus norvegicus
ctaggtttagacttggctcctgtga

SEQ ID NO: 263502 - DNA, 25 bp, Rattus norvegicus
ctaggtttagagactgaagccgccg

SEQ ID NO: 263503 - DNA, 25 bp, Rattus norvegicus
ctaggtttagagtctgaagccgccg

SEQ ID NO: 263504 - DNA, 25 bp, Rattus norvegicus
ctaggtttaggcactatctcagcaa

SEQ ID NO: 263505 - DNA, 25 bp, Rattus norvegicus
ctaggtttaggctctatctcagcaa

SEQ ID NO: 263506 - DNA, 25 bp, Rattus norvegicus
ctaggtttatatataccgctgcaaa

SEQ ID NO: 263507 - DNA, 25 bp, Rattus norvegicus
ctaggtttatatcatctggcttgaa

SEQ ID NO: 263508 - DNA, 25 bp, Rattus norvegicus
ctaggtttatatgatctggcttgaa

SEQ ID NO: 263509 - DNA, 25 bp, Rattus norvegicus
ctaggtttatatttaccgctgcaaa

SEQ ID NO: 263510 - DNA, 25 bp, Rattus norvegicus
ctaggtttctttcggtcttcatgtc

SEQ ID NO: 263511 - DNA, 25 bp, Rattus norvegicus
ctaggtttctttgggtcttcatgtc

SEQ ID NO: 263512 - DNA, 25 bp, Rattus norvegicus
ctaggtttgaatactccaggccctc

SEQ ID NO: 263513 - DNA, 25 bp, Rattus norvegicus
ctaggtttgaattctccaggccctc

SEQ ID NO: 263514 - DNA, 25 bp, Rattus norvegicus
ctagtaaatcggacgggctggcagc

SEQ ID NO: 263515 - DNA, 25 bp, Rattus norvegicus
ctagtaaatcggtcgggctggcagc

SEQ ID NO: 263516 - DNA, 25 bp, Rattus norvegicus
ctagtaaccaagcacagtcctctgg

SEQ ID NO: 263517 - DNA, 25 bp, Rattus norvegicus
ctagtaaccaaggacagtcctctgg

SEQ ID NO: 263518 - DNA, 25 bp, Rattus norvegicus
ctagtaactattagattgcagcacg

SEQ ID NO: 263519 - DNA, 25 bp, Rattus norvegicus
ctagtaactatttgattgcagcacg

SEQ ID NO: 263520 - DNA, 25 bp, Rattus norvegicus
ctagtaatgctacccaccttttaag

SEQ ID NO: 263521 - DNA, 25 bp, Rattus norvegicus
ctagtaatgctagccaccttttaag

SEQ ID NO: 263522 - DNA, 25 bp, Rattus norvegicus
ctagtactgtacaggtcaacctcaa

SEQ ID NO: 263523 - DNA, 25 bp, Rattus norvegicus
ctagtactgtactggtcaacctcaa

SEQ ID NO: 263524 - DNA, 25 bp, Rattus norvegicus
ctagtactgttcctgattctgtgag

SEQ ID NO: 263525 - DNA, 25 bp, Rattus norvegicus
ctagtactgttcgtgattctgtgag

SEQ ID NO: 263526 - DNA, 25 bp, Rattus norvegicus
ctagtaggtcacagctattagcaat

SEQ ID NO: 263527 - DNA, 25 bp, Rattus norvegicus
ctagtaggtcactgctattagcaat

SEQ ID NO: 263528 - DNA, 25 bp, Rattus norvegicus
ctagtaggttctctgcatgtggagc

SEQ ID NO: 263529 - DNA, 25 bp, Rattus norvegicus
ctagtaggttctgtgcatgtggagc

SEQ ID NO: 263530 - DNA, 25 bp, Rattus norvegicus
ctagtagtctaaactctgcttccga

SEQ ID NO: 263531 - DNA, 25 bp, Rattus norvegicus
ctagtagtctaatctctgcttccga

SEQ ID NO: 263532 - DNA, 25 bp, Rattus norvegicus
ctagtagtttctcagagggtcctct

SEQ ID NO: 263533 - DNA, 25 bp, Rattus norvegicus
ctagtagtttctgagagggtcctct

SEQ ID NO: 263534 - DNA, 25 bp, Rattus norvegicus
ctagtatcctgcagtttacacctga

SEQ ID NO: 263535 - DNA, 25 bp, Rattus norvegicus
ctagtatcctgctgtttacacctga

SEQ ID NO: 263536 - DNA, 25 bp, Rattus norvegicus
ctagtattcaaaaatgcctgcatct

SEQ ID NO: 263537 - DNA, 25 bp, Rattus norvegicus
ctagtattcaaatatgcctgcatct

SEQ ID NO: 263538 - DNA, 25 bp, Rattus norvegicus
ctagtcacctcaacttctgtagaag

SEQ ID NO: 263539 - DNA, 25 bp, Rattus norvegicus
ctagtcacctcatcttctgtagaag

SEQ ID NO: 263540 - DNA, 25 bp, Rattus norvegicus
ctagtccagccacggctagctatgt

SEQ ID NO: 263541 - DNA, 25 bp, Rattus norvegicus
ctagtccagccagggctagctatgt

SEQ ID NO: 263542 - DNA, 25 bp, Rattus norvegicus
ctagtccccacaagctcaggatgtc

SEQ ID NO: 263543 - DNA, 25 bp, Rattus norvegicus
ctagtccccacatgctcaggatgtc

SEQ ID NO: 263544 - DNA, 25 bp, Rattus norvegicus
ctagtccccagtcgagtgcgtgtgt

SEQ ID NO: 263545 - DNA, 25 bp, Rattus norvegicus
ctagtccccagtggagtgcgtgtgt

SEQ ID NO: 263546 - DNA, 25 bp, Rattus norvegicus
ctagtcctacctcgcagaagatcat

SEQ ID NO: 263547 - DNA, 25 bp, Rattus norvegicus
ctagtcctacctggcagaagatcat

SEQ ID NO: 263548 - DNA, 25 bp, Rattus norvegicus
ctagtcctcaagacagcaaaccaga

SEQ ID NO: 263549 - DNA, 25 bp, Rattus norvegicus
ctagtcctcaagtcagcaaaccaga

SEQ ID NO: 263550 - DNA, 25 bp, Rattus norvegicus
ctagtcctcatgcaatcctgaacaa

SEQ ID NO: 263551 - DNA, 25 bp, Rattus norvegicus
ctagtcctcatggaatcctgaacaa

SEQ ID NO: 263552 - DNA, 25 bp, Rattus norvegicus
ctagtcctccggaggacgatgggat

SEQ ID NO: 263553 - DNA, 25 bp, Rattus norvegicus
ctagtcctccggtggacgatgggat

SEQ ID NO: 263554 - DNA, 25 bp, Rattus norvegicus
ctagtccttcacagcctgtttaaga

SEQ ID NO: 263555 - DNA, 25 bp, Rattus norvegicus
ctagtccttcactgcctgtttaaga

SEQ ID NO: 263556 - DNA, 25 bp, Rattus norvegicus
ctagtcgatgacagatttgcagcaa

SEQ ID NO: 263557 - DNA, 25 bp, Rattus norvegicus
ctagtcgatgactgatttgcagcaa

SEQ ID NO: 263558 - DNA, 25 bp, Rattus norvegicus
ctagtctagtttcctgtagcaaaga

SEQ ID NO: 263559 - DNA, 25 bp, Rattus norvegicus
ctagtctagtttgctgtagcaaaga

SEQ ID NO: 263560 - DNA, 25 bp, Rattus norvegicus
ctagtctcttctccctattgtgtgc

SEQ ID NO: 263561 - DNA, 25 bp, Rattus norvegicus
ctagtctcttctgcctattgtgtgc

SEQ ID NO: 263562 - DNA, 25 bp, Rattus norvegicus
ctagtctcttttccgtacacaactt

SEQ ID NO: 263563 - DNA, 25 bp, Rattus norvegicus
ctagtctcttttgcgtacacaactt

SEQ ID NO: 263564 - DNA, 25 bp, Rattus norvegicus
ctagtctggaagctccgaccgacat

SEQ ID NO: 263565 - DNA, 25 bp, Rattus norvegicus
ctagtctggaaggtccgaccgacat

SEQ ID NO: 263566 - DNA, 25 bp, Rattus norvegicus
ctagtctggcagaccggtatagaga

SEQ ID NO: 263567 - DNA, 25 bp, Rattus norvegicus
ctagtctggcagtccggtatagaga

SEQ ID NO: 263568 - DNA, 25 bp, Rattus norvegicus
ctagtctgtcatctagttcacaagt

SEQ ID NO: 263569 - DNA, 25 bp, Rattus norvegicus
ctagtctgtcatgtagttcacaagt

SEQ ID NO: 263570 - DNA, 25 bp, Rattus norvegicus
ctagtctgtttcagccattctgatt

SEQ ID NO: 263571 - DNA, 25 bp, Rattus norvegicus
ctagtctgtttctgccattctgatt

SEQ ID NO: 263572 - DNA, 25 bp, Rattus norvegicus
ctagtctgttttcacagcttcctag

SEQ ID NO: 263573 - DNA, 25 bp, Rattus norvegicus
ctagtctgttttgacagcttcctag

SEQ ID NO: 263574 - DNA, 25 bp, Rattus norvegicus
ctagtcttccccacagaggacatgc

SEQ ID NO: 263575 - DNA, 25 bp, Rattus norvegicus
ctagtcttcccctcagaggacatgc

SEQ ID NO: 263576 - DNA, 25 bp, Rattus norvegicus
ctagtcttgggcatgtagcttcatt

SEQ ID NO: 263577 - DNA, 25 bp, Rattus norvegicus
ctagtcttgggcttgtagcttcatt

SEQ ID NO: 263578 - DNA, 25 bp, Rattus norvegicus
ctagtcttggtcagttgttggccta

SEQ ID NO: 263579 - DNA, 25 bp, Rattus norvegicus
ctagtcttggtctgttgttggccta

SEQ ID NO: 263580 - DNA, 25 bp, Rattus norvegicus
ctagtcttgtatcctggtctctccg

SEQ ID NO: 263581 - DNA, 25 bp, Rattus norvegicus
ctagtcttgtatgctggtctctccg

SEQ ID NO: 263582 - DNA, 25 bp, Rattus norvegicus
ctagtctttctacggaagtccaaca

SEQ ID NO: 263583 - DNA, 25 bp, Rattus norvegicus
ctagtctttctagggaagtccaaca

SEQ ID NO: 263584 - DNA, 25 bp, Rattus norvegicus
ctagtctttggtcaattcagagtgc

SEQ ID NO: 263585 - DNA, 25 bp, Rattus norvegicus
ctagtctttggtgaattcagagtgc

SEQ ID NO: 263586 - DNA, 25 bp, Rattus norvegicus
ctagtgaatttcatgataccctggg

SEQ ID NO: 263587 - DNA, 25 bp, Rattus norvegicus
ctagtgaatttcttgataccctggg

SEQ ID NO: 263588 - DNA, 25 bp, Rattus norvegicus
ctagtgacaaagctggataccaaaa

SEQ ID NO: 263589 - DNA, 25 bp, Rattus norvegicus
ctagtgacaaaggtggataccaaaa

SEQ ID NO: 263590 - DNA, 25 bp, Rattus norvegicus
ctagtgacactaaagccagtcttgt

SEQ ID NO: 263591 - DNA, 25 bp, Rattus norvegicus
ctagtgacactatagccagtcttgt

SEQ ID NO: 263592 - DNA, 25 bp, Rattus norvegicus
ctagtgaggtcacccacagtgtgtg

SEQ ID NO: 263593 - DNA, 25 bp, Rattus norvegicus
ctagtgaggtcagccacagtgtgtg

SEQ ID NO: 263594 - DNA, 25 bp, Rattus norvegicus
ctagtgcaggacaccctgggaggca

SEQ ID NO: 263595 - DNA, 25 bp, Rattus norvegicus
ctagtgcaggactccctgggaggca

SEQ ID NO: 263596 - DNA, 25 bp, Rattus norvegicus
ctagtgccggttctagtccaatgaa

SEQ ID NO: 263597 - DNA, 25 bp, Rattus norvegicus
ctagtgccggttgtagtccaatgaa

SEQ ID NO: 263598 - DNA, 25 bp, Rattus norvegicus
ctagtgcggcgtagtgggttctcaa

SEQ ID NO: 263599 - DNA, 25 bp, Rattus norvegicus
ctagtgcggcgttgtgggttctcaa

SEQ ID NO: 263600 - DNA, 25 bp, Rattus norvegicus
ctagtgctcaggcaagacggccttc

SEQ ID NO: 263601 - DNA, 25 bp, Rattus norvegicus
ctagtgctcagggaagacggccttc

SEQ ID NO: 263602 - DNA, 25 bp, Rattus norvegicus
ctagtgctttctctccattttttaa

SEQ ID NO: 263603 - DNA, 25 bp, Rattus norvegicus
ctagtgctttctgtccattttttaa

SEQ ID NO: 263604 - DNA, 25 bp, Rattus norvegicus
ctagtggaagaaacaggattggcct

SEQ ID NO: 263605 - DNA, 25 bp, Rattus norvegicus
ctagtggaagaatcaggattggcct

SEQ ID NO: 263606 - DNA, 25 bp, Rattus norvegicus
ctagtggcagccacggccaagaaga

SEQ ID NO: 263607 - DNA, 25 bp, Rattus norvegicus
ctagtggcagcctcggccaagaaga

SEQ ID NO: 263608 - DNA, 25 bp, Rattus norvegicus
ctagtggcgggcagtgggccagcag

SEQ ID NO: 263609 - DNA, 25 bp, Rattus norvegicus
ctagtggcgggctgtgggccagcag

SEQ ID NO: 263610 - DNA, 25 bp, Rattus norvegicus
ctagtggtatagatcaaacatgcta

SEQ ID NO: 263611 - DNA, 25 bp, Rattus norvegicus
ctagtggtatagttcaaacatgcta

SEQ ID NO: 263612 - DNA, 25 bp, Rattus norvegicus
ctagtggtcccactgccacagagaa

SEQ ID NO: 263613 - DNA, 25 bp, Rattus norvegicus
ctagtggtcccagtgccacagagaa

SEQ ID NO: 263614 - DNA, 25 bp, Rattus norvegicus
ctagtggtgacaagggaggcccttc

SEQ ID NO: 263615 - DNA, 25 bp, Rattus norvegicus
ctagtggtgacatgggaggcccttc

SEQ ID NO: 263616 - DNA, 25 bp, Rattus norvegicus
ctagtggtgtatacaggcctcctgg

SEQ ID NO: 263617 - DNA, 25 bp, Rattus norvegicus
ctagtggtgtattcaggcctcctgg

SEQ ID NO: 263618 - DNA, 25 bp, Rattus norvegicus
ctagtgtactgacaagagtgggcat

SEQ ID NO: 263619 - DNA, 25 bp, Rattus norvegicus
ctagtgtactgagaagagtgggcat

SEQ ID NO: 263620 - DNA, 25 bp, Rattus norvegicus
ctagtgtccaatacagtttgcagat

SEQ ID NO: 263621 - DNA, 25 bp, Rattus norvegicus
ctagtgtccaattcagtttgcagat

SEQ ID NO: 263622 - DNA, 25 bp, Rattus norvegicus
ctagtgtcccgtccgagcgctgtat

SEQ ID NO: 263623 - DNA, 25 bp, Rattus norvegicus
ctagtgtcccgtgcgagcgctgtat

SEQ ID NO: 263624 - DNA, 25 bp, Rattus norvegicus
ctagtgtggaagacagcaagagctg

SEQ ID NO: 263625 - DNA, 25 bp, Rattus norvegicus
ctagtgtggaagtcagcaagagctg

SEQ ID NO: 263626 - DNA, 25 bp, Rattus norvegicus
ctagtgtgtacaatattgggtcttt

SEQ ID NO: 263627 - DNA, 25 bp, Rattus norvegicus
ctagtgtgtacattattgggtcttt

SEQ ID NO: 263628 - DNA, 25 bp, Rattus norvegicus
ctagtgttaatcatcctgctgttgc

SEQ ID NO: 263629 - DNA, 25 bp, Rattus norvegicus
ctagtgttaatcttcctgctgttgc

SEQ ID NO: 263630 - DNA, 25 bp, Rattus norvegicus
ctagtgttacaaaaggctggtcccc

SEQ ID NO: 263631 - DNA, 25 bp, Rattus norvegicus
ctagtgttacaataggctggtcccc

SEQ ID NO: 263632 - DNA, 25 bp, Rattus norvegicus
ctagtgttatccctatctgcatatt

SEQ ID NO: 263633 - DNA, 25 bp, Rattus norvegicus
ctagtgttatccgtatctgcatatt

SEQ ID NO: 263634 - DNA, 25 bp, Rattus norvegicus
ctagttaaccatcaacatgccagtt

SEQ ID NO: 263635 - DNA, 25 bp, Rattus norvegicus
ctagttaaccatgaacatgccagtt

SEQ ID NO: 263636 - DNA, 25 bp, Rattus norvegicus
ctagttacagccatcactctttaag

SEQ ID NO: 263637 - DNA, 25 bp, Rattus norvegicus
ctagttacagccttcactctttaag

SEQ ID NO: 263638 - DNA, 25 bp, Rattus norvegicus
ctagttagtggtagtgccagggcca

SEQ ID NO: 263639 - DNA, 25 bp, Rattus norvegicus
ctagttagtggttgtgccagggcca

SEQ ID NO: 263640 - DNA, 25 bp, Rattus norvegicus
ctagttagttctcagcttgggcaat

SEQ ID NO: 263641 - DNA, 25 bp, Rattus norvegicus
ctagttagttctgagcttgggcaat

SEQ ID NO: 263642 - DNA, 25 bp, Rattus norvegicus
ctagttcaagccagatcacacattt

SEQ ID NO: 263643 - DNA, 25 bp, Rattus norvegicus
ctagttcaagcctgatcacacattt

SEQ ID NO: 263644 - DNA, 25 bp, Rattus norvegicus
ctagttcattcacagacatttgtat

SEQ ID NO: 263645 - DNA, 25 bp, Rattus norvegicus
ctagttcattcagagacatttgtat

SEQ ID NO: 263646 - DNA, 25 bp, Rattus norvegicus
ctagttccatcaaaagctgcctgtg

SEQ ID NO: 263647 - DNA, 25 bp, Rattus norvegicus
ctagttccatcataagctgcctgtg

SEQ ID NO: 263648 - DNA, 25 bp, Rattus norvegicus
ctagttccatttacacttcctgtga

SEQ ID NO: 263649 - DNA, 25 bp, Rattus norvegicus
ctagttccattttcacttcctgtga

SEQ ID NO: 263650 - DNA, 25 bp, Rattus norvegicus
ctagttcgaagcaacctaagcggta

SEQ ID NO: 263651 - DNA, 25 bp, Rattus norvegicus
ctagttcgaagctacctaagcggta

SEQ ID NO: 263652 - DNA, 25 bp, Rattus norvegicus
ctagttctccggactgtgtataaat

SEQ ID NO: 263653 - DNA, 25 bp, Rattus norvegicus
ctagttctccggtctgtgtataaat

SEQ ID NO: 263654 - DNA, 25 bp, Rattus norvegicus
ctagttctgtttcttctcttgtttt

SEQ ID NO: 263655 - DNA, 25 bp, Rattus norvegicus
ctagttctgtttgttctcttgtttt

SEQ ID NO: 263656 - DNA, 25 bp, Rattus norvegicus
ctagttcttgaacagtccttgattc

SEQ ID NO: 263657 - DNA, 25 bp, Rattus norvegicus
ctagttcttgaagagtccttgattc

SEQ ID NO: 263658 - DNA, 25 bp, Rattus norvegicus
ctagttgagctcagtgtggtctgca

SEQ ID NO: 263659 - DNA, 25 bp, Rattus norvegicus
ctagttgagctctgtgtggtctgca

SEQ ID NO: 263660 - DNA, 25 bp, Rattus norvegicus
ctagttgcagggatttggtgatttt

SEQ ID NO: 263661 - DNA, 25 bp, Rattus norvegicus
ctagttgcagggttttggtgatttt

SEQ ID NO: 263662 - DNA, 25 bp, Rattus norvegicus
ctagttgcctgtcgaggctgagcca

SEQ ID NO: 263663 - DNA, 25 bp, Rattus norvegicus
ctagttgcctgtggaggctgagcca

SEQ ID NO: 263664 - DNA, 25 bp, Rattus norvegicus
ctagttgctgaacgcgctggtccct

SEQ ID NO: 263665 - DNA, 25 bp, Rattus norvegicus
ctagttgctgaaggcgctggtccct

SEQ ID NO: 263666 - DNA, 25 bp, Rattus norvegicus
ctagttgctgttcaatcgtctgtta

SEQ ID NO: 263667 - DNA, 25 bp, Rattus norvegicus
ctagttgctgttgaatcgtctgtta

SEQ ID NO: 263668 - DNA, 25 bp, Rattus norvegicus
ctagttggacatatggcctggctca

SEQ ID NO: 263669 - DNA, 25 bp, Rattus norvegicus
ctagttggacatttggcctggctca

SEQ ID NO: 263670 - DNA, 25 bp, Rattus norvegicus
ctagttgggcatcagttagtgagac

SEQ ID NO: 263671 - DNA, 25 bp, Rattus norvegicus
ctagttgggcatgagttagtgagac

SEQ ID NO: 263672 - DNA, 25 bp, Rattus norvegicus
ctagttgtcaacagctgtcaaattt

SEQ ID NO: 263673 - DNA, 25 bp, Rattus norvegicus
ctagttgtcaactgctgtcaaattt

SEQ ID NO: 263674 - DNA, 25 bp, Rattus norvegicus
ctagttgttcccacataggacacgt

SEQ ID NO: 263675 - DNA, 25 bp, Rattus norvegicus
ctagttgttccctcataggacacgt

SEQ ID NO: 263676 - DNA, 25 bp, Rattus norvegicus
ctagtttccattcagttcctacatc

SEQ ID NO: 263677 - DNA, 25 bp, Rattus norvegicus
ctagtttccattgagttcctacatc

SEQ ID NO: 263678 - DNA, 25 bp, Rattus norvegicus
ctagtttcctctcccatgagaaggg

SEQ ID NO: 263679 - DNA, 25 bp, Rattus norvegicus
ctagtttcctctgccatgagaaggg

SEQ ID NO: 263680 - DNA, 25 bp, Rattus norvegicus
ctagtttctgaaagttttgttggca

SEQ ID NO: 263681 - DNA, 25 bp, Rattus norvegicus
ctagtttctgaatgttttgttggca

SEQ ID NO: 263682 - DNA, 25 bp, Rattus norvegicus
ctagttttccaactactgactgtga

SEQ ID NO: 263683 - DNA, 25 bp, Rattus norvegicus
ctagttttccaagtactgactgtga

SEQ ID NO: 263684 - DNA, 25 bp, Rattus norvegicus
ctagttttggtgatcttcacatcca

SEQ ID NO: 263685 - DNA, 25 bp, Rattus norvegicus
ctagttttggtgttcttcacatcca

SEQ ID NO: 263686 - DNA, 25 bp, Rattus norvegicus
ctataaacagctatcctattccttt

SEQ ID NO: 263687 - DNA, 25 bp, Rattus norvegicus
ctataaacagctttcctattccttt

SEQ ID NO: 263688 - DNA, 25 bp, Rattus norvegicus
ctataaacatccagtatgctgagct

SEQ ID NO: 263689 - DNA, 25 bp, Rattus norvegicus
ctataaacatcctgtatgctgagct

SEQ ID NO: 263690 - DNA, 25 bp, Rattus norvegicus
ctataaagctgtacccatgctgggt

SEQ ID NO: 263691 - DNA, 25 bp, Rattus norvegicus
ctataaagctgttcccatgctgggt

SEQ ID NO: 263692 - DNA, 25 bp, Rattus norvegicus
ctataaatgtgactccgtggcttac

SEQ ID NO: 263693 - DNA, 25 bp, Rattus norvegicus
ctataaatgtgagtccgtggcttac

SEQ ID NO: 263694 - DNA, 25 bp, Rattus norvegicus
ctataacaaaacacagcccatcgtc

SEQ ID NO: 263695 - DNA, 25 bp, Rattus norvegicus
ctataacaaaactcagcccatcgtc

SEQ ID NO: 263696 - DNA, 25 bp, Rattus norvegicus
ctataagactaaccgggtgctccca

SEQ ID NO: 263697 - DNA, 25 bp, Rattus norvegicus
ctataagactaagcgggtgctccca

SEQ ID NO: 263698 - DNA, 25 bp, Rattus norvegicus
ctataaggtccaatttctgtgtctg

SEQ ID NO: 263699 - DNA, 25 bp, Rattus norvegicus
ctataaggtccattttctgtgtctg

SEQ ID NO: 263700 - DNA, 25 bp, Rattus norvegicus
ctataatagagcactttcctggttt

SEQ ID NO: 263701 - DNA, 25 bp, Rattus norvegicus
ctataatagagctctttcctggttt

SEQ ID NO: 263702 - DNA, 25 bp, Rattus norvegicus
ctataatagttgagctccaggccag

SEQ ID NO: 263703 - DNA, 25 bp, Rattus norvegicus
ctataatagttgtgctccaggccag

SEQ ID NO: 263704 - DNA, 25 bp, Rattus norvegicus
ctataatcaatgctgccttggcaga

SEQ ID NO: 263705 - DNA, 25 bp, Rattus norvegicus
ctataatcaatggtgccttggcaga

SEQ ID NO: 263706 - DNA, 25 bp, Rattus norvegicus
ctataatgatgtctggtgccctttt

SEQ ID NO: 263707 - DNA, 25 bp, Rattus norvegicus
ctataatgatgtgtggtgccctttt

SEQ ID NO: 263708 - DNA, 25 bp, Rattus norvegicus
ctataatgtagtcttgttagctttt

SEQ ID NO: 263709 - DNA, 25 bp, Rattus norvegicus
ctataatgtagtgttgttagctttt

SEQ ID NO: 263710 - DNA, 25 bp, Rattus norvegicus
ctatacaatcttcgcattgcccttg

SEQ ID NO: 263711 - DNA, 25 bp, Rattus norvegicus
ctatacaatcttggcattgcccttg

SEQ ID NO: 263712 - DNA, 25 bp, Rattus norvegicus
ctatacacacttataagggttctat

SEQ ID NO: 263713 - DNA, 25 bp, Rattus norvegicus
ctatacacacttttaagggttctat

SEQ ID NO: 263714 - DNA, 25 bp, Rattus norvegicus
ctatacagagcactccattctctta

SEQ ID NO: 263715 - DNA, 25 bp, Rattus norvegicus
ctatacagagcagtccattctctta

SEQ ID NO: 263716 - DNA, 25 bp, Rattus norvegicus
ctatacagccttagttgtgcgacac

SEQ ID NO: 263717 - DNA, 25 bp, Rattus norvegicus
ctatacagcctttgttgtgcgacac

SEQ ID NO: 263718 - DNA, 25 bp, Rattus norvegicus
ctatacagttaaccccttagcaagg

SEQ ID NO: 263719 - DNA, 25 bp, Rattus norvegicus
ctatacagttaagcccttagcaagg

SEQ ID NO: 263720 - DNA, 25 bp, Rattus norvegicus
ctatacccaaagaagctgccgtttc

SEQ ID NO: 263721 - DNA, 25 bp, Rattus norvegicus
ctatacccaaagtagctgccgtttc

SEQ ID NO: 263722 - DNA, 25 bp, Rattus norvegicus
ctataccgagatctttttccagtga

SEQ ID NO: 263723 - DNA, 25 bp, Rattus norvegicus
ctataccgagatgtttttccagtga

SEQ ID NO: 263724 - DNA, 25 bp, Rattus norvegicus
ctataccggtgaagcgtgcgcccta

SEQ ID NO: 263725 - DNA, 25 bp, Rattus norvegicus
ctataccggtgatgcgtgcgcccta

SEQ ID NO: 263726 - DNA, 25 bp, Rattus norvegicus
ctatactccaatccctgttcggtat

SEQ ID NO: 263727 - DNA, 25 bp, Rattus norvegicus
ctatactccaatgcctgttcggtat

SEQ ID NO: 263728 - DNA, 25 bp, Rattus norvegicus
ctatactgactcactgctaactgaa

SEQ ID NO: 263729 - DNA, 25 bp, Rattus norvegicus
ctatactgactctctgctaactgaa

SEQ ID NO: 263730 - DNA, 25 bp, Rattus norvegicus
ctatagagctgtaaggacactggac

SEQ ID NO: 263731 - DNA, 25 bp, Rattus norvegicus
ctatagagctgttaggacactggac

SEQ ID NO: 263732 - DNA, 25 bp, Rattus norvegicus
ctatagatagagatcctggacagcc

SEQ ID NO: 263733 - DNA, 25 bp, Rattus norvegicus
ctatagatagagttcctggacagcc

SEQ ID NO: 263734 - DNA, 25 bp, Rattus norvegicus
ctatagatcttgagccccgtactat

SEQ ID NO: 263735 - DNA, 25 bp, Rattus norvegicus
ctatagatcttgtgccccgtactat

SEQ ID NO: 263736 - DNA, 25 bp, Rattus norvegicus
ctatagatgtgcacagtggcccctg

SEQ ID NO: 263737 - DNA, 25 bp, Rattus norvegicus
ctatagatgtgctcagtggcccctg

SEQ ID NO: 263738 - DNA, 25 bp, Rattus norvegicus
ctatagccccgtatcctttttgcag

SEQ ID NO: 263739 - DNA, 25 bp, Rattus norvegicus
ctatagccccgtttcctttttgcag

SEQ ID NO: 263740 - DNA, 25 bp, Rattus norvegicus
ctatagctctcacacaacacctggg

SEQ ID NO: 263741 - DNA, 25 bp, Rattus norvegicus
ctatagctctcagacaacacctggg

SEQ ID NO: 263742 - DNA, 25 bp, Rattus norvegicus
ctataggcttctcatgtgtttctgt

SEQ ID NO: 263743 - DNA, 25 bp, Rattus norvegicus
ctataggcttctgatgtgtttctgt

SEQ ID NO: 263744 - DNA, 25 bp, Rattus norvegicus
ctatagggaaagagccaggctactc

SEQ ID NO: 263745 - DNA, 25 bp, Rattus norvegicus
ctatagggaaagtgccaggctactc

SEQ ID NO: 263746 - DNA, 25 bp, Rattus norvegicus
ctataggtcgcactttgacggctat

SEQ ID NO: 263747 - DNA, 25 bp, Rattus norvegicus
ctataggtcgcagtttgacggctat

SEQ ID NO: 263748 - DNA, 25 bp, Rattus norvegicus
ctatagtactggatgaactgtatac

SEQ ID NO: 263749 - DNA, 25 bp, Rattus norvegicus
ctatagtactggttgaactgtatac

SEQ ID NO: 263750 - DNA, 25 bp, Rattus norvegicus
ctatagtggagtatcgcgacctgga

SEQ ID NO: 263751 - DNA, 25 bp, Rattus norvegicus
ctatagtggagtttcgcgacctgga

SEQ ID NO: 263752 - DNA, 25 bp, Rattus norvegicus
ctatatagcacgagcttccttagcc

SEQ ID NO: 263753 - DNA, 25 bp, Rattus norvegicus
ctatatagcacgtgcttccttagcc

SEQ ID NO: 263754 - DNA, 25 bp, Rattus norvegicus
ctatatcgaggcactcgcagccaat

SEQ ID NO: 263755 - DNA, 25 bp, Rattus norvegicus
ctatatcgaggctctcgcagccaat

SEQ ID NO: 263756 - DNA, 25 bp, Rattus norvegicus
ctatatcttagccatctcctgttaa

SEQ ID NO: 263757 - DNA, 25 bp, Rattus norvegicus
ctatatcttagcgatctcctgttaa

SEQ ID NO: 263758 - DNA, 25 bp, Rattus norvegicus
ctatatcttgacatttctttcttta

SEQ ID NO: 263759 - DNA, 25 bp, Rattus norvegicus
ctatatcttgacttttctttcttta

SEQ ID NO: 263760 - DNA, 25 bp, Rattus norvegicus
ctatatgatggaacacatgggtggt

SEQ ID NO: 263761 - DNA, 25 bp, Rattus norvegicus
ctatatgatggatcacatgggtggt

SEQ ID NO: 263762 - DNA, 25 bp, Rattus norvegicus
ctatatgctctcaggtcaccaaagg

SEQ ID NO: 263763 - DNA, 25 bp, Rattus norvegicus
ctatatgctctctggtcaccaaagg

SEQ ID NO: 263764 - DNA, 25 bp, Rattus norvegicus
ctatatgctgtcagatgttctccca

SEQ ID NO: 263765 - DNA, 25 bp, Rattus norvegicus
ctatatgctgtctgatgttctccca

SEQ ID NO: 263766 - DNA, 25 bp, Rattus norvegicus
ctatatgcttcaatctgacttcctg

SEQ ID NO: 263767 - DNA, 25 bp, Rattus norvegicus
ctatatgcttcattctgacttcctg

SEQ ID NO: 263768 - DNA, 25 bp, Rattus norvegicus
ctatatgtatttcggacagggcctt

SEQ ID NO: 263769 - DNA, 25 bp, Rattus norvegicus
ctatatgtatttgggacagggcctt

SEQ ID NO: 263770 - DNA, 25 bp, Rattus norvegicus
ctatattcagttcatctagtcagca

SEQ ID NO: 263771 - DNA, 25 bp, Rattus norvegicus
ctatattcagttgatctagtcagca

SEQ ID NO: 263772 - DNA, 25 bp, Rattus norvegicus
ctatattctgctattctagctgttt

SEQ ID NO: 263773 - DNA, 25 bp, Rattus norvegicus
ctatattctgcttttctagctgttt

SEQ ID NO: 263774 - DNA, 25 bp, Rattus norvegicus
ctatattgatggacaggtgctggta

SEQ ID NO: 263775 - DNA, 25 bp, Rattus norvegicus
ctatattgatggtcaggtgctggta

SEQ ID NO: 263776 - DNA, 25 bp, Rattus norvegicus
ctatatttactgactgccggaatga

SEQ ID NO: 263777 - DNA, 25 bp, Rattus norvegicus
ctatatttactgtctgccggaatga

SEQ ID NO: 263778 - DNA, 25 bp, Rattus norvegicus
ctatatttgaggatgtctacgacta

SEQ ID NO: 263779 - DNA, 25 bp, Rattus norvegicus
ctatatttgaggttgtctacgacta

SEQ ID NO: 263780 - DNA, 25 bp, Rattus norvegicus
ctatcaaagcgcaagccagccaggg

SEQ ID NO: 263781 - DNA, 25 bp, Rattus norvegicus
ctatcaaagcgctagccagccaggg

SEQ ID NO: 263782 - DNA, 25 bp, Rattus norvegicus
ctatcaaatcagaggccgtggaggt

SEQ ID NO: 263783 - DNA, 25 bp, Rattus norvegicus
ctatcaaatcagtggccgtggaggt

SEQ ID NO: 263784 - DNA, 25 bp, Rattus norvegicus
ctatcaactcagctctttacagaag

SEQ ID NO: 263785 - DNA, 25 bp, Rattus norvegicus
ctatcaactcaggtctttacagaag

SEQ ID NO: 263786 - DNA, 25 bp, Rattus norvegicus
ctatcaactgtcatgcctttttcat

SEQ ID NO: 263787 - DNA, 25 bp, Rattus norvegicus
ctatcaactgtcttgcctttttcat

SEQ ID NO: 263788 - DNA, 25 bp, Rattus norvegicus
ctatcaaggattacttagccccaag

SEQ ID NO: 263789 - DNA, 25 bp, Rattus norvegicus
ctatcaaggatttcttagccccaag

SEQ ID NO: 263790 - DNA, 25 bp, Rattus norvegicus
ctatcaatatgaccccactgttact

SEQ ID NO: 263791 - DNA, 25 bp, Rattus norvegicus
ctatcaatatgagcccactgttact

SEQ ID NO: 263792 - DNA, 25 bp, Rattus norvegicus
ctatcaccaagtcttgacctagcac

SEQ ID NO: 263793 - DNA, 25 bp, Rattus norvegicus
ctatcaccaagtgttgacctagcac

SEQ ID NO: 263794 - DNA, 25 bp, Rattus norvegicus
ctatcaccacctcgcaagttattca

SEQ ID NO: 263795 - DNA, 25 bp, Rattus norvegicus
ctatcaccacctggcaagttattca

SEQ ID NO: 263796 - DNA, 25 bp, Rattus norvegicus
ctatcacccgtgaaagttggcattt

SEQ ID NO: 263797 - DNA, 25 bp, Rattus norvegicus
ctatcacccgtgtaagttggcattt

SEQ ID NO: 263798 - DNA, 25 bp, Rattus norvegicus
ctatcaccctctaatgttctgacat

SEQ ID NO: 263799 - DNA, 25 bp, Rattus norvegicus
ctatcaccctcttatgttctgacat

SEQ ID NO: 263800 - DNA, 25 bp, Rattus norvegicus
ctatcacgaaccactcttttctata

SEQ ID NO: 263801 - DNA, 25 bp, Rattus norvegicus
ctatcacgaacctctcttttctata

SEQ ID NO: 263802 - DNA, 25 bp, Rattus norvegicus
ctatcactaagcctgaagggcctat

SEQ ID NO: 263803 - DNA, 25 bp, Rattus norvegicus
ctatcactaagcgtgaagggcctat

SEQ ID NO: 263804 - DNA, 25 bp, Rattus norvegicus
ctatcagagtccattgttgcgcttg

SEQ ID NO: 263805 - DNA, 25 bp, Rattus norvegicus
ctatcagagtcctttgttgcgcttg

SEQ ID NO: 263806 - DNA, 25 bp, Rattus norvegicus
ctatcagatacaaggctctgggttt

SEQ ID NO: 263807 - DNA, 25 bp, Rattus norvegicus
ctatcagatacatggctctgggttt

SEQ ID NO: 263808 - DNA, 25 bp, Rattus norvegicus
ctatcagatcgcaagtacgagttag

SEQ ID NO: 263809 - DNA, 25 bp, Rattus norvegicus
ctatcagatcgctagtacgagttag

SEQ ID NO: 263810 - DNA, 25 bp, Rattus norvegicus
ctatcagccctcactagcaaacaaa

SEQ ID NO: 263811 - DNA, 25 bp, Rattus norvegicus
ctatcagccctctctagcaaacaaa

SEQ ID NO: 263812 - DNA, 25 bp, Rattus norvegicus
ctatcagctctgcaatcactggtga

SEQ ID NO: 263813 - DNA, 25 bp, Rattus norvegicus
ctatcagctctggaatcactggtga

SEQ ID NO: 263814 - DNA, 25 bp, Rattus norvegicus
ctatcagggtctattggtgtctaca

SEQ ID NO: 263815 - DNA, 25 bp, Rattus norvegicus
ctatcagggtcttttggtgtctaca

SEQ ID NO: 263816 - DNA, 25 bp, Rattus norvegicus
ctatcagtagatataggtacgagct

SEQ ID NO: 263817 - DNA, 25 bp, Rattus norvegicus
ctatcagtagatttaggtacgagct

SEQ ID NO: 263818 - DNA, 25 bp, Rattus norvegicus
ctatcagtctgaacgttgtggcaac

SEQ ID NO: 263819 - DNA, 25 bp, Rattus norvegicus
ctatcagtctgatcgttgtggcaac

SEQ ID NO: 263820 - DNA, 25 bp, Rattus norvegicus
ctatcagttctcatgtaatggccct

SEQ ID NO: 263821 - DNA, 25 bp, Rattus norvegicus
ctatcagttctcttgtaatggccct

SEQ ID NO: 263822 - DNA, 25 bp, Rattus norvegicus
ctatcataatatccccttttcttgc

SEQ ID NO: 263823 - DNA, 25 bp, Rattus norvegicus
ctatcataatatgcccttttcttgc

SEQ ID NO: 263824 - DNA, 25 bp, Rattus norvegicus
ctatcatccacacagttcacagcat

SEQ ID NO: 263825 - DNA, 25 bp, Rattus norvegicus
ctatcatccacagagttcacagcat

SEQ ID NO: 263826 - DNA, 25 bp, Rattus norvegicus
ctatcatgccttatactgccatggg

SEQ ID NO: 263827 - DNA, 25 bp, Rattus norvegicus
ctatcatgccttttactgccatggg

SEQ ID NO: 263828 - DNA, 25 bp, Rattus norvegicus
ctatcattggtgaaagttccggaat

SEQ ID NO: 263829 - DNA, 25 bp, Rattus norvegicus
ctatcattggtgtaagttccggaat

SEQ ID NO: 263830 - DNA, 25 bp, Rattus norvegicus
ctatccaatattatgcagcatcctt

SEQ ID NO: 263831 - DNA, 25 bp, Rattus norvegicus
ctatccaatattttgcagcatcctt

SEQ ID NO: 263832 - DNA, 25 bp, Rattus norvegicus
ctatccacatcactcatctttcagt

SEQ ID NO: 263833 - DNA, 25 bp, Rattus norvegicus
ctatccacatcagtcatctttcagt

SEQ ID NO: 263834 - DNA, 25 bp, Rattus norvegicus
ctatccaccctaatcagtctttgaa

SEQ ID NO: 263835 - DNA, 25 bp, Rattus norvegicus
ctatccaccctattcagtctttgaa

SEQ ID NO: 263836 - DNA, 25 bp, Rattus norvegicus
ctatccaccgacaccaacatggaaa

SEQ ID NO: 263837 - DNA, 25 bp, Rattus norvegicus
ctatccaccgactccaacatggaaa

SEQ ID NO: 263838 - DNA, 25 bp, Rattus norvegicus
ctatccatatacattcctgtcacaa

SEQ ID NO: 263839 - DNA, 25 bp, Rattus norvegicus
ctatccatatactttcctgtcacaa

SEQ ID NO: 263840 - DNA, 25 bp, Rattus norvegicus
ctatccatccccagcaaagaaacta

SEQ ID NO: 263841 - DNA, 25 bp, Rattus norvegicus
ctatccatcccctgcaaagaaacta

SEQ ID NO: 263842 - DNA, 25 bp, Rattus norvegicus
ctatcccaccttctagcatattcta

SEQ ID NO: 263843 - DNA, 25 bp, Rattus norvegicus
ctatcccaccttgtagcatattcta

SEQ ID NO: 263844 - DNA, 25 bp, Rattus norvegicus
ctatcccactaaatatgaggtaaga

SEQ ID NO: 263845 - DNA, 25 bp, Rattus norvegicus
ctatcccactaattatgaggtaaga

SEQ ID NO: 263846 - DNA, 25 bp, Rattus norvegicus
ctatcccagggaactgaattccagg

SEQ ID NO: 263847 - DNA, 25 bp, Rattus norvegicus
ctatcccagggatctgaattccagg

SEQ ID NO: 263848 - DNA, 25 bp, Rattus norvegicus
ctatcccagggcagagcccggcagg

SEQ ID NO: 263849 - DNA, 25 bp, Rattus norvegicus
ctatcccagggctgagcccggcagg

SEQ ID NO: 263850 - DNA, 25 bp, Rattus norvegicus
ctatcccagtgcattggctttttat

SEQ ID NO: 263851 - DNA, 25 bp, Rattus norvegicus
ctatcccagtgctttggctttttat

SEQ ID NO: 263852 - DNA, 25 bp, Rattus norvegicus
ctatcccattatcgagagcatttga

SEQ ID NO: 263853 - DNA, 25 bp, Rattus norvegicus
ctatcccattatggagagcatttga

SEQ ID NO: 263854 - DNA, 25 bp, Rattus norvegicus
ctatccccagtcagtgtttggaggt

SEQ ID NO: 263855 - DNA, 25 bp, Rattus norvegicus
ctatccccagtctgtgtttggaggt

SEQ ID NO: 263856 - DNA, 25 bp, Rattus norvegicus
ctatccccgtatctcgagaggttga

SEQ ID NO: 263857 - DNA, 25 bp, Rattus norvegicus
ctatccccgtatgtcgagaggttga

SEQ ID NO: 263858 - DNA, 25 bp, Rattus norvegicus
ctatccctcacccaaaagcaaaaag

SEQ ID NO: 263859 - DNA, 25 bp, Rattus norvegicus
ctatccctcaccgaaaagcaaaaag

SEQ ID NO: 263860 - DNA, 25 bp, Rattus norvegicus
ctatccctgggaccttcatgagaga

SEQ ID NO: 263861 - DNA, 25 bp, Rattus norvegicus
ctatccctgggagcttcatgagaga

SEQ ID NO: 263862 - DNA, 25 bp, Rattus norvegicus
ctatccgatatcctgcaaatccgat

SEQ ID NO: 263863 - DNA, 25 bp, Rattus norvegicus
ctatccgatatcgtgcaaatccgat

SEQ ID NO: 263864 - DNA, 25 bp, Rattus norvegicus
ctatccgccctgaggttaaattggt

SEQ ID NO: 263865 - DNA, 25 bp, Rattus norvegicus
ctatccgccctgtggttaaattggt

SEQ ID NO: 263866 - DNA, 25 bp, Rattus norvegicus
ctatccgctggacattgtgtttgga

SEQ ID NO: 263867 - DNA, 25 bp, Rattus norvegicus
ctatccgctggagattgtgtttgga

SEQ ID NO: 263868 - DNA, 25 bp, Rattus norvegicus
ctatcctgtcctagctgtatgtaaa

SEQ ID NO: 263869 - DNA, 25 bp, Rattus norvegicus
ctatcctgtccttgctgtatgtaaa

SEQ ID NO: 263870 - DNA, 25 bp, Rattus norvegicus
ctatccttacggagtgtgcttattc

SEQ ID NO: 263871 - DNA, 25 bp, Rattus norvegicus
ctatccttacggtgtgtgcttattc

SEQ ID NO: 263872 - DNA, 25 bp, Rattus norvegicus
ctatccttagctcgcaggtgccata

SEQ ID NO: 263873 - DNA, 25 bp, Rattus norvegicus
ctatccttagctggcaggtgccata

SEQ ID NO: 263874 - DNA, 25 bp, Rattus norvegicus
ctatccttatttctaccctggtttg

SEQ ID NO: 263875 - DNA, 25 bp, Rattus norvegicus
ctatccttatttgtaccctggtttg

SEQ ID NO: 263876 - DNA, 25 bp, Rattus norvegicus
ctatccttccgcatcaattaattgt

SEQ ID NO: 263877 - DNA, 25 bp, Rattus norvegicus
ctatccttccgcttcaattaattgt

SEQ ID NO: 263878 - DNA, 25 bp, Rattus norvegicus
ctatcctttctgaagaggtcttgga

SEQ ID NO: 263879 - DNA, 25 bp, Rattus norvegicus
ctatcctttctgtagaggtcttgga

SEQ ID NO: 263880 - DNA, 25 bp, Rattus norvegicus
ctatcctttggcagtgtacacacgt

SEQ ID NO: 263881 - DNA, 25 bp, Rattus norvegicus
ctatcctttggctgtgtacacacgt

SEQ ID NO: 263882 - DNA, 25 bp, Rattus norvegicus
ctatcgagccacatcgatttgtgga

SEQ ID NO: 263883 - DNA, 25 bp, Rattus norvegicus
ctatcgagccacttcgatttgtgga

SEQ ID NO: 263884 - DNA, 25 bp, Rattus norvegicus
ctatcgatctgccatggtttctatt

SEQ ID NO: 263885 - DNA, 25 bp, Rattus norvegicus
ctatcgatctgcgatggtttctatt

SEQ ID NO: 263886 - DNA, 25 bp, Rattus norvegicus
ctatcgcactccacacagatttaag

SEQ ID NO: 263887 - DNA, 25 bp, Rattus norvegicus
ctatcgcactcctcacagatttaag

SEQ ID NO: 263888 - DNA, 25 bp, Rattus norvegicus
ctatcggaagctcgcgctcaagtac

SEQ ID NO: 263889 - DNA, 25 bp, Rattus norvegicus
ctatcggaagctggcgctcaagtac

SEQ ID NO: 263890 - DNA, 25 bp, Rattus norvegicus
ctatcggatcgtagctgggagtcat

SEQ ID NO: 263891 - DNA, 25 bp, Rattus norvegicus
ctatcggatcgttgctgggagtcat

SEQ ID NO: 263892 - DNA, 25 bp, Rattus norvegicus
ctatcgtaacccaacaactgctgta

SEQ ID NO: 263893 - DNA, 25 bp, Rattus norvegicus
ctatcgtaaccctacaactgctgta

SEQ ID NO: 263894 - DNA, 25 bp, Rattus norvegicus
ctatctaacgtgagtatggtgtcta

SEQ ID NO: 263895 - DNA, 25 bp, Rattus norvegicus
ctatctaacgtgtgtatggtgtcta

SEQ ID NO: 263896 - DNA, 25 bp, Rattus norvegicus
ctatctaatgctacgtttggtcttg

SEQ ID NO: 263897 - DNA, 25 bp, Rattus norvegicus
ctatctaatgcttcgtttggtcttg

SEQ ID NO: 263898 - DNA, 25 bp, Rattus norvegicus
ctatctataactacagctgtaggtt

SEQ ID NO: 263899 - DNA, 25 bp, Rattus norvegicus
ctatctataacttcagctgtaggtt

SEQ ID NO: 263900 - DNA, 25 bp, Rattus norvegicus
ctatctatcctgatttgaatcccac

SEQ ID NO: 263901 - DNA, 25 bp, Rattus norvegicus
ctatctatcctgttttgaatcccac

SEQ ID NO: 263902 - DNA, 25 bp, Rattus norvegicus
ctatctcatcccatctgtttttaga

SEQ ID NO: 263903 - DNA, 25 bp, Rattus norvegicus
ctatctcatcccttctgtttttaga

SEQ ID NO: 263904 - DNA, 25 bp, Rattus norvegicus
ctatctccatttatacctcacagag

SEQ ID NO: 263905 - DNA, 25 bp, Rattus norvegicus
ctatctccatttttacctcacagag

SEQ ID NO: 263906 - DNA, 25 bp, Rattus norvegicus
ctatctccccaactaggtggtatta

SEQ ID NO: 263907 - DNA, 25 bp, Rattus norvegicus
ctatctccccaagtaggtggtatta

SEQ ID NO: 263908 - DNA, 25 bp, Rattus norvegicus
ctatctctaccaaaccatcatgtta

SEQ ID NO: 263909 - DNA, 25 bp, Rattus norvegicus
ctatctctaccataccatcatgtta

SEQ ID NO: 263910 - DNA, 25 bp, Rattus norvegicus
ctatctctcttcaaacattttacaa

SEQ ID NO: 263911 - DNA, 25 bp, Rattus norvegicus
ctatctctcttctaacattttacaa

SEQ ID NO: 263912 - DNA, 25 bp, Rattus norvegicus
ctatctctggatagtggctggctta

SEQ ID NO: 263913 - DNA, 25 bp, Rattus norvegicus
ctatctctggattgtggctggctta

SEQ ID NO: 263914 - DNA, 25 bp, Rattus norvegicus
ctatctcttgggattatttcttctg

SEQ ID NO: 263915 - DNA, 25 bp, Rattus norvegicus
ctatctcttgggtttatttcttctg

SEQ ID NO: 263916 - DNA, 25 bp, Rattus norvegicus
ctatctgacaacactatttctggaa

SEQ ID NO: 263917 - DNA, 25 bp, Rattus norvegicus
ctatctgacaactctatttctggaa

SEQ ID NO: 263918 - DNA, 25 bp, Rattus norvegicus
ctatctgacagaccttgaaatgaag

SEQ ID NO: 263919 - DNA, 25 bp, Rattus norvegicus
ctatctgacagagcttgaaatgaag

SEQ ID NO: 263920 - DNA, 25 bp, Rattus norvegicus
ctatctgcagatcgcgcacagctat

SEQ ID NO: 263921 - DNA, 25 bp, Rattus norvegicus
ctatctgcagatggcgcacagctat

SEQ ID NO: 263922 - DNA, 25 bp, Rattus norvegicus
ctatctgcatctatggacactccaa

SEQ ID NO: 263923 - DNA, 25 bp, Rattus norvegicus
ctatctgcatctttggacactccaa

SEQ ID NO: 263924 - DNA, 25 bp, Rattus norvegicus
ctatctggatttacttctgtcttga

SEQ ID NO: 263925 - DNA, 25 bp, Rattus norvegicus
ctatctggattttcttctgtcttga

SEQ ID NO: 263926 - DNA, 25 bp, Rattus norvegicus
ctatctgggctacaaaggaaactca

SEQ ID NO: 263927 - DNA, 25 bp, Rattus norvegicus
ctatctgggctagaaaggaaactca

SEQ ID NO: 263928 - DNA, 25 bp, Rattus norvegicus
ctatctgggcttcatgaggcttgtg

SEQ ID NO: 263929 - DNA, 25 bp, Rattus norvegicus
ctatctgggcttgatgaggcttgtg

SEQ ID NO: 263930 - DNA, 25 bp, Rattus norvegicus
ctatctgggtctactctgtgagcga

SEQ ID NO: 263931 - DNA, 25 bp, Rattus norvegicus
ctatctgggtcttctctgtgagcga

SEQ ID NO: 263932 - DNA, 25 bp, Rattus norvegicus
ctatctgggtgtagatgacgctgct

SEQ ID NO: 263933 - DNA, 25 bp, Rattus norvegicus
ctatctgggtgttgatgacgctgct

SEQ ID NO: 263934 - DNA, 25 bp, Rattus norvegicus
ctatctggtttgagtggtgctggca

SEQ ID NO: 263935 - DNA, 25 bp, Rattus norvegicus
ctatctggtttgtgtggtgctggca

SEQ ID NO: 263936 - DNA, 25 bp, Rattus norvegicus
ctatctgtagtgaacctgacttgag

SEQ ID NO: 263937 - DNA, 25 bp, Rattus norvegicus
ctatctgtagtgtacctgacttgag

SEQ ID NO: 263938 - DNA, 25 bp, Rattus norvegicus
ctatctgtgtccattctacatttgg

SEQ ID NO: 263939 - DNA, 25 bp, Rattus norvegicus
ctatctgtgtcctttctacatttgg

SEQ ID NO: 263940 - DNA, 25 bp, Rattus norvegicus
ctatcttattccaggctcatttcat

SEQ ID NO: 263941 - DNA, 25 bp, Rattus norvegicus
ctatcttattcctggctcatttcat

SEQ ID NO: 263942 - DNA, 25 bp, Rattus norvegicus
ctatcttatttcagtacttcggcaa

SEQ ID NO: 263943 - DNA, 25 bp, Rattus norvegicus
ctatcttatttctgtacttcggcaa

SEQ ID NO: 263944 - DNA, 25 bp, Rattus norvegicus
ctatcttccccacaattcctaatgt

SEQ ID NO: 263945 - DNA, 25 bp, Rattus norvegicus
ctatcttccccagaattcctaatgt

SEQ ID NO: 263946 - DNA, 25 bp, Rattus norvegicus
ctatcttccttaaccccacaatgaa

SEQ ID NO: 263947 - DNA, 25 bp, Rattus norvegicus
ctatcttccttatccccacaatgaa

SEQ ID NO: 263948 - DNA, 25 bp, Rattus norvegicus
ctatcttcgtgaatcaggtgcttga

SEQ ID NO: 263949 - DNA, 25 bp, Rattus norvegicus
ctatcttcgtgattcaggtgcttga

SEQ ID NO: 263950 - DNA, 25 bp, Rattus norvegicus
ctatcttgagttaccactgctcctg

SEQ ID NO: 263951 - DNA, 25 bp, Rattus norvegicus
ctatcttgagtttccactgctcctg

SEQ ID NO: 263952 - DNA, 25 bp, Rattus norvegicus
ctatcttgccttatgtttttctgaa

SEQ ID NO: 263953 - DNA, 25 bp, Rattus norvegicus
ctatcttgccttttgtttttctgaa

SEQ ID NO: 263954 - DNA, 25 bp, Rattus norvegicus
ctatcttggaagctatttggatcaa

SEQ ID NO: 263955 - DNA, 25 bp, Rattus norvegicus
ctatcttggaaggtatttggatcaa

SEQ ID NO: 263956 - DNA, 25 bp, Rattus norvegicus
ctatcttggccaaggtggtgcacac

SEQ ID NO: 263957 - DNA, 25 bp, Rattus norvegicus
ctatcttggccatggtggtgcacac

SEQ ID NO: 263958 - DNA, 25 bp, Rattus norvegicus
ctatcttgtgtaacctttcagagca

SEQ ID NO: 263959 - DNA, 25 bp, Rattus norvegicus
ctatcttgtgtatcctttcagagca

SEQ ID NO: 263960 - DNA, 25 bp, Rattus norvegicus
ctatctttatgaaattttggacagg

SEQ ID NO: 263961 - DNA, 25 bp, Rattus norvegicus
ctatctttatgatattttggacagg

SEQ ID NO: 263962 - DNA, 25 bp, Rattus norvegicus
ctatctttccgtctgctgtatgctg

SEQ ID NO: 263963 - DNA, 25 bp, Rattus norvegicus
ctatctttccgtgtgctgtatgctg

SEQ ID NO: 263964 - DNA, 25 bp, Rattus norvegicus
ctatctttgggcagtctgggtactt

SEQ ID NO: 263965 - DNA, 25 bp, Rattus norvegicus
ctatctttgggctgtctgggtactt

SEQ ID NO: 263966 - DNA, 25 bp, Rattus norvegicus
ctatgaaaaatacttgagctgtgct

SEQ ID NO: 263967 - DNA, 25 bp, Rattus norvegicus
ctatgaaaaatagttgagctgtgct

SEQ ID NO: 263968 - DNA, 25 bp, Rattus norvegicus
ctatgaaagtaaccagccagccctg

SEQ ID NO: 263969 - DNA, 25 bp, Rattus norvegicus
ctatgaaagtaagcagccagccctg

SEQ ID NO: 263970 - DNA, 25 bp, Rattus norvegicus
ctatgaaatcgcccttcttgaagac

SEQ ID NO: 263971 - DNA, 25 bp, Rattus norvegicus
ctatgaaatcgcgcttcttgaagac

SEQ ID NO: 263972 - DNA, 25 bp, Rattus norvegicus
ctatgaaccagccacaagacttgag

SEQ ID NO: 263973 - DNA, 25 bp, Rattus norvegicus
ctatgaaccagcgacaagacttgag

SEQ ID NO: 263974 - DNA, 25 bp, Rattus norvegicus
ctatgaatgtggcttctctgtgtag

SEQ ID NO: 263975 - DNA, 25 bp, Rattus norvegicus
ctatgaatgtgggttctctgtgtag

SEQ ID NO: 263976 - DNA, 25 bp, Rattus norvegicus
ctatgacagacaatcacggtttaat

SEQ ID NO: 263977 - DNA, 25 bp, Rattus norvegicus
ctatgacagacattcacggtttaat

SEQ ID NO: 263978 - DNA, 25 bp, Rattus norvegicus
ctatgacagcagatggagacgccca

SEQ ID NO: 263979 - DNA, 25 bp, Rattus norvegicus
ctatgacagcagctaggtcgcagtt

SEQ ID NO: 263980 - DNA, 25 bp, Rattus norvegicus
ctatgacagcaggtaggtcgcagtt

SEQ ID NO: 263981 - DNA, 25 bp, Rattus norvegicus
ctatgacagcagttggagacgccca

SEQ ID NO: 263982 - DNA, 25 bp, Rattus norvegicus
ctatgacatagaagactcctgccct

SEQ ID NO: 263983 - DNA, 25 bp, Rattus norvegicus
ctatgacatagatgactcctgccct

SEQ ID NO: 263984 - DNA, 25 bp, Rattus norvegicus
ctatgacatcatcgccagcatctat

SEQ ID NO: 263985 - DNA, 25 bp, Rattus norvegicus
ctatgacatcatggccagcatctat

SEQ ID NO: 263986 - DNA, 25 bp, Rattus norvegicus
ctatgacatgggagtgctctgctga

SEQ ID NO: 263987 - DNA, 25 bp, Rattus norvegicus
ctatgacatgggtgtgctctgctga

SEQ ID NO: 263988 - DNA, 25 bp, Rattus norvegicus
ctatgaccaacaccctgtcttataa

SEQ ID NO: 263989 - DNA, 25 bp, Rattus norvegicus
ctatgaccaacagcctgtcttataa

SEQ ID NO: 263990 - DNA, 25 bp, Rattus norvegicus
ctatgaccaatgaaagctgccatgt

SEQ ID NO: 263991 - DNA, 25 bp, Rattus norvegicus
ctatgaccaatgtaagctgccatgt

SEQ ID NO: 263992 - DNA, 25 bp, Rattus norvegicus
ctatgaccattcaccgcatgataac

SEQ ID NO: 263993 - DNA, 25 bp, Rattus norvegicus
ctatgaccattctccgcatgataac

SEQ ID NO: 263994 - DNA, 25 bp, Rattus norvegicus
ctatgacgactgaaggcacggcggt

SEQ ID NO: 263995 - DNA, 25 bp, Rattus norvegicus
ctatgacgactgtaggcacggcggt

SEQ ID NO: 263996 - DNA, 25 bp, Rattus norvegicus
ctatgactgtatattctgattcgga

SEQ ID NO: 263997 - DNA, 25 bp, Rattus norvegicus
ctatgactgtattttctgattcgga

SEQ ID NO: 263998 - DNA, 25 bp, Rattus norvegicus
ctatgacttaccaaatctgcctatc

SEQ ID NO: 263999 - DNA, 25 bp, Rattus norvegicus
ctatgacttacctaatctgcctatc

SEQ ID NO: 264000 - DNA, 25 bp, Rattus norvegicus
ctatgagctcataaccttgggactt

SEQ ID NO: 264001 - DNA, 25 bp, Rattus norvegicus
ctatgagctcattaccttgggactt

SEQ ID NO: 264002 - DNA, 25 bp, Rattus norvegicus
ctatgagtatatcgcaagttggaga

SEQ ID NO: 264003 - DNA, 25 bp, Rattus norvegicus
ctatgagtatatggcaagttggaga

SEQ ID NO: 264004 - DNA, 25 bp, Rattus norvegicus
ctatgatctcatacagaagtggaat

SEQ ID NO: 264005 - DNA, 25 bp, Rattus norvegicus
ctatgatctcattcagaagtggaat

SEQ ID NO: 264006 - DNA, 25 bp, Rattus norvegicus
ctatgatctccaaaggcccttcaag

SEQ ID NO: 264007 - DNA, 25 bp, Rattus norvegicus
ctatgatctccataggcccttcaag

SEQ ID NO: 264008 - DNA, 25 bp, Rattus norvegicus
ctatgatgctaacattgtcgccgtg

SEQ ID NO: 264009 - DNA, 25 bp, Rattus norvegicus
ctatgatgctaagattgtcgccgtg

SEQ ID NO: 264010 - DNA, 25 bp, Rattus norvegicus
ctatgatggctgatgatccctcgga

SEQ ID NO: 264011 - DNA, 25 bp, Rattus norvegicus
ctatgatggctgttgatccctcgga

SEQ ID NO: 264012 - DNA, 25 bp, Rattus norvegicus
ctatgatgtttgatctgttgtcctt

SEQ ID NO: 264013 - DNA, 25 bp, Rattus norvegicus
ctatgatgtttgttctgttgtcctt

SEQ ID NO: 264014 - DNA, 25 bp, Rattus norvegicus
ctatgattgcggatcctttgtggga

SEQ ID NO: 264015 - DNA, 25 bp, Rattus norvegicus
ctatgattgcggttcctttgtggga

SEQ ID NO: 264016 - DNA, 25 bp, Rattus norvegicus
ctatgatttctgcttgagtctacct

SEQ ID NO: 264017 - DNA, 25 bp, Rattus norvegicus
ctatgatttctggttgagtctacct

SEQ ID NO: 264018 - DNA, 25 bp, Rattus norvegicus
ctatgattttgtatcctgggcagca

SEQ ID NO: 264019 - DNA, 25 bp, Rattus norvegicus
ctatgattttgtttcctgggcagca

SEQ ID NO: 264020 - DNA, 25 bp, Rattus norvegicus
ctatgcaagcgccaggaccagagtt

SEQ ID NO: 264021 - DNA, 25 bp, Rattus norvegicus
ctatgcaagcgcgaggaccagagtt

SEQ ID NO: 264022 - DNA, 25 bp, Rattus norvegicus
ctatgcagaggaacctgacctgtac

SEQ ID NO: 264023 - DNA, 25 bp, Rattus norvegicus
ctatgcagaggatcctgacctgtac

SEQ ID NO: 264024 - DNA, 25 bp, Rattus norvegicus
ctatgcagctgtagatgatcctcct

SEQ ID NO: 264025 - DNA, 25 bp, Rattus norvegicus
ctatgcagctgttgatgatcctcct

SEQ ID NO: 264026 - DNA, 25 bp, Rattus norvegicus
ctatgcaggagtaccagggcaatct

SEQ ID NO: 264027 - DNA, 25 bp, Rattus norvegicus
ctatgcaggagttccagggcaatct

SEQ ID NO: 264028 - DNA, 25 bp, Rattus norvegicus
ctatgcatccgtagctgtgtgagca

SEQ ID NO: 264029 - DNA, 25 bp, Rattus norvegicus
ctatgcatccgttgctgtgtgagca

SEQ ID NO: 264030 - DNA, 25 bp, Rattus norvegicus
ctatgcatctggcactatgatggtt

SEQ ID NO: 264031 - DNA, 25 bp, Rattus norvegicus
ctatgcatctgggactatgatggtt

SEQ ID NO: 264032 - DNA, 25 bp, Rattus norvegicus
ctatgcatggttctttcccctgttt

SEQ ID NO: 264033 - DNA, 25 bp, Rattus norvegicus
ctatgcatggttgtttcccctgttt

SEQ ID NO: 264034 - DNA, 25 bp, Rattus norvegicus
ctatgcattcatacagctttttaat

SEQ ID NO: 264035 - DNA, 25 bp, Rattus norvegicus
ctatgcattcattcagctttttaat

SEQ ID NO: 264036 - DNA, 25 bp, Rattus norvegicus
ctatgcattggtctccacacaaaca

SEQ ID NO: 264037 - DNA, 25 bp, Rattus norvegicus
ctatgcattggtgtccacacaaaca

SEQ ID NO: 264038 - DNA, 25 bp, Rattus norvegicus
ctatgcattgttcatgtcccatcgg

SEQ ID NO: 264039 - DNA, 25 bp, Rattus norvegicus
ctatgcattgttgatgtcccatcgg

SEQ ID NO: 264040 - DNA, 25 bp, Rattus norvegicus
ctatgcatttacagtgttctataac

SEQ ID NO: 264041 - DNA, 25 bp, Rattus norvegicus
ctatgcatttactgtgttctataac

SEQ ID NO: 264042 - DNA, 25 bp, Rattus norvegicus
ctatgccacggcagataaacaaact

SEQ ID NO: 264043 - DNA, 25 bp, Rattus norvegicus
ctatgccacggctgataaacaaact

SEQ ID NO: 264044 - DNA, 25 bp, Rattus norvegicus
ctatgccatgctagggatgtttgaa

SEQ ID NO: 264045 - DNA, 25 bp, Rattus norvegicus
ctatgccatgcttgggatgtttgaa

SEQ ID NO: 264046 - DNA, 25 bp, Rattus norvegicus
ctatgcccactaagtgtgcacagac

SEQ ID NO: 264047 - DNA, 25 bp, Rattus norvegicus
ctatgcccactatgtgtgcacagac

SEQ ID NO: 264048 - DNA, 25 bp, Rattus norvegicus
ctatgcccaggtacagatgtctaat

SEQ ID NO: 264049 - DNA, 25 bp, Rattus norvegicus
ctatgcccaggttcagatgtctaat

SEQ ID NO: 264050 - DNA, 25 bp, Rattus norvegicus
ctatgccccaggaaggtgggtgcta

SEQ ID NO: 264051 - DNA, 25 bp, Rattus norvegicus
ctatgccccaggtaggtgggtgcta

SEQ ID NO: 264052 - DNA, 25 bp, Rattus norvegicus
ctatgcccgtggaatttaaagaatt

SEQ ID NO: 264053 - DNA, 25 bp, Rattus norvegicus
ctatgcccgtggtatttaaagaatt

SEQ ID NO: 264054 - DNA, 25 bp, Rattus norvegicus
ctatgccctctgaaagtggaactat

SEQ ID NO: 264055 - DNA, 25 bp, Rattus norvegicus
ctatgccctctgtaagtggaactat

SEQ ID NO: 264056 - DNA, 25 bp, Rattus norvegicus
ctatgccctgttcttaacaggaggt

SEQ ID NO: 264057 - DNA, 25 bp, Rattus norvegicus
ctatgccctgttgttaacaggaggt

SEQ ID NO: 264058 - DNA, 25 bp, Rattus norvegicus
ctatgcccttggaatcagtgtgctc

SEQ ID NO: 264059 - DNA, 25 bp, Rattus norvegicus
ctatgcccttggtatcagtgtgctc

SEQ ID NO: 264060 - DNA, 25 bp, Rattus norvegicus
ctatgccgatagagtacacctgtat

SEQ ID NO: 264061 - DNA, 25 bp, Rattus norvegicus
ctatgccgatagtgtacacctgtat

SEQ ID NO: 264062 - DNA, 25 bp, Rattus norvegicus
ctatgccgtctcctaaggtcatata

SEQ ID NO: 264063 - DNA, 25 bp, Rattus norvegicus
ctatgccgtctcgtaaggtcatata

SEQ ID NO: 264064 - DNA, 25 bp, Rattus norvegicus
ctatgcctcagtagtacccgttaaa

SEQ ID NO: 264065 - DNA, 25 bp, Rattus norvegicus
ctatgcctcagttgtacccgttaaa

SEQ ID NO: 264066 - DNA, 25 bp, Rattus norvegicus
ctatgcctgtatcctacattatcct

SEQ ID NO: 264067 - DNA, 25 bp, Rattus norvegicus
ctatgcctgtatgctacattatcct

SEQ ID NO: 264068 - DNA, 25 bp, Rattus norvegicus
ctatgccttaagatctctatcacac

SEQ ID NO: 264069 - DNA, 25 bp, Rattus norvegicus
ctatgccttaagttctctatcacac

SEQ ID NO: 264070 - DNA, 25 bp, Rattus norvegicus
ctatgcgacgtgacccagagaaggg

SEQ ID NO: 264071 - DNA, 25 bp, Rattus norvegicus
ctatgcgacgtgtcccagagaaggg

SEQ ID NO: 264072 - DNA, 25 bp, Rattus norvegicus
ctatgcgctctaagcttctttgtgg

SEQ ID NO: 264073 - DNA, 25 bp, Rattus norvegicus
ctatgcgctctatgcttctttgtgg

SEQ ID NO: 264074 - DNA, 25 bp, Rattus norvegicus
ctatgcgggcacacgctggctctgc

SEQ ID NO: 264075 - DNA, 25 bp, Rattus norvegicus
ctatgcgggcactcgctggctctgc

SEQ ID NO: 264076 - DNA, 25 bp, Rattus norvegicus
ctatgcgtatccacagtactgacac

SEQ ID NO: 264077 - DNA, 25 bp, Rattus norvegicus
ctatgcgtatcctcagtactgacac

SEQ ID NO: 264078 - DNA, 25 bp, Rattus norvegicus
ctatgctcagaacattaaccaggtt

SEQ ID NO: 264079 - DNA, 25 bp, Rattus norvegicus
ctatgctcagaagattaaccaggtt

SEQ ID NO: 264080 - DNA, 25 bp, Rattus norvegicus
ctatgctcagagaaagggctacttt

SEQ ID NO: 264081 - DNA, 25 bp, Rattus norvegicus
ctatgctcagagtaagggctacttt

SEQ ID NO: 264082 - DNA, 25 bp, Rattus norvegicus
ctatgctccagaccaagagtaagat

SEQ ID NO: 264083 - DNA, 25 bp, Rattus norvegicus
ctatgctccagagcaagagtaagat

SEQ ID NO: 264084 - DNA, 25 bp, Rattus norvegicus
ctatgctcgactccagtactgaatg

SEQ ID NO: 264085 - DNA, 25 bp, Rattus norvegicus
ctatgctcgactgcagtactgaatg

SEQ ID NO: 264086 - DNA, 25 bp, Rattus norvegicus
ctatgctggcagacttgaactatga

SEQ ID NO: 264087 - DNA, 25 bp, Rattus norvegicus
ctatgctggcagtcttgaactatga

SEQ ID NO: 264088 - DNA, 25 bp, Rattus norvegicus
ctatgctgttttagtatctgtaatc

SEQ ID NO: 264089 - DNA, 25 bp, Rattus norvegicus
ctatgctgtttttgtatctgtaatc

SEQ ID NO: 264090 - DNA, 25 bp, Rattus norvegicus
ctatgcttagccctgtgactgaagg

SEQ ID NO: 264091 - DNA, 25 bp, Rattus norvegicus
ctatgcttagccgtgtgactgaagg

SEQ ID NO: 264092 - DNA, 25 bp, Rattus norvegicus
ctatgcttcaaacggccagctgcaa

SEQ ID NO: 264093 - DNA, 25 bp, Rattus norvegicus
ctatgcttcaaagggccagctgcaa

SEQ ID NO: 264094 - DNA, 25 bp, Rattus norvegicus
ctatgcttccttaatgacatctggg

SEQ ID NO: 264095 - DNA, 25 bp, Rattus norvegicus
ctatgcttccttagaacccagttaa

SEQ ID NO: 264096 - DNA, 25 bp, Rattus norvegicus
ctatgcttcctttatgacatctggg

SEQ ID NO: 264097 - DNA, 25 bp, Rattus norvegicus
ctatgcttcctttgaacccagttaa

SEQ ID NO: 264098 - DNA, 25 bp, Rattus norvegicus
ctatgctttgttcgtttgtgtgtgt

SEQ ID NO: 264099 - DNA, 25 bp, Rattus norvegicus
ctatgctttgttggtttgtgtgtgt

SEQ ID NO: 264100 - DNA, 25 bp, Rattus norvegicus
ctatgcttttatatttcctctgtgg

SEQ ID NO: 264101 - DNA, 25 bp, Rattus norvegicus
ctatgcttttatttttcctctgtgg

SEQ ID NO: 264102 - DNA, 25 bp, Rattus norvegicus
ctatggaagacccaagaaccttgag

SEQ ID NO: 264103 - DNA, 25 bp, Rattus norvegicus
ctatggaagaccgaagaaccttgag

SEQ ID NO: 264104 - DNA, 25 bp, Rattus norvegicus
ctatggaagctcctaccagatgtgg

SEQ ID NO: 264105 - DNA, 25 bp, Rattus norvegicus
ctatggaagctcgtaccagatgtgg

SEQ ID NO: 264106 - DNA, 25 bp, Rattus norvegicus
ctatggaatgttccctctgggtgcc

SEQ ID NO: 264107 - DNA, 25 bp, Rattus norvegicus
ctatggaatgttgcctctgggtgcc

SEQ ID NO: 264108 - DNA, 25 bp, Rattus norvegicus
ctatggagactgcttctgtgggaca

SEQ ID NO: 264109 - DNA, 25 bp, Rattus norvegicus
ctatggagactggttctgtgggaca

SEQ ID NO: 264110 - DNA, 25 bp, Rattus norvegicus
ctatggagatccaggagtcccgccc

SEQ ID NO: 264111 - DNA, 25 bp, Rattus norvegicus
ctatggagatcctggagtcccgccc

SEQ ID NO: 264112 - DNA, 25 bp, Rattus norvegicus
ctatggaggagaccgaggtggctat

SEQ ID NO: 264113 - DNA, 25 bp, Rattus norvegicus
ctatggaggagagcgaggtggctat

SEQ ID NO: 264114 - DNA, 25 bp, Rattus norvegicus
ctatggataaggctggctgtttgaa

SEQ ID NO: 264115 - DNA, 25 bp, Rattus norvegicus
ctatggataagggtggctgtttgaa

SEQ ID NO: 264116 - DNA, 25 bp, Rattus norvegicus
ctatggatgtgaatgatgcggtaaa

SEQ ID NO: 264117 - DNA, 25 bp, Rattus norvegicus
ctatggatgtgattgatgcggtaaa

SEQ ID NO: 264118 - DNA, 25 bp, Rattus norvegicus
ctatggcaaatgctgtcacacttga

SEQ ID NO: 264119 - DNA, 25 bp, Rattus norvegicus
ctatggcaaatggtgtcacacttga

SEQ ID NO: 264120 - DNA, 25 bp, Rattus norvegicus
ctatggcagctcattctacttgtgg

SEQ ID NO: 264121 - DNA, 25 bp, Rattus norvegicus
ctatggcagctctttctacttgtgg

SEQ ID NO: 264122 - DNA, 25 bp, Rattus norvegicus
ctatggcagtgtctcttgaactttc

SEQ ID NO: 264123 - DNA, 25 bp, Rattus norvegicus
ctatggcagtgtgtcttgaactttc

SEQ ID NO: 264124 - DNA, 25 bp, Rattus norvegicus
ctatggcctgggaagatgttctcca

SEQ ID NO: 264125 - DNA, 25 bp, Rattus norvegicus
ctatggcctgggtagatgttctcca

SEQ ID NO: 264126 - DNA, 25 bp, Rattus norvegicus
ctatggcgcgcaccatgtgctgcaa

SEQ ID NO: 264127 - DNA, 25 bp, Rattus norvegicus
ctatggcgcgcagcatgtgctgcaa

SEQ ID NO: 264128 - DNA, 25 bp, Rattus norvegicus
ctatggctaccaccctgatgcattt

SEQ ID NO: 264129 - DNA, 25 bp, Rattus norvegicus
ctatggctaccagcctgatgcattt

SEQ ID NO: 264130 - DNA, 25 bp, Rattus norvegicus
ctatggctagacattgggtgacaca

SEQ ID NO: 264131 - DNA, 25 bp, Rattus norvegicus
ctatggctagactttgggtgacaca

SEQ ID NO: 264132 - DNA, 25 bp, Rattus norvegicus
ctatggctatggaaccagagcggtt

SEQ ID NO: 264133 - DNA, 25 bp, Rattus norvegicus
ctatggctatggtaccagagcggtt

SEQ ID NO: 264134 - DNA, 25 bp, Rattus norvegicus
ctatggctatgtatatgtctgttta

SEQ ID NO: 264135 - DNA, 25 bp, Rattus norvegicus
ctatggctatgtttatgtctgttta

SEQ ID NO: 264136 - DNA, 25 bp, Rattus norvegicus
ctatggctgccgcaaatgctttggg

SEQ ID NO: 264137 - DNA, 25 bp, Rattus norvegicus
ctatggctgccggaaatgctttggg

SEQ ID NO: 264138 - DNA, 25 bp, Rattus norvegicus
ctatggctggtgaacactttcctcc

SEQ ID NO: 264139 - DNA, 25 bp, Rattus norvegicus
ctatggctggtgtacactttcctcc

SEQ ID NO: 264140 - DNA, 25 bp, Rattus norvegicus
ctatggctgtgtagaatatggagtc

SEQ ID NO: 264141 - DNA, 25 bp, Rattus norvegicus
ctatggctgtgttgaatatggagtc

SEQ ID NO: 264142 - DNA, 25 bp, Rattus norvegicus
ctatggcttagtagagttccttatg

SEQ ID NO: 264143 - DNA, 25 bp, Rattus norvegicus
ctatggcttagttgagttccttatg

SEQ ID NO: 264144 - DNA, 25 bp, Rattus norvegicus
ctatggcttcttcctgctgggtggc

SEQ ID NO: 264145 - DNA, 25 bp, Rattus norvegicus
ctatggcttcttgctgctgggtggc

SEQ ID NO: 264146 - DNA, 25 bp, Rattus norvegicus
ctatgggacctaagctgactactta

SEQ ID NO: 264147 - DNA, 25 bp, Rattus norvegicus
ctatgggacctatgctgactactta

SEQ ID NO: 264148 - DNA, 25 bp, Rattus norvegicus
ctatgggagtttcgcggtagtcaat

SEQ ID NO: 264149 - DNA, 25 bp, Rattus norvegicus
ctatgggagtttggcggtagtcaat

SEQ ID NO: 264150 - DNA, 25 bp, Rattus norvegicus
ctatgggctttcacacgacggagga

SEQ ID NO: 264151 - DNA, 25 bp, Rattus norvegicus
ctatgggctttctcacgacggagga

SEQ ID NO: 264152 - DNA, 25 bp, Rattus norvegicus
ctatgggtacacacctagtaggcta

SEQ ID NO: 264153 - DNA, 25 bp, Rattus norvegicus
ctatgggtacactcctagtaggcta

SEQ ID NO: 264154 - DNA, 25 bp, Rattus norvegicus
ctatgggtccaacgtgatccacaat

SEQ ID NO: 264155 - DNA, 25 bp, Rattus norvegicus
ctatgggtccaaggtgatccacaat

SEQ ID NO: 264156 - DNA, 25 bp, Rattus norvegicus
ctatggtagggacaacacagtgaac

SEQ ID NO: 264157 - DNA, 25 bp, Rattus norvegicus
ctatggtagggagaacacagtgaac

SEQ ID NO: 264158 - DNA, 25 bp, Rattus norvegicus
ctatggtatgataactgatcttttc

SEQ ID NO: 264159 - DNA, 25 bp, Rattus norvegicus
ctatggtatgattactgatcttttc

SEQ ID NO: 264160 - DNA, 25 bp, Rattus norvegicus
ctatggtcactgcagaaaccgttga

SEQ ID NO: 264161 - DNA, 25 bp, Rattus norvegicus
ctatggtcactggagaaaccgttga

SEQ ID NO: 264162 - DNA, 25 bp, Rattus norvegicus
ctatggtcagctcctatagtcgtaa

SEQ ID NO: 264163 - DNA, 25 bp, Rattus norvegicus
ctatggtcagctgctatagtcgtaa

SEQ ID NO: 264164 - DNA, 25 bp, Rattus norvegicus
ctatggtctcaactctgggccaagc

SEQ ID NO: 264165 - DNA, 25 bp, Rattus norvegicus
ctatggtctcaagtctgggccaagc

SEQ ID NO: 264166 - DNA, 25 bp, Rattus norvegicus
ctatggtctttcaacatttgaagca

SEQ ID NO: 264167 - DNA, 25 bp, Rattus norvegicus
ctatggtctttctacatttgaagca

SEQ ID NO: 264168 - DNA, 25 bp, Rattus norvegicus
ctatggtgtttcattatgtctctgg

SEQ ID NO: 264169 - DNA, 25 bp, Rattus norvegicus
ctatggtgtttctttatgtctctgg

SEQ ID NO: 264170 - DNA, 25 bp, Rattus norvegicus
ctatggttacgaacccatgggtgga

SEQ ID NO: 264171 - DNA, 25 bp, Rattus norvegicus
ctatggttacgatcccatgggtgga

SEQ ID NO: 264172 - DNA, 25 bp, Rattus norvegicus
ctatggttcctgctcactactgtgt

SEQ ID NO: 264173 - DNA, 25 bp, Rattus norvegicus
ctatggttcctggtcactactgtgt

SEQ ID NO: 264174 - DNA, 25 bp, Rattus norvegicus
ctatggtttattacagttcttatca

SEQ ID NO: 264175 - DNA, 25 bp, Rattus norvegicus
ctatggtttatttcagttcttatca

SEQ ID NO: 264176 - DNA, 25 bp, Rattus norvegicus
ctatgtacgcctccctgagctcggg

SEQ ID NO: 264177 - DNA, 25 bp, Rattus norvegicus
ctatgtacgcctgcctgagctcggg

SEQ ID NO: 264178 - DNA, 25 bp, Rattus norvegicus
ctatgtagactgcagaatgttgcgt

SEQ ID NO: 264179 - DNA, 25 bp, Rattus norvegicus
ctatgtagactggagaatgttgcgt

SEQ ID NO: 264180 - DNA, 25 bp, Rattus norvegicus
ctatgtagctgcatctaggttctca

SEQ ID NO: 264181 - DNA, 25 bp, Rattus norvegicus
ctatgtagctgcttctaggttctca

SEQ ID NO: 264182 - DNA, 25 bp, Rattus norvegicus
ctatgtagtctcattctagtagaat

SEQ ID NO: 264183 - DNA, 25 bp, Rattus norvegicus
ctatgtagtctctttctagtagaat

SEQ ID NO: 264184 - DNA, 25 bp, Rattus norvegicus
ctatgtagtgaaccagcctgagcta

SEQ ID NO: 264185 - DNA, 25 bp, Rattus norvegicus
ctatgtagtgaagcagcctgagcta

SEQ ID NO: 264186 - DNA, 25 bp, Rattus norvegicus
ctatgtatacttagagtcctcactg

SEQ ID NO: 264187 - DNA, 25 bp, Rattus norvegicus
ctatgtatactttgagtcctcactg

SEQ ID NO: 264188 - DNA, 25 bp, Rattus norvegicus
ctatgtatgtacattgcctgtttgt

SEQ ID NO: 264189 - DNA, 25 bp, Rattus norvegicus
ctatgtatgtactttgcctgtttgt

SEQ ID NO: 264190 - DNA, 25 bp, Rattus norvegicus
ctatgtatttacatgtggttggtac

SEQ ID NO: 264191 - DNA, 25 bp, Rattus norvegicus
ctatgtatttacttgtggttggtac

SEQ ID NO: 264192 - DNA, 25 bp, Rattus norvegicus
ctatgtcagttccacttctttgtta

SEQ ID NO: 264193 - DNA, 25 bp, Rattus norvegicus
ctatgtcagttcgacttctttgtta

SEQ ID NO: 264194 - DNA, 25 bp, Rattus norvegicus
ctatgtcatacccagaagttcccat

SEQ ID NO: 264195 - DNA, 25 bp, Rattus norvegicus
ctatgtcataccgagaagttcccat

SEQ ID NO: 264196 - DNA, 25 bp, Rattus norvegicus
ctatgtcataggcaatattctggaa

SEQ ID NO: 264197 - DNA, 25 bp, Rattus norvegicus
ctatgtcatagggaatattctggaa

SEQ ID NO: 264198 - DNA, 25 bp, Rattus norvegicus
ctatgtcatcagagttgagcccggg

SEQ ID NO: 264199 - DNA, 25 bp, Rattus norvegicus
ctatgtcatcagtgttgagcccggg

SEQ ID NO: 264200 - DNA, 25 bp, Rattus norvegicus
ctatgtcattttccttctttggatt

SEQ ID NO: 264201 - DNA, 25 bp, Rattus norvegicus
ctatgtcattttgcttctttggatt

SEQ ID NO: 264202 - DNA, 25 bp, Rattus norvegicus
ctatgtccagaaaattttgcctttt

SEQ ID NO: 264203 - DNA, 25 bp, Rattus norvegicus
ctatgtccagaatattttgcctttt

SEQ ID NO: 264204 - DNA, 25 bp, Rattus norvegicus
ctatgtccggatattggctgacctg

SEQ ID NO: 264205 - DNA, 25 bp, Rattus norvegicus
ctatgtccggattttggctgacctg

SEQ ID NO: 264206 - DNA, 25 bp, Rattus norvegicus
ctatgtccttccatgtaaagtccac

SEQ ID NO: 264207 - DNA, 25 bp, Rattus norvegicus
ctatgtccttccttgtaaagtccac

SEQ ID NO: 264208 - DNA, 25 bp, Rattus norvegicus
ctatgtccttgcagtggtcgggatg

SEQ ID NO: 264209 - DNA, 25 bp, Rattus norvegicus
ctatgtccttgctgtggtcgggatg

SEQ ID NO: 264210 - DNA, 25 bp, Rattus norvegicus
ctatgtctaagtagctttccttttt

SEQ ID NO: 264211 - DNA, 25 bp, Rattus norvegicus
ctatgtctaagttgctttccttttt

SEQ ID NO: 264212 - DNA, 25 bp, Rattus norvegicus
ctatgtctgggcctttggaacaaat

SEQ ID NO: 264213 - DNA, 25 bp, Rattus norvegicus
ctatgtctgggcgtttggaacaaat

SEQ ID NO: 264214 - DNA, 25 bp, Rattus norvegicus
ctatgtgaacatcgtagtataccct

SEQ ID NO: 264215 - DNA, 25 bp, Rattus norvegicus
ctatgtgaacatggtagtataccct

SEQ ID NO: 264216 - DNA, 25 bp, Rattus norvegicus
ctatgtgagacgctgtgtggcccat

SEQ ID NO: 264217 - DNA, 25 bp, Rattus norvegicus
ctatgtgagacggtgtgtggcccat

SEQ ID NO: 264218 - DNA, 25 bp, Rattus norvegicus
ctatgtgcatctaatatcctgttta

SEQ ID NO: 264219 - DNA, 25 bp, Rattus norvegicus
ctatgtgcatcttatatcctgttta

SEQ ID NO: 264220 - DNA, 25 bp, Rattus norvegicus
ctatgtgccttcataatgtgtttat

SEQ ID NO: 264221 - DNA, 25 bp, Rattus norvegicus
ctatgtgccttcttaatgtgtttat

SEQ ID NO: 264222 - DNA, 25 bp, Rattus norvegicus
ctatgtgctaggctggtgaattttt

SEQ ID NO: 264223 - DNA, 25 bp, Rattus norvegicus
ctatgtgctagggtggtgaattttt

SEQ ID NO: 264224 - DNA, 25 bp, Rattus norvegicus
ctatgtgctgggaactgtgctaaga

SEQ ID NO: 264225 - DNA, 25 bp, Rattus norvegicus
ctatgtgctgggtactgtgctaaga

SEQ ID NO: 264226 - DNA, 25 bp, Rattus norvegicus
ctatgtggcccacactggcctcaaa

SEQ ID NO: 264227 - DNA, 25 bp, Rattus norvegicus
ctatgtggcccagactggcctcaaa

SEQ ID NO: 264228 - DNA, 25 bp, Rattus norvegicus
ctatgtggcccccatgatgcgatga

SEQ ID NO: 264229 - DNA, 25 bp, Rattus norvegicus
ctatgtggccccgatgatgcgatga

SEQ ID NO: 264230 - DNA, 25 bp, Rattus norvegicus
ctatgtggttgtcggcctggactac

SEQ ID NO: 264231 - DNA, 25 bp, Rattus norvegicus
ctatgtggttgtgggcctggactac

SEQ ID NO: 264232 - DNA, 25 bp, Rattus norvegicus
ctatgtgtaagtattctcagttaaa

SEQ ID NO: 264233 - DNA, 25 bp, Rattus norvegicus
ctatgtgtaagttttctcagttaaa

SEQ ID NO: 264234 - DNA, 25 bp, Rattus norvegicus
ctatgtgtcctgctccagagctagc

SEQ ID NO: 264235 - DNA, 25 bp, Rattus norvegicus
ctatgtgtcctggtccagagctagc

SEQ ID NO: 264236 - DNA, 25 bp, Rattus norvegicus
ctatgtgtgcttactctcagctttc

SEQ ID NO: 264237 - DNA, 25 bp, Rattus norvegicus
ctatgtgtgctttctctcagctttc

SEQ ID NO: 264238 - DNA, 25 bp, Rattus norvegicus
ctatgtgtgtgtcctagagatgata

SEQ ID NO: 264239 - DNA, 25 bp, Rattus norvegicus
ctatgtgtgtgtgctagagatgata

SEQ ID NO: 264240 - DNA, 25 bp, Rattus norvegicus
ctatgtgttctgagttcaaatgtaa

SEQ ID NO: 264241 - DNA, 25 bp, Rattus norvegicus
ctatgtgttctgtgttcaaatgtaa

SEQ ID NO: 264242 - DNA, 25 bp, Rattus norvegicus
ctatgttagactatgcagaatgccc

SEQ ID NO: 264243 - DNA, 25 bp, Rattus norvegicus
ctatgttagactttgcagaatgccc

SEQ ID NO: 264244 - DNA, 25 bp, Rattus norvegicus
ctatgttagcggacaacttggtcta

SEQ ID NO: 264245 - DNA, 25 bp, Rattus norvegicus
ctatgttagcggtcaacttggtcta

SEQ ID NO: 264246 - DNA, 25 bp, Rattus norvegicus
ctatgttctgagcacaggagcctga

SEQ ID NO: 264247 - DNA, 25 bp, Rattus norvegicus
ctatgttctgaggacaggagcctga

SEQ ID NO: 264248 - DNA, 25 bp, Rattus norvegicus
ctatgttctgttacgtagccttaag

SEQ ID NO: 264249 - DNA, 25 bp, Rattus norvegicus
ctatgttctgtttcgtagccttaag

SEQ ID NO: 264250 - DNA, 25 bp, Rattus norvegicus
ctatgttgaagactttgatgccagc

SEQ ID NO: 264251 - DNA, 25 bp, Rattus norvegicus
ctatgttgaagagtttgatgccagc

SEQ ID NO: 264252 - DNA, 25 bp, Rattus norvegicus
ctatgtttgcgcatgaccatgtgcg

SEQ ID NO: 264253 - DNA, 25 bp, Rattus norvegicus
ctatgtttgcgcttgaccatgtgcg

SEQ ID NO: 264254 - DNA, 25 bp, Rattus norvegicus
ctatgtttttccatggtcttaggtg

SEQ ID NO: 264255 - DNA, 25 bp, Rattus norvegicus
ctatgtttttccttggtcttaggtg

SEQ ID NO: 264256 - DNA, 25 bp, Rattus norvegicus
ctattaagttctctgagccggcaca

SEQ ID NO: 264257 - DNA, 25 bp, Rattus norvegicus
ctattaagttctgtgagccggcaca

SEQ ID NO: 264258 - DNA, 25 bp, Rattus norvegicus
ctattaatgtgcatgtctgttctaa

SEQ ID NO: 264259 - DNA, 25 bp, Rattus norvegicus
ctattaatgtgcttgtctgttctaa

SEQ ID NO: 264260 - DNA, 25 bp, Rattus norvegicus
ctattacagtagattcaaccttcct

SEQ ID NO: 264261 - DNA, 25 bp, Rattus norvegicus
ctattacagtagtttcaaccttcct

SEQ ID NO: 264262 - DNA, 25 bp, Rattus norvegicus
ctattacataggacaaatcctcgga

SEQ ID NO: 264263 - DNA, 25 bp, Rattus norvegicus
ctattacataggtcaaatcctcgga

SEQ ID NO: 264264 - DNA, 25 bp, Rattus norvegicus
ctattacgacgtcatgggccagtgg

SEQ ID NO: 264265 - DNA, 25 bp, Rattus norvegicus
ctattacgacgtgatgggccagtgg

SEQ ID NO: 264266 - DNA, 25 bp, Rattus norvegicus
ctattacggattacccgagtgggat

SEQ ID NO: 264267 - DNA, 25 bp, Rattus norvegicus
ctattacggatttcccgagtgggat

SEQ ID NO: 264268 - DNA, 25 bp, Rattus norvegicus
ctattactaggtattgcctctgacc

SEQ ID NO: 264269 - DNA, 25 bp, Rattus norvegicus
ctattactaggttttgcctctgacc

SEQ ID NO: 264270 - DNA, 25 bp, Rattus norvegicus
ctattactctagcaccatacacctg

SEQ ID NO: 264271 - DNA, 25 bp, Rattus norvegicus
ctattactctaggaccatacacctg

SEQ ID NO: 264272 - DNA, 25 bp, Rattus norvegicus
ctattactctggctcaaggcatcaa

SEQ ID NO: 264273 - DNA, 25 bp, Rattus norvegicus
ctattactctgggtcaaggcatcaa

SEQ ID NO: 264274 - DNA, 25 bp, Rattus norvegicus
ctattactggagagactgtcatgga

SEQ ID NO: 264275 - DNA, 25 bp, Rattus norvegicus
ctattactggagtgactgtcatgga

SEQ ID NO: 264276 - DNA, 25 bp, Rattus norvegicus
ctattactttatatattggccctct

SEQ ID NO: 264277 - DNA, 25 bp, Rattus norvegicus
ctattactttatttattggccctct

SEQ ID NO: 264278 - DNA, 25 bp, Rattus norvegicus
ctattagagttgaggtggctgcaaa

SEQ ID NO: 264279 - DNA, 25 bp, Rattus norvegicus
ctattagagttgtggtggctgcaaa

SEQ ID NO: 264280 - DNA, 25 bp, Rattus norvegicus
ctattagcagccacattgtcacagc

SEQ ID NO: 264281 - DNA, 25 bp, Rattus norvegicus
ctattagcagcctcattgtcacagc

SEQ ID NO: 264282 - DNA, 25 bp, Rattus norvegicus
ctattagccttcaatcatactgcct

SEQ ID NO: 264283 - DNA, 25 bp, Rattus norvegicus
ctattagccttctatcatactgcct

SEQ ID NO: 264284 - DNA, 25 bp, Rattus norvegicus
ctattaggaagtcctcccgctcttg

SEQ ID NO: 264285 - DNA, 25 bp, Rattus norvegicus
ctattaggaagtgctcccgctcttg

SEQ ID NO: 264286 - DNA, 25 bp, Rattus norvegicus
ctattaggatcaatcaccagtgtga

SEQ ID NO: 264287 - DNA, 25 bp, Rattus norvegicus
ctattaggatcattcaccagtgtga

SEQ ID NO: 264288 - DNA, 25 bp, Rattus norvegicus
ctattatctgacagtttgaccctgt

SEQ ID NO: 264289 - DNA, 25 bp, Rattus norvegicus
ctattatctgactgtttgaccctgt

SEQ ID NO: 264290 - DNA, 25 bp, Rattus norvegicus
ctattatctttgatgccttttgctt

SEQ ID NO: 264291 - DNA, 25 bp, Rattus norvegicus
ctattatctttgttgccttttgctt

SEQ ID NO: 264292 - DNA, 25 bp, Rattus norvegicus
ctattattggtcattgtgtctgaga

SEQ ID NO: 264293 - DNA, 25 bp, Rattus norvegicus
ctattattggtctttgtgtctgaga

SEQ ID NO: 264294 - DNA, 25 bp, Rattus norvegicus
ctattcactccgctctctataatta

SEQ ID NO: 264295 - DNA, 25 bp, Rattus norvegicus
ctattcactccggtctctataatta

SEQ ID NO: 264296 - DNA, 25 bp, Rattus norvegicus
ctattcagaccccacgataatcaaa

SEQ ID NO: 264297 - DNA, 25 bp, Rattus norvegicus
ctattcagacccgacgataatcaaa

SEQ ID NO: 264298 - DNA, 25 bp, Rattus norvegicus
ctattcatccccagtggctcagaag

SEQ ID NO: 264299 - DNA, 25 bp, Rattus norvegicus
ctattcatcccctgtggctcagaag

SEQ ID NO: 264300 - DNA, 25 bp, Rattus norvegicus
ctattcatttgtagatccgctgaga

SEQ ID NO: 264301 - DNA, 25 bp, Rattus norvegicus
ctattcatttgttgatccgctgaga

SEQ ID NO: 264302 - DNA, 25 bp, Rattus norvegicus
ctattccaggtacccaggagaccaa

SEQ ID NO: 264303 - DNA, 25 bp, Rattus norvegicus
ctattccaggtagccaggagaccaa

SEQ ID NO: 264304 - DNA, 25 bp, Rattus norvegicus
ctattcccgtgcagataactggtgt

SEQ ID NO: 264305 - DNA, 25 bp, Rattus norvegicus
ctattcccgtgctgataactggtgt

SEQ ID NO: 264306 - DNA, 25 bp, Rattus norvegicus
ctattccctagtccatgttactgaa

SEQ ID NO: 264307 - DNA, 25 bp, Rattus norvegicus
ctattccctagtgcatgttactgaa

SEQ ID NO: 264308 - DNA, 25 bp, Rattus norvegicus
ctattcctatccagtaagctttgag

SEQ ID NO: 264309 - DNA, 25 bp, Rattus norvegicus
ctattcctatcctgtaagctttgag

SEQ ID NO: 264310 - DNA, 25 bp, Rattus norvegicus
ctattcctccacagatgggtcagaa

SEQ ID NO: 264311 - DNA, 25 bp, Rattus norvegicus
ctattcctccactgatgggtcagaa

SEQ ID NO: 264312 - DNA, 25 bp, Rattus norvegicus
ctattcctccatagatgggtagaaa

SEQ ID NO: 264313 - DNA, 25 bp, Rattus norvegicus
ctattcctccattgatgggtagaaa

SEQ ID NO: 264314 - DNA, 25 bp, Rattus norvegicus
ctattccttctacaacattcacaca

SEQ ID NO: 264315 - DNA, 25 bp, Rattus norvegicus
ctattccttctagaacattcacaca

SEQ ID NO: 264316 - DNA, 25 bp, Rattus norvegicus
ctattcgcagagatcgtgaggcaga

SEQ ID NO: 264317 - DNA, 25 bp, Rattus norvegicus
ctattcgcagagttcgtgaggcaga

SEQ ID NO: 264318 - DNA, 25 bp, Rattus norvegicus
ctattcgctgggatgtggacacact

SEQ ID NO: 264319 - DNA, 25 bp, Rattus norvegicus
ctattcgctgggttgtggacacact

SEQ ID NO: 264320 - DNA, 25 bp, Rattus norvegicus
ctattcggttgtatgtcaggtccaa

SEQ ID NO: 264321 - DNA, 25 bp, Rattus norvegicus
ctattcggttgtttgtcaggtccaa

SEQ ID NO: 264322 - DNA, 25 bp, Rattus norvegicus
ctattctgaatactgctgagcccga

SEQ ID NO: 264323 - DNA, 25 bp, Rattus norvegicus
ctattctgaatagtgctgagcccga

SEQ ID NO: 264324 - DNA, 25 bp, Rattus norvegicus
ctattctgtccaactacttccgaga

SEQ ID NO: 264325 - DNA, 25 bp, Rattus norvegicus
ctattctgtccatctacttccgaga

SEQ ID NO: 264326 - DNA, 25 bp, Rattus norvegicus
ctattctgtctgctgattggctcag

SEQ ID NO: 264327 - DNA, 25 bp, Rattus norvegicus
ctattctgtctggtgattggctcag

SEQ ID NO: 264328 - DNA, 25 bp, Rattus norvegicus
ctattcttagatagttttgccccac

SEQ ID NO: 264329 - DNA, 25 bp, Rattus norvegicus
ctattcttagattgttttgccccac

SEQ ID NO: 264330 - DNA, 25 bp, Rattus norvegicus
ctattcttcctacttgccaaataca

SEQ ID NO: 264331 - DNA, 25 bp, Rattus norvegicus
ctattcttcctagttgccaaataca

SEQ ID NO: 264332 - DNA, 25 bp, Rattus norvegicus
ctattgacaagcacgtttccaccag

SEQ ID NO: 264333 - DNA, 25 bp, Rattus norvegicus
ctattgacaagctcgtttccaccag

SEQ ID NO: 264334 - DNA, 25 bp, Rattus norvegicus
ctattgattgaaatgctgccctgag

SEQ ID NO: 264335 - DNA, 25 bp, Rattus norvegicus
ctattgattgaattgctgccctgag

SEQ ID NO: 264336 - DNA, 25 bp, Rattus norvegicus
ctattgatttcaatgccccagaggc

SEQ ID NO: 264337 - DNA, 25 bp, Rattus norvegicus
ctattgatttcattgccccagaggc

SEQ ID NO: 264338 - DNA, 25 bp, Rattus norvegicus
ctattgccagaacagacatcagact

SEQ ID NO: 264339 - DNA, 25 bp, Rattus norvegicus
ctattgccagaagagacatcagact

SEQ ID NO: 264340 - DNA, 25 bp, Rattus norvegicus
ctattgcctggtctttttctatcat

SEQ ID NO: 264341 - DNA, 25 bp, Rattus norvegicus
ctattgcctggtgtttttctatcat

SEQ ID NO: 264342 - DNA, 25 bp, Rattus norvegicus
ctattgctcagcacttcaggtaaat

SEQ ID NO: 264343 - DNA, 25 bp, Rattus norvegicus
ctattgctcagctcttcaggtaaat

SEQ ID NO: 264344 - DNA, 25 bp, Rattus norvegicus
ctattggagagtagcctttgcagga

SEQ ID NO: 264345 - DNA, 25 bp, Rattus norvegicus
ctattggagagttgcctttgcagga

SEQ ID NO: 264346 - DNA, 25 bp, Rattus norvegicus
ctattggctgggatttatttcgtgt

SEQ ID NO: 264347 - DNA, 25 bp, Rattus norvegicus
ctattggctgggttttatttcgtgt

SEQ ID NO: 264348 - DNA, 25 bp, Rattus norvegicus
ctattggttgtaaggacttcagcat

SEQ ID NO: 264349 - DNA, 25 bp, Rattus norvegicus
ctattggttgtatggacttcagcat

SEQ ID NO: 264350 - DNA, 25 bp, Rattus norvegicus
ctattgtaagcaagatccccaccta

SEQ ID NO: 264351 - DNA, 25 bp, Rattus norvegicus
ctattgtaagcatgatccccaccta

SEQ ID NO: 264352 - DNA, 25 bp, Rattus norvegicus
ctattgtacttcatggcttccggct

SEQ ID NO: 264353 - DNA, 25 bp, Rattus norvegicus
ctattgtacttcttggcttccggct

SEQ ID NO: 264354 - DNA, 25 bp, Rattus norvegicus
ctatttaatacaagaacagcctttg

SEQ ID NO: 264355 - DNA, 25 bp, Rattus norvegicus
ctatttaatacatgaacagcctttg

SEQ ID NO: 264356 - DNA, 25 bp, Rattus norvegicus
ctatttagttcaacgaccattgccc

SEQ ID NO: 264357 - DNA, 25 bp, Rattus norvegicus
ctatttagttcatcgaccattgccc

SEQ ID NO: 264358 - DNA, 25 bp, Rattus norvegicus
ctatttatcactatcctcagggacc

SEQ ID NO: 264359 - DNA, 25 bp, Rattus norvegicus
ctatttatcactttcctcagggacc

SEQ ID NO: 264360 - DNA, 25 bp, Rattus norvegicus
ctatttatgttgagcctctgcaggc

SEQ ID NO: 264361 - DNA, 25 bp, Rattus norvegicus
ctatttatgttgtgcctctgcaggc

SEQ ID NO: 264362 - DNA, 25 bp, Rattus norvegicus
ctatttattctgaagcactgtggct

SEQ ID NO: 264363 - DNA, 25 bp, Rattus norvegicus
ctatttattctgtagcactgtggct

SEQ ID NO: 264364 - DNA, 25 bp, Rattus norvegicus
ctatttattttgctgaccctgactg

SEQ ID NO: 264365 - DNA, 25 bp, Rattus norvegicus
ctatttattttggtgaccctgactg

SEQ ID NO: 264366 - DNA, 25 bp, Rattus norvegicus
ctatttcacaatcggttctgctgga

SEQ ID NO: 264367 - DNA, 25 bp, Rattus norvegicus
ctatttcacaatgggttctgctgga

SEQ ID NO: 264368 - DNA, 25 bp, Rattus norvegicus
ctatttcacctgagccctgaagaaa

SEQ ID NO: 264369 - DNA, 25 bp, Rattus norvegicus
ctatttcacctgtgccctgaagaaa

SEQ ID NO: 264370 - DNA, 25 bp, Rattus norvegicus
ctatttcagagaagcccgtgtggta

SEQ ID NO: 264371 - DNA, 25 bp, Rattus norvegicus
ctatttcagagatgcccgtgtggta

SEQ ID NO: 264372 - DNA, 25 bp, Rattus norvegicus
ctatttccccataacatgtgatgtt

SEQ ID NO: 264373 - DNA, 25 bp, Rattus norvegicus
ctatttccccattacatgtgatgtt

SEQ ID NO: 264374 - DNA, 25 bp, Rattus norvegicus
ctatttctccacacctttgtgtttt

SEQ ID NO: 264375 - DNA, 25 bp, Rattus norvegicus
ctatttctccactcctttgtgtttt

SEQ ID NO: 264376 - DNA, 25 bp, Rattus norvegicus
ctatttctctctatgatcattttgc

SEQ ID NO: 264377 - DNA, 25 bp, Rattus norvegicus
ctatttctctctttgatcattttgc

SEQ ID NO: 264378 - DNA, 25 bp, Rattus norvegicus
ctatttctgagaaaaggtcccggga

SEQ ID NO: 264379 - DNA, 25 bp, Rattus norvegicus
ctatttctgagataaggtcccggga

SEQ ID NO: 264380 - DNA, 25 bp, Rattus norvegicus
ctatttctgtgaactcaatgttttg

SEQ ID NO: 264381 - DNA, 25 bp, Rattus norvegicus
ctatttctgtgatctcaatgttttg

SEQ ID NO: 264382 - DNA, 25 bp, Rattus norvegicus
ctatttgagcagcagatcttctgaa

SEQ ID NO: 264383 - DNA, 25 bp, Rattus norvegicus
ctatttgagcaggagatcttctgaa

SEQ ID NO: 264384 - DNA, 25 bp, Rattus norvegicus
ctatttgccctcatcagtggacctc

SEQ ID NO: 264385 - DNA, 25 bp, Rattus norvegicus
ctatttgccctcttcagtggacctc

SEQ ID NO: 264386 - DNA, 25 bp, Rattus norvegicus
ctatttgtaattaaaacacttggat

SEQ ID NO: 264387 - DNA, 25 bp, Rattus norvegicus
ctatttgtaatttaaacacttggat

SEQ ID NO: 264388 - DNA, 25 bp, Rattus norvegicus
ctatttgtattcatatgccttttca

SEQ ID NO: 264389 - DNA, 25 bp, Rattus norvegicus
ctatttgtattcttatgccttttca

SEQ ID NO: 264390 - DNA, 25 bp, Rattus norvegicus
ctatttgtttggctactgatgtcta

SEQ ID NO: 264391 - DNA, 25 bp, Rattus norvegicus
ctatttgtttgggtactgatgtcta

SEQ ID NO: 264392 - DNA, 25 bp, Rattus norvegicus
ctattttcatgacaagatgctgtaa

SEQ ID NO: 264393 - DNA, 25 bp, Rattus norvegicus
ctattttcatgagaagatgctgtaa

SEQ ID NO: 264394 - DNA, 25 bp, Rattus norvegicus
ctattttcctaaagtctgtggtaca

SEQ ID NO: 264395 - DNA, 25 bp, Rattus norvegicus
ctattttcctaatgtctgtggtaca

SEQ ID NO: 264396 - DNA, 25 bp, Rattus norvegicus
ctattttctaatcgtggtgtgtcta

SEQ ID NO: 264397 - DNA, 25 bp, Rattus norvegicus
ctattttctaatggtggtgtgtcta

SEQ ID NO: 264398 - DNA, 25 bp, Rattus norvegicus
ctattttggaatattctgtaggcac

SEQ ID NO: 264399 - DNA, 25 bp, Rattus norvegicus
ctattttggaattttctgtaggcac

SEQ ID NO: 264400 - DNA, 25 bp, Rattus norvegicus
ctattttgttgcatgggtgtaccca

SEQ ID NO: 264401 - DNA, 25 bp, Rattus norvegicus
ctattttgttgcttgggtgtaccca

SEQ ID NO: 264402 - DNA, 25 bp, Rattus norvegicus
ctattttgttgtatggtctgtggga

SEQ ID NO: 264403 - DNA, 25 bp, Rattus norvegicus
ctattttgttgtttggtctgtggga

SEQ ID NO: 264404 - DNA, 25 bp, Rattus norvegicus
ctatttttccaacactaattccagt

SEQ ID NO: 264405 - DNA, 25 bp, Rattus norvegicus
ctatttttccaagactaattccagt

SEQ ID NO: 264406 - DNA, 25 bp, Rattus norvegicus
ctatttttctacaaactgacccaag

SEQ ID NO: 264407 - DNA, 25 bp, Rattus norvegicus
ctatttttctactaactgacccaag

SEQ ID NO: 264408 - DNA, 25 bp, Rattus norvegicus
ctatttttctcgatcacactgtgat

SEQ ID NO: 264409 - DNA, 25 bp, Rattus norvegicus
ctatttttctcgttcacactgtgat

SEQ ID NO: 264410 - DNA, 25 bp, Rattus norvegicus
ctatttttgacgattggagccctta

SEQ ID NO: 264411 - DNA, 25 bp, Rattus norvegicus
ctatttttgacgtttggagccctta

SEQ ID NO: 264412 - DNA, 25 bp, Rattus norvegicus
ctcaaaacctagattcagaactcat

SEQ ID NO: 264413 - DNA, 25 bp, Rattus norvegicus
ctcaaaacctagtttcagaactcat

SEQ ID NO: 264414 - DNA, 25 bp, Rattus norvegicus
ctcaaaataactagtctgcctccac

SEQ ID NO: 264415 - DNA, 25 bp, Rattus norvegicus
ctcaaaataacttgtctgcctccac

SEQ ID NO: 264416 - DNA, 25 bp, Rattus norvegicus
ctcaaaatggtcctttcagctctta

SEQ ID NO: 264417 - DNA, 25 bp, Rattus norvegicus
ctcaaaatggtcgtttcagctctta

SEQ ID NO: 264418 - DNA, 25 bp, Rattus norvegicus
ctcaaacacctgaggtcctcggtac

SEQ ID NO: 264419 - DNA, 25 bp, Rattus norvegicus
ctcaaacacctgtggtcctcggtac

SEQ ID NO: 264420 - DNA, 25 bp, Rattus norvegicus
ctcaaacatgcactgtccctcagtg

SEQ ID NO: 264421 - DNA, 25 bp, Rattus norvegicus
ctcaaacatgcagtgtccctcagtg

SEQ ID NO: 264422 - DNA, 25 bp, Rattus norvegicus
ctcaaacctggcacgattaccaatt

SEQ ID NO: 264423 - DNA, 25 bp, Rattus norvegicus
ctcaaacctggctcgattaccaatt

SEQ ID NO: 264424 - DNA, 25 bp, Rattus norvegicus
ctcaaactcagtctgcctagggtgc

SEQ ID NO: 264425 - DNA, 25 bp, Rattus norvegicus
ctcaaactcagtgtgcctagggtgc

SEQ ID NO: 264426 - DNA, 25 bp, Rattus norvegicus
ctcaaacttgagagctctggaagag

SEQ ID NO: 264427 - DNA, 25 bp, Rattus norvegicus
ctcaaacttgagtgctctggaagag

SEQ ID NO: 264428 - DNA, 25 bp, Rattus norvegicus
ctcaaagaattcaatggtcctaaat

SEQ ID NO: 264429 - DNA, 25 bp, Rattus norvegicus
ctcaaagaattctatggtcctaaat

SEQ ID NO: 264430 - DNA, 25 bp, Rattus norvegicus
ctcaaagcagcaacagtgtccacag

SEQ ID NO: 264431 - DNA, 25 bp, Rattus norvegicus
ctcaaagcagcatcagtgtccacag

SEQ ID NO: 264432 - DNA, 25 bp, Rattus norvegicus
ctcaaagcccgtaagagacacgata

SEQ ID NO: 264433 - DNA, 25 bp, Rattus norvegicus
ctcaaagcccgttagagacacgata

SEQ ID NO: 264434 - DNA, 25 bp, Rattus norvegicus
ctcaaagctgtgcactagaagtgga

SEQ ID NO: 264435 - DNA, 25 bp, Rattus norvegicus
ctcaaagctgtggactagaagtgga

SEQ ID NO: 264436 - DNA, 25 bp, Rattus norvegicus
ctcaaaggactaatctccccaaagt

SEQ ID NO: 264437 - DNA, 25 bp, Rattus norvegicus
ctcaaaggactattctccccaaagt

SEQ ID NO: 264438 - DNA, 25 bp, Rattus norvegicus
ctcaaaggtcagcagagcttactct

SEQ ID NO: 264439 - DNA, 25 bp, Rattus norvegicus
ctcaaaggtcaggagagcttactct

SEQ ID NO: 264440 - DNA, 25 bp, Rattus norvegicus
ctcaaagtgactaggtgactctggg

SEQ ID NO: 264441 - DNA, 25 bp, Rattus norvegicus
ctcaaagtgacttggtgactctggg

SEQ ID NO: 264442 - DNA, 25 bp, Rattus norvegicus
ctcaaatactccaacagaactgtct

SEQ ID NO: 264443 - DNA, 25 bp, Rattus norvegicus
ctcaaatactcctacagaactgtct

SEQ ID NO: 264444 - DNA, 25 bp, Rattus norvegicus
ctcaaattgccccatgtgctatatt

SEQ ID NO: 264445 - DNA, 25 bp, Rattus norvegicus
ctcaaattgcccgatgtgctatatt

SEQ ID NO: 264446 - DNA, 25 bp, Rattus norvegicus
ctcaacacccatatgctgtttgttt

SEQ ID NO: 264447 - DNA, 25 bp, Rattus norvegicus
ctcaacacccatttgctgtttgttt

SEQ ID NO: 264448 - DNA, 25 bp, Rattus norvegicus
ctcaacagactcactagcagttcat

SEQ ID NO: 264449 - DNA, 25 bp, Rattus norvegicus
ctcaacagactctctagcagttcat

SEQ ID NO: 264450 - DNA, 25 bp, Rattus norvegicus
ctcaacagagcacttcctgatcttc

SEQ ID NO: 264451 - DNA, 25 bp, Rattus norvegicus
ctcaacagagcagttcctgatcttc

SEQ ID NO: 264452 - DNA, 25 bp, Rattus norvegicus
ctcaacatggaacaagccttctcac

SEQ ID NO: 264453 - DNA, 25 bp, Rattus norvegicus
ctcaacatggaagaagccttctcac

SEQ ID NO: 264454 - DNA, 25 bp, Rattus norvegicus
ctcaacccataactgctgtcaaaca

SEQ ID NO: 264455 - DNA, 25 bp, Rattus norvegicus
ctcaacccataagtgctgtcaaaca

SEQ ID NO: 264456 - DNA, 25 bp, Rattus norvegicus
ctcaacccatccacagatttgggat

SEQ ID NO: 264457 - DNA, 25 bp, Rattus norvegicus
ctcaacccatcctcagatttgggat

SEQ ID NO: 264458 - DNA, 25 bp, Rattus norvegicus
ctcaaccctgtgaggcaagccttca

SEQ ID NO: 264459 - DNA, 25 bp, Rattus norvegicus
ctcaaccctgtgtggcaagccttca

SEQ ID NO: 264460 - DNA, 25 bp, Rattus norvegicus
ctcaacccttgtcgcagggaagggc

SEQ ID NO: 264461 - DNA, 25 bp, Rattus norvegicus
ctcaacccttgtggcagggaagggc

SEQ ID NO: 264462 - DNA, 25 bp, Rattus norvegicus
ctcaacctactcagtttacaaactc

SEQ ID NO: 264463 - DNA, 25 bp, Rattus norvegicus
ctcaacctactctgtttacaaactc

SEQ ID NO: 264464 - DNA, 25 bp, Rattus norvegicus
ctcaacctggacattgtttgcagtt

SEQ ID NO: 264465 - DNA, 25 bp, Rattus norvegicus
ctcaacctggactttgtttgcagtt

SEQ ID NO: 264466 - DNA, 25 bp, Rattus norvegicus
ctcaacgagtgcatcatcaaactgc

SEQ ID NO: 264467 - DNA, 25 bp, Rattus norvegicus
ctcaacgagtgcttcatcaaactgc

SEQ ID NO: 264468 - DNA, 25 bp, Rattus norvegicus
ctcaacgtcataacacttcttaagt

SEQ ID NO: 264469 - DNA, 25 bp, Rattus norvegicus
ctcaacgtcatatcacttcttaagt

SEQ ID NO: 264470 - DNA, 25 bp, Rattus norvegicus
ctcaactatgttaagggacgtcctc

SEQ ID NO: 264471 - DNA, 25 bp, Rattus norvegicus
ctcaactatgtttagggacgtcctc

SEQ ID NO: 264472 - DNA, 25 bp, Rattus norvegicus
ctcaactcacatctgcgggttcctg

SEQ ID NO: 264473 - DNA, 25 bp, Rattus norvegicus
ctcaactcacatgtgcgggttcctg

SEQ ID NO: 264474 - DNA, 25 bp, Rattus norvegicus
ctcaactccccaattctaagaaacg

SEQ ID NO: 264475 - DNA, 25 bp, Rattus norvegicus
ctcaactccccatttctaagaaacg

SEQ ID NO: 264476 - DNA, 25 bp, Rattus norvegicus
ctcaactcctgcaatctttacagta

SEQ ID NO: 264477 - DNA, 25 bp, Rattus norvegicus
ctcaactcctgctatctttacagta

SEQ ID NO: 264478 - DNA, 25 bp, Rattus norvegicus
ctcaactctcaactaaatgccactg

SEQ ID NO: 264479 - DNA, 25 bp, Rattus norvegicus
ctcaactctcaagtaaatgccactg

SEQ ID NO: 264480 - DNA, 25 bp, Rattus norvegicus
ctcaactgaattccgtgacgtcact

SEQ ID NO: 264481 - DNA, 25 bp, Rattus norvegicus
ctcaactgaattgcgtgacgtcact

SEQ ID NO: 264482 - DNA, 25 bp, Rattus norvegicus
ctcaactgagttccccgagtattag

SEQ ID NO: 264483 - DNA, 25 bp, Rattus norvegicus
ctcaactgagttgcccgagtattag

SEQ ID NO: 264484 - DNA, 25 bp, Rattus norvegicus
ctcaactggttgatgtgtacactga

SEQ ID NO: 264485 - DNA, 25 bp, Rattus norvegicus
ctcaactggttgttgtgtacactga

SEQ ID NO: 264486 - DNA, 25 bp, Rattus norvegicus
ctcaacttagctccactgtgactta

SEQ ID NO: 264487 - DNA, 25 bp, Rattus norvegicus
ctcaacttagctgcactgtgactta

SEQ ID NO: 264488 - DNA, 25 bp, Rattus norvegicus
ctcaacttccctcctataaaactgt

SEQ ID NO: 264489 - DNA, 25 bp, Rattus norvegicus
ctcaacttccctgctataaaactgt

SEQ ID NO: 264490 - DNA, 25 bp, Rattus norvegicus
ctcaagaagttacactcccaaataa

SEQ ID NO: 264491 - DNA, 25 bp, Rattus norvegicus
ctcaagaagttagactcccaaataa

SEQ ID NO: 264492 - DNA, 25 bp, Rattus norvegicus
ctcaagacaaggaactagctatgcg

SEQ ID NO: 264493 - DNA, 25 bp, Rattus norvegicus
ctcaagacaaggtactagctatgcg

SEQ ID NO: 264494 - DNA, 25 bp, Rattus norvegicus
ctcaagacccatctgagctacagag

SEQ ID NO: 264495 - DNA, 25 bp, Rattus norvegicus
ctcaagacccatgtgagctacagag

SEQ ID NO: 264496 - DNA, 25 bp, Rattus norvegicus
ctcaagactttactgtttgctggta

SEQ ID NO: 264497 - DNA, 25 bp, Rattus norvegicus
ctcaagactttagtgtttgctggta

SEQ ID NO: 264498 - DNA, 25 bp, Rattus norvegicus
ctcaagactttgatccttggaaacc

SEQ ID NO: 264499 - DNA, 25 bp, Rattus norvegicus
ctcaagactttgttccttggaaacc

SEQ ID NO: 264500 - DNA, 25 bp, Rattus norvegicus
ctcaagagacttagggccacagaaa

SEQ ID NO: 264501 - DNA, 25 bp, Rattus norvegicus
ctcaagagactttgggccacagaaa

SEQ ID NO: 264502 - DNA, 25 bp, Rattus norvegicus
ctcaagcactgtatttccacgtttt

SEQ ID NO: 264503 - DNA, 25 bp, Rattus norvegicus
ctcaagcactgtttttccacgtttt

SEQ ID NO: 264504 - DNA, 25 bp, Rattus norvegicus
ctcaagcagagccacctgaacaagg

SEQ ID NO: 264505 - DNA, 25 bp, Rattus norvegicus
ctcaagcagagcgacctgaacaagg

SEQ ID NO: 264506 - DNA, 25 bp, Rattus norvegicus
ctcaagcaggctatggatgatcaga

SEQ ID NO: 264507 - DNA, 25 bp, Rattus norvegicus
ctcaagcaggctttggatgatcaga

SEQ ID NO: 264508 - DNA, 25 bp, Rattus norvegicus
ctcaagcatccaaggaatttcccct

SEQ ID NO: 264509 - DNA, 25 bp, Rattus norvegicus
ctcaagcatccatggaatttcccct

SEQ ID NO: 264510 - DNA, 25 bp, Rattus norvegicus
ctcaagcccgagctatgacttacat

SEQ ID NO: 264511 - DNA, 25 bp, Rattus norvegicus
ctcaagcccgaggtatgacttacat

SEQ ID NO: 264512 - DNA, 25 bp, Rattus norvegicus
ctcaagcccgtactcagcgaggaga

SEQ ID NO: 264513 - DNA, 25 bp, Rattus norvegicus
ctcaagcccgtagtcagcgaggaga

SEQ ID NO: 264514 - DNA, 25 bp, Rattus norvegicus
ctcaagccctggctgttcactgaga

SEQ ID NO: 264515 - DNA, 25 bp, Rattus norvegicus
ctcaagccctgggtgttcactgaga

SEQ ID NO: 264516 - DNA, 25 bp, Rattus norvegicus
ctcaagcctcttctaacagtggttt

SEQ ID NO: 264517 - DNA, 25 bp, Rattus norvegicus
ctcaagcctcttgtaacagtggttt

SEQ ID NO: 264518 - DNA, 25 bp, Rattus norvegicus
ctcaagcggttgacctaccagagtg

SEQ ID NO: 264519 - DNA, 25 bp, Rattus norvegicus
ctcaagcggttgtcctaccagagtg

SEQ ID NO: 264520 - DNA, 25 bp, Rattus norvegicus
ctcaagctacttaaactcattaatt

SEQ ID NO: 264521 - DNA, 25 bp, Rattus norvegicus
ctcaagctactttaactcattaatt

SEQ ID NO: 264522 - DNA, 25 bp, Rattus norvegicus
ctcaagctcccacgcttcagaaaat

SEQ ID NO: 264523 - DNA, 25 bp, Rattus norvegicus
ctcaagctcccaggcttcagaaaat

SEQ ID NO: 264524 - DNA, 25 bp, Rattus norvegicus
ctcaaggcacagatcatcacagcag

SEQ ID NO: 264525 - DNA, 25 bp, Rattus norvegicus
ctcaaggcacagttcatcacagcag

SEQ ID NO: 264526 - DNA, 25 bp, Rattus norvegicus
ctcaaggccaccacaactgtgaaat

SEQ ID NO: 264527 - DNA, 25 bp, Rattus norvegicus
ctcaaggccacctcaactgtgaaat

SEQ ID NO: 264528 - DNA, 25 bp, Rattus norvegicus
ctcaaggccctgagaacgaactgtg

SEQ ID NO: 264529 - DNA, 25 bp, Rattus norvegicus
ctcaaggccctgtgaacgaactgtg

SEQ ID NO: 264530 - DNA, 25 bp, Rattus norvegicus
ctcaaggcggcgatcagaagcagta

SEQ ID NO: 264531 - DNA, 25 bp, Rattus norvegicus
ctcaaggcggcgttcagaagcagta

SEQ ID NO: 264532 - DNA, 25 bp, Rattus norvegicus
ctcaagggcagactggcctcttttt

SEQ ID NO: 264533 - DNA, 25 bp, Rattus norvegicus
ctcaagggcagagtggcctcttttt

SEQ ID NO: 264534 - DNA, 25 bp, Rattus norvegicus
ctcaagggcagtcgcgagcgcggcg

SEQ ID NO: 264535 - DNA, 25 bp, Rattus norvegicus
ctcaagggcagtggcgagcgcggcg

SEQ ID NO: 264536 - DNA, 25 bp, Rattus norvegicus
ctcaagggccctcatttaactaata

SEQ ID NO: 264537 - DNA, 25 bp, Rattus norvegicus
ctcaagggccctgatttaactaata

SEQ ID NO: 264538 - DNA, 25 bp, Rattus norvegicus
ctcaagggcctccaggttatggcaa

SEQ ID NO: 264539 - DNA, 25 bp, Rattus norvegicus
ctcaagggcctcgaggttatggcaa

SEQ ID NO: 264540 - DNA, 25 bp, Rattus norvegicus
ctcaagggctgaagatctgggctga

SEQ ID NO: 264541 - DNA, 25 bp, Rattus norvegicus
ctcaagggctgatgatctgggctga

SEQ ID NO: 264542 - DNA, 25 bp, Rattus norvegicus
ctcaagggttaaaagcagttctcaa

SEQ ID NO: 264543 - DNA, 25 bp, Rattus norvegicus
ctcaagggttaatagcagttctcaa

SEQ ID NO: 264544 - DNA, 25 bp, Rattus norvegicus
ctcaaggtcaagaccttggtaccag

SEQ ID NO: 264545 - DNA, 25 bp, Rattus norvegicus
ctcaaggtcaagtccttggtaccag

SEQ ID NO: 264546 - DNA, 25 bp, Rattus norvegicus
ctcaaggtccttctggcaactatgg

SEQ ID NO: 264547 - DNA, 25 bp, Rattus norvegicus
ctcaaggtccttgtggcaactatgg

SEQ ID NO: 264548 - DNA, 25 bp, Rattus norvegicus
ctcaaggtggccagacgaaggtgtc

SEQ ID NO: 264549 - DNA, 25 bp, Rattus norvegicus
ctcaaggtggcctgacgaaggtgtc

SEQ ID NO: 264550 - DNA, 25 bp, Rattus norvegicus
ctcaaggttggacagcatacagcaa

SEQ ID NO: 264551 - DNA, 25 bp, Rattus norvegicus
ctcaaggttggagagcatacagcaa

SEQ ID NO: 264552 - DNA, 25 bp, Rattus norvegicus
ctcaagtaaaatcttaggcctctag

SEQ ID NO: 264553 - DNA, 25 bp, Rattus norvegicus
ctcaagtaaaatgttaggcctctag

SEQ ID NO: 264554 - DNA, 25 bp, Rattus norvegicus
ctcaagtcccatatataatcctgtg

SEQ ID NO: 264555 - DNA, 25 bp, Rattus norvegicus
ctcaagtcccatttataatcctgtg

SEQ ID NO: 264556 - DNA, 25 bp, Rattus norvegicus
ctcaagtcgtcgctggacaaatatt

SEQ ID NO: 264557 - DNA, 25 bp, Rattus norvegicus
ctcaagtcgtcggtggacaaatatt

SEQ ID NO: 264558 - DNA, 25 bp, Rattus norvegicus
ctcaagtgagagcttcggctgtgtc

SEQ ID NO: 264559 - DNA, 25 bp, Rattus norvegicus
ctcaagtgagaggttcggctgtgtc

SEQ ID NO: 264560 - DNA, 25 bp, Rattus norvegicus
ctcaagtgctggaatcaaaggtatg

SEQ ID NO: 264561 - DNA, 25 bp, Rattus norvegicus
ctcaagtgctggtatcaaaggtatg

SEQ ID NO: 264562 - DNA, 25 bp, Rattus norvegicus
ctcaagttcaagctccaggtccagg

SEQ ID NO: 264563 - DNA, 25 bp, Rattus norvegicus
ctcaagttcaaggtccaggtccagg

SEQ ID NO: 264564 - DNA, 25 bp, Rattus norvegicus
ctcaagttccagcattcggttcctt

SEQ ID NO: 264565 - DNA, 25 bp, Rattus norvegicus
ctcaagttccaggattcggttcctt

SEQ ID NO: 264566 - DNA, 25 bp, Rattus norvegicus
ctcaagttgcaaaggtttctctgtt

SEQ ID NO: 264567 - DNA, 25 bp, Rattus norvegicus
ctcaagttgcaatggtttctctgtt

SEQ ID NO: 264568 - DNA, 25 bp, Rattus norvegicus
ctcaataaccctcatgtagaccaga

SEQ ID NO: 264569 - DNA, 25 bp, Rattus norvegicus
ctcaataaccctgatgtagaccaga

SEQ ID NO: 264570 - DNA, 25 bp, Rattus norvegicus
ctcaatagttaacagccctggctac

SEQ ID NO: 264571 - DNA, 25 bp, Rattus norvegicus
ctcaatagttaagagccctggctac

SEQ ID NO: 264572 - DNA, 25 bp, Rattus norvegicus
ctcaatccatggagcaaacgtgttt

SEQ ID NO: 264573 - DNA, 25 bp, Rattus norvegicus
ctcaatccatggtgcaaacgtgttt

SEQ ID NO: 264574 - DNA, 25 bp, Rattus norvegicus
ctcaatctcttaattgctgtgtcaa

SEQ ID NO: 264575 - DNA, 25 bp, Rattus norvegicus
ctcaatctcttatttgctgtgtcaa

SEQ ID NO: 264576 - DNA, 25 bp, Rattus norvegicus
ctcaatgacaacattgtgaagctca

SEQ ID NO: 264577 - DNA, 25 bp, Rattus norvegicus
ctcaatgacaactttgtgaagctca

SEQ ID NO: 264578 - DNA, 25 bp, Rattus norvegicus
ctcaatgagctgaagcgccgaggca

SEQ ID NO: 264579 - DNA, 25 bp, Rattus norvegicus
ctcaatgagctgtagcgccgaggca

SEQ ID NO: 264580 - DNA, 25 bp, Rattus norvegicus
ctcaatgaggccagaattttctttc

SEQ ID NO: 264581 - DNA, 25 bp, Rattus norvegicus
ctcaatgaggcctgaattttctttc

SEQ ID NO: 264582 - DNA, 25 bp, Rattus norvegicus
ctcaatgctttgcacctgttttttc

SEQ ID NO: 264583 - DNA, 25 bp, Rattus norvegicus
ctcaatgctttggacctgttttttc

SEQ ID NO: 264584 - DNA, 25 bp, Rattus norvegicus
ctcaatgtaaagaaggtggcccctt

SEQ ID NO: 264585 - DNA, 25 bp, Rattus norvegicus
ctcaatgtaaagtaggtggcccctt

SEQ ID NO: 264586 - DNA, 25 bp, Rattus norvegicus
ctcaattcccttctagctcagactg

SEQ ID NO: 264587 - DNA, 25 bp, Rattus norvegicus
ctcaattcccttgtagctcagactg

SEQ ID NO: 264588 - DNA, 25 bp, Rattus norvegicus
ctcaattcttatcttttgggcgcga

SEQ ID NO: 264589 - DNA, 25 bp, Rattus norvegicus
ctcaattcttatgttttgggcgcga

SEQ ID NO: 264590 - DNA, 25 bp, Rattus norvegicus
ctcaatttctcacctcatcaagtaa

SEQ ID NO: 264591 - DNA, 25 bp, Rattus norvegicus
ctcaatttctcagctcatcaagtaa

SEQ ID NO: 264592 - DNA, 25 bp, Rattus norvegicus
ctcacaaatcggcaggagttatcat

SEQ ID NO: 264593 - DNA, 25 bp, Rattus norvegicus
ctcacaaatcgggaggagttatcat

SEQ ID NO: 264594 - DNA, 25 bp, Rattus norvegicus
ctcacaaccttcatctctatgtttg

SEQ ID NO: 264595 - DNA, 25 bp, Rattus norvegicus
ctcacaaccttcttctctatgtttg

SEQ ID NO: 264596 - DNA, 25 bp, Rattus norvegicus
ctcacacacattaggcccagatagg

SEQ ID NO: 264597 - DNA, 25 bp, Rattus norvegicus
ctcacacacatttggcccagatagg

SEQ ID NO: 264598 - DNA, 25 bp, Rattus norvegicus
ctcacacatgccctgtggtcactgt

SEQ ID NO: 264599 - DNA, 25 bp, Rattus norvegicus
ctcacacatgccgtgtggtcactgt

SEQ ID NO: 264600 - DNA, 25 bp, Rattus norvegicus
ctcacaccagaacagactattgaaa

SEQ ID NO: 264601 - DNA, 25 bp, Rattus norvegicus
ctcacaccagaagagactattgaaa

SEQ ID NO: 264602 - DNA, 25 bp, Rattus norvegicus
ctcacaccagcaatctctagggagt

SEQ ID NO: 264603 - DNA, 25 bp, Rattus norvegicus
ctcacaccagcattctctagggagt

SEQ ID NO: 264604 - DNA, 25 bp, Rattus norvegicus
ctcacacccatcataaacttcattg

SEQ ID NO: 264605 - DNA, 25 bp, Rattus norvegicus
ctcacacccatcttaaacttcattg

SEQ ID NO: 264606 - DNA, 25 bp, Rattus norvegicus
ctcacacccttgacctatatgtagt

SEQ ID NO: 264607 - DNA, 25 bp, Rattus norvegicus
ctcacacccttgtcctatatgtagt

SEQ ID NO: 264608 - DNA, 25 bp, Rattus norvegicus
ctcacacctctgcattctgatagaa

SEQ ID NO: 264609 - DNA, 25 bp, Rattus norvegicus
ctcacacctctggattctgatagaa

SEQ ID NO: 264610 - DNA, 25 bp, Rattus norvegicus
ctcacactacgaccaggtcatgact

SEQ ID NO: 264611 - DNA, 25 bp, Rattus norvegicus
ctcacactacgagcaggtcatgact

SEQ ID NO: 264612 - DNA, 25 bp, Rattus norvegicus
ctcacactctgcaacatgatcatca

SEQ ID NO: 264613 - DNA, 25 bp, Rattus norvegicus
ctcacactctgctacatgatcatca

SEQ ID NO: 264614 - DNA, 25 bp, Rattus norvegicus
ctcacacttaggagatgcctgggtt

SEQ ID NO: 264615 - DNA, 25 bp, Rattus norvegicus
ctcacacttaggtgatgcctgggtt

SEQ ID NO: 264616 - DNA, 25 bp, Rattus norvegicus
ctcacagaaacaagccggattatat

SEQ ID NO: 264617 - DNA, 25 bp, Rattus norvegicus
ctcacagaaacatgccggattatat

SEQ ID NO: 264618 - DNA, 25 bp, Rattus norvegicus
ctcacagaaattcagggccccttat

SEQ ID NO: 264619 - DNA, 25 bp, Rattus norvegicus
ctcacagaaattgagggccccttat

SEQ ID NO: 264620 - DNA, 25 bp, Rattus norvegicus
ctcacagaatggagtcgtatccttt

SEQ ID NO: 264621 - DNA, 25 bp, Rattus norvegicus
ctcacagaatggtgtcgtatccttt

SEQ ID NO: 264622 - DNA, 25 bp, Rattus norvegicus
ctcacagagccacgccaggtgaagc

SEQ ID NO: 264623 - DNA, 25 bp, Rattus norvegicus
ctcacagagccaggccaggtgaagc

SEQ ID NO: 264624 - DNA, 25 bp, Rattus norvegicus
ctcacagaggacactggtgccagcg

SEQ ID NO: 264625 - DNA, 25 bp, Rattus norvegicus
ctcacagaggactctggtgccagcg

SEQ ID NO: 264626 - DNA, 25 bp, Rattus norvegicus
ctcacagaggtcacgtggatgccgt

SEQ ID NO: 264627 - DNA, 25 bp, Rattus norvegicus
ctcacagaggtctcgtggatgccgt

SEQ ID NO: 264628 - DNA, 25 bp, Rattus norvegicus
ctcacagatctgcacccgggaaaag

SEQ ID NO: 264629 - DNA, 25 bp, Rattus norvegicus
ctcacagatctggacccgggaaaag

SEQ ID NO: 264630 - DNA, 25 bp, Rattus norvegicus
ctcacagattccagcgtcggaacaa

SEQ ID NO: 264631 - DNA, 25 bp, Rattus norvegicus
ctcacagattcctgcgtcggaacaa

SEQ ID NO: 264632 - DNA, 25 bp, Rattus norvegicus
ctcacagccctgatcatttcaagtt

SEQ ID NO: 264633 - DNA, 25 bp, Rattus norvegicus
ctcacagccctgttcatttcaagtt

SEQ ID NO: 264634 - DNA, 25 bp, Rattus norvegicus
ctcacagccttgaatgtgtgcgtgc

SEQ ID NO: 264635 - DNA, 25 bp, Rattus norvegicus
ctcacagccttgtatgtgtgcgtgc

SEQ ID NO: 264636 - DNA, 25 bp, Rattus norvegicus
ctcacagcgggacgaacttggtgta

SEQ ID NO: 264637 - DNA, 25 bp, Rattus norvegicus
ctcacagcgggaggaacttggtgta

SEQ ID NO: 264638 - DNA, 25 bp, Rattus norvegicus
ctcacaggaggcaagcgctatccaa

SEQ ID NO: 264639 - DNA, 25 bp, Rattus norvegicus
ctcacaggaggctagcgctatccaa

SEQ ID NO: 264640 - DNA, 25 bp, Rattus norvegicus
ctcacaggctgactcggacgagaga

SEQ ID NO: 264641 - DNA, 25 bp, Rattus norvegicus
ctcacaggctgagtcggacgagaga

SEQ ID NO: 264642 - DNA, 25 bp, Rattus norvegicus
ctcacaggctggcatgacaggctat

SEQ ID NO: 264643 - DNA, 25 bp, Rattus norvegicus
ctcacaggctgggatgacaggctat

SEQ ID NO: 264644 - DNA, 25 bp, Rattus norvegicus
ctcacagggagtattcatttggtaa

SEQ ID NO: 264645 - DNA, 25 bp, Rattus norvegicus
ctcacagggagttttcatttggtaa

SEQ ID NO: 264646 - DNA, 25 bp, Rattus norvegicus
ctcacagggattaaatcaccaccaa

SEQ ID NO: 264647 - DNA, 25 bp, Rattus norvegicus
ctcacagggatttaatcaccaccaa

SEQ ID NO: 264648 - DNA, 25 bp, Rattus norvegicus
ctcacagtagtgcaggctggcagtt

SEQ ID NO: 264649 - DNA, 25 bp, Rattus norvegicus
ctcacagtagtggaggctggcagtt

SEQ ID NO: 264650 - DNA, 25 bp, Rattus norvegicus
ctcacagtcagcagggttgtcatcc

SEQ ID NO: 264651 - DNA, 25 bp, Rattus norvegicus
ctcacagtcagctgggttgtcatcc

SEQ ID NO: 264652 - DNA, 25 bp, Rattus norvegicus
ctcacagtggagctctttgcatcaa

SEQ ID NO: 264653 - DNA, 25 bp, Rattus norvegicus
ctcacagtggaggtctttgcatcaa

SEQ ID NO: 264654 - DNA, 25 bp, Rattus norvegicus
ctcacagttcacctgtacagtagaa

SEQ ID NO: 264655 - DNA, 25 bp, Rattus norvegicus
ctcacagttcacgtgtacagtagaa

SEQ ID NO: 264656 - DNA, 25 bp, Rattus norvegicus
ctcacagttccgcaagccttataag

SEQ ID NO: 264657 - DNA, 25 bp, Rattus norvegicus
ctcacagttccggaagccttataag

SEQ ID NO: 264658 - DNA, 25 bp, Rattus norvegicus
ctcacatagtggcagtatcattccc

SEQ ID NO: 264659 - DNA, 25 bp, Rattus norvegicus
ctcacatagtgggagtatcattccc

SEQ ID NO: 264660 - DNA, 25 bp, Rattus norvegicus
ctcacatcactgaataatttctcat

SEQ ID NO: 264661 - DNA, 25 bp, Rattus norvegicus
ctcacatcactgtataatttctcat

SEQ ID NO: 264662 - DNA, 25 bp, Rattus norvegicus
ctcacatctaccagtttgtcacaga

SEQ ID NO: 264663 - DNA, 25 bp, Rattus norvegicus
ctcacatctacctgtttgtcacaga

SEQ ID NO: 264664 - DNA, 25 bp, Rattus norvegicus
ctcacatctccacggtacacaggga

SEQ ID NO: 264665 - DNA, 25 bp, Rattus norvegicus
ctcacatctccagggtacacaggga

SEQ ID NO: 264666 - DNA, 25 bp, Rattus norvegicus
ctcacatgcgtgcaccatggtgtat

SEQ ID NO: 264667 - DNA, 25 bp, Rattus norvegicus
ctcacatgcgtggaccatggtgtat

SEQ ID NO: 264668 - DNA, 25 bp, Rattus norvegicus
ctcacattaagacaggcctagacct

SEQ ID NO: 264669 - DNA, 25 bp, Rattus norvegicus
ctcacattaagagaggcctagacct

SEQ ID NO: 264670 - DNA, 25 bp, Rattus norvegicus
ctcacattgcacattaagtggcggg

SEQ ID NO: 264671 - DNA, 25 bp, Rattus norvegicus
ctcacattgcactttaagtggcggg

SEQ ID NO: 264672 - DNA, 25 bp, Rattus norvegicus
ctcacattgcatcacagctgactga

SEQ ID NO: 264673 - DNA, 25 bp, Rattus norvegicus
ctcacattgcatgacagctgactga

SEQ ID NO: 264674 - DNA, 25 bp, Rattus norvegicus
ctcacattgcctatctgtcaaatac

SEQ ID NO: 264675 - DNA, 25 bp, Rattus norvegicus
ctcacattgcctttctgtcaaatac

SEQ ID NO: 264676 - DNA, 25 bp, Rattus norvegicus
ctcaccaactgcacctcagaaaaaa

SEQ ID NO: 264677 - DNA, 25 bp, Rattus norvegicus
ctcaccaactgctcctcagaaaaaa

SEQ ID NO: 264678 - DNA, 25 bp, Rattus norvegicus
ctcaccaacttgactgcttaacatg

SEQ ID NO: 264679 - DNA, 25 bp, Rattus norvegicus
ctcaccaacttgtctgcttaacatg

SEQ ID NO: 264680 - DNA, 25 bp, Rattus norvegicus
ctcaccaagttcatcgctgtcaaga

SEQ ID NO: 264681 - DNA, 25 bp, Rattus norvegicus
ctcaccaagttcttcgctgtcaaga

SEQ ID NO: 264682 - DNA, 25 bp, Rattus norvegicus
ctcaccacataaaaccttctgctgt

SEQ ID NO: 264683 - DNA, 25 bp, Rattus norvegicus
ctcaccacataataccttctgctgt

SEQ ID NO: 264684 - DNA, 25 bp, Rattus norvegicus
ctcaccacatggcttttgtcctaaa

SEQ ID NO: 264685 - DNA, 25 bp, Rattus norvegicus
ctcaccacatgggttttgtcctaaa

SEQ ID NO: 264686 - DNA, 25 bp, Rattus norvegicus
ctcaccaccattataacgtccaatg

SEQ ID NO: 264687 - DNA, 25 bp, Rattus norvegicus
ctcaccaccattttaacgtccaatg

SEQ ID NO: 264688 - DNA, 25 bp, Rattus norvegicus
ctcaccaccgccattgaaatggaag

SEQ ID NO: 264689 - DNA, 25 bp, Rattus norvegicus
ctcaccaccgcctttgaaatggaag

SEQ ID NO: 264690 - DNA, 25 bp, Rattus norvegicus
ctcaccacctccatagatgtataaa

SEQ ID NO: 264691 - DNA, 25 bp, Rattus norvegicus
ctcaccacctccttagatgtataaa

SEQ ID NO: 264692 - DNA, 25 bp, Rattus norvegicus
ctcaccacgggtactaagttcactt

SEQ ID NO: 264693 - DNA, 25 bp, Rattus norvegicus
ctcaccacgggttctaagttcactt

SEQ ID NO: 264694 - DNA, 25 bp, Rattus norvegicus
ctcaccagccttcaattgtggtctc

SEQ ID NO: 264695 - DNA, 25 bp, Rattus norvegicus
ctcaccagccttgaattgtggtctc

SEQ ID NO: 264696 - DNA, 25 bp, Rattus norvegicus
ctcaccagtgtgcatatgggcaagg

SEQ ID NO: 264697 - DNA, 25 bp, Rattus norvegicus
ctcaccagtgtggatatgggcaagg

SEQ ID NO: 264698 - DNA, 25 bp, Rattus norvegicus
ctcaccatcgtgctacacttagaga

SEQ ID NO: 264699 - DNA, 25 bp, Rattus norvegicus
ctcaccatcgtggtacacttagaga

SEQ ID NO: 264700 - DNA, 25 bp, Rattus norvegicus
ctcaccatgatcacacagagagcaa

SEQ ID NO: 264701 - DNA, 25 bp, Rattus norvegicus
ctcaccatgatctcacagagagcaa

SEQ ID NO: 264702 - DNA, 25 bp, Rattus norvegicus
ctcaccatgctgcagttttttgcag

SEQ ID NO: 264703 - DNA, 25 bp, Rattus norvegicus
ctcaccatgctggagttttttgcag

SEQ ID NO: 264704 - DNA, 25 bp, Rattus norvegicus
ctcaccatgggaagcactgctgttt

SEQ ID NO: 264705 - DNA, 25 bp, Rattus norvegicus
ctcaccatgggatgcactgctgttt

SEQ ID NO: 264706 - DNA, 25 bp, Rattus norvegicus
ctcaccatggttccagcacaaagca

SEQ ID NO: 264707 - DNA, 25 bp, Rattus norvegicus
ctcaccatggttgcagcacaaagca

SEQ ID NO: 264708 - DNA, 25 bp, Rattus norvegicus
ctcaccattcccctgggcaaaatat

SEQ ID NO: 264709 - DNA, 25 bp, Rattus norvegicus
ctcaccattcccgtgggcaaaatat

SEQ ID NO: 264710 - DNA, 25 bp, Rattus norvegicus
ctcacccacatgctgaagatctttg

SEQ ID NO: 264711 - DNA, 25 bp, Rattus norvegicus
ctcacccacatggtgaagatctttg

SEQ ID NO: 264712 - DNA, 25 bp, Rattus norvegicus
ctcacccaccagatttagtcagaaa

SEQ ID NO: 264713 - DNA, 25 bp, Rattus norvegicus
ctcacccaccagttttagtcagaaa

SEQ ID NO: 264714 - DNA, 25 bp, Rattus norvegicus
ctcacccactgacctctgaattagg

SEQ ID NO: 264715 - DNA, 25 bp, Rattus norvegicus
ctcacccactgagctctgaattagg

SEQ ID NO: 264716 - DNA, 25 bp, Rattus norvegicus
ctcacccatagcctgcataagtggt

SEQ ID NO: 264717 - DNA, 25 bp, Rattus norvegicus
ctcacccatagcgtgcataagtggt

SEQ ID NO: 264718 - DNA, 25 bp, Rattus norvegicus
ctcacccatttccaaatctcatagt

SEQ ID NO: 264719 - DNA, 25 bp, Rattus norvegicus
ctcacccatttcgaaatctcatagt

SEQ ID NO: 264720 - DNA, 25 bp, Rattus norvegicus
ctcaccccatgtcctttttacaata

SEQ ID NO: 264721 - DNA, 25 bp, Rattus norvegicus
ctcaccccatgtgctttttacaata

SEQ ID NO: 264722 - DNA, 25 bp, Rattus norvegicus
ctcacccgaagcagggctggcgcag

SEQ ID NO: 264723 - DNA, 25 bp, Rattus norvegicus
ctcacccgaagctgggctggcgcag

SEQ ID NO: 264724 - DNA, 25 bp, Rattus norvegicus
ctcaccctgggtatggtacatgtta

SEQ ID NO: 264725 - DNA, 25 bp, Rattus norvegicus
ctcaccctgggtttggtacatgtta

SEQ ID NO: 264726 - DNA, 25 bp, Rattus norvegicus
ctcaccctggtgagaatccttagga

SEQ ID NO: 264727 - DNA, 25 bp, Rattus norvegicus
ctcaccctggtgtgaatccttagga

SEQ ID NO: 264728 - DNA, 25 bp, Rattus norvegicus
ctcaccctgtggcatattcacatat

SEQ ID NO: 264729 - DNA, 25 bp, Rattus norvegicus
ctcaccctgtgggatattcacatat

SEQ ID NO: 264730 - DNA, 25 bp, Rattus norvegicus
ctcacccttctgcttaatctgggat

SEQ ID NO: 264731 - DNA, 25 bp, Rattus norvegicus
ctcacccttctggttaatctgggat

SEQ ID NO: 264732 - DNA, 25 bp, Rattus norvegicus
ctcaccggtggaattggactggaca

SEQ ID NO: 264733 - DNA, 25 bp, Rattus norvegicus
ctcaccggtggatttggactggaca

SEQ ID NO: 264734 - DNA, 25 bp, Rattus norvegicus
ctcacctcagatcacgttttgttta

SEQ ID NO: 264735 - DNA, 25 bp, Rattus norvegicus
ctcacctcagatgacgttttgttta

SEQ ID NO: 264736 - DNA, 25 bp, Rattus norvegicus
ctcacctcgggaatgtctggatgtt

SEQ ID NO: 264737 - DNA, 25 bp, Rattus norvegicus
ctcacctcgggattgtctggatgtt

SEQ ID NO: 264738 - DNA, 25 bp, Rattus norvegicus
ctcacctctcacaaagcagtttgtt

SEQ ID NO: 264739 - DNA, 25 bp, Rattus norvegicus
ctcacctctcactaagcagtttgtt

SEQ ID NO: 264740 - DNA, 25 bp, Rattus norvegicus
ctcacctctctgctgcggtgataaa

SEQ ID NO: 264741 - DNA, 25 bp, Rattus norvegicus
ctcacctctctggtgcggtgataaa

SEQ ID NO: 264742 - DNA, 25 bp, Rattus norvegicus
ctcacctcttcaagtgtcttcaaag

SEQ ID NO: 264743 - DNA, 25 bp, Rattus norvegicus
ctcacctcttcatgtgtcttcaaag

SEQ ID NO: 264744 - DNA, 25 bp, Rattus norvegicus
ctcacctgccagaacttttttggaa

SEQ ID NO: 264745 - DNA, 25 bp, Rattus norvegicus
ctcacctgccagtacttttttggaa

SEQ ID NO: 264746 - DNA, 25 bp, Rattus norvegicus
ctcacctgcggacgcacatggagat

SEQ ID NO: 264747 - DNA, 25 bp, Rattus norvegicus
ctcacctgcggaggcacatggagat

SEQ ID NO: 264748 - DNA, 25 bp, Rattus norvegicus
ctcacctggattaacaaagcacttc

SEQ ID NO: 264749 - DNA, 25 bp, Rattus norvegicus
ctcacctggatttacaaagcacttc

SEQ ID NO: 264750 - DNA, 25 bp, Rattus norvegicus
ctcacctgtggtcccataaacgttt

SEQ ID NO: 264751 - DNA, 25 bp, Rattus norvegicus
ctcacctgtggtgccataaacgttt

SEQ ID NO: 264752 - DNA, 25 bp, Rattus norvegicus
ctcacctgtttaacatgccaactct

SEQ ID NO: 264753 - DNA, 25 bp, Rattus norvegicus
ctcacctgtttatcatgccaactct

SEQ ID NO: 264754 - DNA, 25 bp, Rattus norvegicus
ctcaccttacttagcagttctcaga

SEQ ID NO: 264755 - DNA, 25 bp, Rattus norvegicus
ctcaccttactttgcagttctcaga

SEQ ID NO: 264756 - DNA, 25 bp, Rattus norvegicus
ctcaccttaggtatgtaggcataaa

SEQ ID NO: 264757 - DNA, 25 bp, Rattus norvegicus
ctcaccttaggtttgtaggcataaa

SEQ ID NO: 264758 - DNA, 25 bp, Rattus norvegicus
ctcaccttcatcacagactggtaag

SEQ ID NO: 264759 - DNA, 25 bp, Rattus norvegicus
ctcaccttcatctcagactggtaag

SEQ ID NO: 264760 - DNA, 25 bp, Rattus norvegicus
ctcaccttccagcagatcaaacagg

SEQ ID NO: 264761 - DNA, 25 bp, Rattus norvegicus
ctcaccttccaggagatcaaacagg

SEQ ID NO: 264762 - DNA, 25 bp, Rattus norvegicus
ctcaccttccctactttctggttat

SEQ ID NO: 264763 - DNA, 25 bp, Rattus norvegicus
ctcaccttcccttctttctggttat

SEQ ID NO: 264764 - DNA, 25 bp, Rattus norvegicus
ctcaccttctacaacatcattttct

SEQ ID NO: 264765 - DNA, 25 bp, Rattus norvegicus
ctcaccttctactacatcattttct

SEQ ID NO: 264766 - DNA, 25 bp, Rattus norvegicus
ctcaccttggagactcctgtatgga

SEQ ID NO: 264767 - DNA, 25 bp, Rattus norvegicus
ctcaccttggagtctcctgtatgga

SEQ ID NO: 264768 - DNA, 25 bp, Rattus norvegicus
ctcaccttgtatacactgtgtacac

SEQ ID NO: 264769 - DNA, 25 bp, Rattus norvegicus
ctcaccttgtattcactgtgtacac

SEQ ID NO: 264770 - DNA, 25 bp, Rattus norvegicus
ctcacctttccgattcatagacaaa

SEQ ID NO: 264771 - DNA, 25 bp, Rattus norvegicus
ctcacctttccgtttcatagacaaa

SEQ ID NO: 264772 - DNA, 25 bp, Rattus norvegicus
ctcacctttgagagcatcatgtaaa

SEQ ID NO: 264773 - DNA, 25 bp, Rattus norvegicus
ctcacctttgagtgcatcatgtaaa

SEQ ID NO: 264774 - DNA, 25 bp, Rattus norvegicus
ctcacgagctcacccgaggagtcgg

SEQ ID NO: 264775 - DNA, 25 bp, Rattus norvegicus
ctcacgagctcagccgaggagtcgg

SEQ ID NO: 264776 - DNA, 25 bp, Rattus norvegicus
ctcacgctcctgaactttcaaaaag

SEQ ID NO: 264777 - DNA, 25 bp, Rattus norvegicus
ctcacgctcctgtactttcaaaaag

SEQ ID NO: 264778 - DNA, 25 bp, Rattus norvegicus
ctcacgctctcgatggcggtggccg

SEQ ID NO: 264779 - DNA, 25 bp, Rattus norvegicus
ctcacgctctcgttggcggtggccg

SEQ ID NO: 264780 - DNA, 25 bp, Rattus norvegicus
ctcacggagcctcggtctatcaagg

SEQ ID NO: 264781 - DNA, 25 bp, Rattus norvegicus
ctcacggagcctgggtctatcaagg

SEQ ID NO: 264782 - DNA, 25 bp, Rattus norvegicus
ctcacggctgatcctcagtggaaat

SEQ ID NO: 264783 - DNA, 25 bp, Rattus norvegicus
ctcacggctgatgctcagtggaaat

SEQ ID NO: 264784 - DNA, 25 bp, Rattus norvegicus
ctcacggctggtctacttgtgtgtt

SEQ ID NO: 264785 - DNA, 25 bp, Rattus norvegicus
ctcacggctggtgtacttgtgtgtt

SEQ ID NO: 264786 - DNA, 25 bp, Rattus norvegicus
ctcacggttgatactttaccctaca

SEQ ID NO: 264787 - DNA, 25 bp, Rattus norvegicus
ctcacggttgattctttaccctaca

SEQ ID NO: 264788 - DNA, 25 bp, Rattus norvegicus
ctcacggttggaagcaaaggcatct

SEQ ID NO: 264789 - DNA, 25 bp, Rattus norvegicus
ctcacggttggatgcaaaggcatct

SEQ ID NO: 264790 - DNA, 25 bp, Rattus norvegicus
ctcacgtctctcaaatgcacaggta

SEQ ID NO: 264791 - DNA, 25 bp, Rattus norvegicus
ctcacgtctctctaatgcacaggta

SEQ ID NO: 264792 - DNA, 25 bp, Rattus norvegicus
ctcacgttcaacctactttactgta

SEQ ID NO: 264793 - DNA, 25 bp, Rattus norvegicus
ctcacgttcaacgtactttactgta

SEQ ID NO: 264794 - DNA, 25 bp, Rattus norvegicus
ctcacgttctggatcgccattagaa

SEQ ID NO: 264795 - DNA, 25 bp, Rattus norvegicus
ctcacgttctggttcgccattagaa

SEQ ID NO: 264796 - DNA, 25 bp, Rattus norvegicus
ctcacgttgaggacacctgttgata

SEQ ID NO: 264797 - DNA, 25 bp, Rattus norvegicus
ctcacgttgaggtcacctgttgata

SEQ ID NO: 264798 - DNA, 25 bp, Rattus norvegicus
ctcacgtttccactcacaacagtgg

SEQ ID NO: 264799 - DNA, 25 bp, Rattus norvegicus
ctcacgtttccagtcacaacagtgg

SEQ ID NO: 264800 - DNA, 25 bp, Rattus norvegicus
ctcactacatttcgatccctggaac

SEQ ID NO: 264801 - DNA, 25 bp, Rattus norvegicus
ctcactacatttggatccctggaac

SEQ ID NO: 264802 - DNA, 25 bp, Rattus norvegicus
ctcactacgtcaccatttttaactg

SEQ ID NO: 264803 - DNA, 25 bp, Rattus norvegicus
ctcactacgtcagcatttttaactg

SEQ ID NO: 264804 - DNA, 25 bp, Rattus norvegicus
ctcactacttccaagtactgactga

SEQ ID NO: 264805 - DNA, 25 bp, Rattus norvegicus
ctcactacttcctagtactgactga

SEQ ID NO: 264806 - DNA, 25 bp, Rattus norvegicus
ctcactagaaaaccagctctgctgc

SEQ ID NO: 264807 - DNA, 25 bp, Rattus norvegicus
ctcactagaaaagcagctctgctgc

SEQ ID NO: 264808 - DNA, 25 bp, Rattus norvegicus
ctcactcactgccaagatgaccaaa

SEQ ID NO: 264809 - DNA, 25 bp, Rattus norvegicus
ctcactcactgcgaagatgaccaaa

SEQ ID NO: 264810 - DNA, 25 bp, Rattus norvegicus
ctcactcagggcatctctagaaagg

SEQ ID NO: 264811 - DNA, 25 bp, Rattus norvegicus
ctcactcagggcttctctagaaagg

SEQ ID NO: 264812 - DNA, 25 bp, Rattus norvegicus
ctcactccccagatgaatatgccat

SEQ ID NO: 264813 - DNA, 25 bp, Rattus norvegicus
ctcactccccagttgaatatgccat

SEQ ID NO: 264814 - DNA, 25 bp, Rattus norvegicus
ctcactccccatattgatacatttg

SEQ ID NO: 264815 - DNA, 25 bp, Rattus norvegicus
ctcactccccattttgatacatttg

SEQ ID NO: 264816 - DNA, 25 bp, Rattus norvegicus
ctcactccccttatcagatttgtat

SEQ ID NO: 264817 - DNA, 25 bp, Rattus norvegicus
ctcactccccttttcagatttgtat

SEQ ID NO: 264818 - DNA, 25 bp, Rattus norvegicus
ctcactcctgagacatgtcgattga

SEQ ID NO: 264819 - DNA, 25 bp, Rattus norvegicus
ctcactcctgagtcatgtcgattga

SEQ ID NO: 264820 - DNA, 25 bp, Rattus norvegicus
ctcactccttgaactcttaatctaa

SEQ ID NO: 264821 - DNA, 25 bp, Rattus norvegicus
ctcactccttgatctcttaatctaa

SEQ ID NO: 264822 - DNA, 25 bp, Rattus norvegicus
ctcactcctttcacaacacaaaaga

SEQ ID NO: 264823 - DNA, 25 bp, Rattus norvegicus
ctcactcctttctcaacacaaaaga

SEQ ID NO: 264824 - DNA, 25 bp, Rattus norvegicus
ctcactccttttaatgctcaatgct

SEQ ID NO: 264825 - DNA, 25 bp, Rattus norvegicus
ctcactccttttctctgattgttaa

SEQ ID NO: 264826 - DNA, 25 bp, Rattus norvegicus
ctcactccttttgtctgattgttaa

SEQ ID NO: 264827 - DNA, 25 bp, Rattus norvegicus
ctcactcctttttatgctcaatgct

SEQ ID NO: 264828 - DNA, 25 bp, Rattus norvegicus
ctcactcgatagctttatgcgggtt

SEQ ID NO: 264829 - DNA, 25 bp, Rattus norvegicus
ctcactcgataggtttatgcgggtt

SEQ ID NO: 264830 - DNA, 25 bp, Rattus norvegicus
ctcactctctgtaccacaaacatag

SEQ ID NO: 264831 - DNA, 25 bp, Rattus norvegicus
ctcactctctgttccacaaacatag

SEQ ID NO: 264832 - DNA, 25 bp, Rattus norvegicus
ctcactctggagaatagcctgggat

SEQ ID NO: 264833 - DNA, 25 bp, Rattus norvegicus
ctcactctggagtatagcctgggat

SEQ ID NO: 264834 - DNA, 25 bp, Rattus norvegicus
ctcactcttcagcatcttgttacaa

SEQ ID NO: 264835 - DNA, 25 bp, Rattus norvegicus
ctcactcttcaggatcttgttacaa

SEQ ID NO: 264836 - DNA, 25 bp, Rattus norvegicus
ctcactcttcttcctgaggaaggag

SEQ ID NO: 264837 - DNA, 25 bp, Rattus norvegicus
ctcactcttcttcggatcggtgaaa

SEQ ID NO: 264838 - DNA, 25 bp, Rattus norvegicus
ctcactcttcttgctgaggaaggag

SEQ ID NO: 264839 - DNA, 25 bp, Rattus norvegicus
ctcactcttcttgggatcggtgaaa

SEQ ID NO: 264840 - DNA, 25 bp, Rattus norvegicus
ctcactcttgttagggagccagatg

SEQ ID NO: 264841 - DNA, 25 bp, Rattus norvegicus
ctcactcttgtttgggagccagatg

SEQ ID NO: 264842 - DNA, 25 bp, Rattus norvegicus
ctcactgaaattctagccccttagg

SEQ ID NO: 264843 - DNA, 25 bp, Rattus norvegicus
ctcactgaaattgtagccccttagg

SEQ ID NO: 264844 - DNA, 25 bp, Rattus norvegicus
ctcactgagcagaccttgggataaa

SEQ ID NO: 264845 - DNA, 25 bp, Rattus norvegicus
ctcactgagcagtccttgggataaa

SEQ ID NO: 264846 - DNA, 25 bp, Rattus norvegicus
ctcactgagcgacttggctaataac

SEQ ID NO: 264847 - DNA, 25 bp, Rattus norvegicus
ctcactgagcgagttggctaataac

SEQ ID NO: 264848 - DNA, 25 bp, Rattus norvegicus
ctcactgagggaccacgggcttaac

SEQ ID NO: 264849 - DNA, 25 bp, Rattus norvegicus
ctcactgagggagcacgggcttaac

SEQ ID NO: 264850 - DNA, 25 bp, Rattus norvegicus
ctcactgagtccacatgtctgcggc

SEQ ID NO: 264851 - DNA, 25 bp, Rattus norvegicus
ctcactgagtcctcatgtctgcggc

SEQ ID NO: 264852 - DNA, 25 bp, Rattus norvegicus
ctcactgagttacttcttcgcctct

SEQ ID NO: 264853 - DNA, 25 bp, Rattus norvegicus
ctcactgagttagttcttcgcctct

SEQ ID NO: 264854 - DNA, 25 bp, Rattus norvegicus
ctcactgagttgatcgactactatg

SEQ ID NO: 264855 - DNA, 25 bp, Rattus norvegicus
ctcactgagttgttcgactactatg

SEQ ID NO: 264856 - DNA, 25 bp, Rattus norvegicus
ctcactgatgagcagctacggcaat

SEQ ID NO: 264857 - DNA, 25 bp, Rattus norvegicus
ctcactgatgaggagctacggcaat

SEQ ID NO: 264858 - DNA, 25 bp, Rattus norvegicus
ctcactgcctacctgttgatatatt

SEQ ID NO: 264859 - DNA, 25 bp, Rattus norvegicus
ctcactgcctacgtgttgatatatt

SEQ ID NO: 264860 - DNA, 25 bp, Rattus norvegicus
ctcactgctgtcatgaactgacttt

SEQ ID NO: 264861 - DNA, 25 bp, Rattus norvegicus
ctcactgctgtcttgaactgacttt

SEQ ID NO: 264862 - DNA, 25 bp, Rattus norvegicus
ctcactgggatacctcatggcacta

SEQ ID NO: 264863 - DNA, 25 bp, Rattus norvegicus
ctcactgggatagctcatggcacta

SEQ ID NO: 264864 - DNA, 25 bp, Rattus norvegicus
ctcactggttatctttgcaaagctg

SEQ ID NO: 264865 - DNA, 25 bp, Rattus norvegicus
ctcactggttatgtttgcaaagctg

SEQ ID NO: 264866 - DNA, 25 bp, Rattus norvegicus
ctcactggttcactccttgtgtgga

SEQ ID NO: 264867 - DNA, 25 bp, Rattus norvegicus
ctcactggttcagtccttgtgtgga

SEQ ID NO: 264868 - DNA, 25 bp, Rattus norvegicus
ctcactgtagttctcggccagggac

SEQ ID NO: 264869 - DNA, 25 bp, Rattus norvegicus
ctcactgtagttgtcggccagggac

SEQ ID NO: 264870 - DNA, 25 bp, Rattus norvegicus
ctcactgtccaacatgcgctcataa

SEQ ID NO: 264871 - DNA, 25 bp, Rattus norvegicus
ctcactgtccaagatgcgctcataa

SEQ ID NO: 264872 - DNA, 25 bp, Rattus norvegicus
ctcactgtctggaggtcacattgga

SEQ ID NO: 264873 - DNA, 25 bp, Rattus norvegicus
ctcactgtctggtggtcacattgga

SEQ ID NO: 264874 - DNA, 25 bp, Rattus norvegicus
ctcactgtgaggactccagaggaca

SEQ ID NO: 264875 - DNA, 25 bp, Rattus norvegicus
ctcactgtgaggtctccagaggaca

SEQ ID NO: 264876 - DNA, 25 bp, Rattus norvegicus
ctcactgtgcctacagacagagtgg

SEQ ID NO: 264877 - DNA, 25 bp, Rattus norvegicus
ctcactgtgccttcagacagagtgg

SEQ ID NO: 264878 - DNA, 25 bp, Rattus norvegicus
ctcactgtgctcaatctgtaacact

SEQ ID NO: 264879 - DNA, 25 bp, Rattus norvegicus
ctcactgtgctctatctgtaacact

SEQ ID NO: 264880 - DNA, 25 bp, Rattus norvegicus
ctcactgtgggcagaaccaggacct

SEQ ID NO: 264881 - DNA, 25 bp, Rattus norvegicus
ctcactgtgggctgaaccaggacct

SEQ ID NO: 264882 - DNA, 25 bp, Rattus norvegicus
ctcactgtggtgcttttatcctttc

SEQ ID NO: 264883 - DNA, 25 bp, Rattus norvegicus
ctcactgtggtggttttatcctttc

SEQ ID NO: 264884 - DNA, 25 bp, Rattus norvegicus
ctcactgtgtgcatattccttgtaa

SEQ ID NO: 264885 - DNA, 25 bp, Rattus norvegicus
ctcactgtgtgcttattccttgtaa

SEQ ID NO: 264886 - DNA, 25 bp, Rattus norvegicus
ctcactgtgtttcattgtttcctac

SEQ ID NO: 264887 - DNA, 25 bp, Rattus norvegicus
ctcactgtgtttgattgtttcctac

SEQ ID NO: 264888 - DNA, 25 bp, Rattus norvegicus
ctcactgttgtcctatgctttggat

SEQ ID NO: 264889 - DNA, 25 bp, Rattus norvegicus
ctcactgttgtcgtatgctttggat

SEQ ID NO: 264890 - DNA, 25 bp, Rattus norvegicus
ctcactgttgtgctttgttcctgaa

SEQ ID NO: 264891 - DNA, 25 bp, Rattus norvegicus
ctcactgttgtggtttgttcctgaa

SEQ ID NO: 264892 - DNA, 25 bp, Rattus norvegicus
ctcactgttttcatacctgtcccag

SEQ ID NO: 264893 - DNA, 25 bp, Rattus norvegicus
ctcactgttttcttacctgtcccag

SEQ ID NO: 264894 - DNA, 25 bp, Rattus norvegicus
ctcacttacgcacgaccacatgtag

SEQ ID NO: 264895 - DNA, 25 bp, Rattus norvegicus
ctcacttacgcaggaccacatgtag

SEQ ID NO: 264896 - DNA, 25 bp, Rattus norvegicus
ctcacttagattatgttcccacttg

SEQ ID NO: 264897 - DNA, 25 bp, Rattus norvegicus
ctcacttagattttgttcccacttg

SEQ ID NO: 264898 - DNA, 25 bp, Rattus norvegicus
ctcacttcaggaaaagccgcacttt

SEQ ID NO: 264899 - DNA, 25 bp, Rattus norvegicus
ctcacttcaggataagccgcacttt

SEQ ID NO: 264900 - DNA, 25 bp, Rattus norvegicus
ctcacttctaacactaggatgccac

SEQ ID NO: 264901 - DNA, 25 bp, Rattus norvegicus
ctcacttctaactctaggatgccac

SEQ ID NO: 264902 - DNA, 25 bp, Rattus norvegicus
ctcacttctcagcacggcaaatatt

SEQ ID NO: 264903 - DNA, 25 bp, Rattus norvegicus
ctcacttctcaggacggcaaatatt

SEQ ID NO: 264904 - DNA, 25 bp, Rattus norvegicus
ctcacttctcttaggctgcggttta

SEQ ID NO: 264905 - DNA, 25 bp, Rattus norvegicus
ctcacttctctttggctgcggttta

SEQ ID NO: 264906 - DNA, 25 bp, Rattus norvegicus
ctcacttgatgtctcctggaagcag

SEQ ID NO: 264907 - DNA, 25 bp, Rattus norvegicus
ctcacttgatgtgtcctggaagcag

SEQ ID NO: 264908 - DNA, 25 bp, Rattus norvegicus
ctcacttgctaccattttcctataa

SEQ ID NO: 264909 - DNA, 25 bp, Rattus norvegicus
ctcacttgctacgattttcctataa

SEQ ID NO: 264910 - DNA, 25 bp, Rattus norvegicus
ctcacttggtacagcagcggctgga

SEQ ID NO: 264911 - DNA, 25 bp, Rattus norvegicus
ctcacttggtactgcagcggctgga

SEQ ID NO: 264912 - DNA, 25 bp, Rattus norvegicus
ctcactttccttataatcccacaat

SEQ ID NO: 264913 - DNA, 25 bp, Rattus norvegicus
ctcactttccttttaatcccacaat

SEQ ID NO: 264914 - DNA, 25 bp, Rattus norvegicus
ctcactttctaaacccgatgcataa

SEQ ID NO: 264915 - DNA, 25 bp, Rattus norvegicus
ctcactttctaatcccgatgcataa

SEQ ID NO: 264916 - DNA, 25 bp, Rattus norvegicus
ctcagaaaagtcagcagtaagtgca

SEQ ID NO: 264917 - DNA, 25 bp, Rattus norvegicus
ctcagaaaagtctgcagtaagtgca

SEQ ID NO: 264918 - DNA, 25 bp, Rattus norvegicus
ctcagaaagtgcaagagagctggaa

SEQ ID NO: 264919 - DNA, 25 bp, Rattus norvegicus
ctcagaaagtgctagagagctggaa

SEQ ID NO: 264920 - DNA, 25 bp, Rattus norvegicus
ctcagaacatgacgcccgggtcatc

SEQ ID NO: 264921 - DNA, 25 bp, Rattus norvegicus
ctcagaacatgaggcccgggtcatc

SEQ ID NO: 264922 - DNA, 25 bp, Rattus norvegicus
ctcagaaccgagatcattgtcacct

SEQ ID NO: 264923 - DNA, 25 bp, Rattus norvegicus
ctcagaaccgagttcattgtcacct

SEQ ID NO: 264924 - DNA, 25 bp, Rattus norvegicus
ctcagaaccgccaggcaagcgggaa

SEQ ID NO: 264925 - DNA, 25 bp, Rattus norvegicus
ctcagaaccgcctggcaagcgggaa

SEQ ID NO: 264926 - DNA, 25 bp, Rattus norvegicus
ctcagaaccgggaggaaagcacaga

SEQ ID NO: 264927 - DNA, 25 bp, Rattus norvegicus
ctcagaaccgggtggaaagcacaga

SEQ ID NO: 264928 - DNA, 25 bp, Rattus norvegicus
ctcagaactgtgatcctccaaggag

SEQ ID NO: 264929 - DNA, 25 bp, Rattus norvegicus
ctcagaactgtgttcctccaaggag

SEQ ID NO: 264930 - DNA, 25 bp, Rattus norvegicus
ctcagaagatgacgcccaggacatg

SEQ ID NO: 264931 - DNA, 25 bp, Rattus norvegicus
ctcagaagatgaggcccaggacatg

SEQ ID NO: 264932 - DNA, 25 bp, Rattus norvegicus
ctcagaatgcataacggtggccact

SEQ ID NO: 264933 - DNA, 25 bp, Rattus norvegicus
ctcagaatgcattacggtggccact

SEQ ID NO: 264934 - DNA, 25 bp, Rattus norvegicus
ctcagaatgggaaggtgttgtcaca

SEQ ID NO: 264935 - DNA, 25 bp, Rattus norvegicus
ctcagaatgggatggtgttgtcaca

SEQ ID NO: 264936 - DNA, 25 bp, Rattus norvegicus
ctcagaatgtctctggtggccatgt

SEQ ID NO: 264937 - DNA, 25 bp, Rattus norvegicus
ctcagaatgtctgtggtggccatgt

SEQ ID NO: 264938 - DNA, 25 bp, Rattus norvegicus
ctcagacaatgtcaatccctccttt

SEQ ID NO: 264939 - DNA, 25 bp, Rattus norvegicus
ctcagacaatgtgaatccctccttt

SEQ ID NO: 264940 - DNA, 25 bp, Rattus norvegicus
ctcagacacagacagggtccctaaa

SEQ ID NO: 264941 - DNA, 25 bp, Rattus norvegicus
ctcagacacagagagggtccctaaa

SEQ ID NO: 264942 - DNA, 25 bp, Rattus norvegicus
ctcagacaccgaagagggctgattg

SEQ ID NO: 264943 - DNA, 25 bp, Rattus norvegicus
ctcagacaccgatgagggctgattg

SEQ ID NO: 264944 - DNA, 25 bp, Rattus norvegicus
ctcagacactccaatgagccatatt

SEQ ID NO: 264945 - DNA, 25 bp, Rattus norvegicus
ctcagacactcctatgagccatatt

SEQ ID NO: 264946 - DNA, 25 bp, Rattus norvegicus
ctcagacatgtcacacagcgaaagg

SEQ ID NO: 264947 - DNA, 25 bp, Rattus norvegicus
ctcagacatgtctcacagcgaaagg

SEQ ID NO: 264948 - DNA, 25 bp, Rattus norvegicus
ctcagacattgtattatgacgcatt

SEQ ID NO: 264949 - DNA, 25 bp, Rattus norvegicus
ctcagacattgttttatgacgcatt

SEQ ID NO: 264950 - DNA, 25 bp, Rattus norvegicus
ctcagaccacctaaagctctaatga

SEQ ID NO: 264951 - DNA, 25 bp, Rattus norvegicus
ctcagaccaccttaagctctaatga

SEQ ID NO: 264952 - DNA, 25 bp, Rattus norvegicus
ctcagaccgttcacatgaagcacag

SEQ ID NO: 264953 - DNA, 25 bp, Rattus norvegicus
ctcagaccgttctcatgaagcacag

SEQ ID NO: 264954 - DNA, 25 bp, Rattus norvegicus
ctcagacctctgatgctgttaacat

SEQ ID NO: 264955 - DNA, 25 bp, Rattus norvegicus
ctcagacctctgttgctgttaacat

SEQ ID NO: 264956 - DNA, 25 bp, Rattus norvegicus
ctcagacctgatacccagcaagaag

SEQ ID NO: 264957 - DNA, 25 bp, Rattus norvegicus
ctcagacctgattcccagcaagaag

SEQ ID NO: 264958 - DNA, 25 bp, Rattus norvegicus
ctcagactatttcaggacgtttgtt

SEQ ID NO: 264959 - DNA, 25 bp, Rattus norvegicus
ctcagactatttgaggacgtttgtt

SEQ ID NO: 264960 - DNA, 25 bp, Rattus norvegicus
ctcagactcagaagccgaccaggat

SEQ ID NO: 264961 - DNA, 25 bp, Rattus norvegicus
ctcagactcagatgccgaccaggat

SEQ ID NO: 264962 - DNA, 25 bp, Rattus norvegicus
ctcagactcctgcaatttgcagcat

SEQ ID NO: 264963 - DNA, 25 bp, Rattus norvegicus
ctcagactcctggaatttgcagcat

SEQ ID NO: 264964 - DNA, 25 bp, Rattus norvegicus
ctcagactgtgtcgccggtggacac

SEQ ID NO: 264965 - DNA, 25 bp, Rattus norvegicus
ctcagactgtgtggccggtggacac

SEQ ID NO: 264966 - DNA, 25 bp, Rattus norvegicus
ctcagacttgagattcacttttaca

SEQ ID NO: 264967 - DNA, 25 bp, Rattus norvegicus
ctcagacttgagtttcacttttaca

SEQ ID NO: 264968 - DNA, 25 bp, Rattus norvegicus
ctcagagaccttagtgcagcgtgta

SEQ ID NO: 264969 - DNA, 25 bp, Rattus norvegicus
ctcagagacctttgtgcagcgtgta

SEQ ID NO: 264970 - DNA, 25 bp, Rattus norvegicus
ctcagagagagccatgtccgaccgt

SEQ ID NO: 264971 - DNA, 25 bp, Rattus norvegicus
ctcagagagagcgatgtccgaccgt

SEQ ID NO: 264972 - DNA, 25 bp, Rattus norvegicus
ctcagagagtaccatgtcaagatag

SEQ ID NO: 264973 - DNA, 25 bp, Rattus norvegicus
ctcagagagtacgatgtcaagatag

SEQ ID NO: 264974 - DNA, 25 bp, Rattus norvegicus
ctcagagatctgattgcctaagaca

SEQ ID NO: 264975 - DNA, 25 bp, Rattus norvegicus
ctcagagatctgtttgcctaagaca

SEQ ID NO: 264976 - DNA, 25 bp, Rattus norvegicus
ctcagagcctacaggagttccgtgt

SEQ ID NO: 264977 - DNA, 25 bp, Rattus norvegicus
ctcagagcctactggagttccgtgt

SEQ ID NO: 264978 - DNA, 25 bp, Rattus norvegicus
ctcagagctgctcccaaatcagaaa

SEQ ID NO: 264979 - DNA, 25 bp, Rattus norvegicus
ctcagagctgctcggtgtggctaca

SEQ ID NO: 264980 - DNA, 25 bp, Rattus norvegicus
ctcagagctgctgccaaatcagaaa

SEQ ID NO: 264981 - DNA, 25 bp, Rattus norvegicus
ctcagagctgctgggtgtggctaca

SEQ ID NO: 264982 - DNA, 25 bp, Rattus norvegicus
ctcagaggccgtcggagcccggcag

SEQ ID NO: 264983 - DNA, 25 bp, Rattus norvegicus
ctcagaggccgtgggagcccggcag

SEQ ID NO: 264984 - DNA, 25 bp, Rattus norvegicus
ctcagagggtttaagggttacagct

SEQ ID NO: 264985 - DNA, 25 bp, Rattus norvegicus
ctcagagggttttagggttacagct

SEQ ID NO: 264986 - DNA, 25 bp, Rattus norvegicus
ctcagaggtcgcacggaagttgctg

SEQ ID NO: 264987 - DNA, 25 bp, Rattus norvegicus
ctcagaggtcgctcggaagttgctg

SEQ ID NO: 264988 - DNA, 25 bp, Rattus norvegicus
ctcagagtagctacttgcctgctga

SEQ ID NO: 264989 - DNA, 25 bp, Rattus norvegicus
ctcagagtagcttcttgcctgctga

SEQ ID NO: 264990 - DNA, 25 bp, Rattus norvegicus
ctcagagtggtgagcggctgcctca

SEQ ID NO: 264991 - DNA, 25 bp, Rattus norvegicus
ctcagagtggtgtgcggctgcctca

SEQ ID NO: 264992 - DNA, 25 bp, Rattus norvegicus
ctcagagtttgccaggttttccaga

SEQ ID NO: 264993 - DNA, 25 bp, Rattus norvegicus
ctcagagtttgcgaggttttccaga

SEQ ID NO: 264994 - DNA, 25 bp, Rattus norvegicus
ctcagatactggacgacctgggtat

SEQ ID NO: 264995 - DNA, 25 bp, Rattus norvegicus
ctcagatactggtcgacctgggtat

SEQ ID NO: 264996 - DNA, 25 bp, Rattus norvegicus
ctcagatagacccagctgttgaagg

SEQ ID NO: 264997 - DNA, 25 bp, Rattus norvegicus
ctcagatagaccgagctgttgaagg

SEQ ID NO: 264998 - DNA, 25 bp, Rattus norvegicus
ctcagatcggttcttgtcttttgca

SEQ ID NO: 264999 - DNA, 25 bp, Rattus norvegicus
ctcagatcggttgttgtcttttgca

SEQ ID NO: 265000 - DNA, 25 bp, Rattus norvegicus
ctcagatcttctctctcattcgata

SEQ ID NO: 265001 - DNA, 25 bp, Rattus norvegicus
ctcagatcttctgtctcattcgata

SEQ ID NO: 265002 - DNA, 25 bp, Rattus norvegicus
ctcagatgaggaccggccacgtcaa

SEQ ID NO: 265003 - DNA, 25 bp, Rattus norvegicus
ctcagatgaggagcggccacgtcaa

SEQ ID NO: 265004 - DNA, 25 bp, Rattus norvegicus
ctcagatgcgctagcctgtttgctg

SEQ ID NO: 265005 - DNA, 25 bp, Rattus norvegicus
ctcagatgcgcttgcctgtttgctg

SEQ ID NO: 265006 - DNA, 25 bp, Rattus norvegicus
ctcagatgctcaccttagggaggca

SEQ ID NO: 265007 - DNA, 25 bp, Rattus norvegicus
ctcagatgctcagcttagggaggca

SEQ ID NO: 265008 - DNA, 25 bp, Rattus norvegicus
ctcagatggagcacaggcagcctgt

SEQ ID NO: 265009 - DNA, 25 bp, Rattus norvegicus
ctcagatggagctcaggcagcctgt

SEQ ID NO: 265010 - DNA, 25 bp, Rattus norvegicus
ctcagatgggcaatgggcttggctc

SEQ ID NO: 265011 - DNA, 25 bp, Rattus norvegicus
ctcagatgggcattgggcttggctc

SEQ ID NO: 265012 - DNA, 25 bp, Rattus norvegicus
ctcagatgtcggatggtacgtccat

SEQ ID NO: 265013 - DNA, 25 bp, Rattus norvegicus
ctcagatgtcggttggtacgtccat

SEQ ID NO: 265014 - DNA, 25 bp, Rattus norvegicus
ctcagattcaaactcagtctggact

SEQ ID NO: 265015 - DNA, 25 bp, Rattus norvegicus
ctcagattcaaagtcagtctggact

SEQ ID NO: 265016 - DNA, 25 bp, Rattus norvegicus
ctcagattcctgctattgacttaat

SEQ ID NO: 265017 - DNA, 25 bp, Rattus norvegicus
ctcagattcctggtattgacttaat

SEQ ID NO: 265018 - DNA, 25 bp, Rattus norvegicus
ctcagattctgactttcctgtggaa

SEQ ID NO: 265019 - DNA, 25 bp, Rattus norvegicus
ctcagattctgagtttcctgtggaa

SEQ ID NO: 265020 - DNA, 25 bp, Rattus norvegicus
ctcagatttggcacttaagttgctt

SEQ ID NO: 265021 - DNA, 25 bp, Rattus norvegicus
ctcagatttggctcttaagttgctt

SEQ ID NO: 265022 - DNA, 25 bp, Rattus norvegicus
ctcagcaacgcgagacgtcaggaga

SEQ ID NO: 265023 - DNA, 25 bp, Rattus norvegicus
ctcagcaacgcgtgacgtcaggaga

SEQ ID NO: 265024 - DNA, 25 bp, Rattus norvegicus
ctcagcaatcagactatccatgttc

SEQ ID NO: 265025 - DNA, 25 bp, Rattus norvegicus
ctcagcaatcagtctatccatgttc

SEQ ID NO: 265026 - DNA, 25 bp, Rattus norvegicus
ctcagcaatgtcatgtttatttgtg

SEQ ID NO: 265027 - DNA, 25 bp, Rattus norvegicus
ctcagcaatgtcttgtttatttgtg

SEQ ID NO: 265028 - DNA, 25 bp, Rattus norvegicus
ctcagcacactgaattcctcagaag

SEQ ID NO: 265029 - DNA, 25 bp, Rattus norvegicus
ctcagcacactgtattcctcagaag

SEQ ID NO: 265030 - DNA, 25 bp, Rattus norvegicus
ctcagcacctgacgcagaggacgaa

SEQ ID NO: 265031 - DNA, 25 bp, Rattus norvegicus
ctcagcacctgaggcagaggacgaa

SEQ ID NO: 265032 - DNA, 25 bp, Rattus norvegicus
ctcagcacgggaatggaaagatggc

SEQ ID NO: 265033 - DNA, 25 bp, Rattus norvegicus
ctcagcacgggattggaaagatggc

SEQ ID NO: 265034 - DNA, 25 bp, Rattus norvegicus
ctcagcactcatactaaactagggt

SEQ ID NO: 265035 - DNA, 25 bp, Rattus norvegicus
ctcagcactcattctaaactagggt

SEQ ID NO: 265036 - DNA, 25 bp, Rattus norvegicus
ctcagcactgtgactggcgcagaag

SEQ ID NO: 265037 - DNA, 25 bp, Rattus norvegicus
ctcagcactgtgtctggcgcagaag

SEQ ID NO: 265038 - DNA, 25 bp, Rattus norvegicus
ctcagcagcagtaacatggtaacat

SEQ ID NO: 265039 - DNA, 25 bp, Rattus norvegicus
ctcagcagcagttacatggtaacat

SEQ ID NO: 265040 - DNA, 25 bp, Rattus norvegicus
ctcagcaggcctagttcacgatatg

SEQ ID NO: 265041 - DNA, 25 bp, Rattus norvegicus
ctcagcaggccttgttcacgatatg

SEQ ID NO: 265042 - DNA, 25 bp, Rattus norvegicus
ctcagcagtagacccctagtctagc

SEQ ID NO: 265043 - DNA, 25 bp, Rattus norvegicus
ctcagcagtagagccctagtctagc

SEQ ID NO: 265044 - DNA, 25 bp, Rattus norvegicus
ctcagcagtctcactatttaagcac

SEQ ID NO: 265045 - DNA, 25 bp, Rattus norvegicus
ctcagcagtctctctatttaagcac

SEQ ID NO: 265046 - DNA, 25 bp, Rattus norvegicus
ctcagcagttacctcatttgctcaa

SEQ ID NO: 265047 - DNA, 25 bp, Rattus norvegicus
ctcagcagttacgtcatttgctcaa

SEQ ID NO: 265048 - DNA, 25 bp, Rattus norvegicus
ctcagcatccttccactatgggtgt

SEQ ID NO: 265049 - DNA, 25 bp, Rattus norvegicus
ctcagcatccttgcactatgggtgt

SEQ ID NO: 265050 - DNA, 25 bp, Rattus norvegicus
ctcagcattgaacgcctctcaggag

SEQ ID NO: 265051 - DNA, 25 bp, Rattus norvegicus
ctcagcattgaaggcctctcaggag

SEQ ID NO: 265052 - DNA, 25 bp, Rattus norvegicus
ctcagcattgctcgcgatatgggtt

SEQ ID NO: 265053 - DNA, 25 bp, Rattus norvegicus
ctcagcattgctggcgatatgggtt

SEQ ID NO: 265054 - DNA, 25 bp, Rattus norvegicus
ctcagcatttagcagttagagactt

SEQ ID NO: 265055 - DNA, 25 bp, Rattus norvegicus
ctcagcatttaggagttagagactt

SEQ ID NO: 265056 - DNA, 25 bp, Rattus norvegicus
ctcagccacagacactcataacaga

SEQ ID NO: 265057 - DNA, 25 bp, Rattus norvegicus
ctcagccacagagactcataacaga

SEQ ID NO: 265058 - DNA, 25 bp, Rattus norvegicus
ctcagccactccacatgaaagatgg

SEQ ID NO: 265059 - DNA, 25 bp, Rattus norvegicus
ctcagccactcctcatgaaagatgg

SEQ ID NO: 265060 - DNA, 25 bp, Rattus norvegicus
ctcagccactctcgtgcaaacagga

SEQ ID NO: 265061 - DNA, 25 bp, Rattus norvegicus
ctcagccactctggtgcaaacagga

SEQ ID NO: 265062 - DNA, 25 bp, Rattus norvegicus
ctcagccagattcgatctcacttaa

SEQ ID NO: 265063 - DNA, 25 bp, Rattus norvegicus
ctcagccagattggatctcacttaa

SEQ ID NO: 265064 - DNA, 25 bp, Rattus norvegicus
ctcagccattggcaaacagttgtca

SEQ ID NO: 265065 - DNA, 25 bp, Rattus norvegicus
ctcagccattgggaaacagttgtca

SEQ ID NO: 265066 - DNA, 25 bp, Rattus norvegicus
ctcagcccatttactgttgctagaa

SEQ ID NO: 265067 - DNA, 25 bp, Rattus norvegicus
ctcagcccattttctgttgctagaa

SEQ ID NO: 265068 - DNA, 25 bp, Rattus norvegicus
ctcagcccctttcaggatggtggct

SEQ ID NO: 265069 - DNA, 25 bp, Rattus norvegicus
ctcagcccctttgaggatggtggct

SEQ ID NO: 265070 - DNA, 25 bp, Rattus norvegicus
ctcagccctaacacttgtacataga

SEQ ID NO: 265071 - DNA, 25 bp, Rattus norvegicus
ctcagccctaactcttgtacataga

SEQ ID NO: 265072 - DNA, 25 bp, Rattus norvegicus
ctcagccgcagacagagctcagttt

SEQ ID NO: 265073 - DNA, 25 bp, Rattus norvegicus
ctcagccgcagagagagctcagttt

SEQ ID NO: 265074 - DNA, 25 bp, Rattus norvegicus
ctcagccgtggaagcagctgtgctt

SEQ ID NO: 265075 - DNA, 25 bp, Rattus norvegicus
ctcagccgtggatgcagctgtgctt

SEQ ID NO: 265076 - DNA, 25 bp, Rattus norvegicus
ctcagcctaaagctgcaggagctgc

SEQ ID NO: 265077 - DNA, 25 bp, Rattus norvegicus
ctcagcctaaaggtgcaggagctgc

SEQ ID NO: 265078 - DNA, 25 bp, Rattus norvegicus
ctcagcctatttctgatccttctag

SEQ ID NO: 265079 - DNA, 25 bp, Rattus norvegicus
ctcagcctatttgtgatccttctag

SEQ ID NO: 265080 - DNA, 25 bp, Rattus norvegicus
ctcagcctcccaaagagtgggcaaa

SEQ ID NO: 265081 - DNA, 25 bp, Rattus norvegicus
ctcagcctcccatagagtgggcaaa

SEQ ID NO: 265082 - DNA, 25 bp, Rattus norvegicus
ctcagcctctcaagtgtctgggatc

SEQ ID NO: 265083 - DNA, 25 bp, Rattus norvegicus
ctcagcctctcatgtgtctgggatc

SEQ ID NO: 265084 - DNA, 25 bp, Rattus norvegicus
ctcagcctctccatagtaagggtta

SEQ ID NO: 265085 - DNA, 25 bp, Rattus norvegicus
ctcagcctctccttagtaagggtta

SEQ ID NO: 265086 - DNA, 25 bp, Rattus norvegicus
ctcagcctgaggcattcgcagataa

SEQ ID NO: 265087 - DNA, 25 bp, Rattus norvegicus
ctcagcctgagggattcgcagataa

SEQ ID NO: 265088 - DNA, 25 bp, Rattus norvegicus
ctcagcctgcacaggagcaggtctg

SEQ ID NO: 265089 - DNA, 25 bp, Rattus norvegicus
ctcagcctgcactggagcaggtctg

SEQ ID NO: 265090 - DNA, 25 bp, Rattus norvegicus
ctcagcctggtgactgggaggattc

SEQ ID NO: 265091 - DNA, 25 bp, Rattus norvegicus
ctcagcctggtgtctgggaggattc

SEQ ID NO: 265092 - DNA, 25 bp, Rattus norvegicus
ctcagcctgtgaaagaccattggta

SEQ ID NO: 265093 - DNA, 25 bp, Rattus norvegicus
ctcagcctgtgatagaccattggta

SEQ ID NO: 265094 - DNA, 25 bp, Rattus norvegicus
ctcagcctgtggaaactccagtgaa

SEQ ID NO: 265095 - DNA, 25 bp, Rattus norvegicus
ctcagcctgtggtaactccagtgaa

SEQ ID NO: 265096 - DNA, 25 bp, Rattus norvegicus
ctcagcctgtgtccgattcgtataa

SEQ ID NO: 265097 - DNA, 25 bp, Rattus norvegicus
ctcagcctgtgtgcgattcgtataa

SEQ ID NO: 265098 - DNA, 25 bp, Rattus norvegicus
ctcagccttaggataaaccatggta

SEQ ID NO: 265099 - DNA, 25 bp, Rattus norvegicus
ctcagccttaggttaaaccatggta

SEQ ID NO: 265100 - DNA, 25 bp, Rattus norvegicus
ctcagccttcagagcagatgacctg

SEQ ID NO: 265101 - DNA, 25 bp, Rattus norvegicus
ctcagccttcagtgcagatgacctg

SEQ ID NO: 265102 - DNA, 25 bp, Rattus norvegicus
ctcagccttggtactggcagtagtt

SEQ ID NO: 265103 - DNA, 25 bp, Rattus norvegicus
ctcagccttggttctggcagtagtt

SEQ ID NO: 265104 - DNA, 25 bp, Rattus norvegicus
ctcagcctttcaaagctaccttaaa

SEQ ID NO: 265105 - DNA, 25 bp, Rattus norvegicus
ctcagcctttcatagctaccttaaa

SEQ ID NO: 265106 - DNA, 25 bp, Rattus norvegicus
ctcagcctttctcggttgggtatgt

SEQ ID NO: 265107 - DNA, 25 bp, Rattus norvegicus
ctcagcctttctgggttgggtatgt

SEQ ID NO: 265108 - DNA, 25 bp, Rattus norvegicus
ctcagcgatagccttcataccaaaa

SEQ ID NO: 265109 - DNA, 25 bp, Rattus norvegicus
ctcagcgatagcgttcataccaaaa

SEQ ID NO: 265110 - DNA, 25 bp, Rattus norvegicus
ctcagcgctgagaaagcattcggtt

SEQ ID NO: 265111 - DNA, 25 bp, Rattus norvegicus
ctcagcgctgagtaagcattcggtt

SEQ ID NO: 265112 - DNA, 25 bp, Rattus norvegicus
ctcagcgctgggattagggcacaca

SEQ ID NO: 265113 - DNA, 25 bp, Rattus norvegicus
ctcagcgctgggtttagggcacaca

SEQ ID NO: 265114 - DNA, 25 bp, Rattus norvegicus
ctcagcggatccattgtacacaggg

SEQ ID NO: 265115 - DNA, 25 bp, Rattus norvegicus
ctcagcggatcctttgtacacaggg

SEQ ID NO: 265116 - DNA, 25 bp, Rattus norvegicus
ctcagcgggctgaggaactatgttt

SEQ ID NO: 265117 - DNA, 25 bp, Rattus norvegicus
ctcagcgggctgtggaactatgttt

SEQ ID NO: 265118 - DNA, 25 bp, Rattus norvegicus
ctcagcgtaatcatccatggactac

SEQ ID NO: 265119 - DNA, 25 bp, Rattus norvegicus
ctcagcgtaatcttccatggactac

SEQ ID NO: 265120 - DNA, 25 bp, Rattus norvegicus
ctcagctacatgcttagggcccagc

SEQ ID NO: 265121 - DNA, 25 bp, Rattus norvegicus
ctcagctacatggttagggcccagc

SEQ ID NO: 265122 - DNA, 25 bp, Rattus norvegicus
ctcagctacctgcttgcaaacattt

SEQ ID NO: 265123 - DNA, 25 bp, Rattus norvegicus
ctcagctacctggttgcaaacattt

SEQ ID NO: 265124 - DNA, 25 bp, Rattus norvegicus
ctcagctagaaccatgaaggctaat

SEQ ID NO: 265125 - DNA, 25 bp, Rattus norvegicus
ctcagctagaacgatgaaggctaat

SEQ ID NO: 265126 - DNA, 25 bp, Rattus norvegicus
ctcagctagagccatcattgtttta

SEQ ID NO: 265127 - DNA, 25 bp, Rattus norvegicus
ctcagctagagcgatcattgtttta

SEQ ID NO: 265128 - DNA, 25 bp, Rattus norvegicus
ctcagctagctgagtgtacttcata

SEQ ID NO: 265129 - DNA, 25 bp, Rattus norvegicus
ctcagctagctgtgtgtacttcata

SEQ ID NO: 265130 - DNA, 25 bp, Rattus norvegicus
ctcagctatgagcagagactctggt

SEQ ID NO: 265131 - DNA, 25 bp, Rattus norvegicus
ctcagctatgaggagagactctggt

SEQ ID NO: 265132 - DNA, 25 bp, Rattus norvegicus
ctcagctatgccatagcacagggat

SEQ ID NO: 265133 - DNA, 25 bp, Rattus norvegicus
ctcagctatgccttagcacagggat

SEQ ID NO: 265134 - DNA, 25 bp, Rattus norvegicus
ctcagctcaactctttcctgaagaa

SEQ ID NO: 265135 - DNA, 25 bp, Rattus norvegicus
ctcagctcaactgtttcctgaagaa

SEQ ID NO: 265136 - DNA, 25 bp, Rattus norvegicus
ctcagctcactgcaaaggtaatggg

SEQ ID NO: 265137 - DNA, 25 bp, Rattus norvegicus
ctcagctcactggaaaggtaatggg

SEQ ID NO: 265138 - DNA, 25 bp, Rattus norvegicus
ctcagctcagcccttgaaggacagg

SEQ ID NO: 265139 - DNA, 25 bp, Rattus norvegicus
ctcagctcagccgttgaaggacagg

SEQ ID NO: 265140 - DNA, 25 bp, Rattus norvegicus
ctcagctcagcgaatacctggttaa

SEQ ID NO: 265141 - DNA, 25 bp, Rattus norvegicus
ctcagctcagcgtatacctggttaa

SEQ ID NO: 265142 - DNA, 25 bp, Rattus norvegicus
ctcagctcagctatgtacactaact

SEQ ID NO: 265143 - DNA, 25 bp, Rattus norvegicus
ctcagctcagctttgtacactaact

SEQ ID NO: 265144 - DNA, 25 bp, Rattus norvegicus
ctcagctccaggagactgggagagt

SEQ ID NO: 265145 - DNA, 25 bp, Rattus norvegicus
ctcagctccaggtgactgggagagt

SEQ ID NO: 265146 - DNA, 25 bp, Rattus norvegicus
ctcagctccataacttttacattcc

SEQ ID NO: 265147 - DNA, 25 bp, Rattus norvegicus
ctcagctccatatcttttacattcc

SEQ ID NO: 265148 - DNA, 25 bp, Rattus norvegicus
ctcagctccctactgatttcttaat

SEQ ID NO: 265149 - DNA, 25 bp, Rattus norvegicus
ctcagctccctagtgatttcttaat

SEQ ID NO: 265150 - DNA, 25 bp, Rattus norvegicus
ctcagctccggactgtcattatagg

SEQ ID NO: 265151 - DNA, 25 bp, Rattus norvegicus
ctcagctccggagtgtcattatagg

SEQ ID NO: 265152 - DNA, 25 bp, Rattus norvegicus
ctcagctcctgcatgttgcaaagag

SEQ ID NO: 265153 - DNA, 25 bp, Rattus norvegicus
ctcagctcctgcttgttgcaaagag

SEQ ID NO: 265154 - DNA, 25 bp, Rattus norvegicus
ctcagctcgggaattcgacttgtta

SEQ ID NO: 265155 - DNA, 25 bp, Rattus norvegicus
ctcagctcgggatttcgacttgtta

SEQ ID NO: 265156 - DNA, 25 bp, Rattus norvegicus
ctcagctgaatactaacgggccaaa

SEQ ID NO: 265157 - DNA, 25 bp, Rattus norvegicus
ctcagctgaatagtaacgggccaaa

SEQ ID NO: 265158 - DNA, 25 bp, Rattus norvegicus
ctcagctgagagactattcgtggtg

SEQ ID NO: 265159 - DNA, 25 bp, Rattus norvegicus
ctcagctgagagtctattcgtggtg

SEQ ID NO: 265160 - DNA, 25 bp, Rattus norvegicus
ctcagctgatttagcctcacagaga

SEQ ID NO: 265161 - DNA, 25 bp, Rattus norvegicus
ctcagctgattttgcctcacagaga

SEQ ID NO: 265162 - DNA, 25 bp, Rattus norvegicus
ctcagctgcttcattgaaacttctt

SEQ ID NO: 265163 - DNA, 25 bp, Rattus norvegicus
ctcagctgcttctttgaaacttctt

SEQ ID NO: 265164 - DNA, 25 bp, Rattus norvegicus
ctcagctgtcaaaccactggtatat

SEQ ID NO: 265165 - DNA, 25 bp, Rattus norvegicus
ctcagctgtcaatccactggtatat

SEQ ID NO: 265166 - DNA, 25 bp, Rattus norvegicus
ctcagctgtcttcatctaatgcagc

SEQ ID NO: 265167 - DNA, 25 bp, Rattus norvegicus
ctcagctgtcttgatctaatgcagc

SEQ ID NO: 265168 - DNA, 25 bp, Rattus norvegicus
ctcagctgtgggaccctgggagctt

SEQ ID NO: 265169 - DNA, 25 bp, Rattus norvegicus
ctcagctgtgggtccctgggagctt

SEQ ID NO: 265170 - DNA, 25 bp, Rattus norvegicus
ctcagcttacctatcatacttcatg

SEQ ID NO: 265171 - DNA, 25 bp, Rattus norvegicus
ctcagcttacctttcatacttcatg

SEQ ID NO: 265172 - DNA, 25 bp, Rattus norvegicus
ctcagcttatttatctgttaggtaa
